United States Patent 8,084,598 (BIOIONFORMALITY DETECTABLE GROUP OF NOVEL REGULATORY OLIGONUCLEOTIDES AND USES THEREOF) - sequence listing, part 2

SEQ ID NO: 41376 - RNA, 20 nt, Human
uagauacaaucagcugcuuu

SEQ ID NO: 41377 - RNA, 21 nt, Human
uuugggaaggaacacuaaaga

SEQ ID NO: 41378 - RNA, 24 nt, Human
gcccccagccuguagggaacuuuc

SEQ ID NO: 41379 - RNA, 22 nt, Human
uggguguccuguauuucaucug

SEQ ID NO: 41380 - RNA, 20 nt, Human
aucucugagugucucugccu

SEQ ID NO: 41381 - RNA, 22 nt, Human
cuuguccaggcuggagugcaau

SEQ ID NO: 41382 - RNA, 24 nt, Human
ccagaacauuucccuaaccccaac

SEQ ID NO: 41383 - RNA, 21 nt, Human
cacucaggcuggagcacagug

SEQ ID NO: 41384 - RNA, 19 nt, Human
caguauccuuuuuucuccu

SEQ ID NO: 41385 - RNA, 23 nt, Human
cauguugagugugccuaauacuc

SEQ ID NO: 41386 - RNA, 21 nt, Human
gaggucagggagugcuggcuc

SEQ ID NO: 41387 - RNA, 24 nt, Human
auuccugagcaagauagucuggga

SEQ ID NO: 41388 - RNA, 20 nt, Human
uccuggccuugcugaccuca

SEQ ID NO: 41389 - RNA, 21 nt, Human
agagaauacuucuaaggacag

SEQ ID NO: 41390 - RNA, 24 nt, Human
cccacacaacaggcuuauuuucug

SEQ ID NO: 41391 - RNA, 22 nt, Human
cauuuacuuuuaaaaaccuaua

SEQ ID NO: 41392 - RNA, 21 nt, Human
ucagccgccucagucgccuca

SEQ ID NO: 41393 - RNA, 20 nt, Human
uucugcccugcccucagccu

SEQ ID NO: 41394 - RNA, 20 nt, Human
gcugggaucuucugccacca

SEQ ID NO: 41395 - RNA, 25 nt, Human
caguugccuguaauccuagcuacuc

SEQ ID NO: 41396 - RNA, 22 nt, Human
ccaucuaggaaagauauggaug

SEQ ID NO: 41397 - RNA, 27 nt, Human
auaaagugaauuuuauuuaaagcuaaa

SEQ ID NO: 41398 - RNA, 24 nt, Human
cccuggaaggagaagcaccaccuu

SEQ ID NO: 41399 - RNA, 25 nt, Human
gcacaggccaucucagcuugguugc

SEQ ID NO: 41400 - RNA, 21 nt, Human
cgccaacauggugaaaccgua

SEQ ID NO: 41401 - RNA, 26 nt, Human
gagcauauggguccagccacucagaa

SEQ ID NO: 41402 - RNA, 21 nt, Human
uguucugcuuuuuucauuguu

SEQ ID NO: 41403 - RNA, 20 nt, Human
uacuacugauaacugagcca

SEQ ID NO: 41404 - RNA, 23 nt, Human
agcuaguguuuugacaaugcuuu

SEQ ID NO: 41405 - RNA, 20 nt, Human
agccuugagggcuggcagaa

SEQ ID NO: 41406 - RNA, 20 nt, Human
gaacagucuuacauuuuucu

SEQ ID NO: 41407 - RNA, 25 nt, Human
ucagucgcugucucuuuucugugau

SEQ ID NO: 41408 - RNA, 26 nt, Human
ugcccacacaacaggcuuauuuucug

SEQ ID NO: 41409 - RNA, 22 nt, Human
cccaggcccagccucuuguucu

SEQ ID NO: 41410 - RNA, 18 nt, Human
ucaugaucucccucuaag

SEQ ID NO: 41411 - RNA, 23 nt, Human
uugguuagagccaagauagcucc

SEQ ID NO: 41412 - RNA, 23 nt, Human
ccaaacuggcaggggggccaggc

SEQ ID NO: 41413 - RNA, 25 nt, Human
ugguggcgggcgccuguaaucccag

SEQ ID NO: 41414 - RNA, 25 nt, Human
ugguggcaggcgccuauaaucccag

SEQ ID NO: 41415 - RNA, 20 nt, Human
cuccugggccuggcuuggcu

SEQ ID NO: 41416 - RNA, 21 nt, Human
ccuuagcccaacaccaggguc

SEQ ID NO: 41417 - RNA, 27 nt, Human
uucaacaaauggcaccgagacaaugau

SEQ ID NO: 41418 - RNA, 26 nt, Human
gggaggcccucaccuuccagagagga

SEQ ID NO: 41419 - RNA, 27 nt, Human
uugcccagcuuuccuggcaauugacuu

SEQ ID NO: 41420 - RNA, 25 nt, Human
uucacaguguugauugcuauuagca

SEQ ID NO: 41421 - RNA, 21 nt, Human
gagccuaaauuuacucugcuu

SEQ ID NO: 41422 - RNA, 21 nt, Human
acuucuauaagagcgugacuu

SEQ ID NO: 41423 - RNA, 22 nt, Human
gaccagccuaaacaacauagug

SEQ ID NO: 41424 - RNA, 22 nt, Human
ggagauuuggccugggaguuug

SEQ ID NO: 41425 - RNA, 24 nt, Human
cuggagcaugcagaggaggugaga

SEQ ID NO: 41426 - RNA, 23 nt, Human
aaccuuggggccagcaucuccca

SEQ ID NO: 41427 - RNA, 19 nt, Human
cuccuuggagcuaugagau

SEQ ID NO: 41428 - RNA, 25 nt, Human
gcagagggaaaugggaggucuaagg

SEQ ID NO: 41429 - RNA, 22 nt, Human
caggaaggaaggaggccaucug

SEQ ID NO: 41430 - RNA, 21 nt, Human
ccaaaacaaaguaauagcgcc

SEQ ID NO: 41431 - RNA, 24 nt, Human
cccacaugccgugacucuggacua

SEQ ID NO: 41432 - RNA, 28 nt, Human
ugaggcagaagcauugcuugagcuuggg

SEQ ID NO: 41433 - RNA, 29 nt, Human
ugcaauuuuauuaaaugcaucaauaugua

SEQ ID NO: 41434 - RNA, 22 nt, Human
guugugcaggcuggagugcagu

SEQ ID NO: 41435 - RNA, 21 nt, Human
ucaguagauaggaaaccaguu

SEQ ID NO: 41436 - RNA, 24 nt, Human
cuuacuauucacacagccugccga

SEQ ID NO: 41437 - RNA, 21 nt, Human
cuggaaagaacaacuggcagg

SEQ ID NO: 41438 - RNA, 22 nt, Human
cccuguggggccugauggugcu

SEQ ID NO: 41439 - RNA, 24 nt, Human
aaaucagcuuuguaacuguuuuca

SEQ ID NO: 41440 - RNA, 22 nt, Human
ucugguggaacaaagaaauacc

SEQ ID NO: 41441 - RNA, 24 nt, Human
ggguugugacacaccagcccaggu

SEQ ID NO: 41442 - RNA, 23 nt, Human
gcaguuggagaccagucugggca

SEQ ID NO: 41443 - RNA, 19 nt, Human
agccucuccaagcucaagu

SEQ ID NO: 41444 - RNA, 22 nt, Human
uuugcugucuguaucccuugga

SEQ ID NO: 41445 - RNA, 22 nt, Human
gggaagcagagucugcagugag

SEQ ID NO: 41446 - RNA, 21 nt, Human
ucaggcugacugcuuugccau

SEQ ID NO: 41447 - RNA, 20 nt, Human
uuaacaauaccucaaacuuu

SEQ ID NO: 41448 - RNA, 31 nt, Human
gugggagaauugcuugaggccaggaguuuga

SEQ ID NO: 41449 - RNA, 18 nt, Human
ugguauacuccagggauu

SEQ ID NO: 41450 - RNA, 23 nt, Human
uugugauggcggggcagggagcc

SEQ ID NO: 41451 - RNA, 18 nt, Human
caggcagcccugccaugu

SEQ ID NO: 41452 - RNA, 21 nt, Human
cugagcucuuuagcauugaag

SEQ ID NO: 41453 - RNA, 27 nt, Human
cagcagccaccuguggguauuuaugag

SEQ ID NO: 41454 - RNA, 27 nt, Human
guguaaaccuggcuguagccgcauaug

SEQ ID NO: 41455 - RNA, 25 nt, Human
guguaucucaccagguagcugucag

SEQ ID NO: 41456 - RNA, 22 nt, Human
gugaucaagguucacugaagcc

SEQ ID NO: 41457 - RNA, 21 nt, Human
aggcccuggcccugcuggggc

SEQ ID NO: 41458 - RNA, 27 nt, Human
cucuccaggaagguagcccagcacugu

SEQ ID NO: 41459 - RNA, 23 nt, Human
gggccuuuguaugagcugcauug

SEQ ID NO: 41460 - RNA, 24 nt, Human
cccagcuggaguaggagcgcggac

SEQ ID NO: 41461 - RNA, 22 nt, Human
ccauuuucuccauaaauuugua

SEQ ID NO: 41462 - RNA, 12 nt, Human
accaaugccuuu

SEQ ID NO: 41463 - RNA, 21 nt, Human
cuccccggagugcacagcucc

SEQ ID NO: 41464 - RNA, 21 nt, Human
ucucaaauccugugacuggga

SEQ ID NO: 41465 - RNA, 21 nt, Human
uaaagugcugggauuacaggu

SEQ ID NO: 41466 - RNA, 22 nt, Human
gccacuaagcagaggaggggcc

SEQ ID NO: 41467 - RNA, 22 nt, Human
gucagcacucaucuccuccucc

SEQ ID NO: 41468 - RNA, 23 nt, Human
ugcacacaacguuucacaaaauc

SEQ ID NO: 41469 - RNA, 22 nt, Human
cgccagcccagcccagcccagc

SEQ ID NO: 41470 - RNA, 27 nt, Human
cugugugaccuuggguaagucccuuga

SEQ ID NO: 41471 - RNA, 18 nt, Human
ccuccuccuccuccuggc

SEQ ID NO: 41472 - RNA, 24 nt, Human
accacuccgggcuaauuuuugugu

SEQ ID NO: 41473 - RNA, 27 nt, Human
cccacaccccuccuugcuggaaugugu

SEQ ID NO: 41474 - RNA, 22 nt, Human
aacaugggcagccugugaccgg

SEQ ID NO: 41475 - RNA, 21 nt, Human
aaagaauuucaaaaauggcua

SEQ ID NO: 41476 - RNA, 22 nt, Human
cagcccaggcuggagugcagug

SEQ ID NO: 41477 - RNA, 22 nt, Human
aaccaggcuguccaggaauggc

SEQ ID NO: 41478 - RNA, 25 nt, Human
uguuucuaauuaauuugcuuaauuc

SEQ ID NO: 41479 - RNA, 22 nt, Human
aucauguuuuuaugcuuccaua

SEQ ID NO: 41480 - RNA, 24 nt, Human
guugcucagugccuggauugcagg

SEQ ID NO: 41481 - RNA, 26 nt, Human
ugcugcuucccagccuggcuuccccg

SEQ ID NO: 41482 - RNA, 26 nt, Human
ccuuggggcucccugugucagggcac

SEQ ID NO: 41483 - RNA, 23 nt, Human
uucacacacuuuucuugcguacu

SEQ ID NO: 41484 - RNA, 24 nt, Human
cacaugcucaucccaaaagcuaga

SEQ ID NO: 41485 - RNA, 26 nt, Human
uuuucuuugcugaauuugauggaugu

SEQ ID NO: 41486 - RNA, 22 nt, Human
agggcuucaggcugggggcagu

SEQ ID NO: 41487 - RNA, 28 nt, Human
ggagagugaugugagggagcugugugac

SEQ ID NO: 41488 - RNA, 26 nt, Human
acaucaacauggaguccaaguaauga

SEQ ID NO: 41489 - RNA, 20 nt, Human
cugucuccuggcccucucuc

SEQ ID NO: 41490 - RNA, 27 nt, Human
cgcagcccagcccggaggccgguaccc

SEQ ID NO: 41491 - RNA, 22 nt, Human
uagcugagggguaagagguugu

SEQ ID NO: 41492 - RNA, 21 nt, Human
cccacagacucaaaguuacuc

SEQ ID NO: 41493 - RNA, 25 nt, Human
ggggugagagaccugcucaggcguc

SEQ ID NO: 41494 - RNA, 19 nt, Human
guucaggagauucuaaauu

SEQ ID NO: 41495 - RNA, 18 nt, Human
cggcagcugcuucacccc

SEQ ID NO: 41496 - RNA, 26 nt, Human
ugcucacacccccaccugcauuuuga

SEQ ID NO: 41497 - RNA, 22 nt, Human
cgguagccagcacacagggcag

SEQ ID NO: 41498 - RNA, 19 nt, Human
cugcccggcucagugcagu

SEQ ID NO: 41499 - RNA, 21 nt, Human
ggguguccuaggaaccuuuua

SEQ ID NO: 41500 - RNA, 21 nt, Human
cuccacaaccucuugggccca

SEQ ID NO: 41501 - RNA, 17 nt, Human
gggguuagaacauauca

SEQ ID NO: 41502 - RNA, 29 nt, Human
aagcaguagucaaggaggaaagggauagu

SEQ ID NO: 41503 - RNA, 20 nt, Human
ccuugggucgcaggugggag

SEQ ID NO: 41504 - RNA, 27 nt, Human
cuccaucucaaaaagaaaagaaaagaa

SEQ ID NO: 41505 - RNA, 21 nt, Human
gcugacaugacuucuuugcca

SEQ ID NO: 41506 - RNA, 27 nt, Human
guguguaguuacuugacagcaucaaau

SEQ ID NO: 41507 - RNA, 25 nt, Human
ccagacacagcuguuguucggggcu

SEQ ID NO: 41508 - RNA, 21 nt, Human
ucucaggaugaaucagucuag

SEQ ID NO: 41509 - RNA, 23 nt, Human
cucaugccauaggugacauucua

SEQ ID NO: 41510 - RNA, 20 nt, Human
uucacaguuucagcacucaa

SEQ ID NO: 41511 - RNA, 22 nt, Human
ccaacagaaaacaaagcagcug

SEQ ID NO: 41512 - RNA, 22 nt, Human
ucugucacucaggcuggaguac

SEQ ID NO: 41513 - RNA, 22 nt, Human
ucucaauaaauaaauaaauaaa

SEQ ID NO: 41514 - RNA, 26 nt, Human
guuuauuauugguuuuguucuugccu

SEQ ID NO: 41515 - RNA, 24 nt, Human
uacauuguauuaagauaacaaaac

SEQ ID NO: 41516 - RNA, 22 nt, Human
uucugggcugaguagauaaaaa

SEQ ID NO: 41517 - RNA, 19 nt, Human
ggcacuacacggcugugac

SEQ ID NO: 41518 - RNA, 23 nt, Human
ccuuuacugcuguguauggggcu

SEQ ID NO: 41519 - RNA, 21 nt, Human
aaaauauaaaaaauuagccag

SEQ ID NO: 41520 - RNA, 24 nt, Human
aaugcuacgcacguggagcuggcc

SEQ ID NO: 41521 - RNA, 26 nt, Human
gauucuugauuccuggcucuacccug

SEQ ID NO: 41522 - RNA, 21 nt, Human
uuaccagggacccuggaguau

SEQ ID NO: 41523 - RNA, 22 nt, Human
uugcaauuugaaauauauucug

SEQ ID NO: 41524 - RNA, 19 nt, Human
accugacaggggucacuca

SEQ ID NO: 41525 - RNA, 24 nt, Human
uuaggcccuguuccagcaauaaga

SEQ ID NO: 41526 - RNA, 21 nt, Human
ucaccagcucaccucugguag

SEQ ID NO: 41527 - RNA, 27 nt, Human
gucucgaacuccugggcucaaacaguc

SEQ ID NO: 41528 - RNA, 24 nt, Human
ggcagcagcagagggagagcucgg

SEQ ID NO: 41529 - RNA, 25 nt, Human
ucccaaaccucaaaaacgucuugga

SEQ ID NO: 41530 - RNA, 21 nt, Human
ucuggguggaauggggcugaa

SEQ ID NO: 41531 - RNA, 26 nt, Human
gguggggacggaggggaaagggaagc

SEQ ID NO: 41532 - RNA, 20 nt, Human
uggaaaagccacuuucucca

SEQ ID NO: 41533 - RNA, 22 nt, Human
cuugagcauucaaaugaagauu

SEQ ID NO: 41534 - RNA, 26 nt, Human
ccacugcacccagccuagaaucuugu

SEQ ID NO: 41535 - RNA, 24 nt, Human
ccugccagcugugccuugcuugcc

SEQ ID NO: 41536 - RNA, 19 nt, Human
gggggcuugguacugugaa

SEQ ID NO: 41537 - RNA, 19 nt, Human
uccaucuucagcuucuuca

SEQ ID NO: 41538 - RNA, 24 nt, Human
cugcuauuccucugcgugccugua

SEQ ID NO: 41539 - RNA, 26 nt, Human
gcugaggcuggagaaucgcuugaggc

SEQ ID NO: 41540 - RNA, 32 nt, Human
ggcagggaagggugccuggcugggcuuugggg

SEQ ID NO: 41541 - RNA, 25 nt, Human
ggagagggaggggagagaccacagc

SEQ ID NO: 41542 - RNA, 22 nt, Human
ugccuguagucccagcuccuug

SEQ ID NO: 41543 - RNA, 31 nt, Human
acaaaccugaaaagauguugugucuuguguu

SEQ ID NO: 41544 - RNA, 22 nt, Human
ggaauucugucucaucaguucu

SEQ ID NO: 41545 - RNA, 25 nt, Human
gcauucucuggauugaccacccaca

SEQ ID NO: 41546 - RNA, 23 nt, Human
caucaguguuaagagcaugauga

SEQ ID NO: 41547 - RNA, 20 nt, Human
gacccugccuuaguagaggg

SEQ ID NO: 41548 - RNA, 24 nt, Human
uucuccaggagcuccggacccuga

SEQ ID NO: 41549 - RNA, 21 nt, Human
gccagacuccccucccccuca

SEQ ID NO: 41550 - RNA, 25 nt, Human
ucucuugccagcuuuuucccgugcu

SEQ ID NO: 41551 - RNA, 21 nt, Human
ugggacugaggguggagcagc

SEQ ID NO: 41552 - RNA, 26 nt, Human
ucuccugggcccgcuuugccugcuug

SEQ ID NO: 41553 - RNA, 18 nt, Human
agcuucauuuccuguguc

SEQ ID NO: 41554 - RNA, 23 nt, Human
ggaacccaggccuggggggcggu

SEQ ID NO: 41555 - RNA, 21 nt, Human
gugaacaaauaaacuugucua

SEQ ID NO: 41556 - RNA, 25 nt, Human
accuguaauccuagcuauucaaggg

SEQ ID NO: 41557 - RNA, 25 nt, Human
agagccagaccuguuuguccugaga

SEQ ID NO: 41558 - RNA, 22 nt, Human
aggcaaaggcucucacuccagg

SEQ ID NO: 41559 - RNA, 23 nt, Human
agacauuuuaagaaccagagcca

SEQ ID NO: 41560 - RNA, 24 nt, Human
gugaccuugcucggagcauugauu

SEQ ID NO: 41561 - RNA, 21 nt, Human
ugcauguaagaacaucuacug

SEQ ID NO: 41562 - RNA, 21 nt, Human
ugauagggcuggagggcuaug

SEQ ID NO: 41563 - RNA, 20 nt, Human
agccccaucuccagccugau

SEQ ID NO: 41564 - RNA, 21 nt, Human
cugccuggccuuuauaauuuu

SEQ ID NO: 41565 - RNA, 23 nt, Human
cagguuagagaaaauagagauga

SEQ ID NO: 41566 - RNA, 21 nt, Human
cagaagccucucgcauccuga

SEQ ID NO: 41567 - RNA, 22 nt, Human
uccgcauuucaaugaaaggagg

SEQ ID NO: 41568 - RNA, 20 nt, Human
ugucaucaggacacuaucuc

SEQ ID NO: 41569 - RNA, 23 nt, Human
cuguacccaggcaagagagaagc

SEQ ID NO: 41570 - RNA, 22 nt, Human
uauuccccucugauauucaacc

SEQ ID NO: 41571 - RNA, 26 nt, Human
cgcccaggcuggagugcaacgguacg

SEQ ID NO: 41572 - RNA, 27 nt, Human
ugccuguaaucccagcuacucaggagg

SEQ ID NO: 41573 - RNA, 31 nt, Human
ccugccucuggcccugguccugggcggggcc

SEQ ID NO: 41574 - RNA, 23 nt, Human
cggcucagguuuugagaagccau

SEQ ID NO: 41575 - RNA, 22 nt, Human
ugugagccacuguggccgaccu

SEQ ID NO: 41576 - RNA, 26 nt, Human
accacgccuggcuaaaucuuuuuugu

SEQ ID NO: 41577 - RNA, 21 nt, Human
aauuuucaucuuccuucuuug

SEQ ID NO: 41578 - RNA, 21 nt, Human
cuugucacuguggagaaagag

SEQ ID NO: 41579 - RNA, 22 nt, Human
gugggaugugccgaccaaggau

SEQ ID NO: 41580 - RNA, 22 nt, Human
gcauuuguauauacacacugca

SEQ ID NO: 41581 - RNA, 23 nt, Human
uggagcucagcaacaaggcugca

SEQ ID NO: 41582 - RNA, 23 nt, Human
ugcaggcaagcauuaugcugcua

SEQ ID NO: 41583 - RNA, 26 nt, Human
gagccugaggaaucaggagcuccagg

SEQ ID NO: 41584 - RNA, 22 nt, Human
cccugcagccagcucacgucca

SEQ ID NO: 41585 - RNA, 23 nt, Human
gggccugggaaucuaagugggag

SEQ ID NO: 41586 - RNA, 21 nt, Human
acaaaaaggauagaagcacaa

SEQ ID NO: 41587 - RNA, 22 nt, Human
uacagauaguuuauaagcacaa

SEQ ID NO: 41588 - RNA, 20 nt, Human
ucuccucuuuuguuuguguu

SEQ ID NO: 41589 - RNA, 21 nt, Human
gauccucagauguggagggag

SEQ ID NO: 41590 - RNA, 22 nt, Human
uagccuaauacaacauguagcu

SEQ ID NO: 41591 - RNA, 23 nt, Human
ggugaagcccaaaagcucuuaag

SEQ ID NO: 41592 - RNA, 23 nt, Human
gugagggauaaaaugaggcucca

SEQ ID NO: 41593 - RNA, 21 nt, Human
aaacacuucuaauucugugau

SEQ ID NO: 41594 - RNA, 22 nt, Human
ggucgcgaacuccugagcucag

SEQ ID NO: 41595 - RNA, 27 nt, Human
ccuuagacugaucaagccaaaaaagaa

SEQ ID NO: 41596 - RNA, 26 nt, Human
acacacacgcugcuguaucucccugu

SEQ ID NO: 41597 - RNA, 21 nt, Human
acgggcagccugggccugggu

SEQ ID NO: 41598 - RNA, 21 nt, Human
cugacgagccgaggcagcagu

SEQ ID NO: 41599 - RNA, 26 nt, Human
ggucuguuuuaauuuaacuguauuua

SEQ ID NO: 41600 - RNA, 26 nt, Human
cucaguucuuauuugcaccuacuuca

SEQ ID NO: 41601 - RNA, 21 nt, Human
ugccugugaucccagcacuuu

SEQ ID NO: 41602 - RNA, 19 nt, Human
ggagggccuccugugccgc

SEQ ID NO: 41603 - RNA, 20 nt, Human
agcuuuccuguacuagaugg

SEQ ID NO: 41604 - RNA, 25 nt, Human
cgccaccgccucugccuccaggccg

SEQ ID NO: 41605 - RNA, 20 nt, Human
uucugagcucuucacacgua

SEQ ID NO: 41606 - RNA, 23 nt, Human
ggggagggggauccgacugcuuu

SEQ ID NO: 41607 - RNA, 27 nt, Human
cuucagcugacuccaguauaaucuccu

SEQ ID NO: 41608 - RNA, 26 nt, Human
uccaacuggaaggcuuuauucuucca

SEQ ID NO: 41609 - RNA, 23 nt, Human
ucagucuaaagagucuaaagggg

SEQ ID NO: 41610 - RNA, 19 nt, Human
cuucccuucccacuggugc

SEQ ID NO: 41611 - RNA, 27 nt, Human
cuugggugaguccuuguggacaaccac

SEQ ID NO: 41612 - RNA, 22 nt, Human
auguucuuucucaagugcucag

SEQ ID NO: 41613 - RNA, 23 nt, Human
ggcaucuuaggagggaaaaagga

SEQ ID NO: 41614 - RNA, 21 nt, Human
cagaucgguuuguaauaacac

SEQ ID NO: 41615 - RNA, 22 nt, Human
acguuuaaucccagcacuuugg

SEQ ID NO: 41616 - RNA, 19 nt, Human
gcaucccugccucuuguca

SEQ ID NO: 41617 - RNA, 19 nt, Human
uuugucugccacagacaca

SEQ ID NO: 41618 - RNA, 20 nt, Human
ccagcacccuguggggccca

SEQ ID NO: 41619 - RNA, 24 nt, Human
guuuaacuguuugacucuuaugau

SEQ ID NO: 41620 - RNA, 31 nt, Human
ccccacccacccuugggggagcaugaugggc

SEQ ID NO: 41621 - RNA, 26 nt, Human
ccacccugcccugcucagggugggaa

SEQ ID NO: 41622 - RNA, 21 nt, Human
gcccagaggagcgacccccug

SEQ ID NO: 41623 - RNA, 19 nt, Human
ugcacguccugccugacca

SEQ ID NO: 41624 - RNA, 23 nt, Human
uuuuguguauucuuauuuacuua

SEQ ID NO: 41625 - RNA, 22 nt, Human
cauugcccaggcuggagugcag

SEQ ID NO: 41626 - RNA, 20 nt, Human
gcgccgccacacccagcuaa

SEQ ID NO: 41627 - RNA, 22 nt, Human
auauuuccaugggccaguguga

SEQ ID NO: 41628 - RNA, 26 nt, Human
cacccaggaaaggggaaaugcggccc

SEQ ID NO: 41629 - RNA, 19 nt, Human
uggagugagucaccugcuc

SEQ ID NO: 41630 - RNA, 19 nt, Human
guccuguuuucuugguucc

SEQ ID NO: 41631 - RNA, 23 nt, Human
aggaaugaccagcugccuuccaa

SEQ ID NO: 41632 - RNA, 18 nt, Human
cucauuugagaacuguca

SEQ ID NO: 41633 - RNA, 27 nt, Human
cugugugaccuuaggaagucucugccc

SEQ ID NO: 41634 - RNA, 25 nt, Human
cagccuggagggaggcauugguggc

SEQ ID NO: 41635 - RNA, 20 nt, Human
ugggaguuugagguuaguau

SEQ ID NO: 41636 - RNA, 24 nt, Human
gccacauuccaaaagaauuuugca

SEQ ID NO: 41637 - RNA, 23 nt, Human
cacugcugggccccucugccucc

SEQ ID NO: 41638 - RNA, 19 nt, Human
ggguggaagagggaguagc

SEQ ID NO: 41639 - RNA, 22 nt, Human
aaauugcugggauuacaggcau

SEQ ID NO: 41640 - RNA, 21 nt, Human
aggaucccuuccaugaaggaa

SEQ ID NO: 41641 - RNA, 20 nt, Human
agaagcaacagagccugucu

SEQ ID NO: 41642 - RNA, 23 nt, Human
gccucugcugcccuuucugugcc

SEQ ID NO: 41643 - RNA, 22 nt, Human
ugcuaauuuuuguauuuucagu

SEQ ID NO: 41644 - RNA, 22 nt, Human
cgaacuccugaccucaagcagu

SEQ ID NO: 41645 - RNA, 27 nt, Human
gucuuaaacuccuggccucaagcaauc

SEQ ID NO: 41646 - RNA, 22 nt, Human
cucucuguucugcugacaggca

SEQ ID NO: 41647 - RNA, 18 nt, Human
cccacacagagacuugca

SEQ ID NO: 41648 - RNA, 19 nt, Human
agugcugcuguggagugag

SEQ ID NO: 41649 - RNA, 26 nt, Human
aaagucagggaaucaagccaugcuua

SEQ ID NO: 41650 - RNA, 27 nt, Human
ggcaaaguagccaagagccuuuuguuu

SEQ ID NO: 41651 - RNA, 27 nt, Human
agcucacucggcacccugcaaaauuug

SEQ ID NO: 41652 - RNA, 24 nt, Human
gcugucgguuuuuaccugccuguu

SEQ ID NO: 41653 - RNA, 22 nt, Human
cccaucaggcgucuacacuguc

SEQ ID NO: 41654 - RNA, 21 nt, Human
gugcugucuguggaguguguc

SEQ ID NO: 41655 - RNA, 27 nt, Human
gucacccacgcuggagugcugugaugc

SEQ ID NO: 41656 - RNA, 23 nt, Human
gggagaggacacaggagccuggg

SEQ ID NO: 41657 - RNA, 22 nt, Human
ccggguagcugggacuacaggu

SEQ ID NO: 41658 - RNA, 20 nt, Human
agaaguuaaaaaacagcugc

SEQ ID NO: 41659 - RNA, 20 nt, Human
uggauggggaagggaaagac

SEQ ID NO: 41660 - RNA, 25 nt, Human
cugauccaggagaugcucacaggcc

SEQ ID NO: 41661 - RNA, 26 nt, Human
cgaucaggaaucuugcuccaauaaag

SEQ ID NO: 41662 - RNA, 22 nt, Human
cccagacuucauagaauacuca

SEQ ID NO: 41663 - RNA, 21 nt, Human
ggcucacuguagucucgaccu

SEQ ID NO: 41664 - RNA, 21 nt, Human
gcucacugcagccuugacucc

SEQ ID NO: 41665 - RNA, 20 nt, Human
acuagagcuggaaggaucua

SEQ ID NO: 41666 - RNA, 21 nt, Human
ugucccucgugacaauuauag

SEQ ID NO: 41667 - RNA, 20 nt, Human
agcucccuccuccucaccua

SEQ ID NO: 41668 - RNA, 21 nt, Human
cagggcggcggcgggagaagc

SEQ ID NO: 41669 - RNA, 26 nt, Human
aggcugaggaagucucuucucugugc

SEQ ID NO: 41670 - RNA, 19 nt, Human
acuuuguuagaaagugcuu

SEQ ID NO: 41671 - RNA, 23 nt, Human
agagggcugggacgguggaagac

SEQ ID NO: 41672 - RNA, 17 nt, Human
ccucacugcuacagccu

SEQ ID NO: 41673 - RNA, 22 nt, Human
uugcuugucuugggccugucac

SEQ ID NO: 41674 - RNA, 24 nt, Human
ucuccccaggaugcuguuuguggu

SEQ ID NO: 41675 - RNA, 20 nt, Human
gccuggccaugcccaggaag

SEQ ID NO: 41676 - RNA, 27 nt, Human
gcugugccaauacugccuacugugcua

SEQ ID NO: 41677 - RNA, 22 nt, Human
uggcuuuugcgcuccaaagaag

SEQ ID NO: 41678 - RNA, 22 nt, Human
ugucacccaggcuggagugauc

SEQ ID NO: 41679 - RNA, 21 nt, Human
ucccugccuccuccucucuuc

SEQ ID NO: 41680 - RNA, 27 nt, Human
acugccucuguuccuccuugagccugu

SEQ ID NO: 41681 - RNA, 18 nt, Human
cucucuaagucaggcugg

SEQ ID NO: 41682 - RNA, 21 nt, Human
uaaagugcugggauuacaggc

SEQ ID NO: 41683 - RNA, 26 nt, Human
acgcacagcuaauggcaguaccuguc

SEQ ID NO: 41684 - RNA, 22 nt, Human
gaacccagggauuucaccucca

SEQ ID NO: 41685 - RNA, 24 nt, Human
uuuucaacuccaagcagcccaggg

SEQ ID NO: 41686 - RNA, 27 nt, Human
gccuguuuuggagugugucugagacug

SEQ ID NO: 41687 - RNA, 27 nt, Human
uuguauacuaucuuuaacugguuuuuc

SEQ ID NO: 41688 - RNA, 25 nt, Human
ccacgucgcccccuccugcacagcc

SEQ ID NO: 41689 - RNA, 27 nt, Human
gccuugaacuccugggcuuaagugacc

SEQ ID NO: 41690 - RNA, 22 nt, Human
agccuccguacugggugcaaug

SEQ ID NO: 41691 - RNA, 21 nt, Human
ugggcucugggagacagcuuu

SEQ ID NO: 41692 - RNA, 24 nt, Human
ccuugcccucugucuugucacuaa

SEQ ID NO: 41693 - RNA, 26 nt, Human
ccugccguccugcgggagccugcugu

SEQ ID NO: 41694 - RNA, 19 nt, Human
agaacacuuagucuugccu

SEQ ID NO: 41695 - RNA, 23 nt, Human
gagucccaggagagugacucugg

SEQ ID NO: 41696 - RNA, 24 nt, Human
auccaggcuggagugcagugaugc

SEQ ID NO: 41697 - RNA, 24 nt, Human
uugaaggugguauggaaaagccug

SEQ ID NO: 41698 - RNA, 23 nt, Human
uaaagacugacacagaaaaucag

SEQ ID NO: 41699 - RNA, 21 nt, Human
uggccaccccucuguccuggc

SEQ ID NO: 41700 - RNA, 18 nt, Human
aggagagcugcucacuua

SEQ ID NO: 41701 - RNA, 22 nt, Human
accuaggcuggagugcaguggc

SEQ ID NO: 41702 - RNA, 14 nt, Human
aacauacauauucc

SEQ ID NO: 41703 - RNA, 27 nt, Human
aaaccuacagacaaggaggaguuccac

SEQ ID NO: 41704 - RNA, 26 nt, Human
gcaaagugcuuacuguguaagcccaa

SEQ ID NO: 41705 - RNA, 20 nt, Human
cugcuuaugcauuuaucucu

SEQ ID NO: 41706 - RNA, 23 nt, Human
caggcccagguuagaucugcaau

SEQ ID NO: 41707 - RNA, 29 nt, Human
auagacggagccgcccugcccugcucagc

SEQ ID NO: 41708 - RNA, 22 nt, Human
auugcuugagcccagaacuuca

SEQ ID NO: 41709 - RNA, 16 nt, Human
ugggcagaguccugcc

SEQ ID NO: 41710 - RNA, 24 nt, Human
gucuucauucucucgcacauuucc

SEQ ID NO: 41711 - RNA, 20 nt, Human
agaccuggggcguccuggcc

SEQ ID NO: 41712 - RNA, 21 nt, Human
agcuuucugagcaagaggauu

SEQ ID NO: 41713 - RNA, 19 nt, Human
guaaaauuccaggccaggc

SEQ ID NO: 41714 - RNA, 26 nt, Human
caagacauaaguaaaugagccuuucu

SEQ ID NO: 41715 - RNA, 22 nt, Human
gcaagacgauggcugugcucag

SEQ ID NO: 41716 - RNA, 19 nt, Human
gagccagacaagcuuucaa

SEQ ID NO: 41717 - RNA, 19 nt, Human
uuacagucuuagggauccg

SEQ ID NO: 41718 - RNA, 25 nt, Human
gcccaggcuggagugcaauggugca

SEQ ID NO: 41719 - RNA, 28 nt, Human
ucaccuacucacacaggcauuuccuggg

SEQ ID NO: 41720 - RNA, 25 nt, Human
agcagcuucacucaacucuggggaa

SEQ ID NO: 41721 - RNA, 20 nt, Human
guuucuuuuucccagaaaac

SEQ ID NO: 41722 - RNA, 26 nt, Human
ccuugcagcccugcaccugccugcca

SEQ ID NO: 41723 - RNA, 21 nt, Human
uuucaucacaacuuguuuucc

SEQ ID NO: 41724 - RNA, 22 nt, Human
uuucagaauacuuuucuaaauu

SEQ ID NO: 41725 - RNA, 25 nt, Human
ucagggaccccagucgcuggaacau

SEQ ID NO: 41726 - RNA, 24 nt, Human
acucccgcucucucagcgccgccg

SEQ ID NO: 41727 - RNA, 22 nt, Human
ugccuguaaucccaguacucug

SEQ ID NO: 41728 - RNA, 22 nt, Human
aggcuggagugcagcagcacag

SEQ ID NO: 41729 - RNA, 22 nt, Human
aguauguaucccuugcuucauu

SEQ ID NO: 41730 - RNA, 22 nt, Human
cuuauuacucucuauuuugaga

SEQ ID NO: 41731 - RNA, 24 nt, Human
gucuacuuucuucuccauccugcu

SEQ ID NO: 41732 - RNA, 30 nt, Human
cugcccgaggagcccugccugccccgacac

SEQ ID NO: 41733 - RNA, 20 nt, Human
gugacucccagacccagcca

SEQ ID NO: 41734 - RNA, 24 nt, Human
gcuccucccucuacccucggcacc

SEQ ID NO: 41735 - RNA, 21 nt, Human
uuuggagaacacaguggcugg

SEQ ID NO: 41736 - RNA, 23 nt, Human
ccuacugcugguuucugccuucu

SEQ ID NO: 41737 - RNA, 24 nt, Human
gggugggaggcggggaggagcagc

SEQ ID NO: 41738 - RNA, 22 nt, Human
ugucucccaggcugaagugcag

SEQ ID NO: 41739 - RNA, 27 nt, Human
uagccuuuaacacuaugcaacuuugua

SEQ ID NO: 41740 - RNA, 21 nt, Human
cugacugcccggcacagaugc

SEQ ID NO: 41741 - RNA, 22 nt, Human
aaugggguuucgccauguugcu

SEQ ID NO: 41742 - RNA, 22 nt, Human
agggggugaagggaagugucug

SEQ ID NO: 41743 - RNA, 22 nt, Human
gccuguaaucccaguacuuggg

SEQ ID NO: 41744 - RNA, 26 nt, Human
ugucauaaacgauucugagccauuca

SEQ ID NO: 41745 - RNA, 22 nt, Human
agagagaguuuuaacaauccau

SEQ ID NO: 41746 - RNA, 26 nt, Human
cacugcaccuccaccuuccgggcuca

SEQ ID NO: 41747 - RNA, 20 nt, Human
ggggcagcccuucgguccac

SEQ ID NO: 41748 - RNA, 26 nt, Human
gcucuguaacugucacacugcaccug

SEQ ID NO: 41749 - RNA, 25 nt, Human
ccuccgcugucaugccugcuuccgc

SEQ ID NO: 41750 - RNA, 21 nt, Human
agcagcacccuccccuccucc

SEQ ID NO: 41751 - RNA, 22 nt, Human
uauaagugacuuuaaacuuucc

SEQ ID NO: 41752 - RNA, 19 nt, Human
uggucucaggauauccuua

SEQ ID NO: 41753 - RNA, 20 nt, Human
cgguccuucagcaccccucg

SEQ ID NO: 41754 - RNA, 19 nt, Human
agagccacguggccgccac

SEQ ID NO: 41755 - RNA, 22 nt, Human
gacuccaguaucccucauucca

SEQ ID NO: 41756 - RNA, 23 nt, Human
uaucauugcuaucaaauaauuuc

SEQ ID NO: 41757 - RNA, 23 nt, Human
uaacccauaccccacaccugccc

SEQ ID NO: 41758 - RNA, 19 nt, Human
gagaacugaacuguggaaa

SEQ ID NO: 41759 - RNA, 22 nt, Human
ccaacuuguuguggcucuuauu

SEQ ID NO: 41760 - RNA, 19 nt, Human
cuuugcucugcuggaagcu

SEQ ID NO: 41761 - RNA, 24 nt, Human
caaccagcaaaacauaaacugaga

SEQ ID NO: 41762 - RNA, 23 nt, Human
gcuggucacagccuccucugucu

SEQ ID NO: 41763 - RNA, 22 nt, Human
gcuccuccaaucccauuuuauc

SEQ ID NO: 41764 - RNA, 24 nt, Human
uccccacccucagcugucaccacc

SEQ ID NO: 41765 - RNA, 21 nt, Human
auacuagauggaagacuugca

SEQ ID NO: 41766 - RNA, 25 nt, Human
uggggagaucggggccagaggcaga

SEQ ID NO: 41767 - RNA, 21 nt, Human
auuaaaaaucacgacauugua

SEQ ID NO: 41768 - RNA, 22 nt, Human
guccaggcuggagugcaauagc

SEQ ID NO: 41769 - RNA, 26 nt, Human
ggagggagggggaaggcagggagggc

SEQ ID NO: 41770 - RNA, 26 nt, Human
aacucauauucugcacgaucuguaua

SEQ ID NO: 41771 - RNA, 22 nt, Human
gauuauuaagggaauaagccau

SEQ ID NO: 41772 - RNA, 23 nt, Human
uccagaugugguuuacucugcca

SEQ ID NO: 41773 - RNA, 24 nt, Human
ccuuugcaucugcacguguucgca

SEQ ID NO: 41774 - RNA, 17 nt, Human
guuugcucagcacugug

SEQ ID NO: 41775 - RNA, 22 nt, Human
gcagauuaaauggacucaucag

SEQ ID NO: 41776 - RNA, 26 nt, Human
gguccccacagcccacaggauggacc

SEQ ID NO: 41777 - RNA, 21 nt, Human
gccagcugacaggacaucuua

SEQ ID NO: 41778 - RNA, 21 nt, Human
cccucaggcccuucacgugag

SEQ ID NO: 41779 - RNA, 21 nt, Human
acagcucugggucccuguuuu

SEQ ID NO: 41780 - RNA, 25 nt, Human
caggggaggggucaguagcagaagc

SEQ ID NO: 41781 - RNA, 20 nt, Human
ugccaccccuucuaccucac

SEQ ID NO: 41782 - RNA, 21 nt, Human
ggaagagacccucccauguac

SEQ ID NO: 41783 - RNA, 26 nt, Human
ugacaugacacaggcagagcagagug

SEQ ID NO: 41784 - RNA, 19 nt, Human
agagggaaggaaacugaca

SEQ ID NO: 41785 - RNA, 23 nt, Human
uaccaugcuaaugaggugcacac

SEQ ID NO: 41786 - RNA, 27 nt, Human
cacccgccgccucccacggcaccucgg

SEQ ID NO: 41787 - RNA, 20 nt, Human
uuuaaaaaauacaugucuau

SEQ ID NO: 41788 - RNA, 21 nt, Human
cuggacaccuguucugcuguu

SEQ ID NO: 41789 - RNA, 18 nt, Human
ggcaaaagagaaaaagaa

SEQ ID NO: 41790 - RNA, 23 nt, Human
ugccucuuauuccugcuacagca

SEQ ID NO: 41791 - RNA, 26 nt, Human
acugacuuaugagaaagcaaagcacu

SEQ ID NO: 41792 - RNA, 23 nt, Human
ucaaggcuugguuccuggaaagu

SEQ ID NO: 41793 - RNA, 21 nt, Human
cgggcuuccucauccugccug

SEQ ID NO: 41794 - RNA, 19 nt, Human
gcccaggccagagugcagu

SEQ ID NO: 41795 - RNA, 17 nt, Human
gaagccugaccuagcca

SEQ ID NO: 41796 - RNA, 20 nt, Human
uucacauuccauuauuugua

SEQ ID NO: 41797 - RNA, 23 nt, Human
uaauuauuuguuaauucaucuuu

SEQ ID NO: 41798 - RNA, 26 nt, Human
aggccuuuuguuguauaaggcugugg

SEQ ID NO: 41799 - RNA, 23 nt, Human
uuuauagaagaaauggaaugaau

SEQ ID NO: 41800 - RNA, 22 nt, Human
cagaguauccuggggguggugg

SEQ ID NO: 41801 - RNA, 22 nt, Human
aaacccagggauacagguuugu

SEQ ID NO: 41802 - RNA, 27 nt, Human
ugagaccaagggggugucuugugggca

SEQ ID NO: 41803 - RNA, 26 nt, Human
ccagugcuucccaccaggcuuuccuu

SEQ ID NO: 41804 - RNA, 23 nt, Human
guccccaagccgcugggagaugu

SEQ ID NO: 41805 - RNA, 32 nt, Human
ccugccccuccccgcccugccuggccgucacc

SEQ ID NO: 41806 - RNA, 23 nt, Human
ucaggaccaggacccagggagag

SEQ ID NO: 41807 - RNA, 21 nt, Human
augggaaaguuagcucuuccc

SEQ ID NO: 41808 - RNA, 21 nt, Human
guggacaggauggaguguggu

SEQ ID NO: 41809 - RNA, 27 nt, Human
gcaccuugcucaggaccucugccccua

SEQ ID NO: 41810 - RNA, 27 nt, Human
ugcccugcucuggggaugcacggcggc

SEQ ID NO: 41811 - RNA, 20 nt, Human
ugccuugccagugugucuua

SEQ ID NO: 41812 - RNA, 27 nt, Human
cgucauugcacuccagccuggucaaca

SEQ ID NO: 41813 - RNA, 23 nt, Human
aguacugguccccuucugggcaa

SEQ ID NO: 41814 - RNA, 24 nt, Human
guuugcacagucaucugacuucug

SEQ ID NO: 41815 - RNA, 21 nt, Human
uuuucuacuguugcuuaauua

SEQ ID NO: 41816 - RNA, 22 nt, Human
uguaucuuaaucaaggcugucu

SEQ ID NO: 41817 - RNA, 19 nt, Human
acacugguccaguccauug

SEQ ID NO: 41818 - RNA, 27 nt, Human
ccccugccuccuacuccaguaugacag

SEQ ID NO: 41819 - RNA, 24 nt, Human
aggaacuccucgguccagagacca

SEQ ID NO: 41820 - RNA, 23 nt, Human
ggacuguugaagacaggucucca

SEQ ID NO: 41821 - RNA, 28 nt, Human
ccucacaccucccuagagggagggaggg

SEQ ID NO: 41822 - RNA, 24 nt, Human
aguggguggguggggugggguggg

SEQ ID NO: 41823 - RNA, 21 nt, Human
gugcucggccaccaggguuuu

SEQ ID NO: 41824 - RNA, 27 nt, Human
uggcccaccugucuuggcuuucucauc

SEQ ID NO: 41825 - RNA, 24 nt, Human
aucuauccucucagacccucgcag

SEQ ID NO: 41826 - RNA, 23 nt, Human
ggcacggagcuuccugccucugc

SEQ ID NO: 41827 - RNA, 27 nt, Human
cauggccgccucaggccuccauggagg

SEQ ID NO: 41828 - RNA, 22 nt, Human
ccaucacacuccagccuaggcg

SEQ ID NO: 41829 - RNA, 21 nt, Human
ugagugugugugagugaggcg

SEQ ID NO: 41830 - RNA, 19 nt, Human
uuuuagauacuccuuagag

SEQ ID NO: 41831 - RNA, 22 nt, Human
gacuacaggcaugaaauacugu

SEQ ID NO: 41832 - RNA, 26 nt, Human
ucgcccaggauggagaggcggguccc

SEQ ID NO: 41833 - RNA, 27 nt, Human
cuaccuuaguucuuucucucugacucc

SEQ ID NO: 41834 - RNA, 24 nt, Human
ggcacccacugcuacacucagccu

SEQ ID NO: 41835 - RNA, 26 nt, Human
uguacacgucuccuugccugaauaag

SEQ ID NO: 41836 - RNA, 24 nt, Human
uggcauggagucccaaaggcccug

SEQ ID NO: 41837 - RNA, 23 nt, Human
cgaguaccuccagucacacuccc

SEQ ID NO: 41838 - RNA, 28 nt, Human
ucaacacugugacaucucuauuccccac

SEQ ID NO: 41839 - RNA, 25 nt, Human
augguaucuuuaaaauaauugacac

SEQ ID NO: 41840 - RNA, 25 nt, Human
gcugcugcugcugcugcugcuucuc

SEQ ID NO: 41841 - RNA, 28 nt, Human
cugggaagcugugccugucuggcucugg

SEQ ID NO: 41842 - RNA, 29 nt, Human
uuuccuuuuuccucuuccuuaauucuagu

SEQ ID NO: 41843 - RNA, 26 nt, Human
gcugccucuugguccugacaggaagu

SEQ ID NO: 41844 - RNA, 20 nt, Human
ucuuaauucaacacaggauc

SEQ ID NO: 41845 - RNA, 32 nt, Human
auuagggcaaggugugguagcucacaccuaua

SEQ ID NO: 41846 - RNA, 20 nt, Human
cuaggacaagagccaggaag

SEQ ID NO: 41847 - RNA, 22 nt, Human
ugcccacgcuggagugcaguga

SEQ ID NO: 41848 - RNA, 28 nt, Human
uucagaggcucugugugcccucacuaga

SEQ ID NO: 41849 - RNA, 23 nt, Human
caggcagcgguccuagccaguuc

SEQ ID NO: 41850 - RNA, 17 nt, Human
ccacuuccugcugcauu

SEQ ID NO: 41851 - RNA, 16 nt, Human
agggugggugggugga

SEQ ID NO: 41852 - RNA, 22 nt, Human
gcucuuagacacggccuugcca

SEQ ID NO: 41853 - RNA, 21 nt, Human
ggcaaaacauuuucucuguau

SEQ ID NO: 41854 - RNA, 26 nt, Human
acaggcuggcauucuagauuacuuuu

SEQ ID NO: 41855 - RNA, 26 nt, Human
ccccauccaucugugucugucuguug

SEQ ID NO: 41856 - RNA, 20 nt, Human
gaggggaaugaauacuucag

SEQ ID NO: 41857 - RNA, 23 nt, Human
agaaucugcaauuauaccuucug

SEQ ID NO: 41858 - RNA, 23 nt, Human
auuuuucugaggcaauuaaauuu

SEQ ID NO: 41859 - RNA, 21 nt, Human
uguggucccacccaggaaggg

SEQ ID NO: 41860 - RNA, 27 nt, Human
uugccuuuccauaaucacucagugauu

SEQ ID NO: 41861 - RNA, 27 nt, Human
acugcaaccuccaccucuuauguucaa

SEQ ID NO: 41862 - RNA, 18 nt, Human
ccugcggaagccuggcua

SEQ ID NO: 41863 - RNA, 26 nt, Human
aaccugacacugggcaagauggccca

SEQ ID NO: 41864 - RNA, 23 nt, Human
cccuguugaggguccucagucca

SEQ ID NO: 41865 - RNA, 20 nt, Human
gccucuccuuucacauucca

SEQ ID NO: 41866 - RNA, 18 nt, Human
cugguucucacacuguac

SEQ ID NO: 41867 - RNA, 25 nt, Human
aaaugauuucgugacuguaguuuuu

SEQ ID NO: 41868 - RNA, 23 nt, Human
gguggaccaagcacugguguugg

SEQ ID NO: 41869 - RNA, 21 nt, Human
cucccuguucuacacugggga

SEQ ID NO: 41870 - RNA, 21 nt, Human
guuaucgucuucuguauuuug

SEQ ID NO: 41871 - RNA, 21 nt, Human
cccucauuaaugacacuuguc

SEQ ID NO: 41872 - RNA, 29 nt, Human
ccugagcuuccuguacccugacccucucc

SEQ ID NO: 41873 - RNA, 15 nt, Human
uggguggguggggag

SEQ ID NO: 41874 - RNA, 30 nt, Human
ccuaacgucuuccuuucccugcacuaacgc

SEQ ID NO: 41875 - RNA, 24 nt, Human
gguaugugcgugugcguguuccuu

SEQ ID NO: 41876 - RNA, 27 nt, Human
ccaacuguuguauuuucaguucuucca

SEQ ID NO: 41877 - RNA, 22 nt, Human
ccaaaaugcugggauuacaggg

SEQ ID NO: 41878 - RNA, 22 nt, Human
ccaaagugcugggauuacagga

SEQ ID NO: 41879 - RNA, 19 nt, Human
agucuaaauguuaaccuca

SEQ ID NO: 41880 - RNA, 27 nt, Human
cccaggaguucgaggcugcagucaguc

SEQ ID NO: 41881 - RNA, 23 nt, Human
ugggagccacugggccaggggcc

SEQ ID NO: 41882 - RNA, 16 nt, Human
ucaagacgaggggcag

SEQ ID NO: 41883 - RNA, 24 nt, Human
cuuguacagucugcuccucuuguu

SEQ ID NO: 41884 - RNA, 26 nt, Human
cauuuucugccaagauucaagcaguc

SEQ ID NO: 41885 - RNA, 21 nt, Human
aggacagccugccagagucug

SEQ ID NO: 41886 - RNA, 25 nt, Human
agagacagcugugcucacuuuuccu

SEQ ID NO: 41887 - RNA, 25 nt, Human
agcuauuauacacuaaccaggcauu

SEQ ID NO: 41888 - RNA, 25 nt, Human
gcccaggcuggagugcgguggcuau

SEQ ID NO: 41889 - RNA, 26 nt, Human
ggagaggguagcagcaugggcuacgc

SEQ ID NO: 41890 - RNA, 22 nt, Human
aguaaagcugcagugauugagg

SEQ ID NO: 41891 - RNA, 27 nt, Human
cagcccagcggcggccauucgcggaaa

SEQ ID NO: 41892 - RNA, 25 nt, Human
aaagggaggguacaguggugggggc

SEQ ID NO: 41893 - RNA, 22 nt, Human
gucgggauggaggugagaagac

SEQ ID NO: 41894 - RNA, 31 nt, Human
ugcuuuauauuugccaaaguccuaacugacu

SEQ ID NO: 41895 - RNA, 21 nt, Human
gucuccccgcuggagaagggu

SEQ ID NO: 41896 - RNA, 21 nt, Human
cacugcucacuuccugccucu

SEQ ID NO: 41897 - RNA, 23 nt, Human
guucuuuuaaagggucagcagau

SEQ ID NO: 41898 - RNA, 21 nt, Human
gcugccucuugugccucuggc

SEQ ID NO: 41899 - RNA, 21 nt, Human
cauccaggcuggagugcggug

SEQ ID NO: 41900 - RNA, 21 nt, Human
cguccaggcuggagugcagug

SEQ ID NO: 41901 - RNA, 22 nt, Human
cauaccacuugucagggcacag

SEQ ID NO: 41902 - RNA, 19 nt, Human
uacugugauauagguacuc

SEQ ID NO: 41903 - RNA, 22 nt, Human
cacaggcagcauucaccuuugu

SEQ ID NO: 41904 - RNA, 23 nt, Human
gcgccgucgcgagccacagcccg

SEQ ID NO: 41905 - RNA, 28 nt, Human
aaaucugagcaaaacaagaaacuggggu

SEQ ID NO: 41906 - RNA, 23 nt, Human
aaccuguuucaugaacaagcuua

SEQ ID NO: 41907 - RNA, 25 nt, Human
ccuaguuuccucuccuccagcccag

SEQ ID NO: 41908 - RNA, 20 nt, Human
uuugaccuuccgagugcagu

SEQ ID NO: 41909 - RNA, 23 nt, Human
cugugcagccccgccuccaggcc

SEQ ID NO: 41910 - RNA, 25 nt, Human
uucuuaauuuuuaauuuaguuuggg

SEQ ID NO: 41911 - RNA, 22 nt, Human
gcucacuguaaccucaaacucu

SEQ ID NO: 41912 - RNA, 21 nt, Human
cugucugcucuuauuuuugua

SEQ ID NO: 41913 - RNA, 23 nt, Human
ucauuuacauuguuuacacuucu

SEQ ID NO: 41914 - RNA, 22 nt, Human
cgugauucaucuucugaagcug

SEQ ID NO: 41915 - RNA, 18 nt, Human
ccugcuggggcuggguga

SEQ ID NO: 41916 - RNA, 21 nt, Human
ggguugugucaggcuuggggg

SEQ ID NO: 41917 - RNA, 27 nt, Human
ggguuugggguuuuauuuugaugucuu

SEQ ID NO: 41918 - RNA, 23 nt, Human
ccuggugcucaucuucucuuguc

SEQ ID NO: 41919 - RNA, 24 nt, Human
gcagccucgaccaccugugcucaa

SEQ ID NO: 41920 - RNA, 20 nt, Human
cacuuuccagccuauagcag

SEQ ID NO: 41921 - RNA, 24 nt, Human
gcuuugacugagcagacuggugag

SEQ ID NO: 41922 - RNA, 19 nt, Human
aucagaggugcuuuccuca

SEQ ID NO: 41923 - RNA, 22 nt, Human
cucagcuuccagggcacugugg

SEQ ID NO: 41924 - RNA, 27 nt, Human
gggaggguauacagggagccccucccg

SEQ ID NO: 41925 - RNA, 21 nt, Human
ugccuaugcuggaauagcucc

SEQ ID NO: 41926 - RNA, 19 nt, Human
ccaccuccuccccugccgc

SEQ ID NO: 41927 - RNA, 22 nt, Human
aucgcuugagacugggaggcag

SEQ ID NO: 41928 - RNA, 25 nt, Human
gaugguggagucaagggugggcagc

SEQ ID NO: 41929 - RNA, 26 nt, Human
guggguggagaguggagugugcuggg

SEQ ID NO: 41930 - RNA, 20 nt, Human
ugugcaugggcucgaaggga

SEQ ID NO: 41931 - RNA, 21 nt, Human
uaccuggggccuggcuuuucu

SEQ ID NO: 41932 - RNA, 20 nt, Human
uuccaauagucugcacuucu

SEQ ID NO: 41933 - RNA, 19 nt, Human
aacucccguuccuguccca

SEQ ID NO: 41934 - RNA, 20 nt, Human
ccuucaaucuucauuuugga

SEQ ID NO: 41935 - RNA, 21 nt, Human
uaguguuuggcuuauuuucca

SEQ ID NO: 41936 - RNA, 22 nt, Human
ccagucugggcaacauggugaa

SEQ ID NO: 41937 - RNA, 22 nt, Human
gugagggaugaugguugcuuga

SEQ ID NO: 41938 - RNA, 21 nt, Human
agaccagccuggccaaccugg

SEQ ID NO: 41939 - RNA, 26 nt, Human
cauguaccuccccugccuugcuguug

SEQ ID NO: 41940 - RNA, 29 nt, Human
ggcaaggccggaguggugccugcggcccc

SEQ ID NO: 41941 - RNA, 22 nt, Human
caggagguggaggaauuaagug

SEQ ID NO: 41942 - RNA, 23 nt, Human
agugaagauaucuccuacuucuc

SEQ ID NO: 41943 - RNA, 26 nt, Human
agugccuucugcccucccuggagccu

SEQ ID NO: 41944 - RNA, 22 nt, Human
caggcaggcagaggcugcccug

SEQ ID NO: 41945 - RNA, 23 nt, Human
gcuuccaagaguaaacacugccu

SEQ ID NO: 41946 - RNA, 27 nt, Human
ucacagcuguaccaucucuaaaaaggu

SEQ ID NO: 41947 - RNA, 20 nt, Human
ggugcucucuuacucuuuca

SEQ ID NO: 41948 - RNA, 26 nt, Human
uuaagccccacaacaccccacaggag

SEQ ID NO: 41949 - RNA, 24 nt, Human
acacacaccccaaaacacauacau

SEQ ID NO: 41950 - RNA, 20 nt, Human
acugccuuccccuccugucc

SEQ ID NO: 41951 - RNA, 24 nt, Human
uaaacuucaacacucuuuaugaua

SEQ ID NO: 41952 - RNA, 28 nt, Human
ugcaguagacgauacagguugcaugugg

SEQ ID NO: 41953 - RNA, 24 nt, Human
ucauuguccuaaaaccuuauuuua

SEQ ID NO: 41954 - RNA, 26 nt, Human
gcaucagucccugagucaccauggaa

SEQ ID NO: 41955 - RNA, 22 nt, Human
ugaaaaaauauuaaaucaagag

SEQ ID NO: 41956 - RNA, 25 nt, Human
ucuguccuuuuucuugcugauuuau

SEQ ID NO: 41957 - RNA, 21 nt, Human
cuagcaccccaggaagaugug

SEQ ID NO: 41958 - RNA, 23 nt, Human
cuccccacucugauccccugacu

SEQ ID NO: 41959 - RNA, 27 nt, Human
gcuacuuugaguuugguguuacuagga

SEQ ID NO: 41960 - RNA, 21 nt, Human
gaacagcaaagaaauccauca

SEQ ID NO: 41961 - RNA, 26 nt, Human
cuuagaguuuauugcaguguagcuua

SEQ ID NO: 41962 - RNA, 31 nt, Human
cuggguucugggagacugcaggugccgcaca

SEQ ID NO: 41963 - RNA, 23 nt, Human
ccuggggcaaaaauauaacucua

SEQ ID NO: 41964 - RNA, 20 nt, Human
uaggauggaagggaacucug

SEQ ID NO: 41965 - RNA, 20 nt, Human
cucuuauugaauuguauuua

SEQ ID NO: 41966 - RNA, 23 nt, Human
ggaaguccugaagcucucgcagu

SEQ ID NO: 41967 - RNA, 22 nt, Human
uugaaucagcugucccucuucg

SEQ ID NO: 41968 - RNA, 19 nt, Human
gucacaggcaggacccagu

SEQ ID NO: 41969 - RNA, 19 nt, Human
auagaguuuuucacuuuaa

SEQ ID NO: 41970 - RNA, 18 nt, Human
gagaagcuaaacguguuu

SEQ ID NO: 41971 - RNA, 22 nt, Human
ggccugggccuagacuguggug

SEQ ID NO: 41972 - RNA, 25 nt, Human
ggcuccuguuucucauccuagcuuu

SEQ ID NO: 41973 - RNA, 27 nt, Human
gcuggaagguacugaaggcuucugcag

SEQ ID NO: 41974 - RNA, 22 nt, Human
agagaucccaaguagaaucuca

SEQ ID NO: 41975 - RNA, 22 nt, Human
ucaaaccaaacuuuuucucaaa

SEQ ID NO: 41976 - RNA, 22 nt, Human
aaagugcugggauuacagacac

SEQ ID NO: 41977 - RNA, 21 nt, Human
gagguugugcuuucucaggga

SEQ ID NO: 41978 - RNA, 28 nt, Human
ggaggagggagagggaggucacuggaaa

SEQ ID NO: 41979 - RNA, 24 nt, Human
ucgugauugugccacugcacucca

SEQ ID NO: 41980 - RNA, 24 nt, Human
ucuguauguguauguaucuuugua

SEQ ID NO: 41981 - RNA, 20 nt, Human
auuuugagaccucagcuugg

SEQ ID NO: 41982 - RNA, 22 nt, Human
ccauuuggaccaaaucuaguua

SEQ ID NO: 41983 - RNA, 21 nt, Human
gggcagaggcggucagccugg

SEQ ID NO: 41984 - RNA, 18 nt, Human
uuucauaugacauucaug

SEQ ID NO: 41985 - RNA, 21 nt, Human
uucccugccccucccccacca

SEQ ID NO: 41986 - RNA, 19 nt, Human
ugagaggagcagucaggac

SEQ ID NO: 41987 - RNA, 24 nt, Human
uuugcugacaguccugcccugccu

SEQ ID NO: 41988 - RNA, 23 nt, Human
ggucccauacaaucagccuuucu

SEQ ID NO: 41989 - RNA, 23 nt, Human
gcgcagagaagcugagggcgguc

SEQ ID NO: 41990 - RNA, 25 nt, Human
uaggugacagagggaaacuccaucu

SEQ ID NO: 41991 - RNA, 23 nt, Human
gacgggguuucuccauguugguc

SEQ ID NO: 41992 - RNA, 22 nt, Human
aggaagaggcucugggcuggca

SEQ ID NO: 41993 - RNA, 23 nt, Human
gccucuguaccugcagcucugcu

SEQ ID NO: 41994 - RNA, 23 nt, Human
uuuacccaggcuggagugcaaug

SEQ ID NO: 41995 - RNA, 24 nt, Human
cugcgaugccucugccucaucuca

SEQ ID NO: 41996 - RNA, 23 nt, Human
ucugcuuaaagcuucccucucag

SEQ ID NO: 41997 - RNA, 23 nt, Human
cacccaggcugugaucuguccug

SEQ ID NO: 41998 - RNA, 27 nt, Human
cugggugacaagagugaaacuccaucu

SEQ ID NO: 41999 - RNA, 23 nt, Human
uuacauauuugugcaccaaacuu

SEQ ID NO: 42000 - RNA, 20 nt, Human
agauacugcugaccugugcu

SEQ ID NO: 42001 - RNA, 24 nt, Human
uugguuucagcauuaguaccuaca

SEQ ID NO: 42002 - RNA, 27 nt, Human
cauuuaauuagaaaaagagaauaaaaa

SEQ ID NO: 42003 - RNA, 27 nt, Human
agcggcguugggguuuggcugcagugg

SEQ ID NO: 42004 - RNA, 22 nt, Human
ucuucaucuaugacugcagugc

SEQ ID NO: 42005 - RNA, 22 nt, Human
ccuuccagcucuguccuaggag

SEQ ID NO: 42006 - RNA, 27 nt, Human
ggcuggguggugaaggacccuggcucu

SEQ ID NO: 42007 - RNA, 22 nt, Human
ucagaaggcuucaucaccaaga

SEQ ID NO: 42008 - RNA, 27 nt, Human
ucucaacaaggagcaguauguacacag

SEQ ID NO: 42009 - RNA, 22 nt, Human
cuuuuucuaccuuguuguguuu

SEQ ID NO: 42010 - RNA, 23 nt, Human
auuagcccugggccaccuccucc

SEQ ID NO: 42011 - RNA, 32 nt, Human
uaugcuuuaaagcuaucaacaaaaacugaaua

SEQ ID NO: 42012 - RNA, 27 nt, Human
gcacagccgcugggagcgccucagacc

SEQ ID NO: 42013 - RNA, 20 nt, Human
uuuugcagcuaucaugaucc

SEQ ID NO: 42014 - RNA, 22 nt, Human
guaaagcucucagcauuggcuu

SEQ ID NO: 42015 - RNA, 27 nt, Human
guucgucucaugcgcguccuccguccc

SEQ ID NO: 42016 - RNA, 26 nt, Human
uggcaggaacagccagugggagguuc

SEQ ID NO: 42017 - RNA, 22 nt, Human
cauuucuuccccuucugggcaa

SEQ ID NO: 42018 - RNA, 24 nt, Human
gagccuggcuggagagcugcuaug

SEQ ID NO: 42019 - RNA, 24 nt, Human
agagugagaaagaauaggggcuga

SEQ ID NO: 42020 - RNA, 21 nt, Human
guugcugucggcaggcugaag

SEQ ID NO: 42021 - RNA, 20 nt, Human
aaacuccugggccuccgaca

SEQ ID NO: 42022 - RNA, 16 nt, Human
aguggucggcugcagu

SEQ ID NO: 42023 - RNA, 19 nt, Human
ggaaguaguuuaaaugucu

SEQ ID NO: 42024 - RNA, 18 nt, Human
agggaaagggauauggag

SEQ ID NO: 42025 - RNA, 27 nt, Human
gcaggaggaucgcuugaacccaggaag

SEQ ID NO: 42026 - RNA, 18 nt, Human
ggcugcaagcccaccucg

SEQ ID NO: 42027 - RNA, 24 nt, Human
uuuccagucgggggaacugaggca

SEQ ID NO: 42028 - RNA, 22 nt, Human
gaacccaggaggcagcuguugc

SEQ ID NO: 42029 - RNA, 22 nt, Human
ccugcucuauuuuccugggcag

SEQ ID NO: 42030 - RNA, 20 nt, Human
aucacccagaggggugccuu

SEQ ID NO: 42031 - RNA, 32 nt, Human
agaugggacuacaggcacaggccauuaugccu

SEQ ID NO: 42032 - RNA, 27 nt, Human
ggccagggagcagagcuuccacaagac

SEQ ID NO: 42033 - RNA, 25 nt, Human
ccagcggcugcucaagccgcaagcu

SEQ ID NO: 42034 - RNA, 24 nt, Human
aggugccuguaauccuagcuacuu

SEQ ID NO: 42035 - RNA, 21 nt, Human
cuccuuccuaaagagcacuuu

SEQ ID NO: 42036 - RNA, 27 nt, Human
uucagcaggaggcaagcguguucucag

SEQ ID NO: 42037 - RNA, 23 nt, Human
cuuaucuccccagggaaugcucc

SEQ ID NO: 42038 - RNA, 20 nt, Human
caggaguuuaaagcugcagu

SEQ ID NO: 42039 - RNA, 21 nt, Human
uauccaggcaaccucuuuuca

SEQ ID NO: 42040 - RNA, 30 nt, Human
ggagcugggggaaggcaggagccuuccuuu

SEQ ID NO: 42041 - RNA, 22 nt, Human
ugcuucugguccaacuuguaca

SEQ ID NO: 42042 - RNA, 20 nt, Human
cugcagcugcagcgcgagcc

SEQ ID NO: 42043 - RNA, 25 nt, Human
ggagagggagcugagguccuggugc

SEQ ID NO: 42044 - RNA, 27 nt, Human
agccuccuugucuauccuuccuccccc

SEQ ID NO: 42045 - RNA, 18 nt, Human
uuauuugagacuuccuca

SEQ ID NO: 42046 - RNA, 21 nt, Human
auuugccugacauugacuuca

SEQ ID NO: 42047 - RNA, 27 nt, Human
ucuccuggcccucucucugaucaugcc

SEQ ID NO: 42048 - RNA, 24 nt, Human
ggcaguagacauggagaaauccua

SEQ ID NO: 42049 - RNA, 23 nt, Human
cuguugggaaccaggaagguggg

SEQ ID NO: 42050 - RNA, 26 nt, Human
agagagcugccuuccacaagaccagc

SEQ ID NO: 42051 - RNA, 22 nt, Human
cuacugcauuccagccugggug

SEQ ID NO: 42052 - RNA, 19 nt, Human
accauacacuauccacaga

SEQ ID NO: 42053 - RNA, 23 nt, Human
aaaucagaguuuggaacaugaug

SEQ ID NO: 42054 - RNA, 19 nt, Human
cagagggagagaacaaggc

SEQ ID NO: 42055 - RNA, 24 nt, Human
cacagguuguagagauagagaugg

SEQ ID NO: 42056 - RNA, 20 nt, Human
acuauaguauucuuagaaua

SEQ ID NO: 42057 - RNA, 23 nt, Human
aggcauaagccaauaggauaaua

SEQ ID NO: 42058 - RNA, 19 nt, Human
caggaccuggaaaacacuc

SEQ ID NO: 42059 - RNA, 27 nt, Human
uagcacaaaaucauucuuugcaacuca

SEQ ID NO: 42060 - RNA, 26 nt, Human
uguuuuuuaaaugaacacaguugagu

SEQ ID NO: 42061 - RNA, 22 nt, Human
cugcaaccucuaccucccaggu

SEQ ID NO: 42062 - RNA, 19 nt, Human
cagucccucucauauugcc

SEQ ID NO: 42063 - RNA, 23 nt, Human
ggauggccagggucugauggcug

SEQ ID NO: 42064 - RNA, 26 nt, Human
ugagcauggaauuggaaugugucaca

SEQ ID NO: 42065 - RNA, 21 nt, Human
agcaaggaccagaggaaggug

SEQ ID NO: 42066 - RNA, 27 nt, Human
ggagagcggucccccgugcuguggaac

SEQ ID NO: 42067 - RNA, 25 nt, Human
aagaacauuucuaauaaaaauaaac

SEQ ID NO: 42068 - RNA, 18 nt, Human
ccggauuugcuaugcaaa

SEQ ID NO: 42069 - RNA, 23 nt, Human
aaacuauucuuacauuuguuuug

SEQ ID NO: 42070 - RNA, 27 nt, Human
gagaugggagagcaacaaguagagaug

SEQ ID NO: 42071 - RNA, 22 nt, Human
cugcagcagagcuuguagcugg

SEQ ID NO: 42072 - RNA, 22 nt, Human
cugccucuccuuccucucugca

SEQ ID NO: 42073 - RNA, 23 nt, Human
ggcuguaguaccucugcuguugu

SEQ ID NO: 42074 - RNA, 25 nt, Human
ugccuaucugggccacaagugaguc

SEQ ID NO: 42075 - RNA, 26 nt, Human
ccacuucucuagggccaguagcagac

SEQ ID NO: 42076 - RNA, 26 nt, Human
ucugcgcuccagccuucgccuggcag

SEQ ID NO: 42077 - RNA, 21 nt, Human
cagagcuggaggugagcuucu

SEQ ID NO: 42078 - RNA, 19 nt, Human
uuugucuccccuucccacc

SEQ ID NO: 42079 - RNA, 23 nt, Human
ccagaagcugcucuccacuugcu

SEQ ID NO: 42080 - RNA, 20 nt, Human
aucucucucccaguacacca

SEQ ID NO: 42081 - RNA, 22 nt, Human
ugggggaguggguagaggccgg

SEQ ID NO: 42082 - RNA, 22 nt, Human
aaaagugcuugucaguuguuga

SEQ ID NO: 42083 - RNA, 17 nt, Human
uuuguaugucuacuuuc

SEQ ID NO: 42084 - RNA, 25 nt, Human
uugccauaguguaugcauuaaacca

SEQ ID NO: 42085 - RNA, 21 nt, Human
ucuaaguaaagcacagucccu

SEQ ID NO: 42086 - RNA, 22 nt, Human
cugcaccauuuaaaaacaggca

SEQ ID NO: 42087 - RNA, 22 nt, Human
ugggguggaaaggccaggccug

SEQ ID NO: 42088 - RNA, 27 nt, Human
gucgugaacuccugggcucaagugauc

SEQ ID NO: 42089 - RNA, 24 nt, Human
ucccuccucugcuuucaaaaguca

SEQ ID NO: 42090 - RNA, 23 nt, Human
uugcccaggcaggucuugaacuc

SEQ ID NO: 42091 - RNA, 19 nt, Human
guuguuucucuagcgcuga

SEQ ID NO: 42092 - RNA, 18 nt, Human
aggaaagaugcagaggaa

SEQ ID NO: 42093 - RNA, 30 nt, Human
uuuagcugcaggacauguauucccauugca

SEQ ID NO: 42094 - RNA, 22 nt, Human
uuccuuugacagaugguauccc

SEQ ID NO: 42095 - RNA, 23 nt, Human
aauucguacauacaauuuggaau

SEQ ID NO: 42096 - RNA, 27 nt, Human
gauaccccucagggcucagcuagacau

SEQ ID NO: 42097 - RNA, 25 nt, Human
gguggcuggcugcaagugugacggg

SEQ ID NO: 42098 - RNA, 23 nt, Human
cugcuucucugggggccucuuuc

SEQ ID NO: 42099 - RNA, 26 nt, Human
cagagggagagaguagcagaaggcuu

SEQ ID NO: 42100 - RNA, 18 nt, Human
gcugcaauuacuugcugu

SEQ ID NO: 42101 - RNA, 26 nt, Human
ccucaccuccauccugucuacuaauc

SEQ ID NO: 42102 - RNA, 21 nt, Human
acaagcaguguguugaacuuu

SEQ ID NO: 42103 - RNA, 20 nt, Human
cuaggguuuuauaaaggagg

SEQ ID NO: 42104 - RNA, 27 nt, Human
caccacugcccacauuccugaaguguu

SEQ ID NO: 42105 - RNA, 21 nt, Human
cacacuugggccucugccucu

SEQ ID NO: 42106 - RNA, 27 nt, Human
gguuuuaaacucuugaccucauguucc

SEQ ID NO: 42107 - RNA, 22 nt, Human
guuuuuaaaauaucuguuuuua

SEQ ID NO: 42108 - RNA, 25 nt, Human
ugggagguggugguggguggcggug

SEQ ID NO: 42109 - RNA, 22 nt, Human
accauacaucugugcauuuucu

SEQ ID NO: 42110 - RNA, 22 nt, Human
gcgacugggaagaacacugccc

SEQ ID NO: 42111 - RNA, 29 nt, Human
ggcuggggcuggagaaugagagacugcgc

SEQ ID NO: 42112 - RNA, 22 nt, Human
cuuuggagaaaaugaaugaaga

SEQ ID NO: 42113 - RNA, 16 nt, Human
cuucccuucccagccg

SEQ ID NO: 42114 - RNA, 22 nt, Human
cgaaugcauuuggaaccaaagu

SEQ ID NO: 42115 - RNA, 18 nt, Human
gcuuuuucucccuccucc

SEQ ID NO: 42116 - RNA, 27 nt, Human
gccuuuuuauucauaaauuauccaguc

SEQ ID NO: 42117 - RNA, 21 nt, Human
cucuggcugagaagggaccag

SEQ ID NO: 42118 - RNA, 26 nt, Human
cauccagcggcggcgccagcaguucc

SEQ ID NO: 42119 - RNA, 21 nt, Human
ccagagcguccagaucugcca

SEQ ID NO: 42120 - RNA, 26 nt, Human
accuucugccuuuguccugcucccuu

SEQ ID NO: 42121 - RNA, 21 nt, Human
aggauccgagauguucugcuu

SEQ ID NO: 42122 - RNA, 27 nt, Human
gcacagccccugcugggaaauggcucu

SEQ ID NO: 42123 - RNA, 27 nt, Human
cuccagccucauuugcuugagacuuug

SEQ ID NO: 42124 - RNA, 24 nt, Human
gcgucgcucccccucuucaugguc

SEQ ID NO: 42125 - RNA, 30 nt, Human
ucugccgcgcuccgcccugccgccgaccgc

SEQ ID NO: 42126 - RNA, 20 nt, Human
ccccuccccuuuccucucca

SEQ ID NO: 42127 - RNA, 20 nt, Human
guggagguggggguugcugu

SEQ ID NO: 42128 - RNA, 16 nt, Human
cuuuuguaccuagcua

SEQ ID NO: 42129 - RNA, 27 nt, Human
cccuccugccccggcauugcaucuucc

SEQ ID NO: 42130 - RNA, 27 nt, Human
uucuggcuucugcuucauccugcucca

SEQ ID NO: 42131 - RNA, 23 nt, Human
agggaagagaaauaaacguggca

SEQ ID NO: 42132 - RNA, 23 nt, Human
cuuaacacaacagaaacuuauuu

SEQ ID NO: 42133 - RNA, 18 nt, Human
ccauaauauacaaacuuc

SEQ ID NO: 42134 - RNA, 27 nt, Human
gaccagccuggccaacauaauuaaaau

SEQ ID NO: 42135 - RNA, 21 nt, Human
acuccugaacccccauuucug

SEQ ID NO: 42136 - RNA, 22 nt, Human
ugggcagaaccucucagccuuc

SEQ ID NO: 42137 - RNA, 19 nt, Human
uaaacagaggauaucggca

SEQ ID NO: 42138 - RNA, 22 nt, Human
aagaagagaacugccuuuggca

SEQ ID NO: 42139 - RNA, 22 nt, Human
augagccuucucccaugcaaag

SEQ ID NO: 42140 - RNA, 22 nt, Human
aagccauggccugccugccuuu

SEQ ID NO: 42141 - RNA, 27 nt, Human
ugggggaggggggacgcgggagggugc

SEQ ID NO: 42142 - RNA, 22 nt, Human
gcuagccacacuccguggccca

SEQ ID NO: 42143 - RNA, 22 nt, Human
ugcauaaaagacaagcacuuug

SEQ ID NO: 42144 - RNA, 22 nt, Human
cuggcuucuaguugugccaccu

SEQ ID NO: 42145 - RNA, 22 nt, Human
acugcaacccccaucucccagg

SEQ ID NO: 42146 - RNA, 27 nt, Human
cagugcacucuuuugggccacagacau

SEQ ID NO: 42147 - RNA, 21 nt, Human
aauagagaguugagacuugcc

SEQ ID NO: 42148 - RNA, 24 nt, Human
agcucacugcagccuccacuuccu

SEQ ID NO: 42149 - RNA, 23 nt, Human
uuuuccaggaagauccaggaggg

SEQ ID NO: 42150 - RNA, 24 nt, Human
cuaauauuuaaaauuuacacuucu

SEQ ID NO: 42151 - RNA, 25 nt, Human
gaagugagggaaggauguuuagcag

SEQ ID NO: 42152 - RNA, 23 nt, Human
ucccauuuuaccgagguggaucu

SEQ ID NO: 42153 - RNA, 23 nt, Human
cgcgggcgcugaugaugggugag

SEQ ID NO: 42154 - RNA, 23 nt, Human
aaccauccugccaaugcccagga

SEQ ID NO: 42155 - RNA, 23 nt, Human
aguucccacagccucugccugcc

SEQ ID NO: 42156 - RNA, 19 nt, Human
cacugucuuuaauucugua

SEQ ID NO: 42157 - RNA, 23 nt, Human
aaccuaacuccccaccccaacau

SEQ ID NO: 42158 - RNA, 22 nt, Human
gagaccccaucucuacaaaaaa

SEQ ID NO: 42159 - RNA, 22 nt, Human
aacucaggaacaacucuugucu

SEQ ID NO: 42160 - RNA, 21 nt, Human
cuauacagcuuggcagagaaa

SEQ ID NO: 42161 - RNA, 26 nt, Human
cuugcugcugguuuuuuccuuuccuu

SEQ ID NO: 42162 - RNA, 26 nt, Human
cagcuacauauaugaacaaauccuuu

SEQ ID NO: 42163 - RNA, 25 nt, Human
agguugaggugggaggaucacuuga

SEQ ID NO: 42164 - RNA, 21 nt, Human
ggccgggaggggacuagaaga

SEQ ID NO: 42165 - RNA, 25 nt, Human
gcagccgccucccagcccugccuag

SEQ ID NO: 42166 - RNA, 21 nt, Human
uagaacuuucuccaauaguca

SEQ ID NO: 42167 - RNA, 24 nt, Human
agcccuggauuuccugcugccauc

SEQ ID NO: 42168 - RNA, 23 nt, Human
acuucucccaacagccccagggc

SEQ ID NO: 42169 - RNA, 22 nt, Human
cggcccagacugaagugcagug

SEQ ID NO: 42170 - RNA, 20 nt, Human
caccuacaccaacugcucuc

SEQ ID NO: 42171 - RNA, 27 nt, Human
cggaaggcauugcuguagucagucauu

SEQ ID NO: 42172 - RNA, 21 nt, Human
uaaaugaugucgguuugccca

SEQ ID NO: 42173 - RNA, 21 nt, Human
ccugccuguuuuuguuggugc

SEQ ID NO: 42174 - RNA, 24 nt, Human
agugacuguacuuucuauuuuaau

SEQ ID NO: 42175 - RNA, 23 nt, Human
aaccccuggugucccuguggaac

SEQ ID NO: 42176 - RNA, 27 nt, Human
guggaaugagccuggaucaggagaagu

SEQ ID NO: 42177 - RNA, 27 nt, Human
gggggagcugaaagggagccccugcuc

SEQ ID NO: 42178 - RNA, 26 nt, Human
gaggcaaauaguacauguaaaacaau

SEQ ID NO: 42179 - RNA, 25 nt, Human
gaucaggaucguaguucucaggcac

SEQ ID NO: 42180 - RNA, 22 nt, Human
uaaauguuauauuucacaagaa

SEQ ID NO: 42181 - RNA, 22 nt, Human
gaaucugggaggcagagguugc

SEQ ID NO: 42182 - RNA, 23 nt, Human
gcccaguccuuggugugaguuua

SEQ ID NO: 42183 - RNA, 23 nt, Human
ccacuuugccuucucuggacuca

SEQ ID NO: 42184 - RNA, 27 nt, Human
cagguucugagaacagaaccugggaaa

SEQ ID NO: 42185 - RNA, 24 nt, Human
uacauuccaggccagaaccagcac

SEQ ID NO: 42186 - RNA, 21 nt, Human
auagaaaaagcaccugcuuuu

SEQ ID NO: 42187 - RNA, 27 nt, Human
aggcugagagcaccuccccaaacacac

SEQ ID NO: 42188 - RNA, 27 nt, Human
guaaucaggaagccaaaugucaccuuc

SEQ ID NO: 42189 - RNA, 27 nt, Human
ggcagggagucuggugccugcagagau

SEQ ID NO: 42190 - RNA, 20 nt, Human
gaaguagcucuggugaccuu

SEQ ID NO: 42191 - RNA, 21 nt, Human
cgccuccauccaucuguccgu

SEQ ID NO: 42192 - RNA, 23 nt, Human
gccuaugcccagccuccaacucc

SEQ ID NO: 42193 - RNA, 22 nt, Human
cucgaccucccaaagugcuggg

SEQ ID NO: 42194 - RNA, 22 nt, Human
cucggccucccaaagugcugag

SEQ ID NO: 42195 - RNA, 25 nt, Human
ugccaugacauggaaaccugguggu

SEQ ID NO: 42196 - RNA, 23 nt, Human
gacacguguccaugcaccacaga

SEQ ID NO: 42197 - RNA, 29 nt, Human
uucugcuauuuacugcucuuauuguuaag

SEQ ID NO: 42198 - RNA, 22 nt, Human
gggauuacaggcgcgagccacg

SEQ ID NO: 42199 - RNA, 20 nt, Human
ccggaaagcuugcuuugaaa

SEQ ID NO: 42200 - RNA, 24 nt, Human
cccuccugccucaggccgcgaaga

SEQ ID NO: 42201 - RNA, 26 nt, Human
ccucacaaccaccucaguccucccuc

SEQ ID NO: 42202 - RNA, 19 nt, Human
aaaauaguguuuuguaguu

SEQ ID NO: 42203 - RNA, 26 nt, Human
uacauacuuauaagucuaucauuuaa

SEQ ID NO: 42204 - RNA, 26 nt, Human
uccaugugugucggcagugcuggugu

SEQ ID NO: 42205 - RNA, 23 nt, Human
ucagcucugcugaaaauuuccaa

SEQ ID NO: 42206 - RNA, 22 nt, Human
gaggcugccccauuugagguca

SEQ ID NO: 42207 - RNA, 18 nt, Human
uauacuugguucucucca

SEQ ID NO: 42208 - RNA, 22 nt, Human
uaucggccaggcuggagugcag

SEQ ID NO: 42209 - RNA, 27 nt, Human
gccauucucccccucuuugggcagugc

SEQ ID NO: 42210 - RNA, 18 nt, Human
acugguuuguguuuugcu

SEQ ID NO: 42211 - RNA, 20 nt, Human
gcuuacucaaccucugccuc

SEQ ID NO: 42212 - RNA, 26 nt, Human
acugggugcacacaugaguggggcag

SEQ ID NO: 42213 - RNA, 23 nt, Human
ucaggcugaggugucuuaagccu

SEQ ID NO: 42214 - RNA, 24 nt, Human
cugcccguggcccugcugucgggc

SEQ ID NO: 42215 - RNA, 22 nt, Human
gguuaauucuaagacuugcugc

SEQ ID NO: 42216 - RNA, 26 nt, Human
ugacccaccuccugcugagaaccuuc

SEQ ID NO: 42217 - RNA, 20 nt, Human
acccacugguggggugggag

SEQ ID NO: 42218 - RNA, 26 nt, Human
acuguucucagagggaugugagggaa

SEQ ID NO: 42219 - RNA, 22 nt, Human
ggacauccagggaucagggcau

SEQ ID NO: 42220 - RNA, 16 nt, Human
ucuacuuccagguuga

SEQ ID NO: 42221 - RNA, 20 nt, Human
aggaaacaaaagauucccuu

SEQ ID NO: 42222 - RNA, 28 nt, Human
uagccauuaggguuuucccuggggggcc

SEQ ID NO: 42223 - RNA, 21 nt, Human
acccccacccaacccagcucc

SEQ ID NO: 42224 - RNA, 16 nt, Human
ggcucaccucuugccu

SEQ ID NO: 42225 - RNA, 23 nt, Human
agaaccaccugcucacucugucc

SEQ ID NO: 42226 - RNA, 21 nt, Human
cacuggaggugggggacggga

SEQ ID NO: 42227 - RNA, 24 nt, Human
agcacagacugccaaguacuguuu

SEQ ID NO: 42228 - RNA, 23 nt, Human
ugggaggaugacaugcagaggaa

SEQ ID NO: 42229 - RNA, 21 nt, Human
cccuguccucaccacucuggg

SEQ ID NO: 42230 - RNA, 22 nt, Human
augccauggccgggugcagugg

SEQ ID NO: 42231 - RNA, 21 nt, Human
agaaggaaggaggcagacuga

SEQ ID NO: 42232 - RNA, 27 nt, Human
aaguuggcaaaaacagccuucuagcac

SEQ ID NO: 42233 - RNA, 22 nt, Human
ugucaccguuccuucucauagu

SEQ ID NO: 42234 - RNA, 26 nt, Human
cucugccuguccccagggucugcucc

SEQ ID NO: 42235 - RNA, 22 nt, Human
cuccuauggacccugcccgcuc

SEQ ID NO: 42236 - RNA, 22 nt, Human
agaaaaaccgucacuugcaaaa

SEQ ID NO: 42237 - RNA, 24 nt, Human
cugugugcucuuaucaccaaucag

SEQ ID NO: 42238 - RNA, 22 nt, Human
auuuuuaaagaguuguuuuuug

SEQ ID NO: 42239 - RNA, 25 nt, Human
cccucugccgcugcuuccaggcugg

SEQ ID NO: 42240 - RNA, 22 nt, Human
acuaccugugagcaugggaaua

SEQ ID NO: 42241 - RNA, 27 nt, Human
uuauguagcugaaacaaaaaugccaga

SEQ ID NO: 42242 - RNA, 22 nt, Human
cuagggcagcagggagucuuga

SEQ ID NO: 42243 - RNA, 23 nt, Human
aaaccaaggauguuuugaaggga

SEQ ID NO: 42244 - RNA, 21 nt, Human
uaaacagagcugugauaagca

SEQ ID NO: 42245 - RNA, 24 nt, Human
ucccaaaacaccugacagccccuc

SEQ ID NO: 42246 - RNA, 20 nt, Human
ccagugcuccagccuaggag

SEQ ID NO: 42247 - RNA, 21 nt, Human
ucuuuacaaaaaguaaaguga

SEQ ID NO: 42248 - RNA, 25 nt, Human
ccccccacugaaugcuugccuugcc

SEQ ID NO: 42249 - RNA, 23 nt, Human
ggccucgccugccuuucugccuu

SEQ ID NO: 42250 - RNA, 27 nt, Human
gggaguaauggcgggcacuuucaccaa

SEQ ID NO: 42251 - RNA, 21 nt, Human
uuuguuuuaaauuaguccguc

SEQ ID NO: 42252 - RNA, 22 nt, Human
cccuucagagcagggauugugc

SEQ ID NO: 42253 - RNA, 26 nt, Human
guuaucuccccauuugucaaaguuga

SEQ ID NO: 42254 - RNA, 21 nt, Human
gggccuuugagaaucagacug

SEQ ID NO: 42255 - RNA, 23 nt, Human
ucuagcaugguauauaacaaaac

SEQ ID NO: 42256 - RNA, 22 nt, Human
uguuuguauguauaauucaaag

SEQ ID NO: 42257 - RNA, 24 nt, Human
ccgcugccucuguucucagcguca

SEQ ID NO: 42258 - RNA, 21 nt, Human
aucaucaggccgggugcagug

SEQ ID NO: 42259 - RNA, 22 nt, Human
ggaggcggcggcggcagaggag

SEQ ID NO: 42260 - RNA, 23 nt, Human
cgucgcccaggcuggaaugcagu

SEQ ID NO: 42261 - RNA, 22 nt, Human
guugcccagcaccuuaggcacu

SEQ ID NO: 42262 - RNA, 24 nt, Human
gccuaucuccuagggcuauggugu

SEQ ID NO: 42263 - RNA, 26 nt, Human
uagcuucuaaaaggaaagaugcagau

SEQ ID NO: 42264 - RNA, 22 nt, Human
uacuucauuuuuaaaacaacug

SEQ ID NO: 42265 - RNA, 27 nt, Human
cuccagccacuccuuccuggggcugac

SEQ ID NO: 42266 - RNA, 26 nt, Human
ccucaccauccuucagucuaaggaag

SEQ ID NO: 42267 - RNA, 21 nt, Human
uggaguagacaaaaggaaagg

SEQ ID NO: 42268 - RNA, 22 nt, Human
ucacuguugcugaucagauuuc

SEQ ID NO: 42269 - RNA, 22 nt, Human
aagaauauugcaaaauacauga

SEQ ID NO: 42270 - RNA, 21 nt, Human
uugaggugaucagcauaagag

SEQ ID NO: 42271 - RNA, 18 nt, Human
caucccaggcuugcugug

SEQ ID NO: 42272 - RNA, 22 nt, Human
uggagaaagaacagugugccuc

SEQ ID NO: 42273 - RNA, 28 nt, Human
cuuuuuucacuuuuccuccuccaaagag

SEQ ID NO: 42274 - RNA, 21 nt, Human
accagugacacgucucgccaa

SEQ ID NO: 42275 - RNA, 22 nt, Human
caggcuggagugcaguagugca

SEQ ID NO: 42276 - RNA, 21 nt, Human
ggaggcacacagcugcagaga

SEQ ID NO: 42277 - RNA, 21 nt, Human
aaaucuaggccgggugcagug

SEQ ID NO: 42278 - RNA, 21 nt, Human
ucugucggcccugcuuccugc

SEQ ID NO: 42279 - RNA, 23 nt, Human
cuguaaggcaggagcaggcagcu

SEQ ID NO: 42280 - RNA, 22 nt, Human
agggaaaggcaagcuugaggcc

SEQ ID NO: 42281 - RNA, 22 nt, Human
ggagcuuccugccucugcuccg

SEQ ID NO: 42282 - RNA, 20 nt, Human
cugaucuguaccaugacccu

SEQ ID NO: 42283 - RNA, 26 nt, Human
uucccaagcucugcuccucuccccag

SEQ ID NO: 42284 - RNA, 22 nt, Human
gccccuggcuccuuggucucuc

SEQ ID NO: 42285 - RNA, 21 nt, Human
agcaauggauaaacagcucug

SEQ ID NO: 42286 - RNA, 30 nt, Human
cagucuggaguuaauuccuguuaacucauu

SEQ ID NO: 42287 - RNA, 26 nt, Human
ccugcacuugucccucuccagcaaga

SEQ ID NO: 42288 - RNA, 21 nt, Human
ccggccacgcggagagcugua

SEQ ID NO: 42289 - RNA, 22 nt, Human
aggaauucuaaaacauggggga

SEQ ID NO: 42290 - RNA, 20 nt, Human
gcuccuccucagguccuggc

SEQ ID NO: 42291 - RNA, 22 nt, Human
gcucgcucaaccucuuuuguuc

SEQ ID NO: 42292 - RNA, 24 nt, Human
gaugccuccauucgccuguggacc

SEQ ID NO: 42293 - RNA, 25 nt, Human
gggacacagccacuccccaaagagu

SEQ ID NO: 42294 - RNA, 25 nt, Human
gcaccguuucucccuccacagggcc

SEQ ID NO: 42295 - RNA, 22 nt, Human
cagcggaacucgaccggaucca

SEQ ID NO: 42296 - RNA, 30 nt, Human
cagcucuccgccaauuucucucagauuucc

SEQ ID NO: 42297 - RNA, 21 nt, Human
gcuuccuuugggacauucuua

SEQ ID NO: 42298 - RNA, 27 nt, Human
gcagugaucaugggggaaauguuuaca

SEQ ID NO: 42299 - RNA, 23 nt, Human
ucuuguuccuaggcaugaccuag

SEQ ID NO: 42300 - RNA, 21 nt, Human
uccagccugggcgaaagagcg

SEQ ID NO: 42301 - RNA, 23 nt, Human
cuggcuccccucuucguuccuuc

SEQ ID NO: 42302 - RNA, 23 nt, Human
gcuagugaucugguuuacugccu

SEQ ID NO: 42303 - RNA, 19 nt, Human
ugcuggcacugaugucccu

SEQ ID NO: 42304 - RNA, 22 nt, Human
gacuggcugcugaugcaccuug

SEQ ID NO: 42305 - RNA, 21 nt, Human
ccugcagggcaggucaggcug

SEQ ID NO: 42306 - RNA, 23 nt, Human
aaucauuccuuccuugugaucca

SEQ ID NO: 42307 - RNA, 25 nt, Human
ggagcggggccgggaguggagcagc

SEQ ID NO: 42308 - RNA, 24 nt, Human
ugcgccgugccucacacagccgag

SEQ ID NO: 42309 - RNA, 20 nt, Human
cacacacaccggcacuuuca

SEQ ID NO: 42310 - RNA, 24 nt, Human
uuuguuuaugucguuaugaagcau

SEQ ID NO: 42311 - RNA, 26 nt, Human
uaguguccaggcuggucugaaacccu

SEQ ID NO: 42312 - RNA, 22 nt, Human
auacuauaacauauguacauaa

SEQ ID NO: 42313 - RNA, 20 nt, Human
uauggcuucucuuguccuug

SEQ ID NO: 42314 - RNA, 22 nt, Human
gaaagagaacuucucgccaugg

SEQ ID NO: 42315 - RNA, 21 nt, Human
aaauguuuccagugcaagaga

SEQ ID NO: 42316 - RNA, 22 nt, Human
gucuguaaucccagcgcuuugg

SEQ ID NO: 42317 - RNA, 16 nt, Human
ggagagaagcagccag

SEQ ID NO: 42318 - RNA, 28 nt, Human
ggcggugaggacggacagucaccgacuu

SEQ ID NO: 42319 - RNA, 20 nt, Human
caaccuauccugggagaccc

SEQ ID NO: 42320 - RNA, 23 nt, Human
acuggguggaugaaaggccgagg

SEQ ID NO: 42321 - RNA, 20 nt, Human
uugucccaggcugggcagag

SEQ ID NO: 42322 - RNA, 20 nt, Human
aucauuccacucagccuggg

SEQ ID NO: 42323 - RNA, 23 nt, Human
uucauggacuauggacucuuuca

SEQ ID NO: 42324 - RNA, 22 nt, Human
gcaacaugguaaaaccccaucu

SEQ ID NO: 42325 - RNA, 22 nt, Human
gcaacauggcgaaacccugucu

SEQ ID NO: 42326 - RNA, 22 nt, Human
caccgcugcacucaagcuuggg

SEQ ID NO: 42327 - RNA, 27 nt, Human
ccagcauuuccugauuuccucuguggu

SEQ ID NO: 42328 - RNA, 27 nt, Human
gcggcagauugaguuuucuucugugau

SEQ ID NO: 42329 - RNA, 21 nt, Human
acaggguggggguggggaggg

SEQ ID NO: 42330 - RNA, 25 nt, Human
cccaaugcuuuggaaaaugcaagau

SEQ ID NO: 42331 - RNA, 25 nt, Human
gcgccgccucaccucgcuuuucgaa

SEQ ID NO: 42332 - RNA, 23 nt, Human
gaccuccaggaccccacuguugg

SEQ ID NO: 42333 - RNA, 22 nt, Human
ucgaugcagacagggggccaga

SEQ ID NO: 42334 - RNA, 22 nt, Human
uugaggaaguguugagcuuuau

SEQ ID NO: 42335 - RNA, 23 nt, Human
aguguaaauuugacaucgcguug

SEQ ID NO: 42336 - RNA, 28 nt, Human
gacccccggagcaggggucugagccaca

SEQ ID NO: 42337 - RNA, 27 nt, Human
uacuacugagucaaguuuucuaguucu

SEQ ID NO: 42338 - RNA, 26 nt, Human
ucaggagacacaaagaugagacugug

SEQ ID NO: 42339 - RNA, 23 nt, Human
gcaagaauucuguuuccuaggca

SEQ ID NO: 42340 - RNA, 24 nt, Human
acucccucugugucacuguaugug

SEQ ID NO: 42341 - RNA, 22 nt, Human
ugcugcacuccagccuaggcaa

SEQ ID NO: 42342 - RNA, 23 nt, Human
gggcacagccugucacugcucug

SEQ ID NO: 42343 - RNA, 22 nt, Human
cugcaaccucccccuccugggu

SEQ ID NO: 42344 - RNA, 21 nt, Human
ggucaucuggaugcuggucau

SEQ ID NO: 42345 - RNA, 27 nt, Human
agacgcuguuacuuccuaaaauggcgg

SEQ ID NO: 42346 - RNA, 21 nt, Human
gcacaggcugggguggaugac

SEQ ID NO: 42347 - RNA, 21 nt, Human
gacacagcccaggucccuccg

SEQ ID NO: 42348 - RNA, 15 nt, Human
ggacuccucugucca

SEQ ID NO: 42349 - RNA, 21 nt, Human
uacaaggucagggguggggaa

SEQ ID NO: 42350 - RNA, 24 nt, Human
ucugggagagaggauaggauggga

SEQ ID NO: 42351 - RNA, 19 nt, Human
gucuagcuagaccugcacu

SEQ ID NO: 42352 - RNA, 28 nt, Human
aguuggcuuauugccugccucuauacca

SEQ ID NO: 42353 - RNA, 27 nt, Human
ggcucacugcaguuuugaccucccagg

SEQ ID NO: 42354 - RNA, 20 nt, Human
guucuuaucucuagcucaga

SEQ ID NO: 42355 - RNA, 27 nt, Human
ccagaucuuucuucacgcugugcuaca

SEQ ID NO: 42356 - RNA, 22 nt, Human
cugaauccaaacauuuucucca

SEQ ID NO: 42357 - RNA, 20 nt, Human
aggccuguguugagaaagau

SEQ ID NO: 42358 - RNA, 27 nt, Human
cugccacgauguugcugcucagccuga

SEQ ID NO: 42359 - RNA, 22 nt, Human
acgagccucaguuuccucaccu

SEQ ID NO: 42360 - RNA, 23 nt, Human
caaaguacugggauuauauaggc

SEQ ID NO: 42361 - RNA, 22 nt, Human
cuggaacacuggcaucucugag

SEQ ID NO: 42362 - RNA, 25 nt, Human
ccuucucagacuccaguugggccgg

SEQ ID NO: 42363 - RNA, 27 nt, Human
guggcaaaagccacauuacaagcugcc

SEQ ID NO: 42364 - RNA, 27 nt, Human
ugugaaaaugagaucacauacuuuuua

SEQ ID NO: 42365 - RNA, 20 nt, Human
uccagccuggugacagagug

SEQ ID NO: 42366 - RNA, 20 nt, Human
uccagccuggcgacagagcg

SEQ ID NO: 42367 - RNA, 16 nt, Human
cucccauuaagccacc

SEQ ID NO: 42368 - RNA, 27 nt, Human
uuaguaaaaugguaauuuaucccgaaa

SEQ ID NO: 42369 - RNA, 21 nt, Human
cuaaguguuuacuaugugcca

SEQ ID NO: 42370 - RNA, 22 nt, Human
gacuacaggcgugcgccaccau

SEQ ID NO: 42371 - RNA, 22 nt, Human
cuguuugccacugcugcccuca

SEQ ID NO: 42372 - RNA, 22 nt, Human
accugaaacauguuacugggac

SEQ ID NO: 42373 - RNA, 26 nt, Human
gcucacugccuucgaaguccggcgcc

SEQ ID NO: 42374 - RNA, 24 nt, Human
ggugaagcagcaucugggugugag

SEQ ID NO: 42375 - RNA, 22 nt, Human
ugccauugcuacuauugcuugu

SEQ ID NO: 42376 - RNA, 20 nt, Human
guguggugaauguaaaauac

SEQ ID NO: 42377 - RNA, 21 nt, Human
gccauuuacauagacauaucu

SEQ ID NO: 42378 - RNA, 19 nt, Human
agcaagaaguaaaaugaga

SEQ ID NO: 42379 - RNA, 27 nt, Human
cgcugcccagaccauaggagagaugug

SEQ ID NO: 42380 - RNA, 32 nt, Human
gugagggacagagcuaguggggugggcucagc

SEQ ID NO: 42381 - RNA, 19 nt, Human
cuuccucccucccucuuuc

SEQ ID NO: 42382 - RNA, 27 nt, Human
gaguagcugggauuauaggugcgcacc

SEQ ID NO: 42383 - RNA, 25 nt, Human
ggggaaaccaguguagccuugcccg

SEQ ID NO: 42384 - RNA, 18 nt, Human
ugguaaaauaauguccca

SEQ ID NO: 42385 - RNA, 26 nt, Human
uaccauaagccaacaaccgcugacuc

SEQ ID NO: 42386 - RNA, 23 nt, Human
ccccucgcuuucucaacacccuu

SEQ ID NO: 42387 - RNA, 24 nt, Human
cccacauugugccuuuauuuuaug

SEQ ID NO: 42388 - RNA, 29 nt, Human
cugggucuaggcuguucugugccuccaag

SEQ ID NO: 42389 - RNA, 21 nt, Human
acgaguagcuggaauuacagg

SEQ ID NO: 42390 - RNA, 22 nt, Human
ugccuaacuggacaggaagccu

SEQ ID NO: 42391 - RNA, 28 nt, Human
gccggaaccacacccaaguagcugcccu

SEQ ID NO: 42392 - RNA, 18 nt, Human
ugacuucucuguccgaag

SEQ ID NO: 42393 - RNA, 22 nt, Human
ugccuucaggacaauaagugga

SEQ ID NO: 42394 - RNA, 18 nt, Human
acaaaaacaugcuauuuu

SEQ ID NO: 42395 - RNA, 27 nt, Human
guaauguccuucuuuaucugugauaau

SEQ ID NO: 42396 - RNA, 21 nt, Human
ucugcucuccucuuacccacc

SEQ ID NO: 42397 - RNA, 23 nt, Human
ccacgaugccaaaggacagcccu

SEQ ID NO: 42398 - RNA, 26 nt, Human
gacauccugauggggaggcagagcca

SEQ ID NO: 42399 - RNA, 22 nt, Human
uagcccaggccagagugcagug

SEQ ID NO: 42400 - RNA, 25 nt, Human
agggaauuugcuggugaaaagaggc

SEQ ID NO: 42401 - RNA, 22 nt, Human
cugguuuuuguagccuuccucc

SEQ ID NO: 42402 - RNA, 25 nt, Human
cacacagucgcccucauaccccgac

SEQ ID NO: 42403 - RNA, 21 nt, Human
caggcagccuccuuugugugu

SEQ ID NO: 42404 - RNA, 21 nt, Human
acugaguguaccacugccuuc

SEQ ID NO: 42405 - RNA, 22 nt, Human
aggcuagagugcaguggcuauu

SEQ ID NO: 42406 - RNA, 21 nt, Human
uaagggagggggcgcuggagc

SEQ ID NO: 42407 - RNA, 21 nt, Human
cucuuuuccaaugagaaguca

SEQ ID NO: 42408 - RNA, 21 nt, Human
cgcgcugagcagacagagcgg

SEQ ID NO: 42409 - RNA, 20 nt, Human
aaacaaugccaauucaagua

SEQ ID NO: 42410 - RNA, 22 nt, Human
cucaggggguaggagagcacug

SEQ ID NO: 42411 - RNA, 20 nt, Human
gccucaagguagugaggcua

SEQ ID NO: 42412 - RNA, 23 nt, Human
gggggaagaggaagaaaagucgg

SEQ ID NO: 42413 - RNA, 23 nt, Human
gucguuggaggcuggagcgcaau

SEQ ID NO: 42414 - RNA, 27 nt, Human
ccucccccgcccagcuucagcccuggc

SEQ ID NO: 42415 - RNA, 27 nt, Human
agagugccacauuuauuuuuauaucua

SEQ ID NO: 42416 - RNA, 23 nt, Human
ccugccugccgcaccccuguggc

SEQ ID NO: 42417 - RNA, 19 nt, Human
uuuggucugaacaaaccuu

SEQ ID NO: 42418 - RNA, 27 nt, Human
aaaaagagcuuuuguugagauuuggca

SEQ ID NO: 42419 - RNA, 22 nt, Human
cucugucccucuuugccugugu

SEQ ID NO: 42420 - RNA, 21 nt, Human
gcagggcuccgggccugcucu

SEQ ID NO: 42421 - RNA, 23 nt, Human
ucacugcaaauuuccucccauca

SEQ ID NO: 42422 - RNA, 23 nt, Human
uccucuuccuccucucgcugcca

SEQ ID NO: 42423 - RNA, 25 nt, Human
cuaccugcuuuuaaugacucacuuu

SEQ ID NO: 42424 - RNA, 20 nt, Human
cgugugccaucaguggaucc

SEQ ID NO: 42425 - RNA, 18 nt, Human
cccuccagugcuggauuu

SEQ ID NO: 42426 - RNA, 23 nt, Human
ccagguggcaucgccaacuccug

SEQ ID NO: 42427 - RNA, 26 nt, Human
uggagguggaggcaguacccuggacu

SEQ ID NO: 42428 - RNA, 22 nt, Human
cucgccccgccgcuccugcugc

SEQ ID NO: 42429 - RNA, 27 nt, Human
cccuccuucuggcagugggcuggacca

SEQ ID NO: 42430 - RNA, 27 nt, Human
cugcuuugggauuuaauuuccaggguu

SEQ ID NO: 42431 - RNA, 23 nt, Human
uuacuuaucaaaagacagcacua

SEQ ID NO: 42432 - RNA, 20 nt, Human
cugugcuggggauaacuaag

SEQ ID NO: 42433 - RNA, 26 nt, Human
gggcaggcgccauugggcagagggau

SEQ ID NO: 42434 - RNA, 22 nt, Human
acacacacucagcgcgcacuca

SEQ ID NO: 42435 - RNA, 23 nt, Human
uuaagagccuuuuuuguuucugc

SEQ ID NO: 42436 - RNA, 19 nt, Human
gaucccaggaggugcagug

SEQ ID NO: 42437 - RNA, 21 nt, Human
ugacuucuuuaaugcuugaag

SEQ ID NO: 42438 - RNA, 24 nt, Human
ggacuccuuucccuuucuucucug

SEQ ID NO: 42439 - RNA, 18 nt, Human
guggcuuucagggcugga

SEQ ID NO: 42440 - RNA, 22 nt, Human
cuacuacagucuggaguggggu

SEQ ID NO: 42441 - RNA, 22 nt, Human
ccacccugcuauuucucuucca

SEQ ID NO: 42442 - RNA, 28 nt, Human
agguagccucuuggagaugaccguugcg

SEQ ID NO: 42443 - RNA, 20 nt, Human
caggcagcccucugcggaaa

SEQ ID NO: 42444 - RNA, 18 nt, Human
gcggcucugggaagcuca

SEQ ID NO: 42445 - RNA, 24 nt, Human
ucaauccugauuccucucuaagug

SEQ ID NO: 42446 - RNA, 17 nt, Human
uagcuccucccaccucg

SEQ ID NO: 42447 - RNA, 26 nt, Human
gacauggucagucuacuaaaaaacaa

SEQ ID NO: 42448 - RNA, 23 nt, Human
ggugagcagaaguggagcugggg

SEQ ID NO: 42449 - RNA, 22 nt, Human
guagggaagggggcuggaagcc

SEQ ID NO: 42450 - RNA, 21 nt, Human
cgccugccggccagagccucc

SEQ ID NO: 42451 - RNA, 18 nt, Human
auggccucuuugugacca

SEQ ID NO: 42452 - RNA, 21 nt, Human
ccaacugccacuacuccuuca

SEQ ID NO: 42453 - RNA, 27 nt, Human
augguaaaguuaaaaugacaaauugau

SEQ ID NO: 42454 - RNA, 24 nt, Human
aucgagggagcaggagcaucaggc

SEQ ID NO: 42455 - RNA, 23 nt, Human
gugagacucccaucucaaaaaau

SEQ ID NO: 42456 - RNA, 26 nt, Human
acagaagccuguuucagaaaucugga

SEQ ID NO: 42457 - RNA, 21 nt, Human
gggcuguacuggggacugcuc

SEQ ID NO: 42458 - RNA, 21 nt, Human
aucuguaaguaacuucacauu

SEQ ID NO: 42459 - RNA, 22 nt, Human
gccugccuccccucgagcgucc

SEQ ID NO: 42460 - RNA, 24 nt, Human
auggaaggcagacuauuuacagcu

SEQ ID NO: 42461 - RNA, 23 nt, Human
agccucgggcccuccugccugca

SEQ ID NO: 42462 - RNA, 24 nt, Human
ugaauccuuccauuucuucugcac

SEQ ID NO: 42463 - RNA, 23 nt, Human
uccuggcuggagaauguggagaa

SEQ ID NO: 42464 - RNA, 24 nt, Human
cucucugcccagaggcuccugggc

SEQ ID NO: 42465 - RNA, 16 nt, Human
ucggcaucucugugaa

SEQ ID NO: 42466 - RNA, 19 nt, Human
uguucacaccugugggaag

SEQ ID NO: 42467 - RNA, 23 nt, Human
ucauauuguuauuuucucucauc

SEQ ID NO: 42468 - RNA, 22 nt, Human
ggcucuggcuuacccugcaacc

SEQ ID NO: 42469 - RNA, 26 nt, Human
cugagcugcugguucacucuucagca

SEQ ID NO: 42470 - RNA, 28 nt, Human
agaguagcuggaauuacaggcacacacc

SEQ ID NO: 42471 - RNA, 18 nt, Human
uggggguggaggguggga

SEQ ID NO: 42472 - RNA, 21 nt, Human
uguugcccaggcuggucgcga

SEQ ID NO: 42473 - RNA, 20 nt, Human
aacagcuuaguggguguggg

SEQ ID NO: 42474 - RNA, 23 nt, Human
acuguucuguucuguauuuuggc

SEQ ID NO: 42475 - RNA, 22 nt, Human
gugugcaugugugugcucaggg

SEQ ID NO: 42476 - RNA, 23 nt, Human
gggacacaccuguguccuccggg

SEQ ID NO: 42477 - RNA, 22 nt, Human
ugcaaccuccaacucccugguu

SEQ ID NO: 42478 - RNA, 21 nt, Human
aagagccuccuucagcagcua

SEQ ID NO: 42479 - RNA, 27 nt, Human
caggcuggagugcaguggcacgaucuc

SEQ ID NO: 42480 - RNA, 27 nt, Human
caggcuggaguguaguggcaugaucuc

SEQ ID NO: 42481 - RNA, 22 nt, Human
caucauaguagcccagacacau

SEQ ID NO: 42482 - RNA, 20 nt, Human
ugugucccucuaugagggcc

SEQ ID NO: 42483 - RNA, 24 nt, Human
ccgucucucugugcuucccuggcc

SEQ ID NO: 42484 - RNA, 20 nt, Human
ggaggcagcuguugcaguga

SEQ ID NO: 42485 - RNA, 24 nt, Human
uuugggagcuucaggugcuuguua

SEQ ID NO: 42486 - RNA, 19 nt, Human
ggccucggcucuuuacucc

SEQ ID NO: 42487 - RNA, 24 nt, Human
uggauagaaaaaucauuggauaga

SEQ ID NO: 42488 - RNA, 21 nt, Human
uguuugcuugaaaguaucuca

SEQ ID NO: 42489 - RNA, 26 nt, Human
auucuggacauaugcaucauugaugu

SEQ ID NO: 42490 - RNA, 23 nt, Human
auuucccaagcuggagugcagug

SEQ ID NO: 42491 - RNA, 23 nt, Human
acaucaugucagggugagcagag

SEQ ID NO: 42492 - RNA, 20 nt, Human
aggugguggaguggagugag

SEQ ID NO: 42493 - RNA, 25 nt, Human
ggggugagggaauaugagugcgugg

SEQ ID NO: 42494 - RNA, 24 nt, Human
uucagugacaaaggccuuugcugu

SEQ ID NO: 42495 - RNA, 20 nt, Human
uucuagaaaaauauaucuaa

SEQ ID NO: 42496 - RNA, 26 nt, Human
aggccaaacucccacucucugccccc

SEQ ID NO: 42497 - RNA, 21 nt, Human
caaccacauuucuggccauuu

SEQ ID NO: 42498 - RNA, 19 nt, Human
aggaagggagaccacugug

SEQ ID NO: 42499 - RNA, 25 nt, Human
ugacauccuuucuuuuaaugaugcc

SEQ ID NO: 42500 - RNA, 22 nt, Human
uagguucaccaguugagggaca

SEQ ID NO: 42501 - RNA, 27 nt, Human
aaauguuccacaaggcgggaguguuuc

SEQ ID NO: 42502 - RNA, 26 nt, Human
acguccucgugagaugagagccugag

SEQ ID NO: 42503 - RNA, 21 nt, Human
gcggcuugccauuuucuuagu

SEQ ID NO: 42504 - RNA, 23 nt, Human
aguuucaguauuagaugcacuua

SEQ ID NO: 42505 - RNA, 22 nt, Human
ccuuccccugagcccagaucug

SEQ ID NO: 42506 - RNA, 24 nt, Human
aaaguauuuugccauggauauaga

SEQ ID NO: 42507 - RNA, 22 nt, Human
ggcuguguuuggcuuucaggga

SEQ ID NO: 42508 - RNA, 21 nt, Human
cugugccaagccuagcacuug

SEQ ID NO: 42509 - RNA, 22 nt, Human
ugugagcccuuauuugagagcu

SEQ ID NO: 42510 - RNA, 18 nt, Human
cucuccuccgcucaggcc

SEQ ID NO: 42511 - RNA, 26 nt, Human
cuguucuguuuccugugucuccaagc

SEQ ID NO: 42512 - RNA, 25 nt, Human
ucauccagaaauuauggaaacaggg

SEQ ID NO: 42513 - RNA, 25 nt, Human
cacugcaaacaugcaugauucucca

SEQ ID NO: 42514 - RNA, 22 nt, Human
caugccuguaaucucagcaauu

SEQ ID NO: 42515 - RNA, 23 nt, Human
agccuccugacccuucccagccc

SEQ ID NO: 42516 - RNA, 23 nt, Human
uuuuuccuuccuuccuuccauug

SEQ ID NO: 42517 - RNA, 24 nt, Human
aguguucuucuuucacacuucuca

SEQ ID NO: 42518 - RNA, 27 nt, Human
agcaguuuugcucaugacuuaccauuc

SEQ ID NO: 42519 - RNA, 27 nt, Human
ggaggguggggaugggaggggagagac

SEQ ID NO: 42520 - RNA, 21 nt, Human
acugguuuuucauguguuuuu

SEQ ID NO: 42521 - RNA, 20 nt, Human
aauguguuagacaagccaca

SEQ ID NO: 42522 - RNA, 22 nt, Human
ugauugccacugccaucuggaa

SEQ ID NO: 42523 - RNA, 24 nt, Human
gggucccuccauccuugggcuucc

SEQ ID NO: 42524 - RNA, 28 nt, Human
gggauucacgcuccagccuccuucuugg

SEQ ID NO: 42525 - RNA, 25 nt, Human
cuccugagcugccuucccgccuggu

SEQ ID NO: 42526 - RNA, 23 nt, Human
ugccauucauguccuguaauacu

SEQ ID NO: 42527 - RNA, 20 nt, Human
cagagggcagcaggagcagc

SEQ ID NO: 42528 - RNA, 27 nt, Human
uggguagacuuaggaauuuucuacuug

SEQ ID NO: 42529 - RNA, 26 nt, Human
uaaacauguuuuuaccugcucucucu

SEQ ID NO: 42530 - RNA, 21 nt, Human
ucuagccucuuuguguuuuug

SEQ ID NO: 42531 - RNA, 23 nt, Human
gccagcccucccuguccuccucg

SEQ ID NO: 42532 - RNA, 26 nt, Human
uuuucgguguuuaaaaaaugagccca

SEQ ID NO: 42533 - RNA, 18 nt, Human
ccgagugccugcugcagu

SEQ ID NO: 42534 - RNA, 26 nt, Human
uugucuucuggcuggaggugcuuuug

SEQ ID NO: 42535 - RNA, 26 nt, Human
ucacagucucaguucucuugcuuuca

SEQ ID NO: 42536 - RNA, 22 nt, Human
ccacugcacuauagccuaggug

SEQ ID NO: 42537 - RNA, 22 nt, Human
uaggugaucgagggugugccca

SEQ ID NO: 42538 - RNA, 23 nt, Human
ggaaaucaggucgauuuguggua

SEQ ID NO: 42539 - RNA, 23 nt, Human
gugauguaaacuuuuaaacauug

SEQ ID NO: 42540 - RNA, 27 nt, Human
gcuccuugccagcucccucuucccuua

SEQ ID NO: 42541 - RNA, 22 nt, Human
guacgcagcacccacagcaccg

SEQ ID NO: 42542 - RNA, 24 nt, Human
ggcacagccagugcauuccugccu

SEQ ID NO: 42543 - RNA, 27 nt, Human
cugugugaccuugggcaagucacuuca

SEQ ID NO: 42544 - RNA, 20 nt, Human
ccgggagcggauggagaagc

SEQ ID NO: 42545 - RNA, 21 nt, Human
uucuacacuucuuuuuucccc

SEQ ID NO: 42546 - RNA, 22 nt, Human
ugccagacuggagugcaguggc

SEQ ID NO: 42547 - RNA, 23 nt, Human
guggcaccacugcacuccagccu

SEQ ID NO: 42548 - RNA, 22 nt, Human
cugacagaugguaucugccagu

SEQ ID NO: 42549 - RNA, 21 nt, Human
ucaaggagcuaguuuacaggc

SEQ ID NO: 42550 - RNA, 21 nt, Human
gaggaagacggaaaagacugc

SEQ ID NO: 42551 - RNA, 22 nt, Human
agaacaaugccaacaaagcuua

SEQ ID NO: 42552 - RNA, 22 nt, Human
agauggauucuccacucaguug

SEQ ID NO: 42553 - RNA, 18 nt, Human
acucuuaaaaauguuuuu

SEQ ID NO: 42554 - RNA, 21 nt, Human
ccauggguagcaacaagagca

SEQ ID NO: 42555 - RNA, 21 nt, Human
guguacuguccugccugugca

SEQ ID NO: 42556 - RNA, 30 nt, Human
agccauugacugcaacuuguucuuuugccc

SEQ ID NO: 42557 - RNA, 20 nt, Human
acuuccauuaggugaagauu

SEQ ID NO: 42558 - RNA, 21 nt, Human
ggugaacugcaacuggcuguu

SEQ ID NO: 42559 - RNA, 27 nt, Human
guauagacuauggucgaagaaaaagaa

SEQ ID NO: 42560 - RNA, 25 nt, Human
cccccaggcuuggggggaaaacagg

SEQ ID NO: 42561 - RNA, 24 nt, Human
acagacccacagcccugcccuugu

SEQ ID NO: 42562 - RNA, 25 nt, Human
cugccacccucugcugucaucagcu

SEQ ID NO: 42563 - RNA, 22 nt, Human
ggcuaauuuuuguauuuuuagu

SEQ ID NO: 42564 - RNA, 16 nt, Human
cuuuuguaccuagcuc

SEQ ID NO: 42565 - RNA, 21 nt, Human
cucauggucucaugcuuaauc

SEQ ID NO: 42566 - RNA, 18 nt, Human
cuuugcagucgcugccuu

SEQ ID NO: 42567 - RNA, 22 nt, Human
guucuacauuccacagucuuua

SEQ ID NO: 42568 - RNA, 22 nt, Human
gaacccaggagacggugguugc

SEQ ID NO: 42569 - RNA, 22 nt, Human
acaguccccagagugugauauu

SEQ ID NO: 42570 - RNA, 21 nt, Human
aaacuauuuauuguaagcuua

SEQ ID NO: 42571 - RNA, 25 nt, Human
uuagugcuuuuugugucauguuuaa

SEQ ID NO: 42572 - RNA, 27 nt, Human
cugaauguagacggaacaguguggaag

SEQ ID NO: 42573 - RNA, 26 nt, Human
cucugggccucaucagaccaaaccaa

SEQ ID NO: 42574 - RNA, 25 nt, Human
ccuucuccuccuccuaccugggccu

SEQ ID NO: 42575 - RNA, 21 nt, Human
uguggggucuccuggguucag

SEQ ID NO: 42576 - RNA, 21 nt, Human
agcuacuccccuuucuuccaa

SEQ ID NO: 42577 - RNA, 24 nt, Human
aucuccugccuggguucgguuuca

SEQ ID NO: 42578 - RNA, 22 nt, Human
caguagaccuaaaaggguuuua

SEQ ID NO: 42579 - RNA, 22 nt, Human
uuccauucuuuacauugucaug

SEQ ID NO: 42580 - RNA, 20 nt, Human
cuuccgccccugccugccau

SEQ ID NO: 42581 - RNA, 22 nt, Human
ggagggacagggagcagggcag

SEQ ID NO: 42582 - RNA, 19 nt, Human
acagaaccuggugaagagc

SEQ ID NO: 42583 - RNA, 20 nt, Human
cacugguuuuuuguuauccu

SEQ ID NO: 42584 - RNA, 20 nt, Human
gagcaagcuuacacaagaag

SEQ ID NO: 42585 - RNA, 20 nt, Human
agugacuucacagagacgca

SEQ ID NO: 42586 - RNA, 21 nt, Human
acacagccuucauuucaacuu

SEQ ID NO: 42587 - RNA, 22 nt, Human
cuaucuagcuaauuuuuuaaau

SEQ ID NO: 42588 - RNA, 22 nt, Human
gaguccagccccuccucccuca

SEQ ID NO: 42589 - RNA, 19 nt, Human
ccuaucuuucuucuucuau

SEQ ID NO: 42590 - RNA, 21 nt, Human
cgugagccacugcguccugcc

SEQ ID NO: 42591 - RNA, 22 nt, Human
gcuaccugauuucuaugaaaug

SEQ ID NO: 42592 - RNA, 23 nt, Human
ccugcaacuucuauccuuucuuc

SEQ ID NO: 42593 - RNA, 22 nt, Human
uuuuuguauagcuucagacugg

SEQ ID NO: 42594 - RNA, 26 nt, Human
ccuccuggccccauccuccugguccu

SEQ ID NO: 42595 - RNA, 27 nt, Human
ugcggaguugugccgagugccugcugc

SEQ ID NO: 42596 - RNA, 20 nt, Human
ggaguuccuguuuugcucau

SEQ ID NO: 42597 - RNA, 27 nt, Human
agggucuggggucaccccugccucauc

SEQ ID NO: 42598 - RNA, 21 nt, Human
guguccuuuucacuacaccau

SEQ ID NO: 42599 - RNA, 22 nt, Human
gggcaggugcauaccuugggga

SEQ ID NO: 42600 - RNA, 25 nt, Human
uguuaucugugaaugcacauauuaa

SEQ ID NO: 42601 - RNA, 27 nt, Human
cuuugauucuccuucagcccucacccc

SEQ ID NO: 42602 - RNA, 32 nt, Human
acaccacacuguacuuuuucccccugcccccg

SEQ ID NO: 42603 - RNA, 21 nt, Human
gaguccauccuucccagguuc

SEQ ID NO: 42604 - RNA, 22 nt, Human
ucuuucagauuucuauuuugga

SEQ ID NO: 42605 - RNA, 22 nt, Human
cucggcuucccaaguagcuggg

SEQ ID NO: 42606 - RNA, 20 nt, Human
agagcagaagcagaagagua

SEQ ID NO: 42607 - RNA, 22 nt, Human
cuugggucccagggaaguuuug

SEQ ID NO: 42608 - RNA, 27 nt, Human
gaaagguugggggaggcugggagaggg

SEQ ID NO: 42609 - RNA, 20 nt, Human
aagaucauaguauuucaguc

SEQ ID NO: 42610 - RNA, 19 nt, Human
ccuuuuccaaccuaccuca

SEQ ID NO: 42611 - RNA, 21 nt, Human
caacagguuaaaacucggcuu

SEQ ID NO: 42612 - RNA, 21 nt, Human
gcugggugggagcccagaagg

SEQ ID NO: 42613 - RNA, 21 nt, Human
ggaggcgaagauugcagugag

SEQ ID NO: 42614 - RNA, 22 nt, Human
ccuuccuuccuccucuguuuag

SEQ ID NO: 42615 - RNA, 23 nt, Human
ggaggcuguggcagcuguggcau

SEQ ID NO: 42616 - RNA, 21 nt, Human
cacacagacacacacauguau

SEQ ID NO: 42617 - RNA, 23 nt, Human
gauugcuuaccuacauacguguu

SEQ ID NO: 42618 - RNA, 22 nt, Human
uuugcacuaaaguuucugugau

SEQ ID NO: 42619 - RNA, 29 nt, Human
cccagccacccaggacuccugggacaucc

SEQ ID NO: 42620 - RNA, 20 nt, Human
uuagugcuuugagauuguga

SEQ ID NO: 42621 - RNA, 19 nt, Human
ugaaaucccagcccugccc

SEQ ID NO: 42622 - RNA, 19 nt, Human
aaaggcugggcgggcagug

SEQ ID NO: 42623 - RNA, 24 nt, Human
gggcgccuguaaucccagcuacuu

SEQ ID NO: 42624 - RNA, 22 nt, Human
uguauguccuucuguucugccu

SEQ ID NO: 42625 - RNA, 21 nt, Human
cacaugauucuccugccucag

SEQ ID NO: 42626 - RNA, 22 nt, Human
aucaccuaccggcuggugcagu

SEQ ID NO: 42627 - RNA, 22 nt, Human
uauuaaaagugacauuugucua

SEQ ID NO: 42628 - RNA, 25 nt, Human
gaccucaggugauccgcccaccucg

SEQ ID NO: 42629 - RNA, 25 nt, Human
gaccucaagugauccacccaccucg

SEQ ID NO: 42630 - RNA, 27 nt, Human
cggccuacacgcuugggggacagcccu

SEQ ID NO: 42631 - RNA, 25 nt, Human
guugcccaggcugguuucgaacucg

SEQ ID NO: 42632 - RNA, 23 nt, Human
gcuagagccaccauuagacucag

SEQ ID NO: 42633 - RNA, 24 nt, Human
aggcgguggcaguggagcugcuuc

SEQ ID NO: 42634 - RNA, 26 nt, Human
cucucucucaccaugugacacacugg

SEQ ID NO: 42635 - RNA, 32 nt, Human
gccucgggaggugguggagugaccuggcccca

SEQ ID NO: 42636 - RNA, 22 nt, Human
uuccugucagggaucagggcag

SEQ ID NO: 42637 - RNA, 25 nt, Human
gccgugcucuccagccuggcugcca

SEQ ID NO: 42638 - RNA, 23 nt, Human
auugccagaguuuugccugcugc

SEQ ID NO: 42639 - RNA, 20 nt, Human
ucauuaaccugggguccggg

SEQ ID NO: 42640 - RNA, 23 nt, Human
ggcucaacagaacauugaccugg

SEQ ID NO: 42641 - RNA, 21 nt, Human
ccaaaguggauuaauuacacg

SEQ ID NO: 42642 - RNA, 21 nt, Human
uggaggugauauuuuccucaa

SEQ ID NO: 42643 - RNA, 28 nt, Human
ugggcuuuuggauuauguguacaguugg

SEQ ID NO: 42644 - RNA, 23 nt, Human
uaccacucuuuuacugugcacau

SEQ ID NO: 42645 - RNA, 21 nt, Human
cugagccucaggguuuuguuu

SEQ ID NO: 42646 - RNA, 28 nt, Human
gaauguugacccauuugaguacgcuaaa

SEQ ID NO: 42647 - RNA, 21 nt, Human
cuuccacagagggaaguuuaa

SEQ ID NO: 42648 - RNA, 18 nt, Human
acaucccggacuccaucu

SEQ ID NO: 42649 - RNA, 23 nt, Human
guugcccaggcuggaaugcagug

SEQ ID NO: 42650 - RNA, 21 nt, Human
agcuauaaauuaccuggucau

SEQ ID NO: 42651 - RNA, 19 nt, Human
gccgggaugacagcucucc

SEQ ID NO: 42652 - RNA, 22 nt, Human
cccugcagggaguaccgaccua

SEQ ID NO: 42653 - RNA, 22 nt, Human
cugaggcaccagaauugcuuga

SEQ ID NO: 42654 - RNA, 22 nt, Human
gagggagcugaggccucccuug

SEQ ID NO: 42655 - RNA, 18 nt, Human
acagaguuuucacucuua

SEQ ID NO: 42656 - RNA, 22 nt, Human
ccccccucagccccugccucca

SEQ ID NO: 42657 - RNA, 21 nt, Human
uguuugccagacugggugcag

SEQ ID NO: 42658 - RNA, 26 nt, Human
cuguuauuuugggccugaugugacac

SEQ ID NO: 42659 - RNA, 21 nt, Human
ucccuuggccuuccucagcuu

SEQ ID NO: 42660 - RNA, 25 nt, Human
uugcagcugcucuugcaucugggcc

SEQ ID NO: 42661 - RNA, 27 nt, Human
aaaugucccccauugaggacaacagcc

SEQ ID NO: 42662 - RNA, 22 nt, Human
uaccuccuggguucaagggauu

SEQ ID NO: 42663 - RNA, 19 nt, Human
ucuuucaagugacuuuugg

SEQ ID NO: 42664 - RNA, 23 nt, Human
aggcccuuccucuccacugccuu

SEQ ID NO: 42665 - RNA, 26 nt, Human
gggguagcagcaggacagacagugaa

SEQ ID NO: 42666 - RNA, 22 nt, Human
auuggaaaagcucccugccuuc

SEQ ID NO: 42667 - RNA, 25 nt, Human
gucagauugcugucagacauggccc

SEQ ID NO: 42668 - RNA, 26 nt, Human
ucagcacagaaauagauguggacuuu

SEQ ID NO: 42669 - RNA, 24 nt, Human
ggcaguggaguagggaaugggagg

SEQ ID NO: 42670 - RNA, 22 nt, Human
cuuuacuggcccugacugcugu

SEQ ID NO: 42671 - RNA, 30 nt, Human
gauacuggcaauacuccagccuggugacag

SEQ ID NO: 42672 - RNA, 24 nt, Human
aaucuaggaaaauauuuugaucuu

SEQ ID NO: 42673 - RNA, 24 nt, Human
ugccuguccuccagcugucugacu

SEQ ID NO: 42674 - RNA, 28 nt, Human
ccaggauggcagaggcggaauugcacaa

SEQ ID NO: 42675 - RNA, 22 nt, Human
aggacaucagaccucccuaccu

SEQ ID NO: 42676 - RNA, 18 nt, Human
cucuccucagcccaugcc

SEQ ID NO: 42677 - RNA, 22 nt, Human
ugcuugaacccaggaggcagag

SEQ ID NO: 42678 - RNA, 24 nt, Human
auaccuccuggcugggugaggcgg

SEQ ID NO: 42679 - RNA, 22 nt, Human
cucgcaggagcaacacgugaug

SEQ ID NO: 42680 - RNA, 18 nt, Human
uugcccagggcacacgcc

SEQ ID NO: 42681 - RNA, 22 nt, Human
aacauggucaccaucuaacuau

SEQ ID NO: 42682 - RNA, 22 nt, Human
cccuaugggggagcugccucac

SEQ ID NO: 42683 - RNA, 23 nt, Human
aggcagauacaggaaaagcugcu

SEQ ID NO: 42684 - RNA, 27 nt, Human
aggaggccacaguccuuccuggggcau

SEQ ID NO: 42685 - RNA, 20 nt, Human
cagguaucaugucucaauua

SEQ ID NO: 42686 - RNA, 18 nt, Human
uggccuccugaugcugug

SEQ ID NO: 42687 - RNA, 19 nt, Human
ccacugggccaagugcagu

SEQ ID NO: 42688 - RNA, 23 nt, Human
uagcaaaacauccugugucuuuu

SEQ ID NO: 42689 - RNA, 19 nt, Human
aucaauacuguuucuuccu

SEQ ID NO: 42690 - RNA, 22 nt, Human
ccaguuuucagcacuagucuua

SEQ ID NO: 42691 - RNA, 23 nt, Human
cuucugcuggaguuauugacauu

SEQ ID NO: 42692 - RNA, 26 nt, Human
ggagaucugucagcucauucuugccu

SEQ ID NO: 42693 - RNA, 22 nt, Human
ccagauuguggugggcccugag

SEQ ID NO: 42694 - RNA, 30 nt, Human
ugguugggugcaccuguaguucuguuuauu

SEQ ID NO: 42695 - RNA, 22 nt, Human
gcacagccaaguuacacuccuc

SEQ ID NO: 42696 - RNA, 22 nt, Human
ccaucgccaacuccugcgauca

SEQ ID NO: 42697 - RNA, 26 nt, Human
gacgggacucaggucaucaaaaugaa

SEQ ID NO: 42698 - RNA, 27 nt, Human
cacauuuaauaucuucagcucuuuuug

SEQ ID NO: 42699 - RNA, 22 nt, Human
gugggagggagggcagagcucu

SEQ ID NO: 42700 - RNA, 23 nt, Human
auucuccaacccaaaguauucuu

SEQ ID NO: 42701 - RNA, 26 nt, Human
caggaggccgagcugcggcgcgugga

SEQ ID NO: 42702 - RNA, 23 nt, Human
guuaggcuugguuagagugcagc

SEQ ID NO: 42703 - RNA, 19 nt, Human
uucccccuugcuguucuca

SEQ ID NO: 42704 - RNA, 20 nt, Human
uaaugcuggaggcugagcca

SEQ ID NO: 42705 - RNA, 24 nt, Human
uuccugagcuuucuccugucgguu

SEQ ID NO: 42706 - RNA, 24 nt, Human
ggagagaaggacuuuggucuccgg

SEQ ID NO: 42707 - RNA, 21 nt, Human
uuacaagccuuauaagaaaua

SEQ ID NO: 42708 - RNA, 21 nt, Human
ucugguuuucgcuuuccuccg

SEQ ID NO: 42709 - RNA, 24 nt, Human
uuuggagcaccacaguuguccugg

SEQ ID NO: 42710 - RNA, 27 nt, Human
ucagaaucugugugaaguuacacaauu

SEQ ID NO: 42711 - RNA, 22 nt, Human
caggcuggagugcaauggcgcg

SEQ ID NO: 42712 - RNA, 22 nt, Human
caggcuagagugcaguggcgcg

SEQ ID NO: 42713 - RNA, 24 nt, Human
auggggucaauaccaccuaccuca

SEQ ID NO: 42714 - RNA, 22 nt, Human
ugggcacagagaggggccugug

SEQ ID NO: 42715 - RNA, 25 nt, Human
acgaucauagguggucacuacaguc

SEQ ID NO: 42716 - RNA, 18 nt, Human
uuuucaucuuccauucua

SEQ ID NO: 42717 - RNA, 23 nt, Human
acacauuugcauuguaaaugaua

SEQ ID NO: 42718 - RNA, 25 nt, Human
ggacccaggccaggugggagucugc

SEQ ID NO: 42719 - RNA, 21 nt, Human
gagcugaaaugcugcauuuua

SEQ ID NO: 42720 - RNA, 24 nt, Human
cauuccccaccugguccucccccu

SEQ ID NO: 42721 - RNA, 21 nt, Human
uacuugcuggcacugcaccug

SEQ ID NO: 42722 - RNA, 24 nt, Human
gauaaacauaguagggaagggaau

SEQ ID NO: 42723 - RNA, 23 nt, Human
gaaaauuuaagacaaguucaaca

SEQ ID NO: 42724 - RNA, 25 nt, Human
ccucauucuccucuggccucuaaua

SEQ ID NO: 42725 - RNA, 26 nt, Human
uuucucucacuggcaacucuucagag

SEQ ID NO: 42726 - RNA, 19 nt, Human
gggaugcugugagcauuaa

SEQ ID NO: 42727 - RNA, 21 nt, Human
ccacaugcagccagauguuug

SEQ ID NO: 42728 - RNA, 27 nt, Human
gggagagaagaagggggucuuugccca

SEQ ID NO: 42729 - RNA, 20 nt, Human
uucuuccagggccucuggca

SEQ ID NO: 42730 - RNA, 29 nt, Human
cuggugcaccuagagagguugccuggugg

SEQ ID NO: 42731 - RNA, 18 nt, Human
ccuugcucucccaggauc

SEQ ID NO: 42732 - RNA, 21 nt, Human
acuuagucauuguucuguguu

SEQ ID NO: 42733 - RNA, 23 nt, Human
uuugcuguuccccagcagccugc

SEQ ID NO: 42734 - RNA, 21 nt, Human
guggcgcagugaggagggggc

SEQ ID NO: 42735 - RNA, 22 nt, Human
gugcugcugacuucaccccacu

SEQ ID NO: 42736 - RNA, 30 nt, Human; identical to SEQ ID NO: 5692

SEQ ID NO: 42737 - RNA, 25 nt, Human
ccaaaacaaaggcagcauccggggc

SEQ ID NO: 42738 - RNA, 19 nt, Human
cuccauaucaauccauucu

SEQ ID NO: 42739 - RNA, 25 nt, Human
gggggcuucauccuuccagggagga

SEQ ID NO: 42740 - RNA, 25 nt, Human
ggauggugcuugccgcguaucaugg

SEQ ID NO: 42741 - RNA, 24 nt, Human
aggugcauaccaccacaccaggcu

SEQ ID NO: 42742 - RNA, 23 nt, Human
uuagcacucacugacucuucuau

SEQ ID NO: 42743 - RNA, 21 nt, Human
agcagcaccugggaaugcugc

SEQ ID NO: 42744 - RNA, 27 nt, Human
aauuggauaaauacacacaccauacac

SEQ ID NO: 42745 - RNA, 25 nt, Human
auggcauucgcagugcccagugaug

SEQ ID NO: 42746 - RNA, 25 nt, Human
uucucucucaaacugucuuuucuca

SEQ ID NO: 42747 - RNA, 26 nt, Human
caacagcaagaaaaucucauuuaucu

SEQ ID NO: 42748 - RNA, 28 nt, Human
gagcgggcgucgcucagcagcaggucgc

SEQ ID NO: 42749 - RNA, 25 nt, Human
ccugcugccuccccaacccugcccc

SEQ ID NO: 42750 - RNA, 19 nt, Human
cucucucuccccuuggagc

SEQ ID NO: 42751 - RNA, 20 nt, Human
guauuucuauuucuuuugga

SEQ ID NO: 42752 - RNA, 22 nt, Human
ccagagugcugggauuacaauu

SEQ ID NO: 42753 - RNA, 22 nt, Human
gggcuguaggaauggaagcuuc

SEQ ID NO: 42754 - RNA, 23 nt, Human
cagcuccguuuggcagugcaaug

SEQ ID NO: 42755 - RNA, 19 nt, Human
cagggagagggugaagcag

SEQ ID NO: 42756 - RNA, 19 nt, Human
aguaaagcccugaaauaga

SEQ ID NO: 42757 - RNA, 21 nt, Human
cugaguucuugaagcauuuca

SEQ ID NO: 42758 - RNA, 22 nt, Human
cugcacagaccuggagcgccac

SEQ ID NO: 42759 - RNA, 21 nt, Human
ugaacaucuaaaguguguaga

SEQ ID NO: 42760 - RNA, 26 nt, Human
ugagcuguaacaaagccucuuuaaau

SEQ ID NO: 42761 - RNA, 27 nt, Human
gggcucugcucggaaaucguccuggcc

SEQ ID NO: 42762 - RNA, 26 nt, Human
gcuuuuauccuggugccugauugggg

SEQ ID NO: 42763 - RNA, 23 nt, Human
cuggggacaggaucccugcugca

SEQ ID NO: 42764 - RNA, 21 nt, Human
ucaaagcaacaccaccaccac

SEQ ID NO: 42765 - RNA, 21 nt, Human
gcaccuggccugcucuuccca

SEQ ID NO: 42766 - RNA, 27 nt, Human
ugugccgggccaagauacucacaggcu

SEQ ID NO: 42767 - RNA, 30 nt, Human
gggagagaaaaccuuccagcagcccaguaa

SEQ ID NO: 42768 - RNA, 22 nt, Human
ucauccacagcuucucacugcc

SEQ ID NO: 42769 - RNA, 19 nt, Human
uccuguccccuugggcacu

SEQ ID NO: 42770 - RNA, 25 nt, Human
aaaacaugugcauuuuacaguucag

SEQ ID NO: 42771 - RNA, 21 nt, Human
gcccuacugcaaucuacugca

SEQ ID NO: 42772 - RNA, 21 nt, Human
gcugggagcaggacugauuga

SEQ ID NO: 42773 - RNA, 23 nt, Human
uuucuucugcccccuccugaguc

SEQ ID NO: 42774 - RNA, 21 nt, Human
gagucuggcuggaacacuuuc

SEQ ID NO: 42775 - RNA, 27 nt, Human
uugcccagcccugcuggcaaucucucc

SEQ ID NO: 42776 - RNA, 26 nt, Human
ggcuggaggaagggggguugcagugg

SEQ ID NO: 42777 - RNA, 22 nt, Human
ucgccgaggcugcagugcagcg

SEQ ID NO: 42778 - RNA, 19 nt, Human
ccuccuggcacugcuguuu

SEQ ID NO: 42779 - RNA, 22 nt, Human
gaaagagagcaagaacaugugg

SEQ ID NO: 42780 - RNA, 21 nt, Human
aauauaaaaauaaagcacuua

SEQ ID NO: 42781 - RNA, 28 nt, Human
ucuagagagguacaguuguaagucagag

SEQ ID NO: 42782 - RNA, 20 nt, Human
ccaaguaggauuacaagcau

SEQ ID NO: 42783 - RNA, 26 nt, Human
cugcagauggccuuauuuguguauuu

SEQ ID NO: 42784 - RNA, 20 nt, Human
gcugucaauaaaugacaccc

SEQ ID NO: 42785 - RNA, 24 nt, Human
cauuuuuacuguuauccuauuuag

SEQ ID NO: 42786 - RNA, 20 nt, Human
cacugcacccaccaagucaa

SEQ ID NO: 42787 - RNA, 20 nt, Human
cuggaaaccacacuucuuga

SEQ ID NO: 42788 - RNA, 22 nt, Human
gaagugagcuguucagaggcag

SEQ ID NO: 42789 - RNA, 23 nt, Human
uuagaucuuucaauacucuuaaa

SEQ ID NO: 42790 - RNA, 20 nt, Human
agauuauaucacuaucacca

SEQ ID NO: 42791 - RNA, 26 nt, Human
ccagccuggcuggccugcaggugucu

SEQ ID NO: 42792 - RNA, 20 nt, Human
cauuuaugcagaguucagga

SEQ ID NO: 42793 - RNA, 22 nt, Human
guggccuuuagcaaaacuggac

SEQ ID NO: 42794 - RNA, 24 nt, Human
cuguaaaauuuuaaacgguugugu

SEQ ID NO: 42795 - RNA, 24 nt, Human
ccacugcucucccccuugcccucc

SEQ ID NO: 42796 - RNA, 22 nt, Human
agaagcagccgggggcgcugac

SEQ ID NO: 42797 - RNA, 21 nt, Human
ccagcuuuucugggggucuca

SEQ ID NO: 42798 - RNA, 20 nt, Human
cuugcuugcuuuauuagugu

SEQ ID NO: 42799 - RNA, 23 nt, Human
ccugcuuguacaacaugguuugg

SEQ ID NO: 42800 - RNA, 19 nt, Human
ggguuucugcuugcuccuc

SEQ ID NO: 42801 - RNA, 23 nt, Human
gguaaaaucacuucagaucucua

SEQ ID NO: 42802 - RNA, 18 nt, Human
acugagggccugccugug

SEQ ID NO: 42803 - RNA, 26 nt, Human
ggugccagcuguguccuggguuaggg

SEQ ID NO: 42804 - RNA, 25 nt, Human
ucugaggggcccuugaggccaaucu

SEQ ID NO: 42805 - RNA, 20 nt, Human
agugggcugcacccacccag

SEQ ID NO: 42806 - RNA, 26 nt, Human
uagccaucuuacuuggcuuuuuacua

SEQ ID NO: 42807 - RNA, 22 nt, Human
cagagggagcaggaagaguugc

SEQ ID NO: 42808 - RNA, 26 nt, Human
gccuagaaaaguuuggucugcacuau

SEQ ID NO: 42809 - RNA, 22 nt, Human
cagaagccagccuuucgcuccc

SEQ ID NO: 42810 - RNA, 20 nt, Human
agaacaauccugcagucuug

SEQ ID NO: 42811 - RNA, 24 nt, Human
ucggguggggaaggaggcccagac

SEQ ID NO: 42812 - RNA, 26 nt, Human
cccuauuccuccuucccuugccuucu

SEQ ID NO: 42813 - RNA, 23 nt, Human
ccauggcgagaauccagcuuuga

SEQ ID NO: 42814 - RNA, 24 nt, Human
accagggucuuaucucucugggac

SEQ ID NO: 42815 - RNA, 22 nt, Human
ucaaguagcugggacuacaggu

SEQ ID NO: 42816 - RNA, 20 nt, Human
guuauuuuggggaaauaaau

SEQ ID NO: 42817 - RNA, 26 nt, Human
uugugccuuucaucagaaagucaauc

SEQ ID NO: 42818 - RNA, 20 nt, Human
acuugacaaauaguucgaag

SEQ ID NO: 42819 - RNA, 24 nt, Human
ucuucccucucucccaauaaaagg

SEQ ID NO: 42820 - RNA, 28 nt, Human
cugauccucagccccuccagucguuauu

SEQ ID NO: 42821 - RNA, 21 nt, Human
acagccaggcuggagucagug

SEQ ID NO: 42822 - RNA, 24 nt, Human
cugaggcuuuaaaaagccaagaca

SEQ ID NO: 42823 - RNA, 28 nt, Human
cagcauuucuauccugacugccucuugg

SEQ ID NO: 42824 - RNA, 24 nt, Human
cccauagaccacauucaucuccac

SEQ ID NO: 42825 - RNA, 18 nt, Human
gccauaaaacuagccagg

SEQ ID NO: 42826 - RNA, 24 nt, Human
ccgcugucugcugcugccucuuuc

SEQ ID NO: 42827 - RNA, 14 nt, Human
ugcccuuucuugaa

SEQ ID NO: 42828 - RNA, 22 nt, Human
ggagaggggccaagagcgcggc

SEQ ID NO: 42829 - RNA, 23 nt, Human
cacagcccaguucccgugacgag

SEQ ID NO: 42830 - RNA, 21 nt, Human
gcugcucccugacagcaccug

SEQ ID NO: 42831 - RNA, 26 nt, Human
gcaggcugggcccaggaggucagguu

SEQ ID NO: 42832 - RNA, 24 nt, Human
ccccaggcuggagcagcaugaggc

SEQ ID NO: 42833 - RNA, 19 nt, Human
ucacucuaugucagugugg

SEQ ID NO: 42834 - RNA, 20 nt, Human
uugaaucucccaguguucag

SEQ ID NO: 42835 - RNA, 27 nt, Human
cacugcacccccagcccugcacccuca

SEQ ID NO: 42836 - RNA, 21 nt, Human
cuuccugggucuaccacucag

SEQ ID NO: 42837 - RNA, 22 nt, Human
cccagugccaagcacagugccu

SEQ ID NO: 42838 - RNA, 23 nt, Human
aaccuauaugugauggagaucac

SEQ ID NO: 42839 - RNA, 28 nt, Human
gaagcaguuccagaaguucugggcugga

SEQ ID NO: 42840 - RNA, 19 nt, Human
ccuccaucuccuggauuca

SEQ ID NO: 42841 - RNA, 22 nt, Human
acaaucucgacucacugcagcu

SEQ ID NO: 42842 - RNA, 22 nt, Human
ucucgaugccacuccugcuucu

SEQ ID NO: 42843 - RNA, 22 nt, Human
gugggguggagcagcgggggag

SEQ ID NO: 42844 - RNA, 22 nt, Human
uggacacaccccacugaaagau

SEQ ID NO: 42845 - RNA, 21 nt, Human
guuucagaagcaacaggacag

SEQ ID NO: 42846 - RNA, 22 nt, Human
guggaccacugggccagcaccg

SEQ ID NO: 42847 - RNA, 24 nt, Human
aaccucaaaagcaugccuuguuuc

SEQ ID NO: 42848 - RNA, 24 nt, Human
guguaagagaaaaguaccaacagg

SEQ ID NO: 42849 - RNA, 30 nt, Human
ggcuggagcggugagaaugagaggccagag

SEQ ID NO: 42850 - RNA, 22 nt, Human
agagagaaauuggggacccuga

SEQ ID NO: 42851 - RNA, 23 nt, Human
cuggacccgguugaccuguuggc

SEQ ID NO: 42852 - RNA, 27 nt, Human
ccugccaaucucaagcaccugccucua

SEQ ID NO: 42853 - RNA, 22 nt, Human
ugguauggugacagugucucuc

SEQ ID NO: 42854 - RNA, 23 nt, Human
aagcacuuccagaacuucaccuc

SEQ ID NO: 42855 - RNA, 18 nt, Human
uccucacaccuacuguag

SEQ ID NO: 42856 - RNA, 24 nt, Human
ggcccuccagcuccccuccaguua

SEQ ID NO: 42857 - RNA, 20 nt, Human
gcaguuucccacuugccaaa

SEQ ID NO: 42858 - RNA, 27 nt, Human
accagccugggcgcaguggugcugggg

SEQ ID NO: 42859 - RNA, 23 nt, Human
gcgauguuugcgcucgcauuaca

SEQ ID NO: 42860 - RNA, 27 nt, Human
uggaaacauagggacuuggggcuugga

SEQ ID NO: 42861 - RNA, 22 nt, Human
gcguggauugucacagcugcgg

SEQ ID NO: 42862 - RNA, 26 nt, Human
gcuuugcugccuucccuuugcaccag

SEQ ID NO: 42863 - RNA, 24 nt, Human
ugcagaaugcgugccuucaucuca

SEQ ID NO: 42864 - RNA, 20 nt, Human
ucaggcucccugaaacagcu

SEQ ID NO: 42865 - RNA, 21 nt, Human
gugaugucagagcaucuacug

SEQ ID NO: 42866 - RNA, 22 nt, Human
aggaugugaguggguggcagag

SEQ ID NO: 42867 - RNA, 27 nt, Human
ggcugagaaacacugauagaccaagag

SEQ ID NO: 42868 - RNA, 20 nt, Human
gcuuucucagugucagcacu

SEQ ID NO: 42869 - RNA, 21 nt, Human
uuuguauccucaaggguccuu

SEQ ID NO: 42870 - RNA, 22 nt, Human
gggauuacaggcaugagccacg

SEQ ID NO: 42871 - RNA, 22 nt, Human
gggauuacaggcaggagccacu

SEQ ID NO: 42872 - RNA, 21 nt, Human
cuaaagaguuuauuuuaagac

SEQ ID NO: 42873 - RNA, 22 nt, Human
aggcugaggugggaggauggcu

SEQ ID NO: 42874 - RNA, 22 nt, Human
aggcugagguuggaggauugcu

SEQ ID NO: 42875 - RNA, 20 nt, Human
acacugacggcaucuuccca

SEQ ID NO: 42876 - RNA, 23 nt, Human
ggacuccucuuuuccacugugag

SEQ ID NO: 42877 - RNA, 26 nt, Human
cugggagccaggcagggccagggcag

SEQ ID NO: 42878 - RNA, 28 nt, Human
gguaucacugcagucaccucuucuaccc

SEQ ID NO: 42879 - RNA, 27 nt, Human
agggagacaacagcccugucucaaaac

SEQ ID NO: 42880 - RNA, 21 nt, Human
caaaacugucuagaauuugaa

SEQ ID NO: 42881 - RNA, 28 nt, Human
gccaccauccugcagccuccuccugacc

SEQ ID NO: 42882 - RNA, 24 nt, Human
ugcuguugacaaguugguuugagg

SEQ ID NO: 42883 - RNA, 20 nt, Human
gugccccucugccugccugc

SEQ ID NO: 42884 - RNA, 21 nt, Human
aggcagugucuggccauuauu

SEQ ID NO: 42885 - RNA, 25 nt, Human
gcuuaagaggugaaaaagaugaccc

SEQ ID NO: 42886 - RNA, 22 nt, Human
uagaagccuggcuacaauacug

SEQ ID NO: 42887 - RNA, 23 nt, Human
cugcagcugcaccagcaggugcc

SEQ ID NO: 42888 - RNA, 20 nt, Human
agacagacgcccaccugcuc

SEQ ID NO: 42889 - RNA, 22 nt, Human
ugcccaggcuggaaugcagugg

SEQ ID NO: 42890 - RNA, 22 nt, Human
ugcccaggcuggagugcaguga

SEQ ID NO: 42891 - RNA, 21 nt, Human
ugccugguccuaccuuuugcu

SEQ ID NO: 42892 - RNA, 22 nt, Human
ucagcgauguuggaauguagca

SEQ ID NO: 42893 - RNA, 19 nt, Human
cgaacucggcucaagugau

SEQ ID NO: 42894 - RNA, 26 nt, Human
cuccuggcucacccuccugagcuggg

SEQ ID NO: 42895 - RNA, 24 nt, Human
caucuggaaaugggaggaugaaga

SEQ ID NO: 42896 - RNA, 22 nt, Human
aggcuggagugcaguggcuccg

SEQ ID NO: 42897 - RNA, 27 nt, Human
ccugccugggagcuuucucuugcauac

SEQ ID NO: 42898 - RNA, 22 nt, Human
cuccaccucccagguucaagag

SEQ ID NO: 42899 - RNA, 24 nt, Human
agaaacuugacaaguaucucucca

SEQ ID NO: 42900 - RNA, 21 nt, Human
cacauggcuuuccaccaauau

SEQ ID NO: 42901 - RNA, 22 nt, Human
gccucacugcaaccuucaccua

SEQ ID NO: 42902 - RNA, 21 nt, Human
ccugccugcccuggccugggc

SEQ ID NO: 42903 - RNA, 22 nt, Human
gcccucugccguuuggggggca

SEQ ID NO: 42904 - RNA, 22 nt, Human
uuugcuccccuauccucugcuu

SEQ ID NO: 42905 - RNA, 19 nt, Human
acagcagcagagugagugg

SEQ ID NO: 42906 - RNA, 18 nt, Human
ggagcgagagggaggcag

SEQ ID NO: 42907 - RNA, 19 nt, Human
uggaaggcagaaaguggga

SEQ ID NO: 42908 - RNA, 20 nt, Human
uacagauuaugcuuaccuca

SEQ ID NO: 42909 - RNA, 25 nt, Human
ugcuaucucugagaugucugcuacu

SEQ ID NO: 42910 - RNA, 23 nt, Human
gaagcuaggaggcaggaaaaugu

SEQ ID NO: 42911 - RNA, 24 nt, Human
uuguacuguuuaauguucugugau

SEQ ID NO: 42912 - RNA, 22 nt, Human
auuucuccauuucugccggggu

SEQ ID NO: 42913 - RNA, 25 nt, Human
uuuugcaucauuugggacugccauu

SEQ ID NO: 42914 - RNA, 23 nt, Human
aaggcagccuuuuucuggccuug

SEQ ID NO: 42915 - RNA, 18 nt, Human
ccggaaggaaccaucuca

SEQ ID NO: 42916 - RNA, 23 nt, Human
augcagaugauucauuggauugg

SEQ ID NO: 42917 - RNA, 28 nt, Human
ccucgcugucugauucacuucuuaccau

SEQ ID NO: 42918 - RNA, 25 nt, Human
ggugccacagaucuggagguaugau

SEQ ID NO: 42919 - RNA, 26 nt, Human
uccaugugugggacauucauugcgga

SEQ ID NO: 42920 - RNA, 21 nt, Human
agcaacccagguucugcugca

SEQ ID NO: 42921 - RNA, 21 nt, Human
uggggucagcuggcugugggg

SEQ ID NO: 42922 - RNA, 23 nt, Human
aggccagaguugguaccugcuuu

SEQ ID NO: 42923 - RNA, 20 nt, Human
ugcucgcugccucuccagau

SEQ ID NO: 42924 - RNA, 20 nt, Human
ugcccagggaggaggccuug

SEQ ID NO: 42925 - RNA, 21 nt, Human
cagacaccucauggcacuuca

SEQ ID NO: 42926 - RNA, 22 nt, Human
caagaucacgucauugcacucc

SEQ ID NO: 42927 - RNA, 20 nt, Human
ccagccgccuggccuguggc

SEQ ID NO: 42928 - RNA, 19 nt, Human
cacaguauuacaggugcua

SEQ ID NO: 42929 - RNA, 21 nt, Human
guaagucgaggagcaucugug

SEQ ID NO: 42930 - RNA, 27 nt, Human
ggggcaggcccaggauccucagaggaa

SEQ ID NO: 42931 - RNA, 26 nt, Human
cugcccauaccccugccuggguuuuc

SEQ ID NO: 42932 - RNA, 22 nt, Human
ucuuuaacauagagaucuuuaa

SEQ ID NO: 42933 - RNA, 23 nt, Human
agcauuuuucacucuuggcuucu

SEQ ID NO: 42934 - RNA, 21 nt, Human
ucacugcaguuucaaguuccu

SEQ ID NO: 42935 - RNA, 22 nt, Human
caacuuuguaaucccaacacuu

SEQ ID NO: 42936 - RNA, 23 nt, Human
uuuuugaaggcauaaaagcaguu

SEQ ID NO: 42937 - RNA, 26 nt, Human
cugagaagaguguauugacucugagu

SEQ ID NO: 42938 - RNA, 16 nt, Human
aacaacaaauacuucc

SEQ ID NO: 42939 - RNA, 23 nt, Human
uaagaucauccugguuuaaaucu

SEQ ID NO: 42940 - RNA, 21 nt, Human
aggcuggauacggugcaguga

SEQ ID NO: 42941 - RNA, 23 nt, Human
ugcuccaccuuucagcccacguc

SEQ ID NO: 42942 - RNA, 22 nt, Human
acaaaggcaaacagaucugcca

SEQ ID NO: 42943 - RNA, 21 nt, Human
cagccuauacuuuaggcuaga

SEQ ID NO: 42944 - RNA, 27 nt, Human
accauuguaaaguuuaugucaccagaa

SEQ ID NO: 42945 - RNA, 27 nt, Human
ccagugcaggaacccggugcucgcugg

SEQ ID NO: 42946 - RNA, 22 nt, Human
gggcuccuccugcccuccaucu

SEQ ID NO: 42947 - RNA, 27 nt, Human
cccugcucuguucccugggacaccccc

SEQ ID NO: 42948 - RNA, 27 nt, Human
ugcucacuucuagcuauuuaagagaga

SEQ ID NO: 42949 - RNA, 27 nt, Human
ggggucugagcagcccagcgugcccau

SEQ ID NO: 42950 - RNA, 28 nt, Human
gcuucuccucaagcuguaggcuccagag

SEQ ID NO: 42951 - RNA, 25 nt, Human
uugcuguggcuggagcuggacagug

SEQ ID NO: 42952 - RNA, 22 nt, Human
agaaaacucucacuaacugucu

SEQ ID NO: 42953 - RNA, 22 nt, Human
caccagccuguuuucauaauaa

SEQ ID NO: 42954 - RNA, 23 nt, Human
ugugcagccuuuugugggccuuc

SEQ ID NO: 42955 - RNA, 18 nt, Human
ucuagguucuaaaaugaa

SEQ ID NO: 42956 - RNA, 24 nt, Human
uauccagcagacuuuucauuauga

SEQ ID NO: 42957 - RNA, 24 nt, Human
cuuccucaccagccagcccacagc

SEQ ID NO: 42958 - RNA, 14 nt, Human
uuucccuuaagcau

SEQ ID NO: 42959 - RNA, 22 nt, Human
gucacccaggcuggacugcaau

SEQ ID NO: 42960 - RNA, 20 nt, Human
aauucagccucauauaauga

SEQ ID NO: 42961 - RNA, 27 nt, Human
agguuuuuucccacccagcaguuggug

SEQ ID NO: 42962 - RNA, 19 nt, Human
cccagacuggagugcagug

SEQ ID NO: 42963 - RNA, 22 nt, Human
augugggaaagccuacaguugg

SEQ ID NO: 42964 - RNA, 21 nt, Human
gcagagucaggagaccccaag

SEQ ID NO: 42965 - RNA, 26 nt, Human
cuuggggcgggcagggccagccucuc

SEQ ID NO: 42966 - RNA, 22 nt, Human
ccacuuuuaaagaugggucuca

SEQ ID NO: 42967 - RNA, 32 nt, Human
ucuauuucagauaaugguuagcauuacgaugg

SEQ ID NO: 42968 - RNA, 21 nt, Human
cucuccuccccccuccaguug

SEQ ID NO: 42969 - RNA, 23 nt, Human
gccuaggaauugugguuuguaua

SEQ ID NO: 42970 - RNA, 22 nt, Human
ccccucacagacugccugagcu

SEQ ID NO: 42971 - RNA, 20 nt, Human
aaaugauuuaaaacauuuua

SEQ ID NO: 42972 - RNA, 21 nt, Human
gccacugcgggcgaggagggc

SEQ ID NO: 42973 - RNA, 16 nt, Human
uuuuucugacuccagu

SEQ ID NO: 42974 - RNA, 26 nt, Human
cacuaccuuuguccaggccugggugg

SEQ ID NO: 42975 - RNA, 24 nt, Human
acccccaccaggccucccuccucc

SEQ ID NO: 42976 - RNA, 23 nt, Human
cugcugccugccgccaucauguc

SEQ ID NO: 42977 - RNA, 22 nt, Human
ccacacacagcugggcuguggu

SEQ ID NO: 42978 - RNA, 21 nt, Human
ccgcccaggcugcagugcagu

SEQ ID NO: 42979 - RNA, 26 nt, Human
cugucucucuggcaggagugccugua

SEQ ID NO: 42980 - RNA, 25 nt, Human
caucccaacgcaugcuccuggagcu

SEQ ID NO: 42981 - RNA, 22 nt, Human
caucugacagcguagauaaaag

SEQ ID NO: 42982 - RNA, 25 nt, Human
ggaaugagggagagaagggggcugu

SEQ ID NO: 42983 - RNA, 22 nt, Human
gcuaggagagagaaaggauucc

SEQ ID NO: 42984 - RNA, 21 nt, Human
ucauuucuuaugggguucaca

SEQ ID NO: 42985 - RNA, 27 nt, Human
cugcuugcugugccuuguuauggcugc

SEQ ID NO: 42986 - RNA, 25 nt, Human
ggcucgcugcaaccucugacucccu

SEQ ID NO: 42987 - RNA, 23 nt, Human
ggcagaaaaagggaauggcaggg

SEQ ID NO: 42988 - RNA, 20 nt, Human
cccacauuuguagauccaug

SEQ ID NO: 42989 - RNA, 22 nt, Human
uccuggagacucccauucuccc

SEQ ID NO: 42990 - RNA, 22 nt, Human
cccguguagcugggacuacagg

SEQ ID NO: 42991 - RNA, 27 nt, Human
gacaagccuggccuacaugguugaaac

SEQ ID NO: 42992 - RNA, 18 nt, Human
ccagauugagaaccugga

SEQ ID NO: 42993 - RNA, 22 nt, Human
ccccuuaccucccccagugccu

SEQ ID NO: 42994 - RNA, 20 nt, Human
agaccuccagauuauuuucu

SEQ ID NO: 42995 - RNA, 19 nt, Human
gcagggcugggagaacuuu

SEQ ID NO: 42996 - RNA, 21 nt, Human
uguggaggcaacccugggacu

SEQ ID NO: 42997 - RNA, 19 nt, Human
gcacuuucucaaccccaca

SEQ ID NO: 42998 - RNA, 22 nt, Human
agggcgcucugcccucccuccu

SEQ ID NO: 42999 - RNA, 20 nt, Human
cuccacacuucaucugaucc

SEQ ID NO: 43000 - RNA, 22 nt, Human
uaaucagcagagucauuuuuca

SEQ ID NO: 43001 - RNA, 19 nt, Human
aacucacauacugacuuca

SEQ ID NO: 43002 - RNA, 24 nt, Human
cuuuucaugcccuccugcauugcu

SEQ ID NO: 43003 - RNA, 27 nt, Human
ugguggccauggagggucuugucugcu

SEQ ID NO: 43004 - RNA, 26 nt, Human
ucuuuacccuguguuuauguuuguuc

SEQ ID NO: 43005 - RNA, 17 nt, Human
aucuccugaaucaggcu

SEQ ID NO: 43006 - RNA, 25 nt, Human
cuuuuuaaacaacacauacuuuuug

SEQ ID NO: 43007 - RNA, 21 nt, Human
gugauugucugugugucuguc

SEQ ID NO: 43008 - RNA, 22 nt, Human
cucuguccuggcugugcacauu

SEQ ID NO: 43009 - RNA, 22 nt, Human
gcacaucuacuccagcaugauc

SEQ ID NO: 43010 - RNA, 21 nt, Human
gugcccagggagccgcugaug

SEQ ID NO: 43011 - RNA, 21 nt, Human
uagucucaguuugugugucuu

SEQ ID NO: 43012 - RNA, 17 nt, Human
uauuucuuuaaucuagu

SEQ ID NO: 43013 - RNA, 19 nt, Human
ccaggugaaucacagcuga

SEQ ID NO: 43014 - RNA, 26 nt, Human
ccuugggccuccucugcggagccccc

SEQ ID NO: 43015 - RNA, 22 nt, Human
ccacugcaccuggccugacauu

SEQ ID NO: 43016 - RNA, 18 nt, Human
ccuauacaacuuggcuuc

SEQ ID NO: 43017 - RNA, 24 nt, Human
cagggguaagggugggcacuggau

SEQ ID NO: 43018 - RNA, 22 nt, Human
uaucagaaaaacauuacaaauu

SEQ ID NO: 43019 - RNA, 21 nt, Human
caccuuccaccccaaccaucu

SEQ ID NO: 43020 - RNA, 22 nt, Human
gaauccagugggcagaggcagc

SEQ ID NO: 43021 - RNA, 19 nt, Human
ugcuuugggggugccucac

SEQ ID NO: 43022 - RNA, 19 nt, Human
ccucuuacuuccugccuca

SEQ ID NO: 43023 - RNA, 22 nt, Human
cccuucccuccaccuccuaggg

SEQ ID NO: 43024 - RNA, 24 nt, Human
ucagguuuguuuugugaauuuucu

SEQ ID NO: 43025 - RNA, 21 nt, Human
auuuucuguuaucaaagcaca

SEQ ID NO: 43026 - RNA, 24 nt, Human
agcugaaaacggaauucuuugccg

SEQ ID NO: 43027 - RNA, 27 nt, Human
gggccuggagcuuggcuuguauccaag

SEQ ID NO: 43028 - RNA, 22 nt, Human
aaagugcugggacugcaggcgu

SEQ ID NO: 43029 - RNA, 21 nt, Human
gcuccccaggcucuagugcag

SEQ ID NO: 43030 - RNA, 22 nt, Human
gcucucugcaaccucugucucc

SEQ ID NO: 43031 - RNA, 29 nt, Human
gugcggucuccacacccuuacgguuuccu

SEQ ID NO: 43032 - RNA, 26 nt, Human
ucucauuccuccaccugccguggacu

SEQ ID NO: 43033 - RNA, 22 nt, Human
gcuuuguguugcuuaacccagc

SEQ ID NO: 43034 - RNA, 26 nt, Human
gggcaagugaacucagcacucugcag

SEQ ID NO: 43035 - RNA, 21 nt, Human
gccucuggacggacagugggg

SEQ ID NO: 43036 - RNA, 24 nt, Human
uugugaauuuucuaaaagcuuuca

SEQ ID NO: 43037 - RNA, 27 nt, Human
gggcugaggcagcgagugauucccgcg

SEQ ID NO: 43038 - RNA, 21 nt, Human
cucugcaggauguaagguuua

SEQ ID NO: 43039 - RNA, 18 nt, Human
uuccuuuagaaagcaguu

SEQ ID NO: 43040 - RNA, 19 nt, Human
uuggagucuuaauuuucau

SEQ ID NO: 43041 - RNA, 22 nt, Human
uggcccaggcuagagugcagug

SEQ ID NO: 43042 - RNA, 23 nt, Human
gcagaaaaggcaguugaaggagg

SEQ ID NO: 43043 - RNA, 26 nt, Human
cugagggcagagucuuagcuguuuuc

SEQ ID NO: 43044 - RNA, 23 nt, Human
ugaggcacagccguagagcugug

SEQ ID NO: 43045 - RNA, 27 nt, Human
ucaacacuuguaucuggccucugugcc

SEQ ID NO: 43046 - RNA, 22 nt, Human
uaccuacauuuuaaugcaccug

SEQ ID NO: 43047 - RNA, 25 nt, Human
uccuuguacagcaaucuccuccucc

SEQ ID NO: 43048 - RNA, 23 nt, Human
ucuugauacaaaauauacuuuua

SEQ ID NO: 43049 - RNA, 23 nt, Human
uggaccuggaaucauguguaacu

SEQ ID NO: 43050 - RNA, 22 nt, Human
uguauuuuuaguagacaugggg

SEQ ID NO: 43051 - RNA, 25 nt, Human
cuccugaggcucucccuucccuggg

SEQ ID NO: 43052 - RNA, 30 nt, Human
uccauaucacauaggcaauuccuuuuaaau

SEQ ID NO: 43053 - RNA, 27 nt, Human
caaccaaaaaauucuacaacacacacu

SEQ ID NO: 43054 - RNA, 21 nt, Human
gccacucaccccuccuggccc

SEQ ID NO: 43055 - RNA, 21 nt, Human
aagcgcaggaaagaaaggccc

SEQ ID NO: 43056 - RNA, 21 nt, Human
agaacaaaauccacagaugca

SEQ ID NO: 43057 - RNA, 22 nt, Human
ggcaggagaaucacuugaaccc

SEQ ID NO: 43058 - RNA, 25 nt, Human
gaggauguugugcucagaaauguca

SEQ ID NO: 43059 - RNA, 22 nt, Human
cuaacagcaccuucccccugca

SEQ ID NO: 43060 - RNA, 21 nt, Human
aucaugaaacacuucucauca

SEQ ID NO: 43061 - RNA, 21 nt, Human
gggagugggguagaggaagac

SEQ ID NO: 43062 - RNA, 20 nt, Human
caaagaaggaugaagggugg

SEQ ID NO: 43063 - RNA, 22 nt, Human
uccacgccacacagcacuacgg

SEQ ID NO: 43064 - RNA, 23 nt, Human
gaugggguuucacuguguaggcc

SEQ ID NO: 43065 - RNA, 26 nt, Human
cuagcuguuuacauuugcaaauguag

SEQ ID NO: 43066 - RNA, 26 nt, Human
ugagccagaccuuaagcucuaugguu

SEQ ID NO: 43067 - RNA, 20 nt, Human
auuagaagaaaaguacugua

SEQ ID NO: 43068 - RNA, 23 nt, Human
uccgucgguccugcacagcgcaa

SEQ ID NO: 43069 - RNA, 20 nt, Human
uccgugucccaugcucccuc

SEQ ID NO: 43070 - RNA, 22 nt, Human
uggugcaugccuauaaucccag

SEQ ID NO: 43071 - RNA, 22 nt, Human
ugguacaugccuguaaucccag

SEQ ID NO: 43072 - RNA, 25 nt, Human
uagaaagcuaauacaaaacuauccu

SEQ ID NO: 43073 - RNA, 25 nt, Human
cuucccaaacccagucuccucucca

SEQ ID NO: 43074 - RNA, 21 nt, Human
guguaaagguguucaaauaaa

SEQ ID NO: 43075 - RNA, 26 nt, Human
ucaacaauaacaagaaaagcuuuuca

SEQ ID NO: 43076 - RNA, 20 nt, Human
cugcgcgcaugggccuguuc

SEQ ID NO: 43077 - RNA, 16 nt, Human
ugcaugauaugccuua

SEQ ID NO: 43078 - RNA, 25 nt, Human
gggguugucagcucucaucugaggc

SEQ ID NO: 43079 - RNA, 23 nt, Human
cugcugaccuuuuuaucuugagu

SEQ ID NO: 43080 - RNA, 29 nt, Human
aggcaccagaaucaggcuuuauuucgaua

SEQ ID NO: 43081 - RNA, 23 nt, Human
cggagagaaggagagccggucag

SEQ ID NO: 43082 - RNA, 22 nt, Human
gcccaggggccgcaguggccuu

SEQ ID NO: 43083 - RNA, 27 nt, Human
uugggauaggcuuguuuugucuguuga

SEQ ID NO: 43084 - RNA, 22 nt, Human
uucaggggacagaaagagagca

SEQ ID NO: 43085 - RNA, 32 nt, Human
ucccgcgccucgcucagcuccaacauggcaaa

SEQ ID NO: 43086 - RNA, 27 nt, Human
guuccaggguguguauguuucaggggc

SEQ ID NO: 43087 - RNA, 23 nt, Human
acaauuugccauuguuucuccug

SEQ ID NO: 43088 - RNA, 20 nt, Human
gauacagcuuuuugcaguau

SEQ ID NO: 43089 - RNA, 21 nt, Human
uggcagcagcagcagcagcgg

SEQ ID NO: 43090 - RNA, 22 nt, Human
caggagguggaaguugcuuuga

SEQ ID NO: 43091 - RNA, 26 nt, Human
cccucccucugcuccugagaugcuga

SEQ ID NO: 43092 - RNA, 22 nt, Human
ccacugcauuccagccugggug

SEQ ID NO: 43093 - RNA, 27 nt, Human
agcucacuuaccucucuguguucagau

SEQ ID NO: 43094 - RNA, 27 nt, Human
ugcccugcggaguugcacucugggugg

SEQ ID NO: 43095 - RNA, 21 nt, Human
gccauuaucagucaugccuua

SEQ ID NO: 43096 - RNA, 21 nt, Human
uuugaacauuuuaucuuugga

SEQ ID NO: 43097 - RNA, 25 nt, Human
aaaacugccuguuccuugaaucuga

SEQ ID NO: 43098 - RNA, 30 nt, Human
gggagccgagagaagggacuuugcugucag

SEQ ID NO: 43099 - RNA, 22 nt, Human
aguguuacagagagcuugcugu

SEQ ID NO: 43100 - RNA, 27 nt, Human
gagcagccuggccaacauggcaaaacc

SEQ ID NO: 43101 - RNA, 27 nt, Human
gaccagccugcccaacauggcaaaacc

SEQ ID NO: 43102 - RNA, 22 nt, Human
ggaagcugaggcaggaggauca

SEQ ID NO: 43103 - RNA, 23 nt, Human
ugccuucauuaguuugcuauaga

SEQ ID NO: 43104 - RNA, 23 nt, Human
auuucuauggccuugcucucugc

SEQ ID NO: 43105 - RNA, 20 nt, Human
agagauaccugcugcuucca

SEQ ID NO: 43106 - RNA, 27 nt, Human
uaauugaaaggacaucaauaaucauaa

SEQ ID NO: 43107 - RNA, 24 nt, Human
ugguccuccccugguuauugugag

SEQ ID NO: 43108 - RNA, 25 nt, Human
caagugccagagaaguggaggcaga

SEQ ID NO: 43109 - RNA, 23 nt, Human
uguggcugagccaagauugcacu

SEQ ID NO: 43110 - RNA, 19 nt, Human
cacuauccguuucugacaa

SEQ ID NO: 43111 - RNA, 22 nt, Human
ugcuaaagagaauguuauucaa

SEQ ID NO: 43112 - RNA, 26 nt, Human
ucuuuuuuaauaagggugggggaggg

SEQ ID NO: 43113 - RNA, 19 nt, Human
ggucuucccaguugucuca

SEQ ID NO: 43114 - RNA, 26 nt, Human
uuuuuugccaaccucaggcauacucg

SEQ ID NO: 43115 - RNA, 27 nt, Human
gugguggcaguggacagaucaaggcac

SEQ ID NO: 43116 - RNA, 23 nt, Human
aucuguguccugguuagcagagc

SEQ ID NO: 43117 - RNA, 22 nt, Human
auauggacauacacauuuacau

SEQ ID NO: 43118 - RNA, 22 nt, Human
cagcaaugguggaauggaagac

SEQ ID NO: 43119 - RNA, 22 nt, Human
ccaaguagcuaggacuacagac

SEQ ID NO: 43120 - RNA, 22 nt, Human
ugcgccuacgccuucugcucca

SEQ ID NO: 43121 - RNA, 20 nt, Human
gaggggacacuggcccaggg

SEQ ID NO: 43122 - RNA, 16 nt, Human
auacauuuaauuguac

SEQ ID NO: 43123 - RNA, 21 nt, Human
uauauugccauuucuuccaca

SEQ ID NO: 43124 - RNA, 26 nt, Human
gggccuuuucccacuaaguaguauug

SEQ ID NO: 43125 - RNA, 20 nt, Human
ggcuggagugcaguggugcg

SEQ ID NO: 43126 - RNA, 22 nt, Human
agcuucuccaucgccugccuuc

SEQ ID NO: 43127 - RNA, 27 nt, Human
agcucacuaucucuggccauucacuaa

SEQ ID NO: 43128 - RNA, 23 nt, Human
uuuuaagcauuugagaauucuua

SEQ ID NO: 43129 - RNA, 21 nt, Human
cucuuaucuuccacagggucc

SEQ ID NO: 43130 - RNA, 24 nt, Human
cccucugcucuguacccuuuuucc

SEQ ID NO: 43131 - RNA, 23 nt, Human
ugaaaaaauaucagccaccaaaa

SEQ ID NO: 43132 - RNA, 19 nt, Human
acuucaauguaaucaugcc

SEQ ID NO: 43133 - RNA, 22 nt, Human
cuccacuuccguggaugucuaa

SEQ ID NO: 43134 - RNA, 20 nt, Human
aucagcgguaagaacaguga

SEQ ID NO: 43135 - RNA, 24 nt, Human
uggaaacaagugcauagaugugaa

SEQ ID NO: 43136 - RNA, 26 nt, Human
gguggugaggaagauacuuugguuag

SEQ ID NO: 43137 - RNA, 21 nt, Human
uugugguuucucucuuucugg

SEQ ID NO: 43138 - RNA, 21 nt, Human
gcgccugccaccaugcccgcc

SEQ ID NO: 43139 - RNA, 23 nt, Human
uccuggcuccugggacugcacca

SEQ ID NO: 43140 - RNA, 22 nt, Human
gggaagagaaauaaacguggca

SEQ ID NO: 43141 - RNA, 27 nt, Human
ucugaauccgauaccgcuucucuuaga

SEQ ID NO: 43142 - RNA, 26 nt, Human
ucacccacuccaagagacugcagccc

SEQ ID NO: 43143 - RNA, 21 nt, Human
gccagggcaucccggaagcug

SEQ ID NO: 43144 - RNA, 27 nt, Human
cugcuuuguuuaugguuuuguuucacu

SEQ ID NO: 43145 - RNA, 26 nt, Human
caccuugccagaaagucugguggcag

SEQ ID NO: 43146 - RNA, 25 nt, Human
ccucagcccucccccacccacaggc

SEQ ID NO: 43147 - RNA, 22 nt, Human
gccagugacuacuucucccugg

SEQ ID NO: 43148 - RNA, 22 nt, Human
aagaaggcugccuaaggaggag

SEQ ID NO: 43149 - RNA, 27 nt, Human
gcuccgcucugcgccgcugcugccauc

SEQ ID NO: 43150 - RNA, 25 nt, Human
ugguggcgggcaccuguagucccag

SEQ ID NO: 43151 - RNA, 22 nt, Human
cucccagccuccuucccgcuac

SEQ ID NO: 43152 - RNA, 28 nt, Human
ggagccgggcuggcaggagcaggauggc

SEQ ID NO: 43153 - RNA, 27 nt, Human
cugcuuuucaguucccuucccugcugu

SEQ ID NO: 43154 - RNA, 22 nt, Human
ccuggugucuuucuccugggcu

SEQ ID NO: 43155 - RNA, 21 nt, Human
ucccucggggccgaaugcgca

SEQ ID NO: 43156 - RNA, 25 nt, Human
aguaaugcaagcaaaguaucaaaga

SEQ ID NO: 43157 - RNA, 27 nt, Human
aaaugcacauuugucacugaauaaugg

SEQ ID NO: 43158 - RNA, 21 nt, Human
cgggagccuccugggggcucc

SEQ ID NO: 43159 - RNA, 27 nt, Human
gggaggcacuuugcugucugcaaucga

SEQ ID NO: 43160 - RNA, 18 nt, Human
augugggagaaaaucucc

SEQ ID NO: 43161 - RNA, 20 nt, Human
ccaguuccauuucucucauu

SEQ ID NO: 43162 - RNA, 22 nt, Human
cauuuccuuccugcgaccaucc

SEQ ID NO: 43163 - RNA, 21 nt, Human
ggcaccguggggaaacuggaa

SEQ ID NO: 43164 - RNA, 22 nt, Human
cccuucagcguggacuuccugg

SEQ ID NO: 43165 - RNA, 21 nt, Human
cuuccauucuggauguuugga

SEQ ID NO: 43166 - RNA, 25 nt, Human
ggcugguaauuuuuaugagcauuuu

SEQ ID NO: 43167 - RNA, 22 nt, Human
aggagugugugauguguuucca

SEQ ID NO: 43168 - RNA, 26 nt, Human
ccauaaacaggaaugccuuuggcaau

SEQ ID NO: 43169 - RNA, 22 nt, Human
cugcaaccuucgccucccaggu

SEQ ID NO: 43170 - RNA, 21 nt, Human
cucaggccuccagcuccuggg

SEQ ID NO: 43171 - RNA, 21 nt, Human
cucucgccuccuccuccuggg

SEQ ID NO: 43172 - RNA, 20 nt, Human
gggaggcacuuuuguggagg

SEQ ID NO: 43173 - RNA, 26 nt, Human
gcacagccaagaaaaauuacauuccu

SEQ ID NO: 43174 - RNA, 20 nt, Human
gaggaggaggugauguagca

SEQ ID NO: 43175 - RNA, 23 nt, Human
ccagucccuuacacguaccucuc

SEQ ID NO: 43176 - RNA, 19 nt, Human
ccaguaguuauauuacaaa

SEQ ID NO: 43177 - RNA, 24 nt, Human
aggacccgacacaccaggcuucgc

SEQ ID NO: 43178 - RNA, 17 nt, Human
ccaaauaaacaaaaagg

SEQ ID NO: 43179 - RNA, 27 nt, Human
caggaagggaaagcgggcagccccguu

SEQ ID NO: 43180 - RNA, 24 nt, Human
gguguuggccucagccuaacccuc

SEQ ID NO: 43181 - RNA, 22 nt, Human
gggaaguuggcuuagcucggcu

SEQ ID NO: 43182 - RNA, 24 nt, Human
cugaggcaucagaacuuuguucac

SEQ ID NO: 43183 - RNA, 23 nt, Human
guaugaucaguacugacuuucug

SEQ ID NO: 43184 - RNA, 27 nt, Human
gcgcucuggagaaucccggacagcccu

SEQ ID NO: 43185 - RNA, 22 nt, Human
cucuuuggagcuucugaggacu

SEQ ID NO: 43186 - RNA, 27 nt, Human
ggcugagaaaauucuggaacuauggau

SEQ ID NO: 43187 - RNA, 22 nt, Human
gagaggaucgagccauugaaag

SEQ ID NO: 43188 - RNA, 19 nt, Human
ucaggcuggagugcagugg

SEQ ID NO: 43189 - RNA, 24 nt, Human
ccaguaggagguuggacuagauga

SEQ ID NO: 43190 - RNA, 27 nt, Human
gccugcacuggagucugaggccuggga

SEQ ID NO: 43191 - RNA, 24 nt, Human
ggagaaguugaaggguccuugugc

SEQ ID NO: 43192 - RNA, 23 nt, Human
ugacgcccuuccccuugccccag

SEQ ID NO: 43193 - RNA, 22 nt, Human
ugcaaccuccgccucccagguu

SEQ ID NO: 43194 - RNA, 24 nt, Human
auggguggggauggagguauagac

SEQ ID NO: 43195 - RNA, 26 nt, Human
ccccacagggaccucagucaccuuug

SEQ ID NO: 43196 - RNA, 24 nt, Human
acuauuuaccaaaacaaauggaga

SEQ ID NO: 43197 - RNA, 22 nt, Human
acuacugacguccucccugauc

SEQ ID NO: 43198 - RNA, 20 nt, Human
acuuguuuucccagcaucau

SEQ ID NO: 43199 - RNA, 27 nt, Human
ucugauuccuguuuugaaaguccugcc

SEQ ID NO: 43200 - RNA, 19 nt, Human
cagugccucuccuggucgu

SEQ ID NO: 43201 - RNA, 27 nt, Human
acaaaccuguuauuccaguguaaucug

SEQ ID NO: 43202 - RNA, 21 nt, Human
uuaacuuacccuuaucugcca

SEQ ID NO: 43203 - RNA, 21 nt, Human
augauccccucucuuccuccc

SEQ ID NO: 43204 - RNA, 22 nt, Human
cgccuccuggguucaagcaauu

SEQ ID NO: 43205 - RNA, 16 nt, Human
uggacugccacacauu

SEQ ID NO: 43206 - RNA, 22 nt, Human
agagaggcuccccuggggcugu

SEQ ID NO: 43207 - RNA, 22 nt, Human
uaaaagagaauaggcugcccau

SEQ ID NO: 43208 - RNA, 23 nt, Human
ugaggagugacgggcaaggggcc

SEQ ID NO: 43209 - RNA, 22 nt, Human
caaauguuauuuuuggaaacac

SEQ ID NO: 43210 - RNA, 23 nt, Human
uuuuccuucagagugaaucaucc

SEQ ID NO: 43211 - RNA, 23 nt, Human
gaggcauucaccuuuauguguua

SEQ ID NO: 43212 - RNA, 27 nt, Human
uuuucauuuuucuaauuguuuaaacug

SEQ ID NO: 43213 - RNA, 20 nt, Human
ggaaggcuucucaggaggaa

SEQ ID NO: 43214 - RNA, 23 nt, Human
cggcuuaggccgcagaggucugu

SEQ ID NO: 43215 - RNA, 23 nt, Human
agcauuuuggucccugcuccuug

SEQ ID NO: 43216 - RNA, 21 nt, Human
cugaguauguggaaggcagca

SEQ ID NO: 43217 - RNA, 23 nt, Human
uuauauagcuacaaaugaaaaca

SEQ ID NO: 43218 - RNA, 22 nt, Human
accagccucauucuucuccggu

SEQ ID NO: 43219 - RNA, 21 nt, Human
cugcucugcucaccaauugcu

SEQ ID NO: 43220 - RNA, 22 nt, Human
cgucauguugugggaucuuuag

SEQ ID NO: 43221 - RNA, 22 nt, Human
aacauuuuugcuuucuccaguu

SEQ ID NO: 43222 - RNA, 22 nt, Human
uuagaaaaccuuuccauuucuu

SEQ ID NO: 43223 - RNA, 23 nt, Human
ccaaacaucuuccugaaaauaac

SEQ ID NO: 43224 - RNA, 24 nt, Human
ugaccagccugggaaacauaacaa

SEQ ID NO: 43225 - RNA, 22 nt, Human
accagcuuggcaaguaacucua

SEQ ID NO: 43226 - RNA, 21 nt, Human
gucacagccucgcucuccgcu

SEQ ID NO: 43227 - RNA, 27 nt, Human
ccccacccuccagaagggguccacguu

SEQ ID NO: 43228 - RNA, 19 nt, Human
ugcagugaauguucaacag

SEQ ID NO: 43229 - RNA, 26 nt, Human
gccuguaaucccaguacuugggaggc

SEQ ID NO: 43230 - RNA, 27 nt, Human
ccugcccagcccugccuccuggccaug

SEQ ID NO: 43231 - RNA, 25 nt, Human
aaaauacaaaaauuagccgagcaug

SEQ ID NO: 43232 - RNA, 20 nt, Human
cauucuguuaugugaagauu

SEQ ID NO: 43233 - RNA, 21 nt, Human
gacuuuucugcccugcccuca

SEQ ID NO: 43234 - RNA, 20 nt, Human
aaagaucugauaucuguaaa

SEQ ID NO: 43235 - RNA, 26 nt, Human
ccgggggcggggguucgguuugacua

SEQ ID NO: 43236 - RNA, 26 nt, Human
gccacugugcccagccucuucucuca

SEQ ID NO: 43237 - RNA, 24 nt, Human
uuguaaagucuugcaaaugcagcu

SEQ ID NO: 43238 - RNA, 24 nt, Human
gaguauuuuaauccuauuacuuga

SEQ ID NO: 43239 - RNA, 24 nt, Human
ucaguucuagcauaguaaacuacg

SEQ ID NO: 43240 - RNA, 24 nt, Human
agacccucacucucucugucagaa

SEQ ID NO: 43241 - RNA, 20 nt, Human
ucuuuauuuuuauuuuuucc

SEQ ID NO: 43242 - RNA, 18 nt, Human
uaugagcacacucugcug

SEQ ID NO: 43243 - RNA, 21 nt, Human
ugccuccucacaucugcccug

SEQ ID NO: 43244 - RNA, 22 nt, Human
cauugcacuccauccugagcca

SEQ ID NO: 43245 - RNA, 22 nt, Human
gcagaugacugaggaagggaug

SEQ ID NO: 43246 - RNA, 26 nt, Human
augcggcaguggaaucuggaagggcg

SEQ ID NO: 43247 - RNA, 25 nt, Human
ugugagauggcuggcuggugauagg

SEQ ID NO: 43248 - RNA, 22 nt, Human
agaaguggucaggcagaaggug

SEQ ID NO: 43249 - RNA, 21 nt, Human
gagcuugguggcugagcuugg

SEQ ID NO: 43250 - RNA, 22 nt, Human
uuucccuuaucaaacuugggcc

SEQ ID NO: 43251 - RNA, 24 nt, Human
cucuaggggaccccuacuaaaggg

SEQ ID NO: 43252 - RNA, 21 nt, Human
uuuucuuacuuguuacuguag

SEQ ID NO: 43253 - RNA, 22 nt, Human
aucuuaaguauuugcuccaucu

SEQ ID NO: 43254 - RNA, 22 nt, Human
gguccaggcuguguuuggcuuu

SEQ ID NO: 43255 - RNA, 21 nt, Human
gccagcuacuuccuccucccc

SEQ ID NO: 43256 - RNA, 23 nt, Human
gcagagcaggugguagugggaca

SEQ ID NO: 43257 - RNA, 27 nt, Human
uugccuuuccccucugccuguuuccuu

SEQ ID NO: 43258 - RNA, 27 nt, Human
ucugggagccuuuugacagcugguccc

SEQ ID NO: 43259 - RNA, 22 nt, Human
agcaaacagcucacuguccucu

SEQ ID NO: 43260 - RNA, 27 nt, Human
gccagccugggaaacauggcaaaaucc

SEQ ID NO: 43261 - RNA, 22 nt, Human
uuaaguuggauauuucucuaca

SEQ ID NO: 43262 - RNA, 20 nt, Human
acugaacuuucuggaauggg

SEQ ID NO: 43263 - RNA, 22 nt, Human
caggaggcagcuguugcaguga

SEQ ID NO: 43264 - RNA, 24 nt, Human
ggcguccugugccccucugcuccg

SEQ ID NO: 43265 - RNA, 29 nt, Human
gccagugggacucaggagagagcaagcua

SEQ ID NO: 43266 - RNA, 20 nt, Human
gagugcggagccagagauca

SEQ ID NO: 43267 - RNA, 21 nt, Human
uugccccaggacucuggcacu

SEQ ID NO: 43268 - RNA, 18 nt, Human
ccccagguuccuccaggc

SEQ ID NO: 43269 - RNA, 21 nt, Human
aggcuuucauuuccucccgac

SEQ ID NO: 43270 - RNA, 24 nt, Human
gaggcaugggaaacagugcaguga

SEQ ID NO: 43271 - RNA, 25 nt, Human
uuuucugagcucuccccaaucacca

SEQ ID NO: 43272 - RNA, 21 nt, Human
ccagccugggcaaccccaccc

SEQ ID NO: 43273 - RNA, 18 nt, Human
uggcucucuggcuccugu

SEQ ID NO: 43274 - RNA, 27 nt, Human
aggggaagcaggggacagguguccagu

SEQ ID NO: 43275 - RNA, 21 nt, Human
ugggaagggaugggauuucug

SEQ ID NO: 43276 - RNA, 22 nt, Human
uuuuggcaucuaccuccugugg

SEQ ID NO: 43277 - RNA, 22 nt, Human
gauaugguugaugagaaucuua

SEQ ID NO: 43278 - RNA, 26 nt, Human
cacagccccuccaggcaagggagaag

SEQ ID NO: 43279 - RNA, 22 nt, Human
gucacuuaggggccacuuccua

SEQ ID NO: 43280 - RNA, 23 nt, Human
cucgcaccacugugacucugcca

SEQ ID NO: 43281 - RNA, 24 nt, Human
uggaaaguacuuuggaaaauauac

SEQ ID NO: 43282 - RNA, 26 nt, Human
aggaagagagcaggcagccucugagc

SEQ ID NO: 43283 - RNA, 20 nt, Human
uucagaagagacauugucuu

SEQ ID NO: 43284 - RNA, 26 nt, Human
gacugggcuagggagaaugcagagag

SEQ ID NO: 43285 - RNA, 21 nt, Human
gccugcuauaugucaugguuu

SEQ ID NO: 43286 - RNA, 22 nt, Human
gauggcuguaucucccuucacu

SEQ ID NO: 43287 - RNA, 20 nt, Human
gccaccacacccagccuggg

SEQ ID NO: 43288 - RNA, 22 nt, Human
aggccgaggcaggcggaucaug

SEQ ID NO: 43289 - RNA, 17 nt, Human
uugcuuuggucauauga

SEQ ID NO: 43290 - RNA, 24 nt, Human
accuaaacugaggucagcacuugg

SEQ ID NO: 43291 - RNA, 21 nt, Human
cgguagagugcacuuucucca

SEQ ID NO: 43292 - RNA, 25 nt, Human
ugcccucaugaguuccaauguugug

SEQ ID NO: 43293 - RNA, 23 nt, Human
agaauugauuacacucuccagag

SEQ ID NO: 43294 - RNA, 22 nt, Human
ucccuaucucucacucuggacc

SEQ ID NO: 43295 - RNA, 20 nt, Human
gggauuccaccacacccaau

SEQ ID NO: 43296 - RNA, 23 nt, Human
cagcaaaacauccacaacucugu

SEQ ID NO: 43297 - RNA, 22 nt, Human
acugcugcuuugucacuuucuc

SEQ ID NO: 43298 - RNA, 16 nt, Human
gagguuaggaguucaa

SEQ ID NO: 43299 - RNA, 21 nt, Human
cagcuuuucuuucuccccuac

SEQ ID NO: 43300 - RNA, 22 nt, Human
gcugggccauaugaaaaaucaa

SEQ ID NO: 43301 - RNA, 23 nt, Human
uauuccccugccuuccuggcuug

SEQ ID NO: 43302 - RNA, 26 nt, Human
ccugcuucagccccaccgcaccccuc

SEQ ID NO: 43303 - RNA, 20 nt, Human
cugcucucuggccuccagcc

SEQ ID NO: 43304 - RNA, 26 nt, Human
gggagguggaguuccggaauuauucu

SEQ ID NO: 43305 - RNA, 23 nt, Human
acaucagccuucuccugucucca

SEQ ID NO: 43306 - RNA, 27 nt, Human
ccgagacugagggaaagcaugucugcu

SEQ ID NO: 43307 - RNA, 20 nt, Human
ucuguauaugauucucugug

SEQ ID NO: 43308 - RNA, 22 nt, Human
ugcagccccaaaccccaggacc

SEQ ID NO: 43309 - RNA, 20 nt, Human
cuccacuguugccaaacuuu

SEQ ID NO: 43310 - RNA, 24 nt, Human
aagcaguuucuuucaaagaagcca

SEQ ID NO: 43311 - RNA, 23 nt, Human
gcucuugaacuccugaccucagg

SEQ ID NO: 43312 - RNA, 18 nt, Human
gcuugggcuggagugggc

SEQ ID NO: 43313 - RNA, 20 nt, Human
aucacaauucuaauguaaua

SEQ ID NO: 43314 - RNA, 21 nt, Human
guucugacaguguuuuaggug

SEQ ID NO: 43315 - RNA, 24 nt, Human
uauccuuccuccucacccugccgg

SEQ ID NO: 43316 - RNA, 20 nt, Human
ugugaucuuggccccuugga

SEQ ID NO: 43317 - RNA, 28 nt, Human
ccaccugccucuaaucugagcugcagcc

SEQ ID NO: 43318 - RNA, 19 nt, Human
auucccaggaggcuuggag

SEQ ID NO: 43319 - RNA, 23 nt, Human
auuuucucauagauuuaaguaaa

SEQ ID NO: 43320 - RNA, 24 nt, Human
aacugaagagacaguuauuuauag

SEQ ID NO: 43321 - RNA, 27 nt, Human
cgcccggccaacgucauuuucuuuuca

SEQ ID NO: 43322 - RNA, 21 nt, Human
acauucucuuacuuuuuguaa

SEQ ID NO: 43323 - RNA, 20 nt, Human
gaucuggaaccucagccugg

SEQ ID NO: 43324 - RNA, 22 nt, Human
gcucacaccuauaaucccagca

SEQ ID NO: 43325 - RNA, 21 nt, Human
ccacccccaaacccccagagg

SEQ ID NO: 43326 - RNA, 25 nt, Human
gcugccacccaugccuccuccuacc

SEQ ID NO: 43327 - RNA, 20 nt, Human
uuccuuggggaaauggugcc

SEQ ID NO: 43328 - RNA, 27 nt, Human
ucuccccucagcagucugagugcaacc

SEQ ID NO: 43329 - RNA, 21 nt, Human
cugccaccgcuggggcugcac

SEQ ID NO: 43330 - RNA, 22 nt, Human
cacccagguucgaguucagugg

SEQ ID NO: 43331 - RNA, 25 nt, Human
ugccugugccuagaucagagcccag

SEQ ID NO: 43332 - RNA, 24 nt, Human
agugcagagaaacccuccacauuu

SEQ ID NO: 43333 - RNA, 27 nt, Human
uuuugucacuucuccccuccguggagu

SEQ ID NO: 43334 - RNA, 22 nt, Human
gugauucuucuugccucagccu

SEQ ID NO: 43335 - RNA, 27 nt, Human
gucuugaacuccugagcucaagugauc

SEQ ID NO: 43336 - RNA, 21 nt, Human
uuuaaaaaacaccaugcuugg

SEQ ID NO: 43337 - RNA, 18 nt, Human
ggacggcccucuggccac

SEQ ID NO: 43338 - RNA, 22 nt, Human
agaacagagauuuuacaguuaa

SEQ ID NO: 43339 - RNA, 26 nt, Human
cacacuaccaguguugugggcacauu

SEQ ID NO: 43340 - RNA, 27 nt, Human
uggcucacaccuguaaucccaauacug

SEQ ID NO: 43341 - RNA, 22 nt, Human
cuggaacccacgccuccugagg

SEQ ID NO: 43342 - RNA, 23 nt, Human
cauugccaccaacucuauccuac

SEQ ID NO: 43343 - RNA, 23 nt, Human
agcacagauuuuaauugucaugg

SEQ ID NO: 43344 - RNA, 18 nt, Human
cgccucgggacccccucu

SEQ ID NO: 43345 - RNA, 24 nt, Human
ccuuucucccuggucaguugguuc

SEQ ID NO: 43346 - RNA, 23 nt, Human
aaacauuuuaucauucuaaaugg

SEQ ID NO: 43347 - RNA, 25 nt, Human
auggggagagagaggaagcgacuga

SEQ ID NO: 43348 - RNA, 21 nt, Human
uccagccugggcaauagagug

SEQ ID NO: 43349 - RNA, 19 nt, Human
uuaugauaguacaagacag

SEQ ID NO: 43350 - RNA, 20 nt, Human
gggagagauggagaagcuag

SEQ ID NO: 43351 - RNA, 21 nt, Human
caggaaaagaguuuucugccg

SEQ ID NO: 43352 - RNA, 21 nt, Human
gguccugccaccuccugagcu

SEQ ID NO: 43353 - RNA, 29 nt, Human
uaacauaguuuauuuuuacacugucuuau

SEQ ID NO: 43354 - RNA, 19 nt, Human
aaucugggggccaggcugg

SEQ ID NO: 43355 - RNA, 21 nt, Human
ucacugcaagcucuaccucuu

SEQ ID NO: 43356 - RNA, 24 nt, Human
ccugcugcuccgacccgcucccgg

SEQ ID NO: 43357 - RNA, 21 nt, Human
ggagacugaagacucagcccg

SEQ ID NO: 43358 - RNA, 21 nt, Human
gaagugggaaagcauuuucuc

SEQ ID NO: 43359 - RNA, 19 nt, Human
acuugaagauuaauguagg

SEQ ID NO: 43360 - RNA, 21 nt, Human
gccagagcccuucacugccau

SEQ ID NO: 43361 - RNA, 21 nt, Human
cuggcuguugagaugggugga

SEQ ID NO: 43362 - RNA, 22 nt, Human
ccucacugcccgccuuccccuc

SEQ ID NO: 43363 - RNA, 21 nt, Human
gcgacugccacaucauugaag

SEQ ID NO: 43364 - RNA, 22 nt, Human
cucaagagguugaggcugcagu

SEQ ID NO: 43365 - RNA, 19 nt, Human
caaguccuucacuucucgc

SEQ ID NO: 43366 - RNA, 20 nt, Human
uuucauuccuuuguuuacua

SEQ ID NO: 43367 - RNA, 26 nt, Human
caccccucucugguacuuguggcuug

SEQ ID NO: 43368 - RNA, 21 nt, Human
ccaauggcugggauuuguggc

SEQ ID NO: 43369 - RNA, 25 nt, Human
guuugugcccuuuguucuggucuga

SEQ ID NO: 43370 - RNA, 23 nt, Human
ccaggcaagcagcuuuuacaguu

SEQ ID NO: 43371 - RNA, 21 nt, Human
ccacaggaagucacaguggug

SEQ ID NO: 43372 - RNA, 24 nt, Human
aaaacaauugggcaaaacuaccua

SEQ ID NO: 43373 - RNA, 18 nt, Human
cugccucuuucccuuguu

SEQ ID NO: 43374 - RNA, 23 nt, Human
ccagcacuucuggaacugugcuu

SEQ ID NO: 43375 - RNA, 16 nt, Human
ucucaugcucuaccuu

SEQ ID NO: 43376 - RNA, 18 nt, Human
cuccacugguuccugggc

SEQ ID NO: 43377 - RNA, 25 nt, Human
acuaccugaguuuuuacuugcauaa

SEQ ID NO: 43378 - RNA, 22 nt, Human
gggguggaagggugauggggag

SEQ ID NO: 43379 - RNA, 17 nt, Human
ccuauuuucucucucca

SEQ ID NO: 43380 - RNA, 32 nt, Human
gagggaggggcgggggcuggaggcagcagcgc

SEQ ID NO: 43381 - RNA, 22 nt, Human
ggaggcugaggcagaaggauua

SEQ ID NO: 43382 - RNA, 24 nt, Human
uucuuuaagcccaucaacucccag

SEQ ID NO: 43383 - RNA, 26 nt, Human
cgccuugccaggagucugcagaacca

SEQ ID NO: 43384 - RNA, 26 nt, Human
aggaggucacugagcaagagucauuc

SEQ ID NO: 43385 - RNA, 23 nt, Human
aggcacugcaaaccgccaccucc

SEQ ID NO: 43386 - RNA, 22 nt, Human
agugaacucuccuuuugugcuu

SEQ ID NO: 43387 - RNA, 22 nt, Human
uaaaaacugcagugucuuugga

SEQ ID NO: 43388 - RNA, 21 nt, Human
agucagccaaagaauauuguu

SEQ ID NO: 43389 - RNA, 26 nt, Human
gccucccagcagugcuauuuuuugcc

SEQ ID NO: 43390 - RNA, 27 nt, Human
gaaagagaaucccagcugucauuguuc

SEQ ID NO: 43391 - RNA, 28 nt, Human
ugcugccuucucugggcucacgacuguu

SEQ ID NO: 43392 - RNA, 28 nt, Human
gggccaagcagggguugcagggcaguag

SEQ ID NO: 43393 - RNA, 27 nt, Human
gccuaucuccuagggcuauggugugga

SEQ ID NO: 43394 - RNA, 22 nt, Human
gaaggccgaaggcagugcaaga

SEQ ID NO: 43395 - RNA, 22 nt, Human
uuucccuggggaaggaggggaa

SEQ ID NO: 43396 - RNA, 27 nt, Human
uacacagugcuuuccagccuuuggugc

SEQ ID NO: 43397 - RNA, 24 nt, Human
ccccauccucuccacgccgcugcc

SEQ ID NO: 43398 - RNA, 22 nt, Human
gggcaugccuuggaauauugcc

SEQ ID NO: 43399 - RNA, 22 nt, Human
uagacugauuacacugagguga

SEQ ID NO: 43400 - RNA, 27 nt, Human
uuuugguuucucucuacugaucaacag

SEQ ID NO: 43401 - RNA, 22 nt, Human
gagcccaaggaccaugccuuug

SEQ ID NO: 43402 - RNA, 27 nt, Human
gagccuuauagggucaguagcucucca

SEQ ID NO: 43403 - RNA, 19 nt, Human
uccuuuuaggagaucaugg

SEQ ID NO: 43404 - RNA, 27 nt, Human
cgcuucuuuucucucaucaucauguuc

SEQ ID NO: 43405 - RNA, 27 nt, Human
ccauggcuggcagagguuucuagggug

SEQ ID NO: 43406 - RNA, 27 nt, Human
caccagaugcuggacacccucuuccca

SEQ ID NO: 43407 - RNA, 21 nt, Human
ugcccuaguugugaucaaagg

SEQ ID NO: 43408 - RNA, 27 nt, Human
gagcuggggccgcaggagcggaggcaa

SEQ ID NO: 43409 - RNA, 27 nt, Human
cccuugagccugcuuccucacuccagg

SEQ ID NO: 43410 - RNA, 25 nt, Human
ccccacuccggagucgccgcugccg

SEQ ID NO: 43411 - RNA, 19 nt, Human
ggaaguuaaaaggaagggg

SEQ ID NO: 43412 - RNA, 21 nt, Human
ugggauuugcaugaacuccac

SEQ ID NO: 43413 - RNA, 23 nt, Human
gcucuccgacccagcuaccggga

SEQ ID NO: 43414 - RNA, 22 nt, Human
aaaugcacacauuucugagggg

SEQ ID NO: 43415 - RNA, 27 nt, Human
ucugggagccacugggcaauugccagg

SEQ ID NO: 43416 - RNA, 22 nt, Human
cgcuccugccuacccaguucca

SEQ ID NO: 43417 - RNA, 25 nt, Human
gacaauuuauuaguuuucucaguau

SEQ ID NO: 43418 - RNA, 20 nt, Human
agccaagagaaagaugagga

SEQ ID NO: 43419 - RNA, 24 nt, Human
gaggucuuuagaggaccagcuauu

SEQ ID NO: 43420 - RNA, 32 nt, Human
ggcagggauuccacucagaaccucucuggaau

SEQ ID NO: 43421 - RNA, 27 nt, Human
uuuaaauaaugcacaguugcagccugg

SEQ ID NO: 43422 - RNA, 22 nt, Human
cuacugaacuccaguuuugauc

SEQ ID NO: 43423 - RNA, 26 nt, Human
gagugcaaagugacugcccggucaga

SEQ ID NO: 43424 - RNA, 24 nt, Human
ucacucuucagccucuguuugacc

SEQ ID NO: 43425 - RNA, 20 nt, Human
cuuugguggagguaguucuu

SEQ ID NO: 43426 - RNA, 27 nt, Human
gucucuugucuacaggcagcaucgggg

SEQ ID NO: 43427 - RNA, 20 nt, Human
ucaaugcaauggcucaucag

SEQ ID NO: 43428 - RNA, 20 nt, Human
gggcagccagccacagcccg

SEQ ID NO: 43429 - RNA, 24 nt, Human
caggacagccauaguauagugugu

SEQ ID NO: 43430 - RNA, 22 nt, Human
caagugauuuuaauuuaaaaac

SEQ ID NO: 43431 - RNA, 21 nt, Human
cacgagccaccucaccuagcc

SEQ ID NO: 43432 - RNA, 22 nt, Human
uaggacuauggguacauuccac

SEQ ID NO: 43433 - RNA, 23 nt, Human
cagggaggggaggcagauggagc

SEQ ID NO: 43434 - RNA, 27 nt, Human
agaucagggccugggugaacucccugg

SEQ ID NO: 43435 - RNA, 22 nt, Human
gggcugcauuucacacuccucc

SEQ ID NO: 43436 - RNA, 20 nt, Human
cugucuaucuucucaguuga

SEQ ID NO: 43437 - RNA, 22 nt, Human
gucugggcuugggagccgcgug

SEQ ID NO: 43438 - RNA, 22 nt, Human
uuuucugacuucuuccuccucc

SEQ ID NO: 43439 - RNA, 22 nt, Human
uaaugagucacaaaauaaagcu

SEQ ID NO: 43440 - RNA, 21 nt, Human
gccacugcacuccaggcuggg

SEQ ID NO: 43441 - RNA, 26 nt, Human
agucagcccagcaccaacuccgacgc

SEQ ID NO: 43442 - RNA, 20 nt, Human
ggugugugcugagcauggca

SEQ ID NO: 43443 - RNA, 22 nt, Human
cgccuggagcccuccgccuuca

SEQ ID NO: 43444 - RNA, 26 nt, Human
caguugccucuugaaguggauuuaac

SEQ ID NO: 43445 - RNA, 25 nt, Human
ggggagguaggcggggcggcgcgug

SEQ ID NO: 43446 - RNA, 23 nt, Human
ucaggccacaaggaccucugacc

SEQ ID NO: 43447 - RNA, 22 nt, Human
cuggacacagcucuucauucca

SEQ ID NO: 43448 - RNA, 21 nt, Human
gcuguucacucccauucuccc

SEQ ID NO: 43449 - RNA, 29 nt, Human
ugagcuuagauugccucucuagacaacua

SEQ ID NO: 43450 - RNA, 22 nt, Human
gggucucacccugucacucagg

SEQ ID NO: 43451 - RNA, 23 nt, Human
cucccuuccaaauaaaucacuuu

SEQ ID NO: 43452 - RNA, 23 nt, Human
uucauaggaugaaaugaaugacu

SEQ ID NO: 43453 - RNA, 27 nt, Human
ucagcacuccgucaguguugccaugac

SEQ ID NO: 43454 - RNA, 22 nt, Human
uuggggcagcuccugaguucag

SEQ ID NO: 43455 - RNA, 26 nt, Human
gcaguuucaaacucuaccauggauaa

SEQ ID NO: 43456 - RNA, 23 nt, Human
ugcgcuccaggguggucucgguc

SEQ ID NO: 43457 - RNA, 25 nt, Human
ggggugaggcagggucaagugcuac

SEQ ID NO: 43458 - RNA, 28 nt, Human
uacugggcauccggccugugcugggcau

SEQ ID NO: 43459 - RNA, 29 nt, Human
ucucggaacuccugaccucaggugaucug

SEQ ID NO: 43460 - RNA, 20 nt, Human
uggacacuucuuuauacucu

SEQ ID NO: 43461 - RNA, 18 nt, Human
cagagugaggggugcagg

SEQ ID NO: 43462 - RNA, 17 nt, Human
auaugcuggucagggcu

SEQ ID NO: 43463 - RNA, 22 nt, Human
uggggugcaccuguagucccag

SEQ ID NO: 43464 - RNA, 22 nt, Human
gcaggcggaucaccugaaauca

SEQ ID NO: 43465 - RNA, 21 nt, Human
cacccugaccaaucacugugg

SEQ ID NO: 43466 - RNA, 22 nt, Human
gguuugguuguguagcuucugu

SEQ ID NO: 43467 - RNA, 28 nt, Human
gggggucaugccgggggagccaccagcc

SEQ ID NO: 43468 - RNA, 24 nt, Human
gggggaaggcuacuccgcaucuca

SEQ ID NO: 43469 - RNA, 21 nt, Human
acagauaaauguggucucagc

SEQ ID NO: 43470 - RNA, 22 nt, Human
cuaaagcaucuuuaaucugcca

SEQ ID NO: 43471 - RNA, 26 nt, Human
ccuucaacaaccggccaccagauguc

SEQ ID NO: 43472 - RNA, 19 nt, Human
aaucagucuucauuuucca

SEQ ID NO: 43473 - RNA, 29 nt, Human
caccaacagaauuaaaaacgaaaaacaaa

SEQ ID NO: 43474 - RNA, 22 nt, Human
acagucccuauggaaagauggc

SEQ ID NO: 43475 - RNA, 25 nt, Human
ccugcugcuccucuaggccucacuc

SEQ ID NO: 43476 - RNA, 22 nt, Human
cacagcugcugugccaggacug

SEQ ID NO: 43477 - RNA, 21 nt, Human
accagccaugaauucagugaa

SEQ ID NO: 43478 - RNA, 26 nt, Human
gcuguucuccagccuuucuggaggga

SEQ ID NO: 43479 - RNA, 21 nt, Human
cuaagugcugggauuauaggc

SEQ ID NO: 43480 - RNA, 22 nt, Human
cugcaaccuccaccucccgggc

SEQ ID NO: 43481 - RNA, 20 nt, Human
aauaacugaaacuguuuguc

SEQ ID NO: 43482 - RNA, 25 nt, Human
guuugccaaucauugcaaacaacug

SEQ ID NO: 43483 - RNA, 21 nt, Human
uccuauaucagaaggccaggc

SEQ ID NO: 43484 - RNA, 20 nt, Human
ccuguaauccagcacuuugg

SEQ ID NO: 43485 - RNA, 21 nt, Human
aguugcugggauuacaggugu

SEQ ID NO: 43486 - RNA, 26 nt, Human
uccagccugggcaacauagcaaaauc

SEQ ID NO: 43487 - RNA, 24 nt, Human
cuccuccuccccucagccuugugg

SEQ ID NO: 43488 - RNA, 23 nt, Human
uuaaucaggacccaagucugcuu

SEQ ID NO: 43489 - RNA, 22 nt, Human
acuugcccugaacauacacaug

SEQ ID NO: 43490 - RNA, 28 nt, Human
ggcuggacauggccaagacacaaggcau

SEQ ID NO: 43491 - RNA, 19 nt, Human
gacuacaggcacaugccac

SEQ ID NO: 43492 - RNA, 20 nt, Human
cuuccagcaaacguacggga

SEQ ID NO: 43493 - RNA, 21 nt, Human
ucucccaucugcuuuucucca

SEQ ID NO: 43494 - RNA, 27 nt, Human
aacuguaccuucuaugguuugcuugca

SEQ ID NO: 43495 - RNA, 22 nt, Human
gaagugcugagcucuggggcag

SEQ ID NO: 43496 - RNA, 21 nt, Human
aaccuguuuucuucaagccug

SEQ ID NO: 43497 - RNA, 21 nt, Human
cuuacuucccuaaugaaguua

SEQ ID NO: 43498 - RNA, 27 nt, Human
caucuggaagaaaaugacuaaaacugu

SEQ ID NO: 43499 - RNA, 21 nt, Human
auauguuacuggaaaggccac

SEQ ID NO: 43500 - RNA, 27 nt, Human
agcucacugccuacuugcugcagggag

SEQ ID NO: 43501 - RNA, 21 nt, Human
aaccaaaaaacuacauauuuu

SEQ ID NO: 43502 - RNA, 19 nt, Human
aaaacacaaaauuagcugg

SEQ ID NO: 43503 - RNA, 22 nt, Human
caguuauaggaacaauucucuu

SEQ ID NO: 43504 - RNA, 26 nt, Human
uuuucaucugggaaagacauccauaa

SEQ ID NO: 43505 - RNA, 19 nt, Human
cucuucuccuccugugcca

SEQ ID NO: 43506 - RNA, 25 nt, Human
cacucugaggucaggaguuugagcc

SEQ ID NO: 43507 - RNA, 22 nt, Human
ggcuaauguuuguauuuuuagu

SEQ ID NO: 43508 - RNA, 22 nt, Human
cugaggcucacccaggucucca

SEQ ID NO: 43509 - RNA, 27 nt, Human
ggacuccuaugugaccuguucuuagag

SEQ ID NO: 43510 - RNA, 23 nt, Human
aaugacaucugcuguaauuuugg

SEQ ID NO: 43511 - RNA, 24 nt, Human
ggagaggaagaaaucuugcaucac

SEQ ID NO: 43512 - RNA, 21 nt, Human
agcauuuuauauuacuacuca

SEQ ID NO: 43513 - RNA, 21 nt, Human
acucuauccuggauaggcacu

SEQ ID NO: 43514 - RNA, 22 nt, Human
aggcugagccggguggaucgcc

SEQ ID NO: 43515 - RNA, 19 nt, Human
cucuccucaaugcugggcc

SEQ ID NO: 43516 - RNA, 23 nt, Human
ccuuucugucaaccucucauuuc

SEQ ID NO: 43517 - RNA, 21 nt, Human
acucccagccuagggcagcag

SEQ ID NO: 43518 - RNA, 21 nt, Human
cugccucugacucgcugugua

SEQ ID NO: 43519 - RNA, 23 nt, Human
cuucaguaaaugugauucaccuc

SEQ ID NO: 43520 - RNA, 22 nt, Human
ggaacuccuccuuccugcuuca

SEQ ID NO: 43521 - RNA, 21 nt, Human
ccuccgucugccucuuugguc

SEQ ID NO: 43522 - RNA, 23 nt, Human
auggcgccacugcacuccagccu

SEQ ID NO: 43523 - RNA, 29 nt, Human
cucuugaacuccugaccucagguaaucga

SEQ ID NO: 43524 - RNA, 26 nt, Human
acauugcagucugcuucugcaccuua

SEQ ID NO: 43525 - RNA, 24 nt, Human
guugcccaagucugggagugaggg

SEQ ID NO: 43526 - RNA, 23 nt, Human
cucuccaggagggcucggggugu

SEQ ID NO: 43527 - RNA, 20 nt, Human
uucuaucuccuuguugaucu

SEQ ID NO: 43528 - RNA, 27 nt, Human
ggcaggcagggucuguuggggucucuu

SEQ ID NO: 43529 - RNA, 22 nt, Human
uacuacugauauuugcuuuucu

SEQ ID NO: 43530 - RNA, 24 nt, Human
ugccuauagucucagccuccagag

SEQ ID NO: 43531 - RNA, 23 nt, Human
ucgggauuagaaggacaagagca

SEQ ID NO: 43532 - RNA, 24 nt, Human
ugcugcuuuuggggaaugagggga

SEQ ID NO: 43533 - RNA, 27 nt, Human
ugccagaccuccuuccugaccucugag

SEQ ID NO: 43534 - RNA, 21 nt, Human
aggacgcugugccauuuggga

SEQ ID NO: 43535 - RNA, 22 nt, Human
ggcaccgagaguucugaaggga

SEQ ID NO: 43536 - RNA, 22 nt, Human
cuuucagaugucuucugccugu

SEQ ID NO: 43537 - RNA, 23 nt, Human
gcccuacuccuuugcccaagaca

SEQ ID NO: 43538 - RNA, 24 nt, Human
ggacaugaucuucuuuauaauucu

SEQ ID NO: 43539 - RNA, 20 nt, Human
cacugcacacugccuagccc

SEQ ID NO: 43540 - RNA, 20 nt, Human
cauagaauuucacuuuugga

SEQ ID NO: 43541 - RNA, 21 nt, Human
aaucucugcauguuugcagca

SEQ ID NO: 43542 - RNA, 23 nt, Human
caggaaggggacaggauugucug

SEQ ID NO: 43543 - RNA, 24 nt, Human
acuggccuagccugggcaucacug

SEQ ID NO: 43544 - RNA, 22 nt, Human
ggcugcagcggaggcacuuugg

SEQ ID NO: 43545 - RNA, 19 nt, Human
cagacagaaacuggauuaa

SEQ ID NO: 43546 - RNA, 22 nt, Human
acagauaaucagaagaugauac

SEQ ID NO: 43547 - RNA, 24 nt, Human
cccuucaacauauuuuuuguacuu

SEQ ID NO: 43548 - RNA, 21 nt, Human
ccgagcugcuggggaggaccu

SEQ ID NO: 43549 - RNA, 23 nt, Human
cucugcucugcuguuacucagcc

SEQ ID NO: 43550 - RNA, 23 nt, Human
uccuuaaaauauaacugagauug

SEQ ID NO: 43551 - RNA, 24 nt, Human
cgccaggcaccacagccuccaaaa

SEQ ID NO: 43552 - RNA, 23 nt, Human
ucuguccccucuccccucaugga

SEQ ID NO: 43553 - RNA, 21 nt, Human
gccucugccauguccagaggg

SEQ ID NO: 43554 - RNA, 26 nt, Human
ugcugcuuacacuccagguguggacc

SEQ ID NO: 43555 - RNA, 22 nt, Human
gccgauauuugccauucuuccu

SEQ ID NO: 43556 - RNA, 27 nt, Human
ccuggaagugcuaauuuugaaaaacug

SEQ ID NO: 43557 - RNA, 21 nt, Human
ccuaccgccagccuccccgcc

SEQ ID NO: 43558 - RNA, 21 nt, Human
cuucccaggcuucugagaguc

SEQ ID NO: 43559 - RNA, 27 nt, Human
auagagugcacagcaaaggggaucugc

SEQ ID NO: 43560 - RNA, 23 nt, Human
ggggggaucggcaaacaggcuac

SEQ ID NO: 43561 - RNA, 23 nt, Human
cuguuucuucucaggcucaggga

SEQ ID NO: 43562 - RNA, 21 nt, Human
ggagggcagagggggcugugg

SEQ ID NO: 43563 - RNA, 21 nt, Human
ggcgcugccuuucgguugcca

SEQ ID NO: 43564 - RNA, 23 nt, Human
ggaugguguuaccuuagcuaacu

SEQ ID NO: 43565 - RNA, 25 nt, Human
cagacaccucuuucagaaacgccca

SEQ ID NO: 43566 - RNA, 27 nt, Human
uaggucuuugccuuccaagcacuguac

SEQ ID NO: 43567 - RNA, 24 nt, Human
cccgguaccuuccauacacagagg

SEQ ID NO: 43568 - RNA, 26 nt, Human
cacaagguuaucagaaagaucaaauu

SEQ ID NO: 43569 - RNA, 21 nt, Human
guggccuuuggauaucugucc

SEQ ID NO: 43570 - RNA, 24 nt, Human
acuucucauuuucuuugcugacuu

SEQ ID NO: 43571 - RNA, 19 nt, Human
ucucaauagaacuuguauu

SEQ ID NO: 43572 - RNA, 27 nt, Human
gaggaagaggaggcugguugguaccau

SEQ ID NO: 43573 - RNA, 21 nt, Human
ccugugcuauaagcagcagau

SEQ ID NO: 43574 - RNA, 26 nt, Human
ucugaacucaauguuuugcuuuuacu

SEQ ID NO: 43575 - RNA, 22 nt, Human
uuaggagcuguguguacauggg

SEQ ID NO: 43576 - RNA, 21 nt, Human
aguaaaccaaaaaggcuaguu

SEQ ID NO: 43577 - RNA, 24 nt, Human
aaaggaggacagggagggaacaga

SEQ ID NO: 43578 - RNA, 24 nt, Human
agacucaggaagacaacuucugca

SEQ ID NO: 43579 - RNA, 18 nt, Human
cugccuggugucugcugu

SEQ ID NO: 43580 - RNA, 26 nt, Human
ggccucucuagcuugcggccuguguc

SEQ ID NO: 43581 - RNA, 23 nt, Human
ccauugcacuccagccuugggcg

SEQ ID NO: 43582 - RNA, 21 nt, Human
ggugguauuuugcauugcaag

SEQ ID NO: 43583 - RNA, 26 nt, Human
caucccucuccagccacugcgacccg

SEQ ID NO: 43584 - RNA, 22 nt, Human
ugcuccaccccuccuguguguc

SEQ ID NO: 43585 - RNA, 21 nt, Human
acccagucucuuaaaucuuuu

SEQ ID NO: 43586 - RNA, 25 nt, Human
cugggggagagccggguucauuccc

SEQ ID NO: 43587 - RNA, 21 nt, Human
auucugcuaccucacuggggu

SEQ ID NO: 43588 - RNA, 27 nt, Human
uagccuggcuuuucuggcuggggaugg

SEQ ID NO: 43589 - RNA, 22 nt, Human
caggacugacagccgaguggcu

SEQ ID NO: 43590 - RNA, 24 nt, Human
uuccaucgguccuuacagccgcuc

SEQ ID NO: 43591 - RNA, 22 nt, Human
cgaggaggaggguugagcugcu

SEQ ID NO: 43592 - RNA, 21 nt, Human
cauccagcuaagcgaucuuga

SEQ ID NO: 43593 - RNA, 21 nt, Human
uccuguucacaagcugagcca

SEQ ID NO: 43594 - RNA, 21 nt, Human
cugucgcccaggcuggagugc

SEQ ID NO: 43595 - RNA, 22 nt, Human
ccaaccugacccccaucugcca

SEQ ID NO: 43596 - RNA, 18 nt, Human
uuucuuccucuucguggc

SEQ ID NO: 43597 - RNA, 26 nt, Human
gcuuguaugguuauggaggucugacu

SEQ ID NO: 43598 - RNA, 21 nt, Human
ccuuucuccuccggcagccag

SEQ ID NO: 43599 - RNA, 19 nt, Human
gcuggcaauucagcaaaga

SEQ ID NO: 43600 - RNA, 22 nt, Human
ccaggccucaguuucuucaccu

SEQ ID NO: 43601 - RNA, 19 nt, Human
uuuacugaucucuuagauu

SEQ ID NO: 43602 - RNA, 27 nt, Human
cccaaguugcugggauuacugacacaa

SEQ ID NO: 43603 - RNA, 20 nt, Human
cacacaugccuuucuggggu

SEQ ID NO: 43604 - RNA, 26 nt, Human
ugagccaagaucaugccacaucacuc

SEQ ID NO: 43605 - RNA, 23 nt, Human
ggugaggcccaagagcccugugg

SEQ ID NO: 43606 - RNA, 19 nt, Human
gggccuguaggagcugucc

SEQ ID NO: 43607 - RNA, 23 nt, Human
ggugugccaaacuaccguuccca

SEQ ID NO: 43608 - RNA, 20 nt, Human
uccacuaaaaauagaaaaau

SEQ ID NO: 43609 - RNA, 27 nt, Human
gccaaguacucguuuccacaccaagac

SEQ ID NO: 43610 - RNA, 20 nt, Human
aacuacccugugacuaugaa

SEQ ID NO: 43611 - RNA, 22 nt, Human
augagugggauagauggguuuu

SEQ ID NO: 43612 - RNA, 22 nt, Human
aaaccuacagacaaguacuuug

SEQ ID NO: 43613 - RNA, 21 nt, Human
uuccaaaugaacuugcacuug

SEQ ID NO: 43614 - RNA, 22 nt, Human
caugauacgcucugcgucugcu

SEQ ID NO: 43615 - RNA, 26 nt, Human
cuauuccucucuaccuuuaaggacau

SEQ ID NO: 43616 - RNA, 22 nt, Human
ugcaggacauuuggcugugaug

SEQ ID NO: 43617 - RNA, 25 nt, Human
agcaucagcugggcugcuuucuuug

SEQ ID NO: 43618 - RNA, 28 nt, Human
cuucugaucuugggaaaacagcgucuuc

SEQ ID NO: 43619 - RNA, 22 nt, Human
uggccuggagcuggagaguaag

SEQ ID NO: 43620 - RNA, 26 nt, Human
ugucuagccaauagguuaaaauuuca

SEQ ID NO: 43621 - RNA, 20 nt, Human
acuguguggauccaccagaa

SEQ ID NO: 43622 - RNA, 24 nt, Human
ucugcagcagagugacagcagugg

SEQ ID NO: 43623 - RNA, 23 nt, Human
uccuuggaaguaccccuguuucu

SEQ ID NO: 43624 - RNA, 24 nt, Human
ggaugcuggccacagaaaggccac

SEQ ID NO: 43625 - RNA, 25 nt, Human
cuauuagcuucacaagcacaacaaa

SEQ ID NO: 43626 - RNA, 27 nt, Human
uucaguuuuuuaaaacuucaauugucc

SEQ ID NO: 43627 - RNA, 23 nt, Human
agagccuagagcccuuugcucaa

SEQ ID NO: 43628 - RNA, 21 nt, Human
ucaccugcgugguccauucca

SEQ ID NO: 43629 - RNA, 26 nt, Human
uuuucagguuggagugcauucauuca

SEQ ID NO: 43630 - RNA, 23 nt, Human
cuucgccugccuccuuccuccgc

SEQ ID NO: 43631 - RNA, 21 nt, Human
gaaggcugagaggaguaggaa

SEQ ID NO: 43632 - RNA, 22 nt, Human
cacaaggucaagagauagagac

SEQ ID NO: 43633 - RNA, 29 nt, Human
uuguacuagcugugccugccuuguuguga

SEQ ID NO: 43634 - RNA, 26 nt, Human
acugggagacuggggagacuggcugu

SEQ ID NO: 43635 - RNA, 27 nt, Human
ggguacccggcucugcaucgcgucgcc

SEQ ID NO: 43636 - RNA, 22 nt, Human
uggcucacgccucuaaucccag

SEQ ID NO: 43637 - RNA, 20 nt, Human
guuuccuguaucauaaaucc

SEQ ID NO: 43638 - RNA, 20 nt, Human
gacucuuuagaauacuccaa

SEQ ID NO: 43639 - RNA, 20 nt, Human
guugaggcgagcagggcagg

SEQ ID NO: 43640 - RNA, 25 nt, Human
aggagacugaggcagaaggaucgcu

SEQ ID NO: 43641 - RNA, 31 nt, Human
gguaauuacauuggaaaguucugcaauaaga

SEQ ID NO: 43642 - RNA, 19 nt, Human
gcacugcagcuuccugcuc

SEQ ID NO: 43643 - RNA, 23 nt, Human
gucacccaaggcugguggucagu

SEQ ID NO: 43644 - RNA, 21 nt, Human
uggccaucccuuccccagcca

SEQ ID NO: 43645 - RNA, 27 nt, Human
aaagaacaaauacuuaacgugggagug

SEQ ID NO: 43646 - RNA, 22 nt, Human
gcaaaacuuggacaggggcaaa

SEQ ID NO: 43647 - RNA, 19 nt, Human
cuuuagacucaaaugcuua

SEQ ID NO: 43648 - RNA, 27 nt, Human
cgcugcacuccguaacucaacauggca

SEQ ID NO: 43649 - RNA, 23 nt, Human
gcuauucuccccuaauuaauauc

SEQ ID NO: 43650 - RNA, 20 nt, Human
gguaauguauggagcauuuu

SEQ ID NO: 43651 - RNA, 22 nt, Human
ccgggaucgcgccacuguacuc

SEQ ID NO: 43652 - RNA, 19 nt, Human
uuaugcuuuugccaacaca

SEQ ID NO: 43653 - RNA, 21 nt, Human
acagacuucugagacucagac

SEQ ID NO: 43654 - RNA, 26 nt, Human
gcggcagccucacacgcgagcgccac

SEQ ID NO: 43655 - RNA, 21 nt, Human
auggugcacuugaaaaaucaa

SEQ ID NO: 43656 - RNA, 25 nt, Human
ucauccagcagguuggguucuaggg

SEQ ID NO: 43657 - RNA, 24 nt, Human
aggguagcaugggauuacagggcc

SEQ ID NO: 43658 - RNA, 24 nt, Human
ugucacccaggcuggagugccgug

SEQ ID NO: 43659 - RNA, 24 nt, Human
ugucccccaggcuggagugcagug

SEQ ID NO: 43660 - RNA, 24 nt, Human
uaugcaaaucauacuccugcccaa

SEQ ID NO: 43661 - RNA, 22 nt, Human
cacacguuuaaucccagcacuu

SEQ ID NO: 43662 - RNA, 21 nt, Human
gaauucccuggauacagccuu

SEQ ID NO: 43663 - RNA, 22 nt, Human
uucuucuggcuugaaacccccu

SEQ ID NO: 43664 - RNA, 21 nt, Human
uucaaagcugugaaaaaucaa

SEQ ID NO: 43665 - RNA, 23 nt, Human
caccuccaucuucuuugcagccu

SEQ ID NO: 43666 - RNA, 25 nt, Human
cucccuggaaauaacugagcacuuu

SEQ ID NO: 43667 - RNA, 19 nt, Human
gccuugggaagugagacua

SEQ ID NO: 43668 - RNA, 23 nt, Human
aaaagaaauguuuuuagcuguag

SEQ ID NO: 43669 - RNA, 19 nt, Human
guguucucuucccucucuc

SEQ ID NO: 43670 - RNA, 25 nt, Human
ggacuaaugauguuuccucuugccu

SEQ ID NO: 43671 - RNA, 24 nt, Human
uggguauagacaauaaagaacuga

SEQ ID NO: 43672 - RNA, 19 nt, Human
gcucuauucccccucugcc

SEQ ID NO: 43673 - RNA, 22 nt, Human
ggcucucugcaaccuccgccuc

SEQ ID NO: 43674 - RNA, 22 nt, Human
agagggcuuggaauaaaaugaa

SEQ ID NO: 43675 - RNA, 24 nt, Human
ucaagagcaucuggaacaacagau

SEQ ID NO: 43676 - RNA, 21 nt, Human
ccagccgccgcccugcuccag

SEQ ID NO: 43677 - RNA, 21 nt, Human
ugccagaaauguuauuaauaa

SEQ ID NO: 43678 - RNA, 19 nt, Human
ucccaggcugaagugcagu

SEQ ID NO: 43679 - RNA, 22 nt, Human
ucugaacuaacuugcuuuuaga

SEQ ID NO: 43680 - RNA, 23 nt, Human
gcaaagcccagagcaucugagca

SEQ ID NO: 43681 - RNA, 27 nt, Human
ugucacccaggcuggagugcuauggcu

SEQ ID NO: 43682 - RNA, 22 nt, Human
augaagcccuacaugaucacug

SEQ ID NO: 43683 - RNA, 21 nt, Human
agaaacugcagccccacuucu

SEQ ID NO: 43684 - RNA, 18 nt, Human
caugcuuacuuguggauc

SEQ ID NO: 43685 - RNA, 24 nt, Human
cccuucagaccagcugcuuccauc

SEQ ID NO: 43686 - RNA, 21 nt, Human
cugcugaaaugcugccucuug

SEQ ID NO: 43687 - RNA, 25 nt, Human
ccugcugcugccccucuaggucugg

SEQ ID NO: 43688 - RNA, 22 nt, Human
agggaggccuccgaaaugcaga

SEQ ID NO: 43689 - RNA, 22 nt, Human
ucuuauaauuguucucagaauc

SEQ ID NO: 43690 - RNA, 24 nt, Human
uucauucucaugauuauuauuuua

SEQ ID NO: 43691 - RNA, 20 nt, Human
uccagggugguccggguuug

SEQ ID NO: 43692 - RNA, 19 nt, Human
cacucggguggaguggaag

SEQ ID NO: 43693 - RNA, 26 nt, Human
ugcuaccucgagaagccauggccugc

SEQ ID NO: 43694 - RNA, 29 nt, Human
gguccuacccgcuucccaucaccggagga

SEQ ID NO: 43695 - RNA, 22 nt, Human
auuuucucagaauuuacacuca

SEQ ID NO: 43696 - RNA, 22 nt, Human
auuaucucugaguccaccagaa

SEQ ID NO: 43697 - RNA, 27 nt, Human
ccaggagguggagaucccuccggucca

SEQ ID NO: 43698 - RNA, 25 nt, Human
ccucuugguggguguggccagcaca

SEQ ID NO: 43699 - RNA, 20 nt, Human
cggccaggcuggagugcagu

SEQ ID NO: 43700 - RNA, 20 nt, Human
gcuacuucccuuccucccgg

SEQ ID NO: 43701 - RNA, 18 nt, Human
cucugguggcaggugcuu

SEQ ID NO: 43702 - RNA, 21 nt, Human
aaccuuuucuuccuggauuug

SEQ ID NO: 43703 - RNA, 21 nt, Human
uauugccuguauuucuaccuc

SEQ ID NO: 43704 - RNA, 27 nt, Human
aucaucuggauuaggaaaugaauuugu

SEQ ID NO: 43705 - RNA, 27 nt, Human
ugaggggagcaugcuucccugcagcug

SEQ ID NO: 43706 - RNA, 25 nt, Human
acagcauaaagcacauugcugagcc

SEQ ID NO: 43707 - RNA, 24 nt, Human
ggagagguggggacagcaagaagc

SEQ ID NO: 43708 - RNA, 26 nt, Human
gacauaaggagugccugaauagcuug

SEQ ID NO: 43709 - RNA, 25 nt, Human
aacuuuucauguauuaccuggucau

SEQ ID NO: 43710 - RNA, 22 nt, Human
ucuuucuaaauuucucucucca

SEQ ID NO: 43711 - RNA, 27 nt, Human
gaacagcugaaauacugucacuagugg

SEQ ID NO: 43712 - RNA, 19 nt, Human
auucugacacuuuggggug

SEQ ID NO: 43713 - RNA, 28 nt, Human
gcggcgcucgguuucccgccuccuaggg

SEQ ID NO: 43714 - RNA, 23 nt, Human
gaagauuuauaccauugugguuu

SEQ ID NO: 43715 - RNA, 21 nt, Human
aguccccuuuaaaugcacauu

SEQ ID NO: 43716 - RNA, 22 nt, Human
ggucacugcaaacuccgccucc

SEQ ID NO: 43717 - RNA, 20 nt, Human
ugugcccacuucauagauga

SEQ ID NO: 43718 - RNA, 26 nt, Human
acagaaguaucaagccaugugcuuua

SEQ ID NO: 43719 - RNA, 19 nt, Human
ccaguguccuaaaguuuua

SEQ ID NO: 43720 - RNA, 22 nt, Human
gaguguugccaauuuucugauu

SEQ ID NO: 43721 - RNA, 27 nt, Human
uaaauauucauugaauaaugaaugaac

SEQ ID NO: 43722 - RNA, 25 nt, Human
gcaccuuggucccagugucuuccuu

SEQ ID NO: 43723 - RNA, 20 nt, Human
ggggacacaguggugcucug

SEQ ID NO: 43724 - RNA, 27 nt, Human
uagcuaacccuucguugugcacaugua

SEQ ID NO: 43725 - RNA, 19 nt, Human
ucucaaaggggcagaggaa

SEQ ID NO: 43726 - RNA, 27 nt, Human
gugucggcagugcuggugucugucguc

SEQ ID NO: 43727 - RNA, 25 nt, Human
gaguguguggaccaccccacagagg

SEQ ID NO: 43728 - RNA, 24 nt, Human
uacuuaagucggggguggcaaggg

SEQ ID NO: 43729 - RNA, 22 nt, Human
gagaggaaggagguggagcagc

SEQ ID NO: 43730 - RNA, 21 nt, Human
uuguugcccaggcuggagugc

SEQ ID NO: 43731 - RNA, 20 nt, Human
ucucauuccacuguugguau

SEQ ID NO: 43732 - RNA, 27 nt, Human
ugaccaacauugagauauccuuuauca

SEQ ID NO: 43733 - RNA, 20 nt, Human
aacauuuuccccuaagccca

SEQ ID NO: 43734 - RNA, 21 nt, Human
ggcucacugcaaccuucaccu

SEQ ID NO: 43735 - RNA, 21 nt, Human
ggcucaccgcaaccuccaccu

SEQ ID NO: 43736 - RNA, 21 nt, Human
gacucacugcaaccuucgccu

SEQ ID NO: 43737 - RNA, 23 nt, Human
uggcuauauacauggcuuuagua

SEQ ID NO: 43738 - RNA, 19 nt, Human
cagaagcagguugcaguga

SEQ ID NO: 43739 - RNA, 19 nt, Human
acuaaaaucaaaguuucac

SEQ ID NO: 43740 - RNA, 24 nt, Human
ggagggcggguggcgcgggaggaa

SEQ ID NO: 43741 - RNA, 22 nt, Human
cccaucuggccugaacugaggc

SEQ ID NO: 43742 - RNA, 18 nt, Human
uugucucuggcauugauu

SEQ ID NO: 43743 - RNA, 19 nt, Human
cccagccucacccugcauu

SEQ ID NO: 43744 - RNA, 23 nt, Human
uucaggaggcggagguugcagug

SEQ ID NO: 43745 - RNA, 27 nt, Human
gcgugaaccaccaugccaggagggaau

SEQ ID NO: 43746 - RNA, 26 nt, Human
cccacccaguccggcuggacugcggc

SEQ ID NO: 43747 - RNA, 24 nt, Human
agcucacuucucuguguucugccu

SEQ ID NO: 43748 - RNA, 24 nt, Human
cuccaccuugcagcucuccccuuc

SEQ ID NO: 43749 - RNA, 19 nt, Human
gucuacccugaucaccuca

SEQ ID NO: 43750 - RNA, 21 nt, Human
cagcagccucugggaccucgg

SEQ ID NO: 43751 - RNA, 22 nt, Human
cagcccagccacggacgcuggc

SEQ ID NO: 43752 - RNA, 23 nt, Human
cccaagcagcuggccaacaugug

SEQ ID NO: 43753 - RNA, 22 nt, Human
caggcagccuccgggcguguga

SEQ ID NO: 43754 - RNA, 23 nt, Human
aaguaucuguuuuaauaagcucu

SEQ ID NO: 43755 - RNA, 22 nt, Human
cuggggucacuucuuugcccac

SEQ ID NO: 43756 - RNA, 27 nt, Human
ccguauuuaaugccucugacugccuuu

SEQ ID NO: 43757 - RNA, 22 nt, Human
ucugggagaccucggggaguuu

SEQ ID NO: 43758 - RNA, 27 nt, Human
ggagccacauggauugauuguauccac

SEQ ID NO: 43759 - RNA, 17 nt, Human
uacauauauaugccuua

SEQ ID NO: 43760 - RNA, 21 nt, Human
uaguauuaucuacuuacuuga

SEQ ID NO: 43761 - RNA, 23 nt, Human
gagcagccacacucgcaccuccu

SEQ ID NO: 43762 - RNA, 26 nt, Human
ucuuguuucuuuccucccugucuuag

SEQ ID NO: 43763 - RNA, 27 nt, Human
gaacaaagggaacucaagauucuucca

SEQ ID NO: 43764 - RNA, 27 nt, Human
cgcaacucagacccagugaacccaagg

SEQ ID NO: 43765 - RNA, 22 nt, Human
cccacucuguacagcugcucuu

SEQ ID NO: 43766 - RNA, 24 nt, Human
cagcccagugccgugagcccugac

SEQ ID NO: 43767 - RNA, 22 nt, Human
aucaacucucucagcuacaugg

SEQ ID NO: 43768 - RNA, 20 nt, Human
agcucacauuccugucccuu

SEQ ID NO: 43769 - RNA, 22 nt, Human
agguagugcuuuuuauuuuaaa

SEQ ID NO: 43770 - RNA, 24 nt, Human
cagguguuuccguaccacagcagg

SEQ ID NO: 43771 - RNA, 22 nt, Human
aucgcuugaaccugggaggcag

SEQ ID NO: 43772 - RNA, 22 nt, Human
auugcuugaaucugggaggcag

SEQ ID NO: 43773 - RNA, 27 nt, Human
gggagagggaaucggagggagcagcgg

SEQ ID NO: 43774 - RNA, 22 nt, Human
cugggaggccaggauggcacug

SEQ ID NO: 43775 - RNA, 23 nt, Human
uccucauucccucgucuuuccca

SEQ ID NO: 43776 - RNA, 23 nt, Human
uagaaagaauuuagcugcaagug

SEQ ID NO: 43777 - RNA, 24 nt, Human
agcccacguggugugguuggugaa

SEQ ID NO: 43778 - RNA, 21 nt, Human
ggaugccaccuggagccccac

SEQ ID NO: 43779 - RNA, 21 nt, Human
aacaggacaugaucucacaug

SEQ ID NO: 43780 - RNA, 27 nt, Human
cccagccugaugccagaacaaaggaca

SEQ ID NO: 43781 - RNA, 20 nt, Human
ucuucacuugugauauugug

SEQ ID NO: 43782 - RNA, 20 nt, Human
gcccagggacuggagcggga

SEQ ID NO: 43783 - RNA, 22 nt, Human
ugcuuuaaaaauggccuuccua

SEQ ID NO: 43784 - RNA, 22 nt, Human
gcccuggccuaccacagcugcc

SEQ ID NO: 43785 - RNA, 22 nt, Human
gguggagggcaaggcugggggg

SEQ ID NO: 43786 - RNA, 25 nt, Human
gaaacaacagaagucuauucaccug

SEQ ID NO: 43787 - RNA, 25 nt, Human
ccugaugauggcccuguuggccugu

SEQ ID NO: 43788 - RNA, 27 nt, Human
agccucuccccaucuaccuagcaacug

SEQ ID NO: 43789 - RNA, 21 nt, Human
aagguuugcccugccugcagc

SEQ ID NO: 43790 - RNA, 22 nt, Human
gcucaagcugaauaaauagcug

SEQ ID NO: 43791 - RNA, 23 nt, Human
agcaaggaaacaugguuuggauu

SEQ ID NO: 43792 - RNA, 21 nt, Human
aagaggcagaucuuugcugcc

SEQ ID NO: 43793 - RNA, 22 nt, Human
gggucccggguccuuugcggcg

SEQ ID NO: 43794 - RNA, 25 nt, Human
aagacuccugggcuucagccucucc

SEQ ID NO: 43795 - RNA, 19 nt, Human
aaaauccugaaaaccagga

SEQ ID NO: 43796 - RNA, 20 nt, Human
cugacagaugguaucugcca

SEQ ID NO: 43797 - RNA, 22 nt, Human
ccacacacauccucaccccaca

SEQ ID NO: 43798 - RNA, 18 nt, Human
gccaaauaaaaaucuuug

SEQ ID NO: 43799 - RNA, 31 nt, Human
ccuucucggcuuccuccucagccccgggccg

SEQ ID NO: 43800 - RNA, 23 nt, Human
uuucaagaaaaggaaauuggugg

SEQ ID NO: 43801 - RNA, 22 nt, Human
gacaguauuuaaauauugcaaa

SEQ ID NO: 43802 - RNA, 22 nt, Human
aggagggaccuacaaagacugg

SEQ ID NO: 43803 - RNA, 22 nt, Human
acgugacaggaagaggagggag

SEQ ID NO: 43804 - RNA, 22 nt, Human
uugcaaccuccgccucccgggu

SEQ ID NO: 43805 - RNA, 22 nt, Human
cugcaaccuccgccucucgggu

SEQ ID NO: 43806 - RNA, 23 nt, Human
cccggacucuacacacacaagcu

SEQ ID NO: 43807 - RNA, 28 nt, Human
cagagcuguugcucugugcagaccacga

SEQ ID NO: 43808 - RNA, 26 nt, Human
ggggacuuucuaccagacucacagag

SEQ ID NO: 43809 - RNA, 28 nt, Human
gggcacagggaagagggagggugucuca

SEQ ID NO: 43810 - RNA, 19 nt, Human
uucaauacaaggggaaaau

SEQ ID NO: 43811 - RNA, 27 nt, Human
cgcggaugccgccucaagggucuucag

SEQ ID NO: 43812 - RNA, 22 nt, Human
ucaaugauacagucccuaaaga

SEQ ID NO: 43813 - RNA, 25 nt, Human
agccucagaagaccuggaacaagau

SEQ ID NO: 43814 - RNA, 23 nt, Human
auacuuuuugcaaacaaaugcau

SEQ ID NO: 43815 - RNA, 28 nt, Human
uuccaguugcaauucauaacuaaugaau

SEQ ID NO: 43816 - RNA, 24 nt, Human
aaauguuccuuccgccacucacug

SEQ ID NO: 43817 - RNA, 21 nt, Human
guuguauauuaucuaacuggu

SEQ ID NO: 43818 - RNA, 21 nt, Human
ggggugaggaauggaugcugu

SEQ ID NO: 43819 - RNA, 22 nt, Human
ucuggagaacccagaggcagcu

SEQ ID NO: 43820 - RNA, 27 nt, Human
caggcuggaguggaguggcacgaucuu

SEQ ID NO: 43821 - RNA, 27 nt, Human
ggggaagagagaggccugggugugacc

SEQ ID NO: 43822 - RNA, 20 nt, Human
gugauugccauuucuuccca

SEQ ID NO: 43823 - RNA, 19 nt, Human
ggccacaauacccaccucu

SEQ ID NO: 43824 - RNA, 21 nt, Human
cacccaggagcaggguggugg

SEQ ID NO: 43825 - RNA, 23 nt, Human
ccgggacgcagagguuacaguga

SEQ ID NO: 43826 - RNA, 20 nt, Human
auuauccaggcugagaugga

SEQ ID NO: 43827 - RNA, 27 nt, Human
gaugucaggagagcugcugcccucuug

SEQ ID NO: 43828 - RNA, 23 nt, Human
cucgagguauaaccgucggcaga

SEQ ID NO: 43829 - RNA, 25 nt, Human
cuuuuggacaugcuuuugcagacag

SEQ ID NO: 43830 - RNA, 21 nt, Human
caagcccaguuguugcaguga

SEQ ID NO: 43831 - RNA, 22 nt, Human
cuuggccucccaaagcgcuggg

SEQ ID NO: 43832 - RNA, 27 nt, Human
uauuucuuacguacacuguacuucugu

SEQ ID NO: 43833 - RNA, 22 nt, Human
gucuugaacuccuggacuuaga

SEQ ID NO: 43834 - RNA, 24 nt, Human
agaaggagaaggcuggagaaggac

SEQ ID NO: 43835 - RNA, 22 nt, Human
caaacuccugggcuccaacgau

SEQ ID NO: 43836 - RNA, 24 nt, Human
cucacacacaggucugucugucac

SEQ ID NO: 43837 - RNA, 22 nt, Human
aaucuucacaugaaugucggua

SEQ ID NO: 43838 - RNA, 22 nt, Human
agaggggccucaucagcaaaga

SEQ ID NO: 43839 - RNA, 23 nt, Human
ucgccugagauguuuuacuucuc

SEQ ID NO: 43840 - RNA, 17 nt, Human
uauuuaaaaaugucuug

SEQ ID NO: 43841 - RNA, 21 nt, Human
uccauuacaggggcagugccu

SEQ ID NO: 43842 - RNA, 21 nt, Human
uuggguggaaaacagggugcu

SEQ ID NO: 43843 - RNA, 24 nt, Human
cgcuaccauuuggccaaacaaccg

SEQ ID NO: 43844 - RNA, 22 nt, Human
gcaauuuuuguucacugcaacc

SEQ ID NO: 43845 - RNA, 20 nt, Human
cucaucuccaagucaccucc

SEQ ID NO: 43846 - RNA, 24 nt, Human
aggagaaagccagauucccaggga

SEQ ID NO: 43847 - RNA, 21 nt, Human
ugccagcggaggcugcacuga

SEQ ID NO: 43848 - RNA, 25 nt, Human
gcucauugugcccauugcucuuuca

SEQ ID NO: 43849 - RNA, 22 nt, Human
cagcaccaccagcugugggcag

SEQ ID NO: 43850 - RNA, 21 nt, Human
auucagucugauacuugaaug

SEQ ID NO: 43851 - RNA, 16 nt, Human
ucuacuucccugcuaa

SEQ ID NO: 43852 - RNA, 21 nt, Human
ugcaauuuccccucugugucc

SEQ ID NO: 43853 - RNA, 20 nt, Human
ucauucuccaacgauauaca

SEQ ID NO: 43854 - RNA, 21 nt, Human
augaaggcuugaggucagccu

SEQ ID NO: 43855 - RNA, 26 nt, Human
aaccaaaagagaucacaauacucaaa

SEQ ID NO: 43856 - RNA, 25 nt, Human
aaccagguuccugcccggucagcgc

SEQ ID NO: 43857 - RNA, 26 nt, Human
ugcucuuacaaggcuuggaaacuaug

SEQ ID NO: 43858 - RNA, 20 nt, Human
gagcugcccuuucuacuuca

SEQ ID NO: 43859 - RNA, 23 nt, Human
gccauucucccccucuuugggca

SEQ ID NO: 43860 - RNA, 25 nt, Human
agaguagggggagggauaggaagac

SEQ ID NO: 43861 - RNA, 24 nt, Human
aucccuuaagcaagcagggugggg

SEQ ID NO: 43862 - RNA, 27 nt, Human
ccuccuuccuguucaccuuugccuuug

SEQ ID NO: 43863 - RNA, 21 nt, Human
guccucuccccucgcgcacag

SEQ ID NO: 43864 - RNA, 27 nt, Human
ggggccugcugacugaaggaauuugug

SEQ ID NO: 43865 - RNA, 23 nt, Human
gcugaaaaggcugcucacucuca

SEQ ID NO: 43866 - RNA, 22 nt, Human
cuucccuugguuccaaaagcca

SEQ ID NO: 43867 - RNA, 26 nt, Human
cuauuugaacuacuuaaacaguauua

SEQ ID NO: 43868 - RNA, 20 nt, Human
uuaaacuggcauucuugccu

SEQ ID NO: 43869 - RNA, 21 nt, Human
gacuauguaauuguaacuaua

SEQ ID NO: 43870 - RNA, 27 nt, Human
ccuucuuucugcccuccagauccacgg

SEQ ID NO: 43871 - RNA, 24 nt, Human
auggagccuggauuuuucccacug

SEQ ID NO: 43872 - RNA, 22 nt, Human
uaaucuuuuucuaacuggacug

SEQ ID NO: 43873 - RNA, 27 nt, Human
ccugauggugcugcucaggcccaugcu

SEQ ID NO: 43874 - RNA, 21 nt, Human
ugggaggagcgagggagcgag

SEQ ID NO: 43875 - RNA, 21 nt, Human
uauccaccugccuuggcuucc

SEQ ID NO: 43876 - RNA, 27 nt, Human
uugcccaagggacaacaacaaacagug

SEQ ID NO: 43877 - RNA, 23 nt, Human
ggcaccagcagcagaauggggaa

SEQ ID NO: 43878 - RNA, 23 nt, Human
caugaugugaauaggcaugauaa

SEQ ID NO: 43879 - RNA, 26 nt, Human
ucgggaggcugaggcaggagaaaggc

SEQ ID NO: 43880 - RNA, 26 nt, Human
ugggacaagauaacauagcagaggaa

SEQ ID NO: 43881 - RNA, 26 nt, Human
augaacacaugggccgccgcucaucc

SEQ ID NO: 43882 - RNA, 27 nt, Human
cauuggauuugguggaacagcaaucau

SEQ ID NO: 43883 - RNA, 22 nt, Human
uagaaguaggaggcuggacgac

SEQ ID NO: 43884 - RNA, 25 nt, Human
uuuuaauaacaugauuuguucuuua

SEQ ID NO: 43885 - RNA, 24 nt, Human
uucaccagaauggaaagaccugua

SEQ ID NO: 43886 - RNA, 24 nt, Human
agguacuucuacucacagcggccg

SEQ ID NO: 43887 - RNA, 24 nt, Human
agauagugucagcuuauuugaaga

SEQ ID NO: 43888 - RNA, 21 nt, Human
agugcuuugcccaucagugaa

SEQ ID NO: 43889 - RNA, 20 nt, Human
cuaaugcucugaucugucca

SEQ ID NO: 43890 - RNA, 24 nt, Human
uucacagucaccaaguguauugua

SEQ ID NO: 43891 - RNA, 20 nt, Human
agugagacccuaucucuaca

SEQ ID NO: 43892 - RNA, 25 nt, Human
ugucugugagcagcacuugacagcu

SEQ ID NO: 43893 - RNA, 22 nt, Human
agcuaauuuuuguauuuuuguu

SEQ ID NO: 43894 - RNA, 22 nt, Human
cacaggcugggguggaugacuu

SEQ ID NO: 43895 - RNA, 28 nt, Human
ggaguagaagaagggucgucccugcugc

SEQ ID NO: 43896 - RNA, 18 nt, Human
uggucucagaacaacuca

SEQ ID NO: 43897 - RNA, 22 nt, Human
augaucucagcucacugcaaac

SEQ ID NO: 43898 - RNA, 21 nt, Human
guggguugggagagagcugug

SEQ ID NO: 43899 - RNA, 26 nt, Human
uugccugcugcugcugcugcugccuc

SEQ ID NO: 43900 - RNA, 24 nt, Human
accaucaaaacaaaggaugggaua

SEQ ID NO: 43901 - RNA, 22 nt, Human
accaaaacucagcagugugauc

SEQ ID NO: 43902 - RNA, 26 nt, Human
cuuccaaugcugccuugaucucuguc

SEQ ID NO: 43903 - RNA, 21 nt, Human
uucuaaaguucuaagauucug

SEQ ID NO: 43904 - RNA, 19 nt, Human
agaaaugcagugucugccu

SEQ ID NO: 43905 - RNA, 21 nt, Human
ccgggaguggagcuugcaaug

SEQ ID NO: 43906 - RNA, 22 nt, Human
uaugccuguaaucccgguacuu

SEQ ID NO: 43907 - RNA, 21 nt, Human
uucuuaaaaaucagcuauuua

SEQ ID NO: 43908 - RNA, 26 nt, Human
uucacuaauuuagcaaugcauucaua

SEQ ID NO: 43909 - RNA, 22 nt, Human
gcugccucugccacugacugca

SEQ ID NO: 43910 - RNA, 22 nt, Human
ccagcacaguggccaggaaaag

SEQ ID NO: 43911 - RNA, 23 nt, Human
uggggaucccagaaccucccuga

SEQ ID NO: 43912 - RNA, 22 nt, Human
uacuaauuuuuguauuuuuugu

SEQ ID NO: 43913 - RNA, 27 nt, Human
agggugaggauggugagggagggcugg

SEQ ID NO: 43914 - RNA, 25 nt, Human
uaaucuguuccuuacagcacuugcu

SEQ ID NO: 43915 - RNA, 22 nt, Human
ggcaggacuccuggcagggcca

SEQ ID NO: 43916 - RNA, 24 nt, Human
ggagaggguggcaucaggagcugc

SEQ ID NO: 43917 - RNA, 20 nt, Human
ugucaucuaauuaagggaau

SEQ ID NO: 43918 - RNA, 27 nt, Human
ugcauuccuuauuuugucuagaaauua

SEQ ID NO: 43919 - RNA, 22 nt, Human
cucauuucuaaaagaauauuca

SEQ ID NO: 43920 - RNA, 22 nt, Human
ggccaucagauuagcagggacg

SEQ ID NO: 43921 - RNA, 25 nt, Human
uccuucuccccuccagaccccuacc

SEQ ID NO: 43922 - RNA, 28 nt, Human
aggaaacuucugccucagguggggagag

SEQ ID NO: 43923 - RNA, 22 nt, Human
gugugagccaccgcccccggcc

SEQ ID NO: 43924 - RNA, 22 nt, Human
aggcaggcggaucacaagguca

SEQ ID NO: 43925 - RNA, 19 nt, Human
gcacagccauacggcacug

SEQ ID NO: 43926 - RNA, 19 nt, Human
acuuuucugagcagacguc

SEQ ID NO: 43927 - RNA, 23 nt, Human
ucccugcgcccccuuccucuccg

SEQ ID NO: 43928 - RNA, 22 nt, Human
gcuuuugcuuaguguuuccugg

SEQ ID NO: 43929 - RNA, 19 nt, Human
uuuuuauaucuaacuuucc

SEQ ID NO: 43930 - RNA, 26 nt, Human
agugccagcucaaguuggaguugacu

SEQ ID NO: 43931 - RNA, 26 nt, Human
ccugccucucugggugggugaggggc

SEQ ID NO: 43932 - RNA, 28 nt, Human
gggucccaccccucaccccacccccacc

SEQ ID NO: 43933 - RNA, 26 nt, Human
agcccuccuccuccuuaacccugcca

SEQ ID NO: 43934 - RNA, 20 nt, Human
cuuaauuccuaaacuaccuu

SEQ ID NO: 43935 - RNA, 27 nt, Human
ccugcuagccaacauucagcugcucug

SEQ ID NO: 43936 - RNA, 19 nt, Human
gacaggugcgaaaggauga

SEQ ID NO: 43937 - RNA, 25 nt, Human
gggguagggagagggaggagguugc

SEQ ID NO: 43938 - RNA, 22 nt, Human
uuucauuuuugcagugugguuc

SEQ ID NO: 43939 - RNA, 27 nt, Human
aucaugaaagaaggcaugcggaugaga

SEQ ID NO: 43940 - RNA, 23 nt, Human
ggcugucagccaaggugccugaa

SEQ ID NO: 43941 - RNA, 28 nt, Human
ucucaaacuccugaccucaggugaucua

SEQ ID NO: 43942 - RNA, 22 nt, Human
auugaaaugaggugccacccag

SEQ ID NO: 43943 - RNA, 18 nt, Human
ggcaggcagugguucggu

SEQ ID NO: 43944 - RNA, 25 nt, Human
aagacuagaaaauuagacugugauu

SEQ ID NO: 43945 - RNA, 25 nt, Human
aggcagugagacugguggggcacgg

SEQ ID NO: 43946 - RNA, 21 nt, Human
gaagaaaaagaaggacugaac

SEQ ID NO: 43947 - RNA, 27 nt, Human
ggaacuccacucggggaacuccuuucc

SEQ ID NO: 43948 - RNA, 22 nt, Human
uugggacucugucuuacauauc

SEQ ID NO: 43949 - RNA, 22 nt, Human
uuuguaucucugccugugauuu

SEQ ID NO: 43950 - RNA, 22 nt, Human
ccugcacuggguuguccaggga

SEQ ID NO: 43951 - RNA, 23 nt, Human
agacccuucucuuaauagagaga

SEQ ID NO: 43952 - RNA, 21 nt, Human
cucauuucuuacucuuuuucu

SEQ ID NO: 43953 - RNA, 27 nt, Human
gggagagagacuggagcuggcaaggac

SEQ ID NO: 43954 - RNA, 26 nt, Human
cuucugcugcaacgaaaauauuuccu

SEQ ID NO: 43955 - RNA, 22 nt, Human
caauguauaauacauucacauc

SEQ ID NO: 43956 - RNA, 18 nt, Human
ugacagccacccagcccu

SEQ ID NO: 43957 - RNA, 22 nt, Human
agguaccagcuuugcagaggag

SEQ ID NO: 43958 - RNA, 24 nt, Human
cuagaaccugugucuuauuccuau

SEQ ID NO: 43959 - RNA, 21 nt, Human
cuuaugcaccuuacugccuag

SEQ ID NO: 43960 - RNA, 24 nt, Human
cugucucccaggcuggagugcagu

SEQ ID NO: 43961 - RNA, 22 nt, Human
cacagccgccagacccgccugc

SEQ ID NO: 43962 - RNA, 25 nt, Human
ugcacgauggaauuguguuuugcgu

SEQ ID NO: 43963 - RNA, 22 nt, Human
cagaugacagagguuugaagga

SEQ ID NO: 43964 - RNA, 25 nt, Human
acugaagaacauuuuuaauucuuua

SEQ ID NO: 43965 - RNA, 20 nt, Human
aagggaguggaggugcagcg

SEQ ID NO: 43966 - RNA, 22 nt, Human
ccuucuagaacaccugccuucu

SEQ ID NO: 43967 - RNA, 26 nt, Human
ccugcucuguccccaaaggacgccug

SEQ ID NO: 43968 - RNA, 27 nt, Human
ugucaauguuauuugaacuugggguac

SEQ ID NO: 43969 - RNA, 23 nt, Human
cgagcuuucauguucagcaugca

SEQ ID NO: 43970 - RNA, 22 nt, Human
gaccccugugaggccccgggaa

SEQ ID NO: 43971 - RNA, 26 nt, Human
ccacccaggcuugaggcagcggcggg

SEQ ID NO: 43972 - RNA, 20 nt, Human
uuauugauucgcugugucau

SEQ ID NO: 43973 - RNA, 26 nt, Human
gagcucuucggggcccugcguugugc

SEQ ID NO: 43974 - RNA, 22 nt, Human
cauugcacuccacccugggcga

SEQ ID NO: 43975 - RNA, 22 nt, Human
cacugcacucuagccugggcca

SEQ ID NO: 43976 - RNA, 21 nt, Human
accagccuggccaacauggug

SEQ ID NO: 43977 - RNA, 21 nt, Human
cuagaggggaaccaggcugca

SEQ ID NO: 43978 - RNA, 21 nt, Human
gaccuucagggccagagcccu

SEQ ID NO: 43979 - RNA, 23 nt, Human
ccucugccucaaagacucuuguc

SEQ ID NO: 43980 - RNA, 22 nt, Human
cccagcugcuuggggggcugag

SEQ ID NO: 43981 - RNA, 22 nt, Human
caggcuggagugcaaugacgca

SEQ ID NO: 43982 - RNA, 22 nt, Human
cacgccuguaauccaagcacuu

SEQ ID NO: 43983 - RNA, 26 nt, Human
ccaagugccagagaaguggaggcaga

SEQ ID NO: 43984 - RNA, 24 nt, Human
aauucaaggagauauaaaaucuag

SEQ ID NO: 43985 - RNA, 19 nt, Human
ggcggaggcgagggagcag

SEQ ID NO: 43986 - RNA, 22 nt, Human
cgggacaccauguucuccauca

SEQ ID NO: 43987 - RNA, 28 nt, Human
ggcuauuuggacucaggugggcccucug

SEQ ID NO: 43988 - RNA, 25 nt, Human
caagucuuuaauuuaauuuuuguuu

SEQ ID NO: 43989 - RNA, 24 nt, Human
uggcuucccugcucacacccacac

SEQ ID NO: 43990 - RNA, 22 nt, Human
auccuguuugaauuuugauguc

SEQ ID NO: 43991 - RNA, 26 nt, Human
ucauucuugcucacuggucccugcca

SEQ ID NO: 43992 - RNA, 19 nt, Human
uagcuccuggaccuguguc

SEQ ID NO: 43993 - RNA, 26 nt, Human
cucauuucugacccacuuuuuccuuu

SEQ ID NO: 43994 - RNA, 26 nt, Human
ccucuaccuccuggguucaagugauu

SEQ ID NO: 43995 - RNA, 24 nt, Human
cagccagcucacguccagguucaa

SEQ ID NO: 43996 - RNA, 23 nt, Human
caggaggucuugaagugugcugu

SEQ ID NO: 43997 - RNA, 23 nt, Human
acgcacacaccacacacauacac

SEQ ID NO: 43998 - RNA, 26 nt, Human
uggaaaugucaucuaaccauuaaguc

SEQ ID NO: 43999 - RNA, 22 nt, Human
ggggagccagggcuaugggagc

SEQ ID NO: 44000 - RNA, 22 nt, Human
agacccuucucuucuacaaaga

SEQ ID NO: 44001 - RNA, 26 nt, Human
gggcaggucuccuuccaggccagggg

SEQ ID NO: 44002 - RNA, 20 nt, Human
uuaugaaaggacauauuuca

SEQ ID NO: 44003 - RNA, 23 nt, Human
aggaucacaccucgacacccaac

SEQ ID NO: 44004 - RNA, 21 nt, Human
uuuauuuaagccuacuccuga

SEQ ID NO: 44005 - RNA, 23 nt, Human
ccucgcugcccccgccucgccuc

SEQ ID NO: 44006 - RNA, 26 nt, Human
gcaagguuucuggugccuauuuauuc

SEQ ID NO: 44007 - RNA, 21 nt, Human
uccuagccauggucagacugu

SEQ ID NO: 44008 - RNA, 19 nt, Human
uaguagccucaauucucca

SEQ ID NO: 44009 - RNA, 27 nt, Human
cccaucacgcggccgagacauggcuug

SEQ ID NO: 44010 - RNA, 27 nt, Human
cuccaucuuaggacagaaugagaggcc

SEQ ID NO: 44011 - RNA, 21 nt, Human
gggcugugccugagaauggua

SEQ ID NO: 44012 - RNA, 26 nt, Human
cagauguuaauacuguaacauacuuu

SEQ ID NO: 44013 - RNA, 27 nt, Human
guacagugggggucuacaacaagaagu

SEQ ID NO: 44014 - RNA, 23 nt, Human
uccagagugagcaaggauuaugu

SEQ ID NO: 44015 - RNA, 25 nt, Human
guucaguaucauuacuuuuaaucuc

SEQ ID NO: 44016 - RNA, 21 nt, Human
cugacuaauagaccucagccu

SEQ ID NO: 44017 - RNA, 22 nt, Human
agcuucccgaguagcugggacu

SEQ ID NO: 44018 - RNA, 23 nt, Human
accucagggccucaccucucugc

SEQ ID NO: 44019 - RNA, 22 nt, Human
agucucccaaagcgcugggauu

SEQ ID NO: 44020 - RNA, 23 nt, Human
ccagagccuggccugggagccag

SEQ ID NO: 44021 - RNA, 21 nt, Human
uccucccaaccaaccagcagg

SEQ ID NO: 44022 - RNA, 21 nt, Human
ugacuggcuuagaggcagcag

SEQ ID NO: 44023 - RNA, 23 nt, Human
ucagcuuccugugccucuguggg

SEQ ID NO: 44024 - RNA, 24 nt, Human
uacuaaaacuauggagaaacuuug

SEQ ID NO: 44025 - RNA, 18 nt, Human
uacucuggcauuacgcuu

SEQ ID NO: 44026 - RNA, 26 nt, Human
ugauuccaagcaaaaaccaggcucca

SEQ ID NO: 44027 - RNA, 25 nt, Human
augugggaaagccuuuaaccagccc

SEQ ID NO: 44028 - RNA, 21 nt, Human
gugaacauuuuaauggguuuc

SEQ ID NO: 44029 - RNA, 22 nt, Human
gucuacuguaacuuaagacuuu

SEQ ID NO: 44030 - RNA, 20 nt, Human
gugaccacucugaaguaaga

SEQ ID NO: 44031 - RNA, 26 nt, Human
cuucauaaucaaauauaugacauaua

SEQ ID NO: 44032 - RNA, 28 nt, Human
caggagaggagacucaccucugucgcuu

SEQ ID NO: 44033 - RNA, 24 nt, Human
cuguggcccaggcuggagugcagu

SEQ ID NO: 44034 - RNA, 20 nt, Human
cagcugcaucuuucuccuua

SEQ ID NO: 44035 - RNA, 23 nt, Human
uccaaugggguaacugaaauacu

SEQ ID NO: 44036 - RNA, 22 nt, Human
cuggcugcagaggagucugaga

SEQ ID NO: 44037 - RNA, 21 nt, Human
cuguuccugacuuuauacuau

SEQ ID NO: 44038 - RNA, 27 nt, Human
ugggagguggcugucuccuagugucua

SEQ ID NO: 44039 - RNA, 26 nt, Human
gggcuuaugccuuacucucagggaca

SEQ ID NO: 44040 - RNA, 24 nt, Human
gggcagcuuuucugcuuuuucccu

SEQ ID NO: 44041 - RNA, 21 nt, Human
gucugccuuaaagagccuuac

SEQ ID NO: 44042 - RNA, 20 nt, Human
gggcauagccagagcuguuc

SEQ ID NO: 44043 - RNA, 27 nt, Human
ccuguucugucucugagcucugugucc

SEQ ID NO: 44044 - RNA, 22 nt, Human
ggcucagucgcggaucugcagu

SEQ ID NO: 44045 - RNA, 21 nt, Human
ugacaggcaugccuuguacuc

SEQ ID NO: 44046 - RNA, 21 nt, Human
ggggaggcagggagucuggug

SEQ ID NO: 44047 - RNA, 24 nt, Human
agcuccaaauacacauucucguuc

SEQ ID NO: 44048 - RNA, 27 nt, Human
auggaaauuacauuugaaagccauuag

SEQ ID NO: 44049 - RNA, 24 nt, Human
uccuugauacaacagcugaccuca

SEQ ID NO: 44050 - RNA, 27 nt, Human
ugcuguuguaaacauauuugaaaacua

SEQ ID NO: 44051 - RNA, 24 nt, Human
uuacauggacuucuguccuuuaaa

SEQ ID NO: 44052 - RNA, 27 nt, Human
caccauugcacuccagccuagauaaca

SEQ ID NO: 44053 - RNA, 26 nt, Human
gguuugugaagugcggaaaaccagag

SEQ ID NO: 44054 - RNA, 27 nt, Human
gccagguuugcagugcgggaagaugag

SEQ ID NO: 44055 - RNA, 20 nt, Human
aauuaaccccaagguguauu

SEQ ID NO: 44056 - RNA, 21 nt, Human
cuccccucugaccuccagacc

SEQ ID NO: 44057 - RNA, 26 nt, Human
gcggaaaggauggggagaaggcugca

SEQ ID NO: 44058 - RNA, 20 nt, Human
ggcauggccagucguggcag

SEQ ID NO: 44059 - RNA, 22 nt, Human
uguucaggcugacacuggcaau

SEQ ID NO: 44060 - RNA, 22 nt, Human
ccccccacucugcacagccuag

SEQ ID NO: 44061 - RNA, 21 nt, Human
gacaaaugccaccacagcagg

SEQ ID NO: 44062 - RNA, 22 nt, Human
agugaggcggcggaggagccag

SEQ ID NO: 44063 - RNA, 18 nt, Human
ugccaaaaguauuuacaa

SEQ ID NO: 44064 - RNA, 23 nt, Human
aaaggcugauuauguguaucaag

SEQ ID NO: 44065 - RNA, 23 nt, Human
cauauaaccuuuacuuugaugga

SEQ ID NO: 44066 - RNA, 21 nt, Human
gggguuagaguucacugcuga

SEQ ID NO: 44067 - RNA, 23 nt, Human
ugcagauguuauaucacagcaau

SEQ ID NO: 44068 - RNA, 24 nt, Human
accacccuccccaggcugggugug

SEQ ID NO: 44069 - RNA, 22 nt, Human
cccaggcugcuggagugcagug

SEQ ID NO: 44070 - RNA, 21 nt, Human
ccuggaagacaacccaggcag

SEQ ID NO: 44071 - RNA, 23 nt, Human
uguaugaagccaaauauuaggcu

SEQ ID NO: 44072 - RNA, 25 nt, Human
uccucagaucccacaggcauugcga

SEQ ID NO: 44073 - RNA, 26 nt, Human
cugugaacugugagugcugaagauuc

SEQ ID NO: 44074 - RNA, 20 nt, Human
cacucuggcagccagugccc

SEQ ID NO: 44075 - RNA, 19 nt, Human
ggaaacacgcggaucugaa

SEQ ID NO: 44076 - RNA, 22 nt, Human
uuaucuuucuguuauuauuguu

SEQ ID NO: 44077 - RNA, 27 nt, Human
ggagcgccuggcagcagcaggagcagc

SEQ ID NO: 44078 - RNA, 22 nt, Human
uggagaaaagugucugcuccua

SEQ ID NO: 44079 - RNA, 27 nt, Human
aaguguuuaugcuuuguuagcauuuca

SEQ ID NO: 44080 - RNA, 26 nt, Human
acaggcuggagacguuuaaagaccgu

SEQ ID NO: 44081 - RNA, 27 nt, Human
agggucugugcaccuucccugcuggcc

SEQ ID NO: 44082 - RNA, 21 nt, Human
gccuguaaucccagcacuuug

SEQ ID NO: 44083 - RNA, 22 nt, Human
aggguagaggaaagggucuaga

SEQ ID NO: 44084 - RNA, 20 nt, Human
aggcgugaagccacccugga

SEQ ID NO: 44085 - RNA, 21 nt, Human
gaauuucacuggccuaaugag

SEQ ID NO: 44086 - RNA, 21 nt, Human
ucuacaccauuaugugcgcug

SEQ ID NO: 44087 - RNA, 24 nt, Human
agcauaaggaagacuugcuccccu

SEQ ID NO: 44088 - RNA, 22 nt, Human
gggcugaggccugcagugcaca

SEQ ID NO: 44089 - RNA, 26 nt, Human
gggggccgggcagguccugcccaugu

SEQ ID NO: 44090 - RNA, 20 nt, Human
aaaucagcuuuguaacuguu

SEQ ID NO: 44091 - RNA, 22 nt, Human
uuggccuggcugggugcagugg

SEQ ID NO: 44092 - RNA, 27 nt, Human
auuucaguucaaucaaacuuucagcuu

SEQ ID NO: 44093 - RNA, 24 nt, Human
ugguugagcagaggaaaucggaga

SEQ ID NO: 44094 - RNA, 21 nt, Human
uacuauauguaacuucagaca

SEQ ID NO: 44095 - RNA, 27 nt, Human
uggcaaaagugucacugaaagacaagc

SEQ ID NO: 44096 - RNA, 20 nt, Human
aguuaacauuaaugccugcu

SEQ ID NO: 44097 - RNA, 23 nt, Human
cagaggcuggagagcagagcacc

SEQ ID NO: 44098 - RNA, 19 nt, Human
gcacagccuuccaugcccc

SEQ ID NO: 44099 - RNA, 29 nt, Human
guacuucagacaccagaaagucugguggc

SEQ ID NO: 44100 - RNA, 23 nt, Human
uaugggguuucaccguguuagcc

SEQ ID NO: 44101 - RNA, 23 nt, Human
ucccugccucagccuucagcaga

SEQ ID NO: 44102 - RNA, 26 nt, Human
caguuauucuggaauaaggcaaggag

SEQ ID NO: 44103 - RNA, 21 nt, Human
gccuagcacggacauggucug

SEQ ID NO: 44104 - RNA, 23 nt, Human
ucagcccucaguuccuucauuuc

SEQ ID NO: 44105 - RNA, 22 nt, Human
gcccagucgcuggccugaggcu

SEQ ID NO: 44106 - RNA, 24 nt, Human
cucuuucccugaaagagaaucucg

SEQ ID NO: 44107 - RNA, 27 nt, Human
caggaagggagggagcugaggccuccc

SEQ ID NO: 44108 - RNA, 32 nt, Human
cuccgugucaccaggauggaagggggugccuc

SEQ ID NO: 44109 - RNA, 27 nt, Human
cccauguagcugggauuacagcugccu

SEQ ID NO: 44110 - RNA, 25 nt, Human
ccucagcucagccucccccugcugc

SEQ ID NO: 44111 - RNA, 25 nt, Human
ccacaggaccuggaguuaucagggg

SEQ ID NO: 44112 - RNA, 22 nt, Human
ggggaucugagugaucuugcug

SEQ ID NO: 44113 - RNA, 32 nt, Human
ggggguagcagggacccaggcacugugaccau

SEQ ID NO: 44114 - RNA, 21 nt, Human
gguaggggccacaguugcugg

SEQ ID NO: 44115 - RNA, 21 nt, Human
gugacuucuuuugaguuaggu

SEQ ID NO: 44116 - RNA, 20 nt, Human
gcaaguaagcaucuuacaac

SEQ ID NO: 44117 - RNA, 20 nt, Human
auccucugcuucccccacca

SEQ ID NO: 44118 - RNA, 32 nt, Human
gagugggugcgagugagaaugaguggcaaaau

SEQ ID NO: 44119 - RNA, 27 nt, Human
uuccaugagcucuuggaggcaccaaga

SEQ ID NO: 44120 - RNA, 21 nt, Human
ggaccccacaggcaggcggcg

SEQ ID NO: 44121 - RNA, 21 nt, Human
ugucgccaggcuggaguguag

SEQ ID NO: 44122 - RNA, 25 nt, Human
ccuuccagcuagugacccacaugcc

SEQ ID NO: 44123 - RNA, 21 nt, Human
uugcccagccaccaccgucuc

SEQ ID NO: 44124 - RNA, 19 nt, Human
ggguucagagaucauagga

SEQ ID NO: 44125 - RNA, 20 nt, Human
caucauuucccaucuggacc

SEQ ID NO: 44126 - RNA, 27 nt, Human
ggaggcugagauaggagaaucgcuuga

SEQ ID NO: 44127 - RNA, 21 nt, Human
cuccugagcuccgccgcccag

SEQ ID NO: 44128 - RNA, 20 nt, Human
guccggucucuggggccaag

SEQ ID NO: 44129 - RNA, 21 nt, Human
gggcuggaaaggagggcaggg

SEQ ID NO: 44130 - RNA, 26 nt, Human
acagccgcccucuccuccaggcccgu

SEQ ID NO: 44131 - RNA, 25 nt, Human
ucggcucugcccucugugaccuugc

SEQ ID NO: 44132 - RNA, 24 nt, Human
ugaggcucagggaaaggccagugu

SEQ ID NO: 44133 - RNA, 23 nt, Human
ugugaucauagcucacuguaacc

SEQ ID NO: 44134 - RNA, 21 nt, Human
cuuguaaucccagcaauuugg

SEQ ID NO: 44135 - RNA, 21 nt, Human
ccuguaaucucagcaauuugg

SEQ ID NO: 44136 - RNA, 21 nt, Human
ucucaacaaugguuacagaga

SEQ ID NO: 44137 - RNA, 24 nt, Human
ucccaggcuggagugcuauggugc

SEQ ID NO: 44138 - RNA, 22 nt, Human
cacugcacuccagccugggcag

SEQ ID NO: 44139 - RNA, 20 nt, Human
guucaugccauucugccuca

SEQ ID NO: 44140 - RNA, 28 nt, Human
cugggcagggaccaggccagcgcugcaa

SEQ ID NO: 44141 - RNA, 20 nt, Human
agugucaaaugcugcagccu

SEQ ID NO: 44142 - RNA, 22 nt, Human
guagggcugcacaagaugcugg

SEQ ID NO: 44143 - RNA, 26 nt, Human
aaaagggcugaguuuguauuauuacu

SEQ ID NO: 44144 - RNA, 21 nt, Human
gaaucgaggaggcaagccugu

SEQ ID NO: 44145 - RNA, 17 nt, Human
gccugggagugaccuca

SEQ ID NO: 44146 - RNA, 20 nt, Human
gcguucugccuuccuuguua

SEQ ID NO: 44147 - RNA, 24 nt, Human
aggguccacacggcaaucagaaga

SEQ ID NO: 44148 - RNA, 27 nt, Human
uggugaguguggcugcccuggcucccc

SEQ ID NO: 44149 - RNA, 23 nt, Human
gcccagccagcugcgccugcgcu

SEQ ID NO: 44150 - RNA, 27 nt, Human
cgccgccgccucguucacgcaccccga

SEQ ID NO: 44151 - RNA, 26 nt, Human
uggucucaagugauccgcccgccucg

SEQ ID NO: 44152 - RNA, 22 nt, Human
accuguaauccuagcacuuugg

SEQ ID NO: 44153 - RNA, 27 nt, Human
acccaagguggucuuggagaggaggug

SEQ ID NO: 44154 - RNA, 26 nt, Human
aaacuuugccauuucaucuguuuaca

SEQ ID NO: 44155 - RNA, 27 nt, Human
caccuuccagggcuccguccaguaguu

SEQ ID NO: 44156 - RNA, 22 nt, Human
cuuccucugcuaaauugauguu

SEQ ID NO: 44157 - RNA, 20 nt, Human
ugggaggcagaggcaggugg

SEQ ID NO: 44158 - RNA, 16 nt, Human
aucuagacaugccuua

SEQ ID NO: 44159 - RNA, 18 nt, Human
aaacugcuauccuccccu

SEQ ID NO: 44160 - RNA, 20 nt, Human
ugucuuuuuaaauuuucauu

SEQ ID NO: 44161 - RNA, 21 nt, Human
cauuuuuuaaggagggagaaa

SEQ ID NO: 44162 - RNA, 21 nt, Human
ggagucuaaacuuuuucauug

SEQ ID NO: 44163 - RNA, 19 nt, Human
ccccaagucacacaguggu

SEQ ID NO: 44164 - RNA, 24 nt, Human
uuucuauuuauuuacugagcuucu

SEQ ID NO: 44165 - RNA, 23 nt, Human
cugucucucccauaugauggcug

SEQ ID NO: 44166 - RNA, 23 nt, Human
cccaaaggaaacuacucucgauu

SEQ ID NO: 44167 - RNA, 21 nt, Human
agguacccgcagggccuagca

SEQ ID NO: 44168 - RNA, 21 nt, Human
aacaaacaaauuuuucugcuu

SEQ ID NO: 44169 - RNA, 28 nt, Human
uguuguagcuuuggagugcagaguguaa

SEQ ID NO: 44170 - RNA, 22 nt, Human
agcuaauuuuuguauuuuuuau

SEQ ID NO: 44171 - RNA, 30 nt, Human
acgcaccacccucuggccuaggcuggcucc

SEQ ID NO: 44172 - RNA, 22 nt, Human
ccccagcgccuccucuggaugc

SEQ ID NO: 44173 - RNA, 22 nt, Human
uuugcacuccaguagaagacag

SEQ ID NO: 44174 - RNA, 23 nt, Human
cugggaaaguugcugggccagcu

SEQ ID NO: 44175 - RNA, 23 nt, Human
acgugcccucuuaaaaagcacaa

SEQ ID NO: 44176 - RNA, 21 nt, Human
aaauguucuguauuugcguug

SEQ ID NO: 44177 - RNA, 21 nt, Human
gacacaccuacugcuuccuca

SEQ ID NO: 44178 - RNA, 21 nt, Human
cacccaggcugcagggugagg

SEQ ID NO: 44179 - RNA, 20 nt, Human
ucccaaagcacaaagcaguu

SEQ ID NO: 44180 - RNA, 22 nt, Human
ccgagaucacaccauugcacug

SEQ ID NO: 44181 - RNA, 23 nt, Human
cagacuucagacgcugaaacugc

SEQ ID NO: 44182 - RNA, 24 nt, Human
agguggcguguugcagugcagagu

SEQ ID NO: 44183 - RNA, 22 nt, Human
augcacuacguuuaucugacaa

SEQ ID NO: 44184 - RNA, 22 nt, Human
cuagcugcuccagucucagccu

SEQ ID NO: 44185 - RNA, 25 nt, Human
aucaggagaaaaguaaauauaaaaa

SEQ ID NO: 44186 - RNA, 22 nt, Human
uugacuuugggagacucagcca

SEQ ID NO: 44187 - RNA, 24 nt, Human
cucaagaguuauccugccuuccag

SEQ ID NO: 44188 - RNA, 23 nt, Human
augacugcaggagugggcaggcc

SEQ ID NO: 44189 - RNA, 22 nt, Human
guccucugacccuuuggcucau

SEQ ID NO: 44190 - RNA, 22 nt, Human
gugacugcaagagcguucgugc

SEQ ID NO: 44191 - RNA, 23 nt, Human
uucccagguaaaagugguuuuca

SEQ ID NO: 44192 - RNA, 26 nt, Human
cugaacacuucaaagcugucagugug

SEQ ID NO: 44193 - RNA, 20 nt, Human
auauuucugaauaaggcuuc

SEQ ID NO: 44194 - RNA, 26 nt, Human
accuccucagaagucagcgcaggaag

SEQ ID NO: 44195 - RNA, 21 nt, Human
aaauggauuuaaacauauuuc

SEQ ID NO: 44196 - RNA, 25 nt, Human
gagacccggugcucugggagccagg

SEQ ID NO: 44197 - RNA, 26 nt, Human
ccucccccuccuggguucaagcgauu

SEQ ID NO: 44198 - RNA, 21 nt, Human
cucccagauuuuuacuuuuuc

SEQ ID NO: 44199 - RNA, 23 nt, Human
gucuagcccaucauccugcuugg

SEQ ID NO: 44200 - RNA, 21 nt, Human
ugcagugacaugaucuuagcu

SEQ ID NO: 44201 - RNA, 21 nt, Human
uggagcuggggggagggccgg

SEQ ID NO: 44202 - RNA, 26 nt, Human
cccuuuauucaagccucagauuucug

SEQ ID NO: 44203 - RNA, 24 nt, Human
guggcucugacuaagccuggacug

SEQ ID NO: 44204 - RNA, 18 nt, Human
aaucuuuaacauuaccug

SEQ ID NO: 44205 - RNA, 21 nt, Human
cccagcaccggggaggacugg

SEQ ID NO: 44206 - RNA, 23 nt, Human
uuauuaaaaaacaauguagaccu

SEQ ID NO: 44207 - RNA, 23 nt, Human
ccuccacugucuucuucaggucc

SEQ ID NO: 44208 - RNA, 21 nt, Human
ugcauccucaaccuccugggu

SEQ ID NO: 44209 - RNA, 22 nt, Human
cccagcugguggccgugcuggu

SEQ ID NO: 44210 - RNA, 22 nt, Human
acuugcagagguaaacuccccu

SEQ ID NO: 44211 - RNA, 23 nt, Human
gaagggagacucuaggaguugaa

SEQ ID NO: 44212 - RNA, 24 nt, Human
guucagggcuggaguuguuaaggc

SEQ ID NO: 44213 - RNA, 22 nt, Human
ucucccaccucccuccgcacac

SEQ ID NO: 44214 - RNA, 27 nt, Human
ccacugcaauccagccugggcaacaga

SEQ ID NO: 44215 - RNA, 21 nt, Human
gggggaggcaggggugagagg

SEQ ID NO: 44216 - RNA, 26 nt, Human
gggagaaagcuggagggaggggcuuu

SEQ ID NO: 44217 - RNA, 20 nt, Human
ccacaucccuaacaucaugc

SEQ ID NO: 44218 - RNA, 32 nt, Human
ccuggcccuuccuaaggucccugccuggcauc

SEQ ID NO: 44219 - RNA, 22 nt, Human
gauagauaggagacacuuuuuu

SEQ ID NO: 44220 - RNA, 21 nt, Human
gcacagaaaacauagccacca

SEQ ID NO: 44221 - RNA, 22 nt, Human
agggguggggaauggggaggga

SEQ ID NO: 44222 - RNA, 22 nt, Human
cuggcacacuggccuccagaag

SEQ ID NO: 44223 - RNA, 18 nt, Human
ggccucucugggaagguc

SEQ ID NO: 44224 - RNA, 25 nt, Human
cgguuucagcaauuuuaaaucuaua

SEQ ID NO: 44225 - RNA, 26 nt, Human
ugcauacuuaugagaauuucacauug

SEQ ID NO: 44226 - RNA, 26 nt, Human
cuccaucucuuuaaaaacaaacaaaa

SEQ ID NO: 44227 - RNA, 22 nt, Human
guguuagauucaacacugcgcu

SEQ ID NO: 44228 - RNA, 27 nt, Human
gaacagcucuucacucagccacacccc

SEQ ID NO: 44229 - RNA, 26 nt, Human
gcaccuccccggccucucucuuccca

SEQ ID NO: 44230 - RNA, 27 nt, Human
aacaagaaaaguacauucuuuagaaac

SEQ ID NO: 44231 - RNA, 24 nt, Human
gaauguaagcuccucaagagcagg

SEQ ID NO: 44232 - RNA, 26 nt, Human
ccucauucggaggccucuugacuggg

SEQ ID NO: 44233 - RNA, 19 nt, Human
uugcccaggccaguuagaa

SEQ ID NO: 44234 - RNA, 21 nt, Human
gcaguuucuggguaacagggc

SEQ ID NO: 44235 - RNA, 26 nt, Human
augccucugaggccagccuggccucc

SEQ ID NO: 44236 - RNA, 23 nt, Human
cuacagccacauccccaagccca

SEQ ID NO: 44237 - RNA, 21 nt, Human
cguugcuggggaggccuggag

SEQ ID NO: 44238 - RNA, 21 nt, Human
ccaaaaauguugagggcaugc

SEQ ID NO: 44239 - RNA, 23 nt, Human
auuccugauccguucacaugaau

SEQ ID NO: 44240 - RNA, 27 nt, Human
cccaccucucccugggggucucaggga

SEQ ID NO: 44241 - RNA, 20 nt, Human
cuccagccuuuggccuuggc

SEQ ID NO: 44242 - RNA, 22 nt, Human
ucacccaggcugcaguguagug

SEQ ID NO: 44243 - RNA, 27 nt, Human
uuagggaauggugaaugaagucaagca

SEQ ID NO: 44244 - RNA, 24 nt, Human
ucacugcagucaccucuucuaccc

SEQ ID NO: 44245 - RNA, 19 nt, Human
gggagccggaggcugcagu

SEQ ID NO: 44246 - RNA, 22 nt, Human
gguucacugcaaccucugccuc

SEQ ID NO: 44247 - RNA, 23 nt, Human
ccugcugcaugucccuucccuuc

SEQ ID NO: 44248 - RNA, 21 nt, Human
ccaguauggccccaccugcuc

SEQ ID NO: 44249 - RNA, 23 nt, Human
ggaggugggugacugaccagggc

SEQ ID NO: 44250 - RNA, 21 nt, Human
acuucuguaaucacugccugg

SEQ ID NO: 44251 - RNA, 27 nt, Human
gcucagccugucagcugagcacgggcg

SEQ ID NO: 44252 - RNA, 24 nt, Human
gcccccagccuggccuggcauuuc

SEQ ID NO: 44253 - RNA, 25 nt, Human
cuauucugcuuccucaggcaacacu

SEQ ID NO: 44254 - RNA, 22 nt, Human
uucauacucucuaccuuccuua

SEQ ID NO: 44255 - RNA, 25 nt, Human
acccagacuggcgugcaguggcacu

SEQ ID NO: 44256 - RNA, 23 nt, Human
guggaaggcagaagcuagcgguu

SEQ ID NO: 44257 - RNA, 27 nt, Human
auaguauauacacuuaugacuuuagua

SEQ ID NO: 44258 - RNA, 24 nt, Human
ugccccugugugcuacaugaugga

SEQ ID NO: 44259 - RNA, 22 nt, Human
acaaaggcgccccgagggagug

SEQ ID NO: 44260 - RNA, 24 nt, Human
uuacaucuuacacggugucuuaca

SEQ ID NO: 44261 - RNA, 24 nt, Human
ucuuucucaggcaucaaaagcauu

SEQ ID NO: 44262 - RNA, 22 nt, Human
gaccagccuggucaacauggug

SEQ ID NO: 44263 - RNA, 22 nt, Human
gacuagccuggccaacauggug

SEQ ID NO: 44264 - RNA, 22 nt, Human
cucgugccaagacuucugcugg

SEQ ID NO: 44265 - RNA, 19 nt, Human
caaagagaaucauuuugga

SEQ ID NO: 44266 - RNA, 24 nt, Human
agcucacucgaccuugggaggccu

SEQ ID NO: 44267 - RNA, 20 nt, Human
cugagcagccaccuccaggg

SEQ ID NO: 44268 - RNA, 20 nt, Human
cacgauugaccuguccucuu

SEQ ID NO: 44269 - RNA, 27 nt, Human
uucuaggguaaagauaaauucagaaau

SEQ ID NO: 44270 - RNA, 21 nt, Human
aacacaauuuacaauuuugga

SEQ ID NO: 44271 - RNA, 23 nt, Human
gccgggagcucugccagcuuugg

SEQ ID NO: 44272 - RNA, 22 nt, Human
gacuggguguuacuggagggaa

SEQ ID NO: 44273 - RNA, 17 nt, Human
aacuugaccucaugccu

SEQ ID NO: 44274 - RNA, 26 nt, Human
uggaaagaaaaugacauuuaaauaau

SEQ ID NO: 44275 - RNA, 26 nt, Human
ccuggguuuucugccccagccuccuc

SEQ ID NO: 44276 - RNA, 20 nt, Human
agcuaugaugagaaggugga

SEQ ID NO: 44277 - RNA, 23 nt, Human
auggugccacugcacucuaaccu

SEQ ID NO: 44278 - RNA, 27 nt, Human
cacugcacuuuggaccccuggggccaa

SEQ ID NO: 44279 - RNA, 21 nt, Human
accaguaccuccaaguguuca

SEQ ID NO: 44280 - RNA, 16 nt, Human
augcuucagugcugcu

SEQ ID NO: 44281 - RNA, 27 nt, Human
uuaguuagccacuugugucauuuccag

SEQ ID NO: 44282 - RNA, 27 nt, Human
gacauguaaggaggacuacugucuagc

SEQ ID NO: 44283 - RNA, 25 nt, Human
gcagggcugacuaggguuaguuugg

SEQ ID NO: 44284 - RNA, 19 nt, Human
auuuugggggguauacauu

SEQ ID NO: 44285 - RNA, 23 nt, Human
ccuccuguccacugugucacucu

SEQ ID NO: 44286 - RNA, 21 nt, Human
gcaggaagaacauugauuuca

SEQ ID NO: 44287 - RNA, 25 nt, Human
gcuaacuugaacaccaagggugcua

SEQ ID NO: 44288 - RNA, 27 nt, Human
aaugcccuucaguggcccucaccauuu

SEQ ID NO: 44289 - RNA, 27 nt, Human
cccuaucucucacucuggacccagggc

SEQ ID NO: 44290 - RNA, 21 nt, Human
uguccaggcuggagugcagug

SEQ ID NO: 44291 - RNA, 26 nt, Human
cgcccgggcuggaggcgccgagcacc

SEQ ID NO: 44292 - RNA, 17 nt, Human
auucaguuuauauuuca

SEQ ID NO: 44293 - RNA, 21 nt, Human
cugccagucacaaucuaaauu

SEQ ID NO: 44294 - RNA, 22 nt, Human
cucuguacuccucaagcacugg

SEQ ID NO: 44295 - RNA, 20 nt, Human
auuuguucuagcaccuuuga

SEQ ID NO: 44296 - RNA, 23 nt, Human
gacacagccucuacuguacuuua

SEQ ID NO: 44297 - RNA, 23 nt, Human
uggcauagagcacccaggcaucg

SEQ ID NO: 44298 - RNA, 27 nt, Human
cuugcuugccacuguuccccaugacga

SEQ ID NO: 44299 - RNA, 21 nt, Human
cgaguaaacaacacgaugcca

SEQ ID NO: 44300 - RNA, 27 nt, Human
ucaugcugucuuuagaguuaggugccu

SEQ ID NO: 44301 - RNA, 25 nt, Human
ucugggggcugggugaggccacuca

SEQ ID NO: 44302 - RNA, 18 nt, Human
cuccccugaccucacgcu

SEQ ID NO: 44303 - RNA, 20 nt, Human
auaccugaaauucaguagua

SEQ ID NO: 44304 - RNA, 16 nt, Human
caguucugcucugguu

SEQ ID NO: 44305 - RNA, 22 nt, Human
aagaggaaaaggauccuuuucc

SEQ ID NO: 44306 - RNA, 23 nt, Human
cgcuccgccucaccugccaccag

SEQ ID NO: 44307 - RNA, 27 nt, Human
cccugcaggagcgcgagucacaguuga

SEQ ID NO: 44308 - RNA, 22 nt, Human
cccaccccccacccuguucucu

SEQ ID NO: 44309 - RNA, 26 nt, Human
uugcccaggcuggagugcaauggcac

SEQ ID NO: 44310 - RNA, 24 nt, Human
cagggcagagaggucugugguucu

SEQ ID NO: 44311 - RNA, 22 nt, Human
uucaauauuauuugacuccuuu

SEQ ID NO: 44312 - RNA, 25 nt, Human
caaugccaucacuggaauuucccac

SEQ ID NO: 44313 - RNA, 22 nt, Human
cagccuuaacauucucuucccc

SEQ ID NO: 44314 - RNA, 21 nt, Human
ggacuggccacacccacccca

SEQ ID NO: 44315 - RNA, 24 nt, Human
gaguauuuccuugauugcgguaua

SEQ ID NO: 44316 - RNA, 19 nt, Human
cccuuucucccccucgguu

SEQ ID NO: 44317 - RNA, 29 nt, Human
ggggcagcacagagagggggccaccuccc

SEQ ID NO: 44318 - RNA, 22 nt, Human
ugccucccaaggugcugggauu

SEQ ID NO: 44319 - RNA, 23 nt, Human
gcagagaaauguuuucacuuuug

SEQ ID NO: 44320 - RNA, 21 nt, Human
ccugccuguccuuccugggcc

SEQ ID NO: 44321 - RNA, 18 nt, Human
cugacaugcaucaucuca

SEQ ID NO: 44322 - RNA, 21 nt, Human
cccuuccuccuucccucacca

SEQ ID NO: 44323 - RNA, 21 nt, Human
gugucaauugaaaaguuguca

SEQ ID NO: 44324 - RNA, 19 nt, Human
agaggacuuucacgacuau

SEQ ID NO: 44325 - RNA, 25 nt, Human
uucuggaagucaucucauuccacug

SEQ ID NO: 44326 - RNA, 19 nt, Human
uuuguccuuaccaggauuu

SEQ ID NO: 44327 - RNA, 24 nt, Human
uugauuuuuaaccacuucccaugu

SEQ ID NO: 44328 - RNA, 22 nt, Human
guagcccagucuggagugcagu

SEQ ID NO: 44329 - RNA, 26 nt, Human
uguuucuguucuuaggacuccagucc

SEQ ID NO: 44330 - RNA, 23 nt, Human
ggcucuagauuuaucagcuauuu

SEQ ID NO: 44331 - RNA, 23 nt, Human
ggaggaagauccggagggcaggg

SEQ ID NO: 44332 - RNA, 19 nt, Human
ucacccaggaagugcaagg

SEQ ID NO: 44333 - RNA, 23 nt, Human
gagccuggccucagcaaggggcc

SEQ ID NO: 44334 - RNA, 23 nt, Human
augccauuucugggaaaugcauc

SEQ ID NO: 44335 - RNA, 25 nt, Human
gagugcuccccauugauugaagagu

SEQ ID NO: 44336 - RNA, 27 nt, Human
ccugcugucauugcuucuucugaggcc

SEQ ID NO: 44337 - RNA, 22 nt, Human
gcaaagcaaucucccuuuguuu

SEQ ID NO: 44338 - RNA, 21 nt, Human
gcagccuggcuaacaugguga

SEQ ID NO: 44339 - RNA, 27 nt, Human
cuauugcacuccauccuggaugaaaga

SEQ ID NO: 44340 - RNA, 27 nt, Human
gggacucgggugcugggaguguggcuc

SEQ ID NO: 44341 - RNA, 22 nt, Human
uugugugacuuuggagccauga

SEQ ID NO: 44342 - RNA, 26 nt, Human
caacaaagaccaaaucugaacugcua

SEQ ID NO: 44343 - RNA, 25 nt, Human
ggcggauuagcuaucuuccaacaau

SEQ ID NO: 44344 - RNA, 28 nt, Human
auugcugcuuccucuuccuuugaagcau

SEQ ID NO: 44345 - RNA, 19 nt, Human
ccccaggaaacgauucuua

SEQ ID NO: 44346 - RNA, 25 nt, Human
ggcucgugacccaaaaaagucaaga

SEQ ID NO: 44347 - RNA, 20 nt, Human
accauaaagaucacaccaau

SEQ ID NO: 44348 - RNA, 27 nt, Human
uagaagaaucauuccacaaacuuacau

SEQ ID NO: 44349 - RNA, 22 nt, Human
cuuucugccagcaucugcagcc

SEQ ID NO: 44350 - RNA, 21 nt, Human
caguucacauccuuggugugu

SEQ ID NO: 44351 - RNA, 20 nt, Human
ggccucuccgcaccaccuca

SEQ ID NO: 44352 - RNA, 29 nt, Human
agagcaguggagccuugcccacagggcug

SEQ ID NO: 44353 - RNA, 27 nt, Human
cauuccccugcguucucuuuccucacc

SEQ ID NO: 44354 - RNA, 26 nt, Human
gucucaaacuccuggccucaugugau

SEQ ID NO: 44355 - RNA, 21 nt, Human
auaguucugccuauuguccuu

SEQ ID NO: 44356 - RNA, 26 nt, Human
gcauccagacugguggagucggaggg

SEQ ID NO: 44357 - RNA, 27 nt, Human
uggcuaacacggugaaaccccgucucu

SEQ ID NO: 44358 - RNA, 23 nt, Human
ccaggagaagccaagaacuugug

SEQ ID NO: 44359 - RNA, 19 nt, Human
gagcccaaccuucuuucac

SEQ ID NO: 44360 - RNA, 25 nt, Human
aaguuucuggcauagaguccuggcu

SEQ ID NO: 44361 - RNA, 24 nt, Human
cguccugcugagaaauugcacuga

SEQ ID NO: 44362 - RNA, 22 nt, Human
ccugccccgcgcgcccugccgg

SEQ ID NO: 44363 - RNA, 22 nt, Human
aggcugagguaggaggaucacg

SEQ ID NO: 44364 - RNA, 25 nt, Human
agcuucaguuuccuggucuguagaa

SEQ ID NO: 44365 - RNA, 23 nt, Human
agccugcgguccugcccaccucc

SEQ ID NO: 44366 - RNA, 24 nt, Human
aguucaggcugugaucugggcucc

SEQ ID NO: 44367 - RNA, 27 nt, Human
ggagagggucuggagaagcagugagcc

SEQ ID NO: 44368 - RNA, 21 nt, Human
gauuuucuuucagaagcaauu

SEQ ID NO: 44369 - RNA, 25 nt, Human
uggagucaccugcaaucucauaucc

SEQ ID NO: 44370 - RNA, 25 nt, Human
cuccuccuaaucugggccucuuguc

SEQ ID NO: 44371 - RNA, 23 nt, Human
gauugcuuucccauuaugagcgu

SEQ ID NO: 44372 - RNA, 21 nt, Human
cuuaacaaugaaaaaaguuuu

SEQ ID NO: 44373 - RNA, 27 nt, Human
ggucauauguuuauucaaaauauuuua

SEQ ID NO: 44374 - RNA, 19 nt, Human
uaaagaaggauaaauugua

SEQ ID NO: 44375 - RNA, 29 nt, Human
ggucuaaagugccugggcuugguggccau

SEQ ID NO: 44376 - RNA, 22 nt, Human
ugccaggcugacggguccagug

SEQ ID NO: 44377 - RNA, 24 nt, Human
ccuaguauacugggugaauaauua

SEQ ID NO: 44378 - RNA, 21 nt, Human
cucuccucagugacaucgucu

SEQ ID NO: 44379 - RNA, 20 nt, Human
gaaggauuggaaaaggcuau

SEQ ID NO: 44380 - RNA, 27 nt, Human
ggucgugaacuccugggcucaagugau

SEQ ID NO: 44381 - RNA, 24 nt, Human
cuguccuaggguaacucacucugc

SEQ ID NO: 44382 - RNA, 21 nt, Human
ugggagcccugcguggaggug

SEQ ID NO: 44383 - RNA, 20 nt, Human
ccuagcgcuaucucccugcc

SEQ ID NO: 44384 - RNA, 26 nt, Human
gaccacugacauuuauggauguggcc

SEQ ID NO: 44385 - RNA, 22 nt, Human
uuguauauuuaaaaguuggaca

SEQ ID NO: 44386 - RNA, 22 nt, Human
agcaggaggagcugcaggccgc

SEQ ID NO: 44387 - RNA, 18 nt, Human
cuccacccucacucugcc

SEQ ID NO: 44388 - RNA, 21 nt, Human
ccucgggcaccuggagagaug

SEQ ID NO: 44389 - RNA, 27 nt, Human
gcccugaugccuuuuugccagccauac

SEQ ID NO: 44390 - RNA, 20 nt, Human
cacaacucauccagaacugu

SEQ ID NO: 44391 - RNA, 22 nt, Human
cgcagggucaggagaucgagac

SEQ ID NO: 44392 - RNA, 27 nt, Human
cacugccugcuccuuugggugugauug

SEQ ID NO: 44393 - RNA, 26 nt, Human
agccuccucugcaugccaguuugugc

SEQ ID NO: 44394 - RNA, 24 nt, Human
agggaucuugccugaggaacccug

SEQ ID NO: 44395 - RNA, 21 nt, Human
uugauuaaaaguuauguaaua

SEQ ID NO: 44396 - RNA, 27 nt, Human
cccugcugaccuucuucccaccuguug

SEQ ID NO: 44397 - RNA, 24 nt, Human
ccuagaacacagaaggguaccagu

SEQ ID NO: 44398 - RNA, 24 nt, Human
gcaucaucucagcucacugcaacc

SEQ ID NO: 44399 - RNA, 21 nt, Human
uucagacccuuuaauaaguga

SEQ ID NO: 44400 - RNA, 27 nt, Human
agcaguuucccacuugccaaagauccc

SEQ ID NO: 44401 - RNA, 24 nt, Human
cacuggcagaggucgccaagaaga

SEQ ID NO: 44402 - RNA, 18 nt, Human
uggucucugagcuccugu

SEQ ID NO: 44403 - RNA, 27 nt, Human
cggaaggcgcuggagccugcggggcag

SEQ ID NO: 44404 - RNA, 19 nt, Human
acaacagacaggugaccuu

SEQ ID NO: 44405 - RNA, 23 nt, Human
aucaauaaaagcaccuguucucc

SEQ ID NO: 44406 - RNA, 23 nt, Human
uucuggcuucacauuuguauuua

SEQ ID NO: 44407 - RNA, 24 nt, Human
ggaagacagaaagcccagaaggag

SEQ ID NO: 44408 - RNA, 21 nt, Human
agugucuccugguaacuggaa

SEQ ID NO: 44409 - RNA, 21 nt, Human
uuguuugcauaggugaucuca

SEQ ID NO: 44410 - RNA, 22 nt, Human
ggagucucugccaguuacuugg

SEQ ID NO: 44411 - RNA, 19 nt, Human
accucuaauauaugccuua

SEQ ID NO: 44412 - RNA, 27 nt, Human
gcuccucccggucucgccuuccucgcg

SEQ ID NO: 44413 - RNA, 22 nt, Human
gcuaaaaucauccuauuacuua

SEQ ID NO: 44414 - RNA, 21 nt, Human
ugcguuccucauuugugaacu

SEQ ID NO: 44415 - RNA, 21 nt, Human
cucuccucuggagcacacacc

SEQ ID NO: 44416 - RNA, 23 nt, Human
ccgccugcgcccugccagucuga

SEQ ID NO: 44417 - RNA, 24 nt, Human
gacccaggcugcuaagagggcaag

SEQ ID NO: 44418 - RNA, 27 nt, Human
ccagcacuuggcagguguccaguaccu

SEQ ID NO: 44419 - RNA, 22 nt, Human
ccaacauggagaaacccugucu

SEQ ID NO: 44420 - RNA, 19 nt, Human
uccuuaggcaagauuuccc

SEQ ID NO: 44421 - RNA, 27 nt, Human
ggggagggagagggagcuuuguguuaa

SEQ ID NO: 44422 - RNA, 19 nt, Human
aaguuuccuaauuacuuga

SEQ ID NO: 44423 - RNA, 26 nt, Human
cuuugauguuaacacauuuuguauaa

SEQ ID NO: 44424 - RNA, 27 nt, Human
cucucuuucuccucccacagggucccc

SEQ ID NO: 44425 - RNA, 24 nt, Human
ucacgccuguaucccagcacuuug

SEQ ID NO: 44426 - RNA, 20 nt, Human
aauauaauugcuuuccucca

SEQ ID NO: 44427 - RNA, 24 nt, Human
accugcauuucucccacagcaaug

SEQ ID NO: 44428 - RNA, 19 nt, Human
uuuuccuccucuucccugc

SEQ ID NO: 44429 - RNA, 23 nt, Human
ccaguccuucacaugaugggcac

SEQ ID NO: 44430 - RNA, 27 nt, Human
ccacugcacucuagccuggcaacagag

SEQ ID NO: 44431 - RNA, 27 nt, Human
gucccuugccaggcucuuccacuuagc

SEQ ID NO: 44432 - RNA, 23 nt, Human
uucuaagccucaucagcaacccc

SEQ ID NO: 44433 - RNA, 21 nt, Human
caagugauucuccugccucag

SEQ ID NO: 44434 - RNA, 27 nt, Human
cccugcacuguccugcuccacaguguu

SEQ ID NO: 44435 - RNA, 21 nt, Human
accugcaguaguggaucaugu

SEQ ID NO: 44436 - RNA, 24 nt, Human
aaaaauauuaaagagaaacaaaac

SEQ ID NO: 44437 - RNA, 24 nt, Human
cuguggacacccaagucgcuggag

SEQ ID NO: 44438 - RNA, 23 nt, Human
ggagccgggcuggcaggagcagg

SEQ ID NO: 44439 - RNA, 22 nt, Human
aguuguccuggugccuccauca

SEQ ID NO: 44440 - RNA, 18 nt, Human
ccuguucugugugugccg

SEQ ID NO: 44441 - RNA, 20 nt, Human
uagggagggggcugugaugu

SEQ ID NO: 44442 - RNA, 23 nt, Human
guuuacagaugaggucuugcugu

SEQ ID NO: 44443 - RNA, 26 nt, Human
ucuuuccccucuauuucuuuguauga

SEQ ID NO: 44444 - RNA, 22 nt, Human
cccgaguagcugggacuacagg

SEQ ID NO: 44445 - RNA, 22 nt, Human
guuuggcucauuugagcauuuu

SEQ ID NO: 44446 - RNA, 23 nt, Human
aaacagguggagacucagccuga

SEQ ID NO: 44447 - RNA, 21 nt, Human
aggacagaggccaggagccag

SEQ ID NO: 44448 - RNA, 19 nt, Human
agcaucaguugauccuuac

SEQ ID NO: 44449 - RNA, 21 nt, Human
ggcugagaacuggacaguggc

SEQ ID NO: 44450 - RNA, 30 nt, Human
cgggacuguggcugcagcuuccacagccac

SEQ ID NO: 44451 - RNA, 21 nt, Human
gcccugccuugccccugcacu

SEQ ID NO: 44452 - RNA, 27 nt, Human
guggcgccuucccagggccagccuggg

SEQ ID NO: 44453 - RNA, 26 nt, Human
gaagaauugaacccaggagguggagg

SEQ ID NO: 44454 - RNA, 26 nt, Human
cgcagcccuggcagggggcaugcggu

SEQ ID NO: 44455 - RNA, 24 nt, Human
aaacaccuuggcuuguuauugccu

SEQ ID NO: 44456 - RNA, 23 nt, Human
ccagcacuccaaaaucucugugu

SEQ ID NO: 44457 - RNA, 21 nt, Human
aagguuuuuaugcucuguaaa

SEQ ID NO: 44458 - RNA, 26 nt, Human
guuaauacaaugaugacaaacaaaac

SEQ ID NO: 44459 - RNA, 19 nt, Human
ucagugccuuauggaacac

SEQ ID NO: 44460 - RNA, 26 nt, Human
ggagugagacaagggcucggccuuaa

SEQ ID NO: 44461 - RNA, 21 nt, Human
cggaguuucucuagcugcagu

SEQ ID NO: 44462 - RNA, 22 nt, Human
aaacaaaagugcguguaauuaa

SEQ ID NO: 44463 - RNA, 22 nt, Human
ggggcaggcggcugcaggcuag

SEQ ID NO: 44464 - RNA, 21 nt, Human
cuucauugaacaaauggugcc

SEQ ID NO: 44465 - RNA, 23 nt, Human
guggagagaagugagaauaggca

SEQ ID NO: 44466 - RNA, 21 nt, Human
caaagcugggauuacaggugu

SEQ ID NO: 44467 - RNA, 22 nt, Human
gugucugaguccaugagccaag

SEQ ID NO: 44468 - RNA, 22 nt, Human
agcagguggaggcucaaguuuu

SEQ ID NO: 44469 - RNA, 22 nt, Human
gccucucugucaugcugggaag

SEQ ID NO: 44470 - RNA, 26 nt, Human
cuccaucagccaggcuggagugcagu

SEQ ID NO: 44471 - RNA, 22 nt, Human
uccaccagaguucugacacugu

SEQ ID NO: 44472 - RNA, 26 nt, Human
cagcacagccagagaagccucuggau

SEQ ID NO: 44473 - RNA, 19 nt, Human
agcagaggagagcauuuga

SEQ ID NO: 44474 - RNA, 21 nt, Human
ccaaaucucucaaaucuguua

SEQ ID NO: 44475 - RNA, 22 nt, Human
gcauaacuucauuugacuucuc

SEQ ID NO: 44476 - RNA, 23 nt, Human
agccugcguccaacugcgcugcu

SEQ ID NO: 44477 - RNA, 24 nt, Human
ccgggaggcuugcgaaggagaagc

SEQ ID NO: 44478 - RNA, 19 nt, Human
ccuucuugucuuccuuccc

SEQ ID NO: 44479 - RNA, 22 nt, Human
gguuuuucauccacugcaggaa

SEQ ID NO: 44480 - RNA, 22 nt, Human
ugggaaugaagcaaugcuucau

SEQ ID NO: 44481 - RNA, 21 nt, Human
agcaggaaggggaauggaaua

SEQ ID NO: 44482 - RNA, 26 nt, Human
uuucugagagaaagaaacaucugcaa

SEQ ID NO: 44483 - RNA, 20 nt, Human
aaacauccuuuacaggcucc

SEQ ID NO: 44484 - RNA, 20 nt, Human
ggcuggcugccuuaaacaca

SEQ ID NO: 44485 - RNA, 23 nt, Human
uuagcaacuggagauacaaagca

SEQ ID NO: 44486 - RNA, 27 nt, Human
gcugguggccacgcccccaccaucauc

SEQ ID NO: 44487 - RNA, 24 nt, Human
gguagagcaaucugggcacuuugg

SEQ ID NO: 44488 - RNA, 22 nt, Human
ccuagugucccuucagccuggg

SEQ ID NO: 44489 - RNA, 23 nt, Human
agcaguauuuauacuauuguaaa

SEQ ID NO: 44490 - RNA, 27 nt, Human
cucucauuccauuucugccuuaacuuu

SEQ ID NO: 44491 - RNA, 24 nt, Human
accagugagcuggagauggcugaa

SEQ ID NO: 44492 - RNA, 26 nt, Human
ccuuguaguuucuucccuccuguucu

SEQ ID NO: 44493 - RNA, 23 nt, Human
gucuuaacuguugagccuuuccu

SEQ ID NO: 44494 - RNA, 24 nt, Human
ggcuuaugucucugccuuaggguu

SEQ ID NO: 44495 - RNA, 22 nt, Human
guuuuggagauccuuguuuuuu

SEQ ID NO: 44496 - RNA, 20 nt, Human
ggcuggcuggcgaggcagag

SEQ ID NO: 44497 - RNA, 20 nt, Human
uuuucaaugaauagcacuua

SEQ ID NO: 44498 - RNA, 20 nt, Human
ccccauccuuuuugccucca

SEQ ID NO: 44499 - RNA, 20 nt, Human
ucucaacaacagugugauca

SEQ ID NO: 44500 - RNA, 21 nt, Human
accuacucuugccugcuggag

SEQ ID NO: 44501 - RNA, 24 nt, Human
uggggaauggcuucaaaauaaguc

SEQ ID NO: 44502 - RNA, 23 nt, Human
gaauuaauuuucagccaugugga

SEQ ID NO: 44503 - RNA, 27 nt, Human
ggucaggcaucuucccuucacucaagc

SEQ ID NO: 44504 - RNA, 27 nt, Human
ggggaaagauggcggaaaauuuaaaag

SEQ ID NO: 44505 - RNA, 22 nt, Human
aguaaccuguuuugaauccaga

SEQ ID NO: 44506 - RNA, 23 nt, Human
ccuaggcaacagagacucugucu

SEQ ID NO: 44507 - RNA, 26 nt, Human
ggagagaagagcaguucugcagcugg

SEQ ID NO: 44508 - RNA, 22 nt, Human
cacgccuguagucccagcacuu

SEQ ID NO: 44509 - RNA, 22 nt, Human
cacgccuguaaucccagcgcuu

SEQ ID NO: 44510 - RNA, 27 nt, Human
gguuugcaccagccucgagucucccau

SEQ ID NO: 44511 - RNA, 23 nt, Human
ugcaugcuguugauuuuccugag

SEQ ID NO: 44512 - RNA, 26 nt, Human
gcauguccuaacauuuguucuggucu

SEQ ID NO: 44513 - RNA, 21 nt, Human
gccuguaaugccagcgcuuug

SEQ ID NO: 44514 - RNA, 22 nt, Human
caguuuuucuccaucuccuggg

SEQ ID NO: 44515 - RNA, 18 nt, Human
gcuagugccgcucagccc

SEQ ID NO: 44516 - RNA, 23 nt, Human
aaauguucauuuaagggcuaccc

SEQ ID NO: 44517 - RNA, 22 nt, Human
uguacuuuuccccuggcagugg

SEQ ID NO: 44518 - RNA, 20 nt, Human
aaacaguuuuuuagacugga

SEQ ID NO: 44519 - RNA, 21 nt, Human
ccuccccauggaaugggcugu

SEQ ID NO: 44520 - RNA, 20 nt, Human
cugguugcuggccaaaggga

SEQ ID NO: 44521 - RNA, 23 nt, Human
uuagaugaugucuguuucccgug

SEQ ID NO: 44522 - RNA, 23 nt, Human
uuugcauaucucucucauccucu

SEQ ID NO: 44523 - RNA, 22 nt, Human
cacgccuguaaucccagcaauu

SEQ ID NO: 44524 - RNA, 18 nt, Human
acacccagggcagcugcc

SEQ ID NO: 44525 - RNA, 25 nt, Human
auacaauaaaaguaaacacauacac

SEQ ID NO: 44526 - RNA, 20 nt, Human
cuguagugagguugcaguga

SEQ ID NO: 44527 - RNA, 25 nt, Human
ccugucacucaggcuggagcacagu

SEQ ID NO: 44528 - RNA, 22 nt, Human
auucuuguuuuccacugcugug

SEQ ID NO: 44529 - RNA, 26 nt, Human
acaauggggaagauaggagcaagguc

SEQ ID NO: 44530 - RNA, 20 nt, Human
uauuaaaaagauuuuugcug

SEQ ID NO: 44531 - RNA, 23 nt, Human
aagcgagccgccuccagcccugu

SEQ ID NO: 44532 - RNA, 19 nt, Human
cguccugccaccuggggca

SEQ ID NO: 44533 - RNA, 24 nt, Human
auguaaggcucaguaaaugacaga

SEQ ID NO: 44534 - RNA, 22 nt, Human
agaaggcagguggucacugaca

SEQ ID NO: 44535 - RNA, 20 nt, Human
accuaaaauaugauucuauu

SEQ ID NO: 44536 - RNA, 20 nt, Human
uuuggaauaguaauauccau

SEQ ID NO: 44537 - RNA, 26 nt, Human
cgugaaaggcagagggugacugugug

SEQ ID NO: 44538 - RNA, 20 nt, Human
augaguuaggugaccaugag

SEQ ID NO: 44539 - RNA, 24 nt, Human
uccucaguucuaccuaguuucaca

SEQ ID NO: 44540 - RNA, 27 nt, Human
gacagcagauuccccacauucucaucu

SEQ ID NO: 44541 - RNA, 21 nt, Human
agucaaacaaacaaguuuaca

SEQ ID NO: 44542 - RNA, 21 nt, Human
gcgaucuuggcucacugcacc

SEQ ID NO: 44543 - RNA, 22 nt, Human
ggcugugccaucgucauagugc

SEQ ID NO: 44544 - RNA, 27 nt, Human
agcaaaucugcuguggcaggcugugga

SEQ ID NO: 44545 - RNA, 22 nt, Human
aagcaggacaggggccugggga

SEQ ID NO: 44546 - RNA, 26 nt, Human
cagccuggccacugccuagcuggaau

SEQ ID NO: 44547 - RNA, 22 nt, Human
accacacuuggcuaauuuuugu

SEQ ID NO: 44548 - RNA, 23 nt, Human
uugauuuguauucaaguacucuu

SEQ ID NO: 44549 - RNA, 18 nt, Human
cugcagugaacacaugcc

SEQ ID NO: 44550 - RNA, 21 nt, Human
aaaagcuuugaauacugugaa

SEQ ID NO: 44551 - RNA, 22 nt, Human
guggggaugaagaagaggggca

SEQ ID NO: 44552 - RNA, 20 nt, Human
gagggguuaaggugcaguga

SEQ ID NO: 44553 - RNA, 24 nt, Human
uacaacacagaguacugacucugc

SEQ ID NO: 44554 - RNA, 20 nt, Human
gaaagcugcaagaauggcac

SEQ ID NO: 44555 - RNA, 27 nt, Human
agagacacuucuauagacugcauccug

SEQ ID NO: 44556 - RNA, 29 nt, Human
ucagcugcagucgaaggcuuuaacuuugc

SEQ ID NO: 44557 - RNA, 26 nt, Human
gccauuuuaaggaaaugguggcacuc

SEQ ID NO: 44558 - RNA, 21 nt, Human
acaaauaugaagaauguggua

SEQ ID NO: 44559 - RNA, 22 nt, Human
ugaaacuccauguagcaaccag

SEQ ID NO: 44560 - RNA, 24 nt, Human
gcugcuuagagucagccugggugg

SEQ ID NO: 44561 - RNA, 27 nt, Human
caucccaggcugguggcaggagcuggg

SEQ ID NO: 44562 - RNA, 23 nt, Human
aucagaucccauccuccuccuuc

SEQ ID NO: 44563 - RNA, 17 nt, Human
aaaguguccaacaagga

SEQ ID NO: 44564 - RNA, 22 nt, Human
uagcugagaaauggagauguac

SEQ ID NO: 44565 - RNA, 24 nt, Human
ccagcacuuugcuaucuacagccg

SEQ ID NO: 44566 - RNA, 22 nt, Human
cacugcagucgagccugggcga

SEQ ID NO: 44567 - RNA, 21 nt, Human
ugcucagcaugaucaccagag

SEQ ID NO: 44568 - RNA, 23 nt, Human
ccuugauacaacagcugaccuca

SEQ ID NO: 44569 - RNA, 21 nt, Human
ggaggagggagagggagguca

SEQ ID NO: 44570 - RNA, 22 nt, Human
cugucccaccaugcagugcccc

SEQ ID NO: 44571 - RNA, 18 nt, Human
aacuauacuugaaggacc

SEQ ID NO: 44572 - RNA, 20 nt, Human
uucaugcaaccuuccauucc

SEQ ID NO: 44573 - RNA, 24 nt, Human
aggugggcggaucaccugagguca

SEQ ID NO: 44574 - RNA, 22 nt, Human
gcaacucuugccccuaccucuu

SEQ ID NO: 44575 - RNA, 24 nt, Human
cagaagcaacagcccgaccgcgcc

SEQ ID NO: 44576 - RNA, 22 nt, Human
auauaaguuuaaccacacuuug

SEQ ID NO: 44577 - RNA, 24 nt, Human
ccuagccccugcccgccugccugc

SEQ ID NO: 44578 - RNA, 23 nt, Human
gucacccagucuggagugcagug

SEQ ID NO: 44579 - RNA, 22 nt, Human
agaucaggagaaccucagucug

SEQ ID NO: 44580 - RNA, 25 nt, Human
cucgagcaccuggccuguuugcuca

SEQ ID NO: 44581 - RNA, 24 nt, Human
cugucaccaggcuggagugcagug

SEQ ID NO: 44582 - RNA, 19 nt, Human
ugccuccuggauaucuugg

SEQ ID NO: 44583 - RNA, 25 nt, Human
gggagcuuggccucuggcuccaucu

SEQ ID NO: 44584 - RNA, 26 nt, Human
cucuauuuuggugaccaauacuacug

SEQ ID NO: 44585 - RNA, 21 nt, Human
ccuucagagagcagugcuuuu

SEQ ID NO: 44586 - RNA, 23 nt, Human
uguuuaccagacacagagcccag

SEQ ID NO: 44587 - RNA, 20 nt, Human
guucaucuuaauguuuuugu

SEQ ID NO: 44588 - RNA, 23 nt, Human
uccacuccuuggcuggaggcagu

SEQ ID NO: 44589 - RNA, 21 nt, Human
ggaggcgggaucugcucugag

SEQ ID NO: 44590 - RNA, 20 nt, Human
ccugucucaaaagcaaaaca

SEQ ID NO: 44591 - RNA, 27 nt, Human
gaguagcugggauuacaggagcgugcc

SEQ ID NO: 44592 - RNA, 24 nt, Human
cacuugagcccaggagauugaggc

SEQ ID NO: 44593 - RNA, 22 nt, Human
acugcugucuaucuucuugcuc

SEQ ID NO: 44594 - RNA, 25 nt, Human
uucuuuuguuuacuuuuagaccaaa

SEQ ID NO: 44595 - RNA, 26 nt, Human
aucuggaggagaggauaauuuccacu

SEQ ID NO: 44596 - RNA, 27 nt, Human
ucuccugcccaauucuuggcacaggca

SEQ ID NO: 44597 - RNA, 25 nt, Human
gguugggaugugggaaugacugggg

SEQ ID NO: 44598 - RNA, 22 nt, Human
cucuggccccucucguggagcu

SEQ ID NO: 44599 - RNA, 22 nt, Human
gggauuacaggugccugccacc

SEQ ID NO: 44600 - RNA, 27 nt, Human
cucccacacgugagcucccacacguac

SEQ ID NO: 44601 - RNA, 22 nt, Human
aaagguuggugguagggaggcu

SEQ ID NO: 44602 - RNA, 26 nt, Human
ugagccaagaucaugccacugcacuc

SEQ ID NO: 44603 - RNA, 19 nt, Human
gaggagggggaaauuugua

SEQ ID NO: 44604 - RNA, 20 nt, Human
agacaccuccggggucccua

SEQ ID NO: 44605 - RNA, 27 nt, Human
ccagacauaaggaggccagaggcugca

SEQ ID NO: 44606 - RNA, 25 nt, Human
cccucagguucuauuuucuuaaacc

SEQ ID NO: 44607 - RNA, 17 nt, Human
gccaccccgugccaccc

SEQ ID NO: 44608 - RNA, 25 nt, Human
ggcaugaagccuccucagcucuugg

SEQ ID NO: 44609 - RNA, 20 nt, Human
ccuccuccuucucucuuggc

SEQ ID NO: 44610 - RNA, 23 nt, Human
guuuuuaaaaucaguacuuuuua

SEQ ID NO: 44611 - RNA, 21 nt, Human
gagcacuucuccacagcgggu

SEQ ID NO: 44612 - RNA, 20 nt, Human
ggggugagauuggggguugg

SEQ ID NO: 44613 - RNA, 22 nt, Human
cuuucugcucuauacuguggcc

SEQ ID NO: 44614 - RNA, 26 nt, Human
aacacccuucuaggggaggcgggugg

SEQ ID NO: 44615 - RNA, 21 nt, Human
cccccuggggcugcuggagcu

SEQ ID NO: 44616 - RNA, 28 nt, Human
cauucucucguggcuuuccaucucagcc

SEQ ID NO: 44617 - RNA, 19 nt, Human
cacaggcacacagggcccg

SEQ ID NO: 44618 - RNA, 20 nt, Human
gaucuccuccuccuucaugc

SEQ ID NO: 44619 - RNA, 29 nt, Human
cuccagccuccaggcacccgggauccagc

SEQ ID NO: 44620 - RNA, 27 nt, Human
cuucccaaguucuuuuacagucccugc

SEQ ID NO: 44621 - RNA, 20 nt, Human
ccugcagcugcuuguuagcu

SEQ ID NO: 44622 - RNA, 22 nt, Human
ugcgccccuggcugggaggaag

SEQ ID NO: 44623 - RNA, 20 nt, Human
gugacagaagcaguccagua

SEQ ID NO: 44624 - RNA, 20 nt, Human
ucuuuuggcuucccugggcc

SEQ ID NO: 44625 - RNA, 21 nt, Human
gugccugcuuaguagcuuugg

SEQ ID NO: 44626 - RNA, 19 nt, Human
agggaucuuguguacccuu

SEQ ID NO: 44627 - RNA, 24 nt, Human
aggagagaagagagaaauagccug

SEQ ID NO: 44628 - RNA, 25 nt, Human
gcccagccuggggaauuuaaacacu

SEQ ID NO: 44629 - RNA, 20 nt, Human
uguagccaguuuucugaguu

SEQ ID NO: 44630 - RNA, 27 nt, Human
cuauauccuuaaccauucuguccaauu

SEQ ID NO: 44631 - RNA, 26 nt, Human
uucuucuucuuuauuauucuuugcuu

SEQ ID NO: 44632 - RNA, 23 nt, Human
accaguaaucccagcuacucggg

SEQ ID NO: 44633 - RNA, 23 nt, Human
cuuucauuuugcaccugcagcca

SEQ ID NO: 44634 - RNA, 20 nt, Human
gggcuccugccuucuguccu

SEQ ID NO: 44635 - RNA, 24 nt, Human
cuuguuucuaggcuguaucacagu

SEQ ID NO: 44636 - RNA, 21 nt, Human
agaauguccuucuuuaaaccu

SEQ ID NO: 44637 - RNA, 21 nt, Human
ggaauguguucucucagugaa

SEQ ID NO: 44638 - RNA, 23 nt, Human
cuccccagcuucugcugcucgcc

SEQ ID NO: 44639 - RNA, 27 nt, Human
ccugcagcuuguuuugcugcgcuucau

SEQ ID NO: 44640 - RNA, 21 nt, Human
cuggaaacugcaggccagaug

SEQ ID NO: 44641 - RNA, 22 nt, Human
accuauaaccccagcacuuugg

SEQ ID NO: 44642 - RNA, 27 nt, Human
aguucucugucauguguguucccugcc

SEQ ID NO: 44643 - RNA, 26 nt, Human
gaggagcagagagagcugcaaagauu

SEQ ID NO: 44644 - RNA, 22 nt, Human
uaucacccagacuggcgugcag

SEQ ID NO: 44645 - RNA, 21 nt, Human
caacaugccagccacugugau

SEQ ID NO: 44646 - RNA, 20 nt, Human
augcaagaguugcagcggcu

SEQ ID NO: 44647 - RNA, 24 nt, Human
caggcugcagggggcuggagaagc

SEQ ID NO: 44648 - RNA, 24 nt, Human
guucucuccaugcccugggucacu

SEQ ID NO: 44649 - RNA, 32 nt, Human
ugcuuuugaaaugcuuaucugccugucacaua

SEQ ID NO: 44650 - RNA, 23 nt, Human
cgcccggggcuguggcuggcagc

SEQ ID NO: 44651 - RNA, 27 nt, Human
uacaagugguuuuacagcuaccacccu

SEQ ID NO: 44652 - RNA, 23 nt, Human
ucuuuauguuauucuuucacuuu

SEQ ID NO: 44653 - RNA, 23 nt, Human
cugugcacugauugcauaugcau

SEQ ID NO: 44654 - RNA, 21 nt, Human
cucacugauccuucugcauau

SEQ ID NO: 44655 - RNA, 21 nt, Human
aggucucuuucauuuuucucu

SEQ ID NO: 44656 - RNA, 29 nt, Human
ccguggucccgaguucccugggaggcuga

SEQ ID NO: 44657 - RNA, 26 nt, Human
cuauagcuacauacuccuggcauugc

SEQ ID NO: 44658 - RNA, 26 nt, Human
ggaaagaagagagaccgagcuaauua

SEQ ID NO: 44659 - RNA, 23 nt, Human
uacuauuuugacaguuauuuuga

SEQ ID NO: 44660 - RNA, 21 nt, Human
gugggcggcagagaggacugu

SEQ ID NO: 44661 - RNA, 20 nt, Human
caccuaggcuggagugcagu

SEQ ID NO: 44662 - RNA, 27 nt, Human
ucuucugccagccauggauuccaggcu

SEQ ID NO: 44663 - RNA, 27 nt, Human
gguuucaucuggaauuaacuggaugga

SEQ ID NO: 44664 - RNA, 22 nt, Human
ccuggagagccgaguugcagug

SEQ ID NO: 44665 - RNA, 26 nt, Human
ccugcucucuccagagaaacuggagg

SEQ ID NO: 44666 - RNA, 26 nt, Human
aggcuagugaugagcuucacccugga

SEQ ID NO: 44667 - RNA, 27 nt, Human
uuuucuuguuuaucacacauacaagua

SEQ ID NO: 44668 - RNA, 27 nt, Human
cucugaaccucaguuuccucaucugca

SEQ ID NO: 44669 - RNA, 20 nt, Human
cccugcucaccacugaggcc

SEQ ID NO: 44670 - RNA, 22 nt, Human
gcguacaccaccaugccuggcu

SEQ ID NO: 44671 - RNA, 27 nt, Human
aaaggaagccagaguugacaguacaaa

SEQ ID NO: 44672 - RNA, 24 nt, Human
gaaagagaaaugaaauauuuuuga

SEQ ID NO: 44673 - RNA, 23 nt, Human
auuuacuccaacacaaauaggac

SEQ ID NO: 44674 - RNA, 21 nt, Human
uucauucugcauacuuggaca

SEQ ID NO: 44675 - RNA, 19 nt, Human
ugaugcccuucuguaagug

SEQ ID NO: 44676 - RNA, 22 nt, Human
gugcacagaccacacacagcac

SEQ ID NO: 44677 - RNA, 20 nt, Human
cuauuuucugcuaccauuuc

SEQ ID NO: 44678 - RNA, 23 nt, Human
cagccagggcuggggaacacugu

SEQ ID NO: 44679 - RNA, 23 nt, Human
ucugcucccacagugccuuuucc

SEQ ID NO: 44680 - RNA, 23 nt, Human
aacaaguguucagagcagacaga

SEQ ID NO: 44681 - RNA, 21 nt, Human
gggagguugaggcugcagugg

SEQ ID NO: 44682 - RNA, 27 nt, Human
uggcucacagcuauaaucucagcacuu

SEQ ID NO: 44683 - RNA, 24 nt, Human
ggccaccggcgggagugcagcggc

SEQ ID NO: 44684 - RNA, 27 nt, Human
uauagugguaacuuuucaaacagcccu

SEQ ID NO: 44685 - RNA, 22 nt, Human
cccgcagcugccucagucggcu

SEQ ID NO: 44686 - RNA, 27 nt, Human
cuucuugccagccacagcugcugccuc

SEQ ID NO: 44687 - RNA, 26 nt, Human
uggcuggaguucaguggugugaucuu

SEQ ID NO: 44688 - RNA, 25 nt, Human
auggaguagagucaggagaaacccc

SEQ ID NO: 44689 - RNA, 26 nt, Human
uaucugaauguugcauuguauuguac

SEQ ID NO: 44690 - RNA, 24 nt, Human
ggucccuacccaucuggcagcugc

SEQ ID NO: 44691 - RNA, 23 nt, Human
aaaugauugcuuuuaaaauuuua

SEQ ID NO: 44692 - RNA, 23 nt, Human
ccuaacucccuguucuccugccu

SEQ ID NO: 44693 - RNA, 22 nt, Human
ugugcaucaugaaugauaagcu

SEQ ID NO: 44694 - RNA, 24 nt, Human
ggggaaugcaccuccccaaagcag

SEQ ID NO: 44695 - RNA, 22 nt, Human
cccaggaggcggcaggacggcc

SEQ ID NO: 44696 - RNA, 26 nt, Human
aucauuucuuaaggcugccuuccucu

SEQ ID NO: 44697 - RNA, 22 nt, Human
ggcaggagaaucucuugaaccc

SEQ ID NO: 44698 - RNA, 27 nt, Human
aaccuugaaucacuugagcauguaaua

SEQ ID NO: 44699 - RNA, 25 nt, Human
ggcuucugcgugcuuucucccuucc

SEQ ID NO: 44700 - RNA, 27 nt, Human
gagcccaaguccuucaaaccuccuccu

SEQ ID NO: 44701 - RNA, 21 nt, Human
ccgcugacaccuucccuuucg

SEQ ID NO: 44702 - RNA, 22 nt, Human
cugccccccaccccucaguuaa

SEQ ID NO: 44703 - RNA, 21 nt, Human
cguguagcuguugagaggugg

SEQ ID NO: 44704 - RNA, 22 nt, Human
gcgugagcuacugugcccagcc

SEQ ID NO: 44705 - RNA, 22 nt, Human
aguguucugcagccaugcuuca

SEQ ID NO: 44706 - RNA, 21 nt, Human
aguggagggagagguggggcc

SEQ ID NO: 44707 - RNA, 21 nt, Human
ucuccacuguuaccuaaguuc

SEQ ID NO: 44708 - RNA, 22 nt, Human
ugcucccuccuuccucauccag

SEQ ID NO: 44709 - RNA, 21 nt, Human
uguggcacaaguucucuuguc

SEQ ID NO: 44710 - RNA, 27 nt, Human
aaccugaccaacauggagaaacccugu

SEQ ID NO: 44711 - RNA, 20 nt, Human
aaguauuuaagccuaaagau

SEQ ID NO: 44712 - RNA, 23 nt, Human
aaaacauuuguaauaauuaaugg

SEQ ID NO: 44713 - RNA, 22 nt, Human
ccguguagcugggacuacaggc

SEQ ID NO: 44714 - RNA, 21 nt, Human
aacugcugagagacagagcua

SEQ ID NO: 44715 - RNA, 18 nt, Human
aagaaaccacagguucca

SEQ ID NO: 44716 - RNA, 19 nt, Human
guaggaguucgccagggaa

SEQ ID NO: 44717 - RNA, 20 nt, Human
ggggaagccucugggcugag

SEQ ID NO: 44718 - RNA, 21 nt, Human
uccuauacuaacuuguuucaa

SEQ ID NO: 44719 - RNA, 21 nt, Human
aguucaguccuccugcccugg

SEQ ID NO: 44720 - RNA, 22 nt, Human
ugcuugcaaucugagcucuuga

SEQ ID NO: 44721 - RNA, 28 nt, Human
auggccagggccgcagugccccuccccc

SEQ ID NO: 44722 - RNA, 22 nt, Human
ccacacugugaaggcaguauua

SEQ ID NO: 44723 - RNA, 18 nt, Human
ccccguucugcucccaca

SEQ ID NO: 44724 - RNA, 22 nt, Human
ucagagaacacaguagaugugu

SEQ ID NO: 44725 - RNA, 25 nt, Human
agggcaugcccugccuaccuucuga

SEQ ID NO: 44726 - RNA, 22 nt, Human
cgggagguggagguugccguga

SEQ ID NO: 44727 - RNA, 23 nt, Human
cuucauugcccagcuccugcccg

SEQ ID NO: 44728 - RNA, 24 nt, Human
agacagccacaguacccucacuuu

SEQ ID NO: 44729 - RNA, 23 nt, Human
cuacauuaaacucaaauguaaua

SEQ ID NO: 44730 - RNA, 27 nt, Human
ggaagaaaucaaguuaauguacuuuca

SEQ ID NO: 44731 - RNA, 22 nt, Human
acauuuucacacuuaagauuca

SEQ ID NO: 44732 - RNA, 21 nt, Human
agccuggcccuuaucugcacu

SEQ ID NO: 44733 - RNA, 21 nt, Human
gacuggagacugaugcaugag

SEQ ID NO: 44734 - RNA, 22 nt, Human
gcauccagaauuuccucccucu

SEQ ID NO: 44735 - RNA, 22 nt, Human
ggcgguggggagaggccgaggc

SEQ ID NO: 44736 - RNA, 23 nt, Human
gguucucgggauucgaguccugg

SEQ ID NO: 44737 - RNA, 24 nt, Human
gccaccauggccaaagguggagaa

SEQ ID NO: 44738 - RNA, 26 nt, Human
aggaggaacggaagaaaccuauugug

SEQ ID NO: 44739 - RNA, 23 nt, Human
cucaagugauccuccugcuuugg

SEQ ID NO: 44740 - RNA, 25 nt, Human
auugcuugaacccaggaaguggcag

SEQ ID NO: 44741 - RNA, 22 nt, Human
uaggggaucuggaagggccaag

SEQ ID NO: 44742 - RNA, 24 nt, Human
gcagucaacaacacagagugcugg

SEQ ID NO: 44743 - RNA, 21 nt, Human
aggaagaggaaggcagcccug

SEQ ID NO: 44744 - RNA, 27 nt, Human
uggaacauugaggauggaaacuggacu

SEQ ID NO: 44745 - RNA, 20 nt, Human
auuuuucuacaucaaaccua

SEQ ID NO: 44746 - RNA, 26 nt, Human
cccuacucccucuucacuguggccac

SEQ ID NO: 44747 - RNA, 22 nt, Human
cuuuguuuucuugaucuguuac

SEQ ID NO: 44748 - RNA, 26 nt, Human
ggaggcggcggcggggcagugaaacu

SEQ ID NO: 44749 - RNA, 23 nt, Human
ucugagaucagugccucuggguu

SEQ ID NO: 44750 - RNA, 21 nt, Human
caggcagcccgggcugccuga

SEQ ID NO: 44751 - RNA, 22 nt, Human
ggcgaggaaagcgggaugggaa

SEQ ID NO: 44752 - RNA, 22 nt, Human
uucaagcgauuuuccugccuca

SEQ ID NO: 44753 - RNA, 24 nt, Human
aaucccuggcugucugugagcagc

SEQ ID NO: 44754 - RNA, 23 nt, Human
cauggcagauguaggagggacug

SEQ ID NO: 44755 - RNA, 21 nt, Human
ggacccgccaguuucaaacuc

SEQ ID NO: 44756 - RNA, 23 nt, Human
auuugauaucccuuucuccauuc

SEQ ID NO: 44757 - RNA, 22 nt, Human
cugggcuuagcugggccucuga

SEQ ID NO: 44758 - RNA, 20 nt, Human
ggccaggcguucccaccucu

SEQ ID NO: 44759 - RNA, 32 nt, Human
cccugcacuugggagccgguagcacuccuauc

SEQ ID NO: 44760 - RNA, 22 nt, Human
uugccuuuuaaauucuuuuccc

SEQ ID NO: 44761 - RNA, 22 nt, Human
ggcagagugggggcagugccuu

SEQ ID NO: 44762 - RNA, 23 nt, Human
ccuccggcucccugugcugcccc

SEQ ID NO: 44763 - RNA, 24 nt, Human
gcaugcgcgugugugcacagggug

SEQ ID NO: 44764 - RNA, 26 nt, Human
cccagccugugccaagcuucaacagg

SEQ ID NO: 44765 - RNA, 18 nt, Human
ggccucggcggcuccuca

SEQ ID NO: 44766 - RNA, 21 nt, Human
aagcaaauucauauuugcaau

SEQ ID NO: 44767 - RNA, 22 nt, Human
cggcagacaccgcuagcccugg

SEQ ID NO: 44768 - RNA, 22 nt, Human
uuucuuuucuuuucuucugguu

SEQ ID NO: 44769 - RNA, 22 nt, Human
acagugcugggauuaccggcgu

SEQ ID NO: 44770 - RNA, 29 nt, Human
agcauaaggcuucagggcccaaguuggga

SEQ ID NO: 44771 - RNA, 26 nt, Human
cugaagccagaagcugugggcugugg

SEQ ID NO: 44772 - RNA, 23 nt, Human
aguuuuggauauuugcuugcugu

SEQ ID NO: 44773 - RNA, 25 nt, Human
caccacugcugggcugcgagcuggg

SEQ ID NO: 44774 - RNA, 25 nt, Human
auuuggcuguugugcuuuccaagcg

SEQ ID NO: 44775 - RNA, 24 nt, Human
accaaagacacaagcaaccaaugg

SEQ ID NO: 44776 - RNA, 21 nt, Human
agcgagugcucagaacagggc

SEQ ID NO: 44777 - RNA, 25 nt, Human
caggauugauaaacagcugggcaca

SEQ ID NO: 44778 - RNA, 26 nt, Human
cacuccugccucccucaucugugucc

SEQ ID NO: 44779 - RNA, 22 nt, Human
gcagggaggagcaucugaggug

SEQ ID NO: 44780 - RNA, 25 nt, Human
gcuuccucauccugccuguuccccc

SEQ ID NO: 44781 - RNA, 22 nt, Human
uucauuucuucaagaugcucug

SEQ ID NO: 44782 - RNA, 22 nt, Human
uguaguaagcaguguuucuggc

SEQ ID NO: 44783 - RNA, 27 nt, Human
acauugagaccagccaacuucuugccu

SEQ ID NO: 44784 - RNA, 26 nt, Human
ggggcugccagagaaccccagaccug

SEQ ID NO: 44785 - RNA, 23 nt, Human
uaaagaauggaagguggagaagc

SEQ ID NO: 44786 - RNA, 24 nt, Human
ggggucaggaacacuacacugcac

SEQ ID NO: 44787 - RNA, 22 nt, Human
ugcaaccuccgccucucggguu

SEQ ID NO: 44788 - RNA, 32 nt, Human
gggguauagaaaaaggaaugaauaagcguugu

SEQ ID NO: 44789 - RNA, 26 nt, Human
gucugccugugaaucuccccauguag

SEQ ID NO: 44790 - RNA, 24 nt, Human
agaaggagggggaaggacagaggg

SEQ ID NO: 44791 - RNA, 21 nt, Human
ggcccaccaagagauauugcc

SEQ ID NO: 44792 - RNA, 23 nt, Human
cuuggaagaaugcuuuuugaugu

SEQ ID NO: 44793 - RNA, 21 nt, Human
acuaccugcagcuaagcagug

SEQ ID NO: 44794 - RNA, 18 nt, Human
ccuguucucugagcucca

SEQ ID NO: 44795 - RNA, 21 nt, Human
uucccugcaaaaggacacaga

SEQ ID NO: 44796 - RNA, 24 nt, Human
uccucagcccccaggauugaccuc

SEQ ID NO: 44797 - RNA, 27 nt, Human
auggaaaucccuugcaucugcuaccuc

SEQ ID NO: 44798 - RNA, 22 nt, Human
gguuucugcaagugugaggucc

SEQ ID NO: 44799 - RNA, 24 nt, Human
ccaccgcacuucagccugggugac

SEQ ID NO: 44800 - RNA, 24 nt, Human
cuccacccucccccagacacagcc

SEQ ID NO: 44801 - RNA, 18 nt, Human
uguaaauugucagaugcu

SEQ ID NO: 44802 - RNA, 25 nt, Human
agccuggauuuucacucaucccuga

SEQ ID NO: 44803 - RNA, 21 nt, Human
ucucugagugugacuugggcu

SEQ ID NO: 44804 - RNA, 22 nt, Human
uggucucaaacccccagccuca

SEQ ID NO: 44805 - RNA, 24 nt, Human
gccagucaccagcccucugccugc

SEQ ID NO: 44806 - RNA, 20 nt, Human
ugccccaggccggagcccag

SEQ ID NO: 44807 - RNA, 22 nt, Human
gugugcaugaguguggaugggu

SEQ ID NO: 44808 - RNA, 27 nt, Human
gcaggcucugggccugccccuugccca

SEQ ID NO: 44809 - RNA, 20 nt, Human
cuuccuggcccagucccugc

SEQ ID NO: 44810 - RNA, 24 nt, Human
gaucguggccaacguggaccugcc

SEQ ID NO: 44811 - RNA, 27 nt, Human
acuguacaguaauggucaacuuugcca

SEQ ID NO: 44812 - RNA, 26 nt, Human
ccagaagucuccugaaaggcuuacau

SEQ ID NO: 44813 - RNA, 26 nt, Human
gcugggugggcagaaugcagaguaga

SEQ ID NO: 44814 - RNA, 26 nt, Human
ccaaacagccccaaagucaauuaaag

SEQ ID NO: 44815 - RNA, 20 nt, Human
cuaccugccuaagggacuua

SEQ ID NO: 44816 - RNA, 21 nt, Human
gguaauaaaccuuaggaacua

SEQ ID NO: 44817 - RNA, 23 nt, Human
cauucuuggcuuaaucauuuuca

SEQ ID NO: 44818 - RNA, 25 nt, Human
gccacugcgcccagccugaaucauu

SEQ ID NO: 44819 - RNA, 20 nt, Human
ugcuaaaaaagcauauauaa

SEQ ID NO: 44820 - RNA, 22 nt, Human
cgacagacauguaugacugcau

SEQ ID NO: 44821 - RNA, 21 nt, Human
uuuagggucuucaguuacaca

SEQ ID NO: 44822 - RNA, 24 nt, Human
uguuagacaugaagggaaaaagag

SEQ ID NO: 44823 - RNA, 21 nt, Human
uucuccacucugcacccuacc

SEQ ID NO: 44824 - RNA, 21 nt, Human
uuguuugucagcaucugacca

SEQ ID NO: 44825 - RNA, 22 nt, Human
cugccaagccccugccuccagc

SEQ ID NO: 44826 - RNA, 20 nt, Human
agguuuaucagccucugcaa

SEQ ID NO: 44827 - RNA, 30 nt, Human
uccaucaccuuccuccucugcucugggugg

SEQ ID NO: 44828 - RNA, 27 nt, Human
guugcccaggcuggucuugaacuccug

SEQ ID NO: 44829 - RNA, 27 nt, Human
agccccaaacuccuuaucuuuugcagu

SEQ ID NO: 44830 - RNA, 21 nt, Human
cuucccuucuacucugcgcug

SEQ ID NO: 44831 - RNA, 23 nt, Human
cacuggguuucggccucuuccca

SEQ ID NO: 44832 - RNA, 27 nt, Human
aaccaaaauaaauauuucugcauuucg

SEQ ID NO: 44833 - RNA, 15 nt, Human
gcucacuguguuucu

SEQ ID NO: 44834 - RNA, 20 nt, Human
guacuuuuuguggcuugguu

SEQ ID NO: 44835 - RNA, 16 nt, Human
aaucugcugcaccuug

SEQ ID NO: 44836 - RNA, 28 nt, Human
agaguauuucaaaugcaagaaaugagaa

SEQ ID NO: 44837 - RNA, 25 nt, Human
ucuacuuccccauggcccugagcga

SEQ ID NO: 44838 - RNA, 23 nt, Human
cccuccccaccccccaaaaaagg

SEQ ID NO: 44839 - RNA, 27 nt, Human
uuugcuacacuucuccccaccugguac

SEQ ID NO: 44840 - RNA, 22 nt, Human
acaccuugccuugcucuugcca

SEQ ID NO: 44841 - RNA, 23 nt, Human
gcccuaaauugacacucucucca

SEQ ID NO: 44842 - RNA, 22 nt, Human
cugcagucccagcuacuuggga

SEQ ID NO: 44843 - RNA, 27 nt, Human
cuagguggcaggcccugcaucauggaa

SEQ ID NO: 44844 - RNA, 27 nt, Human
caccuuccacacucugaucacagcccc

SEQ ID NO: 44845 - RNA, 27 nt, Human
agccuuugccagccauucuuucccuuu

SEQ ID NO: 44846 - RNA, 23 nt, Human
uuguaaauauagugaagcaauuu

SEQ ID NO: 44847 - RNA, 26 nt, Human
gcugcccagggcuccggaggugcagc

SEQ ID NO: 44848 - RNA, 22 nt, Human
ugggguacguuucaaacugagg

SEQ ID NO: 44849 - RNA, 27 nt, Human
aggcagacggaagauguggcagaaguc

SEQ ID NO: 44850 - RNA, 21 nt, Human
ggcucacugcagccucugccu

SEQ ID NO: 44851 - RNA, 26 nt, Human
ggagagaaaggggauguauccauggg

SEQ ID NO: 44852 - RNA, 21 nt, Human
ugggaggcggagguugcagug

SEQ ID NO: 44853 - RNA, 20 nt, Human
cgggagauggaagccuccca

SEQ ID NO: 44854 - RNA, 20 nt, Human
gcucagccucagggcucaga

SEQ ID NO: 44855 - RNA, 22 nt, Human
gagauggagucuugcucuguca

SEQ ID NO: 44856 - RNA, 27 nt, Human
ccaggcacugcugcccagccuccaagc

SEQ ID NO: 44857 - RNA, 21 nt, Human
uuguuaaacuucugugcuguu

SEQ ID NO: 44858 - RNA, 27 nt, Human
ccuccacuccccucugagauuggcuuc

SEQ ID NO: 44859 - RNA, 20 nt, Human
augaucucggcuuacugcaa

SEQ ID NO: 44860 - RNA, 21 nt, Human
ugcugcuaacagcauugccug

SEQ ID NO: 44861 - RNA, 24 nt, Human
agcagcuggccauuuguucuugaa

SEQ ID NO: 44862 - RNA, 32 nt, Human
ucuuucuuacacagaaacauacacauaccgag

SEQ ID NO: 44863 - RNA, 21 nt, Human
agggucucacccugucacuca

SEQ ID NO: 44864 - RNA, 22 nt, Human
cucucucuuccuuucucucugc

SEQ ID NO: 44865 - RNA, 22 nt, Human
ccaagcccccaaccccuccuuc

SEQ ID NO: 44866 - RNA, 22 nt, Human
ggagaaacugugaauuggagaa

SEQ ID NO: 44867 - RNA, 22 nt, Human
gggagcuuggaugccaaaggga

SEQ ID NO: 44868 - RNA, 20 nt, Human
auuaugcugcucacucuuau

SEQ ID NO: 44869 - RNA, 24 nt, Human
gcagaaaagccugaucccaggagg

SEQ ID NO: 44870 - RNA, 23 nt, Human
aggcugaggcacggagaagaaaa

SEQ ID NO: 44871 - RNA, 20 nt, Human
ggggucugaaguacacugga

SEQ ID NO: 44872 - RNA, 20 nt, Human
ggcugcuugugaaugcagcu

SEQ ID NO: 44873 - RNA, 26 nt, Human
gagaaacuuuuauuuugaagagacca

SEQ ID NO: 44874 - RNA, 28 nt, Human
auuuagaaaaagauucuggauaucaucc

SEQ ID NO: 44875 - RNA, 26 nt, Human
uauucagcaaaaguauuaaugggcuu

SEQ ID NO: 44876 - RNA, 23 nt, Human
cccacuugcaaccaccaggcugg

SEQ ID NO: 44877 - RNA, 27 nt, Human
cccgaguagcugggauuagaggcgcca

SEQ ID NO: 44878 - RNA, 23 nt, Human
gauggggaaaucagaagcuuuga

SEQ ID NO: 44879 - RNA, 24 nt, Human
ucagaagcagcagguccuaucuga

SEQ ID NO: 44880 - RNA, 22 nt, Human
ggcaagacauugauccucucuc

SEQ ID NO: 44881 - RNA, 29 nt, Human
ggcugcaagacugccucuccugcaaggca

SEQ ID NO: 44882 - RNA, 25 nt, Human
gugugaauuccugcuccucaugcug

SEQ ID NO: 44883 - RNA, 23 nt, Human
ucaagauuuggaagcauugccaa

SEQ ID NO: 44884 - RNA, 31 nt, Human
ccucaaggacugcggccucuucuauccucac

SEQ ID NO: 44885 - RNA, 22 nt, Human
ucacugcagccucauacuccug

SEQ ID NO: 44886 - RNA, 23 nt, Human
uuauccucaguuucagauacuuc

SEQ ID NO: 44887 - RNA, 31 nt, Human
gguggggcugcuccuccagggccacgugcca

SEQ ID NO: 44888 - RNA, 20 nt, Human
cuccucucugagccuuuguc

SEQ ID NO: 44889 - RNA, 21 nt, Human
cuucccacugcaaugccuuua

SEQ ID NO: 44890 - RNA, 21 nt, Human
caccacacugugaugucaucg

SEQ ID NO: 44891 - RNA, 23 nt, Human
gccaggaggcugugagcaaagug

SEQ ID NO: 44892 - RNA, 19 nt, Human
cugcagcccaggccaguca

SEQ ID NO: 44893 - RNA, 23 nt, Human
gccuguaauuccagcuacucagg

SEQ ID NO: 44894 - RNA, 23 nt, Human
gccuguaaucccagcuauucagg

SEQ ID NO: 44895 - RNA, 20 nt, Human
uucguugucucugggcuggg

SEQ ID NO: 44896 - RNA, 20 nt, Human
aacucacugcaaaaucacca

SEQ ID NO: 44897 - RNA, 20 nt, Human
caaucuguaaaaacaucucc

SEQ ID NO: 44898 - RNA, 22 nt, Human
ccccccuggcucuucucucuca

SEQ ID NO: 44899 - RNA, 27 nt, Human
acuggaacucaggcucaagcaauccuc

SEQ ID NO: 44900 - RNA, 22 nt, Human
aaaguacugggauuacaggcgu

SEQ ID NO: 44901 - RNA, 24 nt, Human
aagagccggcagcuccuccucauc

SEQ ID NO: 44902 - RNA, 19 nt, Human
uguccgugggugugcagug

SEQ ID NO: 44903 - RNA, 17 nt, Human
cacccugggcucuggga

SEQ ID NO: 44904 - RNA, 22 nt, Human
gacucacugcaagcuccgccuc

SEQ ID NO: 44905 - RNA, 25 nt, Human
gugcacaaacaauauaaaggcuugc

SEQ ID NO: 44906 - RNA, 20 nt, Human
ccuucacucugacaguauua

SEQ ID NO: 44907 - RNA, 27 nt, Human
uggucagucauuugaaaauugacuuua

SEQ ID NO: 44908 - RNA, 26 nt, Human
ggcugugcguccacuggggacugggg

SEQ ID NO: 44909 - RNA, 20 nt, Human
cagaguuaaauuguucucag

SEQ ID NO: 44910 - RNA, 19 nt, Human
agcugccugggaggcagau

SEQ ID NO: 44911 - RNA, 28 nt, Human
ccaccugccucugcccagauuugcccuc

SEQ ID NO: 44912 - RNA, 22 nt, Human
uucauucuuaaaaguuaauuga

SEQ ID NO: 44913 - RNA, 25 nt, Human
gugcugaagggcagggaacaacuug

SEQ ID NO: 44914 - RNA, 24 nt, Human
gcgcucaacugcagccccuccucc

SEQ ID NO: 44915 - RNA, 22 nt, Human
ggacguggaaccugggagccac

SEQ ID NO: 44916 - RNA, 23 nt, Human
acccaaagaguauccacugggga

SEQ ID NO: 44917 - RNA, 28 nt, Human
ccagcccccagcaaccaccaaucugcuu

SEQ ID NO: 44918 - RNA, 23 nt, Human
cccuuacucucacaccugggcaa

SEQ ID NO: 44919 - RNA, 30 nt, Human
ggggagaggguuuuucucacugugccaauu

SEQ ID NO: 44920 - RNA, 27 nt, Human
caggcagcaaugggguuccugcagcug

SEQ ID NO: 44921 - RNA, 22 nt, Human
cuucagccacuccgacugccug

SEQ ID NO: 44922 - RNA, 24 nt, Human
gccugcccuuucucccaaaaggac

SEQ ID NO: 44923 - RNA, 20 nt, Human
guugcccugagcugcagccu

SEQ ID NO: 44924 - RNA, 23 nt, Human
gagguacaaccuguucugcuuuc

SEQ ID NO: 44925 - RNA, 21 nt, Human
ggguccagggcugaucaaaga

SEQ ID NO: 44926 - RNA, 27 nt, Human
uuucugccucuguaguagcccugcaca

SEQ ID NO: 44927 - RNA, 22 nt, Human
uggugcagaggugagcagagga

SEQ ID NO: 44928 - RNA, 26 nt, Human
uuguacucaggagucugacuccuggg

SEQ ID NO: 44929 - RNA, 21 nt, Human
aggaggcagaggcugugguga

SEQ ID NO: 44930 - RNA, 19 nt, Human
uuauuuuuacaguucuccc

SEQ ID NO: 44931 - RNA, 20 nt, Human
ucacccauacacauuuggcu

SEQ ID NO: 44932 - RNA, 27 nt, Human
uuggaugguucuugaaagugucugagc

SEQ ID NO: 44933 - RNA, 25 nt, Human
uucucacuuaauugcuuugcugcua

SEQ ID NO: 44934 - RNA, 20 nt, Human
cccuggagcgagcuggugag

SEQ ID NO: 44935 - RNA, 23 nt, Human
uuuuauauuauuguaaccaauaa

SEQ ID NO: 44936 - RNA, 22 nt, Human
aggcuggagugcaguggcguaa

SEQ ID NO: 44937 - RNA, 22 nt, Human
aggcuggaguacaguggcauaa

SEQ ID NO: 44938 - RNA, 27 nt, Human
auuaacaaaagcaauuguauuacuucc

SEQ ID NO: 44939 - RNA, 17 nt, Human
agagugaggggugcagg

SEQ ID NO: 44940 - RNA, 23 nt, Human
acuugcuugucuugggccuguca

SEQ ID NO: 44941 - RNA, 25 nt, Human
gcucugaagaagaacaacccuuuag

SEQ ID NO: 44942 - RNA, 25 nt, Human
gaacacaaccaaaugaacuguccug

SEQ ID NO: 44943 - RNA, 25 nt, Human
cucgggaggcugagacaggagaauc

SEQ ID NO: 44944 - RNA, 26 nt, Human
ugggaagcuggcaaucugcaccuugg

SEQ ID NO: 44945 - RNA, 29 nt, Human
gaggcaggggacaagggaggcaguggcua

SEQ ID NO: 44946 - RNA, 23 nt, Human
caguuucagggcuaacgaccaca

SEQ ID NO: 44947 - RNA, 22 nt, Human
gccugagccauauucucacaug

SEQ ID NO: 44948 - RNA, 26 nt, Human
aggcauucagggguguguuugccaca

SEQ ID NO: 44949 - RNA, 22 nt, Human
gaaccuaacgaggagagcccag

SEQ ID NO: 44950 - RNA, 27 nt, Human
cagaguccuggcccuugaugcccagcu

SEQ ID NO: 44951 - RNA, 21 nt, Human
ucuuuuuucucccucuggauc

SEQ ID NO: 44952 - RNA, 20 nt, Human
uaugaucuugaguauaagaa

SEQ ID NO: 44953 - RNA, 26 nt, Human
uccagccucggagaccuucacaaagc

SEQ ID NO: 44954 - RNA, 25 nt, Human
gccugcucuccagccucuggaggaa

SEQ ID NO: 44955 - RNA, 22 nt, Human
agccuccggaguagcugggacc

SEQ ID NO: 44956 - RNA, 22 nt, Human
ggagggagaggaggggagccaa

SEQ ID NO: 44957 - RNA, 20 nt, Human
aacauauuuacuaagccaca

SEQ ID NO: 44958 - RNA, 26 nt, Human
gcugcaacuuuuuuaugucucuuaga

SEQ ID NO: 44959 - RNA, 27 nt, Human
cccugcacuuuccuccaccucccaccc

SEQ ID NO: 44960 - RNA, 21 nt, Human
ggaaguggagguugcagugag

SEQ ID NO: 44961 - RNA, 27 nt, Human
cgcggacaccagccuugcagagcccag

SEQ ID NO: 44962 - RNA, 25 nt, Human
uuguccacauucgucacagauauag

SEQ ID NO: 44963 - RNA, 27 nt, Human
aauuuaauguauuaaucuguuugugca

SEQ ID NO: 44964 - RNA, 22 nt, Human
uucacucagagaagcaaggcug

SEQ ID NO: 44965 - RNA, 23 nt, Human
aggcggugggcacccacccuggg

SEQ ID NO: 44966 - RNA, 22 nt, Human
acccaggcugcaguguaguggu

SEQ ID NO: 44967 - RNA, 23 nt, Human
ucagaucugucuugaugugucau

SEQ ID NO: 44968 - RNA, 22 nt, Human
gaaaggcugggaucauauguau

SEQ ID NO: 44969 - RNA, 21 nt, Human
gauuauaaauaaaucacugga

SEQ ID NO: 44970 - RNA, 20 nt, Human
ccaucccuucacuucugcau

SEQ ID NO: 44971 - RNA, 24 nt, Human
caccugaggucaggaguuuaagac

SEQ ID NO: 44972 - RNA, 25 nt, Human
agccgcauccaugcuucuggcgcgg

SEQ ID NO: 44973 - RNA, 22 nt, Human
ccaaguagcugggguuacaggc

SEQ ID NO: 44974 - RNA, 23 nt, Human
gcauucuguaguuucuuccuuuc

SEQ ID NO: 44975 - RNA, 21 nt, Human
gaggagugaaccccaaaggug

SEQ ID NO: 44976 - RNA, 22 nt, Human
uugagauuuaaaauuuguaaca

SEQ ID NO: 44977 - RNA, 20 nt, Human
ucacccaagcacacucacuu

SEQ ID NO: 44978 - RNA, 22 nt, Human
ucucuuucugacuccugccugu

SEQ ID NO: 44979 - RNA, 21 nt, Human
gugguggaaggagcacugggc

SEQ ID NO: 44980 - RNA, 23 nt, Human
uuccaaauuaaaacaaauauaca

SEQ ID NO: 44981 - RNA, 20 nt, Human
uacagcuuggcuucucagcu

SEQ ID NO: 44982 - RNA, 19 nt, Human
gcccagacacagacuggca

SEQ ID NO: 44983 - RNA, 20 nt, Human
uguugggaaaggaguacgug

SEQ ID NO: 44984 - RNA, 25 nt, Human
caggcagcagcuagcgaggcggucu

SEQ ID NO: 44985 - RNA, 31 nt, Human
gggcuccacuccacagccaaggguaagaauu

SEQ ID NO: 44986 - RNA, 27 nt, Human
gacuauacauuugcuacuggugauuca

SEQ ID NO: 44987 - RNA, 27 nt, Human
ucccaaaccucacguccuuaacugugc

SEQ ID NO: 44988 - RNA, 21 nt, Human
gucagcgagaaggaguguaug

SEQ ID NO: 44989 - RNA, 27 nt, Human
caggcugcagugcaguggcaugaucuu

SEQ ID NO: 44990 - RNA, 21 nt, Human
uucucagaauccaaagaucac

SEQ ID NO: 44991 - RNA, 23 nt, Human
cauucugucucccccaaaaaaga

SEQ ID NO: 44992 - RNA, 20 nt, Human
ucauagugauagagugcagu

SEQ ID NO: 44993 - RNA, 20 nt, Human
aaccuccucuggucuuccca

SEQ ID NO: 44994 - RNA, 21 nt, Human
auguguggcccugucugcuua

SEQ ID NO: 44995 - RNA, 26 nt, Human
caggucacuacacgggugcagaauca

SEQ ID NO: 44996 - RNA, 25 nt, Human
ccuguuugcuaauuuaaaaauauuu

SEQ ID NO: 44997 - RNA, 20 nt, Human
uuagugacuaucacagccga

SEQ ID NO: 44998 - RNA, 24 nt, Human
gcacagcccuugucggugccccgg

SEQ ID NO: 44999 - RNA, 20 nt, Human
ugccuucaugauguaacaga

SEQ ID NO: 45000 - RNA, 24 nt, Human
uucccuagcacacuggccuugcca

SEQ ID NO: 45001 - RNA, 21 nt, Human
cagacuccaagggcugcccug

SEQ ID NO: 45002 - RNA, 20 nt, Human
ccuaccaccuggugcccuca

SEQ ID NO: 45003 - RNA, 23 nt, Human
uggugugcaccugagaaucccag

SEQ ID NO: 45004 - RNA, 22 nt, Human
cugcacccaggaggggaacacu

SEQ ID NO: 45005 - RNA, 27 nt, Human
gggagagaagggaggaggugggcacag

SEQ ID NO: 45006 - RNA, 22 nt, Human
ccuccaggagucgcuguguugg

SEQ ID NO: 45007 - RNA, 22 nt, Human
acugcaagcucggccuccuggg

SEQ ID NO: 45008 - RNA, 28 nt, Human
gccacuaauucauucacacuaaggugua

SEQ ID NO: 45009 - RNA, 21 nt, Human
gagcuaggguggggggcgagg

SEQ ID NO: 45010 - RNA, 21 nt, Human
gugcugugggaugacagcggg

SEQ ID NO: 45011 - RNA, 24 nt, Human
gccaggcuggagugcaguggcgca

SEQ ID NO: 45012 - RNA, 27 nt, Human
agggccccugccugcagguuagaaaga

SEQ ID NO: 45013 - RNA, 22 nt, Human
aguguucuaaaaccuggcuaaa

SEQ ID NO: 45014 - RNA, 26 nt, Human
ugcgugagaaaggggaggagaguggu

SEQ ID NO: 45015 - RNA, 21 nt, Human
gacuacaguuguguuagccuc

SEQ ID NO: 45016 - RNA, 20 nt, Human
cgugaaauacauuuuguugu

SEQ ID NO: 45017 - RNA, 26 nt, Human
cucugaugugcuaugcuuagcuaucu

SEQ ID NO: 45018 - RNA, 21 nt, Human
cacggacagcuuucccccuuc

SEQ ID NO: 45019 - RNA, 22 nt, Human
cugugaagccaaacaauaugcu

SEQ ID NO: 45020 - RNA, 21 nt, Human
uuguuccccucccugugucca

SEQ ID NO: 45021 - RNA, 23 nt, Human
cauaaagagaguaaagauaagag

SEQ ID NO: 45022 - RNA, 20 nt, Human
ccaguccuucacacucacac

SEQ ID NO: 45023 - RNA, 25 nt, Human
uggaacuucccccucaccgccagac

SEQ ID NO: 45024 - RNA, 21 nt, Human
agugcucugcccuaccuaccu

SEQ ID NO: 45025 - RNA, 23 nt, Human
ccucgcccuggcccuggcugggc

SEQ ID NO: 45026 - RNA, 21 nt, Human
cuuuaaaauauuggguuguuu

SEQ ID NO: 45027 - RNA, 24 nt, Human
gcucuguguccuccguucauucca

SEQ ID NO: 45028 - RNA, 21 nt, Human
aagaacauacaugauacauuu

SEQ ID NO: 45029 - RNA, 21 nt, Human
gcaaaacuaccccacaccccu

SEQ ID NO: 45030 - RNA, 24 nt, Human
aaaaauuaaauauuuuguguucaa

SEQ ID NO: 45031 - RNA, 18 nt, Human
guuuaggcuggaaauggu

SEQ ID NO: 45032 - RNA, 25 nt, Human
auauuccagaagaacaacuuuagca

SEQ ID NO: 45033 - RNA, 29 nt, Human
caguuuugcacagugaucuuccccauugu

SEQ ID NO: 45034 - RNA, 26 nt, Human
ucagugcuuccaguagauuuuagaac

SEQ ID NO: 45035 - RNA, 22 nt, Human
uauuucuuuuaaugacuccagu

SEQ ID NO: 45036 - RNA, 25 nt, Human
cgagagaagggaauagggaagacag

SEQ ID NO: 45037 - RNA, 24 nt, Human
uucuccucugcuccaacagacacc

SEQ ID NO: 45038 - RNA, 21 nt, Human
cagucgcccaggcuggagugc

SEQ ID NO: 45039 - RNA, 22 nt, Human
gcagcccagcgccaggccagag

SEQ ID NO: 45040 - RNA, 22 nt, Human
cuucagcauuaagauccaggug

SEQ ID NO: 45041 - RNA, 23 nt, Human
uggacagcuacggcgccgaaaga

SEQ ID NO: 45042 - RNA, 21 nt, Human
ggugagccaccgcacccaguc

SEQ ID NO: 45043 - RNA, 22 nt, Human
ccaacagguugcuuacagcuuu

SEQ ID NO: 45044 - RNA, 22 nt, Human
guugcccaggcuggagugcaac

SEQ ID NO: 45045 - RNA, 22 nt, Human
gagaagcagacagaugcaaaga

SEQ ID NO: 45046 - RNA, 20 nt, Human
acuggaauggagauguagca

SEQ ID NO: 45047 - RNA, 21 nt, Human
uacuuugcugaauucucugaa

SEQ ID NO: 45048 - RNA, 26 nt, Human
aucugguuuguagaugugcuugggga

SEQ ID NO: 45049 - RNA, 18 nt, Human
cgggagguugaugcagga

SEQ ID NO: 45050 - RNA, 21 nt, Human
cuuuuccucuguuuuguguuu

SEQ ID NO: 45051 - RNA, 19 nt, Human
aaccaaaaaaugaaccccu

SEQ ID NO: 45052 - RNA, 19 nt, Human
accucccaggggacuguuc

SEQ ID NO: 45053 - RNA, 21 nt, Human
auuauccaggcugagauggaa

SEQ ID NO: 45054 - RNA, 24 nt, Human
cacucccuguuuuaauucaaccca

SEQ ID NO: 45055 - RNA, 18 nt, Human
gcgaggaucuccaggcag

SEQ ID NO: 45056 - RNA, 26 nt, Human
uccagggccugacacggggugugugc

SEQ ID NO: 45057 - RNA, 25 nt, Human
gcuccagggccugggccacuuccuu

SEQ ID NO: 45058 - RNA, 20 nt, Human
cugagugcuucauuugucuu

SEQ ID NO: 45059 - RNA, 19 nt, Human
ugaggcugcagugagccau

SEQ ID NO: 45060 - RNA, 21 nt, Human
uaccuuuuaacaccugaugug

SEQ ID NO: 45061 - RNA, 20 nt, Human
agguuggauggaugggugga

SEQ ID NO: 45062 - RNA, 30 nt, Human
ggcugccuuugcuuaagccaucuuuguggu

SEQ ID NO: 45063 - RNA, 21 nt, Human
cagucuccaaaugacagcugc

SEQ ID NO: 45064 - RNA, 21 nt, Human
augccaagugccugcuuagua

SEQ ID NO: 45065 - RNA, 21 nt, Human
ggaggugggagaggauggggc

SEQ ID NO: 45066 - RNA, 21 nt, Human
uuguugcccaggcuggugugc

SEQ ID NO: 45067 - RNA, 21 nt, Human
cuguugcccaggcuggcgugc

SEQ ID NO: 45068 - RNA, 22 nt, Human
gcucugacuucugcucuggacc

SEQ ID NO: 45069 - RNA, 27 nt, Human
aaucugcuugaauauuuuuauauuuca

SEQ ID NO: 45070 - RNA, 20 nt, Human
cuggaccaguguuaguuaua

SEQ ID NO: 45071 - RNA, 27 nt, Human
gaagcagcuccaacuggggugauuaaa

SEQ ID NO: 45072 - RNA, 20 nt, Human
ggccuuugaacaacuggggg

SEQ ID NO: 45073 - RNA, 23 nt, Human
cccuguuugccuuuccuuugcca

SEQ ID NO: 45074 - RNA, 26 nt, Human
gggggcuguggcccugcccuuggcac

SEQ ID NO: 45075 - RNA, 21 nt, Human
acccuuggagcuaaaugcguu

SEQ ID NO: 45076 - RNA, 23 nt, Human
auauaauaugcacacagugcuuu

SEQ ID NO: 45077 - RNA, 27 nt, Human
augagacagacuugugguucuucaaca

SEQ ID NO: 45078 - RNA, 24 nt, Human
uacuuaaguagccuggagguaggu

SEQ ID NO: 45079 - RNA, 27 nt, Human
aaaacauuugaauagguuuagaauagc

SEQ ID NO: 45080 - RNA, 27 nt, Human
caggcuggagugcagugggugaucuug

SEQ ID NO: 45081 - RNA, 25 nt, Human
uucuccuccuucauccuguaaaggu

SEQ ID NO: 45082 - RNA, 27 nt, Human
ggguuacaccuguagccacuugacacu

SEQ ID NO: 45083 - RNA, 23 nt, Human
ucacuguguccagcugggcccag

SEQ ID NO: 45084 - RNA, 22 nt, Human
gcccuacuuuuguucuucuaua

SEQ ID NO: 45085 - RNA, 21 nt, Human
ucaucccacacaccucucuac

SEQ ID NO: 45086 - RNA, 22 nt, Human
cccucucugugaaacauuauuu

SEQ ID NO: 45087 - RNA, 24 nt, Human
gcaacuugcuucauuucuuuuuca

SEQ ID NO: 45088 - RNA, 29 nt, Human
gagguccagcccuggcugaaggacuguga

SEQ ID NO: 45089 - RNA, 23 nt, Human
gcaccacucaaacucaaacucag

SEQ ID NO: 45090 - RNA, 19 nt, Human
uuggcugcugcccgcucuc

SEQ ID NO: 45091 - RNA, 22 nt, Human
acugaaagcuccgccucccggg

SEQ ID NO: 45092 - RNA, 17 nt, Human
ucauuuauaaagccacu

SEQ ID NO: 45093 - RNA, 20 nt, Human
ugcuaguaaucagcacucuu

SEQ ID NO: 45094 - RNA, 26 nt, Human
ggaucacccucuucgucgcuucggcc

SEQ ID NO: 45095 - RNA, 22 nt, Human
cuugacugacaaaaugaucuga

SEQ ID NO: 45096 - RNA, 20 nt, Human
uuuucauuuacucuggacug

SEQ ID NO: 45097 - RNA, 21 nt, Human
ugucauucaagucccuuuaca

SEQ ID NO: 45098 - RNA, 23 nt, Human
cauuguguaugauuuugaugcac

SEQ ID NO: 45099 - RNA, 23 nt, Human
gugugagccaccgugcccaggcc

SEQ ID NO: 45100 - RNA, 26 nt, Human
uuguucugcugguguccuuccuuggc

SEQ ID NO: 45101 - RNA, 22 nt, Human
gaucugagcagcugggcagcag

SEQ ID NO: 45102 - RNA, 27 nt, Human
gggccucugugucacccacuccugggu

SEQ ID NO: 45103 - RNA, 28 nt, Human
aaggcccccagagggaggucaccugggg

SEQ ID NO: 45104 - RNA, 19 nt, Human
aagagaagcacgcccaggg

SEQ ID NO: 45105 - RNA, 22 nt, Human
ugucacugcauccauugccacc

SEQ ID NO: 45106 - RNA, 24 nt, Human
aguguccccagacccuucuugccu

SEQ ID NO: 45107 - RNA, 20 nt, Human
ccuuuauccccuccuuuacc

SEQ ID NO: 45108 - RNA, 20 nt, Human
auccagugucucacagcccu

SEQ ID NO: 45109 - RNA, 21 nt, Human
auuuuguuuuuauugcaccug

SEQ ID NO: 45110 - RNA, 24 nt, Human
cauuacuuuaugaacacagguguc

SEQ ID NO: 45111 - RNA, 23 nt, Human
ggccuucagaauuaauggccagc

SEQ ID NO: 45112 - RNA, 27 nt, Human
ggggaaacugcaggucaagggcugaua

SEQ ID NO: 45113 - RNA, 26 nt, Human
cuaacgauuggaaacuacauuuacaa

SEQ ID NO: 45114 - RNA, 25 nt, Human
gugucucucgcuauuucugcugcug

SEQ ID NO: 45115 - RNA, 19 nt, Human
ucuagggugaaccaagcua

SEQ ID NO: 45116 - RNA, 27 nt, Human
ugaggccagacucauguccagcaagga

SEQ ID NO: 45117 - RNA, 26 nt, Human
cuacuuccugugccccgcccggcccc

SEQ ID NO: 45118 - RNA, 25 nt, Human
uuccugaaucuccccuucuuuguga

SEQ ID NO: 45119 - RNA, 20 nt, Human
cacacagacuccuacuccau

SEQ ID NO: 45120 - RNA, 19 nt, Human
ucagcuggaagucagucua

SEQ ID NO: 45121 - RNA, 23 nt, Human
auacauauauacauuuugcagcu

SEQ ID NO: 45122 - RNA, 18 nt, Human
acugaaagcucugccuuc

SEQ ID NO: 45123 - RNA, 26 nt, Human
cucuuccugccccguucagcuucacu

SEQ ID NO: 45124 - RNA, 27 nt, Human
aggccaucaaggaguauauggacacua

SEQ ID NO: 45125 - RNA, 26 nt, Human
ggccuggaaacgagagucuuaauuga

SEQ ID NO: 45126 - RNA, 26 nt, Human
acuggugccucgccgccuccucucgg

SEQ ID NO: 45127 - RNA, 23 nt, Human
uagaagcggcgggccaccaggcu

SEQ ID NO: 45128 - RNA, 27 nt, Human
cugugugaccagcggaaacaggugugu

SEQ ID NO: 45129 - RNA, 21 nt, Human
gagcacguauuuugcaaaagc

SEQ ID NO: 45130 - RNA, 20 nt, Human
uugggaguggcaggagaagu

SEQ ID NO: 45131 - RNA, 27 nt, Human
auauccuaccagcugcucuucagacac

SEQ ID NO: 45132 - RNA, 26 nt, Human
uugcccaggguccugugccuggaugg

SEQ ID NO: 45133 - RNA, 22 nt, Human
auuugaaaauagcaguguguuc

SEQ ID NO: 45134 - RNA, 24 nt, Human
uuggcuucauuucaaucauugaag

SEQ ID NO: 45135 - RNA, 27 nt, Human
gccuauuccgaaaacaucacuggcgug

SEQ ID NO: 45136 - RNA, 24 nt, Human
caggaaggcagggcgcagugguug

SEQ ID NO: 45137 - RNA, 23 nt, Human
agguaauccuugauggcuggauc

SEQ ID NO: 45138 - RNA, 22 nt, Human
agcugccugccagcugcccuuc

SEQ ID NO: 45139 - RNA, 21 nt, Human
cuucagaucugcuccuggguu

SEQ ID NO: 45140 - RNA, 27 nt, Human
gcaccuugaaaaucugcccuaaaacag

SEQ ID NO: 45141 - RNA, 27 nt, Human
gacuguacuguacaccuucuugcaccu

SEQ ID NO: 45142 - RNA, 19 nt, Human
ggggguggggaccacgggc

SEQ ID NO: 45143 - RNA, 25 nt, Human
cuggccucuagaacacccacuggcc

SEQ ID NO: 45144 - RNA, 25 nt, Human
aacuagccagccacugagaccuucu

SEQ ID NO: 45145 - RNA, 23 nt, Human
uuugucugacuucuacucuguca

SEQ ID NO: 45146 - RNA, 29 nt, Human
agggauaagaacagaggaggcagcagcau

SEQ ID NO: 45147 - RNA, 21 nt, Human
gcucacugcaaccuccgcauc

SEQ ID NO: 45148 - RNA, 21 nt, Human
gcucacugcacccuccgccuc

SEQ ID NO: 45149 - RNA, 22 nt, Human
uguuggccaggcuggagugcag

SEQ ID NO: 45150 - RNA, 27 nt, Human
cugcccccgacaggcuggcucucagug

SEQ ID NO: 45151 - RNA, 22 nt, Human
agccuugacugacucaaagcaa

SEQ ID NO: 45152 - RNA, 22 nt, Human
cauggaggcagcuguggcggug

SEQ ID NO: 45153 - RNA, 24 nt, Human
aaauguucucauuccaugacacuu

SEQ ID NO: 45154 - RNA, 21 nt, Human
gcugcuacuggagccugcgug

SEQ ID NO: 45155 - RNA, 27 nt, Human
cccugggauguugggcuuccucucuca

SEQ ID NO: 45156 - RNA, 20 nt, Human
cuguuugcugaagacuucga

SEQ ID NO: 45157 - RNA, 21 nt, Human
uuccaguuuuauucuuguuga

SEQ ID NO: 45158 - RNA, 28 nt, Human
cacugcagucuccagccugagccauggg

SEQ ID NO: 45159 - RNA, 21 nt, Human
cauggacuggggacuucucag

SEQ ID NO: 45160 - RNA, 22 nt, Human
gcaaggacaucauauguuucua

SEQ ID NO: 45161 - RNA, 24 nt, Human
uccacaaagugcugggauuacagg

SEQ ID NO: 45162 - RNA, 22 nt, Human
aucucacauuuuuauaccuguu

SEQ ID NO: 45163 - RNA, 21 nt, Human
uaguguaaugcccugcuuuau

SEQ ID NO: 45164 - RNA, 23 nt, Human
gacccugucucaaaaaagaaaga

SEQ ID NO: 45165 - RNA, 24 nt, Human
ccucagaguuccuguaucagggag

SEQ ID NO: 45166 - RNA, 24 nt, Human
uucacaauaacuuaccuaguagag

SEQ ID NO: 45167 - RNA, 26 nt, Human
cuuccaagccuuuugcuccagcccug

SEQ ID NO: 45168 - RNA, 30 nt, Human
cccugccugccuccccaacaccguggaauc

SEQ ID NO: 45169 - RNA, 27 nt, Human
ccugccugccugucucuaguuucucuc

SEQ ID NO: 45170 - RNA, 19 nt, Human
gucugcccuccugcuccag

SEQ ID NO: 45171 - RNA, 19 nt, Human
ccggaucgaugugcugcug

SEQ ID NO: 45172 - RNA, 20 nt, Human
ugccacccucuccgcuugcc

SEQ ID NO: 45173 - RNA, 24 nt, Human
agacaaugccuucuccauuacuug

SEQ ID NO: 45174 - RNA, 26 nt, Human
acuaauuuacuaggcuaccuacuuuc

SEQ ID NO: 45175 - RNA, 27 nt, Human
uaggcuggagugcagcggcaugacugc

SEQ ID NO: 45176 - RNA, 23 nt, Human
ggcuucaaaccaauacugccuuu

SEQ ID NO: 45177 - RNA, 21 nt, Human
cuguuucuucccauacugcau

SEQ ID NO: 45178 - RNA, 22 nt, Human
cugcuggcccugacucugcagc

SEQ ID NO: 45179 - RNA, 22 nt, Human
aggcucucuugugagcucuugg

SEQ ID NO: 45180 - RNA, 24 nt, Human
ucuaucauauuuacuaauguucca

SEQ ID NO: 45181 - RNA, 27 nt, Human
gggagagaugaguggguuagcuaccug

SEQ ID NO: 45182 - RNA, 21 nt, Human
agggucucgcucugucacaca

SEQ ID NO: 45183 - RNA, 26 nt, Human
caguaauauuuuuugguccacuguau

SEQ ID NO: 45184 - RNA, 23 nt, Human
gagagugagccaggaacagcaag

SEQ ID NO: 45185 - RNA, 21 nt, Human
ccucugugcuaucaaucaucu

SEQ ID NO: 45186 - RNA, 27 nt, Human
caaccaaaaacaagguagccagugcaa

SEQ ID NO: 45187 - RNA, 21 nt, Human
gcccccuuccccuccugaccc

SEQ ID NO: 45188 - RNA, 22 nt, Human
cccuccagugccucccggcugc

SEQ ID NO: 45189 - RNA, 23 nt, Human
ccucgggcugaccccaccuccuc

SEQ ID NO: 45190 - RNA, 24 nt, Human
acucagucugauaaucugccucca

SEQ ID NO: 45191 - RNA, 25 nt, Human
accuucaacuguuggcacagcugug

SEQ ID NO: 45192 - RNA, 23 nt, Human
gcuucccucuuccuacugcagca

SEQ ID NO: 45193 - RNA, 22 nt, Human
ggcuaauuuuuauauuuuuagu

SEQ ID NO: 45194 - RNA, 22 nt, Human
ggcuaauuuuuguauuuuuggu

SEQ ID NO: 45195 - RNA, 26 nt, Human
ccugcuccuuccugucccuuuaccgg

SEQ ID NO: 45196 - RNA, 22 nt, Human
cugcuucucuuccaggcuuugc

SEQ ID NO: 45197 - RNA, 22 nt, Human
caggguggggggacagaggggc

SEQ ID NO: 45198 - RNA, 23 nt, Human
gcuagauuuagcacaguauuuug

SEQ ID NO: 45199 - RNA, 23 nt, Human
ugaaacucaugaaaaacccagac

SEQ ID NO: 45200 - RNA, 27 nt, Human
agcucacuggccacguuugccggagcu

SEQ ID NO: 45201 - RNA, 23 nt, Human
uuuucacugcuaggacaagcuca

SEQ ID NO: 45202 - RNA, 21 nt, Human
ugggacccagcuccaucagac

SEQ ID NO: 45203 - RNA, 25 nt, Human
cagcaguuuccugccagauauugcc

SEQ ID NO: 45204 - RNA, 21 nt, Human
agaaauuuagaguuuccaaau

SEQ ID NO: 45205 - RNA, 25 nt, Human
ccuguucucugccgucuuuggcuca

SEQ ID NO: 45206 - RNA, 21 nt, Human
gauaaguuauugaacccuuug

SEQ ID NO: 45207 - RNA, 26 nt, Human
ucaggccaccuccaaaccccaccuag

SEQ ID NO: 45208 - RNA, 22 nt, Human
ugugaugcgaucucggcucucu

SEQ ID NO: 45209 - RNA, 21 nt, Human
aucagacuuugagugacauca

SEQ ID NO: 45210 - RNA, 19 nt, Human
gauugcaggcgugagccac

SEQ ID NO: 45211 - RNA, 19 nt, Human
gauuacaggcguaagccac

SEQ ID NO: 45212 - RNA, 26 nt, Human
ugggaaagacugauguugauuuggaa

SEQ ID NO: 45213 - RNA, 21 nt, Human
ccuuccucugcuggucuuguu

SEQ ID NO: 45214 - RNA, 24 nt, Human
gguggagggugcagaggggcuggg

SEQ ID NO: 45215 - RNA, 23 nt, Human
uaucacuaugcauuucuacacau

SEQ ID NO: 45216 - RNA, 22 nt, Human
ccccaaaaugugaugcuuauaa

SEQ ID NO: 45217 - RNA, 21 nt, Human
gcuuauccccucucaucuucc

SEQ ID NO: 45218 - RNA, 24 nt, Human
gaacaucugcacuccugaacacac

SEQ ID NO: 45219 - RNA, 25 nt, Human
ccuccauccguaccuugccuagccu

SEQ ID NO: 45220 - RNA, 21 nt, Human
cauaguggaagaggagagcau

SEQ ID NO: 45221 - RNA, 24 nt, Human
uaaaggaguaagaaccuugccuga

SEQ ID NO: 45222 - RNA, 20 nt, Human
gaaucccggaggcagaggcc

SEQ ID NO: 45223 - RNA, 22 nt, Human
gccuggagcaagcccuggucaa

SEQ ID NO: 45224 - RNA, 22 nt, Human
gugucugcuccuagccaagauc

SEQ ID NO: 45225 - RNA, 18 nt, Human
ccaccagcaccaccaaga

SEQ ID NO: 45226 - RNA, 21 nt, Human
ccaguaggaggcugggccugg

SEQ ID NO: 45227 - RNA, 21 nt, Human
aaggaaacaacaaaggaagug

SEQ ID NO: 45228 - RNA, 20 nt, Human
agaaucauaugauucugcuu

SEQ ID NO: 45229 - RNA, 25 nt, Human
uggcacaaagcaugaagaaacccca

SEQ ID NO: 45230 - RNA, 26 nt, Human
aaacagcaauuaaaguuuuucuucca

SEQ ID NO: 45231 - RNA, 26 nt, Human
aggaagaggaugucugagcuggagaa

SEQ ID NO: 45232 - RNA, 27 nt, Human
gcagagauguuuuaacauuauauuuug

SEQ ID NO: 45233 - RNA, 28 nt, Human
acucaagcugcaguauacagcgggaaaa

SEQ ID NO: 45234 - RNA, 29 nt, Human
ccaggagggacccaggaaacuaagauuug

SEQ ID NO: 45235 - RNA, 21 nt, Human
ucuuucucucaaugaagagca

SEQ ID NO: 45236 - RNA, 27 nt, Human
gggagagagaaaggguggccacuuucc

SEQ ID NO: 45237 - RNA, 27 nt, Human
ucauucuacuaaugugaugcuuucauu

SEQ ID NO: 45238 - RNA, 22 nt, Human
ucaagcauccaucugacuaagg

SEQ ID NO: 45239 - RNA, 21 nt, Human
guggaaguggagcccagugag

SEQ ID NO: 45240 - RNA, 20 nt, Human
ccaagaguaucccaguauua

SEQ ID NO: 45241 - RNA, 22 nt, Human
gggcuggagaacaguggcacca

SEQ ID NO: 45242 - RNA, 22 nt, Human
cuuuguguccuuguucauuuau

SEQ ID NO: 45243 - RNA, 23 nt, Human
ccccagccugggccuauggagag

SEQ ID NO: 45244 - RNA, 22 nt, Human
cguccguucgcacaggcagcgg

SEQ ID NO: 45245 - RNA, 23 nt, Human
gccuguaaugccagcuacucggg

SEQ ID NO: 45246 - RNA, 19 nt, Human
cugaggucacagggccugg

SEQ ID NO: 45247 - RNA, 21 nt, Human
uguggagggaacacuggguau

SEQ ID NO: 45248 - RNA, 23 nt, Human
cuguugccaggcuggagugcagu

SEQ ID NO: 45249 - RNA, 26 nt, Human
gucagccuguggauuugauacgacuu

SEQ ID NO: 45250 - RNA, 28 nt, Human
gcagcagcuguguuucugcaccauuucc

SEQ ID NO: 45251 - RNA, 22 nt, Human
cccaaguaacugggauuacagg

SEQ ID NO: 45252 - RNA, 23 nt, Human
gaacagcuuccucucacugaacg

SEQ ID NO: 45253 - RNA, 28 nt, Human
uccaguuuaguuugcugcuauuagcaga

SEQ ID NO: 45254 - RNA, 22 nt, Human
ccgcacccucuccgcucgcgcc

SEQ ID NO: 45255 - RNA, 22 nt, Human
acccaaagguggcccgaggcag

SEQ ID NO: 45256 - RNA, 21 nt, Human
uccaggccccucccucuccag

SEQ ID NO: 45257 - RNA, 21 nt, Human
gcgcugggcgucuugggggug

SEQ ID NO: 45258 - RNA, 22 nt, Human
uacccuguaccacucuagcccu

SEQ ID NO: 45259 - RNA, 21 nt, Human
ugggaugucuaaaacaugaca

SEQ ID NO: 45260 - RNA, 24 nt, Human
ccuggcuacccccuuccauggccc

SEQ ID NO: 45261 - RNA, 28 nt, Human
caggaaagacaaaaggcguuauggaaga

SEQ ID NO: 45262 - RNA, 22 nt, Human
cuagggggacagccacuguguu

SEQ ID NO: 45263 - RNA, 23 nt, Human
cagucagcaccuaccccuucccc

SEQ ID NO: 45264 - RNA, 22 nt, Human
cuuccagugacugcucuuauuu

SEQ ID NO: 45265 - RNA, 27 nt, Human
uccuuccacuucaacacuggagaacug

SEQ ID NO: 45266 - RNA, 21 nt, Human
gcuacuuagcuggccaaggag

SEQ ID NO: 45267 - RNA, 20 nt, Human
aggaaacuuuugcagcggcu

SEQ ID NO: 45268 - RNA, 24 nt, Human
uuugcauuuguucugugacaccuu

SEQ ID NO: 45269 - RNA, 22 nt, Human
ccugcagccgugaaaggaagcu

SEQ ID NO: 45270 - RNA, 21 nt, Human
uuguggagcuguggcaagucc

SEQ ID NO: 45271 - RNA, 20 nt, Human
ccagauaaauagaacuaucu

SEQ ID NO: 45272 - RNA, 21 nt, Human
ucaagccccagccuaggaaag

SEQ ID NO: 45273 - RNA, 29 nt, Human
gugaaucaggcaccggagugcagguucgg

SEQ ID NO: 45274 - RNA, 21 nt, Human
ccguaacccccuccugccucc

SEQ ID NO: 45275 - RNA, 28 nt, Human
ucucgaacuccugaccucaugaucugcc

SEQ ID NO: 45276 - RNA, 27 nt, Human
cagccauuuaaaugaucauugcugcua

SEQ ID NO: 45277 - RNA, 25 nt, Human
cuccccgcggcgccgcaucuugaau

SEQ ID NO: 45278 - RNA, 20 nt, Human
cuuuuuacaaggcuguauuc

SEQ ID NO: 45279 - RNA, 21 nt, Human
cguagauguugccuggugcaa

SEQ ID NO: 45280 - RNA, 19 nt, Human
cacauuaugaagcugcagu

SEQ ID NO: 45281 - RNA, 27 nt, Human
ccuguucuggacuguguucugggccug

SEQ ID NO: 45282 - RNA, 19 nt, Human
gugagcuucagauggugaa

SEQ ID NO: 45283 - RNA, 21 nt, Human
gugauucucgugccucagccu

SEQ ID NO: 45284 - RNA, 23 nt, Human
ccuuagaccuuccauaaugcuac

SEQ ID NO: 45285 - RNA, 23 nt, Human
gcaucuuuaugaaacaggcacag

SEQ ID NO: 45286 - RNA, 24 nt, Human
cuuuuagcugcucgcaugcuuguc

SEQ ID NO: 45287 - RNA, 24 nt, Human
aggacuucccccaccccagaagau

SEQ ID NO: 45288 - RNA, 23 nt, Human
guggacuguuuucuuucuucuca

SEQ ID NO: 45289 - RNA, 21 nt, Human
uacauaguguuucaagugcau

SEQ ID NO: 45290 - RNA, 22 nt, Human
caccugccacugggcccacagc

SEQ ID NO: 45291 - RNA, 28 nt, Human
ugguuggugaaagcaguggugccggagu

SEQ ID NO: 45292 - RNA, 19 nt, Human
uggaagauauauaaagcaa

SEQ ID NO: 45293 - RNA, 26 nt, Human
gcggugccacccaaucaugcccagcu

SEQ ID NO: 45294 - RNA, 23 nt, Human
acagagcagaggggacgcagaca

SEQ ID NO: 45295 - RNA, 22 nt, Human
gugccuggccuucggcuccugc

SEQ ID NO: 45296 - RNA, 22 nt, Human
cuccuucuguucaaaggccuca

SEQ ID NO: 45297 - RNA, 22 nt, Human
uacacuugaggguaaauuaaau

SEQ ID NO: 45298 - RNA, 20 nt, Human
cagacuucauagaauacuca

SEQ ID NO: 45299 - RNA, 21 nt, Human
cgucccccuccugccucaucu

SEQ ID NO: 45300 - RNA, 23 nt, Human
ggaaagacagagguuacagagga

SEQ ID NO: 45301 - RNA, 22 nt, Human
gguggaggguagcccuggggcc

SEQ ID NO: 45302 - RNA, 23 nt, Human
gcugaaguuaacaaaugcaccug

SEQ ID NO: 45303 - RNA, 25 nt, Human
aggaaggagcccaggagcagaggaa

SEQ ID NO: 45304 - RNA, 25 nt, Human
cuuucuaacuuucuuuacuccauca

SEQ ID NO: 45305 - RNA, 23 nt, Human
uucucgcuuccuccuuugggcau

SEQ ID NO: 45306 - RNA, 22 nt, Human
uuacccaggagggacugagcac

SEQ ID NO: 45307 - RNA, 21 nt, Human
ggcccgcacaucugcgcugcc

SEQ ID NO: 45308 - RNA, 27 nt, Human
ugagaauaacuaauguggauugaaaug

SEQ ID NO: 45309 - RNA, 23 nt, Human
uggggcuaauuuaacaagaacuu

SEQ ID NO: 45310 - RNA, 23 nt, Human
accagcccucugccuccagggag

SEQ ID NO: 45311 - RNA, 25 nt, Human
acccaggcuggagugcaguggugcu

SEQ ID NO: 45312 - RNA, 21 nt, Human
guuugcaugaugucuaccuca

SEQ ID NO: 45313 - RNA, 26 nt, Human
ugauaguggucaccugugaagagugg

SEQ ID NO: 45314 - RNA, 21 nt, Human
uucaccccacucagcucaccu

SEQ ID NO: 45315 - RNA, 27 nt, Human
cccuguuggccaggcuggagugcagua

SEQ ID NO: 45316 - RNA, 21 nt, Human
agcacagaugccaucauuucc

SEQ ID NO: 45317 - RNA, 21 nt, Human
ccuguaaucccaggacuuugg

SEQ ID NO: 45318 - RNA, 26 nt, Human
cuggggcaggggggucaaggagaggg

SEQ ID NO: 45319 - RNA, 22 nt, Human
auuuacugugaaaaagcauuuu

SEQ ID NO: 45320 - RNA, 24 nt, Human
ugguggagggagccgugggcgugg

SEQ ID NO: 45321 - RNA, 22 nt, Human
gagcccaggaauuugagguugu

SEQ ID NO: 45322 - RNA, 22 nt, Human
agcucccagcuccagcuucguc

SEQ ID NO: 45323 - RNA, 25 nt, Human
uccagccuggcugccagggagggug

SEQ ID NO: 45324 - RNA, 22 nt, Human
ugggaggccucguaccagccag

SEQ ID NO: 45325 - RNA, 24 nt, Human
aaaccaauaugcuuauaagaaaua

SEQ ID NO: 45326 - RNA, 27 nt, Human
ccaagcccccagccccgaucugcagau

SEQ ID NO: 45327 - RNA, 26 nt, Human
acagaaguuccaguuacuccagaaac

SEQ ID NO: 45328 - RNA, 22 nt, Human
agacugccagggagacccuggc

SEQ ID NO: 45329 - RNA, 27 nt, Human
uguccauguacuucugcccugccuccu

SEQ ID NO: 45330 - RNA, 21 nt, Human
uucccuggccccuuguauuuu

SEQ ID NO: 45331 - RNA, 21 nt, Human
gguggaggcaacagggccaug

SEQ ID NO: 45332 - RNA, 22 nt, Human
gaacuccugggaucaagccugg

SEQ ID NO: 45333 - RNA, 21 nt, Human
gugcuuguaccucugauuuca

SEQ ID NO: 45334 - RNA, 20 nt, Human
cagaacugggaaggccaggu

SEQ ID NO: 45335 - RNA, 21 nt, Human
cuguggaccccucgucaucag

SEQ ID NO: 45336 - RNA, 26 nt, Human
cagccagcgguuuuccucucuucucu

SEQ ID NO: 45337 - RNA, 17 nt, Human
uucuauguuggucaacu

SEQ ID NO: 45338 - RNA, 22 nt, Human
ccacauccuuucagacacaucc

SEQ ID NO: 45339 - RNA, 22 nt, Human
ugcagugagcccagaucgagcc

SEQ ID NO: 45340 - RNA, 23 nt, Human
gccuguaaucccagcuacuaggg

SEQ ID NO: 45341 - RNA, 27 nt, Human
ucccugccugcugcugccccauuugau

SEQ ID NO: 45342 - RNA, 25 nt, Human
gcccuuguccccgcccuccugagcu

SEQ ID NO: 45343 - RNA, 23 nt, Human
gugagggcgacugggugggugaa

SEQ ID NO: 45344 - RNA, 21 nt, Human
gggaaaugcugaaagcaccag

SEQ ID NO: 45345 - RNA, 16 nt, Human
ccgcccacccuagcca

SEQ ID NO: 45346 - RNA, 23 nt, Human
cagcccagucccuagugcccaag

SEQ ID NO: 45347 - RNA, 27 nt, Human
acaagcagaguaacaggaucagugggu

SEQ ID NO: 45348 - RNA, 22 nt, Human
ucuuucugacauacacacugca

SEQ ID NO: 45349 - RNA, 23 nt, Human
ccaggagguugaggcugcaguga

SEQ ID NO: 45350 - RNA, 23 nt, Human
agcugcaguccccaggccaugag

SEQ ID NO: 45351 - RNA, 19 nt, Human
ccuacgcugaaauuuuggg

SEQ ID NO: 45352 - RNA, 21 nt, Human
gucuucccccaccccuaaccu

SEQ ID NO: 45353 - RNA, 24 nt, Human
caugugagaaagaaagcaggcuag

SEQ ID NO: 45354 - RNA, 21 nt, Human
guggagagugcggaaaagggg

SEQ ID NO: 45355 - RNA, 27 nt, Human
cuguggaugcagaaaucugcccuacaa

SEQ ID NO: 45356 - RNA, 21 nt, Human
cuccccagagggcacccccua

SEQ ID NO: 45357 - RNA, 24 nt, Human
gcgcuuuccccuccucccugggau

SEQ ID NO: 45358 - RNA, 20 nt, Human
uugagccucuuuucuccucu

SEQ ID NO: 45359 - RNA, 26 nt, Human
cugggugacagaacgagacuccaccu

SEQ ID NO: 45360 - RNA, 21 nt, Human
uguaauaaacuuuggauaauu

SEQ ID NO: 45361 - RNA, 26 nt, Human
acuuccugcagguaaacaguucuugu

SEQ ID NO: 45362 - RNA, 22 nt, Human
caggagacggugguugcaguga

SEQ ID NO: 45363 - RNA, 20 nt, Human
cugggaggugaagguugcug

SEQ ID NO: 45364 - RNA, 28 nt, Human
ucugaccggcaguggcucuggaagcagu

SEQ ID NO: 45365 - RNA, 23 nt, Human
ggucccccuuguaacaauaaauc

SEQ ID NO: 45366 - RNA, 22 nt, Human
uggguguggggacgcgggagcc

SEQ ID NO: 45367 - RNA, 22 nt, Human
acccaggcuggagugcaguggg

SEQ ID NO: 45368 - RNA, 20 nt, Human
ugauggucagacacaaacaa

SEQ ID NO: 45369 - RNA, 18 nt, Human
ggggcagccugugccugc

SEQ ID NO: 45370 - RNA, 20 nt, Human
ccugcagcaauucaccugcc

SEQ ID NO: 45371 - RNA, 22 nt, Human
cgugaagucaggagaucgagac

SEQ ID NO: 45372 - RNA, 22 nt, Human
uugaugaaucuggcgaggggcu

SEQ ID NO: 45373 - RNA, 27 nt, Human
gccagccugggcaacauaacaagaucc

SEQ ID NO: 45374 - RNA, 28 nt, Human
gguguacccgcuacuggugcuauccaga

SEQ ID NO: 45375 - RNA, 21 nt, Human
cugaggagaccucagccucgg

SEQ ID NO: 45376 - RNA, 26 nt, Human
cccagccuggccccaagcauggaaac

SEQ ID NO: 45377 - RNA, 24 nt, Human
aguguagacuggccaugcaagugg

SEQ ID NO: 45378 - RNA, 21 nt, Human
uuauuuuucucaugaaucugc

SEQ ID NO: 45379 - RNA, 27 nt, Human
gcguggcuggggaagcuucacaaucau

SEQ ID NO: 45380 - RNA, 23 nt, Human
gugcucugccugccagugcagug

SEQ ID NO: 45381 - RNA, 22 nt, Human
cugucucuccucggucucagcu

SEQ ID NO: 45382 - RNA, 20 nt, Human
guccaggcuggagugcagug

SEQ ID NO: 45383 - RNA, 22 nt, Human
uauguauuuuggucauauugcc

SEQ ID NO: 45384 - RNA, 26 nt, Human
ucuaaaacaugacuaucauuuccuga

SEQ ID NO: 45385 - RNA, 24 nt, Human
uccuuucaggaugauggaauuaga

SEQ ID NO: 45386 - RNA, 25 nt, Human
ucuucuucuuuuuuguucaugggac

SEQ ID NO: 45387 - RNA, 24 nt, Human
agcuggcuguguuugcagugcaaa

SEQ ID NO: 45388 - RNA, 22 nt, Human
gccuguaaucccagcuacaugg

SEQ ID NO: 45389 - RNA, 24 nt, Human
gaggaagaggguaucccuuuagga

SEQ ID NO: 45390 - RNA, 20 nt, Human
aacuugucaaauuacaauca

SEQ ID NO: 45391 - RNA, 23 nt, Human
ugcacuacccuguucuguaguua

SEQ ID NO: 45392 - RNA, 22 nt, Human
ggcaaaaugagacaaguagccu

SEQ ID NO: 45393 - RNA, 21 nt, Human
ggggugggguggggagccagg

SEQ ID NO: 45394 - RNA, 24 nt, Human
uggcucggaggcaggaagagcaga

SEQ ID NO: 45395 - RNA, 22 nt, Human
ccaacaacaacgagguuccuau

SEQ ID NO: 45396 - RNA, 20 nt, Human
agcacaggcugggguggaug

SEQ ID NO: 45397 - RNA, 23 nt, Human
cugcccaagguguguguagcaca

SEQ ID NO: 45398 - RNA, 21 nt, Human
aggucauccaaccucuuuccu

SEQ ID NO: 45399 - RNA, 26 nt, Human
uggagccaucucugcacuaacugccc

SEQ ID NO: 45400 - RNA, 22 nt, Human
cugguucucacacuguacucug

SEQ ID NO: 45401 - RNA, 20 nt, Human
uucggccacagccucagccu

SEQ ID NO: 45402 - RNA, 20 nt, Human
gcuaggaauuaugucauuug

SEQ ID NO: 45403 - RNA, 23 nt, Human
gugcugcguaucuugucucaaua

SEQ ID NO: 45404 - RNA, 21 nt, Human
ugaaauccaagucuuccucca

SEQ ID NO: 45405 - RNA, 21 nt, Human
ccucgcccugcuugcccugcc

SEQ ID NO: 45406 - RNA, 23 nt, Human
ggcucacugcaaucucugccucc

SEQ ID NO: 45407 - RNA, 20 nt, Human
gugaugcccccacagcaccu

SEQ ID NO: 45408 - RNA, 22 nt, Human
guccucucccuaucccuugcuc

SEQ ID NO: 45409 - RNA, 19 nt, Human
ggguccccucaccccgggc

SEQ ID NO: 45410 - RNA, 26 nt, Human
uugcuuguaacuuuaugaauucugga

SEQ ID NO: 45411 - RNA, 21 nt, Human
gcagugagccgagaucacgcc

SEQ ID NO: 45412 - RNA, 21 nt, Human
gcagugagccaagaucacacc

SEQ ID NO: 45413 - RNA, 21 nt, Human
cccugccuaagccucagcaga

SEQ ID NO: 45414 - RNA, 27 nt, Human
ccauggugcaacccacagcaaagcccu

SEQ ID NO: 45415 - RNA, 23 nt, Human
caggccugccuucucagggacuu

SEQ ID NO: 45416 - RNA, 23 nt, Human
ugagguuucaaacuuuccuucug

SEQ ID NO: 45417 - RNA, 19 nt, Human
guucauuuuuucucuuuac

SEQ ID NO: 45418 - RNA, 26 nt, Human
ggagguggagguugcagugaacugag

SEQ ID NO: 45419 - RNA, 20 nt, Human
uccugcgaggagcugagcca

SEQ ID NO: 45420 - RNA, 23 nt, Human
agaccugagaugcuggucaagcc

SEQ ID NO: 45421 - RNA, 22 nt, Human
aaagagacuugccuuuuaagga

SEQ ID NO: 45422 - RNA, 22 nt, Human
agacagagcgagacuccaucuc

SEQ ID NO: 45423 - RNA, 22 nt, Human
cgacagagagagacuccaucuc

SEQ ID NO: 45424 - RNA, 27 nt, Human
ugugugcugggggguucgggugcugca

SEQ ID NO: 45425 - RNA, 20 nt, Human
gaacaccuggcauccuuccc

SEQ ID NO: 45426 - RNA, 24 nt, Human
cuggaggagagucaccuccagaca

SEQ ID NO: 45427 - RNA, 23 nt, Human
ugauuuauauugauugcacuugc

SEQ ID NO: 45428 - RNA, 22 nt, Human
uucacccucaguuuccucacuu

SEQ ID NO: 45429 - RNA, 16 nt, Human
ugggaauucagaggaa

SEQ ID NO: 45430 - RNA, 24 nt, Human
agcagguugcagcuuggagcgugg

SEQ ID NO: 45431 - RNA, 21 nt, Human
cuucuucuaacuccugcuguc

SEQ ID NO: 45432 - RNA, 22 nt, Human
ucuguuucuccucgggugccag

SEQ ID NO: 45433 - RNA, 27 nt, Human
ugcagguugcagaggaagaguagauga

SEQ ID NO: 45434 - RNA, 21 nt, Human
cucuccucagcagaacauguc

SEQ ID NO: 45435 - RNA, 21 nt, Human
ggauuaggaaaguuugcugaa

SEQ ID NO: 45436 - RNA, 18 nt, Human
ugcacuccagccuaggca

SEQ ID NO: 45437 - RNA, 25 nt, Human
aaugcuugaggcuuaucaccugcca

SEQ ID NO: 45438 - RNA, 23 nt, Human
ccagccaucugcacccacuuuug

SEQ ID NO: 45439 - RNA, 20 nt, Human
uccaugugaucauucugccu

SEQ ID NO: 45440 - RNA, 27 nt, Human
agagcaucuacugggacuacaggugca

SEQ ID NO: 45441 - RNA, 22 nt, Human
ugccugggguguuaguggcacc

SEQ ID NO: 45442 - RNA, 22 nt, Human
uguuggcagacuggagugcaau

SEQ ID NO: 45443 - RNA, 22 nt, Human
ucacagacccacacacauacac

SEQ ID NO: 45444 - RNA, 23 nt, Human
cccacauccauuucaucuauuuc

SEQ ID NO: 45445 - RNA, 21 nt, Human
acauguguccaucccagcggc

SEQ ID NO: 45446 - RNA, 23 nt, Human
ugcuggaagaaacuaaaaauaua

SEQ ID NO: 45447 - RNA, 25 nt, Human
ugcccucaccaugagccucuggcag

SEQ ID NO: 45448 - RNA, 21 nt, Human
gggcaucaucuuccucaucug

SEQ ID NO: 45449 - RNA, 24 nt, Human
uuauguuauuauuacacugucuuu

SEQ ID NO: 45450 - RNA, 21 nt, Human
uacucacuguacuuguauuug

SEQ ID NO: 45451 - RNA, 26 nt, Human
ucuugucgcucagccuggagugcagu

SEQ ID NO: 45452 - RNA, 23 nt, Human
guaaggagacuugaaauucagaa

SEQ ID NO: 45453 - RNA, 21 nt, Human
ugggaagugaggggacgaagc

SEQ ID NO: 45454 - RNA, 22 nt, Human
auuaaaaaacacagcaguuuuc

SEQ ID NO: 45455 - RNA, 20 nt, Human
uaaaaugauaacuuaccuua

SEQ ID NO: 45456 - RNA, 19 nt, Human
cuaaaacuugaggcagagu

SEQ ID NO: 45457 - RNA, 25 nt, Human
ucugccugcugcccccucucuccuc

SEQ ID NO: 45458 - RNA, 21 nt, Human
ccgugcucuccagccuggcug

SEQ ID NO: 45459 - RNA, 22 nt, Human
caguuaaucuugcuuucuuugu

SEQ ID NO: 45460 - RNA, 21 nt, Human
uucaucugccuuucauccugc

SEQ ID NO: 45461 - RNA, 25 nt, Human
cccacccccacauuggagcccuccu

SEQ ID NO: 45462 - RNA, 27 nt, Human
cccuccagaggcugagaauugcuugaa

SEQ ID NO: 45463 - RNA, 23 nt, Human
guuaucugcaagugagguguguc

SEQ ID NO: 45464 - RNA, 22 nt, Human
ccaccgcaccuggccuucccca

SEQ ID NO: 45465 - RNA, 22 nt, Human
ugcagugagccaagaucacguc

SEQ ID NO: 45466 - RNA, 25 nt, Human
ggggcuucuggaggagaggaugaga

SEQ ID NO: 45467 - RNA, 24 nt, Human
uauuuccacagauuucucccaagg

SEQ ID NO: 45468 - RNA, 27 nt, Human
ugagugugugcucugugucacugugga

SEQ ID NO: 45469 - RNA, 25 nt, Human
auguuuuguccuucaccugaauuac

SEQ ID NO: 45470 - RNA, 21 nt, Human
cgcacagacccaggauuaucu

SEQ ID NO: 45471 - RNA, 22 nt, Human
ucaugacacugcacuccagccu

SEQ ID NO: 45472 - RNA, 24 nt, Human
gaagaggcagaaaggcuguggaaa

SEQ ID NO: 45473 - RNA, 23 nt, Human
uucaaguaauuuauuuugcuacc

SEQ ID NO: 45474 - RNA, 21 nt, Human
guuuaaauaaaguaucaugca

SEQ ID NO: 45475 - RNA, 27 nt, Human
auuucaggaagacuggcaggagauuua

SEQ ID NO: 45476 - RNA, 25 nt, Human
ggggcagcaggggguguguuugugg

SEQ ID NO: 45477 - RNA, 24 nt, Human
auuucauuccaggcccucagucuu

SEQ ID NO: 45478 - RNA, 26 nt, Human
uugaauaguauuguguuccuauauuc

SEQ ID NO: 45479 - RNA, 23 nt, Human
auuaauuucuugccuccaguguu

SEQ ID NO: 45480 - RNA, 23 nt, Human
ggcccagccacuuccagcuuuug

SEQ ID NO: 45481 - RNA, 21 nt, Human
aagccuugguuuaacugaggu

SEQ ID NO: 45482 - RNA, 26 nt, Human
cuguagcucuaaaaucugcuuguauc

SEQ ID NO: 45483 - RNA, 22 nt, Human
ggccuccucuucaccccggcag

SEQ ID NO: 45484 - RNA, 18 nt, Human
gguauuuagaaaauaaau

SEQ ID NO: 45485 - RNA, 22 nt, Human
uguugcucaggcuggaguacag

SEQ ID NO: 45486 - RNA, 21 nt, Human
aaaaaaucuccuacaugugaa

SEQ ID NO: 45487 - RNA, 21 nt, Human
ugaccuagucaggcuggaagc

SEQ ID NO: 45488 - RNA, 23 nt, Human
augaugaguacuccccuugggga

SEQ ID NO: 45489 - RNA, 20 nt, Human
gguggaggcugagucgcagg

SEQ ID NO: 45490 - RNA, 24 nt, Human
gacuuugucccaaaacaaaauagg

SEQ ID NO: 45491 - RNA, 22 nt, Human
ggcccccuccucccuccuguag

SEQ ID NO: 45492 - RNA, 22 nt, Human
aaauaaaugugcaugcuuuucu

SEQ ID NO: 45493 - RNA, 27 nt, Human
uggagagacaaguaaacucucagagua

SEQ ID NO: 45494 - RNA, 22 nt, Human
caggaaggggcggcuggcuuug

SEQ ID NO: 45495 - RNA, 26 nt, Human
acagccgccuuuggcagcgagcgcuc

SEQ ID NO: 45496 - RNA, 22 nt, Human
gggagcuggggagcuuggcuga

SEQ ID NO: 45497 - RNA, 22 nt, Human
uuaaauguuuaacaucauugca

SEQ ID NO: 45498 - RNA, 26 nt, Human
cauuccacucagccugggacgauggg

SEQ ID NO: 45499 - RNA, 21 nt, Human
aacacuuugagaaaccaaagu

SEQ ID NO: 45500 - RNA, 27 nt, Human
gaacagcuguuccccacuccguguucu

SEQ ID NO: 45501 - RNA, 19 nt, Human
ggccucggagccugucucg

SEQ ID NO: 45502 - RNA, 21 nt, Human
guauuuuucuggugucacuuc

SEQ ID NO: 45503 - RNA, 26 nt, Human
ggggcaaugccugccuguucaccacu

SEQ ID NO: 45504 - RNA, 27 nt, Human
gggguagagugagguagacacuggacu

SEQ ID NO: 45505 - RNA, 27 nt, Human
acugcaucucucuuccugcuucuggcc

SEQ ID NO: 45506 - RNA, 27 nt, Human
caccauggcaccuuuugcacauaacau

SEQ ID NO: 45507 - RNA, 26 nt, Human
cugggacucaguuuaccuuaaugccu

SEQ ID NO: 45508 - RNA, 21 nt, Human
uggucugaggagcagguuggg

SEQ ID NO: 45509 - RNA, 26 nt, Human
ccagugcuuccaggggauccacguuc

SEQ ID NO: 45510 - RNA, 22 nt, Human
cagguucuagaagauugguugc

SEQ ID NO: 45511 - RNA, 23 nt, Human
uuaguauguaaacuccauauuua

SEQ ID NO: 45512 - RNA, 19 nt, Human
ugcaggacugccagcggga

SEQ ID NO: 45513 - RNA, 20 nt, Human
uacucugcuucucuuacuau

SEQ ID NO: 45514 - RNA, 23 nt, Human
ugccagcuucucucuccagggug

SEQ ID NO: 45515 - RNA, 23 nt, Human
agucccuggccaccagcacaccc

SEQ ID NO: 45516 - RNA, 21 nt, Human
acaggaagccgccuagugcag

SEQ ID NO: 45517 - RNA, 25 nt, Human
auugucacccaggcuggaguacagu

SEQ ID NO: 45518 - RNA, 19 nt, Human
uguguacauucuucaccuc

SEQ ID NO: 45519 - RNA, 21 nt, Human
cauuuugcagaggcuauggga

SEQ ID NO: 45520 - RNA, 21 nt, Human
aaucuacuuucuccaucuucc

SEQ ID NO: 45521 - RNA, 20 nt, Human
ggucuccgcccucugcuccg

SEQ ID NO: 45522 - RNA, 22 nt, Human
gccucccagguucaaguaauuc

SEQ ID NO: 45523 - RNA, 22 nt, Human
ccucugcccagaggggcagcag

SEQ ID NO: 45524 - RNA, 23 nt, Human
ucuguguaucugugccagauguu

SEQ ID NO: 45525 - RNA, 19 nt, Human
agaaauucacugucuuuua

SEQ ID NO: 45526 - RNA, 23 nt, Human
gauuccccugugucaucccauca

SEQ ID NO: 45527 - RNA, 22 nt, Human
ugucugaugcugucucuugcuc

SEQ ID NO: 45528 - RNA, 23 nt, Human
acagaaguccugucugagguccu

SEQ ID NO: 45529 - RNA, 20 nt, Human
agaugccucauuuuagaacc

SEQ ID NO: 45530 - RNA, 22 nt, Human
caggcgucuacacugucacuca

SEQ ID NO: 45531 - RNA, 20 nt, Human
ugaggugcuacaguuacaug

SEQ ID NO: 45532 - RNA, 24 nt, Human
uccaaaaagguuuaguuuguacuc

SEQ ID NO: 45533 - RNA, 26 nt, Human
uuuaacuguuagucuuaaauaguugg

SEQ ID NO: 45534 - RNA, 25 nt, Human
ccaggcaugguggugugcaccugag

SEQ ID NO: 45535 - RNA, 21 nt, Human
gcauaugcuuguuuaaagugg

SEQ ID NO: 45536 - RNA, 24 nt, Human
ccgaguagcugggauuacaagugc

SEQ ID NO: 45537 - RNA, 24 nt, Human
cacuucuccuuugagaguuggggu

SEQ ID NO: 45538 - RNA, 19 nt, Human
uaagauauauaugugcucu

SEQ ID NO: 45539 - RNA, 20 nt, Human
ucacuugcuggagugccaag

SEQ ID NO: 45540 - RNA, 21 nt, Human
acugcacuccagcuugggcaa

SEQ ID NO: 45541 - RNA, 26 nt, Human
auggaagaaagugugagcagggagaa

SEQ ID NO: 45542 - RNA, 22 nt, Human
cccaccccacagacuccggccu

SEQ ID NO: 45543 - RNA, 20 nt, Human
cuuuaugccccugcaaccaa

SEQ ID NO: 45544 - RNA, 23 nt, Human
gccugugcuuuugcucauggccu

SEQ ID NO: 45545 - RNA, 21 nt, Human
cuaccucccucccucuccgcg

SEQ ID NO: 45546 - RNA, 26 nt, Human
ugaagccugcuccuucuuguucugcc

SEQ ID NO: 45547 - RNA, 25 nt, Human
ugcuauauuuuuaacagcacuccag

SEQ ID NO: 45548 - RNA, 23 nt, Human
aaugcuguuuauauuuuggguga

SEQ ID NO: 45549 - RNA, 26 nt, Human
ccaaaacaucaaccugccagcuggcc

SEQ ID NO: 45550 - RNA, 27 nt, Human
ggggugagcaggcgaacagagcucucu

SEQ ID NO: 45551 - RNA, 22 nt, Human
acuuuggcauggacuguauuua

SEQ ID NO: 45552 - RNA, 20 nt, Human
caaggagggggaucgcuuga

SEQ ID NO: 45553 - RNA, 23 nt, Human
cccuucuguaggaaacagcagag

SEQ ID NO: 45554 - RNA, 27 nt, Human
gcccagugagaucugggagacccugaa

SEQ ID NO: 45555 - RNA, 23 nt, Human
caaacggucacauguccaucguu

SEQ ID NO: 45556 - RNA, 23 nt, Human
gccauugcuccccucucccugcc

SEQ ID NO: 45557 - RNA, 21 nt, Human
ucaggcugaggagaugggugc

SEQ ID NO: 45558 - RNA, 25 nt, Human
uucuaaacuguuuucauguguugca

SEQ ID NO: 45559 - RNA, 25 nt, Human
cacauguuccugauagugcugcagu

SEQ ID NO: 45560 - RNA, 23 nt, Human
aguccacaaagugcugggauuac

SEQ ID NO: 45561 - RNA, 25 nt, Human
caccuccuuuguagacagagggcca

SEQ ID NO: 45562 - RNA, 25 nt, Human
cccuccagaacacggcucacgcuua

SEQ ID NO: 45563 - RNA, 21 nt, Human
agcugaccuggaaaugaauga

SEQ ID NO: 45564 - RNA, 24 nt, Human
gagacagccucuuacuugccaaga

SEQ ID NO: 45565 - RNA, 19 nt, Human
agcaggggcagaugccacc

SEQ ID NO: 45566 - RNA, 23 nt, Human
ucucccacccggccacagcugcu

SEQ ID NO: 45567 - RNA, 20 nt, Human
ccugggucucugcucuagca

SEQ ID NO: 45568 - RNA, 27 nt, Human
ccacugcauuccagccugugcgacaga

SEQ ID NO: 45569 - RNA, 21 nt, Human
cgcccgggcuggaggcgccga

SEQ ID NO: 45570 - RNA, 21 nt, Human
caugagccaccacaugcagcc

SEQ ID NO: 45571 - RNA, 30 nt, Human
gucaagcaggccucuggagugcuacccuuc

SEQ ID NO: 45572 - RNA, 20 nt, Human
gucacuguuacagcacuuug

SEQ ID NO: 45573 - RNA, 24 nt, Human
cuccuaaucccucuccuuucuggc

SEQ ID NO: 45574 - RNA, 27 nt, Human
aaagaaauuggccuucagcuggagaaa

SEQ ID NO: 45575 - RNA, 22 nt, Human
uucuuuguaccaucugucuugc

SEQ ID NO: 45576 - RNA, 22 nt, Human
cacugcacuccggccuagguga

SEQ ID NO: 45577 - RNA, 25 nt, Human
ucucuacugcuuuggauccuggguc

SEQ ID NO: 45578 - RNA, 24 nt, Human
ggcuggugucccuugucuuugcca

SEQ ID NO: 45579 - RNA, 20 nt, Human
agaaaugucccuccucagaa

SEQ ID NO: 45580 - RNA, 23 nt, Human
cuaccucauguccucucauuugg

SEQ ID NO: 45581 - RNA, 23 nt, Human
cugcaaccuccgccuccuugguu

SEQ ID NO: 45582 - RNA, 21 nt, Human
gggugaggacgggugggaggg

SEQ ID NO: 45583 - RNA, 23 nt, Human
cggcuccucccagaaccaguccc

SEQ ID NO: 45584 - RNA, 23 nt, Human
gggucugcggccuaagggaccuc

SEQ ID NO: 45585 - RNA, 26 nt, Human
ggcccgcacuggccgcggagugcaag

SEQ ID NO: 45586 - RNA, 26 nt, Human
gguuugcaggaggucgguuuucaugg

SEQ ID NO: 45587 - RNA, 25 nt, Human
cugaguauucucauaggagacugcg

SEQ ID NO: 45588 - RNA, 26 nt, Human
ggaccccgcaguugggaggaggaagu

SEQ ID NO: 45589 - RNA, 23 nt, Human
agaccccaggcuggacaugcuga

SEQ ID NO: 45590 - RNA, 20 nt, Human
acacuccuggaucgagccaa

SEQ ID NO: 45591 - RNA, 20 nt, Human
ccgggcugccccgccucagc

SEQ ID NO: 45592 - RNA, 26 nt, Human
gggaggcaagaggauucucugucauc

SEQ ID NO: 45593 - RNA, 23 nt, Human
gguuuagucucaauuuugguuau

SEQ ID NO: 45594 - RNA, 21 nt, Human
uuaccugcacaugcuuucuuu

SEQ ID NO: 45595 - RNA, 18 nt, Human
uggcugcuuuugucuccc

SEQ ID NO: 45596 - RNA, 24 nt, Human
gcuccccaggaaagcaguggcagc

SEQ ID NO: 45597 - RNA, 20 nt, Human
aaagggaguuuaacaaaaac

SEQ ID NO: 45598 - RNA, 27 nt, Human
agccaucaaaauuggacuuuguauugu

SEQ ID NO: 45599 - RNA, 24 nt, Human
agucugcugcccuccaucccgaca

SEQ ID NO: 45600 - RNA, 22 nt, Human
ugucucugcuuagcugugcugg

SEQ ID NO: 45601 - RNA, 22 nt, Human
agugaauccagaccaaccuucc

SEQ ID NO: 45602 - RNA, 22 nt, Human
uucccacgcuuccuggacacug

SEQ ID NO: 45603 - RNA, 27 nt, Human
ucccaacucuagccugaauucuuuuca

SEQ ID NO: 45604 - RNA, 22 nt, Human
ccccugccucccagccuccgca

SEQ ID NO: 45605 - RNA, 22 nt, Human
aacuccaggacgccccagcugg

SEQ ID NO: 45606 - RNA, 26 nt, Human
aguauauaggugcuggauguauguaa

SEQ ID NO: 45607 - RNA, 21 nt, Human
ucugugcauuuucucuuuagg

SEQ ID NO: 45608 - RNA, 22 nt, Human
uucugauguaccuuuuuucucu

SEQ ID NO: 45609 - RNA, 24 nt, Human
ggccagggguuacaccugcccucc

SEQ ID NO: 45610 - RNA, 24 nt, Human
auaaagauguuuggcuaugcgcuu

SEQ ID NO: 45611 - RNA, 20 nt, Human
ucuuccuucucagcacuuuc

SEQ ID NO: 45612 - RNA, 23 nt, Human
gcacaggaagccuucacacugga

SEQ ID NO: 45613 - RNA, 26 nt, Human
ugaaguagaggguaaaucagcgguaa

SEQ ID NO: 45614 - RNA, 22 nt, Human
aaaaguuauuuuccaacagggc

SEQ ID NO: 45615 - RNA, 19 nt, Human
ucaaugguuagaucuuuaa

SEQ ID NO: 45616 - RNA, 22 nt, Human
caugccuguaaucccagcacua

SEQ ID NO: 45617 - RNA, 22 nt, Human
gcagaguuuguguguugucuug

SEQ ID NO: 45618 - RNA, 22 nt, Human
ucccaggaacucaggcuucagg

SEQ ID NO: 45619 - RNA, 23 nt, Human
uucucucugccagggacauguca

SEQ ID NO: 45620 - RNA, 22 nt, Human
caggccugccuuuccagcgaga

SEQ ID NO: 45621 - RNA, 20 nt, Human
uuucauaauauauaggauaa

SEQ ID NO: 45622 - RNA, 22 nt, Human
guggcuucguggucacugcucc

SEQ ID NO: 45623 - RNA, 22 nt, Human
gccucucugccauuucgguccc

SEQ ID NO: 45624 - RNA, 21 nt, Human
ucacugcagucuugaccuccc

SEQ ID NO: 45625 - RNA, 20 nt, Human
uggggguggagaaaggggaa

SEQ ID NO: 45626 - RNA, 27 nt, Human
gaccagccugggcaacauggcaagacc

SEQ ID NO: 45627 - RNA, 27 nt, Human
uucacaacuuugagaagguagcacugg

SEQ ID NO: 45628 - RNA, 21 nt, Human
auggcugccucacaaacuuca

SEQ ID NO: 45629 - RNA, 24 nt, Human
agccugaaaccucuuccacgccau

SEQ ID NO: 45630 - RNA, 22 nt, Human
uaaagccacaauuauuuuaaua

SEQ ID NO: 45631 - RNA, 19 nt, Human
auccggcccccacagcucu

SEQ ID NO: 45632 - RNA, 23 nt, Human
gcuucaugcaaccuuccauuccu

SEQ ID NO: 45633 - RNA, 24 nt, Human
gagagagacccagugguuauugug

SEQ ID NO: 45634 - RNA, 27 nt, Human
cccugcuucuccagccuggacccccag

SEQ ID NO: 45635 - RNA, 18 nt, Human
cacucacuccuuuaucuc

SEQ ID NO: 45636 - RNA, 26 nt, Human
gccuccuacaaggaggagaauguugc

SEQ ID NO: 45637 - RNA, 23 nt, Human
aacauucacacagggcucuugga

SEQ ID NO: 45638 - RNA, 27 nt, Human
gccugccugcaugcaugugcacccuug

SEQ ID NO: 45639 - RNA, 24 nt, Human
ccugguuccucccugccccuugcc

SEQ ID NO: 45640 - RNA, 23 nt, Human
acccccacccauccucagcuacc

SEQ ID NO: 45641 - RNA, 23 nt, Human
ccagagggguggucaccccaccc

SEQ ID NO: 45642 - RNA, 27 nt, Human
uggaaacaucacucuguuguaagcuga

SEQ ID NO: 45643 - RNA, 18 nt, Human
ccacuccaccccaccuca

SEQ ID NO: 45644 - RNA, 22 nt, Human
gagggacaaacuuuucccaaac

SEQ ID NO: 45645 - RNA, 22 nt, Human
gccugcucccugucuguguccc

SEQ ID NO: 45646 - RNA, 21 nt, Human
ucgaacacuuacugagagcca

SEQ ID NO: 45647 - RNA, 26 nt, Human
caccuugccuccaggcucuuuccuuc

SEQ ID NO: 45648 - RNA, 20 nt, Human
ucugaacuggauuuuauagg

SEQ ID NO: 45649 - RNA, 19 nt, Human
uucuaugaggagaccaugu

SEQ ID NO: 45650 - RNA, 22 nt, Human
cacugugcuccagccugggcaa

SEQ ID NO: 45651 - RNA, 19 nt, Human
ucuuucccuguuaggcuga

SEQ ID NO: 45652 - RNA, 19 nt, Human
aagcagccacugcccaggg

SEQ ID NO: 45653 - RNA, 22 nt, Human
gauacuuaaagcuucaaaaaga

SEQ ID NO: 45654 - RNA, 25 nt, Human
ugacuucuucuacccuaaaauauuc

SEQ ID NO: 45655 - RNA, 24 nt, Human
uaggaauagucagacauuuuauga

SEQ ID NO: 45656 - RNA, 25 nt, Human
ugccccacucugccugccugcuguu

SEQ ID NO: 45657 - RNA, 23 nt, Human
caacuuccugggcucaagugacc

SEQ ID NO: 45658 - RNA, 27 nt, Human
uuuugauacaagaaagcaaugccaauc

SEQ ID NO: 45659 - RNA, 21 nt, Human
ggggugaugcagggaggaggg

SEQ ID NO: 45660 - RNA, 27 nt, Human
cauugaucugcuuuuccuaaucauguc

SEQ ID NO: 45661 - RNA, 24 nt, Human
gcugguggcuuugcccuccaccug

SEQ ID NO: 45662 - RNA, 18 nt, Human
ggacaccacacaccagcu

SEQ ID NO: 45663 - RNA, 21 nt, Human
gccuguauuuucggacuuuga

SEQ ID NO: 45664 - RNA, 22 nt, Human
auaacaaaagcaauauauaccc

SEQ ID NO: 45665 - RNA, 27 nt, Human
cccagccugcacgucugucccucucug

SEQ ID NO: 45666 - RNA, 20 nt, Human
ggacccauggccucucucca

SEQ ID NO: 45667 - RNA, 22 nt, Human
caugccuuuaaucccagcauuu

SEQ ID NO: 45668 - RNA, 21 nt, Human
ugggacaccucaaauacauac

SEQ ID NO: 45669 - RNA, 22 nt, Human
uucuccugggagccagaccaaa

SEQ ID NO: 45670 - RNA, 20 nt, Human
cuucagguugucuuguuucu

SEQ ID NO: 45671 - RNA, 21 nt, Human
caggcagccguggccgagugg

SEQ ID NO: 45672 - RNA, 22 nt, Human
cugugccucaguuuccucaucu

SEQ ID NO: 45673 - RNA, 24 nt, Human
uuaugugaguuucuauauuagaca

SEQ ID NO: 45674 - RNA, 24 nt, Human
cagggaggagaagagggacuccag

SEQ ID NO: 45675 - RNA, 26 nt, Human
ucaucccauggccagggcgggccacu

SEQ ID NO: 45676 - RNA, 26 nt, Human
uuuguaaucacucccauuuuuacuua

SEQ ID NO: 45677 - RNA, 22 nt, Human
auuggaaucagcccaucuaaag

SEQ ID NO: 45678 - RNA, 27 nt, Human
uuguuugcagauaagaaaggaagcuaa

SEQ ID NO: 45679 - RNA, 22 nt, Human
uucuuguugcuucucuggaucc

SEQ ID NO: 45680 - RNA, 25 nt, Human
uagagaaguccauuuaaaaauuauu

SEQ ID NO: 45681 - RNA, 27 nt, Human
ggauacugaugggugacauugaaaacg

SEQ ID NO: 45682 - RNA, 23 nt, Human
gcagccgccccgccgagucgcag

SEQ ID NO: 45683 - RNA, 21 nt, Human
ggaaugagagcaaggguuggg

SEQ ID NO: 45684 - RNA, 22 nt, Human
agcucacugcaaccucaauccu

SEQ ID NO: 45685 - RNA, 25 nt, Human
gcaaacuacauggacucugucccug

SEQ ID NO: 45686 - RNA, 22 nt, Human
gaaccgagccagccacugaggg

SEQ ID NO: 45687 - RNA, 27 nt, Human
caccacugcccaccuagcuguccuggc

SEQ ID NO: 45688 - RNA, 22 nt, Human
cagcaugucccagucacugcag

SEQ ID NO: 45689 - RNA, 21 nt, Human
ggcagcacggcccacccaggc

SEQ ID NO: 45690 - RNA, 24 nt, Human
uuuauuccuuuuucuacugugucu

SEQ ID NO: 45691 - RNA, 24 nt, Human
agagacacaucuuaaggggaccca

SEQ ID NO: 45692 - RNA, 23 nt, Human
gaaaugcggaccaaacuacuuca

SEQ ID NO: 45693 - RNA, 27 nt, Human
gacaggcucccaagcucacucuuugag

SEQ ID NO: 45694 - RNA, 24 nt, Human
gcagggggaaggugggguacugga

SEQ ID NO: 45695 - RNA, 27 nt, Human
uuagccaaauucaggcccagucaucuc

SEQ ID NO: 45696 - RNA, 27 nt, Human
aggugcuuuccggccgcccucuggucg

SEQ ID NO: 45697 - RNA, 20 nt, Human
auaugguguacauucuuccu

SEQ ID NO: 45698 - RNA, 23 nt, Human
gcucugcugcccccuccugggca

SEQ ID NO: 45699 - RNA, 25 nt, Human
cugcacuccaggcugggugacagag

SEQ ID NO: 45700 - RNA, 22 nt, Human
gcuaugcucacauucauggccu

SEQ ID NO: 45701 - RNA, 22 nt, Human
agcaagaaggaggagacagaga

SEQ ID NO: 45702 - RNA, 21 nt, Human
uguuucgacaguuuuaucucu

SEQ ID NO: 45703 - RNA, 22 nt, Human
gcucacugcaaccucugccucc

SEQ ID NO: 45704 - RNA, 26 nt, Human
uugagacagggucucacucugucacc

SEQ ID NO: 45705 - RNA, 22 nt, Human
ccugccuggacggcuguucugu

SEQ ID NO: 45706 - RNA, 22 nt, Human
uccaggcagcagucucugcucc

SEQ ID NO: 45707 - RNA, 25 nt, Human
uguccccacggguaccaggaagugc

SEQ ID NO: 45708 - RNA, 24 nt, Human
ucuccuucuagcggucugccuccu

SEQ ID NO: 45709 - RNA, 22 nt, Human
cuccucuggcuccgggguuugc

SEQ ID NO: 45710 - RNA, 23 nt, Human
ccauaacaacagcugcucaaacu

SEQ ID NO: 45711 - RNA, 22 nt, Human
cccgccagccucagugccacuu

SEQ ID NO: 45712 - RNA, 22 nt, Human
aggacugcaagaguuuuccucc

SEQ ID NO: 45713 - RNA, 26 nt, Human
accagccugguccacugggaacucaa

SEQ ID NO: 45714 - RNA, 23 nt, Human
uuuuucucucuuuccaaaaauuu

SEQ ID NO: 45715 - RNA, 21 nt, Human
ucaguggucccugggagccag

SEQ ID NO: 45716 - RNA, 18 nt, Human
uuucccuuaaggaugucu

SEQ ID NO: 45717 - RNA, 20 nt, Human
aauguagugaaauguuaaua

SEQ ID NO: 45718 - RNA, 31 nt, Human
acuguccuugcucaugccugccucuuucacu

SEQ ID NO: 45719 - RNA, 22 nt, Human
ccagaaggcagagguuguagug

SEQ ID NO: 45720 - RNA, 19 nt, Human
ucccucuuucuagccuggg

SEQ ID NO: 45721 - RNA, 20 nt, Human
uuuggucccugcuccuugcc

SEQ ID NO: 45722 - RNA, 22 nt, Human
gcucacugcaaccucuuccucc

SEQ ID NO: 45723 - RNA, 22 nt, Human
ucucacugcaaccucugccucc

SEQ ID NO: 45724 - RNA, 27 nt, Human
ccaugcuccaucauacucaggucuccc

SEQ ID NO: 45725 - RNA, 26 nt, Human
gaaaacagacuccucuaguacuugga

SEQ ID NO: 45726 - RNA, 21 nt, Human
aacaaccaaaugugcauugaa

SEQ ID NO: 45727 - RNA, 22 nt, Human
auggaaagcgaccugcaccaga

SEQ ID NO: 45728 - RNA, 22 nt, Human
cacaccuguaaucccagcgcuu

SEQ ID NO: 45729 - RNA, 17 nt, Human
gcgggaggggaggaggc

SEQ ID NO: 45730 - RNA, 26 nt, Human
cuagaugaucaacauaauggaccacu

SEQ ID NO: 45731 - RNA, 23 nt, Human
uacuguuucucuggguuguuugu

SEQ ID NO: 45732 - RNA, 24 nt, Human
agggcuggagaacacugcugggca

SEQ ID NO: 45733 - RNA, 25 nt, Human
ucauggccaccuccagggacaaaga

SEQ ID NO: 45734 - RNA, 23 nt, Human
gagauagaucauuguucucucca

SEQ ID NO: 45735 - RNA, 23 nt, Human
ccuuaaggagcugaagagucugg

SEQ ID NO: 45736 - RNA, 25 nt, Human
cugccccucucugggccuguugcuc

SEQ ID NO: 45737 - RNA, 23 nt, Human
gugaucuuuguuuuauuaguaaa

SEQ ID NO: 45738 - RNA, 27 nt, Human
cucaaagccaucccccuagccaucgug

SEQ ID NO: 45739 - RNA, 22 nt, Human
aggcugaggcaggagaauagcc

SEQ ID NO: 45740 - RNA, 20 nt, Human
cugccugguggaguugagug

SEQ ID NO: 45741 - RNA, 23 nt, Human
ucgcgcccccuucagccacuccg

SEQ ID NO: 45742 - RNA, 22 nt, Human
gguagaacggcccugugcuuaa

SEQ ID NO: 45743 - RNA, 23 nt, Human
cuucugggggcuuccuuagucau

SEQ ID NO: 45744 - RNA, 31 nt, Human
uaagcccuaaauuucuccccaaaaucaagac

SEQ ID NO: 45745 - RNA, 22 nt, Human
acccugugcugucagauacccu

SEQ ID NO: 45746 - RNA, 22 nt, Human
caagaucaugccacaucacucc

SEQ ID NO: 45747 - RNA, 27 nt, Human
agaacuccagagucaccugucucaucg

SEQ ID NO: 45748 - RNA, 21 nt, Human
ggcugguugcugcugcaguga

SEQ ID NO: 45749 - RNA, 22 nt, Human
gggccucccugacuuugcuucu

SEQ ID NO: 45750 - RNA, 25 nt, Human
uuggaguuuauaucacucauuccug

SEQ ID NO: 45751 - RNA, 23 nt, Human
gggccucugacagccacuuugaa

SEQ ID NO: 45752 - RNA, 21 nt, Human
guacagucacugcuaguguuc

SEQ ID NO: 45753 - RNA, 23 nt, Human
ugcuggccucucagggaugagga

SEQ ID NO: 45754 - RNA, 24 nt, Human
cuugcccaggccccaccucuccuc

SEQ ID NO: 45755 - RNA, 21 nt, Human
aaggagaccugaauuuuugga

SEQ ID NO: 45756 - RNA, 20 nt, Human
aacucacaaccuaaagccca

SEQ ID NO: 45757 - RNA, 22 nt, Human
ucgcaccccuguauuugccuca

SEQ ID NO: 45758 - RNA, 25 nt, Human
ucucacaggcuggggacagaggugg

SEQ ID NO: 45759 - RNA, 26 nt, Human
augauugccaaaugagauggcugguu

SEQ ID NO: 45760 - RNA, 21 nt, Human
gccuggagccccaucggccaa

SEQ ID NO: 45761 - RNA, 22 nt, Human
uauuugguggagacaaugggaa

SEQ ID NO: 45762 - RNA, 23 nt, Human
ucugcucccgccuguuuucuuuc

SEQ ID NO: 45763 - RNA, 23 nt, Human
agagguggcggcgggcagagggu

SEQ ID NO: 45764 - RNA, 19 nt, Human
cugggcuggugugcagugg

SEQ ID NO: 45765 - RNA, 30 nt, Human
ucugagcugaguuugaggccguccccgacu

SEQ ID NO: 45766 - RNA, 23 nt, Human
aagaguccacuccaggacccuuu

SEQ ID NO: 45767 - RNA, 22 nt, Human
ccaggaggaggaggcugcagug

SEQ ID NO: 45768 - RNA, 24 nt, Human
cuguugcccaggcugcagugcagu

SEQ ID NO: 45769 - RNA, 23 nt, Human
guggucagaugguggggugggcc

SEQ ID NO: 45770 - RNA, 20 nt, Human
uugcucuacacaucucuuca

SEQ ID NO: 45771 - RNA, 21 nt, Human
ccauauuuauauauuguuuua

SEQ ID NO: 45772 - RNA, 27 nt, Human
accagccugggcaacauagggggaucc

SEQ ID NO: 45773 - RNA, 30 nt, Human
gugcacuuuacaucuuuauuuaaauuuuuu

SEQ ID NO: 45774 - RNA, 24 nt, Human
ucugucucuccuagccccucucuc

SEQ ID NO: 45775 - RNA, 25 nt, Human
uuccaccuugcagugaugcagcuug

SEQ ID NO: 45776 - RNA, 24 nt, Human
agcuguugguuaauuccugccuuc

SEQ ID NO: 45777 - RNA, 22 nt, Human
ggugugggcuggagaggcagaa

SEQ ID NO: 45778 - RNA, 27 nt, Human
guugcccagcccagcccuagugucagg

SEQ ID NO: 45779 - RNA, 28 nt, Human
ugcauaaacauucuuuuaacuucuuucu

SEQ ID NO: 45780 - RNA, 26 nt, Human
ccagguggcagcaucuugucauacgu

SEQ ID NO: 45781 - RNA, 22 nt, Human
acacagaccccuuugcauucac

SEQ ID NO: 45782 - RNA, 20 nt, Human
gcugucccucauguugaauu

SEQ ID NO: 45783 - RNA, 26 nt, Human
cugccucuccagcggcuugggccggg

SEQ ID NO: 45784 - RNA, 27 nt, Human
ggucaucuaagugcuguccauaugaac

SEQ ID NO: 45785 - RNA, 22 nt, Human
uugucagauucuuccuccuuua

SEQ ID NO: 45786 - RNA, 25 nt, Human
caggcagcuccgggguccgcgguuu

SEQ ID NO: 45787 - RNA, 24 nt, Human
guaauuuccugcuccuccaguaca

SEQ ID NO: 45788 - RNA, 22 nt, Human
ugaugccacugagauggcaccu

SEQ ID NO: 45789 - RNA, 21 nt, Human
uccucuuucucgacuccaucu

SEQ ID NO: 45790 - RNA, 32 nt, Human
ucugcuuggugaauugugccucuccuggcucu

SEQ ID NO: 45791 - RNA, 29 nt, Human
caccgggccgccuccccuuccccgucccc

SEQ ID NO: 45792 - RNA, 23 nt, Human
accguggcaaggagguguacagc

SEQ ID NO: 45793 - RNA, 26 nt, Human
acaaguccuacugacugcacaucuua

SEQ ID NO: 45794 - RNA, 23 nt, Human
caucggaagugauuuucuaaauu

SEQ ID NO: 45795 - RNA, 23 nt, Human
cacuccuggaaucacagaggggu

SEQ ID NO: 45796 - RNA, 27 nt, Human
uggcagcuggggcuaggggaagggcuu

SEQ ID NO: 45797 - RNA, 22 nt, Human
cauuacugagcaccuuggugag

SEQ ID NO: 45798 - RNA, 23 nt, Human
gauacaaccucccucuuguuuug

SEQ ID NO: 45799 - RNA, 26 nt, Human
cuguggcuaagggguggggugagggg

SEQ ID NO: 45800 - RNA, 19 nt, Human
gccggguccccaccaggga

SEQ ID NO: 45801 - RNA, 23 nt, Human
gauuauaccacuagagucuucag

SEQ ID NO: 45802 - RNA, 27 nt, Human
augacaccugccggcaguacccccacg

SEQ ID NO: 45803 - RNA, 20 nt, Human
ucuuccuuguccuucucugg

SEQ ID NO: 45804 - RNA, 23 nt, Human
ccaaguucucagcaccuacuuuu

SEQ ID NO: 45805 - RNA, 21 nt, Human
gaucccagcucacugcagccu

SEQ ID NO: 45806 - RNA, 22 nt, Human
ucugcugucucuuccucuggag

SEQ ID NO: 45807 - RNA, 27 nt, Human
uacaaaugaugcaaaaugugcaccugg

SEQ ID NO: 45808 - RNA, 23 nt, Human
cuccugauuggcuucccggccgc

SEQ ID NO: 45809 - RNA, 21 nt, Human
aggagccucucugaaggacca

SEQ ID NO: 45810 - RNA, 24 nt, Human
gcagcauucacucucccugucuuu

SEQ ID NO: 45811 - RNA, 22 nt, Human
ccccggcuguaucucaggucug

SEQ ID NO: 45812 - RNA, 21 nt, Human
uuuccuuuccaaaugcaucuc

SEQ ID NO: 45813 - RNA, 22 nt, Human
acauuuugcccauaacuuuuua

SEQ ID NO: 45814 - RNA, 28 nt, Human
acuugacacuccagucuuagacagggga

SEQ ID NO: 45815 - RNA, 27 nt, Human
gcaacuugcacaacagccuggaccugu

SEQ ID NO: 45816 - RNA, 26 nt, Human
cugagucucggaacgcuccagcucuc

SEQ ID NO: 45817 - RNA, 27 nt, Human
ccacugcacuggggccagcugggaagc

SEQ ID NO: 45818 - RNA, 23 nt, Human
guuugguggcacauucuaaaaua

SEQ ID NO: 45819 - RNA, 19 nt, Human
gcccauuuuucauucccua

SEQ ID NO: 45820 - RNA, 19 nt, Human
cuuccgucuuuucucccau

SEQ ID NO: 45821 - RNA, 23 nt, Human
ggggccuuuggucugcccuaccu

SEQ ID NO: 45822 - RNA, 20 nt, Human
cuuugaagcacccaugucag

SEQ ID NO: 45823 - RNA, 19 nt, Human
uuucugcugccucccugcu

SEQ ID NO: 45824 - RNA, 22 nt, Human
aucagcuucccaaguagcuggg

SEQ ID NO: 45825 - RNA, 21 nt, Human
cccuggacucucagcaucaca

SEQ ID NO: 45826 - RNA, 22 nt, Human
aggcugaagcaggaaaaucgcu

SEQ ID NO: 45827 - RNA, 25 nt, Human
uaaauguuaauuucaugguauagaa

SEQ ID NO: 45828 - RNA, 25 nt, Human
cuaaccucaguacugaaucaggacc

SEQ ID NO: 45829 - RNA, 22 nt, Human
cagcucaggggcuucgagccac

SEQ ID NO: 45830 - RNA, 23 nt, Human
guaaugguggagaggcugcccau

SEQ ID NO: 45831 - RNA, 23 nt, Human
cgccucccaccuggugugcacag

SEQ ID NO: 45832 - RNA, 20 nt, Human
uuaguuuuaaaagacaagau

SEQ ID NO: 45833 - RNA, 26 nt, Human
accuauacuguucuauacuacuccua

SEQ ID NO: 45834 - RNA, 23 nt, Human
aucaugccacugcacccuagcuu

SEQ ID NO: 45835 - RNA, 26 nt, Human
gcuauuguguuauuuuacuacuucuc

SEQ ID NO: 45836 - RNA, 22 nt, Human
cacaauacucuauacugugaug

SEQ ID NO: 45837 - RNA, 20 nt, Human
uaaucuccuauuccuucaca

SEQ ID NO: 45838 - RNA, 21 nt, Human
gaacuccuggcucaaucgauc

SEQ ID NO: 45839 - RNA, 26 nt, Human
uucucccagucauuuaauaaaugugc

SEQ ID NO: 45840 - RNA, 27 nt, Human
uucccgcaggaacugaacccaaaggau

SEQ ID NO: 45841 - RNA, 26 nt, Human
cugccuggugacacugcugccgcugc

SEQ ID NO: 45842 - RNA, 26 nt, Human
uugagacagggucucacucugucacu

SEQ ID NO: 45843 - RNA, 23 nt, Human
gauaucuguuguugcaauguuag

SEQ ID NO: 45844 - RNA, 21 nt, Human
gaauauaaacaggugauuuua

SEQ ID NO: 45845 - RNA, 20 nt, Human
uguccagaagcagcacuuug

SEQ ID NO: 45846 - RNA, 27 nt, Human
cuccugagccucccaccccgcugccug

SEQ ID NO: 45847 - RNA, 20 nt, Human
uaacucauagacaucaauca

SEQ ID NO: 45848 - RNA, 22 nt, Human
ucucccacuuucuguuccuucc

SEQ ID NO: 45849 - RNA, 22 nt, Human
cgcucagucacuggugccugag

SEQ ID NO: 45850 - RNA, 21 nt, Human
cugugccccccacuuucuccc

SEQ ID NO: 45851 - RNA, 21 nt, Human
uugccaggcuggagugcagug

SEQ ID NO: 45852 - RNA, 27 nt, Human
uccaauucaaaaauaaauuagaaaaau

SEQ ID NO: 45853 - RNA, 27 nt, Human
cuccagccugggacugcugugaugggg

SEQ ID NO: 45854 - RNA, 19 nt, Human
gugcccugcccugcccugc

SEQ ID NO: 45855 - RNA, 22 nt, Human
gcagacggccccucucuuccca

SEQ ID NO: 45856 - RNA, 21 nt, Human
agcugccuuuuucuuuucuuu

SEQ ID NO: 45857 - RNA, 21 nt, Human
ugacugcagcuccuacuguug

SEQ ID NO: 45858 - RNA, 23 nt, Human
ucuaggaaaaugaaacaauuuua

SEQ ID NO: 45859 - RNA, 22 nt, Human
gggauuacagguaugaaccacu

SEQ ID NO: 45860 - RNA, 23 nt, Human
uccagugagcuuaucaugcuguc

SEQ ID NO: 45861 - RNA, 23 nt, Human
uguugcccaggguggagugcagu

SEQ ID NO: 45862 - RNA, 23 nt, Human
uguugcccaggcuggaguggagu

SEQ ID NO: 45863 - RNA, 22 nt, Human
auccaguguacuuugcauuuua

SEQ ID NO: 45864 - RNA, 26 nt, Human
gggagagacugugaggcggcagcugg

SEQ ID NO: 45865 - RNA, 23 nt, Human
uugagaagaugcaggacaaguag

SEQ ID NO: 45866 - RNA, 24 nt, Human
uaucucaaauguauuccuuuuuug

SEQ ID NO: 45867 - RNA, 21 nt, Human
cuuuuugcuuucuuuuacgac

SEQ ID NO: 45868 - RNA, 18 nt, Human
aaauccaugcagugcagu

SEQ ID NO: 45869 - RNA, 27 nt, Human
ccagcuguccuaguuugcccaggacuc

SEQ ID NO: 45870 - RNA, 21 nt, Human
guuuaaaucugccacuuucug

SEQ ID NO: 45871 - RNA, 21 nt, Human
uuccuuuaguucuaguuaguc

SEQ ID NO: 45872 - RNA, 22 nt, Human
uuugaaguagaaauaaaaugaa

SEQ ID NO: 45873 - RNA, 20 nt, Human
accaacaacaaacgugcuuu

SEQ ID NO: 45874 - RNA, 20 nt, Human
uccacuccacaucugcauca

SEQ ID NO: 45875 - RNA, 21 nt, Human
uucuugaggguggcagaggag

SEQ ID NO: 45876 - RNA, 22 nt, Human
cauugcgcucuagccugggcaa

SEQ ID NO: 45877 - RNA, 27 nt, Human
ccaccucuuuggauguuuucaccaauu

SEQ ID NO: 45878 - RNA, 25 nt, Human
ggugaagcugcccagggcuccggag

SEQ ID NO: 45879 - RNA, 25 nt, Human
uuacccacucuguccacucccauag

SEQ ID NO: 45880 - RNA, 24 nt, Human
uuggaaaugugcaaccacugcuuc

SEQ ID NO: 45881 - RNA, 22 nt, Human
gccucccgaguagcugagacua

SEQ ID NO: 45882 - RNA, 27 nt, Human
agaaauguuauuuucccugugauagag

SEQ ID NO: 45883 - RNA, 20 nt, Human
cuccagccugagccaugggc

SEQ ID NO: 45884 - RNA, 25 nt, Human
caggucagguggaggguggggcgug

SEQ ID NO: 45885 - RNA, 22 nt, Human
agguacccuuuaaaaaggggcu

SEQ ID NO: 45886 - RNA, 25 nt, Human
agagaggccccagcaauucagcagg

SEQ ID NO: 45887 - RNA, 22 nt, Human
gcugccugcaccccaggaaagg

SEQ ID NO: 45888 - RNA, 20 nt, Human
uuauagaauaccaauguaua

SEQ ID NO: 45889 - RNA, 21 nt, Human
uuacaggcgugagccacugag

SEQ ID NO: 45890 - RNA, 19 nt, Human
aaagcauucucuaacucua

SEQ ID NO: 45891 - RNA, 19 nt, Human
cuucccuucuuuuuggcca

SEQ ID NO: 45892 - RNA, 27 nt, Human
caggaaggaaggagaggcuuuuccaga

SEQ ID NO: 45893 - RNA, 19 nt, Human
ugccccuuccccagacagg

SEQ ID NO: 45894 - RNA, 24 nt, Human
gaguugggaccucugucuuuaaaa

SEQ ID NO: 45895 - RNA, 22 nt, Human
uuaaaaauauauuugacagaaa

SEQ ID NO: 45896 - RNA, 25 nt, Human
auucaguccaguuuaauacuguaug

SEQ ID NO: 45897 - RNA, 20 nt, Human
uggggagggacagggucggc

SEQ ID NO: 45898 - RNA, 21 nt, Human
ucaagcuccacccuccuggcc

SEQ ID NO: 45899 - RNA, 22 nt, Human
gcucacugcaaccuccuccucc

SEQ ID NO: 45900 - RNA, 22 nt, Human
ucucacugcaaccuccgccucc

SEQ ID NO: 45901 - RNA, 22 nt, Human
uaguucugcauuagaaauggca

SEQ ID NO: 45902 - RNA, 20 nt, Human
uucccaggacagugaaacaa

SEQ ID NO: 45903 - RNA, 20 nt, Human
ugcccuuuaaccggcauuug

SEQ ID NO: 45904 - RNA, 18 nt, Human
gugucugaaccaaacgga

SEQ ID NO: 45905 - RNA, 21 nt, Human
cuuguacauaacccuggguga

SEQ ID NO: 45906 - RNA, 22 nt, Human
ggugguggaaucauagcucacu

SEQ ID NO: 45907 - RNA, 25 nt, Human
aucugucugcugacgcccccuggcc

SEQ ID NO: 45908 - RNA, 24 nt, Human
ugggcugcgcggccccagccuggg

SEQ ID NO: 45909 - RNA, 27 nt, Human
aacacaaaguccuuaacaugccaggcu

SEQ ID NO: 45910 - RNA, 23 nt, Human
augugaggaagaacuacagcucu

SEQ ID NO: 45911 - RNA, 22 nt, Human
ggaggugggcugagagguagag

SEQ ID NO: 45912 - RNA, 20 nt, Human
augccugcccugugcguggc

SEQ ID NO: 45913 - RNA, 22 nt, Human
auuccucuucguucaccuuggc

SEQ ID NO: 45914 - RNA, 25 nt, Human
uucugaacauguuuugucauucaca

SEQ ID NO: 45915 - RNA, 23 nt, Human
gcaucggcucuucagcagaucca

SEQ ID NO: 45916 - RNA, 26 nt, Human
caaaaucaugccuuaccuuucuuugg

SEQ ID NO: 45917 - RNA, 23 nt, Human
auaucuucuucaggcucugacag

SEQ ID NO: 45918 - RNA, 27 nt, Human
caccauggcgucacgcauaggguugcg

SEQ ID NO: 45919 - RNA, 22 nt, Human
aaucaugcgaaaggggagcugu

SEQ ID NO: 45920 - RNA, 16 nt, Human
auuauaaaaaucugau

SEQ ID NO: 45921 - RNA, 25 nt, Human
gagggcaggggugggagcccuccua

SEQ ID NO: 45922 - RNA, 25 nt, Human
gcucugguggagcugacaaccuuug

SEQ ID NO: 45923 - RNA, 22 nt, Human
cuaacacagugaaaccccaucu

SEQ ID NO: 45924 - RNA, 21 nt, Human
cacugguaaucccaagaucug

SEQ ID NO: 45925 - RNA, 16 nt, Human
cuucccuucuuggucu

SEQ ID NO: 45926 - RNA, 23 nt, Human
accucugagauuaggacaggaaa

SEQ ID NO: 45927 - RNA, 22 nt, Human
guugcuugaacccaggaggcgg

SEQ ID NO: 45928 - RNA, 31 nt, Human
gcggcagcagauguguguggggucagcccac

SEQ ID NO: 45929 - RNA, 20 nt, Human
cuccugagcugcugucuccc

SEQ ID NO: 45930 - RNA, 22 nt, Human
ugugagccaggauggucucaau

SEQ ID NO: 45931 - RNA, 22 nt, Human
agcauuuucauguuuaucuuua

SEQ ID NO: 45932 - RNA, 21 nt, Human
gaaacuucaaaauugaugaaa

SEQ ID NO: 45933 - RNA, 21 nt, Human
ccucgaucaucaagaaauacu

SEQ ID NO: 45934 - RNA, 22 nt, Human
ugccacugcacccuagcuuggg

SEQ ID NO: 45935 - RNA, 21 nt, Human
gaugcuggugcuaaaccucca

SEQ ID NO: 45936 - RNA, 22 nt, Human
gcuuugugcaaccagggcccac

SEQ ID NO: 45937 - RNA, 22 nt, Human
accagccugaccaaaaugguga

SEQ ID NO: 45938 - RNA, 22 nt, Human
accagccuggccaaaauaguga

SEQ ID NO: 45939 - RNA, 32 nt, Human
cugagcaggaauggugagauguuuaucauggg

SEQ ID NO: 45940 - RNA, 26 nt, Human
ucuucaaggaggcccacugugucuag

SEQ ID NO: 45941 - RNA, 24 nt, Human
gcucuugcugucugcccugccuca

SEQ ID NO: 45942 - RNA, 23 nt, Human
aguuugccaugagauaacacagu

SEQ ID NO: 45943 - RNA, 21 nt, Human
uuucugcugcuucuguccacc

SEQ ID NO: 45944 - RNA, 23 nt, Human
uguuacccaggcuggagugcaau

SEQ ID NO: 45945 - RNA, 27 nt, Human
ggcuggcuguuggccccucugcugucc

SEQ ID NO: 45946 - RNA, 21 nt, Human
uugccuaggcuggcgucgaga

SEQ ID NO: 45947 - RNA, 22 nt, Human
ugagacuacaggcacaugccac

SEQ ID NO: 45948 - RNA, 26 nt, Human
aggccugugucuucacccaccugcca

SEQ ID NO: 45949 - RNA, 27 nt, Human
gaacaccacacaagacauuuuucuaca

SEQ ID NO: 45950 - RNA, 24 nt, Human
cugacuccugccagccuccagguc

SEQ ID NO: 45951 - RNA, 16 nt, Human
ugccuuaacaugugga

SEQ ID NO: 45952 - RNA, 22 nt, Human
gccaaagauguugaccaggaag

SEQ ID NO: 45953 - RNA, 22 nt, Human
gacuuaccaaaugaauuuuaga

SEQ ID NO: 45954 - RNA, 23 nt, Human
accacgccuggcuaguuuuuugu

SEQ ID NO: 45955 - RNA, 24 nt, Human
aacauuccuucuuuacuggucaca

SEQ ID NO: 45956 - RNA, 27 nt, Human
gaccagccagggcaacauaauaagacu

SEQ ID NO: 45957 - RNA, 19 nt, Human
ccaucccaugccucccucc

SEQ ID NO: 45958 - RNA, 28 nt, Human
uuccuggggauuacacagcuaugaaugu

SEQ ID NO: 45959 - RNA, 21 nt, Human
agcuguagauuaguuauguuu

SEQ ID NO: 45960 - RNA, 27 nt, Human
cucauuucccagccuuucuugcuguua

SEQ ID NO: 45961 - RNA, 24 nt, Human
agucuccgggauccccaggccugg

SEQ ID NO: 45962 - RNA, 24 nt, Human
agcucgguuaggcuggggcugaug

SEQ ID NO: 45963 - RNA, 21 nt, Human
uuaggcguagcauggccaggc

SEQ ID NO: 45964 - RNA, 18 nt, Human
gcaccugcccgccugccu

SEQ ID NO: 45965 - RNA, 26 nt, Human
ccucaacaaggaucaggcugcuggaa

SEQ ID NO: 45966 - RNA, 27 nt, Human
ccaccucuguccucucucuagccugcc

SEQ ID NO: 45967 - RNA, 25 nt, Human
gcuguggacacuggcagccaauggg

SEQ ID NO: 45968 - RNA, 21 nt, Human
auugcccaggcuggagugcag

SEQ ID NO: 45969 - RNA, 22 nt, Human
ccuucaugugccugacagucuu

SEQ ID NO: 45970 - RNA, 18 nt, Human
guuguauacucuacuuuc

SEQ ID NO: 45971 - RNA, 27 nt, Human
gggccuucagcuggagcuguggacuuu

SEQ ID NO: 45972 - RNA, 26 nt, Human
acuagcaccuaucauaauggucuuag

SEQ ID NO: 45973 - RNA, 23 nt, Human
gcugaggccgaccaugcccagcc

SEQ ID NO: 45974 - RNA, 21 nt, Human
gagcgucaugcaggucuucug

SEQ ID NO: 45975 - RNA, 25 nt, Human
caggcagcgggaggaggggcggcgc

SEQ ID NO: 45976 - RNA, 26 nt, Human
gaaggucacagcacggucacagcaga

SEQ ID NO: 45977 - RNA, 19 nt, Human
uuccugugucaugaccuca

SEQ ID NO: 45978 - RNA, 22 nt, Human
ccaagguaagaggauugcuuga

SEQ ID NO: 45979 - RNA, 22 nt, Human
ggaaaucuggauuuccaccuac

SEQ ID NO: 45980 - RNA, 23 nt, Human
gaccucgucucccagggauuaga

SEQ ID NO: 45981 - RNA, 21 nt, Human
uggaggaaguggcggcuuuga

SEQ ID NO: 45982 - RNA, 22 nt, Human
ugucagcauguuuguucacaua

SEQ ID NO: 45983 - RNA, 22 nt, Human
cugaggcaggagaaaggcauga

SEQ ID NO: 45984 - RNA, 27 nt, Human
uucaggacugcaggcuccggagagugg

SEQ ID NO: 45985 - RNA, 21 nt, Human
ugcaaccucuuccuccugguu

SEQ ID NO: 45986 - RNA, 24 nt, Human
ccugcaucugucuguccuuccuuc

SEQ ID NO: 45987 - RNA, 22 nt, Human
aguaaagcuuuuuauauguaga

SEQ ID NO: 45988 - RNA, 22 nt, Human
aggccgaggcagguggaucaug

SEQ ID NO: 45989 - RNA, 24 nt, Human
accagccugggcaacaugauguga

SEQ ID NO: 45990 - RNA, 24 nt, Human
ucccuugucuccagggcuuuggag

SEQ ID NO: 45991 - RNA, 27 nt, Human
ccgggagguggcaguugcagggagcua

SEQ ID NO: 45992 - RNA, 21 nt, Human
ccuauuuggcuaccuacuucu

SEQ ID NO: 45993 - RNA, 24 nt, Human
ccugucgccaggcuggaguguagu

SEQ ID NO: 45994 - RNA, 27 nt, Human
gagaggcugucugagcagggagguugg

SEQ ID NO: 45995 - RNA, 25 nt, Human
gggaggggcaguccuuggcacuuuc

SEQ ID NO: 45996 - RNA, 25 nt, Human
ugcagcucugccuucuccauggggu

SEQ ID NO: 45997 - RNA, 23 nt, Human
gagcaaauuaguugguuugugug

SEQ ID NO: 45998 - RNA, 23 nt, Human
aaacuuggcuucuuuauacaucu

SEQ ID NO: 45999 - RNA, 23 nt, Human
ccugcccacuuguccccugcugc

SEQ ID NO: 46000 - RNA, 22 nt, Human
ccugcugcugcuaucuguccuu

SEQ ID NO: 46001 - RNA, 18 nt, Human
ccgcacgccucaguucua

SEQ ID NO: 46002 - RNA, 19 nt, Human
uucauuucuaauacucuua

SEQ ID NO: 46003 - RNA, 22 nt, Human
gaggcugaugguccuccucagg

SEQ ID NO: 46004 - RNA, 22 nt, Human
acugcucagaauuuggagggag

SEQ ID NO: 46005 - RNA, 18 nt, Human
aucuuuauuuauucccua

SEQ ID NO: 46006 - RNA, 20 nt, Human
agcugcuuuuuguuuuuugu

SEQ ID NO: 46007 - RNA, 23 nt, Human
ucaugccaucccauagaaaaccu

SEQ ID NO: 46008 - RNA, 22 nt, Human
caguuuuguuaaggagauuuag

SEQ ID NO: 46009 - RNA, 22 nt, Human
agacuucagugacuuugcugug

SEQ ID NO: 46010 - RNA, 26 nt, Human
uguuuuuaaguguggagggcaaaagg

SEQ ID NO: 46011 - RNA, 23 nt, Human
uugagaucguguaacaaaaugaa

SEQ ID NO: 46012 - RNA, 22 nt, Human
ucuaccccccaggcugaagugc

SEQ ID NO: 46013 - RNA, 21 nt, Human
gagcagcugcuccauugugcc

SEQ ID NO: 46014 - RNA, 22 nt, Human
uccucacccugauuucuugcuu

SEQ ID NO: 46015 - RNA, 21 nt, Human
gaccaaggagcuuccaucuag

SEQ ID NO: 46016 - RNA, 24 nt, Human
ugagccaccacgcccugccuacuc

SEQ ID NO: 46017 - RNA, 22 nt, Human
uggcacgugucuguaaucccag

SEQ ID NO: 46018 - RNA, 21 nt, Human
uauguaugaauguuauucacu

SEQ ID NO: 46019 - RNA, 22 nt, Human
agcaggaggaguuacgagccgg

SEQ ID NO: 46020 - RNA, 24 nt, Human
ccuucugccuacacuccugccugc

SEQ ID NO: 46021 - RNA, 19 nt, Human
gcgcaucucuguuuuuguu

SEQ ID NO: 46022 - RNA, 27 nt, Human
ucaacagcaacacauaccugacccucc

SEQ ID NO: 46023 - RNA, 20 nt, Human
ugcugguacaggauacagga

SEQ ID NO: 46024 - RNA, 22 nt, Human
ugucgccaggcuggagugcagu

SEQ ID NO: 46025 - RNA, 22 nt, Human
guuuuugcauaauaagcagguu

SEQ ID NO: 46026 - RNA, 17 nt, Human
gccugguccacugggaa

SEQ ID NO: 46027 - RNA, 22 nt, Human
uagaaagagugggagagcagcu

SEQ ID NO: 46028 - RNA, 27 nt, Human
caagccuuuggaagccagaucugugau

SEQ ID NO: 46029 - RNA, 23 nt, Human
cuuugcagauguauugcuguccu

SEQ ID NO: 46030 - RNA, 25 nt, Human
ugacccugcccuugccagaauuucc

SEQ ID NO: 46031 - RNA, 23 nt, Human
aggggggaaggggugggagccaa

SEQ ID NO: 46032 - RNA, 28 nt, Human
uacuccaaguauuucacaaaugcaucug

SEQ ID NO: 46033 - RNA, 27 nt, Human
gggauuuggcacaaaauggagcauuaa

SEQ ID NO: 46034 - RNA, 21 nt, Human
uggggaaacuuuugcccuaug

SEQ ID NO: 46035 - RNA, 21 nt, Human
caccucuucucuucauacucu

SEQ ID NO: 46036 - RNA, 21 nt, Human
agugaagccuccaacccuaag

SEQ ID NO: 46037 - RNA, 18 nt, Human
agugccugugugcagccu

SEQ ID NO: 46038 - RNA, 27 nt, Human
ccccugcccaccucuccaaccuaacug

SEQ ID NO: 46039 - RNA, 23 nt, Human
ugcauggaaaggugguuggugaa

SEQ ID NO: 46040 - RNA, 25 nt, Human
guguauugugcauuaaccucuuccu

SEQ ID NO: 46041 - RNA, 21 nt, Human
ggaaaugcuacaaacauauca

SEQ ID NO: 46042 - RNA, 24 nt, Human
ccccacuuccucugggcccuggcu

SEQ ID NO: 46043 - RNA, 27 nt, Human
ccuggggccuccagccugggacugcug

SEQ ID NO: 46044 - RNA, 21 nt, Human
ugagauuguccuuuuccccug

SEQ ID NO: 46045 - RNA, 26 nt, Human
uagggaggaaggauggcacaugggau

SEQ ID NO: 46046 - RNA, 20 nt, Human
uuguuugggagagugcagua

SEQ ID NO: 46047 - RNA, 22 nt, Human
augaagagacugagcaucuaaa

SEQ ID NO: 46048 - RNA, 22 nt, Human
gcuguucccaugucuaacagga

SEQ ID NO: 46049 - RNA, 23 nt, Human
ccugccccuccucucccucauca

SEQ ID NO: 46050 - RNA, 22 nt, Human
ggaggcugaagcaagcagauca

SEQ ID NO: 46051 - RNA, 24 nt, Human
acccaguccagccuccuggcuguu

SEQ ID NO: 46052 - RNA, 23 nt, Human
ugacuccuguuuucucucucaca

SEQ ID NO: 46053 - RNA, 25 nt, Human
agaucuacccaucucaccugcucug

SEQ ID NO: 46054 - RNA, 18 nt, Human
cccaacaauaaaugccgc

SEQ ID NO: 46055 - RNA, 21 nt, Human
uugaacaaugcguaaaaggug

SEQ ID NO: 46056 - RNA, 27 nt, Human
gagcccaaaccauccucuccuuaccac

SEQ ID NO: 46057 - RNA, 27 nt, Human
cagggcccacccccaggaaggccacag

SEQ ID NO: 46058 - RNA, 22 nt, Human
uguuugacuguuuaauuugaaa

SEQ ID NO: 46059 - RNA, 25 nt, Human
ucagaaucuccaaaaauguaacugg

SEQ ID NO: 46060 - RNA, 15 nt, Human
cuucccuuguagucu

SEQ ID NO: 46061 - RNA, 21 nt, Human
ccaccauccugccaccaccuu

SEQ ID NO: 46062 - RNA, 26 nt, Human
cagggagaguguggggacaggacagc

SEQ ID NO: 46063 - RNA, 22 nt, Human
gaacuuugaaccuaggaggcag

SEQ ID NO: 46064 - RNA, 18 nt, Human
ucaccacccuccccuguc

SEQ ID NO: 46065 - RNA, 23 nt, Human
ccagggagugaccucucugacuu

SEQ ID NO: 46066 - RNA, 22 nt, Human
guaagcauguauacacugugcu

SEQ ID NO: 46067 - RNA, 27 nt, Human
uggucucagaccccacucuuagaaauu

SEQ ID NO: 46068 - RNA, 26 nt, Human
ccucugccuccuggguucaagcgauu

SEQ ID NO: 46069 - RNA, 26 nt, Human
accaucaaaggaauauaagaaaagua

SEQ ID NO: 46070 - RNA, 22 nt, Human
aacaaacuaagccagguaugca

SEQ ID NO: 46071 - RNA, 20 nt, Human
aucgcuguuacuacuucucu

SEQ ID NO: 46072 - RNA, 21 nt, Human
gguggcggccagggaugagga

SEQ ID NO: 46073 - RNA, 22 nt, Human
ccaagccccuagucuuagagau

SEQ ID NO: 46074 - RNA, 19 nt, Human
cuaacaacugcccaguuuc

SEQ ID NO: 46075 - RNA, 26 nt, Human
ccugugccggacuccagccggggcga

SEQ ID NO: 46076 - RNA, 22 nt, Human
cgcggugcauggaaugggcuau

SEQ ID NO: 46077 - RNA, 23 nt, Human
accaugccuggcuaauuuuguau

SEQ ID NO: 46078 - RNA, 21 nt, Human
ggcaggcuggggaggccagug

SEQ ID NO: 46079 - RNA, 19 nt, Human
cacaagucugaguugcugu

SEQ ID NO: 46080 - RNA, 22 nt, Human
cacacuccuccugccagcucug

SEQ ID NO: 46081 - RNA, 24 nt, Human
gcagaugcucuuaaaagcauugau

SEQ ID NO: 46082 - RNA, 27 nt, Human
caggcugggguggacucagaugccagg

SEQ ID NO: 46083 - RNA, 23 nt, Human
cucucagugggcugcaguugccc

SEQ ID NO: 46084 - RNA, 26 nt, Human
auuuccuaccuuccuuccuccucugu

SEQ ID NO: 46085 - RNA, 22 nt, Human
cuuuggaugccccacugagguc

SEQ ID NO: 46086 - RNA, 23 nt, Human
auggaaggauggagaaaaacaga

SEQ ID NO: 46087 - RNA, 22 nt, Human
cacagcaggagcggucagggcu

SEQ ID NO: 46088 - RNA, 23 nt, Human
ucucucaucuuuugacuauuuca

SEQ ID NO: 46089 - RNA, 19 nt, Human
uucucucuuauagugacca

SEQ ID NO: 46090 - RNA, 27 nt, Human
gagaucuugcauuucugcucucuuaug

SEQ ID NO: 46091 - RNA, 27 nt, Human
acaagggcagaaagcaccaugaguggg

SEQ ID NO: 46092 - RNA, 27 nt, Human
cgugggugggcgggugcugcagcugug

SEQ ID NO: 46093 - RNA, 21 nt, Human
ggaaccuugaacccaccagcu

SEQ ID NO: 46094 - RNA, 27 nt, Human
ccucuacugguaaccaaggcaaucagg

SEQ ID NO: 46095 - RNA, 22 nt, Human
aggcuggagugcuauggcucga

SEQ ID NO: 46096 - RNA, 22 nt, Human
cccaaagugaugggauuacagg

SEQ ID NO: 46097 - RNA, 22 nt, Human
cccaaagugcugggauuccagg

SEQ ID NO: 46098 - RNA, 22 nt, Human
uguggugagccaagguugcgcc

SEQ ID NO: 46099 - RNA, 26 nt, Human
ccgcuccaccgucugcccuccaagga

SEQ ID NO: 46100 - RNA, 27 nt, Human
ggucaucuaugucacacaaaaauuuuc

SEQ ID NO: 46101 - RNA, 22 nt, Human
gucaugagcauucgagcuaaga

SEQ ID NO: 46102 - RNA, 23 nt, Human
aagaggcccagcguccaccucuc

SEQ ID NO: 46103 - RNA, 22 nt, Human
gacucacuucugacuuuaguuu

SEQ ID NO: 46104 - RNA, 22 nt, Human
ggaguuugucaguggaggcaga

SEQ ID NO: 46105 - RNA, 30 nt, Human
cccauaaacaacaggagccuuuuguuccgc

SEQ ID NO: 46106 - RNA, 23 nt, Human
cuguggacuuggaauaucagcag

SEQ ID NO: 46107 - RNA, 19 nt, Human
aguauucucugcuacuucu

SEQ ID NO: 46108 - RNA, 24 nt, Human
guggauggaugccgggaaguuuaa

SEQ ID NO: 46109 - RNA, 24 nt, Human
accggauuugguggugguuuuguu

SEQ ID NO: 46110 - RNA, 20 nt, Human
cuuuuagcucaucgcaccaa

SEQ ID NO: 46111 - RNA, 23 nt, Human
cccaggaggcagagguugcagug

SEQ ID NO: 46112 - RNA, 23 nt, Human
cggcugacccaggggugugcaca

SEQ ID NO: 46113 - RNA, 24 nt, Human
ccucuugccuucucuggugccucc

SEQ ID NO: 46114 - RNA, 21 nt, Human
gcuuccaggcuggcgugcagc

SEQ ID NO: 46115 - RNA, 21 nt, Human
uggagcugcugggcuguuaug

SEQ ID NO: 46116 - RNA, 27 nt, Human
ggagggcaagcccugcccacagaaagc

SEQ ID NO: 46117 - RNA, 28 nt, Human
ccucgacuucucagccuccugggguucc

SEQ ID NO: 46118 - RNA, 25 nt, Human
uccggaagaaagggaucugggagcg

SEQ ID NO: 46119 - RNA, 23 nt, Human
gggaggcggggaggagcagcggg

SEQ ID NO: 46120 - RNA, 20 nt, Human
uuacacuuuccuuuguacuu

SEQ ID NO: 46121 - RNA, 23 nt, Human
uugcuccuuuuuaaauuuuguag

SEQ ID NO: 46122 - RNA, 21 nt, Human
ccucaguccuucaccuugcca

SEQ ID NO: 46123 - RNA, 22 nt, Human
acagucgggaucuuuugcuuca

SEQ ID NO: 46124 - RNA, 27 nt, Human
gccaucguuuucugucaaaguuccuuu

SEQ ID NO: 46125 - RNA, 22 nt, Human
ccaagcaccugggauuacaagc

SEQ ID NO: 46126 - RNA, 20 nt, Human
caggaguucgaagcugcagg

SEQ ID NO: 46127 - RNA, 24 nt, Human
gaagaagacaaagagagauugaaa

SEQ ID NO: 46128 - RNA, 22 nt, Human
gcagccgccucccuuaugcagg

SEQ ID NO: 46129 - RNA, 22 nt, Human
aucuguuuucacaccuucaucc

SEQ ID NO: 46130 - RNA, 24 nt, Human
aaucacugcauccaaggccauucc

SEQ ID NO: 46131 - RNA, 24 nt, Human
uugacacagguucuauauucuucc

SEQ ID NO: 46132 - RNA, 22 nt, Human
agugaguccuccccacucuggg

SEQ ID NO: 46133 - RNA, 22 nt, Human
ucacccuggagguagcagguaa

SEQ ID NO: 46134 - RNA, 21 nt, Human
uuucagucucuucauuuuguc

SEQ ID NO: 46135 - RNA, 22 nt, Human
gugguguggggaggggagacgc

SEQ ID NO: 46136 - RNA, 20 nt, Human
aauuccauccacugcugaga

SEQ ID NO: 46137 - RNA, 22 nt, Human
agccucccuaguagcugggauu

SEQ ID NO: 46138 - RNA, 18 nt, Human
ucucacaccagaaaccac

SEQ ID NO: 46139 - RNA, 21 nt, Human
uuuuccucuucagucucccag

SEQ ID NO: 46140 - RNA, 20 nt, Human
gaacagcuuucgcccuggag

SEQ ID NO: 46141 - RNA, 20 nt, Human
ugaggguggucagccaaggc

SEQ ID NO: 46142 - RNA, 20 nt, Human
ccugccccuuucugcagccu

SEQ ID NO: 46143 - RNA, 22 nt, Human
ucuccaauguuuuggggaugcu

SEQ ID NO: 46144 - RNA, 28 nt, Human
acuaacuuuaugugauuuaauucauuca

SEQ ID NO: 46145 - RNA, 18 nt, Human
uaucaucauuauauuuca

SEQ ID NO: 46146 - RNA, 26 nt, Human
ucagcuguccuaagaagcaguuguca

SEQ ID NO: 46147 - RNA, 20 nt, Human
ccuucugucuguccccuuuc

SEQ ID NO: 46148 - RNA, 23 nt, Human
uuaaaaaacggauugguuaaaaa

SEQ ID NO: 46149 - RNA, 23 nt, Human
cugucccuucccaaucagugucc

SEQ ID NO: 46150 - RNA, 26 nt, Human
uuguuugguuauagugcaauauauuu

SEQ ID NO: 46151 - RNA, 24 nt, Human
aauuacugcuauuuuaaaauuucu

SEQ ID NO: 46152 - RNA, 23 nt, Human
gguccccucacucagucucucau

SEQ ID NO: 46153 - RNA, 26 nt, Human
gauccaggcugucaugugauuuaugg

SEQ ID NO: 46154 - RNA, 27 nt, Human
ccugguccuuuuuaaacuacuaguuuu

SEQ ID NO: 46155 - RNA, 23 nt, Human
ggggugaguggcuucaccgccgg

SEQ ID NO: 46156 - RNA, 22 nt, Human
gcuuagggcccugucaggaaac

SEQ ID NO: 46157 - RNA, 21 nt, Human
auuccucuccaucagcaagga

SEQ ID NO: 46158 - RNA, 24 nt, Human
cugggaagaggucccuaggcugca

SEQ ID NO: 46159 - RNA, 26 nt, Human
gguagagaagauaagguuuauggcag

SEQ ID NO: 46160 - RNA, 26 nt, Human
aggcuggagugcaaugacaugaucuc

SEQ ID NO: 46161 - RNA, 25 nt, Human
ccagcaauuuucuaugauuuuuuca

SEQ ID NO: 46162 - RNA, 19 nt, Human
cuucuagcugacucgcaca

SEQ ID NO: 46163 - RNA, 23 nt, Human
aaaccacgugaaaccuacauugc

SEQ ID NO: 46164 - RNA, 22 nt, Human
cuguucuguuuguccaguuuca

SEQ ID NO: 46165 - RNA, 21 nt, Human
cgccguuuccagcccccaguc

SEQ ID NO: 46166 - RNA, 28 nt, Human
ggaagaagaagagacagagcugcccacu

SEQ ID NO: 46167 - RNA, 23 nt, Human
uggccuagcccaccugcaggaag

SEQ ID NO: 46168 - RNA, 32 nt, Human
gcaaaacuacacagucuugacuguguaguuuu

SEQ ID NO: 46169 - RNA, 19 nt, Human
ccucagggggccaggcugg

SEQ ID NO: 46170 - RNA, 24 nt, Human
gaagaauuaaucucuguuaagaag

SEQ ID NO: 46171 - RNA, 22 nt, Human
ccuaaccugcuccucugugccu

SEQ ID NO: 46172 - RNA, 21 nt, Human
ucucgauuucacaugccuuca

SEQ ID NO: 46173 - RNA, 19 nt, Human
aguucuguaaaaucaaaga

SEQ ID NO: 46174 - RNA, 20 nt, Human
uuagaaaacagaaaugcccu

SEQ ID NO: 46175 - RNA, 26 nt, Human
cucaagcgauucuccugccucaggcu

SEQ ID NO: 46176 - RNA, 23 nt, Human
ccggaagauguugcaaggcugug

SEQ ID NO: 46177 - RNA, 25 nt, Human
cugaaaacugccggcaucugagguu

SEQ ID NO: 46178 - RNA, 22 nt, Human
ucacuucuaaaaccauuaugau

SEQ ID NO: 46179 - RNA, 27 nt, Human
gacagagugccuuuucgagacuggcag

SEQ ID NO: 46180 - RNA, 27 nt, Human
cugggcaacaagaacaaaacuccaucu

SEQ ID NO: 46181 - RNA, 23 nt, Human
cauuaucucugaguccaccagaa

SEQ ID NO: 46182 - RNA, 25 nt, Human
ggcaaacccuggugcuuuccuucau

SEQ ID NO: 46183 - RNA, 22 nt, Human
gugugagccaccacgcccugcc

SEQ ID NO: 46184 - RNA, 28 nt, Human
gccucaccagcccugggcuccgccccag

SEQ ID NO: 46185 - RNA, 24 nt, Human
cgccugucugugugcaucauguuu

SEQ ID NO: 46186 - RNA, 24 nt, Human
gguaggaggagggggaguggaggg

SEQ ID NO: 46187 - RNA, 17 nt, Human
acuuacugacaugugaa

SEQ ID NO: 46188 - RNA, 19 nt, Human
cacauacuccagauugacc

SEQ ID NO: 46189 - RNA, 23 nt, Human
gcaauacucaucagagcagcuag

SEQ ID NO: 46190 - RNA, 19 nt, Human
ucuagggcucuucacucau

SEQ ID NO: 46191 - RNA, 22 nt, Human
ucucagcccuuggugguccagg

SEQ ID NO: 46192 - RNA, 23 nt, Human
cucuguccucuccaugccuggcc

SEQ ID NO: 46193 - RNA, 22 nt, Human
ugggguuaaagcaugacaggga

SEQ ID NO: 46194 - RNA, 29 nt, Human
gaaacaaaaagguauuuugcuguuaccuc

SEQ ID NO: 46195 - RNA, 23 nt, Human
cccauuucuccccacccuggggc

SEQ ID NO: 46196 - RNA, 24 nt, Human
uccugcuucauaggugccaccuug

SEQ ID NO: 46197 - RNA, 15 nt, Human
ucccuauccugggcc

SEQ ID NO: 46198 - RNA, 23 nt, Human
uaaacuucaaagugauucuggag

SEQ ID NO: 46199 - RNA, 22 nt, Human
acaauguccaagacacagcaga

SEQ ID NO: 46200 - RNA, 26 nt, Human
cugccugccugccugccugagguccc

SEQ ID NO: 46201 - RNA, 26 nt, Human
cagggaauucuuacagccaaguugug

SEQ ID NO: 46202 - RNA, 22 nt, Human
uauccuucuagcucuccaguca

SEQ ID NO: 46203 - RNA, 22 nt, Human
gccagaggaccuaagugugaug

SEQ ID NO: 46204 - RNA, 27 nt, Human
uaaaugauguauuugugacacccuauc

SEQ ID NO: 46205 - RNA, 22 nt, Human
acacaugcacacacauauacac

SEQ ID NO: 46206 - RNA, 19 nt, Human
ggaggaggagggaggccgg

SEQ ID NO: 46207 - RNA, 22 nt, Human
gagaacauccauaauuuggggc

SEQ ID NO: 46208 - RNA, 22 nt, Human
aagccucccccuggcucuucag

SEQ ID NO: 46209 - RNA, 22 nt, Human
ugcagugagcucagauagugcc

SEQ ID NO: 46210 - RNA, 26 nt, Human
cccagcacuggucaagaaaacaagau

SEQ ID NO: 46211 - RNA, 23 nt, Human
caggcggcuccagcccugggcag

SEQ ID NO: 46212 - RNA, 21 nt, Human
guuuccuucuuugcuuucauc

SEQ ID NO: 46213 - RNA, 21 nt, Human
cucugccagauccugagacgc

SEQ ID NO: 46214 - RNA, 23 nt, Human
gcuggcuguuucguggcauuucu

SEQ ID NO: 46215 - RNA, 22 nt, Human
uuugcuugcuagucugaaccaa

SEQ ID NO: 46216 - RNA, 22 nt, Human
ccacugcacuccagccggggug

SEQ ID NO: 46217 - RNA, 21 nt, Human
gggaaagcccucugcccacac

SEQ ID NO: 46218 - RNA, 21 nt, Human
aguuacggucccaucucuuca

SEQ ID NO: 46219 - RNA, 27 nt, Human
gguuggagugcgggugggcuccugggc

SEQ ID NO: 46220 - RNA, 26 nt, Human
gcugguacggcuccuaccuggucugg

SEQ ID NO: 46221 - RNA, 22 nt, Human
gacagauuuuacagauauuuuu

SEQ ID NO: 46222 - RNA, 23 nt, Human
gccuuugcauccgcuccugggca

SEQ ID NO: 46223 - RNA, 21 nt, Human
guugugcugguauuuggcuca

SEQ ID NO: 46224 - RNA, 19 nt, Human
cuguuuccuguuuucuccc

SEQ ID NO: 46225 - RNA, 25 nt, Human
agugaaaagcaggcaaaagacuuga

SEQ ID NO: 46226 - RNA, 21 nt, Human
gaggucagggggcacugucug

SEQ ID NO: 46227 - RNA, 23 nt, Human
ccucacuugcccugccacuuugc

SEQ ID NO: 46228 - RNA, 22 nt, Human
gcacaggaaccugacacauagu

SEQ ID NO: 46229 - RNA, 27 nt, Human
cccuccugcccuaagugcagcuggacu

SEQ ID NO: 46230 - RNA, 24 nt, Human
ucuggaggcagauggguaaccagg

SEQ ID NO: 46231 - RNA, 22 nt, Human
accagccugaccaacgugguga

SEQ ID NO: 46232 - RNA, 23 nt, Human
ucuagccugcccugccugccugc

SEQ ID NO: 46233 - RNA, 24 nt, Human
agagccacuuggugacagagccag

SEQ ID NO: 46234 - RNA, 22 nt, Human
cucccuaaggguaaccuagcca

SEQ ID NO: 46235 - RNA, 20 nt, Human
uaacuggacaaauucaggau

SEQ ID NO: 46236 - RNA, 21 nt, Human
augugaacugccuauuuccua

SEQ ID NO: 46237 - RNA, 30 nt, Human
ggggcacagggagaggccgggacacacuua

SEQ ID NO: 46238 - RNA, 25 nt, Human
caggaagauuucaaggcagggagaa

SEQ ID NO: 46239 - RNA, 21 nt, Human
ucucuggguucugcagcagca

SEQ ID NO: 46240 - RNA, 22 nt, Human
uuaguaaaaaucccucauucca

SEQ ID NO: 46241 - RNA, 22 nt, Human
agcuaaguuauguauuuuuagu

SEQ ID NO: 46242 - RNA, 21 nt, Human
ggagggucagaugggagacca

SEQ ID NO: 46243 - RNA, 22 nt, Human
cccaggccacacagauucuccu

SEQ ID NO: 46244 - RNA, 22 nt, Human
gcagggauaugcagggcacuuu

SEQ ID NO: 46245 - RNA, 25 nt, Human
cguugcugagcaacgagauggugag

SEQ ID NO: 46246 - RNA, 27 nt, Human
cuaccgcacaccacccugaaacagcca

SEQ ID NO: 46247 - RNA, 23 nt, Human
caccuucuccaagucuggcagcu

SEQ ID NO: 46248 - RNA, 21 nt, Human
agcccauggggccugaaggga

SEQ ID NO: 46249 - RNA, 20 nt, Human
ggaggggcuggcugggcagg

SEQ ID NO: 46250 - RNA, 25 nt, Human
uggggucacccucuccagcaagaga

SEQ ID NO: 46251 - RNA, 21 nt, Human
ccaucagcaacaucauuccug

SEQ ID NO: 46252 - RNA, 22 nt, Human
uggaugccauuguauuucuuca

SEQ ID NO: 46253 - RNA, 22 nt, Human
acugaaaagaaggaaagauggu

SEQ ID NO: 46254 - RNA, 21 nt, Human
gaaugauuuguaaauagcuac

SEQ ID NO: 46255 - RNA, 24 nt, Human
gaaguccacuugaagcuguggaag

SEQ ID NO: 46256 - RNA, 27 nt, Human
uggagggcagaggugaaaaucccagug

SEQ ID NO: 46257 - RNA, 24 nt, Human
ccaagagaaaacaccacacuguga

SEQ ID NO: 46258 - RNA, 27 nt, Human
ggagacaccugaccuuucucaagcuga

SEQ ID NO: 46259 - RNA, 18 nt, Human
ugccuuucaaaaguacug

SEQ ID NO: 46260 - RNA, 24 nt, Human
ggagaauuggaacauguguggccc

SEQ ID NO: 46261 - RNA, 22 nt, Human
uggcucacgcuuguaaucccag

SEQ ID NO: 46262 - RNA, 22 nt, Human
uggcucacgccuguaaucucag

SEQ ID NO: 46263 - RNA, 25 nt, Human
uucuggcuaacguuaaaugcugcua

SEQ ID NO: 46264 - RNA, 16 nt, Human
gcagacaccucuuuca

SEQ ID NO: 46265 - RNA, 22 nt, Human
agaaggggauagcacugcccag

SEQ ID NO: 46266 - RNA, 18 nt, Human
gaaugucccuuuuuuccu

SEQ ID NO: 46267 - RNA, 20 nt, Human
gacaguuuuuuagaccugug

SEQ ID NO: 46268 - RNA, 26 nt, Human
ugugagccaccauggaacagaaucac

SEQ ID NO: 46269 - RNA, 26 nt, Human
ccagcuacuguggccacaccccaccu

SEQ ID NO: 46270 - RNA, 27 nt, Human
gcucaaagggaacagugaauuagccag

SEQ ID NO: 46271 - RNA, 27 nt, Human
uugcccaguguuugugcaaggauggag

SEQ ID NO: 46272 - RNA, 19 nt, Human
caccaucugaauuccagaa

SEQ ID NO: 46273 - RNA, 25 nt, Human
cagaaaguuggagcucuguccuuca

SEQ ID NO: 46274 - RNA, 22 nt, Human
cccgggcauccaguggcagcuc

SEQ ID NO: 46275 - RNA, 21 nt, Human
cucucugcugcuguagcugcc

SEQ ID NO: 46276 - RNA, 20 nt, Human
ucuaauguaaaauccagaac

SEQ ID NO: 46277 - RNA, 21 nt, Human
gugggggagggguucaggccu

SEQ ID NO: 46278 - RNA, 27 nt, Human
ggucuugaacuccugagcucaagugau

SEQ ID NO: 46279 - RNA, 27 nt, Human
uggucucaauccuggccucuugauagu

SEQ ID NO: 46280 - RNA, 24 nt, Human
agaguagauggugcaaagcaagcc

SEQ ID NO: 46281 - RNA, 23 nt, Human
ggaagccaccauggaugcaguga

SEQ ID NO: 46282 - RNA, 22 nt, Human
gauucacgacauuccuguccca

SEQ ID NO: 46283 - RNA, 18 nt, Human
uaggagggaaggagcagu

SEQ ID NO: 46284 - RNA, 22 nt, Human
auucuauuaccuaaauauugcc

SEQ ID NO: 46285 - RNA, 17 nt, Human
ggagagggacgcacagc

SEQ ID NO: 46286 - RNA, 22 nt, Human
acgcccaugccuccgucgcugc

SEQ ID NO: 46287 - RNA, 22 nt, Human
cggcugaggcaggagaauggcg

SEQ ID NO: 46288 - RNA, 22 nt, Human
aggcugaggcaggagacuggcg

SEQ ID NO: 46289 - RNA, 29 nt, Human
ccggccaccagaaaauuugcccagcuuug

SEQ ID NO: 46290 - RNA, 24 nt, Human
agcugcuaaauguucucuuugcca

SEQ ID NO: 46291 - RNA, 19 nt, Human
uucugcgccuuccuaggag

SEQ ID NO: 46292 - RNA, 22 nt, Human
cugcuaaaacauuugguugcua

SEQ ID NO: 46293 - RNA, 22 nt, Human
auggggguauccugugcauugu

SEQ ID NO: 46294 - RNA, 22 nt, Human
cauuccucuccuuccuugcugc

SEQ ID NO: 46295 - RNA, 21 nt, Human
cauguuguuugccaggacacu

SEQ ID NO: 46296 - RNA, 23 nt, Human
ggcaagcagcuagacuggugaau

SEQ ID NO: 46297 - RNA, 27 nt, Human
acucuucagcaaccucuggcgcccugc

SEQ ID NO: 46298 - RNA, 22 nt, Human
cagauguuauuuuuguauuuuu

SEQ ID NO: 46299 - RNA, 27 nt, Human
gaucagccuggcugguaccgucuagua

SEQ ID NO: 46300 - RNA, 22 nt, Human
cccuccgucucuucggcugcuu

SEQ ID NO: 46301 - RNA, 27 nt, Human
gguacuuaguugccuguuacugaguua

SEQ ID NO: 46302 - RNA, 22 nt, Human
uuuccugaaaucucugccauuu

SEQ ID NO: 46303 - RNA, 21 nt, Human
ccccugcccuugagaaacaca

SEQ ID NO: 46304 - RNA, 23 nt, Human
ccuaguuccacugcacauggccc

SEQ ID NO: 46305 - RNA, 26 nt, Human
uccuaucucuagcaaccuccugggcc

SEQ ID NO: 46306 - RNA, 22 nt, Human
ccuguucuucccucagccucgc

SEQ ID NO: 46307 - RNA, 22 nt, Human
agccuccugaguagcuaugacu

SEQ ID NO: 46308 - RNA, 27 nt, Human
cauugcacuccagcugggagacacagc

SEQ ID NO: 46309 - RNA, 20 nt, Human
guaggaauggaagcuucagg

SEQ ID NO: 46310 - RNA, 21 nt, Human
ucgcccaggcuggagugcagu

SEQ ID NO: 46311 - RNA, 21 nt, Human
ucacccaggcuggagugcggu

SEQ ID NO: 46312 - RNA, 24 nt, Human
uuguucucuaucuuaccucaucaa

SEQ ID NO: 46313 - RNA, 22 nt, Human
cacuucaagcuggucuguuuua

SEQ ID NO: 46314 - RNA, 26 nt, Human
gugucuggaucccagcaucuucucca

SEQ ID NO: 46315 - RNA, 20 nt, Human
cuggaaccuuuauaaaguga

SEQ ID NO: 46316 - RNA, 25 nt, Human
aaaaagaguuaacuuaucagaacac

SEQ ID NO: 46317 - RNA, 23 nt, Human
guuuucuuuuuugucuugaauga

SEQ ID NO: 46318 - RNA, 25 nt, Human
gcuugguggggucccccuuguaaca

SEQ ID NO: 46319 - RNA, 26 nt, Human
ugggaaacugacaucagaugucuuga

SEQ ID NO: 46320 - RNA, 22 nt, Human
ugggcuuuuccuacugugucuu

SEQ ID NO: 46321 - RNA, 22 nt, Human
ugcaacuucugccucccaugcu

SEQ ID NO: 46322 - RNA, 22 nt, Human
aagcaacaaagcagccacaguu

SEQ ID NO: 46323 - RNA, 27 nt, Human
cgcagccgccgccgccgccgcuccucu

SEQ ID NO: 46324 - RNA, 27 nt, Human
auucaggagcuuccuguccucccagcu

SEQ ID NO: 46325 - RNA, 20 nt, Human
ccaggagaacugauucugug

SEQ ID NO: 46326 - RNA, 20 nt, Human
auccuuaaugcagagcuaga

SEQ ID NO: 46327 - RNA, 22 nt, Human
gccuguaaucucagcaauuugg

SEQ ID NO: 46328 - RNA, 17 nt, Human
uaccuuuuaccuagcca

SEQ ID NO: 46329 - RNA, 26 nt, Human
acuguugccaaacuuugucgcaugca

SEQ ID NO: 46330 - RNA, 21 nt, Human
ugaccuacaagucagagucca

SEQ ID NO: 46331 - RNA, 22 nt, Human
gccucuaugucaggacucccug

SEQ ID NO: 46332 - RNA, 20 nt, Human
agagccaccuggcagacugc

SEQ ID NO: 46333 - RNA, 22 nt, Human
ucacccgagcuggagugcagug

SEQ ID NO: 46334 - RNA, 25 nt, Human
agacaaccacugggaucagcuggug

SEQ ID NO: 46335 - RNA, 27 nt, Human
gugagccaccacguggagcuggaaggg

SEQ ID NO: 46336 - RNA, 21 nt, Human
gcuggcuggacacuuugguca

SEQ ID NO: 46337 - RNA, 29 nt, Human
gagaaugggacguugcuguggacacccaa

SEQ ID NO: 46338 - RNA, 20 nt, Human
cucuccugaccucaggguga

SEQ ID NO: 46339 - RNA, 26 nt, Human
ggagcagugggacguguuucugucau

SEQ ID NO: 46340 - RNA, 23 nt, Human
ccugccuggaccuuguucccugg

SEQ ID NO: 46341 - RNA, 27 nt, Human
cugagagcagcagcagucucugucauc

SEQ ID NO: 46342 - RNA, 23 nt, Human
cccuagaaugccuagaacaggaa

SEQ ID NO: 46343 - RNA, 23 nt, Human
acccaaagguggcagcuugugaa

SEQ ID NO: 46344 - RNA, 23 nt, Human
gcacaccucuggcugucuuuuug

SEQ ID NO: 46345 - RNA, 28 nt, Human
ccagaauacccacccaagaaaauaauag

SEQ ID NO: 46346 - RNA, 23 nt, Human
aggcugagauggcccccacugug

SEQ ID NO: 46347 - RNA, 22 nt, Human
gggccugggacaacugcuccca

SEQ ID NO: 46348 - RNA, 22 nt, Human
cccccaaaccaccgacucucau

SEQ ID NO: 46349 - RNA, 23 nt, Human
accaacaagccaacugcucacag

SEQ ID NO: 46350 - RNA, 25 nt, Human
ugaggcggccggccccucagcccac

SEQ ID NO: 46351 - RNA, 21 nt, Human
gcccaggagccaccagaucuc

SEQ ID NO: 46352 - RNA, 23 nt, Human
uugcucaaguccaaacagcgugu

SEQ ID NO: 46353 - RNA, 19 nt, Human
uggcuugaaaccucugccu

SEQ ID NO: 46354 - RNA, 26 nt, Human
cuguguggcccacagaguucacugcc

SEQ ID NO: 46355 - RNA, 22 nt, Human
ugggggauguagcaaacuggac

SEQ ID NO: 46356 - RNA, 22 nt, Human
guggggaugggaggggagagac

SEQ ID NO: 46357 - RNA, 22 nt, Human
guagaugacugacagaugauag

SEQ ID NO: 46358 - RNA, 24 nt, Human
gcuuccacacauuaauggcaugau

SEQ ID NO: 46359 - RNA, 22 nt, Human
aguaugguccccauuugcccuu

SEQ ID NO: 46360 - RNA, 23 nt, Human
gaccugacagugcuggagccucc

SEQ ID NO: 46361 - RNA, 23 nt, Human
agacuggucaaaauguuuaugca

SEQ ID NO: 46362 - RNA, 21 nt, Human
aaaaucaaggacaaaaauaag

SEQ ID NO: 46363 - RNA, 27 nt, Human
guugcccaggcugggagggcaauggca

SEQ ID NO: 46364 - RNA, 23 nt, Human
uagcucagguucucuggagccau

SEQ ID NO: 46365 - RNA, 23 nt, Human
gcugguaguggcagaggacugag

SEQ ID NO: 46366 - RNA, 20 nt, Human
uauuucuucuuccucaggga

SEQ ID NO: 46367 - RNA, 27 nt, Human
acccaugucuccaucuggucauacucc

SEQ ID NO: 46368 - RNA, 22 nt, Human
cuucagggugggcuucguucuu

SEQ ID NO: 46369 - RNA, 23 nt, Human
accacgcccggcuaguuuuuugu

SEQ ID NO: 46370 - RNA, 21 nt, Human
caucgccgucgcuuggcuucu

SEQ ID NO: 46371 - RNA, 20 nt, Human
acuaauucucagcagcagug

SEQ ID NO: 46372 - RNA, 20 nt, Human
agacuuuaagagaugaggga

SEQ ID NO: 46373 - RNA, 27 nt, Human
uaggugucuauaauggcugaaaccacu

SEQ ID NO: 46374 - RNA, 21 nt, Human
ccugcgcagcuucccugccau

SEQ ID NO: 46375 - RNA, 27 nt, Human
ggagguggcugcgcaggguggagggag

SEQ ID NO: 46376 - RNA, 23 nt, Human
agagagaaggggucucucccaac

SEQ ID NO: 46377 - RNA, 27 nt, Human
agccuccccauccuuccuucccagccc

SEQ ID NO: 46378 - RNA, 21 nt, Human
uuuuauuuuugucaccagcca

SEQ ID NO: 46379 - RNA, 24 nt, Human
ucuuaauuagagacaagaaaccug

SEQ ID NO: 46380 - RNA, 22 nt, Human
gggugggagucagcacauucac

SEQ ID NO: 46381 - RNA, 24 nt, Human
agcucugacuucugcucuggacca

SEQ ID NO: 46382 - RNA, 25 nt, Human
aucauuuuuggugauuauuuuuugu

SEQ ID NO: 46383 - RNA, 22 nt, Human
agaauggcccaacaagcaaaug

SEQ ID NO: 46384 - RNA, 32 nt, Human
guugccugucaaaggcuggagggcaggaggag

SEQ ID NO: 46385 - RNA, 27 nt, Human
uccuagagugcagggauuacaggcgug

SEQ ID NO: 46386 - RNA, 23 nt, Human
uuaccugcacaccgagucacgga

SEQ ID NO: 46387 - RNA, 20 nt, Human
ccacuuggcccugcggcugc

SEQ ID NO: 46388 - RNA, 22 nt, Human
ucaauguuaauaaagcauuuca

SEQ ID NO: 46389 - RNA, 25 nt, Human
ucuucacacugugcuguauugcugc

SEQ ID NO: 46390 - RNA, 28 nt, Human
ccuaccagcugcucuucagacacacaug

SEQ ID NO: 46391 - RNA, 20 nt, Human
gccacguccagcacagagug

SEQ ID NO: 46392 - RNA, 24 nt, Human
guggcccgggcggcugggagaagc

SEQ ID NO: 46393 - RNA, 22 nt, Human
uucucucuggacugggagcuca

SEQ ID NO: 46394 - RNA, 21 nt, Human
uuuuaaggacuuuccuuccuc

SEQ ID NO: 46395 - RNA, 21 nt, Human
ccagaaccaccaccgcgccgc

SEQ ID NO: 46396 - RNA, 23 nt, Human
uuuccuuuucuugcuccuucuuc

SEQ ID NO: 46397 - RNA, 26 nt, Human
ugguggagguggguguuugggaaagg

SEQ ID NO: 46398 - RNA, 22 nt, Human
gugggaggcagagguugcagug

SEQ ID NO: 46399 - RNA, 19 nt, Human
ggagugagaagaaggaaga

SEQ ID NO: 46400 - RNA, 27 nt, Human
gggggcagcagcaaguuggaguuuugg

SEQ ID NO: 46401 - RNA, 26 nt, Human
ggauucacugcaucauagcuaugccu

SEQ ID NO: 46402 - RNA, 22 nt, Human
gcucuguggagcagaguccuuu

SEQ ID NO: 46403 - RNA, 20 nt, Human
uagcaaacuuggaauuugua

SEQ ID NO: 46404 - RNA, 24 nt, Human
gugagcaaggaaggcucccugcau

SEQ ID NO: 46405 - RNA, 21 nt, Human
ccaugcuacuaccaccaccac

SEQ ID NO: 46406 - RNA, 25 nt, Human
ccaggugugguggggugcaccugua

SEQ ID NO: 46407 - RNA, 19 nt, Human
ggggugaggguauaaguag

SEQ ID NO: 46408 - RNA, 22 nt, Human
ugcccacccucauugucaugcc

SEQ ID NO: 46409 - RNA, 22 nt, Human
aaccuagugaagcaucuuuuua

SEQ ID NO: 46410 - RNA, 22 nt, Human
ccacacagacuugggcagggua

SEQ ID NO: 46411 - RNA, 22 nt, Human
uaccuguaaaucccagcacuuu

SEQ ID NO: 46412 - RNA, 20 nt, Human
uauucccuuugacuucagcu

SEQ ID NO: 46413 - RNA, 22 nt, Human
cuauugcacuccagccugggug

SEQ ID NO: 46414 - RNA, 22 nt, Human
gucagcauuugucuccuccuuu

SEQ ID NO: 46415 - RNA, 22 nt, Human
acuauuugaaaauuggaggggg

SEQ ID NO: 46416 - RNA, 25 nt, Human
uuaaggcuaugauauuaagauagaa

SEQ ID NO: 46417 - RNA, 25 nt, Human
uucacaguauuuacaagcuauuuuu

SEQ ID NO: 46418 - RNA, 22 nt, Human
gcuggucucaaacuccugggcu

SEQ ID NO: 46419 - RNA, 22 nt, Human
ugugcccagaagcaguuaugua

SEQ ID NO: 46420 - RNA, 27 nt, Human
ucuuucuuuuaaggcuguuccugggcc

SEQ ID NO: 46421 - RNA, 21 nt, Human
uaagcagagucaggagacccc

SEQ ID NO: 46422 - RNA, 28 nt, Human
cuuuuaucacuuugagaauaaaaaguua

SEQ ID NO: 46423 - RNA, 25 nt, Human
ucacagcuuucccagaucgggagga

SEQ ID NO: 46424 - RNA, 19 nt, Human
acaaugucauuugcugcua

SEQ ID NO: 46425 - RNA, 25 nt, Human
cagggcuguugugaggauuaaauga

SEQ ID NO: 46426 - RNA, 22 nt, Human
aaacucauuuaucuccucuuca

SEQ ID NO: 46427 - RNA, 23 nt, Human
agacaggccccugaguccuggcu

SEQ ID NO: 46428 - RNA, 26 nt, Human
cccuggucuuccuccaacaucacacc

SEQ ID NO: 46429 - RNA, 20 nt, Human
uccugcagggccacagucgg

SEQ ID NO: 46430 - RNA, 23 nt, Human
ggcauccuggugccugcauaccu

SEQ ID NO: 46431 - RNA, 27 nt, Human
cuugacagauggcuucucuguuucccu

SEQ ID NO: 46432 - RNA, 25 nt, Human
ccccaggcuggagugcaguggcuca

SEQ ID NO: 46433 - RNA, 23 nt, Human
cucuuaaagcuucaguggccuag

SEQ ID NO: 46434 - RNA, 20 nt, Human
gugccuccacaugcugccug

SEQ ID NO: 46435 - RNA, 20 nt, Human
ucugaccugguucucaacag

SEQ ID NO: 46436 - RNA, 25 nt, Human
ucagaaauuagaaacuugcuacaga

SEQ ID NO: 46437 - RNA, 20 nt, Human
auuagauagucaugcugcua

SEQ ID NO: 46438 - RNA, 21 nt, Human
gcccagucccuggauguugcu

SEQ ID NO: 46439 - RNA, 23 nt, Human
ucugcuugucugcaaaugcuuug

SEQ ID NO: 46440 - RNA, 25 nt, Human
uucauaugcuuuuaauuuuaaagga

SEQ ID NO: 46441 - RNA, 26 nt, Human
ccuccaggaacugucauggaugucca

SEQ ID NO: 46442 - RNA, 24 nt, Human
aacuauuaaaaugaaugagcuuuc

SEQ ID NO: 46443 - RNA, 22 nt, Human
aacaaccuuaucaacaggccgc

SEQ ID NO: 46444 - RNA, 24 nt, Human
ggagucccuuggcccagacaccca

SEQ ID NO: 46445 - RNA, 26 nt, Human
acucaggucucccuacuccugccuua

SEQ ID NO: 46446 - RNA, 25 nt, Human
acugauucugucguguucaccagag

SEQ ID NO: 46447 - RNA, 25 nt, Human
cccaguagcucuugcauccuccucc

SEQ ID NO: 46448 - RNA, 27 nt, Human
gaacuccuggauuucaggacaagugaa

SEQ ID NO: 46449 - RNA, 28 nt, Human
gggaccgucugaggacuggaguuugauc

SEQ ID NO: 46450 - RNA, 23 nt, Human
cuguuuuuaacauggauccucug

SEQ ID NO: 46451 - RNA, 23 nt, Human
cccucugucuccuuccuucucgg

SEQ ID NO: 46452 - RNA, 25 nt, Human
cccaggaaugaaagaggagaagaaa

SEQ ID NO: 46453 - RNA, 16 nt, Human
aaguaaaauaugucca

SEQ ID NO: 46454 - RNA, 22 nt, Human
caccuccaggucccaguccucu

SEQ ID NO: 46455 - RNA, 29 nt, Human
gcugggggcaggagaaugggguguucccu

SEQ ID NO: 46456 - RNA, 18 nt, Human
caugaacuccacucugag

SEQ ID NO: 46457 - RNA, 20 nt, Human
guucucccaggucugggauu

SEQ ID NO: 46458 - RNA, 27 nt, Human
ugacccaggcuggaggacaggaccagc

SEQ ID NO: 46459 - RNA, 22 nt, Human
cauacagcccuauucuagagga

SEQ ID NO: 46460 - RNA, 23 nt, Human
ucauguguuuucuaagcuuuuca

SEQ ID NO: 46461 - RNA, 25 nt, Human
cugucucccaguuaugaaucagugg

SEQ ID NO: 46462 - RNA, 22 nt, Human
gcacaugaagaagcacacgggg

SEQ ID NO: 46463 - RNA, 22 nt, Human
cugcaggagacucuugcaguga

SEQ ID NO: 46464 - RNA, 25 nt, Human
uaagggaaaaagccuugacaauaga

SEQ ID NO: 46465 - RNA, 23 nt, Human
aagggagaacauaucuauccucu

SEQ ID NO: 46466 - RNA, 21 nt, Human
uguacaauuuugguuacuuga

SEQ ID NO: 46467 - RNA, 23 nt, Human
ggaggucuuggccgacucaggga

SEQ ID NO: 46468 - RNA, 21 nt, Human
ugcaguaccagugccaugucc

SEQ ID NO: 46469 - RNA, 21 nt, Human
uagcacuugacucugccugug

SEQ ID NO: 46470 - RNA, 16 nt, Human
auauguguuucugugu

SEQ ID NO: 46471 - RNA, 21 nt, Human
ccuucuuggaaucucagucug

SEQ ID NO: 46472 - RNA, 20 nt, Human
guuccaggugucuguguucc

SEQ ID NO: 46473 - RNA, 26 nt, Human
gugccccagcagugccuugugcaaug

SEQ ID NO: 46474 - RNA, 20 nt, Human
gcauguugcccuguugcugc

SEQ ID NO: 46475 - RNA, 21 nt, Human
gugagccaggaaagggcugug

SEQ ID NO: 46476 - RNA, 23 nt, Human
agcaggacagccagcagcaggau

SEQ ID NO: 46477 - RNA, 22 nt, Human
aggaagaggaaguaaaucugca

SEQ ID NO: 46478 - RNA, 21 nt, Human
ccgggagcgggcgucuugccg

SEQ ID NO: 46479 - RNA, 24 nt, Human
aaguccuucacuacauggccaggu

SEQ ID NO: 46480 - RNA, 22 nt, Human
ugcccccaggacuuugccucua

SEQ ID NO: 46481 - RNA, 22 nt, Human
acuaccugaugcaaaagcuaua

SEQ ID NO: 46482 - RNA, 22 nt, Human
uucucugcucuuuguauucucc

SEQ ID NO: 46483 - RNA, 22 nt, Human
cguucacugcaaucucugccuc

SEQ ID NO: 46484 - RNA, 29 nt, Human
uuaaacaaaugauuuccacaaacagauca

SEQ ID NO: 46485 - RNA, 20 nt, Human
gauucuucaaagaggcacag

SEQ ID NO: 46486 - RNA, 26 nt, Human
uggaagacauggauuagcuggaagau

SEQ ID NO: 46487 - RNA, 21 nt, Human
cagcuguucucucccucucuc

SEQ ID NO: 46488 - RNA, 24 nt, Human
ggucagaucuauuggaaaugacag

SEQ ID NO: 46489 - RNA, 21 nt, Human
gagauggacucuguccucagc

SEQ ID NO: 46490 - RNA, 23 nt, Human
aggcuggagugcaauggcgugau

SEQ ID NO: 46491 - RNA, 23 nt, Human
aggcuagagugcaguggcgugau

SEQ ID NO: 46492 - RNA, 23 nt, Human
gcauauauuaucaucaaaugcau

SEQ ID NO: 46493 - RNA, 25 nt, Human
cagggucuugcuuucuuugaccucu

SEQ ID NO: 46494 - RNA, 22 nt, Human
aucugaaaacgcuucaaaaucc

SEQ ID NO: 46495 - RNA, 22 nt, Human
cgccaggcugaccacagcacag

SEQ ID NO: 46496 - RNA, 23 nt, Human
gagcacagcugugcuggaagugu

SEQ ID NO: 46497 - RNA, 24 nt, Human
acugugcccugccuucagcuuugg

SEQ ID NO: 46498 - RNA, 22 nt, Human
gggauuacaggugcgugccacc

SEQ ID NO: 46499 - RNA, 27 nt, Human
gagguuagcaggaauaucuuuagggug

SEQ ID NO: 46500 - RNA, 21 nt, Human
gcuccccagagaggcgugggu

SEQ ID NO: 46501 - RNA, 27 nt, Human
gggaguggcaacugucaggcagaggaa

SEQ ID NO: 46502 - RNA, 25 nt, Human
auuuuugaacaacuguuggaaaugu

SEQ ID NO: 46503 - RNA, 23 nt, Human
uuguaauugacuaaagcauucca

SEQ ID NO: 46504 - RNA, 28 nt, Human
ucuaagaagaaagaaacagagauaauau

SEQ ID NO: 46505 - RNA, 28 nt, Human
gcuugcugcucaaccucuagugucccuc

SEQ ID NO: 46506 - RNA, 23 nt, Human
ggugucuuugcuuauagcauuuu

SEQ ID NO: 46507 - RNA, 24 nt, Human
agggacacagaugaccgaccuggu

SEQ ID NO: 46508 - RNA, 23 nt, Human
cugcucuagccaagguggccgca

SEQ ID NO: 46509 - RNA, 20 nt, Human
cuacagaugucauuugucuc

SEQ ID NO: 46510 - RNA, 22 nt, Human
uuagggucuuagacucugcuga

SEQ ID NO: 46511 - RNA, 21 nt, Human
ggacauacauuuaauauuucu

SEQ ID NO: 46512 - RNA, 27 nt, Human
ucauccagagcuggagugcagcggcac

SEQ ID NO: 46513 - RNA, 21 nt, Human
uggaugucauuugaggaucau

SEQ ID NO: 46514 - RNA, 22 nt, Human
gaccagccuggccaccuuagug

SEQ ID NO: 46515 - RNA, 28 nt, Human
ggucuacuugaggcagaugggauaguag

SEQ ID NO: 46516 - RNA, 23 nt, Human
guguuuggggccccgugaucuca

SEQ ID NO: 46517 - RNA, 27 nt, Human
uuaaugccacuuuaaaugucuuaaauu

SEQ ID NO: 46518 - RNA, 26 nt, Human
aggagggagaguagcagagcaugggu

SEQ ID NO: 46519 - RNA, 24 nt, Human
agcucccucgcuccgugcgcugcu

SEQ ID NO: 46520 - RNA, 21 nt, Human
ucugcugcugcucgcugcuug

SEQ ID NO: 46521 - RNA, 21 nt, Human
cagggaggggugcuacuguuu

SEQ ID NO: 46522 - RNA, 25 nt, Human
uucuucugcuuuugcaauuguguuu

SEQ ID NO: 46523 - RNA, 27 nt, Human
ggacaaggacaugagacaguggugaug

SEQ ID NO: 46524 - RNA, 18 nt, Human
aucagcuccuucucucca

SEQ ID NO: 46525 - RNA, 27 nt, Human
uguauuuuuaauuuuuucuuuucuccc

SEQ ID NO: 46526 - RNA, 23 nt, Human
ggccuuugacaaauaaauguuca

SEQ ID NO: 46527 - RNA, 22 nt, Human
uucauucuauuggucaauucca

SEQ ID NO: 46528 - RNA, 21 nt, Human
ugaaagauggagcugggccac

SEQ ID NO: 46529 - RNA, 25 nt, Human
gaaacuggagcauguugccaaggca

SEQ ID NO: 46530 - RNA, 23 nt, Human
ggccugguggagggggaggggag

SEQ ID NO: 46531 - RNA, 24 nt, Human
gcauaugcuucuuuaaaaacgcua

SEQ ID NO: 46532 - RNA, 21 nt, Human
uucagccugugcuccaguucu

SEQ ID NO: 46533 - RNA, 23 nt, Human
aucaugaccaggagaaaaaugug

SEQ ID NO: 46534 - RNA, 19 nt, Human
gauacccuuuccuucucca

SEQ ID NO: 46535 - RNA, 21 nt, Human
auaagggagagcugagccagu

SEQ ID NO: 46536 - RNA, 22 nt, Human
cugaggcaggaaaauugcuuga

SEQ ID NO: 46537 - RNA, 25 nt, Human
ugggcguccacaccugcugcuccag

SEQ ID NO: 46538 - RNA, 24 nt, Human
gcgugcgucugugugugccugugu

SEQ ID NO: 46539 - RNA, 22 nt, Human
uuaguagagacugguuucucca

SEQ ID NO: 46540 - RNA, 21 nt, Human
cuuccccugacuccagccaca

SEQ ID NO: 46541 - RNA, 27 nt, Human
cucagcaggcaggcagcagccucccgc

SEQ ID NO: 46542 - RNA, 26 nt, Human
gggagguggcaggacagacagacagc

SEQ ID NO: 46543 - RNA, 25 nt, Human
aggccucgccccaacacuguccuuc

SEQ ID NO: 46544 - RNA, 21 nt, Human
guucccuucugccaccugccu

SEQ ID NO: 46545 - RNA, 22 nt, Human
aggccccucagagaucaacaga

SEQ ID NO: 46546 - RNA, 22 nt, Human
ccaaguagcugggagccugggc

SEQ ID NO: 46547 - RNA, 19 nt, Human
ccagaucuccaucuccaaa

SEQ ID NO: 46548 - RNA, 27 nt, Human
aguagcauaauccucucaaaaugagga

SEQ ID NO: 46549 - RNA, 20 nt, Human
caauugcuuuaggguaagug

SEQ ID NO: 46550 - RNA, 23 nt, Human
cggugugcuaccccucucgcggg

SEQ ID NO: 46551 - RNA, 26 nt, Human
cccauccaugguccccagcagugccu

SEQ ID NO: 46552 - RNA, 24 nt, Human
cagaaaggcuaccauuuaucauca

SEQ ID NO: 46553 - RNA, 20 nt, Human
cagucuccucucucuucuuu

SEQ ID NO: 46554 - RNA, 23 nt, Human
ugcuagucuccaucaucuuaucu

SEQ ID NO: 46555 - RNA, 23 nt, Human
cucuccaaacgggauacaggaga

SEQ ID NO: 46556 - RNA, 20 nt, Human
uagggcauaccauuucuucc

SEQ ID NO: 46557 - RNA, 20 nt, Human
guagacaaucauuaacucua

SEQ ID NO: 46558 - RNA, 22 nt, Human
cauggggagagaaggagacuga

SEQ ID NO: 46559 - RNA, 24 nt, Human
ccguucccugcgcuucaucucaug

SEQ ID NO: 46560 - RNA, 20 nt, Human
ccagguggggugaggcagug

SEQ ID NO: 46561 - RNA, 27 nt, Human
cagcuuuguuaccuaacagcuuggcuc

SEQ ID NO: 46562 - RNA, 24 nt, Human
uuccuccaaggcuggagugcagug

SEQ ID NO: 46563 - RNA, 22 nt, Human
uugaccuuugagccaacccacc

SEQ ID NO: 46564 - RNA, 22 nt, Human
gcucaucaaaaugucucuggug

SEQ ID NO: 46565 - RNA, 22 nt, Human
ggcugcuuaaaccucugucucu

SEQ ID NO: 46566 - RNA, 25 nt, Human
cucuguucucuaccugucaugcuuc

SEQ ID NO: 46567 - RNA, 25 nt, Human
ccaugguguuucucucgggaaaugc

SEQ ID NO: 46568 - RNA, 24 nt, Human
aacauuagagcuggaguggggcug

SEQ ID NO: 46569 - RNA, 23 nt, Human
gaucucacugcaaccucugccuc

SEQ ID NO: 46570 - RNA, 21 nt, Human
acugcaacuuccaccucuggg

SEQ ID NO: 46571 - RNA, 21 nt, Human
ccucgcagguacccugccucc

SEQ ID NO: 46572 - RNA, 23 nt, Human
ggcuucuaugaucagaacuggga

SEQ ID NO: 46573 - RNA, 17 nt, Human
agaaauuuauugcugau

SEQ ID NO: 46574 - RNA, 26 nt, Human
ggaucuucauguaccugcucuucugu

SEQ ID NO: 46575 - RNA, 22 nt, Human
ccgagggcgaggagauggaggc

SEQ ID NO: 46576 - RNA, 23 nt, Human
cugcccccucccuaccucuacuc

SEQ ID NO: 46577 - RNA, 22 nt, Human
aagucuggcccacugugcagug

SEQ ID NO: 46578 - RNA, 21 nt, Human
aagauaggaagugaggccagg

SEQ ID NO: 46579 - RNA, 23 nt, Human
ucaagacugagcaacucccugaa

SEQ ID NO: 46580 - RNA, 20 nt, Human
ugcccuuuaauacacuccua

SEQ ID NO: 46581 - RNA, 27 nt, Human
cccuaaccaucuuggaugcugggcuuu

SEQ ID NO: 46582 - RNA, 22 nt, Human
auagaaaaccuguaagcuuuga

SEQ ID NO: 46583 - RNA, 19 nt, Human
gugccucaguuguuuccac

SEQ ID NO: 46584 - RNA, 23 nt, Human
gcuggcacgucacccacagccug

SEQ ID NO: 46585 - RNA, 22 nt, Human
gcaugagccaccacgcccggcc

SEQ ID NO: 46586 - RNA, 27 nt, Human
cuugccugccuuccucgccaguagcuu

SEQ ID NO: 46587 - RNA, 26 nt, Human
auuuuuaaaaaauauuuucucuguac

SEQ ID NO: 46588 - RNA, 20 nt, Human
aagaugugauucccaaccaa

SEQ ID NO: 46589 - RNA, 28 nt, Human
acaguguggggaaaaggaagagagauca

SEQ ID NO: 46590 - RNA, 27 nt, Human
acucauaccagauuuaaaauuagcuag

SEQ ID NO: 46591 - RNA, 19 nt, Human
augcucuuuuaaagccaau

SEQ ID NO: 46592 - RNA, 27 nt, Human
gcucucaucgguuggcuucauuuucaa

SEQ ID NO: 46593 - RNA, 20 nt, Human
ggcacuuacacacuugcugu

SEQ ID NO: 46594 - RNA, 22 nt, Human
cucccugcuuaaagggaacuga

SEQ ID NO: 46595 - RNA, 27 nt, Human
cugggaggggccaggggcagaaugaua

SEQ ID NO: 46596 - RNA, 21 nt, Human
cgggacgcagggguugcagug

SEQ ID NO: 46597 - RNA, 21 nt, Human
cccaccccaucagucccucuc

SEQ ID NO: 46598 - RNA, 22 nt, Human
ucaaaaccuugcacagguccca

SEQ ID NO: 46599 - RNA, 24 nt, Human
ccugccugccuuguuugauuuggc

SEQ ID NO: 46600 - RNA, 24 nt, Human
ggcacagaggucuccgucucucca

SEQ ID NO: 46601 - RNA, 23 nt, Human
aaacugaggcacuaucccagaga

SEQ ID NO: 46602 - RNA, 23 nt, Human
uuuacacaccaaaacuuuuuaca

SEQ ID NO: 46603 - RNA, 26 nt, Human
gacuccugcauuccuccuccccuccu

SEQ ID NO: 46604 - RNA, 22 nt, Human
ccuguggguucugccggugggg

SEQ ID NO: 46605 - RNA, 24 nt, Human
gggagcaggcugggaacugcagga

SEQ ID NO: 46606 - RNA, 25 nt, Human
cuucccucccuuucugauacaguga

SEQ ID NO: 46607 - RNA, 22 nt, Human
cacccagcaucccaggcuggug

SEQ ID NO: 46608 - RNA, 22 nt, Human
agggucagaacuggacagcugc

SEQ ID NO: 46609 - RNA, 24 nt, Human
ccuucaccaggaccugacuucaaa

SEQ ID NO: 46610 - RNA, 18 nt, Human
cuauguacuuuucugugu

SEQ ID NO: 46611 - RNA, 23 nt, Human
uggaaggcagggcuggacacuga

SEQ ID NO: 46612 - RNA, 23 nt, Human
caauuuuaaaaaucaguguaccu

SEQ ID NO: 46613 - RNA, 19 nt, Human
auuagaaauuaugcugcua

SEQ ID NO: 46614 - RNA, 21 nt, Human
auucugaaauccaggcagcag

SEQ ID NO: 46615 - RNA, 25 nt, Human
cugggcuugggaggcaaugcuccau

SEQ ID NO: 46616 - RNA, 22 nt, Human
ccagcugccaagccacccaagg

SEQ ID NO: 46617 - RNA, 22 nt, Human
uuugcuccuuccuuuccugaga

SEQ ID NO: 46618 - RNA, 24 nt, Human
cagcguuaaguuuuaauuuacaac

SEQ ID NO: 46619 - RNA, 23 nt, Human
cagggaaucaucucacaugcugu

SEQ ID NO: 46620 - RNA, 25 nt, Human
gcccaggcuggagugcaguggugug

SEQ ID NO: 46621 - RNA, 23 nt, Human
cccuccacuucucuccuaggcaa

SEQ ID NO: 46622 - RNA, 20 nt, Human
aauaaaaaauacauucagug

SEQ ID NO: 46623 - RNA, 27 nt, Human
gugauuguccuggaaaucgaggugaaa

SEQ ID NO: 46624 - RNA, 22 nt, Human
aagcugaggcagaaagaucccu

SEQ ID NO: 46625 - RNA, 20 nt, Human
cauggaugaagacucugcug

SEQ ID NO: 46626 - RNA, 22 nt, Human
ugcauuugugcauuucuacuac

SEQ ID NO: 46627 - RNA, 22 nt, Human
ugcuauagauagcacugccuuc

SEQ ID NO: 46628 - RNA, 21 nt, Human
gguugcagaguugaguguccu

SEQ ID NO: 46629 - RNA, 26 nt, Human
cuggggggcaggcugcagaggacuca

SEQ ID NO: 46630 - RNA, 23 nt, Human
cacaauccuaauagacagugucc

SEQ ID NO: 46631 - RNA, 22 nt, Human
aguauuuuuguacagauuugcu

SEQ ID NO: 46632 - RNA, 27 nt, Human
cugggaggauggaggacggagcugcag

SEQ ID NO: 46633 - RNA, 21 nt, Human
ccuguucuggcugaagggcua

SEQ ID NO: 46634 - RNA, 24 nt, Human
aaauuuugaaaugaacacuuuagg

SEQ ID NO: 46635 - RNA, 22 nt, Human
cacagcaaccucucugccucca

SEQ ID NO: 46636 - RNA, 25 nt, Human
guggggagugcagggccagaugggg

SEQ ID NO: 46637 - RNA, 20 nt, Human
ucucuauugcugcucucuca

SEQ ID NO: 46638 - RNA, 23 nt, Human
agagaggcguccguggaugcugg

SEQ ID NO: 46639 - RNA, 20 nt, Human
ugggcacuuguuauuuucca

SEQ ID NO: 46640 - RNA, 22 nt, Human
agccucccgaguaguugggauu

SEQ ID NO: 46641 - RNA, 22 nt, Human
aaaugauuguaugcuuaugcug

SEQ ID NO: 46642 - RNA, 20 nt, Human
ccaagcccacccccaaauau

SEQ ID NO: 46643 - RNA, 26 nt, Human
ccaaacaguaaaaacuaccaagagaa

SEQ ID NO: 46644 - RNA, 22 nt, Human
cgcuggugcuccuucugccuca

SEQ ID NO: 46645 - RNA, 24 nt, Human
ugcugugacucauaguuuacuuuu

SEQ ID NO: 46646 - RNA, 22 nt, Human
ucggcccagacugaagugcagu

SEQ ID NO: 46647 - RNA, 21 nt, Human
caauaagcaaaaacaaaaaga

SEQ ID NO: 46648 - RNA, 27 nt, Human
gucacccagaacuggaugguaccugac

SEQ ID NO: 46649 - RNA, 20 nt, Human
agugccaggcuggaggcggc

SEQ ID NO: 46650 - RNA, 24 nt, Human
gggaccugaggcaggagugucacc

SEQ ID NO: 46651 - RNA, 24 nt, Human
cccaaauguagcaaguuuccuaag

SEQ ID NO: 46652 - RNA, 25 nt, Human
uuuguuccuuuguuaacuguugugu

SEQ ID NO: 46653 - RNA, 22 nt, Human
agccucuugaguagcugggauu

SEQ ID NO: 46654 - RNA, 22 nt, Human
cugaacuaaaauaaauacaugc

SEQ ID NO: 46655 - RNA, 22 nt, Human
gcuugauaucuucuguuuuccc

SEQ ID NO: 46656 - RNA, 21 nt, Human
cugucccggcaucucucgggu

SEQ ID NO: 46657 - RNA, 23 nt, Human
ggcagaggggcuggugcccugga

SEQ ID NO: 46658 - RNA, 19 nt, Human
cugucuguccuuuuccucc

SEQ ID NO: 46659 - RNA, 18 nt, Human
gcugccucucuucugugu

SEQ ID NO: 46660 - RNA, 18 nt, Human
ugccuaacuucagagcag

SEQ ID NO: 46661 - RNA, 21 nt, Human
cguacagaugaugacugcaaa

SEQ ID NO: 46662 - RNA, 22 nt, Human
cauccaggcuggagugcaguga

SEQ ID NO: 46663 - RNA, 22 nt, Human
uugaugaaauaacacagcaguu

SEQ ID NO: 46664 - RNA, 22 nt, Human
aaacuccugaccugaggcgauc

SEQ ID NO: 46665 - RNA, 31 nt, Human
uccucucucugaguuccucugggcugccgca

SEQ ID NO: 46666 - RNA, 28 nt, Human
accguuuuuaacacauagcgccgugcug

SEQ ID NO: 46667 - RNA, 22 nt, Human
ucugucuccuugugaauacuua

SEQ ID NO: 46668 - RNA, 21 nt, Human
ucucuaacuguggagugaaug

SEQ ID NO: 46669 - RNA, 25 nt, Human
cucaccgccggccuccucgacuucc

SEQ ID NO: 46670 - RNA, 26 nt, Human
gcucgagaaucugaaggugcccuggu

SEQ ID NO: 46671 - RNA, 27 nt, Human
cuucugcuuuccagugacuccaccagu

SEQ ID NO: 46672 - RNA, 23 nt, Human
gaagcaguucuuaguagaggcau

SEQ ID NO: 46673 - RNA, 24 nt, Human
aaacugccuguuccuugaaucuga

SEQ ID NO: 46674 - RNA, 29 nt, Human
ugccugauaccucucagcauuugagggcc

SEQ ID NO: 46675 - RNA, 23 nt, Human
ugguagagacagacuccaggcag

SEQ ID NO: 46676 - RNA, 22 nt, Human
gcucauaccuguaaucccagca

SEQ ID NO: 46677 - RNA, 21 nt, Human
agcuuccagggcuuggguggc

SEQ ID NO: 46678 - RNA, 21 nt, Human
cacacugacaggaguccaaga

SEQ ID NO: 46679 - RNA, 22 nt, Human
cauugcccggaaacucagucua

SEQ ID NO: 46680 - RNA, 27 nt, Human
ucaaauacccaaaucccauuccaaguu

SEQ ID NO: 46681 - RNA, 19 nt, Human
uuuauuaaggcauguaaua

SEQ ID NO: 46682 - RNA, 20 nt, Human
uccaccccugccugccuugu

SEQ ID NO: 46683 - RNA, 26 nt, Human
gcugacauauuaaaugacucuugccu

SEQ ID NO: 46684 - RNA, 20 nt, Human
ugaggagauugaguacucug

SEQ ID NO: 46685 - RNA, 22 nt, Human
cacaccuguaauuccagcacuu

SEQ ID NO: 46686 - RNA, 22 nt, Human
cacaucuguaaucccagcacuu

SEQ ID NO: 46687 - RNA, 26 nt, Human
gauaccacuuuuagcucuuugcaucu

SEQ ID NO: 46688 - RNA, 19 nt, Human
ggucuccucucccaccuca

SEQ ID NO: 46689 - RNA, 16 nt, Human
ugccccuuaccugccg

SEQ ID NO: 46690 - RNA, 27 nt, Human
cccgccuggccccugggccugccaagg

SEQ ID NO: 46691 - RNA, 22 nt, Human
ggaccgcacuuccucuccgcca

SEQ ID NO: 46692 - RNA, 23 nt, Human
ugcacacagagcagcuacuucua

SEQ ID NO: 46693 - RNA, 28 nt, Human
ucucgcuccccucugccggucccccaug

SEQ ID NO: 46694 - RNA, 26 nt, Human
ucugguguguguuccagcagugagac

SEQ ID NO: 46695 - RNA, 22 nt, Human
ugaacuccggggcucaagcgau

SEQ ID NO: 46696 - RNA, 21 nt, Human
gcccucuguugcucccuagca

SEQ ID NO: 46697 - RNA, 21 nt, Human
agcucacugcagguucagccu

SEQ ID NO: 46698 - RNA, 19 nt, Human
cagccugccagcucuggcu

SEQ ID NO: 46699 - RNA, 23 nt, Human
ugcuccaccagcagcauggcaua

SEQ ID NO: 46700 - RNA, 23 nt, Human
gcucagaauucaucugaagagag

SEQ ID NO: 46701 - RNA, 22 nt, Human
ggcgugccaggguggugacagu

SEQ ID NO: 46702 - RNA, 22 nt, Human
agaccagccuggccaacguggu

SEQ ID NO: 46703 - RNA, 22 nt, Human
aaaccagccuggccaacauggu

SEQ ID NO: 46704 - RNA, 23 nt, Human
caugguucacuccagcauggggg

SEQ ID NO: 46705 - RNA, 23 nt, Human
gccugcacucucagaaaucagac

SEQ ID NO: 46706 - RNA, 27 nt, Human
uuacaaaccacacucauauucgucacg

SEQ ID NO: 46707 - RNA, 27 nt, Human
cggaaggcaggaggcugccggggcgcg

SEQ ID NO: 46708 - RNA, 22 nt, Human
guggaaaugucacuugcuacag

SEQ ID NO: 46709 - RNA, 21 nt, Human
acaaucuaaauaagcugcagu

SEQ ID NO: 46710 - RNA, 21 nt, Human
ggcuccccuccuuccuauuag

SEQ ID NO: 46711 - RNA, 23 nt, Human
gagacagaaaccagccccagagg

SEQ ID NO: 46712 - RNA, 21 nt, Human
agcaguuucccacuugccaaa

SEQ ID NO: 46713 - RNA, 26 nt, Human
gggaaagacccgugccagcgggcgug

SEQ ID NO: 46714 - RNA, 26 nt, Human
guuggcugagugccuucgugagagua

SEQ ID NO: 46715 - RNA, 17 nt, Human
cuugcuacacuggcuga

SEQ ID NO: 46716 - RNA, 22 nt, Human
gcucuuaggguacucaauuuua

SEQ ID NO: 46717 - RNA, 21 nt, Human
ggcuccuucuucacuaccuca

SEQ ID NO: 46718 - RNA, 22 nt, Human
ugccauguuugcuuggagugcc

SEQ ID NO: 46719 - RNA, 19 nt, Human
ccucugccccaucccaacu

SEQ ID NO: 46720 - RNA, 22 nt, Human
ggguuucugugcuuuugccaua

SEQ ID NO: 46721 - RNA, 19 nt, Human
cauccagccccuguccuca

SEQ ID NO: 46722 - RNA, 22 nt, Human
cauggaccagaaaaaguauaug

SEQ ID NO: 46723 - RNA, 25 nt, Human
ccagcgagacccagagaugccugua

SEQ ID NO: 46724 - RNA, 27 nt, Human
uuugcagaaucuuaaaauguguacucg

SEQ ID NO: 46725 - RNA, 22 nt, Human
agcggaucccggggcugggauu

SEQ ID NO: 46726 - RNA, 24 nt, Human
uaauaaacauccuuauuuuucugu

SEQ ID NO: 46727 - RNA, 22 nt, Human
gaagaagaaaggagggcgcggg

SEQ ID NO: 46728 - RNA, 26 nt, Human
uggaagggaaggugcaucgccaucua

SEQ ID NO: 46729 - RNA, 20 nt, Human
cucgacguggugaaugugca

SEQ ID NO: 46730 - RNA, 20 nt, Human
gucgucugcuuucuuuuuug

SEQ ID NO: 46731 - RNA, 19 nt, Human
ucaaugcuauucuaacuaa

SEQ ID NO: 46732 - RNA, 21 nt, Human
cagagcuucucccaggcacag

SEQ ID NO: 46733 - RNA, 30 nt, Human
cugccucagcugcugccugccagaggcgug

SEQ ID NO: 46734 - RNA, 21 nt, Human
agcuuucugaacagcuggugu

SEQ ID NO: 46735 - RNA, 21 nt, Human
ggguaucagcaucuguccuca

SEQ ID NO: 46736 - RNA, 20 nt, Human
ggaagcuuucagugcugcug

SEQ ID NO: 46737 - RNA, 25 nt, Human
ggagguggugguggguggcgguggc

SEQ ID NO: 46738 - RNA, 23 nt, Human
cagccuuucugucaucaucucca

SEQ ID NO: 46739 - RNA, 25 nt, Human
cccaggcacagccaugggagauucg

SEQ ID NO: 46740 - RNA, 24 nt, Human
gaaaggaguuuaaaaacauuuuuu

SEQ ID NO: 46741 - RNA, 27 nt, Human
gcugcaccuuccccacccccuccuggg

SEQ ID NO: 46742 - RNA, 26 nt, Human
ccgcaucuccaggcacauccaaaaag

SEQ ID NO: 46743 - RNA, 22 nt, Human
acaucuauccuuucacaguguu

SEQ ID NO: 46744 - RNA, 27 nt, Human
guaguaagauaggaagugaggccaggu

SEQ ID NO: 46745 - RNA, 24 nt, Human
cuucugcugcauuauuuuuccaag

SEQ ID NO: 46746 - RNA, 20 nt, Human
gugccaaguucuacuagaau

SEQ ID NO: 46747 - RNA, 22 nt, Human
caggcuggagugcaguggcaua

SEQ ID NO: 46748 - RNA, 22 nt, Human
caggcuggaguguaguggcaca

SEQ ID NO: 46749 - RNA, 27 nt, Human
ccccuuuucacagagaaauaaaggucu

SEQ ID NO: 46750 - RNA, 20 nt, Human
ggccucggacuuucacccca

SEQ ID NO: 46751 - RNA, 22 nt, Human
ggcaguccucacagggugccug

SEQ ID NO: 46752 - RNA, 22 nt, Human
ccaugaccccaagccucaggcc

SEQ ID NO: 46753 - RNA, 22 nt, Human
gaaaugagaaaucgcauuugga

SEQ ID NO: 46754 - RNA, 20 nt, Human
gagcccaggcgggagcggug

SEQ ID NO: 46755 - RNA, 21 nt, Human
cuuggccucugcuuuuauguc

SEQ ID NO: 46756 - RNA, 20 nt, Human
gggaagggaagcacacucug

SEQ ID NO: 46757 - RNA, 23 nt, Human
agaguggcaagacccagagguca

SEQ ID NO: 46758 - RNA, 21 nt, Human
uucuuaaaaaguaacuccuag

SEQ ID NO: 46759 - RNA, 25 nt, Human
cuggggcagcccagcagcggcugac

SEQ ID NO: 46760 - RNA, 27 nt, Human
gugauugccuucuuacaacagagaugg

SEQ ID NO: 46761 - RNA, 20 nt, Human
auuuggcucuccacugagca

SEQ ID NO: 46762 - RNA, 22 nt, Human
ugguacggggcgccacccugga

SEQ ID NO: 46763 - RNA, 26 nt, Human
uuaucacuuuuccuccaggguuagau

SEQ ID NO: 46764 - RNA, 20 nt, Human
ggaaccaacaguccaccuca

SEQ ID NO: 46765 - RNA, 20 nt, Human
uccagcgcugagauguggcc

SEQ ID NO: 46766 - RNA, 21 nt, Human
cugcauccccccuccucugcc

SEQ ID NO: 46767 - RNA, 24 nt, Human
uccucaccucaugagucuuaacuu

SEQ ID NO: 46768 - RNA, 21 nt, Human
guucuuaguuguaugucaucu

SEQ ID NO: 46769 - RNA, 26 nt, Human
agcccugcuccucuucuccccaccaa

SEQ ID NO: 46770 - RNA, 27 nt, Human
gggaggcuggaguagagggaagccugc

SEQ ID NO: 46771 - RNA, 26 nt, Human
uggucauuuuucugcuccugcuucuc

SEQ ID NO: 46772 - RNA, 22 nt, Human
ugggacgcaggccccaucuguc

SEQ ID NO: 46773 - RNA, 20 nt, Human
acuaagcuggugcuuugcau

SEQ ID NO: 46774 - RNA, 26 nt, Human
cccucucuccccuggaaaggacacca

SEQ ID NO: 46775 - RNA, 27 nt, Human
ccuacuuccugugacuucagcucuguu

SEQ ID NO: 46776 - RNA, 25 nt, Human
uuuccaucuguacuuugguccucug

SEQ ID NO: 46777 - RNA, 21 nt, Human
aaagaacaaugaagcccagug

SEQ ID NO: 46778 - RNA, 27 nt, Human
uuuugguguguuggacagagaagggcu

SEQ ID NO: 46779 - RNA, 21 nt, Human
agcaugcauacuuuaacuucu

SEQ ID NO: 46780 - RNA, 25 nt, Human
caggcuguguguggggcccaagcau

SEQ ID NO: 46781 - RNA, 21 nt, Human
aggaccacgucuauuucauca

SEQ ID NO: 46782 - RNA, 19 nt, Human
ugagaguagagucacugga

SEQ ID NO: 46783 - RNA, 21 nt, Human
cuuuccuuuucucugucugcu

SEQ ID NO: 46784 - RNA, 21 nt, Human
agcuuugacucaggagccugu

SEQ ID NO: 46785 - RNA, 22 nt, Human
guccaauaacaggucaacuuca

SEQ ID NO: 46786 - RNA, 22 nt, Human
gccuuucuugcuguuaggggcu

SEQ ID NO: 46787 - RNA, 22 nt, Human
ccaacuccugcccucaagugau

SEQ ID NO: 46788 - RNA, 23 nt, Human
ggggagccagcuggccugggguu

SEQ ID NO: 46789 - RNA, 22 nt, Human
ccccucggaguagagcugcaca

SEQ ID NO: 46790 - RNA, 22 nt, Human
gggauuacaggcgcccgucacc

SEQ ID NO: 46791 - RNA, 25 nt, Human
aaacaacagacuuacguuaaacuuc

SEQ ID NO: 46792 - RNA, 20 nt, Human
ucuucuccagggaugucaac

SEQ ID NO: 46793 - RNA, 28 nt, Human
uggcucucaaacucucuaacuuauaagu

SEQ ID NO: 46794 - RNA, 17 nt, Human
aaacacuuucucacuua

SEQ ID NO: 46795 - RNA, 22 nt, Human
cugucucuguugcuucggggca

SEQ ID NO: 46796 - RNA, 22 nt, Human
ugugcuccucuugauuccuggu

SEQ ID NO: 46797 - RNA, 29 nt, Human
gugguguugucagcccaugcuuaucccuc

SEQ ID NO: 46798 - RNA, 25 nt, Human
ccucagcugcugcccucgcuaccgc

SEQ ID NO: 46799 - RNA, 23 nt, Human
caggcagcuuaaaaccuuagugc

SEQ ID NO: 46800 - RNA, 26 nt, Human
agagaggcgccuccuggccuggcucu

SEQ ID NO: 46801 - RNA, 20 nt, Human
gacuccugccugaguuucca

SEQ ID NO: 46802 - RNA, 26 nt, Human
aaagaaugcccgcgcugaaauuuggc

SEQ ID NO: 46803 - RNA, 23 nt, Human
ucucuguuauagaagagccuucu

SEQ ID NO: 46804 - RNA, 22 nt, Human
guggcccugguucacuugccgg

SEQ ID NO: 46805 - RNA, 21 nt, Human
uguaacccguuacacugugug

SEQ ID NO: 46806 - RNA, 22 nt, Human
gucgaucccccucccuuggauc

SEQ ID NO: 46807 - RNA, 23 nt, Human
ggggcgggauccugguguccuga

SEQ ID NO: 46808 - RNA, 25 nt, Human
agccucgggaccucugaaagccuug

SEQ ID NO: 46809 - RNA, 22 nt, Human
gaucaagaaaauuucuuucuuc

SEQ ID NO: 46810 - RNA, 20 nt, Human
ggguacaggcugaguggggc

SEQ ID NO: 46811 - RNA, 24 nt, Human
ccuuaguauuuucccaaccaauag

SEQ ID NO: 46812 - RNA, 21 nt, Human
ccuucccccagcccuggagcc

SEQ ID NO: 46813 - RNA, 24 nt, Human
ggcucucccuccauccucauuccu

SEQ ID NO: 46814 - RNA, 29 nt, Human
ugggagccaggaaggugggggguguccag

SEQ ID NO: 46815 - RNA, 20 nt, Human
aagaauugaaugaaaaguca

SEQ ID NO: 46816 - RNA, 21 nt, Human
gaucucaggcuggagugcagu

SEQ ID NO: 46817 - RNA, 22 nt, Human
ggguuugggguccgggucuccc

SEQ ID NO: 46818 - RNA, 21 nt, Human
uuugaacucucuuuguacuug

SEQ ID NO: 46819 - RNA, 20 nt, Human
aaaaaccauuuaaacugcua

SEQ ID NO: 46820 - RNA, 26 nt, Human
aauguucuuugcauguuacugugcac

SEQ ID NO: 46821 - RNA, 20 nt, Human
ugaaucuccuuucuguucua

SEQ ID NO: 46822 - RNA, 19 nt, Human
ccucagcuuugauauuuca

SEQ ID NO: 46823 - RNA, 26 nt, Human
gucuggcaucucccacacaagaccca

SEQ ID NO: 46824 - RNA, 21 nt, Human
ccuguaaucccagcaguuugg

SEQ ID NO: 46825 - RNA, 27 nt, Human
cuugcuuccugucuuauccuccaccgu

SEQ ID NO: 46826 - RNA, 22 nt, Human
gcugggcugcaggcucucggcu

SEQ ID NO: 46827 - RNA, 27 nt, Human
gguucacugcagcuccugucacaagcu

SEQ ID NO: 46828 - RNA, 26 nt, Human
cccagccgggcuggaggcugugcaga

SEQ ID NO: 46829 - RNA, 20 nt, Human
ccccucccucugcucucaua

SEQ ID NO: 46830 - RNA, 22 nt, Human
aaguuucucuuucaucuggcca

SEQ ID NO: 46831 - RNA, 21 nt, Human
agguucuaaaaagaaaguggu

SEQ ID NO: 46832 - RNA, 26 nt, Human
cuucuggaauguugcugacccaggcc

SEQ ID NO: 46833 - RNA, 18 nt, Human
aaaccucuucuccaguca

SEQ ID NO: 46834 - RNA, 22 nt, Human
caggagauugaggcugcaguga

SEQ ID NO: 46835 - RNA, 24 nt, Human
cuggacucugcgccuuugccugca

SEQ ID NO: 46836 - RNA, 23 nt, Human
gccuaguguucccagcacugugc

SEQ ID NO: 46837 - RNA, 22 nt, Human
ugcucuuguuucucaaaaaaga

SEQ ID NO: 46838 - RNA, 22 nt, Human
caaaagaaaauauagucacagg

SEQ ID NO: 46839 - RNA, 26 nt, Human
ugcacguuucuaagguagggaggagg

SEQ ID NO: 46840 - RNA, 23 nt, Human
cagcuccagggaaauggagguau

SEQ ID NO: 46841 - RNA, 27 nt, Human
cgcugcacucauggcuucuccuagcaa

SEQ ID NO: 46842 - RNA, 23 nt, Human
cuuucuguuccuuccuccacugc

SEQ ID NO: 46843 - RNA, 21 nt, Human
uccgggagagaaaugaagaaa

SEQ ID NO: 46844 - RNA, 23 nt, Human
ccccuuugagcgauuagccaguc

SEQ ID NO: 46845 - RNA, 21 nt, Human
cucauuucuaugguuuuguua

SEQ ID NO: 46846 - RNA, 19 nt, Human
gcucuucuugaaucaugcu

SEQ ID NO: 46847 - RNA, 24 nt, Human
caccuucaucuagccuggccgcgg

SEQ ID NO: 46848 - RNA, 26 nt, Human
cguguuuuuaucacaccugcucccca

SEQ ID NO: 46849 - RNA, 24 nt, Human
uguucccucuccaaucuuccagcc

SEQ ID NO: 46850 - RNA, 24 nt, Human
agagccccaaagaucccacgggag

SEQ ID NO: 46851 - RNA, 26 nt, Human
gccucuacugugucucacaucaccau

SEQ ID NO: 46852 - RNA, 24 nt, Human
acgauggagagaugccagugaccu

SEQ ID NO: 46853 - RNA, 21 nt, Human
gugggccacacccaggaaggg

SEQ ID NO: 46854 - RNA, 25 nt, Human
gcccacaauggagugggagaucagc

SEQ ID NO: 46855 - RNA, 20 nt, Human
ccaccgaggagggagcagug

SEQ ID NO: 46856 - RNA, 26 nt, Human
uuguuucucugggcgguuguggcagc

SEQ ID NO: 46857 - RNA, 21 nt, Human
cuuauucagguuuaauggagg

SEQ ID NO: 46858 - RNA, 23 nt, Human
cucacccuuggagcccaccuugg

SEQ ID NO: 46859 - RNA, 20 nt, Human
cucugagcacccaagccagg

SEQ ID NO: 46860 - RNA, 26 nt, Human
uuccauuucuuuuguauuuguuuucu

SEQ ID NO: 46861 - RNA, 22 nt, Human
gcucaugcccagacacacucac

SEQ ID NO: 46862 - RNA, 21 nt, Human
ugugagccaagauuguaacca

SEQ ID NO: 46863 - RNA, 19 nt, Human
uguagaugccaagcauuuu

SEQ ID NO: 46864 - RNA, 26 nt, Human
cuugcagaaugugcucugguggaaca

SEQ ID NO: 46865 - RNA, 20 nt, Human
gccagccucacgcucugggc

SEQ ID NO: 46866 - RNA, 23 nt, Human
cgggggaucggggguuaggggug

SEQ ID NO: 46867 - RNA, 22 nt, Human
accaucauagcucacugcagcc

SEQ ID NO: 46868 - RNA, 21 nt, Human
uuccugcuccaaucaucccuu

SEQ ID NO: 46869 - RNA, 20 nt, Human
cugcccaggcggcggcggcg

SEQ ID NO: 46870 - RNA, 22 nt, Human
augugcugcggucacucaggcc

SEQ ID NO: 46871 - RNA, 22 nt, Human
caacauagugagaccccaucuc

SEQ ID NO: 46872 - RNA, 22 nt, Human
caacauagcaagacccugucuc

SEQ ID NO: 46873 - RNA, 22 nt, Human
uaacauagugagacccuaucuc

SEQ ID NO: 46874 - RNA, 23 nt, Human
agcaaggaguaacuacugagaga

SEQ ID NO: 46875 - RNA, 20 nt, Human
uaggaugucagacaauacca

SEQ ID NO: 46876 - RNA, 21 nt, Human
aacuccuggccucaagcaauc

SEQ ID NO: 46877 - RNA, 23 nt, Human
aaacuauacaacaaaggcaaguu

SEQ ID NO: 46878 - RNA, 19 nt, Human
uagacccuguucccucacc

SEQ ID NO: 46879 - RNA, 21 nt, Human
agcccaggcuggagugcaaug

SEQ ID NO: 46880 - RNA, 25 nt, Human
aggagggagagaacuaggggcccgc

SEQ ID NO: 46881 - RNA, 22 nt, Human
ggcuguccugaaagucuggacu

SEQ ID NO: 46882 - RNA, 19 nt, Human
ccugggauugacucugagu

SEQ ID NO: 46883 - RNA, 24 nt, Human
ccuugagugggccuuugagcugcu

SEQ ID NO: 46884 - RNA, 27 nt, Human
agagaauauuugguuacucagauccau

SEQ ID NO: 46885 - RNA, 18 nt, Human
gcggccgccuccggccag

SEQ ID NO: 46886 - RNA, 22 nt, Human
ugucauucaggcuggagugcag

SEQ ID NO: 46887 - RNA, 20 nt, Human
ucugccuggccuccugcuga

SEQ ID NO: 46888 - RNA, 27 nt, Human
agaugucugauuuacugugaauuugcc

SEQ ID NO: 46889 - RNA, 22 nt, Human
gcaggcaugggaagagcacugg

SEQ ID NO: 46890 - RNA, 23 nt, Human
uuucugcugcuuccaucaaagcc

SEQ ID NO: 46891 - RNA, 27 nt, Human
ugggcucagaccccccucagccccagc

SEQ ID NO: 46892 - RNA, 20 nt, Human
uccagcuuuacuuuuuugcu

SEQ ID NO: 46893 - RNA, 21 nt, Human
ucacuggcaaaagcaucagau

SEQ ID NO: 46894 - RNA, 24 nt, Human
auacauacgcuccucuauucuucc

SEQ ID NO: 46895 - RNA, 19 nt, Human
agcgucccuggucucucca

SEQ ID NO: 46896 - RNA, 21 nt, Human
gacagcugucgccugcggcug

SEQ ID NO: 46897 - RNA, 27 nt, Human
ccgggaggcaguggcuuggagaggcag

SEQ ID NO: 46898 - RNA, 20 nt, Human
acuguauguacauacuggca

SEQ ID NO: 46899 - RNA, 25 nt, Human
cuucugcuuauucaguccuucagcu

SEQ ID NO: 46900 - RNA, 24 nt, Human
ccaugaucuugagauuauuuuuag

SEQ ID NO: 46901 - RNA, 24 nt, Human
ucaggucuggaaaguaugaccugg

SEQ ID NO: 46902 - RNA, 25 nt, Human
agcucagagggacacggucuugccu

SEQ ID NO: 46903 - RNA, 21 nt, Human
gcugcuuggagcgcugccucg

SEQ ID NO: 46904 - RNA, 22 nt, Human
gcccagacugaagugcaguggc

SEQ ID NO: 46905 - RNA, 25 nt, Human
ugcuauacuggauacucugcuccgg

SEQ ID NO: 46906 - RNA, 26 nt, Human
ccauuuuacagaugaggaaacugaag

SEQ ID NO: 46907 - RNA, 22 nt, Human
gucgcccuggcuggagugcaau

SEQ ID NO: 46908 - RNA, 20 nt, Human
uugagaagccaccuaaagcu

SEQ ID NO: 46909 - RNA, 25 nt, Human
uaucugaaauuuugcuacugguauc

SEQ ID NO: 46910 - RNA, 19 nt, Human
cagaagaauuucaugugaa

SEQ ID NO: 46911 - RNA, 24 nt, Human
gaccacaggcugguguguaggugg

SEQ ID NO: 46912 - RNA, 27 nt, Human
ccccaagauuucagauauucugcucua

SEQ ID NO: 46913 - RNA, 28 nt, Human
gcugggaccauaggcucacaacaccaca

SEQ ID NO: 46914 - RNA, 26 nt, Human
ccucuacugggcgugcugccaaggcc

SEQ ID NO: 46915 - RNA, 21 nt, Human
gcauaucaaugugguggagaa

SEQ ID NO: 46916 - RNA, 27 nt, Human
ccauuugucuguguuuucuucuugugg

SEQ ID NO: 46917 - RNA, 17 nt, Human
cugcccuuuugcuuccc

SEQ ID NO: 46918 - RNA, 27 nt, Human
cuacaucuucccugcuuacucucugcc

SEQ ID NO: 46919 - RNA, 22 nt, Human
ugggucacgccuguaaucccag

SEQ ID NO: 46920 - RNA, 21 nt, Human
gggggccagugccugcagccu

SEQ ID NO: 46921 - RNA, 21 nt, Human
auguaaaagacuuuuuuccca

SEQ ID NO: 46922 - RNA, 21 nt, Human
ucgguucuccccuucccggcu

SEQ ID NO: 46923 - RNA, 27 nt, Human
agcucacuuaggcagggccucuggcug

SEQ ID NO: 46924 - RNA, 22 nt, Human
gcuucugcuacuaaaauguucu

SEQ ID NO: 46925 - RNA, 21 nt, Human
augauauggagguucaaugag

SEQ ID NO: 46926 - RNA, 22 nt, Human
uucucucucggguccgcacuca

SEQ ID NO: 46927 - RNA, 24 nt, Human
uuuuugggggaaggucagcccagc

SEQ ID NO: 46928 - RNA, 24 nt, Human
gugcuauaguuuucacuccaguca

SEQ ID NO: 46929 - RNA, 27 nt, Human
gacucacaaggggcuucuuggccugca

SEQ ID NO: 46930 - RNA, 27 nt, Human
ugaauccuggcucugauuuuuuacugg

SEQ ID NO: 46931 - RNA, 21 nt, Human
auccuugguaccacagucaca

SEQ ID NO: 46932 - RNA, 23 nt, Human
cugcccuuucccugcauaugcuu

SEQ ID NO: 46933 - RNA, 23 nt, Human
cccaggaggcggagguugcagug

SEQ ID NO: 46934 - RNA, 27 nt, Human
cuucuguaauuuuuugcccaccugccu

SEQ ID NO: 46935 - RNA, 27 nt, Human
guucucauuguucaaauagagcuguuc

SEQ ID NO: 46936 - RNA, 21 nt, Human
cuguccuguacccucuaccuc

SEQ ID NO: 46937 - RNA, 27 nt, Human
aagugcuucaacccgcgccggcggcga

SEQ ID NO: 46938 - RNA, 19 nt, Human
ccugccuccugccugcccc

SEQ ID NO: 46939 - RNA, 20 nt, Human
cggccccuccuggaaucgcc

SEQ ID NO: 46940 - RNA, 24 nt, Human
cgucauccaggcuggacaguucag

SEQ ID NO: 46941 - RNA, 25 nt, Human
agcagaugcaaacggggaggcagag

SEQ ID NO: 46942 - RNA, 22 nt, Human
ccgaguagcugggauugcaggc

SEQ ID NO: 46943 - RNA, 25 nt, Human
gggagagagaguuugagacagcucc

SEQ ID NO: 46944 - RNA, 24 nt, Human
gagagggaagcuggcugggcuggc

SEQ ID NO: 46945 - RNA, 26 nt, Human
aaaagcauuaugaaggaaggcuuggu

SEQ ID NO: 46946 - RNA, 18 nt, Human
cugccucucuuccgaguc

SEQ ID NO: 46947 - RNA, 26 nt, Human
gucuaaaaugagaaaaaagagagaaa

SEQ ID NO: 46948 - RNA, 22 nt, Human
cuccucuuggaaccaaaggacu

SEQ ID NO: 46949 - RNA, 18 nt, Human
gacaccagccacucagag

SEQ ID NO: 46950 - RNA, 25 nt, Human
gaggagaggcccucuggccgccuca

SEQ ID NO: 46951 - RNA, 27 nt, Human
ccccacccuccccacccggggaagcca

SEQ ID NO: 46952 - RNA, 23 nt, Human
ggagagggggagggggcuguggu

SEQ ID NO: 46953 - RNA, 25 nt, Human
cugccaccugggcccggagccucca

SEQ ID NO: 46954 - RNA, 22 nt, Human
agacuagccugggcaacauggu

SEQ ID NO: 46955 - RNA, 25 nt, Human
ggagcugggggaaggcaggagccuu

SEQ ID NO: 46956 - RNA, 25 nt, Human
uucucucuuguccuucacaucacca

SEQ ID NO: 46957 - RNA, 19 nt, Human
cugcuguuccaagggcaca

SEQ ID NO: 46958 - RNA, 31 nt, Human
agaguaaauucucucccucccuacugaggcc

SEQ ID NO: 46959 - RNA, 26 nt, Human
ggagagaacaagaggagagaugccug

SEQ ID NO: 46960 - RNA, 26 nt, Human
augcugaugaccucaaguagcacuga

SEQ ID NO: 46961 - RNA, 24 nt, Human
ggaaauauugaguaauuuguaauc

SEQ ID NO: 46962 - RNA, 26 nt, Human
uucuccaggagccagggggugacugg

SEQ ID NO: 46963 - RNA, 20 nt, Human
cccuggacugcagugcagga

SEQ ID NO: 46964 - RNA, 23 nt, Human
ccuguacugcaguggugccuuca

SEQ ID NO: 46965 - RNA, 25 nt, Human
aggaauguuaacauguaugacaggg

SEQ ID NO: 46966 - RNA, 22 nt, Human
ugaggaaacgucucucccacug

SEQ ID NO: 46967 - RNA, 21 nt, Human
cccuuccuccccaaccugcaa

SEQ ID NO: 46968 - RNA, 25 nt, Human
guauuuauuaauucugucaugugca

SEQ ID NO: 46969 - RNA, 28 nt, Human
ccaagcaaaggcuucaaggcucugagcc

SEQ ID NO: 46970 - RNA, 21 nt, Human
gccucaugccuguaaucccag

SEQ ID NO: 46971 - RNA, 25 nt, Human
cggcggcggcgggcaguugcagugg

SEQ ID NO: 46972 - RNA, 27 nt, Human
gcuucccugucucuuccugccugugua

SEQ ID NO: 46973 - RNA, 24 nt, Human
ugguuaaauaaggcaguguggccu

SEQ ID NO: 46974 - RNA, 22 nt, Human
caggccagggaaagcccguguc

SEQ ID NO: 46975 - RNA, 23 nt, Human
guugcucccuucuguccucagca

SEQ ID NO: 46976 - RNA, 24 nt, Human
ucaagccccaguagcaggagaaag

SEQ ID NO: 46977 - RNA, 25 nt, Human
uuucuuggcuuuugcuccuggaguu

SEQ ID NO: 46978 - RNA, 27 nt, Human
ucaugagguggagcaguuccuguguug

SEQ ID NO: 46979 - RNA, 24 nt, Human
cacuaguugagcuaauaugcgugu

SEQ ID NO: 46980 - RNA, 20 nt, Human
ucucucauaggugcaaccug

SEQ ID NO: 46981 - RNA, 26 nt, Human
acuguacuguauuuuuauauugcugu

SEQ ID NO: 46982 - RNA, 21 nt, Human
augccuaacaccuuccucuca

SEQ ID NO: 46983 - RNA, 22 nt, Human
ggugacggggcccugccgccgc

SEQ ID NO: 46984 - RNA, 21 nt, Human
cucaaagccauuuccacucag

SEQ ID NO: 46985 - RNA, 22 nt, Human
uggcuccaacacugcugcucca

SEQ ID NO: 46986 - RNA, 26 nt, Human
ugggacaaguggggagcccaagaaag

SEQ ID NO: 46987 - RNA, 23 nt, Human
guuccacugcaaauaaagccuuu

SEQ ID NO: 46988 - RNA, 25 nt, Human
cugagaccuccagaaaucuauucca

SEQ ID NO: 46989 - RNA, 20 nt, Human
aagcgucagcugaguuucca

SEQ ID NO: 46990 - RNA, 23 nt, Human
gguccagccuguucacacugcac

SEQ ID NO: 46991 - RNA, 20 nt, Human
cacaugcccauucacaccac

SEQ ID NO: 46992 - RNA, 21 nt, Human
ggagagcugcugaggagccag

SEQ ID NO: 46993 - RNA, 27 nt, Human
agcaguuucgauuuugccugugaauau

SEQ ID NO: 46994 - RNA, 22 nt, Human
cacugcacuccggccuaggcaa

SEQ ID NO: 46995 - RNA, 27 nt, Human
cuucaaaaacuuugggaaaggguggga

SEQ ID NO: 46996 - RNA, 27 nt, Human
gaguacaccuagagagcuuggcuguuu

SEQ ID NO: 46997 - RNA, 21 nt, Human
gggccucccgcccaccugccu

SEQ ID NO: 46998 - RNA, 17 nt, Human
gacucacuucucuuuuu

SEQ ID NO: 46999 - RNA, 22 nt, Human
ggcaggggacagaugugcugcu

SEQ ID NO: 47000 - RNA, 20 nt, Human
aggcccaugggaagaagggg

SEQ ID NO: 47001 - RNA, 26 nt, Human
ucucaaacuccugaccucaagugauc

SEQ ID NO: 47002 - RNA, 22 nt, Human
ccagaggcccuggaggucucca

SEQ ID NO: 47003 - RNA, 31 nt, Human
agggaguuggcaggauggcagagggcaaggc

SEQ ID NO: 47004 - RNA, 19 nt, Human
gccucucugucgcugucgc

SEQ ID NO: 47005 - RNA, 20 nt, Human
ucuuguuugcacuccagaaa

SEQ ID NO: 47006 - RNA, 23 nt, Human
uguaauaaacuauuuuuguacca

SEQ ID NO: 47007 - RNA, 20 nt, Human
gggaguuggcuucugauucu

SEQ ID NO: 47008 - RNA, 27 nt, Human
uccucaucaauucucaggcugcaggga

SEQ ID NO: 47009 - RNA, 22 nt, Human
gcguccuccaccaugccuggcu

SEQ ID NO: 47010 - RNA, 24 nt, Human
agcagagcaggcaggcagagugga

SEQ ID NO: 47011 - RNA, 27 nt, Human
ccugcagcuccaugugcaagaagcuuu

SEQ ID NO: 47012 - RNA, 19 nt, Human
ucaaguugugaacaagcac

SEQ ID NO: 47013 - RNA, 24 nt, Human
gcgaaaucccugcucacugcagcc

SEQ ID NO: 47014 - RNA, 22 nt, Human
ccaggcagaaccaggacaggug

SEQ ID NO: 47015 - RNA, 20 nt, Human
acgccguccuggcugcgcag

SEQ ID NO: 47016 - RNA, 27 nt, Human
guugcccaggcuagcaugcaauggugu

SEQ ID NO: 47017 - RNA, 22 nt, Human
uguuacaggcugcauagggaau

SEQ ID NO: 47018 - RNA, 21 nt, Human
gcuauucuacugccucagccu

SEQ ID NO: 47019 - RNA, 23 nt, Human
gugcaccaccacacccagccaaa

SEQ ID NO: 47020 - RNA, 25 nt, Human
ccagcaccugguugauguguauuca

SEQ ID NO: 47021 - RNA, 26 nt, Human
gcauuuuccucuuguccuggcccuuc

SEQ ID NO: 47022 - RNA, 27 nt, Human
acugcugcucccgcccuuucgcuccuc

SEQ ID NO: 47023 - RNA, 24 nt, Human
gaaacagcauucuucuucagugaa

SEQ ID NO: 47024 - RNA, 22 nt, Human
gaaguuaagugggcacaggugg

SEQ ID NO: 47025 - RNA, 20 nt, Human
caguguauauccacucagau

SEQ ID NO: 47026 - RNA, 19 nt, Human
aaacaccucauuguuuccc

SEQ ID NO: 47027 - RNA, 24 nt, Human
ucugagcacuuccuucugaguggg

SEQ ID NO: 47028 - RNA, 21 nt, Human
agcaggagaaagccagauucc

SEQ ID NO: 47029 - RNA, 23 nt, Human
cguucaugguccccauugcugag

SEQ ID NO: 47030 - RNA, 18 nt, Human
ccuuucucccugcgggcc

SEQ ID NO: 47031 - RNA, 25 nt, Human
ccuuugugugcauacgccucuuguu

SEQ ID NO: 47032 - RNA, 24 nt, Human
gcacagccuagacauccagguccc

SEQ ID NO: 47033 - RNA, 19 nt, Human
gcccucuuucaucuguaag

SEQ ID NO: 47034 - RNA, 21 nt, Human
ccaaagugcugggauuacagc

SEQ ID NO: 47035 - RNA, 24 nt, Human
aaaagacagcaguagccauuugua

SEQ ID NO: 47036 - RNA, 19 nt, Human
gggauuacaggcaugcacu

SEQ ID NO: 47037 - RNA, 26 nt, Human
cagaagaaaaaguugcagucucagaa

SEQ ID NO: 47038 - RNA, 21 nt, Human
aagaggaaccaggaggacaag

SEQ ID NO: 47039 - RNA, 20 nt, Human
cucaguuccugaccucugcu

SEQ ID NO: 47040 - RNA, 21 nt, Human
cugaucuggacucaccucugg

SEQ ID NO: 47041 - RNA, 21 nt, Human
ugcgcucugggccagcgcucg

SEQ ID NO: 47042 - RNA, 21 nt, Human
ggcagggccagccucuccucu

SEQ ID NO: 47043 - RNA, 27 nt, Human
gcugcagccuccgccuacgugagaaga

SEQ ID NO: 47044 - RNA, 26 nt, Human
ucuccaccucacuagcuccccaaucc

SEQ ID NO: 47045 - RNA, 20 nt, Human
gcugggaauaagugccagga

SEQ ID NO: 47046 - RNA, 25 nt, Human
cggaaaggaggggacuucuccugca

SEQ ID NO: 47047 - RNA, 26 nt, Human
uccacaucaaaagaagaacuaugaca

SEQ ID NO: 47048 - RNA, 27 nt, Human
ugcagugagcuaagaucacaucacugc

SEQ ID NO: 47049 - RNA, 24 nt, Human
aaaauucaaaauuagccuggugug

SEQ ID NO: 47050 - RNA, 22 nt, Human
aagcagacacacacauauauac

SEQ ID NO: 47051 - RNA, 22 nt, Human
ucucccacuuuuccauaagcag

SEQ ID NO: 47052 - RNA, 19 nt, Human
ugggugaaucaugagguca

SEQ ID NO: 47053 - RNA, 21 nt, Human
uuucauuuguugcugaaugcu

SEQ ID NO: 47054 - RNA, 26 nt, Human
ggugcacgcaggcacagcagcugcag

SEQ ID NO: 47055 - RNA, 25 nt, Human
auuuauacugaaugaguuacuguaa

SEQ ID NO: 47056 - RNA, 24 nt, Human
cauuagugucucccgggccugucc

SEQ ID NO: 47057 - RNA, 20 nt, Human
uggccugguuuucucagacg

SEQ ID NO: 47058 - RNA, 28 nt, Human
uggcacaacuuuaccucugugggagaug

SEQ ID NO: 47059 - RNA, 23 nt, Human
gcuaaacauuaacuacaauucac

SEQ ID NO: 47060 - RNA, 23 nt, Human
accuugcucucaucaccagcuag

SEQ ID NO: 47061 - RNA, 20 nt, Human
auggcagccauucugccuuu

SEQ ID NO: 47062 - RNA, 20 nt, Human
auauuugguaauuagguugg

SEQ ID NO: 47063 - RNA, 26 nt, Human
gcucacuggucccugccagacuggug

SEQ ID NO: 47064 - RNA, 23 nt, Human
cagaccaaugggcuccauguucu

SEQ ID NO: 47065 - RNA, 21 nt, Human
uggaauucuccuucuguccag

SEQ ID NO: 47066 - RNA, 20 nt, Human
gaauugccuucuaauguuau

SEQ ID NO: 47067 - RNA, 21 nt, Human
caacuuggccucccacacguu

SEQ ID NO: 47068 - RNA, 21 nt, Human
cacuguaccagccucugauaa

SEQ ID NO: 47069 - RNA, 23 nt, Human
ugcuagagcgagacccacacaac

SEQ ID NO: 47070 - RNA, 21 nt, Human
accuguaaucccaacacuuug

SEQ ID NO: 47071 - RNA, 25 nt, Human
uucuguguccuuuuaucucucagac

SEQ ID NO: 47072 - RNA, 20 nt, Human
ucuccugccagcaccaagca

SEQ ID NO: 47073 - RNA, 26 nt, Human
uccagucagcagauggucagcagguu

SEQ ID NO: 47074 - RNA, 21 nt, Human
uccucauggauuugaaugaaa

SEQ ID NO: 47075 - RNA, 24 nt, Human
cuaucccacaucagaaucacuggg

SEQ ID NO: 47076 - RNA, 22 nt, Human
uguugcccaggcuggugugcaa

SEQ ID NO: 47077 - RNA, 25 nt, Human
ucauuugauacugguauuaagcuga

SEQ ID NO: 47078 - RNA, 20 nt, Human
ggacaggcacacacaugcag

SEQ ID NO: 47079 - RNA, 19 nt, Human
acauucuucuacuuguuua

SEQ ID NO: 47080 - RNA, 23 nt, Human
ccacagaaagcuguucuuuacau

SEQ ID NO: 47081 - RNA, 23 nt, Human
auuuucaggagggacgugcaaua

SEQ ID NO: 47082 - RNA, 21 nt, Human
cucaagauuccccuccagaaa

SEQ ID NO: 47083 - RNA, 18 nt, Human
uacugguuucugcuuucu

SEQ ID NO: 47084 - RNA, 25 nt, Human
ucaaaugaugcaaaauauauacaag

SEQ ID NO: 47085 - RNA, 24 nt, Human
gcccuuccuucuccccagaagacc

SEQ ID NO: 47086 - RNA, 23 nt, Human
gccuccgcggccgagagugcagc

SEQ ID NO: 47087 - RNA, 28 nt, Human
cccaugcacuugcacguccaggacuccu

SEQ ID NO: 47088 - RNA, 21 nt, Human
caucucuauacuguacacuca

SEQ ID NO: 47089 - RNA, 24 nt, Human
ccuucuuguaaauaccugccuccc

SEQ ID NO: 47090 - RNA, 18 nt, Human
gcugcacacguguggacc

SEQ ID NO: 47091 - RNA, 22 nt, Human
gcuuuuucucccuccccauguc

SEQ ID NO: 47092 - RNA, 22 nt, Human
uuguuguuauuuugaaaaacac

SEQ ID NO: 47093 - RNA, 22 nt, Human
cuuugcuccuggugagagcuua

SEQ ID NO: 47094 - RNA, 20 nt, Human
uuuucaucuugagguggcca

SEQ ID NO: 47095 - RNA, 22 nt, Human
uucugccggguaauggcugcuu

SEQ ID NO: 47096 - RNA, 26 nt, Human
gccaagucccuggugcuggguuugcu

SEQ ID NO: 47097 - RNA, 25 nt, Human
caccagguucuccugccaccaagau

SEQ ID NO: 47098 - RNA, 21 nt, Human
gcccuuggcaacacuggagug

SEQ ID NO: 47099 - RNA, 25 nt, Human
uauuugacccugugggaggauggua

SEQ ID NO: 47100 - RNA, 23 nt, Human
ugugcuuuuauguuuaauuuuau

SEQ ID NO: 47101 - RNA, 22 nt, Human
auaugggaaacuaaaucugccg

SEQ ID NO: 47102 - RNA, 26 nt, Human
gcauuaaaaagcaaagggaaaaagga

SEQ ID NO: 47103 - RNA, 22 nt, Human
gaucccuuuucgucacacucag

SEQ ID NO: 47104 - RNA, 26 nt, Human
uuguucugcucauuguguuugugaca

SEQ ID NO: 47105 - RNA, 22 nt, Human
cacgccuguaaucccaguacuu

SEQ ID NO: 47106 - RNA, 25 nt, Human
gcagcagcucgccuaccucugagcc

SEQ ID NO: 47107 - RNA, 27 nt, Human
ccaccucuucucuucauacucucuacc

SEQ ID NO: 47108 - RNA, 23 nt, Human
auaacuucaaaaaucccaugguu

SEQ ID NO: 47109 - RNA, 22 nt, Human
agcucacugcaaccugugccuc

SEQ ID NO: 47110 - RNA, 22 nt, Human
gccccacccacccuccugggcc

SEQ ID NO: 47111 - RNA, 23 nt, Human
gccucacucaucccuccuguacc

SEQ ID NO: 47112 - RNA, 19 nt, Human
ggggguggggaggcaagaa

SEQ ID NO: 47113 - RNA, 21 nt, Human
aauccuucucauagugaagca

SEQ ID NO: 47114 - RNA, 27 nt, Human
uuucuaugccuucugacccaguuuccc

SEQ ID NO: 47115 - RNA, 21 nt, Human
ugcuuugggacuuugucaucu

SEQ ID NO: 47116 - RNA, 27 nt, Human
cuuguccaucugauucaggagaucacu

SEQ ID NO: 47117 - RNA, 26 nt, Human
caggccccuuuucacucccuccauca

SEQ ID NO: 47118 - RNA, 22 nt, Human
auuccuuaaaauauaacugaga

SEQ ID NO: 47119 - RNA, 23 nt, Human
ccacagcccuaaauccaugauaa

SEQ ID NO: 47120 - RNA, 19 nt, Human
ccgauucacaaccaaccag

SEQ ID NO: 47121 - RNA, 22 nt, Human
cgccauagaguuccagacauau

SEQ ID NO: 47122 - RNA, 22 nt, Human
aacccugcuucugcugcccuga

SEQ ID NO: 47123 - RNA, 22 nt, Human
acaaaccugcacauccugcaca

SEQ ID NO: 47124 - RNA, 17 nt, Human
ucgacgucucucucacc

SEQ ID NO: 47125 - RNA, 24 nt, Human
cguuugugcagaaucucuauguau

SEQ ID NO: 47126 - RNA, 22 nt, Human
ugcagugagccgagauagcacc

SEQ ID NO: 47127 - RNA, 26 nt, Human
ccgcugucugugcgcccaccucugcu

SEQ ID NO: 47128 - RNA, 22 nt, Human
uggcuucagcuccagccccuuu

SEQ ID NO: 47129 - RNA, 21 nt, Human
cccccuggcccugccucaucc

SEQ ID NO: 47130 - RNA, 25 nt, Human
gccucuugaaguggauuuaacuaaa

SEQ ID NO: 47131 - RNA, 27 nt, Human
uugcauauuucuuaggacaugcaucuu

SEQ ID NO: 47132 - RNA, 22 nt, Human
ccagggccaggguuccaaaaag

SEQ ID NO: 47133 - RNA, 26 nt, Human
acaaacaaggaagcacauuguguaca

SEQ ID NO: 47134 - RNA, 18 nt, Human
cugccacccacacgcccu

SEQ ID NO: 47135 - RNA, 22 nt, Human
ccuccugucucuccacucugga

SEQ ID NO: 47136 - RNA, 30 nt, Human
ggcuuuaguucugcuuucugccucuccucc

SEQ ID NO: 47137 - RNA, 20 nt, Human
ugccccugacacugcacuga

SEQ ID NO: 47138 - RNA, 22 nt, Human
cuucugcagccccuccccacca

SEQ ID NO: 47139 - RNA, 24 nt, Human
aaagaauaauauauuggguacaau

SEQ ID NO: 47140 - RNA, 24 nt, Human
gcaccuuguggaaucuguuuccua

SEQ ID NO: 47141 - RNA, 22 nt, Human
uuuugaauauccuggucacauc

SEQ ID NO: 47142 - RNA, 27 nt, Human
cucucuguggucccuuccaaugcugug

SEQ ID NO: 47143 - RNA, 22 nt, Human
ucuucuaaaaugggaucaugcc

SEQ ID NO: 47144 - RNA, 24 nt, Human
gccguggcacgaucucagcucacu

SEQ ID NO: 47145 - RNA, 22 nt, Human
cuggggagaaagggaagucagg

SEQ ID NO: 47146 - RNA, 23 nt, Human
accugauggaacauuugcaccug

SEQ ID NO: 47147 - RNA, 25 nt, Human
uucagcuugggcaagugugugccug

SEQ ID NO: 47148 - RNA, 19 nt, Human
gagguugaggcguacugga

SEQ ID NO: 47149 - RNA, 26 nt, Human
ggaaacucuuacaggccaggaagcca

SEQ ID NO: 47150 - RNA, 28 nt, Human
gcgcagccccgagcugggcagugucccc

SEQ ID NO: 47151 - RNA, 23 nt, Human
ucuucuuguaaaagugcuuuuca

SEQ ID NO: 47152 - RNA, 22 nt, Human
cucuccaagaggauaugggaag

SEQ ID NO: 47153 - RNA, 22 nt, Human
gauuacaggcgugggccgccgc

SEQ ID NO: 47154 - RNA, 27 nt, Human
cgcggcccagacccagcccgcggccug

SEQ ID NO: 47155 - RNA, 23 nt, Human
ccugugccucggcuuuucucagc

SEQ ID NO: 47156 - RNA, 23 nt, Human
uucgcugcccuuguucagcagug

SEQ ID NO: 47157 - RNA, 26 nt, Human
caucauaccacugcccuccaaaucua

SEQ ID NO: 47158 - RNA, 19 nt, Human
auccaggcuggagugcagu

SEQ ID NO: 47159 - RNA, 21 nt, Human
ucaggcugggcucuguagcgu

SEQ ID NO: 47160 - RNA, 19 nt, Human
aaaaguugcacuauugcaa

SEQ ID NO: 47161 - RNA, 18 nt, Human
cuagaggaauagacucag

SEQ ID NO: 47162 - RNA, 25 nt, Human
cuccaucuucugcguucccccaguu

SEQ ID NO: 47163 - RNA, 26 nt, Human
caccuugcagcgcauuccaaccaccu

SEQ ID NO: 47164 - RNA, 20 nt, Human
uuauuuauuuagaaaugcuu

SEQ ID NO: 47165 - RNA, 22 nt, Human
ggagguuaagugacuugcccag

SEQ ID NO: 47166 - RNA, 21 nt, Human
gcucacugagcugcugcuuuu

SEQ ID NO: 47167 - RNA, 27 nt, Human
ggaggcugaggcacaagaaucgcuuga

SEQ ID NO: 47168 - RNA, 21 nt, Human
cgggguggaaguggggguggg

SEQ ID NO: 47169 - RNA, 25 nt, Human
gcccaggcuggagugcaguggugag

SEQ ID NO: 47170 - RNA, 25 nt, Human
uggccacugcugcagacaccugccu

SEQ ID NO: 47171 - RNA, 27 nt, Human
uguuuuuaaaacucagaauucuuuccu

SEQ ID NO: 47172 - RNA, 23 nt, Human
ggccacagacucuccuguccccc

SEQ ID NO: 47173 - RNA, 21 nt, Human
ccgggcaugguggcacaugcc

SEQ ID NO: 47174 - RNA, 21 nt, Human
uaccccgauggccaagcaauu

SEQ ID NO: 47175 - RNA, 22 nt, Human
cuuggacauacaccaccagguc

SEQ ID NO: 47176 - RNA, 22 nt, Human
gcaugacucuagucacagcagg

SEQ ID NO: 47177 - RNA, 26 nt, Human
gcugggacagugugggugggagacca

SEQ ID NO: 47178 - RNA, 21 nt, Human
gcagagccggggcugggcuag

SEQ ID NO: 47179 - RNA, 21 nt, Human
guaagcucaggauauggcuua

SEQ ID NO: 47180 - RNA, 23 nt, Human
ugccaggucaaggugggggcagg

SEQ ID NO: 47181 - RNA, 19 nt, Human
gccaucucucccuccugcc

SEQ ID NO: 47182 - RNA, 21 nt, Human
ggacucagaauaaauguaaua

SEQ ID NO: 47183 - RNA, 26 nt, Human
uggccaggguagacuuggagcugucc

SEQ ID NO: 47184 - RNA, 27 nt, Human
ucagccaggcuggagcaagguaccuuu

SEQ ID NO: 47185 - RNA, 26 nt, Human
cacacugaggccaccuagcaagguag

SEQ ID NO: 47186 - RNA, 24 nt, Human
gagaauaaauauauaaauaaauac

SEQ ID NO: 47187 - RNA, 19 nt, Human
ccgcuccuccaggucucca

SEQ ID NO: 47188 - RNA, 23 nt, Human
cuggauucugguucugacagggc

SEQ ID NO: 47189 - RNA, 27 nt, Human
acagauggauaaaugaggcugauguuu

SEQ ID NO: 47190 - RNA, 22 nt, Human
gugguggcacgaucacagcuca

SEQ ID NO: 47191 - RNA, 20 nt, Human
aguucagcaaaacugaaagg

SEQ ID NO: 47192 - RNA, 23 nt, Human
cugcucuuuuucccaaaagguaa

SEQ ID NO: 47193 - RNA, 21 nt, Human
gagggccugcuggcugagaua

SEQ ID NO: 47194 - RNA, 26 nt, Human
uggaaauagauauuugugcagcucaa

SEQ ID NO: 47195 - RNA, 22 nt, Human
ccugccucugcuccugccuggu

SEQ ID NO: 47196 - RNA, 23 nt, Human
ggccuugccagaguggcuucuga

SEQ ID NO: 47197 - RNA, 21 nt, Human
ucuagggcuaguagaacugga

SEQ ID NO: 47198 - RNA, 23 nt, Human
ugaguggcugggauugcaggugu

SEQ ID NO: 47199 - RNA, 21 nt, Human
cuccacccuggcaggaauccc

SEQ ID NO: 47200 - RNA, 22 nt, Human
uucaaaccccuuuuucuugcuu

SEQ ID NO: 47201 - RNA, 18 nt, Human
gagagugaggauggcaga

SEQ ID NO: 47202 - RNA, 21 nt, Human
ucucucaaacugcuaauugcg

SEQ ID NO: 47203 - RNA, 24 nt, Human
uuggaucugcaagaacacuggacc

SEQ ID NO: 47204 - RNA, 21 nt, Human
guuugcuuuggacaccccaaa

SEQ ID NO: 47205 - RNA, 28 nt, Human
accacguucuuagccuagauugagcuua

SEQ ID NO: 47206 - RNA, 21 nt, Human
aacauggcucacaaauuucua

SEQ ID NO: 47207 - RNA, 22 nt, Human
gcaaagugcacugaugugugag

SEQ ID NO: 47208 - RNA, 21 nt, Human
cucccucucugcaccugucuc

SEQ ID NO: 47209 - RNA, 22 nt, Human
agccagacaucucucccccuca

SEQ ID NO: 47210 - RNA, 23 nt, Human
aaccauggacugagucacagcag

SEQ ID NO: 47211 - RNA, 20 nt, Human
ucauuaaauaaauuugacuu

SEQ ID NO: 47212 - RNA, 22 nt, Human
uuuauugagcugaaaugauguu

SEQ ID NO: 47213 - RNA, 23 nt, Human
guaccuccugccagcaucucuug

SEQ ID NO: 47214 - RNA, 20 nt, Human
uaauaaaauugugugaucaa

SEQ ID NO: 47215 - RNA, 22 nt, Human
ucagcacgccguaaccaggggc

SEQ ID NO: 47216 - RNA, 21 nt, Human
cuagcaguuuaaaccccacuu

SEQ ID NO: 47217 - RNA, 20 nt, Human
uccaggccuaagacuagguu

SEQ ID NO: 47218 - RNA, 25 nt, Human
acggucgguuccaagugggccuggg

SEQ ID NO: 47219 - RNA, 24 nt, Human
uucuccagggucagaaacaggacc

SEQ ID NO: 47220 - RNA, 20 nt, Human
cacugcacuccagucugguc

SEQ ID NO: 47221 - RNA, 24 nt, Human
acucacugccucauguggccccuu

SEQ ID NO: 47222 - RNA, 20 nt, Human
cugggugacagagcaaguga

SEQ ID NO: 47223 - RNA, 22 nt, Human
uuuuauaagauuuuagcauuaa

SEQ ID NO: 47224 - RNA, 22 nt, Human
gaaacauggugaaaccccgucu

SEQ ID NO: 47225 - RNA, 23 nt, Human
guucaagcuauucuccugccuca

SEQ ID NO: 47226 - RNA, 26 nt, Human
accaagacaauaccugcuacaguauu

SEQ ID NO: 47227 - RNA, 27 nt, Human
cugggcccugagaacgggugcccuuga

SEQ ID NO: 47228 - RNA, 22 nt, Human
gauugguggaaaguagggugga

SEQ ID NO: 47229 - RNA, 26 nt, Human
uucgaaucacuuuuaggauguaacuu

SEQ ID NO: 47230 - RNA, 22 nt, Human
gcgugagccaccaugcccagcc

SEQ ID NO: 47231 - RNA, 22 nt, Human
gcaugagccaccaugcccggcc

SEQ ID NO: 47232 - RNA, 19 nt, Human
ugcugcauucugccucucu

SEQ ID NO: 47233 - RNA, 27 nt, Human
gcucccuugacucaggacugugcucga

SEQ ID NO: 47234 - RNA, 26 nt, Human
ccuguugccccugccugcccagauuu

SEQ ID NO: 47235 - RNA, 24 nt, Human
gccacagguaugaaagucuugccu

SEQ ID NO: 47236 - RNA, 24 nt, Human
gucuucucccguccauuccaguca

SEQ ID NO: 47237 - RNA, 25 nt, Human
aacacaaaaucucauucuaccugca

SEQ ID NO: 47238 - RNA, 19 nt, Human
ugcaagccagggaugaaga

SEQ ID NO: 47239 - RNA, 21 nt, Human
gucuucccccacccccgggga

SEQ ID NO: 47240 - RNA, 27 nt, Human
auuagcuauuugcuguaaugucaagaa

SEQ ID NO: 47241 - RNA, 26 nt, Human
ggcauaucuggucagaacugcagggc

SEQ ID NO: 47242 - RNA, 23 nt, Human
cuguugaccuugguuuucucuuc

SEQ ID NO: 47243 - RNA, 21 nt, Human
agggcaccuuuccucagugag

SEQ ID NO: 47244 - RNA, 21 nt, Human
uaaccagcccucgacucuuag

SEQ ID NO: 47245 - RNA, 20 nt, Human
agcucuucaugcauucuuug

SEQ ID NO: 47246 - RNA, 19 nt, Human
ugcccaucccuuucuugag

SEQ ID NO: 47247 - RNA, 18 nt, Human
aagaggaagacggggcgg

SEQ ID NO: 47248 - RNA, 21 nt, Human
ggcacuccgaaagugugcggc

SEQ ID NO: 47249 - RNA, 22 nt, Human
uugccagaguuuugccugcugc

SEQ ID NO: 47250 - RNA, 21 nt, Human
cugguuagccaaaaaguccug

SEQ ID NO: 47251 - RNA, 23 nt, Human
uucugagaaacauggagcagcgc

SEQ ID NO: 47252 - RNA, 25 nt, Human
ugugcauauugagcuccugcugugg

SEQ ID NO: 47253 - RNA, 22 nt, Human
ccguugcgggguggagugaggu

SEQ ID NO: 47254 - RNA, 14 nt, Human
gugggugaagggga

SEQ ID NO: 47255 - RNA, 27 nt, Human
cacugcacuccagucuggcaacagagc

SEQ ID NO: 47256 - RNA, 25 nt, Human
gggaccacagagggcaggagcuugc

SEQ ID NO: 47257 - RNA, 19 nt, Human
uggucucaggccaagccca

SEQ ID NO: 47258 - RNA, 20 nt, Human
uguuuuuaaacuuguucuua

SEQ ID NO: 47259 - RNA, 24 nt, Human
aaaaagaguuuuucaaaauuagcc

SEQ ID NO: 47260 - RNA, 19 nt, Human
auuuugacaagcuuaaugu

SEQ ID NO: 47261 - RNA, 22 nt, Human
uggguugugcacauuucuuugc

SEQ ID NO: 47262 - RNA, 20 nt, Human
guuaacuacauauugucugg

SEQ ID NO: 47263 - RNA, 27 nt, Human
gcccagccuguguggcccugugaccug

SEQ ID NO: 47264 - RNA, 20 nt, Human
auuauuuggcuuaaaccaga

SEQ ID NO: 47265 - RNA, 19 nt, Human
gcaaccuguggcucagggg

SEQ ID NO: 47266 - RNA, 20 nt, Human
cccacuccagggaucugcca

SEQ ID NO: 47267 - RNA, 21 nt, Human
uggugggggaggcagggcagg

SEQ ID NO: 47268 - RNA, 19 nt, Human
ccagcacgagccugggcga

SEQ ID NO: 47269 - RNA, 21 nt, Human
gcucugggcuggcacaugugu

SEQ ID NO: 47270 - RNA, 20 nt, Human
ucugcucccccuuuucccuc

SEQ ID NO: 47271 - RNA, 20 nt, Human
uuccucucaucuccccaccg

SEQ ID NO: 47272 - RNA, 20 nt, Human
guuuaaucccagcacuuugg

SEQ ID NO: 47273 - RNA, 24 nt, Human
agcccucccuuccuuccucugccg

SEQ ID NO: 47274 - RNA, 20 nt, Human
ucccgcugcaccucuuguuu

SEQ ID NO: 47275 - RNA, 21 nt, Human
uaccuggaugauucaggagag

SEQ ID NO: 47276 - RNA, 15 nt, Human
ccaauauagaaaaau

SEQ ID NO: 47277 - RNA, 22 nt, Human
acaaucacaguucacugcagcc

SEQ ID NO: 47278 - RNA, 26 nt, Human
ggagggagggagaggguuuagaaaua

SEQ ID NO: 47279 - RNA, 21 nt, Human
acacagaccacauauuuggac

SEQ ID NO: 47280 - RNA, 20 nt, Human
uuuagcaggcugcagcaggc

SEQ ID NO: 47281 - RNA, 26 nt, Human
uuucauguucuuguauugcaaccuaa

SEQ ID NO: 47282 - RNA, 21 nt, Human
cuugcagaguacaugauagca

SEQ ID NO: 47283 - RNA, 20 nt, Human
uucccuuuuaaaugcaaauc

SEQ ID NO: 47284 - RNA, 20 nt, Human
aagguuugggggaauuugug

SEQ ID NO: 47285 - RNA, 24 nt, Human
ugauggccaagcugcaucagccgc

SEQ ID NO: 47286 - RNA, 23 nt, Human
uuggugccucaguuuccugaccu

SEQ ID NO: 47287 - RNA, 21 nt, Human
gaagcagcugaggaaagggag

SEQ ID NO: 47288 - RNA, 23 nt, Human
ccugacacaagaaguucuuguuc

SEQ ID NO: 47289 - RNA, 27 nt, Human
ggggagggaagauaaagugaauugccc

SEQ ID NO: 47290 - RNA, 25 nt, Human
agagagaagggagaggccuccuucu

SEQ ID NO: 47291 - RNA, 22 nt, Human
ugguggacaccuguagucccag

SEQ ID NO: 47292 - RNA, 27 nt, Human
uacccaggcuggggcuucugggacagg

SEQ ID NO: 47293 - RNA, 22 nt, Human
ucugagcguccacuucugcacu

SEQ ID NO: 47294 - RNA, 23 nt, Human
uguuuauuaaaaagcaugauuuu

SEQ ID NO: 47295 - RNA, 22 nt, Human
aacucucaguccaacauuauuu

SEQ ID NO: 47296 - RNA, 20 nt, Human
uacuauaugcuauuaauaca

SEQ ID NO: 47297 - RNA, 21 nt, Human
cuuucugcaagaccuuuggcu

SEQ ID NO: 47298 - RNA, 23 nt, Human
agggaaagggguacacugaggga

SEQ ID NO: 47299 - RNA, 19 nt, Human
uuucuuuccuacacacucu

SEQ ID NO: 47300 - RNA, 22 nt, Human
uaucacaaaaugauauuuaaua

SEQ ID NO: 47301 - RNA, 26 nt, Human
uggcagcauggagagccucuuaguga

SEQ ID NO: 47302 - RNA, 19 nt, Human
cuacugguuagaaggugag

SEQ ID NO: 47303 - RNA, 22 nt, Human
accugguaacauaaaagcaguu

SEQ ID NO: 47304 - RNA, 21 nt, Human
auggggcacugacccaggagg

SEQ ID NO: 47305 - RNA, 26 nt, Human
aggccagaaucauuccuaguacauuu

SEQ ID NO: 47306 - RNA, 20 nt, Human
agacgcagaaaauuggugag

SEQ ID NO: 47307 - RNA, 20 nt, Human
cugccuuuuaaugucucauu

SEQ ID NO: 47308 - RNA, 22 nt, Human
gagcuaggagccggaagcuggg

SEQ ID NO: 47309 - RNA, 21 nt, Human
uuugggacucagauggcagga

SEQ ID NO: 47310 - RNA, 21 nt, Human
uucuccaaauuugacagcaga

SEQ ID NO: 47311 - RNA, 22 nt, Human
augaccaaauauuuuguaucgg

SEQ ID NO: 47312 - RNA, 22 nt, Human
ucuucccucagccucgccugcu

SEQ ID NO: 47313 - RNA, 21 nt, Human
ucucucauugucuguguagag

SEQ ID NO: 47314 - RNA, 23 nt, Human
ugggcguugauuguuacaggucc

SEQ ID NO: 47315 - RNA, 22 nt, Human
aauggcucugcccugcaccuua

SEQ ID NO: 47316 - RNA, 22 nt, Human
uacucauauagauauauuguca

SEQ ID NO: 47317 - RNA, 21 nt, Human
ucugauuucaccccagaguug

SEQ ID NO: 47318 - RNA, 22 nt, Human
auuuggcuguuucuaaguugua

SEQ ID NO: 47319 - RNA, 22 nt, Human
ggauuuuguuaaucaaauuuau

SEQ ID NO: 47320 - RNA, 20 nt, Human
ccucucucccugccuguuuu

SEQ ID NO: 47321 - RNA, 26 nt, Human
cugucucucuggcuccugaccuggcc

SEQ ID NO: 47322 - RNA, 24 nt, Human
uguguucucugggcuuuauguauc

SEQ ID NO: 47323 - RNA, 27 nt, Human
ccugaguagcugggacuacaguugugc

SEQ ID NO: 47324 - RNA, 24 nt, Human
uuaggcauuaaauuuuagcaaaga

SEQ ID NO: 47325 - RNA, 25 nt, Human
acucacucugugcugggcuuuggua

SEQ ID NO: 47326 - RNA, 21 nt, Human
cgggagcggagguugcaguga

SEQ ID NO: 47327 - RNA, 20 nt, Human
guucuccaguugcugccucc

SEQ ID NO: 47328 - RNA, 21 nt, Human
gggagguagagguugcaguga

SEQ ID NO: 47329 - RNA, 22 nt, Human
cugccuccuggguuuaagcaau

SEQ ID NO: 47330 - RNA, 22 nt, Human
ugaaggaggauggaagggcagg

SEQ ID NO: 47331 - RNA, 22 nt, Human
ggaaacuuggcucgaaucucug

SEQ ID NO: 47332 - RNA, 22 nt, Human
uuguucacaucccauguagaaa

SEQ ID NO: 47333 - RNA, 22 nt, Human
ugcagugagccgagaucacgcc

SEQ ID NO: 47334 - RNA, 22 nt, Human
ugcagugagcugagaucaugcc

SEQ ID NO: 47335 - RNA, 22 nt, Human
ugcagugagccaagaucacacc

SEQ ID NO: 47336 - RNA, 25 nt, Human
cugcaaugccuauuccaaacuuuaa

SEQ ID NO: 47337 - RNA, 22 nt, Human
gcccaggauggagugcaguggu

SEQ ID NO: 47338 - RNA, 22 nt, Human
acaccugcccguugacccuugc

SEQ ID NO: 47339 - RNA, 22 nt, Human
ucaccaggcuggagugcagugc

SEQ ID NO: 47340 - RNA, 22 nt, Human
ucuuuuuaaagaagauaagauu

SEQ ID NO: 47341 - RNA, 22 nt, Human
uuucucuuacuugcuguacuau

SEQ ID NO: 47342 - RNA, 27 nt, Human
cuguggaauaugugcuggaaaaauugc

SEQ ID NO: 47343 - RNA, 24 nt, Human
cccugcucccugcccuccugggca

SEQ ID NO: 47344 - RNA, 25 nt, Human
cuggggguguggggguuggaagcug

SEQ ID NO: 47345 - RNA, 20 nt, Human
ccagcaaugaccucugcuca

SEQ ID NO: 47346 - RNA, 23 nt, Human
gaacacagaagagaggagguugu

SEQ ID NO: 47347 - RNA, 19 nt, Human
uuggcugcugcuguuuucu

SEQ ID NO: 47348 - RNA, 22 nt, Human
uauuacuguauucucuacuucu

SEQ ID NO: 47349 - RNA, 25 nt, Human
gcuacuuauuuuaaagacuuguuca

SEQ ID NO: 47350 - RNA, 24 nt, Human
gguggagaaacuggaccccagguc

SEQ ID NO: 47351 - RNA, 19 nt, Human
uccucugaccucaggccgg

SEQ ID NO: 47352 - RNA, 19 nt, Human
acucaggacagguggguga

SEQ ID NO: 47353 - RNA, 28 nt, Human
gguggaaauaugucuccaguuacaacuc

SEQ ID NO: 47354 - RNA, 24 nt, Human
aagcuaaauuauagucuuuugcca

SEQ ID NO: 47355 - RNA, 27 nt, Human
cucucauuggccauguuucagauuuug

SEQ ID NO: 47356 - RNA, 23 nt, Human
gcggcggcgggcaguugcagugg

SEQ ID NO: 47357 - RNA, 23 nt, Human
caacaacagcaaaacuccaucuc

SEQ ID NO: 47358 - RNA, 22 nt, Human
gcucacugaaaccucugccucc

SEQ ID NO: 47359 - RNA, 22 nt, Human
auggaccucugggcagggagac

SEQ ID NO: 47360 - RNA, 24 nt, Human
uaaaguauuuacaaaacagugaca

SEQ ID NO: 47361 - RNA, 23 nt, Human
accuaacgcagccuccugccucc

SEQ ID NO: 47362 - RNA, 19 nt, Human
uuuaagauauauacagcac

SEQ ID NO: 47363 - RNA, 30 nt, Human
aguuguuauuguuaaccuuuucggcagcuu

SEQ ID NO: 47364 - RNA, 23 nt, Human
caacuacccaggaggcugaggca

SEQ ID NO: 47365 - RNA, 24 nt, Human
gccuucugccugcucuccugcacu

SEQ ID NO: 47366 - RNA, 22 nt, Human
ugagaucacaggaacagcaggu

SEQ ID NO: 47367 - RNA, 22 nt, Human
ccuuuccucuucugucaucuca

SEQ ID NO: 47368 - RNA, 17 nt, Human
uugucaggaaugcugaa

SEQ ID NO: 47369 - RNA, 26 nt, Human
gaaggagguugagcucuucacugugu

SEQ ID NO: 47370 - RNA, 22 nt, Human
accacgcuuggcuaauuuuugu

SEQ ID NO: 47371 - RNA, 22 nt, Human
gaacccaggaggcggagguagu

SEQ ID NO: 47372 - RNA, 27 nt, Human
ccuucacugcauuaugaaaauauuuca

SEQ ID NO: 47373 - RNA, 26 nt, Human
gcaggcaauuuggauacuuuaggcuu

SEQ ID NO: 47374 - RNA, 26 nt, Human
aaauacaugcacagucauacaaguca

SEQ ID NO: 47375 - RNA, 21 nt, Human
cugcaugaaagcguuaucucu

SEQ ID NO: 47376 - RNA, 18 nt, Human
cuggacacagcuucagcu

SEQ ID NO: 47377 - RNA, 21 nt, Human
agucucaaacugucccccuua

SEQ ID NO: 47378 - RNA, 24 nt, Human
ccuuagcucccuguucuuggaucu

SEQ ID NO: 47379 - RNA, 23 nt, Human
uacugcugaccuuuuuaucuuga

SEQ ID NO: 47380 - RNA, 24 nt, Human
aaacccagcagacuguacuuagca

SEQ ID NO: 47381 - RNA, 27 nt, Human
uuaccauggauuuccuacauuucugag

SEQ ID NO: 47382 - RNA, 24 nt, Human
ccacccuucuccccucagagagga

SEQ ID NO: 47383 - RNA, 14 nt, Human
auccaguuaccuca

SEQ ID NO: 47384 - RNA, 24 nt, Human
gggaagaaaucggauucccagagg

SEQ ID NO: 47385 - RNA, 20 nt, Human
cugauagcuccuccauguug

SEQ ID NO: 47386 - RNA, 25 nt, Human
guaacucucuuccuucuuuuucucc

SEQ ID NO: 47387 - RNA, 24 nt, Human
ccuuucuccagcuucugcucugcc

SEQ ID NO: 47388 - RNA, 19 nt, Human
ucaagagcaucuggaacaa

SEQ ID NO: 47389 - RNA, 20 nt, Human
uaggaagagaaaccagggag

SEQ ID NO: 47390 - RNA, 21 nt, Human
agcucacugcaaccuccaccu

SEQ ID NO: 47391 - RNA, 19 nt, Human
cucuccucgggaucggguc

SEQ ID NO: 47392 - RNA, 19 nt, Human
ucaucaccacaugccuuca

SEQ ID NO: 47393 - RNA, 20 nt, Human
cguuccaaaaggcuauuuca

SEQ ID NO: 47394 - RNA, 18 nt, Human
aggacccccacccccgac

SEQ ID NO: 47395 - RNA, 21 nt, Human
ugaauaaaugaaccaaaucaa

SEQ ID NO: 47396 - RNA, 20 nt, Human
ccuggugcugggauucuacg

SEQ ID NO: 47397 - RNA, 25 nt, Human
guuguacucccuccuccuggaagcc

SEQ ID NO: 47398 - RNA, 27 nt, Human
ggucucgaacuucugacgucaagugau

SEQ ID NO: 47399 - RNA, 22 nt, Human
acacggagcacaggucucugcu

SEQ ID NO: 47400 - RNA, 23 nt, Human
cuucccuccaaaccccaaguaag

SEQ ID NO: 47401 - RNA, 25 nt, Human
cccauauuaaaagaacucauucaua

SEQ ID NO: 47402 - RNA, 22 nt, Human
acccaggcuggagugcaguguc

SEQ ID NO: 47403 - RNA, 21 nt, Human
aguugcugggauugcgggcau

SEQ ID NO: 47404 - RNA, 19 nt, Human
uguagugagguugcaguga

SEQ ID NO: 47405 - RNA, 28 nt, Human
cuguuuuaaaagaucauaguugcaaaau

SEQ ID NO: 47406 - RNA, 23 nt, Human
cccaggaggcagagguuggggug

SEQ ID NO: 47407 - RNA, 26 nt, Human
ugggcacaguggacucagcagugacc

SEQ ID NO: 47408 - RNA, 22 nt, Human
gagaagcugauccagcuuuccg

SEQ ID NO: 47409 - RNA, 26 nt, Human
cgccugggacccccaagcuguguccu

SEQ ID NO: 47410 - RNA, 22 nt, Human
auaaggugugauguggggaaga

SEQ ID NO: 47411 - RNA, 22 nt, Human
uggguggggggaaugagcauga

SEQ ID NO: 47412 - RNA, 21 nt, Human
gccaauuaacaguaugugccu

SEQ ID NO: 47413 - RNA, 22 nt, Human
ucaggauuuaaaauuuaauuau

SEQ ID NO: 47414 - RNA, 23 nt, Human
cggacuucuuagucuugagagug

SEQ ID NO: 47415 - RNA, 22 nt, Human
acauuuaauggacugagcauug

SEQ ID NO: 47416 - RNA, 27 nt, Human
agcaauaauaaaguacuugacuaccua

SEQ ID NO: 47417 - RNA, 28 nt, Human
gcacaggaagcugagaugaacccuggca

SEQ ID NO: 47418 - RNA, 26 nt, Human
aacacccagggccgggcggcugcugu

SEQ ID NO: 47419 - RNA, 22 nt, Human
aggagguggaggaauuaaguga

SEQ ID NO: 47420 - RNA, 22 nt, Human
cgugcccaggccuguggguagu

SEQ ID NO: 47421 - RNA, 26 nt, Human
uguugucugaggacugaacuguggac

SEQ ID NO: 47422 - RNA, 24 nt, Human
ggucuuggugucccaucccuguca

SEQ ID NO: 47423 - RNA, 27 nt, Human
aaaagagaacucucugcccaacacccc

SEQ ID NO: 47424 - RNA, 19 nt, Human
gggcauuucaaccaacuca

SEQ ID NO: 47425 - RNA, 24 nt, Human
gggagagaggcaagggguggacgg

SEQ ID NO: 47426 - RNA, 22 nt, Human
uccagccccauaaagaguguca

SEQ ID NO: 47427 - RNA, 22 nt, Human
guacauuuauuguaccaaacca

SEQ ID NO: 47428 - RNA, 22 nt, Human
cacugccugcagaggucugugc

SEQ ID NO: 47429 - RNA, 22 nt, Human
uggcucuccacugagcaccuua

SEQ ID NO: 47430 - RNA, 20 nt, Human
caguaucugcuguucuucag

SEQ ID NO: 47431 - RNA, 21 nt, Human
caggggucgucaccaccucuc

SEQ ID NO: 47432 - RNA, 23 nt, Human
gcaacguuuuauuuucucuguuc

SEQ ID NO: 47433 - RNA, 19 nt, Human
ggcagcugcugugccugag

SEQ ID NO: 47434 - RNA, 22 nt, Human
ggaggcugaggugggagaauua

SEQ ID NO: 47435 - RNA, 18 nt, Human
uacagccgccaggccugg

SEQ ID NO: 47436 - RNA, 20 nt, Human
ucuaggcuugcgugcugcua

SEQ ID NO: 47437 - RNA, 27 nt, Human
guggcaaaagccuacaauugacaaacu

SEQ ID NO: 47438 - RNA, 22 nt, Human
gccuucuccccucccgcgagcc

SEQ ID NO: 47439 - RNA, 21 nt, Human
gacacugucauuucugcuuca

SEQ ID NO: 47440 - RNA, 14 nt, Human
aggugcaaugugau

SEQ ID NO: 47441 - RNA, 24 nt, Human
aagaacauugguuuagauaaauac

SEQ ID NO: 47442 - RNA, 22 nt, Human
ucugaguagcugggauuacagg

SEQ ID NO: 47443 - RNA, 23 nt, Human
cagaguugagacaaaaagaaaua

SEQ ID NO: 47444 - RNA, 22 nt, Human
cucuucugcaggcucugccaug

SEQ ID NO: 47445 - RNA, 21 nt, Human
gggcggggcaggaaauguacc

SEQ ID NO: 47446 - RNA, 25 nt, Human
ugcccccaguuaaauaccuccucua

SEQ ID NO: 47447 - RNA, 21 nt, Human
agccccaccugcacgugaucu

SEQ ID NO: 47448 - RNA, 25 nt, Human
uccucauuccuuugguuuuggccca

SEQ ID NO: 47449 - RNA, 27 nt, Human
cccugcacgcugggccuucagaauuaa

SEQ ID NO: 47450 - RNA, 27 nt, Human
uucucauuuugaaauauuuguguguuu

SEQ ID NO: 47451 - RNA, 23 nt, Human
auuguggguggcucugugggcgc

SEQ ID NO: 47452 - RNA, 23 nt, Human
ccuuuuucuccucccgaaggaac

SEQ ID NO: 47453 - RNA, 22 nt, Human
ucuuuuucucuuugauugaaag

SEQ ID NO: 47454 - RNA, 22 nt, Human
auggaaagaaguuauuuuuagg

SEQ ID NO: 47455 - RNA, 23 nt, Human
cuccagccuggcaguuucugcgu

SEQ ID NO: 47456 - RNA, 21 nt, Human
aucguuugugaucuggacccg

SEQ ID NO: 47457 - RNA, 27 nt, Human
uuccugagccagcccuccuugacccag

SEQ ID NO: 47458 - RNA, 27 nt, Human
agaagcagcaaaaugccuuuacguugu

SEQ ID NO: 47459 - RNA, 19 nt, Human
uauggucuuccaggaaaag

SEQ ID NO: 47460 - RNA, 22 nt, Human
ggcuuugggauucuugucaagc

SEQ ID NO: 47461 - RNA, 20 nt, Human
accugcauucugccaccccu

SEQ ID NO: 47462 - RNA, 27 nt, Human
aaaugcacguggaugugagacacaaaa

SEQ ID NO: 47463 - RNA, 19 nt, Human
cugaccucccugggagggu

SEQ ID NO: 47464 - RNA, 22 nt, Human
cagcuccccuguauucccccau

SEQ ID NO: 47465 - RNA, 24 nt, Human
aggcuauucacaaccacucauuca

SEQ ID NO: 47466 - RNA, 22 nt, Human
caggcuggagugcaguggugcu

SEQ ID NO: 47467 - RNA, 23 nt, Human
ccccggcagccucagcaucagcg

SEQ ID NO: 47468 - RNA, 23 nt, Human
ggcuccucuucugcucuuuccau

SEQ ID NO: 47469 - RNA, 17 nt, Human
auaugauaaaagcacaa

SEQ ID NO: 47470 - RNA, 31 nt, Human
gagggacagagagacagggagagucagccuc

SEQ ID NO: 47471 - RNA, 22 nt, Human
cuaggaaugcagccccaggaag

SEQ ID NO: 47472 - RNA, 22 nt, Human
cuccaucucaccucggggggcu

SEQ ID NO: 47473 - RNA, 24 nt, Human
cuccacccucaucacccacacucc

SEQ ID NO: 47474 - RNA, 27 nt, Human
cuguggcuggccaggcggugcggcugg

SEQ ID NO: 47475 - RNA, 25 nt, Human
uggagaucgcuuuucucagacucac

SEQ ID NO: 47476 - RNA, 22 nt, Human
gccgaccugaggacauggcuuc

SEQ ID NO: 47477 - RNA, 23 nt, Human
ccaugccucccuggccugaagaa

SEQ ID NO: 47478 - RNA, 26 nt, Human
guugcccaggugggucucaaacuccu

SEQ ID NO: 47479 - RNA, 19 nt, Human
ggccucggaacacgccauu

SEQ ID NO: 47480 - RNA, 21 nt, Human
gcagaugggagcccgcggagc

SEQ ID NO: 47481 - RNA, 21 nt, Human
gcugagugcaagaugagggag

SEQ ID NO: 47482 - RNA, 20 nt, Human
ggccuucagcccucuguggu

SEQ ID NO: 47483 - RNA, 27 nt, Human
cagggagaccugggucuucucuggcug

SEQ ID NO: 47484 - RNA, 21 nt, Human
agucauuuucacauccucuug

SEQ ID NO: 47485 - RNA, 23 nt, Human
uuccauaaagguaacaaagggca

SEQ ID NO: 47486 - RNA, 26 nt, Human
gggaaucggaauaacuccagcaagga

SEQ ID NO: 47487 - RNA, 19 nt, Human
ggcauuugcaccuaccuca

SEQ ID NO: 47488 - RNA, 22 nt, Human
cagggaggaaaggcagaagcug

SEQ ID NO: 47489 - RNA, 20 nt, Human
caguaucuuuaaugaguauc

SEQ ID NO: 47490 - RNA, 22 nt, Human
ccaacauacugaaaccccgucu

SEQ ID NO: 47491 - RNA, 21 nt, Human
ggcuguaacuacuuuauaacu

SEQ ID NO: 47492 - RNA, 20 nt, Human
gguucuugacucugaaggga

SEQ ID NO: 47493 - RNA, 23 nt, Human
caccuuauguaauacuguaacuu

SEQ ID NO: 47494 - RNA, 19 nt, Human
uaugcuagagcaccagggu

SEQ ID NO: 47495 - RNA, 20 nt, Human
gcauggagcaggacacugcc

SEQ ID NO: 47496 - RNA, 23 nt, Human
ucuucucccuucucccuccauca

SEQ ID NO: 47497 - RNA, 23 nt, Human
cuaggcaggcacugcucucugca

SEQ ID NO: 47498 - RNA, 26 nt, Human
guggguggacgugguuggugauuggc

SEQ ID NO: 47499 - RNA, 22 nt, Human
cucuccuccacucgcucgggcu

SEQ ID NO: 47500 - RNA, 24 nt, Human
cagcuugaguuaaccuugcuuuuc

SEQ ID NO: 47501 - RNA, 23 nt, Human
guugcccaggguggagugcagug

SEQ ID NO: 47502 - RNA, 23 nt, Human
guugcccaggcuggaguggagug

SEQ ID NO: 47503 - RNA, 23 nt, Human
ccacugcacuuggugcugcuuug

SEQ ID NO: 47504 - RNA, 23 nt, Human
agguuccccugaggucacucuga

SEQ ID NO: 47505 - RNA, 26 nt, Human
auuuuucuuguuaaucagaauuccua

SEQ ID NO: 47506 - RNA, 25 nt, Human
uuggcucuuuuaucaucagaauagg

SEQ ID NO: 47507 - RNA, 21 nt, Human
ccagacacuuuuacauucaug

SEQ ID NO: 47508 - RNA, 22 nt, Human
accgcaaccuccgcccccuggg

SEQ ID NO: 47509 - RNA, 19 nt, Human
uggcagaauauaauuccca

SEQ ID NO: 47510 - RNA, 20 nt, Human
gcuaaggaacaaugccgccu

SEQ ID NO: 47511 - RNA, 22 nt, Human
gacuggcauuuugauacuucag

SEQ ID NO: 47512 - RNA, 27 nt, Human
gcccuggggcacuuuucugcuuccuuc

SEQ ID NO: 47513 - RNA, 21 nt, Human
aucagcuuuuaauaaaauuga

SEQ ID NO: 47514 - RNA, 22 nt, Human
gggcugaggugggaggaucucu

SEQ ID NO: 47515 - RNA, 25 nt, Human
ucugguuccugugugacccugggca

SEQ ID NO: 47516 - RNA, 22 nt, Human
aaaauggugggauuacaggugu

SEQ ID NO: 47517 - RNA, 24 nt, Human
acagaacaaagaacggcaugugaa

SEQ ID NO: 47518 - RNA, 25 nt, Human
ggucccuggccaguggacugaaggc

SEQ ID NO: 47519 - RNA, 29 nt, Human
ucuuguaagcacuggacugucuucaucaa

SEQ ID NO: 47520 - RNA, 24 nt, Human
gcuacagccacuaaacuugcuuca

SEQ ID NO: 47521 - RNA, 21 nt, Human
gccuucccaguggggcugguc

SEQ ID NO: 47522 - RNA, 23 nt, Human
aagaacauguauaguuuuuguac

SEQ ID NO: 47523 - RNA, 25 nt, Human
gggcuguaggccugguccgccauuc

SEQ ID NO: 47524 - RNA, 29 nt, Human
acugcccccgguugccugccugggcccca

SEQ ID NO: 47525 - RNA, 22 nt, Human
ugugugccggccuucuugcugc

SEQ ID NO: 47526 - RNA, 24 nt, Human
ccagccgccgcgcccgcuacccgg

SEQ ID NO: 47527 - RNA, 25 nt, Human
agagaaacucuacaaaugugaagaa

SEQ ID NO: 47528 - RNA, 27 nt, Human
gcugaacacuggugcuguggugguuuu

SEQ ID NO: 47529 - RNA, 21 nt, Human
ccgacuugccauguuuuugcc

SEQ ID NO: 47530 - RNA, 21 nt, Human
cuaaugagaguuccuuccaga

SEQ ID NO: 47531 - RNA, 22 nt, Human
aaccccugucagaaugacgggc

SEQ ID NO: 47532 - RNA, 27 nt, Human
ucugucugguccauagcugugguguag

SEQ ID NO: 47533 - RNA, 19 nt, Human
ccugccucagccucuugag

SEQ ID NO: 47534 - RNA, 20 nt, Human
cuguuuucccagcugcugcc

SEQ ID NO: 47535 - RNA, 27 nt, Human
ccccugcccaccucuccaaccuaacua

SEQ ID NO: 47536 - RNA, 23 nt, Human
ugccugcuuacacccugcccuca

SEQ ID NO: 47537 - RNA, 25 nt, Human
guuuccccacuuuaggaggaggugg

SEQ ID NO: 47538 - RNA, 22 nt, Human
gaagcacaggcuccuguccuca

SEQ ID NO: 47539 - RNA, 20 nt, Human
augcuugccuagggccuggu

SEQ ID NO: 47540 - RNA, 27 nt, Human
gucugucucccugggacuuggguggcu

SEQ ID NO: 47541 - RNA, 21 nt, Human
ugccaagcuuccagcugccuc

SEQ ID NO: 47542 - RNA, 23 nt, Human
uuccaauagaacaguuuacuugg

SEQ ID NO: 47543 - RNA, 28 nt, Human
guuuaacagucaggaaggcuaaacuggu

SEQ ID NO: 47544 - RNA, 24 nt, Human
ggcucuuucacggauuuaggcuga

SEQ ID NO: 47545 - RNA, 22 nt, Human
acagcucucagcaccugcuucc

SEQ ID NO: 47546 - RNA, 26 nt, Human
cuuagcaaucuccuuaguucuugcua

SEQ ID NO: 47547 - RNA, 22 nt, Human
guucauguugcugaaagcuguu

SEQ ID NO: 47548 - RNA, 28 nt, Human
gcggccucggggaauggaagcggagaac

SEQ ID NO: 47549 - RNA, 24 nt, Human
uacuacuguagaacugcaauuucc

SEQ ID NO: 47550 - RNA, 23 nt, Human
gccccuuaccagccuuguggcag

SEQ ID NO: 47551 - RNA, 27 nt, Human
gagcucccucuucgcggacaugggauu

SEQ ID NO: 47552 - RNA, 21 nt, Human
acgucucucgguuucuucuua

SEQ ID NO: 47553 - RNA, 22 nt, Human
gccauuugaagaaggaggaauu

SEQ ID NO: 47554 - RNA, 24 nt, Human
acugaggagaaugguagagaggag

SEQ ID NO: 47555 - RNA, 21 nt, Human
gggcccucagcugugagguug

SEQ ID NO: 47556 - RNA, 23 nt, Human
aauaugcucauucgacuaacuag

SEQ ID NO: 47557 - RNA, 24 nt, Human
ggaagcguuagguauuacagcaga

SEQ ID NO: 47558 - RNA, 22 nt, Human
aggcugaggcggguggaucacc

SEQ ID NO: 47559 - RNA, 27 nt, Human
gcacccucugcggcgugucaugggccc

SEQ ID NO: 47560 - RNA, 22 nt, Human
gugaggcagaagcauugcuuga

SEQ ID NO: 47561 - RNA, 21 nt, Human
uuggaauguugagaguguggu

SEQ ID NO: 47562 - RNA, 23 nt, Human
ucccucacugaaggaccugagcu

SEQ ID NO: 47563 - RNA, 27 nt, Human
cacaggcugggauggagcacuucuucu

SEQ ID NO: 47564 - RNA, 26 nt, Human
cacgccgccucgccugccgccgcgcu

SEQ ID NO: 47565 - RNA, 23 nt, Human
gcaccuagcaaggcacaccaaga

SEQ ID NO: 47566 - RNA, 20 nt, Human
cucucuuaggcacaggcugg

SEQ ID NO: 47567 - RNA, 21 nt, Human
cucagccucaggcaguggugc

SEQ ID NO: 47568 - RNA, 21 nt, Human
agauugaaccugaauauugcc

SEQ ID NO: 47569 - RNA, 27 nt, Human
ucuggauuugugggaauggcuuugcgu

SEQ ID NO: 47570 - RNA, 26 nt, Human
cuuccucucuuccuccagggacucug

SEQ ID NO: 47571 - RNA, 23 nt, Human
gucuagggcaggaguccagcgga

SEQ ID NO: 47572 - RNA, 23 nt, Human
agcaggaagcaaagcuagugaca

SEQ ID NO: 47573 - RNA, 19 nt, Human
aaaccaagaaaauagugag

SEQ ID NO: 47574 - RNA, 22 nt, Human
cacuggcagacauuguaaaaga

SEQ ID NO: 47575 - RNA, 23 nt, Human
gugccccaguggugcgggccagg

SEQ ID NO: 47576 - RNA, 26 nt, Human
cugccucuggccauggccugccggug

SEQ ID NO: 47577 - RNA, 19 nt, Human
cuuccacgauggugcagug

SEQ ID NO: 47578 - RNA, 26 nt, Human
agucuggagugcaauggcacgaucuc

SEQ ID NO: 47579 - RNA, 19 nt, Human
acucacugcccuccagaaa

SEQ ID NO: 47580 - RNA, 21 nt, Human
accggcaaccacgggcagcuc

SEQ ID NO: 47581 - RNA, 22 nt, Human
uugcccaagauugggugucaag

SEQ ID NO: 47582 - RNA, 27 nt, Human
gggugcuguaaucggcgggcagaggag

SEQ ID NO: 47583 - RNA, 21 nt, Human
guucauuuacauguggggaga

SEQ ID NO: 47584 - RNA, 21 nt, Human
ucgaaugcuacaguaucugca

SEQ ID NO: 47585 - RNA, 25 nt, Human
cacugugaugaugagccaagcaauu

SEQ ID NO: 47586 - RNA, 25 nt, Human
ggcccagggggcagcuggaguggug

SEQ ID NO: 47587 - RNA, 16 nt, Human
cccugacauccagaaa

SEQ ID NO: 47588 - RNA, 21 nt, Human
gaaagguuaggagaguaggga

SEQ ID NO: 47589 - RNA, 24 nt, Human
aaaccauucuuacugcucucuucc

SEQ ID NO: 47590 - RNA, 20 nt, Human
ccugccuggccgucaccacu

SEQ ID NO: 47591 - RNA, 21 nt, Human
ugccuccagaauguucuggga

SEQ ID NO: 47592 - RNA, 23 nt, Human
acuaaagacuuacuauucuguuc

SEQ ID NO: 47593 - RNA, 22 nt, Human
gaggagggaggaggggagaagu

SEQ ID NO: 47594 - RNA, 25 nt, Human
uacagccgccugcaucuguauccag

SEQ ID NO: 47595 - RNA, 22 nt, Human
agaaccuccuauuuuaauugga

SEQ ID NO: 47596 - RNA, 27 nt, Human
acucagggcuuuugugaagguuccccc

SEQ ID NO: 47597 - RNA, 27 nt, Human
uggacuauaacguugauuucuuauugc

SEQ ID NO: 47598 - RNA, 22 nt, Human
agagggggugugauuugccuga

SEQ ID NO: 47599 - RNA, 17 nt, Human
uggucucacugacuuca

SEQ ID NO: 47600 - RNA, 22 nt, Human
uggcuuuaacagucaacacucu

SEQ ID NO: 47601 - RNA, 24 nt, Human
aaugcaaaguuaagcagacuugac

SEQ ID NO: 47602 - RNA, 21 nt, Human
agaaccauuuuaacuccaucu

SEQ ID NO: 47603 - RNA, 23 nt, Human
cucaggugaucugccugccucag

SEQ ID NO: 47604 - RNA, 26 nt, Human
cagcuuugagcaauacucugcuuuca

SEQ ID NO: 47605 - RNA, 23 nt, Human
gccuccagcuccugggauccggg

SEQ ID NO: 47606 - RNA, 22 nt, Human
caccagaagagucagugucaca

SEQ ID NO: 47607 - RNA, 24 nt, Human
gcccuugcuggggggugccuggga

SEQ ID NO: 47608 - RNA, 24 nt, Human
uauuuugagaacuccagcuggugc

SEQ ID NO: 47609 - RNA, 23 nt, Human
cgccuuguaaucccagcacuuug

SEQ ID NO: 47610 - RNA, 21 nt, Human
uacuuguuuguaaagcacuuu

SEQ ID NO: 47611 - RNA, 21 nt, Human
gcugacucgcucacugccuuc

SEQ ID NO: 47612 - RNA, 27 nt, Human
gacuuuggggauucucccccuguucac

SEQ ID NO: 47613 - RNA, 25 nt, Human
ccugccugaguuuccagccugcuag

SEQ ID NO: 47614 - RNA, 22 nt, Human
ggcuccaagcucaggaccucag

SEQ ID NO: 47615 - RNA, 23 nt, Human
uguggaaccagggagcuguggga

SEQ ID NO: 47616 - RNA, 23 nt, Human
cgcgaggguagcagccagaggga

SEQ ID NO: 47617 - RNA, 21 nt, Human
acucaaguccagcauucucaa

SEQ ID NO: 47618 - RNA, 25 nt, Human
cuugugagcaucagagggcugaugg

SEQ ID NO: 47619 - RNA, 26 nt, Human
gggagagacaugggcgaaugagugag

SEQ ID NO: 47620 - RNA, 21 nt, Human
ugcccucuccccucagccucu

SEQ ID NO: 47621 - RNA, 22 nt, Human
gcucacucccccuccugcugcu

SEQ ID NO: 47622 - RNA, 20 nt, Human
ccagagagcuggcaccugag

SEQ ID NO: 47623 - RNA, 27 nt, Human
cucagggggcugggauuuugauauauu

SEQ ID NO: 47624 - RNA, 21 nt, Human
uauuucuguuacuacuugucu

SEQ ID NO: 47625 - RNA, 21 nt, Human
uuaucugaauuuuuaaacaag

SEQ ID NO: 47626 - RNA, 23 nt, Human
agaguuaaagggaauaucaagga

SEQ ID NO: 47627 - RNA, 19 nt, Human
cagcugcacauuccuggcc

SEQ ID NO: 47628 - RNA, 22 nt, Human
gccccuuccuugccccuucagu

SEQ ID NO: 47629 - RNA, 27 nt, Human
caggcagccggcgggcgcugcgugugu

SEQ ID NO: 47630 - RNA, 22 nt, Human
aaaaaccagaaggccauuuggu

SEQ ID NO: 47631 - RNA, 23 nt, Human
uggccccuugcuggagucaugug

SEQ ID NO: 47632 - RNA, 25 nt, Human
gugggagccaccacuccugccugcc

SEQ ID NO: 47633 - RNA, 22 nt, Human
ggaggcugaggaaggagaauca

SEQ ID NO: 47634 - RNA, 25 nt, Human
uuagcauuuguuuuagcauuaccua

SEQ ID NO: 47635 - RNA, 21 nt, Human
ugcaaaccacaggguuucgca

SEQ ID NO: 47636 - RNA, 20 nt, Human
ucaucuaggcuaggugcagu

SEQ ID NO: 47637 - RNA, 22 nt, Human
ggacaaaaugaacacuggcuuu

SEQ ID NO: 47638 - RNA, 23 nt, Human
cccgaaaccccaagaaaaaucag

SEQ ID NO: 47639 - RNA, 22 nt, Human
uuuccuaucuuccugugucuug

SEQ ID NO: 47640 - RNA, 19 nt, Human
gcugggccgagccugcacu

SEQ ID NO: 47641 - RNA, 23 nt, Human
uucaagagauucuccugccucag

SEQ ID NO: 47642 - RNA, 21 nt, Human
ucacccaggcugcaguguagu

SEQ ID NO: 47643 - RNA, 22 nt, Human
ucuggacuuccuugcucucccc

SEQ ID NO: 47644 - RNA, 20 nt, Human
ucuuucaggagcuuuacuga

SEQ ID NO: 47645 - RNA, 25 nt, Human
cgcccgcagcggaggagguuuucag

SEQ ID NO: 47646 - RNA, 26 nt, Human
caugccaccgcgcccagcuaauuuuu

SEQ ID NO: 47647 - RNA, 28 nt, Human
cugcaugguggagagggagcuggggcgc

SEQ ID NO: 47648 - RNA, 22 nt, Human
uagaccagcaauugcagcacuu

SEQ ID NO: 47649 - RNA, 22 nt, Human
aucaugagauucaaaagccaca

SEQ ID NO: 47650 - RNA, 20 nt, Human
ccucacugcccacucugccc

SEQ ID NO: 47651 - RNA, 18 nt, Human
ccgccuaggcaagacagu

SEQ ID NO: 47652 - RNA, 27 nt, Human
gcaaaacugagugauaacucaugagaa

SEQ ID NO: 47653 - RNA, 25 nt, Human
agcauuuucuuuaccaguauccuua

SEQ ID NO: 47654 - RNA, 22 nt, Human
cccaggagaguacauggcauug

SEQ ID NO: 47655 - RNA, 21 nt, Human
accagcccggccugcucccag

SEQ ID NO: 47656 - RNA, 26 nt, Human
uguuggaccucuuucacucccugcgu

SEQ ID NO: 47657 - RNA, 21 nt, Human
cagggaggggugcugguggug

SEQ ID NO: 47658 - RNA, 27 nt, Human
gaccaauuaacugagcacuugcugcua

SEQ ID NO: 47659 - RNA, 21 nt, Human
ccaccucucugugccucaguu

SEQ ID NO: 47660 - RNA, 24 nt, Human
gccuccauuaaagccacagcagug

SEQ ID NO: 47661 - RNA, 22 nt, Human
agcucugugcugaaggguggaa

SEQ ID NO: 47662 - RNA, 22 nt, Human
cacaacagcacaaagugucuuu

SEQ ID NO: 47663 - RNA, 24 nt, Human
aguuucuuugaaaauaguuauuca

SEQ ID NO: 47664 - RNA, 18 nt, Human
cggaaggcugaggcagga

SEQ ID NO: 47665 - RNA, 18 nt, Human
cuaagggaccugcuccca

SEQ ID NO: 47666 - RNA, 24 nt, Human
uccugcuccccaggcccagccagg

SEQ ID NO: 47667 - RNA, 25 nt, Human
aaaacucaggaccaugauggcucag

SEQ ID NO: 47668 - RNA, 22 nt, Human
cuguaaaauaaacacauuguuu

SEQ ID NO: 47669 - RNA, 21 nt, Human
acuauugcacaucauauucua

SEQ ID NO: 47670 - RNA, 24 nt, Human
cuuuuucugauuagcuuuguguuu

SEQ ID NO: 47671 - RNA, 28 nt, Human
acugagaggggagagagacuggagcugg

SEQ ID NO: 47672 - RNA, 29 nt, Human
ccuuggcagcccugugccucucgaauguu

SEQ ID NO: 47673 - RNA, 18 nt, Human
ucaugcugcuguggguga

SEQ ID NO: 47674 - RNA, 26 nt, Human
cauugcacuccaggcugggcagcaag

SEQ ID NO: 47675 - RNA, 30 nt, Human
gagauggacuaggaaguggaagcaggcugg

SEQ ID NO: 47676 - RNA, 21 nt, Human
agggcccugcucucaagcagu

SEQ ID NO: 47677 - RNA, 21 nt, Human
acuggcuucagccuccccacc

SEQ ID NO: 47678 - RNA, 27 nt, Human
uguguacagcgccaucucucugccuuc

SEQ ID NO: 47679 - RNA, 21 nt, Human
cuguguggccccugccugugc

SEQ ID NO: 47680 - RNA, 24 nt, Human
uugcuugucagccugugugcgugu

SEQ ID NO: 47681 - RNA, 26 nt, Human
cuucccaagccuuugaugacaaacca

SEQ ID NO: 47682 - RNA, 23 nt, Human
uccugcucugcucgccucggauc

SEQ ID NO: 47683 - RNA, 26 nt, Human
cugcccagguccuggggugguggcag

SEQ ID NO: 47684 - RNA, 30 nt, Human
ugugccaggcacuacacuagcugcccuaca

SEQ ID NO: 47685 - RNA, 20 nt, Human
ucuuccucuuuuccaggcuc

SEQ ID NO: 47686 - RNA, 18 nt, Human
aauuugcaaacugccuuc

SEQ ID NO: 47687 - RNA, 26 nt, Human
cauucaaggcaagcaccaccuuugcu

SEQ ID NO: 47688 - RNA, 24 nt, Human
gggcugcagaguaacaguccugaa

SEQ ID NO: 47689 - RNA, 23 nt, Human
uucagugcaggccagccuggcag

SEQ ID NO: 47690 - RNA, 28 nt, Human
gauuccucaaguuuucugcuuaguggca

SEQ ID NO: 47691 - RNA, 23 nt, Human
augccuguguguaaacuugggga

SEQ ID NO: 47692 - RNA, 27 nt, Human
aaauguccucauuauguagaauggaau

SEQ ID NO: 47693 - RNA, 20 nt, Human
uuguccucacaaccaccuca

SEQ ID NO: 47694 - RNA, 27 nt, Human
cuagggaggcugaggcaggagaaucgc

SEQ ID NO: 47695 - RNA, 27 nt, Human
gcugcaaccucugacucccugguucaa

SEQ ID NO: 47696 - RNA, 25 nt, Human
ggagagggacgcggcggacgccggc

SEQ ID NO: 47697 - RNA, 26 nt, Human
aggaccaaggagaugaagcaaacaca

SEQ ID NO: 47698 - RNA, 21 nt, Human
agugacaugggacuucagcau

SEQ ID NO: 47699 - RNA, 25 nt, Human
aaugaauucuucaacagggaaaaca

SEQ ID NO: 47700 - RNA, 29 nt, Human
ugcccacagcuugccuacucucggccuag

SEQ ID NO: 47701 - RNA, 18 nt, Human
ugcccagggcccgcagug

SEQ ID NO: 47702 - RNA, 24 nt, Human
gagcccagggaggccaaucagccc

SEQ ID NO: 47703 - RNA, 23 nt, Human
aucaagcaauucugacucagccu

SEQ ID NO: 47704 - RNA, 22 nt, Human
caccuuauuucauugacugcug

SEQ ID NO: 47705 - RNA, 26 nt, Human
gugggaaugacuggggugaggcaggg

SEQ ID NO: 47706 - RNA, 22 nt, Human
uaccuucaggauugcugacaga

SEQ ID NO: 47707 - RNA, 27 nt, Human
cccugcucccauuccucccuccggcca

SEQ ID NO: 47708 - RNA, 27 nt, Human
ggaggcugcugugguggggauccccag

SEQ ID NO: 47709 - RNA, 22 nt, Human
ggaaggagccaggauggccugg

SEQ ID NO: 47710 - RNA, 20 nt, Human
cccaccccacaauuccuccu

SEQ ID NO: 47711 - RNA, 24 nt, Human
agccuccucugaauggcuuuguga

SEQ ID NO: 47712 - RNA, 21 nt, Human
gacagcuagagaagauggccc

SEQ ID NO: 47713 - RNA, 21 nt, Human
uccuccaggccuggggacagg

SEQ ID NO: 47714 - RNA, 22 nt, Human
ggcucacagcaaccucuaccuc

SEQ ID NO: 47715 - RNA, 22 nt, Human
acauaucaaccaauagcauuaa

SEQ ID NO: 47716 - RNA, 23 nt, Human
cccagcaggcccagcaugcaggu

SEQ ID NO: 47717 - RNA, 27 nt, Human
caggcuggagugcaguggcaccaccau

SEQ ID NO: 47718 - RNA, 21 nt, Human
gagcgggacccaggagccggc

SEQ ID NO: 47719 - RNA, 31 nt, Human
ccucuuucucaccuacccccugccgcacagc

SEQ ID NO: 47720 - RNA, 20 nt, Human
ggggcugcagccagccuggg

SEQ ID NO: 47721 - RNA, 21 nt, Human
cacauacauuaaaacuaggua

SEQ ID NO: 47722 - RNA, 20 nt, Human
aagaccccccuccacccugc

SEQ ID NO: 47723 - RNA, 26 nt, Human
agagcccagucucccuccaggaaagg

SEQ ID NO: 47724 - RNA, 26 nt, Human
ugauauuggggccaugaguaaaauag

SEQ ID NO: 47725 - RNA, 23 nt, Human
uucuaggaaacugggaguuuaga

SEQ ID NO: 47726 - RNA, 16 nt, Human
cuucccuugacuucca

SEQ ID NO: 47727 - RNA, 26 nt, Human
cuguuuuuacuccuccuuuucauuca

SEQ ID NO: 47728 - RNA, 26 nt, Human
cuguaucucuuguucucuccuauuug

SEQ ID NO: 47729 - RNA, 21 nt, Human
uggaagcuucuucaaccaauc

SEQ ID NO: 47730 - RNA, 27 nt, Human
uucuacaaauuaauuuuaaagugucag

SEQ ID NO: 47731 - RNA, 20 nt, Human
caucugucgguaggccaucu

SEQ ID NO: 47732 - RNA, 22 nt, Human
acuacaaccuccaccuuccagg

SEQ ID NO: 47733 - RNA, 23 nt, Human
ucuggggacugaaccuuacccag

SEQ ID NO: 47734 - RNA, 19 nt, Human
ugcuagucgggcuuggggg

SEQ ID NO: 47735 - RNA, 27 nt, Human
gugcccaggacaggaagacguguacug

SEQ ID NO: 47736 - RNA, 26 nt, Human
uagggaggagagaaagggacaaaagc

SEQ ID NO: 47737 - RNA, 22 nt, Human
ugcaguuucuggguaacagggc

SEQ ID NO: 47738 - RNA, 24 nt, Human
acugagucucauggagagaugucu

SEQ ID NO: 47739 - RNA, 27 nt, Human
gacuauuaaaacuaauaaucaccauau

SEQ ID NO: 47740 - RNA, 26 nt, Human
gcucuagcccaggcuuugucccaggc

SEQ ID NO: 47741 - RNA, 21 nt, Human
cagagucuugcucugucgccg

SEQ ID NO: 47742 - RNA, 22 nt, Human
cacugcacuccaucuugggcaa

SEQ ID NO: 47743 - RNA, 18 nt, Human
aucuauuacaaguuuaga

SEQ ID NO: 47744 - RNA, 29 nt, Human
gucuaauaauaaaaacccauacuagccua

SEQ ID NO: 47745 - RNA, 24 nt, Human
uggccucuccuugccaaaucuaaa

SEQ ID NO: 47746 - RNA, 21 nt, Human
cccacccccaccaggccuccc

SEQ ID NO: 47747 - RNA, 22 nt, Human
ggggugagggacaccagggaau

SEQ ID NO: 47748 - RNA, 24 nt, Human
cugcuucucuggggucccuuccac

SEQ ID NO: 47749 - RNA, 23 nt, Human
caccauucagucaccagacuggg

SEQ ID NO: 47750 - RNA, 25 nt, Human
cuggguggcaaaguuacuacuggaa

SEQ ID NO: 47751 - RNA, 22 nt, Human
accagccugggcagcaugguga

SEQ ID NO: 47752 - RNA, 22 nt, Human
cugucugcggaggaaacugcau

SEQ ID NO: 47753 - RNA, 23 nt, Human
gcaccuguggccucucagucaaa

SEQ ID NO: 47754 - RNA, 19 nt, Human
auggauucuucaccaccau

SEQ ID NO: 47755 - RNA, 21 nt, Human
acugcuaucucgcauucuucu

SEQ ID NO: 47756 - RNA, 22 nt, Human
ccaggagggggagcuuggagcg

SEQ ID NO: 47757 - RNA, 21 nt, Human
gaaguauuuugcuggaauaag

SEQ ID NO: 47758 - RNA, 22 nt, Human
cuggcuucauucugcucucucu

SEQ ID NO: 47759 - RNA, 20 nt, Human
guggguggagggagggagau

SEQ ID NO: 47760 - RNA, 22 nt, Human
aucaaauucugcaguggaaugg

SEQ ID NO: 47761 - RNA, 21 nt, Human
caucccuguggggagugcagg

SEQ ID NO: 47762 - RNA, 24 nt, Human
gugguagggaguguuuuuucccac

SEQ ID NO: 47763 - RNA, 24 nt, Human
uaagucuguacaugugcgugcaca

SEQ ID NO: 47764 - RNA, 24 nt, Human
caagaccugugcuucuuuacucca

SEQ ID NO: 47765 - RNA, 18 nt, Human
ggaggugggugugaagaa

SEQ ID NO: 47766 - RNA, 25 nt, Human
ggcagccgccgccaccgcugcccag

SEQ ID NO: 47767 - RNA, 23 nt, Human
agggucucuuucuuuucucuuuu

SEQ ID NO: 47768 - RNA, 24 nt, Human
agcaauucuguccccaucaagggg

SEQ ID NO: 47769 - RNA, 24 nt, Human
acuugaagcucccugucccccuca

SEQ ID NO: 47770 - RNA, 20 nt, Human
ccucccucucccaccucauc

SEQ ID NO: 47771 - RNA, 22 nt, Human
uguuccuguagucccagcacuc

SEQ ID NO: 47772 - RNA, 23 nt, Human
uucaaugcuucuaucagacucag

SEQ ID NO: 47773 - RNA, 19 nt, Human
agguagaggggcagaggcg

SEQ ID NO: 47774 - RNA, 19 nt, Human
ccaaugcucaccuauucag

SEQ ID NO: 47775 - RNA, 22 nt, Human
gcuccuccccuggaccauugca

SEQ ID NO: 47776 - RNA, 23 nt, Human
ucuaggaacccuggcuuuuaucu

SEQ ID NO: 47777 - RNA, 22 nt, Human
ccaaggcugggaaaagacaaug

SEQ ID NO: 47778 - RNA, 21 nt, Human
auacaaaaacaaaaucuugua

SEQ ID NO: 47779 - RNA, 24 nt, Human
guggcucaggcugggagggacuuc

SEQ ID NO: 47780 - RNA, 27 nt, Human
cauuuaggaagcagcaccaagucuauu

SEQ ID NO: 47781 - RNA, 23 nt, Human
gaacaucauuagaacaaaggaca

SEQ ID NO: 47782 - RNA, 22 nt, Human
uuaaggcugaucagcagauggg

SEQ ID NO: 47783 - RNA, 18 nt, Human
uuccugggcuuguuuucu

SEQ ID NO: 47784 - RNA, 26 nt, Human
uuguucaguguggaguauauucagca

SEQ ID NO: 47785 - RNA, 22 nt, Human
uucucucuucuggaaucgcuug

SEQ ID NO: 47786 - RNA, 27 nt, Human
aucugcucagaaaaauguaugugcaca

SEQ ID NO: 47787 - RNA, 20 nt, Human
cagcaucaggacgggggcuc

SEQ ID NO: 47788 - RNA, 24 nt, Human
gcagacacccuguguccuccuuca

SEQ ID NO: 47789 - RNA, 20 nt, Human
caggggcaaacaucuccauc

SEQ ID NO: 47790 - RNA, 19 nt, Human
ucuuccuagugccuacaau

SEQ ID NO: 47791 - RNA, 23 nt, Human
gccuauaaucccagcuacuuggg

SEQ ID NO: 47792 - RNA, 23 nt, Human
gcccguaaucccagcuacucagg

SEQ ID NO: 47793 - RNA, 23 nt, Human
gccuguaauccuagcuacucagg

SEQ ID NO: 47794 - RNA, 25 nt, Human
uuagauugaaaacuuuucucagaug

SEQ ID NO: 47795 - RNA, 24 nt, Human
gccaaagaacugccuauaauuuca

SEQ ID NO: 47796 - RNA, 26 nt, Human
uguggaguccagagugcugccaggac

SEQ ID NO: 47797 - RNA, 23 nt, Human
gcacagucaggggcugggcaucc

SEQ ID NO: 47798 - RNA, 22 nt, Human
ugcauccucugccucccggguu

SEQ ID NO: 47799 - RNA, 23 nt, Human
guuugagcuggagugcugcgggc

SEQ ID NO: 47800 - RNA, 24 nt, Human
ugcaaaacuaccacauucuguccc

SEQ ID NO: 47801 - RNA, 21 nt, Human
ccuggugggugaaccugagcu

SEQ ID NO: 47802 - RNA, 24 nt, Human
cuuuucuaugccuccauuugggga

SEQ ID NO: 47803 - RNA, 17 nt, Human
uguaccugaaguacagu

SEQ ID NO: 47804 - RNA, 19 nt, Human
accugcucuccccuggacu

SEQ ID NO: 47805 - RNA, 27 nt, Human
cuuuggcccaauucuccagcucaaccc

SEQ ID NO: 47806 - RNA, 20 nt, Human
aucuuacucuacugcugcug

SEQ ID NO: 47807 - RNA, 22 nt, Human
ggcuggcauucugaugcuuuuc

SEQ ID NO: 47808 - RNA, 23 nt, Human
uggagauguagaagaugugacgc

SEQ ID NO: 47809 - RNA, 27 nt, Human
caggcuggaguacaguggcauaaucac

SEQ ID NO: 47810 - RNA, 24 nt, Human
cugagguaguuucaguccaucaca

SEQ ID NO: 47811 - RNA, 20 nt, Human
ucccaaccaucauucacccu

SEQ ID NO: 47812 - RNA, 22 nt, Human
ggguuugggguuucuuuuucgg

SEQ ID NO: 47813 - RNA, 23 nt, Human
gcagugagcugcggucugaggcc

SEQ ID NO: 47814 - RNA, 24 nt, Human
gguacuggucccuuccuuuuguua

SEQ ID NO: 47815 - RNA, 27 nt, Human
aggcuggaacuugugguugaggcaggg

SEQ ID NO: 47816 - RNA, 21 nt, Human
cugucuuucucccagauacac

SEQ ID NO: 47817 - RNA, 20 nt, Human
ucaguuuccucaucuguaag

SEQ ID NO: 47818 - RNA, 27 nt, Human
acucuccaagcuccugucuuucuuucc

SEQ ID NO: 47819 - RNA, 26 nt, Human
gccacugcacucaaccuuaagaccua

SEQ ID NO: 47820 - RNA, 26 nt, Human
ucauaucuucucuaauuugguccuga

SEQ ID NO: 47821 - RNA, 20 nt, Human
gguuccucucuuggcaauuc

SEQ ID NO: 47822 - RNA, 21 nt, Human
uucgaggcuacauaguuuuca

SEQ ID NO: 47823 - RNA, 20 nt, Human
uguuaucucccuccuggccu

SEQ ID NO: 47824 - RNA, 23 nt, Human
aaauacuguauuuaaaauguaaa

SEQ ID NO: 47825 - RNA, 24 nt, Human
gucccucccuuugccuuugaguca

SEQ ID NO: 47826 - RNA, 21 nt, Human
uucaguauacuaacacucaua

SEQ ID NO: 47827 - RNA, 22 nt, Human
uauuuucauggguucaguaacu

SEQ ID NO: 47828 - RNA, 22 nt, Human
uuccuggcuccuuaucagugcc

SEQ ID NO: 47829 - RNA, 22 nt, Human
accauuuaaccauaaaauggac

SEQ ID NO: 47830 - RNA, 22 nt, Human
uaaaaugcuuggguacacuucu

SEQ ID NO: 47831 - RNA, 22 nt, Human
cgccuguaauuccaucauuuug

SEQ ID NO: 47832 - RNA, 22 nt, Human
ucugcuggcacagccugggcaa

SEQ ID NO: 47833 - RNA, 22 nt, Human
uuugcucugugcugacuguggu

SEQ ID NO: 47834 - RNA, 22 nt, Human
uuggagccaccccaagugacac

SEQ ID NO: 47835 - RNA, 23 nt, Human
uuuauuccauuugcuuguuuugu

SEQ ID NO: 47836 - RNA, 26 nt, Human
uugcuauacucacagucuuguuuucc

SEQ ID NO: 47837 - RNA, 20 nt, Human
ccuuuaucuuucuuccuguc

SEQ ID NO: 47838 - RNA, 21 nt, Human
guaaguuuggccaacaaggug

SEQ ID NO: 47839 - RNA, 21 nt, Human
ccgaucugcaaaagggccucu

SEQ ID NO: 47840 - RNA, 24 nt, Human
ccgaagaucucaggaauuuuugua

SEQ ID NO: 47841 - RNA, 22 nt, Human
uuucaauaaaauuuuaaauaaa

SEQ ID NO: 47842 - RNA, 27 nt, Human
ucugggaucuucagcugagauugggcc

SEQ ID NO: 47843 - RNA, 22 nt, Human
uugcccaggucugggcugaaua

SEQ ID NO: 47844 - RNA, 23 nt, Human
gcaauccucaaacaugugguuau

SEQ ID NO: 47845 - RNA, 27 nt, Human
cacugcaccccaggcagccacuccuag

SEQ ID NO: 47846 - RNA, 22 nt, Human
ggaagagaguccugaacgguuu

SEQ ID NO: 47847 - RNA, 21 nt, Human
gggcacugccucacagccaag

SEQ ID NO: 47848 - RNA, 23 nt, Human
uguuuaccuagugagcauugugc

SEQ ID NO: 47849 - RNA, 18 nt, Human
cagaucuccccucucacc

SEQ ID NO: 47850 - RNA, 24 nt, Human
agagaaacaaaaacacugagagug

SEQ ID NO: 47851 - RNA, 22 nt, Human
augaucuccugguggucggcgg

SEQ ID NO: 47852 - RNA, 22 nt, Human
ugacuuccuaauuugcuacuua

SEQ ID NO: 47853 - RNA, 19 nt, Human
cuucccuuuuuaucugcug

SEQ ID NO: 47854 - RNA, 23 nt, Human
ucugguauccuauccacccaagg

SEQ ID NO: 47855 - RNA, 19 nt, Human
ccaugcuggagugcaaugg

SEQ ID NO: 47856 - RNA, 17 nt, Human
cuuaggggagagcuuuc

SEQ ID NO: 47857 - RNA, 23 nt, Human
aaggcuccaggccccaccuccuc

SEQ ID NO: 47858 - RNA, 23 nt, Human
cguccgcccugcaaaucugccag

SEQ ID NO: 47859 - RNA, 21 nt, Human
uuucaugucaauggaaucaug

SEQ ID NO: 47860 - RNA, 26 nt, Human
cacuccuagcugcuccagucucagcc

SEQ ID NO: 47861 - RNA, 21 nt, Human
ccugcccacugcugucacuuc

SEQ ID NO: 47862 - RNA, 20 nt, Human
uuugggaauggaaucacuga

SEQ ID NO: 47863 - RNA, 27 nt, Human
ugugcuccuuggagcuggugugcagug

SEQ ID NO: 47864 - RNA, 24 nt, Human
gccuaagccucagcagaacuugua

SEQ ID NO: 47865 - RNA, 22 nt, Human
gggauuacaggcgugugucacc

SEQ ID NO: 47866 - RNA, 24 nt, Human
aaaaggaguauacaaacauuuaag

SEQ ID NO: 47867 - RNA, 24 nt, Human
ccucuuucagcuccugaccaguug

SEQ ID NO: 47868 - RNA, 22 nt, Human
ccaacauggcaaaaccccuucu

SEQ ID NO: 47869 - RNA, 27 nt, Human
gaguagcugggauuauaggcacaugcc

SEQ ID NO: 47870 - RNA, 21 nt, Human
agccccuccucccugcccucg

SEQ ID NO: 47871 - RNA, 22 nt, Human
acugcacccaccaagucaagca

SEQ ID NO: 47872 - RNA, 22 nt, Human
gacuccaagagcagagugagga

SEQ ID NO: 47873 - RNA, 22 nt, Human
cacucaggcuggaauguagugg

SEQ ID NO: 47874 - RNA, 23 nt, Human
acugcaggauggcgucaucucug

SEQ ID NO: 47875 - RNA, 25 nt, Human
ccaguuuuaccagacuuccaaaaag

SEQ ID NO: 47876 - RNA, 23 nt, Human
acacuuuacuacugcagaaggaa

SEQ ID NO: 47877 - RNA, 22 nt, Human
uugugaaccccaaauaucugag

SEQ ID NO: 47878 - RNA, 20 nt, Human
ucaacuugccacagccaaca

SEQ ID NO: 47879 - RNA, 23 nt, Human
agaccugugugaacuauugagaa

SEQ ID NO: 47880 - RNA, 24 nt, Human
uaucccagcuuugggcacauguau

SEQ ID NO: 47881 - RNA, 22 nt, Human
uguggugagcugaaaugacgcc

SEQ ID NO: 47882 - RNA, 22 nt, Human
uucgccaaggcuggagugcagu

SEQ ID NO: 47883 - RNA, 21 nt, Human
ccuaucucccuggcagcaacu

SEQ ID NO: 47884 - RNA, 24 nt, Human
uuucccugcugaggggcucaggga

SEQ ID NO: 47885 - RNA, 20 nt, Human
auagauuuaguaaagcagga

SEQ ID NO: 47886 - RNA, 25 nt, Human
gcgcgcuccagccgguguaggcgag

SEQ ID NO: 47887 - RNA, 21 nt, Human
auucagucccaaauauguauu

SEQ ID NO: 47888 - RNA, 22 nt, Human
aucucaguuaggagaagagaca

SEQ ID NO: 47889 - RNA, 21 nt, Human
aagguggggacagggaugagc

SEQ ID NO: 47890 - RNA, 21 nt, Human
agggugccaggucugggugaa

SEQ ID NO: 47891 - RNA, 23 nt, Human
gccucucccucacugcuggacug

SEQ ID NO: 47892 - RNA, 26 nt, Human
caauugugccuucugugggccaggcc

SEQ ID NO: 47893 - RNA, 27 nt, Human
ucccucucccuccccaggacuucugug

SEQ ID NO: 47894 - RNA, 22 nt, Human
cagccuggaccauacacugccu

SEQ ID NO: 47895 - RNA, 27 nt, Human
cacuccacuccaggugggccacuccaa

SEQ ID NO: 47896 - RNA, 30 nt, Human
ucaauaaaccaucagucccagaagcaaagg

SEQ ID NO: 47897 - RNA, 21 nt, Human
ggugcaggaaaacuaccugga

SEQ ID NO: 47898 - RNA, 23 nt, Human
uugcugaguuccggggugcaaug

SEQ ID NO: 47899 - RNA, 19 nt, Human
ucuguagcuugagcaaucu

SEQ ID NO: 47900 - RNA, 26 nt, Human
aagaacaucauaaaauuuuuauauau

SEQ ID NO: 47901 - RNA, 22 nt, Human
uagguauuaaucuuauuguuua

SEQ ID NO: 47902 - RNA, 19 nt, Human
aguuuuaggauauaguuga

SEQ ID NO: 47903 - RNA, 20 nt, Human
cugucuggcccugaauuugc

SEQ ID NO: 47904 - RNA, 23 nt, Human
uggucccagcauccagcugccuc

SEQ ID NO: 47905 - RNA, 20 nt, Human
ccuaggcuggagugcagugg

SEQ ID NO: 47906 - RNA, 24 nt, Human
guguugaccaucgcaggggugggg

SEQ ID NO: 47907 - RNA, 22 nt, Human
gcccugagacagcugggccagc

SEQ ID NO: 47908 - RNA, 25 nt, Human
ccaggccuccugccccagccuacuc

SEQ ID NO: 47909 - RNA, 22 nt, Human
guguauguauacacacauauac

SEQ ID NO: 47910 - RNA, 22 nt, Human
cgugccuggcccugagcgaagc

SEQ ID NO: 47911 - RNA, 23 nt, Human
ucacuucuacaaaucagcaagau

SEQ ID NO: 47912 - RNA, 31 nt, Human
guggaaauauuccucugagaauggcuuuuau

SEQ ID NO: 47913 - RNA, 25 nt, Human
agcaguuuucacagugacuaccauu

SEQ ID NO: 47914 - RNA, 24 nt, Human
uuuguacuugcuugagucccauga

SEQ ID NO: 47915 - RNA, 19 nt, Human
uccuggcugccacaggguc

SEQ ID NO: 47916 - RNA, 20 nt, Human
auguuagccaggauggucuc

SEQ ID NO: 47917 - RNA, 24 nt, Human
uaugaucacagcucacugcagcuu

SEQ ID NO: 47918 - RNA, 31 nt, Human
uccauacuguauuuuguuugcauuaaguaau

SEQ ID NO: 47919 - RNA, 21 nt, Human
acccugcuucugcugcccuga

SEQ ID NO: 47920 - RNA, 22 nt, Human
ggccuggacgcuguggcuuaag

SEQ ID NO: 47921 - RNA, 22 nt, Human
gaucagccugggcaauauagug

SEQ ID NO: 47922 - RNA, 24 nt, Human
acagagcccuggguuguggaagag

SEQ ID NO: 47923 - RNA, 26 nt, Human
gucauuuuagcucaaacccuguaagu

SEQ ID NO: 47924 - RNA, 26 nt, Human
ggugaccucaugaaaugaguugcagc

SEQ ID NO: 47925 - RNA, 20 nt, Human
ugguccuggaguugguagau

SEQ ID NO: 47926 - RNA, 27 nt, Human
ggggaaaguuggagaagccguggccuu

SEQ ID NO: 47927 - RNA, 28 nt, Human
cuucccaccugcccuccccacccccugc

SEQ ID NO: 47928 - RNA, 22 nt, Human
uaaugaucuuggaauauuugcu

SEQ ID NO: 47929 - RNA, 21 nt, Human
uggagagaaaaaacuuaagua

SEQ ID NO: 47930 - RNA, 23 nt, Human
gcuggguuuauagaugugagcca

SEQ ID NO: 47931 - RNA, 27 nt, Human
cuuacagacuugaacauuugcagacgu

SEQ ID NO: 47932 - RNA, 27 nt, Human
caggcagcagaaaucauuuucuuuuug

SEQ ID NO: 47933 - RNA, 23 nt, Human
aaaucacugccagagacagucua

SEQ ID NO: 47934 - RNA, 22 nt, Human
uguggagggaagcauuggaacu

SEQ ID NO: 47935 - RNA, 25 nt, Human
gaauguccccaccaauccccgccac

SEQ ID NO: 47936 - RNA, 27 nt, Human
gcacaaaacccacacagauugucuuau

SEQ ID NO: 47937 - RNA, 22 nt, Human
cagcccuugcacugaccugccu

SEQ ID NO: 47938 - RNA, 22 nt, Human
cccaugccaccacccaccccaa

SEQ ID NO: 47939 - RNA, 27 nt, Human
accacaaccaacaccacaaaccuuuca

SEQ ID NO: 47940 - RNA, 21 nt, Human
agccuccuccucuagcagcaa

SEQ ID NO: 47941 - RNA, 27 nt, Human
uccagcagguuuagaggagauccagcc

SEQ ID NO: 47942 - RNA, 25 nt, Human
acuggaagccgggacugcuagggcu

SEQ ID NO: 47943 - RNA, 22 nt, Human
ugaaauucaaguuacaugugaa

SEQ ID NO: 47944 - RNA, 28 nt, Human
cacuuucuugcucaccucaccaguugca

SEQ ID NO: 47945 - RNA, 24 nt, Human
aaccgggaagugggaggacguaga

SEQ ID NO: 47946 - RNA, 24 nt, Human
ucuccugccagcucuucucaagca

SEQ ID NO: 47947 - RNA, 27 nt, Human
gagaagcaucauuuccccaacagggca

SEQ ID NO: 47948 - RNA, 26 nt, Human
cgccucagccucccaaaguguuagga

SEQ ID NO: 47949 - RNA, 20 nt, Human
ugauagugucugaaauugag

SEQ ID NO: 47950 - RNA, 22 nt, Human
gacuagugugcuuucugcuaca

SEQ ID NO: 47951 - RNA, 21 nt, Human
uaucugaauggccaacucacu

SEQ ID NO: 47952 - RNA, 19 nt, Human
gaaauaaaccaaggcucua

SEQ ID NO: 47953 - RNA, 21 nt, Human
cgguuuugcaagagccgggaa

SEQ ID NO: 47954 - RNA, 23 nt, Human
cgaguagcugggauuacaggcac

SEQ ID NO: 47955 - RNA, 23 nt, Human
ugaguagcugggauuauaggcac

SEQ ID NO: 47956 - RNA, 20 nt, Human
uugggagcaguguauguuac

SEQ ID NO: 47957 - RNA, 26 nt, Human
ucucaagcuccagauuggcuagauuu

SEQ ID NO: 47958 - RNA, 22 nt, Human
gucacccauacuuaacauuugu

SEQ ID NO: 47959 - RNA, 21 nt, Human
gggcuaauuaauuugcuuuau

SEQ ID NO: 47960 - RNA, 22 nt, Human
acucuucacuguuagcuuuuua

SEQ ID NO: 47961 - RNA, 21 nt, Human
ccggggggaccuggaggcaga

SEQ ID NO: 47962 - RNA, 26 nt, Human
gcagcaucuggaagagcuaggcaggg

SEQ ID NO: 47963 - RNA, 22 nt, Human
cacagccgaggaagcggcccgg

SEQ ID NO: 47964 - RNA, 19 nt, Human
gucuuuauguugcuggaac

SEQ ID NO: 47965 - RNA, 22 nt, Human
aggccuggucauugccuccuca

SEQ ID NO: 47966 - RNA, 27 nt, Human
agaacuccaccaggaauuccugugacg

SEQ ID NO: 47967 - RNA, 23 nt, Human
gucacccaggcuggagugcuaug

SEQ ID NO: 47968 - RNA, 23 nt, Human
gucucccaggcuggagugcaaug

SEQ ID NO: 47969 - RNA, 20 nt, Human
cacucauauucgucacguca

SEQ ID NO: 47970 - RNA, 28 nt, Human
gcucaugcugcugaccacugacucagcu

SEQ ID NO: 47971 - RNA, 21 nt, Human
uggggcagugauggccuccca

SEQ ID NO: 47972 - RNA, 23 nt, Human
uggaggcucaaguuuucugcuca

SEQ ID NO: 47973 - RNA, 20 nt, Human
uuuaucacucucugcuaaga

SEQ ID NO: 47974 - RNA, 27 nt, Human
gagacccuggacacuguuccugcuccc

SEQ ID NO: 47975 - RNA, 17 nt, Human
gcacagccagggcacag

SEQ ID NO: 47976 - RNA, 19 nt, Human
cucagacgacucuggaagc

SEQ ID NO: 47977 - RNA, 25 nt, Human
ugguugcuuucuaaaacugaaggag

SEQ ID NO: 47978 - RNA, 21 nt, Human
cacagcccugagaugggccgg

SEQ ID NO: 47979 - RNA, 21 nt, Human
ucuuucugggcucucuugccu

SEQ ID NO: 47980 - RNA, 21 nt, Human
cucugucucagacuuuuguac

SEQ ID NO: 47981 - RNA, 22 nt, Human
gcucucucuucaccugcucugu

SEQ ID NO: 47982 - RNA, 21 nt, Human
cacccagucuggagugcagug

SEQ ID NO: 47983 - RNA, 18 nt, Human
auuuuuuguaagccaguc

SEQ ID NO: 47984 - RNA, 19 nt, Human
cugggaggcgggcgcacug

SEQ ID NO: 47985 - RNA, 22 nt, Human
gcgcggaggcaggaggagcagu

SEQ ID NO: 47986 - RNA, 22 nt, Human
gcuucucucucuucauuggggu

SEQ ID NO: 47987 - RNA, 23 nt, Human
uggaagccacgggcucaagcagc

SEQ ID NO: 47988 - RNA, 22 nt, Human
gcucaugccuuuaaucccagca

SEQ ID NO: 47989 - RNA, 22 nt, Human
agaccagccuaaacaacauagu

SEQ ID NO: 47990 - RNA, 22 nt, Human
ccccagcccagcccagcccagc

SEQ ID NO: 47991 - RNA, 22 nt, Human
gcucucugggugagagaccgag

SEQ ID NO: 47992 - RNA, 22 nt, Human
caaaacugugcagagucuagaa

SEQ ID NO: 47993 - RNA, 20 nt, Human
cccaucucccugccuggccc

SEQ ID NO: 47994 - RNA, 22 nt, Human
ccugggcuugggggaagggacg

SEQ ID NO: 47995 - RNA, 22 nt, Human
gagcccagcccaggaguuugag

SEQ ID NO: 47996 - RNA, 19 nt, Human
uuacaacuaaauaacacag

SEQ ID NO: 47997 - RNA, 24 nt, Human
cucgcaccugugggaccucagggc

SEQ ID NO: 47998 - RNA, 27 nt, Human
gacacaggucagggcucagagugaccc

SEQ ID NO: 47999 - RNA, 23 nt, Human
accagcaccaucucuccuccuuu

SEQ ID NO: 48000 - RNA, 22 nt, Human
ugaucuuguuagcaaugcuguu

SEQ ID NO: 48001 - RNA, 23 nt, Human
cccucgcaguuccccuguccuga

SEQ ID NO: 48002 - RNA, 24 nt, Human
ccucuucccagguucccuggcccc

SEQ ID NO: 48003 - RNA, 19 nt, Human
agccucucggugcugaugu

SEQ ID NO: 48004 - RNA, 23 nt, Human
gcucacauuucuuucugucacca

SEQ ID NO: 48005 - RNA, 23 nt, Human
agcuagcagaaacuccauuuuca

SEQ ID NO: 48006 - RNA, 20 nt, Human
gggucuguuuucaaaaaaga

SEQ ID NO: 48007 - RNA, 21 nt, Human
gccagccacagguacaggcca

SEQ ID NO: 48008 - RNA, 21 nt, Human
ggaaacagcagccaaucggcg

SEQ ID NO: 48009 - RNA, 22 nt, Human
augugaagcugugggugcagug

SEQ ID NO: 48010 - RNA, 18 nt, Human
uggcuguuucucacgcuc

SEQ ID NO: 48011 - RNA, 21 nt, Human
auuucugcuccaagugcaauc

SEQ ID NO: 48012 - RNA, 22 nt, Human
cugcuggacucaggugcccaga

SEQ ID NO: 48013 - RNA, 18 nt, Human
uucuuauucuuuacuuga

SEQ ID NO: 48014 - RNA, 23 nt, Human
aggcugaggacacagccacguga

SEQ ID NO: 48015 - RNA, 21 nt, Human
aguccacccucuccagugguc

SEQ ID NO: 48016 - RNA, 20 nt, Human
cccugcucacccccuucucc

SEQ ID NO: 48017 - RNA, 23 nt, Human
cuguucuguaaucaugaguuugg

SEQ ID NO: 48018 - RNA, 21 nt, Human
ucaugagagaugaaugacaga

SEQ ID NO: 48019 - RNA, 20 nt, Human
uuuccggaggauugucaucu

SEQ ID NO: 48020 - RNA, 21 nt, Human
cugagacugaaggccaaggaa

SEQ ID NO: 48021 - RNA, 27 nt, Human
agguccccaggggggccgggcuggggc

SEQ ID NO: 48022 - RNA, 26 nt, Human
cccagccugugugcccuguuccuugc

SEQ ID NO: 48023 - RNA, 26 nt, Human
ccgggccaccacgcuuccuaugugac

SEQ ID NO: 48024 - RNA, 21 nt, Human
cccaggccugggaugcaguga

SEQ ID NO: 48025 - RNA, 24 nt, Human
ucacugcacuuucuuccugccuua

SEQ ID NO: 48026 - RNA, 21 nt, Human
cgacuccugccugaguuucca

SEQ ID NO: 48027 - RNA, 28 nt, Human
cacaggcuggggacagagguggcccugg

SEQ ID NO: 48028 - RNA, 27 nt, Human
agccccaucuaccacaucuucaugugg

SEQ ID NO: 48029 - RNA, 23 nt, Human
ucgcuugaggcuagugagcugug

SEQ ID NO: 48030 - RNA, 21 nt, Human
cuuucuugcucaccucaccag

SEQ ID NO: 48031 - RNA, 22 nt, Human
gcagguggaucacuugagguca

SEQ ID NO: 48032 - RNA, 22 nt, Human
gcaggcggaucaccugagguca

SEQ ID NO: 48033 - RNA, 17 nt, Human
gccagaauucacuagga

SEQ ID NO: 48034 - RNA, 24 nt, Human
cucuggacucuccccugugaggcc

SEQ ID NO: 48035 - RNA, 22 nt, Human
cuccccggcuggagugcagugg

SEQ ID NO: 48036 - RNA, 22 nt, Human
aggcucuccuugcagcugcuua

SEQ ID NO: 48037 - RNA, 20 nt, Human
ggguuuaagagauugggggc

SEQ ID NO: 48038 - RNA, 18 nt, Human
gccaguccuccacaccca

SEQ ID NO: 48039 - RNA, 23 nt, Human
uauuaaaauauucuaauuuugcu

SEQ ID NO: 48040 - RNA, 22 nt, Human
uugcuuaaccuggagugaagag

SEQ ID NO: 48041 - RNA, 23 nt, Human
agagguggggacagcaagaagcc

SEQ ID NO: 48042 - RNA, 21 nt, Human
ugcccuucugacccaaagcaa

SEQ ID NO: 48043 - RNA, 27 nt, Human
gaagcaguuccuucuaaaaggguagcc

SEQ ID NO: 48044 - RNA, 23 nt, Human
ggcuguuauuuugggccugaugu

SEQ ID NO: 48045 - RNA, 20 nt, Human
uaaacugguucaaagaaaua

SEQ ID NO: 48046 - RNA, 22 nt, Human
ggccaaaacugagauguguuua

SEQ ID NO: 48047 - RNA, 24 nt, Human
ucuccauugcccagcuccugccca

SEQ ID NO: 48048 - RNA, 19 nt, Human
uaaaugagugccacaaaag

SEQ ID NO: 48049 - RNA, 23 nt, Human
ugguaccaaaaugauuucuuugg

SEQ ID NO: 48050 - RNA, 26 nt, Human
ucgccuccucuucgucuuuucuaacc

SEQ ID NO: 48051 - RNA, 24 nt, Human
auguguguagacaaauauuuggag

SEQ ID NO: 48052 - RNA, 25 nt, Human
gugcccaggugguggcugcaaggug

SEQ ID NO: 48053 - RNA, 20 nt, Human
uccgagugaggcgacggggu

SEQ ID NO: 48054 - RNA, 28 nt, Human
ucucaaacuccugaccucaggugaugca

SEQ ID NO: 48055 - RNA, 21 nt, Human
cacacagccugugugcagugg

SEQ ID NO: 48056 - RNA, 22 nt, Human
aaagcagcuuguuuugaaagaa

SEQ ID NO: 48057 - RNA, 21 nt, Human
uuggaggcuaccucaccuggg

SEQ ID NO: 48058 - RNA, 26 nt, Human
ucacauucuacuugauuuacacuucc

SEQ ID NO: 48059 - RNA, 17 nt, Human
ggggugccccaggcuag

SEQ ID NO: 48060 - RNA, 22 nt, Human
agaccagccugggcaacauggu

SEQ ID NO: 48061 - RNA, 23 nt, Human
ccuuggaggcggagguugcauug

SEQ ID NO: 48062 - RNA, 22 nt, Human
ugcuggaaaggagaucaugccc

SEQ ID NO: 48063 - RNA, 23 nt, Human
cucgccugacccugcugccaccu

SEQ ID NO: 48064 - RNA, 26 nt, Human
gacaggauuuggaugaaguaauggau

SEQ ID NO: 48065 - RNA, 24 nt, Human
ccugauuucuagaacccgugacug

SEQ ID NO: 48066 - RNA, 24 nt, Human
auguuguccaggauggucuugauc

SEQ ID NO: 48067 - RNA, 22 nt, Human
aggcugaggcaggaggauugcc

SEQ ID NO: 48068 - RNA, 20 nt, Human
ccaaagcucagacuugccag

SEQ ID NO: 48069 - RNA, 24 nt, Human
ccuaucuucacaccugccaccuca

SEQ ID NO: 48070 - RNA, 25 nt, Human
gcaugcugcugggccacaccccaag

SEQ ID NO: 48071 - RNA, 32 nt, Human
aggagcacacggcaccuuuccccagagcccca

SEQ ID NO: 48072 - RNA, 26 nt, Human
cccagagacacucucccuccuccucu

SEQ ID NO: 48073 - RNA, 24 nt, Human
agggacagccacggccaagugguu

SEQ ID NO: 48074 - RNA, 21 nt, Human
gcuggccccgccuccuccuuc

SEQ ID NO: 48075 - RNA, 22 nt, Human
uugcccagcucuugaguacagu

SEQ ID NO: 48076 - RNA, 18 nt, Human
auucagccugggagacca

SEQ ID NO: 48077 - RNA, 23 nt, Human
ccgggccuggccuguccuacugu

SEQ ID NO: 48078 - RNA, 21 nt, Human
ucuguaauccuagcuacuugg

SEQ ID NO: 48079 - RNA, 22 nt, Human
cccuggccccaaccugccaccu

SEQ ID NO: 48080 - RNA, 26 nt, Human
aaacuaaguugugaaggaagggaggg

SEQ ID NO: 48081 - RNA, 26 nt, Human
cacuccugcucugcucgccucggauc

SEQ ID NO: 48082 - RNA, 25 nt, Human
caggagucuggagugcaauggcacg

SEQ ID NO: 48083 - RNA, 23 nt, Human
agagagggagggggaagagcaga

SEQ ID NO: 48084 - RNA, 21 nt, Human
uuugacauccccuugugucuc

SEQ ID NO: 48085 - RNA, 22 nt, Human
auguauauacacacagacacau

SEQ ID NO: 48086 - RNA, 20 nt, Human
uagugaagacaagcauuuca

SEQ ID NO: 48087 - RNA, 23 nt, Human
ucugaccacuugaggccugaucu

SEQ ID NO: 48088 - RNA, 22 nt, Human
uccaugcacgcuuccucuugca

SEQ ID NO: 48089 - RNA, 22 nt, Human
ugaugaacaggcugauaccuuc

SEQ ID NO: 48090 - RNA, 23 nt, Human
cuucugcugggaacucccugacu

SEQ ID NO: 48091 - RNA, 22 nt, Human
uguuaucaauauagaguguugc

SEQ ID NO: 48092 - RNA, 21 nt, Human
gcuagccguuugugccucguc

SEQ ID NO: 48093 - RNA, 27 nt, Human
augagacaccacauuccauuugugcua

SEQ ID NO: 48094 - RNA, 21 nt, Human
gggauuugugaugucuguaaa

SEQ ID NO: 48095 - RNA, 27 nt, Human
gcuuuucgcuuucuuucugcaugacua

SEQ ID NO: 48096 - RNA, 25 nt, Human
uugguuggagagcugaacaggcugg

SEQ ID NO: 48097 - RNA, 20 nt, Human
agaagcaaucucucucccca

SEQ ID NO: 48098 - RNA, 19 nt, Human
aggcugugaugagagccag

SEQ ID NO: 48099 - RNA, 27 nt, Human
ccuacuucuugcugccucacgguugcu

SEQ ID NO: 48100 - RNA, 24 nt, Human
gaggcuuccugcguccuccucacc

SEQ ID NO: 48101 - RNA, 22 nt, Human
agagauggacagagaacuuuau

SEQ ID NO: 48102 - RNA, 17 nt, Human
agcccuggcaaaugaau

SEQ ID NO: 48103 - RNA, 22 nt, Human
ccuccuggcucaggcccagcuu

SEQ ID NO: 48104 - RNA, 22 nt, Human
uguuuuauagcaaaacaggaaa

SEQ ID NO: 48105 - RNA, 27 nt, Human
gccucaaacuccugggcuccagugauc

SEQ ID NO: 48106 - RNA, 25 nt, Human
aacaguggccuggcuggcguggcag

SEQ ID NO: 48107 - RNA, 18 nt, Human
ccugcauuccuucuuaug

SEQ ID NO: 48108 - RNA, 22 nt, Human
gagaaagaccgugucucaaaac

SEQ ID NO: 48109 - RNA, 24 nt, Human
agagaucuacccgucucccucccu

SEQ ID NO: 48110 - RNA, 21 nt, Human
ugcauacaguaauuuuaagua

SEQ ID NO: 48111 - RNA, 21 nt, Human
guaacuguugucugugccuuu

SEQ ID NO: 48112 - RNA, 19 nt, Human
uaucucaaaucugcuuuca

SEQ ID NO: 48113 - RNA, 20 nt, Human
cacacaugugguugugcaca

SEQ ID NO: 48114 - RNA, 23 nt, Human
ucucacugugucacccaggcugg

SEQ ID NO: 48115 - RNA, 22 nt, Human
uccucauucugcauccuggcuu

SEQ ID NO: 48116 - RNA, 27 nt, Human
ccuuucgggggcaagguucaccuguca

SEQ ID NO: 48117 - RNA, 21 nt, Human
ugccuguagucagaccugcug

SEQ ID NO: 48118 - RNA, 23 nt, Human
ccgggucccgggcuaggccagcc

SEQ ID NO: 48119 - RNA, 21 nt, Human
gcagggagaauaacuugcgca

SEQ ID NO: 48120 - RNA, 22 nt, Human
ccuaaagccuggugauuauuca

SEQ ID NO: 48121 - RNA, 20 nt, Human
ggacacccucucccucuguc

SEQ ID NO: 48122 - RNA, 20 nt, Human
uacccaucuguugugcgcau

SEQ ID NO: 48123 - RNA, 21 nt, Human
ggcucccaggggaauagagga

SEQ ID NO: 48124 - RNA, 22 nt, Human
gcccccuugcuccuugguuuau

SEQ ID NO: 48125 - RNA, 25 nt, Human
ucuugcuguuuuuccucuuuaugac

SEQ ID NO: 48126 - RNA, 22 nt, Human
gucaagugauucuccugccuca

SEQ ID NO: 48127 - RNA, 22 nt, Human
aagggaggguggcagagacagu

SEQ ID NO: 48128 - RNA, 22 nt, Human
augugccuugugauugcugcug

SEQ ID NO: 48129 - RNA, 21 nt, Human
gugauucucaugccucagccu

SEQ ID NO: 48130 - RNA, 27 nt, Human
uuccauucccagaauauguuugcugcu

SEQ ID NO: 48131 - RNA, 20 nt, Human
cuaaugaggaaacugcacug

SEQ ID NO: 48132 - RNA, 27 nt, Human
uucaaagcuuuuguaaaauaaaaccac

SEQ ID NO: 48133 - RNA, 20 nt, Human
ccggcaugccuccucuucca

SEQ ID NO: 48134 - RNA, 25 nt, Human
ccuucccuguaguuucccagaugug

SEQ ID NO: 48135 - RNA, 15 nt, Human
caccucgccaccuca

SEQ ID NO: 48136 - RNA, 22 nt, Human
uaggaaagaggaagcaaauaga

SEQ ID NO: 48137 - RNA, 30 nt, Human
uccugcucuguuauuucuucaucugcuggg

SEQ ID NO: 48138 - RNA, 18 nt, Human
uuaacuugcccuuucagu

SEQ ID NO: 48139 - RNA, 27 nt, Human
ggucacugucucaccugcacucuccaa

SEQ ID NO: 48140 - RNA, 26 nt, Human
cugccucuggcccugguccugggcgg

SEQ ID NO: 48141 - RNA, 23 nt, Human
gaggccccgcggucgcucagggg

SEQ ID NO: 48142 - RNA, 25 nt, Human
uuucuugacuauaaauuuguuauuc

SEQ ID NO: 48143 - RNA, 22 nt, Human
ugggauguguucuucuuucucu

SEQ ID NO: 48144 - RNA, 21 nt, Human
uauccagcagaucauuuagga

SEQ ID NO: 48145 - RNA, 22 nt, Human
gggauuacaggugugagccgcu

SEQ ID NO: 48146 - RNA, 23 nt, Human
cuccaccagccaauggcaaccaa

SEQ ID NO: 48147 - RNA, 27 nt, Human
cccuaccuccuccucuggacaaagcgu

SEQ ID NO: 48148 - RNA, 20 nt, Human
cccugugaggagaggugcug

SEQ ID NO: 48149 - RNA, 20 nt, Human
aaagcugugcucuggacagu

SEQ ID NO: 48150 - RNA, 24 nt, Human
cugcaaucuccaccucccacaggu

SEQ ID NO: 48151 - RNA, 27 nt, Human
cccucagauguuccugcagugcugaaa

SEQ ID NO: 48152 - RNA, 23 nt, Human
ggagguaggaaggggaggaaguc

SEQ ID NO: 48153 - RNA, 27 nt, Human
ggaugcaaaggcaauuauucuuuguaa

SEQ ID NO: 48154 - RNA, 27 nt, Human
ugccuguagaacauaaacauuuuccug

SEQ ID NO: 48155 - RNA, 22 nt, Human
uugaagccuuccccacccccug

SEQ ID NO: 48156 - RNA, 22 nt, Human
cccaaagugcugggauuacagg

SEQ ID NO: 48157 - RNA, 22 nt, Human
ccuaaagugcugggauuauagg

SEQ ID NO: 48158 - RNA, 27 nt, Human
uugccuagaauaggcugcaugguguau

SEQ ID NO: 48159 - RNA, 31 nt, Human
ucuugguguuaucuuuucucagaauaaaauu

SEQ ID NO: 48160 - RNA, 23 nt, Human
aaauuguuacaacauagccauag

SEQ ID NO: 48161 - RNA, 24 nt, Human
gcucacaucuuggcacauuuaaga

SEQ ID NO: 48162 - RNA, 24 nt, Human
cuucuguggagccuguuccucacu

SEQ ID NO: 48163 - RNA, 23 nt, Human
ccagagauuacaaaaauguagcu

SEQ ID NO: 48164 - RNA, 22 nt, Human
ucaguagagaugggguuugacc

SEQ ID NO: 48165 - RNA, 21 nt, Human
gacagccucaagguuccuggc

SEQ ID NO: 48166 - RNA, 22 nt, Human
cucagcuugcggggugggggga

SEQ ID NO: 48167 - RNA, 24 nt, Human
uauguuuuuauuuguaaggugcug

SEQ ID NO: 48168 - RNA, 23 nt, Human
ggaauaacaaaacugucuggcuc

SEQ ID NO: 48169 - RNA, 21 nt, Human
ggugggagguaggcugugggg

SEQ ID NO: 48170 - RNA, 27 nt, Human
caggcugcagugcaguggugugaucuu

SEQ ID NO: 48171 - RNA, 26 nt, Human
gccauucaacuagggaaaugaagaaa

SEQ ID NO: 48172 - RNA, 22 nt, Human
ccugccuggcaggugugcgugc

SEQ ID NO: 48173 - RNA, 21 nt, Human
cugaauugcuguaacaagcac

SEQ ID NO: 48174 - RNA, 21 nt, Human
ccaagugcuggaauuacaggc

SEQ ID NO: 48175 - RNA, 27 nt, Human
agcucacucgagaucuuuguguccaga

SEQ ID NO: 48176 - RNA, 24 nt, Human
ccuccugcaguuccucaacaugcc

SEQ ID NO: 48177 - RNA, 22 nt, Human
ugccaaaaauuguuuuaugcuu

SEQ ID NO: 48178 - RNA, 25 nt, Human
ugggcuguaugcugugugguacagg

SEQ ID NO: 48179 - RNA, 23 nt, Human
ucaaaguggugaaacuaauaucu

SEQ ID NO: 48180 - RNA, 23 nt, Human
cacagggcuauuccuuuccucca

SEQ ID NO: 48181 - RNA, 24 nt, Human
ugacauuucacaggcagagaggug

SEQ ID NO: 48182 - RNA, 32 nt, Human
gggagggucagcuccuuccagcgaucauuuua

SEQ ID NO: 48183 - RNA, 24 nt, Human
agaugcagccacaguaaggcucca

SEQ ID NO: 48184 - RNA, 22 nt, Human
agggaucuuucuucuaaaacgg

SEQ ID NO: 48185 - RNA, 27 nt, Human
uucacagugucauuucuucagaacucc

SEQ ID NO: 48186 - RNA, 22 nt, Human
cucagccagaaaggcaaggagg

SEQ ID NO: 48187 - RNA, 20 nt, Human
gcacaaacaagcacauacac

SEQ ID NO: 48188 - RNA, 28 nt, Human
aguaaauuauuuguggcuuugcugagug

SEQ ID NO: 48189 - RNA, 24 nt, Human
auggcaacugccauuugaguccgg

SEQ ID NO: 48190 - RNA, 26 nt, Human
gacagagagcuccucccuggguuguc

SEQ ID NO: 48191 - RNA, 23 nt, Human
gcagccagggagagcccaggagc

SEQ ID NO: 48192 - RNA, 27 nt, Human
ccgcuccagaucugcacuggguguggc

SEQ ID NO: 48193 - RNA, 27 nt, Human
uguuuuuaacucaauauuuuccaugaa

SEQ ID NO: 48194 - RNA, 25 nt, Human
ccagcauuuguccuuuugugaaauc

SEQ ID NO: 48195 - RNA, 22 nt, Human
aguuggagguuggugacaagga

SEQ ID NO: 48196 - RNA, 13 nt, Human
accaaaugccuuc

SEQ ID NO: 48197 - RNA, 22 nt, Human
auauaaauaaggaaaauaaauc

SEQ ID NO: 48198 - RNA, 22 nt, Human
uacagaagaguacuguauuuuu

SEQ ID NO: 48199 - RNA, 26 nt, Human
ucuggcuucuugugucuggacuaagu

SEQ ID NO: 48200 - RNA, 22 nt, Human
gugaacaaaagaagacuuucca

SEQ ID NO: 48201 - RNA, 25 nt, Human
uccuuauuugcuucauuguacuacc

SEQ ID NO: 48202 - RNA, 23 nt, Human
auuaaugauucacaaacacuuuu

SEQ ID NO: 48203 - RNA, 19 nt, Human
ucucagccucgcuccgggc

SEQ ID NO: 48204 - RNA, 22 nt, Human
gagaucgugccauuacacucca

SEQ ID NO: 48205 - RNA, 20 nt, Human
gaggcugaagauuggguuca

SEQ ID NO: 48206 - RNA, 21 nt, Human
gacaguggacagggacucaga

SEQ ID NO: 48207 - RNA, 22 nt, Human
ucuguggguacccggagcacgg

SEQ ID NO: 48208 - RNA, 20 nt, Human
acccaucuaaauuucuugag

SEQ ID NO: 48209 - RNA, 24 nt, Human
cacuugaggucaggaguucaagac

SEQ ID NO: 48210 - RNA, 23 nt, Human
ggccuguaaucccagcacuuugg

SEQ ID NO: 48211 - RNA, 20 nt, Human
cgucccggcugaagugcagu

SEQ ID NO: 48212 - RNA, 23 nt, Human
ucccaaaguguucggauuacaaa

SEQ ID NO: 48213 - RNA, 22 nt, Human
cuucuuccucuucccccagggc

SEQ ID NO: 48214 - RNA, 19 nt, Human
agccucucuuccucuguca

SEQ ID NO: 48215 - RNA, 23 nt, Human
aacauuucucaccaacuuucuua

SEQ ID NO: 48216 - RNA, 24 nt, Human
cagugaccaccacccacaugacau

SEQ ID NO: 48217 - RNA, 27 nt, Human
uggccaacauggcaaaaccaucucuac

SEQ ID NO: 48218 - RNA, 23 nt, Human
ccuuccccucuuugcuacuauua

SEQ ID NO: 48219 - RNA, 21 nt, Human
aagaccaaaauuacuaauaaa

SEQ ID NO: 48220 - RNA, 22 nt, Human
guuaugaagaaaacaaugucau

SEQ ID NO: 48221 - RNA, 29 nt, Human
cugccuaauuccuuccucacagucuguag

SEQ ID NO: 48222 - RNA, 21 nt, Human
ucucugccaccaccaagucau

SEQ ID NO: 48223 - RNA, 22 nt, Human
uggguaccacagauaggcaugu

SEQ ID NO: 48224 - RNA, 25 nt, Human
acgcgguaaaacaucaucucuacua

SEQ ID NO: 48225 - RNA, 19 nt, Human
uuccacucuggagugaagu

SEQ ID NO: 48226 - RNA, 30 nt, Human
augaauaaacgucuuggcucugcccuuugg

SEQ ID NO: 48227 - RNA, 27 nt, Human
gcggagcugugagugccugcaggagag

SEQ ID NO: 48228 - RNA, 25 nt, Human
ccaagcagaaguuauuuaagaaaga

SEQ ID NO: 48229 - RNA, 18 nt, Human
uccucauauucaguccag

SEQ ID NO: 48230 - RNA, 20 nt, Human
cugacuucucacuuccuaag

SEQ ID NO: 48231 - RNA, 23 nt, Human
ucuccucccgaaggaacagcuga

SEQ ID NO: 48232 - RNA, 20 nt, Human
acugcucagggaaguacaga

SEQ ID NO: 48233 - RNA, 18 nt, Human
caacucuucgccuuugcu

SEQ ID NO: 48234 - RNA, 20 nt, Human
auuuucucauuuaaaggaca

SEQ ID NO: 48235 - RNA, 25 nt, Human
cuuuccucaaaucaaaaacaggcag

SEQ ID NO: 48236 - RNA, 20 nt, Human
ggauccuuccuaucucucca

SEQ ID NO: 48237 - RNA, 22 nt, Human
uccucugcucugugguacuucc

SEQ ID NO: 48238 - RNA, 22 nt, Human
caggaaagagaauacuugcaga

SEQ ID NO: 48239 - RNA, 24 nt, Human
aggcuggagugcaguguugcaguc

SEQ ID NO: 48240 - RNA, 22 nt, Human
gagagaggugcagggaggaagg

SEQ ID NO: 48241 - RNA, 24 nt, Human
uuucaguauuuacuguguaauacu

SEQ ID NO: 48242 - RNA, 26 nt, Human
ugcccaggccaggacugaggcaagcc

SEQ ID NO: 48243 - RNA, 19 nt, Human
cuauuccuggaaaccacaa

SEQ ID NO: 48244 - RNA, 20 nt, Human
caacaaauauuuuccguugc

SEQ ID NO: 48245 - RNA, 21 nt, Human
ugucccacccacacagcugcc

SEQ ID NO: 48246 - RNA, 21 nt, Human
uuaccugcauuuguucacuuu

SEQ ID NO: 48247 - RNA, 20 nt, Human
uuuucucaaaauuuagugaa

SEQ ID NO: 48248 - RNA, 24 nt, Human
uccaaguagagauuacacccagca

SEQ ID NO: 48249 - RNA, 20 nt, Human
ucaucuucagcuugugcaca

SEQ ID NO: 48250 - RNA, 22 nt, Human
ggaacagaugggaaccagcuca

SEQ ID NO: 48251 - RNA, 21 nt, Human
cuguaucucuuguucucuccu

SEQ ID NO: 48252 - RNA, 20 nt, Human
ucuucuuuguuacccuugac

SEQ ID NO: 48253 - RNA, 21 nt, Human
gaggggagggggcaguugggc

SEQ ID NO: 48254 - RNA, 23 nt, Human
caugcugccugcuuucuggagcu

SEQ ID NO: 48255 - RNA, 18 nt, Human
agugagagggcagaggaa

SEQ ID NO: 48256 - RNA, 21 nt, Human
uuauuuccucuggcuuccuca

SEQ ID NO: 48257 - RNA, 22 nt, Human
guuuuucuguaacacagaauau

SEQ ID NO: 48258 - RNA, 22 nt, Human
cgcccaggcuggagcgcagucc

SEQ ID NO: 48259 - RNA, 25 nt, Human
uguaauccauucacauuccucaguu

SEQ ID NO: 48260 - RNA, 24 nt, Human
gagggaggggugugcaggagccgc

SEQ ID NO: 48261 - RNA, 23 nt, Human
ccacugggagagcugguggugca

SEQ ID NO: 48262 - RNA, 21 nt, Human
gccagcacgccgucauggccc

SEQ ID NO: 48263 - RNA, 27 nt, Human
ugcugggacugcaggcgugagccaccg

SEQ ID NO: 48264 - RNA, 21 nt, Human
cuccuccuccucuuccagcaa

SEQ ID NO: 48265 - RNA, 21 nt, Human
cccagcacuuugggagacuga

SEQ ID NO: 48266 - RNA, 26 nt, Human
acuugccugggaaacauagcagaccu

SEQ ID NO: 48267 - RNA, 27 nt, Human
ugccgcaggcugggugcacggccgggc

SEQ ID NO: 48268 - RNA, 21 nt, Human
cucacacacuaugcucucuca

SEQ ID NO: 48269 - RNA, 28 nt, Human
gggaagugagacuagaagaggggagcag

SEQ ID NO: 48270 - RNA, 20 nt, Human
gccagacauacacacguuac

SEQ ID NO: 48271 - RNA, 20 nt, Human
gccacaagcuaagaaacacc

SEQ ID NO: 48272 - RNA, 23 nt, Human
uauggccguaucaaaugguagcu

SEQ ID NO: 48273 - RNA, 23 nt, Human
gaaugaggcaguuggcaaacuuc

SEQ ID NO: 48274 - RNA, 23 nt, Human
agcuauuuggagcuuauguaaua

SEQ ID NO: 48275 - RNA, 21 nt, Human
uaaacauccacuucucuuuca

SEQ ID NO: 48276 - RNA, 22 nt, Human
ccucccaccugcaacagcugcc

SEQ ID NO: 48277 - RNA, 22 nt, Human
uauaggugggaagaaaagguga

SEQ ID NO: 48278 - RNA, 22 nt, Human
uucaagcaauccuccugccuca

SEQ ID NO: 48279 - RNA, 22 nt, Human
uuuaagcaauucuccugccuca

SEQ ID NO: 48280 - RNA, 26 nt, Human
guuauccugaauacaugucuaacaau

SEQ ID NO: 48281 - RNA, 19 nt, Human
ggcugagaaauagcaggua

SEQ ID NO: 48282 - RNA, 25 nt, Human
gugaguaauugaggaaaaacugaca

SEQ ID NO: 48283 - RNA, 21 nt, Human
ccuuagaccccgcugugcccu

SEQ ID NO: 48284 - RNA, 32 nt, Human
aacacggcugugcucagggcucgcgggugacc

SEQ ID NO: 48285 - RNA, 26 nt, Human
uagggagggacugggaugagagaaag

SEQ ID NO: 48286 - RNA, 19 nt, Human
agaggcugggacgugggua

SEQ ID NO: 48287 - RNA, 21 nt, Human
uuaaauguuaaucaaaaugag

SEQ ID NO: 48288 - RNA, 27 nt, Human
uucacagucagauuuccaccauugaga

SEQ ID NO: 48289 - RNA, 27 nt, Human
aacauaguguggacuggaugaugccuu

SEQ ID NO: 48290 - RNA, 25 nt, Human
ggcucacugcaaccuccaacucccu

SEQ ID NO: 48291 - RNA, 24 nt, Human
uuagugccaccaccuucugaacac

SEQ ID NO: 48292 - RNA, 24 nt, Human
acugucaccaaggcuuagugcagu

SEQ ID NO: 48293 - RNA, 23 nt, Human
ccacugucccuccccuuggugcu

SEQ ID NO: 48294 - RNA, 22 nt, Human
uuacagacaugagccacugcac

SEQ ID NO: 48295 - RNA, 27 nt, Human
accagcguggucaacaugguguaaccc

SEQ ID NO: 48296 - RNA, 27 nt, Human
uagccacuggacugacgacuugagugc

SEQ ID NO: 48297 - RNA, 24 nt, Human
ccgguccugccgcucuccuggggc

SEQ ID NO: 48298 - RNA, 23 nt, Human
accacaucuggcuaauuuuuugu

SEQ ID NO: 48299 - RNA, 22 nt, Human
aaccugacgaaaaguaacauca

SEQ ID NO: 48300 - RNA, 19 nt, Human
gagccuuuugacagcuggu

SEQ ID NO: 48301 - RNA, 23 nt, Human
uccuaaaucugccuuuucaucua

SEQ ID NO: 48302 - RNA, 27 nt, Human
ugucacccacgcuggagugcugugaug

SEQ ID NO: 48303 - RNA, 28 nt, Human
aggcccuucagccccaagguuguccucg

SEQ ID NO: 48304 - RNA, 25 nt, Human
gacaguuucaauugaaggugcuguu

SEQ ID NO: 48305 - RNA, 21 nt, Human
acugagaccuaacucacugga

SEQ ID NO: 48306 - RNA, 20 nt, Human
ccuccccucugcacuuuguu

SEQ ID NO: 48307 - RNA, 21 nt, Human
ugggugagguaggcgggaaag

SEQ ID NO: 48308 - RNA, 24 nt, Human
gaaacggaggggaugaauucuucc

SEQ ID NO: 48309 - RNA, 30 nt, Human
caccucugggagcuggaguccacuggggug

SEQ ID NO: 48310 - RNA, 20 nt, Human
aucaaugucuugaauccuuu

SEQ ID NO: 48311 - RNA, 27 nt, Human
ggucucgaucucuugaccucgugauuc

SEQ ID NO: 48312 - RNA, 25 nt, Human
cucagacuccauuuguauuauaguc

SEQ ID NO: 48313 - RNA, 22 nt, Human
agagacacccuuuguaacucuc

SEQ ID NO: 48314 - RNA, 22 nt, Human
caccacccagacuugggggcag

SEQ ID NO: 48315 - RNA, 26 nt, Human
gaacguuucccccacuguguuccagu

SEQ ID NO: 48316 - RNA, 23 nt, Human
gagcugccacugcaugucccaac

SEQ ID NO: 48317 - RNA, 24 nt, Human
ggugggcuccuggaacugcagcag

SEQ ID NO: 48318 - RNA, 22 nt, Human
gcgugagcccccaugcuuggcc

SEQ ID NO: 48319 - RNA, 25 nt, Human
aggccaccugucacucauggccagg

SEQ ID NO: 48320 - RNA, 27 nt, Human
ggaggcugaggcaggaggaucgcuuga

SEQ ID NO: 48321 - RNA, 24 nt, Human
cugcagcugcugaaguucugagcc

SEQ ID NO: 48322 - RNA, 20 nt, Human
guugcacuuucagccugugu

SEQ ID NO: 48323 - RNA, 22 nt, Human
aucugccagccccaggccucua

SEQ ID NO: 48324 - RNA, 19 nt, Human
gcuagacgcacagacucag

SEQ ID NO: 48325 - RNA, 22 nt, Human
ggacccccaaagugcugggauu

SEQ ID NO: 48326 - RNA, 23 nt, Human
agcuauagucucuucagcauuuu

SEQ ID NO: 48327 - RNA, 27 nt, Human
caaaaauugaaacauuuccuuuugcuc

SEQ ID NO: 48328 - RNA, 23 nt, Human
ugaguagcugggauuauagguac

SEQ ID NO: 48329 - RNA, 21 nt, Human
cccccuggcauguuucaccac

SEQ ID NO: 48330 - RNA, 22 nt, Human
cucccucugcuccugagaugcu

SEQ ID NO: 48331 - RNA, 27 nt, Human
uccuccuggagggcugccuagggccac

SEQ ID NO: 48332 - RNA, 21 nt, Human
auugaggcccaguuccuggga

SEQ ID NO: 48333 - RNA, 27 nt, Human
gcaggugauuugggaaguguagaaaga

SEQ ID NO: 48334 - RNA, 27 nt, Human
gggcggguggggaggggugcucugcug

SEQ ID NO: 48335 - RNA, 24 nt, Human
cauucacaagccuccuguaccuca

SEQ ID NO: 48336 - RNA, 28 nt, Human
aaaaagccagguaauuaauaaucugcac

SEQ ID NO: 48337 - RNA, 28 nt, Human
cuucagccgugguccuccugggaccggu

SEQ ID NO: 48338 - RNA, 21 nt, Human
gccugggcagcugaacaagac

SEQ ID NO: 48339 - RNA, 17 nt, Human
gcauacaccugccugca

SEQ ID NO: 48340 - RNA, 22 nt, Human
ugucuuagauguugguggugca

SEQ ID NO: 48341 - RNA, 28 nt, Human
ccaagggggcagagggcuuucagcgccc

SEQ ID NO: 48342 - RNA, 25 nt, Human
ggccagaggcauccuggauauuaga

SEQ ID NO: 48343 - RNA, 20 nt, Human
ccucauucaugagcugguca

SEQ ID NO: 48344 - RNA, 23 nt, Human
cuucuccucuccccagauaccuc

SEQ ID NO: 48345 - RNA, 26 nt, Human
cccugcacucccuccuggagcucugu

SEQ ID NO: 48346 - RNA, 26 nt, Human
ucugcuuucaaauuacaaugguggga

SEQ ID NO: 48347 - RNA, 21 nt, Human
ccaaccuuaaaccucuucuau

SEQ ID NO: 48348 - RNA, 20 nt, Human
cccaaggugaaccagcuggu

SEQ ID NO: 48349 - RNA, 22 nt, Human
aaccuucggaguagcugggauc

SEQ ID NO: 48350 - RNA, 16 nt, Human
cugcccuugugcagug

SEQ ID NO: 48351 - RNA, 23 nt, Human
ugcuucugggcaguagaggcgcg

SEQ ID NO: 48352 - RNA, 22 nt, Human
ugugagccggugguggcggcag

SEQ ID NO: 48353 - RNA, 25 nt, Human
ucauacccuguaauuuugucccaaa

SEQ ID NO: 48354 - RNA, 20 nt, Human
uuuaauauuuacagaaaaau

SEQ ID NO: 48355 - RNA, 21 nt, Human
gcagggcugccuguuuauuga

SEQ ID NO: 48356 - RNA, 20 nt, Human
uucucccacagaaaugauga

SEQ ID NO: 48357 - RNA, 22 nt, Human
gcuaagcuguuuccagggugac

SEQ ID NO: 48358 - RNA, 21 nt, Human
aagggaaagcuucauucuccu

SEQ ID NO: 48359 - RNA, 21 nt, Human
cagacuggcuggcugcaguga

SEQ ID NO: 48360 - RNA, 25 nt, Human
ugacuucuauccuguuaacacugua

SEQ ID NO: 48361 - RNA, 22 nt, Human
gaacugcacuacaagacacuuu

SEQ ID NO: 48362 - RNA, 23 nt, Human
ucugaacuguaaauauuuaaaga

SEQ ID NO: 48363 - RNA, 24 nt, Human
ucuuccucugcuauacccuaugca

SEQ ID NO: 48364 - RNA, 22 nt, Human
uaauauuucuccaucauggccu

SEQ ID NO: 48365 - RNA, 27 nt, Human
cagcccuccugugccugcuucccugug

SEQ ID NO: 48366 - RNA, 26 nt, Human
auuucgaauuccugaccucaagugau

SEQ ID NO: 48367 - RNA, 22 nt, Human
cugccaaauccaccuccugagg

SEQ ID NO: 48368 - RNA, 27 nt, Human
ugguagcaggagcucaguguggugcuc

SEQ ID NO: 48369 - RNA, 22 nt, Human
gucuggcuucucucuggacugg

SEQ ID NO: 48370 - RNA, 20 nt, Human
guaauguuaacugaucagga

SEQ ID NO: 48371 - RNA, 22 nt, Human
gcguaagggcccacgcccagcc

SEQ ID NO: 48372 - RNA, 18 nt, Human
ccaggcuggagguuaaug

SEQ ID NO: 48373 - RNA, 27 nt, Human
auaaagugcaguuuaaaacccaaaaaa

SEQ ID NO: 48374 - RNA, 22 nt, Human
uucagccucccaagcaccuggg

SEQ ID NO: 48375 - RNA, 27 nt, Human
ccgccacggcccugcucuguucccugg

SEQ ID NO: 48376 - RNA, 30 nt, Human
cuuccucccccgcuuccuccuagcccugug

SEQ ID NO: 48377 - RNA, 22 nt, Human
gcagugucuuucggaauuuuua

SEQ ID NO: 48378 - RNA, 21 nt, Human
gcaacuggugaaacuccgcgc

SEQ ID NO: 48379 - RNA, 21 nt, Human
ugugugaccaugugucuguga

SEQ ID NO: 48380 - RNA, 18 nt, Human
gccuuuuuaagaggaauc

SEQ ID NO: 48381 - RNA, 24 nt, Human
auucuguuugcuuaauucagagua

SEQ ID NO: 48382 - RNA, 19 nt, Human
acccgagcuggagugcagu

SEQ ID NO: 48383 - RNA, 21 nt, Human
ucuccacugcucucagccucc

SEQ ID NO: 48384 - RNA, 21 nt, Human
gcugcccaggcuagagugcag

SEQ ID NO: 48385 - RNA, 22 nt, Human
ggugcugccucacacuccugag

SEQ ID NO: 48386 - RNA, 23 nt, Human
cagaagugauuuaguuguggaaa

SEQ ID NO: 48387 - RNA, 20 nt, Human
uuaaucuccucuucucucca

SEQ ID NO: 48388 - RNA, 20 nt, Human
aaagauguucauuuaaucau

SEQ ID NO: 48389 - RNA, 26 nt, Human
caugccaccacacccagcuaauuuuu

SEQ ID NO: 48390 - RNA, 22 nt, Human
gagagggacguguagggagagu

SEQ ID NO: 48391 - RNA, 21 nt, Human
gguuucugguuuuagaagguu

SEQ ID NO: 48392 - RNA, 18 nt, Human
cgcugcgcucccaccucg

SEQ ID NO: 48393 - RNA, 20 nt, Human
ucaaauuuuucaucucuuca

SEQ ID NO: 48394 - RNA, 20 nt, Human
uuacccagcaucuggaguac

SEQ ID NO: 48395 - RNA, 21 nt, Human
cucagcuuagacugcguaaga

SEQ ID NO: 48396 - RNA, 21 nt, Human
caccagcccugggcacgagau

SEQ ID NO: 48397 - RNA, 26 nt, Human
cacccaggcuggaguggaguggcacg

SEQ ID NO: 48398 - RNA, 22 nt, Human
gaaaacugaaggauauggggaa

SEQ ID NO: 48399 - RNA, 22 nt, Human
uucuccucuccuucccauggcc

SEQ ID NO: 48400 - RNA, 24 nt, Human
cagauccuaccagguugcuccucc

SEQ ID NO: 48401 - RNA, 22 nt, Human
agcauuaggaugcucaaacauc

SEQ ID NO: 48402 - RNA, 22 nt, Human
caggcucaggagaagccagugu

SEQ ID NO: 48403 - RNA, 21 nt, Human
ccaucuauuucacugaagauu

SEQ ID NO: 48404 - RNA, 29 nt, Human
gcuuugccgccucuccaucgucuugggcc

SEQ ID NO: 48405 - RNA, 20 nt, Human
caggaggcggaggcugcagu

SEQ ID NO: 48406 - RNA, 22 nt, Human
aagaaccguguuggugcugcua

SEQ ID NO: 48407 - RNA, 21 nt, Human
guaaguguuuaauugugcaaa

SEQ ID NO: 48408 - RNA, 25 nt, Human
ggcaucaaccaccauggauuuuuac

SEQ ID NO: 48409 - RNA, 21 nt, Human
cuuguuuucaaaaugguuaca

SEQ ID NO: 48410 - RNA, 29 nt, Human
gugucccagccacgcagggccauccacug

SEQ ID NO: 48411 - RNA, 22 nt, Human
gcacacacacccauaccucuca

SEQ ID NO: 48412 - RNA, 22 nt, Human
cgcccuggcuggagugcaaugg

SEQ ID NO: 48413 - RNA, 29 nt, Human
gcugguuuuaccaucaucgugaugccacu

SEQ ID NO: 48414 - RNA, 22 nt, Human
guccccagccccaaccccacuc

SEQ ID NO: 48415 - RNA, 20 nt, Human
ucccggguugacaccauuuu

SEQ ID NO: 48416 - RNA, 20 nt, Human
uucaaauccaagcucuuuca

SEQ ID NO: 48417 - RNA, 21 nt, Human
ucugaacuggaguggaguagg

SEQ ID NO: 48418 - RNA, 21 nt, Human
caacaacagaagggaaauuuc

SEQ ID NO: 48419 - RNA, 27 nt, Human
cuuugggcguccaccagggccucaucc

SEQ ID NO: 48420 - RNA, 20 nt, Human
ucaacucaagaugucugauu

SEQ ID NO: 48421 - RNA, 27 nt, Human
ggggccccacagccgagacgacguguc

SEQ ID NO: 48422 - RNA, 27 nt, Human
cuugacagaaauguggccauuaagaag

SEQ ID NO: 48423 - RNA, 22 nt, Human
gcagcagccccucuuucaccuc

SEQ ID NO: 48424 - RNA, 21 nt, Human
cacaguuuaauaccacagcuu

SEQ ID NO: 48425 - RNA, 21 nt, Human
agugaaacuacuuaacacagc

SEQ ID NO: 48426 - RNA, 19 nt, Human
aagaucugauaucuguaaa

SEQ ID NO: 48427 - RNA, 22 nt, Human
cucccucauccucccaucccag

SEQ ID NO: 48428 - RNA, 27 nt, Human
ggggcagcugugccugcugcccucucu

SEQ ID NO: 48429 - RNA, 22 nt, Human
ccgcuuuggacagaaaaucacu

SEQ ID NO: 48430 - RNA, 22 nt, Human
cucucucacugaaugcugccuc

SEQ ID NO: 48431 - RNA, 21 nt, Human
ucuucccagcucucugcucug

SEQ ID NO: 48432 - RNA, 18 nt, Human
agccaaggggccaccuca

SEQ ID NO: 48433 - RNA, 24 nt, Human
agagaaaccuccaggagacugcua

SEQ ID NO: 48434 - RNA, 27 nt, Human
acagaugggcuggaaguaaggaaacau

SEQ ID NO: 48435 - RNA, 20 nt, Human
ccguggagccgcauccacug

SEQ ID NO: 48436 - RNA, 21 nt, Human
auacagugucuggacgcugcc

SEQ ID NO: 48437 - RNA, 20 nt, Human
uuguguagccaaaaauuaca

SEQ ID NO: 48438 - RNA, 27 nt, Human
uuugcagaagaaauguucguuaccuac

SEQ ID NO: 48439 - RNA, 23 nt, Human
aauugcagagaaucagacuccuu

SEQ ID NO: 48440 - RNA, 21 nt, Human
gguacgacauucuauauugca

SEQ ID NO: 48441 - RNA, 21 nt, Human
ccuuucaucugugcucauacu

SEQ ID NO: 48442 - RNA, 24 nt, Human
auguuagccaggauggucuggauc

SEQ ID NO: 48443 - RNA, 19 nt, Human
accccuggcuguacugcuc

SEQ ID NO: 48444 - RNA, 21 nt, Human
uugcagaggaaaacagccaaa

SEQ ID NO: 48445 - RNA, 24 nt, Human
cagccggcccuggagugcgggcgg

SEQ ID NO: 48446 - RNA, 20 nt, Human
ggggcucugcccucccuccu

SEQ ID NO: 48447 - RNA, 21 nt, Human
cgcccaggcuggagugcaaug

SEQ ID NO: 48448 - RNA, 22 nt, Human
aaagcguugggauuauaggcau

SEQ ID NO: 48449 - RNA, 26 nt, Human
aggauaaagucauccccaaggcucca

SEQ ID NO: 48450 - RNA, 22 nt, Human
accccaggcuggagugcagugg

SEQ ID NO: 48451 - RNA, 22 nt, Human
auugcauuucaaaaacaugcua

SEQ ID NO: 48452 - RNA, 26 nt, Human
aggaagaggucaaugaccuaggagua

SEQ ID NO: 48453 - RNA, 25 nt, Human
uuggaaucuggaauacagaauuggg

SEQ ID NO: 48454 - RNA, 23 nt, Human
aaaaaauucucccuuuguaaccu

SEQ ID NO: 48455 - RNA, 22 nt, Human
gugcaaccucugccucccaggu

SEQ ID NO: 48456 - RNA, 25 nt, Human
gggccuggcggccuguggguuuggg

SEQ ID NO: 48457 - RNA, 19 nt, Human
agaaucucaucucagugaa

SEQ ID NO: 48458 - RNA, 21 nt, Human
ucacccagucuggagugcagu

SEQ ID NO: 48459 - RNA, 23 nt, Human
cauguuucccuggcuggucucgg

SEQ ID NO: 48460 - RNA, 26 nt, Human
caugccggucaaaggaggcaccaagu

SEQ ID NO: 48461 - RNA, 25 nt, Human
cuccaaggcuggagugcagugacgc

SEQ ID NO: 48462 - RNA, 26 nt, Human
cuccaccccuccagugggugcgggac

SEQ ID NO: 48463 - RNA, 27 nt, Human
aaagugcugggauuacaggcggccagg

SEQ ID NO: 48464 - RNA, 21 nt, Human
uguacagaugaugacugcaaa

SEQ ID NO: 48465 - RNA, 25 nt, Human
aggagcagagccugcgcaucuggag

SEQ ID NO: 48466 - RNA, 22 nt, Human
aaaccagcucccaugugcugag

SEQ ID NO: 48467 - RNA, 22 nt, Human
gguccaagccuccccuccacca

SEQ ID NO: 48468 - RNA, 29 nt, Human
ucucuagauccacugugguuggcaguaug

SEQ ID NO: 48469 - RNA, 30 nt, Human
gaggcggagcggcggcaggagcggguagug

SEQ ID NO: 48470 - RNA, 23 nt, Human
gagccagcccuaccucaggcugg

SEQ ID NO: 48471 - RNA, 30 nt, Human
ucaggucagagcccaggaauucucacaggu

SEQ ID NO: 48472 - RNA, 22 nt, Human
acacuagccuucuuuuguacuu

SEQ ID NO: 48473 - RNA, 27 nt, Human
ggacuguuucguuucugcuucuagaga

SEQ ID NO: 48474 - RNA, 19 nt, Human
aacugauuuuaaaggguuu

SEQ ID NO: 48475 - RNA, 22 nt, Human
ugcccaaacccuuaacugacau

SEQ ID NO: 48476 - RNA, 24 nt, Human
uuccuuccuugcugcauuuccucc

SEQ ID NO: 48477 - RNA, 23 nt, Human
uggcaggacacagagagguaggu

SEQ ID NO: 48478 - RNA, 21 nt, Human
guggucucccuuuuuucaaaa

SEQ ID NO: 48479 - RNA, 21 nt, Human
cggacagcugcccagacacau

SEQ ID NO: 48480 - RNA, 21 nt, Human
cuggccuugguuccuccagca

SEQ ID NO: 48481 - RNA, 27 nt, Human
uuuauuucucagccugcccuuggggag

SEQ ID NO: 48482 - RNA, 25 nt, Human
guccacgggucuccccauucccacc

SEQ ID NO: 48483 - RNA, 23 nt, Human
cuucaucacuauucuuaggauaa

SEQ ID NO: 48484 - RNA, 22 nt, Human
caagaucacagguugaugcugc

SEQ ID NO: 48485 - RNA, 24 nt, Human
agaugccacagcacagaaauaucg

SEQ ID NO: 48486 - RNA, 22 nt, Human
ugaccagccuggccaauauggu

SEQ ID NO: 48487 - RNA, 22 nt, Human
ugccucccggguucaagcaauu

SEQ ID NO: 48488 - RNA, 20 nt, Human
aacacaaaauuaucaguguu

SEQ ID NO: 48489 - RNA, 26 nt, Human
cgggcacggccuccccacggccuguc

SEQ ID NO: 48490 - RNA, 22 nt, Human
uuuccagguuguuaauccagcu

SEQ ID NO: 48491 - RNA, 20 nt, Human
cauucagcuaauacaaagcu

SEQ ID NO: 48492 - RNA, 21 nt, Human
cacagcugcuuccccaggcug

SEQ ID NO: 48493 - RNA, 21 nt, Human
uuuaaaggaaaaagcaaccaa

SEQ ID NO: 48494 - RNA, 31 nt, Human
gccccuuccuggaugaaggagucaaagaaua

SEQ ID NO: 48495 - RNA, 19 nt, Human
gcacaugccaccacaccca

SEQ ID NO: 48496 - RNA, 22 nt, Human
uugugugguaugucacucagaa

SEQ ID NO: 48497 - RNA, 25 nt, Human
agagaauaagccuccuggggggucu

SEQ ID NO: 48498 - RNA, 27 nt, Human
caugugguaucuggagcauuguguaua

SEQ ID NO: 48499 - RNA, 25 nt, Human
agacacuacagaccacagcauucag

SEQ ID NO: 48500 - RNA, 23 nt, Human
cuuuguuaucuuccacuggaaaa

SEQ ID NO: 48501 - RNA, 22 nt, Human
ggcagcagcugcagcaucaucu

SEQ ID NO: 48502 - RNA, 23 nt, Human
ggugggugcuggaggauuuucca

SEQ ID NO: 48503 - RNA, 23 nt, Human
ugucuccccggcuggagugcagu

SEQ ID NO: 48504 - RNA, 22 nt, Human
uagaaagagcccagaagcagcc

SEQ ID NO: 48505 - RNA, 27 nt, Human
gcccaguccaucuaccuggcugggauu

SEQ ID NO: 48506 - RNA, 20 nt, Human
uccagccuggggaccccacu

SEQ ID NO: 48507 - RNA, 20 nt, Human
ucugcuggucugugcugguc

SEQ ID NO: 48508 - RNA, 26 nt, Human
gggaagggaagggcuuuucuccacac

SEQ ID NO: 48509 - RNA, 21 nt, Human
caugcucagaggugggaaggg

SEQ ID NO: 48510 - RNA, 27 nt, Human
augagggagggagaauaagucagucau

SEQ ID NO: 48511 - RNA, 27 nt, Human
guuuuaccgcugacugaacacaaccaa

SEQ ID NO: 48512 - RNA, 23 nt, Human
uuuuuggggguaaaaaauauagc

SEQ ID NO: 48513 - RNA, 22 nt, Human
ggggacauccugggucaucuca

SEQ ID NO: 48514 - RNA, 19 nt, Human
gagggaggggccaggcagc

SEQ ID NO: 48515 - RNA, 27 nt, Human
cugagugucccaaagguuuauuaauaa

SEQ ID NO: 48516 - RNA, 23 nt, Human
cccuaaaauauuccuauaauacu

SEQ ID NO: 48517 - RNA, 21 nt, Human
guuucaccauguugcccaggc

SEQ ID NO: 48518 - RNA, 27 nt, Human
cugcuauuucccaagcuggagugcagu

SEQ ID NO: 48519 - RNA, 22 nt, Human
uuuuccacguuggucaggcugg

SEQ ID NO: 48520 - RNA, 22 nt, Human
ggcaaagcaggaaccaagagac

SEQ ID NO: 48521 - RNA, 18 nt, Human
ccccucggccccagcaca

SEQ ID NO: 48522 - RNA, 27 nt, Human
ccccagccaggguuggagucuuagccu

SEQ ID NO: 48523 - RNA, 25 nt, Human
ccagcagggcugcugugaauuugug

SEQ ID NO: 48524 - RNA, 27 nt, Human
agggucugaguuucacauuugaaccaa

SEQ ID NO: 48525 - RNA, 23 nt, Human
cgauccuggcccuccaccugccu

SEQ ID NO: 48526 - RNA, 25 nt, Human
cccaccccgcgcgccucugccgccu

SEQ ID NO: 48527 - RNA, 20 nt, Human
cuuuuguaugucucaguguu

SEQ ID NO: 48528 - RNA, 27 nt, Human
gggccuuuuguauugcacucuugauau

SEQ ID NO: 48529 - RNA, 27 nt, Human
cuugcagcuguaaacauauuggaaugu

SEQ ID NO: 48530 - RNA, 29 nt, Human
cucucuguucugcugacaggcagagaguc

SEQ ID NO: 48531 - RNA, 27 nt, Human
gcacaauguucacagacaucuguugcu

SEQ ID NO: 48532 - RNA, 31 nt, Human
uugacugaugccagcucugugccagacacau

SEQ ID NO: 48533 - RNA, 26 nt, Human
aaaugcauccauuccucagggacaga

SEQ ID NO: 48534 - RNA, 22 nt, Human
cugggcuucacggcugccagga

SEQ ID NO: 48535 - RNA, 20 nt, Human
caguauaguggaaagacuga

SEQ ID NO: 48536 - RNA, 27 nt, Human
ucacugcacuccagcuugggcaacaga

SEQ ID NO: 48537 - RNA, 23 nt, Human
uuugauggggucuucauugucca

SEQ ID NO: 48538 - RNA, 19 nt, Human
gccccuccuucuccccucc

SEQ ID NO: 48539 - RNA, 27 nt, Human
uguaacugcaggauggggaagcagaau

SEQ ID NO: 48540 - RNA, 24 nt, Human
ucugcugacacuccugccugcugu

SEQ ID NO: 48541 - RNA, 19 nt, Human
gcucugagaaacucagcag

SEQ ID NO: 48542 - RNA, 27 nt, Human
aaacucauuuuuguuuucauuaucuca

SEQ ID NO: 48543 - RNA, 19 nt, Human
ggaggcugagauaggauca

SEQ ID NO: 48544 - RNA, 29 nt, Human
cacuuuccauggguucaguuaucugcggu

SEQ ID NO: 48545 - RNA, 26 nt, Human
ucagccgccguccacacucgcugcag

SEQ ID NO: 48546 - RNA, 22 nt, Human
uuagcacggucuccagacucag

SEQ ID NO: 48547 - RNA, 22 nt, Human
aggauuaucacacccuccaucu

SEQ ID NO: 48548 - RNA, 22 nt, Human
ccaguauggugaaacccugucu

SEQ ID NO: 48549 - RNA, 23 nt, Human
gggaggaagaggaggaagguugg

SEQ ID NO: 48550 - RNA, 26 nt, Human
agagugaggcaggaaggaacucaagg

SEQ ID NO: 48551 - RNA, 24 nt, Human
caugccugucuucaagaucccagu

SEQ ID NO: 48552 - RNA, 20 nt, Human
ccaacccaaaccaugagaau

SEQ ID NO: 48553 - RNA, 24 nt, Human
gacgaccuguuagggucucaguau

SEQ ID NO: 48554 - RNA, 21 nt, Human
uaccagcuuguaugcaaugga

SEQ ID NO: 48555 - RNA, 20 nt, Human
aguccaaggcauuaaccuca

SEQ ID NO: 48556 - RNA, 22 nt, Human
gcugucugccccuugucaggcu

SEQ ID NO: 48557 - RNA, 21 nt, Human
gugcagggggagaugggugau

SEQ ID NO: 48558 - RNA, 22 nt, Human
ccucccuggcugcuggcugagc

SEQ ID NO: 48559 - RNA, 22 nt, Human
accaucucaguucacugcaacu

SEQ ID NO: 48560 - RNA, 22 nt, Human
cucacuguccaccucccaacgg

SEQ ID NO: 48561 - RNA, 25 nt, Human
agucugucuggcuuuucuccuaucu

SEQ ID NO: 48562 - RNA, 27 nt, Human
cgucacccaaggcugguggucagugug

SEQ ID NO: 48563 - RNA, 24 nt, Human
ucacccugguaaguacaguauuuc

SEQ ID NO: 48564 - RNA, 27 nt, Human
gcagcaaaaaccaauacaacaaaacga

SEQ ID NO: 48565 - RNA, 25 nt, Human
cugguccccccaccugacgucuugc

SEQ ID NO: 48566 - RNA, 23 nt, Human
uaggaugaagucaaucuucuugc

SEQ ID NO: 48567 - RNA, 25 nt, Human
agggcaguaucuggguuacagccac

SEQ ID NO: 48568 - RNA, 24 nt, Human
ucucugccucuuaacuccuucacg

SEQ ID NO: 48569 - RNA, 23 nt, Human
cucugugagggaccggggggcca

SEQ ID NO: 48570 - RNA, 21 nt, Human
ucuguaaccccagcacuuugg

SEQ ID NO: 48571 - RNA, 21 nt, Human
agcugccuccugaggugacac

SEQ ID NO: 48572 - RNA, 22 nt, Human
agagaacaaccagauugaaaca

SEQ ID NO: 48573 - RNA, 21 nt, Human
aucucccugcaaccuccgccu

SEQ ID NO: 48574 - RNA, 19 nt, Human
ggggaggcagggguuggug

SEQ ID NO: 48575 - RNA, 21 nt, Human
gcaacuuguaaaugugguaaa

SEQ ID NO: 48576 - RNA, 25 nt, Human
uucucagagauuaaaaaagguaguu

SEQ ID NO: 48577 - RNA, 22 nt, Human
uucacaguuuucaguuuuuaau

SEQ ID NO: 48578 - RNA, 24 nt, Human
ggcuggggcuggagaaugagagac

SEQ ID NO: 48579 - RNA, 24 nt, Human
aaaucugcccagagccuacccuca

SEQ ID NO: 48580 - RNA, 26 nt, Human
ggcuguagauguuggaggcuagggag

SEQ ID NO: 48581 - RNA, 27 nt, Human
ccaucauuccugccugggaauccugga

SEQ ID NO: 48582 - RNA, 25 nt, Human
uccacaaaaacauuuaauuuaugga

SEQ ID NO: 48583 - RNA, 27 nt, Human
gccuacagguuggaccgggaggcagug

SEQ ID NO: 48584 - RNA, 28 nt, Human
guccacugucaaguguuuuacuaucuca

SEQ ID NO: 48585 - RNA, 24 nt, Human
ggaaagguuuugucaucacacaac

SEQ ID NO: 48586 - RNA, 17 nt, Human
caaugcucuggggucuu

SEQ ID NO: 48587 - RNA, 24 nt, Human
caguucugggcugggauccuggcu

SEQ ID NO: 48588 - RNA, 32 nt, Human
ggcaagugguucuuuuucucugaauuacagga

SEQ ID NO: 48589 - RNA, 25 nt, Human
guccccaaggauggaaagggaaugu

SEQ ID NO: 48590 - RNA, 22 nt, Human
uuuaaggcaauauauaauugaa

SEQ ID NO: 48591 - RNA, 29 nt, Human
aucuuuauggaaucacuguggauacugac

SEQ ID NO: 48592 - RNA, 27 nt, Human
cucugguauugcucauaacuuaccaag

SEQ ID NO: 48593 - RNA, 22 nt, Human
uacugcagccugggcucccucu

SEQ ID NO: 48594 - RNA, 22 nt, Human
cgcgcugugccaccagcugggg

SEQ ID NO: 48595 - RNA, 22 nt, Human
cugcaaccuccaccucuuaugu

SEQ ID NO: 48596 - RNA, 21 nt, Human
uguaaaccccggagcgagguu

SEQ ID NO: 48597 - RNA, 25 nt, Human
cgggugggaggcggggaggagcagc

SEQ ID NO: 48598 - RNA, 20 nt, Human
cugugggggcggcugugggg

SEQ ID NO: 48599 - RNA, 31 nt, Human
agagggugaguccuccagaacucuuccucca

SEQ ID NO: 48600 - RNA, 22 nt, Human
cucaaccucugccucuuggguu

SEQ ID NO: 48601 - RNA, 23 nt, Human
uggggcaaugguagagugagagg

SEQ ID NO: 48602 - RNA, 27 nt, Human
auugcugcuggggcuccccauuugcuu

SEQ ID NO: 48603 - RNA, 20 nt, Human
uguuuaugcaagagcugguu

SEQ ID NO: 48604 - RNA, 21 nt, Human
cccacagugcugggauuaccg

SEQ ID NO: 48605 - RNA, 23 nt, Human
ucucuguccuuuccuccuggaca

SEQ ID NO: 48606 - RNA, 25 nt, Human
aaagagccccacccacaggauuccu

SEQ ID NO: 48607 - RNA, 22 nt, Human
ggaaaaugagauccguguuaga

SEQ ID NO: 48608 - RNA, 20 nt, Human
cugggcugugaacagcacug

SEQ ID NO: 48609 - RNA, 22 nt, Human
ucugaguagcugggacuacagg

SEQ ID NO: 48610 - RNA, 20 nt, Human
cgaaucagcuauuuacugcc

SEQ ID NO: 48611 - RNA, 24 nt, Human
cccagacccugcuuuauaccauuc

SEQ ID NO: 48612 - RNA, 18 nt, Human
gggauaggggcagaggag

SEQ ID NO: 48613 - RNA, 18 nt, Human
ggugacagugucucucca

SEQ ID NO: 48614 - RNA, 19 nt, Human
cugccuggauggccgcugu

SEQ ID NO: 48615 - RNA, 22 nt, Human
gccuuacaauucacucauucca

SEQ ID NO: 48616 - RNA, 23 nt, Human
cuguaagcaucugacucaucuca

SEQ ID NO: 48617 - RNA, 21 nt, Human
gagcagaacagggaggcuaga

SEQ ID NO: 48618 - RNA, 22 nt, Human
uuggugguuuuguuuugcuuug

SEQ ID NO: 48619 - RNA, 20 nt, Human
acgucaauagcagcccaggg

SEQ ID NO: 48620 - RNA, 20 nt, Human
gccagccagcacucugccuu

SEQ ID NO: 48621 - RNA, 20 nt, Human
gcuccacccuccagcauguu

SEQ ID NO: 48622 - RNA, 21 nt, Human
ccugcuugcccugccgcaggc

SEQ ID NO: 48623 - RNA, 21 nt, Human
ggauuuuauggagagcaugcu

SEQ ID NO: 48624 - RNA, 21 nt, Human
agagguugaggcugcagugag

SEQ ID NO: 48625 - RNA, 22 nt, Human
cccuuccugcaguauucauaca

SEQ ID NO: 48626 - RNA, 23 nt, Human
ccucccucugguccacugccuuu

SEQ ID NO: 48627 - RNA, 23 nt, Human
gacaguuuucaccaucucuugua

SEQ ID NO: 48628 - RNA, 26 nt, Human
uuacaccucccagugcccuucugaaa

SEQ ID NO: 48629 - RNA, 22 nt, Human
uuuggaauuugccuucuugaac

SEQ ID NO: 48630 - RNA, 26 nt, Human
agaacuccacuguggggaugaagcgc

SEQ ID NO: 48631 - RNA, 25 nt, Human
gcacccuuccgagggccauaggcga

SEQ ID NO: 48632 - RNA, 23 nt, Human
ccauuuuaaagaagaaguggauc

SEQ ID NO: 48633 - RNA, 21 nt, Human
caccugugaucccagcacuuu

SEQ ID NO: 48634 - RNA, 25 nt, Human
cucuguucccgggucccucaggcgg

SEQ ID NO: 48635 - RNA, 19 nt, Human
uggaggcagagggcaaggg

SEQ ID NO: 48636 - RNA, 22 nt, Human
aacuaaugacucugcugccuuc

SEQ ID NO: 48637 - RNA, 23 nt, Human
cucacccccucacacaggcccag

SEQ ID NO: 48638 - RNA, 27 nt, Human
cucauuuccaggcgcccuucccucuuc

SEQ ID NO: 48639 - RNA, 20 nt, Human
uuuuuaaaaucauguauuua

SEQ ID NO: 48640 - RNA, 25 nt, Human
gcccggaguccccguucacacugag

SEQ ID NO: 48641 - RNA, 19 nt, Human
aagaggcagaguucuguga

SEQ ID NO: 48642 - RNA, 23 nt, Human
gcugaaaacagcagcauuuucag

SEQ ID NO: 48643 - RNA, 26 nt, Human
gcaucuguccuugccuaggugauuuu

SEQ ID NO: 48644 - RNA, 28 nt, Human
gcacauuguaacagcacaguguuuuguu

SEQ ID NO: 48645 - RNA, 23 nt, Human
gaguguugagagucauuugaggu

SEQ ID NO: 48646 - RNA, 27 nt, Human
ucagcacuguggacaccucccugugaa

SEQ ID NO: 48647 - RNA, 18 nt, Human
auguuggccaggcugguc

SEQ ID NO: 48648 - RNA, 22 nt, Human
ccacugcaauccugucuuucug

SEQ ID NO: 48649 - RNA, 22 nt, Human
ugucuaaccccuucacugauuc

SEQ ID NO: 48650 - RNA, 21 nt, Human
gaagggagaagaauuagugua

SEQ ID NO: 48651 - RNA, 22 nt, Human
uuucccugcugaccuucuuccc

SEQ ID NO: 48652 - RNA, 26 nt, Human
ucaccaggcuguaagcaauaucuuga

SEQ ID NO: 48653 - RNA, 26 nt, Human
cagcagcccuggauugcuuucuccaa

SEQ ID NO: 48654 - RNA, 20 nt, Human
guauagcaguuucugcuuca

SEQ ID NO: 48655 - RNA, 21 nt, Human
ucauuuauucacuuccguagc

SEQ ID NO: 48656 - RNA, 31 nt, Human
cuuugguuaauaauaaaaugccuuuguauau

SEQ ID NO: 48657 - RNA, 22 nt, Human
uugcagggcggccagugcagug

SEQ ID NO: 48658 - RNA, 27 nt, Human
ggacuccugcuaguccccucuuggcau

SEQ ID NO: 48659 - RNA, 30 nt, Human
gagguuaaucuaggaaugacucguuuaagg

SEQ ID NO: 48660 - RNA, 22 nt, Human
ccugcccccugccccaccccug

SEQ ID NO: 48661 - RNA, 25 nt, Human
ucuccacugccacccuuucuacuca

SEQ ID NO: 48662 - RNA, 21 nt, Human
cugggccucagugucuugaug

SEQ ID NO: 48663 - RNA, 21 nt, Human
ccugccucaguggcucugggu

SEQ ID NO: 48664 - RNA, 30 nt, Human
cagcgcgcucagcccagccuaggaaagagg

SEQ ID NO: 48665 - RNA, 21 nt, Human
uccacaaccuuguucuaugga

SEQ ID NO: 48666 - RNA, 23 nt, Human
auuguccaggcuagagugcagug

SEQ ID NO: 48667 - RNA, 20 nt, Human
ggaggaucuuaaagagacca

SEQ ID NO: 48668 - RNA, 21 nt, Human
gcagugagccaugaucaugcc

SEQ ID NO: 48669 - RNA, 22 nt, Human
agcgccagaacccagauuuccu

SEQ ID NO: 48670 - RNA, 24 nt, Human
acuggcauuaaagagucauagaaa

SEQ ID NO: 48671 - RNA, 22 nt, Human
cagguggagcagugaccaggac

SEQ ID NO: 48672 - RNA, 20 nt, Human
gggcaugacauaagaugugu

SEQ ID NO: 48673 - RNA, 19 nt, Human
ucacaauagagcucaggga

SEQ ID NO: 48674 - RNA, 22 nt, Human
caugagcccacagacagagcug

SEQ ID NO: 48675 - RNA, 23 nt, Human
cuuuuuaaaaaauuguuugcuug

SEQ ID NO: 48676 - RNA, 27 nt, Human
gcccggcccacacccgacaccagcccu

SEQ ID NO: 48677 - RNA, 23 nt, Human
uccgcccaggcugcagugcagug

SEQ ID NO: 48678 - RNA, 20 nt, Human
aaaguuucagacuuaucuuu

SEQ ID NO: 48679 - RNA, 23 nt, Human
uggaacugagggagugagcuugg

SEQ ID NO: 48680 - RNA, 22 nt, Human
ggaggcugguccuauggccuca

SEQ ID NO: 48681 - RNA, 23 nt, Human
cuuugcagauacuucauuuucuu

SEQ ID NO: 48682 - RNA, 22 nt, Human
gagcauucuugguuuuccgaca

SEQ ID NO: 48683 - RNA, 23 nt, Human
ugccgucugggcuggagcgcagu

SEQ ID NO: 48684 - RNA, 22 nt, Human
caggcuggagugcaauggcacg

SEQ ID NO: 48685 - RNA, 26 nt, Human
acuugccuccggacugucuuccaaac

SEQ ID NO: 48686 - RNA, 24 nt, Human
acuucugcucagguuucccuggcu

SEQ ID NO: 48687 - RNA, 24 nt, Human
uucuucuggguucaaccacuuuag

SEQ ID NO: 48688 - RNA, 25 nt, Human
caugcccagcccugccuuggucccc

SEQ ID NO: 48689 - RNA, 18 nt, Human
accaugucauggagugua

SEQ ID NO: 48690 - RNA, 25 nt, Human
ccccgggggcaaccugucgagcugg

SEQ ID NO: 48691 - RNA, 30 nt, Human
cugauccugguuuccaccuccagcccuggg

SEQ ID NO: 48692 - RNA, 23 nt, Human
guggauggggaggaugguugcac

SEQ ID NO: 48693 - RNA, 20 nt, Human
uuccacccuucacaauagcu

SEQ ID NO: 48694 - RNA, 24 nt, Human
guugggacucuggagagcggagga

SEQ ID NO: 48695 - RNA, 23 nt, Human
uucaguugaaaagagguggauuc

SEQ ID NO: 48696 - RNA, 26 nt, Human
gagcaaagcccacugccaguaagaag

SEQ ID NO: 48697 - RNA, 20 nt, Human
uuguauaccccuccccugac

SEQ ID NO: 48698 - RNA, 22 nt, Human
ucuccagugguaucugccucca

SEQ ID NO: 48699 - RNA, 21 nt, Human
gaugaggcaaggcugccuuca

SEQ ID NO: 48700 - RNA, 27 nt, Human
cacccaggcuggaguacaauagcguga

SEQ ID NO: 48701 - RNA, 24 nt, Human
ggcugaggcaggugguucacugga

SEQ ID NO: 48702 - RNA, 26 nt, Human
acugccucucggcugugcuccgugga

SEQ ID NO: 48703 - RNA, 21 nt, Human
uuaucuuauuguaauagauga

SEQ ID NO: 48704 - RNA, 20 nt, Human
augcucaagaauguagucag

SEQ ID NO: 48705 - RNA, 21 nt, Human
cagcaagagaacagaaauacu

SEQ ID NO: 48706 - RNA, 20 nt, Human
uucauucucugugguaucca

SEQ ID NO: 48707 - RNA, 19 nt, Human
aauguuucauuugacgguc

SEQ ID NO: 48708 - RNA, 23 nt, Human
uuaaggggccgguucaagaagga

SEQ ID NO: 48709 - RNA, 26 nt, Human
gggaagaaaagagggagcagcuaggg

SEQ ID NO: 48710 - RNA, 23 nt, Human
gugacggcucacauuugccccag

SEQ ID NO: 48711 - RNA, 27 nt, Human
ugccuguaaucccagcacuuucaaagg

SEQ ID NO: 48712 - RNA, 18 nt, Human
acucuaaccucuccagcu

SEQ ID NO: 48713 - RNA, 20 nt, Human
uuuaugugcuguguuuuuua

SEQ ID NO: 48714 - RNA, 25 nt, Human
uugaguauuugaagugaauuugaaa

SEQ ID NO: 48715 - RNA, 21 nt, Human
ccugguggggacggggaggga

SEQ ID NO: 48716 - RNA, 25 nt, Human
aggagagcuguaaggccauucuuua

SEQ ID NO: 48717 - RNA, 21 nt, Human
uccagaacuuuuuaguauugu

SEQ ID NO: 48718 - RNA, 25 nt, Human
uggggugggcgacagacaggagggc

SEQ ID NO: 48719 - RNA, 20 nt, Human
agaugagcuuugucuaccuu

SEQ ID NO: 48720 - RNA, 21 nt, Human
uccugccuuugccuccagaag

SEQ ID NO: 48721 - RNA, 22 nt, Human
gguugcccuggcuggggcccgg

SEQ ID NO: 48722 - RNA, 21 nt, Human
ccaggagguugagaaugcagu

SEQ ID NO: 48723 - RNA, 22 nt, Human
ggaggaggagagucccuucucg

SEQ ID NO: 48724 - RNA, 21 nt, Human
caucucccucuccuugcuggc

SEQ ID NO: 48725 - RNA, 19 nt, Human
cacagcaaacacauucucc

SEQ ID NO: 48726 - RNA, 28 nt, Human
acuguguauuuuguacuuaucacuacac

SEQ ID NO: 48727 - RNA, 20 nt, Human
acagauggcaggaugggcac

SEQ ID NO: 48728 - RNA, 27 nt, Human
uugggcccugcauguagugugggaggc

SEQ ID NO: 48729 - RNA, 24 nt, Human
cccugcaccugcgacccucaggcu

SEQ ID NO: 48730 - RNA, 23 nt, Human
ugcccugcuauuuuuugcauuuu

SEQ ID NO: 48731 - RNA, 25 nt, Human
gacugagaauauaauacuguauuug

SEQ ID NO: 48732 - RNA, 26 nt, Human
cuguaucuaaaauaucaaagguucua

SEQ ID NO: 48733 - RNA, 25 nt, Human
acagaggccuccuguggccugccag

SEQ ID NO: 48734 - RNA, 22 nt, Human
acaaucugcuuuuuauuaguug

SEQ ID NO: 48735 - RNA, 22 nt, Human
gcccccacucuccuuucauguc

SEQ ID NO: 48736 - RNA, 24 nt, Human
gcccugugcccccuccucccugcc

SEQ ID NO: 48737 - RNA, 20 nt, Human
uacugggauuacaagcauaa

SEQ ID NO: 48738 - RNA, 25 nt, Human
ugguggcuggcgccuguaaucccag

SEQ ID NO: 48739 - RNA, 27 nt, Human
cagcucuucuccuggaaugacuggcuu

SEQ ID NO: 48740 - RNA, 23 nt, Human
aaauguccucauauuugaggacc

SEQ ID NO: 48741 - RNA, 25 nt, Human
uuauucucucacaguguacucuaua

SEQ ID NO: 48742 - RNA, 25 nt, Human
gcacacaagcccacagcacagcucc

SEQ ID NO: 48743 - RNA, 20 nt, Human
uccagccuggcgacagagug

SEQ ID NO: 48744 - RNA, 25 nt, Human
ccuuuucccaacuccucaugucuuc

SEQ ID NO: 48745 - RNA, 28 nt, Human
cuggcaggaccuguggagauagggaagg

SEQ ID NO: 48746 - RNA, 27 nt, Human
gcccuugacaccacgcccuuugcuuua

SEQ ID NO: 48747 - RNA, 22 nt, Human
ugccgcugcacuccagccuggg

SEQ ID NO: 48748 - RNA, 26 nt, Human
gguuuguuuauaauguuaucggcucu

SEQ ID NO: 48749 - RNA, 23 nt, Human
agauccaaaaccagaauaagcca

SEQ ID NO: 48750 - RNA, 22 nt, Human
cacuguacuccagcccggcacu

SEQ ID NO: 48751 - RNA, 23 nt, Human
ggcugagagaauuguaacauagc

SEQ ID NO: 48752 - RNA, 22 nt, Human
gccguggggagugggggccagu

SEQ ID NO: 48753 - RNA, 22 nt, Human
uucacccuuaacccaagggagc

SEQ ID NO: 48754 - RNA, 23 nt, Human
guguacugugugguaacuguggu

SEQ ID NO: 48755 - RNA, 19 nt, Human
gagcuaaagcaggucucca

SEQ ID NO: 48756 - RNA, 20 nt, Human
ugagaaagagaaugagaaga

SEQ ID NO: 48757 - RNA, 22 nt, Human
guggcccuuaugacugccaaga

SEQ ID NO: 48758 - RNA, 23 nt, Human
gacagcuccgucauggcacuuuu

SEQ ID NO: 48759 - RNA, 27 nt, Human
uuaucuuucuguccuuuuaaguguacc

SEQ ID NO: 48760 - RNA, 26 nt, Human
cugaggcaggagugucaccugcggga

SEQ ID NO: 48761 - RNA, 22 nt, Human
aucgcuuuucucagacucacca

SEQ ID NO: 48762 - RNA, 25 nt, Human
cggacagagugcacaaucggaggga

SEQ ID NO: 48763 - RNA, 24 nt, Human
ccgacccagcccugccuccucagc

SEQ ID NO: 48764 - RNA, 22 nt, Human
uacuauacaacaauguucuuuu

SEQ ID NO: 48765 - RNA, 26 nt, Human
uaaucagucuuaagaaaauguugaca

SEQ ID NO: 48766 - RNA, 18 nt, Human
cggaauuggccgcggaaa

SEQ ID NO: 48767 - RNA, 19 nt, Human
ggucaacuccugucuucag

SEQ ID NO: 48768 - RNA, 13 nt, Human
accaaaugccuuu

SEQ ID NO: 48769 - RNA, 23 nt, Human
auauuugugcuccuucacgggag

SEQ ID NO: 48770 - RNA, 27 nt, Human
ggcauccauguuuugugccugcccucc

SEQ ID NO: 48771 - RNA, 24 nt, Human
ccugcaaacgcugccugcccacac

SEQ ID NO: 48772 - RNA, 20 nt, Human
uaacacuuuuaaccacugag

SEQ ID NO: 48773 - RNA, 20 nt, Human
gagggcaggagcaagggagg

SEQ ID NO: 48774 - RNA, 22 nt, Human
gucucaguuuucacugucgaca

SEQ ID NO: 48775 - RNA, 19 nt, Human
ucuccugaccucuugaucu

SEQ ID NO: 48776 - RNA, 22 nt, Human
cccguuccuucauccauccugc

SEQ ID NO: 48777 - RNA, 22 nt, Human
cauuggcuuuuuaaauuuucca

SEQ ID NO: 48778 - RNA, 21 nt, Human
cugcaggucucuguuuugaaa

SEQ ID NO: 48779 - RNA, 25 nt, Human
uuccuaauuccacagcugcucaaua

SEQ ID NO: 48780 - RNA, 22 nt, Human
ucgcugccgcucugcucucuca

SEQ ID NO: 48781 - RNA, 22 nt, Human
uucucuucuccccuagaaggcu

SEQ ID NO: 48782 - RNA, 26 nt, Human
agcagccugccagcaguuacugugaa

SEQ ID NO: 48783 - RNA, 24 nt, Human
uagcacaggcuucacagugauuuu

SEQ ID NO: 48784 - RNA, 20 nt, Human
gcucugaaaggcagugcugu

SEQ ID NO: 48785 - RNA, 25 nt, Human
ugaggaagaagacugcguggauuca

SEQ ID NO: 48786 - RNA, 21 nt, Human
aacuuucuuccucucucucca

SEQ ID NO: 48787 - RNA, 23 nt, Human
ugccugggggcuuuugccacucc

SEQ ID NO: 48788 - RNA, 26 nt, Human
ccaucccugccuggucacaggcaugc

SEQ ID NO: 48789 - RNA, 24 nt, Human
ccgagggcaccugugaccugcacu

SEQ ID NO: 48790 - RNA, 27 nt, Human
cccugcaguaagaagcgugucuggguc

SEQ ID NO: 48791 - RNA, 21 nt, Human
auguggagaaaaugaugagaa

SEQ ID NO: 48792 - RNA, 22 nt, Human
gacugggugugaccagaggaaa

SEQ ID NO: 48793 - RNA, 20 nt, Human
ggauacugccuucucuuucg

SEQ ID NO: 48794 - RNA, 22 nt, Human
cuguguguguucuucaagccag

SEQ ID NO: 48795 - RNA, 22 nt, Human
cguacuugcuguggcuacuucu

SEQ ID NO: 48796 - RNA, 29 nt, Human
cccaaugcuccaucccaaccaggcaccuc

SEQ ID NO: 48797 - RNA, 22 nt, Human
ugcuuagcugucaacaaaaaga

SEQ ID NO: 48798 - RNA, 23 nt, Human
ggaagaaguaguccucucuuccu

SEQ ID NO: 48799 - RNA, 22 nt, Human
cugguuccccucaccacccaac

SEQ ID NO: 48800 - RNA, 21 nt, Human
gaggaagggggguugcagugg

SEQ ID NO: 48801 - RNA, 21 nt, Human
guggugagaggaugaggggga

SEQ ID NO: 48802 - RNA, 21 nt, Human
gcggggcugccagagaacccc

SEQ ID NO: 48803 - RNA, 20 nt, Human
ugggugcgaccccaucugcc

SEQ ID NO: 48804 - RNA, 25 nt, Human
gcccagccucugucccucuuugccu

SEQ ID NO: 48805 - RNA, 23 nt, Human
guuccugcaaagcugcuggagcu

SEQ ID NO: 48806 - RNA, 22 nt, Human
agacccugucugaaagaaagag

SEQ ID NO: 48807 - RNA, 22 nt, Human
cuguacuuuuuguauuuuuugu

SEQ ID NO: 48808 - RNA, 21 nt, Human
ccagaguucagacccaggaag

SEQ ID NO: 48809 - RNA, 24 nt, Human
ccugcagcugcugcuguggcugcc

SEQ ID NO: 48810 - RNA, 18 nt, Human
auugccuucucaccagcu

SEQ ID NO: 48811 - RNA, 17 nt, Human
ccuugauaaaugccuca

SEQ ID NO: 48812 - RNA, 22 nt, Human
uggcccaugccugggaucuucu

SEQ ID NO: 48813 - RNA, 19 nt, Human
cagaugaguuuucugcuug

SEQ ID NO: 48814 - RNA, 27 nt, Human
caggaaggaaugaaagagaguucuuuc

SEQ ID NO: 48815 - RNA, 23 nt, Human
cuccagacuggcaguuucaagga

SEQ ID NO: 48816 - RNA, 32 nt, Human
ccuucucggugcagaucccuaugggggagcug

SEQ ID NO: 48817 - RNA, 22 nt, Human
guagaggccgagcccagcaaag

SEQ ID NO: 48818 - RNA, 21 nt, Human
gcuggcccugauggggugggg

SEQ ID NO: 48819 - RNA, 23 nt, Human
agcuaggacugcaggcaccaugu

SEQ ID NO: 48820 - RNA, 28 nt, Human
cauggcacugacaaugggcacacaggga

SEQ ID NO: 48821 - RNA, 24 nt, Human
gugggcaaaagagaaaaagaagga

SEQ ID NO: 48822 - RNA, 26 nt, Human
aggcaggagcaggcagcucagcuuga

SEQ ID NO: 48823 - RNA, 23 nt, Human
aucugucacuacaccugcagcac

SEQ ID NO: 48824 - RNA, 20 nt, Human
gccgacuggaguuuggggga

SEQ ID NO: 48825 - RNA, 23 nt, Human
uggcagcagaagugggugcagga

SEQ ID NO: 48826 - RNA, 28 nt, Human
gugugccugaaccagugccaaccugccc

SEQ ID NO: 48827 - RNA, 27 nt, Human
gauggcugauucugggugguccuggac

SEQ ID NO: 48828 - RNA, 21 nt, Human
gcuggcagaggugaugagcgg

SEQ ID NO: 48829 - RNA, 20 nt, Human
cucaaauugugcaaccauga

SEQ ID NO: 48830 - RNA, 27 nt, Human
caacuggacauugucugcgugguuccu

SEQ ID NO: 48831 - RNA, 22 nt, Human
accaugcccggcuaauuuuugu

SEQ ID NO: 48832 - RNA, 26 nt, Human
ccuccaggagcccagcuaugaacucc

SEQ ID NO: 48833 - RNA, 18 nt, Human
gcugcugcuggucugacu

SEQ ID NO: 48834 - RNA, 22 nt, Human
cugaggcaggagaauggcauga

SEQ ID NO: 48835 - RNA, 22 nt, Human
cuaaggcaggagaauggcguga

SEQ ID NO: 48836 - RNA, 21 nt, Human
gcuggagagauguauguaaua

SEQ ID NO: 48837 - RNA, 23 nt, Human
gggaacuuggagaggugugccua

SEQ ID NO: 48838 - RNA, 16 nt, Human
ucuccugaaucaggcu

SEQ ID NO: 48839 - RNA, 22 nt, Human
gaaguaauucaagaaagaaaua

SEQ ID NO: 48840 - RNA, 23 nt, Human
cuuaaaauguacaguguauuuua

SEQ ID NO: 48841 - RNA, 19 nt, Human
auaauuacugguuuuguaa

SEQ ID NO: 48842 - RNA, 21 nt, Human
cugcaucugucacagcagaac

SEQ ID NO: 48843 - RNA, 22 nt, Human
aaaacaaaaggugauucuauuc

SEQ ID NO: 48844 - RNA, 26 nt, Human
uuauauggugguagggagcuuauagc

SEQ ID NO: 48845 - RNA, 22 nt, Human
aauguacuaauauuucugucaa

SEQ ID NO: 48846 - RNA, 27 nt, Human
uccuccagggccacgugccaggcccgg

SEQ ID NO: 48847 - RNA, 20 nt, Human
ucagaucaccugaauuugug

SEQ ID NO: 48848 - RNA, 26 nt, Human
ccaggaucucuuuccccaaggaccca

SEQ ID NO: 48849 - RNA, 23 nt, Human
gaggaugugugggaaagcuggaa

SEQ ID NO: 48850 - RNA, 26 nt, Human
gggaggcaacuacacaccaaccugcu

SEQ ID NO: 48851 - RNA, 19 nt, Human
acugcccucgagaacuggc

SEQ ID NO: 48852 - RNA, 20 nt, Human
auauguaaacuuuaacuucc

SEQ ID NO: 48853 - RNA, 20 nt, Human
gaaaacaggcucaggguuuc

SEQ ID NO: 48854 - RNA, 27 nt, Human
aaauguuccuuuaaaugcagcacacug

SEQ ID NO: 48855 - RNA, 22 nt, Human
cugauaaggugucaacagggua

SEQ ID NO: 48856 - RNA, 21 nt, Human
ggaggcggagcuggcagugag

SEQ ID NO: 48857 - RNA, 21 nt, Human
gagagaaacuccuacucuucu

SEQ ID NO: 48858 - RNA, 21 nt, Human
cacugcagucuccagccugag

SEQ ID NO: 48859 - RNA, 18 nt, Human
gaacaccugacaacuucu

SEQ ID NO: 48860 - RNA, 21 nt, Human
gggacuguggagggagcacag

SEQ ID NO: 48861 - RNA, 22 nt, Human
uuguugcccaggcugggagggc

SEQ ID NO: 48862 - RNA, 21 nt, Human
cucugcuucauuacugcuucc

SEQ ID NO: 48863 - RNA, 26 nt, Human
gaggggaaucggggacuucaugcgaa

SEQ ID NO: 48864 - RNA, 28 nt, Human
uuugucauauccccucuccuuauuuuuc

SEQ ID NO: 48865 - RNA, 20 nt, Human
gggaggcaagcucagcaaga

SEQ ID NO: 48866 - RNA, 22 nt, Human
ucuggcugcugccccgucuccc

SEQ ID NO: 48867 - RNA, 24 nt, Human
gccucuaauuuauauugcuuugca

SEQ ID NO: 48868 - RNA, 26 nt, Human
cuugcccagccgugguggcccccagg

SEQ ID NO: 48869 - RNA, 18 nt, Human
cuuccuucucagcacuuu

SEQ ID NO: 48870 - RNA, 26 nt, Human
guagugcuuacaauuuuguguaccaa

SEQ ID NO: 48871 - RNA, 27 nt, Human
cacugcacuccagccugggcuacagag

SEQ ID NO: 48872 - RNA, 22 nt, Human
cuccucccucagacccaggggu

SEQ ID NO: 48873 - RNA, 23 nt, Human
uggacuuuguuguuuuucuuuuu

SEQ ID NO: 48874 - RNA, 22 nt, Human
aucuuuguuuaaacuagcuuua

SEQ ID NO: 48875 - RNA, 22 nt, Human
ccagggcggcggcgggagaagc

SEQ ID NO: 48876 - RNA, 22 nt, Human
cuguuuuucuaaucauaugugg

SEQ ID NO: 48877 - RNA, 21 nt, Human
gacaggcugcacaucucagua

SEQ ID NO: 48878 - RNA, 25 nt, Human
cccaggggcuucagaaaaggagugg

SEQ ID NO: 48879 - RNA, 21 nt, Human
cagccuuggugaggacagugu

SEQ ID NO: 48880 - RNA, 26 nt, Human
ugagccaagauggcgccauugcacuc

SEQ ID NO: 48881 - RNA, 25 nt, Human
gcccaggcuggagugcaguagugca

SEQ ID NO: 48882 - RNA, 27 nt, Human
ggcugagaacccugcgugaggacaggg

SEQ ID NO: 48883 - RNA, 24 nt, Human
ccgaagggagcggagcgcagccug

SEQ ID NO: 48884 - RNA, 26 nt, Human
gaacaccgcugccacuguggcuccag

SEQ ID NO: 48885 - RNA, 22 nt, Human
ggcagccccuggcugggcgagg

SEQ ID NO: 48886 - RNA, 20 nt, Human
ccucagccccaagacccagc

SEQ ID NO: 48887 - RNA, 21 nt, Human
ggcuuaccugaccucuugcug

SEQ ID NO: 48888 - RNA, 27 nt, Human
aggugucccuaauuugagaaguaaccu

SEQ ID NO: 48889 - RNA, 18 nt, Human
aaaugaacccuacuugcu

SEQ ID NO: 48890 - RNA, 28 nt, Human
uguggggugagaggaugggugauggggu

SEQ ID NO: 48891 - RNA, 25 nt, Human
gaagaagacaaagagagauugaaau

SEQ ID NO: 48892 - RNA, 29 nt, Human
cuguuccaccuccccucagacuaucuuuc

SEQ ID NO: 48893 - RNA, 23 nt, Human
gugcuacaaacuucucugucuca

SEQ ID NO: 48894 - RNA, 21 nt, Human
aguugguuuuucauuuuuugu

SEQ ID NO: 48895 - RNA, 22 nt, Human
caccgagugucugcagcugggg

SEQ ID NO: 48896 - RNA, 20 nt, Human
aaaugaccaccaaguacuac

SEQ ID NO: 48897 - RNA, 28 nt, Human
ggcuggguaacagaaugagaccuuaucu

SEQ ID NO: 48898 - RNA, 27 nt, Human
cuggcagcaggggcugcuccacgagug

SEQ ID NO: 48899 - RNA, 21 nt, Human
ccaagugccucuggaagccuc

SEQ ID NO: 48900 - RNA, 25 nt, Human
uugucuuaguuaauuuugugcugcu

SEQ ID NO: 48901 - RNA, 27 nt, Human
ggcugauuucaaaugcaguccagugag

SEQ ID NO: 48902 - RNA, 26 nt, Human
uugggagcugcugggcuagguccaga

SEQ ID NO: 48903 - RNA, 26 nt, Human
ggucaaauuaggcgaagaaaagaugg

SEQ ID NO: 48904 - RNA, 21 nt, Human
agagcugcuggugaacuccau

SEQ ID NO: 48905 - RNA, 20 nt, Human
acuaaaauuacauauuuuau

SEQ ID NO: 48906 - RNA, 21 nt, Human
uuguauuguuaaugcaucauc

SEQ ID NO: 48907 - RNA, 22 nt, Human
uauugagugcccacuacgugcc

SEQ ID NO: 48908 - RNA, 21 nt, Human
caaucaaacaccaaaccgggg

SEQ ID NO: 48909 - RNA, 24 nt, Human
gggaggcaggcauuccugaaggga

SEQ ID NO: 48910 - RNA, 26 nt, Human
gcaagucccugagcugugcuuccagc

SEQ ID NO: 48911 - RNA, 23 nt, Human
gugcggcuccacagcauggaauc

SEQ ID NO: 48912 - RNA, 21 nt, Human
cuccuugcaaagaugauauga

SEQ ID NO: 48913 - RNA, 23 nt, Human
acugccaaacugccuguccuggg

SEQ ID NO: 48914 - RNA, 24 nt, Human
aggacagugugugccaugucuccc

SEQ ID NO: 48915 - RNA, 22 nt, Human
ggggugggaggggaaugccaca

SEQ ID NO: 48916 - RNA, 26 nt, Human
aguuggcaucccuguagggaucccag

SEQ ID NO: 48917 - RNA, 22 nt, Human
cacaugcucuaacugcucaaca

SEQ ID NO: 48918 - RNA, 22 nt, Human
cugcuccccucccuccucuguc

SEQ ID NO: 48919 - RNA, 21 nt, Human
cgcuaagcuccagucggcgcc

SEQ ID NO: 48920 - RNA, 24 nt, Human
aaacucauaauguugauauaauca

SEQ ID NO: 48921 - RNA, 26 nt, Human
cugaggaaccaacaguccaccucagc

SEQ ID NO: 48922 - RNA, 27 nt, Human
ucaagccccauuggucccagaguagcu

SEQ ID NO: 48923 - RNA, 27 nt, Human
ucugggaguucacgggagccggagcug

SEQ ID NO: 48924 - RNA, 26 nt, Human
agaacaauuaaauucauuuuaguuau

SEQ ID NO: 48925 - RNA, 23 nt, Human
auuuuucugauuguuaagacuuu

SEQ ID NO: 48926 - RNA, 20 nt, Human
ccuccccagcucaacccauu

SEQ ID NO: 48927 - RNA, 22 nt, Human
uuggggucgggagugcaggagg

SEQ ID NO: 48928 - RNA, 20 nt, Human
gagggaggccgguguggaaa

SEQ ID NO: 48929 - RNA, 17 nt, Human
gggccccccaugcauac

SEQ ID NO: 48930 - RNA, 22 nt, Human
aaggaugaggcagaccauguac

SEQ ID NO: 48931 - RNA, 26 nt, Human
cagugacgccuuuccccaaaacucuc

SEQ ID NO: 48932 - RNA, 22 nt, Human
ucuuauauugccauuucuucca

SEQ ID NO: 48933 - RNA, 27 nt, Human
gccuacaucuucuuauucuauuuagga

SEQ ID NO: 48934 - RNA, 21 nt, Human
gccugucucccccaccgggcu

SEQ ID NO: 48935 - RNA, 20 nt, Human
cucuuccucucuuuuuuggg

SEQ ID NO: 48936 - RNA, 27 nt, Human
guuggccaggcuggucuccaacuccug

SEQ ID NO: 48937 - RNA, 19 nt, Human
gcucugucauucaggcugg

SEQ ID NO: 48938 - RNA, 19 nt, Human
guucugucacucaggcugg

SEQ ID NO: 48939 - RNA, 21 nt, Human
uagggcuggaggauggcauuu

SEQ ID NO: 48940 - RNA, 22 nt, Human
augagcuauugagagcugcagu

SEQ ID NO: 48941 - RNA, 29 nt, Human
aaguugucacuaauuugcacauuuucugu

SEQ ID NO: 48942 - RNA, 23 nt, Human
aacaaagcuugcaaaauauuuua

SEQ ID NO: 48943 - RNA, 23 nt, Human
cuguccuuuuaauguaagucacu

SEQ ID NO: 48944 - RNA, 21 nt, Human
aucagcggcagaucucuccag

SEQ ID NO: 48945 - RNA, 26 nt, Human
aguaaauauuccauucugauuucaua

SEQ ID NO: 48946 - RNA, 25 nt, Human
agcuuaaacugaauuuguauuucau

SEQ ID NO: 48947 - RNA, 22 nt, Human
agucauggacacagggcacugc

SEQ ID NO: 48948 - RNA, 23 nt, Human
ugaggugagagugaagagacuag

SEQ ID NO: 48949 - RNA, 20 nt, Human
uauguauguaugugcauaca

SEQ ID NO: 48950 - RNA, 22 nt, Human
cacuccacuccagucugggcga

SEQ ID NO: 48951 - RNA, 22 nt, Human
gagugaaauuccaucucaaaac

SEQ ID NO: 48952 - RNA, 27 nt, Human
ccugccugcaccuccgcgggcugacug

SEQ ID NO: 48953 - RNA, 19 nt, Human
ccuccagggcccagguucg

SEQ ID NO: 48954 - RNA, 21 nt, Human
cccauggucgggacagugccc

SEQ ID NO: 48955 - RNA, 27 nt, Human
uccuccaggcucugccuggccugaccc

SEQ ID NO: 48956 - RNA, 20 nt, Human
aacagggacagaagacucac

SEQ ID NO: 48957 - RNA, 27 nt, Human
ugucucugccaaucugcugggcugguc

SEQ ID NO: 48958 - RNA, 24 nt, Human
agucaggagaaucgcuugaaccug

SEQ ID NO: 48959 - RNA, 20 nt, Human
caaccauggaccuguugcua

SEQ ID NO: 48960 - RNA, 22 nt, Human
ccuagcacuucaccaccuccuu

SEQ ID NO: 48961 - RNA, 26 nt, Human
cauguuccucuccauccuaguggcgc

SEQ ID NO: 48962 - RNA, 30 nt, Human
auucuuagccuguggcaguaaagagaaacu

SEQ ID NO: 48963 - RNA, 27 nt, Human
gaaagagaacuuccuucuguacuguua

SEQ ID NO: 48964 - RNA, 23 nt, Human
uauguguguccucucuuccacac

SEQ ID NO: 48965 - RNA, 27 nt, Human
cuuaccucuuuaggucacugaugguca

SEQ ID NO: 48966 - RNA, 26 nt, Human
ggcgccuguaaucccagcuacucagg

SEQ ID NO: 48967 - RNA, 21 nt, Human
guuugaagaaaaagguacaaa

SEQ ID NO: 48968 - RNA, 24 nt, Human
aaacauucacaccucugucccuca

SEQ ID NO: 48969 - RNA, 22 nt, Human
gaacuccugggcucaaacaguc

SEQ ID NO: 48970 - RNA, 22 nt, Human
agccuucaauguaccugugugu

SEQ ID NO: 48971 - RNA, 24 nt, Human
gccguccuuggagauaauuggguu

SEQ ID NO: 48972 - RNA, 25 nt, Human
accaugccauccaggcugguuucga

SEQ ID NO: 48973 - RNA, 27 nt, Human
gggucacagugauagggccacccugga

SEQ ID NO: 48974 - RNA, 23 nt, Human
uguagcccagucuggagugcagu

SEQ ID NO: 48975 - RNA, 26 nt, Human
uccacacacuuauugccauccucucc

SEQ ID NO: 48976 - RNA, 26 nt, Human
guccaacccagcuucuuggcaugagg

SEQ ID NO: 48977 - RNA, 18 nt, Human
gaucaaucuugaaauacu

SEQ ID NO: 48978 - RNA, 25 nt, Human
caggccggggaaggagcccucccuc

SEQ ID NO: 48979 - RNA, 25 nt, Human
uccaggucuugacucauggcagcug

SEQ ID NO: 48980 - RNA, 22 nt, Human
ugagguuggcucuaacaucucu

SEQ ID NO: 48981 - RNA, 18 nt, Human
ggcagcucugucuuugga

SEQ ID NO: 48982 - RNA, 23 nt, Human
aguuuacagcgucucugcccccu

SEQ ID NO: 48983 - RNA, 21 nt, Human
uucaaucuaagcaucuuguca

SEQ ID NO: 48984 - RNA, 22 nt, Human
gggcucccggagagggagucag

SEQ ID NO: 48985 - RNA, 22 nt, Human
acaaaccuuuugguaaugugca

SEQ ID NO: 48986 - RNA, 20 nt, Human
guccucuguccuuggaccag

SEQ ID NO: 48987 - RNA, 17 nt, Human
ggccucggccggccgca

SEQ ID NO: 48988 - RNA, 21 nt, Human
gcgggaggauguucugggaca

SEQ ID NO: 48989 - RNA, 22 nt, Human
aggagucaggagccacugugag

SEQ ID NO: 48990 - RNA, 22 nt, Human
ucacguccuuaacugugcucuc

SEQ ID NO: 48991 - RNA, 25 nt, Human
aacagcccauggagggagguauuau

SEQ ID NO: 48992 - RNA, 21 nt, Human
ucacugcagccucugccaccc

SEQ ID NO: 48993 - RNA, 23 nt, Human
agagccacacggucaaguugcac

SEQ ID NO: 48994 - RNA, 27 nt, Human
aaccacaccuucucuuucuuaugucuu

SEQ ID NO: 48995 - RNA, 28 nt, Human
ccucaugccaccacauucgccagaaaug

SEQ ID NO: 48996 - RNA, 26 nt, Human
cauggugucucacacguuuaauccca

SEQ ID NO: 48997 - RNA, 25 nt, Human
accagcuggucccagauucgcugcu

SEQ ID NO: 48998 - RNA, 22 nt, Human
ugcaacuucugccucccgaguu

SEQ ID NO: 48999 - RNA, 22 nt, Human
gcuuguggcaggagauggcuua

SEQ ID NO: 49000 - RNA, 27 nt, Human
ccaggggaacacaaagcaggagacagc

SEQ ID NO: 49001 - RNA, 21 nt, Human
cuccucugcugcagcuacuga

SEQ ID NO: 49002 - RNA, 26 nt, Human
gcuagcaaccaugugccucccauccu

SEQ ID NO: 49003 - RNA, 27 nt, Human
cauggcaggauggagaggacuuggugg

SEQ ID NO: 49004 - RNA, 27 nt, Human
acucuguagcccagucuggagugcagu

SEQ ID NO: 49005 - RNA, 26 nt, Human
cccuuuuuuguggugucuagcauuaa

SEQ ID NO: 49006 - RNA, 24 nt, Human
aguucugagcucuguacuuccucu

SEQ ID NO: 49007 - RNA, 23 nt, Human
cucuaucugcuaccaucuguguu

SEQ ID NO: 49008 - RNA, 26 nt, Human
aguauuuuuauaaugacuggucuucc

SEQ ID NO: 49009 - RNA, 25 nt, Human
cucucugcuguccaguaggcugcuu

SEQ ID NO: 49010 - RNA, 22 nt, Human
ugggaggcggagguugcaguga

SEQ ID NO: 49011 - RNA, 20 nt, Human
gguagagcgugaaauccaga

SEQ ID NO: 49012 - RNA, 27 nt, Human
aacuugucacccaaagccugucccagg

SEQ ID NO: 49013 - RNA, 22 nt, Human
cccugcaccucuuugagccuug

SEQ ID NO: 49014 - RNA, 28 nt, Human
cccugcgcccggcccuccagccagccuu

SEQ ID NO: 49015 - RNA, 22 nt, Human
uuaugccacugcuuuccagccu

SEQ ID NO: 49016 - RNA, 20 nt, Human
uuguauccuuuaauucuuca

SEQ ID NO: 49017 - RNA, 21 nt, Human
caccuguaaucucagcacuuu

SEQ ID NO: 49018 - RNA, 21 nt, Human
cacuuguaaucccagcacuuu

SEQ ID NO: 49019 - RNA, 22 nt, Human
aauaguauugauauauuuuaug

SEQ ID NO: 49020 - RNA, 22 nt, Human
gccucagccucccaaauagcug

SEQ ID NO: 49021 - RNA, 26 nt, Human
acccuuuaacaacucuuuguaaauuu

SEQ ID NO: 49022 - RNA, 23 nt, Human
ggccauucccccaggccuguguc

SEQ ID NO: 49023 - RNA, 21 nt, Human
ugcuugccaaggcuauggccu

SEQ ID NO: 49024 - RNA, 21 nt, Human
agcucacugcaagcucugccu

SEQ ID NO: 49025 - RNA, 30 nt, Human
auagagcacagucccugacaucacacagcu

SEQ ID NO: 49026 - RNA, 21 nt, Human
gaguuucuauuaaaggucauu

SEQ ID NO: 49027 - RNA, 21 nt, Human
cuccagcccaugacccggggc

SEQ ID NO: 49028 - RNA, 22 nt, Human
aaagugcugggauuacagacau

SEQ ID NO: 49029 - RNA, 22 nt, Human
cgcuugcuccgcgccugagcca

SEQ ID NO: 49030 - RNA, 23 nt, Human
ggcauuuaaugcauuucacacau

SEQ ID NO: 49031 - RNA, 20 nt, Human
ugccuaggcuggaggacagu

SEQ ID NO: 49032 - RNA, 22 nt, Human
agacuucucagauuauugugag

SEQ ID NO: 49033 - RNA, 21 nt, Human
gguaccccauuuacucagccu

SEQ ID NO: 49034 - RNA, 21 nt, Human
cacugccugauggaccuguca

SEQ ID NO: 49035 - RNA, 14 nt, Human
ccugcucuucuacc

SEQ ID NO: 49036 - RNA, 27 nt, Human
uucacuacccugauucuugauuccugg

SEQ ID NO: 49037 - RNA, 22 nt, Human
gcucacugccaccuccgccucu

SEQ ID NO: 49038 - RNA, 20 nt, Human
ccccagggcucccuaaagag

SEQ ID NO: 49039 - RNA, 26 nt, Human
cuuucugcuugcucuucuguuugcgg

SEQ ID NO: 49040 - RNA, 21 nt, Human
gaggucaggaguucuagacca

SEQ ID NO: 49041 - RNA, 27 nt, Human
cuucacagauguacugaugcuaugcca

SEQ ID NO: 49042 - RNA, 22 nt, Human
ucccugcagaggaaagacagga

SEQ ID NO: 49043 - RNA, 23 nt, Human
uauauuguguuugcugacaauca

SEQ ID NO: 49044 - RNA, 20 nt, Human
ucuuuuaauaaaacuaccua

SEQ ID NO: 49045 - RNA, 14 nt, Human
ccuaaaacuaccuu

SEQ ID NO: 49046 - RNA, 27 nt, Human
gggccuggaccagcuguccuuuacacc

SEQ ID NO: 49047 - RNA, 23 nt, Human
gccacccagccaggaggggcugu

SEQ ID NO: 49048 - RNA, 21 nt, Human
cagccaacucuuucucucugg

SEQ ID NO: 49049 - RNA, 21 nt, Human
aacagcccuguccacugugag

SEQ ID NO: 49050 - RNA, 21 nt, Human
guugcacuugccacccaagga

SEQ ID NO: 49051 - RNA, 22 nt, Human
cgaacuccugagcucaggcaau

SEQ ID NO: 49052 - RNA, 22 nt, Human
aggcuggagugcgguggcgcaa

SEQ ID NO: 49053 - RNA, 20 nt, Human
acuuucucccuuucucuacc

SEQ ID NO: 49054 - RNA, 22 nt, Human
accauuucuccucaccugggcc

SEQ ID NO: 49055 - RNA, 22 nt, Human
aaagcgcugggauuauaggucu

SEQ ID NO: 49056 - RNA, 20 nt, Human
ccgacggaauuucucuccca

SEQ ID NO: 49057 - RNA, 27 nt, Human
aaccuauauccuaugauacaacucuaa

SEQ ID NO: 49058 - RNA, 21 nt, Human
gaaaccagagccuucucccca

SEQ ID NO: 49059 - RNA, 22 nt, Human
agaaauuuggguguuuuuaaaa

SEQ ID NO: 49060 - RNA, 23 nt, Human
ggcccccauaaaccagcuggagc

SEQ ID NO: 49061 - RNA, 20 nt, Human
ggaaaucagccguagccaug

SEQ ID NO: 49062 - RNA, 22 nt, Human
ucuuuaaacuccuccucucuug

SEQ ID NO: 49063 - RNA, 27 nt, Human
uuaguaaaugucuuuuucccuccuuuc

SEQ ID NO: 49064 - RNA, 27 nt, Human
ggguaggagugggcguggcggagccag

SEQ ID NO: 49065 - RNA, 24 nt, Human
cagccucaccugcagcugcgccuc

SEQ ID NO: 49066 - RNA, 27 nt, Human
auggggccuuugguaagggaaguuuag

SEQ ID NO: 49067 - RNA, 24 nt, Human
uuccaguguuccagcuucugcgag

SEQ ID NO: 49068 - RNA, 24 nt, Human
aaacuauucuaucauaacuaccca

SEQ ID NO: 49069 - RNA, 20 nt, Human
ccccuguuugcuuuagagcc

SEQ ID NO: 49070 - RNA, 23 nt, Human
caccccacuccagccucgaggaa

SEQ ID NO: 49071 - RNA, 22 nt, Human
caggaccugcuagaaguggccg

SEQ ID NO: 49072 - RNA, 22 nt, Human
aagaugcaaaugcauggcaaau

SEQ ID NO: 49073 - RNA, 21 nt, Human
cuggaaguggagguugcagug

SEQ ID NO: 49074 - RNA, 25 nt, Human
gcugggagggauagaggggggcugc

SEQ ID NO: 49075 - RNA, 21 nt, Human
agcaggagaguuaauaaccuc

SEQ ID NO: 49076 - RNA, 27 nt, Human
gcaccuugggcacuguugaagugccuu

SEQ ID NO: 49077 - RNA, 21 nt, Human
augccucacagagcuuccugu

SEQ ID NO: 49078 - RNA, 28 nt, Human
acuuucacaccucauauaaucagaucua

SEQ ID NO: 49079 - RNA, 26 nt, Human
uucuaugccuuuagucaggaauggcu

SEQ ID NO: 49080 - RNA, 22 nt, Human
uuguuagcuuucauuucucagc

SEQ ID NO: 49081 - RNA, 22 nt, Human
cugcagcacaccccacagccaa

SEQ ID NO: 49082 - RNA, 25 nt, Human
uugccaggcugauugaagcaggccu

SEQ ID NO: 49083 - RNA, 22 nt, Human
aggcaggcugaucacgagguca

SEQ ID NO: 49084 - RNA, 18 nt, Human
gaagaauugcugugaaga

SEQ ID NO: 49085 - RNA, 26 nt, Human
uccagcugaaucucaaacagaaggca

SEQ ID NO: 49086 - RNA, 27 nt, Human
gcugcuugagugacgucucugucgugu

SEQ ID NO: 49087 - RNA, 22 nt, Human
cccacuuuccacauaguguucg

SEQ ID NO: 49088 - RNA, 28 nt, Human
gguucagcaugcaggaaaaagacgccuc

SEQ ID NO: 49089 - RNA, 20 nt, Human
aucuuaaaaaucuaugccua

SEQ ID NO: 49090 - RNA, 22 nt, Human
cugaggcagagcugcuugaacc

SEQ ID NO: 49091 - RNA, 22 nt, Human
cuguuugcuguuccugcuuuau

SEQ ID NO: 49092 - RNA, 22 nt, Human
cgccuguaaucccaguacuuug

SEQ ID NO: 49093 - RNA, 22 nt, Human
aucauuacaaugaaaggaauuc

SEQ ID NO: 49094 - RNA, 21 nt, Human
ucccuccagcccuggccuccu

SEQ ID NO: 49095 - RNA, 23 nt, Human
ggccccaucaggccugcccugag

SEQ ID NO: 49096 - RNA, 24 nt, Human
guucuucccaaugaucugagguca

SEQ ID NO: 49097 - RNA, 20 nt, Human
guuauugcugcuccaggaga

SEQ ID NO: 49098 - RNA, 22 nt, Human
ugaauuccugggcucaagcuuc

SEQ ID NO: 49099 - RNA, 26 nt, Human
cuuuccuuucucaaaauaauguuaua

SEQ ID NO: 49100 - RNA, 23 nt, Human
gggaggcauccaguguggcaaga

SEQ ID NO: 49101 - RNA, 24 nt, Human
cagggcaggggacaggucucaagu

SEQ ID NO: 49102 - RNA, 27 nt, Human
ccagaaacauuucccagaaaauguuuc

SEQ ID NO: 49103 - RNA, 22 nt, Human
agcaacuaacuuauugcuuuau

SEQ ID NO: 49104 - RNA, 23 nt, Human
caugcucaggaaguuucuggauc

SEQ ID NO: 49105 - RNA, 20 nt, Human
cucacaccugguaccacuca

SEQ ID NO: 49106 - RNA, 21 nt, Human
cagaaaaauauguaccaagaa

SEQ ID NO: 49107 - RNA, 20 nt, Human
cuaguuugcagugcugggca

SEQ ID NO: 49108 - RNA, 22 nt, Human
gccugucugugugcaucauguu

SEQ ID NO: 49109 - RNA, 21 nt, Human
cugauugccagaggcuuuuca

SEQ ID NO: 49110 - RNA, 23 nt, Human
aagcugacagaaguuauaccuua

SEQ ID NO: 49111 - RNA, 22 nt, Human
gugacucggggccaggcccagg

SEQ ID NO: 49112 - RNA, 20 nt, Human
auuucagaaaagcagucuag

SEQ ID NO: 49113 - RNA, 29 nt, Human
cacggcgaaggucugcagcuucacuccug

SEQ ID NO: 49114 - RNA, 27 nt, Human
augaaccauucacagugcaagaaggau

SEQ ID NO: 49115 - RNA, 23 nt, Human
uaccauugcuguucuacuuuuug

SEQ ID NO: 49116 - RNA, 26 nt, Human
cucuuuuaaacaggcaaaacaggaag

SEQ ID NO: 49117 - RNA, 22 nt, Human
cuguggcuuggagaugauagga

SEQ ID NO: 49118 - RNA, 23 nt, Human
caaggggauuccagccuucagaa

SEQ ID NO: 49119 - RNA, 20 nt, Human
uggguggacaggaggaagga

SEQ ID NO: 49120 - RNA, 27 nt, Human
uuguccagaguuccuguguagcacggg

SEQ ID NO: 49121 - RNA, 23 nt, Human
ugugugccaccacacuuggcuaa

SEQ ID NO: 49122 - RNA, 26 nt, Human
uacauacaucaauuaaacuuaugucc

SEQ ID NO: 49123 - RNA, 23 nt, Human
acccccaccgcgguccagcagcc

SEQ ID NO: 49124 - RNA, 27 nt, Human
cagcccaggacaccuuucucugccgcc

SEQ ID NO: 49125 - RNA, 19 nt, Human
agugguccacaucccggga

SEQ ID NO: 49126 - RNA, 23 nt, Human
ucugcaucugcaucugagcuucu

SEQ ID NO: 49127 - RNA, 21 nt, Human
aagugcuggaauuacaggcgu

SEQ ID NO: 49128 - RNA, 21 nt, Human
ccaaacaccccaccauuggcc

SEQ ID NO: 49129 - RNA, 20 nt, Human
gacaguguuaaccgugaaaa

SEQ ID NO: 49130 - RNA, 26 nt, Human
cuguuugcauguaagaugagaugaga

SEQ ID NO: 49131 - RNA, 28 nt, Human
gcucuaggacagugguucucaaaauuuu

SEQ ID NO: 49132 - RNA, 20 nt, Human
ucaaauucacuuuuauuuca

SEQ ID NO: 49133 - RNA, 23 nt, Human
cugcuaucaccuuccucuuguca

SEQ ID NO: 49134 - RNA, 22 nt, Human
gcucacugcaagcucugcuucc

SEQ ID NO: 49135 - RNA, 22 nt, Human
cugaggugggagaauugcuuga

SEQ ID NO: 49136 - RNA, 22 nt, Human
ccugugguuucagcgugccgcu

SEQ ID NO: 49137 - RNA, 23 nt, Human
acaagcaugaagugcuguggcug

SEQ ID NO: 49138 - RNA, 22 nt, Human
gaagucaggaaaagccuuucag

SEQ ID NO: 49139 - RNA, 24 nt, Human
agccuaacagaacaggagguauca

SEQ ID NO: 49140 - RNA, 23 nt, Human
ggccugucuuuaagcaaugcuuu

SEQ ID NO: 49141 - RNA, 22 nt, Human
uccaggccuggcuuccucucuu

SEQ ID NO: 49142 - RNA, 26 nt, Human
gcagcuuggaaauucaagcacgugau

SEQ ID NO: 49143 - RNA, 20 nt, Human
gguaagaguagcuggguuuu

SEQ ID NO: 49144 - RNA, 22 nt, Human
uaaauugagagauaaacaauga

SEQ ID NO: 49145 - RNA, 25 nt, Human
gaaacuuucaguagaugaagucuca

SEQ ID NO: 49146 - RNA, 25 nt, Human
guugucuacacaaaauaaauguaua

SEQ ID NO: 49147 - RNA, 21 nt, Human
cccugccugggcuuuggugca

SEQ ID NO: 49148 - RNA, 21 nt, Human
gccccgcgcacaggaucccag

SEQ ID NO: 49149 - RNA, 19 nt, Human
ggaauuccuaccgcuggga

SEQ ID NO: 49150 - RNA, 24 nt, Human
ugggcagcccgcaucauccagcac

SEQ ID NO: 49151 - RNA, 17 nt, Human
aagauaaaaaucucuua

SEQ ID NO: 49152 - RNA, 28 nt, Human
ggaccugggccuguucugcuccuaggag

SEQ ID NO: 49153 - RNA, 20 nt, Human
guagacacacaaaaaaugaa

SEQ ID NO: 49154 - RNA, 25 nt, Human
cccugcccuccucugcaccugacca

SEQ ID NO: 49155 - RNA, 24 nt, Human
uagaaaaugacuuauuucugcucu

SEQ ID NO: 49156 - RNA, 28 nt, Human
ccccgcguagccgcugccuccuccuacc

SEQ ID NO: 49157 - RNA, 21 nt, Human
acauauuugaaaauuuuguaa

SEQ ID NO: 49158 - RNA, 20 nt, Human
ccagcacuguggcagcgccc

SEQ ID NO: 49159 - RNA, 19 nt, Human
gcuucuguuauauucaaag

SEQ ID NO: 49160 - RNA, 20 nt, Human
gucuccuccccaccuugcaa

SEQ ID NO: 49161 - RNA, 27 nt, Human
gcugcgcuucaucauggagucauagaa

SEQ ID NO: 49162 - RNA, 16 nt, Human
ccagaucaaggcugug

SEQ ID NO: 49163 - RNA, 23 nt, Human
cacugccucucccuggcccucag

SEQ ID NO: 49164 - RNA, 25 nt, Human
ugaagucucccuuggaaaucugcca

SEQ ID NO: 49165 - RNA, 27 nt, Human
aagcuccaauuauugguccccaaaagc

SEQ ID NO: 49166 - RNA, 24 nt, Human
gugcacaggggacccucugcccca

SEQ ID NO: 49167 - RNA, 24 nt, Human
ggauccccaacccugagcacucuu

SEQ ID NO: 49168 - RNA, 32 nt, Human
gggagggagagggagcuuuguguuaagugccu

SEQ ID NO: 49169 - RNA, 24 nt, Human
acugaggguuucaaaauucgacua

SEQ ID NO: 49170 - RNA, 22 nt, Human
gaguccuggcccugcugcuugc

SEQ ID NO: 49171 - RNA, 22 nt, Human
uuuagcuaaugaaaaaguguuu

SEQ ID NO: 49172 - RNA, 27 nt, Human
gcacagccauuuagauauaacauccuu

SEQ ID NO: 49173 - RNA, 24 nt, Human
agagacacgggcucaaggaaccca

SEQ ID NO: 49174 - RNA, 22 nt, Human
ugagagggagcgcgcgggcagc

SEQ ID NO: 49175 - RNA, 26 nt, Human
ucucuguugcugugcuggucuuuagc

SEQ ID NO: 49176 - RNA, 27 nt, Human
guugcugcuguauuuuccccccacuuc

SEQ ID NO: 49177 - RNA, 20 nt, Human
uaaauguuaacacucaugaa

SEQ ID NO: 49178 - RNA, 19 nt, Human
cuuccucugcugcaucccc

SEQ ID NO: 49179 - RNA, 22 nt, Human
ugcaguuacucugggcucccau

SEQ ID NO: 49180 - RNA, 26 nt, Human
cugcgggcucaccaggcugcuggcuc

SEQ ID NO: 49181 - RNA, 24 nt, Human
gccucgguuggcuccucuggaaca

SEQ ID NO: 49182 - RNA, 27 nt, Human
gaguagcuggaauuacaggcaggcgcc

SEQ ID NO: 49183 - RNA, 29 nt, Human
gccagcgccacucugccaggcucccggcc

SEQ ID NO: 49184 - RNA, 27 nt, Human
agugggugguuugcgaggaugagggac

SEQ ID NO: 49185 - RNA, 23 nt, Human
cugcccgucugcugaugugacca

SEQ ID NO: 49186 - RNA, 24 nt, Human
ugggucuguagguuguugcaguga

SEQ ID NO: 49187 - RNA, 23 nt, Human
ugggauauaccaaggcagaggag

SEQ ID NO: 49188 - RNA, 19 nt, Human
cgaggaguagagaggcaga

SEQ ID NO: 49189 - RNA, 21 nt, Human
gcagccuggcccuccuggugc

SEQ ID NO: 49190 - RNA, 22 nt, Human
ccuccucaaccuucaccuccuu

SEQ ID NO: 49191 - RNA, 25 nt, Human
caguugcuuccuuuccuugaaggua

SEQ ID NO: 49192 - RNA, 24 nt, Human
caucuguuuguccaucugcugaaa

SEQ ID NO: 49193 - RNA, 26 nt, Human
uccagccugggccacauagcaagacc

SEQ ID NO: 49194 - RNA, 28 nt, Human
cacauggcgcaccggcaguauuccguaa

SEQ ID NO: 49195 - RNA, 24 nt, Human
gagaaugagaagggaaggccgggu

SEQ ID NO: 49196 - RNA, 27 nt, Human
cacugcacgccggaggccccuuccucg

SEQ ID NO: 49197 - RNA, 22 nt, Human
caggggcugagaguagcuuuga

SEQ ID NO: 49198 - RNA, 22 nt, Human
auucuaugcucucuguacuuuu

SEQ ID NO: 49199 - RNA, 23 nt, Human
uuuaccucccuuuauuuggugca

SEQ ID NO: 49200 - RNA, 19 nt, Human
ccacaaacaaaacucuucg

SEQ ID NO: 49201 - RNA, 23 nt, Human
uaaucauauuuaaauauauuuca

SEQ ID NO: 49202 - RNA, 19 nt, Human
uagaaaauauagguuccua

SEQ ID NO: 49203 - RNA, 23 nt, Human
gacaucaucucugauuguccuca

SEQ ID NO: 49204 - RNA, 21 nt, Human
uaaauugagaaagggugauaa

SEQ ID NO: 49205 - RNA, 26 nt, Human
ccauccaauuaucuacccaccugucu

SEQ ID NO: 49206 - RNA, 26 nt, Human
ucucacuguugacccuuuggccucug

SEQ ID NO: 49207 - RNA, 23 nt, Human
gucaucuguuuucugauaagaac

SEQ ID NO: 49208 - RNA, 25 nt, Human
ucuccagagaucucuccauugugca

SEQ ID NO: 49209 - RNA, 21 nt, Human
ccagccugggcgacagaguga

SEQ ID NO: 49210 - RNA, 26 nt, Human
acaagcuuuuguucucucaguacuug

SEQ ID NO: 49211 - RNA, 24 nt, Human
ccuucaucugccaucacucguguc

SEQ ID NO: 49212 - RNA, 25 nt, Human
gagucggaggcgccagcccacuggg

SEQ ID NO: 49213 - RNA, 23 nt, Human
cagagcugagugauggacgaccu

SEQ ID NO: 49214 - RNA, 27 nt, Human
agcaguuuuauccuggccuuguacuug

SEQ ID NO: 49215 - RNA, 22 nt, Human
aggguucccggagcuccgggaa

SEQ ID NO: 49216 - RNA, 25 nt, Human
ccuugcaguguugcaggcucaggcc

SEQ ID NO: 49217 - RNA, 22 nt, Human
auccuccugaguagcugggauu

SEQ ID NO: 49218 - RNA, 20 nt, Human
guuuuaaaaaugaguuuuug

SEQ ID NO: 49219 - RNA, 25 nt, Human
cuccugaggacuucugcggcugcag

SEQ ID NO: 49220 - RNA, 22 nt, Human
cagaacaugccagguguccuca

SEQ ID NO: 49221 - RNA, 20 nt, Human
ccccaaaacagcauuuucag

SEQ ID NO: 49222 - RNA, 22 nt, Human
cucagcaggcgcacguugguuu

SEQ ID NO: 49223 - RNA, 24 nt, Human
caaccugcaucuuuagugcuuucu

SEQ ID NO: 49224 - RNA, 19 nt, Human
ugccaggaagcagcacaga

SEQ ID NO: 49225 - RNA, 21 nt, Human
ccucuuaucugcccuggagcc

SEQ ID NO: 49226 - RNA, 22 nt, Human
ugccuaggcuggaggacagugg

SEQ ID NO: 49227 - RNA, 23 nt, Human
cuccuguuucucauccuagcuuu

SEQ ID NO: 49228 - RNA, 26 nt, Human
gauccugguggcugcgcuuuuugcua

SEQ ID NO: 49229 - RNA, 30 nt, Human
aagcacuccggaucuugcaacugaucugcc

SEQ ID NO: 49230 - RNA, 23 nt, Human
uaggcuucuuaguuuuaaaagga

SEQ ID NO: 49231 - RNA, 18 nt, Human
cccccgccuccaggcugg

SEQ ID NO: 49232 - RNA, 19 nt, Human
uuuuaauuucuugauuuca

SEQ ID NO: 49233 - RNA, 23 nt, Human
ggagcgggaaacuggagcuuaaa

SEQ ID NO: 49234 - RNA, 20 nt, Human
ccgugggguggagcauggug

SEQ ID NO: 49235 - RNA, 24 nt, Human
uuacgaauguuuauaagcuuucca

SEQ ID NO: 49236 - RNA, 22 nt, Human
uccuggguucccuugugugauc

SEQ ID NO: 49237 - RNA, 22 nt, Human
ggaccugggaggcagagguuuc

SEQ ID NO: 49238 - RNA, 22 nt, Human
gccaucauugcugucugcagcc

SEQ ID NO: 49239 - RNA, 22 nt, Human
uggucucaaacaccugaccuug

SEQ ID NO: 49240 - RNA, 22 nt, Human
uggacucaaacuccugaccuug

SEQ ID NO: 49241 - RNA, 20 nt, Human
cggggguggggaaagggguc

SEQ ID NO: 49242 - RNA, 24 nt, Human
uccgauuuccuguuaucaccagag

SEQ ID NO: 49243 - RNA, 23 nt, Human
uuggccuuccucagcuucaccuu

SEQ ID NO: 49244 - RNA, 24 nt, Human
ggcccagugcacucacuucacagu

SEQ ID NO: 49245 - RNA, 24 nt, Human
gggccuguugcccuuucuguacca

SEQ ID NO: 49246 - RNA, 26 nt, Human
gucugcuucugugauauuaucuuuaa

SEQ ID NO: 49247 - RNA, 23 nt, Human
ucugagcgccucugcucucuccc

SEQ ID NO: 49248 - RNA, 22 nt, Human
gacugugcucacuaccugggug

SEQ ID NO: 49249 - RNA, 19 nt, Human
gccgccgccgccgccucag

SEQ ID NO: 49250 - RNA, 24 nt, Human
cuccugcccucuccuugcccugcc

SEQ ID NO: 49251 - RNA, 21 nt, Human
accucugaacucugaccucag

SEQ ID NO: 49252 - RNA, 18 nt, Human
cuuuacacaucagucaca

SEQ ID NO: 49253 - RNA, 22 nt, Human
gccuguaauggugagacuuugg

SEQ ID NO: 49254 - RNA, 22 nt, Human
ggauuguuaggauggagcccag

SEQ ID NO: 49255 - RNA, 27 nt, Human
aagaauuguaauggcuacaguuucagu

SEQ ID NO: 49256 - RNA, 21 nt, Human
agagagcuagggcuggaggga

SEQ ID NO: 49257 - RNA, 21 nt, Human
ucauuuugcaacuuggagauu

SEQ ID NO: 49258 - RNA, 27 nt, Human
cuuccaggcccuccuguagugaguuga

SEQ ID NO: 49259 - RNA, 23 nt, Human
uggaaccagaugucuuguuacag

SEQ ID NO: 49260 - RNA, 21 nt, Human
gccuguggucucagcacuuug

SEQ ID NO: 49261 - RNA, 26 nt, Human
cucucuuugugcugaauuucugggcc

SEQ ID NO: 49262 - RNA, 23 nt, Human
ucuggcagaaguuuccagaagga

SEQ ID NO: 49263 - RNA, 23 nt, Human
ggggcagaagagaaaggacucag

SEQ ID NO: 49264 - RNA, 22 nt, Human
uggaauuguugcacuuucagcc

SEQ ID NO: 49265 - RNA, 24 nt, Human
guuucccuguguuguuccacaccc

SEQ ID NO: 49266 - RNA, 22 nt, Human
ggaaaggcagaggguggaggga

SEQ ID NO: 49267 - RNA, 22 nt, Human
cagagggaggagccagaccagc

SEQ ID NO: 49268 - RNA, 27 nt, Human
ccaagcccaacuccggaucucgcucuc

SEQ ID NO: 49269 - RNA, 22 nt, Human
aucaaguuaaacacaauucauu

SEQ ID NO: 49270 - RNA, 21 nt, Human
uccagcccagugcgagacagc

SEQ ID NO: 49271 - RNA, 19 nt, Human
ugucugucuauagcuugga

SEQ ID NO: 49272 - RNA, 19 nt, Human
uucaggaucagucaaggga

SEQ ID NO: 49273 - RNA, 24 nt, Human
ugaacagagcaggcuucugagguc

SEQ ID NO: 49274 - RNA, 27 nt, Human
gagacagaccuggauucaaaucugcca

SEQ ID NO: 49275 - RNA, 22 nt, Human
aaagugcuaggauuacaggccc

SEQ ID NO: 49276 - RNA, 22 nt, Human
ugaucggcguuuggacaucuca

SEQ ID NO: 49277 - RNA, 23 nt, Human
ucccaagaaucagagguuauaua

SEQ ID NO: 49278 - RNA, 23 nt, Human
uugcccaagguugcacagcaaga

SEQ ID NO: 49279 - RNA, 23 nt, Human
cuucugaaggcccauucauuaga

SEQ ID NO: 49280 - RNA, 27 nt, Human
aaaugcuguuuauucaugcugagguga

SEQ ID NO: 49281 - RNA, 22 nt, Human
cucagaguuuaaaagcuacuga

SEQ ID NO: 49282 - RNA, 24 nt, Human
acccaauuuccauagaugcaaaug

SEQ ID NO: 49283 - RNA, 25 nt, Human
uauuuuuauaaugcagaagaaggaa

SEQ ID NO: 49284 - RNA, 24 nt, Human
uacaacacacaugaugacugaggc

SEQ ID NO: 49285 - RNA, 27 nt, Human
gagcccaugggcuguuugaauuuggga

SEQ ID NO: 49286 - RNA, 21 nt, Human
aaacuucugguguggccaggu

SEQ ID NO: 49287 - RNA, 25 nt, Human
gaacaucaaccaugucuuacacucc

SEQ ID NO: 49288 - RNA, 21 nt, Human
cggggaaagccaacuccaucu

SEQ ID NO: 49289 - RNA, 20 nt, Human
cagagaagguaaaagacuga

SEQ ID NO: 49290 - RNA, 25 nt, Human
aucuuuauacucuuuuacugugugg

SEQ ID NO: 49291 - RNA, 21 nt, Human
gugccccaggccacagcugcu

SEQ ID NO: 49292 - RNA, 19 nt, Human
augguuuccaugcuuuugu

SEQ ID NO: 49293 - RNA, 22 nt, Human
aggggacgcaaugggaggcagg

SEQ ID NO: 49294 - RNA, 20 nt, Human
cccugcaccccuuccuggga

SEQ ID NO: 49295 - RNA, 22 nt, Human
gguucugcaaggaaccagggcu

SEQ ID NO: 49296 - RNA, 23 nt, Human
cagaaggccaagauccuugcuuu

SEQ ID NO: 49297 - RNA, 20 nt, Human
uuuucuguuuugagugucuu

SEQ ID NO: 49298 - RNA, 23 nt, Human
ggcaggagaauugcuugaaccgg

SEQ ID NO: 49299 - RNA, 20 nt, Human
ccaaacauaagccaccagcc

SEQ ID NO: 49300 - RNA, 24 nt, Human
aggaaccugcauugucauucucug

SEQ ID NO: 49301 - RNA, 22 nt, Human
cacagcuggcagucaagccaca

SEQ ID NO: 49302 - RNA, 29 nt, Human
cugccucuggccgcggccugugggauggu

SEQ ID NO: 49303 - RNA, 22 nt, Human
accaaacuuggccauuuuuugu

SEQ ID NO: 49304 - RNA, 24 nt, Human
gcugucacucugugccuuucuaca

SEQ ID NO: 49305 - RNA, 26 nt, Human
gcuagcaaucagcgagacuccauggg

SEQ ID NO: 49306 - RNA, 22 nt, Human
cucuuaucguuuugagcuaccu

SEQ ID NO: 49307 - RNA, 21 nt, Human
agcaugacccggguggcggga

SEQ ID NO: 49308 - RNA, 23 nt, Human
aguuccucucucuuuuguaauuu

SEQ ID NO: 49309 - RNA, 23 nt, Human
gcugcugcuguuaugaguuucuc

SEQ ID NO: 49310 - RNA, 27 nt, Human
ccuccugcucccagggagcuccagggc

SEQ ID NO: 49311 - RNA, 22 nt, Human
guggauguuggcuucacuccug

SEQ ID NO: 49312 - RNA, 22 nt, Human
gaugggagaaggggaggcauga

SEQ ID NO: 49313 - RNA, 20 nt, Human
gcuucuccaacacugaagug

SEQ ID NO: 49314 - RNA, 23 nt, Human
uggcuccaccucuguccucucuc

SEQ ID NO: 49315 - RNA, 22 nt, Human
cauccaggcuggagugcagugg

SEQ ID NO: 49316 - RNA, 22 nt, Human
gcaugagcugcugugcccagcc

SEQ ID NO: 49317 - RNA, 24 nt, Human
cccugcagcuccagccccgggcug

SEQ ID NO: 49318 - RNA, 25 nt, Human
gagcauggaauuggaaugugucaca

SEQ ID NO: 49319 - RNA, 23 nt, Human
cugucucuugucaagugggaccu

SEQ ID NO: 49320 - RNA, 22 nt, Human
uugucugacuucuacucuguca

SEQ ID NO: 49321 - RNA, 25 nt, Human
gugauuccaagaucauccuucaccc

SEQ ID NO: 49322 - RNA, 21 nt, Human
gaaaccagcucgugggcuggg

SEQ ID NO: 49323 - RNA, 23 nt, Human
agcaggagaaucacuugaaccug

SEQ ID NO: 49324 - RNA, 25 nt, Human
guuaugggguuggagugccgacggg

SEQ ID NO: 49325 - RNA, 20 nt, Human
ccucuaaccuccugaccuca

SEQ ID NO: 49326 - RNA, 22 nt, Human
agcaaggaggcuggcuggggcc

SEQ ID NO: 49327 - RNA, 22 nt, Human
ggucaguaacaagugcaaugga

SEQ ID NO: 49328 - RNA, 24 nt, Human
gggcacuuccuccacaguccccca

SEQ ID NO: 49329 - RNA, 22 nt, Human
ugcagugaacuaugauggugcc

SEQ ID NO: 49330 - RNA, 19 nt, Human
cuucucagccuccuagcca

SEQ ID NO: 49331 - RNA, 23 nt, Human
auagcugcugcccuaguuuucuu

SEQ ID NO: 49332 - RNA, 21 nt, Human
cuggagccuggcuggccucug

SEQ ID NO: 49333 - RNA, 22 nt, Human
aaauguucgccugcuccaaguu

SEQ ID NO: 49334 - RNA, 22 nt, Human
ugacugccccuggucuuccacc

SEQ ID NO: 49335 - RNA, 24 nt, Human
ugcagcccaggcuggagugcagug

SEQ ID NO: 49336 - RNA, 19 nt, Human
ggacaugaaacuccaccuu

SEQ ID NO: 49337 - RNA, 22 nt, Human
gcugcccuuccaugauguugcc

SEQ ID NO: 49338 - RNA, 21 nt, Human
cggccgccugcagucuccucu

SEQ ID NO: 49339 - RNA, 26 nt, Human
cuccacccucugccuugcaauacgca

SEQ ID NO: 49340 - RNA, 21 nt, Human
gugacugccccacagagauaa

SEQ ID NO: 49341 - RNA, 27 nt, Human
aacacccuucuggcccucagucuguuc

SEQ ID NO: 49342 - RNA, 26 nt, Human
uaaggcccacgugggacagucuaaua

SEQ ID NO: 49343 - RNA, 22 nt, Human
ccaugaucaagcguuuccugga

SEQ ID NO: 49344 - RNA, 26 nt, Human
ccuccaggaaucggugucucuaucag

SEQ ID NO: 49345 - RNA, 19 nt, Human
cccggccuggccacaggug

SEQ ID NO: 49346 - RNA, 27 nt, Human
ccacugccuccucccuggcugcagccu

SEQ ID NO: 49347 - RNA, 22 nt, Human
uaaaaaguucagaguucauugg

SEQ ID NO: 49348 - RNA, 24 nt, Human
uaauugagucaaaggcaggaucag

SEQ ID NO: 49349 - RNA, 22 nt, Human
uucauaaggaauaaacaaguug

SEQ ID NO: 49350 - RNA, 23 nt, Human
uguugucauugcuccugcagccu

SEQ ID NO: 49351 - RNA, 27 nt, Human
acuauuucccacauguucucugccuuc

SEQ ID NO: 49352 - RNA, 24 nt, Human
gaccccuggcucuauaagcugaau

SEQ ID NO: 49353 - RNA, 24 nt, Human
agcccccaaagagcuguggcuggg

SEQ ID NO: 49354 - RNA, 26 nt, Human
cccuggauaggaagccacugagucug

SEQ ID NO: 49355 - RNA, 22 nt, Human
ucugcugcuggcucucuucccu

SEQ ID NO: 49356 - RNA, 23 nt, Human
ugcuggacccaguaagaugagga

SEQ ID NO: 49357 - RNA, 21 nt, Human
agccuccagggcauugcucag

SEQ ID NO: 49358 - RNA, 24 nt, Human
cccucacugcaggcuccccuccuc

SEQ ID NO: 49359 - RNA, 23 nt, Human
uuccauuccugauacacuguaca

SEQ ID NO: 49360 - RNA, 22 nt, Human
cagccuauacuucccuuuuuga

SEQ ID NO: 49361 - RNA, 21 nt, Human
uggaaggagagagguugagga

SEQ ID NO: 49362 - RNA, 20 nt, Human
ggaggcagagcuugcaguga

SEQ ID NO: 49363 - RNA, 27 nt, Human
ucccuggguccaggaguguagaauaug

SEQ ID NO: 49364 - RNA, 22 nt, Human
uuugcagaagaacacuguugua

SEQ ID NO: 49365 - RNA, 19 nt, Human
auggaaauaccaggaccag

SEQ ID NO: 49366 - RNA, 27 nt, Human
gaacccauggauacagagggccaacug

SEQ ID NO: 49367 - RNA, 25 nt, Human
ucccugccuuggucccgccaacaca

SEQ ID NO: 49368 - RNA, 21 nt, Human
guaaaaaauauuucccaaaga

SEQ ID NO: 49369 - RNA, 25 nt, Human
uuugcggacagcgucucccucgacu

SEQ ID NO: 49370 - RNA, 23 nt, Human
guggcaguggugaggccagugcu

SEQ ID NO: 49371 - RNA, 21 nt, Human
accugcucuguccccaaagga

SEQ ID NO: 49372 - RNA, 21 nt, Human
agggcuggggcucagccuggg

SEQ ID NO: 49373 - RNA, 21 nt, Human
agccuccaggcgcaugcuguc

SEQ ID NO: 49374 - RNA, 22 nt, Human
uuuuuccuuugcuuucucuuua

SEQ ID NO: 49375 - RNA, 25 nt, Human
uuccucuucguucaccuuggcucau

SEQ ID NO: 49376 - RNA, 23 nt, Human
accugacuuauggagcacuugua

SEQ ID NO: 49377 - RNA, 24 nt, Human
ggaaagggacagauagcuuuccaa

SEQ ID NO: 49378 - RNA, 22 nt, Human
aauucaaguucaacagacuuca

SEQ ID NO: 49379 - RNA, 19 nt, Human
ucucacugcccucugcacc

SEQ ID NO: 49380 - RNA, 22 nt, Human
ggcuaaaauguuuucagcuagg

SEQ ID NO: 49381 - RNA, 21 nt, Human
guaauuuguuaugacagcccu

SEQ ID NO: 49382 - RNA, 22 nt, Human
cugcuucucccauguaccaggg

SEQ ID NO: 49383 - RNA, 22 nt, Human
cuguguacacaucuccaagcaa

SEQ ID NO: 49384 - RNA, 25 nt, Human
aacaaaaugugcuagccacugggga

SEQ ID NO: 49385 - RNA, 26 nt, Human
gcuucaaggaguaugcagggagcugg

SEQ ID NO: 49386 - RNA, 18 nt, Human
agcagguugcagcuugga

SEQ ID NO: 49387 - RNA, 23 nt, Human
uuugcagacguuaugaucuugcu

SEQ ID NO: 49388 - RNA, 23 nt, Human
aggaugucaccuggaaucagcac

SEQ ID NO: 49389 - RNA, 25 nt, Human
gaugggguuucaccaucuuggccag

SEQ ID NO: 49390 - RNA, 21 nt, Human
gccaagggaggcggauuuccc

SEQ ID NO: 49391 - RNA, 20 nt, Human
cacaaacccagccuggggag

SEQ ID NO: 49392 - RNA, 20 nt, Human
caaaugucuuccuggauuau

SEQ ID NO: 49393 - RNA, 23 nt, Human
guacagccacccacugacaucug

SEQ ID NO: 49394 - RNA, 22 nt, Human
gcuuuuaccaacagcauuuuag

SEQ ID NO: 49395 - RNA, 18 nt, Human
aggcucucgcacaccucu

SEQ ID NO: 49396 - RNA, 23 nt, Human
uguuacugcuguguuauuuacac

SEQ ID NO: 49397 - RNA, 17 nt, Human
ucuuccucuccugggcc

SEQ ID NO: 49398 - RNA, 21 nt, Human
guaguggaauuauguuuauga

SEQ ID NO: 49399 - RNA, 21 nt, Human
agucaccauguaccucugaca

SEQ ID NO: 49400 - RNA, 22 nt, Human
uccaugaaagguacgucugaaa

SEQ ID NO: 49401 - RNA, 22 nt, Human
aacuucagaaaggaacaggaaa

SEQ ID NO: 49402 - RNA, 25 nt, Human
ugcuucuuccuucagaaaguagagg

SEQ ID NO: 49403 - RNA, 28 nt, Human
cucugggcuauggacacagggugacggu

SEQ ID NO: 49404 - RNA, 18 nt, Human
cacuuccuucauguaaga

SEQ ID NO: 49405 - RNA, 23 nt, Human
ccuggcuggggcccugcugucaa

SEQ ID NO: 49406 - RNA, 26 nt, Human
ggcuucuccagccuuucucccucaca

SEQ ID NO: 49407 - RNA, 21 nt, Human
uuagagauccaucuuucucca

SEQ ID NO: 49408 - RNA, 22 nt, Human
cuuuugaaucaaucuggcuucu

SEQ ID NO: 49409 - RNA, 21 nt, Human
caugccuguaauccaacauug

SEQ ID NO: 49410 - RNA, 22 nt, Human
aucgguucuccccuucccggcu

SEQ ID NO: 49411 - RNA, 22 nt, Human
uuccuuuuuccuuccucuuuau

SEQ ID NO: 49412 - RNA, 21 nt, Human
cuucccuugcuggaaaaccca

SEQ ID NO: 49413 - RNA, 22 nt, Human
acagucccuccaggguuugggc

SEQ ID NO: 49414 - RNA, 26 nt, Human
gagaaauggggagaauaagccagaaa

SEQ ID NO: 49415 - RNA, 27 nt, Human
uggccagacuauucccuaggacaagga

SEQ ID NO: 49416 - RNA, 26 nt, Human
uagauauauuauuguuuuaacuuaac

SEQ ID NO: 49417 - RNA, 27 nt, Human
caccuaaggcuggaugggaaagugcag

SEQ ID NO: 49418 - RNA, 20 nt, Human
gccuugagagaaagccuucu

SEQ ID NO: 49419 - RNA, 21 nt, Human
ccccaaaccuuuguuuaugua

SEQ ID NO: 49420 - RNA, 21 nt, Human
cauauucucugauucugggaa

SEQ ID NO: 49421 - RNA, 21 nt, Human
ugaaagggauggccacaaguu

SEQ ID NO: 49422 - RNA, 20 nt, Human
ccgauauuugccauucuucc

SEQ ID NO: 49423 - RNA, 20 nt, Human
cuggcucucugguccuuguu

SEQ ID NO: 49424 - RNA, 21 nt, Human
ucuccaccaggccccucaucu

SEQ ID NO: 49425 - RNA, 26 nt, Human
gugacuucuucccuaaaauguagaaa

SEQ ID NO: 49426 - RNA, 28 nt, Human
ugguuugccuuuuauguaaauuuuuuac

SEQ ID NO: 49427 - RNA, 22 nt, Human
ccccaaaucuuggcugggcacg

SEQ ID NO: 49428 - RNA, 18 nt, Human
uuuccaaugcugaaugcc

SEQ ID NO: 49429 - RNA, 21 nt, Human
cugaguauucugucacagaca

SEQ ID NO: 49430 - RNA, 26 nt, Human
accauccugucuucucagcaucuccu

SEQ ID NO: 49431 - RNA, 23 nt, Human
ggggcacgccugcccagccucgc

SEQ ID NO: 49432 - RNA, 31 nt, Human
gggcugaccccugccuuugauugucauucuc

SEQ ID NO: 49433 - RNA, 24 nt, Human
ugucuuuuuaaaugguccauuuuc

SEQ ID NO: 49434 - RNA, 21 nt, Human
ccugcagcugccccaagccau

SEQ ID NO: 49435 - RNA, 26 nt, Human
cacuggcggcccuaagccacucccgc

SEQ ID NO: 49436 - RNA, 19 nt, Human
cugcaguucagccauggca

SEQ ID NO: 49437 - RNA, 21 nt, Human
gcaacaacacuuuacuaccua

SEQ ID NO: 49438 - RNA, 27 nt, Human
uucucuguuuucugucagucccccagu

SEQ ID NO: 49439 - RNA, 26 nt, Human
aguggugccaucaccacggcucacug

SEQ ID NO: 49440 - RNA, 23 nt, Human
ugaacaacauggaacugaugauu

SEQ ID NO: 49441 - RNA, 27 nt, Human
ugccugacggacccuguugccugcucc

SEQ ID NO: 49442 - RNA, 27 nt, Human
uuucccaagcguuucuuuccaccugga

SEQ ID NO: 49443 - RNA, 28 nt, Human
ccugcacacagcugcucagcaccauuuc

SEQ ID NO: 49444 - RNA, 23 nt, Human
gaaccauggcuuuucaugcuucc

SEQ ID NO: 49445 - RNA, 23 nt, Human
cucauaacaccaucacacucuuc

SEQ ID NO: 49446 - RNA, 24 nt, Human
uuuuccagagcugacagcacgggc

SEQ ID NO: 49447 - RNA, 27 nt, Human
ucuccugggcauggccuccccuccucu

SEQ ID NO: 49448 - RNA, 20 nt, Human
gaggaagauggaccuggaca

SEQ ID NO: 49449 - RNA, 22 nt, Human
ucccaagguggucguaguggug

SEQ ID NO: 49450 - RNA, 20 nt, Human
gugauaauuuucuguguucu

SEQ ID NO: 49451 - RNA, 21 nt, Human
cugccaccuggucugccacag

SEQ ID NO: 49452 - RNA, 23 nt, Human
ccagccucaacagccgccagaag

SEQ ID NO: 49453 - RNA, 27 nt, Human
gccuccugcuuggaucucuccuggguc

SEQ ID NO: 49454 - RNA, 23 nt, Human
gggcccuuugaugucuucaucug

SEQ ID NO: 49455 - RNA, 22 nt, Human
gaauauggaacucaggaggcgg

SEQ ID NO: 49456 - RNA, 20 nt, Human
ggcccaggaguguggcugca

SEQ ID NO: 49457 - RNA, 27 nt, Human
gcucugucacccaggcuugagugcagu

SEQ ID NO: 49458 - RNA, 21 nt, Human
uucucucuaaagcagggcuua

SEQ ID NO: 49459 - RNA, 22 nt, Human
ccgcccaaacuggagugcagug

SEQ ID NO: 49460 - RNA, 26 nt, Human
ccuguaaucccagcauuuugagaggc

SEQ ID NO: 49461 - RNA, 22 nt, Human
cccaaguagcugggacugcagg

SEQ ID NO: 49462 - RNA, 21 nt, Human
ccaucaucuguugcccauauu

SEQ ID NO: 49463 - RNA, 22 nt, Human
uccagcccccaggcagugccuu

SEQ ID NO: 49464 - RNA, 26 nt, Human
gguaccugguccccacugcugagcug

SEQ ID NO: 49465 - RNA, 16 nt, Human
gacacucccucagccu

SEQ ID NO: 49466 - RNA, 22 nt, Human
cccgcagcugccgcagccggcc

SEQ ID NO: 49467 - RNA, 19 nt, Human
gcucacauuugccccaggg

SEQ ID NO: 49468 - RNA, 19 nt, Human
cugggcccuccuuuccccc

SEQ ID NO: 49469 - RNA, 21 nt, Human
ugugugaaaaaauacccucug

SEQ ID NO: 49470 - RNA, 22 nt, Human
cccagugagagcggagggugcc

SEQ ID NO: 49471 - RNA, 24 nt, Human
ugcccaggcugugcagcgcagcug

SEQ ID NO: 49472 - RNA, 22 nt, Human
aucgcuugaacccaggaggcag

SEQ ID NO: 49473 - RNA, 27 nt, Human
ugucucugcauccuaacuugcugccuu

SEQ ID NO: 49474 - RNA, 22 nt, Human
agcaauuguauuacuuccucug

SEQ ID NO: 49475 - RNA, 21 nt, Human
uccaaauugaggcauuuauua

SEQ ID NO: 49476 - RNA, 23 nt, Human
cugcugcuuaguuuuuggacuga

SEQ ID NO: 49477 - RNA, 27 nt, Human
aggcauaaacaauguguauugcagugc

SEQ ID NO: 49478 - RNA, 27 nt, Human
aaacucauaaagauguucauuuaauca

SEQ ID NO: 49479 - RNA, 26 nt, Human
agaaaugcuguggcccuucccuuuac

SEQ ID NO: 49480 - RNA, 21 nt, Human
guugcccacauuaagcacugu

SEQ ID NO: 49481 - RNA, 20 nt, Human
ccaagcuuuugugauuguau

SEQ ID NO: 49482 - RNA, 25 nt, Human
cccguuuucuucgguucccugcugu

SEQ ID NO: 49483 - RNA, 21 nt, Human
gaagcagcugggagcuuggaa

SEQ ID NO: 49484 - RNA, 19 nt, Human
ccggcagcugcucuuuguc

SEQ ID NO: 49485 - RNA, 22 nt, Human
ggcucacugcaagcucugcuuc

SEQ ID NO: 49486 - RNA, 20 nt, Human
uggcgccgccuuccccuaca

SEQ ID NO: 49487 - RNA, 27 nt, Human
agggggaccagagguugaccacugugg

SEQ ID NO: 49488 - RNA, 23 nt, Human
ugucuuaugaaaauugccaaaca

SEQ ID NO: 49489 - RNA, 24 nt, Human
ugggcuuuugcuguccucuucuca

SEQ ID NO: 49490 - RNA, 21 nt, Human
cccaucucccuagaagagccc

SEQ ID NO: 49491 - RNA, 22 nt, Human
ggcccaaacucagaacuguucc

SEQ ID NO: 49492 - RNA, 23 nt, Human
ccaacaugccaccauguugacau

SEQ ID NO: 49493 - RNA, 22 nt, Human
gagcccaggaggucaaggcugc

SEQ ID NO: 49494 - RNA, 21 nt, Human
accaguaccucucagcuuacu

SEQ ID NO: 49495 - RNA, 26 nt, Human
gugcucugucacccaggcuggagugc

SEQ ID NO: 49496 - RNA, 21 nt, Human
ucacccaggcuggagugcagu

SEQ ID NO: 49497 - RNA, 17 nt, Human
gcagcuaugaucccgcu

SEQ ID NO: 49498 - RNA, 24 nt, Human
auacuagcucacaucugaagucaa

SEQ ID NO: 49499 - RNA, 27 nt, Human
gcccagccuagcgugcccugccccucu

SEQ ID NO: 49500 - RNA, 23 nt, Human
ucucaggcaucaaaagcauuuug

SEQ ID NO: 49501 - RNA, 30 nt, Human
ggggagcaaugauggagggagccccugaga

SEQ ID NO: 49502 - RNA, 22 nt, Human
ugaggggaaguguagcucccag

SEQ ID NO: 49503 - RNA, 20 nt, Human
auguuagagacaaacacaaa

SEQ ID NO: 49504 - RNA, 22 nt, Human
uugggaagcuuucagugcugcu

SEQ ID NO: 49505 - RNA, 24 nt, Human
cucagagugccuucuccaucccag

SEQ ID NO: 49506 - RNA, 25 nt, Human
ggccagguucuccguuagcuccugu

SEQ ID NO: 49507 - RNA, 32 nt, Human
uccagccuggggaacagagcaagacugucuca

SEQ ID NO: 49508 - RNA, 23 nt, Human
agacccagggcucugcacucuca

SEQ ID NO: 49509 - RNA, 23 nt, Human
cggccccgggagcggagagcgag

SEQ ID NO: 49510 - RNA, 22 nt, Human
ucacccaggcugcagugcaaug

SEQ ID NO: 49511 - RNA, 25 nt, Human
cagccugcacccucuucucuucugg

SEQ ID NO: 49512 - RNA, 23 nt, Human
ggagagggggagugcgcggcggc

SEQ ID NO: 49513 - RNA, 27 nt, Human
uuuucauuuucuguguucuaaauagaa

SEQ ID NO: 49514 - RNA, 24 nt, Human
cgccuguaggcuggagggacugug

SEQ ID NO: 49515 - RNA, 22 nt, Human
cacuugugagcaaauugaguua

SEQ ID NO: 49516 - RNA, 26 nt, Human
cgccugugcuuuuucucccagcacug

SEQ ID NO: 49517 - RNA, 26 nt, Human
cccgucugcucucagccuccuccucc

SEQ ID NO: 49518 - RNA, 23 nt, Human
aucugaaaacuaccacaccauau

SEQ ID NO: 49519 - RNA, 26 nt, Human
agggguuucuucaagagcugagaaac

SEQ ID NO: 49520 - RNA, 27 nt, Human
gcuuguaauccuagcacuuuuugaggc

SEQ ID NO: 49521 - RNA, 30 nt, Human
aagcuucccauuucacaaaggggaaacuga

SEQ ID NO: 49522 - RNA, 26 nt, Human
acuugccccagaugccuccucugucc

SEQ ID NO: 49523 - RNA, 22 nt, Human
agucuggaccuccaucccugcu

SEQ ID NO: 49524 - RNA, 25 nt, Human
ccaggugugaugaugugcaccuaua

SEQ ID NO: 49525 - RNA, 25 nt, Human
accaggucucucaaaagaaaggaca

SEQ ID NO: 49526 - RNA, 26 nt, Human
uccugucuccccuaauugacauucua

SEQ ID NO: 49527 - RNA, 25 nt, Human
ugcaggggguggggguuggggaaga

SEQ ID NO: 49528 - RNA, 22 nt, Human
gugccugacaguguuuaaggug

SEQ ID NO: 49529 - RNA, 27 nt, Human
cgcugucacccaggcuggagugcagug

SEQ ID NO: 49530 - RNA, 22 nt, Human
augggccucagucuucccaucu

SEQ ID NO: 49531 - RNA, 20 nt, Human
agcuagcaagucuuguguuu

SEQ ID NO: 49532 - RNA, 22 nt, Human
gugaucccagcucacugcagcc

SEQ ID NO: 49533 - RNA, 21 nt, Human
agaaaacacacuccuuugcuu

SEQ ID NO: 49534 - RNA, 23 nt, Human
uuccccacucugcucccagcccc

SEQ ID NO: 49535 - RNA, 22 nt, Human
ugcugcccaggcuagagugcag

SEQ ID NO: 49536 - RNA, 26 nt, Human
caucccugcaccaggacucaccaaga

SEQ ID NO: 49537 - RNA, 23 nt, Human
gcugggcauacuuucucucuagg

SEQ ID NO: 49538 - RNA, 24 nt, Human
gccgguguuuugcaguccugggca

SEQ ID NO: 49539 - RNA, 23 nt, Human
ccaguaaauccacccaaggagag

SEQ ID NO: 49540 - RNA, 21 nt, Human
ccaaggugcuggauuacaggu

SEQ ID NO: 49541 - RNA, 23 nt, Human
aaucagcuuuguaacuguuuuca

SEQ ID NO: 49542 - RNA, 23 nt, Human
cauuccccuuucagcucccauga

SEQ ID NO: 49543 - RNA, 22 nt, Human
uuuuucuccucugucccgaggu

SEQ ID NO: 49544 - RNA, 22 nt, Human
gccauccugaaacucuuuggag

SEQ ID NO: 49545 - RNA, 18 nt, Human
uagccuggcuuucuugcu

SEQ ID NO: 49546 - RNA, 21 nt, Human
ccuuccuauguaugacgaaac

SEQ ID NO: 49547 - RNA, 21 nt, Human
cugaccucauuuucugcuaug

SEQ ID NO: 49548 - RNA, 24 nt, Human
ccagcaaaagaucuacauucuugc

SEQ ID NO: 49549 - RNA, 25 nt, Human
cacacacacuugcauucaugaaucu

SEQ ID NO: 49550 - RNA, 18 nt, Human
ccugccucuccgucuugu

SEQ ID NO: 49551 - RNA, 26 nt, Human
aggaauagacucagggauuucaccag

SEQ ID NO: 49552 - RNA, 21 nt, Human
ccucgcccucaugaauagcug

SEQ ID NO: 49553 - RNA, 23 nt, Human
cauguguuacaaaagcaugauaa

SEQ ID NO: 49554 - RNA, 21 nt, Human
ggccucgggaagccccaucca

SEQ ID NO: 49555 - RNA, 22 nt, Human
ugucaccgaggcuggagugcag

SEQ ID NO: 49556 - RNA, 26 nt, Human
uugccucuguccugccugguguggag

SEQ ID NO: 49557 - RNA, 19 nt, Human
auggaggaaaaaugacuaa

SEQ ID NO: 49558 - RNA, 22 nt, Human
ugagccaagaucgcucccacug

SEQ ID NO: 49559 - RNA, 23 nt, Human
gaguccuggaauuuggacaagug

SEQ ID NO: 49560 - RNA, 26 nt, Human
ccacaaccaacaccacaaaccuuuca

SEQ ID NO: 49561 - RNA, 23 nt, Human
uugaugcaugggccucagucaca

SEQ ID NO: 49562 - RNA, 27 nt, Human
cgcaaaugaagggagcagacagugauu

SEQ ID NO: 49563 - RNA, 28 nt, Human
ucuguguaugugucugugugucugcguc

SEQ ID NO: 49564 - RNA, 25 nt, Human
ggugugaaaaaagcagacaaguugu

SEQ ID NO: 49565 - RNA, 22 nt, Human
cugccuccuggguucaagcgau

SEQ ID NO: 49566 - RNA, 22 nt, Human
guucccgugucugucugucuug

SEQ ID NO: 49567 - RNA, 22 nt, Human
cuguuauccuuccaucaugacu

SEQ ID NO: 49568 - RNA, 22 nt, Human
gacguagguuguggugagcuga

SEQ ID NO: 49569 - RNA, 19 nt, Human
uuggucugauuucacagga

SEQ ID NO: 49570 - RNA, 25 nt, Human
aaguacaguguuagaugugcacaag

SEQ ID NO: 49571 - RNA, 21 nt, Human
ucauuaaaaaaguuauagccu

SEQ ID NO: 49572 - RNA, 25 nt, Human
ccaauggcaaccaagaccaaagcca

SEQ ID NO: 49573 - RNA, 25 nt, Human
ucaugccaggcugacggguccagug

SEQ ID NO: 49574 - RNA, 26 nt, Human
ucauuuuucuucucugggaaggugaa

SEQ ID NO: 49575 - RNA, 19 nt, Human
gcugcccaggcugugcagc

SEQ ID NO: 49576 - RNA, 22 nt, Human
agcuggaccucagcccugggug

SEQ ID NO: 49577 - RNA, 21 nt, Human
uaacaccugauuuguauucua

SEQ ID NO: 49578 - RNA, 23 nt, Human
ccaauggcccacgaaaucugcua

SEQ ID NO: 49579 - RNA, 22 nt, Human
auuucuuauuugaaaguguuuu

SEQ ID NO: 49580 - RNA, 25 nt, Human
gaccucaggugauccacccaccucg

SEQ ID NO: 49581 - RNA, 19 nt, Human
gcacacacaauggugccug

SEQ ID NO: 49582 - RNA, 29 nt, Human
guggcaacuaccuggaaauggccuccagu

SEQ ID NO: 49583 - RNA, 27 nt, Human
agaauucuuaggcaaccuucauaccuu

SEQ ID NO: 49584 - RNA, 25 nt, Human
cccuagacggccucagucccuccca

SEQ ID NO: 49585 - RNA, 22 nt, Human
uuauuugucugguaagcauuuu

SEQ ID NO: 49586 - RNA, 26 nt, Human
cucugccucaaggcuugguuccugga

SEQ ID NO: 49587 - RNA, 26 nt, Human
ccuagccugugauggcguuugacguc

SEQ ID NO: 49588 - RNA, 20 nt, Human
augagacucgagguuuucug

SEQ ID NO: 49589 - RNA, 21 nt, Human
ggaaauuuaaaauuuauggaa

SEQ ID NO: 49590 - RNA, 18 nt, Human
cagaagcagguugcagug

SEQ ID NO: 49591 - RNA, 27 nt, Human
caggcuggagugcgguggcuauucaca

SEQ ID NO: 49592 - RNA, 20 nt, Human
aaauagccacacuguguccu

SEQ ID NO: 49593 - RNA, 20 nt, Human
agaugaagcugcaaaggguu

SEQ ID NO: 49594 - RNA, 20 nt, Human
aauugagaaacuggauagau

SEQ ID NO: 49595 - RNA, 23 nt, Human
cgggguguaacuuccugcugcac

SEQ ID NO: 49596 - RNA, 20 nt, Human
cggaugggagaaaccagaga

SEQ ID NO: 49597 - RNA, 23 nt, Human
uucccucacccuguauccugucu

SEQ ID NO: 49598 - RNA, 27 nt, Human
uugcuugcacuauaggagucauaaaag

SEQ ID NO: 49599 - RNA, 26 nt, Human
uaacauuuacacagugcuuuuuacca

SEQ ID NO: 49600 - RNA, 22 nt, Human
gcggcucgggauggaggcugga

SEQ ID NO: 49601 - RNA, 27 nt, Human
uccugcucuccuugggaugauggcugg

SEQ ID NO: 49602 - RNA, 20 nt, Human
uucuggugggguguguucca

SEQ ID NO: 49603 - RNA, 22 nt, Human
ccaaugccaaggcaaaaagaac

SEQ ID NO: 49604 - RNA, 18 nt, Human
uacaggacagaaaccacu

SEQ ID NO: 49605 - RNA, 27 nt, Human
cccucagcccccgccaggauucccgca

SEQ ID NO: 49606 - RNA, 22 nt, Human
ucugucacccaggcugaagugc

SEQ ID NO: 49607 - RNA, 27 nt, Human
uuuucuuucuugguuuuuguccaagau

SEQ ID NO: 49608 - RNA, 27 nt, Human
ccugugcacugagcccaccagccacag

SEQ ID NO: 49609 - RNA, 22 nt, Human
cacaucugcauuuucaccccac

SEQ ID NO: 49610 - RNA, 19 nt, Human
ucuuccucuuucuucauuc

SEQ ID NO: 49611 - RNA, 23 nt, Human
cccucauucucauuccugggcag

SEQ ID NO: 49612 - RNA, 21 nt, Human
guggccaaacaacagucuuca

SEQ ID NO: 49613 - RNA, 23 nt, Human
gcgccccgcugaucuuugcuuca

SEQ ID NO: 49614 - RNA, 24 nt, Human
cucuuugacuaggucccaggaucc

SEQ ID NO: 49615 - RNA, 27 nt, Human
cugggcaacaacagcaaaacuccaucu

SEQ ID NO: 49616 - RNA, 24 nt, Human
ugugugucagagcuaggguggggg

SEQ ID NO: 49617 - RNA, 22 nt, Human
gcuucaaagcugcacagagucu

SEQ ID NO: 49618 - RNA, 22 nt, Human
caccccacucuguacagcugcu

SEQ ID NO: 49619 - RNA, 23 nt, Human
cccaggccacacagaggccggcu

SEQ ID NO: 49620 - RNA, 20 nt, Human
gcugucuuagggaagaaaug

SEQ ID NO: 49621 - RNA, 25 nt, Human
cucaucauccugugcuccguggucu

SEQ ID NO: 49622 - RNA, 23 nt, Human
caccuacugcacuuucccccuuc

SEQ ID NO: 49623 - RNA, 31 nt, Human
auggcugcccugauuccaagugcucuuaucg

SEQ ID NO: 49624 - RNA, 24 nt, Human
cagaggcaauaaaagcugcaguga

SEQ ID NO: 49625 - RNA, 18 nt, Human
cuggggugaggcagcggc

SEQ ID NO: 49626 - RNA, 22 nt, Human
agucuucaguauuaaaaccacu

SEQ ID NO: 49627 - RNA, 23 nt, Human
guuaaauuaugcaaaacaacuga

SEQ ID NO: 49628 - RNA, 19 nt, Human
cacugcggagccugagcgc

SEQ ID NO: 49629 - RNA, 23 nt, Human
cccuaaauucuccuccuccccca

SEQ ID NO: 49630 - RNA, 21 nt, Human
cugacccaagagcaccauaac

SEQ ID NO: 49631 - RNA, 21 nt, Human
accaaaacccaaagaucaaag

SEQ ID NO: 49632 - RNA, 19 nt, Human
ugaguauugagaagccaca

SEQ ID NO: 49633 - RNA, 27 nt, Human
gacuuauaccuuuaauaacaagcaauu

SEQ ID NO: 49634 - RNA, 22 nt, Human
aaaacuccugaccucaagugau

SEQ ID NO: 49635 - RNA, 22 nt, Human
gggagaagaaacaagaaaagua

SEQ ID NO: 49636 - RNA, 22 nt, Human
gcggcuggagacguuugaugca

SEQ ID NO: 49637 - RNA, 20 nt, Human
ggggugaggauaaggggugg

SEQ ID NO: 49638 - RNA, 25 nt, Human
guguguuccuaccuuuucugaaccu

SEQ ID NO: 49639 - RNA, 27 nt, Human
agcuugucacuggaagaucuuaaggua

SEQ ID NO: 49640 - RNA, 25 nt, Human
ccucuccagggcugcucaggcaagg

SEQ ID NO: 49641 - RNA, 22 nt, Human
gaaaccugggcuggagugaggu

SEQ ID NO: 49642 - RNA, 27 nt, Human
ccaggaggccggggggagcaggaggag

SEQ ID NO: 49643 - RNA, 18 nt, Human
uccugcucuuccuggacu

SEQ ID NO: 49644 - RNA, 27 nt, Human
ccuggcuggcccugugauauuucugug

SEQ ID NO: 49645 - RNA, 23 nt, Human
cuuucagaucauuaaugagcaga

SEQ ID NO: 49646 - RNA, 22 nt, Human
ugcauucucauaccugcccaca

SEQ ID NO: 49647 - RNA, 20 nt, Human
gagacuuggaaaugggagac

SEQ ID NO: 49648 - RNA, 21 nt, Human
ugccuuggggucacuaaaggg

SEQ ID NO: 49649 - RNA, 20 nt, Human
acagaagucacucaauuguu

SEQ ID NO: 49650 - RNA, 21 nt, Human
agggacugaaggcggagccca

SEQ ID NO: 49651 - RNA, 19 nt, Human
ccauucuuccucccauuca

SEQ ID NO: 49652 - RNA, 18 nt, Human
cuguccuggaaaaggccu

SEQ ID NO: 49653 - RNA, 27 nt, Human
aaagugcugggauuacaggccugagcc

SEQ ID NO: 49654 - RNA, 27 nt, Human
gucacccagagcacaggagcugccaug

SEQ ID NO: 49655 - RNA, 20 nt, Human
ugccacuggucggcacuuug

SEQ ID NO: 49656 - RNA, 27 nt, Human
uggccaacaugcugaaaccucgucucu

SEQ ID NO: 49657 - RNA, 20 nt, Human
gagcacaaccucuuucccca

SEQ ID NO: 49658 - RNA, 27 nt, Human
uuagaaaauaugaugauuuuugauugc

SEQ ID NO: 49659 - RNA, 24 nt, Human
agugccgggcaggagcauggggug

SEQ ID NO: 49660 - RNA, 26 nt, Human
aacuaugccacagucuggauguguuu

SEQ ID NO: 49661 - RNA, 24 nt, Human
ucugucuucuuuaaucaaaucaca

SEQ ID NO: 49662 - RNA, 22 nt, Human
gcgaucuccacucacugcaggc

SEQ ID NO: 49663 - RNA, 27 nt, Human
aaccccugaugcauuuuccuugagagc

SEQ ID NO: 49664 - RNA, 25 nt, Human
aacuggagacccugucaaauaugac

SEQ ID NO: 49665 - RNA, 20 nt, Human
gugcuggccacaccagcccc

SEQ ID NO: 49666 - RNA, 26 nt, Human
acagccugaaucaaaugguuagcuua

SEQ ID NO: 49667 - RNA, 21 nt, Human
ccuguaaucccagcgcuuugg

SEQ ID NO: 49668 - RNA, 21 nt, Human
ccuguagucccagcacuuugg

SEQ ID NO: 49669 - RNA, 29 nt, Human
ggauuucugaagccuaugaaagguagaaa

SEQ ID NO: 49670 - RNA, 22 nt, Human
ucccuggcaggcagccuugcca

SEQ ID NO: 49671 - RNA, 18 nt, Human
uucgccucaucugaggcc

SEQ ID NO: 49672 - RNA, 27 nt, Human
ucacuggagugcaccugccucuaccuc

SEQ ID NO: 49673 - RNA, 23 nt, Human
acuuagccacgucuggccugugu

SEQ ID NO: 49674 - RNA, 30 nt, Human
ucaggggacagggagagcaagaggucaaga

SEQ ID NO: 49675 - RNA, 24 nt, Human
cuauccuuauucgaguagcacuuu

SEQ ID NO: 49676 - RNA, 20 nt, Human
cacagcccagcaggagggag

SEQ ID NO: 49677 - RNA, 21 nt, Human
gaaagagagaggggggcccag

SEQ ID NO: 49678 - RNA, 23 nt, Human
cccuaggcuuuuccuuguggaca

SEQ ID NO: 49679 - RNA, 23 nt, Human
ccagccccgcucaggccuaggag

SEQ ID NO: 49680 - RNA, 25 nt, Human
gacagcuguccccccguccuccucc

SEQ ID NO: 49681 - RNA, 27 nt, Human
gucugaucaggcugaguuuuguaugua

SEQ ID NO: 49682 - RNA, 27 nt, Human
uucauuucccccugaacaucaaauaug

SEQ ID NO: 49683 - RNA, 25 nt, Human
auuuucaucuucuuccaugguucca

SEQ ID NO: 49684 - RNA, 21 nt, Human
uccuggaggccucauucucau

SEQ ID NO: 49685 - RNA, 20 nt, Human
cugcuuugaaaucugguuga

SEQ ID NO: 49686 - RNA, 23 nt, Human
cacaggacccgcauccuggguga

SEQ ID NO: 49687 - RNA, 29 nt, Human
uucaguggccucaucagcagcucucaaca

SEQ ID NO: 49688 - RNA, 23 nt, Human
cacccaggcuggccgccagcugg

SEQ ID NO: 49689 - RNA, 26 nt, Human
ccaucucuacuaaaaauaccaaaaau

SEQ ID NO: 49690 - RNA, 23 nt, Human
ggccgcacuccagcacugcgcag

SEQ ID NO: 49691 - RNA, 20 nt, Human
gggagagccagcucucucua

SEQ ID NO: 49692 - RNA, 19 nt, Human
aaaccccuucuuuacuucc

SEQ ID NO: 49693 - RNA, 24 nt, Human
uucuccaggauuuuaauuucagga

SEQ ID NO: 49694 - RNA, 22 nt, Human
aagguguuucauuuuggugugc

SEQ ID NO: 49695 - RNA, 22 nt, Human
gcuggaaggcuggcguaggacu

SEQ ID NO: 49696 - RNA, 23 nt, Human
cucugggagaaaaucaucaagaa

SEQ ID NO: 49697 - RNA, 22 nt, Human
accgcaaaguccgccucccagg

SEQ ID NO: 49698 - RNA, 22 nt, Human
gggagacggagguugcagugag

SEQ ID NO: 49699 - RNA, 21 nt, Human
aaucuuucuaacauuccaucu

SEQ ID NO: 49700 - RNA, 22 nt, Human
ucucuucugcuguuuaauucca

SEQ ID NO: 49701 - RNA, 24 nt, Human
uccaguggggcccccauucacguu

SEQ ID NO: 49702 - RNA, 21 nt, Human
uagaagcugaacuuacugcuu

SEQ ID NO: 49703 - RNA, 29 nt, Human
agcucucuccacaaccucuugggcccaag

SEQ ID NO: 49704 - RNA, 18 nt, Human
cuguuuaaucauaguuac

SEQ ID NO: 49705 - RNA, 25 nt, Human
ucuuccagcaaggaacgcaccgaaa

SEQ ID NO: 49706 - RNA, 26 nt, Human
uugcccagggauuaggagcagcucuu

SEQ ID NO: 49707 - RNA, 24 nt, Human
cuggauuuaaucaucccugcccua

SEQ ID NO: 49708 - RNA, 22 nt, Human
cggugguagagagagauaaaag

SEQ ID NO: 49709 - RNA, 23 nt, Human
auggaaagguccugcuguggaaa

SEQ ID NO: 49710 - RNA, 27 nt, Human
ggaggcugagacaggaggauugccuga

SEQ ID NO: 49711 - RNA, 25 nt, Human
agcucacugcaagcuccaacucccg

SEQ ID NO: 49712 - RNA, 21 nt, Human
ccaggagggagaaaagaagau

SEQ ID NO: 49713 - RNA, 24 nt, Human
augucagugagcaccaugcuggag

SEQ ID NO: 49714 - RNA, 21 nt, Human
cuggaagaaaggacagaagua

SEQ ID NO: 49715 - RNA, 24 nt, Human
ggagagggcgggcagcgccgcggc

SEQ ID NO: 49716 - RNA, 24 nt, Human
aggcaaagagaaaaggacccaaga

SEQ ID NO: 49717 - RNA, 23 nt, Human
caagccuguaaucccagcuacuc

SEQ ID NO: 49718 - RNA, 22 nt, Human
ccaguguccuuagaacauuuua

SEQ ID NO: 49719 - RNA, 23 nt, Human
gaaggccuggcuggaagagggug

SEQ ID NO: 49720 - RNA, 27 nt, Human
uugcucaggcuggaguacaguggcaua

SEQ ID NO: 49721 - RNA, 21 nt, Human
ggaacucucacucuugcucaa

SEQ ID NO: 49722 - RNA, 23 nt, Human
accacagccggcuaauuuuuuau

SEQ ID NO: 49723 - RNA, 26 nt, Human
caacuggcccuccugucccucacccc

SEQ ID NO: 49724 - RNA, 21 nt, Human
gcucaguaauuccuguuacuu

SEQ ID NO: 49725 - RNA, 26 nt, Human
cucugccucccguguucaagcgauuc

SEQ ID NO: 49726 - RNA, 23 nt, Human
cauccagcaagaacugcacaaga

SEQ ID NO: 49727 - RNA, 25 nt, Human
gccauuuccacccuccagucauuuc

SEQ ID NO: 49728 - RNA, 30 nt, Human
ccacuggaacucacaaaggucuccuucacc

SEQ ID NO: 49729 - RNA, 20 nt, Human
acuuaugaagacauucuuuc

SEQ ID NO: 49730 - RNA, 21 nt, Human
gccgcauccaccuccuccgcc

SEQ ID NO: 49731 - RNA, 26 nt, Human
cagaccugcauugaacaguccugugg

SEQ ID NO: 49732 - RNA, 22 nt, Human
gagcaacauggggcccacccua

SEQ ID NO: 49733 - RNA, 27 nt, Human
ucuccaccacccauucucccaaugguc

SEQ ID NO: 49734 - RNA, 26 nt, Human
aaauguucacaaccacaaugcaucug

SEQ ID NO: 49735 - RNA, 21 nt, Human
uccagcgcgugccagccuggg

SEQ ID NO: 49736 - RNA, 20 nt, Human
uucauuugaguuaacagugg

SEQ ID NO: 49737 - RNA, 25 nt, Human
cuggggcaggguguuuagaauuuuc

SEQ ID NO: 49738 - RNA, 20 nt, Human
ugcagcccuggggguugcag

SEQ ID NO: 49739 - RNA, 25 nt, Human
gaagagagagacccucacugcuggg

SEQ ID NO: 49740 - RNA, 27 nt, Human
gcugccucuugugccucuggcacagcc

SEQ ID NO: 49741 - RNA, 20 nt, Human
agacuauuccccaccugcuu

SEQ ID NO: 49742 - RNA, 20 nt, Human
ccuguuccugguucccgcuu

SEQ ID NO: 49743 - RNA, 22 nt, Human
uugcaguuauguuaucauucuu

SEQ ID NO: 49744 - RNA, 24 nt, Human
caggaccuguuggcagaguugcca

SEQ ID NO: 49745 - RNA, 25 nt, Human
aacacaaaguguauaaaucugagua

SEQ ID NO: 49746 - RNA, 25 nt, Human
agaaauguuuaguuacugaauugaa

SEQ ID NO: 49747 - RNA, 22 nt, Human
agcuucccaaguagcugggauu

SEQ ID NO: 49748 - RNA, 26 nt, Human
uugggagcucugugccaggcccaccu

SEQ ID NO: 49749 - RNA, 29 nt, Human
gugaacuuguuucaggaagugugagcacg

SEQ ID NO: 49750 - RNA, 27 nt, Human
augucggcagcugugccucuacugccc

SEQ ID NO: 49751 - RNA, 25 nt, Human
gaaagagaacgggccaagacuggga

SEQ ID NO: 49752 - RNA, 24 nt, Human
uugcaguauuaccaaugcuguugu

SEQ ID NO: 49753 - RNA, 19 nt, Human
cggaggaaaggcaguccug

SEQ ID NO: 49754 - RNA, 22 nt, Human
gccccuggccccgccugccugc

SEQ ID NO: 49755 - RNA, 26 nt, Human
caccuugcaguggccuuuccuuguca

SEQ ID NO: 49756 - RNA, 21 nt, Human
ugccuccuguggucucaggcu

SEQ ID NO: 49757 - RNA, 17 nt, Human
uucuaugccugucuuaa

SEQ ID NO: 49758 - RNA, 21 nt, Human
gaggcugaggugggcagauca

SEQ ID NO: 49759 - RNA, 28 nt, Human
guuuuaaaucuucugucucccugcuuuu

SEQ ID NO: 49760 - RNA, 26 nt, Human
ucucagucuucagcucuauuuaucuu

SEQ ID NO: 49761 - RNA, 22 nt, Human
uugccuucuuggacuucuugaa

SEQ ID NO: 49762 - RNA, 19 nt, Human
auuguuguuccagagaauu

SEQ ID NO: 49763 - RNA, 24 nt, Human
aauagaaacauugaagaugaacau

SEQ ID NO: 49764 - RNA, 27 nt, Human
ccagguggccagggggcagggugggaa

SEQ ID NO: 49765 - RNA, 21 nt, Human
agccgggcuccaacagccucu

SEQ ID NO: 49766 - RNA, 27 nt, Human
ccacaaacaagaggagcaccagaccuc

SEQ ID NO: 49767 - RNA, 25 nt, Human
cuucccgggcccugccagacccugc

SEQ ID NO: 49768 - RNA, 21 nt, Human
gaaguagcucuggcugugaug

SEQ ID NO: 49769 - RNA, 23 nt, Human
ccuccuccucuugcuccuccagc

SEQ ID NO: 49770 - RNA, 27 nt, Human
gcacaccaaauuuggcaaaacagcccu

SEQ ID NO: 49771 - RNA, 21 nt, Human
cccauaauccugcauuucucu

SEQ ID NO: 49772 - RNA, 27 nt, Human
cggaaggcggcagaggcugggaggcgg

SEQ ID NO: 49773 - RNA, 23 nt, Human
uuaccaauuucugucaacuacca

SEQ ID NO: 49774 - RNA, 22 nt, Human
uuuaaaaaacuucguuguuuuu

SEQ ID NO: 49775 - RNA, 22 nt, Human
uggaagaggaagaugccuagca

SEQ ID NO: 49776 - RNA, 21 nt, Human
cuggaggccuccugaggccag

SEQ ID NO: 49777 - RNA, 23 nt, Human
uguuacagcaggacacucuggac

SEQ ID NO: 49778 - RNA, 21 nt, Human
aguagcugcuggauguugacg

SEQ ID NO: 49779 - RNA, 26 nt, Human
cuguguauuuaauuguaaacuguacu

SEQ ID NO: 49780 - RNA, 22 nt, Human
ggucucauuccuuucuguuccc

SEQ ID NO: 49781 - RNA, 20 nt, Human
gguccuugccugaacuccag

SEQ ID NO: 49782 - RNA, 26 nt, Human
uuccccucugcucuggccugugugcc

SEQ ID NO: 49783 - RNA, 26 nt, Human
cuccacacagugcucaaggccagcuu

SEQ ID NO: 49784 - RNA, 24 nt, Human
ucuuacuaggaggagauggagugu

SEQ ID NO: 49785 - RNA, 27 nt, Human
ugggcugcguucacccucacaccacac

SEQ ID NO: 49786 - RNA, 22 nt, Human
aucuggagaggcucacuggggu

SEQ ID NO: 49787 - RNA, 27 nt, Human
ccaacagcccaggcuguugauaccuca

SEQ ID NO: 49788 - RNA, 20 nt, Human
caggcuggaguacagugaca

SEQ ID NO: 49789 - RNA, 22 nt, Human
gggauuacaggugcaugccacc

SEQ ID NO: 49790 - RNA, 27 nt, Human
auucaggacuagaagccccucugggca

SEQ ID NO: 49791 - RNA, 21 nt, Human
cugggcuugggaauuggcugg

SEQ ID NO: 49792 - RNA, 19 nt, Human
aucagauccugggcacauu

SEQ ID NO: 49793 - RNA, 19 nt, Human
uccucuugaagaugcugaa

SEQ ID NO: 49794 - RNA, 22 nt, Human
gaccacuuuuuagaaagauaau

SEQ ID NO: 49795 - RNA, 23 nt, Human
uucuagaauuaugagaccaccuu

SEQ ID NO: 49796 - RNA, 27 nt, Human
ugcagugaaccaugauugcacuccaac

SEQ ID NO: 49797 - RNA, 17 nt, Human
cuggcuccccuccuggg

SEQ ID NO: 49798 - RNA, 24 nt, Human
gccuguauucccagcuacucauga

SEQ ID NO: 49799 - RNA, 22 nt, Human
gcgugagccaccaugcccggcc

SEQ ID NO: 49800 - RNA, 22 nt, Human
gugugagccaccaugccuggcc

SEQ ID NO: 49801 - RNA, 21 nt, Human
cucccacacggacaccuucug

SEQ ID NO: 49802 - RNA, 23 nt, Human
aaaaucaagggaugacccuccuc

SEQ ID NO: 49803 - RNA, 25 nt, Human
cuuguccuccccuggccuccagucu

SEQ ID NO: 49804 - RNA, 27 nt, Human
ccacagcaccugcuaaguuuguauuua

SEQ ID NO: 49805 - RNA, 26 nt, Human
cacguccuuaacugugcucucccucc

SEQ ID NO: 49806 - RNA, 21 nt, Human
ugugagcccagaugaagacug

SEQ ID NO: 49807 - RNA, 22 nt, Human
ggcagcagugggaacgacucau

SEQ ID NO: 49808 - RNA, 21 nt, Human
uccuguaaucccagcacuuug

SEQ ID NO: 49809 - RNA, 21 nt, Human
agcccccgugggccaggggaa

SEQ ID NO: 49810 - RNA, 26 nt, Human
aaaaugcaagaaaacagcauggccag

SEQ ID NO: 49811 - RNA, 23 nt, Human
uagggcuuuuugcagcuuuuuga

SEQ ID NO: 49812 - RNA, 27 nt, Human
uggaaggcagguugcgagaaggagagg

SEQ ID NO: 49813 - RNA, 27 nt, Human
ggaggcugaggugggaggguugcuuga

SEQ ID NO: 49814 - RNA, 27 nt, Human
uaggagguggagguugcauucaacuga

SEQ ID NO: 49815 - RNA, 20 nt, Human
caucuaagaccaucucucca

SEQ ID NO: 49816 - RNA, 22 nt, Human
gccaaggcuggagugcaguggc

SEQ ID NO: 49817 - RNA, 22 nt, Human
guggccuuuagcgucauggagc

SEQ ID NO: 49818 - RNA, 32 nt, Human
ucucccaccauuaugagaacuucuagccccug

SEQ ID NO: 49819 - RNA, 30 nt, Human
ggacucuggcauugucaccuccuccagaaa

SEQ ID NO: 49820 - RNA, 28 nt, Human
cgcuaagcccuggcggcggcgccguggc

SEQ ID NO: 49821 - RNA, 26 nt, Human
uuuucugcuucuggaaggugcuggac

SEQ ID NO: 49822 - RNA, 22 nt, Human
cgggagcagaggaggcgaggga

SEQ ID NO: 49823 - RNA, 19 nt, Human
uggaagggaaauggcucug

SEQ ID NO: 49824 - RNA, 25 nt, Human
gcagggauucccccucgucuuggcc

SEQ ID NO: 49825 - RNA, 21 nt, Human
acucagcacaucuuagcuuua

SEQ ID NO: 49826 - RNA, 24 nt, Human
cuccaccccugcagccuccuggcc

SEQ ID NO: 49827 - RNA, 20 nt, Human
cuucccuuccgcacuuacca

SEQ ID NO: 49828 - RNA, 24 nt, Human
aaaaagaguuuucuuuaguauagc

SEQ ID NO: 49829 - RNA, 22 nt, Human
gaccagccugaccaacguggug

SEQ ID NO: 49830 - RNA, 28 nt, Human
acucaagccuuuuuauucuuugugauua

SEQ ID NO: 49831 - RNA, 23 nt, Human
acucauagcacauuucuuguguu

SEQ ID NO: 49832 - RNA, 26 nt, Human
ucauucucuaauauccacuuguccau

SEQ ID NO: 49833 - RNA, 27 nt, Human
gggccgccaagcaggucaggggcuggg

SEQ ID NO: 49834 - RNA, 19 nt, Human
uaacauccugcuccauucc

SEQ ID NO: 49835 - RNA, 20 nt, Human
gccaccgcgugcuccugggc

SEQ ID NO: 49836 - RNA, 20 nt, Human
gcgcccagggaggagucagu

SEQ ID NO: 49837 - RNA, 23 nt, Human
uccuguugcugucuucagucuca

SEQ ID NO: 49838 - RNA, 25 nt, Human
gccgggggccugcaucaccaccuca

SEQ ID NO: 49839 - RNA, 23 nt, Human
ucgucuuuccuccuuagaagaac

SEQ ID NO: 49840 - RNA, 26 nt, Human
uguggaauuugugcuuauuucccauc

SEQ ID NO: 49841 - RNA, 22 nt, Human
ucagcauuuggaccaauagccc

SEQ ID NO: 49842 - RNA, 23 nt, Human
ggcugggcagaggcacagggcag

SEQ ID NO: 49843 - RNA, 23 nt, Human
ugugcgcgugcuuucucagcagc

SEQ ID NO: 49844 - RNA, 26 nt, Human
uuuuuagcuuguuuuaccuacaucua

SEQ ID NO: 49845 - RNA, 22 nt, Human
caccacacccuccugaucacca

SEQ ID NO: 49846 - RNA, 22 nt, Human
ggaacuccugagcucaagcagu

SEQ ID NO: 49847 - RNA, 20 nt, Human
aguguagagcaagccagugu

SEQ ID NO: 49848 - RNA, 21 nt, Human
aggggucuguagugucacuca

SEQ ID NO: 49849 - RNA, 20 nt, Human
agggagggguggcagaggau

SEQ ID NO: 49850 - RNA, 23 nt, Human
ggugagccagggucugaguuuca

SEQ ID NO: 49851 - RNA, 21 nt, Human
cagcaacuuugagagcagugg

SEQ ID NO: 49852 - RNA, 20 nt, Human
cugacucccuuaucucuuca

SEQ ID NO: 49853 - RNA, 29 nt, Human
cuaggugucuuuaaaaaauuaaggugaca

SEQ ID NO: 49854 - RNA, 22 nt, Human
agcucaggaaaagccugcugaa

SEQ ID NO: 49855 - RNA, 20 nt, Human
caucucauccacagcucuuc

SEQ ID NO: 49856 - RNA, 31 nt, Human
agccuaggugacagaaugagacucuaucuca

SEQ ID NO: 49857 - RNA, 25 nt, Human
cccuccucugacacagggcuggccc

SEQ ID NO: 49858 - RNA, 22 nt, Human
gaacuccuggagauaagcugua

SEQ ID NO: 49859 - RNA, 17 nt, Human
ugucccuuaccuggcuu

SEQ ID NO: 49860 - RNA, 20 nt, Human
uacccaggcuggagugcaau

SEQ ID NO: 49861 - RNA, 24 nt, Human
gggaggcagcagacagggagccac

SEQ ID NO: 49862 - RNA, 29 nt, Human
ugacuuccccagcaaggaucuucccacuu

SEQ ID NO: 49863 - RNA, 20 nt, Human
guugcuacuuuuauuuugga

SEQ ID NO: 49864 - RNA, 25 nt, Human
auuaccuugaagagugcauucgggg

SEQ ID NO: 49865 - RNA, 23 nt, Human
cccuggugucuuucuccugggcu

SEQ ID NO: 49866 - RNA, 22 nt, Human
aggcuggagugcaguggcucga

SEQ ID NO: 49867 - RNA, 23 nt, Human
gcuuaaacaggagugaacucccu

SEQ ID NO: 49868 - RNA, 20 nt, Human
cucagcccucuccugcaucc

SEQ ID NO: 49869 - RNA, 25 nt, Human
ugccucucuagguagcugcuggcgg

SEQ ID NO: 49870 - RNA, 26 nt, Human
cacuguacuccagccugggugacaga

SEQ ID NO: 49871 - RNA, 23 nt, Human
accuauuaucauggacacacugg

SEQ ID NO: 49872 - RNA, 22 nt, Human
uauaagugucccauggggcaga

SEQ ID NO: 49873 - RNA, 28 nt, Human
ggcaaggaauuuucaccuccagccccca

SEQ ID NO: 49874 - RNA, 26 nt, Human
uggaaaacauuucaaguuuacuccuu

SEQ ID NO: 49875 - RNA, 31 nt, Human
cuccaguccugucucaucuccugggagaggc

SEQ ID NO: 49876 - RNA, 23 nt, Human
cagguuaauuaauuuucuucucc

SEQ ID NO: 49877 - RNA, 23 nt, Human
cagcccuggccaagcuuugaggc

SEQ ID NO: 49878 - RNA, 19 nt, Human
cuuccuggccuacucccaa

SEQ ID NO: 49879 - RNA, 25 nt, Human
gccucagccuccuggguagcuggga

SEQ ID NO: 49880 - RNA, 25 nt, Human
ccugcaauuucccaccuccugccca

SEQ ID NO: 49881 - RNA, 23 nt, Human
ugaaggggaagaagcugaccuuc

SEQ ID NO: 49882 - RNA, 24 nt, Human
acaucuuugaagcuggggccccug

SEQ ID NO: 49883 - RNA, 27 nt, Human
ucaugccacuugagcagaggagucagc

SEQ ID NO: 49884 - RNA, 23 nt, Human
uccuccucucugagggacuggag

SEQ ID NO: 49885 - RNA, 22 nt, Human
cuggauguguuuacguggagag

SEQ ID NO: 49886 - RNA, 30 nt, Human
ccuguuucugucuguuuugugcuguaccuu

SEQ ID NO: 49887 - RNA, 21 nt, Human
ugaaccaaggauuguaguuua

SEQ ID NO: 49888 - RNA, 21 nt, Human
uccggcuccagccuccaaucc

SEQ ID NO: 49889 - RNA, 20 nt, Human
gaccugcuuagcugccuuga

SEQ ID NO: 49890 - RNA, 31 nt, Human
cucucauccauuccucuuacuggggccuggg

SEQ ID NO: 49891 - RNA, 23 nt, Human
uaacaguguugaauucaacugaa

SEQ ID NO: 49892 - RNA, 22 nt, Human
caagauggagcauugauggggg

SEQ ID NO: 49893 - RNA, 26 nt, Human
uuacagaaaaaguuuucuaaccccug

SEQ ID NO: 49894 - RNA, 25 nt, Human
aacuguauuuugcauuuugucuacu

SEQ ID NO: 49895 - RNA, 24 nt, Human
cuggaggccagggagcaguggcug

SEQ ID NO: 49896 - RNA, 22 nt, Human
ccauugcauuccagccugggag

SEQ ID NO: 49897 - RNA, 21 nt, Human
gccuuuccuguuguacucuga

SEQ ID NO: 49898 - RNA, 20 nt, Human
ucccggagaaggaaaaagaa

SEQ ID NO: 49899 - RNA, 23 nt, Human
gacuauguaaaccacauuguacu

SEQ ID NO: 49900 - RNA, 20 nt, Human
agcuggugugguugcaguga

SEQ ID NO: 49901 - RNA, 23 nt, Human
gggcugcaggagcaggugcagug

SEQ ID NO: 49902 - RNA, 19 nt, Human
caguguuuuauugcuuuau

SEQ ID NO: 49903 - RNA, 20 nt, Human
ucuugggagugcugcagucu

SEQ ID NO: 49904 - RNA, 26 nt, Human
ggagggagggagcgagcaggcgaagc

SEQ ID NO: 49905 - RNA, 22 nt, Human
uaucugaauuugcugucuugaa

SEQ ID NO: 49906 - RNA, 26 nt, Human
auuaauuaacaugucuaggaguggga

SEQ ID NO: 49907 - RNA, 22 nt, Human
ucaaauaaguuucaaggagacu

SEQ ID NO: 49908 - RNA, 21 nt, Human
acccaacaugccaccauguug

SEQ ID NO: 49909 - RNA, 22 nt, Human
gggcuguugggacuuucuugaa

SEQ ID NO: 49910 - RNA, 22 nt, Human
ggaacuccugaccucaggugau

SEQ ID NO: 49911 - RNA, 22 nt, Human
gaagggcagucuucucuggcuu

SEQ ID NO: 49912 - RNA, 23 nt, Human
uacaggcuucagcagagugugag

SEQ ID NO: 49913 - RNA, 20 nt, Human
accaguaccugaaguaggcu

SEQ ID NO: 49914 - RNA, 22 nt, Human
uuuucuuuacgagagggucuca

SEQ ID NO: 49915 - RNA, 24 nt, Human
cucugugcaaauuuaaaacaaaua

SEQ ID NO: 49916 - RNA, 29 nt, Human
ugagaucuuuuugcuaagcuggcagaaag

SEQ ID NO: 49917 - RNA, 27 nt, Human
uuuuuacuucucuccauauuccugacc

SEQ ID NO: 49918 - RNA, 22 nt, Human
gaauuccuuggagccacuggga

SEQ ID NO: 49919 - RNA, 20 nt, Human
cugugguagagcuugcauug

SEQ ID NO: 49920 - RNA, 22 nt, Human
cugucaccaucaccugcugcua

SEQ ID NO: 49921 - RNA, 22 nt, Human
ugaaacccuaucucuacuaaaa

SEQ ID NO: 49922 - RNA, 18 nt, Human
ucaccucuuuucucagcu

SEQ ID NO: 49923 - RNA, 29 nt, Human
uuccuaagccuugggacagcugggaacuu

SEQ ID NO: 49924 - RNA, 22 nt, Human
ucuaaacagagaugagguggua

SEQ ID NO: 49925 - RNA, 21 nt, Human
ggcugcagacuggagcugcgc

SEQ ID NO: 49926 - RNA, 21 nt, Human
cacacuucuagauucuuccca

SEQ ID NO: 49927 - RNA, 27 nt, Human
gaguagcugggauuacaggcacgcacc

SEQ ID NO: 49928 - RNA, 26 nt, Human
ugcaauuauuuucuguacuuuuuugu

SEQ ID NO: 49929 - RNA, 20 nt, Human
cuguuguucagaaguuguua

SEQ ID NO: 49930 - RNA, 29 nt, Human
cccggcccaccuggugugacuucuuuaag

SEQ ID NO: 49931 - RNA, 24 nt, Human
uuguugauguuugugaagcaaaac

SEQ ID NO: 49932 - RNA, 22 nt, Human
ugcccaggguggagugcagugg

SEQ ID NO: 49933 - RNA, 22 nt, Human
ugcccaggcuggaguggagugg

SEQ ID NO: 49934 - RNA, 26 nt, Human
gggaagggaggucuccucuagacuga

SEQ ID NO: 49935 - RNA, 22 nt, Human
ggcaugguggugggugccugua

SEQ ID NO: 49936 - RNA, 26 nt, Human
cuucccagccucuccggcgcgcucca

SEQ ID NO: 49937 - RNA, 26 nt, Human
ggccuuucauauuuuagcuacuauau

SEQ ID NO: 49938 - RNA, 21 nt, Human
cccagcacuuggagaggcuga

SEQ ID NO: 49939 - RNA, 30 nt, Human
uuguuguuuguaaaugccucuuaaauuaua

SEQ ID NO: 49940 - RNA, 21 nt, Human
acugacauccuucaugacguu

SEQ ID NO: 49941 - RNA, 20 nt, Human
uuccagggauuuuugagucc

SEQ ID NO: 49942 - RNA, 22 nt, Human
uguauuuuuaugagauuuuaac

SEQ ID NO: 49943 - RNA, 20 nt, Human
guuuuuaagaggaaaaagaa

SEQ ID NO: 49944 - RNA, 27 nt, Human
ggcugccccauuuauccaccuccaucu

SEQ ID NO: 49945 - RNA, 22 nt, Human
gagcucgcugaugcccaccuca

SEQ ID NO: 49946 - RNA, 21 nt, Human
ucugcuuccaacaggcaccuc

SEQ ID NO: 49947 - RNA, 25 nt, Human
cucuggcaaauucuucacugagucu

SEQ ID NO: 49948 - RNA, 24 nt, Human
gcucgcccaggauggagaggcggg

SEQ ID NO: 49949 - RNA, 26 nt, Human
gggaggggcgaaauggaggaggguac

SEQ ID NO: 49950 - RNA, 22 nt, Human
augaagacaucuaagaucccua

SEQ ID NO: 49951 - RNA, 25 nt, Human
gaauuaaaagccacugacuguuaua

SEQ ID NO: 49952 - RNA, 25 nt, Human
cggggccgcggguggaggucgggga

SEQ ID NO: 49953 - RNA, 19 nt, Human
gggguucucccugccacag

SEQ ID NO: 49954 - RNA, 22 nt, Human
uaccaucccauagcuccugcca

SEQ ID NO: 49955 - RNA, 20 nt, Human
caggagaaaaggcaguuaug

SEQ ID NO: 49956 - RNA, 20 nt, Human
gccaggaugugcaugcaucu

SEQ ID NO: 49957 - RNA, 20 nt, Human
ggaauucugguuacagccca

SEQ ID NO: 49958 - RNA, 21 nt, Human
uggggaggggucagcucuggc

SEQ ID NO: 49959 - RNA, 27 nt, Human
gucauggccucaguggcucauggggaa

SEQ ID NO: 49960 - RNA, 20 nt, Human
uacaaccuugaaucacuuga

SEQ ID NO: 49961 - RNA, 22 nt, Human
agaugggauugccacucaccca

SEQ ID NO: 49962 - RNA, 22 nt, Human
ggggcagccaacccuggcucau

SEQ ID NO: 49963 - RNA, 21 nt, Human
uguuggucaggcuggucucga

SEQ ID NO: 49964 - RNA, 21 nt, Human
uugaauaccaacaagguugca

SEQ ID NO: 49965 - RNA, 24 nt, Human
cucuccucuucaaauaaacauguc

SEQ ID NO: 49966 - RNA, 27 nt, Human
ggcuguggcuggcuguggagcuagagc

SEQ ID NO: 49967 - RNA, 25 nt, Human
guuucccucuuaggugcauuuaucu

SEQ ID NO: 49968 - RNA, 21 nt, Human
aacuuuuguguauucucagcu

SEQ ID NO: 49969 - RNA, 27 nt, Human
gcaaaccugccgcagguggccaccccg

SEQ ID NO: 49970 - RNA, 32 nt, Human
ugcccauggacaggcuggcuccagaugcaggg

SEQ ID NO: 49971 - RNA, 28 nt, Human
gagcagccuuuaucaagagacuccugaa

SEQ ID NO: 49972 - RNA, 21 nt, Human
cagagcuccccccagacugga

SEQ ID NO: 49973 - RNA, 19 nt, Human
gaaccugaaacucuuccac

SEQ ID NO: 49974 - RNA, 22 nt, Human
accacgccuggcuaaauuuugu

SEQ ID NO: 49975 - RNA, 24 nt, Human
guccuugggucagugggacauggg

SEQ ID NO: 49976 - RNA, 25 nt, Human
gcugggcugcuucuuuggcccagcu

SEQ ID NO: 49977 - RNA, 21 nt, Human
aggcccagccccagagcccag

SEQ ID NO: 49978 - RNA, 21 nt, Human
ccuaucuccauguucacaucc

SEQ ID NO: 49979 - RNA, 26 nt, Human
cugcagcugauccaauacaccaagcc

SEQ ID NO: 49980 - RNA, 22 nt, Human
ucuguuucucuuuucucuuaac

SEQ ID NO: 49981 - RNA, 30 nt, Human
gcuauggugcuugcuggugccugccaccuu

SEQ ID NO: 49982 - RNA, 22 nt, Human
gggaggcggagguugcggucag

SEQ ID NO: 49983 - RNA, 23 nt, Human
cagcccagauguucaguucucuu

SEQ ID NO: 49984 - RNA, 27 nt, Human
cugugugacccugggcaguuccuuacc

SEQ ID NO: 49985 - RNA, 25 nt, Human
ggaggagcaacucaaauccccaaga

SEQ ID NO: 49986 - RNA, 22 nt, Human
cuacagguuuggguacaagugg

SEQ ID NO: 49987 - RNA, 26 nt, Human
gggaccccccuugcccaugccuccag

SEQ ID NO: 49988 - RNA, 28 nt, Human
cugcugaaaugcugccucuugccuuuuu

SEQ ID NO: 49989 - RNA, 20 nt, Human
agaaauacacagggagggga

SEQ ID NO: 49990 - RNA, 21 nt, Human
gccuguaaucccagcaguuug

SEQ ID NO: 49991 - RNA, 27 nt, Human
ugagaccacggcugguuuuuggcagga

SEQ ID NO: 49992 - RNA, 24 nt, Human
gguuccccuuccucccucccuuca

SEQ ID NO: 49993 - RNA, 21 nt, Human
cgcagucaggcugggcucugu

SEQ ID NO: 49994 - RNA, 22 nt, Human
uauuuauuuguuuuaacuuuuc

SEQ ID NO: 49995 - RNA, 23 nt, Human
ugcucccucuuccucuagcugag

SEQ ID NO: 49996 - RNA, 24 nt, Human
ccuccagguacagccacagccagg

SEQ ID NO: 49997 - RNA, 21 nt, Human
cggccuaugccccaccugccc

SEQ ID NO: 49998 - RNA, 27 nt, Human
cacugccuccuggguucaggugauucu

SEQ ID NO: 49999 - RNA, 22 nt, Human
uguucacugcaaccucugccuu

SEQ ID NO: 50000 - RNA, 21 nt, Human
cccggccaccacccaugcccu

SEQ ID NO: 50001 - RNA, 22 nt, Human
aggcccuaggguugagcaauuu

SEQ ID NO: 50002 - RNA, 21 nt, Human
caguguuauuuaaacauuuuc

SEQ ID NO: 50003 - RNA, 26 nt, Human
uagggagggggaaugcaagggguccc

SEQ ID NO: 50004 - RNA, 21 nt, Human
gcugccucucaaucccugucc

SEQ ID NO: 50005 - RNA, 21 nt, Human
cacuuguaaagauuacuccaa

SEQ ID NO: 50006 - RNA, 23 nt, Human
aaggaaacagugcaacagcacug

SEQ ID NO: 50007 - RNA, 22 nt, Human
agccucccgauuagcugggauc

SEQ ID NO: 50008 - RNA, 26 nt, Human
uccagagacaggaaagaauuugccuu

SEQ ID NO: 50009 - RNA, 26 nt, Human
gcccaggcucggugaggaggcaaggu

SEQ ID NO: 50010 - RNA, 27 nt, Human
aacagcauuacuguucuuauuugcugc

SEQ ID NO: 50011 - RNA, 22 nt, Human
ucuugccuuauaccucagucua

SEQ ID NO: 50012 - RNA, 19 nt, Human
uguuuuauaaaugucugac

SEQ ID NO: 50013 - RNA, 27 nt, Human
ugggacgggcucucccucacagccucc

SEQ ID NO: 50014 - RNA, 21 nt, Human
aaagaaaauauugaaaggaaa

SEQ ID NO: 50015 - RNA, 17 nt, Human
ggaacuuggaguggaga

SEQ ID NO: 50016 - RNA, 25 nt, Human
agcaguugccugugaauguaagagg

SEQ ID NO: 50017 - RNA, 21 nt, Human
ccagaugaucaacucuucgaa

SEQ ID NO: 50018 - RNA, 22 nt, Human
ucaaagcuaaauuccacacuac

SEQ ID NO: 50019 - RNA, 22 nt, Human
agaagggaccuggcuggaaagc

SEQ ID NO: 50020 - RNA, 26 nt, Human
aguccaggaauuugagaccagccugg

SEQ ID NO: 50021 - RNA, 23 nt, Human
cucuggagcaguucauuuuacag

SEQ ID NO: 50022 - RNA, 22 nt, Human
uguuaauuuauuucauaguuga

SEQ ID NO: 50023 - RNA, 18 nt, Human
gggcagcagaggcagaga

SEQ ID NO: 50024 - RNA, 19 nt, Human
uuccaaagaacuuaccucu

SEQ ID NO: 50025 - RNA, 20 nt, Human
guucagacuggggccaggga

SEQ ID NO: 50026 - RNA, 23 nt, Human
ggagagcucaagugcagcaaaga

SEQ ID NO: 50027 - RNA, 23 nt, Human
gugccucacaccuuguucucuuc

SEQ ID NO: 50028 - RNA, 20 nt, Human
agccucuccagcucucuugu

SEQ ID NO: 50029 - RNA, 22 nt, Human
auggaaaugggaagagcaacag

SEQ ID NO: 50030 - RNA, 24 nt, Human
gcaccuugcacuagaggcuucuga

SEQ ID NO: 50031 - RNA, 27 nt, Human
uucaguauuuucuuaagaaauugcuuu

SEQ ID NO: 50032 - RNA, 21 nt, Human
ggccccugugugccucaggga

SEQ ID NO: 50033 - RNA, 22 nt, Human
acccugaucagucuaagauggg

SEQ ID NO: 50034 - RNA, 23 nt, Human
ugugcauuuuauugacugggcaa

SEQ ID NO: 50035 - RNA, 23 nt, Human
ugggggcagaggcccaucuggcc

SEQ ID NO: 50036 - RNA, 21 nt, Human
gagagccgggaggcagaggga

SEQ ID NO: 50037 - RNA, 23 nt, Human
acagauuuuaaaaauugauauga

SEQ ID NO: 50038 - RNA, 24 nt, Human
cccagcuacauuccucagcugcca

SEQ ID NO: 50039 - RNA, 27 nt, Human
ccucgccugcugccucugcccauccug

SEQ ID NO: 50040 - RNA, 20 nt, Human
agcggcuguaucucggcaug

SEQ ID NO: 50041 - RNA, 23 nt, Human
agggcagcuguggcuucuagcug

SEQ ID NO: 50042 - RNA, 26 nt, Human
gaguccaugauggaggcagagguaaa

SEQ ID NO: 50043 - RNA, 27 nt, Human
gcucugucgcccaggcuggagugcaau

SEQ ID NO: 50044 - RNA, 26 nt, Human
caccuugccagcaggcucugugcucc

SEQ ID NO: 50045 - RNA, 22 nt, Human
augcccaaggaaagaugcuaaa

SEQ ID NO: 50046 - RNA, 20 nt, Human
cuguccugggaccaggcugg

SEQ ID NO: 50047 - RNA, 20 nt, Human
gaccauaaccacugaaggga

SEQ ID NO: 50048 - RNA, 20 nt, Human
acuuccccacugcucucugu

SEQ ID NO: 50049 - RNA, 26 nt, Human
gcaaaaauacuccauuucaaguuaaa

SEQ ID NO: 50050 - RNA, 16 nt, Human
ucccuguuagcauucc

SEQ ID NO: 50051 - RNA, 23 nt, Human
uuagaaaauauaguuugaggccg

SEQ ID NO: 50052 - RNA, 31 nt, Human
gggucaaaaagagaauaauuuggccuauaau

SEQ ID NO: 50053 - RNA, 24 nt, Human
gggauaccugccugucaccucagg

SEQ ID NO: 50054 - RNA, 21 nt, Human
uuguuucagcauguaauuuua

SEQ ID NO: 50055 - RNA, 19 nt, Human
ccuuucuguagccuaaaac

SEQ ID NO: 50056 - RNA, 22 nt, Human
gcuggaugccgccaugcccacc

SEQ ID NO: 50057 - RNA, 23 nt, Human
auauuuuuaauaaauguuucccu

SEQ ID NO: 50058 - RNA, 22 nt, Human
gaugaaaaggggccacugaaaa

SEQ ID NO: 50059 - RNA, 20 nt, Human
auagaugccucacaauucag

SEQ ID NO: 50060 - RNA, 25 nt, Human
ugucaucacuugguccaugaaauau

SEQ ID NO: 50061 - RNA, 19 nt, Human
gaaagagagcaccacguga

SEQ ID NO: 50062 - RNA, 23 nt, Human
agaccuacuguucuaaagcucug

SEQ ID NO: 50063 - RNA, 20 nt, Human
agaggaaaacaggaaccuga

SEQ ID NO: 50064 - RNA, 24 nt, Human
ggaagauguuuuaagaagcauuuu

SEQ ID NO: 50065 - RNA, 21 nt, Human
cucagcuuuagcaggacauga

SEQ ID NO: 50066 - RNA, 25 nt, Human
uacaggcaugagccaccacgcccag

SEQ ID NO: 50067 - RNA, 24 nt, Human
gucuccaggagacucagggccugc

SEQ ID NO: 50068 - RNA, 21 nt, Human
agaauaauaugacucauuuca

SEQ ID NO: 50069 - RNA, 20 nt, Human
gcauguccagaagcauuucc

SEQ ID NO: 50070 - RNA, 20 nt, Human
gacuaccugaugugcaguuu

SEQ ID NO: 50071 - RNA, 25 nt, Human
gcacuguggagaccacacacccuuu

SEQ ID NO: 50072 - RNA, 26 nt, Human
ucuuccuauguucuuaggucuaugag

SEQ ID NO: 50073 - RNA, 20 nt, Human
uugguggaaaguagggugga

SEQ ID NO: 50074 - RNA, 29 nt, Human
cagcgugggccagaggcagcucgugugcc

SEQ ID NO: 50075 - RNA, 22 nt, Human
agaguaguuauuaguucugcuu

SEQ ID NO: 50076 - RNA, 23 nt, Human
ugucacccaggcuagagugcagu

SEQ ID NO: 50077 - RNA, 23 nt, Human
ugucacccaggcuggagugcaau

SEQ ID NO: 50078 - RNA, 23 nt, Human
ugucucccaggcuggagugcuau

SEQ ID NO: 50079 - RNA, 26 nt, Human
ggcugaggacaaauaccugcugucac

SEQ ID NO: 50080 - RNA, 20 nt, Human
uacaggaccugcagcuuugu

SEQ ID NO: 50081 - RNA, 26 nt, Human
aaguugaguguggaaggaucuuggca

SEQ ID NO: 50082 - RNA, 25 nt, Human
agucuccucaguauccaggauucaa

SEQ ID NO: 50083 - RNA, 22 nt, Human
cgggguuucacucugucaccca

SEQ ID NO: 50084 - RNA, 22 nt, Human
guuauaccagcaaaagugcagu

SEQ ID NO: 50085 - RNA, 22 nt, Human
agaccagagccuuccugucacc

SEQ ID NO: 50086 - RNA, 22 nt, Human
agcagacugaggggcagaggca

SEQ ID NO: 50087 - RNA, 21 nt, Human
cuguuacccagcuccuggagg

SEQ ID NO: 50088 - RNA, 19 nt, Human
uuucaguuacuuaccugca

SEQ ID NO: 50089 - RNA, 21 nt, Human
gacuucucauccuuuuuggga

SEQ ID NO: 50090 - RNA, 27 nt, Human
gucacccaggcuggagugcaaugacgc

SEQ ID NO: 50091 - RNA, 27 nt, Human
uugagcccaggcgguugaggcugcagu

SEQ ID NO: 50092 - RNA, 19 nt, Human
ucauaagacuuaauuugua

SEQ ID NO: 50093 - RNA, 23 nt, Human
auuucagguauccaaggcagcag

SEQ ID NO: 50094 - RNA, 20 nt, Human
uccuaaccuaguaaaauguc

SEQ ID NO: 50095 - RNA, 22 nt, Human
caccugcgcuguggacacugag

SEQ ID NO: 50096 - RNA, 21 nt, Human
gaccacacccaccccguucgg

SEQ ID NO: 50097 - RNA, 21 nt, Human
cuggcgcaucauaugcaguga

SEQ ID NO: 50098 - RNA, 27 nt, Human
cacuccuacuccaguaucagcuggcac

SEQ ID NO: 50099 - RNA, 24 nt, Human
cccgauucacguuuuucuggacca

SEQ ID NO: 50100 - RNA, 24 nt, Human
gcuuucacucugcuggcuucuccc

SEQ ID NO: 50101 - RNA, 20 nt, Human
ugcuucucagacagugccuu

SEQ ID NO: 50102 - RNA, 24 nt, Human
ucugugcagugcccaugagcugcu

SEQ ID NO: 50103 - RNA, 20 nt, Human
caugcugugccaauggcugg

SEQ ID NO: 50104 - RNA, 22 nt, Human
ugcggugagccaagaucgcgcc

SEQ ID NO: 50105 - RNA, 22 nt, Human
ugcagugagcugagaucgugcc

SEQ ID NO: 50106 - RNA, 22 nt, Human
ugcagugagccgagaucgcgcc

SEQ ID NO: 50107 - RNA, 22 nt, Human
ugcagugagccaagaucgcacc

SEQ ID NO: 50108 - RNA, 21 nt, Human
gauguccuguuuucaccagag

SEQ ID NO: 50109 - RNA, 17 nt, Human
gcucuaaaagcaccucc

SEQ ID NO: 50110 - RNA, 23 nt, Human
gucacccaggcuggagugcagug

SEQ ID NO: 50111 - RNA, 23 nt, Human
gucacccaggcuagagugcaaug

SEQ ID NO: 50112 - RNA, 20 nt, Human
ccaacaaccucaacugccua

SEQ ID NO: 50113 - RNA, 21 nt, Human
cuccaccuugcucuucuuucu

SEQ ID NO: 50114 - RNA, 21 nt, Human
gguaucugcccaccauggccc

SEQ ID NO: 50115 - RNA, 24 nt, Human
acggccaccacugcagccgggggc

SEQ ID NO: 50116 - RNA, 23 nt, Human
ugcuuucauuuuuucacugauau

SEQ ID NO: 50117 - RNA, 26 nt, Human
uuuuuuaaaauauauacuuccuuaug

SEQ ID NO: 50118 - RNA, 19 nt, Human
uauagcaaauaauucguua

SEQ ID NO: 50119 - RNA, 19 nt, Human
ccauuuucaacugcuuuga

SEQ ID NO: 50120 - RNA, 27 nt, Human
uggaaaugcaaauaagugagccuccca

SEQ ID NO: 50121 - RNA, 27 nt, Human
acugagucucggcauaguccccagagc

SEQ ID NO: 50122 - RNA, 21 nt, Human
gggcagcugaccccaaagugu

SEQ ID NO: 50123 - RNA, 26 nt, Human
uucaaauaacugcagaaaaaauauug

SEQ ID NO: 50124 - RNA, 23 nt, Human
ugggccagagaggcauuggugcg

SEQ ID NO: 50125 - RNA, 21 nt, Human
ccauugaauuugccuuccuca

SEQ ID NO: 50126 - RNA, 24 nt, Human
agcagaaaugaaugaacugugaaa

SEQ ID NO: 50127 - RNA, 20 nt, Human
ccuccacugucacagccuuu

SEQ ID NO: 50128 - RNA, 27 nt, Human
ucauuuuaguaaugcucagcuggacca

SEQ ID NO: 50129 - RNA, 21 nt, Human
cagccagccccuuccugcugc

SEQ ID NO: 50130 - RNA, 27 nt, Human
ccuguucugaugucagugccuguacau

SEQ ID NO: 50131 - RNA, 22 nt, Human
gaggcagcagaaaacugucuga

SEQ ID NO: 50132 - RNA, 24 nt, Human
gggauuucaaacuuaaacaaaaaa

SEQ ID NO: 50133 - RNA, 26 nt, Human
cccagcucgggaccuggugcugauca

SEQ ID NO: 50134 - RNA, 22 nt, Human
acugccuauuuuuccucuuguu

SEQ ID NO: 50135 - RNA, 21 nt, Human
agaguaagccucuccccucca

SEQ ID NO: 50136 - RNA, 26 nt, Human
ucacugaugugggcaggagggguggu

SEQ ID NO: 50137 - RNA, 22 nt, Human
guacucaguaaggcagugcagu

SEQ ID NO: 50138 - RNA, 19 nt, Human
ccaaagugcauagucugag

SEQ ID NO: 50139 - RNA, 19 nt, Human
aagaaugcaaacugccuuu

SEQ ID NO: 50140 - RNA, 19 nt, Human
gagcccaacuccuucucau

SEQ ID NO: 50141 - RNA, 21 nt, Human
agagcucaguggcagacccca

SEQ ID NO: 50142 - RNA, 27 nt, Human
ggggaaugggguauggaaguuuuccua

SEQ ID NO: 50143 - RNA, 23 nt, Human
ucugaacugugaagacacuuggg

SEQ ID NO: 50144 - RNA, 22 nt, Human
gcucacgguaaccucugccucc

SEQ ID NO: 50145 - RNA, 30 nt, Human
uugucucccaggcuggagugcaaucgcgca

SEQ ID NO: 50146 - RNA, 27 nt, Human
ccucuucuuucagacuugccaugugac

SEQ ID NO: 50147 - RNA, 25 nt, Human
auccccagaccaggacagcagccac

SEQ ID NO: 50148 - RNA, 22 nt, Human
acaccugcuccuucuugcuuuc

SEQ ID NO: 50149 - RNA, 24 nt, Human
ucugggcugaugaauuuguuuuca

SEQ ID NO: 50150 - RNA, 21 nt, Human
cauguaaccaaaaaccacuug

SEQ ID NO: 50151 - RNA, 20 nt, Human
cuccucucccgcuccugggc

SEQ ID NO: 50152 - RNA, 22 nt, Human
gcaugucucccugaucugaacu

SEQ ID NO: 50153 - RNA, 26 nt, Human
cacucuggccuucaucacgagagcuc

SEQ ID NO: 50154 - RNA, 24 nt, Human
uagcaguguuggcuuuuauuugga

SEQ ID NO: 50155 - RNA, 20 nt, Human
uuucccccucucauaacuuc

SEQ ID NO: 50156 - RNA, 21 nt, Human
cacauauauauguacauacac

SEQ ID NO: 50157 - RNA, 22 nt, Human
acacagccugagccuggcccag

SEQ ID NO: 50158 - RNA, 20 nt, Human
uauuuuuuauauauacagua

SEQ ID NO: 50159 - RNA, 19 nt, Human
uuaaggggagcaggagugc

SEQ ID NO: 50160 - RNA, 23 nt, Human
ucagggcgggggccuggagcagc

SEQ ID NO: 50161 - RNA, 25 nt, Human
acccacgcuggagugcugugaugcg

SEQ ID NO: 50162 - RNA, 19 nt, Human
uucaguuuuucuguuguau

SEQ ID NO: 50163 - RNA, 24 nt, Human
ugugggguggaaaggaagagugag

SEQ ID NO: 50164 - RNA, 26 nt, Human
gaaaacaguagguccugagaaccaua

SEQ ID NO: 50165 - RNA, 23 nt, Human
gaauguacacagauccaaaauag

SEQ ID NO: 50166 - RNA, 24 nt, Human
uuggggaagaggugcaggagaagc

SEQ ID NO: 50167 - RNA, 26 nt, Human
aguggaggcugggaugggugagagaa

SEQ ID NO: 50168 - RNA, 22 nt, Human
aaaagguaccguggcugcugca

SEQ ID NO: 50169 - RNA, 26 nt, Human
uuccagucuuucuggacagcuauuaa

SEQ ID NO: 50170 - RNA, 23 nt, Human
uccucuuggagcugagaugagcc

SEQ ID NO: 50171 - RNA, 23 nt, Human
gaugcugcugagcacaucucuuc

SEQ ID NO: 50172 - RNA, 21 nt, Human
ccaaaacagcauuuuccugcu

SEQ ID NO: 50173 - RNA, 27 nt, Human
accacucuguggccagccuggcaucag

SEQ ID NO: 50174 - RNA, 17 nt, Human
ucugggagcucuagaau

SEQ ID NO: 50175 - RNA, 22 nt, Human
ugggagcaccuggugccucggg

SEQ ID NO: 50176 - RNA, 22 nt, Human
uguucccagcuccagcucuaac

SEQ ID NO: 50177 - RNA, 27 nt, Human
uuuccaggggaccucaggucuaccuca

SEQ ID NO: 50178 - RNA, 23 nt, Human
cacaugguuaaaaacaagcacaa

SEQ ID NO: 50179 - RNA, 22 nt, Human
gggacaccugcccugcccccac

SEQ ID NO: 50180 - RNA, 20 nt, Human
uaaaauauuuugaugcugaa

SEQ ID NO: 50181 - RNA, 21 nt, Human
caccaagcacagcagccuggg

SEQ ID NO: 50182 - RNA, 23 nt, Human
uggcuucugugccugacucugug

SEQ ID NO: 50183 - RNA, 19 nt, Human
guguuuagaaaucauagaa

SEQ ID NO: 50184 - RNA, 17 nt, Human
uuuuccaucccuagcca

SEQ ID NO: 50185 - RNA, 22 nt, Human
uuuuaaacuccugaaauucaga

SEQ ID NO: 50186 - RNA, 21 nt, Human
cuguuugcagggaagccccac

SEQ ID NO: 50187 - RNA, 23 nt, Human
gccuguaccaguuaguucaucaa

SEQ ID NO: 50188 - RNA, 27 nt, Human
uacauucaacccuuucucuuccuucag

SEQ ID NO: 50189 - RNA, 24 nt, Human
gcugucucucccuccauuguucag

SEQ ID NO: 50190 - RNA, 24 nt, Human
gccauauuggaguagcgaggaauc

SEQ ID NO: 50191 - RNA, 27 nt, Human
agcauuuuggucccugcuccuugccca

SEQ ID NO: 50192 - RNA, 21 nt, Human
cacccaggcuggacugcaaug

SEQ ID NO: 50193 - RNA, 27 nt, Human
gcugaguccuugcugugggaugugcca

SEQ ID NO: 50194 - RNA, 30 nt, Human
cagggggacuggaaaggcagcaugcgcucg

SEQ ID NO: 50195 - RNA, 22 nt, Human
ggauauuuacuguggcuugauu

SEQ ID NO: 50196 - RNA, 21 nt, Human
ccaucuccaccccaucauguu

SEQ ID NO: 50197 - RNA, 21 nt, Human
guccuuuauaaauagccagcc

SEQ ID NO: 50198 - RNA, 22 nt, Human
aucgcuugaacccgggaggcag

SEQ ID NO: 50199 - RNA, 22 nt, Human
cuauccccggacgcaugcaggg

SEQ ID NO: 50200 - RNA, 24 nt, Human
uauuuggaaaauguuaugugcucu

SEQ ID NO: 50201 - RNA, 22 nt, Human
ugaggccacugugucucagggg

SEQ ID NO: 50202 - RNA, 27 nt, Human
gugggaaaaacagcuaauaccaggggu

SEQ ID NO: 50203 - RNA, 27 nt, Human
uuaucagaacacagauuuaagugaaau

SEQ ID NO: 50204 - RNA, 20 nt, Human
gcucuagccacuacuuggua

SEQ ID NO: 50205 - RNA, 22 nt, Human
uucagaucuuucuagucaccuu

SEQ ID NO: 50206 - RNA, 23 nt, Human
uucuguucuacacccuccaggaa

SEQ ID NO: 50207 - RNA, 22 nt, Human
uccugcuuccucacuguggacc

SEQ ID NO: 50208 - RNA, 23 nt, Human
uucacaguccacuggcuggacca

SEQ ID NO: 50209 - RNA, 27 nt, Human
uuccuagaagucaagagcuagccuuga

SEQ ID NO: 50210 - RNA, 22 nt, Human
ggaggcagcaggggguacagac

SEQ ID NO: 50211 - RNA, 22 nt, Human
ggcucucugcaaccucugccuc

SEQ ID NO: 50212 - RNA, 24 nt, Human
uagaagccucucgucccgucccuc

SEQ ID NO: 50213 - RNA, 21 nt, Human
aaaauauaacuggaucugcca

SEQ ID NO: 50214 - RNA, 22 nt, Human
uuugcuuaauucagaguacagu

SEQ ID NO: 50215 - RNA, 23 nt, Human
gccguccccauccccugcccuca

SEQ ID NO: 50216 - RNA, 21 nt, Human
ucaauuguuuacagcccguga

SEQ ID NO: 50217 - RNA, 26 nt, Human
accagcaccgagcucggcaccucccc

SEQ ID NO: 50218 - RNA, 21 nt, Human
ggcaaaagggcagcugugaug

SEQ ID NO: 50219 - RNA, 22 nt, Human
ccucacccaggcugcagugcca

SEQ ID NO: 50220 - RNA, 21 nt, Human
accaugaagcuuccacucagg

SEQ ID NO: 50221 - RNA, 22 nt, Human
cacuuccugaggucaggucuug

SEQ ID NO: 50222 - RNA, 26 nt, Human
aaagcauuugaaugcauuuuguuugg

SEQ ID NO: 50223 - RNA, 21 nt, Human
aaccagaugaaagcaugauga

SEQ ID NO: 50224 - RNA, 19 nt, Human
aggccugccugugggcugc

SEQ ID NO: 50225 - RNA, 20 nt, Human
cuggcaggaagcccgcccug

SEQ ID NO: 50226 - RNA, 22 nt, Human
ccuauccauccugcgagcuccu

SEQ ID NO: 50227 - RNA, 27 nt, Human
ugagacucuaaggaggugaaaugaauc

SEQ ID NO: 50228 - RNA, 18 nt, Human
uggaggugggggacggga

SEQ ID NO: 50229 - RNA, 28 nt, Human
aaaucauguacauuugaaaauauuugca

SEQ ID NO: 50230 - RNA, 22 nt, Human
gaaaugugcaaccacugcuucu

SEQ ID NO: 50231 - RNA, 32 nt, Human
gugagcugcuggcacagcaguucuggcccugg

SEQ ID NO: 50232 - RNA, 22 nt, Human
guugcccaggcugaucucgaac

SEQ ID NO: 50233 - RNA, 26 nt, Human
gcacagcccugagugucccaagccgg

SEQ ID NO: 50234 - RNA, 21 nt, Human
guuucuuuucuguugaaaauc

SEQ ID NO: 50235 - RNA, 24 nt, Human
ccugcccagcugcucuugucagcc

SEQ ID NO: 50236 - RNA, 20 nt, Human
gcugcaccuacugcucuucu

SEQ ID NO: 50237 - RNA, 25 nt, Human
ccagcuguuaauccaucacucugag

SEQ ID NO: 50238 - RNA, 24 nt, Human
cagacaacucagaagguugggggg

SEQ ID NO: 50239 - RNA, 27 nt, Human
uuuucccaggaggaguuacagaugcag

SEQ ID NO: 50240 - RNA, 22 nt, Human
gccuguaauccgagcacuuugg

SEQ ID NO: 50241 - RNA, 23 nt, Human
acugcaucauagcuaugccugua

SEQ ID NO: 50242 - RNA, 27 nt, Human
gggaagaagcaugaagcuuuguguggg

SEQ ID NO: 50243 - RNA, 27 nt, Human
gggcagcccuucgguccacugcucugc

SEQ ID NO: 50244 - RNA, 22 nt, Human
guggggagggggagggggaagu

SEQ ID NO: 50245 - RNA, 27 nt, Human
uuuaaaagaggugugggagcagaggaa

SEQ ID NO: 50246 - RNA, 22 nt, Human
gugccuggcacucugccggugc

SEQ ID NO: 50247 - RNA, 18 nt, Human
ggcuggccuggaauggcc

SEQ ID NO: 50248 - RNA, 23 nt, Human
acgaaaaguaugccuugccuugu

SEQ ID NO: 50249 - RNA, 23 nt, Human
gggucuguagagggucugcugga

SEQ ID NO: 50250 - RNA, 22 nt, Human
cccuucugcugacacuccugcc

SEQ ID NO: 50251 - RNA, 26 nt, Human
caccccagccaccacugaguccacuc

SEQ ID NO: 50252 - RNA, 26 nt, Human
caaagcagcgcaaaucugagguuucc

SEQ ID NO: 50253 - RNA, 23 nt, Human
uuguuccccuccuccacucuccc

SEQ ID NO: 50254 - RNA, 26 nt, Human
aaaccugagccuauuucuaguauaag

SEQ ID NO: 50255 - RNA, 21 nt, Human
aaccuccugggcuaagugauc

SEQ ID NO: 50256 - RNA, 27 nt, Human
accaggauggcugagccccgccaggag

SEQ ID NO: 50257 - RNA, 27 nt, Human
uuucuuuucuuuucuucugguuuaauu

SEQ ID NO: 50258 - RNA, 23 nt, Human
uguuuaaucuguauuucuugcuu

SEQ ID NO: 50259 - RNA, 26 nt, Human
cucuuccucucuuucuuccuuuugga

SEQ ID NO: 50260 - RNA, 20 nt, Human
ggaacuccucaagaaccuga

SEQ ID NO: 50261 - RNA, 26 nt, Human
ucucucuguccugccagcacugaggg

SEQ ID NO: 50262 - RNA, 21 nt, Human
ccgcccaggcugggugcaguc

SEQ ID NO: 50263 - RNA, 22 nt, Human
cguuuuguaggacacuugggga

SEQ ID NO: 50264 - RNA, 23 nt, Human
ccacuccucugcuacacagcacg

SEQ ID NO: 50265 - RNA, 21 nt, Human
ucuguguccccucugcaugcc

SEQ ID NO: 50266 - RNA, 25 nt, Human
acccaagaacuccugaaaucauaua

SEQ ID NO: 50267 - RNA, 27 nt, Human
cuucagccucaguucccucauugguua

SEQ ID NO: 50268 - RNA, 27 nt, Human
gcagcauccugugagcauuuccgcggg

SEQ ID NO: 50269 - RNA, 22 nt, Human
ccccugccuuuucuccgguggg

SEQ ID NO: 50270 - RNA, 27 nt, Human
ccauugcgcuucagccugggcaacaag

SEQ ID NO: 50271 - RNA, 21 nt, Human
ggggaagggaaagacugggga

SEQ ID NO: 50272 - RNA, 22 nt, Human
cucuccaccccacaaaauaacg

SEQ ID NO: 50273 - RNA, 27 nt, Human
ggaggcugaggugggagaauugccuga

SEQ ID NO: 50274 - RNA, 21 nt, Human
uuaggagacacagggaagugg

SEQ ID NO: 50275 - RNA, 23 nt, Human
ccuugcacaggucccacugcccu

SEQ ID NO: 50276 - RNA, 22 nt, Human
ugaggggacagggaggagcaga

SEQ ID NO: 50277 - RNA, 22 nt, Human
ugugugacaggaaaaucuguag

SEQ ID NO: 50278 - RNA, 24 nt, Human
uacauagcuccuagcacagugccu

SEQ ID NO: 50279 - RNA, 20 nt, Human
guugggccuuccuuuuugga

SEQ ID NO: 50280 - RNA, 22 nt, Human
uucauucuuaaaauuauacuca

SEQ ID NO: 50281 - RNA, 28 nt, Human
guaggggaggggcgucuggagaggaccc

SEQ ID NO: 50282 - RNA, 22 nt, Human
uucugagcgucuucuaagacaa

SEQ ID NO: 50283 - RNA, 19 nt, Human
aauacagagcugaucuucu

SEQ ID NO: 50284 - RNA, 26 nt, Human
agcaguuugugguuucuaugcccgca

SEQ ID NO: 50285 - RNA, 25 nt, Human
agggucagggauuuuuuacagucug

SEQ ID NO: 50286 - RNA, 23 nt, Human
gucacagccacgugcucauucca

SEQ ID NO: 50287 - RNA, 20 nt, Human
uuauucuacugaaggcacag

SEQ ID NO: 50288 - RNA, 23 nt, Human
ggcugguagaauaaacuaccuca

SEQ ID NO: 50289 - RNA, 22 nt, Human
ggccacaugccuggucacugaa

SEQ ID NO: 50290 - RNA, 18 nt, Human
aaaaccagagaaucuuaa

SEQ ID NO: 50291 - RNA, 22 nt, Human
ucuggggcuggcaccagcaggc

SEQ ID NO: 50292 - RNA, 27 nt, Human
guuacccaggcuggucucaacuccugg

SEQ ID NO: 50293 - RNA, 15 nt, Human
cuuuagaccuagccc

SEQ ID NO: 50294 - RNA, 18 nt, Human
gggaaggucaagcaaaga

SEQ ID NO: 50295 - RNA, 24 nt, Human
ggacaacacugccuuucaaacuuu

SEQ ID NO: 50296 - RNA, 22 nt, Human
aagaauuguuuaagcugcauca

SEQ ID NO: 50297 - RNA, 21 nt, Human
gcuuauuucagaacaagucua

SEQ ID NO: 50298 - RNA, 18 nt, Human
guacucaggcagugcagu

SEQ ID NO: 50299 - RNA, 18 nt, Human
cuucugcugcugcucgcu

SEQ ID NO: 50300 - RNA, 21 nt, Human
aggagcagaauuuucccacug

SEQ ID NO: 50301 - RNA, 24 nt, Human
uuuacagucuuuugguauguuuca

SEQ ID NO: 50302 - RNA, 23 nt, Human
ugucugagguccuuaugaagcac

SEQ ID NO: 50303 - RNA, 22 nt, Human
cuggaugggcuucacuggggcc

SEQ ID NO: 50304 - RNA, 22 nt, Human
agaaagauucugaauggaagag

SEQ ID NO: 50305 - RNA, 21 nt, Human
uauguaaucccagcacuuugg

SEQ ID NO: 50306 - RNA, 19 nt, Human
auacuggcagauugcagug

SEQ ID NO: 50307 - RNA, 21 nt, Human
ggagugggugggcagggguag

SEQ ID NO: 50308 - RNA, 26 nt, Human
cagccugggcgcaguggugcuggggg

SEQ ID NO: 50309 - RNA, 27 nt, Human
ugguggaggugggcauggggucuguuc

SEQ ID NO: 50310 - RNA, 20 nt, Human
agaccuccaccucaacuucu

SEQ ID NO: 50311 - RNA, 22 nt, Human
auuuucucccucccuguguguc

SEQ ID NO: 50312 - RNA, 21 nt, Human
aaagcaaaggcaggcacuuca

SEQ ID NO: 50313 - RNA, 27 nt, Human
ggcaacacucaauuuaccugcgaagca

SEQ ID NO: 50314 - RNA, 21 nt, Human
gggggagggagagggagcuuu

SEQ ID NO: 50315 - RNA, 26 nt, Human
uccaucucugaaaacaagagacugcu

SEQ ID NO: 50316 - RNA, 20 nt, Human
uucccagguggcagacucgu

SEQ ID NO: 50317 - RNA, 26 nt, Human
ugcaaccuauccugggagacccuaaa

SEQ ID NO: 50318 - RNA, 27 nt, Human
uauuaaaaugucggauuuaucuuuccc

SEQ ID NO: 50319 - RNA, 21 nt, Human
ugcuugauccugggaggcaga

SEQ ID NO: 50320 - RNA, 29 nt, Human
cauguuuugcauguaaaagccuaggucua

SEQ ID NO: 50321 - RNA, 23 nt, Human
uucucucuccaacacuucauucu

SEQ ID NO: 50322 - RNA, 28 nt, Human
cucuacgaccucuccagcuucgugcggc

SEQ ID NO: 50323 - RNA, 27 nt, Human
ccauaauguaauauucuuuuuaaaccc

SEQ ID NO: 50324 - RNA, 20 nt, Human
uacuccccagaccucaggga

SEQ ID NO: 50325 - RNA, 22 nt, Human
gcucaugccuguaaucccagcu

SEQ ID NO: 50326 - RNA, 22 nt, Human
gcucacgccuguaaucccagcc

SEQ ID NO: 50327 - RNA, 25 nt, Human
acauaaacgugcaaggcacauacau

SEQ ID NO: 50328 - RNA, 26 nt, Human
auugcccagugcugccagagugagug

SEQ ID NO: 50329 - RNA, 20 nt, Human
ugcuccacccccaggcgguu

SEQ ID NO: 50330 - RNA, 25 nt, Human
ugucuucucccugcacaagccaggg

SEQ ID NO: 50331 - RNA, 19 nt, Human
gggacuuugaacaugucgg

SEQ ID NO: 50332 - RNA, 19 nt, Human
agccucucuugguuccuuc

SEQ ID NO: 50333 - RNA, 27 nt, Human
cuguucuguuuuagugaagguagauuu

SEQ ID NO: 50334 - RNA, 25 nt, Human
guucugacucccuuugaguugugug

SEQ ID NO: 50335 - RNA, 22 nt, Human
aucuuuaguucuuccuaccuag

SEQ ID NO: 50336 - RNA, 25 nt, Human
cagugguucuccaagugugguccug

SEQ ID NO: 50337 - RNA, 22 nt, Human
uucuccucuaucucauaaugca

SEQ ID NO: 50338 - RNA, 31 nt, Human
gggagggagagaagagggggcuaaauuugau

SEQ ID NO: 50339 - RNA, 22 nt, Human
gcuccccagguucuggaacagc

SEQ ID NO: 50340 - RNA, 32 nt, Human
gcuguaagauagucaaccacaguagucaccua

SEQ ID NO: 50341 - RNA, 27 nt, Human
cucccucuuucauaacuggaugcagcu

SEQ ID NO: 50342 - RNA, 26 nt, Human
aacacccuuccggaacccuucgggga

SEQ ID NO: 50343 - RNA, 22 nt, Human
ggauggccugggcugcgggugg

SEQ ID NO: 50344 - RNA, 23 nt, Human
accuaaaauggagugaggccaaa

SEQ ID NO: 50345 - RNA, 25 nt, Human
auuaauguuucuaucugauuuugug

SEQ ID NO: 50346 - RNA, 21 nt, Human
aaccugggcuggagugaggug

SEQ ID NO: 50347 - RNA, 25 nt, Human
ucccagauggcucaggcugugaccu

SEQ ID NO: 50348 - RNA, 23 nt, Human
aaagugcugggauuaacagguau

SEQ ID NO: 50349 - RNA, 21 nt, Human
cugcccugcccaccagccugu

SEQ ID NO: 50350 - RNA, 19 nt, Human
uguccccaggaaguugugu

SEQ ID NO: 50351 - RNA, 21 nt, Human
ugacuucuuuugcucucaaag

SEQ ID NO: 50352 - RNA, 25 nt, Human
ucuuggcaagaaugcuuuaauguau

SEQ ID NO: 50353 - RNA, 18 nt, Human
agcaccuucucucaggga

SEQ ID NO: 50354 - RNA, 22 nt, Human
ugugagcucuggccgcugccuu

SEQ ID NO: 50355 - RNA, 22 nt, Human
ccaugucacagcccccuaggag

SEQ ID NO: 50356 - RNA, 24 nt, Human
uccuguaauccuuguacuguucgg

SEQ ID NO: 50357 - RNA, 21 nt, Human
uaugaaaacuuaacucugcug

SEQ ID NO: 50358 - RNA, 27 nt, Human
ccauacagaagaaacaacaaaccugcg

SEQ ID NO: 50359 - RNA, 24 nt, Human
gggucuguuuuguucauuacuuug

SEQ ID NO: 50360 - RNA, 18 nt, Human
caguauugaagcauuuua

SEQ ID NO: 50361 - RNA, 27 nt, Human
uuuacaagaaucacaucucugauuuca

SEQ ID NO: 50362 - RNA, 20 nt, Human
aggacucaggaaaaauaaau

SEQ ID NO: 50363 - RNA, 22 nt, Human
cggugccaccaggcacggccac

SEQ ID NO: 50364 - RNA, 24 nt, Human
ucuccuuucuuucucacuucuguc

SEQ ID NO: 50365 - RNA, 24 nt, Human
gcaaaucccaagcaucauaucauu

SEQ ID NO: 50366 - RNA, 27 nt, Human
caaaggacaacugaggagacugcccag

SEQ ID NO: 50367 - RNA, 23 nt, Human
ggaggcugaucccaaaguuguca

SEQ ID NO: 50368 - RNA, 23 nt, Human
cuuagguugaguaacccacucug

SEQ ID NO: 50369 - RNA, 24 nt, Human
cauucacccuccuucccaccuacc

SEQ ID NO: 50370 - RNA, 21 nt, Human
cacuauuuuaauuauucuuga

SEQ ID NO: 50371 - RNA, 22 nt, Human
aaaucaugggccagagccucgg

SEQ ID NO: 50372 - RNA, 26 nt, Human
uucuuuauaauucacacauauaugca

SEQ ID NO: 50373 - RNA, 23 nt, Human
ucuaaaaauaacauacgcacuca

SEQ ID NO: 50374 - RNA, 23 nt, Human
aucuucucgauguagauguuuau

SEQ ID NO: 50375 - RNA, 23 nt, Human
gucuucuggcucuaggggugcag

SEQ ID NO: 50376 - RNA, 24 nt, Human
caaacuaagaagaccuuagaaaua

SEQ ID NO: 50377 - RNA, 22 nt, Human
ggcaucccaaagugcugggauu

SEQ ID NO: 50378 - RNA, 22 nt, Human
gagugagauucugucucaaaag

SEQ ID NO: 50379 - RNA, 21 nt, Human
uguuaagaaaaauacuuuuua

SEQ ID NO: 50380 - RNA, 22 nt, Human
aauccacugccaauucagcucc

SEQ ID NO: 50381 - RNA, 26 nt, Human
ucccaggucacaugcacguaugucca

SEQ ID NO: 50382 - RNA, 23 nt, Human
gaauaaaagggaacuuaauucau

SEQ ID NO: 50383 - RNA, 27 nt, Human
agcuuuucucucuuacgaugaaggcug

SEQ ID NO: 50384 - RNA, 22 nt, Human
ccucccacucuccacccuacug

SEQ ID NO: 50385 - RNA, 22 nt, Human
gcacucuugccaguccuugaca

SEQ ID NO: 50386 - RNA, 25 nt, Human
ggcuccuggucuggcucuguccuca

SEQ ID NO: 50387 - RNA, 22 nt, Human
ccagugcacuccagccuuggug

SEQ ID NO: 50388 - RNA, 22 nt, Human
uccucauuccugccugaagcca

SEQ ID NO: 50389 - RNA, 22 nt, Human
cugaagacaagagggaucucuu

SEQ ID NO: 50390 - RNA, 20 nt, Human
ugggguaauugcauucgucu

SEQ ID NO: 50391 - RNA, 20 nt, Human
gauccccaggcuuggggcaa

SEQ ID NO: 50392 - RNA, 26 nt, Human
uagacuccaugauggaugcuuguuuc

SEQ ID NO: 50393 - RNA, 26 nt, Human
ccccauccaaucaacugcuguaccca

SEQ ID NO: 50394 - RNA, 18 nt, Human
uuuguacugcagaaaaau

SEQ ID NO: 50395 - RNA, 23 nt, Human
ggguggggugugagaugggugcc

SEQ ID NO: 50396 - RNA, 22 nt, Human
ccccacccucucccagccugcc

SEQ ID NO: 50397 - RNA, 27 nt, Human
accagccuggccaauauggcaaaaccc

SEQ ID NO: 50398 - RNA, 20 nt, Human
ugccacacaccuugacaaaa

SEQ ID NO: 50399 - RNA, 22 nt, Human
caugccuguaaucccagcacuu

SEQ ID NO: 50400 - RNA, 22 nt, Human
caugccuguaaucucagcacuc

SEQ ID NO: 50401 - RNA, 22 nt, Human
cgugccugugaucccagcacuu

SEQ ID NO: 50402 - RNA, 20 nt, Human
ucugcucuccucucucuucc

SEQ ID NO: 50403 - RNA, 26 nt, Human
aggugcuuuagagauaauugcuugcc

SEQ ID NO: 50404 - RNA, 23 nt, Human
aagcucaaggauggaagugcagu

SEQ ID NO: 50405 - RNA, 23 nt, Human
ccgaaugucuguguuucauuguc

SEQ ID NO: 50406 - RNA, 23 nt, Human
aaggaagccuucuuauuuaucuu

SEQ ID NO: 50407 - RNA, 23 nt, Human
ugcaccuguaaucccagcuacuc

SEQ ID NO: 50408 - RNA, 20 nt, Human
ccggcacuccagccuggcga

SEQ ID NO: 50409 - RNA, 21 nt, Human
uccaauaaagugaaacaaagc

SEQ ID NO: 50410 - RNA, 19 nt, Human
ccacuuccauuggucucca

SEQ ID NO: 50411 - RNA, 18 nt, Human
gcccuucaucagccuggg

SEQ ID NO: 50412 - RNA, 28 nt, Human
uucuugguuuuucagccauucccugcag

SEQ ID NO: 50413 - RNA, 23 nt, Human
cgugggugggggcagggcaugag

SEQ ID NO: 50414 - RNA, 22 nt, Human
uuuucaaugaauuaagaaagau

SEQ ID NO: 50415 - RNA, 27 nt, Human
ugggcagucucauuugcacccauagcc

SEQ ID NO: 50416 - RNA, 22 nt, Human
uccauuuuggcgcuauuacaaa

SEQ ID NO: 50417 - RNA, 19 nt, Human
agauggcagauucccacug

SEQ ID NO: 50418 - RNA, 19 nt, Human
acuguaagccucaguacug

SEQ ID NO: 50419 - RNA, 21 nt, Human
aucagcuuuuaaaaaaugugu

SEQ ID NO: 50420 - RNA, 21 nt, Human
caucaacucuguuggauacga

SEQ ID NO: 50421 - RNA, 19 nt, Human
cccaggguggagugcagug

SEQ ID NO: 50422 - RNA, 23 nt, Human
ucuccacguacuaccaucuugau

SEQ ID NO: 50423 - RNA, 23 nt, Human
gaagggagggggcgggcaggugc

SEQ ID NO: 50424 - RNA, 22 nt, Human
guugcccaggcuggucucgaac

SEQ ID NO: 50425 - RNA, 22 nt, Human
aagcaggaaggggcauccacug

SEQ ID NO: 50426 - RNA, 24 nt, Human
aacgccgccucgucauacgccccu

SEQ ID NO: 50427 - RNA, 25 nt, Human
acaguuuugaauaaaagcauuuaca

SEQ ID NO: 50428 - RNA, 25 nt, Human
uucuggcaauaaauuuugguagacu

SEQ ID NO: 50429 - RNA, 24 nt, Human
gccccccacccucucuccugggcc

SEQ ID NO: 50430 - RNA, 20 nt, Human
gcacagaaggaaggagccag

SEQ ID NO: 50431 - RNA, 27 nt, Human
ugggaccccucccaaccucaaugcccu

SEQ ID NO: 50432 - RNA, 21 nt, Human
aacuuguugacaaugcacuga

SEQ ID NO: 50433 - RNA, 24 nt, Human
agguacuggugagggcaagaggug

SEQ ID NO: 50434 - RNA, 21 nt, Human
guuucugcuaauagaggaauc

SEQ ID NO: 50435 - RNA, 27 nt, Human
cugccucugucgcccaggcuggagugc

SEQ ID NO: 50436 - RNA, 29 nt, Human
ucagggccuucgcaugugcuguucccucu

SEQ ID NO: 50437 - RNA, 22 nt, Human
agcaggaggauggacacacccc

SEQ ID NO: 50438 - RNA, 18 nt, Human
cuauacugagacaacaag

SEQ ID NO: 50439 - RNA, 21 nt, Human
cuguccacuuccuaacccagg

SEQ ID NO: 50440 - RNA, 18 nt, Human
ugcuucuucaguaccaug

SEQ ID NO: 50441 - RNA, 21 nt, Human
ggccugggccuggugcccgag

SEQ ID NO: 50442 - RNA, 24 nt, Human
gggggaggggagggagugaggggc

SEQ ID NO: 50443 - RNA, 24 nt, Human
ugcgcucuucacaauuaaaggccu

SEQ ID NO: 50444 - RNA, 20 nt, Human
caaguuucccaggcacuuuu

SEQ ID NO: 50445 - RNA, 24 nt, Human
cacagagaggcuggagggacugug

SEQ ID NO: 50446 - RNA, 21 nt, Human
auacaguaagcauuuguauuu

SEQ ID NO: 50447 - RNA, 17 nt, Human
gucuuccugccugaaac

SEQ ID NO: 50448 - RNA, 20 nt, Human
ccuggcgccccuucucucca

SEQ ID NO: 50449 - RNA, 22 nt, Human
gggggcuguggacgucuuugga

SEQ ID NO: 50450 - RNA, 21 nt, Human
uggucaugaggccccugugga

SEQ ID NO: 50451 - RNA, 21 nt, Human
ccaggcccugcucuuccugcu

SEQ ID NO: 50452 - RNA, 25 nt, Human
ugcuaaaaaguccuugauuuagcac

SEQ ID NO: 50453 - RNA, 19 nt, Human
uuuuacugacagaaaugca

SEQ ID NO: 50454 - RNA, 27 nt, Human
cuccugccucagccuuccaacuagcug

SEQ ID NO: 50455 - RNA, 27 nt, Human
gggagcugggccuggucucacccugga

SEQ ID NO: 50456 - RNA, 22 nt, Human
cagccugugugcguguggugca

SEQ ID NO: 50457 - RNA, 20 nt, Human
acauaacugaagcaugugaa

SEQ ID NO: 50458 - RNA, 24 nt, Human
cgagucugcuuuaagugauuucuu

SEQ ID NO: 50459 - RNA, 22 nt, Human
ccaaguagugugaacuaaaggc

SEQ ID NO: 50460 - RNA, 22 nt, Human
ugucgcccaggcuggagggcag

SEQ ID NO: 50461 - RNA, 22 nt, Human
ugucgcccaugcuggagugcag

SEQ ID NO: 50462 - RNA, 25 nt, Human
cugccagggugggguacgggguuug

SEQ ID NO: 50463 - RNA, 29 nt, Human
aggcagcggaaggcggcagaggcugggag

SEQ ID NO: 50464 - RNA, 26 nt, Human
ccuccucuccagaaucauguggaggg

SEQ ID NO: 50465 - RNA, 24 nt, Human
gggagagagaagcaggcagauaag

SEQ ID NO: 50466 - RNA, 22 nt, Human
ugcaaccuccaccucuuauguu

SEQ ID NO: 50467 - RNA, 21 nt, Human
gagcauggacauuuuacuuug

SEQ ID NO: 50468 - RNA, 21 nt, Human
caagcuggaacccaggagcag

SEQ ID NO: 50469 - RNA, 21 nt, Human
gacaguauggagaaaucacca

SEQ ID NO: 50470 - RNA, 26 nt, Human
guguacacuauugaccuuuuuuccug

SEQ ID NO: 50471 - RNA, 22 nt, Human
ggcccagacugaagugcagugg

SEQ ID NO: 50472 - RNA, 21 nt, Human
accucugcuccaaaggaaauc

SEQ ID NO: 50473 - RNA, 19 nt, Human
uagcuggagcacucagagc

SEQ ID NO: 50474 - RNA, 20 nt, Human
ugaguuuuguuauguguuuu

SEQ ID NO: 50475 - RNA, 18 nt, Human
gugaggcuccaaaaugag

SEQ ID NO: 50476 - RNA, 22 nt, Human
auacagacucacauacagacac

SEQ ID NO: 50477 - RNA, 26 nt, Human
gcauuuugcuaccaagccucuuccca

SEQ ID NO: 50478 - RNA, 25 nt, Human
aggaguggagugugguuuggcagaa

SEQ ID NO: 50479 - RNA, 22 nt, Human
gugcaaagagaauuaggagaga

SEQ ID NO: 50480 - RNA, 19 nt, Human
ucugcuccccaccuuacuc

SEQ ID NO: 50481 - RNA, 23 nt, Human
acggggguuucaccauguuagcc

SEQ ID NO: 50482 - RNA, 27 nt, Human
ggcuuugacaucaagcugggugaauua

SEQ ID NO: 50483 - RNA, 21 nt, Human
gcacuuugcaucacagucaca

SEQ ID NO: 50484 - RNA, 21 nt, Human
accccaugggagugggaggga

SEQ ID NO: 50485 - RNA, 22 nt, Human
ugcaaccuucaccuccagguuc

SEQ ID NO: 50486 - RNA, 20 nt, Human
uguuaucaaagcacaugacu

SEQ ID NO: 50487 - RNA, 21 nt, Human
ccguggcugcucacugcguuc

SEQ ID NO: 50488 - RNA, 21 nt, Human
gcugcucucuccuucagaacc

SEQ ID NO: 50489 - RNA, 21 nt, Human
gggccggacagaggagccagc

SEQ ID NO: 50490 - RNA, 21 nt, Human
uccccccacacccguccaccu

SEQ ID NO: 50491 - RNA, 21 nt, Human
cuggagugcucacaguguggc

SEQ ID NO: 50492 - RNA, 21 nt, Human
ccgaggcugggacacugugug

SEQ ID NO: 50493 - RNA, 22 nt, Human
guauuuuucuaugcacugggca

SEQ ID NO: 50494 - RNA, 24 nt, Human
ucuuguuccuagauauauagcucu

SEQ ID NO: 50495 - RNA, 27 nt, Human
uucucucuguaccacgugcacaugagg

SEQ ID NO: 50496 - RNA, 21 nt, Human
ucaucucucuagugcugccuc

SEQ ID NO: 50497 - RNA, 27 nt, Human
cccuccugacccauugcuguuguccaa

SEQ ID NO: 50498 - RNA, 27 nt, Human
acacaaaacaaaugccacacaucaccc

SEQ ID NO: 50499 - RNA, 21 nt, Human
acugcccaggcuggaauccaa

SEQ ID NO: 50500 - RNA, 21 nt, Human
ugucuauccagguugagcauc

SEQ ID NO: 50501 - RNA, 23 nt, Human
acccagugaggaugcugcaguga

SEQ ID NO: 50502 - RNA, 22 nt, Human
ucuacuuagcguggcuguuuug

SEQ ID NO: 50503 - RNA, 25 nt, Human
ggccucuuuagcucucuuuaucuuu

SEQ ID NO: 50504 - RNA, 21 nt, Human
ucaucccuguggggagugcag

SEQ ID NO: 50505 - RNA, 23 nt, Human
acaugccaccccgaauggcucac

SEQ ID NO: 50506 - RNA, 20 nt, Human
gcgugagggugaggggcugg

SEQ ID NO: 50507 - RNA, 25 nt, Human
aacaaauucagaauaucaacagaug

SEQ ID NO: 50508 - RNA, 20 nt, Human
aggaguacugucucaucuca

SEQ ID NO: 50509 - RNA, 21 nt, Human
guggugagcaaagaucguacc

SEQ ID NO: 50510 - RNA, 27 nt, Human
ugcagugagcuguaauugcaucacugc

SEQ ID NO: 50511 - RNA, 25 nt, Human
uccucugguccccaggccccuccag

SEQ ID NO: 50512 - RNA, 21 nt, Human
aggaaggggagggaagcuucc

SEQ ID NO: 50513 - RNA, 28 nt, Human
uuacuuuguugauucucaguuacuguag

SEQ ID NO: 50514 - RNA, 28 nt, Human
uccucccugcaggagcuucccaagcugg

SEQ ID NO: 50515 - RNA, 27 nt, Human
aaagugcugggauuacaagaaugagcc

SEQ ID NO: 50516 - RNA, 21 nt, Human
ccauucacuacagccuggaug

SEQ ID NO: 50517 - RNA, 20 nt, Human
ucauuuucacauguuacuca

SEQ ID NO: 50518 - RNA, 27 nt, Human
cccuccagaggacccuugccucagccu

SEQ ID NO: 50519 - RNA, 20 nt, Human
ugccaucaaauaaacugagu

SEQ ID NO: 50520 - RNA, 22 nt, Human
gaagugcugcguguucaggcca

SEQ ID NO: 50521 - RNA, 19 nt, Human
agaagcaguagucacuuuu

SEQ ID NO: 50522 - RNA, 21 nt, Human
uaucagaaaaacuguuggauu

SEQ ID NO: 50523 - RNA, 29 nt, Human
gucacugagagacagaggcagcaucugcc

SEQ ID NO: 50524 - RNA, 20 nt, Human
acagcccuguguugugcuca

SEQ ID NO: 50525 - RNA, 21 nt, Human
uuaagugggagucucaggcaa

SEQ ID NO: 50526 - RNA, 30 nt, Human
gacucaagugauccuccugucuuggccucc

SEQ ID NO: 50527 - RNA, 23 nt, Human
cuccguucucaacaccuuccuua

SEQ ID NO: 50528 - RNA, 23 nt, Human
gcucaccugagcaaugaagugag

SEQ ID NO: 50529 - RNA, 25 nt, Human
gcggugcgugccuguaaucccagcu

SEQ ID NO: 50530 - RNA, 27 nt, Human
ugccuguaaacccagggcuuuagaagg

SEQ ID NO: 50531 - RNA, 24 nt, Human
gguaaugagaaaccaggacaggcc

SEQ ID NO: 50532 - RNA, 21 nt, Human
aggccucccugccucagcugc

SEQ ID NO: 50533 - RNA, 20 nt, Human
uguaucucacacagugccuu

SEQ ID NO: 50534 - RNA, 16 nt, Human
ucaagacgaggugcgg

SEQ ID NO: 50535 - RNA, 26 nt, Human
ucagaagaagcgagcacaggcugggg

SEQ ID NO: 50536 - RNA, 20 nt, Human
gccaugagacugucuuugga

SEQ ID NO: 50537 - RNA, 27 nt, Human
uucuggcugccugucuuugcugccaug

SEQ ID NO: 50538 - RNA, 20 nt, Human
augugagugggcuccggagc

SEQ ID NO: 50539 - RNA, 22 nt, Human
gccuguaaucccagcacuuuca

SEQ ID NO: 50540 - RNA, 23 nt, Human
ugccuguaguccaagcuacuuga

SEQ ID NO: 50541 - RNA, 27 nt, Human
ccucaagaucauucaguguuuuuccuu

SEQ ID NO: 50542 - RNA, 27 nt, Human
uuggccaggcugguggugagcuccugg

SEQ ID NO: 50543 - RNA, 21 nt, Human
ggcaauuucuuuuccuuucua

SEQ ID NO: 50544 - RNA, 22 nt, Human
agaguuagcuuuuggacaguua

SEQ ID NO: 50545 - RNA, 22 nt, Human
cuccugcuuuucuguccugggc

SEQ ID NO: 50546 - RNA, 20 nt, Human
ccacagaaucauuuguuuuu

SEQ ID NO: 50547 - RNA, 19 nt, Human
cagggacccaggcacugug

SEQ ID NO: 50548 - RNA, 23 nt, Human
aacuuuucaugaagugcauugua

SEQ ID NO: 50549 - RNA, 22 nt, Human
uuuucuuuugcuuuuucucggc

SEQ ID NO: 50550 - RNA, 22 nt, Human
cgggccgaaggccagcuggagc

SEQ ID NO: 50551 - RNA, 23 nt, Human
ccguccugccccuuccuccuuca

SEQ ID NO: 50552 - RNA, 16 nt, Human
gggagugcgaggcaga

SEQ ID NO: 50553 - RNA, 22 nt, Human
uccaucagagacugcaccucug

SEQ ID NO: 50554 - RNA, 27 nt, Human
ugcagagucucagcaugaucaguccug

SEQ ID NO: 50555 - RNA, 24 nt, Human
gaacuauggcacuaaccaaaaacu

SEQ ID NO: 50556 - RNA, 25 nt, Human
cacauggacacacacccaagccaca

SEQ ID NO: 50557 - RNA, 28 nt, Human
ggguucaugacuuggcuguuaaagaugu

SEQ ID NO: 50558 - RNA, 26 nt, Human
uggaaagaggaagaggcugccugggg

SEQ ID NO: 50559 - RNA, 22 nt, Human
cacuagcucuuuuuaaauucca

SEQ ID NO: 50560 - RNA, 26 nt, Human
uugcccaggcuugagugcaaugaccu

SEQ ID NO: 50561 - RNA, 26 nt, Human
aggggagggggccgugccgagaaggg

SEQ ID NO: 50562 - RNA, 24 nt, Human
accucauugacuaggcuguuacuu

SEQ ID NO: 50563 - RNA, 22 nt, Human
agccuuccaacuagcugggacu

SEQ ID NO: 50564 - RNA, 27 nt, Human
ccccucggcuggccugggcaugugaug

SEQ ID NO: 50565 - RNA, 22 nt, Human
uugcaggcugagucccuccaug

SEQ ID NO: 50566 - RNA, 22 nt, Human
uuucaugaaauuaaaacaguga

SEQ ID NO: 50567 - RNA, 22 nt, Human
ggggucaccuggcgagacgcac

SEQ ID NO: 50568 - RNA, 19 nt, Human
cuuagcaauguucuaauca

SEQ ID NO: 50569 - RNA, 24 nt, Human
uccuuuaucacaaccaccguuaca

SEQ ID NO: 50570 - RNA, 25 nt, Human
guuugguuucuucauucuuuacugc

SEQ ID NO: 50571 - RNA, 22 nt, Human
guuggccucccaaagugcuggg

SEQ ID NO: 50572 - RNA, 19 nt, Human
caaagcuacccaucugcca

SEQ ID NO: 50573 - RNA, 23 nt, Human
acacauuuaauucagcuuugucc

SEQ ID NO: 50574 - RNA, 21 nt, Human
gaaccaggaggcagagcggga

SEQ ID NO: 50575 - RNA, 23 nt, Human
guucacgccauucuccugccuca

SEQ ID NO: 50576 - RNA, 27 nt, Human
cuuuguuccucaauagcugggggcugg

SEQ ID NO: 50577 - RNA, 27 nt, Human
ucuggugcccaccugucuccuaccuca

SEQ ID NO: 50578 - RNA, 30 nt, Human
uguuccuguucauugugaguccuguuugcu

SEQ ID NO: 50579 - RNA, 22 nt, Human
ucugaucugagaagacaugaac

SEQ ID NO: 50580 - RNA, 27 nt, Human
caggcagcuggaucuguuugcaugcag

SEQ ID NO: 50581 - RNA, 26 nt, Human
acauuuucacagcccuucuugcagag

SEQ ID NO: 50582 - RNA, 27 nt, Human
agcuguacuguaauuucuuugaguuga

SEQ ID NO: 50583 - RNA, 21 nt, Human
ccuguaaucccagcacuuugg

SEQ ID NO: 50584 - RNA, 21 nt, Human
ccuguaaucucagcacucugg

SEQ ID NO: 50585 - RNA, 27 nt, Human
gucgcccaggcuggagugcaaugcacg

SEQ ID NO: 50586 - RNA, 26 nt, Human
uuugucgcccaggcuggagugcagug

SEQ ID NO: 50587 - RNA, 22 nt, Human
ucugauuuucuuuuucuuuugc

SEQ ID NO: 50588 - RNA, 17 nt, Human
accacaaagaaaggaca

SEQ ID NO: 50589 - RNA, 22 nt, Human
uugaggagggaggauggcuuga

SEQ ID NO: 50590 - RNA, 26 nt, Human
agcauggaggacacagaugacucuuu

SEQ ID NO: 50591 - RNA, 24 nt, Human
uuuauuccuuuccuuuuuugagau

SEQ ID NO: 50592 - RNA, 23 nt, Human
ugaggauuuucuagcauguugcu

SEQ ID NO: 50593 - RNA, 22 nt, Human
ucugccugcugcccacuucccu

SEQ ID NO: 50594 - RNA, 28 nt, Human
gcuugguuugcaaccucuuugcucaaca

SEQ ID NO: 50595 - RNA, 21 nt, Human
cuggaggugacugcagguugu

SEQ ID NO: 50596 - RNA, 24 nt, Human
aggugaauucucccacaguggucu

SEQ ID NO: 50597 - RNA, 22 nt, Human
uucaccauguugcccaggcugg

SEQ ID NO: 50598 - RNA, 22 nt, Human
ucccuuaagaaucaaaagcaga

SEQ ID NO: 50599 - RNA, 22 nt, Human
cacccagccacguaaagaggua

SEQ ID NO: 50600 - RNA, 23 nt, Human
aguuaugccacuugauuuuagug

SEQ ID NO: 50601 - RNA, 22 nt, Human
gguucacugcagucuugaccuc

SEQ ID NO: 50602 - RNA, 20 nt, Human
auguagucaucuguuuucug

SEQ ID NO: 50603 - RNA, 22 nt, Human
cugggggaggaggggagaaagc

SEQ ID NO: 50604 - RNA, 25 nt, Human
uucauucucugcuuuauucucucca

SEQ ID NO: 50605 - RNA, 23 nt, Human
gcggcugcggaaagcggagggag

SEQ ID NO: 50606 - RNA, 21 nt, Human
agcuaauuuuguauuuuuagu

SEQ ID NO: 50607 - RNA, 22 nt, Human
gcugguggcccuggccccacug

SEQ ID NO: 50608 - RNA, 27 nt, Human
cugcuucuauguuucauaguugggguc

SEQ ID NO: 50609 - RNA, 24 nt, Human
uucaugauuucaaccacauuugcu

SEQ ID NO: 50610 - RNA, 21 nt, Human
ucaaacccacacacaacugaa

SEQ ID NO: 50611 - RNA, 21 nt, Human
uguggggcugggcagaggcgg

SEQ ID NO: 50612 - RNA, 22 nt, Human
aaaccugauauuucacuuauac

SEQ ID NO: 50613 - RNA, 20 nt, Human
gugacgacugucaaagagua

SEQ ID NO: 50614 - RNA, 21 nt, Human
ugcccaggcuggagugcaaua

SEQ ID NO: 50615 - RNA, 22 nt, Human
ccaacgugcugggauuauaggc

SEQ ID NO: 50616 - RNA, 20 nt, Human
ccccagcacccgggcucagg

SEQ ID NO: 50617 - RNA, 21 nt, Human
ucuccacugccaaugacagcc

SEQ ID NO: 50618 - RNA, 23 nt, Human
uuccagaucagcccaaguuuacu

SEQ ID NO: 50619 - RNA, 21 nt, Human
ccugcagccauugcagcugcc

SEQ ID NO: 50620 - RNA, 26 nt, Human
agcugucagaauaaauuccugguggu

SEQ ID NO: 50621 - RNA, 18 nt, Human
gacauaaaaacaacuuua

SEQ ID NO: 50622 - RNA, 19 nt, Human
gaggcccuccucugccuuu

SEQ ID NO: 50623 - RNA, 31 nt, Human
aggaaaccaguugaggaggaauugacucagg

SEQ ID NO: 50624 - RNA, 19 nt, Human
gcgccuggccuuguguggc

SEQ ID NO: 50625 - RNA, 22 nt, Human
gggaaucagugagugcuccaug

SEQ ID NO: 50626 - RNA, 23 nt, Human
cacucugucuggugagcucugcu

SEQ ID NO: 50627 - RNA, 22 nt, Human
caggucagagcccaggaauucu

SEQ ID NO: 50628 - RNA, 20 nt, Human
acaucuauugaaaguguugg

SEQ ID NO: 50629 - RNA, 22 nt, Human
uuugugacccccuccugcccag

SEQ ID NO: 50630 - RNA, 26 nt, Human
gcucagccacacaggaagaaagucuu

SEQ ID NO: 50631 - RNA, 26 nt, Human
cccagccucgcaugccagagccuggg

SEQ ID NO: 50632 - RNA, 24 nt, Human
uuugggagcuuggcccuacgguuu

SEQ ID NO: 50633 - RNA, 23 nt, Human
cuaccccggaaggcuggaaauac

SEQ ID NO: 50634 - RNA, 22 nt, Human
caaguguacacagcagcagcaa

SEQ ID NO: 50635 - RNA, 25 nt, Human
gccggggagggcuaccuccuccucc

SEQ ID NO: 50636 - RNA, 27 nt, Human
agcccagccagcugcgccugcgcugca

SEQ ID NO: 50637 - RNA, 24 nt, Human
gcugggguugggagcuugggcagg

SEQ ID NO: 50638 - RNA, 27 nt, Human
acagcucugcauguugcugcagcugaa

SEQ ID NO: 50639 - RNA, 16 nt, Human
cuucccuuccuuuuca

SEQ ID NO: 50640 - RNA, 25 nt, Human
uuaggacuucuuucaaauugagaga

SEQ ID NO: 50641 - RNA, 27 nt, Human
auaaaguguucuaugaaauucagaacu

SEQ ID NO: 50642 - RNA, 22 nt, Human
ucugagaaaacaagcaaguucu

SEQ ID NO: 50643 - RNA, 23 nt, Human
gggaaacugaggcccagcuuggg

SEQ ID NO: 50644 - RNA, 22 nt, Human
uguuuucucuccaucagaauga

SEQ ID NO: 50645 - RNA, 25 nt, Human
ggcuuuguauagaaccucuuugucu

SEQ ID NO: 50646 - RNA, 23 nt, Human
gagagggagguggcuaagcuggc

SEQ ID NO: 50647 - RNA, 21 nt, Human
aucuguguaacuguaaaacau

SEQ ID NO: 50648 - RNA, 24 nt, Human
cucaggaagugcugggauuacagg

SEQ ID NO: 50649 - RNA, 24 nt, Human
ccagggagucagagguuucaguga

SEQ ID NO: 50650 - RNA, 24 nt, Human
ggcagggaaaacacagauguguug

SEQ ID NO: 50651 - RNA, 20 nt, Human
ggucaccuccauuaccaagu

SEQ ID NO: 50652 - RNA, 22 nt, Human
ggaggcuggaguaaucagauua

SEQ ID NO: 50653 - RNA, 22 nt, Human
agccugggggcaaguuagcacu

SEQ ID NO: 50654 - RNA, 19 nt, Human
ccuucucccaagcugcagu

SEQ ID NO: 50655 - RNA, 27 nt, Human
ugcaggcagacuuuucccuaccucugu

SEQ ID NO: 50656 - RNA, 26 nt, Human
gagggggcuggggcgcacggagaagc

SEQ ID NO: 50657 - RNA, 20 nt, Human
ggccccaucucuguucuguu

SEQ ID NO: 50658 - RNA, 26 nt, Human
cagucuuuacucuuuuucucuucaac

SEQ ID NO: 50659 - RNA, 25 nt, Human
ccggggucagguggagcaggcaggg

SEQ ID NO: 50660 - RNA, 25 nt, Human
aggacaucugggucucauuugcuuc

SEQ ID NO: 50661 - RNA, 22 nt, Human
agagggagacaaauauaaagau

SEQ ID NO: 50662 - RNA, 25 nt, Human
gacauaucuuuauauugauguaaua

SEQ ID NO: 50663 - RNA, 26 nt, Human
gacguggcucaggucccgcccucaua

SEQ ID NO: 50664 - RNA, 22 nt, Human
ggggugagaggaugggugaugg

SEQ ID NO: 50665 - RNA, 23 nt, Human
ugagcagauggaguauggaagaa

SEQ ID NO: 50666 - RNA, 21 nt, Human
acuccugacaucuugcuuuag

SEQ ID NO: 50667 - RNA, 27 nt, Human
cagcuuuauuagcuuauaaauuacuca

SEQ ID NO: 50668 - RNA, 21 nt, Human
uaauuccuauuuucugcuuca

SEQ ID NO: 50669 - RNA, 22 nt, Human
auccagagcuuuagaggaagac

SEQ ID NO: 50670 - RNA, 21 nt, Human
cacaaaugaugcaggugcaaa

SEQ ID NO: 50671 - RNA, 24 nt, Human
uccugugcauuguaggaucuuuag

SEQ ID NO: 50672 - RNA, 21 nt, Human
guugggaggccucucugggcu

SEQ ID NO: 50673 - RNA, 21 nt, Human
ugcccaaccuccagauaccuc

SEQ ID NO: 50674 - RNA, 21 nt, Human
gaaugcacagcauauggaaag

SEQ ID NO: 50675 - RNA, 22 nt, Human
cugcaacccugcucuaugcuga

SEQ ID NO: 50676 - RNA, 24 nt, Human
ucagccacccugaguugcuuuuca

SEQ ID NO: 50677 - RNA, 19 nt, Human
ccaggcugggagggcaaug

SEQ ID NO: 50678 - RNA, 21 nt, Human
auauuccuccagcugggauug

SEQ ID NO: 50679 - RNA, 22 nt, Human
ugaccucgugauccaccugccu

SEQ ID NO: 50680 - RNA, 18 nt, Human
aggcuggagagcagagca

SEQ ID NO: 50681 - RNA, 25 nt, Human
ucaggugagcuguggaggugggguc

SEQ ID NO: 50682 - RNA, 22 nt, Human
uauguacguauauuucuguauc

SEQ ID NO: 50683 - RNA, 21 nt, Human
cagucccaguuucucuuauua

SEQ ID NO: 50684 - RNA, 25 nt, Human
gggccucaggccuccagcuccuggg

SEQ ID NO: 50685 - RNA, 22 nt, Human
uucuuucuagaagauugagaag

SEQ ID NO: 50686 - RNA, 22 nt, Human
aucagccuggccaacaugauga

SEQ ID NO: 50687 - RNA, 22 nt, Human
gcauuuucuucacuugcaggca

SEQ ID NO: 50688 - RNA, 23 nt, Human
ucuccacgaguguucagucuuag

SEQ ID NO: 50689 - RNA, 21 nt, Human
gccagcaccucccgcuucucc

SEQ ID NO: 50690 - RNA, 21 nt, Human
ccuccacuuguucagggcuuu

SEQ ID NO: 50691 - RNA, 25 nt, Human
ugguuguaauucuaaauuacagagu

SEQ ID NO: 50692 - RNA, 26 nt, Human
uuccauucuuaaagaggcgguuagca

SEQ ID NO: 50693 - RNA, 21 nt, Human
agagggccuucccugacuuac

SEQ ID NO: 50694 - RNA, 21 nt, Human
aaagcguugcagcuguggaag

SEQ ID NO: 50695 - RNA, 20 nt, Human
cuugucccaggcugggcaga

SEQ ID NO: 50696 - RNA, 23 nt, Human
ugugugcucuuaucaccaaucag

SEQ ID NO: 50697 - RNA, 21 nt, Human
cugcacugcucacuuguggcc

SEQ ID NO: 50698 - RNA, 27 nt, Human
ucugcuccccaucguccucuugcugac

SEQ ID NO: 50699 - RNA, 18 nt, Human
ggucuccgggguccgcuu

SEQ ID NO: 50700 - RNA, 26 nt, Human
acucauuguaaguugccacugccaac

SEQ ID NO: 50701 - RNA, 23 nt, Human
uagccucaucauuuugugcugcu

SEQ ID NO: 50702 - RNA, 27 nt, Human
caggcuggagugcaguggcuccgaucu

SEQ ID NO: 50703 - RNA, 25 nt, Human
gugugcugggggaugucaggugcca

SEQ ID NO: 50704 - RNA, 22 nt, Human
gaacuccugaccucaacugauc

SEQ ID NO: 50705 - RNA, 23 nt, Human
aaagggcccucuucuccucucgc

SEQ ID NO: 50706 - RNA, 16 nt, Human
uuagcaagucugugau

SEQ ID NO: 50707 - RNA, 20 nt, Human
ugccuaauccuagcacuuug

SEQ ID NO: 50708 - RNA, 22 nt, Human
uugcagggcaggcugaaaaguu

SEQ ID NO: 50709 - RNA, 23 nt, Human
ccacaagagcaaaacuccgucuc

SEQ ID NO: 50710 - RNA, 21 nt, Human
ugcaaagaucagagcagguga

SEQ ID NO: 50711 - RNA, 24 nt, Human
cuucccacucuccccgacuucauu

SEQ ID NO: 50712 - RNA, 21 nt, Human
aauuucuaguucacagacaua

SEQ ID NO: 50713 - RNA, 22 nt, Human
gaggugaccugucccaucugcc

SEQ ID NO: 50714 - RNA, 26 nt, Human
gugacuuccaccugcucaaccuacgu

SEQ ID NO: 50715 - RNA, 21 nt, Human
cucucuggcugaugucaccug

SEQ ID NO: 50716 - RNA, 22 nt, Human
guugggaguugauggggccaga

SEQ ID NO: 50717 - RNA, 27 nt, Human
ugggaugaguacccccucaaacccugc

SEQ ID NO: 50718 - RNA, 24 nt, Human
cucuuguccuuuauauuuuuuguc

SEQ ID NO: 50719 - RNA, 24 nt, Human
ggcuuggagggaccaggguuucca

SEQ ID NO: 50720 - RNA, 27 nt, Human
cugugugacuucaggcaagacauugau

SEQ ID NO: 50721 - RNA, 26 nt, Human
ccuuagggagcuuccagugauugauu

SEQ ID NO: 50722 - RNA, 20 nt, Human
cugucccagucggcugcugu

SEQ ID NO: 50723 - RNA, 22 nt, Human
ggaggcaccgugcauucugagg

SEQ ID NO: 50724 - RNA, 27 nt, Human
caggaaccuguuggagaggcaggaccu

SEQ ID NO: 50725 - RNA, 20 nt, Human
ugguguauuaaaaugacuga

SEQ ID NO: 50726 - RNA, 27 nt, Human
uucauucuuuucccauauccuuggcuu

SEQ ID NO: 50727 - RNA, 21 nt, Human
guggugugaucucggcucacu

SEQ ID NO: 50728 - RNA, 18 nt, Human
cucaguucauuuccugag

SEQ ID NO: 50729 - RNA, 27 nt, Human
cugagaugcuaauuuauuuccccgagu

SEQ ID NO: 50730 - RNA, 26 nt, Human
gguucugaggccccuacccucccagg

SEQ ID NO: 50731 - RNA, 21 nt, Human
acaguccccugaggagaacuu

SEQ ID NO: 50732 - RNA, 25 nt, Human
ccgcggcccagcugacccucggggc

SEQ ID NO: 50733 - RNA, 17 nt, Human
agucuucccccaccuca

SEQ ID NO: 50734 - RNA, 26 nt, Human
acauuaaaauauuuagcugggcacag

SEQ ID NO: 50735 - RNA, 27 nt, Human
gggaugguguugucacaaacugugguu

SEQ ID NO: 50736 - RNA, 28 nt, Human
gggcaggguggggagggagccucgggug

SEQ ID NO: 50737 - RNA, 21 nt, Human
ccuccaauuccauuuucuccc

SEQ ID NO: 50738 - RNA, 27 nt, Human
gagggugagacacaggucaagcccaca

SEQ ID NO: 50739 - RNA, 21 nt, Human
cugcaugucuguuuacacuuc

SEQ ID NO: 50740 - RNA, 24 nt, Human
gggagggggauggugacugagaug

SEQ ID NO: 50741 - RNA, 22 nt, Human
ugugcuguacugagcacugaac

SEQ ID NO: 50742 - RNA, 22 nt, Human
uaauucuucccauuucaaaagg

SEQ ID NO: 50743 - RNA, 21 nt, Human
aagcaauauaccacuaaccug

SEQ ID NO: 50744 - RNA, 25 nt, Human
gcugggagaaagagagagcuucugu

SEQ ID NO: 50745 - RNA, 23 nt, Human
ugcucauuaauuuuuauuuacag

SEQ ID NO: 50746 - RNA, 21 nt, Human
agauucuuggacucaauuuua

SEQ ID NO: 50747 - RNA, 19 nt, Human
uuuuggaauuucugaguca

SEQ ID NO: 50748 - RNA, 23 nt, Human
cucccagagccccugucucgggc

SEQ ID NO: 50749 - RNA, 19 nt, Human
ccuagaacuucccuuaaga

SEQ ID NO: 50750 - RNA, 21 nt, Human
gaucuuccuuggagacucuga

SEQ ID NO: 50751 - RNA, 19 nt, Human
uguccaugugugugcagug

SEQ ID NO: 50752 - RNA, 23 nt, Human
ugcucacugcagccccucugccc

SEQ ID NO: 50753 - RNA, 21 nt, Human
uaauuaguuuaaaaugucacu

SEQ ID NO: 50754 - RNA, 18 nt, Human
caggugcucaccaccaca

SEQ ID NO: 50755 - RNA, 25 nt, Human
uaaaacaauugcagauugcuaagua

SEQ ID NO: 50756 - RNA, 23 nt, Human
gaacacacuagagaaccaaaaau

SEQ ID NO: 50757 - RNA, 21 nt, Human
ggugcucaggcugggcucucc

SEQ ID NO: 50758 - RNA, 24 nt, Human
cccgcuccccacucagugccacuc

SEQ ID NO: 50759 - RNA, 23 nt, Human
gccuucaucuguucagucaucuc

SEQ ID NO: 50760 - RNA, 19 nt, Human
cccaccccucaccccaucu

SEQ ID NO: 50761 - RNA, 24 nt, Human
acucaggcccagcucaugcccuuu

SEQ ID NO: 50762 - RNA, 22 nt, Human
ccuccuuccauuccuaagcucu

SEQ ID NO: 50763 - RNA, 27 nt, Human
gggcuggaauucuggcggauggcacga

SEQ ID NO: 50764 - RNA, 16 nt, Human
gguucugcagagggcc

SEQ ID NO: 50765 - RNA, 21 nt, Human
agaggcaccucaagaagaaga

SEQ ID NO: 50766 - RNA, 27 nt, Human
cacuuccuggguauaugacucggcaca

SEQ ID NO: 50767 - RNA, 22 nt, Human
gcugggcccgggagacuggacu

SEQ ID NO: 50768 - RNA, 20 nt, Human
gaugcauucacuucuccuuu

SEQ ID NO: 50769 - RNA, 20 nt, Human
ccugagauuuccuccuggcc

SEQ ID NO: 50770 - RNA, 24 nt, Human
cugagacugaaauguggggaucca

SEQ ID NO: 50771 - RNA, 26 nt, Human
gaaauuguuuuugucuccaaaagucu

SEQ ID NO: 50772 - RNA, 22 nt, Human
ggcucacugcagccuccaccuc

SEQ ID NO: 50773 - RNA, 20 nt, Human
uagagacauugcuguuccug

SEQ ID NO: 50774 - RNA, 22 nt, Human
caccuguaaucucagcacuuug

SEQ ID NO: 50775 - RNA, 22 nt, Human
cacuuguaaucccagcacuuug

SEQ ID NO: 50776 - RNA, 21 nt, Human
agccuccuucccugccugccc

SEQ ID NO: 50777 - RNA, 22 nt, Human
cagauguuugugccuuuucuuu

SEQ ID NO: 50778 - RNA, 19 nt, Human
uucagugguccagcuuuau

SEQ ID NO: 50779 - RNA, 32 nt, Human
cuaccaguaugugcuacuacuaacauucuuca

SEQ ID NO: 50780 - RNA, 19 nt, Human
cucuccggaagcaggcugg

SEQ ID NO: 50781 - RNA, 25 nt, Human
gcugugcacaccugcucucuccucu

SEQ ID NO: 50782 - RNA, 23 nt, Human
cuccucccuaaugcucaccuuua

SEQ ID NO: 50783 - RNA, 20 nt, Human
ugucugacuucuacucuguc

SEQ ID NO: 50784 - RNA, 27 nt, Human
cacagcccggcccgaccuggagggccc

SEQ ID NO: 50785 - RNA, 22 nt, Human
ccugacauccacuguuugccuu

SEQ ID NO: 50786 - RNA, 24 nt, Human
acuggacaucucauccauucucau

SEQ ID NO: 50787 - RNA, 23 nt, Human
cuguacacuccuccuuuucuguu

SEQ ID NO: 50788 - RNA, 17 nt, Human
caggcagcacccagaac

SEQ ID NO: 50789 - RNA, 22 nt, Human
ugcagcucacugcugcugccuc

SEQ ID NO: 50790 - RNA, 22 nt, Human
uguccugccagcacugagggcu

SEQ ID NO: 50791 - RNA, 19 nt, Human
ugaacaaacaggugcucca

SEQ ID NO: 50792 - RNA, 21 nt, Human
uccuaagauuaaaaacaaaug

SEQ ID NO: 50793 - RNA, 26 nt, Human
gucaagugauucuccugccucagccu

SEQ ID NO: 50794 - RNA, 18 nt, Human
ucaguuacacaugaucau

SEQ ID NO: 50795 - RNA, 24 nt, Human
uguacccaggcaagagagaagcaa

SEQ ID NO: 50796 - RNA, 21 nt, Human
aucgaugaagcacuuuuuuau

SEQ ID NO: 50797 - RNA, 21 nt, Human
acaagugucucuguguguggg

SEQ ID NO: 50798 - RNA, 24 nt, Human
caggcaagccggcccccaccucuc

SEQ ID NO: 50799 - RNA, 25 nt, Human
ggcacaauaaacauucucuguuuug

SEQ ID NO: 50800 - RNA, 19 nt, Human
uuguaaaauauuuucugcu

SEQ ID NO: 50801 - RNA, 22 nt, Human
cgcccaggccugggaugcagug

SEQ ID NO: 50802 - RNA, 23 nt, Human
ucucagccgccgcucugccccgc

SEQ ID NO: 50803 - RNA, 22 nt, Human
cuguuccugaugggcugugggg

SEQ ID NO: 50804 - RNA, 23 nt, Human
ggagcagcacuggcaggagcugc

SEQ ID NO: 50805 - RNA, 22 nt, Human
uuggaagcugucuguggcccac

SEQ ID NO: 50806 - RNA, 22 nt, Human
gucaugagaagucaagcaugga

SEQ ID NO: 50807 - RNA, 27 nt, Human
ccagccagacccuggagagcucacaga

SEQ ID NO: 50808 - RNA, 28 nt, Human
gcaccugaucgcgagaccccaacggcug

SEQ ID NO: 50809 - RNA, 22 nt, Human
cacagccgccugaaagccacaa

SEQ ID NO: 50810 - RNA, 21 nt, Human
uaguagauguucuacuuuguu

SEQ ID NO: 50811 - RNA, 21 nt, Human
uccacgcccuggggagugagc

SEQ ID NO: 50812 - RNA, 32 nt, Human
ggagcacacggcaccuuuccccagagccccag

SEQ ID NO: 50813 - RNA, 26 nt, Human
aaccuguagaagaugaccucguuccg

SEQ ID NO: 50814 - RNA, 26 nt, Human
guuaacuguuaacucuugccguauca

SEQ ID NO: 50815 - RNA, 27 nt, Human
ugcuaccugcuguauuuauuauaugga

SEQ ID NO: 50816 - RNA, 22 nt, Human
uauucuacuggccaugaugcca

SEQ ID NO: 50817 - RNA, 24 nt, Human
ccugcugcugccggccgcccagac

SEQ ID NO: 50818 - RNA, 23 nt, Human
agugaagccucugagggauugag

SEQ ID NO: 50819 - RNA, 26 nt, Human
uggaaagagaugcacgcaguuggcuc

SEQ ID NO: 50820 - RNA, 27 nt, Human
aacccaggcagcuggcaggaguggggu

SEQ ID NO: 50821 - RNA, 23 nt, Human
ccuccugccgaccacacggaguu

SEQ ID NO: 50822 - RNA, 19 nt, Human
acccaggcuggaguggagu

SEQ ID NO: 50823 - RNA, 19 nt, Human
acccaggguggagugcagu

SEQ ID NO: 50824 - RNA, 21 nt, Human
cgcugcacucuagccugggug

SEQ ID NO: 50825 - RNA, 22 nt, Human
ucaagaucacugggaccaggcc

SEQ ID NO: 50826 - RNA, 22 nt, Human
gcucacugcagccuccgccucc

SEQ ID NO: 50827 - RNA, 22 nt, Human
accagccuaaacaacauaguga

SEQ ID NO: 50828 - RNA, 22 nt, Human
guugcuuguaaaauuucacuua

SEQ ID NO: 50829 - RNA, 23 nt, Human
ucucaaacuccugaccucaggug

SEQ ID NO: 50830 - RNA, 20 nt, Human
ucccugggcaaagauuuccu

SEQ ID NO: 50831 - RNA, 24 nt, Human
gcaagggcuuagggguuggaggug

SEQ ID NO: 50832 - RNA, 20 nt, Human
ggacgccaccuuccccagga

SEQ ID NO: 50833 - RNA, 27 nt, Human
guugcccaggcuagagugcaauggcgc

SEQ ID NO: 50834 - RNA, 20 nt, Human
auugcaaaagccucuauaga

SEQ ID NO: 50835 - RNA, 21 nt, Human
guccucucccaaacugaccag

SEQ ID NO: 50836 - RNA, 21 nt, Human
ccuugcuacuuuuaaaaacuu

SEQ ID NO: 50837 - RNA, 31 nt, Human
gcuggaucuguuugcaugcaggaugaagagg

SEQ ID NO: 50838 - RNA, 20 nt, Human
ucuccuuuuacugugucuug

SEQ ID NO: 50839 - RNA, 23 nt, Human
ccggccgccucgcccuuccccgg

SEQ ID NO: 50840 - RNA, 19 nt, Human
caaguccccguccaaaaag

SEQ ID NO: 50841 - RNA, 20 nt, Human
aacucacaccccugccccca

SEQ ID NO: 50842 - RNA, 30 nt, Human
ggaaaugguuucacuugcucuuugacuguc

SEQ ID NO: 50843 - RNA, 23 nt, Human
guuuucauuuuggggugaagauu

SEQ ID NO: 50844 - RNA, 22 nt, Human
uccgucccucuaucucuggcuc

SEQ ID NO: 50845 - RNA, 25 nt, Human
gcccaggcugcagugcaguggugug

SEQ ID NO: 50846 - RNA, 22 nt, Human
cacugcacugcagccuggguga

SEQ ID NO: 50847 - RNA, 27 nt, Human
uucaguuacuguuucugauuuaaugua

SEQ ID NO: 50848 - RNA, 21 nt, Human
guagaacugagaaggagaagc

SEQ ID NO: 50849 - RNA, 19 nt, Human
ugaauugaaaaagggcagg

SEQ ID NO: 50850 - RNA, 21 nt, Human
cuguucucugagaguaccaug

SEQ ID NO: 50851 - RNA, 24 nt, Human
agccucacugccugcuuauugccu

SEQ ID NO: 50852 - RNA, 22 nt, Human
ggagucugcacaugcagcugca

SEQ ID NO: 50853 - RNA, 21 nt, Human
ucuaguauuuucuuucucaau

SEQ ID NO: 50854 - RNA, 24 nt, Human
acccaggcuggagugcagugcugc

SEQ ID NO: 50855 - RNA, 27 nt, Human
ugccuguaaucccagcacuuggagagg

SEQ ID NO: 50856 - RNA, 25 nt, Human
cacacagucuucacugugcugcagc

SEQ ID NO: 50857 - RNA, 23 nt, Human
uuagguuuuauguuauaucugca

SEQ ID NO: 50858 - RNA, 24 nt, Human
gccagcuccucacaccacagccag

SEQ ID NO: 50859 - RNA, 27 nt, Human
auugcacuucacucugccuguuuucaa

SEQ ID NO: 50860 - RNA, 27 nt, Human
uuugcuucagcaggauccuugugggcc

SEQ ID NO: 50861 - RNA, 21 nt, Human
gagcuaacccggaggaaaggc

SEQ ID NO: 50862 - RNA, 29 nt, Human
uccucaaaagagaauucagucuacagcca

SEQ ID NO: 50863 - RNA, 23 nt, Human
ugcaugaaucuaccugaguugcu

SEQ ID NO: 50864 - RNA, 23 nt, Human
gcccaguggugucucugagcgcg

SEQ ID NO: 50865 - RNA, 24 nt, Human
gcauuaguuaccacagccagccca

SEQ ID NO: 50866 - RNA, 22 nt, Human
ggccuaaacccacauuuucucu

SEQ ID NO: 50867 - RNA, 22 nt, Human
aggcaaccucugccuucuuccc

SEQ ID NO: 50868 - RNA, 25 nt, Human
cuucaaccuugagacagcuucgguu

SEQ ID NO: 50869 - RNA, 22 nt, Human
ucucugcuuagguuuugcuugg

SEQ ID NO: 50870 - RNA, 25 nt, Human
uggagauguugugugcaaugcuggc

SEQ ID NO: 50871 - RNA, 23 nt, Human
cccucugcgggcuucucuugcuc

SEQ ID NO: 50872 - RNA, 21 nt, Human
ccaugauaagagcaaggcugu

SEQ ID NO: 50873 - RNA, 22 nt, Human
auuuugggaacuccugccuuau

SEQ ID NO: 50874 - RNA, 21 nt, Human
ccuaucccaccuccaucccag

SEQ ID NO: 50875 - RNA, 22 nt, Human
uaaugaugucugacaugcuauu

SEQ ID NO: 50876 - RNA, 22 nt, Human
guuggccaggcuggagugcagu

SEQ ID NO: 50877 - RNA, 27 nt, Human
cugagguacagcggcgguuucugaggu

SEQ ID NO: 50878 - RNA, 21 nt, Human
uguuauucucggacugugaau

SEQ ID NO: 50879 - RNA, 25 nt, Human
agaagcauucaggcacugccaggcu

SEQ ID NO: 50880 - RNA, 22 nt, Human
gagacaaaagcaguuucucucc

SEQ ID NO: 50881 - RNA, 20 nt, Human
cccagccuuuguucugcacu

SEQ ID NO: 50882 - RNA, 22 nt, Human
guauguguaggcaguuuagugc

SEQ ID NO: 50883 - RNA, 27 nt, Human
auuacacggccuggggucucugccuuc

SEQ ID NO: 50884 - RNA, 22 nt, Human
ccaaguagcuuggacuauaggu

SEQ ID NO: 50885 - RNA, 20 nt, Human
uccuccagaaagcaccaagg

SEQ ID NO: 50886 - RNA, 22 nt, Human
ugcagugagccauaaucgugcc

SEQ ID NO: 50887 - RNA, 24 nt, Human
cagccagggcuuccuuagcuuuga

SEQ ID NO: 50888 - RNA, 22 nt, Human
gaggcacaagaaaaagcauugg

SEQ ID NO: 50889 - RNA, 22 nt, Human
uuagcuacugcgccucugacaa

SEQ ID NO: 50890 - RNA, 27 nt, Human
ccugcaguauuaguucuugcagcuggu

SEQ ID NO: 50891 - RNA, 25 nt, Human
ccaggagucccugguaauaaguacu

SEQ ID NO: 50892 - RNA, 20 nt, Human
aacauacacuauagcacuuu

SEQ ID NO: 50893 - RNA, 27 nt, Human
gucuauaaagcauuuaagcugccugua

SEQ ID NO: 50894 - RNA, 22 nt, Human
guacuuuccuuucgcuauucau

SEQ ID NO: 50895 - RNA, 23 nt, Human
cuccuagggaggcucugagggga

SEQ ID NO: 50896 - RNA, 22 nt, Human
cccacuguccuggccuggagcu

SEQ ID NO: 50897 - RNA, 20 nt, Human
ggacuccuccuuuauuucag

SEQ ID NO: 50898 - RNA, 22 nt, Human
uccaagugauacuucugccuug

SEQ ID NO: 50899 - RNA, 27 nt, Human
ucucaaaugcuggcaaauccaggcugg

SEQ ID NO: 50900 - RNA, 23 nt, Human
aggaucuuauuuggaauugacau

SEQ ID NO: 50901 - RNA, 24 nt, Human
ugcucaggaagagauuuaagcaug

SEQ ID NO: 50902 - RNA, 23 nt, Human
ccagauugaucaucuccccuggc

SEQ ID NO: 50903 - RNA, 23 nt, Human
gacaguuuaauucaggaacugug

SEQ ID NO: 50904 - RNA, 23 nt, Human
caucagccuuuuaccaucauguc

SEQ ID NO: 50905 - RNA, 26 nt, Human
ccucuuuccugucuguguaaauuguu

SEQ ID NO: 50906 - RNA, 29 nt, Human
accaguggccuggccgaccugcucuggcc

SEQ ID NO: 50907 - RNA, 27 nt, Human
ccaagcccacccccaaauauaacuguu

SEQ ID NO: 50908 - RNA, 30 nt, Human
gagaguggggagacaggcagcaaagcuuau

SEQ ID NO: 50909 - RNA, 28 nt, Human
aauuguguaacuguucuuugcagugaag

SEQ ID NO: 50910 - RNA, 27 nt, Human
gauccucccaccucaaccuucggagua

SEQ ID NO: 50911 - RNA, 21 nt, Human
accccuuccuccccauacucc

SEQ ID NO: 50912 - RNA, 22 nt, Human
ucuuuugcucucucauucccag

SEQ ID NO: 50913 - RNA, 27 nt, Human
cagagcucccaguccccgaggcuugaa

SEQ ID NO: 50914 - RNA, 21 nt, Human
cugugcuccugggccugugac

SEQ ID NO: 50915 - RNA, 21 nt, Human
gcaguccacaguguuuacaga

SEQ ID NO: 50916 - RNA, 26 nt, Human
auggaaagacugggacagcccaggaa

SEQ ID NO: 50917 - RNA, 20 nt, Human
guguucugcuuuauauguua

SEQ ID NO: 50918 - RNA, 23 nt, Human
ggggucggguguccgggagccag

SEQ ID NO: 50919 - RNA, 21 nt, Human
aggagaaaaaauuaagagaua

SEQ ID NO: 50920 - RNA, 23 nt, Human
gaggcaggauaccuggagauuug

SEQ ID NO: 50921 - RNA, 24 nt, Human
uugauuauauuuaaaaguaauaca

SEQ ID NO: 50922 - RNA, 28 nt, Human
aggaguugucaaggcagagaagagagug

SEQ ID NO: 50923 - RNA, 20 nt, Human
cagcagcagauacuggugag

SEQ ID NO: 50924 - RNA, 24 nt, Human
ucucuguuccucugggguggucca

SEQ ID NO: 50925 - RNA, 27 nt, Human
ccugcugccugcacaccacaucgccua

SEQ ID NO: 50926 - RNA, 27 nt, Human
cugggaggcgagcagcucugcaguuaa

SEQ ID NO: 50927 - RNA, 24 nt, Human
cccucccugccccaggacuuaaag

SEQ ID NO: 50928 - RNA, 25 nt, Human
ugcgcgugagaggucccagauacgu

SEQ ID NO: 50929 - RNA, 18 nt, Human
auucaugccccaguauua

SEQ ID NO: 50930 - RNA, 29 nt, Human
gguaauccggaguggcaauggaguggcug

SEQ ID NO: 50931 - RNA, 24 nt, Human
gcacugcgacugcccagucuggcc

SEQ ID NO: 50932 - RNA, 24 nt, Human
ugccuggccucugccuccacccuc

SEQ ID NO: 50933 - RNA, 27 nt, Human
cugucuaaaccuccuacuccucaacuc

SEQ ID NO: 50934 - RNA, 23 nt, Human
ggagagguuauaggucacuccug

SEQ ID NO: 50935 - RNA, 19 nt, Human
cuuaagcccagauaugaga

SEQ ID NO: 50936 - RNA, 19 nt, Human
ugccuucuccauuacuuga

SEQ ID NO: 50937 - RNA, 21 nt, Human
gcccucucacagaggaugggu

SEQ ID NO: 50938 - RNA, 23 nt, Human
auggggaugacccugacaggugc

SEQ ID NO: 50939 - RNA, 22 nt, Human
cucagagugcugggaucacagg

SEQ ID NO: 50940 - RNA, 22 nt, Human
gcaaaacugaaaggcaugugaa

SEQ ID NO: 50941 - RNA, 22 nt, Human
auugcucaucucaguccucaaa

SEQ ID NO: 50942 - RNA, 24 nt, Human
gucuuagggucaagugaucuuuau

SEQ ID NO: 50943 - RNA, 21 nt, Human
gguguuuuguucaaucuggaa

SEQ ID NO: 50944 - RNA, 20 nt, Human
cgccucgggcgcuguaccca

SEQ ID NO: 50945 - RNA, 20 nt, Human
ucuguguguuuguguguauc

SEQ ID NO: 50946 - RNA, 27 nt, Human
cugaguauuuuauuaacaccugauuug

SEQ ID NO: 50947 - RNA, 23 nt, Human
gauacuucccuuccuaauuauca

SEQ ID NO: 50948 - RNA, 21 nt, Human
uuuaccccuucuccuccagca

SEQ ID NO: 50949 - RNA, 27 nt, Human
agguacccccacgccugcaguccccgc

SEQ ID NO: 50950 - RNA, 23 nt, Human
gcccccugaauauuaauucccua

SEQ ID NO: 50951 - RNA, 21 nt, Human
uccugccaccaugugggucag

SEQ ID NO: 50952 - RNA, 22 nt, Human
guagggcaugugguucaaagag

SEQ ID NO: 50953 - RNA, 23 nt, Human
aucauguuaauagacaguagcca

SEQ ID NO: 50954 - RNA, 21 nt, Human
cagacugccuggguccuggcg

SEQ ID NO: 50955 - RNA, 17 nt, Human
ccuacuccugggucagg

SEQ ID NO: 50956 - RNA, 23 nt, Human
ccgagagaagcaggggagcucgg

SEQ ID NO: 50957 - RNA, 20 nt, Human
gcaguugaagggcaauauga

SEQ ID NO: 50958 - RNA, 20 nt, Human
ccuccucuggcacucaugcu

SEQ ID NO: 50959 - RNA, 27 nt, Human
gcagacaccaugaccacccuugaugau

SEQ ID NO: 50960 - RNA, 24 nt, Human
gcucacugcagcgcgcuccugacc

SEQ ID NO: 50961 - RNA, 20 nt, Human
cacccaaguggaaggugcua

SEQ ID NO: 50962 - RNA, 21 nt, Human
cacccuguuuuacaaaaaaga

SEQ ID NO: 50963 - RNA, 29 nt, Human
acuauuugacuuuuuaaaaucuucugaca

SEQ ID NO: 50964 - RNA, 19 nt, Human
gaugcguuuccuggcagcu

SEQ ID NO: 50965 - RNA, 22 nt, Human
aacaacacagagugcuggaagc

SEQ ID NO: 50966 - RNA, 22 nt, Human
ugucauuggaaacacugccuuu

SEQ ID NO: 50967 - RNA, 22 nt, Human
cuucccuuucucacucaccugc

SEQ ID NO: 50968 - RNA, 24 nt, Human
cucugaguuagcaagccuuccuca

SEQ ID NO: 50969 - RNA, 23 nt, Human
aucacaccagcguacaguagcua

SEQ ID NO: 50970 - RNA, 21 nt, Human
gauuagacuccauguaguuac

SEQ ID NO: 50971 - RNA, 25 nt, Human
uuucaauaucauuacuaacuucuuc

SEQ ID NO: 50972 - RNA, 22 nt, Human
ucagcugaaccuggauccugug

SEQ ID NO: 50973 - RNA, 22 nt, Human
agcaggagagugggcuagccug

SEQ ID NO: 50974 - RNA, 28 nt, Human
ccugcugcugcugcugcugcuaaucuuc

SEQ ID NO: 50975 - RNA, 27 nt, Human
agcagcauucuggaggggagagcuuug

SEQ ID NO: 50976 - RNA, 23 nt, Human
gacugggagagcccgagccagag

SEQ ID NO: 50977 - RNA, 23 nt, Human
aauccagggugguggugauaggu

SEQ ID NO: 50978 - RNA, 17 nt, Human
ccaucuacaacagcaga

SEQ ID NO: 50979 - RNA, 21 nt, Human
cucuucccccuccugcuccgg

SEQ ID NO: 50980 - RNA, 23 nt, Human
guauugaaaauggcuuucucagc

SEQ ID NO: 50981 - RNA, 17 nt, Human
aauguugcccuuugcca

SEQ ID NO: 50982 - RNA, 19 nt, Human
uuagaaaauucagcuccuu

SEQ ID NO: 50983 - RNA, 27 nt, Human
caguucuggaauggaaggguucuggcu

SEQ ID NO: 50984 - RNA, 23 nt, Human
uggugugggcuugggauccuccu

SEQ ID NO: 50985 - RNA, 20 nt, Human
gaaguuggggcacccuccuc

SEQ ID NO: 50986 - RNA, 23 nt, Human
agaauugcauccucagaugauua

SEQ ID NO: 50987 - RNA, 24 nt, Human
uggaucugcuuuguuuggcugcug

SEQ ID NO: 50988 - RNA, 22 nt, Human
uuuggaggacuuggcagcacag

SEQ ID NO: 50989 - RNA, 25 nt, Human
cgggugagguccgcgcagcugcugg

SEQ ID NO: 50990 - RNA, 21 nt, Human
cuuucuugucgcuggcagcug

SEQ ID NO: 50991 - RNA, 22 nt, Human
acucaggcuggagcacaguggu

SEQ ID NO: 50992 - RNA, 29 nt, Human
cggcaagcagcuagguugcaagaacauuc

SEQ ID NO: 50993 - RNA, 27 nt, Human
uccuggugucccucagaguaagccuga

SEQ ID NO: 50994 - RNA, 27 nt, Human
gggcggaaggggacuucgggagccagu

SEQ ID NO: 50995 - RNA, 22 nt, Human
ggcccgagcgccuggugcugag

SEQ ID NO: 50996 - RNA, 20 nt, Human
uagacuucucgaacaugagg

SEQ ID NO: 50997 - RNA, 23 nt, Human
guagagcugagaauacuacaucu

SEQ ID NO: 50998 - RNA, 27 nt, Human
acucugcuuucacguaccugugcucag

SEQ ID NO: 50999 - RNA, 23 nt, Human
ucccuucuugccuuccuuucucu

SEQ ID NO: 51000 - RNA, 25 nt, Human
acacccugggaguuuuaguagcuug

SEQ ID NO: 51001 - RNA, 22 nt, Human
uuuguaaagcucacuuuacuua

SEQ ID NO: 51002 - RNA, 21 nt, Human
ggucacugcaaccuccaccuc

SEQ ID NO: 51003 - RNA, 22 nt, Human
agaccagcguggucaacauggu

SEQ ID NO: 51004 - RNA, 27 nt, Human
uccaguaauauacuuaaauaagccaau

SEQ ID NO: 51005 - RNA, 26 nt, Human
uccagccuuaauuucuugcuccauaa

SEQ ID NO: 51006 - RNA, 24 nt, Human
uuagucgggugucauugugcauac

SEQ ID NO: 51007 - RNA, 20 nt, Human
gucugcucucagcuugugcc

SEQ ID NO: 51008 - RNA, 22 nt, Human
ccaagaucgcaacauugcacuc

SEQ ID NO: 51009 - RNA, 22 nt, Human
aaagugcugagauugcagaugu

SEQ ID NO: 51010 - RNA, 21 nt, Human
ggcuaugaggaaacugaguca

SEQ ID NO: 51011 - RNA, 22 nt, Human
aacugcugauuugauggagcua

SEQ ID NO: 51012 - RNA, 18 nt, Human
aucucucaaaggcagcag

SEQ ID NO: 51013 - RNA, 20 nt, Human
uucucuuggcgacaggauuu

SEQ ID NO: 51014 - RNA, 21 nt, Human
uccaggaaccagguguccaag

SEQ ID NO: 51015 - RNA, 26 nt, Human
gccuggccaccagccauccucccucc

SEQ ID NO: 51016 - RNA, 19 nt, Human
cuuuuggggggcauauauu

SEQ ID NO: 51017 - RNA, 22 nt, Human
uuccauggagggaaaugggaca

SEQ ID NO: 51018 - RNA, 27 nt, Human
gagaagcuagucuugaauuccugaccu

SEQ ID NO: 51019 - RNA, 27 nt, Human
uagcagagagccaaaucugaccuaaaa

SEQ ID NO: 51020 - RNA, 22 nt, Human
aaacacuccuucuuagcacuuc

SEQ ID NO: 51021 - RNA, 24 nt, Human
ggugaagcuucgcuggcugccagg

SEQ ID NO: 51022 - RNA, 22 nt, Human
uugccccagggaaaugggcucu

SEQ ID NO: 51023 - RNA, 21 nt, Human
ucgccaggcuggagugcagug

SEQ ID NO: 51024 - RNA, 26 nt, Human
agauuggcaugccauugaaacuaaga

SEQ ID NO: 51025 - RNA, 26 nt, Human
uuucuaucauggaauauuuauaggcc

SEQ ID NO: 51026 - RNA, 18 nt, Human
ccuuggcuucuuuacuua

SEQ ID NO: 51027 - RNA, 20 nt, Human
ucacaugauuccagugcagu

SEQ ID NO: 51028 - RNA, 22 nt, Human
ugagggcaauugcguugcucaa

SEQ ID NO: 51029 - RNA, 32 nt, Human
uuucucagccuaacuccauccccaccgcuccc

SEQ ID NO: 51030 - RNA, 22 nt, Human
ucgucccggcugaagugcagug

SEQ ID NO: 51031 - RNA, 24 nt, Human
cccauugcugacgauuaguucuaa

SEQ ID NO: 51032 - RNA, 21 nt, Human
gagaucgcacuccagccuggg

SEQ ID NO: 51033 - RNA, 26 nt, Human
gggggacacggcccugcauucuggac

SEQ ID NO: 51034 - RNA, 22 nt, Human
cuaacuccugggcuuaagugau

SEQ ID NO: 51035 - RNA, 23 nt, Human
aaacaaaucguaucaguguuugu

SEQ ID NO: 51036 - RNA, 27 nt, Human
cucaaagcucccacgcagcucucccgc

SEQ ID NO: 51037 - RNA, 21 nt, Human
auacccuuuuucuuuuaguau

SEQ ID NO: 51038 - RNA, 22 nt, Human
uggcacaugccuguaaucccag

SEQ ID NO: 51039 - RNA, 22 nt, Human
uggcgcaugccuauaaucccag

SEQ ID NO: 51040 - RNA, 27 nt, Human
caggaauauguauuaagauuguggaau

SEQ ID NO: 51041 - RNA, 28 nt, Human
ggcuuuacauggguucaauuggacaauu

SEQ ID NO: 51042 - RNA, 20 nt, Human
ucugcccuagagucauuuac

SEQ ID NO: 51043 - RNA, 20 nt, Human
ugagcaaucugggcacuuuu

SEQ ID NO: 51044 - RNA, 28 nt, Human
agauugcaccacugcacuccagucuggg

SEQ ID NO: 51045 - RNA, 26 nt, Human
uguguagacaagcucucgcucuguca

SEQ ID NO: 51046 - RNA, 27 nt, Human
ccggcucccagugugcgcccggccggc

SEQ ID NO: 51047 - RNA, 20 nt, Human
guucauccguucaucuugcu

SEQ ID NO: 51048 - RNA, 19 nt, Human
ucaugcuguuuauguguga

SEQ ID NO: 51049 - RNA, 26 nt, Human
uacugcuugucaucugcaugucuacu

SEQ ID NO: 51050 - RNA, 19 nt, Human
uaagacaaaauuuaauugu

SEQ ID NO: 51051 - RNA, 19 nt, Human
ugagucuaauguaauuuug

SEQ ID NO: 51052 - RNA, 24 nt, Human
cucugcccacuuccauuggucucc

SEQ ID NO: 51053 - RNA, 28 nt, Human
cuggacccuggacugcagugcaggagau

SEQ ID NO: 51054 - RNA, 19 nt, Human
ggggagcagggugggcagg

SEQ ID NO: 51055 - RNA, 22 nt, Human
gcuucagagccucgggcucagg

SEQ ID NO: 51056 - RNA, 27 nt, Human
aguguuagagguguuagcuugcuagug

SEQ ID NO: 51057 - RNA, 20 nt, Human
uuuacuucucagugccaucu

SEQ ID NO: 51058 - RNA, 22 nt, Human
gaccuggagagcaggggcuggu

SEQ ID NO: 51059 - RNA, 22 nt, Human
uggaggugggguuggagcagga

SEQ ID NO: 51060 - RNA, 22 nt, Human
uucuggagaguuuguaaaacaa

SEQ ID NO: 51061 - RNA, 18 nt, Human
ccuccacuccugccucca

SEQ ID NO: 51062 - RNA, 18 nt, Human
cuuguacucuucucucca

SEQ ID NO: 51063 - RNA, 21 nt, Human
uaagauaaggagaggccaggc

SEQ ID NO: 51064 - RNA, 27 nt, Human
aaaacauuaagaaaaucauauugcuuc

SEQ ID NO: 51065 - RNA, 22 nt, Human
cugcuggcagggacuugcagug

SEQ ID NO: 51066 - RNA, 22 nt, Human
aacuucugggucaaaacucaaa

SEQ ID NO: 51067 - RNA, 22 nt, Human
gaccagccugggcaacauaggg

SEQ ID NO: 51068 - RNA, 27 nt, Human
ucuguucuguuucucuacuggguguuc

SEQ ID NO: 51069 - RNA, 22 nt, Human
auugcccagcgugaggagcgau

SEQ ID NO: 51070 - RNA, 27 nt, Human
gcgugccccaccaugucagacgcagcc

SEQ ID NO: 51071 - RNA, 24 nt, Human
ggucuaugaguagcuguguaugaa

SEQ ID NO: 51072 - RNA, 20 nt, Human
aaaaauauaaacaacaaaac

SEQ ID NO: 51073 - RNA, 20 nt, Human
uggcauggguggagugugug

SEQ ID NO: 51074 - RNA, 21 nt, Human
uggcuggguuuucaggggcuu

SEQ ID NO: 51075 - RNA, 19 nt, Human
auuagacaugaaaucugag

SEQ ID NO: 51076 - RNA, 21 nt, Human
guucccccuccuucuuuugua

SEQ ID NO: 51077 - RNA, 21 nt, Human
ugacccucaugugagcacuuu

SEQ ID NO: 51078 - RNA, 27 nt, Human
aguucacugcaugugcugcccccuugg

SEQ ID NO: 51079 - RNA, 25 nt, Human
uaguccuggacucgaaagggaaggu

SEQ ID NO: 51080 - RNA, 21 nt, Human
cugcuuccuguuuucuucuga

SEQ ID NO: 51081 - RNA, 21 nt, Human
ggagagggaaguaguggcagc

SEQ ID NO: 51082 - RNA, 32 nt, Human
caacugcccuguaaccaccaacugcccuuauu

SEQ ID NO: 51083 - RNA, 27 nt, Human
auugcuugacccagguagucaaaggca

SEQ ID NO: 51084 - RNA, 24 nt, Human
ccuagcuauuugaugagaagacca

SEQ ID NO: 51085 - RNA, 22 nt, Human
uauugcacuccagccuggguga

SEQ ID NO: 51086 - RNA, 22 nt, Human
ggucucaaacuccugaccugag

SEQ ID NO: 51087 - RNA, 22 nt, Human
ccaaccucacagccucguagag

SEQ ID NO: 51088 - RNA, 22 nt, Human
ccacagaaaagaaaguucaugc

SEQ ID NO: 51089 - RNA, 27 nt, Human
ccccaacagcuggacccugaccagcuc

SEQ ID NO: 51090 - RNA, 26 nt, Human
cuucugcugcaucgcuguucugggca

SEQ ID NO: 51091 - RNA, 21 nt, Human
uucacagaccucagcagggca

SEQ ID NO: 51092 - RNA, 22 nt, Human
cauuuucugaacuaaaaaccuc

SEQ ID NO: 51093 - RNA, 23 nt, Human
ccaagguuaaggaugcaccugug

SEQ ID NO: 51094 - RNA, 21 nt, Human
aaauguucugacagcauuuca

SEQ ID NO: 51095 - RNA, 19 nt, Human
gggccuacuuggugcagug

SEQ ID NO: 51096 - RNA, 22 nt, Human
gaugugaguuuaaucuuuucag

SEQ ID NO: 51097 - RNA, 27 nt, Human
gaggccgggagacagggacuggugaga

SEQ ID NO: 51098 - RNA, 21 nt, Human
gggaggcagagggaggaggga

SEQ ID NO: 51099 - RNA, 21 nt, Human
cacuguuuuggcuuucaugaa

SEQ ID NO: 51100 - RNA, 25 nt, Human
uguccccaccaacaccaggaauuua

SEQ ID NO: 51101 - RNA, 22 nt, Human
agagagggugaagcggagcagc

SEQ ID NO: 51102 - RNA, 21 nt, Human
aaccaguauccuucuagcucu

SEQ ID NO: 51103 - RNA, 17 nt, Human
aauacccuucacaugga

SEQ ID NO: 51104 - RNA, 22 nt, Human
ugccauucaaggcuuauuuaua

SEQ ID NO: 51105 - RNA, 25 nt, Human
uacuucaccuccaggaacugucaug

SEQ ID NO: 51106 - RNA, 27 nt, Human
gggaccaagccagagagggacagguau

SEQ ID NO: 51107 - RNA, 21 nt, Human
gacugacuuuuuucucacugu

SEQ ID NO: 51108 - RNA, 23 nt, Human
aguuuugggguacccugcuucac

SEQ ID NO: 51109 - RNA, 23 nt, Human
ugugcucagaagagcaccugccc

SEQ ID NO: 51110 - RNA, 23 nt, Human
gccauuuuacguaccagggaguc

SEQ ID NO: 51111 - RNA, 22 nt, Human
ggcaugaauccaggaggcagag

SEQ ID NO: 51112 - RNA, 22 nt, Human
gugcacaggugcccaggcucca

SEQ ID NO: 51113 - RNA, 27 nt, Human
cccaacaacaggaucacaagcuggaga

SEQ ID NO: 51114 - RNA, 24 nt, Human
uguacuccucugacuggagucuag

SEQ ID NO: 51115 - RNA, 23 nt, Human
gcaaaacugucauuuauugugaa

SEQ ID NO: 51116 - RNA, 27 nt, Human
gaaaguuagcauauuuauuaccaauga

SEQ ID NO: 51117 - RNA, 25 nt, Human
cucccaggcugcuggagugcagugg

SEQ ID NO: 51118 - RNA, 22 nt, Human
uuuaagaguaaguugguuacuu

SEQ ID NO: 51119 - RNA, 21 nt, Human
agagacacuugcaggacugaa

SEQ ID NO: 51120 - RNA, 22 nt, Human
ccagcucacaagcccaggcugg

SEQ ID NO: 51121 - RNA, 22 nt, Human
gacuacaggcgccagccaccau

SEQ ID NO: 51122 - RNA, 23 nt, Human
acuuuuaaaauauuaagugucuu

SEQ ID NO: 51123 - RNA, 22 nt, Human
cuaauggcacaggaaaaaccua

SEQ ID NO: 51124 - RNA, 23 nt, Human
ggagagcacggaaccgcacgcac

SEQ ID NO: 51125 - RNA, 23 nt, Human
ucuuucucccuccccuaccagcc

SEQ ID NO: 51126 - RNA, 26 nt, Human
ccucggcuauugugcuggcuggacac

SEQ ID NO: 51127 - RNA, 26 nt, Human
cggcugcaccugcuguucucuucuuu

SEQ ID NO: 51128 - RNA, 27 nt, Human
guugcccaggcuggugugcaauggcgu

SEQ ID NO: 51129 - RNA, 26 nt, Human
gguagaguuugaagagaagaucaugu

SEQ ID NO: 51130 - RNA, 21 nt, Human
cacacacaucccagcccuccg

SEQ ID NO: 51131 - RNA, 16 nt, Human
accuaaaaaugucuga

SEQ ID NO: 51132 - RNA, 24 nt, Human
ugucacccuuguccuugagugcuc

SEQ ID NO: 51133 - RNA, 31 nt, Human
cguggggcagccaccccugcccagcgagagc

SEQ ID NO: 51134 - RNA, 21 nt, Human
agccacaaugaacaucccuuu

SEQ ID NO: 51135 - RNA, 20 nt, Human
uuugaacugccuuacauguu

SEQ ID NO: 51136 - RNA, 28 nt, Human
agccccuuucacacucuguccuccuauc

SEQ ID NO: 51137 - RNA, 19 nt, Human
auauuuuaaaaggagaauu

SEQ ID NO: 51138 - RNA, 29 nt, Human
gcccucuccucccccuccuaggggguguc

SEQ ID NO: 51139 - RNA, 27 nt, Human
acucagggcauucuguuggccuaagug

SEQ ID NO: 51140 - RNA, 28 nt, Human
aaagcaccgagucaggugccugauacgc

SEQ ID NO: 51141 - RNA, 22 nt, Human
ggucucgaacucuuggccucag

SEQ ID NO: 51142 - RNA, 28 nt, Human
cuuugccgccucuccaucgucuugggcc

SEQ ID NO: 51143 - RNA, 18 nt, Human
ggggaggugucacacaac

SEQ ID NO: 51144 - RNA, 23 nt, Human
cagcugggggaaaggcaguucug

SEQ ID NO: 51145 - RNA, 23 nt, Human
acucagaugggguucauguggga

SEQ ID NO: 51146 - RNA, 21 nt, Human
acuuuauagaauccucucugu

SEQ ID NO: 51147 - RNA, 23 nt, Human
uaagguuaggagaaaaccucagu

SEQ ID NO: 51148 - RNA, 21 nt, Human
auucagaaugauaaccucuuu

SEQ ID NO: 51149 - RNA, 27 nt, Human
ggccuggauguuugccugguccgugag

SEQ ID NO: 51150 - RNA, 27 nt, Human
ucauuuaauccucucaaccaccuuuca

SEQ ID NO: 51151 - RNA, 25 nt, Human
cguggguggugggcccauggcagag

SEQ ID NO: 51152 - RNA, 22 nt, Human
uagaaccuuccugggacucugg

SEQ ID NO: 51153 - RNA, 21 nt, Human
ugagugagcugaauucuugcc

SEQ ID NO: 51154 - RNA, 25 nt, Human
gguccauccauuuccaaaccuccac

SEQ ID NO: 51155 - RNA, 19 nt, Human
gucacuucccgccuccucc

SEQ ID NO: 51156 - RNA, 22 nt, Human
gacagaaugaagagacugagca

SEQ ID NO: 51157 - RNA, 21 nt, Human
ccaaaaugcugcaauguagcu

SEQ ID NO: 51158 - RNA, 26 nt, Human
ucuagggacaccuggugauuccuaca

SEQ ID NO: 51159 - RNA, 24 nt, Human
cacaaauauagaaaaguauacaaa

SEQ ID NO: 51160 - RNA, 22 nt, Human
gaggugcccacccagcuacugg

SEQ ID NO: 51161 - RNA, 20 nt, Human
cuuaaagguaaucauuucag

SEQ ID NO: 51162 - RNA, 22 nt, Human
ucauuuuucauuugccaaccaa

SEQ ID NO: 51163 - RNA, 18 nt, Human
acgcccaggguuacuuga

SEQ ID NO: 51164 - RNA, 21 nt, Human
cugaguagcuggauuacaggc

SEQ ID NO: 51165 - RNA, 27 nt, Human
ggcuggucccuaugucaugucuuccau

SEQ ID NO: 51166 - RNA, 21 nt, Human
cacuacauccaucuaugccau

SEQ ID NO: 51167 - RNA, 21 nt, Human
cuagcaucuucucuaccuuca

SEQ ID NO: 51168 - RNA, 16 nt, Human
cuucccuucauggcgu

SEQ ID NO: 51169 - RNA, 14 nt, Human
caggcagccaguga

SEQ ID NO: 51170 - RNA, 23 nt, Human
gcugccaggcugcagccugcugc

SEQ ID NO: 51171 - RNA, 20 nt, Human
guggggauaucagggcacag

SEQ ID NO: 51172 - RNA, 23 nt, Human
uggcuucauuuuauacuacuuug

SEQ ID NO: 51173 - RNA, 27 nt, Human
cagggaggaaggcagcuagaaauggga

SEQ ID NO: 51174 - RNA, 27 nt, Human
uuuucucacuauguaugcagacuggac

SEQ ID NO: 51175 - RNA, 30 nt, Human
uggggaagggaggggagacuaugugugagc

SEQ ID NO: 51176 - RNA, 20 nt, Human
ccucaccauccuucagucua

SEQ ID NO: 51177 - RNA, 25 nt, Human
gacauauagaacagcgcauucuucu

SEQ ID NO: 51178 - RNA, 18 nt, Human
ggugccugccuugcuucu

SEQ ID NO: 51179 - RNA, 20 nt, Human
gacuauguuccaauaaaacu

SEQ ID NO: 51180 - RNA, 20 nt, Human
uucucagagcccaggugccc

SEQ ID NO: 51181 - RNA, 27 nt, Human
gcuaauguaaacuuugucaugguuucc

SEQ ID NO: 51182 - RNA, 27 nt, Human
cuugggcaacagaguaagacucugucu

SEQ ID NO: 51183 - RNA, 27 nt, Human
cggcaggcucaggugcagccgcugcuc

SEQ ID NO: 51184 - RNA, 19 nt, Human
ugaugaggacagaacugua

SEQ ID NO: 51185 - RNA, 27 nt, Human
gggcuccugcccaggggcuugucaccu

SEQ ID NO: 51186 - RNA, 19 nt, Human
agccuccguucccaccucu

SEQ ID NO: 51187 - RNA, 29 nt, Human
cucuuguuugaaucugucauucaaaggcc

SEQ ID NO: 51188 - RNA, 22 nt, Human
cguugcacuccagccugggcga

SEQ ID NO: 51189 - RNA, 20 nt, Human
ugggaagcuggcaaucugca

SEQ ID NO: 51190 - RNA, 25 nt, Human
guggcaggaacaacuauccucgucu

SEQ ID NO: 51191 - RNA, 24 nt, Human
aggauugccuuuaauauuuuguaa

SEQ ID NO: 51192 - RNA, 23 nt, Human
ggcuaaaacaaaucucagaacag

SEQ ID NO: 51193 - RNA, 27 nt, Human
accaugcagauaaggagccucuggcaa

SEQ ID NO: 51194 - RNA, 23 nt, Human
gcuuuuuauuccuccugcucaua

SEQ ID NO: 51195 - RNA, 22 nt, Human
cacuccucauagcaauacuugg

SEQ ID NO: 51196 - RNA, 25 nt, Human
acuaaguaaucucacagcauuugcc

SEQ ID NO: 51197 - RNA, 21 nt, Human
acaaacucacagcacagugug

SEQ ID NO: 51198 - RNA, 25 nt, Human
ggccucaggagcugggggugcagug

SEQ ID NO: 51199 - RNA, 30 nt, Human
gaucucuuuaggaugacuguauuuuucagu

SEQ ID NO: 51200 - RNA, 19 nt, Human
guaggcaguuuccuccuca

SEQ ID NO: 51201 - RNA, 20 nt, Human
caguuucauccccaucccca

SEQ ID NO: 51202 - RNA, 22 nt, Human
gggagcugggcuaacaggcuga

SEQ ID NO: 51203 - RNA, 23 nt, Human
cacagccccaggcacaguggcag

SEQ ID NO: 51204 - RNA, 26 nt, Human
cugcagagggcaggucuagggcagaa

SEQ ID NO: 51205 - RNA, 24 nt, Human
ucaugaucucaccuauacuuuggg

SEQ ID NO: 51206 - RNA, 21 nt, Human
acuguuuccccucucagcauc

SEQ ID NO: 51207 - RNA, 22 nt, Human
agcuccggguugggcugagaug

SEQ ID NO: 51208 - RNA, 21 nt, Human
gccuuucuccaccggaggacc

SEQ ID NO: 51209 - RNA, 22 nt, Human
agggacugacuucaaagaagga

SEQ ID NO: 51210 - RNA, 27 nt, Human
gagaccaagacucugaaaucucagaau

SEQ ID NO: 51211 - RNA, 27 nt, Human
cuucuuucacauaaugcugucucagcu

SEQ ID NO: 51212 - RNA, 27 nt, Human
aauaagaaagcggcuccuacuccaggc

SEQ ID NO: 51213 - RNA, 21 nt, Human
gaucauaccacugcacugcag

SEQ ID NO: 51214 - RNA, 23 nt, Human
gaacugcacuacaagacacuuug

SEQ ID NO: 51215 - RNA, 20 nt, Human
cugccaggcuggaguggagu

SEQ ID NO: 51216 - RNA, 21 nt, Human
agccccgggcucugauagaga

SEQ ID NO: 51217 - RNA, 22 nt, Human
cccagccucccaaagugcuaag

SEQ ID NO: 51218 - RNA, 21 nt, Human
aaauuaauuugguuuucaggu

SEQ ID NO: 51219 - RNA, 22 nt, Human
ugaugaucccaggaggcucugg

SEQ ID NO: 51220 - RNA, 22 nt, Human
gagcccaggaguuggaggcuga

SEQ ID NO: 51221 - RNA, 22 nt, Human
gggucuaauuuuagcuccagcc

SEQ ID NO: 51222 - RNA, 21 nt, Human
caggugucacccuguucucaa

SEQ ID NO: 51223 - RNA, 28 nt, Human
uuguucaaagauccagugcaguuuuucu

SEQ ID NO: 51224 - RNA, 22 nt, Human
aaaggcuggggcacuaugagua

SEQ ID NO: 51225 - RNA, 23 nt, Human
acuuacaggccuugcucacagcu

SEQ ID NO: 51226 - RNA, 27 nt, Human
gggugcacggccgggcaccacaguggg

SEQ ID NO: 51227 - RNA, 22 nt, Human
gguugaaagccauccuacuuua

SEQ ID NO: 51228 - RNA, 24 nt, Human
gggcgccuguaaucccaguuacuc

SEQ ID NO: 51229 - RNA, 18 nt, Human
ccuccugcucggggggcu

SEQ ID NO: 51230 - RNA, 20 nt, Human
ggcuugagugcaguggugcg

SEQ ID NO: 51231 - RNA, 27 nt, Human
ccugcuuagaagccagucaccagcccu

SEQ ID NO: 51232 - RNA, 24 nt, Human
guaaagcauccucuaccucucagc

SEQ ID NO: 51233 - RNA, 27 nt, Human
cuguggaaauggugagcgcugugagau

SEQ ID NO: 51234 - RNA, 23 nt, Human
auacaaaaauuggcugggcaugg

SEQ ID NO: 51235 - RNA, 21 nt, Human
aggcuacaauuuucucccagg

SEQ ID NO: 51236 - RNA, 20 nt, Human
uucuuagcucauucuccuug

SEQ ID NO: 51237 - RNA, 23 nt, Human
gugaggagguagauuuggcuccu

SEQ ID NO: 51238 - RNA, 29 nt, Human
cuuuggcagaugaagcucagucucugaaa

SEQ ID NO: 51239 - RNA, 21 nt, Human
cugacuucucuuugugcagag

SEQ ID NO: 51240 - RNA, 21 nt, Human
ccguucccagcugcuccuggg

SEQ ID NO: 51241 - RNA, 22 nt, Human
ucuucucucuuucuccuucaaa

SEQ ID NO: 51242 - RNA, 17 nt, Human
ugaacaaccucaauuuc

SEQ ID NO: 51243 - RNA, 26 nt, Human
caggccccaaacuaccagccguaucu

SEQ ID NO: 51244 - RNA, 27 nt, Human
gaggagccgcccagauucuugcagugg

SEQ ID NO: 51245 - RNA, 26 nt, Human
agccuccuucuccuggguccaagcaa

SEQ ID NO: 51246 - RNA, 20 nt, Human
aauuauucuuuagcagugua

SEQ ID NO: 51247 - RNA, 22 nt, Human
ccuagggcuaccauuuccuagc

SEQ ID NO: 51248 - RNA, 23 nt, Human
caaagagauaaugucacagugcu

SEQ ID NO: 51249 - RNA, 29 nt, Human
ucucuucuuuuuucuggaccucaguuucc

SEQ ID NO: 51250 - RNA, 27 nt, Human
cuugcugucuuuugugccucugcaagc

SEQ ID NO: 51251 - RNA, 20 nt, Human
caaucagcucagcauucucc

SEQ ID NO: 51252 - RNA, 23 nt, Human
acauguguaauacauaucuggga

SEQ ID NO: 51253 - RNA, 21 nt, Human
aggcuaccauugcauuuuccu

SEQ ID NO: 51254 - RNA, 26 nt, Human
cgggggcagaggcuuucucugggugc

SEQ ID NO: 51255 - RNA, 22 nt, Human
aauacagucaguagauguuuua

SEQ ID NO: 51256 - RNA, 26 nt, Human
agcucaggcuggagcaggcauaugag

SEQ ID NO: 51257 - RNA, 22 nt, Human
accauaaaaagaggaugauuuc

SEQ ID NO: 51258 - RNA, 21 nt, Human
gguguguuacgugggggagag

SEQ ID NO: 51259 - RNA, 23 nt, Human
uagggagggcucugucucuaagc

SEQ ID NO: 51260 - RNA, 22 nt, Human
ccgcccaggcuggagugcagug

SEQ ID NO: 51261 - RNA, 27 nt, Human
gccagcuguguucacacuguaaacauu

SEQ ID NO: 51262 - RNA, 21 nt, Human
cauugcacuucagccugggcg

SEQ ID NO: 51263 - RNA, 23 nt, Human
uauuugacuuacuaguucucaau

SEQ ID NO: 51264 - RNA, 23 nt, Human
augggccguuugcaccucgguuu

SEQ ID NO: 51265 - RNA, 26 nt, Human
gccacugcacucuagccuggcaacag

SEQ ID NO: 51266 - RNA, 20 nt, Human
gggucggggagagggaccgg

SEQ ID NO: 51267 - RNA, 21 nt, Human
cugacuuccuuuucggaggaa

SEQ ID NO: 51268 - RNA, 21 nt, Human
gcugggcucugcccugggcag

SEQ ID NO: 51269 - RNA, 22 nt, Human
cucagccccagcccagcccagc

SEQ ID NO: 51270 - RNA, 23 nt, Human
uuucaggcuccucacaaaggaga

SEQ ID NO: 51271 - RNA, 27 nt, Human
ugagaaacauggagcagcgcacgccca

SEQ ID NO: 51272 - RNA, 18 nt, Human
cuccucugcugaccugcu

SEQ ID NO: 51273 - RNA, 21 nt, Human
ugguguaugacagagcauugg

SEQ ID NO: 51274 - RNA, 24 nt, Human
aagugaucuugguaguaucccugg

SEQ ID NO: 51275 - RNA, 24 nt, Human
acucacugcagcuaucucucgccu

SEQ ID NO: 51276 - RNA, 22 nt, Human
agggagagagaaaaagcugaga

SEQ ID NO: 51277 - RNA, 22 nt, Human
gaggcuguuuacuggggugggg

SEQ ID NO: 51278 - RNA, 21 nt, Human
agaggcuguuuacuggggugg

SEQ ID NO: 51279 - RNA, 23 nt, Human
agaagcaaucuccuuacuguguu

SEQ ID NO: 51280 - RNA, 25 nt, Human
gcuccagggacuggaguguaaugcu

SEQ ID NO: 51281 - RNA, 23 nt, Human
cugucucuccacaaguagagcca

SEQ ID NO: 51282 - RNA, 24 nt, Human
ugauagacauacuguguaaaauua

SEQ ID NO: 51283 - RNA, 22 nt, Human
aauccuccuaagccaccagcau

SEQ ID NO: 51284 - RNA, 22 nt, Human
gucacccaggcuguggugcagu

SEQ ID NO: 51285 - RNA, 23 nt, Human
cugagacagagucucgcucuguu

SEQ ID NO: 51286 - RNA, 25 nt, Human
cacauuuaauucagcuuuguccaaa

SEQ ID NO: 51287 - RNA, 27 nt, Human
cauugcacucuagccugggccacaggg

SEQ ID NO: 51288 - RNA, 21 nt, Human
cuaaagguguauuuaaacuau

SEQ ID NO: 51289 - RNA, 25 nt, Human
aacuacauuaccaugcugugccuca

SEQ ID NO: 51290 - RNA, 23 nt, Human
uaaugagagacaagugaggugga

SEQ ID NO: 51291 - RNA, 27 nt, Human
ugccuuagcaugugacuccugaaggga

SEQ ID NO: 51292 - RNA, 22 nt, Human
aauccagcagaauccucacaga

SEQ ID NO: 51293 - RNA, 24 nt, Human
cuguauccucgcuccguuccgccu

SEQ ID NO: 51294 - RNA, 25 nt, Human
aucaaggcuucaauaagaagaugga

SEQ ID NO: 51295 - RNA, 24 nt, Human
aagaaauggccuguggaauguuau

SEQ ID NO: 51296 - RNA, 30 nt, Human
gcugcagugagccaucaucauggcaucauu

SEQ ID NO: 51297 - RNA, 27 nt, Human
cuagucccgggcuggcgggagugcagu

SEQ ID NO: 51298 - RNA, 25 nt, Human
acuucuguucauccccaccuugcua

SEQ ID NO: 51299 - RNA, 31 nt, Human
uggccaacaugaugaaaccuugucuuuacua

SEQ ID NO: 51300 - RNA, 27 nt, Human
cuuugggcauauaugggccuggcgaag

SEQ ID NO: 51301 - RNA, 27 nt, Human
ucacaugcuucugcagcugagcuugca

SEQ ID NO: 51302 - RNA, 22 nt, Human
ucuuagcccucaccacagccuu

SEQ ID NO: 51303 - RNA, 25 nt, Human
ucugccuaacguuugcuucugugau

SEQ ID NO: 51304 - RNA, 21 nt, Human
agacuauucaauaaaaacuca

SEQ ID NO: 51305 - RNA, 27 nt, Human
acugcaaucuccaccucccacagguuc

SEQ ID NO: 51306 - RNA, 24 nt, Human
cuccugucuacagcagcuuccuca

SEQ ID NO: 51307 - RNA, 25 nt, Human
gugugaucuuuauaauuuacacucu

SEQ ID NO: 51308 - RNA, 19 nt, Human
ucaugccaaggcugggcuu

SEQ ID NO: 51309 - RNA, 20 nt, Human
uuugcagaaacuuguucaca

SEQ ID NO: 51310 - RNA, 22 nt, Human
uuuggaauugcauuuuuuaaag

SEQ ID NO: 51311 - RNA, 24 nt, Human
cuccaggcugcugggcagcugggc

SEQ ID NO: 51312 - RNA, 18 nt, Human
aggaaagaaaaauguagg

SEQ ID NO: 51313 - RNA, 27 nt, Human
cugccguccccuccuuaucacgguccc

SEQ ID NO: 51314 - RNA, 23 nt, Human
ccggggagacggagguugcagug

SEQ ID NO: 51315 - RNA, 20 nt, Human
acucuugucacccaggcugg

SEQ ID NO: 51316 - RNA, 28 nt, Human
aauagccaucugcuauaacucuuucaac

SEQ ID NO: 51317 - RNA, 23 nt, Human
cgcccaggcugcggaggggcucg

SEQ ID NO: 51318 - RNA, 27 nt, Human
cagucccaggggcauguauuggccugg

SEQ ID NO: 51319 - RNA, 27 nt, Human
cccuccuggaacccaggcucuaaacaa

SEQ ID NO: 51320 - RNA, 24 nt, Human
agaggcugagugugacuuuauaaa

SEQ ID NO: 51321 - RNA, 26 nt, Human
cuucuccucugcuccaacagacaccu

SEQ ID NO: 51322 - RNA, 26 nt, Human
cgggagguggguggcugcggggcaau

SEQ ID NO: 51323 - RNA, 22 nt, Human
cucugccucccaaggugcuggg

SEQ ID NO: 51324 - RNA, 27 nt, Human
cagaucugggcuccaagccaggaaagg

SEQ ID NO: 51325 - RNA, 27 nt, Human
uggccaacaugguguaacgcugucucu

SEQ ID NO: 51326 - RNA, 27 nt, Human
aaagguugggggaggcugggagagggg

SEQ ID NO: 51327 - RNA, 22 nt, Human
ggagcaccacucacuucugcag

SEQ ID NO: 51328 - RNA, 23 nt, Human
cuggggcaggaacagagggugaa

SEQ ID NO: 51329 - RNA, 26 nt, Human
caacuugcuaaccccaaaagaagcaa

SEQ ID NO: 51330 - RNA, 25 nt, Human
uggggcgccuuccuggaggugacac

SEQ ID NO: 51331 - RNA, 21 nt, Human
uacugugaacuggaagauggu

SEQ ID NO: 51332 - RNA, 22 nt, Human
ucccuuccuuuccucauuuaua

SEQ ID NO: 51333 - RNA, 21 nt, Human
ggggugggcuuuguugugaga

SEQ ID NO: 51334 - RNA, 24 nt, Human
aaguguuuacaacuggcaugugcu

SEQ ID NO: 51335 - RNA, 22 nt, Human
uucucucucccucaaccauucu

SEQ ID NO: 51336 - RNA, 22 nt, Human
cccuagacuggagccuacuggg

SEQ ID NO: 51337 - RNA, 25 nt, Human
accagugaccagcuagacugugauu

SEQ ID NO: 51338 - RNA, 19 nt, Human
uucaggagauugugcagug

SEQ ID NO: 51339 - RNA, 22 nt, Human
ugcacacacgccaacaggcauc

SEQ ID NO: 51340 - RNA, 26 nt, Human
ccuguaaucccaacacuuugagaagc

SEQ ID NO: 51341 - RNA, 23 nt, Human
gccuugauuaaggcuacugaccc

SEQ ID NO: 51342 - RNA, 26 nt, Human
ccucauuuccuguuucaccuugauuu

SEQ ID NO: 51343 - RNA, 27 nt, Human
acaauugccuguuuccuguccuuuaca

SEQ ID NO: 51344 - RNA, 21 nt, Human
uggucuaugacuucugccacu

SEQ ID NO: 51345 - RNA, 21 nt, Human
cauguggcaacauucugucag

SEQ ID NO: 51346 - RNA, 21 nt, Human
ugugguugccaaauauuuacu

SEQ ID NO: 51347 - RNA, 26 nt, Human
caaaacugagauguguuuaaugaaga

SEQ ID NO: 51348 - RNA, 29 nt, Human
ggcgcuggcaggcuggagcugggaaccca

SEQ ID NO: 51349 - RNA, 19 nt, Human
uucacaguuuguuuuucua

SEQ ID NO: 51350 - RNA, 20 nt, Human
gccagccaggacacccccug

SEQ ID NO: 51351 - RNA, 20 nt, Human
gagcuccccuccccugucuc

SEQ ID NO: 51352 - RNA, 26 nt, Human
ccugcuguauuuccugcuucccuguu

SEQ ID NO: 51353 - RNA, 22 nt, Human
gcaugagccaccgugcccggcu

SEQ ID NO: 51354 - RNA, 22 nt, Human
gcaugagccaccgcgcccggcc

SEQ ID NO: 51355 - RNA, 22 nt, Human
gcgugagccaccgcgcccagcc

SEQ ID NO: 51356 - RNA, 22 nt, Human
aggaagagcucaggguuggaca

SEQ ID NO: 51357 - RNA, 20 nt, Human
accuguaaggacccaggagg

SEQ ID NO: 51358 - RNA, 13 nt, Human
cacuacccuucca

SEQ ID NO: 51359 - RNA, 22 nt, Human
cuugagagaaaaaauaggauaa

SEQ ID NO: 51360 - RNA, 25 nt, Human
aacacuuagugacuaucacagccga

SEQ ID NO: 51361 - RNA, 23 nt, Human
guggguggguggggugggguggg

SEQ ID NO: 51362 - RNA, 23 nt, Human
gacacacaaccuccuccuccucu

SEQ ID NO: 51363 - RNA, 26 nt, Human
uuuauguuucccucagucauuugguu

SEQ ID NO: 51364 - RNA, 20 nt, Human
aacacuucugaaccugcauu

SEQ ID NO: 51365 - RNA, 21 nt, Human
aguccuucuuguccuggucgu

SEQ ID NO: 51366 - RNA, 18 nt, Human
guccccucagguuugguu

SEQ ID NO: 51367 - RNA, 22 nt, Human
ccagugagcuuaucaugcuguc

SEQ ID NO: 51368 - RNA, 26 nt, Human
ggagggggagagagcaaggagaucgg

SEQ ID NO: 51369 - RNA, 26 nt, Human
gcucuacaucuucugccuuagucuca

SEQ ID NO: 51370 - RNA, 22 nt, Human
acaguuuuccaaacugugucac

SEQ ID NO: 51371 - RNA, 21 nt, Human
guuuccuagcucugugcucag

SEQ ID NO: 51372 - RNA, 19 nt, Human
cccaccccccaggccgccu

SEQ ID NO: 51373 - RNA, 22 nt, Human
uaagaucacaccacuacacucc

SEQ ID NO: 51374 - RNA, 20 nt, Human
auauaguggauauaaaauag

SEQ ID NO: 51375 - RNA, 24 nt, Human
ccuuucuccugcuucauauaggcc

SEQ ID NO: 51376 - RNA, 22 nt, Human
aauaacugcuaauuugugaucc

SEQ ID NO: 51377 - RNA, 23 nt, Human
guaaguuuggaaaguuuagcaaa

SEQ ID NO: 51378 - RNA, 22 nt, Human
ccuccuccuccucuccaggggc

SEQ ID NO: 51379 - RNA, 21 nt, Human
cccuguucuucagaaggugag

SEQ ID NO: 51380 - RNA, 22 nt, Human
agcucagucucugaaagaugag

SEQ ID NO: 51381 - RNA, 22 nt, Human
gcuacugaaagcuaucccaggu

SEQ ID NO: 51382 - RNA, 23 nt, Human
gaaccaaauaaaccuaccauuac

SEQ ID NO: 51383 - RNA, 25 nt, Human
cugcccaucugggaaaauaccccau

SEQ ID NO: 51384 - RNA, 22 nt, Human
gggagagaggggcaagcaugau

SEQ ID NO: 51385 - RNA, 22 nt, Human
acucucucccuguggcuggucu

SEQ ID NO: 51386 - RNA, 23 nt, Human
uggcuggagugccucucuggucu

SEQ ID NO: 51387 - RNA, 27 nt, Human
gcaggagaaucacuugaacccaggagg

SEQ ID NO: 51388 - RNA, 24 nt, Human
ggaggcugggaaggcgaagggcau

SEQ ID NO: 51389 - RNA, 24 nt, Human
uucacugcaagaguaacaggauuu

SEQ ID NO: 51390 - RNA, 21 nt, Human
uucccugggagucaucaaaga

SEQ ID NO: 51391 - RNA, 29 nt, Human
cuccaguauguguaccaucuuguaaauuc

SEQ ID NO: 51392 - RNA, 21 nt, Human
cgucccggcugaagugcagug

SEQ ID NO: 51393 - RNA, 22 nt, Human
agccucccacagugcugggauu

SEQ ID NO: 51394 - RNA, 18 nt, Human
ccuggccucagacuuggc

SEQ ID NO: 51395 - RNA, 20 nt, Human
ucuuuuucacaugcaauaaa

SEQ ID NO: 51396 - RNA, 22 nt, Human
aaaaucuuuguuacucuguaaa

SEQ ID NO: 51397 - RNA, 24 nt, Human
aacuucagcagacaacaagcaauu

SEQ ID NO: 51398 - RNA, 25 nt, Human
uggagagacuguuccaaaccccaag

SEQ ID NO: 51399 - RNA, 17 nt, Human
cugugucuucgcuucca

SEQ ID NO: 51400 - RNA, 26 nt, Human
uuguaaaauauugaaagugguuugag

SEQ ID NO: 51401 - RNA, 24 nt, Human
ccauguuggccaggauggucucca

SEQ ID NO: 51402 - RNA, 19 nt, Human
agggcagauggcagaggau

SEQ ID NO: 51403 - RNA, 22 nt, Human
cccaugccuggcuaauuuuugu

SEQ ID NO: 51404 - RNA, 24 nt, Human
ggaucgcuuuguacuuugugcaaa

SEQ ID NO: 51405 - RNA, 22 nt, Human
cucaaggcugcccccuuccuca

SEQ ID NO: 51406 - RNA, 20 nt, Human
auugugucugugccccugug

SEQ ID NO: 51407 - RNA, 23 nt, Human
agguaucuugccuccuuucucuc

SEQ ID NO: 51408 - RNA, 28 nt, Human
caccacuuacccguucccccuuuaccua

SEQ ID NO: 51409 - RNA, 26 nt, Human
uauuccucgucacagcaaaaacacuu

SEQ ID NO: 51410 - RNA, 25 nt, Human
caaaacuccagcccacugaaccucu

SEQ ID NO: 51411 - RNA, 22 nt, Human
caccaggcuggagugcaguggu

SEQ ID NO: 51412 - RNA, 22 nt, Human
cacuggagggagauuugauggg

SEQ ID NO: 51413 - RNA, 25 nt, Human
gccugcagccaccaugcuccacucc

SEQ ID NO: 51414 - RNA, 25 nt, Human
uuucugcuguaaaaacguaguuacu

SEQ ID NO: 51415 - RNA, 23 nt, Human
gguugaagaguggccccuugagg

SEQ ID NO: 51416 - RNA, 23 nt, Human
ucaucuguugaucuggaggcagg

SEQ ID NO: 51417 - RNA, 22 nt, Human
acuuggguucccgcccaggaag

SEQ ID NO: 51418 - RNA, 21 nt, Human
gucaccaaucucucauauacc

SEQ ID NO: 51419 - RNA, 21 nt, Human
ccagccugggcgaaaggguga

SEQ ID NO: 51420 - RNA, 23 nt, Human
guggccuguaaucccagcuacuu

SEQ ID NO: 51421 - RNA, 20 nt, Human
ucaugauucugguggagauu

SEQ ID NO: 51422 - RNA, 27 nt, Human
cacuggcagaggguaucugaaguggga

SEQ ID NO: 51423 - RNA, 24 nt, Human
ggccgcgcuccagccucaccaggc

SEQ ID NO: 51424 - RNA, 20 nt, Human
ugccuagacccggcgcagca

SEQ ID NO: 51425 - RNA, 26 nt, Human
cacaaacccgcgcgucucggcugccc

SEQ ID NO: 51426 - RNA, 22 nt, Human
gcucuuacucccuccugaggcc

SEQ ID NO: 51427 - RNA, 27 nt, Human
cccagccccaacuccaggggcaccuau

SEQ ID NO: 51428 - RNA, 27 nt, Human
caucuggaagagaugguugacccagag

SEQ ID NO: 51429 - RNA, 25 nt, Human
auccaggacacugggagcacauaga

SEQ ID NO: 51430 - RNA, 26 nt, Human
cauccuaaaauuaacaacccagaaac

SEQ ID NO: 51431 - RNA, 21 nt, Human
uaugucacuccccaccuccuc

SEQ ID NO: 51432 - RNA, 27 nt, Human
ucacugcacuuuggaccccuggggcca

SEQ ID NO: 51433 - RNA, 20 nt, Human
uaccacuguccucugccccc

SEQ ID NO: 51434 - RNA, 22 nt, Human
cugaucaaucugcaguuuguga

SEQ ID NO: 51435 - RNA, 22 nt, Human
agacuaaaucuuuaucuugaau

SEQ ID NO: 51436 - RNA, 23 nt, Human
ggagguagagagagggcagccgg

SEQ ID NO: 51437 - RNA, 24 nt, Human
ccugucugucugucucucuuuugc

SEQ ID NO: 51438 - RNA, 18 nt, Human
cuccuuguccagcacuuu

SEQ ID NO: 51439 - RNA, 22 nt, Human
ucuacuuuaauuuauuuuguga

SEQ ID NO: 51440 - RNA, 27 nt, Human
gucugagcuggggagcggaagccacuu

SEQ ID NO: 51441 - RNA, 22 nt, Human
gaggccugagcccugccuaugc

SEQ ID NO: 51442 - RNA, 26 nt, Human
caugccacaauccuaugcucuugccu

SEQ ID NO: 51443 - RNA, 24 nt, Human
uuccaaacagcagggugacuuuag

SEQ ID NO: 51444 - RNA, 27 nt, Human
ggucucgaacuccuggccucgugaucu

SEQ ID NO: 51445 - RNA, 16 nt, Human
guacccuuaccagcca

SEQ ID NO: 51446 - RNA, 26 nt, Human
gaaguuagaggguaaagagccccacc

SEQ ID NO: 51447 - RNA, 29 nt, Human
gaggagagggcgcuccucucugcacaccu

SEQ ID NO: 51448 - RNA, 21 nt, Human
ucuggguggaugugagcagaa

SEQ ID NO: 51449 - RNA, 28 nt, Human
ucauucucaggcugggguggacucagau

SEQ ID NO: 51450 - RNA, 22 nt, Human
agcucuggagugggaggguugg

SEQ ID NO: 51451 - RNA, 23 nt, Human
guccccgugggguggagcauggu

SEQ ID NO: 51452 - RNA, 27 nt, Human
ccccaccccugccugucggacgcggcg

SEQ ID NO: 51453 - RNA, 22 nt, Human
gggagagaagggggcuguacag

SEQ ID NO: 51454 - RNA, 27 nt, Human
uucuggcccuacgugcauucacaggca

SEQ ID NO: 51455 - RNA, 24 nt, Human
ccucuucgccagcucccagguccc

SEQ ID NO: 51456 - RNA, 20 nt, Human
gucagaucucuuuaggauga

SEQ ID NO: 51457 - RNA, 24 nt, Human
gucuaaggcuggaaguuuaaugaa

SEQ ID NO: 51458 - RNA, 21 nt, Human
gccaggacuaggaccugggcc

SEQ ID NO: 51459 - RNA, 27 nt, Human
aucccagacccauuccuuagcuauuua

SEQ ID NO: 51460 - RNA, 24 nt, Human
ucugccacuuaauagcucugugau

SEQ ID NO: 51461 - RNA, 22 nt, Human
cacccaggcuggagugcagugc

SEQ ID NO: 51462 - RNA, 25 nt, Human
guaggguuccuuagagaagugacau

SEQ ID NO: 51463 - RNA, 21 nt, Human
uucugugaaauacauuuugga

SEQ ID NO: 51464 - RNA, 24 nt, Human
ggcauuugcugauuucuaguguau

SEQ ID NO: 51465 - RNA, 21 nt, Human
ucaagccaguacgugcuaaca

SEQ ID NO: 51466 - RNA, 21 nt, Human
gcaggagggauugcugggauu

SEQ ID NO: 51467 - RNA, 21 nt, Human
ucugcucccucucgcucucuc

SEQ ID NO: 51468 - RNA, 25 nt, Human
gaccucaggugaucugcccaccucg

SEQ ID NO: 51469 - RNA, 22 nt, Human
gcagagcuuacugucauggcuc

SEQ ID NO: 51470 - RNA, 24 nt, Human
augugucuggaugaagcuggggcu

SEQ ID NO: 51471 - RNA, 26 nt, Human
gggaaguggagguugcuguacaggaa

SEQ ID NO: 51472 - RNA, 27 nt, Human
ggacuccuuucccuuucuucucugaaa

SEQ ID NO: 51473 - RNA, 20 nt, Human
ccauuaacuuucuucugggc

SEQ ID NO: 51474 - RNA, 17 nt, Human
aucucccucuccuugcu

SEQ ID NO: 51475 - RNA, 24 nt, Human
ucauuucuaaaagaauauucagag

SEQ ID NO: 51476 - RNA, 26 nt, Human
gcugcacucagcugcccgcgcggcaa

SEQ ID NO: 51477 - RNA, 22 nt, Human
ggggccaugaggccucagugga

SEQ ID NO: 51478 - RNA, 22 nt, Human
agccuccugcccuuaccugcca

SEQ ID NO: 51479 - RNA, 22 nt, Human
gcucacaucuguaaccccagca

SEQ ID NO: 51480 - RNA, 22 nt, Human
aguccuagaguuuuccaggggg

SEQ ID NO: 51481 - RNA, 17 nt, Human
uucaugcucuugucaua

SEQ ID NO: 51482 - RNA, 26 nt, Human
cagccuaucugcuuaagagacucugg

SEQ ID NO: 51483 - RNA, 23 nt, Human
ucaaccucugccugcaucugcca

SEQ ID NO: 51484 - RNA, 25 nt, Human
ccugaccuggggcuggccucaggcc

SEQ ID NO: 51485 - RNA, 21 nt, Human
ugggagguggaguugcaguga

SEQ ID NO: 51486 - RNA, 20 nt, Human
ccucuguccucuucucuggc

SEQ ID NO: 51487 - RNA, 21 nt, Human
cuccucuauguugccugcugu

SEQ ID NO: 51488 - RNA, 26 nt, Human
agacguucaaacaggccaggcuccag

SEQ ID NO: 51489 - RNA, 26 nt, Human
cccaccccauaacuguuccuaagccu

SEQ ID NO: 51490 - RNA, 26 nt, Human
cucuaucuuuaaacgaaacaaagaca

SEQ ID NO: 51491 - RNA, 22 nt, Human
gcccaucgugugaacuauagag

SEQ ID NO: 51492 - RNA, 22 nt, Human
ucuguucucaggauggagagaa

SEQ ID NO: 51493 - RNA, 19 nt, Human
ccucucuugccaaaaagca

SEQ ID NO: 51494 - RNA, 23 nt, Human
ccuccaucuccagcaagucuccu

SEQ ID NO: 51495 - RNA, 24 nt, Human
gcucagccacucugcccagcuggg

SEQ ID NO: 51496 - RNA, 20 nt, Human
cugacuucuuuauuucagag

SEQ ID NO: 51497 - RNA, 20 nt, Human
ccugauccaauucugugcca

SEQ ID NO: 51498 - RNA, 30 nt, Human
gucuguuggcagacuggagugcaaucaugg

SEQ ID NO: 51499 - RNA, 22 nt, Human
uccccauccaggggcuguguau

SEQ ID NO: 51500 - RNA, 24 nt, Human
cugguuccugucugccguuuuccc

SEQ ID NO: 51501 - RNA, 25 nt, Human
gggccugggacuuccaugccuuaaa

SEQ ID NO: 51502 - RNA, 22 nt, Human
gccccagggaagcaggcuagga

SEQ ID NO: 51503 - RNA, 21 nt, Human
gccauugcacuccagccuggg

SEQ ID NO: 51504 - RNA, 27 nt, Human
augcucacaccuuacugcacagaaaag

SEQ ID NO: 51505 - RNA, 27 nt, Human
gaacagcuaucacguugaaccacguga

SEQ ID NO: 51506 - RNA, 29 nt, Human
ucauucucaggcugggguggacucagaug

SEQ ID NO: 51507 - RNA, 18 nt, Human
cuugccuuaccuguaccu

SEQ ID NO: 51508 - RNA, 23 nt, Human
gaugcagccacugucucuuguca

SEQ ID NO: 51509 - RNA, 23 nt, Human
cucuuacuuccugccucagucug

SEQ ID NO: 51510 - RNA, 22 nt, Human
uugcacagauguguaagcuugu

SEQ ID NO: 51511 - RNA, 26 nt, Human
guuuuauuugaaaaguaauguaucuu

SEQ ID NO: 51512 - RNA, 21 nt, Human
gcaaacugagugaugaaggaa

SEQ ID NO: 51513 - RNA, 22 nt, Human
ugcuaucccuccccucuccacc

SEQ ID NO: 51514 - RNA, 22 nt, Human
acagucuccagaagaucagcuc

SEQ ID NO: 51515 - RNA, 24 nt, Human
aggguggucacaccugagccuuca

SEQ ID NO: 51516 - RNA, 22 nt, Human
guauuuuuaugagauuuuaacc

SEQ ID NO: 51517 - RNA, 24 nt, Human
gcagcccaggcggagcgggaggag

SEQ ID NO: 51518 - RNA, 18 nt, Human
ggaggucaaggcugcagu

SEQ ID NO: 51519 - RNA, 20 nt, Human
agaaauagcaucuaagggaa

SEQ ID NO: 51520 - RNA, 21 nt, Human
cccagcccugccuccucagcc

SEQ ID NO: 51521 - RNA, 23 nt, Human
cugcuccccuuuuagaauuuacc

SEQ ID NO: 51522 - RNA, 21 nt, Human
cuucuuuccuuuuuguagggc

SEQ ID NO: 51523 - RNA, 23 nt, Human
gcauuccaggccgaauuuuguau

SEQ ID NO: 51524 - RNA, 21 nt, Human
agccuauucaauagcucagag

SEQ ID NO: 51525 - RNA, 18 nt, Human
uccuacccugucugguca

SEQ ID NO: 51526 - RNA, 22 nt, Human
gggccucugugggugcugggua

SEQ ID NO: 51527 - RNA, 25 nt, Human
uuagauuugccauuguagcuuuucu

SEQ ID NO: 51528 - RNA, 24 nt, Human
ggguccccagggacucugcagugu

SEQ ID NO: 51529 - RNA, 23 nt, Human
uagcaaacacugggggcaccuua

SEQ ID NO: 51530 - RNA, 27 nt, Human
ggggugagauaagcggccaugugaucc

SEQ ID NO: 51531 - RNA, 21 nt, Human
gccagccuggccaacauggug

SEQ ID NO: 51532 - RNA, 21 nt, Human
ggaggcagcuguugcagugag

SEQ ID NO: 51533 - RNA, 19 nt, Human
gcucacugcuucugcuuuu

SEQ ID NO: 51534 - RNA, 26 nt, Human
acaaguguucacucacaucuguaaaa

SEQ ID NO: 51535 - RNA, 19 nt, Human
gcauuuucuacauguauua

SEQ ID NO: 51536 - RNA, 25 nt, Human
acugccuggcucugcucgcuccggc

SEQ ID NO: 51537 - RNA, 28 nt, Human
ccugcuucuccaggccucuugccuuuga

SEQ ID NO: 51538 - RNA, 22 nt, Human
acugcugaacugugagugcagu

SEQ ID NO: 51539 - RNA, 22 nt, Human
auuucuauuuucaagguguuaa

SEQ ID NO: 51540 - RNA, 19 nt, Human
gacuugaccugugaccuca

SEQ ID NO: 51541 - RNA, 23 nt, Human
ggcccuguaucuucucuaaaacc

SEQ ID NO: 51542 - RNA, 20 nt, Human
cucuugcaucaaaggugcag

SEQ ID NO: 51543 - RNA, 19 nt, Human
uggaagcucuguugcaggu

SEQ ID NO: 51544 - RNA, 18 nt, Human
ucgcccaggcuggagugc

SEQ ID NO: 51545 - RNA, 18 nt, Human
uugcccaggcuggagugu

SEQ ID NO: 51546 - RNA, 22 nt, Human
gccaauacugccuacugugcua

SEQ ID NO: 51547 - RNA, 26 nt, Human
cagcccccuccuucccucucuucugc

SEQ ID NO: 51548 - RNA, 23 nt, Human
uuccagcaauucuccugccucgg

SEQ ID NO: 51549 - RNA, 27 nt, Human
gauauuaaguaauuuccccacucugag

SEQ ID NO: 51550 - RNA, 20 nt, Human
ugucaaugacaguuucuuuu

SEQ ID NO: 51551 - RNA, 19 nt, Human
ccugcacuccucagggcag

SEQ ID NO: 51552 - RNA, 22 nt, Human
cgguacccucgacccuccuggg

SEQ ID NO: 51553 - RNA, 19 nt, Human
uuuucucucuugaugcuca

SEQ ID NO: 51554 - RNA, 22 nt, Human
ccuccugcuggcuccuccugcc

SEQ ID NO: 51555 - RNA, 25 nt, Human
gccggccuccaggccccuccuggcu

SEQ ID NO: 51556 - RNA, 21 nt, Human
gugagcuuggcagggccaggc

SEQ ID NO: 51557 - RNA, 20 nt, Human
gggggcagaguugcacuuuu

SEQ ID NO: 51558 - RNA, 24 nt, Human
uguauaacaucacugucaaacuuu

SEQ ID NO: 51559 - RNA, 22 nt, Human
cacccauggcugcaguggaggg

SEQ ID NO: 51560 - RNA, 23 nt, Human
uuuauuucucaauaccugcuuca

SEQ ID NO: 51561 - RNA, 24 nt, Human
agugaauacuuugaugauugccaa

SEQ ID NO: 51562 - RNA, 24 nt, Human
ccaaucauuuuaauuauuauucuu

SEQ ID NO: 51563 - RNA, 25 nt, Human
cuccugccugcuccaagaaaagggc

SEQ ID NO: 51564 - RNA, 22 nt, Human
gucuuaaaaaugauguuaaccc

SEQ ID NO: 51565 - RNA, 23 nt, Human
aacuuuauaaauucauaacuggu

SEQ ID NO: 51566 - RNA, 15 nt, Human
ucucuagcuuuguca

SEQ ID NO: 51567 - RNA, 27 nt, Human
ccagcuccacaguguugccagagccuu

SEQ ID NO: 51568 - RNA, 27 nt, Human
cccuccaggacccggucccccugcugc

SEQ ID NO: 51569 - RNA, 23 nt, Human
acacauauaugauacaaaugcuu

SEQ ID NO: 51570 - RNA, 19 nt, Human
ggcccagcuucugaaggga

SEQ ID NO: 51571 - RNA, 22 nt, Human
cagagcaagacuccgucucggg

SEQ ID NO: 51572 - RNA, 27 nt, Human
gagcucccuucccauggcggcccuagu

SEQ ID NO: 51573 - RNA, 27 nt, Human
acaggcuuuauuuucaccuuguguaca

SEQ ID NO: 51574 - RNA, 22 nt, Human
cacccagacuggcgugcagugg

SEQ ID NO: 51575 - RNA, 23 nt, Human
guggcucaugccugcaauuccag

SEQ ID NO: 51576 - RNA, 21 nt, Human
uggaugggcaaagcuugucaa

SEQ ID NO: 51577 - RNA, 22 nt, Human
accuguaaucccagcuacucgg

SEQ ID NO: 51578 - RNA, 26 nt, Human
agagacacuguccuuccccucaucca

SEQ ID NO: 51579 - RNA, 21 nt, Human
guagaccugugugugggaccu

SEQ ID NO: 51580 - RNA, 22 nt, Human
ugagauuacagacaugagccuc

SEQ ID NO: 51581 - RNA, 21 nt, Human
gaggaagaagagggcuguggu

SEQ ID NO: 51582 - RNA, 22 nt, Human
ugcauuuuucggacacuggaaa

SEQ ID NO: 51583 - RNA, 20 nt, Human
accuacaccagaagagucag

SEQ ID NO: 51584 - RNA, 19 nt, Human
ccuccaggaccugggaagg

SEQ ID NO: 51585 - RNA, 20 nt, Human
cacgugcucacccacccgca

SEQ ID NO: 51586 - RNA, 23 nt, Human
caaaaguuaauuuucuuguuaca

SEQ ID NO: 51587 - RNA, 27 nt, Human
ucgggacugaaggaaggccaagccauu

SEQ ID NO: 51588 - RNA, 20 nt, Human
caugaagauggagugcuaug

SEQ ID NO: 51589 - RNA, 18 nt, Human
cagaacccguuguggaaa

SEQ ID NO: 51590 - RNA, 24 nt, Human
cucaaauugaaacuuuucugcaca

SEQ ID NO: 51591 - RNA, 22 nt, Human
caucaacccucuaauucaccuu

SEQ ID NO: 51592 - RNA, 29 nt, Human
cuggagggggcgggggccguggcggcuuu

SEQ ID NO: 51593 - RNA, 26 nt, Human
ccuucuccuuccccaggauggacucu

SEQ ID NO: 51594 - RNA, 21 nt, Human
cuggucacugcuucugcuaua

SEQ ID NO: 51595 - RNA, 21 nt, Human
caggugaggugggagguugga

SEQ ID NO: 51596 - RNA, 26 nt, Human
agcccagccuccgugguucuuaaugc

SEQ ID NO: 51597 - RNA, 20 nt, Human
cucuccucugccaugaggcc

SEQ ID NO: 51598 - RNA, 24 nt, Human
uggcuucugauuuuucucuuuuuu

SEQ ID NO: 51599 - RNA, 27 nt, Human
uucuuaaagccccaggauuagauggau

SEQ ID NO: 51600 - RNA, 19 nt, Human
gggcccacaggcaggggua

SEQ ID NO: 51601 - RNA, 23 nt, Human
cucuuccucauauuucagcagug

SEQ ID NO: 51602 - RNA, 19 nt, Human
ugccccucaguuugugacc

SEQ ID NO: 51603 - RNA, 22 nt, Human
gcgaucuuugcucacugcaacc

SEQ ID NO: 51604 - RNA, 26 nt, Human
ccugcagcauggccccugccuuaggc

SEQ ID NO: 51605 - RNA, 21 nt, Human
uuuccaggaacaucaaugugg

SEQ ID NO: 51606 - RNA, 21 nt, Human
cuuggaugaggcagggccagg

SEQ ID NO: 51607 - RNA, 27 nt, Human
cugacuuugauccuguuccacuuuuga

SEQ ID NO: 51608 - RNA, 27 nt, Human
gacgccugggugcgccugccugccggc

SEQ ID NO: 51609 - RNA, 20 nt, Human
aaacaccuagcuuuauucuu

SEQ ID NO: 51610 - RNA, 26 nt, Human
gaugucagggguuugagaccagccug

SEQ ID NO: 51611 - RNA, 25 nt, Human
cuguacugugccugccucaacuucc

SEQ ID NO: 51612 - RNA, 23 nt, Human
uguuugugaagcugccugguguu

SEQ ID NO: 51613 - RNA, 23 nt, Human
augccaccuccaagcuuguccua

SEQ ID NO: 51614 - RNA, 22 nt, Human
cacucacugacucuucuaugca

SEQ ID NO: 51615 - RNA, 21 nt, Human
ugcugguuucagggaaggagu

SEQ ID NO: 51616 - RNA, 25 nt, Human
accaucaccacugcuuucucuucca

SEQ ID NO: 51617 - RNA, 21 nt, Human
uuggggccggucccucugcug

SEQ ID NO: 51618 - RNA, 20 nt, Human
cuccccuccucuccccucca

SEQ ID NO: 51619 - RNA, 22 nt, Human
cgcugcugccgugggccugaga

SEQ ID NO: 51620 - RNA, 24 nt, Human
cugcacauuagagggacagccaaa

SEQ ID NO: 51621 - RNA, 20 nt, Human
ccuuuuguguuguuuuugcc

SEQ ID NO: 51622 - RNA, 26 nt, Human
cuacaucucccuuuucccccgaucca

SEQ ID NO: 51623 - RNA, 19 nt, Human
gcccagccucuguggcgcu

SEQ ID NO: 51624 - RNA, 19 nt, Human
uucguggucucucaaagga

SEQ ID NO: 51625 - RNA, 21 nt, Human
cugaaagaaaaauaacugaca

SEQ ID NO: 51626 - RNA, 21 nt, Human
uccuccaggccgucagccuga

SEQ ID NO: 51627 - RNA, 20 nt, Human
agagcauuuuuuaugauauc

SEQ ID NO: 51628 - RNA, 22 nt, Human
cagacuccuggguucaagcaau

SEQ ID NO: 51629 - RNA, 19 nt, Human
cucacccaggaagugcaag

SEQ ID NO: 51630 - RNA, 22 nt, Human
uagacuuuugccuaaguggcuu

SEQ ID NO: 51631 - RNA, 21 nt, Human
uggagagggaauguguggcuc

SEQ ID NO: 51632 - RNA, 22 nt, Human
ugucacuuagggauaacacugu

SEQ ID NO: 51633 - RNA, 23 nt, Human
gcgggguccaggagaagcaggcg

SEQ ID NO: 51634 - RNA, 24 nt, Human
uacucuccucggcccccuccaucg

SEQ ID NO: 51635 - RNA, 24 nt, Human
aacuuugacaaaucaugcugcugu

SEQ ID NO: 51636 - RNA, 21 nt, Human
uauuaaaaugauggcuuuugg

SEQ ID NO: 51637 - RNA, 25 nt, Human
caagggcacacaacugguuccguua

SEQ ID NO: 51638 - RNA, 22 nt, Human
acccaggcugcagugcaauggc

SEQ ID NO: 51639 - RNA, 21 nt, Human
uggggagcacagggaggcaga

SEQ ID NO: 51640 - RNA, 20 nt, Human
gaugccaugaugcuggguga

SEQ ID NO: 51641 - RNA, 25 nt, Human
gucagcucaggcuggagcaggcaua

SEQ ID NO: 51642 - RNA, 26 nt, Human
ggagggcccauggggguaggagcagu

SEQ ID NO: 51643 - RNA, 23 nt, Human
uggacucauaucaagaugcucug

SEQ ID NO: 51644 - RNA, 23 nt, Human
guuuucaucuucuaguuugucua

SEQ ID NO: 51645 - RNA, 24 nt, Human
gccuuaaggagcugaagagucugg

SEQ ID NO: 51646 - RNA, 23 nt, Human
ugccgcccaaacuggagugcagu

SEQ ID NO: 51647 - RNA, 21 nt, Human
gcugcaggagaccuguagcug

SEQ ID NO: 51648 - RNA, 22 nt, Human
gggccuugcgugcagccuccca

SEQ ID NO: 51649 - RNA, 22 nt, Human
acucuaccccgagacugccuuc

SEQ ID NO: 51650 - RNA, 22 nt, Human
ccguuauuuuaggaggucccug

SEQ ID NO: 51651 - RNA, 21 nt, Human
aggcggccacaggcgagggug

SEQ ID NO: 51652 - RNA, 20 nt, Human
gagcccaggcuggggaagug

SEQ ID NO: 51653 - RNA, 25 nt, Human
ccugccccugccccauuuccuccuc

SEQ ID NO: 51654 - RNA, 27 nt, Human
cugggaaaugccaccuccuggaaggca

SEQ ID NO: 51655 - RNA, 21 nt, Human
caccuaggcuggagugcagcg

SEQ ID NO: 51656 - RNA, 20 nt, Human
ggaggucaaggcugcaguga

SEQ ID NO: 51657 - RNA, 22 nt, Human
cuccucuuuccuccugcuucau

SEQ ID NO: 51658 - RNA, 22 nt, Human
aggauuacaggcaugagccacu

SEQ ID NO: 51659 - RNA, 22 nt, Human
ugggagguggagguugcauuga

SEQ ID NO: 51660 - RNA, 26 nt, Human
gcaguuucagggccccucccuaggcc

SEQ ID NO: 51661 - RNA, 21 nt, Human
ggggugagccagacagacuga

SEQ ID NO: 51662 - RNA, 21 nt, Human
ugcucagagucuaucaacauu

SEQ ID NO: 51663 - RNA, 20 nt, Human
gucauucaagucccuuuaca

SEQ ID NO: 51664 - RNA, 24 nt, Human
uccaauacucagguuaaugcugaa

SEQ ID NO: 51665 - RNA, 23 nt, Human
ucaccccgaauuguccuuccucc

SEQ ID NO: 51666 - RNA, 20 nt, Human
ugcugggaagaaauuccauc

SEQ ID NO: 51667 - RNA, 19 nt, Human
agagacaccugcaccuccc

SEQ ID NO: 51668 - RNA, 22 nt, Human
ugcuaaacuuuguucuguucag

SEQ ID NO: 51669 - RNA, 20 nt, Human
acucauucccauuuguccca

SEQ ID NO: 51670 - RNA, 25 nt, Human
ccucaggcugcugcucugccuucau

SEQ ID NO: 51671 - RNA, 20 nt, Human
aaaauuacaacacugccuuu

SEQ ID NO: 51672 - RNA, 26 nt, Human
ugacucacauaaaaucaggaacuuga

SEQ ID NO: 51673 - RNA, 21 nt, Human
aaauuacaguuuacguccauu

SEQ ID NO: 51674 - RNA, 27 nt, Human
ugcuguugccaagacugcaaaccacug

SEQ ID NO: 51675 - RNA, 25 nt, Human
ggaguauuugcagaaggcucaggca

SEQ ID NO: 51676 - RNA, 24 nt, Human
aaaauuauauuuugaacaacucga

SEQ ID NO: 51677 - RNA, 19 nt, Human
ccuggauuuccaccaggag

SEQ ID NO: 51678 - RNA, 21 nt, Human
auguccaucugggccacuguc

SEQ ID NO: 51679 - RNA, 19 nt, Human
aggccuggccucgcccugu

SEQ ID NO: 51680 - RNA, 20 nt, Human
ccugccccauuuccuccuca

SEQ ID NO: 51681 - RNA, 27 nt, Human
ccgugcaucgcaccuauuuaagaggga

SEQ ID NO: 51682 - RNA, 23 nt, Human
cugccucucucauggcuugggcu

SEQ ID NO: 51683 - RNA, 19 nt, Human
agcaguuuguuccuuuuca

SEQ ID NO: 51684 - RNA, 20 nt, Human
ugcccagaguuaaagggaau

SEQ ID NO: 51685 - RNA, 27 nt, Human
acugcaaccuucaccuaccgaguucaa

SEQ ID NO: 51686 - RNA, 18 nt, Human
ugccacacacaacaaaac

SEQ ID NO: 51687 - RNA, 27 nt, Human
ucucaacaaugaguaaaggaacuuaag

SEQ ID NO: 51688 - RNA, 25 nt, Human
gguacccaugagcagaggguagugg

SEQ ID NO: 51689 - RNA, 22 nt, Human
aggcugggcugugccucugcuc

SEQ ID NO: 51690 - RNA, 21 nt, Human
uuuuugguuucuugcuguugc

SEQ ID NO: 51691 - RNA, 26 nt, Human
cucacugcaagcucggccuccugggu

SEQ ID NO: 51692 - RNA, 23 nt, Human
cuucucucaaaauggauccgaua

SEQ ID NO: 51693 - RNA, 21 nt, Human
agcauugcaaggaaauugugc

SEQ ID NO: 51694 - RNA, 31 nt, Human
ggagagggagcucucgggucggggcuaggga

SEQ ID NO: 51695 - RNA, 21 nt, Human
cucaguguacuuaaaauuuua

SEQ ID NO: 51696 - RNA, 26 nt, Human
gccagcugagaggugguagagcagga

SEQ ID NO: 51697 - RNA, 21 nt, Human
ggaaaccaagucaggccaggu

SEQ ID NO: 51698 - RNA, 27 nt, Human
ccacaaacccugcugaacacagugucu

SEQ ID NO: 51699 - RNA, 28 nt, Human
guaauacacuuccuguaaacaaaugggg

SEQ ID NO: 51700 - RNA, 25 nt, Human
uggccuuuauaggaccaaugcugau

SEQ ID NO: 51701 - RNA, 27 nt, Human
ccccgaaucucagccaccgugucacuc

SEQ ID NO: 51702 - RNA, 19 nt, Human
acauaauaugcagcuuagg

SEQ ID NO: 51703 - RNA, 24 nt, Human
agaaaucagagaguggcugccaug

SEQ ID NO: 51704 - RNA, 19 nt, Human
uauaugcacaaaucugcca

SEQ ID NO: 51705 - RNA, 23 nt, Human
uaaucuugaagguuagagauaaa

SEQ ID NO: 51706 - RNA, 30 nt, Human
gggaggcggaggagguugcagugaacugag

SEQ ID NO: 51707 - RNA, 17 nt, Human
gcaguaagaaagauguc

SEQ ID NO: 51708 - RNA, 23 nt, Human
uuuggagcagaauccugcacauu

SEQ ID NO: 51709 - RNA, 25 nt, Human
gcauuaauaaaacugugcaucucaa

SEQ ID NO: 51710 - RNA, 21 nt, Human
cuccaaaggggggagccuucu

SEQ ID NO: 51711 - RNA, 22 nt, Human
cgucuguuuguagggcugccag

SEQ ID NO: 51712 - RNA, 22 nt, Human
uuuccuggcuaaacguugguga

SEQ ID NO: 51713 - RNA, 22 nt, Human
gcaugggcugggccugggcaca

SEQ ID NO: 51714 - RNA, 20 nt, Human
aguccacagugcgcugucuc

SEQ ID NO: 51715 - RNA, 26 nt, Human
uuccugagcaccuuuccuucuuucag

SEQ ID NO: 51716 - RNA, 22 nt, Human
gaauuaaaugcacuggagcuuu

SEQ ID NO: 51717 - RNA, 27 nt, Human
agauaauucaaccaucuaaucaaaaug

SEQ ID NO: 51718 - RNA, 22 nt, Human
uauuccaccuccuuccccugag

SEQ ID NO: 51719 - RNA, 27 nt, Human
gagucauuugcaguguuuucugccaca

SEQ ID NO: 51720 - RNA, 23 nt, Human
caaagagacuguguguuacugaa

SEQ ID NO: 51721 - RNA, 22 nt, Human
agggguugugggggcagagggg

SEQ ID NO: 51722 - RNA, 20 nt, Human
ugcccaggcuggagugcaac

SEQ ID NO: 51723 - RNA, 22 nt, Human
gacacccaggcuggagugcagu

SEQ ID NO: 51724 - RNA, 19 nt, Human
cuugacaccuugaggguag

SEQ ID NO: 51725 - RNA, 22 nt, Human
uuuugagcuuuagaccucagcc

SEQ ID NO: 51726 - RNA, 19 nt, Human
ucuaacuguuguuacugga

SEQ ID NO: 51727 - RNA, 17 nt, Human
accauaaaaaugaaauu

SEQ ID NO: 51728 - RNA, 21 nt, Human
aguauuuaggaugacugcugu

SEQ ID NO: 51729 - RNA, 22 nt, Human
ggggagggagaagggaggaagc

SEQ ID NO: 51730 - RNA, 21 nt, Human
gaggcuggaugacuugcucaa

SEQ ID NO: 51731 - RNA, 31 nt, Human
gcacauaauuacuaccuuccccuuggcggcu

SEQ ID NO: 51732 - RNA, 19 nt, Human
ccaggagauugaggcugca

SEQ ID NO: 51733 - RNA, 24 nt, Human
uagugccaccacagcuuauggcau

SEQ ID NO: 51734 - RNA, 28 nt, Human
aguggcugagcuccaagugccugcugaa

SEQ ID NO: 51735 - RNA, 28 nt, Human
ugucuuugcugcagaacugaagagacua

SEQ ID NO: 51736 - RNA, 28 nt, Human
gaaaucuuuuuuguucaaagauuaaugc

SEQ ID NO: 51737 - RNA, 27 nt, Human
uucuccucuccucucaggucaguccau

SEQ ID NO: 51738 - RNA, 26 nt, Human
uggaguagcugggacuacagacaugc

SEQ ID NO: 51739 - RNA, 22 nt, Human
ugguucuaaaaucaaaagcugu

SEQ ID NO: 51740 - RNA, 22 nt, Human
ccaacauggcggcgccgagccu

SEQ ID NO: 51741 - RNA, 22 nt, Human
uucuaaagguaguuaagaugaa

SEQ ID NO: 51742 - RNA, 17 nt, Human
gagaauugcuguggaga

SEQ ID NO: 51743 - RNA, 26 nt, Human
aggacuaguagagcgucgcgcucccu

SEQ ID NO: 51744 - RNA, 21 nt, Human
caccuguaauuccagcacuuu

SEQ ID NO: 51745 - RNA, 21 nt, Human
caucuguaaucccagcacuuu

SEQ ID NO: 51746 - RNA, 28 nt, Human
ucucgaacucuugaccucaggugaucug

SEQ ID NO: 51747 - RNA, 28 nt, Human
ucucgaacuccugaccucaggugauccg

SEQ ID NO: 51748 - RNA, 25 nt, Human
gcugggagggagucaucgugacugc

SEQ ID NO: 51749 - RNA, 27 nt, Human
ccuguuuuggaauucuguucuauuccu

SEQ ID NO: 51750 - RNA, 22 nt, Human
guggaaacuaaagcccagagag

SEQ ID NO: 51751 - RNA, 22 nt, Human
ggaacaaaaaucaggagugugg

SEQ ID NO: 51752 - RNA, 20 nt, Human
agaagaaaaguugucuggga

SEQ ID NO: 51753 - RNA, 19 nt, Human
ucaagccugaccuggaacc

SEQ ID NO: 51754 - RNA, 27 nt, Human
ccuaugggaaaggugauaccagcucug

SEQ ID NO: 51755 - RNA, 21 nt, Human
ccccuuuuguuucucaguaac

SEQ ID NO: 51756 - RNA, 25 nt, Human
cccugggaagccuccgggugauagg

SEQ ID NO: 51757 - RNA, 22 nt, Human
aggcauccaggccagggcuccu

SEQ ID NO: 51758 - RNA, 23 nt, Human
ucggucagggagcggccugccuc

SEQ ID NO: 51759 - RNA, 23 nt, Human
ugcaggggcaagcaggagcuagc

SEQ ID NO: 51760 - RNA, 18 nt, Human
guacacagacacagggug

SEQ ID NO: 51761 - RNA, 24 nt, Human
ugucuuuuccccuucccucagcag

SEQ ID NO: 51762 - RNA, 21 nt, Human
uuuacuugagagaaggugagu

SEQ ID NO: 51763 - RNA, 21 nt, Human
guuugcucucccgcuguugcc

SEQ ID NO: 51764 - RNA, 22 nt, Human
uguuacccaggaugcagcaggu

SEQ ID NO: 51765 - RNA, 22 nt, Human
ccaagcccagcgcaacaaagga

SEQ ID NO: 51766 - RNA, 28 nt, Human
ggucaccagacggggcuggagugugagg

SEQ ID NO: 51767 - RNA, 23 nt, Human
gugacucccuugccagcuccaga

SEQ ID NO: 51768 - RNA, 22 nt, Human
ucaugccacugcacuccauccu

SEQ ID NO: 51769 - RNA, 20 nt, Human
cucaacaaggauggaacuga

SEQ ID NO: 51770 - RNA, 22 nt, Human
cugucucugucccucacugccu

SEQ ID NO: 51771 - RNA, 22 nt, Human
aacccaggaaauauauucuucc

SEQ ID NO: 51772 - RNA, 21 nt, Human
ucagcacuuggcaucuuguca

SEQ ID NO: 51773 - RNA, 22 nt, Human
gggcucgggauggacucccugg

SEQ ID NO: 51774 - RNA, 21 nt, Human
uucuucucacacaauuacuua

SEQ ID NO: 51775 - RNA, 21 nt, Human
ccuuccuaugcuguucacugg

SEQ ID NO: 51776 - RNA, 22 nt, Human
uacgccuguaauccuagcacuu

SEQ ID NO: 51777 - RNA, 31 nt, Human
uccucacagucccacugugcaggugcuauug

SEQ ID NO: 51778 - RNA, 27 nt, Human
gagcccaaagccuuugguuccucaguu

SEQ ID NO: 51779 - RNA, 23 nt, Human
agagacacguggcuaggguucca

SEQ ID NO: 51780 - RNA, 25 nt, Human
ugggccugggaggaagauguuuaca

SEQ ID NO: 51781 - RNA, 22 nt, Human
cugagucugaguccugucucug

SEQ ID NO: 51782 - RNA, 22 nt, Human
guuucaugaccgcuuguuuuuc

SEQ ID NO: 51783 - RNA, 21 nt, Human
gaaagcaugcuuauacaauca

SEQ ID NO: 51784 - RNA, 20 nt, Human
cagggcccaggcagcuuuga

SEQ ID NO: 51785 - RNA, 22 nt, Human
gccagaauaaaaccaccaggaa

SEQ ID NO: 51786 - RNA, 24 nt, Human
gcauggcacugacaucugccuugu

SEQ ID NO: 51787 - RNA, 21 nt, Human
acugucucaguaaacagcugu

SEQ ID NO: 51788 - RNA, 23 nt, Human
uguguuugauaucacaguguuug

SEQ ID NO: 51789 - RNA, 24 nt, Human
cuaugaacuacaacauuaugaaga

SEQ ID NO: 51790 - RNA, 21 nt, Human
aggcaauaaaagcugcaguga

SEQ ID NO: 51791 - RNA, 22 nt, Human
agagugcaaaaaauuagccggg

SEQ ID NO: 51792 - RNA, 18 nt, Human
uugcuaccuauuguaacu

SEQ ID NO: 51793 - RNA, 25 nt, Human
ccuguuugcucacaugcaagacaca

SEQ ID NO: 51794 - RNA, 26 nt, Human
uuacccagacugguuugggcaagcag

SEQ ID NO: 51795 - RNA, 22 nt, Human
ggacacugccuggcagaggcug

SEQ ID NO: 51796 - RNA, 20 nt, Human
uuugagacuagccugggcaa

SEQ ID NO: 51797 - RNA, 27 nt, Human
gaggaagagauaugucgugagcuggag

SEQ ID NO: 51798 - RNA, 21 nt, Human
auuagcugggaucacaggugu

SEQ ID NO: 51799 - RNA, 26 nt, Human
uggaaaguagagagcaacagacacau

SEQ ID NO: 51800 - RNA, 22 nt, Human
agcuuuggaaccagcuggcgac

SEQ ID NO: 51801 - RNA, 21 nt, Human
aacgagggggagggagguccc

SEQ ID NO: 51802 - RNA, 20 nt, Human
ugacucugcaaaaucaugcu

SEQ ID NO: 51803 - RNA, 26 nt, Human
ccuccucugcaccugaccacacuccc

SEQ ID NO: 51804 - RNA, 20 nt, Human
cccugaaccacuccuccucc

SEQ ID NO: 51805 - RNA, 23 nt, Human
ccacagcuuuuccuccaugucug

SEQ ID NO: 51806 - RNA, 18 nt, Human
ccucaucugcaccauguc

SEQ ID NO: 51807 - RNA, 22 nt, Human
uuuagcccuggggcauggagcu

SEQ ID NO: 51808 - RNA, 21 nt, Human
gcuuggguuagaaaaguggac

SEQ ID NO: 51809 - RNA, 28 nt, Human
ggagagaagcuggacugcagcugguuuc

SEQ ID NO: 51810 - RNA, 22 nt, Human
gaaccgagagccuggagcccag

SEQ ID NO: 51811 - RNA, 26 nt, Human
caccuugcuguccucccuucccugca

SEQ ID NO: 51812 - RNA, 20 nt, Human
aggccuuugcuucucugccu

SEQ ID NO: 51813 - RNA, 21 nt, Human
ggaagcccgcccugcccgccc

SEQ ID NO: 51814 - RNA, 19 nt, Human
aguaagaaaguuucaugga

SEQ ID NO: 51815 - RNA, 28 nt, Human
acugucuugacugucacggaacagaucu

SEQ ID NO: 51816 - RNA, 22 nt, Human
gagcuccccugcugguuggggc

SEQ ID NO: 51817 - RNA, 21 nt, Human
gccacugcuuccuccugggcc

SEQ ID NO: 51818 - RNA, 30 nt, Human
caguauuucacaacuuccuggucgcugaga

SEQ ID NO: 51819 - RNA, 25 nt, Human
caccugccaccaccacccccgccau

SEQ ID NO: 51820 - RNA, 20 nt, Human
uugccugcacucuugccugc

SEQ ID NO: 51821 - RNA, 20 nt, Human
acagcuguuuuuaggcuguu

SEQ ID NO: 51822 - RNA, 27 nt, Human
gcagggccaucuuugcagcucagucua

SEQ ID NO: 51823 - RNA, 24 nt, Human
uuguuacccaggcuggagugcagu

SEQ ID NO: 51824 - RNA, 26 nt, Human
ucaguguaccacuacuuagagauaug

SEQ ID NO: 51825 - RNA, 21 nt, Human
cggcgggguggggugggggug

SEQ ID NO: 51826 - RNA, 21 nt, Human
gucaaaucuucuuuuuucuca

SEQ ID NO: 51827 - RNA, 20 nt, Human
agggcuuuaugugaggauuu

SEQ ID NO: 51828 - RNA, 23 nt, Human
gacauacauuucucauaccuucc

SEQ ID NO: 51829 - RNA, 24 nt, Human
cuguuuuucucacagcagaggaac

SEQ ID NO: 51830 - RNA, 19 nt, Human
cauuuuagcuuucucaguu

SEQ ID NO: 51831 - RNA, 25 nt, Human
gaaagagaauauuugguuacucaga

SEQ ID NO: 51832 - RNA, 20 nt, Human
guguccgugggugugcagug

SEQ ID NO: 51833 - RNA, 21 nt, Human
cucaagacuaucagugugacc

SEQ ID NO: 51834 - RNA, 26 nt, Human
ccccucccucacuccuuccuuugcgg

SEQ ID NO: 51835 - RNA, 18 nt, Human
acacuuccuaucuuguca

SEQ ID NO: 51836 - RNA, 26 nt, Human
gccagcccacccugggcugggcccag

SEQ ID NO: 51837 - RNA, 27 nt, Human
aggacuuucccccacacccagaucaca

SEQ ID NO: 51838 - RNA, 24 nt, Human
ugcaugaaaaggaaaugaauggau

SEQ ID NO: 51839 - RNA, 20 nt, Human
cgccuaguggggucucccuc

SEQ ID NO: 51840 - RNA, 17 nt, Human
aagauuuuaucuguaaa

SEQ ID NO: 51841 - RNA, 21 nt, Human
gggccagagcaguuacagccc

SEQ ID NO: 51842 - RNA, 27 nt, Human
agggcaaggugguacuuccuccuucug

SEQ ID NO: 51843 - RNA, 22 nt, Human
cauggggcugaaggccgcccag

SEQ ID NO: 51844 - RNA, 20 nt, Human
acccuguggagucaccccaa

SEQ ID NO: 51845 - RNA, 21 nt, Human
ggagguugaggagggaggaug

SEQ ID NO: 51846 - RNA, 17 nt, Human
cuaagaaugaugaagca

SEQ ID NO: 51847 - RNA, 22 nt, Human
auguaaccauuuuaugaagguu

SEQ ID NO: 51848 - RNA, 20 nt, Human
guauguggcaaaauguuaca

SEQ ID NO: 51849 - RNA, 27 nt, Human
ggugguuguuuuuaaguguggagggca

SEQ ID NO: 51850 - RNA, 26 nt, Human
caguucugagguagguguuacuagcc

SEQ ID NO: 51851 - RNA, 27 nt, Human
caucugcacuccagcccaggacugugg

SEQ ID NO: 51852 - RNA, 18 nt, Human
ggcgggggaucccgagca

SEQ ID NO: 51853 - RNA, 23 nt, Human
cuggccuccuguuccucugcugg

SEQ ID NO: 51854 - RNA, 22 nt, Human
gaacccgggaggcagagguugc

SEQ ID NO: 51855 - RNA, 22 nt, Human
gagcccgggaagcagagguugc

SEQ ID NO: 51856 - RNA, 22 nt, Human
gaaccugggaggcagagguugu

SEQ ID NO: 51857 - RNA, 22 nt, Human
cugcuggagugcaguggcacaa

SEQ ID NO: 51858 - RNA, 23 nt, Human
gcuguccuuugcaacauucucau

SEQ ID NO: 51859 - RNA, 23 nt, Human
guggaagagaaaugagcuuggcu

SEQ ID NO: 51860 - RNA, 22 nt, Human
uaccaguuuuggagacugccug

SEQ ID NO: 51861 - RNA, 21 nt, Human
uuccagcaccuucucucucca

SEQ ID NO: 51862 - RNA, 23 nt, Human
cuacaucuagcaauuucucuuua

SEQ ID NO: 51863 - RNA, 25 nt, Human
uucuauuggucaggcaauugucaua

SEQ ID NO: 51864 - RNA, 25 nt, Human
cacuuccucugggcccuggcugugg

SEQ ID NO: 51865 - RNA, 22 nt, Human
ucucaaggagcuuccagugcag

SEQ ID NO: 51866 - RNA, 22 nt, Human
agaaccucuuuuugugggugau

SEQ ID NO: 51867 - RNA, 22 nt, Human
uuuggaggcagggcugggaagg

SEQ ID NO: 51868 - RNA, 20 nt, Human
gcacggcaaccgcgaggccu

SEQ ID NO: 51869 - RNA, 24 nt, Human
accaggauugcuggaagugugacg

SEQ ID NO: 51870 - RNA, 23 nt, Human
ucugcagcugcccugcccgugcc

SEQ ID NO: 51871 - RNA, 23 nt, Human
augcaccagcccuugugcauuua

SEQ ID NO: 51872 - RNA, 24 nt, Human
uuuccucugcggaguguagcagcc

SEQ ID NO: 51873 - RNA, 24 nt, Human
caggcggccgcuuggccggaucca

SEQ ID NO: 51874 - RNA, 22 nt, Human
cauguaugauuauuucuguuaa

SEQ ID NO: 51875 - RNA, 22 nt, Human
agaccuacagucagauguuuug

SEQ ID NO: 51876 - RNA, 21 nt, Human
uuucagucuuucaaauagcug

SEQ ID NO: 51877 - RNA, 23 nt, Human
ugucgccuaggcuggagugcagu

SEQ ID NO: 51878 - RNA, 26 nt, Human
gaggugcgcuuauuugauugccaagu

SEQ ID NO: 51879 - RNA, 22 nt, Human
guugccuaggcuggucuggagc

SEQ ID NO: 51880 - RNA, 24 nt, Human
gcauagugccauuggauagggaag

SEQ ID NO: 51881 - RNA, 22 nt, Human
gaguagcugggauuagaggcgu

SEQ ID NO: 51882 - RNA, 21 nt, Human
aggauguuucugcaucauguc

SEQ ID NO: 51883 - RNA, 23 nt, Human
cccuccagggggcccugggccuc

SEQ ID NO: 51884 - RNA, 27 nt, Human
agguaccucucuuagggacucugugau

SEQ ID NO: 51885 - RNA, 22 nt, Human
ucuccaggcuggagugcagugg

SEQ ID NO: 51886 - RNA, 22 nt, Human
ggcugcaaucucugcacuuugg

SEQ ID NO: 51887 - RNA, 24 nt, Human
ccucacggucacagaacuaguuuu

SEQ ID NO: 51888 - RNA, 26 nt, Human
uucauuucuaguacacgcccuauuua

SEQ ID NO: 51889 - RNA, 22 nt, Human
ccucucccugcaccugccuugu

SEQ ID NO: 51890 - RNA, 24 nt, Human
cugcacgcaccuggccuccaugga

SEQ ID NO: 51891 - RNA, 27 nt, Human
cccaccccacgccuuagcugcaggccc

SEQ ID NO: 51892 - RNA, 23 nt, Human
gcuuggggccagggaagggacug

SEQ ID NO: 51893 - RNA, 29 nt, Human
uacagugguuucugaagcuuuugcaggga

SEQ ID NO: 51894 - RNA, 22 nt, Human
aggcuggagugcuauggugcaa

SEQ ID NO: 51895 - RNA, 19 nt, Human
acaaguugauuuggaacac

SEQ ID NO: 51896 - RNA, 25 nt, Human
gcuugaagaguggagaggcgagagg

SEQ ID NO: 51897 - RNA, 22 nt, Human
gcuccccagguucauccugugu

SEQ ID NO: 51898 - RNA, 28 nt, Human
ugcuuuauauuaguuuguuuuucacugu

SEQ ID NO: 51899 - RNA, 20 nt, Human
gcuugagacacuaauacaga

SEQ ID NO: 51900 - RNA, 20 nt, Human
uuaacaaaugcaaccaccaa

SEQ ID NO: 51901 - RNA, 22 nt, Human
ccaacauggcaaaaccccuuau

SEQ ID NO: 51902 - RNA, 27 nt, Human
ggucagccacaccagggcaccgcagcc

SEQ ID NO: 51903 - RNA, 22 nt, Human
ggcuuccucugugcucuaccuu

SEQ ID NO: 51904 - RNA, 23 nt, Human
ugggaaagagaauguuccuggua

SEQ ID NO: 51905 - RNA, 21 nt, Human
ccgccucccgagcaccagcgc

SEQ ID NO: 51906 - RNA, 25 nt, Human
ccugccauccugucagcacagucuu

SEQ ID NO: 51907 - RNA, 22 nt, Human
aagcugaggcaggugaauuguu

SEQ ID NO: 51908 - RNA, 24 nt, Human
guccugcugccucccuuucauaca

SEQ ID NO: 51909 - RNA, 21 nt, Human
ggcucacugcaacuuccaccu

SEQ ID NO: 51910 - RNA, 24 nt, Human
uucuccucucagcucauacauaac

SEQ ID NO: 51911 - RNA, 18 nt, Human
gguagugccugccuuuga

SEQ ID NO: 51912 - RNA, 21 nt, Human
acuuugcugccccaccaucuu

SEQ ID NO: 51913 - RNA, 25 nt, Human
ccuccuguccacugugucacucucc

SEQ ID NO: 51914 - RNA, 26 nt, Human
accacugcacgacggggcuggacuga

SEQ ID NO: 51915 - RNA, 23 nt, Human
ugccaaaacaugauugaagccuu

SEQ ID NO: 51916 - RNA, 23 nt, Human
gguuccuuggaccguaucacugg

SEQ ID NO: 51917 - RNA, 21 nt, Human
ccugcuguuuggaaaggguga

SEQ ID NO: 51918 - RNA, 22 nt, Human
aguucaacugcuuacucccaaa

SEQ ID NO: 51919 - RNA, 27 nt, Human
ggagacuguuucacacacaggagauug

SEQ ID NO: 51920 - RNA, 22 nt, Human
ugcaaccuccgcauccgggguu

SEQ ID NO: 51921 - RNA, 26 nt, Human
gguuugcaggugcagggggaccuuag

SEQ ID NO: 51922 - RNA, 23 nt, Human
ccuucccuugaagaaaugcagca

SEQ ID NO: 51923 - RNA, 23 nt, Human
ugcagccgccuccggagcuucgg

SEQ ID NO: 51924 - RNA, 21 nt, Human
aaaaacugaaguucugccucu

SEQ ID NO: 51925 - RNA, 22 nt, Human
gguagugccaaucuccuugccc

SEQ ID NO: 51926 - RNA, 24 nt, Human
uugcauugugacuauccagugauc

SEQ ID NO: 51927 - RNA, 19 nt, Human
cugguccccacagacucag

SEQ ID NO: 51928 - RNA, 25 nt, Human
gccugugcaucuucucgcacugaga

SEQ ID NO: 51929 - RNA, 21 nt, Human
cuuuagguacuucaguuauga

SEQ ID NO: 51930 - RNA, 22 nt, Human
uacagauauuuuuucuaaccau

SEQ ID NO: 51931 - RNA, 20 nt, Human
caccuuauucauggcugaag

SEQ ID NO: 51932 - RNA, 23 nt, Human
uguggugauuccauuuuacuucc

SEQ ID NO: 51933 - RNA, 19 nt, Human
gacacugucucaaaaaaga

SEQ ID NO: 51934 - RNA, 19 nt, Human
auauucuucuaauaauuua

SEQ ID NO: 51935 - RNA, 21 nt, Human
uucccuggugcucucagucca

SEQ ID NO: 51936 - RNA, 18 nt, Human
ccaagguggccaagcaga

SEQ ID NO: 51937 - RNA, 24 nt, Human
ucagugauugccauuagacuguug

SEQ ID NO: 51938 - RNA, 22 nt, Human
gaucgggaggaaaaauauggaa

SEQ ID NO: 51939 - RNA, 18 nt, Human
gucccuugccacucccca

SEQ ID NO: 51940 - RNA, 21 nt, Human
ccuguaauccaagcacuuggg

SEQ ID NO: 51941 - RNA, 21 nt, Human
uauuuggaaaguguguauuua

SEQ ID NO: 51942 - RNA, 17 nt, Human
aaguguaacuggcaguu

SEQ ID NO: 51943 - RNA, 26 nt, Human
ccugcacuucauaucuagauuucuag

SEQ ID NO: 51944 - RNA, 20 nt, Human
ugguguaggacuuaaccuca

SEQ ID NO: 51945 - RNA, 21 nt, Human
cccugcuccccauaacagacc

SEQ ID NO: 51946 - RNA, 20 nt, Human
cuucccuuggacacuaacuc

SEQ ID NO: 51947 - RNA, 20 nt, Human
uuccaaagccauuuaccuca

SEQ ID NO: 51948 - RNA, 21 nt, Human
cuggccuccagaacucagccu

SEQ ID NO: 51949 - RNA, 29 nt, Human
uucugccucccugcccuccagaccaugga

SEQ ID NO: 51950 - RNA, 27 nt, Human
gugaccucccaagggggugggaacuug

SEQ ID NO: 51951 - RNA, 22 nt, Human
agccuaacucugaggaaaacaa

SEQ ID NO: 51952 - RNA, 26 nt, Human
uucccccugccccaccucucccacca

SEQ ID NO: 51953 - RNA, 21 nt, Human
aaaaaguuuauuuuccuuuug

SEQ ID NO: 51954 - RNA, 26 nt, Human
cuaccugaguugcuggcauugggagg

SEQ ID NO: 51955 - RNA, 26 nt, Human
gguacccguccgcauacgaaucuagc

SEQ ID NO: 51956 - RNA, 23 nt, Human
acaaauaaguuuauauguguaca

SEQ ID NO: 51957 - RNA, 22 nt, Human
ggagcaguaaguggagaagagc

SEQ ID NO: 51958 - RNA, 22 nt, Human
cagcccagacaagauggcugga

SEQ ID NO: 51959 - RNA, 27 nt, Human
ggagcugagacaggcucggcagcggca

SEQ ID NO: 51960 - RNA, 23 nt, Human
cagggccagggagccaaguuucc

SEQ ID NO: 51961 - RNA, 18 nt, Human
ucaagaagaccagaggaa

SEQ ID NO: 51962 - RNA, 25 nt, Human
cccucgaagcugcuguucucuuguc

SEQ ID NO: 51963 - RNA, 26 nt, Human
auaaaugaucaaaaaauuugcauuua

SEQ ID NO: 51964 - RNA, 25 nt, Human
uggguuugcagaugggugcccugaa

SEQ ID NO: 51965 - RNA, 21 nt, Human
ucauaguugaggacagcaggu

SEQ ID NO: 51966 - RNA, 27 nt, Human
gauuacaucaaggcuucaaaaauacuc

SEQ ID NO: 51967 - RNA, 23 nt, Human
uaaucagugcauuugaaaauuca

SEQ ID NO: 51968 - RNA, 22 nt, Human
gaaaguuucagcucacugugaa

SEQ ID NO: 51969 - RNA, 24 nt, Human
ucuccacucugcacccuaccucgu

SEQ ID NO: 51970 - RNA, 21 nt, Human
acuucuuagcugucacuuugg

SEQ ID NO: 51971 - RNA, 24 nt, Human
aguucucgcuuccuccuuugggca

SEQ ID NO: 51972 - RNA, 27 nt, Human
ugcuuggauuuauuuguguuuuuguaa

SEQ ID NO: 51973 - RNA, 22 nt, Human
gcgucgguccuggugcccugga

SEQ ID NO: 51974 - RNA, 23 nt, Human
agacuucugguauuaucucucua

SEQ ID NO: 51975 - RNA, 27 nt, Human
acacuucaaggugacagaaggaccagc

SEQ ID NO: 51976 - RNA, 22 nt, Human
cgggagguggugaccgcgcugg

SEQ ID NO: 51977 - RNA, 21 nt, Human
cucccaucccccaccuucccg

SEQ ID NO: 51978 - RNA, 24 nt, Human
ucuccacccaccccacagcaggcc

SEQ ID NO: 51979 - RNA, 21 nt, Human
aacaggggcugggaauggagg

SEQ ID NO: 51980 - RNA, 18 nt, Human
cucugguggcaggugccu

SEQ ID NO: 51981 - RNA, 18 nt, Human
ccaaguguagauguagca

SEQ ID NO: 51982 - RNA, 22 nt, Human
ucuccugcuaccagucugugcc

SEQ ID NO: 51983 - RNA, 24 nt, Human
gauaccacuggcuuuccugcuucu

SEQ ID NO: 51984 - RNA, 22 nt, Human
gcacagccugccccaauucccc

SEQ ID NO: 51985 - RNA, 21 nt, Human
gcuaucucccugccuccugcc

SEQ ID NO: 51986 - RNA, 24 nt, Human
agaggggagagagacuggagcugg

SEQ ID NO: 51987 - RNA, 21 nt, Human
gggaguggcucggaaggggcc

SEQ ID NO: 51988 - RNA, 27 nt, Human
caugggugugaaugcacacacauacgc

SEQ ID NO: 51989 - RNA, 22 nt, Human
auguucuuuaacuauauacuau

SEQ ID NO: 51990 - RNA, 27 nt, Human
guccagccuguucacacugcaccucag

SEQ ID NO: 51991 - RNA, 21 nt, Human
gcuugggcaaagggcaucaua

SEQ ID NO: 51992 - RNA, 17 nt, Human
uuucccuuacacagauu

SEQ ID NO: 51993 - RNA, 23 nt, Human
uggucccagggaggccucucugc

SEQ ID NO: 51994 - RNA, 26 nt, Human
ucucuguucugcucccagaugccuuc

SEQ ID NO: 51995 - RNA, 25 nt, Human
acaccgccagccucgggccugggau

SEQ ID NO: 51996 - RNA, 24 nt, Human
caucuugccagcucugucuuucca

SEQ ID NO: 51997 - RNA, 27 nt, Human
uucuccuccucuccaucccuauucccu

SEQ ID NO: 51998 - RNA, 25 nt, Human
cccaacaaauuaagguuugugccua

SEQ ID NO: 51999 - RNA, 24 nt, Human
gucccuuuuugucucucaugggcc

SEQ ID NO: 52000 - RNA, 27 nt, Human
ggcuacugucugggcugagcaguagug

SEQ ID NO: 52001 - RNA, 23 nt, Human
ggaauucccuccugagugcccca

SEQ ID NO: 52002 - RNA, 23 nt, Human
agggagaaacuucugggagccuc

SEQ ID NO: 52003 - RNA, 22 nt, Human
cugacgaacuccuugauuuuag

SEQ ID NO: 52004 - RNA, 30 nt, Human
ucacugaauaauuauaggcuuuuccucaca

SEQ ID NO: 52005 - RNA, 21 nt, Human
ccugcccagccccaccucagc

SEQ ID NO: 52006 - RNA, 23 nt, Human
ugguuucagcauuaguaccuaca

SEQ ID NO: 52007 - RNA, 24 nt, Human
ggcgcugugaucugguuauuggga

SEQ ID NO: 52008 - RNA, 26 nt, Human
uuuugaaggagcuaaugaaacacugg

SEQ ID NO: 52009 - RNA, 21 nt, Human
uuuccuucucucucaauuuuc

SEQ ID NO: 52010 - RNA, 24 nt, Human
cucuguuacaaccucagcacuuug

SEQ ID NO: 52011 - RNA, 27 nt, Human
gcugcuguuuagggaacuugagggacg

SEQ ID NO: 52012 - RNA, 27 nt, Human
ucaggcugaagaaccggggugcuguuu

SEQ ID NO: 52013 - RNA, 32 nt, Human
gggcagaggugcaagagagggauguacugaag

SEQ ID NO: 52014 - RNA, 25 nt, Human
guaaaugggcuuuagucuggaaacc

SEQ ID NO: 52015 - RNA, 26 nt, Human
ccuggcaacagagcgagauuccaucu

SEQ ID NO: 52016 - RNA, 20 nt, Human
agguccuguccacagcugga

SEQ ID NO: 52017 - RNA, 29 nt, Human
gaaguggaaggauggucucaggguucuga

SEQ ID NO: 52018 - RNA, 24 nt, Human
aauggucauucgggcugggcgcag

SEQ ID NO: 52019 - RNA, 26 nt, Human
caaaccugcaugaagcaagaacaacu

SEQ ID NO: 52020 - RNA, 27 nt, Human
caccuugguuugcaaaacccauauccc

SEQ ID NO: 52021 - RNA, 21 nt, Human
guccucucccccucgccgccc

SEQ ID NO: 52022 - RNA, 22 nt, Human
uucauuuccuuggggcugcagu

SEQ ID NO: 52023 - RNA, 24 nt, Human
caugcagcucucagcacugggugg

SEQ ID NO: 52024 - RNA, 25 nt, Human
cauugugaagcaccuacuaugugcu

SEQ ID NO: 52025 - RNA, 21 nt, Human
ggaagcagagguugcaguaag

SEQ ID NO: 52026 - RNA, 23 nt, Human
caguucacugcaacuucugccuc

SEQ ID NO: 52027 - RNA, 32 nt, Human
gugagcagagucacccacagggccagccccuc

SEQ ID NO: 52028 - RNA, 22 nt, Human
uuggccaucccuuccccagcca

SEQ ID NO: 52029 - RNA, 19 nt, Human
ccagcacugugggaggcug

SEQ ID NO: 52030 - RNA, 27 nt, Human
cccagcuccccggaugaaacagauaua

SEQ ID NO: 52031 - RNA, 27 nt, Human
uacagaagaucagcuagacacacccag

SEQ ID NO: 52032 - RNA, 21 nt, Human
gguggacacuuggcaccagcu

SEQ ID NO: 52033 - RNA, 22 nt, Human
ugcuugaacccgggagguggag

SEQ ID NO: 52034 - RNA, 22 nt, Human
cuucuggugcuacuccaugcag

SEQ ID NO: 52035 - RNA, 26 nt, Human
uucauugucucuaucugaaccacccu

SEQ ID NO: 52036 - RNA, 21 nt, Human
aaggucuucauuuuacaguga

SEQ ID NO: 52037 - RNA, 27 nt, Human
ugcagugaguggagaucgcaccacugc

SEQ ID NO: 52038 - RNA, 21 nt, Human
uaacauuugcuguuuuauagg

SEQ ID NO: 52039 - RNA, 20 nt, Human
aucuaucagucuuacuccaa

SEQ ID NO: 52040 - RNA, 24 nt, Human
agagacacuuagguccagccuguu

SEQ ID NO: 52041 - RNA, 27 nt, Human
gccauugcugcugugcagaaggucagu

SEQ ID NO: 52042 - RNA, 20 nt, Human
ccuuucuccacaggcaggcu

SEQ ID NO: 52043 - RNA, 24 nt, Human
cccuucccuauacacacagggcuc

SEQ ID NO: 52044 - RNA, 22 nt, Human
ccggaucgucagccaccuugcc

SEQ ID NO: 52045 - RNA, 24 nt, Human
ucacccaggcugggaauugcagug

SEQ ID NO: 52046 - RNA, 27 nt, Human
caaagagacuuccucuuggcguucagg

SEQ ID NO: 52047 - RNA, 20 nt, Human
cugcccuuuuguguguuagc

SEQ ID NO: 52048 - RNA, 20 nt, Human
cgggccggcccugccuccac

SEQ ID NO: 52049 - RNA, 25 nt, Human
cuauucaauuucucaguuuauguug

SEQ ID NO: 52050 - RNA, 20 nt, Human
acuauccugauuccaaauau

SEQ ID NO: 52051 - RNA, 22 nt, Human
aaaugaacuuuuacagaaugca

SEQ ID NO: 52052 - RNA, 23 nt, Human
ugguucugcaaggaaccagggcu

SEQ ID NO: 52053 - RNA, 25 nt, Human
uuagcaacaacagugugaggcucca

SEQ ID NO: 52054 - RNA, 27 nt, Human
acacagccuugcuacagcggaggcagc

SEQ ID NO: 52055 - RNA, 18 nt, Human
ccuguuagcacagugccu

SEQ ID NO: 52056 - RNA, 22 nt, Human
cuccccgccuguccugccucuc

SEQ ID NO: 52057 - RNA, 21 nt, Human
uucuuuucuccccuugggucu

SEQ ID NO: 52058 - RNA, 20 nt, Human
ugacacacaggaucccaggc

SEQ ID NO: 52059 - RNA, 25 nt, Human
ucaccuucuuuguaaucccuucaca

SEQ ID NO: 52060 - RNA, 22 nt, Human
caggacugccccuuccugggcc

SEQ ID NO: 52061 - RNA, 25 nt, Human
guuuucugggggagugcagggggag

SEQ ID NO: 52062 - RNA, 21 nt, Human
auucucauucuuuaucccacu

SEQ ID NO: 52063 - RNA, 21 nt, Human
ccuaggaggcugcaugcggau

SEQ ID NO: 52064 - RNA, 27 nt, Human
ccuguggacuuucacccagcacugugg

SEQ ID NO: 52065 - RNA, 21 nt, Human
ccugccccaccccaccuccac

SEQ ID NO: 52066 - RNA, 19 nt, Human
gcagcguucccacagcccc

SEQ ID NO: 52067 - RNA, 25 nt, Human
gccugguccaggcuugggcuccauu

SEQ ID NO: 52068 - RNA, 24 nt, Human
uggaagccugguggccuuccuuuc

SEQ ID NO: 52069 - RNA, 26 nt, Human
guagugcuaggauugauuauguguuc

SEQ ID NO: 52070 - RNA, 29 nt, Human
gacagccucaugggccacuguggcccgau

SEQ ID NO: 52071 - RNA, 22 nt, Human
uccggaguccccguggccaggg

SEQ ID NO: 52072 - RNA, 28 nt, Human
ugaacccugaaauguuguguagacaccc

SEQ ID NO: 52073 - RNA, 22 nt, Human
ggggugcugccucucccucccu

SEQ ID NO: 52074 - RNA, 22 nt, Human
uucaccauguugcucaggcugg

SEQ ID NO: 52075 - RNA, 19 nt, Human
agugcaacggcacgaucuc

SEQ ID NO: 52076 - RNA, 27 nt, Human
cucuagggugaaccaagcuauaaaagc

SEQ ID NO: 52077 - RNA, 22 nt, Human
agccuccagaguagcugggacu

SEQ ID NO: 52078 - RNA, 21 nt, Human
ucauaggcaccacauuuuuca

SEQ ID NO: 52079 - RNA, 22 nt, Human
ugccuguaaucccagcacuaug

SEQ ID NO: 52080 - RNA, 21 nt, Human
gcaugcaucuguaacccagcu

SEQ ID NO: 52081 - RNA, 20 nt, Human
ugaccaggcuggagugcagu

SEQ ID NO: 52082 - RNA, 18 nt, Human
aaaacacaaauuagccag

SEQ ID NO: 52083 - RNA, 21 nt, Human
agucagaggucaguaucucag

SEQ ID NO: 52084 - RNA, 26 nt, Human
uugcccaggcuggaguacaauggugc

SEQ ID NO: 52085 - RNA, 23 nt, Human
gcccuguuccccacccuaccuca

SEQ ID NO: 52086 - RNA, 27 nt, Human
uaauccuucacuuuaauacaauaggcu

SEQ ID NO: 52087 - RNA, 23 nt, Human
ucuuaauuuuguuauacagucuu

SEQ ID NO: 52088 - RNA, 25 nt, Human
caaaagcagaccugcgagaucucuu

SEQ ID NO: 52089 - RNA, 20 nt, Human
uuccuuccccuccucucucc

SEQ ID NO: 52090 - RNA, 27 nt, Human
gaccauccuggccauagcagccaagcc

SEQ ID NO: 52091 - RNA, 22 nt, Human
ggcucacugcaagcuuccccuu

SEQ ID NO: 52092 - RNA, 22 nt, Human
gaacgugggaggcagagguugc

SEQ ID NO: 52093 - RNA, 23 nt, Human
ccugcuguccggacacuuuuuuc

SEQ ID NO: 52094 - RNA, 26 nt, Human
cucguuugugcuuugcgccuuccucc

SEQ ID NO: 52095 - RNA, 18 nt, Human
gcccuccccuccugcgcu

SEQ ID NO: 52096 - RNA, 22 nt, Human
cagucccuucucuccuggucug

SEQ ID NO: 52097 - RNA, 22 nt, Human
cucaacacuuuaaucaugguuu

SEQ ID NO: 52098 - RNA, 22 nt, Human
acuccacuggcuccaugauucu

SEQ ID NO: 52099 - RNA, 22 nt, Human
cacacucaaaggggcaugggug

SEQ ID NO: 52100 - RNA, 26 nt, Human
gggggcacccuuugagcugugggucu

SEQ ID NO: 52101 - RNA, 21 nt, Human
gcugccuccccuccaucagcc

SEQ ID NO: 52102 - RNA, 22 nt, Human
auugcuugagcccaggaguuga

SEQ ID NO: 52103 - RNA, 21 nt, Human
uuugggagcugagcuagugcu

SEQ ID NO: 52104 - RNA, 25 nt, Human
gggugucgaggcaggaaggauuguu

SEQ ID NO: 52105 - RNA, 23 nt, Human
ucucacuauguugcccaggcugg

SEQ ID NO: 52106 - RNA, 22 nt, Human
aacucacucuauucuguccuca

SEQ ID NO: 52107 - RNA, 22 nt, Human
cucugcucucccagcacugacu

SEQ ID NO: 52108 - RNA, 20 nt, Human
ccaccccauuaaagugcagu

SEQ ID NO: 52109 - RNA, 22 nt, Human
gcaggagccacugagcccagcc

SEQ ID NO: 52110 - RNA, 26 nt, Human
ggcuggggccaacuggaaccauuggc

SEQ ID NO: 52111 - RNA, 22 nt, Human
cccaacaugccuccugcccugc

SEQ ID NO: 52112 - RNA, 25 nt, Human
uacuuuguaaaguguuauacaauca

SEQ ID NO: 52113 - RNA, 20 nt, Human
ucugccucccaggcucaagc

SEQ ID NO: 52114 - RNA, 17 nt, Human
uucauguuuaucuuuaa

SEQ ID NO: 52115 - RNA, 25 nt, Human
ugccuguaaacacaacaguauuuau

SEQ ID NO: 52116 - RNA, 26 nt, Human
cccuccagauguauccuugggaaaag

SEQ ID NO: 52117 - RNA, 22 nt, Human
gggccccugccuucaagagcca

SEQ ID NO: 52118 - RNA, 27 nt, Human
gagaccccauggauccucuggcuggga

SEQ ID NO: 52119 - RNA, 25 nt, Human
ggggugagcaggcgaacagagcucu

SEQ ID NO: 52120 - RNA, 20 nt, Human
guguuaaccaggauggucuc

SEQ ID NO: 52121 - RNA, 24 nt, Human
uuucauguguuuuauaaaaucaag

SEQ ID NO: 52122 - RNA, 22 nt, Human
uucaagacauugaaacuacuuu

SEQ ID NO: 52123 - RNA, 21 nt, Human
guggccuccccucugucugcc

SEQ ID NO: 52124 - RNA, 23 nt, Human
agggagccaccagcaguggcuuc

SEQ ID NO: 52125 - RNA, 22 nt, Human
gucuguaauccuagcacugugg

SEQ ID NO: 52126 - RNA, 21 nt, Human
uggcuguaaauuauuguaaau

SEQ ID NO: 52127 - RNA, 23 nt, Human
uuccuagauagaaaccaaagcag

SEQ ID NO: 52128 - RNA, 21 nt, Human
acgccuguaucccagcacuuu

SEQ ID NO: 52129 - RNA, 22 nt, Human
cccaguagcugagauugcaggc

SEQ ID NO: 52130 - RNA, 19 nt, Human
auaccagccugaauagugu

SEQ ID NO: 52131 - RNA, 21 nt, Human
ccucacugggggcuuugggcc

SEQ ID NO: 52132 - RNA, 29 nt, Human
ccuggaggaaggauggcucuggccucggu

SEQ ID NO: 52133 - RNA, 21 nt, Human
ucucugcuguuccucucuaca

SEQ ID NO: 52134 - RNA, 26 nt, Human
caggagcagaggcuuugagaagccag

SEQ ID NO: 52135 - RNA, 21 nt, Human
ccacucgcuugccugcccugg

SEQ ID NO: 52136 - RNA, 18 nt, Human
ggcccuagagcacuucua

SEQ ID NO: 52137 - RNA, 20 nt, Human
uugugaucccagcacuuugg

SEQ ID NO: 52138 - RNA, 26 nt, Human
ccuggucagcccaaaccaccagaagc

SEQ ID NO: 52139 - RNA, 20 nt, Human
ccuccucccccuccacagcc

SEQ ID NO: 52140 - RNA, 23 nt, Human
ucuguuguuuuuaggauggagcu

SEQ ID NO: 52141 - RNA, 21 nt, Human
gggaccccacccucucccagc

SEQ ID NO: 52142 - RNA, 22 nt, Human
gacccuacuggagcaauuugug

SEQ ID NO: 52143 - RNA, 20 nt, Human
gucgccuccugcucuuuugu

SEQ ID NO: 52144 - RNA, 20 nt, Human
ugcuggcaguacaaugacag

SEQ ID NO: 52145 - RNA, 24 nt, Human
gaggacccaguguucuuagcugaa

SEQ ID NO: 52146 - RNA, 21 nt, Human
uugccaggccccaaaggccac

SEQ ID NO: 52147 - RNA, 23 nt, Human
cuguauccccuaaaauauuucug

SEQ ID NO: 52148 - RNA, 22 nt, Human
ugcuuaaacccgggaggcggag

SEQ ID NO: 52149 - RNA, 22 nt, Human
aucccauucugcgucaugcuug

SEQ ID NO: 52150 - RNA, 27 nt, Human
cuguauuccuagaaacugacacaugcu

SEQ ID NO: 52151 - RNA, 21 nt, Human
aguuguuauuguuaucccuug

SEQ ID NO: 52152 - RNA, 20 nt, Human
gugugacccaaauuuguaua

SEQ ID NO: 52153 - RNA, 18 nt, Human
ccuaaccuagagcagguu

SEQ ID NO: 52154 - RNA, 18 nt, Human
cccuuuccugauucccua

SEQ ID NO: 52155 - RNA, 23 nt, Human
gcccccagaggcucagcacuuug

SEQ ID NO: 52156 - RNA, 22 nt, Human
auugcuugaaccugggagguag

SEQ ID NO: 52157 - RNA, 20 nt, Human
agaagccagcaggcaccacu

SEQ ID NO: 52158 - RNA, 26 nt, Human
aagauaacauguaggccaggcagguc

SEQ ID NO: 52159 - RNA, 21 nt, Human
ucuggaagcuuuucucuuugc

SEQ ID NO: 52160 - RNA, 22 nt, Human
caccuucacuccagcuggacaa

SEQ ID NO: 52161 - RNA, 21 nt, Human
uguuacagguuacaugagagc

SEQ ID NO: 52162 - RNA, 29 nt, Human
caaaauugggaaagaacauguguccauuu

SEQ ID NO: 52163 - RNA, 22 nt, Human
aggggugacagggaguaaaagg

SEQ ID NO: 52164 - RNA, 21 nt, Human
uuugggccacgccgggcuggg

SEQ ID NO: 52165 - RNA, 21 nt, Human
aggauagugaaucauucuuua

SEQ ID NO: 52166 - RNA, 22 nt, Human
aauggcugaggugggguuuggg

SEQ ID NO: 52167 - RNA, 21 nt, Human
guccuggcugauuaugcauca

SEQ ID NO: 52168 - RNA, 25 nt, Human
accagaauugcuugaacccaggagg

SEQ ID NO: 52169 - RNA, 22 nt, Human
gaugcucugaggcuucugggag

SEQ ID NO: 52170 - RNA, 22 nt, Human
ggagagccccucacacagcccu

SEQ ID NO: 52171 - RNA, 24 nt, Human
uuaauuucuucacaccuacccucc

SEQ ID NO: 52172 - RNA, 21 nt, Human
auagauuucauuucacucuag

SEQ ID NO: 52173 - RNA, 26 nt, Human
uugcagcugaucauagcucacugcag

SEQ ID NO: 52174 - RNA, 23 nt, Human
cccagaaggcagagguugcagug

SEQ ID NO: 52175 - RNA, 23 nt, Human
accuucaggcagccagugugaca

SEQ ID NO: 52176 - RNA, 25 nt, Human
gcgucauaccuuuaucuauagccuu

SEQ ID NO: 52177 - RNA, 20 nt, Human
agcgccauggcagagcugug

SEQ ID NO: 52178 - RNA, 19 nt, Human
ucauagcucgcugcagccu

SEQ ID NO: 52179 - RNA, 20 nt, Human
agaggaccuccagaacacca

SEQ ID NO: 52180 - RNA, 21 nt, Human
ugaggacaacagccccagcuc

SEQ ID NO: 52181 - RNA, 21 nt, Human
ccucuacucuggcucaggacc

SEQ ID NO: 52182 - RNA, 21 nt, Human
cucagggcccaccuccuccag

SEQ ID NO: 52183 - RNA, 23 nt, Human
ucucuauacuacauuauuaaugg

SEQ ID NO: 52184 - RNA, 22 nt, Human
aacuuuaaaauaccugcuuuau

SEQ ID NO: 52185 - RNA, 21 nt, Human
ggcuucagcagagugugaggg

SEQ ID NO: 52186 - RNA, 22 nt, Human
uucagagauggcuuccaggcaa

SEQ ID NO: 52187 - RNA, 27 nt, Human
ggaggcugaggcaggaggauugccuga

SEQ ID NO: 52188 - RNA, 26 nt, Human
ccccaggccaguuuuguacugaaggc

SEQ ID NO: 52189 - RNA, 25 nt, Human
uuuacugauuuuuuauucuccagcu

SEQ ID NO: 52190 - RNA, 22 nt, Human
gaugcuggcggaaaaccuggua

SEQ ID NO: 52191 - RNA, 20 nt, Human
auacaguguguguuauuacg

SEQ ID NO: 52192 - RNA, 23 nt, Human
agcuuccuccuccucuccagcug

SEQ ID NO: 52193 - RNA, 21 nt, Human
ucacagcccugcagugcccua

SEQ ID NO: 52194 - RNA, 20 nt, Human
gcucagucuccuuggugauu

SEQ ID NO: 52195 - RNA, 29 nt, Human
agagaaagggagggagggagccacccggg

SEQ ID NO: 52196 - RNA, 24 nt, Human
cuaccccccaggcugaagugcagu

SEQ ID NO: 52197 - RNA, 19 nt, Human
uacagcagguaacugugaa

SEQ ID NO: 52198 - RNA, 27 nt, Human
ccagcacucccacccacauugccugaa

SEQ ID NO: 52199 - RNA, 26 nt, Human
cucucaucuuuaucaucggaguugac

SEQ ID NO: 52200 - RNA, 24 nt, Human
cuucugcugcucucguggcccccu

SEQ ID NO: 52201 - RNA, 26 nt, Human
ucauagauuuauaugaugauaugaca

SEQ ID NO: 52202 - RNA, 27 nt, Human
ccgagauugugccauugcacugcagcc

SEQ ID NO: 52203 - RNA, 26 nt, Human
ugaggcggaggcugaggcaguggcga

SEQ ID NO: 52204 - RNA, 20 nt, Human
gcagaagggagcugggaaga

SEQ ID NO: 52205 - RNA, 20 nt, Human
cccuuucucccaaaaggaca

SEQ ID NO: 52206 - RNA, 19 nt, Human
auuacuuuagaaaauaagu

SEQ ID NO: 52207 - RNA, 20 nt, Human
agacaccucuccacuccuca

SEQ ID NO: 52208 - RNA, 22 nt, Human
cuugcaaacaaagaaggcuccg

SEQ ID NO: 52209 - RNA, 21 nt, Human
gggaaagggugggauuaagua

SEQ ID NO: 52210 - RNA, 23 nt, Human
cacacagggcgggagcccaggcc

SEQ ID NO: 52211 - RNA, 25 nt, Human
ccccaacagaagcagcagugccucu

SEQ ID NO: 52212 - RNA, 20 nt, Human
agagguagauuucaauuuga

SEQ ID NO: 52213 - RNA, 26 nt, Human
gcuagcaaacaaauggcuuacuuaca

SEQ ID NO: 52214 - RNA, 20 nt, Human
cagggaccccccacccaggg

SEQ ID NO: 52215 - RNA, 20 nt, Human
ccgaggcaggggaucugacc

SEQ ID NO: 52216 - RNA, 21 nt, Human
uugucuuuuuuccuccuugca

SEQ ID NO: 52217 - RNA, 23 nt, Human
aguuacuaugaaguuaacacagc

SEQ ID NO: 52218 - RNA, 23 nt, Human
cugauagucuuuaagccauucca

SEQ ID NO: 52219 - RNA, 25 nt, Human
guuaccugagauacugaagugcagc

SEQ ID NO: 52220 - RNA, 25 nt, Human
aggccugcccuucuccacugccccc

SEQ ID NO: 52221 - RNA, 20 nt, Human
agcuuacucaaccucugccu

SEQ ID NO: 52222 - RNA, 26 nt, Human
aucagccuggccaaaaugcugaaacu

SEQ ID NO: 52223 - RNA, 20 nt, Human
auaaagcaagaagacugauu

SEQ ID NO: 52224 - RNA, 20 nt, Human
ccugcucucuccucucuccc

SEQ ID NO: 52225 - RNA, 26 nt, Human
agguuagagggacaaagagcuuugca

SEQ ID NO: 52226 - RNA, 23 nt, Human
ccgacugcugcucugccuuccuu

SEQ ID NO: 52227 - RNA, 27 nt, Human
cagugggacuagccaggaaugagggag

SEQ ID NO: 52228 - RNA, 24 nt, Human
gggugccuguaaucccagcuacuu

SEQ ID NO: 52229 - RNA, 27 nt, Human
cuucugcuacuaaaauguucucauccu

SEQ ID NO: 52230 - RNA, 19 nt, Human
cucgacacagacucugcug

SEQ ID NO: 52231 - RNA, 24 nt, Human
cugcuccgggguggagcuggggug

SEQ ID NO: 52232 - RNA, 24 nt, Human
agccucgggcccuccugccugcag

SEQ ID NO: 52233 - RNA, 21 nt, Human
aauauacuaaauuaacuuuuu

SEQ ID NO: 52234 - RNA, 24 nt, Human
ucuauguaggugauguuuccagcu

SEQ ID NO: 52235 - RNA, 22 nt, Human
cagaaggcucgcuuacuuuggg

SEQ ID NO: 52236 - RNA, 27 nt, Human
ucuguaaccguuuugguuugagaaaaa

SEQ ID NO: 52237 - RNA, 23 nt, Human
cagccucuguaguucuuuuuaca

SEQ ID NO: 52238 - RNA, 22 nt, Human
ucugcccuugaggggccuaggg

SEQ ID NO: 52239 - RNA, 21 nt, Human
cccuuuugcaggcaccaccuu

SEQ ID NO: 52240 - RNA, 24 nt, Human
cccaaaccccacacugcgcugguu

SEQ ID NO: 52241 - RNA, 22 nt, Human
cuuaucuagaagcaguguuuag

SEQ ID NO: 52242 - RNA, 23 nt, Human
auccugccacugcacaccagccu

SEQ ID NO: 52243 - RNA, 19 nt, Human
auacuccaaacuguuucug

SEQ ID NO: 52244 - RNA, 21 nt, Human
gucgccaggcuggagugcagu

SEQ ID NO: 52245 - RNA, 20 nt, Human
ugugggaacucauucauucu

SEQ ID NO: 52246 - RNA, 26 nt, Human
auggaugggcuggugggcaggggggu

SEQ ID NO: 52247 - RNA, 21 nt, Human
cuguuacccaggcuggagugc

SEQ ID NO: 52248 - RNA, 21 nt, Human
ggcgcguagcggagaucccag

SEQ ID NO: 52249 - RNA, 21 nt, Human
gacauaggucuaggaugugug

SEQ ID NO: 52250 - RNA, 27 nt, Human
gcauggucauaguugcccuggguucag

SEQ ID NO: 52251 - RNA, 18 nt, Human
gcuuuaaaaauggccuuc

SEQ ID NO: 52252 - RNA, 22 nt, Human
agacuggcagaauauuuuuuaa

SEQ ID NO: 52253 - RNA, 27 nt, Human
agggaagaggcagggagggagcugagg

SEQ ID NO: 52254 - RNA, 27 nt, Human
agaucccuuugaccaggaugacugggg

SEQ ID NO: 52255 - RNA, 21 nt, Human
gacaacaacauuacuaaccug

SEQ ID NO: 52256 - RNA, 20 nt, Human
gcaaugcaaggaggggaaga

SEQ ID NO: 52257 - RNA, 26 nt, Human
cauaaaacaaaagcauuuugcuaagg

SEQ ID NO: 52258 - RNA, 24 nt, Human
ggccaaaucucgugguguuucgca

SEQ ID NO: 52259 - RNA, 21 nt, Human
gauccagaccaccuuccucca

SEQ ID NO: 52260 - RNA, 27 nt, Human
aggaaaagggcaaaaagaccaagaaga

SEQ ID NO: 52261 - RNA, 25 nt, Human
cuugcuuguuuucucugaacagcaa

SEQ ID NO: 52262 - RNA, 22 nt, Human
cucagccucccaaguagcugga

SEQ ID NO: 52263 - RNA, 22 nt, Human
cucagccucccaaauagcuggg

SEQ ID NO: 52264 - RNA, 26 nt, Human
cccaggcuguucuucaacuccugggc

SEQ ID NO: 52265 - RNA, 27 nt, Human
gacuuauuucaaauuuggacauggcua

SEQ ID NO: 52266 - RNA, 27 nt, Human
uuccuucaguuccccaggcuccuccuc

SEQ ID NO: 52267 - RNA, 25 nt, Human
gcuaugucccuagcugcaggaagcc

SEQ ID NO: 52268 - RNA, 21 nt, Human
augucugaccgacgaucccuc

SEQ ID NO: 52269 - RNA, 20 nt, Human
auaacuuuuucucaaaguca

SEQ ID NO: 52270 - RNA, 27 nt, Human
aaagugcugggauuacaagggugagcc

SEQ ID NO: 52271 - RNA, 21 nt, Human
gacaugugugccucagaucug

SEQ ID NO: 52272 - RNA, 25 nt, Human
uguuuguaauguauuuugauagcaa

SEQ ID NO: 52273 - RNA, 27 nt, Human
uugcccaggcuggaguguaguggugug

SEQ ID NO: 52274 - RNA, 27 nt, Human
uugcccaggcuggagugcaguggugcg

SEQ ID NO: 52275 - RNA, 27 nt, Human
uugcccaggauggagugcaguggugag

SEQ ID NO: 52276 - RNA, 22 nt, Human
cuagccugaauucuuuucaaua

SEQ ID NO: 52277 - RNA, 22 nt, Human
ucuccaucugcacgucucuccg

SEQ ID NO: 52278 - RNA, 22 nt, Human
cccuccucugcuccuccccaca

SEQ ID NO: 52279 - RNA, 24 nt, Human
gaugucagacuggcuggcugcagu

SEQ ID NO: 52280 - RNA, 19 nt, Human
uacugguuuguggccuuuu

SEQ ID NO: 52281 - RNA, 20 nt, Human
ugacuucucuuugugcagag

SEQ ID NO: 52282 - RNA, 19 nt, Human
caauggugggaacaggcau

SEQ ID NO: 52283 - RNA, 26 nt, Human
acauggucaguaggcacacugccccu

SEQ ID NO: 52284 - RNA, 23 nt, Human
cauccaggcuggagugcgguggu

SEQ ID NO: 52285 - RNA, 23 nt, Human
cguccaggcuggagugcaguggu

SEQ ID NO: 52286 - RNA, 27 nt, Human
auucucuauuuuuauauugaaacauaa

SEQ ID NO: 52287 - RNA, 25 nt, Human
agagaagagggcccagcccagagcc

SEQ ID NO: 52288 - RNA, 23 nt, Human
uccuccccacacagacuccaccc

SEQ ID NO: 52289 - RNA, 22 nt, Human
aaaaugaaaaagaaggucaugu

SEQ ID NO: 52290 - RNA, 22 nt, Human
ccaaaguguugggauuauaagc

SEQ ID NO: 52291 - RNA, 21 nt, Human
uuugcaugcugaaacuucuca

SEQ ID NO: 52292 - RNA, 19 nt, Human
cugcccagggggugcaaag

SEQ ID NO: 52293 - RNA, 22 nt, Human
gggagagagcagagaaguacag

SEQ ID NO: 52294 - RNA, 20 nt, Human
aucuccucuguggucuugcc

SEQ ID NO: 52295 - RNA, 21 nt, Human
acuguauuaguccauucuugc

SEQ ID NO: 52296 - RNA, 21 nt, Human
uuacucguccccgccauucca

SEQ ID NO: 52297 - RNA, 27 nt, Human
ggcucacgccuguaauuccaucauuuu

SEQ ID NO: 52298 - RNA, 18 nt, Human
ucaccuaggcuggagugc

SEQ ID NO: 52299 - RNA, 20 nt, Human
cuccaguaccuucugccaga

SEQ ID NO: 52300 - RNA, 26 nt, Human
uuacuaggcuaccuacuuucaugagu

SEQ ID NO: 52301 - RNA, 20 nt, Human
ugggcugguagacuuuuucg

SEQ ID NO: 52302 - RNA, 27 nt, Human
ccagcacuaugcuuuccuucuuuggga

SEQ ID NO: 52303 - RNA, 18 nt, Human
ggcucagggcccaccucc

SEQ ID NO: 52304 - RNA, 19 nt, Human
guugcucugcuacucugaa

SEQ ID NO: 52305 - RNA, 23 nt, Human
ggcuuaucuacagagcacacuuu

SEQ ID NO: 52306 - RNA, 27 nt, Human
auugcuguuaacuacuacugauaacug

SEQ ID NO: 52307 - RNA, 19 nt, Human
aaacaccuccacuaccuca

SEQ ID NO: 52308 - RNA, 23 nt, Human
gcgagccuggccagcgaggguag

SEQ ID NO: 52309 - RNA, 20 nt, Human
cagcccagggaaaccuccuc

SEQ ID NO: 52310 - RNA, 21 nt, Human
cuaggaggcagaagcuaagug

SEQ ID NO: 52311 - RNA, 22 nt, Human
cuccugaggccuggacccccag

SEQ ID NO: 52312 - RNA, 21 nt, Human
uuggcacagucucugccugcu

SEQ ID NO: 52313 - RNA, 18 nt, Human
ccugcucucacacacacc

SEQ ID NO: 52314 - RNA, 29 nt, Human
guuuaaguaacucucagcauuacaaaaga

SEQ ID NO: 52315 - RNA, 24 nt, Human
gcagccaggaguggcuggggaaga

SEQ ID NO: 52316 - RNA, 23 nt, Human
aaacuauucauucagcaugccua

SEQ ID NO: 52317 - RNA, 23 nt, Human
cacuccuguaaucccagcuacuc

SEQ ID NO: 52318 - RNA, 22 nt, Human
cuccaggcuggagugcaguggc

SEQ ID NO: 52319 - RNA, 21 nt, Human
cagugaagcugaauguccuca

SEQ ID NO: 52320 - RNA, 22 nt, Human
uuuuuccugaccggccuguguc

SEQ ID NO: 52321 - RNA, 24 nt, Human
uggugcccccacacccaccuaccc

SEQ ID NO: 52322 - RNA, 25 nt, Human
aguucucuacauuucucuggaugga

SEQ ID NO: 52323 - RNA, 20 nt, Human
aagugguucuacaaaugcua

SEQ ID NO: 52324 - RNA, 22 nt, Human
caaucugugccacucacugccu

SEQ ID NO: 52325 - RNA, 21 nt, Human
agucuccccccuuccaccuca

SEQ ID NO: 52326 - RNA, 24 nt, Human
ugcccagccugcaauuauucuuua

SEQ ID NO: 52327 - RNA, 21 nt, Human
aaaugguacuuaaacauuuuu

SEQ ID NO: 52328 - RNA, 24 nt, Human
ggauccaggaggagcaggggccag

SEQ ID NO: 52329 - RNA, 27 nt, Human
gcugccucucugugcuuuuggccucug

SEQ ID NO: 52330 - RNA, 21 nt, Human
gcaccaagaccccaaaggccc

SEQ ID NO: 52331 - RNA, 24 nt, Human
cuccugagccugcuucugccugcu

SEQ ID NO: 52332 - RNA, 22 nt, Human
cacugguuaguacugguccccu

SEQ ID NO: 52333 - RNA, 23 nt, Human
ucagaucuuuguacguaauuaaa

SEQ ID NO: 52334 - RNA, 27 nt, Human
cucugccuuuguucacugugaguucug

SEQ ID NO: 52335 - RNA, 24 nt, Human
aauggacagugaggacaguuaugu

SEQ ID NO: 52336 - RNA, 19 nt, Human
uggacacaccccgccauau

SEQ ID NO: 52337 - RNA, 21 nt, Human
uaucacugucuagcuguuuca

SEQ ID NO: 52338 - RNA, 21 nt, Human
cacucuggcaggccccagccc

SEQ ID NO: 52339 - RNA, 21 nt, Human
cccuaccuuuugcccuaggag

SEQ ID NO: 52340 - RNA, 23 nt, Human
gcuccucccguguuacauucuca

SEQ ID NO: 52341 - RNA, 21 nt, Human
ccacccaaauguuagaaaaau

SEQ ID NO: 52342 - RNA, 22 nt, Human
caugcucucccaugacaucucc

SEQ ID NO: 52343 - RNA, 19 nt, Human
caugggcaaggaagggaau

SEQ ID NO: 52344 - RNA, 27 nt, Human
uggagaugucacagauuccugcagagc

SEQ ID NO: 52345 - RNA, 22 nt, Human
acuauaccaguaagugccacuu

SEQ ID NO: 52346 - RNA, 24 nt, Human
uuguuuuuauaaaaauuauucccu

SEQ ID NO: 52347 - RNA, 21 nt, Human
ucauuuuacaagagaaucucu

SEQ ID NO: 52348 - RNA, 21 nt, Human
accuguauuuauaguuuaugg

SEQ ID NO: 52349 - RNA, 17 nt, Human
ugacugccaaucucaac

SEQ ID NO: 52350 - RNA, 18 nt, Human
agggaaaggaauggggaa

SEQ ID NO: 52351 - RNA, 23 nt, Human
caggcugggaggggaguguggca

SEQ ID NO: 52352 - RNA, 27 nt, Human
cccucauucccgcugaccucacuggcc

SEQ ID NO: 52353 - RNA, 22 nt, Human
auuuuucuaguuaguagauccc

SEQ ID NO: 52354 - RNA, 25 nt, Human
ucacacacugcuguagucuucccca

SEQ ID NO: 52355 - RNA, 23 nt, Human
gugcgucagauccgagcucgcca

SEQ ID NO: 52356 - RNA, 20 nt, Human
ccugcuggccggcuuccugc

SEQ ID NO: 52357 - RNA, 18 nt, Human
cccagcaccucugacuca

SEQ ID NO: 52358 - RNA, 21 nt, Human
gcuuuuggcacugggaguaga

SEQ ID NO: 52359 - RNA, 22 nt, Human
uggugagcaccuguaaucccag

SEQ ID NO: 52360 - RNA, 23 nt, Human
acuaaaauuaaugcagauuucuc

SEQ ID NO: 52361 - RNA, 21 nt, Human
caagauguggagguggaagac

SEQ ID NO: 52362 - RNA, 25 nt, Human
ucuccaggacguuccgggaggcucc

SEQ ID NO: 52363 - RNA, 21 nt, Human
acuuccuauuaaucuuaaaac

SEQ ID NO: 52364 - RNA, 27 nt, Human
uagacuuuauuuaugugggucuauaau

SEQ ID NO: 52365 - RNA, 22 nt, Human
uccuuuuggagauuagacuauu

SEQ ID NO: 52366 - RNA, 22 nt, Human
caggaagcagagguugcaguaa

SEQ ID NO: 52367 - RNA, 26 nt, Human
gcucagccuggagugcagugagcuga

SEQ ID NO: 52368 - RNA, 22 nt, Human
ggccaaaggaagcacaugccuc

SEQ ID NO: 52369 - RNA, 31 nt, Human
ggggugugugaggacgcgcucccagucgcug

SEQ ID NO: 52370 - RNA, 25 nt, Human
ggggugaugagugagaggcgagugg

SEQ ID NO: 52371 - RNA, 21 nt, Human
uaccuggcuguggguuggaag

SEQ ID NO: 52372 - RNA, 24 nt, Human
ucaugccacuccccacuguggcca

SEQ ID NO: 52373 - RNA, 21 nt, Human
uuccuuuaugaacugucacua

SEQ ID NO: 52374 - RNA, 24 nt, Human
uggugccagccuuucagacccugc

SEQ ID NO: 52375 - RNA, 24 nt, Human
cgcccucucuuccugcagccuggg

SEQ ID NO: 52376 - RNA, 24 nt, Human
auguguguagacccuccucuguuc

SEQ ID NO: 52377 - RNA, 23 nt, Human
gccccucccccagcugcugccuu

SEQ ID NO: 52378 - RNA, 24 nt, Human
gcucacucugcaaccuccacuucc

SEQ ID NO: 52379 - RNA, 21 nt, Human
caggcagcuggcacagcgugg

SEQ ID NO: 52380 - RNA, 20 nt, Human
uuucugggccauucuuuucc

SEQ ID NO: 52381 - RNA, 20 nt, Human
ggcucagagaggaaagacgu

SEQ ID NO: 52382 - RNA, 20 nt, Human
cccugcaucuugcacuuugg

SEQ ID NO: 52383 - RNA, 23 nt, Human
gacugugcaugcuccugucccca

SEQ ID NO: 52384 - RNA, 27 nt, Human
ccugcuguaugaaaagcuucuuggcaa

SEQ ID NO: 52385 - RNA, 20 nt, Human
uucugagccauucacacuuu

SEQ ID NO: 52386 - RNA, 23 nt, Human
cccuccagccagccuucugccgg

SEQ ID NO: 52387 - RNA, 22 nt, Human
ccgccgcucugcgggagugucc

SEQ ID NO: 52388 - RNA, 27 nt, Human
uugcccaggcuggagugcaguggcgaa

SEQ ID NO: 52389 - RNA, 27 nt, Human
ggaggaaguggaagggacaggagcaca

SEQ ID NO: 52390 - RNA, 23 nt, Human
aaacucauguucuucuccagucc

SEQ ID NO: 52391 - RNA, 21 nt, Human
uauguaugugcuuugcuuacu

SEQ ID NO: 52392 - RNA, 24 nt, Human
cccgagguauggcagaggugcaag

SEQ ID NO: 52393 - RNA, 29 nt, Human
ggucagcagagggaaggcuuggccuugau

SEQ ID NO: 52394 - RNA, 22 nt, Human
aaccccuguuguuggacuguac

SEQ ID NO: 52395 - RNA, 23 nt, Human
aucccagugagguguauccagcu

SEQ ID NO: 52396 - RNA, 20 nt, Human
gcugcaucggccugccugug

SEQ ID NO: 52397 - RNA, 21 nt, Human
aggacuucacuaaauuagcag

SEQ ID NO: 52398 - RNA, 21 nt, Human
aucagagguuaucugucugca

SEQ ID NO: 52399 - RNA, 21 nt, Human
ggugcugggcaagggcugcuu

SEQ ID NO: 52400 - RNA, 17 nt, Human
uaaagagacuuacgugg

SEQ ID NO: 52401 - RNA, 22 nt, Human
ccugacuaaccccucucuuaga

SEQ ID NO: 52402 - RNA, 20 nt, Human
ggguuggaagugucucucca

SEQ ID NO: 52403 - RNA, 20 nt, Human
uuugggcuccaaacuaacca

SEQ ID NO: 52404 - RNA, 21 nt, Human
caagaggcaucucagauuugu

SEQ ID NO: 52405 - RNA, 20 nt, Human
agaauucagaaaauuguugg

SEQ ID NO: 52406 - RNA, 22 nt, Human
auccucucucuauuuucaaaaa

SEQ ID NO: 52407 - RNA, 21 nt, Human
acccauuaaaaaaguuaaaug

SEQ ID NO: 52408 - RNA, 21 nt, Human
cccugucucaaaagcaaaaca

SEQ ID NO: 52409 - RNA, 18 nt, Human
acagguccucacgcccag

SEQ ID NO: 52410 - RNA, 19 nt, Human
ccaucguagcacaguauua

SEQ ID NO: 52411 - RNA, 23 nt, Human
acuuccucccccuuugccugucc

SEQ ID NO: 52412 - RNA, 22 nt, Human
ccaugggcuguggcguauguca

SEQ ID NO: 52413 - RNA, 22 nt, Human
acugcaaccuucgccucccagg

SEQ ID NO: 52414 - RNA, 22 nt, Human
cagaagccugggcgaggcccuc

SEQ ID NO: 52415 - RNA, 21 nt, Human
cucagcucccaaguagcuggg

SEQ ID NO: 52416 - RNA, 23 nt, Human
gacccugccagcuuccaagaggg

SEQ ID NO: 52417 - RNA, 18 nt, Human
gggcggccagugcaguga

SEQ ID NO: 52418 - RNA, 26 nt, Human
gugucuguuagcaucuuccuuuucau

SEQ ID NO: 52419 - RNA, 20 nt, Human
ccucccucuuuguguccauu

SEQ ID NO: 52420 - RNA, 26 nt, Human
uggccucugugccgccugcucccugc

SEQ ID NO: 52421 - RNA, 24 nt, Human
uuuuaaauauccacuuagcccugu

SEQ ID NO: 52422 - RNA, 22 nt, Human
uauuugggcuaacuuuugggau

SEQ ID NO: 52423 - RNA, 25 nt, Human
aguccagcuuccuguccuccuaaag

SEQ ID NO: 52424 - RNA, 17 nt, Human
ucccuccuccccugcaa

SEQ ID NO: 52425 - RNA, 20 nt, Human
ggggugugaggagugguucu

SEQ ID NO: 52426 - RNA, 25 nt, Human
gagaggggagacagaggcagcuagg

SEQ ID NO: 52427 - RNA, 22 nt, Human
cccagagggaguggcgagccca

SEQ ID NO: 52428 - RNA, 24 nt, Human
cuuccuacucuucucucugcucug

SEQ ID NO: 52429 - RNA, 22 nt, Human
acagaagguaaaauggaagggc

SEQ ID NO: 52430 - RNA, 21 nt, Human
ccacugcacaccagucuggag

SEQ ID NO: 52431 - RNA, 26 nt, Human
ccgcacgacuguuacagaggucucca

SEQ ID NO: 52432 - RNA, 21 nt, Human
ccccacugagguccuagagug

SEQ ID NO: 52433 - RNA, 20 nt, Human
ccugagccccaugcccagcc

SEQ ID NO: 52434 - RNA, 23 nt, Human
gcaacaggcugggcuucaguggc

SEQ ID NO: 52435 - RNA, 23 nt, Human
guacagccgccaggagcuacuca

SEQ ID NO: 52436 - RNA, 22 nt, Human
ccucgggcgagucacugccucu

SEQ ID NO: 52437 - RNA, 22 nt, Human
caucucagauguggagugucgg

SEQ ID NO: 52438 - RNA, 18 nt, Human
ccuuucucugccucuccc

SEQ ID NO: 52439 - RNA, 23 nt, Human
gccuccgccccccacccuugcca

SEQ ID NO: 52440 - RNA, 23 nt, Human
gcgucucuugugucucacucacg

SEQ ID NO: 52441 - RNA, 26 nt, Human
guggguggaagagggaguagcugauu

SEQ ID NO: 52442 - RNA, 19 nt, Human
acccagucuggagugcagu

SEQ ID NO: 52443 - RNA, 29 nt, Human
gcccaaccugcucuccucuugccacugcc

SEQ ID NO: 52444 - RNA, 23 nt, Human
acuuacuccuaugauggugccau

SEQ ID NO: 52445 - RNA, 22 nt, Human
gcccaaagggacaaauagggac

SEQ ID NO: 52446 - RNA, 20 nt, Human
cccuucacccccuccaggga

SEQ ID NO: 52447 - RNA, 22 nt, Human
gacauuuguaguuccuagcucc

SEQ ID NO: 52448 - RNA, 31 nt, Human
cugcuccaugguggggccaagagucacuucu

SEQ ID NO: 52449 - RNA, 27 nt, Human
cccuccagcaaggauucaggagugccc

SEQ ID NO: 52450 - RNA, 21 nt, Human
uguguuacacauaugucugua

SEQ ID NO: 52451 - RNA, 23 nt, Human
ugucuagcuuggugguauuuuua

SEQ ID NO: 52452 - RNA, 25 nt, Human
gguuuaaacuacugauuuuuccugu

SEQ ID NO: 52453 - RNA, 26 nt, Human
gcagagagcggcgggagcccggacgu

SEQ ID NO: 52454 - RNA, 22 nt, Human
gucucuggcugaaccggcgcuc

SEQ ID NO: 52455 - RNA, 22 nt, Human
aacacacccuacacacuagacu

SEQ ID NO: 52456 - RNA, 22 nt, Human
cucagccucaguccacuuaccu

SEQ ID NO: 52457 - RNA, 25 nt, Human
cagccuaucccaaugcauccccgcc

SEQ ID NO: 52458 - RNA, 22 nt, Human
gcagggccuuuaccacugggac

SEQ ID NO: 52459 - RNA, 21 nt, Human
gaguugagcgcuuuucccccc

SEQ ID NO: 52460 - RNA, 32 nt, Human
ugcugcagccugcuccagccuggcccccaccc

SEQ ID NO: 52461 - RNA, 22 nt, Human
ggaggcagaggguugcagugag

SEQ ID NO: 52462 - RNA, 22 nt, Human
uuucacucaggcuggaauguag

SEQ ID NO: 52463 - RNA, 20 nt, Human
gcucuugggugcuguuccac

SEQ ID NO: 52464 - RNA, 21 nt, Human
ugaggcaggagaaucgcuuga

SEQ ID NO: 52465 - RNA, 24 nt, Human
gcuucugggcucuaaccugggaga

SEQ ID NO: 52466 - RNA, 27 nt, Human
cuugacagagccugccccagcgcugac

SEQ ID NO: 52467 - RNA, 23 nt, Human
auccuucaggauugugagcugga

SEQ ID NO: 52468 - RNA, 22 nt, Human
ggaggccaaagggacagggcag

SEQ ID NO: 52469 - RNA, 19 nt, Human
caugggagucacacugaaa

SEQ ID NO: 52470 - RNA, 22 nt, Human
ucaaucagcucugacacuuguu

SEQ ID NO: 52471 - RNA, 26 nt, Human
gccuaguaguucgaguccagccuggg

SEQ ID NO: 52472 - RNA, 21 nt, Human
cuuccucggggccugccuccc

SEQ ID NO: 52473 - RNA, 25 nt, Human
cugcuuuucuucccagcaaagguug

SEQ ID NO: 52474 - RNA, 21 nt, Human
gccccaagcucuccauggccc

SEQ ID NO: 52475 - RNA, 22 nt, Human
acagaaaagugggcuuagaaag

SEQ ID NO: 52476 - RNA, 27 nt, Human
cucaaagccacaucgcauugaagccac

SEQ ID NO: 52477 - RNA, 20 nt, Human
aaccagcucgagaaaccgcg

SEQ ID NO: 52478 - RNA, 21 nt, Human
uaauccaaggacuaguauaga

SEQ ID NO: 52479 - RNA, 21 nt, Human
cugcagaaugaaauagaagca

SEQ ID NO: 52480 - RNA, 26 nt, Human
uccauccugcucuuccauuucuucca

SEQ ID NO: 52481 - RNA, 21 nt, Human
uuccaacauuuaaaaggcaau

SEQ ID NO: 52482 - RNA, 26 nt, Human
caaaaagugaaaaauguuaaaacaga

SEQ ID NO: 52483 - RNA, 20 nt, Human
uaagcaagacaugcccaggg

SEQ ID NO: 52484 - RNA, 27 nt, Human
ucucuuccccgugaucuucccugcagc

SEQ ID NO: 52485 - RNA, 25 nt, Human
cgccucucuugacgucugccugguc

SEQ ID NO: 52486 - RNA, 21 nt, Human
uucaggcccaucagcuacccc

SEQ ID NO: 52487 - RNA, 28 nt, Human
ugcccucucucugggcccagggcugugg

SEQ ID NO: 52488 - RNA, 22 nt, Human
cugaucauccaggccucagccu

SEQ ID NO: 52489 - RNA, 26 nt, Human
uuaccuccccuuccuccacccuaagc

SEQ ID NO: 52490 - RNA, 29 nt, Human
ugcaacccuggggaggaccccaacucacc

SEQ ID NO: 52491 - RNA, 25 nt, Human
ucucagcccugcaacuugacccagg

SEQ ID NO: 52492 - RNA, 22 nt, Human
cauggcuauagaguuggcauuu

SEQ ID NO: 52493 - RNA, 29 nt, Human
ucauuuuuguucuuuacaucaagaaauuu

SEQ ID NO: 52494 - RNA, 21 nt, Human
aguagagugugcccuuaguuc

SEQ ID NO: 52495 - RNA, 21 nt, Human
cagagucccagcuguccugga

SEQ ID NO: 52496 - RNA, 23 nt, Human
gcgggcggggguccgggagaagc

SEQ ID NO: 52497 - RNA, 27 nt, Human
gucucggacuccugggcucaagcaauc

SEQ ID NO: 52498 - RNA, 22 nt, Human
aacccuuaucaccagcugccuc

SEQ ID NO: 52499 - RNA, 21 nt, Human
agcggaccacucuucucucca

SEQ ID NO: 52500 - RNA, 25 nt, Human
aaagacgaccuuccaugugaugcac

SEQ ID NO: 52501 - RNA, 26 nt, Human
uauacagucuuuaugaauuucuuaau

SEQ ID NO: 52502 - RNA, 26 nt, Human
ggaaacacuaaggcugcuucaaagau

SEQ ID NO: 52503 - RNA, 28 nt, Human
ucacugcagccuuucacaggacucugca

SEQ ID NO: 52504 - RNA, 23 nt, Human
agcuuugacaaaccuccugcucc

SEQ ID NO: 52505 - RNA, 23 nt, Human
caaguaagucagguuucacaaga

SEQ ID NO: 52506 - RNA, 23 nt, Human
aucugcuaccuccuccccccucc

SEQ ID NO: 52507 - RNA, 20 nt, Human
ugagaggccuucagggccug

SEQ ID NO: 52508 - RNA, 27 nt, Human
caggcuggagugcaguggcaccaucuu

SEQ ID NO: 52509 - RNA, 22 nt, Human
gaggcagcagguaggacaguga

SEQ ID NO: 52510 - RNA, 22 nt, Human
caagaucauaccacuggacuaa

SEQ ID NO: 52511 - RNA, 27 nt, Human
ggcaggcaggugccucucagaggccac

SEQ ID NO: 52512 - RNA, 29 nt, Human
cugugucugucugugucugcauguaagag

SEQ ID NO: 52513 - RNA, 22 nt, Human
aggcuggagggcaggaggaggg

SEQ ID NO: 52514 - RNA, 25 nt, Human
uacagcuggcagagacagaugccuc

SEQ ID NO: 52515 - RNA, 21 nt, Human
ggagcacggccagccuuccgc

SEQ ID NO: 52516 - RNA, 20 nt, Human
uucacaagcuguuuguacuc

SEQ ID NO: 52517 - RNA, 27 nt, Human
ggucgugaacuccuggcuucaagcagu

SEQ ID NO: 52518 - RNA, 27 nt, Human
uggcuucuccagccuuucucccucaca

SEQ ID NO: 52519 - RNA, 23 nt, Human
gaucgcccaggcuggagcuggcc

SEQ ID NO: 52520 - RNA, 20 nt, Human
uggccucccauccugguuca

SEQ ID NO: 52521 - RNA, 22 nt, Human
ccauaaagaaagaacaagauca

SEQ ID NO: 52522 - RNA, 22 nt, Human
ucccugaugggggacaggauuu

SEQ ID NO: 52523 - RNA, 22 nt, Human
aggccugcucuggccuaaugga

SEQ ID NO: 52524 - RNA, 27 nt, Human
accuucaaguaugugcuacuuuuuugu

SEQ ID NO: 52525 - RNA, 18 nt, Human
agaacaauuucucauuuc

SEQ ID NO: 52526 - RNA, 22 nt, Human
aucgucccggcugaagugcagu

SEQ ID NO: 52527 - RNA, 20 nt, Human
ccuugcagcuccuccagagg

SEQ ID NO: 52528 - RNA, 22 nt, Human
aggaagcuugucacuggaagau

SEQ ID NO: 52529 - RNA, 19 nt, Human
cagacagagagggagcggc

SEQ ID NO: 52530 - RNA, 23 nt, Human
uuagaauaguguucuccccaaau

SEQ ID NO: 52531 - RNA, 22 nt, Human
auaaugccaccaaaggagacau

SEQ ID NO: 52532 - RNA, 24 nt, Human
gucacccacucuggaagaaauagu

SEQ ID NO: 52533 - RNA, 23 nt, Human
ggcaggaggacugugaacaagac

SEQ ID NO: 52534 - RNA, 25 nt, Human
auggcaugaugauagcauauguguu

SEQ ID NO: 52535 - RNA, 26 nt, Human
caggcgccaagcacccaacuccagag

SEQ ID NO: 52536 - RNA, 27 nt, Human
uguccccaggaacaguagagauggcaa

SEQ ID NO: 52537 - RNA, 26 nt, Human
ccugagcaaccaaaaauuccucugcg

SEQ ID NO: 52538 - RNA, 21 nt, Human
gagucugacagggucaccucc

SEQ ID NO: 52539 - RNA, 26 nt, Human
uggggaggggcggcaggagggagguu

SEQ ID NO: 52540 - RNA, 26 nt, Human
ggcaaaugcuagggcuucaucagacc

SEQ ID NO: 52541 - RNA, 23 nt, Human
gaccacacucuaguuguuuucca

SEQ ID NO: 52542 - RNA, 24 nt, Human
cauuccuucuuucacaggcaucag

SEQ ID NO: 52543 - RNA, 26 nt, Human
cagagggagggacugggcagggacug

SEQ ID NO: 52544 - RNA, 20 nt, Human
ugccuguaucucucacuauu

SEQ ID NO: 52545 - RNA, 27 nt, Human
aggccggaaccacagggccagagggag

SEQ ID NO: 52546 - RNA, 24 nt, Human
uacuuggcaaaaaauuccgcacua

SEQ ID NO: 52547 - RNA, 22 nt, Human
uguuacccaggcuggagugcaa

SEQ ID NO: 52548 - RNA, 27 nt, Human
uucauucuucuggcaaagcuggcuucu

SEQ ID NO: 52549 - RNA, 30 nt, Human
ugcucagccaggcuggaggcggcaggcggc

SEQ ID NO: 52550 - RNA, 22 nt, Human
cugagguaggagaaucgcuuga

SEQ ID NO: 52551 - RNA, 22 nt, Human
gcaggaggaucaccugagguca

SEQ ID NO: 52552 - RNA, 26 nt, Human
uccaacaacuccaggaaaacuguuuu

SEQ ID NO: 52553 - RNA, 20 nt, Human
uucuaaaacugccuuucugg

SEQ ID NO: 52554 - RNA, 21 nt, Human
gccugggaaacauaacaagac

SEQ ID NO: 52555 - RNA, 22 nt, Human
cuggcacaucacucaacuacua

SEQ ID NO: 52556 - RNA, 23 nt, Human
ugucucaaagcugugcagucuuu

SEQ ID NO: 52557 - RNA, 27 nt, Human
cuccaucucaguggaccaggaagcaag

SEQ ID NO: 52558 - RNA, 27 nt, Human
uggcuguaaggcauuuucaucuuuccu

SEQ ID NO: 52559 - RNA, 19 nt, Human
aauucagugccuucugcag

SEQ ID NO: 52560 - RNA, 22 nt, Human
caggaggucaaggcuucaguga

SEQ ID NO: 52561 - RNA, 22 nt, Human
uagagggagagagggagagagc

SEQ ID NO: 52562 - RNA, 22 nt, Human
gucacccaggcuggaguacacu

SEQ ID NO: 52563 - RNA, 25 nt, Human
ugauccuaacauaucaggccaugga

SEQ ID NO: 52564 - RNA, 31 nt, Human
uugcaccucgcugcccaucagaaagccugag

SEQ ID NO: 52565 - RNA, 22 nt, Human
acccaggcuggagugcaguggu

SEQ ID NO: 52566 - RNA, 22 nt, Human
gcccaggcuggagugcgguggu

SEQ ID NO: 52567 - RNA, 22 nt, Human
ugugagccaccacaccaggcca

SEQ ID NO: 52568 - RNA, 26 nt, Human
agugccucaggaguccugacgcagug

SEQ ID NO: 52569 - RNA, 22 nt, Human
cucccaggcuggagugcagugg

SEQ ID NO: 52570 - RNA, 27 nt, Human
gggugcucugucccugugguugucaua

SEQ ID NO: 52571 - RNA, 20 nt, Human
cucaaauccugugacuggga

SEQ ID NO: 52572 - RNA, 23 nt, Human
gcucucucagcaaccacuccuca

SEQ ID NO: 52573 - RNA, 21 nt, Human
cuaggcccagccccucagccu

SEQ ID NO: 52574 - RNA, 27 nt, Human
cuguggcaggccagcugugguuuucuu

SEQ ID NO: 52575 - RNA, 20 nt, Human
cguccuuggaaugaaugaug

SEQ ID NO: 52576 - RNA, 23 nt, Human
aguuuaaugcugugucucuguca

SEQ ID NO: 52577 - RNA, 19 nt, Human
gcucauaaguugcccagcc

SEQ ID NO: 52578 - RNA, 21 nt, Human
guguucucuucaagauuccau

SEQ ID NO: 52579 - RNA, 25 nt, Human
ggcaaaguuuccauguggccuugag

SEQ ID NO: 52580 - RNA, 20 nt, Human
gguaggggcaggauggaggg

SEQ ID NO: 52581 - RNA, 23 nt, Human
cacuguacuccagccugaagagc

SEQ ID NO: 52582 - RNA, 20 nt, Human
gacaucacaaccuguuccca

SEQ ID NO: 52583 - RNA, 21 nt, Human
uguggagggggugcuggcccc

SEQ ID NO: 52584 - RNA, 22 nt, Human
ggaggcggaaccggcagugcag

SEQ ID NO: 52585 - RNA, 21 nt, Human
gguuugucaucccugcccuag

SEQ ID NO: 52586 - RNA, 25 nt, Human
cccuagggacaugagacaccacauu

SEQ ID NO: 52587 - RNA, 22 nt, Human
gcugcugcugcugcugguuuuc

SEQ ID NO: 52588 - RNA, 24 nt, Human
ucugaacugggauuucauuuuguu

SEQ ID NO: 52589 - RNA, 22 nt, Human
cccaaguagcuuggacuacagg

SEQ ID NO: 52590 - RNA, 27 nt, Human
uggagaaacugcagccccacuucuguu

SEQ ID NO: 52591 - RNA, 27 nt, Human
uguggguaguaugauggguguuuuuag

SEQ ID NO: 52592 - RNA, 19 nt, Human
agccacucgggaggcugag

SEQ ID NO: 52593 - RNA, 23 nt, Human
cccaggaggcaggcagugcgggg

SEQ ID NO: 52594 - RNA, 25 nt, Human
aacagauggucauauacacugugag

SEQ ID NO: 52595 - RNA, 22 nt, Human
ggcagugagcugagaucacacc

SEQ ID NO: 52596 - RNA, 23 nt, Human
aacugauuuguuaaaacaugcua

SEQ ID NO: 52597 - RNA, 21 nt, Human
uuaguuaaguaucacugaugu

SEQ ID NO: 52598 - RNA, 31 nt, Human
gcucuuuccuuuccccucuaguuuugggugu

SEQ ID NO: 52599 - RNA, 21 nt, Human
cauucccaacaacauccucug

SEQ ID NO: 52600 - RNA, 22 nt, Human
caggcagcagcaaagccaguuc

SEQ ID NO: 52601 - RNA, 26 nt, Human
cugucugaggcuaaggcccacguggg

SEQ ID NO: 52602 - RNA, 24 nt, Human
cccuacacccagaccccaggcugg

SEQ ID NO: 52603 - RNA, 20 nt, Human
aguccaaggaagggagggag

SEQ ID NO: 52604 - RNA, 21 nt, Human
gugaccccagagacagagcca

SEQ ID NO: 52605 - RNA, 24 nt, Human
cccuaaccuuucgccgaauggggc

SEQ ID NO: 52606 - RNA, 26 nt, Human
uagggugcucuggaagagaggaaugc

SEQ ID NO: 52607 - RNA, 22 nt, Human
gcuaggaaauaucauuaauucu

SEQ ID NO: 52608 - RNA, 21 nt, Human
gcugcauuaaaaguaaagaaa

SEQ ID NO: 52609 - RNA, 27 nt, Human
uugcccaggcuggagugcaguggcacc

SEQ ID NO: 52610 - RNA, 22 nt, Human
cacugcacaccagccuggguga

SEQ ID NO: 52611 - RNA, 21 nt, Human
gaugcuuacagguuuugugag

SEQ ID NO: 52612 - RNA, 20 nt, Human
accauccccaccugccaccu

SEQ ID NO: 52613 - RNA, 20 nt, Human
acccuuuaggauagccacug

SEQ ID NO: 52614 - RNA, 21 nt, Human
ccuugaguuuguaggugccac

SEQ ID NO: 52615 - RNA, 23 nt, Human
gagagggagcaagcaagguuagc

SEQ ID NO: 52616 - RNA, 22 nt, Human
caggaagguggagcugcauugg

SEQ ID NO: 52617 - RNA, 25 nt, Human
cagucucuacgcugugaauauugcc

SEQ ID NO: 52618 - RNA, 20 nt, Human
uggucucagaagugccuuca

SEQ ID NO: 52619 - RNA, 27 nt, Human
ucccuccaguccccauggauuggaaau

SEQ ID NO: 52620 - RNA, 24 nt, Human
gucuguuucuuccccuccuacgag

SEQ ID NO: 52621 - RNA, 28 nt, Human
caggucccaggggagagguuggggcugg

SEQ ID NO: 52622 - RNA, 26 nt, Human
gcgccucucuggguguccgugccagu

SEQ ID NO: 52623 - RNA, 22 nt, Human
gagagugagagagauugacaga

SEQ ID NO: 52624 - RNA, 28 nt, Human
ggggccugguaucucaggcagauuguug

SEQ ID NO: 52625 - RNA, 22 nt, Human
cagaaauuuuucucuuuucuug

SEQ ID NO: 52626 - RNA, 26 nt, Human
uggggaggggcuacaaggaguaauug

SEQ ID NO: 52627 - RNA, 25 nt, Human
uacucuuaaagcuucaguggccuag

SEQ ID NO: 52628 - RNA, 23 nt, Human
cccuauucucucagacgguggaa

SEQ ID NO: 52629 - RNA, 19 nt, Human
ggagagagaaggggagaag

SEQ ID NO: 52630 - RNA, 20 nt, Human
ugcugcuuccugguuaagua

SEQ ID NO: 52631 - RNA, 23 nt, Human
aaggcauuuggaccccugccuuu

SEQ ID NO: 52632 - RNA, 22 nt, Human
auugcuugagcccaggaauucg

SEQ ID NO: 52633 - RNA, 23 nt, Human
agcaggagcauggccgcaacuuc

SEQ ID NO: 52634 - RNA, 22 nt, Human
ccacccuaggaggcugcaugcg

SEQ ID NO: 52635 - RNA, 22 nt, Human
ucugggucucuaaucugugcug

SEQ ID NO: 52636 - RNA, 24 nt, Human
caaaacaaagcaugucuuugagua

SEQ ID NO: 52637 - RNA, 22 nt, Human
cuuccuuugguguguuuccugu

SEQ ID NO: 52638 - RNA, 27 nt, Human
uuuucuugaagauguuuuaaagcugga

SEQ ID NO: 52639 - RNA, 22 nt, Human
gucuuuuggcuucucaguagcu

SEQ ID NO: 52640 - RNA, 20 nt, Human
gauguguuauucuugcccuc

SEQ ID NO: 52641 - RNA, 22 nt, Human
acugagcacgcugggagcugag

SEQ ID NO: 52642 - RNA, 26 nt, Human
cucaauuucuuaggcuggagugcagu

SEQ ID NO: 52643 - RNA, 22 nt, Human
gccuagcaggccuuccuuuuca

SEQ ID NO: 52644 - RNA, 26 nt, Human
cugcuucucgggguccagugcauuuu

SEQ ID NO: 52645 - RNA, 25 nt, Human
acagcucuagcauuuucuuaaucag

SEQ ID NO: 52646 - RNA, 32 nt, Human
cacccugagucuugcaaaagcugcagccccac

SEQ ID NO: 52647 - RNA, 21 nt, Human
cagggcugaagcuguguccuc

SEQ ID NO: 52648 - RNA, 23 nt, Human
aaugcuuuagggggaaaaucagu

SEQ ID NO: 52649 - RNA, 21 nt, Human
uuacaguguauaugugggcua

SEQ ID NO: 52650 - RNA, 21 nt, Human
uacaucuuugauacuuguuca

SEQ ID NO: 52651 - RNA, 19 nt, Human
gguggggagagauggacag

SEQ ID NO: 52652 - RNA, 22 nt, Human
uuugcacucuugguucuuugga

SEQ ID NO: 52653 - RNA, 23 nt, Human
gaagcauccuucuaagacauucu

SEQ ID NO: 52654 - RNA, 26 nt, Human
cuccccucggucuuccgaggcgcccg

SEQ ID NO: 52655 - RNA, 20 nt, Human
uagauuccaucaacacucca

SEQ ID NO: 52656 - RNA, 23 nt, Human
ggagggucuggaggaaaacuggc

SEQ ID NO: 52657 - RNA, 26 nt, Human
gcucagaagauaaaagauaaguaggg

SEQ ID NO: 52658 - RNA, 25 nt, Human
gcacuuccucaaagcuuguguacag

SEQ ID NO: 52659 - RNA, 23 nt, Human
guugugcaggcuggagugcagug

SEQ ID NO: 52660 - RNA, 27 nt, Human
cacugucaagaugaugaugaucuuuaa

SEQ ID NO: 52661 - RNA, 19 nt, Human
ggccaccuagcaagguagu

SEQ ID NO: 52662 - RNA, 22 nt, Human
ggaggcaaaggcgggaggauca

SEQ ID NO: 52663 - RNA, 22 nt, Human
cccaguagcugggauuacaggc

SEQ ID NO: 52664 - RNA, 27 nt, Human
cauugucuuguucugucccuuccacuu

SEQ ID NO: 52665 - RNA, 24 nt, Human
gcaugacugcuucucugagagaac

SEQ ID NO: 52666 - RNA, 25 nt, Human
uucuauuucaaacguuaauuuugcu

SEQ ID NO: 52667 - RNA, 27 nt, Human
ccaggaggugggcuggcgcggagggag

SEQ ID NO: 52668 - RNA, 26 nt, Human
agacccaggauggcugcaggccaggu

SEQ ID NO: 52669 - RNA, 24 nt, Human
ucagagcaagaugaguugcugcua

SEQ ID NO: 52670 - RNA, 22 nt, Human
gacagccaccaagauaucugag

SEQ ID NO: 52671 - RNA, 21 nt, Human
cagggcacaaagaugggugaa

SEQ ID NO: 52672 - RNA, 27 nt, Human
agcucacucugcaaccuccacuuccca

SEQ ID NO: 52673 - RNA, 26 nt, Human
acauucucuccacagcucacuuaccu

SEQ ID NO: 52674 - RNA, 25 nt, Human
uuuguacuuauuuacaaaacagucu

SEQ ID NO: 52675 - RNA, 22 nt, Human
cucacaccucccuucaucccag

SEQ ID NO: 52676 - RNA, 21 nt, Human
cccaaggcugcuuuccagaaa

SEQ ID NO: 52677 - RNA, 25 nt, Human
gggauuacaggcgugagccaucgcu

SEQ ID NO: 52678 - RNA, 23 nt, Human
cacugcugagaaagacauaccca

SEQ ID NO: 52679 - RNA, 21 nt, Human
ucgcccaggcuggagugcaau

SEQ ID NO: 52680 - RNA, 25 nt, Human
ugggaugggcuuucucagugucagc

SEQ ID NO: 52681 - RNA, 20 nt, Human
gcuuuccccugccugccugu

SEQ ID NO: 52682 - RNA, 22 nt, Human
gagcucuuaacccuccccaccu

SEQ ID NO: 52683 - RNA, 18 nt, Human
gaaggccgauggggaagg

SEQ ID NO: 52684 - RNA, 22 nt, Human
caggaguucgaagcugcaggga

SEQ ID NO: 52685 - RNA, 28 nt, Human
gaguaugagagacagguacaugguccag

SEQ ID NO: 52686 - RNA, 22 nt, Human
accaugccaggggagaaggcac

SEQ ID NO: 52687 - RNA, 26 nt, Human
aucaaauuaugucaauaaauguuaua

SEQ ID NO: 52688 - RNA, 21 nt, Human
uguuugcuguuccugcuuuau

SEQ ID NO: 52689 - RNA, 21 nt, Human
gggggagggggcugugguggu

SEQ ID NO: 52690 - RNA, 27 nt, Human
cuugcagaguagacacgaugacaccuu

SEQ ID NO: 52691 - RNA, 25 nt, Human
aagguuugcuugugaaaugaggcug

SEQ ID NO: 52692 - RNA, 25 nt, Human
cacggaggagugaggagcccaggaa

SEQ ID NO: 52693 - RNA, 23 nt, Human
gggcacagagagacagagguuca

SEQ ID NO: 52694 - RNA, 25 nt, Human
uagcuaggguauaguggcuggugag

SEQ ID NO: 52695 - RNA, 23 nt, Human
cugacuugggauaggacugagug

SEQ ID NO: 52696 - RNA, 23 nt, Human
uccaccccacucacagugguucu

SEQ ID NO: 52697 - RNA, 23 nt, Human
ccccugcacugagggagcaaguu

SEQ ID NO: 52698 - RNA, 20 nt, Human
gccaggcuggaguguagugg

SEQ ID NO: 52699 - RNA, 23 nt, Human
cccuauucucucagcccucggcg

SEQ ID NO: 52700 - RNA, 23 nt, Human
ggcuggggucaggaugacgaggc

SEQ ID NO: 52701 - RNA, 22 nt, Human
gggaacuuggauuagguggaga

SEQ ID NO: 52702 - RNA, 27 nt, Human
accagccuggccaacacuaucuguacu

SEQ ID NO: 52703 - RNA, 22 nt, Human
cacccugcacguugugcacuga

SEQ ID NO: 52704 - RNA, 22 nt, Human
ucgcccaggcuggagcgcaguc

SEQ ID NO: 52705 - RNA, 18 nt, Human
aggaagagugagcgagca

SEQ ID NO: 52706 - RNA, 25 nt, Human
ggcgcgcuccagccgguguaggcga

SEQ ID NO: 52707 - RNA, 26 nt, Human
ucacacaccacaccugauuccuguug

SEQ ID NO: 52708 - RNA, 26 nt, Human
uauacugcuauuuacacuauuauuuc

SEQ ID NO: 52709 - RNA, 25 nt, Human
aggccaagauggcugcugccugcuc

SEQ ID NO: 52710 - RNA, 25 nt, Human
aagaucuggagcgguaaggcggaga

SEQ ID NO: 52711 - RNA, 23 nt, Human
ugcagauuuagcaucaagcacag

SEQ ID NO: 52712 - RNA, 21 nt, Human
cugccugggcccugugguugc

SEQ ID NO: 52713 - RNA, 22 nt, Human
cauacagucuuaaagccacaga

SEQ ID NO: 52714 - RNA, 29 nt, Human
auagaucuacauaaguugugcaguuuugu

SEQ ID NO: 52715 - RNA, 21 nt, Human
caggaauagcagaauaauugg

SEQ ID NO: 52716 - RNA, 24 nt, Human
ccugccuuaucucugccugcacgc

SEQ ID NO: 52717 - RNA, 26 nt, Human
uucuucuguggcaacuaaguggauaa

SEQ ID NO: 52718 - RNA, 27 nt, Human
ccguucccaguccacuucucuagggcc

SEQ ID NO: 52719 - RNA, 21 nt, Human
ggagacacacagaggccaggc

SEQ ID NO: 52720 - RNA, 31 nt, Human
ggccgugcguccagcccgggccucuccaagg

SEQ ID NO: 52721 - RNA, 26 nt, Human
gguggagguugcagugagcagagauc

SEQ ID NO: 52722 - RNA, 24 nt, Human
uccagcauuuuuauaaacuaccaa

SEQ ID NO: 52723 - RNA, 21 nt, Human
ccagaaagguggagggcuguu

SEQ ID NO: 52724 - RNA, 23 nt, Human
ggcucacugcagccuugacuccg

SEQ ID NO: 52725 - RNA, 26 nt, Human
ggacugugccucaggccagggcucac

SEQ ID NO: 52726 - RNA, 23 nt, Human
guauuuuuauaaguaucuagacc

SEQ ID NO: 52727 - RNA, 19 nt, Human
acagccaccucauucuucu

SEQ ID NO: 52728 - RNA, 17 nt, Human
caggaaagacagaggaa

SEQ ID NO: 52729 - RNA, 23 nt, Human
gacuuucuuccuccuguuucucg

SEQ ID NO: 52730 - RNA, 20 nt, Human
ggggaguuauguuuuguuac

SEQ ID NO: 52731 - RNA, 22 nt, Human
uaagguuuuuaugcucuguaaa

SEQ ID NO: 52732 - RNA, 21 nt, Human
agcuacaguuccuucucucca

SEQ ID NO: 52733 - RNA, 28 nt, Human
ucacaaucuaaauuaauuuuggcaaaag

SEQ ID NO: 52734 - RNA, 21 nt, Human
ugccccaguaaauggaaaugu

SEQ ID NO: 52735 - RNA, 23 nt, Human
gggucucaaacuccugaccucag

SEQ ID NO: 52736 - RNA, 22 nt, Human
gcucacugcagccucauacucc

SEQ ID NO: 52737 - RNA, 23 nt, Human
uguuauagaagauuaaaacuaga

SEQ ID NO: 52738 - RNA, 25 nt, Human
auccaguuuugguccuacuaaauau

SEQ ID NO: 52739 - RNA, 22 nt, Human
ggcugggacugcaggagcaugc

SEQ ID NO: 52740 - RNA, 24 nt, Human
aaacucauagugcauaacuuguca

SEQ ID NO: 52741 - RNA, 26 nt, Human
ucacccagaggggugccuugcccugg

SEQ ID NO: 52742 - RNA, 22 nt, Human
cugggagguggugguugcagug

SEQ ID NO: 52743 - RNA, 23 nt, Human
cucaccuccgugugaauggaagg

SEQ ID NO: 52744 - RNA, 29 nt, Human
uccugcucugucuuucucagaaaaccaaa

SEQ ID NO: 52745 - RNA, 21 nt, Human
uaaagacauuccuggaaucac

SEQ ID NO: 52746 - RNA, 18 nt, Human
gccgcaaccuccuccucg

SEQ ID NO: 52747 - RNA, 24 nt, Human
gcccucacugcucucucagucuuc

SEQ ID NO: 52748 - RNA, 24 nt, Human
gaccucggacugcagggagccagu

SEQ ID NO: 52749 - RNA, 29 nt, Human
uucuuauuugacagaggguauggaagacu

SEQ ID NO: 52750 - RNA, 24 nt, Human
gggagugcuccaaaugucagggug

SEQ ID NO: 52751 - RNA, 27 nt, Human
cugcccucccuucauuguacuuuauca

SEQ ID NO: 52752 - RNA, 19 nt, Human
ucucacuucacauucucaa

SEQ ID NO: 52753 - RNA, 26 nt, Human
ggugagacauugauauauccuuuugc

SEQ ID NO: 52754 - RNA, 27 nt, Human
ccugccugccacccuccucucccacuc

SEQ ID NO: 52755 - RNA, 23 nt, Human
guucccugugggccccaugagga

SEQ ID NO: 52756 - RNA, 22 nt, Human
auguagggugguccugaugguu

SEQ ID NO: 52757 - RNA, 24 nt, Human
caccugaggucaggaguucgagag

SEQ ID NO: 52758 - RNA, 25 nt, Human
ugagaaaugaaugaauguuucuauu

SEQ ID NO: 52759 - RNA, 22 nt, Human
cucuggauuugcaacccuauca

SEQ ID NO: 52760 - RNA, 23 nt, Human
cccucuuuccucuauuugucucc

SEQ ID NO: 52761 - RNA, 31 nt, Human
ucacucacucuccaccagccugggaaaugaa

SEQ ID NO: 52762 - RNA, 26 nt, Human
acccaggcuggagugcaaugggcaca

SEQ ID NO: 52763 - RNA, 23 nt, Human
accagcaccccacuccagccucg

SEQ ID NO: 52764 - RNA, 24 nt, Human
cccugcuccugccccugcucggcu

SEQ ID NO: 52765 - RNA, 23 nt, Human
auuucuccuggagccuccagggc

SEQ ID NO: 52766 - RNA, 20 nt, Human
agcaauaacauuuuauguca

SEQ ID NO: 52767 - RNA, 23 nt, Human
gccgcccaggcuggacugcagug

SEQ ID NO: 52768 - RNA, 21 nt, Human
accgaucgccaggaccaggaa

SEQ ID NO: 52769 - RNA, 20 nt, Human
ccaggcucuaugugcugcug

SEQ ID NO: 52770 - RNA, 19 nt, Human
uuccaaaauucaguauuua

SEQ ID NO: 52771 - RNA, 22 nt, Human
caggagagacagugaggcugca

SEQ ID NO: 52772 - RNA, 19 nt, Human
guggguggaagagggagua

SEQ ID NO: 52773 - RNA, 21 nt, Human
gcuaucucucgccucagcccc

SEQ ID NO: 52774 - RNA, 25 nt, Human
cccgccccaccccgugcuucagccu

SEQ ID NO: 52775 - RNA, 24 nt, Human
ggccagguuccuuauccuucugau

SEQ ID NO: 52776 - RNA, 28 nt, Human
cugcugcuaccgaggcugugggccucau

SEQ ID NO: 52777 - RNA, 22 nt, Human
gcccgaaccaccaugacccacu

SEQ ID NO: 52778 - RNA, 17 nt, Human
cacaacaaaauucuuca

SEQ ID NO: 52779 - RNA, 23 nt, Human
ccucuacuggugauacccucacc

SEQ ID NO: 52780 - RNA, 25 nt, Human
uguguguguauguuugcacacuugu

SEQ ID NO: 52781 - RNA, 24 nt, Human
agcacuuucagcaucggcucuuca

SEQ ID NO: 52782 - RNA, 26 nt, Human
uugcucugucaccuaggcuggagugc

SEQ ID NO: 52783 - RNA, 24 nt, Human
uugucaccaggcuggagugcagug

SEQ ID NO: 52784 - RNA, 22 nt, Human
gccauuucuaaaauggcagcuu

SEQ ID NO: 52785 - RNA, 20 nt, Human
cccgagugagcucagguguc

SEQ ID NO: 52786 - RNA, 21 nt, Human
ggccuggagcuggagaguaag

SEQ ID NO: 52787 - RNA, 22 nt, Human
gggaauuuaaaauaauacauac

SEQ ID NO: 52788 - RNA, 22 nt, Human
acagccgccucuaggggcuggg

SEQ ID NO: 52789 - RNA, 20 nt, Human
ggaacucaggcucaagcaau

SEQ ID NO: 52790 - RNA, 21 nt, Human
uuugacagacauccuugcagu

SEQ ID NO: 52791 - RNA, 21 nt, Human
acucugagugcugugaauuuc

SEQ ID NO: 52792 - RNA, 22 nt, Human
ccuccucccccuccucucuggc

SEQ ID NO: 52793 - RNA, 26 nt, Human
gccucugaaggaggugagauuugugc

SEQ ID NO: 52794 - RNA, 27 nt, Human
ugccuguaaucccaacacuuagggugg

SEQ ID NO: 52795 - RNA, 26 nt, Human
ucuuuacugcuguuauuuuaaaaacc

SEQ ID NO: 52796 - RNA, 23 nt, Human
ccccacaggcucugcuccacaga

SEQ ID NO: 52797 - RNA, 20 nt, Human
ugcuccucagcuucuuaucc

SEQ ID NO: 52798 - RNA, 20 nt, Human
uucuccucugcuucuuugcc

SEQ ID NO: 52799 - RNA, 22 nt, Human
cacuccaucuccagcugcucuc

SEQ ID NO: 52800 - RNA, 19 nt, Human
cgauauaccaggugcucug

SEQ ID NO: 52801 - RNA, 20 nt, Human
acacauacuccagauugacc

SEQ ID NO: 52802 - RNA, 24 nt, Human
ccugcacucccucccuugccugua

SEQ ID NO: 52803 - RNA, 20 nt, Human
gugauuugcugagugcugug

SEQ ID NO: 52804 - RNA, 21 nt, Human
aaaacuuuucuuucuuucuua

SEQ ID NO: 52805 - RNA, 22 nt, Human
caggcugugcugggaagaagag

SEQ ID NO: 52806 - RNA, 22 nt, Human
cucucaucuuuugacuauuuca

SEQ ID NO: 52807 - RNA, 19 nt, Human
gcacacacaccuccauuca

SEQ ID NO: 52808 - RNA, 23 nt, Human
cugcucacucuuccacagauaua

SEQ ID NO: 52809 - RNA, 24 nt, Human
agauuugccauuaugcacaucaca

SEQ ID NO: 52810 - RNA, 25 nt, Human
agguggaguuucucuguuguuuggu

SEQ ID NO: 52811 - RNA, 25 nt, Human
ugcuuuucgcuuucuuucugcauga

SEQ ID NO: 52812 - RNA, 24 nt, Human
gggcuccagggacuggaguguaau

SEQ ID NO: 52813 - RNA, 25 nt, Human
gccugguuugcuucuauuacuuuuc

SEQ ID NO: 52814 - RNA, 24 nt, Human
aaucagauaccugcugucaccaca

SEQ ID NO: 52815 - RNA, 27 nt, Human
ugcccugcucuacucugcgcucucugc

SEQ ID NO: 52816 - RNA, 22 nt, Human
aagcuauaaauuaccuggucau

SEQ ID NO: 52817 - RNA, 20 nt, Human
gucaaacaaacaaguuuaca

SEQ ID NO: 52818 - RNA, 22 nt, Human
cuugggaaggcuugggagccag

SEQ ID NO: 52819 - RNA, 21 nt, Human
aagaauugguuuaaacuuuua

SEQ ID NO: 52820 - RNA, 27 nt, Human
ugccccuguggcaugucggaaugaaug

SEQ ID NO: 52821 - RNA, 27 nt, Human
gugacucuucccccuccugcuccggcc

SEQ ID NO: 52822 - RNA, 22 nt, Human
cagaauuugguucaacuguuga

SEQ ID NO: 52823 - RNA, 31 nt, Human
ucaucucagucauccugcaggcacaugaggg

SEQ ID NO: 52824 - RNA, 24 nt, Human
ccuuuagcugcugcccugcccuug

SEQ ID NO: 52825 - RNA, 23 nt, Human
ggcuauuccagcgagcugggaca

SEQ ID NO: 52826 - RNA, 27 nt, Human
cccagcaccccauguggauuuuggggg

SEQ ID NO: 52827 - RNA, 27 nt, Human
gacugggugcagguacacccaaaggaa

SEQ ID NO: 52828 - RNA, 27 nt, Human
gggccugggaggaagauguuuacauuu

SEQ ID NO: 52829 - RNA, 24 nt, Human
caggccuggauaauauccagccuc

SEQ ID NO: 52830 - RNA, 20 nt, Human
acagcucugcccaggcccuu

SEQ ID NO: 52831 - RNA, 20 nt, Human
gccucaacguaggggugggu

SEQ ID NO: 52832 - RNA, 19 nt, Human
ggccugggaucccuccuuu

SEQ ID NO: 52833 - RNA, 22 nt, Human
uguuauuuauugcuacuuccug

SEQ ID NO: 52834 - RNA, 26 nt, Human
gcccgggagaagacugaaggagcagu

SEQ ID NO: 52835 - RNA, 26 nt, Human
gaagggagacucuaggaguugaaaug

SEQ ID NO: 52836 - RNA, 27 nt, Human
acugcaaccuccgccucccugguucaa

SEQ ID NO: 52837 - RNA, 22 nt, Human
uuuccagugaaaucaguuacuc

SEQ ID NO: 52838 - RNA, 22 nt, Human
caauauuaggucagcaugugaa

SEQ ID NO: 52839 - RNA, 27 nt, Human
uaacugcagcuggggucugauuugccc

SEQ ID NO: 52840 - RNA, 27 nt, Human
auguucucuuugccauaaagacuccgu

SEQ ID NO: 52841 - RNA, 22 nt, Human
caaacuccugggcucaggcgau

SEQ ID NO: 52842 - RNA, 22 nt, Human
aggaccaccuccuacacuauug

SEQ ID NO: 52843 - RNA, 22 nt, Human
ccccaacaacuaucaaagucua

SEQ ID NO: 52844 - RNA, 26 nt, Human
ggagguagggcuggcuggaggaagga

SEQ ID NO: 52845 - RNA, 24 nt, Human
ccuuuauuuuaaaugaucuguacu

SEQ ID NO: 52846 - RNA, 20 nt, Human
auguugcauuucaucugugu

SEQ ID NO: 52847 - RNA, 25 nt, Human
ugccucucagcccguguguauaaua

SEQ ID NO: 52848 - RNA, 22 nt, Human
agcuaaggagccucauagccug

SEQ ID NO: 52849 - RNA, 22 nt, Human
ccucucugugccuuacugaggc

SEQ ID NO: 52850 - RNA, 26 nt, Human
ccucugccuccuggguucaagugauu

SEQ ID NO: 52851 - RNA, 23 nt, Human
aauucugcaaaaucugugcuuuu

SEQ ID NO: 52852 - RNA, 23 nt, Human
ccuuuuaauuuuccuggugccaa

SEQ ID NO: 52853 - RNA, 21 nt, Human
ccaggagguuguggcugcagu

SEQ ID NO: 52854 - RNA, 27 nt, Human
cuuugggccuuuuauggagaacuccau

SEQ ID NO: 52855 - RNA, 20 nt, Human
gcccuuugcuuuaucuugcu

SEQ ID NO: 52856 - RNA, 26 nt, Human
cucagguagagaaaaaaggacaguga

SEQ ID NO: 52857 - RNA, 24 nt, Human
gcucagggcuauccucucagagug

SEQ ID NO: 52858 - RNA, 27 nt, Human
agaagcagaaagcaucacuuuaaaagu

SEQ ID NO: 52859 - RNA, 22 nt, Human
uggaagggaaguggguguccau

SEQ ID NO: 52860 - RNA, 30 nt, Human
ucuccucaccugucucuccauauuuagguc

SEQ ID NO: 52861 - RNA, 19 nt, Human
uacugugcgucaagcacag

SEQ ID NO: 52862 - RNA, 22 nt, Human
uuuaagggauucuccugccuca

SEQ ID NO: 52863 - RNA, 21 nt, Human
ccugccgcaggccccacccuc

SEQ ID NO: 52864 - RNA, 19 nt, Human
ucuuuuuccucacagucuu

SEQ ID NO: 52865 - RNA, 22 nt, Human
ucgucuucucuauccuacacuc

SEQ ID NO: 52866 - RNA, 24 nt, Human
uuguugugauuuguucuuccgugc

SEQ ID NO: 52867 - RNA, 22 nt, Human
agucugcguaacagucucccac

SEQ ID NO: 52868 - RNA, 20 nt, Human
uaaagcuguuggaaugagua

SEQ ID NO: 52869 - RNA, 26 nt, Human
aggugccggcuccucacacaccaugg

SEQ ID NO: 52870 - RNA, 26 nt, Human
ggugcugaugaaucugccagaguuga

SEQ ID NO: 52871 - RNA, 27 nt, Human
gccggugggcuagggcaaggugugugc

SEQ ID NO: 52872 - RNA, 22 nt, Human
ccugcuucccaguccugccuga

SEQ ID NO: 52873 - RNA, 23 nt, Human
aucacuugagcccaggagucuag

SEQ ID NO: 52874 - RNA, 20 nt, Human
cugugucuugggccugugag

SEQ ID NO: 52875 - RNA, 24 nt, Human
guuuuuucuccuccguuuccccag

SEQ ID NO: 52876 - RNA, 22 nt, Human
cuuagccucccaaaguguuggg

SEQ ID NO: 52877 - RNA, 26 nt, Human
ugcagguggagguugcuagucuaguu

SEQ ID NO: 52878 - RNA, 25 nt, Human
aagggcgugggggguugcagcuggg

SEQ ID NO: 52879 - RNA, 22 nt, Human
ucccuaggggagcagauuaacc

SEQ ID NO: 52880 - RNA, 26 nt, Human
agcuguuuuccuccccucuguguacu

SEQ ID NO: 52881 - RNA, 22 nt, Human
aacugcugauucuacugggcug

SEQ ID NO: 52882 - RNA, 26 nt, Human
ugggguaggaggaacagguuuaaaaa

SEQ ID NO: 52883 - RNA, 27 nt, Human
cugggugacccuggcaggugcgcucag

SEQ ID NO: 52884 - RNA, 24 nt, Human
cagucgccuuugcuacugcuuuaa

SEQ ID NO: 52885 - RNA, 21 nt, Human
ugagccacagaccaccugcuu

SEQ ID NO: 52886 - RNA, 23 nt, Human
ccaaagauuuauuucucuugaca

SEQ ID NO: 52887 - RNA, 22 nt, Human
uccuauuuugcuaugcuuucua

SEQ ID NO: 52888 - RNA, 20 nt, Human
guggcuaccauucacuggca

SEQ ID NO: 52889 - RNA, 25 nt, Human
acgucuggcccuggcggguggcugc

SEQ ID NO: 52890 - RNA, 26 nt, Human
cacauuuguaauacuuuaggguccgu

SEQ ID NO: 52891 - RNA, 22 nt, Human
uauauuaacaaaauacuuuuua

SEQ ID NO: 52892 - RNA, 24 nt, Human
ugcaacagccacuacauuacuuca

SEQ ID NO: 52893 - RNA, 25 nt, Human
acuucuacaguuuagaaaguaucug

SEQ ID NO: 52894 - RNA, 22 nt, Human
gcccaggcuggggugcaguggc

SEQ ID NO: 52895 - RNA, 22 nt, Human
gcccaggcuggagugcaguagc

SEQ ID NO: 52896 - RNA, 24 nt, Human
gugacuuccuccuaacugucaggg

SEQ ID NO: 52897 - RNA, 25 nt, Human
gcgggccucaccccagacagagggc

SEQ ID NO: 52898 - RNA, 26 nt, Human
gcagagugccugaguuuagggucaag

SEQ ID NO: 52899 - RNA, 21 nt, Human
ccuuguucccagugcugucaa

SEQ ID NO: 52900 - RNA, 23 nt, Human
cucaucuuuuucucucuguauau

SEQ ID NO: 52901 - RNA, 22 nt, Human
ugcuguuguguuagcucugagu

SEQ ID NO: 52902 - RNA, 22 nt, Human
ccaugcccacuuugcgucugca

SEQ ID NO: 52903 - RNA, 22 nt, Human
aaccaucggaggagaaacucua

SEQ ID NO: 52904 - RNA, 22 nt, Human
aacgguaagaaaccaugagcac

SEQ ID NO: 52905 - RNA, 26 nt, Human
ggaauuuguuuuaucucuuugggaua

SEQ ID NO: 52906 - RNA, 27 nt, Human
agggaaaguagggcagaaacuggauac

SEQ ID NO: 52907 - RNA, 23 nt, Human
ccagcugggccauuucucagaca

SEQ ID NO: 52908 - RNA, 22 nt, Human
agccaagggaaggcaugacaga

SEQ ID NO: 52909 - RNA, 32 nt, Human
ggccaggggucucccuggagugcaguuuccaa

SEQ ID NO: 52910 - RNA, 23 nt, Human
uccacauuccucacuacuaacca

SEQ ID NO: 52911 - RNA, 23 nt, Human
cacuuucacuuugagcugggcaa

SEQ ID NO: 52912 - RNA, 27 nt, Human
uccuugccaagccccaggaagaaaaug

SEQ ID NO: 52913 - RNA, 21 nt, Human
uguuacaggcagaauuggaua

SEQ ID NO: 52914 - RNA, 21 nt, Human
gagaauucacuuguucuguca

SEQ ID NO: 52915 - RNA, 19 nt, Human
uuuccuucuuucuucuggc

SEQ ID NO: 52916 - RNA, 20 nt, Human
ggauguuucugcaucauguc

SEQ ID NO: 52917 - RNA, 25 nt, Human
ccagugacgaguggcccuuguaagg

SEQ ID NO: 52918 - RNA, 21 nt, Human
acaggacucucccuacugccu

SEQ ID NO: 52919 - RNA, 19 nt, Human
gucaggcaaagugcugcug

SEQ ID NO: 52920 - RNA, 20 nt, Human
uuagacugaauucaugugaa

SEQ ID NO: 52921 - RNA, 22 nt, Human
ccuuaucauucauucuuagcuc

SEQ ID NO: 52922 - RNA, 23 nt, Human
ccagaguagcugggacugcgggc

SEQ ID NO: 52923 - RNA, 20 nt, Human
ccucucccucuggucccaca

SEQ ID NO: 52924 - RNA, 23 nt, Human
ugcauauagaaaacaaaggagca

SEQ ID NO: 52925 - RNA, 24 nt, Human
aauugggacucccauucuuugcca

SEQ ID NO: 52926 - RNA, 21 nt, Human
auccagaagagacacuuuuua

SEQ ID NO: 52927 - RNA, 20 nt, Human
gaggcagcagaauugcuuga

SEQ ID NO: 52928 - RNA, 25 nt, Human
acgugacauagggaaagcuugcaau

SEQ ID NO: 52929 - RNA, 27 nt, Human
ggaggcugagacaggagaaucgcuuaa

SEQ ID NO: 52930 - RNA, 30 nt, Human
ggggguagaacggcccugugcuuaagacac

SEQ ID NO: 52931 - RNA, 26 nt, Human
caucauuacaauacaguauuucuuug

SEQ ID NO: 52932 - RNA, 26 nt, Human
ucagcuuggccaacuuggggggcugu

SEQ ID NO: 52933 - RNA, 23 nt, Human
caugccucuaaucccagcuacuc

SEQ ID NO: 52934 - RNA, 17 nt, Human
ugcuaucuccagcugcu

SEQ ID NO: 52935 - RNA, 26 nt, Human
cugccucugggcucauguaucugcgc

SEQ ID NO: 52936 - RNA, 19 nt, Human
uuuaaggcacuguagugaa

SEQ ID NO: 52937 - RNA, 26 nt, Human
gcuaccccuuacuccccucugcaacc

SEQ ID NO: 52938 - RNA, 25 nt, Human
aacagggacuucaaaaucacuguga

SEQ ID NO: 52939 - RNA, 21 nt, Human
acacuaaagcuacaagaaaua

SEQ ID NO: 52940 - RNA, 24 nt, Human
aaacauuuuggcauugaaugaugg

SEQ ID NO: 52941 - RNA, 23 nt, Human
agcagcgccugccuccucccucc

SEQ ID NO: 52942 - RNA, 26 nt, Human
cguggacugaagcucuucaugaugag

SEQ ID NO: 52943 - RNA, 19 nt, Human
uuugucaccucacccacag

SEQ ID NO: 52944 - RNA, 21 nt, Human
ugggcccugaguccugguuuc

SEQ ID NO: 52945 - RNA, 27 nt, Human
gcagagggccccaugccagacagcccu

SEQ ID NO: 52946 - RNA, 25 nt, Human
ugcaugauuuauuaguuucucucca

SEQ ID NO: 52947 - RNA, 26 nt, Human
ucucugaggagggagcaucugagcca

SEQ ID NO: 52948 - RNA, 27 nt, Human
aaaaagcauaaaaauuagccaagugug

SEQ ID NO: 52949 - RNA, 24 nt, Human
acuguaaaugcagccuucuuuuca

SEQ ID NO: 52950 - RNA, 24 nt, Human
gcccuauuccucuccuccuccucc

SEQ ID NO: 52951 - RNA, 27 nt, Human
gaggcaggaccagaaggcaaucaagag

SEQ ID NO: 52952 - RNA, 18 nt, Human
caugguuauuucugucag

SEQ ID NO: 52953 - RNA, 21 nt, Human
ccuccugccguggcugggguc

SEQ ID NO: 52954 - RNA, 23 nt, Human
uucugguccccacagacucagag

SEQ ID NO: 52955 - RNA, 19 nt, Human
acucugucacccaggcugg

SEQ ID NO: 52956 - RNA, 27 nt, Human
cccucauuagggcccuggaugauuuuu

SEQ ID NO: 52957 - RNA, 25 nt, Human
cugcagguuccaugaaaacagcccu

SEQ ID NO: 52958 - RNA, 24 nt, Human
ucagaggaacauugugaauuugua

SEQ ID NO: 52959 - RNA, 22 nt, Human
cccaucuguaucaucagugccu

SEQ ID NO: 52960 - RNA, 21 nt, Human
accuuagagguaugggccaga

SEQ ID NO: 52961 - RNA, 26 nt, Human
ccuguaaucccaacacuuugcgaggc

SEQ ID NO: 52962 - RNA, 22 nt, Human
cgccacuacacuccagccuggg

SEQ ID NO: 52963 - RNA, 20 nt, Human
ucugcccucaugaaauuggc

SEQ ID NO: 52964 - RNA, 22 nt, Human
ggauaggugaagaacagagccu

SEQ ID NO: 52965 - RNA, 23 nt, Human
aacaucuauuuugaaucuguaaa

SEQ ID NO: 52966 - RNA, 19 nt, Human
gaguuucagugugauuuca

SEQ ID NO: 52967 - RNA, 18 nt, Human
uuucagaaaggaguagaa

SEQ ID NO: 52968 - RNA, 22 nt, Human
ggugaagccucacauacuucuc

SEQ ID NO: 52969 - RNA, 22 nt, Human
gcgccucugccgccucuuccag

SEQ ID NO: 52970 - RNA, 20 nt, Human
cccugcagggggcucagcug

SEQ ID NO: 52971 - RNA, 27 nt, Human
cacuauacaauucaguacugauuauuc

SEQ ID NO: 52972 - RNA, 27 nt, Human
ucaugcccucuaagucucuuuccaacc

SEQ ID NO: 52973 - RNA, 23 nt, Human
ccagccucaaccacaauucuucc

SEQ ID NO: 52974 - RNA, 26 nt, Human
cuggaaggcagaaguugcagugagcu

SEQ ID NO: 52975 - RNA, 22 nt, Human
uuuucagucucaugugaaaauc

SEQ ID NO: 52976 - RNA, 24 nt, Human
guucccucucucugcuccuucacu

SEQ ID NO: 52977 - RNA, 22 nt, Human
caccaaaugaucucagcccugc

SEQ ID NO: 52978 - RNA, 21 nt, Human
gcacaggggacgcaaugggag

SEQ ID NO: 52979 - RNA, 22 nt, Human
ucugggcacuaagaaggucuau

SEQ ID NO: 52980 - RNA, 21 nt, Human
uuggugaucaagccucagucc

SEQ ID NO: 52981 - RNA, 22 nt, Human
acuccucuucugccugccuuug

SEQ ID NO: 52982 - RNA, 20 nt, Human
agccuccuguaccucagugg

SEQ ID NO: 52983 - RNA, 23 nt, Human
cuaccaccacaggaggaccagcc

SEQ ID NO: 52984 - RNA, 27 nt, Human
cgcucuuccuccagccgcugagccguc

SEQ ID NO: 52985 - RNA, 24 nt, Human
guucuguaaucuguaaacucaguu

SEQ ID NO: 52986 - RNA, 20 nt, Human
caaguuaaucaccuuuuacc

SEQ ID NO: 52987 - RNA, 25 nt, Human
ccagaaguacacauuuacaauagau

SEQ ID NO: 52988 - RNA, 22 nt, Human
uucccaggcuggggaugcuuug

SEQ ID NO: 52989 - RNA, 27 nt, Human
ucuccaaucccaucuauucucugccuu

SEQ ID NO: 52990 - RNA, 22 nt, Human
aagcugaggcaggaggauuacu

SEQ ID NO: 52991 - RNA, 27 nt, Human
gcagccuugacuccgugagcucaggga

SEQ ID NO: 52992 - RNA, 24 nt, Human
uuggggguuaugaaauuucauuaa

SEQ ID NO: 52993 - RNA, 18 nt, Human
gauaauucuucuccauca

SEQ ID NO: 52994 - RNA, 23 nt, Human
gggcccugaucgcccaccugccu

SEQ ID NO: 52995 - RNA, 19 nt, Human
uuugcuguuuucuuccucc

SEQ ID NO: 52996 - RNA, 22 nt, Human
cuaaacuucaaauaucauuuua

SEQ ID NO: 52997 - RNA, 19 nt, Human
gacuaggcuggagucuggc

SEQ ID NO: 52998 - RNA, 22 nt, Human
acccaauaaaccuucccuccca

SEQ ID NO: 52999 - RNA, 22 nt, Human
gggaggcaccguccggcggcga

SEQ ID NO: 53000 - RNA, 24 nt, Human
accuauguuggauguuggucuacu

SEQ ID NO: 53001 - RNA, 22 nt, Human
uccagcagaacauguucccuca

SEQ ID NO: 53002 - RNA, 20 nt, Human
gacugugauaacagugcaag

SEQ ID NO: 53003 - RNA, 22 nt, Human
aucucuacuuccagcuguguuc

SEQ ID NO: 53004 - RNA, 23 nt, Human
cuuggcagcugugacauuggggg

SEQ ID NO: 53005 - RNA, 23 nt, Human
uucugauaauauauguuuacuua

SEQ ID NO: 53006 - RNA, 21 nt, Human
aauuaaaaucgcuguuuucug

SEQ ID NO: 53007 - RNA, 21 nt, Human
gagggagggggagggaucggc

SEQ ID NO: 53008 - RNA, 24 nt, Human
ucucccuacucucucccgccgcuu

SEQ ID NO: 53009 - RNA, 19 nt, Human
gcuugaaaaacagcucugu

SEQ ID NO: 53010 - RNA, 20 nt, Human
auuuuuaaagaucuucucua

SEQ ID NO: 53011 - RNA, 22 nt, Human
guuccucuugggagaacacugc

SEQ ID NO: 53012 - RNA, 20 nt, Human
auuuuaggagcuuuauuugg

SEQ ID NO: 53013 - RNA, 23 nt, Human
guggagagcagugagcaaggggc

SEQ ID NO: 53014 - RNA, 29 nt, Human
ggaguuagggagagagaagcaggcagaua

SEQ ID NO: 53015 - RNA, 24 nt, Human
ccugcccucccgggcaguacuggg

SEQ ID NO: 53016 - RNA, 23 nt, Human
ccuugccccucuugcucgccuug

SEQ ID NO: 53017 - RNA, 23 nt, Human
cccaccccacacauucucaacca

SEQ ID NO: 53018 - RNA, 22 nt, Human
auagaucuaggcagagugccuu

SEQ ID NO: 53019 - RNA, 22 nt, Human
ugccacggccaccagcuggagc

SEQ ID NO: 53020 - RNA, 20 nt, Human
ccgccucccgggccugcugu

SEQ ID NO: 53021 - RNA, 22 nt, Human
gaagggaggggaagagagaggc

SEQ ID NO: 53022 - RNA, 22 nt, Human
ccauucacugagucuucucagc

SEQ ID NO: 53023 - RNA, 24 nt, Human
cccaguggggacagggagggggac

SEQ ID NO: 53024 - RNA, 23 nt, Human
gaggcaaagagaaaagccacgga

SEQ ID NO: 53025 - RNA, 23 nt, Human
ggcgaggacaagagcagggcggc

SEQ ID NO: 53026 - RNA, 21 nt, Human
uugagaguuuauauggaacac

SEQ ID NO: 53027 - RNA, 19 nt, Human
cuggcugcccucggccucc

SEQ ID NO: 53028 - RNA, 18 nt, Human
cccacccccacugcaccc

SEQ ID NO: 53029 - RNA, 21 nt, Human
cugccuccugccugccccucu

SEQ ID NO: 53030 - RNA, 24 nt, Human
ucucucuuacaaccaagaacauua

SEQ ID NO: 53031 - RNA, 21 nt, Human
gacugacugaaugaaugaaug

SEQ ID NO: 53032 - RNA, 21 nt, Human
auacuguggacacaacuugcu

SEQ ID NO: 53033 - RNA, 17 nt, Human
uagaaaauauauuugca

SEQ ID NO: 53034 - RNA, 23 nt, Human
ggcagaauuuaucucuuuuuugu

SEQ ID NO: 53035 - RNA, 20 nt, Human
uucuccuccucucccagggc

SEQ ID NO: 53036 - RNA, 17 nt, Human
ccaccuagggguucagu

SEQ ID NO: 53037 - RNA, 26 nt, Human
uuccuuucggaguaauccugccuggg

SEQ ID NO: 53038 - RNA, 24 nt, Human
acccagacauaaaggaaaagacac

SEQ ID NO: 53039 - RNA, 22 nt, Human
ggaggcugagccaggaggauca

SEQ ID NO: 53040 - RNA, 22 nt, Human
aggcugaggugggaggauccca

SEQ ID NO: 53041 - RNA, 25 nt, Human
cuccagguuccagccgucucauggc

SEQ ID NO: 53042 - RNA, 22 nt, Human
ccaaagugcuaggauuacaggu

SEQ ID NO: 53043 - RNA, 20 nt, Human
ccuuauuccacagauaucuu

SEQ ID NO: 53044 - RNA, 28 nt, Human
gcucaauaaaccuccugcccuccccucc

SEQ ID NO: 53045 - RNA, 20 nt, Human
cuaagucucuuuucucacgg

SEQ ID NO: 53046 - RNA, 25 nt, Human
acuagcacaccacugcaugucucua

SEQ ID NO: 53047 - RNA, 22 nt, Human
cagcugggccuccugccuccgg

SEQ ID NO: 53048 - RNA, 19 nt, Human
gaggaaggggacaaguagc

SEQ ID NO: 53049 - RNA, 26 nt, Human
acgaguguccauagauauaaagccau

SEQ ID NO: 53050 - RNA, 21 nt, Human
caauugucgucauuaucaucu

SEQ ID NO: 53051 - RNA, 22 nt, Human
cuuuuuaaacuacuaguuuuaa

SEQ ID NO: 53052 - RNA, 26 nt, Human
uagggaggcugggggaaaagguuaga

SEQ ID NO: 53053 - RNA, 20 nt, Human
uagcuucccuucccucauca

SEQ ID NO: 53054 - RNA, 20 nt, Human
gauggcugauuccccaaggg

SEQ ID NO: 53055 - RNA, 25 nt, Human
ccugagcuuccuguacccugacccu

SEQ ID NO: 53056 - RNA, 22 nt, Human
ggccucugaaaguacugggauu

SEQ ID NO: 53057 - RNA, 23 nt, Human
gacaugugcacuccuuccaggag

SEQ ID NO: 53058 - RNA, 22 nt, Human
cggggugggggugggcagugag

SEQ ID NO: 53059 - RNA, 21 nt, Human
uaguugaacugguuuuucagu

SEQ ID NO: 53060 - RNA, 26 nt, Human
ugcucacauguuucccugcugaccuu

SEQ ID NO: 53061 - RNA, 22 nt, Human
cacaaaaucucugggacuguuc

SEQ ID NO: 53062 - RNA, 20 nt, Human
gaacuaauaaaugcaccuua

SEQ ID NO: 53063 - RNA, 21 nt, Human
uaagaaaaaauugcacaaaaa

SEQ ID NO: 53064 - RNA, 22 nt, Human
uggagaccucaugacaaaggag

SEQ ID NO: 53065 - RNA, 23 nt, Human
cuucacugcauccuggagugcaa

SEQ ID NO: 53066 - RNA, 19 nt, Human
acucugacugcuguuaucc

SEQ ID NO: 53067 - RNA, 21 nt, Human
ugcuuauguacuaauaguuga

SEQ ID NO: 53068 - RNA, 21 nt, Human
ccugguuucccuaucuguaaa

SEQ ID NO: 53069 - RNA, 27 nt, Human
ccaccugcagccaaaucuggcccaccu

SEQ ID NO: 53070 - RNA, 21 nt, Human
uuauccaggcagugggucugc

SEQ ID NO: 53071 - RNA, 20 nt, Human
aaagacauuccuggaaucac

SEQ ID NO: 53072 - RNA, 25 nt, Human
ggacggggagagcgugggucacugc

SEQ ID NO: 53073 - RNA, 19 nt, Human
cacuuucccucucuggacc

SEQ ID NO: 53074 - RNA, 25 nt, Human
aacugaauuuaguaaccacucugaa

SEQ ID NO: 53075 - RNA, 25 nt, Human
cucguucaucuucauuuacuuucca

SEQ ID NO: 53076 - RNA, 30 nt, Human
aagucacccacugugagagcuggucuucua

SEQ ID NO: 53077 - RNA, 25 nt, Human
gucuuugucuaguugggaucuuuau

SEQ ID NO: 53078 - RNA, 23 nt, Human
ccaagucgccacauuucucugca

SEQ ID NO: 53079 - RNA, 27 nt, Human
gccagugcucugcgcaggauuggaaca

SEQ ID NO: 53080 - RNA, 26 nt, Human
gcuggcugagugcguuuuguccuuca

SEQ ID NO: 53081 - RNA, 26 nt, Human
ccugcucuccucacacauuguguggu

SEQ ID NO: 53082 - RNA, 19 nt, Human
uagagggagacuggagggu

SEQ ID NO: 53083 - RNA, 21 nt, Human
ucuugaacuccugaccucagg

SEQ ID NO: 53084 - RNA, 22 nt, Human
ggggaaagaaaggcagcgggaa

SEQ ID NO: 53085 - RNA, 21 nt, Human
cugugugaccauagaaaguga

SEQ ID NO: 53086 - RNA, 21 nt, Human
uccugucuccccuaauugaca

SEQ ID NO: 53087 - RNA, 20 nt, Human
cuugguuccugaugggaaca

SEQ ID NO: 53088 - RNA, 24 nt, Human
agccucacuccaccuuccuuccau

SEQ ID NO: 53089 - RNA, 27 nt, Human
uacuacugcugccgucaauggugcuac

SEQ ID NO: 53090 - RNA, 26 nt, Human
ucuuaggaucaucaaaagaaaaagag

SEQ ID NO: 53091 - RNA, 27 nt, Human
gggagagaagagccguccagggaccca

SEQ ID NO: 53092 - RNA, 16 nt, Human
accuccgaaugccuuu

SEQ ID NO: 53093 - RNA, 27 nt, Human
gggccagccugggucacgagaugcugu

SEQ ID NO: 53094 - RNA, 21 nt, Human
cagggcuguagcacaggcuuc

SEQ ID NO: 53095 - RNA, 22 nt, Human
cgccucccggguucaagugauu

SEQ ID NO: 53096 - RNA, 26 nt, Human
agauuguggggugcagcugggugggg

SEQ ID NO: 53097 - RNA, 22 nt, Human
uugagauacuauuuucauuuuu

SEQ ID NO: 53098 - RNA, 24 nt, Human
gagcaacuugaauaauacugugaa

SEQ ID NO: 53099 - RNA, 22 nt, Human
gcucagcuucuccacaaggcua

SEQ ID NO: 53100 - RNA, 20 nt, Human
accgggcuggagugcagugg

SEQ ID NO: 53101 - RNA, 23 nt, Human
cucggucuguggcagcagcguug

SEQ ID NO: 53102 - RNA, 21 nt, Human
ccagcaccaagagauuauuua

SEQ ID NO: 53103 - RNA, 27 nt, Human
uuagaaaacaagugggacauauuuucc

SEQ ID NO: 53104 - RNA, 24 nt, Human
gguaaagcaucuuaaucagacuua

SEQ ID NO: 53105 - RNA, 26 nt, Human
ggggucugagcuccagcuccuuuggg

SEQ ID NO: 53106 - RNA, 23 nt, Human
ugggaaccccccucccacccacc

SEQ ID NO: 53107 - RNA, 20 nt, Human
ccacagaaacauuuucauuu

SEQ ID NO: 53108 - RNA, 21 nt, Human
uucaaguaaucaugugccaaa

SEQ ID NO: 53109 - RNA, 19 nt, Human
cuuugcaccugucuucagg

SEQ ID NO: 53110 - RNA, 22 nt, Human
ccucgcgucugugccugccuca

SEQ ID NO: 53111 - RNA, 20 nt, Human
cuuccuggcccagcgcucgu

SEQ ID NO: 53112 - RNA, 27 nt, Human
ccucacacacuggcuccagcugccagc

SEQ ID NO: 53113 - RNA, 22 nt, Human
ucacuggcaauauuuguucugg

SEQ ID NO: 53114 - RNA, 20 nt, Human
caaauguuaucuguggggga

SEQ ID NO: 53115 - RNA, 22 nt, Human
uuuguuucucaaccacuuuaua

SEQ ID NO: 53116 - RNA, 18 nt, Human
cuuguauuuuucugugau

SEQ ID NO: 53117 - RNA, 23 nt, Human
cucuuugccaccuaggccaguuu

SEQ ID NO: 53118 - RNA, 26 nt, Human
cuccccucugagguuucucagguggc

SEQ ID NO: 53119 - RNA, 27 nt, Human
cacugcacuccagccugggcaacauag

SEQ ID NO: 53120 - RNA, 27 nt, Human
cacugcacgccagccugggcaacagag

SEQ ID NO: 53121 - RNA, 23 nt, Human
ccuccccuggcccuccuuucugg

SEQ ID NO: 53122 - RNA, 26 nt, Human
ucuggcuuuucuccuaucuugcuucu

SEQ ID NO: 53123 - RNA, 22 nt, Human
aggggaccucaggucuaccuca

SEQ ID NO: 53124 - RNA, 20 nt, Human
gugggacaaacugccuccug

SEQ ID NO: 53125 - RNA, 22 nt, Human
gcuuuaugauauccuacuuggc

SEQ ID NO: 53126 - RNA, 19 nt, Human
acgggaagaggcagaggga

SEQ ID NO: 53127 - RNA, 22 nt, Human
gucucaaacuccugcccucagg

SEQ ID NO: 53128 - RNA, 22 nt, Human
gcgaucucugcucacugcaacc

SEQ ID NO: 53129 - RNA, 31 nt, Human
gcuguuguauuacuuauucuuugccuuguuc

SEQ ID NO: 53130 - RNA, 27 nt, Human
ggugcaguucugaaacugaaaggacug

SEQ ID NO: 53131 - RNA, 27 nt, Human
ccaggagauugugauugggagagggua

SEQ ID NO: 53132 - RNA, 26 nt, Human
ucagugagccaagaucgcaccacugc

SEQ ID NO: 53133 - RNA, 29 nt, Human
gaguccuaagggagagaucaaguugagac

SEQ ID NO: 53134 - RNA, 22 nt, Human
uuuguguuacugcagugaccug

SEQ ID NO: 53135 - RNA, 22 nt, Human
gcaaauucugggagguuugggc

SEQ ID NO: 53136 - RNA, 25 nt, Human
caggauggacuuccuccggcuauac

SEQ ID NO: 53137 - RNA, 21 nt, Human
gggagucauuuggagaaagcc

SEQ ID NO: 53138 - RNA, 21 nt, Human
guaagcacugacugggaccag

SEQ ID NO: 53139 - RNA, 32 nt, Human
uggcgcggggaggagcagggaucuuggcagcg

SEQ ID NO: 53140 - RNA, 21 nt, Human
ggugagggcugggcuuuugcu

SEQ ID NO: 53141 - RNA, 23 nt, Human
cuggggagggaaagcgccuuuuc

SEQ ID NO: 53142 - RNA, 22 nt, Human
uagaaaacaaugcaaaaccuuu

SEQ ID NO: 53143 - RNA, 23 nt, Human
gguacuuccuuucucccugcggg

SEQ ID NO: 53144 - RNA, 28 nt, Human
ucuuguccaggcuggagugcaauagcgc

SEQ ID NO: 53145 - RNA, 19 nt, Human
gccucaacacaaugccuua

SEQ ID NO: 53146 - RNA, 19 nt, Human
accaaggcuuagugcagug

SEQ ID NO: 53147 - RNA, 23 nt, Human
ugcaagaggcaggauggucucca

SEQ ID NO: 53148 - RNA, 18 nt, Human
acuuuuguucugcuuuau

SEQ ID NO: 53149 - RNA, 21 nt, Human
cuucccuucucuugggggccg

SEQ ID NO: 53150 - RNA, 27 nt, Human
ucacaugcauuaugagucgcuuugagc

SEQ ID NO: 53151 - RNA, 27 nt, Human
aggacagacagcaggcacggcccgcag

SEQ ID NO: 53152 - RNA, 31 nt, Human
gcuuauucuccucccuguuaucugcuagauc

SEQ ID NO: 53153 - RNA, 23 nt, Human
agaucggaucuguugcaaacuca

SEQ ID NO: 53154 - RNA, 24 nt, Human
ggagagaagagaaggcagcagcag

SEQ ID NO: 53155 - RNA, 23 nt, Human
ugcccgcuggggagggguccggg

SEQ ID NO: 53156 - RNA, 19 nt, Human
gugcugagccaagagcucc

SEQ ID NO: 53157 - RNA, 24 nt, Human
aguuacagcaaucauucaaucuga

SEQ ID NO: 53158 - RNA, 23 nt, Human
cacgggccucucuguguuugcgu

SEQ ID NO: 53159 - RNA, 23 nt, Human
ucaucuggauguauuagaaguaa

SEQ ID NO: 53160 - RNA, 27 nt, Human
augauaucugaauucaccagcugaguu

SEQ ID NO: 53161 - RNA, 20 nt, Human
cagcaguuugccacugugac

SEQ ID NO: 53162 - RNA, 23 nt, Human
ugucauccaggcuggagugcagu

SEQ ID NO: 53163 - RNA, 22 nt, Human
acagugaguaaauaccauggaa

SEQ ID NO: 53164 - RNA, 23 nt, Human
gugacccugacacccuccuucug

SEQ ID NO: 53165 - RNA, 20 nt, Human
ccugcccugcccugcccugc

SEQ ID NO: 53166 - RNA, 22 nt, Human
caaacgacugggaaaccaaaau

SEQ ID NO: 53167 - RNA, 22 nt, Human
uuguaaauuuuuuaagguucuu

SEQ ID NO: 53168 - RNA, 17 nt, Human
auggcagcaggcggugg

SEQ ID NO: 53169 - RNA, 27 nt, Human
cacugcacucuagccugggccauagag

SEQ ID NO: 53170 - RNA, 24 nt, Human
gcucugcuuggaaaacaguucacu

SEQ ID NO: 53171 - RNA, 22 nt, Human
cgcugugggcaucuucugccca

SEQ ID NO: 53172 - RNA, 23 nt, Human
caguucacugcaaccucugccuc

SEQ ID NO: 53173 - RNA, 22 nt, Human
gaucacaucacuccaccccugc

SEQ ID NO: 53174 - RNA, 23 nt, Human
ccaaaacuugccaaauuccucca

SEQ ID NO: 53175 - RNA, 27 nt, Human
gggcgcacacaggcagaaggcucgggg

SEQ ID NO: 53176 - RNA, 21 nt, Human
uuugcuuuagguaucacugga

SEQ ID NO: 53177 - RNA, 23 nt, Human
cugaugggccagcaggagccagc

SEQ ID NO: 53178 - RNA, 21 nt, Human
acaucucccuuccaccucaca

SEQ ID NO: 53179 - RNA, 24 nt, Human
gagaguacuagccuccuccacucc

SEQ ID NO: 53180 - RNA, 30 nt, Human
cacccucuugucuucagggaauucagagga

SEQ ID NO: 53181 - RNA, 23 nt, Human
cuggaugugcugugcagguuggu

SEQ ID NO: 53182 - RNA, 25 nt, Human
gccuuucuuucucccucuugcaacc

SEQ ID NO: 53183 - RNA, 26 nt, Human
ccagaguagcugccgccaccagaguc

SEQ ID NO: 53184 - RNA, 18 nt, Human
cccucccuccccuuggcc

SEQ ID NO: 53185 - RNA, 17 nt, Human
aaagacaccuggaaccc

SEQ ID NO: 53186 - RNA, 23 nt, Human
ccauuuuguuuucuccugcccuu

SEQ ID NO: 53187 - RNA, 25 nt, Human
agaugugguuuacucugccacaguc

SEQ ID NO: 53188 - RNA, 20 nt, Human
agucucaagagcucuugccu

SEQ ID NO: 53189 - RNA, 31 nt, Human
agagcuaguuuuaaaauaaugaucucagauu

SEQ ID NO: 53190 - RNA, 24 nt, Human
uucuuuucuccauggaaaaggaca

SEQ ID NO: 53191 - RNA, 22 nt, Human
cuacauacuguuccagacuuuu

SEQ ID NO: 53192 - RNA, 23 nt, Human
aagggguucgugcgcuguggaga

SEQ ID NO: 53193 - RNA, 16 nt, Human
cugcccuuaccugcca

SEQ ID NO: 53194 - RNA, 23 nt, Human
cuccaagcuguacaggcaauggc

SEQ ID NO: 53195 - RNA, 27 nt, Human
cccuuccuucaauuucucagugacauu

SEQ ID NO: 53196 - RNA, 18 nt, Human
augagugccuacagcaga

SEQ ID NO: 53197 - RNA, 27 nt, Human
aauuuacagaucagacaugaaugggug

SEQ ID NO: 53198 - RNA, 22 nt, Human
ggcggagggaggggagggguga

SEQ ID NO: 53199 - RNA, 25 nt, Human
acaucacaauguaaauaucauuuuu

SEQ ID NO: 53200 - RNA, 22 nt, Human
ugcuaccucuugaaacugacau

SEQ ID NO: 53201 - RNA, 23 nt, Human
acacauuuauaaggacagagauu

SEQ ID NO: 53202 - RNA, 23 nt, Human
guuuuucuucaacaucuuaacuc

SEQ ID NO: 53203 - RNA, 24 nt, Human
uguugcccaggcugggagggcaau

SEQ ID NO: 53204 - RNA, 22 nt, Human
gggcucguuccccaccuggccu

SEQ ID NO: 53205 - RNA, 22 nt, Human
gaaacccagggaaccucucuga

SEQ ID NO: 53206 - RNA, 22 nt, Human
agccugcuucuuccccaggguu

SEQ ID NO: 53207 - RNA, 20 nt, Human
uccugucucaaauccaauag

SEQ ID NO: 53208 - RNA, 27 nt, Human
gucacccaggaugcuggggcacuuuaa

SEQ ID NO: 53209 - RNA, 22 nt, Human
ccaacauggugaaaccucaucu

SEQ ID NO: 53210 - RNA, 18 nt, Human
agaaaugaucagaacaaa

SEQ ID NO: 53211 - RNA, 21 nt, Human
auucuaugugauuaguaugcu

SEQ ID NO: 53212 - RNA, 27 nt, Human
ccugggucucucauuuccuggcugaag

SEQ ID NO: 53213 - RNA, 26 nt, Human
cccucucugggccucaguuuccccuu

SEQ ID NO: 53214 - RNA, 24 nt, Human
guugcacugccccacugccugucc

SEQ ID NO: 53215 - RNA, 24 nt, Human
gcccuggccucuuugcccugggcc

SEQ ID NO: 53216 - RNA, 22 nt, Human
acucuguagacuggaucuguuu

SEQ ID NO: 53217 - RNA, 20 nt, Human
cuccaccuuacuucuucuca

SEQ ID NO: 53218 - RNA, 27 nt, Human
agcacagugccuuguguauaauaggca

SEQ ID NO: 53219 - RNA, 26 nt, Human
guggggaggggcgcgcggaucauggc

SEQ ID NO: 53220 - RNA, 26 nt, Human
ccaggcagcugggauucaauucccug

SEQ ID NO: 53221 - RNA, 23 nt, Human
auuuggcuuuuuucuuaaauguc

SEQ ID NO: 53222 - RNA, 27 nt, Human
ccugccugguccucacacucacccaac

SEQ ID NO: 53223 - RNA, 26 nt, Human
cccucgggggaccugaacuugaugcg

SEQ ID NO: 53224 - RNA, 24 nt, Human
ucagauacaacagcauuuggggcc

SEQ ID NO: 53225 - RNA, 23 nt, Human
agcucaccucccuccuguucaca

SEQ ID NO: 53226 - RNA, 27 nt, Human
acuugaauuugacacaagagaaaagca

SEQ ID NO: 53227 - RNA, 21 nt, Human
ugcagggcggccagugcagug

SEQ ID NO: 53228 - RNA, 20 nt, Human
gacaggcaagccagcucugg

SEQ ID NO: 53229 - RNA, 22 nt, Human
agggaauucuggccacccuggg

SEQ ID NO: 53230 - RNA, 23 nt, Human
uuacuguuugaguuucucucaca

SEQ ID NO: 53231 - RNA, 27 nt, Human
ugcaugcugugaucccaauuuuguguu

SEQ ID NO: 53232 - RNA, 24 nt, Human
aagacagguucugugugcuuuuua

SEQ ID NO: 53233 - RNA, 27 nt, Human
guagggaguccacggagaagaugcagu

SEQ ID NO: 53234 - RNA, 22 nt, Human
uccggguagcugggacuacagg

SEQ ID NO: 53235 - RNA, 26 nt, Human
aauuuuuccuuuaucacauaacugua

SEQ ID NO: 53236 - RNA, 24 nt, Human
uuccccaccccccagcgucaucuc

SEQ ID NO: 53237 - RNA, 20 nt, Human
ugucccucauggagaccuca

SEQ ID NO: 53238 - RNA, 25 nt, Human
gaaagagaauuuuauuuauaaauga

SEQ ID NO: 53239 - RNA, 25 nt, Human
caguauuucacaacuuccuggucgc

SEQ ID NO: 53240 - RNA, 21 nt, Human
cugucccuucgccugcugcug

SEQ ID NO: 53241 - RNA, 23 nt, Human
aggugcacuccagacucuggggg

SEQ ID NO: 53242 - RNA, 20 nt, Human
gccugccagccacagcaauc

SEQ ID NO: 53243 - RNA, 22 nt, Human
acugcaaccuccgccucuuggg

SEQ ID NO: 53244 - RNA, 22 nt, Human
caccuccuggguucaagcaauu

SEQ ID NO: 53245 - RNA, 23 nt, Human
cugugagccauugucccucuuug

SEQ ID NO: 53246 - RNA, 23 nt, Human
cccacaacgugcaacugacacuc

SEQ ID NO: 53247 - RNA, 27 nt, Human
acaagcagaugucauggcacccccagu

SEQ ID NO: 53248 - RNA, 27 nt, Human
guugcccaggcuggagggcaauggugc

SEQ ID NO: 53249 - RNA, 27 nt, Human
ggcaggguggagggcaaggcugggggg

SEQ ID NO: 53250 - RNA, 22 nt, Human
ccccuuccugcaucaccaccuu

SEQ ID NO: 53251 - RNA, 25 nt, Human
ugugauuauuaaaaugacuguagcu

SEQ ID NO: 53252 - RNA, 21 nt, Human
cuugcucuguugccugggcug

SEQ ID NO: 53253 - RNA, 21 nt, Human
aaaaggagaaguacaaauguc

SEQ ID NO: 53254 - RNA, 22 nt, Human
gcccaggcuggugugcaauggc

SEQ ID NO: 53255 - RNA, 22 nt, Human
gcgugagcaaucgugcccagcc

SEQ ID NO: 53256 - RNA, 18 nt, Human
uccuuuaucacaggauuu

SEQ ID NO: 53257 - RNA, 22 nt, Human
ucagcucucuuauuuuuuccuu

SEQ ID NO: 53258 - RNA, 20 nt, Human
caguucuuaaauaaaacugc

SEQ ID NO: 53259 - RNA, 23 nt, Human
ucuuagaguguagcuguaagggc

SEQ ID NO: 53260 - RNA, 27 nt, Human
uccuaaaacauggaagguuuuccccuc

SEQ ID NO: 53261 - RNA, 23 nt, Human
gccacugcgggagcucuguaugg

SEQ ID NO: 53262 - RNA, 23 nt, Human
ccugcuucccaccucccugccca

SEQ ID NO: 53263 - RNA, 26 nt, Human
ugcccaggcuugaugggauaaaaugu

SEQ ID NO: 53264 - RNA, 27 nt, Human
gccaugauuggaacccaggaacucugg

SEQ ID NO: 53265 - RNA, 27 nt, Human
gcugccucuugucuagcugcugucagg

SEQ ID NO: 53266 - RNA, 20 nt, Human
gcgccacagcaggcugccuc

SEQ ID NO: 53267 - RNA, 22 nt, Human
aagauuuagaagccuugcacuc

SEQ ID NO: 53268 - RNA, 22 nt, Human
uguucccucucucccuccaggg

SEQ ID NO: 53269 - RNA, 24 nt, Human
caagggagauccuggaguuaagac

SEQ ID NO: 53270 - RNA, 21 nt, Human
aggucacugcaaccuccaccu

SEQ ID NO: 53271 - RNA, 21 nt, Human
cuccgccagacuccugcccag

SEQ ID NO: 53272 - RNA, 23 nt, Human
gcgcaggagggaggagaacuggg

SEQ ID NO: 53273 - RNA, 21 nt, Human
uugcccaggcuggucgcgaac

SEQ ID NO: 53274 - RNA, 27 nt, Human
ggggaaaggaaaagccccuggaaaugc

SEQ ID NO: 53275 - RNA, 20 nt, Human
cugcauuagcagugugguua

SEQ ID NO: 53276 - RNA, 22 nt, Human
auuguuaucugaaaggcuuuca

SEQ ID NO: 53277 - RNA, 32 nt, Human
acuucuaagcucuucuucuuccuucauuggcc

SEQ ID NO: 53278 - RNA, 26 nt, Human
acaaggucaauugguuaccucaguau

SEQ ID NO: 53279 - RNA, 25 nt, Human
uuuuggagcacuauuccauugucag

SEQ ID NO: 53280 - RNA, 20 nt, Human
gaagggaggaggagagccag

SEQ ID NO: 53281 - RNA, 20 nt, Human
ccucaguucugugcccagcc

SEQ ID NO: 53282 - RNA, 24 nt, Human
gguccacucuguacacaggcauuc

SEQ ID NO: 53283 - RNA, 24 nt, Human
ccuucacuccucuguggcucugga

SEQ ID NO: 53284 - RNA, 26 nt, Human
ccuguguggggaggcccuccugcugc

SEQ ID NO: 53285 - RNA, 22 nt, Human
gcccaauagaaguacagagcca

SEQ ID NO: 53286 - RNA, 22 nt, Human
aaaccacagucuguaaucccag

SEQ ID NO: 53287 - RNA, 21 nt, Human
gugcuucucccugugcugagg

SEQ ID NO: 53288 - RNA, 21 nt, Human
gggcccagccgagcagccugc

SEQ ID NO: 53289 - RNA, 29 nt, Human
acacaggaucccugcugggcaccaacagc

SEQ ID NO: 53290 - RNA, 20 nt, Human
aagagguugaggcugcagug

SEQ ID NO: 53291 - RNA, 22 nt, Human
ccacccagcaggcgcuggugcu

SEQ ID NO: 53292 - RNA, 20 nt, Human
ucacugcuacagccuagaag

SEQ ID NO: 53293 - RNA, 21 nt, Human
uuucuugaucuuaccccacca

SEQ ID NO: 53294 - RNA, 19 nt, Human
cuuuaccucauaugcagcu

SEQ ID NO: 53295 - RNA, 22 nt, Human
uuauaagauucauucucuuuca

SEQ ID NO: 53296 - RNA, 21 nt, Human
ccuauuugaaagucucagggg

SEQ ID NO: 53297 - RNA, 26 nt, Human
aagucuguggaugcagcuguuaugaa

SEQ ID NO: 53298 - RNA, 22 nt, Human
ccgagaucgcgccacugugcuc

SEQ ID NO: 53299 - RNA, 22 nt, Human
cugagaucgcaccacugcacuc

SEQ ID NO: 53300 - RNA, 27 nt, Human
gagagugagcaaccagcuggaagguac

SEQ ID NO: 53301 - RNA, 16 nt, Human
cuucccuugagggcag

SEQ ID NO: 53302 - RNA, 21 nt, Human
aaccugcucuguugugcuggc

SEQ ID NO: 53303 - RNA, 25 nt, Human
gagcuaaguauacacuaucugguga

SEQ ID NO: 53304 - RNA, 21 nt, Human
ucuguggcccaggcugagagc

SEQ ID NO: 53305 - RNA, 24 nt, Human
cccauaagcugggucucaggcugg

SEQ ID NO: 53306 - RNA, 21 nt, Human
cccaacaacauccucugccac

SEQ ID NO: 53307 - RNA, 21 nt, Human
ggcugcucugggcagcgccuu

SEQ ID NO: 53308 - RNA, 23 nt, Human
aacuuuaguaacacagcuggaac

SEQ ID NO: 53309 - RNA, 22 nt, Human
ucuggcccuuccuuuucgcagg

SEQ ID NO: 53310 - RNA, 19 nt, Human
gcagacuccagacaaggau

SEQ ID NO: 53311 - RNA, 21 nt, Human
accuaguuccuucuagggaua

SEQ ID NO: 53312 - RNA, 27 nt, Human
cacugcaccaucaggcuuggcccugcu

SEQ ID NO: 53313 - RNA, 28 nt, Human
acacacacagccucucugcccaccucug

SEQ ID NO: 53314 - RNA, 22 nt, Human
gccagggucucacuauguugcc

SEQ ID NO: 53315 - RNA, 21 nt, Human
ucagcacagcuuuucuugugu

SEQ ID NO: 53316 - RNA, 22 nt, Human
aagaguuggcuuuaaaauguuu

SEQ ID NO: 53317 - RNA, 22 nt, Human
accuggguggcuuaugagagag

SEQ ID NO: 53318 - RNA, 22 nt, Human
gcccccagaaccccuuccucuc

SEQ ID NO: 53319 - RNA, 27 nt, Human
ggagaggggcugcugugcaggggugug

SEQ ID NO: 53320 - RNA, 22 nt, Human
uggcccuuccccuuggaggcga

SEQ ID NO: 53321 - RNA, 27 nt, Human
ucccucggggccauacuucuguuucca

SEQ ID NO: 53322 - RNA, 21 nt, Human
ugaaugaaugaaugaaugagg

SEQ ID NO: 53323 - RNA, 23 nt, Human
uuugguuucuuccuuuccuguga

SEQ ID NO: 53324 - RNA, 19 nt, Human
uguaacuuuuacaugugaa

SEQ ID NO: 53325 - RNA, 21 nt, Human
aacacaacaaucugugcuuau

SEQ ID NO: 53326 - RNA, 22 nt, Human
uuuucaggagggacgugcaaua

SEQ ID NO: 53327 - RNA, 20 nt, Human
agagagggaaacacagcagc

SEQ ID NO: 53328 - RNA, 23 nt, Human
ccccugccucgguuggugacaga

SEQ ID NO: 53329 - RNA, 22 nt, Human
gggggagaaguaaccaggcggg

SEQ ID NO: 53330 - RNA, 21 nt, Human
gcgugagcccccacgcuggcc

SEQ ID NO: 53331 - RNA, 24 nt, Human
gcucccuucugucauuuucauuga

SEQ ID NO: 53332 - RNA, 22 nt, Human
cucaccugggguucucugugug

SEQ ID NO: 53333 - RNA, 27 nt, Human
uaggccaugggacagggaggauccugu

SEQ ID NO: 53334 - RNA, 22 nt, Human
augcuuguaauccuagcacuuu

SEQ ID NO: 53335 - RNA, 21 nt, Human
ggagaaacuuaagcuaaaguc

SEQ ID NO: 53336 - RNA, 23 nt, Human
ugccuguauucacagcugcuugg

SEQ ID NO: 53337 - RNA, 24 nt, Human
ccugcccaccuccccuuuuguuuc

SEQ ID NO: 53338 - RNA, 27 nt, Human
ucugaacuaggugaucucaguucucuu

SEQ ID NO: 53339 - RNA, 21 nt, Human
ugggaggcggcuugugcuuug

SEQ ID NO: 53340 - RNA, 21 nt, Human
gcuccgccucaccugccacca

SEQ ID NO: 53341 - RNA, 24 nt, Human
aauaucuuaauccuacucagugaa

SEQ ID NO: 53342 - RNA, 25 nt, Human
ugaccaacuacauuaccaugcugug

SEQ ID NO: 53343 - RNA, 18 nt, Human
ugccucaaagcaguaacu

SEQ ID NO: 53344 - RNA, 21 nt, Human
uucuuuuacuccugagcccag

SEQ ID NO: 53345 - RNA, 21 nt, Human
gcccagacuugauguuuuggg

SEQ ID NO: 53346 - RNA, 16 nt, Human
agccccaucagcugcc

SEQ ID NO: 53347 - RNA, 21 nt, Human
ccuccuggcugcagcucugaa

SEQ ID NO: 53348 - RNA, 22 nt, Human
ucacucacuuuucuauuuugga

SEQ ID NO: 53349 - RNA, 26 nt, Human
ccccugccuccgccauguuccgcagg

SEQ ID NO: 53350 - RNA, 18 nt, Human
ucagcacugucuccagau

SEQ ID NO: 53351 - RNA, 26 nt, Human
agccuccucagcucuuggaauugcug

SEQ ID NO: 53352 - RNA, 19 nt, Human
cugacuucucuguccgaag

SEQ ID NO: 53353 - RNA, 23 nt, Human
gaagggcagggguguccugaugc

SEQ ID NO: 53354 - RNA, 19 nt, Human
cucagcccacuuaggauaa

SEQ ID NO: 53355 - RNA, 24 nt, Human
ggaggaagaaagaggaggggcugg

SEQ ID NO: 53356 - RNA, 23 nt, Human
cugcugcucugcugccugcccgc

SEQ ID NO: 53357 - RNA, 16 nt, Human
cccaccccacccaccc

SEQ ID NO: 53358 - RNA, 20 nt, Human
agcaaacuggcaaaaucaca

SEQ ID NO: 53359 - RNA, 30 nt, Human; identical to SEQ ID NO: 7527

SEQ ID NO: 53360 - RNA, 23 nt, Human
ccuuucagaaccaaacacaugcc

SEQ ID NO: 53361 - RNA, 22 nt, Human
uccauucuuugcuccaauguca

SEQ ID NO: 53362 - RNA, 22 nt, Human
ugauucuguaaugagcacagca

SEQ ID NO: 53363 - RNA, 22 nt, Human
ccaggugucaggaaacagacua

SEQ ID NO: 53364 - RNA, 22 nt, Human
uuuugaaucacuaauauuuuca

SEQ ID NO: 53365 - RNA, 18 nt, Human
guuuaaauuaccuagcua

SEQ ID NO: 53366 - RNA, 27 nt, Human
gggagggagagaccggagcagcgccag

SEQ ID NO: 53367 - RNA, 22 nt, Human
aagggaccaagcuaaauuugua

SEQ ID NO: 53368 - RNA, 22 nt, Human
gccuuuccacaaccucuaccuu

SEQ ID NO: 53369 - RNA, 17 nt, Human
aggggaggggacagugc

SEQ ID NO: 53370 - RNA, 30 nt, Human
ugcugaauauacagcaggugcucaauaaau

SEQ ID NO: 53371 - RNA, 25 nt, Human
uggugacucaugccuguaaucccag

SEQ ID NO: 53372 - RNA, 26 nt, Human
ccuccuuccugucaugcucccuccag

SEQ ID NO: 53373 - RNA, 21 nt, Human
aggaccaccuggauucauuca

SEQ ID NO: 53374 - RNA, 26 nt, Human
agucccuuccccaugcuuccuugccu

SEQ ID NO: 53375 - RNA, 23 nt, Human
gggcaugcagguacccaccucuu

SEQ ID NO: 53376 - RNA, 21 nt, Human
gugacuuccuggucaccaagg

SEQ ID NO: 53377 - RNA, 26 nt, Human
cuguggugaggucacuagauucuacu

SEQ ID NO: 53378 - RNA, 24 nt, Human
gauuuuugauugcuuuuguauuua

SEQ ID NO: 53379 - RNA, 22 nt, Human
ugcccuggggacaggaaggagc

SEQ ID NO: 53380 - RNA, 21 nt, Human
augucggcacuuugcuggggc

SEQ ID NO: 53381 - RNA, 24 nt, Human
acugcugcuuaguuuuuggacuga

SEQ ID NO: 53382 - RNA, 24 nt, Human
gugauuuuggucugucacacugua

SEQ ID NO: 53383 - RNA, 25 nt, Human
ccuccuucauucaaacugcaucacc

SEQ ID NO: 53384 - RNA, 19 nt, Human
ucaguauaaaaacuguaca

SEQ ID NO: 53385 - RNA, 22 nt, Human
agcaguuugagaagcuaaggca

SEQ ID NO: 53386 - RNA, 22 nt, Human
caggcuguguggaaacagcugc

SEQ ID NO: 53387 - RNA, 21 nt, Human
agaggagagggaggccgcgga

SEQ ID NO: 53388 - RNA, 24 nt, Human
cucucccuggcugccucaggcuuc

SEQ ID NO: 53389 - RNA, 24 nt, Human
gaaggacaggauacuuuguggaaa

SEQ ID NO: 53390 - RNA, 23 nt, Human
cgcagccaaguagguucauccuu

SEQ ID NO: 53391 - RNA, 23 nt, Human
uguugcccaggcaagagugcagu

SEQ ID NO: 53392 - RNA, 20 nt, Human
acaucugcuuuggcuuugcc

SEQ ID NO: 53393 - RNA, 26 nt, Human
aagagggagaagcaugaaaaagcagc

SEQ ID NO: 53394 - RNA, 21 nt, Human
uuuaaaagcauauaccaccuu

SEQ ID NO: 53395 - RNA, 27 nt, Human
gccccuggcuggccgaggagacuggcu

SEQ ID NO: 53396 - RNA, 21 nt, Human
ggaaagcuuuuagcacaguau

SEQ ID NO: 53397 - RNA, 22 nt, Human
gcgugagccacugugccuggcc

SEQ ID NO: 53398 - RNA, 22 nt, Human
augccuguaaucccagcacuuu

SEQ ID NO: 53399 - RNA, 22 nt, Human
gugccugugaucccagcacuuu

SEQ ID NO: 53400 - RNA, 23 nt, Human
cugggagaaccucuuuuucuccc

SEQ ID NO: 53401 - RNA, 21 nt, Human
ccggcaccgcagccaccugcu

SEQ ID NO: 53402 - RNA, 24 nt, Human
cuugucaggacaacugccugcugc

SEQ ID NO: 53403 - RNA, 22 nt, Human
aucugaaaguauauuuuccucc

SEQ ID NO: 53404 - RNA, 25 nt, Human
auugcgccacugcaguccgcagucu

SEQ ID NO: 53405 - RNA, 21 nt, Human
uguuguccaagccaccgucuu

SEQ ID NO: 53406 - RNA, 20 nt, Human
gacugggucaaagugaagga

SEQ ID NO: 53407 - RNA, 22 nt, Human
agaaauuuuuauuuuucuaagg

SEQ ID NO: 53408 - RNA, 19 nt, Human
cccaagcuggagugcagug

SEQ ID NO: 53409 - RNA, 22 nt, Human
uccagcaccaaaucuuugcuua

SEQ ID NO: 53410 - RNA, 22 nt, Human
uucaaaugauucuccugccuca

SEQ ID NO: 53411 - RNA, 25 nt, Human
uuuccaaugcaucuucuacccugcu

SEQ ID NO: 53412 - RNA, 19 nt, Human
gugccccucauccuuuuca

SEQ ID NO: 53413 - RNA, 27 nt, Human
gacagggcagagcaggaaggacaggaa

SEQ ID NO: 53414 - RNA, 27 nt, Human
ucagcauccucauccggccucuguuug

SEQ ID NO: 53415 - RNA, 28 nt, Human
ggcuacacugcaacuuccguccagugcu

SEQ ID NO: 53416 - RNA, 28 nt, Human
gcauccuccuuuccuccuccuccucaca

SEQ ID NO: 53417 - RNA, 21 nt, Human
uucaacauuagacuuaccuua

SEQ ID NO: 53418 - RNA, 19 nt, Human
uacugugcccagccugcaa

SEQ ID NO: 53419 - RNA, 21 nt, Human
ccuuugcugcugaccucggcu

SEQ ID NO: 53420 - RNA, 21 nt, Human
cagaccuccccagugcagccu

SEQ ID NO: 53421 - RNA, 26 nt, Human
gccuugggauuaauaaacaugcacug

SEQ ID NO: 53422 - RNA, 22 nt, Human
agcucuuuaacugcuguccuca

SEQ ID NO: 53423 - RNA, 22 nt, Human
ccaauauggugaaaccacgucu

SEQ ID NO: 53424 - RNA, 20 nt, Human
ugcagcucgggcagagccgc

SEQ ID NO: 53425 - RNA, 26 nt, Human
ggagaauuggccagagccuguggccc

SEQ ID NO: 53426 - RNA, 26 nt, Human
accccuucccucaucaggcacaccca

SEQ ID NO: 53427 - RNA, 19 nt, Human
auuucucccagcucuagac

SEQ ID NO: 53428 - RNA, 27 nt, Human
uugaggcaugacuaaugcuuuuuagaa

SEQ ID NO: 53429 - RNA, 22 nt, Human
ucucccaggcuggaggucagug

SEQ ID NO: 53430 - RNA, 24 nt, Human
ggccuugagcgccuggugugggag

SEQ ID NO: 53431 - RNA, 25 nt, Human
uucaguaggauucaauucaaugugg

SEQ ID NO: 53432 - RNA, 22 nt, Human
uggaagacaaauacacauacau

SEQ ID NO: 53433 - RNA, 21 nt, Human
uuacuguuucucaaguguuuu

SEQ ID NO: 53434 - RNA, 25 nt, Human
uguuguguaaauauucuauuuuauu

SEQ ID NO: 53435 - RNA, 27 nt, Human
ugccuguaaaguaguauuuuugaucac

SEQ ID NO: 53436 - RNA, 22 nt, Human
augccugcaauuccagcacuuu

SEQ ID NO: 53437 - RNA, 20 nt, Human
aauggcuggacauggguggg

SEQ ID NO: 53438 - RNA, 22 nt, Human
ucucucucuuucaugcaguuca

SEQ ID NO: 53439 - RNA, 19 nt, Human
uacucugcucccucacugc

SEQ ID NO: 53440 - RNA, 21 nt, Human
aucuuuuggcuucccugggcc

SEQ ID NO: 53441 - RNA, 24 nt, Human
agguguucauuauaaucuguauug

SEQ ID NO: 53442 - RNA, 25 nt, Human
cugccugucucuaguuucucucaca

SEQ ID NO: 53443 - RNA, 21 nt, Human
caugugcuugguacaaaaagg

SEQ ID NO: 53444 - RNA, 22 nt, Human
gcugacacagauggucaccucc

SEQ ID NO: 53445 - RNA, 22 nt, Human
caaacuccugaccucaggcaau

SEQ ID NO: 53446 - RNA, 22 nt, Human
agaacaucccagacagauggga

SEQ ID NO: 53447 - RNA, 22 nt, Human
ccgucaccccacacaggcugcg

SEQ ID NO: 53448 - RNA, 22 nt, Human
ucugggcccagcuguguacagc

SEQ ID NO: 53449 - RNA, 22 nt, Human
acccggggcccgcuugccucag

SEQ ID NO: 53450 - RNA, 20 nt, Human
uuaguaaugaauguaaugag

SEQ ID NO: 53451 - RNA, 27 nt, Human
auguaaacaaagauaucuuugcuuuaa

SEQ ID NO: 53452 - RNA, 22 nt, Human
ugucuccuaagcuggagugcag

SEQ ID NO: 53453 - RNA, 22 nt, Human
caagaucauaccacugcacugc

SEQ ID NO: 53454 - RNA, 21 nt, Human
ccccagcugcuucgggcugcc

SEQ ID NO: 53455 - RNA, 19 nt, Human
cccggcgaccgcuccccag

SEQ ID NO: 53456 - RNA, 26 nt, Human
uguggaccaguucccucagcccucau

SEQ ID NO: 53457 - RNA, 22 nt, Human
ugguugggacccaguggcaggg

SEQ ID NO: 53458 - RNA, 18 nt, Human
uuucauuuuguggcuuac

SEQ ID NO: 53459 - RNA, 26 nt, Human
auggcagggauaugcagggcacuuuu

SEQ ID NO: 53460 - RNA, 27 nt, Human
gaccagccugggaaacauaacaagacc

SEQ ID NO: 53461 - RNA, 27 nt, Human
cccccuggcgcugaggcugcuccggcc

SEQ ID NO: 53462 - RNA, 23 nt, Human
gugaccucugcugggucacagcc

SEQ ID NO: 53463 - RNA, 18 nt, Human
gagccuugcaucucucca

SEQ ID NO: 53464 - RNA, 21 nt, Human
gaguacuggaauaaacaguga

SEQ ID NO: 53465 - RNA, 21 nt, Human
aauaacugcaugugucugguc

SEQ ID NO: 53466 - RNA, 23 nt, Human
gaggaagacuuugguauggagca

SEQ ID NO: 53467 - RNA, 20 nt, Human
cggggaggaggcugccggag

SEQ ID NO: 53468 - RNA, 23 nt, Human
caccggcgaaccugccugggcag

SEQ ID NO: 53469 - RNA, 23 nt, Human
cuugccugccucccugccucugg

SEQ ID NO: 53470 - RNA, 23 nt, Human
ugcugcaucuccccucagauucc

SEQ ID NO: 53471 - RNA, 22 nt, Human
acccaggcuggagugcagugac

SEQ ID NO: 53472 - RNA, 22 nt, Human
acccaggcuggaaugcaguggc

SEQ ID NO: 53473 - RNA, 21 nt, Human
uuccaaauguacuguuaaaua

SEQ ID NO: 53474 - RNA, 24 nt, Human
uuugaggcuuucagguuuuaguuu

SEQ ID NO: 53475 - RNA, 22 nt, Human
gcucugaacaagaccuuuucgu

SEQ ID NO: 53476 - RNA, 26 nt, Human
uuauuuuauaaucagaagaaaaggaa

SEQ ID NO: 53477 - RNA, 22 nt, Human
ccuucuuucucccucuugaguc

SEQ ID NO: 53478 - RNA, 19 nt, Human
uaucaguccccuucacugc

SEQ ID NO: 53479 - RNA, 22 nt, Human
guaaagguuuagacgaaacccc

SEQ ID NO: 53480 - RNA, 25 nt, Human
ucucguuucuccucuuuccuccugc

SEQ ID NO: 53481 - RNA, 22 nt, Human
aaucuuaagacuaacaaauccu

SEQ ID NO: 53482 - RNA, 22 nt, Human
cacccaggcuguggugcaguaa

SEQ ID NO: 53483 - RNA, 24 nt, Human
caucuauuuuuguuugggaagagg

SEQ ID NO: 53484 - RNA, 24 nt, Human
uucuugggcaucucccggaaagug

SEQ ID NO: 53485 - RNA, 19 nt, Human
uucaacaccuuccugcuau

SEQ ID NO: 53486 - RNA, 21 nt, Human
cagugcagcagaggacagucu

SEQ ID NO: 53487 - RNA, 23 nt, Human
ugcucagagugaagagugaagag

SEQ ID NO: 53488 - RNA, 21 nt, Human
caggaggugcugcuuucugug

SEQ ID NO: 53489 - RNA, 21 nt, Human
aagugcugggauuauaggcgu

SEQ ID NO: 53490 - RNA, 22 nt, Human
ucacauuagaagacaauugaca

SEQ ID NO: 53491 - RNA, 22 nt, Human
agucugcugcaucuucuaccuc

SEQ ID NO: 53492 - RNA, 25 nt, Human
ccagaagcauuacccauaggucuua

SEQ ID NO: 53493 - RNA, 21 nt, Human
ggaggcugggggaaaagguua

SEQ ID NO: 53494 - RNA, 16 nt, Human
ucaauaaaaaucuuug

SEQ ID NO: 53495 - RNA, 27 nt, Human
cuacagcacuccaccuugggaccuguu

SEQ ID NO: 53496 - RNA, 19 nt, Human
cccugaccccacuggacca

SEQ ID NO: 53497 - RNA, 21 nt, Human
gcugugcccucuccauuccac

SEQ ID NO: 53498 - RNA, 27 nt, Human
accauuuuaaaccguuggcaauaaaga

SEQ ID NO: 53499 - RNA, 22 nt, Human
agagaggcguccugggugaagg

SEQ ID NO: 53500 - RNA, 24 nt, Human
acaucuauggugucccaggcacag

SEQ ID NO: 53501 - RNA, 24 nt, Human
gagaccugagucugcaugugcacg

SEQ ID NO: 53502 - RNA, 21 nt, Human
agcagauccuguauuugcugg

SEQ ID NO: 53503 - RNA, 20 nt, Human
auucuaugcugauuagcuuc

SEQ ID NO: 53504 - RNA, 25 nt, Human
acaagcuaguuuucaaauuuugugu

SEQ ID NO: 53505 - RNA, 22 nt, Human
cccuuugguaggugcaccugag

SEQ ID NO: 53506 - RNA, 27 nt, Human
ugacaaguguggagaaacuccuaauuu

SEQ ID NO: 53507 - RNA, 20 nt, Human
uccugaggaggcggcggcag

SEQ ID NO: 53508 - RNA, 21 nt, Human
ccccuuaaaaugaguucuaga

SEQ ID NO: 53509 - RNA, 20 nt, Human
gacuuccucuccagccuucu

SEQ ID NO: 53510 - RNA, 21 nt, Human
ugaaauugcauguuuaucaua

SEQ ID NO: 53511 - RNA, 23 nt, Human
caaacauaagugggaaccaaaga

SEQ ID NO: 53512 - RNA, 28 nt, Human
cuuguccucccuuccgucuucucccuca

SEQ ID NO: 53513 - RNA, 26 nt, Human
aguaaaacacauuugggauguuccuu

SEQ ID NO: 53514 - RNA, 23 nt, Human
gucacccaggcugaagugcagug

SEQ ID NO: 53515 - RNA, 22 nt, Human
caggcuggagugcaguggcgag

SEQ ID NO: 53516 - RNA, 25 nt, Human
aucacuggugugauaaaccccauuu

SEQ ID NO: 53517 - RNA, 27 nt, Human
ccgucauccaggcuggacaguucagug

SEQ ID NO: 53518 - RNA, 22 nt, Human
uugggcaccagcuucuuucucg

SEQ ID NO: 53519 - RNA, 26 nt, Human
gacucagcaacuuucccuugcccugg

SEQ ID NO: 53520 - RNA, 25 nt, Human
acacuggucuagccucagaguaacc

SEQ ID NO: 53521 - RNA, 23 nt, Human
accuacucuuucaguuuucuggc

SEQ ID NO: 53522 - RNA, 22 nt, Human
uucaugagcugaggcgugggcc

SEQ ID NO: 53523 - RNA, 23 nt, Human
uauuuuagcaaacucagcucuuc

SEQ ID NO: 53524 - RNA, 27 nt, Human
gacuucugcuuugcacugcccugcagg

SEQ ID NO: 53525 - RNA, 21 nt, Human
agcucccgaacccuguccuuu

SEQ ID NO: 53526 - RNA, 22 nt, Human
gcuaucaaaauaaauugaaaua

SEQ ID NO: 53527 - RNA, 21 nt, Human
gagacagugacuggugccagu

SEQ ID NO: 53528 - RNA, 22 nt, Human
aggcggguggaucacgagguca

SEQ ID NO: 53529 - RNA, 27 nt, Human
cacugcacuccaaccugggaaacgcag

SEQ ID NO: 53530 - RNA, 22 nt, Human
gggcccccuguccucagcacau

SEQ ID NO: 53531 - RNA, 25 nt, Human
uccaacuggaaggcuuuauucuucc

SEQ ID NO: 53532 - RNA, 29 nt, Human
gaaaguagaucauguucacugcaaugcug

SEQ ID NO: 53533 - RNA, 21 nt, Human
ggacacaucugacauccugug

SEQ ID NO: 53534 - RNA, 22 nt, Human
ucccuuuccccaccucuuacag

SEQ ID NO: 53535 - RNA, 27 nt, Human
ggucucgaacuccugaccucaugaucu

SEQ ID NO: 53536 - RNA, 26 nt, Human
gcaugcuggggagugcggucagcucc

SEQ ID NO: 53537 - RNA, 20 nt, Human
cacugcaccuggccugacau

SEQ ID NO: 53538 - RNA, 24 nt, Human
ugugcagaucuuaaucaucccagu

SEQ ID NO: 53539 - RNA, 24 nt, Human
cuagaugucacaagggacuccuuu

SEQ ID NO: 53540 - RNA, 23 nt, Human
gcaaauauuauuuucuucauaca

SEQ ID NO: 53541 - RNA, 27 nt, Human
cuguuccugcugauugcuuuuuaagcu

SEQ ID NO: 53542 - RNA, 23 nt, Human
gagacauccuuucugaauacuuc

SEQ ID NO: 53543 - RNA, 23 nt, Human
guugcccaggcugcagugcagug

SEQ ID NO: 53544 - RNA, 21 nt, Human
aucccucuuugcacagcauga

SEQ ID NO: 53545 - RNA, 24 nt, Human
gcccagccugggacccucugggcu

SEQ ID NO: 53546 - RNA, 21 nt, Human
ugaugucugagccacucagaa

SEQ ID NO: 53547 - RNA, 21 nt, Human
cccuuuccacuacgggugggu

SEQ ID NO: 53548 - RNA, 27 nt, Human
gugagccagaaaccagggcuucccuac

SEQ ID NO: 53549 - RNA, 23 nt, Human
agaaauuucaugauuuugcagug

SEQ ID NO: 53550 - RNA, 21 nt, Human
aacuuccugcuuccucagagg

SEQ ID NO: 53551 - RNA, 20 nt, Human
caaaccucccuuccccagca

SEQ ID NO: 53552 - RNA, 22 nt, Human
aaaguguucaccacuaaagcua

SEQ ID NO: 53553 - RNA, 20 nt, Human
aguguucuaguccacauaua

SEQ ID NO: 53554 - RNA, 23 nt, Human
gcagggauggggacagggugggu

SEQ ID NO: 53555 - RNA, 27 nt, Human
ugcccagccuguggagagacccugcaa

SEQ ID NO: 53556 - RNA, 26 nt, Human
agccaggccuggaauauucaguuucc

SEQ ID NO: 53557 - RNA, 26 nt, Human
ucccuggggggugacccccaaggaaa

SEQ ID NO: 53558 - RNA, 20 nt, Human
gcacaagcucagguccugcu

SEQ ID NO: 53559 - RNA, 20 nt, Human
uuucucuaacuccugccauu

SEQ ID NO: 53560 - RNA, 22 nt, Human
gccugagccacugugcccagcc

SEQ ID NO: 53561 - RNA, 22 nt, Human
auguccccacugggccugaguc

SEQ ID NO: 53562 - RNA, 24 nt, Human
ggagagagggacgcgggcugcagg

SEQ ID NO: 53563 - RNA, 23 nt, Human
ccuccacuuccugcuuuagcccc

SEQ ID NO: 53564 - RNA, 26 nt, Human
ccaagucucaguggcuucaucuguca

SEQ ID NO: 53565 - RNA, 32 nt, Human
gggguggggugagguuaaccucauuguugucu

SEQ ID NO: 53566 - RNA, 22 nt, Human
agcugggaaguggggugacaua

SEQ ID NO: 53567 - RNA, 19 nt, Human
ccaggaggucaaggcuuca

SEQ ID NO: 53568 - RNA, 25 nt, Human
ugugugaauuccugcuccucaugcu

SEQ ID NO: 53569 - RNA, 22 nt, Human
uucaguauuucaguauucuaga

SEQ ID NO: 53570 - RNA, 21 nt, Human
accccuucaaauccuuacucu

SEQ ID NO: 53571 - RNA, 27 nt, Human
uggagaaaugguccgcuuuccuggagc

SEQ ID NO: 53572 - RNA, 21 nt, Human
auggugagccgugauugugcc

SEQ ID NO: 53573 - RNA, 23 nt, Human
uauaagcuuugagagcaacguca

SEQ ID NO: 53574 - RNA, 24 nt, Human
gcaucuuucccugcccuccccugu

SEQ ID NO: 53575 - RNA, 26 nt, Human
ggugcaaucacagcucacugcagccu

SEQ ID NO: 53576 - RNA, 23 nt, Human
gaacccaugcugaucuccaggga

SEQ ID NO: 53577 - RNA, 18 nt, Human
agcuuccucugugccucc

SEQ ID NO: 53578 - RNA, 25 nt, Human
ucucagccucccacaauuaaaccgc

SEQ ID NO: 53579 - RNA, 21 nt, Human
aggcagcaaggaccagaggaa

SEQ ID NO: 53580 - RNA, 26 nt, Human
cucuccaucuuccacgaaaugggcca

SEQ ID NO: 53581 - RNA, 22 nt, Human
aggcugaggugguuguauugcu

SEQ ID NO: 53582 - RNA, 22 nt, Human
ggcuaacuuuuguauuuuuagu

SEQ ID NO: 53583 - RNA, 22 nt, Human
uaaagaagaaaagcgcguugug

SEQ ID NO: 53584 - RNA, 25 nt, Human
cagucgguccggcgugucacaggug

SEQ ID NO: 53585 - RNA, 27 nt, Human
cgguucugcagcacuaggggagggggc

SEQ ID NO: 53586 - RNA, 24 nt, Human
cugaaaacauguuuguugcuuuuu

SEQ ID NO: 53587 - RNA, 22 nt, Human
gccuggguccuggugccuugga

SEQ ID NO: 53588 - RNA, 27 nt, Human
ggcauuuuccuaccuuccuguaacgac

SEQ ID NO: 53589 - RNA, 22 nt, Human
ccaggcuaauuuuuugaaauuu

SEQ ID NO: 53590 - RNA, 22 nt, Human
aaucggcgacggagcacugcac

SEQ ID NO: 53591 - RNA, 32 nt, Human
agcccauagcacugggcucugauggcugcucc

SEQ ID NO: 53592 - RNA, 22 nt, Human
cgaacuucugagcucaagcgau

SEQ ID NO: 53593 - RNA, 25 nt, Human
uuugcacuuccuuccuaaucuuggu

SEQ ID NO: 53594 - RNA, 22 nt, Human
cuguaaucccagcuacguggga

SEQ ID NO: 53595 - RNA, 23 nt, Human
ugagccaggagacagaagcugug

SEQ ID NO: 53596 - RNA, 26 nt, Human
ugccuaaacagucuuucuguugguua

SEQ ID NO: 53597 - RNA, 22 nt, Human
gcuuuacugcugagcuccugcu

SEQ ID NO: 53598 - RNA, 22 nt, Human
aauuacaggcgugagcuacugu

SEQ ID NO: 53599 - RNA, 27 nt, Human
ugccuuuguccagggagaguccuggcc

SEQ ID NO: 53600 - RNA, 21 nt, Human
uuuuauacugagugugccuag

SEQ ID NO: 53601 - RNA, 27 nt, Human
uccugcucuuccccgacuaggcgggca

SEQ ID NO: 53602 - RNA, 27 nt, Human
uggucucaaacuccuaaccuugugauc

SEQ ID NO: 53603 - RNA, 25 nt, Human
uauuaaaaugaaaugauacuuaaac

SEQ ID NO: 53604 - RNA, 23 nt, Human
uuagugguuguaucugcuuugaa

SEQ ID NO: 53605 - RNA, 23 nt, Human
gagcuugcuucuuucuugcuuug

SEQ ID NO: 53606 - RNA, 23 nt, Human
cagcauuucaagcgucacuuuau

SEQ ID NO: 53607 - RNA, 27 nt, Human
aaacuauuuaacuugagcuuuaaaaau

SEQ ID NO: 53608 - RNA, 24 nt, Human
uacuccucugcgugagugcgugug

SEQ ID NO: 53609 - RNA, 27 nt, Human
guccuccaggcuguaggggaggagagc

SEQ ID NO: 53610 - RNA, 22 nt, Human
gccagaacccacacccggcccc

SEQ ID NO: 53611 - RNA, 25 nt, Human
agcacuuuguucacuguccuguguc

SEQ ID NO: 53612 - RNA, 22 nt, Human
gccagaacccagauuuccuaac

SEQ ID NO: 53613 - RNA, 22 nt, Human
ccacccaggcagggagcaagug

SEQ ID NO: 53614 - RNA, 27 nt, Human
cuguguuuuccaggaauccaacugagc

SEQ ID NO: 53615 - RNA, 21 nt, Human
ugugggugccaucucuaccuc

SEQ ID NO: 53616 - RNA, 26 nt, Human
cugccucuggccgcggccugugggau

SEQ ID NO: 53617 - RNA, 18 nt, Human
gcauggucacaagcacaa

SEQ ID NO: 53618 - RNA, 22 nt, Human
ccagucaugugugcaucauguc

SEQ ID NO: 53619 - RNA, 18 nt, Human
ucuguucuguugauccca

SEQ ID NO: 53620 - RNA, 23 nt, Human
ugaguagcugggauuacaggugu

SEQ ID NO: 53621 - RNA, 23 nt, Human
ccguaccucuccuggcccccuca

SEQ ID NO: 53622 - RNA, 21 nt, Human
cugccucugauguauuuugug

SEQ ID NO: 53623 - RNA, 24 nt, Human
ccagggacucaaaauuccaaaaag

SEQ ID NO: 53624 - RNA, 21 nt, Human
gccagcaccaccccauccgca

SEQ ID NO: 53625 - RNA, 24 nt, Human
ccaugagagccucagcacucugaa

SEQ ID NO: 53626 - RNA, 23 nt, Human
cacaggacucugcugcagagggg

SEQ ID NO: 53627 - RNA, 27 nt, Human
uccuccaggccgucagccugaugcaua

SEQ ID NO: 53628 - RNA, 20 nt, Human
ucuucauuauucucugcuau

SEQ ID NO: 53629 - RNA, 21 nt, Human
aaaccuuucuucaccaaaucu

SEQ ID NO: 53630 - RNA, 22 nt, Human
acucacugcauuuggggccuuu

SEQ ID NO: 53631 - RNA, 22 nt, Human
gugguucuauguccauucucau

SEQ ID NO: 53632 - RNA, 27 nt, Human
cagguuggagugcaguggcgugaucuc

SEQ ID NO: 53633 - RNA, 27 nt, Human
cagacuggagugcaguggcacgaucuc

SEQ ID NO: 53634 - RNA, 27 nt, Human
cagguuggagugcaguggugugaucuu

SEQ ID NO: 53635 - RNA, 20 nt, Human
uccagagcugcuauuagaag

SEQ ID NO: 53636 - RNA, 23 nt, Human
gagauggucagcguggagcgcaa

SEQ ID NO: 53637 - RNA, 22 nt, Human
gcuguugcuacugcgucucucu

SEQ ID NO: 53638 - RNA, 27 nt, Human
ccugcuguaaauuuggcuucuguuguc

SEQ ID NO: 53639 - RNA, 22 nt, Human
gaccaucuuugccaacauggug

SEQ ID NO: 53640 - RNA, 24 nt, Human
caagaucuagcaccucugccagug

SEQ ID NO: 53641 - RNA, 20 nt, Human
ucaggugccaacccaaaaau

SEQ ID NO: 53642 - RNA, 21 nt, Human
aagaucugaagugugaguaga

SEQ ID NO: 53643 - RNA, 20 nt, Human
acccaugcaagagccugguu

SEQ ID NO: 53644 - RNA, 20 nt, Human
ggggugaggaaagaggagac

SEQ ID NO: 53645 - RNA, 27 nt, Human
ucuauuguuggaagucuuugguauaug

SEQ ID NO: 53646 - RNA, 23 nt, Human
cccuccucucuuugcauuuccuc

SEQ ID NO: 53647 - RNA, 22 nt, Human
ucuuucauagguguccaucuug

SEQ ID NO: 53648 - RNA, 21 nt, Human
ugggccgccucuccuccaucu

SEQ ID NO: 53649 - RNA, 21 nt, Human
agaagcugcagcaagagguac

SEQ ID NO: 53650 - RNA, 24 nt, Human
cauaucccaauacguguagggcga

SEQ ID NO: 53651 - RNA, 18 nt, Human
cuccaccuugcucccucc

SEQ ID NO: 53652 - RNA, 18 nt, Human
ugucuugaugugucaucu

SEQ ID NO: 53653 - RNA, 26 nt, Human
caugguccuggcuggaagguacugaa

SEQ ID NO: 53654 - RNA, 28 nt, Human
caggcauggcaagguugcauauguaaua

SEQ ID NO: 53655 - RNA, 26 nt, Human
aaagucugcuuuugcuauucuuuuug

SEQ ID NO: 53656 - RNA, 26 nt, Human
cuuuacuggguucuaaaugcucucug

SEQ ID NO: 53657 - RNA, 23 nt, Human
ccuguccucgcccugccuccugc

SEQ ID NO: 53658 - RNA, 22 nt, Human
gcuagggggcagguggggaggg

SEQ ID NO: 53659 - RNA, 26 nt, Human
gcccagccugugcuccccgggcugcu

SEQ ID NO: 53660 - RNA, 18 nt, Human
caggagguguugcaguga

SEQ ID NO: 53661 - RNA, 22 nt, Human
cugagcauccaucccagaucug

SEQ ID NO: 53662 - RNA, 20 nt, Human
ugaagaagaagcuaacuggg

SEQ ID NO: 53663 - RNA, 23 nt, Human
uaaagguuucauguucacuguga

SEQ ID NO: 53664 - RNA, 28 nt, Human
uuucaccaccucccuccccaccccccaa

SEQ ID NO: 53665 - RNA, 27 nt, Human
ggcaacuuuggagaggcgagcagcagc

SEQ ID NO: 53666 - RNA, 21 nt, Human
ucugcugcugccauccuccag

SEQ ID NO: 53667 - RNA, 23 nt, Human
caguuacagacauuucugucuca

SEQ ID NO: 53668 - RNA, 25 nt, Human
acccaggcuggagugcaguggcaua

SEQ ID NO: 53669 - RNA, 22 nt, Human
gaguuuuuuguuugucuugaga

SEQ ID NO: 53670 - RNA, 22 nt, Human
aaugcugaugaaaacugucaag

SEQ ID NO: 53671 - RNA, 22 nt, Human
aaaaagagaagaaaccccggua

SEQ ID NO: 53672 - RNA, 23 nt, Human
uuucuguuggugcuagcuacugg

SEQ ID NO: 53673 - RNA, 18 nt, Human
uguuacgagaaugcaguu

SEQ ID NO: 53674 - RNA, 20 nt, Human
aggguucucuucugugucuu

SEQ ID NO: 53675 - RNA, 22 nt, Human
cugaagcuggcggaucgcuuga

SEQ ID NO: 53676 - RNA, 23 nt, Human
ccuguuccaugaaggcagagcca

SEQ ID NO: 53677 - RNA, 20 nt, Human
cucaggacugcacagaggag

SEQ ID NO: 53678 - RNA, 20 nt, Human
aaauacuguggacacuuaaa

SEQ ID NO: 53679 - RNA, 28 nt, Human
ugcauaccagguuuuacacuugcaucuc

SEQ ID NO: 53680 - RNA, 23 nt, Human
cccucgugucuauuuuccagaaa

SEQ ID NO: 53681 - RNA, 22 nt, Human
ugagcauguaauaacuaauaaa

SEQ ID NO: 53682 - RNA, 31 nt, Human
cuggcuuugugggcagccugccuggcccgca

SEQ ID NO: 53683 - RNA, 19 nt, Human
cacccaugggggcggggga

SEQ ID NO: 53684 - RNA, 26 nt, Human
agggcaggcaggcugcagggagccaa

SEQ ID NO: 53685 - RNA, 27 nt, Human
uuuuguuuuuauuuucaagagggcaag

SEQ ID NO: 53686 - RNA, 21 nt, Human
uauucauaaguuuuacaauca

SEQ ID NO: 53687 - RNA, 21 nt, Human
gaucacauccccugucuacuc

SEQ ID NO: 53688 - RNA, 27 nt, Human
gcugcccagguccuggggugguggcag

SEQ ID NO: 53689 - RNA, 20 nt, Human
ugguccuggaggaguuccgu

SEQ ID NO: 53690 - RNA, 25 nt, Human
uaauccuuccucuaggagaagagca

SEQ ID NO: 53691 - RNA, 27 nt, Human
uuugcugcugugaaucccaccugccac

SEQ ID NO: 53692 - RNA, 21 nt, Human
cgggcagcagcgccgcggccc

SEQ ID NO: 53693 - RNA, 23 nt, Human
uggaaacaugggcugaaaaugaa

SEQ ID NO: 53694 - RNA, 23 nt, Human
aucuacucucaaaaaauucagaa

SEQ ID NO: 53695 - RNA, 27 nt, Human
cggaaggcagggauguugaaguauccc

SEQ ID NO: 53696 - RNA, 27 nt, Human
caaacucaggagaacauaagccugcuc

SEQ ID NO: 53697 - RNA, 22 nt, Human
caagaucacaccauugcacucc

SEQ ID NO: 53698 - RNA, 22 nt, Human
ugagaucgugccauuacacucc

SEQ ID NO: 53699 - RNA, 25 nt, Human
cugccgcccaaacuggagugcagug

SEQ ID NO: 53700 - RNA, 22 nt, Human
cccucugccucccauuucugcc

SEQ ID NO: 53701 - RNA, 25 nt, Human
ugguagcacauaccuguaaucccag

SEQ ID NO: 53702 - RNA, 20 nt, Human
gagauagugccagggugcgg

SEQ ID NO: 53703 - RNA, 23 nt, Human
gacucauguuucugcuaugacca

SEQ ID NO: 53704 - RNA, 22 nt, Human
aaagaacaaggaaaaauggaug

SEQ ID NO: 53705 - RNA, 27 nt, Human
cuugggaggcugagacaggagaaucgc

SEQ ID NO: 53706 - RNA, 19 nt, Human
gaccuuggccaugaccuua

SEQ ID NO: 53707 - RNA, 22 nt, Human
cacgaggucaagagaucaagac

SEQ ID NO: 53708 - RNA, 18 nt, Human
ugagcuggaaugaugauu

SEQ ID NO: 53709 - RNA, 22 nt, Human
ccagguuuuauuuuucaccuua

SEQ ID NO: 53710 - RNA, 24 nt, Human
gugguuaucaugcaguugcaguga

SEQ ID NO: 53711 - RNA, 21 nt, Human
uuggaggaggucaagagagag

SEQ ID NO: 53712 - RNA, 21 nt, Human
guuuuuguguccugccaggca

SEQ ID NO: 53713 - RNA, 19 nt, Human
agcugccuccagccuggug

SEQ ID NO: 53714 - RNA, 27 nt, Human
ucacccagcaaacggcccugggccagg

SEQ ID NO: 53715 - RNA, 23 nt, Human
gugagggcugggggcauccaggc

SEQ ID NO: 53716 - RNA, 27 nt, Human
caggcagcaaggaccagaggaaggugg

SEQ ID NO: 53717 - RNA, 23 nt, Human
ccaaaaagcaaccaacuuagcca

SEQ ID NO: 53718 - RNA, 21 nt, Human
gagguucccuugugagcuuga

SEQ ID NO: 53719 - RNA, 18 nt, Human
cccuugcccaggcaagga

SEQ ID NO: 53720 - RNA, 21 nt, Human
gugugagguccaggguugcua

SEQ ID NO: 53721 - RNA, 26 nt, Human
aggguccaaacaaaauagagcuaaga

SEQ ID NO: 53722 - RNA, 21 nt, Human
ucucccaccugguuaccacag

SEQ ID NO: 53723 - RNA, 22 nt, Human
gugagcccugagauccuccucc

SEQ ID NO: 53724 - RNA, 27 nt, Human
uucacauucuuauuguaaccuuccuca

SEQ ID NO: 53725 - RNA, 24 nt, Human
uguacacacaagggccaggcucca

SEQ ID NO: 53726 - RNA, 19 nt, Human
cgcgcggagcggugcaaug

SEQ ID NO: 53727 - RNA, 22 nt, Human
accucuuucucguuuguggaca

SEQ ID NO: 53728 - RNA, 26 nt, Human
cagcaagccaugccccuggggugagg

SEQ ID NO: 53729 - RNA, 27 nt, Human
ugagaaagagagagauacaucuuauaa

SEQ ID NO: 53730 - RNA, 27 nt, Human
ccagcuccuucagguguuuguuccagc

SEQ ID NO: 53731 - RNA, 24 nt, Human
ggauugguccuacuuucuuucucu

SEQ ID NO: 53732 - RNA, 26 nt, Human
uggaggccucucaaguccaagugccu

SEQ ID NO: 53733 - RNA, 22 nt, Human
ucuccuggguguggagacagcu

SEQ ID NO: 53734 - RNA, 24 nt, Human
acauuggggucaaaggcacacauu

SEQ ID NO: 53735 - RNA, 27 nt, Human
aaguagcugggauuacaggcacgugcc

SEQ ID NO: 53736 - RNA, 21 nt, Human
gccacugcauaccagccuagg

SEQ ID NO: 53737 - RNA, 26 nt, Human
cucuaagaggcuuuuuugcugaguca

SEQ ID NO: 53738 - RNA, 20 nt, Human
aacuauauaggugcuaugua

SEQ ID NO: 53739 - RNA, 29 nt, Human
uugucagcaggcaggcuggggaggccagu

SEQ ID NO: 53740 - RNA, 25 nt, Human
cuccacuuccggacuccuggacugc

SEQ ID NO: 53741 - RNA, 22 nt, Human
ugagcuguucaauaaugacgga

SEQ ID NO: 53742 - RNA, 27 nt, Human
cugccuaauuuuuauaucuucuaagca

SEQ ID NO: 53743 - RNA, 23 nt, Human
uugucaccaggcuggagugcagu

SEQ ID NO: 53744 - RNA, 25 nt, Human
cucugccacugugcuccagcaccgu

SEQ ID NO: 53745 - RNA, 27 nt, Human
ugcuccguauagugauuguagcuguuc

SEQ ID NO: 53746 - RNA, 22 nt, Human
ccaacuuguauuucuagcagca

SEQ ID NO: 53747 - RNA, 20 nt, Human
aaagugauccgccaagcagg

SEQ ID NO: 53748 - RNA, 21 nt, Human
cgagaugccagcucuggaguu

SEQ ID NO: 53749 - RNA, 19 nt, Human
ccagaaugaagguguagcc

SEQ ID NO: 53750 - RNA, 22 nt, Human
cauacagcuagugacgaaugga

SEQ ID NO: 53751 - RNA, 20 nt, Human
ucccuaaauaggaguuuaca

SEQ ID NO: 53752 - RNA, 20 nt, Human
gggacuggggagggagcuaa

SEQ ID NO: 53753 - RNA, 24 nt, Human
cuggguguggccuggcuucuggga

SEQ ID NO: 53754 - RNA, 25 nt, Human
cagccgccaggccugggguccugaa

SEQ ID NO: 53755 - RNA, 26 nt, Human
gccucuacugaauuauuccucuuuua

SEQ ID NO: 53756 - RNA, 23 nt, Human
ucuuuaccuccuuuucucuuuca

SEQ ID NO: 53757 - RNA, 22 nt, Human
aauucgguacgcacuagccaca

SEQ ID NO: 53758 - RNA, 26 nt, Human
ccagugcuuucaccagccauauuagc

SEQ ID NO: 53759 - RNA, 20 nt, Human
agcuaauuauuuacuuuugu

SEQ ID NO: 53760 - RNA, 27 nt, Human
gucucaaacuccuggccucaugugauc

SEQ ID NO: 53761 - RNA, 27 nt, Human
cagaggcuggggcauuggcaagaucac

SEQ ID NO: 53762 - RNA, 27 nt, Human
gcugacccuugaacauggggguuaggg

SEQ ID NO: 53763 - RNA, 23 nt, Human
ccugcucagagguucccuguugg

SEQ ID NO: 53764 - RNA, 21 nt, Human
caccccacuccagcuccggag

SEQ ID NO: 53765 - RNA, 25 nt, Human
auuucucuuccaauuacuguucaaa

SEQ ID NO: 53766 - RNA, 24 nt, Human
ccuggggcuugguuucccugcccu

SEQ ID NO: 53767 - RNA, 26 nt, Human
cucaaagcaccugaacaguuuaucga

SEQ ID NO: 53768 - RNA, 22 nt, Human
ccccaaaacaauuacacacaac

SEQ ID NO: 53769 - RNA, 27 nt, Human
ucugccuggggccucaccugcuggagu

SEQ ID NO: 53770 - RNA, 22 nt, Human
uuuggccucccaaaaugcuggg

SEQ ID NO: 53771 - RNA, 24 nt, Human
gacaaggggcaguggugguuuucu

SEQ ID NO: 53772 - RNA, 17 nt, Human
ggaacaacagcuaucua

SEQ ID NO: 53773 - RNA, 19 nt, Human
gcugggaggaaaagccugg

SEQ ID NO: 53774 - RNA, 23 nt, Human
uacagguugcugaaaagccagga

SEQ ID NO: 53775 - RNA, 23 nt, Human
auccucucuccccucugcaaccc

SEQ ID NO: 53776 - RNA, 20 nt, Human
cacauucauuaugcugcagu

SEQ ID NO: 53777 - RNA, 25 nt, Human
guuuuuguccuaugaacaagcagac

SEQ ID NO: 53778 - RNA, 25 nt, Human
auagguauuuccugaaaguguauac

SEQ ID NO: 53779 - RNA, 26 nt, Human
guugucugaacccaggcagcuggcag

SEQ ID NO: 53780 - RNA, 22 nt, Human
cuuaugcaaaguggaagcaagg

SEQ ID NO: 53781 - RNA, 26 nt, Human
ucucaaacuccugggcuccaacgauc

SEQ ID NO: 53782 - RNA, 21 nt, Human
uuuucuccaauaaaucaggag

SEQ ID NO: 53783 - RNA, 21 nt, Human
gcuccaccccuccuguguguc

SEQ ID NO: 53784 - RNA, 27 nt, Human
ccuccucugcucuccaucauaacugcu

SEQ ID NO: 53785 - RNA, 21 nt, Human
cccugacaagcccaccaggcc

SEQ ID NO: 53786 - RNA, 23 nt, Human
gggcaucgcucuuccucacacca

SEQ ID NO: 53787 - RNA, 26 nt, Human
cugaccaagggugguuaagugacaca

SEQ ID NO: 53788 - RNA, 23 nt, Human
agaacauugguuuagauaaauac

SEQ ID NO: 53789 - RNA, 22 nt, Human
aguauuuugucacuucuccccu

SEQ ID NO: 53790 - RNA, 26 nt, Human
uuuccuccucuuuguuuuuaaaaguu

SEQ ID NO: 53791 - RNA, 21 nt, Human
ccccagcccagggccagagcg

SEQ ID NO: 53792 - RNA, 26 nt, Human
gagcugcagaacagaacacuuucuca

SEQ ID NO: 53793 - RNA, 24 nt, Human
agcugcaagaugcacuagccggcu

SEQ ID NO: 53794 - RNA, 21 nt, Human
ugaccucaugaccacgcuggc

SEQ ID NO: 53795 - RNA, 23 nt, Human
auagugccacugcaauucagccu

SEQ ID NO: 53796 - RNA, 23 nt, Human
uaauuaguugucuaaauauuuuu

SEQ ID NO: 53797 - RNA, 19 nt, Human
cagacuccaacuuccccuc

SEQ ID NO: 53798 - RNA, 32 nt, Human
cugacucaucucugcacaaccucucugugcca

SEQ ID NO: 53799 - RNA, 24 nt, Human
ggaagcaagcggagguugcaguga

SEQ ID NO: 53800 - RNA, 20 nt, Human
cauucaaauacaucugugua

SEQ ID NO: 53801 - RNA, 23 nt, Human
cuggggcagaggggggagggagg

SEQ ID NO: 53802 - RNA, 24 nt, Human
ccacugcugccucuccaucccucu

SEQ ID NO: 53803 - RNA, 21 nt, Human
ucucaauaaauaaaaaauaau

SEQ ID NO: 53804 - RNA, 22 nt, Human
ggggaaaaggaagagagaucag

SEQ ID NO: 53805 - RNA, 21 nt, Human
cuggggggccugcugggcagg

SEQ ID NO: 53806 - RNA, 24 nt, Human
ccuuccauguucucucacccgcuu

SEQ ID NO: 53807 - RNA, 29 nt, Human
aacauugauuucagggcugccaggaagga

SEQ ID NO: 53808 - RNA, 23 nt, Human
cuggauguuguguguaucgagag

SEQ ID NO: 53809 - RNA, 22 nt, Human
gcagcuuucacuuugacuauga

SEQ ID NO: 53810 - RNA, 28 nt, Human
aguucccccagugccugcccuacgcacc

SEQ ID NO: 53811 - RNA, 22 nt, Human
uacuacauagguuaauuuuuua

SEQ ID NO: 53812 - RNA, 27 nt, Human
aacagaagaaguuaucaacaugcacac

SEQ ID NO: 53813 - RNA, 20 nt, Human
aggcucucugucagcuuuca

SEQ ID NO: 53814 - RNA, 21 nt, Human
uccauuuaugugugagcuuug

SEQ ID NO: 53815 - RNA, 22 nt, Human
ggcuggcugagcuuagcguccg

SEQ ID NO: 53816 - RNA, 19 nt, Human
guccccauuuuauagauga

SEQ ID NO: 53817 - RNA, 19 nt, Human
augugguagcuacagcuuc

SEQ ID NO: 53818 - RNA, 21 nt, Human
cugauuuggucaccuuccucu

SEQ ID NO: 53819 - RNA, 26 nt, Human
ucauuugauaugagcguuaccaaaau

SEQ ID NO: 53820 - RNA, 23 nt, Human
auaaaaaguuuggaauauacaaa

SEQ ID NO: 53821 - RNA, 26 nt, Human
gaaccuagucuagagacaaugaugcu

SEQ ID NO: 53822 - RNA, 25 nt, Human
gaacauaauuguuaggaccacugag

SEQ ID NO: 53823 - RNA, 20 nt, Human
cucugugagaucaagggucu

SEQ ID NO: 53824 - RNA, 23 nt, Human
uucaaaagagacaccaagugaca

SEQ ID NO: 53825 - RNA, 23 nt, Human
agagacacaggccacacauuuca

SEQ ID NO: 53826 - RNA, 26 nt, Human
cccuccacaggaaauugccucauggg

SEQ ID NO: 53827 - RNA, 20 nt, Human
uggacuagccagaauucuac

SEQ ID NO: 53828 - RNA, 22 nt, Human
cucgcccaggcuggagugcaac

SEQ ID NO: 53829 - RNA, 19 nt, Human
uuugccuucgaaugcagua

SEQ ID NO: 53830 - RNA, 25 nt, Human
uacaacaccuauauauccaagaagc

SEQ ID NO: 53831 - RNA, 22 nt, Human
uacaccuguaaucccaacacuu

SEQ ID NO: 53832 - RNA, 22 nt, Human
uucaagugaucuuucaucccag

SEQ ID NO: 53833 - RNA, 22 nt, Human
cugcaaccuccaccuccugggu

SEQ ID NO: 53834 - RNA, 22 nt, Human
cauguguguauauauguguaua

SEQ ID NO: 53835 - RNA, 25 nt, Human
cgcaaccuccuggaccgccaggcuu

SEQ ID NO: 53836 - RNA, 18 nt, Human
ccucuuucccugucgccu

SEQ ID NO: 53837 - RNA, 23 nt, Human
gcauauuuaaacaaggguccuca

SEQ ID NO: 53838 - RNA, 20 nt, Human
uguaagguaauuucugugua

SEQ ID NO: 53839 - RNA, 20 nt, Human
augccucuucuaccucuucc

SEQ ID NO: 53840 - RNA, 27 nt, Human
ggcaucagcguuucaugcucugccuuu

SEQ ID NO: 53841 - RNA, 22 nt, Human
cuccauguuugauguaucugag

SEQ ID NO: 53842 - RNA, 20 nt, Human
cuuaagguugggugcugcua

SEQ ID NO: 53843 - RNA, 26 nt, Human
ggccacuuauuucacuaucuucuuca

SEQ ID NO: 53844 - RNA, 23 nt, Human
ggcccucgggacaucuccacccg

SEQ ID NO: 53845 - RNA, 21 nt, Human
uugugucucuguugcacagau

SEQ ID NO: 53846 - RNA, 21 nt, Human
ccacugcauccuggccagggg

SEQ ID NO: 53847 - RNA, 23 nt, Human
caucagccaggcuggagugcagu

SEQ ID NO: 53848 - RNA, 21 nt, Human
ggagcccaggcggagcccagu

SEQ ID NO: 53849 - RNA, 24 nt, Human
gcuuggagagagcagacgccuucu

SEQ ID NO: 53850 - RNA, 23 nt, Human
agaugaaaauaaggaugaugggg

SEQ ID NO: 53851 - RNA, 22 nt, Human
gugacaccuucagcaggucuca

SEQ ID NO: 53852 - RNA, 27 nt, Human
accagccugggcaacauggcaagaccc

SEQ ID NO: 53853 - RNA, 20 nt, Human
guaugccacaccuggccuua

SEQ ID NO: 53854 - RNA, 21 nt, Human
ggaggguggcagcgucccggc

SEQ ID NO: 53855 - RNA, 27 nt, Human
cuguacaguugccacguuacugccuuu

SEQ ID NO: 53856 - RNA, 25 nt, Human
aguaugcccaccucaggcagacaca

SEQ ID NO: 53857 - RNA, 23 nt, Human
cucgcucccaagauccccgccuc

SEQ ID NO: 53858 - RNA, 20 nt, Human
ugggaccacagagggcagga

SEQ ID NO: 53859 - RNA, 24 nt, Human
aggauuaauuucauuuaucuggaa

SEQ ID NO: 53860 - RNA, 26 nt, Human
cccuucagugcccaccaacaucccau

SEQ ID NO: 53861 - RNA, 18 nt, Human
ucacaaaccaaugcucua

SEQ ID NO: 53862 - RNA, 26 nt, Human
uccauucuacuuauggagauccacac

SEQ ID NO: 53863 - RNA, 23 nt, Human
ggcuucuuggugaagagcauuuu

SEQ ID NO: 53864 - RNA, 22 nt, Human
cgggcagcagcccugaagccga

SEQ ID NO: 53865 - RNA, 27 nt, Human
cauugcacuucagccuggugacaugag

SEQ ID NO: 53866 - RNA, 28 nt, Human
ggcucccuggaagagaucaagccaucgg

SEQ ID NO: 53867 - RNA, 19 nt, Human
ggcaccucugcccuguguc

SEQ ID NO: 53868 - RNA, 22 nt, Human
cuguguacgccauuuauggcau

SEQ ID NO: 53869 - RNA, 25 nt, Human
ugaggcggggggcaagcccucccuc

SEQ ID NO: 53870 - RNA, 20 nt, Human
aauaugaaagaaaaauggau

SEQ ID NO: 53871 - RNA, 22 nt, Human
ccuccggagcugggauccaggc

SEQ ID NO: 53872 - RNA, 26 nt, Human
gagagggaggcccugggaggagagaa

SEQ ID NO: 53873 - RNA, 23 nt, Human
ucugaugugugagggaaaauacu

SEQ ID NO: 53874 - RNA, 21 nt, Human
agugacaacccuuucucucca

SEQ ID NO: 53875 - RNA, 23 nt, Human
cccaggccucccuccuacugccu

SEQ ID NO: 53876 - RNA, 25 nt, Human
ucuguuguuucugcugacugugugg

SEQ ID NO: 53877 - RNA, 20 nt, Human
cccugcagccccucgcacua

SEQ ID NO: 53878 - RNA, 23 nt, Human
uccuaaccugcagcacggugguu

SEQ ID NO: 53879 - RNA, 22 nt, Human
gugaggggagguggggccaggc

SEQ ID NO: 53880 - RNA, 23 nt, Human
caaacaaaaucaccgaccuugca

SEQ ID NO: 53881 - RNA, 27 nt, Human
caugccccugacacugcacugagcacu

SEQ ID NO: 53882 - RNA, 24 nt, Human
cggagcugggaaaagggaggcaga

SEQ ID NO: 53883 - RNA, 22 nt, Human
cuugggaaaagggggugacaga

SEQ ID NO: 53884 - RNA, 25 nt, Human
uacuauaucaguuugcacauucuaa

SEQ ID NO: 53885 - RNA, 23 nt, Human
agaaguauuuugccauauauaaa

SEQ ID NO: 53886 - RNA, 23 nt, Human
cuugcagaaacaucgaggugaca

SEQ ID NO: 53887 - RNA, 25 nt, Human
cuucucagccccgggccugccucug

SEQ ID NO: 53888 - RNA, 21 nt, Human
uacccaggcuggagugcagug

SEQ ID NO: 53889 - RNA, 21 nt, Human
cacccagguuggagugcagug

SEQ ID NO: 53890 - RNA, 21 nt, Human
cacccaggcuggaguguagug

SEQ ID NO: 53891 - RNA, 24 nt, Human
aggcuggagugcaaugaugcgauc

SEQ ID NO: 53892 - RNA, 26 nt, Human
ccuuggguccccauccucuggaacca

SEQ ID NO: 53893 - RNA, 24 nt, Human
uuuucuccucuccccaauccaugc

SEQ ID NO: 53894 - RNA, 27 nt, Human
cucuccaacaagaaggaaagcagggag

SEQ ID NO: 53895 - RNA, 24 nt, Human
aucugcaaaaugaaaaugucaaua

SEQ ID NO: 53896 - RNA, 23 nt, Human
uguucagguugcgggugagcugc

SEQ ID NO: 53897 - RNA, 29 nt, Human
cucauauuucucacacuaaauaaaucucu

SEQ ID NO: 53898 - RNA, 25 nt, Human
cugucacacaggcuggagugcagug

SEQ ID NO: 53899 - RNA, 21 nt, Human
ggcaggggcugggcagagggg

SEQ ID NO: 53900 - RNA, 16 nt, Human
ucauccaggcccaagg

SEQ ID NO: 53901 - RNA, 22 nt, Human
ccucugccuccugggcucaaga

SEQ ID NO: 53902 - RNA, 20 nt, Human
aucgggaaagaaugagggag

SEQ ID NO: 53903 - RNA, 19 nt, Human
ggccaucguccccaccucc

SEQ ID NO: 53904 - RNA, 27 nt, Human
uaagcuaauauugauacaaugaugauu

SEQ ID NO: 53905 - RNA, 26 nt, Human
cgccuuccaccuccugcguguccauc

SEQ ID NO: 53906 - RNA, 21 nt, Human
caggagguugaggcugcagug

SEQ ID NO: 53907 - RNA, 27 nt, Human
guuucucuuaauauaguucuccaguca

SEQ ID NO: 53908 - RNA, 22 nt, Human
ggaggcugaggcacgagaauca

SEQ ID NO: 53909 - RNA, 13 nt, Human
ucugcagcuggcc

SEQ ID NO: 53910 - RNA, 22 nt, Human
cuggggcucugugcagggagga

SEQ ID NO: 53911 - RNA, 24 nt, Human
ggguucugccuuuagccuggacca

SEQ ID NO: 53912 - RNA, 22 nt, Human
ugcuuuguuugauuuguucuau

SEQ ID NO: 53913 - RNA, 20 nt, Human
ucagccuguugaggcaugga

SEQ ID NO: 53914 - RNA, 24 nt, Human
aguggaccuugagaccacaggguu

SEQ ID NO: 53915 - RNA, 25 nt, Human
uugcagucuacauuuuaaagccaau

SEQ ID NO: 53916 - RNA, 19 nt, Human
ccaaugccaagguggcugc

SEQ ID NO: 53917 - RNA, 24 nt, Human
uaggacuuuccucugugaagagga

SEQ ID NO: 53918 - RNA, 21 nt, Human
aauagccugugagccagcccu

SEQ ID NO: 53919 - RNA, 23 nt, Human
ucaagggagaggccaggcgcagc

SEQ ID NO: 53920 - RNA, 25 nt, Human
aagcagaaaccuaacucacucguca

SEQ ID NO: 53921 - RNA, 20 nt, Human
auuucuaagcagacaggaaa

SEQ ID NO: 53922 - RNA, 22 nt, Human
agagcagucccucccucaggaa

SEQ ID NO: 53923 - RNA, 19 nt, Human
ccucaaagaagaaaaagaa

SEQ ID NO: 53924 - RNA, 31 nt, Human
gauccuugggcccaucacuguauagacaugc

SEQ ID NO: 53925 - RNA, 25 nt, Human
ugcagauacaggcuuggcgcucggg

SEQ ID NO: 53926 - RNA, 26 nt, Human
gcugagccacgcugcccaugcagcag

SEQ ID NO: 53927 - RNA, 20 nt, Human
acucccuccucacacuccag

SEQ ID NO: 53928 - RNA, 22 nt, Human
acacaccuuggagaaguggcau

SEQ ID NO: 53929 - RNA, 22 nt, Human
cugaguagcugggacuacaggc

SEQ ID NO: 53930 - RNA, 22 nt, Human
cugugaucccagcuacuuggga

SEQ ID NO: 53931 - RNA, 21 nt, Human
caucccugcacacagccuggg

SEQ ID NO: 53932 - RNA, 26 nt, Human
guauagacuuaaauggaugcaaugga

SEQ ID NO: 53933 - RNA, 22 nt, Human
caggucuguggaaaguggugca

SEQ ID NO: 53934 - RNA, 23 nt, Human
cccaguaacgccugcuguuuacu

SEQ ID NO: 53935 - RNA, 29 nt, Human
gaugucugggugaccucacuuuaggcagc

SEQ ID NO: 53936 - RNA, 18 nt, Human
gccauaaaaugugcuucu

SEQ ID NO: 53937 - RNA, 21 nt, Human
gccuccuucuucccaggauca

SEQ ID NO: 53938 - RNA, 21 nt, Human
ccuuguucuguguguaguuac

SEQ ID NO: 53939 - RNA, 22 nt, Human
ggggagggagaaauuaagcgga

SEQ ID NO: 53940 - RNA, 22 nt, Human
ccagaagaacagagcaguggca

SEQ ID NO: 53941 - RNA, 22 nt, Human
agcguccugggcucaaaugauc

SEQ ID NO: 53942 - RNA, 22 nt, Human
aggcugaggcggguggaucacu

SEQ ID NO: 53943 - RNA, 26 nt, Human
acugucccgcuagugccugcuaggug

SEQ ID NO: 53944 - RNA, 24 nt, Human
uuagaaauguaaacugccauauau

SEQ ID NO: 53945 - RNA, 23 nt, Human
aaguacaccuuuaagaauguuuc

SEQ ID NO: 53946 - RNA, 23 nt, Human
uugaagccaaacuccaccuucug

SEQ ID NO: 53947 - RNA, 21 nt, Human
caggggcggggcagggccagg

SEQ ID NO: 53948 - RNA, 24 nt, Human
uuuuggcauuucgagguuuacuua

SEQ ID NO: 53949 - RNA, 22 nt, Human
gucaccagcuaucugucaucuc

SEQ ID NO: 53950 - RNA, 22 nt, Human
gggccggggaggaaacccaacc

SEQ ID NO: 53951 - RNA, 21 nt, Human
caucugccucugccugagcau

SEQ ID NO: 53952 - RNA, 22 nt, Human
gccacccaggcagggagcaagu

SEQ ID NO: 53953 - RNA, 25 nt, Human
cacaucucauggcagcuaagccaca

SEQ ID NO: 53954 - RNA, 27 nt, Human
gccuccaacuccugggcucaaggcauc

SEQ ID NO: 53955 - RNA, 26 nt, Human
gugaagccuuucgugagggcuugcag

SEQ ID NO: 53956 - RNA, 20 nt, Human
gcaauccugaagaaccagag

SEQ ID NO: 53957 - RNA, 20 nt, Human
cacucaacaugagucaagag

SEQ ID NO: 53958 - RNA, 20 nt, Human
ccuugccaagccccaggaag

SEQ ID NO: 53959 - RNA, 24 nt, Human
gcccugagaucugccggucaucuc

SEQ ID NO: 53960 - RNA, 25 nt, Human
ucuuccucacuuuucaccuuaguuu

SEQ ID NO: 53961 - RNA, 26 nt, Human
uggagugcuggguaagcaguuuccaa

SEQ ID NO: 53962 - RNA, 19 nt, Human
cugucccaggcuguggugc

SEQ ID NO: 53963 - RNA, 27 nt, Human
uuaguaaagaacaaaaugauucucucc

SEQ ID NO: 53964 - RNA, 25 nt, Human
gauauucaaccucacaagggcucuc

SEQ ID NO: 53965 - RNA, 26 nt, Human
cccuccagggaauccgccugcagagg

SEQ ID NO: 53966 - RNA, 23 nt, Human
ccgugaagucgaggcugcaguga

SEQ ID NO: 53967 - RNA, 20 nt, Human
gagcccagggcagaggcagc

SEQ ID NO: 53968 - RNA, 25 nt, Human
gggagccugaggcaggagaacugcu

SEQ ID NO: 53969 - RNA, 21 nt, Human
aauguaaaugucuguugaauu

SEQ ID NO: 53970 - RNA, 19 nt, Human
gcagcugggaacaugugca

SEQ ID NO: 53971 - RNA, 21 nt, Human
ggaagggccaaggucugagca

SEQ ID NO: 53972 - RNA, 23 nt, Human
ccaguagcugggauuagaggcau

SEQ ID NO: 53973 - RNA, 23 nt, Human
aauggaugauuccaaagcaaggg

SEQ ID NO: 53974 - RNA, 22 nt, Human
ugcugccuuugccuccagugca

SEQ ID NO: 53975 - RNA, 22 nt, Human
augcuuguaaucccagcacuuu

SEQ ID NO: 53976 - RNA, 22 nt, Human
augccuguaaucucagcacuuu

SEQ ID NO: 53977 - RNA, 18 nt, Human
acagccugggcucaggga

SEQ ID NO: 53978 - RNA, 23 nt, Human
aggagucagaucauaaggcucca

SEQ ID NO: 53979 - RNA, 23 nt, Human
gccuguaaucccaacuacuuggg

SEQ ID NO: 53980 - RNA, 27 nt, Human
gucucccaggcuggagugcaaucgcgc

SEQ ID NO: 53981 - RNA, 20 nt, Human
cugcagagcccucuccucag

SEQ ID NO: 53982 - RNA, 22 nt, Human
gagagugaaaggaagagacaga

SEQ ID NO: 53983 - RNA, 23 nt, Human
cugcuuuauaagauggccagauc

SEQ ID NO: 53984 - RNA, 25 nt, Human
cccuguauucauggcuugacuuugu

SEQ ID NO: 53985 - RNA, 22 nt, Human
aggagcaggauguaauaaauac

SEQ ID NO: 53986 - RNA, 26 nt, Human
ggaccuguccaagcugucacacuggg

SEQ ID NO: 53987 - RNA, 26 nt, Human
uccuagagugaacuuguggcuuaugg

SEQ ID NO: 53988 - RNA, 22 nt, Human
cuugggguuuucaguaugaacc

SEQ ID NO: 53989 - RNA, 22 nt, Human
ccagaaagggacagccacggcc

SEQ ID NO: 53990 - RNA, 22 nt, Human
gccucucuauaccccuggauga

SEQ ID NO: 53991 - RNA, 25 nt, Human
aacagcuuugggggccgggcguggg

SEQ ID NO: 53992 - RNA, 28 nt, Human
agcuuuugccuugguucuuccuagugcc

SEQ ID NO: 53993 - RNA, 21 nt, Human
ccuagcuauuuggaauaaccg

SEQ ID NO: 53994 - RNA, 19 nt, Human
gucacaaaagcgcaucucc

SEQ ID NO: 53995 - RNA, 23 nt, Human
agagaaacuacuaaccugaaaga

SEQ ID NO: 53996 - RNA, 22 nt, Human
ucacccugggaaccgggagugc

SEQ ID NO: 53997 - RNA, 22 nt, Human
gagcucaguccacgguccuccc

SEQ ID NO: 53998 - RNA, 22 nt, Human
uacaugguccauugcuacucuu

SEQ ID NO: 53999 - RNA, 26 nt, Human
uacuucgaaggcugugcuccgcucac

SEQ ID NO: 54000 - RNA, 22 nt, Human
uguguauguacuuagcuguacu

SEQ ID NO: 54001 - RNA, 31 nt, Human
cugcccaugacccuguucccugucuauaaau

SEQ ID NO: 54002 - RNA, 21 nt, Human
auaaaauuaccuaaguacaca

SEQ ID NO: 54003 - RNA, 22 nt, Human
ggcuauuccuaggccucaggcc

SEQ ID NO: 54004 - RNA, 19 nt, Human
cuaguuuuugcuaugugga

SEQ ID NO: 54005 - RNA, 22 nt, Human
gcauuaguaccuggugcuagag

SEQ ID NO: 54006 - RNA, 20 nt, Human
cugccuauccugggaccucc

SEQ ID NO: 54007 - RNA, 22 nt, Human
uaguguuugcauuccugguuau

SEQ ID NO: 54008 - RNA, 22 nt, Human
caggcuggagugccauggcgcg

SEQ ID NO: 54009 - RNA, 20 nt, Human
cauuuuccugcauuggguga

SEQ ID NO: 54010 - RNA, 19 nt, Human
auccgggaaagauggugga

SEQ ID NO: 54011 - RNA, 22 nt, Human
gcaaaccugccgcagguggcca

SEQ ID NO: 54012 - RNA, 22 nt, Human
cugaggcagaagaaucgcuuga

SEQ ID NO: 54013 - RNA, 22 nt, Human
accuaccuaggcaacaugguga

SEQ ID NO: 54014 - RNA, 21 nt, Human
acaaaccauuuugcccccuca

SEQ ID NO: 54015 - RNA, 27 nt, Human
cagaaagggaaagaguuccauggcucg

SEQ ID NO: 54016 - RNA, 29 nt, Human
cucaaccggcucaucaaacacacuccuuu

SEQ ID NO: 54017 - RNA, 23 nt, Human
ccuauuuguuacuaccugccuca

SEQ ID NO: 54018 - RNA, 21 nt, Human
cauuacuauccagucuguauu

SEQ ID NO: 54019 - RNA, 22 nt, Human
gucuuucucaaacuauguaugg

SEQ ID NO: 54020 - RNA, 21 nt, Human
uuccauuccagagaauggaca

SEQ ID NO: 54021 - RNA, 26 nt, Human
gaguuucuuugcagugagcagugcag

SEQ ID NO: 54022 - RNA, 23 nt, Human
uggacaacaggucaaucauuuuc

SEQ ID NO: 54023 - RNA, 20 nt, Human
cccuccuaccccggcugcuu

SEQ ID NO: 54024 - RNA, 23 nt, Human
acagaaauacuuccugcgagcau

SEQ ID NO: 54025 - RNA, 26 nt, Human
acaggcugggacagaggcagaugggu

SEQ ID NO: 54026 - RNA, 24 nt, Human
aaaugauuccaguuacucauuuug

SEQ ID NO: 54027 - RNA, 21 nt, Human
ugaugauuugcuggagugcug

SEQ ID NO: 54028 - RNA, 23 nt, Human
ugagaagccucaugggagucagg

SEQ ID NO: 54029 - RNA, 24 nt, Human
ccacaggcaaggggguugcagugg

SEQ ID NO: 54030 - RNA, 23 nt, Human
ccccucggucgcccaccugcaca

SEQ ID NO: 54031 - RNA, 27 nt, Human
ucccugccucggccucccaacgugcug

SEQ ID NO: 54032 - RNA, 19 nt, Human
gcccaagcuggagugaagu

SEQ ID NO: 54033 - RNA, 22 nt, Human
cccuugagcccuuccucuacag

SEQ ID NO: 54034 - RNA, 25 nt, Human
cuguucucuaggcaugcugugacau

SEQ ID NO: 54035 - RNA, 27 nt, Human
cccugcagaauuuuccuuaguuaaaaa

SEQ ID NO: 54036 - RNA, 27 nt, Human
uucacuacuucuguagucucaucuuga

SEQ ID NO: 54037 - RNA, 19 nt, Human
ccuaagcuggagugcagug

SEQ ID NO: 54038 - RNA, 23 nt, Human
uccaggauggacucagugcagag

SEQ ID NO: 54039 - RNA, 27 nt, Human
ucuuaacaaaaaggaacuuuauaaaag

SEQ ID NO: 54040 - RNA, 23 nt, Human
uuagaagcagccaggucugguga

SEQ ID NO: 54041 - RNA, 25 nt, Human
ggagaaaaagaagaaaagauucuuu

SEQ ID NO: 54042 - RNA, 27 nt, Human
guggacucuguuaccauugaggauguu

SEQ ID NO: 54043 - RNA, 22 nt, Human
ugccgcccaggcuggacugcag

SEQ ID NO: 54044 - RNA, 21 nt, Human
augccugguaaguggcuuuuu

SEQ ID NO: 54045 - RNA, 27 nt, Human
uguagcucuggguaagaugaccugagu

SEQ ID NO: 54046 - RNA, 22 nt, Human
gagcgagaaucagacagagggc

SEQ ID NO: 54047 - RNA, 19 nt, Human
ugcuaggauuaaaacauga

SEQ ID NO: 54048 - RNA, 30 nt, Human
ccugccccuucugcccugccuugccccugc

SEQ ID NO: 54049 - RNA, 21 nt, Human
ucuuagacuccacaggaccaa

SEQ ID NO: 54050 - RNA, 24 nt, Human
augaaguaagcaacaaggaugaca

SEQ ID NO: 54051 - RNA, 24 nt, Human
auugcuugaaccugggaagugcag

SEQ ID NO: 54052 - RNA, 21 nt, Human
gggagaaggaaaaggccagua

SEQ ID NO: 54053 - RNA, 21 nt, Human
uggccagaucuucucgcaggu

SEQ ID NO: 54054 - RNA, 26 nt, Human
ucccacaucagggcggccucccaggu

SEQ ID NO: 54055 - RNA, 22 nt, Human
gccuuuaucucagccauccgca

SEQ ID NO: 54056 - RNA, 23 nt, Human
ugugccagcucaggugacuggag

SEQ ID NO: 54057 - RNA, 21 nt, Human
agcuggggagcagcugagaug

SEQ ID NO: 54058 - RNA, 23 nt, Human
ccggccgguuuccagacgcccag

SEQ ID NO: 54059 - RNA, 22 nt, Human
cagccugguggucuagaugugu

SEQ ID NO: 54060 - RNA, 27 nt, Human
ggcaguuacagggcccaggugagcuga

SEQ ID NO: 54061 - RNA, 21 nt, Human
cuccaucucaaaaacaaaaca

SEQ ID NO: 54062 - RNA, 27 nt, Human
cugcuucuggucuccagggacagugcu

SEQ ID NO: 54063 - RNA, 20 nt, Human
acuuggauuugcucucuucc

SEQ ID NO: 54064 - RNA, 25 nt, Human
ucuccaccgauacacaucaugugcc

SEQ ID NO: 54065 - RNA, 28 nt, Human
ucuggauuccuguuuuuugguuaccuga

SEQ ID NO: 54066 - RNA, 24 nt, Human
uggcaucauuagucccagauagcu

SEQ ID NO: 54067 - RNA, 22 nt, Human
gagaauugcuuucguauaguuc

SEQ ID NO: 54068 - RNA, 26 nt, Human
agaaggcaaaagagugaugguaggca

SEQ ID NO: 54069 - RNA, 21 nt, Human
agaauucuaaugaccagccgu

SEQ ID NO: 54070 - RNA, 27 nt, Human
uugcccaggcuggucuccaacaccugg

SEQ ID NO: 54071 - RNA, 22 nt, Human
ccuaaguagcuggguuuacagg

SEQ ID NO: 54072 - RNA, 23 nt, Human
auuauaccacugcacuccagccu

SEQ ID NO: 54073 - RNA, 18 nt, Human
cucuuggacuuguuuucc

SEQ ID NO: 54074 - RNA, 22 nt, Human
gcuucugccucauccugccuua

SEQ ID NO: 54075 - RNA, 21 nt, Human
ggacagagcaccugaccucag

SEQ ID NO: 54076 - RNA, 23 nt, Human
gcaaauugucacaggacagcccu

SEQ ID NO: 54077 - RNA, 26 nt, Human
ggggccuggaggagggcaggagccgc

SEQ ID NO: 54078 - RNA, 23 nt, Human
cccuuugggguuccacacuucac

SEQ ID NO: 54079 - RNA, 26 nt, Human
caacuugcauguuccuuacuccuguu

SEQ ID NO: 54080 - RNA, 24 nt, Human
guguuucuggccccuaaguauugc

SEQ ID NO: 54081 - RNA, 25 nt, Human
caguuucagcuuucuuguuaugccu

SEQ ID NO: 54082 - RNA, 19 nt, Human
aaaucuucaguucuguugu

SEQ ID NO: 54083 - RNA, 23 nt, Human
auuuauuuugauuuuagcauuaa

SEQ ID NO: 54084 - RNA, 21 nt, Human
uucauucuccuaucaccuguc

SEQ ID NO: 54085 - RNA, 28 nt, Human
ggagggcagggagugggagccaaugaac

SEQ ID NO: 54086 - RNA, 21 nt, Human
aguuccauauauuguauuugu

SEQ ID NO: 54087 - RNA, 26 nt, Human
auugcugcuuucucuucuacuucuug

SEQ ID NO: 54088 - RNA, 23 nt, Human
gacgucuguaaucucagaggcuu

SEQ ID NO: 54089 - RNA, 25 nt, Human
accaaaaccaccccagugccugaga

SEQ ID NO: 54090 - RNA, 27 nt, Human
uuggccauuccuccuuggugggaauca

SEQ ID NO: 54091 - RNA, 26 nt, Human
agccaggaaggaaauaaagucacaac

SEQ ID NO: 54092 - RNA, 22 nt, Human
ugaacaagguggacacucacug

SEQ ID NO: 54093 - RNA, 17 nt, Human
cuucccuuuugcggcca

SEQ ID NO: 54094 - RNA, 20 nt, Human
ccuagauuuccuuucauucu

SEQ ID NO: 54095 - RNA, 22 nt, Human
gcuuuggagcagcuucugggac

SEQ ID NO: 54096 - RNA, 24 nt, Human
cagaaauuugguggguuuuuuguu

SEQ ID NO: 54097 - RNA, 21 nt, Human
ccgaggcagccucgcugcgcc

SEQ ID NO: 54098 - RNA, 27 nt, Human
aaguguucuucaguaauugugcuggca

SEQ ID NO: 54099 - RNA, 21 nt, Human
cagguccuggcuuugccuuug

SEQ ID NO: 54100 - RNA, 20 nt, Human
gcugccggcuggagggaggu

SEQ ID NO: 54101 - RNA, 23 nt, Human
cugggggcuggccagucagggag

SEQ ID NO: 54102 - RNA, 20 nt, Human
ucccugcaaagcaagcaggg

SEQ ID NO: 54103 - RNA, 22 nt, Human
aagaagccagaaaauauuauca

SEQ ID NO: 54104 - RNA, 27 nt, Human
ccuacagaguuagggaauggagcccag

SEQ ID NO: 54105 - RNA, 22 nt, Human
ucaacagcaaucaucuuugggg

SEQ ID NO: 54106 - RNA, 21 nt, Human
gacucacaccugcaaucccag

SEQ ID NO: 54107 - RNA, 24 nt, Human
cccacucaccaguucugcugccuc

SEQ ID NO: 54108 - RNA, 24 nt, Human
ugugucccaggcuggagugcagug

SEQ ID NO: 54109 - RNA, 25 nt, Human
uuguuucucucccugggccucaguu

SEQ ID NO: 54110 - RNA, 29 nt, Human
uuuuccaaaccuccuuccccacccuaucu

SEQ ID NO: 54111 - RNA, 24 nt, Human
accuggcaaccccagccccagccu

SEQ ID NO: 54112 - RNA, 20 nt, Human
aagcggguaauuagagcccg

SEQ ID NO: 54113 - RNA, 23 nt, Human
ccuguccccuuaaacacaggucc

SEQ ID NO: 54114 - RNA, 23 nt, Human
cuucaagcaauucuccugccuca

SEQ ID NO: 54115 - RNA, 26 nt, Human
uucauucuuccucaaaguauuuacca

SEQ ID NO: 54116 - RNA, 23 nt, Human
cuggugagccaagggaucaugcc

SEQ ID NO: 54117 - RNA, 21 nt, Human
uccgcccacacagagcuggcu

SEQ ID NO: 54118 - RNA, 22 nt, Human
uuuucugcucuguuuguauguu

SEQ ID NO: 54119 - RNA, 27 nt, Human
aaggcauucuuguuagcuuugcuuuuc

SEQ ID NO: 54120 - RNA, 25 nt, Human
cagauuugccauuaugcacaucaca

SEQ ID NO: 54121 - RNA, 27 nt, Human
gugacaucuguggaauuuuuuagcucu

SEQ ID NO: 54122 - RNA, 20 nt, Human
agaagguuggaaaaggagga

SEQ ID NO: 54123 - RNA, 23 nt, Human
cccaaauagcuggggcuaccaug

SEQ ID NO: 54124 - RNA, 27 nt, Human
cacuacuacacuccagccuggugacag

SEQ ID NO: 54125 - RNA, 19 nt, Human
gacucugggaaucaugcuc

SEQ ID NO: 54126 - RNA, 26 nt, Human
ggauguuuuacuacagaucuggaugg

SEQ ID NO: 54127 - RNA, 25 nt, Human
acagcauugcgccugggugcagcag

SEQ ID NO: 54128 - RNA, 23 nt, Human
cccaggagauggaaguugcagug

SEQ ID NO: 54129 - RNA, 20 nt, Human
ccaugcacgcauacucugaa

SEQ ID NO: 54130 - RNA, 25 nt, Human
uggggcugguugcugcugcagugag

SEQ ID NO: 54131 - RNA, 20 nt, Human
agcaauaaaccuuugcauca

SEQ ID NO: 54132 - RNA, 22 nt, Human
agcucacugcagccuccaucuc

SEQ ID NO: 54133 - RNA, 25 nt, Human
cuuugugccaguggauccuggaggg

SEQ ID NO: 54134 - RNA, 25 nt, Human
aagcccaggccuuggacauuuagug

SEQ ID NO: 54135 - RNA, 19 nt, Human
caguucuguguccugugcu

SEQ ID NO: 54136 - RNA, 20 nt, Human
cuuggguuagguauauccau

SEQ ID NO: 54137 - RNA, 27 nt, Human
uccuggcugacugccuuagcagugggg

SEQ ID NO: 54138 - RNA, 24 nt, Human
aaggauucuggcagcaguucucaa

SEQ ID NO: 54139 - RNA, 22 nt, Human
aggacagcagaccagacaguca

SEQ ID NO: 54140 - RNA, 19 nt, Human
uuucugccuccaucccacc

SEQ ID NO: 54141 - RNA, 24 nt, Human
ucacugaaagccacauucuuagcc

SEQ ID NO: 54142 - RNA, 26 nt, Human
gccugacagacaaccacuacgcgggc

SEQ ID NO: 54143 - RNA, 25 nt, Human
aacuuagaggaaaaugaguauuugg

SEQ ID NO: 54144 - RNA, 23 nt, Human
ccuccccgucuccuccucaggcu

SEQ ID NO: 54145 - RNA, 27 nt, Human
ccgaauuuguaauucuuuucucucaaa

SEQ ID NO: 54146 - RNA, 22 nt, Human
caagaaacugcuucuugaaaug

SEQ ID NO: 54147 - RNA, 25 nt, Human
cacccacugaaaaacaaguugagua

SEQ ID NO: 54148 - RNA, 22 nt, Human
auggaacacauuugucccagau

SEQ ID NO: 54149 - RNA, 22 nt, Human
caacuccugaccucaagcaauu

SEQ ID NO: 54150 - RNA, 23 nt, Human
gcugcgcagccugggcgcuuggg

SEQ ID NO: 54151 - RNA, 21 nt, Human
aaagaaaaggucagccuccca

SEQ ID NO: 54152 - RNA, 21 nt, Human
gucaugguccucaucacacac

SEQ ID NO: 54153 - RNA, 23 nt, Human
cacuacugcugugcccucaggcu

SEQ ID NO: 54154 - RNA, 22 nt, Human
agaggaugguugucccugggga

SEQ ID NO: 54155 - RNA, 25 nt, Human
uucauuuuguuuucaucugugauag

SEQ ID NO: 54156 - RNA, 25 nt, Human
aaugucggaaaaggguguugggagg

SEQ ID NO: 54157 - RNA, 22 nt, Human
caggccuguguugccagagcug

SEQ ID NO: 54158 - RNA, 24 nt, Human
ccucugucuccuugcuccaaugga

SEQ ID NO: 54159 - RNA, 19 nt, Human
agcuacaggaucuaaagca

SEQ ID NO: 54160 - RNA, 20 nt, Human
ccagcgucaggccuaccuca

SEQ ID NO: 54161 - RNA, 19 nt, Human
accuggguccacauccugc

SEQ ID NO: 54162 - RNA, 26 nt, Human
ucucucucuuauaucacuugaaugau

SEQ ID NO: 54163 - RNA, 26 nt, Human
aucucgaacuccuaaccucaagugau

SEQ ID NO: 54164 - RNA, 26 nt, Human
aucucaaacuccugaccucaagugau

SEQ ID NO: 54165 - RNA, 20 nt, Human
agccuccuccccucccgcga

SEQ ID NO: 54166 - RNA, 25 nt, Human
gggagagaaggcccggaggggcucu

SEQ ID NO: 54167 - RNA, 21 nt, Human
ucagguuggugcagaggcgcu

SEQ ID NO: 54168 - RNA, 26 nt, Human
gguuuuucuuuuuccuuuuuguugau

SEQ ID NO: 54169 - RNA, 23 nt, Human
augccuggcuaauuuuguauuuu

SEQ ID NO: 54170 - RNA, 27 nt, Human
cccuccuggggccaggccgggccugua

SEQ ID NO: 54171 - RNA, 18 nt, Human
gccuggaaggaaaaagag

SEQ ID NO: 54172 - RNA, 21 nt, Human
ugagaagcuggauuuaaucau

SEQ ID NO: 54173 - RNA, 22 nt, Human
guaugaacaccugggcuuaaga

SEQ ID NO: 54174 - RNA, 27 nt, Human
uagcccagucccuggagcuguccuuca

SEQ ID NO: 54175 - RNA, 23 nt, Human
caccacuuacccguucccccuuu

SEQ ID NO: 54176 - RNA, 27 nt, Human
ugaaaccaguauuuaagcuuuaaauga

SEQ ID NO: 54177 - RNA, 21 nt, Human
ccccucucccuccugcaauaa

SEQ ID NO: 54178 - RNA, 22 nt, Human
aaacccagagcugucagucccu

SEQ ID NO: 54179 - RNA, 18 nt, Human
uuuucuuucuuucuuaac

SEQ ID NO: 54180 - RNA, 23 nt, Human
uucucauuuggcuauucuuuucc

SEQ ID NO: 54181 - RNA, 23 nt, Human
gcaccuuucaucuuccuugggug

SEQ ID NO: 54182 - RNA, 24 nt, Human
ucacucuccugaaaagaagauauu

SEQ ID NO: 54183 - RNA, 22 nt, Human
uuccaaugccucuugucuuccu

SEQ ID NO: 54184 - RNA, 22 nt, Human
caguuucagguguuuaguugca

SEQ ID NO: 54185 - RNA, 24 nt, Human
aaguugugaaauguuacaacuugu

SEQ ID NO: 54186 - RNA, 21 nt, Human
agguguacccugcacuugcag

SEQ ID NO: 54187 - RNA, 23 nt, Human
uuccagaucuccauccacuuuuc

SEQ ID NO: 54188 - RNA, 22 nt, Human
caacauagugagaucccaucuc

SEQ ID NO: 54189 - RNA, 27 nt, Human
ucugcugcuucuuaagcuccagcgucu

SEQ ID NO: 54190 - RNA, 27 nt, Human
gcagugugcugugauugugacacugcc

SEQ ID NO: 54191 - RNA, 21 nt, Human
gccaugccgcugcacugacau

SEQ ID NO: 54192 - RNA, 21 nt, Human
ucucaucaacaaagaaauauu

SEQ ID NO: 54193 - RNA, 21 nt, Human
ugggaguagaaggugggaaga

SEQ ID NO: 54194 - RNA, 20 nt, Human
ugccuucaggaaagacuuaa

SEQ ID NO: 54195 - RNA, 28 nt, Human
uuaggagaagccaggaauuucccaggac

SEQ ID NO: 54196 - RNA, 28 nt, Human
uucucagccuccuuccucaugccuccag

SEQ ID NO: 54197 - RNA, 23 nt, Human
ccugccugucaaccucuuugagc

SEQ ID NO: 54198 - RNA, 23 nt, Human
agggguuucuggcaccuaccuac

SEQ ID NO: 54199 - RNA, 28 nt, Human
gcuuuaaucuuucugucauuuaaagcaa

SEQ ID NO: 54200 - RNA, 22 nt, Human
augccugcaaucccagcacuuu

SEQ ID NO: 54201 - RNA, 22 nt, Human
gugugagcuacugugcccagcc

SEQ ID NO: 54202 - RNA, 21 nt, Human
cgcccaggcuggggugcagug

SEQ ID NO: 54203 - RNA, 23 nt, Human
guuuaacuguugggcucucaaua

SEQ ID NO: 54204 - RNA, 22 nt, Human
aaaguucugaggcauuagccag

SEQ ID NO: 54205 - RNA, 25 nt, Human
uaaaagucucucaaauuaggccaga

SEQ ID NO: 54206 - RNA, 18 nt, Human
cuugaaucccuguggaaa

SEQ ID NO: 54207 - RNA, 20 nt, Human
aagcugaggcagaacucacu

SEQ ID NO: 54208 - RNA, 23 nt, Human
gugaauccucuucuuuauacugu

SEQ ID NO: 54209 - RNA, 23 nt, Human
ccuggaaggcagaaguugcagug

SEQ ID NO: 54210 - RNA, 18 nt, Human
uagagugcuuuccuugug

SEQ ID NO: 54211 - RNA, 26 nt, Human
cugcccccgggggccuguggcuaagu

SEQ ID NO: 54212 - RNA, 21 nt, Human
aggaagagacacauccucuca

SEQ ID NO: 54213 - RNA, 23 nt, Human
caggaauugaauggguuugcuag

SEQ ID NO: 54214 - RNA, 25 nt, Human
gugaagccuccaguggagaacuggg

SEQ ID NO: 54215 - RNA, 22 nt, Human
uagguucauuucucuggaacau

SEQ ID NO: 54216 - RNA, 25 nt, Human
ggacaugaaaucaucuuagcuuagc

SEQ ID NO: 54217 - RNA, 27 nt, Human
uggcuuacaccuguaaucccaacacuu

SEQ ID NO: 54218 - RNA, 25 nt, Human
aacucacaaacuugaacuggcuuca

SEQ ID NO: 54219 - RNA, 25 nt, Human
acuguccguguugccuucuugaaca

SEQ ID NO: 54220 - RNA, 16 nt, Human
gccaaaaaaugcugga

SEQ ID NO: 54221 - RNA, 25 nt, Human
gagguacugugaggaagagcaggca

SEQ ID NO: 54222 - RNA, 21 nt, Human
gucuugaacuccuggccucaa

SEQ ID NO: 54223 - RNA, 24 nt, Human
aaaagcuuuuuacucaaagaguau

SEQ ID NO: 54224 - RNA, 22 nt, Human
gccacaucaccugagacuaggg

SEQ ID NO: 54225 - RNA, 21 nt, Human
aagugcugggauuacaggcgu

SEQ ID NO: 54226 - RNA, 27 nt, Human
ccaaguccaccugccuauccauccugc

SEQ ID NO: 54227 - RNA, 25 nt, Human
cuaguuccucacucuuccuuuucag

SEQ ID NO: 54228 - RNA, 27 nt, Human
ccagauuuuuacacauguaucuaugca

SEQ ID NO: 54229 - RNA, 20 nt, Human
cgccaggcuggaguguagug

SEQ ID NO: 54230 - RNA, 22 nt, Human
ucccuugccuuaugggcugaag

SEQ ID NO: 54231 - RNA, 23 nt, Human
agaaggaaguuuauuauauaacc

SEQ ID NO: 54232 - RNA, 24 nt, Human
ggagaggggaccggcggcggcggc

SEQ ID NO: 54233 - RNA, 27 nt, Human
uccucaccuccaggaugagcacugcag

SEQ ID NO: 54234 - RNA, 26 nt, Human
caucccucgaauccaccagcacgagc

SEQ ID NO: 54235 - RNA, 23 nt, Human
uuguaacaauguugugguugcua

SEQ ID NO: 54236 - RNA, 22 nt, Human
cggccuggggcgagcacuguga

SEQ ID NO: 54237 - RNA, 23 nt, Human
augccauaaggaaaacgagugcc

SEQ ID NO: 54238 - RNA, 21 nt, Human
acuuguucaucaccauuacug

SEQ ID NO: 54239 - RNA, 25 nt, Human
aguaaugcuuaagggaguuuaauag

SEQ ID NO: 54240 - RNA, 27 nt, Human
gucacauuugacaaauaggacugccua

SEQ ID NO: 54241 - RNA, 19 nt, Human
uuuccaggcuggaacaaua

SEQ ID NO: 54242 - RNA, 21 nt, Human
gcuccuuucuguccuggagcu

SEQ ID NO: 54243 - RNA, 21 nt, Human
cccuccucuggcacucaugcu

SEQ ID NO: 54244 - RNA, 22 nt, Human
uuccaagucucccucaaagaag

SEQ ID NO: 54245 - RNA, 21 nt, Human
gcugggagagggaaagacauu

SEQ ID NO: 54246 - RNA, 31 nt, Human
cccuggaggcaccugguggccaugcuccucu

SEQ ID NO: 54247 - RNA, 22 nt, Human
cuccugagucccguagccucau

SEQ ID NO: 54248 - RNA, 21 nt, Human
uuacauggacaaauguuuagg

SEQ ID NO: 54249 - RNA, 27 nt, Human
ucugcucccaugacccucugcccacuu

SEQ ID NO: 54250 - RNA, 26 nt, Human
gaagcccgggcccaggaaaauuagaa

SEQ ID NO: 54251 - RNA, 22 nt, Human
ucacagcuggugggccagacug

SEQ ID NO: 54252 - RNA, 24 nt, Human
gccauugcuaacuacuucaacuga

SEQ ID NO: 54253 - RNA, 24 nt, Human
gccaggaccccuccacaugcaccu

SEQ ID NO: 54254 - RNA, 26 nt, Human
gggcaggccagguggaaaggagccag

SEQ ID NO: 54255 - RNA, 21 nt, Human
cuucuccuuucacaaccuucu

SEQ ID NO: 54256 - RNA, 21 nt, Human
gcuggcaaucugcaccuuggg

SEQ ID NO: 54257 - RNA, 21 nt, Human
ccacuucugagaguaguaaau

SEQ ID NO: 54258 - RNA, 30 nt, Human
uucagugguacgguguccaagcaaacagca

SEQ ID NO: 54259 - RNA, 22 nt, Human
gcugcauggggagcccggggag

SEQ ID NO: 54260 - RNA, 20 nt, Human
gggggcagugugagcuuuga

SEQ ID NO: 54261 - RNA, 22 nt, Human
gacuauaucaaccuacaacuuu

SEQ ID NO: 54262 - RNA, 22 nt, Human
cugcccaggacacagugcaggc

SEQ ID NO: 54263 - RNA, 21 nt, Human
ggguaccuccugaguggcugu

SEQ ID NO: 54264 - RNA, 19 nt, Human
acacccugacugugcuuaa

SEQ ID NO: 54265 - RNA, 28 nt, Human
gggcaaagcccacuauaaacuauaggag

SEQ ID NO: 54266 - RNA, 23 nt, Human
ucggaauucccugaagcaacacu

SEQ ID NO: 54267 - RNA, 20 nt, Human
uuucccuuagcccaacacca

SEQ ID NO: 54268 - RNA, 20 nt, Human
cugagauauuaacuuacuca

SEQ ID NO: 54269 - RNA, 27 nt, Human
ggcucacugcaaucuagguggaggucu

SEQ ID NO: 54270 - RNA, 26 nt, Human
ugcccaggagguggcguccagcaguc

SEQ ID NO: 54271 - RNA, 22 nt, Human
aaacagcuuuaggggugguggg

SEQ ID NO: 54272 - RNA, 23 nt, Human
aaucaaugccauuuguaacucaa

SEQ ID NO: 54273 - RNA, 25 nt, Human
gagucggauuaccaaaacacugccu

SEQ ID NO: 54274 - RNA, 26 nt, Human
ggguuugggaagcaggacuccguccc

SEQ ID NO: 54275 - RNA, 23 nt, Human
gacuguggagaaggaggccccug

SEQ ID NO: 54276 - RNA, 22 nt, Human
ccccaacagcccccaacuauag

SEQ ID NO: 54277 - RNA, 21 nt, Human
ugccuguaauccaacauuggg

SEQ ID NO: 54278 - RNA, 22 nt, Human
aacagggcauauaucaaagaug

SEQ ID NO: 54279 - RNA, 20 nt, Human
agaagguuuggacucacuug

SEQ ID NO: 54280 - RNA, 26 nt, Human
gacuccugucccuuccccuucugcuu

SEQ ID NO: 54281 - RNA, 17 nt, Human
ggucggcagagguggac

SEQ ID NO: 54282 - RNA, 21 nt, Human
gucacgcaggcugagugcacu

SEQ ID NO: 54283 - RNA, 18 nt, Human
gccagugaaacacuugcu

SEQ ID NO: 54284 - RNA, 22 nt, Human
gguuggacuggauaaucuuuau

SEQ ID NO: 54285 - RNA, 20 nt, Human
gacuagucucauuacuccgg

SEQ ID NO: 54286 - RNA, 25 nt, Human
uaagaaggauuccacagaucacaua

SEQ ID NO: 54287 - RNA, 21 nt, Human
caacaagcccaggccaagaag

SEQ ID NO: 54288 - RNA, 22 nt, Human
gcucucagccacaggcagcuuc

SEQ ID NO: 54289 - RNA, 21 nt, Human
ucuccccaugguucaugugga

SEQ ID NO: 54290 - RNA, 27 nt, Human
ggcucagagaugaagcagugaagagac

SEQ ID NO: 54291 - RNA, 27 nt, Human
cagucucuuccuggucugaacucccgc

SEQ ID NO: 54292 - RNA, 26 nt, Human
gacucagaguuggggucucacugugu

SEQ ID NO: 54293 - RNA, 22 nt, Human
aaaacauacaaaaauuagccgg

SEQ ID NO: 54294 - RNA, 22 nt, Human
cccgaguagcugagauuauagg

SEQ ID NO: 54295 - RNA, 24 nt, Human
ccaugccuggcccagguaacaugu

SEQ ID NO: 54296 - RNA, 22 nt, Human
gagcucaggaaaugagagccua

SEQ ID NO: 54297 - RNA, 22 nt, Human
gcucuacuggaauuuucauaca

SEQ ID NO: 54298 - RNA, 20 nt, Human
uaacugcauuaguggccauu

SEQ ID NO: 54299 - RNA, 22 nt, Human
uuauugaaaaaucaguguauua

SEQ ID NO: 54300 - RNA, 28 nt, Human
gcaugaccugcacuuucauuguacugaa

SEQ ID NO: 54301 - RNA, 22 nt, Human
ccacagcaggcacaggucugag

SEQ ID NO: 54302 - RNA, 20 nt, Human
ucuuuaguuuugauuuugga

SEQ ID NO: 54303 - RNA, 24 nt, Human
ccuuaggauucacugcucucuccu

SEQ ID NO: 54304 - RNA, 19 nt, Human
ucaguaaaucaagucagcu

SEQ ID NO: 54305 - RNA, 22 nt, Human
aggauuacaggcgugagccacc

SEQ ID NO: 54306 - RNA, 23 nt, Human
ggagagcgagggagcgcgcuccc

SEQ ID NO: 54307 - RNA, 21 nt, Human
cgggcagcggagguugcagug

SEQ ID NO: 54308 - RNA, 20 nt, Human
aaagggaguauuacaaaaac

SEQ ID NO: 54309 - RNA, 21 nt, Human
gucacccaggcgggaguggug

SEQ ID NO: 54310 - RNA, 27 nt, Human
gcaaagaaugcucuggcugguuaccag

SEQ ID NO: 54311 - RNA, 20 nt, Human
gagaagcagcauugaagugg

SEQ ID NO: 54312 - RNA, 22 nt, Human
aaaacauuccaaaacuuuaagg

SEQ ID NO: 54313 - RNA, 21 nt, Human
cuucccuuccucagcaggcca

SEQ ID NO: 54314 - RNA, 23 nt, Human
ggacaguuggcuuccagagguuu

SEQ ID NO: 54315 - RNA, 29 nt, Human
ggcuuggucggggguggucucgugggguc

SEQ ID NO: 54316 - RNA, 24 nt, Human
auauucagaaauucuccaggauuu

SEQ ID NO: 54317 - RNA, 27 nt, Human
uugcccaggcugcagugcaguggugug

SEQ ID NO: 54318 - RNA, 21 nt, Human
ugucagaaagaggggaaggaa

SEQ ID NO: 54319 - RNA, 24 nt, Human
uaucuguguauuuucaaauguuac

SEQ ID NO: 54320 - RNA, 25 nt, Human
ugccuuuuauaguaugcccaccuca

SEQ ID NO: 54321 - RNA, 26 nt, Human
gggucugaggccccugccuccaagau

SEQ ID NO: 54322 - RNA, 26 nt, Human
auugccucucagggguagugaagcug

SEQ ID NO: 54323 - RNA, 27 nt, Human
cacgcuggagugcagugagccgagauc

SEQ ID NO: 54324 - RNA, 24 nt, Human
cuaugccaccugcaagugugcuac

SEQ ID NO: 54325 - RNA, 25 nt, Human
caccuugaggucaggaguucaagac

SEQ ID NO: 54326 - RNA, 24 nt, Human
gccucaucugccccacccugggcc

SEQ ID NO: 54327 - RNA, 19 nt, Human
caguuucacacagaaguca

SEQ ID NO: 54328 - RNA, 16 nt, Human
cacuacugcugccuuu

SEQ ID NO: 54329 - RNA, 26 nt, Human
ccugccuggcgccgagggcagguggc

SEQ ID NO: 54330 - RNA, 28 nt, Human
ggcaguaggccggugugccugacugccc

SEQ ID NO: 54331 - RNA, 20 nt, Human
gguucuuagcacauccucug

SEQ ID NO: 54332 - RNA, 22 nt, Human
aagguaaaacugcucugccuuu

SEQ ID NO: 54333 - RNA, 16 nt, Human
ugccaucccaccugca

SEQ ID NO: 54334 - RNA, 22 nt, Human
guaacccaggcuggaaugcaau

SEQ ID NO: 54335 - RNA, 22 nt, Human
ucauuucuacuuucugcccuca

SEQ ID NO: 54336 - RNA, 25 nt, Human
accaaauugucuuuagaaaaauuaa

SEQ ID NO: 54337 - RNA, 27 nt, Human
gaguuuucuuugauaguuucugccuca

SEQ ID NO: 54338 - RNA, 25 nt, Human
ccucccagccuucaggcuguagggc

SEQ ID NO: 54339 - RNA, 22 nt, Human
ucauuaugaggggcacauucuu

SEQ ID NO: 54340 - RNA, 20 nt, Human
cugggccccugcucuuccca

SEQ ID NO: 54341 - RNA, 27 nt, Human
guggcggaggcugaggagaaggaggag

SEQ ID NO: 54342 - RNA, 20 nt, Human
gagcuacaaccuggccuuca

SEQ ID NO: 54343 - RNA, 27 nt, Human
caggcuggagugcagugacaugaucuu

SEQ ID NO: 54344 - RNA, 27 nt, Human
caggcuggaguacagugaugugaucuc

SEQ ID NO: 54345 - RNA, 22 nt, Human
aagugcuuuccuaagggggugg

SEQ ID NO: 54346 - RNA, 22 nt, Human
gggucuguagugucacucaagg

SEQ ID NO: 54347 - RNA, 21 nt, Human
acaaacuguugugcuauugga

SEQ ID NO: 54348 - RNA, 24 nt, Human
uuuauggcuguuagguguuuccca

SEQ ID NO: 54349 - RNA, 23 nt, Human
uccugguggugguauccaaaauc

SEQ ID NO: 54350 - RNA, 25 nt, Human
ccuccaucuuaggccuuugccucau

SEQ ID NO: 54351 - RNA, 22 nt, Human
cugcagcuccgcccgccgggcu

SEQ ID NO: 54352 - RNA, 27 nt, Human
cuccagccaugacuaaaagagaagcag

SEQ ID NO: 54353 - RNA, 22 nt, Human
ggucucgaacuccgcaucucag

SEQ ID NO: 54354 - RNA, 24 nt, Human
aguagugacaccuaccugcgguca

SEQ ID NO: 54355 - RNA, 21 nt, Human
cccuucaggagggccuccugu

SEQ ID NO: 54356 - RNA, 31 nt, Human
uccuggccauggagaggagaucuggacccga

SEQ ID NO: 54357 - RNA, 26 nt, Human
uuauaugauucacaugcuaaagccag

SEQ ID NO: 54358 - RNA, 26 nt, Human
gcucacugcagugcugauguauuuca

SEQ ID NO: 54359 - RNA, 22 nt, Human
uggacuuuuccuguuguuguac

SEQ ID NO: 54360 - RNA, 19 nt, Human
auuucauacguucuuuuca

SEQ ID NO: 54361 - RNA, 21 nt, Human
ugugcuugagccaggaggccu

SEQ ID NO: 54362 - RNA, 22 nt, Human
cuucccgacagccaacagguuu

SEQ ID NO: 54363 - RNA, 27 nt, Human
augcuuucuguuucacuguggauaguu

SEQ ID NO: 54364 - RNA, 22 nt, Human
guugaccaggcuggagugaagu

SEQ ID NO: 54365 - RNA, 28 nt, Human
uugccuuuuuuaaauucagcaucauguu

SEQ ID NO: 54366 - RNA, 24 nt, Human
uccucgguuucccuguccuugccc

SEQ ID NO: 54367 - RNA, 25 nt, Human
gggggcaguuggguagauggguggg

SEQ ID NO: 54368 - RNA, 21 nt, Human
cacugccacacagggucugca

SEQ ID NO: 54369 - RNA, 21 nt, Human
uccuguguguuucaggcauuc

SEQ ID NO: 54370 - RNA, 26 nt, Human
guuucaucuaaaugaaagugguaauc

SEQ ID NO: 54371 - RNA, 22 nt, Human
guggcaucugacugcggcucau

SEQ ID NO: 54372 - RNA, 21 nt, Human
ggcuccugcagguccacacac

SEQ ID NO: 54373 - RNA, 21 nt, Human
ucuaaacaaagugauauuuua

SEQ ID NO: 54374 - RNA, 26 nt, Human
cccaaguacugggauuacagcuucca

SEQ ID NO: 54375 - RNA, 24 nt, Human
cacagccggguagaaaugccugag

SEQ ID NO: 54376 - RNA, 23 nt, Human
uucugauuuuacauguaaaacaa

SEQ ID NO: 54377 - RNA, 22 nt, Human
ccagcaugagugcugagauaug

SEQ ID NO: 54378 - RNA, 22 nt, Human
acuugaucuucugggagcagga

SEQ ID NO: 54379 - RNA, 22 nt, Human
uugcccuuaccuccuaggguca

SEQ ID NO: 54380 - RNA, 27 nt, Human
ugggaacacuggcugccucuccaaacc

SEQ ID NO: 54381 - RNA, 20 nt, Human
ucuauucuuugagaugugau

SEQ ID NO: 54382 - RNA, 22 nt, Human
aaauacugagaaacauuuugaa

SEQ ID NO: 54383 - RNA, 23 nt, Human
ugccacaucccagugggcucuga

SEQ ID NO: 54384 - RNA, 27 nt, Human
ggccccguuucugguggucuguuggca

SEQ ID NO: 54385 - RNA, 26 nt, Human
uucuaugcauguuacugguauuuaua

SEQ ID NO: 54386 - RNA, 22 nt, Human
gccucccaaguagcugagacua

SEQ ID NO: 54387 - RNA, 24 nt, Human
uagacagagaugaacugagguccu

SEQ ID NO: 54388 - RNA, 23 nt, Human
ugcccuccaucucagccauuggg

SEQ ID NO: 54389 - RNA, 20 nt, Human
uggaaacacuaaauguuaaa

SEQ ID NO: 54390 - RNA, 22 nt, Human
gcuccuccugcccuccaucuca

SEQ ID NO: 54391 - RNA, 22 nt, Human
cgcauguggagcgcauggggag

SEQ ID NO: 54392 - RNA, 27 nt, Human
accucacacaccucugccccuugggcc

SEQ ID NO: 54393 - RNA, 24 nt, Human
guccagccuagucuggacugcuuc

SEQ ID NO: 54394 - RNA, 23 nt, Human
aguccuccgagacggggagggag

SEQ ID NO: 54395 - RNA, 20 nt, Human
cuauuucuguuccagucaca

SEQ ID NO: 54396 - RNA, 19 nt, Human
ggugaagggaaguguuuau

SEQ ID NO: 54397 - RNA, 23 nt, Human
agaugugauuuuuguugcuuuuc

SEQ ID NO: 54398 - RNA, 24 nt, Human
ucuguaacacuuuggguauuuugc

SEQ ID NO: 54399 - RNA, 25 nt, Human
ucaucauuaaugacuuuauguauua

SEQ ID NO: 54400 - RNA, 23 nt, Human
gucccugggcucuggggcugaag

SEQ ID NO: 54401 - RNA, 22 nt, Human
cuguggucuccugugugcugcu

SEQ ID NO: 54402 - RNA, 19 nt, Human
uggcuaugccuucacuaca

SEQ ID NO: 54403 - RNA, 19 nt, Human
uucaaugccagugggccaa

SEQ ID NO: 54404 - RNA, 30 nt, Human
agauggaaacacacagaacuuaaaacucag

SEQ ID NO: 54405 - RNA, 25 nt, Human
gcugcuuccuccccuccuggcaccc

SEQ ID NO: 54406 - RNA, 21 nt, Human
uccuucagaaucuguggagca

SEQ ID NO: 54407 - RNA, 23 nt, Human
uacagaagguccugugugacccu

SEQ ID NO: 54408 - RNA, 26 nt, Human
cccugcgcuccuccacagccugggcc

SEQ ID NO: 54409 - RNA, 22 nt, Human
guccccagcccuuccucugcuc

SEQ ID NO: 54410 - RNA, 26 nt, Human
gccugccaugacgucauagcucugcg

SEQ ID NO: 54411 - RNA, 26 nt, Human
cugcagcugcugggccguggagcuuc

SEQ ID NO: 54412 - RNA, 24 nt, Human
ccacucucauuaauccaucauguu

SEQ ID NO: 54413 - RNA, 20 nt, Human
cagcccagaauagcuuugaa

SEQ ID NO: 54414 - RNA, 27 nt, Human
ccaaugccuaugccauccuccaugcuu

SEQ ID NO: 54415 - RNA, 21 nt, Human
cguggguaacagccuugggga

SEQ ID NO: 54416 - RNA, 19 nt, Human
ggccucggccuccgccgcu

SEQ ID NO: 54417 - RNA, 24 nt, Human
ucaccacaccuggcccaugguggg

SEQ ID NO: 54418 - RNA, 22 nt, Human
uccuggaggcccaguucacccu

SEQ ID NO: 54419 - RNA, 26 nt, Human
ugcuugcccuaagcagaaagugccuu

SEQ ID NO: 54420 - RNA, 19 nt, Human
uuaaggagguucaagcaga

SEQ ID NO: 54421 - RNA, 21 nt, Human
agggaaaugaugaaaauaaau

SEQ ID NO: 54422 - RNA, 24 nt, Human
cagcuggagcagcccuuucaggga

SEQ ID NO: 54423 - RNA, 25 nt, Human
agucccaguuacucgggaggcugag

SEQ ID NO: 54424 - RNA, 26 nt, Human
ggggcccgccucacaccccaguggau

SEQ ID NO: 54425 - RNA, 24 nt, Human
ugugugccuggcacucagugugug

SEQ ID NO: 54426 - RNA, 22 nt, Human
ucuccaccggaucucacccgcc

SEQ ID NO: 54427 - RNA, 21 nt, Human
ucagaagugggucugugggau

SEQ ID NO: 54428 - RNA, 22 nt, Human
uaagcaaugcuuaacacaggca

SEQ ID NO: 54429 - RNA, 22 nt, Human
gagagaagaagaaauauuucca

SEQ ID NO: 54430 - RNA, 22 nt, Human
aagaagguugucagcugcagcc

SEQ ID NO: 54431 - RNA, 23 nt, Human
acucagaacaugaaccucuuuaa

SEQ ID NO: 54432 - RNA, 21 nt, Human
cucugucgccgaggcugcagu

SEQ ID NO: 54433 - RNA, 27 nt, Human
uucacauccacauguaaucaugucugc

SEQ ID NO: 54434 - RNA, 21 nt, Human
caaaacaaucuaucccagguu

SEQ ID NO: 54435 - RNA, 19 nt, Human
cccaugcuggagugcagug

SEQ ID NO: 54436 - RNA, 20 nt, Human
uuuaaugcccugucaguccc

SEQ ID NO: 54437 - RNA, 17 nt, Human
gcuugagugaaaggagg

SEQ ID NO: 54438 - RNA, 26 nt, Human
agagccucucccaucugacccaggcc

SEQ ID NO: 54439 - RNA, 22 nt, Human
uucuacccuuucugccuucugu

SEQ ID NO: 54440 - RNA, 21 nt, Human
gcuugguucucaggcccagcc

SEQ ID NO: 54441 - RNA, 20 nt, Human
cuuuucucgcugaaagcacu

SEQ ID NO: 54442 - RNA, 21 nt, Human
agauuaggaggagaaaaagag

SEQ ID NO: 54443 - RNA, 26 nt, Human
gccugccucugcccagcuccccauuc

SEQ ID NO: 54444 - RNA, 21 nt, Human
gagggagggagggacgauggc

SEQ ID NO: 54445 - RNA, 25 nt, Human
cggagcucccccugccuccuccucc

SEQ ID NO: 54446 - RNA, 23 nt, Human
cccaaugccugccuccucacucc

SEQ ID NO: 54447 - RNA, 24 nt, Human
ucuuuaaugggccagcauucucau

SEQ ID NO: 54448 - RNA, 19 nt, Human
aaagauucauacaugugaa

SEQ ID NO: 54449 - RNA, 26 nt, Human
cauucuccaagaugcagcccaggagc

SEQ ID NO: 54450 - RNA, 20 nt, Human
cggagcgccucacagcuuag

SEQ ID NO: 54451 - RNA, 20 nt, Human
gggcugagaacccagcgaua

SEQ ID NO: 54452 - RNA, 23 nt, Human
uccuccuugcgcucaccuugcca

SEQ ID NO: 54453 - RNA, 26 nt, Human
uggcugggagucacugaugcugccuc

SEQ ID NO: 54454 - RNA, 29 nt, Human
caucuggguauggagagugcaaucacgcu

SEQ ID NO: 54455 - RNA, 20 nt, Human
gaggaagaaaacaaagggca

SEQ ID NO: 54456 - RNA, 22 nt, Human
uucauuucaucaaauucuaucu

SEQ ID NO: 54457 - RNA, 21 nt, Human
cagaggcagagauuggaguga

SEQ ID NO: 54458 - RNA, 25 nt, Human
acuucucucuguuugccugccucca

SEQ ID NO: 54459 - RNA, 22 nt, Human
aggagacaccuuuuccccccug

SEQ ID NO: 54460 - RNA, 20 nt, Human
aaagaacaaugagugugaug

SEQ ID NO: 54461 - RNA, 20 nt, Human
gcgcccaccaccacagccug

SEQ ID NO: 54462 - RNA, 19 nt, Human
uguucucuggguagguguu

SEQ ID NO: 54463 - RNA, 21 nt, Human
gagaaagaggccccugcagcu

SEQ ID NO: 54464 - RNA, 18 nt, Human
ccagguagccccaaggag

SEQ ID NO: 54465 - RNA, 19 nt, Human
gggucccaccagcccaggg

SEQ ID NO: 54466 - RNA, 21 nt, Human
cagcagccagucgcccguguc

SEQ ID NO: 54467 - RNA, 30 nt, Human
cuacauuccuuaggauuucucucccuauca

SEQ ID NO: 54468 - RNA, 24 nt, Human
auggaggaggccaggcucagagcu

SEQ ID NO: 54469 - RNA, 19 nt, Human
aacaaauuugcacaauggc

SEQ ID NO: 54470 - RNA, 25 nt, Human
caguauaagccuuuuuaaccuucca

SEQ ID NO: 54471 - RNA, 21 nt, Human
ucuaucccaauaggcagacug

SEQ ID NO: 54472 - RNA, 20 nt, Human
cuuuucuccccgccugcucc

SEQ ID NO: 54473 - RNA, 22 nt, Human
gucagcucaggcuggagcaggu

SEQ ID NO: 54474 - RNA, 23 nt, Human
aggacccaaacccagacacuuca

SEQ ID NO: 54475 - RNA, 26 nt, Human
ccaagucccuggaaaaggagcuucag

SEQ ID NO: 54476 - RNA, 23 nt, Human
gacuagaaaauuagacugugauu

SEQ ID NO: 54477 - RNA, 21 nt, Human
uauguguuuuuaagcaucccu

SEQ ID NO: 54478 - RNA, 19 nt, Human
ccuacuucuaauuugcuga

SEQ ID NO: 54479 - RNA, 17 nt, Human
cagcauuucuguccuga

SEQ ID NO: 54480 - RNA, 21 nt, Human
gcuacugcuucuaacaccucu

SEQ ID NO: 54481 - RNA, 21 nt, Human
acucauuccuucacucaucca

SEQ ID NO: 54482 - RNA, 22 nt, Human
uucaguuacacauacaccuguu

SEQ ID NO: 54483 - RNA, 22 nt, Human
ugaauugaguaaagugcaauuu

SEQ ID NO: 54484 - RNA, 22 nt, Human
gcacuucuuccucuguucccac

SEQ ID NO: 54485 - RNA, 26 nt, Human
gcuccuugccaccagugcugugucuu

SEQ ID NO: 54486 - RNA, 25 nt, Human
gacaucguguuggaggagaucaagc

SEQ ID NO: 54487 - RNA, 20 nt, Human
acaaaggcagagagucagac

SEQ ID NO: 54488 - RNA, 21 nt, Human
ccccaggaauauguguuuucc

SEQ ID NO: 54489 - RNA, 19 nt, Human
cgcugcaggcuuucuugga

SEQ ID NO: 54490 - RNA, 25 nt, Human
uggguggagagguuugucucagccu

SEQ ID NO: 54491 - RNA, 21 nt, Human
ucaggagaaguuuauucuucc

SEQ ID NO: 54492 - RNA, 20 nt, Human
ccuuuucugagcaaggucuc

SEQ ID NO: 54493 - RNA, 24 nt, Human
uacaugugugccucucacagcagu

SEQ ID NO: 54494 - RNA, 21 nt, Human
caacauacacuauagcacuuu

SEQ ID NO: 54495 - RNA, 21 nt, Human
caaagugcugggauuacaggu

SEQ ID NO: 54496 - RNA, 20 nt, Human
auccucuaagcuaacccccu

SEQ ID NO: 54497 - RNA, 20 nt, Human
cucaucugcuuucccgccac

SEQ ID NO: 54498 - RNA, 25 nt, Human
uggauaguugaguauggguuagaaa

SEQ ID NO: 54499 - RNA, 23 nt, Human
cgacccagggcgacucacgccca

SEQ ID NO: 54500 - RNA, 21 nt, Human
cauacuuuuuugcuaaacuca

SEQ ID NO: 54501 - RNA, 21 nt, Human
cagaauaugagccaaugagua

SEQ ID NO: 54502 - RNA, 27 nt, Human
ccucucaaggcccugaccucaggggcc

SEQ ID NO: 54503 - RNA, 22 nt, Human
acggcacaggagagcaaacuuc

SEQ ID NO: 54504 - RNA, 26 nt, Human
aggcauucagucugugacuguggaau

SEQ ID NO: 54505 - RNA, 24 nt, Human
ggauaaucacuuucucauuugggu

SEQ ID NO: 54506 - RNA, 24 nt, Human
cccaggagauggaaguugcaguga

SEQ ID NO: 54507 - RNA, 25 nt, Human
cacagcccaaggaccaaaggagggg

SEQ ID NO: 54508 - RNA, 22 nt, Human
uucaagcaauccuucugucuca

SEQ ID NO: 54509 - RNA, 22 nt, Human
gagacuccggcucuacaaaaaa

SEQ ID NO: 54510 - RNA, 26 nt, Human
uuuaacuguucaguuuuaucuggcag

SEQ ID NO: 54511 - RNA, 22 nt, Human
aaaaugaaaaauaaaugaagua

SEQ ID NO: 54512 - RNA, 21 nt, Human
acuugggucauaagaagggag

SEQ ID NO: 54513 - RNA, 25 nt, Human
cucugccuugucucucuuugucuua

SEQ ID NO: 54514 - RNA, 25 nt, Human
ccuaaaaacauacuuuauaacuuua

SEQ ID NO: 54515 - RNA, 23 nt, Human
uguuuuuaaaaaacauugaccug

SEQ ID NO: 54516 - RNA, 23 nt, Human
gcaguuagcagcauuuccuaucc

SEQ ID NO: 54517 - RNA, 20 nt, Human
caaguauccaaccaacuugg

SEQ ID NO: 54518 - RNA, 22 nt, Human
agcacggccgccugcagucucc

SEQ ID NO: 54519 - RNA, 32 nt, Human
ccuggucaccuaggaagccucagauuccuucc

SEQ ID NO: 54520 - RNA, 27 nt, Human
cucauaaggaggcagccaucauaacca

SEQ ID NO: 54521 - RNA, 21 nt, Human
acagggagagaacaugagucu

SEQ ID NO: 54522 - RNA, 22 nt, Human
gugacugauucccagccugugg

SEQ ID NO: 54523 - RNA, 27 nt, Human
cugggaggugggcacacaggggcaccg

SEQ ID NO: 54524 - RNA, 24 nt, Human
uuguacagauuucuauauuuugga

SEQ ID NO: 54525 - RNA, 27 nt, Human
uucuggcuuuucuacaaaauacuccug

SEQ ID NO: 54526 - RNA, 17 nt, Human
ugcaaauaaaugccuua

SEQ ID NO: 54527 - RNA, 21 nt, Human
aaauucuugccaucagaaggg

SEQ ID NO: 54528 - RNA, 27 nt, Human
uccagaagugcaagcagagaaacacgu

SEQ ID NO: 54529 - RNA, 26 nt, Human
ucuucuuugugccugaguggccugua

SEQ ID NO: 54530 - RNA, 23 nt, Human
cuaauacuggugaaaauuuaccu

SEQ ID NO: 54531 - RNA, 20 nt, Human
uugauucaagaaagacuaua

SEQ ID NO: 54532 - RNA, 22 nt, Human
cugagagaaaggcucucugagu

SEQ ID NO: 54533 - RNA, 27 nt, Human
ucauugcacuccagccugggcaacaga

SEQ ID NO: 54534 - RNA, 21 nt, Human
gcaucugaagaaaggaucccu

SEQ ID NO: 54535 - RNA, 22 nt, Human
guuccucugcuggaguucaucc

SEQ ID NO: 54536 - RNA, 21 nt, Human
ggaguuucuuaaugagauauu

SEQ ID NO: 54537 - RNA, 20 nt, Human
ugaaaccauuuuuuguacaa

SEQ ID NO: 54538 - RNA, 22 nt, Human
cacuggccgcggagugcaagag

SEQ ID NO: 54539 - RNA, 26 nt, Human
agcccccaggacccugagaggcagag

SEQ ID NO: 54540 - RNA, 22 nt, Human
ggagagaaggagguggcccugc

SEQ ID NO: 54541 - RNA, 21 nt, Human
gcuuuggcacgcaagccuggg

SEQ ID NO: 54542 - RNA, 23 nt, Human
cagcugcaagguacucuggugag

SEQ ID NO: 54543 - RNA, 24 nt, Human
accgucauauucuaauagcucaug

SEQ ID NO: 54544 - RNA, 24 nt, Human
agagacacauccucucauacuccc

SEQ ID NO: 54545 - RNA, 20 nt, Human
gcucuugucacccaggcugg

SEQ ID NO: 54546 - RNA, 23 nt, Human
gccuuuuucuccuuaaggaggcc

SEQ ID NO: 54547 - RNA, 21 nt, Human
uugcaauuacagaugcauaca

SEQ ID NO: 54548 - RNA, 26 nt, Human
cuguaucugugcuuugcccacaugcc

SEQ ID NO: 54549 - RNA, 21 nt, Human
auccucucacugcaagcacag

SEQ ID NO: 54550 - RNA, 27 nt, Human
ucugccccccucuauccuugauacaac

SEQ ID NO: 54551 - RNA, 22 nt, Human
gcgaucugggcucacugcaacc

SEQ ID NO: 54552 - RNA, 22 nt, Human
gagugagacuccgucucaaaaa

SEQ ID NO: 54553 - RNA, 21 nt, Human
gcccucacaucuuccaccagc

SEQ ID NO: 54554 - RNA, 27 nt, Human
ggaccuccagcuuccacaaacaccauc

SEQ ID NO: 54555 - RNA, 19 nt, Human
ucugugucagcacagugua

SEQ ID NO: 54556 - RNA, 21 nt, Human
cccuuuagugcuauauuugug

SEQ ID NO: 54557 - RNA, 22 nt, Human
ugucacccuggaugcccagcag

SEQ ID NO: 54558 - RNA, 22 nt, Human
caagaucacaccacugcacucc

SEQ ID NO: 54559 - RNA, 27 nt, Human
ugaccaacguggugaaacuccgucucu

SEQ ID NO: 54560 - RNA, 18 nt, Human
gcucaugccaucaugccc

SEQ ID NO: 54561 - RNA, 18 nt, Human
gaccuccaggcuucaauc

SEQ ID NO: 54562 - RNA, 20 nt, Human
uccuuuccccccuccgugcu

SEQ ID NO: 54563 - RNA, 24 nt, Human
cucagaucuucacuauggcaacuu

SEQ ID NO: 54564 - RNA, 19 nt, Human
ccucuccccaaccagccca

SEQ ID NO: 54565 - RNA, 27 nt, Human
cucauuucuauuuguuacuccuuuuua

SEQ ID NO: 54566 - RNA, 23 nt, Human
guugcccaggcuggucuugaacu

SEQ ID NO: 54567 - RNA, 23 nt, Human
cccaucaggucagcucaggcugg

SEQ ID NO: 54568 - RNA, 23 nt, Human
cgaguagcugggauuacaggagc

SEQ ID NO: 54569 - RNA, 24 nt, Human
cucacuccuccagccuggaaugug

SEQ ID NO: 54570 - RNA, 20 nt, Human
ccuggggccuaacaaaaaga

SEQ ID NO: 54571 - RNA, 26 nt, Human
ucauuucuccagucugucacccuccu

SEQ ID NO: 54572 - RNA, 21 nt, Human
cuggugguauggcacagcaga

SEQ ID NO: 54573 - RNA, 22 nt, Human
gcgugagccacugcacccagcc

SEQ ID NO: 54574 - RNA, 22 nt, Human
gcaugagccacugcacccggcc

SEQ ID NO: 54575 - RNA, 22 nt, Human
gguuuguccucagugcauugga

SEQ ID NO: 54576 - RNA, 25 nt, Human
gccccccagggucugggaccccgcu

SEQ ID NO: 54577 - RNA, 27 nt, Human
uagggucccuaaaagcauuugacacac

SEQ ID NO: 54578 - RNA, 18 nt, Human
cgggcuggaggcugugca

SEQ ID NO: 54579 - RNA, 30 nt, Human
agcucacugcaaccuccaccucuuauguuc

SEQ ID NO: 54580 - RNA, 26 nt, Human
augccccacgcugggccgcggccucu

SEQ ID NO: 54581 - RNA, 26 nt, Human
ggccacugcaaacccugcugcugccg

SEQ ID NO: 54582 - RNA, 22 nt, Human
cacccaaggcuggauguuugug

SEQ ID NO: 54583 - RNA, 21 nt, Human
gcuucucccuucuccaugaug

SEQ ID NO: 54584 - RNA, 27 nt, Human
cuccagccucggccucccaaguagcug

SEQ ID NO: 54585 - RNA, 27 nt, Human
cuccagccucagccucccaaguagcua

SEQ ID NO: 54586 - RNA, 27 nt, Human
guuucuccucuuuccuccugcuucaug

SEQ ID NO: 54587 - RNA, 26 nt, Human
uuuucuuucugcucuuuauugaagac

SEQ ID NO: 54588 - RNA, 21 nt, Human
ccagagaauggacaccaucca

SEQ ID NO: 54589 - RNA, 29 nt, Human
uccugcacuuccuccucauguagucugga

SEQ ID NO: 54590 - RNA, 27 nt, Human
ccgcugccucugggcccucccagcaca

SEQ ID NO: 54591 - RNA, 21 nt, Human
cuccaucuucaaaacaaaaca

SEQ ID NO: 54592 - RNA, 29 nt, Human
agaaauugagguuguucaaaguuuaagca

SEQ ID NO: 54593 - RNA, 26 nt, Human
acccccacccuguaacuccagcugcc

SEQ ID NO: 54594 - RNA, 23 nt, Human
gcuuuuuaauuaagcaaagcacc

SEQ ID NO: 54595 - RNA, 23 nt, Human
guguggguauauuucuggguucu

SEQ ID NO: 54596 - RNA, 27 nt, Human
cuguggaccccucaacuuccugcugcu

SEQ ID NO: 54597 - RNA, 19 nt, Human
uuuguauagguacuuaaug

SEQ ID NO: 54598 - RNA, 22 nt, Human
ggaagugaagugacuugcccag

SEQ ID NO: 54599 - RNA, 21 nt, Human
uaagccuucaguugaccuaau

SEQ ID NO: 54600 - RNA, 25 nt, Human
cugugaagacuauaauuuauuucca

SEQ ID NO: 54601 - RNA, 22 nt, Human
guacaggcuggauggaaggggc

SEQ ID NO: 54602 - RNA, 18 nt, Human
ugucccaggcugggcaga

SEQ ID NO: 54603 - RNA, 20 nt, Human
gccaugcucacccgcccaca

SEQ ID NO: 54604 - RNA, 22 nt, Human
ccccuagggacuguccuagcca

SEQ ID NO: 54605 - RNA, 23 nt, Human
uucauuugugccaaaaauauuaa

SEQ ID NO: 54606 - RNA, 28 nt, Human
accagugccuggccagccugcccccuuc

SEQ ID NO: 54607 - RNA, 20 nt, Human
aguuguagacuucgauguuu

SEQ ID NO: 54608 - RNA, 22 nt, Human
cugaggcaggaggauugcuuga

SEQ ID NO: 54609 - RNA, 23 nt, Human
ggugcaugccaccaugccaggcu

SEQ ID NO: 54610 - RNA, 23 nt, Human
uuaguaaagacgggguuuuguca

SEQ ID NO: 54611 - RNA, 20 nt, Human
cccacggaaagccucauuug

SEQ ID NO: 54612 - RNA, 26 nt, Human
cguccucagcgggcagggaacaccuc

SEQ ID NO: 54613 - RNA, 22 nt, Human
ccaggcugggguguuuucggua

SEQ ID NO: 54614 - RNA, 20 nt, Human
ccuuuuaaaaaauauaccua

SEQ ID NO: 54615 - RNA, 22 nt, Human
cagcaauguuucucuuuucuua

SEQ ID NO: 54616 - RNA, 21 nt, Human
ugcauuuucauauugcuacca

SEQ ID NO: 54617 - RNA, 21 nt, Human
cuucccuccugucauaauucc

SEQ ID NO: 54618 - RNA, 26 nt, Human
ugccuagggaggagcuaagcaggccc

SEQ ID NO: 54619 - RNA, 21 nt, Human
aauacaaaacugaauucuucc

SEQ ID NO: 54620 - RNA, 18 nt, Human
cccugcucccccacagcc

SEQ ID NO: 54621 - RNA, 22 nt, Human
uuucugcugccuccagcccugu

SEQ ID NO: 54622 - RNA, 19 nt, Human
guuguacugaucaccagaa

SEQ ID NO: 54623 - RNA, 19 nt, Human
gaggcuuucaaagcuguga

SEQ ID NO: 54624 - RNA, 22 nt, Human
acagaguuugugauaacucaua

SEQ ID NO: 54625 - RNA, 25 nt, Human
ggccccuugcucacuuugugcagug

SEQ ID NO: 54626 - RNA, 24 nt, Human
gagcaccaaagagaucuaugagga

SEQ ID NO: 54627 - RNA, 20 nt, Human
uuaacacaaguacuaauaaa

SEQ ID NO: 54628 - RNA, 27 nt, Human
ccuggucuucaguucugugcccaacgu

SEQ ID NO: 54629 - RNA, 19 nt, Human
cauaauugccgucuggacc

SEQ ID NO: 54630 - RNA, 25 nt, Human
uaggacuguuugaguuuugcagacu

SEQ ID NO: 54631 - RNA, 23 nt, Human
cggcucaagugaucuaccugccu

SEQ ID NO: 54632 - RNA, 27 nt, Human
uccuccuggucggcggcugcagcgggg

SEQ ID NO: 54633 - RNA, 23 nt, Human
gccucucucagcccacuggccug

SEQ ID NO: 54634 - RNA, 27 nt, Human
aaagugcugggauuaaagcugugagcc

SEQ ID NO: 54635 - RNA, 24 nt, Human
aggaaacuaagauuugagauucag

SEQ ID NO: 54636 - RNA, 20 nt, Human
uaaacagaggaguacaggug

SEQ ID NO: 54637 - RNA, 22 nt, Human
aagccuccuccggguacuauag

SEQ ID NO: 54638 - RNA, 24 nt, Human
aggagggaggagggugaagacuga

SEQ ID NO: 54639 - RNA, 28 nt, Human
guccucacccuccccaccacauaaacac

SEQ ID NO: 54640 - RNA, 20 nt, Human
aggcugaggcccugacgugg

SEQ ID NO: 54641 - RNA, 19 nt, Human
ucacaccucacucuuuaua

SEQ ID NO: 54642 - RNA, 27 nt, Human
aagcuauucaacuuugcuuagcuaauc

SEQ ID NO: 54643 - RNA, 21 nt, Human
cacacuguaaccucagucuac

SEQ ID NO: 54644 - RNA, 29 nt, Human
ccugggcuuucugcucccugcccagaucc

SEQ ID NO: 54645 - RNA, 22 nt, Human
gugugagccacccugcccagcc

SEQ ID NO: 54646 - RNA, 20 nt, Human
ggaaacacucugcuccuggg

SEQ ID NO: 54647 - RNA, 30 nt, Human
uugcaaaccaggcugugaccaacacaugug

SEQ ID NO: 54648 - RNA, 25 nt, Human
agcuuuucauguaaauuagucuugg

SEQ ID NO: 54649 - RNA, 27 nt, Human
gucagccuugcuuggaauucuggcagg

SEQ ID NO: 54650 - RNA, 19 nt, Human
ugggggaauguguuccuuc

SEQ ID NO: 54651 - RNA, 22 nt, Human
aggcugggcuucaguggcagcu

SEQ ID NO: 54652 - RNA, 18 nt, Human
acacacacaacugaucua

SEQ ID NO: 54653 - RNA, 22 nt, Human
ucuaaacacacuaguuuggauu

SEQ ID NO: 54654 - RNA, 21 nt, Human
caaaacaaacccaaauuggua

SEQ ID NO: 54655 - RNA, 23 nt, Human
ugaauuccugggccuccugcaga

SEQ ID NO: 54656 - RNA, 25 nt, Human
uggacuuuuuucauguuuucuucac

SEQ ID NO: 54657 - RNA, 19 nt, Human
gccacccucagugccacaa

SEQ ID NO: 54658 - RNA, 21 nt, Human
gccuguaaucccagcucuuug

SEQ ID NO: 54659 - RNA, 23 nt, Human
cucauuucugacccacuuuuucc

SEQ ID NO: 54660 - RNA, 23 nt, Human
cuccucccucuacucagccuuaa

SEQ ID NO: 54661 - RNA, 27 nt, Human
cuugcagccaaguucccugguuucugg

SEQ ID NO: 54662 - RNA, 23 nt, Human
guggagcuguggcagggggcacu

SEQ ID NO: 54663 - RNA, 27 nt, Human
cugccuugccccugagcacuucuggag

SEQ ID NO: 54664 - RNA, 22 nt, Human
ugacauggagugaagugcaaua

SEQ ID NO: 54665 - RNA, 27 nt, Human
gugaaggagggaggccucuuugcaguu

SEQ ID NO: 54666 - RNA, 23 nt, Human
cucacacacgugcagauauugcc

SEQ ID NO: 54667 - RNA, 26 nt, Human
gcugcugcuguggccccagcagguuc

SEQ ID NO: 54668 - RNA, 22 nt, Human
caccuguaaucccagcacuuug

SEQ ID NO: 54669 - RNA, 24 nt, Human
caaugcuguuuauauuuuggguga

SEQ ID NO: 54670 - RNA, 19 nt, Human
cacuccugcccacgcccac

SEQ ID NO: 54671 - RNA, 27 nt, Human
ccugcuguucugcuuaggggcuuggcu

SEQ ID NO: 54672 - RNA, 22 nt, Human
aagucagaguuggaagggucau

SEQ ID NO: 54673 - RNA, 23 nt, Human
cuuaccucaccucccuccauuua

SEQ ID NO: 54674 - RNA, 22 nt, Human
cuauaacaucugcuggaguguu

SEQ ID NO: 54675 - RNA, 23 nt, Human
ccacuucugggaggucagcagag

SEQ ID NO: 54676 - RNA, 19 nt, Human
aucuguauuuguuucuuua

SEQ ID NO: 54677 - RNA, 22 nt, Human
uaccuguaauccuagcacuuug

SEQ ID NO: 54678 - RNA, 22 nt, Human
gcagagugggggcagugccuug

SEQ ID NO: 54679 - RNA, 20 nt, Human
ucucacuauguugcccaggc

SEQ ID NO: 54680 - RNA, 25 nt, Human
agaggggcuaucaucugggagccug

SEQ ID NO: 54681 - RNA, 21 nt, Human
gcgggguuucgccauguugcc

SEQ ID NO: 54682 - RNA, 25 nt, Human
gcuugucccagccacucuagcugcu

SEQ ID NO: 54683 - RNA, 22 nt, Human
gacucugcuccugcauggaaag

SEQ ID NO: 54684 - RNA, 23 nt, Human
uauacucuaaaauggacauuuuc

SEQ ID NO: 54685 - RNA, 21 nt, Human
aagacccuuuuugauuaccca

SEQ ID NO: 54686 - RNA, 26 nt, Human
agcuuguuccacugcaaauaaagccu

SEQ ID NO: 54687 - RNA, 22 nt, Human
ccagaauggacccagggacaag

SEQ ID NO: 54688 - RNA, 23 nt, Human
ggcuacauaaucacuccaugcgg

SEQ ID NO: 54689 - RNA, 28 nt, Human
gggcgugggaggagggaggcggccucca

SEQ ID NO: 54690 - RNA, 22 nt, Human
ggccuggaaggaaccucuuaaa

SEQ ID NO: 54691 - RNA, 23 nt, Human
cugucaccaggcuggagugcagu

SEQ ID NO: 54692 - RNA, 22 nt, Human
ggcagggcaggcagagcucagc

SEQ ID NO: 54693 - RNA, 22 nt, Human
gacuucucuguuugaguuggga

SEQ ID NO: 54694 - RNA, 21 nt, Human
uaucuuuaauucugggagaaa

SEQ ID NO: 54695 - RNA, 22 nt, Human
cacaacuguaaccgcugccccg

SEQ ID NO: 54696 - RNA, 27 nt, Human
agacccuagcuuuaagagaagcuguau

SEQ ID NO: 54697 - RNA, 22 nt, Human
gcuucauuuaaaaccauuucag

SEQ ID NO: 54698 - RNA, 20 nt, Human
agagggccugugggagccug

SEQ ID NO: 54699 - RNA, 27 nt, Human
aaagaaugcagagaugugcccccaccc

SEQ ID NO: 54700 - RNA, 25 nt, Human
ucacaauuacaucucuucuaggaaa

SEQ ID NO: 54701 - RNA, 21 nt, Human
acauaguuuauuuuuacacug

SEQ ID NO: 54702 - RNA, 20 nt, Human
cuggccuggcccccagcuuc

SEQ ID NO: 54703 - RNA, 23 nt, Human
gcauuaaaaacugugcuagucuc

SEQ ID NO: 54704 - RNA, 22 nt, Human
ucaauuugccauugguuucuga

SEQ ID NO: 54705 - RNA, 22 nt, Human
agaguuaucaagagacacuccc

SEQ ID NO: 54706 - RNA, 19 nt, Human
cauuuucagcaacauccca

SEQ ID NO: 54707 - RNA, 22 nt, Human
ucucugcccugaugcugccuca

SEQ ID NO: 54708 - RNA, 21 nt, Human
caaagugcugggauuacaggc

SEQ ID NO: 54709 - RNA, 21 nt, Human
uaaagugcugggauuauaggc

SEQ ID NO: 54710 - RNA, 22 nt, Human
ccaugcggguccauaacagcca

SEQ ID NO: 54711 - RNA, 22 nt, Human
cuaaggcaggcagaucacuuga

SEQ ID NO: 54712 - RNA, 21 nt, Human
ccauccacaggaaauggacua

SEQ ID NO: 54713 - RNA, 19 nt, Human
uuugccuccacgagccugc

SEQ ID NO: 54714 - RNA, 21 nt, Human
acucacccucucugugcuguc

SEQ ID NO: 54715 - RNA, 21 nt, Human
cccugacccagagccuagggg

SEQ ID NO: 54716 - RNA, 22 nt, Human
cgugccuguacucccagcacuu

SEQ ID NO: 54717 - RNA, 23 nt, Human
ggggugggggagaaaaaaucacu

SEQ ID NO: 54718 - RNA, 25 nt, Human
guggagaggggacuuggauaggagc

SEQ ID NO: 54719 - RNA, 28 nt, Human
gcugggucccaccuggccuccuccugcc

SEQ ID NO: 54720 - RNA, 24 nt, Human
acugugagcuuuugccugccugug

SEQ ID NO: 54721 - RNA, 16 nt, Human
acacccagcucaggga

SEQ ID NO: 54722 - RNA, 24 nt, Human
ccaggggaacgaggagaucugugu

SEQ ID NO: 54723 - RNA, 22 nt, Human
gccaugauuuugucacugacau

SEQ ID NO: 54724 - RNA, 21 nt, Human
cauugugauggaugcuggaac

SEQ ID NO: 54725 - RNA, 21 nt, Human
cacccaggcuggagugcuaug

SEQ ID NO: 54726 - RNA, 21 nt, Human
cucccaggcuggagugcaaug

SEQ ID NO: 54727 - RNA, 22 nt, Human
ucccaagcuggagugcaguggu

SEQ ID NO: 54728 - RNA, 23 nt, Human
uuguugugauuuucagcaccugg

SEQ ID NO: 54729 - RNA, 23 nt, Human
gugaacaaacauacgcugcuuua

SEQ ID NO: 54730 - RNA, 25 nt, Human
cccagcauacuuugugaaccuggcu

SEQ ID NO: 54731 - RNA, 26 nt, Human
cccagccuguagggaacuuucuggac

SEQ ID NO: 54732 - RNA, 28 nt, Human
agucaaaccacaaccauucuuucuuguc

SEQ ID NO: 54733 - RNA, 25 nt, Human
uuggugccauaauuucuccuuucac

SEQ ID NO: 54734 - RNA, 22 nt, Human
aaaagagaugccuuuuguguuu

SEQ ID NO: 54735 - RNA, 27 nt, Human
uugcuaccucagucaguauuguuuugg

SEQ ID NO: 54736 - RNA, 20 nt, Human
uguccuccuccuucuccggc

SEQ ID NO: 54737 - RNA, 27 nt, Human
gggagagacuuggaugaggagugguug

SEQ ID NO: 54738 - RNA, 23 nt, Human
guguguaguuucugaaagcaaac

SEQ ID NO: 54739 - RNA, 24 nt, Human
ccgcuaucuuuuggguucauucca

SEQ ID NO: 54740 - RNA, 22 nt, Human
caggcuggagugcagucgugcc

SEQ ID NO: 54741 - RNA, 23 nt, Human
cacuggccgccucuccuugccag

SEQ ID NO: 54742 - RNA, 24 nt, Human
uuugcuuuuucccugccugucuug

SEQ ID NO: 54743 - RNA, 20 nt, Human
ggggucaggguuugagacca

SEQ ID NO: 54744 - RNA, 20 nt, Human
uuucagauggaaaacuuaca

SEQ ID NO: 54745 - RNA, 23 nt, Human
aacccuguaugguuuuuaguuua

SEQ ID NO: 54746 - RNA, 20 nt, Human
uggcuccagguggccuggug

SEQ ID NO: 54747 - RNA, 25 nt, Human
gagguggauucauguccagagcuca

SEQ ID NO: 54748 - RNA, 22 nt, Human
cugggcuuugucaugucucugg

SEQ ID NO: 54749 - RNA, 19 nt, Human
auugucccaaaaguaccug

SEQ ID NO: 54750 - RNA, 21 nt, Human
gacacucagacuugcccuaau

SEQ ID NO: 54751 - RNA, 27 nt, Human
cacagccgcucacuccccgugccucug

SEQ ID NO: 54752 - RNA, 22 nt, Human
uuucagucuuuaugucaccuca

SEQ ID NO: 54753 - RNA, 27 nt, Human
cagauacaugaacaugucuuacauggg

SEQ ID NO: 54754 - RNA, 22 nt, Human
gcccucacuggccuugugacgg

SEQ ID NO: 54755 - RNA, 25 nt, Human
ggcuguauccagccuuuccuugcau

SEQ ID NO: 54756 - RNA, 21 nt, Human
ggcagucuccccuuccuggca

SEQ ID NO: 54757 - RNA, 26 nt, Human
uacaggugucagaucagaauuuuuaa

SEQ ID NO: 54758 - RNA, 23 nt, Human
ggggugaggggauggagagggag

SEQ ID NO: 54759 - RNA, 24 nt, Human
agacccagcauacaaacaagagcu

SEQ ID NO: 54760 - RNA, 20 nt, Human
ccuuccucacuuccauacag

SEQ ID NO: 54761 - RNA, 24 nt, Human
cuggccaggaggccucacauccag

SEQ ID NO: 54762 - RNA, 20 nt, Human
cuuccaucuggcugccuuug

SEQ ID NO: 54763 - RNA, 23 nt, Human
cuggggcagugucugucacuggc

SEQ ID NO: 54764 - RNA, 27 nt, Human
ugcacacacauuggcggguggggugca

SEQ ID NO: 54765 - RNA, 27 nt, Human
ccaacagcaccaauuguacauucucug

SEQ ID NO: 54766 - RNA, 21 nt, Human
cuugcagagacacguaccaca

SEQ ID NO: 54767 - RNA, 19 nt, Human
caagugagaaggggagcag

SEQ ID NO: 54768 - RNA, 21 nt, Human
aaauguucauuauaaacucua

SEQ ID NO: 54769 - RNA, 20 nt, Human
ggcucuacugccuuguucca

SEQ ID NO: 54770 - RNA, 19 nt, Human
ugcacuccccucagccucc

SEQ ID NO: 54771 - RNA, 22 nt, Human
acacuauacucuaaaauggaca

SEQ ID NO: 54772 - RNA, 23 nt, Human
ccacaggcaaggggguugcagug

SEQ ID NO: 54773 - RNA, 25 nt, Human
guggcucucuuuucaucuuugaugu

SEQ ID NO: 54774 - RNA, 29 nt, Human
guaauauauuucuguggcaucaaauuuua

SEQ ID NO: 54775 - RNA, 26 nt, Human
cgaguggggucaggugccugcagcgc

SEQ ID NO: 54776 - RNA, 23 nt, Human
cugacaucugggccccgcgccac

SEQ ID NO: 54777 - RNA, 22 nt, Human
ggggaggcagagguugcgguga

SEQ ID NO: 54778 - RNA, 21 nt, Human
caaugccaaccuuaguguuuc

SEQ ID NO: 54779 - RNA, 22 nt, Human
gggcccccuucuuucggcuuuc

SEQ ID NO: 54780 - RNA, 22 nt, Human
ggcuggccagucacugagggaa

SEQ ID NO: 54781 - RNA, 24 nt, Human
gcacagccugcacuugggggcuca

SEQ ID NO: 54782 - RNA, 31 nt, Human
cucuuuggaaucgugaacacaggugugcuau

SEQ ID NO: 54783 - RNA, 25 nt, Human
acgguaaucugcauuuugucucuuu

SEQ ID NO: 54784 - RNA, 21 nt, Human
aggagguuccucacacacaac

SEQ ID NO: 54785 - RNA, 26 nt, Human
ggaggugggagugaggagaugagggc

SEQ ID NO: 54786 - RNA, 24 nt, Human
cuggcccuggcugaccccaaagag

SEQ ID NO: 54787 - RNA, 24 nt, Human
gggcagccugugccugccuuugug

SEQ ID NO: 54788 - RNA, 26 nt, Human
gggcccagggaguuuacucagagcuc

SEQ ID NO: 54789 - RNA, 22 nt, Human
gugaagggaagagacagcccag

SEQ ID NO: 54790 - RNA, 21 nt, Human
cacagccgucacaugguccuc

SEQ ID NO: 54791 - RNA, 23 nt, Human
uuuauuauguuuucucuccauca

SEQ ID NO: 54792 - RNA, 27 nt, Human
agcaguuucugcauuauuugugcauuu

SEQ ID NO: 54793 - RNA, 22 nt, Human
guacauguuacacuucacaaaa

SEQ ID NO: 54794 - RNA, 21 nt, Human
agcagauaaaaucuacuccaa

SEQ ID NO: 54795 - RNA, 22 nt, Human
uggugaguaaaagcugcagaua

SEQ ID NO: 54796 - RNA, 26 nt, Human
guuuacuuaacaguugguuggguagu

SEQ ID NO: 54797 - RNA, 22 nt, Human
aacaucauuagaacaaaggaca

SEQ ID NO: 54798 - RNA, 26 nt, Human
guuauggcuucacauucauugcagug

SEQ ID NO: 54799 - RNA, 27 nt, Human
ggucucaaacuccugaccucaggugau

SEQ ID NO: 54800 - RNA, 21 nt, Human
guucaauguugacacugugag

SEQ ID NO: 54801 - RNA, 20 nt, Human
gugaaaaauuaacaugugga

SEQ ID NO: 54802 - RNA, 21 nt, Human
uggauaauauccagccuccca

SEQ ID NO: 54803 - RNA, 24 nt, Human
cuggagggcuagaaccuggaaggg

SEQ ID NO: 54804 - RNA, 25 nt, Human
gcccgcuggccccaggaccugcacu

SEQ ID NO: 54805 - RNA, 23 nt, Human
uuugcaaaugccauauauucaaa

SEQ ID NO: 54806 - RNA, 23 nt, Human
acacacacagucuucacugugcu

SEQ ID NO: 54807 - RNA, 27 nt, Human
aaagcauuugaagaaauaguacgacaa

SEQ ID NO: 54808 - RNA, 24 nt, Human
agcaugaaggaaaugaagcuggag

SEQ ID NO: 54809 - RNA, 22 nt, Human
cccgaguugcugggauugcggg

SEQ ID NO: 54810 - RNA, 26 nt, Human
uguggcaucagucccugagucaccau

SEQ ID NO: 54811 - RNA, 22 nt, Human
uucugagcagucuuguaauauu

SEQ ID NO: 54812 - RNA, 27 nt, Human
cuuaccuccucuucccccauuaaggca

SEQ ID NO: 54813 - RNA, 25 nt, Human
uucugccuuuuaauuuuguaugagg

SEQ ID NO: 54814 - RNA, 22 nt, Human
ccagaguugggggccucugagu

SEQ ID NO: 54815 - RNA, 22 nt, Human
ccagauuguggauuggccugua

SEQ ID NO: 54816 - RNA, 21 nt, Human
ccccaacaaacucauggcguu

SEQ ID NO: 54817 - RNA, 22 nt, Human
gcgagccuggccaacaugguga

SEQ ID NO: 54818 - RNA, 22 nt, Human
cugcaaccucugccucccgggc

SEQ ID NO: 54819 - RNA, 22 nt, Human
cugcaaccucugcuucccgggu

SEQ ID NO: 54820 - RNA, 23 nt, Human
gaucagaucccuccuucagcugu

SEQ ID NO: 54821 - RNA, 22 nt, Human
augguaaaguuaaaaugacaaa

SEQ ID NO: 54822 - RNA, 21 nt, Human
ucagcagggugcaugaugcca

SEQ ID NO: 54823 - RNA, 22 nt, Human
ugcauucacaaggugacuggga

SEQ ID NO: 54824 - RNA, 20 nt, Human
cgcccaggcuggagugcagg

SEQ ID NO: 54825 - RNA, 25 nt, Human
ugcccagccccuccugauuucuuug

SEQ ID NO: 54826 - RNA, 21 nt, Human
cacucccuuuuuguaacuccc

SEQ ID NO: 54827 - RNA, 20 nt, Human
gauuguauuuuugcaccuua

SEQ ID NO: 54828 - RNA, 22 nt, Human
ccaggaggcggagcuggcagug

SEQ ID NO: 54829 - RNA, 22 nt, Human
uucucagguggcaauguaacuc

SEQ ID NO: 54830 - RNA, 26 nt, Human
cccacuaccuccuccaacaaaggagu

SEQ ID NO: 54831 - RNA, 21 nt, Human
ccacuuucugcugcaguauug

SEQ ID NO: 54832 - RNA, 19 nt, Human
gcugcucucccuuggaacc

SEQ ID NO: 54833 - RNA, 19 nt, Human
acugucucaaaacaaaaca

SEQ ID NO: 54834 - RNA, 21 nt, Human
cccugaaaagccucaugucug

SEQ ID NO: 54835 - RNA, 19 nt, Human
cacaacccaauaggagucu

SEQ ID NO: 54836 - RNA, 23 nt, Human
cacaaaguuucucauauccuguu

SEQ ID NO: 54837 - RNA, 18 nt, Human
ggaacggaagaaaccuau

SEQ ID NO: 54838 - RNA, 21 nt, Human
uuggaaggcggaguucaggcu

SEQ ID NO: 54839 - RNA, 23 nt, Human
ugccgggaguguugagugaaggg

SEQ ID NO: 54840 - RNA, 21 nt, Human
cacauucuuauuaauucuuca

SEQ ID NO: 54841 - RNA, 24 nt, Human
accauuuucaagagggacgguauu

SEQ ID NO: 54842 - RNA, 23 nt, Human
auuuaucauaucccuuuucuccu

SEQ ID NO: 54843 - RNA, 24 nt, Human
ucugcucccgccagccuuguuuuc

SEQ ID NO: 54844 - RNA, 23 nt, Human
uacugugaacccugugccugugu

SEQ ID NO: 54845 - RNA, 24 nt, Human
ccugguugagaagcaacgagggcu

SEQ ID NO: 54846 - RNA, 27 nt, Human
gaaaugcugggcugacggugcagucug

SEQ ID NO: 54847 - RNA, 19 nt, Human
caaucagcaauugaaagcu

SEQ ID NO: 54848 - RNA, 27 nt, Human
gacgagauaaugugaacuagcuggaau

SEQ ID NO: 54849 - RNA, 23 nt, Human
cauccucacucagcugcugccuc

SEQ ID NO: 54850 - RNA, 22 nt, Human
gcacagacaugaacaucuauug

SEQ ID NO: 54851 - RNA, 23 nt, Human
ccagcuuuuaugacgcaccugaa

SEQ ID NO: 54852 - RNA, 22 nt, Human
cccagccaacaggacguucuug

SEQ ID NO: 54853 - RNA, 21 nt, Human
cccgccaacccugccugccgc

SEQ ID NO: 54854 - RNA, 15 nt, Human
ucagcagucaacuga

SEQ ID NO: 54855 - RNA, 22 nt, Human
cccucugccucacucucuugcu

SEQ ID NO: 54856 - RNA, 27 nt, Human
aucugaaaagaauacauacucuuucca

SEQ ID NO: 54857 - RNA, 21 nt, Human
aacuccuggcuucaagcaguc

SEQ ID NO: 54858 - RNA, 22 nt, Human
cacucugugaggagugagggaa

SEQ ID NO: 54859 - RNA, 21 nt, Human
acuagcacuguucuguccuca

SEQ ID NO: 54860 - RNA, 16 nt, Human
cuucccuugauggucc

SEQ ID NO: 54861 - RNA, 23 nt, Human
ccucaggugaucugccugccuca

SEQ ID NO: 54862 - RNA, 19 nt, Human
guagguuugccaagucuuu

SEQ ID NO: 54863 - RNA, 21 nt, Human
ggagauggaacauagauuagu

SEQ ID NO: 54864 - RNA, 20 nt, Human
agccggccccgggaggagag

SEQ ID NO: 54865 - RNA, 24 nt, Human
gcaguuuccucucccagcgccucg

SEQ ID NO: 54866 - RNA, 23 nt, Human
ggggaugaagacacugcugccau

SEQ ID NO: 54867 - RNA, 26 nt, Human
uggcaggauaagaaaaauaggucaga

SEQ ID NO: 54868 - RNA, 22 nt, Human
gcagccgccccgauaugccccg

SEQ ID NO: 54869 - RNA, 22 nt, Human
ucagacggguaugcagaaggau

SEQ ID NO: 54870 - RNA, 27 nt, Human
cuugcagaauggucaccucacccacuu

SEQ ID NO: 54871 - RNA, 27 nt, Human
gcugggagggaggguugugucaggcuu

SEQ ID NO: 54872 - RNA, 26 nt, Human
cgggcugucaggaaaccuaccugaac

SEQ ID NO: 54873 - RNA, 21 nt, Human
aaaccaaugcucuauauugcu

SEQ ID NO: 54874 - RNA, 20 nt, Human
ccgguccuuuugccauacac

SEQ ID NO: 54875 - RNA, 21 nt, Human
ugcuuguuugcuucaacuguc

SEQ ID NO: 54876 - RNA, 23 nt, Human
aaagaaccguguuggugcugcua

SEQ ID NO: 54877 - RNA, 26 nt, Human
auuuuucuuaacaaguuagaaaauuc

SEQ ID NO: 54878 - RNA, 24 nt, Human
gggaccacccugggccuccuuucu

SEQ ID NO: 54879 - RNA, 26 nt, Human
cucagccaugagcaacaggaguagcu

SEQ ID NO: 54880 - RNA, 25 nt, Human
ucacacccaaagcauuuugccuacc

SEQ ID NO: 54881 - RNA, 31 nt, Human
uuugaaagcucagugucugugcuaugacuug

SEQ ID NO: 54882 - RNA, 26 nt, Human
cagcacagaugccauuagaaugugaa

SEQ ID NO: 54883 - RNA, 21 nt, Human
gcuccauccuuccucugugca

SEQ ID NO: 54884 - RNA, 25 nt, Human
uaaggggaggggguguaagagccag

SEQ ID NO: 54885 - RNA, 22 nt, Human
acugcaagcuccgccucccagg

SEQ ID NO: 54886 - RNA, 24 nt, Human
gcacagaagaugggaacacuggug

SEQ ID NO: 54887 - RNA, 23 nt, Human
gccacaggaucccagcacuuugg

SEQ ID NO: 54888 - RNA, 27 nt, Human
cacugcacuccagccugggcaacggau

SEQ ID NO: 54889 - RNA, 24 nt, Human
cacuauauacaucacguuaaagua

SEQ ID NO: 54890 - RNA, 21 nt, Human
agacaacccuggguagccugu

SEQ ID NO: 54891 - RNA, 25 nt, Human
gcccaggcuggagugcaguggugcc

SEQ ID NO: 54892 - RNA, 24 nt, Human
gcuuccuucugucauuccccucuu

SEQ ID NO: 54893 - RNA, 25 nt, Human
ggagcugggggaggcaguggcggcu

SEQ ID NO: 54894 - RNA, 24 nt, Human
agcagcagcagcagcagcacaauu

SEQ ID NO: 54895 - RNA, 20 nt, Human
gcaagaaugaagaugaagcc

SEQ ID NO: 54896 - RNA, 20 nt, Human
cucccuggacccucccucca

SEQ ID NO: 54897 - RNA, 21 nt, Human
ccccaguucaagacuuagcuc

SEQ ID NO: 54898 - RNA, 19 nt, Human
uccugcagguagcagucuc

SEQ ID NO: 54899 - RNA, 29 nt, Human
ucccgaagaaugaacccaagagcaagggc

SEQ ID NO: 54900 - RNA, 20 nt, Human
uuaacucccuccaccagccu

SEQ ID NO: 54901 - RNA, 22 nt, Human
ugucgcccaggcuggaguacag

SEQ ID NO: 54902 - RNA, 22 nt, Human
ugucgcccagacuggagugcag

SEQ ID NO: 54903 - RNA, 26 nt, Human
cacaaggucuggagaccccggguggc

SEQ ID NO: 54904 - RNA, 22 nt, Human
ccaaaucuuugcaccuaguaga

SEQ ID NO: 54905 - RNA, 22 nt, Human
cacuguauuccagacuggguga

SEQ ID NO: 54906 - RNA, 21 nt, Human
ucuccgacugugccugcuugc

SEQ ID NO: 54907 - RNA, 21 nt, Human
ggcuaauuuuguauuuuuagu

SEQ ID NO: 54908 - RNA, 25 nt, Human
ggccuccucccuuagcucccuguuc

SEQ ID NO: 54909 - RNA, 23 nt, Human
ccaaucauuugccauuuaugaca

SEQ ID NO: 54910 - RNA, 27 nt, Human
cacugcacuccagcuugggcaacagag

SEQ ID NO: 54911 - RNA, 27 nt, Human
cacugcacuccagccugggcaauagag

SEQ ID NO: 54912 - RNA, 20 nt, Human
augccuucuccauuacuuga

SEQ ID NO: 54913 - RNA, 27 nt, Human
cauccuccuuuuuaacuucucuccucc

SEQ ID NO: 54914 - RNA, 19 nt, Human
uuuggccaucaaaauccag

SEQ ID NO: 54915 - RNA, 27 nt, Human
uggagcuucccucacagaccccaucug

SEQ ID NO: 54916 - RNA, 22 nt, Human
ugcagcccugcaccugccugcc

SEQ ID NO: 54917 - RNA, 21 nt, Human
uagagugcugggauuacaggu

SEQ ID NO: 54918 - RNA, 26 nt, Human
uguccucccuucccugcagcuccagu

SEQ ID NO: 54919 - RNA, 19 nt, Human
acauuuccaucaccccaga

SEQ ID NO: 54920 - RNA, 21 nt, Human
guuucauauuuuucuuuugac

SEQ ID NO: 54921 - RNA, 20 nt, Human
ccaaugccuuccacugcucc

SEQ ID NO: 54922 - RNA, 25 nt, Human
aaacacuugcaaacauuuuauucag

SEQ ID NO: 54923 - RNA, 27 nt, Human
cccacccccagcucugccagugcucuc

SEQ ID NO: 54924 - RNA, 20 nt, Human
ccacacagcuacagcuuucu

SEQ ID NO: 54925 - RNA, 26 nt, Human
cucucauuccccagguggcugaccca

SEQ ID NO: 54926 - RNA, 26 nt, Human
gcagacccugcccuuguuuggggcag

SEQ ID NO: 54927 - RNA, 22 nt, Human
ccauugcacugcagccugggug

SEQ ID NO: 54928 - RNA, 23 nt, Human
uucugccaagauucaagcagucg

SEQ ID NO: 54929 - RNA, 26 nt, Human
caggcccaagggacaaaaagaacaga

SEQ ID NO: 54930 - RNA, 17 nt, Human
uuccaauaaccaccuaa

SEQ ID NO: 54931 - RNA, 20 nt, Human
gcccuugggcuuccugccuu

SEQ ID NO: 54932 - RNA, 24 nt, Human
ccaugaggggccaagacacugccu

SEQ ID NO: 54933 - RNA, 22 nt, Human
cuguuugcaggggacacgguca

SEQ ID NO: 54934 - RNA, 22 nt, Human
gugccucugugcuguguaugug

SEQ ID NO: 54935 - RNA, 26 nt, Human
cagcacuuugacugcucuggaguagg

SEQ ID NO: 54936 - RNA, 24 nt, Human
cacgaaguuuucauuaaagccaca

SEQ ID NO: 54937 - RNA, 20 nt, Human
gaguaacagcagccaccgcc

SEQ ID NO: 54938 - RNA, 21 nt, Human
cuuaaaaagguuacuucuugg

SEQ ID NO: 54939 - RNA, 19 nt, Human
uucugccuuguuccagaaa

SEQ ID NO: 54940 - RNA, 22 nt, Human
cgcuugagacugggaggcagag

SEQ ID NO: 54941 - RNA, 27 nt, Human
gccagccuggucccauggaaaaugaug

SEQ ID NO: 54942 - RNA, 25 nt, Human
cugucucuuaaagggccccgggccg

SEQ ID NO: 54943 - RNA, 21 nt, Human
aucucaagugcuucagucuuu

SEQ ID NO: 54944 - RNA, 25 nt, Human
cuaggcccacugcagguccugccag

SEQ ID NO: 54945 - RNA, 21 nt, Human
aaacagcauggagaaaacccg

SEQ ID NO: 54946 - RNA, 20 nt, Human
agcgccgccucugugcccag

SEQ ID NO: 54947 - RNA, 26 nt, Human
ccuccaggcaggccaggcugccucgg

SEQ ID NO: 54948 - RNA, 23 nt, Human
ccuugucacugucucccugccug

SEQ ID NO: 54949 - RNA, 26 nt, Human
caggcuucagcacuuccuuuggugug

SEQ ID NO: 54950 - RNA, 21 nt, Human
gagagugaggcuggggguucu

SEQ ID NO: 54951 - RNA, 19 nt, Human
aauguaaaccauguaucug

SEQ ID NO: 54952 - RNA, 24 nt, Human
uccuaccuugugcuuagcuuucag

SEQ ID NO: 54953 - RNA, 26 nt, Human
cauuagacuuaaauuuuaauucuuca

SEQ ID NO: 54954 - RNA, 24 nt, Human
ucucagcccuucaguuuggucugc

SEQ ID NO: 54955 - RNA, 20 nt, Human
ugucaucugcaaauacagac

SEQ ID NO: 54956 - RNA, 21 nt, Human
augauuacaccuguaaaguaa

SEQ ID NO: 54957 - RNA, 25 nt, Human
uaugggacuguuuacaaaugaguga

SEQ ID NO: 54958 - RNA, 22 nt, Human
agcucaguugcccagacuggag

SEQ ID NO: 54959 - RNA, 20 nt, Human
uucucucuugcauagauaca

SEQ ID NO: 54960 - RNA, 19 nt, Human
acagaggcaucagcaucga

SEQ ID NO: 54961 - RNA, 25 nt, Human
auauuucucauuaucuugucacuua

SEQ ID NO: 54962 - RNA, 22 nt, Human
gggaauggaaggcuuugccaug

SEQ ID NO: 54963 - RNA, 22 nt, Human
cuagcuggugugguugcaguga

SEQ ID NO: 54964 - RNA, 25 nt, Human
cuucaaaccuuugugugcggaguca

SEQ ID NO: 54965 - RNA, 22 nt, Human
gucagagaccgcugcuucccuc

SEQ ID NO: 54966 - RNA, 24 nt, Human
acuagauuuuaaaaagcuacuuuc

SEQ ID NO: 54967 - RNA, 22 nt, Human
gggcuuuuaaauaaauagaugu

SEQ ID NO: 54968 - RNA, 22 nt, Human
ccaacauggugaaaccguaucu

SEQ ID NO: 54969 - RNA, 20 nt, Human
aauugcagaagcacaagcca

SEQ ID NO: 54970 - RNA, 22 nt, Human
uaugaacacacgugaaguguug

SEQ ID NO: 54971 - RNA, 23 nt, Human
agacaguguuuaauuuucgaaaa

SEQ ID NO: 54972 - RNA, 21 nt, Human
uccugcaccagccccagcucc

SEQ ID NO: 54973 - RNA, 19 nt, Human
uccucccuccucuuucaca

SEQ ID NO: 54974 - RNA, 28 nt, Human
cucucguuucuccuccaucugugcuuau

SEQ ID NO: 54975 - RNA, 20 nt, Human
caaauugacauguugucaca

SEQ ID NO: 54976 - RNA, 22 nt, Human
gaggagggggagguugguuccu

SEQ ID NO: 54977 - RNA, 22 nt, Human
gcauccagcuggcccgccaggg

SEQ ID NO: 54978 - RNA, 24 nt, Human
ccacccugggccacugccugcucc

SEQ ID NO: 54979 - RNA, 23 nt, Human
uguaauagacaacuccagauuga

SEQ ID NO: 54980 - RNA, 27 nt, Human
aggguccaucucagagaauuuacgagc

SEQ ID NO: 54981 - RNA, 21 nt, Human
uuugagaaugaaguugucauu

SEQ ID NO: 54982 - RNA, 26 nt, Human
uucucagaauucucuggacugaggcu

SEQ ID NO: 54983 - RNA, 25 nt, Human
augagaugucaccaggauaagacca

SEQ ID NO: 54984 - RNA, 26 nt, Human
uaggaaccggggcagagucagcucug

SEQ ID NO: 54985 - RNA, 23 nt, Human
uggaccccccuuucacaggcagc

SEQ ID NO: 54986 - RNA, 20 nt, Human
auugcacuucacugcagcuu

SEQ ID NO: 54987 - RNA, 24 nt, Human
ccccucccugugcuggagccuguc

SEQ ID NO: 54988 - RNA, 22 nt, Human
auuccuuaaaaccagaaacuga

SEQ ID NO: 54989 - RNA, 27 nt, Human
gugugcagggcaggucagggaagggca

SEQ ID NO: 54990 - RNA, 25 nt, Human
gcccuccucucccucccagauggac

SEQ ID NO: 54991 - RNA, 23 nt, Human
ugcaguauugcauucauuacaaa

SEQ ID NO: 54992 - RNA, 29 nt, Human
agcucgccugcugcccucuugcgcgcggg

SEQ ID NO: 54993 - RNA, 27 nt, Human
cuguaggaacuauuuugaaugcaugug

SEQ ID NO: 54994 - RNA, 27 nt, Human
ccagcacugugaagacccagcaggaag

SEQ ID NO: 54995 - RNA, 27 nt, Human
cugagauacauucuuccaaucuguggu

SEQ ID NO: 54996 - RNA, 22 nt, Human
uagugccaugcgaguccugaac

SEQ ID NO: 54997 - RNA, 23 nt, Human
ugcagccuccagccucgaccucc

SEQ ID NO: 54998 - RNA, 23 nt, Human
gcacagccacugccaacagauau

SEQ ID NO: 54999 - RNA, 26 nt, Human
gcucacugcaaccucugccacccggg

SEQ ID NO: 55000 - RNA, 21 nt, Human
ccagugcugcugcagcucuga

SEQ ID NO: 55001 - RNA, 19 nt, Human
aggcaucuaccccuggccu

SEQ ID NO: 55002 - RNA, 25 nt, Human
agggcagccuucccugggccuuugc

SEQ ID NO: 55003 - RNA, 21 nt, Human
uuccauuuccuaaaguuuacu

SEQ ID NO: 55004 - RNA, 22 nt, Human
gauuacaggcgcccgucaccac

SEQ ID NO: 55005 - RNA, 22 nt, Human
acgcuuguaaucccagcacuuu

SEQ ID NO: 55006 - RNA, 22 nt, Human
acgccuguaaucucagcacuuu

SEQ ID NO: 55007 - RNA, 24 nt, Human
guuccauucucucuccuguacuuu

SEQ ID NO: 55008 - RNA, 26 nt, Human
ccuguacagugacccugccugcucgc

SEQ ID NO: 55009 - RNA, 27 nt, Human
gcagaacugcaaccuuuuguaccuuuc

SEQ ID NO: 55010 - RNA, 20 nt, Human
uaugaggucacagggcccag

SEQ ID NO: 55011 - RNA, 22 nt, Human
cucaccccaccuaaggccaucu

SEQ ID NO: 55012 - RNA, 19 nt, Human
cccaugcucaugggccgcg

SEQ ID NO: 55013 - RNA, 22 nt, Human
cacacacgcgcuuuuccaguca

SEQ ID NO: 55014 - RNA, 25 nt, Human
cccaacaaccuagaugugaaaacag

SEQ ID NO: 55015 - RNA, 18 nt, Human
augauagauaaugccuuu

SEQ ID NO: 55016 - RNA, 24 nt, Human
ccgugacagguuuccacaaacuuc

SEQ ID NO: 55017 - RNA, 20 nt, Human
gggagagaaguuugagcccc

SEQ ID NO: 55018 - RNA, 22 nt, Human
gggcccaaguaaauggaaaugu

SEQ ID NO: 55019 - RNA, 21 nt, Human
ucucccucucccugugaugcc

SEQ ID NO: 55020 - RNA, 23 nt, Human
ucuccucuuccucucccugaaga

SEQ ID NO: 55021 - RNA, 27 nt, Human
ugcccaccggcccccggcagugcaguc

SEQ ID NO: 55022 - RNA, 23 nt, Human
gagcaagacucugucucauaaau

SEQ ID NO: 55023 - RNA, 25 nt, Human
agaggcaguucugaaucauucucuc

SEQ ID NO: 55024 - RNA, 27 nt, Human
agcacaaaauucuacagaaggccccau

SEQ ID NO: 55025 - RNA, 22 nt, Human
acgucuguaaucccagcacuuu

SEQ ID NO: 55026 - RNA, 22 nt, Human
acgccuguaauuccagcacuuu

SEQ ID NO: 55027 - RNA, 21 nt, Human
guaaaacucuucaagacuuca

SEQ ID NO: 55028 - RNA, 28 nt, Human
uuccccaaggucacacagcuggcugggg

SEQ ID NO: 55029 - RNA, 23 nt, Human
ccugcuguugcugccacugcuuc

SEQ ID NO: 55030 - RNA, 27 nt, Human
cagccugccuugcccacuccugcucug

SEQ ID NO: 55031 - RNA, 22 nt, Human
ugaauccuagcccaucugcaga

SEQ ID NO: 55032 - RNA, 20 nt, Human
ucgggcuguugcugugguuu

SEQ ID NO: 55033 - RNA, 20 nt, Human
ccaaaaauagaggugcagag

SEQ ID NO: 55034 - RNA, 27 nt, Human
agcccuaggacaguguauucaagaguu

SEQ ID NO: 55035 - RNA, 26 nt, Human
cugcaaccguuuccgccuccugcuag

SEQ ID NO: 55036 - RNA, 26 nt, Human
uggucaguaggcacacugccccugcc

SEQ ID NO: 55037 - RNA, 21 nt, Human
ccagcaccgcggcaaugucca

SEQ ID NO: 55038 - RNA, 26 nt, Human
auauuaaaacauacuaugaagccucu

SEQ ID NO: 55039 - RNA, 25 nt, Human
ggcucacugcaaccuccgccucuca

SEQ ID NO: 55040 - RNA, 22 nt, Human
caagaagaauugaggcugcuug

SEQ ID NO: 55041 - RNA, 21 nt, Human
gucuugcuauguugcccaagc

SEQ ID NO: 55042 - RNA, 24 nt, Human
aaaggaggagacaagcagaggucu

SEQ ID NO: 55043 - RNA, 27 nt, Human
cacagcaaucaggacucacagcucuuc

SEQ ID NO: 55044 - RNA, 26 nt, Human
cugggacugugccuggcucccugaug

SEQ ID NO: 55045 - RNA, 29 nt, Human
ucugcagggcugcucaguucacaggaggc

SEQ ID NO: 55046 - RNA, 19 nt, Human
aucuuaucuauuacuccaa

SEQ ID NO: 55047 - RNA, 22 nt, Human
ggagaagcagacauggacuucc

SEQ ID NO: 55048 - RNA, 19 nt, Human
gcucacugagcugcugcuu

SEQ ID NO: 55049 - RNA, 27 nt, Human
gcccagccugccccagccugccccagc

SEQ ID NO: 55050 - RNA, 28 nt, Human
ccaaccagcaaccagaaauguucuagug

SEQ ID NO: 55051 - RNA, 26 nt, Human
caucccagcuggaguucaaccuucau

SEQ ID NO: 55052 - RNA, 25 nt, Human
cagagaagcucccagaaggagagau

SEQ ID NO: 55053 - RNA, 23 nt, Human
acucccacaggggcucagcagga

SEQ ID NO: 55054 - RNA, 21 nt, Human
ccgucugggcuggagcgcagu

SEQ ID NO: 55055 - RNA, 25 nt, Human
gggagggagcgggagagggaggaga

SEQ ID NO: 55056 - RNA, 23 nt, Human
aucuuccagaguaaaaugcaaau

SEQ ID NO: 55057 - RNA, 22 nt, Human
cacugcugcuccuuuuuucuag

SEQ ID NO: 55058 - RNA, 22 nt, Human
auuuuuuguucccuaaugagaa

SEQ ID NO: 55059 - RNA, 22 nt, Human
cuagcucccagucgccaagcgu

SEQ ID NO: 55060 - RNA, 19 nt, Human
ggcccagcaccccaccuca

SEQ ID NO: 55061 - RNA, 26 nt, Human
gagcuagcuggugugguugcagugac

SEQ ID NO: 55062 - RNA, 21 nt, Human
uggccccagccucagacccca

SEQ ID NO: 55063 - RNA, 23 nt, Human
caacaagaguaaaacuccaucuc

SEQ ID NO: 55064 - RNA, 22 nt, Human
uuuggggccaaucuacaaugga

SEQ ID NO: 55065 - RNA, 21 nt, Human
caccucacacgggaccacagc

SEQ ID NO: 55066 - RNA, 22 nt, Human
uuuuccuuuuugagccgccuga

SEQ ID NO: 55067 - RNA, 23 nt, Human
ucaggguggucucuucuuggggc

SEQ ID NO: 55068 - RNA, 20 nt, Human
cuguggcugaagcuggcgga

SEQ ID NO: 55069 - RNA, 23 nt, Human
cucaacuucacaccuugauuuca

SEQ ID NO: 55070 - RNA, 32 nt, Human
gcuaguuagcugacacagauggucaccuccau

SEQ ID NO: 55071 - RNA, 18 nt, Human
uccuccuccuccucacca

SEQ ID NO: 55072 - RNA, 23 nt, Human
gggugaaagacgaguaaggggca

SEQ ID NO: 55073 - RNA, 27 nt, Human
ucuucuuucuuagccuuacuugaaucu

SEQ ID NO: 55074 - RNA, 23 nt, Human
uguacuacagagaguccugagcc

SEQ ID NO: 55075 - RNA, 24 nt, Human
caauuuucacuuuuucugucuuua

SEQ ID NO: 55076 - RNA, 25 nt, Human
gcugccucuaccugccugguccagc

SEQ ID NO: 55077 - RNA, 24 nt, Human
agccucuccccgcucuggauccug

SEQ ID NO: 55078 - RNA, 27 nt, Human
cuccccgcugcuaaucuccccugggcc

SEQ ID NO: 55079 - RNA, 21 nt, Human
cacauuauuuggcuuaaacca

SEQ ID NO: 55080 - RNA, 20 nt, Human
aauucuuaaaauauauuuca

SEQ ID NO: 55081 - RNA, 20 nt, Human
ucagcacagcuguggugucc

SEQ ID NO: 55082 - RNA, 26 nt, Human
uugggagcuggggcugaaguugcucu

SEQ ID NO: 55083 - RNA, 23 nt, Human
gcauccaacuccuggggcuggga

SEQ ID NO: 55084 - RNA, 23 nt, Human
cugcuucuauguuucauaguugg

SEQ ID NO: 55085 - RNA, 25 nt, Human
aaucuuuguugugugugcauuuuua

SEQ ID NO: 55086 - RNA, 20 nt, Human
gcaaauauuuguauauuccc

SEQ ID NO: 55087 - RNA, 22 nt, Human
cuauugcacuccauccuggaug

SEQ ID NO: 55088 - RNA, 20 nt, Human
gcccucucugcuccuucacu

SEQ ID NO: 55089 - RNA, 22 nt, Human
uccagcaucccugccucuuguc

SEQ ID NO: 55090 - RNA, 24 nt, Human
aacuguaucaaaaauaaaaagcug

SEQ ID NO: 55091 - RNA, 27 nt, Human
agagcuuugggugcugaagggccaaac

SEQ ID NO: 55092 - RNA, 21 nt, Human
acaggagggaaauggcggcuc

SEQ ID NO: 55093 - RNA, 26 nt, Human
ccagcuguuacugaccuugucauuuu

SEQ ID NO: 55094 - RNA, 21 nt, Human
cucccucuuuguguccauucc

SEQ ID NO: 55095 - RNA, 22 nt, Human
uuaugcccacgcuggagugcag

SEQ ID NO: 55096 - RNA, 23 nt, Human
gggcaccagccugcauauguguu

SEQ ID NO: 55097 - RNA, 23 nt, Human
aucugauagaccagcacuucuga

SEQ ID NO: 55098 - RNA, 25 nt, Human
ggcuggaggcagggauggggacagg

SEQ ID NO: 55099 - RNA, 26 nt, Human
uuuaaaccauuauuuccaaguugaca

SEQ ID NO: 55100 - RNA, 21 nt, Human
ugagcaagggacacgacacuc

SEQ ID NO: 55101 - RNA, 20 nt, Human
ggccuggcgacugccccugc

SEQ ID NO: 55102 - RNA, 23 nt, Human
ccccucacucuuccgcuagggau

SEQ ID NO: 55103 - RNA, 21 nt, Human
cacucugagaaccagcugcgc

SEQ ID NO: 55104 - RNA, 21 nt, Human
agcccaggccagagugcagug

SEQ ID NO: 55105 - RNA, 23 nt, Human
ggccucgaggcugucucugacaa

SEQ ID NO: 55106 - RNA, 22 nt, Human
cuucccuugugucucccuggac

SEQ ID NO: 55107 - RNA, 21 nt, Human
cauccaggcuggagugcagug

SEQ ID NO: 55108 - RNA, 22 nt, Human
agccucccaaguagcuaagacc

SEQ ID NO: 55109 - RNA, 21 nt, Human
uuucuccuguugacagagcca

SEQ ID NO: 55110 - RNA, 23 nt, Human
ugguuaaccuguuuucuucaagc

SEQ ID NO: 55111 - RNA, 22 nt, Human
agcucacugcagccucgaccuc

SEQ ID NO: 55112 - RNA, 22 nt, Human
ggcucacugcagccucaaccuc

SEQ ID NO: 55113 - RNA, 22 nt, Human
accauccuggccaacaugauga

SEQ ID NO: 55114 - RNA, 26 nt, Human
gugggaggggauaagguggcagaagg

SEQ ID NO: 55115 - RNA, 23 nt, Human
ugguacuauuucuuaguguuuua

SEQ ID NO: 55116 - RNA, 22 nt, Human
ccuccucugcccacucggggcc

SEQ ID NO: 55117 - RNA, 21 nt, Human
gcacgacuuuggcugggaugg

SEQ ID NO: 55118 - RNA, 22 nt, Human
ucgauggcuuagcuugggcuca

SEQ ID NO: 55119 - RNA, 21 nt, Human
guccaggcuuuuuuaucaugu

SEQ ID NO: 55120 - RNA, 22 nt, Human
gggcugaggcguacgggucgca

SEQ ID NO: 55121 - RNA, 24 nt, Human
cugucugaccagagaaugcaccuc

SEQ ID NO: 55122 - RNA, 19 nt, Human
aaauacuggugccugcaga

SEQ ID NO: 55123 - RNA, 21 nt, Human
uguccuaauuugcauucucaa

SEQ ID NO: 55124 - RNA, 22 nt, Human
ggacuuggaucccaggggcuua

SEQ ID NO: 55125 - RNA, 22 nt, Human
agccucccgaguagcugagauu

SEQ ID NO: 55126 - RNA, 21 nt, Human
aagcuggcauuucagaaguau

SEQ ID NO: 55127 - RNA, 20 nt, Human
ucuagcuaaauggaagacac

SEQ ID NO: 55128 - RNA, 22 nt, Human
ccuggagcgucccugccuagag

SEQ ID NO: 55129 - RNA, 21 nt, Human
uugagccauucuauuguguuc

SEQ ID NO: 55130 - RNA, 22 nt, Human
gggccagagggagaggagccga

SEQ ID NO: 55131 - RNA, 22 nt, Human
cuagagaugucagccuacaaag

SEQ ID NO: 55132 - RNA, 21 nt, Human
uuuaguuuuaaaaucuaaaag

SEQ ID NO: 55133 - RNA, 22 nt, Human
gccaggaugcaggcauccacau

SEQ ID NO: 55134 - RNA, 27 nt, Human
ccuacuucucccuugcucccaaagcuu

SEQ ID NO: 55135 - RNA, 27 nt, Human
uuccaauaaaacgugcguuccucucga

SEQ ID NO: 55136 - RNA, 23 nt, Human
uuuugguucucucucguuuuuua

SEQ ID NO: 55137 - RNA, 21 nt, Human
ugcuuucugaauauagacuuu

SEQ ID NO: 55138 - RNA, 25 nt, Human
caugcaaauauuuuucaucagucau

SEQ ID NO: 55139 - RNA, 22 nt, Human
cgaacuccugaacucaagugau

SEQ ID NO: 55140 - RNA, 21 nt, Human
caggucauugucaguuuaugg

SEQ ID NO: 55141 - RNA, 21 nt, Human
uuggauuucauuuccccaggu

SEQ ID NO: 55142 - RNA, 21 nt, Human
augcuaguauguuuugcucac

SEQ ID NO: 55143 - RNA, 21 nt, Human
gggccuggagcuuggcuugua

SEQ ID NO: 55144 - RNA, 24 nt, Human
gggccuuucacuuuggaugcucug

SEQ ID NO: 55145 - RNA, 22 nt, Human
ccaggaggucagggcugcagug

SEQ ID NO: 55146 - RNA, 20 nt, Human
uuuguuuuuacaaaauaaua

SEQ ID NO: 55147 - RNA, 26 nt, Human
gucuucucccuggaaugaguugaggc

SEQ ID NO: 55148 - RNA, 17 nt, Human
cccagccucucuugggc

SEQ ID NO: 55149 - RNA, 19 nt, Human
uuuugcccucuccuuagcu

SEQ ID NO: 55150 - RNA, 18 nt, Human
ggcccugggaagcagccc

SEQ ID NO: 55151 - RNA, 19 nt, Human
caccaguucagaagugcua

SEQ ID NO: 55152 - RNA, 22 nt, Human
gccaggcccaggaagugagccg

SEQ ID NO: 55153 - RNA, 26 nt, Human
gggcuucaucucucugcguucucagu

SEQ ID NO: 55154 - RNA, 22 nt, Human
auugaaauauuacagauggaaa

SEQ ID NO: 55155 - RNA, 23 nt, Human
gaacaggauuccagaaugaucau

SEQ ID NO: 55156 - RNA, 30 nt, Human
cccaucauucaguccaagugcuuucucugc

SEQ ID NO: 55157 - RNA, 21 nt, Human
ccaggagguugaggcugcagu

SEQ ID NO: 55158 - RNA, 23 nt, Human
agagaaaccccuccagaacuccc

SEQ ID NO: 55159 - RNA, 22 nt, Human
aggcugagguggaaggaucacu

SEQ ID NO: 55160 - RNA, 22 nt, Human
augccuguaauuccagcacuuu

SEQ ID NO: 55161 - RNA, 22 nt, Human
gcucacugcauccucaaccucc

SEQ ID NO: 55162 - RNA, 20 nt, Human
aagaauugcugugaagauua

SEQ ID NO: 55163 - RNA, 26 nt, Human
cgucccgggcacugucaugcccagcu

SEQ ID NO: 55164 - RNA, 27 nt, Human
ggucaucugagcucacgcuggcucaca

SEQ ID NO: 55165 - RNA, 16 nt, Human
ucuuaaucaucuuuaa

SEQ ID NO: 55166 - RNA, 20 nt, Human
ucuguaacauaggcagcugc

SEQ ID NO: 55167 - RNA, 21 nt, Human
ccaccaauguuguacauguau

SEQ ID NO: 55168 - RNA, 25 nt, Human
agacauaauccuccuguuauacuca

SEQ ID NO: 55169 - RNA, 21 nt, Human
gccacuuagagagcaguaggg

SEQ ID NO: 55170 - RNA, 21 nt, Human
ccgcacuuuccuggugcccca

SEQ ID NO: 55171 - RNA, 21 nt, Human
uggggcugcggggguuccgug

SEQ ID NO: 55172 - RNA, 27 nt, Human
uguuucauuguaucacauagaaauaug

SEQ ID NO: 55173 - RNA, 23 nt, Human
ugcugcugguaggagacccccaa

SEQ ID NO: 55174 - RNA, 27 nt, Human
cccucucuucccuaucaugggucaucu

SEQ ID NO: 55175 - RNA, 22 nt, Human
guugccuaggcuggagugcagu

SEQ ID NO: 55176 - RNA, 27 nt, Human
gucucaguucaacagcauacagccaac

SEQ ID NO: 55177 - RNA, 22 nt, Human
cucagaggcuaucacaggcuca

SEQ ID NO: 55178 - RNA, 27 nt, Human
cgcccaggcuggagugcaaugccguga

SEQ ID NO: 55179 - RNA, 27 nt, Human
augaccuguucccauuuggaguacagu

SEQ ID NO: 55180 - RNA, 21 nt, Human
ucacucaggcuggaauguagu

SEQ ID NO: 55181 - RNA, 30 nt, Human
uugcccaaaaggcuggagagggcagggagc

SEQ ID NO: 55182 - RNA, 19 nt, Human
ucucccuggcaggguccuc

SEQ ID NO: 55183 - RNA, 21 nt, Human
aggaaaacugagcuucagaca

SEQ ID NO: 55184 - RNA, 23 nt, Human
agccucguguacccaucuuccca

SEQ ID NO: 55185 - RNA, 22 nt, Human
aucuaaagagaaaauaugcaga

SEQ ID NO: 55186 - RNA, 24 nt, Human
gcuuuguauuaaaccucuuugucu

SEQ ID NO: 55187 - RNA, 22 nt, Human
aggcccccaaucaucagaagga

SEQ ID NO: 55188 - RNA, 20 nt, Human
cucucagcaucgcuuuugcu

SEQ ID NO: 55189 - RNA, 24 nt, Human
cccuggaagccuagguuuuaagca

SEQ ID NO: 55190 - RNA, 23 nt, Human
gcugccucugggccaugccaggc

SEQ ID NO: 55191 - RNA, 21 nt, Human
guggaagagaaacgcugcaga

SEQ ID NO: 55192 - RNA, 27 nt, Human
gagaggggagagcugaacagaugaccc

SEQ ID NO: 55193 - RNA, 20 nt, Human
aaacuauucaugaguauuca

SEQ ID NO: 55194 - RNA, 28 nt, Human
ggaccgugccucacagggcccacucccu

SEQ ID NO: 55195 - RNA, 21 nt, Human
ugcacuuagaggaaauuugaa

SEQ ID NO: 55196 - RNA, 22 nt, Human
ggguaaccacaugggcaagcac

SEQ ID NO: 55197 - RNA, 18 nt, Human
uucaucagacuccugugc

SEQ ID NO: 55198 - RNA, 26 nt, Human
uuauuucucaucccucacccccuccc

SEQ ID NO: 55199 - RNA, 25 nt, Human
auugaugucugacgugagucugucu

SEQ ID NO: 55200 - RNA, 27 nt, Human
acuaccugaauucuaccugcauuucaa

SEQ ID NO: 55201 - RNA, 27 nt, Human
uguccaacauggugaaacccccaucuc

SEQ ID NO: 55202 - RNA, 21 nt, Human
cggacaguuauucauucucuu

SEQ ID NO: 55203 - RNA, 22 nt, Human
guacaguugggauaggaggcca

SEQ ID NO: 55204 - RNA, 20 nt, Human
gcuuuuagcccuccugagcc

SEQ ID NO: 55205 - RNA, 22 nt, Human
ccuuucagaaggccgugaagca

SEQ ID NO: 55206 - RNA, 21 nt, Human
aaagugcuugucaguuguuga

SEQ ID NO: 55207 - RNA, 19 nt, Human
cagucccagcuaacucuga

SEQ ID NO: 55208 - RNA, 21 nt, Human
uaguuucagaaucuaaguuua

SEQ ID NO: 55209 - RNA, 22 nt, Human
gucuuccucucgucaguucuuu

SEQ ID NO: 55210 - RNA, 23 nt, Human
aggagagaggaaaaacacaggca

SEQ ID NO: 55211 - RNA, 22 nt, Human
aguaacucuuauuuggagagaa

SEQ ID NO: 55212 - RNA, 25 nt, Human
gcaaaguauuguaaauuauauuugu

SEQ ID NO: 55213 - RNA, 22 nt, Human
ccuuccacuuuucccagugggg

SEQ ID NO: 55214 - RNA, 22 nt, Human
ucuuccuuccuccucccgguca

SEQ ID NO: 55215 - RNA, 27 nt, Human
aggggccagggugugagguuucaccuc

SEQ ID NO: 55216 - RNA, 22 nt, Human
ugcacgaguccucagcacucug

SEQ ID NO: 55217 - RNA, 19 nt, Human
uguaggagagauugccuga

SEQ ID NO: 55218 - RNA, 28 nt, Human
ggacuucauguccccaaccuagcuuggu

SEQ ID NO: 55219 - RNA, 27 nt, Human
cccuccugguaccaagcugcugggugc

SEQ ID NO: 55220 - RNA, 21 nt, Human
gacucucugaaugcugcucca

SEQ ID NO: 55221 - RNA, 24 nt, Human
gcuacuuccaaaaagcauccuuca

SEQ ID NO: 55222 - RNA, 27 nt, Human
cggcagccgccggacugggcagauccu

SEQ ID NO: 55223 - RNA, 23 nt, Human
uuugcagaaaagccguggcuaca

SEQ ID NO: 55224 - RNA, 20 nt, Human
aucaagucugugaaagucuc

SEQ ID NO: 55225 - RNA, 26 nt, Human
acaaaccuuuauucauagugucuaca

SEQ ID NO: 55226 - RNA, 22 nt, Human
ccugugaccagcacugucucag

SEQ ID NO: 55227 - RNA, 22 nt, Human
uggggcucucggcugggcgcag

SEQ ID NO: 55228 - RNA, 27 nt, Human
ggaggcugaggcaggaggauuguuuga

SEQ ID NO: 55229 - RNA, 25 nt, Human
acaggaggccagaaaccacaaguau

SEQ ID NO: 55230 - RNA, 23 nt, Human
ugucauccagagcuggagugcag

SEQ ID NO: 55231 - RNA, 27 nt, Human
ccuguuucccacccagcuaaaaaccgu

SEQ ID NO: 55232 - RNA, 23 nt, Human
cagggagcugcaagagugaggcu

SEQ ID NO: 55233 - RNA, 23 nt, Human
ccuccauccucauuccugccuga

SEQ ID NO: 55234 - RNA, 27 nt, Human
ucugaucucccccaacuagacuggagc

SEQ ID NO: 55235 - RNA, 23 nt, Human
ccuuuuugucuuaccugccuuuu

SEQ ID NO: 55236 - RNA, 21 nt, Human
cugucauuuggauggcugguc

SEQ ID NO: 55237 - RNA, 25 nt, Human
auuacagcuacugacaauauaaagg

SEQ ID NO: 55238 - RNA, 24 nt, Human
gaagauguuuuaagaagcauuuua

SEQ ID NO: 55239 - RNA, 22 nt, Human
cacaacacagcuaacacaaggc

SEQ ID NO: 55240 - RNA, 26 nt, Human
aggaagggaaaagcagcagcagcagc

SEQ ID NO: 55241 - RNA, 19 nt, Human
cgaggcacagcuucgcgcc

SEQ ID NO: 55242 - RNA, 20 nt, Human
cagcccagugcagccuugca

SEQ ID NO: 55243 - RNA, 21 nt, Human
cagugucuuuucagcacuuug

SEQ ID NO: 55244 - RNA, 17 nt, Human
gccaagcggaaguggaa

SEQ ID NO: 55245 - RNA, 26 nt, Human
uccagccaugguuuucagggggacag

SEQ ID NO: 55246 - RNA, 24 nt, Human
gcugggccucccuuccccauaaca

SEQ ID NO: 55247 - RNA, 26 nt, Human
guauuguuugcauccccuugcccuca

SEQ ID NO: 55248 - RNA, 20 nt, Human
uuuugacagaauauguuuca

SEQ ID NO: 55249 - RNA, 21 nt, Human
aggaggcagagauugcgguga

SEQ ID NO: 55250 - RNA, 26 nt, Human
gcugcaaaagacaugaucucguucuu

SEQ ID NO: 55251 - RNA, 22 nt, Human
cacggggucaggagaucgagac

SEQ ID NO: 55252 - RNA, 26 nt, Human
aggaauagugaagaguuuguccaaug

SEQ ID NO: 55253 - RNA, 26 nt, Human
cgcccaggcuagaguggauuggcgug

SEQ ID NO: 55254 - RNA, 19 nt, Human
augauuuuaagacaaaaca

SEQ ID NO: 55255 - RNA, 21 nt, Human
aacuggagaagaucuuagagg

SEQ ID NO: 55256 - RNA, 23 nt, Human
uccuguaaucccagcuacucaga

SEQ ID NO: 55257 - RNA, 21 nt, Human
uccagccugagugacagagcg

SEQ ID NO: 55258 - RNA, 22 nt, Human
auugcccaggcuggagugcagu

SEQ ID NO: 55259 - RNA, 27 nt, Human
uugccuagggacguguaacuacaggcu

SEQ ID NO: 55260 - RNA, 20 nt, Human
agugcccuguggagcaaggc

SEQ ID NO: 55261 - RNA, 23 nt, Human
ggcuggaaguggugucugccuuc

SEQ ID NO: 55262 - RNA, 26 nt, Human
gccuuucagagacagggacacagccc

SEQ ID NO: 55263 - RNA, 22 nt, Human
ucccaaaccuaaugaucaucug

SEQ ID NO: 55264 - RNA, 23 nt, Human
acauugcuaaccccaaacaggca

SEQ ID NO: 55265 - RNA, 24 nt, Human
gccguacaggguagcaccuccuca

SEQ ID NO: 55266 - RNA, 21 nt, Human
cgggacuccccaagcccagcc

SEQ ID NO: 55267 - RNA, 22 nt, Human
gccuguaaucguagcgcuuuga

SEQ ID NO: 55268 - RNA, 23 nt, Human
caaccuugccgggcuguuucccg

SEQ ID NO: 55269 - RNA, 25 nt, Human
ggaggauccuggcuaccacucugaa

SEQ ID NO: 55270 - RNA, 24 nt, Human
agaggagugcagccuucuccauau

SEQ ID NO: 55271 - RNA, 19 nt, Human
aaguugccuggugaaggaa

SEQ ID NO: 55272 - RNA, 22 nt, Human
gcccaggcuggagguuaauggc

SEQ ID NO: 55273 - RNA, 22 nt, Human
acauuugacauaagaugagaac

SEQ ID NO: 55274 - RNA, 24 nt, Human
gaagacauggauuuccuggaagac

SEQ ID NO: 55275 - RNA, 25 nt, Human
cacccacgcugguuucugugcagug

SEQ ID NO: 55276 - RNA, 23 nt, Human
cagagcccugcucccuccggguc

SEQ ID NO: 55277 - RNA, 20 nt, Human
uccccuccaggggugcagug

SEQ ID NO: 55278 - RNA, 21 nt, Human
gacuuggcuguggcugucuuu

SEQ ID NO: 55279 - RNA, 21 nt, Human
uugaagccauauuauuuucug

SEQ ID NO: 55280 - RNA, 26 nt, Human
gcugcacucuggcuggggaaggcaug

SEQ ID NO: 55281 - RNA, 18 nt, Human
gcaaaacucggaagugaa

SEQ ID NO: 55282 - RNA, 22 nt, Human
acgccuguaaucccagcacuuu

SEQ ID NO: 55283 - RNA, 23 nt, Human
uuuggagcuuauguaauaauggc

SEQ ID NO: 55284 - RNA, 21 nt, Human
gcauucucuguaaccugugcg

SEQ ID NO: 55285 - RNA, 32 nt, Human
agcguuuuuaacugcaacuuucuauaaugcca

SEQ ID NO: 55286 - RNA, 24 nt, Human
ucuuuuauuucuuuuucucuuuga

SEQ ID NO: 55287 - RNA, 24 nt, Human
cuggggaagaggaugagcagaggg

SEQ ID NO: 55288 - RNA, 27 nt, Human
acucagggggucuggaaagaaggucau

SEQ ID NO: 55289 - RNA, 27 nt, Human
cuucccgggccucucccccaaggcucc

SEQ ID NO: 55290 - RNA, 27 nt, Human
guucagcagaaaggaggaauccuggcc

SEQ ID NO: 55291 - RNA, 24 nt, Human
aguagagagaaacuaccuaccuca

SEQ ID NO: 55292 - RNA, 21 nt, Human
ucugaacuguaauuagcaaga

SEQ ID NO: 55293 - RNA, 20 nt, Human
ggccuccagggcccagguuc

SEQ ID NO: 55294 - RNA, 21 nt, Human
aaaggcugggaucauauguau

SEQ ID NO: 55295 - RNA, 23 nt, Human
cgggccguggcaggaagccggaa

SEQ ID NO: 55296 - RNA, 20 nt, Human
uacagugcagaaaggcuuga

SEQ ID NO: 55297 - RNA, 19 nt, Human
uguauuuucacugucuuca

SEQ ID NO: 55298 - RNA, 21 nt, Human
ccggguagcuggggcuacagg

SEQ ID NO: 55299 - RNA, 22 nt, Human
ucacugcaaccucuuccuccug

SEQ ID NO: 55300 - RNA, 29 nt, Human
ucagaugucuuugccccauuugucaccuc

SEQ ID NO: 55301 - RNA, 20 nt, Human
auauaaugguuuacugcugu

SEQ ID NO: 55302 - RNA, 22 nt, Human
agccucccgaguagcugagacu

SEQ ID NO: 55303 - RNA, 22 nt, Human
ggccucccaaguagcugagacu

SEQ ID NO: 55304 - RNA, 22 nt, Human
aggcccucuuccuuguuagaag

SEQ ID NO: 55305 - RNA, 22 nt, Human
agccuccagaauagcugggauu

SEQ ID NO: 55306 - RNA, 21 nt, Human
caccucaggccaggugcagug

SEQ ID NO: 55307 - RNA, 22 nt, Human
guauguacuucagugcaccuua

SEQ ID NO: 55308 - RNA, 21 nt, Human
uauagcagaagcacauuuuca

SEQ ID NO: 55309 - RNA, 25 nt, Human
cgcugggagucugaggccugaguga

SEQ ID NO: 55310 - RNA, 22 nt, Human
agguauccagcccugauauuuu

SEQ ID NO: 55311 - RNA, 20 nt, Human
aucuaauaucuauguauuua

SEQ ID NO: 55312 - RNA, 21 nt, Human
cuucugcuguuccaccuuucu

SEQ ID NO: 55313 - RNA, 23 nt, Human
ucaagauggaagaaauaacagua

SEQ ID NO: 55314 - RNA, 22 nt, Human
agcucacugcagccuugaccuc

SEQ ID NO: 55315 - RNA, 22 nt, Human
ccuguucugcuuuccucuuccu

SEQ ID NO: 55316 - RNA, 21 nt, Human
agccaaauaaaccucuuuucu

SEQ ID NO: 55317 - RNA, 22 nt, Human
aauuuuguaucuugaugucuuu

SEQ ID NO: 55318 - RNA, 22 nt, Human
ggucucgaacuccugaccuuag

SEQ ID NO: 55319 - RNA, 22 nt, Human
ggucucgaacuucugaccucag

SEQ ID NO: 55320 - RNA, 22 nt, Human
gguuucgaacuccugaccucag

SEQ ID NO: 55321 - RNA, 21 nt, Human
uuccuuccugaaguccugggc

SEQ ID NO: 55322 - RNA, 23 nt, Human
ggugacugacccuugagcuuaaa

SEQ ID NO: 55323 - RNA, 27 nt, Human
caccugaggucaggauucaaaaccagc

SEQ ID NO: 55324 - RNA, 21 nt, Human
ggcgagggcgcgcauggggag

SEQ ID NO: 55325 - RNA, 19 nt, Human
gcugugaaccagauuuccu

SEQ ID NO: 55326 - RNA, 20 nt, Human
cgcagccgccugcguuucgg

SEQ ID NO: 55327 - RNA, 27 nt, Human
ucucaacaagaaauaauagaaaugucu

SEQ ID NO: 55328 - RNA, 22 nt, Human
ucagcuggcagaguuagcauug

SEQ ID NO: 55329 - RNA, 26 nt, Human
uguaaucccagcacuuuggcaggccg

SEQ ID NO: 55330 - RNA, 26 nt, Human
cccacauucugugacucuuugcauca

SEQ ID NO: 55331 - RNA, 22 nt, Human
uucuaaccuugucauuagaguu

SEQ ID NO: 55332 - RNA, 31 nt, Human
ggagccccuguccacccucccccaggggccu

SEQ ID NO: 55333 - RNA, 21 nt, Human
cuggcagcugccgcccccucc

SEQ ID NO: 55334 - RNA, 25 nt, Human
cugccucuuugugugcgucacugug

SEQ ID NO: 55335 - RNA, 30 nt, Human
cacuuccggccucucugcccuggcuuaugu

SEQ ID NO: 55336 - RNA, 25 nt, Human
cugccuggcuccuagauggcucugc

SEQ ID NO: 55337 - RNA, 25 nt, Human
ccgucucaacaaacaaacaaaaaga

SEQ ID NO: 55338 - RNA, 22 nt, Human
uuaccuuucccaugcugaauua

SEQ ID NO: 55339 - RNA, 20 nt, Human
aacaaaagagggcgucuucu

SEQ ID NO: 55340 - RNA, 22 nt, Human
acccagguccagcgagccuuuu

SEQ ID NO: 55341 - RNA, 27 nt, Human
agggucugagcuguaucugcugguggc

SEQ ID NO: 55342 - RNA, 22 nt, Human
acuuuuuccccaccuuggacag

SEQ ID NO: 55343 - RNA, 19 nt, Human
cuagaaagaaaacacaagg

SEQ ID NO: 55344 - RNA, 26 nt, Human
uuguaaccuccugucccuccuaaaac

SEQ ID NO: 55345 - RNA, 23 nt, Human
gucucgaacuccugaccucauga

SEQ ID NO: 55346 - RNA, 19 nt, Human
gagguggagguugcgguga

SEQ ID NO: 55347 - RNA, 27 nt, Human
gccaucguccccaccuccaccugggcc

SEQ ID NO: 55348 - RNA, 21 nt, Human
ccuagcaccuggcuaguuucu

SEQ ID NO: 55349 - RNA, 26 nt, Human
ugcccagguguggagcgaggggcaca

SEQ ID NO: 55350 - RNA, 21 nt, Human
auugcaaauuaugaccucaaa

SEQ ID NO: 55351 - RNA, 23 nt, Human
accacaaccuccaccuccugggu

SEQ ID NO: 55352 - RNA, 28 nt, Human
cuuccuguaccuccuccccacagcuugc

SEQ ID NO: 55353 - RNA, 21 nt, Human
ugcaaccucgccucccugguu

SEQ ID NO: 55354 - RNA, 22 nt, Human
gagcggcuucagcaccgaggag

SEQ ID NO: 55355 - RNA, 19 nt, Human
acccaggcuggaguacagu

SEQ ID NO: 55356 - RNA, 19 nt, Human
acccagacuggagugcagu

SEQ ID NO: 55357 - RNA, 22 nt, Human
cagacuggagugcaggggggca

SEQ ID NO: 55358 - RNA, 22 nt, Human
gacaggcuugcugcuuccuccu

SEQ ID NO: 55359 - RNA, 24 nt, Human
aguguggaggcagggacagucaug

SEQ ID NO: 55360 - RNA, 22 nt, Human
aggaguaaaaagacuacuggcc

SEQ ID NO: 55361 - RNA, 20 nt, Human
cugaguguugagauuuuaaa

SEQ ID NO: 55362 - RNA, 23 nt, Human
uugagcucccagguaccaaaaag

SEQ ID NO: 55363 - RNA, 23 nt, Human
ccugccugcacccacgaugcugc

SEQ ID NO: 55364 - RNA, 21 nt, Human
caugcaggcugguggugaugg

SEQ ID NO: 55365 - RNA, 24 nt, Human
aaugcuuggcuucucauacgucca

SEQ ID NO: 55366 - RNA, 28 nt, Human
caugaauugcauuauguucucugguaac

SEQ ID NO: 55367 - RNA, 22 nt, Human
ucaccucuuugcucccugaguu

SEQ ID NO: 55368 - RNA, 27 nt, Human
cucuccucucugaaucucaaacaaguu

SEQ ID NO: 55369 - RNA, 21 nt, Human
agcuaaaucacaaaacaucca

SEQ ID NO: 55370 - RNA, 21 nt, Human
uuucuuucacgauuucauuaa

SEQ ID NO: 55371 - RNA, 21 nt, Human
gguggguggagggagggagau

SEQ ID NO: 55372 - RNA, 23 nt, Human
ucuagugcuuagcaaaaggggug

SEQ ID NO: 55373 - RNA, 20 nt, Human
cugcauguuaccaucuuacu

SEQ ID NO: 55374 - RNA, 22 nt, Human
aagaucccuccagacagcacca

SEQ ID NO: 55375 - RNA, 22 nt, Human
ugggcaacaacagcaaaacucc

SEQ ID NO: 55376 - RNA, 21 nt, Human
agcacaccauuugugcugcug

SEQ ID NO: 55377 - RNA, 27 nt, Human
acugguuuccccauguccucccauuca

SEQ ID NO: 55378 - RNA, 27 nt, Human
auuuuugcucucuugcaguuuuuugcu

SEQ ID NO: 55379 - RNA, 20 nt, Human
uaagaagauacacugcagcu

SEQ ID NO: 55380 - RNA, 21 nt, Human
ccaugcgccacguccugggug

SEQ ID NO: 55381 - RNA, 21 nt, Human
gccuggugucuccucaugccc

SEQ ID NO: 55382 - RNA, 27 nt, Human
agcaaaucaguguguucgugaugacug

SEQ ID NO: 55383 - RNA, 20 nt, Human
uuaaggccuuuuccacacgc

SEQ ID NO: 55384 - RNA, 22 nt, Human
accccuggcgccugacaugagc

SEQ ID NO: 55385 - RNA, 22 nt, Human
gaacuccugaacucaagugauu

SEQ ID NO: 55386 - RNA, 22 nt, Human
uggugauggaguguucccacug

SEQ ID NO: 55387 - RNA, 26 nt, Human
ccacugccaccacggucgccugccac

SEQ ID NO: 55388 - RNA, 25 nt, Human
uuccauuccaaaacauguguuuauu

SEQ ID NO: 55389 - RNA, 23 nt, Human
cuggcccuuaccugacagagccc

SEQ ID NO: 55390 - RNA, 22 nt, Human
uugagcucuaggguggcugguu

SEQ ID NO: 55391 - RNA, 24 nt, Human
gagcaauguauaaccccaaagaaa

SEQ ID NO: 55392 - RNA, 21 nt, Human
ugcccuuuuggagcuuuuguu

SEQ ID NO: 55393 - RNA, 24 nt, Human
guggcuggaagcgaggaggcucca

SEQ ID NO: 55394 - RNA, 20 nt, Human
cucaaagcucuagccuuuag

SEQ ID NO: 55395 - RNA, 25 nt, Human
ccccucuuucuccugcacuuggcuu

SEQ ID NO: 55396 - RNA, 22 nt, Human
aaacccagcagucccuaaagcu

SEQ ID NO: 55397 - RNA, 22 nt, Human
cauguaaauaaauguuuuccug

SEQ ID NO: 55398 - RNA, 24 nt, Human
guuaggaacugccucccacauucu

SEQ ID NO: 55399 - RNA, 29 nt, Human
agucccagcuccucagucacuuuccucag

SEQ ID NO: 55400 - RNA, 23 nt, Human
gucuucuccccauuccgcugccg

SEQ ID NO: 55401 - RNA, 17 nt, Human
ucucacugccuuuguuu

SEQ ID NO: 55402 - RNA, 23 nt, Human
uuggcacuguuugcuuuuuuaca

SEQ ID NO: 55403 - RNA, 24 nt, Human
uuaguaaagccucugagaccuucc

SEQ ID NO: 55404 - RNA, 23 nt, Human
cagcauuccagaacaggagggaa

SEQ ID NO: 55405 - RNA, 21 nt, Human
ucgccaggcuagagugcggug

SEQ ID NO: 55406 - RNA, 27 nt, Human
ccuggagcugcucuccuaucagaagcu

SEQ ID NO: 55407 - RNA, 29 nt, Human
gagcagcucggcccuucaaacuuaacccc

SEQ ID NO: 55408 - RNA, 22 nt, Human
ucuggaaaugaaacaaguuaua

SEQ ID NO: 55409 - RNA, 29 nt, Human
gcuucauugaccucuacuugcugaaggag

SEQ ID NO: 55410 - RNA, 26 nt, Human
ugagauuugaggccuuggagacucag

SEQ ID NO: 55411 - RNA, 27 nt, Human
cgggccaucaugcagaggugguugugg

SEQ ID NO: 55412 - RNA, 23 nt, Human
uuauuuuuaauacaccugcuuca

SEQ ID NO: 55413 - RNA, 23 nt, Human
ggcugugauccuggaaugaggcc

SEQ ID NO: 55414 - RNA, 20 nt, Human
ggucacccuccugguucugc

SEQ ID NO: 55415 - RNA, 22 nt, Human
acugugacccuagucaccagaa

SEQ ID NO: 55416 - RNA, 22 nt, Human
gccacugcgccuggccuguugc

SEQ ID NO: 55417 - RNA, 23 nt, Human
auuucuccagccucacaaugguc

SEQ ID NO: 55418 - RNA, 25 nt, Human
uccuuuucugcuccaaccugcccca

SEQ ID NO: 55419 - RNA, 22 nt, Human
gccuggaguuacgcacacugag

SEQ ID NO: 55420 - RNA, 26 nt, Human
cccaaaccaccacaggugcuccuccu

SEQ ID NO: 55421 - RNA, 21 nt, Human
ucauuaaaaugaaaguaauuu

SEQ ID NO: 55422 - RNA, 22 nt, Human
cggcagcagagaggagcgcuga

SEQ ID NO: 55423 - RNA, 22 nt, Human
agguacuucagaaccucagagc

SEQ ID NO: 55424 - RNA, 19 nt, Human
cacugugugccuucugcca

SEQ ID NO: 55425 - RNA, 21 nt, Human
uggggagggaaggcuggggug

SEQ ID NO: 55426 - RNA, 22 nt, Human
ccauagcuggggccagcagguu

SEQ ID NO: 55427 - RNA, 25 nt, Human
ucagaaauugguuugaagauguaau

SEQ ID NO: 55428 - RNA, 25 nt, Human
acagaagucuauucaccugugcacu

SEQ ID NO: 55429 - RNA, 23 nt, Human
guuacaggcucuaaagugcaaug

SEQ ID NO: 55430 - RNA, 23 nt, Human
gcgcgcccgcccggaacccagaa

SEQ ID NO: 55431 - RNA, 24 nt, Human
aacauuguaccugcuuuggcugcu

SEQ ID NO: 55432 - RNA, 22 nt, Human
cguacuuucuguuaucaagcua

SEQ ID NO: 55433 - RNA, 24 nt, Human
gucccauucuuucucaccggcugg

SEQ ID NO: 55434 - RNA, 24 nt, Human
gagcagucaucuguggugaggcug

SEQ ID NO: 55435 - RNA, 16 nt, Human
acguccucagagggag

SEQ ID NO: 55436 - RNA, 26 nt, Human
auaccugcccugacaugcacaccucc

SEQ ID NO: 55437 - RNA, 21 nt, Human
aucacaaaauguaauuuaaug

SEQ ID NO: 55438 - RNA, 22 nt, Human
ugcuuuaguuacaaccaucugu

SEQ ID NO: 55439 - RNA, 27 nt, Human
guagucauuuccauucuuuacauuguc

SEQ ID NO: 55440 - RNA, 27 nt, Human
ccagccuggcccugagcugcuggauac

SEQ ID NO: 55441 - RNA, 21 nt, Human
gggagagaaagagaaagaagg

SEQ ID NO: 55442 - RNA, 23 nt, Human
caguaugggacaaggcuuguaaa

SEQ ID NO: 55443 - RNA, 26 nt, Human
ggagaaacgcucuccccacccacgcc

SEQ ID NO: 55444 - RNA, 27 nt, Human
cacccacacaccacucucccuagacuc

SEQ ID NO: 55445 - RNA, 22 nt, Human
cagccaucuguaccuacuggag

SEQ ID NO: 55446 - RNA, 20 nt, Human
aaggcauuguuuuuuccuuu

SEQ ID NO: 55447 - RNA, 22 nt, Human
gggcuuuugcauggcaauggau

SEQ ID NO: 55448 - RNA, 24 nt, Human
gccgucccgagcuaccagcagguu

SEQ ID NO: 55449 - RNA, 19 nt, Human
cuuugcagagauuugccuu

SEQ ID NO: 55450 - RNA, 27 nt, Human
gccgugcucgccccagcaggugcugac

SEQ ID NO: 55451 - RNA, 25 nt, Human
auacaagacuccuucagccaacaug

SEQ ID NO: 55452 - RNA, 25 nt, Human
ggaaggagauuccacacaggggugg

SEQ ID NO: 55453 - RNA, 22 nt, Human
cucagccucccaaaaugguggg

SEQ ID NO: 55454 - RNA, 23 nt, Human
caagucaaauucugagccugggg

SEQ ID NO: 55455 - RNA, 24 nt, Human
gaaagaauacaaucuugaacugua

SEQ ID NO: 55456 - RNA, 24 nt, Human
ggcucacaccuguaauaccagcag

SEQ ID NO: 55457 - RNA, 22 nt, Human
gggaccccaccucuggccccac

SEQ ID NO: 55458 - RNA, 22 nt, Human
gugagacaauaaacucucauug

SEQ ID NO: 55459 - RNA, 24 nt, Human
gggccaaggacuuuagagcuguuu

SEQ ID NO: 55460 - RNA, 29 nt, Human
ugccaggcuggaggcggcagcgguuggag

SEQ ID NO: 55461 - RNA, 27 nt, Human
agaaaugucaucugcaaauacagacca

SEQ ID NO: 55462 - RNA, 22 nt, Human
acaacaacgagauaccaucuca

SEQ ID NO: 55463 - RNA, 24 nt, Human
cccgggugaggcaauucucuugga

SEQ ID NO: 55464 - RNA, 17 nt, Human
ccccauacaaguuuaua

SEQ ID NO: 55465 - RNA, 22 nt, Human
gauuacaggcgcccgccaccac

SEQ ID NO: 55466 - RNA, 22 nt, Human
gauuacaggcgccugccaccau

SEQ ID NO: 55467 - RNA, 22 nt, Human
acugcagccucaaccuccuggg

SEQ ID NO: 55468 - RNA, 23 nt, Human
ccuggccuggcccccaccggugc

SEQ ID NO: 55469 - RNA, 26 nt, Human
uugcccaggagcaagugaggccggag

SEQ ID NO: 55470 - RNA, 28 nt, Human
cagaguaugaaauagcuuccaggagcuc

SEQ ID NO: 55471 - RNA, 25 nt, Human
ggcaacauggugaaaccuugucucu

SEQ ID NO: 55472 - RNA, 22 nt, Human
ugacuuucccacagagacugga

SEQ ID NO: 55473 - RNA, 21 nt, Human
uuuccauuugcuaucauguca

SEQ ID NO: 55474 - RNA, 15 nt, Human
cuucccuucuaaccc

SEQ ID NO: 55475 - RNA, 25 nt, Human
cccccuguaccucaggcuguggcgg

SEQ ID NO: 55476 - RNA, 19 nt, Human
ggacgaagagcaggccagc

SEQ ID NO: 55477 - RNA, 27 nt, Human
acaugcccaaacucuggguggggaaga

SEQ ID NO: 55478 - RNA, 27 nt, Human
gaggaagaaaugcuagccuggaagcuc

SEQ ID NO: 55479 - RNA, 22 nt, Human
uacuauuuugaauucauucauu

SEQ ID NO: 55480 - RNA, 19 nt, Human
uaggauguaaaacacauca

SEQ ID NO: 55481 - RNA, 23 nt, Human
ggagaagaaaggccaucagagca

SEQ ID NO: 55482 - RNA, 22 nt, Human
ugcaaccucccccuccuggguu

SEQ ID NO: 55483 - RNA, 23 nt, Human
ucuaagucaguacccaccaccuu

SEQ ID NO: 55484 - RNA, 23 nt, Human
uugugcuguuugcuuguaguuga

SEQ ID NO: 55485 - RNA, 21 nt, Human
uccccaaaauuuaauuuuuga

SEQ ID NO: 55486 - RNA, 21 nt, Human
uuuauuuguaaaugucugacu

SEQ ID NO: 55487 - RNA, 23 nt, Human
gggaauugcgagcuugggaauua

SEQ ID NO: 55488 - RNA, 24 nt, Human
gcccggggugguccaaugggugug

SEQ ID NO: 55489 - RNA, 22 nt, Human
aggcgggcggaucaugagguca

SEQ ID NO: 55490 - RNA, 27 nt, Human
cucuccaggagauuucaauccaggcua

SEQ ID NO: 55491 - RNA, 22 nt, Human
agaaggauagaaccuggaagau

SEQ ID NO: 55492 - RNA, 26 nt, Human
gggagagaaggggagugcggagcccc

SEQ ID NO: 55493 - RNA, 26 nt, Human
cagaucuuuccucuugucugugguaa

SEQ ID NO: 55494 - RNA, 26 nt, Human
agccccggccugggucaaucaaggca

SEQ ID NO: 55495 - RNA, 22 nt, Human
caccauuuuguccaagccuggg

SEQ ID NO: 55496 - RNA, 21 nt, Human
ucuuagagguagguguauucc

SEQ ID NO: 55497 - RNA, 21 nt, Human
aagucagagagaaacgguccu

SEQ ID NO: 55498 - RNA, 23 nt, Human
ggagggacugucgcugugaucag

SEQ ID NO: 55499 - RNA, 27 nt, Human
ugugagacauuaaaaaauggcccaggg

SEQ ID NO: 55500 - RNA, 23 nt, Human
agugcuuggcaggugcucaggga

SEQ ID NO: 55501 - RNA, 23 nt, Human
cugcacaucaugggcucugucug

SEQ ID NO: 55502 - RNA, 26 nt, Human
uucuaccccuuuuucugcaauucuca

SEQ ID NO: 55503 - RNA, 26 nt, Human
cuguuguagaagacaaaauguucaca

SEQ ID NO: 55504 - RNA, 23 nt, Human
gaggucagggcugcagugagccg

SEQ ID NO: 55505 - RNA, 22 nt, Human
aggauagcauuuggagauauac

SEQ ID NO: 55506 - RNA, 18 nt, Human
acuuggcaaacagcuggu

SEQ ID NO: 55507 - RNA, 19 nt, Human
ugccuucaugaauucaccu

SEQ ID NO: 55508 - RNA, 25 nt, Human
guguuggcuggcaugcccaucagcu

SEQ ID NO: 55509 - RNA, 22 nt, Human
ugaccuacuccccauuguucug

SEQ ID NO: 55510 - RNA, 29 nt, Human
cuguggccagggcuggcccccaccgcugu

SEQ ID NO: 55511 - RNA, 23 nt, Human
ccuguguagcugggauuauagau

SEQ ID NO: 55512 - RNA, 19 nt, Human
cccugcuccccacagggcc

SEQ ID NO: 55513 - RNA, 22 nt, Human
gaagggagagcacaagacuaac

SEQ ID NO: 55514 - RNA, 23 nt, Human
uaccccuggggccauggugggau

SEQ ID NO: 55515 - RNA, 23 nt, Human
uacagccgcucgucagacuccag

SEQ ID NO: 55516 - RNA, 23 nt, Human
ucuaacaaaugaucuaguucaga

SEQ ID NO: 55517 - RNA, 27 nt, Human
augauguuauaaaaaacucauaaggca

SEQ ID NO: 55518 - RNA, 27 nt, Human
gggaggagggagagggaggucacugga

SEQ ID NO: 55519 - RNA, 29 nt, Human
ucuauuauuguuuuaagaccucaguaacc

SEQ ID NO: 55520 - RNA, 19 nt, Human
gacaugugagccacucaga

SEQ ID NO: 55521 - RNA, 22 nt, Human
gcaguuauucugcuuuuuguaa

SEQ ID NO: 55522 - RNA, 24 nt, Human
agugaggccucggcagggaguggg

SEQ ID NO: 55523 - RNA, 27 nt, Human
ccaacuuguuguggcucuuauuucuga

SEQ ID NO: 55524 - RNA, 24 nt, Human
gcuccagggacuggaguguaaugc

SEQ ID NO: 55525 - RNA, 21 nt, Human
cccgaaacccccuccuccuuc

SEQ ID NO: 55526 - RNA, 20 nt, Human
ucuuccacgauggugcagug

SEQ ID NO: 55527 - RNA, 26 nt, Human
gggggaaagagucaaacaaacaagca

SEQ ID NO: 55528 - RNA, 25 nt, Human
uacuacuguuagcaccacuacuaau

SEQ ID NO: 55529 - RNA, 22 nt, Human
ggguucuuagcuugucugugau

SEQ ID NO: 55530 - RNA, 22 nt, Human
ccagcuugcugcuccugccuca

SEQ ID NO: 55531 - RNA, 21 nt, Human
gacugggucaaagugaaggaa

SEQ ID NO: 55532 - RNA, 25 nt, Human
uauacacguggggcagagccagcag

SEQ ID NO: 55533 - RNA, 18 nt, Human
ccaggcuggggcgcaaug

SEQ ID NO: 55534 - RNA, 26 nt, Human
ccucaucugcugccucuccagacuuc

SEQ ID NO: 55535 - RNA, 19 nt, Human
ugacugccagaucuccaaa

SEQ ID NO: 55536 - RNA, 19 nt, Human
gcgucagugcuggagggag

SEQ ID NO: 55537 - RNA, 18 nt, Human
gcuuaagaaaaugccuuc

SEQ ID NO: 55538 - RNA, 21 nt, Human
cagccagcucauuugguucag

SEQ ID NO: 55539 - RNA, 24 nt, Human
auuuugucugaagaucaguggcca

SEQ ID NO: 55540 - RNA, 24 nt, Human
cccaccccauaccuugaucuacca

SEQ ID NO: 55541 - RNA, 25 nt, Human
gcacuugcucccugggcaacuccuu

SEQ ID NO: 55542 - RNA, 27 nt, Human
gggagagagggagagagccuauacccc

SEQ ID NO: 55543 - RNA, 27 nt, Human
aagacuccacuuccgucuuacccacuu

SEQ ID NO: 55544 - RNA, 23 nt, Human
gagggagggggaagagcagaagu

SEQ ID NO: 55545 - RNA, 22 nt, Human
agcacagauucaagugcaaucc

SEQ ID NO: 55546 - RNA, 26 nt, Human
acuuucucaguucagaguuguacacu

SEQ ID NO: 55547 - RNA, 18 nt, Human
ucugaacuccauuuugga

SEQ ID NO: 55548 - RNA, 25 nt, Human
ggcaggguggucaggaaccaccuca

SEQ ID NO: 55549 - RNA, 23 nt, Human
uuguuugcacaaaaaguugguga

SEQ ID NO: 55550 - RNA, 24 nt, Human
agagagggaagaugaccugcccca

SEQ ID NO: 55551 - RNA, 21 nt, Human
ccugaguagcuggauuacagg

SEQ ID NO: 55552 - RNA, 31 nt, Human
gcacuaggcacuccaugaucugcagagcaug

SEQ ID NO: 55553 - RNA, 23 nt, Human
guguacacugcuccuguggccuu

SEQ ID NO: 55554 - RNA, 20 nt, Human
uuaaacagauuacacaaaaa

SEQ ID NO: 55555 - RNA, 26 nt, Human
gccucggagcaccagucacuuacucc

SEQ ID NO: 55556 - RNA, 22 nt, Human
cacaaggucaggaaauugagac

SEQ ID NO: 55557 - RNA, 27 nt, Human
cucugucucaaaagcaaagcaaaaaca

SEQ ID NO: 55558 - RNA, 22 nt, Human
aggcugaggcaggagaauggug

SEQ ID NO: 55559 - RNA, 19 nt, Human
ggaggcagguggucuaagu

SEQ ID NO: 55560 - RNA, 24 nt, Human
ggcuuccaucucagcacucugugg

SEQ ID NO: 55561 - RNA, 21 nt, Human
ucugacuuggaaaguuggaga

SEQ ID NO: 55562 - RNA, 22 nt, Human
uuagcuuuugacuuugccaaag

SEQ ID NO: 55563 - RNA, 22 nt, Human
aacaaccaaacaaaaagcagga

SEQ ID NO: 55564 - RNA, 20 nt, Human
agccucggcccugcgcugcg

SEQ ID NO: 55565 - RNA, 22 nt, Human
ugccugcaaucccagcacuuug

SEQ ID NO: 55566 - RNA, 26 nt, Human
cuggaagguagacuauggcauaagug

SEQ ID NO: 55567 - RNA, 25 nt, Human
ccgcccuucagccccgcggucucca

SEQ ID NO: 55568 - RNA, 21 nt, Human
agaaugagaauggacguuugg

SEQ ID NO: 55569 - RNA, 27 nt, Human
gaucaagguagcagcuagacuggugug

SEQ ID NO: 55570 - RNA, 21 nt, Human
accucuaaccuccugaccuca

SEQ ID NO: 55571 - RNA, 17 nt, Human
cugucuguugcugccug

SEQ ID NO: 55572 - RNA, 22 nt, Human
ccccagcccagucccucccggc

SEQ ID NO: 55573 - RNA, 27 nt, Human
gccccuggacuauggugcuguauauaa

SEQ ID NO: 55574 - RNA, 23 nt, Human
ugggauugaauuaaaacagcugc

SEQ ID NO: 55575 - RNA, 19 nt, Human
caugaaagagaaagacuga

SEQ ID NO: 55576 - RNA, 22 nt, Human
uuuagaaauucuauaagagaca

SEQ ID NO: 55577 - RNA, 23 nt, Human
ucucgaacucuggaccucagauc

SEQ ID NO: 55578 - RNA, 24 nt, Human
gcaccuugcuggcacggugccuca

SEQ ID NO: 55579 - RNA, 20 nt, Human
cuugugcauugugugucaca

SEQ ID NO: 55580 - RNA, 20 nt, Human
agaggcaccccggacagaga

SEQ ID NO: 55581 - RNA, 21 nt, Human
ugaaaagaagauauuuuucaa

SEQ ID NO: 55582 - RNA, 27 nt, Human
ggaacccaaagcagauugcaagacuga

SEQ ID NO: 55583 - RNA, 21 nt, Human
cauccacagagcagugcagug

SEQ ID NO: 55584 - RNA, 19 nt, Human
agugcaauggcacgaucuc

SEQ ID NO: 55585 - RNA, 26 nt, Human
uucucaucugugauucccuccugcua

SEQ ID NO: 55586 - RNA, 21 nt, Human
ugucaucagacagagaaagua

SEQ ID NO: 55587 - RNA, 25 nt, Human
agaacaacagcaacaaaaggcucca

SEQ ID NO: 55588 - RNA, 21 nt, Human
gggcuccggaucccagccucu

SEQ ID NO: 55589 - RNA, 25 nt, Human
caaguuaagguaucugguaucugca

SEQ ID NO: 55590 - RNA, 29 nt, Human
gccuccugucguccugccuggccuccagc

SEQ ID NO: 55591 - RNA, 21 nt, Human
agccuccgaguagcugggacu

SEQ ID NO: 55592 - RNA, 22 nt, Human
ccucugagcccucccugcuaag

SEQ ID NO: 55593 - RNA, 20 nt, Human
cugugaucccagcuacuugg

SEQ ID NO: 55594 - RNA, 27 nt, Human
acuguucuuucucuauacuuugucucu

SEQ ID NO: 55595 - RNA, 23 nt, Human
ccaucaucuccauaggucagauc

SEQ ID NO: 55596 - RNA, 26 nt, Human
gacagaaugaauguagaaaaggcuga

SEQ ID NO: 55597 - RNA, 20 nt, Human
ucagcacagugccuugugua

SEQ ID NO: 55598 - RNA, 23 nt, Human
ucccaguccagggugguagugcu

SEQ ID NO: 55599 - RNA, 19 nt, Human
ucucucuggcucucuggca

SEQ ID NO: 55600 - RNA, 22 nt, Human
guucuguccaguuuccaaaggg

SEQ ID NO: 55601 - RNA, 28 nt, Human
ggggaguagagggaaggagcaggccgcg

SEQ ID NO: 55602 - RNA, 26 nt, Human
aaccaaaaaggcuagaaaccagagga

SEQ ID NO: 55603 - RNA, 26 nt, Human
ugaggcugaguguguuuaaguacgug

SEQ ID NO: 55604 - RNA, 20 nt, Human
caguuccuuuguuucuugag

SEQ ID NO: 55605 - RNA, 22 nt, Human
cucucucuuacaaccaagaaca

SEQ ID NO: 55606 - RNA, 27 nt, Human
gcaacguucuucuguuauucccuugag

SEQ ID NO: 55607 - RNA, 28 nt, Human
acucaguagcucagguucucuggagcca

SEQ ID NO: 55608 - RNA, 27 nt, Human
ucaacuugaagcaagcuuucucucaua

SEQ ID NO: 55609 - RNA, 24 nt, Human
uucguugaaagaaaacugaagaca

SEQ ID NO: 55610 - RNA, 18 nt, Human
ucugaacucuggcugaga

SEQ ID NO: 55611 - RNA, 22 nt, Human
uugccuggcccugccucgaugc

SEQ ID NO: 55612 - RNA, 20 nt, Human
gagaucuaaauuuccacacc

SEQ ID NO: 55613 - RNA, 20 nt, Human
uggcaugcaucuuuaauucc

SEQ ID NO: 55614 - RNA, 20 nt, Human
agacccccaggcagaggggc

SEQ ID NO: 55615 - RNA, 21 nt, Human
uggggacagaguccagcuccc

SEQ ID NO: 55616 - RNA, 19 nt, Human
gccucccaggacaggcugg

SEQ ID NO: 55617 - RNA, 21 nt, Human
uaaggcuggggaggcccgaag

SEQ ID NO: 55618 - RNA, 18 nt, Human
gcggcagccuuuucccgc

SEQ ID NO: 55619 - RNA, 22 nt, Human
cucauuccccuccgguucuccu

SEQ ID NO: 55620 - RNA, 26 nt, Human
acugcacuucuagccaguagcucugc

SEQ ID NO: 55621 - RNA, 26 nt, Human
cucuucagaucccuguggacacacug

SEQ ID NO: 55622 - RNA, 22 nt, Human
uuuucuuuugauuauucaugau

SEQ ID NO: 55623 - RNA, 24 nt, Human
cuguccaucaccuccuggauggau

SEQ ID NO: 55624 - RNA, 20 nt, Human
gaaguguccagauucucaga

SEQ ID NO: 55625 - RNA, 27 nt, Human
ucccaauguuugacaaacacagccaag

SEQ ID NO: 55626 - RNA, 23 nt, Human
uuccuagugucuuuuuuggccuu

SEQ ID NO: 55627 - RNA, 27 nt, Human
uaccacugcacugcagccugagugaca

SEQ ID NO: 55628 - RNA, 23 nt, Human
caugaacaucauggacugagcug

SEQ ID NO: 55629 - RNA, 27 nt, Human
cauuccugggggcuggaggguggggug

SEQ ID NO: 55630 - RNA, 18 nt, Human
ccuacuucuugcugccuc

SEQ ID NO: 55631 - RNA, 24 nt, Human
uaggauuguugaacuuugcugcca

SEQ ID NO: 55632 - RNA, 27 nt, Human
caacguugucuuuucucucaaagcugu

SEQ ID NO: 55633 - RNA, 27 nt, Human
ugcauggucaccuucaagcuacuuuaa

SEQ ID NO: 55634 - RNA, 23 nt, Human
uccuccuaagccaccagcaucuc

SEQ ID NO: 55635 - RNA, 21 nt, Human
aagaccguagaucucaggccu

SEQ ID NO: 55636 - RNA, 24 nt, Human
ucuuccuauuugagucucuugaga

SEQ ID NO: 55637 - RNA, 21 nt, Human
aaagaacaucaacgugcaaug

SEQ ID NO: 55638 - RNA, 23 nt, Human
cacugucaauggacugcaccuug

SEQ ID NO: 55639 - RNA, 23 nt, Human
gccuguaauuccagcugcuuggg

SEQ ID NO: 55640 - RNA, 22 nt, Human
cacuccaccucucugugccuca

SEQ ID NO: 55641 - RNA, 26 nt, Human
gggaggugguaggcugcaugugccac

SEQ ID NO: 55642 - RNA, 24 nt, Human
ccggggcagagucagcucugugcu

SEQ ID NO: 55643 - RNA, 17 nt, Human
agggaagacaaaacugg

SEQ ID NO: 55644 - RNA, 23 nt, Human
ccuuucucccaaucuccauuccc

SEQ ID NO: 55645 - RNA, 20 nt, Human
cguggcgcauggcuugggga

SEQ ID NO: 55646 - RNA, 22 nt, Human
uucuguuggaagcuuguuuucc

SEQ ID NO: 55647 - RNA, 20 nt, Human
ugauggggaggcagagccag

SEQ ID NO: 55648 - RNA, 24 nt, Human
ucaaggcuucaauaagaagaugga

SEQ ID NO: 55649 - RNA, 20 nt, Human
uggccugcaugcugccugua

SEQ ID NO: 55650 - RNA, 22 nt, Human
gucccccaggcuggagugcagu

SEQ ID NO: 55651 - RNA, 22 nt, Human
gucacccaggcuggagugccgu

SEQ ID NO: 55652 - RNA, 23 nt, Human
acccccacuuagcccuucucucc

SEQ ID NO: 55653 - RNA, 24 nt, Human
gguuaagaacugugaaauuuacaa

SEQ ID NO: 55654 - RNA, 27 nt, Human
uguccccaaacaauuugguucauucag

SEQ ID NO: 55655 - RNA, 19 nt, Human
uugaugggugggaccuguc

SEQ ID NO: 55656 - RNA, 25 nt, Human
aggaggaagaggaaggcagcccugg

SEQ ID NO: 55657 - RNA, 26 nt, Human
uggcucaggcugggagggacuucagu

SEQ ID NO: 55658 - RNA, 24 nt, Human
cugucgcucaggcuggagugcagu

SEQ ID NO: 55659 - RNA, 25 nt, Human
cugguuaugaauauuaagguuggaa

SEQ ID NO: 55660 - RNA, 24 nt, Human
gcaggagaaguugcagcuuacuga

SEQ ID NO: 55661 - RNA, 24 nt, Human
cgggaccuggcucgugcagaggag

SEQ ID NO: 55662 - RNA, 22 nt, Human
cggcugaggcagcggaggugcc

SEQ ID NO: 55663 - RNA, 23 nt, Human
auucaguuugccuuccuggauuu

SEQ ID NO: 55664 - RNA, 20 nt, Human
cucgggagggugaaaggagg

SEQ ID NO: 55665 - RNA, 22 nt, Human
gagcacuuuuucgcugccugug

SEQ ID NO: 55666 - RNA, 24 nt, Human
ucaagaucauuuugagacucugaa

SEQ ID NO: 55667 - RNA, 21 nt, Human
uagacaccuuucaguaagcca

SEQ ID NO: 55668 - RNA, 23 nt, Human
cugugucacccaggcugccaggc

SEQ ID NO: 55669 - RNA, 20 nt, Human
augugggaaguguuagcuuc

SEQ ID NO: 55670 - RNA, 23 nt, Human
uccuggaccugaaggcaucugag

SEQ ID NO: 55671 - RNA, 23 nt, Human
gcggggacucagcacagcucugg

SEQ ID NO: 55672 - RNA, 22 nt, Human
ugcucaucauugcucagcuccu

SEQ ID NO: 55673 - RNA, 21 nt, Human
gccgaaccuccuggggccgga

SEQ ID NO: 55674 - RNA, 27 nt, Human
agcaauucacugcaucccucugugccu

SEQ ID NO: 55675 - RNA, 26 nt, Human
auggaaacuugagaaaggacugcuua

SEQ ID NO: 55676 - RNA, 27 nt, Human
aagaaggagcugauguggaggagcagc

SEQ ID NO: 55677 - RNA, 27 nt, Human
cuugccuugaugucugagcuuuccagu

SEQ ID NO: 55678 - RNA, 26 nt, Human
aaggacacaggagcccacaggccagu

SEQ ID NO: 55679 - RNA, 24 nt, Human
ccugccuggggccucaccugcugg

SEQ ID NO: 55680 - RNA, 22 nt, Human
gcucauaccuguaauccuagca

SEQ ID NO: 55681 - RNA, 23 nt, Human
ccaagcccugcugcuccaggaca

SEQ ID NO: 55682 - RNA, 21 nt, Human
augagacacacuuaacuacuu

SEQ ID NO: 55683 - RNA, 25 nt, Human
cuuccuggcucauccuggcucaaaa

SEQ ID NO: 55684 - RNA, 28 nt, Human
ccuauacaacuuggcuucacauacuuuu

SEQ ID NO: 55685 - RNA, 22 nt, Human
auuccuggaacuguauuuugaa

SEQ ID NO: 55686 - RNA, 30 nt, Human
uugcacuccaggcugggcagcaagagcaag

SEQ ID NO: 55687 - RNA, 21 nt, Human
cugcuucugugcuguaugcca

SEQ ID NO: 55688 - RNA, 19 nt, Human
uaucuuguaugugcacauu

SEQ ID NO: 55689 - RNA, 21 nt, Human
uucaucucucugcguucucag

SEQ ID NO: 55690 - RNA, 21 nt, Human
aggacuagcuaaaggcgucac

SEQ ID NO: 55691 - RNA, 24 nt, Human
gugagaguccugagucccucagug

SEQ ID NO: 55692 - RNA, 27 nt, Human
augggaaggugggcgggcaggggaggg

SEQ ID NO: 55693 - RNA, 20 nt, Human
ggcagagugggacugagaug

SEQ ID NO: 55694 - RNA, 22 nt, Human
ggucucaaacuccugaccucag

SEQ ID NO: 55695 - RNA, 27 nt, Human
uguuaucucccuccuggccuuuguagc

SEQ ID NO: 55696 - RNA, 23 nt, Human
gagcccuguuugggcucaggaga

SEQ ID NO: 55697 - RNA, 27 nt, Human
ggcuccaaacuuccuuucugugccuca

SEQ ID NO: 55698 - RNA, 27 nt, Human
cacugcacuccagccuggcaauagacc

SEQ ID NO: 55699 - RNA, 20 nt, Human
acucuccuccccucccucag

SEQ ID NO: 55700 - RNA, 18 nt, Human
uaggacacggaacucccu

SEQ ID NO: 55701 - RNA, 24 nt, Human
cauguguaaugcuggauguguaca

SEQ ID NO: 55702 - RNA, 25 nt, Human
ugaucauguauuuauaaauauuuua

SEQ ID NO: 55703 - RNA, 22 nt, Human
ccuccucgccagcucuuccgcu

SEQ ID NO: 55704 - RNA, 24 nt, Human
ggcauggcuccaauccauucuuug

SEQ ID NO: 55705 - RNA, 21 nt, Human
gcuucugcucauuacuacacu

SEQ ID NO: 55706 - RNA, 21 nt, Human
uucucuuucucucuguuuuua

SEQ ID NO: 55707 - RNA, 21 nt, Human
ccuccuucccgccugccugua

SEQ ID NO: 55708 - RNA, 20 nt, Human
uccaaauaaugaacuaccug

SEQ ID NO: 55709 - RNA, 22 nt, Human
ugcaacuuguaaaugugguaaa

SEQ ID NO: 55710 - RNA, 23 nt, Human
cacuuaaggagcuaaacuuaccu

SEQ ID NO: 55711 - RNA, 22 nt, Human
uacuaugugcaggaacccuugg

SEQ ID NO: 55712 - RNA, 21 nt, Human
gccugaaggguucugcacauu

SEQ ID NO: 55713 - RNA, 22 nt, Human
gcuugaaaucuugcuguacuau

SEQ ID NO: 55714 - RNA, 19 nt, Human
gcccugcgugggggccagu

SEQ ID NO: 55715 - RNA, 20 nt, Human
uuuucucucaaaugaaaauu

SEQ ID NO: 55716 - RNA, 26 nt, Human
caacagcagcccucgcagcccgccag

SEQ ID NO: 55717 - RNA, 26 nt, Human
agcagauggcaaagauagcagccuga

SEQ ID NO: 55718 - RNA, 22 nt, Human
aguggugcaaucucggcucacu

SEQ ID NO: 55719 - RNA, 24 nt, Human
ugcaaacugccuuuuccacacaaa

SEQ ID NO: 55720 - RNA, 25 nt, Human
aaggaugaauuagcauggucuuaaa

SEQ ID NO: 55721 - RNA, 28 nt, Human
ucucgaacucccgaccucaggugaucug

SEQ ID NO: 55722 - RNA, 31 nt, Human
ccagagauuagccccgcauuccgcaucuguc

SEQ ID NO: 55723 - RNA, 21 nt, Human
uuucgaacuccugaccucaga

SEQ ID NO: 55724 - RNA, 26 nt, Human
ggcugacuuccucacuauccucuuca

SEQ ID NO: 55725 - RNA, 22 nt, Human
gcccugcugcacuccggccgcg

SEQ ID NO: 55726 - RNA, 18 nt, Human
uuaugauuuuuucccucu

SEQ ID NO: 55727 - RNA, 21 nt, Human
uccaggagcauagaagccaca

SEQ ID NO: 55728 - RNA, 22 nt, Human
ccaacauagugaaacccccucu

SEQ ID NO: 55729 - RNA, 21 nt, Human
ggaggcggagauugcagugag

SEQ ID NO: 55730 - RNA, 21 nt, Human
ggaggcggagguugcaguaag

SEQ ID NO: 55731 - RNA, 22 nt, Human
ucuccaguuuuucuccaucucc

SEQ ID NO: 55732 - RNA, 20 nt, Human
acucugggcuggaggcaggg

SEQ ID NO: 55733 - RNA, 17 nt, Human
ugguggugucuugggga

SEQ ID NO: 55734 - RNA, 20 nt, Human
ucaugccacaccgguacccu

SEQ ID NO: 55735 - RNA, 20 nt, Human
gacaaauaccugcugucacu

SEQ ID NO: 55736 - RNA, 23 nt, Human
cugacccauggggccugccugug

SEQ ID NO: 55737 - RNA, 23 nt, Human
acauuuagcuuguucacacuuug

SEQ ID NO: 55738 - RNA, 22 nt, Human
acagcuagugguggagcuggag

SEQ ID NO: 55739 - RNA, 22 nt, Human
gccaaggcuggagugcaggccg

SEQ ID NO: 55740 - RNA, 19 nt, Human
uuguaacuacaccaaacac

SEQ ID NO: 55741 - RNA, 23 nt, Human
ugacucucuggguugccugcuuc

SEQ ID NO: 55742 - RNA, 22 nt, Human
ccuguucaucugugcaccacuu

SEQ ID NO: 55743 - RNA, 20 nt, Human
cuguaucccccaggucuccu

SEQ ID NO: 55744 - RNA, 20 nt, Human
auggaaauggugaauuccaa

SEQ ID NO: 55745 - RNA, 19 nt, Human
acugugcauguauguaaua

SEQ ID NO: 55746 - RNA, 23 nt, Human
uggggggucaggaaaaacaugcg

SEQ ID NO: 55747 - RNA, 22 nt, Human
cugccugguguuaggucucugc

SEQ ID NO: 55748 - RNA, 21 nt, Human
ccuuagauuagcucuggacca

SEQ ID NO: 55749 - RNA, 21 nt, Human
guaccugauuuuucaugagcc

SEQ ID NO: 55750 - RNA, 21 nt, Human
cacugccuuuuccucaaggga

SEQ ID NO: 55751 - RNA, 23 nt, Human
cucucccucccccuucaggggcu

SEQ ID NO: 55752 - RNA, 22 nt, Human
caaaccugguucauauuuauac

SEQ ID NO: 55753 - RNA, 26 nt, Human
ugcuccuuagagaagggaagaugagu

SEQ ID NO: 55754 - RNA, 26 nt, Human
cucugccucccagguucaagcaauuc

SEQ ID NO: 55755 - RNA, 20 nt, Human
cagcuuuucugucuccuggg

SEQ ID NO: 55756 - RNA, 21 nt, Human
ggacuucucccgucucuaggg

SEQ ID NO: 55757 - RNA, 25 nt, Human
cguccgccucccggguugacaccau

SEQ ID NO: 55758 - RNA, 21 nt, Human
gcguuuuagccagucuggaca

SEQ ID NO: 55759 - RNA, 20 nt, Human
gcacauccuucuuggcuucc

SEQ ID NO: 55760 - RNA, 18 nt, Human
aggccacuaucauccucc

SEQ ID NO: 55761 - RNA, 18 nt, Human
ggugauggcagggccagg

SEQ ID NO: 55762 - RNA, 23 nt, Human
uuuccacccucucuccaccugcc

SEQ ID NO: 55763 - RNA, 21 nt, Human
caaccaggcuagaaugcagcg

SEQ ID NO: 55764 - RNA, 21 nt, Human
gcuauaauccuagcacuuugg

SEQ ID NO: 55765 - RNA, 23 nt, Human
uauucuauuuaggaaucguucuu

SEQ ID NO: 55766 - RNA, 23 nt, Human
auuaggaagugguagaaacuuua

SEQ ID NO: 55767 - RNA, 24 nt, Human
cugccauggacacuucacccaccc

SEQ ID NO: 55768 - RNA, 22 nt, Human
ccagcuuuucggaacagcagag

SEQ ID NO: 55769 - RNA, 21 nt, Human
ucuuugaggucaaaauucagc

SEQ ID NO: 55770 - RNA, 24 nt, Human
cucaguuuuuaugaacuguuguau

SEQ ID NO: 55771 - RNA, 26 nt, Human
aucuugaacuccugggcucaagagau

SEQ ID NO: 55772 - RNA, 21 nt, Human
aaauguucuaccucugcacuc

SEQ ID NO: 55773 - RNA, 22 nt, Human
guucuguugaucccacuucacu

SEQ ID NO: 55774 - RNA, 29 nt, Human
uuucagcuuuucugucuccugggggguuu

SEQ ID NO: 55775 - RNA, 20 nt, Human
ucucagacacaugcaccaga

SEQ ID NO: 55776 - RNA, 24 nt, Human
ccaacagcaguccaagcucaguca

SEQ ID NO: 55777 - RNA, 22 nt, Human
gugcgggccccgaggccaguuu

SEQ ID NO: 55778 - RNA, 21 nt, Human
ggcucacugcaaccucuuccu

SEQ ID NO: 55779 - RNA, 23 nt, Human
uaccagccagcaggaggugauca

SEQ ID NO: 55780 - RNA, 21 nt, Human
caucugccuccuuaagccaca

SEQ ID NO: 55781 - RNA, 22 nt, Human
cccgggcuggcgggagugcagu

SEQ ID NO: 55782 - RNA, 23 nt, Human
ucaugccauuuucccgcagagcu

SEQ ID NO: 55783 - RNA, 23 nt, Human
cucccccaauaaacucgccucuu

SEQ ID NO: 55784 - RNA, 22 nt, Human
guuugaagcuacugcugccucc

SEQ ID NO: 55785 - RNA, 23 nt, Human
cucaagugauucuccugccucag

SEQ ID NO: 55786 - RNA, 23 nt, Human
uaaaccccuggcuuuugugcaca

SEQ ID NO: 55787 - RNA, 26 nt, Human
acucggagcgggacuaggauccuccc

SEQ ID NO: 55788 - RNA, 24 nt, Human
gcugugcauguuggcuucuuugga

SEQ ID NO: 55789 - RNA, 21 nt, Human
gcuaagcuuuacaguggcaaa

SEQ ID NO: 55790 - RNA, 27 nt, Human
ggucucaaacuccugaccucaagugau

SEQ ID NO: 55791 - RNA, 23 nt, Human
aacuagaacaaauacagucuuag

SEQ ID NO: 55792 - RNA, 22 nt, Human
gaacauccuuucccugcagucc

SEQ ID NO: 55793 - RNA, 27 nt, Human
aaccugacaaccauguguacaccaggg

SEQ ID NO: 55794 - RNA, 21 nt, Human
ggcuaauuuuguauuuuuaag

SEQ ID NO: 55795 - RNA, 22 nt, Human
ccaugagguggagguugcggug

SEQ ID NO: 55796 - RNA, 23 nt, Human
gggagcuauagggaccucaggga

SEQ ID NO: 55797 - RNA, 26 nt, Human
aggaacagacaaaaauagaugacaug

SEQ ID NO: 55798 - RNA, 22 nt, Human
ccaaagugcugagauuacaggu

SEQ ID NO: 55799 - RNA, 22 nt, Human
ccaaagugcugggauuacaagu

SEQ ID NO: 55800 - RNA, 22 nt, Human
ccagagugcugggauuacaggu

SEQ ID NO: 55801 - RNA, 18 nt, Human
ccucucucauaucacuga

SEQ ID NO: 55802 - RNA, 22 nt, Human
aguugcccagacuggagagcag

SEQ ID NO: 55803 - RNA, 26 nt, Human
ucuccaccccucccacauuuacagcc

SEQ ID NO: 55804 - RNA, 27 nt, Human
uuauucuaugucaaugauuuuuaagcu

SEQ ID NO: 55805 - RNA, 21 nt, Human
gcaaguauaaugaauguagca

SEQ ID NO: 55806 - RNA, 21 nt, Human
caggguugagaacagaaggug

SEQ ID NO: 55807 - RNA, 19 nt, Human
acauccugcaaaaagccca

SEQ ID NO: 55808 - RNA, 20 nt, Human
cuuuuuaaaggaacuucgug

SEQ ID NO: 55809 - RNA, 22 nt, Human
aggcuucugaguagcugggauu

SEQ ID NO: 55810 - RNA, 22 nt, Human
ugcuggugagaggugcaaagag

SEQ ID NO: 55811 - RNA, 21 nt, Human
uugcccaguguuugugcaagg

SEQ ID NO: 55812 - RNA, 24 nt, Human
agggguggggacggcgaggaggug

SEQ ID NO: 55813 - RNA, 20 nt, Human
acugccucugugugccccuu

SEQ ID NO: 55814 - RNA, 24 nt, Human
uuagauacccaacuuaaaccaaag

SEQ ID NO: 55815 - RNA, 20 nt, Human
ccacaaacacuacaacugca

SEQ ID NO: 55816 - RNA, 30 nt, Human
cagccugacauggaaauggaggcaaacgag

SEQ ID NO: 55817 - RNA, 19 nt, Human
agagcaagacuccaucuca

SEQ ID NO: 55818 - RNA, 28 nt, Human
ucaaggcuugguuccuggaaaguaaagg

SEQ ID NO: 55819 - RNA, 30 nt, Human
ucuccagcugcucugcacacauggacaggg

SEQ ID NO: 55820 - RNA, 21 nt, Human
caugugcagaagaugagguau

SEQ ID NO: 55821 - RNA, 21 nt, Human
gcucacugcaaccuccgccuc

SEQ ID NO: 55822 - RNA, 21 nt, Human
cuaccugcaacacaacauuug

SEQ ID NO: 55823 - RNA, 23 nt, Human
acccucauuucaccugcgcugug

SEQ ID NO: 55824 - RNA, 23 nt, Human
cccuggccucugcucaacuagca

SEQ ID NO: 55825 - RNA, 21 nt, Human
gcggaacucuuccuggaaugc

SEQ ID NO: 55826 - RNA, 23 nt, Human
uauggguggagggugaguuugaa

SEQ ID NO: 55827 - RNA, 19 nt, Human
aucauuaacaccuucccca

SEQ ID NO: 55828 - RNA, 20 nt, Human
gacuauggcuaccaaaaaga

SEQ ID NO: 55829 - RNA, 21 nt, Human
cagccuauuuugauuaacaaa

SEQ ID NO: 55830 - RNA, 22 nt, Human
aagugcuuuaccuaaguguuga

SEQ ID NO: 55831 - RNA, 26 nt, Human
ccucuccugcugcugaccugaucacc

SEQ ID NO: 55832 - RNA, 23 nt, Human
cugaugguuugguuuccucucug

SEQ ID NO: 55833 - RNA, 23 nt, Human
gaccuauacugaaagaucucugu

SEQ ID NO: 55834 - RNA, 23 nt, Human
auaauaaggaauaaaccccaccu

SEQ ID NO: 55835 - RNA, 24 nt, Human
ucuucauucuuuuauacucagcuu

SEQ ID NO: 55836 - RNA, 21 nt, Human
aacuccugaccucaagcaauu

SEQ ID NO: 55837 - RNA, 22 nt, Human
aacuuacuggaagugugccucu

SEQ ID NO: 55838 - RNA, 24 nt, Human
cauccaggcuggccagugcugccc

SEQ ID NO: 55839 - RNA, 22 nt, Human
cccggcucucccgaugugaacc

SEQ ID NO: 55840 - RNA, 22 nt, Human
ggcagagguugaagauggaaga

SEQ ID NO: 55841 - RNA, 25 nt, Human
cagagaaagggagggagggagccac

SEQ ID NO: 55842 - RNA, 23 nt, Human
ccugcaguuuuuaauuugguaga

SEQ ID NO: 55843 - RNA, 23 nt, Human
gacgggguuuccccauguugguc

SEQ ID NO: 55844 - RNA, 26 nt, Human
aaaaugaugcaaaaucaaaaugagug

SEQ ID NO: 55845 - RNA, 27 nt, Human
gucucacuauguugucuaggcuggucu

SEQ ID NO: 55846 - RNA, 22 nt, Human
auuuccagaguucuuccuuccc

SEQ ID NO: 55847 - RNA, 23 nt, Human
cugccuggccaugcugucccugc

SEQ ID NO: 55848 - RNA, 18 nt, Human
agguauuucaaaauaaau

SEQ ID NO: 55849 - RNA, 21 nt, Human
agagugagggugaaggcaaga

SEQ ID NO: 55850 - RNA, 22 nt, Human
aaaucacuguguuuucagcuca

SEQ ID NO: 55851 - RNA, 22 nt, Human
ccacucggggaacuccuuucca

SEQ ID NO: 55852 - RNA, 22 nt, Human
aggcgaucuugugucuacucua

SEQ ID NO: 55853 - RNA, 27 nt, Human
uucuguuccacugcucuucucugguuc

SEQ ID NO: 55854 - RNA, 27 nt, Human
ccccacccucccucggcuuuacuccug

SEQ ID NO: 55855 - RNA, 24 nt, Human
acugacacugguauuccugccucc

SEQ ID NO: 55856 - RNA, 25 nt, Human
ucacagccaaaccacugacauuccu

SEQ ID NO: 55857 - RNA, 20 nt, Human
cacgccaaucccaaaggcau

SEQ ID NO: 55858 - RNA, 20 nt, Human
acccuugugugaaaugaagg

SEQ ID NO: 55859 - RNA, 23 nt, Human
ggucaccguuucaccaucaugcu

SEQ ID NO: 55860 - RNA, 21 nt, Human
uuccuuaaaaucucuaauaga

SEQ ID NO: 55861 - RNA, 23 nt, Human
uugcccaggcuggcgugcagugg

SEQ ID NO: 55862 - RNA, 22 nt, Human
cucauuuugcauuacugucuuc

SEQ ID NO: 55863 - RNA, 22 nt, Human
uggggaacuugaucuguacugu

SEQ ID NO: 55864 - RNA, 26 nt, Human
guugcacauuuguccagaugaagcaa

SEQ ID NO: 55865 - RNA, 22 nt, Human
cucggccucccaaagugcugcg

SEQ ID NO: 55866 - RNA, 25 nt, Human
acucuauccuggauagguauuuaga

SEQ ID NO: 55867 - RNA, 26 nt, Human
cccuacucucuccuuuuugcuuccuc

SEQ ID NO: 55868 - RNA, 27 nt, Human
uucccacaugccgugacucuggacuau

SEQ ID NO: 55869 - RNA, 23 nt, Human
aacuugacugggugagacccaaa

SEQ ID NO: 55870 - RNA, 23 nt, Human
gucgcccaggcuggagugcaguc

SEQ ID NO: 55871 - RNA, 24 nt, Human
agauuguuaaauugagacaaguaa

SEQ ID NO: 55872 - RNA, 20 nt, Human
gacucugguuacccuugccu

SEQ ID NO: 55873 - RNA, 26 nt, Human
ggaggaguggggaccgggcggggggu

SEQ ID NO: 55874 - RNA, 23 nt, Human
uaaacacauguucugugccugcu

SEQ ID NO: 55875 - RNA, 23 nt, Human
caggcaggcuggggaggccagug

SEQ ID NO: 55876 - RNA, 23 nt, Human
uccagugcaguccauuuccuaau

SEQ ID NO: 55877 - RNA, 23 nt, Human
ccucucucuguguaucugugcca

SEQ ID NO: 55878 - RNA, 21 nt, Human
ggaggacuugcuggggaccag

SEQ ID NO: 55879 - RNA, 20 nt, Human
ccuccuccucuccagcuggu

SEQ ID NO: 55880 - RNA, 20 nt, Human
cacaggaacucugugugaga

SEQ ID NO: 55881 - RNA, 20 nt, Human
auagcacauauggaauuuug

SEQ ID NO: 55882 - RNA, 27 nt, Human
uacccuuuuucuugaauauuugccacc

SEQ ID NO: 55883 - RNA, 20 nt, Human
gucuccuugcugucauccca

SEQ ID NO: 55884 - RNA, 27 nt, Human
ugggggaggcagacaugggagugccaa

SEQ ID NO: 55885 - RNA, 26 nt, Human
ugcccugcgcuccuccacagccuggg

SEQ ID NO: 55886 - RNA, 26 nt, Human
ugaggcaagagaaggccagaaaccau

SEQ ID NO: 55887 - RNA, 27 nt, Human
ugucauuguccuaaaaccuuauuuuag

SEQ ID NO: 55888 - RNA, 19 nt, Human
ggggugaggaguuggcaau

SEQ ID NO: 55889 - RNA, 21 nt, Human
caccuccuggguucaagcagu

SEQ ID NO: 55890 - RNA, 19 nt, Human
augauuccuugagcauuuu

SEQ ID NO: 55891 - RNA, 23 nt, Human
cagcccagcugacugugccuguu

SEQ ID NO: 55892 - RNA, 21 nt, Human
acgugacagaauugguacuca

SEQ ID NO: 55893 - RNA, 23 nt, Human
cacacacccccacuuuccucuac

SEQ ID NO: 55894 - RNA, 17 nt, Human
gagggugggugggugga

SEQ ID NO: 55895 - RNA, 21 nt, Human
uuuuggggaggauuugcugaa

SEQ ID NO: 55896 - RNA, 22 nt, Human
gggauuacaggugcccaccacc

SEQ ID NO: 55897 - RNA, 23 nt, Human
uagggcugaaaagagaagacuga

SEQ ID NO: 55898 - RNA, 21 nt, Human
uguugaccuaucaucauuuuc

SEQ ID NO: 55899 - RNA, 19 nt, Human
gcugggcuucuguccuccu

SEQ ID NO: 55900 - RNA, 23 nt, Human
cucggccucccaaagugcuugga

SEQ ID NO: 55901 - RNA, 21 nt, Human
gaccaggcaacauuucauuug

SEQ ID NO: 55902 - RNA, 30 nt, Human
gagaggccagggacagggagaccggugcga

SEQ ID NO: 55903 - RNA, 23 nt, Human
ccuccuccugauuucccugcucu

SEQ ID NO: 55904 - RNA, 19 nt, Human
uuugcaaugaaauuuuggg

SEQ ID NO: 55905 - RNA, 22 nt, Human
uguccaaguaggcuaggcucca

SEQ ID NO: 55906 - RNA, 27 nt, Human
ccuggccucccagcccugcccggcugc

SEQ ID NO: 55907 - RNA, 25 nt, Human
gcuccccacgcuggcugcugugcag

SEQ ID NO: 55908 - RNA, 23 nt, Human
gcaaacccugcaaagggcuggga

SEQ ID NO: 55909 - RNA, 21 nt, Human
gccccuggccccuugcuguuc

SEQ ID NO: 55910 - RNA, 25 nt, Human
ggaggguuagauagagaaugcugaa

SEQ ID NO: 55911 - RNA, 25 nt, Human
gucugaccacucugacaggucucca

SEQ ID NO: 55912 - RNA, 21 nt, Human
gcauuguaggaucuuuagcag

SEQ ID NO: 55913 - RNA, 20 nt, Human
agggcuccaagauucgccgc

SEQ ID NO: 55914 - RNA, 27 nt, Human
ucuuauacuuuuucaguugcugucuua

SEQ ID NO: 55915 - RNA, 21 nt, Human
guggcagcucacaggcaugag

SEQ ID NO: 55916 - RNA, 21 nt, Human
cuucccuuuaacccaagaccc

SEQ ID NO: 55917 - RNA, 22 nt, Human
aaaauuacaaaaauuagccgag

SEQ ID NO: 55918 - RNA, 23 nt, Human
ccuggcugcugccauaguuucug

SEQ ID NO: 55919 - RNA, 24 nt, Human
ccuuuugcugcucacugagaaccc

SEQ ID NO: 55920 - RNA, 30 nt, Human
ccuccugccgacuccuggguugagcuguug

SEQ ID NO: 55921 - RNA, 18 nt, Human
gcacauuugaaugccuua

SEQ ID NO: 55922 - RNA, 22 nt, Human
ggcaaauacuugcacucaguau

SEQ ID NO: 55923 - RNA, 22 nt, Human
gauugcaccacugcacuccagg

SEQ ID NO: 55924 - RNA, 25 nt, Human
acagaugaaaagccucuguuuugau

SEQ ID NO: 55925 - RNA, 21 nt, Human
uguugcccaggcuggucucga

SEQ ID NO: 55926 - RNA, 24 nt, Human
ccagcccaggcguuggguguuagu

SEQ ID NO: 55927 - RNA, 22 nt, Human
agaccuacaggcugacguuccg

SEQ ID NO: 55928 - RNA, 20 nt, Human
ggcggcaucuuuaacuggcc

SEQ ID NO: 55929 - RNA, 26 nt, Human
ugagucuagggcagauucuucccucu

SEQ ID NO: 55930 - RNA, 22 nt, Human
ccgaaguugcaccauugcacuc

SEQ ID NO: 55931 - RNA, 15 nt, Human
cacuacccuucuccu

SEQ ID NO: 55932 - RNA, 17 nt, Human
ccugccuggccugcuca

SEQ ID NO: 55933 - RNA, 20 nt, Human
cagccucucugggcacuugc

SEQ ID NO: 55934 - RNA, 22 nt, Human
ugacacgcaaagacacagcccu

SEQ ID NO: 55935 - RNA, 23 nt, Human
gacucacuucaaugugucauuuc

SEQ ID NO: 55936 - RNA, 22 nt, Human
agccugaagagccccaaagcag

SEQ ID NO: 55937 - RNA, 21 nt, Human
uuguaaggagaaguucuccuu

SEQ ID NO: 55938 - RNA, 21 nt, Human
cauaccugcuccucaucugcc

SEQ ID NO: 55939 - RNA, 22 nt, Human
cucgggccgccgcagugcagcg

SEQ ID NO: 55940 - RNA, 24 nt, Human
gguggggggucucccuauguugcc

SEQ ID NO: 55941 - RNA, 22 nt, Human
accaaaauacuacuaugccuua

SEQ ID NO: 55942 - RNA, 24 nt, Human
ugucuggaaaagcacuuuacagau

SEQ ID NO: 55943 - RNA, 21 nt, Human
aaguuauaaccuccugccugg

SEQ ID NO: 55944 - RNA, 23 nt, Human
agaguagacaagcagacaagaga

SEQ ID NO: 55945 - RNA, 23 nt, Human
gcucccucuucagcccgcugagg

SEQ ID NO: 55946 - RNA, 24 nt, Human
cccagccaccagcccucauccucu

SEQ ID NO: 55947 - RNA, 24 nt, Human
gguacuugggaccccagugccuug

SEQ ID NO: 55948 - RNA, 24 nt, Human
uugccaguaagcaccucucucccu

SEQ ID NO: 55949 - RNA, 28 nt, Human
auggggcugcucugagggaaacgcuguc

SEQ ID NO: 55950 - RNA, 23 nt, Human
aagagauagcuuucaagggccca

SEQ ID NO: 55951 - RNA, 27 nt, Human
ccaccccguuccccacccuugccaccu

SEQ ID NO: 55952 - RNA, 22 nt, Human
uaucagauauaguaaauuuaua

SEQ ID NO: 55953 - RNA, 22 nt, Human
gcucuuucuccccucccucccc

SEQ ID NO: 55954 - RNA, 21 nt, Human
cccuccaggggacacagcucc

SEQ ID NO: 55955 - RNA, 16 nt, Human
gauugcuucuguagua

SEQ ID NO: 55956 - RNA, 26 nt, Human
gggcucccacccucugcuccuggccu

SEQ ID NO: 55957 - RNA, 22 nt, Human
gccuauaaucccagcacuuugg

SEQ ID NO: 55958 - RNA, 22 nt, Human
gccuguaaucccagcacuuuag

SEQ ID NO: 55959 - RNA, 24 nt, Human
ugguaaacacugguguguuuugaa

SEQ ID NO: 55960 - RNA, 22 nt, Human
cuccugagggagcuccaacuca

SEQ ID NO: 55961 - RNA, 22 nt, Human
ggccagugccuggugcucuggc

SEQ ID NO: 55962 - RNA, 21 nt, Human
cuuggccucccaaaugcuggg

SEQ ID NO: 55963 - RNA, 17 nt, Human
ucauguccuuacacucc

SEQ ID NO: 55964 - RNA, 26 nt, Human
ucacugcagccuuucacaggacucug

SEQ ID NO: 55965 - RNA, 23 nt, Human
gucgcccagggcuuggcuacugu

SEQ ID NO: 55966 - RNA, 22 nt, Human
cuauuuuacgucauucuaaauu

SEQ ID NO: 55967 - RNA, 19 nt, Human
guuuuuaccaaaguggcca

SEQ ID NO: 55968 - RNA, 22 nt, Human
ucaauugaggggaaagugcagu

SEQ ID NO: 55969 - RNA, 22 nt, Human
cuagccaucaugacaccucugg

SEQ ID NO: 55970 - RNA, 26 nt, Human
uuggacccagaucuguucaugcuuuu

SEQ ID NO: 55971 - RNA, 26 nt, Human
gccagguuuucuggguguccaaagga

SEQ ID NO: 55972 - RNA, 25 nt, Human
uuuccugaucccuuccccuuccacu

SEQ ID NO: 55973 - RNA, 23 nt, Human
caggaccugcggcaucagcaucc

SEQ ID NO: 55974 - RNA, 21 nt, Human
aaauguucuauuuaacaacug

SEQ ID NO: 55975 - RNA, 21 nt, Human
gucauuucuucagaacucccc

SEQ ID NO: 55976 - RNA, 26 nt, Human
ggccucaagcaauccuccugccucag

SEQ ID NO: 55977 - RNA, 20 nt, Human
ucugcuccacgccaacuccc

SEQ ID NO: 55978 - RNA, 28 nt, Human
gagagggagagggggcugaggagguagu

SEQ ID NO: 55979 - RNA, 23 nt, Human
cuguucuaaauguuaacaccugu

SEQ ID NO: 55980 - RNA, 26 nt, Human
ggugaaugcccucugcuggggugggg

SEQ ID NO: 55981 - RNA, 22 nt, Human
uccagggcauaaaacucaaccc

SEQ ID NO: 55982 - RNA, 22 nt, Human
aggagagagggucaggagccag

SEQ ID NO: 55983 - RNA, 26 nt, Human
cugccucuaaaaggccugucccugca

SEQ ID NO: 55984 - RNA, 21 nt, Human
uugcccaggucuucugcgauc

SEQ ID NO: 55985 - RNA, 23 nt, Human
cugguccccguccagccgcugac

SEQ ID NO: 55986 - RNA, 26 nt, Human
ugggaggcagggggcaggccugcgga

SEQ ID NO: 55987 - RNA, 22 nt, Human
ggcauuaugggcccugccuccc

SEQ ID NO: 55988 - RNA, 20 nt, Human
guuagaaggcugccuucuca

SEQ ID NO: 55989 - RNA, 25 nt, Human
ugaguugggcuggucacagccuugu

SEQ ID NO: 55990 - RNA, 24 nt, Human
cgagugagagguuccgggcagcag

SEQ ID NO: 55991 - RNA, 27 nt, Human
ugccuguagucucagcuacuuaggagg

SEQ ID NO: 55992 - RNA, 19 nt, Human
cucagugaagguggggaga

SEQ ID NO: 55993 - RNA, 27 nt, Human
aaaauauugcaauaaaugagaccgaug

SEQ ID NO: 55994 - RNA, 23 nt, Human
gcacucaggaugacuguggagaa

SEQ ID NO: 55995 - RNA, 23 nt, Human
cugcccuucagaguagccucacc

SEQ ID NO: 55996 - RNA, 26 nt, Human
gagagggccaggcagucgcacuguga

SEQ ID NO: 55997 - RNA, 25 nt, Human
gccagcgccagccucaacagccgcc

SEQ ID NO: 55998 - RNA, 25 nt, Human
agacaggagagauuauuuacaagaa

SEQ ID NO: 55999 - RNA, 22 nt, Human
cccgaauagcugggacuacagg

SEQ ID NO: 56000 - RNA, 24 nt, Human
guauuucucauuccugccuccuca

SEQ ID NO: 56001 - RNA, 17 nt, Human
gccaccugcugcagucu

SEQ ID NO: 56002 - RNA, 23 nt, Human
ggcucugugcugacauggcucug

SEQ ID NO: 56003 - RNA, 20 nt, Human
gugacuucccuuugcaaacc

SEQ ID NO: 56004 - RNA, 27 nt, Human
gaguagcuaggauuacaggugccugcc

SEQ ID NO: 56005 - RNA, 19 nt, Human
gcccuacuucuugcacuga

SEQ ID NO: 56006 - RNA, 20 nt, Human
uccucguuuugaaagcaguu

SEQ ID NO: 56007 - RNA, 25 nt, Human
gcagacaucuuccacguggagaagc

SEQ ID NO: 56008 - RNA, 20 nt, Human
acugcagcugcucgguugcc

SEQ ID NO: 56009 - RNA, 22 nt, Human
uggcugaggcaggagaacuacu

SEQ ID NO: 56010 - RNA, 23 nt, Human
agacggacaggguccucacccua

SEQ ID NO: 56011 - RNA, 21 nt, Human
gugcagcuggcucgcgccucc

SEQ ID NO: 56012 - RNA, 22 nt, Human
agcuuugaaaauucaguggugu

SEQ ID NO: 56013 - RNA, 24 nt, Human
gguccuuuuccugccuccuucaca

SEQ ID NO: 56014 - RNA, 23 nt, Human
ccaccuucucaacacugcugaaa

SEQ ID NO: 56015 - RNA, 21 nt, Human
aacagcuuggguuuguuagaa

SEQ ID NO: 56016 - RNA, 24 nt, Human
uccgucgccgcugccuccuccccc

SEQ ID NO: 56017 - RNA, 24 nt, Human
agagucaaaggguagagugaacag

SEQ ID NO: 56018 - RNA, 26 nt, Human
gcuguugcugggggccgauucugauc

SEQ ID NO: 56019 - RNA, 25 nt, Human
cuucugcaucaaaggagauucuuug

SEQ ID NO: 56020 - RNA, 23 nt, Human
gccgcgcuccagccucgcucucc

SEQ ID NO: 56021 - RNA, 21 nt, Human
cuaggccugggacuccugggu

SEQ ID NO: 56022 - RNA, 23 nt, Human
gucacccugcucccaagugcaac

SEQ ID NO: 56023 - RNA, 26 nt, Human
ccgcgccgccuucccccaucucuucc

SEQ ID NO: 56024 - RNA, 25 nt, Human
ccuccacccccuccugucaccggcc

SEQ ID NO: 56025 - RNA, 27 nt, Human
accagccugaccaacauggagaagccc

SEQ ID NO: 56026 - RNA, 27 nt, Human
accagccugaccaacguggagaaaccc

SEQ ID NO: 56027 - RNA, 23 nt, Human
uggagaaacagaaaaaucuuggg

SEQ ID NO: 56028 - RNA, 26 nt, Human
accugugccaagccuagcacuuguga

SEQ ID NO: 56029 - RNA, 26 nt, Human
cgccuugccacaucugugucucugga

SEQ ID NO: 56030 - RNA, 20 nt, Human
aucaaugucacaugaacaaa

SEQ ID NO: 56031 - RNA, 23 nt, Human
accucauccucuccacagcugcc

SEQ ID NO: 56032 - RNA, 19 nt, Human
cagcuacucaggagucuga

SEQ ID NO: 56033 - RNA, 21 nt, Human
gcucacaaagcuggaaauacu

SEQ ID NO: 56034 - RNA, 21 nt, Human
agcugaagcguuacuacagca

SEQ ID NO: 56035 - RNA, 21 nt, Human
cugguccaugauggagucagg

SEQ ID NO: 56036 - RNA, 22 nt, Human
ugccuccuggguucaagugauu

SEQ ID NO: 56037 - RNA, 20 nt, Human
aucguacccagccugggcaa

SEQ ID NO: 56038 - RNA, 30 nt, Human
ucagcgcuucuucuuucuugguuugauccu

SEQ ID NO: 56039 - RNA, 22 nt, Human
ccaacauggugaaaccccaucu

SEQ ID NO: 56040 - RNA, 22 nt, Human
ccaacauggcaaaacccugucu

SEQ ID NO: 56041 - RNA, 22 nt, Human
ucauaacuucauagaugcagga

SEQ ID NO: 56042 - RNA, 23 nt, Human
agaauaaauauauaaauaaauac

SEQ ID NO: 56043 - RNA, 21 nt, Human
ccucugcaguguccucuuguu

SEQ ID NO: 56044 - RNA, 23 nt, Human
ucccacccgaccuuccucucugu

SEQ ID NO: 56045 - RNA, 27 nt, Human
agcucacuguaaccucaaacucugggg

SEQ ID NO: 56046 - RNA, 21 nt, Human
ggaguuggagagcacaguugc

SEQ ID NO: 56047 - RNA, 21 nt, Human
ggugugguggcuuuaauccca

SEQ ID NO: 56048 - RNA, 24 nt, Human
caaagagaagcugucuuuacagga

SEQ ID NO: 56049 - RNA, 23 nt, Human
gcgcccgagaugauggugcugga

SEQ ID NO: 56050 - RNA, 20 nt, Human
uuguccucuugaccuguguc

SEQ ID NO: 56051 - RNA, 25 nt, Human
cagguuaaagaugguugcagcugga

SEQ ID NO: 56052 - RNA, 23 nt, Human
gcugcugcugcccugacuuuggc

SEQ ID NO: 56053 - RNA, 24 nt, Human
gccagcacccagcaucuccuggcc

SEQ ID NO: 56054 - RNA, 21 nt, Human
ggaggcacugcugauugaaga

SEQ ID NO: 56055 - RNA, 23 nt, Human
ggacuccugccuuuccuguuuag

SEQ ID NO: 56056 - RNA, 24 nt, Human
acuagcacgacuuacauagcucaa

SEQ ID NO: 56057 - RNA, 24 nt, Human
ggcgcugcgggcgaggugggcagg

SEQ ID NO: 56058 - RNA, 25 nt, Human
cagggucccaucacagccacaccac

SEQ ID NO: 56059 - RNA, 25 nt, Human
guuccagggacuuuuuauuugaccc

SEQ ID NO: 56060 - RNA, 22 nt, Human
gccggaccgggcagccagaaaa

SEQ ID NO: 56061 - RNA, 27 nt, Human
aggacauuugacuguuuacuuucucca

SEQ ID NO: 56062 - RNA, 23 nt, Human
agcaggagcaucuucuuggcagc

SEQ ID NO: 56063 - RNA, 19 nt, Human
ccuuguucccuccugcccc

SEQ ID NO: 56064 - RNA, 22 nt, Human
uggcacauggcuauaaucccag

SEQ ID NO: 56065 - RNA, 20 nt, Human
gcuacuuccuguaaugagga

SEQ ID NO: 56066 - RNA, 22 nt, Human
uuugcugcugcccauguuucaa

SEQ ID NO: 56067 - RNA, 26 nt, Human
ccagugcuugccaaugcaaauugccu

SEQ ID NO: 56068 - RNA, 21 nt, Human
cagaucugggccuccugcugc

SEQ ID NO: 56069 - RNA, 24 nt, Human
ccuucuccgcccccuccccuggcu

SEQ ID NO: 56070 - RNA, 18 nt, Human
gacccucugggcugugcc

SEQ ID NO: 56071 - RNA, 22 nt, Human
uuugguuaaaaucucuguagau

SEQ ID NO: 56072 - RNA, 26 nt, Human
ggccagaauagaaccacugguuaaac

SEQ ID NO: 56073 - RNA, 27 nt, Human
gaagucuuggcagggaaaucccuuuug

SEQ ID NO: 56074 - RNA, 21 nt, Human
cacacaguauuaagugacagu

SEQ ID NO: 56075 - RNA, 25 nt, Human
aagccuguaguccauuauuacuugg

SEQ ID NO: 56076 - RNA, 25 nt, Human
uuguuuuauaacauaguuguugacu

SEQ ID NO: 56077 - RNA, 26 nt, Human
ccuagcugcaccccagcgccugggcc

SEQ ID NO: 56078 - RNA, 25 nt, Human
uuuccugaucucugagacuguugcu

SEQ ID NO: 56079 - RNA, 23 nt, Human
cccuacuuuggccaacauccugc

SEQ ID NO: 56080 - RNA, 21 nt, Human
ugacccugccccuugcccagg

SEQ ID NO: 56081 - RNA, 27 nt, Human
cuccacccucccacuccuuggauuucu

SEQ ID NO: 56082 - RNA, 19 nt, Human
cugcagauggacugccugg

SEQ ID NO: 56083 - RNA, 20 nt, Human
gcaauacuugcuucuuccca

SEQ ID NO: 56084 - RNA, 22 nt, Human
caggcuggagugcagaggugcg

SEQ ID NO: 56085 - RNA, 24 nt, Human
aauuucugcuuuuuagccagggcc

SEQ ID NO: 56086 - RNA, 28 nt, Human
uguccccuacugcaggucuuacagugga

SEQ ID NO: 56087 - RNA, 21 nt, Human
gcgcaagccacagccugucuu

SEQ ID NO: 56088 - RNA, 21 nt, Human
ggagucuucucuccacuucug

SEQ ID NO: 56089 - RNA, 20 nt, Human
uugaagcccagcuuucauau

SEQ ID NO: 56090 - RNA, 28 nt, Human
ucuagaauuucuuuaauuuugcuucucu

SEQ ID NO: 56091 - RNA, 21 nt, Human
agucucaucucuaacguucua

SEQ ID NO: 56092 - RNA, 20 nt, Human
cucuuagaccucucccauca

SEQ ID NO: 56093 - RNA, 19 nt, Human
cugcuacguccugccugug

SEQ ID NO: 56094 - RNA, 25 nt, Human
ccaagcaccuccaaccaaauaagac

SEQ ID NO: 56095 - RNA, 22 nt, Human
uggcuuaugccuguaaucccgg

SEQ ID NO: 56096 - RNA, 23 nt, Human
uauuaaaagaagauuacguuuua

SEQ ID NO: 56097 - RNA, 22 nt, Human
ccccucaaauuggcacugagau

SEQ ID NO: 56098 - RNA, 19 nt, Human
uuugugagccuaggguagg

SEQ ID NO: 56099 - RNA, 27 nt, Human
ugaccaacauggagaagccccgucucu

SEQ ID NO: 56100 - RNA, 22 nt, Human
gcucacugcaaccuccgccucu

SEQ ID NO: 56101 - RNA, 22 nt, Human
cgacacugucauuucugcuuca

SEQ ID NO: 56102 - RNA, 24 nt, Human
aggcuaugagcuggcacaccagcg

SEQ ID NO: 56103 - RNA, 21 nt, Human
caaggggagucagggucccuc

SEQ ID NO: 56104 - RNA, 27 nt, Human
ucugcccucgcugcucuuggaauugcg

SEQ ID NO: 56105 - RNA, 23 nt, Human
gcaaaccugggugaucgggaaca

SEQ ID NO: 56106 - RNA, 15 nt, Human
cgccuccccaccucc

SEQ ID NO: 56107 - RNA, 22 nt, Human
cuaccugcagccgaaguacgca

SEQ ID NO: 56108 - RNA, 26 nt, Human
ggaggaggggcgagcuguggagcagc

SEQ ID NO: 56109 - RNA, 20 nt, Human
uugauuccaaagaacuccac

SEQ ID NO: 56110 - RNA, 21 nt, Human
gcucccuguggcacucaggga

SEQ ID NO: 56111 - RNA, 24 nt, Human
cgggagaagagcggcccuaugcau

SEQ ID NO: 56112 - RNA, 23 nt, Human
gggaccacauuuuacgaccaccu

SEQ ID NO: 56113 - RNA, 20 nt, Human
cagcauuuuacucacuuuau

SEQ ID NO: 56114 - RNA, 22 nt, Human
uacagugagcaaagauugugcc

SEQ ID NO: 56115 - RNA, 24 nt, Human
cgcugcugagcaggcaugcggccc

SEQ ID NO: 56116 - RNA, 20 nt, Human
ugcucaguaauacuugaguu

SEQ ID NO: 56117 - RNA, 23 nt, Human
uuaugagcucaucuagcaaucag

SEQ ID NO: 56118 - RNA, 27 nt, Human
gaugcccagguugcacaggagugggau

SEQ ID NO: 56119 - RNA, 26 nt, Human
cagaaacacgcuucuccaacacgggc

SEQ ID NO: 56120 - RNA, 23 nt, Human
uucaacagauucuccugccucgg

SEQ ID NO: 56121 - RNA, 22 nt, Human
cuucugaagcgcccuccaggga

SEQ ID NO: 56122 - RNA, 16 nt, Human
cuacaguuugcagugg

SEQ ID NO: 56123 - RNA, 21 nt, Human
ucuaaacaaggacaaaugaga

SEQ ID NO: 56124 - RNA, 26 nt, Human
gcuagccucugugccccguccuugug

SEQ ID NO: 56125 - RNA, 30 nt, Human
ccaucaccaucugcuugacuauguagcuug

SEQ ID NO: 56126 - RNA, 23 nt, Human
uguuaagguggcguguugcagug

SEQ ID NO: 56127 - RNA, 20 nt, Human
uuguucagaagaacugagca

SEQ ID NO: 56128 - RNA, 20 nt, Human
uauuaccuuuaaauauuuca

SEQ ID NO: 56129 - RNA, 18 nt, Human
cccucuccauguccagga

SEQ ID NO: 56130 - RNA, 27 nt, Human
uggagagaaugauugcuuuuuguacag

SEQ ID NO: 56131 - RNA, 19 nt, Human
cguccucuccaucugcugu

SEQ ID NO: 56132 - RNA, 21 nt, Human
ugcacacuccagucuuggugg

SEQ ID NO: 56133 - RNA, 25 nt, Human
uauuucucagccugcccuuggggag

SEQ ID NO: 56134 - RNA, 20 nt, Human
uucuucagugaaauuuuggg

SEQ ID NO: 56135 - RNA, 22 nt, Human
ccccagcagcugggacuacagg

SEQ ID NO: 56136 - RNA, 24 nt, Human
gugugcaugcgugcguguaugcgu

SEQ ID NO: 56137 - RNA, 21 nt, Human
gcugggguuugggaaugugcu

SEQ ID NO: 56138 - RNA, 22 nt, Human
cuaucccuggacgcaugcaggg

SEQ ID NO: 56139 - RNA, 24 nt, Human
ucuuugcugacuuaccuuuuuacu

SEQ ID NO: 56140 - RNA, 15 nt, Human
cguccccugcagccu

SEQ ID NO: 56141 - RNA, 27 nt, Human
uuggugauuuggaugcuguucugugau

SEQ ID NO: 56142 - RNA, 23 nt, Human
gcacugugcuggcugucuuccca

SEQ ID NO: 56143 - RNA, 23 nt, Human
ugugauuaauuugauuucuuuaa

SEQ ID NO: 56144 - RNA, 22 nt, Human
ggucuagguuuuuaauuuuuua

SEQ ID NO: 56145 - RNA, 26 nt, Human
cacagccgcagccaugcugugccucc

SEQ ID NO: 56146 - RNA, 25 nt, Human
cugccccaccagccaccucuugggc

SEQ ID NO: 56147 - RNA, 23 nt, Human
gccuguaaucccagcuacuuggg

SEQ ID NO: 56148 - RNA, 20 nt, Human
ccaucuuugaauauauuuca

SEQ ID NO: 56149 - RNA, 22 nt, Human
uugcccaggcuggagugcaaug

SEQ ID NO: 56150 - RNA, 22 nt, Human
ugcaaccuccaccucccgggcu

SEQ ID NO: 56151 - RNA, 24 nt, Human
uggcuauauggcaagaaagcuggu

SEQ ID NO: 56152 - RNA, 20 nt, Human
gauggcagaggagagggcuc

SEQ ID NO: 56153 - RNA, 30 nt, Human
gccgcacgggugccuccagccugagacauc

SEQ ID NO: 56154 - RNA, 25 nt, Human
acaugaucugaggaccauucaugga

SEQ ID NO: 56155 - RNA, 22 nt, Human
guggcuggcuguggagcuagag

SEQ ID NO: 56156 - RNA, 20 nt, Human
ggcuaauuauuauuuuuugu

SEQ ID NO: 56157 - RNA, 25 nt, Human
agcauuuucaccuuuuuugcuccca

SEQ ID NO: 56158 - RNA, 27 nt, Human
aggacuccaaugucgaacucuucuuug

SEQ ID NO: 56159 - RNA, 26 nt, Human
cugugucaguuccugccuuuucucau

SEQ ID NO: 56160 - RNA, 27 nt, Human
cccuccaggaguugcugaaauuuagga

SEQ ID NO: 56161 - RNA, 25 nt, Human
gauucugcuuuucauccucuguggu

SEQ ID NO: 56162 - RNA, 23 nt, Human
gaauagauaaaccaaaucuggua

SEQ ID NO: 56163 - RNA, 23 nt, Human
uguuuuuaaaagauuacuuucua

SEQ ID NO: 56164 - RNA, 27 nt, Human
ccugucauccuccacauuucugcucca

SEQ ID NO: 56165 - RNA, 22 nt, Human
aaucccugcuuuacugcugagc

SEQ ID NO: 56166 - RNA, 23 nt, Human
gcuguucugguggcaguaacaug

SEQ ID NO: 56167 - RNA, 26 nt, Human
guucugaccauccuguguuguaagua

SEQ ID NO: 56168 - RNA, 25 nt, Human
ccuguucuuuuaccacugacagcua

SEQ ID NO: 56169 - RNA, 22 nt, Human
ggacgugaggacagccagcucc

SEQ ID NO: 56170 - RNA, 27 nt, Human
caguagaagugucacagccauagucaa

SEQ ID NO: 56171 - RNA, 24 nt, Human
gucuugaaaaccuaugauugucuc

SEQ ID NO: 56172 - RNA, 27 nt, Human
ggacuccucuuuggcuccuugaaguuu

SEQ ID NO: 56173 - RNA, 20 nt, Human
gcccccagugaucucgacuc

SEQ ID NO: 56174 - RNA, 21 nt, Human
gggugaguauggggccaggcc

SEQ ID NO: 56175 - RNA, 23 nt, Human
aucgcuugagcccaggaggucag

SEQ ID NO: 56176 - RNA, 23 nt, Human
uccucaaggaagcuucugucaug

SEQ ID NO: 56177 - RNA, 25 nt, Human
uuuguuguuuccaugaaauccugcg

SEQ ID NO: 56178 - RNA, 22 nt, Human
uucccuggcugcuggacacaag

SEQ ID NO: 56179 - RNA, 21 nt, Human
uguugcccaggcugguuucga

SEQ ID NO: 56180 - RNA, 19 nt, Human
gccucucuccaauagacag

SEQ ID NO: 56181 - RNA, 24 nt, Human
ccaggcaagggagaagucagaggc

SEQ ID NO: 56182 - RNA, 21 nt, Human
gcucagccuggagugcaguga

SEQ ID NO: 56183 - RNA, 29 nt, Human
ggccugagccuggccagccuacaaugggg

SEQ ID NO: 56184 - RNA, 31 nt, Human
gguggccugaaggaccuuuucugcugggaca

SEQ ID NO: 56185 - RNA, 22 nt, Human
gcucaagucugaacucuaccuc

SEQ ID NO: 56186 - RNA, 21 nt, Human
agagcguagcacggcucgcac

SEQ ID NO: 56187 - RNA, 22 nt, Human
uuaguaggugaguuuucaccuc

SEQ ID NO: 56188 - RNA, 23 nt, Human
cgccucuagcgcgguucugggaa

SEQ ID NO: 56189 - RNA, 19 nt, Human
uuuauuccuugcguuauca

SEQ ID NO: 56190 - RNA, 28 nt, Human
cccagcgggagugacaccacugaugcca

SEQ ID NO: 56191 - RNA, 27 nt, Human
gccuacuuuggggaaauaaagugccuu

SEQ ID NO: 56192 - RNA, 20 nt, Human
cuccucuucugaucacuucc

SEQ ID NO: 56193 - RNA, 26 nt, Human
gccagauguucuuucuacagaagaau

SEQ ID NO: 56194 - RNA, 18 nt, Human
uugccuaggaugccaaug

SEQ ID NO: 56195 - RNA, 20 nt, Human
ugagugagaggcagagcgag

SEQ ID NO: 56196 - RNA, 23 nt, Human
uucacccacacugccagccuggg

SEQ ID NO: 56197 - RNA, 22 nt, Human
cgccugcaaucccagcacuuug

SEQ ID NO: 56198 - RNA, 23 nt, Human
ucuucugcuuugucugugucuau

SEQ ID NO: 56199 - RNA, 21 nt, Human
cuuucuuuuggauugcacuga

SEQ ID NO: 56200 - RNA, 26 nt, Human
uuauuuuucuccuuagagauaaggaa

SEQ ID NO: 56201 - RNA, 28 nt, Human
ccuagauuaaauaaaaucaaaguugaga

SEQ ID NO: 56202 - RNA, 21 nt, Human
cgugcuguuuguggcuguuga

SEQ ID NO: 56203 - RNA, 23 nt, Human
cacucuuccgcccaggcugcagu

SEQ ID NO: 56204 - RNA, 22 nt, Human
uauuucuaugucaaaggcacag

SEQ ID NO: 56205 - RNA, 23 nt, Human
uggcccuguggcgugacggggga

SEQ ID NO: 56206 - RNA, 22 nt, Human
ucaagccccggucaugauggag

SEQ ID NO: 56207 - RNA, 15 nt, Human
cuucccaccuuaccu

SEQ ID NO: 56208 - RNA, 21 nt, Human
ucuccucuauggaaggaggcc

SEQ ID NO: 56209 - RNA, 23 nt, Human
aaguagguauuucaguacccugu

SEQ ID NO: 56210 - RNA, 26 nt, Human
agcucacugcagcuuugaucugaccg

SEQ ID NO: 56211 - RNA, 26 nt, Human
cccccucuccccuggggcaucccuuu

SEQ ID NO: 56212 - RNA, 20 nt, Human
ccgcuccccagcccugccgc

SEQ ID NO: 56213 - RNA, 25 nt, Human
ugggccggacucuccaaaccugcuu

SEQ ID NO: 56214 - RNA, 18 nt, Human
acugagucagaugggucu

SEQ ID NO: 56215 - RNA, 17 nt, Human
ccgccugguuucuugaa

SEQ ID NO: 56216 - RNA, 22 nt, Human
gcgggcagaugacuugagguca

SEQ ID NO: 56217 - RNA, 26 nt, Human
gccacugcacccagccuagaaucuug

SEQ ID NO: 56218 - RNA, 20 nt, Human
acagcuagaguaguaguauu

SEQ ID NO: 56219 - RNA, 20 nt, Human
uaaaacuuuauguaucugag

SEQ ID NO: 56220 - RNA, 26 nt, Human
ucgcccaggcucaagugauucuccug

SEQ ID NO: 56221 - RNA, 23 nt, Human
uauaacugcuuuuguaccuagcu

SEQ ID NO: 56222 - RNA, 27 nt, Human
gggcuguaggggagaguguggcaggug

SEQ ID NO: 56223 - RNA, 22 nt, Human
ggcugggaaguccugcguuuca

SEQ ID NO: 56224 - RNA, 23 nt, Human
cccgcugcucugcuccgcccaua

SEQ ID NO: 56225 - RNA, 23 nt, Human
ugaggagaaagagccccagaaaa

SEQ ID NO: 56226 - RNA, 21 nt, Human
gcccggcccgcccaacccagc

SEQ ID NO: 56227 - RNA, 23 nt, Human
agggaaagcauuuaaagggugau

SEQ ID NO: 56228 - RNA, 23 nt, Human
ccaggaagcagagauuccaguga

SEQ ID NO: 56229 - RNA, 22 nt, Human
guaacuuucuuccucuggauca

SEQ ID NO: 56230 - RNA, 22 nt, Human
ccuguaauccuugcauuuugga

SEQ ID NO: 56231 - RNA, 19 nt, Human
gcucuguggcccaggcugg

SEQ ID NO: 56232 - RNA, 27 nt, Human
acaaaccugcgccugcaccgccucugc

SEQ ID NO: 56233 - RNA, 24 nt, Human
gcucccacucuuaucaccucuccc

SEQ ID NO: 56234 - RNA, 23 nt, Human
uacagauaacaggauuauuacaa

SEQ ID NO: 56235 - RNA, 19 nt, Human
cacucuguucucugccuug

SEQ ID NO: 56236 - RNA, 25 nt, Human
caugugucaccaucuucccuccugu

SEQ ID NO: 56237 - RNA, 22 nt, Human
uucaagugguucuccugccuca

SEQ ID NO: 56238 - RNA, 23 nt, Human
guucauucacagagacugccucu

SEQ ID NO: 56239 - RNA, 27 nt, Human
uguuugugccaucugauccugaugucu

SEQ ID NO: 56240 - RNA, 21 nt, Human
agggacugaggccucuucuca

SEQ ID NO: 56241 - RNA, 25 nt, Human
cucauguauuuuuaucacacuuaua

SEQ ID NO: 56242 - RNA, 23 nt, Human
gcauaauuugaagacacagcaga

SEQ ID NO: 56243 - RNA, 26 nt, Human
cccugccuuuccuuuacuuuuacuuu

SEQ ID NO: 56244 - RNA, 20 nt, Human
cuucauuuccuuggggcugc

SEQ ID NO: 56245 - RNA, 22 nt, Human
ggcugugagacuagcacuaagg

SEQ ID NO: 56246 - RNA, 22 nt, Human
gcugagucuuaaagaaggguuu

SEQ ID NO: 56247 - RNA, 21 nt, Human
auugcacuccaaccugggcga

SEQ ID NO: 56248 - RNA, 24 nt, Human
gcccuguccugccuaaggcugaac

SEQ ID NO: 56249 - RNA, 21 nt, Human
aggggaggggcagggggcggu

SEQ ID NO: 56250 - RNA, 24 nt, Human
cagcaccuggaucuugccuuuaua

SEQ ID NO: 56251 - RNA, 20 nt, Human
ucuuaaauuuggguugcaaa

SEQ ID NO: 56252 - RNA, 25 nt, Human
gagaaagagagaagccagccacaga

SEQ ID NO: 56253 - RNA, 20 nt, Human
cucucauucccucuuaucca

SEQ ID NO: 56254 - RNA, 29 nt, Human
ucagggugauuucaccuggaacagcaugu

SEQ ID NO: 56255 - RNA, 19 nt, Human
agagguccaaggcugcagu

SEQ ID NO: 56256 - RNA, 23 nt, Human
uucccagacacugauucuggaau

SEQ ID NO: 56257 - RNA, 25 nt, Human
gcugcuggggaggaccucaguuaac

SEQ ID NO: 56258 - RNA, 27 nt, Human
cuugugcaaagggauccagaagagaca

SEQ ID NO: 56259 - RNA, 27 nt, Human
ucuccugggcucaguccuggcuccagc

SEQ ID NO: 56260 - RNA, 29 nt, Human
cuuugaccucugcuaagacaagagcaugg

SEQ ID NO: 56261 - RNA, 27 nt, Human
uucauucucuagacaaaauccaucagg

SEQ ID NO: 56262 - RNA, 26 nt, Human
aaagcagaaugaaaaugagucauugc

SEQ ID NO: 56263 - RNA, 28 nt, Human
guuccuagugcuacuuguuuuacaaacu

SEQ ID NO: 56264 - RNA, 16 nt, Human
gggguccacuccagga

SEQ ID NO: 56265 - RNA, 22 nt, Human
agacuagccugggcaauaugau

SEQ ID NO: 56266 - RNA, 26 nt, Human
gcuacugcugcugcugccuuaaguag

SEQ ID NO: 56267 - RNA, 20 nt, Human
uugucucuucucacagguuu

SEQ ID NO: 56268 - RNA, 25 nt, Human
uucugccaugauuguaagcuucgug

SEQ ID NO: 56269 - RNA, 20 nt, Human
ucguccauuuuauuaggauu

SEQ ID NO: 56270 - RNA, 24 nt, Human
cacugcccugggccuuacuuccca

SEQ ID NO: 56271 - RNA, 21 nt, Human
cugucaggcugggccugccuc

SEQ ID NO: 56272 - RNA, 25 nt, Human
ccuuuucccucuugcgucugugcca

SEQ ID NO: 56273 - RNA, 22 nt, Human
ggagagggcaagcgggaccggu

SEQ ID NO: 56274 - RNA, 26 nt, Human
cgaggcagacagaucaccugagguca

SEQ ID NO: 56275 - RNA, 22 nt, Human
guagggagugggggaggugggu

SEQ ID NO: 56276 - RNA, 20 nt, Human
uccugccagccuccccuucc

SEQ ID NO: 56277 - RNA, 22 nt, Human
gggagcugggggaaacgacgcc

SEQ ID NO: 56278 - RNA, 27 nt, Human
gggccggcugggcuggggguugcccug

SEQ ID NO: 56279 - RNA, 17 nt, Human
gcuccccaggacgcaga

SEQ ID NO: 56280 - RNA, 23 nt, Human
gccuguucccaguucccugggcc

SEQ ID NO: 56281 - RNA, 20 nt, Human
gucuaaugcccauuuuccca

SEQ ID NO: 56282 - RNA, 22 nt, Human
auauggcuccuggcugcgucag

SEQ ID NO: 56283 - RNA, 21 nt, Human
aacaaaacccaaagcuuuuca

SEQ ID NO: 56284 - RNA, 24 nt, Human
ucuccacuguaauccgaauacuuu

SEQ ID NO: 56285 - RNA, 27 nt, Human
gccucaagaugaacagcugguagauca

SEQ ID NO: 56286 - RNA, 23 nt, Human
uggauacuuccagacauuuucca

SEQ ID NO: 56287 - RNA, 21 nt, Human
gacgcccauucggacugcugu

SEQ ID NO: 56288 - RNA, 22 nt, Human
uagaaaugccauuuaugcugua

SEQ ID NO: 56289 - RNA, 20 nt, Human
cagccaggcuggagucagug

SEQ ID NO: 56290 - RNA, 19 nt, Human
uauugcauuuaaagaaaga

SEQ ID NO: 56291 - RNA, 25 nt, Human
aauucagaaacacuuguaugguccu

SEQ ID NO: 56292 - RNA, 19 nt, Human
guccuuucucucauccucu

SEQ ID NO: 56293 - RNA, 24 nt, Human
gggcuguuagaggggugagugaca

SEQ ID NO: 56294 - RNA, 17 nt, Human
agcugcucuguucuucu

SEQ ID NO: 56295 - RNA, 22 nt, Human
ggcacuugagauaugugcagug

SEQ ID NO: 56296 - RNA, 24 nt, Human
ccauuaacuuaagaauuugucagu

SEQ ID NO: 56297 - RNA, 22 nt, Human
aauauuuuuggacuggcagacu

SEQ ID NO: 56298 - RNA, 22 nt, Human
gaagaagaaaaaaggauccuug

SEQ ID NO: 56299 - RNA, 19 nt, Human
uggaagcuuuuucccaagg

SEQ ID NO: 56300 - RNA, 19 nt, Human
acaugcugccuucuugggg

SEQ ID NO: 56301 - RNA, 22 nt, Human
ugagguccuagagugccuccag

SEQ ID NO: 56302 - RNA, 22 nt, Human
uagagacgggguuucacucugu

SEQ ID NO: 56303 - RNA, 21 nt, Human
cucuucaggaaccggagcuca

SEQ ID NO: 56304 - RNA, 25 nt, Human
gcaccuuggaaguuguuuucaacca

SEQ ID NO: 56305 - RNA, 25 nt, Human
ucucaauaaaagccaggaacagaga

SEQ ID NO: 56306 - RNA, 20 nt, Human
guagagaccagcucacugga

SEQ ID NO: 56307 - RNA, 27 nt, Human
ugcccugggguggaggcaccaucacca

SEQ ID NO: 56308 - RNA, 27 nt, Human
uggggaagugcggugacugggaaaugc

SEQ ID NO: 56309 - RNA, 22 nt, Human
gugugagaaucaaaacucuccu

SEQ ID NO: 56310 - RNA, 21 nt, Human
uugaugagcaaggcuuuucuc

SEQ ID NO: 56311 - RNA, 24 nt, Human
gcugcauggaagguggaggacaga

SEQ ID NO: 56312 - RNA, 27 nt, Human
caggcuggcucucaguggaggccgaga

SEQ ID NO: 56313 - RNA, 26 nt, Human
ggaaaagaagagagacagagagacag

SEQ ID NO: 56314 - RNA, 21 nt, Human
cucuuuggucuauuuucugca

SEQ ID NO: 56315 - RNA, 26 nt, Human
gucucccaggcuggagugcuauggug

SEQ ID NO: 56316 - RNA, 23 nt, Human
ggugcugcugccuccuggucuuu

SEQ ID NO: 56317 - RNA, 22 nt, Human
augacaccuccauuucucucca

SEQ ID NO: 56318 - RNA, 21 nt, Human
gauggugacuuagacucgggu

SEQ ID NO: 56319 - RNA, 22 nt, Human
cugcuccugggccugcugcugc

SEQ ID NO: 56320 - RNA, 23 nt, Human
ccuucacugcucacguguuugcu

SEQ ID NO: 56321 - RNA, 23 nt, Human
uucuuugauaguuucugccucac

SEQ ID NO: 56322 - RNA, 17 nt, Human
caugcuguuauggguga

SEQ ID NO: 56323 - RNA, 20 nt, Human
ggccaugugaucccaccugg

SEQ ID NO: 56324 - RNA, 19 nt, Human
aagaucugaaggggggaac

SEQ ID NO: 56325 - RNA, 27 nt, Human
agagagaaaggguggccacuuucccga

SEQ ID NO: 56326 - RNA, 19 nt, Human
cucacacacacucaucccc

SEQ ID NO: 56327 - RNA, 22 nt, Human
cacagccgccuuuggguuccau

SEQ ID NO: 56328 - RNA, 22 nt, Human
cugcaaccuccgccuccagguu

SEQ ID NO: 56329 - RNA, 22 nt, Human
ccacagcuauauccugaugcug

SEQ ID NO: 56330 - RNA, 23 nt, Human
gcugaaaucucagcaugaaagca

SEQ ID NO: 56331 - RNA, 21 nt, Human
cacucugucucccaggcugga

SEQ ID NO: 56332 - RNA, 22 nt, Human
ggaggcaggggacaagggaggc

SEQ ID NO: 56333 - RNA, 22 nt, Human
cuuggagccuugggugggcagg

SEQ ID NO: 56334 - RNA, 23 nt, Human
ggcaacugcuaaucuacuuucug

SEQ ID NO: 56335 - RNA, 19 nt, Human
ucaauacauagugcugcug

SEQ ID NO: 56336 - RNA, 22 nt, Human
caugaggucaggagaucgagac

SEQ ID NO: 56337 - RNA, 26 nt, Human
cuguggcuuccaccucagcucuagaa

SEQ ID NO: 56338 - RNA, 19 nt, Human
aggacacacagauggacag

SEQ ID NO: 56339 - RNA, 22 nt, Human
gccacugcggggaggaggggga

SEQ ID NO: 56340 - RNA, 17 nt, Human
agcaguuucuucucuca

SEQ ID NO: 56341 - RNA, 20 nt, Human
ccccuguggacaaaccccca

SEQ ID NO: 56342 - RNA, 22 nt, Human
cgucacagcaaaaacacuuucc

SEQ ID NO: 56343 - RNA, 24 nt, Human
uaucugguuucuuuucaccaauau

SEQ ID NO: 56344 - RNA, 26 nt, Human
caucuagagaaaaacaaaaauagaaa

SEQ ID NO: 56345 - RNA, 22 nt, Human
acacagccuuggaucaggacag

SEQ ID NO: 56346 - RNA, 17 nt, Human
cuucccuugguuugcca

SEQ ID NO: 56347 - RNA, 23 nt, Human
aucuaugagagaaaguucaguca

SEQ ID NO: 56348 - RNA, 29 nt, Human
gcugagggggaggaagaaacgaagacuga

SEQ ID NO: 56349 - RNA, 21 nt, Human
guucacugcagccucaaccuc

SEQ ID NO: 56350 - RNA, 22 nt, Human
cuagaggcagagguugaagaug

SEQ ID NO: 56351 - RNA, 20 nt, Human
caugucccuucuaugauccc

SEQ ID NO: 56352 - RNA, 22 nt, Human
ggcugucccgcgccacuggaaa

SEQ ID NO: 56353 - RNA, 22 nt, Human
aagccucuguuuugcaccugua

SEQ ID NO: 56354 - RNA, 21 nt, Human
ccuccugcugcccccucgcua

SEQ ID NO: 56355 - RNA, 27 nt, Human
gggagagaaggauggggaagcauugca

SEQ ID NO: 56356 - RNA, 26 nt, Human
ccauagccacacaggaagcugccuug

SEQ ID NO: 56357 - RNA, 22 nt, Human
caccuguaaucccagcacuuuu

SEQ ID NO: 56358 - RNA, 27 nt, Human
gcuauguuauuuacaaugcaggauuuu

SEQ ID NO: 56359 - RNA, 27 nt, Human
cagaauacugguaggggccaaggccau

SEQ ID NO: 56360 - RNA, 25 nt, Human
guuguuugaggcauaacaaugugua

SEQ ID NO: 56361 - RNA, 19 nt, Human
auauuuuuaugagucuucc

SEQ ID NO: 56362 - RNA, 22 nt, Human
ugccuccugggcucaacggauc

SEQ ID NO: 56363 - RNA, 26 nt, Human
cacuauacaauucaguacugauuauu

SEQ ID NO: 56364 - RNA, 21 nt, Human
aucucagucauaugaauuaca

SEQ ID NO: 56365 - RNA, 23 nt, Human
acugcccaggcuggagcauagug

SEQ ID NO: 56366 - RNA, 22 nt, Human
cuccuaagcuggagugcagugg

SEQ ID NO: 56367 - RNA, 20 nt, Human
gcagagccaacaugcccauc

SEQ ID NO: 56368 - RNA, 24 nt, Human
uaggcagcaagggcuguucuagga

SEQ ID NO: 56369 - RNA, 20 nt, Human
cagcaacucuggagggaagc

SEQ ID NO: 56370 - RNA, 25 nt, Human
ggcucacugcaaccaccaucuccca

SEQ ID NO: 56371 - RNA, 19 nt, Human
caggcuggagugcagugcc

SEQ ID NO: 56372 - RNA, 26 nt, Human
gccuguaaucccagcuacucagaugg

SEQ ID NO: 56373 - RNA, 21 nt, Human
acaaagaauuuaaaauaacac

SEQ ID NO: 56374 - RNA, 21 nt, Human
caggcuuccaccccagcacuu

SEQ ID NO: 56375 - RNA, 27 nt, Human
cugaggucucuuccagcccucagucug

SEQ ID NO: 56376 - RNA, 27 nt, Human
ucucagauuccuuucuugucuguuaga

SEQ ID NO: 56377 - RNA, 26 nt, Human
uuacaauuuguauuacuuucucugua

SEQ ID NO: 56378 - RNA, 24 nt, Human
aggucaggaaaaacacuggcuggg

SEQ ID NO: 56379 - RNA, 21 nt, Human
aguuguuucucucccugggcc

SEQ ID NO: 56380 - RNA, 24 nt, Human
aaagugcagcaggagaacucuuuu

SEQ ID NO: 56381 - RNA, 22 nt, Human
ucucccccucucccugagaguc

SEQ ID NO: 56382 - RNA, 18 nt, Human
aacaugugcucuuuucag

SEQ ID NO: 56383 - RNA, 23 nt, Human
cuaaaaguuugaggaauauuuca

SEQ ID NO: 56384 - RNA, 22 nt, Human
gggcaccucuggaggggagcgc

SEQ ID NO: 56385 - RNA, 23 nt, Human
gucauuauucucucaguuacucc

SEQ ID NO: 56386 - RNA, 22 nt, Human
ggaccugaacgccgcuccagcc

SEQ ID NO: 56387 - RNA, 25 nt, Human
ccccucgggaggggagcugagcccg

SEQ ID NO: 56388 - RNA, 21 nt, Human
uucaaguuuucaugaacuagc

SEQ ID NO: 56389 - RNA, 24 nt, Human
cuguggacuaaaucugccacgauu

SEQ ID NO: 56390 - RNA, 27 nt, Human
uccuuuguuagaguggucgagauuuca

SEQ ID NO: 56391 - RNA, 21 nt, Human
ccuuccaaucagcugccuuca

SEQ ID NO: 56392 - RNA, 27 nt, Human
gcccagaacaugggucaccaauggggg

SEQ ID NO: 56393 - RNA, 23 nt, Human
uggaaagaauggggguuuacagg

SEQ ID NO: 56394 - RNA, 23 nt, Human
ucguuuguuuuaaaugggagaaa

SEQ ID NO: 56395 - RNA, 21 nt, Human
cuuacugaaccaacaaucaaa

SEQ ID NO: 56396 - RNA, 25 nt, Human
caucagguuaggcaguauaaagaau

SEQ ID NO: 56397 - RNA, 20 nt, Human
ccugcagccuccggccggcc

SEQ ID NO: 56398 - RNA, 23 nt, Human
ugucacccaggcuggaguacaau

SEQ ID NO: 56399 - RNA, 22 nt, Human
ccuagagugcugggauuacagg

SEQ ID NO: 56400 - RNA, 27 nt, Human
ggucagcaaacuacugccugugggcca

SEQ ID NO: 56401 - RNA, 24 nt, Human
gaaggcccugcucccuauccuguc

SEQ ID NO: 56402 - RNA, 20 nt, Human
ggugggguaguggggugggg

SEQ ID NO: 56403 - RNA, 20 nt, Human
gggccugcgcaguccugguc

SEQ ID NO: 56404 - RNA, 21 nt, Human
ucacacacucuguauuuauca

SEQ ID NO: 56405 - RNA, 26 nt, Human
ccaucccucagcuccuagagggagau

SEQ ID NO: 56406 - RNA, 21 nt, Human
guauuuuuucauagucccacc

SEQ ID NO: 56407 - RNA, 27 nt, Human
ugucuucaauuaaaagaccacagacuu

SEQ ID NO: 56408 - RNA, 26 nt, Human
caucccucuccaaaaggucacuucag

SEQ ID NO: 56409 - RNA, 19 nt, Human
cucccaggcuggggcagug

SEQ ID NO: 56410 - RNA, 23 nt, Human
auccuguucaaccuccuagugcc

SEQ ID NO: 56411 - RNA, 22 nt, Human
gggccuggaagaccaccugccc

SEQ ID NO: 56412 - RNA, 21 nt, Human
gauuuggguucugccuguggc

SEQ ID NO: 56413 - RNA, 20 nt, Human
uuuucaaggagaggguuuaa

SEQ ID NO: 56414 - RNA, 27 nt, Human
acguggcccgcccccggcagggcacag

SEQ ID NO: 56415 - RNA, 24 nt, Human
uuaaaggaauccacaaagcaaaca

SEQ ID NO: 56416 - RNA, 21 nt, Human
cguugcccugagcugcagccu

SEQ ID NO: 56417 - RNA, 22 nt, Human
cuaucuauccuucacugcucug

SEQ ID NO: 56418 - RNA, 25 nt, Human
aggauggagucagaacaacuacagu

SEQ ID NO: 56419 - RNA, 20 nt, Human
ccuugaauucagccugggug

SEQ ID NO: 56420 - RNA, 21 nt, Human
ggaaacaagccacuuagccag

SEQ ID NO: 56421 - RNA, 26 nt, Human
cuggagcccaggaguuugaggcugca

SEQ ID NO: 56422 - RNA, 24 nt, Human
gaacaccaucaaagaugccuucaa

SEQ ID NO: 56423 - RNA, 23 nt, Human
aguggaguugguggauggguggg

SEQ ID NO: 56424 - RNA, 23 nt, Human
cggagcagcagagucugcagcag

SEQ ID NO: 56425 - RNA, 17 nt, Human
ugcucuaagcugcagca

SEQ ID NO: 56426 - RNA, 26 nt, Human
cccacugcacuccagccuggugacuc

SEQ ID NO: 56427 - RNA, 22 nt, Human
ggccuguaaucguagcgcuuug

SEQ ID NO: 56428 - RNA, 26 nt, Human
augcacgucccuuccccuuacucccc

SEQ ID NO: 56429 - RNA, 29 nt, Human
caccugaugcucaccugccccucuuucuc

SEQ ID NO: 56430 - RNA, 21 nt, Human
uagugguucuguuuucuugag

SEQ ID NO: 56431 - RNA, 24 nt, Human
acauuuaugauugucccucugggc

SEQ ID NO: 56432 - RNA, 27 nt, Human
cucuguucccuucuccuuucaucccag

SEQ ID NO: 56433 - RNA, 21 nt, Human
ucuaucuuuuccuucagugaa

SEQ ID NO: 56434 - RNA, 20 nt, Human
aaagaauguuuggaaaaugc

SEQ ID NO: 56435 - RNA, 22 nt, Human
ggccuugcaaaaugcugggauu

SEQ ID NO: 56436 - RNA, 23 nt, Human
ccaaguagcugggaguacagcgu

SEQ ID NO: 56437 - RNA, 21 nt, Human
ggacagcagaccagacaguca

SEQ ID NO: 56438 - RNA, 29 nt, Human
cagguuccucugaaccccaaacuguaaau

SEQ ID NO: 56439 - RNA, 20 nt, Human
uccuccccgcugucauuuca

SEQ ID NO: 56440 - RNA, 19 nt, Human
cucuuccuccuccaccgag

SEQ ID NO: 56441 - RNA, 25 nt, Human
uggcuuuuagguuauucugcuuuag

SEQ ID NO: 56442 - RNA, 21 nt, Human
ccggggcgcugagcucaggcc

SEQ ID NO: 56443 - RNA, 17 nt, Human
ccccucuccccgggacc

SEQ ID NO: 56444 - RNA, 21 nt, Human
ggaauacuugguuucuuuucu

SEQ ID NO: 56445 - RNA, 21 nt, Human
gucugggggcagaaccugagu

SEQ ID NO: 56446 - RNA, 25 nt, Human
cacacacagcauucuguucuccaug

SEQ ID NO: 56447 - RNA, 23 nt, Human
cugggaaagcaauaccccugcuu

SEQ ID NO: 56448 - RNA, 21 nt, Human
ggaauuucauccugcccacac

SEQ ID NO: 56449 - RNA, 26 nt, Human
cagggaggggcaggguguucuagagg

SEQ ID NO: 56450 - RNA, 22 nt, Human
ugucucauuacacugcuggcuu

SEQ ID NO: 56451 - RNA, 23 nt, Human
gcauuuguuuguggcaaaagccu

SEQ ID NO: 56452 - RNA, 25 nt, Human
ugauagugauuuugauguaauuuau

SEQ ID NO: 56453 - RNA, 21 nt, Human
ugcccagcccuuaguuucugg

SEQ ID NO: 56454 - RNA, 28 nt, Human
gugagguggcggccuggugcccggugga

SEQ ID NO: 56455 - RNA, 21 nt, Human
acugacacagggucauagugu

SEQ ID NO: 56456 - RNA, 25 nt, Human
gccacugagagacccaucccccuca

SEQ ID NO: 56457 - RNA, 21 nt, Human
aagacccuguucagucucuuu

SEQ ID NO: 56458 - RNA, 25 nt, Human
ggcgccuguaaucccagcuacuugg

SEQ ID NO: 56459 - RNA, 19 nt, Human
cccucucuuggagcauuuu

SEQ ID NO: 56460 - RNA, 20 nt, Human
uccagccucggaaccugagc

SEQ ID NO: 56461 - RNA, 30 nt, Human
auacuggcucagaagaauuuaaguucuauu

SEQ ID NO: 56462 - RNA, 21 nt, Human
uggccuccuuggggcuccugu

SEQ ID NO: 56463 - RNA, 21 nt, Human
gucuuuaguuuugauuuugga

SEQ ID NO: 56464 - RNA, 27 nt, Human
cacacacauuaugagcuugaauucuua

SEQ ID NO: 56465 - RNA, 24 nt, Human
cacuugaagcuguggaagaugguu

SEQ ID NO: 56466 - RNA, 23 nt, Human
uggcaagccccaccacacaggag

SEQ ID NO: 56467 - RNA, 19 nt, Human
aacuccauuuauugcuuuu

SEQ ID NO: 56468 - RNA, 17 nt, Human
aaucuguaaauauuuua

SEQ ID NO: 56469 - RNA, 22 nt, Human
gaaccugggaggcagagguuac

SEQ ID NO: 56470 - RNA, 27 nt, Human
gccggggacccacucugcccagccgga

SEQ ID NO: 56471 - RNA, 23 nt, Human
uuuccccaaauccuacucccuca

SEQ ID NO: 56472 - RNA, 22 nt, Human
gccauggugucaacaugcuuag

SEQ ID NO: 56473 - RNA, 23 nt, Human
aggggcuagcagcagaggcuuca

SEQ ID NO: 56474 - RNA, 27 nt, Human
uggaggaggggacuccaggaaugggga

SEQ ID NO: 56475 - RNA, 22 nt, Human
auucuuccucuuuuuguccuca

SEQ ID NO: 56476 - RNA, 22 nt, Human
gggaccaaggaaacaugauggg

SEQ ID NO: 56477 - RNA, 28 nt, Human
aaugugaaagagccuucagugccaaguc

SEQ ID NO: 56478 - RNA, 27 nt, Human
gguuaccacucuuuuacugugcacaua

SEQ ID NO: 56479 - RNA, 24 nt, Human
uuuuacugccuuugcuaggcuuuu

SEQ ID NO: 56480 - RNA, 28 nt, Human
cuccuacgggggcagcacacuuagauau

SEQ ID NO: 56481 - RNA, 22 nt, Human
agacuuuuaaaauauguguuuu

SEQ ID NO: 56482 - RNA, 25 nt, Human
ggaggcagagguugcagugcgcuga

SEQ ID NO: 56483 - RNA, 22 nt, Human
agaccagccugaccaacauggu

SEQ ID NO: 56484 - RNA, 22 nt, Human
agaccagccuggccaacauagu

SEQ ID NO: 56485 - RNA, 20 nt, Human
aggguucugggauguuuuca

SEQ ID NO: 56486 - RNA, 15 nt, Human
acagcucacagccaa

SEQ ID NO: 56487 - RNA, 20 nt, Human
gaggugggcggaucacaaga

SEQ ID NO: 56488 - RNA, 21 nt, Human
cugccacccaggcuggaguac

SEQ ID NO: 56489 - RNA, 27 nt, Human
ugccauccuguggaagccaccaucauc

SEQ ID NO: 56490 - RNA, 24 nt, Human
gggaucaugaaaaggucuggucag

SEQ ID NO: 56491 - RNA, 22 nt, Human
cccauuccaccacagugccccu

SEQ ID NO: 56492 - RNA, 23 nt, Human
ucuucagcugcauuucacaugcc

SEQ ID NO: 56493 - RNA, 27 nt, Human
ucuucaaacuccacuuguucagucuga

SEQ ID NO: 56494 - RNA, 24 nt, Human
gucacauuugacaaauaggacugc

SEQ ID NO: 56495 - RNA, 22 nt, Human
gcgagcaccuguaaucccagcu

SEQ ID NO: 56496 - RNA, 21 nt, Human
aaauguucauugauuucaugu

SEQ ID NO: 56497 - RNA, 19 nt, Human
cauuuguugagccauaucu

SEQ ID NO: 56498 - RNA, 19 nt, Human
gggaaggagggagggaagc

SEQ ID NO: 56499 - RNA, 21 nt, Human
cgaguggacuguccaagcaga

SEQ ID NO: 56500 - RNA, 20 nt, Human
ugccucccgggacauugauu

SEQ ID NO: 56501 - RNA, 22 nt, Human
cuccacccacccuccugccuca

SEQ ID NO: 56502 - RNA, 23 nt, Human
cgucugucuguuaucgucugucu

SEQ ID NO: 56503 - RNA, 27 nt, Human
ucauuuugacagcaucuuccucccucc

SEQ ID NO: 56504 - RNA, 24 nt, Human
gauacagcuccaggguuaaaaaga

SEQ ID NO: 56505 - RNA, 22 nt, Human
ccaaagugcugggauugugggc

SEQ ID NO: 56506 - RNA, 27 nt, Human
uccuccaggaagccuucccagcuaccc

SEQ ID NO: 56507 - RNA, 27 nt, Human
uucucucuguaccaugagcuccuccag

SEQ ID NO: 56508 - RNA, 18 nt, Human
ggagguggguugggagaa

SEQ ID NO: 56509 - RNA, 24 nt, Human
uugucaccgaggcuggagugcaau

SEQ ID NO: 56510 - RNA, 23 nt, Human
uuuggaggggaaauggggaaagc

SEQ ID NO: 56511 - RNA, 19 nt, Human
cagcagccgauuggaugua

SEQ ID NO: 56512 - RNA, 26 nt, Human
agcuucaggaaccucgaguacugugg

SEQ ID NO: 56513 - RNA, 26 nt, Human
ugcccgagcucuggccuagggaccuu

SEQ ID NO: 56514 - RNA, 21 nt, Human
uuaccuuucuguccuugauaa

SEQ ID NO: 56515 - RNA, 23 nt, Human
ggcugcucugugagaucaagggu

SEQ ID NO: 56516 - RNA, 26 nt, Human
ugcccaggccauggacugugagguca

SEQ ID NO: 56517 - RNA, 23 nt, Human
gcuccagccaccagugcccgguc

SEQ ID NO: 56518 - RNA, 27 nt, Human
uauuaaaaugauaaaauaaauggcauu

SEQ ID NO: 56519 - RNA, 20 nt, Human
ugcaccaaaccaagugccuc

SEQ ID NO: 56520 - RNA, 22 nt, Human
ccucgugauccaccugccucgg

SEQ ID NO: 56521 - RNA, 20 nt, Human
uauguucaaaaaaguacaug

SEQ ID NO: 56522 - RNA, 22 nt, Human
accccuagccaccaguguccuc

SEQ ID NO: 56523 - RNA, 22 nt, Human
ggggaagaagaaacgcugcaga

SEQ ID NO: 56524 - RNA, 21 nt, Human
agcaucacuuaaacuuccucc

SEQ ID NO: 56525 - RNA, 20 nt, Human
cuccuagucuguccugcguc

SEQ ID NO: 56526 - RNA, 25 nt, Human
ggggaaagacagcuuucuuugggaa

SEQ ID NO: 56527 - RNA, 26 nt, Human
cuaagguauacaaaucugucuacaug

SEQ ID NO: 56528 - RNA, 22 nt, Human
aaaguccuguuuauugagaccc

SEQ ID NO: 56529 - RNA, 23 nt, Human
gucugccccuggagaacccagaa

SEQ ID NO: 56530 - RNA, 23 nt, Human
gcauguccaugcauuuucugugu

SEQ ID NO: 56531 - RNA, 23 nt, Human
ucuuucagagaaaccucagcuuc

SEQ ID NO: 56532 - RNA, 22 nt, Human
ccguuacagucuuuuucucagg

SEQ ID NO: 56533 - RNA, 26 nt, Human
uagaaaacauuccaaaacuuuaaggu

SEQ ID NO: 56534 - RNA, 17 nt, Human
guguucuccugcugcuc

SEQ ID NO: 56535 - RNA, 22 nt, Human
uagacuuuuaugaacucuuuaa

SEQ ID NO: 56536 - RNA, 21 nt, Human
augcaauuucaugccauucag

SEQ ID NO: 56537 - RNA, 21 nt, Human
ccgucuuccuccuacacacca

SEQ ID NO: 56538 - RNA, 22 nt, Human
cgaagagugagaagcagagggc

SEQ ID NO: 56539 - RNA, 25 nt, Human
uaguuucagacaagccugcuugccg

SEQ ID NO: 56540 - RNA, 19 nt, Human
gaacucauauugacacuca

SEQ ID NO: 56541 - RNA, 22 nt, Human
ggcaccguggggaaacuggaaa

SEQ ID NO: 56542 - RNA, 25 nt, Human
uagcuguaugagcaguuccaaggcc

SEQ ID NO: 56543 - RNA, 20 nt, Human
cacccgagcuggagugcagu

SEQ ID NO: 56544 - RNA, 24 nt, Human
gcccaggcugggugcagucacggc

SEQ ID NO: 56545 - RNA, 23 nt, Human
cacugcuugggccugcuuucuca

SEQ ID NO: 56546 - RNA, 24 nt, Human
cuucaagcaguccuccugccucag

SEQ ID NO: 56547 - RNA, 21 nt, Human
cuccugaccugugacccccug

SEQ ID NO: 56548 - RNA, 21 nt, Human
ucacucugacuccaucaaacu

SEQ ID NO: 56549 - RNA, 22 nt, Human
guguuuuaauuccaauaugaug

SEQ ID NO: 56550 - RNA, 23 nt, Human
ucucaucugcaucuuucacaccu

SEQ ID NO: 56551 - RNA, 26 nt, Human
ccagaaccuccgccucccgcuccggg

SEQ ID NO: 56552 - RNA, 22 nt, Human
gcccaggcugguaugcagucau

SEQ ID NO: 56553 - RNA, 26 nt, Human
cauccagcauuugcaucaccucccug

SEQ ID NO: 56554 - RNA, 22 nt, Human
gcauccgucuccccucguuaac

SEQ ID NO: 56555 - RNA, 20 nt, Human
acuaggagaaaaaauggaaa

SEQ ID NO: 56556 - RNA, 24 nt, Human
aacugguccauacccauucauuaa

SEQ ID NO: 56557 - RNA, 28 nt, Human
aguguagauaguuaaaagacugcagcug

SEQ ID NO: 56558 - RNA, 23 nt, Human
gucaugugucaccaucuucccuc

SEQ ID NO: 56559 - RNA, 22 nt, Human
acuagccuggccaacaucauga

SEQ ID NO: 56560 - RNA, 25 nt, Human
guccacucagaguucugagggggcc

SEQ ID NO: 56561 - RNA, 22 nt, Human
cucagccucccaaagugguggg

SEQ ID NO: 56562 - RNA, 22 nt, Human
gacaggcagcaggagucucggc

SEQ ID NO: 56563 - RNA, 21 nt, Human
uaaggggucggcuaaguggga

SEQ ID NO: 56564 - RNA, 18 nt, Human
ggggaaagaaaggcagcg

SEQ ID NO: 56565 - RNA, 27 nt, Human
gggcacuggguacccaagugaagguuc

SEQ ID NO: 56566 - RNA, 25 nt, Human
uuuccacugcucuauuucugacucu

SEQ ID NO: 56567 - RNA, 22 nt, Human
cucuggccaaagcuugcucccu

SEQ ID NO: 56568 - RNA, 19 nt, Human
uucucauuccucucagcca

SEQ ID NO: 56569 - RNA, 20 nt, Human
cugcagcgugagcuguggga

SEQ ID NO: 56570 - RNA, 21 nt, Human
augaaguauacuuuuccccug

SEQ ID NO: 56571 - RNA, 22 nt, Human
agcuucccaaguagcugggacu

SEQ ID NO: 56572 - RNA, 20 nt, Human
cuccaucucaaaacaaaaca

SEQ ID NO: 56573 - RNA, 23 nt, Human
cgcuagaaucagaucugcucucc

SEQ ID NO: 56574 - RNA, 24 nt, Human
aacaguaauggaguacaugagcac

SEQ ID NO: 56575 - RNA, 20 nt, Human
ccugcuguuguggccauguc

SEQ ID NO: 56576 - RNA, 24 nt, Human
ggacuacaggcccugccaccacgc

SEQ ID NO: 56577 - RNA, 26 nt, Human
augccuggccccccuccaggcaugcu

SEQ ID NO: 56578 - RNA, 18 nt, Human
uuucaugauuucuaccuc

SEQ ID NO: 56579 - RNA, 29 nt, Human
gcccuuccucaucuccaugcucuuucacc

SEQ ID NO: 56580 - RNA, 25 nt, Human
gagaggggagagagacuggagcugg

SEQ ID NO: 56581 - RNA, 25 nt, Human
gcuccucugcaucuugcucugugcc

SEQ ID NO: 56582 - RNA, 26 nt, Human
agaacaaugccauuugagagugaggu

SEQ ID NO: 56583 - RNA, 22 nt, Human
cccggccgccuccacccgggga

SEQ ID NO: 56584 - RNA, 20 nt, Human
gguucuguguuuugccugaa

SEQ ID NO: 56585 - RNA, 27 nt, Human
ggcuuuccugguuuguuccucucucca

SEQ ID NO: 56586 - RNA, 24 nt, Human
cggccuguccgcugcacaccagcu

SEQ ID NO: 56587 - RNA, 24 nt, Human
ggauggcuugaagccaguaguuca

SEQ ID NO: 56588 - RNA, 19 nt, Human
ucagagcaagcacuggacu

SEQ ID NO: 56589 - RNA, 26 nt, Human
gagggggagagcaggcagcgggcggc

SEQ ID NO: 56590 - RNA, 18 nt, Human
ucauaaccauccaugcag

SEQ ID NO: 56591 - RNA, 22 nt, Human
uuuaagauaugaaucaaugugu

SEQ ID NO: 56592 - RNA, 18 nt, Human
uggaagcuucagcccugc

SEQ ID NO: 56593 - RNA, 27 nt, Human
uucauucucuuacauuuguguggguug

SEQ ID NO: 56594 - RNA, 21 nt, Human
augugguucugaugguuguug

SEQ ID NO: 56595 - RNA, 22 nt, Human
cuacagacauuucgccccaaau

SEQ ID NO: 56596 - RNA, 22 nt, Human
uaggcuggagugcaguggcaca

SEQ ID NO: 56597 - RNA, 21 nt, Human
aucauuagcauuucccaucau

SEQ ID NO: 56598 - RNA, 21 nt, Human
ucuauuauuuugcaaaacaaa

SEQ ID NO: 56599 - RNA, 20 nt, Human
gcaaccagaggaaacuugca

SEQ ID NO: 56600 - RNA, 21 nt, Human
cuguauucugugccuuccauc

SEQ ID NO: 56601 - RNA, 22 nt, Human
agagcacgguucccauaagggc

SEQ ID NO: 56602 - RNA, 21 nt, Human
ccccccaggcugaagugcagu

SEQ ID NO: 56603 - RNA, 21 nt, Human
aucucccaaagaagauaaaga

SEQ ID NO: 56604 - RNA, 23 nt, Human
caggcagccaacaucacucagga

SEQ ID NO: 56605 - RNA, 23 nt, Human
aggaaaauccaaaguggagagag

SEQ ID NO: 56606 - RNA, 19 nt, Human
ccuccguuugcaguaggca

SEQ ID NO: 56607 - RNA, 21 nt, Human
ucauucuucuuuuauuauuca

SEQ ID NO: 56608 - RNA, 21 nt, Human
ucugagcaagggcugagggaa

SEQ ID NO: 56609 - RNA, 22 nt, Human
uccagccuggguaacaagagca

SEQ ID NO: 56610 - RNA, 25 nt, Human
acaauagcaccuugaaaaucugccc

SEQ ID NO: 56611 - RNA, 19 nt, Human
agaagcagcucguauuuca

SEQ ID NO: 56612 - RNA, 22 nt, Human
gucugacauauacuggaaaugu

SEQ ID NO: 56613 - RNA, 27 nt, Human
ggucucaaacuccugcccucaggugau

SEQ ID NO: 56614 - RNA, 28 nt, Human
gcuuucagucuucugucagcaguaaaac

SEQ ID NO: 56615 - RNA, 20 nt, Human
ucacugcaaccucugccuuc

SEQ ID NO: 56616 - RNA, 27 nt, Human
cacacacaacaccuuaguuccucuagg

SEQ ID NO: 56617 - RNA, 27 nt, Human
ccaacagcaucaucugcacugcccacu

SEQ ID NO: 56618 - RNA, 22 nt, Human
uccugguggcauccuccagauc

SEQ ID NO: 56619 - RNA, 21 nt, Human
auuuaaaauauuaauuugcug

SEQ ID NO: 56620 - RNA, 22 nt, Human
agucuauuucauuuuuccacac

SEQ ID NO: 56621 - RNA, 22 nt, Human
cgcaucaggaauucaccuggag

SEQ ID NO: 56622 - RNA, 20 nt, Human
ggauagugcuggcuuccaug

SEQ ID NO: 56623 - RNA, 20 nt, Human
ucucuaauuucacaucagca

SEQ ID NO: 56624 - RNA, 24 nt, Human
uagaaugacugcccugggagggug

SEQ ID NO: 56625 - RNA, 26 nt, Human
cccugcacuccgccuuaguccugggg

SEQ ID NO: 56626 - RNA, 26 nt, Human
accaugucgcgcucagugcugcagcc

SEQ ID NO: 56627 - RNA, 21 nt, Human
uccuccagcaagaugcuaggg

SEQ ID NO: 56628 - RNA, 19 nt, Human
cucuagcaaccuccugggc

SEQ ID NO: 56629 - RNA, 21 nt, Human
uauuugcugacuagucucauu

SEQ ID NO: 56630 - RNA, 24 nt, Human
guuagauauagagucauuguaaug

SEQ ID NO: 56631 - RNA, 24 nt, Human
gucccauucuccacucacugcauu

SEQ ID NO: 56632 - RNA, 24 nt, Human
ccacugcucuccagccuggggaac

SEQ ID NO: 56633 - RNA, 20 nt, Human
cauauccaagagcucagggc

SEQ ID NO: 56634 - RNA, 25 nt, Human
ggacuacaugcuggccacugcugug

SEQ ID NO: 56635 - RNA, 20 nt, Human
ccucccccaggccucaggcc

SEQ ID NO: 56636 - RNA, 23 nt, Human
cuccaccuagacuguaaaccucu

SEQ ID NO: 56637 - RNA, 24 nt, Human
uuccugggccuccugcagaagcag

SEQ ID NO: 56638 - RNA, 20 nt, Human
caccacugcuaagggacucu

SEQ ID NO: 56639 - RNA, 21 nt, Human
caccugagccuuucuucugag

SEQ ID NO: 56640 - RNA, 20 nt, Human
acuccugauucuuccuuuuc

SEQ ID NO: 56641 - RNA, 21 nt, Human
caccuccggguucaagcgauu

SEQ ID NO: 56642 - RNA, 21 nt, Human
gugacuucauucuuuuuagac

SEQ ID NO: 56643 - RNA, 23 nt, Human
ucuuuuugcccaggcuggagugc

SEQ ID NO: 56644 - RNA, 22 nt, Human
uuggagggguauuuuugcccug

SEQ ID NO: 56645 - RNA, 21 nt, Human
cugugaccccuccuuucuucc

SEQ ID NO: 56646 - RNA, 25 nt, Human
uccaagugcccccucaccucuccag

SEQ ID NO: 56647 - RNA, 27 nt, Human
gcaucaaacagcacagcucugggggau

SEQ ID NO: 56648 - RNA, 27 nt, Human
cuucugcuuuaaugacuuuacaaagcu

SEQ ID NO: 56649 - RNA, 23 nt, Human
uccaacaacaggaaaccugacug

SEQ ID NO: 56650 - RNA, 23 nt, Human
gagugcuggauauuuuacuacca

SEQ ID NO: 56651 - RNA, 21 nt, Human
guggaaugccaugguuauuaa

SEQ ID NO: 56652 - RNA, 20 nt, Human
ugagcagcucacaugcucag

SEQ ID NO: 56653 - RNA, 22 nt, Human
cagggccucaguuucccuaucu

SEQ ID NO: 56654 - RNA, 26 nt, Human
ucacuucucacaaugucccuucagca

SEQ ID NO: 56655 - RNA, 23 nt, Human
uuauguccauuauucaagaaaga

SEQ ID NO: 56656 - RNA, 21 nt, Human
guccaaguccauugucaucuc

SEQ ID NO: 56657 - RNA, 16 nt, Human
ccuugcccuuuccaua

SEQ ID NO: 56658 - RNA, 19 nt, Human
aaccaaaaacaaacgccuu

SEQ ID NO: 56659 - RNA, 24 nt, Human
cggugacccaggggcucugcgaca

SEQ ID NO: 56660 - RNA, 20 nt, Human
aagugcccaggcucaggugc

SEQ ID NO: 56661 - RNA, 22 nt, Human
gaacagcuucagauuauggcuu

SEQ ID NO: 56662 - RNA, 27 nt, Human
cuguucucucacaggugauaaacaaug

SEQ ID NO: 56663 - RNA, 22 nt, Human
ucacauucuuagcacaccuaca

SEQ ID NO: 56664 - RNA, 19 nt, Human
cacuggcuggccugagcaa

SEQ ID NO: 56665 - RNA, 22 nt, Human
uguuugccucucagucuuucau

SEQ ID NO: 56666 - RNA, 22 nt, Human
ccccuugagcugagauggaacc

SEQ ID NO: 56667 - RNA, 28 nt, Human
ggcuaaguuauacccaaagcucacuuua

SEQ ID NO: 56668 - RNA, 21 nt, Human
uuuucugcuuuuucuauugcc

SEQ ID NO: 56669 - RNA, 21 nt, Human
gccccucugggccugccugug

SEQ ID NO: 56670 - RNA, 21 nt, Human
caguguuuuggacuccaucuc

SEQ ID NO: 56671 - RNA, 23 nt, Human
gagccccuccacagucggccuca

SEQ ID NO: 56672 - RNA, 23 nt, Human
aggggagaguccccuacuccccu

SEQ ID NO: 56673 - RNA, 22 nt, Human
uacuaccugaauucuaccugca

SEQ ID NO: 56674 - RNA, 21 nt, Human
acaugacccagggggugcaca

SEQ ID NO: 56675 - RNA, 27 nt, Human
uuaaggggagcaggagugcagaacaaa

SEQ ID NO: 56676 - RNA, 27 nt, Human
cuuugcagggccagugguuucugucag

SEQ ID NO: 56677 - RNA, 20 nt, Human
ccuuccucuuugcuuggguu

SEQ ID NO: 56678 - RNA, 22 nt, Human
cuguagucccagcuacucugaa

SEQ ID NO: 56679 - RNA, 23 nt, Human
cugacuucccaccaacagcuaac

SEQ ID NO: 56680 - RNA, 22 nt, Human
gaggccaccuuaacaacugaau

SEQ ID NO: 56681 - RNA, 22 nt, Human
acaacagcaacaaaaggcucca

SEQ ID NO: 56682 - RNA, 22 nt, Human
aacuuagcuuggccuauucuag

SEQ ID NO: 56683 - RNA, 21 nt, Human
gcccugcaguaaggagcccag

SEQ ID NO: 56684 - RNA, 18 nt, Human
cuuccagucaugugugca

SEQ ID NO: 56685 - RNA, 22 nt, Human
gccucugcccauggcggggugg

SEQ ID NO: 56686 - RNA, 17 nt, Human
cucugucuguccguguu

SEQ ID NO: 56687 - RNA, 17 nt, Human
uuuaugggaaugccuuu

SEQ ID NO: 56688 - RNA, 21 nt, Human
gguacacacacccccaccucc

SEQ ID NO: 56689 - RNA, 23 nt, Human
aaaggaauuuggagauagccaag

SEQ ID NO: 56690 - RNA, 21 nt, Human
uaggccagggugggagcagug

SEQ ID NO: 56691 - RNA, 22 nt, Human
gagcccagggagcuggaggucg

SEQ ID NO: 56692 - RNA, 26 nt, Human
gcagcucugggaccaguuaccccauu

SEQ ID NO: 56693 - RNA, 23 nt, Human
gccagcacuuggucagucacucu

SEQ ID NO: 56694 - RNA, 19 nt, Human
ccagccuacaaccuaggag

SEQ ID NO: 56695 - RNA, 20 nt, Human
uugcugagagagcuucuucu

SEQ ID NO: 56696 - RNA, 22 nt, Human
ggggaggcuacccgcggaagag

SEQ ID NO: 56697 - RNA, 23 nt, Human
gagagggagaagcacugugaggc

SEQ ID NO: 56698 - RNA, 25 nt, Human
agcugggacuucuccaggccugugu

SEQ ID NO: 56699 - RNA, 25 nt, Human
aacucgcacaucucuccugucuguu

SEQ ID NO: 56700 - RNA, 21 nt, Human
cagcuggaauuuaguggggag

SEQ ID NO: 56701 - RNA, 20 nt, Human
uauucuuuguuuccuguugg

SEQ ID NO: 56702 - RNA, 22 nt, Human
gggcuaggacuuugggguuagg

SEQ ID NO: 56703 - RNA, 20 nt, Human
uguuuacuaaaguguguaaa

SEQ ID NO: 56704 - RNA, 26 nt, Human
aagcacauaagcuagaagaagaaaua

SEQ ID NO: 56705 - RNA, 25 nt, Human
agccuccugcgaaccccagccugca

SEQ ID NO: 56706 - RNA, 21 nt, Human
ccaugguggugugcaccugug

SEQ ID NO: 56707 - RNA, 16 nt, Human
aucuaaaaaugcuccu

SEQ ID NO: 56708 - RNA, 21 nt, Human
uccagccugggugacagcgcg

SEQ ID NO: 56709 - RNA, 24 nt, Human
ggagggaguaaggaaacauuccuu

SEQ ID NO: 56710 - RNA, 27 nt, Human
uugcccaggcggacgggagggaggcac

SEQ ID NO: 56711 - RNA, 29 nt, Human
caggaucagcagagcaggcaggcagagug

SEQ ID NO: 56712 - RNA, 26 nt, Human
cugggcaacagagcaaaacucugucu

SEQ ID NO: 56713 - RNA, 25 nt, Human
gcccucuccccgccucggccagcgu

SEQ ID NO: 56714 - RNA, 21 nt, Human
ucacccagccaccggauucuc

SEQ ID NO: 56715 - RNA, 20 nt, Human
gggggccuggagaggacuga

SEQ ID NO: 56716 - RNA, 22 nt, Human
ccgggagguggagcuugcagug

SEQ ID NO: 56717 - RNA, 22 nt, Human
uagauauuauucauucauuuac

SEQ ID NO: 56718 - RNA, 27 nt, Human
cacccaggcuggcagaucaugguagca

SEQ ID NO: 56719 - RNA, 26 nt, Human
acagaaguuaaaccaauagagagaaa

SEQ ID NO: 56720 - RNA, 23 nt, Human
gaggcgguggcccuucuguugcu

SEQ ID NO: 56721 - RNA, 26 nt, Human
gcccugcugaggucacuguggggcac

SEQ ID NO: 56722 - RNA, 22 nt, Human
ugugugccgggcacugugguuu

SEQ ID NO: 56723 - RNA, 26 nt, Human
acagagcagaggcuggggcauuggca

SEQ ID NO: 56724 - RNA, 21 nt, Human
agagaaaccaggaauguaaug

SEQ ID NO: 56725 - RNA, 21 nt, Human
guccaccccucuccacacccc

SEQ ID NO: 56726 - RNA, 21 nt, Human
uuaguauuuuauaucagcaaa

SEQ ID NO: 56727 - RNA, 23 nt, Human
auugaggcuucuccuucacugga

SEQ ID NO: 56728 - RNA, 21 nt, Human
aacaaggcuguggggagcagg

SEQ ID NO: 56729 - RNA, 27 nt, Human
gaccucaacgggcaaaguugugcacac

SEQ ID NO: 56730 - RNA, 26 nt, Human
gcauuuucccagauacuucccauuuu

SEQ ID NO: 56731 - RNA, 30 nt, Human
agguccauuccagcacccaccugaguuccg

SEQ ID NO: 56732 - RNA, 27 nt, Human
aucccaggugcgugugucucugucucu

SEQ ID NO: 56733 - RNA, 24 nt, Human
cuguugcccaggauggagugcagu

SEQ ID NO: 56734 - RNA, 22 nt, Human
ugcccaagcuggagugaagugg

SEQ ID NO: 56735 - RNA, 23 nt, Human
uggggacacucugccagcaaaga

SEQ ID NO: 56736 - RNA, 20 nt, Human
uuaacggugcuaaaaaugaa

SEQ ID NO: 56737 - RNA, 21 nt, Human
aguguguauuccuguuaaauu

SEQ ID NO: 56738 - RNA, 22 nt, Human
gcaggaugcccauagaaacccc

SEQ ID NO: 56739 - RNA, 27 nt, Human
ucccuccagcuccaaaaggagcagccc

SEQ ID NO: 56740 - RNA, 24 nt, Human
gucacccagccugugaggguccug

SEQ ID NO: 56741 - RNA, 24 nt, Human
gggccaucuugguuuuugcaagaa

SEQ ID NO: 56742 - RNA, 18 nt, Human
agcaggaacucccaggga

SEQ ID NO: 56743 - RNA, 27 nt, Human
aagacuccagacuccagcuaacagucc

SEQ ID NO: 56744 - RNA, 22 nt, Human
acugcaaccuccacauccuggg

SEQ ID NO: 56745 - RNA, 27 nt, Human
ccccaccccuucccuauaggaacagcc

SEQ ID NO: 56746 - RNA, 25 nt, Human
uaucuccuggccuggaccucagaag

SEQ ID NO: 56747 - RNA, 23 nt, Human
ucugauuggcuuuuagcuuuuug

SEQ ID NO: 56748 - RNA, 20 nt, Human
ucucagcauguugacuggga

SEQ ID NO: 56749 - RNA, 21 nt, Human
acaacgugcugcuuacacucc

SEQ ID NO: 56750 - RNA, 24 nt, Human
ggucuccugcagcccucugcuccu

SEQ ID NO: 56751 - RNA, 27 nt, Human
ccacggggcuugggcgacuacaggguc

SEQ ID NO: 56752 - RNA, 25 nt, Human
cuucaagauccugcuaccauuuucu

SEQ ID NO: 56753 - RNA, 24 nt, Human
cucacugcacuuuggaccccuggg

SEQ ID NO: 56754 - RNA, 23 nt, Human
gauuagguauuagcagagacaaa

SEQ ID NO: 56755 - RNA, 21 nt, Human
ccacagucuccggccucucca

SEQ ID NO: 56756 - RNA, 20 nt, Human
aguaaacccuaucugugauu

SEQ ID NO: 56757 - RNA, 20 nt, Human
uugcccagccugcugcaauc

SEQ ID NO: 56758 - RNA, 20 nt, Human
gcuggggucugggcagugcc

SEQ ID NO: 56759 - RNA, 24 nt, Human
agccucacaaaccuguuauuccag

SEQ ID NO: 56760 - RNA, 23 nt, Human
ucuccucugaccugccuguacca

SEQ ID NO: 56761 - RNA, 22 nt, Human
gcaccuuaagauuuugcaccug

SEQ ID NO: 56762 - RNA, 21 nt, Human
guaugguuuuucaccaaacca

SEQ ID NO: 56763 - RNA, 23 nt, Human
ugcuggcauuugcugcauuucaa

SEQ ID NO: 56764 - RNA, 23 nt, Human
gccuaauuuauauucacuauccu

SEQ ID NO: 56765 - RNA, 23 nt, Human
cucaccuuuagguccugugaggg

SEQ ID NO: 56766 - RNA, 23 nt, Human
cagcacagcucugggggauguca

SEQ ID NO: 56767 - RNA, 26 nt, Human
agccccggcggggaggagcggguggg

SEQ ID NO: 56768 - RNA, 23 nt, Human
gugaacugugcgagcacuguggu

SEQ ID NO: 56769 - RNA, 21 nt, Human
ggaggaagagaccaagaaaua

SEQ ID NO: 56770 - RNA, 22 nt, Human
cccagccaagggacacaucuca

SEQ ID NO: 56771 - RNA, 24 nt, Human
ccaguagcucuugcauccuccucc

SEQ ID NO: 56772 - RNA, 27 nt, Human
accagccugggcagcauagcaagaucc

SEQ ID NO: 56773 - RNA, 22 nt, Human
cuccaucucuacugaaaauaca

SEQ ID NO: 56774 - RNA, 23 nt, Human
aggcuuugccaugggccugcugc

SEQ ID NO: 56775 - RNA, 22 nt, Human
guaaaguuuuauugugugauca

SEQ ID NO: 56776 - RNA, 19 nt, Human
cugcgccgccagggccgcu

SEQ ID NO: 56777 - RNA, 18 nt, Human
cagucagcuguccuggcc

SEQ ID NO: 56778 - RNA, 21 nt, Human
uguccagcaagccuacucuga

SEQ ID NO: 56779 - RNA, 21 nt, Human
uuuaucucucagaccacacac

SEQ ID NO: 56780 - RNA, 19 nt, Human
uuccuaaaucucuaucucu

SEQ ID NO: 56781 - RNA, 23 nt, Human
gcagccagcuaccccacugugug

SEQ ID NO: 56782 - RNA, 23 nt, Human
ugaucgggagagccggagcgagc

SEQ ID NO: 56783 - RNA, 26 nt, Human
agcggguauggcaggcagccggcggg

SEQ ID NO: 56784 - RNA, 21 nt, Human
ucaguggcugauugaaacuca

SEQ ID NO: 56785 - RNA, 22 nt, Human
cuucugagccccccugcuucua

SEQ ID NO: 56786 - RNA, 27 nt, Human
cacacacauauuuuuaaaguuuuuccu

SEQ ID NO: 56787 - RNA, 23 nt, Human
cagcggcaucaggcuuucuuaaa

SEQ ID NO: 56788 - RNA, 22 nt, Human
guugugcuugccugcguuuugg

SEQ ID NO: 56789 - RNA, 27 nt, Human
uggagcuuucuguagccuccggauacg

SEQ ID NO: 56790 - RNA, 23 nt, Human
ugcuaccucucuccuugaaggga

SEQ ID NO: 56791 - RNA, 22 nt, Human
uguaauaaaaaucauggcaaca

SEQ ID NO: 56792 - RNA, 22 nt, Human
gcccaggcuggagugcaauggc

SEQ ID NO: 56793 - RNA, 22 nt, Human
gcccaggcuagagugcaguggc

SEQ ID NO: 56794 - RNA, 27 nt, Human
uagccacaaguucuuguuuagagacca

SEQ ID NO: 56795 - RNA, 22 nt, Human
gggaggcacugccauuuggaga

SEQ ID NO: 56796 - RNA, 25 nt, Human
accagugaucccccaccucggucac

SEQ ID NO: 56797 - RNA, 21 nt, Human
ggacgccaggccugaggcagu

SEQ ID NO: 56798 - RNA, 22 nt, Human
acuuacugcuagcucugcuuuu

SEQ ID NO: 56799 - RNA, 18 nt, Human
gucugcugucuaacccug

SEQ ID NO: 56800 - RNA, 22 nt, Human
gauggagaggaccaggagccag

SEQ ID NO: 56801 - RNA, 21 nt, Human
uaaguuaauaacccacaaaag

SEQ ID NO: 56802 - RNA, 22 nt, Human
gucccagcacggacauggccuc

SEQ ID NO: 56803 - RNA, 22 nt, Human
ugaaaccaggacaagcuacuua

SEQ ID NO: 56804 - RNA, 22 nt, Human
gcccuuuaauauuuccaaugug

SEQ ID NO: 56805 - RNA, 25 nt, Human
uucaaaacauguuaaacguuacuuu

SEQ ID NO: 56806 - RNA, 31 nt, Human
ccagcucagaggcccaggaaucggagcgaag

SEQ ID NO: 56807 - RNA, 25 nt, Human
aagccuccgggagaccagagcuggg

SEQ ID NO: 56808 - RNA, 32 nt, Human; identical to SEQ ID NO: 4911

SEQ ID NO: 56809 - RNA, 22 nt, Human
cuuuuccuacugugucuuguua

SEQ ID NO: 56810 - RNA, 22 nt, Human
ugaacuccuggucucaagugau

SEQ ID NO: 56811 - RNA, 23 nt, Human
uguuggccaggcuggagugcagu

SEQ ID NO: 56812 - RNA, 21 nt, Human
gaccuccugggcaacauagug

SEQ ID NO: 56813 - RNA, 22 nt, Human
auugcuugaacccaggaggcag

SEQ ID NO: 56814 - RNA, 22 nt, Human
ggaaggcacaagguagcugugg

SEQ ID NO: 56815 - RNA, 27 nt, Human
gcugugacgccugaauaacugucuacu

SEQ ID NO: 56816 - RNA, 19 nt, Human
cucaggccacaccggccuu

SEQ ID NO: 56817 - RNA, 28 nt, Human
caaggcucugagcaaauguggcuccugg

SEQ ID NO: 56818 - RNA, 29 nt, Human
gugccaaagccauuucuguacuaacuguu

SEQ ID NO: 56819 - RNA, 19 nt, Human
ucuuguuccaugccuccag

SEQ ID NO: 56820 - RNA, 20 nt, Human
ucagccuggaauccccaccu

SEQ ID NO: 56821 - RNA, 27 nt, Human
uguuaccuuccugaggccucaguauua

SEQ ID NO: 56822 - RNA, 25 nt, Human
acgacugcuccugccaacagaaggu

SEQ ID NO: 56823 - RNA, 22 nt, Human
ccaaagugcugagauuacaggc

SEQ ID NO: 56824 - RNA, 22 nt, Human
ccaaagugcugggauuacaagc

SEQ ID NO: 56825 - RNA, 24 nt, Human
gucccuucacugcacuuucuuccu

SEQ ID NO: 56826 - RNA, 21 nt, Human
ugacgacauggagcagcuucg

SEQ ID NO: 56827 - RNA, 26 nt, Human
gauuuugaaccccuguauuuucuuuu

SEQ ID NO: 56828 - RNA, 26 nt, Human
aaaaugcucaugccaguuaaugccag

SEQ ID NO: 56829 - RNA, 20 nt, Human
guuacaccuccacucagcac

SEQ ID NO: 56830 - RNA, 20 nt, Human
agccccggagaggguccuga

SEQ ID NO: 56831 - RNA, 20 nt, Human
ucgggaaaauaaccaguuaa

SEQ ID NO: 56832 - RNA, 20 nt, Human
ugaacagauguuuuggcucu

SEQ ID NO: 56833 - RNA, 20 nt, Human
cuucauguuaaaagaccauc

SEQ ID NO: 56834 - RNA, 21 nt, Human
caggggucccugagcuguucu

SEQ ID NO: 56835 - RNA, 29 nt, Human
ggguuaaaugcggaaaucucuccuugcgu

SEQ ID NO: 56836 - RNA, 25 nt, Human
cugcgugucccacagacgcuuguuc

SEQ ID NO: 56837 - RNA, 21 nt, Human
caccucccggguucaagcaau

SEQ ID NO: 56838 - RNA, 22 nt, Human
aggcuggagugcaauggcgcgu

SEQ ID NO: 56839 - RNA, 20 nt, Human
agcuaaauuucugagcuuua

SEQ ID NO: 56840 - RNA, 27 nt, Human
ugcugagacucuugacagcaccuccag

SEQ ID NO: 56841 - RNA, 19 nt, Human
uuguuuuaaagagagaauu

SEQ ID NO: 56842 - RNA, 25 nt, Human
ccuguugacgucuugcccuaggcaa

SEQ ID NO: 56843 - RNA, 23 nt, Human
acuucaaggagcaccuucauuag

SEQ ID NO: 56844 - RNA, 17 nt, Human
gcccagcccagcccagc

SEQ ID NO: 56845 - RNA, 21 nt, Human
cugggaugguggcugccugug

SEQ ID NO: 56846 - RNA, 21 nt, Human
caaaugucaucaguguuuuaa

SEQ ID NO: 56847 - RNA, 22 nt, Human
ucucggcugccaggggcucugu

SEQ ID NO: 56848 - RNA, 22 nt, Human
cuccacuggggagauauaagaa

SEQ ID NO: 56849 - RNA, 29 nt, Human
ccaaucauuucuucacuucucugggacac

SEQ ID NO: 56850 - RNA, 19 nt, Human
ccgccucggccccugcugc

SEQ ID NO: 56851 - RNA, 23 nt, Human
caaguagcugggauaacaggcgc

SEQ ID NO: 56852 - RNA, 26 nt, Human
ccugccuguguuucccucuuaggugc

SEQ ID NO: 56853 - RNA, 22 nt, Human
ggagagggggugggggagccag

SEQ ID NO: 56854 - RNA, 20 nt, Human
guuaaccuuuguuguuuucc

SEQ ID NO: 56855 - RNA, 26 nt, Human
acugccuccagggcuggaauccugug

SEQ ID NO: 56856 - RNA, 21 nt, Human
aaacccagaguuuauguagaa

SEQ ID NO: 56857 - RNA, 23 nt, Human
accuguaauuccagcacuucagg

SEQ ID NO: 56858 - RNA, 23 nt, Human
ucaggaauuugggaagcuggcuc

SEQ ID NO: 56859 - RNA, 21 nt, Human
gaaaaaguuuggaagcacuga

SEQ ID NO: 56860 - RNA, 20 nt, Human
uuaagcccucaucacuucaa

SEQ ID NO: 56861 - RNA, 23 nt, Human
agacucacugcaaguuccugccc

SEQ ID NO: 56862 - RNA, 22 nt, Human
uacucggagcucggaucccagu

SEQ ID NO: 56863 - RNA, 22 nt, Human
cugcaaccuuugccucccaggu

SEQ ID NO: 56864 - RNA, 18 nt, Human
uacauacuucagacuuuu

SEQ ID NO: 56865 - RNA, 24 nt, Human
gagugacccugagacuaaugaaca

SEQ ID NO: 56866 - RNA, 25 nt, Human
gccuggccuguaccugcaccccacu

SEQ ID NO: 56867 - RNA, 23 nt, Human
ggcacagaaguagcucuggugac

SEQ ID NO: 56868 - RNA, 24 nt, Human
uauugugauauuuuagcacuuugg

SEQ ID NO: 56869 - RNA, 22 nt, Human
gguacaggcaggaugauccagg

SEQ ID NO: 56870 - RNA, 20 nt, Human
ccuugcgaccaccaacacac

SEQ ID NO: 56871 - RNA, 27 nt, Human
gcccagccccucagccucaucuggagc

SEQ ID NO: 56872 - RNA, 21 nt, Human
cuccucuccuucccauggccc

SEQ ID NO: 56873 - RNA, 23 nt, Human
gugcauuuaacuguuucaugcgc

SEQ ID NO: 56874 - RNA, 27 nt, Human
gcgacugggaagaacacugcccccucc

SEQ ID NO: 56875 - RNA, 22 nt, Human
gccugcucuucccauguuggcc

SEQ ID NO: 56876 - RNA, 28 nt, Human
cucucccaggcccaaggcugcgggcgcc

SEQ ID NO: 56877 - RNA, 25 nt, Human
gaaaggcuuugagaaggacgugggc

SEQ ID NO: 56878 - RNA, 23 nt, Human
auauugauuuaaacuguguuuca

SEQ ID NO: 56879 - RNA, 22 nt, Human
uugaguagcugggauuacaggc

SEQ ID NO: 56880 - RNA, 22 nt, Human
aguguccguuauccugccugca

SEQ ID NO: 56881 - RNA, 19 nt, Human
ggaggucccacagcaaaga

SEQ ID NO: 56882 - RNA, 27 nt, Human
ccucuaaccccuuaauggugcaaccac

SEQ ID NO: 56883 - RNA, 24 nt, Human
cuuccacccuccccauuuggaguc

SEQ ID NO: 56884 - RNA, 26 nt, Human
aagaacaucuggaguuggagccgcac

SEQ ID NO: 56885 - RNA, 20 nt, Human
gccgggcagccuccugcucu

SEQ ID NO: 56886 - RNA, 22 nt, Human
aagaaaaauggccgggccaggu

SEQ ID NO: 56887 - RNA, 21 nt, Human
uagauggaguccaaacgcagu

SEQ ID NO: 56888 - RNA, 27 nt, Human
gcugagucucuaucauagcugaacccu

SEQ ID NO: 56889 - RNA, 18 nt, Human
uuucaguaguucuaccuc

SEQ ID NO: 56890 - RNA, 24 nt, Human
ccaccaccuucucuucucuuguca

SEQ ID NO: 56891 - RNA, 16 nt, Human
cuaccucccccaguua

SEQ ID NO: 56892 - RNA, 22 nt, Human
cuauccauguaauaagcacuug

SEQ ID NO: 56893 - RNA, 27 nt, Human
uuuucuuucuuuaguuccuguauucua

SEQ ID NO: 56894 - RNA, 26 nt, Human
ggaggcggcaggcggcaggcagcagg

SEQ ID NO: 56895 - RNA, 23 nt, Human
accuguguucuuuacacacuaca

SEQ ID NO: 56896 - RNA, 24 nt, Human
caagcuggagugaagugguacaau

SEQ ID NO: 56897 - RNA, 21 nt, Human
aauaggagggagacuguggua

SEQ ID NO: 56898 - RNA, 28 nt, Human
cacuuacugaccggccugggcugcucug

SEQ ID NO: 56899 - RNA, 23 nt, Human
cagcuuuguaaauauuucuuuaa

SEQ ID NO: 56900 - RNA, 21 nt, Human
auccagcuuuggugcaauggc

SEQ ID NO: 56901 - RNA, 23 nt, Human
uuuacauucauuuaaccugccga

SEQ ID NO: 56902 - RNA, 21 nt, Human
uugagggaaggacaagagaua

SEQ ID NO: 56903 - RNA, 27 nt, Human
cucuggcacuccaguccagcuugggcc

SEQ ID NO: 56904 - RNA, 22 nt, Human
guugcccaggcuggucuccaac

SEQ ID NO: 56905 - RNA, 22 nt, Human
cuacacucauucuuaacuuuuc

SEQ ID NO: 56906 - RNA, 19 nt, Human
ggcuggguggaggagggag

SEQ ID NO: 56907 - RNA, 20 nt, Human
agagaauauguuuaauccau

SEQ ID NO: 56908 - RNA, 28 nt, Human
cacuggcacuccagccugggcaacagag

SEQ ID NO: 56909 - RNA, 23 nt, Human
uugaucaauucuuuaauuuugga

SEQ ID NO: 56910 - RNA, 20 nt, Human
ccuuguguaugugacauaua

SEQ ID NO: 56911 - RNA, 22 nt, Human
cacuuagaauauauuuuauuua

SEQ ID NO: 56912 - RNA, 16 nt, Human
caggcagccgcggugc

SEQ ID NO: 56913 - RNA, 19 nt, Human
uuauuuuuaaagaucuucu

SEQ ID NO: 56914 - RNA, 27 nt, Human
gagaagggagccccaggcuggagcagc

SEQ ID NO: 56915 - RNA, 22 nt, Human
gcaaugugauaaaaccccaucu

SEQ ID NO: 56916 - RNA, 27 nt, Human
uucacacauuuagccaaucuuucuaga

SEQ ID NO: 56917 - RNA, 23 nt, Human
gugcuuugcuguccaucuuccca

SEQ ID NO: 56918 - RNA, 26 nt, Human
gccucugugucacccacuccugggug

SEQ ID NO: 56919 - RNA, 20 nt, Human
aaauugugcaaaauggcaua

SEQ ID NO: 56920 - RNA, 26 nt, Human
guaucauuauuucuguuguuuuuguu

SEQ ID NO: 56921 - RNA, 26 nt, Human
aguccagccacucuucaccuggcucc

SEQ ID NO: 56922 - RNA, 23 nt, Human
cggccacaucauucugugucucu

SEQ ID NO: 56923 - RNA, 22 nt, Human
augcagcagcggcugggcuugg

SEQ ID NO: 56924 - RNA, 22 nt, Human
cccaccccgucccuggccauuc

SEQ ID NO: 56925 - RNA, 23 nt, Human
gcugugcagcacuucuguccuca

SEQ ID NO: 56926 - RNA, 31 nt, Human
gcugggcaucccugugccugucccuggcggc

SEQ ID NO: 56927 - RNA, 22 nt, Human
uguccaggcuggagugcagugg

SEQ ID NO: 56928 - RNA, 20 nt, Human
cauugacugcuuaaccaaag

SEQ ID NO: 56929 - RNA, 24 nt, Human
ccugccuguguuccagcaugcuua

SEQ ID NO: 56930 - RNA, 27 nt, Human
uccaaguguaugggauuaacuaaucau

SEQ ID NO: 56931 - RNA, 26 nt, Human
ggcuaauuuuuuauuuaauuuuuugu

SEQ ID NO: 56932 - RNA, 20 nt, Human
ccugcuugcccugcccucuc

SEQ ID NO: 56933 - RNA, 25 nt, Human
ucuucaccaucacuccaucaaaguc

SEQ ID NO: 56934 - RNA, 22 nt, Human
cuuuuugguguuuaugaaaauc

SEQ ID NO: 56935 - RNA, 21 nt, Human
ugcagugagauguaacuuucu

SEQ ID NO: 56936 - RNA, 22 nt, Human
cauucagagaacuagauaaaag

SEQ ID NO: 56937 - RNA, 21 nt, Human
cuuguguccuccucagucaga

SEQ ID NO: 56938 - RNA, 22 nt, Human
acuugcuccucccucuacccuc

SEQ ID NO: 56939 - RNA, 27 nt, Human
ugagaaguuacaguucaucuccccugu

SEQ ID NO: 56940 - RNA, 22 nt, Human
uguugccaugaaggcuugcaga

SEQ ID NO: 56941 - RNA, 20 nt, Human
auacaagaucuuccuuccuc

SEQ ID NO: 56942 - RNA, 22 nt, Human
gggagggucagagggaggccgg

SEQ ID NO: 56943 - RNA, 25 nt, Human
gaauuugccauuauugcacaucaca

SEQ ID NO: 56944 - RNA, 24 nt, Human
ucagcaagcccagaaguaucugca

SEQ ID NO: 56945 - RNA, 23 nt, Human
aagguugcugggauuaaggggau

SEQ ID NO: 56946 - RNA, 20 nt, Human
ucuaaacuugaaacaaaaca

SEQ ID NO: 56947 - RNA, 26 nt, Human
caccgcaccccgcccagccuggcaga

SEQ ID NO: 56948 - RNA, 24 nt, Human
uaucugucugguggccccguuucu

SEQ ID NO: 56949 - RNA, 22 nt, Human
uguaauaaagauuauaauaccc

SEQ ID NO: 56950 - RNA, 20 nt, Human
ugggcccucccacuccaucu

SEQ ID NO: 56951 - RNA, 24 nt, Human
ccugcucuccgagucugugucucc

SEQ ID NO: 56952 - RNA, 21 nt, Human
guucugagccuccccacauua

SEQ ID NO: 56953 - RNA, 20 nt, Human
agccauggcgauucuuuuug

SEQ ID NO: 56954 - RNA, 20 nt, Human
ggaugcagaguucagggaag

SEQ ID NO: 56955 - RNA, 23 nt, Human
ccacuguacuccagccugaagag

SEQ ID NO: 56956 - RNA, 22 nt, Human
cuuaccccacaacgugcaacug

SEQ ID NO: 56957 - RNA, 27 nt, Human
ugggagguguuggcugcacgugcgggu

SEQ ID NO: 56958 - RNA, 23 nt, Human
cccuucauccugcggggcuggcu

SEQ ID NO: 56959 - RNA, 21 nt, Human
cugcgguugccaacacugcug

SEQ ID NO: 56960 - RNA, 20 nt, Human
cugggcaggucuucuccucc

SEQ ID NO: 56961 - RNA, 20 nt, Human
ggugacugggaaaugcugag

SEQ ID NO: 56962 - RNA, 22 nt, Human
ucgaagcugaugguuggaagac

SEQ ID NO: 56963 - RNA, 20 nt, Human
gauuacuuuucuuacucuga

SEQ ID NO: 56964 - RNA, 25 nt, Human
uaguuucuugggggacucacucacu

SEQ ID NO: 56965 - RNA, 21 nt, Human
uugaguauuugaaaauuguug

SEQ ID NO: 56966 - RNA, 23 nt, Human
uggcccagacacccaccugacuu

SEQ ID NO: 56967 - RNA, 24 nt, Human
caguagcugcucgccacacaggcu

SEQ ID NO: 56968 - RNA, 20 nt, Human
ucuauauauacaaugaguaa

SEQ ID NO: 56969 - RNA, 22 nt, Human
cuuuuaacucagaugaauuuau

SEQ ID NO: 56970 - RNA, 19 nt, Human
acgagacauagugcugcua

SEQ ID NO: 56971 - RNA, 19 nt, Human
ugagugugggugugauaca

SEQ ID NO: 56972 - RNA, 22 nt, Human
agaccagcuugggcaacauggc

SEQ ID NO: 56973 - RNA, 21 nt, Human
cugagcaccugcugugugcca

SEQ ID NO: 56974 - RNA, 21 nt, Human
ccauauuuucaagucaucuua

SEQ ID NO: 56975 - RNA, 23 nt, Human
ccugacccugcugccaccuccug

SEQ ID NO: 56976 - RNA, 22 nt, Human
acauucuuaaccuguauuugaa

SEQ ID NO: 56977 - RNA, 21 nt, Human
gccagcauuggugaauauuca

SEQ ID NO: 56978 - RNA, 21 nt, Human
uccagcguggcaucucuugug

SEQ ID NO: 56979 - RNA, 20 nt, Human
uaggauucaggaagguaggc

SEQ ID NO: 56980 - RNA, 19 nt, Human
gugucugcugacuguuuca

SEQ ID NO: 56981 - RNA, 24 nt, Human
gugucauccaggcuggagugcggu

SEQ ID NO: 56982 - RNA, 20 nt, Human
ccaggccucagccaccugcc

SEQ ID NO: 56983 - RNA, 26 nt, Human
ucucucuccauaucaaucuggaccau

SEQ ID NO: 56984 - RNA, 22 nt, Human
caaaccucgucaccacggucag

SEQ ID NO: 56985 - RNA, 27 nt, Human
uuaguagacauuuauaacucaaggaua

SEQ ID NO: 56986 - RNA, 21 nt, Human
cuccugaggcugcuggcugag

SEQ ID NO: 56987 - RNA, 21 nt, Human
uaaaaccaccaaauggcauuu

SEQ ID NO: 56988 - RNA, 22 nt, Human
gccacagacgccuucccccuug

SEQ ID NO: 56989 - RNA, 21 nt, Human
uauggucucaacugugcuuga

SEQ ID NO: 56990 - RNA, 27 nt, Human
aggaacaauaaaauagaaacauuugua

SEQ ID NO: 56991 - RNA, 19 nt, Human
acugaucaggaagugcagu

SEQ ID NO: 56992 - RNA, 22 nt, Human
ugacagagcaagacuccaucuc

SEQ ID NO: 56993 - RNA, 22 nt, Human
caacagagugagacuccaucuc

SEQ ID NO: 56994 - RNA, 25 nt, Human
ccuaccccacauccugucuuagccg

SEQ ID NO: 56995 - RNA, 23 nt, Human
gacugggcccagauaaugagcug

SEQ ID NO: 56996 - RNA, 24 nt, Human
aucuaacugugaaagaaacuucug

SEQ ID NO: 56997 - RNA, 27 nt, Human
cuuuagcuuaucuuuugaagcuacugg

SEQ ID NO: 56998 - RNA, 20 nt, Human
guaaucugcuuuccugucug

SEQ ID NO: 56999 - RNA, 23 nt, Human
uucauucugcuacuuuguaacua

SEQ ID NO: 57000 - RNA, 25 nt, Human
agaggcagcagcacuugguaaaagu

SEQ ID NO: 57001 - RNA, 25 nt, Human
auaccugaaauuuuccgugguaaua

SEQ ID NO: 57002 - RNA, 22 nt, Human
aggauggugaguugaagcauca

SEQ ID NO: 57003 - RNA, 25 nt, Human
cugacacaggcugacacauucuuuc

SEQ ID NO: 57004 - RNA, 20 nt, Human
uuaccugcacccaggccuca

SEQ ID NO: 57005 - RNA, 22 nt, Human
cugaagcaggagauuugcuuga

SEQ ID NO: 57006 - RNA, 28 nt, Human
ggcaggacaagagaaggcauugagcuuu

SEQ ID NO: 57007 - RNA, 24 nt, Human
gggcccuucacugccuuugcuccu

SEQ ID NO: 57008 - RNA, 19 nt, Human
cgcaaaccaggggcggguu

SEQ ID NO: 57009 - RNA, 26 nt, Human
ccuuccagauccucucuggggcugug

SEQ ID NO: 57010 - RNA, 27 nt, Human
uggaaacuuagcuucaaagaaaaugca

SEQ ID NO: 57011 - RNA, 21 nt, Human
ugcugcuggggggaucacaga

SEQ ID NO: 57012 - RNA, 24 nt, Human
augccuggcuaauuuuuguauuuu

SEQ ID NO: 57013 - RNA, 25 nt, Human
uccugucaagucaucuugugaaagg

SEQ ID NO: 57014 - RNA, 24 nt, Human
uaccuacugaauuagaaacucuag

SEQ ID NO: 57015 - RNA, 22 nt, Human
uagaaacuucuaagugcacugg

SEQ ID NO: 57016 - RNA, 21 nt, Human
gagagggacgguucacaaggc

SEQ ID NO: 57017 - RNA, 25 nt, Human
agggucgaugauauuucacugaugg

SEQ ID NO: 57018 - RNA, 19 nt, Human
gcugccugccuucuugcca

SEQ ID NO: 57019 - RNA, 22 nt, Human
ugcagcucuggcuccuugucuc

SEQ ID NO: 57020 - RNA, 24 nt, Human
ucuacuuaggagauaauuucuuua

SEQ ID NO: 57021 - RNA, 22 nt, Human
guuguccaggcuaagagguggg

SEQ ID NO: 57022 - RNA, 25 nt, Human
cagguguccauggggagcacuggau

SEQ ID NO: 57023 - RNA, 22 nt, Human
cuuggcuggaauccaggacugu

SEQ ID NO: 57024 - RNA, 23 nt, Human
cuccuguuuguugagugcacuga

SEQ ID NO: 57025 - RNA, 26 nt, Human
cugggagccugugggggaggcucagg

SEQ ID NO: 57026 - RNA, 22 nt, Human
cccagccucccaaguagcuggg

SEQ ID NO: 57027 - RNA, 27 nt, Human
ucugccuggcugaccucugagcccaug

SEQ ID NO: 57028 - RNA, 22 nt, Human
gggaaggaagagaguuucacag

SEQ ID NO: 57029 - RNA, 27 nt, Human
guggguuuguaccuuccuuaagccagg

SEQ ID NO: 57030 - RNA, 26 nt, Human
cacuccuccaucucaugggcucacgg

SEQ ID NO: 57031 - RNA, 22 nt, Human
cagacacucucucccucaggaa

SEQ ID NO: 57032 - RNA, 21 nt, Human
cgcauauaucaugacacuucu

SEQ ID NO: 57033 - RNA, 22 nt, Human
gcaugagccaccacuccuggcc

SEQ ID NO: 57034 - RNA, 18 nt, Human
ucaguuaggcagugcagu

SEQ ID NO: 57035 - RNA, 27 nt, Human
gaggagaagcagcagcaaacauuugcu

SEQ ID NO: 57036 - RNA, 21 nt, Human
gcagugagccaagaucacguc

SEQ ID NO: 57037 - RNA, 26 nt, Human
cccacuccuccccuauaacagaagau

SEQ ID NO: 57038 - RNA, 20 nt, Human
ucuccccucagguagggguc

SEQ ID NO: 57039 - RNA, 22 nt, Human
ugcccagcugacgagcuuuuga

SEQ ID NO: 57040 - RNA, 25 nt, Human
ggccuuagggccaaaagucuugagg

SEQ ID NO: 57041 - RNA, 26 nt, Human
ggugcaaucaugguucacugcagucu

SEQ ID NO: 57042 - RNA, 20 nt, Human
aacuccaucugcugccauga

SEQ ID NO: 57043 - RNA, 26 nt, Human
accccugggguucaauacuggaagug

SEQ ID NO: 57044 - RNA, 18 nt, Human
augcagauguugaaggaa

SEQ ID NO: 57045 - RNA, 20 nt, Human
gccaggcccaccaagagaua

SEQ ID NO: 57046 - RNA, 26 nt, Human
cucccggucucgccuuccucgcgguc

SEQ ID NO: 57047 - RNA, 23 nt, Human
gccaggccucauccuccuggacc

SEQ ID NO: 57048 - RNA, 24 nt, Human
cuccaccuuccaaaggaccuacug

SEQ ID NO: 57049 - RNA, 26 nt, Human
agcuugcugcucaaccucuagugucc

SEQ ID NO: 57050 - RNA, 21 nt, Human
acuaaaauggauauauuuuua

SEQ ID NO: 57051 - RNA, 23 nt, Human
ucacccaggcugggaauugcagu

SEQ ID NO: 57052 - RNA, 22 nt, Human
ugcuggcaacaaaggauucggg

SEQ ID NO: 57053 - RNA, 22 nt, Human
ccuucacugcagagccuugccu

SEQ ID NO: 57054 - RNA, 20 nt, Human
aaaauugaugaaaugcccca

SEQ ID NO: 57055 - RNA, 21 nt, Human
gggaaggucugaugccuccca

SEQ ID NO: 57056 - RNA, 26 nt, Human
uucagggcaucugaauguuugaugug

SEQ ID NO: 57057 - RNA, 21 nt, Human
ggcuuacaccuguaaucccaa

SEQ ID NO: 57058 - RNA, 21 nt, Human
ucuucuuaauuuaacaaauuu

SEQ ID NO: 57059 - RNA, 23 nt, Human
agccuccagggcccgaggugauc

SEQ ID NO: 57060 - RNA, 20 nt, Human
cacucuguuaaaaacacaua

SEQ ID NO: 57061 - RNA, 27 nt, Human
gacccgcuucagggccaggaguggcgu

SEQ ID NO: 57062 - RNA, 18 nt, Human
ucaaauucucauaggggc

SEQ ID NO: 57063 - RNA, 16 nt, Human
ccucaaggaggucugg

SEQ ID NO: 57064 - RNA, 22 nt, Human
ucuuagcaaccucauuucgaca

SEQ ID NO: 57065 - RNA, 27 nt, Human
uucugcucuccucagaggucccgggcu

SEQ ID NO: 57066 - RNA, 24 nt, Human
gccaggcuggaguguaguggcaca

SEQ ID NO: 57067 - RNA, 27 nt, Human
ucuuagcaaucucucaaugccuuuuca

SEQ ID NO: 57068 - RNA, 23 nt, Human
uaaaugauugaauuauauguuca

SEQ ID NO: 57069 - RNA, 28 nt, Human
cagugugugaaguaccuaccuccuugcc

SEQ ID NO: 57070 - RNA, 21 nt, Human
cuccuugccuagugcuuuuca

SEQ ID NO: 57071 - RNA, 20 nt, Human
aucuaauuuguagcuacugg

SEQ ID NO: 57072 - RNA, 20 nt, Human
ggauuacaggcuugagccuc

SEQ ID NO: 57073 - RNA, 27 nt, Human
uucugucuccugcauacacuccggcau

SEQ ID NO: 57074 - RNA, 22 nt, Human
acagagcaaaugacacuucucu

SEQ ID NO: 57075 - RNA, 24 nt, Human
ugucagaugucacauaauuacuuu

SEQ ID NO: 57076 - RNA, 23 nt, Human
gcugagaaucagagacauuucag

SEQ ID NO: 57077 - RNA, 22 nt, Human
cagcauagccuuucuguauuua

SEQ ID NO: 57078 - RNA, 23 nt, Human
ggccuuuggaacaccaagcucug

SEQ ID NO: 57079 - RNA, 21 nt, Human
gccccaccagccaccucuugg

SEQ ID NO: 57080 - RNA, 26 nt, Human
gucccaagccccacuccauggggcca

SEQ ID NO: 57081 - RNA, 22 nt, Human
gaggcugauuccaguagaauua

SEQ ID NO: 57082 - RNA, 27 nt, Human
aucuauguugauuugcuuuugucuauu

SEQ ID NO: 57083 - RNA, 21 nt, Human
gccauugugcagucauggccc

SEQ ID NO: 57084 - RNA, 26 nt, Human
ucauuugauuuuguuaagagugcagu

SEQ ID NO: 57085 - RNA, 23 nt, Human
aucacaccacuacacuccagccu

SEQ ID NO: 57086 - RNA, 23 nt, Human
aucgcaccacugcacuccagccu

SEQ ID NO: 57087 - RNA, 23 nt, Human
aucacaccacugcacuccaaccu

SEQ ID NO: 57088 - RNA, 27 nt, Human
ugggaggccaaggcaaggggaucacuu

SEQ ID NO: 57089 - RNA, 26 nt, Human
aacccaguagcuggagucugaagaug

SEQ ID NO: 57090 - RNA, 25 nt, Human
aguguauuuaaauauuucauugaca

SEQ ID NO: 57091 - RNA, 25 nt, Human
gcuucugucaauuacugaagcuaua

SEQ ID NO: 57092 - RNA, 22 nt, Human
ugcccccucugcccugcggguc

SEQ ID NO: 57093 - RNA, 22 nt, Human
caguuaagagaaaugagcuuga

SEQ ID NO: 57094 - RNA, 25 nt, Human
gcccccagcucacacucagcguggg

SEQ ID NO: 57095 - RNA, 22 nt, Human
ucaguagacauugcaguuaguu

SEQ ID NO: 57096 - RNA, 27 nt, Human
caggcuggagggcaguggcacgaucuc

SEQ ID NO: 57097 - RNA, 18 nt, Human
gugauauacuccaggacu

SEQ ID NO: 57098 - RNA, 23 nt, Human
uuguggucuuagguauggugcua

SEQ ID NO: 57099 - RNA, 21 nt, Human
uacuacacuccagccugguga

SEQ ID NO: 57100 - RNA, 21 nt, Human
ggagcacggggcugaucaagc

SEQ ID NO: 57101 - RNA, 22 nt, Human
cgaacuccugggcucaagugau

SEQ ID NO: 57102 - RNA, 20 nt, Human
agaugccaaaccacaagacu

SEQ ID NO: 57103 - RNA, 26 nt, Human
ugccaugcagucaucuuccccuccaa

SEQ ID NO: 57104 - RNA, 25 nt, Human
gccuagacuggauaguggggguggg

SEQ ID NO: 57105 - RNA, 24 nt, Human
gccuucuuauuguccuccuccucc

SEQ ID NO: 57106 - RNA, 24 nt, Human
guguccucccuguccaaauuggga

SEQ ID NO: 57107 - RNA, 23 nt, Human
uaccucuguuuaagcaagguaau

SEQ ID NO: 57108 - RNA, 26 nt, Human
ggucacuucucauuuucuuugcugac

SEQ ID NO: 57109 - RNA, 21 nt, Human
caccugcaugcuucccgccuc

SEQ ID NO: 57110 - RNA, 22 nt, Human
ugcccaggaauguugucaagug

SEQ ID NO: 57111 - RNA, 26 nt, Human
ccagccuggugacagcgugagacucu

SEQ ID NO: 57112 - RNA, 18 nt, Human
gcugcuggggagcucaga

SEQ ID NO: 57113 - RNA, 22 nt, Human
uguccauuuccuguccaggaga

SEQ ID NO: 57114 - RNA, 28 nt, Human
agccccauuauuuucacagugccagccu

SEQ ID NO: 57115 - RNA, 25 nt, Human
aggauguuuauauuccuucaucccu

SEQ ID NO: 57116 - RNA, 20 nt, Human
cuucucucaauuccagucau

SEQ ID NO: 57117 - RNA, 20 nt, Human
uggaggugguugcacuugcc

SEQ ID NO: 57118 - RNA, 22 nt, Human
uuugccccacugccuccccugu

SEQ ID NO: 57119 - RNA, 27 nt, Human
gggagagaagaccuugggccaagaugc

SEQ ID NO: 57120 - RNA, 23 nt, Human
uaaagcauuucuucagugcucag

SEQ ID NO: 57121 - RNA, 22 nt, Human
aggcugaggcaggaaaauggcg

SEQ ID NO: 57122 - RNA, 28 nt, Human
guacacacacccccaccuccugcaauua

SEQ ID NO: 57123 - RNA, 24 nt, Human
uggggaggacaggaaggggacucc

SEQ ID NO: 57124 - RNA, 20 nt, Human
uaauuagucauuagccauaa

SEQ ID NO: 57125 - RNA, 25 nt, Human
ggcuacugcugaguccuuugggguu

SEQ ID NO: 57126 - RNA, 23 nt, Human
ccaggaguuugaggcugcaguga

SEQ ID NO: 57127 - RNA, 20 nt, Human
ugcaaaauauuuguuguacu

SEQ ID NO: 57128 - RNA, 20 nt, Human
aacucugccuguaucaccgg

SEQ ID NO: 57129 - RNA, 27 nt, Human
uucauucucuauuuuugcuaaauuucu

SEQ ID NO: 57130 - RNA, 21 nt, Human
guaccucuguuacucucagcc

SEQ ID NO: 57131 - RNA, 20 nt, Human
gcuuuuccuccuuccugaca

SEQ ID NO: 57132 - RNA, 23 nt, Human
uucucucucccaucaccuugccc

SEQ ID NO: 57133 - RNA, 22 nt, Human
cacugcacacugccuagcccaa

SEQ ID NO: 57134 - RNA, 22 nt, Human
ccucccagccacaccugccccu

SEQ ID NO: 57135 - RNA, 21 nt, Human
gggcauaagucaggaacuugg

SEQ ID NO: 57136 - RNA, 24 nt, Human
ggcgacaccuccgcgggcacucac

SEQ ID NO: 57137 - RNA, 24 nt, Human
ccccacugaggccccuacugaggc

SEQ ID NO: 57138 - RNA, 21 nt, Human
gaaaucugaaaaauggccaug

SEQ ID NO: 57139 - RNA, 25 nt, Human
gccaaggcuggagugcaguggcacg

SEQ ID NO: 57140 - RNA, 25 nt, Human
ucugcucccugccuuugccucacuu

SEQ ID NO: 57141 - RNA, 23 nt, Human
uucagccagauaguaaaugggau

SEQ ID NO: 57142 - RNA, 21 nt, Human
ucauguauugguacaagcaga

SEQ ID NO: 57143 - RNA, 19 nt, Human
ccccgcuggugacccucug

SEQ ID NO: 57144 - RNA, 22 nt, Human
ggccauucaauagccugccuuc

SEQ ID NO: 57145 - RNA, 25 nt, Human
uucuagucuuaacauacuugcaucc

SEQ ID NO: 57146 - RNA, 27 nt, Human
uggccaacaugguaaaaucccgucucu

SEQ ID NO: 57147 - RNA, 22 nt, Human
uaagccccaggcugaauacuca

SEQ ID NO: 57148 - RNA, 22 nt, Human
acuccaaagaaagcacauaacu

SEQ ID NO: 57149 - RNA, 27 nt, Human
ucacccaggcuggaguacaauagcgug

SEQ ID NO: 57150 - RNA, 18 nt, Human
agcagccggaagugccuu

SEQ ID NO: 57151 - RNA, 21 nt, Human
uaagccaagaucacaccacug

SEQ ID NO: 57152 - RNA, 19 nt, Human
cacucuuauuucaagcaga

SEQ ID NO: 57153 - RNA, 24 nt, Human
ucuguuaucuuuugcccucuuaga

SEQ ID NO: 57154 - RNA, 24 nt, Human
aggccaggaccaagggcagagggg

SEQ ID NO: 57155 - RNA, 22 nt, Human
guccguggcccacacucgguca

SEQ ID NO: 57156 - RNA, 25 nt, Human
gugcuggucuuuagccccacugcug

SEQ ID NO: 57157 - RNA, 24 nt, Human
auggggucaggucaauauuaugaa

SEQ ID NO: 57158 - RNA, 22 nt, Human
acccaggcuggagcacacuggu

SEQ ID NO: 57159 - RNA, 22 nt, Human
acccaggcuggaguacacuggc

SEQ ID NO: 57160 - RNA, 25 nt, Human
ccugcagcugcugagacaagaggcg

SEQ ID NO: 57161 - RNA, 22 nt, Human
ugaacaccugggcuuaagaaau

SEQ ID NO: 57162 - RNA, 24 nt, Human
ugcauuuucacgcugugcuaagca

SEQ ID NO: 57163 - RNA, 17 nt, Human
guuuuuucauuguguuu

SEQ ID NO: 57164 - RNA, 22 nt, Human
ggcucacugcagccuugacuuc

SEQ ID NO: 57165 - RNA, 20 nt, Human
gaaaguuggcuuugaugucu

SEQ ID NO: 57166 - RNA, 22 nt, Human
gucugggcaacauggugaaacc

SEQ ID NO: 57167 - RNA, 21 nt, Human
gcccagccgcuccaucauguc

SEQ ID NO: 57168 - RNA, 24 nt, Human
ggcacaaggaagcauugaauuccu

SEQ ID NO: 57169 - RNA, 26 nt, Human
ugucggggguggagauguagaagaug

SEQ ID NO: 57170 - RNA, 25 nt, Human
ugcccaagagugggguuuucuugaa

SEQ ID NO: 57171 - RNA, 27 nt, Human
ucuguucuguuguuugugguuuucuca

SEQ ID NO: 57172 - RNA, 18 nt, Human
ugggcacagccugcuguc

SEQ ID NO: 57173 - RNA, 26 nt, Human
gcugacacaggagccagagugagacc

SEQ ID NO: 57174 - RNA, 22 nt, Human
gcagcccagcuccugaauaaag

SEQ ID NO: 57175 - RNA, 23 nt, Human
agaacucccuagugaggagcuga

SEQ ID NO: 57176 - RNA, 19 nt, Human
ggaacuggcauacugcaaa

SEQ ID NO: 57177 - RNA, 24 nt, Human
gcagaaaacagggggccuaaagaa

SEQ ID NO: 57178 - RNA, 22 nt, Human
ugggauuacagaugugagccau

SEQ ID NO: 57179 - RNA, 19 nt, Human
accaggaucucacuggguc

SEQ ID NO: 57180 - RNA, 23 nt, Human
ccaacaugguguaaacacugucu

SEQ ID NO: 57181 - RNA, 21 nt, Human
ucccuuugguaggugcaccug

SEQ ID NO: 57182 - RNA, 22 nt, Human
acccaggcuggagugcaauggu

SEQ ID NO: 57183 - RNA, 22 nt, Human
ucccaggcuggagugcuauggu

SEQ ID NO: 57184 - RNA, 26 nt, Human
uggaacccaagcaaugcuggcacccc

SEQ ID NO: 57185 - RNA, 26 nt, Human
aggaggucaaagcacuggagccaaca

SEQ ID NO: 57186 - RNA, 22 nt, Human
acgccuguagucccagcacuuu

SEQ ID NO: 57187 - RNA, 18 nt, Human
gccuuugcaaccuauccu

SEQ ID NO: 57188 - RNA, 22 nt, Human
ucccagaucucagcuagaacca

SEQ ID NO: 57189 - RNA, 23 nt, Human
agcacagcaccuucccagucucc

SEQ ID NO: 57190 - RNA, 26 nt, Human
ccugccuggcuggcucccuuggcugu

SEQ ID NO: 57191 - RNA, 21 nt, Human
cuccuugccaccggcuuucua

SEQ ID NO: 57192 - RNA, 22 nt, Human
agguauucacacauuuaaggaa

SEQ ID NO: 57193 - RNA, 24 nt, Human
ugccccucuggccacugcugcaga

SEQ ID NO: 57194 - RNA, 21 nt, Human
agucacugucucaacuacuca

SEQ ID NO: 57195 - RNA, 26 nt, Human
caggagguggagauucccaguuaaaa

SEQ ID NO: 57196 - RNA, 27 nt, Human
acuggaagggaaguucaggcucugaga

SEQ ID NO: 57197 - RNA, 21 nt, Human
gcccccagaggcugugucucu

SEQ ID NO: 57198 - RNA, 25 nt, Human
uccguuucaagagaggagaucauga

SEQ ID NO: 57199 - RNA, 18 nt, Human
ucacacacuuucucuuca

SEQ ID NO: 57200 - RNA, 24 nt, Human
uuccaauaaaacgugcguuccucu

SEQ ID NO: 57201 - RNA, 22 nt, Human
gaugggguuuugccauguugcc

SEQ ID NO: 57202 - RNA, 28 nt, Human
ccacucauuccuucucgugcacugcuuu

SEQ ID NO: 57203 - RNA, 22 nt, Human
gaacuccuggacuuaagugagc

SEQ ID NO: 57204 - RNA, 27 nt, Human
aucagagagucucugaagaagauucug

SEQ ID NO: 57205 - RNA, 25 nt, Human
ggagccgcccucacacauuuuccag

SEQ ID NO: 57206 - RNA, 27 nt, Human
ucugcuuccugugaaaguccuuuccgu

SEQ ID NO: 57207 - RNA, 27 nt, Human
uacaucuggccuugaaaccaccuuuua

SEQ ID NO: 57208 - RNA, 21 nt, Human
aagaacauuaauuauauguau

SEQ ID NO: 57209 - RNA, 24 nt, Human
auuuuaaucacuguguauaaugau

SEQ ID NO: 57210 - RNA, 25 nt, Human
aaaaucaagauauuucuuugcugaa

SEQ ID NO: 57211 - RNA, 22 nt, Human
agagaaagaugccacugaaaug

SEQ ID NO: 57212 - RNA, 22 nt, Human
uacauaugaucugcagguuugg

SEQ ID NO: 57213 - RNA, 28 nt, Human
ucuccaacuccugaccucagguaauccg

SEQ ID NO: 57214 - RNA, 24 nt, Human
gacaugacuuggcuuucucaucca

SEQ ID NO: 57215 - RNA, 22 nt, Human
uaguuccuaaaguuucuucuac

SEQ ID NO: 57216 - RNA, 22 nt, Human
ggguuuuggagguugaauagga

SEQ ID NO: 57217 - RNA, 19 nt, Human
auuaugcuauagcuucuau

SEQ ID NO: 57218 - RNA, 27 nt, Human
ucacccacccuguacccucuucugugu

SEQ ID NO: 57219 - RNA, 22 nt, Human
gacuacaggugcccgccaccgu

SEQ ID NO: 57220 - RNA, 27 nt, Human
agcucugugaucuugggcaaguuacuu

SEQ ID NO: 57221 - RNA, 23 nt, Human
caccagccugagcaacaugguaa

SEQ ID NO: 57222 - RNA, 21 nt, Human
cccaaggagcagcaggcaugg

SEQ ID NO: 57223 - RNA, 24 nt, Human
ccccugagaggacacgcuccuuuu

SEQ ID NO: 57224 - RNA, 22 nt, Human
uggguauugcuccugcccagac

SEQ ID NO: 57225 - RNA, 20 nt, Human
ccuguucuggucucuucccg

SEQ ID NO: 57226 - RNA, 21 nt, Human
uccaugcagaauuacuuacag

SEQ ID NO: 57227 - RNA, 24 nt, Human
gugauggccaucagacagagacuu

SEQ ID NO: 57228 - RNA, 22 nt, Human
uaauccggauccuaguccugag

SEQ ID NO: 57229 - RNA, 24 nt, Human
ggcgccaagcugagccccuucgca

SEQ ID NO: 57230 - RNA, 20 nt, Human
ucaccaaggagccccacugg

SEQ ID NO: 57231 - RNA, 23 nt, Human
ccgaguucuuucaggccaaaaag

SEQ ID NO: 57232 - RNA, 18 nt, Human
aaauaagaagaaugcuua

SEQ ID NO: 57233 - RNA, 25 nt, Human
uccguggguuucccgccagccgcag

SEQ ID NO: 57234 - RNA, 21 nt, Human
uguuuguuuuucagugcaaua

SEQ ID NO: 57235 - RNA, 23 nt, Human
uucuagauggcuuuaauuuugaa

SEQ ID NO: 57236 - RNA, 21 nt, Human
aguaaagcucuuuggauuaga

SEQ ID NO: 57237 - RNA, 23 nt, Human
uccugggggaagaggagauguga

SEQ ID NO: 57238 - RNA, 29 nt, Human
aggauucuaccugaacugaaaggacugug

SEQ ID NO: 57239 - RNA, 25 nt, Human
gucucagauuccugggcuuaagcag

SEQ ID NO: 57240 - RNA, 23 nt, Human
gacacccuucaugggcucgugag

SEQ ID NO: 57241 - RNA, 22 nt, Human
cugggaggagcgagggagcgag

SEQ ID NO: 57242 - RNA, 20 nt, Human
agggcacugcugcugccuuu

SEQ ID NO: 57243 - RNA, 20 nt, Human
caggcugggguuagugagca

SEQ ID NO: 57244 - RNA, 21 nt, Human
auuucauagccaaacaggaga

SEQ ID NO: 57245 - RNA, 22 nt, Human
gaacaaugcaacuuuuuauuua

SEQ ID NO: 57246 - RNA, 25 nt, Human
gccugggccaccaucggccgcaccc

SEQ ID NO: 57247 - RNA, 27 nt, Human
gucucccaccuggaacugaauugcuug

SEQ ID NO: 57248 - RNA, 21 nt, Human
gauauuucuuucccuaaccau

SEQ ID NO: 57249 - RNA, 22 nt, Human
ugagagaaguuagcgucccugg

SEQ ID NO: 57250 - RNA, 23 nt, Human
acugguaacucuuaacugagaca

SEQ ID NO: 57251 - RNA, 23 nt, Human
cuccucagacccuguucuuggcc

SEQ ID NO: 57252 - RNA, 27 nt, Human
ggggggcggagggcggucaccugccag

SEQ ID NO: 57253 - RNA, 22 nt, Human
ggagacguuucuucuguggaag

SEQ ID NO: 57254 - RNA, 25 nt, Human
cuccaccucugcagugaucauaagu

SEQ ID NO: 57255 - RNA, 21 nt, Human
ucacucaggcuggaguacagu

SEQ ID NO: 57256 - RNA, 23 nt, Human
ugccuucagaaauaaguccuaga

SEQ ID NO: 57257 - RNA, 22 nt, Human
uggaaggaagagguugcaguga

SEQ ID NO: 57258 - RNA, 21 nt, Human
gacacugcccuccagccuggg

SEQ ID NO: 57259 - RNA, 20 nt, Human
ggaaggcaggcguguccugg

SEQ ID NO: 57260 - RNA, 27 nt, Human
uugagacagagucucacucucgucgcc

SEQ ID NO: 57261 - RNA, 25 nt, Human
aggaaacuucugccucaggugggga

SEQ ID NO: 57262 - RNA, 23 nt, Human
cacaaguccuggauguugugugu

SEQ ID NO: 57263 - RNA, 25 nt, Human
ucucccugcacucccuccuggagcu

SEQ ID NO: 57264 - RNA, 22 nt, Human
gaccauucugcuccugcugcug

SEQ ID NO: 57265 - RNA, 22 nt, Human
uggauuacaggugugagccacc

SEQ ID NO: 57266 - RNA, 22 nt, Human
ugcacagugcaucucagcccac

SEQ ID NO: 57267 - RNA, 27 nt, Human
uggcucagcccagagucccugucuccc

SEQ ID NO: 57268 - RNA, 23 nt, Human
ccaggaggcagagcuugcaguga

SEQ ID NO: 57269 - RNA, 21 nt, Human
aaagcucccgggccucagccu

SEQ ID NO: 57270 - RNA, 22 nt, Human
ucacccagguccagaggcggcg

SEQ ID NO: 57271 - RNA, 21 nt, Human
gaugccagcugggagucuugc

SEQ ID NO: 57272 - RNA, 21 nt, Human
aaauaagaucacagagcagca

SEQ ID NO: 57273 - RNA, 22 nt, Human
agcuaagaaacuuacuugauuc

SEQ ID NO: 57274 - RNA, 22 nt, Human
cagaccucagcuccugggggcc

SEQ ID NO: 57275 - RNA, 22 nt, Human
ccguuaggccaagcaggugcua

SEQ ID NO: 57276 - RNA, 21 nt, Human
gucagcccauggggagcuuug

SEQ ID NO: 57277 - RNA, 21 nt, Human
uuucuguggugagguggaaac

SEQ ID NO: 57278 - RNA, 22 nt, Human
aaagguuucauguucacuguga

SEQ ID NO: 57279 - RNA, 29 nt, Human
uuuucucucuguauaucacuucuuacaua

SEQ ID NO: 57280 - RNA, 27 nt, Human
acuguaaccucagucuaccccucuccu

SEQ ID NO: 57281 - RNA, 19 nt, Human
gaccuguuuuuccuguuuc

SEQ ID NO: 57282 - RNA, 27 nt, Human
ggccaccggaagagucgcggucgccag

SEQ ID NO: 57283 - RNA, 22 nt, Human
ccaacauggcgaaaccccgucu

SEQ ID NO: 57284 - RNA, 27 nt, Human
ccccagccccugcuccagcagcuguca

SEQ ID NO: 57285 - RNA, 22 nt, Human
ccaacauggugaaacccugucu

SEQ ID NO: 57286 - RNA, 22 nt, Human
ccaacauggcaaaaccccaucu

SEQ ID NO: 57287 - RNA, 22 nt, Human
cuaacauggugaaaccccgucu

SEQ ID NO: 57288 - RNA, 26 nt, Human
uugcuugaauucuuucuuaauuuacg

SEQ ID NO: 57289 - RNA, 22 nt, Human
cuucuucccucuccagaagucc

SEQ ID NO: 57290 - RNA, 24 nt, Human
auaaggaguuagaaccacagcaga

SEQ ID NO: 57291 - RNA, 22 nt, Human
agacgcgugcgcgugcacagau

SEQ ID NO: 57292 - RNA, 24 nt, Human
ucucucuuaaugcaugauacagaa

SEQ ID NO: 57293 - RNA, 27 nt, Human
gggcccugaggccccugcccuagugca

SEQ ID NO: 57294 - RNA, 32 nt, Human
aggcugaagaccugggacaggucgauugcugg

SEQ ID NO: 57295 - RNA, 22 nt, Human
agccucccaaguaguuaggaca

SEQ ID NO: 57296 - RNA, 22 nt, Human
cucacccaggcugcagugccau

SEQ ID NO: 57297 - RNA, 21 nt, Human
ugcuuauacugcuguaauauu

SEQ ID NO: 57298 - RNA, 24 nt, Human
ccagcacugcuguuuaccuugcag

SEQ ID NO: 57299 - RNA, 23 nt, Human
agagcgcggcccugcgucagagc

SEQ ID NO: 57300 - RNA, 24 nt, Human
gcugagggagggagccauggaagg

SEQ ID NO: 57301 - RNA, 23 nt, Human
cuaagcgguaacuauggcaauuu

SEQ ID NO: 57302 - RNA, 22 nt, Human
uucuccucuuuuugaaaauucc

SEQ ID NO: 57303 - RNA, 29 nt, Human
ugucuguggauggucauugcaguuuaaga

SEQ ID NO: 57304 - RNA, 19 nt, Human
uagcuuaaggaagcccccc

SEQ ID NO: 57305 - RNA, 18 nt, Human
aucuucugucugugacac

SEQ ID NO: 57306 - RNA, 21 nt, Human
caggcuucugagcacagcugc

SEQ ID NO: 57307 - RNA, 21 nt, Human
ucaguccuuugcacuuccuca

SEQ ID NO: 57308 - RNA, 21 nt, Human
guaacaucugcugaacgggcc

SEQ ID NO: 57309 - RNA, 27 nt, Human
ugggaccccuguccacacccacccuau

SEQ ID NO: 57310 - RNA, 26 nt, Human
aaaugagaggagugcuaggugggugg

SEQ ID NO: 57311 - RNA, 22 nt, Human
agugcuugugggaugcaguggu

SEQ ID NO: 57312 - RNA, 23 nt, Human
aagucugccuauccuggccaggu

SEQ ID NO: 57313 - RNA, 20 nt, Human
uuuugcaucagccuggagug

SEQ ID NO: 57314 - RNA, 27 nt, Human
aaauguuccuuuuauuuaacauuguaa

SEQ ID NO: 57315 - RNA, 23 nt, Human
aguuauacuguaaccucuuaagu

SEQ ID NO: 57316 - RNA, 21 nt, Human
gacuguguggauccaccagaa

SEQ ID NO: 57317 - RNA, 27 nt, Human
ggacuccuccuuuuuccaugcccuaaa

SEQ ID NO: 57318 - RNA, 22 nt, Human
agugggaagucaggccucucug

SEQ ID NO: 57319 - RNA, 21 nt, Human
ccaacagcucacuagcuggca

SEQ ID NO: 57320 - RNA, 27 nt, Human
aagaggaauaagaauggagcaguacau

SEQ ID NO: 57321 - RNA, 22 nt, Human
aggacuuguccccuggcagcug

SEQ ID NO: 57322 - RNA, 20 nt, Human
acuccccagcuuggagcagu

SEQ ID NO: 57323 - RNA, 20 nt, Human
cagacuucagauuagacuuu

SEQ ID NO: 57324 - RNA, 23 nt, Human
auucaguccugggcaaagguauu

SEQ ID NO: 57325 - RNA, 24 nt, Human
cgccucucccugcauccugagcca

SEQ ID NO: 57326 - RNA, 22 nt, Human
acuugccuccccacugcagccu

SEQ ID NO: 57327 - RNA, 25 nt, Human
gccuuucucuccuagugagugugcu

SEQ ID NO: 57328 - RNA, 21 nt, Human
guuuaucuggagugagguggc

SEQ ID NO: 57329 - RNA, 21 nt, Human
gguccugcugccucucuuuca

SEQ ID NO: 57330 - RNA, 22 nt, Human
ugagcgggcugccggccuccaa

SEQ ID NO: 57331 - RNA, 15 nt, Human
cuucccuucuguccu

SEQ ID NO: 57332 - RNA, 27 nt, Human
agcuagcagacacauccaguaucuccu

SEQ ID NO: 57333 - RNA, 19 nt, Human
acauguuuacaaagagguu

SEQ ID NO: 57334 - RNA, 19 nt, Human
uaccuuguaaaucuuccca

SEQ ID NO: 57335 - RNA, 22 nt, Human
uaguccuucccaccuccaguca

SEQ ID NO: 57336 - RNA, 23 nt, Human
aaugugaggaaaaccuaaaggga

SEQ ID NO: 57337 - RNA, 20 nt, Human
ugcuggagcugucacaugac

SEQ ID NO: 57338 - RNA, 21 nt, Human
gcagucugcccuccugcucca

SEQ ID NO: 57339 - RNA, 23 nt, Human
ugcaacugaagcagagugugggu

SEQ ID NO: 57340 - RNA, 22 nt, Human
acuaagcuuccauagaaauaca

SEQ ID NO: 57341 - RNA, 27 nt, Human
gugaggcagaagcauugcuugagcuug

SEQ ID NO: 57342 - RNA, 21 nt, Human
aauguguguacaguguguaua

SEQ ID NO: 57343 - RNA, 22 nt, Human
aggauggaugcccugugccagu

SEQ ID NO: 57344 - RNA, 21 nt, Human
guugcugcacuccagccuagg

SEQ ID NO: 57345 - RNA, 22 nt, Human
guagguggaucaccugaggucg

SEQ ID NO: 57346 - RNA, 20 nt, Human
gucaaguugugaacaagcac

SEQ ID NO: 57347 - RNA, 23 nt, Human
gugaugggcuguuuaaaguguca

SEQ ID NO: 57348 - RNA, 22 nt, Human
guggaagcagugcuguaguuac

SEQ ID NO: 57349 - RNA, 20 nt, Human
cgcugccauuucacacucac

SEQ ID NO: 57350 - RNA, 24 nt, Human
cggugcccucuccuuuucguuucc

SEQ ID NO: 57351 - RNA, 20 nt, Human
ggaaaauuuaaaaggcugca

SEQ ID NO: 57352 - RNA, 19 nt, Human
cuuugacaccuacuguguu

SEQ ID NO: 57353 - RNA, 27 nt, Human
ugacccaggcugggcaaggaggccacg

SEQ ID NO: 57354 - RNA, 27 nt, Human
agaagcagcggcucacuuggacuuuuu

SEQ ID NO: 57355 - RNA, 18 nt, Human
gggggcagagggcagagg

SEQ ID NO: 57356 - RNA, 21 nt, Human
ggaaaggggauaccuucccac

SEQ ID NO: 57357 - RNA, 21 nt, Human
gucccugguggaaauucaaag

SEQ ID NO: 57358 - RNA, 19 nt, Human
aggugauggggaacuccau

SEQ ID NO: 57359 - RNA, 20 nt, Human
aaguuauccuguggccaggu

SEQ ID NO: 57360 - RNA, 20 nt, Human
ccgcagcuuugggccugguc

SEQ ID NO: 57361 - RNA, 20 nt, Human
acuuuugcaggaugaccuca

SEQ ID NO: 57362 - RNA, 27 nt, Human
ugucugugucccauggucauagucaaa

SEQ ID NO: 57363 - RNA, 23 nt, Human
ugggcguucaaggcauuaagaua

SEQ ID NO: 57364 - RNA, 22 nt, Human
cccagcugacaggggggauccu

SEQ ID NO: 57365 - RNA, 20 nt, Human
uauuugaccagauucccaac

SEQ ID NO: 57366 - RNA, 32 nt, Human
uccaacaauucuaaccaacaaaggaccuagac

SEQ ID NO: 57367 - RNA, 24 nt, Human
cuauaacaacaacaacaaaagcga

SEQ ID NO: 57368 - RNA, 21 nt, Human
ggaguuuccuagugggcuucu

SEQ ID NO: 57369 - RNA, 23 nt, Human
uucuggagcacugauugcagcag

SEQ ID NO: 57370 - RNA, 29 nt, Human
cccuuuaccggucccaggcugcugacugg

SEQ ID NO: 57371 - RNA, 26 nt, Human
ugcuccacaucucccugcugcucauc

SEQ ID NO: 57372 - RNA, 20 nt, Human
gaagagccuggauugcucac

SEQ ID NO: 57373 - RNA, 29 nt, Human
cccuccacuuccuccuccuguuuggcuuc

SEQ ID NO: 57374 - RNA, 22 nt, Human
ugucccuacacaugaccuugga

SEQ ID NO: 57375 - RNA, 20 nt, Human
aucugucugaauuacuucag

SEQ ID NO: 57376 - RNA, 27 nt, Human
uccuuuaucagucccuugggcacagca

SEQ ID NO: 57377 - RNA, 17 nt, Human
cacaucuuccauuucca

SEQ ID NO: 57378 - RNA, 26 nt, Human
cugcucccucuaccccuuaccccaca

SEQ ID NO: 57379 - RNA, 23 nt, Human
ucaguaauuacaaauuaaggguu

SEQ ID NO: 57380 - RNA, 23 nt, Human
uuguggacugagcggccgcagag

SEQ ID NO: 57381 - RNA, 21 nt, Human
cuuuccucugcugcucaauag

SEQ ID NO: 57382 - RNA, 23 nt, Human
gacgcacaggcuggagugcagug

SEQ ID NO: 57383 - RNA, 22 nt, Human
aauaaaaaaucacuucauugua

SEQ ID NO: 57384 - RNA, 23 nt, Human
auggugguauguuuucaggcuag

SEQ ID NO: 57385 - RNA, 24 nt, Human
aagccccgggacaccuguuggagg

SEQ ID NO: 57386 - RNA, 24 nt, Human
agaucaagcauuacacacaaaaaa

SEQ ID NO: 57387 - RNA, 21 nt, Human
ggaugagagacauagacgaga

SEQ ID NO: 57388 - RNA, 21 nt, Human
gaccccuggagguccaggggg

SEQ ID NO: 57389 - RNA, 22 nt, Human
ggcuggcuggguccccuucgca

SEQ ID NO: 57390 - RNA, 25 nt, Human
uguugaaauauccucaauuucucua

SEQ ID NO: 57391 - RNA, 20 nt, Human
cuggauggaggcuugagggc

SEQ ID NO: 57392 - RNA, 23 nt, Human
caucacccucugggcagcuguca

SEQ ID NO: 57393 - RNA, 22 nt, Human
ucaacuucucuaccccaaagaa

SEQ ID NO: 57394 - RNA, 22 nt, Human
aguuauuucucuuguucuggcc

SEQ ID NO: 57395 - RNA, 27 nt, Human
aucucugaggagauggaucgguaccug

SEQ ID NO: 57396 - RNA, 23 nt, Human
gcacagcccuagauacaaucccu

SEQ ID NO: 57397 - RNA, 26 nt, Human
gcauacacagaugaaggugggaagga

SEQ ID NO: 57398 - RNA, 32 nt, Human
cccuggcuucccccuuccucugggcaggggac

SEQ ID NO: 57399 - RNA, 17 nt, Human
gcuacccuucuucucca

SEQ ID NO: 57400 - RNA, 19 nt, Human
ucacugcacuuuuuuauug

SEQ ID NO: 57401 - RNA, 23 nt, Human
ccugcagucuccucucuggguga

SEQ ID NO: 57402 - RNA, 24 nt, Human
ccccugagagaucuaguccugucc

SEQ ID NO: 57403 - RNA, 22 nt, Human
uucauucuauagaagaaaugca

SEQ ID NO: 57404 - RNA, 26 nt, Human
ccaguggagggagcaagaggagaggg

SEQ ID NO: 57405 - RNA, 29 nt, Human
cuccccgcaucccucuccucccucgcgcc

SEQ ID NO: 57406 - RNA, 23 nt, Human
cuauaaaauuaaggacaaaaaga

SEQ ID NO: 57407 - RNA, 25 nt, Human
gcgugagccugugugcuugugugcu

SEQ ID NO: 57408 - RNA, 20 nt, Human
cuuaagacaaauagcagcag

SEQ ID NO: 57409 - RNA, 22 nt, Human
uuucuauggagaccucagagcu

SEQ ID NO: 57410 - RNA, 23 nt, Human
cucccauugucuccaucagagcc

SEQ ID NO: 57411 - RNA, 26 nt, Human
aaaugggauugcuggacuuggcagcu

SEQ ID NO: 57412 - RNA, 22 nt, Human
ccucuuaacauggcacugagac

SEQ ID NO: 57413 - RNA, 26 nt, Human
ugagaauuggagguuagugccugaag

SEQ ID NO: 57414 - RNA, 22 nt, Human
aauagccccaagcagagaaaag

SEQ ID NO: 57415 - RNA, 22 nt, Human
agagagccagagacaguguugc

SEQ ID NO: 57416 - RNA, 26 nt, Human
agguccccgacugagccagggccacu

SEQ ID NO: 57417 - RNA, 24 nt, Human
cacagcugcuggagacuccuaggc

SEQ ID NO: 57418 - RNA, 19 nt, Human
ggccuggcugggugcagug

SEQ ID NO: 57419 - RNA, 22 nt, Human
gcuugcagaggccggcagcccu

SEQ ID NO: 57420 - RNA, 23 nt, Human
gaugggaugguggcuuaccucuu

SEQ ID NO: 57421 - RNA, 20 nt, Human
uauuuaaacugaauuuccag

SEQ ID NO: 57422 - RNA, 24 nt, Human
agcagugaccgugcuccuacccag

SEQ ID NO: 57423 - RNA, 21 nt, Human
gaccagcuguagcucauucca

SEQ ID NO: 57424 - RNA, 20 nt, Human
gucagcaaaugcauguuaag

SEQ ID NO: 57425 - RNA, 28 nt, Human
gcucuacagugcuuacugcagccuugug

SEQ ID NO: 57426 - RNA, 25 nt, Human
auuagugcuuugccagaggcugaug

SEQ ID NO: 57427 - RNA, 24 nt, Human
aaauguccuuugugggggagaacu

SEQ ID NO: 57428 - RNA, 22 nt, Human
gcgcggccuacacgcuuggggg

SEQ ID NO: 57429 - RNA, 26 nt, Human
ccaaacuuugccauugugcuccugca

SEQ ID NO: 57430 - RNA, 24 nt, Human
aagucaggaaaagucuuggcugga

SEQ ID NO: 57431 - RNA, 24 nt, Human
ucugcuaccucgagaagccauggc

SEQ ID NO: 57432 - RNA, 20 nt, Human
uaaucuuuuucuuuaccucc

SEQ ID NO: 57433 - RNA, 22 nt, Human
cccaaguagcuggaauuacagg

SEQ ID NO: 57434 - RNA, 22 nt, Human
cccaaauagcugggauuacagg

SEQ ID NO: 57435 - RNA, 22 nt, Human
uuuucucaaaggggcagaggaa

SEQ ID NO: 57436 - RNA, 25 nt, Human
aaucuucccaauguuugggauauua

SEQ ID NO: 57437 - RNA, 25 nt, Human
aggcacucaaccacuauuuguugaa

SEQ ID NO: 57438 - RNA, 27 nt, Human
uauuucuuuaauaagaacaauuccauc

SEQ ID NO: 57439 - RNA, 22 nt, Human
aaaaagcucaaugcauugucuu

SEQ ID NO: 57440 - RNA, 22 nt, Human
gccaaagccauuucuguacuaa

SEQ ID NO: 57441 - RNA, 22 nt, Human
gaacucaaacugaggaauuuca

SEQ ID NO: 57442 - RNA, 21 nt, Human
aguguucuauaaugauaugca

SEQ ID NO: 57443 - RNA, 23 nt, Human
aggcggugcaggcuguccuggcu

SEQ ID NO: 57444 - RNA, 20 nt, Human
uccacugcaagagucuggcu

SEQ ID NO: 57445 - RNA, 25 nt, Human
ucuguauuacuucaggcuugugggc

SEQ ID NO: 57446 - RNA, 20 nt, Human
aaagaauguuuugagaaugu

SEQ ID NO: 57447 - RNA, 25 nt, Human
cucuccuccccugcccccucccgcc

SEQ ID NO: 57448 - RNA, 20 nt, Human
cccuugcuucauccagcaca

SEQ ID NO: 57449 - RNA, 19 nt, Human
uguuuuauaaaauuuugcu

SEQ ID NO: 57450 - RNA, 19 nt, Human
ggccucccaaagcucucug

SEQ ID NO: 57451 - RNA, 22 nt, Human
aggcuggagugcaauggcagga

SEQ ID NO: 57452 - RNA, 25 nt, Human
cugccagaccugcauggucaagccu

SEQ ID NO: 57453 - RNA, 21 nt, Human
gcccucccuccugccugcgca

SEQ ID NO: 57454 - RNA, 22 nt, Human
cuuugcagaaucuucuugcuca

SEQ ID NO: 57455 - RNA, 20 nt, Human
gaagaggcuacagggccaaa

SEQ ID NO: 57456 - RNA, 21 nt, Human
gggaaagcugugccuuuuuua

SEQ ID NO: 57457 - RNA, 22 nt, Human
cugaacaaaggcuucacuuguc

SEQ ID NO: 57458 - RNA, 23 nt, Human
guggucaggaacuaggcaugcuu

SEQ ID NO: 57459 - RNA, 22 nt, Human
uccucaccccuccucugaccca

SEQ ID NO: 57460 - RNA, 25 nt, Human
ugacuuuguuuaugugucuaucccu

SEQ ID NO: 57461 - RNA, 28 nt, Human
gcugccuccguggucccugccuggcuga

SEQ ID NO: 57462 - RNA, 22 nt, Human
uacaaaugacucgaguugugga

SEQ ID NO: 57463 - RNA, 24 nt, Human
acagccugaaaauguacuaguguu

SEQ ID NO: 57464 - RNA, 22 nt, Human
ggaagguggggacagggaugag

SEQ ID NO: 57465 - RNA, 25 nt, Human
uggaagauuuuaaauaauuucuuua

SEQ ID NO: 57466 - RNA, 21 nt, Human
ggcucaccgcaaccucugccu

SEQ ID NO: 57467 - RNA, 24 nt, Human
cccagcucugggaccaagucacuu

SEQ ID NO: 57468 - RNA, 20 nt, Human
cuggcugucagacacuugcu

SEQ ID NO: 57469 - RNA, 26 nt, Human
cugauagacaacaagaagguauucca

SEQ ID NO: 57470 - RNA, 21 nt, Human
ccucuggcaaguagcuuucuc

SEQ ID NO: 57471 - RNA, 26 nt, Human
ccuuucucuuccuucaggaaaauacc

SEQ ID NO: 57472 - RNA, 22 nt, Human
uuggaaacacaucaaaauaaau

SEQ ID NO: 57473 - RNA, 24 nt, Human
gcugcugugcccagucugaguacc

SEQ ID NO: 57474 - RNA, 23 nt, Human
agaccagccugguaaaauaguga

SEQ ID NO: 57475 - RNA, 25 nt, Human
cucucuauuuguuucaccuucugua

SEQ ID NO: 57476 - RNA, 23 nt, Human
uggugagagaaagugaaaugaaa

SEQ ID NO: 57477 - RNA, 22 nt, Human
cacugcccuccagccuagguga

SEQ ID NO: 57478 - RNA, 27 nt, Human
gcacagcccuaguuuggcgccugcugc

SEQ ID NO: 57479 - RNA, 26 nt, Human
acacccuugggcuuaucuacagagca

SEQ ID NO: 57480 - RNA, 20 nt, Human
ggcccccagccccagccucu

SEQ ID NO: 57481 - RNA, 25 nt, Human
uagaaauuaccagaguuguucuguc

SEQ ID NO: 57482 - RNA, 30 nt, Human
ccaucgcucuuacccgguaaguaaacaguc

SEQ ID NO: 57483 - RNA, 21 nt, Human
aacuucuccccaucccaggag

SEQ ID NO: 57484 - RNA, 25 nt, Human
ugguggcaugcaccugcaaucccag

SEQ ID NO: 57485 - RNA, 25 nt, Human
aggcugaggcugaggggcagucacc

SEQ ID NO: 57486 - RNA, 21 nt, Human
gcaaccucugccuccugggcu

SEQ ID NO: 57487 - RNA, 22 nt, Human
ugugucaugccugcaaucccag

SEQ ID NO: 57488 - RNA, 27 nt, Human
caccaugagcuggaguggggaugacaa

SEQ ID NO: 57489 - RNA, 20 nt, Human
ggagccccuaucucaggaau

SEQ ID NO: 57490 - RNA, 26 nt, Human
caugccaccauggcuggcuaauuuuu

SEQ ID NO: 57491 - RNA, 21 nt, Human
gccgcuguggcuggagguagg

SEQ ID NO: 57492 - RNA, 29 nt, Human
agcuugcuugcuuucuuuuuuaaaaucaa

SEQ ID NO: 57493 - RNA, 27 nt, Human
ccaugaucuugagggacccaacauuug

SEQ ID NO: 57494 - RNA, 26 nt, Human
aacugauucugcagaaauaaugguua

SEQ ID NO: 57495 - RNA, 22 nt, Human
agagccaccauacaagguucau

SEQ ID NO: 57496 - RNA, 26 nt, Human
acacgguccuaagagcugggcaccag

SEQ ID NO: 57497 - RNA, 23 nt, Human
gacuuacuaugauucaagcaaua

SEQ ID NO: 57498 - RNA, 26 nt, Human
cacugcacccagccuagaaucuugua

SEQ ID NO: 57499 - RNA, 22 nt, Human
uggagaaagcugugcagaggaa

SEQ ID NO: 57500 - RNA, 27 nt, Human
aaguagcugggauuacaccaccaugcc

SEQ ID NO: 57501 - RNA, 27 nt, Human
gaacugcacuaccuucuguuguacuuu

SEQ ID NO: 57502 - RNA, 23 nt, Human
cagcuucuucuuuccucgcacag

SEQ ID NO: 57503 - RNA, 22 nt, Human
uucauuuuuauuuacuaagaaa

SEQ ID NO: 57504 - RNA, 24 nt, Human
cgaaaccaucuacuccacacaugc

SEQ ID NO: 57505 - RNA, 27 nt, Human
agcuaaaauguuacucccuguuuuagu

SEQ ID NO: 57506 - RNA, 22 nt, Human
uagaugggggaacugugaauac

SEQ ID NO: 57507 - RNA, 22 nt, Human
uuuguugcccaggcuggagugu

SEQ ID NO: 57508 - RNA, 22 nt, Human
uuugucgcccaggcuggagugc

SEQ ID NO: 57509 - RNA, 22 nt, Human
gccuguaaucccagcaguuugg

SEQ ID NO: 57510 - RNA, 25 nt, Human
cagacagaaucaccugaggcguuca

SEQ ID NO: 57511 - RNA, 20 nt, Human
cuugucuccuccuccaggag

SEQ ID NO: 57512 - RNA, 26 nt, Human
ucucagagucccaggaccuugagugu

SEQ ID NO: 57513 - RNA, 22 nt, Human
uggcucaugccuguaauuccag

SEQ ID NO: 57514 - RNA, 22 nt, Human
uggcucaugucuguaaucccag

SEQ ID NO: 57515 - RNA, 22 nt, Human
cacuggaaaaagagacugaaaa

SEQ ID NO: 57516 - RNA, 20 nt, Human
acuucagaaaggaacaggaa

SEQ ID NO: 57517 - RNA, 22 nt, Human
auuuacaaggguucauuuugga

SEQ ID NO: 57518 - RNA, 23 nt, Human
uaaaguauguugguggugaaagc

SEQ ID NO: 57519 - RNA, 19 nt, Human
cccaggcuugagugcagug

SEQ ID NO: 57520 - RNA, 22 nt, Human
gcacacaucuguggucccaggu

SEQ ID NO: 57521 - RNA, 19 nt, Human
aguguggggaaugggaaga

SEQ ID NO: 57522 - RNA, 23 nt, Human
cuucacugcagagccuugccuuu

SEQ ID NO: 57523 - RNA, 22 nt, Human
agcgggaagaaaaucagaggga

SEQ ID NO: 57524 - RNA, 21 nt, Human
gacuagguuuugcugucuaca

SEQ ID NO: 57525 - RNA, 22 nt, Human
cugcguguguccaagguggcuu

SEQ ID NO: 57526 - RNA, 23 nt, Human
ucagucugguacugaagucagga

SEQ ID NO: 57527 - RNA, 22 nt, Human
cagccuccauccuuagcuuugg

SEQ ID NO: 57528 - RNA, 20 nt, Human
uuuuccuuggggugcugaaa

SEQ ID NO: 57529 - RNA, 21 nt, Human
cacauacuuuccaucuaccuu

SEQ ID NO: 57530 - RNA, 21 nt, Human
aggaagagaagcccagcucug

SEQ ID NO: 57531 - RNA, 21 nt, Human
ugggccagaguccuuguggcc

SEQ ID NO: 57532 - RNA, 22 nt, Human
acccccagcugacuguuggcuc

SEQ ID NO: 57533 - RNA, 27 nt, Human
ggaagagaaaccagggagccccuuuga

SEQ ID NO: 57534 - RNA, 18 nt, Human
cugcagcuucuuguggcc

SEQ ID NO: 57535 - RNA, 18 nt, Human
guaugacgccacucugaa

SEQ ID NO: 57536 - RNA, 21 nt, Human
acaacucagggagagcuguau

SEQ ID NO: 57537 - RNA, 20 nt, Human
aggugucccggaaaggggcu

SEQ ID NO: 57538 - RNA, 27 nt, Human
ggacccuuccccuccaggggugcagug

SEQ ID NO: 57539 - RNA, 21 nt, Human
acagaugggggcugggcccac

SEQ ID NO: 57540 - RNA, 24 nt, Human
gccuccaaaguagcugggauuaca

SEQ ID NO: 57541 - RNA, 27 nt, Human
acuacaaccuccgccucccauguucaa

SEQ ID NO: 57542 - RNA, 22 nt, Human
cgcuguacuccaggcuugcuuc

SEQ ID NO: 57543 - RNA, 25 nt, Human
gcacuauauucuuguuuguuagucc

SEQ ID NO: 57544 - RNA, 27 nt, Human
gaagugacgagaccugucggccaugga

SEQ ID NO: 57545 - RNA, 23 nt, Human
cagugggccacuuucagucuuca

SEQ ID NO: 57546 - RNA, 19 nt, Human
cguuuacuaugccuguguc

SEQ ID NO: 57547 - RNA, 24 nt, Human
uguguguccaguuuacagcgucuc

SEQ ID NO: 57548 - RNA, 23 nt, Human
auggggugcccggguuccucucg

SEQ ID NO: 57549 - RNA, 21 nt, Human
ugccuggggugagaggucagu

SEQ ID NO: 57550 - RNA, 22 nt, Human
uuugaggccagaggugcuguca

SEQ ID NO: 57551 - RNA, 27 nt, Human
aaguggaagggacaggagcacauaggu

SEQ ID NO: 57552 - RNA, 29 nt, Human
ucucagugcuuuccuccuucacuguuuca

SEQ ID NO: 57553 - RNA, 23 nt, Human
aaacucauauauugggauuuuca

SEQ ID NO: 57554 - RNA, 23 nt, Human
cagggaugcaaagguugcaguga

SEQ ID NO: 57555 - RNA, 22 nt, Human
ucugguccucgcccauccugca

SEQ ID NO: 57556 - RNA, 26 nt, Human
agcuucuucagagaucaaguccucug

SEQ ID NO: 57557 - RNA, 18 nt, Human
acaacaaauguuucuucu

SEQ ID NO: 57558 - RNA, 21 nt, Human
uaucuauuaaguggaaagaag

SEQ ID NO: 57559 - RNA, 22 nt, Human
gcuccucccaacccaauucagg

SEQ ID NO: 57560 - RNA, 29 nt, Human
guguaaacuuggggauggcugagggaaca

SEQ ID NO: 57561 - RNA, 29 nt, Human
cugggaucgggcugaggccaggccucucc

SEQ ID NO: 57562 - RNA, 18 nt, Human
uuucauguuuuggccaaa

SEQ ID NO: 57563 - RNA, 22 nt, Human
cgccuguaauucuagcacuuug

SEQ ID NO: 57564 - RNA, 22 nt, Human
cgccuguaauccuagcaccuug

SEQ ID NO: 57565 - RNA, 26 nt, Human
gcugggacugcaggcaugagccauca

SEQ ID NO: 57566 - RNA, 21 nt, Human
ucugggguuuuuacuguuacc

SEQ ID NO: 57567 - RNA, 23 nt, Human
uauuugugcuauucacucccuuc

SEQ ID NO: 57568 - RNA, 23 nt, Human
ucgcuagaacccgggaggcggag

SEQ ID NO: 57569 - RNA, 21 nt, Human
gaaacuuaggcuggagacagg

SEQ ID NO: 57570 - RNA, 22 nt, Human
cacugcacuccagccuaggcaa

SEQ ID NO: 57571 - RNA, 26 nt, Human
ugcacacaggacucucauuacuuuuu

SEQ ID NO: 57572 - RNA, 21 nt, Human
ccuaccucaaaccccagcugg

SEQ ID NO: 57573 - RNA, 18 nt, Human
cuggcgccuucauccccc

SEQ ID NO: 57574 - RNA, 22 nt, Human
gccccuugguugacccugcacu

SEQ ID NO: 57575 - RNA, 22 nt, Human
ggaggcaagagggaggguacag

SEQ ID NO: 57576 - RNA, 25 nt, Human
auggacccaucugugacgcuguggc

SEQ ID NO: 57577 - RNA, 22 nt, Human
cuccgcacuggcgaaccgaggg

SEQ ID NO: 57578 - RNA, 18 nt, Human
ucucccuuacucuacuca

SEQ ID NO: 57579 - RNA, 21 nt, Human
ggcuuuccucaccaaaaaagg

SEQ ID NO: 57580 - RNA, 23 nt, Human
caccagccagcguagcagggucg

SEQ ID NO: 57581 - RNA, 23 nt, Human
uggcugcugucugccucagugac

SEQ ID NO: 57582 - RNA, 20 nt, Human
uccagacagugaaacaguca

SEQ ID NO: 57583 - RNA, 28 nt, Human
ugcuaugcugggcaggccuucucuuguc

SEQ ID NO: 57584 - RNA, 22 nt, Human
aaagugcugggauuaugggcgg

SEQ ID NO: 57585 - RNA, 22 nt, Human
gaaauguuggguuuccagagag

SEQ ID NO: 57586 - RNA, 26 nt, Human
cccugcuccucugcugguggugggcu

SEQ ID NO: 57587 - RNA, 22 nt, Human
uuucauggcuguuacugcccag

SEQ ID NO: 57588 - RNA, 23 nt, Human
gcacagcuccccuguccuccucc

SEQ ID NO: 57589 - RNA, 21 nt, Human
guccaucugguuuucucucca

SEQ ID NO: 57590 - RNA, 22 nt, Human
uuugugaaauuagcacuuuugg

SEQ ID NO: 57591 - RNA, 28 nt, Human
gacauggguggaaugauggcagaaucca

SEQ ID NO: 57592 - RNA, 26 nt, Human
aucauguuugcucucccgguucuucc

SEQ ID NO: 57593 - RNA, 26 nt, Human
agauaaauaaccauauaugucuggcu

SEQ ID NO: 57594 - RNA, 23 nt, Human
uuuacugugcuguuaacuuggaa

SEQ ID NO: 57595 - RNA, 20 nt, Human
ggaagaaaguucccugggga

SEQ ID NO: 57596 - RNA, 27 nt, Human
ugccaugucagcgcucuggugcugcag

SEQ ID NO: 57597 - RNA, 26 nt, Human
acuguguguugcagaaaacugccuuc

SEQ ID NO: 57598 - RNA, 26 nt, Human
aaugucccucaaguuuauggcagugu

SEQ ID NO: 57599 - RNA, 20 nt, Human
ggaaaugucuacaaaugucu

SEQ ID NO: 57600 - RNA, 27 nt, Human
gacuggguauuuuauaaggaaaagagg

SEQ ID NO: 57601 - RNA, 26 nt, Human
aggaagagaaaugggaucucaggacc

SEQ ID NO: 57602 - RNA, 22 nt, Human
gaaagguuaaaaaagcgaggug

SEQ ID NO: 57603 - RNA, 25 nt, Human
aagcuaagcaccagccucugcuggg

SEQ ID NO: 57604 - RNA, 22 nt, Human
ggacccucaguucccacacugc

SEQ ID NO: 57605 - RNA, 27 nt, Human
cccaaguagcuaggacuacagacaugu

SEQ ID NO: 57606 - RNA, 22 nt, Human
cugaggaaggaggaucgcuuga

SEQ ID NO: 57607 - RNA, 24 nt, Human
cagggaggacuacggugcucggga

SEQ ID NO: 57608 - RNA, 22 nt, Human
agcgauccuccuuccucauccu

SEQ ID NO: 57609 - RNA, 17 nt, Human
gcgcagcgcugcaguga

SEQ ID NO: 57610 - RNA, 19 nt, Human
cuuguucuguucugggcca

SEQ ID NO: 57611 - RNA, 22 nt, Human
ggcauuucucaaccaucucuca

SEQ ID NO: 57612 - RNA, 20 nt, Human
uuucuguuuaaaauauuuua

SEQ ID NO: 57613 - RNA, 23 nt, Human
aacaaauuaaaugucaagagagu

SEQ ID NO: 57614 - RNA, 28 nt, Human
cuaucucaccaguauuugcucucgacuc

SEQ ID NO: 57615 - RNA, 19 nt, Human
uuuaaaacauuuuaccuca

SEQ ID NO: 57616 - RNA, 25 nt, Human
cuuuccugugcacacaguccagccu

SEQ ID NO: 57617 - RNA, 21 nt, Human
uacacucagaauagccugcug

SEQ ID NO: 57618 - RNA, 26 nt, Human
aaccaaagacuuagcucaccugcauu

SEQ ID NO: 57619 - RNA, 22 nt, Human
uugcuggagaaguguauuucuu

SEQ ID NO: 57620 - RNA, 21 nt, Human
uuucaugucucuauauucauu

SEQ ID NO: 57621 - RNA, 24 nt, Human
cgcaagcuccagcugcagccuccg

SEQ ID NO: 57622 - RNA, 27 nt, Human
gcccuguaauuuaaccagucuuuaagg

SEQ ID NO: 57623 - RNA, 20 nt, Human
ggcuuuucugacacuccagg

SEQ ID NO: 57624 - RNA, 22 nt, Human
ccccugagaagauuugccuccu

SEQ ID NO: 57625 - RNA, 24 nt, Human
cuucacccucuuccuuccccagcc

SEQ ID NO: 57626 - RNA, 28 nt, Human
aggcccuucagccccaaggucagcaggg

SEQ ID NO: 57627 - RNA, 22 nt, Human
ugcuuguaauccuagcacuuuu

SEQ ID NO: 57628 - RNA, 31 nt, Human
uugcaaccaccaggcuggugcccugcagcug

SEQ ID NO: 57629 - RNA, 21 nt, Human
gcuggggucccagcagcugcc

SEQ ID NO: 57630 - RNA, 18 nt, Human
acaaaucucugcuuuauu

SEQ ID NO: 57631 - RNA, 26 nt, Human
gggcauucagccuccugcucuuaacu

SEQ ID NO: 57632 - RNA, 24 nt, Human
ccucauuccccauucuguguccca

SEQ ID NO: 57633 - RNA, 21 nt, Human
agggccuuauguggagcagag

SEQ ID NO: 57634 - RNA, 18 nt, Human
ucuucuuuugccuaaaau

SEQ ID NO: 57635 - RNA, 25 nt, Human
gugggguggaggcugcuggaggugg

SEQ ID NO: 57636 - RNA, 20 nt, Human
uccagaagaguuagaaaaau

SEQ ID NO: 57637 - RNA, 21 nt, Human
gguccuacccugucuggucau

SEQ ID NO: 57638 - RNA, 25 nt, Human
augccuuuggaugacccagcacuuu

SEQ ID NO: 57639 - RNA, 22 nt, Human
acacucuucccgugucuuccag

SEQ ID NO: 57640 - RNA, 25 nt, Human
uguaacuugaagguggcuacaaaga

SEQ ID NO: 57641 - RNA, 22 nt, Human
ucugaccgggcuuccucccucc

SEQ ID NO: 57642 - RNA, 22 nt, Human
gaagauuuuaaaaaccaaaaag

SEQ ID NO: 57643 - RNA, 18 nt, Human
uagauggggaagaaauac

SEQ ID NO: 57644 - RNA, 22 nt, Human
cuguggaaaccaggaagauaaa

SEQ ID NO: 57645 - RNA, 21 nt, Human
cgucauguguggaugaggaca

SEQ ID NO: 57646 - RNA, 20 nt, Human
uugaaaguguuguguuuaca

SEQ ID NO: 57647 - RNA, 23 nt, Human
uaauuuuucuacuuugaagauac

SEQ ID NO: 57648 - RNA, 23 nt, Human
auccugucuaucuucucaguuga

SEQ ID NO: 57649 - RNA, 24 nt, Human
cucucgcucucucucgcugcgucc

SEQ ID NO: 57650 - RNA, 27 nt, Human
gcuuagugccauuaugucauuuugauu

SEQ ID NO: 57651 - RNA, 22 nt, Human
uauuuucauuguuggcccacgg

SEQ ID NO: 57652 - RNA, 21 nt, Human
aggaagaguguuugcacagua

SEQ ID NO: 57653 - RNA, 24 nt, Human
ggcuagcaaucugccuguaucucu

SEQ ID NO: 57654 - RNA, 23 nt, Human
cuuccaucaugcugaauuuuguc

SEQ ID NO: 57655 - RNA, 27 nt, Human
cagaagggggccauggaagcugacacc

SEQ ID NO: 57656 - RNA, 19 nt, Human
caguaaaauaauuugguca

SEQ ID NO: 57657 - RNA, 20 nt, Human
guuggagcuguuccauuggg

SEQ ID NO: 57658 - RNA, 23 nt, Human
uuuugcagagaaacguguaccca

SEQ ID NO: 57659 - RNA, 20 nt, Human
ggcccggggaagcagagccc

SEQ ID NO: 57660 - RNA, 22 nt, Human
ucacugcaaccucugccuccua

SEQ ID NO: 57661 - RNA, 30 nt, Human
cacuccuagagacagcugugcucacuuuuc

SEQ ID NO: 57662 - RNA, 24 nt, Human
ucagccgaaggucucguggaacac

SEQ ID NO: 57663 - RNA, 21 nt, Human
cuggaaagcuuuguuaaggag

SEQ ID NO: 57664 - RNA, 23 nt, Human
gucgcccaggcuggagugcagca

SEQ ID NO: 57665 - RNA, 22 nt, Human
aaggcuggagugcagugacgcg

SEQ ID NO: 57666 - RNA, 22 nt, Human
ccgaguagcugggaccacaggc

SEQ ID NO: 57667 - RNA, 22 nt, Human
cugaguagcugggaccauaggc

SEQ ID NO: 57668 - RNA, 26 nt, Human
cugcaaauugaguuucuuucucuuua

SEQ ID NO: 57669 - RNA, 22 nt, Human
gaagggagaaagugucagugac

SEQ ID NO: 57670 - RNA, 24 nt, Human
ccacccgcuucgcuugcaucagcu

SEQ ID NO: 57671 - RNA, 19 nt, Human
ucccaaaacuucauauuuu

SEQ ID NO: 57672 - RNA, 22 nt, Human
gaacccaggaggcggaccuugu

SEQ ID NO: 57673 - RNA, 25 nt, Human
cacaucaaaaagagugaauguggua

SEQ ID NO: 57674 - RNA, 29 nt, Human
cgggcaggugguugcagcauugcagaaga

SEQ ID NO: 57675 - RNA, 27 nt, Human
gagacuugcugauuuucugguuggagu

SEQ ID NO: 57676 - RNA, 23 nt, Human
gggggauggucagagcccagucg

SEQ ID NO: 57677 - RNA, 22 nt, Human
uccugacucagacuuaacuggc

SEQ ID NO: 57678 - RNA, 21 nt, Human
aagaucaaaccucacaaagag

SEQ ID NO: 57679 - RNA, 24 nt, Human
agaaaugugcagcuggugcccgag

SEQ ID NO: 57680 - RNA, 21 nt, Human
gcacagccacuccccggcaug

SEQ ID NO: 57681 - RNA, 22 nt, Human
caggcagcagcgagugacagga

SEQ ID NO: 57682 - RNA, 27 nt, Human
cacaaugauuccuucuuuucuaggcaa

SEQ ID NO: 57683 - RNA, 23 nt, Human
uucaguuauuucuguaguuugua

SEQ ID NO: 57684 - RNA, 23 nt, Human
agcaagaagccagaacuguugga

SEQ ID NO: 57685 - RNA, 23 nt, Human
gacucaggcuggggucugcagug

SEQ ID NO: 57686 - RNA, 25 nt, Human
agaaaugugcaguuugcagauagaa

SEQ ID NO: 57687 - RNA, 27 nt, Human
ugccuguaaagucuccucuaauauuua

SEQ ID NO: 57688 - RNA, 22 nt, Human
aaaauuaccauugcuuccucca

SEQ ID NO: 57689 - RNA, 21 nt, Human
cgucugguugucgucugucau

SEQ ID NO: 57690 - RNA, 24 nt, Human
ucucucucuucauucuauucuuuu

SEQ ID NO: 57691 - RNA, 19 nt, Human
gugucuggagacguuucuu

SEQ ID NO: 57692 - RNA, 26 nt, Human
accacauucccaacuagaaaaaucuu

SEQ ID NO: 57693 - RNA, 18 nt, Human
ugucugcugaagcccgcu

SEQ ID NO: 57694 - RNA, 24 nt, Human
uagugcugagccuuggcugggcca

SEQ ID NO: 57695 - RNA, 27 nt, Human
auccauucuauuuuuaacuuccauauc

SEQ ID NO: 57696 - RNA, 27 nt, Human
ccacgugccccggaagcaggugugucc

SEQ ID NO: 57697 - RNA, 24 nt, Human
cuucuucaggacuaguuaaccaga

SEQ ID NO: 57698 - RNA, 24 nt, Human
gcagugugcccugcugugucuugg

SEQ ID NO: 57699 - RNA, 26 nt, Human
gcuguugcuuuggaucugaucuauau

SEQ ID NO: 57700 - RNA, 21 nt, Human
cggcggcggaggcugccaugg

SEQ ID NO: 57701 - RNA, 22 nt, Human
gccuucuccccuccauccagcc

SEQ ID NO: 57702 - RNA, 21 nt, Human
guucuguuccuccuccucaug

SEQ ID NO: 57703 - RNA, 20 nt, Human
accuauccauaugcaucaga

SEQ ID NO: 57704 - RNA, 18 nt, Human
uacuucaauugugccucu

SEQ ID NO: 57705 - RNA, 25 nt, Human
acggaggagugaggagcccaggaac

SEQ ID NO: 57706 - RNA, 25 nt, Human
guugcccaggcuggucucgaacuuc

SEQ ID NO: 57707 - RNA, 23 nt, Human
uuggccucgauuuagaacagggu

SEQ ID NO: 57708 - RNA, 24 nt, Human
cugccggcccugcgccugcccagc

SEQ ID NO: 57709 - RNA, 22 nt, Human
ccccugagaagccauuccuuug

SEQ ID NO: 57710 - RNA, 22 nt, Human
gauaauucuuacuguucugaaa

SEQ ID NO: 57711 - RNA, 24 nt, Human
ucuguucuggucaucuggaugcug

SEQ ID NO: 57712 - RNA, 22 nt, Human
ugaggcaaaggcugggccaggc

SEQ ID NO: 57713 - RNA, 16 nt, Human
ucuccacccuccggcc

SEQ ID NO: 57714 - RNA, 21 nt, Human
gaggcaaagaagaauucuucc

SEQ ID NO: 57715 - RNA, 22 nt, Human
gccaccacaucacaugaccuua

SEQ ID NO: 57716 - RNA, 17 nt, Human
ggacccagcagaaagca

SEQ ID NO: 57717 - RNA, 24 nt, Human
guuuuuaaaguaaaucucuuuuua

SEQ ID NO: 57718 - RNA, 24 nt, Human
caauuccauuucuuucugguuauu

SEQ ID NO: 57719 - RNA, 21 nt, Human
ucugcccugcgggucacagga

SEQ ID NO: 57720 - RNA, 20 nt, Human
uaaaagcaagaaaccacagu

SEQ ID NO: 57721 - RNA, 20 nt, Human
ccauauugugaaaccggccu

SEQ ID NO: 57722 - RNA, 22 nt, Human
gaauguaaugucuuggaacuug

SEQ ID NO: 57723 - RNA, 22 nt, Human
cuggucccugcacccagggacc

SEQ ID NO: 57724 - RNA, 23 nt, Human
ccuuucugggucccuccugguuc

SEQ ID NO: 57725 - RNA, 21 nt, Human
aaccuagagaagcagaauccu

SEQ ID NO: 57726 - RNA, 24 nt, Human
ugaaaucagguggcuucugccacc

SEQ ID NO: 57727 - RNA, 23 nt, Human
ucuuuguaucucacacagugccu

SEQ ID NO: 57728 - RNA, 22 nt, Human
cagcucuucuccguggagcucg

SEQ ID NO: 57729 - RNA, 28 nt, Human
gauugaucacuuuguuaaaaauauuuuc

SEQ ID NO: 57730 - RNA, 26 nt, Human
aaucagcucugacacuuguuuagacg

SEQ ID NO: 57731 - RNA, 25 nt, Human
agcgagcagcaccuggaucuugccu

SEQ ID NO: 57732 - RNA, 20 nt, Human
cacggggucugcagcaauga

SEQ ID NO: 57733 - RNA, 26 nt, Human
guucucuugcucuucuguauuuuccu

SEQ ID NO: 57734 - RNA, 23 nt, Human
uuugcccagggagaggcugcggc

SEQ ID NO: 57735 - RNA, 20 nt, Human
uccucuguugcccaggcugg

SEQ ID NO: 57736 - RNA, 25 nt, Human
ugguagcaggcaccuguagucuuag

SEQ ID NO: 57737 - RNA, 24 nt, Human
ucugcugcuucuguccaccuuaau

SEQ ID NO: 57738 - RNA, 26 nt, Human
acuccucugcgugagugcguguguac

SEQ ID NO: 57739 - RNA, 22 nt, Human
ugcagauacuuauuaagagcaa

SEQ ID NO: 57740 - RNA, 21 nt, Human
ccauaauuucucccagagacc

SEQ ID NO: 57741 - RNA, 22 nt, Human
uauucaaagaaaagcuaaagca

SEQ ID NO: 57742 - RNA, 20 nt, Human
gaugccuggccuuaggcugu

SEQ ID NO: 57743 - RNA, 24 nt, Human
gcuggaggcugagugaaagucauu

SEQ ID NO: 57744 - RNA, 20 nt, Human
ggccuagaccuggugcugag

SEQ ID NO: 57745 - RNA, 27 nt, Human
cucuggccaacaacuuuguucucaucg

SEQ ID NO: 57746 - RNA, 24 nt, Human
ccuuucucccccuaaacuuuggcc

SEQ ID NO: 57747 - RNA, 23 nt, Human
cuaguagcugggauuacaggcau

SEQ ID NO: 57748 - RNA, 27 nt, Human
caggucagcugcccuggccuugcaccc

SEQ ID NO: 57749 - RNA, 18 nt, Human
cugcugcccaggcugugc

SEQ ID NO: 57750 - RNA, 22 nt, Human
guaguguccccagccuaccucu

SEQ ID NO: 57751 - RNA, 27 nt, Human
aguaggacaaggugcaggcaggcuggc

SEQ ID NO: 57752 - RNA, 23 nt, Human
ggcaccucacucccucagcucuu

SEQ ID NO: 57753 - RNA, 21 nt, Human
uuaaguuucuuuuucucaucu

SEQ ID NO: 57754 - RNA, 16 nt, Human
cucuccucccucagcc

SEQ ID NO: 57755 - RNA, 22 nt, Human
ccuccgccccuccucucuccca

SEQ ID NO: 57756 - RNA, 30 nt, Human
cuggggucuucugacugcaggggaaggaug

SEQ ID NO: 57757 - RNA, 20 nt, Human
agggaaaggaagcagggcag

SEQ ID NO: 57758 - RNA, 27 nt, Human
gucaaacccauuucacugacaggagag

SEQ ID NO: 57759 - RNA, 25 nt, Human
accuggcuucucaguucuuugguug

SEQ ID NO: 57760 - RNA, 21 nt, Human
gcugucccugagggccugugu

SEQ ID NO: 57761 - RNA, 20 nt, Human
gguccaccccggaaucccag

SEQ ID NO: 57762 - RNA, 27 nt, Human
uccuccagccaugaggcugcucugggg

SEQ ID NO: 57763 - RNA, 28 nt, Human
auugcaacaggcugggcuucaguggcag

SEQ ID NO: 57764 - RNA, 25 nt, Human
cuucucaauuuucuuccuucucugc

SEQ ID NO: 57765 - RNA, 22 nt, Human
ccacggcacuucagccugggug

SEQ ID NO: 57766 - RNA, 22 nt, Human
gccuggcuccccucuucguucc

SEQ ID NO: 57767 - RNA, 21 nt, Human
agcuagcagccgccuacuugg

SEQ ID NO: 57768 - RNA, 20 nt, Human
gcuugggugaggaagggggc

SEQ ID NO: 57769 - RNA, 27 nt, Human
auaaacugaagagucucaguauggcua

SEQ ID NO: 57770 - RNA, 24 nt, Human
gcucagacuuuuguuauacacauu

SEQ ID NO: 57771 - RNA, 23 nt, Human
uccucaaggaggugaaggucaug

SEQ ID NO: 57772 - RNA, 22 nt, Human
cauccauucucauauguauucu

SEQ ID NO: 57773 - RNA, 25 nt, Human
ggagguuucuuuggucuucuauucc

SEQ ID NO: 57774 - RNA, 27 nt, Human
uccagauggacugugagcacagccuga

SEQ ID NO: 57775 - RNA, 20 nt, Human
aaguacuggcucuuuauuca

SEQ ID NO: 57776 - RNA, 23 nt, Human
uccgaugccaaggaguccuggcc

SEQ ID NO: 57777 - RNA, 22 nt, Human
gugggaggggcccacaggaagc

SEQ ID NO: 57778 - RNA, 23 nt, Human
uaccaucugcuguggaaugcagg

SEQ ID NO: 57779 - RNA, 24 nt, Human
agguagagggaggacacagagccg

SEQ ID NO: 57780 - RNA, 27 nt, Human
ccuugccccugcccucccacgaauggu

SEQ ID NO: 57781 - RNA, 20 nt, Human
caacgcaagcugguuuuaua

SEQ ID NO: 57782 - RNA, 28 nt, Human
gggcucgagccaucucugcucccgccag

SEQ ID NO: 57783 - RNA, 32 nt, Human
ggggaggaggcggagagcaauguguuacagau

SEQ ID NO: 57784 - RNA, 20 nt, Human
uaagccauaugacaauuuca

SEQ ID NO: 57785 - RNA, 25 nt, Human
gccaugcucacuggccaauaaagag

SEQ ID NO: 57786 - RNA, 23 nt, Human
acauuuauacaucaccuuuuuga

SEQ ID NO: 57787 - RNA, 26 nt, Human
aggccacauuuucaccauuacuuaag

SEQ ID NO: 57788 - RNA, 27 nt, Human
ccaggaggcagcagggucuggucauaa

SEQ ID NO: 57789 - RNA, 22 nt, Human
guugcccaggcaagagugcagu

SEQ ID NO: 57790 - RNA, 27 nt, Human
cagcucuucccagugauguugagagca

SEQ ID NO: 57791 - RNA, 24 nt, Human
agaccugaauaauucuguguaaua

SEQ ID NO: 57792 - RNA, 23 nt, Human
gggacuccuggguccccggcagu

SEQ ID NO: 57793 - RNA, 25 nt, Human
ugaguauuugcaauaaacuaugaua

SEQ ID NO: 57794 - RNA, 24 nt, Human
cuguugaccaggcuggagugcagu

SEQ ID NO: 57795 - RNA, 19 nt, Human
ccucucugcaccugcucaa

SEQ ID NO: 57796 - RNA, 19 nt, Human
caggcagcaguuguaguua

SEQ ID NO: 57797 - RNA, 27 nt, Human
cuucuauguuuauucuauucauuuguu

SEQ ID NO: 57798 - RNA, 22 nt, Human
gaacauuccuucuuuacugguc

SEQ ID NO: 57799 - RNA, 27 nt, Human
ccaggcugacauuuccucaaucuuuau

SEQ ID NO: 57800 - RNA, 20 nt, Human
uacuacccucucagucacca

SEQ ID NO: 57801 - RNA, 26 nt, Human
ugccucuguccugccugguguggagg

SEQ ID NO: 57802 - RNA, 23 nt, Human
aguugaaugauaauagcucacag

SEQ ID NO: 57803 - RNA, 24 nt, Human
ugggcagggccacagcagagagac

SEQ ID NO: 57804 - RNA, 22 nt, Human
cuccgcaauggcacaugcuucc

SEQ ID NO: 57805 - RNA, 19 nt, Human
ccaggcugaacugaggcag

SEQ ID NO: 57806 - RNA, 25 nt, Human
ucugggaaggggcauuugagcuggg

SEQ ID NO: 57807 - RNA, 27 nt, Human
uugcccaggcuggucucgaacuucuga

SEQ ID NO: 57808 - RNA, 19 nt, Human
gaccccuggcaaacugggc

SEQ ID NO: 57809 - RNA, 22 nt, Human
agcaucuucagcacuuaccgau

SEQ ID NO: 57810 - RNA, 23 nt, Human
uggaauguggaaauggaaaagga

SEQ ID NO: 57811 - RNA, 21 nt, Human
gggaucuguggucaaaggaca

SEQ ID NO: 57812 - RNA, 22 nt, Human
acugcagccucauacuccuggg

SEQ ID NO: 57813 - RNA, 27 nt, Human
agauucacacagaagucuggacacaau

SEQ ID NO: 57814 - RNA, 22 nt, Human
cuccucacugggagccuguggg

SEQ ID NO: 57815 - RNA, 25 nt, Human
guggggaggggaacugguauccugc

SEQ ID NO: 57816 - RNA, 24 nt, Human
ggaagcaucugucuugucauucca

SEQ ID NO: 57817 - RNA, 21 nt, Human
cccagcaugacuuuccuuagg

SEQ ID NO: 57818 - RNA, 25 nt, Human
acacaaauguuccacaaggcgggag

SEQ ID NO: 57819 - RNA, 22 nt, Human
ccuccacuccagaguugggugg

SEQ ID NO: 57820 - RNA, 23 nt, Human
aggguggaagaggagagggugga

SEQ ID NO: 57821 - RNA, 23 nt, Human
ccacggccacaggcaaggggguu

SEQ ID NO: 57822 - RNA, 26 nt, Human
gcaggaaaaaugcagcuuucaaauca

SEQ ID NO: 57823 - RNA, 20 nt, Human
ugcacaccacuacucacccu

SEQ ID NO: 57824 - RNA, 20 nt, Human
ggaacgggcuuucuuuucag

SEQ ID NO: 57825 - RNA, 20 nt, Human
aggagcugggggugcagugg

SEQ ID NO: 57826 - RNA, 22 nt, Human
ugggacuacaauugugagccac

SEQ ID NO: 57827 - RNA, 27 nt, Human
cucaucuggaagaccaccacucugggg

SEQ ID NO: 57828 - RNA, 22 nt, Human
cuccaccugggggccccuggac

SEQ ID NO: 57829 - RNA, 26 nt, Human
accacugcauucugaccugcuguaca

SEQ ID NO: 57830 - RNA, 21 nt, Human
uguggaggcuuccaccaggag

SEQ ID NO: 57831 - RNA, 20 nt, Human
ucgguggaaagagcagaaca

SEQ ID NO: 57832 - RNA, 21 nt, Human
caggaggcggaccuuguagug

SEQ ID NO: 57833 - RNA, 21 nt, Human
ggcauggcgggauccuccaca

SEQ ID NO: 57834 - RNA, 22 nt, Human
gucuccuaagcuggagugcagu

SEQ ID NO: 57835 - RNA, 22 nt, Human
aauguuuugaugaauacaaugu

SEQ ID NO: 57836 - RNA, 20 nt, Human
agcuguguccuugcaccugc

SEQ ID NO: 57837 - RNA, 21 nt, Human
ggucauuuuauguuaagggaa

SEQ ID NO: 57838 - RNA, 23 nt, Human
gcuccuccccgcgugccuucgcc

SEQ ID NO: 57839 - RNA, 18 nt, Human
ugucuuggagugcauuug

SEQ ID NO: 57840 - RNA, 25 nt, Human
cugccucaccgcuucccuccugccc

SEQ ID NO: 57841 - RNA, 25 nt, Human
ggcacacgcaggcauccauccaucc

SEQ ID NO: 57842 - RNA, 21 nt, Human
acgccuguaauccagcacuuu

SEQ ID NO: 57843 - RNA, 22 nt, Human
cccucgauugguuaacuccuua

SEQ ID NO: 57844 - RNA, 26 nt, Human
ccgcaaccacucccaccccagggagg

SEQ ID NO: 57845 - RNA, 23 nt, Human
gcauuccucaaaaagaccaucag

SEQ ID NO: 57846 - RNA, 24 nt, Human
gcuggcccugaugaccuguccuua

SEQ ID NO: 57847 - RNA, 27 nt, Human
cucauuucuuugucuuuuuccuacucc

SEQ ID NO: 57848 - RNA, 27 nt, Human
cugggcccuggcucggucgcacacuca

SEQ ID NO: 57849 - RNA, 23 nt, Human
ugcuuuauuuggggaauucaggg

SEQ ID NO: 57850 - RNA, 21 nt, Human
accucaaacuccuggacucau

SEQ ID NO: 57851 - RNA, 26 nt, Human
cacuccucgcacuuccagccuuggag

SEQ ID NO: 57852 - RNA, 21 nt, Human
accccuggcccaccucuccaa

SEQ ID NO: 57853 - RNA, 26 nt, Human
cugcagcugcugugaccccugcagcc

SEQ ID NO: 57854 - RNA, 22 nt, Human
cuagaagaaaguaaaaagaaca

SEQ ID NO: 57855 - RNA, 27 nt, Human
gugaggguggcuuugucuaagaugccu

SEQ ID NO: 57856 - RNA, 26 nt, Human
uacccaggcuuugcagaccacgcggg

SEQ ID NO: 57857 - RNA, 21 nt, Human
acuccugagugucccgcucuc

SEQ ID NO: 57858 - RNA, 27 nt, Human
cuggccucagacugcacccaggagggg

SEQ ID NO: 57859 - RNA, 23 nt, Human
cgccacauccccgcuggcugggg

SEQ ID NO: 57860 - RNA, 28 nt, Human
gacccaaagcucucuccccacccuaccu

SEQ ID NO: 57861 - RNA, 21 nt, Human
cuccucacuguucucagaggg

SEQ ID NO: 57862 - RNA, 19 nt, Human
agcaucauauauuaguuca

SEQ ID NO: 57863 - RNA, 22 nt, Human
ucuguucagagcugacccccua

SEQ ID NO: 57864 - RNA, 17 nt, Human
ccugccugcagccugca

SEQ ID NO: 57865 - RNA, 31 nt, Human
caaaugcuuuuuuauuucuguaaguucaaau

SEQ ID NO: 57866 - RNA, 21 nt, Human
auuuccucuccacugcuggac

SEQ ID NO: 57867 - RNA, 21 nt, Human
ggucuggacugaauugcccaa

SEQ ID NO: 57868 - RNA, 21 nt, Human
acugacugcuuacucuaccuu

SEQ ID NO: 57869 - RNA, 21 nt, Human
uucccauucuaauuaaugccc

SEQ ID NO: 57870 - RNA, 20 nt, Human
gucucuauuuuuucacuuua

SEQ ID NO: 57871 - RNA, 27 nt, Human
uguuaaaaugugaaauuguaauuuuua

SEQ ID NO: 57872 - RNA, 20 nt, Human
uggccaaacaaccggcuaca

SEQ ID NO: 57873 - RNA, 27 nt, Human
aacacaaaaugcagcuuccugaugcuu

SEQ ID NO: 57874 - RNA, 22 nt, Human
cgucacugcacuccaaccuggg

SEQ ID NO: 57875 - RNA, 23 nt, Human
cucagcuuaucuaaaccuaauga

SEQ ID NO: 57876 - RNA, 25 nt, Human
ucuguaaaugucagugucugaacag

SEQ ID NO: 57877 - RNA, 27 nt, Human
gccucucuuguacaggcugagaggcug

SEQ ID NO: 57878 - RNA, 22 nt, Human
agugcaauaauccuuccucaga

SEQ ID NO: 57879 - RNA, 20 nt, Human
uccgacacuccugggucaga

SEQ ID NO: 57880 - RNA, 22 nt, Human
gaaagguugagaaaggaauggu

SEQ ID NO: 57881 - RNA, 20 nt, Human
ccuguggcugggaugacugc

SEQ ID NO: 57882 - RNA, 22 nt, Human
uucacagugacuaccauuucca

SEQ ID NO: 57883 - RNA, 21 nt, Human
aaaaggcaguccuggaaucac

SEQ ID NO: 57884 - RNA, 26 nt, Human
cugccucugucgcccaggcuggagug

SEQ ID NO: 57885 - RNA, 28 nt, Human
cuguggcggguuucuuccuggggaacac

SEQ ID NO: 57886 - RNA, 24 nt, Human
ugaagaggagacuugaguguugcu

SEQ ID NO: 57887 - RNA, 23 nt, Human
aggaaggcuagaguuacccagag

SEQ ID NO: 57888 - RNA, 19 nt, Human
auacuugcaacucuuuuug

SEQ ID NO: 57889 - RNA, 24 nt, Human
ugcauguguaaugguuuaugucaa

SEQ ID NO: 57890 - RNA, 22 nt, Human
augguuuaggauuaaagccagg

SEQ ID NO: 57891 - RNA, 20 nt, Human
uuaaagccucuucauccagg

SEQ ID NO: 57892 - RNA, 27 nt, Human
gcuggggcugagagagaccacagcccu

SEQ ID NO: 57893 - RNA, 22 nt, Human
acucaaccucccucugaccuca

SEQ ID NO: 57894 - RNA, 21 nt, Human
ccaguuuuauaaacagcagau

SEQ ID NO: 57895 - RNA, 27 nt, Human
ucuguaacccaguagcugugacguucc

SEQ ID NO: 57896 - RNA, 22 nt, Human
guagacauuucucuuacugcaa

SEQ ID NO: 57897 - RNA, 26 nt, Human
cucuuuugggccacagacaucauugc

SEQ ID NO: 57898 - RNA, 22 nt, Human
cuucgucucaaaauaaauaaau

SEQ ID NO: 57899 - RNA, 20 nt, Human
gaaagagaagaaagaaguga

SEQ ID NO: 57900 - RNA, 26 nt, Human
acaaaacaaaacaaaauuaacugcuu

SEQ ID NO: 57901 - RNA, 20 nt, Human
cuugaaacauguuacuuccu

SEQ ID NO: 57902 - RNA, 22 nt, Human
cccaaaguguuaggauuacagg

SEQ ID NO: 57903 - RNA, 24 nt, Human
cccuaauuuuaaaacaaaagaaca

SEQ ID NO: 57904 - RNA, 22 nt, Human
gcucacugcagccucgaccucc

SEQ ID NO: 57905 - RNA, 23 nt, Human
cuuugcagaguggucccugcccu

SEQ ID NO: 57906 - RNA, 24 nt, Human
ucacccaaauagcugagugcaguc

SEQ ID NO: 57907 - RNA, 16 nt, Human
uuugccucaccccugc

SEQ ID NO: 57908 - RNA, 18 nt, Human
gauccagcagcacugggg

SEQ ID NO: 57909 - RNA, 25 nt, Human
aagagggacuguauuucuguggaaa

SEQ ID NO: 57910 - RNA, 23 nt, Human
uugccuucaggcuggaugaggaa

SEQ ID NO: 57911 - RNA, 21 nt, Human
gucaugucucugguggugcug

SEQ ID NO: 57912 - RNA, 23 nt, Human
ggcggacuggagcugaaaguguu

SEQ ID NO: 57913 - RNA, 23 nt, Human
uccaccuggccuuccuguucuuc

SEQ ID NO: 57914 - RNA, 24 nt, Human
ccuccugccaaggcucuugucccc

SEQ ID NO: 57915 - RNA, 21 nt, Human
agggcgccugagccuaggcgg

SEQ ID NO: 57916 - RNA, 19 nt, Human
aaaagacaaaccagaugua

SEQ ID NO: 57917 - RNA, 21 nt, Human
acccugcacguugugcacuga

SEQ ID NO: 57918 - RNA, 18 nt, Human
accaacauaaaacaaaac

SEQ ID NO: 57919 - RNA, 23 nt, Human
aaauguucauuuuauuuggugcc

SEQ ID NO: 57920 - RNA, 20 nt, Human
cagaggcagagauuggagug

SEQ ID NO: 57921 - RNA, 22 nt, Human
ggacccauaauccuuucugccg

SEQ ID NO: 57922 - RNA, 18 nt, Human
uuuuccucuagugcucaa

SEQ ID NO: 57923 - RNA, 27 nt, Human
gaccacaccucuucuucccaagguccc

SEQ ID NO: 57924 - RNA, 24 nt, Human
guccuggaugaugguccauaagaa

SEQ ID NO: 57925 - RNA, 23 nt, Human
aggcuggagugaaguggugugau

SEQ ID NO: 57926 - RNA, 23 nt, Human
aggcuggagcauaguggcaagau

SEQ ID NO: 57927 - RNA, 21 nt, Human
uuuuaucacaccugcucccca

SEQ ID NO: 57928 - RNA, 26 nt, Human
uugcccaggguguguuugcugagugu

SEQ ID NO: 57929 - RNA, 24 nt, Human
acacugccaccaucucaaagccau

SEQ ID NO: 57930 - RNA, 22 nt, Human
uuccucuggugcaaccagcaag

SEQ ID NO: 57931 - RNA, 25 nt, Human
caccacugagcuuuuccucauaaca

SEQ ID NO: 57932 - RNA, 26 nt, Human
gggaaaggaaaagaacacuagcuaag

SEQ ID NO: 57933 - RNA, 26 nt, Human
uaccuugccuuaggccuucuaaucau

SEQ ID NO: 57934 - RNA, 19 nt, Human
uucaagagauucugccuca

SEQ ID NO: 57935 - RNA, 23 nt, Human
ccagagaauauucauuauacuuc

SEQ ID NO: 57936 - RNA, 27 nt, Human
gcuccuucugaauacacaaaagaguuc

SEQ ID NO: 57937 - RNA, 27 nt, Human
cauugcacuccagccugggcaacacag

SEQ ID NO: 57938 - RNA, 22 nt, Human
cugguuuccccuccuuccuccc

SEQ ID NO: 57939 - RNA, 20 nt, Human
uuucucucugggccuguauc

SEQ ID NO: 57940 - RNA, 20 nt, Human
gcccacuucccuagacugga

SEQ ID NO: 57941 - RNA, 21 nt, Human
aaacagaagagaggcugccgg

SEQ ID NO: 57942 - RNA, 27 nt, Human
acacggacgugugauacacacaugcau

SEQ ID NO: 57943 - RNA, 25 nt, Human
agaaaacugccuacauacugguuug

SEQ ID NO: 57944 - RNA, 21 nt, Human
acuccaucuaacucguuuuca

SEQ ID NO: 57945 - RNA, 21 nt, Human
ugcaagugccuuccugagcag

SEQ ID NO: 57946 - RNA, 19 nt, Human
caagucccaaaaacuaagg

SEQ ID NO: 57947 - RNA, 26 nt, Human
aggcugagacaggaggaucgguugag

SEQ ID NO: 57948 - RNA, 22 nt, Human
ucuaccucuggggcaccacgga

SEQ ID NO: 57949 - RNA, 19 nt, Human
cugcgugauuuugggggug

SEQ ID NO: 57950 - RNA, 21 nt, Human
ccagaagucccuucaauuucu

SEQ ID NO: 57951 - RNA, 23 nt, Human
uaauuaguuuuaucuguuccaug

SEQ ID NO: 57952 - RNA, 20 nt, Human
agcucacugccuacuugcug

SEQ ID NO: 57953 - RNA, 23 nt, Human
cuaaugccaccucaguuuguuuc

SEQ ID NO: 57954 - RNA, 23 nt, Human
uaaaugcucaucugguaacucaa

SEQ ID NO: 57955 - RNA, 21 nt, Human
guguuucuccucccccuugcu

SEQ ID NO: 57956 - RNA, 22 nt, Human
agcucacugcaagcucuaccuc

SEQ ID NO: 57957 - RNA, 24 nt, Human
acauuuauaauuccaacauugugg

SEQ ID NO: 57958 - RNA, 27 nt, Human
gugagccagagcuggagcacguuuggu

SEQ ID NO: 57959 - RNA, 22 nt, Human
gaaugguggagggaggcagugg

SEQ ID NO: 57960 - RNA, 22 nt, Human
ggggcagccugugccugccuuu

SEQ ID NO: 57961 - RNA, 22 nt, Human
ugucuccccggcuggagugcag

SEQ ID NO: 57962 - RNA, 28 nt, Human
cagggggcgaagugcaguggcucaugcc

SEQ ID NO: 57963 - RNA, 26 nt, Human
ggcugaagggcuaucucuggcaccuc

SEQ ID NO: 57964 - RNA, 29 nt, Human
gccugucacugcagcugccccugcccugu

SEQ ID NO: 57965 - RNA, 22 nt, Human
gcugcaacccuggugugcuggg

SEQ ID NO: 57966 - RNA, 20 nt, Human
cucuuauguucaagcaauuc

SEQ ID NO: 57967 - RNA, 21 nt, Human
gugccuggcccuuggcuuuag

SEQ ID NO: 57968 - RNA, 23 nt, Human
cgccuccagcgcccccgccuucu

SEQ ID NO: 57969 - RNA, 21 nt, Human
ccggaauaaagagaauuugua

SEQ ID NO: 57970 - RNA, 27 nt, Human
ccccacccccucaaucugucggggagc

SEQ ID NO: 57971 - RNA, 23 nt, Human
gaccucgugauccgcccaccucg

SEQ ID NO: 57972 - RNA, 25 nt, Human
ugguagugggugccuguaaucccag

SEQ ID NO: 57973 - RNA, 31 nt, Human
uccuuaggaagcacuuacaccaccugggaac

SEQ ID NO: 57974 - RNA, 27 nt, Human
ggcaggaaaggguggccuucuugggua

SEQ ID NO: 57975 - RNA, 22 nt, Human
cccagauccuaaaugcuaguuc

SEQ ID NO: 57976 - RNA, 24 nt, Human
ucacuguuguaucuugaauaaacg

SEQ ID NO: 57977 - RNA, 25 nt, Human
gucacccaggcugggaauugcagug

SEQ ID NO: 57978 - RNA, 20 nt, Human
aaaauacaaaaauuaguugg

SEQ ID NO: 57979 - RNA, 21 nt, Human
cacugcuggcagccugggcaa

SEQ ID NO: 57980 - RNA, 23 nt, Human
ucuuuuccacuuucuccuucagg

SEQ ID NO: 57981 - RNA, 21 nt, Human
gaacugcagcuuucgcugcug

SEQ ID NO: 57982 - RNA, 24 nt, Human
gacucgaguuguggauugcaagaa

SEQ ID NO: 57983 - RNA, 22 nt, Human
agcugucuuagaaaugacuuca

SEQ ID NO: 57984 - RNA, 24 nt, Human
guauuaaguaacuaagugccaaau

SEQ ID NO: 57985 - RNA, 25 nt, Human
gcaugcagcacccccgggccugucc

SEQ ID NO: 57986 - RNA, 25 nt, Human
caaaacaauaaggcacuugugggug

SEQ ID NO: 57987 - RNA, 26 nt, Human
ggacuccggaggcagccugggugggu

SEQ ID NO: 57988 - RNA, 21 nt, Human
uuggguugguuccaagucuuu

SEQ ID NO: 57989 - RNA, 24 nt, Human
ccauagaaaacaaucugcccaccg

SEQ ID NO: 57990 - RNA, 27 nt, Human
ggagagggaacggaaauaaaggaguua

SEQ ID NO: 57991 - RNA, 22 nt, Human
ugcugcccugaucucaguggga

SEQ ID NO: 57992 - RNA, 22 nt, Human
ccuucucuuccuaccuccaucc

SEQ ID NO: 57993 - RNA, 23 nt, Human
agggaccaccagaggcagaggcc

SEQ ID NO: 57994 - RNA, 25 nt, Human
gcccaaauuugagaugcauuauucc

SEQ ID NO: 57995 - RNA, 23 nt, Human
gugccauuaagacaacuacagcc

SEQ ID NO: 57996 - RNA, 24 nt, Human
aaauuaccugggaaaucuuaacag

SEQ ID NO: 57997 - RNA, 25 nt, Human
ugcagcucugaugagagagugcuga

SEQ ID NO: 57998 - RNA, 22 nt, Human
gauuacaggcgugagccaccag

SEQ ID NO: 57999 - RNA, 21 nt, Human
ggacucugccuuuuuguuggu

SEQ ID NO: 58000 - RNA, 21 nt, Human
ggucugauguucuguuccauu

SEQ ID NO: 58001 - RNA, 21 nt, Human
uagcaagauuauugcauucca

SEQ ID NO: 58002 - RNA, 22 nt, Human
gagccagccugggucaaagaag

SEQ ID NO: 58003 - RNA, 20 nt, Human
ucaugcugguuuaccccaaa

SEQ ID NO: 58004 - RNA, 27 nt, Human
uugggugccagagugagacacagcagg

SEQ ID NO: 58005 - RNA, 21 nt, Human
auuaugcucuaaugcugcuua

SEQ ID NO: 58006 - RNA, 22 nt, Human
aucgcccaggcuggagugcaau

SEQ ID NO: 58007 - RNA, 19 nt, Human
cucccaugacccucugccc

SEQ ID NO: 58008 - RNA, 22 nt, Human
aggugacagcggccaccaggcu

SEQ ID NO: 58009 - RNA, 24 nt, Human
gaugggguuuauguauguucagcc

SEQ ID NO: 58010 - RNA, 26 nt, Human
aaugcaaaugugcauuuuucugacga

SEQ ID NO: 58011 - RNA, 23 nt, Human
uuggagcccagggcaucuugcug

SEQ ID NO: 58012 - RNA, 18 nt, Human
cuucccuuacauuaguac

SEQ ID NO: 58013 - RNA, 23 nt, Human
cuguagcauucaaggcuugaggc

SEQ ID NO: 58014 - RNA, 22 nt, Human
ccccugagcaggugagcccccg

SEQ ID NO: 58015 - RNA, 21 nt, Human
cagccaucaaaucuuguugag

SEQ ID NO: 58016 - RNA, 23 nt, Human
ccaggaggcggaggaggcuagug

SEQ ID NO: 58017 - RNA, 22 nt, Human
ccuguuuauuuauucuacuuuc

SEQ ID NO: 58018 - RNA, 21 nt, Human
ugcuaucgccaucacagcuga

SEQ ID NO: 58019 - RNA, 20 nt, Human
auucuuaacacucauacuug

SEQ ID NO: 58020 - RNA, 22 nt, Human
gagccagacuccgucucaaagg

SEQ ID NO: 58021 - RNA, 22 nt, Human
cugaggcaggagacucgcuuga

SEQ ID NO: 58022 - RNA, 19 nt, Human
cccuuccuccugccgucca

SEQ ID NO: 58023 - RNA, 22 nt, Human
ccuccuggcccucugguccagc

SEQ ID NO: 58024 - RNA, 22 nt, Human
cugcuuacucccaaaacagccu

SEQ ID NO: 58025 - RNA, 22 nt, Human
ggaaaacuuugaggaacauuca

SEQ ID NO: 58026 - RNA, 27 nt, Human
ugggacccauaucccagccccaggcgg

SEQ ID NO: 58027 - RNA, 18 nt, Human
guucuugaugaucccacu

SEQ ID NO: 58028 - RNA, 25 nt, Human
acucuucagagugcuguuccuacuc

SEQ ID NO: 58029 - RNA, 27 nt, Human
aagacuccuucagccaacaugauggua

SEQ ID NO: 58030 - RNA, 20 nt, Human
ccuguugccacacuuucacu

SEQ ID NO: 58031 - RNA, 21 nt, Human
aaucccgggaagugaguggga

SEQ ID NO: 58032 - RNA, 25 nt, Human
ccagccaccaccaggccuggaguau

SEQ ID NO: 58033 - RNA, 22 nt, Human
ugaacuccuggccugaagcaau

SEQ ID NO: 58034 - RNA, 21 nt, Human
guucauuuuauugcaguauua

SEQ ID NO: 58035 - RNA, 27 nt, Human
cgggaaagaagcccucguggauggagg

SEQ ID NO: 58036 - RNA, 24 nt, Human
caguguugaguccuccauugagga

SEQ ID NO: 58037 - RNA, 27 nt, Human
uuaaccagcacauuucuccuguuuaca

SEQ ID NO: 58038 - RNA, 27 nt, Human
ggagagggaggagguugcaaaaagcca

SEQ ID NO: 58039 - RNA, 23 nt, Human
cugcucccucugauccuccauca

SEQ ID NO: 58040 - RNA, 28 nt, Human
ucaggaacacuacacugcacaggaagcc

SEQ ID NO: 58041 - RNA, 24 nt, Human
ucuuccucuucucccuugccagcc

SEQ ID NO: 58042 - RNA, 22 nt, Human
aggcggcggacguggcccggaa

SEQ ID NO: 58043 - RNA, 24 nt, Human
aggauaacucuguauuacagcuuu

SEQ ID NO: 58044 - RNA, 23 nt, Human
agaaguagcugggauuuguuugc

SEQ ID NO: 58045 - RNA, 27 nt, Human
uuggaaccugcugucaacaggucuuac

SEQ ID NO: 58046 - RNA, 21 nt, Human
uaucagagaaaaacaggaaag

SEQ ID NO: 58047 - RNA, 27 nt, Human
ggaugccaagauuaaaaggugacaggu

SEQ ID NO: 58048 - RNA, 22 nt, Human
uucagcagaugccuccucugcc

SEQ ID NO: 58049 - RNA, 22 nt, Human
gcuauccuguuucagauaauau

SEQ ID NO: 58050 - RNA, 22 nt, Human
ugccacugcacuuagcacuuuc

SEQ ID NO: 58051 - RNA, 20 nt, Human
uuuuacugaaguugcuagaa

SEQ ID NO: 58052 - RNA, 23 nt, Human
gggccccagggugugcagccacu

SEQ ID NO: 58053 - RNA, 23 nt, Human
cuagacuguuacuuuggcaauuu

SEQ ID NO: 58054 - RNA, 21 nt, Human
gcccuccucugcacucccacc

SEQ ID NO: 58055 - RNA, 24 nt, Human
aaagcagcagaaggugaagcagga

SEQ ID NO: 58056 - RNA, 24 nt, Human
agcaggacuuccuacccagaggag

SEQ ID NO: 58057 - RNA, 22 nt, Human
gguugggcugggggguuuccca

SEQ ID NO: 58058 - RNA, 20 nt, Human
aaagagacagugauauugga

SEQ ID NO: 58059 - RNA, 23 nt, Human
uuacugaauucguauuugguggc

SEQ ID NO: 58060 - RNA, 21 nt, Human
ccuugcaauauagaaaaacuu

SEQ ID NO: 58061 - RNA, 27 nt, Human
agccuccuguagguauuugcccauguu

SEQ ID NO: 58062 - RNA, 22 nt, Human
gagcaagacacugucucaaaaa

SEQ ID NO: 58063 - RNA, 26 nt, Human
uuccuuuacagagguucggacuaaca

SEQ ID NO: 58064 - RNA, 22 nt, Human
aauguacuuuuccuuccagaaa

SEQ ID NO: 58065 - RNA, 25 nt, Human
ugguggcacacuccuguaaucccag

SEQ ID NO: 58066 - RNA, 25 nt, Human
aacugaaagcacuagagcagccuug

SEQ ID NO: 58067 - RNA, 26 nt, Human
caauacaaugaaaaggcuuaaaaagc

SEQ ID NO: 58068 - RNA, 24 nt, Human
gcaaagugacgccgagggccugag

SEQ ID NO: 58069 - RNA, 29 nt, Human
caggucacagagcagaggggacgcagaca

SEQ ID NO: 58070 - RNA, 24 nt, Human
caggauucagacgcaaaagacuug

SEQ ID NO: 58071 - RNA, 23 nt, Human
gggaggcagugucuggaugaugc

SEQ ID NO: 58072 - RNA, 22 nt, Human
uauuuggagaaaaugguaagag

SEQ ID NO: 58073 - RNA, 32 nt, Human
ccuggcugcugauccugagccugcugggagau

SEQ ID NO: 58074 - RNA, 19 nt, Human
uccuggugugcuuauuauc

SEQ ID NO: 58075 - RNA, 25 nt, Human
uauucagcaaaaguuaauauucaga

SEQ ID NO: 58076 - RNA, 22 nt, Human
acccaggcuggagugcagugga

SEQ ID NO: 58077 - RNA, 19 nt, Human
aggcuuuugcuuuugucuu

SEQ ID NO: 58078 - RNA, 17 nt, Human
ggaagggagggagcagc

SEQ ID NO: 58079 - RNA, 21 nt, Human
caguaucacuuucugugcuua

SEQ ID NO: 58080 - RNA, 22 nt, Human
ucucagcuuguuucguuuugau

SEQ ID NO: 58081 - RNA, 24 nt, Human
aacaggggacauagcugugcuaug

SEQ ID NO: 58082 - RNA, 27 nt, Human
ugcaggaggauguagcgccucaguuua

SEQ ID NO: 58083 - RNA, 22 nt, Human
ggcucgcugcaaccuucacccu

SEQ ID NO: 58084 - RNA, 26 nt, Human
uuucacccucucccuaaaaagaucaa

SEQ ID NO: 58085 - RNA, 21 nt, Human
ccugcagccaucauguccgcc

SEQ ID NO: 58086 - RNA, 22 nt, Human
ggugcuuguaccucugauuuca

SEQ ID NO: 58087 - RNA, 22 nt, Human
ggugcugagaaauuccacacau

SEQ ID NO: 58088 - RNA, 21 nt, Human
aguuuaaaaaagacuuuaugu

SEQ ID NO: 58089 - RNA, 26 nt, Human
cucuguccuacuucugacuuuacuug

SEQ ID NO: 58090 - RNA, 22 nt, Human
ugcagugagccgaguuugggcc

SEQ ID NO: 58091 - RNA, 21 nt, Human
accagccuguccaauauagug

SEQ ID NO: 58092 - RNA, 20 nt, Human
auguacuugcuaugggccua

SEQ ID NO: 58093 - RNA, 20 nt, Human
gcacuaccacacccagcuaa

SEQ ID NO: 58094 - RNA, 21 nt, Human
aucauucuccaacgauauaca

SEQ ID NO: 58095 - RNA, 22 nt, Human
aggcugaggagggaggauuauc

SEQ ID NO: 58096 - RNA, 21 nt, Human
gcacuauuagugucccccuca

SEQ ID NO: 58097 - RNA, 22 nt, Human
aauggcgugaucucggcucacc

SEQ ID NO: 58098 - RNA, 21 nt, Human
ugggggccaggcuggaggcag

SEQ ID NO: 58099 - RNA, 27 nt, Human
ucagauucaagagauguuuccccaggu

SEQ ID NO: 58100 - RNA, 23 nt, Human
gucacauuuaguaaaugcugaaa

SEQ ID NO: 58101 - RNA, 20 nt, Human
ugugcaucaagccagccuga

SEQ ID NO: 58102 - RNA, 23 nt, Human
auugucacucauuugaugacacc

SEQ ID NO: 58103 - RNA, 23 nt, Human
auugcgccacugcacaccagucu

SEQ ID NO: 58104 - RNA, 25 nt, Human
ucggguuguggcaaaccccaaagag

SEQ ID NO: 58105 - RNA, 20 nt, Human
cauauucuucuaauaauuua

SEQ ID NO: 58106 - RNA, 24 nt, Human
ggcugaggugggaggaucucuuga

SEQ ID NO: 58107 - RNA, 22 nt, Human
cgcccccgcgggacacgcccag

SEQ ID NO: 58108 - RNA, 21 nt, Human
gcucagaaaccacugcauucu

SEQ ID NO: 58109 - RNA, 24 nt, Human
ccccgagucccaugacaccgcuuc

SEQ ID NO: 58110 - RNA, 24 nt, Human
auacugggaucuucaguggcagga

SEQ ID NO: 58111 - RNA, 21 nt, Human
uuagucauuuaaaaagauauu

SEQ ID NO: 58112 - RNA, 25 nt, Human
ggccucaagcaauccgccuaccuca

SEQ ID NO: 58113 - RNA, 20 nt, Human
ccaagcuagaaggaggaauc

SEQ ID NO: 58114 - RNA, 19 nt, Human
augcugccaaccagcuugu

SEQ ID NO: 58115 - RNA, 22 nt, Human
ucauggcccccuuccucccuug

SEQ ID NO: 58116 - RNA, 21 nt, Human
uagaaagagcauaaugaagcc

SEQ ID NO: 58117 - RNA, 21 nt, Human
ggaguuugaggcugcagugag

SEQ ID NO: 58118 - RNA, 27 nt, Human
guuuugaagaaaacauugaauguuuua

SEQ ID NO: 58119 - RNA, 27 nt, Human
cccugcagagccggugucuccgccugc

SEQ ID NO: 58120 - RNA, 27 nt, Human
ucucaacaguaaucaacagucaggugu

SEQ ID NO: 58121 - RNA, 23 nt, Human
gaggcacggggaagguuuuggag

SEQ ID NO: 58122 - RNA, 21 nt, Human
ccuuguacauaacccugggug

SEQ ID NO: 58123 - RNA, 23 nt, Human
gcccccaccacuccucagcugcc

SEQ ID NO: 58124 - RNA, 21 nt, Human
gugcaaccuccgccuccuggg

SEQ ID NO: 58125 - RNA, 25 nt, Human
ccuucacugcacuuucuuccugccu

SEQ ID NO: 58126 - RNA, 24 nt, Human
gggcuguaggucgcugugcugugu

SEQ ID NO: 58127 - RNA, 21 nt, Human
acucacugaaguuuugcauuc

SEQ ID NO: 58128 - RNA, 27 nt, Human
gagaggaaguuauagaaggcuuguugg

SEQ ID NO: 58129 - RNA, 23 nt, Human
cccuccagggugcccccggcuuu

SEQ ID NO: 58130 - RNA, 20 nt, Human
gaacagcucaccacugugcc

SEQ ID NO: 58131 - RNA, 31 nt, Human; identical to SEQ ID NO: 6060

SEQ ID NO: 58132 - RNA, 27 nt, Human
gcccgagcucuucuccguaauucaaag

SEQ ID NO: 58133 - RNA, 25 nt, Human
cccccugcuucaggcugcugagcac

SEQ ID NO: 58134 - RNA, 21 nt, Human
cguuaacugcauuuuacacau

SEQ ID NO: 58135 - RNA, 23 nt, Human
ugcuguuaguaaauuucugugau

SEQ ID NO: 58136 - RNA, 22 nt, Human
ccuugggcucccuccugccucc

SEQ ID NO: 58137 - RNA, 18 nt, Human
ggcaugaaauagcuuaaa

SEQ ID NO: 58138 - RNA, 19 nt, Human
guaguuugggcagugccuu

SEQ ID NO: 58139 - RNA, 22 nt, Human
uaggauuacaggcaugagccac

SEQ ID NO: 58140 - RNA, 22 nt, Human
ugggauuacgggcaugagccac

SEQ ID NO: 58141 - RNA, 22 nt, Human
uucuggcuuuacauuuuauuua

SEQ ID NO: 58142 - RNA, 22 nt, Human
ugggauagaaaaaucauaaaga

SEQ ID NO: 58143 - RNA, 21 nt, Human
uaguauuuugcauucuguaaa

SEQ ID NO: 58144 - RNA, 23 nt, Human
ucaggcaauaggacagaugagug

SEQ ID NO: 58145 - RNA, 24 nt, Human
gcaacaacaaggacccuguuuucc

SEQ ID NO: 58146 - RNA, 21 nt, Human
agaauggaaacccaugccuau

SEQ ID NO: 58147 - RNA, 21 nt, Human
uccaacggaccuuacaucgug

SEQ ID NO: 58148 - RNA, 26 nt, Human
cacuuugccagccacugguggucccu

SEQ ID NO: 58149 - RNA, 20 nt, Human
ucacagcucaccacagccuc

SEQ ID NO: 58150 - RNA, 24 nt, Human
cugauuucuucacaauccuucuca

SEQ ID NO: 58151 - RNA, 25 nt, Human
guuuucacgcccucuagccccuacc

SEQ ID NO: 58152 - RNA, 26 nt, Human
gguaaucacugucaauuggauuuggu

SEQ ID NO: 58153 - RNA, 22 nt, Human
agaucuguccucagccuugcca

SEQ ID NO: 58154 - RNA, 29 nt, Human
cacauccucauucacuaagccaugccaug

SEQ ID NO: 58155 - RNA, 23 nt, Human
ugcagcucugccuccgcagccuc

SEQ ID NO: 58156 - RNA, 22 nt, Human
acugcaaccuccaccucccggg

SEQ ID NO: 58157 - RNA, 23 nt, Human
gcaucccuagaaagccaugugca

SEQ ID NO: 58158 - RNA, 21 nt, Human
acaucgaggacccauagcagg

SEQ ID NO: 58159 - RNA, 26 nt, Human
guggcuuaggccagggugggagcagu

SEQ ID NO: 58160 - RNA, 22 nt, Human
uuuuaaaaaggucauauauuuu

SEQ ID NO: 58161 - RNA, 20 nt, Human
gacaguaaccuuucucuuca

SEQ ID NO: 58162 - RNA, 26 nt, Human
uuagaaggcaggucagcucaccugcu

SEQ ID NO: 58163 - RNA, 21 nt, Human
gcuccaggguuucuguuacua

SEQ ID NO: 58164 - RNA, 27 nt, Human
gccccugguggagguggacgacaugau

SEQ ID NO: 58165 - RNA, 22 nt, Human
caggcacugugagggcuucucc

SEQ ID NO: 58166 - RNA, 22 nt, Human
uuuggagggaagggcuggggcu

SEQ ID NO: 58167 - RNA, 23 nt, Human
ggccaaggcugcgggaggcuggg

SEQ ID NO: 58168 - RNA, 23 nt, Human
accugcaaucccagcuacucggg

SEQ ID NO: 58169 - RNA, 27 nt, Human
auuaaaggcuaauuuaugaaauuugaa

SEQ ID NO: 58170 - RNA, 20 nt, Human
agcugucagcaccggccuca

SEQ ID NO: 58171 - RNA, 21 nt, Human
gcccccaccccgccauggccc

SEQ ID NO: 58172 - RNA, 23 nt, Human
gccgggacuguacccacagcuug

SEQ ID NO: 58173 - RNA, 25 nt, Human
augagacagacuuugccuuguaucu

SEQ ID NO: 58174 - RNA, 23 nt, Human
gccucccagcccugcccggcugc

SEQ ID NO: 58175 - RNA, 26 nt, Human
agaacaaugccuccaagaccaucauc

SEQ ID NO: 58176 - RNA, 23 nt, Human
uucaacacagagaaguugcugcu

SEQ ID NO: 58177 - RNA, 21 nt, Human
ccaacaugugcaccccugcau

SEQ ID NO: 58178 - RNA, 20 nt, Human
cuucauaaguaguauuaacu

SEQ ID NO: 58179 - RNA, 22 nt, Human
gcucacugcaaacucugccucc

SEQ ID NO: 58180 - RNA, 19 nt, Human
ccaguccuagcagaaaaau

SEQ ID NO: 58181 - RNA, 22 nt, Human
ugugugccaggccgggugcugg

SEQ ID NO: 58182 - RNA, 20 nt, Human
aaccaaacugaauuuuugaa

SEQ ID NO: 58183 - RNA, 24 nt, Human
ugggagguggaggguuguacugug

SEQ ID NO: 58184 - RNA, 19 nt, Human
gagaggcucucaacugggc

SEQ ID NO: 58185 - RNA, 25 nt, Human
aagcuauucaacuuugcuuagcuaa

SEQ ID NO: 58186 - RNA, 22 nt, Human
ccuggcucccccugcugguguc

SEQ ID NO: 58187 - RNA, 22 nt, Human
uccugguguguuuuaaaggauc

SEQ ID NO: 58188 - RNA, 21 nt, Human
uaacugcagaagacuaucuua

SEQ ID NO: 58189 - RNA, 24 nt, Human
gacucggcauucguucauuccuua

SEQ ID NO: 58190 - RNA, 19 nt, Human
cugggugcggacuguggga

SEQ ID NO: 58191 - RNA, 22 nt, Human
ucucccacugggucaccucaag

SEQ ID NO: 58192 - RNA, 28 nt, Human
ggguagaauuguuuggcaaugcacugaa

SEQ ID NO: 58193 - RNA, 21 nt, Human
ccuagaaccucccugucuucc

SEQ ID NO: 58194 - RNA, 26 nt, Human
gcgccugagccaugcccagcagcccu

SEQ ID NO: 58195 - RNA, 23 nt, Human
gggcucuuuucugcuuccugaag

SEQ ID NO: 58196 - RNA, 20 nt, Human
ugagaaggcguccacaaaag

SEQ ID NO: 58197 - RNA, 27 nt, Human
cugugugauuuucauacagguuauuuu

SEQ ID NO: 58198 - RNA, 21 nt, Human
caggcccagucacaggggcag

SEQ ID NO: 58199 - RNA, 20 nt, Human
cauguguguguuuguguaua

SEQ ID NO: 58200 - RNA, 23 nt, Human
aaagugcugggcugugugggucg

SEQ ID NO: 58201 - RNA, 22 nt, Human
gccuggacacacacaugugcac

SEQ ID NO: 58202 - RNA, 23 nt, Human
uuccuguccagcuccaaccugca

SEQ ID NO: 58203 - RNA, 23 nt, Human
gcgugagcugccagccuuuugcc

SEQ ID NO: 58204 - RNA, 24 nt, Human
cccugcucuuggccacugugcucc

SEQ ID NO: 58205 - RNA, 23 nt, Human
agagaacuaaaguaguugaaaca

SEQ ID NO: 58206 - RNA, 20 nt, Human
gaaaucaugagggagguugu

SEQ ID NO: 58207 - RNA, 23 nt, Human
ggggagguaaaggcagucuccug

SEQ ID NO: 58208 - RNA, 24 nt, Human
acuuuuaaaaaauuaugcuuucug

SEQ ID NO: 58209 - RNA, 20 nt, Human
ccacgcagggccauccacug

SEQ ID NO: 58210 - RNA, 22 nt, Human
cugcaucuucgcgugugcucag

SEQ ID NO: 58211 - RNA, 21 nt, Human
accacagacucaaugugcucu

SEQ ID NO: 58212 - RNA, 27 nt, Human
cuggggacugcgccuuuuguccccgga

SEQ ID NO: 58213 - RNA, 21 nt, Human
cuucuccuccagacuccuagc

SEQ ID NO: 58214 - RNA, 21 nt, Human
cuucugcuauaacaauaaacu

SEQ ID NO: 58215 - RNA, 22 nt, Human
gagacuuuaaucacugcugaag

SEQ ID NO: 58216 - RNA, 23 nt, Human
cgucugucugcgcccccauuucu

SEQ ID NO: 58217 - RNA, 22 nt, Human
gcauuucuguggcucugcagug

SEQ ID NO: 58218 - RNA, 19 nt, Human
cacagguucucaaccacgu

SEQ ID NO: 58219 - RNA, 23 nt, Human
gacuauguaagggagaguuuauu

SEQ ID NO: 58220 - RNA, 19 nt, Human
ucugccuccagcccggcag

SEQ ID NO: 58221 - RNA, 22 nt, Human
ggcuggccagaguucaggaacg

SEQ ID NO: 58222 - RNA, 22 nt, Human
gccuguauucacagcugcuugg

SEQ ID NO: 58223 - RNA, 22 nt, Human
ugaacaacuaggcuucagcaua

SEQ ID NO: 58224 - RNA, 28 nt, Human
guugggggccgcgaagaugaggcugucc

SEQ ID NO: 58225 - RNA, 21 nt, Human
uugugcaaggauggagugggu

SEQ ID NO: 58226 - RNA, 26 nt, Human
agcuuuucauuguguugugugguugg

SEQ ID NO: 58227 - RNA, 27 nt, Human
ucuccacugcauccgaucucauuauuu

SEQ ID NO: 58228 - RNA, 19 nt, Human
aguuuaccuuccccagauc

SEQ ID NO: 58229 - RNA, 21 nt, Human
ccacccucaccugcccccuca

SEQ ID NO: 58230 - RNA, 25 nt, Human
cuguauguuuaguuucuuuucuccc

SEQ ID NO: 58231 - RNA, 24 nt, Human
caguguugaauguaauuuucggaa

SEQ ID NO: 58232 - RNA, 22 nt, Human
cgccggcgccuccagcugccuc

SEQ ID NO: 58233 - RNA, 23 nt, Human
cuggggcagugccagacucugau

SEQ ID NO: 58234 - RNA, 25 nt, Human
ggaccagggcuuuagggcucacgga

SEQ ID NO: 58235 - RNA, 28 nt, Human
gcuugggagaggggcgcagcuaagacug

SEQ ID NO: 58236 - RNA, 19 nt, Human
ggcucagaggcuguaagaa

SEQ ID NO: 58237 - RNA, 20 nt, Human
cucucugcugaccuccggcu

SEQ ID NO: 58238 - RNA, 25 nt, Human
uucagaaggagcguggcccagccaa

SEQ ID NO: 58239 - RNA, 24 nt, Human
uaccaaauacaguaaaaacaaaug

SEQ ID NO: 58240 - RNA, 19 nt, Human
gcugguuugaaaagcacaa

SEQ ID NO: 58241 - RNA, 27 nt, Human
cccacggucuuccacuaccagccuggg

SEQ ID NO: 58242 - RNA, 18 nt, Human
ugagggagaggaacgugg

SEQ ID NO: 58243 - RNA, 25 nt, Human
uacaaguguuucuaguaacaguauu

SEQ ID NO: 58244 - RNA, 24 nt, Human
ucgaaaacugaggcuccggccgca

SEQ ID NO: 58245 - RNA, 21 nt, Human
aacuggcauuucucuacuuuc

SEQ ID NO: 58246 - RNA, 20 nt, Human
uccacucccaucuuuaugac

SEQ ID NO: 58247 - RNA, 24 nt, Human
ucuuaacaguuucaacaggccacu

SEQ ID NO: 58248 - RNA, 16 nt, Human
guggugagaucacggc

SEQ ID NO: 58249 - RNA, 27 nt, Human
gggaaggacaaagccacucucacaaga

SEQ ID NO: 58250 - RNA, 24 nt, Human
ucuaaguguaaaaaagaaauaacu

SEQ ID NO: 58251 - RNA, 19 nt, Human
gagguuagucgcgcgcuga

SEQ ID NO: 58252 - RNA, 27 nt, Human
cugugguugcacauuugguucaucuga

SEQ ID NO: 58253 - RNA, 20 nt, Human
caacccagggaucacuuccg

SEQ ID NO: 58254 - RNA, 22 nt, Human
ccgagaucaugccaccgcacuu

SEQ ID NO: 58255 - RNA, 23 nt, Human
guuauuuaggaacacaaaggaca

SEQ ID NO: 58256 - RNA, 21 nt, Human
uggagcagaguccuuucugcu

SEQ ID NO: 58257 - RNA, 23 nt, Human
gaguguaugaaauguagaaagau

SEQ ID NO: 58258 - RNA, 22 nt, Human
gccccuggcccagaguugcugu

SEQ ID NO: 58259 - RNA, 27 nt, Human
gcugaagugccuugugaacccugcaau

SEQ ID NO: 58260 - RNA, 26 nt, Human
ugaggcaugagaauguugccccaucu

SEQ ID NO: 58261 - RNA, 22 nt, Human
uccauuuauuuaaaacuaccca

SEQ ID NO: 58262 - RNA, 25 nt, Human
gggcugaggugcaaggaccaggacu

SEQ ID NO: 58263 - RNA, 23 nt, Human
ccuguucuggcacauauggucca

SEQ ID NO: 58264 - RNA, 28 nt, Human
cccuagcccuuccagccugggacacaca

SEQ ID NO: 58265 - RNA, 23 nt, Human
aaaaaccaaugauuuugcugcag

SEQ ID NO: 58266 - RNA, 18 nt, Human
auaaaauuaugaccaugg

SEQ ID NO: 58267 - RNA, 19 nt, Human
guauuuuuguaauuccucu

SEQ ID NO: 58268 - RNA, 27 nt, Human
uuuugagccuuuuugauacugaacaug

SEQ ID NO: 58269 - RNA, 22 nt, Human
cguuacccaggguggagugcag

SEQ ID NO: 58270 - RNA, 20 nt, Human
aauguuguggaaaacuggaa

SEQ ID NO: 58271 - RNA, 21 nt, Human
agcggggacuuaaaugccuuc

SEQ ID NO: 58272 - RNA, 26 nt, Human
cugcccacacuccugccuguugcggu

SEQ ID NO: 58273 - RNA, 22 nt, Human
gcagcuucuccuccagacuccu

SEQ ID NO: 58274 - RNA, 27 nt, Human
ccaucucccagucucccugccccccau

SEQ ID NO: 58275 - RNA, 24 nt, Human
agccaucaaauagugaauggucuc

SEQ ID NO: 58276 - RNA, 27 nt, Human
gaccuccaguggcccacucaaguccau

SEQ ID NO: 58277 - RNA, 23 nt, Human
accaugccuggcuaauauuuugu

SEQ ID NO: 58278 - RNA, 23 nt, Human
guccucuggcuuauugccucaga

SEQ ID NO: 58279 - RNA, 20 nt, Human
uuggaguaaaguugcagugg

SEQ ID NO: 58280 - RNA, 22 nt, Human
cauuucaaaagccagauaaaag

SEQ ID NO: 58281 - RNA, 24 nt, Human
augacuuuuauacuauuucuuuau

SEQ ID NO: 58282 - RNA, 21 nt, Human
uacuuaauaacacuucaccuu

SEQ ID NO: 58283 - RNA, 24 nt, Human
aguuuuaccucacaaaaacuacua

SEQ ID NO: 58284 - RNA, 27 nt, Human
ccugcugugacacugugcucucuucug

SEQ ID NO: 58285 - RNA, 24 nt, Human
uagggagggcaaagguucgggggc

SEQ ID NO: 58286 - RNA, 20 nt, Human
gcuguuauuuuccauggacu

SEQ ID NO: 58287 - RNA, 23 nt, Human
gcccuguggcugccugcacccca

SEQ ID NO: 58288 - RNA, 24 nt, Human
cugaggcaggauaauuuugcuuaa

SEQ ID NO: 58289 - RNA, 27 nt, Human
uagauguuuuuaauuaaacuuuucucu

SEQ ID NO: 58290 - RNA, 25 nt, Human
gccuacuucuagcuguauuuuuugu

SEQ ID NO: 58291 - RNA, 22 nt, Human
cauugcgcuucagccugggcaa

SEQ ID NO: 58292 - RNA, 22 nt, Human
cacacucacacgcacgcucaca

SEQ ID NO: 58293 - RNA, 22 nt, Human
caguccaaacucugauuuacau

SEQ ID NO: 58294 - RNA, 21 nt, Human
aucacccaggcuggaguggag

SEQ ID NO: 58295 - RNA, 21 nt, Human
agcugugcccacaagcuguuc

SEQ ID NO: 58296 - RNA, 21 nt, Human
uguaauguucuagagaucauu

SEQ ID NO: 58297 - RNA, 23 nt, Human
uucauucugucucaaaaaucaca

SEQ ID NO: 58298 - RNA, 27 nt, Human
cucacuuccugccucugcugccaccau

SEQ ID NO: 58299 - RNA, 22 nt, Human
caaaccuggauuuuuuauguac

SEQ ID NO: 58300 - RNA, 22 nt, Human
uccuuucugccccuuccuggaa

SEQ ID NO: 58301 - RNA, 22 nt, Human
auggcagggcugggacugcugu

SEQ ID NO: 58302 - RNA, 27 nt, Human
cauugcacuccagccuagauaacaaga

SEQ ID NO: 58303 - RNA, 22 nt, Human
gcuccccaggcucuagugcagg

SEQ ID NO: 58304 - RNA, 22 nt, Human
agaccucuuggcccaaccugcu

SEQ ID NO: 58305 - RNA, 26 nt, Human
cggaggagcagagguggccgccgugg

SEQ ID NO: 58306 - RNA, 21 nt, Human
acaggccauuaugccuggcua

SEQ ID NO: 58307 - RNA, 21 nt, Human
gguaggacugcgggagacugc

SEQ ID NO: 58308 - RNA, 24 nt, Human
cuuuccagaaaccaaacuaggaga

SEQ ID NO: 58309 - RNA, 20 nt, Human
uaugcuuugcugaauuaguc

SEQ ID NO: 58310 - RNA, 18 nt, Human
aaggggaggggacagugc

SEQ ID NO: 58311 - RNA, 21 nt, Human
uagggucucauuuucucaccg

SEQ ID NO: 58312 - RNA, 20 nt, Human
agagagggccugggagcuug

SEQ ID NO: 58313 - RNA, 26 nt, Human
gguaugggcagcccaagguugcaugg

SEQ ID NO: 58314 - RNA, 26 nt, Human
uguuagugcaaauugucacaggacag

SEQ ID NO: 58315 - RNA, 19 nt, Human
cagugguuuguuccuucuu

SEQ ID NO: 58316 - RNA, 21 nt, Human
ugggguggaauagggaacugu

SEQ ID NO: 58317 - RNA, 19 nt, Human
cgagaggcuacaaccaaga

SEQ ID NO: 58318 - RNA, 29 nt, Human
ggggaaccggaaaccuaggaaucccaacc

SEQ ID NO: 58319 - RNA, 23 nt, Human
cuggcccaggcuagagugcagug

SEQ ID NO: 58320 - RNA, 21 nt, Human
uuccuucagggugaugccagg

SEQ ID NO: 58321 - RNA, 26 nt, Human
cagcagagcuggaggagggggugacc

SEQ ID NO: 58322 - RNA, 24 nt, Human
gaaugaaccacaucuugcucugcu

SEQ ID NO: 58323 - RNA, 21 nt, Human
cuccaagcaaguagcuuucca

SEQ ID NO: 58324 - RNA, 23 nt, Human
aauaguguccuuugaaaaaacuu

SEQ ID NO: 58325 - RNA, 23 nt, Human
ccuugcaacugucagugccucca

SEQ ID NO: 58326 - RNA, 25 nt, Human
cggugcucggucgccgccuaggcgg

SEQ ID NO: 58327 - RNA, 21 nt, Human
auacuguauauuuaagaaggu

SEQ ID NO: 58328 - RNA, 20 nt, Human
aucucaaacuccagcacugg

SEQ ID NO: 58329 - RNA, 27 nt, Human
cucacgaaucagcugcaggucucuguu

SEQ ID NO: 58330 - RNA, 24 nt, Human
acaggaaggaaggaacacugggca

SEQ ID NO: 58331 - RNA, 22 nt, Human
uucauuucaucuaccauuuucu

SEQ ID NO: 58332 - RNA, 23 nt, Human
ucuacuauggcaggagauguggu

SEQ ID NO: 58333 - RNA, 21 nt, Human
augaagccuauugggguuaag

SEQ ID NO: 58334 - RNA, 22 nt, Human
uauuguuauuaaacugauggga

SEQ ID NO: 58335 - RNA, 27 nt, Human
gagaggcacagagcuauuucagccaca

SEQ ID NO: 58336 - RNA, 23 nt, Human
auucuaccauuauacagucuuuc

SEQ ID NO: 58337 - RNA, 22 nt, Human
ucacacacucucacauguacac

SEQ ID NO: 58338 - RNA, 27 nt, Human
ucccugccuccugccccugacgcccau

SEQ ID NO: 58339 - RNA, 26 nt, Human
ugggaaaacguguugcaagucaacca

SEQ ID NO: 58340 - RNA, 21 nt, Human
gccauccugacccagcgagga

SEQ ID NO: 58341 - RNA, 25 nt, Human
uucauuucuuacguucuuucacuuc

SEQ ID NO: 58342 - RNA, 26 nt, Human
uuuguauuuuuaguggagacgggguu

SEQ ID NO: 58343 - RNA, 25 nt, Human
cuucaguuuugaugcauuuugcuga

SEQ ID NO: 58344 - RNA, 20 nt, Human
agaagagggggaggggaagc

SEQ ID NO: 58345 - RNA, 22 nt, Human
ugucacccacgcuggagugcug

SEQ ID NO: 58346 - RNA, 23 nt, Human
ucccaacaacaugaaacugccua

SEQ ID NO: 58347 - RNA, 21 nt, Human
auuuggcuuuuguuaauaugc

SEQ ID NO: 58348 - RNA, 23 nt, Human
guguauuauguuguucaaaugca

SEQ ID NO: 58349 - RNA, 25 nt, Human
agagaaaacuuaggaaguugaaguu

SEQ ID NO: 58350 - RNA, 32 nt, Human
uuacuuuagugaagauucuuagcaguuuuaua

SEQ ID NO: 58351 - RNA, 20 nt, Human
uucaaaacacuuucagauag

SEQ ID NO: 58352 - RNA, 23 nt, Human
aucagcaaauguguacgugcaug

SEQ ID NO: 58353 - RNA, 21 nt, Human
ugagggccccucugcccagcu

SEQ ID NO: 58354 - RNA, 27 nt, Human
uccauuuucaaauuuuaagcaaucaua

SEQ ID NO: 58355 - RNA, 25 nt, Human
gcucacugcugcaaccucccccucc

SEQ ID NO: 58356 - RNA, 20 nt, Human
caugcugucucuaagggugg

SEQ ID NO: 58357 - RNA, 20 nt, Human
accacgcaagagacacccuu

SEQ ID NO: 58358 - RNA, 23 nt, Human
ccugcuucugcugccuguuuggg

SEQ ID NO: 58359 - RNA, 19 nt, Human
uucaaauaaauagaaaaau

SEQ ID NO: 58360 - RNA, 21 nt, Human
gcagggacccaggcacuguga

SEQ ID NO: 58361 - RNA, 17 nt, Human
aucugaaauuuccaucu

SEQ ID NO: 58362 - RNA, 31 nt, Human
uccacugaggauuaagagcaacagccccaga

SEQ ID NO: 58363 - RNA, 21 nt, Human
gucccccacuuuuaaagaugg

SEQ ID NO: 58364 - RNA, 20 nt, Human
gcagucuccaugugugugua

SEQ ID NO: 58365 - RNA, 26 nt, Human
ggcagaaauacagucuuccacaaaga

SEQ ID NO: 58366 - RNA, 23 nt, Human
cacugcuagggaugcucaagggg

SEQ ID NO: 58367 - RNA, 25 nt, Human
cuggucccccaccaggcuugggagc

SEQ ID NO: 58368 - RNA, 26 nt, Human
ugucuagggugagaccagugcucagc

SEQ ID NO: 58369 - RNA, 21 nt, Human
uacugugucuguguagaaaga

SEQ ID NO: 58370 - RNA, 24 nt, Human
ucuucuuucaaauuguuuguauga

SEQ ID NO: 58371 - RNA, 27 nt, Human
ucccagccauguccgacgagagagagg

SEQ ID NO: 58372 - RNA, 25 nt, Human
ggaggagggagagaucaggaaaaau

SEQ ID NO: 58373 - RNA, 22 nt, Human
aaacaccugaccuugugauccg

SEQ ID NO: 58374 - RNA, 23 nt, Human
cuguuuauguucacgugaucuca

SEQ ID NO: 58375 - RNA, 27 nt, Human
ggcacauuucaugaggggaaagggaga

SEQ ID NO: 58376 - RNA, 23 nt, Human
uguaaucuuuuaaaaauauuauc

SEQ ID NO: 58377 - RNA, 27 nt, Human
acauuucagaagugaaggcuuuugagg

SEQ ID NO: 58378 - RNA, 27 nt, Human
ggcugggugggggacugcccacaggag

SEQ ID NO: 58379 - RNA, 19 nt, Human
uggaguggucuaagacuga

SEQ ID NO: 58380 - RNA, 21 nt, Human
agggagacaacggcagaggga

SEQ ID NO: 58381 - RNA, 21 nt, Human
ugcucacugcagccuccgcuu

SEQ ID NO: 58382 - RNA, 24 nt, Human
cugcugccucuccaucccucucuc

SEQ ID NO: 58383 - RNA, 22 nt, Human
cugggaauuuggagugaccaaa

SEQ ID NO: 58384 - RNA, 27 nt, Human
ucguggacugagugggaagcccauccu

SEQ ID NO: 58385 - RNA, 22 nt, Human
ugucuuaucaccaaggaaauuu

SEQ ID NO: 58386 - RNA, 20 nt, Human
cgcccaggcuggaguacagu

SEQ ID NO: 58387 - RNA, 20 nt, Human
cgcccagacuggagugcagu

SEQ ID NO: 58388 - RNA, 23 nt, Human
cacugacugugcacugugcuuag

SEQ ID NO: 58389 - RNA, 22 nt, Human
cuucagcccagcccagccaggu

SEQ ID NO: 58390 - RNA, 19 nt, Human
uccugucugacugaccuca

SEQ ID NO: 58391 - RNA, 27 nt, Human
ccccaacagaagagaaagacugaagga

SEQ ID NO: 58392 - RNA, 26 nt, Human
caacauagcaagacccccaccaucuc

SEQ ID NO: 58393 - RNA, 23 nt, Human
ccaguuugccuccuucucucaau

SEQ ID NO: 58394 - RNA, 17 nt, Human
aucacagcugugccagu

SEQ ID NO: 58395 - RNA, 26 nt, Human
agcuaaaauuuaauuucuuuuuuccu

SEQ ID NO: 58396 - RNA, 20 nt, Human
gccucaagaaggggcucaga

SEQ ID NO: 58397 - RNA, 24 nt, Human
cucccagauacuuucguuuuggac

SEQ ID NO: 58398 - RNA, 23 nt, Human
uacaugguuaccacaagccacaa

SEQ ID NO: 58399 - RNA, 20 nt, Human
uucccccucucccaguuguc

SEQ ID NO: 58400 - RNA, 22 nt, Human
uaauuucacuccaguauauuuu

SEQ ID NO: 58401 - RNA, 22 nt, Human
guuuuaagcaggagaauagcug

SEQ ID NO: 58402 - RNA, 21 nt, Human
gcuugauucucagcacuuggg

SEQ ID NO: 58403 - RNA, 25 nt, Human
uccuccugugcugaccucagggugg

SEQ ID NO: 58404 - RNA, 19 nt, Human
agcaacaaaagauuugucc

SEQ ID NO: 58405 - RNA, 26 nt, Human
ccugagcugcucagcaggcaggcagc

SEQ ID NO: 58406 - RNA, 24 nt, Human
cggccacacuggucacaggcaaag

SEQ ID NO: 58407 - RNA, 27 nt, Human
cacaaauggcuacaucuccaaauauca

SEQ ID NO: 58408 - RNA, 21 nt, Human
uuagguauuagaaagugauac

SEQ ID NO: 58409 - RNA, 21 nt, Human
gugcucagccaggcuggaggc

SEQ ID NO: 58410 - RNA, 25 nt, Human
gcauggccagcaagcucaucaucuc

SEQ ID NO: 58411 - RNA, 28 nt, Human
ccucucccucccuuccucaggcaucaga

SEQ ID NO: 58412 - RNA, 18 nt, Human
ugcuguuuuugucugacu

SEQ ID NO: 58413 - RNA, 26 nt, Human
gaggcugaagaaggaagaggaggaag

SEQ ID NO: 58414 - RNA, 24 nt, Human
caggcagcggcggcugcgcgguga

SEQ ID NO: 58415 - RNA, 24 nt, Human
ggcaggaucagaugacucucucca

SEQ ID NO: 58416 - RNA, 24 nt, Human
gcauuccuuucuuuaauuuuguaa

SEQ ID NO: 58417 - RNA, 22 nt, Human
uacugucuuccccucccuaccu

SEQ ID NO: 58418 - RNA, 24 nt, Human
uugucgcucaggcuggagugccau

SEQ ID NO: 58419 - RNA, 21 nt, Human
cacgagggccgcggugcagug

SEQ ID NO: 58420 - RNA, 20 nt, Human
cuccacccuggccuggggcc

SEQ ID NO: 58421 - RNA, 24 nt, Human
aaaugauuucuguacugcaaaaua

SEQ ID NO: 58422 - RNA, 21 nt, Human
cugagccaguuguccuaugga

SEQ ID NO: 58423 - RNA, 28 nt, Human
gggugauuuguugauuggcaaugaggau

SEQ ID NO: 58424 - RNA, 23 nt, Human
agguccuccucucucuacuugaa

SEQ ID NO: 58425 - RNA, 22 nt, Human
gcaggggcaagcaggagcuagc

SEQ ID NO: 58426 - RNA, 20 nt, Human
cgucuccuccccccaugcac

SEQ ID NO: 58427 - RNA, 28 nt, Human
acccaaguuggagugcaguggccccgca

SEQ ID NO: 58428 - RNA, 22 nt, Human
cugggagguagagguugcacug

SEQ ID NO: 58429 - RNA, 20 nt, Human
uagcaugugaggggacuaag

SEQ ID NO: 58430 - RNA, 27 nt, Human
uaagaaccacagccacagagucaggcu

SEQ ID NO: 58431 - RNA, 25 nt, Human
cccucagccugcaaccucuauccug

SEQ ID NO: 58432 - RNA, 20 nt, Human
cucuccucggaagaacugcc

SEQ ID NO: 58433 - RNA, 27 nt, Human
uucucugagaaguccuuuucagucuga

SEQ ID NO: 58434 - RNA, 26 nt, Human
uguccaggcuggacaccugccauugc

SEQ ID NO: 58435 - RNA, 22 nt, Human
cugcagcuacugauaucuggcc

SEQ ID NO: 58436 - RNA, 22 nt, Human
gccugggacacugcgggacaga

SEQ ID NO: 58437 - RNA, 26 nt, Human
ggagagaagaaacaugucagggugcu

SEQ ID NO: 58438 - RNA, 24 nt, Human
gcugcacuuggcuccugugaggaa

SEQ ID NO: 58439 - RNA, 27 nt, Human
aaacuucuguucaguaagaaucauguc

SEQ ID NO: 58440 - RNA, 22 nt, Human
gcuccacccuccccgugcugcu

SEQ ID NO: 58441 - RNA, 20 nt, Human
uccgucaguccaagucuucu

SEQ ID NO: 58442 - RNA, 27 nt, Human
aagcuuccagaccagcccuucacacca

SEQ ID NO: 58443 - RNA, 21 nt, Human
ggagaugaugugauggaacac

SEQ ID NO: 58444 - RNA, 22 nt, Human
aggauucuguccucuccucauu

SEQ ID NO: 58445 - RNA, 22 nt, Human
gguccagccugguuuagccugg

SEQ ID NO: 58446 - RNA, 20 nt, Human
uccuuuccaaauccaaaaag

SEQ ID NO: 58447 - RNA, 21 nt, Human
caucaugaucagccuccagcc

SEQ ID NO: 58448 - RNA, 23 nt, Human
gcugggagacacagcaagacucc

SEQ ID NO: 58449 - RNA, 27 nt, Human
ccagguggcagcgguugaggaggggua

SEQ ID NO: 58450 - RNA, 30 nt, Human
uuguagauauaacucguucaucuucauuua

SEQ ID NO: 58451 - RNA, 24 nt, Human
acaguggaagggagcaucaggaga

SEQ ID NO: 58452 - RNA, 21 nt, Human
aagagggaacacacugagaug

SEQ ID NO: 58453 - RNA, 17 nt, Human
cucauaccgugcugcua

SEQ ID NO: 58454 - RNA, 27 nt, Human
augugaagccuaauuuaccugcaggaa

SEQ ID NO: 58455 - RNA, 19 nt, Human
agccaagaagagcucacag

SEQ ID NO: 58456 - RNA, 21 nt, Human
cagcaucguccuggaauggcc

SEQ ID NO: 58457 - RNA, 21 nt, Human
caggaguucgaggugcaguuu

SEQ ID NO: 58458 - RNA, 22 nt, Human
cgggaggcagagguaguaguga

SEQ ID NO: 58459 - RNA, 21 nt, Human
uccuugccaccaugaccagcc

SEQ ID NO: 58460 - RNA, 22 nt, Human
gcccagaagcuguuguggccga

SEQ ID NO: 58461 - RNA, 20 nt, Human
uagagcuuggcugggucuag

SEQ ID NO: 58462 - RNA, 26 nt, Human
ugcaggaugggugaaaccacaugggg

SEQ ID NO: 58463 - RNA, 22 nt, Human
caccucacagcaucuugcucca

SEQ ID NO: 58464 - RNA, 26 nt, Human
cagccuagugaacaaaacuccaucac

SEQ ID NO: 58465 - RNA, 23 nt, Human
ugaguuugggauugugguacaau

SEQ ID NO: 58466 - RNA, 21 nt, Human
ccgccugccuguccuccagca

SEQ ID NO: 58467 - RNA, 23 nt, Human
gcucacaccuguaauccuaagua

SEQ ID NO: 58468 - RNA, 20 nt, Human
aaccaucaccagaauuaauu

SEQ ID NO: 58469 - RNA, 26 nt, Human
ugagaguauuaggaaacaugagcagc

SEQ ID NO: 58470 - RNA, 21 nt, Human
auuccugcccccaucaugccc

SEQ ID NO: 58471 - RNA, 18 nt, Human
ggaaaggcucagugacug

SEQ ID NO: 58472 - RNA, 21 nt, Human
gucuuggaccuccugcaucag

SEQ ID NO: 58473 - RNA, 19 nt, Human
cuuccuccuccuguuuggc

SEQ ID NO: 58474 - RNA, 20 nt, Human
cuuaaaaaauacuugcauga

SEQ ID NO: 58475 - RNA, 21 nt, Human
aagucccaggcccagugcagu

SEQ ID NO: 58476 - RNA, 19 nt, Human
gggcugggcccacacaggc

SEQ ID NO: 58477 - RNA, 24 nt, Human
ccuaaccaaauuuuaaaaauacuu

SEQ ID NO: 58478 - RNA, 27 nt, Human
ggcaaagcucaccaucuucacuacaaa

SEQ ID NO: 58479 - RNA, 27 nt, Human
ugagccaguugucaguguucuguuaca

SEQ ID NO: 58480 - RNA, 19 nt, Human
ccaaauucugcagaguggu

SEQ ID NO: 58481 - RNA, 22 nt, Human
agagguggggaggaggaggcac

SEQ ID NO: 58482 - RNA, 18 nt, Human
ccuguuucccaccuccuu

SEQ ID NO: 58483 - RNA, 27 nt, Human
ccaagcccccaaauagcuccaggcgcc

SEQ ID NO: 58484 - RNA, 24 nt, Human
cccugcucuucucucuugccugcc

SEQ ID NO: 58485 - RNA, 27 nt, Human
ggaagaugagaagaaaucuucagggug

SEQ ID NO: 58486 - RNA, 22 nt, Human
cuggcagcagcucuuugcccau

SEQ ID NO: 58487 - RNA, 24 nt, Human
gccuggaucuaucauuacugcaaa

SEQ ID NO: 58488 - RNA, 23 nt, Human
cuuuuuucuccucgccuaguuuc

SEQ ID NO: 58489 - RNA, 22 nt, Human
cuuucacagccggucucucugc

SEQ ID NO: 58490 - RNA, 22 nt, Human
ccgagcgucaccgaaccugcuu

SEQ ID NO: 58491 - RNA, 21 nt, Human
uuccuguuuccauccaguucc

SEQ ID NO: 58492 - RNA, 28 nt, Human
ggaguagcugggaucacagcugcaggcc

SEQ ID NO: 58493 - RNA, 19 nt, Human
gauccagcaaggaugaaga

SEQ ID NO: 58494 - RNA, 24 nt, Human
cgugagcacacucagugcccagcc

SEQ ID NO: 58495 - RNA, 25 nt, Human
uucuccaaaugaaaccugaaucaau

SEQ ID NO: 58496 - RNA, 20 nt, Human
ccauccagccccuguccuca

SEQ ID NO: 58497 - RNA, 22 nt, Human
accagccugggcaacacaguaa

SEQ ID NO: 58498 - RNA, 21 nt, Human
aaagugccggauuacaggugu

SEQ ID NO: 58499 - RNA, 22 nt, Human
gaccccugucccuuccucccgg

SEQ ID NO: 58500 - RNA, 26 nt, Human
ucccugcacaccagagacaagcagag

SEQ ID NO: 58501 - RNA, 23 nt, Human
cggggagggggauaggaagacgc

SEQ ID NO: 58502 - RNA, 26 nt, Human
cugcagcuccuagaacaugagaauca

SEQ ID NO: 58503 - RNA, 21 nt, Human
guugaucagguuacuguagau

SEQ ID NO: 58504 - RNA, 19 nt, Human
guuccucuguuaucaugcc

SEQ ID NO: 58505 - RNA, 20 nt, Human
gaaauaccagugaaccaaag

SEQ ID NO: 58506 - RNA, 18 nt, Human
aucaagccacacccccuu

SEQ ID NO: 58507 - RNA, 26 nt, Human
gccgucacccacucugcacuggggcg

SEQ ID NO: 58508 - RNA, 25 nt, Human
uucucucucacucuguguauaagua

SEQ ID NO: 58509 - RNA, 21 nt, Human
agagcugucugccacagccuu

SEQ ID NO: 58510 - RNA, 28 nt, Human
gccacucugucccuuccugggcaaagaa

SEQ ID NO: 58511 - RNA, 24 nt, Human
agaccagccugggcaagaugguga

SEQ ID NO: 58512 - RNA, 20 nt, Human
uauuggcaaugaagcacuuu

SEQ ID NO: 58513 - RNA, 19 nt, Human
aaacagagaacguguccca

SEQ ID NO: 58514 - RNA, 25 nt, Human
gaccgugucucaaaacaaacaaaca

SEQ ID NO: 58515 - RNA, 25 nt, Human
ugggcgugagaggauagguggcagg

SEQ ID NO: 58516 - RNA, 24 nt, Human
cuccccccuuuccccacccccucc

SEQ ID NO: 58517 - RNA, 25 nt, Human
ccgcauugccuauugauacacuuua

SEQ ID NO: 58518 - RNA, 22 nt, Human
gccagccggcaaaggaaggagg

SEQ ID NO: 58519 - RNA, 21 nt, Human
ccugcccuccccuccucaguc

SEQ ID NO: 58520 - RNA, 29 nt, Human
ccccauucccacuccucugagcccggagg

SEQ ID NO: 58521 - RNA, 22 nt, Human
agccuccugaguagcugggaau

SEQ ID NO: 58522 - RNA, 23 nt, Human
uaauuacucaagaaauauuugca

SEQ ID NO: 58523 - RNA, 20 nt, Human
cccaucacugcuuucuccca

SEQ ID NO: 58524 - RNA, 28 nt, Human
ccccagaaagcagagaacugagugcagc

SEQ ID NO: 58525 - RNA, 27 nt, Human
cauuuuacgcugucucugacauaagga

SEQ ID NO: 58526 - RNA, 26 nt, Human
ggaagcacagcuucauuuccuguguc

SEQ ID NO: 58527 - RNA, 25 nt, Human
uguuuucuuugagacagucugauuc

SEQ ID NO: 58528 - RNA, 22 nt, Human
aggcagcaucugggggcagugg

SEQ ID NO: 58529 - RNA, 28 nt, Human
cccaugcaccuggucauugugucucccg

SEQ ID NO: 58530 - RNA, 22 nt, Human
gaucaggacuggagggggcgga

SEQ ID NO: 58531 - RNA, 25 nt, Human
caggcagugucagcagugaagguuc

SEQ ID NO: 58532 - RNA, 24 nt, Human
gaaggcaucuggugcuuugcucag

SEQ ID NO: 58533 - RNA, 28 nt, Human
ggccuagacagaacaucuguauacccuc

SEQ ID NO: 58534 - RNA, 22 nt, Human
cugccucuucuucgcccuguuc

SEQ ID NO: 58535 - RNA, 22 nt, Human
uggaggcagagaugcaguuacc

SEQ ID NO: 58536 - RNA, 21 nt, Human
uuugcacacauuacagguggu

SEQ ID NO: 58537 - RNA, 23 nt, Human
cuccugccucagccucccucgca

SEQ ID NO: 58538 - RNA, 24 nt, Human
gaaagagaaugggagcauauguga

SEQ ID NO: 58539 - RNA, 26 nt, Human
guucacugcauguagguugauuucuu

SEQ ID NO: 58540 - RNA, 19 nt, Human
ggaaccuguuaaaugagua

SEQ ID NO: 58541 - RNA, 21 nt, Human
uucugucuucuuugauagcca

SEQ ID NO: 58542 - RNA, 23 nt, Human
cacaucuguaaccccagcacuuu

SEQ ID NO: 58543 - RNA, 28 nt, Human
gccugaguuugaaugaaaggauaaugua

SEQ ID NO: 58544 - RNA, 20 nt, Human
ggccucccuccuugggucau

SEQ ID NO: 58545 - RNA, 23 nt, Human
cuacaaacgugugucaccaggcc

SEQ ID NO: 58546 - RNA, 24 nt, Human
ugggaggcugaggugguuguauug

SEQ ID NO: 58547 - RNA, 20 nt, Human
uuuuuaaaagcuucagcuuc

SEQ ID NO: 58548 - RNA, 19 nt, Human
uaaugauuuaagcauuuua

SEQ ID NO: 58549 - RNA, 25 nt, Human
cccucuuuuccucuggaugcacucu

SEQ ID NO: 58550 - RNA, 22 nt, Human
gcuuucgcuuguuccugccucg

SEQ ID NO: 58551 - RNA, 24 nt, Human
agccgccgccucccucccgcccag

SEQ ID NO: 58552 - RNA, 24 nt, Human
uccagcuccugcggcuccuccucc

SEQ ID NO: 58553 - RNA, 27 nt, Human
ccauugcacuccagccugggcaacaag

SEQ ID NO: 58554 - RNA, 26 nt, Human
uacaaaccauauacaucugguuacca

SEQ ID NO: 58555 - RNA, 20 nt, Human
ggguacuguugacaccagcu

SEQ ID NO: 58556 - RNA, 29 nt, Human
gacucccgucuccuccuguccuccggcuu

SEQ ID NO: 58557 - RNA, 26 nt, Human
gccguguuugugacccccuccugccc

SEQ ID NO: 58558 - RNA, 23 nt, Human
gggggcgcggagguuggagagag

SEQ ID NO: 58559 - RNA, 20 nt, Human
uaagaggugguggggaccag

SEQ ID NO: 58560 - RNA, 23 nt, Human
agacccuucuccuuagaagugga

SEQ ID NO: 58561 - RNA, 24 nt, Human
guccaggcuggagugcaauggcac

SEQ ID NO: 58562 - RNA, 24 nt, Human
ccuuggaccuguucacguugccac

SEQ ID NO: 58563 - RNA, 24 nt, Human
uauuaagcaaaauguuuaaagaca

SEQ ID NO: 58564 - RNA, 22 nt, Human
ccuccugugcugaccucagggu

SEQ ID NO: 58565 - RNA, 25 nt, Human
cugaauguguucugucacucagcuu

SEQ ID NO: 58566 - RNA, 24 nt, Human
agaccagccugggcaacaugaugu

SEQ ID NO: 58567 - RNA, 23 nt, Human
ggagaggcaaugguggucuuggc

SEQ ID NO: 58568 - RNA, 26 nt, Human
agcuuccagaccaggcccaacaugug

SEQ ID NO: 58569 - RNA, 21 nt, Human
agcuccacccaaaucacucuu

SEQ ID NO: 58570 - RNA, 27 nt, Human
cccuccugcccaggacugcauuguuuu

SEQ ID NO: 58571 - RNA, 21 nt, Human
cacacaacucagccuggcuga

SEQ ID NO: 58572 - RNA, 23 nt, Human
gauugagugagguagauugcugu

SEQ ID NO: 58573 - RNA, 21 nt, Human
accagccugccaacaugguga

SEQ ID NO: 58574 - RNA, 26 nt, Human
gggaagggaagggcuacugcagcuuu

SEQ ID NO: 58575 - RNA, 21 nt, Human
ugccaggcuggaggcggcagc

SEQ ID NO: 58576 - RNA, 21 nt, Human
gcgccgcgagagaggcagcag

SEQ ID NO: 58577 - RNA, 25 nt, Human
ggcagauccgcagcucgaaaaagaa

SEQ ID NO: 58578 - RNA, 22 nt, Human
auccguggagugcgccugcgca

SEQ ID NO: 58579 - RNA, 24 nt, Human
ugugaccacaggcugguguguagg

SEQ ID NO: 58580 - RNA, 20 nt, Human
accuguauauuuuacuuugu

SEQ ID NO: 58581 - RNA, 23 nt, Human
cauccccagccacaacugccagc

SEQ ID NO: 58582 - RNA, 23 nt, Human
guguacuguauuuugugcauuuc

SEQ ID NO: 58583 - RNA, 24 nt, Human
guggcuuggggucgggagugcagg

SEQ ID NO: 58584 - RNA, 21 nt, Human
uugcucuuguccgcugucuga

SEQ ID NO: 58585 - RNA, 27 nt, Human
uguauuucgugguaguccuugccugua

SEQ ID NO: 58586 - RNA, 23 nt, Human
auguucucuaauuaucuugccaa

SEQ ID NO: 58587 - RNA, 22 nt, Human
uuugcccucggagcaaacugaa

SEQ ID NO: 58588 - RNA, 22 nt, Human
cauuuaucuucuguuuuucuca

SEQ ID NO: 58589 - RNA, 22 nt, Human
gggaggcggagcuugcagcgag

SEQ ID NO: 58590 - RNA, 26 nt, Human
gagucucccaagccaaaauuuugaca

SEQ ID NO: 58591 - RNA, 20 nt, Human
uucucucucauuuacucucg

SEQ ID NO: 58592 - RNA, 21 nt, Human
guuucuccccuuuucccuacc

SEQ ID NO: 58593 - RNA, 22 nt, Human
cuugcagcuuccugcauccagg

SEQ ID NO: 58594 - RNA, 21 nt, Human
agcucacugcagccuugaccu

SEQ ID NO: 58595 - RNA, 25 nt, Human
cugcauugggcagaggaagcugugc

SEQ ID NO: 58596 - RNA, 27 nt, Human
gugagggugggcgacccaggauucccc

SEQ ID NO: 58597 - RNA, 30 nt, Human
gccauuccugaauuucuuucagcacuggga

SEQ ID NO: 58598 - RNA, 22 nt, Human
ucuuggggccggaggccagucc

SEQ ID NO: 58599 - RNA, 22 nt, Human
cauagaacauguauauucuaca

SEQ ID NO: 58600 - RNA, 26 nt, Human
uucuugaacuccuggccucaaaugau

SEQ ID NO: 58601 - RNA, 24 nt, Human
ucugucugggcgaacagcccccuc

SEQ ID NO: 58602 - RNA, 27 nt, Human
ccaggaggugcaguggagggggcaagc

SEQ ID NO: 58603 - RNA, 20 nt, Human
uuacagguuuaccagaucug

SEQ ID NO: 58604 - RNA, 25 nt, Human
augguuucugaaaauguuuaaguau

SEQ ID NO: 58605 - RNA, 24 nt, Human
gacaccuucagcaggucucaggga

SEQ ID NO: 58606 - RNA, 18 nt, Human
cauguguggauguguaaa

SEQ ID NO: 58607 - RNA, 22 nt, Human
ugugggucuucauugcccagcu

SEQ ID NO: 58608 - RNA, 19 nt, Human
gggacuggaggggccaggu

SEQ ID NO: 58609 - RNA, 19 nt, Human
cuucacagugacacuggac

SEQ ID NO: 58610 - RNA, 22 nt, Human
cucaaagcucccacgcagcucu

SEQ ID NO: 58611 - RNA, 23 nt, Human
ucucuuucucuucucacccucag

SEQ ID NO: 58612 - RNA, 18 nt, Human
acaagagaccaggugugg

SEQ ID NO: 58613 - RNA, 20 nt, Human
cacuuccuguucauguacga

SEQ ID NO: 58614 - RNA, 22 nt, Human
gaaccuuggagguggagguugu

SEQ ID NO: 58615 - RNA, 24 nt, Human
uuuuguguauguacuuagcuguac

SEQ ID NO: 58616 - RNA, 19 nt, Human
aaagcacuggcugaaggaa

SEQ ID NO: 58617 - RNA, 25 nt, Human
uguauuucgcucaucuggacccugc

SEQ ID NO: 58618 - RNA, 22 nt, Human
ccagugucauuucucauccaca

SEQ ID NO: 58619 - RNA, 17 nt, Human
ggacacagaucauggua

SEQ ID NO: 58620 - RNA, 25 nt, Human
uacccuguggcauggagaagccuca

SEQ ID NO: 58621 - RNA, 23 nt, Human
ugucacacaggcuggagugcagu

SEQ ID NO: 58622 - RNA, 22 nt, Human
ucucacugccuucugucugccc

SEQ ID NO: 58623 - RNA, 26 nt, Human
ccacagacgccuucccccuuggacuc

SEQ ID NO: 58624 - RNA, 24 nt, Human
uguuuguaaucaugguaauuuaga

SEQ ID NO: 58625 - RNA, 20 nt, Human
ucagauagucaucucagucc

SEQ ID NO: 58626 - RNA, 24 nt, Human
gaagaagaaaagaaaagcugugca

SEQ ID NO: 58627 - RNA, 21 nt, Human
ccacauguaucccucggucug

SEQ ID NO: 58628 - RNA, 27 nt, Human
cccugcagaggcagccugaggucaccg

SEQ ID NO: 58629 - RNA, 27 nt, Human
ggucaucugugugucacagccucagaa

SEQ ID NO: 58630 - RNA, 21 nt, Human
ucagaaaagcagucuagcaaa

SEQ ID NO: 58631 - RNA, 23 nt, Human
ggugaagccccgucucugcuaag

SEQ ID NO: 58632 - RNA, 19 nt, Human
aagcuggaggauuacuuga

SEQ ID NO: 58633 - RNA, 21 nt, Human
uguccucagagcaggggccag

SEQ ID NO: 58634 - RNA, 27 nt, Human
accuggccacaguugggggaggcagag

SEQ ID NO: 58635 - RNA, 23 nt, Human
caaguagcugggauuacaggugu

SEQ ID NO: 58636 - RNA, 21 nt, Human
uccgcccaggcugggugcagu

SEQ ID NO: 58637 - RNA, 21 nt, Human
cugcucccagccacugaggcc

SEQ ID NO: 58638 - RNA, 21 nt, Human
uuaggcuuuuucauacaguau

SEQ ID NO: 58639 - RNA, 22 nt, Human
agcaacaaaaucauggcuuagg

SEQ ID NO: 58640 - RNA, 20 nt, Human
caagggagggggagagaagc

SEQ ID NO: 58641 - RNA, 26 nt, Human
aauugcuuucuuaacugucaagaauc

SEQ ID NO: 58642 - RNA, 21 nt, Human
acccgauccagagcagcagug

SEQ ID NO: 58643 - RNA, 24 nt, Human
gcugccucugggaagucugcagua

SEQ ID NO: 58644 - RNA, 27 nt, Human
ugcccacggcuggagcugccucucuca

SEQ ID NO: 58645 - RNA, 25 nt, Human
uuccuccucccccuccucccugcag

SEQ ID NO: 58646 - RNA, 25 nt, Human
caucucuuugcaaauuccuguacau

SEQ ID NO: 58647 - RNA, 20 nt, Human
uggggaggagggaagggucc

SEQ ID NO: 58648 - RNA, 20 nt, Human
cuuucgaggcagcaggauuu

SEQ ID NO: 58649 - RNA, 23 nt, Human
gcucacgccauucuccugccuca

SEQ ID NO: 58650 - RNA, 22 nt, Human
auugguugaacccgggaggugg

SEQ ID NO: 58651 - RNA, 22 nt, Human
cuuccuacuuugcuucucucca

SEQ ID NO: 58652 - RNA, 26 nt, Human
agauggaccacacuuugagaaacacc

SEQ ID NO: 58653 - RNA, 20 nt, Human
uccuccaccucaggccuugg

SEQ ID NO: 58654 - RNA, 24 nt, Human
cugucuguccucuccuuuuuagga

SEQ ID NO: 58655 - RNA, 18 nt, Human
uccuuggcuggaggcagu

SEQ ID NO: 58656 - RNA, 21 nt, Human
ucaaugcugauauuuaacuga

SEQ ID NO: 58657 - RNA, 22 nt, Human
cauccagcuuuggcugcugaaa

SEQ ID NO: 58658 - RNA, 22 nt, Human
cucuccauauuccugaccauag

SEQ ID NO: 58659 - RNA, 21 nt, Human
ugggguggggacggaggggaa

SEQ ID NO: 58660 - RNA, 22 nt, Human
ggaaggaagaaaagcugccauu

SEQ ID NO: 58661 - RNA, 22 nt, Human
acugcuugaacccagaaggcag

SEQ ID NO: 58662 - RNA, 21 nt, Human
aggcaccauucaggaaccugg

SEQ ID NO: 58663 - RNA, 22 nt, Human
uguagagagaacaggugggcug

SEQ ID NO: 58664 - RNA, 22 nt, Human
cgcugcacucaagcuuggguga

SEQ ID NO: 58665 - RNA, 16 nt, Human
auggguggagggugag

SEQ ID NO: 58666 - RNA, 21 nt, Human
gagagggaggugcuucgccgu

SEQ ID NO: 58667 - RNA, 26 nt, Human
auguuccacuccacuuuguauagaca

SEQ ID NO: 58668 - RNA, 24 nt, Human
agccuugcguuuccacagccuuca

SEQ ID NO: 58669 - RNA, 22 nt, Human
uccuuuggagaggagauuauga

SEQ ID NO: 58670 - RNA, 27 nt, Human
ccacugcacuucagcuugggcaacaga

SEQ ID NO: 58671 - RNA, 23 nt, Human
acacuccucuugaugugacuaaa

SEQ ID NO: 58672 - RNA, 23 nt, Human
ggaaugauugguuaaaaugugau

SEQ ID NO: 58673 - RNA, 23 nt, Human
guagcccagucuggagugcagug

SEQ ID NO: 58674 - RNA, 25 nt, Human
agagcauggacauuuuacuuuggag

SEQ ID NO: 58675 - RNA, 23 nt, Human
cucagaaccucucuggaauuugu

SEQ ID NO: 58676 - RNA, 20 nt, Human
gaccugccugcugugguaug

SEQ ID NO: 58677 - RNA, 22 nt, Human
gaacuccggggcucaagcgauc

SEQ ID NO: 58678 - RNA, 24 nt, Human
ugaacuccuggcuuuccaggagac

SEQ ID NO: 58679 - RNA, 20 nt, Human
ucucagaucauugauuggcc

SEQ ID NO: 58680 - RNA, 22 nt, Human
ucauggucauucgcaugcauag

SEQ ID NO: 58681 - RNA, 20 nt, Human
acaccauuguuccuuaccuu

SEQ ID NO: 58682 - RNA, 25 nt, Human
ggaccauuugggaucccgaaucuca

SEQ ID NO: 58683 - RNA, 27 nt, Human
uguguaccucauggaugcuuuggcaau

SEQ ID NO: 58684 - RNA, 19 nt, Human
uccagaaagagcaacagua

SEQ ID NO: 58685 - RNA, 22 nt, Human
caggccccuucccccagcacgg

SEQ ID NO: 58686 - RNA, 23 nt, Human
gcaugucggucaggcacagcagg

SEQ ID NO: 58687 - RNA, 24 nt, Human
aguaggagagcacguucagaggga

SEQ ID NO: 58688 - RNA, 17 nt, Human
cuguaaaauauuagcug

SEQ ID NO: 58689 - RNA, 21 nt, Human
uggccaguaaucccaggcugg

SEQ ID NO: 58690 - RNA, 23 nt, Human
uggcaguucuggaauggaagggu

SEQ ID NO: 58691 - RNA, 20 nt, Human
ccacacacccauuuuccuca

SEQ ID NO: 58692 - RNA, 23 nt, Human
gcuuccuuauuccccaucugguc

SEQ ID NO: 58693 - RNA, 24 nt, Human
aauaaauccucagguaguacuggg

SEQ ID NO: 58694 - RNA, 23 nt, Human
agccuggugggcuuccuggacuc

SEQ ID NO: 58695 - RNA, 20 nt, Human
uuucagaugaccuuuuggaa

SEQ ID NO: 58696 - RNA, 22 nt, Human
acuauagucaacagcaauuuaa

SEQ ID NO: 58697 - RNA, 22 nt, Human
aggccaaggcaggaggaucgcu

SEQ ID NO: 58698 - RNA, 23 nt, Human
guuggagacaugacaaucauuuu

SEQ ID NO: 58699 - RNA, 20 nt, Human
uugcuuuccugggccuuugc

SEQ ID NO: 58700 - RNA, 19 nt, Human
agggaggguggcagagaca

SEQ ID NO: 58701 - RNA, 26 nt, Human
ccuuuuuuguuccuuuuuccugcugc

SEQ ID NO: 58702 - RNA, 16 nt, Human
caguccuuaccugcca

SEQ ID NO: 58703 - RNA, 17 nt, Human
uagcugcuauguccccu

SEQ ID NO: 58704 - RNA, 22 nt, Human
ggucuguagguuguugcaguga

SEQ ID NO: 58705 - RNA, 24 nt, Human
ggugacucaugccuguaaucccag

SEQ ID NO: 58706 - RNA, 22 nt, Human
uacuacugccuuguacuuuuca

SEQ ID NO: 58707 - RNA, 23 nt, Human
uccaggccaguauaaagggacuu

SEQ ID NO: 58708 - RNA, 24 nt, Human
gugcucuggggcuggaggcuagua

SEQ ID NO: 58709 - RNA, 25 nt, Human
ugguauacagacauuugugcaauuu

SEQ ID NO: 58710 - RNA, 20 nt, Human
uuccucccucuccugaaucc

SEQ ID NO: 58711 - RNA, 23 nt, Human
uaauuuccugcuccuccaguaca

SEQ ID NO: 58712 - RNA, 27 nt, Human
cugggcccugacacugucacccuccac

SEQ ID NO: 58713 - RNA, 20 nt, Human
ugggcccuuucacaccccac

SEQ ID NO: 58714 - RNA, 20 nt, Human
ggcuuacaaauucuacagca

SEQ ID NO: 58715 - RNA, 21 nt, Human
auugcccggaaacucagucua

SEQ ID NO: 58716 - RNA, 22 nt, Human
agggagcuguuugccagcaccg

SEQ ID NO: 58717 - RNA, 20 nt, Human
cucugugccugcucucucca

SEQ ID NO: 58718 - RNA, 20 nt, Human
gauucugcucuuugaaaacc

SEQ ID NO: 58719 - RNA, 27 nt, Human
cacagcccacucucaggcaggaacaau

SEQ ID NO: 58720 - RNA, 24 nt, Human
guuaacaccuuugacgucuuugga

SEQ ID NO: 58721 - RNA, 26 nt, Human
augaacacuggcuuuuguucacuuug

SEQ ID NO: 58722 - RNA, 22 nt, Human
cgccuguaaugccagcgcuuug

SEQ ID NO: 58723 - RNA, 25 nt, Human
caccacccucuccuugcuuucagcc

SEQ ID NO: 58724 - RNA, 24 nt, Human
gcguuaaguuuuaauuuacaacuu

SEQ ID NO: 58725 - RNA, 24 nt, Human
agcuccauguuuagaaauaaauga

SEQ ID NO: 58726 - RNA, 18 nt, Human
ucuggugaccuaaggcuc

SEQ ID NO: 58727 - RNA, 23 nt, Human
ugagauacagucgguuuaccuca

SEQ ID NO: 58728 - RNA, 27 nt, Human
ccucccaccacuccacuccuccagcca

SEQ ID NO: 58729 - RNA, 26 nt, Human
ccaccacacccagccugggucucucu

SEQ ID NO: 58730 - RNA, 20 nt, Human
uccugcucucaccaugagcc

SEQ ID NO: 58731 - RNA, 28 nt, Human
gauuucuggacgcuucugcucguugccu

SEQ ID NO: 58732 - RNA, 28 nt, Human
auucaccgugccugaucugcacauuuca

SEQ ID NO: 58733 - RNA, 22 nt, Human
ugucacccgagcuggagugcag

SEQ ID NO: 58734 - RNA, 15 nt, Human
augugggaaagcuuc

SEQ ID NO: 58735 - RNA, 21 nt, Human
aaaucagcuagacgcuauacc

SEQ ID NO: 58736 - RNA, 21 nt, Human
cacgguguugcucuucaguca

SEQ ID NO: 58737 - RNA, 22 nt, Human
uuccuauuucuggcugccucag

SEQ ID NO: 58738 - RNA, 27 nt, Human
gauggcggcggccucgagcacccuucu

SEQ ID NO: 58739 - RNA, 22 nt, Human
cuggcagcaggaugcucaguga

SEQ ID NO: 58740 - RNA, 25 nt, Human
cacuguccuuuugaaccaggaaaag

SEQ ID NO: 58741 - RNA, 22 nt, Human
auuuauuuuauccucugguuua

SEQ ID NO: 58742 - RNA, 22 nt, Human
gagcgucagugaggguuuucau

SEQ ID NO: 58743 - RNA, 20 nt, Human
cccaacucuccccagugccu

SEQ ID NO: 58744 - RNA, 27 nt, Human
uuuucugggcaugcuuauguauguaca

SEQ ID NO: 58745 - RNA, 20 nt, Human
uucuggugugucuguugauc

SEQ ID NO: 58746 - RNA, 24 nt, Human
ccaguccaguucaggcugccgugc

SEQ ID NO: 58747 - RNA, 22 nt, Human
cuguauccuuccuuccccucca

SEQ ID NO: 58748 - RNA, 27 nt, Human
aggguucccgcagcuggggggugugcg

SEQ ID NO: 58749 - RNA, 22 nt, Human
gccuggagcaccuuuccuucaa

SEQ ID NO: 58750 - RNA, 27 nt, Human
ggugagcuucagugggcagagugaagu

SEQ ID NO: 58751 - RNA, 23 nt, Human
gucuccccggcuggagugcagug

SEQ ID NO: 58752 - RNA, 27 nt, Human
uuggaaaacaugaugaaaauuuuggug

SEQ ID NO: 58753 - RNA, 29 nt, Human
ggcgugaucugcaaccucugccccccggg

SEQ ID NO: 58754 - RNA, 18 nt, Human
ccacagcacaacagcccu

SEQ ID NO: 58755 - RNA, 15 nt, Human
agcgguccuugggga

SEQ ID NO: 58756 - RNA, 27 nt, Human
aaaauucaagaaaauaaaacuaagcuc

SEQ ID NO: 58757 - RNA, 23 nt, Human
ucucgaaugucugaccucaggug

SEQ ID NO: 58758 - RNA, 25 nt, Human
auuucuauuuuauuaugaagaaggu

SEQ ID NO: 58759 - RNA, 23 nt, Human
cacugccauuuccuccugggcaa

SEQ ID NO: 58760 - RNA, 23 nt, Human
cucucugccugaaauguuacaca

SEQ ID NO: 58761 - RNA, 22 nt, Human
gccucucuugagcacuucccug

SEQ ID NO: 58762 - RNA, 24 nt, Human
uagguuggcuuuaauuuaauauac

SEQ ID NO: 58763 - RNA, 22 nt, Human
uccauccuccccacuccugguc

SEQ ID NO: 58764 - RNA, 17 nt, Human
ucuccaauuuucuugua

SEQ ID NO: 58765 - RNA, 23 nt, Human
cccucauuuccuuuuugcacaca

SEQ ID NO: 58766 - RNA, 26 nt, Human
aaaugagagaauagaguaugguugau

SEQ ID NO: 58767 - RNA, 21 nt, Human
uuuuaaauucagcaucauguu

SEQ ID NO: 58768 - RNA, 25 nt, Human
ugagucaggggcagagcagggcggu

SEQ ID NO: 58769 - RNA, 23 nt, Human
agguucugaaaacaaagcuguau

SEQ ID NO: 58770 - RNA, 22 nt, Human
caggugggaagaugggaaugag

SEQ ID NO: 58771 - RNA, 23 nt, Human
gggcuggagaacacugcugggca

SEQ ID NO: 58772 - RNA, 21 nt, Human
cugagcuguaacaaagccucu

SEQ ID NO: 58773 - RNA, 27 nt, Human
uuccuugugcagagguggguauggcaa

SEQ ID NO: 58774 - RNA, 21 nt, Human
ugaguucuuaacauguggacc

SEQ ID NO: 58775 - RNA, 26 nt, Human
uuggagguaagagagaaaaugaaaga

SEQ ID NO: 58776 - RNA, 20 nt, Human
auugauuauagcaaugugau

SEQ ID NO: 58777 - RNA, 24 nt, Human
uggggaaagaauuaggaaggguca

SEQ ID NO: 58778 - RNA, 21 nt, Human
gccuguaaucucagcuacuca

SEQ ID NO: 58779 - RNA, 24 nt, Human
uuauauuuuagagacagggucucg

SEQ ID NO: 58780 - RNA, 22 nt, Human
ccuacugucccucucagugccu

SEQ ID NO: 58781 - RNA, 25 nt, Human
ggccuuucccuuccuuuccuuucuc

SEQ ID NO: 58782 - RNA, 21 nt, Human
auuuucaugucaaacuucaaa

SEQ ID NO: 58783 - RNA, 26 nt, Human
gagagggagaggagcagagaugcugc

SEQ ID NO: 58784 - RNA, 19 nt, Human
cuggcaaagcuuuuagaaa

SEQ ID NO: 58785 - RNA, 22 nt, Human
agccucccaaaauacugggauu

SEQ ID NO: 58786 - RNA, 31 nt, Human
ugcuuuucagcugagguuugcacuuccucuc

SEQ ID NO: 58787 - RNA, 19 nt, Human
gcuggcacagccugggcaa

SEQ ID NO: 58788 - RNA, 21 nt, Human
ccugcacugcucaccuggguu

SEQ ID NO: 58789 - RNA, 29 nt, Human
ccagucagauuccaggaauuugcgcccua

SEQ ID NO: 58790 - RNA, 20 nt, Human
aguccuccucuuccucuggc

SEQ ID NO: 58791 - RNA, 26 nt, Human
ggccacauggacuggggugcaauggg

SEQ ID NO: 58792 - RNA, 21 nt, Human
acguccuccuaggugauggag

SEQ ID NO: 58793 - RNA, 20 nt, Human
uucaguaucaucuccaucau

SEQ ID NO: 58794 - RNA, 22 nt, Human
ccuguuuuucucaucugugcag

SEQ ID NO: 58795 - RNA, 22 nt, Human
gucagaggccuggcccuucuuu

SEQ ID NO: 58796 - RNA, 23 nt, Human
caaucacaguuaagaaaaugaug

SEQ ID NO: 58797 - RNA, 20 nt, Human
auccauugugcucuaaagag

SEQ ID NO: 58798 - RNA, 22 nt, Human
uguucaguaaaaauaacaaaua

SEQ ID NO: 58799 - RNA, 22 nt, Human
uccauccugagcuaaacaagag

SEQ ID NO: 58800 - RNA, 24 nt, Human
ugcccgccucugccucccaaggug

SEQ ID NO: 58801 - RNA, 22 nt, Human
aagugagacauuaaacauuuua

SEQ ID NO: 58802 - RNA, 19 nt, Human
gacuucucuuucuuauuuu

SEQ ID NO: 58803 - RNA, 21 nt, Human
aagauacaaaaaauuagccgg

SEQ ID NO: 58804 - RNA, 29 nt, Human
ggaggaaaaggaaagggccccagccuacu

SEQ ID NO: 58805 - RNA, 26 nt, Human
gccuuuguccagggagaguccuggcc

SEQ ID NO: 58806 - RNA, 29 nt, Human
guuauuugacuuagcaggugcaacaaaaa

SEQ ID NO: 58807 - RNA, 19 nt, Human
cauacggggucucucucca

SEQ ID NO: 58808 - RNA, 22 nt, Human
ugccuguaaucccgacacuuug

SEQ ID NO: 58809 - RNA, 22 nt, Human
aaagaacaacacccuagagaga

SEQ ID NO: 58810 - RNA, 21 nt, Human
cauccagcgucauccuccaga

SEQ ID NO: 58811 - RNA, 21 nt, Human
agccccuucagcuuugagggg

SEQ ID NO: 58812 - RNA, 21 nt, Human
ugaagugccuugggggcaccc

SEQ ID NO: 58813 - RNA, 24 nt, Human
ccuggcuuuaaccccuccuuggcc

SEQ ID NO: 58814 - RNA, 20 nt, Human
agagguugaggcugcaguga

SEQ ID NO: 58815 - RNA, 22 nt, Human
uuuaaaauguaaauacaucagu

SEQ ID NO: 58816 - RNA, 23 nt, Human
gcuuguaaucccagcuacucggg

SEQ ID NO: 58817 - RNA, 21 nt, Human
uggugagggagggcagcucug

SEQ ID NO: 58818 - RNA, 18 nt, Human
cuacauacauuauuuucu

SEQ ID NO: 58819 - RNA, 20 nt, Human
agaaaucaguguuggccaug

SEQ ID NO: 58820 - RNA, 19 nt, Human
agccaccaccgucucucca

SEQ ID NO: 58821 - RNA, 22 nt, Human
uuggaggcuggagcgcaauggc

SEQ ID NO: 58822 - RNA, 24 nt, Human
ucaugcauauuuuaaacagaaauu

SEQ ID NO: 58823 - RNA, 21 nt, Human
ccacagccuccaacuccuggg

SEQ ID NO: 58824 - RNA, 18 nt, Human
uccaugcguuaacuuuuc

SEQ ID NO: 58825 - RNA, 19 nt, Human
cuccugagcucugccucuu

SEQ ID NO: 58826 - RNA, 27 nt, Human
ggggaaagaagaccuaggacuggggga

SEQ ID NO: 58827 - RNA, 22 nt, Human
aaauguacccagccuaccagag

SEQ ID NO: 58828 - RNA, 18 nt, Human
gagagaagagaccuggga

SEQ ID NO: 58829 - RNA, 20 nt, Human
uccuauuucccccuccuccc

SEQ ID NO: 58830 - RNA, 22 nt, Human
cucaagcaauccuucugccuug

SEQ ID NO: 58831 - RNA, 31 nt, Human
uccauaaaguacaaaugaagaaagucaaaaa

SEQ ID NO: 58832 - RNA, 20 nt, Human
ggacacaccccugcccagac

SEQ ID NO: 58833 - RNA, 24 nt, Human
gaccguggcuuccuuccucaccug

SEQ ID NO: 58834 - RNA, 21 nt, Human
ugucugguaggaaugaccuca

SEQ ID NO: 58835 - RNA, 21 nt, Human
gucagugauguugccuagaau

SEQ ID NO: 58836 - RNA, 20 nt, Human
caaccgggcuggagugcagu

SEQ ID NO: 58837 - RNA, 20 nt, Human
ugggcacacgcugcucugcc

SEQ ID NO: 58838 - RNA, 26 nt, Human
cgccgcgcccagcuccagucuccccu

SEQ ID NO: 58839 - RNA, 22 nt, Human
uuuaaaugguauaaacaugauu

SEQ ID NO: 58840 - RNA, 27 nt, Human
gguugcuguuagcagaggauuggugca

SEQ ID NO: 58841 - RNA, 20 nt, Human
uucaaagcugaagaaucuaa

SEQ ID NO: 58842 - RNA, 23 nt, Human
agaacucuugugacauuagccag

SEQ ID NO: 58843 - RNA, 20 nt, Human
cuccaucucaaacaaaaaca

SEQ ID NO: 58844 - RNA, 19 nt, Human
gcccucucccuuccuggca

SEQ ID NO: 58845 - RNA, 24 nt, Human
uguaagaaaccuuaggaugagcuc

SEQ ID NO: 58846 - RNA, 23 nt, Human
cucccugccuggagcacacuuua

SEQ ID NO: 58847 - RNA, 22 nt, Human
ggaggcggaggcagcuggggag

SEQ ID NO: 58848 - RNA, 22 nt, Human
cuuaggugauccuucugucuca

SEQ ID NO: 58849 - RNA, 20 nt, Human
agaggaagaggaggaggcgg

SEQ ID NO: 58850 - RNA, 27 nt, Human
ucucaacaaaacuuuauaggcagucuu

SEQ ID NO: 58851 - RNA, 20 nt, Human
cagccucuucccuagggccu

SEQ ID NO: 58852 - RNA, 22 nt, Human
cagggucucacucugucaccca

SEQ ID NO: 58853 - RNA, 19 nt, Human
cccucccuccucugucccu

SEQ ID NO: 58854 - RNA, 23 nt, Human
aaggaauaacuuucacaaaauaa

SEQ ID NO: 58855 - RNA, 20 nt, Human
auucaggaagcagcuuuccc

SEQ ID NO: 58856 - RNA, 21 nt, Human
auacacagagagaggcagcag

SEQ ID NO: 58857 - RNA, 23 nt, Human
aaguauauguagccucagccuga

SEQ ID NO: 58858 - RNA, 23 nt, Human
uuuauuuugacaaguuuuaggca

SEQ ID NO: 58859 - RNA, 24 nt, Human
uucuuguugagcugcauuguguua

SEQ ID NO: 58860 - RNA, 18 nt, Human
aagcagcuggguuaggaa

SEQ ID NO: 58861 - RNA, 24 nt, Human
gugggggagagaggccgcagccag

SEQ ID NO: 58862 - RNA, 26 nt, Human
cccagcaccccucuccuuuggccucc

SEQ ID NO: 58863 - RNA, 27 nt, Human
cuuaccucucuguguucagauguggcc

SEQ ID NO: 58864 - RNA, 27 nt, Human
ucacugcacuccagccuggguaacaga

SEQ ID NO: 58865 - RNA, 23 nt, Human
gauccacagcuuuuccuccaugu

SEQ ID NO: 58866 - RNA, 26 nt, Human
cugcccagggcuccggaggugcagcu

SEQ ID NO: 58867 - RNA, 26 nt, Human
ucacauuugcuucgugagaugggggc

SEQ ID NO: 58868 - RNA, 23 nt, Human
gaaaccacauguaacuuagccag

SEQ ID NO: 58869 - RNA, 23 nt, Human
gaagaagcuagggucuggaggga

SEQ ID NO: 58870 - RNA, 22 nt, Human
ccccacugcuggcaguaagucc

SEQ ID NO: 58871 - RNA, 27 nt, Human
agcaguuuaaaccccacuuuccuccac

SEQ ID NO: 58872 - RNA, 26 nt, Human
agaacaaacagaaacgagauuugcca

SEQ ID NO: 58873 - RNA, 20 nt, Human
ccagcccaaaccugggaagg

SEQ ID NO: 58874 - RNA, 27 nt, Human
gcugcccuggguccugccugcaguauu

SEQ ID NO: 58875 - RNA, 21 nt, Human
ccaccucccuuuucucagccu

SEQ ID NO: 58876 - RNA, 25 nt, Human
gcuucuggcuccugggaaaagugga

SEQ ID NO: 58877 - RNA, 23 nt, Human
gcaggggaggcggaaaaauagag

SEQ ID NO: 58878 - RNA, 21 nt, Human
ugccuggaacucaucugugaa

SEQ ID NO: 58879 - RNA, 19 nt, Human
ggaggaggcagggggaagg

SEQ ID NO: 58880 - RNA, 24 nt, Human
ccuuccucaccccuccucugaccc

SEQ ID NO: 58881 - RNA, 29 nt, Human
ucccagauucgcugcuggagugcuggaug

SEQ ID NO: 58882 - RNA, 24 nt, Human
gcgcucucuuucugcugcucccca

SEQ ID NO: 58883 - RNA, 21 nt, Human
uggagaaggugggcacuggau

SEQ ID NO: 58884 - RNA, 23 nt, Human
gucuaaauuguguuacuagccuc

SEQ ID NO: 58885 - RNA, 21 nt, Human
ggaaaugcaggaaggccgggu

SEQ ID NO: 58886 - RNA, 21 nt, Human
gggcuagaaccuagagaagcu

SEQ ID NO: 58887 - RNA, 27 nt, Human
cugggugacaagagcgaaacuccaucu

SEQ ID NO: 58888 - RNA, 21 nt, Human
uucuaucuccccgucacaccc

SEQ ID NO: 58889 - RNA, 22 nt, Human
aguggugggaucgcggcucacu

SEQ ID NO: 58890 - RNA, 22 nt, Human
uauacaugugagagacaucuca

SEQ ID NO: 58891 - RNA, 30 nt, Human
uuuugcugcucuccuugaggauacgugcaa

SEQ ID NO: 58892 - RNA, 19 nt, Human
agagagggaggggugcagc

SEQ ID NO: 58893 - RNA, 27 nt, Human
ccgucgcucgccugggugccuggagcu

SEQ ID NO: 58894 - RNA, 22 nt, Human
agaaggugcuuucugcuuacug

SEQ ID NO: 58895 - RNA, 22 nt, Human
cccugcucacucucugcugacc

SEQ ID NO: 58896 - RNA, 21 nt, Human
ggagagggaaugcugagcaga

SEQ ID NO: 58897 - RNA, 21 nt, Human
aggaugaucuguucccccucu

SEQ ID NO: 58898 - RNA, 22 nt, Human
ucacugcaaccucuaccuccug

SEQ ID NO: 58899 - RNA, 26 nt, Human
caagggcagaggggugcucauagcgg

SEQ ID NO: 58900 - RNA, 22 nt, Human
ccuucugcucaauuuccuuucc

SEQ ID NO: 58901 - RNA, 21 nt, Human
ugcuucugcgcuucugagggc

SEQ ID NO: 58902 - RNA, 24 nt, Human
uggcagucuuggcuuuaaagugag

SEQ ID NO: 58903 - RNA, 23 nt, Human
cccugagcaucccucuggacuca

SEQ ID NO: 58904 - RNA, 22 nt, Human
uaucuaucuuauuguucuugaa

SEQ ID NO: 58905 - RNA, 20 nt, Human
ccucuggagcuugacugggg

SEQ ID NO: 58906 - RNA, 22 nt, Human
cuuauugaggaaauuuccuaac

SEQ ID NO: 58907 - RNA, 25 nt, Human
ccagggacacccacacagguggcca

SEQ ID NO: 58908 - RNA, 21 nt, Human
gugugggcaucgcuacguguu

SEQ ID NO: 58909 - RNA, 22 nt, Human
cuuggccucccaaaguacuggg

SEQ ID NO: 58910 - RNA, 20 nt, Human
uucugggagggcagcggcca

SEQ ID NO: 58911 - RNA, 23 nt, Human
guuucaggcuuuccccggagacu

SEQ ID NO: 58912 - RNA, 19 nt, Human
auguucucuucugcauuuu

SEQ ID NO: 58913 - RNA, 21 nt, Human
ucccgcggggacaccagcacu

SEQ ID NO: 58914 - RNA, 24 nt, Human
cagggggagaucccaagccuagcc

SEQ ID NO: 58915 - RNA, 20 nt, Human
cuccccagcccccagcccuc

SEQ ID NO: 58916 - RNA, 22 nt, Human
uacagacaggaggauguugccu

SEQ ID NO: 58917 - RNA, 28 nt, Human
guuacuaauaugccuagcacaaguacca

SEQ ID NO: 58918 - RNA, 26 nt, Human
ggguagugacugagauguaaaaauag

SEQ ID NO: 58919 - RNA, 29 nt, Human
ucugacccgcucaggcuugaggguuucuc

SEQ ID NO: 58920 - RNA, 29 nt, Human
ggcuggggguuggagaauaaaagcaggag

SEQ ID NO: 58921 - RNA, 19 nt, Human
ucuuuucuccccuuggguc

SEQ ID NO: 58922 - RNA, 26 nt, Human
caauuugccauuguuucuccuggguu

SEQ ID NO: 58923 - RNA, 22 nt, Human
caguacuggauuccagcauuca

SEQ ID NO: 58924 - RNA, 22 nt, Human
uccucaccccuaucuucaucuc

SEQ ID NO: 58925 - RNA, 21 nt, Human
gacugcacuuuggagaggcaa

SEQ ID NO: 58926 - RNA, 23 nt, Human
cuaccugcguguggguuugccgc

SEQ ID NO: 58927 - RNA, 21 nt, Human
uuugaucuuaaugcuucugaa

SEQ ID NO: 58928 - RNA, 22 nt, Human
uggccuccccuccucugcuugc

SEQ ID NO: 58929 - RNA, 22 nt, Human
guaaucacuuuuaacacugcua

SEQ ID NO: 58930 - RNA, 23 nt, Human
ggcuaauuuuuuguacuuuuagu

SEQ ID NO: 58931 - RNA, 27 nt, Human
cccuuggaauaaaguucuguuuucugu

SEQ ID NO: 58932 - RNA, 19 nt, Human
aagggagggcagagggggc

SEQ ID NO: 58933 - RNA, 24 nt, Human
uggcugcuuacuucagcacuauug

SEQ ID NO: 58934 - RNA, 18 nt, Human
cugccucucccucugccu

SEQ ID NO: 58935 - RNA, 22 nt, Human
uagcaccuucucucagggauga

SEQ ID NO: 58936 - RNA, 19 nt, Human
uuggucucaagcuaaaaca

SEQ ID NO: 58937 - RNA, 20 nt, Human
cauguucuuaauucuuagcu

SEQ ID NO: 58938 - RNA, 24 nt, Human
cagacuccucacauuccagcacuu

SEQ ID NO: 58939 - RNA, 20 nt, Human
gccaggaggcugguggagcg

SEQ ID NO: 58940 - RNA, 22 nt, Human
ucagcucuucuuguuucuacag

SEQ ID NO: 58941 - RNA, 21 nt, Human
augcaugaaggaaacugaacu

SEQ ID NO: 58942 - RNA, 20 nt, Human
gacuugugcugaucgugcua

SEQ ID NO: 58943 - RNA, 22 nt, Human
cauggagcuauuauggcugguc

SEQ ID NO: 58944 - RNA, 21 nt, Human
ccccaggcucacagcaguggc

SEQ ID NO: 58945 - RNA, 21 nt, Human
gcccucacucgccuucgagag

SEQ ID NO: 58946 - RNA, 20 nt, Human
ccccgcagucacuuucuuug

SEQ ID NO: 58947 - RNA, 22 nt, Human
gggagagaaggcccuuggucag

SEQ ID NO: 58948 - RNA, 27 nt, Human
ccucugaucucccuccaacaaacccug

SEQ ID NO: 58949 - RNA, 27 nt, Human
cagggccaucuuugcagcucagucuag

SEQ ID NO: 58950 - RNA, 27 nt, Human
gucucgaacuccugaccucaagugauc

SEQ ID NO: 58951 - RNA, 29 nt, Human
aaccuagcuacugccuucuaugaaagcag

SEQ ID NO: 58952 - RNA, 22 nt, Human
acagcggcaaucuuuucuuugg

SEQ ID NO: 58953 - RNA, 18 nt, Human
aggagaaugucagaugcu

SEQ ID NO: 58954 - RNA, 21 nt, Human
cugauuugugggaugguggca

SEQ ID NO: 58955 - RNA, 23 nt, Human
aagggcauaaaguaaauacaugc

SEQ ID NO: 58956 - RNA, 21 nt, Human
uuccucuuggacauuguugua

SEQ ID NO: 58957 - RNA, 19 nt, Human
ugacagucaaaaccccacc

SEQ ID NO: 58958 - RNA, 21 nt, Human
cagauauuuugaaaggcacag

SEQ ID NO: 58959 - RNA, 25 nt, Human
cuuuaugcugaccaucgguaacgga

SEQ ID NO: 58960 - RNA, 26 nt, Human
caccuuuucagguuggagugcauuca

SEQ ID NO: 58961 - RNA, 18 nt, Human
uagcccaggcuggagugc

SEQ ID NO: 58962 - RNA, 20 nt, Human
caccuauugaauuaccauag

SEQ ID NO: 58963 - RNA, 19 nt, Human
caggggcuucacccaugaa

SEQ ID NO: 58964 - RNA, 21 nt, Human
agcggggaaguggucgcagug

SEQ ID NO: 58965 - RNA, 21 nt, Human
acgaguggcagugccugcugc

SEQ ID NO: 58966 - RNA, 21 nt, Human
aucuucucgcaggucacaaga

SEQ ID NO: 58967 - RNA, 24 nt, Human
aacucccguauuugcagcuggaac

SEQ ID NO: 58968 - RNA, 27 nt, Human
uacuaugucuagguuugcaagaauuga

SEQ ID NO: 58969 - RNA, 23 nt, Human
aguuaaguucagcacuugucuca

SEQ ID NO: 58970 - RNA, 27 nt, Human
ggcacaccaucuaccugcccgacugcc

SEQ ID NO: 58971 - RNA, 22 nt, Human
ugaaguuaaacaaacauuggga

SEQ ID NO: 58972 - RNA, 24 nt, Human
gcuguuuucacauccuuucccuua

SEQ ID NO: 58973 - RNA, 26 nt, Human
accacauucuucuuacuuauuuuaug

SEQ ID NO: 58974 - RNA, 24 nt, Human
ggaggucuuccagcagcagcaggu

SEQ ID NO: 58975 - RNA, 17 nt, Human
caguaaagcugcaguga

SEQ ID NO: 58976 - RNA, 21 nt, Human
ccccucucucagugucaauag

SEQ ID NO: 58977 - RNA, 23 nt, Human
augggcugagggaguggaggggg

SEQ ID NO: 58978 - RNA, 27 nt, Human
gucacccaggcugccaggcuggagugg

SEQ ID NO: 58979 - RNA, 26 nt, Human
gugacuucauucuuuuuagacaucag

SEQ ID NO: 58980 - RNA, 22 nt, Human
caccacugcccuccagccuagg

SEQ ID NO: 58981 - RNA, 22 nt, Human
ucugggccacucaggccagugc

SEQ ID NO: 58982 - RNA, 20 nt, Human
ucucaugcuauuucuaccuc

SEQ ID NO: 58983 - RNA, 22 nt, Human
auuccugauauaauuacuguag

SEQ ID NO: 58984 - RNA, 27 nt, Human
cccuaggcccuuuucagacuccugggc

SEQ ID NO: 58985 - RNA, 20 nt, Human
gacauucagcacacugugaa

SEQ ID NO: 58986 - RNA, 20 nt, Human
gaaugucaggagaaacucca

SEQ ID NO: 58987 - RNA, 27 nt, Human
ucugaacuuuccuguuaccuuuucagg

SEQ ID NO: 58988 - RNA, 24 nt, Human
ggggaaagaaaaggaagcugcagg

SEQ ID NO: 58989 - RNA, 19 nt, Human
cccaggcuggggcgcaaug

SEQ ID NO: 58990 - RNA, 23 nt, Human
uaggggcaggauggagggcugag

SEQ ID NO: 58991 - RNA, 23 nt, Human
accuauaauucccagcacuuugg

SEQ ID NO: 58992 - RNA, 21 nt, Human
uucaaugcuucuuuuagucag

SEQ ID NO: 58993 - RNA, 24 nt, Human
ugccucucuuucacacaaugccca

SEQ ID NO: 58994 - RNA, 26 nt, Human
uucuuccaggaugguguuacugcagu

SEQ ID NO: 58995 - RNA, 21 nt, Human
cugagaaacucuggcaagugg

SEQ ID NO: 58996 - RNA, 23 nt, Human
agcaagacucuguggaguuuguu

SEQ ID NO: 58997 - RNA, 26 nt, Human
gaaaagaaucacaguacuuuccagca

SEQ ID NO: 58998 - RNA, 24 nt, Human
gggcguguuguggacucagcacug

SEQ ID NO: 58999 - RNA, 23 nt, Human
gucucucuucugucuuauucuca

SEQ ID NO: 59000 - RNA, 21 nt, Human
guacuuuuuagagugcacuga

SEQ ID NO: 59001 - RNA, 21 nt, Human
acuaagcugaaacugcugcuc

SEQ ID NO: 59002 - RNA, 21 nt, Human
aaaaugauagccacaagcaga

SEQ ID NO: 59003 - RNA, 26 nt, Human
cauuucaauaccuuguaauccuccaa

SEQ ID NO: 59004 - RNA, 27 nt, Human
auggacucuuaaggcauugagggcucu

SEQ ID NO: 59005 - RNA, 23 nt, Human
ccucugcaggauuggcccccagg

SEQ ID NO: 59006 - RNA, 19 nt, Human
ucccuggauggcuggagga

SEQ ID NO: 59007 - RNA, 18 nt, Human
agugucuucaucacaaga

SEQ ID NO: 59008 - RNA, 21 nt, Human
cuuccgggguuuauugcugag

SEQ ID NO: 59009 - RNA, 26 nt, Human
ugacaccugcggucucccgccgggcu

SEQ ID NO: 59010 - RNA, 27 nt, Human
gcugccuuuggcccugccuggcccagc

SEQ ID NO: 59011 - RNA, 25 nt, Human
gcugaggcucucccuuucucuguga

SEQ ID NO: 59012 - RNA, 21 nt, Human
ggauaagccuggggcuacugu

SEQ ID NO: 59013 - RNA, 28 nt, Human
ggaggcgauggggacgauggacagagac

SEQ ID NO: 59014 - RNA, 24 nt, Human
gcacccagaugauguggcagggau

SEQ ID NO: 59015 - RNA, 21 nt, Human
auuucuucccagcuccuggcc

SEQ ID NO: 59016 - RNA, 22 nt, Human
uucccaggggaugcugaugcug

SEQ ID NO: 59017 - RNA, 22 nt, Human
gaacuccuggcuucaagcgauc

SEQ ID NO: 59018 - RNA, 24 nt, Human
agggaaagugaauguggucuggag

SEQ ID NO: 59019 - RNA, 19 nt, Human
gccgugccuggauccugaa

SEQ ID NO: 59020 - RNA, 25 nt, Human
aggaaacacugauuuugcugcugaa

SEQ ID NO: 59021 - RNA, 27 nt, Human
guuacuuauucagauaaacauggugcc

SEQ ID NO: 59022 - RNA, 23 nt, Human
ggcauuggugcucuacugucuuu

SEQ ID NO: 59023 - RNA, 25 nt, Human
ccgaggcgagcaggagcagggaaca

SEQ ID NO: 59024 - RNA, 23 nt, Human
gaguuugaaauucugacaucugc

SEQ ID NO: 59025 - RNA, 27 nt, Human
uccugaaaauccugaaaaccaggauuu

SEQ ID NO: 59026 - RNA, 24 nt, Human
cgcauucugcucccacagugccuu

SEQ ID NO: 59027 - RNA, 23 nt, Human
uucuucugugggaggccagucca

SEQ ID NO: 59028 - RNA, 27 nt, Human
agacaaccaauacaugcaggguugggu

SEQ ID NO: 59029 - RNA, 21 nt, Human
ccccccacucugugccugacc

SEQ ID NO: 59030 - RNA, 24 nt, Human
uuagcacauugcauaguaguuuua

SEQ ID NO: 59031 - RNA, 20 nt, Human
agaaagggaggagagcucua

SEQ ID NO: 59032 - RNA, 25 nt, Human
uucauuucuccugucaccuuccggg

SEQ ID NO: 59033 - RNA, 19 nt, Human
uuccacccuuucugguguc

SEQ ID NO: 59034 - RNA, 30 nt, Human
ucuccagagaucucuccauugugcaaauuu

SEQ ID NO: 59035 - RNA, 21 nt, Human
uaggacuuuaaaacacuggac

SEQ ID NO: 59036 - RNA, 22 nt, Human
cggcuccugggcuguggccgug

SEQ ID NO: 59037 - RNA, 22 nt, Human
gagcccaggaggaggaggcugc

SEQ ID NO: 59038 - RNA, 23 nt, Human
uuuucacccucuguugucucuuc

SEQ ID NO: 59039 - RNA, 27 nt, Human
agcaacaguucaaugaaucaaaaugga

SEQ ID NO: 59040 - RNA, 20 nt, Human
gcccuccucccuccugcaca

SEQ ID NO: 59041 - RNA, 22 nt, Human
ucacucacuuucaaagccagcu

SEQ ID NO: 59042 - RNA, 22 nt, Human
uccucaucuccagccucaguag

SEQ ID NO: 59043 - RNA, 20 nt, Human
uugucuaauucguagggaug

SEQ ID NO: 59044 - RNA, 25 nt, Human
ucaagccccauuuccucacacuaag

SEQ ID NO: 59045 - RNA, 27 nt, Human
uccugacuccuaccugcccuggaacau

SEQ ID NO: 59046 - RNA, 20 nt, Human
gaguaaaauuaccauuucca

SEQ ID NO: 59047 - RNA, 26 nt, Human
ccuuucuccccaacuaugcaucuguu

SEQ ID NO: 59048 - RNA, 21 nt, Human
uccagauuccaagugcugcua

SEQ ID NO: 59049 - RNA, 21 nt, Human
auuaccuuccuuaccuucaua

SEQ ID NO: 59050 - RNA, 27 nt, Human
cuggugcagagcacuucaaauaugucc

SEQ ID NO: 59051 - RNA, 32 nt, Human
cugcacuuaaaggcuucuccuccuggagggcu

SEQ ID NO: 59052 - RNA, 24 nt, Human
gucuugcuauuugagcaugcacag

SEQ ID NO: 59053 - RNA, 20 nt, Human
aucuggacacuucuuuauac

SEQ ID NO: 59054 - RNA, 23 nt, Human
ggacaacagcaucuucccaaaac

SEQ ID NO: 59055 - RNA, 27 nt, Human
gcugcuugcgcucaucaucucuauuaa

SEQ ID NO: 59056 - RNA, 26 nt, Human
augcacacuacauggucagugggcuu

SEQ ID NO: 59057 - RNA, 22 nt, Human
cccuaguagcugggaugacagg

SEQ ID NO: 59058 - RNA, 22 nt, Human
ccagucugggacaggcacagug

SEQ ID NO: 59059 - RNA, 20 nt, Human
cagggcgcugggaaggggug

SEQ ID NO: 59060 - RNA, 24 nt, Human
cucucugcugcuuuagauguugcu

SEQ ID NO: 59061 - RNA, 22 nt, Human
uaguaucuuaauuuuuacucca

SEQ ID NO: 59062 - RNA, 25 nt, Human
gcucucuacccagcccaucuugccu

SEQ ID NO: 59063 - RNA, 21 nt, Human
cuucugacacauuuauuauag

SEQ ID NO: 59064 - RNA, 15 nt, Human
ucuguagcuacuuuc

SEQ ID NO: 59065 - RNA, 21 nt, Human
accauuucaaacuggagagaa

SEQ ID NO: 59066 - RNA, 27 nt, Human
aguuaggaauaaaccuauaacauuuac

SEQ ID NO: 59067 - RNA, 22 nt, Human
gacacacagccuuucuguauca

SEQ ID NO: 59068 - RNA, 24 nt, Human
auggaggaaaaaugacuaaggacu

SEQ ID NO: 59069 - RNA, 24 nt, Human
ggccuauuuucucagcugcccucu

SEQ ID NO: 59070 - RNA, 26 nt, Human
gaggcugaagagugaggacucuucag

SEQ ID NO: 59071 - RNA, 21 nt, Human
gcuccugggucguaggcacag

SEQ ID NO: 59072 - RNA, 26 nt, Human
gguacccgggaccccagcccggccgc

SEQ ID NO: 59073 - RNA, 22 nt, Human
uuccaucucugguaaaguuaca

SEQ ID NO: 59074 - RNA, 25 nt, Human
gcauuagaaucugguuuuucugugc

SEQ ID NO: 59075 - RNA, 24 nt, Human
auggcuacacugcaacuuccgucc

SEQ ID NO: 59076 - RNA, 28 nt, Human
ugagcccgggaagcagagguugcaguga

SEQ ID NO: 59077 - RNA, 28 nt, Human
cugccuugcaggaccugccuggagguuc

SEQ ID NO: 59078 - RNA, 27 nt, Human
uuguuuuacauuguugcugcacuggca

SEQ ID NO: 59079 - RNA, 19 nt, Human
cccagguuggagugcagug

SEQ ID NO: 59080 - RNA, 26 nt, Human
gaugccacuuugcagcuaaaauaagc

SEQ ID NO: 59081 - RNA, 27 nt, Human
aaguugggacugagcagcugggagcag

SEQ ID NO: 59082 - RNA, 17 nt, Human
aaaugaacuugcuugug

SEQ ID NO: 59083 - RNA, 23 nt, Human
gaggaagaggcugcacugcagcc

SEQ ID NO: 59084 - RNA, 20 nt, Human
gguaacaacagagugucaga

SEQ ID NO: 59085 - RNA, 23 nt, Human
uuuaacauaucuucacuguaguc

SEQ ID NO: 59086 - RNA, 25 nt, Human
ccaucucucccuccuggugaagugu

SEQ ID NO: 59087 - RNA, 20 nt, Human
ggcugaugucacauugaaaa

SEQ ID NO: 59088 - RNA, 24 nt, Human
caccccacuccagcuccggagcac

SEQ ID NO: 59089 - RNA, 24 nt, Human
cugacuguagccauuacaguaucc

SEQ ID NO: 59090 - RNA, 21 nt, Human
aggauccccagaaagcuguug

SEQ ID NO: 59091 - RNA, 20 nt, Human
gagcccaagcucuccuccac

SEQ ID NO: 59092 - RNA, 25 nt, Human
augugcagugagccaccauggagga

SEQ ID NO: 59093 - RNA, 22 nt, Human
ggaccagccuguaccuugcugu

SEQ ID NO: 59094 - RNA, 26 nt, Human
aagcuugucuugaacuccuggccuua

SEQ ID NO: 59095 - RNA, 21 nt, Human
uuuucauucucuauuuuugcu

SEQ ID NO: 59096 - RNA, 18 nt, Human
acauucacauccaaagaa

SEQ ID NO: 59097 - RNA, 22 nt, Human
ugaaagggacagcacuguguau

SEQ ID NO: 59098 - RNA, 22 nt, Human
acguccucccgugcgucgggag

SEQ ID NO: 59099 - RNA, 25 nt, Human
ggggugagaggagacaugaggaaag

SEQ ID NO: 59100 - RNA, 21 nt, Human
ugaccagcagcguuuauuuag

SEQ ID NO: 59101 - RNA, 22 nt, Human
ggaaugggaagaagcaguuuac

SEQ ID NO: 59102 - RNA, 20 nt, Human
ugucccugcuucuuuucuga

SEQ ID NO: 59103 - RNA, 22 nt, Human
gaguagcugggaugacaggcgu

SEQ ID NO: 59104 - RNA, 20 nt, Human
cuuuguuucuuuauggaacu

SEQ ID NO: 59105 - RNA, 20 nt, Human
ggacaaugcccguugacuug

SEQ ID NO: 59106 - RNA, 24 nt, Human
cgugaucuuggcuuacugcagccu

SEQ ID NO: 59107 - RNA, 22 nt, Human
caguugagccuaagguccuucu

SEQ ID NO: 59108 - RNA, 20 nt, Human
ccaccacuuucccugcucug

SEQ ID NO: 59109 - RNA, 19 nt, Human
uacuucagaaaccaaauca

SEQ ID NO: 59110 - RNA, 25 nt, Human
acuguguucugggccugcugaggau

SEQ ID NO: 59111 - RNA, 26 nt, Human
uuucaguuugcaaaaucacugcccag

SEQ ID NO: 59112 - RNA, 21 nt, Human
ccaccaccaccucuugccccc

SEQ ID NO: 59113 - RNA, 27 nt, Human
cacugcacuccagccugggcagcagag

SEQ ID NO: 59114 - RNA, 20 nt, Human
aguccucugcuaguuaagcu

SEQ ID NO: 59115 - RNA, 24 nt, Human
uacuguacuucaucuuacuugcca

SEQ ID NO: 59116 - RNA, 25 nt, Human
auucauacagaccucuugagcuccu

SEQ ID NO: 59117 - RNA, 22 nt, Human
gagcuccugggaacagguggug

SEQ ID NO: 59118 - RNA, 21 nt, Human
caggaggcggagguuguagug

SEQ ID NO: 59119 - RNA, 21 nt, Human
cgggaggcggagguuguggug

SEQ ID NO: 59120 - RNA, 24 nt, Human
agagaauugguugaacccgggagg

SEQ ID NO: 59121 - RNA, 21 nt, Human
uucaaccagaguuccaaccaa

SEQ ID NO: 59122 - RNA, 27 nt, Human
ggagaauugggugcgagaugugguuuc

SEQ ID NO: 59123 - RNA, 20 nt, Human
caaaacaaaauaggugaggg

SEQ ID NO: 59124 - RNA, 18 nt, Human
gggcucccuccuuguagc

SEQ ID NO: 59125 - RNA, 23 nt, Human
gaggaccuggacucagagccaga

SEQ ID NO: 59126 - RNA, 22 nt, Human
ucugcugcucaaaaauaaucgu

SEQ ID NO: 59127 - RNA, 22 nt, Human
gccucccgggguggggagggag

SEQ ID NO: 59128 - RNA, 20 nt, Human
gcuuaagaaaacauugccau

SEQ ID NO: 59129 - RNA, 19 nt, Human
gcaaauaaaacugaccuca

SEQ ID NO: 59130 - RNA, 27 nt, Human
cuauucuaacgcaaaaccacuaacuga

SEQ ID NO: 59131 - RNA, 20 nt, Human
uuucaagccuacuuaccuuu

SEQ ID NO: 59132 - RNA, 21 nt, Human
ccagcaauagaucucauuuuc

SEQ ID NO: 59133 - RNA, 21 nt, Human
ggagccugccugguggaguug

SEQ ID NO: 59134 - RNA, 27 nt, Human
gggagagaaacagagacucagggagag

SEQ ID NO: 59135 - RNA, 23 nt, Human
gccagugccuuauuacccaggaa

SEQ ID NO: 59136 - RNA, 22 nt, Human
cgcuuuccugggccucucaguu

SEQ ID NO: 59137 - RNA, 20 nt, Human
ugccucgcugccccaccucc

SEQ ID NO: 59138 - RNA, 21 nt, Human
gggacuugcccuaauucaggu

SEQ ID NO: 59139 - RNA, 22 nt, Human
uggugcacaccuguacucccag

SEQ ID NO: 59140 - RNA, 20 nt, Human
caggaguucgaggcugcagu

SEQ ID NO: 59141 - RNA, 27 nt, Human
guaaaacacaucaggucaggggguuaa

SEQ ID NO: 59142 - RNA, 21 nt, Human
cuccaccucucugugccucag

SEQ ID NO: 59143 - RNA, 22 nt, Human
cccaacaaaguucauuaaccug

SEQ ID NO: 59144 - RNA, 23 nt, Human
uuacccagcuccuggaggcagug

SEQ ID NO: 59145 - RNA, 26 nt, Human
ccuagcuguuagggacauuuccaagc

SEQ ID NO: 59146 - RNA, 24 nt, Human
ccaacaucuucucauaaaagggga

SEQ ID NO: 59147 - RNA, 20 nt, Human
cuggaaaugggaaagggagg

SEQ ID NO: 59148 - RNA, 27 nt, Human
acucuucugggagugcuguucugcuuu

SEQ ID NO: 59149 - RNA, 22 nt, Human
uggcuuuagcuuucaaaccaga

SEQ ID NO: 59150 - RNA, 16 nt, Human
cucaccccugccaccu

SEQ ID NO: 59151 - RNA, 27 nt, Human
uugcuaccugucaacaugaauguuucu

SEQ ID NO: 59152 - RNA, 19 nt, Human
ugguuccucugccuguguc

SEQ ID NO: 59153 - RNA, 20 nt, Human
auuuaaguuguccuuagcuc

SEQ ID NO: 59154 - RNA, 21 nt, Human
uuucagagugcaagacuggga

SEQ ID NO: 59155 - RNA, 22 nt, Human
auugauuuuguucuuuuuucuu

SEQ ID NO: 59156 - RNA, 24 nt, Human
cccacagauugcaucuuuaaauuc

SEQ ID NO: 59157 - RNA, 27 nt, Human
uccugcagguagcagucuccuauuauc

SEQ ID NO: 59158 - RNA, 16 nt, Human
uauaggagcuggugag

SEQ ID NO: 59159 - RNA, 23 nt, Human
uuuuucucccuuuuucccgugcc

SEQ ID NO: 59160 - RNA, 22 nt, Human
cucagccgcccaaguaucuggg

SEQ ID NO: 59161 - RNA, 29 nt, Human
acuguagguucauuucugaaaguagcuug

SEQ ID NO: 59162 - RNA, 21 nt, Human
ccauuuaucugggauuauggu

SEQ ID NO: 59163 - RNA, 23 nt, Human
ggaagggcagaggauaaaugugg

SEQ ID NO: 59164 - RNA, 22 nt, Human
gcacauaccuguaaucccagcu

SEQ ID NO: 59165 - RNA, 27 nt, Human
gagcuaaagagcucugguuuuuccuac

SEQ ID NO: 59166 - RNA, 22 nt, Human
aaggcggggcuccuuccucaaa

SEQ ID NO: 59167 - RNA, 21 nt, Human
cagauguuuaaaauuauucca

SEQ ID NO: 59168 - RNA, 22 nt, Human
acuccccacaggcaauggguuu

SEQ ID NO: 59169 - RNA, 28 nt, Human
ggagggaagacguggcucaggucccgcc

SEQ ID NO: 59170 - RNA, 26 nt, Human
ggcucagaaaccccggaaugguugag

SEQ ID NO: 59171 - RNA, 23 nt, Human
ccagcccugggcaaggaagcuuu

SEQ ID NO: 59172 - RNA, 22 nt, Human
cacuggacuccagccugcguga

SEQ ID NO: 59173 - RNA, 26 nt, Human
ggaaggcaggguuuguauugucaguc

SEQ ID NO: 59174 - RNA, 22 nt, Human
cuaccgguccggccucucucca

SEQ ID NO: 59175 - RNA, 22 nt, Human
gauuguugaaagccaugaggga

SEQ ID NO: 59176 - RNA, 20 nt, Human
uuaugauuuguuugcucuuu

SEQ ID NO: 59177 - RNA, 27 nt, Human
acuaccugagucuuuccaaacgacaag

SEQ ID NO: 59178 - RNA, 28 nt, Human
acagcucagcuaaugaaguacuaauaua

SEQ ID NO: 59179 - RNA, 19 nt, Human
ccugcucugugucuguguu

SEQ ID NO: 59180 - RNA, 20 nt, Human
uucuaaaguagcuuucucca

SEQ ID NO: 59181 - RNA, 23 nt, Human
gcgaguggggccaaggaggcagc

SEQ ID NO: 59182 - RNA, 27 nt, Human
ucagaauccugggaaccugaacacuaa

SEQ ID NO: 59183 - RNA, 18 nt, Human
uucauuucccacuucccc

SEQ ID NO: 59184 - RNA, 22 nt, Human
aguacccaggugagaugugcaa

SEQ ID NO: 59185 - RNA, 27 nt, Human
cccucauuccccucgugugacucucuu

SEQ ID NO: 59186 - RNA, 31 nt, Human
ccugccugccugucucuaguuucucucacau

SEQ ID NO: 59187 - RNA, 20 nt, Human
ccuccugcugugcuggaauu

SEQ ID NO: 59188 - RNA, 23 nt, Human
ccugcuggcagggacuugcagug

SEQ ID NO: 59189 - RNA, 26 nt, Human
uggucuuuuugacuaaccucuuuuau

SEQ ID NO: 59190 - RNA, 20 nt, Human
cugccaggggccugggggug

SEQ ID NO: 59191 - RNA, 20 nt, Human
cauccagcuuuggugcaaug

SEQ ID NO: 59192 - RNA, 20 nt, Human
agggcuugguugagggaacg

SEQ ID NO: 59193 - RNA, 23 nt, Human
acaaaaagcaggaaaaacaaaug

SEQ ID NO: 59194 - RNA, 21 nt, Human
uccaggauuacucccuccucc

SEQ ID NO: 59195 - RNA, 22 nt, Human
gaacccaggagguggaggcugc

SEQ ID NO: 59196 - RNA, 22 nt, Human
gaacucaggaggcggaggcugc

SEQ ID NO: 59197 - RNA, 27 nt, Human
gagacagagggauaaagugaagauggu

SEQ ID NO: 59198 - RNA, 22 nt, Human
gucaucugccccuuccguguug

SEQ ID NO: 59199 - RNA, 23 nt, Human
agaagcccugcuccucuucuccc

SEQ ID NO: 59200 - RNA, 22 nt, Human
uugauacaaaguacagaaaaau

SEQ ID NO: 59201 - RNA, 22 nt, Human
uucauauucuucacugucuucu

SEQ ID NO: 59202 - RNA, 27 nt, Human
ggugaagccugagagcccaaauggcca

SEQ ID NO: 59203 - RNA, 19 nt, Human
uuugcacacccuccagaaa

SEQ ID NO: 59204 - RNA, 18 nt, Human
ccugcucuccccuggacu

SEQ ID NO: 59205 - RNA, 20 nt, Human
cuuucacacuuccaccaccc

SEQ ID NO: 59206 - RNA, 27 nt, Human
cugcuucucauaucacagacuuuaauc

SEQ ID NO: 59207 - RNA, 26 nt, Human
aaagagagugcgcccugcacgccccg

SEQ ID NO: 59208 - RNA, 26 nt, Human
gccgccgcgcaccugccuucgcuccc

SEQ ID NO: 59209 - RNA, 21 nt, Human
uucaaaccucauagcaaccag

SEQ ID NO: 59210 - RNA, 22 nt, Human
gggugacccagugcauccaaca

SEQ ID NO: 59211 - RNA, 23 nt, Human
uccuauucauucuuagcacuuug

SEQ ID NO: 59212 - RNA, 21 nt, Human
cuuguuacauugaucuguaca

SEQ ID NO: 59213 - RNA, 22 nt, Human
ccuugagguucccuugugagcu

SEQ ID NO: 59214 - RNA, 24 nt, Human
guccucugggaugaugggcacugc

SEQ ID NO: 59215 - RNA, 23 nt, Human
gcuccugcugaccuucugcggcu

SEQ ID NO: 59216 - RNA, 25 nt, Human
ggagcccuaaguugucacucaguuu

SEQ ID NO: 59217 - RNA, 27 nt, Human
acaaaaguucccugaaacacgaaacuu

SEQ ID NO: 59218 - RNA, 27 nt, Human
ccuccacugcugggggugagcuguacu

SEQ ID NO: 59219 - RNA, 20 nt, Human
cagagagaccugcugccgga

SEQ ID NO: 59220 - RNA, 23 nt, Human
guuuguguguugucucuugaguu

SEQ ID NO: 59221 - RNA, 22 nt, Human
ugucuugucuuauucccugagg

SEQ ID NO: 59222 - RNA, 26 nt, Human
acucacugcagagcugcugccugcca

SEQ ID NO: 59223 - RNA, 21 nt, Human
cagcucuucaccagaagcuuu

SEQ ID NO: 59224 - RNA, 21 nt, Human
ugguaccaguuucuccucaug

SEQ ID NO: 59225 - RNA, 27 nt, Human
cacgcauuugagcgauugcucugugaa

SEQ ID NO: 59226 - RNA, 19 nt, Human
uucaagcgauucugccucg

SEQ ID NO: 59227 - RNA, 23 nt, Human
acacaguaacuacaaaagguuac

SEQ ID NO: 59228 - RNA, 20 nt, Human
ucccccacuccucgcagguc

SEQ ID NO: 59229 - RNA, 26 nt, Human
uuuuccuccucugccuacagccaggu

SEQ ID NO: 59230 - RNA, 23 nt, Human
uacucuauugauacaauauugug

SEQ ID NO: 59231 - RNA, 27 nt, Human
cgcaaccacacggagcugcagagggcc

SEQ ID NO: 59232 - RNA, 21 nt, Human
cugccgucuugguucaucuca

SEQ ID NO: 59233 - RNA, 25 nt, Human
cccuccuugaacuaggauuguaguc

SEQ ID NO: 59234 - RNA, 21 nt, Human
cugcccugcccucaggcacag

SEQ ID NO: 59235 - RNA, 22 nt, Human
uuugccuauaaacagugaacuu

SEQ ID NO: 59236 - RNA, 24 nt, Human
gaucuuugaaggaguccucaggcc

SEQ ID NO: 59237 - RNA, 24 nt, Human
ccuguuacacuugugcagaaagau

SEQ ID NO: 59238 - RNA, 27 nt, Human
ggccucugcccaagaaauuagcuuuga

SEQ ID NO: 59239 - RNA, 24 nt, Human
ggcucacugcagccuugaacuccu

SEQ ID NO: 59240 - RNA, 24 nt, Human
agguagcauuucccugcagauggu

SEQ ID NO: 59241 - RNA, 22 nt, Human
uuaauauaugccaaaucuuaca

SEQ ID NO: 59242 - RNA, 23 nt, Human
auagcuguccacgcccacguguu

SEQ ID NO: 59243 - RNA, 29 nt, Human
ugcaauacuuagagaaccuauagcaucuu

SEQ ID NO: 59244 - RNA, 26 nt, Human
cuccccuccuuuaccgaggacagccu

SEQ ID NO: 59245 - RNA, 24 nt, Human
cagcagcauccaggcugaccucaa

SEQ ID NO: 59246 - RNA, 26 nt, Human
gggcuggggaaagggaugggagccag

SEQ ID NO: 59247 - RNA, 27 nt, Human
uacccuuucacuguguaucaugcuaag

SEQ ID NO: 59248 - RNA, 20 nt, Human
gaguacuggacaaggaguca

SEQ ID NO: 59249 - RNA, 26 nt, Human
ugggacuagcacagcaucacuucuac

SEQ ID NO: 59250 - RNA, 22 nt, Human
cccgaggcugggacacugugug

SEQ ID NO: 59251 - RNA, 22 nt, Human
ugguaauuguggcuaaauauuu

SEQ ID NO: 59252 - RNA, 31 nt, Human
ccuguucucacucccuguuuuaauucaaccc

SEQ ID NO: 59253 - RNA, 20 nt, Human
ugccaagaggagacuuuaau

SEQ ID NO: 59254 - RNA, 21 nt, Human
augcagccacugucucuuguc

SEQ ID NO: 59255 - RNA, 22 nt, Human
ucuuaugugugucugugucuuc

SEQ ID NO: 59256 - RNA, 24 nt, Human
gacaucaccuuuucgcuuuuucca

SEQ ID NO: 59257 - RNA, 21 nt, Human
aagaccucuggcuuuccugga

SEQ ID NO: 59258 - RNA, 22 nt, Human
ucuggguggauuguguacggag

SEQ ID NO: 59259 - RNA, 25 nt, Human
acacagcuuuaacuaugucaugcaa

SEQ ID NO: 59260 - RNA, 22 nt, Human
aacauagugucugcugcugccu

SEQ ID NO: 59261 - RNA, 22 nt, Human
uguugcccaggcugcagugcag

SEQ ID NO: 59262 - RNA, 22 nt, Human
gaacucuugggcucaagugauc

SEQ ID NO: 59263 - RNA, 21 nt, Human
cuuguccaggcuggagugcaa

SEQ ID NO: 59264 - RNA, 28 nt, Human
ugggagagaguuuuguuuucuuggccgg

SEQ ID NO: 59265 - RNA, 24 nt, Human
caggcuccauccuuccucugugca

SEQ ID NO: 59266 - RNA, 22 nt, Human
gagagccucccugcagccacca

SEQ ID NO: 59267 - RNA, 21 nt, Human
gagcaaaugauuaguuuuaga

SEQ ID NO: 59268 - RNA, 22 nt, Human
acccauucauagcauagcuaga

SEQ ID NO: 59269 - RNA, 22 nt, Human
cucaaagcuaauuuuuuacuaa

SEQ ID NO: 59270 - RNA, 25 nt, Human
gccccuuacuggcucaggucgugag

SEQ ID NO: 59271 - RNA, 21 nt, Human
uggccgggacaugcagcucug

SEQ ID NO: 59272 - RNA, 16 nt, Human
cgcccccgccaccuca

SEQ ID NO: 59273 - RNA, 23 nt, Human
cagagcagcacugggguuugggg

SEQ ID NO: 59274 - RNA, 18 nt, Human
aaaagauuaaaccaaugg

SEQ ID NO: 59275 - RNA, 20 nt, Human
gggcugccacugcacuuagc

SEQ ID NO: 59276 - RNA, 25 nt, Human
ucuagguaucucaagugauaaguaa

SEQ ID NO: 59277 - RNA, 21 nt, Human
uucagaccugcugagacugcu

SEQ ID NO: 59278 - RNA, 21 nt, Human
gacucuggggaagccaggccc

SEQ ID NO: 59279 - RNA, 17 nt, Human
gugccucccccugcugc

SEQ ID NO: 59280 - RNA, 24 nt, Human
acauuauuugcuuuucucaacugc

SEQ ID NO: 59281 - RNA, 19 nt, Human
aagccuccuuuugcuugaa

SEQ ID NO: 59282 - RNA, 20 nt, Human
aaaggaagaaacuagcggug

SEQ ID NO: 59283 - RNA, 27 nt, Human
aauaggagucaugggcguuaguucugu

SEQ ID NO: 59284 - RNA, 22 nt, Human
auggaggugcagggcuugggua

SEQ ID NO: 59285 - RNA, 26 nt, Human
aaaacaauccugcaguuggguuuugu

SEQ ID NO: 59286 - RNA, 24 nt, Human
agggaacuuucugucuucacaagg

SEQ ID NO: 59287 - RNA, 25 nt, Human
cagauuguaagguccuggcggcuga

SEQ ID NO: 59288 - RNA, 23 nt, Human
cugggaggggcgggagggaggug

SEQ ID NO: 59289 - RNA, 21 nt, Human
uguagagaccagcucacugga

SEQ ID NO: 59290 - RNA, 21 nt, Human
acaguccuuuaaauuuugcac

SEQ ID NO: 59291 - RNA, 18 nt, Human
cucccgucuccaucuguc

SEQ ID NO: 59292 - RNA, 27 nt, Human
ucccaggcugagccucagucucccucc

SEQ ID NO: 59293 - RNA, 27 nt, Human
cccugcacucgggccuccuccagccag

SEQ ID NO: 59294 - RNA, 22 nt, Human
aacucuuaauaucagcacagca

SEQ ID NO: 59295 - RNA, 21 nt, Human
uguauacuucagugcucaccc

SEQ ID NO: 59296 - RNA, 24 nt, Human
uuuacccugcucccucucucuguc

SEQ ID NO: 59297 - RNA, 25 nt, Human
cuaccuuuguauucucuccuguacc

SEQ ID NO: 59298 - RNA, 21 nt, Human
cuuuccucugcugucucugca

SEQ ID NO: 59299 - RNA, 22 nt, Human
cccaggaggcauugaggcggcg

SEQ ID NO: 59300 - RNA, 20 nt, Human
uauaugcaugcauguguaua

SEQ ID NO: 59301 - RNA, 20 nt, Human
ggguugggagagagcugugu

SEQ ID NO: 59302 - RNA, 23 nt, Human
ggggugcugggggcagugggcau

SEQ ID NO: 59303 - RNA, 21 nt, Human
ugaaagccauccuacuuuacu

SEQ ID NO: 59304 - RNA, 27 nt, Human
cuucgaucuuggcaccugcggccuccc

SEQ ID NO: 59305 - RNA, 22 nt, Human
agaaggagggguggcaugauga

SEQ ID NO: 59306 - RNA, 24 nt, Human
gugaugauuuguugagccuugcug

SEQ ID NO: 59307 - RNA, 25 nt, Human
cuagcugaccuggagaugcugccug

SEQ ID NO: 59308 - RNA, 19 nt, Human
agcuggaugugguggugca

SEQ ID NO: 59309 - RNA, 23 nt, Human
cgccgcacccggggccuggguga

SEQ ID NO: 59310 - RNA, 24 nt, Human
ccagucuucauucgcaguuuaugg

SEQ ID NO: 59311 - RNA, 21 nt, Human
aguugaguuaagggauggcuu

SEQ ID NO: 59312 - RNA, 20 nt, Human
aaggaaggaggaaugcuuga

SEQ ID NO: 59313 - RNA, 21 nt, Human
gcauuuuucuuacuuuuguaa

SEQ ID NO: 59314 - RNA, 26 nt, Human
gugggggagugagcacuggguuggga

SEQ ID NO: 59315 - RNA, 21 nt, Human
gagggagagaauaaccuggug

SEQ ID NO: 59316 - RNA, 23 nt, Human
gccuguaaucccagcacuucagg

SEQ ID NO: 59317 - RNA, 24 nt, Human
aguugcuaggaacaugugguggga

SEQ ID NO: 59318 - RNA, 22 nt, Human
agauauagaagagugcacuuuu

SEQ ID NO: 59319 - RNA, 27 nt, Human
gagcuaaaugucugucucuaaaggguu

SEQ ID NO: 59320 - RNA, 21 nt, Human
cggggccacuaggcacauggc

SEQ ID NO: 59321 - RNA, 27 nt, Human
ccccaaaacacuaccaugccccagccc

SEQ ID NO: 59322 - RNA, 22 nt, Human
cucauggcccaaccccuuuccu

SEQ ID NO: 59323 - RNA, 23 nt, Human
uauuugacauuuuacauuucaaa

SEQ ID NO: 59324 - RNA, 22 nt, Human
uuugaagccuuuuguuucccuu

SEQ ID NO: 59325 - RNA, 28 nt, Human
agggcagcaccaucucugccuucgaugg

SEQ ID NO: 59326 - RNA, 19 nt, Human
acccuccugagcugggauu

SEQ ID NO: 59327 - RNA, 21 nt, Human
gcauuccaagcagacaaguca

SEQ ID NO: 59328 - RNA, 21 nt, Human
ggagaggcgcccucccuuccu

SEQ ID NO: 59329 - RNA, 21 nt, Human
cuccccaaggugugaaugagg

SEQ ID NO: 59330 - RNA, 19 nt, Human
ucuccaccccuaucuuucc

SEQ ID NO: 59331 - RNA, 19 nt, Human
gcagaaagcugugaaaugu

SEQ ID NO: 59332 - RNA, 21 nt, Human
cagcaucuuggcugucugcua

SEQ ID NO: 59333 - RNA, 22 nt, Human
aagugugguggugcacaccugu

SEQ ID NO: 59334 - RNA, 19 nt, Human
cccuucagaucaucugugc

SEQ ID NO: 59335 - RNA, 21 nt, Human
ccccuagcccaaccaaugcua

SEQ ID NO: 59336 - RNA, 20 nt, Human
ccgcuucuaccugcugcugc

SEQ ID NO: 59337 - RNA, 27 nt, Human
agcuaaaauguuuauugcuguuuuguc

SEQ ID NO: 59338 - RNA, 27 nt, Human
gggcauugggaaacagccuccuccuuu

SEQ ID NO: 59339 - RNA, 27 nt, Human
ggggaaggacguggcucugaagacgga

SEQ ID NO: 59340 - RNA, 26 nt, Human
uggugcgcagguacacugaugcugaa

SEQ ID NO: 59341 - RNA, 19 nt, Human
cagaaagcuaaugauuguu

SEQ ID NO: 59342 - RNA, 24 nt, Human
ggccucucugcagaccucuuccca

SEQ ID NO: 59343 - RNA, 20 nt, Human
uuauccuauuuuuagcaaua

SEQ ID NO: 59344 - RNA, 21 nt, Human
guugccagacuggagugcagu

SEQ ID NO: 59345 - RNA, 21 nt, Human
cuuacugaggggggagugcag

SEQ ID NO: 59346 - RNA, 22 nt, Human
ugacuucugucugccacaugag

SEQ ID NO: 59347 - RNA, 20 nt, Human
gccccucccccuccuucuca

SEQ ID NO: 59348 - RNA, 22 nt, Human
caggaggcggagguuacaguga

SEQ ID NO: 59349 - RNA, 25 nt, Human
uggaagagaaaaguuugugacuugg

SEQ ID NO: 59350 - RNA, 23 nt, Human
gucuacucuuccguucauucaau

SEQ ID NO: 59351 - RNA, 22 nt, Human
gcuucaaauacguuaccuuacu

SEQ ID NO: 59352 - RNA, 19 nt, Human
gugcuuuaauuagagccag

SEQ ID NO: 59353 - RNA, 20 nt, Human
guccucagacuuaaccuucu

SEQ ID NO: 59354 - RNA, 21 nt, Human
auauaggcaugagccacugag

SEQ ID NO: 59355 - RNA, 22 nt, Human
cccgcucccagugucuuccugu

SEQ ID NO: 59356 - RNA, 27 nt, Human
auaaagugaacagauuuuauuaaucac

SEQ ID NO: 59357 - RNA, 24 nt, Human
agaaaacaaaauuuuauuuugugc

SEQ ID NO: 59358 - RNA, 27 nt, Human
ggggguuuaaugauuugcucaaaguca

SEQ ID NO: 59359 - RNA, 22 nt, Human
agaccuccuccacucuccaucc

SEQ ID NO: 59360 - RNA, 22 nt, Human
gguuuggggccaugguggaggg

SEQ ID NO: 59361 - RNA, 22 nt, Human
gagcccaggaggucaaggcuau

SEQ ID NO: 59362 - RNA, 24 nt, Human
aaagaagaaggggcgaacugcuug

SEQ ID NO: 59363 - RNA, 23 nt, Human
cccaaguaggauuacaagcaugc

SEQ ID NO: 59364 - RNA, 21 nt, Human
ucugcagcugccacuggugca

SEQ ID NO: 59365 - RNA, 21 nt, Human
ucaggcugagugugguggcuc

SEQ ID NO: 59366 - RNA, 24 nt, Human
ggcacucccuaaccaaaugcuguc

SEQ ID NO: 59367 - RNA, 26 nt, Human
caccuugcccucauugucuucccucu

SEQ ID NO: 59368 - RNA, 22 nt, Human
gaaaugcuggggucccuggugu

SEQ ID NO: 59369 - RNA, 22 nt, Human
accgagcgugugccacuggacc

SEQ ID NO: 59370 - RNA, 20 nt, Human
guauauauuuuuuaacuucc

SEQ ID NO: 59371 - RNA, 21 nt, Human
cugagugccuggccaaaggga

SEQ ID NO: 59372 - RNA, 21 nt, Human
aacauguaucugucuacuuuc

SEQ ID NO: 59373 - RNA, 26 nt, Human
cagggagggaaggaggggagggaaaa

SEQ ID NO: 59374 - RNA, 20 nt, Human
uauuacacaaccaacaaaac

SEQ ID NO: 59375 - RNA, 20 nt, Human
ccagcccagaacaggggugg

SEQ ID NO: 59376 - RNA, 21 nt, Human
gccacugcagugacuuugggc

SEQ ID NO: 59377 - RNA, 27 nt, Human
cuccugggacugcaccagacugcucca

SEQ ID NO: 59378 - RNA, 27 nt, Human
ggucucaaucuccugaccuugugaacc

SEQ ID NO: 59379 - RNA, 27 nt, Human
ggucucaaacuccugaccuugugaucc

SEQ ID NO: 59380 - RNA, 31 nt, Human
cccugcccuccugaagccucaguccuucacc

SEQ ID NO: 59381 - RNA, 20 nt, Human
gggaggcuucacuaaaugag

SEQ ID NO: 59382 - RNA, 20 nt, Human
ggagggagggagggaguugg

SEQ ID NO: 59383 - RNA, 22 nt, Human
caacauaucuaugcagagggug

SEQ ID NO: 59384 - RNA, 18 nt, Human
gcccucuguucaguaaca

SEQ ID NO: 59385 - RNA, 27 nt, Human
gccagugcucaagguuacugggagugu

SEQ ID NO: 59386 - RNA, 27 nt, Human
gggccccccaucagcgaugugucuuca

SEQ ID NO: 59387 - RNA, 22 nt, Human
cagcccaggccuggucugggag

SEQ ID NO: 59388 - RNA, 24 nt, Human
caggcagccugucuggguuccuga

SEQ ID NO: 59389 - RNA, 23 nt, Human
agaggggguggccuugaggcaga

SEQ ID NO: 59390 - RNA, 26 nt, Human
gguguggaagucagugacuuggugac

SEQ ID NO: 59391 - RNA, 23 nt, Human
gcgaggacgaggcagaagucagc

SEQ ID NO: 59392 - RNA, 17 nt, Human
cccccuaaacauucaua

SEQ ID NO: 59393 - RNA, 26 nt, Human
cuggagcauugaggccggacccucgc

SEQ ID NO: 59394 - RNA, 20 nt, Human
agccugagggaggaggcagg

SEQ ID NO: 59395 - RNA, 21 nt, Human
uggaggcggagguugcauuga

SEQ ID NO: 59396 - RNA, 20 nt, Human
gaguagcacauuaaagugau

SEQ ID NO: 59397 - RNA, 17 nt, Human
ccucuucucccugcccu

SEQ ID NO: 59398 - RNA, 24 nt, Human
gcuguuguguccugccauucuccu

SEQ ID NO: 59399 - RNA, 26 nt, Human
ccucugcucugcucccgggcuaggag

SEQ ID NO: 59400 - RNA, 24 nt, Human
aucacagcaaggcuuuugugccuu

SEQ ID NO: 59401 - RNA, 22 nt, Human
guugcccaggcugaucuugaac

SEQ ID NO: 59402 - RNA, 27 nt, Human
auucuauuaugaguuuagcagucuuuu

SEQ ID NO: 59403 - RNA, 25 nt, Human
uaugcuaaaauacauuuauggucuu

SEQ ID NO: 59404 - RNA, 22 nt, Human
ccaugucggcucugccugcagu

SEQ ID NO: 59405 - RNA, 25 nt, Human
uuugaaaacuuccuuuuuuauuagu

SEQ ID NO: 59406 - RNA, 21 nt, Human
gguagagugugccugaagucc

SEQ ID NO: 59407 - RNA, 21 nt, Human
ggcugcgcacagggagcuguc

SEQ ID NO: 59408 - RNA, 19 nt, Human
gacuuacacucaagcaauc

SEQ ID NO: 59409 - RNA, 23 nt, Human
augaacacaugcacaugugcaca

SEQ ID NO: 59410 - RNA, 25 nt, Human
ggcgagccaggguggagaagagcca

SEQ ID NO: 59411 - RNA, 22 nt, Human
ugucucccaggcuggaggucag

SEQ ID NO: 59412 - RNA, 22 nt, Human
cuugcuguuccaccuucccuca

SEQ ID NO: 59413 - RNA, 27 nt, Human
gaccagccucggcaacaugccaagacc

SEQ ID NO: 59414 - RNA, 19 nt, Human
acagucccagcacauuucc

SEQ ID NO: 59415 - RNA, 25 nt, Human
auggcggaggcugugccaggggacc

SEQ ID NO: 59416 - RNA, 18 nt, Human
acacauauacaaauguau

SEQ ID NO: 59417 - RNA, 26 nt, Human
uccagcccagguggucucaaucauca

SEQ ID NO: 59418 - RNA, 25 nt, Human
uggccucuccugcugcugaccugau

SEQ ID NO: 59419 - RNA, 21 nt, Human
uuagagaggggagggagagag

SEQ ID NO: 59420 - RNA, 21 nt, Human
ugcugguggguuuuuguuuaa

SEQ ID NO: 59421 - RNA, 23 nt, Human
gaaguuauuaauaucauaaguua

SEQ ID NO: 59422 - RNA, 22 nt, Human
gggauuacaggcgugagucacc

SEQ ID NO: 59423 - RNA, 23 nt, Human
cugcgugcuuucucccuuccguc

SEQ ID NO: 59424 - RNA, 24 nt, Human
cucuggcuuccuuucauugucuua

SEQ ID NO: 59425 - RNA, 23 nt, Human
cugugccaugugccagguuuuug

SEQ ID NO: 59426 - RNA, 21 nt, Human
aaacucuguuuacaugggugg

SEQ ID NO: 59427 - RNA, 21 nt, Human
caauggauuuucaaccagaua

SEQ ID NO: 59428 - RNA, 21 nt, Human
ccugcaggcguucucucucua

SEQ ID NO: 59429 - RNA, 21 nt, Human
gacagagaucuuccacauccc

SEQ ID NO: 59430 - RNA, 20 nt, Human
aauaacaacagacaauauuu

SEQ ID NO: 59431 - RNA, 27 nt, Human
uuuccaaagucauuucauuaaagauga

SEQ ID NO: 59432 - RNA, 27 nt, Human
uugccuaggcuggcgucgagacuugag

SEQ ID NO: 59433 - RNA, 21 nt, Human
ccucaacuccagccaccugcc

SEQ ID NO: 59434 - RNA, 20 nt, Human
aaaucacugaaaauagaaca

SEQ ID NO: 59435 - RNA, 21 nt, Human
gucaaaggggagcacuccuug

SEQ ID NO: 59436 - RNA, 20 nt, Human
uucugugagcucugguguca

SEQ ID NO: 59437 - RNA, 21 nt, Human
uuguauauuuaaaugcuuacc

SEQ ID NO: 59438 - RNA, 21 nt, Human
ccagccuggccaacauggugu

SEQ ID NO: 59439 - RNA, 23 nt, Human
gccuguaaucccaguuagucggg

SEQ ID NO: 59440 - RNA, 23 nt, Human
ccuccucccuuucugggcuucca

SEQ ID NO: 59441 - RNA, 27 nt, Human
agcauuuuucauauucuucacugucuu

SEQ ID NO: 59442 - RNA, 25 nt, Human
ccuucacugcugacccagaggggcu

SEQ ID NO: 59443 - RNA, 19 nt, Human
ggaugaagggaugcaguga

SEQ ID NO: 59444 - RNA, 26 nt, Human
ccugcagggccucugucaauuguacg

SEQ ID NO: 59445 - RNA, 21 nt, Human
aguaauaaacuuugccaacca

SEQ ID NO: 59446 - RNA, 21 nt, Human
ugcccccuccccuccuuuacc

SEQ ID NO: 59447 - RNA, 26 nt, Human
uggggaggggcagggggagaggcccc

SEQ ID NO: 59448 - RNA, 21 nt, Human
aggaaagaggaagcaaauaga

SEQ ID NO: 59449 - RNA, 22 nt, Human
ugggccuuuuguucaauugugu

SEQ ID NO: 59450 - RNA, 23 nt, Human
cguuuccuucugccuccgggauu

SEQ ID NO: 59451 - RNA, 23 nt, Human
ccuccccagccugcgccugcugc

SEQ ID NO: 59452 - RNA, 18 nt, Human
aguaaagccucucccagg

SEQ ID NO: 59453 - RNA, 22 nt, Human
gcucacuguaaccucugccucc

SEQ ID NO: 59454 - RNA, 23 nt, Human
aaacauugcaaccaaaaagguca

SEQ ID NO: 59455 - RNA, 19 nt, Human
aggcaaggcccugcccugc

SEQ ID NO: 59456 - RNA, 21 nt, Human
acacuggcucugggacuugca

SEQ ID NO: 59457 - RNA, 23 nt, Human
ggcauugugaggaacugugcaaa

SEQ ID NO: 59458 - RNA, 24 nt, Human
cuccacccccuccugucaccggcc

SEQ ID NO: 59459 - RNA, 18 nt, Human
cugccuggcagaggcugc

SEQ ID NO: 59460 - RNA, 22 nt, Human
uccgccaccggcuuccuccucc

SEQ ID NO: 59461 - RNA, 30 nt, Human
uugauuagggcaauggagugcauaaauuag

SEQ ID NO: 59462 - RNA, 20 nt, Human
ccucugccucaucuuuccuc

SEQ ID NO: 59463 - RNA, 22 nt, Human
cacuacucuguccucugccugu

SEQ ID NO: 59464 - RNA, 23 nt, Human
aaggagagagggucaggagccag

SEQ ID NO: 59465 - RNA, 21 nt, Human
aggcagggcccggcagaggaa

SEQ ID NO: 59466 - RNA, 20 nt, Human
uuugacaccagccugggcaa

SEQ ID NO: 59467 - RNA, 21 nt, Human
ccugccuccuuccuccgcgca

SEQ ID NO: 59468 - RNA, 25 nt, Human
agagugagagaguagaagagaaggg

SEQ ID NO: 59469 - RNA, 22 nt, Human
ccuuucauccugcaaaaagccc

SEQ ID NO: 59470 - RNA, 22 nt, Human
cgcccaggcuggagugcaaugg

SEQ ID NO: 59471 - RNA, 22 nt, Human
ggacuccugccgcagugaucaa

SEQ ID NO: 59472 - RNA, 21 nt, Human
ucuuuguauuucaaagaaggu

SEQ ID NO: 59473 - RNA, 22 nt, Human
uccuucuggugucagccccaca

SEQ ID NO: 59474 - RNA, 21 nt, Human
cccuuuccaccagugccacag

SEQ ID NO: 59475 - RNA, 19 nt, Human
acucuguggcccaggcugg

SEQ ID NO: 59476 - RNA, 20 nt, Human
cuucgcuguggugacuuuaa

SEQ ID NO: 59477 - RNA, 27 nt, Human
cacaagucauuacuaaguugagcaaaa

SEQ ID NO: 59478 - RNA, 24 nt, Human
ugggguggaagugggguaggggaa

SEQ ID NO: 59479 - RNA, 19 nt, Human
ccaucacccggcagccucu

SEQ ID NO: 59480 - RNA, 27 nt, Human
aaguuugcaaauuaaguuggggagggc

SEQ ID NO: 59481 - RNA, 25 nt, Human
acccuucuccccuuccugguagacc

SEQ ID NO: 59482 - RNA, 25 nt, Human
ugcagagcuauggucccuuucucca

SEQ ID NO: 59483 - RNA, 22 nt, Human
auggagggaaaaaaugaacaga

SEQ ID NO: 59484 - RNA, 26 nt, Human
cacagcuuguacacacugcccccuca

SEQ ID NO: 59485 - RNA, 20 nt, Human
gaggcaaaaggucuauggcu

SEQ ID NO: 59486 - RNA, 24 nt, Human
uguuugccaggcugauugaagcag

SEQ ID NO: 59487 - RNA, 20 nt, Human
uccuugcccagacuacaggg

SEQ ID NO: 59488 - RNA, 21 nt, Human
cuugugcuggcccugcaaugu

SEQ ID NO: 59489 - RNA, 22 nt, Human
cuuccccuaaugccuaucugac

SEQ ID NO: 59490 - RNA, 28 nt, Human
ugcuguguccaacuccaguaccuggagc

SEQ ID NO: 59491 - RNA, 21 nt, Human
ugcgcccaggcugguaugcag

SEQ ID NO: 59492 - RNA, 23 nt, Human
ucguacuugaacucacucccuca

SEQ ID NO: 59493 - RNA, 20 nt, Human
ugccucugguggcugggauu

SEQ ID NO: 59494 - RNA, 20 nt, Human
cuuucuuccuccuuggguug

SEQ ID NO: 59495 - RNA, 26 nt, Human
acaagauguugaggcgagcagggcag

SEQ ID NO: 59496 - RNA, 23 nt, Human
acagggcugaaaggggcuuuugu

SEQ ID NO: 59497 - RNA, 21 nt, Human
ccagcaccugcgggagcugca

SEQ ID NO: 59498 - RNA, 29 nt, Human
uccccaggggguacucuggagugagcagu

SEQ ID NO: 59499 - RNA, 21 nt, Human
ggccauccccucuucuaccuc

SEQ ID NO: 59500 - RNA, 26 nt, Human
acuccucugcugggcuguucauuguc

SEQ ID NO: 59501 - RNA, 26 nt, Human
cgccgccgccucagccuucgccucag

SEQ ID NO: 59502 - RNA, 25 nt, Human
ccaggaauaaauacuuccugaacau

SEQ ID NO: 59503 - RNA, 26 nt, Human
cauucccuggcauaaaaagugcucaa

SEQ ID NO: 59504 - RNA, 23 nt, Human
ccuguccuggcccaggccucugc

SEQ ID NO: 59505 - RNA, 22 nt, Human
uuuuccucucauugcauguuuc

SEQ ID NO: 59506 - RNA, 22 nt, Human
guccacaggccauaacagggua

SEQ ID NO: 59507 - RNA, 18 nt, Human
cuguguaggccaggcugg

SEQ ID NO: 59508 - RNA, 23 nt, Human
ggaggcagacagggugggcuggg

SEQ ID NO: 59509 - RNA, 21 nt, Human
caguuccuaugacacaguuau

SEQ ID NO: 59510 - RNA, 27 nt, Human
cacuugaguuuuuaaaacugugguuaa

SEQ ID NO: 59511 - RNA, 22 nt, Human
ucacccaggcuggagugaucuc

SEQ ID NO: 59512 - RNA, 22 nt, Human
acucacugcaaaaucugccucc

SEQ ID NO: 59513 - RNA, 29 nt, Human
cacugucauucagggccugggucuccagc

SEQ ID NO: 59514 - RNA, 23 nt, Human
ccgucacugccagcgcuugggcu

SEQ ID NO: 59515 - RNA, 27 nt, Human
uguaauuuucucaucagaaaugccuaa

SEQ ID NO: 59516 - RNA, 22 nt, Human
gcugagagugaaagaaaggagg

SEQ ID NO: 59517 - RNA, 22 nt, Human
cucagccucccaagcaacuggg

SEQ ID NO: 59518 - RNA, 25 nt, Human
aucucaguuaucuaaacuagauuag

SEQ ID NO: 59519 - RNA, 26 nt, Human
auuauucucucgaagagcaacuuacg

SEQ ID NO: 59520 - RNA, 25 nt, Human
uggauuacagguguaagccaucaca

SEQ ID NO: 59521 - RNA, 22 nt, Human
ucgccuguaaucucagcacuuu

SEQ ID NO: 59522 - RNA, 26 nt, Human
cuuguaaucccagcacuuugaggugg

SEQ ID NO: 59523 - RNA, 23 nt, Human
guaaucaugugucaggacauaaa

SEQ ID NO: 59524 - RNA, 21 nt, Human
ggucuaggacacaguuccugg

SEQ ID NO: 59525 - RNA, 28 nt, Human
aggagagcuuagggucucaggguguccc

SEQ ID NO: 59526 - RNA, 21 nt, Human
aauccuuccaugaaacguuuu

SEQ ID NO: 59527 - RNA, 20 nt, Human
ugggccaguccauuuuugga

SEQ ID NO: 59528 - RNA, 26 nt, Human
guugcccaggcuggaguucagcggug

SEQ ID NO: 59529 - RNA, 23 nt, Human
cuuaaaccacaccgaggugucua

SEQ ID NO: 59530 - RNA, 28 nt, Human
agacaagccccacacccaccucagcccu

SEQ ID NO: 59531 - RNA, 26 nt, Human
ccuaccagcuccuccagcccugccgg

SEQ ID NO: 59532 - RNA, 23 nt, Human
ggaguuugagaccagugugcaaa

SEQ ID NO: 59533 - RNA, 24 nt, Human
ucugcuuguauuugugauauuuca

SEQ ID NO: 59534 - RNA, 23 nt, Human
uugagccucaguuucucuagcug

SEQ ID NO: 59535 - RNA, 21 nt, Human
ccagaagacccaggcagugua

SEQ ID NO: 59536 - RNA, 27 nt, Human
ugggugaggaagcagagcucucgguac

SEQ ID NO: 59537 - RNA, 26 nt, Human
ccauuuuaguguugaggaaaacgagg

SEQ ID NO: 59538 - RNA, 23 nt, Human
ucaugcaaauucuauauuuuaca

SEQ ID NO: 59539 - RNA, 27 nt, Human
aacacaaaugcucaaagaaaucuacua

SEQ ID NO: 59540 - RNA, 26 nt, Human
cugccugguucagccucuucgcugac

SEQ ID NO: 59541 - RNA, 20 nt, Human
ccugcagcauaacacagacc

SEQ ID NO: 59542 - RNA, 21 nt, Human
aacauuuuuggggcucagcca

SEQ ID NO: 59543 - RNA, 21 nt, Human
ucucucuacucccacccacac

SEQ ID NO: 59544 - RNA, 21 nt, Human
gcauuuucuuaucugaucaca

SEQ ID NO: 59545 - RNA, 24 nt, Human
gccagcaccaggcacugcuuucac

SEQ ID NO: 59546 - RNA, 22 nt, Human
gucacauuggcaaagggagaac

SEQ ID NO: 59547 - RNA, 23 nt, Human
cccugccccuuaaccccaaggac

SEQ ID NO: 59548 - RNA, 25 nt, Human
gagcagcuuuccuggaggaaaaggu

SEQ ID NO: 59549 - RNA, 24 nt, Human
ccagcuacagacccagaggauaag

SEQ ID NO: 59550 - RNA, 26 nt, Human
agccaaauacucuuugugcaagugcc

SEQ ID NO: 59551 - RNA, 21 nt, Human
ccucgccuuccccaccucccc

SEQ ID NO: 59552 - RNA, 21 nt, Human
augcagaugaauuucuuuugg

SEQ ID NO: 59553 - RNA, 20 nt, Human
ugaggaaagggaggagagga

SEQ ID NO: 59554 - RNA, 27 nt, Human
agacagcaucuguucaaagucguaggg

SEQ ID NO: 59555 - RNA, 22 nt, Human
gucugccugugguucaggcuua

SEQ ID NO: 59556 - RNA, 20 nt, Human
uugccucugugcugugugug

SEQ ID NO: 59557 - RNA, 20 nt, Human
gagaggaggagggaggcugu

SEQ ID NO: 59558 - RNA, 23 nt, Human
uacugauuuccagaggaaagcua

SEQ ID NO: 59559 - RNA, 19 nt, Human
acaaggccacgugcugcug

SEQ ID NO: 59560 - RNA, 23 nt, Human
acagaaacauggcagauagguau

SEQ ID NO: 59561 - RNA, 23 nt, Human
ugcacuuuuuuguaguuuuuugu

SEQ ID NO: 59562 - RNA, 18 nt, Human
acagacugagcaagugga

SEQ ID NO: 59563 - RNA, 22 nt, Human
cacacacauauccaagagcuca

SEQ ID NO: 59564 - RNA, 22 nt, Human
uguaauuuaauuuaggacacau

SEQ ID NO: 59565 - RNA, 21 nt, Human
uuguagaaggguuauauuuua

SEQ ID NO: 59566 - RNA, 27 nt, Human
uuuucauuuuauguuuuuguacucugc

SEQ ID NO: 59567 - RNA, 26 nt, Human
cuccccucugucuggggcaggguggg

SEQ ID NO: 59568 - RNA, 24 nt, Human
gcacauuuacuccuaacuacacac

SEQ ID NO: 59569 - RNA, 23 nt, Human
ugaaacgccacaaaaauagagaa

SEQ ID NO: 59570 - RNA, 20 nt, Human
ggcucacugucuuacaauca

SEQ ID NO: 59571 - RNA, 21 nt, Human
ucaggagguugaggcagcaga

SEQ ID NO: 59572 - RNA, 21 nt, Human
aggcuuaauaaaaaugacaga

SEQ ID NO: 59573 - RNA, 21 nt, Human
gcuccucggcagagcugccuc

SEQ ID NO: 59574 - RNA, 23 nt, Human
cuuaccuccucuucccccauuaa

SEQ ID NO: 59575 - RNA, 20 nt, Human
ggcagggguggcugccucau

SEQ ID NO: 59576 - RNA, 22 nt, Human
aaccuccugggcucaagcaacc

SEQ ID NO: 59577 - RNA, 25 nt, Human
gccuaggcuggaggacaguggcaca

SEQ ID NO: 59578 - RNA, 24 nt, Human
uagggaggcugagccaggaggauc

SEQ ID NO: 59579 - RNA, 21 nt, Human
agggaaagaauaccucaggaa

SEQ ID NO: 59580 - RNA, 20 nt, Human
gccagugcucugcgcaggau

SEQ ID NO: 59581 - RNA, 21 nt, Human
aacaguguugaauucaacuga

SEQ ID NO: 59582 - RNA, 19 nt, Human
ucaagccaaaggucuaaga

SEQ ID NO: 59583 - RNA, 22 nt, Human
gucuugaacuccugaugucagg

SEQ ID NO: 59584 - RNA, 28 nt, Human
gugugaucuauagcaggauggcccaguc

SEQ ID NO: 59585 - RNA, 21 nt, Human
aggaaaggaugcuauuuggua

SEQ ID NO: 59586 - RNA, 24 nt, Human
ugauaguggcuugcaugauggugg

SEQ ID NO: 59587 - RNA, 26 nt, Human
ugggagguggaggaggguugcagcuc

SEQ ID NO: 59588 - RNA, 26 nt, Human
ggcuccugcccguuuuccuacucgag

SEQ ID NO: 59589 - RNA, 21 nt, Human
ccacugcaucagaagcagguu

SEQ ID NO: 59590 - RNA, 21 nt, Human
agaauacaacuugauacuuuu

SEQ ID NO: 59591 - RNA, 21 nt, Human
ggggaggggcgucuggagagg

SEQ ID NO: 59592 - RNA, 27 nt, Human
caggccuggaguaugagcucagcagau

SEQ ID NO: 59593 - RNA, 20 nt, Human
gcagucuuaagaaagaggua

SEQ ID NO: 59594 - RNA, 23 nt, Human
acacagccccaggcuccacacag

SEQ ID NO: 59595 - RNA, 22 nt, Human
aaaauuacaaaaaauuagcugg

SEQ ID NO: 59596 - RNA, 23 nt, Human
aaaccuacagcccagaaacccag

SEQ ID NO: 59597 - RNA, 19 nt, Human
ucccuuaagaagagagaga

SEQ ID NO: 59598 - RNA, 21 nt, Human
aauuuuggggaaggguuugaa

SEQ ID NO: 59599 - RNA, 27 nt, Human
ccugcagcggaucauggugcagcaggc

SEQ ID NO: 59600 - RNA, 22 nt, Human
ccuagaaaagagaaauguaguu

SEQ ID NO: 59601 - RNA, 20 nt, Human
gguucuuaagagucccagcu

SEQ ID NO: 59602 - RNA, 19 nt, Human
cguggaauuccuucauuuc

SEQ ID NO: 59603 - RNA, 19 nt, Human
gucccgaguuccugaaggg

SEQ ID NO: 59604 - RNA, 23 nt, Human
guaaguccaggaccaggcuggga

SEQ ID NO: 59605 - RNA, 22 nt, Human
ccacuuccgccaggccugggug

SEQ ID NO: 59606 - RNA, 22 nt, Human
ucauuuaggcuggaaaaaaguu

SEQ ID NO: 59607 - RNA, 21 nt, Human
gggcagaaucuucacuccagg

SEQ ID NO: 59608 - RNA, 22 nt, Human
agaagcuuccacaaaauuagaa

SEQ ID NO: 59609 - RNA, 22 nt, Human
cccaaguagcugggacuacaug

SEQ ID NO: 59610 - RNA, 24 nt, Human
cgcgucgacgccuucacugccauc

SEQ ID NO: 59611 - RNA, 24 nt, Human
cuuugcaguaggucacccugccaa

SEQ ID NO: 59612 - RNA, 23 nt, Human
aggaggaagaagaggggcagugg

SEQ ID NO: 59613 - RNA, 24 nt, Human
cuuggggaaaagugaggccagucu

SEQ ID NO: 59614 - RNA, 23 nt, Human
guuaagauugcuuggaaaaagaa

SEQ ID NO: 59615 - RNA, 22 nt, Human
cauaggagucuaggauuuugau

SEQ ID NO: 59616 - RNA, 21 nt, Human
cuuugcagggauucuuguccu

SEQ ID NO: 59617 - RNA, 24 nt, Human
aucacaccacuggcacuccagccu

SEQ ID NO: 59618 - RNA, 24 nt, Human
uuuucugcccuuuuccucuccagc

SEQ ID NO: 59619 - RNA, 22 nt, Human
ugauuugcaacuuuucuuguug

SEQ ID NO: 59620 - RNA, 26 nt, Human
ggugccugucacucagcauucccaug

SEQ ID NO: 59621 - RNA, 23 nt, Human
ugcagaggcuuauucaguucuua

SEQ ID NO: 59622 - RNA, 27 nt, Human
ucccaagacugguuuuucuacucucau

SEQ ID NO: 59623 - RNA, 20 nt, Human
gauggugggaugugguuuuc

SEQ ID NO: 59624 - RNA, 24 nt, Human
cuugcuuacuccagccaucugcag

SEQ ID NO: 59625 - RNA, 27 nt, Human
uaaagaauguuuugagcaaugguagca

SEQ ID NO: 59626 - RNA, 21 nt, Human
auugcucuccccucuguggcu

SEQ ID NO: 59627 - RNA, 20 nt, Human
ggauaauuggaaaucugagu

SEQ ID NO: 59628 - RNA, 27 nt, Human
aaccauccacuuaaaaugaaugguaaa

SEQ ID NO: 59629 - RNA, 23 nt, Human
ggacccaggagcugcauggcugu

SEQ ID NO: 59630 - RNA, 22 nt, Human
gaaagcuccuggcaaugcugga

SEQ ID NO: 59631 - RNA, 21 nt, Human
ucugucccucuuugccugugu

SEQ ID NO: 59632 - RNA, 27 nt, Human
ugcagcucuggugacauucucuccacg

SEQ ID NO: 59633 - RNA, 20 nt, Human
uccaaacauucaaagccaau

SEQ ID NO: 59634 - RNA, 22 nt, Human
gucccgggggucuccacucagu

SEQ ID NO: 59635 - RNA, 20 nt, Human
cuuaccccuuccuuugauca

SEQ ID NO: 59636 - RNA, 23 nt, Human
uagacccuucaucucuuacuuga

SEQ ID NO: 59637 - RNA, 26 nt, Human
uggggagggggaagagaaauuuuuau

SEQ ID NO: 59638 - RNA, 26 nt, Human
gguuuguuauaucagggaaaaggagu

SEQ ID NO: 59639 - RNA, 29 nt, Human
gccuucuuuucucccuuuuaauccuggcu

SEQ ID NO: 59640 - RNA, 27 nt, Human
cagcuuuguacaucagcacuguuuuga

SEQ ID NO: 59641 - RNA, 17 nt, Human
ucuuuugccaacccuca

SEQ ID NO: 59642 - RNA, 25 nt, Human
cccaagaaaaucacaucacuaccua

SEQ ID NO: 59643 - RNA, 29 nt, Human
gagucucuaaaucacuguuaguguggcca

SEQ ID NO: 59644 - RNA, 24 nt, Human
cacccagccuucuaaaacacaaug

SEQ ID NO: 59645 - RNA, 24 nt, Human
uguacguuguaauuaccaaaaaga

SEQ ID NO: 59646 - RNA, 26 nt, Human
gauccacauggaggaccuuucugaug

SEQ ID NO: 59647 - RNA, 25 nt, Human
gguagggauagggcaugaucaaagg

SEQ ID NO: 59648 - RNA, 22 nt, Human
ugcaacuucugccucuuggguu

SEQ ID NO: 59649 - RNA, 21 nt, Human
cuggucucgaacuccugggcu

SEQ ID NO: 59650 - RNA, 27 nt, Human
aacaaaaacaaauguguuauccgacgg

SEQ ID NO: 59651 - RNA, 21 nt, Human
ugugcuucucucuggcagcug

SEQ ID NO: 59652 - RNA, 21 nt, Human
aagccuccuacaggaccuggu

SEQ ID NO: 59653 - RNA, 22 nt, Human
gcugcccucaggcuugccugua

SEQ ID NO: 59654 - RNA, 21 nt, Human
cagguaggaccauugcaguga

SEQ ID NO: 59655 - RNA, 21 nt, Human
uaacaacagaagaaaaccuuc

SEQ ID NO: 59656 - RNA, 23 nt, Human
gcuuaaggccuggcucacaggcu

SEQ ID NO: 59657 - RNA, 19 nt, Human
ggaacuuaauguugugcca

SEQ ID NO: 59658 - RNA, 21 nt, Human
uacaaaccaggaauuucuuua

SEQ ID NO: 59659 - RNA, 21 nt, Human
acccccaccccugccuccucc

SEQ ID NO: 59660 - RNA, 21 nt, Human
uugccuauauuccaccugcca

SEQ ID NO: 59661 - RNA, 22 nt, Human
gacugcagggguccacugugag

SEQ ID NO: 59662 - RNA, 22 nt, Human
ccacgcuccaaaccccagggua

SEQ ID NO: 59663 - RNA, 21 nt, Human
ccgggccugguggccccuggg

SEQ ID NO: 59664 - RNA, 21 nt, Human
agagagagucagauuuuggag

SEQ ID NO: 59665 - RNA, 23 nt, Human
uacagcucuccuccagcccuggg

SEQ ID NO: 59666 - RNA, 27 nt, Human
ggggucugauuugcccagccugucuuu

SEQ ID NO: 59667 - RNA, 28 nt, Human
uucuguccccgggagccucagggcucug

SEQ ID NO: 59668 - RNA, 27 nt, Human
ggguccccagagaagacuggcggggac

SEQ ID NO: 59669 - RNA, 23 nt, Human
gauccaguaucuuccucggcuuu

SEQ ID NO: 59670 - RNA, 26 nt, Human
gagcuggugcguugguuucucucaua

SEQ ID NO: 59671 - RNA, 22 nt, Human
aaagucagguacaaauuuccuc

SEQ ID NO: 59672 - RNA, 20 nt, Human
cacacaggcuggagugcagu

SEQ ID NO: 59673 - RNA, 24 nt, Human
uucagccucugcuggcauccugcu

SEQ ID NO: 59674 - RNA, 21 nt, Human
aaagccgccucccccucccag

SEQ ID NO: 59675 - RNA, 20 nt, Human
ggccucgggggcagggcaug

SEQ ID NO: 59676 - RNA, 21 nt, Human
cuccaugcugggucugaggcc

SEQ ID NO: 59677 - RNA, 25 nt, Human
cuggaguccgcgccucccugggacu

SEQ ID NO: 59678 - RNA, 27 nt, Human
uguggguggacaguccuaauggggauc

SEQ ID NO: 59679 - RNA, 27 nt, Human
ugcagugagccaagauugcacacugca

SEQ ID NO: 59680 - RNA, 23 nt, Human
guggcugcaaggcggucaguugc

SEQ ID NO: 59681 - RNA, 27 nt, Human
uugggagagacuuguuuuggaugcccc

SEQ ID NO: 59682 - RNA, 20 nt, Human
aaacagcaaagggaaugcca

SEQ ID NO: 59683 - RNA, 20 nt, Human
uggggugggacagggagggc

SEQ ID NO: 59684 - RNA, 20 nt, Human
ucccugggaucccucuguca

SEQ ID NO: 59685 - RNA, 23 nt, Human
cucaggagaaguuuauucuucca

SEQ ID NO: 59686 - RNA, 24 nt, Human
ccucccucuuucggcugguguaga

SEQ ID NO: 59687 - RNA, 20 nt, Human
aucuacuuucuccaucuucc

SEQ ID NO: 59688 - RNA, 21 nt, Human
agaaaacuuugcuuauuucuu

SEQ ID NO: 59689 - RNA, 29 nt, Human
ggguugugacacaccagcccaggugagag

SEQ ID NO: 59690 - RNA, 26 nt, Human
ugagacaaacguuuccuacauucuuu

SEQ ID NO: 59691 - RNA, 25 nt, Human
ccuucaguuugcuccgcugccuccu

SEQ ID NO: 59692 - RNA, 23 nt, Human
uugagacagagucucacucuguc

SEQ ID NO: 59693 - RNA, 26 nt, Human
ggaggugaggacaagccagagguccu

SEQ ID NO: 59694 - RNA, 19 nt, Human
gggaaucugaaaggggaga

SEQ ID NO: 59695 - RNA, 22 nt, Human
ucgcauauaucaugacacuucu

SEQ ID NO: 59696 - RNA, 21 nt, Human
uagcccaggcuggagugcaau

SEQ ID NO: 59697 - RNA, 27 nt, Human
ggccugccgcggcuuccucauugccag

SEQ ID NO: 59698 - RNA, 18 nt, Human
ugcacuccggccuaggca

SEQ ID NO: 59699 - RNA, 28 nt, Human
gcagcucagccaccacucagugcuucuc

SEQ ID NO: 59700 - RNA, 22 nt, Human
ccuagauugcaccauugcacuc

SEQ ID NO: 59701 - RNA, 22 nt, Human
cgucagcccugacucggcccgg

SEQ ID NO: 59702 - RNA, 21 nt, Human
aacucaagaggacagaggcug

SEQ ID NO: 59703 - RNA, 21 nt, Human
uucucaaguucuaagauucua

SEQ ID NO: 59704 - RNA, 22 nt, Human
caacauagcaaaacccugucuc

SEQ ID NO: 59705 - RNA, 22 nt, Human
caacauagugaaaccccaucuc

SEQ ID NO: 59706 - RNA, 23 nt, Human
gagggaagggaggcgaggcugca

SEQ ID NO: 59707 - RNA, 20 nt, Human
aacugcacuguuuuauuuua

SEQ ID NO: 59708 - RNA, 23 nt, Human
uuggguguccauccuggggcagg

SEQ ID NO: 59709 - RNA, 22 nt, Human
auaagaaaauuuacacuagaga

SEQ ID NO: 59710 - RNA, 18 nt, Human
gcugcugcccugaucuca

SEQ ID NO: 59711 - RNA, 27 nt, Human
cccgaauagcugggauuacagacaggc

SEQ ID NO: 59712 - RNA, 21 nt, Human
gcucacugcaccucugucucc

SEQ ID NO: 59713 - RNA, 24 nt, Human
ugccuggaucucaccagcacuuuc

SEQ ID NO: 59714 - RNA, 22 nt, Human
gaugcugcugccaugaucccuu

SEQ ID NO: 59715 - RNA, 19 nt, Human
aggccagaauugacucuuu

SEQ ID NO: 59716 - RNA, 23 nt, Human
gaaaaacaaaacaaaggcuguuu

SEQ ID NO: 59717 - RNA, 26 nt, Human
guuuuuaaaauaauauuuaacauacg

SEQ ID NO: 59718 - RNA, 21 nt, Human
ggccuguauuagagaucaaga

SEQ ID NO: 59719 - RNA, 22 nt, Human
aggcggaggcaggaggaucgcu

SEQ ID NO: 59720 - RNA, 21 nt, Human
gucuauauuucuaccugggcc

SEQ ID NO: 59721 - RNA, 19 nt, Human
ugggggagggggcagaagu

SEQ ID NO: 59722 - RNA, 28 nt, Human
uccuuuauguguuucuccagaauggugc

SEQ ID NO: 59723 - RNA, 26 nt, Human
ucacucgccacaucuacuuugauagc

SEQ ID NO: 59724 - RNA, 24 nt, Human
caucacauuccagucugaagugcc

SEQ ID NO: 59725 - RNA, 22 nt, Human
agggcagcccuaccucucccau

SEQ ID NO: 59726 - RNA, 25 nt, Human
aagguggcaaaaauuagcuauacug

SEQ ID NO: 59727 - RNA, 27 nt, Human
gggggaucuguuguguacguggagagg

SEQ ID NO: 59728 - RNA, 22 nt, Human
gcuccccacaaugaaauaaagu

SEQ ID NO: 59729 - RNA, 20 nt, Human
cacccaggcuguggugcagu

SEQ ID NO: 59730 - RNA, 23 nt, Human
cccggagaggcaggaucgcagug

SEQ ID NO: 59731 - RNA, 24 nt, Human
uguggccgucaguggaaugcagcu

SEQ ID NO: 59732 - RNA, 22 nt, Human
ugggacuucugccuccauggcu

SEQ ID NO: 59733 - RNA, 20 nt, Human
uaucaaaccacuucugacaa

SEQ ID NO: 59734 - RNA, 21 nt, Human
uguuugucuugagacaggguc

SEQ ID NO: 59735 - RNA, 23 nt, Human
agguacccaccccacuuccuucu

SEQ ID NO: 59736 - RNA, 22 nt, Human
cuuaucuguaaaagguuucucc

SEQ ID NO: 59737 - RNA, 27 nt, Human
ucuccugcccucuccugaucuaacucc

SEQ ID NO: 59738 - RNA, 24 nt, Human
ucagcucuggcauggcugccccgg

SEQ ID NO: 59739 - RNA, 21 nt, Human
ccugccuggagcguuucuagc

SEQ ID NO: 59740 - RNA, 23 nt, Human
acucaacauuuuuugaugugcca

SEQ ID NO: 59741 - RNA, 26 nt, Human
uguacauuauaaaccuucagaagcua

SEQ ID NO: 59742 - RNA, 27 nt, Human
ggcucuaucaguucugacauucuaggc

SEQ ID NO: 59743 - RNA, 23 nt, Human
gagucucuucucagugagggucu

SEQ ID NO: 59744 - RNA, 24 nt, Human
aggaacccagcuagcuggccaggu

SEQ ID NO: 59745 - RNA, 20 nt, Human
gcugccuacagccuggacag

SEQ ID NO: 59746 - RNA, 26 nt, Human
gaggaacucacaauuccagacauaca

SEQ ID NO: 59747 - RNA, 26 nt, Human
ccagaagaacgggcggguuggucccu

SEQ ID NO: 59748 - RNA, 20 nt, Human
gcaguggcacaaucuugccu

SEQ ID NO: 59749 - RNA, 25 nt, Human
ccauugucagaggaggaaacggggu

SEQ ID NO: 59750 - RNA, 23 nt, Human
gaugaaagauacaccacagggug

SEQ ID NO: 59751 - RNA, 27 nt, Human
accagagcucuggaaagaugaucaugu

SEQ ID NO: 59752 - RNA, 27 nt, Human
cgcucugugucauucagguugugcaca

SEQ ID NO: 59753 - RNA, 20 nt, Human
caccauggagcacgguuuaa

SEQ ID NO: 59754 - RNA, 21 nt, Human
ccuugaagccccaggugccac

SEQ ID NO: 59755 - RNA, 22 nt, Human
ccagaucaggagagcaagguca

SEQ ID NO: 59756 - RNA, 27 nt, Human
cccugcagccagccauuuuugcaguuu

SEQ ID NO: 59757 - RNA, 26 nt, Human
ugagccaauaaagcucacacuugggc

SEQ ID NO: 59758 - RNA, 21 nt, Human
ucuguuuuaaauuuaaaacaa

SEQ ID NO: 59759 - RNA, 20 nt, Human
aacaaauucaaguucuuggc

SEQ ID NO: 59760 - RNA, 21 nt, Human
cgcuuuaaccucuuuauuucu

SEQ ID NO: 59761 - RNA, 22 nt, Human
acugcaaccacugccuccaggg

SEQ ID NO: 59762 - RNA, 21 nt, Human
uuugcaaaugauuggauuaaa

SEQ ID NO: 59763 - RNA, 22 nt, Human
cuuuguuguuuuucuuuuugau

SEQ ID NO: 59764 - RNA, 26 nt, Human
ucccucgggggcuuugggaaagcaug

SEQ ID NO: 59765 - RNA, 26 nt, Human
cuucugcugcuacugcugcugccgcu

SEQ ID NO: 59766 - RNA, 26 nt, Human
uccaacaacaguguccacacuaguca

SEQ ID NO: 59767 - RNA, 25 nt, Human
ugguggcacaugccuguaauuccag

SEQ ID NO: 59768 - RNA, 22 nt, Human
cacucccuuaaucuguccgucu

SEQ ID NO: 59769 - RNA, 25 nt, Human
uugcauuguaguaugcauuaauccu

SEQ ID NO: 59770 - RNA, 21 nt, Human
aggggcagggcuggggugggg

SEQ ID NO: 59771 - RNA, 22 nt, Human
ccgggcagcggagguugcagug

SEQ ID NO: 59772 - RNA, 26 nt, Human
gaacugccaauuuuauuucucuugca

SEQ ID NO: 59773 - RNA, 22 nt, Human
ugcagugagucgugauugugcc

SEQ ID NO: 59774 - RNA, 23 nt, Human
agcuggcuuuuggaaaugaauca

SEQ ID NO: 59775 - RNA, 22 nt, Human
acugagcuaacagucucuuagg

SEQ ID NO: 59776 - RNA, 22 nt, Human
gcuuccugaacugggagcaggg

SEQ ID NO: 59777 - RNA, 26 nt, Human
caaaacugagacaagagaauguagua

SEQ ID NO: 59778 - RNA, 25 nt, Human
accuggcuacccccuuccauggccc

SEQ ID NO: 59779 - RNA, 22 nt, Human
ccauggggacgcccucagucua

SEQ ID NO: 59780 - RNA, 28 nt, Human
aggccacagcgugggaacucacuuuccc

SEQ ID NO: 59781 - RNA, 22 nt, Human
caugaucuguacccuucgggag

SEQ ID NO: 59782 - RNA, 22 nt, Human
ugaaggcuguggguucagggag

SEQ ID NO: 59783 - RNA, 23 nt, Human
uuuagcugaucuuccauccucaa

SEQ ID NO: 59784 - RNA, 24 nt, Human
aggccucuccuuucacauuccaga

SEQ ID NO: 59785 - RNA, 27 nt, Human
cugagugugaacagguuugccuacguu

SEQ ID NO: 59786 - RNA, 23 nt, Human
ccuuggggagggggaugccuuca

SEQ ID NO: 59787 - RNA, 20 nt, Human
cuugcagcugcuuagacgcu

SEQ ID NO: 59788 - RNA, 20 nt, Human
uucuuugcuucuccaaccaa

SEQ ID NO: 59789 - RNA, 21 nt, Human
gggcggcggaggcagcgugcg

SEQ ID NO: 59790 - RNA, 21 nt, Human
aacuauucuaucauaacuacc

SEQ ID NO: 59791 - RNA, 22 nt, Human
acuccuggcuuuugcgcuccaa

SEQ ID NO: 59792 - RNA, 22 nt, Human
acccagcaagcagugggccagu

SEQ ID NO: 59793 - RNA, 21 nt, Human
ccgaguagcugggacuacagg

SEQ ID NO: 59794 - RNA, 22 nt, Human
ccuugaacccccucccuguccc

SEQ ID NO: 59795 - RNA, 29 nt, Human
cacucucccucucugggcaugucugcuac

SEQ ID NO: 59796 - RNA, 21 nt, Human
cucagcuucugaagugcauga

SEQ ID NO: 59797 - RNA, 27 nt, Human
aaguagcugggauuacagauugauguu

SEQ ID NO: 59798 - RNA, 19 nt, Human
aaaacaucacuggcgugau

SEQ ID NO: 59799 - RNA, 25 nt, Human
ucucaccccagcuccuuuguguggc

SEQ ID NO: 59800 - RNA, 22 nt, Human
uucuggcacuuuaauggcuuga

SEQ ID NO: 59801 - RNA, 27 nt, Human
cuugucuucuuagcugucaccugccga

SEQ ID NO: 59802 - RNA, 23 nt, Human
guggacacuagccccugcugcug

SEQ ID NO: 59803 - RNA, 25 nt, Human
ggcuuuggagcugucccaccugcac

SEQ ID NO: 59804 - RNA, 23 nt, Human
ccugggaaaaucauuuuuauaga

SEQ ID NO: 59805 - RNA, 23 nt, Human
gucacccaggcugcaguucacug

SEQ ID NO: 59806 - RNA, 24 nt, Human
ugcgccaggcagagcugagggccc

SEQ ID NO: 59807 - RNA, 21 nt, Human
gcucugggagagagcccuuuu

SEQ ID NO: 59808 - RNA, 27 nt, Human
gagggauuggccgcuuggcacaugaca

SEQ ID NO: 59809 - RNA, 23 nt, Human
uuuguagcugccaggcuuucugu

SEQ ID NO: 59810 - RNA, 21 nt, Human
aaaaacacaaauuagccaggc

SEQ ID NO: 59811 - RNA, 21 nt, Human
ucuggagcggcuucaguucag

SEQ ID NO: 59812 - RNA, 19 nt, Human
uugccaggcuggaugcugu

SEQ ID NO: 59813 - RNA, 28 nt, Human
acuuccaccuaccaccuccugcaccccu

SEQ ID NO: 59814 - RNA, 20 nt, Human
cagaccaucaggaaagcuuu

SEQ ID NO: 59815 - RNA, 18 nt, Human
ggcacuagggaucaaaga

SEQ ID NO: 59816 - RNA, 23 nt, Human
aauuuuacauuuuuccucaccau

SEQ ID NO: 59817 - RNA, 22 nt, Human
gguugccucucuugccccuugu

SEQ ID NO: 59818 - RNA, 22 nt, Human
gacuuuccucuuaggaaccugg

SEQ ID NO: 59819 - RNA, 14 nt, Human
ggcuuccugcucca

SEQ ID NO: 59820 - RNA, 20 nt, Human
uggagcagcccugcccagcc

SEQ ID NO: 59821 - RNA, 21 nt, Human
uucauagugauagagugcagu

SEQ ID NO: 59822 - RNA, 20 nt, Human
guggguuagaggaacaaaua

SEQ ID NO: 59823 - RNA, 26 nt, Human
uucaaaccauuguggucuucaagcaa

SEQ ID NO: 59824 - RNA, 27 nt, Human
gcgcuggaucaguccacggcuugggga

SEQ ID NO: 59825 - RNA, 24 nt, Human
gcguggcaaacaagcacacgaaaa

SEQ ID NO: 59826 - RNA, 22 nt, Human
aggcaggggcugggcagagggg

SEQ ID NO: 59827 - RNA, 23 nt, Human
gauucagccccaccuccugcuca

SEQ ID NO: 59828 - RNA, 21 nt, Human
aggacuucucuuuagucaggg

SEQ ID NO: 59829 - RNA, 22 nt, Human
cccagagugcugggauuacagg

SEQ ID NO: 59830 - RNA, 27 nt, Human
cuccagccuccuucuugguugucauag

SEQ ID NO: 59831 - RNA, 17 nt, Human
ccuugcccucuuccuuu

SEQ ID NO: 59832 - RNA, 29 nt, Human
uaccugucccuuggcuaugagcaggcuuu

SEQ ID NO: 59833 - RNA, 27 nt, Human
cacugcacuccacucugggcaacagaa

SEQ ID NO: 59834 - RNA, 20 nt, Human
ucaaagcugcagucagccaa

SEQ ID NO: 59835 - RNA, 23 nt, Human
cuucaaggcccugucaccaccua

SEQ ID NO: 59836 - RNA, 22 nt, Human
ccugcucuccugcacugacccu

SEQ ID NO: 59837 - RNA, 26 nt, Human
acccacugcaaaauuuucuacuggcc

SEQ ID NO: 59838 - RNA, 24 nt, Human
aaacugcugacuaggucauccucu

SEQ ID NO: 59839 - RNA, 24 nt, Human
auuuucccucauuugaguuuacuu

SEQ ID NO: 59840 - RNA, 24 nt, Human
cacagcugcagagacagagaggac

SEQ ID NO: 59841 - RNA, 21 nt, Human
cgcuuggcuccaugcuccuca

SEQ ID NO: 59842 - RNA, 26 nt, Human
ucgcucugucacacaggcuggagugc

SEQ ID NO: 59843 - RNA, 21 nt, Human
gggucugcuuugguuuuugcu

SEQ ID NO: 59844 - RNA, 25 nt, Human
uuugcagcugguaaaaccagaggcu

SEQ ID NO: 59845 - RNA, 21 nt, Human
ccuuaguaguuugcaggcugg

SEQ ID NO: 59846 - RNA, 26 nt, Human
aagccuccacccagccacaucuuggg

SEQ ID NO: 59847 - RNA, 27 nt, Human
uuuagcggagagcacgggaaguguagc

SEQ ID NO: 59848 - RNA, 27 nt, Human
cugccuuggcccugcuuggcugaguca

SEQ ID NO: 59849 - RNA, 21 nt, Human
uucagccuguggcccagcacu

SEQ ID NO: 59850 - RNA, 25 nt, Human
gcuggaauuuuucuccccauggaau

SEQ ID NO: 59851 - RNA, 20 nt, Human
ccacgccacacagcacuacg

SEQ ID NO: 59852 - RNA, 19 nt, Human
uagcucuccaugguccucc

SEQ ID NO: 59853 - RNA, 21 nt, Human
agggucugcgacacucucggg

SEQ ID NO: 59854 - RNA, 27 nt, Human
caggaauaagaagucagacagagacag

SEQ ID NO: 59855 - RNA, 28 nt, Human
gcccacagccucagcauuucuuggagca

SEQ ID NO: 59856 - RNA, 29 nt, Human
ggcuguuuccucgucuguuaagugugaau

SEQ ID NO: 59857 - RNA, 23 nt, Human
ccuagcacagugucuucaacaua

SEQ ID NO: 59858 - RNA, 27 nt, Human
gagacuccacucaggugcacacaucac

SEQ ID NO: 59859 - RNA, 21 nt, Human
cugggucaugugcaucuggug

SEQ ID NO: 59860 - RNA, 22 nt, Human
uuucaugcucucuccugccuuc

SEQ ID NO: 59861 - RNA, 23 nt, Human
cagaguuagcuuuuggacaguua

SEQ ID NO: 59862 - RNA, 27 nt, Human
gcgggcguccggcucugagguggugga

SEQ ID NO: 59863 - RNA, 25 nt, Human
ggagcagggcaggggcugaaagggg

SEQ ID NO: 59864 - RNA, 22 nt, Human
uccucagccuuucuuuuuugcc

SEQ ID NO: 59865 - RNA, 23 nt, Human
auuuaggugaucauacaggacag

SEQ ID NO: 59866 - RNA, 19 nt, Human
ucauucaaaucagugaucu

SEQ ID NO: 59867 - RNA, 22 nt, Human
caguuucaucagcauuacuugg

SEQ ID NO: 59868 - RNA, 22 nt, Human
aaagugcugggauuagaggcau

SEQ ID NO: 59869 - RNA, 25 nt, Human
gcuguucuucaguccuuugucuuuc

SEQ ID NO: 59870 - RNA, 25 nt, Human
agcagaggcuggacucccugguuca

SEQ ID NO: 59871 - RNA, 22 nt, Human
agcuaaaauuaagaguuuuaug

SEQ ID NO: 59872 - RNA, 22 nt, Human
uacuaccaaaauguaacugcua

SEQ ID NO: 59873 - RNA, 21 nt, Human
cagcuccgagcucccucucuc

SEQ ID NO: 59874 - RNA, 22 nt, Human
uucucaccucuaccugucauuc

SEQ ID NO: 59875 - RNA, 27 nt, Human
accagccuggccgggacccggcugugg

SEQ ID NO: 59876 - RNA, 24 nt, Human
aguccugggagaaccucaggcuuc

SEQ ID NO: 59877 - RNA, 21 nt, Human
gaaccuggagacagagguugc

SEQ ID NO: 59878 - RNA, 23 nt, Human
cagaagugccucacuguucucgu

SEQ ID NO: 59879 - RNA, 17 nt, Human
ugaacaacucuuccuuu

SEQ ID NO: 59880 - RNA, 21 nt, Human
ugacucaggcaggcuccaugc

SEQ ID NO: 59881 - RNA, 26 nt, Human
cuuccuggcccugucugccucuguuc

SEQ ID NO: 59882 - RNA, 24 nt, Human
ugaccucagaugacccaccugccu

SEQ ID NO: 59883 - RNA, 22 nt, Human
uuugggaaaagcgagaaacaga

SEQ ID NO: 59884 - RNA, 23 nt, Human
uugcuacaaauuuaugcauuuca

SEQ ID NO: 59885 - RNA, 22 nt, Human
cuucccuugugcacuugggucg

SEQ ID NO: 59886 - RNA, 22 nt, Human
ucaccugcuggagucuuuggug

SEQ ID NO: 59887 - RNA, 25 nt, Human
uuuucaaauucuugcuggucuuagc

SEQ ID NO: 59888 - RNA, 23 nt, Human
uucauucuucuuuagcaaguaca

SEQ ID NO: 59889 - RNA, 19 nt, Human
guacuguacauaaauucca

SEQ ID NO: 59890 - RNA, 20 nt, Human
gucucucaggauggugcucu

SEQ ID NO: 59891 - RNA, 22 nt, Human
cacucaggcuggagcacagugg

SEQ ID NO: 59892 - RNA, 18 nt, Human
gaaaagaaaacuaacccu

SEQ ID NO: 59893 - RNA, 20 nt, Human
uuuuccuuggucuccagugg

SEQ ID NO: 59894 - RNA, 20 nt, Human
augcagguuauaucauucca

SEQ ID NO: 59895 - RNA, 22 nt, Human
uagcuuuauugaagucuucuua

SEQ ID NO: 59896 - RNA, 22 nt, Human
ccaucuuccuaaaagggaccag

SEQ ID NO: 59897 - RNA, 22 nt, Human
gggcagcggagguugcagugag

SEQ ID NO: 59898 - RNA, 21 nt, Human
uguccaaguagcuaggcucca

SEQ ID NO: 59899 - RNA, 24 nt, Human
ccuuccaggaaccuguggacuagg

SEQ ID NO: 59900 - RNA, 23 nt, Human
ucucauuugccagcaaaauaaua

SEQ ID NO: 59901 - RNA, 18 nt, Human
ggaaaagggagaaacuga

SEQ ID NO: 59902 - RNA, 26 nt, Human
gcaucacagcuaacaauugugaaguc

SEQ ID NO: 59903 - RNA, 25 nt, Human
gcauguagcuacaaauauuaaagga

SEQ ID NO: 59904 - RNA, 18 nt, Human
aguauuuuaaaaauaaau

SEQ ID NO: 59905 - RNA, 23 nt, Human
agcggugccacccaaucaugccc

SEQ ID NO: 59906 - RNA, 21 nt, Human
aaauacugaucuaaaugcaag

SEQ ID NO: 59907 - RNA, 22 nt, Human
uugcuguucuugcucagugauu

SEQ ID NO: 59908 - RNA, 28 nt, Human
ucuugaacuccugaccucagguaauccg

SEQ ID NO: 59909 - RNA, 23 nt, Human
gaagcaucuuccagaagugugau

SEQ ID NO: 59910 - RNA, 26 nt, Human
uguccagcaaagaagcaaucagccaa

SEQ ID NO: 59911 - RNA, 22 nt, Human
ucuccuccugcugcccccucgc

SEQ ID NO: 59912 - RNA, 24 nt, Human
caugcaaauaucuauuucuaaacc

SEQ ID NO: 59913 - RNA, 21 nt, Human
ggggaaaacaggcaacguguu

SEQ ID NO: 59914 - RNA, 25 nt, Human
cuaccgucgcuuucuauuucucuuu

SEQ ID NO: 59915 - RNA, 27 nt, Human
agguauuucacuggagaaguuuuaauu

SEQ ID NO: 59916 - RNA, 24 nt, Human
ccuccacccuccuccucuucacca

SEQ ID NO: 59917 - RNA, 22 nt, Human
cgccucucggguucaagcaauu

SEQ ID NO: 59918 - RNA, 23 nt, Human
ccgaacuccagccaccacuuucc

SEQ ID NO: 59919 - RNA, 23 nt, Human
auuaauaccacugagaccuucag

SEQ ID NO: 59920 - RNA, 24 nt, Human
ccccggcuggagugcaguggcaug

SEQ ID NO: 59921 - RNA, 22 nt, Human
uguggcccagaccccagagcag

SEQ ID NO: 59922 - RNA, 17 nt, Human
cuucucuccauccuucg

SEQ ID NO: 59923 - RNA, 20 nt, Human
accaacugcuccugcuggcc

SEQ ID NO: 59924 - RNA, 24 nt, Human
cgcuccgccaccagggcuuggggg

SEQ ID NO: 59925 - RNA, 21 nt, Human
cucaggguaauacuauucaga

SEQ ID NO: 59926 - RNA, 22 nt, Human
cccucccuugguaaaggcacag

SEQ ID NO: 59927 - RNA, 19 nt, Human
uccagcccagcuucccggg

SEQ ID NO: 59928 - RNA, 22 nt, Human
agcauuccuaggaauauuuucc

SEQ ID NO: 59929 - RNA, 21 nt, Human
ucuggcuccccccaccaccuc

SEQ ID NO: 59930 - RNA, 27 nt, Human
augugaucaauuuugacuuaaugugau

SEQ ID NO: 59931 - RNA, 21 nt, Human
augagguugaauuucaugcca

SEQ ID NO: 59932 - RNA, 24 nt, Human
auugagucauugagcaucuguaca

SEQ ID NO: 59933 - RNA, 24 nt, Human
gggggaugcuucaccugcuuauua

SEQ ID NO: 59934 - RNA, 23 nt, Human
guggggguuaagcacuuauuuga

SEQ ID NO: 59935 - RNA, 21 nt, Human
cacaugagaggucugcucaga

SEQ ID NO: 59936 - RNA, 26 nt, Human
cugccccugcccugaggagggccacu

SEQ ID NO: 59937 - RNA, 21 nt, Human
cuguucauuuccucaaaaaga

SEQ ID NO: 59938 - RNA, 22 nt, Human
cugcauacaugggcuccuguca

SEQ ID NO: 59939 - RNA, 23 nt, Human
aggagggcaagggccaugcugaa

SEQ ID NO: 59940 - RNA, 22 nt, Human
ggucucgagcuccugaccucag

SEQ ID NO: 59941 - RNA, 20 nt, Human
cagacuucauguugccaagg

SEQ ID NO: 59942 - RNA, 26 nt, Human
aaccucaauccugggcucaagugauc

SEQ ID NO: 59943 - RNA, 19 nt, Human
auggaaauuuugcuaucaa

SEQ ID NO: 59944 - RNA, 26 nt, Human
gauagcuucagcagaugugauuuguc

SEQ ID NO: 59945 - RNA, 25 nt, Human
ucuugucagaauuggccucagugua

SEQ ID NO: 59946 - RNA, 17 nt, Human
ucuccacccguucugcc

SEQ ID NO: 59947 - RNA, 18 nt, Human
uaaagcuuggagugccuu

SEQ ID NO: 59948 - RNA, 22 nt, Human
uugaccaaccugaaaacugaua

SEQ ID NO: 59949 - RNA, 20 nt, Human
cccuccagggccacugcuug

SEQ ID NO: 59950 - RNA, 21 nt, Human
gccucggccaccaagguguca

SEQ ID NO: 59951 - RNA, 19 nt, Human
ccuuuugucuauuuuugcu

SEQ ID NO: 59952 - RNA, 21 nt, Human
cuguccuuccucucuggacug

SEQ ID NO: 59953 - RNA, 25 nt, Human
gaaguuucaguauuagaugcacuua

SEQ ID NO: 59954 - RNA, 31 nt, Human
ccugcccaccgacgccagccugcuuggauga

SEQ ID NO: 59955 - RNA, 20 nt, Human
uuguuugcacaggacuggug

SEQ ID NO: 59956 - RNA, 23 nt, Human
gggaggcagcuccaacagcuuga

SEQ ID NO: 59957 - RNA, 22 nt, Human
aacaggauuauuacaaggauga

SEQ ID NO: 59958 - RNA, 26 nt, Human
uuuuauaacauacuuugacaacccca

SEQ ID NO: 59959 - RNA, 25 nt, Human
gggcggggagggcugaggucaggga

SEQ ID NO: 59960 - RNA, 24 nt, Human
acugcccagccccugccuggcugc

SEQ ID NO: 59961 - RNA, 22 nt, Human
cuguagucccagcuacauggga

SEQ ID NO: 59962 - RNA, 23 nt, Human
cucaagugauccuccugccuuag

SEQ ID NO: 59963 - RNA, 26 nt, Human
uuucucacuccauccccacccaaaag

SEQ ID NO: 59964 - RNA, 23 nt, Human
augccuaaacagucuuucuguug

SEQ ID NO: 59965 - RNA, 18 nt, Human
uucuaaacuccuuuccug

SEQ ID NO: 59966 - RNA, 20 nt, Human
gcaccucuaaguguugugaa

SEQ ID NO: 59967 - RNA, 27 nt, Human
cauuuaacuccagccuuggguuugacc

SEQ ID NO: 59968 - RNA, 27 nt, Human
cuccgggucacugcuguauauaacucc

SEQ ID NO: 59969 - RNA, 21 nt, Human
ucuuucuuggccgugagccua

SEQ ID NO: 59970 - RNA, 21 nt, Human
gcauuuaacuagcacaaccua

SEQ ID NO: 59971 - RNA, 20 nt, Human
agacacaacagcguggcuua

SEQ ID NO: 59972 - RNA, 22 nt, Human
ugguauuucuuuuuuacacucu

SEQ ID NO: 59973 - RNA, 23 nt, Human
aggugcccaccaccaagcccugc

SEQ ID NO: 59974 - RNA, 23 nt, Human
agauugccacugcacuccagccu

SEQ ID NO: 59975 - RNA, 24 nt, Human
ccuaacauaaguuuucacuguggu

SEQ ID NO: 59976 - RNA, 21 nt, Human
gcuugucacccaguugccuuu

SEQ ID NO: 59977 - RNA, 21 nt, Human
uacuauuuaagcaaucuuuaa

SEQ ID NO: 59978 - RNA, 22 nt, Human
ggaaggaagcauggugugugag

SEQ ID NO: 59979 - RNA, 23 nt, Human
agcauagcaaucaucgaacuugg

SEQ ID NO: 59980 - RNA, 22 nt, Human
caggcuggagugcaauggcagu

SEQ ID NO: 59981 - RNA, 18 nt, Human
ucuuccuugguuuauuga

SEQ ID NO: 59982 - RNA, 21 nt, Human
auuauacuacuacuaauuuuu

SEQ ID NO: 59983 - RNA, 23 nt, Human
ugcagcuccagcuuugugcucug

SEQ ID NO: 59984 - RNA, 21 nt, Human
uuaggaaacauacccaggaag

SEQ ID NO: 59985 - RNA, 21 nt, Human
uuaguuccuuacauauuuuug

SEQ ID NO: 59986 - RNA, 22 nt, Human
acuccaaagccuguuguucuua

SEQ ID NO: 59987 - RNA, 23 nt, Human
uguggggugugggcuggaagcac

SEQ ID NO: 59988 - RNA, 19 nt, Human
aggagccuaagacagcaca

SEQ ID NO: 59989 - RNA, 21 nt, Human
aucuucucauugucuuauagg

SEQ ID NO: 59990 - RNA, 19 nt, Human
cccuggccagaacaucuca

SEQ ID NO: 59991 - RNA, 22 nt, Human
ccuuagacugaccccucaggcc

SEQ ID NO: 59992 - RNA, 26 nt, Human
auacagcugugaagacuugccuuugu

SEQ ID NO: 59993 - RNA, 23 nt, Human
cucgcucgguccggcugccucag

SEQ ID NO: 59994 - RNA, 28 nt, Human
ugcgugcugcgaggugggggacccuggg

SEQ ID NO: 59995 - RNA, 22 nt, Human
ggagcacuuacaaggcuguggu

SEQ ID NO: 59996 - RNA, 23 nt, Human
acuugcuucugccucauccugcc

SEQ ID NO: 59997 - RNA, 22 nt, Human
ggugcucucaccuuaucuggaa

SEQ ID NO: 59998 - RNA, 27 nt, Human
guguucugauuccuucaacuggcuacu

SEQ ID NO: 59999 - RNA, 21 nt, Human
ggauggaggcuccuucaucaa

SEQ ID NO: 60000 - RNA, 26 nt, Human
gcaggguggccaaagaggacuggacu

SEQ ID NO: 60001 - RNA, 29 nt, Human
accucgacuucucagccuccugggguucc

SEQ ID NO: 60002 - RNA, 21 nt, Human
caacagcgagagcuccaucuc

SEQ ID NO: 60003 - RNA, 22 nt, Human
ccacugcacuccggccugggcg

SEQ ID NO: 60004 - RNA, 21 nt, Human
agaggugggauagaggaaggg

SEQ ID NO: 60005 - RNA, 19 nt, Human
aaaagcaaauaccucagug

SEQ ID NO: 60006 - RNA, 22 nt, Human
uguuuaauguaucccuguucug

SEQ ID NO: 60007 - RNA, 22 nt, Human
gggaggcagagguugcagugug

SEQ ID NO: 60008 - RNA, 22 nt, Human
gaggggcugagcaggacgccgc

SEQ ID NO: 60009 - RNA, 23 nt, Human
uugcccagauaaugauaauaaug

SEQ ID NO: 60010 - RNA, 23 nt, Human
ucccauaguuuauuucucucuca

SEQ ID NO: 60011 - RNA, 24 nt, Human
cagaacugcaaccuuuuguaccuu

SEQ ID NO: 60012 - RNA, 23 nt, Human
cucagugagcugccacugagucg

SEQ ID NO: 60013 - RNA, 27 nt, Human
cuccagccuuaagaucuuaggacguuu

SEQ ID NO: 60014 - RNA, 27 nt, Human
ggaggcagggcaggagguuggagcagc

SEQ ID NO: 60015 - RNA, 23 nt, Human
ucuuaacugcaacauauuauuuc

SEQ ID NO: 60016 - RNA, 21 nt, Human
cccaacaauuggagggucuug

SEQ ID NO: 60017 - RNA, 22 nt, Human
cacgccuguaaucccagcacac

SEQ ID NO: 60018 - RNA, 20 nt, Human
gaaagagacagagacuggca

SEQ ID NO: 60019 - RNA, 21 nt, Human
uucuguugaaagacuucagaa

SEQ ID NO: 60020 - RNA, 23 nt, Human
aucuuacaacugagagugaucug

SEQ ID NO: 60021 - RNA, 21 nt, Human
gugugggauggggaggggaga

SEQ ID NO: 60022 - RNA, 22 nt, Human
guuccugaagaaaagaguccag

SEQ ID NO: 60023 - RNA, 29 nt, Human
agacgcaaucuccccucccucccaucccc

SEQ ID NO: 60024 - RNA, 21 nt, Human
agaauucuccuuguaagccuu

SEQ ID NO: 60025 - RNA, 23 nt, Human
ucagaucagagguucgacugugg

SEQ ID NO: 60026 - RNA, 25 nt, Human
cucuucccugccugccuguuccuuc

SEQ ID NO: 60027 - RNA, 22 nt, Human
cccugcaccuguggagcaggag

SEQ ID NO: 60028 - RNA, 21 nt, Human
gcacaauccaugaacagcauu

SEQ ID NO: 60029 - RNA, 21 nt, Human
cagaaacaggacugcucaaau

SEQ ID NO: 60030 - RNA, 22 nt, Human
auugcuugaacaagguaggcag

SEQ ID NO: 60031 - RNA, 27 nt, Human
aagagaagggagcaacuuauccuucag

SEQ ID NO: 60032 - RNA, 23 nt, Human
cacaggcaaacccgugauuuugg

SEQ ID NO: 60033 - RNA, 21 nt, Human
cgggagguggagguugcagug

SEQ ID NO: 60034 - RNA, 22 nt, Human
uugagccaggccucucucaccu

SEQ ID NO: 60035 - RNA, 26 nt, Human
cugucuccuuggaccucuuugauucu

SEQ ID NO: 60036 - RNA, 25 nt, Human
agggaggcagggauggcaaggcgug

SEQ ID NO: 60037 - RNA, 18 nt, Human
ggacccccugcugcucug

SEQ ID NO: 60038 - RNA, 27 nt, Human
gccaggauauggacaucuugggauauc

SEQ ID NO: 60039 - RNA, 22 nt, Human
cuaauacagugaaaccccaugu

SEQ ID NO: 60040 - RNA, 23 nt, Human
cauccccuccauacucagcucuu

SEQ ID NO: 60041 - RNA, 27 nt, Human
cucaaccuucagauucccagggccucu

SEQ ID NO: 60042 - RNA, 21 nt, Human
gggaggcagagguuguaguga

SEQ ID NO: 60043 - RNA, 22 nt, Human
gccuguaaucccagcucuuugg

SEQ ID NO: 60044 - RNA, 20 nt, Human
aguauuccucacaaagggcu

SEQ ID NO: 60045 - RNA, 21 nt, Human
ccaucaucugcuauuucugcc

SEQ ID NO: 60046 - RNA, 20 nt, Human
gauucugccuuucugcugga

SEQ ID NO: 60047 - RNA, 27 nt, Human
ccaucauccaacauuauugagauuguc

SEQ ID NO: 60048 - RNA, 23 nt, Human
ugggcccuuggauacucuucucc

SEQ ID NO: 60049 - RNA, 20 nt, Human
aggaugucucccucaaugga

SEQ ID NO: 60050 - RNA, 21 nt, Human
uguagagauuugagugcaguu

SEQ ID NO: 60051 - RNA, 23 nt, Human
guccuaguggguguuccuguuuc

SEQ ID NO: 60052 - RNA, 21 nt, Human
augugggaaagguggagauac

SEQ ID NO: 60053 - RNA, 21 nt, Human
gggugaucucauuugaaagcu

SEQ ID NO: 60054 - RNA, 22 nt, Human
gcgccuaccaccaugcccagcu

SEQ ID NO: 60055 - RNA, 23 nt, Human
uuuacuaacauacucauucuuca

SEQ ID NO: 60056 - RNA, 20 nt, Human
augaagacucaaaaccaagc

SEQ ID NO: 60057 - RNA, 25 nt, Human
ugcugccugccugucugucucucca

SEQ ID NO: 60058 - RNA, 17 nt, Human
gaaagagaaggggguga

SEQ ID NO: 60059 - RNA, 28 nt, Human
gguccagaaacuccuguuucuccuuagu

SEQ ID NO: 60060 - RNA, 19 nt, Human
uuuggaguguaggugacuu

SEQ ID NO: 60061 - RNA, 19 nt, Human
accauguuaaagaggcguc

SEQ ID NO: 60062 - RNA, 31 nt, Human
ggagaggaagagagaccugcccuguagcgug

SEQ ID NO: 60063 - RNA, 19 nt, Human
cagggaggggaggauaagu

SEQ ID NO: 60064 - RNA, 27 nt, Human
uggcauugaagccucccagacccagcc

SEQ ID NO: 60065 - RNA, 23 nt, Human
ugucaauguuaaucagccccuca

SEQ ID NO: 60066 - RNA, 23 nt, Human
cucauucuugcuaaccuagucua

SEQ ID NO: 60067 - RNA, 21 nt, Human
aaaaacaacuuucuguucuca

SEQ ID NO: 60068 - RNA, 20 nt, Human
ggagagaagguagggguugg

SEQ ID NO: 60069 - RNA, 21 nt, Human
gccccaggucacaaucauucu

SEQ ID NO: 60070 - RNA, 23 nt, Human
agccucggggcccaagccccucc

SEQ ID NO: 60071 - RNA, 20 nt, Human
aggaagagucaacucacuug

SEQ ID NO: 60072 - RNA, 20 nt, Human
ggaaagggacagccucccau

SEQ ID NO: 60073 - RNA, 22 nt, Human
gacagccucaggucuugggggc

SEQ ID NO: 60074 - RNA, 22 nt, Human
guggguggaucaccugagguca

SEQ ID NO: 60075 - RNA, 22 nt, Human
gguaucuguagaaaaccacagc

SEQ ID NO: 60076 - RNA, 27 nt, Human
aggcagagacccuuugccccugccuuu

SEQ ID NO: 60077 - RNA, 22 nt, Human
ccacucucugcuucaucuaaga

SEQ ID NO: 60078 - RNA, 24 nt, Human
ucccaggcuggagugcaaucgcgc

SEQ ID NO: 60079 - RNA, 26 nt, Human
uauaacuugagauuuaagucuuuggg

SEQ ID NO: 60080 - RNA, 23 nt, Human
gcaaacccaccgggauggugggg

SEQ ID NO: 60081 - RNA, 27 nt, Human
cugcugcuucugcuccagccccuuugc

SEQ ID NO: 60082 - RNA, 23 nt, Human
cucauagauggcccugcuuuccc

SEQ ID NO: 60083 - RNA, 16 nt, Human
cggggaggggacgagc

SEQ ID NO: 60084 - RNA, 23 nt, Human
gagaaaguguauguaaacuaccu

SEQ ID NO: 60085 - RNA, 27 nt, Human
guaugucuuuuaaacaguucuaguuuc

SEQ ID NO: 60086 - RNA, 22 nt, Human
caaggcugaguagguccacaaa

SEQ ID NO: 60087 - RNA, 25 nt, Human
gagaucugugaagagagagggcugg

SEQ ID NO: 60088 - RNA, 20 nt, Human
cgagggccgcagggagccag

SEQ ID NO: 60089 - RNA, 22 nt, Human
aacacuuguaauuuuguaucuu

SEQ ID NO: 60090 - RNA, 25 nt, Human
gcccaggccagagugcaguggcgcg

SEQ ID NO: 60091 - RNA, 21 nt, Human
uuucucccucaacugaagggg

SEQ ID NO: 60092 - RNA, 25 nt, Human
acuccucuggagacugagccuugcc

SEQ ID NO: 60093 - RNA, 22 nt, Human
ucagcagggcccuggagagaug

SEQ ID NO: 60094 - RNA, 22 nt, Human
gacuacaggcaugugccaccac

SEQ ID NO: 60095 - RNA, 26 nt, Human
ucucccaccaugcgaugagcauccuu

SEQ ID NO: 60096 - RNA, 23 nt, Human
acggggaccagaacacugguacg

SEQ ID NO: 60097 - RNA, 23 nt, Human
uggcccuaaauacuuucaugucu

SEQ ID NO: 60098 - RNA, 22 nt, Human
gaaaaccuggcucuaagguggg

SEQ ID NO: 60099 - RNA, 25 nt, Human
ucgucacuggaaacuuccucucucg

SEQ ID NO: 60100 - RNA, 27 nt, Human
uaagucaaauccaacggcccggugcgc

SEQ ID NO: 60101 - RNA, 22 nt, Human
cccugcugggugaccucaggcc

SEQ ID NO: 60102 - RNA, 23 nt, Human
gggcuuucagauuucucuuuuua

SEQ ID NO: 60103 - RNA, 20 nt, Human
guguugccauugccucucuc

SEQ ID NO: 60104 - RNA, 19 nt, Human
gauccagcaggggacagga

SEQ ID NO: 60105 - RNA, 25 nt, Human
gugagagcuuccugugcccagcagg

SEQ ID NO: 60106 - RNA, 21 nt, Human
acugcacuccagccugggcaa

SEQ ID NO: 60107 - RNA, 22 nt, Human
guccugggccucagcuucccuu

SEQ ID NO: 60108 - RNA, 21 nt, Human
acaaucagauuagacacuaug

SEQ ID NO: 60109 - RNA, 27 nt, Human
uaagucaaacccuguucaggacgcugu

SEQ ID NO: 60110 - RNA, 21 nt, Human
gcgggguuucgccauguuaca

SEQ ID NO: 60111 - RNA, 26 nt, Human
cuccaaugcugccugggagccagggu

SEQ ID NO: 60112 - RNA, 21 nt, Human
gccccagccccgaggcucaga

SEQ ID NO: 60113 - RNA, 18 nt, Human
uugcccaggcuggagcgc

SEQ ID NO: 60114 - RNA, 21 nt, Human
ccuccuuuugcuccuggaccc

SEQ ID NO: 60115 - RNA, 20 nt, Human
uggacuuuucuuuucuuuuu

SEQ ID NO: 60116 - RNA, 21 nt, Human
gcaguuucaggacuucauuca

SEQ ID NO: 60117 - RNA, 22 nt, Human
ccagcccccaggcagugccuua

SEQ ID NO: 60118 - RNA, 25 nt, Human
cuguguacuucaucuauuuguguac

SEQ ID NO: 60119 - RNA, 20 nt, Human
ccaccuacagucaggccaca

SEQ ID NO: 60120 - RNA, 27 nt, Human
gccaccuugaggcagccuaucccaaug

SEQ ID NO: 60121 - RNA, 25 nt, Human
gcucuuagaccucucccaucaugcc

SEQ ID NO: 60122 - RNA, 27 nt, Human
uuuccccagccucuccuccuugggcag

SEQ ID NO: 60123 - RNA, 20 nt, Human
gcauccucagccucuggugg

SEQ ID NO: 60124 - RNA, 26 nt, Human
ggucuauuguucuggaguguacugug

SEQ ID NO: 60125 - RNA, 22 nt, Human
ucccacuggcuggccucaggcu

SEQ ID NO: 60126 - RNA, 29 nt, Human
ugcugaagggccaaacguuuucugggcau

SEQ ID NO: 60127 - RNA, 22 nt, Human
ggacuccuacaauaaugcuaua

SEQ ID NO: 60128 - RNA, 22 nt, Human
gagcccaggaguucgaggcugc

SEQ ID NO: 60129 - RNA, 23 nt, Human
cugggagcuuggaaaccuggucu

SEQ ID NO: 60130 - RNA, 21 nt, Human
gacaggggauacagaaacuag

SEQ ID NO: 60131 - RNA, 21 nt, Human
cccaaaggagagccaggauuu

SEQ ID NO: 60132 - RNA, 22 nt, Human
agggagggaggggcuggaagau

SEQ ID NO: 60133 - RNA, 25 nt, Human
aggcggauucucuuucucuuucucu

SEQ ID NO: 60134 - RNA, 20 nt, Human
ugacuucuggagaaagcuca

SEQ ID NO: 60135 - RNA, 21 nt, Human
ggacuuaacguccuaaccuca

SEQ ID NO: 60136 - RNA, 21 nt, Human
ggguucugcucugacuccagg

SEQ ID NO: 60137 - RNA, 18 nt, Human
cucuucccucucccugcc

SEQ ID NO: 60138 - RNA, 29 nt, Human
gccagggcagccugaucuccauguggugg

SEQ ID NO: 60139 - RNA, 22 nt, Human
cuuccuuuucagagaacaguua

SEQ ID NO: 60140 - RNA, 22 nt, Human
guaacaucuguuaucaaacugc

SEQ ID NO: 60141 - RNA, 27 nt, Human
auaggguaauaaauagcaugcaucaaa

SEQ ID NO: 60142 - RNA, 21 nt, Human
aaucaugaucacaacugagau

SEQ ID NO: 60143 - RNA, 21 nt, Human
ccguaaguggaucacuugcca

SEQ ID NO: 60144 - RNA, 23 nt, Human
cagccauggccuuccucuccugc

SEQ ID NO: 60145 - RNA, 27 nt, Human
uguuccccuagcacagcuggggugggg

SEQ ID NO: 60146 - RNA, 22 nt, Human
ucaaaugauauuaaaauacaag

SEQ ID NO: 60147 - RNA, 23 nt, Human
ucuccugccgcccccgggaagcg

SEQ ID NO: 60148 - RNA, 22 nt, Human
uggagccacuaggccuggccuc

SEQ ID NO: 60149 - RNA, 32 nt, Human
agucagugguuauuugaaaauuugauuuugau

SEQ ID NO: 60150 - RNA, 22 nt, Human
ccaggacccgacacaccaggcu

SEQ ID NO: 60151 - RNA, 22 nt, Human
auccacugcucgcugccucucc

SEQ ID NO: 60152 - RNA, 22 nt, Human
cccgaguagcugagauuacagg

SEQ ID NO: 60153 - RNA, 25 nt, Human
aucaaagcaucuugcauuaugcaau

SEQ ID NO: 60154 - RNA, 21 nt, Human
ugucacccgaccucagugaag

SEQ ID NO: 60155 - RNA, 20 nt, Human
cuggggagggaggcaggugg

SEQ ID NO: 60156 - RNA, 27 nt, Human
uucauucuccuaucaccugucuugccu

SEQ ID NO: 60157 - RNA, 19 nt, Human
uuuaacaccuuccucgugu

SEQ ID NO: 60158 - RNA, 22 nt, Human
ggaggugggcacacaggggcac

SEQ ID NO: 60159 - RNA, 22 nt, Human
ugccuguauauuccacgcuuug

SEQ ID NO: 60160 - RNA, 21 nt, Human
uccagccugcgggacagagug

SEQ ID NO: 60161 - RNA, 22 nt, Human
cagacagauuaauccagaagca

SEQ ID NO: 60162 - RNA, 24 nt, Human
gaccagaaggccugcuguaaucag

SEQ ID NO: 60163 - RNA, 19 nt, Human
uuuccuguaucauaaaucc

SEQ ID NO: 60164 - RNA, 27 nt, Human
ggcuugacucaggauuuaaaaacugga

SEQ ID NO: 60165 - RNA, 22 nt, Human
ugccuucauuaucaaguccagg

SEQ ID NO: 60166 - RNA, 22 nt, Human
caagaaaagggaucugagaaaa

SEQ ID NO: 60167 - RNA, 22 nt, Human
uucugaccagugacuuacacaa

SEQ ID NO: 60168 - RNA, 21 nt, Human
caccccauuaccacagcugcc

SEQ ID NO: 60169 - RNA, 30 nt, Human
accccuucuguccuuccugccuguuucucu

SEQ ID NO: 60170 - RNA, 25 nt, Human
ugcuguacuccaauuuucuuugcaa

SEQ ID NO: 60171 - RNA, 27 nt, Human
cacugcacgcuggugcugggagcgccu

SEQ ID NO: 60172 - RNA, 22 nt, Human
caggaccugugaauaagggcua

SEQ ID NO: 60173 - RNA, 21 nt, Human
gcgugaucucagcucacucug

SEQ ID NO: 60174 - RNA, 23 nt, Human
uagccaccuggccuaaugcugug

SEQ ID NO: 60175 - RNA, 26 nt, Human
gcacugucauuguaugcaagcauuuu

SEQ ID NO: 60176 - RNA, 25 nt, Human
acgccgccucgucauacgccccucc

SEQ ID NO: 60177 - RNA, 26 nt, Human
cuucagccucuccaaacauguaggag

SEQ ID NO: 60178 - RNA, 21 nt, Human
aaaauaggcuguuacauaucc

SEQ ID NO: 60179 - RNA, 21 nt, Human
acauuuuucuuagggaaggau

SEQ ID NO: 60180 - RNA, 25 nt, Human
cuggaaagacuuuguuuaaaugaaa

SEQ ID NO: 60181 - RNA, 21 nt, Human
uccagcaugcaguuucaaguc

SEQ ID NO: 60182 - RNA, 24 nt, Human
gccccauguagccccagucauccu

SEQ ID NO: 60183 - RNA, 21 nt, Human
aaggauagaggaagugcugcc

SEQ ID NO: 60184 - RNA, 21 nt, Human
guuucaccauguugccaaggc

SEQ ID NO: 60185 - RNA, 21 nt, Human
cauugcacuccagccuagaua

SEQ ID NO: 60186 - RNA, 27 nt, Human
cccugcucucugccugagcucugggcc

SEQ ID NO: 60187 - RNA, 19 nt, Human
cagaagcagaugcaccuga

SEQ ID NO: 60188 - RNA, 22 nt, Human
aguaaucauuucugaugauuug

SEQ ID NO: 60189 - RNA, 28 nt, Human
ccacaggguagcugggaguuggaagagc

SEQ ID NO: 60190 - RNA, 16 nt, Human
ugucucggccaccuca

SEQ ID NO: 60191 - RNA, 19 nt, Human
uacagguaucccagcuuug

SEQ ID NO: 60192 - RNA, 22 nt, Human
ucucugacuucugccuggagac

SEQ ID NO: 60193 - RNA, 21 nt, Human
agaggcucaucccucaguggc

SEQ ID NO: 60194 - RNA, 24 nt, Human
ccugcagcauguacaccgaguguc

SEQ ID NO: 60195 - RNA, 21 nt, Human
agacacuguagucagaccuca

SEQ ID NO: 60196 - RNA, 23 nt, Human
acccccagccaguccgucgaucc

SEQ ID NO: 60197 - RNA, 22 nt, Human
gggcgcugacaccagacuuggg

SEQ ID NO: 60198 - RNA, 22 nt, Human
gugacauagccucauguucugu

SEQ ID NO: 60199 - RNA, 21 nt, Human
cuccagccaggccucuguggc

SEQ ID NO: 60200 - RNA, 23 nt, Human
cacaggcucagggcaaagaagug

SEQ ID NO: 60201 - RNA, 26 nt, Human
agaguagauggugauaaaaagggagg

SEQ ID NO: 60202 - RNA, 21 nt, Human
ccccaacacuguccuucccug

SEQ ID NO: 60203 - RNA, 26 nt, Human
cuuugucuaucacuauggcuggccug

SEQ ID NO: 60204 - RNA, 27 nt, Human
ggggucugaggcccaggacccaccccc

SEQ ID NO: 60205 - RNA, 28 nt, Human
cuuguaacugcugcccccucccuaccuc

SEQ ID NO: 60206 - RNA, 18 nt, Human
cccagccugccugcaugc

SEQ ID NO: 60207 - RNA, 20 nt, Human
guguuucccugugggugggg

SEQ ID NO: 60208 - RNA, 23 nt, Human
aagaggccgcuggggacacuguc

SEQ ID NO: 60209 - RNA, 22 nt, Human
ucuccugggaugacaauuugcu

SEQ ID NO: 60210 - RNA, 19 nt, Human
gagugcucuguuguuuaca

SEQ ID NO: 60211 - RNA, 20 nt, Human
agcucugacucccacgugag

SEQ ID NO: 60212 - RNA, 24 nt, Human
uuuaguauuuuucuuuguuuuaaa

SEQ ID NO: 60213 - RNA, 22 nt, Human
ccggugggcaaugagaucaugu

SEQ ID NO: 60214 - RNA, 26 nt, Human
uuaguaaaaugcugaucaguaaacca

SEQ ID NO: 60215 - RNA, 24 nt, Human
gggggucggguguccgggagccag

SEQ ID NO: 60216 - RNA, 19 nt, Human
uuucccaccucucucccca

SEQ ID NO: 60217 - RNA, 21 nt, Human
acucauguuaagugcaauggc

SEQ ID NO: 60218 - RNA, 21 nt, Human
cuaaucuuaacccugugcugu

SEQ ID NO: 60219 - RNA, 20 nt, Human
cuugguacaggguucauuca

SEQ ID NO: 60220 - RNA, 22 nt, Human
ugucuugccauacuuugucuga

SEQ ID NO: 60221 - RNA, 19 nt, Human
gggguuagagagagcaaga

SEQ ID NO: 60222 - RNA, 26 nt, Human
ucucucugcaaucugcaaauaacucc

SEQ ID NO: 60223 - RNA, 24 nt, Human
gaagccagaaggacaacauaugaa

SEQ ID NO: 60224 - RNA, 25 nt, Human
uaucggguacuuuaacaauauuuca

SEQ ID NO: 60225 - RNA, 27 nt, Human
ggcccggcggaggcggcggugcagcgc

SEQ ID NO: 60226 - RNA, 27 nt, Human
ugcacaucaguaaucucuuggacuuug

SEQ ID NO: 60227 - RNA, 22 nt, Human
uugucaagucagaacagccagg

SEQ ID NO: 60228 - RNA, 24 nt, Human
ggcuggguggggugggugugggga

SEQ ID NO: 60229 - RNA, 23 nt, Human
cccuuaggugagcuucaaucuaa

SEQ ID NO: 60230 - RNA, 24 nt, Human
gauaagaaaacugaggcaagggga

SEQ ID NO: 60231 - RNA, 23 nt, Human
acaccugucgccagguuacuuga

SEQ ID NO: 60232 - RNA, 21 nt, Human
ggcaggccaggauggagccca

SEQ ID NO: 60233 - RNA, 27 nt, Human
ggcugcagauaacagaaaggcuuuuua

SEQ ID NO: 60234 - RNA, 21 nt, Human
ggaaggcaacagucgccagca

SEQ ID NO: 60235 - RNA, 21 nt, Human
gggacccuguccuccucacug

SEQ ID NO: 60236 - RNA, 22 nt, Human
cuccacccccuccaacucugcu

SEQ ID NO: 60237 - RNA, 27 nt, Human
aggcucucuuguauucuuucaccucuu

SEQ ID NO: 60238 - RNA, 21 nt, Human
ccuuguucuuggagggaccau

SEQ ID NO: 60239 - RNA, 25 nt, Human
ccaaacucauccuaaaucucucaca

SEQ ID NO: 60240 - RNA, 22 nt, Human
cagacuucagaccuugaacaaa

SEQ ID NO: 60241 - RNA, 19 nt, Human
uauuuuaaaaauaguccua

SEQ ID NO: 60242 - RNA, 24 nt, Human
uugugcccuuguaccgaugcagcu

SEQ ID NO: 60243 - RNA, 25 nt, Human
ugccuugauaaauauauaugaucau

SEQ ID NO: 60244 - RNA, 22 nt, Human
cucuccaagccccugugggagg

SEQ ID NO: 60245 - RNA, 24 nt, Human
uccaucauccugauuagcauguuu

SEQ ID NO: 60246 - RNA, 23 nt, Human
ggaugccgcggagcacagaguga

SEQ ID NO: 60247 - RNA, 21 nt, Human
ggagagcucaguacagggcag

SEQ ID NO: 60248 - RNA, 24 nt, Human
guagggagggacggggaggggagc

SEQ ID NO: 60249 - RNA, 25 nt, Human
acaugucacauuuagcugugcucag

SEQ ID NO: 60250 - RNA, 23 nt, Human
cacaggucccugagccuugggga

SEQ ID NO: 60251 - RNA, 23 nt, Human
ucaugggagacuuccuucaucac

SEQ ID NO: 60252 - RNA, 22 nt, Human
aaucucaguauuaaaccacauu

SEQ ID NO: 60253 - RNA, 23 nt, Human
gcucccucuuccucuagcugaga

SEQ ID NO: 60254 - RNA, 22 nt, Human
gugugagccacggcacccagcc

SEQ ID NO: 60255 - RNA, 26 nt, Human
cuuuuggagacuggagcuuucuguuc

SEQ ID NO: 60256 - RNA, 26 nt, Human
gcuguucugguuccuccugguaggcu

SEQ ID NO: 60257 - RNA, 26 nt, Human
gguuguuuccccuccuucccagggcc

SEQ ID NO: 60258 - RNA, 24 nt, Human
caauaaaaaauguuagcauuauaa

SEQ ID NO: 60259 - RNA, 25 nt, Human
uggagagcgggacguggcagaggag

SEQ ID NO: 60260 - RNA, 25 nt, Human
cuagccaugugcaaccaaacaccac

SEQ ID NO: 60261 - RNA, 26 nt, Human
auacagacuggcugggccccaccccc

SEQ ID NO: 60262 - RNA, 22 nt, Human
cgcagcccugcccuguccuguc

SEQ ID NO: 60263 - RNA, 25 nt, Human
ugucauugcuuuauagacuguaaga

SEQ ID NO: 60264 - RNA, 20 nt, Human
gaguccgaauccuacuccau

SEQ ID NO: 60265 - RNA, 22 nt, Human
caggaucccagagcuucccagg

SEQ ID NO: 60266 - RNA, 24 nt, Human
uuugagacuaaauacaggcuuaga

SEQ ID NO: 60267 - RNA, 25 nt, Human
gcuggccagggaagcagaggaugug

SEQ ID NO: 60268 - RNA, 20 nt, Human
aaaaggagauaauguuuuua

SEQ ID NO: 60269 - RNA, 21 nt, Human
ggggucuggcaaacaggcugg

SEQ ID NO: 60270 - RNA, 27 nt, Human
ggccacaguggcacuuggguguggcuc

SEQ ID NO: 60271 - RNA, 23 nt, Human
uagccccagcgccagggcacgcg

SEQ ID NO: 60272 - RNA, 28 nt, Human
ccgcggcgcaggagcuucaguggucugg

SEQ ID NO: 60273 - RNA, 24 nt, Human
ggccacaggcaaggggguugcagu

SEQ ID NO: 60274 - RNA, 25 nt, Human
agccuccuagcucccucuugugucc

SEQ ID NO: 60275 - RNA, 21 nt, Human
gaauucaaccugcucugucca

SEQ ID NO: 60276 - RNA, 20 nt, Human
uaccucugaauucaugagag

SEQ ID NO: 60277 - RNA, 20 nt, Human
cucucauuccuuccgugcca

SEQ ID NO: 60278 - RNA, 27 nt, Human
uggacaacauggugaaaccccgucucu

SEQ ID NO: 60279 - RNA, 21 nt, Human
uguauggucuauuccugacag

SEQ ID NO: 60280 - RNA, 27 nt, Human
gcggcuagugccagccacuguguuguc

SEQ ID NO: 60281 - RNA, 26 nt, Human
ggcucucuccuggugccugcaccugc

SEQ ID NO: 60282 - RNA, 21 nt, Human
gucacauacuuccagaagagc

SEQ ID NO: 60283 - RNA, 23 nt, Human
ucagcucuggacccccucccuca

SEQ ID NO: 60284 - RNA, 27 nt, Human
aaaccuaguaaaaccuuguucuauuuu

SEQ ID NO: 60285 - RNA, 24 nt, Human
ucugaagagugagagcauucaugu

SEQ ID NO: 60286 - RNA, 27 nt, Human
ccacacccucccucuacugggagccua

SEQ ID NO: 60287 - RNA, 23 nt, Human
ccaacauggugaaacccccaucu

SEQ ID NO: 60288 - RNA, 20 nt, Human
ucuugccaccacaaguccac

SEQ ID NO: 60289 - RNA, 22 nt, Human
guggagcagagguugucucuga

SEQ ID NO: 60290 - RNA, 28 nt, Human
gcaaggcagggacccacaguggcugccu

SEQ ID NO: 60291 - RNA, 25 nt, Human
uugugcccccuggagcagugggcaa

SEQ ID NO: 60292 - RNA, 23 nt, Human
guagauggguggaguccagaaaa

SEQ ID NO: 60293 - RNA, 20 nt, Human
cacccaggcuggggcgcaau

SEQ ID NO: 60294 - RNA, 22 nt, Human
uaucaucuggcacacaacuguc

SEQ ID NO: 60295 - RNA, 26 nt, Human
ggucuucagcucacaccagccuugag

SEQ ID NO: 60296 - RNA, 20 nt, Human
ccccucuccccgcguggacu

SEQ ID NO: 60297 - RNA, 20 nt, Human
gcaaucagggcagacugccu

SEQ ID NO: 60298 - RNA, 22 nt, Human
cggaggucaagaaagcaguaua

SEQ ID NO: 60299 - RNA, 22 nt, Human
uuaaugccacuuuaaaugucuu

SEQ ID NO: 60300 - RNA, 28 nt, Human
aggcuccccagaggccucuguggccucc

SEQ ID NO: 60301 - RNA, 23 nt, Human
cuugccucccuuacccacccuca

SEQ ID NO: 60302 - RNA, 21 nt, Human
gcacagaugccaucauuuccc

SEQ ID NO: 60303 - RNA, 22 nt, Human
ggggagcgaugagcuguggagg

SEQ ID NO: 60304 - RNA, 20 nt, Human
ugguucugcaugaccuagcc

SEQ ID NO: 60305 - RNA, 25 nt, Human
uugaagccccagguaucccccuucc

SEQ ID NO: 60306 - RNA, 21 nt, Human
uccaccuggaggagguggugc

SEQ ID NO: 60307 - RNA, 26 nt, Human
gcaaguuagagaaucuggcaauggau

SEQ ID NO: 60308 - RNA, 27 nt, Human
ucuguagacaauggcucugacuccccg

SEQ ID NO: 60309 - RNA, 22 nt, Human
gacuacaggcaugugccaccau

SEQ ID NO: 60310 - RNA, 21 nt, Human
guugcaggcccugcuuguggu

SEQ ID NO: 60311 - RNA, 28 nt, Human
cgcagacgcacacuucccccuucauaau

SEQ ID NO: 60312 - RNA, 22 nt, Human
uggcucaccaaaaugugcucaa

SEQ ID NO: 60313 - RNA, 24 nt, Human
cuugcauguuuguaucuaauuucu

SEQ ID NO: 60314 - RNA, 24 nt, Human
ugcccaguccuugcaccucagagu

SEQ ID NO: 60315 - RNA, 22 nt, Human
ucucaggcuggagugcaguggc

SEQ ID NO: 60316 - RNA, 22 nt, Human
cucaucuacuucgggccagcuu

SEQ ID NO: 60317 - RNA, 25 nt, Human
aaaauacccauugccccagaccugg

SEQ ID NO: 60318 - RNA, 21 nt, Human
aacucauaugaucucccuuca

SEQ ID NO: 60319 - RNA, 21 nt, Human
ucuccucucuggauggaaucc

SEQ ID NO: 60320 - RNA, 23 nt, Human
gugcuagauuggaguggggaagu

SEQ ID NO: 60321 - RNA, 26 nt, Human
ccugucaugcuucaagaguuccagcu

SEQ ID NO: 60322 - RNA, 20 nt, Human
agacacaagcucauaauguu

SEQ ID NO: 60323 - RNA, 23 nt, Human
ugaccauaaccacugaagggaau

SEQ ID NO: 60324 - RNA, 22 nt, Human
acuugaaugagcagcacuuugc

SEQ ID NO: 60325 - RNA, 20 nt, Human
gaccccuggccacccccggc

SEQ ID NO: 60326 - RNA, 22 nt, Human
cauugcacuccagccugggcga

SEQ ID NO: 60327 - RNA, 22 nt, Human
caucgcacuccagccuggguga

SEQ ID NO: 60328 - RNA, 22 nt, Human
gugugcgccaccaugcccgacu

SEQ ID NO: 60329 - RNA, 21 nt, Human
acagaaguccacgggcacccu

SEQ ID NO: 60330 - RNA, 16 nt, Human
ggcugcuagcacuugg

SEQ ID NO: 60331 - RNA, 27 nt, Human
uugaggcaggagaaucgcuuaaaccca

SEQ ID NO: 60332 - RNA, 22 nt, Human
aggaugaggcagggcagacaca

SEQ ID NO: 60333 - RNA, 22 nt, Human
cuaauuccccugguuuucuccc

SEQ ID NO: 60334 - RNA, 24 nt, Human
gcugauaggaacaacauucagcuc

SEQ ID NO: 60335 - RNA, 21 nt, Human
uacagucucagauuccugggc

SEQ ID NO: 60336 - RNA, 19 nt, Human
agagguaaacauacuuuca

SEQ ID NO: 60337 - RNA, 26 nt, Human
guucucucuucuugcccuuggcccag

SEQ ID NO: 60338 - RNA, 23 nt, Human
aagcugccugacuccaccuagcu

SEQ ID NO: 60339 - RNA, 26 nt, Human
ucacagucugcuuccauuuccucuca

SEQ ID NO: 60340 - RNA, 23 nt, Human
aagauggggagcucuggaggugu

SEQ ID NO: 60341 - RNA, 27 nt, Human
uauguagaagccuaggaucacagggug

SEQ ID NO: 60342 - RNA, 25 nt, Human
cacauuuucucuguuucucucuccg

SEQ ID NO: 60343 - RNA, 23 nt, Human
gggggaaaaaauuuggaaccaua

SEQ ID NO: 60344 - RNA, 25 nt, Human
ucauccacuuggagugcugcgggga

SEQ ID NO: 60345 - RNA, 25 nt, Human
ccaaggcuggagugcagugacgcga

SEQ ID NO: 60346 - RNA, 21 nt, Human
cuugagagaagaggcagcagc

SEQ ID NO: 60347 - RNA, 23 nt, Human
ccuggagcccagguugcaggugg

SEQ ID NO: 60348 - RNA, 24 nt, Human
cucuccucucaggggcagcaugcu

SEQ ID NO: 60349 - RNA, 24 nt, Human
cucugcucuccugucccuugagcc

SEQ ID NO: 60350 - RNA, 26 nt, Human
uucacaccauucuccugccucagccu

SEQ ID NO: 60351 - RNA, 24 nt, Human
guguuuuuaugacuuuuauacuau

SEQ ID NO: 60352 - RNA, 21 nt, Human
guuccuaagcuggagugcuua

SEQ ID NO: 60353 - RNA, 22 nt, Human
aagaacauuuguuuuuacauua

SEQ ID NO: 60354 - RNA, 22 nt, Human
acagaaucaauagcccagagag

SEQ ID NO: 60355 - RNA, 23 nt, Human
agcugcacugcagggcacgggga

SEQ ID NO: 60356 - RNA, 27 nt, Human
cucuccucccuuucuucccuacaguug

SEQ ID NO: 60357 - RNA, 24 nt, Human
gagcagcuucaugacuacgcggag

SEQ ID NO: 60358 - RNA, 22 nt, Human
auggacgcggcugaaacguguu

SEQ ID NO: 60359 - RNA, 26 nt, Human
caagcagagcugggugggcugagacc

SEQ ID NO: 60360 - RNA, 21 nt, Human
ucugcucuccucuauucucca

SEQ ID NO: 60361 - RNA, 24 nt, Human
gaggaaagcuagaggaucuaguuc

SEQ ID NO: 60362 - RNA, 25 nt, Human
ugcccugaccucugcccccagguag

SEQ ID NO: 60363 - RNA, 23 nt, Human
ggacauuuuccaagcugacucag

SEQ ID NO: 60364 - RNA, 26 nt, Human
auccugugauuccugguggccaguau

SEQ ID NO: 60365 - RNA, 19 nt, Human
cacagcauuucagaugcug

SEQ ID NO: 60366 - RNA, 23 nt, Human
ugaaaaaauacuaccuauaggaa

SEQ ID NO: 60367 - RNA, 17 nt, Human
ggcuagaauagcauuuu

SEQ ID NO: 60368 - RNA, 23 nt, Human
uggaggcugagauaggaggauca

SEQ ID NO: 60369 - RNA, 21 nt, Human
gaaggugagaagcagauuuua

SEQ ID NO: 60370 - RNA, 20 nt, Human
uacaacauaauuuaggcuuc

SEQ ID NO: 60371 - RNA, 17 nt, Human
cugguggcaacagcuca

SEQ ID NO: 60372 - RNA, 22 nt, Human
ucaguagucccugcacagugac

SEQ ID NO: 60373 - RNA, 22 nt, Human
gggcgugggggguugcagcugg

SEQ ID NO: 60374 - RNA, 21 nt, Human
cucggccucccaagugcuggg

SEQ ID NO: 60375 - RNA, 26 nt, Human
cuucccugcugaccuuaguuucaaag

SEQ ID NO: 60376 - RNA, 23 nt, Human
cuacuucucccuugcucccaaag

SEQ ID NO: 60377 - RNA, 24 nt, Human
ggaggcugaggagaaggaggagcg

SEQ ID NO: 60378 - RNA, 27 nt, Human
ucuccaauguuacgcucgcuugccuag

SEQ ID NO: 60379 - RNA, 22 nt, Human
gacucaugggacccuguccucc

SEQ ID NO: 60380 - RNA, 22 nt, Human
cacagccaggcuggagucagug

SEQ ID NO: 60381 - RNA, 25 nt, Human
gccauggccauggcaacaugcucag

SEQ ID NO: 60382 - RNA, 27 nt, Human
cccagaauauauuuguuuuugcaccug

SEQ ID NO: 60383 - RNA, 25 nt, Human
ucuggcugaagauuugaugugguuc

SEQ ID NO: 60384 - RNA, 22 nt, Human
cgauaaccacaggggaagggca

SEQ ID NO: 60385 - RNA, 21 nt, Human
uuuaacaugugugaugugcca

SEQ ID NO: 60386 - RNA, 25 nt, Human
gcccaggcuggagugcaguggugca

SEQ ID NO: 60387 - RNA, 25 nt, Human
acccagguuggagugcaguggugug

SEQ ID NO: 60388 - RNA, 25 nt, Human
gcccaggcuggagugcgguggugcg

SEQ ID NO: 60389 - RNA, 23 nt, Human
gggcuuuggagucagauuuuagu

SEQ ID NO: 60390 - RNA, 27 nt, Human
guagagaggggacugggggacugggag

SEQ ID NO: 60391 - RNA, 22 nt, Human
uuuuauuuaggggaacaugguu

SEQ ID NO: 60392 - RNA, 27 nt, Human
augcauccuggcccacggccugagcaa

SEQ ID NO: 60393 - RNA, 20 nt, Human
ucgagcagucucuggaacac

SEQ ID NO: 60394 - RNA, 21 nt, Human
agauugccacugcacuccagc

SEQ ID NO: 60395 - RNA, 20 nt, Human
aacuauacugcuuugagauc

SEQ ID NO: 60396 - RNA, 21 nt, Human
cccucuauuuuauuuuucuug

SEQ ID NO: 60397 - RNA, 26 nt, Human
accuugugauuuguacuguuugcugc

SEQ ID NO: 60398 - RNA, 20 nt, Human
cucagguuuccggcuacuga

SEQ ID NO: 60399 - RNA, 21 nt, Human
cgagcugagaggagcagguag

SEQ ID NO: 60400 - RNA, 22 nt, Human
cuaaggcaggagaaucgcuuga

SEQ ID NO: 60401 - RNA, 27 nt, Human
gaggaguugguugaggcacuucuucaa

SEQ ID NO: 60402 - RNA, 21 nt, Human
gcagacugggagguggggaga

SEQ ID NO: 60403 - RNA, 22 nt, Human
aggggugauagccaaagggguu

SEQ ID NO: 60404 - RNA, 19 nt, Human
uacauuuuuauacagcaga

SEQ ID NO: 60405 - RNA, 22 nt, Human
acugcaacuucuaccuccgagg

SEQ ID NO: 60406 - RNA, 23 nt, Human
gccgggccgggcgggagugcagg

SEQ ID NO: 60407 - RNA, 27 nt, Human
ucugcgagguguuuacacuggaggugg

SEQ ID NO: 60408 - RNA, 17 nt, Human
agucucucauaagcacu

SEQ ID NO: 60409 - RNA, 27 nt, Human
auucagucaguaauaauuuacguguau

SEQ ID NO: 60410 - RNA, 19 nt, Human
guccacccucauuucugcc

SEQ ID NO: 60411 - RNA, 21 nt, Human
ggcaagggaagagacccccaa

SEQ ID NO: 60412 - RNA, 23 nt, Human
cagcagccgccuugcugcgugga

SEQ ID NO: 60413 - RNA, 22 nt, Human
ccuccucccaccacccucccac

SEQ ID NO: 60414 - RNA, 22 nt, Human
aauguauguauacuggcguacu

SEQ ID NO: 60415 - RNA, 20 nt, Human
gcucacauccuccuggguga

SEQ ID NO: 60416 - RNA, 25 nt, Human
ucugucccccaggcuggagugcagu

SEQ ID NO: 60417 - RNA, 24 nt, Human
agugacauaagugaccugcuuugu

SEQ ID NO: 60418 - RNA, 22 nt, Human
acugcugcuguuuuacgauuuc

SEQ ID NO: 60419 - RNA, 24 nt, Human
aagucccagagacucgaacacuga

SEQ ID NO: 60420 - RNA, 15 nt, Human
ugcccccaucccacu

SEQ ID NO: 60421 - RNA, 21 nt, Human
ccacggcugcauaccugcacu

SEQ ID NO: 60422 - RNA, 27 nt, Human
ucucaacagcauuaaacagucaauaac

SEQ ID NO: 60423 - RNA, 18 nt, Human
ucagcacugcagcucuga

SEQ ID NO: 60424 - RNA, 15 nt, Human
uuccuauacugccaa

SEQ ID NO: 60425 - RNA, 29 nt, Human
ucugccugcuuuccugccugccccaccug

SEQ ID NO: 60426 - RNA, 21 nt, Human
ucauuccuuaacucucccuca

SEQ ID NO: 60427 - RNA, 21 nt, Human
caauaaccaugaugaccugaa

SEQ ID NO: 60428 - RNA, 28 nt, Human
ggcuucuaggaaguagguuucaucuauc

SEQ ID NO: 60429 - RNA, 23 nt, Human
gcucccugccccuccucaugccc

SEQ ID NO: 60430 - RNA, 27 nt, Human
acacagccgucugagcagggcaggugc

SEQ ID NO: 60431 - RNA, 20 nt, Human
cuggggccugaaagugauga

SEQ ID NO: 60432 - RNA, 30 nt, Human
ggggaagaaaaaggaaaaccuauuaaaaaa

SEQ ID NO: 60433 - RNA, 23 nt, Human
ccaugaauucuucuuuucucagc

SEQ ID NO: 60434 - RNA, 21 nt, Human
uccacuuggauaccagcaccc

SEQ ID NO: 60435 - RNA, 27 nt, Human
guugcccaggcuggugucaaacuccug

SEQ ID NO: 60436 - RNA, 23 nt, Human
ugucuucuccccucagcaauucc

SEQ ID NO: 60437 - RNA, 26 nt, Human
auuuucugcuuuuugacuugcaucug

SEQ ID NO: 60438 - RNA, 20 nt, Human
uauucccuuguuccuaaaac

SEQ ID NO: 60439 - RNA, 22 nt, Human
gguuugcuuacucuacaguuau

SEQ ID NO: 60440 - RNA, 21 nt, Human
gcucacugcaaacccgccucc

SEQ ID NO: 60441 - RNA, 28 nt, Human
uccuguuccacuccggccuuccuagcgg

SEQ ID NO: 60442 - RNA, 27 nt, Human
gucucgaacuccugaccucaagcgauc

SEQ ID NO: 60443 - RNA, 22 nt, Human
accccucacacucaccuagcca

SEQ ID NO: 60444 - RNA, 26 nt, Human
acugcuaagagacauucuucauccac

SEQ ID NO: 60445 - RNA, 22 nt, Human
uuauuuagauuucaaaggcaaa

SEQ ID NO: 60446 - RNA, 21 nt, Human
agggaaccauauguuuugaga

SEQ ID NO: 60447 - RNA, 20 nt, Human
gcgaagagacaagaucuuga

SEQ ID NO: 60448 - RNA, 23 nt, Human
gcaccaucugcuugguuggcugg

SEQ ID NO: 60449 - RNA, 25 nt, Human
ucauucagcuaaauucacauuugcc

SEQ ID NO: 60450 - RNA, 27 nt, Human
uuagagacuccugaaugauuuagacaa

SEQ ID NO: 60451 - RNA, 19 nt, Human
uugucucuccuuucuugcc

SEQ ID NO: 60452 - RNA, 22 nt, Human
gccugcagggcaggucaggcug

SEQ ID NO: 60453 - RNA, 21 nt, Human
gaggccuguguuugcggccuu

SEQ ID NO: 60454 - RNA, 19 nt, Human
aaguauucuucuuuucuua

SEQ ID NO: 60455 - RNA, 22 nt, Human
gcuauuugggugauacccagug

SEQ ID NO: 60456 - RNA, 24 nt, Human
gccuucccccucccuuuugcgcac

SEQ ID NO: 60457 - RNA, 27 nt, Human
guagcuuacugucaaaauguucaauga

SEQ ID NO: 60458 - RNA, 19 nt, Human
gcuguucccuguccugccu

SEQ ID NO: 60459 - RNA, 26 nt, Human
cuuuccucugccauggcuuggaugcc

SEQ ID NO: 60460 - RNA, 21 nt, Human
accagccuggccaacauagug

SEQ ID NO: 60461 - RNA, 22 nt, Human
uuguguaccugugacuaaacaa

SEQ ID NO: 60462 - RNA, 19 nt, Human
gggcugcggaggcagugag

SEQ ID NO: 60463 - RNA, 20 nt, Human
ccaccaucugcaugucccca

SEQ ID NO: 60464 - RNA, 19 nt, Human
cccucgggggcauggcgcg

SEQ ID NO: 60465 - RNA, 23 nt, Human
uucucucucuuucaugcaguuca

SEQ ID NO: 60466 - RNA, 21 nt, Human
auccuccucccugacucgcag

SEQ ID NO: 60467 - RNA, 27 nt, Human
cacaucccagaggccauucccgggucg

SEQ ID NO: 60468 - RNA, 22 nt, Human
gcaauguuaaagaugcacagaa

SEQ ID NO: 60469 - RNA, 23 nt, Human
ggcauuuucaaauucugccuacc

SEQ ID NO: 60470 - RNA, 23 nt, Human
auugcgccacugcacuccagccu

SEQ ID NO: 60471 - RNA, 25 nt, Human
ccaugcugcugauccccaccugcgc

SEQ ID NO: 60472 - RNA, 28 nt, Human
cccuggcaggaagcuuccaagaguaaac

SEQ ID NO: 60473 - RNA, 21 nt, Human
uguauccaugcaccuaccuca

SEQ ID NO: 60474 - RNA, 22 nt, Human
uugcccaggguggagugcagug

SEQ ID NO: 60475 - RNA, 22 nt, Human
uugcccaggcuggaguggagug

SEQ ID NO: 60476 - RNA, 22 nt, Human
gugcagcugcugcgccuguguc

SEQ ID NO: 60477 - RNA, 26 nt, Human
guacauuuuauauuuucugaauuuau

SEQ ID NO: 60478 - RNA, 23 nt, Human
ucgcccaggcuggagcuggcccc

SEQ ID NO: 60479 - RNA, 25 nt, Human
ugggcacuguacuuggaucuucccg

SEQ ID NO: 60480 - RNA, 23 nt, Human
acuaaauaaacuacuuugaauag

SEQ ID NO: 60481 - RNA, 22 nt, Human
gccuugacacacacaugcacgg

SEQ ID NO: 60482 - RNA, 21 nt, Human
ugccaacauggugaaacucca

SEQ ID NO: 60483 - RNA, 22 nt, Human
uuagcuagcccacccugugcua

SEQ ID NO: 60484 - RNA, 22 nt, Human
gcacacacauacacagauacac

SEQ ID NO: 60485 - RNA, 22 nt, Human
cuggucccgucacucuccaugc

SEQ ID NO: 60486 - RNA, 20 nt, Human
agaagugccucaggaguccu

SEQ ID NO: 60487 - RNA, 26 nt, Human
aaaaucaagauucaguccagcagaug

SEQ ID NO: 60488 - RNA, 22 nt, Human
gaagaaggagggagggagccag

SEQ ID NO: 60489 - RNA, 22 nt, Human
ggagucagaucauaaggcucca

SEQ ID NO: 60490 - RNA, 18 nt, Human
gcuaucucucaugguucc

SEQ ID NO: 60491 - RNA, 21 nt, Human
ugccccucccccgcagacaca

SEQ ID NO: 60492 - RNA, 22 nt, Human
ggaugauaaaggaaauaggauc

SEQ ID NO: 60493 - RNA, 28 nt, Human
uggucucuuccuuuagcugacaaggaca

SEQ ID NO: 60494 - RNA, 27 nt, Human
ccaacuuguagcuuuuuaucccuuacc

SEQ ID NO: 60495 - RNA, 21 nt, Human
gugaccugauguaaacagugu

SEQ ID NO: 60496 - RNA, 23 nt, Human
uuuucucgagugacuagaccaaa

SEQ ID NO: 60497 - RNA, 17 nt, Human
agcuauguuauuuacaa

SEQ ID NO: 60498 - RNA, 27 nt, Human
auaaagugccuauaaaggaaacacguu

SEQ ID NO: 60499 - RNA, 26 nt, Human
gggguggcaggggccuugcagggcgc

SEQ ID NO: 60500 - RNA, 22 nt, Human
ccaccacaccuggccuggaagg

SEQ ID NO: 60501 - RNA, 26 nt, Human
cagagcccaccuccccaacaugugaa

SEQ ID NO: 60502 - RNA, 23 nt, Human
agcuguagaaauguauccugaua

SEQ ID NO: 60503 - RNA, 25 nt, Human
cacaccuacagguuugccaaaggaa

SEQ ID NO: 60504 - RNA, 26 nt, Human
gacuccugauugccuccucaagucgc

SEQ ID NO: 60505 - RNA, 23 nt, Human
gucauccaggcuggacaguucag

SEQ ID NO: 60506 - RNA, 22 nt, Human
cagaaaugcaaggggcugcaug

SEQ ID NO: 60507 - RNA, 20 nt, Human
gauccucccuccccuucaag

SEQ ID NO: 60508 - RNA, 26 nt, Human
ggccucccugaacuguuagggcugug

SEQ ID NO: 60509 - RNA, 26 nt, Human
aacacagcugaacuauuucaguguca

SEQ ID NO: 60510 - RNA, 24 nt, Human
ggaaaucaguauuuaaaugccaaa

SEQ ID NO: 60511 - RNA, 22 nt, Human
agaccagcuugugcaauauagg

SEQ ID NO: 60512 - RNA, 22 nt, Human
uucuccucugcuucauucucgu

SEQ ID NO: 60513 - RNA, 25 nt, Human
ggugcucuugucacagguagaacag

SEQ ID NO: 60514 - RNA, 22 nt, Human
cccuguguccugaguuacguac

SEQ ID NO: 60515 - RNA, 25 nt, Human
ggugccauggaagaggcuacagggc

SEQ ID NO: 60516 - RNA, 18 nt, Human
accugcggaucaggauuu

SEQ ID NO: 60517 - RNA, 27 nt, Human
uugcuucugauuacaggagcacugugg

SEQ ID NO: 60518 - RNA, 25 nt, Human
ggccccagacgcauagacugaggua

SEQ ID NO: 60519 - RNA, 26 nt, Human
aucugcucaggccuggcaugaccuca

SEQ ID NO: 60520 - RNA, 20 nt, Human
guguuucucccuuucgagcc

SEQ ID NO: 60521 - RNA, 22 nt, Human
ccugcuguggcucaccugcugc

SEQ ID NO: 60522 - RNA, 27 nt, Human
cugggaggagggggccacagcuuaggu

SEQ ID NO: 60523 - RNA, 23 nt, Human
gccuguaaucccagcuacucggg

SEQ ID NO: 60524 - RNA, 23 nt, Human
gccuauaaucccagcuacucagg

SEQ ID NO: 60525 - RNA, 23 nt, Human
gccuguaauccuagcuacuuggg

SEQ ID NO: 60526 - RNA, 21 nt, Human
cagccuauuuauauauguuga

SEQ ID NO: 60527 - RNA, 22 nt, Human
uuuacaagaauaauuagcaaua

SEQ ID NO: 60528 - RNA, 19 nt, Human
gucccggcugaagugcagu

SEQ ID NO: 60529 - RNA, 20 nt, Human
ugccuaacuuauuggagcac

SEQ ID NO: 60530 - RNA, 21 nt, Human
uucugcucuccccggcaugcc

SEQ ID NO: 60531 - RNA, 26 nt, Human
gacuccugcccuguuguguauagaug

SEQ ID NO: 60532 - RNA, 20 nt, Human
auaauuccuuuuuacuucua

SEQ ID NO: 60533 - RNA, 23 nt, Human
gccagcucccugucggauggcuu

SEQ ID NO: 60534 - RNA, 20 nt, Human
auaucuauccuggauucuga

SEQ ID NO: 60535 - RNA, 23 nt, Human
acccccacuucaugcccacugcc

SEQ ID NO: 60536 - RNA, 22 nt, Human
uacagggcucacagaauucauu

SEQ ID NO: 60537 - RNA, 21 nt, Human
gggagagagggagagagccua

SEQ ID NO: 60538 - RNA, 20 nt, Human
gccugugucacucagcagug

SEQ ID NO: 60539 - RNA, 23 nt, Human
gucauuuccagguuuucuggggg

SEQ ID NO: 60540 - RNA, 27 nt, Human
uggauuucauuuggggcaaagaaacaa

SEQ ID NO: 60541 - RNA, 27 nt, Human
aacuauacaucauuuuugcccucugcc

SEQ ID NO: 60542 - RNA, 27 nt, Human
aagacuugccuuuguuucuguuagacu

SEQ ID NO: 60543 - RNA, 21 nt, Human
cgucuguaaucccagcacuuu

SEQ ID NO: 60544 - RNA, 21 nt, Human
cgccuguaauuccagcacuuu

SEQ ID NO: 60545 - RNA, 25 nt, Human
gccauccacacccaggcauagccug

SEQ ID NO: 60546 - RNA, 22 nt, Human
ggggaagaggagaugugaucag

SEQ ID NO: 60547 - RNA, 29 nt, Human
ggagcaguuguuuuucccucccugggccu

SEQ ID NO: 60548 - RNA, 20 nt, Human
ucgggaacaguguuucccau

SEQ ID NO: 60549 - RNA, 27 nt, Human
ucaccccggcuggagucaugugggccg

SEQ ID NO: 60550 - RNA, 23 nt, Human
aaggaacaacaauaaaucauaug

SEQ ID NO: 60551 - RNA, 19 nt, Human
cccuccagccagaugcugg

SEQ ID NO: 60552 - RNA, 27 nt, Human
gggcuguaaagcaaacuggggcugugu

SEQ ID NO: 60553 - RNA, 27 nt, Human
gggagagaaggagguggcccugcuguu

SEQ ID NO: 60554 - RNA, 26 nt, Human
uccaugcucaccagcagccgcccagg

SEQ ID NO: 60555 - RNA, 22 nt, Human
uggcaauuuuuuccuucaucug

SEQ ID NO: 60556 - RNA, 24 nt, Human
agcucugaggugcaacuucuucac

SEQ ID NO: 60557 - RNA, 21 nt, Human
ggagaugcucacaggccacag

SEQ ID NO: 60558 - RNA, 24 nt, Human
uucaggaggccgagguggacagau

SEQ ID NO: 60559 - RNA, 27 nt, Human
cuggagugcugugcuguguuuaaucag

SEQ ID NO: 60560 - RNA, 19 nt, Human
ugacuucucacuuccuaag

SEQ ID NO: 60561 - RNA, 22 nt, Human
uuagaaaauauacuguaauuca

SEQ ID NO: 60562 - RNA, 24 nt, Human
gaaacccagcaauuugcuguuaug

SEQ ID NO: 60563 - RNA, 21 nt, Human
ggcuuuuaaaagacuuguuag

SEQ ID NO: 60564 - RNA, 25 nt, Human
ucugacauugaauagaaaacagcuc

SEQ ID NO: 60565 - RNA, 29 nt, Human
cuuuggguugcaggaccucaggugagaag

SEQ ID NO: 60566 - RNA, 22 nt, Human
ugcacacuguagaugacuagga

SEQ ID NO: 60567 - RNA, 21 nt, Human
uauggcagagaggcagggagu

SEQ ID NO: 60568 - RNA, 21 nt, Human
aaacuaucuauuugcaccuua

SEQ ID NO: 60569 - RNA, 25 nt, Human
ugccgccugagagugcagaggaugc

SEQ ID NO: 60570 - RNA, 27 nt, Human
cucugcucuccugggagacaaagcaau

SEQ ID NO: 60571 - RNA, 22 nt, Human
agcuuccuuggcuuuuacugaa

SEQ ID NO: 60572 - RNA, 22 nt, Human
aaauguccuugaguuuggagcc

SEQ ID NO: 60573 - RNA, 21 nt, Human
guagacaaugcaaaauuugua

SEQ ID NO: 60574 - RNA, 24 nt, Human
uaacugcacacgccccacgccuuc

SEQ ID NO: 60575 - RNA, 27 nt, Human
aggacagcaugguccugcccuguuguc

SEQ ID NO: 60576 - RNA, 24 nt, Human
cacuaccagucucccaaauagaaa

SEQ ID NO: 60577 - RNA, 18 nt, Human
agggaaagugcauaugaa

SEQ ID NO: 60578 - RNA, 21 nt, Human
aaggcccaggcugggguucag

SEQ ID NO: 60579 - RNA, 24 nt, Human
ggcacucagucucucuucucucca

SEQ ID NO: 60580 - RNA, 20 nt, Human
guggaggcggccuugcggug

SEQ ID NO: 60581 - RNA, 22 nt, Human
acccagacuggagugcagugcc

SEQ ID NO: 60582 - RNA, 23 nt, Human
uacuggcacaaggccuaagggau

SEQ ID NO: 60583 - RNA, 24 nt, Human
ccuggcagaggaagaaggaaggca

SEQ ID NO: 60584 - RNA, 20 nt, Human
ugcugcuguggagugaggug

SEQ ID NO: 60585 - RNA, 26 nt, Human
uauggcccuggccuagcauacguaca

SEQ ID NO: 60586 - RNA, 23 nt, Human
ccgcgcugcugcuccagccgccc

SEQ ID NO: 60587 - RNA, 19 nt, Human
aagggaaccgucuguuuuu

SEQ ID NO: 60588 - RNA, 21 nt, Human
ucuguucucuuucccugccac

SEQ ID NO: 60589 - RNA, 20 nt, Human
ggugaagcccuucagcuggg

SEQ ID NO: 60590 - RNA, 20 nt, Human
uagguuguaacagucucucc

SEQ ID NO: 60591 - RNA, 26 nt, Human
ucacccaggcugcagugccaugcaga

SEQ ID NO: 60592 - RNA, 24 nt, Human
ccgcuggccacccagcacagcccg

SEQ ID NO: 60593 - RNA, 26 nt, Human
gccuguaaucucagcuacucaggagg

SEQ ID NO: 60594 - RNA, 28 nt, Human
aaguugccucuuuuaggaaucucuuugg

SEQ ID NO: 60595 - RNA, 21 nt, Human
gguucagagcaugggugcucu

SEQ ID NO: 60596 - RNA, 22 nt, Human
cauucccccgcugguuccacca

SEQ ID NO: 60597 - RNA, 26 nt, Human
ucacucaggguggggucaggaaucug

SEQ ID NO: 60598 - RNA, 19 nt, Human
gcugucccagagccugugu

SEQ ID NO: 60599 - RNA, 22 nt, Human
uucaagcgagucuccugccuca

SEQ ID NO: 60600 - RNA, 20 nt, Human
caccagugagcuccagccug

SEQ ID NO: 60601 - RNA, 27 nt, Human
acuggccacacuuacuauugacaguca

SEQ ID NO: 60602 - RNA, 24 nt, Human
agaaucagaucuguuuggggcugg

SEQ ID NO: 60603 - RNA, 27 nt, Human
aggcuaggacguuggccucagggccag

SEQ ID NO: 60604 - RNA, 21 nt, Human
aaaucagcuuggauuggugcc

SEQ ID NO: 60605 - RNA, 27 nt, Human
agaccuccagccacucacagcucuuuu

SEQ ID NO: 60606 - RNA, 22 nt, Human
aaccaguugcuguuucuuccca

SEQ ID NO: 60607 - RNA, 22 nt, Human
uuugcugucugugacagaugaa

SEQ ID NO: 60608 - RNA, 21 nt, Human
gugaagaggagcaaggcuccg

SEQ ID NO: 60609 - RNA, 24 nt, Human
ugauccugguuuccaccuccagcc

SEQ ID NO: 60610 - RNA, 26 nt, Human
agacuugcuuccugcaugguagggag

SEQ ID NO: 60611 - RNA, 22 nt, Human
cugcagccucgaacuccugggc

SEQ ID NO: 60612 - RNA, 21 nt, Human
aaaagugcccgaggcagcccu

SEQ ID NO: 60613 - RNA, 20 nt, Human
gugacaucuucaucugcucu

SEQ ID NO: 60614 - RNA, 22 nt, Human
uuuggcaaaccaacagcuuugg

SEQ ID NO: 60615 - RNA, 24 nt, Human
ucucacugccacugcucuugccuc

SEQ ID NO: 60616 - RNA, 24 nt, Human
ugccacugcuuucauugaagaccc

SEQ ID NO: 60617 - RNA, 22 nt, Human
ccgccucuuggguucaagcaau

SEQ ID NO: 60618 - RNA, 26 nt, Human
cuggagggagagcggggggccucagu

SEQ ID NO: 60619 - RNA, 24 nt, Human
cuucaauuuuuguuuguuuuuugu

SEQ ID NO: 60620 - RNA, 22 nt, Human
uuaaugucauuuguuaaaauac

SEQ ID NO: 60621 - RNA, 19 nt, Human
ggggugacugaacugggag

SEQ ID NO: 60622 - RNA, 23 nt, Human
uccuagacuggacucuugaggga

SEQ ID NO: 60623 - RNA, 27 nt, Human
ccccaaaacuggggucccagcaacccu

SEQ ID NO: 60624 - RNA, 24 nt, Human
gcauucuuagcugagacaccaaga

SEQ ID NO: 60625 - RNA, 23 nt, Human
gugucccaggcuggagugcagug

SEQ ID NO: 60626 - RNA, 23 nt, Human
uggcucauaccuguaaaucccag

SEQ ID NO: 60627 - RNA, 26 nt, Human
aaguccccaggagaggggagcugugu

SEQ ID NO: 60628 - RNA, 27 nt, Human
gcuuuuugcaagaggagggggaccagc

SEQ ID NO: 60629 - RNA, 21 nt, Human
agaauuacaaguagaauggca

SEQ ID NO: 60630 - RNA, 17 nt, Human
accauaaacaguccagg

SEQ ID NO: 60631 - RNA, 22 nt, Human
ugucccacugagguccagggua

SEQ ID NO: 60632 - RNA, 26 nt, Human
gcucuauuucuucuucacauccauug

SEQ ID NO: 60633 - RNA, 26 nt, Human
ucuaaacucccuccauccugacucac

SEQ ID NO: 60634 - RNA, 24 nt, Human
ccucuggcugucugcacuuuuguu

SEQ ID NO: 60635 - RNA, 27 nt, Human
ucccacccucccuccuuagcaggugcc

SEQ ID NO: 60636 - RNA, 19 nt, Human
ccugaccucugaccucacc

SEQ ID NO: 60637 - RNA, 21 nt, Human
uuucauuuuucuccucacugc

SEQ ID NO: 60638 - RNA, 22 nt, Human
gccaagcaggcugguuugcaag

SEQ ID NO: 60639 - RNA, 24 nt, Human
ggcauaggagaagggucgggccag

SEQ ID NO: 60640 - RNA, 22 nt, Human
caagaucauaccacggcacucc

SEQ ID NO: 60641 - RNA, 21 nt, Human
ugugugccaagcccuggcccc

SEQ ID NO: 60642 - RNA, 22 nt, Human
uuccucuucuguaaaaugggua

SEQ ID NO: 60643 - RNA, 23 nt, Human
aggcuggagugcaguggcacgau

SEQ ID NO: 60644 - RNA, 23 nt, Human
aggcuggaguguaguggcaugau

SEQ ID NO: 60645 - RNA, 23 nt, Human
agacucugucuaccuggucuggu

SEQ ID NO: 60646 - RNA, 24 nt, Human
ucagaucuuucuagucaccuuaga

SEQ ID NO: 60647 - RNA, 27 nt, Human
uucaccagccuguaucuugucugagac

SEQ ID NO: 60648 - RNA, 26 nt, Human
acuacugcuacccucauuucaccugc

SEQ ID NO: 60649 - RNA, 25 nt, Human
ccuaaaaauuuucccucccugccca

SEQ ID NO: 60650 - RNA, 22 nt, Human
gcucacugcaaccuccaucucc

SEQ ID NO: 60651 - RNA, 22 nt, Human
ugcaucucugggcuccagggau

SEQ ID NO: 60652 - RNA, 21 nt, Human
uugagauacagguuuauaaca

SEQ ID NO: 60653 - RNA, 24 nt, Human
gggagcuggaguccacuggggugg

SEQ ID NO: 60654 - RNA, 26 nt, Human
ccaugccuggcuaauuuucuuguagu

SEQ ID NO: 60655 - RNA, 27 nt, Human
agaccagccuggccaaugugaugaaac

SEQ ID NO: 60656 - RNA, 24 nt, Human
cagauguuaugauuuguuugcucu

SEQ ID NO: 60657 - RNA, 22 nt, Human
ucugguugcuuuggccugcugc

SEQ ID NO: 60658 - RNA, 24 nt, Human
cuguccucugcugaggcuacggcc

SEQ ID NO: 60659 - RNA, 21 nt, Human
auaacugcaacuucacaguau

SEQ ID NO: 60660 - RNA, 21 nt, Human
uuacugacauggagugaagug

SEQ ID NO: 60661 - RNA, 26 nt, Human
uaaaacacggggguccugagacugag

SEQ ID NO: 60662 - RNA, 18 nt, Human
auacucccagucuuguca

SEQ ID NO: 60663 - RNA, 21 nt, Human
uaguauguuauuccugguuaa

SEQ ID NO: 60664 - RNA, 21 nt, Human
ggugcagcugccgaaagugcc

SEQ ID NO: 60665 - RNA, 31 nt, Human
cauccgugaggcuggacagcgauaaaccccu

SEQ ID NO: 60666 - RNA, 22 nt, Human
gcuuaugcuuguaaucccagca

SEQ ID NO: 60667 - RNA, 27 nt, Human
ggacugaacugacuuggcauaugugcu

SEQ ID NO: 60668 - RNA, 24 nt, Human
ugcugagaaacugcagagcauaau

SEQ ID NO: 60669 - RNA, 25 nt, Human
cagcucuggcaguucccaagucugg

SEQ ID NO: 60670 - RNA, 18 nt, Human
ugugagcucuggugucac

SEQ ID NO: 60671 - RNA, 22 nt, Human
uacaucccaaagaaacaggcau

SEQ ID NO: 60672 - RNA, 20 nt, Human
uucauucuggugacacagca

SEQ ID NO: 60673 - RNA, 27 nt, Human
augcaguuaaggcugggcagaaauucu

SEQ ID NO: 60674 - RNA, 21 nt, Human
gaaacaaaacagggaucuuuu

SEQ ID NO: 60675 - RNA, 21 nt, Human
cauauuuagaagcugaacuua

SEQ ID NO: 60676 - RNA, 22 nt, Human
ucauugagcuucauugcagccu

SEQ ID NO: 60677 - RNA, 25 nt, Human
ccuuuugccauccccucaacccagc

SEQ ID NO: 60678 - RNA, 26 nt, Human
uccgggagcuucggcuguagccggcu

SEQ ID NO: 60679 - RNA, 26 nt, Human
cucuccucucuguccccugacacucc

SEQ ID NO: 60680 - RNA, 27 nt, Human
gcccccagcugacccuaauuuauucuc

SEQ ID NO: 60681 - RNA, 27 nt, Human
gcucugucaccgaggcuggagugcagu

SEQ ID NO: 60682 - RNA, 27 nt, Human
cucaccauuaugauauuuaucuugaaa

SEQ ID NO: 60683 - RNA, 23 nt, Human
uuaguaguuaauucugucacuca

SEQ ID NO: 60684 - RNA, 21 nt, Human
cugguuuccccuccuuccucc

SEQ ID NO: 60685 - RNA, 23 nt, Human
gguccuggacaccucccagggga

SEQ ID NO: 60686 - RNA, 19 nt, Human
aaaaagcuuuuaugagcuc

SEQ ID NO: 60687 - RNA, 20 nt, Human
gccuuuuaaaaauguucuuu

SEQ ID NO: 60688 - RNA, 19 nt, Human
cacuguccugggugcacac

SEQ ID NO: 60689 - RNA, 22 nt, Human
gugcccagggcuggaggccccu

SEQ ID NO: 60690 - RNA, 20 nt, Human
aacaaggcagaaaaggaucc

SEQ ID NO: 60691 - RNA, 22 nt, Human
gucuucuccccauuccgcugcc

SEQ ID NO: 60692 - RNA, 23 nt, Human
acggaguuuauagcucacugcaa

SEQ ID NO: 60693 - RNA, 21 nt, Human
cccauucccugcccaccagaa

SEQ ID NO: 60694 - RNA, 27 nt, Human
cuuagacauguugugaggagacuauga

SEQ ID NO: 60695 - RNA, 19 nt, Human
caaaaguaaugggucuugg

SEQ ID NO: 60696 - RNA, 26 nt, Human
uggcaaaaaugggcaguaggggaaau

SEQ ID NO: 60697 - RNA, 27 nt, Human
gggaaggucaagcaaagaacuguaacc

SEQ ID NO: 60698 - RNA, 21 nt, Human
ucuacuaaaaauaagaaaaau

SEQ ID NO: 60699 - RNA, 27 nt, Human
aaccuauaguuauauaaucugacucuc

SEQ ID NO: 60700 - RNA, 21 nt, Human
ucugcuauuucucuugcugga

SEQ ID NO: 60701 - RNA, 27 nt, Human
acauuuauuaauccagccucugccuuu

SEQ ID NO: 60702 - RNA, 28 nt, Human
uggcaccucaccucacaccugcucccug

SEQ ID NO: 60703 - RNA, 21 nt, Human
acccugucuccgaaacaaaua

SEQ ID NO: 60704 - RNA, 20 nt, Human
auuuuaauucucucccccua

SEQ ID NO: 60705 - RNA, 27 nt, Human
gccucccuucuguuguagacuggacuc

SEQ ID NO: 60706 - RNA, 26 nt, Human
gugucauccagagcuggagugcagcg

SEQ ID NO: 60707 - RNA, 22 nt, Human
uguugcccaggcuggagugcgg

SEQ ID NO: 60708 - RNA, 22 nt, Human
ugucacccaggcuggaguguag

SEQ ID NO: 60709 - RNA, 21 nt, Human
agcucacugcaaccugugccu

SEQ ID NO: 60710 - RNA, 22 nt, Human
cucucucuucaacacuccccug

SEQ ID NO: 60711 - RNA, 22 nt, Human
uguuacccaggcuggagugcag

SEQ ID NO: 60712 - RNA, 22 nt, Human
ugucacccagguuggagugcag

SEQ ID NO: 60713 - RNA, 26 nt, Human
uuuguagcaauguuauuucucuugga

SEQ ID NO: 60714 - RNA, 21 nt, Human
gcugccaggagaaugauggaa

SEQ ID NO: 60715 - RNA, 20 nt, Human
aacuagaaggcuucucucca

SEQ ID NO: 60716 - RNA, 26 nt, Human
gcaggcaaggaggggggucacaggcc

SEQ ID NO: 60717 - RNA, 22 nt, Human
ucaugucucacuucacagcccu

SEQ ID NO: 60718 - RNA, 26 nt, Human
gacuuacccaacuccuucccccucag

SEQ ID NO: 60719 - RNA, 26 nt, Human
cuuccuggcccugugcuggggguggg

SEQ ID NO: 60720 - RNA, 21 nt, Human
aucaguugacagaauggugcc

SEQ ID NO: 60721 - RNA, 25 nt, Human
cuuacuuccugccucagucugcuuu

SEQ ID NO: 60722 - RNA, 18 nt, Human
caaauauugaaugccuua

SEQ ID NO: 60723 - RNA, 22 nt, Human
acugcaacuucugccucuuggg

SEQ ID NO: 60724 - RNA, 31 nt, Human
cugggaaaugaggcccacagacucaaaguua

SEQ ID NO: 60725 - RNA, 27 nt, Human
agcuagagaaacaauauuacugccuuu

SEQ ID NO: 60726 - RNA, 29 nt, Human
gcaucaaacagcacagcucugggggaugu

SEQ ID NO: 60727 - RNA, 23 nt, Human
ucccugcaauugggucucuggca

SEQ ID NO: 60728 - RNA, 25 nt, Human
guccaggccauuugacacaccaucu

SEQ ID NO: 60729 - RNA, 27 nt, Human
uguagagaagcauacuggagaagcaua

SEQ ID NO: 60730 - RNA, 28 nt, Human
uucuucugcgccucaggcugcuggggcc

SEQ ID NO: 60731 - RNA, 22 nt, Human
ccugguccacuaaaugcagccu

SEQ ID NO: 60732 - RNA, 17 nt, Human
cuucccuucaucagcua

SEQ ID NO: 60733 - RNA, 26 nt, Human
cccugccugugguccugagcacugau

SEQ ID NO: 60734 - RNA, 22 nt, Human
uuacauagagucuuguacauau

SEQ ID NO: 60735 - RNA, 25 nt, Human
cugccuguuccccacugccuguguu

SEQ ID NO: 60736 - RNA, 25 nt, Human
gacagacaccacagccuccccuucc

SEQ ID NO: 60737 - RNA, 22 nt, Human
cccuggccucugcacugugaua

SEQ ID NO: 60738 - RNA, 23 nt, Human
cuugcagaaugcgugguguuaau

SEQ ID NO: 60739 - RNA, 26 nt, Human
accccaagccucuccacuaggccucu

SEQ ID NO: 60740 - RNA, 20 nt, Human
gcaugacugcuuuucucagc

SEQ ID NO: 60741 - RNA, 28 nt, Human
cccaccacagaucccuggauugcuggga

SEQ ID NO: 60742 - RNA, 22 nt, Human
caccacugcaauccagccuggg

SEQ ID NO: 60743 - RNA, 23 nt, Human
guugcccaggucaggaguguuuu

SEQ ID NO: 60744 - RNA, 25 nt, Human
ggaggagcuggaggagaagggguua

SEQ ID NO: 60745 - RNA, 22 nt, Human
ccgauggcugugacaauguggu

SEQ ID NO: 60746 - RNA, 24 nt, Human
ucuuaaaagugcccaugaugguca

SEQ ID NO: 60747 - RNA, 19 nt, Human
uacuacaucuuuauucucu

SEQ ID NO: 60748 - RNA, 27 nt, Human
gucucgaacuccugggcucaagcaguc

SEQ ID NO: 60749 - RNA, 20 nt, Human
gaaggcuucugcagcuuugg

SEQ ID NO: 60750 - RNA, 27 nt, Human
uugaccucugugaccaacuguuggauu

SEQ ID NO: 60751 - RNA, 20 nt, Human
ggccucgguccucccccaac

SEQ ID NO: 60752 - RNA, 22 nt, Human
gucuuccaccaaaggccguuca

SEQ ID NO: 60753 - RNA, 25 nt, Human
cuucuccauaccccucuccccagca

SEQ ID NO: 60754 - RNA, 26 nt, Human
agugguuuccucggcccuccuggguu

SEQ ID NO: 60755 - RNA, 23 nt, Human
auguauguuugcuccuguuguua

SEQ ID NO: 60756 - RNA, 22 nt, Human
uggucucaaaccccggaccuca

SEQ ID NO: 60757 - RNA, 21 nt, Human
ggguugggagaaagguggcgg

SEQ ID NO: 60758 - RNA, 27 nt, Human
ccucucccacagccagugccaaguccu

SEQ ID NO: 60759 - RNA, 19 nt, Human
gguuugacauaacauuuau

SEQ ID NO: 60760 - RNA, 27 nt, Human
ccugagcucuggugaaaugcugauaca

SEQ ID NO: 60761 - RNA, 21 nt, Human
cgcacaccucugcaccuuugc

SEQ ID NO: 60762 - RNA, 27 nt, Human
cccuccagcgagucccaggagagugac

SEQ ID NO: 60763 - RNA, 24 nt, Human
uguuggcuuugagauggcugucuc

SEQ ID NO: 60764 - RNA, 26 nt, Human
uucacgccauucuccugccucagccu

SEQ ID NO: 60765 - RNA, 25 nt, Human
cagcucgcagccaccccaaagggag

SEQ ID NO: 60766 - RNA, 30 nt, Human
agggaggaaggggcggcugcucagacagau

SEQ ID NO: 60767 - RNA, 26 nt, Human
ugaaccucaccuucucugauuguggg

SEQ ID NO: 60768 - RNA, 21 nt, Human
ugucccacccacccgccgccu

SEQ ID NO: 60769 - RNA, 20 nt, Human
uaaugauuuuuauaauuuuc

SEQ ID NO: 60770 - RNA, 18 nt, Human
ccagcucccugggucucc

SEQ ID NO: 60771 - RNA, 18 nt, Human
caaucaggcgagacgccu

SEQ ID NO: 60772 - RNA, 21 nt, Human
uugccuuauaccucuuucucu

SEQ ID NO: 60773 - RNA, 29 nt, Human
agcugaacaguugaccugcuuugaagaaa

SEQ ID NO: 60774 - RNA, 22 nt, Human
cugagguuggaggauugcuuga

SEQ ID NO: 60775 - RNA, 22 nt, Human
ugcggaacucuuccuggaaugc

SEQ ID NO: 60776 - RNA, 23 nt, Human
accuuuaauaaaaugaaggaaug

SEQ ID NO: 60777 - RNA, 15 nt, Human
ucaagagcauuucac

SEQ ID NO: 60778 - RNA, 23 nt, Human
cuuuauuugaacaaugaaguuga

SEQ ID NO: 60779 - RNA, 21 nt, Human
ccuugaccaucuccaucugcc

SEQ ID NO: 60780 - RNA, 18 nt, Human
gcugcucuggagaacaau

SEQ ID NO: 60781 - RNA, 23 nt, Human
cgugccugcccaugccagcacuu

SEQ ID NO: 60782 - RNA, 22 nt, Human
gagagcaaagcacaagcuugcc

SEQ ID NO: 60783 - RNA, 27 nt, Human
acugcaacuucugucccuuguuuuuga

SEQ ID NO: 60784 - RNA, 20 nt, Human
ucuuacauccucucucucca

SEQ ID NO: 60785 - RNA, 21 nt, Human
acuccugaggucuuuguucuc

SEQ ID NO: 60786 - RNA, 23 nt, Human
cuuucugcggggcaucaggcugc

SEQ ID NO: 60787 - RNA, 21 nt, Human
cacgaaagaacccggucucca

SEQ ID NO: 60788 - RNA, 25 nt, Human
ucaguuucacuuccacauguaugua

SEQ ID NO: 60789 - RNA, 25 nt, Human
ccccaccccucugccaaccggggua

SEQ ID NO: 60790 - RNA, 21 nt, Human
acaucagcuuaaaaucuguca

SEQ ID NO: 60791 - RNA, 22 nt, Human
caaugaacuuccauuuguauuc

SEQ ID NO: 60792 - RNA, 27 nt, Human
cccagcccagagcagccaucaggcugg

SEQ ID NO: 60793 - RNA, 18 nt, Human
aggaagagaaggccagca

SEQ ID NO: 60794 - RNA, 20 nt, Human
cagcgggcgagcaggacagu

SEQ ID NO: 60795 - RNA, 28 nt, Human
cuccagccucuccuccauucccuauggg

SEQ ID NO: 60796 - RNA, 24 nt, Human
ugucacccagucuggagugcagug

SEQ ID NO: 60797 - RNA, 19 nt, Human
ccagagagucccugccacu

SEQ ID NO: 60798 - RNA, 27 nt, Human
gucacccacaagggaggcuagggcaau

SEQ ID NO: 60799 - RNA, 24 nt, Human
agggugcugggagcuggcaggguc

SEQ ID NO: 60800 - RNA, 26 nt, Human
ugaaaaaauauccccaaaguggaaau

SEQ ID NO: 60801 - RNA, 22 nt, Human
aggcuggagugcaguggcagga

SEQ ID NO: 60802 - RNA, 26 nt, Human
uuagccuggaugcccaccccugcugc

SEQ ID NO: 60803 - RNA, 21 nt, Human
agccugggcaacagagcuaga

SEQ ID NO: 60804 - RNA, 26 nt, Human
gucgccaggcaggaggccauuccagg

SEQ ID NO: 60805 - RNA, 21 nt, Human
augguggagggaggcaguggg

SEQ ID NO: 60806 - RNA, 19 nt, Human
gguuuucagaaccaccuca

SEQ ID NO: 60807 - RNA, 20 nt, Human
ccaaccaaaccaauucacca

SEQ ID NO: 60808 - RNA, 26 nt, Human
acugcaccuuaaccugggcacuggga

SEQ ID NO: 60809 - RNA, 26 nt, Human
aggcuggagugcaguggcacgaucuc

SEQ ID NO: 60810 - RNA, 23 nt, Human
aaagcugucaagugugguguagu

SEQ ID NO: 60811 - RNA, 24 nt, Human
gaagggaauguaaaauuugccuga

SEQ ID NO: 60812 - RNA, 22 nt, Human
gaccggccuggccaacauggug

SEQ ID NO: 60813 - RNA, 23 nt, Human
gagaguauuaugagggaggccga

SEQ ID NO: 60814 - RNA, 19 nt, Human
acagcaguagggaggucag

SEQ ID NO: 60815 - RNA, 21 nt, Human
cccaggaggcuuaguccaguc

SEQ ID NO: 60816 - RNA, 23 nt, Human
aacauucagcucuggagaacagu

SEQ ID NO: 60817 - RNA, 27 nt, Human
gcaaucaggaaagcagcagcccacucc

SEQ ID NO: 60818 - RNA, 26 nt, Human
acuucauucucccucucccugcugcu

SEQ ID NO: 60819 - RNA, 23 nt, Human
cuaccugcacuucuagaugcucc

SEQ ID NO: 60820 - RNA, 19 nt, Human
ccaaggaggggguaguuga

SEQ ID NO: 60821 - RNA, 24 nt, Human
ccaggagaagucccaccagggacc

SEQ ID NO: 60822 - RNA, 22 nt, Human
cauucucagcaaaugaagguuu

SEQ ID NO: 60823 - RNA, 23 nt, Human
gcucugccccgaccuccuucacc

SEQ ID NO: 60824 - RNA, 20 nt, Human
cccagccuccgucuccccgc

SEQ ID NO: 60825 - RNA, 24 nt, Human
gcccaggcuggagugcaauggcgc

SEQ ID NO: 60826 - RNA, 28 nt, Human
aguugcccuauggaaaugaauccuacuu

SEQ ID NO: 60827 - RNA, 19 nt, Human
ugaggaccuuccaggagga

SEQ ID NO: 60828 - RNA, 20 nt, Human
gccuggaucccagcaguagg

SEQ ID NO: 60829 - RNA, 20 nt, Human
caggcccgaccucaggucau

SEQ ID NO: 60830 - RNA, 15 nt, Human
uuuaaccuugaaguc

SEQ ID NO: 60831 - RNA, 22 nt, Human
acugugcucacuaccuggguga

SEQ ID NO: 60832 - RNA, 24 nt, Human
agcgagguuucaugacacaaccuu

SEQ ID NO: 60833 - RNA, 26 nt, Human
cccuaucaugaccaaggaguaucaag

SEQ ID NO: 60834 - RNA, 22 nt, Human
cgccaaguuggagugcaauggu

SEQ ID NO: 60835 - RNA, 25 nt, Human
gggcggggagccuucaggagccccg

SEQ ID NO: 60836 - RNA, 22 nt, Human
uaaggacaugagguuuucuuuc

SEQ ID NO: 60837 - RNA, 26 nt, Human
uccugcucucccuccugcaggugacc

SEQ ID NO: 60838 - RNA, 23 nt, Human
uucaguauuuacuguguaauacu

SEQ ID NO: 60839 - RNA, 21 nt, Human
uauuuuauucaaacucuguug

SEQ ID NO: 60840 - RNA, 25 nt, Human
cagaccccagagcuuggcuuuugaa

SEQ ID NO: 60841 - RNA, 21 nt, Human
cugggagaaucaagaacagaa

SEQ ID NO: 60842 - RNA, 19 nt, Human
gcccaggcugcccugcacu

SEQ ID NO: 60843 - RNA, 23 nt, Human
gcaaagaagagaagugacuuuuc

SEQ ID NO: 60844 - RNA, 24 nt, Human
cuguccgaaccuggagacaggaaa

SEQ ID NO: 60845 - RNA, 27 nt, Human
gucacccaggcugcaguucacuggugu

SEQ ID NO: 60846 - RNA, 20 nt, Human
gggaguggaaaaaacaggcg

SEQ ID NO: 60847 - RNA, 24 nt, Human
ucucuacaucacgguaaucaugcc

SEQ ID NO: 60848 - RNA, 24 nt, Human
gcccauuggaucugugaaagccuc

SEQ ID NO: 60849 - RNA, 22 nt, Human
gaucuuccccaagagggacugg

SEQ ID NO: 60850 - RNA, 25 nt, Human
cccaacaacccagguucuuuuccuu

SEQ ID NO: 60851 - RNA, 25 nt, Human
uuucugacacuucagacaucccacg

SEQ ID NO: 60852 - RNA, 24 nt, Human
ccuccugccugcuccuguccagcc

SEQ ID NO: 60853 - RNA, 21 nt, Human
aaauauuuuagauaaaugcac

SEQ ID NO: 60854 - RNA, 24 nt, Human
ccuggcuggcuguguccucuccag

SEQ ID NO: 60855 - RNA, 19 nt, Human
uucucaucucuguuuugca

SEQ ID NO: 60856 - RNA, 25 nt, Human
gguguggaguagggagcuggcuccc

SEQ ID NO: 60857 - RNA, 27 nt, Human
uucauuucucuuuuacacuuuuguacu

SEQ ID NO: 60858 - RNA, 27 nt, Human
ugcuauccugaaaauucuguagguucu

SEQ ID NO: 60859 - RNA, 23 nt, Human
cucuccucaguuuugccgacugc

SEQ ID NO: 60860 - RNA, 20 nt, Human
cucugcuuucugauguugcc

SEQ ID NO: 60861 - RNA, 22 nt, Human
uggcucauaccuguaaugccag

SEQ ID NO: 60862 - RNA, 26 nt, Human
cuaguaacauuuucuugaugauauga

SEQ ID NO: 60863 - RNA, 22 nt, Human
ugggacccucuggacagccacc

SEQ ID NO: 60864 - RNA, 22 nt, Human
cucucugcugccacucauucca

SEQ ID NO: 60865 - RNA, 23 nt, Human
cagauuccuauggaguucuugaa

SEQ ID NO: 60866 - RNA, 22 nt, Human
ugucuuuuuaaaaauacuggca

SEQ ID NO: 60867 - RNA, 26 nt, Human
cgccuccuccuccugggaagaagcgg

SEQ ID NO: 60868 - RNA, 19 nt, Human
ggacauguuguaacugcag

SEQ ID NO: 60869 - RNA, 22 nt, Human
uucugccccacaucugcuuuuu

SEQ ID NO: 60870 - RNA, 26 nt, Human
agggucccugaacugcugcgggccca

SEQ ID NO: 60871 - RNA, 23 nt, Human
uguagaugcuccuguuccugguu

SEQ ID NO: 60872 - RNA, 26 nt, Human
uggggagcccacacuccccaaagcag

SEQ ID NO: 60873 - RNA, 21 nt, Human
cggcaggcacagguguaaugg

SEQ ID NO: 60874 - RNA, 22 nt, Human
ucguaaccuccaccucccgggu

SEQ ID NO: 60875 - RNA, 26 nt, Human
caacagaugagaacuggugguuaaua

SEQ ID NO: 60876 - RNA, 20 nt, Human
uuuccuucuacuuacacauc

SEQ ID NO: 60877 - RNA, 27 nt, Human
ugccuguaaacacaacaguauuuauaa

SEQ ID NO: 60878 - RNA, 20 nt, Human
gccccuggaaaggggcagga

SEQ ID NO: 60879 - RNA, 24 nt, Human
ucucuagccucuuuguguuuuugu

SEQ ID NO: 60880 - RNA, 19 nt, Human
ccagaacccguuguggaaa

SEQ ID NO: 60881 - RNA, 22 nt, Human
gccaaaacaugauugaagccuu

SEQ ID NO: 60882 - RNA, 26 nt, Human
augguuuguuggagacaagaucaccu

SEQ ID NO: 60883 - RNA, 24 nt, Human
uguccuggcccgggagccgcaggg

SEQ ID NO: 60884 - RNA, 23 nt, Human
ccucccccaccugcugaccagcc

SEQ ID NO: 60885 - RNA, 20 nt, Human
aucuuaaguaccaaugggaa

SEQ ID NO: 60886 - RNA, 20 nt, Human
ucucagacuuuaaagccacc

SEQ ID NO: 60887 - RNA, 21 nt, Human
aaaaugcaaaaauuaguccgg

SEQ ID NO: 60888 - RNA, 17 nt, Human
caguuuauuuuacuuga

SEQ ID NO: 60889 - RNA, 22 nt, Human
uggagaggcgggccugcaagug

SEQ ID NO: 60890 - RNA, 26 nt, Human
gccauuucccccuccucagauggggc

SEQ ID NO: 60891 - RNA, 23 nt, Human
uagaaagagcugggcucucagcu

SEQ ID NO: 60892 - RNA, 20 nt, Human
caguacugggugugaggccu

SEQ ID NO: 60893 - RNA, 31 nt, Human
gcugaguuuccuaugggaacaauugaaguaa

SEQ ID NO: 60894 - RNA, 19 nt, Human
gauccagaccaccuuccuc

SEQ ID NO: 60895 - RNA, 23 nt, Human
aacacaaaugugaagaacuugua

SEQ ID NO: 60896 - RNA, 20 nt, Human
gcccaggcuggucuucuggc

SEQ ID NO: 60897 - RNA, 22 nt, Human
ccugggcuccagccuccugcaa

SEQ ID NO: 60898 - RNA, 21 nt, Human
ccgguggccggcaucuggccc

SEQ ID NO: 60899 - RNA, 19 nt, Human
gaaggcacuggggccaggc

SEQ ID NO: 60900 - RNA, 20 nt, Human
cagcauuuuuaguuaugugg

SEQ ID NO: 60901 - RNA, 21 nt, Human
aaaacaacuauauuuugccaa

SEQ ID NO: 60902 - RNA, 22 nt, Human
ggggacuucucuuccaccagcu

SEQ ID NO: 60903 - RNA, 28 nt, Human
uguauaugcaguauugagcacuguaggc

SEQ ID NO: 60904 - RNA, 27 nt, Human
cacagccgccgccacugcguccguccc

SEQ ID NO: 60905 - RNA, 21 nt, Human
uaccauggugugaaagucaga

SEQ ID NO: 60906 - RNA, 22 nt, Human
ccaacauggcgaaacuccguca

SEQ ID NO: 60907 - RNA, 23 nt, Human
ccgggagguggagguugccguga

SEQ ID NO: 60908 - RNA, 25 nt, Human
uauucugcuccauucccuucacugu

SEQ ID NO: 60909 - RNA, 21 nt, Human
gcucagaugaaaugcaucagg

SEQ ID NO: 60910 - RNA, 20 nt, Human
gaacaacaagguuaagcuuc

SEQ ID NO: 60911 - RNA, 21 nt, Human
gaggcauucaugaaggcuuuu

SEQ ID NO: 60912 - RNA, 24 nt, Human
cuggggccuggcuuaaaagcagga

SEQ ID NO: 60913 - RNA, 20 nt, Human
augugggaggaagaagcccc

SEQ ID NO: 60914 - RNA, 22 nt, Human
guggguggacgugguuggugau

SEQ ID NO: 60915 - RNA, 28 nt, Human
gagccugagagcucagaggauuccugcc

SEQ ID NO: 60916 - RNA, 20 nt, Human
cuaccagaacuaagcacuuu

SEQ ID NO: 60917 - RNA, 24 nt, Human
uuagaaucuaaggaaaacaugcau

SEQ ID NO: 60918 - RNA, 17 nt, Human
caggccgccugcagccu

SEQ ID NO: 60919 - RNA, 26 nt, Human
aggaagggagggagcagccacuccuc

SEQ ID NO: 60920 - RNA, 22 nt, Human
gcuggcuucagccccuugagca

SEQ ID NO: 60921 - RNA, 21 nt, Human
guaguuucugcugaacgugcu

SEQ ID NO: 60922 - RNA, 25 nt, Human
acuuacaacuugcuucuugagcuau

SEQ ID NO: 60923 - RNA, 32 nt, Human
acucaggccagugugucucugaaacggaucca

SEQ ID NO: 60924 - RNA, 22 nt, Human
uuaccuuuugguuuacaaaucu

SEQ ID NO: 60925 - RNA, 24 nt, Human
uccaaagugcugggauuacggacg

SEQ ID NO: 60926 - RNA, 23 nt, Human
uggucagagauucugugccugcu

SEQ ID NO: 60927 - RNA, 21 nt, Human
guugcccacacugggggccag

SEQ ID NO: 60928 - RNA, 26 nt, Human
ggacuugcccacagccucaaggagga

SEQ ID NO: 60929 - RNA, 27 nt, Human
ucaggauccagucuggaaaacagaaac

SEQ ID NO: 60930 - RNA, 22 nt, Human
ugcagcgagcuaugaucgcgcc

SEQ ID NO: 60931 - RNA, 20 nt, Human
ucggcacaccacaaccuuca

SEQ ID NO: 60932 - RNA, 18 nt, Human
uccacggacccauucaua

SEQ ID NO: 60933 - RNA, 22 nt, Human
cuccacccuccucucucgcacc

SEQ ID NO: 60934 - RNA, 19 nt, Human
ccaugcugcucccuaggag

SEQ ID NO: 60935 - RNA, 19 nt, Human
ggccucucccugccccucc

SEQ ID NO: 60936 - RNA, 22 nt, Human
ucugcugcucucucauuucauc

SEQ ID NO: 60937 - RNA, 19 nt, Human
uguuguccaggcagcucau

SEQ ID NO: 60938 - RNA, 22 nt, Human
cuuaccagggagauuugcucaa

SEQ ID NO: 60939 - RNA, 25 nt, Human
uaaguugagcagagaagauaugccu

SEQ ID NO: 60940 - RNA, 27 nt, Human
uucauucuuggcuucuuuaaguauucc

SEQ ID NO: 60941 - RNA, 20 nt, Human
gaaggcacagggugcugcug

SEQ ID NO: 60942 - RNA, 24 nt, Human
uguguauguaucacccaacucacu

SEQ ID NO: 60943 - RNA, 21 nt, Human
uccuuugcuucaaauucaagg

SEQ ID NO: 60944 - RNA, 22 nt, Human
cacgcuggagugcugugaugcg

SEQ ID NO: 60945 - RNA, 20 nt, Human
cucucccggcccgggccacu

SEQ ID NO: 60946 - RNA, 25 nt, Human
auauaguuauaaucugaugggccug

SEQ ID NO: 60947 - RNA, 22 nt, Human
aauaauuacagaaaagggcuac

SEQ ID NO: 60948 - RNA, 26 nt, Human
ggaauagaaguguguuauaaaucuag

SEQ ID NO: 60949 - RNA, 25 nt, Human
ucaagggcacuacauaaccucucug

SEQ ID NO: 60950 - RNA, 28 nt, Human
cuccauacugcugagauacagggaaaug

SEQ ID NO: 60951 - RNA, 27 nt, Human
acccauucuuauuucaauuucuccuuu

SEQ ID NO: 60952 - RNA, 21 nt, Human
uauacucuuauagacaacaug

SEQ ID NO: 60953 - RNA, 28 nt, Human
gcuggccucuagaacacccacuggccag

SEQ ID NO: 60954 - RNA, 19 nt, Human
ggccaucuuucccaccucu

SEQ ID NO: 60955 - RNA, 23 nt, Human
cagaaggccugcuguaaucagug

SEQ ID NO: 60956 - RNA, 26 nt, Human
ccucagccuuccccuugcccagggcu

SEQ ID NO: 60957 - RNA, 23 nt, Human
ugaaaacaaaaucaguuuugcau

SEQ ID NO: 60958 - RNA, 21 nt, Human
gugcccaggauagauguaaua

SEQ ID NO: 60959 - RNA, 19 nt, Human
uagcacaugucuguccuca

SEQ ID NO: 60960 - RNA, 23 nt, Human
ggacucaggcuggcagaggggcu

SEQ ID NO: 60961 - RNA, 20 nt, Human
gauauauguacagacuugua

SEQ ID NO: 60962 - RNA, 20 nt, Human
ggcugcgcuccuccugggug

SEQ ID NO: 60963 - RNA, 21 nt, Human
gacuucagucuugccuaggcg

SEQ ID NO: 60964 - RNA, 21 nt, Human
accucagaucaggugcaccug

SEQ ID NO: 60965 - RNA, 23 nt, Human
gccuuagcccagguuccugggcu

SEQ ID NO: 60966 - RNA, 24 nt, Human
uagcacugugguuuuccuuuugca

SEQ ID NO: 60967 - RNA, 26 nt, Human
cucacagcaaccucuaccuccugggu

SEQ ID NO: 60968 - RNA, 24 nt, Human
ugucugacuacuuugccuucuuuu

SEQ ID NO: 60969 - RNA, 19 nt, Human
gucacaaauaggugugugc

SEQ ID NO: 60970 - RNA, 27 nt, Human
ucuuaugcaauuuuaaguauacacuca

SEQ ID NO: 60971 - RNA, 23 nt, Human
uguccacccucauuucugccagc

SEQ ID NO: 60972 - RNA, 21 nt, Human
guugguugaguugccuagaac

SEQ ID NO: 60973 - RNA, 27 nt, Human
cugcccuuauggagcucacacuccagu

SEQ ID NO: 60974 - RNA, 22 nt, Human
gggcugcagcuuccagcacuga

SEQ ID NO: 60975 - RNA, 21 nt, Human
cguucaaauauugacucagua

SEQ ID NO: 60976 - RNA, 19 nt, Human
agcuggggcgcauggggaa

SEQ ID NO: 60977 - RNA, 22 nt, Human
gcaccuggcccuggcagcacag

SEQ ID NO: 60978 - RNA, 22 nt, Human
guaaacccuucuuuggcuuucc

SEQ ID NO: 60979 - RNA, 21 nt, Human
auguugcauucaucuuuugga

SEQ ID NO: 60980 - RNA, 23 nt, Human
auauuauuccuccuuugaagcua

SEQ ID NO: 60981 - RNA, 20 nt, Human
cacacugaugauauuguagg

SEQ ID NO: 60982 - RNA, 20 nt, Human
acaaaaccagguggcagguu

SEQ ID NO: 60983 - RNA, 20 nt, Human
cggaagggaggcggccucug

SEQ ID NO: 60984 - RNA, 26 nt, Human
cacugcuggcagccugggcaaaccgg

SEQ ID NO: 60985 - RNA, 23 nt, Human
aaaaaucuuuguuacucuguaaa

SEQ ID NO: 60986 - RNA, 21 nt, Human
uaacuaggcgcuucucucuca

SEQ ID NO: 60987 - RNA, 24 nt, Human
uucauucuaguucacuaaugacca

SEQ ID NO: 60988 - RNA, 21 nt, Human
ugagccaagauggcaccauug

SEQ ID NO: 60989 - RNA, 21 nt, Human
guagcacaggcugagugcagg

SEQ ID NO: 60990 - RNA, 23 nt, Human
gugggaagggggacagagagggc

SEQ ID NO: 60991 - RNA, 27 nt, Human
acuaccucugugccuugccacauuaaa

SEQ ID NO: 60992 - RNA, 22 nt, Human
caaccuuaguguuucuccagcc

SEQ ID NO: 60993 - RNA, 23 nt, Human
ccagguggggaggggcuggggac

SEQ ID NO: 60994 - RNA, 26 nt, Human
caugccacuccagacugcaccggcau

SEQ ID NO: 60995 - RNA, 21 nt, Human
cauuucauuguuauguuuuau

SEQ ID NO: 60996 - RNA, 22 nt, Human
acugcaaccuccaccucccagg

SEQ ID NO: 60997 - RNA, 23 nt, Human
ccagugaaaaaaucuuguggcuu

SEQ ID NO: 60998 - RNA, 27 nt, Human
cuguuucuucgcuuccaccuuuuucuc

SEQ ID NO: 60999 - RNA, 22 nt, Human
ugggaggcagagcuugcaguga

SEQ ID NO: 61000 - RNA, 20 nt, Human
uucuccucaucuccccauca

SEQ ID NO: 61001 - RNA, 21 nt, Human
ccagaggcagagguuguggug

SEQ ID NO: 61002 - RNA, 24 nt, Human
ggcuggagugagguggaaggaugu

SEQ ID NO: 61003 - RNA, 25 nt, Human
ccauguuagaaaacagaauccaguc

SEQ ID NO: 61004 - RNA, 24 nt, Human
gggacauuugaacauguuuaaugg

SEQ ID NO: 61005 - RNA, 22 nt, Human
gcuguaucucccuucacugucu

SEQ ID NO: 61006 - RNA, 19 nt, Human
cugcuauuuggaaaccccu

SEQ ID NO: 61007 - RNA, 26 nt, Human
ucucccacuggcuggcucacccacag

SEQ ID NO: 61008 - RNA, 16 nt, Human
aagaauugggauucca

SEQ ID NO: 61009 - RNA, 22 nt, Human
ccugcagcgccgguacauagcc

SEQ ID NO: 61010 - RNA, 18 nt, Human
uccugacagaaggacuca

SEQ ID NO: 61011 - RNA, 19 nt, Human
ucaucaaggagaaauaugg

SEQ ID NO: 61012 - RNA, 19 nt, Human
ucucuuucgaaagcauuaa

SEQ ID NO: 61013 - RNA, 18 nt, Human
guugagaguccucucccu

SEQ ID NO: 61014 - RNA, 24 nt, Human
ugguuccagggacuuuuuauuuga

SEQ ID NO: 61015 - RNA, 21 nt, Human
uaggcuugguuagagugcagc

SEQ ID NO: 61016 - RNA, 27 nt, Human
gugggguaugcaccugagcuccugcuu

SEQ ID NO: 61017 - RNA, 25 nt, Human
ucaggguucugaucuugccuucaug

SEQ ID NO: 61018 - RNA, 24 nt, Human
cgucacuguaaaccauuucuguca

SEQ ID NO: 61019 - RNA, 28 nt, Human
acuagcacggcucagccuccugcuaucc

SEQ ID NO: 61020 - RNA, 22 nt, Human
cgcuugcuucagcacauuggga

SEQ ID NO: 61021 - RNA, 21 nt, Human
acucugucugugccgagugua

SEQ ID NO: 61022 - RNA, 22 nt, Human
gcagagcuggguggcagcucuu

SEQ ID NO: 61023 - RNA, 20 nt, Human
augaacagcagaaagacugg

SEQ ID NO: 61024 - RNA, 20 nt, Human
cuuucuaacaaaacagaaua

SEQ ID NO: 61025 - RNA, 25 nt, Human
agucagucugacccacaguuguccu

SEQ ID NO: 61026 - RNA, 23 nt, Human
uuuacugugugguucccugcuuu

SEQ ID NO: 61027 - RNA, 22 nt, Human
ccugacuuauggagcacuugua

SEQ ID NO: 61028 - RNA, 22 nt, Human
aacacccuuaacuuucucuuua

SEQ ID NO: 61029 - RNA, 26 nt, Human
cauauccucuugggccuggugauuaa

SEQ ID NO: 61030 - RNA, 21 nt, Human
agcucacuucaaauucuucuu

SEQ ID NO: 61031 - RNA, 23 nt, Human
gcccaacugugagcaaggagcac

SEQ ID NO: 61032 - RNA, 26 nt, Human
ccucaaaccacuugccuggggcggca

SEQ ID NO: 61033 - RNA, 23 nt, Human
ccagagagagcaaggaagcuuca

SEQ ID NO: 61034 - RNA, 26 nt, Human
ugggcccagaguccagccguccagcu

SEQ ID NO: 61035 - RNA, 20 nt, Human
gcuggucucggacuccuggg

SEQ ID NO: 61036 - RNA, 22 nt, Human
uuauucuauuuccccucccucu

SEQ ID NO: 61037 - RNA, 22 nt, Human
ugccaggagaacagaacacacu

SEQ ID NO: 61038 - RNA, 22 nt, Human
cugaacacagggaaggucuggu

SEQ ID NO: 61039 - RNA, 20 nt, Human
uccgcucucccuucuaaacu

SEQ ID NO: 61040 - RNA, 22 nt, Human
cacaccuguaaucucagcacuu

SEQ ID NO: 61041 - RNA, 21 nt, Human
cuucccuugaacuuugaaccu

SEQ ID NO: 61042 - RNA, 22 nt, Human
cacacuuguaaucccagcacuu

SEQ ID NO: 61043 - RNA, 20 nt, Human
ccaggugagaugugcaagag

SEQ ID NO: 61044 - RNA, 27 nt, Human
cuacuccucccccaagagcgguggcac

SEQ ID NO: 61045 - RNA, 25 nt, Human
cuauuaaccugccuuuuuugucagc

SEQ ID NO: 61046 - RNA, 21 nt, Human
cucugccauuuuagauacugu

SEQ ID NO: 61047 - RNA, 21 nt, Human
ccaguuccuguaauuuuguga

SEQ ID NO: 61048 - RNA, 25 nt, Human
ucaaucagcagaugacccccaggcc

SEQ ID NO: 61049 - RNA, 19 nt, Human
ucagaagaggaaaggccag

SEQ ID NO: 61050 - RNA, 23 nt, Human
ucuccucccuuacuucuaucaga

SEQ ID NO: 61051 - RNA, 22 nt, Human
gcugggaaggcagcgcccagcu

SEQ ID NO: 61052 - RNA, 23 nt, Human
gucaugcuugcugauuacaguua

SEQ ID NO: 61053 - RNA, 26 nt, Human
agaacuccgcuggauggggagucuca

SEQ ID NO: 61054 - RNA, 23 nt, Human
ugguacuuccucugugaacugug

SEQ ID NO: 61055 - RNA, 22 nt, Human
uggaacuauaauacaaauguau

SEQ ID NO: 61056 - RNA, 21 nt, Human
ccaucagcuaaacaccacguc

SEQ ID NO: 61057 - RNA, 21 nt, Human
cgccagguuccggccgcggcc

SEQ ID NO: 61058 - RNA, 26 nt, Human
agugccccaagagagcucuaauggua

SEQ ID NO: 61059 - RNA, 23 nt, Human
uuaauuugcuaaagcugugcaca

SEQ ID NO: 61060 - RNA, 22 nt, Human
cccagauggcuccucugggcca

SEQ ID NO: 61061 - RNA, 27 nt, Human
ccugggcaacagagcaagacucugucu

SEQ ID NO: 61062 - RNA, 27 nt, Human
ccugggcaacagagugagacuccaucu

SEQ ID NO: 61063 - RNA, 21 nt, Human
ccaccaccgccagcugccagc

SEQ ID NO: 61064 - RNA, 21 nt, Human
ggugugaacccgggagcggag

SEQ ID NO: 61065 - RNA, 20 nt, Human
cuuguaacccagcacuuugg

SEQ ID NO: 61066 - RNA, 27 nt, Human
uguugcccaggcuggucuugaacucuu

SEQ ID NO: 61067 - RNA, 22 nt, Human
ggaagggagacaggggcacaga

SEQ ID NO: 61068 - RNA, 21 nt, Human
gucuuaaaacuuacuggaaug

SEQ ID NO: 61069 - RNA, 23 nt, Human
uaguugauuuucaaaagcauuaa

SEQ ID NO: 61070 - RNA, 19 nt, Human
uggccaugagaguauuuag

SEQ ID NO: 61071 - RNA, 20 nt, Human
uuccaugugugaaagcuacu

SEQ ID NO: 61072 - RNA, 23 nt, Human
gcagaaaagaaagugcuugaaag

SEQ ID NO: 61073 - RNA, 22 nt, Human
uuuguggguucuuccugcauau

SEQ ID NO: 61074 - RNA, 24 nt, Human
aacuuuacaacuucuauaacuuuu

SEQ ID NO: 61075 - RNA, 21 nt, Human
auuauuauguucuuagcaaua

SEQ ID NO: 61076 - RNA, 19 nt, Human
uuaugagagaaauguuggg

SEQ ID NO: 61077 - RNA, 23 nt, Human
uuuauguuuguccgauggagauu

SEQ ID NO: 61078 - RNA, 22 nt, Human
augccuugguuuuggugcugcu

SEQ ID NO: 61079 - RNA, 20 nt, Human
cagaaccucccaaauuugag

SEQ ID NO: 61080 - RNA, 21 nt, Human
ugcccuugccccugugcucaa

SEQ ID NO: 61081 - RNA, 27 nt, Human
ggcuacuggcauuaauuauuaauacca

SEQ ID NO: 61082 - RNA, 20 nt, Human
cccagcaccagccccccucu

SEQ ID NO: 61083 - RNA, 26 nt, Human
gccagguacaacaccuuuuucauaca

SEQ ID NO: 61084 - RNA, 21 nt, Human
uuauucugccaacaagagaua

SEQ ID NO: 61085 - RNA, 26 nt, Human
aguggggccuuuauccagugccaggg

SEQ ID NO: 61086 - RNA, 22 nt, Human
auuuuugcuuucuuaugugacu

SEQ ID NO: 61087 - RNA, 26 nt, Human
ccauuuuaaagguugaggaaacaagc

SEQ ID NO: 61088 - RNA, 21 nt, Human
uuuuuagcuuguuuuaccuac

SEQ ID NO: 61089 - RNA, 19 nt, Human
aggcagcucuaacagcccu

SEQ ID NO: 61090 - RNA, 23 nt, Human
cagacuccaaagcccugguccuu

SEQ ID NO: 61091 - RNA, 27 nt, Human
ugaaaacagcagcauuuucaguaauuc

SEQ ID NO: 61092 - RNA, 21 nt, Human
uuugcagcuggaacugcagcc

SEQ ID NO: 61093 - RNA, 20 nt, Human
uccagucugugcuccugggc

SEQ ID NO: 61094 - RNA, 25 nt, Human
aggcugacagaggcggccucaggac

SEQ ID NO: 61095 - RNA, 22 nt, Human
uuuuuuaaaaaauggacucuug

SEQ ID NO: 61096 - RNA, 20 nt, Human
guuuuaaguaaauguauuua

SEQ ID NO: 61097 - RNA, 19 nt, Human
cccggccucuuucucaccu

SEQ ID NO: 61098 - RNA, 20 nt, Human
agugucucugggcuuugugc

SEQ ID NO: 61099 - RNA, 20 nt, Human
uuauccaucuccagcaaaga

SEQ ID NO: 61100 - RNA, 22 nt, Human
uuccugguuccacugcuacuga

SEQ ID NO: 61101 - RNA, 21 nt, Human
cgcucauggucaucaucaugg

SEQ ID NO: 61102 - RNA, 21 nt, Human
ucauuuucagcacuuacuuca

SEQ ID NO: 61103 - RNA, 22 nt, Human
guacagugccuggcacucuggg

SEQ ID NO: 61104 - RNA, 21 nt, Human
cuccucacuggccucugggcu

SEQ ID NO: 61105 - RNA, 23 nt, Human
ccuucauuguacauccuuuucuu

SEQ ID NO: 61106 - RNA, 22 nt, Human
gaugccauaaucagaacacacu

SEQ ID NO: 61107 - RNA, 21 nt, Human
cugggagcagagguggagcga

SEQ ID NO: 61108 - RNA, 25 nt, Human
gcauagagcugucugccacagccuu

SEQ ID NO: 61109 - RNA, 28 nt, Human
ccucagguucccaagacuucaguccugg

SEQ ID NO: 61110 - RNA, 23 nt, Human
agacuucuagaaaaccugagagg

SEQ ID NO: 61111 - RNA, 26 nt, Human
cuuuuuaaaggaucagugcugcccua

SEQ ID NO: 61112 - RNA, 20 nt, Human
augaaaagagaacggagagg

SEQ ID NO: 61113 - RNA, 20 nt, Human
gaaaaguuuuguaaauuucu

SEQ ID NO: 61114 - RNA, 23 nt, Human
cuuccaugcuucuccuuuucuua

SEQ ID NO: 61115 - RNA, 27 nt, Human
gggggccccagccagagugaugaccaa

SEQ ID NO: 61116 - RNA, 26 nt, Human
ccugagaaagcagcaagaggacauga

SEQ ID NO: 61117 - RNA, 26 nt, Human
gcucacugcagccucugccacccaga

SEQ ID NO: 61118 - RNA, 23 nt, Human
cgaguagcugggauuacaggugg

SEQ ID NO: 61119 - RNA, 19 nt, Human
ccugccugggccuccuggc

SEQ ID NO: 61120 - RNA, 20 nt, Human
ccuccuccccuuccugcacc

SEQ ID NO: 61121 - RNA, 26 nt, Human
augugcaaaguuaggucuucccaguu

SEQ ID NO: 61122 - RNA, 21 nt, Human
uuucacugcauuguauauuuu

SEQ ID NO: 61123 - RNA, 21 nt, Human
agaacuuggaaaaguuguagg

SEQ ID NO: 61124 - RNA, 22 nt, Human
gggcccccacaggggaugguuu

SEQ ID NO: 61125 - RNA, 26 nt, Human
ccuucagggucaucaggcugucccag

SEQ ID NO: 61126 - RNA, 22 nt, Human
ugccaacaccuguugagccagg

SEQ ID NO: 61127 - RNA, 22 nt, Human
caggguggggacaggggcuggc

SEQ ID NO: 61128 - RNA, 27 nt, Human
uguugguuggagguggggggcucccac

SEQ ID NO: 61129 - RNA, 22 nt, Human
cugccacagccggacuccgcca

SEQ ID NO: 61130 - RNA, 21 nt, Human
ggggaaaggaacacgcgggua

SEQ ID NO: 61131 - RNA, 20 nt, Human
aauucagagggaccagccca

SEQ ID NO: 61132 - RNA, 24 nt, Human
agcauuuuacuacuuguuaccuuu

SEQ ID NO: 61133 - RNA, 26 nt, Human
uggacaacuguagugcagugauccuu

SEQ ID NO: 61134 - RNA, 21 nt, Human
cuagguauugucuacucugaa

SEQ ID NO: 61135 - RNA, 22 nt, Human
gucaaccgggcuggagugcagu

SEQ ID NO: 61136 - RNA, 27 nt, Human
cccguuuaucauccuuucccaguuccu

SEQ ID NO: 61137 - RNA, 20 nt, Human
gggcugggugcaguggcuca

SEQ ID NO: 61138 - RNA, 20 nt, Human
ccagacagcugcucagagcc

SEQ ID NO: 61139 - RNA, 28 nt, Human
ggcggugaggaucggagggcgcuauguc

SEQ ID NO: 61140 - RNA, 22 nt, Human
ugcuagccauuuccaguguccc

SEQ ID NO: 61141 - RNA, 26 nt, Human
ggcccagccucuuguucuuagggcuu

SEQ ID NO: 61142 - RNA, 23 nt, Human
uagucuuuaaaaacuguguuuga

SEQ ID NO: 61143 - RNA, 29 nt, Human
ccugcaaacaacagaguuauccguaucuu

SEQ ID NO: 61144 - RNA, 22 nt, Human
cauugcacuccaggcugggcag

SEQ ID NO: 61145 - RNA, 22 nt, Human
gcgggcagaucauuugagguca

SEQ ID NO: 61146 - RNA, 18 nt, Human
cuccuggggccuuuuguu

SEQ ID NO: 61147 - RNA, 23 nt, Human
cuagacugugucugaaucauguc

SEQ ID NO: 61148 - RNA, 22 nt, Human
gaccuccuuggcucaaggcauc

SEQ ID NO: 61149 - RNA, 18 nt, Human
gccucuaccuucauucca

SEQ ID NO: 61150 - RNA, 22 nt, Human
uucaauacugaaaauuuguccu

SEQ ID NO: 61151 - RNA, 25 nt, Human
uccuaucucugugcuggaagaugcu

SEQ ID NO: 61152 - RNA, 22 nt, Human
ccuccccuucucccugccucca

SEQ ID NO: 61153 - RNA, 21 nt, Human
ucaaaccacaucuugaugcua

SEQ ID NO: 61154 - RNA, 21 nt, Human
cccccacccucuccccugcca

SEQ ID NO: 61155 - RNA, 23 nt, Human
gauguguggcucauucuuuucag

SEQ ID NO: 61156 - RNA, 30 nt, Human
ggacuggcagaagcauugccuggacugacc

SEQ ID NO: 61157 - RNA, 23 nt, Human
aggcaggaaggaggcuggaauaa

SEQ ID NO: 61158 - RNA, 25 nt, Human
ccuugugccaucuuucuuccuggcc

SEQ ID NO: 61159 - RNA, 20 nt, Human
gaccaggagcaggacugggg

SEQ ID NO: 61160 - RNA, 22 nt, Human
accccagguauuaauucucgcu

SEQ ID NO: 61161 - RNA, 25 nt, Human
ggcucagaacaggguggggagagcg

SEQ ID NO: 61162 - RNA, 21 nt, Human
ugcuuuagccuuugucugaga

SEQ ID NO: 61163 - RNA, 26 nt, Human
cccccaguguccccaggggcacacuu

SEQ ID NO: 61164 - RNA, 21 nt, Human
ugccuguacuacaguauuuuu

SEQ ID NO: 61165 - RNA, 31 nt, Human
cuguccucuucucuggccugccuggggagcc

SEQ ID NO: 61166 - RNA, 21 nt, Human
gacucagcuugagacacucca

SEQ ID NO: 61167 - RNA, 17 nt, Human
ugggcccugccugcugc

SEQ ID NO: 61168 - RNA, 27 nt, Human
cagagugcucaucaucaugucauagaa

SEQ ID NO: 61169 - RNA, 23 nt, Human
ccaaacugugcccugccuucagc

SEQ ID NO: 61170 - RNA, 23 nt, Human
ccucacugcaaccuucaccuacc

SEQ ID NO: 61171 - RNA, 23 nt, Human
uuacugcagcaucugggcugcca

SEQ ID NO: 61172 - RNA, 23 nt, Human
uuuauugcugauuggccaggugc

SEQ ID NO: 61173 - RNA, 19 nt, Human
gcucugagagagggcagag

SEQ ID NO: 61174 - RNA, 20 nt, Human
cuggguugccugaauuugug

SEQ ID NO: 61175 - RNA, 28 nt, Human
gggcccacucuggacccaccuggcgcca

SEQ ID NO: 61176 - RNA, 22 nt, Human
uacugcuguggccagcuggggg

SEQ ID NO: 61177 - RNA, 22 nt, Human
gucuuaaauguguauauagcuc

SEQ ID NO: 61178 - RNA, 20 nt, Human
ccugccggccugccugccac

SEQ ID NO: 61179 - RNA, 26 nt, Human
ccuagaccuuggaaccaguuuccugg

SEQ ID NO: 61180 - RNA, 23 nt, Human
cucuggaauuucccuaccaauaa

SEQ ID NO: 61181 - RNA, 22 nt, Human
ugaaaggcaggaagggaagcgu

SEQ ID NO: 61182 - RNA, 22 nt, Human
gacuaaaacuuauuguuaccau

SEQ ID NO: 61183 - RNA, 23 nt, Human
cucaagcaguccuccugcuuugg

SEQ ID NO: 61184 - RNA, 25 nt, Human
caaguacgacuucguggaggugcgc

SEQ ID NO: 61185 - RNA, 20 nt, Human
augagauguaaaugugccca

SEQ ID NO: 61186 - RNA, 25 nt, Human
ucuucuacuuguaaaaugcuuuuca

SEQ ID NO: 61187 - RNA, 23 nt, Human
augcucaguaacacagugcagug

SEQ ID NO: 61188 - RNA, 25 nt, Human
agugauaccaguucagacacuaccc

SEQ ID NO: 61189 - RNA, 21 nt, Human
gaauauuggacauuuuaaaca

SEQ ID NO: 61190 - RNA, 22 nt, Human
cacauuuuccuuccuccuguua

SEQ ID NO: 61191 - RNA, 22 nt, Human
guucucucaccccuaacccuag

SEQ ID NO: 61192 - RNA, 25 nt, Human
aauuucugcuucuucauggaaugcu

SEQ ID NO: 61193 - RNA, 21 nt, Human
cucauggcuaaugccacuugc

SEQ ID NO: 61194 - RNA, 21 nt, Human
aggagggcacauuaacucccu

SEQ ID NO: 61195 - RNA, 22 nt, Human
ccuccauccaucuguccgucca

SEQ ID NO: 61196 - RNA, 23 nt, Human
uccaaucggagacaaaagcaguu

SEQ ID NO: 61197 - RNA, 29 nt, Human
aggagagaagacgugcagggaccccgcgc

SEQ ID NO: 61198 - RNA, 24 nt, Human
cucguccucccccugccagugccu

SEQ ID NO: 61199 - RNA, 18 nt, Human
uuauagaaacaucuuuaa

SEQ ID NO: 61200 - RNA, 20 nt, Human
cuccaucucaaacaacaaca

SEQ ID NO: 61201 - RNA, 22 nt, Human
cccaacaagagcucucugccuc

SEQ ID NO: 61202 - RNA, 23 nt, Human
cgacaaaggaagcugugaaucac

SEQ ID NO: 61203 - RNA, 23 nt, Human
uucaaaugaucagcacagccacu

SEQ ID NO: 61204 - RNA, 24 nt, Human
caccuguggucaggaguuugagac

SEQ ID NO: 61205 - RNA, 24 nt, Human
gcaaaacuacugucgguugaugug

SEQ ID NO: 61206 - RNA, 20 nt, Human
gauacuaacuuccuccauga

SEQ ID NO: 61207 - RNA, 20 nt, Human
agagcugaggcagaaucccu

SEQ ID NO: 61208 - RNA, 21 nt, Human
caggaguuugugguaacuuga

SEQ ID NO: 61209 - RNA, 23 nt, Human
ucugccucccucuccauaucucc

SEQ ID NO: 61210 - RNA, 24 nt, Human
ucauuccuucacucauccagccac

SEQ ID NO: 61211 - RNA, 22 nt, Human
uaucccagaaacuagaacugug

SEQ ID NO: 61212 - RNA, 23 nt, Human
ggaucagaucuggggcagcaacc

SEQ ID NO: 61213 - RNA, 20 nt, Human
ggagggaauguucuuucuug

SEQ ID NO: 61214 - RNA, 23 nt, Human
ugucuucuuuguuaggcuguguc

SEQ ID NO: 61215 - RNA, 23 nt, Human
gucccauuuuuauccgcuacucu

SEQ ID NO: 61216 - RNA, 22 nt, Human
uucauuuucagcacuuacuuca

SEQ ID NO: 61217 - RNA, 27 nt, Human
cccaagcaacugggauucauccuuucu

SEQ ID NO: 61218 - RNA, 20 nt, Human
auuauguuagauauauauca

SEQ ID NO: 61219 - RNA, 22 nt, Human
caggaggucagggcugcaguga

SEQ ID NO: 61220 - RNA, 21 nt, Human
cccauucuucuuugugagaca

SEQ ID NO: 61221 - RNA, 21 nt, Human
ucauggacggaagaccccugg

SEQ ID NO: 61222 - RNA, 27 nt, Human
ggucucgaacuccugaccucaagcagu

SEQ ID NO: 61223 - RNA, 27 nt, Human
cgggagaaaaggcauccuuaccucugg

SEQ ID NO: 61224 - RNA, 21 nt, Human
ggacgggucuccgucucucca

SEQ ID NO: 61225 - RNA, 27 nt, Human
ucucagcccagcucccagggggcccgg

SEQ ID NO: 61226 - RNA, 22 nt, Human
cccagcucuggacagaguucuu

SEQ ID NO: 61227 - RNA, 25 nt, Human
ugccaguuugcuuaguucucacugu

SEQ ID NO: 61228 - RNA, 23 nt, Human
ggcaucugggguuccugacugau

SEQ ID NO: 61229 - RNA, 20 nt, Human
gcuaaagucagcacagcuuu

SEQ ID NO: 61230 - RNA, 26 nt, Human
uuuaccucccugcuuuccucuuuucg

SEQ ID NO: 61231 - RNA, 22 nt, Human
gggagguggagcuugcagugag

SEQ ID NO: 61232 - RNA, 24 nt, Human
ucccccagccccaugcucccuuuu

SEQ ID NO: 61233 - RNA, 25 nt, Human
ugucugacagucuuuagcuauggug

SEQ ID NO: 61234 - RNA, 30 nt, Human
ccugucuccuggacucuccugggaaguucc

SEQ ID NO: 61235 - RNA, 23 nt, Human
ucgucaccucugugccugaguuc

SEQ ID NO: 61236 - RNA, 27 nt, Human
agaagcagccgggggcgcugacucccg

SEQ ID NO: 61237 - RNA, 18 nt, Human
ggaugaaagaggagccag

SEQ ID NO: 61238 - RNA, 20 nt, Human
gggaaagagaaagagacaga

SEQ ID NO: 61239 - RNA, 24 nt, Human
ucuaugcuauuuaggacuacuuuc

SEQ ID NO: 61240 - RNA, 23 nt, Human
cauccccuugacaguugcagccu

SEQ ID NO: 61241 - RNA, 23 nt, Human
aaacugaaaggcaugugaaggga

SEQ ID NO: 61242 - RNA, 19 nt, Human
uuccugcuucaucuuccca

SEQ ID NO: 61243 - RNA, 20 nt, Human
acagcuacuucaucaacugg

SEQ ID NO: 61244 - RNA, 22 nt, Human
uggcaucacccauaaagggaac

SEQ ID NO: 61245 - RNA, 21 nt, Human
gggcuggaaugcuggguaugc

SEQ ID NO: 61246 - RNA, 27 nt, Human
caguuuuguuaaggagauuuaguuuua

SEQ ID NO: 61247 - RNA, 20 nt, Human
ggcugagccuggugugggga

SEQ ID NO: 61248 - RNA, 20 nt, Human
ggcuucucuucuuccuuucc

SEQ ID NO: 61249 - RNA, 24 nt, Human
guuuuuaaguuaugcuacaucuug

SEQ ID NO: 61250 - RNA, 25 nt, Human
cacggucuugccucucagugcuuau

SEQ ID NO: 61251 - RNA, 25 nt, Human
gcuugcugguagcacuugcuacccu

SEQ ID NO: 61252 - RNA, 18 nt, Human
guccccucagcgggggcc

SEQ ID NO: 61253 - RNA, 22 nt, Human
gugccaccacagcuuauggcau

SEQ ID NO: 61254 - RNA, 25 nt, Human
aagcucaggguuuucuuagugccuc

SEQ ID NO: 61255 - RNA, 23 nt, Human
cccaggaggugcgaguguggcug

SEQ ID NO: 61256 - RNA, 27 nt, Human
ggcagcaucugccauucuaacuacgga

SEQ ID NO: 61257 - RNA, 21 nt, Human
aucagagguuacuaggguuua

SEQ ID NO: 61258 - RNA, 20 nt, Human
cuccagccucucgccugcgc

SEQ ID NO: 61259 - RNA, 21 nt, Human
gaaagagaauuuuacuuuugg

SEQ ID NO: 61260 - RNA, 21 nt, Human
auucuuugccuuccuggagcu

SEQ ID NO: 61261 - RNA, 20 nt, Human
uaggcagcagggggucagga

SEQ ID NO: 61262 - RNA, 21 nt, Human
gagauuucucccucuagcacu

SEQ ID NO: 61263 - RNA, 28 nt, Human
gaaguagcuucagcugggacugccaggg

SEQ ID NO: 61264 - RNA, 19 nt, Human
gccuuucuccacguccgcc

SEQ ID NO: 61265 - RNA, 30 nt, Human
aucagccauuucaugcaaccagaaacuagu

SEQ ID NO: 61266 - RNA, 20 nt, Human
ucuuagcagugucucucaca

SEQ ID NO: 61267 - RNA, 27 nt, Human
aggagcagcagccgcgccugcagaccg

SEQ ID NO: 61268 - RNA, 22 nt, Human
ugucgcccaggcuggagguuaa

SEQ ID NO: 61269 - RNA, 19 nt, Human
uggagccauugaacagcug

SEQ ID NO: 61270 - RNA, 24 nt, Human
uggagagaaaaugacugucuccuu

SEQ ID NO: 61271 - RNA, 22 nt, Human
uucccuacacccuucucugccu

SEQ ID NO: 61272 - RNA, 25 nt, Human
ucccggauggggcauucaucauugu

SEQ ID NO: 61273 - RNA, 23 nt, Human
ugcaaccucugccucccaggauc

SEQ ID NO: 61274 - RNA, 22 nt, Human
cacaggaagucugagugugagg

SEQ ID NO: 61275 - RNA, 22 nt, Human
auuccuggggcugauacuucuc

SEQ ID NO: 61276 - RNA, 18 nt, Human
uuuccugauauguuaucu

SEQ ID NO: 61277 - RNA, 17 nt, Human
aaauuuguacaguguga

SEQ ID NO: 61278 - RNA, 23 nt, Human
guuuaguucugugacacuguuuu

SEQ ID NO: 61279 - RNA, 27 nt, Human
cccucucacuugaagaucaggcacaga

SEQ ID NO: 61280 - RNA, 23 nt, Human
aguuucuugaggagacuccuagu

SEQ ID NO: 61281 - RNA, 22 nt, Human
augauuucuuugguaauugugu

SEQ ID NO: 61282 - RNA, 22 nt, Human
gagaaauggcguggcaggggac

SEQ ID NO: 61283 - RNA, 26 nt, Human
agccuugcaggcuggagggcggcugg

SEQ ID NO: 61284 - RNA, 26 nt, Human
gucugaagcugguccugggcuccggg

SEQ ID NO: 61285 - RNA, 24 nt, Human
gucucuauuucugucucuccucug

SEQ ID NO: 61286 - RNA, 27 nt, Human
uacuacuguacuuguuggcucuucaug

SEQ ID NO: 61287 - RNA, 24 nt, Human
ucugaccugagucuuuguuuuaag

SEQ ID NO: 61288 - RNA, 23 nt, Human
guggagagaaaagagaaugcuga

SEQ ID NO: 61289 - RNA, 21 nt, Human
ucuaauuccaagauccaauag

SEQ ID NO: 61290 - RNA, 22 nt, Human
cuagcugcccuacaugaagcaa

SEQ ID NO: 61291 - RNA, 22 nt, Human
gcagcuauuuuaagccaucuca

SEQ ID NO: 61292 - RNA, 19 nt, Human
gcacuucccugucuggacu

SEQ ID NO: 61293 - RNA, 22 nt, Human
aaauguucauugaauuuuauuu

SEQ ID NO: 61294 - RNA, 21 nt, Human
agagacacagaggcaccugcc

SEQ ID NO: 61295 - RNA, 22 nt, Human
uagaaagcucauuagcagcccu

SEQ ID NO: 61296 - RNA, 24 nt, Human
gggcagcagggguagggguaggga

SEQ ID NO: 61297 - RNA, 22 nt, Human
uuuguaaaauguucucuuauga

SEQ ID NO: 61298 - RNA, 23 nt, Human
ugagggcccuucguuaaagacac

SEQ ID NO: 61299 - RNA, 24 nt, Human
augcucaucuacagcuuucuugga

SEQ ID NO: 61300 - RNA, 24 nt, Human
uucauucuuuugaacucuggugca

SEQ ID NO: 61301 - RNA, 22 nt, Human
cauuagaaacaaaacaaaaaga

SEQ ID NO: 61302 - RNA, 25 nt, Human
uugaguauuuuuaaaaaauaugucg

SEQ ID NO: 61303 - RNA, 22 nt, Human
gcucccaggguggacuucagug

SEQ ID NO: 61304 - RNA, 22 nt, Human
gaucgggagagccggagcgagc

SEQ ID NO: 61305 - RNA, 31 nt, Human
ggucauuuuguugcauuuccccauuucuugu

SEQ ID NO: 61306 - RNA, 22 nt, Human
cgcucaggcuggaggccagcca

SEQ ID NO: 61307 - RNA, 22 nt, Human
agugcaguucauucuuaaugga

SEQ ID NO: 61308 - RNA, 27 nt, Human
uaggaauagagcaaauaagauaauggc

SEQ ID NO: 61309 - RNA, 21 nt, Human
ggauguaauuuuaaugcuucc

SEQ ID NO: 61310 - RNA, 19 nt, Human
gucugucuuccugccuucg

SEQ ID NO: 61311 - RNA, 23 nt, Human
ggucucaggguucugucuugccu

SEQ ID NO: 61312 - RNA, 22 nt, Human
uuccagguucccaugcuuuuug

SEQ ID NO: 61313 - RNA, 22 nt, Human
uuucuuucuuuucuuuucuccu

SEQ ID NO: 61314 - RNA, 20 nt, Human
caguaaaauguauggaucua

SEQ ID NO: 61315 - RNA, 20 nt, Human
ucuugcucuccuagguagcc

SEQ ID NO: 61316 - RNA, 21 nt, Human
ucugugucccccucgcgggcc

SEQ ID NO: 61317 - RNA, 21 nt, Human
gggagagaagagaccugccag

SEQ ID NO: 61318 - RNA, 25 nt, Human
augugggagaggcuuuauucacucc

SEQ ID NO: 61319 - RNA, 23 nt, Human
caccaugguuuauaaaacuuugg

SEQ ID NO: 61320 - RNA, 24 nt, Human
cccuucucuccccaguucuggucc

SEQ ID NO: 61321 - RNA, 24 nt, Human
gccucacuggccuuacccuccucc

SEQ ID NO: 61322 - RNA, 26 nt, Human
ucaugacgacuucgcugcuccugcau

SEQ ID NO: 61323 - RNA, 22 nt, Human
uucuucuucuuuuuuaauacca

SEQ ID NO: 61324 - RNA, 17 nt, Human
agcaugcuaaagccaca

SEQ ID NO: 61325 - RNA, 18 nt, Human
gagauggacuuaaagagc

SEQ ID NO: 61326 - RNA, 29 nt, Human
agccuugucaccaaccucuaacugcagaa

SEQ ID NO: 61327 - RNA, 21 nt, Human
agugagguaugaugugcugcu

SEQ ID NO: 61328 - RNA, 19 nt, Human
ggaauucugcugagguccc

SEQ ID NO: 61329 - RNA, 25 nt, Human
gagagagguucacuguaguccugaa

SEQ ID NO: 61330 - RNA, 22 nt, Human
auugcuugaacccgggaggugg

SEQ ID NO: 61331 - RNA, 22 nt, Human
uuagcauugccauuccucuacu

SEQ ID NO: 61332 - RNA, 27 nt, Human
ugaacaacgaauguaaauuuggucaag

SEQ ID NO: 61333 - RNA, 26 nt, Human
ccagccgggcuggaggcugugcagaa

SEQ ID NO: 61334 - RNA, 22 nt, Human
ccaccuccuggguuuaagcgau

SEQ ID NO: 61335 - RNA, 27 nt, Human
ucucuucccucucccaucguauuuugu

SEQ ID NO: 61336 - RNA, 19 nt, Human
ccucacugcgccagccucc

SEQ ID NO: 61337 - RNA, 22 nt, Human
guugagcccggguagggccagg

SEQ ID NO: 61338 - RNA, 21 nt, Human
gaucguacccagccugggcaa

SEQ ID NO: 61339 - RNA, 24 nt, Human
gggagcccugcaccgcuccuggcc

SEQ ID NO: 61340 - RNA, 21 nt, Human
gguuuucuuggcccagcacug

SEQ ID NO: 61341 - RNA, 23 nt, Human
acaggugggccugggaggaagau

SEQ ID NO: 61342 - RNA, 23 nt, Human
ucccauaugcuaccuaguuugcu

SEQ ID NO: 61343 - RNA, 21 nt, Human
ggcuuuucccguuggggccga

SEQ ID NO: 61344 - RNA, 23 nt, Human
uagucagugaaguaaauauuuua

SEQ ID NO: 61345 - RNA, 21 nt, Human
ugacccuucccucgguguggg

SEQ ID NO: 61346 - RNA, 22 nt, Human
gcccugugcaaccucuuggccu

SEQ ID NO: 61347 - RNA, 27 nt, Human
agccccuggccuggcugaguuuggcag

SEQ ID NO: 61348 - RNA, 17 nt, Human
aaaaagaguuuaaacaa

SEQ ID NO: 61349 - RNA, 23 nt, Human
cccaaauugucaccugcuucucu

SEQ ID NO: 61350 - RNA, 22 nt, Human
ugauucuuuguuacaggcaccg

SEQ ID NO: 61351 - RNA, 22 nt, Human
cacuguacuccagccugggaga

SEQ ID NO: 61352 - RNA, 21 nt, Human
uuguccugaugcugugcucaa

SEQ ID NO: 61353 - RNA, 25 nt, Human
ccugcugucuacuccccaccuucgg

SEQ ID NO: 61354 - RNA, 27 nt, Human
ggcauuuuccuacaccuccaaaugagg

SEQ ID NO: 61355 - RNA, 25 nt, Human
aagucgugcacagcccaggaguguu

SEQ ID NO: 61356 - RNA, 27 nt, Human
gcaugccugcaggaacgguggcuuuuu

SEQ ID NO: 61357 - RNA, 20 nt, Human
agggcagcccuccuuaccac

SEQ ID NO: 61358 - RNA, 22 nt, Human
ggauggccccagugcuggaaag

SEQ ID NO: 61359 - RNA, 21 nt, Human
agugacugaagaagcagucca

SEQ ID NO: 61360 - RNA, 22 nt, Human
uuuucauacuuaaaagauuuuc

SEQ ID NO: 61361 - RNA, 25 nt, Human
acgaagccuguccucaccgcggcuc

SEQ ID NO: 61362 - RNA, 24 nt, Human
caucaggguccccagccucugggc

SEQ ID NO: 61363 - RNA, 26 nt, Human
uuugucgcccaggcuggagugcaaug

SEQ ID NO: 61364 - RNA, 17 nt, Human
cccagcaccuggacuca

SEQ ID NO: 61365 - RNA, 25 nt, Human
cagauagaguguggcuucauuuguc

SEQ ID NO: 61366 - RNA, 25 nt, Human
ggcuccuugcuccuugcucucccag

SEQ ID NO: 61367 - RNA, 25 nt, Human
cuugcuggucgcagacucccugacc

SEQ ID NO: 61368 - RNA, 24 nt, Human
gcaggcacgcgccaccacgcccag

SEQ ID NO: 61369 - RNA, 19 nt, Human
acgcaaaccaccugugaca

SEQ ID NO: 61370 - RNA, 27 nt, Human
aguuggcaugacucuugacucuugccu

SEQ ID NO: 61371 - RNA, 20 nt, Human
ugugugcccagcucagcuag

SEQ ID NO: 61372 - RNA, 29 nt, Human
guuucucuguuugcucugaaucaacagcc

SEQ ID NO: 61373 - RNA, 22 nt, Human
gcccucugggcgcuuggacaua

SEQ ID NO: 61374 - RNA, 21 nt, Human
gucaaggguuuauuauagcac

SEQ ID NO: 61375 - RNA, 24 nt, Human
ccgggaggggcgcugcggggaagc

SEQ ID NO: 61376 - RNA, 27 nt, Human
gggacaaacauguaaaccuauuuuccu

SEQ ID NO: 61377 - RNA, 26 nt, Human
gcagcccaggccuggucugggagaca

SEQ ID NO: 61378 - RNA, 24 nt, Human
uuuaguaucaaccugcuguauauu

SEQ ID NO: 61379 - RNA, 21 nt, Human
acuccaggacgccccagcugg

SEQ ID NO: 61380 - RNA, 23 nt, Human
agaaauucgcauguuuaauguga

SEQ ID NO: 61381 - RNA, 27 nt, Human
cugaagccuggauccuccuggugaaau

SEQ ID NO: 61382 - RNA, 27 nt, Human
ccagcauccuaucaccuccugguggcc

SEQ ID NO: 61383 - RNA, 23 nt, Human
acuaagguauaauugauguaaua

SEQ ID NO: 61384 - RNA, 22 nt, Human
agguaggcagaucacgagguca

SEQ ID NO: 61385 - RNA, 22 nt, Human
gguggaagccucagaggccuug

SEQ ID NO: 61386 - RNA, 24 nt, Human
ggcugggugggagcggggagggac

SEQ ID NO: 61387 - RNA, 22 nt, Human
ugcaguaagcuaugaucaugcc

SEQ ID NO: 61388 - RNA, 24 nt, Human
uggugagagggccgggcagagggg

SEQ ID NO: 61389 - RNA, 28 nt, Human
cuacacacaccucuucuuuucuugguau

SEQ ID NO: 61390 - RNA, 22 nt, Human
ucgagccucacgucuacucccu

SEQ ID NO: 61391 - RNA, 23 nt, Human
guuucuagcccauggacuucaca

SEQ ID NO: 61392 - RNA, 25 nt, Human
caaagagauuuugauuaauucuggg

SEQ ID NO: 61393 - RNA, 27 nt, Human
ugcagugagcuaagauugcaccacugc

SEQ ID NO: 61394 - RNA, 25 nt, Human
ccugccacuuguaauuuucagaauc

SEQ ID NO: 61395 - RNA, 26 nt, Human
gucccgggcuggcgggagugcaguuc

SEQ ID NO: 61396 - RNA, 22 nt, Human
ugagagugagcaaccagcugga

SEQ ID NO: 61397 - RNA, 19 nt, Human
uggaggaaggccagaggaa

SEQ ID NO: 61398 - RNA, 27 nt, Human
aaagagcucuugaucccgauuucaugc

SEQ ID NO: 61399 - RNA, 24 nt, Human
cagcuagcuugaaaacuugcugaa

SEQ ID NO: 61400 - RNA, 26 nt, Human
ggguuuuguugcuuucacacucuauc

SEQ ID NO: 61401 - RNA, 19 nt, Human
ugccccagcagaucaaagg

SEQ ID NO: 61402 - RNA, 27 nt, Human
cucugcacuugcagacuuucugagcca

SEQ ID NO: 61403 - RNA, 26 nt, Human
uuauagaauaugaccuauuuaucuga

SEQ ID NO: 61404 - RNA, 21 nt, Human
uucuaaacgguccuugcccca

SEQ ID NO: 61405 - RNA, 21 nt, Human
uguuguuugggagagugcagu

SEQ ID NO: 61406 - RNA, 23 nt, Human
uguguggggaggggaguggauuc

SEQ ID NO: 61407 - RNA, 23 nt, Human
guucauuaauuuugucaguauua

SEQ ID NO: 61408 - RNA, 23 nt, Human
agcuuucuuuauaucaguggaaa

SEQ ID NO: 61409 - RNA, 22 nt, Human
uaacaucuucaguuuuucuccc

SEQ ID NO: 61410 - RNA, 24 nt, Human
gucaucuguuaggaagccauucua

SEQ ID NO: 61411 - RNA, 23 nt, Human
uuacaucuuuaauuucauaucca

SEQ ID NO: 61412 - RNA, 25 nt, Human
uucauaaggagucaauauguaguuu

SEQ ID NO: 61413 - RNA, 21 nt, Human
uaaagagacuggccaacagga

SEQ ID NO: 61414 - RNA, 24 nt, Human
agcacccccuuguaagcucagggc

SEQ ID NO: 61415 - RNA, 25 nt, Human
cacuuucugccagcaucugcagcca

SEQ ID NO: 61416 - RNA, 17 nt, Human
uguuccaggcugagaac

SEQ ID NO: 61417 - RNA, 27 nt, Human
uggggugaaugugaauccagagucuau

SEQ ID NO: 61418 - RNA, 23 nt, Human
ccuuucccccuccuccgggggcc

SEQ ID NO: 61419 - RNA, 22 nt, Human
caugaucuguuucuacuaugga

SEQ ID NO: 61420 - RNA, 23 nt, Human
acauuuuccuuccuccuguuaca

SEQ ID NO: 61421 - RNA, 25 nt, Human
ucuguccaaccuccuuucugguaga

SEQ ID NO: 61422 - RNA, 25 nt, Human
ugcaaggguauaucauauauacaaa

SEQ ID NO: 61423 - RNA, 24 nt, Human
gcagugguaugaucacagcucacu

SEQ ID NO: 61424 - RNA, 23 nt, Human
uuccccagccucucugcccagua

SEQ ID NO: 61425 - RNA, 22 nt, Human
accauccuggcuaacaugguga

SEQ ID NO: 61426 - RNA, 22 nt, Human
agcucaugcugaauuauuuuug

SEQ ID NO: 61427 - RNA, 24 nt, Human
auucacugcaucccucugugccuc

SEQ ID NO: 61428 - RNA, 20 nt, Human
ccugagcugccaccugccga

SEQ ID NO: 61429 - RNA, 21 nt, Human
agcucugaaccuucuuuguua

SEQ ID NO: 61430 - RNA, 22 nt, Human
ccuacccuuguuaguuauuuua

SEQ ID NO: 61431 - RNA, 23 nt, Human
agguuuuagaagcuaggaggcag

SEQ ID NO: 61432 - RNA, 21 nt, Human
ccacucacagugguucuguuu

SEQ ID NO: 61433 - RNA, 24 nt, Human
cgaguuucaggugaauuggucacc

SEQ ID NO: 61434 - RNA, 25 nt, Human
ggcgagggcgcgagugaggagcaga

SEQ ID NO: 61435 - RNA, 19 nt, Human
gcccaaacuggagugcagu

SEQ ID NO: 61436 - RNA, 22 nt, Human
agcagaucuuuacaagcaguuu

SEQ ID NO: 61437 - RNA, 19 nt, Human
uggaauccugauguggaaa

SEQ ID NO: 61438 - RNA, 24 nt, Human
caggcugggcuucaguggcagcug

SEQ ID NO: 61439 - RNA, 21 nt, Human
uccagccugggcaacauagcg

SEQ ID NO: 61440 - RNA, 22 nt, Human
caggaguucaaggcugcagaga

SEQ ID NO: 61441 - RNA, 27 nt, Human
gggaagggaagauauuuuaaggcgugu

SEQ ID NO: 61442 - RNA, 20 nt, Human
cccugcacucugccucacaa

SEQ ID NO: 61443 - RNA, 26 nt, Human
ucacuggccccuugaagacagcagaa

SEQ ID NO: 61444 - RNA, 23 nt, Human
cccuuucucucaccccuggagcc

SEQ ID NO: 61445 - RNA, 20 nt, Human
aaacaguaguuuuacaauca

SEQ ID NO: 61446 - RNA, 20 nt, Human
aaucauaccauugaauguag

SEQ ID NO: 61447 - RNA, 22 nt, Human
ugucucuaaagaaccaaaucaa

SEQ ID NO: 61448 - RNA, 29 nt, Human
ucauuauggcuauguaucuuguccauacc

SEQ ID NO: 61449 - RNA, 22 nt, Human
caggaguuugaggcugcaguga

SEQ ID NO: 61450 - RNA, 22 nt, Human
ggggugugauuugccugaccuc

SEQ ID NO: 61451 - RNA, 30 nt, Human
agguagauaaucaaggcaggaggucaaagc

SEQ ID NO: 61452 - RNA, 22 nt, Human
aagaacuuuugcuggagagaau

SEQ ID NO: 61453 - RNA, 21 nt, Human
caggaggcgaagauugcagug

SEQ ID NO: 61454 - RNA, 24 nt, Human
uccugcugcccuccagacaugcug

SEQ ID NO: 61455 - RNA, 24 nt, Human
gccucuagauugacgugggccagc

SEQ ID NO: 61456 - RNA, 23 nt, Human
cugaaucucccaguguucagucu

SEQ ID NO: 61457 - RNA, 22 nt, Human
cuguccauccugugcaguauuu

SEQ ID NO: 61458 - RNA, 23 nt, Human
gucccaaguuggaaauauucaug

SEQ ID NO: 61459 - RNA, 25 nt, Human
auugaacuucuuugaauuuacugga

SEQ ID NO: 61460 - RNA, 23 nt, Human
gauaaugcaaaaauuauguaaua

SEQ ID NO: 61461 - RNA, 22 nt, Human
uagaagcagauguucuguuugg

SEQ ID NO: 61462 - RNA, 21 nt, Human
cugagugguuuaaaaaggacu

SEQ ID NO: 61463 - RNA, 22 nt, Human
agacaguggcagcaaaggaaga

SEQ ID NO: 61464 - RNA, 26 nt, Human
ugaaaaaauacuuccgaaaccaggaa

SEQ ID NO: 61465 - RNA, 21 nt, Human
uacagugucaguuauuuaaag

SEQ ID NO: 61466 - RNA, 28 nt, Human
cucuccucagagagccaggucuaaugcc

SEQ ID NO: 61467 - RNA, 28 nt, Human
ucucuauguuucucuccauuuucauucc

SEQ ID NO: 61468 - RNA, 26 nt, Human
aucuaccacuauaucccaaauaccua

SEQ ID NO: 61469 - RNA, 20 nt, Human
cccgcuggccacccagcaca

SEQ ID NO: 61470 - RNA, 27 nt, Human
gucucgaacuccugaacucaagugauu

SEQ ID NO: 61471 - RNA, 22 nt, Human
uucauucuccugguccugugca

SEQ ID NO: 61472 - RNA, 22 nt, Human
gucugacaaaaucagaguuagg

SEQ ID NO: 61473 - RNA, 26 nt, Human
ggaaagugcuuagcucucucccuccu

SEQ ID NO: 61474 - RNA, 23 nt, Human
guuccucccucuccccuguaacc

SEQ ID NO: 61475 - RNA, 19 nt, Human
ccacacguuggccauucca

SEQ ID NO: 61476 - RNA, 24 nt, Human
aacggugacuuuguggaucgaggc

SEQ ID NO: 61477 - RNA, 21 nt, Human
uuauuuuauaauacuuuugga

SEQ ID NO: 61478 - RNA, 20 nt, Human
cccgcugaccgcuccuccag

SEQ ID NO: 61479 - RNA, 20 nt, Human
agaucuguaauguuauuucc

SEQ ID NO: 61480 - RNA, 22 nt, Human
agggaaaggaauauuaugggau

SEQ ID NO: 61481 - RNA, 22 nt, Human
uggacuuuguuaaauauuuuac

SEQ ID NO: 61482 - RNA, 20 nt, Human
augcaaggugcugguggguc

SEQ ID NO: 61483 - RNA, 20 nt, Human
auuacugacuuuccuugagu

SEQ ID NO: 61484 - RNA, 22 nt, Human
uguuuuuaaaaaguuuucucug

SEQ ID NO: 61485 - RNA, 21 nt, Human
ucuggagaagugggcgcugca

SEQ ID NO: 61486 - RNA, 21 nt, Human
ggccaauggucagaucuucaa

SEQ ID NO: 61487 - RNA, 25 nt, Human
ucuacugcugcuguacccuaggaau

SEQ ID NO: 61488 - RNA, 22 nt, Human
uucgccauguugcccaggcugg

SEQ ID NO: 61489 - RNA, 24 nt, Human
ccaugaucuguugauaucuuugaa

SEQ ID NO: 61490 - RNA, 26 nt, Human
cuuugggcauggccaggggaagcaga

SEQ ID NO: 61491 - RNA, 20 nt, Human
cagccaucaugugccuggaa

SEQ ID NO: 61492 - RNA, 27 nt, Human
ugaacaacuaggcuucagcauauuuau

SEQ ID NO: 61493 - RNA, 25 nt, Human
acccaggcuggagugcaguggcaca

SEQ ID NO: 61494 - RNA, 25 nt, Human
gcccaggcuggagugcaguggcacg

SEQ ID NO: 61495 - RNA, 22 nt, Human
ggccagcgcugcaaccuccuuc

SEQ ID NO: 61496 - RNA, 25 nt, Human
ggcuuccuggguguuucaggcaagg

SEQ ID NO: 61497 - RNA, 26 nt, Human
cuucauacaaaacaaaaggaauaaga

SEQ ID NO: 61498 - RNA, 18 nt, Human
aauaagaaaucuuugggg

SEQ ID NO: 61499 - RNA, 22 nt, Human
uuaacuguuucaugcgcuuguu

SEQ ID NO: 61500 - RNA, 25 nt, Human
gaggugcggccaccacccuacuuca

SEQ ID NO: 61501 - RNA, 22 nt, Human
acccuugccacgguagaauggg

SEQ ID NO: 61502 - RNA, 19 nt, Human
cugcucccucuccucagcc

SEQ ID NO: 61503 - RNA, 18 nt, Human
agaacaacaguggacuuu

SEQ ID NO: 61504 - RNA, 21 nt, Human
gaccagccugccaacauggug

SEQ ID NO: 61505 - RNA, 21 nt, Human
uuuuauuggacuaaauaguca

SEQ ID NO: 61506 - RNA, 23 nt, Human
ccaagcguuccuggccuucugaa

SEQ ID NO: 61507 - RNA, 24 nt, Human
caagacagaaagagacaggagaca

SEQ ID NO: 61508 - RNA, 22 nt, Human
uuggccaggcugguggugagcu

SEQ ID NO: 61509 - RNA, 21 nt, Human
agaacggcugggcucaaagau

SEQ ID NO: 61510 - RNA, 26 nt, Human
cccggcucucccgcccugcacgagcc

SEQ ID NO: 61511 - RNA, 22 nt, Human
ccugucacauauuucucuuagg

SEQ ID NO: 61512 - RNA, 23 nt, Human
gaaugucccccaucauguggccc

SEQ ID NO: 61513 - RNA, 22 nt, Human
ggcgggauauguggugccuguc

SEQ ID NO: 61514 - RNA, 22 nt, Human
acagaaauucauuaugcugcua

SEQ ID NO: 61515 - RNA, 27 nt, Human
gguggggggucuuggagccaagcucuu

SEQ ID NO: 61516 - RNA, 25 nt, Human
accacagaaaccucugaauguaaug

SEQ ID NO: 61517 - RNA, 24 nt, Human
gguacggagaaacugaacugagaa

SEQ ID NO: 61518 - RNA, 20 nt, Human
ucgcccgaagcccucccucg

SEQ ID NO: 61519 - RNA, 19 nt, Human
ccaggcuggaguguagugg

SEQ ID NO: 61520 - RNA, 19 nt, Human
ccagguuggagugcagugg

SEQ ID NO: 61521 - RNA, 29 nt, Human
gcugcgcggccccagccugggcacccuga

SEQ ID NO: 61522 - RNA, 21 nt, Human
gcgccgccaccaugcccaacu

SEQ ID NO: 61523 - RNA, 21 nt, Human
cucguuuuuucuucacugcaa

SEQ ID NO: 61524 - RNA, 20 nt, Human
acccaguucuucauuuggag

SEQ ID NO: 61525 - RNA, 21 nt, Human
ucgcccaggcuggggugcagu

SEQ ID NO: 61526 - RNA, 22 nt, Human
agugggccauccagagcauggc

SEQ ID NO: 61527 - RNA, 23 nt, Human
uggguguauguuugggaagaaaa

SEQ ID NO: 61528 - RNA, 27 nt, Human
ucugguuaauaauccgaaauguuaccg

SEQ ID NO: 61529 - RNA, 27 nt, Human
ggcuggcuagucagccuugcauguauu

SEQ ID NO: 61530 - RNA, 23 nt, Human
cauuaucagugaacuacucugag

SEQ ID NO: 61531 - RNA, 26 nt, Human
uuccagaguuuuugagcuagaaggag

SEQ ID NO: 61532 - RNA, 19 nt, Human
ugggacugagcagcuggga

SEQ ID NO: 61533 - RNA, 20 nt, Human
acccuaacuuggaagaguga

SEQ ID NO: 61534 - RNA, 18 nt, Human
uccauauacuauauugug

SEQ ID NO: 61535 - RNA, 26 nt, Human
cccuccaggccgacaggaggccaugc

SEQ ID NO: 61536 - RNA, 22 nt, Human
ggugcggugcuggugccuuggg

SEQ ID NO: 61537 - RNA, 19 nt, Human
acucugucuuacucuguca

SEQ ID NO: 61538 - RNA, 20 nt, Human
caucuagccuaaaguauaca

SEQ ID NO: 61539 - RNA, 22 nt, Human
uccagguuauauaaaacugcau

SEQ ID NO: 61540 - RNA, 27 nt, Human
ccugccugccaccuccccugccagccc

SEQ ID NO: 61541 - RNA, 22 nt, Human
ccgcagccugucagccaacauu

SEQ ID NO: 61542 - RNA, 22 nt, Human
acugcccaggcuggagcauagu

SEQ ID NO: 61543 - RNA, 23 nt, Human
ugggguggggggacaggaggggg

SEQ ID NO: 61544 - RNA, 23 nt, Human
gcucaucuguggccacugccuuc

SEQ ID NO: 61545 - RNA, 26 nt, Human
uuuacuuucccuucccccauaaguug

SEQ ID NO: 61546 - RNA, 22 nt, Human
gauggggucuugcuauguugcc

SEQ ID NO: 61547 - RNA, 23 nt, Human
uugccauagucccuucccccuga

SEQ ID NO: 61548 - RNA, 29 nt, Human
caggucaauagacagaaaguacauuagaa

SEQ ID NO: 61549 - RNA, 25 nt, Human
gcaguuaucauagagcacagucccu

SEQ ID NO: 61550 - RNA, 20 nt, Human
uagagcuggaggcuguggga

SEQ ID NO: 61551 - RNA, 24 nt, Human
auggacucaugagcuauuguuggu

SEQ ID NO: 61552 - RNA, 20 nt, Human
gcccuucuccccgcugggcu

SEQ ID NO: 61553 - RNA, 22 nt, Human
cgcuaaaucauugaugacucca

SEQ ID NO: 61554 - RNA, 27 nt, Human
cucagcagcugcguccuccuucagcug

SEQ ID NO: 61555 - RNA, 26 nt, Human
accuucagugaguuugaccauugugc

SEQ ID NO: 61556 - RNA, 18 nt, Human
gggggauggcaccucuca

SEQ ID NO: 61557 - RNA, 22 nt, Human
cuguccucaccaacuguuuugu

SEQ ID NO: 61558 - RNA, 22 nt, Human
ugcggugagccaagagcgcacc

SEQ ID NO: 61559 - RNA, 24 nt, Human
uguugcugagucugcagaugagga

SEQ ID NO: 61560 - RNA, 27 nt, Human
aaggccgcuguucaccacagggcuaag

SEQ ID NO: 61561 - RNA, 29 nt, Human
uagguuucagcagagcugaaagcuggugg

SEQ ID NO: 61562 - RNA, 22 nt, Human
gccagaagcagcuccucuuuaa

SEQ ID NO: 61563 - RNA, 22 nt, Human
cccaaguagcugagauuacagg

SEQ ID NO: 61564 - RNA, 22 nt, Human
cccagguagcugggauuacagg

SEQ ID NO: 61565 - RNA, 25 nt, Human
ccuuuaucugcaccuagaaccuccc

SEQ ID NO: 61566 - RNA, 27 nt, Human
uaaaccugaacaaacccuuuaaauggg

SEQ ID NO: 61567 - RNA, 24 nt, Human
aaacuauuugaccaugauaauuca

SEQ ID NO: 61568 - RNA, 22 nt, Human
aaauaucucccuggcagggucc

SEQ ID NO: 61569 - RNA, 22 nt, Human
ccaacccaaacuagcugggagu

SEQ ID NO: 61570 - RNA, 28 nt, Human
guuuucugaaucuugccuagguguuuca

SEQ ID NO: 61571 - RNA, 21 nt, Human
agcccgaggcuggaaguggug

SEQ ID NO: 61572 - RNA, 22 nt, Human
uaucugucaucuugcaguauua

SEQ ID NO: 61573 - RNA, 22 nt, Human
caggcuggccgccagcuggcac

SEQ ID NO: 61574 - RNA, 18 nt, Human
gggcuccugccggaucca

SEQ ID NO: 61575 - RNA, 23 nt, Human
ggaguuagggagagagaagcagg

SEQ ID NO: 61576 - RNA, 23 nt, Human
ugccuguaaucccagcuacuugg

SEQ ID NO: 61577 - RNA, 22 nt, Human
agcuauaaucuccccugccuuc

SEQ ID NO: 61578 - RNA, 21 nt, Human
cucaaugcucaucacacacag

SEQ ID NO: 61579 - RNA, 22 nt, Human
uuacucucuucugcccucucuc

SEQ ID NO: 61580 - RNA, 23 nt, Human
aagcugggauagaugggcagcag

SEQ ID NO: 61581 - RNA, 23 nt, Human
aaauugguagugucuguuaaguu

SEQ ID NO: 61582 - RNA, 21 nt, Human
uuaaacucagggacagagcca

SEQ ID NO: 61583 - RNA, 26 nt, Human
cuccaccuccacaugcuccgccucca

SEQ ID NO: 61584 - RNA, 21 nt, Human
ugccucuguuccugaauuaca

SEQ ID NO: 61585 - RNA, 25 nt, Human
agaaauguuaaacuaucugggggaa

SEQ ID NO: 61586 - RNA, 22 nt, Human
ccaggagaauuaggaaggccau

SEQ ID NO: 61587 - RNA, 22 nt, Human
uauugcauacaagauuuauugc

SEQ ID NO: 61588 - RNA, 21 nt, Human
cuuuuucacacugauguagau

SEQ ID NO: 61589 - RNA, 23 nt, Human
ucugcuuucugugccuaguugaa

SEQ ID NO: 61590 - RNA, 24 nt, Human
aaacucaagacaaugcaccuagcu

SEQ ID NO: 61591 - RNA, 19 nt, Human
aaucuuucuuuucauugac

SEQ ID NO: 61592 - RNA, 21 nt, Human
cugacucucugguuuagugcu

SEQ ID NO: 61593 - RNA, 25 nt, Human
gccuaaacuguguuuuuuaugucca

SEQ ID NO: 61594 - RNA, 23 nt, Human
acauguguauguauuauuuggac

SEQ ID NO: 61595 - RNA, 22 nt, Human
uguucugcucuguuuuugacuc

SEQ ID NO: 61596 - RNA, 22 nt, Human
gugaucucggcucgcugcagcc

SEQ ID NO: 61597 - RNA, 22 nt, Human
uuaccuuugcugucacuuucuc

SEQ ID NO: 61598 - RNA, 22 nt, Human
cugaguagcugggacuacagga

SEQ ID NO: 61599 - RNA, 22 nt, Human
agcuuuacugccuuccuccuua

SEQ ID NO: 61600 - RNA, 23 nt, Human
acuaccuggagagaacuuaguaa

SEQ ID NO: 61601 - RNA, 27 nt, Human
ggcaaagcagcaacuauucacaaaaua

SEQ ID NO: 61602 - RNA, 27 nt, Human
ugccuguaaucucagcuacucaggagg

SEQ ID NO: 61603 - RNA, 24 nt, Human
cuugagguucaaaaauaauucauu

SEQ ID NO: 61604 - RNA, 21 nt, Human
ucacccauugucuguguuuag

SEQ ID NO: 61605 - RNA, 18 nt, Human
gcucaagcuauugagcug

SEQ ID NO: 61606 - RNA, 27 nt, Human
cacaaaugcaauaauacaauaccccuu

SEQ ID NO: 61607 - RNA, 20 nt, Human
caguagagagccuuucucca

SEQ ID NO: 61608 - RNA, 21 nt, Human
cacagccgcuugcacguauag

SEQ ID NO: 61609 - RNA, 24 nt, Human
gacaaauucaggauaccagaaggc

SEQ ID NO: 61610 - RNA, 23 nt, Human
acuguucuuuucuuucuuuuugu

SEQ ID NO: 61611 - RNA, 23 nt, Human
ucacguuuucagccaaacaucua

SEQ ID NO: 61612 - RNA, 25 nt, Human
cugcagucuuuacacccacagcucu

SEQ ID NO: 61613 - RNA, 21 nt, Human
ugauuguccauuuacagcccu

SEQ ID NO: 61614 - RNA, 22 nt, Human
caaaacuguaacugcauuagaa

SEQ ID NO: 61615 - RNA, 23 nt, Human
cuccucuggcccugcucuccugc

SEQ ID NO: 61616 - RNA, 25 nt, Human
ucuguccuacuucugacuuuacuug

SEQ ID NO: 61617 - RNA, 29 nt, Human
aaugcaaaguuaagcagacuugaccaaug

SEQ ID NO: 61618 - RNA, 27 nt, Human
ucuucugccucagccucccgaguagcu

SEQ ID NO: 61619 - RNA, 31 nt, Human
cucuuuccaucuacccuccgauuguuccuga

SEQ ID NO: 61620 - RNA, 22 nt, Human
uuucuuucuuuuucuucaaauu

SEQ ID NO: 61621 - RNA, 22 nt, Human
cauuuugguccaaguugugcuu

SEQ ID NO: 61622 - RNA, 21 nt, Human
ccugccuccaucaccugggcc

SEQ ID NO: 61623 - RNA, 22 nt, Human
cacgccuguaaucccagcacuu

SEQ ID NO: 61624 - RNA, 20 nt, Human
gcaggcugagugcacuggca

SEQ ID NO: 61625 - RNA, 26 nt, Human
gauggccaugcuuaagccagcaauug

SEQ ID NO: 61626 - RNA, 21 nt, Human
cccacccacacagcugcccua

SEQ ID NO: 61627 - RNA, 20 nt, Human
cccucgaggaaccuggucuc

SEQ ID NO: 61628 - RNA, 24 nt, Human
gugcugcuggaaauggcuucuuua

SEQ ID NO: 61629 - RNA, 21 nt, Human
ccaaaacaguggccacccguc

SEQ ID NO: 61630 - RNA, 21 nt, Human
auaguacacuuuaacucuuuc

SEQ ID NO: 61631 - RNA, 19 nt, Human
acccccacuccugcccgcc

SEQ ID NO: 61632 - RNA, 21 nt, Human
ugucaugagauccucuaccuc

SEQ ID NO: 61633 - RNA, 28 nt, Human
acggucugguguaaaaguagugaguuaa

SEQ ID NO: 61634 - RNA, 22 nt, Human
ggaggcaccuccaggcaggcca

SEQ ID NO: 61635 - RNA, 23 nt, Human
ugggcagucaggggcaaggacug

SEQ ID NO: 61636 - RNA, 22 nt, Human
ccacucauucacccaaccucag

SEQ ID NO: 61637 - RNA, 21 nt, Human
cagcucuugccaaagggccug

SEQ ID NO: 61638 - RNA, 19 nt, Human
agaaaacaaaauucugaau

SEQ ID NO: 61639 - RNA, 31 nt, Human
caucuaccucuguuuuuaauuuucuuuccaa

SEQ ID NO: 61640 - RNA, 21 nt, Human
aggauuucagaguuaaccuca

SEQ ID NO: 61641 - RNA, 21 nt, Human
cucccccacacuucgcggcuu

SEQ ID NO: 61642 - RNA, 22 nt, Human
ccagagcugccauuugucucca

SEQ ID NO: 61643 - RNA, 27 nt, Human
uuucccaagauuccugucccuagcccu

SEQ ID NO: 61644 - RNA, 22 nt, Human
cuacaacuccagccacccagcc

SEQ ID NO: 61645 - RNA, 22 nt, Human
gugaacaaacaauaugugguca

SEQ ID NO: 61646 - RNA, 26 nt, Human
acaauauguuaacuacauuaaaugcu

SEQ ID NO: 61647 - RNA, 22 nt, Human
uucuggcugaaaacuugccuua

SEQ ID NO: 61648 - RNA, 19 nt, Human
guauuuuugcaguuccucc

SEQ ID NO: 61649 - RNA, 20 nt, Human
ggaagccucugaagagacca

SEQ ID NO: 61650 - RNA, 21 nt, Human
cagugggaggccaguggugcu

SEQ ID NO: 61651 - RNA, 26 nt, Human
uucaaaacaaauguggauacagucuu

SEQ ID NO: 61652 - RNA, 19 nt, Human
uuucauguugaaaaucagu

SEQ ID NO: 61653 - RNA, 22 nt, Human
ugcacacacccaggaaguucug

SEQ ID NO: 61654 - RNA, 23 nt, Human
cgccuguaaucccagcuacuugg

SEQ ID NO: 61655 - RNA, 27 nt, Human
uggccuuugggguucaagaucacuggg

SEQ ID NO: 61656 - RNA, 23 nt, Human
cuguuguuugugguuuucucaua

SEQ ID NO: 61657 - RNA, 20 nt, Human
cagacagacagacggaucua

SEQ ID NO: 61658 - RNA, 24 nt, Human
auuuuucuuagcccaagaggucuu

SEQ ID NO: 61659 - RNA, 21 nt, Human
acucucaggauuucaccagaa

SEQ ID NO: 61660 - RNA, 23 nt, Human
gcucccagccaggacauggccgc

SEQ ID NO: 61661 - RNA, 21 nt, Human
auagguaacccacaggcccag

SEQ ID NO: 61662 - RNA, 29 nt, Human
ugcaggagggacucugaaaccucaagcug

SEQ ID NO: 61663 - RNA, 28 nt, Human
cugcagucaucuccccuccuggcgaguu

SEQ ID NO: 61664 - RNA, 18 nt, Human
ggccucggcuugcucuug

SEQ ID NO: 61665 - RNA, 26 nt, Human
uuucccuggcuauuuucuacccacag

SEQ ID NO: 61666 - RNA, 21 nt, Human
uuauucagaaguaaaaaagca

SEQ ID NO: 61667 - RNA, 24 nt, Human
caaggugggacccugaacaguggu

SEQ ID NO: 61668 - RNA, 20 nt, Human
uuccauucuggauguuugga

SEQ ID NO: 61669 - RNA, 19 nt, Human
gaagagaggagugggacag

SEQ ID NO: 61670 - RNA, 23 nt, Human
uacugcauucuuaccauccuucu

SEQ ID NO: 61671 - RNA, 21 nt, Human
aggcugaagagauuucaaaga

SEQ ID NO: 61672 - RNA, 20 nt, Human
gaacaguccuguggaaaggc

SEQ ID NO: 61673 - RNA, 22 nt, Human
aguagccccuuccuccuccucc

SEQ ID NO: 61674 - RNA, 22 nt, Human
ggaggcugaggcaggaaaauca

SEQ ID NO: 61675 - RNA, 20 nt, Human
ucaguguuuguucccacuua

SEQ ID NO: 61676 - RNA, 22 nt, Human
gacuacaggugugcgccaccau

SEQ ID NO: 61677 - RNA, 18 nt, Human
gucagggcugaagucgga

SEQ ID NO: 61678 - RNA, 22 nt, Human
gcagccgccgcccacggcacgg

SEQ ID NO: 61679 - RNA, 22 nt, Human
ccauccagcuggguagccgggg

SEQ ID NO: 61680 - RNA, 22 nt, Human
uuguuuuucccuuuuuucucca

SEQ ID NO: 61681 - RNA, 22 nt, Human
ucugaaggaacgguugcagucc

SEQ ID NO: 61682 - RNA, 26 nt, Human
cccaucaucuguggacacuggagucu

SEQ ID NO: 61683 - RNA, 22 nt, Human
cucagaccacaggaaacucuuc

SEQ ID NO: 61684 - RNA, 25 nt, Human
aacaugcucuccugcucaaggcaca

SEQ ID NO: 61685 - RNA, 27 nt, Human
uaucuggagcauuguguauagaacugg

SEQ ID NO: 61686 - RNA, 22 nt, Human
uucuccuccuccuuucuccagc

SEQ ID NO: 61687 - RNA, 21 nt, Human
ggggguggggaggaggaagcc

SEQ ID NO: 61688 - RNA, 21 nt, Human
gggaguggggaccaggaagag

SEQ ID NO: 61689 - RNA, 27 nt, Human
gcagagcugggugggcugagaccagca

SEQ ID NO: 61690 - RNA, 22 nt, Human
ucuccuccucugcguccucggc

SEQ ID NO: 61691 - RNA, 21 nt, Human
gggagcacacucuuggcacau

SEQ ID NO: 61692 - RNA, 22 nt, Human
ggcagucuccccuuccuggcac

SEQ ID NO: 61693 - RNA, 21 nt, Human
ugagccaagaucgcaccacug

SEQ ID NO: 61694 - RNA, 21 nt, Human
cuuugcagagaaagccccccu

SEQ ID NO: 61695 - RNA, 25 nt, Human
ucucggcucacagcaaccucucugc

SEQ ID NO: 61696 - RNA, 21 nt, Human
ucucccacaugcacagcuucc

SEQ ID NO: 61697 - RNA, 23 nt, Human
gcucuguacccaugaacucccag

SEQ ID NO: 61698 - RNA, 21 nt, Human
ggagccggcgucucagcacac

SEQ ID NO: 61699 - RNA, 21 nt, Human
auugacuguaccacagacaca

SEQ ID NO: 61700 - RNA, 23 nt, Human
cucagccaggagccaguggcagg

SEQ ID NO: 61701 - RNA, 23 nt, Human
uuauuccagagugccucaguuag

SEQ ID NO: 61702 - RNA, 27 nt, Human
cuuauuucucaagcugugccuucccuu

SEQ ID NO: 61703 - RNA, 26 nt, Human
cugccucugcugccgggccuggacca

SEQ ID NO: 61704 - RNA, 23 nt, Human
aggcccagccugggacccucugg

SEQ ID NO: 61705 - RNA, 22 nt, Human
uguggugaugacagaaucagcu

SEQ ID NO: 61706 - RNA, 23 nt, Human
aaggcuuagguuuggugugcaga

SEQ ID NO: 61707 - RNA, 20 nt, Human
gaacaguucagccauuugaa

SEQ ID NO: 61708 - RNA, 24 nt, Human
ucacucaccugcacaucucaguca

SEQ ID NO: 61709 - RNA, 22 nt, Human
cucuugugcuggauggagccca

SEQ ID NO: 61710 - RNA, 15 nt, Human
acucccccgcacagg

SEQ ID NO: 61711 - RNA, 27 nt, Human
cucacuggugacuucaucccucaggcu

SEQ ID NO: 61712 - RNA, 22 nt, Human
uuuugacaaaguggaacagugg

SEQ ID NO: 61713 - RNA, 27 nt, Human
gccucaaacuccugcccuccccaggcc

SEQ ID NO: 61714 - RNA, 25 nt, Human
augggagcugaggccacacucagca

SEQ ID NO: 61715 - RNA, 22 nt, Human
ccccuucccugcuugcacccug

SEQ ID NO: 61716 - RNA, 20 nt, Human
ggagggugguuacugugggu

SEQ ID NO: 61717 - RNA, 21 nt, Human
gcacuuauuucccuccugucc

SEQ ID NO: 61718 - RNA, 19 nt, Human
acuccaucagccaggcugg

SEQ ID NO: 61719 - RNA, 26 nt, Human
gucaaugugaacaccucucuuugugc

SEQ ID NO: 61720 - RNA, 23 nt, Human
cugagguagcucucuucaucuua

SEQ ID NO: 61721 - RNA, 23 nt, Human
uucacuacccacuaucuuauuca

SEQ ID NO: 61722 - RNA, 20 nt, Human
gacaucaugacgaaacccca

SEQ ID NO: 61723 - RNA, 22 nt, Human
cucuggggcccagccugccugc

SEQ ID NO: 61724 - RNA, 23 nt, Human
ccauauuuauguaggugguuuua

SEQ ID NO: 61725 - RNA, 17 nt, Human
ugaaguaauacuguguu

SEQ ID NO: 61726 - RNA, 22 nt, Human
ccaacauggggaaacccugucu

SEQ ID NO: 61727 - RNA, 25 nt, Human
ccuucagacaaacaggaaacuucug

SEQ ID NO: 61728 - RNA, 23 nt, Human
ggaguagcugggauuacaggcac

SEQ ID NO: 61729 - RNA, 22 nt, Human
ccaggaggagaggcuugccgug

SEQ ID NO: 61730 - RNA, 23 nt, Human
cugacccuacucccuugcccuag

SEQ ID NO: 61731 - RNA, 22 nt, Human
cuuguucugccagcuggagcca

SEQ ID NO: 61732 - RNA, 21 nt, Human
ggcaaagugcugggacuuuuu

SEQ ID NO: 61733 - RNA, 27 nt, Human
uaugauacagagaaccugaacucugaa

SEQ ID NO: 61734 - RNA, 23 nt, Human
ugggcuuuuuuauacucuucuca

SEQ ID NO: 61735 - RNA, 23 nt, Human
cccugacuuuguuuuuguggaca

SEQ ID NO: 61736 - RNA, 21 nt, Human
uucauucuucccauggcagcu

SEQ ID NO: 61737 - RNA, 18 nt, Human
auucauugcagugggaua

SEQ ID NO: 61738 - RNA, 24 nt, Human
acacuaguaacagugaaagcacaa

SEQ ID NO: 61739 - RNA, 21 nt, Human
uugcuaccacagacuugcacu

SEQ ID NO: 61740 - RNA, 27 nt, Human
uccuccaggauccccacccaaagccug

SEQ ID NO: 61741 - RNA, 25 nt, Human
cgauccuaucaccucagucucccaa

SEQ ID NO: 61742 - RNA, 22 nt, Human
caggcuggaggucaguggcaca

SEQ ID NO: 61743 - RNA, 19 nt, Human
gccccagggcaggaaagca

SEQ ID NO: 61744 - RNA, 22 nt, Human
ucuggauucucugggucuaugu

SEQ ID NO: 61745 - RNA, 21 nt, Human
accacaacuaacaaugccuug

SEQ ID NO: 61746 - RNA, 28 nt, Human
ggggacugggacuggcagagcugccggc

SEQ ID NO: 61747 - RNA, 22 nt, Human
cuaaucaaauucugucugggga

SEQ ID NO: 61748 - RNA, 23 nt, Human
ccuuuuccccacggcccuugcca

SEQ ID NO: 61749 - RNA, 21 nt, Human
auuuaagguagcuucagcuag

SEQ ID NO: 61750 - RNA, 22 nt, Human
uuccauuuauugcacucagcuu

SEQ ID NO: 61751 - RNA, 29 nt, Human
ccacaaccaccuccagccugggagauagg

SEQ ID NO: 61752 - RNA, 21 nt, Human
gccaugucacugcucugcgug

SEQ ID NO: 61753 - RNA, 21 nt, Human
guugccaggcuggagugcagu

SEQ ID NO: 61754 - RNA, 21 nt, Human
gcccaguuaguggugugcaaa

SEQ ID NO: 61755 - RNA, 22 nt, Human
uucuaaacaugugucucuccca

SEQ ID NO: 61756 - RNA, 23 nt, Human
uccaucuccugggaaauggggcg

SEQ ID NO: 61757 - RNA, 27 nt, Human
ugugaacucagccaagcacaguggugg

SEQ ID NO: 61758 - RNA, 21 nt, Human
ucguuuuugggcaacuccagu

SEQ ID NO: 61759 - RNA, 22 nt, Human
uucuaaucugaacacaguuauc

SEQ ID NO: 61760 - RNA, 23 nt, Human
agcaugucaaaaugaauguuuac

SEQ ID NO: 61761 - RNA, 27 nt, Human
cagcaguuugagcuugcuggagagugg

SEQ ID NO: 61762 - RNA, 22 nt, Human
cagcuccuccugcuuucuuggg

SEQ ID NO: 61763 - RNA, 24 nt, Human
cugccgcccaggcuggagugcagu

SEQ ID NO: 61764 - RNA, 21 nt, Human
auccuggggcuucaaugcuuc

SEQ ID NO: 61765 - RNA, 20 nt, Human
aucuccacucacugcaggcu

SEQ ID NO: 61766 - RNA, 26 nt, Human
uacuaaguuuccuuuuaauucuacca

SEQ ID NO: 61767 - RNA, 21 nt, Human
uaaaagaaaaaggaaaaagaa

SEQ ID NO: 61768 - RNA, 21 nt, Human
accgucgauggugaaguugcc

SEQ ID NO: 61769 - RNA, 27 nt, Human
ugguucacacauaugacacacucccgu

SEQ ID NO: 61770 - RNA, 18 nt, Human
cucuucaugaauuacagc

SEQ ID NO: 61771 - RNA, 27 nt, Human
ggugucucaaaggaguaacugcagcuu

SEQ ID NO: 61772 - RNA, 28 nt, Human
ggguaaguuucagaauuguaauuugaga

SEQ ID NO: 61773 - RNA, 24 nt, Human
aggccaucaacccucuugguugag

SEQ ID NO: 61774 - RNA, 22 nt, Human
ugaacuccugggcucaagugau

SEQ ID NO: 61775 - RNA, 22 nt, Human
ugaacuccuggccucaagucau

SEQ ID NO: 61776 - RNA, 21 nt, Human
aguguucugguagcaucuacc

SEQ ID NO: 61777 - RNA, 27 nt, Human
uucuccaggaaccacaucaccugcccu

SEQ ID NO: 61778 - RNA, 24 nt, Human
caggggaggggcaggagucccagc

SEQ ID NO: 61779 - RNA, 21 nt, Human
accccuuucuuugacucagaa

SEQ ID NO: 61780 - RNA, 21 nt, Human
acucuguggaagggaaggggu

SEQ ID NO: 61781 - RNA, 25 nt, Human
acucaugucuccuuccacaguuuac

SEQ ID NO: 61782 - RNA, 27 nt, Human
uuuuccuuggcuggauuuacccagugg

SEQ ID NO: 61783 - RNA, 24 nt, Human
ccugccacccugccgcccugccgc

SEQ ID NO: 61784 - RNA, 21 nt, Human
ccaggcuggggcagguucuua

SEQ ID NO: 61785 - RNA, 20 nt, Human
aacuuugaagcaacugugaa

SEQ ID NO: 61786 - RNA, 22 nt, Human
aggccuuaauauguuaaccuca

SEQ ID NO: 61787 - RNA, 20 nt, Human
ugcuguuuccaacacuggug

SEQ ID NO: 61788 - RNA, 21 nt, Human
aaaggcugaugaugguauaaa

SEQ ID NO: 61789 - RNA, 21 nt, Human
agagaaacugugugugagggg

SEQ ID NO: 61790 - RNA, 22 nt, Human
cugcaaccuccgccuucccaga

SEQ ID NO: 61791 - RNA, 25 nt, Human
cuugucaaccgggcuggagugcagu

SEQ ID NO: 61792 - RNA, 18 nt, Human
aguuuuuuagacuggaaa

SEQ ID NO: 61793 - RNA, 26 nt, Human
aguuuugacaagcuggcuuacacugg

SEQ ID NO: 61794 - RNA, 26 nt, Human
gcugcucugggaagugaguucgccug

SEQ ID NO: 61795 - RNA, 22 nt, Human
gucuugaacuccuggcucaaga

SEQ ID NO: 61796 - RNA, 26 nt, Human
ucugugcucacccaggcugagggugc

SEQ ID NO: 61797 - RNA, 26 nt, Human
caggagguggagguugcaguaagcug

SEQ ID NO: 61798 - RNA, 22 nt, Human
guucuugccugcuucacugugg

SEQ ID NO: 61799 - RNA, 18 nt, Human
ccaacagcagcgcuguua

SEQ ID NO: 61800 - RNA, 23 nt, Human
uagaucauccucagaaaagccuu

SEQ ID NO: 61801 - RNA, 23 nt, Human
aggauuucuugugccauuuucau

SEQ ID NO: 61802 - RNA, 21 nt, Human
guuuccugggucaggaacaga

SEQ ID NO: 61803 - RNA, 27 nt, Human
ggaggcuggaggaagggggguugcagu

SEQ ID NO: 61804 - RNA, 19 nt, Human
cuuuuuucuuuuuuccggc

SEQ ID NO: 61805 - RNA, 21 nt, Human
cucugccuucaaacaaaggca

SEQ ID NO: 61806 - RNA, 26 nt, Human
cagguccuuaaauaaaagugugcugu

SEQ ID NO: 61807 - RNA, 31 nt, Human
ugggcuguggugggaggguugcagcgccgcg

SEQ ID NO: 61808 - RNA, 19 nt, Human
ucaauccuauaaggcacag

SEQ ID NO: 61809 - RNA, 23 nt, Human
accuguaauccuagcuacucggg

SEQ ID NO: 61810 - RNA, 23 nt, Human
accuguaaucccagcuacuuggg

SEQ ID NO: 61811 - RNA, 22 nt, Human
uccuuggagcuggugugcagug

SEQ ID NO: 61812 - RNA, 20 nt, Human
gcaaaggaugcaucuuccca

SEQ ID NO: 61813 - RNA, 24 nt, Human
guugcagggcaguaggagugcaga

SEQ ID NO: 61814 - RNA, 22 nt, Human
caggaucaagacaacccguugg

SEQ ID NO: 61815 - RNA, 27 nt, Human
cccuccuggcccaggccuugcugacuc

SEQ ID NO: 61816 - RNA, 21 nt, Human
caaacuccuuuacugcagccu

SEQ ID NO: 61817 - RNA, 26 nt, Human
accagccugggcaacauaguaagacc

SEQ ID NO: 61818 - RNA, 22 nt, Human
gcagcauuucugagagcauuca

SEQ ID NO: 61819 - RNA, 24 nt, Human
gccucugccaacuccucuggaccc

SEQ ID NO: 61820 - RNA, 23 nt, Human
gcagggaggggacaucugagggc

SEQ ID NO: 61821 - RNA, 26 nt, Human
caggcaccaccuuccuccuugagcuu

SEQ ID NO: 61822 - RNA, 22 nt, Human
gaagugcugggauuacaggcau

SEQ ID NO: 61823 - RNA, 22 nt, Human
aaagugcuaggauuacaggcau

SEQ ID NO: 61824 - RNA, 22 nt, Human
aaagugcugggauuacgggcau

SEQ ID NO: 61825 - RNA, 20 nt, Human
ccaucagcugcuccaucacc

SEQ ID NO: 61826 - RNA, 22 nt, Human
gggccuccccaggagcugugga

SEQ ID NO: 61827 - RNA, 21 nt, Human
ccgaccagcagccaccccgcc

SEQ ID NO: 61828 - RNA, 20 nt, Human
ccggugugaggagcaucugu

SEQ ID NO: 61829 - RNA, 27 nt, Human
gagguugcagcgagcugagaucacgcc

SEQ ID NO: 61830 - RNA, 30 nt, Human
uggugcaagaggcaggauggucuccagaca

SEQ ID NO: 61831 - RNA, 22 nt, Human
guuuaacauacaaucaugugaa

SEQ ID NO: 61832 - RNA, 20 nt, Human
cacaucgcauugaagccaca

SEQ ID NO: 61833 - RNA, 23 nt, Human
uaaaugaugcaauaaaagaccua

SEQ ID NO: 61834 - RNA, 22 nt, Human
uuggguuuuuaaaaaauuguuu

SEQ ID NO: 61835 - RNA, 20 nt, Human
agccagaguuuucucaagag

SEQ ID NO: 61836 - RNA, 28 nt, Human
guguaggcaggugggcucugcuucccga

SEQ ID NO: 61837 - RNA, 16 nt, Human
cccagcucagugccuu

SEQ ID NO: 61838 - RNA, 20 nt, Human
gacuuuuugucucaguccca

SEQ ID NO: 61839 - RNA, 20 nt, Human
uuuauccugugaaacuggcu

SEQ ID NO: 61840 - RNA, 21 nt, Human
agccccgggguggcguaggga

SEQ ID NO: 61841 - RNA, 20 nt, Human
gcaaaguuaacuacacagag

SEQ ID NO: 61842 - RNA, 32 nt, Human
ccacgaacgcucuuagcuuucucaggggguca

SEQ ID NO: 61843 - RNA, 22 nt, Human
ccagcugaggaccucaggcugc

SEQ ID NO: 61844 - RNA, 22 nt, Human
acaaaccugcauguugugcaca

SEQ ID NO: 61845 - RNA, 20 nt, Human
gagcaggccuaucucuuuca

SEQ ID NO: 61846 - RNA, 23 nt, Human
uugcugucuggugcuccucucuc

SEQ ID NO: 61847 - RNA, 21 nt, Human
uaugucccuuaccugggauuu

SEQ ID NO: 61848 - RNA, 20 nt, Human
uaaagaauuuuguggaauac

SEQ ID NO: 61849 - RNA, 23 nt, Human
aguuuauagcaugccuguccuaa

SEQ ID NO: 61850 - RNA, 26 nt, Human
gcagugugccuggcuuggcuucccuu

SEQ ID NO: 61851 - RNA, 23 nt, Human
guguuacugucccuccugguguc

SEQ ID NO: 61852 - RNA, 20 nt, Human
cuuuagaaaaucuggcuucu

SEQ ID NO: 61853 - RNA, 21 nt, Human
uuuaauuuagauucuguguuu

SEQ ID NO: 61854 - RNA, 23 nt, Human
uacagccgccaggagcuacucag

SEQ ID NO: 61855 - RNA, 20 nt, Human
uccccgcaggacauggcucc

SEQ ID NO: 61856 - RNA, 18 nt, Human
agaugaucuuugucugaa

SEQ ID NO: 61857 - RNA, 25 nt, Human
cugauuccccaaaucugcauccuuu

SEQ ID NO: 61858 - RNA, 27 nt, Human
ggcccugccagcaucucuggcucggcu

SEQ ID NO: 61859 - RNA, 19 nt, Human
cccgccuggccggagcugu

SEQ ID NO: 61860 - RNA, 29 nt, Human
ugguggacucgccuguaaucucacuacac

SEQ ID NO: 61861 - RNA, 23 nt, Human
gcuccaagcccagccugccccgc

SEQ ID NO: 61862 - RNA, 25 nt, Human
ugcuucucuccucaucaucauuccc

SEQ ID NO: 61863 - RNA, 23 nt, Human
ggaacaucugcuacuacagccuu

SEQ ID NO: 61864 - RNA, 24 nt, Human
aaccuuugccauuucucugccaua

SEQ ID NO: 61865 - RNA, 19 nt, Human
gggaagagaaugggcagca

SEQ ID NO: 61866 - RNA, 21 nt, Human
cuugccuggcaguguuuguuc

SEQ ID NO: 61867 - RNA, 24 nt, Human
uccgggguucgggcugggagcagc

SEQ ID NO: 61868 - RNA, 27 nt, Human
cauugcacugcagccuggaugacagag

SEQ ID NO: 61869 - RNA, 24 nt, Human
uaaaauaaggcauaaaugcaggua

SEQ ID NO: 61870 - RNA, 24 nt, Human
gagauuggaaagauuguugggagu

SEQ ID NO: 61871 - RNA, 23 nt, Human
agcuugaguugaagaagacacug

SEQ ID NO: 61872 - RNA, 19 nt, Human
gccuguucugggcauuuca

SEQ ID NO: 61873 - RNA, 24 nt, Human
uugcaauccaggcuguucucagcg

SEQ ID NO: 61874 - RNA, 23 nt, Human
ugcauuucugugcucccuccucc

SEQ ID NO: 61875 - RNA, 23 nt, Human
ugguuccuagggggauacuccuu

SEQ ID NO: 61876 - RNA, 19 nt, Human
caguuccucagucuguaaa

SEQ ID NO: 61877 - RNA, 20 nt, Human
ccuuccugccuccugcccca

SEQ ID NO: 61878 - RNA, 22 nt, Human
uggcagcuucaguucuagagaa

SEQ ID NO: 61879 - RNA, 23 nt, Human
cuguagugccuccuaauaagcag

SEQ ID NO: 61880 - RNA, 21 nt, Human
caaugccaagacggagaccac

SEQ ID NO: 61881 - RNA, 21 nt, Human
acugaccuuccuuaaaaacag

SEQ ID NO: 61882 - RNA, 20 nt, Human
cacuguguuucccugccucu

SEQ ID NO: 61883 - RNA, 21 nt, Human
cuaauaacgcaugcuaguguu

SEQ ID NO: 61884 - RNA, 22 nt, Human
uuggggauuuucaaaagauaau

SEQ ID NO: 61885 - RNA, 21 nt, Human
auggagaaggguauuccuuua

SEQ ID NO: 61886 - RNA, 24 nt, Human
ugagccccagugcuggaagggagg

SEQ ID NO: 61887 - RNA, 24 nt, Human
guuguaucuguaacacuggcacug

SEQ ID NO: 61888 - RNA, 21 nt, Human
aagaagccgggagacacucua

SEQ ID NO: 61889 - RNA, 21 nt, Human
ucacccaggcuggaguggagu

SEQ ID NO: 61890 - RNA, 18 nt, Human
agacuuguucagacccca

SEQ ID NO: 61891 - RNA, 27 nt, Human
aaauguaaaauauuugagaauaaguuc

SEQ ID NO: 61892 - RNA, 21 nt, Human
uugauuacaaguucucugcug

SEQ ID NO: 61893 - RNA, 23 nt, Human
ccugcucuuccauaucauggccc

SEQ ID NO: 61894 - RNA, 19 nt, Human
acucuuuuacucagcucug

SEQ ID NO: 61895 - RNA, 21 nt, Human
ccucaagcccucaaguaggug

SEQ ID NO: 61896 - RNA, 21 nt, Human
cucugugucccccucgcgggc

SEQ ID NO: 61897 - RNA, 20 nt, Human
uugcucucugggcuuuuggu

SEQ ID NO: 61898 - RNA, 22 nt, Human
cuucaucuuccuugggauauau

SEQ ID NO: 61899 - RNA, 27 nt, Human
ccaacuggccagcaggcugugucccug

SEQ ID NO: 61900 - RNA, 22 nt, Human
gugugagccacugcgcccagcc

SEQ ID NO: 61901 - RNA, 21 nt, Human
uguaauucuagcugagugcaa

SEQ ID NO: 61902 - RNA, 25 nt, Human
acucacugccuugagccugcuuccu

SEQ ID NO: 61903 - RNA, 21 nt, Human
caggacauggccgcaccucuc

SEQ ID NO: 61904 - RNA, 21 nt, Human
uaguaucuguggguccuggcc

SEQ ID NO: 61905 - RNA, 27 nt, Human
uuccaagaaugcugagguuacaggcac

SEQ ID NO: 61906 - RNA, 21 nt, Human
cauguagcagagacagagcua

SEQ ID NO: 61907 - RNA, 22 nt, Human
acauggcaucugccacagcaga

SEQ ID NO: 61908 - RNA, 20 nt, Human
ggaaauuuaaguuugcagau

SEQ ID NO: 61909 - RNA, 21 nt, Human
cccaguguugcauuuccuggc

SEQ ID NO: 61910 - RNA, 21 nt, Human
uugguggugaugaugggugag

SEQ ID NO: 61911 - RNA, 22 nt, Human
cccaccccauuaagacucacca

SEQ ID NO: 61912 - RNA, 23 nt, Human
agcuggugcagcggcagagugga

SEQ ID NO: 61913 - RNA, 27 nt, Human
ucugcugucuacgugguggguuguggg

SEQ ID NO: 61914 - RNA, 19 nt, Human
aagcuuccucuggccaggu

SEQ ID NO: 61915 - RNA, 26 nt, Human
cuuuuuaaacaaguguuuccuuucuu

SEQ ID NO: 61916 - RNA, 27 nt, Human
ucucaacuauaucaaguuacuguucag

SEQ ID NO: 61917 - RNA, 19 nt, Human
uuguucugugguuaucaug

SEQ ID NO: 61918 - RNA, 27 nt, Human
cauguuauuucagaauuaugcaaaacg

SEQ ID NO: 61919 - RNA, 21 nt, Human
ugccucagugaccaccucuuu

SEQ ID NO: 61920 - RNA, 20 nt, Human
ugcuccuggagcuucacugg

SEQ ID NO: 61921 - RNA, 20 nt, Human
cuguucuggccccagacaca

SEQ ID NO: 61922 - RNA, 22 nt, Human
gggaauuuggcuucauacucuu

SEQ ID NO: 61923 - RNA, 22 nt, Human
aaacuuuuuauuggcagcagau

SEQ ID NO: 61924 - RNA, 24 nt, Human
aaagugcugggauuacaugagcca

SEQ ID NO: 61925 - RNA, 20 nt, Human
ggcucacuggccguuuguuu

SEQ ID NO: 61926 - RNA, 21 nt, Human
agaaagaugucaacaugcuag

SEQ ID NO: 61927 - RNA, 19 nt, Human
uuacuugguaaagugcagu

SEQ ID NO: 61928 - RNA, 27 nt, Human
gagucugacucaguacuuuucucacuc

SEQ ID NO: 61929 - RNA, 27 nt, Human
ugucacccggguggcgcuggaaguuau

SEQ ID NO: 61930 - RNA, 23 nt, Human
ggcucacugaaaccucugccucc

SEQ ID NO: 61931 - RNA, 25 nt, Human
uacaaaggaaauuucuaaagcacaa

SEQ ID NO: 61932 - RNA, 22 nt, Human
cgccccucugggccugccugug

SEQ ID NO: 61933 - RNA, 26 nt, Human
uauauauguauuaucaaauauguaag

SEQ ID NO: 61934 - RNA, 26 nt, Human
uguauacaaaaguuuuaacuacuuuu

SEQ ID NO: 61935 - RNA, 24 nt, Human
acuaauaucaacaguauaucucag

SEQ ID NO: 61936 - RNA, 21 nt, Human
ccuugggaucugccaggcugg

SEQ ID NO: 61937 - RNA, 22 nt, Human
cucagcuuuuugucuuuucuga

SEQ ID NO: 61938 - RNA, 27 nt, Human
ccuguccucuagaccccacccugggug

SEQ ID NO: 61939 - RNA, 28 nt, Human
gggacaccucucccccucaucccccgau

SEQ ID NO: 61940 - RNA, 27 nt, Human
uuccauucaacaggcacauguuuaaaa

SEQ ID NO: 61941 - RNA, 27 nt, Human
acaaaccuuuugguaaugugcacugug

SEQ ID NO: 61942 - RNA, 21 nt, Human
cgucuggcugggggcugccag

SEQ ID NO: 61943 - RNA, 27 nt, Human
agagcaucugccccagucaacuucuca

SEQ ID NO: 61944 - RNA, 20 nt, Human
caggagauagcuguucucca

SEQ ID NO: 61945 - RNA, 24 nt, Human
gguuccaugccugcucucgaggca

SEQ ID NO: 61946 - RNA, 16 nt, Human
accuaaaaauguuugc

SEQ ID NO: 61947 - RNA, 24 nt, Human
uggaaacaaacaaaaagcagcuga

SEQ ID NO: 61948 - RNA, 25 nt, Human
cccccgacggacaccaccaggccca

SEQ ID NO: 61949 - RNA, 22 nt, Human
ugcagugagccaugaucauucc

SEQ ID NO: 61950 - RNA, 26 nt, Human
guggggaggggagugacagguccaca

SEQ ID NO: 61951 - RNA, 25 nt, Human
aacccauguuucucauuagugucuc

SEQ ID NO: 61952 - RNA, 28 nt, Human
cuagaggcuucugacuccugggacuuug

SEQ ID NO: 61953 - RNA, 21 nt, Human
ccuccucccgggucugugccg

SEQ ID NO: 61954 - RNA, 22 nt, Human
uguuagucauuguuauuuauac

SEQ ID NO: 61955 - RNA, 23 nt, Human
ggcugggaccaagcucugccuuc

SEQ ID NO: 61956 - RNA, 24 nt, Human
aagcagcauucuggaggggagagc

SEQ ID NO: 61957 - RNA, 22 nt, Human
acuaucacacacuuucucuuca

SEQ ID NO: 61958 - RNA, 27 nt, Human
gccacccaggacaggacgggggucagc

SEQ ID NO: 61959 - RNA, 25 nt, Human
aucaaauuaagaugacacuuaaaga

SEQ ID NO: 61960 - RNA, 21 nt, Human
auaauauauuauuauucuucc

SEQ ID NO: 61961 - RNA, 21 nt, Human
aaaagcucugugcauccugcc

SEQ ID NO: 61962 - RNA, 24 nt, Human
uaaggcuguuuugaugagugcguu

SEQ ID NO: 61963 - RNA, 22 nt, Human
cuucugagcccgagccccucau

SEQ ID NO: 61964 - RNA, 22 nt, Human
ugagcuccugggaacagguggu

SEQ ID NO: 61965 - RNA, 25 nt, Human
aaggcuacuauucauccucugugau

SEQ ID NO: 61966 - RNA, 22 nt, Human
aaacuauuuauuaacuaaugua

SEQ ID NO: 61967 - RNA, 21 nt, Human
gugacuucucuccacauaggg

SEQ ID NO: 61968 - RNA, 20 nt, Human
ugaacuccuguuuaaggaag

SEQ ID NO: 61969 - RNA, 24 nt, Human
ggagaguaggaagagcuguggagg

SEQ ID NO: 61970 - RNA, 27 nt, Human
gggagagaaguuugagccccaggcuua

SEQ ID NO: 61971 - RNA, 22 nt, Human
agccuucugaguucaagcaauc

SEQ ID NO: 61972 - RNA, 21 nt, Human
aggcccuuccuuaggccaggu

SEQ ID NO: 61973 - RNA, 22 nt, Human
cgccucucuggguguccgugcc

SEQ ID NO: 61974 - RNA, 20 nt, Human
aagcccagugcccuccugga

SEQ ID NO: 61975 - RNA, 27 nt, Human
cauugcacuccagccugggcaacgagu

SEQ ID NO: 61976 - RNA, 24 nt, Human
uuuauuacugcuugccuguuguua

SEQ ID NO: 61977 - RNA, 28 nt, Human
agauugcaccauugcacuccagccuggg

SEQ ID NO: 61978 - RNA, 21 nt, Human
guaaaggccauggccaugcag

SEQ ID NO: 61979 - RNA, 20 nt, Human
cgucagcugcuguguuaaca

SEQ ID NO: 61980 - RNA, 26 nt, Human
cuccaaggcuggagugcagugacgcg

SEQ ID NO: 61981 - RNA, 26 nt, Human
augcugaugucucuguucaucuauuu

SEQ ID NO: 61982 - RNA, 22 nt, Human
ucuccaggcugcugggcagcug

SEQ ID NO: 61983 - RNA, 23 nt, Human
gaggauuauucucccguucucaa

SEQ ID NO: 61984 - RNA, 25 nt, Human
uaacugcauugagaacugcauaugu

SEQ ID NO: 61985 - RNA, 27 nt, Human
uggcucacgccuguaauccaagcacuu

SEQ ID NO: 61986 - RNA, 20 nt, Human
gcaucuggggagacagcagg

SEQ ID NO: 61987 - RNA, 21 nt, Human
cuggaaagcuucauguugaaa

SEQ ID NO: 61988 - RNA, 21 nt, Human
cucaagaggaaaauccaaaag

SEQ ID NO: 61989 - RNA, 25 nt, Human
caaacucacaaggagacaucaaccu

SEQ ID NO: 61990 - RNA, 25 nt, Human
cgggaagugaguuucuuugcaguga

SEQ ID NO: 61991 - RNA, 26 nt, Human
ugagccccaagggcaagaacacuucu

SEQ ID NO: 61992 - RNA, 27 nt, Human
ccugugaggggugcagagagaucauca

SEQ ID NO: 61993 - RNA, 20 nt, Human
cucccuucucucuuuucuuc

SEQ ID NO: 61994 - RNA, 20 nt, Human
uuuaccuuccucucuccuca

SEQ ID NO: 61995 - RNA, 25 nt, Human
gaagcaagaagaaagccauuguguc

SEQ ID NO: 61996 - RNA, 23 nt, Human
gaaaucuuucucccucaacugaa

SEQ ID NO: 61997 - RNA, 26 nt, Human
uuuucuucuuuuucccccuguaggac

SEQ ID NO: 61998 - RNA, 23 nt, Human
ugaaauccaagacaucuuggccc

SEQ ID NO: 61999 - RNA, 21 nt, Human
uuugaacuucccuuccuuaaa

SEQ ID NO: 62000 - RNA, 19 nt, Human
gccccucacugcagcugcc

SEQ ID NO: 62001 - RNA, 19 nt, Human
gcugcuccuucccugccac

SEQ ID NO: 62002 - RNA, 21 nt, Human
uacuucccuuuuugaauacca

SEQ ID NO: 62003 - RNA, 27 nt, Human
cuucugcuucucagacucuauuccgac

SEQ ID NO: 62004 - RNA, 29 nt, Human
uuugugauaucacuuuaauuuuucuuggg

SEQ ID NO: 62005 - RNA, 24 nt, Human
ggagaggguggggaggggcccagc

SEQ ID NO: 62006 - RNA, 18 nt, Human
agccucucugauguuguc

SEQ ID NO: 62007 - RNA, 23 nt, Human
cuaguuccugugcuucuucccau

SEQ ID NO: 62008 - RNA, 26 nt, Human
caccucuuugcuguuuucuuccuccu

SEQ ID NO: 62009 - RNA, 27 nt, Human
gucaccuaguugggucagaagagucga

SEQ ID NO: 62010 - RNA, 29 nt, Human
ggugugugaauuccuaccccgaacuggaa

SEQ ID NO: 62011 - RNA, 22 nt, Human
agaaagaaucucauuugcaaaa

SEQ ID NO: 62012 - RNA, 21 nt, Human
gugacuuccaccugcucaacc

SEQ ID NO: 62013 - RNA, 16 nt, Human
ccaccaccaccaccac

SEQ ID NO: 62014 - RNA, 26 nt, Human
cgccacugcauuccagccugugcgac

SEQ ID NO: 62015 - RNA, 14 nt, Human
agagaauguggaaa

SEQ ID NO: 62016 - RNA, 26 nt, Human
gaagagaccaagcuuguuucccugcu

SEQ ID NO: 62017 - RNA, 22 nt, Human
cagagguuacagguuacaguga

SEQ ID NO: 62018 - RNA, 24 nt, Human
uccuaaaauucagcauuugcagca

SEQ ID NO: 62019 - RNA, 21 nt, Human
ggcaugguuugcggagguuag

SEQ ID NO: 62020 - RNA, 23 nt, Human
ugucaaaggcugaaaaugugcau

SEQ ID NO: 62021 - RNA, 24 nt, Human
ccucccgcgcccagccccugcugc

SEQ ID NO: 62022 - RNA, 28 nt, Human
ccuucagcuguauuuccacagauuucuc

SEQ ID NO: 62023 - RNA, 28 nt, Human
ggguauucugccuucaggacucugccuu

SEQ ID NO: 62024 - RNA, 27 nt, Human
ugagagaggaggcaggagccccagggc

SEQ ID NO: 62025 - RNA, 27 nt, Human
gggacugcuagggcugguggccaggga

SEQ ID NO: 62026 - RNA, 22 nt, Human
ggccucuggggcccacuggaaa

SEQ ID NO: 62027 - RNA, 18 nt, Human
uccuacccucucccugcc

SEQ ID NO: 62028 - RNA, 20 nt, Human
uuucuacugcuuuugaggcc

SEQ ID NO: 62029 - RNA, 27 nt, Human
cacagccccgucuuccaggagccacaa

SEQ ID NO: 62030 - RNA, 19 nt, Human
ucuccuccuccccuuccca

SEQ ID NO: 62031 - RNA, 26 nt, Human
gggaaaugccuuuguacuuuagggaa

SEQ ID NO: 62032 - RNA, 24 nt, Human
ggcauccacugcauuuccuuucau

SEQ ID NO: 62033 - RNA, 27 nt, Human
gcgaagcagagagguggagaacuggga

SEQ ID NO: 62034 - RNA, 22 nt, Human
ugcugcucucuccuucagaacc

SEQ ID NO: 62035 - RNA, 22 nt, Human
cccaggccacccuuccugggcu

SEQ ID NO: 62036 - RNA, 20 nt, Human
guggcuuucagcaaaccuca

SEQ ID NO: 62037 - RNA, 22 nt, Human
acugcaaccaccaucucccagg

SEQ ID NO: 62038 - RNA, 23 nt, Human
gcaguccccugaggagcggggcu

SEQ ID NO: 62039 - RNA, 19 nt, Human
cucuacccuguuccucagc

SEQ ID NO: 62040 - RNA, 20 nt, Human
cuucaaaaccucuuuuuucu

SEQ ID NO: 62041 - RNA, 22 nt, Human
caaguauuuuaacucucagucc

SEQ ID NO: 62042 - RNA, 18 nt, Human
cggccguggaaacccacc

SEQ ID NO: 62043 - RNA, 23 nt, Human
ccgcuccgcugcgcgcaggcugg

SEQ ID NO: 62044 - RNA, 27 nt, Human
ugcagcuccgcaccugcggccagugcc

SEQ ID NO: 62045 - RNA, 19 nt, Human
ucagccugugcuguggcau

SEQ ID NO: 62046 - RNA, 29 nt, Human
gugugcugaggacagccacaagcagccau

SEQ ID NO: 62047 - RNA, 21 nt, Human
cagaaggcagagguugcagug

SEQ ID NO: 62048 - RNA, 26 nt, Human
aagaggacugugugagaggggcgccu

SEQ ID NO: 62049 - RNA, 22 nt, Human
uugcaacaaugcaaaagccaag

SEQ ID NO: 62050 - RNA, 27 nt, Human
uaguaguuagcuuaaguaguuucucca

SEQ ID NO: 62051 - RNA, 19 nt, Human
gggaagggagaguucuuug

SEQ ID NO: 62052 - RNA, 20 nt, Human
cuguugcccuccuuuucccg

SEQ ID NO: 62053 - RNA, 20 nt, Human
uuuucuuuaguauagccaca

SEQ ID NO: 62054 - RNA, 21 nt, Human
ucuucagcccaggcuuuugcu

SEQ ID NO: 62055 - RNA, 26 nt, Human
cuucagccuugcguuuccacagccuu

SEQ ID NO: 62056 - RNA, 22 nt, Human
ccuguaaucccagcuacuuagg

SEQ ID NO: 62057 - RNA, 22 nt, Human
ccuguaauccuagcuacucagg

SEQ ID NO: 62058 - RNA, 24 nt, Human
cuuugcagauuuguccauugcucu

SEQ ID NO: 62059 - RNA, 30 nt, Human
gggccggggcgagcgagggagcacauuggc

SEQ ID NO: 62060 - RNA, 27 nt, Human
gguggugcuugcuauaugcuuaccuuu

SEQ ID NO: 62061 - RNA, 21 nt, Human
ucugccucugagacugcggua

SEQ ID NO: 62062 - RNA, 22 nt, Human
ugugccaaccccuccuuguugc

SEQ ID NO: 62063 - RNA, 20 nt, Human
gcccugugcaugucuggacu

SEQ ID NO: 62064 - RNA, 19 nt, Human
ggcuuccuugauccuugcc

SEQ ID NO: 62065 - RNA, 20 nt, Human
uccugcagggacuaggucuu

SEQ ID NO: 62066 - RNA, 24 nt, Human
aaccaucacgaugagauggaggug

SEQ ID NO: 62067 - RNA, 22 nt, Human
ggucaaggcugcagugagcugu

SEQ ID NO: 62068 - RNA, 23 nt, Human
uuuaguaaaugaaacuaaucacu

SEQ ID NO: 62069 - RNA, 22 nt, Human
ucugcccuggggaugggccggg

SEQ ID NO: 62070 - RNA, 22 nt, Human
cucuuguuuuucucacaguuuc

SEQ ID NO: 62071 - RNA, 20 nt, Human
cagggguaauuuucugcuca

SEQ ID NO: 62072 - RNA, 27 nt, Human
ggcucacaccuguaaucccagcgcuuu

SEQ ID NO: 62073 - RNA, 23 nt, Human
accauuuucaugguggaagaauu

SEQ ID NO: 62074 - RNA, 19 nt, Human
gcuggaauuccuggugcuc

SEQ ID NO: 62075 - RNA, 22 nt, Human
aaagucagaaguuuuacuccag

SEQ ID NO: 62076 - RNA, 24 nt, Human
ucccagacuccugggugcuguggg

SEQ ID NO: 62077 - RNA, 21 nt, Human
uaguuaguucugcagucuagu

SEQ ID NO: 62078 - RNA, 23 nt, Human
cuggagaacuagaaccuggaggg

SEQ ID NO: 62079 - RNA, 29 nt, Human
auguucucggucacccuccugguucugcc

SEQ ID NO: 62080 - RNA, 21 nt, Human
uugcugucuggcuuucccgaa

SEQ ID NO: 62081 - RNA, 22 nt, Human
ucaagagaucaagaccauagug

SEQ ID NO: 62082 - RNA, 24 nt, Human
gcugcccgucuucagccuagccga

SEQ ID NO: 62083 - RNA, 20 nt, Human
uucugugucaucuagucgug

SEQ ID NO: 62084 - RNA, 20 nt, Human
gcagggcagacacaggccag

SEQ ID NO: 62085 - RNA, 22 nt, Human
ccaggaggcagaggcuguggug

SEQ ID NO: 62086 - RNA, 25 nt, Human
gagcaucuccucuccacaccugccu

SEQ ID NO: 62087 - RNA, 22 nt, Human
agggaaagcagcgugcggggaa

SEQ ID NO: 62088 - RNA, 22 nt, Human
ucaccaucuggaagaagauggg

SEQ ID NO: 62089 - RNA, 27 nt, Human
cuccaucugucaacaggggcgugaggu

SEQ ID NO: 62090 - RNA, 23 nt, Human
auggcaccacaacagguagauaa

SEQ ID NO: 62091 - RNA, 18 nt, Human
caggcuggacugcaguga

SEQ ID NO: 62092 - RNA, 22 nt, Human
gucaucuagcccuacuccgcca

SEQ ID NO: 62093 - RNA, 26 nt, Human
aacacacacaucucacucauccuucu

SEQ ID NO: 62094 - RNA, 21 nt, Human
uaggugaguagggguggugca

SEQ ID NO: 62095 - RNA, 22 nt, Human
ccccaguagcugggaccacagg

SEQ ID NO: 62096 - RNA, 18 nt, Human
augaaugaucuuaaggua

SEQ ID NO: 62097 - RNA, 23 nt, Human
ugcccuauuuaguuuguggcuaa

SEQ ID NO: 62098 - RNA, 23 nt, Human
uuucuauaauaaaaagcacucuc

SEQ ID NO: 62099 - RNA, 27 nt, Human
cccgaguagcugggacucuacuaaaag

SEQ ID NO: 62100 - RNA, 21 nt, Human
ugagccaagaucgcaccauug

SEQ ID NO: 62101 - RNA, 20 nt, Human
ugggguggaaauaggguggg

SEQ ID NO: 62102 - RNA, 22 nt, Human
gaaagguugagcccagaguggc

SEQ ID NO: 62103 - RNA, 20 nt, Human
ccaggggucaggagagagau

SEQ ID NO: 62104 - RNA, 20 nt, Human
gccucuccaguuugcaccug

SEQ ID NO: 62105 - RNA, 23 nt, Human
uuccccugggucagugauggaaa

SEQ ID NO: 62106 - RNA, 22 nt, Human
caagaucaugugcauaucaucc

SEQ ID NO: 62107 - RNA, 18 nt, Human
agugcacccaggacgcag

SEQ ID NO: 62108 - RNA, 26 nt, Human
ucauuucucagagauuccuaggaaag

SEQ ID NO: 62109 - RNA, 21 nt, Human
ugugugcugggggaugucagg

SEQ ID NO: 62110 - RNA, 23 nt, Human
aacuacauuggaagccugagcag

SEQ ID NO: 62111 - RNA, 21 nt, Human
uauuuagcuugagaaugggua

SEQ ID NO: 62112 - RNA, 22 nt, Human
aucgacgacuucccggggcgac

SEQ ID NO: 62113 - RNA, 21 nt, Human
auggcagaggagacaucucug

SEQ ID NO: 62114 - RNA, 25 nt, Human
uucuuaaaaacuuaggcuuggccuc

SEQ ID NO: 62115 - RNA, 23 nt, Human
uucaucuuggucacauacaauua

SEQ ID NO: 62116 - RNA, 20 nt, Human
accagaacuuucuguccuaa

SEQ ID NO: 62117 - RNA, 23 nt, Human
uuuacacacuugcaugaauuacu

SEQ ID NO: 62118 - RNA, 22 nt, Human
acaacagcaaccaaagaaaaca

SEQ ID NO: 62119 - RNA, 20 nt, Human
cccaagccgccuccuccacc

SEQ ID NO: 62120 - RNA, 21 nt, Human
caggaggcagcuguugcagug

SEQ ID NO: 62121 - RNA, 21 nt, Human
ucuccugcccuucugcaagcu

SEQ ID NO: 62122 - RNA, 22 nt, Human
ugcuauauacuauaugauucca

SEQ ID NO: 62123 - RNA, 23 nt, Human
caggcuggaaggccuuccugguu

SEQ ID NO: 62124 - RNA, 22 nt, Human
agcagagggaggccucuugccu

SEQ ID NO: 62125 - RNA, 25 nt, Human
agggcgucacguggcagcguggggc

SEQ ID NO: 62126 - RNA, 27 nt, Human
aaaccuacagaauacuagccagagcuc

SEQ ID NO: 62127 - RNA, 24 nt, Human
cuguaaugaugugagcagggagcc

SEQ ID NO: 62128 - RNA, 27 nt, Human
cuguuagugugcauucuaaauaaauau

SEQ ID NO: 62129 - RNA, 19 nt, Human
cucccagguuauguuuuca

SEQ ID NO: 62130 - RNA, 20 nt, Human
agacucguaccugcgcuguu

SEQ ID NO: 62131 - RNA, 19 nt, Human
aaacccaguggacugggcu

SEQ ID NO: 62132 - RNA, 24 nt, Human
auccugcagacccuuaucuggagg

SEQ ID NO: 62133 - RNA, 24 nt, Human
aacacaaaguaggaucccagugca

SEQ ID NO: 62134 - RNA, 22 nt, Human
cucagcuucccaaguagcuggg

SEQ ID NO: 62135 - RNA, 26 nt, Human
uuaaaaaauauauuccuacagugaug

SEQ ID NO: 62136 - RNA, 21 nt, Human
uccaugaaugaauuuauggaa

SEQ ID NO: 62137 - RNA, 23 nt, Human
gggguaucaacaagccugccuuu

SEQ ID NO: 62138 - RNA, 23 nt, Human
uguaacuuaagacuuucauagaa

SEQ ID NO: 62139 - RNA, 23 nt, Human
cgucuucacucuuaggcacuuug

SEQ ID NO: 62140 - RNA, 31 nt, Human
ugacuaacaaacacagugaaaccccgucucu

SEQ ID NO: 62141 - RNA, 24 nt, Human
uccucaaaagagaauucagucuac

SEQ ID NO: 62142 - RNA, 25 nt, Human
ugcgagaaggagggggaaggacaga

SEQ ID NO: 62143 - RNA, 23 nt, Human
gucugcucucagccuccuccucc

SEQ ID NO: 62144 - RNA, 20 nt, Human
uccuuucggcauguggagga

SEQ ID NO: 62145 - RNA, 24 nt, Human
ugccuaggauugugccuguaugca

SEQ ID NO: 62146 - RNA, 26 nt, Human
ugagccaagaucaugcuacugcacuc

SEQ ID NO: 62147 - RNA, 24 nt, Human
agccccgcgccuccuuccuugcug

SEQ ID NO: 62148 - RNA, 24 nt, Human
cccugccgaacacagcgugaggag

SEQ ID NO: 62149 - RNA, 25 nt, Human
ucuucuugugccuucugcucucuca

SEQ ID NO: 62150 - RNA, 27 nt, Human
ugagccaagaucgcucccacugcacuc

SEQ ID NO: 62151 - RNA, 24 nt, Human
accacugaauucacuccagucaac

SEQ ID NO: 62152 - RNA, 23 nt, Human
cugccccagggcucccggcuaug

SEQ ID NO: 62153 - RNA, 21 nt, Human
ccaccacugcuccuugacucu

SEQ ID NO: 62154 - RNA, 24 nt, Human
cccaguccuuuccuacuccagaaa

SEQ ID NO: 62155 - RNA, 20 nt, Human
cugcaccuccaccugcccca

SEQ ID NO: 62156 - RNA, 26 nt, Human
gugacucuccacagggccucuaccau

SEQ ID NO: 62157 - RNA, 22 nt, Human
ccgcuagcucuuuccuaaugag

SEQ ID NO: 62158 - RNA, 20 nt, Human
aaguuaaccgguuuucuagc

SEQ ID NO: 62159 - RNA, 25 nt, Human
caacagcaaauaagcagacggacca

SEQ ID NO: 62160 - RNA, 20 nt, Human
cuuuagaaccugcuucucug

SEQ ID NO: 62161 - RNA, 21 nt, Human
uggucucaacuccugggcuca

SEQ ID NO: 62162 - RNA, 25 nt, Human
gcagccucuguccagccugcaggug

SEQ ID NO: 62163 - RNA, 21 nt, Human
uugcucccugcucuuucugcc

SEQ ID NO: 62164 - RNA, 25 nt, Human
acccccacgauucuucaccgcugcu

SEQ ID NO: 62165 - RNA, 26 nt, Human
gaaagucacggacaaguucacugaga

SEQ ID NO: 62166 - RNA, 25 nt, Human
gggauccagggcaaugugaauuuuc

SEQ ID NO: 62167 - RNA, 22 nt, Human
ucuccaacuccugacuucauga

SEQ ID NO: 62168 - RNA, 21 nt, Human
uuugagacuccucaguucuug

SEQ ID NO: 62169 - RNA, 28 nt, Human
gcuuuaucucccccagcaguggggacuc

SEQ ID NO: 62170 - RNA, 22 nt, Human
cacugccuguggggaccugccc

SEQ ID NO: 62171 - RNA, 22 nt, Human
gaauuagggccuuccuuuuugc

SEQ ID NO: 62172 - RNA, 22 nt, Human
guugccggccgugggugcucug

SEQ ID NO: 62173 - RNA, 21 nt, Human
cugacagggaaaagauuucug

SEQ ID NO: 62174 - RNA, 22 nt, Human
cuggagcaguugcuuuuugaaa

SEQ ID NO: 62175 - RNA, 22 nt, Human
uaacccucaguaucaagcacaa

SEQ ID NO: 62176 - RNA, 20 nt, Human
ggagggaaucuggagggggc

SEQ ID NO: 62177 - RNA, 26 nt, Human
gccuuucucuccugccuuccacagcc

SEQ ID NO: 62178 - RNA, 25 nt, Human
cucauuucauccucuggcuuccuca

SEQ ID NO: 62179 - RNA, 19 nt, Human
uagaucauuguucucucca

SEQ ID NO: 62180 - RNA, 27 nt, Human
cuguaccucugccuccuuuccccuccc

SEQ ID NO: 62181 - RNA, 21 nt, Human
gaagucucugggcuagcuacu

SEQ ID NO: 62182 - RNA, 22 nt, Human
guugcccaggcuggcgugcagu

SEQ ID NO: 62183 - RNA, 24 nt, Human
acccgcccucuccgcacguccgcc

SEQ ID NO: 62184 - RNA, 22 nt, Human
ugcaaccucuaccuccuggguu

SEQ ID NO: 62185 - RNA, 22 nt, Human
ugcaaccucugccuccugaguu

SEQ ID NO: 62186 - RNA, 26 nt, Human
auguagcagggaaaauauauaucuaa

SEQ ID NO: 62187 - RNA, 26 nt, Human
cagcaccagugugugaggggagcagg

SEQ ID NO: 62188 - RNA, 22 nt, Human
agauguuggaggcuagggaggc

SEQ ID NO: 62189 - RNA, 21 nt, Human
gccgcccaggcuggacugcag

SEQ ID NO: 62190 - RNA, 20 nt, Human
ggcaaaaccuggugcuugag

SEQ ID NO: 62191 - RNA, 21 nt, Human
auguacacugguuugagcuua

SEQ ID NO: 62192 - RNA, 23 nt, Human
ggucaucacuaugaccuaaauua

SEQ ID NO: 62193 - RNA, 18 nt, Human
ucaaggacuuccuuacaa

SEQ ID NO: 62194 - RNA, 26 nt, Human
gcucacugcccccacgccuccugcca

SEQ ID NO: 62195 - RNA, 23 nt, Human
accuccaaaagcacagggacaca

SEQ ID NO: 62196 - RNA, 21 nt, Human
agcaggaauccuuugugcauu

SEQ ID NO: 62197 - RNA, 23 nt, Human
cugcuccugcucucucuccucca

SEQ ID NO: 62198 - RNA, 22 nt, Human
gcucagcccagugcggccuggc

SEQ ID NO: 62199 - RNA, 30 nt, Human
ggcauugagcuuuuucuuucauuuuccuau

SEQ ID NO: 62200 - RNA, 20 nt, Human
ggaggcugccuagagggaca

SEQ ID NO: 62201 - RNA, 24 nt, Human
guacauguaaaugcccacagccca

SEQ ID NO: 62202 - RNA, 22 nt, Human
gcaauucugcugcaucagccuc

SEQ ID NO: 62203 - RNA, 26 nt, Human
ccgcccaccagggcucaggguccucc

SEQ ID NO: 62204 - RNA, 21 nt, Human
caccgagggugcccacugcca

SEQ ID NO: 62205 - RNA, 29 nt, Human
cugccccagaggaaggagcuguagugucc

SEQ ID NO: 62206 - RNA, 21 nt, Human
acuuguaacccagcacuuugg

SEQ ID NO: 62207 - RNA, 22 nt, Human
uuacaaguuucaguaauagcug

SEQ ID NO: 62208 - RNA, 22 nt, Human
acaggugugggcgccagugugg

SEQ ID NO: 62209 - RNA, 23 nt, Human
cuucagggcuccagccucuugau

SEQ ID NO: 62210 - RNA, 22 nt, Human
gggauuacagggaugagccacc

SEQ ID NO: 62211 - RNA, 16 nt, Human
cuucuacuccuagcca

SEQ ID NO: 62212 - RNA, 22 nt, Human
aucacuugaauucaggaggcgg

SEQ ID NO: 62213 - RNA, 19 nt, Human
gauuggucagugaggucaa

SEQ ID NO: 62214 - RNA, 22 nt, Human
cacccagggauggagagucaug

SEQ ID NO: 62215 - RNA, 22 nt, Human
aggcuggagugcaguggugcca

SEQ ID NO: 62216 - RNA, 24 nt, Human
ugucaguuucagauccugaucuua

SEQ ID NO: 62217 - RNA, 21 nt, Human
gcaguucagaaggaauaagca

SEQ ID NO: 62218 - RNA, 27 nt, Human
ccacugcacuccagucuggucggcaag

SEQ ID NO: 62219 - RNA, 28 nt, Human
cuccccucccucuccacucggcaccaug

SEQ ID NO: 62220 - RNA, 22 nt, Human
ugggacccuauacggacuccgc

SEQ ID NO: 62221 - RNA, 22 nt, Human
uucagcagggaugagucuguuu

SEQ ID NO: 62222 - RNA, 19 nt, Human
cacaggcaucucugcauga

SEQ ID NO: 62223 - RNA, 21 nt, Human
aggaaguggcaguugcaguga

SEQ ID NO: 62224 - RNA, 19 nt, Human
ucuucugcucuuguuugug

SEQ ID NO: 62225 - RNA, 22 nt, Human
gcccucgggcgagucacugccu

SEQ ID NO: 62226 - RNA, 24 nt, Human
ggaggaggaggaguuccucaggga

SEQ ID NO: 62227 - RNA, 22 nt, Human
acgccuguggucucagcacuuu

SEQ ID NO: 62228 - RNA, 27 nt, Human
cccaggcugcuggagugcaguggcaca

SEQ ID NO: 62229 - RNA, 21 nt, Human
ucuuuuucaauaaaaagcacu

SEQ ID NO: 62230 - RNA, 26 nt, Human
cuguggccaccaccuccugcuccuga

SEQ ID NO: 62231 - RNA, 22 nt, Human
ggccacgucccaccccaccucu

SEQ ID NO: 62232 - RNA, 26 nt, Human
ugucugaccacucugacaggucucca

SEQ ID NO: 62233 - RNA, 25 nt, Human
ggucggcagacccagagcacuugau

SEQ ID NO: 62234 - RNA, 27 nt, Human
cccaaagugcugggauuacaagcguga

SEQ ID NO: 62235 - RNA, 21 nt, Human
ccaaagcuccccaagcaucaa

SEQ ID NO: 62236 - RNA, 28 nt, Human
ccucgcuuuuaaugaccucagccccgcc

SEQ ID NO: 62237 - RNA, 21 nt, Human
ugacucaccugaagugcaaua

SEQ ID NO: 62238 - RNA, 23 nt, Human
gcuaagcuguaguugcagaguac

SEQ ID NO: 62239 - RNA, 23 nt, Human
gaacagcugucaccuagugcgga

SEQ ID NO: 62240 - RNA, 21 nt, Human
cuccagccugggcuucagagc

SEQ ID NO: 62241 - RNA, 21 nt, Human
ggaaccagaggcacagagaca

SEQ ID NO: 62242 - RNA, 26 nt, Human
cgcagccgccuccgccgcgcgccucc

SEQ ID NO: 62243 - RNA, 26 nt, Human
uauuauauacacaauuuauuagcuuc

SEQ ID NO: 62244 - RNA, 19 nt, Human
ggguaggagggugggaagg

SEQ ID NO: 62245 - RNA, 27 nt, Human
guaaauccccggcaaaaaccagcagcg

SEQ ID NO: 62246 - RNA, 24 nt, Human
ucaggaaagagcaaguauuuuucc

SEQ ID NO: 62247 - RNA, 20 nt, Human
ugugcuguuaacacugcaaa

SEQ ID NO: 62248 - RNA, 26 nt, Human
gcuggcagaaggguuaggagguugaa

SEQ ID NO: 62249 - RNA, 22 nt, Human
ucuggcccaggcuagagugcag

SEQ ID NO: 62250 - RNA, 19 nt, Human
uuuggaguuuuggugacuu

SEQ ID NO: 62251 - RNA, 21 nt, Human
aaguguuuuuacaucaucuca

SEQ ID NO: 62252 - RNA, 21 nt, Human
aggaaguggagacugcaguga

SEQ ID NO: 62253 - RNA, 21 nt, Human
gauuauuauacugcuauuuuu

SEQ ID NO: 62254 - RNA, 27 nt, Human
uuacaaaccacagcaugcccggcuccu

SEQ ID NO: 62255 - RNA, 22 nt, Human
gcagggcugggggguggucugu

SEQ ID NO: 62256 - RNA, 23 nt, Human
uccagacuuuuaaaggggacaau

SEQ ID NO: 62257 - RNA, 26 nt, Human
ucugggacuagaggccaggaugaagu

SEQ ID NO: 62258 - RNA, 22 nt, Human
acccaaagugagcaucugggca

SEQ ID NO: 62259 - RNA, 22 nt, Human
aucacuacucacaguaaccuca

SEQ ID NO: 62260 - RNA, 21 nt, Human
ugagcugccccuugcccacac

SEQ ID NO: 62261 - RNA, 23 nt, Human
ccuggccucucucugccaaaaag

SEQ ID NO: 62262 - RNA, 22 nt, Human
cucucuugccagcauuuucaca

SEQ ID NO: 62263 - RNA, 22 nt, Human
gcucacugcaaccuccgacucc

SEQ ID NO: 62264 - RNA, 21 nt, Human
cugcuggacccucuuccacca

SEQ ID NO: 62265 - RNA, 22 nt, Human
cugucuacccuccuucggaccc

SEQ ID NO: 62266 - RNA, 22 nt, Human
agaagagagagguucacuguag

SEQ ID NO: 62267 - RNA, 27 nt, Human
cccaaguagcugggauuacuggugcac

SEQ ID NO: 62268 - RNA, 20 nt, Human
gguuuuguuggcuuuuugaa

SEQ ID NO: 62269 - RNA, 27 nt, Human
ugccaggagggaauguucuuucuugaa

SEQ ID NO: 62270 - RNA, 25 nt, Human
cagcuagucucuucucuucugugau

SEQ ID NO: 62271 - RNA, 22 nt, Human
cucuaguauuugacuguuacug

SEQ ID NO: 62272 - RNA, 27 nt, Human
ggucucgaacuccuggccucaagugau

SEQ ID NO: 62273 - RNA, 24 nt, Human
ucguaccaaacuuuuccgcccugg

SEQ ID NO: 62274 - RNA, 21 nt, Human
cugcucacauucccucugcug

SEQ ID NO: 62275 - RNA, 21 nt, Human
cccagcugugugucaccagaa

SEQ ID NO: 62276 - RNA, 18 nt, Human
cggccaggcugggcucug

SEQ ID NO: 62277 - RNA, 22 nt, Human
cauggcagggcaaggauggcag

SEQ ID NO: 62278 - RNA, 21 nt, Human
gcuccucccggccgcugcaca

SEQ ID NO: 62279 - RNA, 26 nt, Human
uuccccucagccucugagcugaggcc

SEQ ID NO: 62280 - RNA, 25 nt, Human
caggauucucaccagcuguguccgg

SEQ ID NO: 62281 - RNA, 22 nt, Human
ggcagggggcgaagugcagugg

SEQ ID NO: 62282 - RNA, 22 nt, Human
caccagguacaucucaccugac

SEQ ID NO: 62283 - RNA, 23 nt, Human
ugagacuccagaccugaggcgag

SEQ ID NO: 62284 - RNA, 21 nt, Human
aaggucagauuuucuugucag

SEQ ID NO: 62285 - RNA, 22 nt, Human
ccugguguguaacgacacaauc

SEQ ID NO: 62286 - RNA, 24 nt, Human
uuucagugguuccuucuguuuugu

SEQ ID NO: 62287 - RNA, 18 nt, Human
aguuucaggaugcagggu

SEQ ID NO: 62288 - RNA, 24 nt, Human
ugcggguggggcuuggggcucaca

SEQ ID NO: 62289 - RNA, 21 nt, Human
gcgcccagcuccagucucccc

SEQ ID NO: 62290 - RNA, 22 nt, Human
uggacaccuguucugcuguugu

SEQ ID NO: 62291 - RNA, 21 nt, Human
gcccccgcccgcacagcuccc

SEQ ID NO: 62292 - RNA, 25 nt, Human
ugccuauuuguugcuugugcuuuau

SEQ ID NO: 62293 - RNA, 30 nt, Human
aagauucaaaaccuacaaaagccugccgca

SEQ ID NO: 62294 - RNA, 24 nt, Human
ccuccucugauuugcaucauuucc

SEQ ID NO: 62295 - RNA, 26 nt, Human
ccagauuuucguguacccacucuguu

SEQ ID NO: 62296 - RNA, 21 nt, Human
gccuucucuguucauuuccuc

SEQ ID NO: 62297 - RNA, 27 nt, Human
caaaaagucugagcgaggagugacugc

SEQ ID NO: 62298 - RNA, 21 nt, Human
ggagcaggcccugcccuccac

SEQ ID NO: 62299 - RNA, 26 nt, Human
cuggacugaagagcuucccucuuccu

SEQ ID NO: 62300 - RNA, 22 nt, Human
ggaaaguuuugauccgagugcu

SEQ ID NO: 62301 - RNA, 20 nt, Human
cuaugaaaagacaaggccau

SEQ ID NO: 62302 - RNA, 26 nt, Human
ggggccagacccugcccacaaguccc

SEQ ID NO: 62303 - RNA, 22 nt, Human
agcuccaccuccacuaccacuc

SEQ ID NO: 62304 - RNA, 23 nt, Human
ccauuauucuucucaacccaaga

SEQ ID NO: 62305 - RNA, 24 nt, Human
uuuaucagacaauugaauguagua

SEQ ID NO: 62306 - RNA, 24 nt, Human
ccaaagcuuccagaagccaaaaag

SEQ ID NO: 62307 - RNA, 21 nt, Human
accuuugacaagggcaggccu

SEQ ID NO: 62308 - RNA, 25 nt, Human
caggcaccucuucugccuuuacuug

SEQ ID NO: 62309 - RNA, 25 nt, Human
ucagggaacagcagagagcaguugg

SEQ ID NO: 62310 - RNA, 22 nt, Human
ggaguuggaagguugcauaggg

SEQ ID NO: 62311 - RNA, 24 nt, Human
cucccacucugggcucaggcuguc

SEQ ID NO: 62312 - RNA, 23 nt, Human
cacuaacuggguuccaugugauu

SEQ ID NO: 62313 - RNA, 27 nt, Human
cuccugaccucaugauccucccgccuc

SEQ ID NO: 62314 - RNA, 19 nt, Human
ugaacaaacuaaaggugca

SEQ ID NO: 62315 - RNA, 20 nt, Human
cauggggcagcuacaagcau

SEQ ID NO: 62316 - RNA, 21 nt, Human
cagauagcaaaagaaaaggga

SEQ ID NO: 62317 - RNA, 27 nt, Human
gcacagccaagggaaaaacaaaaaccc

SEQ ID NO: 62318 - RNA, 24 nt, Human
auguaaacugcucuuuuguuucca

SEQ ID NO: 62319 - RNA, 31 nt, Human
ucacaucaccagcucaccucugguagccaua

SEQ ID NO: 62320 - RNA, 26 nt, Human
ugcuaucugcucuguuucuaguuaaa

SEQ ID NO: 62321 - RNA, 20 nt, Human
gugcagugcuaagugucaca

SEQ ID NO: 62322 - RNA, 25 nt, Human
uguaaagcauccucuaccucucagc

SEQ ID NO: 62323 - RNA, 25 nt, Human
ggacagucuccagggucagucccug

SEQ ID NO: 62324 - RNA, 22 nt, Human
gguuuucaggcccucugcucca

SEQ ID NO: 62325 - RNA, 30 nt, Human
cacgcccucgcugcggggccuguggagagu

SEQ ID NO: 62326 - RNA, 20 nt, Human
cugcuagcccgaggucucca

SEQ ID NO: 62327 - RNA, 28 nt, Human
ucccccuccugcugugcuggaauuccac

SEQ ID NO: 62328 - RNA, 25 nt, Human
ggccagagcggcgcuggcagaggag

SEQ ID NO: 62329 - RNA, 24 nt, Human
cgggguggggaggaggcaggaggc

SEQ ID NO: 62330 - RNA, 22 nt, Human
cugcuaacugagccuccagaug

SEQ ID NO: 62331 - RNA, 21 nt, Human
ccuugaauugggagcagcagc

SEQ ID NO: 62332 - RNA, 15 nt, Human
gcaaucagacacccu

SEQ ID NO: 62333 - RNA, 23 nt, Human
aggcuggagugcagugucgugau

SEQ ID NO: 62334 - RNA, 26 nt, Human
ucuauguauggaaagcacacaugauu

SEQ ID NO: 62335 - RNA, 22 nt, Human
ucuuugguaguuuuuugcacua

SEQ ID NO: 62336 - RNA, 20 nt, Human
aauuacauagcaaugcugaa

SEQ ID NO: 62337 - RNA, 21 nt, Human
ccuuuuccucuuggagguugg

SEQ ID NO: 62338 - RNA, 27 nt, Human
uggaaacauucccacaugccgugacuc

SEQ ID NO: 62339 - RNA, 23 nt, Human
agccccauuucccaagcucuguu

SEQ ID NO: 62340 - RNA, 28 nt, Human
uggaaccuagagcuggagugaggaguag

SEQ ID NO: 62341 - RNA, 23 nt, Human
uggcucccaggggcucccuccgc

SEQ ID NO: 62342 - RNA, 22 nt, Human
ugcaaccuccgccucccggguu

SEQ ID NO: 62343 - RNA, 23 nt, Human
ugcccggccuaaacuuuguuuuu

SEQ ID NO: 62344 - RNA, 22 nt, Human
ccccuguauucucagcacuuug

SEQ ID NO: 62345 - RNA, 21 nt, Human
agauguuaagaucuuauggca

SEQ ID NO: 62346 - RNA, 23 nt, Human
auagaugggggaaagcaaagcac

SEQ ID NO: 62347 - RNA, 27 nt, Human
cccaggcaucugcuuuacucuggacca

SEQ ID NO: 62348 - RNA, 22 nt, Human
cuacagacagacauacauagac

SEQ ID NO: 62349 - RNA, 19 nt, Human
aggauuacaagcaugcgcc

SEQ ID NO: 62350 - RNA, 27 nt, Human
agcauagugccugcaugcuucaugauc

SEQ ID NO: 62351 - RNA, 26 nt, Human
guuuuuaaaagcuucagcuucuccag

SEQ ID NO: 62352 - RNA, 20 nt, Human
ccuagagaccgccacuguga

SEQ ID NO: 62353 - RNA, 23 nt, Human
gagggagggggugcagguucagu

SEQ ID NO: 62354 - RNA, 25 nt, Human
gcccaggcuggagggcaguggcacg

SEQ ID NO: 62355 - RNA, 22 nt, Human
uuucucauuuucaaugcacauu

SEQ ID NO: 62356 - RNA, 23 nt, Human
gggcuuucucuuuucucuuuuua

SEQ ID NO: 62357 - RNA, 18 nt, Human
cuugcccuuaccuuuucu

SEQ ID NO: 62358 - RNA, 25 nt, Human
guaguggcaagguggccagagcaau

SEQ ID NO: 62359 - RNA, 21 nt, Human
cgaggugggaggaucgcuuga

SEQ ID NO: 62360 - RNA, 21 nt, Human
uucauucauuuaguugucaua

SEQ ID NO: 62361 - RNA, 26 nt, Human
cccaacaacaggaucacaagcuggag

SEQ ID NO: 62362 - RNA, 21 nt, Human
gcccagcacccccuccccgcc

SEQ ID NO: 62363 - RNA, 27 nt, Human
gaacaucccccaaucucuuacagcucc

SEQ ID NO: 62364 - RNA, 29 nt, Human
gcuguccucuccccucgcgcacagggcuc

SEQ ID NO: 62365 - RNA, 27 nt, Human
ugucuucauguacauuuggaacuaaca

SEQ ID NO: 62366 - RNA, 22 nt, Human
cuggcccaugugcccacugucu

SEQ ID NO: 62367 - RNA, 27 nt, Human
gaucauuaaaaugaaaguaauuuaugg

SEQ ID NO: 62368 - RNA, 24 nt, Human
agacaucuucucccucccuugccu

SEQ ID NO: 62369 - RNA, 20 nt, Human
gccaacccugugacugacau

SEQ ID NO: 62370 - RNA, 25 nt, Human
gaagaaagcaacaaagauugagaag

SEQ ID NO: 62371 - RNA, 23 nt, Human
gccugggaaaggagauagccuug

SEQ ID NO: 62372 - RNA, 22 nt, Human
ucugucuggccucgcuuuccuu

SEQ ID NO: 62373 - RNA, 21 nt, Human
gccaaauaauuggcaugugaa

SEQ ID NO: 62374 - RNA, 21 nt, Human
acauagccuuacacuucucuc

SEQ ID NO: 62375 - RNA, 18 nt, Human
gcucaauuggccgggaaa

SEQ ID NO: 62376 - RNA, 22 nt, Human
aaagugcugggauuacagggau

SEQ ID NO: 62377 - RNA, 22 nt, Human
caucucccggguucaagcgauu

SEQ ID NO: 62378 - RNA, 22 nt, Human
ggucuugaccuccugaccuagg

SEQ ID NO: 62379 - RNA, 21 nt, Human
ggauggagggaggcaggcugg

SEQ ID NO: 62380 - RNA, 23 nt, Human
uugcaaccuccuccugagccggg

SEQ ID NO: 62381 - RNA, 22 nt, Human
cagauguuuugauguuaucgcu

SEQ ID NO: 62382 - RNA, 25 nt, Human
gcccagcaaauagugauaacaaaua

SEQ ID NO: 62383 - RNA, 22 nt, Human
ucacccaggcacugggcaagug

SEQ ID NO: 62384 - RNA, 22 nt, Human
uagagaccucagaaaucugcag

SEQ ID NO: 62385 - RNA, 21 nt, Human
agccccacucugccuccugcu

SEQ ID NO: 62386 - RNA, 20 nt, Human
acagguuuuuauuuuuccua

SEQ ID NO: 62387 - RNA, 26 nt, Human
uguauugcuagagccaggagugccuu

SEQ ID NO: 62388 - RNA, 19 nt, Human
ggagguuuuaccagggguu

SEQ ID NO: 62389 - RNA, 26 nt, Human
gcgggcuaggcagccaggagcucugu

SEQ ID NO: 62390 - RNA, 26 nt, Human
cugagcucacgcuggcucacacagcu

SEQ ID NO: 62391 - RNA, 21 nt, Human
ggguaugcccuuccugaucua

SEQ ID NO: 62392 - RNA, 25 nt, Human
gaauguucaguucucaaugugcugc

SEQ ID NO: 62393 - RNA, 24 nt, Human
gauuuugaaaaccaauuguauuua

SEQ ID NO: 62394 - RNA, 22 nt, Human
ccuaaguagcugggacuacagg

SEQ ID NO: 62395 - RNA, 22 nt, Human
ccaacauagugaaaccccgucu

SEQ ID NO: 62396 - RNA, 22 nt, Human
cuaacauagugaaacccugucu

SEQ ID NO: 62397 - RNA, 22 nt, Human
uguagugagcuacgaucaugcc

SEQ ID NO: 62398 - RNA, 21 nt, Human
aaugagccaccgugccuggcc

SEQ ID NO: 62399 - RNA, 22 nt, Human
agacccaugcagugugcugcca

SEQ ID NO: 62400 - RNA, 21 nt, Human
cuaagacuggcaggguauuaa

SEQ ID NO: 62401 - RNA, 24 nt, Human
ggcuggugguuggugaaagccauu

SEQ ID NO: 62402 - RNA, 26 nt, Human
auggcuggcagagguuucuagggugg

SEQ ID NO: 62403 - RNA, 23 nt, Human
gugguuuggcagaacaacugcau

SEQ ID NO: 62404 - RNA, 27 nt, Human
gguucagaguuauacaacuaaucccag

SEQ ID NO: 62405 - RNA, 22 nt, Human
ggugcugugcuggccauuggug

SEQ ID NO: 62406 - RNA, 19 nt, Human
ccugccuccucuucggcca

SEQ ID NO: 62407 - RNA, 18 nt, Human
agacagaggcagcaguga

SEQ ID NO: 62408 - RNA, 22 nt, Human
gccuccugaguagcugagacua

SEQ ID NO: 62409 - RNA, 21 nt, Human
ucuccccggcuggagugcagu

SEQ ID NO: 62410 - RNA, 26 nt, Human
cugaaucugaccacagacacuccugg

SEQ ID NO: 62411 - RNA, 24 nt, Human
acuaaaagaucgcaguuugccugg

SEQ ID NO: 62412 - RNA, 22 nt, Human
ugcuagcgagauagggggaaga

SEQ ID NO: 62413 - RNA, 23 nt, Human
ggaacacuuuauauaaaugagug

SEQ ID NO: 62414 - RNA, 27 nt, Human
ugucuaaaccuccuacuccucaacuca

SEQ ID NO: 62415 - RNA, 23 nt, Human
cgggcagggacagggcagaggac

SEQ ID NO: 62416 - RNA, 22 nt, Human
agggcaccucccugccccuagc

SEQ ID NO: 62417 - RNA, 22 nt, Human
aucccagggugagaguaacagg

SEQ ID NO: 62418 - RNA, 19 nt, Human
agcaagaaagauugugaug

SEQ ID NO: 62419 - RNA, 23 nt, Human
uuccaggcugggcagcacaaggc

SEQ ID NO: 62420 - RNA, 21 nt, Human
gucagggaggaaaggcagaag

SEQ ID NO: 62421 - RNA, 22 nt, Human
agagacgagguuucacuguguu

SEQ ID NO: 62422 - RNA, 22 nt, Human
cuauuucucagguuuucucagu

SEQ ID NO: 62423 - RNA, 22 nt, Human
aagcugcugggcucaagcaauc

SEQ ID NO: 62424 - RNA, 26 nt, Human
gccaugacuagcagaagcacagcuag

SEQ ID NO: 62425 - RNA, 25 nt, Human
uuucaguuuugacugagugauguga

SEQ ID NO: 62426 - RNA, 17 nt, Human
uccauucaaauuuuaca

SEQ ID NO: 62427 - RNA, 19 nt, Human
cucuaugcugacccuuguc

SEQ ID NO: 62428 - RNA, 20 nt, Human
uugugcccaggcuggagugc

SEQ ID NO: 62429 - RNA, 22 nt, Human
agacccaaccccagcagaaaga

SEQ ID NO: 62430 - RNA, 22 nt, Human
caugcucaggagccaccagcaa

SEQ ID NO: 62431 - RNA, 19 nt, Human
ccacuaauggacagcagau

SEQ ID NO: 62432 - RNA, 28 nt, Human
ugcaggaagucccugagcugagacgcaa

SEQ ID NO: 62433 - RNA, 27 nt, Human
uuacaucacgacuuucucuuaacagcu

SEQ ID NO: 62434 - RNA, 23 nt, Human
agaagcucugugccuggucugua

SEQ ID NO: 62435 - RNA, 21 nt, Human
cagguguaaacaaaaagcuga

SEQ ID NO: 62436 - RNA, 21 nt, Human
aucugaaaaccuuccccacaa

SEQ ID NO: 62437 - RNA, 21 nt, Human
aacuucuguuuuaccagcaua

SEQ ID NO: 62438 - RNA, 23 nt, Human
gacgggguuucaucauguuggcc

SEQ ID NO: 62439 - RNA, 22 nt, Human
cuccaugauggacgaucuugcu

SEQ ID NO: 62440 - RNA, 21 nt, Human
cauacuccugggcucaagcaa

SEQ ID NO: 62441 - RNA, 23 nt, Human
ucauaugcuucccagagaagcuc

SEQ ID NO: 62442 - RNA, 23 nt, Human
cuguaggagauuagugaggcaag

SEQ ID NO: 62443 - RNA, 22 nt, Human
cugccacccucuucuuucuccc

SEQ ID NO: 62444 - RNA, 23 nt, Human
gucacccaggcuggagugcaaug

SEQ ID NO: 62445 - RNA, 23 nt, Human
gucacccaggcuagagugcagug

SEQ ID NO: 62446 - RNA, 24 nt, Human
ucugcccacuuuuuauaaaaacuu

SEQ ID NO: 62447 - RNA, 23 nt, Human
ggguauagacaauaaagaacuga

SEQ ID NO: 62448 - RNA, 19 nt, Human
uggaacgacuucaaagaga

SEQ ID NO: 62449 - RNA, 31 nt, Human
agaagccaucagcagcaaggacaccaugcgg

SEQ ID NO: 62450 - RNA, 25 nt, Human
ugggaagggaagggcuacugcagcu

SEQ ID NO: 62451 - RNA, 20 nt, Human
agaaagaugaagaggaggag

SEQ ID NO: 62452 - RNA, 22 nt, Human
uacaugggucuuagaaaccacu

SEQ ID NO: 62453 - RNA, 26 nt, Human
ggcccagccaccuauuuuaacaagcc

SEQ ID NO: 62454 - RNA, 21 nt, Human
ccagcucagaccauguggacc

SEQ ID NO: 62455 - RNA, 24 nt, Human
uucuccacugucucuucuggacca

SEQ ID NO: 62456 - RNA, 27 nt, Human
uucauucuguuucuacuaaccuauacc

SEQ ID NO: 62457 - RNA, 23 nt, Human
ugccuccagguuuaucuuugucu

SEQ ID NO: 62458 - RNA, 29 nt, Human
ugagucucagagcaggggaguggcuuccc

SEQ ID NO: 62459 - RNA, 20 nt, Human
ggcuugucauacugucuaga

SEQ ID NO: 62460 - RNA, 21 nt, Human
ugagccaagaucacgccacug

SEQ ID NO: 62461 - RNA, 21 nt, Human
ugagccgagaucacaccacug

SEQ ID NO: 62462 - RNA, 23 nt, Human
gggcugcucuuccccaucuggaa

SEQ ID NO: 62463 - RNA, 25 nt, Human
gaacccagggcuguuagagggguga

SEQ ID NO: 62464 - RNA, 24 nt, Human
cagagcagcaccuacccccuccuc

SEQ ID NO: 62465 - RNA, 22 nt, Human
gccccuggguaauggggcagag

SEQ ID NO: 62466 - RNA, 21 nt, Human
cucagucucacauuucucaac

SEQ ID NO: 62467 - RNA, 20 nt, Human
cugugggaaaauaucccucc

SEQ ID NO: 62468 - RNA, 20 nt, Human
gaguguuauuugcacacugc

SEQ ID NO: 62469 - RNA, 22 nt, Human
uacuuuuuuccccuccugggag

SEQ ID NO: 62470 - RNA, 22 nt, Human
gugucucagcaccgcuaucuca

SEQ ID NO: 62471 - RNA, 23 nt, Human
agacggguuucaccauguugguc

SEQ ID NO: 62472 - RNA, 27 nt, Human
ggucuugaacuccugaccucgugaucu

SEQ ID NO: 62473 - RNA, 22 nt, Human
gcacagccccaggcacaguggc

SEQ ID NO: 62474 - RNA, 21 nt, Human
ggcagcgccucucuagcuacu

SEQ ID NO: 62475 - RNA, 20 nt, Human
ugcuacucuuaauuuucaug

SEQ ID NO: 62476 - RNA, 21 nt, Human
ccuugucccuuccuccuccca

SEQ ID NO: 62477 - RNA, 19 nt, Human
cacuguuacaccuugggga

SEQ ID NO: 62478 - RNA, 22 nt, Human
uucauucuguuacuuacuugcc

SEQ ID NO: 62479 - RNA, 22 nt, Human
aaaagagaaggcucucuuuucu

SEQ ID NO: 62480 - RNA, 24 nt, Human
uagugauucugugagucacugugu

SEQ ID NO: 62481 - RNA, 27 nt, Human
acucauuuauuuauauauuguccauau

SEQ ID NO: 62482 - RNA, 23 nt, Human
guguuacuuggucaggacagaga

SEQ ID NO: 62483 - RNA, 27 nt, Human
aacuccagguccuuuauuacugccuuc

SEQ ID NO: 62484 - RNA, 19 nt, Human
auccccucagucuguagcc

SEQ ID NO: 62485 - RNA, 23 nt, Human
gcacagccccaggcuuggugagg

SEQ ID NO: 62486 - RNA, 23 nt, Human
uucuaacauggaaaaagauucuc

SEQ ID NO: 62487 - RNA, 22 nt, Human
ccugucaccgcaguccugggcu

SEQ ID NO: 62488 - RNA, 22 nt, Human
ccaacuccugaccucagguaau

SEQ ID NO: 62489 - RNA, 22 nt, Human
ucacccaggcuggagugcuaug

SEQ ID NO: 62490 - RNA, 22 nt, Human
ucucccaggcuggagugcaaug

SEQ ID NO: 62491 - RNA, 27 nt, Human
cagacuggagugcagugccacaaucau

SEQ ID NO: 62492 - RNA, 21 nt, Human
gaaauaaugcauauauuugua

SEQ ID NO: 62493 - RNA, 20 nt, Human
cgccuaggcuggagugcagu

SEQ ID NO: 62494 - RNA, 27 nt, Human
gccuauaauccuagcacuuugagaggc

SEQ ID NO: 62495 - RNA, 23 nt, Human
agggccacuggaugucugccuuc

SEQ ID NO: 62496 - RNA, 22 nt, Human
agggcagagucacacgggggca

SEQ ID NO: 62497 - RNA, 22 nt, Human
ucuuuaaaaaagcagaugacuc

SEQ ID NO: 62498 - RNA, 21 nt, Human
acaguauuuuucagauauaaa

SEQ ID NO: 62499 - RNA, 20 nt, Human
cagacagacacagccagcca

SEQ ID NO: 62500 - RNA, 25 nt, Human
acugugcccucugugucagugugug

SEQ ID NO: 62501 - RNA, 23 nt, Human
ggaccuggcacugggaggcaggg

SEQ ID NO: 62502 - RNA, 25 nt, Human
cgaaagggagagcagagauggcagc

SEQ ID NO: 62503 - RNA, 22 nt, Human
ugucugagagaggaggcaggag

SEQ ID NO: 62504 - RNA, 18 nt, Human
uuugcagcagauguguga

SEQ ID NO: 62505 - RNA, 26 nt, Human
cugccuggucuuccucccggacgcua

SEQ ID NO: 62506 - RNA, 25 nt, Human
cucuucaguccuucuacuguccugg

SEQ ID NO: 62507 - RNA, 24 nt, Human
ggccccaucaucuuggaugcugcc

SEQ ID NO: 62508 - RNA, 22 nt, Human
guuccaagcccuuguguuuucc

SEQ ID NO: 62509 - RNA, 22 nt, Human
caaacuccugggcucagucagu

SEQ ID NO: 62510 - RNA, 17 nt, Human
cgcacugggcuugggga

SEQ ID NO: 62511 - RNA, 26 nt, Human
ggucucaagcccaccuucgcuguacc

SEQ ID NO: 62512 - RNA, 31 nt, Human
agaagucagcagcagaaacgacaaggcacuu

SEQ ID NO: 62513 - RNA, 25 nt, Human
uacuucuucagccuaggucuuuccc

SEQ ID NO: 62514 - RNA, 25 nt, Human
ggaggugaaggcagagaggagccag

SEQ ID NO: 62515 - RNA, 22 nt, Human
ucaaaaggaaggaaaugacaga

SEQ ID NO: 62516 - RNA, 22 nt, Human
gcuccuccagaccuccuaggcc

SEQ ID NO: 62517 - RNA, 23 nt, Human
ggugugaauuccuggguaacauu

SEQ ID NO: 62518 - RNA, 19 nt, Human
aaggcugaauucuguaaua

SEQ ID NO: 62519 - RNA, 27 nt, Human
caggguggagugcaguggcaugaucuu

SEQ ID NO: 62520 - RNA, 23 nt, Human
uaagggggaagaggagaggguau

SEQ ID NO: 62521 - RNA, 32 nt, Human
gccacuggcucuggucuaaagugccugggcuu

SEQ ID NO: 62522 - RNA, 20 nt, Human
agggugaagggggucccuug

SEQ ID NO: 62523 - RNA, 23 nt, Human
gucucccagggauuagagaaaag

SEQ ID NO: 62524 - RNA, 20 nt, Human
ccccagcauggucauguucg

SEQ ID NO: 62525 - RNA, 22 nt, Human
agcaaauuugcagcuguugugu

SEQ ID NO: 62526 - RNA, 26 nt, Human
uggaagaccucuuauuuguauuacau

SEQ ID NO: 62527 - RNA, 26 nt, Human
ugaaacugagucuguggacacugugg

SEQ ID NO: 62528 - RNA, 22 nt, Human
aagggaggaggagcuucugggg

SEQ ID NO: 62529 - RNA, 25 nt, Human
gggauuacaggugugcgccgccaca

SEQ ID NO: 62530 - RNA, 19 nt, Human
gcccccagccccggcacuc

SEQ ID NO: 62531 - RNA, 22 nt, Human
aaaaugcugggauuacaggccu

SEQ ID NO: 62532 - RNA, 26 nt, Human
uuccccagccucucuuccuaucccau

SEQ ID NO: 62533 - RNA, 19 nt, Human
augggaaaacauuccaccc

SEQ ID NO: 62534 - RNA, 23 nt, Human
ccccgcucagucacccgcagcag

SEQ ID NO: 62535 - RNA, 27 nt, Human
ucuccacccuccagccauggaagaccu

SEQ ID NO: 62536 - RNA, 23 nt, Human
gcucaucaucaagaucgugcugg

SEQ ID NO: 62537 - RNA, 22 nt, Human
uuucugauacguccauucucaa

SEQ ID NO: 62538 - RNA, 20 nt, Human
ggcgagaauagacugagaag

SEQ ID NO: 62539 - RNA, 21 nt, Human
gucugagcuucuuuagcuagg

SEQ ID NO: 62540 - RNA, 19 nt, Human
cugugucugaucugucuca

SEQ ID NO: 62541 - RNA, 21 nt, Human
ucacagaaaugcauaccacug

SEQ ID NO: 62542 - RNA, 26 nt, Human
agcccaggcugcugggcuguagccaa

SEQ ID NO: 62543 - RNA, 20 nt, Human
ucagcacuaaguccugcauu

SEQ ID NO: 62544 - RNA, 21 nt, Human
guccucuggcugaguggccac

SEQ ID NO: 62545 - RNA, 21 nt, Human
ggucacccaggaggauggcaa

SEQ ID NO: 62546 - RNA, 28 nt, Human
gcccggaccugaugugaaaggaccacgg

SEQ ID NO: 62547 - RNA, 31 nt, Human
agccggggugacagaagagaccuugucucga

SEQ ID NO: 62548 - RNA, 23 nt, Human
aaaucacuguuaaaaucuuacua

SEQ ID NO: 62549 - RNA, 21 nt, Human
gcaaagcaacgacuacuuugc

SEQ ID NO: 62550 - RNA, 22 nt, Human
caccgaggcuggagugcagugg

SEQ ID NO: 62551 - RNA, 25 nt, Human
uacauauacauuuucuuguggagca

SEQ ID NO: 62552 - RNA, 19 nt, Human
gcugucagcaccggccuca

SEQ ID NO: 62553 - RNA, 21 nt, Human
caccuagaggagcccugggac

SEQ ID NO: 62554 - RNA, 21 nt, Human
caccuaggcuggagugcagug

SEQ ID NO: 62555 - RNA, 26 nt, Human
ggcgccuguaaucccagcuacuuggg

SEQ ID NO: 62556 - RNA, 25 nt, Human
cgcacagcuaauggcaguaccuguc

SEQ ID NO: 62557 - RNA, 24 nt, Human
agcaauagcaugauguuacaggaa

SEQ ID NO: 62558 - RNA, 20 nt, Human
acucauaguuuugccaauua

SEQ ID NO: 62559 - RNA, 20 nt, Human
ucagcugucaucugcagccu

SEQ ID NO: 62560 - RNA, 23 nt, Human
gccacuccgagaggugggccagu

SEQ ID NO: 62561 - RNA, 27 nt, Human
ccccugccugcccucuagaucgccgcc

SEQ ID NO: 62562 - RNA, 23 nt, Human
gagucugaguccugucucugccu

SEQ ID NO: 62563 - RNA, 21 nt, Human
ccucugcugagaauccccacu

SEQ ID NO: 62564 - RNA, 20 nt, Human
ccagggcuggggaacacugu

SEQ ID NO: 62565 - RNA, 21 nt, Human
agaccuuccugcucuccagca

SEQ ID NO: 62566 - RNA, 19 nt, Human
ccccucuggagccagcaca

SEQ ID NO: 62567 - RNA, 19 nt, Human
ugagggagguuggcaugga

SEQ ID NO: 62568 - RNA, 22 nt, Human
ggagccccgcggugcagggcag

SEQ ID NO: 62569 - RNA, 26 nt, Human
cagcacuucugcucugucgucucucc

SEQ ID NO: 62570 - RNA, 22 nt, Human
acauaaacacauauaaaugcac

SEQ ID NO: 62571 - RNA, 20 nt, Human
aggaccacuugucucuaauu

SEQ ID NO: 62572 - RNA, 25 nt, Human
ccaugguggaauaaagaaaugugca

SEQ ID NO: 62573 - RNA, 23 nt, Human
agaaccucgcaucuuuuggugug

SEQ ID NO: 62574 - RNA, 32 nt, Human
agcccaguuucaaacuccugaccucaggugau

SEQ ID NO: 62575 - RNA, 22 nt, Human
ugggggcagagguuauguggga

SEQ ID NO: 62576 - RNA, 20 nt, Human
cauuucuuugaaaagcaauu

SEQ ID NO: 62577 - RNA, 24 nt, Human
acucuugagcuggcggugucaucg

SEQ ID NO: 62578 - RNA, 17 nt, Human
ccaacaggcaucugcca

SEQ ID NO: 62579 - RNA, 23 nt, Human
ggggaaagaaaaggauuuaagca

SEQ ID NO: 62580 - RNA, 22 nt, Human
ccacaaacaacaaaggcuaccc

SEQ ID NO: 62581 - RNA, 19 nt, Human
ggcaucccugucucaggga

SEQ ID NO: 62582 - RNA, 22 nt, Human
agcucacugcaaaucuaacuuc

SEQ ID NO: 62583 - RNA, 24 nt, Human
uguuuugcuacaguuugcagguga

SEQ ID NO: 62584 - RNA, 22 nt, Human
uaaaucugcuggucccacacac

SEQ ID NO: 62585 - RNA, 27 nt, Human
aacuuguauugcuucuguuucagugca

SEQ ID NO: 62586 - RNA, 25 nt, Human
gcggggacaggcuggaaugagggag

SEQ ID NO: 62587 - RNA, 19 nt, Human
ccuugaagaaugcccuuca

SEQ ID NO: 62588 - RNA, 21 nt, Human
ggcucacuguaaccuccgccu

SEQ ID NO: 62589 - RNA, 22 nt, Human
cgugagccaggaggcccggacc

SEQ ID NO: 62590 - RNA, 25 nt, Human
agccccagagagccugucugugcau

SEQ ID NO: 62591 - RNA, 28 nt, Human
uucagugcucauacguaucugcucauuu

SEQ ID NO: 62592 - RNA, 22 nt, Human
uuucauuuuguuguuuuguugc

SEQ ID NO: 62593 - RNA, 22 nt, Human
ccuuggggagggggaugccuuc

SEQ ID NO: 62594 - RNA, 22 nt, Human
gguaacugaaacaaaccuagca

SEQ ID NO: 62595 - RNA, 22 nt, Human
ucuggaaaacugccuuuuaucu

SEQ ID NO: 62596 - RNA, 22 nt, Human
gcuucaggcugggcacgguggc

SEQ ID NO: 62597 - RNA, 24 nt, Human
cgagacagcuugggaauccugcua

SEQ ID NO: 62598 - RNA, 22 nt, Human
ccacugcaauccagccugggcg

SEQ ID NO: 62599 - RNA, 25 nt, Human
ccagcagcaaccaggacgucuguuc

SEQ ID NO: 62600 - RNA, 27 nt, Human
gaucagucccuauuaugcaaaauguga

SEQ ID NO: 62601 - RNA, 22 nt, Human
gcagagcugagagccauggccu

SEQ ID NO: 62602 - RNA, 30 nt, Human
cccguuuucuucgguucccugcuguccaga

SEQ ID NO: 62603 - RNA, 20 nt, Human
caucuagcaaauguuaugca

SEQ ID NO: 62604 - RNA, 21 nt, Human
gcauguauuuuggaagaaaga

SEQ ID NO: 62605 - RNA, 21 nt, Human
cagauuguagagguccuggcg

SEQ ID NO: 62606 - RNA, 23 nt, Human
ggauggaagcaugaaggaaaggg

SEQ ID NO: 62607 - RNA, 25 nt, Human
ccugcgccugcugccccaacucggc

SEQ ID NO: 62608 - RNA, 26 nt, Human
uagucucugugcuuugacucaccugu

SEQ ID NO: 62609 - RNA, 22 nt, Human
gguuacaaaaagacaugagcug

SEQ ID NO: 62610 - RNA, 21 nt, Human
gaggcugaggcggguggauca

SEQ ID NO: 62611 - RNA, 16 nt, Human
gcuucucucuggacug

SEQ ID NO: 62612 - RNA, 21 nt, Human
uguuuuguaguuugcagauga

SEQ ID NO: 62613 - RNA, 26 nt, Human
cuggugagagggagagcccuucccau

SEQ ID NO: 62614 - RNA, 23 nt, Human
gcccagugccuucuguuucccag

SEQ ID NO: 62615 - RNA, 20 nt, Human
acugaccuucugcuuaauag

SEQ ID NO: 62616 - RNA, 27 nt, Human
cugcaggaucucucuucauagcccagu

SEQ ID NO: 62617 - RNA, 28 nt, Human
cuugccaggagcaugucugugcagcagu

SEQ ID NO: 62618 - RNA, 23 nt, Human
uuguuuccacuggcuuuccaucc

SEQ ID NO: 62619 - RNA, 27 nt, Human
ccaggaggagggggccuggcggacgcc

SEQ ID NO: 62620 - RNA, 23 nt, Human
guccacugcauucuuauaaguuc

SEQ ID NO: 62621 - RNA, 26 nt, Human
gcucugucgccaggcuggagugcagu

SEQ ID NO: 62622 - RNA, 26 nt, Human
acucugucaccaggcuggagugcagu

SEQ ID NO: 62623 - RNA, 27 nt, Human
uucuuucccagaagcgcccuguauuua

SEQ ID NO: 62624 - RNA, 20 nt, Human
ccgggauuguuuccccaagu

SEQ ID NO: 62625 - RNA, 24 nt, Human
agcugggaggacuugcugcuguuc

SEQ ID NO: 62626 - RNA, 26 nt, Human
gggcaggguggcccaccccagugggc

SEQ ID NO: 62627 - RNA, 23 nt, Human
aggagacaaaacuacccccacug

SEQ ID NO: 62628 - RNA, 26 nt, Human
gagacugggccuaggccaggaguucc

SEQ ID NO: 62629 - RNA, 20 nt, Human
gggcacagaccaaagaccgc

SEQ ID NO: 62630 - RNA, 19 nt, Human
ucaccagcaaacgccagga

SEQ ID NO: 62631 - RNA, 24 nt, Human
uguagcccagucuggagugcagug

SEQ ID NO: 62632 - RNA, 24 nt, Human
uucucagccuccagcugggcuguc

SEQ ID NO: 62633 - RNA, 24 nt, Human
cuggcugcugggcucuccaccuca

SEQ ID NO: 62634 - RNA, 19 nt, Human
ugggcagaaagcuguggga

SEQ ID NO: 62635 - RNA, 22 nt, Human
cccggggagguugagaacuggg

SEQ ID NO: 62636 - RNA, 19 nt, Human
cauggcaucauacucagga

SEQ ID NO: 62637 - RNA, 24 nt, Human
cccuauacuucacacugaacucag

SEQ ID NO: 62638 - RNA, 24 nt, Human
agagaggcccuucuuuggauucac

SEQ ID NO: 62639 - RNA, 21 nt, Human
uuaucaucugcaguuacuguu

SEQ ID NO: 62640 - RNA, 23 nt, Human
agggaaaguuaaggaugcuggag

SEQ ID NO: 62641 - RNA, 23 nt, Human
uuguagaaguuuuguuuuugaaa

SEQ ID NO: 62642 - RNA, 20 nt, Human
acugaacuugaacaccagaa

SEQ ID NO: 62643 - RNA, 25 nt, Human
ucacaggcucugcauacacaugcac

SEQ ID NO: 62644 - RNA, 22 nt, Human
guugcacucaggugacauccuc

SEQ ID NO: 62645 - RNA, 18 nt, Human
cuugguuuguguucuucu

SEQ ID NO: 62646 - RNA, 23 nt, Human
gagcuguggacucaggacccagg

SEQ ID NO: 62647 - RNA, 22 nt, Human
gacuacaggcgcccgccaccac

SEQ ID NO: 62648 - RNA, 22 nt, Human
gacuacaggcgccugccaccau

SEQ ID NO: 62649 - RNA, 25 nt, Human
cuggugagaggugcaaagaggcaga

SEQ ID NO: 62650 - RNA, 24 nt, Human
cccaucucccccucacugaaugcc

SEQ ID NO: 62651 - RNA, 27 nt, Human
cuucccaaagcugcccccaaaucagac

SEQ ID NO: 62652 - RNA, 22 nt, Human
guagcguuuuguggaguacugg

SEQ ID NO: 62653 - RNA, 24 nt, Human
ggccuccuacacguacuucuacca

SEQ ID NO: 62654 - RNA, 26 nt, Human
agaacuccauuucauuggacuaaaua

SEQ ID NO: 62655 - RNA, 20 nt, Human
agcugaggugggaggagugc

SEQ ID NO: 62656 - RNA, 22 nt, Human
ugacacccaggcuggagugcag

SEQ ID NO: 62657 - RNA, 25 nt, Human
agaggagaagagacauguaccuuga

SEQ ID NO: 62658 - RNA, 20 nt, Human
acuaccuguuuucugcggaa

SEQ ID NO: 62659 - RNA, 23 nt, Human
ucuccaggcugcugggcagcugg

SEQ ID NO: 62660 - RNA, 21 nt, Human
caaaaggaaggaaaugacaga

SEQ ID NO: 62661 - RNA, 22 nt, Human
ucacaugcuccacguagcugua

SEQ ID NO: 62662 - RNA, 26 nt, Human
uuccgucauugcugugaaugggcugg

SEQ ID NO: 62663 - RNA, 22 nt, Human
ccugcagcaucugaguggggcc

SEQ ID NO: 62664 - RNA, 23 nt, Human
gugccuggcacucugugggugcu

SEQ ID NO: 62665 - RNA, 24 nt, Human
acuaugucagcacagagccccaca

SEQ ID NO: 62666 - RNA, 26 nt, Human
cugcugucaacgaugaugugagucga

SEQ ID NO: 62667 - RNA, 20 nt, Human
ugaaacuuggauuugcucag

SEQ ID NO: 62668 - RNA, 23 nt, Human
guuuguuucuuuguucguucuga

SEQ ID NO: 62669 - RNA, 24 nt, Human
uccacacugagcaaugaaugugag

SEQ ID NO: 62670 - RNA, 23 nt, Human
acuguuuaauuugaaaguuuaca

SEQ ID NO: 62671 - RNA, 19 nt, Human
ucuauugacaguaucugca

SEQ ID NO: 62672 - RNA, 27 nt, Human
agcaguuucagagaacuuuuugcaugc

SEQ ID NO: 62673 - RNA, 20 nt, Human
ugaauccuucacugcauuau

SEQ ID NO: 62674 - RNA, 25 nt, Human
uggacaugaucuucuuuauaauucu

SEQ ID NO: 62675 - RNA, 22 nt, Human
aagaucuggauuugguggaaga

SEQ ID NO: 62676 - RNA, 21 nt, Human
guugcuugagcccagggguuu

SEQ ID NO: 62677 - RNA, 25 nt, Human
caggaccuggcguugggcgguacuu

SEQ ID NO: 62678 - RNA, 21 nt, Human
aucggccuggcccucacggug

SEQ ID NO: 62679 - RNA, 20 nt, Human
uaaucagccuuuuuguuuca

SEQ ID NO: 62680 - RNA, 24 nt, Human
ggcaggcaggacugggaucgaggc

SEQ ID NO: 62681 - RNA, 22 nt, Human
auucucaucuuuggccuguuca

SEQ ID NO: 62682 - RNA, 23 nt, Human
acacugcccuggccuuugcagag

SEQ ID NO: 62683 - RNA, 23 nt, Human
guacauuuauuuauuacuguccc

SEQ ID NO: 62684 - RNA, 22 nt, Human
ccaacauuguaaaaccccaucu

SEQ ID NO: 62685 - RNA, 27 nt, Human
ccccagcccauggacaggagauccugg

SEQ ID NO: 62686 - RNA, 22 nt, Human
aucacccaggcuggagugcagu

SEQ ID NO: 62687 - RNA, 26 nt, Human
ucagcucacaucaccagcucaccucu

SEQ ID NO: 62688 - RNA, 27 nt, Human
gacauggcucccccuccaccugcucug

SEQ ID NO: 62689 - RNA, 23 nt, Human
uacacguugcauacuacaaagca

SEQ ID NO: 62690 - RNA, 23 nt, Human
gccgggucccccggggcugcagu

SEQ ID NO: 62691 - RNA, 20 nt, Human
uugccaugaagccagugaag

SEQ ID NO: 62692 - RNA, 23 nt, Human
uuguccagaugggcacugcugug

SEQ ID NO: 62693 - RNA, 27 nt, Human
agucaucucuuacauucuaguucuggu

SEQ ID NO: 62694 - RNA, 22 nt, Human
uaacaacucucacuuuagugga

SEQ ID NO: 62695 - RNA, 25 nt, Human
uuggauguguuuggggccgggggga

SEQ ID NO: 62696 - RNA, 19 nt, Human
agcuguugcuuucuuugag

SEQ ID NO: 62697 - RNA, 21 nt, Human
ucaccaaggcuuagugcagug

SEQ ID NO: 62698 - RNA, 31 nt, Human
agaguagacaucuagccucccuaaggguaug

SEQ ID NO: 62699 - RNA, 30 nt, Human
ccccucauucuggaccagcacugcagccca

SEQ ID NO: 62700 - RNA, 25 nt, Human
ggggcuggguccacccuguccuaug

SEQ ID NO: 62701 - RNA, 20 nt, Human
gauugaucucugaaugugau

SEQ ID NO: 62702 - RNA, 22 nt, Human
ugcagugagcugagaucucacc

SEQ ID NO: 62703 - RNA, 21 nt, Human
agcugugcugggcacugaggg

SEQ ID NO: 62704 - RNA, 29 nt, Human
ccugcgucuuccgccccugccugccaugu

SEQ ID NO: 62705 - RNA, 19 nt, Human
agggaaagacccagaggga

SEQ ID NO: 62706 - RNA, 19 nt, Human
cuguauaccaggaacugaa

SEQ ID NO: 62707 - RNA, 24 nt, Human
uugccucucuggacgcucugcacc

SEQ ID NO: 62708 - RNA, 23 nt, Human
ggcuacugccacucaggcagccu

SEQ ID NO: 62709 - RNA, 23 nt, Human
ugccuguaaucccagcuacucgg

SEQ ID NO: 62710 - RNA, 23 nt, Human
ugccuguaauccuagcuacuugg

SEQ ID NO: 62711 - RNA, 22 nt, Human
cuggacucaaacuccugcuaca

SEQ ID NO: 62712 - RNA, 24 nt, Human
gcauuuuuagguuagccaguguga

SEQ ID NO: 62713 - RNA, 27 nt, Human
uugcccaggcuggucuugaacuccugg

SEQ ID NO: 62714 - RNA, 22 nt, Human
uuuuuugaccucaucacugaga

SEQ ID NO: 62715 - RNA, 20 nt, Human
acagagucuggugaagcuca

SEQ ID NO: 62716 - RNA, 21 nt, Human
uuguuuuaaaguuuucuagcu

SEQ ID NO: 62717 - RNA, 21 nt, Human
cacccaggcugagggugccuu

SEQ ID NO: 62718 - RNA, 23 nt, Human
gcuguggcugcaacuccccgccc

SEQ ID NO: 62719 - RNA, 21 nt, Human
gugugggcuggaagcacuggc

SEQ ID NO: 62720 - RNA, 21 nt, Human
gcugguuuguucugacuuuuu

SEQ ID NO: 62721 - RNA, 21 nt, Human
ccagcaccuuucucgggucac

SEQ ID NO: 62722 - RNA, 23 nt, Human
aucuccaugccacaccuuaucca

SEQ ID NO: 62723 - RNA, 26 nt, Human
uugcuguauauuugugauagcacuuu

SEQ ID NO: 62724 - RNA, 26 nt, Human
cagcagauuauucagccaugcuucua

SEQ ID NO: 62725 - RNA, 22 nt, Human
ggggagccucacagcagccacg

SEQ ID NO: 62726 - RNA, 23 nt, Human
gaggcagcaaacagauggcagga

SEQ ID NO: 62727 - RNA, 22 nt, Human
ccgcugcagccaccaccgccac

SEQ ID NO: 62728 - RNA, 18 nt, Human
acuaucuguaaugccuuu

SEQ ID NO: 62729 - RNA, 19 nt, Human
ccuccugcaccuaacuccc

SEQ ID NO: 62730 - RNA, 28 nt, Human
gagggagggguggcagaggaucugcagc

SEQ ID NO: 62731 - RNA, 25 nt, Human
ggauuggaggggagagcaagggagg

SEQ ID NO: 62732 - RNA, 25 nt, Human
cuuucugccucuccuccacagcccc

SEQ ID NO: 62733 - RNA, 24 nt, Human
gcucugagcccugcuagccuugag

SEQ ID NO: 62734 - RNA, 22 nt, Human
cuggauucucugggucuaugua

SEQ ID NO: 62735 - RNA, 20 nt, Human
uggccauuaagaagcucagc

SEQ ID NO: 62736 - RNA, 22 nt, Human
cagguucuccagugguaucugc

SEQ ID NO: 62737 - RNA, 21 nt, Human
aucuccccugcuccucugcug

SEQ ID NO: 62738 - RNA, 28 nt, Human
ucugagcgccucugcucucucccgguau

SEQ ID NO: 62739 - RNA, 26 nt, Human
cugcaaccucuauccuggaaccuguc

SEQ ID NO: 62740 - RNA, 23 nt, Human
aaugccaguugugacgaaaugag

SEQ ID NO: 62741 - RNA, 23 nt, Human
auuccugaguuacuucacuuaga

SEQ ID NO: 62742 - RNA, 24 nt, Human
uguaaccucugucuuggcagggcu

SEQ ID NO: 62743 - RNA, 30 nt, Human
ucuggguaucugaguggcucugaaguugca

SEQ ID NO: 62744 - RNA, 24 nt, Human
uccugaguauuuugcaaaugcaca

SEQ ID NO: 62745 - RNA, 23 nt, Human
cugggacauugaggcugcaguga

SEQ ID NO: 62746 - RNA, 21 nt, Human
ccuggcugagccuggcuggca

SEQ ID NO: 62747 - RNA, 27 nt, Human
acagauggccaaggagaggggccuaau

SEQ ID NO: 62748 - RNA, 20 nt, Human
ucaggguuuuuucuuccuuc

SEQ ID NO: 62749 - RNA, 20 nt, Human
cuucccuuauucuaaagcug

SEQ ID NO: 62750 - RNA, 21 nt, Human
guugguuaaaagauggcagaa

SEQ ID NO: 62751 - RNA, 17 nt, Human
uugccucacaacccugc

SEQ ID NO: 62752 - RNA, 27 nt, Human
gggccugacgggcccuucucagcccgu

SEQ ID NO: 62753 - RNA, 22 nt, Human
accuauucuaaccacuuaaaau

SEQ ID NO: 62754 - RNA, 23 nt, Human
cuguaacccuguguacuaagugc

SEQ ID NO: 62755 - RNA, 23 nt, Human
gcacgccucucccugcacucccu

SEQ ID NO: 62756 - RNA, 22 nt, Human
agaauuauaguucacuauggcc

SEQ ID NO: 62757 - RNA, 29 nt, Human
cuccguguuuuuaucacaccugcucccca

SEQ ID NO: 62758 - RNA, 27 nt, Human
cugggaggcugaggugggcggauugcu

SEQ ID NO: 62759 - RNA, 25 nt, Human
cuacaccacacccauacucagcccc

SEQ ID NO: 62760 - RNA, 26 nt, Human
ccuuucucccugaccccaagggcaca

SEQ ID NO: 62761 - RNA, 25 nt, Human
uauuacugcuaagagacauucuuca

SEQ ID NO: 62762 - RNA, 17 nt, Human
cuccaccccaggacgcc

SEQ ID NO: 62763 - RNA, 21 nt, Human
gugagggaagcugcaugggug

SEQ ID NO: 62764 - RNA, 20 nt, Human
ggcgcucucccggcgcugcu

SEQ ID NO: 62765 - RNA, 21 nt, Human
uguucacaagcuuggaauauu

SEQ ID NO: 62766 - RNA, 23 nt, Human
ucucaguggugugugaaguuugg

SEQ ID NO: 62767 - RNA, 26 nt, Human
cgcaugccuguaaucccagaacuuug

SEQ ID NO: 62768 - RNA, 21 nt, Human
ugugggcccagccuaggucag

SEQ ID NO: 62769 - RNA, 26 nt, Human
cacauaccauucuuauuccuaggcaa

SEQ ID NO: 62770 - RNA, 21 nt, Human
ucucagcauuacaaaagagua

SEQ ID NO: 62771 - RNA, 24 nt, Human
ggagccagaagccccggagaugua

SEQ ID NO: 62772 - RNA, 16 nt, Human
uucaagaaaugccuug

SEQ ID NO: 62773 - RNA, 30 nt, Human
acugucugcacuguuuucuuugcaugacuu

SEQ ID NO: 62774 - RNA, 23 nt, Human
gcagccaccgagccucugcccag

SEQ ID NO: 62775 - RNA, 27 nt, Human
uucauucuacucauacuacacacccag

SEQ ID NO: 62776 - RNA, 26 nt, Human
caccauguuacccagccuggucucaa

SEQ ID NO: 62777 - RNA, 20 nt, Human
auccuugcccaggugaggga

SEQ ID NO: 62778 - RNA, 21 nt, Human
ugaacucugggcucaagcaau

SEQ ID NO: 62779 - RNA, 22 nt, Human
augagacaugcuuuuccagcug

SEQ ID NO: 62780 - RNA, 23 nt, Human
gcuauuugacaauuccugccucu

SEQ ID NO: 62781 - RNA, 21 nt, Human
aggcugcagcaggcagaggag

SEQ ID NO: 62782 - RNA, 23 nt, Human
ccuugauuauacgaauacacuca

SEQ ID NO: 62783 - RNA, 26 nt, Human
gcagaaacguugcaccggugccugag

SEQ ID NO: 62784 - RNA, 22 nt, Human
aggcugagauaggaggaucacu

SEQ ID NO: 62785 - RNA, 21 nt, Human
cuggagccuggccacgcccuu

SEQ ID NO: 62786 - RNA, 23 nt, Human
uggcucgggguggagcuagggug

SEQ ID NO: 62787 - RNA, 24 nt, Human
cucaucuuccaggcaacagugccu

SEQ ID NO: 62788 - RNA, 22 nt, Human
cugaggugggcggauugcuuga

SEQ ID NO: 62789 - RNA, 19 nt, Human
augggaaaaaucccagggg

SEQ ID NO: 62790 - RNA, 25 nt, Human
gaguccagagaggaaacuguggaau

SEQ ID NO: 62791 - RNA, 28 nt, Human
gacuuaaccggggaaugagggacuuggu

SEQ ID NO: 62792 - RNA, 22 nt, Human
aaguggguccuuauguacacac

SEQ ID NO: 62793 - RNA, 20 nt, Human
cugcccuugcaaaugaagcu

SEQ ID NO: 62794 - RNA, 27 nt, Human
aggcucgugcauguaauccuagcacuu

SEQ ID NO: 62795 - RNA, 20 nt, Human
ggggaugggagagccacagu

SEQ ID NO: 62796 - RNA, 20 nt, Human
cuuucugcauauuacugaac

SEQ ID NO: 62797 - RNA, 26 nt, Human
uucacaccgcacccugcacucaccca

SEQ ID NO: 62798 - RNA, 19 nt, Human
acuguugugccuguuuguc

SEQ ID NO: 62799 - RNA, 25 nt, Human
uuccacugcagagaaagugguuguu

SEQ ID NO: 62800 - RNA, 22 nt, Human
aacucagauauuuuuuauuuaa

SEQ ID NO: 62801 - RNA, 22 nt, Human
ccucacacauccagacaucaug

SEQ ID NO: 62802 - RNA, 22 nt, Human
aaaugcuuuuguucaguucugg

SEQ ID NO: 62803 - RNA, 19 nt, Human
ugcauccacagaagcacaa

SEQ ID NO: 62804 - RNA, 24 nt, Human
cggccccagggcccugcgcccacu

SEQ ID NO: 62805 - RNA, 22 nt, Human
gccuuccucccuuccuuucaca

SEQ ID NO: 62806 - RNA, 21 nt, Human
guuuuuaauaaaugcuuguua

SEQ ID NO: 62807 - RNA, 26 nt, Human
cccuucuucauugcucucuccagaaa

SEQ ID NO: 62808 - RNA, 24 nt, Human
ugugaaugucaccauugcuuuuca

SEQ ID NO: 62809 - RNA, 21 nt, Human
uuugugucugugacuuuugug

SEQ ID NO: 62810 - RNA, 23 nt, Human
cugucucucuggcaggagugccu

SEQ ID NO: 62811 - RNA, 22 nt, Human
uuuuucacaaucacacugagac

SEQ ID NO: 62812 - RNA, 26 nt, Human
uuuuucuccccauuuuccagggagaa

SEQ ID NO: 62813 - RNA, 28 nt, Human
ucauuagugacuucaaagggaaaucaag

SEQ ID NO: 62814 - RNA, 23 nt, Human
gucccuacgcaauagcagcugcc

SEQ ID NO: 62815 - RNA, 27 nt, Human
cacugccuucuuguuccagcuaggcaa

SEQ ID NO: 62816 - RNA, 27 nt, Human
uccagcaccuggcguggaugcaccgug

SEQ ID NO: 62817 - RNA, 18 nt, Human
aagaucuuugucugugaa

SEQ ID NO: 62818 - RNA, 22 nt, Human
acugcacugcucacuuguggcc

SEQ ID NO: 62819 - RNA, 23 nt, Human
cccuccaccagccggcucacucc

SEQ ID NO: 62820 - RNA, 19 nt, Human
ucucauaacuugcaucaag

SEQ ID NO: 62821 - RNA, 26 nt, Human
cugccuccuguuccagcuccugcugc

SEQ ID NO: 62822 - RNA, 22 nt, Human
gccugcugaguagcugggacua

SEQ ID NO: 62823 - RNA, 23 nt, Human
aacuucuaauggccaucuguaaa

SEQ ID NO: 62824 - RNA, 23 nt, Human
uuucaccugaauaucauaaugcu

SEQ ID NO: 62825 - RNA, 22 nt, Human
ugccuccugcuuaguucacuuu

SEQ ID NO: 62826 - RNA, 29 nt, Human
ccuaguuguccucccucuggagccccguc

SEQ ID NO: 62827 - RNA, 23 nt, Human
agucucacucucuugucccaccc

SEQ ID NO: 62828 - RNA, 22 nt, Human
gcagcaccuggagcccacagag

SEQ ID NO: 62829 - RNA, 26 nt, Human
ccugugugauacaagagucagcauca

SEQ ID NO: 62830 - RNA, 17 nt, Human
ucaaaugaucagacaaa

SEQ ID NO: 62831 - RNA, 21 nt, Human
ugguggcuuagccugggcagg

SEQ ID NO: 62832 - RNA, 23 nt, Human
cugucgccaggcuggaguguagu

SEQ ID NO: 62833 - RNA, 23 nt, Human
ugaaguccaggggcauugaggca

SEQ ID NO: 62834 - RNA, 21 nt, Human
aaauccaguuagaagugcaau

SEQ ID NO: 62835 - RNA, 22 nt, Human
cuguaaaauguuauuuuuggug

SEQ ID NO: 62836 - RNA, 22 nt, Human
acuuaccugcauguguuguaca

SEQ ID NO: 62837 - RNA, 24 nt, Human
aaaaaccaaaugaccgcacuguga

SEQ ID NO: 62838 - RNA, 22 nt, Human
agcccugcucauuccucacgcc

SEQ ID NO: 62839 - RNA, 25 nt, Human
acaagucccuguaauuguuguuugu

SEQ ID NO: 62840 - RNA, 21 nt, Human
cuccucucccauucgcaauaa

SEQ ID NO: 62841 - RNA, 24 nt, Human
uguuguuuuucauccuuggcagcu

SEQ ID NO: 62842 - RNA, 23 nt, Human
cacacucagcacacuuuuccucc

SEQ ID NO: 62843 - RNA, 25 nt, Human
gccccaggggagccagaauccagcc

SEQ ID NO: 62844 - RNA, 20 nt, Human
ugcugucuggcuuucccgaa

SEQ ID NO: 62845 - RNA, 19 nt, Human
aacaagggcguggaucccu

SEQ ID NO: 62846 - RNA, 24 nt, Human
gccagugacuguggucuguacuug

SEQ ID NO: 62847 - RNA, 23 nt, Human
gcucugacuucugcucuggacca

SEQ ID NO: 62848 - RNA, 27 nt, Human
caagagggcggcuucacugugcgaaua

SEQ ID NO: 62849 - RNA, 21 nt, Human
uccugaaagaauggacugaag

SEQ ID NO: 62850 - RNA, 21 nt, Human
uggaaacaucugauuucugaa

SEQ ID NO: 62851 - RNA, 26 nt, Human
ugagccaagaucgcgccauugcacuc

SEQ ID NO: 62852 - RNA, 25 nt, Human
ccccgguccgggggcagccaggccu

SEQ ID NO: 62853 - RNA, 26 nt, Human
gcagccgccccaucugccccacaguc

SEQ ID NO: 62854 - RNA, 26 nt, Human
guggccuuugagaagcugcuguuaac

SEQ ID NO: 62855 - RNA, 19 nt, Human
gagcccaggcgggagcggu

SEQ ID NO: 62856 - RNA, 25 nt, Human
aacucucauucaggggcuccaggau

SEQ ID NO: 62857 - RNA, 21 nt, Human
agggaucuuuuucugccccug

SEQ ID NO: 62858 - RNA, 21 nt, Human
augucuucucccuuguuugag

SEQ ID NO: 62859 - RNA, 22 nt, Human
ggaguggggacugggugggggc

SEQ ID NO: 62860 - RNA, 20 nt, Human
ccccucggaggacaagcgcu

SEQ ID NO: 62861 - RNA, 20 nt, Human
uuucuacugcuaagaagguc

SEQ ID NO: 62862 - RNA, 24 nt, Human
ucuccucagcucucucaucuccug

SEQ ID NO: 62863 - RNA, 21 nt, Human
cucuuucucacgcuuuuaugg

SEQ ID NO: 62864 - RNA, 27 nt, Human
gcugccucucccucccuguuugaaucu

SEQ ID NO: 62865 - RNA, 27 nt, Human
cucauuucugacccacuuuuuccuuug

SEQ ID NO: 62866 - RNA, 23 nt, Human
cauugccucuccuuccuugaacu

SEQ ID NO: 62867 - RNA, 31 nt, Human
ccucagccuguugcccugccucccaaacccc

SEQ ID NO: 62868 - RNA, 18 nt, Human
uaaucagcuugaacugcc

SEQ ID NO: 62869 - RNA, 22 nt, Human
cuugccucagcuucuugcugcc

SEQ ID NO: 62870 - RNA, 27 nt, Human
gaggaagaaugcuccuggcuguuuugu

SEQ ID NO: 62871 - RNA, 27 nt, Human
aagauucaugucucuauaaaauagaca

SEQ ID NO: 62872 - RNA, 20 nt, Human
guggugguggcgcagcagac

SEQ ID NO: 62873 - RNA, 27 nt, Human
gcaauccauguuaguuuuuacuuucug

SEQ ID NO: 62874 - RNA, 22 nt, Human
gugaagcccuguugugccacag

SEQ ID NO: 62875 - RNA, 21 nt, Human
gagagucggcugugaaggaga

SEQ ID NO: 62876 - RNA, 23 nt, Human
ggccuccuacuguaccucgugcc

SEQ ID NO: 62877 - RNA, 25 nt, Human
ucuuggggccagccuaagaucaugg

SEQ ID NO: 62878 - RNA, 19 nt, Human
gcgaacuggguucuuugga

SEQ ID NO: 62879 - RNA, 21 nt, Human
auacuauaaaugugcuaaguu

SEQ ID NO: 62880 - RNA, 19 nt, Human
agagagacacagagcugug

SEQ ID NO: 62881 - RNA, 23 nt, Human
aucgcaccacugcacuccagucu

SEQ ID NO: 62882 - RNA, 23 nt, Human
ugccucccccuugcuggugucag

SEQ ID NO: 62883 - RNA, 21 nt, Human
cagagauccaggaaaccaaag

SEQ ID NO: 62884 - RNA, 26 nt, Human
gacucuugccuuuccaccugcuuucu

SEQ ID NO: 62885 - RNA, 23 nt, Human
ggaguguagaccuguguguggga

SEQ ID NO: 62886 - RNA, 22 nt, Human
cuguuguuaaucuucaagcuag

SEQ ID NO: 62887 - RNA, 21 nt, Human
ucggccgccgccgccucccag

SEQ ID NO: 62888 - RNA, 21 nt, Human
uccuguuugcucgcuggacca

SEQ ID NO: 62889 - RNA, 22 nt, Human
agagaaaccaagcccugcaaug

SEQ ID NO: 62890 - RNA, 24 nt, Human
ucaugaagaaagaacacaggagua

SEQ ID NO: 62891 - RNA, 26 nt, Human
uaggcagcugugcagcuucaccucuu

SEQ ID NO: 62892 - RNA, 21 nt, Human
accuccugccauggaacucca

SEQ ID NO: 62893 - RNA, 19 nt, Human
agaacaccugcauucuucc

SEQ ID NO: 62894 - RNA, 25 nt, Human
cugaagggaaaugaggcagcugcug

SEQ ID NO: 62895 - RNA, 25 nt, Human
uguuguguuuugcucugucuaaaaa

SEQ ID NO: 62896 - RNA, 21 nt, Human
uccaagggaagccuguguuug

SEQ ID NO: 62897 - RNA, 22 nt, Human
agaccccugcuccagggccacu

SEQ ID NO: 62898 - RNA, 22 nt, Human
ucacugcagccuugaacuccug

SEQ ID NO: 62899 - RNA, 20 nt, Human
aacuuuugcuauuacuccua

SEQ ID NO: 62900 - RNA, 25 nt, Human
cacugcagcaaaaacaaaaccacca

SEQ ID NO: 62901 - RNA, 23 nt, Human
acccccacccugcacuuuccucc

SEQ ID NO: 62902 - RNA, 23 nt, Human
aguccgggacgcgcaaggcagag

SEQ ID NO: 62903 - RNA, 22 nt, Human
ucuuccauccagcggcucuucc

SEQ ID NO: 62904 - RNA, 21 nt, Human
uugacagauugcuuacacagu

SEQ ID NO: 62905 - RNA, 25 nt, Human
augaccucaugggggguggagggag

SEQ ID NO: 62906 - RNA, 22 nt, Human
auugggaaaguacagucucaaa

SEQ ID NO: 62907 - RNA, 26 nt, Human
uuguuccuucuccuugccgggaagua

SEQ ID NO: 62908 - RNA, 22 nt, Human
gggguuuucuuuagauuuuacu

SEQ ID NO: 62909 - RNA, 23 nt, Human
gugcaggcuggagaagagaaggc

SEQ ID NO: 62910 - RNA, 21 nt, Human
ucagcaguuucuucucucaua

SEQ ID NO: 62911 - RNA, 21 nt, Human
cccuccucccccuccacagcc

SEQ ID NO: 62912 - RNA, 26 nt, Human
uuuuggcccaaaugauuauguuuccu

SEQ ID NO: 62913 - RNA, 21 nt, Human
gcucaggcugcagcuggacag

SEQ ID NO: 62914 - RNA, 20 nt, Human
cgaucuacagggugaucuca

SEQ ID NO: 62915 - RNA, 21 nt, Human
aacuaguaacugagacuccuc

SEQ ID NO: 62916 - RNA, 22 nt, Human
gucacacaggcuggagugcagu

SEQ ID NO: 62917 - RNA, 25 nt, Human
agggaggagaggcgcggggagccag

SEQ ID NO: 62918 - RNA, 29 nt, Human
ccaacucgccaccacugcugccgaccucg

SEQ ID NO: 62919 - RNA, 20 nt, Human
ucuucugcgccucaggcugc

SEQ ID NO: 62920 - RNA, 23 nt, Human
aucgggccacugcacuccagcuu

SEQ ID NO: 62921 - RNA, 27 nt, Human
ucccacauuuuucuuacggucggagca

SEQ ID NO: 62922 - RNA, 24 nt, Human
cugucuccuaagcuggagugcagu

SEQ ID NO: 62923 - RNA, 26 nt, Human
agcuccuuucuucucuuucugcuuca

SEQ ID NO: 62924 - RNA, 25 nt, Human
ccuggccucauuuaaaacaagacuu

SEQ ID NO: 62925 - RNA, 25 nt, Human
aaauguucauuguuuaauuagcacu

SEQ ID NO: 62926 - RNA, 21 nt, Human
acaauuccuugggcuucuccu

SEQ ID NO: 62927 - RNA, 24 nt, Human
ccuccccuugccagcugcugagcc

SEQ ID NO: 62928 - RNA, 22 nt, Human
gugcagucuugcuuacaaggag

SEQ ID NO: 62929 - RNA, 18 nt, Human
uccucaagcacuugcugg

SEQ ID NO: 62930 - RNA, 20 nt, Human
uugcuguacuaucagccugc

SEQ ID NO: 62931 - RNA, 23 nt, Human
cccacgucuccuccucgaagcca

SEQ ID NO: 62932 - RNA, 22 nt, Human
uggaucacaaggucaagagaua

SEQ ID NO: 62933 - RNA, 21 nt, Human
uuuccauucucuuucaauucu

SEQ ID NO: 62934 - RNA, 23 nt, Human
cugucucuauucuaggcaagaga

SEQ ID NO: 62935 - RNA, 24 nt, Human
ucacgccuauaucccagcacuuug

SEQ ID NO: 62936 - RNA, 25 nt, Human
ccccuuucugcuccacaaaaaccac

SEQ ID NO: 62937 - RNA, 22 nt, Human
cacuuuucacucccaaagaagg

SEQ ID NO: 62938 - RNA, 24 nt, Human
gcugggagggggcagccaagaagc

SEQ ID NO: 62939 - RNA, 21 nt, Human
gacuauacaagaauuaauuuu

SEQ ID NO: 62940 - RNA, 23 nt, Human
ggcagccgccucccuuaugcagg

SEQ ID NO: 62941 - RNA, 25 nt, Human
agaccaucuuggccaacauggugaa

SEQ ID NO: 62942 - RNA, 21 nt, Human
cugcugucaggucugauaguc

SEQ ID NO: 62943 - RNA, 21 nt, Human
gugugcugggauuacaggcau

SEQ ID NO: 62944 - RNA, 22 nt, Human
agaccagccugggcaacacagc

SEQ ID NO: 62945 - RNA, 19 nt, Human
augguacuuccucugugaa

SEQ ID NO: 62946 - RNA, 22 nt, Human
caccaaggaauugccuccagcc

SEQ ID NO: 62947 - RNA, 21 nt, Human
cgaggugagacgggaagaugg

SEQ ID NO: 62948 - RNA, 22 nt, Human
ugccuagaaccagcugcaccug

SEQ ID NO: 62949 - RNA, 20 nt, Human
ggcgguccaggguccugggc

SEQ ID NO: 62950 - RNA, 26 nt, Human
augguuuuuguuaguucacuucagcu

SEQ ID NO: 62951 - RNA, 22 nt, Human
ccaacucugccagcccccaccu

SEQ ID NO: 62952 - RNA, 23 nt, Human
gcugugcccuagggccugggugg

SEQ ID NO: 62953 - RNA, 28 nt, Human
ccaggcucccaggacugcuccagaaccg

SEQ ID NO: 62954 - RNA, 27 nt, Human
acagcuuauccuuuuucaaccaacuuu

SEQ ID NO: 62955 - RNA, 21 nt, Human
uguccccgcucagucuuugag

SEQ ID NO: 62956 - RNA, 25 nt, Human
agggaaagccugcuaugcaggggga

SEQ ID NO: 62957 - RNA, 27 nt, Human
cucaaugcucaucacacacagggcuau

SEQ ID NO: 62958 - RNA, 21 nt, Human
cacgcagcucagccugggcgg

SEQ ID NO: 62959 - RNA, 22 nt, Human
ucuccccugcccuccuggagcc

SEQ ID NO: 62960 - RNA, 21 nt, Human
uagacuccauguaguuacuuc

SEQ ID NO: 62961 - RNA, 21 nt, Human
caacuggaguagucuuuuaac

SEQ ID NO: 62962 - RNA, 20 nt, Human
ugccugacgacuccuguguc

SEQ ID NO: 62963 - RNA, 20 nt, Human
aggcugaggcugcaaugacu

SEQ ID NO: 62964 - RNA, 23 nt, Human
gaaagagaaucgggccacugcca

SEQ ID NO: 62965 - RNA, 19 nt, Human
cacuucuuaaauacaauca

SEQ ID NO: 62966 - RNA, 22 nt, Human
cccucagugaggaucuucaugu

SEQ ID NO: 62967 - RNA, 18 nt, Human
auauguacuuacacuuug

SEQ ID NO: 62968 - RNA, 22 nt, Human
agcagagagguggagaacuggg

SEQ ID NO: 62969 - RNA, 22 nt, Human
ugggggcacggaauaagcacau

SEQ ID NO: 62970 - RNA, 24 nt, Human
ggagauacugaacauuuugcaaaa

SEQ ID NO: 62971 - RNA, 27 nt, Human
ccuguuuuucucaucugugcagugggu

SEQ ID NO: 62972 - RNA, 20 nt, Human
ggagauggagucaguggggc

SEQ ID NO: 62973 - RNA, 20 nt, Human
agggagcugcucagaaugcc

SEQ ID NO: 62974 - RNA, 24 nt, Human
cucuuagaccucucccaucaugcc

SEQ ID NO: 62975 - RNA, 23 nt, Human
ccuggucccaucugccucuuuuc

SEQ ID NO: 62976 - RNA, 21 nt, Human
cauggauccuggauugagacg

SEQ ID NO: 62977 - RNA, 26 nt, Human
cuuaaccccuuccucccuguccccac

SEQ ID NO: 62978 - RNA, 21 nt, Human
gcaggcaaaacaaauguaaug

SEQ ID NO: 62979 - RNA, 20 nt, Human
ggaaaugcugauagcucaua

SEQ ID NO: 62980 - RNA, 23 nt, Human
gggccuguccacaggcuucugag

SEQ ID NO: 62981 - RNA, 27 nt, Human
agcacauacccccacccaguaccaaau

SEQ ID NO: 62982 - RNA, 21 nt, Human
gacacaaauaccagagcacag

SEQ ID NO: 62983 - RNA, 23 nt, Human
ucacuuauccuguucucugaaga

SEQ ID NO: 62984 - RNA, 23 nt, Human
gucugaacuggaguggaguagga

SEQ ID NO: 62985 - RNA, 22 nt, Human
aucaugaaagaaggcucagaga

SEQ ID NO: 62986 - RNA, 23 nt, Human
gacuugcugagcaaacccugccg

SEQ ID NO: 62987 - RNA, 28 nt, Human
ucuugugccuucugcucucucagcaacc

SEQ ID NO: 62988 - RNA, 23 nt, Human
ucaucaucugugaugaugguguc

SEQ ID NO: 62989 - RNA, 23 nt, Human
gggcugucugucaccagcuaucu

SEQ ID NO: 62990 - RNA, 22 nt, Human
aaccaaggagcuaucuagcucu

SEQ ID NO: 62991 - RNA, 23 nt, Human
gcuuugaaagcgggaucuuggag

SEQ ID NO: 62992 - RNA, 22 nt, Human
ugccuguagaugugagcuguug

SEQ ID NO: 62993 - RNA, 24 nt, Human
augagggcagaggugcuaccuggc

SEQ ID NO: 62994 - RNA, 25 nt, Human
agacuucuccagggucaugauccca

SEQ ID NO: 62995 - RNA, 21 nt, Human
uggaaucucacuggugcccca

SEQ ID NO: 62996 - RNA, 26 nt, Human
ccuggggggcagugguguggagaagc

SEQ ID NO: 62997 - RNA, 22 nt, Human
ucauuuaaguuucaaacuuacu

SEQ ID NO: 62998 - RNA, 21 nt, Human
guuccuaacuuuuccuucacu

SEQ ID NO: 62999 - RNA, 23 nt, Human
gcuaugguuuucuccaagagcua

SEQ ID NO: 63000 - RNA, 30 nt, Human
uggcucggccucccucacacugaccaaggg

SEQ ID NO: 63001 - RNA, 27 nt, Human
cgccacugcaguccgcagucuggccug

SEQ ID NO: 63002 - RNA, 27 nt, Human
ccaccucuuccuucccacugccaaagg

SEQ ID NO: 63003 - RNA, 21 nt, Human
agagcaacaacaaacugcuua

SEQ ID NO: 63004 - RNA, 23 nt, Human
cucuucagucucccagucaucug

SEQ ID NO: 63005 - RNA, 21 nt, Human
ggcccagccaaagcaccccuc

SEQ ID NO: 63006 - RNA, 23 nt, Human
aucauuccacugcauuucagccu

SEQ ID NO: 63007 - RNA, 21 nt, Human
uccaauaaaauagcuggauua

SEQ ID NO: 63008 - RNA, 23 nt, Human
uguguaguguggucugggcaggc

SEQ ID NO: 63009 - RNA, 23 nt, Human
aagcaaaauggggauugaaggga

SEQ ID NO: 63010 - RNA, 23 nt, Human
cacccacacaccacucucccuag

SEQ ID NO: 63011 - RNA, 22 nt, Human
accuguaaucccaacacuuugg

SEQ ID NO: 63012 - RNA, 22 nt, Human
accuguaaucccagcacuuuga

SEQ ID NO: 63013 - RNA, 30 nt, Human
acaggcuucccuuccuucccccuccuuagu

SEQ ID NO: 63014 - RNA, 22 nt, Human
gaacccaggaggcagagguugc

SEQ ID NO: 63015 - RNA, 28 nt, Human
agccuacuucacaccgccuucucuuauu

SEQ ID NO: 63016 - RNA, 22 nt, Human
gccucaggaacccugaagcugg

SEQ ID NO: 63017 - RNA, 23 nt, Human
ggucuaaagugccugggcuuggu

SEQ ID NO: 63018 - RNA, 27 nt, Human
aacagcaugcugcugcucaaaaugcca

SEQ ID NO: 63019 - RNA, 27 nt, Human
ggggcaauaugucaucuaccuaccuca

SEQ ID NO: 63020 - RNA, 22 nt, Human
cucuuugcuguugggcauguga

SEQ ID NO: 63021 - RNA, 24 nt, Human
gcgagggcagaggugaucaccugc

SEQ ID NO: 63022 - RNA, 23 nt, Human
ggaggggguggccuugaggcaga

SEQ ID NO: 63023 - RNA, 22 nt, Human
gagccucaccagcagcugcuuu

SEQ ID NO: 63024 - RNA, 19 nt, Human
cuccucucugggccuuggc

SEQ ID NO: 63025 - RNA, 21 nt, Human
ucagaaucauggagaaaaugg

SEQ ID NO: 63026 - RNA, 22 nt, Human
cgcugugugcauuccucacuag

SEQ ID NO: 63027 - RNA, 19 nt, Human
cgcccaggcucggugcugg

SEQ ID NO: 63028 - RNA, 27 nt, Human
acacuccugcucaaaugguguuauugc

SEQ ID NO: 63029 - RNA, 22 nt, Human
ggcuuggauguuuuuaguucug

SEQ ID NO: 63030 - RNA, 22 nt, Human
ggugggcaucuuccccagcaac

SEQ ID NO: 63031 - RNA, 24 nt, Human
caauccacuccuuccuuucuauca

SEQ ID NO: 63032 - RNA, 24 nt, Human
cccucauuccuccggagaaagccg

SEQ ID NO: 63033 - RNA, 21 nt, Human
aagcuacuuuauuagauauag

SEQ ID NO: 63034 - RNA, 26 nt, Human
gaugccacuucccagaggcagagccu

SEQ ID NO: 63035 - RNA, 21 nt, Human
gcagagagggaacuuugcacu

SEQ ID NO: 63036 - RNA, 27 nt, Human
cuucccaaacgccuccccugccccaau

SEQ ID NO: 63037 - RNA, 22 nt, Human
gugaucacagcucacugcagcc

SEQ ID NO: 63038 - RNA, 22 nt, Human
augaucacggcucacugcagcc

SEQ ID NO: 63039 - RNA, 23 nt, Human
uacucaggcagugcaauacucag

SEQ ID NO: 63040 - RNA, 25 nt, Human
gggcucccccacauccuuuccuugc

SEQ ID NO: 63041 - RNA, 22 nt, Human
ucccaguuuuuacuuuuacugg

SEQ ID NO: 63042 - RNA, 24 nt, Human
gcccuggaccccagcagaugagga

SEQ ID NO: 63043 - RNA, 22 nt, Human
augcuugagauuuuccugcugc

SEQ ID NO: 63044 - RNA, 19 nt, Human
caggccacgcaucacaaga

SEQ ID NO: 63045 - RNA, 26 nt, Human
cagccgggcuggaggcugugcagaag

SEQ ID NO: 63046 - RNA, 19 nt, Human
cacguguuuuuauguccuu

SEQ ID NO: 63047 - RNA, 20 nt, Human
gcagagaggcccugccugaa

SEQ ID NO: 63048 - RNA, 27 nt, Human
ccgaggcgcgagguugcggcgcgcagc

SEQ ID NO: 63049 - RNA, 30 nt, Human
gcaagguggaaagggagauuccacggaaga

SEQ ID NO: 63050 - RNA, 26 nt, Human
ggggaugugcauucacauacuauuac

SEQ ID NO: 63051 - RNA, 22 nt, Human
cagaauuuguugaacaacuacg

SEQ ID NO: 63052 - RNA, 22 nt, Human
gugggcagaggugcaagagagg

SEQ ID NO: 63053 - RNA, 32 nt, Human
gggcugguuucaaacuccugaccucaguugau

SEQ ID NO: 63054 - RNA, 19 nt, Human
gcgcuccacuuccuucaca

SEQ ID NO: 63055 - RNA, 18 nt, Human
ucaugccugccucuuuca

SEQ ID NO: 63056 - RNA, 23 nt, Human
ucuuguuccccacugacagccuc

SEQ ID NO: 63057 - RNA, 27 nt, Human
cccucauuuucugguccucgcgacuga

SEQ ID NO: 63058 - RNA, 26 nt, Human
uuuccugagcucuauaccaugcauuu

SEQ ID NO: 63059 - RNA, 27 nt, Human
uggccaacauggugaaacccuguaucu

SEQ ID NO: 63060 - RNA, 22 nt, Human
cgccuccuggguucaagcgauu

SEQ ID NO: 63061 - RNA, 23 nt, Human
ccuccacugaucugaggagaucc

SEQ ID NO: 63062 - RNA, 23 nt, Human
cacgaagcagaggcugggcgugg

SEQ ID NO: 63063 - RNA, 21 nt, Human
gcgagagucccugcagucccu

SEQ ID NO: 63064 - RNA, 24 nt, Human
uuccccucaccuucugcagaaguc

SEQ ID NO: 63065 - RNA, 22 nt, Human
aggcuggagugcaguggcggga

SEQ ID NO: 63066 - RNA, 27 nt, Human
cccaggaguuugaggcugcagugagcc

SEQ ID NO: 63067 - RNA, 25 nt, Human
acauuuucuccuaggagaagcagcc

SEQ ID NO: 63068 - RNA, 23 nt, Human
caugccuguaaucccagcuacgc

SEQ ID NO: 63069 - RNA, 24 nt, Human
auucaugugcccgauuggccaaau

SEQ ID NO: 63070 - RNA, 22 nt, Human
uguccuuuuucacuugcaccuu

SEQ ID NO: 63071 - RNA, 20 nt, Human
gugccuaggccugggcagug

SEQ ID NO: 63072 - RNA, 24 nt, Human
ggcauaugcaauauuuacauuuuu

SEQ ID NO: 63073 - RNA, 27 nt, Human
cccagcuccccacacagcgcugggcca

SEQ ID NO: 63074 - RNA, 21 nt, Human
cccugcagagggccugguuuc

SEQ ID NO: 63075 - RNA, 22 nt, Human
uggagucucgcucugucaccca

SEQ ID NO: 63076 - RNA, 22 nt, Human
cggagucuugcucugucaccca

SEQ ID NO: 63077 - RNA, 23 nt, Human
ucuuuuuacccaggcuggagugc

SEQ ID NO: 63078 - RNA, 19 nt, Human
cugguccacacaccacaga

SEQ ID NO: 63079 - RNA, 20 nt, Human
guuccaaucucaccccacca

SEQ ID NO: 63080 - RNA, 19 nt, Human
gugggggaucacagccucu

SEQ ID NO: 63081 - RNA, 21 nt, Human
ccuccacaaagcuccugggcc

SEQ ID NO: 63082 - RNA, 24 nt, Human
gguuuguagucccaacuugcugcu

SEQ ID NO: 63083 - RNA, 24 nt, Human
ccuggauucugguucugacagggc

SEQ ID NO: 63084 - RNA, 27 nt, Human
cccuccaggaaaugacagcaggugcca

SEQ ID NO: 63085 - RNA, 23 nt, Human
ccccacgcaggaccaacuaccuc

SEQ ID NO: 63086 - RNA, 25 nt, Human
uggggaagggagggcaggguggggc

SEQ ID NO: 63087 - RNA, 21 nt, Human
ucucagaugaguuugcugcgu

SEQ ID NO: 63088 - RNA, 18 nt, Human
gggaggugugaggcagga

SEQ ID NO: 63089 - RNA, 25 nt, Human
gggcuccagcuucugcucagagcgc

SEQ ID NO: 63090 - RNA, 22 nt, Human
aucuuggcacccggaggcagcg

SEQ ID NO: 63091 - RNA, 22 nt, Human
cacgucugccccuguucuggcc

SEQ ID NO: 63092 - RNA, 21 nt, Human
ggauuccagacccaggaggag

SEQ ID NO: 63093 - RNA, 24 nt, Human
cccgcggccggcggcuccuccucc

SEQ ID NO: 63094 - RNA, 25 nt, Human
ugccacauagaaggcucucaacauc

SEQ ID NO: 63095 - RNA, 18 nt, Human
uccucaagucgcagcugg

SEQ ID NO: 63096 - RNA, 27 nt, Human
acugcaaccugugccucccggcuucaa

SEQ ID NO: 63097 - RNA, 22 nt, Human
cuggcugguguuaacagaaggg

SEQ ID NO: 63098 - RNA, 21 nt, Human
uccauuucugucucuaaccau

SEQ ID NO: 63099 - RNA, 20 nt, Human
ccccuccguagcacugagga

SEQ ID NO: 63100 - RNA, 29 nt, Human
ucccuguccccguccccaggagguaccga

SEQ ID NO: 63101 - RNA, 19 nt, Human
ggaaguaguaauugcaaga

SEQ ID NO: 63102 - RNA, 26 nt, Human
ggacgcagaaagguuaaggcacuuuu

SEQ ID NO: 63103 - RNA, 27 nt, Human
uugggaggccgggguuggaggaucauu

SEQ ID NO: 63104 - RNA, 26 nt, Human
uggggaggggccggggucagggagag

SEQ ID NO: 63105 - RNA, 23 nt, Human
agcugcuuuuuuguauuuuuggu

SEQ ID NO: 63106 - RNA, 19 nt, Human
gggaguguguguggguccu

SEQ ID NO: 63107 - RNA, 26 nt, Human
caccacacaccccgccccugaaagga

SEQ ID NO: 63108 - RNA, 20 nt, Human
cgccugaaucaaaagcaguu

SEQ ID NO: 63109 - RNA, 26 nt, Human
uucuaaguucauucagguuguuggcg

SEQ ID NO: 63110 - RNA, 23 nt, Human
acuuucucucucaaacugucuuu

SEQ ID NO: 63111 - RNA, 23 nt, Human
ggugcacuuuuguuucaccaucu

SEQ ID NO: 63112 - RNA, 21 nt, Human
uuaggcucuggcuucugugau

SEQ ID NO: 63113 - RNA, 23 nt, Human
ucuuucuaacuuucuuuacucca

SEQ ID NO: 63114 - RNA, 25 nt, Human
gcuuggggagaaugggggccucuuc

SEQ ID NO: 63115 - RNA, 21 nt, Human
guuuauuuggguacauggccc

SEQ ID NO: 63116 - RNA, 22 nt, Human
gcucuuagaauucuuugcaguu

SEQ ID NO: 63117 - RNA, 22 nt, Human
caccccaagaagugguggggag

SEQ ID NO: 63118 - RNA, 26 nt, Human
uucuccccacuugauuuuucuucuau

SEQ ID NO: 63119 - RNA, 20 nt, Human
acaaagcucaaaguaugcaa

SEQ ID NO: 63120 - RNA, 21 nt, Human
ugggcagccuuuccagccucc

SEQ ID NO: 63121 - RNA, 26 nt, Human
uauuauauacauacugcaucuugguu

SEQ ID NO: 63122 - RNA, 27 nt, Human
ucucaacaauguguaaaggaacuuaag

SEQ ID NO: 63123 - RNA, 24 nt, Human
ugcccagcuuggagugccacgugg

SEQ ID NO: 63124 - RNA, 21 nt, Human
cauuggagagaaagaaaaaga

SEQ ID NO: 63125 - RNA, 23 nt, Human
gcuguucccaacugugcccagcu

SEQ ID NO: 63126 - RNA, 22 nt, Human
ucacuccagaguguucucagcu

SEQ ID NO: 63127 - RNA, 21 nt, Human
cuccccagccugagucuucuc

SEQ ID NO: 63128 - RNA, 23 nt, Human
ccaggcauaaccacagccaagca

SEQ ID NO: 63129 - RNA, 23 nt, Human
ggauggccggagaggaccggcgg

SEQ ID NO: 63130 - RNA, 20 nt, Human
cccgcaccccgauguggacc

SEQ ID NO: 63131 - RNA, 15 nt, Human
cuucccuuugcccca

SEQ ID NO: 63132 - RNA, 26 nt, Human
aggaagagggugaggaagccauaaac

SEQ ID NO: 63133 - RNA, 26 nt, Human
ggcuccugccccuuccugcuuuugca

SEQ ID NO: 63134 - RNA, 20 nt, Human
ggccucggagcaaccacccg

SEQ ID NO: 63135 - RNA, 20 nt, Human
uguggguuucuaagugacac

SEQ ID NO: 63136 - RNA, 22 nt, Human
uucuaccacuggggugcugcug

SEQ ID NO: 63137 - RNA, 26 nt, Human
aggaagagaaaaugggcuaguggaag

SEQ ID NO: 63138 - RNA, 26 nt, Human
aucagagguaucuuacuuuccucuga

SEQ ID NO: 63139 - RNA, 22 nt, Human
ugaacucuugggcucaagugau

SEQ ID NO: 63140 - RNA, 22 nt, Human
agaaauuuggccagauggggaa

SEQ ID NO: 63141 - RNA, 28 nt, Human
aaguucuggcugaacacuggcaacgaca

SEQ ID NO: 63142 - RNA, 24 nt, Human
acaucuguuuaaaaacaagcacaa

SEQ ID NO: 63143 - RNA, 23 nt, Human
gucaugaaagcugccauggggug

SEQ ID NO: 63144 - RNA, 20 nt, Human
gccugcguguaaaccacagc

SEQ ID NO: 63145 - RNA, 28 nt, Human
ucucuggccugcugcucucucaacauca

SEQ ID NO: 63146 - RNA, 28 nt, Human
gccauucgcaccagccaccacccacucc

SEQ ID NO: 63147 - RNA, 24 nt, Human
uacuuaagaucggaaguuaagaga

SEQ ID NO: 63148 - RNA, 24 nt, Human
gcacaggaacuaaaggaaaaagag

SEQ ID NO: 63149 - RNA, 21 nt, Human
uuugguuuugggguguuccug

SEQ ID NO: 63150 - RNA, 27 nt, Human
agguacccgcagggccuagcaagagac

SEQ ID NO: 63151 - RNA, 23 nt, Human
ccuuuugcuauacucacagucuu

SEQ ID NO: 63152 - RNA, 20 nt, Human
uacaugucaauaaaaccacu

SEQ ID NO: 63153 - RNA, 27 nt, Human
uuucccaagcuacuuccuacaguauuu

SEQ ID NO: 63154 - RNA, 20 nt, Human
ugccuccaugguugcuggcc

SEQ ID NO: 63155 - RNA, 26 nt, Human
cccaccccaccugcaggcccagacca

SEQ ID NO: 63156 - RNA, 21 nt, Human
ggggccugcugacugaaggaa

SEQ ID NO: 63157 - RNA, 25 nt, Human
gccugccuuccccaccccagcagug

SEQ ID NO: 63158 - RNA, 24 nt, Human
caggcuggagcgcaguggggugau

SEQ ID NO: 63159 - RNA, 22 nt, Human
uccagaagaaggguuuugauca

SEQ ID NO: 63160 - RNA, 21 nt, Human
gaaaaugugugugaucuuuaa

SEQ ID NO: 63161 - RNA, 21 nt, Human
ucauugggcucccagacgugc

SEQ ID NO: 63162 - RNA, 24 nt, Human
ucugccugcuuuccugccugcccc

SEQ ID NO: 63163 - RNA, 20 nt, Human
aagaccguuuggagguuuca

SEQ ID NO: 63164 - RNA, 21 nt, Human
ccuagaucagcguggcugguc

SEQ ID NO: 63165 - RNA, 21 nt, Human
uuggccucucccaugucucag

SEQ ID NO: 63166 - RNA, 20 nt, Human
gugcucugugccuccugcuc

SEQ ID NO: 63167 - RNA, 25 nt, Human
acuauuuuaagaauguaauugauug

SEQ ID NO: 63168 - RNA, 24 nt, Human
cuccuucuggucauuuucucagcu

SEQ ID NO: 63169 - RNA, 27 nt, Human
gcggggcugugugcugcgaaacaccga

SEQ ID NO: 63170 - RNA, 20 nt, Human
uuguugugauuuucaccugu

SEQ ID NO: 63171 - RNA, 22 nt, Human
gucccauugucagaaauauucu

SEQ ID NO: 63172 - RNA, 29 nt, Human
ugaauccaccuccacaaugccgcucucag

SEQ ID NO: 63173 - RNA, 22 nt, Human
gugcaaccucugcuucccaggu

SEQ ID NO: 63174 - RNA, 27 nt, Human
aagacauggucuggaaauggaugccac

SEQ ID NO: 63175 - RNA, 23 nt, Human
ggcaggacuggggacagguugga

SEQ ID NO: 63176 - RNA, 23 nt, Human
aagucaagagcuaguagaugugu

SEQ ID NO: 63177 - RNA, 22 nt, Human
gugugacuccagccugcccuca

SEQ ID NO: 63178 - RNA, 20 nt, Human
acaaagaaaacaaaccauug

SEQ ID NO: 63179 - RNA, 22 nt, Human
aaaccagacaccgcacaugugu

SEQ ID NO: 63180 - RNA, 20 nt, Human
ugacuuaaaauuggaaaugu

SEQ ID NO: 63181 - RNA, 21 nt, Human
ucgaccucuuuacccauucca

SEQ ID NO: 63182 - RNA, 26 nt, Human
uguggcagaaggcaaaguacaggcca

SEQ ID NO: 63183 - RNA, 21 nt, Human
agccccggcgcggagcaggga

SEQ ID NO: 63184 - RNA, 23 nt, Human
gcaggaaagggagacaaagacug

SEQ ID NO: 63185 - RNA, 26 nt, Human
uuauacauuuuccacuuacaaaaaga

SEQ ID NO: 63186 - RNA, 24 nt, Human
gcucaugccugugauccuagcacu

SEQ ID NO: 63187 - RNA, 25 nt, Human
acaaggcaacuuccuggcuuuuuac

SEQ ID NO: 63188 - RNA, 20 nt, Human
ucuguggucacagugaccuu

SEQ ID NO: 63189 - RNA, 23 nt, Human
ugcucagaagccuccugucucca

SEQ ID NO: 63190 - RNA, 25 nt, Human
ucuuugcagagacaguauuuugcug

SEQ ID NO: 63191 - RNA, 24 nt, Human
acgccugcccagccucgcaugcca

SEQ ID NO: 63192 - RNA, 22 nt, Human
aguggcuagaggugggguggga

SEQ ID NO: 63193 - RNA, 27 nt, Human
ucaagacgaggggcagggaaggacagg

SEQ ID NO: 63194 - RNA, 22 nt, Human
ucacugcagccucgaacuccug

SEQ ID NO: 63195 - RNA, 27 nt, Human
gugccucacucagcuccugcugcucuu

SEQ ID NO: 63196 - RNA, 21 nt, Human
uuccuggacaguuuucugcuu

SEQ ID NO: 63197 - RNA, 26 nt, Human
gucuggcuuuucuccuaucuugcuuc

SEQ ID NO: 63198 - RNA, 21 nt, Human
gagcuaggcuguggaguagag

SEQ ID NO: 63199 - RNA, 21 nt, Human
agcugaaaccucuuuaaaucu

SEQ ID NO: 63200 - RNA, 25 nt, Human
gucgcucaggcuggagugccauggc

SEQ ID NO: 63201 - RNA, 21 nt, Human
ucccuggaaccagaacuugga

SEQ ID NO: 63202 - RNA, 27 nt, Human
cugugugaccucccccaagccaaccac

SEQ ID NO: 63203 - RNA, 26 nt, Human
gcacagcagcaucuucaaacauguac

SEQ ID NO: 63204 - RNA, 21 nt, Human
gcaaucuucugagcacaauau

SEQ ID NO: 63205 - RNA, 20 nt, Human
auuagccuugauauucucca

SEQ ID NO: 63206 - RNA, 23 nt, Human
gggugagccacuggcagugugcu

SEQ ID NO: 63207 - RNA, 22 nt, Human
gucaucucaagaacaaaagaca

SEQ ID NO: 63208 - RNA, 31 nt, Human
gcacugaucaggggcugcacucagacucccu

SEQ ID NO: 63209 - RNA, 22 nt, Human
gcucacaccuguaaucuuaaca

SEQ ID NO: 63210 - RNA, 27 nt, Human
ugucccuugauaacagugacuuaacaa

SEQ ID NO: 63211 - RNA, 28 nt, Human
cugucucuggcccugccgagccuauggg

SEQ ID NO: 63212 - RNA, 25 nt, Human
gcccccaguggacaccagugaaccc

SEQ ID NO: 63213 - RNA, 21 nt, Human
cacucaggcuggaauguagug

SEQ ID NO: 63214 - RNA, 21 nt, Human
aaccuccagucuccgcguuuu

SEQ ID NO: 63215 - RNA, 23 nt, Human
gaccucgugauccacccaccuca

SEQ ID NO: 63216 - RNA, 24 nt, Human
gcccaggcuggagugcaguagugc

SEQ ID NO: 63217 - RNA, 24 nt, Human
acccaaaggaaauagcagugggga

SEQ ID NO: 63218 - RNA, 19 nt, Human
uucuugcuccucuuugugc

SEQ ID NO: 63219 - RNA, 21 nt, Human
uugcccagucugccuguugug

SEQ ID NO: 63220 - RNA, 22 nt, Human
gccuuuuucucccucuuaauau

SEQ ID NO: 63221 - RNA, 17 nt, Human
ucaucuugccagccccu

SEQ ID NO: 63222 - RNA, 25 nt, Human
accaaccaggccuucauccuccucc

SEQ ID NO: 63223 - RNA, 19 nt, Human
agcagauguaccucuguua

SEQ ID NO: 63224 - RNA, 22 nt, Human
cagagccagcgagcaggagcgc

SEQ ID NO: 63225 - RNA, 22 nt, Human
ccuccaaggcuggagugcagug

SEQ ID NO: 63226 - RNA, 25 nt, Human
gcccaggcuggagugcaauggcgug

SEQ ID NO: 63227 - RNA, 25 nt, Human
gcccaggcuagagugcaguggcgug

SEQ ID NO: 63228 - RNA, 21 nt, Human
ugcagaagaugagguauuuua

SEQ ID NO: 63229 - RNA, 22 nt, Human
acuggguggagaaagaauggaa

SEQ ID NO: 63230 - RNA, 21 nt, Human
acuuugucucaucagucuuuu

SEQ ID NO: 63231 - RNA, 22 nt, Human
ugaacucccgaccucagaugau

SEQ ID NO: 63232 - RNA, 22 nt, Human
ugaacucccaaccucaggugau

SEQ ID NO: 63233 - RNA, 22 nt, Human
uggccaccauucaggcuuucca

SEQ ID NO: 63234 - RNA, 18 nt, Human
uacugcuccuacuccagg

SEQ ID NO: 63235 - RNA, 22 nt, Human
ucugagcugcaaggacaagaac

SEQ ID NO: 63236 - RNA, 23 nt, Human
aauucagaggaaugucuucacuu

SEQ ID NO: 63237 - RNA, 27 nt, Human
ugagucaccgcugagagcagcugcagu

SEQ ID NO: 63238 - RNA, 18 nt, Human
caguaauauaauuugcca

SEQ ID NO: 63239 - RNA, 21 nt, Human
uaugucugucucauguguaaa

SEQ ID NO: 63240 - RNA, 18 nt, Human
acauuuuucucuuccuca

SEQ ID NO: 63241 - RNA, 23 nt, Human
cacccccggggaucaagcaacuc

SEQ ID NO: 63242 - RNA, 19 nt, Human
ucucaauaaagaaauuacu

SEQ ID NO: 63243 - RNA, 20 nt, Human
uggauuucaucuuauaucug

SEQ ID NO: 63244 - RNA, 26 nt, Human
gaacauuugcagacguuaugaucuug

SEQ ID NO: 63245 - RNA, 27 nt, Human
aagaggaaggaaugauaauggugacuc

SEQ ID NO: 63246 - RNA, 26 nt, Human
gcccaaaugugauuauuuuaugcaca

SEQ ID NO: 63247 - RNA, 21 nt, Human
cacugcacccggcccuugccu

SEQ ID NO: 63248 - RNA, 24 nt, Human
gcugggagagauggagaagcuaga

SEQ ID NO: 63249 - RNA, 25 nt, Human
cucuggaucuguuccuuggcagugg

SEQ ID NO: 63250 - RNA, 20 nt, Human
cugugaacucacaacucuaa

SEQ ID NO: 63251 - RNA, 20 nt, Human
uuuucugcuuccugaagguu

SEQ ID NO: 63252 - RNA, 24 nt, Human
cccaggaggcagaggguugcagug

SEQ ID NO: 63253 - RNA, 22 nt, Human
cucaauccugggcucaagugau

SEQ ID NO: 63254 - RNA, 27 nt, Human
ggucuccaacuccugcccucaagugau

SEQ ID NO: 63255 - RNA, 19 nt, Human
ugcacacacagguauuuug

SEQ ID NO: 63256 - RNA, 20 nt, Human
uugcacucugaugaccucaa

SEQ ID NO: 63257 - RNA, 21 nt, Human
cccuucagcccaccacccugg

SEQ ID NO: 63258 - RNA, 23 nt, Human
ccccacacuggcggaugaagcag

SEQ ID NO: 63259 - RNA, 19 nt, Human
uaucucaguacuacucuug

SEQ ID NO: 63260 - RNA, 23 nt, Human
cagacagcagcaagccggaucca

SEQ ID NO: 63261 - RNA, 23 nt, Human
caguguugaauucaacugaaggc

SEQ ID NO: 63262 - RNA, 27 nt, Human
guagagcuguggcuaagggcaagcccc

SEQ ID NO: 63263 - RNA, 24 nt, Human
uaggagggagaguagcagagcaug

SEQ ID NO: 63264 - RNA, 27 nt, Human
ucucaacccuuuugucugccucuuaga

SEQ ID NO: 63265 - RNA, 21 nt, Human
ucuuucuccucuuugagaccc

SEQ ID NO: 63266 - RNA, 19 nt, Human
ugaccucaggccggcugug

SEQ ID NO: 63267 - RNA, 29 nt, Human
uugaaaagaagguuggagugcagcuugaa

SEQ ID NO: 63268 - RNA, 23 nt, Human
aacccugucucaaaaaagaaaga

SEQ ID NO: 63269 - RNA, 18 nt, Human
ccuuagccccaucugcca

SEQ ID NO: 63270 - RNA, 21 nt, Human
ggcucacugcaaccucugccc

SEQ ID NO: 63271 - RNA, 21 nt, Human
ggcucacugcaaucucugccu

SEQ ID NO: 63272 - RNA, 23 nt, Human
uucaucuugagccugagccuuag

SEQ ID NO: 63273 - RNA, 25 nt, Human
ccugggcuuccuuuuucccugccua

SEQ ID NO: 63274 - RNA, 20 nt, Human
accugcuggccucugccugu

SEQ ID NO: 63275 - RNA, 26 nt, Human
cuguugacuuuguaucucugccugug

SEQ ID NO: 63276 - RNA, 20 nt, Human
auucucugaacccacugugg

SEQ ID NO: 63277 - RNA, 27 nt, Human
gcuguguaaccuugaacuacacaauuc

SEQ ID NO: 63278 - RNA, 22 nt, Human
cgccucucuaguucaagcgauu

SEQ ID NO: 63279 - RNA, 20 nt, Human
ggggcucaaacuuaacucca

SEQ ID NO: 63280 - RNA, 22 nt, Human
gggccuagaucacuggugugau

SEQ ID NO: 63281 - RNA, 21 nt, Human
cacaccagcagagacagaaac

SEQ ID NO: 63282 - RNA, 23 nt, Human
aagccuucccgcagcggagagau

SEQ ID NO: 63283 - RNA, 24 nt, Human
uacacuggaacaccuucuucuuuu

SEQ ID NO: 63284 - RNA, 20 nt, Human
ugagugugugcucuguguca

SEQ ID NO: 63285 - RNA, 27 nt, Human
gagggacuggaguuccaggcagaggga

SEQ ID NO: 63286 - RNA, 20 nt, Human
uuuaaggccuuuuguuguau

SEQ ID NO: 63287 - RNA, 20 nt, Human
gugucaaggagcaggcucca

SEQ ID NO: 63288 - RNA, 26 nt, Human
gggcgacagagacccugucucaaaaa

SEQ ID NO: 63289 - RNA, 24 nt, Human
gccacauuugcaaccuuggccauc

SEQ ID NO: 63290 - RNA, 23 nt, Human
cccuccaggagaucccagggugc

SEQ ID NO: 63291 - RNA, 30 nt, Human
ccugguuucuucuccucuaucucauaaugc

SEQ ID NO: 63292 - RNA, 22 nt, Human
acacagcccuggaaacauacag

SEQ ID NO: 63293 - RNA, 23 nt, Human
ugucuaaauuugaauguuaagca

SEQ ID NO: 63294 - RNA, 21 nt, Human
ucacuuacaccagcugcucug

SEQ ID NO: 63295 - RNA, 22 nt, Human
uauuuuaucugugugugcucag

SEQ ID NO: 63296 - RNA, 16 nt, Human
gugcuuguaaugcuca

SEQ ID NO: 63297 - RNA, 21 nt, Human
aaaagcaccuguucuccaucu

SEQ ID NO: 63298 - RNA, 19 nt, Human
aggaaaggaaaaaagggca

SEQ ID NO: 63299 - RNA, 21 nt, Human
ugugagccugcaagggagccc

SEQ ID NO: 63300 - RNA, 18 nt, Human
ucacaugcuaaagccagg

SEQ ID NO: 63301 - RNA, 21 nt, Human
ugacaucagcuggcugugaug

SEQ ID NO: 63302 - RNA, 18 nt, Human
cacugcacuccugggcaa

SEQ ID NO: 63303 - RNA, 21 nt, Human
uccaguaacacagcaucauca

SEQ ID NO: 63304 - RNA, 23 nt, Human
agcaugggcaguuucaguuucag

SEQ ID NO: 63305 - RNA, 26 nt, Human
ggcccaggaguuugaggcugcaguga

SEQ ID NO: 63306 - RNA, 22 nt, Human
guugucauugcuccugcagccu

SEQ ID NO: 63307 - RNA, 25 nt, Human
uacuguuccagacuuuuaaagggga

SEQ ID NO: 63308 - RNA, 22 nt, Human
ucaccuaggcuggagugcagug

SEQ ID NO: 63309 - RNA, 20 nt, Human
uuuccaaauaagugcauuua

SEQ ID NO: 63310 - RNA, 20 nt, Human
ggagcugugggaggaaacgc

SEQ ID NO: 63311 - RNA, 21 nt, Human
ucgcacggccacaggggcgca

SEQ ID NO: 63312 - RNA, 18 nt, Human
ugaauucuggcuguggug

SEQ ID NO: 63313 - RNA, 23 nt, Human
gcuguauuaucagcacagcaaau

SEQ ID NO: 63314 - RNA, 20 nt, Human
auccugaacuguuacuccaa

SEQ ID NO: 63315 - RNA, 27 nt, Human
uuuucucacccagugcauguggcagga

SEQ ID NO: 63316 - RNA, 20 nt, Human
gagccccagccagggcagcu

SEQ ID NO: 63317 - RNA, 21 nt, Human
uaaccagcaacauugacccag

SEQ ID NO: 63318 - RNA, 22 nt, Human
cucugggugguuaugagccucc

SEQ ID NO: 63319 - RNA, 22 nt, Human
ggcaggguccucuucuuuuccc

SEQ ID NO: 63320 - RNA, 22 nt, Human
cccugcucucucugcucagaac

SEQ ID NO: 63321 - RNA, 27 nt, Human
cacaggaacccuaaagcaaaucugcca

SEQ ID NO: 63322 - RNA, 22 nt, Human
aaauauguugccaaaauuuauu

SEQ ID NO: 63323 - RNA, 32 nt, Human
uuggcaucuagagcuugaugccaguaggcuca

SEQ ID NO: 63324 - RNA, 27 nt, Human
cgggcuucauuuucucuauuuagagau

SEQ ID NO: 63325 - RNA, 23 nt, Human
gagaggaugguacagaucaaaga

SEQ ID NO: 63326 - RNA, 23 nt, Human
guccccacucuuuccaucagccc

SEQ ID NO: 63327 - RNA, 20 nt, Human
aggucugcgggguccuggcc

SEQ ID NO: 63328 - RNA, 21 nt, Human
cucagccacucugggaggugg

SEQ ID NO: 63329 - RNA, 20 nt, Human
gcgaugccacccggugccga

SEQ ID NO: 63330 - RNA, 21 nt, Human
gagaagcaguuuucacaguga

SEQ ID NO: 63331 - RNA, 22 nt, Human
augccccagccccuguaccacc

SEQ ID NO: 63332 - RNA, 27 nt, Human
cccaaaugcuggcuggccuuguggucc

SEQ ID NO: 63333 - RNA, 20 nt, Human
gcccaggcuggggacagagc

SEQ ID NO: 63334 - RNA, 27 nt, Human
gucccagaagucacuguauuuuugaaa

SEQ ID NO: 63335 - RNA, 22 nt, Human
uaaaagaugcaguaaucuucca

SEQ ID NO: 63336 - RNA, 27 nt, Human
uacaagugugucccaacacaguccugg

SEQ ID NO: 63337 - RNA, 20 nt, Human
gaggaagcagaggcagaugg

SEQ ID NO: 63338 - RNA, 23 nt, Human
gcagaaagaagccagggugugca

SEQ ID NO: 63339 - RNA, 26 nt, Human
gcuguccugaauccuagauaccaguu

SEQ ID NO: 63340 - RNA, 21 nt, Human
cacccaggcuggagugcagug

SEQ ID NO: 63341 - RNA, 21 nt, Human
cacccaggcuagagugcaaug

SEQ ID NO: 63342 - RNA, 21 nt, Human
cugacccaggcuggaggacag

SEQ ID NO: 63343 - RNA, 25 nt, Human
cauuuucauguuaaugagaauuucc

SEQ ID NO: 63344 - RNA, 26 nt, Human
uggcguggccuuaucgauugcagugg

SEQ ID NO: 63345 - RNA, 22 nt, Human
ggugccauuagcagaauuugcc

SEQ ID NO: 63346 - RNA, 25 nt, Human
cugccccugcccugccugggaccca

SEQ ID NO: 63347 - RNA, 25 nt, Human
cgggcaccuguaaucccagcuacuu

SEQ ID NO: 63348 - RNA, 21 nt, Human
gccuuguuuucugucaagaca

SEQ ID NO: 63349 - RNA, 16 nt, Human
ugaauguuaagcagaa

SEQ ID NO: 63350 - RNA, 21 nt, Human
ucuacuucuugaacagugguc

SEQ ID NO: 63351 - RNA, 24 nt, Human
ggcucagaagguugggcugugggg

SEQ ID NO: 63352 - RNA, 23 nt, Human
agccuccccagucaucuaggauu

SEQ ID NO: 63353 - RNA, 21 nt, Human
aggaggaauauggaauccaag

SEQ ID NO: 63354 - RNA, 23 nt, Human
ggcaggagaauagccugaaccug

SEQ ID NO: 63355 - RNA, 23 nt, Human
augcucacaauaaaaaagcaguu

SEQ ID NO: 63356 - RNA, 25 nt, Human
uguucccucucagauuguaccauug

SEQ ID NO: 63357 - RNA, 23 nt, Human
gggccucaccugcuggagucuuc

SEQ ID NO: 63358 - RNA, 21 nt, Human
ugucucucccccgcugccauu

SEQ ID NO: 63359 - RNA, 22 nt, Human
gcgcuagcagggcugaagagaa

SEQ ID NO: 63360 - RNA, 21 nt, Human
agaguggaagcaggugugaga

SEQ ID NO: 63361 - RNA, 22 nt, Human
uuugaaacuuaaaacucuuaga

SEQ ID NO: 63362 - RNA, 23 nt, Human
ucucugguccaucuugggcauua

SEQ ID NO: 63363 - RNA, 22 nt, Human
ccuucuccuuauaaauaaguuc

SEQ ID NO: 63364 - RNA, 20 nt, Human
ccugggagagaggguacuga

SEQ ID NO: 63365 - RNA, 22 nt, Human
gggcuucaugguuucugcucag

SEQ ID NO: 63366 - RNA, 22 nt, Human
gcuuuuauuuagaaaaugucug

SEQ ID NO: 63367 - RNA, 23 nt, Human
cguaagcugaagcacugggugaa

SEQ ID NO: 63368 - RNA, 27 nt, Human
guugccugucaaaggcuggagggcagg

SEQ ID NO: 63369 - RNA, 21 nt, Human
caguaaugcaagggcauuuca

SEQ ID NO: 63370 - RNA, 23 nt, Human
cagaugaaccaaaaauguauuua

SEQ ID NO: 63371 - RNA, 25 nt, Human
gguguugggauacugcagggccagg

SEQ ID NO: 63372 - RNA, 21 nt, Human
uacucugcucccuagucccag

SEQ ID NO: 63373 - RNA, 18 nt, Human
uguggaaugauucacauc

SEQ ID NO: 63374 - RNA, 18 nt, Human
ccuggcuuccuuagcuug

SEQ ID NO: 63375 - RNA, 22 nt, Human
ccugcugcugcucucccuggac

SEQ ID NO: 63376 - RNA, 22 nt, Human
cagagacuccuaguugagugau

SEQ ID NO: 63377 - RNA, 18 nt, Human
ccgcuguuaccucuuguu

SEQ ID NO: 63378 - RNA, 27 nt, Human
cccaggaguuugaggcugcagugagcu

SEQ ID NO: 63379 - RNA, 18 nt, Human
ccccugcccugccgcugc

SEQ ID NO: 63380 - RNA, 22 nt, Human
uggaauccauguaaaacucucu

SEQ ID NO: 63381 - RNA, 27 nt, Human
ucaucccuugugccgcaggcugggcgg

SEQ ID NO: 63382 - RNA, 22 nt, Human
ccaacccaacucaauaaaaaau

SEQ ID NO: 63383 - RNA, 23 nt, Human
ugcagcccaggcuggagugcagu

SEQ ID NO: 63384 - RNA, 31 nt, Human
ccuggggcugccucugcucuccaagacccaa

SEQ ID NO: 63385 - RNA, 24 nt, Human
cuccugaggaccucucugucagcu

SEQ ID NO: 63386 - RNA, 22 nt, Human
ucauuaaaucuguaaaucaccu

SEQ ID NO: 63387 - RNA, 22 nt, Human
ucugauugcaccacugcacucc

SEQ ID NO: 63388 - RNA, 22 nt, Human
uuacaacugaguugauauucua

SEQ ID NO: 63389 - RNA, 23 nt, Human
uagauuaaaauauccuuucauca

SEQ ID NO: 63390 - RNA, 22 nt, Human
ccaaaaacaagcaaaaccaaag

SEQ ID NO: 63391 - RNA, 20 nt, Human
gucucugagucccaaaaaga

SEQ ID NO: 63392 - RNA, 21 nt, Human
cuuuagccaggcacaggacag

SEQ ID NO: 63393 - RNA, 21 nt, Human
ucugccuucuuccaggaucag

SEQ ID NO: 63394 - RNA, 24 nt, Human
ccaggaucauucuuccccuccucc

SEQ ID NO: 63395 - RNA, 24 nt, Human
gaaggaaauuggaaagcccgccuc

SEQ ID NO: 63396 - RNA, 25 nt, Human
aggucugugcucuggagccagggua

SEQ ID NO: 63397 - RNA, 23 nt, Human
cucagccucccaaguagugugaa

SEQ ID NO: 63398 - RNA, 21 nt, Human
gaacucugggaaggagguugu

SEQ ID NO: 63399 - RNA, 20 nt, Human
agaagaaauugucugcugcc

SEQ ID NO: 63400 - RNA, 26 nt, Human
uccaccccagccugcugcugcuacug

SEQ ID NO: 63401 - RNA, 30 nt, Human
cgcagccgccgccuccuccgcgccgcgcuc

SEQ ID NO: 63402 - RNA, 19 nt, Human
cuucauccccauccugggc

SEQ ID NO: 63403 - RNA, 22 nt, Human
uuuuccauguugcccaggcugg

SEQ ID NO: 63404 - RNA, 22 nt, Human
uacccaggcuggagugcaaugg

SEQ ID NO: 63405 - RNA, 24 nt, Human
cuuucagcacccccacuccauucc

SEQ ID NO: 63406 - RNA, 22 nt, Human
caggaaggaugagucugaucug

SEQ ID NO: 63407 - RNA, 22 nt, Human
agaccagccugggcaacauggc

SEQ ID NO: 63408 - RNA, 23 nt, Human
agagcaaggaacauguaauugca

SEQ ID NO: 63409 - RNA, 23 nt, Human
cggccucuccccuguugcugccc

SEQ ID NO: 63410 - RNA, 21 nt, Human
aagaggccucugugcccagcc

SEQ ID NO: 63411 - RNA, 27 nt, Human
ggcucggaagacaaaccccacacacac

SEQ ID NO: 63412 - RNA, 25 nt, Human
acagaggcauucugguaaaugaagc

SEQ ID NO: 63413 - RNA, 24 nt, Human
cgccugaggucaggaguucaagac

SEQ ID NO: 63414 - RNA, 21 nt, Human
uggccagacuguucuguaggu

SEQ ID NO: 63415 - RNA, 23 nt, Human
aacacugagcaggcacucgguaa

SEQ ID NO: 63416 - RNA, 21 nt, Human
uaggaagaggaagguauggcg

SEQ ID NO: 63417 - RNA, 24 nt, Human
ucuccuacuccauccaguccugag

SEQ ID NO: 63418 - RNA, 26 nt, Human
ccacucacuccagcccaacagaagga

SEQ ID NO: 63419 - RNA, 27 nt, Human
ccaacuugguguaacuuaagcuuucau

SEQ ID NO: 63420 - RNA, 20 nt, Human
cggagcccacacugccaccu

SEQ ID NO: 63421 - RNA, 27 nt, Human
ccucugccucuguuuaauaaggauccu

SEQ ID NO: 63422 - RNA, 24 nt, Human
uguugauaauucuguuauuuacau

SEQ ID NO: 63423 - RNA, 27 nt, Human
ggauagguuuuuaugggaauucuuuac

SEQ ID NO: 63424 - RNA, 22 nt, Human
cacagaggucaggaagcagggg

SEQ ID NO: 63425 - RNA, 27 nt, Human
cuuccagcugcuaucaugguauucuca

SEQ ID NO: 63426 - RNA, 25 nt, Human
cuccuguggccucugcuuguacaga

SEQ ID NO: 63427 - RNA, 24 nt, Human
guaauuugcauguuuuguggagca

SEQ ID NO: 63428 - RNA, 21 nt, Human
ucaccuucaguuucuggagcu

SEQ ID NO: 63429 - RNA, 20 nt, Human
agccaguacaccagagccag

SEQ ID NO: 63430 - RNA, 21 nt, Human
cuuugggacuugggagcuggg

SEQ ID NO: 63431 - RNA, 22 nt, Human
gucgcucaggcuggagugccau

SEQ ID NO: 63432 - RNA, 26 nt, Human
aagagugcugagaaauggcucuguau

SEQ ID NO: 63433 - RNA, 24 nt, Human
gcugugugcagaagucuggaaacc

SEQ ID NO: 63434 - RNA, 22 nt, Human
aguggugcuaucuuggcucacu

SEQ ID NO: 63435 - RNA, 21 nt, Human
ucggcagcugugccucuacug

SEQ ID NO: 63436 - RNA, 26 nt, Human
ggagguaaggaagagucuggugggga

SEQ ID NO: 63437 - RNA, 22 nt, Human
gucaggggacauaauggccucc

SEQ ID NO: 63438 - RNA, 22 nt, Human
agagacaaccggcagugaccuc

SEQ ID NO: 63439 - RNA, 19 nt, Human
uagcaguugcucacauguc

SEQ ID NO: 63440 - RNA, 22 nt, Human
ugcuaagaaauguuaucuuuua

SEQ ID NO: 63441 - RNA, 20 nt, Human
uuuucacugcuaauaauucu

SEQ ID NO: 63442 - RNA, 25 nt, Human
acucuucuuaucacacuugcaaaug

SEQ ID NO: 63443 - RNA, 21 nt, Human
ugggugaggaagcagagcucu

SEQ ID NO: 63444 - RNA, 26 nt, Human
ucucuagccuugucacugucucccug

SEQ ID NO: 63445 - RNA, 21 nt, Human
cgacagcauuaaagacugaug

SEQ ID NO: 63446 - RNA, 25 nt, Human
cacgaagccgccugacggcacccag

SEQ ID NO: 63447 - RNA, 26 nt, Human
ggaggcgguagugacgguggcguuuc

SEQ ID NO: 63448 - RNA, 27 nt, Human
ucucagcccauggccggucagccacac

SEQ ID NO: 63449 - RNA, 20 nt, Human
gugauuaaaggccucugccu

SEQ ID NO: 63450 - RNA, 27 nt, Human
cuugcagagcgugucuauuacaagaug

SEQ ID NO: 63451 - RNA, 23 nt, Human
gcagcucaggcuggcaccgcugu

SEQ ID NO: 63452 - RNA, 26 nt, Human
gaaggcuggggcagaucacuucaagc

SEQ ID NO: 63453 - RNA, 21 nt, Human
uaauuuacccauuucuauaca

SEQ ID NO: 63454 - RNA, 27 nt, Human
uuuaaggagcucccaaaauguguuacc

SEQ ID NO: 63455 - RNA, 22 nt, Human
ccaucaguucaccuugugucau

SEQ ID NO: 63456 - RNA, 22 nt, Human
agcugcuaccccuacaucaucu

SEQ ID NO: 63457 - RNA, 24 nt, Human
cccuaaguaaucccagaacaaugg

SEQ ID NO: 63458 - RNA, 23 nt, Human
ccacaagaauucacaggucucaa

SEQ ID NO: 63459 - RNA, 22 nt, Human
aucugaaaauaaagugucaucc

SEQ ID NO: 63460 - RNA, 19 nt, Human
cugagcuugguucaucugc

SEQ ID NO: 63461 - RNA, 20 nt, Human
uacaauaaagucuuaccuca

SEQ ID NO: 63462 - RNA, 27 nt, Human
gucucaaacuccccagcuaaagcaguc

SEQ ID NO: 63463 - RNA, 26 nt, Human
ccuguucugaaaauguuguuaugcua

SEQ ID NO: 63464 - RNA, 22 nt, Human
uuggccaggcuggagugcagua

SEQ ID NO: 63465 - RNA, 21 nt, Human
ucuuucuccucccacaggguc

SEQ ID NO: 63466 - RNA, 20 nt, Human
gcagcccaguccagccuugc

SEQ ID NO: 63467 - RNA, 22 nt, Human
uuccaaagaacuccaccaggaa

SEQ ID NO: 63468 - RNA, 21 nt, Human
cccuaucucucacucuggacc

SEQ ID NO: 63469 - RNA, 26 nt, Human
gcaaauagaaaucagcacauuccucc

SEQ ID NO: 63470 - RNA, 21 nt, Human
accugccauugccuccucucc

SEQ ID NO: 63471 - RNA, 22 nt, Human
ccaggcacaaggcaucuuguug

SEQ ID NO: 63472 - RNA, 30 nt, Human
ugaggaucuguguuuggugaaaaggagcca

SEQ ID NO: 63473 - RNA, 27 nt, Human
uaauuuaugcauuugaagccaguguga

SEQ ID NO: 63474 - RNA, 19 nt, Human
acucaggaagcugggggug

SEQ ID NO: 63475 - RNA, 24 nt, Human
uucaggauaugaacacagguacag

SEQ ID NO: 63476 - RNA, 21 nt, Human
gcuggagugaggaguagaggu

SEQ ID NO: 63477 - RNA, 22 nt, Human
cccuggaugcgcuaacauucac

SEQ ID NO: 63478 - RNA, 21 nt, Human
ccauguuccucuccauccuag

SEQ ID NO: 63479 - RNA, 27 nt, Human
gaaagagaucagguuuccagagcugag

SEQ ID NO: 63480 - RNA, 19 nt, Human
acucaaggaguugguaaag

SEQ ID NO: 63481 - RNA, 27 nt, Human
cuccugaccucaugaucugcccgccuc

SEQ ID NO: 63482 - RNA, 23 nt, Human
cauccuaaaagcaccacagcaga

SEQ ID NO: 63483 - RNA, 23 nt, Human
guagagaauuuggaaacuguaga

SEQ ID NO: 63484 - RNA, 24 nt, Human
ucauuugugcagauucugcccuca

SEQ ID NO: 63485 - RNA, 20 nt, Human
guuuuuaaagaguuuuugua

SEQ ID NO: 63486 - RNA, 21 nt, Human
gcucacuggccccgcuugucu

SEQ ID NO: 63487 - RNA, 20 nt, Human
gucuucuccccagccccguc

SEQ ID NO: 63488 - RNA, 17 nt, Human
uuguccugccuucucca

SEQ ID NO: 63489 - RNA, 26 nt, Human
ugggccuggccucuguaagccugugu

SEQ ID NO: 63490 - RNA, 18 nt, Human
ugcagaagcaagugcuca

SEQ ID NO: 63491 - RNA, 23 nt, Human
uaguucugccuauuguccuuccc

SEQ ID NO: 63492 - RNA, 27 nt, Human
uggcugagagaguggcauuggcagcag

SEQ ID NO: 63493 - RNA, 27 nt, Human
acagagcagaggagggagaagcucugg

SEQ ID NO: 63494 - RNA, 21 nt, Human
guuugagaagaaaacaucuau

SEQ ID NO: 63495 - RNA, 27 nt, Human
acugcaaccucgccucccugguucaag

SEQ ID NO: 63496 - RNA, 23 nt, Human
accaaaguaaccuuuugcaccug

SEQ ID NO: 63497 - RNA, 27 nt, Human
ugugacuacagagaugucccaguaugu

SEQ ID NO: 63498 - RNA, 23 nt, Human
ccaccuggaccuacccuccagcc

SEQ ID NO: 63499 - RNA, 26 nt, Human
ggcucagagcauaaggcuucagggcc

SEQ ID NO: 63500 - RNA, 22 nt, Human
uucacacacaccggcacuuuca

SEQ ID NO: 63501 - RNA, 30 nt, Human
ggggucuucuaccucagacacucugacuac

SEQ ID NO: 63502 - RNA, 20 nt, Human
cuccccgaggugcagcugcc

SEQ ID NO: 63503 - RNA, 27 nt, Human
acugcagccucgaccuccuggacucag

SEQ ID NO: 63504 - RNA, 27 nt, Human
auccuugcccaucgggaccagaaaccu

SEQ ID NO: 63505 - RNA, 27 nt, Human
cacugcacuccagccuggugacuccgu

SEQ ID NO: 63506 - RNA, 22 nt, Human
gcggugccacccaaucaugccc

SEQ ID NO: 63507 - RNA, 31 nt, Human
ucccucuuuuccccuccccaggagaaaaaga

SEQ ID NO: 63508 - RNA, 24 nt, Human
gcuugcuccgcgccacugcccgcc

SEQ ID NO: 63509 - RNA, 20 nt, Human
ccagugaucuguaauuugua

SEQ ID NO: 63510 - RNA, 22 nt, Human
ggacuugcccaucuagcacuuu

SEQ ID NO: 63511 - RNA, 27 nt, Human
gccugugcccuuuucucagacccggaa

SEQ ID NO: 63512 - RNA, 26 nt, Human
gacucacgccuguaaucccaacauuu

SEQ ID NO: 63513 - RNA, 21 nt, Human
ucucacacgccccaacccagc

SEQ ID NO: 63514 - RNA, 17 nt, Human
acuguucagaagcacaa

SEQ ID NO: 63515 - RNA, 21 nt, Human
ugaaacacucgugugcaugag

SEQ ID NO: 63516 - RNA, 19 nt, Human
uaucaaggagcucuucuag

SEQ ID NO: 63517 - RNA, 22 nt, Human
aagcaagucuauaaauaucggc

SEQ ID NO: 63518 - RNA, 20 nt, Human
ucaugccucuccucuguggc

SEQ ID NO: 63519 - RNA, 27 nt, Human
aagacccuggcuuucauuuucucucag

SEQ ID NO: 63520 - RNA, 18 nt, Human
cuggaaagaguugcugac

SEQ ID NO: 63521 - RNA, 19 nt, Human
uucucucuccuuuugcuua

SEQ ID NO: 63522 - RNA, 19 nt, Human
gugcaguuagggcugggaa

SEQ ID NO: 63523 - RNA, 21 nt, Human
ucccaacagcauuacugcagg

SEQ ID NO: 63524 - RNA, 25 nt, Human
gaccagagcaggggaguuuuuaaaa

SEQ ID NO: 63525 - RNA, 26 nt, Human
ccugccuggauuucuuccuauuaggc

SEQ ID NO: 63526 - RNA, 29 nt, Human
ccucuuucuccggcucccugccccuccag

SEQ ID NO: 63527 - RNA, 21 nt, Human
uucagucuuuuuacuguguuu

SEQ ID NO: 63528 - RNA, 19 nt, Human
gggagucuuggccaaggaa

SEQ ID NO: 63529 - RNA, 23 nt, Human
gauacacaccaauaucuucuuca

SEQ ID NO: 63530 - RNA, 22 nt, Human
agcauuuuuauucaugccaucu

SEQ ID NO: 63531 - RNA, 21 nt, Human
ucuucucucaauuacauagca

SEQ ID NO: 63532 - RNA, 25 nt, Human
guauuguuugcuuuuuauguugacc

SEQ ID NO: 63533 - RNA, 21 nt, Human
ggacucgggaucuucaucggg

SEQ ID NO: 63534 - RNA, 29 nt, Human
auuugggaaggaauggaagauggacacca

SEQ ID NO: 63535 - RNA, 22 nt, Human
gcuccuuccuccccuguucauu

SEQ ID NO: 63536 - RNA, 20 nt, Human
ggagaugggguaagaagagc

SEQ ID NO: 63537 - RNA, 23 nt, Human
uugcaauuuugcauagcuuucca

SEQ ID NO: 63538 - RNA, 23 nt, Human
uugcauaggacuuucugucuuuu

SEQ ID NO: 63539 - RNA, 24 nt, Human
ugccuaacugaucuuccaaaguga

SEQ ID NO: 63540 - RNA, 22 nt, Human
gcucagcuacuucuccugcacu

SEQ ID NO: 63541 - RNA, 20 nt, Human
ggcgggcuggcucuuuugca

SEQ ID NO: 63542 - RNA, 24 nt, Human
gggagggagagaagagggggcuaa

SEQ ID NO: 63543 - RNA, 26 nt, Human
ucuuucuccuuuccuucuccaaaggc

SEQ ID NO: 63544 - RNA, 21 nt, Human
ggaagagggagauggagacug

SEQ ID NO: 63545 - RNA, 30 nt, Human
cccuccuggcccuccaaggcggggggacac

SEQ ID NO: 63546 - RNA, 26 nt, Human
uugccucuguccgugccccuucccug

SEQ ID NO: 63547 - RNA, 23 nt, Human
cuuugugaaauuagcacuuuugg

SEQ ID NO: 63548 - RNA, 22 nt, Human
ccauuaaauccgcaaacagcca

SEQ ID NO: 63549 - RNA, 23 nt, Human
agugcuuugcuggaguccuguuc

SEQ ID NO: 63550 - RNA, 24 nt, Human
gggugucugcgugaaugagcgugg

SEQ ID NO: 63551 - RNA, 22 nt, Human
ugcagugagcucucauugggcc

SEQ ID NO: 63552 - RNA, 27 nt, Human
agucaucugaugagaacaagcuauuug

SEQ ID NO: 63553 - RNA, 26 nt, Human
auccgccaagcuucgguucucagccu

SEQ ID NO: 63554 - RNA, 27 nt, Human
ugcagugaaccaagauugcaccacugc

SEQ ID NO: 63555 - RNA, 22 nt, Human
gggccuuuuuaguuggcuacug

SEQ ID NO: 63556 - RNA, 26 nt, Human
acaaacuauuucagaauauuuuguaa

SEQ ID NO: 63557 - RNA, 24 nt, Human
aauucuguuuacaugaaaugggga

SEQ ID NO: 63558 - RNA, 22 nt, Human
auuuuaauuuuuaaaugcaguu

SEQ ID NO: 63559 - RNA, 23 nt, Human
agagagaguuguuuuaauaacuu

SEQ ID NO: 63560 - RNA, 22 nt, Human
aaccucuggcuaaucgggccau

SEQ ID NO: 63561 - RNA, 20 nt, Human
uccaucucaaaaacaaaaca

SEQ ID NO: 63562 - RNA, 19 nt, Human
uuagaucucugaagccaca

SEQ ID NO: 63563 - RNA, 22 nt, Human
ugugugccugcagcuguguagu

SEQ ID NO: 63564 - RNA, 22 nt, Human
ugggauuacuggcaugagccac

SEQ ID NO: 63565 - RNA, 25 nt, Human
cccucugacccucaggcuuucccag

SEQ ID NO: 63566 - RNA, 22 nt, Human
ucugcuuacaauucccugcugu

SEQ ID NO: 63567 - RNA, 25 nt, Human
ccuccaucugccugagacgccuauu

SEQ ID NO: 63568 - RNA, 25 nt, Human
caacacugagcaaguaugcugugga

SEQ ID NO: 63569 - RNA, 19 nt, Human
aacagcauuucuguccuga

SEQ ID NO: 63570 - RNA, 23 nt, Human
ccaucaugcagaggugguugugg

SEQ ID NO: 63571 - RNA, 22 nt, Human
guucuuauagaaaggacacaag

SEQ ID NO: 63572 - RNA, 26 nt, Human
ugggagccagggugagagucuggguc

SEQ ID NO: 63573 - RNA, 21 nt, Human
gccccaacaugccugcaccug

SEQ ID NO: 63574 - RNA, 27 nt, Human
acccuugcccaguccacccagucacau

SEQ ID NO: 63575 - RNA, 25 nt, Human
ccuggcuccuggcccgagccugggc

SEQ ID NO: 63576 - RNA, 20 nt, Human
uggcugcugugacuccuacc

SEQ ID NO: 63577 - RNA, 27 nt, Human
agccucccaccgucuuccuccuacaca

SEQ ID NO: 63578 - RNA, 21 nt, Human
uagaagccugcauaauguuuc

SEQ ID NO: 63579 - RNA, 22 nt, Human
uggcgcauaccuguaaucccag

SEQ ID NO: 63580 - RNA, 23 nt, Human
aacuguuucccuuugauucucca

SEQ ID NO: 63581 - RNA, 19 nt, Human
ccccacaccuggcccuggg

SEQ ID NO: 63582 - RNA, 24 nt, Human
cacuggcaggaagcagagauaaga

SEQ ID NO: 63583 - RNA, 20 nt, Human
ggccgcugccacccaccucc

SEQ ID NO: 63584 - RNA, 21 nt, Human
ccagcaaugugaacuguauuu

SEQ ID NO: 63585 - RNA, 22 nt, Human
caugucaggaaccuauggcugg

SEQ ID NO: 63586 - RNA, 20 nt, Human
uucaaauuauuaauaaaugg

SEQ ID NO: 63587 - RNA, 27 nt, Human
uagcucuuccuccccaggacuuggucu

SEQ ID NO: 63588 - RNA, 24 nt, Human
ugccccgaucugcccgaaccuucu

SEQ ID NO: 63589 - RNA, 23 nt, Human
agcagagggcagcacuuccucca

SEQ ID NO: 63590 - RNA, 26 nt, Human
ucauugccgacacugcagcagaaucu

SEQ ID NO: 63591 - RNA, 26 nt, Human
gcagcugaugaagggagcucaggaga

SEQ ID NO: 63592 - RNA, 20 nt, Human
uugcucuggcuuccuuucau

SEQ ID NO: 63593 - RNA, 20 nt, Human
cucccaagacuaucuugaag

SEQ ID NO: 63594 - RNA, 22 nt, Human
gucacucuguaguuacuguggu

SEQ ID NO: 63595 - RNA, 26 nt, Human
ugucaccuccacuugcuccccgacag

SEQ ID NO: 63596 - RNA, 21 nt, Human
aaaugaaccucucuuauugau

SEQ ID NO: 63597 - RNA, 22 nt, Human
uggucucaaacuccugaccuga

SEQ ID NO: 63598 - RNA, 26 nt, Human
uccucgggggccuggggaaccgcgcg

SEQ ID NO: 63599 - RNA, 24 nt, Human
cauucuauuugcacagguucccug

SEQ ID NO: 63600 - RNA, 26 nt, Human
uauccugagacuguuuauagcuuaaa

SEQ ID NO: 63601 - RNA, 24 nt, Human
agucaucugacauuaaaucauuua

SEQ ID NO: 63602 - RNA, 21 nt, Human
cccagcacuuuuggaggcuga

SEQ ID NO: 63603 - RNA, 20 nt, Human
auucuacacauaucuuguua

SEQ ID NO: 63604 - RNA, 26 nt, Human
gggaggagaaggagagguuauaccuu

SEQ ID NO: 63605 - RNA, 23 nt, Human
uuuggucuucuguugacauucgg

SEQ ID NO: 63606 - RNA, 20 nt, Human
uuugccuccccaucuggugc

SEQ ID NO: 63607 - RNA, 27 nt, Human
gccaccuuugcugucuugucuccuggg

SEQ ID NO: 63608 - RNA, 25 nt, Human
aacugauuuccuuuuuaguccucua

SEQ ID NO: 63609 - RNA, 28 nt, Human
cucuccuuuccuccucccccucggagcc

SEQ ID NO: 63610 - RNA, 26 nt, Human
cuccugaguccuuaauucugccuaaa

SEQ ID NO: 63611 - RNA, 23 nt, Human
ccauugucccaaagucuagaguc

SEQ ID NO: 63612 - RNA, 23 nt, Human
gcccuguggcuccccacacccug

SEQ ID NO: 63613 - RNA, 27 nt, Human
ggcucacugcaggcaugcugaacaagg

SEQ ID NO: 63614 - RNA, 27 nt, Human
caugcagcagagggcagaaggcuugca

SEQ ID NO: 63615 - RNA, 26 nt, Human
aggcuggagagaagccguggugguga

SEQ ID NO: 63616 - RNA, 26 nt, Human
ccagccugaagagcgagacucugucu

SEQ ID NO: 63617 - RNA, 23 nt, Human
ccucaagugauucuccugccuca

SEQ ID NO: 63618 - RNA, 22 nt, Human
gcuuucucacauucggucuacu

SEQ ID NO: 63619 - RNA, 27 nt, Human
ugcccuucuucacacagacacuaacga

SEQ ID NO: 63620 - RNA, 27 nt, Human
gcugccucuugagcagccucgugccug

SEQ ID NO: 63621 - RNA, 29 nt, Human
cgcugcugccacccacacgcccuccccag

SEQ ID NO: 63622 - RNA, 22 nt, Human
uccacacacaaaaaauaccuca

SEQ ID NO: 63623 - RNA, 22 nt, Human
acauuuuuggggucagcucuuu

SEQ ID NO: 63624 - RNA, 23 nt, Human
cgccuguaaucccagcuacucgg

SEQ ID NO: 63625 - RNA, 22 nt, Human
ccuucuuccuggagugccuuca

SEQ ID NO: 63626 - RNA, 27 nt, Human
gacuggguggccccugaggucucuucc

SEQ ID NO: 63627 - RNA, 22 nt, Human
cugaggcccagcccagcccagc

SEQ ID NO: 63628 - RNA, 20 nt, Human
agcuguugcagacucugccu

SEQ ID NO: 63629 - RNA, 21 nt, Human
gcagcugugaggaggucaugu

SEQ ID NO: 63630 - RNA, 24 nt, Human
gcagcuucaggggagcccggagcu

SEQ ID NO: 63631 - RNA, 27 nt, Human
acagaugaggaaauggaggugguccag

SEQ ID NO: 63632 - RNA, 26 nt, Human
ccagccuggccagcagcucagagugc

SEQ ID NO: 63633 - RNA, 23 nt, Human
gguaucuguagaauaaccacagc

SEQ ID NO: 63634 - RNA, 20 nt, Human
gcagaugaccucguacucag

SEQ ID NO: 63635 - RNA, 22 nt, Human
cguuguacuccagccugggcaa

SEQ ID NO: 63636 - RNA, 26 nt, Human
aaccaaaaaucuaucagcccacgugg

SEQ ID NO: 63637 - RNA, 21 nt, Human
ccuccaucuguacuuggucca

SEQ ID NO: 63638 - RNA, 22 nt, Human
cagacucaccaguuccugcuuu

SEQ ID NO: 63639 - RNA, 27 nt, Human
gaguagcugggacuacaggcacccacc

SEQ ID NO: 63640 - RNA, 27 nt, Human
aaguagcugggacuacaggcacccgcc

SEQ ID NO: 63641 - RNA, 27 nt, Human
uacagaagagucucuaaugaaaacacu

SEQ ID NO: 63642 - RNA, 28 nt, Human
ccaccugccuccuccccaaucccacacu

SEQ ID NO: 63643 - RNA, 23 nt, Human
uaccacacaccuguauauucuca

SEQ ID NO: 63644 - RNA, 25 nt, Human
cccaggcccacaggucucgagacgc

SEQ ID NO: 63645 - RNA, 24 nt, Human
ggaccugaugggguagcuggggug

SEQ ID NO: 63646 - RNA, 23 nt, Human
aacucuccccuguccucuagacc

SEQ ID NO: 63647 - RNA, 28 nt, Human
ccugagagcaccuggaauuuguuggaag

SEQ ID NO: 63648 - RNA, 26 nt, Human
accagcagagacauuccaucccaaga

SEQ ID NO: 63649 - RNA, 26 nt, Human
gagggaggguggccuaagaguugagc

SEQ ID NO: 63650 - RNA, 21 nt, Human
gcaaucagaucccauccuccu

SEQ ID NO: 63651 - RNA, 22 nt, Human
agccuccgccuggucucugggu

SEQ ID NO: 63652 - RNA, 22 nt, Human
ggcuauaauccuagcacuuugg

SEQ ID NO: 63653 - RNA, 20 nt, Human
ccugccucccugccucccac

SEQ ID NO: 63654 - RNA, 22 nt, Human
aggcugaggcaggagaaucacu

SEQ ID NO: 63655 - RNA, 22 nt, Human
aggcugaggcaagagaaucgcu

SEQ ID NO: 63656 - RNA, 21 nt, Human
gggaagauguccguggagagg

SEQ ID NO: 63657 - RNA, 23 nt, Human
ggggucugaggaugcauucgaga

SEQ ID NO: 63658 - RNA, 22 nt, Human
uucuauugguguggacucagag

SEQ ID NO: 63659 - RNA, 22 nt, Human
gucaguggcaccauuuccuaaa

SEQ ID NO: 63660 - RNA, 23 nt, Human
gcugaggccuccugcagugaaug

SEQ ID NO: 63661 - RNA, 21 nt, Human
cugucucugggccuuuguucc

SEQ ID NO: 63662 - RNA, 26 nt, Human
gggcccaaacccaguuuccuucucau

SEQ ID NO: 63663 - RNA, 24 nt, Human
cuugccgcccugccacccugccgc

SEQ ID NO: 63664 - RNA, 23 nt, Human
agccccagagcucucaagcuccu

SEQ ID NO: 63665 - RNA, 22 nt, Human
caaaagagaaggaacaaaccuc

SEQ ID NO: 63666 - RNA, 27 nt, Human
gaguagcugggauuacaggcacaugcc

SEQ ID NO: 63667 - RNA, 22 nt, Human
aagcagcuccagcuauguguga

SEQ ID NO: 63668 - RNA, 20 nt, Human
acucacugcugccaugcccu

SEQ ID NO: 63669 - RNA, 22 nt, Human
ucuuauuuuuggagacaggguc

SEQ ID NO: 63670 - RNA, 22 nt, Human
aaggcugaguccacacugcaag

SEQ ID NO: 63671 - RNA, 28 nt, Human
augugcacccaugggcucugacagaaag

SEQ ID NO: 63672 - RNA, 22 nt, Human
accaauaucuguaauuuuuuga

SEQ ID NO: 63673 - RNA, 27 nt, Human
gccagauggacuccagccugccuggca

SEQ ID NO: 63674 - RNA, 21 nt, Human
gcaccgagguugggggcagag

SEQ ID NO: 63675 - RNA, 23 nt, Human
uuggaguggcugcuucugcuaua

SEQ ID NO: 63676 - RNA, 22 nt, Human
caugaaaccaaaacgggcccug

SEQ ID NO: 63677 - RNA, 22 nt, Human
gcagagaacugucuuucauuuu

SEQ ID NO: 63678 - RNA, 29 nt, Human
ugguuggauaccuuugaacuccaugguua

SEQ ID NO: 63679 - RNA, 22 nt, Human
gcauuuuccuaauaugccuuua

SEQ ID NO: 63680 - RNA, 23 nt, Human
gggcuuugcucuccaccgcccug

SEQ ID NO: 63681 - RNA, 19 nt, Human
agguccaaggcugcaguga

SEQ ID NO: 63682 - RNA, 21 nt, Human
cuucccaagccaggccagcca

SEQ ID NO: 63683 - RNA, 23 nt, Human
caguuugagcugcugcuguuaug

SEQ ID NO: 63684 - RNA, 22 nt, Human
ucgcaaucuguugcuucuucca

SEQ ID NO: 63685 - RNA, 20 nt, Human
uacaaaccaauagaauuuca

SEQ ID NO: 63686 - RNA, 22 nt, Human
uccuguggccccacccugggcc

SEQ ID NO: 63687 - RNA, 25 nt, Human
aaaaagaggaaaggcuggaagcugc

SEQ ID NO: 63688 - RNA, 26 nt, Human
agaggaagaguagaugagccgggucc

SEQ ID NO: 63689 - RNA, 24 nt, Human
gaauuacgagggcuggcuguuuua

SEQ ID NO: 63690 - RNA, 32 nt, Human
gucaguugcugcuugucccagcagguggccuu

SEQ ID NO: 63691 - RNA, 21 nt, Human
cugagcccggcgagggugggg

SEQ ID NO: 63692 - RNA, 25 nt, Human
ccugccugcauguucucucuguugu

SEQ ID NO: 63693 - RNA, 22 nt, Human
cuguggauauauuugcacagau

SEQ ID NO: 63694 - RNA, 27 nt, Human
cuugacaguuuuuuagaccuguguuac

SEQ ID NO: 63695 - RNA, 24 nt, Human
gcccucccuucauuguacuuuauc

SEQ ID NO: 63696 - RNA, 24 nt, Human
ccaugugauguuucugaaaagccu

SEQ ID NO: 63697 - RNA, 19 nt, Human
gugcagcugacacacagcu

SEQ ID NO: 63698 - RNA, 26 nt, Human
uauuucaucaaaucugugauuccuuu

SEQ ID NO: 63699 - RNA, 19 nt, Human
acccugugcagaaccuccu

SEQ ID NO: 63700 - RNA, 20 nt, Human
cugucugccagcauaugcag

SEQ ID NO: 63701 - RNA, 27 nt, Human
uccaaaggaaagcuuaaaacccaauac

SEQ ID NO: 63702 - RNA, 29 nt, Human
ccagcggacucggcagccuggggcgcccg

SEQ ID NO: 63703 - RNA, 22 nt, Human
ugcgcaggcuggcccugcccug

SEQ ID NO: 63704 - RNA, 26 nt, Human
ucuggggugaggaguguggggagcuu

SEQ ID NO: 63705 - RNA, 24 nt, Human
cgguuucuuccaagauuccuggcc

SEQ ID NO: 63706 - RNA, 27 nt, Human
ggugaagcuuuggguugccacugccug

SEQ ID NO: 63707 - RNA, 23 nt, Human
auugcaccacugaacuccagccu

SEQ ID NO: 63708 - RNA, 27 nt, Human
augccuaaggucgccacugccugcugc

SEQ ID NO: 63709 - RNA, 22 nt, Human
agaguauugggauuacagacau

SEQ ID NO: 63710 - RNA, 21 nt, Human
cccauuguccugcaccugcag

SEQ ID NO: 63711 - RNA, 27 nt, Human
ggacuccugccuuuccuguuuagacac

SEQ ID NO: 63712 - RNA, 20 nt, Human
gcccacgcuccugacugcug

SEQ ID NO: 63713 - RNA, 24 nt, Human
caucugucuggguaaaccaugaag

SEQ ID NO: 63714 - RNA, 23 nt, Human
cugucucuuucugagucacgucu

SEQ ID NO: 63715 - RNA, 21 nt, Human
aaaaacugcagugucuuugga

SEQ ID NO: 63716 - RNA, 19 nt, Human
gagcuucuguugcugccuc

SEQ ID NO: 63717 - RNA, 24 nt, Human
gagagggaggcagguggacgcugc

SEQ ID NO: 63718 - RNA, 21 nt, Human
aaacaggaucuugcucuguca

SEQ ID NO: 63719 - RNA, 23 nt, Human
cagagaagaaaaagaacagugug

SEQ ID NO: 63720 - RNA, 22 nt, Human
aagguggcaggaugucucagug

SEQ ID NO: 63721 - RNA, 22 nt, Human
aguggcaugaucucagcucacu

SEQ ID NO: 63722 - RNA, 22 nt, Human
aguggcgugaucucggcucacu

SEQ ID NO: 63723 - RNA, 22 nt, Human
acugcugcuguccucccuucau

SEQ ID NO: 63724 - RNA, 27 nt, Human
cccucauuacggcuccucucuaaccuc

SEQ ID NO: 63725 - RNA, 24 nt, Human
cuuuguaacucccaucuguggacc

SEQ ID NO: 63726 - RNA, 22 nt, Human
gccuguaaucccagcgcuuugg

SEQ ID NO: 63727 - RNA, 22 nt, Human
gccuguagucccagcacuuugg

SEQ ID NO: 63728 - RNA, 22 nt, Human
cuggggaggggggaggggaacu

SEQ ID NO: 63729 - RNA, 20 nt, Human
ugucuuggauuuucuuccca

SEQ ID NO: 63730 - RNA, 21 nt, Human
gccagaccccccucccggguc

SEQ ID NO: 63731 - RNA, 19 nt, Human
uagcucaucgcaccaauau

SEQ ID NO: 63732 - RNA, 22 nt, Human
cccguuuuccaaccaguucugc

SEQ ID NO: 63733 - RNA, 20 nt, Human
aguaggcuuuucauggggag

SEQ ID NO: 63734 - RNA, 22 nt, Human
cauuucacuccagccugggcga

SEQ ID NO: 63735 - RNA, 23 nt, Human
cucugggucacauugcuucuuau

SEQ ID NO: 63736 - RNA, 19 nt, Human
uguauccuuuaauucuuca

SEQ ID NO: 63737 - RNA, 22 nt, Human
caggcuggggaacagagaggca

SEQ ID NO: 63738 - RNA, 26 nt, Human
uggcugcccggggugcaggagggaca

SEQ ID NO: 63739 - RNA, 26 nt, Human
uaguuuuucacuuuagcaaaggggca

SEQ ID NO: 63740 - RNA, 21 nt, Human
cuagguacacauguacaugca

SEQ ID NO: 63741 - RNA, 24 nt, Human
uggaaacaucuggaacauccuggg

SEQ ID NO: 63742 - RNA, 19 nt, Human
cugagccugaagagcccca

SEQ ID NO: 63743 - RNA, 20 nt, Human
uguuuucugccacagaccuu

SEQ ID NO: 63744 - RNA, 22 nt, Human
gcuguuuccuguuuucucccga

SEQ ID NO: 63745 - RNA, 20 nt, Human
ugggcacuguggcuuccucc

SEQ ID NO: 63746 - RNA, 22 nt, Human
gggccucccuucccaccugccu

SEQ ID NO: 63747 - RNA, 20 nt, Human
gggccuucuggaggaguggc

SEQ ID NO: 63748 - RNA, 26 nt, Human
ccaggcccauucccagcugcugcagu

SEQ ID NO: 63749 - RNA, 24 nt, Human
ucuucucuuccuuuuaucaguagg

SEQ ID NO: 63750 - RNA, 26 nt, Human
gacauccuucaggauugugagcugga

SEQ ID NO: 63751 - RNA, 22 nt, Human
ggcucauugcaaccucugccuc

SEQ ID NO: 63752 - RNA, 23 nt, Human
gaaguagcugggauuacaggcgc

SEQ ID NO: 63753 - RNA, 27 nt, Human
acuaagcugacccugcuucaagcaauu

SEQ ID NO: 63754 - RNA, 26 nt, Human
gugcccaggcccuuggcugcaggcaa

SEQ ID NO: 63755 - RNA, 27 nt, Human
uucucucucccucuggcaugcaugcug

SEQ ID NO: 63756 - RNA, 19 nt, Human
cagcagccaggugugugua

SEQ ID NO: 63757 - RNA, 25 nt, Human
uggaggccaggauggagaauugguu

SEQ ID NO: 63758 - RNA, 19 nt, Human
cucccucucugccaguguu

SEQ ID NO: 63759 - RNA, 27 nt, Human
gugaguacggagagucuagccugggug

SEQ ID NO: 63760 - RNA, 22 nt, Human
cuuuuguaccagggccaugcag

SEQ ID NO: 63761 - RNA, 20 nt, Human
ugggcagcccuuccuuccac

SEQ ID NO: 63762 - RNA, 22 nt, Human
uuguaaaauauuauguuugauu

SEQ ID NO: 63763 - RNA, 18 nt, Human
aaacccuccaaaucucca

SEQ ID NO: 63764 - RNA, 23 nt, Human
ggacuccugagccugcgggucca

SEQ ID NO: 63765 - RNA, 24 nt, Human
uaaagaauuggccuggcugggugc

SEQ ID NO: 63766 - RNA, 26 nt, Human
gcccacuugcuuaguucuugggcugg

SEQ ID NO: 63767 - RNA, 21 nt, Human
ccugucuuccuucccugcacc

SEQ ID NO: 63768 - RNA, 23 nt, Human
guaaacagcuaacuguuuuuguu

SEQ ID NO: 63769 - RNA, 24 nt, Human
cuugggcugucacagggacuccag

SEQ ID NO: 63770 - RNA, 19 nt, Human
gucauggugccagccugac

SEQ ID NO: 63771 - RNA, 24 nt, Human
gcaaagugcuggauuguccuugga

SEQ ID NO: 63772 - RNA, 23 nt, Human
uucacacauuacgaccgcauuca

SEQ ID NO: 63773 - RNA, 22 nt, Human
cccaaaguccugggauuacagg

SEQ ID NO: 63774 - RNA, 27 nt, Human
gcagcguuuguuccagaacgccgccuc

SEQ ID NO: 63775 - RNA, 24 nt, Human
ggcaagcaucuucauuuugcuagc

SEQ ID NO: 63776 - RNA, 21 nt, Human
uugcggaugaccucauuuuga

SEQ ID NO: 63777 - RNA, 20 nt, Human
agcacuuucugggacuggga

SEQ ID NO: 63778 - RNA, 22 nt, Human
agcaaaugcaauaaugcccuca

SEQ ID NO: 63779 - RNA, 20 nt, Human
gacuauguuucuauucuaag

SEQ ID NO: 63780 - RNA, 23 nt, Human
ccaucuucuuccugaagaagaac

SEQ ID NO: 63781 - RNA, 27 nt, Human
cugccuuuggggcuggagggagacgug

SEQ ID NO: 63782 - RNA, 19 nt, Human
cgaaacacuuaauugugaa

SEQ ID NO: 63783 - RNA, 24 nt, Human
uggcaaauagccacaauuauauaa

SEQ ID NO: 63784 - RNA, 19 nt, Human
aacacaaaugaugcuagag

SEQ ID NO: 63785 - RNA, 25 nt, Human
cauccagcgugaccagggcccgaga

SEQ ID NO: 63786 - RNA, 27 nt, Human
ccgccugcgcccugccagucugaccag

SEQ ID NO: 63787 - RNA, 19 nt, Human
guggccggcccugcagccu

SEQ ID NO: 63788 - RNA, 22 nt, Human
cuguaaaccuucaaaaguuaau

SEQ ID NO: 63789 - RNA, 19 nt, Human
ccugccuggacugcgcggc

SEQ ID NO: 63790 - RNA, 18 nt, Human
gcagauggggaggaccac

SEQ ID NO: 63791 - RNA, 27 nt, Human
auccaguggagcuaaucaguccugccu

SEQ ID NO: 63792 - RNA, 26 nt, Human
gaugcgaacauaguacacugcagccu

SEQ ID NO: 63793 - RNA, 21 nt, Human
ggcggaaaggaaaauacagcg

SEQ ID NO: 63794 - RNA, 27 nt, Human
ggcggagggcagagcaggcccugcgga

SEQ ID NO: 63795 - RNA, 24 nt, Human
aacagcccauggaagaaucauaug

SEQ ID NO: 63796 - RNA, 22 nt, Human
cauuuccuuucccuuuguguuu

SEQ ID NO: 63797 - RNA, 22 nt, Human
aagugaggugggcuccuggaac

SEQ ID NO: 63798 - RNA, 22 nt, Human
acaagucccccgaacgcugagu

SEQ ID NO: 63799 - RNA, 23 nt, Human
gcuaaaacgauuacugacuuucc

SEQ ID NO: 63800 - RNA, 21 nt, Human
ucugauuucagacaaaugcug

SEQ ID NO: 63801 - RNA, 20 nt, Human
auuaaauuggaauuuucuua

SEQ ID NO: 63802 - RNA, 26 nt, Human
aguucagccaccgaauugcuuuuauc

SEQ ID NO: 63803 - RNA, 27 nt, Human
cucuucucugccauccuuauuguguua

SEQ ID NO: 63804 - RNA, 27 nt, Human
acugccucucgcccuguaucugucaac

SEQ ID NO: 63805 - RNA, 20 nt, Human
aggaagaggaagguauggcg

SEQ ID NO: 63806 - RNA, 24 nt, Human
ccuguaauccuagcuauucaaggg

SEQ ID NO: 63807 - RNA, 27 nt, Human
ccugcagcuccaauuucaugcaggaaa

SEQ ID NO: 63808 - RNA, 19 nt, Human
aacuaauaaaugcaccuua

SEQ ID NO: 63809 - RNA, 26 nt, Human
caaguaacagaaaccugguugaaaug

SEQ ID NO: 63810 - RNA, 23 nt, Human
gccuuggacagggcugggccagc

SEQ ID NO: 63811 - RNA, 24 nt, Human
cuggcagcagggcccgcgggguga

SEQ ID NO: 63812 - RNA, 25 nt, Human
gcuuggcccuggcagcccgcaucag

SEQ ID NO: 63813 - RNA, 21 nt, Human
acuguacaacaggaagacuug

SEQ ID NO: 63814 - RNA, 24 nt, Human
aauuuuucuuggguggcuuagaga

SEQ ID NO: 63815 - RNA, 22 nt, Human
agauuugggguauaggucucau

SEQ ID NO: 63816 - RNA, 27 nt, Human
ccucgauuccuccuguguuggacagag

SEQ ID NO: 63817 - RNA, 26 nt, Human
cccuguccccaccucuggagaaucca

SEQ ID NO: 63818 - RNA, 22 nt, Human
ccuccuccuggauucaagcaau

SEQ ID NO: 63819 - RNA, 28 nt, Human
guccuccuaccgaaaccuugccuuucuc

SEQ ID NO: 63820 - RNA, 21 nt, Human
ggggaagaagaaaaaugccuu

SEQ ID NO: 63821 - RNA, 22 nt, Human
cuucccaaugucauauccacca

SEQ ID NO: 63822 - RNA, 21 nt, Human
uggucugaggcaggugguggg

SEQ ID NO: 63823 - RNA, 22 nt, Human
ucuaucuccucauccagggcuu

SEQ ID NO: 63824 - RNA, 25 nt, Human
aggaacggaaacuuagguugggaga

SEQ ID NO: 63825 - RNA, 20 nt, Human
ucugucuguccugcuucuuc

SEQ ID NO: 63826 - RNA, 23 nt, Human
gguccuuguuguaacuaauuuag

SEQ ID NO: 63827 - RNA, 19 nt, Human
cccaguuuuaguuuuuugu

SEQ ID NO: 63828 - RNA, 24 nt, Human
gaaaugagacuugcucucuggccu

SEQ ID NO: 63829 - RNA, 22 nt, Human
gcaugagccaccgcgccuggcc

SEQ ID NO: 63830 - RNA, 22 nt, Human
gugugagccaccgcgcccagcc

SEQ ID NO: 63831 - RNA, 19 nt, Human
guacaguuugugaggaccu

SEQ ID NO: 63832 - RNA, 19 nt, Human
gacucuggccaucauguug

SEQ ID NO: 63833 - RNA, 25 nt, Human
uguuuggauuccucaguuauuguuu

SEQ ID NO: 63834 - RNA, 27 nt, Human
acauggccuugcagcugggcaggcuga

SEQ ID NO: 63835 - RNA, 27 nt, Human
gucucaaacuccugaccucaaguaauc

SEQ ID NO: 63836 - RNA, 19 nt, Human
cuccgccucugcuggcaca

SEQ ID NO: 63837 - RNA, 22 nt, Human
cugugccucaguuuccucacca

SEQ ID NO: 63838 - RNA, 22 nt, Human
uucucauccuuccacugagucc

SEQ ID NO: 63839 - RNA, 21 nt, Human
gccacugcacuccagccgggg

SEQ ID NO: 63840 - RNA, 23 nt, Human
agaugccacccuagccaaugucu

SEQ ID NO: 63841 - RNA, 20 nt, Human
gaucauaccacuggacuaag

SEQ ID NO: 63842 - RNA, 24 nt, Human
ucuucucuaucauggaaugaucuu

SEQ ID NO: 63843 - RNA, 25 nt, Human
cgguuauuuaagucauuucugugau

SEQ ID NO: 63844 - RNA, 25 nt, Human
ugcaucauuuccccucucuggcucc

SEQ ID NO: 63845 - RNA, 14 nt, Human
cacucugcucugcc

SEQ ID NO: 63846 - RNA, 20 nt, Human
uucuucucuucuguguuucg

SEQ ID NO: 63847 - RNA, 27 nt, Human
caggcugcugaaacaagaaauucugag

SEQ ID NO: 63848 - RNA, 20 nt, Human
aguaagacugaaugucuacg

SEQ ID NO: 63849 - RNA, 24 nt, Human
ugucaucagauccagaagaaauau

SEQ ID NO: 63850 - RNA, 21 nt, Human
augacucaccugaagugcaau

SEQ ID NO: 63851 - RNA, 21 nt, Human
ggggcggugccugcuguggaa

SEQ ID NO: 63852 - RNA, 21 nt, Human
uggcugucuucccagacacuu

SEQ ID NO: 63853 - RNA, 18 nt, Human
acuauauuaaaugccucc

SEQ ID NO: 63854 - RNA, 22 nt, Human
ccuccugcucugcccaggaggu

SEQ ID NO: 63855 - RNA, 24 nt, Human
cccacuccaccccacgucccuccu

SEQ ID NO: 63856 - RNA, 20 nt, Human
caccuccuccucugccucaa

SEQ ID NO: 63857 - RNA, 28 nt, Human
gcugaugguggagaaugagcgacugagg

SEQ ID NO: 63858 - RNA, 26 nt, Human
ggagcugagggagggagccauggaag

SEQ ID NO: 63859 - RNA, 27 nt, Human
ggucucgaacuccugaccuugugaugc

SEQ ID NO: 63860 - RNA, 22 nt, Human
agccucccgaguagcugggacc

SEQ ID NO: 63861 - RNA, 20 nt, Human
gugagacugagcauagugag

SEQ ID NO: 63862 - RNA, 22 nt, Human
aggguagagaggguauguccag

SEQ ID NO: 63863 - RNA, 22 nt, Human
uugucugaacccaggcagcugg

SEQ ID NO: 63864 - RNA, 22 nt, Human
gccacccacggugagaagcaga

SEQ ID NO: 63865 - RNA, 18 nt, Human
uggguuugaauucugccu

SEQ ID NO: 63866 - RNA, 25 nt, Human
cacccgggcgcccagcaucguucua

SEQ ID NO: 63867 - RNA, 20 nt, Human
ccgacacaucucacugugcu

SEQ ID NO: 63868 - RNA, 25 nt, Human
uugucaaccgggcuggagugcagug

SEQ ID NO: 63869 - RNA, 26 nt, Human
caucccucugagaagcacaaggagac

SEQ ID NO: 63870 - RNA, 18 nt, Human
ccuucagcuacaaaaaga

SEQ ID NO: 63871 - RNA, 23 nt, Human
uguuucucucuuugcuuuggcug

SEQ ID NO: 63872 - RNA, 23 nt, Human
gguacuugggaccccagugccuu

SEQ ID NO: 63873 - RNA, 21 nt, Human
gucugagcagggcaggugccc

SEQ ID NO: 63874 - RNA, 24 nt, Human
cacugccuauuuuuccucuuguua

SEQ ID NO: 63875 - RNA, 18 nt, Human
ucugcucccaggagccag

SEQ ID NO: 63876 - RNA, 24 nt, Human
aucucucucaacuuccugcacuua

SEQ ID NO: 63877 - RNA, 24 nt, Human
uuucugaugguagaacauucucaa

SEQ ID NO: 63878 - RNA, 21 nt, Human
cugcuucucuggggcugggcu

SEQ ID NO: 63879 - RNA, 26 nt, Human
gauggccuggaugggaggaagggcag

SEQ ID NO: 63880 - RNA, 19 nt, Human
acucacugaagccugcguu

SEQ ID NO: 63881 - RNA, 25 nt, Human
gugugggaaauccuucaguuacucc

SEQ ID NO: 63882 - RNA, 27 nt, Human
ucaucccugccaccagccagagcacag

SEQ ID NO: 63883 - RNA, 22 nt, Human
uccagaucccguccggcagcuu

SEQ ID NO: 63884 - RNA, 24 nt, Human
ggcuaaaaguuacaagugugcaaa

SEQ ID NO: 63885 - RNA, 20 nt, Human
cccaucuauggacaggcugg

SEQ ID NO: 63886 - RNA, 22 nt, Human
agagagggagagugacagcagc

SEQ ID NO: 63887 - RNA, 21 nt, Human
uacagaagcagguugcaguga

SEQ ID NO: 63888 - RNA, 20 nt, Human
gagaaaagcuggaggaaggc

SEQ ID NO: 63889 - RNA, 20 nt, Human
ugucauuuggauggcugguc

SEQ ID NO: 63890 - RNA, 22 nt, Human
cuggagacagagguugcaguga

SEQ ID NO: 63891 - RNA, 21 nt, Human
ugguuuccuaaccucuucuuc

SEQ ID NO: 63892 - RNA, 25 nt, Human
cacguagacacaccuggcugccuuc

SEQ ID NO: 63893 - RNA, 24 nt, Human
cgggagcccuagguuuccucucca

SEQ ID NO: 63894 - RNA, 26 nt, Human
ugaggcaugaggauccggcacagggc

SEQ ID NO: 63895 - RNA, 26 nt, Human
ugcaacaggcugggcuucaguggcag

SEQ ID NO: 63896 - RNA, 18 nt, Human
acaaagcauccuaaagac

SEQ ID NO: 63897 - RNA, 24 nt, Human
uggcaguugcagugcugcugucuc

SEQ ID NO: 63898 - RNA, 22 nt, Human
aguguucuuucaguaaaguaca

SEQ ID NO: 63899 - RNA, 24 nt, Human
gggcuggaggugggggugggggca

SEQ ID NO: 63900 - RNA, 25 nt, Human
acuucuuaacauauuccugugucuu

SEQ ID NO: 63901 - RNA, 21 nt, Human
caguguugggaucacucacuu

SEQ ID NO: 63902 - RNA, 22 nt, Human
agccuuccgaguagcugggauc

SEQ ID NO: 63903 - RNA, 21 nt, Human
guacucuguguaccugcucca

SEQ ID NO: 63904 - RNA, 22 nt, Human
ggccucccaaguagcugggauu

SEQ ID NO: 63905 - RNA, 22 nt, Human
agccucccgaguagcugggauu

SEQ ID NO: 63906 - RNA, 22 nt, Human
agccucccaaguagcuaggauu

SEQ ID NO: 63907 - RNA, 27 nt, Human
gcagacaccugcuucugauuccacaag

SEQ ID NO: 63908 - RNA, 20 nt, Human
ccacagugucuguaucggag

SEQ ID NO: 63909 - RNA, 23 nt, Human
ggggcagccuugucccggcccag

SEQ ID NO: 63910 - RNA, 22 nt, Human
agccucucucugaacugugauc

SEQ ID NO: 63911 - RNA, 20 nt, Human
aucaccccuuccuccuuccu

SEQ ID NO: 63912 - RNA, 20 nt, Human
gugccccugcucacaguguu

SEQ ID NO: 63913 - RNA, 22 nt, Human
uccggcuccaggaacuggcauu

SEQ ID NO: 63914 - RNA, 24 nt, Human
ccuccaagucaccuggccugggaa

SEQ ID NO: 63915 - RNA, 21 nt, Human
aaagagaagaaaggugaccuc

SEQ ID NO: 63916 - RNA, 21 nt, Human
cacccucccuuuuuccugaca

SEQ ID NO: 63917 - RNA, 26 nt, Human
uuugggaaaauaaauacauucgaagg

SEQ ID NO: 63918 - RNA, 23 nt, Human
ccacuuugccauugccauggaca

SEQ ID NO: 63919 - RNA, 26 nt, Human
uguauacuaucuuuaacugguuuuuc

SEQ ID NO: 63920 - RNA, 23 nt, Human
agggagaugucauggugaaaugc

SEQ ID NO: 63921 - RNA, 22 nt, Human
cgccacugcacucaagccuggg

SEQ ID NO: 63922 - RNA, 28 nt, Human
gucaauuagaugugcaggaguaaguagu

SEQ ID NO: 63923 - RNA, 27 nt, Human
ugcuguugcuuuauacguuacguaccc

SEQ ID NO: 63924 - RNA, 21 nt, Human
uacuuccaggagacagagcca

SEQ ID NO: 63925 - RNA, 25 nt, Human
gucccagaauuguaucucauacugu

SEQ ID NO: 63926 - RNA, 21 nt, Human
gcauucccugcccugaaggaa

SEQ ID NO: 63927 - RNA, 25 nt, Human
gcccugcacuccacgcuggccaaga

SEQ ID NO: 63928 - RNA, 25 nt, Human
ggcccugcccucuccuuccuuaccc

SEQ ID NO: 63929 - RNA, 21 nt, Human
caggaccugcggaauaggccu

SEQ ID NO: 63930 - RNA, 26 nt, Human
ugcauugucuugucacaccucccuca

SEQ ID NO: 63931 - RNA, 27 nt, Human
cuguguacauuugcaagauguguguaa

SEQ ID NO: 63932 - RNA, 24 nt, Human
cuaagcuguguuacuccaaaggac

SEQ ID NO: 63933 - RNA, 21 nt, Human
ggcagcaccaucucugccuuc

SEQ ID NO: 63934 - RNA, 23 nt, Human
ggauuguuguguccacuaaccgg

SEQ ID NO: 63935 - RNA, 22 nt, Human
uggugauccagcuucucugcca

SEQ ID NO: 63936 - RNA, 20 nt, Human
auauaugacaaauguauuaa

SEQ ID NO: 63937 - RNA, 27 nt, Human
ugccauucuucauuccuacaaaggacg

SEQ ID NO: 63938 - RNA, 22 nt, Human
accuuuuauugacuguaauauu

SEQ ID NO: 63939 - RNA, 17 nt, Human
ccuuucucuucuccgcc

SEQ ID NO: 63940 - RNA, 21 nt, Human
ggcugccaggcuggaguggag

SEQ ID NO: 63941 - RNA, 23 nt, Human
ucuuucauuuccaaccauuuuuc

SEQ ID NO: 63942 - RNA, 22 nt, Human
cccucacugcagccccugcguc

SEQ ID NO: 63943 - RNA, 23 nt, Human
ggcccucuucgaauucacuggca

SEQ ID NO: 63944 - RNA, 21 nt, Human
aggcuacaacaggauucuagg

SEQ ID NO: 63945 - RNA, 24 nt, Human
ggcagccaacugcuccaaucugcc

SEQ ID NO: 63946 - RNA, 25 nt, Human
aagaggagaaggaaaacaugcugcu

SEQ ID NO: 63947 - RNA, 22 nt, Human
ucaccuuuuaaauuaugucacu

SEQ ID NO: 63948 - RNA, 27 nt, Human
ggaucacacccuguaaucgggcccgug

SEQ ID NO: 63949 - RNA, 22 nt, Human
cugugggcuugggauguuaaca

SEQ ID NO: 63950 - RNA, 27 nt, Human
cuuugggccugucccugcccaggccuc

SEQ ID NO: 63951 - RNA, 27 nt, Human
agggaaagacaugugaacagaguuaag

SEQ ID NO: 63952 - RNA, 21 nt, Human
agaggaagaucuugacuuaua

SEQ ID NO: 63953 - RNA, 23 nt, Human
ggggugagggaaggagcgcuugg

SEQ ID NO: 63954 - RNA, 22 nt, Human
cacccaggcuggagugcuaugg

SEQ ID NO: 63955 - RNA, 22 nt, Human
cucccaggcuggagugcaaugg

SEQ ID NO: 63956 - RNA, 22 nt, Human
ggaacccccaaaaggagaauag

SEQ ID NO: 63957 - RNA, 27 nt, Human
ccuccccuuuuguccuaucauucccua

SEQ ID NO: 63958 - RNA, 22 nt, Human
uaaucagcguaaggggauuucu

SEQ ID NO: 63959 - RNA, 28 nt, Human
ccgaggaggaagagguugauggcggcgg

SEQ ID NO: 63960 - RNA, 20 nt, Human
caccucugcacucccuuggg

SEQ ID NO: 63961 - RNA, 22 nt, Human
ccgaguagcugggauuccaggc

SEQ ID NO: 63962 - RNA, 21 nt, Human
gguggaggccugccuggcagg

SEQ ID NO: 63963 - RNA, 22 nt, Human
ccaaguagcugcaacaacaggc

SEQ ID NO: 63964 - RNA, 26 nt, Human
uucaacaacaccagaacugugugucu

SEQ ID NO: 63965 - RNA, 22 nt, Human
ggccucggguacccucaccuag

SEQ ID NO: 63966 - RNA, 22 nt, Human
acagagcagaaacagcuucaca

SEQ ID NO: 63967 - RNA, 21 nt, Human
ccaacuuguuuuugacugaca

SEQ ID NO: 63968 - RNA, 23 nt, Human
gccagccaggaaguaccucucug

SEQ ID NO: 63969 - RNA, 22 nt, Human
auugcuugaacccaggaggcgg

SEQ ID NO: 63970 - RNA, 22 nt, Human
aucgcuugaauccaggaggcgg

SEQ ID NO: 63971 - RNA, 28 nt, Human
gaauucgagcccuggcugugaaaagaau

SEQ ID NO: 63972 - RNA, 18 nt, Human
cuuccucccuuccuuuca

SEQ ID NO: 63973 - RNA, 21 nt, Human
ccuguugcugcccguguccac

SEQ ID NO: 63974 - RNA, 26 nt, Human
gccuuucucgcaccugcuccugcgcc

SEQ ID NO: 63975 - RNA, 27 nt, Human
ugauugcgcucuucacaauuaaaggcc

SEQ ID NO: 63976 - RNA, 27 nt, Human
gcagaaggcagaggccaccacuggacu

SEQ ID NO: 63977 - RNA, 22 nt, Human
uggcagaaggacagucugguua

SEQ ID NO: 63978 - RNA, 23 nt, Human
aggcuggagugcagaggugcgau

SEQ ID NO: 63979 - RNA, 22 nt, Human
gcacccaucuguaucaucagug

SEQ ID NO: 63980 - RNA, 27 nt, Human
guuacccaggcuggucucaaacuccug

SEQ ID NO: 63981 - RNA, 28 nt, Human
gcauuuuagagaaaacuaaagaaauuuc

SEQ ID NO: 63982 - RNA, 26 nt, Human
ucucaagcuccuuucugucagggugg

SEQ ID NO: 63983 - RNA, 22 nt, Human
gaguagcugggauuacagguau

SEQ ID NO: 63984 - RNA, 20 nt, Human
caggccugggcuuccuggcc

SEQ ID NO: 63985 - RNA, 21 nt, Human
cuuccuggcucuuguuuaaaa

SEQ ID NO: 63986 - RNA, 20 nt, Human
cuguguacgugggugugcag

SEQ ID NO: 63987 - RNA, 26 nt, Human
ucucuuccuguucugcaccccucucc

SEQ ID NO: 63988 - RNA, 19 nt, Human
gucuuaaaagacuagaauc

SEQ ID NO: 63989 - RNA, 26 nt, Human
uggcaaaaagggccgaggucugguga

SEQ ID NO: 63990 - RNA, 23 nt, Human
uggcuauuagugcuacauuuggu

SEQ ID NO: 63991 - RNA, 20 nt, Human
ggucccucagccucugaucc

SEQ ID NO: 63992 - RNA, 27 nt, Human
gcauccccagccacaacugccagcucu

SEQ ID NO: 63993 - RNA, 27 nt, Human
ggcguguacauguggucucagauacuu

SEQ ID NO: 63994 - RNA, 24 nt, Human
uuuaaggcuuuaaaagacagugaa

SEQ ID NO: 63995 - RNA, 24 nt, Human
acucagcccugcucaugaggcagc

SEQ ID NO: 63996 - RNA, 16 nt, Human
agcugcuuuucuugaa

SEQ ID NO: 63997 - RNA, 20 nt, Human
cuagauuuugcugagaugaa

SEQ ID NO: 63998 - RNA, 20 nt, Human
aacauaguuuucaguaguuc

SEQ ID NO: 63999 - RNA, 22 nt, Human
aauaauuucaaagauaucugag

SEQ ID NO: 64000 - RNA, 23 nt, Human
agacggguggcauggggagcagc

SEQ ID NO: 64001 - RNA, 22 nt, Human
aauggcacgaucucagcucacu

SEQ ID NO: 64002 - RNA, 22 nt, Human
aauggugcgaucuuggcucacu

SEQ ID NO: 64003 - RNA, 27 nt, Human
cgugguuuccuuuucuccucucucugc

SEQ ID NO: 64004 - RNA, 21 nt, Human
accuccccaccccaaaaaggg

SEQ ID NO: 64005 - RNA, 24 nt, Human
uuccaccaggagucuggagugcaa

SEQ ID NO: 64006 - RNA, 18 nt, Human
ccugacuuugcucuuaga

SEQ ID NO: 64007 - RNA, 26 nt, Human
aacagcuucaugccuuuguaaguuau

SEQ ID NO: 64008 - RNA, 22 nt, Human
cacgaggucaggagauggagac

SEQ ID NO: 64009 - RNA, 26 nt, Human
aguguguugcuucugucacuuuauau

SEQ ID NO: 64010 - RNA, 26 nt, Human
ggaagucacuguugaaguugcagugg

SEQ ID NO: 64011 - RNA, 27 nt, Human
ccuagaguaggucuaggggaauacuca

SEQ ID NO: 64012 - RNA, 19 nt, Human
ugcccaggcggcggcggcg

SEQ ID NO: 64013 - RNA, 22 nt, Human
uuccaaaacaugauuuaauuuc

SEQ ID NO: 64014 - RNA, 21 nt, Human
gaacaguuggaaguguggaaa

SEQ ID NO: 64015 - RNA, 23 nt, Human
uugucaugcacugacacagcauu

SEQ ID NO: 64016 - RNA, 22 nt, Human
ccagccccaaccuuccaaaccu

SEQ ID NO: 64017 - RNA, 24 nt, Human
cccugggaccccugcuccagcccg

SEQ ID NO: 64018 - RNA, 22 nt, Human
cuaaaacaguccuucaaacuuc

SEQ ID NO: 64019 - RNA, 22 nt, Human
ugggagauggaaguugcaguga

SEQ ID NO: 64020 - RNA, 20 nt, Human
uuuuauuuucaugcuuuuuc

SEQ ID NO: 64021 - RNA, 19 nt, Human
acaaaccugaaugagcaga

SEQ ID NO: 64022 - RNA, 25 nt, Human
uggagaacaacaagguacccagaau

SEQ ID NO: 64023 - RNA, 27 nt, Human
aaaacucaagauugggagcucuuugug

SEQ ID NO: 64024 - RNA, 24 nt, Human
ggcugacucccucucagguggaag

SEQ ID NO: 64025 - RNA, 23 nt, Human
ucucuuuauuagugaaucaugcu

SEQ ID NO: 64026 - RNA, 24 nt, Human
acccaggcuggagugcaguguugc

SEQ ID NO: 64027 - RNA, 19 nt, Human
gcccugcacuccaccuggg

SEQ ID NO: 64028 - RNA, 20 nt, Human
agagcugauuuauuccagua

SEQ ID NO: 64029 - RNA, 20 nt, Human
caggaaggaaagacuuuuua

SEQ ID NO: 64030 - RNA, 19 nt, Human
aucuggagcaacuuaaaaa

SEQ ID NO: 64031 - RNA, 21 nt, Human
cugcccuuuugaagcaggacu

SEQ ID NO: 64032 - RNA, 25 nt, Human
ggugaaaaagaugaccccuuucuga

SEQ ID NO: 64033 - RNA, 26 nt, Human
acgaggcaggaaucuccauuuuugug

SEQ ID NO: 64034 - RNA, 19 nt, Human
cccagccucagcccugagc

SEQ ID NO: 64035 - RNA, 22 nt, Human
uggugaggaccugcggccuugg

SEQ ID NO: 64036 - RNA, 25 nt, Human
gucacccagaacuggaugguaccug

SEQ ID NO: 64037 - RNA, 24 nt, Human
ucacaugccaucucuuccugacag

SEQ ID NO: 64038 - RNA, 21 nt, Human
aagguuaaagaggugagguga

SEQ ID NO: 64039 - RNA, 21 nt, Human
ucagugagcuaugaucgcgcc

SEQ ID NO: 64040 - RNA, 22 nt, Human
ggacagcagaccagacagucac

SEQ ID NO: 64041 - RNA, 26 nt, Human
cucagagaccugcggaaagcccccuc

SEQ ID NO: 64042 - RNA, 22 nt, Human
ugaaagauuguuuacaaacuuc

SEQ ID NO: 64043 - RNA, 30 nt, Human
cguggcugcccacugccacgcccacuacgc

SEQ ID NO: 64044 - RNA, 23 nt, Human
ucaagagucuaaaccccagauuc

SEQ ID NO: 64045 - RNA, 27 nt, Human
uuccaacuuccaauauuuauccauucg

SEQ ID NO: 64046 - RNA, 20 nt, Human
augggaucugcagaguucgg

SEQ ID NO: 64047 - RNA, 27 nt, Human
gccagugcgcuccggcagcaguacgcg

SEQ ID NO: 64048 - RNA, 21 nt, Human
uaccauccuaauuuuacaggc

SEQ ID NO: 64049 - RNA, 20 nt, Human
uaagggagaucuuggccaac

SEQ ID NO: 64050 - RNA, 26 nt, Human
uuuguaguuuuaguggagaugggguu

SEQ ID NO: 64051 - RNA, 22 nt, Human
ggcuucccaaguagcugggauu

SEQ ID NO: 64052 - RNA, 22 nt, Human
agcuucccgaguagcugggauu

SEQ ID NO: 64053 - RNA, 24 nt, Human
accuggggagcugacacuucugua

SEQ ID NO: 64054 - RNA, 25 nt, Human
auuuuggaucuguugggagcuugga

SEQ ID NO: 64055 - RNA, 22 nt, Human
ccacagccuucagccuguucua

SEQ ID NO: 64056 - RNA, 27 nt, Human
cuuucugcucauaucauaaccaggucc

SEQ ID NO: 64057 - RNA, 19 nt, Human
gugugcuggggucuccgaa

SEQ ID NO: 64058 - RNA, 22 nt, Human
gucacucaguaccgccugcagu

SEQ ID NO: 64059 - RNA, 27 nt, Human
uucaaagcucuaauagagucacagcuu

SEQ ID NO: 64060 - RNA, 22 nt, Human
gaacccgggaggcggagguugu

SEQ ID NO: 64061 - RNA, 26 nt, Human
uccagcagucaugaaccccuucaccu

SEQ ID NO: 64062 - RNA, 19 nt, Human
ucaguaaagagcaaaggca

SEQ ID NO: 64063 - RNA, 23 nt, Human
agcaggcggggaggaggcugccg

SEQ ID NO: 64064 - RNA, 19 nt, Human
caccacccuccagccuggg

SEQ ID NO: 64065 - RNA, 20 nt, Human
ggggaaagaaaucaggggac

SEQ ID NO: 64066 - RNA, 24 nt, Human
ggcagugggagagcgucgggcggg

SEQ ID NO: 64067 - RNA, 20 nt, Human
gggcugaggcaggggccgcu

SEQ ID NO: 64068 - RNA, 26 nt, Human
ugggcagccugguauucaguggccac

SEQ ID NO: 64069 - RNA, 24 nt, Human
gaucucaaaccuccuucccucugc

SEQ ID NO: 64070 - RNA, 22 nt, Human
gcucagacccagacguggugcu

SEQ ID NO: 64071 - RNA, 22 nt, Human
acccagacuggaaugcagugac

SEQ ID NO: 64072 - RNA, 22 nt, Human
acccaggcuggaguacaguggc

SEQ ID NO: 64073 - RNA, 20 nt, Human
cacgaguucaaggcugcagu

SEQ ID NO: 64074 - RNA, 20 nt, Human
cuggggcagaugaggcuggc

SEQ ID NO: 64075 - RNA, 24 nt, Human
uucuuuggcuuuuguuuuguguuu

SEQ ID NO: 64076 - RNA, 22 nt, Human
uacuaagaaauguuauuugcau

SEQ ID NO: 64077 - RNA, 24 nt, Human
gcaggugaccuggagcauccggca

SEQ ID NO: 64078 - RNA, 27 nt, Human
agaagcagugagccgcaucuucuccau

SEQ ID NO: 64079 - RNA, 22 nt, Human
uuucucacuuugccaucaugug

SEQ ID NO: 64080 - RNA, 23 nt, Human
uucaugguauucaggauuacaug

SEQ ID NO: 64081 - RNA, 26 nt, Human
gaggcugagggacaggaucuauaggc

SEQ ID NO: 64082 - RNA, 23 nt, Human
uagcaugugauuacuucacuccu

SEQ ID NO: 64083 - RNA, 23 nt, Human
uggucucacugugguugcccuca

SEQ ID NO: 64084 - RNA, 21 nt, Human
cuccccggcuggagugcagug

SEQ ID NO: 64085 - RNA, 22 nt, Human
agccucccaaguagcuaggacu

SEQ ID NO: 64086 - RNA, 22 nt, Human
agccucccgaguagcugggacu

SEQ ID NO: 64087 - RNA, 22 nt, Human
ggccucccaaguagcugggacu

SEQ ID NO: 64088 - RNA, 22 nt, Human
agccuuccgaguagcugggacc

SEQ ID NO: 64089 - RNA, 21 nt, Human
aaucucuaguuacuacucuua

SEQ ID NO: 64090 - RNA, 21 nt, Human
guggugugaucucggcucgcu

SEQ ID NO: 64091 - RNA, 20 nt, Human
uuuaauauguaauucuucca

SEQ ID NO: 64092 - RNA, 20 nt, Human
gcagugcuucugauccugcu

SEQ ID NO: 64093 - RNA, 21 nt, Human
uccaccgcugcccuccuggaa

SEQ ID NO: 64094 - RNA, 22 nt, Human
ccgaguagcugggacuacaggu

SEQ ID NO: 64095 - RNA, 24 nt, Human
uaggagguugaaccuaaagaaaug

SEQ ID NO: 64096 - RNA, 22 nt, Human
agcauuuucacuaaaguuauua

SEQ ID NO: 64097 - RNA, 23 nt, Human
gacauguggccuggcuagugcag

SEQ ID NO: 64098 - RNA, 21 nt, Human
uauuucuuuucuuucucaucu

SEQ ID NO: 64099 - RNA, 24 nt, Human
aggaacagaaaaccaaacacucca

SEQ ID NO: 64100 - RNA, 27 nt, Human
uugacuucccgcauaaggcagggugac

SEQ ID NO: 64101 - RNA, 21 nt, Human
ugucuucaggagucucauggc

SEQ ID NO: 64102 - RNA, 22 nt, Human
caggcagccuucugaucaguac

SEQ ID NO: 64103 - RNA, 23 nt, Human
cccaggagacguagguuguggug

SEQ ID NO: 64104 - RNA, 27 nt, Human
aggaggaagauggcggggugcaggggg

SEQ ID NO: 64105 - RNA, 22 nt, Human
cugacagcucuagacacucaca

SEQ ID NO: 64106 - RNA, 23 nt, Human
uuacucuucauuugucaccaucu

SEQ ID NO: 64107 - RNA, 22 nt, Human
aaacuccugggcucagucaguc

SEQ ID NO: 64108 - RNA, 23 nt, Human
ucuaagaugagggggccaggcgg

SEQ ID NO: 64109 - RNA, 20 nt, Human
ggcggcagagguugcaguga

SEQ ID NO: 64110 - RNA, 21 nt, Human
gccaccacuccuggccccaga

SEQ ID NO: 64111 - RNA, 21 nt, Human
caugcagaugaggaaggcccu

SEQ ID NO: 64112 - RNA, 21 nt, Human
ccacaggccaucagcagcuag

SEQ ID NO: 64113 - RNA, 21 nt, Human
uugggcagucuccuuuugaaa

SEQ ID NO: 64114 - RNA, 22 nt, Human
ugguaugugccuguaaucccag

SEQ ID NO: 64115 - RNA, 19 nt, Human
uaaucagaguuaccauuau

SEQ ID NO: 64116 - RNA, 21 nt, Human
ggaaggcugggggcagggcag

SEQ ID NO: 64117 - RNA, 27 nt, Human
cuccagccgagggacccuggugggggu

SEQ ID NO: 64118 - RNA, 26 nt, Human
ucuuuccucccccugcaacuuccgcu

SEQ ID NO: 64119 - RNA, 17 nt, Human
cuucccuucaggaguug

SEQ ID NO: 64120 - RNA, 23 nt, Human
ugcuccaccugccagcccccgga

SEQ ID NO: 64121 - RNA, 21 nt, Human
ggucggccugugugcccagcu

SEQ ID NO: 64122 - RNA, 26 nt, Human
gcgugaaagaagcuugugauccugcc

SEQ ID NO: 64123 - RNA, 24 nt, Human
ggacuguaaucauaucgcuacugg

SEQ ID NO: 64124 - RNA, 22 nt, Human
gcugccaccucuccauccugcu

SEQ ID NO: 64125 - RNA, 20 nt, Human
uuaauuucuucuucuuuucc

SEQ ID NO: 64126 - RNA, 20 nt, Human
uugccgccuaugagcagcca

SEQ ID NO: 64127 - RNA, 22 nt, Human
gcucacaccuguaaucccaaua

SEQ ID NO: 64128 - RNA, 25 nt, Human
uacuuuugccauugacuucuuccca

SEQ ID NO: 64129 - RNA, 23 nt, Human
ugggaggugggauuuagccagga

SEQ ID NO: 64130 - RNA, 23 nt, Human
gccuucucccugggaacugguuc

SEQ ID NO: 64131 - RNA, 23 nt, Human
gacgggguuucaccauguuggcc

SEQ ID NO: 64132 - RNA, 23 nt, Human
gacaggguuucaccauguuagcc

SEQ ID NO: 64133 - RNA, 22 nt, Human
gcuacucucuugccagcauuuu

SEQ ID NO: 64134 - RNA, 27 nt, Human
uccagggucucagcaaacugcuguuuu

SEQ ID NO: 64135 - RNA, 25 nt, Human
ugcuguugauaacagcaagauggcu

SEQ ID NO: 64136 - RNA, 27 nt, Human
gauucacccauguuuguugaacuuaga

SEQ ID NO: 64137 - RNA, 23 nt, Human
cgaguagcugggauuacaggcau

SEQ ID NO: 64138 - RNA, 24 nt, Human
gcggauucccagacccaugaacag

SEQ ID NO: 64139 - RNA, 21 nt, Human
auguagugccgcucuugggga

SEQ ID NO: 64140 - RNA, 23 nt, Human
uucaguuuucucaccucuugcua

SEQ ID NO: 64141 - RNA, 22 nt, Human
ugccuguaauuccagcacuuug

SEQ ID NO: 64142 - RNA, 22 nt, Human
ugucuguaaucccagcacuuug

SEQ ID NO: 64143 - RNA, 22 nt, Human
uauuccaucaccuuccuccucu

SEQ ID NO: 64144 - RNA, 21 nt, Human
uccagccugcuagucugcccu

SEQ ID NO: 64145 - RNA, 23 nt, Human
gacugugccacugcaccucuagu

SEQ ID NO: 64146 - RNA, 28 nt, Human
aguuagacugugaggaguuacuuuaugu

SEQ ID NO: 64147 - RNA, 21 nt, Human
ggcagggccaccugugcuagu

SEQ ID NO: 64148 - RNA, 22 nt, Human
uggcuaacauggcaaaacccca

SEQ ID NO: 64149 - RNA, 21 nt, Human
gccucccugucuccagcugcc

SEQ ID NO: 64150 - RNA, 22 nt, Human
uggccgacauggugaaacccca

SEQ ID NO: 64151 - RNA, 22 nt, Human
uggccaacaugguaaaacccca

SEQ ID NO: 64152 - RNA, 20 nt, Human
gcuuugcaaccuuguacuuu

SEQ ID NO: 64153 - RNA, 23 nt, Human
caagagaaaacaccacacuguga

SEQ ID NO: 64154 - RNA, 21 nt, Human
cagcccagcgccaggccagag

SEQ ID NO: 64155 - RNA, 21 nt, Human
ugaggcagcugugacuguguc

SEQ ID NO: 64156 - RNA, 26 nt, Human
uuuaaacuuugggaaauguacuuuua

SEQ ID NO: 64157 - RNA, 27 nt, Human
uuuucuaucauggaauauuuauaggcc

SEQ ID NO: 64158 - RNA, 21 nt, Human
gcaucugcacuccagcccagg

SEQ ID NO: 64159 - RNA, 22 nt, Human
agccucagacuuuuucccacug

SEQ ID NO: 64160 - RNA, 23 nt, Human
ugcagcucuggcccaggagcugc

SEQ ID NO: 64161 - RNA, 22 nt, Human
gucagccuguucaaagugcuca

SEQ ID NO: 64162 - RNA, 28 nt, Human
ggccagggagaggcgcaggagccuuugc

SEQ ID NO: 64163 - RNA, 23 nt, Human
ccuguuagucuccccaccucuuc

SEQ ID NO: 64164 - RNA, 18 nt, Human
auugagaucacauuucag

SEQ ID NO: 64165 - RNA, 21 nt, Human
agccuccuuaaaacucugccg

SEQ ID NO: 64166 - RNA, 23 nt, Human
aggucugagggacgggcccuggg

SEQ ID NO: 64167 - RNA, 22 nt, Human
caucucccaaagugcugggauu

SEQ ID NO: 64168 - RNA, 21 nt, Human
aaagagaaggucucuuccuua

SEQ ID NO: 64169 - RNA, 29 nt, Human
uccuuuguauuuugcuacuuugcaguauu

SEQ ID NO: 64170 - RNA, 23 nt, Human
ggauguaggagggggaaggagga

SEQ ID NO: 64171 - RNA, 21 nt, Human
gccugcaaucccagcacuuug

SEQ ID NO: 64172 - RNA, 23 nt, Human
agcagcccacugcaugggacaau

SEQ ID NO: 64173 - RNA, 21 nt, Human
ggaggucaaggcugcagugag

SEQ ID NO: 64174 - RNA, 23 nt, Human
cucuucagucuggaggguccugg

SEQ ID NO: 64175 - RNA, 27 nt, Human
uuguucucuccaucucccuagucauca

SEQ ID NO: 64176 - RNA, 31 nt, Human
uccucggcucgggggccggcaccggcgaugc

SEQ ID NO: 64177 - RNA, 22 nt, Human
uacaaguggcucaucaucaaga

SEQ ID NO: 64178 - RNA, 20 nt, Human
cugagccugggaagauguac

SEQ ID NO: 64179 - RNA, 23 nt, Human
cuagggguggugggagcagccgu

SEQ ID NO: 64180 - RNA, 24 nt, Human
gcccaggcugcccugcacuccugc

SEQ ID NO: 64181 - RNA, 21 nt, Human
uauagagaaaaggaaaccacu

SEQ ID NO: 64182 - RNA, 21 nt, Human
ucuuguacuccauccugggcc

SEQ ID NO: 64183 - RNA, 23 nt, Human
ugggcguaggccuggcuguggug

SEQ ID NO: 64184 - RNA, 26 nt, Human
gcugcacucuacccuguacacugccu

SEQ ID NO: 64185 - RNA, 21 nt, Human
gcccugugguuugacucuccu

SEQ ID NO: 64186 - RNA, 23 nt, Human
cucgcccaggcuggagugcagug

SEQ ID NO: 64187 - RNA, 27 nt, Human
ucuccaaugcucuggagugugcauuuc

SEQ ID NO: 64188 - RNA, 22 nt, Human
guuguagcuuuggagugcagag

SEQ ID NO: 64189 - RNA, 23 nt, Human
ucagguauuagaggaaagagaag

SEQ ID NO: 64190 - RNA, 23 nt, Human
gguucagaaagaggaaugaagau

SEQ ID NO: 64191 - RNA, 23 nt, Human
uggguucucuucuccugugauca

SEQ ID NO: 64192 - RNA, 21 nt, Human
auuuuucuuaaaaaguaacuc

SEQ ID NO: 64193 - RNA, 22 nt, Human
ggaagucagugacuuggugacg

SEQ ID NO: 64194 - RNA, 22 nt, Human
uacacucccucgaagcugcugu

SEQ ID NO: 64195 - RNA, 26 nt, Human
acagaaguccuuaagcagaggaauug

SEQ ID NO: 64196 - RNA, 20 nt, Human
ugcuuuguaguuugcuuugc

SEQ ID NO: 64197 - RNA, 23 nt, Human
ugguagaccaccuucuuuagcag

SEQ ID NO: 64198 - RNA, 26 nt, Human
ucaugccuuuauuucuguaucugaca

SEQ ID NO: 64199 - RNA, 19 nt, Human
gcugauaaguagcaugauc

SEQ ID NO: 64200 - RNA, 17 nt, Human
gcuuuuaaaaguucuua

SEQ ID NO: 64201 - RNA, 22 nt, Human
uuggaagcacaauuuucccccc

SEQ ID NO: 64202 - RNA, 26 nt, Human
acagccucccagccugggcccccggc

SEQ ID NO: 64203 - RNA, 27 nt, Human
ccugcuggaauuugcugugcagagcca

SEQ ID NO: 64204 - RNA, 26 nt, Human
ggucucucauuuccuggcugaaguuu

SEQ ID NO: 64205 - RNA, 22 nt, Human
gcccaccacuuccaccugggcc

SEQ ID NO: 64206 - RNA, 19 nt, Human
aauucccagccauacucug

SEQ ID NO: 64207 - RNA, 23 nt, Human
ggaaccugacaaccauguguaca

SEQ ID NO: 64208 - RNA, 19 nt, Human
ggucaaugcuauuuuuguu

SEQ ID NO: 64209 - RNA, 23 nt, Human
uuuccuuugaguccucuggagcu

SEQ ID NO: 64210 - RNA, 21 nt, Human
uaaaacacaaacgggcucagc

SEQ ID NO: 64211 - RNA, 21 nt, Human
aacacagaaauacuuccugcg

SEQ ID NO: 64212 - RNA, 23 nt, Human
cccaugacaccuaggcugucagu

SEQ ID NO: 64213 - RNA, 21 nt, Human
ggugugaccagaggaaaagga

SEQ ID NO: 64214 - RNA, 20 nt, Human
uccucauuccuuuaccccca

SEQ ID NO: 64215 - RNA, 22 nt, Human
uuugucgcccaggcuggagcgc

SEQ ID NO: 64216 - RNA, 21 nt, Human
ccuguauucucagcacuuugg

SEQ ID NO: 64217 - RNA, 20 nt, Human
aggcagaaagagaucaggga

SEQ ID NO: 64218 - RNA, 21 nt, Human
augaccaggugugcucugcug

SEQ ID NO: 64219 - RNA, 27 nt, Human
ggagagggggcuggugggugccuaggc

SEQ ID NO: 64220 - RNA, 21 nt, Human
acuccuuaguauuucauagaa

SEQ ID NO: 64221 - RNA, 21 nt, Human
aaagaggcgauugaaaccauu

SEQ ID NO: 64222 - RNA, 21 nt, Human
uugcgcgggccuaagaugugu

SEQ ID NO: 64223 - RNA, 22 nt, Human
ccugacuguguucagugccuug

SEQ ID NO: 64224 - RNA, 27 nt, Human
agcaaaucuucuguuuuuuaaaaauaa

SEQ ID NO: 64225 - RNA, 28 nt, Human
gccugagcuguggcggaggauccaggaa

SEQ ID NO: 64226 - RNA, 22 nt, Human
cuuuauauuccuacaaaggaga

SEQ ID NO: 64227 - RNA, 24 nt, Human
ucacccugggaaucacaguggucu

SEQ ID NO: 64228 - RNA, 22 nt, Human
uaaucugguagcaauccaucuc

SEQ ID NO: 64229 - RNA, 20 nt, Human
cccggggcgacaggagcagc

SEQ ID NO: 64230 - RNA, 22 nt, Human
cacaccuauaaucccagcacua

SEQ ID NO: 64231 - RNA, 26 nt, Human
uuauucuucuuacauuauuaaucauu

SEQ ID NO: 64232 - RNA, 24 nt, Human
ucacauucuuucaaaaggucuaau

SEQ ID NO: 64233 - RNA, 22 nt, Human
ugcagugagccaagaucgcgcu

SEQ ID NO: 64234 - RNA, 23 nt, Human
auuuuucuaaacaagaaggcuua

SEQ ID NO: 64235 - RNA, 24 nt, Human
uguuccuuuaaaugcagcacacug

SEQ ID NO: 64236 - RNA, 25 nt, Human
cugacaguccugcccugccugcucc

SEQ ID NO: 64237 - RNA, 22 nt, Human
gucaucucuucauuauuuaggg

SEQ ID NO: 64238 - RNA, 30 nt, Human
ccuggaguucuuccugugcuccuugaucac

SEQ ID NO: 64239 - RNA, 21 nt, Human
gcugguucaguauagcucauu

SEQ ID NO: 64240 - RNA, 24 nt, Human
gcuggaaaagugcauuccuuguua

SEQ ID NO: 64241 - RNA, 20 nt, Human
aauuacugcccucugccuca

SEQ ID NO: 64242 - RNA, 27 nt, Human
acgggcaucgcaggagucucugccacc

SEQ ID NO: 64243 - RNA, 18 nt, Human
agccucgugccucugucc

SEQ ID NO: 64244 - RNA, 28 nt, Human
gcacacacaucuggcccugacuucugga

SEQ ID NO: 64245 - RNA, 29 nt, Human
caggauggcugugugugguggucaccagg

SEQ ID NO: 64246 - RNA, 22 nt, Human
guuucuguguuugucucucugc

SEQ ID NO: 64247 - RNA, 21 nt, Human
gccgccccaguguccuccucc

SEQ ID NO: 64248 - RNA, 22 nt, Human
ugcccccaauuaaguugaucuu

SEQ ID NO: 64249 - RNA, 22 nt, Human
ccgggagguugaggcugcagug

SEQ ID NO: 64250 - RNA, 25 nt, Human
ccuuccccuccuccuuccugaguca

SEQ ID NO: 64251 - RNA, 22 nt, Human
ccagccaccacuucagugugau

SEQ ID NO: 64252 - RNA, 23 nt, Human
guucugagagaaaaagagagaga

SEQ ID NO: 64253 - RNA, 26 nt, Human
cugcuuuguugauauucaaaguguga

SEQ ID NO: 64254 - RNA, 23 nt, Human
gaaaacugcuacuaucuguuuuu

SEQ ID NO: 64255 - RNA, 27 nt, Human
accuaccucacaggggguugugaggau

SEQ ID NO: 64256 - RNA, 20 nt, Human
cacgccuguucccagcaagu

SEQ ID NO: 64257 - RNA, 27 nt, Human
accagccuuaccaacauggagaaaccc

SEQ ID NO: 64258 - RNA, 20 nt, Human
cccagcaccuucuccucccc

SEQ ID NO: 64259 - RNA, 21 nt, Human
caaaaagggaguaaccaaaga

SEQ ID NO: 64260 - RNA, 21 nt, Human
uaugcuugcuuguuggagcaa

SEQ ID NO: 64261 - RNA, 22 nt, Human
agugacugcaacaaauaaaccu

SEQ ID NO: 64262 - RNA, 19 nt, Human
uugcagaaacugugucaga

SEQ ID NO: 64263 - RNA, 22 nt, Human
uguucagaagguugcucuagau

SEQ ID NO: 64264 - RNA, 28 nt, Human
cuugcuggcuuuacuaagccagccacac

SEQ ID NO: 64265 - RNA, 22 nt, Human
cugugccaggcugaauuacagu

SEQ ID NO: 64266 - RNA, 25 nt, Human
gaaauuuccuuguucccuaggcuga

SEQ ID NO: 64267 - RNA, 22 nt, Human
accagcccacagagcucacauu

SEQ ID NO: 64268 - RNA, 20 nt, Human
ucaaggagcaccuucauuag

SEQ ID NO: 64269 - RNA, 22 nt, Human
uacacagucuguauauuuuaau

SEQ ID NO: 64270 - RNA, 20 nt, Human
aaacucugggcucagcugcu

SEQ ID NO: 64271 - RNA, 25 nt, Human
ggagccuuucuuggcccucaguuug

SEQ ID NO: 64272 - RNA, 21 nt, Human
ccugccucuuugaagagagca

SEQ ID NO: 64273 - RNA, 23 nt, Human
cuaaagcucaauucaagugacac

SEQ ID NO: 64274 - RNA, 24 nt, Human
gguuuugacaaugguacuugcuuc

SEQ ID NO: 64275 - RNA, 24 nt, Human
acugcccuauguugucuauaagac

SEQ ID NO: 64276 - RNA, 19 nt, Human
ugcaaccucuuccaggcuc

SEQ ID NO: 64277 - RNA, 23 nt, Human
cccacgccuuggaaccguccuuu

SEQ ID NO: 64278 - RNA, 27 nt, Human
gaugcagauaaagucgguuuaaucacc

SEQ ID NO: 64279 - RNA, 21 nt, Human
aaacaguggugagcuccugug

SEQ ID NO: 64280 - RNA, 21 nt, Human
guccucuuccccuuggcugug

SEQ ID NO: 64281 - RNA, 21 nt, Human
cuauaugaaacauucuuucug

SEQ ID NO: 64282 - RNA, 23 nt, Human
ccuccaggcugcugugagagugu

SEQ ID NO: 64283 - RNA, 23 nt, Human
gucaaccgggcuggagugcagug

SEQ ID NO: 64284 - RNA, 23 nt, Human
gaugggguuuccccauguuggcc

SEQ ID NO: 64285 - RNA, 21 nt, Human
aacugagaaacuucuuaccag

SEQ ID NO: 64286 - RNA, 26 nt, Human
gcccugcucccucugccacuguggac

SEQ ID NO: 64287 - RNA, 22 nt, Human
ugcagcucaagggcuggcacuu

SEQ ID NO: 64288 - RNA, 22 nt, Human
ucagaaacaucuguuugaggau

SEQ ID NO: 64289 - RNA, 18 nt, Human
aaucugacaguagcagug

SEQ ID NO: 64290 - RNA, 25 nt, Human
auccacccucugcauccccuuggcc

SEQ ID NO: 64291 - RNA, 23 nt, Human
aaacaagagcaaaaagcacuucc

SEQ ID NO: 64292 - RNA, 24 nt, Human
aaucuauuuuguuacuugcacuug

SEQ ID NO: 64293 - RNA, 24 nt, Human
ugcacuucuuggaaaaagugccua

SEQ ID NO: 64294 - RNA, 26 nt, Human
caguucugccaggcaagcccuguguu

SEQ ID NO: 64295 - RNA, 23 nt, Human
cccgggcuggcgggagugcaguu

SEQ ID NO: 64296 - RNA, 18 nt, Human
ccucaccuucccuaguuc

SEQ ID NO: 64297 - RNA, 22 nt, Human
gucccauucuagauccugcacc

SEQ ID NO: 64298 - RNA, 24 nt, Human
ccucaccuccucugugauuucuuu

SEQ ID NO: 64299 - RNA, 23 nt, Human
cacacauguauauuucccccugg

SEQ ID NO: 64300 - RNA, 23 nt, Human
gggagagagaggauggguaccau

SEQ ID NO: 64301 - RNA, 21 nt, Human
ucuauucagaaugagaaaaau

SEQ ID NO: 64302 - RNA, 22 nt, Human
agcuuggagauuacuguauuug

SEQ ID NO: 64303 - RNA, 27 nt, Human
ggagccgcgagccaggauggaggcaga

SEQ ID NO: 64304 - RNA, 25 nt, Human
ugccucucccauggcuuugugcugc

SEQ ID NO: 64305 - RNA, 25 nt, Human
ccacacccuggcccagacugccagc

SEQ ID NO: 64306 - RNA, 21 nt, Human
gaaccugcccagagagcuuua

SEQ ID NO: 64307 - RNA, 22 nt, Human
ugggauuacaggcgugagccau

SEQ ID NO: 64308 - RNA, 25 nt, Human
cuaggagcagcagaggaugugguga

SEQ ID NO: 64309 - RNA, 19 nt, Human
ggccaggggaucccucucu

SEQ ID NO: 64310 - RNA, 28 nt, Human
gggcuuccugccuuauccuucuguuugu

SEQ ID NO: 64311 - RNA, 21 nt, Human
augcauuuuuuacaaauggaa

SEQ ID NO: 64312 - RNA, 26 nt, Human
gggccacuacauuugcuccauccucc

SEQ ID NO: 64313 - RNA, 22 nt, Human
uucccaggucaucuucucccuu

SEQ ID NO: 64314 - RNA, 21 nt, Human
gccacaccgguacccuccucc

SEQ ID NO: 64315 - RNA, 22 nt, Human
gcacucccacccacauugccug

SEQ ID NO: 64316 - RNA, 18 nt, Human
uccuggaugagaucaucg

SEQ ID NO: 64317 - RNA, 20 nt, Human
ugaaugucauuuuaaagcau

SEQ ID NO: 64318 - RNA, 21 nt, Human
ggcuuuuguguaugucugacu

SEQ ID NO: 64319 - RNA, 27 nt, Human
agcuuugagcaauacucugcuuucacg

SEQ ID NO: 64320 - RNA, 19 nt, Human
ccaggguccugugccugga

SEQ ID NO: 64321 - RNA, 18 nt, Human
cucccaccugguggcuca

SEQ ID NO: 64322 - RNA, 27 nt, Human
agcuuugccgcuuuugugccucucaca

SEQ ID NO: 64323 - RNA, 24 nt, Human
aucaaaaccagagagucuagggca

SEQ ID NO: 64324 - RNA, 26 nt, Human
ugggggaaugaaguuccuuccacaaa

SEQ ID NO: 64325 - RNA, 20 nt, Human
gcaccaccacacccggcuag

SEQ ID NO: 64326 - RNA, 23 nt, Human
cuuucucaggguuggacccccug

SEQ ID NO: 64327 - RNA, 27 nt, Human
cgcaaaacuaccgggcuggcagggcgg

SEQ ID NO: 64328 - RNA, 22 nt, Human
caaccuagacuggaauaaggcc

SEQ ID NO: 64329 - RNA, 28 nt, Human
uauauacugcuauuuacacuauuauuuc

SEQ ID NO: 64330 - RNA, 24 nt, Human
guuuugggggguauuuugcauguu

SEQ ID NO: 64331 - RNA, 28 nt, Human
aaauggaccugccuuucacugaauuuuc

SEQ ID NO: 64332 - RNA, 25 nt, Human
aggagguggcggcgggcagagguga

SEQ ID NO: 64333 - RNA, 20 nt, Human
cauccccaagccccagagag

SEQ ID NO: 64334 - RNA, 22 nt, Human
ccuguaaucccagcacuucagg

SEQ ID NO: 64335 - RNA, 22 nt, Human
cagugccuucucucagcuccca

SEQ ID NO: 64336 - RNA, 21 nt, Human
acagauucugccuuguuucau

SEQ ID NO: 64337 - RNA, 22 nt, Human
uauuggcucauaaaacuaaccu

SEQ ID NO: 64338 - RNA, 17 nt, Human
cccagcacccgggcuca

SEQ ID NO: 64339 - RNA, 22 nt, Human
agaccagccuggccaacauggg

SEQ ID NO: 64340 - RNA, 22 nt, Human
gcguguggacccgagcccagcc

SEQ ID NO: 64341 - RNA, 23 nt, Human
agucaggcuagcugugcugguau

SEQ ID NO: 64342 - RNA, 22 nt, Human
uugacauccuuugagauauuuu

SEQ ID NO: 64343 - RNA, 27 nt, Human
aacugaauagaggucuugaucuuugga

SEQ ID NO: 64344 - RNA, 21 nt, Human
uuucuucucuucuguguuucg

SEQ ID NO: 64345 - RNA, 21 nt, Human
cccuccccaaaccccaaggaa

SEQ ID NO: 64346 - RNA, 21 nt, Human
ccacccaggcuugaggcagcg

SEQ ID NO: 64347 - RNA, 20 nt, Human
ucauuuucaaaauggaggga

SEQ ID NO: 64348 - RNA, 23 nt, Human
gcccucugcugcuuuccaacaca

SEQ ID NO: 64349 - RNA, 22 nt, Human
cccgcccuccccacggggccuc

SEQ ID NO: 64350 - RNA, 27 nt, Human
uaaauaaaggcauguguauggcugguc

SEQ ID NO: 64351 - RNA, 22 nt, Human
guuugguuugaaguaaguugaa

SEQ ID NO: 64352 - RNA, 25 nt, Human
gcccaggcuggagugcaacggcaug

SEQ ID NO: 64353 - RNA, 26 nt, Human
ccuguuccuuuuuugccuguggaucu

SEQ ID NO: 64354 - RNA, 26 nt, Human
aaccuaggcagugggaggcaaauggg

SEQ ID NO: 64355 - RNA, 24 nt, Human
agguuucucacaccucuguuccca

SEQ ID NO: 64356 - RNA, 21 nt, Human
cugggcuugggagccgcguga

SEQ ID NO: 64357 - RNA, 26 nt, Human
uacagauuugcuuucucuuacaaaaa

SEQ ID NO: 64358 - RNA, 29 nt, Human
ucugguucuuuuucucuuuaccuggggcc

SEQ ID NO: 64359 - RNA, 22 nt, Human
ucuuagagguuuuuugcacucu

SEQ ID NO: 64360 - RNA, 22 nt, Human
acuucuccccagaaaguguuua

SEQ ID NO: 64361 - RNA, 22 nt, Human
aaaacucaaucauuuuauucag

SEQ ID NO: 64362 - RNA, 27 nt, Human
gaucaauggauuuguuuacaaugugau

SEQ ID NO: 64363 - RNA, 27 nt, Human
ugcagcucuggcccaggagcugcaggc

SEQ ID NO: 64364 - RNA, 20 nt, Human
agaugcaaucagacaagugu

SEQ ID NO: 64365 - RNA, 23 nt, Human
gagucuuuucuuucucuugcucc

SEQ ID NO: 64366 - RNA, 25 nt, Human
ucugagccacccuccccgcacagcc

SEQ ID NO: 64367 - RNA, 27 nt, Human
ccauuucucugauuuaguuuucuugag

SEQ ID NO: 64368 - RNA, 21 nt, Human
cacaugcuugcucuaggaaua

SEQ ID NO: 64369 - RNA, 26 nt, Human
uaaacacacagaucugcaucugauag

SEQ ID NO: 64370 - RNA, 27 nt, Human
cucugauggcuugcacaggguggacca

SEQ ID NO: 64371 - RNA, 22 nt, Human
cccagcugccuggagagggucu

SEQ ID NO: 64372 - RNA, 26 nt, Human
uucauuucucuuuuacacuuuuguac

SEQ ID NO: 64373 - RNA, 20 nt, Human
gauguagucuuacucuguca

SEQ ID NO: 64374 - RNA, 22 nt, Human
ucccccgugaugcagcuggaac

SEQ ID NO: 64375 - RNA, 27 nt, Human
gaagcugaggcgggagaaucaugugaa

SEQ ID NO: 64376 - RNA, 22 nt, Human
gcaugagccacuacacccagcc

SEQ ID NO: 64377 - RNA, 23 nt, Human
uaccugacagagcccuggcuuug

SEQ ID NO: 64378 - RNA, 21 nt, Human
guaauguuaaccguuucagga

SEQ ID NO: 64379 - RNA, 21 nt, Human
uccaaagugccccaccagggg

SEQ ID NO: 64380 - RNA, 22 nt, Human
gcccuuuucagacuccugggcc

SEQ ID NO: 64381 - RNA, 19 nt, Human
acuagcugugaaccagccu

SEQ ID NO: 64382 - RNA, 22 nt, Human
accuguaaucccagucacuggg

SEQ ID NO: 64383 - RNA, 20 nt, Human
gaucacugcaaccucugccu

SEQ ID NO: 64384 - RNA, 22 nt, Human
ccaggaaggggcggggagaagc

SEQ ID NO: 64385 - RNA, 23 nt, Human
auuguuagaaucacaggaggcaa

SEQ ID NO: 64386 - RNA, 24 nt, Human
guuagccuggugggaaaaugcaca

SEQ ID NO: 64387 - RNA, 22 nt, Human
gggauuacaggcgcguaucacc

SEQ ID NO: 64388 - RNA, 26 nt, Human
ccugccaggcugcccccgccugcugu

SEQ ID NO: 64389 - RNA, 21 nt, Human
caggggggcaggggccagucu

SEQ ID NO: 64390 - RNA, 26 nt, Human
uuuguuguuuucugggggaaaaagcc

SEQ ID NO: 64391 - RNA, 22 nt, Human
ggagggcaagggccaugcugaa

SEQ ID NO: 64392 - RNA, 20 nt, Human
cgcccaggcugcagugcagu

SEQ ID NO: 64393 - RNA, 20 nt, Human
ucucgggguggcucacagcu

SEQ ID NO: 64394 - RNA, 21 nt, Human
ccuggcauuuggccucuugua

SEQ ID NO: 64395 - RNA, 19 nt, Human
cacuugcagaggagcccag

SEQ ID NO: 64396 - RNA, 21 nt, Human
uuucaguucccuccugcccag

SEQ ID NO: 64397 - RNA, 25 nt, Human
ucccaagcuggagugcaguggugcg

SEQ ID NO: 64398 - RNA, 23 nt, Human
uuuauugcuguuuaucagguugg

SEQ ID NO: 64399 - RNA, 22 nt, Human
ugccacugcacugcagccuggg

SEQ ID NO: 64400 - RNA, 27 nt, Human
uugggggaauuugugacccuggaacau

SEQ ID NO: 64401 - RNA, 24 nt, Human
uugcugucuggugcuccucucuca

SEQ ID NO: 64402 - RNA, 22 nt, Human
caucuguuuucuucugcugaag

SEQ ID NO: 64403 - RNA, 26 nt, Human
cccaucaugacauuggguagcauuaa

SEQ ID NO: 64404 - RNA, 25 nt, Human
ucagaauuuggagggagggagcagu

SEQ ID NO: 64405 - RNA, 26 nt, Human
gcucagacuccuggguggcuuccaga

SEQ ID NO: 64406 - RNA, 27 nt, Human
gcucugucauucaggcuggagugcagu

SEQ ID NO: 64407 - RNA, 19 nt, Human
gcuuucucaucgaaguaau

SEQ ID NO: 64408 - RNA, 21 nt, Human
gccaaagucucccuucuguuu

SEQ ID NO: 64409 - RNA, 20 nt, Human
acuucacuaaugacgaugcc

SEQ ID NO: 64410 - RNA, 22 nt, Human
cuguaauucagacacucagcuu

SEQ ID NO: 64411 - RNA, 26 nt, Human
gccaacacgccuggcuaauuuuuugu

SEQ ID NO: 64412 - RNA, 23 nt, Human
agaaggcagacuuucuacaugca

SEQ ID NO: 64413 - RNA, 23 nt, Human
cauucaacaugcaacuuuaggga

SEQ ID NO: 64414 - RNA, 20 nt, Human
agcggagccggaggccagcu

SEQ ID NO: 64415 - RNA, 22 nt, Human
guggggaggggacccaugaauc

SEQ ID NO: 64416 - RNA, 22 nt, Human
cuucugcuuuucaacccccacc

SEQ ID NO: 64417 - RNA, 23 nt, Human
uuucuacuuugcuuuucucucca

SEQ ID NO: 64418 - RNA, 18 nt, Human
cgagacaaacccuugaug

SEQ ID NO: 64419 - RNA, 26 nt, Human
gauccucagaggaagauggagaggag

SEQ ID NO: 64420 - RNA, 22 nt, Human
aggcugaggugggaggaugguu

SEQ ID NO: 64421 - RNA, 23 nt, Human
uugguccacaguauuuggaaagg

SEQ ID NO: 64422 - RNA, 22 nt, Human
auuucuuuuuagaaaguguauu

SEQ ID NO: 64423 - RNA, 21 nt, Human
cccugcucccgcccgaggacu

SEQ ID NO: 64424 - RNA, 23 nt, Human
gcacaggaaaguucccuuugguc

SEQ ID NO: 64425 - RNA, 22 nt, Human
acaaucaagugauauuuuguag

SEQ ID NO: 64426 - RNA, 27 nt, Human
ggcuuugccuggacagcuccugccucc

SEQ ID NO: 64427 - RNA, 23 nt, Human
acacaugcuuuuguaucuuguca

SEQ ID NO: 64428 - RNA, 28 nt, Human
auaaacaaugcuuuuugugcacuacaua

SEQ ID NO: 64429 - RNA, 25 nt, Human
aaguuuaaaaugcagcuguugauuc

SEQ ID NO: 64430 - RNA, 24 nt, Human
uguaaguuaccugaaagcugcagu

SEQ ID NO: 64431 - RNA, 20 nt, Human
ucuucugcuuugucuguguc

SEQ ID NO: 64432 - RNA, 22 nt, Human
ugucugacaccaugccuuugca

SEQ ID NO: 64433 - RNA, 23 nt, Human
gcuaucuccccugcuccucugcu

SEQ ID NO: 64434 - RNA, 26 nt, Human
ucugcacucuaacccuaggcaucaca

SEQ ID NO: 64435 - RNA, 22 nt, Human
cuaagucagugacuuugcuccc

SEQ ID NO: 64436 - RNA, 22 nt, Human
uuuauagaccaccuccagccag

SEQ ID NO: 64437 - RNA, 20 nt, Human
aguauuuuuuccugugaugg

SEQ ID NO: 64438 - RNA, 24 nt, Human
cuugcucuccacuuccuccgugca

SEQ ID NO: 64439 - RNA, 23 nt, Human
ggcugaggaagucccgcucuccc

SEQ ID NO: 64440 - RNA, 22 nt, Human
aggagaagccgccgcagaggaa

SEQ ID NO: 64441 - RNA, 26 nt, Human
ucccacagcuugccccacaccaccuu

SEQ ID NO: 64442 - RNA, 26 nt, Human
uuccaaugcugccuugaucucugucu

SEQ ID NO: 64443 - RNA, 22 nt, Human
uccugugauaguucaguucuuu

SEQ ID NO: 64444 - RNA, 24 nt, Human
gcccagcccagcuccagcuccagc

SEQ ID NO: 64445 - RNA, 26 nt, Human
cgcuggucccucugggcaugcugugc

SEQ ID NO: 64446 - RNA, 27 nt, Human
ccagcccacagagccugaauuuguaag

SEQ ID NO: 64447 - RNA, 24 nt, Human
ugcuggcauuuucagcagauccuc

SEQ ID NO: 64448 - RNA, 19 nt, Human
ugucuguaaucacacucuc

SEQ ID NO: 64449 - RNA, 23 nt, Human
agggaaaggcuaaucuuacggau

SEQ ID NO: 64450 - RNA, 21 nt, Human
aauauucauacaacaaagagg

SEQ ID NO: 64451 - RNA, 27 nt, Human
aagucacugcacagugcaucucagccc

SEQ ID NO: 64452 - RNA, 24 nt, Human
uuguguauauuacaccaaugccgc

SEQ ID NO: 64453 - RNA, 22 nt, Human
uaauuagcuuguuacaauucua

SEQ ID NO: 64454 - RNA, 22 nt, Human
cuggucacaucauuaacugcua

SEQ ID NO: 64455 - RNA, 20 nt, Human
ccacaucugcugguuugggg

SEQ ID NO: 64456 - RNA, 19 nt, Human
uucugcuuccuuacacaua

SEQ ID NO: 64457 - RNA, 21 nt, Human
ucccaacuaagauucagucag

SEQ ID NO: 64458 - RNA, 26 nt, Human
uucauuuagccugaaagcugcaguua

SEQ ID NO: 64459 - RNA, 19 nt, Human
ccugcucucggugugggcc

SEQ ID NO: 64460 - RNA, 22 nt, Human
gucaucuucuucaugguguuag

SEQ ID NO: 64461 - RNA, 30 nt, Human
cuucagaaaccguucagaacagucugccug

SEQ ID NO: 64462 - RNA, 19 nt, Human
ucugcugucagucuuuguu

SEQ ID NO: 64463 - RNA, 20 nt, Human
gaguucuuagagaaguauga

SEQ ID NO: 64464 - RNA, 24 nt, Human
uguagagagcagcauucccaggga

SEQ ID NO: 64465 - RNA, 22 nt, Human
auguguggcucagugccuggac

SEQ ID NO: 64466 - RNA, 21 nt, Human
ugcugguaaaauguuuaacaa

SEQ ID NO: 64467 - RNA, 22 nt, Human
cacccaggcuggaguacaguga

SEQ ID NO: 64468 - RNA, 21 nt, Human
ggagguggagguugcagugag

SEQ ID NO: 64469 - RNA, 18 nt, Human
aggguccagagagcgggg

SEQ ID NO: 64470 - RNA, 26 nt, Human
cccacaggaagccugcaguccuggaa

SEQ ID NO: 64471 - RNA, 20 nt, Human
ccucgcucgcaccugccucc

SEQ ID NO: 64472 - RNA, 22 nt, Human
gcucacugcaaccuccaccucu

SEQ ID NO: 64473 - RNA, 27 nt, Human
caggcuggaguacagugacacgaccuc

SEQ ID NO: 64474 - RNA, 22 nt, Human
uccucuacgugcuucagucuuc

SEQ ID NO: 64475 - RNA, 22 nt, Human
gcuuacaaggagggguuaccau

SEQ ID NO: 64476 - RNA, 22 nt, Human
gcagcuucguuguucccucugg

SEQ ID NO: 64477 - RNA, 22 nt, Human
ucccauauaacuaagacauaug

SEQ ID NO: 64478 - RNA, 20 nt, Human
cugcugucacuucaagccac

SEQ ID NO: 64479 - RNA, 28 nt, Human
cccuuugcauucuuucuggaccuuaaau

SEQ ID NO: 64480 - RNA, 30 nt, Human
cuuuugcaggaugaccucagggcuaugugg

SEQ ID NO: 64481 - RNA, 27 nt, Human
cacuacccacuaucuuauucagucccu

SEQ ID NO: 64482 - RNA, 21 nt, Human
gagcaggacucacagguugga

SEQ ID NO: 64483 - RNA, 31 nt, Human
gcucuccagcaucuucuguuuccuggcaagu

SEQ ID NO: 64484 - RNA, 23 nt, Human
uucuggcugccugucuuugcugc

SEQ ID NO: 64485 - RNA, 26 nt, Human
cugguccugccaccuccugagcugcc

SEQ ID NO: 64486 - RNA, 27 nt, Human
gcaagcagagguggugauuuguuaaag

SEQ ID NO: 64487 - RNA, 22 nt, Human
gccuguaauuccagugcuuugg

SEQ ID NO: 64488 - RNA, 23 nt, Human
ucagaccugugaacuacccagaa

SEQ ID NO: 64489 - RNA, 27 nt, Human
ccccugccugggucuccacauccccag

SEQ ID NO: 64490 - RNA, 21 nt, Human
ugcccacuucuagcugcccug

SEQ ID NO: 64491 - RNA, 25 nt, Human
ccuggccgggccaggaugggagugg

SEQ ID NO: 64492 - RNA, 24 nt, Human
cagcugguuucccagaggagaagg

SEQ ID NO: 64493 - RNA, 23 nt, Human
gagcgagaccuugucucuaaaaa

SEQ ID NO: 64494 - RNA, 23 nt, Human
ugcaagacaaguguuggggaaga

SEQ ID NO: 64495 - RNA, 22 nt, Human
auucuguuucuuccuccucaca

SEQ ID NO: 64496 - RNA, 27 nt, Human
gccccaggcccagccacccgguaccuc

SEQ ID NO: 64497 - RNA, 27 nt, Human
gguguucccugaggacaagagacaucc

SEQ ID NO: 64498 - RNA, 22 nt, Human
uugugaucccaagugacucugu

SEQ ID NO: 64499 - RNA, 19 nt, Human
uucuacaaaccaagggagu

SEQ ID NO: 64500 - RNA, 21 nt, Human
aaccuugccuguuguuuucua

SEQ ID NO: 64501 - RNA, 21 nt, Human
aguggcggcgcggucagggcu

SEQ ID NO: 64502 - RNA, 28 nt, Human
agucauuuucacauccucuugagguuca

SEQ ID NO: 64503 - RNA, 27 nt, Human
gaggcauuccgucuucauagcccguga

SEQ ID NO: 64504 - RNA, 28 nt, Human
ggauauauuuugagaaugaugaaacgga

SEQ ID NO: 64505 - RNA, 23 nt, Human
gcuguucuucaugugcuucuaug

SEQ ID NO: 64506 - RNA, 21 nt, Human
ucauaguugaaauuagugcag

SEQ ID NO: 64507 - RNA, 22 nt, Human
uucucagcuuguccagaccugg

SEQ ID NO: 64508 - RNA, 25 nt, Human
ugcccaggcuggaguucagcggugc

SEQ ID NO: 64509 - RNA, 22 nt, Human
gaacccaggagguggagguugc

SEQ ID NO: 64510 - RNA, 25 nt, Human
uugagacugaaguuaagugggcaca

SEQ ID NO: 64511 - RNA, 18 nt, Human
guggccagagaggcucca

SEQ ID NO: 64512 - RNA, 27 nt, Human
gcuucuccaacugcaacuggccggucu

SEQ ID NO: 64513 - RNA, 26 nt, Human
aucagucugcagcacagcgcagaagu

SEQ ID NO: 64514 - RNA, 18 nt, Human
ucucugaaaaggaauuga

SEQ ID NO: 64515 - RNA, 23 nt, Human
agagacacuagccauaaaaucua

SEQ ID NO: 64516 - RNA, 22 nt, Human
ugucauccaggcuggagugcag

SEQ ID NO: 64517 - RNA, 21 nt, Human
cgccgccgccuccgagccggg

SEQ ID NO: 64518 - RNA, 25 nt, Human
uccucccugccccaggacuucaucg

SEQ ID NO: 64519 - RNA, 28 nt, Human
gagaaguacaaagguugcagugcugagc

SEQ ID NO: 64520 - RNA, 19 nt, Human
cccaguccuccuccagaaa

SEQ ID NO: 64521 - RNA, 24 nt, Human
cguuuugccucuauuuuucuuguu

SEQ ID NO: 64522 - RNA, 25 nt, Human
acuaauuauuuuauccccaucccag

SEQ ID NO: 64523 - RNA, 22 nt, Human
cccugcucccuccgggucuucc

SEQ ID NO: 64524 - RNA, 24 nt, Human
uauauuaagagaggagcucauuuc

SEQ ID NO: 64525 - RNA, 21 nt, Human
cuggggcagccaagaacgagc

SEQ ID NO: 64526 - RNA, 27 nt, Human
caccacuguacuccagcccggcacucc

SEQ ID NO: 64527 - RNA, 23 nt, Human
guguauguuuaaaacgacagaac

SEQ ID NO: 64528 - RNA, 22 nt, Human
ggcuuccccuucccccaccuca

SEQ ID NO: 64529 - RNA, 21 nt, Human
aucagccgcaaggauccuucc

SEQ ID NO: 64530 - RNA, 26 nt, Human
gaaucaggaaacugcucucccucagc

SEQ ID NO: 64531 - RNA, 24 nt, Human
ccuuagaagccugcucugcaucca

SEQ ID NO: 64532 - RNA, 22 nt, Human
cgggagcgggagccggagcagc

SEQ ID NO: 64533 - RNA, 21 nt, Human
uugaccagaccuagaccuggg

SEQ ID NO: 64534 - RNA, 20 nt, Human
ugacuucugcuagguagagg

SEQ ID NO: 64535 - RNA, 22 nt, Human
ugggggccaggcuggaggcagg

SEQ ID NO: 64536 - RNA, 29 nt, Human
cagccucucuugggcuuucuuacacuaac

SEQ ID NO: 64537 - RNA, 20 nt, Human
augagacauuuuuuccauua

SEQ ID NO: 64538 - RNA, 27 nt, Human
uccagaagagcggaccagggcugcugc

SEQ ID NO: 64539 - RNA, 22 nt, Human
ggggggaucucccugcccccac

SEQ ID NO: 64540 - RNA, 24 nt, Human
gcccgcauagcacuugcagaccug

SEQ ID NO: 64541 - RNA, 18 nt, Human
gacccugcgggugaaggg

SEQ ID NO: 64542 - RNA, 22 nt, Human
gcugcugccuccugggcucuga

SEQ ID NO: 64543 - RNA, 20 nt, Human
caauguggggucggagcuug

SEQ ID NO: 64544 - RNA, 20 nt, Human
gugaggaaguccaggcucca

SEQ ID NO: 64545 - RNA, 23 nt, Human
uccuuuucucucagacacuggag

SEQ ID NO: 64546 - RNA, 26 nt, Human
ugucagguuuuguguucuuguuuucc

SEQ ID NO: 64547 - RNA, 23 nt, Human
ugccuguaaucccagcuacuggg

SEQ ID NO: 64548 - RNA, 24 nt, Human
guuucauagucuuugucuaacugc

SEQ ID NO: 64549 - RNA, 26 nt, Human
augaacacauggacuucuguuuauua

SEQ ID NO: 64550 - RNA, 26 nt, Human
aggaagggagacauauucuuggagaa

SEQ ID NO: 64551 - RNA, 19 nt, Human
uguuuacacacuugcagug

SEQ ID NO: 64552 - RNA, 25 nt, Human
uggcugcuggguggggccgggaaca

SEQ ID NO: 64553 - RNA, 26 nt, Human
uggaagagauggugaugggccugggc

SEQ ID NO: 64554 - RNA, 22 nt, Human
gucucaaacuccugaccucagg

SEQ ID NO: 64555 - RNA, 21 nt, Human
gcaaguagcugggauuacagg

SEQ ID NO: 64556 - RNA, 21 nt, Human
cugcaaccucugucucccggg

SEQ ID NO: 64557 - RNA, 19 nt, Human
ugaacacugcucaaacuuu

SEQ ID NO: 64558 - RNA, 26 nt, Human
gagguguagggguggaaugagccgcg

SEQ ID NO: 64559 - RNA, 20 nt, Human
uucgcauggaaaagccacuu

SEQ ID NO: 64560 - RNA, 18 nt, Human
ugguugcuaaugacagcc

SEQ ID NO: 64561 - RNA, 25 nt, Human
gccugggggcaaguuagcacuuuau

SEQ ID NO: 64562 - RNA, 22 nt, Human
aggugagcggaucacaagguca

SEQ ID NO: 64563 - RNA, 30 nt, Human
ugccuugacuuggcagaagguuaucucuag

SEQ ID NO: 64564 - RNA, 19 nt, Human
ggauacuggcacagaggua

SEQ ID NO: 64565 - RNA, 20 nt, Human
cccgcccugggcugcagccu

SEQ ID NO: 64566 - RNA, 21 nt, Human
gagagggugaagcggagcagc

SEQ ID NO: 64567 - RNA, 25 nt, Human
uggguggagagaggccgggggcugc

SEQ ID NO: 64568 - RNA, 22 nt, Human
caaguuuuaggacaaacagcuc

SEQ ID NO: 64569 - RNA, 22 nt, Human
caggagguuguggcugcaguga

SEQ ID NO: 64570 - RNA, 21 nt, Human
ccuguaaucuuaacacugugg

SEQ ID NO: 64571 - RNA, 22 nt, Human
uauuucugcuacuguugcugaa

SEQ ID NO: 64572 - RNA, 20 nt, Human
uuuugccaggcuggugcaaa

SEQ ID NO: 64573 - RNA, 20 nt, Human
cauuaaaauggaccuaucug

SEQ ID NO: 64574 - RNA, 21 nt, Human
aggagcuggggcagaggcuga

SEQ ID NO: 64575 - RNA, 24 nt, Human
uuguaacccaugugccagaugugu

SEQ ID NO: 64576 - RNA, 25 nt, Human
cuccauuuucuuauugcgcugcuac

SEQ ID NO: 64577 - RNA, 21 nt, Human
aaaauauaagaaauuagccgg

SEQ ID NO: 64578 - RNA, 24 nt, Human
ugucuucaaaagaagcauugcagc

SEQ ID NO: 64579 - RNA, 23 nt, Human
ccugcucuccucuugccacugcc

SEQ ID NO: 64580 - RNA, 24 nt, Human
acaaagccugguucuucaauuuuc

SEQ ID NO: 64581 - RNA, 21 nt, Human
gcgcuuuagggugcuggacug

SEQ ID NO: 64582 - RNA, 22 nt, Human
uggagcccugcuccucucuguc

SEQ ID NO: 64583 - RNA, 21 nt, Human
uagcuuuuauaaguacacuca

SEQ ID NO: 64584 - RNA, 21 nt, Human
ccuccuggccaagcaggcugg

SEQ ID NO: 64585 - RNA, 23 nt, Human
uaucauggagugacggucccaca

SEQ ID NO: 64586 - RNA, 24 nt, Human
gggguggcggccaggaggaaaggc

SEQ ID NO: 64587 - RNA, 22 nt, Human
gcauuuggagauucguggagaa

SEQ ID NO: 64588 - RNA, 22 nt, Human
ccucuauccacagcauucacaa

SEQ ID NO: 64589 - RNA, 20 nt, Human
ccuggcccuagugacagguu

SEQ ID NO: 64590 - RNA, 26 nt, Human
ucugccuccagcaggcuugagcuugc

SEQ ID NO: 64591 - RNA, 23 nt, Human
guccucaggccaccagaccccuc

SEQ ID NO: 64592 - RNA, 25 nt, Human
ccucaugcccaagagaucugugcca

SEQ ID NO: 64593 - RNA, 26 nt, Human
auccuugccacugcucuucccuugcu

SEQ ID NO: 64594 - RNA, 22 nt, Human
gaguggcgaggcgagcuuucca

SEQ ID NO: 64595 - RNA, 21 nt, Human
uguggagggugcccagcagac

SEQ ID NO: 64596 - RNA, 25 nt, Human
gugugaucaugguucacugcagucu

SEQ ID NO: 64597 - RNA, 24 nt, Human
aagucagaacucagaacacugccu

SEQ ID NO: 64598 - RNA, 24 nt, Human
acuguggguguagauuaccugcca

SEQ ID NO: 64599 - RNA, 26 nt, Human
ccuuucucaccccugugauuuggagg

SEQ ID NO: 64600 - RNA, 22 nt, Human
ccuccacugcugcucugcugcc

SEQ ID NO: 64601 - RNA, 22 nt, Human
gcucuuggagaguuucaggccu

SEQ ID NO: 64602 - RNA, 18 nt, Human
auuuuacacauguauuua

SEQ ID NO: 64603 - RNA, 22 nt, Human
cccugccugccacccuaggcag

SEQ ID NO: 64604 - RNA, 22 nt, Human
ccacucuggcccuaaaugcucc

SEQ ID NO: 64605 - RNA, 25 nt, Human
uggugagcauuacaggcaaggggaa

SEQ ID NO: 64606 - RNA, 26 nt, Human
aggaagggagaggcaagcaacuaggu

SEQ ID NO: 64607 - RNA, 20 nt, Human
aaaaggagaaaagccaagua

SEQ ID NO: 64608 - RNA, 27 nt, Human
cccaggaguuugaggcugcaaugagcc

SEQ ID NO: 64609 - RNA, 26 nt, Human
gcaagucccugacucucugugaccug

SEQ ID NO: 64610 - RNA, 22 nt, Human
gcaggcugagcacccuugcccg

SEQ ID NO: 64611 - RNA, 22 nt, Human
caagccuauaaucccagcaugu

SEQ ID NO: 64612 - RNA, 22 nt, Human
ucuccuaagcuggagugcagug

SEQ ID NO: 64613 - RNA, 24 nt, Human
aguagaauccacugauuuucugug

SEQ ID NO: 64614 - RNA, 23 nt, Human
cgcgaaacagcuuuccacacaau

SEQ ID NO: 64615 - RNA, 20 nt, Human
auggaaaaaugguugaugga

SEQ ID NO: 64616 - RNA, 25 nt, Human
acaguaacgugcauacauaucugca

SEQ ID NO: 64617 - RNA, 30 nt, Human
ggggucuuaccuugaacugaaggccacuug

SEQ ID NO: 64618 - RNA, 27 nt, Human
cccuccaggggacgcugaccuaggagg

SEQ ID NO: 64619 - RNA, 21 nt, Human
ccaugagguaaaagagccaag

SEQ ID NO: 64620 - RNA, 20 nt, Human
ggaagagacuaucacaaaaa

SEQ ID NO: 64621 - RNA, 20 nt, Human
aaacgucuccccugccaaag

SEQ ID NO: 64622 - RNA, 20 nt, Human
cuggcuucucacugccaccu

SEQ ID NO: 64623 - RNA, 21 nt, Human
cuaccccagagggaguuguca

SEQ ID NO: 64624 - RNA, 26 nt, Human
ugcauucuuauagaaacaaagcacaa

SEQ ID NO: 64625 - RNA, 22 nt, Human
uguuccuuaccuuucaugggcc

SEQ ID NO: 64626 - RNA, 20 nt, Human
aauaaaagcaccuguucucc

SEQ ID NO: 64627 - RNA, 22 nt, Human
gcccaggcugcagugcaguggu

SEQ ID NO: 64628 - RNA, 24 nt, Human
uauuuauccaaaauguaguugaca

SEQ ID NO: 64629 - RNA, 24 nt, Human
gacucaggcuggggucugcagugc

SEQ ID NO: 64630 - RNA, 23 nt, Human
uuggcacagaaguccugucugag

SEQ ID NO: 64631 - RNA, 21 nt, Human
ccugcugcuguccacgucagu

SEQ ID NO: 64632 - RNA, 22 nt, Human
gcuugcuuacccagacucagag

SEQ ID NO: 64633 - RNA, 23 nt, Human
ugagcugcugccgccgccgccuc

SEQ ID NO: 64634 - RNA, 23 nt, Human
auccucucuccaggccccagguc

SEQ ID NO: 64635 - RNA, 22 nt, Human
cucucuuccuucuuuuucuccc

SEQ ID NO: 64636 - RNA, 20 nt, Human
agagucuccuuucugcucca

SEQ ID NO: 64637 - RNA, 23 nt, Human
uggggacauccugggucaucuca

SEQ ID NO: 64638 - RNA, 22 nt, Human
ugcacacacauaaacggcuuug

SEQ ID NO: 64639 - RNA, 21 nt, Human
gcauggucaaugcgggagcga

SEQ ID NO: 64640 - RNA, 27 nt, Human
gccacugcagcaccugccacugccguc

SEQ ID NO: 64641 - RNA, 19 nt, Human
cacugcaacgccugccucu

SEQ ID NO: 64642 - RNA, 21 nt, Human
aaugauuccuuuauucuagca

SEQ ID NO: 64643 - RNA, 22 nt, Human
accuguaaucccagcacuuugg

SEQ ID NO: 64644 - RNA, 27 nt, Human
cuggccuggcccugagacuggggagug

SEQ ID NO: 64645 - RNA, 21 nt, Human
gcccaaaucucuguuugcuga

SEQ ID NO: 64646 - RNA, 20 nt, Human
gccuguaauccagcacuuug

SEQ ID NO: 64647 - RNA, 28 nt, Human
gggaugaucaacagggcaguguggucuc

SEQ ID NO: 64648 - RNA, 28 nt, Human
ucacauuccagacaauggagaguguuua

SEQ ID NO: 64649 - RNA, 26 nt, Human
guuuuuaaaaaaggaagcuuggucca

SEQ ID NO: 64650 - RNA, 25 nt, Human
aagcugaggcaggaggauuacuuga

SEQ ID NO: 64651 - RNA, 21 nt, Human
gcagugagccauaaucgugcc

SEQ ID NO: 64652 - RNA, 25 nt, Human
gcacagccagguucccccagacccc

SEQ ID NO: 64653 - RNA, 27 nt, Human
ccaggcauuugagaccagccuggguaa

SEQ ID NO: 64654 - RNA, 20 nt, Human
gggaagcagaggcuggagga

SEQ ID NO: 64655 - RNA, 23 nt, Human
cuaguaugucaaugccuaccauu

SEQ ID NO: 64656 - RNA, 23 nt, Human
accaugaaaauuaaagagugaag

SEQ ID NO: 64657 - RNA, 26 nt, Human
acccugacagucuccuuccagcucuc

SEQ ID NO: 64658 - RNA, 22 nt, Human
augggaaugccuuuucccucug

SEQ ID NO: 64659 - RNA, 24 nt, Human
agauguaaacgcagcgugugccca

SEQ ID NO: 64660 - RNA, 22 nt, Human
gccggccgccgggcacuuccug

SEQ ID NO: 64661 - RNA, 22 nt, Human
ucugggagguauguacccaucu

SEQ ID NO: 64662 - RNA, 20 nt, Human
ccacagcagcugaacagcca

SEQ ID NO: 64663 - RNA, 27 nt, Human
guugcccaagcuggagugcaauggcgc

SEQ ID NO: 64664 - RNA, 22 nt, Human
ucugucgcccaggcuggagugc

SEQ ID NO: 64665 - RNA, 22 nt, Human
ucuguugcccaggcuggagugu

SEQ ID NO: 64666 - RNA, 24 nt, Human
gcugccugguauauccaaaagcuu

SEQ ID NO: 64667 - RNA, 22 nt, Human
agcagucuugcucuguuaccca

SEQ ID NO: 64668 - RNA, 22 nt, Human
guggucuauacuauacuguggu

SEQ ID NO: 64669 - RNA, 27 nt, Human
gaucuaagggaagaucacuguaguuua

SEQ ID NO: 64670 - RNA, 23 nt, Human
cacugccuccuggguucagguga

SEQ ID NO: 64671 - RNA, 21 nt, Human
caguuugauuuauuuuguuac

SEQ ID NO: 64672 - RNA, 24 nt, Human
aucaggacuaggcuggagucuggc

SEQ ID NO: 64673 - RNA, 23 nt, Human
uggaucugcuuguugcauuucca

SEQ ID NO: 64674 - RNA, 22 nt, Human
cgcccccuggguucaagcaauu

SEQ ID NO: 64675 - RNA, 24 nt, Human
gcucacugcaugaagacuggcuug

SEQ ID NO: 64676 - RNA, 21 nt, Human
acaaugaaaagcagaaugaaa

SEQ ID NO: 64677 - RNA, 21 nt, Human
ccacaucugcuggcucugggg

SEQ ID NO: 64678 - RNA, 23 nt, Human
gguaggaguaugaggcagaguga

SEQ ID NO: 64679 - RNA, 23 nt, Human
guacuaaaaggcagaaaggucau

SEQ ID NO: 64680 - RNA, 27 nt, Human
uugggacugaaggggaaccccggggug

SEQ ID NO: 64681 - RNA, 21 nt, Human
ccaggcuuugauaucugugau

SEQ ID NO: 64682 - RNA, 26 nt, Human
cucuaaccauaacacaggagaauugg

SEQ ID NO: 64683 - RNA, 19 nt, Human
uguguaauucucuuugcca

SEQ ID NO: 64684 - RNA, 28 nt, Human
ucaucuauauauucuauaugaaaaauau

SEQ ID NO: 64685 - RNA, 23 nt, Human
acuuuugcuccgaagcuacuucu

SEQ ID NO: 64686 - RNA, 26 nt, Human
uuaaggcugucuaaaaugugaugucu

SEQ ID NO: 64687 - RNA, 23 nt, Human
cuaucucuucgcucugucuucca

SEQ ID NO: 64688 - RNA, 23 nt, Human
augagacccagcugauugcacua

SEQ ID NO: 64689 - RNA, 18 nt, Human
guuccccagggcugcacu

SEQ ID NO: 64690 - RNA, 21 nt, Human
guccuccuccuggaucuuuag

SEQ ID NO: 64691 - RNA, 31 nt, Human
agaugccuccccaccaccaauugccaaaggu

SEQ ID NO: 64692 - RNA, 23 nt, Human
cuuuagcugaucagaucucucca

SEQ ID NO: 64693 - RNA, 20 nt, Human
cgcuccacauggugcaagag

SEQ ID NO: 64694 - RNA, 24 nt, Human
ucaacuauaaauggagauaauggu

SEQ ID NO: 64695 - RNA, 27 nt, Human
ucagccggcccuggagugcgggcgggg

SEQ ID NO: 64696 - RNA, 22 nt, Human
gacuuagugguccucuguugcu

SEQ ID NO: 64697 - RNA, 21 nt, Human
aaucaaauacauuuuaagcaa

SEQ ID NO: 64698 - RNA, 24 nt, Human
cgacuucagcagacucaccucugg

SEQ ID NO: 64699 - RNA, 22 nt, Human
ucuuccuuccagcuuucacuuc

SEQ ID NO: 64700 - RNA, 24 nt, Human
ccaccccuauacccuaggucucca

SEQ ID NO: 64701 - RNA, 22 nt, Human
ggccagaugcaaugaucuuuaa

SEQ ID NO: 64702 - RNA, 22 nt, Human
ugcuguuugguggucugccuuc

SEQ ID NO: 64703 - RNA, 25 nt, Human
gagguacaggguuuuaccugucaca

SEQ ID NO: 64704 - RNA, 27 nt, Human
uccuagguaauuuuuuaaaagccaguc

SEQ ID NO: 64705 - RNA, 21 nt, Human
aaucuacuuucauuguuaaca

SEQ ID NO: 64706 - RNA, 22 nt, Human
gugagugggugggauggggaca

SEQ ID NO: 64707 - RNA, 21 nt, Human
gccccuggcccaggaggagga

SEQ ID NO: 64708 - RNA, 27 nt, Human
ccgugccuuagucuucuccacucugca

SEQ ID NO: 64709 - RNA, 19 nt, Human
cagccuaucagugauugcc

SEQ ID NO: 64710 - RNA, 22 nt, Human
caucacgagauaagcaugaugg

SEQ ID NO: 64711 - RNA, 21 nt, Human
agcuuugaaaggaaaguaugu

SEQ ID NO: 64712 - RNA, 21 nt, Human
acugacaccugagcagugucc

SEQ ID NO: 64713 - RNA, 22 nt, Human
ugcuuccucuaggaacacagga

SEQ ID NO: 64714 - RNA, 16 nt, Human
cuaggccuacaagcac

SEQ ID NO: 64715 - RNA, 22 nt, Human
gggagcuugaggacacuguggu

SEQ ID NO: 64716 - RNA, 24 nt, Human
cacuuccuucagaaggaacuguua

SEQ ID NO: 64717 - RNA, 24 nt, Human
ccaugcgagcccuucuccugcugc

SEQ ID NO: 64718 - RNA, 22 nt, Human
guugcccaggcuagucuggaac

SEQ ID NO: 64719 - RNA, 20 nt, Human
gucgcccaggcuagagugga

SEQ ID NO: 64720 - RNA, 27 nt, Human
cccacccaggccuggagcugggaugca

SEQ ID NO: 64721 - RNA, 24 nt, Human
auccucuggcuauuuaagguucaa

SEQ ID NO: 64722 - RNA, 26 nt, Human
aacauuugcaaaauggaaauguaaua

SEQ ID NO: 64723 - RNA, 24 nt, Human
agccggaauggagggcagagguga

SEQ ID NO: 64724 - RNA, 21 nt, Human
uuaauaaaauauuuuuaaagg

SEQ ID NO: 64725 - RNA, 21 nt, Human
auaucccacugggagcacuuu

SEQ ID NO: 64726 - RNA, 22 nt, Human
uucagcaccagagcacgugaug

SEQ ID NO: 64727 - RNA, 25 nt, Human
ugugggcaaggcccaggaaucugga

SEQ ID NO: 64728 - RNA, 21 nt, Human
agagccagcccucccuguccu

SEQ ID NO: 64729 - RNA, 26 nt, Human
gcugcacucucaccuggaggcuccgg

SEQ ID NO: 64730 - RNA, 21 nt, Human
ucacaauaaggaagaaauaac

SEQ ID NO: 64731 - RNA, 23 nt, Human
gcugagacgaacgcuucacuggg

SEQ ID NO: 64732 - RNA, 21 nt, Human
ugccuggcagaacauaccacu

SEQ ID NO: 64733 - RNA, 23 nt, Human
auccgagaguuccccuuagagaa

SEQ ID NO: 64734 - RNA, 23 nt, Human
uccuuggacagaggccugggccc

SEQ ID NO: 64735 - RNA, 21 nt, Human
accagcgugagugguggagga

SEQ ID NO: 64736 - RNA, 21 nt, Human
uuauagaagcagaugaucugu

SEQ ID NO: 64737 - RNA, 20 nt, Human
ggucugggcaggggcagcag

SEQ ID NO: 64738 - RNA, 27 nt, Human
gucucaaacucuuggccucaagggauc

SEQ ID NO: 64739 - RNA, 20 nt, Human
gaacaaaauccacagaugca

SEQ ID NO: 64740 - RNA, 23 nt, Human
agcacagcacaggggcucagccu

SEQ ID NO: 64741 - RNA, 23 nt, Human
ggccccuggccccgccugccugc

SEQ ID NO: 64742 - RNA, 27 nt, Human
cccugcucucagccauagugaaggacc

SEQ ID NO: 64743 - RNA, 18 nt, Human
ucauacuuccucugugag

SEQ ID NO: 64744 - RNA, 22 nt, Human
ccccugagcccagcagccgcgg

SEQ ID NO: 64745 - RNA, 24 nt, Human
gccccuucuacacucuccugggcc

SEQ ID NO: 64746 - RNA, 27 nt, Human
uggaaugggacaggcagcucuagucag

SEQ ID NO: 64747 - RNA, 28 nt, Human
aggcagcccagccccggccucccagcuu

SEQ ID NO: 64748 - RNA, 26 nt, Human
ucagccaggcuggagcaagguaccuu

SEQ ID NO: 64749 - RNA, 27 nt, Human
gccuugggccuuggggcucagccacag

SEQ ID NO: 64750 - RNA, 23 nt, Human
ccuuuccuccuucugggugccca

SEQ ID NO: 64751 - RNA, 27 nt, Human
uguugaccaggcuggagugaaguggug

SEQ ID NO: 64752 - RNA, 23 nt, Human
ucucacugcuguuuuuaugauuc

SEQ ID NO: 64753 - RNA, 19 nt, Human
uccauucaacaagggugca

SEQ ID NO: 64754 - RNA, 22 nt, Human
ccuuucccacccuccugcccca

SEQ ID NO: 64755 - RNA, 26 nt, Human
gaaaccagaaauguguuccuuauuuc

SEQ ID NO: 64756 - RNA, 22 nt, Human
caccauuccuuuaaauucucca

SEQ ID NO: 64757 - RNA, 20 nt, Human
ugacuauucuguaucuuuca

SEQ ID NO: 64758 - RNA, 31 nt, Human
gcaagagaaacugugugugaggggaagaggc

SEQ ID NO: 64759 - RNA, 26 nt, Human
uccauccugaauuuaucaaguaguuc

SEQ ID NO: 64760 - RNA, 22 nt, Human
ccuguugucuacaccaaugccc

SEQ ID NO: 64761 - RNA, 22 nt, Human
ugacuugcucagguuuuuugcc

SEQ ID NO: 64762 - RNA, 25 nt, Human
ggugugaccgcuuggcggcuggugg

SEQ ID NO: 64763 - RNA, 26 nt, Human
uugcuauuucuaaauaccacuuuccu

SEQ ID NO: 64764 - RNA, 23 nt, Human
gcagugugacauggacuugcugu

SEQ ID NO: 64765 - RNA, 21 nt, Human
uuuagcuaauaguaguuuaca

SEQ ID NO: 64766 - RNA, 19 nt, Human
gccgcauuugauguggagg

SEQ ID NO: 64767 - RNA, 21 nt, Human
cuugcuuccuuccuccuggcu

SEQ ID NO: 64768 - RNA, 27 nt, Human
ugagucacacaggacagaggaggcaga

SEQ ID NO: 64769 - RNA, 26 nt, Human
ugucaucauucuucauggacuccuuu

SEQ ID NO: 64770 - RNA, 23 nt, Human
uaaagaaguuuccagaaacuuug

SEQ ID NO: 64771 - RNA, 21 nt, Human
gcucagaaagucaagauagga

SEQ ID NO: 64772 - RNA, 27 nt, Human
ucugcacucuaacccuaggcaucacau

SEQ ID NO: 64773 - RNA, 19 nt, Human
ggagagggaccaggggugc

SEQ ID NO: 64774 - RNA, 22 nt, Human
ccagacugaagugcaguggcac

SEQ ID NO: 64775 - RNA, 22 nt, Human
ugcuagugcgcuccagccuggg

SEQ ID NO: 64776 - RNA, 21 nt, Human
guauguauuauuuacauuuaa

SEQ ID NO: 64777 - RNA, 25 nt, Human
ccaccucccuuuucucagccuaacu

SEQ ID NO: 64778 - RNA, 29 nt, Human
ggguccggagcggcuggaggagcgcagug

SEQ ID NO: 64779 - RNA, 27 nt, Human
uugccuguugccagacuggagugcagu

SEQ ID NO: 64780 - RNA, 20 nt, Human
cggcggccaugauggugcug

SEQ ID NO: 64781 - RNA, 22 nt, Human
cugugggcauccaccucccagg

SEQ ID NO: 64782 - RNA, 20 nt, Human
ugaaaacagacauuccagug

SEQ ID NO: 64783 - RNA, 21 nt, Human
uuauuccucuuguuuuaugga

SEQ ID NO: 64784 - RNA, 21 nt, Human
uugggcauggacuaauuugua

SEQ ID NO: 64785 - RNA, 25 nt, Human
gaaaacagaaaugcccuugauggug

SEQ ID NO: 64786 - RNA, 20 nt, Human
ggaaguggcuguccugaauu

SEQ ID NO: 64787 - RNA, 23 nt, Human
caggcugggaugagcugugugcu

SEQ ID NO: 64788 - RNA, 22 nt, Human
gucagcuuucaggggagaagga

SEQ ID NO: 64789 - RNA, 20 nt, Human
agacagaaccaaaugagcua

SEQ ID NO: 64790 - RNA, 24 nt, Human
agacagauggagaagcuggcagau

SEQ ID NO: 64791 - RNA, 20 nt, Human
gccucugccagacacacacu

SEQ ID NO: 64792 - RNA, 27 nt, Human
gcgugagccaccucgcccagcggcauc

SEQ ID NO: 64793 - RNA, 24 nt, Human
uucacuacucaguuuaucagcuca

SEQ ID NO: 64794 - RNA, 18 nt, Human
cugugccucaguuuaccc

SEQ ID NO: 64795 - RNA, 22 nt, Human
cgaaccucugggcucaagcaau

SEQ ID NO: 64796 - RNA, 23 nt, Human
ugcugugggccaaaaucaugcca

SEQ ID NO: 64797 - RNA, 24 nt, Human
uuuagcuaauuaccaaggagauug

SEQ ID NO: 64798 - RNA, 18 nt, Human
ucaguuucccuaucugca

SEQ ID NO: 64799 - RNA, 21 nt, Human
ugcuucuuauaagacuaaaug

SEQ ID NO: 64800 - RNA, 26 nt, Human
uucucaucuucucaucccuaggacaa

SEQ ID NO: 64801 - RNA, 27 nt, Human
gagauguuuucuacauauuucugcucu

SEQ ID NO: 64802 - RNA, 17 nt, Human
cugcucucuccucucuc

SEQ ID NO: 64803 - RNA, 21 nt, Human
uaaacuagcuaaaaccaaagg

SEQ ID NO: 64804 - RNA, 23 nt, Human
gcccaggccuugggaccuggggg

SEQ ID NO: 64805 - RNA, 20 nt, Human
cuccaggcugacaccagcag

SEQ ID NO: 64806 - RNA, 22 nt, Human
ucagacuggcuggcugcaguga

SEQ ID NO: 64807 - RNA, 22 nt, Human
aggcugaggcaggaaaauugcu

SEQ ID NO: 64808 - RNA, 24 nt, Human
auggaaaugaccuccuggcaccag

SEQ ID NO: 64809 - RNA, 21 nt, Human
aauugagcaaccuacgcacuc

SEQ ID NO: 64810 - RNA, 23 nt, Human
aaauuauuuuaaacugugcucaa

SEQ ID NO: 64811 - RNA, 19 nt, Human
accccuccacaugcaccug

SEQ ID NO: 64812 - RNA, 32 nt, Human
gcacaugcacacaggugcacagaccacacagc

SEQ ID NO: 64813 - RNA, 27 nt, Human
cuaauacccaaacccuaaaccucuuca

SEQ ID NO: 64814 - RNA, 22 nt, Human
caccuguaauaccagcaguuug

SEQ ID NO: 64815 - RNA, 20 nt, Human
gccccuagcuggcaucuugc

SEQ ID NO: 64816 - RNA, 23 nt, Human
uggcacagcuguggcgccuccca

SEQ ID NO: 64817 - RNA, 24 nt, Human
cugucgcccaggcuggagugcagu

SEQ ID NO: 64818 - RNA, 24 nt, Human
cugucacccaggcuggagugcggu

SEQ ID NO: 64819 - RNA, 22 nt, Human
cuuucuccuucccaaaaagcuu

SEQ ID NO: 64820 - RNA, 25 nt, Human
aaacccccaccuuccaguucccuca

SEQ ID NO: 64821 - RNA, 23 nt, Human
aagcuugugggcucugaggaggg

SEQ ID NO: 64822 - RNA, 24 nt, Human
cugggcugccggguucuagucucc

SEQ ID NO: 64823 - RNA, 26 nt, Human
ccacagggauccccaggaugcccacu

SEQ ID NO: 64824 - RNA, 26 nt, Human
uguccucuccccuccagccuuuggcc

SEQ ID NO: 64825 - RNA, 23 nt, Human
gcgaauucuuuuucuuuuucuau

SEQ ID NO: 64826 - RNA, 20 nt, Human
agucagcugggaauauuguu

SEQ ID NO: 64827 - RNA, 27 nt, Human
ugccucccuggcugugucuuucuugag

SEQ ID NO: 64828 - RNA, 24 nt, Human
cucaaacaggccaucagcauccgg

SEQ ID NO: 64829 - RNA, 23 nt, Human
cacacucacagauguuugaggcu

SEQ ID NO: 64830 - RNA, 23 nt, Human
gacugaugcuggaauuacuccug

SEQ ID NO: 64831 - RNA, 21 nt, Human
gucgcccaggcuggaaugcag

SEQ ID NO: 64832 - RNA, 26 nt, Human
cucccccaucuccaucaggaaaaaua

SEQ ID NO: 64833 - RNA, 23 nt, Human
cccaccccaccugggcccagcca

SEQ ID NO: 64834 - RNA, 23 nt, Human
guucaguguuuugaaaauauuca

SEQ ID NO: 64835 - RNA, 19 nt, Human
cugugcgggaacucugagu

SEQ ID NO: 64836 - RNA, 22 nt, Human
gaaggugggaagagcauuugua

SEQ ID NO: 64837 - RNA, 27 nt, Human
cugcacagcuggaugguggaagcaguu

SEQ ID NO: 64838 - RNA, 24 nt, Human
cgaacuccuggauuucaggacaag

SEQ ID NO: 64839 - RNA, 30 nt, Human
ccucuugguacugcugaccccagccaggcu

SEQ ID NO: 64840 - RNA, 27 nt, Human
ugccagugccauuuugauaucaaucuc

SEQ ID NO: 64841 - RNA, 24 nt, Human
ccgcgccccgaggucuccgcggcc

SEQ ID NO: 64842 - RNA, 20 nt, Human
ccaaacuccgccccaaaaag

SEQ ID NO: 64843 - RNA, 22 nt, Human
ccuguaauccuagcacuuuugg

SEQ ID NO: 64844 - RNA, 20 nt, Human
caugaacauuggcuaugaug

SEQ ID NO: 64845 - RNA, 20 nt, Human
gccucaaacccugggguagg

SEQ ID NO: 64846 - RNA, 18 nt, Human
gccagagaagaaaaagaa

SEQ ID NO: 64847 - RNA, 24 nt, Human
gccucuuccacucuggagugaagu

SEQ ID NO: 64848 - RNA, 21 nt, Human
gcuguuucccuuucuauucug

SEQ ID NO: 64849 - RNA, 21 nt, Human
gcaccuugcugcaguguccag

SEQ ID NO: 64850 - RNA, 20 nt, Human
agaaagcucugcaugugugu

SEQ ID NO: 64851 - RNA, 23 nt, Human
ucacaugacuaagccaagaggaa

SEQ ID NO: 64852 - RNA, 24 nt, Human
gcugaggagagaggaggcggcggc

SEQ ID NO: 64853 - RNA, 25 nt, Human
ggcuccacccucuuuagcuguuaau

SEQ ID NO: 64854 - RNA, 26 nt, Human
gccuggaacagugucuggugcacaua

SEQ ID NO: 64855 - RNA, 23 nt, Human
ucuguacuuuguguuuagcuacc

SEQ ID NO: 64856 - RNA, 25 nt, Human
uauguuaguaacaaucuugcagccu

SEQ ID NO: 64857 - RNA, 24 nt, Human
ucucugggccagagcgagccuguu

SEQ ID NO: 64858 - RNA, 22 nt, Human
cacugcugaggagucugaggac

SEQ ID NO: 64859 - RNA, 26 nt, Human
gugggggguggagggggaaugacaga

SEQ ID NO: 64860 - RNA, 21 nt, Human
aagaguuuguuaccuaccuua

SEQ ID NO: 64861 - RNA, 20 nt, Human
ugcuuuugggagacuggaaa

SEQ ID NO: 64862 - RNA, 19 nt, Human
gccuuugagaaaugaauga

SEQ ID NO: 64863 - RNA, 27 nt, Human
cacugguuuguucccugugucauuuca

SEQ ID NO: 64864 - RNA, 24 nt, Human
aacugugaagagaaugaugcagga

SEQ ID NO: 64865 - RNA, 21 nt, Human
cuccaggccucagcaggugcg

SEQ ID NO: 64866 - RNA, 25 nt, Human
acggcugcugcgcccgcggcucccc

SEQ ID NO: 64867 - RNA, 21 nt, Human
gggagagagaaaaagcugaga

SEQ ID NO: 64868 - RNA, 25 nt, Human
ugccucucaagccuugacucccugg

SEQ ID NO: 64869 - RNA, 22 nt, Human
aucccuuagaacccugcucaga

SEQ ID NO: 64870 - RNA, 23 nt, Human
ccugcugcuguuuaguucuccuu

SEQ ID NO: 64871 - RNA, 25 nt, Human
agaacauucagcagcaggugcuuuu

SEQ ID NO: 64872 - RNA, 26 nt, Human
ucuccuccuucucugccuguuucccu

SEQ ID NO: 64873 - RNA, 25 nt, Human
ggguggaucacaaggucaagagaua

SEQ ID NO: 64874 - RNA, 23 nt, Human
cacaggcaaacugucagaaaaga

SEQ ID NO: 64875 - RNA, 21 nt, Human
ggaguagggguauagcuuggg

SEQ ID NO: 64876 - RNA, 21 nt, Human
gcacaucuccagaaaaaugaa

SEQ ID NO: 64877 - RNA, 23 nt, Human
uccagccaaagccuccuccagcc

SEQ ID NO: 64878 - RNA, 25 nt, Human
gucuagggcaggaguccagcggaga

SEQ ID NO: 64879 - RNA, 22 nt, Human
guggacucugugcucacugggu

SEQ ID NO: 64880 - RNA, 24 nt, Human
uucaucuucccauucuuuuacuua

SEQ ID NO: 64881 - RNA, 21 nt, Human
accugcgcagcccccuccucc

SEQ ID NO: 64882 - RNA, 27 nt, Human
gguccccgggaggcuagagaucaugga

SEQ ID NO: 64883 - RNA, 23 nt, Human
cucuagccgggccaugcuuuccu

SEQ ID NO: 64884 - RNA, 27 nt, Human
aauaagaaaguuucacccaauaaaaua

SEQ ID NO: 64885 - RNA, 21 nt, Human
ggagggggagcaucccaccca

SEQ ID NO: 64886 - RNA, 22 nt, Human
ccuggcauagagucaccuguua

SEQ ID NO: 64887 - RNA, 23 nt, Human
accucuuuuuccuccuggacaca

SEQ ID NO: 64888 - RNA, 23 nt, Human
cccuucaggauuaauccucuugc

SEQ ID NO: 64889 - RNA, 24 nt, Human
uccucaccccuguccucacugcuc

SEQ ID NO: 64890 - RNA, 22 nt, Human
acccggaggcagcggaggcagg

SEQ ID NO: 64891 - RNA, 20 nt, Human
gggccuccugccuuccuccc

SEQ ID NO: 64892 - RNA, 27 nt, Human
ggucuugaacuccugaccuugugaucc

SEQ ID NO: 64893 - RNA, 26 nt, Human
ugagccagaccugcagagugggaagc

SEQ ID NO: 64894 - RNA, 25 nt, Human
gggaucuaccuugggucuuacuuga

SEQ ID NO: 64895 - RNA, 27 nt, Human
cugcuuucugugccuaguugaacggca

SEQ ID NO: 64896 - RNA, 20 nt, Human
agaugauuuguaacuucucu

SEQ ID NO: 64897 - RNA, 19 nt, Human
guccaccuucucccucucc

SEQ ID NO: 64898 - RNA, 21 nt, Human
caguucaucuccccuguucag

SEQ ID NO: 64899 - RNA, 21 nt, Human
caugucgggcgaugcuuggaa

SEQ ID NO: 64900 - RNA, 20 nt, Human
uuuucucucugucuuuggcc

SEQ ID NO: 64901 - RNA, 18 nt, Human
ucagcacuccuuuaugga

SEQ ID NO: 64902 - RNA, 26 nt, Human
gggaauuggcacaguggaugacggca

SEQ ID NO: 64903 - RNA, 22 nt, Human
augggaaaguagaucuaaauuu

SEQ ID NO: 64904 - RNA, 24 nt, Human
cauugccauccacugcagacgccu

SEQ ID NO: 64905 - RNA, 24 nt, Human
guuuuguuugcuauucuguguguc

SEQ ID NO: 64906 - RNA, 31 nt, Human
ugcugauuggcuggggaggcccccgcccuuu

SEQ ID NO: 64907 - RNA, 22 nt, Human
agcuuccuaaguagcuggguuu

SEQ ID NO: 64908 - RNA, 21 nt, Human
cauggagcagcgcacgcccag

SEQ ID NO: 64909 - RNA, 19 nt, Human
gugagguggcaggagcagc

SEQ ID NO: 64910 - RNA, 17 nt, Human
aaacuagccaaaaggca

SEQ ID NO: 64911 - RNA, 24 nt, Human
cccaacaacauuaaaaaauacucg

SEQ ID NO: 64912 - RNA, 20 nt, Human
aucuuagugguuccccaccg

SEQ ID NO: 64913 - RNA, 26 nt, Human
ugcccaggcagaggagaauggggucu

SEQ ID NO: 64914 - RNA, 25 nt, Human
cuguaaucccaggagaauugcuuga

SEQ ID NO: 64915 - RNA, 22 nt, Human
cugcaaccuccuccuccuggau

SEQ ID NO: 64916 - RNA, 20 nt, Human
ggggguugggguuucugcca

SEQ ID NO: 64917 - RNA, 24 nt, Human
cucuccucagucugaacuaaggcu

SEQ ID NO: 64918 - RNA, 31 nt, Human
gcugggauuucuuccuuuuuauucauucuuu

SEQ ID NO: 64919 - RNA, 23 nt, Human
cccaguauuaucuuacuugcaaa

SEQ ID NO: 64920 - RNA, 24 nt, Human
ccauguauaucuguggaauacuca

SEQ ID NO: 64921 - RNA, 24 nt, Human
ggcugggaagugaaacggagccag

SEQ ID NO: 64922 - RNA, 22 nt, Human
accagccuggccaccuuaguga

SEQ ID NO: 64923 - RNA, 22 nt, Human
ccccuucuugcaggucucagcu

SEQ ID NO: 64924 - RNA, 20 nt, Human
uccuacuuugcuucucucca

SEQ ID NO: 64925 - RNA, 21 nt, Human
aaaaacaaugauaaagaugug

SEQ ID NO: 64926 - RNA, 23 nt, Human
acuguaaccugauucauccuggg

SEQ ID NO: 64927 - RNA, 17 nt, Human
uccaguaacuuuuuugu

SEQ ID NO: 64928 - RNA, 28 nt, Human
ccgggaggcagagguugcagugugguga

SEQ ID NO: 64929 - RNA, 21 nt, Human
gcccacuggggucuaugauuu

SEQ ID NO: 64930 - RNA, 27 nt, Human
auggaaagacagacucuggacagcugc

SEQ ID NO: 64931 - RNA, 28 nt, Human
ccauguggcugccccauuuauccaccuc

SEQ ID NO: 64932 - RNA, 21 nt, Human
guuaaagguguuuuguuuucu

SEQ ID NO: 64933 - RNA, 24 nt, Human
gucacugauuaguucccacuuggu

SEQ ID NO: 64934 - RNA, 27 nt, Human
cugcuucccaguccugccugaacagcc

SEQ ID NO: 64935 - RNA, 22 nt, Human
gaauccaggaggcggagguugc

SEQ ID NO: 64936 - RNA, 23 nt, Human
gggaaaggaaaagacucauauca

SEQ ID NO: 64937 - RNA, 20 nt, Human
ccacuucuucucagaaaaga

SEQ ID NO: 64938 - RNA, 26 nt, Human
ucauccuauuuacugcagcaaaucuc

SEQ ID NO: 64939 - RNA, 22 nt, Human
ggucccuggcugggagcagggc

SEQ ID NO: 64940 - RNA, 22 nt, Human
gcgcggcgccggcuccuccugc

SEQ ID NO: 64941 - RNA, 20 nt, Human
auguggucagaagugacaua

SEQ ID NO: 64942 - RNA, 27 nt, Human
caggcagcaagggcucuggguuugcag

SEQ ID NO: 64943 - RNA, 20 nt, Human
caguaacaacagaaacccca

SEQ ID NO: 64944 - RNA, 27 nt, Human
ucuguucucacaccugugcgcagguuu

SEQ ID NO: 64945 - RNA, 21 nt, Human
gcagcagcugugugcgggccu

SEQ ID NO: 64946 - RNA, 22 nt, Human
cugaaagagaaagauaggagga

SEQ ID NO: 64947 - RNA, 23 nt, Human
cucauaaggacuuggacaacuca

SEQ ID NO: 64948 - RNA, 22 nt, Human
ugugacccagcccucaccgucc

SEQ ID NO: 64949 - RNA, 24 nt, Human
gggaggguggaggggugacagugg

SEQ ID NO: 64950 - RNA, 27 nt, Human
agucagaccucagcaauauaggaggca

SEQ ID NO: 64951 - RNA, 22 nt, Human
acggcagggcaugaccugggga

SEQ ID NO: 64952 - RNA, 22 nt, Human
ugaaguacugacacaugcugug

SEQ ID NO: 64953 - RNA, 21 nt, Human
uagaaucccuuccugccuugu

SEQ ID NO: 64954 - RNA, 22 nt, Human
gaauggggcugcucugagggaa

SEQ ID NO: 64955 - RNA, 31 nt, Human
ccugggugucauuucucagaacugccguagu

SEQ ID NO: 64956 - RNA, 21 nt, Human
aucuuauuuuuauuuacuuga

SEQ ID NO: 64957 - RNA, 21 nt, Human
cccauagccaggaaacucugc

SEQ ID NO: 64958 - RNA, 27 nt, Human
auggacgugucugcacaggguccucag

SEQ ID NO: 64959 - RNA, 20 nt, Human
cuccugggccugcugccugc

SEQ ID NO: 64960 - RNA, 21 nt, Human
ggacuacacccaagccugauc

SEQ ID NO: 64961 - RNA, 18 nt, Human
uauacuuccucauucaua

SEQ ID NO: 64962 - RNA, 24 nt, Human
aaggcuguauccacaugguacaag

SEQ ID NO: 64963 - RNA, 21 nt, Human
ugccaaacacuguugugccau

SEQ ID NO: 64964 - RNA, 22 nt, Human
gguacuuggaaaaauggacaag

SEQ ID NO: 64965 - RNA, 20 nt, Human
uuugacauccaaaaagccuu

SEQ ID NO: 64966 - RNA, 22 nt, Human
acgaaaaccaccaugggaaaca

SEQ ID NO: 64967 - RNA, 21 nt, Human
auugcccaggguggucucaaa

SEQ ID NO: 64968 - RNA, 23 nt, Human
agguagagggguggggguuggug

SEQ ID NO: 64969 - RNA, 20 nt, Human
agcuagcaauuccuuuuucu

SEQ ID NO: 64970 - RNA, 20 nt, Human
uaccccucugccccuagcca

SEQ ID NO: 64971 - RNA, 30 nt, Human
gacucauaacugcaacuucacaguauagua

SEQ ID NO: 64972 - RNA, 23 nt, Human
ucucacuuuguaacccaggcugg

SEQ ID NO: 64973 - RNA, 27 nt, Human
gugggagccaucugguacuuugacagc

SEQ ID NO: 64974 - RNA, 23 nt, Human
ucagcauucuguacuuuugcuuc

SEQ ID NO: 64975 - RNA, 27 nt, Human
uugucauaaccuuucaauaaauaaaac

SEQ ID NO: 64976 - RNA, 21 nt, Human
cacacagcuuauaacauguau

SEQ ID NO: 64977 - RNA, 22 nt, Human
accuacgaucacagcacuucgg

SEQ ID NO: 64978 - RNA, 21 nt, Human
cugcaaaacggguacagcauu

SEQ ID NO: 64979 - RNA, 21 nt, Human
ucuucugugugucucugcuau

SEQ ID NO: 64980 - RNA, 25 nt, Human
agccauucuugauuggaccucauag

SEQ ID NO: 64981 - RNA, 21 nt, Human
guuugagaccagccugggcaa

SEQ ID NO: 64982 - RNA, 24 nt, Human
aaauccuggaagacaacccaggca

SEQ ID NO: 64983 - RNA, 19 nt, Human
cuucccuuuaauccugcca

SEQ ID NO: 64984 - RNA, 18 nt, Human
gccuugugucagcagguc

SEQ ID NO: 64985 - RNA, 21 nt, Human
gggcuuaugccuuacucucag

SEQ ID NO: 64986 - RNA, 21 nt, Human
ugggcagccgcuauugucuac

SEQ ID NO: 64987 - RNA, 21 nt, Human
acacaaaaaucagauuuagua

SEQ ID NO: 64988 - RNA, 20 nt, Human
cuugucugccuuccuuucca

SEQ ID NO: 64989 - RNA, 21 nt, Human
gguugggcuuggcccucucug

SEQ ID NO: 64990 - RNA, 22 nt, Human
gaacccaggagguggagguuac

SEQ ID NO: 64991 - RNA, 27 nt, Human
auuauaugauuugucugcacucaguuu

SEQ ID NO: 64992 - RNA, 26 nt, Human
gcagaagcucucccucccuacucccu

SEQ ID NO: 64993 - RNA, 25 nt, Human
aguugaaugcagaugccugugccca

SEQ ID NO: 64994 - RNA, 27 nt, Human
gaacugacaggacaauguuuuuagguu

SEQ ID NO: 64995 - RNA, 21 nt, Human
agaacagauguauuacacuaa

SEQ ID NO: 64996 - RNA, 21 nt, Human
uggcugcugucauggcaccuc

SEQ ID NO: 64997 - RNA, 23 nt, Human
gccucugcucccaacuucgccag

SEQ ID NO: 64998 - RNA, 27 nt, Human
aucuccagcuccugcccuaguuccgca

SEQ ID NO: 64999 - RNA, 26 nt, Human
cagcugcagagguggcagugugugga

SEQ ID NO: 65000 - RNA, 25 nt, Human
accaguaggagaucagaaaaaugga

SEQ ID NO: 65001 - RNA, 26 nt, Human
ucugucacucaggcuggaguacagug

SEQ ID NO: 65002 - RNA, 17 nt, Human
ggggagauuucagaaga

SEQ ID NO: 65003 - RNA, 19 nt, Human
acacaacaggcuuauuuuc

SEQ ID NO: 65004 - RNA, 20 nt, Human
ggcgagcugggaggcaggag

SEQ ID NO: 65005 - RNA, 24 nt, Human
ucucacugccaaacugccuguccu

SEQ ID NO: 65006 - RNA, 22 nt, Human
ccugcugcuuucucuguuccug

SEQ ID NO: 65007 - RNA, 27 nt, Human
aacccugugucuugugucuguaguuca

SEQ ID NO: 65008 - RNA, 19 nt, Human
cuccucccuccugcuuugc

SEQ ID NO: 65009 - RNA, 21 nt, Human
acccccacucucauuccccag

SEQ ID NO: 65010 - RNA, 26 nt, Human
uccuagaaccaagcuucagagccuag

SEQ ID NO: 65011 - RNA, 18 nt, Human
aggcagggaaaggcucug

SEQ ID NO: 65012 - RNA, 26 nt, Human
ccacuuucugccagcaucugcagcca

SEQ ID NO: 65013 - RNA, 24 nt, Human
uuacugugagccugucaguagugg

SEQ ID NO: 65014 - RNA, 19 nt, Human
ugaucuguuguaauaucag

SEQ ID NO: 65015 - RNA, 22 nt, Human
cacuggguggaggggcagggag

SEQ ID NO: 65016 - RNA, 21 nt, Human
gaaagacaaggagaaaccuga

SEQ ID NO: 65017 - RNA, 21 nt, Human
ugaacaaacaaaaguacugua

SEQ ID NO: 65018 - RNA, 23 nt, Human
ucucuacugggacauguuaggcc

SEQ ID NO: 65019 - RNA, 20 nt, Human
cuugccuggagggugcagug

SEQ ID NO: 65020 - RNA, 26 nt, Human
gcauuuucaccccacccuuccccucc

SEQ ID NO: 65021 - RNA, 27 nt, Human
aaguagcugagacuacaggcacaugcc

SEQ ID NO: 65022 - RNA, 29 nt, Human
cuaucagaaucuacauucuaaaacagaaa

SEQ ID NO: 65023 - RNA, 25 nt, Human
uuugugggaaaagaauugaaugaaa

SEQ ID NO: 65024 - RNA, 21 nt, Human
cucagcuuaagcguggcaugg

SEQ ID NO: 65025 - RNA, 21 nt, Human
uguacauguaccugacugggg

SEQ ID NO: 65026 - RNA, 24 nt, Human
ucugucugucugcucuuagcuguc

SEQ ID NO: 65027 - RNA, 22 nt, Human
acugccagcugccccuccuggg

SEQ ID NO: 65028 - RNA, 27 nt, Human
ugccacugcacuccagucuggaugaca

SEQ ID NO: 65029 - RNA, 22 nt, Human
acugcauuugggcaccaucuca

SEQ ID NO: 65030 - RNA, 20 nt, Human
ccucccuggccccaggcagc

SEQ ID NO: 65031 - RNA, 22 nt, Human
uuuagcaaauacauauuuuaua

SEQ ID NO: 65032 - RNA, 18 nt, Human
gaucaaaucaaacuaaga

SEQ ID NO: 65033 - RNA, 24 nt, Human
ccauguccgggggcagcagcugca

SEQ ID NO: 65034 - RNA, 20 nt, Human
cucucugaaacucaggcuga

SEQ ID NO: 65035 - RNA, 20 nt, Human
ccccaggcuggagugcagug

SEQ ID NO: 65036 - RNA, 22 nt, Human
ucucccuggcuuuugguucacu

SEQ ID NO: 65037 - RNA, 26 nt, Human
ccacuucuuuucaucuguaccacacc

SEQ ID NO: 65038 - RNA, 25 nt, Human
cucuuuaacugcuauuuuagggacc

SEQ ID NO: 65039 - RNA, 22 nt, Human
gaacacacucgugugugcacau

SEQ ID NO: 65040 - RNA, 27 nt, Human
aaagugcugggauuacaggccuggccc

SEQ ID NO: 65041 - RNA, 25 nt, Human
gggaagagggguuaaggugcaguga

SEQ ID NO: 65042 - RNA, 18 nt, Human
cucauggaaaugauauga

SEQ ID NO: 65043 - RNA, 22 nt, Human
gcggcucggggagcccaggagg

SEQ ID NO: 65044 - RNA, 23 nt, Human
uguaagcaauaacagaucugcca

SEQ ID NO: 65045 - RNA, 26 nt, Human
ugacaugucuguagcuaucagaaaga

SEQ ID NO: 65046 - RNA, 23 nt, Human
ggcuuacaccugcccuucucacc

SEQ ID NO: 65047 - RNA, 21 nt, Human
ucccugccugugccuagauca

SEQ ID NO: 65048 - RNA, 27 nt, Human
cacuuccugagcuggugcagcggcaga

SEQ ID NO: 65049 - RNA, 22 nt, Human
aaaaagagaauguugauagccc

SEQ ID NO: 65050 - RNA, 27 nt, Human
gagaagcuaauaugauuuuuuaagucu

SEQ ID NO: 65051 - RNA, 28 nt, Human
uaauuucucuugaaaauaauuuccucaa

SEQ ID NO: 65052 - RNA, 23 nt, Human
uuccuaguauugucaacucuuag

SEQ ID NO: 65053 - RNA, 25 nt, Human
ggcagccaccuuccaggagcagggg

SEQ ID NO: 65054 - RNA, 23 nt, Human
aacacccuugguggcuuaugggu

SEQ ID NO: 65055 - RNA, 19 nt, Human
uuccacaccccaucuugcu

SEQ ID NO: 65056 - RNA, 19 nt, Human
guguaaguucauacuuggu

SEQ ID NO: 65057 - RNA, 22 nt, Human
agaccccgcgccucugaagggg

SEQ ID NO: 65058 - RNA, 23 nt, Human
gaaagagaggaaacauccuguga

SEQ ID NO: 65059 - RNA, 22 nt, Human
gacugagaccuaacucacugga

SEQ ID NO: 65060 - RNA, 21 nt, Human
cagggucucgcucugucaccg

SEQ ID NO: 65061 - RNA, 30 nt, Human
uccacugcagacgccuggagagggacaggc

SEQ ID NO: 65062 - RNA, 26 nt, Human
agcgagagagccgggaggcagaggga

SEQ ID NO: 65063 - RNA, 18 nt, Human
aggcagagccaucugcca

SEQ ID NO: 65064 - RNA, 21 nt, Human
uauucuggcuggcgaacuccu

SEQ ID NO: 65065 - RNA, 21 nt, Human
uagccccucagacucuucuua

SEQ ID NO: 65066 - RNA, 22 nt, Human
gcugcccggcuggccuaggcag

SEQ ID NO: 65067 - RNA, 24 nt, Human
gcagagccacaccccaagugccug

SEQ ID NO: 65068 - RNA, 20 nt, Human
gucuaaacacuucuuucccu

SEQ ID NO: 65069 - RNA, 22 nt, Human
gggauuacaagaaugagccacc

SEQ ID NO: 65070 - RNA, 23 nt, Human
ccucucccuggcugccucaggcu

SEQ ID NO: 65071 - RNA, 21 nt, Human
cuuugcuuagcuaaucaugcc

SEQ ID NO: 65072 - RNA, 22 nt, Human
cuuccuggcccagcgcucguga

SEQ ID NO: 65073 - RNA, 18 nt, Human
uaauguugaagcauuuua

SEQ ID NO: 65074 - RNA, 28 nt, Human
ccgggauggcagagcgugcggcgcugga

SEQ ID NO: 65075 - RNA, 22 nt, Human
cauccagcaugugugugucucu

SEQ ID NO: 65076 - RNA, 19 nt, Human
cuccaucuacaaaguugca

SEQ ID NO: 65077 - RNA, 28 nt, Human
uuccuauauccuggaauauaucuugcau

SEQ ID NO: 65078 - RNA, 20 nt, Human
ggaggcggagguugcaguga

SEQ ID NO: 65079 - RNA, 22 nt, Human
cagugugaggacucacccugga

SEQ ID NO: 65080 - RNA, 23 nt, Human
cccuucacccccuccgcagagcu

SEQ ID NO: 65081 - RNA, 19 nt, Human
ugucccgaggaccagggga

SEQ ID NO: 65082 - RNA, 22 nt, Human
agggcacuguguuugccuugca

SEQ ID NO: 65083 - RNA, 27 nt, Human
ccugcugcuaaccuggcaccagagccu

SEQ ID NO: 65084 - RNA, 24 nt, Human
uuuucuuccucagagcagaagggc

SEQ ID NO: 65085 - RNA, 26 nt, Human
agaacaauuucucauuucauauuugg

SEQ ID NO: 65086 - RNA, 23 nt, Human
cagacuccaagagcugccaccgc

SEQ ID NO: 65087 - RNA, 24 nt, Human
gcuggggagaauggggcugggccc

SEQ ID NO: 65088 - RNA, 22 nt, Human
ugcccugcccuguuccgcauga

SEQ ID NO: 65089 - RNA, 21 nt, Human
cacuugaaccugggaggcgga

SEQ ID NO: 65090 - RNA, 21 nt, Human
ugagcaucuuuccaugauauu

SEQ ID NO: 65091 - RNA, 29 nt, Human
ugucuguaaguuggaagagaauuaaacga

SEQ ID NO: 65092 - RNA, 23 nt, Human
augugguacucauaccauccaca

SEQ ID NO: 65093 - RNA, 26 nt, Human
aguuucuagauaaacagcgaucucca

SEQ ID NO: 65094 - RNA, 24 nt, Human
cagccggaaguuuucugucacugg

SEQ ID NO: 65095 - RNA, 20 nt, Human
ugcuccagguggcucugagg

SEQ ID NO: 65096 - RNA, 22 nt, Human
gggguggagggggaaugacaga

SEQ ID NO: 65097 - RNA, 21 nt, Human
gaauagcuucuccaaaggcuc

SEQ ID NO: 65098 - RNA, 24 nt, Human
agaguuucacagaaacaaagcuuu

SEQ ID NO: 65099 - RNA, 21 nt, Human
uggcuugaauuccauggaauu

SEQ ID NO: 65100 - RNA, 24 nt, Human
gccaggugcuuuagcagcguggcu

SEQ ID NO: 65101 - RNA, 21 nt, Human
ccggccccccacacccacagc

SEQ ID NO: 65102 - RNA, 29 nt, Human
ccugcuccugggguaacacaugcgcuugu

SEQ ID NO: 65103 - RNA, 26 nt, Human
acaagugugcacaguaaacguguuug

SEQ ID NO: 65104 - RNA, 30 nt, Human
ggcucacugcaaccuccgccucucggguuc

SEQ ID NO: 65105 - RNA, 19 nt, Human
agguucuucuugaaauuca

SEQ ID NO: 65106 - RNA, 22 nt, Human
ugaguuccugccuuucccacca

SEQ ID NO: 65107 - RNA, 23 nt, Human
ccugcugcugaccuccccuugag

SEQ ID NO: 65108 - RNA, 21 nt, Human
agaacagaucccuucuuuucc

SEQ ID NO: 65109 - RNA, 22 nt, Human
cucgccugauccuucugucucu

SEQ ID NO: 65110 - RNA, 22 nt, Human
acugagugccuacucuuugcca

SEQ ID NO: 65111 - RNA, 21 nt, Human
ggagugagcugguggagccag

SEQ ID NO: 65112 - RNA, 29 nt, Human
ggaucugagggagaacaagaccgaucggc

SEQ ID NO: 65113 - RNA, 26 nt, Human
ccuucaugccugggguuucucuccca

SEQ ID NO: 65114 - RNA, 24 nt, Human
aguuucuuucuacuuucuccauca

SEQ ID NO: 65115 - RNA, 27 nt, Human
ucucugucuuuaccagcaggcucugua

SEQ ID NO: 65116 - RNA, 22 nt, Human
ggaaggcuucgcuagugaugga

SEQ ID NO: 65117 - RNA, 20 nt, Human
aauuccuggcccuguucucc

SEQ ID NO: 65118 - RNA, 21 nt, Human
ugaauaaaauuguuauuucaa

SEQ ID NO: 65119 - RNA, 27 nt, Human
ggagagggcgaggggucccagggggcu

SEQ ID NO: 65120 - RNA, 22 nt, Human
uuccgaaugcgagggccuggga

SEQ ID NO: 65121 - RNA, 24 nt, Human
cuccugagcccugauuauccucau

SEQ ID NO: 65122 - RNA, 29 nt, Human
uguacucagcucaugacagcacccugcug

SEQ ID NO: 65123 - RNA, 21 nt, Human
cucccaggucagcgauuuucc

SEQ ID NO: 65124 - RNA, 24 nt, Human
uagugugcagagguguaccaggga

SEQ ID NO: 65125 - RNA, 16 nt, Human
uggaggugaugcugaa

SEQ ID NO: 65126 - RNA, 27 nt, Human
cccaaguagcugggauuacagacucau

SEQ ID NO: 65127 - RNA, 26 nt, Human
uagggagggagcuagaagaaggugcc

SEQ ID NO: 65128 - RNA, 21 nt, Human
uauuguugauaaaucuaaauu

SEQ ID NO: 65129 - RNA, 20 nt, Human
uuggcugcucucggacuccc

SEQ ID NO: 65130 - RNA, 21 nt, Human
gcggcccaggcggggugcgag

SEQ ID NO: 65131 - RNA, 27 nt, Human
agucauacuugaacuugucucauucca

SEQ ID NO: 65132 - RNA, 22 nt, Human
agggauagaguaggacccugga

SEQ ID NO: 65133 - RNA, 25 nt, Human
aaaauucaaaaacaaaauuagccgg

SEQ ID NO: 65134 - RNA, 26 nt, Human
ggcaggagcuggggucucagggcuca

SEQ ID NO: 65135 - RNA, 22 nt, Human
gcugacaucuguaaaaggccuu

SEQ ID NO: 65136 - RNA, 27 nt, Human
ggggugagggccaaaggcuaugguuuc

SEQ ID NO: 65137 - RNA, 21 nt, Human
uugggauuuguugaaaucuuu

SEQ ID NO: 65138 - RNA, 22 nt, Human
gggcugugcuggggcuugggga

SEQ ID NO: 65139 - RNA, 25 nt, Human
ccagugcaagcagaugacaaaaagg

SEQ ID NO: 65140 - RNA, 24 nt, Human
aguuuugacugcuuggaacuggaa

SEQ ID NO: 65141 - RNA, 26 nt, Human
aggcucugagccccagggcagagggg

SEQ ID NO: 65142 - RNA, 22 nt, Human
agauaaauaauguaguuuuguu

SEQ ID NO: 65143 - RNA, 26 nt, Human
ucaguaggggcaugguauaaggaaau

SEQ ID NO: 65144 - RNA, 26 nt, Human
caugccacuggucggcacuuugccac

SEQ ID NO: 65145 - RNA, 22 nt, Human
cgggaggagagugcauggugca

SEQ ID NO: 65146 - RNA, 20 nt, Human
cuaagcugugcagcagauac

SEQ ID NO: 65147 - RNA, 22 nt, Human
cuacagcuaccuggccugagaa

SEQ ID NO: 65148 - RNA, 27 nt, Human
gcaucuccguccugcccaccuucuuaa

SEQ ID NO: 65149 - RNA, 20 nt, Human
auugcaaauauccacuuaga

SEQ ID NO: 65150 - RNA, 21 nt, Human
caugcugcugaccacugacuc

SEQ ID NO: 65151 - RNA, 24 nt, Human
gcccaggcuggagugcaauagcuc

SEQ ID NO: 65152 - RNA, 20 nt, Human
gagcagggagaggggccagc

SEQ ID NO: 65153 - RNA, 24 nt, Human
ugcuacuuguggaccucaccagag

SEQ ID NO: 65154 - RNA, 23 nt, Human
uuguuuuuaaauaaagcaucauu

SEQ ID NO: 65155 - RNA, 22 nt, Human
gcuucugcuuggcuuuccggcu

SEQ ID NO: 65156 - RNA, 22 nt, Human
acauuuccaguugguuuuguaa

SEQ ID NO: 65157 - RNA, 24 nt, Human
agccauuuugaacuucugcccuca

SEQ ID NO: 65158 - RNA, 22 nt, Human
aggcugagacaggagaaucacc

SEQ ID NO: 65159 - RNA, 20 nt, Human
ucacccagaggggugccuug

SEQ ID NO: 65160 - RNA, 22 nt, Human
ucugggagcuagggaagguaug

SEQ ID NO: 65161 - RNA, 21 nt, Human
uagaucuccuaaugauguauu

SEQ ID NO: 65162 - RNA, 30 nt, Human
gaccccuucagagcagggauugugccggga

SEQ ID NO: 65163 - RNA, 22 nt, Human
agccuccggaguagcugggauu

SEQ ID NO: 65164 - RNA, 18 nt, Human
ugaaggaggagcagguga

SEQ ID NO: 65165 - RNA, 27 nt, Human
ucaggguuuauuuagguuauuauuuuu

SEQ ID NO: 65166 - RNA, 21 nt, Human
uucacuccuccgcgggcucug

SEQ ID NO: 65167 - RNA, 19 nt, Human
guuuucauucgucauucca

SEQ ID NO: 65168 - RNA, 24 nt, Human
acugagcugccuccugucucucca

SEQ ID NO: 65169 - RNA, 22 nt, Human
gcccaggcuggcgugcaguggu

SEQ ID NO: 65170 - RNA, 23 nt, Human
cucagcaggaagcauauugucug

SEQ ID NO: 65171 - RNA, 20 nt, Human
augacagcuggaguucucug

SEQ ID NO: 65172 - RNA, 22 nt, Human
caagaaguuugagggacgcgcg

SEQ ID NO: 65173 - RNA, 20 nt, Human
uucaaaccagaggguugcug

SEQ ID NO: 65174 - RNA, 23 nt, Human
uuccuugagcccuggaguuugag

SEQ ID NO: 65175 - RNA, 26 nt, Human
cuaccucagauuuucaagaaggugaa

SEQ ID NO: 65176 - RNA, 23 nt, Human
uggaugugguggugcacaccugu

SEQ ID NO: 65177 - RNA, 22 nt, Human
gagcccaaaugaccaaauccau

SEQ ID NO: 65178 - RNA, 25 nt, Human
cccuugguagagcuugaaccaccuu

SEQ ID NO: 65179 - RNA, 32 nt, Human
ucccuucuccccagaucccucauuugauacuc

SEQ ID NO: 65180 - RNA, 25 nt, Human
ccugugagcugcucacaacuggguc

SEQ ID NO: 65181 - RNA, 21 nt, Human
gucaaaacagagaugugauaa

SEQ ID NO: 65182 - RNA, 20 nt, Human
uguguaacugcccaaagcag

SEQ ID NO: 65183 - RNA, 21 nt, Human
auccaaaucccugccuuccuc

SEQ ID NO: 65184 - RNA, 20 nt, Human
ccuggcucuucucugggcaa

SEQ ID NO: 65185 - RNA, 21 nt, Human
uggugccaccacucaagcaac

SEQ ID NO: 65186 - RNA, 25 nt, Human
ucagcugaccugagagugggaggga

SEQ ID NO: 65187 - RNA, 21 nt, Human
gugcagcauuugaaaacccca

SEQ ID NO: 65188 - RNA, 20 nt, Human
ucacuugccaaauucuggcu

SEQ ID NO: 65189 - RNA, 21 nt, Human
auuacaggguuagcaaaaaga

SEQ ID NO: 65190 - RNA, 23 nt, Human
gucccugcggccaccaccuccuc

SEQ ID NO: 65191 - RNA, 23 nt, Human
ggugugguggcuuacaccuguaa

SEQ ID NO: 65192 - RNA, 20 nt, Human
aucagacauagagagcuuug

SEQ ID NO: 65193 - RNA, 23 nt, Human
ggaacuggcucacccaccugcua

SEQ ID NO: 65194 - RNA, 27 nt, Human
ugccuguagucccagguacucaggagg

SEQ ID NO: 65195 - RNA, 22 nt, Human
uuguaauacugugaugggccuc

SEQ ID NO: 65196 - RNA, 20 nt, Human
caguaacuacagccauuuac

SEQ ID NO: 65197 - RNA, 24 nt, Human
gcugggcgggagagacuguucugu

SEQ ID NO: 65198 - RNA, 19 nt, Human
uuaggaccugggaccacaa

SEQ ID NO: 65199 - RNA, 26 nt, Human
agguacccaaggucacauagcuaguu

SEQ ID NO: 65200 - RNA, 23 nt, Human
gugcaaaugguuuauagcccugu

SEQ ID NO: 65201 - RNA, 24 nt, Human
uucaaaacaccucauuugugcauc

SEQ ID NO: 65202 - RNA, 20 nt, Human
uucuuggucucagcauguug

SEQ ID NO: 65203 - RNA, 22 nt, Human
gacuaagucacagggaucugcu

SEQ ID NO: 65204 - RNA, 24 nt, Human
accacucuugaacccagaaggagg

SEQ ID NO: 65205 - RNA, 20 nt, Human
accucuacugaauauucuag

SEQ ID NO: 65206 - RNA, 22 nt, Human
caccucgcagguucaagcaauc

SEQ ID NO: 65207 - RNA, 26 nt, Human
uuuuuggggggaacuaggagagcagg

SEQ ID NO: 65208 - RNA, 19 nt, Human
gaggcuaguccaucuaggc

SEQ ID NO: 65209 - RNA, 23 nt, Human
ccgaguaccugcuccaucaugcu

SEQ ID NO: 65210 - RNA, 20 nt, Human
acaucuggaagacaaguuca

SEQ ID NO: 65211 - RNA, 25 nt, Human
gguacaucgcuugcaccuguuuuua

SEQ ID NO: 65212 - RNA, 23 nt, Human
guuauuuuucuugaagaggcagc

SEQ ID NO: 65213 - RNA, 21 nt, Human
ggaggcggaccuuguagugag

SEQ ID NO: 65214 - RNA, 23 nt, Human
acaaauucugcuagucuguaagc

SEQ ID NO: 65215 - RNA, 20 nt, Human
acucaaacuuaugucucaga

SEQ ID NO: 65216 - RNA, 23 nt, Human
ucuacugcugcugacauaaaacc

SEQ ID NO: 65217 - RNA, 25 nt, Human
uaggaccuuggccaguuguucucaa

SEQ ID NO: 65218 - RNA, 23 nt, Human
ucaucucauuuaauccucccuuc

SEQ ID NO: 65219 - RNA, 22 nt, Human
uaacugcaguguuuccgccuug

SEQ ID NO: 65220 - RNA, 21 nt, Human
aaaagacacugcagaaacccu

SEQ ID NO: 65221 - RNA, 20 nt, Human
cagaaaacacgaggcuccuu

SEQ ID NO: 65222 - RNA, 21 nt, Human
cgugucguccaaacagcagug

SEQ ID NO: 65223 - RNA, 24 nt, Human
gaguccccguggccagggauuauu

SEQ ID NO: 65224 - RNA, 25 nt, Human
cagagucaucucagcccugccuuuc

SEQ ID NO: 65225 - RNA, 27 nt, Human
ucuguaguuuaugaugcaaaucugcca

SEQ ID NO: 65226 - RNA, 26 nt, Human
gugaggcuucaguguacagcaaccaa

SEQ ID NO: 65227 - RNA, 24 nt, Human
gacugagcacacaggugaacucca

SEQ ID NO: 65228 - RNA, 20 nt, Human
caguccuuaacaucuaccuc

SEQ ID NO: 65229 - RNA, 24 nt, Human
cagacuuccuuuuacuucuuccuu

SEQ ID NO: 65230 - RNA, 22 nt, Human
caucaguguccuucuagcuuua

SEQ ID NO: 65231 - RNA, 22 nt, Human
aggcauggaaguucucugugau

SEQ ID NO: 65232 - RNA, 21 nt, Human
cuuugcaguaucuguugcuug

SEQ ID NO: 65233 - RNA, 24 nt, Human
aacuauucaacaguuuaggaugca

SEQ ID NO: 65234 - RNA, 20 nt, Human
acagagguucccugccuugu

SEQ ID NO: 65235 - RNA, 25 nt, Human
gucugccuuaugaguucuguuuuga

SEQ ID NO: 65236 - RNA, 21 nt, Human
gaagguagcccagcacuguga

SEQ ID NO: 65237 - RNA, 32 nt, Human
caggcaccaucuccuuguucccccucucucuu

SEQ ID NO: 65238 - RNA, 21 nt, Human
aauggacaugguggcuuuguu

SEQ ID NO: 65239 - RNA, 22 nt, Human
acugcuacuacacuuugcuccu

SEQ ID NO: 65240 - RNA, 29 nt, Human
ucugugccugcuuuaucugugcuuggcua

SEQ ID NO: 65241 - RNA, 20 nt, Human
agaguggucccugcccucau

SEQ ID NO: 65242 - RNA, 20 nt, Human
caggcaaggggguugcagug

SEQ ID NO: 65243 - RNA, 27 nt, Human
ccagguggcccaggucugcaccgcggc

SEQ ID NO: 65244 - RNA, 22 nt, Human
agcuuccugaguagcugggauu

SEQ ID NO: 65245 - RNA, 22 nt, Human
agccuccugagcagcugggauu

SEQ ID NO: 65246 - RNA, 20 nt, Human
cccaggaugacaaugcacag

SEQ ID NO: 65247 - RNA, 21 nt, Human
uuguuuuucccucccugggcc

SEQ ID NO: 65248 - RNA, 24 nt, Human
aggccgaggcggaucauaagguca

SEQ ID NO: 65249 - RNA, 20 nt, Human
uacuccaagcugcaggauuu

SEQ ID NO: 65250 - RNA, 21 nt, Human
agcacagauuuuaaaacuucu

SEQ ID NO: 65251 - RNA, 22 nt, Human
cauucgggccugaaaacaaaua

SEQ ID NO: 65252 - RNA, 23 nt, Human
ccucccuccucugcacuguccug

SEQ ID NO: 65253 - RNA, 27 nt, Human
gaaaugaggaauguauauguuggcugu

SEQ ID NO: 65254 - RNA, 23 nt, Human
caggacgguaagcaacauuugag

SEQ ID NO: 65255 - RNA, 22 nt, Human
gcaccacggcagcucuccgcca

SEQ ID NO: 65256 - RNA, 26 nt, Human
cuggaaggaaacuucacggacaggaa

SEQ ID NO: 65257 - RNA, 21 nt, Human
uuaaggcggcacagggccgag

SEQ ID NO: 65258 - RNA, 31 nt, Human
ccauuggaccccacccagccuggaucuaccc

SEQ ID NO: 65259 - RNA, 23 nt, Human
acucuagcugggggugggccagg

SEQ ID NO: 65260 - RNA, 27 nt, Human
cuugcucuucuguauuuuccuauuucc

SEQ ID NO: 65261 - RNA, 23 nt, Human
uccgcagauaggaguagucuuua

SEQ ID NO: 65262 - RNA, 21 nt, Human
aucuccucuccacaccugccu

SEQ ID NO: 65263 - RNA, 22 nt, Human
uggagcuggaccugccugcugc

SEQ ID NO: 65264 - RNA, 25 nt, Human
ccugggcaacagagcaagacugucu

SEQ ID NO: 65265 - RNA, 15 nt, Human
uuucuaagcuuucug

SEQ ID NO: 65266 - RNA, 24 nt, Human
caguucuggagaaagccugauacc

SEQ ID NO: 65267 - RNA, 21 nt, Human
cuggcugcuguggccuccccu

SEQ ID NO: 65268 - RNA, 27 nt, Human
cagccccacccccagguuuuugcccau

SEQ ID NO: 65269 - RNA, 25 nt, Human
agaugcauccuuucauaagaaguga

SEQ ID NO: 65270 - RNA, 27 nt, Human
gacuacccuguacccuuccuucuuccc

SEQ ID NO: 65271 - RNA, 24 nt, Human
uucaguuuuucauuuguuuugcuu

SEQ ID NO: 65272 - RNA, 22 nt, Human
uuuauagaaggaauuuguacuu

SEQ ID NO: 65273 - RNA, 22 nt, Human
accuucagggucaucaggcugu

SEQ ID NO: 65274 - RNA, 24 nt, Human
agcucaagugauccuccuaccuca

SEQ ID NO: 65275 - RNA, 24 nt, Human
agcauuucuagaauagagugggug

SEQ ID NO: 65276 - RNA, 24 nt, Human
gggaguagagucucaaggucauuc

SEQ ID NO: 65277 - RNA, 22 nt, Human
aaagcacugggauuacaggcgu

SEQ ID NO: 65278 - RNA, 21 nt, Human
gcuggcuucuguuuuauucag

SEQ ID NO: 65279 - RNA, 25 nt, Human
aauggcucugggcuggaacugucuu

SEQ ID NO: 65280 - RNA, 22 nt, Human
caggcaauaacugcccaucuca

SEQ ID NO: 65281 - RNA, 22 nt, Human
caggucacaagagucugggguc

SEQ ID NO: 65282 - RNA, 27 nt, Human
aagaggaagaacucacgggugacauuc

SEQ ID NO: 65283 - RNA, 23 nt, Human
agcucacuguugccucgcugucu

SEQ ID NO: 65284 - RNA, 23 nt, Human
ccauuucaccaccaccaugacac

SEQ ID NO: 65285 - RNA, 24 nt, Human
cauugccucucucggauccuccaa

SEQ ID NO: 65286 - RNA, 21 nt, Human
ugaggcugaguagggaacaga

SEQ ID NO: 65287 - RNA, 23 nt, Human
ccucacugcugccucaacuuccu

SEQ ID NO: 65288 - RNA, 31 nt, Human
uacuaccucugucuguuaauucuuuccuaac

SEQ ID NO: 65289 - RNA, 22 nt, Human
gucuccaacuccugaccucagg

SEQ ID NO: 65290 - RNA, 23 nt, Human
ucugccuggcgucgggcuugggc

SEQ ID NO: 65291 - RNA, 20 nt, Human
aauguucucuggguaggugu

SEQ ID NO: 65292 - RNA, 27 nt, Human
uugaugaagcaaggaagauauacauga

SEQ ID NO: 65293 - RNA, 21 nt, Human
cuccauuucuggcuucuaguc

SEQ ID NO: 65294 - RNA, 26 nt, Human
ggaaugagaguuccuucucacuuaga

SEQ ID NO: 65295 - RNA, 27 nt, Human
aaccugaccagaaacacuucgcugcug

SEQ ID NO: 65296 - RNA, 21 nt, Human
caggcgcagaggucccagccc

SEQ ID NO: 65297 - RNA, 20 nt, Human
ucaggaaggagcccaggagc

SEQ ID NO: 65298 - RNA, 23 nt, Human
cucucucuauagagaaggaaaua

SEQ ID NO: 65299 - RNA, 22 nt, Human
agggagggcagagggggcugug

SEQ ID NO: 65300 - RNA, 22 nt, Human
ggaccaccagaggcagaggcca

SEQ ID NO: 65301 - RNA, 24 nt, Human
ccuuccuccuccuuugccuaggag

SEQ ID NO: 65302 - RNA, 20 nt, Human
agaaagaugagaucggagac

SEQ ID NO: 65303 - RNA, 21 nt, Human
uccucauaaagcuugugcugu

SEQ ID NO: 65304 - RNA, 23 nt, Human
ucuguucuucaucgcauucucau

SEQ ID NO: 65305 - RNA, 24 nt, Human
caggcuggagugcaguaaguggca

SEQ ID NO: 65306 - RNA, 20 nt, Human
uuccguagguagauguguaa

SEQ ID NO: 65307 - RNA, 27 nt, Human
aagaggaagaguugagucugucuggga

SEQ ID NO: 65308 - RNA, 17 nt, Human
aacuccucagaccuuaa

SEQ ID NO: 65309 - RNA, 28 nt, Human
cucuccggaagcccccaggauggugagg

SEQ ID NO: 65310 - RNA, 24 nt, Human
ucucccacccucuuccuacugguc

SEQ ID NO: 65311 - RNA, 27 nt, Human
cauugccucucuccccuuggcgucuga

SEQ ID NO: 65312 - RNA, 22 nt, Human
ugaccaacauggagaaacccca

SEQ ID NO: 65313 - RNA, 22 nt, Human
ccacugcacuccagccugggug

SEQ ID NO: 65314 - RNA, 24 nt, Human
ucucagaugguuguuuaacugcga

SEQ ID NO: 65315 - RNA, 27 nt, Human
gcugcaucuucuaccuccugauuauca

SEQ ID NO: 65316 - RNA, 22 nt, Human
ggcagaggagacaggaacaagc

SEQ ID NO: 65317 - RNA, 23 nt, Human
gccuguaaucccagauacucagg

SEQ ID NO: 65318 - RNA, 21 nt, Human
gcgcucccuccaauuuugcag

SEQ ID NO: 65319 - RNA, 22 nt, Human
cuucccuucuucccaccugccu

SEQ ID NO: 65320 - RNA, 22 nt, Human
uuuacucagcaggugugccuua

SEQ ID NO: 65321 - RNA, 25 nt, Human
ggaggugggugagcggguggggugc

SEQ ID NO: 65322 - RNA, 22 nt, Human
ccaggagguggaggcugcggug

SEQ ID NO: 65323 - RNA, 22 nt, Human
caagggaauaccauuauuuucg

SEQ ID NO: 65324 - RNA, 26 nt, Human
ccuuucuccccauccgggaaagaugg

SEQ ID NO: 65325 - RNA, 26 nt, Human
ucacccagagaccagugcucccaacg

SEQ ID NO: 65326 - RNA, 21 nt, Human
gcaaccgggagcccagcaagg

SEQ ID NO: 65327 - RNA, 25 nt, Human
ccuuuuccacacgcauuaauagucc

SEQ ID NO: 65328 - RNA, 22 nt, Human
ugcuggaugagcucugggcagg

SEQ ID NO: 65329 - RNA, 20 nt, Human
uuucccuagcuaucaucucc

SEQ ID NO: 65330 - RNA, 23 nt, Human
agucaaggacagcaacucagcug

SEQ ID NO: 65331 - RNA, 22 nt, Human
gcuuaaucuagagcuaugcaca

SEQ ID NO: 65332 - RNA, 26 nt, Human
gcauuucucuagccuuccuuuucugc

SEQ ID NO: 65333 - RNA, 21 nt, Human
cugugccucaguuuccuaucu

SEQ ID NO: 65334 - RNA, 20 nt, Human
uccaugaaauguguuugaaa

SEQ ID NO: 65335 - RNA, 21 nt, Human
agagccacuugcagacaucac

SEQ ID NO: 65336 - RNA, 27 nt, Human
ggcucuuugagggcagggauugugucu

SEQ ID NO: 65337 - RNA, 22 nt, Human
uaucacugcauuuauuuugccu

SEQ ID NO: 65338 - RNA, 21 nt, Human
acauuuuauccugaacagcca

SEQ ID NO: 65339 - RNA, 22 nt, Human
augccccagcucagggggcaaa

SEQ ID NO: 65340 - RNA, 21 nt, Human
ccugcgcacacagcauuucag

SEQ ID NO: 65341 - RNA, 21 nt, Human
agcaugggucagagugggagg

SEQ ID NO: 65342 - RNA, 22 nt, Human
gggcugccuugcuguucuugaa

SEQ ID NO: 65343 - RNA, 22 nt, Human
ccuacuucuuagaauaugccug

SEQ ID NO: 65344 - RNA, 21 nt, Human
accuuccugguucaagggauu

SEQ ID NO: 65345 - RNA, 21 nt, Human
caggaguucgaguuacagccu

SEQ ID NO: 65346 - RNA, 27 nt, Human
ccggcacuccggacagagcugggccug

SEQ ID NO: 65347 - RNA, 20 nt, Human
uugauagccagucacugccu

SEQ ID NO: 65348 - RNA, 26 nt, Human
uaauugucauuauuuguagacaauaa

SEQ ID NO: 65349 - RNA, 21 nt, Human
aucuuucaggacucuaccuca

SEQ ID NO: 65350 - RNA, 24 nt, Human
ucagcucauuuugucucucucaca

SEQ ID NO: 65351 - RNA, 21 nt, Human
guaaaacaacauacaucugcc

SEQ ID NO: 65352 - RNA, 27 nt, Human
gcucucauccauuccucuuacuggggc

SEQ ID NO: 65353 - RNA, 21 nt, Human
agacauaagaaacuccauuuu

SEQ ID NO: 65354 - RNA, 20 nt, Human
gcauucucucccauccuggg

SEQ ID NO: 65355 - RNA, 21 nt, Human
agauacugauggcucugcaga

SEQ ID NO: 65356 - RNA, 22 nt, Human
auacucacauucccacauacau

SEQ ID NO: 65357 - RNA, 28 nt, Human
gauauguguacaaauucuuuuuaagauu

SEQ ID NO: 65358 - RNA, 21 nt, Human
ugcuaccucaguguuguaguu

SEQ ID NO: 65359 - RNA, 27 nt, Human
cccagcacugccccagacucgcuggca

SEQ ID NO: 65360 - RNA, 24 nt, Human
ucuuagcauccugccuuagagcca

SEQ ID NO: 65361 - RNA, 18 nt, Human
ccucuucuccugccucau

SEQ ID NO: 65362 - RNA, 20 nt, Human
cuugugaggcccgaggcaga

SEQ ID NO: 65363 - RNA, 26 nt, Human
gagcaguuccaggaaguugccaacac

SEQ ID NO: 65364 - RNA, 20 nt, Human
ccuuacuugccucuggaaca

SEQ ID NO: 65365 - RNA, 20 nt, Human
cccaggcugaagugcagugg

SEQ ID NO: 65366 - RNA, 21 nt, Human
acacuucaaugggagugaaca

SEQ ID NO: 65367 - RNA, 22 nt, Human
cgccuguaaucccagcauuuug

SEQ ID NO: 65368 - RNA, 22 nt, Human
aucgcuugaacccuagaggcgg

SEQ ID NO: 65369 - RNA, 22 nt, Human
guugcugcugaagcacauccuu

SEQ ID NO: 65370 - RNA, 25 nt, Human
cgccgccgccucgcaacagguccgg

SEQ ID NO: 65371 - RNA, 22 nt, Human
uguugcccaggcuggucuccaa

SEQ ID NO: 65372 - RNA, 22 nt, Human
uaguuuuaauuucucucuacag

SEQ ID NO: 65373 - RNA, 22 nt, Human
ccaggaaguggcaguugcagug

SEQ ID NO: 65374 - RNA, 24 nt, Human
acagccgccuggagaugacuugag

SEQ ID NO: 65375 - RNA, 23 nt, Human
gggaguuaaagacccuccugggg

SEQ ID NO: 65376 - RNA, 23 nt, Human
gagagugagcuggauguggccgg

SEQ ID NO: 65377 - RNA, 18 nt, Human
agcccaaaucauaaucau

SEQ ID NO: 65378 - RNA, 22 nt, Human
ugucacccaggcugaagugcag

SEQ ID NO: 65379 - RNA, 20 nt, Human
auugcagcagaaagcaguga

SEQ ID NO: 65380 - RNA, 20 nt, Human
uggggcugaguuugagcaag

SEQ ID NO: 65381 - RNA, 24 nt, Human
cggcuaggacuccagggagccucg

SEQ ID NO: 65382 - RNA, 27 nt, Human
acacuucaagagggaggacgcuggggg

SEQ ID NO: 65383 - RNA, 22 nt, Human
cuaaguugcugggauuacaggu

SEQ ID NO: 65384 - RNA, 21 nt, Human
uauguugagaauaaggccagg

SEQ ID NO: 65385 - RNA, 22 nt, Human
ucaauaaaagcaccuguucucc

SEQ ID NO: 65386 - RNA, 24 nt, Human
guccuguaaacuuuucucaguguc

SEQ ID NO: 65387 - RNA, 24 nt, Human
accauuaagugaucuuuaucaaua

SEQ ID NO: 65388 - RNA, 23 nt, Human
gaauguaagauucauucagugug

SEQ ID NO: 65389 - RNA, 24 nt, Human
cgagcaggggagagcgagaccagu

SEQ ID NO: 65390 - RNA, 23 nt, Human
gacaguuuuugcauuuuuaugua

SEQ ID NO: 65391 - RNA, 20 nt, Human
guucauuguacacugccucu

SEQ ID NO: 65392 - RNA, 24 nt, Human
aagcugcuacaauagaaaaaucaa

SEQ ID NO: 65393 - RNA, 28 nt, Human
uugcuuuuguaauucuuaaugagcaaua

SEQ ID NO: 65394 - RNA, 20 nt, Human
cugcccccugggccugaggc

SEQ ID NO: 65395 - RNA, 27 nt, Human
ggucucaaacuccugggcucaggcgau

SEQ ID NO: 65396 - RNA, 18 nt, Human
ucugucucccugaggcuc

SEQ ID NO: 65397 - RNA, 19 nt, Human
ucugcuccccucagccucc

SEQ ID NO: 65398 - RNA, 27 nt, Human
ugccugguccgccauguuccaaagaag

SEQ ID NO: 65399 - RNA, 20 nt, Human
aacauacaaacucugccuuc

SEQ ID NO: 65400 - RNA, 20 nt, Human
ucagcuuuuaauaaaauuga

SEQ ID NO: 65401 - RNA, 22 nt, Human
uuguccacuccuugaggcagau

SEQ ID NO: 65402 - RNA, 20 nt, Human
caccugucugugccucuggc

SEQ ID NO: 65403 - RNA, 17 nt, Human
ugggaaaguucacaaga

SEQ ID NO: 65404 - RNA, 21 nt, Human
ggcuucuccuuggcugagaga

SEQ ID NO: 65405 - RNA, 22 nt, Human
gaccagccuggccaguauggug

SEQ ID NO: 65406 - RNA, 20 nt, Human
gcagacucaaugcacugucg

SEQ ID NO: 65407 - RNA, 26 nt, Human
uacugucugcacuguuuucuuugcau

SEQ ID NO: 65408 - RNA, 23 nt, Human
gauguaguaugauaaagucagcu

SEQ ID NO: 65409 - RNA, 27 nt, Human
cccagcccccaaccccaagaccaagcu

SEQ ID NO: 65410 - RNA, 16 nt, Human
ucaaagcucacaccaa

SEQ ID NO: 65411 - RNA, 21 nt, Human
cuccuuuaucaguuagcuguu

SEQ ID NO: 65412 - RNA, 20 nt, Human
gccugucccuguccccgucc

SEQ ID NO: 65413 - RNA, 21 nt, Human
acugccuggccagccuggggc

SEQ ID NO: 65414 - RNA, 22 nt, Human
guggguacugauuccagacucc

SEQ ID NO: 65415 - RNA, 30 nt, Human
uaauuacugccuugaaaauuuaugguuuug

SEQ ID NO: 65416 - RNA, 22 nt, Human
aggggccugguccgcaaaggga

SEQ ID NO: 65417 - RNA, 23 nt, Human
augaaggacuccacugugcccca

SEQ ID NO: 65418 - RNA, 22 nt, Human
aacagguucuuaaaaaggaaca

SEQ ID NO: 65419 - RNA, 23 nt, Human
uuaagaauuugugacauguagca

SEQ ID NO: 65420 - RNA, 29 nt, Human
uccaccaggagucuggagugcaauggcac

SEQ ID NO: 65421 - RNA, 25 nt, Human
uuguucuaaauaaauauaggucugc

SEQ ID NO: 65422 - RNA, 25 nt, Human
agagcagauucaguguuacagugcu

SEQ ID NO: 65423 - RNA, 27 nt, Human
ccgggugaagccaccgucaucaugucu

SEQ ID NO: 65424 - RNA, 27 nt, Human
aaauuuaagagacagagcccauuuucu

SEQ ID NO: 65425 - RNA, 24 nt, Human
cuuaaauuuuaguucuuacugcuu

SEQ ID NO: 65426 - RNA, 24 nt, Human
ucagucugcuuucucuacugucug

SEQ ID NO: 65427 - RNA, 22 nt, Human
ccaacauggggaaaccccgucu

SEQ ID NO: 65428 - RNA, 20 nt, Human
ccuuccccacuucugugcca

SEQ ID NO: 65429 - RNA, 21 nt, Human
gcccagauguguacagcugcu

SEQ ID NO: 65430 - RNA, 29 nt, Human
uggaugaacaaagagaaagaggguuugga

SEQ ID NO: 65431 - RNA, 27 nt, Human
cccgaguagcugggacuauagaugcgc

SEQ ID NO: 65432 - RNA, 28 nt, Human
cuggucugucugugcauccacugugccg

SEQ ID NO: 65433 - RNA, 22 nt, Human
gcucaaaccuguaaucccagca

SEQ ID NO: 65434 - RNA, 24 nt, Human
guguggccucuccacuucugugga

SEQ ID NO: 65435 - RNA, 23 nt, Human
cuccaaauacacauucucguuca

SEQ ID NO: 65436 - RNA, 28 nt, Human
cgguggggcagaggacccggugccugcc

SEQ ID NO: 65437 - RNA, 22 nt, Human
gaacaccugaaacacaacccca

SEQ ID NO: 65438 - RNA, 22 nt, Human
uguuuuuuguuuuucugcuuua

SEQ ID NO: 65439 - RNA, 21 nt, Human
gcaaaaacauaucgauuuuuc

SEQ ID NO: 65440 - RNA, 22 nt, Human
ccuuccuguucccuccuggucc

SEQ ID NO: 65441 - RNA, 26 nt, Human
gccuugcuggauggaguguggcuguc

SEQ ID NO: 65442 - RNA, 28 nt, Human
cuauuucucagguuuucucagucaacca

SEQ ID NO: 65443 - RNA, 21 nt, Human
gcuuucuauaaucaaaucaau

SEQ ID NO: 65444 - RNA, 18 nt, Human
ccagcggccuacgcccag

SEQ ID NO: 65445 - RNA, 21 nt, Human
gggccuccucuucaucuuggc

SEQ ID NO: 65446 - RNA, 22 nt, Human
gcuccuccuugccuaaugcagg

SEQ ID NO: 65447 - RNA, 27 nt, Human
ugccuguagucccagcuacucaggagg

SEQ ID NO: 65448 - RNA, 21 nt, Human
ccuccaggcccugcaugccgu

SEQ ID NO: 65449 - RNA, 22 nt, Human
ccguuacugaaacuccaaaaag

SEQ ID NO: 65450 - RNA, 22 nt, Human
gcacagacaggcccacgugugu

SEQ ID NO: 65451 - RNA, 25 nt, Human
cccggaccauggccaaccuggagcg

SEQ ID NO: 65452 - RNA, 21 nt, Human
uuggaaagagaagagugaaga

SEQ ID NO: 65453 - RNA, 22 nt, Human
gaguuuauuuuuucuucaucug

SEQ ID NO: 65454 - RNA, 22 nt, Human
cuaggccucaguguccucaucu

SEQ ID NO: 65455 - RNA, 22 nt, Human
cuuaccucucuguguucagaug

SEQ ID NO: 65456 - RNA, 22 nt, Human
ccucuagcagaguggggcggaa

SEQ ID NO: 65457 - RNA, 20 nt, Human
ccaguccucacaaaggggcc

SEQ ID NO: 65458 - RNA, 26 nt, Human
agauacaauaaaaaggcuuaaaucua

SEQ ID NO: 65459 - RNA, 21 nt, Human
ccucacugcuggacuggagcu

SEQ ID NO: 65460 - RNA, 23 nt, Human
aucaugccacugcacuccauccu

SEQ ID NO: 65461 - RNA, 21 nt, Human
ccucugucugugccuaucccc

SEQ ID NO: 65462 - RNA, 30 nt, Human
cuucccgucucuccucuccccauucugugc

SEQ ID NO: 65463 - RNA, 27 nt, Human
uuuaguuuuuuaccuauaccuauguga

SEQ ID NO: 65464 - RNA, 20 nt, Human
aaauccaggcugguguucug

SEQ ID NO: 65465 - RNA, 24 nt, Human
guccaauggcuccuugagccucac

SEQ ID NO: 65466 - RNA, 25 nt, Human
gccauauugucaccucagcacugug

SEQ ID NO: 65467 - RNA, 26 nt, Human
cuucucagggucuccccagcccaguc

SEQ ID NO: 65468 - RNA, 19 nt, Human
gcuaauaaaaauuguuuga

SEQ ID NO: 65469 - RNA, 25 nt, Human
aguggcacgaucauagguggucacu

SEQ ID NO: 65470 - RNA, 18 nt, Human
agucacacuggcacugaa

SEQ ID NO: 65471 - RNA, 27 nt, Human
cccagcuggugggagccucuggcugca

SEQ ID NO: 65472 - RNA, 25 nt, Human
gggucugagucauggccgggugggc

SEQ ID NO: 65473 - RNA, 20 nt, Human
uaccaccccuuccuguccca

SEQ ID NO: 65474 - RNA, 24 nt, Human
aucuguuucuuuaaagcacuuugu

SEQ ID NO: 65475 - RNA, 27 nt, Human
auugacacagcugaaguuuacuggagu

SEQ ID NO: 65476 - RNA, 23 nt, Human
aggggcuuauaauaaaggacugu

SEQ ID NO: 65477 - RNA, 21 nt, Human
ugagccaagguugcgccacug

SEQ ID NO: 65478 - RNA, 22 nt, Human
ugcggucagcugagauggugcc

SEQ ID NO: 65479 - RNA, 24 nt, Human
agagugagagauggaacccgaaga

SEQ ID NO: 65480 - RNA, 22 nt, Human
caacuccugagcucaggugauc

SEQ ID NO: 65481 - RNA, 23 nt, Human
gacuuuuuucucacuguugcauc

SEQ ID NO: 65482 - RNA, 24 nt, Human
guuaucccaauggacacuaaguua

SEQ ID NO: 65483 - RNA, 23 nt, Human
augacugcugugaaauggagaac

SEQ ID NO: 65484 - RNA, 23 nt, Human
ggcucugaggcgcgcccugcccg

SEQ ID NO: 65485 - RNA, 21 nt, Human
gaugugacagcaagcaaguga

SEQ ID NO: 65486 - RNA, 21 nt, Human
cucaacuauugacugcugcag

SEQ ID NO: 65487 - RNA, 23 nt, Human
gagcaagcccagaggcagaggag

SEQ ID NO: 65488 - RNA, 25 nt, Human
ucggucauuagaggaaugagccggg

SEQ ID NO: 65489 - RNA, 19 nt, Human
gagcucccaucugaucugc

SEQ ID NO: 65490 - RNA, 18 nt, Human
uuucaauaaaaagaagcu

SEQ ID NO: 65491 - RNA, 16 nt, Human
ggccuggcaucuuggg

SEQ ID NO: 65492 - RNA, 23 nt, Human
cgccugagcccuacucccugcag

SEQ ID NO: 65493 - RNA, 20 nt, Human
guugguugagacacuuucuc

SEQ ID NO: 65494 - RNA, 23 nt, Human
ccucaagcaauccuccugccuca

SEQ ID NO: 65495 - RNA, 21 nt, Human
ccccaaaccuugcucucauca

SEQ ID NO: 65496 - RNA, 22 nt, Human
ggucaucuucccuaucacacaa

SEQ ID NO: 65497 - RNA, 24 nt, Human
agaaaacauagccaccauuuuguc

SEQ ID NO: 65498 - RNA, 20 nt, Human
uuuucuuuugauugauauga

SEQ ID NO: 65499 - RNA, 23 nt, Human
cagcuuugcuuagcuuucuuuau

SEQ ID NO: 65500 - RNA, 21 nt, Human
uuuugagccagaaugccuuca

SEQ ID NO: 65501 - RNA, 20 nt, Human
acccauucugcacagucccu

SEQ ID NO: 65502 - RNA, 24 nt, Human
gcuuuacaacuugaaugcugauuc

SEQ ID NO: 65503 - RNA, 26 nt, Human
cacuccugccugcuguuccugacuac

SEQ ID NO: 65504 - RNA, 23 nt, Human
gggcugacuggaggcuggcggac

SEQ ID NO: 65505 - RNA, 19 nt, Human
ggggaaagagcugcgggaa

SEQ ID NO: 65506 - RNA, 27 nt, Human
cucugcgccucuccacuguuucaugag

SEQ ID NO: 65507 - RNA, 21 nt, Human
uguuauagccaucauaaaacc

SEQ ID NO: 65508 - RNA, 25 nt, Human
gcccaggcuggagugcaacggcacg

SEQ ID NO: 65509 - RNA, 26 nt, Human
cguuguacuccagcuugggcaacaga

SEQ ID NO: 65510 - RNA, 21 nt, Human
aauuuguuuucaucugucuuu

SEQ ID NO: 65511 - RNA, 22 nt, Human
cacuugaacccgggaagcagag

SEQ ID NO: 65512 - RNA, 21 nt, Human
ggucaucugugugucacagcc

SEQ ID NO: 65513 - RNA, 25 nt, Human
uucuuguugccacagcuggagcucu

SEQ ID NO: 65514 - RNA, 25 nt, Human
gaccucaagugaucugcccaccuca

SEQ ID NO: 65515 - RNA, 19 nt, Human
gccauuuucucaaacgaga

SEQ ID NO: 65516 - RNA, 20 nt, Human
guguuagccaggauggucuc

SEQ ID NO: 65517 - RNA, 22 nt, Human
ccuccuggcccugcugcccagu

SEQ ID NO: 65518 - RNA, 23 nt, Human
agaaaaccauuaguuugcuguua

SEQ ID NO: 65519 - RNA, 27 nt, Human
ccccucgccuuccccaccuccccaccg

SEQ ID NO: 65520 - RNA, 26 nt, Human
ggugagguccuggugccuaucugccu

SEQ ID NO: 65521 - RNA, 23 nt, Human
gggcuggagagcagguucgggca

SEQ ID NO: 65522 - RNA, 27 nt, Human
ccccucggaggcagcgucaucgguagu

SEQ ID NO: 65523 - RNA, 22 nt, Human
ucugacauugcagagugagcua

SEQ ID NO: 65524 - RNA, 22 nt, Human
aaucuccaggguucaaucgauu

SEQ ID NO: 65525 - RNA, 28 nt, Human
ugaucacagauucuuucccaccucacaa

SEQ ID NO: 65526 - RNA, 25 nt, Human
ugccaucaaaaugaggccugugaaa

SEQ ID NO: 65527 - RNA, 20 nt, Human
auguaccaggaugguuucug

SEQ ID NO: 65528 - RNA, 22 nt, Human
ugccgucgggccucugcaccug

SEQ ID NO: 65529 - RNA, 21 nt, Human
gcucaucacuggccuggggag

SEQ ID NO: 65530 - RNA, 20 nt, Human
ucuccaccugccaucucacc

SEQ ID NO: 65531 - RNA, 23 nt, Human
uagugaacagguucuccagguga

SEQ ID NO: 65532 - RNA, 19 nt, Human
uguucuccuuacuccaucu

SEQ ID NO: 65533 - RNA, 26 nt, Human
gucauuguccucugagcugcaguuuc

SEQ ID NO: 65534 - RNA, 20 nt, Human
cagguccacagagagggaga

SEQ ID NO: 65535 - RNA, 21 nt, Human
ggucaauaccagccugggcaa

SEQ ID NO: 65536 - RNA, 19 nt, Human
ugagagagaagucggccag

SEQ ID NO: 65537 - RNA, 24 nt, Human
ggacucaggcuggggucugcagug

SEQ ID NO: 65538 - RNA, 21 nt, Human
guuugcagaagauacuguccu

SEQ ID NO: 65539 - RNA, 19 nt, Human
gugaaaaucaaauacauac

SEQ ID NO: 65540 - RNA, 20 nt, Human
cuuugacauagguucuucua

SEQ ID NO: 65541 - RNA, 22 nt, Human
gguuagaaucaggagacuugag

SEQ ID NO: 65542 - RNA, 22 nt, Human
ccacugcauaccagccuaggug

SEQ ID NO: 65543 - RNA, 22 nt, Human
cagccucuggauucucuucaug

SEQ ID NO: 65544 - RNA, 19 nt, Human
uccuuacccaaacuguuca

SEQ ID NO: 65545 - RNA, 26 nt, Human
cgcccaggcuggagugcaggggcgca

SEQ ID NO: 65546 - RNA, 19 nt, Human
agggaaaguuggagaguac

SEQ ID NO: 65547 - RNA, 25 nt, Human
auggagugaaagccauuugacucaa

SEQ ID NO: 65548 - RNA, 21 nt, Human
acaagucccucuugcuggaac

SEQ ID NO: 65549 - RNA, 22 nt, Human
cucccaggugugaaguuuuuca

SEQ ID NO: 65550 - RNA, 25 nt, Human
uaguuucagugcuuuacaagucucg

SEQ ID NO: 65551 - RNA, 25 nt, Human
uucauccugagcuuuucuccucaug

SEQ ID NO: 65552 - RNA, 22 nt, Human
ccuggcgggggcauccggcgga

SEQ ID NO: 65553 - RNA, 19 nt, Human
gauucagagacugcgcccu

SEQ ID NO: 65554 - RNA, 21 nt, Human
uuauuugcacuaugagccuau

SEQ ID NO: 65555 - RNA, 25 nt, Human
ccagcagugugaguuuaaaaaacuu

SEQ ID NO: 65556 - RNA, 30 nt, Human
gcucagcucuccuccucuagcucaauaaac

SEQ ID NO: 65557 - RNA, 25 nt, Human
agaaauuuagagucaauuugcugaa

SEQ ID NO: 65558 - RNA, 24 nt, Human
uuccugagcccaccgcagcugaag

SEQ ID NO: 65559 - RNA, 24 nt, Human
ggcuuuggugagagagugugcaga

SEQ ID NO: 65560 - RNA, 27 nt, Human
agagcugaguccucuuugucauaccuu

SEQ ID NO: 65561 - RNA, 20 nt, Human
cucugcacucccuugggcag

SEQ ID NO: 65562 - RNA, 28 nt, Human
uuccuauuaaucuuaaaacaaagcgaaa

SEQ ID NO: 65563 - RNA, 21 nt, Human
ugaagucacugaaaauccaac

SEQ ID NO: 65564 - RNA, 23 nt, Human
ucuugcuaaucucucuuuuguua

SEQ ID NO: 65565 - RNA, 27 nt, Human
ucaugccauuuccauuguugagugaag

SEQ ID NO: 65566 - RNA, 24 nt, Human
gacccugcaucaguuguuaagcua

SEQ ID NO: 65567 - RNA, 27 nt, Human
ccuugauaauauauuguguugacuuua

SEQ ID NO: 65568 - RNA, 19 nt, Human
auuugcuugugcucaguau

SEQ ID NO: 65569 - RNA, 22 nt, Human
gccgcacuccagcacugcgcag

SEQ ID NO: 65570 - RNA, 26 nt, Human
ugaaucugcuuguugaucaguguuug

SEQ ID NO: 65571 - RNA, 25 nt, Human
uggagaggcagagcuuucauacuga

SEQ ID NO: 65572 - RNA, 17 nt, Human
acugccucugccugucg

SEQ ID NO: 65573 - RNA, 22 nt, Human
auuccuugaacccaagagguug

SEQ ID NO: 65574 - RNA, 24 nt, Human
gguacccaccauucuccucuguac

SEQ ID NO: 65575 - RNA, 21 nt, Human
gcuguugcugcucuucuuccu

SEQ ID NO: 65576 - RNA, 12 nt, Human
gccaaugccuug

SEQ ID NO: 65577 - RNA, 21 nt, Human
ggauuuguuuucagaaacaag

SEQ ID NO: 65578 - RNA, 22 nt, Human
cacacagagaaugucaccaaga

SEQ ID NO: 65579 - RNA, 24 nt, Human
aggcuucuuggugaagagcauuuu

SEQ ID NO: 65580 - RNA, 25 nt, Human
ggaucucuuggaaugacaaaugaua

SEQ ID NO: 65581 - RNA, 21 nt, Human
cagcugccuucucugcccugu

SEQ ID NO: 65582 - RNA, 25 nt, Human
gugaugaccugaggaccagagacac

SEQ ID NO: 65583 - RNA, 20 nt, Human
cugauccccaggcuuggggc

SEQ ID NO: 65584 - RNA, 23 nt, Human
ccucuucucagcuccacucugaa

SEQ ID NO: 65585 - RNA, 22 nt, Human
aacugauuuuuguauuuuuagu

SEQ ID NO: 65586 - RNA, 21 nt, Human
uuauguuuuucuccaaaaccu

SEQ ID NO: 65587 - RNA, 21 nt, Human
aauucuuaacacucauacuug

SEQ ID NO: 65588 - RNA, 19 nt, Human
uuccagaugaccaggacag

SEQ ID NO: 65589 - RNA, 25 nt, Human
ccucagcugugcccugcugccuggc

SEQ ID NO: 65590 - RNA, 25 nt, Human
uucuuucaaaauuuccucuccaucu

SEQ ID NO: 65591 - RNA, 23 nt, Human
ucguccuccucguccuccggggc

SEQ ID NO: 65592 - RNA, 25 nt, Human
uuuuagaaugagacuuacuucucug

SEQ ID NO: 65593 - RNA, 32 nt, Human
gccaugagaauguuuuagcacagcguuaugug

SEQ ID NO: 65594 - RNA, 23 nt, Human
uguuuuuaaaaugguuuguccug

SEQ ID NO: 65595 - RNA, 22 nt, Human
ugguguugaacuccuaaccuca

SEQ ID NO: 65596 - RNA, 21 nt, Human
ucugccccucuccugccaccu

SEQ ID NO: 65597 - RNA, 20 nt, Human
cccccaggcucacagcagug

SEQ ID NO: 65598 - RNA, 21 nt, Human
agcuuugcagucgcugccuuc

SEQ ID NO: 65599 - RNA, 25 nt, Human
gcaauugcuucucuaaaacagcacu

SEQ ID NO: 65600 - RNA, 26 nt, Human
uugccaccaugaccagccucucccug

SEQ ID NO: 65601 - RNA, 22 nt, Human
cuuggccucccaaagugguggg

SEQ ID NO: 65602 - RNA, 17 nt, Human
ucuccacccuauaugua

SEQ ID NO: 65603 - RNA, 21 nt, Human
ugcagccuggaugacagagcg

SEQ ID NO: 65604 - RNA, 20 nt, Human
agucacugcagcaacgccuu

SEQ ID NO: 65605 - RNA, 21 nt, Human
uaaaaugaucagccaugugaa

SEQ ID NO: 65606 - RNA, 26 nt, Human
gcuucguagagugggugcuguuccca

SEQ ID NO: 65607 - RNA, 18 nt, Human
ucugcccuugucacuggu

SEQ ID NO: 65608 - RNA, 27 nt, Human
gaggugcagagugcccagaacuggacu

SEQ ID NO: 65609 - RNA, 29 nt, Human
ggcugggaucagagcaggagcauccucug

SEQ ID NO: 65610 - RNA, 21 nt, Human
uaaggcaugaggacuauguga

SEQ ID NO: 65611 - RNA, 27 nt, Human
agaacucaagaaagccacuggggaaaa

SEQ ID NO: 65612 - RNA, 21 nt, Human
cucugucuugucacuaaccca

SEQ ID NO: 65613 - RNA, 28 nt, Human
aaggcugugccuacaggacuucucuuua

SEQ ID NO: 65614 - RNA, 23 nt, Human
cuuuuuagcuuuauuuuuucuaa

SEQ ID NO: 65615 - RNA, 21 nt, Human
cugccaggaguagugagcugu

SEQ ID NO: 65616 - RNA, 22 nt, Human
aggcugaggcaccagaauugcu

SEQ ID NO: 65617 - RNA, 21 nt, Human
guguauggcucaugcccagcc

SEQ ID NO: 65618 - RNA, 21 nt, Human
cugauguguccccucucccca

SEQ ID NO: 65619 - RNA, 25 nt, Human
cuguaaccccagcacuuugggaggc

SEQ ID NO: 65620 - RNA, 24 nt, Human
cauucuguuggccuaagugccucu

SEQ ID NO: 65621 - RNA, 23 nt, Human
cuccugucaucacgaucaauuaa

SEQ ID NO: 65622 - RNA, 23 nt, Human
gaguuccccagaauggaugguau

SEQ ID NO: 65623 - RNA, 23 nt, Human
gcaacuccuggauuucucuuaca

SEQ ID NO: 65624 - RNA, 26 nt, Human
ccagcagagccgugggaggguccuug

SEQ ID NO: 65625 - RNA, 18 nt, Human
gagcucaggaagaagaga

SEQ ID NO: 65626 - RNA, 23 nt, Human
cccaggagguggaaacugcagag

SEQ ID NO: 65627 - RNA, 21 nt, Human
ggaguagggguucccgcuucc

SEQ ID NO: 65628 - RNA, 23 nt, Human
cagcuagaccugcuuucuuuucu

SEQ ID NO: 65629 - RNA, 23 nt, Human
auacauguauauacacacagaca

SEQ ID NO: 65630 - RNA, 21 nt, Human
uagcaucuaucuccuuugccu

SEQ ID NO: 65631 - RNA, 26 nt, Human
gaggcugcagccagagggcugggaag

SEQ ID NO: 65632 - RNA, 23 nt, Human
aggggacuagaugggcaaggggc

SEQ ID NO: 65633 - RNA, 23 nt, Human
ugguguuuacucagaaccugcuc

SEQ ID NO: 65634 - RNA, 22 nt, Human
cuucccuuugcaaaccaggcug

SEQ ID NO: 65635 - RNA, 21 nt, Human
acugggcuguacgacagugag

SEQ ID NO: 65636 - RNA, 26 nt, Human
gagaggcggagggaagggaggcgagg

SEQ ID NO: 65637 - RNA, 27 nt, Human
gagggagguggaacagcacacuggacu

SEQ ID NO: 65638 - RNA, 23 nt, Human
gaccguggcuggcggucacgccc

SEQ ID NO: 65639 - RNA, 29 nt, Human
gcuuucuguagcuguaagcauugguggcc

SEQ ID NO: 65640 - RNA, 21 nt, Human
uaucuuucauuaaaaagaaua

SEQ ID NO: 65641 - RNA, 23 nt, Human
cuccagccaucggagaccagagc

SEQ ID NO: 65642 - RNA, 22 nt, Human
cucccaggaaggacuugcuggg

SEQ ID NO: 65643 - RNA, 22 nt, Human
ccugaacugcacuacaagacac

SEQ ID NO: 65644 - RNA, 26 nt, Human
cagcuuagguuuuucugucauccuca

SEQ ID NO: 65645 - RNA, 23 nt, Human
gugcagugagccgagaucacgcc

SEQ ID NO: 65646 - RNA, 19 nt, Human
ccugcagccccgcgccucc

SEQ ID NO: 65647 - RNA, 22 nt, Human
ugaacuccugggcucaagagau

SEQ ID NO: 65648 - RNA, 26 nt, Human
gcaaggaaagcggaccacaaaagucc

SEQ ID NO: 65649 - RNA, 23 nt, Human
gaagcaguccagagucuaggcaa

SEQ ID NO: 65650 - RNA, 22 nt, Human
ggccucccuaagugcugggauu

SEQ ID NO: 65651 - RNA, 23 nt, Human
uuaaaaaacacuuuucacaaaaa

SEQ ID NO: 65652 - RNA, 23 nt, Human
cucuaccucauaacaaaaggaca

SEQ ID NO: 65653 - RNA, 22 nt, Human
cugagagauagaggaggcugug

SEQ ID NO: 65654 - RNA, 21 nt, Human
ugucacccacaagggaggcua

SEQ ID NO: 65655 - RNA, 20 nt, Human
uccaagggccacucccaaga

SEQ ID NO: 65656 - RNA, 21 nt, Human
aaaaugcaaaaaauuagccgg

SEQ ID NO: 65657 - RNA, 22 nt, Human
agagacacagcugcuacgugau

SEQ ID NO: 65658 - RNA, 19 nt, Human
guuucauccuucccuuucc

SEQ ID NO: 65659 - RNA, 17 nt, Human
cuccugaccugcugcua

SEQ ID NO: 65660 - RNA, 17 nt, Human
cuucccuucccuaaagu

SEQ ID NO: 65661 - RNA, 20 nt, Human
ugugugguuugcauuguuaa

SEQ ID NO: 65662 - RNA, 25 nt, Human
acccaccugccccauguccacuggg

SEQ ID NO: 65663 - RNA, 21 nt, Human
guuggacaaaccgagugcaau

SEQ ID NO: 65664 - RNA, 22 nt, Human
cacagcgguuuguuccccuucu

SEQ ID NO: 65665 - RNA, 24 nt, Human
cacgacuucugcccauucucucca

SEQ ID NO: 65666 - RNA, 21 nt, Human
aggaaugaucaugaaugcaaa

SEQ ID NO: 65667 - RNA, 25 nt, Human
aguacagauguuuuucauccauucc

SEQ ID NO: 65668 - RNA, 18 nt, Human
cuuucaucugaagcgcca

SEQ ID NO: 65669 - RNA, 23 nt, Human
aaauacugccuagaaaaugcaaa

SEQ ID NO: 65670 - RNA, 24 nt, Human
gugggugcaauguggguguuuaca

SEQ ID NO: 65671 - RNA, 19 nt, Human
aagagggagaaggagaggc

SEQ ID NO: 65672 - RNA, 22 nt, Human
gggagguggugguugcagugag

SEQ ID NO: 65673 - RNA, 26 nt, Human
cugcugucauugcuucuucugaggcc

SEQ ID NO: 65674 - RNA, 25 nt, Human
uuucugugagcucuggugucacuca

SEQ ID NO: 65675 - RNA, 23 nt, Human
gaaguccugggacccagggaggg

SEQ ID NO: 65676 - RNA, 21 nt, Human
gccaggaggucuagaacugga

SEQ ID NO: 65677 - RNA, 20 nt, Human
guuggcuguuccagacucag

SEQ ID NO: 65678 - RNA, 26 nt, Human
ggugcgaucacagcccagugcagccu

SEQ ID NO: 65679 - RNA, 27 nt, Human
aaacuauucuauggccauuacuaacac

SEQ ID NO: 65680 - RNA, 23 nt, Human
ggcccaggccggcggcggcgaug

SEQ ID NO: 65681 - RNA, 23 nt, Human
cauccucccucucgucuuucgca

SEQ ID NO: 65682 - RNA, 22 nt, Human
guggccagaucaccugagguca

SEQ ID NO: 65683 - RNA, 25 nt, Human
aggaggaagagguugauggcggcgg

SEQ ID NO: 65684 - RNA, 22 nt, Human
agccuccugaguagcugggacu

SEQ ID NO: 65685 - RNA, 22 nt, Human
agccucccgaguagccgggacu

SEQ ID NO: 65686 - RNA, 23 nt, Human
gaagaggaagcgggaggagcuug

SEQ ID NO: 65687 - RNA, 22 nt, Human
ccggggagggggcacggcaggc

SEQ ID NO: 65688 - RNA, 20 nt, Human
ucuuguucuuugcuggacca

SEQ ID NO: 65689 - RNA, 22 nt, Human
agaugccaggccccccaaggug

SEQ ID NO: 65690 - RNA, 27 nt, Human
ugccuguagucccagcuacuugagagg

SEQ ID NO: 65691 - RNA, 24 nt, Human
ugcagauccaggcuuuucugggaa

SEQ ID NO: 65692 - RNA, 22 nt, Human
ucaggacuuguauuagcagguu

SEQ ID NO: 65693 - RNA, 21 nt, Human
agaaaauuaguaauuguaagu

SEQ ID NO: 65694 - RNA, 24 nt, Human
gccuugagucuggccaaggaggug

SEQ ID NO: 65695 - RNA, 20 nt, Human
agggcccaggcuggugcagc

SEQ ID NO: 65696 - RNA, 29 nt, Human
gcagaacguuugggagugugcagcuccug

SEQ ID NO: 65697 - RNA, 22 nt, Human
uguuuacugaaaaaugaguuua

SEQ ID NO: 65698 - RNA, 25 nt, Human
guggccgggcugggcgccgguagug

SEQ ID NO: 65699 - RNA, 25 nt, Human
cugccuccugccugccccucucccg

SEQ ID NO: 65700 - RNA, 21 nt, Human
ccuuucuaccaguuguggacc

SEQ ID NO: 65701 - RNA, 22 nt, Human
cuuuguuuuuagagacaggguc

SEQ ID NO: 65702 - RNA, 21 nt, Human
ucaucagccacaacaaaaaua

SEQ ID NO: 65703 - RNA, 22 nt, Human
ccuuucgggggcaagguucacc

SEQ ID NO: 65704 - RNA, 19 nt, Human
augugggaaaugguucucc

SEQ ID NO: 65705 - RNA, 16 nt, Human
cugggcaccuggcuca

SEQ ID NO: 65706 - RNA, 26 nt, Human
gacuaugugaaccauauccaacuacu

SEQ ID NO: 65707 - RNA, 26 nt, Human
uccuugcccugucuggaggcugcuag

SEQ ID NO: 65708 - RNA, 26 nt, Human
gggcccugggcucugggcccugcugc

SEQ ID NO: 65709 - RNA, 21 nt, Human
gccacuguuuuccagccuggg

SEQ ID NO: 65710 - RNA, 23 nt, Human
cgccaugagcgagaugacgggga

SEQ ID NO: 65711 - RNA, 24 nt, Human
uuggugaagaacaucccaagccag

SEQ ID NO: 65712 - RNA, 27 nt, Human
uaaaacaaugaggaaauguuggucaug

SEQ ID NO: 65713 - RNA, 22 nt, Human
ccacugcgccuggccuguugcu

SEQ ID NO: 65714 - RNA, 20 nt, Human
gccuucccccucccagggcc

SEQ ID NO: 65715 - RNA, 20 nt, Human
uaaauaacugcacauucucc

SEQ ID NO: 65716 - RNA, 20 nt, Human
ccccuccaggcucuuuggca

SEQ ID NO: 65717 - RNA, 22 nt, Human
gauugggaaaaauuauaacucu

SEQ ID NO: 65718 - RNA, 23 nt, Human
ugaacaaaccuuguaaaguucca

SEQ ID NO: 65719 - RNA, 18 nt, Human
aacugauuugugaaguua

SEQ ID NO: 65720 - RNA, 21 nt, Human
uugcacauagauaugguaguc

SEQ ID NO: 65721 - RNA, 21 nt, Human
cugguucagacccagcgaggg

SEQ ID NO: 65722 - RNA, 22 nt, Human
uagcgcaggucugggagccaga

SEQ ID NO: 65723 - RNA, 20 nt, Human
ccuccugugcuuacccacag

SEQ ID NO: 65724 - RNA, 21 nt, Human
cgcccaggcugcagugcagug

SEQ ID NO: 65725 - RNA, 22 nt, Human
cccaaguuuucccuugugcauu

SEQ ID NO: 65726 - RNA, 22 nt, Human
uuguaccucccaaguauuuggg

SEQ ID NO: 65727 - RNA, 22 nt, Human
gugggagcaagggacagggagc

SEQ ID NO: 65728 - RNA, 25 nt, Human
gcugcccucugcugccuguuggggu

SEQ ID NO: 65729 - RNA, 27 nt, Human
aagaggaagguccuuggaggguaucag

SEQ ID NO: 65730 - RNA, 27 nt, Human
uaacugcauugagaacugcauauguuu

SEQ ID NO: 65731 - RNA, 22 nt, Human
uccagugaggcuuagaggagcc

SEQ ID NO: 65732 - RNA, 24 nt, Human
cacggaccaucuuuagcaguuucc

SEQ ID NO: 65733 - RNA, 24 nt, Human
cgcugccaucaacaugucgguccc

SEQ ID NO: 65734 - RNA, 24 nt, Human
caccgcaugcguguggaguguccg

SEQ ID NO: 65735 - RNA, 22 nt, Human
ucgcccaggcuggagugcaaug

SEQ ID NO: 65736 - RNA, 27 nt, Human
aaacuuccagaccagcccucucacuac

SEQ ID NO: 65737 - RNA, 26 nt, Human
gcacacacuuccggacacacaugcac

SEQ ID NO: 65738 - RNA, 20 nt, Human
cagaagugccugguucuggg

SEQ ID NO: 65739 - RNA, 22 nt, Human
uagcuaaaucacaaaacaucca

SEQ ID NO: 65740 - RNA, 25 nt, Human
ccuuccaggaagccugcagcguuca

SEQ ID NO: 65741 - RNA, 21 nt, Human
ucuccagccuuucucccucac

SEQ ID NO: 65742 - RNA, 22 nt, Human
gguccccgagacacaggcacgg

SEQ ID NO: 65743 - RNA, 23 nt, Human
uucucuccucacacacagacuca

SEQ ID NO: 65744 - RNA, 22 nt, Human
gucucaaacuccugaacccuag

SEQ ID NO: 65745 - RNA, 17 nt, Human
agguuggagaugacaga

SEQ ID NO: 65746 - RNA, 24 nt, Human
aacucuagcccuggaucugccuuc

SEQ ID NO: 65747 - RNA, 21 nt, Human
gccgccgccgccuccuccucc

SEQ ID NO: 65748 - RNA, 20 nt, Human
aggcgacuuccucuccagcc

SEQ ID NO: 65749 - RNA, 22 nt, Human
agagcuaggcuguggaguagag

SEQ ID NO: 65750 - RNA, 21 nt, Human
auagcgugaucucggcucacu

SEQ ID NO: 65751 - RNA, 20 nt, Human
ccuuagacuccguuagcucc

SEQ ID NO: 65752 - RNA, 23 nt, Human
gguguuuucacauuucuuccucu

SEQ ID NO: 65753 - RNA, 26 nt, Human
ucuaaccccuccuuucuuaggcuaga

SEQ ID NO: 65754 - RNA, 21 nt, Human
agcaggcuuccaugcugcugu

SEQ ID NO: 65755 - RNA, 22 nt, Human
cccaggcccaucugagggacca

SEQ ID NO: 65756 - RNA, 24 nt, Human
ccagaggaagacuccugaaacccu

SEQ ID NO: 65757 - RNA, 20 nt, Human
ucagaagccauggggccaag

SEQ ID NO: 65758 - RNA, 21 nt, Human
guuuuguauacaaaugggauu

SEQ ID NO: 65759 - RNA, 20 nt, Human
aaagugggaaagcuuucauu

SEQ ID NO: 65760 - RNA, 21 nt, Human
acaguagauguguagucaguu

SEQ ID NO: 65761 - RNA, 22 nt, Human
cacuaccgggggcucugagcca

SEQ ID NO: 65762 - RNA, 18 nt, Human
acugucagaaaugccucc

SEQ ID NO: 65763 - RNA, 27 nt, Human
ugguggaggcaaccugaccagaaacac

SEQ ID NO: 65764 - RNA, 21 nt, Human
cagucugaugccagcugggag

SEQ ID NO: 65765 - RNA, 25 nt, Human
cuuacccacacuucccucugauuug

SEQ ID NO: 65766 - RNA, 27 nt, Human
ugucccccuuaugaccaacagcacauu

SEQ ID NO: 65767 - RNA, 23 nt, Human
acccaccaaggucaugugacuuu

SEQ ID NO: 65768 - RNA, 24 nt, Human
cauguaaacaaaauuuaguuuuug

SEQ ID NO: 65769 - RNA, 21 nt, Human
uccugcaggcagcccgguuug

SEQ ID NO: 65770 - RNA, 26 nt, Human
augugggacuuacaagcacuucucac

SEQ ID NO: 65771 - RNA, 23 nt, Human
gggaaacacugagucuuguuggg

SEQ ID NO: 65772 - RNA, 24 nt, Human
ucugcauucuucucuccacaugcc

SEQ ID NO: 65773 - RNA, 22 nt, Human
cccuauucccuccucugaaaug

SEQ ID NO: 65774 - RNA, 26 nt, Human
ccuguucuguuggggagggguagcca

SEQ ID NO: 65775 - RNA, 25 nt, Human
ccugcccccgcauccccugccucca

SEQ ID NO: 65776 - RNA, 24 nt, Human
caccuugccauacauucuguuuca

SEQ ID NO: 65777 - RNA, 23 nt, Human
uaccugucuggaacaaggaaaag

SEQ ID NO: 65778 - RNA, 22 nt, Human
cagaaacuuugccauuguugga

SEQ ID NO: 65779 - RNA, 20 nt, Human
auucagcuuuguccaaagga

SEQ ID NO: 65780 - RNA, 21 nt, Human
cacacugcacuccagccuggg

SEQ ID NO: 65781 - RNA, 24 nt, Human
cuuuguauuucaaagaaggugcug

SEQ ID NO: 65782 - RNA, 24 nt, Human
uaagugacucagcacccugccuca

SEQ ID NO: 65783 - RNA, 21 nt, Human
cagauguguugggcaugugaa

SEQ ID NO: 65784 - RNA, 22 nt, Human
gaggcgggaucuggcuguaaua

SEQ ID NO: 65785 - RNA, 27 nt, Human
uggaaggcagccaggcuggcagauuuc

SEQ ID NO: 65786 - RNA, 28 nt, Human
caagcgucugcaugugugugaucagaug

SEQ ID NO: 65787 - RNA, 22 nt, Human
ggaccucuuugauucugugguu

SEQ ID NO: 65788 - RNA, 22 nt, Human
ucuccacaaauuccaucaucga

SEQ ID NO: 65789 - RNA, 25 nt, Human
cuggcuacugcugcuuccuguggcc

SEQ ID NO: 65790 - RNA, 22 nt, Human
ccaugacaagaacaaagccacu

SEQ ID NO: 65791 - RNA, 24 nt, Human
accuguacugucaggugcacuuug

SEQ ID NO: 65792 - RNA, 24 nt, Human
guacuuuuaacacuuuagugccug

SEQ ID NO: 65793 - RNA, 20 nt, Human
uugcuacccagaaaucaucu

SEQ ID NO: 65794 - RNA, 27 nt, Human
gggccuuuuauaagccuuaggaaaaga

SEQ ID NO: 65795 - RNA, 20 nt, Human
auuaguucagccauugugga

SEQ ID NO: 65796 - RNA, 19 nt, Human
caaaguccagggucuggug

SEQ ID NO: 65797 - RNA, 23 nt, Human
accugacacagagcaggcacuca

SEQ ID NO: 65798 - RNA, 20 nt, Human
ucaagacgcaggacgagcuc

SEQ ID NO: 65799 - RNA, 21 nt, Human
augaggcuuaaaagggaccag

SEQ ID NO: 65800 - RNA, 23 nt, Human
agccuggcucuaccugcugugcu

SEQ ID NO: 65801 - RNA, 26 nt, Human
ccucugucugcccgcugccucuuguc

SEQ ID NO: 65802 - RNA, 25 nt, Human
ugccgccuucugggcagguagcagu

SEQ ID NO: 65803 - RNA, 22 nt, Human
cgcagcuucugagaccaggguu

SEQ ID NO: 65804 - RNA, 22 nt, Human
agagccaccuggcagggcucac

SEQ ID NO: 65805 - RNA, 21 nt, Human
cuccagccucuccuccauucc

SEQ ID NO: 65806 - RNA, 23 nt, Human
guacuggucccuuccuuuuguua

SEQ ID NO: 65807 - RNA, 19 nt, Human
gguggugcuugcuauaugc

SEQ ID NO: 65808 - RNA, 22 nt, Human
gcagccugggcaacauggugaa

SEQ ID NO: 65809 - RNA, 21 nt, Human
acagaacucucccugcuggac

SEQ ID NO: 65810 - RNA, 24 nt, Human
acgcugguacuuuagcccugggcu

SEQ ID NO: 65811 - RNA, 19 nt, Human
ccccugccugcugccucag

SEQ ID NO: 65812 - RNA, 25 nt, Human
agguccuggacaauaagcaacagau

SEQ ID NO: 65813 - RNA, 19 nt, Human
aggacagcuugcuucuuug

SEQ ID NO: 65814 - RNA, 24 nt, Human
ugaaaccaggguagaauuguuugg

SEQ ID NO: 65815 - RNA, 17 nt, Human
aucauaaaaacgacugu

SEQ ID NO: 65816 - RNA, 23 nt, Human
ggagcacguuuggugagagacca

SEQ ID NO: 65817 - RNA, 24 nt, Human
aaucugagcagucauuuaucagug

SEQ ID NO: 65818 - RNA, 25 nt, Human
cagcaagucucaagaacacagcugc

SEQ ID NO: 65819 - RNA, 23 nt, Human
uaucuauugcacaccacacuaca

SEQ ID NO: 65820 - RNA, 26 nt, Human
ucacccaggcuccagcuagaucauca

SEQ ID NO: 65821 - RNA, 27 nt, Human
agcuagcagcccgucccccuccgacuc

SEQ ID NO: 65822 - RNA, 22 nt, Human
ccuccaccauacuccaucaguu

SEQ ID NO: 65823 - RNA, 19 nt, Human
uacaagugauauuugcagg

SEQ ID NO: 65824 - RNA, 30 nt, Human
auggacacccuuuucccugccuggaggagc

SEQ ID NO: 65825 - RNA, 23 nt, Human
agcugcccggcuggccuaggcag

SEQ ID NO: 65826 - RNA, 22 nt, Human
agacccuucuauuuagaguaga

SEQ ID NO: 65827 - RNA, 26 nt, Human
ccccaucucagagcucagaggguaca

SEQ ID NO: 65828 - RNA, 21 nt, Human
uaagugcuggacugcaggcug

SEQ ID NO: 65829 - RNA, 26 nt, Human
cugugacccuccuuuuuuggccuccu

SEQ ID NO: 65830 - RNA, 22 nt, Human
gaagcucugugccuggucugua

SEQ ID NO: 65831 - RNA, 25 nt, Human
cagcuguccuaagaagcaguuguca

SEQ ID NO: 65832 - RNA, 24 nt, Human
aguugcuuguguuuaacugugaac

SEQ ID NO: 65833 - RNA, 27 nt, Human
ccuucgcugaggcuucgccugccuccu

SEQ ID NO: 65834 - RNA, 21 nt, Human
gucuggauggaggcuggaggc

SEQ ID NO: 65835 - RNA, 22 nt, Human
cgaacuccugaccucaggugau

SEQ ID NO: 65836 - RNA, 24 nt, Human
ucuguucugcuguggccugagcuc

SEQ ID NO: 65837 - RNA, 20 nt, Human
cucuguacaaaaacaaaaca

SEQ ID NO: 65838 - RNA, 23 nt, Human
uagaauacuaauaaaauacauac

SEQ ID NO: 65839 - RNA, 22 nt, Human
aggcugaggugggaaaaucacu

SEQ ID NO: 65840 - RNA, 21 nt, Human
ugucucagggugcagagguca

SEQ ID NO: 65841 - RNA, 27 nt, Human
agaagagagucuucccgagaaggcaga

SEQ ID NO: 65842 - RNA, 22 nt, Human
accuguaaucuuaacacugugg

SEQ ID NO: 65843 - RNA, 22 nt, Human
agaaacugaggccacagagcua

SEQ ID NO: 65844 - RNA, 20 nt, Human
aaaggaaaaggaauguagcu

SEQ ID NO: 65845 - RNA, 27 nt, Human
aggggucaguagcagaagcagagggag

SEQ ID NO: 65846 - RNA, 26 nt, Human
cuucauuuuccucgucugucaaacag

SEQ ID NO: 65847 - RNA, 20 nt, Human
aaugccuccucccugggcag

SEQ ID NO: 65848 - RNA, 25 nt, Human
gggaagaaaacggcccugucuccau

SEQ ID NO: 65849 - RNA, 22 nt, Human
ggcccucuggggcucagcucug

SEQ ID NO: 65850 - RNA, 21 nt, Human
ucuccaggcuggagugcagug

SEQ ID NO: 65851 - RNA, 20 nt, Human
ccaagccaaguuuucucaac

SEQ ID NO: 65852 - RNA, 24 nt, Human
ccugcccacacuccuaccugcugc

SEQ ID NO: 65853 - RNA, 24 nt, Human
ccugcccgcacuccugccugcugc

SEQ ID NO: 65854 - RNA, 27 nt, Human
gcaaguagcuggcuguacugccaaggu

SEQ ID NO: 65855 - RNA, 22 nt, Human
ccucucacuggugcgauggaag

SEQ ID NO: 65856 - RNA, 21 nt, Human
cggcagccaggcuucauauuc

SEQ ID NO: 65857 - RNA, 22 nt, Human
gcuuuucucccaaaaaucggcu

SEQ ID NO: 65858 - RNA, 22 nt, Human
cuagucacgugaaaccucuucu

SEQ ID NO: 65859 - RNA, 20 nt, Human
uuguaacauugcaguaaugg

SEQ ID NO: 65860 - RNA, 20 nt, Human
acaugccacugccugcaccu

SEQ ID NO: 65861 - RNA, 24 nt, Human
ggagaggccucauccagggcccag

SEQ ID NO: 65862 - RNA, 23 nt, Human
gaugugguggcucauaccuguaa

SEQ ID NO: 65863 - RNA, 25 nt, Human
ugugggcagugaugucauucggugc

SEQ ID NO: 65864 - RNA, 19 nt, Human
cuguuugcagaaagugggu

SEQ ID NO: 65865 - RNA, 23 nt, Human
gcugggagaggaaauuagagggg

SEQ ID NO: 65866 - RNA, 23 nt, Human
aaaucacuggggggcugggccuu

SEQ ID NO: 65867 - RNA, 18 nt, Human
gugaugcuugccuuuuga

SEQ ID NO: 65868 - RNA, 19 nt, Human
uuuaaaaaauguuuucugg

SEQ ID NO: 65869 - RNA, 22 nt, Human
gcgugcaccaccaugcauagcu

SEQ ID NO: 65870 - RNA, 24 nt, Human
uagacuucucuagcuuuucacuag

SEQ ID NO: 65871 - RNA, 22 nt, Human
agacuuuacaugacuaggcuga

SEQ ID NO: 65872 - RNA, 22 nt, Human
cccaaauugucagccuucuuac

SEQ ID NO: 65873 - RNA, 22 nt, Human
ucuuccuuuucaauuucauugg

SEQ ID NO: 65874 - RNA, 22 nt, Human
gccugaccucccccuccuuccc

SEQ ID NO: 65875 - RNA, 27 nt, Human
uuuggggcugaaaugagugauccugcc

SEQ ID NO: 65876 - RNA, 27 nt, Human
guugcccaguguucuccugguuuagca

SEQ ID NO: 65877 - RNA, 25 nt, Human
caauacucuuucacuuaauucuuua

SEQ ID NO: 65878 - RNA, 22 nt, Human
aacccaugauacccuacugaac

SEQ ID NO: 65879 - RNA, 24 nt, Human
ucugggguuuccucucccugcccc

SEQ ID NO: 65880 - RNA, 22 nt, Human
cacaaggucaggagaucgagac

SEQ ID NO: 65881 - RNA, 24 nt, Human
gagagggagagcugugguacuggc

SEQ ID NO: 65882 - RNA, 27 nt, Human
cuuugauacacaaccuucucuaaccaa

SEQ ID NO: 65883 - RNA, 27 nt, Human
uagacuuuuguucugucccuggggugu

SEQ ID NO: 65884 - RNA, 18 nt, Human
gccccuuccccagccuca

SEQ ID NO: 65885 - RNA, 21 nt, Human
cucuccucuccccugugagcu

SEQ ID NO: 65886 - RNA, 23 nt, Human
cugucacccuccaccucuucacc

SEQ ID NO: 65887 - RNA, 21 nt, Human
cucccaggcuggagugcagug

SEQ ID NO: 65888 - RNA, 22 nt, Human
uccuacucuccacuacacagag

SEQ ID NO: 65889 - RNA, 23 nt, Human
ggggugagggggauaaggucugu

SEQ ID NO: 65890 - RNA, 22 nt, Human
cacgccuguaaucccagcacug

SEQ ID NO: 65891 - RNA, 20 nt, Human
ccuauaagaauaucccaaga

SEQ ID NO: 65892 - RNA, 21 nt, Human
gaggauguuuuaaauacaugc

SEQ ID NO: 65893 - RNA, 27 nt, Human
accuagcugcaauggcuacaggcuccc

SEQ ID NO: 65894 - RNA, 27 nt, Human
cccugcuccucucugugguuggaggaa

SEQ ID NO: 65895 - RNA, 22 nt, Human
agucuauacauagaugcauauu

SEQ ID NO: 65896 - RNA, 22 nt, Human
ucccucacuuggacacucaggg

SEQ ID NO: 65897 - RNA, 22 nt, Human
acuaucugcagcuaguguguuu

SEQ ID NO: 65898 - RNA, 26 nt, Human
aauccaauuacagcuaucagccucaa

SEQ ID NO: 65899 - RNA, 22 nt, Human
ccccaacaggggaugcucauca

SEQ ID NO: 65900 - RNA, 28 nt, Human
gccuacauuuucaaccacaauaaagaug

SEQ ID NO: 65901 - RNA, 20 nt, Human
gggagagccucacugcugag

SEQ ID NO: 65902 - RNA, 22 nt, Human
uugguaacacugaaaguaguau

SEQ ID NO: 65903 - RNA, 26 nt, Human
cucacccuccugagcugggauuacag

SEQ ID NO: 65904 - RNA, 26 nt, Human
ucacccaguucagguguauagggaau

SEQ ID NO: 65905 - RNA, 22 nt, Human
cagaaucucgcucugucgccca

SEQ ID NO: 65906 - RNA, 22 nt, Human
uagaaucuugcucugucgccca

SEQ ID NO: 65907 - RNA, 22 nt, Human
uccagugcuuuccagccggguu

SEQ ID NO: 65908 - RNA, 21 nt, Human
aaagcgcuggauuacaggcau

SEQ ID NO: 65909 - RNA, 22 nt, Human
cuuacagagacucucccugacg

SEQ ID NO: 65910 - RNA, 21 nt, Human
uuuguuauucuuuuccagaaa

SEQ ID NO: 65911 - RNA, 23 nt, Human
caucggccgccuccagcucccgg

SEQ ID NO: 65912 - RNA, 24 nt, Human
gcauggacgaacuguucccccuca

SEQ ID NO: 65913 - RNA, 25 nt, Human
gauugcaugacugaauuugcuuaag

SEQ ID NO: 65914 - RNA, 22 nt, Human
cggacagacgccuugcccaggg

SEQ ID NO: 65915 - RNA, 23 nt, Human
gccauccugccauacauccagga

SEQ ID NO: 65916 - RNA, 21 nt, Human
gcucacugcagccucgaccuc

SEQ ID NO: 65917 - RNA, 16 nt, Human
gguggcagcuguggga

SEQ ID NO: 65918 - RNA, 22 nt, Human
aacuguuucaccaguacaguga

SEQ ID NO: 65919 - RNA, 22 nt, Human
aaagaaauuccuauuugaaaug

SEQ ID NO: 65920 - RNA, 19 nt, Human
uuuccucccuccucccaca

SEQ ID NO: 65921 - RNA, 22 nt, Human
cgggaccuguggaccacgacca

SEQ ID NO: 65922 - RNA, 21 nt, Human
ccuguaaucccaguacuuggg

SEQ ID NO: 65923 - RNA, 26 nt, Human
gcaggguggagcagaaagugaaggag

SEQ ID NO: 65924 - RNA, 30 nt, Human
uauguguaugcaaguacaaguauauaauau

SEQ ID NO: 65925 - RNA, 27 nt, Human
aaauacuggagcaacaaugccccugcu

SEQ ID NO: 65926 - RNA, 18 nt, Human
gggagggagaugagaagu

SEQ ID NO: 65927 - RNA, 22 nt, Human
gggaggcggauguugaagugag

SEQ ID NO: 65928 - RNA, 25 nt, Human
gggcugggugcaguggcucaugccu

SEQ ID NO: 65929 - RNA, 20 nt, Human
cagcguaggagaaaggccac

SEQ ID NO: 65930 - RNA, 26 nt, Human
gcaacaacccagaacuuacaaacuuc

SEQ ID NO: 65931 - RNA, 22 nt, Human
cccuuauuccucccucauaccu

SEQ ID NO: 65932 - RNA, 21 nt, Human
aaagugcuggauuacaggugu

SEQ ID NO: 65933 - RNA, 25 nt, Human
aguauuccuuauggcugccacucuu

SEQ ID NO: 65934 - RNA, 24 nt, Human
ucuacacuucuuuuuucccccuca

SEQ ID NO: 65935 - RNA, 20 nt, Human
uguuuuuguuuuugccaaag

SEQ ID NO: 65936 - RNA, 25 nt, Human
gaugccuguaaacacaacaguauuu

SEQ ID NO: 65937 - RNA, 25 nt, Human
gucucaagaguaaacccugugucuu

SEQ ID NO: 65938 - RNA, 20 nt, Human
uggcuuuguugcugccaaag

SEQ ID NO: 65939 - RNA, 21 nt, Human
ccacaugcuuggcugugucau

SEQ ID NO: 65940 - RNA, 25 nt, Human
gcuagcauuucagcaugauauugca

SEQ ID NO: 65941 - RNA, 23 nt, Human
gcaaguggcuuucaacacacaac

SEQ ID NO: 65942 - RNA, 23 nt, Human
aauucauauggagaaaaacccua

SEQ ID NO: 65943 - RNA, 29 nt, Human
cacaaagcccagacgcggagaaaauggcg

SEQ ID NO: 65944 - RNA, 20 nt, Human
agcuggcaaucugcaccuug

SEQ ID NO: 65945 - RNA, 24 nt, Human
agaauaggugcagagaugaaguga

SEQ ID NO: 65946 - RNA, 22 nt, Human
guuggggcaaaggugucccgug

SEQ ID NO: 65947 - RNA, 27 nt, Human
uuuuccugugggcagaagggcugagga

SEQ ID NO: 65948 - RNA, 23 nt, Human
ugccagcuacucgggaggcugag

SEQ ID NO: 65949 - RNA, 27 nt, Human
cacugcaauccagccugggcaacagag

SEQ ID NO: 65950 - RNA, 21 nt, Human
gggacaucagagguucuuuga

SEQ ID NO: 65951 - RNA, 23 nt, Human
agucugcguggugcaguggaaca

SEQ ID NO: 65952 - RNA, 27 nt, Human
ggcgacaccuccgcgggcacucaccca

SEQ ID NO: 65953 - RNA, 22 nt, Human
ucgccuaggcuggagugcagug

SEQ ID NO: 65954 - RNA, 21 nt, Human
acaggcaucuacacagccugg

SEQ ID NO: 65955 - RNA, 24 nt, Human
guaagguagaaauagagauaaaaa

SEQ ID NO: 65956 - RNA, 17 nt, Human
ggccgcgucccaccugc

SEQ ID NO: 65957 - RNA, 25 nt, Human
ggcgggcgggaggggagguggcagg

SEQ ID NO: 65958 - RNA, 24 nt, Human
auugccucugaacccagauggcaa

SEQ ID NO: 65959 - RNA, 19 nt, Human
ggagcgggaaaggagcagu

SEQ ID NO: 65960 - RNA, 21 nt, Human
cacagacaaaagcgcuuuucc

SEQ ID NO: 65961 - RNA, 19 nt, Human
gaaaagauuuuucacugga

SEQ ID NO: 65962 - RNA, 20 nt, Human
ucagcaauaaauacuucuca

SEQ ID NO: 65963 - RNA, 24 nt, Human
cagaaagagguugcugcaguuugg

SEQ ID NO: 65964 - RNA, 18 nt, Human
auccagcagcagcacuua

SEQ ID NO: 65965 - RNA, 27 nt, Human
cugucuuugugcugaauacgcuaagcc

SEQ ID NO: 65966 - RNA, 25 nt, Human
gcugggcacuucccugcugccugua

SEQ ID NO: 65967 - RNA, 19 nt, Human
cucagaaugaaaauucauu

SEQ ID NO: 65968 - RNA, 30 nt, Human
cucuuggaucuacccugaguauccuccaaa

SEQ ID NO: 65969 - RNA, 25 nt, Human
auuaaguaaucuuuuuacaguugca

SEQ ID NO: 65970 - RNA, 28 nt, Human
gccucggaacccaggccuggggggcggu

SEQ ID NO: 65971 - RNA, 26 nt, Human
cagagcugggugaguggggagacacc

SEQ ID NO: 65972 - RNA, 20 nt, Human
ugccuggaacuggcugugaa

SEQ ID NO: 65973 - RNA, 19 nt, Human
gacaggacugcaagaggga

SEQ ID NO: 65974 - RNA, 25 nt, Human
gcuagcaucucccuguaacucuccc

SEQ ID NO: 65975 - RNA, 27 nt, Human
ggguacccgggcacaccagcccucaga

SEQ ID NO: 65976 - RNA, 24 nt, Human
uauugucauauuguuauuuucucu

SEQ ID NO: 65977 - RNA, 26 nt, Human
ccuuucuccuucuggagaucaaccca

SEQ ID NO: 65978 - RNA, 22 nt, Human
uucucaccucugauuccggcuc

SEQ ID NO: 65979 - RNA, 23 nt, Human
uggauucuugaacaaacuggaaa

SEQ ID NO: 65980 - RNA, 27 nt, Human
ccacaaacaagaauacagguaucuugg

SEQ ID NO: 65981 - RNA, 22 nt, Human
guugcuuaagaaauacuuguug

SEQ ID NO: 65982 - RNA, 21 nt, Human
ccaagcagagguggagaaggg

SEQ ID NO: 65983 - RNA, 19 nt, Human
gccgcccagccucuccucu

SEQ ID NO: 65984 - RNA, 29 nt, Human
gccgacucugcacucuccacccuggcugg

SEQ ID NO: 65985 - RNA, 19 nt, Human
gcaggcaaagacuuguuca

SEQ ID NO: 65986 - RNA, 22 nt, Human
aacuucggaguuuuuccuugcu

SEQ ID NO: 65987 - RNA, 19 nt, Human
gcacaaaucucagcucacu

SEQ ID NO: 65988 - RNA, 29 nt, Human
ucuacuuuuaaguugcugaugaacucuua

SEQ ID NO: 65989 - RNA, 23 nt, Human
cuuacccagcaucuggaguacag

SEQ ID NO: 65990 - RNA, 23 nt, Human
guggcuggcccugcuggcccugc

SEQ ID NO: 65991 - RNA, 22 nt, Human
cucucauuuucucuuguggacc

SEQ ID NO: 65992 - RNA, 20 nt, Human
ccagggugguccauucaagc

SEQ ID NO: 65993 - RNA, 22 nt, Human
gccgcucucaguggacagggca

SEQ ID NO: 65994 - RNA, 17 nt, Human
uguggugagaucaugcc

SEQ ID NO: 65995 - RNA, 21 nt, Human
ggcuuggaacacugucuuaca

SEQ ID NO: 65996 - RNA, 22 nt, Human
gaccagcuugggcaacauagug

SEQ ID NO: 65997 - RNA, 26 nt, Human
gccgggcagaggggcagauggaaagg

SEQ ID NO: 65998 - RNA, 22 nt, Human
cacgccuguaauccuggcacuu

SEQ ID NO: 65999 - RNA, 26 nt, Human
uucccucugcuguaaaugcaggucuc

SEQ ID NO: 66000 - RNA, 20 nt, Human
guucuauagccuucucuugc

SEQ ID NO: 66001 - RNA, 28 nt, Human
uuguaggugagaugcaacaagcccugcu

SEQ ID NO: 66002 - RNA, 26 nt, Human
acccucaccugcggugcccagcugcc

SEQ ID NO: 66003 - RNA, 23 nt, Human
ccugguuugaggaggagggacuc

SEQ ID NO: 66004 - RNA, 26 nt, Human
gccuccuguggccugccagucaucga

SEQ ID NO: 66005 - RNA, 22 nt, Human
aaacugcacuaugauuugcuuu

SEQ ID NO: 66006 - RNA, 24 nt, Human
gcucucaucauaugcaaauucuca

SEQ ID NO: 66007 - RNA, 24 nt, Human
ugugagccuaggguaggggcacug

SEQ ID NO: 66008 - RNA, 21 nt, Human
uuuggggaaugaacagcagca

SEQ ID NO: 66009 - RNA, 25 nt, Human
cccaccccaaaucuggucgucuccu

SEQ ID NO: 66010 - RNA, 22 nt, Human
cacagcucgugggccugggcgg

SEQ ID NO: 66011 - RNA, 22 nt, Human
uuuccuucuaccuaucuugccu

SEQ ID NO: 66012 - RNA, 27 nt, Human
ccucuacuaaaagauucaggcagcuua

SEQ ID NO: 66013 - RNA, 19 nt, Human
ucucauugagccucaggcu

SEQ ID NO: 66014 - RNA, 27 nt, Human
acccaacaacuaaaugguuuagauugu

SEQ ID NO: 66015 - RNA, 26 nt, Human
guuuucugggucauagggagcacauu

SEQ ID NO: 66016 - RNA, 21 nt, Human
cagaaccucuaagugcugcug

SEQ ID NO: 66017 - RNA, 25 nt, Human
ggaacagacauggaccuucucucca

SEQ ID NO: 66018 - RNA, 26 nt, Human
uuauccuugucguaggaaaaccauga

SEQ ID NO: 66019 - RNA, 21 nt, Human
uucugucuuuguuccuucuua

SEQ ID NO: 66020 - RNA, 26 nt, Human
ugacauacugggaaaggcagagggug

SEQ ID NO: 66021 - RNA, 23 nt, Human
cugccuagccugggcuggagucc

SEQ ID NO: 66022 - RNA, 27 nt, Human
agcuuugacccgaaguaguugaagagc

SEQ ID NO: 66023 - RNA, 24 nt, Human
cguucugccagcuggccuggggau

SEQ ID NO: 66024 - RNA, 23 nt, Human
ccucuuccccacuucccugcacu

SEQ ID NO: 66025 - RNA, 20 nt, Human
agaaggcacaggccacugca

SEQ ID NO: 66026 - RNA, 24 nt, Human
uuugcaguucaaugagaagaggga

SEQ ID NO: 66027 - RNA, 20 nt, Human
ucagauucuucaucuguaua

SEQ ID NO: 66028 - RNA, 24 nt, Human
gggacuucaaaaucagugauggga

SEQ ID NO: 66029 - RNA, 22 nt, Human
cucagguaguacugggaaugga

SEQ ID NO: 66030 - RNA, 19 nt, Human
ccucccccuaauucucauc

SEQ ID NO: 66031 - RNA, 23 nt, Human
gcuacuucuccccuccucuugcc

SEQ ID NO: 66032 - RNA, 21 nt, Human
caaguguccaucuccaucgga

SEQ ID NO: 66033 - RNA, 27 nt, Human
uggcucacgccuguaauccagcacuuu

SEQ ID NO: 66034 - RNA, 22 nt, Human
ccaggaggcagagauugcggug

SEQ ID NO: 66035 - RNA, 20 nt, Human
aguaauucccaucugccuuu

SEQ ID NO: 66036 - RNA, 19 nt, Human
cccaccccaaguuccaccu

SEQ ID NO: 66037 - RNA, 20 nt, Human
uugagaaucaguuuugaccu

SEQ ID NO: 66038 - RNA, 22 nt, Human
ucccucacaucacacagcugca

SEQ ID NO: 66039 - RNA, 24 nt, Human
ccgccucggcgcugccugcguugc

SEQ ID NO: 66040 - RNA, 25 nt, Human
aagauguaauuuuuacuuuaucucu

SEQ ID NO: 66041 - RNA, 20 nt, Human
cuuaguuuuuucaucuguaa

SEQ ID NO: 66042 - RNA, 26 nt, Human
ccagccccaauccaaaacuggcaagg

SEQ ID NO: 66043 - RNA, 18 nt, Human
gauccacccuccucagcc

SEQ ID NO: 66044 - RNA, 18 nt, Human
gagaagggagagauucag

SEQ ID NO: 66045 - RNA, 27 nt, Human
ugggccugagucuagccugggagccag

SEQ ID NO: 66046 - RNA, 21 nt, Human
gucacugugcaguugugcaca

SEQ ID NO: 66047 - RNA, 27 nt, Human
gggaguggccagcggcccugcccagau

SEQ ID NO: 66048 - RNA, 20 nt, Human
uucuccaaaaggacagggca

SEQ ID NO: 66049 - RNA, 23 nt, Human
cuguggaaaacauacauucugug

SEQ ID NO: 66050 - RNA, 22 nt, Human
ucagcucuuccugcuacuccag

SEQ ID NO: 66051 - RNA, 22 nt, Human
ggggcugucucuggacauauca

SEQ ID NO: 66052 - RNA, 20 nt, Human
gagaggcucagccaccggaa

SEQ ID NO: 66053 - RNA, 26 nt, Human
aucacuauuucaaguuaaaggaucuc

SEQ ID NO: 66054 - RNA, 24 nt, Human
ugccaugcucagagaauccuagag

SEQ ID NO: 66055 - RNA, 26 nt, Human
gcccugcucaaccucuugcaggaggg

SEQ ID NO: 66056 - RNA, 22 nt, Human
cagaggacgggaggcuggaagc

SEQ ID NO: 66057 - RNA, 19 nt, Human
guuuccuuaccugcugcua

SEQ ID NO: 66058 - RNA, 28 nt, Human
cugagugguuuaaaaaggacuuuuaagu

SEQ ID NO: 66059 - RNA, 22 nt, Human
cauacacacacaaaccauuuua

SEQ ID NO: 66060 - RNA, 22 nt, Human
gcuguggcaucacaaaacauug

SEQ ID NO: 66061 - RNA, 22 nt, Human
cacccaggcuggagcacacugg

SEQ ID NO: 66062 - RNA, 27 nt, Human
agcucacugcacuccagcagucauggg

SEQ ID NO: 66063 - RNA, 20 nt, Human
ccaucuguaaagucuccucu

SEQ ID NO: 66064 - RNA, 21 nt, Human
ucugucuucuguuccuucuag

SEQ ID NO: 66065 - RNA, 22 nt, Human
gaaauguaccuucuuucacucu

SEQ ID NO: 66066 - RNA, 21 nt, Human
ccaaagugcuggauuacaggu

SEQ ID NO: 66067 - RNA, 21 nt, Human
augaucuugcaaaacagggau

SEQ ID NO: 66068 - RNA, 20 nt, Human
ccaguugcuuuuccccagau

SEQ ID NO: 66069 - RNA, 23 nt, Human
aagguaaccacaaaguuaugaug

SEQ ID NO: 66070 - RNA, 25 nt, Human
ggcucacuguagccucaaccugcca

SEQ ID NO: 66071 - RNA, 27 nt, Human
cagucucucaauggaauguucaugguc

SEQ ID NO: 66072 - RNA, 20 nt, Human
ggagcuccggccugcccagc

SEQ ID NO: 66073 - RNA, 24 nt, Human
ugaguggucggaccguggggaagg

SEQ ID NO: 66074 - RNA, 23 nt, Human
aaggcaucuuguugccuugccac

SEQ ID NO: 66075 - RNA, 21 nt, Human
aggggaaugaacauguuuucc

SEQ ID NO: 66076 - RNA, 22 nt, Human
cuucucgggggcccgccgcacg

SEQ ID NO: 66077 - RNA, 23 nt, Human
aagcucuuauacuaaaaagccuu

SEQ ID NO: 66078 - RNA, 22 nt, Human
aucgcuugaaccugagaggcgg

SEQ ID NO: 66079 - RNA, 19 nt, Human
gcguagcagcacacacuuc

SEQ ID NO: 66080 - RNA, 21 nt, Human
acucggggcccagcugugauu

SEQ ID NO: 66081 - RNA, 25 nt, Human
uuucuauaaugaucaguuuacuuuc

SEQ ID NO: 66082 - RNA, 26 nt, Human
ccgguuauuuaagucauuucugugau

SEQ ID NO: 66083 - RNA, 26 nt, Human
ugugggaaccagcaccucccaccaac

SEQ ID NO: 66084 - RNA, 26 nt, Human
ugaugaagcugagcagaguggaaacu

SEQ ID NO: 66085 - RNA, 22 nt, Human
accagccugggcaacauggcga

SEQ ID NO: 66086 - RNA, 24 nt, Human
uuacuaguuagcauacacauuuua

SEQ ID NO: 66087 - RNA, 30 nt, Human
gccaucugcauggccacucuugcccccaag

SEQ ID NO: 66088 - RNA, 23 nt, Human
ucgcucuucagggccugcccugg

SEQ ID NO: 66089 - RNA, 20 nt, Human
uucuuuauaauugaauuggu

SEQ ID NO: 66090 - RNA, 23 nt, Human
gaucauugcaaacucaacacaau

SEQ ID NO: 66091 - RNA, 22 nt, Human
cucugccauacgcgggcgcugc

SEQ ID NO: 66092 - RNA, 18 nt, Human
acuuucucaaagagcaac

SEQ ID NO: 66093 - RNA, 27 nt, Human
uucucucucauuuacucucguuuugcc

SEQ ID NO: 66094 - RNA, 18 nt, Human
aacugauuagauggguug

SEQ ID NO: 66095 - RNA, 22 nt, Human
cuuuaucuguguuuucuguaaa

SEQ ID NO: 66096 - RNA, 24 nt, Human
uucuguuccuugcaguucaccuca

SEQ ID NO: 66097 - RNA, 22 nt, Human
auucugcccaacuccauccucu

SEQ ID NO: 66098 - RNA, 21 nt, Human
cugagauggcccccacuguga

SEQ ID NO: 66099 - RNA, 19 nt, Human
ugcaugcucaggacccaua

SEQ ID NO: 66100 - RNA, 23 nt, Human
cgccuguuaccagaggauccccg

SEQ ID NO: 66101 - RNA, 19 nt, Human
cccaguccagccuccuggc

SEQ ID NO: 66102 - RNA, 22 nt, Human
aaaguucugggauuacaggcau

SEQ ID NO: 66103 - RNA, 22 nt, Human
aaagugcugggaugacaggcau

SEQ ID NO: 66104 - RNA, 22 nt, Human
ccacagcuggggccuggccuug

SEQ ID NO: 66105 - RNA, 23 nt, Human
acauuccuucuuuacuggucaca

SEQ ID NO: 66106 - RNA, 21 nt, Human
gggugcgguuugcucagcccc

SEQ ID NO: 66107 - RNA, 25 nt, Human
gccacccccuccaaccacugcccuc

SEQ ID NO: 66108 - RNA, 25 nt, Human
gcucugaagacagaauuagcuaacu

SEQ ID NO: 66109 - RNA, 21 nt, Human
ccccccagccccucagcccuc

SEQ ID NO: 66110 - RNA, 22 nt, Human
gccgcaguggccuuccccagca

SEQ ID NO: 66111 - RNA, 20 nt, Human
ucccuccuagacuccugggc

SEQ ID NO: 66112 - RNA, 26 nt, Human
cuggaggaagcuguuuugagccaggg

SEQ ID NO: 66113 - RNA, 24 nt, Human
ucagcggggccucugucuuuugug

SEQ ID NO: 66114 - RNA, 26 nt, Human
ccucauucccgcugaccucacuggcc

SEQ ID NO: 66115 - RNA, 24 nt, Human
cagccuguccuuuacuucauccac

SEQ ID NO: 66116 - RNA, 27 nt, Human
ggagcagaguccuuucugcuggugagg

SEQ ID NO: 66117 - RNA, 19 nt, Human
ucucccuccucugucacca

SEQ ID NO: 66118 - RNA, 27 nt, Human
uaauuuaugcucacaccuuacugcaca

SEQ ID NO: 66119 - RNA, 23 nt, Human
uccagaggggucacguguaggag

SEQ ID NO: 66120 - RNA, 22 nt, Human
ucaccauuagcaaauggaaauu

SEQ ID NO: 66121 - RNA, 21 nt, Human
cguauuagccaggauggucuc

SEQ ID NO: 66122 - RNA, 22 nt, Human
cccagcuggaagggacacuuuc

SEQ ID NO: 66123 - RNA, 20 nt, Human
ucacacucucagagucuggg

SEQ ID NO: 66124 - RNA, 22 nt, Human
aagcuguuuuuauuucguuuuu

SEQ ID NO: 66125 - RNA, 26 nt, Human
aacggagcuugcccgaggccaguuaa

SEQ ID NO: 66126 - RNA, 22 nt, Human
gagcugaggcauccaagaaaug

SEQ ID NO: 66127 - RNA, 26 nt, Human
gugacuucucuaccaagucugauguc

SEQ ID NO: 66128 - RNA, 24 nt, Human
agcacaaaauaaaaagcaucugua

SEQ ID NO: 66129 - RNA, 21 nt, Human
caccuaggcaagagugcaaug

SEQ ID NO: 66130 - RNA, 27 nt, Human
ggcgaagugccucacuuccuucucccg

SEQ ID NO: 66131 - RNA, 26 nt, Human
aauguucuuuaauguugucaggaaac

SEQ ID NO: 66132 - RNA, 22 nt, Human
uccuacuucacccauucaucua

SEQ ID NO: 66133 - RNA, 25 nt, Human
agcccuagaaagcugcugugauccc

SEQ ID NO: 66134 - RNA, 23 nt, Human
cugcaaccuccaccucccaggcu

SEQ ID NO: 66135 - RNA, 25 nt, Human
ggauccaacuggcugucugccucua

SEQ ID NO: 66136 - RNA, 20 nt, Human
gaaggcggcagacacuguga

SEQ ID NO: 66137 - RNA, 21 nt, Human
uugcuagcuuguaguuuucua

SEQ ID NO: 66138 - RNA, 21 nt, Human
guccacuccccucuugaugcc

SEQ ID NO: 66139 - RNA, 19 nt, Human
uuauaaccuccugccuggg

SEQ ID NO: 66140 - RNA, 24 nt, Human
uuugccguggcccuguccuguuua

SEQ ID NO: 66141 - RNA, 21 nt, Human
gcacaaaaguggccaugucga

SEQ ID NO: 66142 - RNA, 27 nt, Human
uccagagagugucuucgaggguaucau

SEQ ID NO: 66143 - RNA, 18 nt, Human
cucagcugcucgcaggcu

SEQ ID NO: 66144 - RNA, 28 nt, Human
uacauuguacauggcaugugggaucaau

SEQ ID NO: 66145 - RNA, 22 nt, Human
ccaccuccuggguucaagugau

SEQ ID NO: 66146 - RNA, 18 nt, Human
ccacugcacucaaccuua

SEQ ID NO: 66147 - RNA, 22 nt, Human
uaaccagccuggucaacauggu

SEQ ID NO: 66148 - RNA, 26 nt, Human
cccugcacuccagccugggcuucaga

SEQ ID NO: 66149 - RNA, 22 nt, Human
ccaggagacggagguugcagug

SEQ ID NO: 66150 - RNA, 22 nt, Human
auucccuuuuucuaaggcacag

SEQ ID NO: 66151 - RNA, 20 nt, Human
uccagcccagucggcccggc

SEQ ID NO: 66152 - RNA, 26 nt, Human
gccugcugagcaagguaccucagcca

SEQ ID NO: 66153 - RNA, 22 nt, Human
uuucuuuucuuugcccuccuga

SEQ ID NO: 66154 - RNA, 21 nt, Human
agaccaagcagacaauaggcc

SEQ ID NO: 66155 - RNA, 23 nt, Human
ugaaggauuuauuucaaacucuc

SEQ ID NO: 66156 - RNA, 25 nt, Human
uugcuuuucugugggccugaagguc

SEQ ID NO: 66157 - RNA, 21 nt, Human
aagcccaguggcaguucuggg

SEQ ID NO: 66158 - RNA, 23 nt, Human
cagauguuuuucuucauuaacca

SEQ ID NO: 66159 - RNA, 21 nt, Human
gccuguaaucccagcacuugg

SEQ ID NO: 66160 - RNA, 22 nt, Human
uugugauuucaaaauuaggcua

SEQ ID NO: 66161 - RNA, 25 nt, Human
ucccugugccggacuccagccgggg

SEQ ID NO: 66162 - RNA, 24 nt, Human
gcauuuuauuuugacccuggacug

SEQ ID NO: 66163 - RNA, 23 nt, Human
uggagaugagucagugccaugac

SEQ ID NO: 66164 - RNA, 25 nt, Human
aguaagaguacuauuaauagaacac

SEQ ID NO: 66165 - RNA, 27 nt, Human
ggagaggggacuuggauaggagcuucc

SEQ ID NO: 66166 - RNA, 23 nt, Human
auugagauauauacuacaagugc

SEQ ID NO: 66167 - RNA, 20 nt, Human
guagcuguguaaaguguggg

SEQ ID NO: 66168 - RNA, 26 nt, Human
uaacugcaauuagaaauugucuuuug

SEQ ID NO: 66169 - RNA, 25 nt, Human
auucaggcuggagugcaguggugcg

SEQ ID NO: 66170 - RNA, 24 nt, Human
ucaucccaacauuuacauccuuaa

SEQ ID NO: 66171 - RNA, 22 nt, Human
gucacccacgcuggagugcugu

SEQ ID NO: 66172 - RNA, 18 nt, Human
gagaugccaucucugucu

SEQ ID NO: 66173 - RNA, 22 nt, Human
gaaacaucauuauuggcaguuu

SEQ ID NO: 66174 - RNA, 21 nt, Human
gauggcagagagccagggcag

SEQ ID NO: 66175 - RNA, 22 nt, Human
agaacagagaagugacagcuag

SEQ ID NO: 66176 - RNA, 21 nt, Human
ucugcaggagcuggcgggcug

SEQ ID NO: 66177 - RNA, 25 nt, Human
cacuccccacucucagccugggaga

SEQ ID NO: 66178 - RNA, 19 nt, Human
uucaagacaucaccaucag

SEQ ID NO: 66179 - RNA, 22 nt, Human
auaaguaaauugauuuccuaau

SEQ ID NO: 66180 - RNA, 22 nt, Human
ucgcccaggcuggagugcagug

SEQ ID NO: 66181 - RNA, 22 nt, Human
ucacccaggcuggagugcggug

SEQ ID NO: 66182 - RNA, 22 nt, Human
uugcccaggcuggaguguagug

SEQ ID NO: 66183 - RNA, 27 nt, Human
ucugggagccugauuccuggauucagu

SEQ ID NO: 66184 - RNA, 23 nt, Human
uccauguaaggaaaugaaaagac

SEQ ID NO: 66185 - RNA, 21 nt, Human
uggcagcugcuuaccuugacc

SEQ ID NO: 66186 - RNA, 21 nt, Human
acaauugaugaauuguguaca

SEQ ID NO: 66187 - RNA, 27 nt, Human
acuggaaggggguucacggucaaacug

SEQ ID NO: 66188 - RNA, 27 nt, Human
agagguccugagcccacccuaguuggg

SEQ ID NO: 66189 - RNA, 22 nt, Human
agaaguuagaugagugcaagga

SEQ ID NO: 66190 - RNA, 16 nt, Human
acaaaggcugggaaug

SEQ ID NO: 66191 - RNA, 23 nt, Human
ggagauaaugguuacaaaugucu

SEQ ID NO: 66192 - RNA, 29 nt, Human
ccuccuguagccccugccugcacccacga

SEQ ID NO: 66193 - RNA, 20 nt, Human
cucucaucuguugcuuucca

SEQ ID NO: 66194 - RNA, 22 nt, Human
ucugugggcgggcccagcacuu

SEQ ID NO: 66195 - RNA, 21 nt, Human
accauccuucagucuaaggaa

SEQ ID NO: 66196 - RNA, 21 nt, Human
ggcuugacaaagcuguucugc

SEQ ID NO: 66197 - RNA, 22 nt, Human
agcucacugcaaccuccaucuc

SEQ ID NO: 66198 - RNA, 26 nt, Human
agccacugcaaaugacuugcaguuuc

SEQ ID NO: 66199 - RNA, 23 nt, Human
ugucagugccauuaucuagcacc

SEQ ID NO: 66200 - RNA, 23 nt, Human
ggcuaauuuuuuguauuuuuaau

SEQ ID NO: 66201 - RNA, 23 nt, Human
ggcuaguuuuuuguauuuuuagu

SEQ ID NO: 66202 - RNA, 20 nt, Human
agacaccugaccuuucucaa

SEQ ID NO: 66203 - RNA, 27 nt, Human
cugagguauuucauaucuccugcuguu

SEQ ID NO: 66204 - RNA, 26 nt, Human
cugugccuuugccuguccuuucuccc

SEQ ID NO: 66205 - RNA, 23 nt, Human
uuuugcauuauucauaugcuucc

SEQ ID NO: 66206 - RNA, 29 nt, Human
uuccuaggccuccucucccugcuggcaga

SEQ ID NO: 66207 - RNA, 25 nt, Human
ucugucacacaggcuggagugcagu

SEQ ID NO: 66208 - RNA, 21 nt, Human
gcuugcagccaggacacugcc

SEQ ID NO: 66209 - RNA, 26 nt, Human
gggacugaggccuccugcagguaccu

SEQ ID NO: 66210 - RNA, 27 nt, Human
ucuguaacagaaccuuaccuccaggug

SEQ ID NO: 66211 - RNA, 21 nt, Human
ucugagcgguuggugccgggu

SEQ ID NO: 66212 - RNA, 21 nt, Human
gaucuuaggucucuucuuuua

SEQ ID NO: 66213 - RNA, 22 nt, Human
cugcccgccgcgcugccugcgc

SEQ ID NO: 66214 - RNA, 22 nt, Human
gcgccuggcaguaagugcucaa

SEQ ID NO: 66215 - RNA, 23 nt, Human
gggcaggguggggagggagccuc

SEQ ID NO: 66216 - RNA, 19 nt, Human
uauuagaauaggguugcua

SEQ ID NO: 66217 - RNA, 19 nt, Human
gcaguguacaggugcucua

SEQ ID NO: 66218 - RNA, 21 nt, Human
cuggggcagggaaggacagag

SEQ ID NO: 66219 - RNA, 20 nt, Human
uugaggcagauccuggcacu

SEQ ID NO: 66220 - RNA, 20 nt, Human
cugauauccucaucuguaaa

SEQ ID NO: 66221 - RNA, 21 nt, Human
gggagcggccaggaugcugaa

SEQ ID NO: 66222 - RNA, 22 nt, Human
cagcacuggcuuucuguuuuca

SEQ ID NO: 66223 - RNA, 21 nt, Human
ucagaauccggagcagagagg

SEQ ID NO: 66224 - RNA, 27 nt, Human
uuuccccucagccucaggaaagguggu

SEQ ID NO: 66225 - RNA, 24 nt, Human
uucuggcuguguuuuuauaacuua

SEQ ID NO: 66226 - RNA, 25 nt, Human
acagucccacuacgagaaagcugug

SEQ ID NO: 66227 - RNA, 24 nt, Human
caaucagcagaugacccccaggcc

SEQ ID NO: 66228 - RNA, 25 nt, Human
gcuggauaggagaggaaaaggcuug

SEQ ID NO: 66229 - RNA, 20 nt, Human
gcagcuuuccccaggaaagg

SEQ ID NO: 66230 - RNA, 21 nt, Human
ggucuugaacuccugaccuca

SEQ ID NO: 66231 - RNA, 25 nt, Human
ucucugacccaggcaccucgagggc

SEQ ID NO: 66232 - RNA, 25 nt, Human
auggaggagggaggccgggacaagg

SEQ ID NO: 66233 - RNA, 21 nt, Human
cgaggcacgagaaucgcuuga

SEQ ID NO: 66234 - RNA, 21 nt, Human
ggagacaaauauccccaagug

SEQ ID NO: 66235 - RNA, 21 nt, Human
augaggugaauggacagccag

SEQ ID NO: 66236 - RNA, 24 nt, Human
uguuacagacugaaaggugugaac

SEQ ID NO: 66237 - RNA, 23 nt, Human
cauguguuucugcaguuuguuac

SEQ ID NO: 66238 - RNA, 25 nt, Human
ucagcuagcaaaagaaguaacaaga

SEQ ID NO: 66239 - RNA, 25 nt, Human
augauaguguaaucauuuugaauug

SEQ ID NO: 66240 - RNA, 18 nt, Human
cagauuaucuucuguaaa

SEQ ID NO: 66241 - RNA, 27 nt, Human
gugagugugacggggguuggggugggg

SEQ ID NO: 66242 - RNA, 26 nt, Human
cacccaggccuggagcugggaugcaa

SEQ ID NO: 66243 - RNA, 27 nt, Human
cacugccucucuaagcuggccucaggu

SEQ ID NO: 66244 - RNA, 26 nt, Human
cuucagauauauuuaggaaggcgcag

SEQ ID NO: 66245 - RNA, 20 nt, Human
aguuucacaucuuaaugaaa

SEQ ID NO: 66246 - RNA, 22 nt, Human
gaucucaggcuggagugcagug

SEQ ID NO: 66247 - RNA, 27 nt, Human
gaccagccuggccaacauggagaaacc

SEQ ID NO: 66248 - RNA, 20 nt, Human
acuaccugaacauuguaaua

SEQ ID NO: 66249 - RNA, 27 nt, Human
cugugugaccucaggccagugugccga

SEQ ID NO: 66250 - RNA, 24 nt, Human
gccgacuuggcccaaguaguuggg

SEQ ID NO: 66251 - RNA, 23 nt, Human
cugagaucguaccuauugcacuc

SEQ ID NO: 66252 - RNA, 22 nt, Human
acuuguccaaggucaagcacag

SEQ ID NO: 66253 - RNA, 21 nt, Human
uguggcagcgaggaagggccg

SEQ ID NO: 66254 - RNA, 22 nt, Human
cuggcagcuucuccuccagacu

SEQ ID NO: 66255 - RNA, 25 nt, Human
agccugcuccuucuuguucugcccu

SEQ ID NO: 66256 - RNA, 23 nt, Human
uucccccugcugaucaaucugca

SEQ ID NO: 66257 - RNA, 23 nt, Human
ccaggaggcagagcgggagggug

SEQ ID NO: 66258 - RNA, 22 nt, Human
agcgcugugaauggaaacagaa

SEQ ID NO: 66259 - RNA, 26 nt, Human
gguugacauuccugcauaagcauuuc

SEQ ID NO: 66260 - RNA, 21 nt, Human
gccuguaauuccagcauguug

SEQ ID NO: 66261 - RNA, 23 nt, Human
cacugcaugcggcaaaccgcaug

SEQ ID NO: 66262 - RNA, 20 nt, Human
cacccagacuggagugcagg

SEQ ID NO: 66263 - RNA, 26 nt, Human
guuuaaguaacucucagcauuacaaa

SEQ ID NO: 66264 - RNA, 26 nt, Human
uggucagcuacgucucuagaauaaga

SEQ ID NO: 66265 - RNA, 26 nt, Human
aggaggugggggccgcaggguugggg

SEQ ID NO: 66266 - RNA, 27 nt, Human
ugggccagccuuuuuugggcagucagg

SEQ ID NO: 66267 - RNA, 27 nt, Human
guggcaggagcggugagaucacugccu

SEQ ID NO: 66268 - RNA, 24 nt, Human
ccucccacuucauaacuacaaaaa

SEQ ID NO: 66269 - RNA, 23 nt, Human
gucacaccacuggcugccaguca

SEQ ID NO: 66270 - RNA, 22 nt, Human
ugguaguguagcuguguggcuu

SEQ ID NO: 66271 - RNA, 17 nt, Human
aaaccugcacugacuuu

SEQ ID NO: 66272 - RNA, 25 nt, Human
caguuuggcaaccuguguccuggcu

SEQ ID NO: 66273 - RNA, 21 nt, Human
gcugccaggugagucaccgcc

SEQ ID NO: 66274 - RNA, 22 nt, Human
ggagcagcagaggaugugguga

SEQ ID NO: 66275 - RNA, 22 nt, Human
gucugugggcaccagcacuuca

SEQ ID NO: 66276 - RNA, 30 nt, Human
ggagguaugggagagcgcugggggcccauc

SEQ ID NO: 66277 - RNA, 23 nt, Human
ucuccaccccauccccucuuguc

SEQ ID NO: 66278 - RNA, 21 nt, Human
gcagcuaaaugugauccugcc

SEQ ID NO: 66279 - RNA, 21 nt, Human
gaccacaccuccgugguucac

SEQ ID NO: 66280 - RNA, 23 nt, Human
ccuuccuccuucaugccugggcc

SEQ ID NO: 66281 - RNA, 26 nt, Human
ucugccugggcucagcguggaccugc

SEQ ID NO: 66282 - RNA, 19 nt, Human
ucgcugcucuuaacuacua

SEQ ID NO: 66283 - RNA, 27 nt, Human
ugguggaggugugggcagaggagggag

SEQ ID NO: 66284 - RNA, 25 nt, Human
gggagccgggacugcucagcaaaga

SEQ ID NO: 66285 - RNA, 21 nt, Human
cuccgcacccucaccccacca

SEQ ID NO: 66286 - RNA, 27 nt, Human
gcacagccccggcuccggcuccugcgg

SEQ ID NO: 66287 - RNA, 20 nt, Human
ggagugugagggaugcugaa

SEQ ID NO: 66288 - RNA, 22 nt, Human
acuggugcgaucauagcucacu

SEQ ID NO: 66289 - RNA, 25 nt, Human
cgaggacaucgggacggaggcagac

SEQ ID NO: 66290 - RNA, 25 nt, Human
uggaggucaaugguggagggagaug

SEQ ID NO: 66291 - RNA, 23 nt, Human
ggucaaggacagggcugagcgug

SEQ ID NO: 66292 - RNA, 22 nt, Human
ccuuucagccacccaauaucuc

SEQ ID NO: 66293 - RNA, 22 nt, Human
ugccucagccucaugaauagcu

SEQ ID NO: 66294 - RNA, 23 nt, Human
ggaccaaccccaggcagaaggug

SEQ ID NO: 66295 - RNA, 21 nt, Human
cacugcccuccagccugggug

SEQ ID NO: 66296 - RNA, 24 nt, Human
accagggaugggggaugggccagg

SEQ ID NO: 66297 - RNA, 27 nt, Human
gucacccaggccuugcagauaaauaau

SEQ ID NO: 66298 - RNA, 22 nt, Human
aucacuugaacccgggaagcag

SEQ ID NO: 66299 - RNA, 26 nt, Human
cgcccaggcuggagugcagcagcaca

SEQ ID NO: 66300 - RNA, 27 nt, Human
gaggaagaagagugaaggccaguguua

SEQ ID NO: 66301 - RNA, 23 nt, Human
cucaccaccacugucaccagccc

SEQ ID NO: 66302 - RNA, 21 nt, Human
agaggcggaguuugcagugag

SEQ ID NO: 66303 - RNA, 19 nt, Human
gacucugcucucccagcac

SEQ ID NO: 66304 - RNA, 27 nt, Human
uauaccccaaaguccucuacccccuca

SEQ ID NO: 66305 - RNA, 21 nt, Human
aggguccauuauuucauaaga

SEQ ID NO: 66306 - RNA, 25 nt, Human
uuagcauucagucauauaacaucug

SEQ ID NO: 66307 - RNA, 26 nt, Human
ugcccaggaggcaggcagugcggggu

SEQ ID NO: 66308 - RNA, 21 nt, Human
gcugggguagagcaaguagcc

SEQ ID NO: 66309 - RNA, 23 nt, Human
guggcccuggcuggaguucagug

SEQ ID NO: 66310 - RNA, 22 nt, Human
uuugauugcccuguucuguguc

SEQ ID NO: 66311 - RNA, 23 nt, Human
ccacagcccagagcagccugagu

SEQ ID NO: 66312 - RNA, 21 nt, Human
caggucgccuuuuugagacuc

SEQ ID NO: 66313 - RNA, 22 nt, Human
caggcugaagugcaguggagca

SEQ ID NO: 66314 - RNA, 25 nt, Human
agcuucagugacaaagacuuaaauc

SEQ ID NO: 66315 - RNA, 23 nt, Human
gccaauucaguaggugcauugga

SEQ ID NO: 66316 - RNA, 26 nt, Human
accagcacugccucccccagggaucc

SEQ ID NO: 66317 - RNA, 19 nt, Human
ccacuucuaaauagcaauu

SEQ ID NO: 66318 - RNA, 22 nt, Human
cugaucaaagugacacuucuga

SEQ ID NO: 66319 - RNA, 23 nt, Human
gucacucaggcuggaguacagug

SEQ ID NO: 66320 - RNA, 21 nt, Human
gaagcagcuagacuaggggag

SEQ ID NO: 66321 - RNA, 28 nt, Human
uucugcucucuucuggcccuccauggag

SEQ ID NO: 66322 - RNA, 21 nt, Human
ggaaggaucagggggccaggc

SEQ ID NO: 66323 - RNA, 26 nt, Human
gcucccucucugccauacugagccug

SEQ ID NO: 66324 - RNA, 25 nt, Human
acugccucugggaccccugccggcc

SEQ ID NO: 66325 - RNA, 23 nt, Human
acauggaguuagucaaagcacaa

SEQ ID NO: 66326 - RNA, 27 nt, Human
uuccgcacuauugucccuucuuccuca

SEQ ID NO: 66327 - RNA, 20 nt, Human
ggugucagaaagaaaaggaa

SEQ ID NO: 66328 - RNA, 28 nt, Human
cugugcuuugacauucuagcacuucagg

SEQ ID NO: 66329 - RNA, 26 nt, Human
aaaacaaugcuugagagaaauggguu

SEQ ID NO: 66330 - RNA, 22 nt, Human
cacuccacaguccucaggcuuc

SEQ ID NO: 66331 - RNA, 23 nt, Human
agacuauugcuuauuuuuguuuu

SEQ ID NO: 66332 - RNA, 24 nt, Human
uccuccugccaacauucagucugg

SEQ ID NO: 66333 - RNA, 20 nt, Human
ccucugucaccaccagccuc

SEQ ID NO: 66334 - RNA, 21 nt, Human
ugaaauuuuggaauccugcuc

SEQ ID NO: 66335 - RNA, 22 nt, Human
accuguaaucccaacacuuugc

SEQ ID NO: 66336 - RNA, 22 nt, Human
cggcgcugcacucuagccuggg

SEQ ID NO: 66337 - RNA, 20 nt, Human
ccuccauccacccgcuucag

SEQ ID NO: 66338 - RNA, 26 nt, Human
uuggaacaacagcuaucuagauagcu

SEQ ID NO: 66339 - RNA, 20 nt, Human
uaugucaaauggauguaaua

SEQ ID NO: 66340 - RNA, 21 nt, Human
ugggguugggacagggagggu

SEQ ID NO: 66341 - RNA, 24 nt, Human
gcucccuucccuuccucccccuuc

SEQ ID NO: 66342 - RNA, 24 nt, Human
ggagguggugaccgcgcuggggac

SEQ ID NO: 66343 - RNA, 19 nt, Human
cggcugaggcgaggucgcu

SEQ ID NO: 66344 - RNA, 23 nt, Human
guugcucaggcuuuguuugaggu

SEQ ID NO: 66345 - RNA, 23 nt, Human
cuccugaagaucugugcuuucca

SEQ ID NO: 66346 - RNA, 22 nt, Human
uucugggagacugcaggugccg

SEQ ID NO: 66347 - RNA, 23 nt, Human
ugcucucucaugaaacaagagcu

SEQ ID NO: 66348 - RNA, 27 nt, Human
cccacuuccuguuuccaucugcuuggg

SEQ ID NO: 66349 - RNA, 21 nt, Human
uggucucagccuaggcccuca

SEQ ID NO: 66350 - RNA, 23 nt, Human
accacgcccagcuaauuuuuugu

SEQ ID NO: 66351 - RNA, 21 nt, Human
ggccucgggcuccaggcccug

SEQ ID NO: 66352 - RNA, 30 nt, Human
cuauauuuaucugagugcugucuaaaacug

SEQ ID NO: 66353 - RNA, 27 nt, Human
gcugcuucccucaccugccugccuguc

SEQ ID NO: 66354 - RNA, 23 nt, Human
caggaggcagaggguugcaguga

SEQ ID NO: 66355 - RNA, 20 nt, Human
cucagguugcagacagcuga

SEQ ID NO: 66356 - RNA, 27 nt, Human
ucauccagaaagcaucauuuucuaggg

SEQ ID NO: 66357 - RNA, 27 nt, Human
ucccuccaggguuugggcaggagaugg

SEQ ID NO: 66358 - RNA, 18 nt, Human
auacugcuaucauucuuc

SEQ ID NO: 66359 - RNA, 18 nt, Human
ucaggauaucuggaacaa

SEQ ID NO: 66360 - RNA, 23 nt, Human
ggggagagaguuuggacaucuca

SEQ ID NO: 66361 - RNA, 29 nt, Human
ugcuaugucaaucucaguuuugcuuuccu

SEQ ID NO: 66362 - RNA, 23 nt, Human
ccuggaaggaagagguugcagug

SEQ ID NO: 66363 - RNA, 23 nt, Human
aucucaaggagcuuccagugcag

SEQ ID NO: 66364 - RNA, 26 nt, Human
gagugcuggcuccucguguuugguga

SEQ ID NO: 66365 - RNA, 31 nt, Human
agcuccuaucugcaaacuguguucacccuuu

SEQ ID NO: 66366 - RNA, 23 nt, Human
ugcagaagaucaugggcaucucc

SEQ ID NO: 66367 - RNA, 25 nt, Human
ccugucacugugaauacuuggccag

SEQ ID NO: 66368 - RNA, 23 nt, Human
gcacaucugcauuuucaccccac

SEQ ID NO: 66369 - RNA, 19 nt, Human
cguucacucucugccuucu

SEQ ID NO: 66370 - RNA, 17 nt, Human
ccucccuuacugaacca

SEQ ID NO: 66371 - RNA, 27 nt, Human
gcucccacucuuaucaccucuccccag

SEQ ID NO: 66372 - RNA, 20 nt, Human
cagacuccgaccauggccuc

SEQ ID NO: 66373 - RNA, 22 nt, Human
agaggcugcugcagacaagugg

SEQ ID NO: 66374 - RNA, 21 nt, Human
gacugauuucuucugugguuu

SEQ ID NO: 66375 - RNA, 21 nt, Human
ucucucaugcuaccuuuugug

SEQ ID NO: 66376 - RNA, 22 nt, Human
cugggaagugcagguugcagug

SEQ ID NO: 66377 - RNA, 17 nt, Human
cuuggcuaaugauaugg

SEQ ID NO: 66378 - RNA, 21 nt, Human
aagagguugaggcugcaguga

SEQ ID NO: 66379 - RNA, 22 nt, Human
agcaugauggggacuuccaugc

SEQ ID NO: 66380 - RNA, 19 nt, Human
cgcccaggccagugcugug

SEQ ID NO: 66381 - RNA, 21 nt, Human
uuuguaauuccucuagcuacc

SEQ ID NO: 66382 - RNA, 23 nt, Human
gagcaaggaguaacuacugagag

SEQ ID NO: 66383 - RNA, 26 nt, Human
agcauaaucacaccucauuucuuuca

SEQ ID NO: 66384 - RNA, 27 nt, Human
gacuggcccugccuaaccucuaccauc

SEQ ID NO: 66385 - RNA, 21 nt, Human
gcagaggagcugaccagggag

SEQ ID NO: 66386 - RNA, 21 nt, Human
ggaaagauggagcaagaagcc

SEQ ID NO: 66387 - RNA, 21 nt, Human
gcauguguaggauguaugcug

SEQ ID NO: 66388 - RNA, 23 nt, Human
caccacuggcacuccagccuggg

SEQ ID NO: 66389 - RNA, 20 nt, Human
cugccccccuccccucccuu

SEQ ID NO: 66390 - RNA, 27 nt, Human
cagugcacuccagucugcagguacugc

SEQ ID NO: 66391 - RNA, 21 nt, Human
guuagugguggggaagggcuu

SEQ ID NO: 66392 - RNA, 26 nt, Human
gagcaguuuccccacugugucugucc

SEQ ID NO: 66393 - RNA, 21 nt, Human
agcccccacccgggagcagug

SEQ ID NO: 66394 - RNA, 21 nt, Human
ugagacaaauaggugauacug

SEQ ID NO: 66395 - RNA, 24 nt, Human
uccacccuucuuagggcuggagga

SEQ ID NO: 66396 - RNA, 15 nt, Human
ugcccccaaguucug

SEQ ID NO: 66397 - RNA, 20 nt, Human
gccaggcucuuccacuuagc

SEQ ID NO: 66398 - RNA, 20 nt, Human
acgcucggaacacauucucc

SEQ ID NO: 66399 - RNA, 22 nt, Human
ggauuugcaggccagggagaaa

SEQ ID NO: 66400 - RNA, 21 nt, Human
gcaguuucaaacucuaccaug

SEQ ID NO: 66401 - RNA, 20 nt, Human
ugaaccaugggaugaugauu

SEQ ID NO: 66402 - RNA, 26 nt, Human
aacgcaccacccucuggccuaggcug

SEQ ID NO: 66403 - RNA, 22 nt, Human
gcuucaggcugggggcagugga

SEQ ID NO: 66404 - RNA, 30 nt, Human
uccugucuguuuauagugcugguaguauca

SEQ ID NO: 66405 - RNA, 28 nt, Human
gcuucuuggaugaugauggacgucccac

SEQ ID NO: 66406 - RNA, 20 nt, Human
uucuggcuugucauucugua

SEQ ID NO: 66407 - RNA, 18 nt, Human
uaauaugggcauuguagu

SEQ ID NO: 66408 - RNA, 23 nt, Human
auguuccucuccugaauucugga

SEQ ID NO: 66409 - RNA, 19 nt, Human
aagcauggaaaauguaaua

SEQ ID NO: 66410 - RNA, 23 nt, Human
gaagauggcuuuuccuggacagc

SEQ ID NO: 66411 - RNA, 22 nt, Human
cgccgucccucaguuugccccc

SEQ ID NO: 66412 - RNA, 20 nt, Human
uggguggagaggaugaugaa

SEQ ID NO: 66413 - RNA, 20 nt, Human
aauuuugagggugggagaga

SEQ ID NO: 66414 - RNA, 26 nt, Human
gcaggcccggggagggugguuaccgc

SEQ ID NO: 66415 - RNA, 22 nt, Human
acaucacauuccucugcccuuc

SEQ ID NO: 66416 - RNA, 22 nt, Human
ccaagaucacgccauugcacuc

SEQ ID NO: 66417 - RNA, 25 nt, Human
agaaccucaccccuggaggggugga

SEQ ID NO: 66418 - RNA, 27 nt, Human
uacaugccugggguaagccacccggcu

SEQ ID NO: 66419 - RNA, 23 nt, Human
uuuggcacauggaucaacaaaau

SEQ ID NO: 66420 - RNA, 22 nt, Human
gaguagcugggauuacaggcau

SEQ ID NO: 66421 - RNA, 19 nt, Human
uacgggucaguagggauaa

SEQ ID NO: 66422 - RNA, 28 nt, Human
ucucugaaacuccucuuugucauacugc

SEQ ID NO: 66423 - RNA, 22 nt, Human
cccugcucccagauggcggucu

SEQ ID NO: 66424 - RNA, 25 nt, Human
ugcaggagccuacccugaaaucucu

SEQ ID NO: 66425 - RNA, 26 nt, Human
aaucagcuuuugcaggucuuuauuuc

SEQ ID NO: 66426 - RNA, 24 nt, Human
ggagggagggcgguggacaauaaa

SEQ ID NO: 66427 - RNA, 27 nt, Human
cagucuugcugaauuaagcagaaaggg

SEQ ID NO: 66428 - RNA, 20 nt, Human
cuccaaccugggaaacgcag

SEQ ID NO: 66429 - RNA, 27 nt, Human
cugcuucugucuugaggauaugggaag

SEQ ID NO: 66430 - RNA, 22 nt, Human
uuguagugcuuacaauuuugug

SEQ ID NO: 66431 - RNA, 20 nt, Human
aagaaugggcaggaucucuu

SEQ ID NO: 66432 - RNA, 23 nt, Human
ucuuucaggguuuucuaacccug

SEQ ID NO: 66433 - RNA, 28 nt, Human
ucccucagugucuuccucuuaaaccuca

SEQ ID NO: 66434 - RNA, 22 nt, Human
gccuguaaucccagcacacugg

SEQ ID NO: 66435 - RNA, 24 nt, Human
uggugcacacgccuguaaucccag

SEQ ID NO: 66436 - RNA, 26 nt, Human
accuucucugcugagcaauuguggcc

SEQ ID NO: 66437 - RNA, 24 nt, Human
caccugaggucaggagcucaagac

SEQ ID NO: 66438 - RNA, 20 nt, Human
cagcucaggcuggagcaggu

SEQ ID NO: 66439 - RNA, 25 nt, Human
cagagucuuccaggugggcauuuca

SEQ ID NO: 66440 - RNA, 24 nt, Human
agcucaguucccauugcuugugcu

SEQ ID NO: 66441 - RNA, 24 nt, Human
uuccaguuucaaucuaacugugaa

SEQ ID NO: 66442 - RNA, 20 nt, Human
ugugcuuaggcaagugcaaa

SEQ ID NO: 66443 - RNA, 27 nt, Human
cucaugcugcugaccacugacucagcu

SEQ ID NO: 66444 - RNA, 19 nt, Human
acagucuuucaugauauga

SEQ ID NO: 66445 - RNA, 26 nt, Human
uggagggggcagaggggaugggcugg

SEQ ID NO: 66446 - RNA, 23 nt, Human
gcuguaaccgucgucuguccggg

SEQ ID NO: 66447 - RNA, 22 nt, Human
cgccuguaaucccagcacuuug

SEQ ID NO: 66448 - RNA, 24 nt, Human
cacggagcacaggucucugcugcu

SEQ ID NO: 66449 - RNA, 19 nt, Human
cugaaaccgcucagauguu

SEQ ID NO: 66450 - RNA, 21 nt, Human
ucuuuguuuucuuguaaauac

SEQ ID NO: 66451 - RNA, 24 nt, Human
gggagaugggguggccugcaguga

SEQ ID NO: 66452 - RNA, 21 nt, Human
cccauggacucuucagucugg

SEQ ID NO: 66453 - RNA, 24 nt, Human
guugaaccuuuccuugauuuuaug

SEQ ID NO: 66454 - RNA, 21 nt, Human
cuccuugucucauccccgaag

SEQ ID NO: 66455 - RNA, 27 nt, Human
uccucauucccacuggcuuugaacauu

SEQ ID NO: 66456 - RNA, 27 nt, Human
aagcccagggacuggcuucucuuucuc

SEQ ID NO: 66457 - RNA, 24 nt, Human
ccaggaggagaccagguugcagug

SEQ ID NO: 66458 - RNA, 23 nt, Human
gucuccagcuccucucccuucca

SEQ ID NO: 66459 - RNA, 21 nt, Human
uaguuaucuucugggguuuca

SEQ ID NO: 66460 - RNA, 26 nt, Human
gcugugugaucuugggcaagucacuu

SEQ ID NO: 66461 - RNA, 22 nt, Human
ccauccuucacuuauguaacau

SEQ ID NO: 66462 - RNA, 29 nt, Human
gccugauuuuagaauucaccagcuccuca

SEQ ID NO: 66463 - RNA, 22 nt, Human
ccuggucucuugcgguccuccu

SEQ ID NO: 66464 - RNA, 20 nt, Human
cugucucaaaauguauaaua

SEQ ID NO: 66465 - RNA, 27 nt, Human
gugcucacaccacugcugcucgagucu

SEQ ID NO: 66466 - RNA, 22 nt, Human
gacuucucuaugcucuuuauga

SEQ ID NO: 66467 - RNA, 26 nt, Human
cuccggcacuaugagcggcuucagca

SEQ ID NO: 66468 - RNA, 22 nt, Human
ggggucagggagaccccugcuu

SEQ ID NO: 66469 - RNA, 25 nt, Human
guauuuuuauuuuuguucaucugcu

SEQ ID NO: 66470 - RNA, 27 nt, Human
ccugcagcucugcucucgggauggugc

SEQ ID NO: 66471 - RNA, 24 nt, Human
auggaggaggaggacuggcccaga

SEQ ID NO: 66472 - RNA, 26 nt, Human
cugggagcuugguacuuucccuccag

SEQ ID NO: 66473 - RNA, 21 nt, Human
ggaggaagagguugcagugag

SEQ ID NO: 66474 - RNA, 23 nt, Human
ugcauauauacaaauuuguagua

SEQ ID NO: 66475 - RNA, 22 nt, Human
gggagguggagguugcugugag

SEQ ID NO: 66476 - RNA, 25 nt, Human
ugcugcugcuacucagacuagcucu

SEQ ID NO: 66477 - RNA, 22 nt, Human
uaucuccagggccccaccaauc

SEQ ID NO: 66478 - RNA, 17 nt, Human
gacugugacuuucagug

SEQ ID NO: 66479 - RNA, 22 nt, Human
uccucuuccuccuccuccucca

SEQ ID NO: 66480 - RNA, 21 nt, Human
ccuacuuuaaacagugcccuu

SEQ ID NO: 66481 - RNA, 23 nt, Human
caggcuccaggagaaagcaggcg

SEQ ID NO: 66482 - RNA, 23 nt, Human
ugaggaaugauugcagggaccag

SEQ ID NO: 66483 - RNA, 26 nt, Human
cuggggcgugcagcagggaaggccca

SEQ ID NO: 66484 - RNA, 25 nt, Human
ccccaacaguugguugucuugucuu

SEQ ID NO: 66485 - RNA, 20 nt, Human
cggcagcugcgucuccugcc

SEQ ID NO: 66486 - RNA, 22 nt, Human
auugcaaauuguaaugcuggaa

SEQ ID NO: 66487 - RNA, 24 nt, Human
ccacggccuuugaccaucuguagu

SEQ ID NO: 66488 - RNA, 18 nt, Human
ugccuccccucugccucc

SEQ ID NO: 66489 - RNA, 22 nt, Human
cauuuugguaccugacaacaag

SEQ ID NO: 66490 - RNA, 24 nt, Human
uuggcacaccaguguucuccugcc

SEQ ID NO: 66491 - RNA, 21 nt, Human
agcagaucgugacaagagaug

SEQ ID NO: 66492 - RNA, 21 nt, Human
ccugagccacugaccacggcc

SEQ ID NO: 66493 - RNA, 25 nt, Human
augcucacaccuuacugcacagaaa

SEQ ID NO: 66494 - RNA, 26 nt, Human
cuuggaguguugguggagaucagagu

SEQ ID NO: 66495 - RNA, 18 nt, Human
uguuuuguaacagccuuc

SEQ ID NO: 66496 - RNA, 19 nt, Human
gcggaggcagaaggcggug

SEQ ID NO: 66497 - RNA, 28 nt, Human
ccccaugccaugguaggaggcagagucu

SEQ ID NO: 66498 - RNA, 23 nt, Human
cuaccauggcuucucuuuucuca

SEQ ID NO: 66499 - RNA, 21 nt, Human
uacauacggggucucucucca

SEQ ID NO: 66500 - RNA, 23 nt, Human
gucauucaggcuggagugcagug

SEQ ID NO: 66501 - RNA, 23 nt, Human
agagaauugguccuggaagggaa

SEQ ID NO: 66502 - RNA, 23 nt, Human
gguccauucugcaccucuuggcu

SEQ ID NO: 66503 - RNA, 27 nt, Human
accagccugaccaacauggagaaaccu

SEQ ID NO: 66504 - RNA, 31 nt, Human; identical to SEQ ID NO: 8120

SEQ ID NO: 66505 - RNA, 25 nt, Human
aaggaugaagagucaucuucugaac

SEQ ID NO: 66506 - RNA, 22 nt, Human
ccuggagaagagagaacuauuu

SEQ ID NO: 66507 - RNA, 25 nt, Human
gcccaggcugcccgacugcagacca

SEQ ID NO: 66508 - RNA, 23 nt, Human
aauuagauuuuuaacagguguca

SEQ ID NO: 66509 - RNA, 24 nt, Human
acuccuccuuuacuuuuuuccugc

SEQ ID NO: 66510 - RNA, 27 nt, Human
ccaucauugugaaauaauuaccucagu

SEQ ID NO: 66511 - RNA, 21 nt, Human
aucagagccucucccacacca

SEQ ID NO: 66512 - RNA, 24 nt, Human
cauauuggagaggagcuaagguaa

SEQ ID NO: 66513 - RNA, 22 nt, Human
gcucacugcaagcucugccucc

SEQ ID NO: 66514 - RNA, 22 nt, Human
ccucuccacccguucugccuca

SEQ ID NO: 66515 - RNA, 21 nt, Human
ucuguauaaaugucuuuaaug

SEQ ID NO: 66516 - RNA, 16 nt, Human
ugccucuuccaccuca

SEQ ID NO: 66517 - RNA, 22 nt, Human
ccagugcacuccggccugggug

SEQ ID NO: 66518 - RNA, 22 nt, Human
ucuccugcagggcccugccucc

SEQ ID NO: 66519 - RNA, 22 nt, Human
uucaaaguuuaagcaauucauu

SEQ ID NO: 66520 - RNA, 21 nt, Human
uuguuuuuguuuugacacugc

SEQ ID NO: 66521 - RNA, 26 nt, Human
ugcccaggacacagugcaggccagag

SEQ ID NO: 66522 - RNA, 26 nt, Human
ucuccuccccucuccucaguuuugcc

SEQ ID NO: 66523 - RNA, 20 nt, Human
cuggguggagugugccuuca

SEQ ID NO: 66524 - RNA, 23 nt, Human
guggacucagaugccaggaaagg

SEQ ID NO: 66525 - RNA, 27 nt, Human
auggacucuguggguuacauugcucua

SEQ ID NO: 66526 - RNA, 21 nt, Human
gacgagauugacucucaguuu

SEQ ID NO: 66527 - RNA, 22 nt, Human
gagcucagacccccacucucau

SEQ ID NO: 66528 - RNA, 26 nt, Human
gguagcugggauuacaggcacccacc

SEQ ID NO: 66529 - RNA, 23 nt, Human
ccagagccagcgagcaggagcgc

SEQ ID NO: 66530 - RNA, 22 nt, Human
caggcaccugggcuuucuggaa

SEQ ID NO: 66531 - RNA, 22 nt, Human
gaggucagguucauuuuguuac

SEQ ID NO: 66532 - RNA, 26 nt, Human
uucuaagagcagcagcauauguuguu

SEQ ID NO: 66533 - RNA, 28 nt, Human
ugcugcugcuuagaucacugcagcuucu

SEQ ID NO: 66534 - RNA, 23 nt, Human
cccuggguuauaaggaggcuuag

SEQ ID NO: 66535 - RNA, 27 nt, Human
ugcuucccggcgugucccuaccuccuc

SEQ ID NO: 66536 - RNA, 25 nt, Human
caaaucucuacaaauuuuucugugg

SEQ ID NO: 66537 - RNA, 23 nt, Human
agcuaauuuuuauauucuuuagu

SEQ ID NO: 66538 - RNA, 26 nt, Human
ugaaucggucucuaucucuaucugcu

SEQ ID NO: 66539 - RNA, 15 nt, Human
cuacacaucucucca

SEQ ID NO: 66540 - RNA, 25 nt, Human
gugcucagccaggcuggaggcggca

SEQ ID NO: 66541 - RNA, 24 nt, Human
uuucuacuggugccaccccgccuc

SEQ ID NO: 66542 - RNA, 22 nt, Human
gauggagaagacaauuguugcu

SEQ ID NO: 66543 - RNA, 25 nt, Human
ucuguuauuucuuuuccugauguac

SEQ ID NO: 66544 - RNA, 26 nt, Human
aacagcuuugccucuguauuguguac

SEQ ID NO: 66545 - RNA, 27 nt, Human
ccccugccuccugcauccagcccccaa

SEQ ID NO: 66546 - RNA, 14 nt, Human
accaaaaugccuua

SEQ ID NO: 66547 - RNA, 21 nt, Human
cuguagacccuagacuggugg

SEQ ID NO: 66548 - RNA, 22 nt, Human
agagauccugugucucuuucau

SEQ ID NO: 66549 - RNA, 21 nt, Human
ccagcucugcucaggccccuu

SEQ ID NO: 66550 - RNA, 27 nt, Human
cacacagcgguuugcagagaauguuag

SEQ ID NO: 66551 - RNA, 30 nt, Human
acuggaccugccuuggcuucuuugauccca

SEQ ID NO: 66552 - RNA, 20 nt, Human
gccagccacacaaacguuua

SEQ ID NO: 66553 - RNA, 23 nt, Human
agugcagccacugccgccgccca

SEQ ID NO: 66554 - RNA, 23 nt, Human
uucggaugaugcuucuaaaacag

SEQ ID NO: 66555 - RNA, 23 nt, Human
uauaacacagaaauaaauuaugc

SEQ ID NO: 66556 - RNA, 22 nt, Human
guacauuugcccuuucucuucc

SEQ ID NO: 66557 - RNA, 27 nt, Human
aaauacugaaugacugcuaagaauuaa

SEQ ID NO: 66558 - RNA, 21 nt, Human
ccaagaccuuucaaagccauu

SEQ ID NO: 66559 - RNA, 22 nt, Human
augcaguauuucaagacugccu

SEQ ID NO: 66560 - RNA, 23 nt, Human
caguucugaagauucacguaucc

SEQ ID NO: 66561 - RNA, 27 nt, Human
cagcccaggcuccugcuguucuugggc

SEQ ID NO: 66562 - RNA, 22 nt, Human
cccuccagggagcccacccuga

SEQ ID NO: 66563 - RNA, 24 nt, Human
uugaagcuguaaaaugagcuucca

SEQ ID NO: 66564 - RNA, 21 nt, Human
uuacagccaccucauucuucu

SEQ ID NO: 66565 - RNA, 22 nt, Human
aucccuuccuguucccuccugg

SEQ ID NO: 66566 - RNA, 22 nt, Human
uggucucaaacuccugaccuca

SEQ ID NO: 66567 - RNA, 26 nt, Human
cccguccugguaucacagugcuucug

SEQ ID NO: 66568 - RNA, 22 nt, Human
gcucaggcuggagugccauggc

SEQ ID NO: 66569 - RNA, 22 nt, Human
accaggccaggcuaauuuuugu

SEQ ID NO: 66570 - RNA, 23 nt, Human
gugcucuggggcuggaggcuagu

SEQ ID NO: 66571 - RNA, 24 nt, Human
ccuccacugccaucauuaaaccuc

SEQ ID NO: 66572 - RNA, 23 nt, Human
accacagucuccaugggucuuuu

SEQ ID NO: 66573 - RNA, 21 nt, Human
cccuucugggggccuggaggu

SEQ ID NO: 66574 - RNA, 22 nt, Human
gcuuuuucuucucuuucauaca

SEQ ID NO: 66575 - RNA, 22 nt, Human
ccuuccgaccccgcuguccuca

SEQ ID NO: 66576 - RNA, 23 nt, Human
ggucuaggaucgaaauguuaaca

SEQ ID NO: 66577 - RNA, 21 nt, Human
uugcuuugucuuaugcuucua

SEQ ID NO: 66578 - RNA, 21 nt, Human
gaauuuuuaugauauuccccc

SEQ ID NO: 66579 - RNA, 23 nt, Human
cuacccagguugggcaggcugug

SEQ ID NO: 66580 - RNA, 20 nt, Human
ggcugaagugggggauguca

SEQ ID NO: 66581 - RNA, 23 nt, Human
aaugcucaguaacacagugcagu

SEQ ID NO: 66582 - RNA, 21 nt, Human
uugcccaggcugguuucgaac

SEQ ID NO: 66583 - RNA, 22 nt, Human
uugcccuuuucagcagcuugcc

SEQ ID NO: 66584 - RNA, 27 nt, Human
ggcucacaccuguaaucccagcacacu

SEQ ID NO: 66585 - RNA, 28 nt, Human
gccgggcugggcggcucacagcgagggg

SEQ ID NO: 66586 - RNA, 23 nt, Human
uacagaagggagugaaaaccucu

SEQ ID NO: 66587 - RNA, 21 nt, Human
acgacugauccccaccuccuc

SEQ ID NO: 66588 - RNA, 24 nt, Human
ggugagguggaaauuccagcaaga

SEQ ID NO: 66589 - RNA, 21 nt, Human
gccacugcgcuccagccuggg

SEQ ID NO: 66590 - RNA, 25 nt, Human
cacagugccugggcuaauuuuuugu

SEQ ID NO: 66591 - RNA, 23 nt, Human
uccccauucucucguggcuuucc

SEQ ID NO: 66592 - RNA, 24 nt, Human
cugucucaccaguggccugcccuc

SEQ ID NO: 66593 - RNA, 26 nt, Human
acuggguggagugugccuucagggca

SEQ ID NO: 66594 - RNA, 25 nt, Human
cgcuuuggggagcgccucgcuucac

SEQ ID NO: 66595 - RNA, 25 nt, Human
aucugccaggucuuagaagucagga

SEQ ID NO: 66596 - RNA, 21 nt, Human
gccauaaacaggaaugccuuu

SEQ ID NO: 66597 - RNA, 22 nt, Human
gcccaggcaggucugcaagggc

SEQ ID NO: 66598 - RNA, 27 nt, Human
cacugacagugggaggggauaaggugg

SEQ ID NO: 66599 - RNA, 19 nt, Human
ugaugcuaugaaaagcuuu

SEQ ID NO: 66600 - RNA, 21 nt, Human
accuguuuaaauugcucacag

SEQ ID NO: 66601 - RNA, 26 nt, Human
ggaagagagaccugcccuguagcgug

SEQ ID NO: 66602 - RNA, 27 nt, Human
ucuaguauuuuuguuacuuuuaauauu

SEQ ID NO: 66603 - RNA, 24 nt, Human
ugucuuugguuugagagccauggc

SEQ ID NO: 66604 - RNA, 18 nt, Human
uuucugcucagcuucucc

SEQ ID NO: 66605 - RNA, 27 nt, Human
gugcuuuggggagcaguugucagucua

SEQ ID NO: 66606 - RNA, 22 nt, Human
uuuuaaaaaauucauuuugcag

SEQ ID NO: 66607 - RNA, 22 nt, Human
ucaucccaagguccgucccaug

SEQ ID NO: 66608 - RNA, 22 nt, Human
ugcagaucaacuauaagcacaa

SEQ ID NO: 66609 - RNA, 23 nt, Human
cagucugcugcaucuucuaccuc

SEQ ID NO: 66610 - RNA, 23 nt, Human
uccaucccaugccucccuccucc

SEQ ID NO: 66611 - RNA, 23 nt, Human
uaucacagaucaagaauggagua

SEQ ID NO: 66612 - RNA, 22 nt, Human
agccucgcaugccagagccugg

SEQ ID NO: 66613 - RNA, 18 nt, Human
cucugugaagcaggguau

SEQ ID NO: 66614 - RNA, 22 nt, Human
cugucucucuccauguuggccu

SEQ ID NO: 66615 - RNA, 21 nt, Human
cugcuguccuggugacuuguc

SEQ ID NO: 66616 - RNA, 20 nt, Human
uccaggcuggagugcggugg

SEQ ID NO: 66617 - RNA, 22 nt, Human
aaaugauuuaucugguauuuua

SEQ ID NO: 66618 - RNA, 26 nt, Human
uccuccagaccauucaggacacaggg

SEQ ID NO: 66619 - RNA, 30 nt, Human
guggauguggcccugucacagguagaaaaa

SEQ ID NO: 66620 - RNA, 27 nt, Human
ugggacccacccaugaacccuucucag

SEQ ID NO: 66621 - RNA, 22 nt, Human
caguuugaaacauuugaucuca

SEQ ID NO: 66622 - RNA, 26 nt, Human
gcacgccugaaaugugcucauagcca

SEQ ID NO: 66623 - RNA, 21 nt, Human
guuuuugcuuucuguuuugcu

SEQ ID NO: 66624 - RNA, 21 nt, Human
uuacuuuucucuucccccuca

SEQ ID NO: 66625 - RNA, 23 nt, Human
ucccaccugugcgagacccccug

SEQ ID NO: 66626 - RNA, 22 nt, Human
ucuccaccaucuauagugagcc

SEQ ID NO: 66627 - RNA, 22 nt, Human
cacaccugcaaucccagcacuu

SEQ ID NO: 66628 - RNA, 26 nt, Human
gccuacugcccucucuugccgcccgc

SEQ ID NO: 66629 - RNA, 24 nt, Human
ucuccgacucugcacccgccucga

SEQ ID NO: 66630 - RNA, 27 nt, Human
ugagggagugggucuaucucagaggaa

SEQ ID NO: 66631 - RNA, 27 nt, Human
cuuuguuguuuucuaguacacagagau

SEQ ID NO: 66632 - RNA, 32 nt, Human
cacugcugccaccucucacacgccccaaccca

SEQ ID NO: 66633 - RNA, 18 nt, Human
gcugguucuguagaaaga

SEQ ID NO: 66634 - RNA, 27 nt, Human
cagggcucugacucugccagggugggg

SEQ ID NO: 66635 - RNA, 18 nt, Human
uuucuccaaacaggauuu

SEQ ID NO: 66636 - RNA, 22 nt, Human
uaaugcuuuguuaaugcuuuuc

SEQ ID NO: 66637 - RNA, 25 nt, Human
ggccucggcucaucgggugccccuc

SEQ ID NO: 66638 - RNA, 26 nt, Human
gaaguggagacccuucuagacaucac

SEQ ID NO: 66639 - RNA, 22 nt, Human
gccucaagaagaaugggagcug

SEQ ID NO: 66640 - RNA, 27 nt, Human
gcugcaaccuccuucggcuuugccccc

SEQ ID NO: 66641 - RNA, 23 nt, Human
ugccuucaaggguuaaucccucu

SEQ ID NO: 66642 - RNA, 22 nt, Human
gagcagugagccaaggagcagc

SEQ ID NO: 66643 - RNA, 21 nt, Human
cguggguuucaucacucugag

SEQ ID NO: 66644 - RNA, 27 nt, Human
cucucacucuucugucauuugcugcua

SEQ ID NO: 66645 - RNA, 22 nt, Human
aacacccuguaccauccaugga

SEQ ID NO: 66646 - RNA, 20 nt, Human
uguaggugccggcagagggg

SEQ ID NO: 66647 - RNA, 21 nt, Human
uaguucuugaucugcugacca

SEQ ID NO: 66648 - RNA, 26 nt, Human
uacugagaaaggaauuguggccauuu

SEQ ID NO: 66649 - RNA, 27 nt, Human
cuuggauucuccuuuguaccuaucccu

SEQ ID NO: 66650 - RNA, 22 nt, Human
ggggaggauaccugggagacag

SEQ ID NO: 66651 - RNA, 22 nt, Human
ggcuuugggaaguuugcugugc

SEQ ID NO: 66652 - RNA, 25 nt, Human
cagauguuuugagaacuuuauuugc

SEQ ID NO: 66653 - RNA, 26 nt, Human
agaccuacagaaucagaaacucuugg

SEQ ID NO: 66654 - RNA, 25 nt, Human
cgaguagcugggauuacaagugcgc

SEQ ID NO: 66655 - RNA, 26 nt, Human
uuucagguguacuuguguuuauguac

SEQ ID NO: 66656 - RNA, 23 nt, Human
gauaguccaucaguuaccagcac

SEQ ID NO: 66657 - RNA, 24 nt, Human
gcaccuugagauauccuacaacca

SEQ ID NO: 66658 - RNA, 25 nt, Human
uucuucuucagugaaauuuugggug

SEQ ID NO: 66659 - RNA, 25 nt, Human
uggggagacaggugaggcgguugga

SEQ ID NO: 66660 - RNA, 24 nt, Human
aggaagcugaggcugggacagggc

SEQ ID NO: 66661 - RNA, 21 nt, Human
gagaaugcaggcaacauggaa

SEQ ID NO: 66662 - RNA, 22 nt, Human
ucgcugcagccacugccuccug

SEQ ID NO: 66663 - RNA, 20 nt, Human
ccauugucaugaguccauga

SEQ ID NO: 66664 - RNA, 18 nt, Human
acugcagacauagcaaua

SEQ ID NO: 66665 - RNA, 18 nt, Human
ucaucauuuugugcugcu

SEQ ID NO: 66666 - RNA, 24 nt, Human
gugaaaggacaauugaaugacagg

SEQ ID NO: 66667 - RNA, 20 nt, Human
ccgugcaagcucuccagaag

SEQ ID NO: 66668 - RNA, 22 nt, Human
cgugggagucacagcuaugcca

SEQ ID NO: 66669 - RNA, 20 nt, Human
gggcacagaagugacuuuga

SEQ ID NO: 66670 - RNA, 25 nt, Human
ugguggcgcaagccuguaaucccag

SEQ ID NO: 66671 - RNA, 26 nt, Human
aaucaucaaaauaaaccuuugugaau

SEQ ID NO: 66672 - RNA, 27 nt, Human
acccuggugcugugcagccucuggcag

SEQ ID NO: 66673 - RNA, 23 nt, Human
uauagguggagcaucagcaguga

SEQ ID NO: 66674 - RNA, 28 nt, Human
gcacagaagcucaucucagucauccugc

SEQ ID NO: 66675 - RNA, 22 nt, Human
cucaggcaauuagacacuuugg

SEQ ID NO: 66676 - RNA, 25 nt, Human
cauuccccauucauuuuucccuucu

SEQ ID NO: 66677 - RNA, 22 nt, Human
cccugcuguaaccucugucuug

SEQ ID NO: 66678 - RNA, 21 nt, Human
ugcuguuaacucagucugacu

SEQ ID NO: 66679 - RNA, 26 nt, Human
gcucagugcuuugguagcacaaggug

SEQ ID NO: 66680 - RNA, 22 nt, Human
gguguagggggagaggggaaag

SEQ ID NO: 66681 - RNA, 23 nt, Human
uuaaugccacaccacuauuccag

SEQ ID NO: 66682 - RNA, 22 nt, Human
ucuaaagccaguggcuugaggc

SEQ ID NO: 66683 - RNA, 27 nt, Human
gagccccuucacuuaccugucucucca

SEQ ID NO: 66684 - RNA, 26 nt, Human
uacaucuucaguuuuucucugaauug

SEQ ID NO: 66685 - RNA, 24 nt, Human
ggagcagcccugcccagccccgug

SEQ ID NO: 66686 - RNA, 21 nt, Human
guccugaugugaaaugggagg

SEQ ID NO: 66687 - RNA, 21 nt, Human
gcccacuccggcuuguccuca

SEQ ID NO: 66688 - RNA, 27 nt, Human
agagacacauuccccucgcugcuccca

SEQ ID NO: 66689 - RNA, 26 nt, Human
cugucccaccgccuccugccucucuc

SEQ ID NO: 66690 - RNA, 22 nt, Human
cccagcauucagugguccuguc

SEQ ID NO: 66691 - RNA, 22 nt, Human
ucuugaacuccugggcucaaga

SEQ ID NO: 66692 - RNA, 23 nt, Human
aaggcagauggaucaugagguca

SEQ ID NO: 66693 - RNA, 22 nt, Human
gucuuaaaagaccuagucccua

SEQ ID NO: 66694 - RNA, 22 nt, Human
acuuguuuguucugcuucucuu

SEQ ID NO: 66695 - RNA, 21 nt, Human
cucuccaggcuggagugcagu

SEQ ID NO: 66696 - RNA, 23 nt, Human
cuuagaauagugccugacauaua

SEQ ID NO: 66697 - RNA, 17 nt, Human
guugcacucuaggguga

SEQ ID NO: 66698 - RNA, 26 nt, Human
gccuccaggugaccucacucggacgg

SEQ ID NO: 66699 - RNA, 25 nt, Human
cucuagggccucuccagacugugcc

SEQ ID NO: 66700 - RNA, 22 nt, Human
gccuucuugcuuuaaagcaauu

SEQ ID NO: 66701 - RNA, 29 nt, Human
agagaccuuguucucccacccgaccuucc

SEQ ID NO: 66702 - RNA, 29 nt, Human
gggggaagagaaacuugcagugaaaagga

SEQ ID NO: 66703 - RNA, 18 nt, Human
uaacugcaguugacuuuc

SEQ ID NO: 66704 - RNA, 22 nt, Human
cagccaucuaucaccucuagaa

SEQ ID NO: 66705 - RNA, 20 nt, Human
cccugcucccugcuuuggcu

SEQ ID NO: 66706 - RNA, 23 nt, Human
agagaauuccuccuggcagcccu

SEQ ID NO: 66707 - RNA, 20 nt, Human
gcacagacuuccuuuuacuu

SEQ ID NO: 66708 - RNA, 22 nt, Human
agaccagcuugggcaacaacaa

SEQ ID NO: 66709 - RNA, 21 nt, Human
ugaguuucuuucuacuuucuc

SEQ ID NO: 66710 - RNA, 22 nt, Human
cugaggcaggaggaucccuuga

SEQ ID NO: 66711 - RNA, 23 nt, Human
aacgaaagagagaauaugaaaga

SEQ ID NO: 66712 - RNA, 19 nt, Human
aguugucucugaugcagcu

SEQ ID NO: 66713 - RNA, 19 nt, Human
uuccuuccucuucacuggc

SEQ ID NO: 66714 - RNA, 23 nt, Human
uacuugacguuuuaaacuccuag

SEQ ID NO: 66715 - RNA, 21 nt, Human
gggagagaagagaaugcacaa

SEQ ID NO: 66716 - RNA, 18 nt, Human
aauuuuacuugcaccuua

SEQ ID NO: 66717 - RNA, 23 nt, Human
cccccagucagaucucaggcuug

SEQ ID NO: 66718 - RNA, 22 nt, Human
gagaaaaugucauaaauggaua

SEQ ID NO: 66719 - RNA, 23 nt, Human
ucuuuggcucuauuggauuuguc

SEQ ID NO: 66720 - RNA, 22 nt, Human
agccuuuucagcaucucaccca

SEQ ID NO: 66721 - RNA, 22 nt, Human
ccagacaugguggcucacaccu

SEQ ID NO: 66722 - RNA, 22 nt, Human
uucaagcaauucuccugccuca

SEQ ID NO: 66723 - RNA, 26 nt, Human
ucauuucucauucuccuaggaguacu

SEQ ID NO: 66724 - RNA, 26 nt, Human
cauaucagagccuaagccaccucucu

SEQ ID NO: 66725 - RNA, 28 nt, Human
uguguggaggagcgaugggcagaaccag

SEQ ID NO: 66726 - RNA, 27 nt, Human
ccccugccacugccacaacccccgaug

SEQ ID NO: 66727 - RNA, 22 nt, Human
cucaaauuggcacugagauuug

SEQ ID NO: 66728 - RNA, 25 nt, Human
aaggugcccauuccacucugccuuu

SEQ ID NO: 66729 - RNA, 25 nt, Human
ccagcugagguguggcccucaggcc

SEQ ID NO: 66730 - RNA, 20 nt, Human
uauuuucagcaaccagcugc

SEQ ID NO: 66731 - RNA, 27 nt, Human
cccugcuccaugggcaccucugcugua

SEQ ID NO: 66732 - RNA, 18 nt, Human
uacagaaguggaguugcu

SEQ ID NO: 66733 - RNA, 19 nt, Human
uuugaauuugaguuugagg

SEQ ID NO: 66734 - RNA, 28 nt, Human
gcaacccgcuggagcccacagcgagccu

SEQ ID NO: 66735 - RNA, 22 nt, Human
caccucaggaagugcugggauu

SEQ ID NO: 66736 - RNA, 24 nt, Human
gccuauuggugucuaaacuucaua

SEQ ID NO: 66737 - RNA, 21 nt, Human
uguuaaaacauugccaacuca

SEQ ID NO: 66738 - RNA, 27 nt, Human
uuuuccccucccagcauugaaaucauu

SEQ ID NO: 66739 - RNA, 22 nt, Human
uggaccaccugcagggcugccu

SEQ ID NO: 66740 - RNA, 21 nt, Human
augcaauucaguaguccugaa

SEQ ID NO: 66741 - RNA, 20 nt, Human
caaugcuucacaucucuuca

SEQ ID NO: 66742 - RNA, 27 nt, Human
uguuuuuaaaccauuauuuccaaguug

SEQ ID NO: 66743 - RNA, 22 nt, Human
guacagacauacauuuaugcac

SEQ ID NO: 66744 - RNA, 23 nt, Human
cacaggcucagacuaaaucagag

SEQ ID NO: 66745 - RNA, 22 nt, Human
cauaggaagagaucugccagac

SEQ ID NO: 66746 - RNA, 21 nt, Human
cgcccugggccagccuccggc

SEQ ID NO: 66747 - RNA, 27 nt, Human
gcugcccucucuggugccuguggagau

SEQ ID NO: 66748 - RNA, 21 nt, Human
gauucuggcuguccuaugucc

SEQ ID NO: 66749 - RNA, 22 nt, Human
uuugugugguggguucuuugga

SEQ ID NO: 66750 - RNA, 23 nt, Human
ugcugugugaaucaguacaguuu

SEQ ID NO: 66751 - RNA, 17 nt, Human
acuuucuagaugccuua

SEQ ID NO: 66752 - RNA, 22 nt, Human
gcugccaggcuggaguggagug

SEQ ID NO: 66753 - RNA, 27 nt, Human
cucccagaccaccucccugcccugucc

SEQ ID NO: 66754 - RNA, 23 nt, Human
gucugggcaggggcagcagcauc

SEQ ID NO: 66755 - RNA, 26 nt, Human
ucugccacccaggcuggaguacagug

SEQ ID NO: 66756 - RNA, 20 nt, Human
ucuuuuacuacaaguuugga

SEQ ID NO: 66757 - RNA, 25 nt, Human
cagauucuuacuuggcuuaaaccua

SEQ ID NO: 66758 - RNA, 16 nt, Human
cuucccuuccuagugc

SEQ ID NO: 66759 - RNA, 24 nt, Human
agguucugcuguugaguccugggu

SEQ ID NO: 66760 - RNA, 23 nt, Human
uuuccagugagggcugcaggcuu

SEQ ID NO: 66761 - RNA, 19 nt, Human
cacuuuuguucugcuuuau

SEQ ID NO: 66762 - RNA, 27 nt, Human
gccucccaccagagccgggaggaaaag

SEQ ID NO: 66763 - RNA, 21 nt, Human
cuggccgcugcucuccagacc

SEQ ID NO: 66764 - RNA, 26 nt, Human
agccucucuugguuccuuccuuggaa

SEQ ID NO: 66765 - RNA, 21 nt, Human
uaggggagagagcagagaagu

SEQ ID NO: 66766 - RNA, 30 nt, Human
ucaugcuuuugcuaucaccaaucauagugu

SEQ ID NO: 66767 - RNA, 23 nt, Human
ugugauaaaauaggaacagcuga

SEQ ID NO: 66768 - RNA, 24 nt, Human
ugaccucaaguaauccaccugccu

SEQ ID NO: 66769 - RNA, 24 nt, Human
ggaggacggggagguugucagggg

SEQ ID NO: 66770 - RNA, 21 nt, Human
uuucuaggaguucaucgugca

SEQ ID NO: 66771 - RNA, 21 nt, Human
ggagugagauuugggugugga

SEQ ID NO: 66772 - RNA, 25 nt, Human
aauuauuugugguuccaaacaauua

SEQ ID NO: 66773 - RNA, 21 nt, Human
cucucucuugcugaggacuca

SEQ ID NO: 66774 - RNA, 27 nt, Human
uugcuucugcagcccgcagaugcccag

SEQ ID NO: 66775 - RNA, 18 nt, Human
gccugccuggccugguag

SEQ ID NO: 66776 - RNA, 21 nt, Human
ggucuugaacuccuggccuca

SEQ ID NO: 66777 - RNA, 26 nt, Human
cauucaaugacuauaaccucuacucc

SEQ ID NO: 66778 - RNA, 19 nt, Human
cugccuuucaaaaggcugg

SEQ ID NO: 66779 - RNA, 20 nt, Human
ucaguauuuaauuuuucaaa

SEQ ID NO: 66780 - RNA, 23 nt, Human
uuccaagucuuccugaccaccuu

SEQ ID NO: 66781 - RNA, 28 nt, Human
gcagguaggguucaggugagcaaaaaga

SEQ ID NO: 66782 - RNA, 21 nt, Human
ccaaucaccucccaccaggcu

SEQ ID NO: 66783 - RNA, 22 nt, Human
gccucaguucaaccugguggca

SEQ ID NO: 66784 - RNA, 31 nt, Human
accuguacccaguucuucaggcugauuuccc

SEQ ID NO: 66785 - RNA, 23 nt, Human
uguccccagagaccaggcugugu

SEQ ID NO: 66786 - RNA, 22 nt, Human
gggggaaugacagauuucugga

SEQ ID NO: 66787 - RNA, 27 nt, Human
accucaagucacuguagcuuuaguaau

SEQ ID NO: 66788 - RNA, 21 nt, Human
auuucuuaggcuggagugcag

SEQ ID NO: 66789 - RNA, 27 nt, Human
ccuacuucucuuaucuuugaucguaua

SEQ ID NO: 66790 - RNA, 21 nt, Human
gcaacaggcugggcuucagug

SEQ ID NO: 66791 - RNA, 25 nt, Human
ugacuucugacauuccaaguuuuuc

SEQ ID NO: 66792 - RNA, 21 nt, Human
uggaagggacuaggagcacug

SEQ ID NO: 66793 - RNA, 19 nt, Human
aagguggcguguugcagug

SEQ ID NO: 66794 - RNA, 27 nt, Human
gugagccagaagcagccucauaacccu

SEQ ID NO: 66795 - RNA, 25 nt, Human
gcuggaccgagcagccuccuccucc

SEQ ID NO: 66796 - RNA, 25 nt, Human
ugccuguaaagcucucagcauuggc

SEQ ID NO: 66797 - RNA, 20 nt, Human
ccuccuggcccugccucuau

SEQ ID NO: 66798 - RNA, 26 nt, Human
gucgccugguggcuggacccccggga

SEQ ID NO: 66799 - RNA, 26 nt, Human
ugccaaggguggacacggcugcagac

SEQ ID NO: 66800 - RNA, 21 nt, Human
ugcaguugguacaguacuuug

SEQ ID NO: 66801 - RNA, 19 nt, Human
agaaggcaggagugcugcc

SEQ ID NO: 66802 - RNA, 24 nt, Human
ccugcuguggggcccugccuuugu

SEQ ID NO: 66803 - RNA, 21 nt, Human
cugugauguuccuuuucucac

SEQ ID NO: 66804 - RNA, 22 nt, Human
ggccuccucucccugcuggcag

SEQ ID NO: 66805 - RNA, 20 nt, Human
gugucucucccuuucuaggu

SEQ ID NO: 66806 - RNA, 23 nt, Human
ugacucaaacugugagaacuuca

SEQ ID NO: 66807 - RNA, 27 nt, Human
uuugggagcugagcuagugcuuuuagg

SEQ ID NO: 66808 - RNA, 21 nt, Human
cccugcaccuggccugggcca

SEQ ID NO: 66809 - RNA, 22 nt, Human
ggaggggcgaggacgaggcaga

SEQ ID NO: 66810 - RNA, 27 nt, Human
gggaagucacuguugaaguugcagugg

SEQ ID NO: 66811 - RNA, 19 nt, Human
guucuuuugaaauucagag

SEQ ID NO: 66812 - RNA, 26 nt, Human
gugacuuccugguagcccaagaagaa

SEQ ID NO: 66813 - RNA, 26 nt, Human
gccaaucauuuuuagagggaggaauc

SEQ ID NO: 66814 - RNA, 26 nt, Human
acuucaguguagaaugagccaaggag

SEQ ID NO: 66815 - RNA, 27 nt, Human
ccagaaacgccacaucccccaauccau

SEQ ID NO: 66816 - RNA, 23 nt, Human
gcuguucuugacagcacucugag

SEQ ID NO: 66817 - RNA, 21 nt, Human
gaaacauccuuuacaggcucc

SEQ ID NO: 66818 - RNA, 27 nt, Human
cgggagguggguggcugcggggcaauu

SEQ ID NO: 66819 - RNA, 27 nt, Human
cauauucuugaauguuucuucauucca

SEQ ID NO: 66820 - RNA, 22 nt, Human
cacccacacucugggccugugg

SEQ ID NO: 66821 - RNA, 23 nt, Human
ucaagaaugaggauauaguagcc

SEQ ID NO: 66822 - RNA, 23 nt, Human
caggcagccuugcccauucucua

SEQ ID NO: 66823 - RNA, 21 nt, Human
uuuuuauucaaacuaccuaua

SEQ ID NO: 66824 - RNA, 20 nt, Human
gauuccaggaggauucuucc

SEQ ID NO: 66825 - RNA, 22 nt, Human
gcuagccucaaccuccuggggc

SEQ ID NO: 66826 - RNA, 21 nt, Human
ccccuaguucccucugcucag

SEQ ID NO: 66827 - RNA, 27 nt, Human
gccuacucucugggccacugcugcaga

SEQ ID NO: 66828 - RNA, 26 nt, Human
ugcaguaugguacauuuuucaacuuu

SEQ ID NO: 66829 - RNA, 19 nt, Human
gcugcuuccaccaucacac

SEQ ID NO: 66830 - RNA, 25 nt, Human
ggaaggcaggcuguugccauggugg

SEQ ID NO: 66831 - RNA, 27 nt, Human
ucuucuuuauuauucuuugcuuagaua

SEQ ID NO: 66832 - RNA, 18 nt, Human
aggugagaauaauuagua

SEQ ID NO: 66833 - RNA, 24 nt, Human
gggaugcagcugugcugcauucug

SEQ ID NO: 66834 - RNA, 20 nt, Human
agaccuccuuccugaccucu

SEQ ID NO: 66835 - RNA, 22 nt, Human
ugccucgggcucucccgcugca

SEQ ID NO: 66836 - RNA, 21 nt, Human
ccagggagggggaagagaagu

SEQ ID NO: 66837 - RNA, 19 nt, Human
ugaaguacuuuuucuucca

SEQ ID NO: 66838 - RNA, 23 nt, Human
uucugcagucaucuccccuccug

SEQ ID NO: 66839 - RNA, 21 nt, Human
uucaaaccagccuuccugcuc

SEQ ID NO: 66840 - RNA, 24 nt, Human
caggcagcuguguggacccaggga

SEQ ID NO: 66841 - RNA, 22 nt, Human
gugaccauagcccacugcagcc

SEQ ID NO: 66842 - RNA, 22 nt, Human
uucaguauuacugaugguacug

SEQ ID NO: 66843 - RNA, 21 nt, Human
cccugcucaucccaggaugcc

SEQ ID NO: 66844 - RNA, 27 nt, Human
gcacuauacuuucuggaaucuuauuua

SEQ ID NO: 66845 - RNA, 20 nt, Human
gacagagggaagaugaauac

SEQ ID NO: 66846 - RNA, 22 nt, Human
uguugcuugcugaacugugaag

SEQ ID NO: 66847 - RNA, 24 nt, Human
ccagguccuugcccuuuguggaaa

SEQ ID NO: 66848 - RNA, 28 nt, Human
ggucucagaaaguaggcaggggaggaga

SEQ ID NO: 66849 - RNA, 20 nt, Human
acuuuuuuaaauauuuucua

SEQ ID NO: 66850 - RNA, 20 nt, Human
aagcgcuggauuacaggcau

SEQ ID NO: 66851 - RNA, 24 nt, Human
cuaggccggcucccccagacucag

SEQ ID NO: 66852 - RNA, 27 nt, Human
auguaaacucgggggugcuggggccag

SEQ ID NO: 66853 - RNA, 25 nt, Human
ccuccugcugaccccugacagcguc

SEQ ID NO: 66854 - RNA, 20 nt, Human
gggagcacccccauccagac

SEQ ID NO: 66855 - RNA, 23 nt, Human
ccuuuccaagcugaccucaguuu

SEQ ID NO: 66856 - RNA, 23 nt, Human
caccgaguccugagccuccaggu

SEQ ID NO: 66857 - RNA, 31 nt, Human
uacuggcaauacuccagccuggugacagagu

SEQ ID NO: 66858 - RNA, 16 nt, Human
ucacugcagauugcaa

SEQ ID NO: 66859 - RNA, 22 nt, Human
ccaagaucacgucauugcacuc

SEQ ID NO: 66860 - RNA, 22 nt, Human
gcccagcccagcccugcccagc

SEQ ID NO: 66861 - RNA, 26 nt, Human
ggcaacaaagcauuuucaaacucaaa

SEQ ID NO: 66862 - RNA, 25 nt, Human
uauaaaccauuuacuuuguguucua

SEQ ID NO: 66863 - RNA, 20 nt, Human
uaacgaagacacagacugcg

SEQ ID NO: 66864 - RNA, 29 nt, Human
aacugauguacugaauuccauaauacaua

SEQ ID NO: 66865 - RNA, 17 nt, Human
uucuccuccuccugugc

SEQ ID NO: 66866 - RNA, 27 nt, Human
cuuuuauuuggacaaauagcuuuuaua

SEQ ID NO: 66867 - RNA, 22 nt, Human
ucugcccuugggcaguugugga

SEQ ID NO: 66868 - RNA, 21 nt, Human
ugcuugcagagcaugaccuga

SEQ ID NO: 66869 - RNA, 22 nt, Human
caccagcaggucgccuccagcc

SEQ ID NO: 66870 - RNA, 22 nt, Human
ggcucacugcgaccuccgucuc

SEQ ID NO: 66871 - RNA, 19 nt, Human
accaaauuugguguuuguu

SEQ ID NO: 66872 - RNA, 18 nt, Human
agagccaaguccucccuc

SEQ ID NO: 66873 - RNA, 25 nt, Human
gcacagcccuuguugaggucagcag

SEQ ID NO: 66874 - RNA, 22 nt, Human
gacaccuguaaucccagcacuu

SEQ ID NO: 66875 - RNA, 24 nt, Human
gcauuucauucuucucuagcuggu

SEQ ID NO: 66876 - RNA, 23 nt, Human
cugucagccugguuuucgucauc

SEQ ID NO: 66877 - RNA, 20 nt, Human
ggagauggagcaggacaagu

SEQ ID NO: 66878 - RNA, 17 nt, Human
gcccagucccuggagcu

SEQ ID NO: 66879 - RNA, 25 nt, Human
ccuguaaucccagcuacucagaugg

SEQ ID NO: 66880 - RNA, 25 nt, Human
cugcuucccucaccugccugccugu

SEQ ID NO: 66881 - RNA, 25 nt, Human
ggcaaagccuccuuuuuaauacauu

SEQ ID NO: 66882 - RNA, 25 nt, Human
aucauccacggaggguggaagagga

SEQ ID NO: 66883 - RNA, 27 nt, Human
gggaaauucagucuugauuuaaccuua

SEQ ID NO: 66884 - RNA, 25 nt, Human
guccagucuccccacaccccagcag

SEQ ID NO: 66885 - RNA, 21 nt, Human
ucaaugcucauaacggaucag

SEQ ID NO: 66886 - RNA, 21 nt, Human
uaaccucuucuuuaggcaucu

SEQ ID NO: 66887 - RNA, 25 nt, Human
ccaagaagguacagauaccucagau

SEQ ID NO: 66888 - RNA, 23 nt, Human
agaauauuuaaauuuuugcaaaa

SEQ ID NO: 66889 - RNA, 26 nt, Human
ggcaggcaggauugggcuuuucuggc

SEQ ID NO: 66890 - RNA, 22 nt, Human
uuaaaggucaugugaaaacucc

SEQ ID NO: 66891 - RNA, 22 nt, Human
gacuacaggcguccuccaccau

SEQ ID NO: 66892 - RNA, 16 nt, Human
gcugcuugugaucuca

SEQ ID NO: 66893 - RNA, 21 nt, Human
ggcuuugaaaagucuugcugu

SEQ ID NO: 66894 - RNA, 22 nt, Human
uacaugccaguacaauuuauaa

SEQ ID NO: 66895 - RNA, 26 nt, Human
cauuauuucuuuauuuuaauucugcu

SEQ ID NO: 66896 - RNA, 25 nt, Human
gugcuauggcucgaucuuggcucac

SEQ ID NO: 66897 - RNA, 25 nt, Human
ccgggaccuugucucacacugauga

SEQ ID NO: 66898 - RNA, 20 nt, Human
ugcauuugagagaaauaaau

SEQ ID NO: 66899 - RNA, 26 nt, Human
caggauugcaggggacacagggaagc

SEQ ID NO: 66900 - RNA, 22 nt, Human
cccaccaccaucacugccaccu

SEQ ID NO: 66901 - RNA, 22 nt, Human
gacaggaggcccccgugccgug

SEQ ID NO: 66902 - RNA, 27 nt, Human
ucuggcccagugcugcccagccucccc

SEQ ID NO: 66903 - RNA, 22 nt, Human
gcauuccuuuugcacuuuugga

SEQ ID NO: 66904 - RNA, 21 nt, Human
uuuaaaaaauuaguugccagu

SEQ ID NO: 66905 - RNA, 21 nt, Human
gacaacacccuucccaggcca

SEQ ID NO: 66906 - RNA, 22 nt, Human
acauucuucaccuccuggugcc

SEQ ID NO: 66907 - RNA, 19 nt, Human
ggggucagggaggaaaggc

SEQ ID NO: 66908 - RNA, 23 nt, Human
gaucaaaugugaaauaaauauga

SEQ ID NO: 66909 - RNA, 24 nt, Human
ugagaccacgugcugcuggcguag

SEQ ID NO: 66910 - RNA, 26 nt, Human
ggcaaagugccaggcacaguugggga

SEQ ID NO: 66911 - RNA, 22 nt, Human
gagccccguccugauugaucgc

SEQ ID NO: 66912 - RNA, 27 nt, Human
gagcccuuuugcuauacucacagucuu

SEQ ID NO: 66913 - RNA, 26 nt, Human
gagagguggccgcuuggaguuugccc

SEQ ID NO: 66914 - RNA, 23 nt, Human
uuccaucaacugugaaagcuggg

SEQ ID NO: 66915 - RNA, 29 nt, Human
ggcucagaauuucugaaaaaugccuccuu

SEQ ID NO: 66916 - RNA, 21 nt, Human
gucuaccagugaccucagggc

SEQ ID NO: 66917 - RNA, 27 nt, Human
gcccaggcggggaaguggggugcgguc

SEQ ID NO: 66918 - RNA, 22 nt, Human
cuccacccuucacccuaguucc

SEQ ID NO: 66919 - RNA, 25 nt, Human
ccuacuuccugaagggcccucccaa

SEQ ID NO: 66920 - RNA, 24 nt, Human
uucuuccggagccguacguggcac

SEQ ID NO: 66921 - RNA, 23 nt, Human
ggcgagaucagccuccugucuca

SEQ ID NO: 66922 - RNA, 22 nt, Human
cugagaucgcgccauugcacuc

SEQ ID NO: 66923 - RNA, 27 nt, Human
aggcucacugucuaggccaggcccacc

SEQ ID NO: 66924 - RNA, 19 nt, Human
ugaguucuuccugguucau

SEQ ID NO: 66925 - RNA, 23 nt, Human
gacagaagaacaaaagcauuugg

SEQ ID NO: 66926 - RNA, 27 nt, Human
auuccuccagcugcaagaagggagcca

SEQ ID NO: 66927 - RNA, 21 nt, Human
cggcggccgaggcugaaggaa

SEQ ID NO: 66928 - RNA, 21 nt, Human
gcucaaguucaccagcauggu

SEQ ID NO: 66929 - RNA, 23 nt, Human
cuccugcucuacccucuuccuca

SEQ ID NO: 66930 - RNA, 22 nt, Human
ggguccccgagugccuagguuu

SEQ ID NO: 66931 - RNA, 25 nt, Human
aggguccauuaaggugagaauaaga

SEQ ID NO: 66932 - RNA, 22 nt, Human
gccaggccccauguccucucug

SEQ ID NO: 66933 - RNA, 22 nt, Human
uugcucuagaagacaacuuuac

SEQ ID NO: 66934 - RNA, 27 nt, Human
aucucuuuguccugaauggcuuugucu

SEQ ID NO: 66935 - RNA, 27 nt, Human
cacagugggguucacacccagggcucc

SEQ ID NO: 66936 - RNA, 18 nt, Human
acucuguuugcuuguguu

SEQ ID NO: 66937 - RNA, 28 nt, Human
acuaauuuuaaagaggaaaaauaauaau

SEQ ID NO: 66938 - RNA, 22 nt, Human
caggcuggagugcaaugacaca

SEQ ID NO: 66939 - RNA, 22 nt, Human
cucauuuacacagugcuuucca

SEQ ID NO: 66940 - RNA, 20 nt, Human
acagcugagccuggaacuga

SEQ ID NO: 66941 - RNA, 18 nt, Human
gcaauuccaggagcggca

SEQ ID NO: 66942 - RNA, 21 nt, Human
cauaagccaccaggcccagcc

SEQ ID NO: 66943 - RNA, 19 nt, Human
cucaucugcaggcgcucac

SEQ ID NO: 66944 - RNA, 22 nt, Human
ggagaaggaaaaagaacuuacg

SEQ ID NO: 66945 - RNA, 24 nt, Human
ugggcucuguuuucucagcuccaa

SEQ ID NO: 66946 - RNA, 26 nt, Human
aguaguugggauuacaggcacaugcc

SEQ ID NO: 66947 - RNA, 27 nt, Human
ccaaccugccccacugggucccggcag

SEQ ID NO: 66948 - RNA, 20 nt, Human
gugaagccaucugcgccaag

SEQ ID NO: 66949 - RNA, 22 nt, Human
gcuggagguggaggaagggcgu

SEQ ID NO: 66950 - RNA, 22 nt, Human
cauugcacuccagccuggucaa

SEQ ID NO: 66951 - RNA, 20 nt, Human
gcuuugugcuugucauucca

SEQ ID NO: 66952 - RNA, 22 nt, Human
uagaaaacucguuuucugcucc

SEQ ID NO: 66953 - RNA, 21 nt, Human
ucugcguugaugcucagaauc

SEQ ID NO: 66954 - RNA, 26 nt, Human
ugacauccuagcuuuauuguuuuuua

SEQ ID NO: 66955 - RNA, 22 nt, Human
cagauguccuaauggugaugca

SEQ ID NO: 66956 - RNA, 20 nt, Human
accuuuugguuaaacuaaua

SEQ ID NO: 66957 - RNA, 22 nt, Human
uugcacccuccgucucucgggu

SEQ ID NO: 66958 - RNA, 27 nt, Human
acuaggacaagaacaaugaccucucug

SEQ ID NO: 66959 - RNA, 21 nt, Human
cugacacccaggcccgagcgc

SEQ ID NO: 66960 - RNA, 22 nt, Human
uguugccagacuggagugcagu

SEQ ID NO: 66961 - RNA, 19 nt, Human
gacuuugcaaccuguucuc

SEQ ID NO: 66962 - RNA, 22 nt, Human
aggcugaggcgagagaaucgcu

SEQ ID NO: 66963 - RNA, 26 nt, Human
cagaagccugagcucauccgccgugg

SEQ ID NO: 66964 - RNA, 19 nt, Human
aaguuucagccaaacuucg

SEQ ID NO: 66965 - RNA, 20 nt, Human
agccucccauagcugggacu

SEQ ID NO: 66966 - RNA, 22 nt, Human
caacauuuggaacguuuccugg

SEQ ID NO: 66967 - RNA, 23 nt, Human
aaaggacaugauaaugggaccag

SEQ ID NO: 66968 - RNA, 28 nt, Human
ccuccaaucugcacuuugauuugcuucc

SEQ ID NO: 66969 - RNA, 25 nt, Human
caggagacuugcaggagaccgugug

SEQ ID NO: 66970 - RNA, 20 nt, Human
accuccaggaagagccacuu

SEQ ID NO: 66971 - RNA, 21 nt, Human
ggcaaauuauuuguagaauga

SEQ ID NO: 66972 - RNA, 22 nt, Human
aaagcucuccccuccugugacc

SEQ ID NO: 66973 - RNA, 16 nt, Human
ccugccugccucuuuc

SEQ ID NO: 66974 - RNA, 28 nt, Human
uugcgguccucuucuucagcacaugcca

SEQ ID NO: 66975 - RNA, 22 nt, Human
uauccugaacacuugacaccuu

SEQ ID NO: 66976 - RNA, 27 nt, Human
ugccuguagucccagcuacuugggagg

SEQ ID NO: 66977 - RNA, 22 nt, Human
ccaaguagcuuggacuacaggc

SEQ ID NO: 66978 - RNA, 23 nt, Human
uggccagcccauucuguauuuaa

SEQ ID NO: 66979 - RNA, 25 nt, Human
gggggaccugggcccugcccuuggc

SEQ ID NO: 66980 - RNA, 23 nt, Human
uguagcuuuaaaauaacaggguc

SEQ ID NO: 66981 - RNA, 21 nt, Human
caggcugggaggcagagggca

SEQ ID NO: 66982 - RNA, 21 nt, Human
ccucugcugcaccucucuucu

SEQ ID NO: 66983 - RNA, 26 nt, Human
ccgugcagcugggauuugaaccaggc

SEQ ID NO: 66984 - RNA, 21 nt, Human
uaacugcagauuuucauuuuc

SEQ ID NO: 66985 - RNA, 23 nt, Human
gucuucuggcucuggggcuacag

SEQ ID NO: 66986 - RNA, 20 nt, Human
auucgauuuaaucagucuuc

SEQ ID NO: 66987 - RNA, 22 nt, Human
cuuguccugaugcugugcucaa

SEQ ID NO: 66988 - RNA, 21 nt, Human
gggggaggggguaaggagcgc

SEQ ID NO: 66989 - RNA, 26 nt, Human
ugggacaauggaauaucccagggugg

SEQ ID NO: 66990 - RNA, 22 nt, Human
aggccagaggucaguacccuuu

SEQ ID NO: 66991 - RNA, 23 nt, Human
aggaugacaugugccauuuuuca

SEQ ID NO: 66992 - RNA, 27 nt, Human
ggcaacuucuggaugugcagcaaucag

SEQ ID NO: 66993 - RNA, 23 nt, Human
ugugaccacagucauaagcauuc

SEQ ID NO: 66994 - RNA, 26 nt, Human
aggugcuuagcucaagccugagaauu

SEQ ID NO: 66995 - RNA, 22 nt, Human
ucccaggcuggagugcaaucgc

SEQ ID NO: 66996 - RNA, 22 nt, Human
uggcuuaugccuguaaucccag

SEQ ID NO: 66997 - RNA, 15 nt, Human
ugccuuaaaaccaau

SEQ ID NO: 66998 - RNA, 22 nt, Human
gcauucagaagaaaaagaagca

SEQ ID NO: 66999 - RNA, 25 nt, Human
ggcagcuggaggcgcaggagccugu

SEQ ID NO: 67000 - RNA, 24 nt, Human
uagcacaccuuagaugugguauuu

SEQ ID NO: 67001 - RNA, 25 nt, Human
ccugcuucagugucuuaaugaccaa

SEQ ID NO: 67002 - RNA, 23 nt, Human
cucccagaccucuccucuuccag

SEQ ID NO: 67003 - RNA, 22 nt, Human
ccagggaaggucacagcugccu

SEQ ID NO: 67004 - RNA, 22 nt, Human
gacgggguuucaccauguugcu

SEQ ID NO: 67005 - RNA, 27 nt, Human
cugggcccuggccgaugugcauaucaa

SEQ ID NO: 67006 - RNA, 21 nt, Human
gcagaacaugcacguguacac

SEQ ID NO: 67007 - RNA, 23 nt, Human
gcagucagcccugauugugccag

SEQ ID NO: 67008 - RNA, 20 nt, Human
uccaaggcuggagugcagug

SEQ ID NO: 67009 - RNA, 23 nt, Human
gcccaucaagugcagucgggacc

SEQ ID NO: 67010 - RNA, 23 nt, Human
ggaacugcaaauguaugaugauu

SEQ ID NO: 67011 - RNA, 18 nt, Human
ggccgggauccagccaua

SEQ ID NO: 67012 - RNA, 19 nt, Human
aauuaucuugaauguagua

SEQ ID NO: 67013 - RNA, 24 nt, Human
cugcccugugccucggugccugug

SEQ ID NO: 67014 - RNA, 22 nt, Human
aacaaccagauucuuacuuggc

SEQ ID NO: 67015 - RNA, 21 nt, Human
ucgccuaagcuggaguguggu

SEQ ID NO: 67016 - RNA, 22 nt, Human
guaaacaaauuuucaggaggga

SEQ ID NO: 67017 - RNA, 20 nt, Human
augacccuuuaauucucaca

SEQ ID NO: 67018 - RNA, 20 nt, Human
acugccucugagucauugug

SEQ ID NO: 67019 - RNA, 23 nt, Human
uuaucccaaacuuuuucagaucu

SEQ ID NO: 67020 - RNA, 22 nt, Human
uggagccucaguuuccucaucu

SEQ ID NO: 67021 - RNA, 26 nt, Human
uaagucuacaggggcugggugaccuc

SEQ ID NO: 67022 - RNA, 20 nt, Human
gcugcuugaaucaggaggag

SEQ ID NO: 67023 - RNA, 21 nt, Human
ggaguuucuucaggaagaacc

SEQ ID NO: 67024 - RNA, 21 nt, Human
gcugcccggcuggccuaggca

SEQ ID NO: 67025 - RNA, 23 nt, Human
aggcuggagugcaauggugagau

SEQ ID NO: 67026 - RNA, 20 nt, Human
gggacuggagggaccaaagu

SEQ ID NO: 67027 - RNA, 21 nt, Human
uacagaugaggaaauggaggu

SEQ ID NO: 67028 - RNA, 22 nt, Human
ugaucacugcaggaugauccuc

SEQ ID NO: 67029 - RNA, 21 nt, Human
cccaagucaggaggucaagug

SEQ ID NO: 67030 - RNA, 21 nt, Human
ggcgguugaggcugcagugag

SEQ ID NO: 67031 - RNA, 25 nt, Human
cccaguagcugggauuagaggcaug

SEQ ID NO: 67032 - RNA, 23 nt, Human
gccagcugagcccagcacugcgg

SEQ ID NO: 67033 - RNA, 24 nt, Human
gauucacuccuuugagucuuugga

SEQ ID NO: 67034 - RNA, 27 nt, Human
ggucucauuccuuucuguuccccagug

SEQ ID NO: 67035 - RNA, 27 nt, Human
cugcccaggagguggcguccagcaguc

SEQ ID NO: 67036 - RNA, 24 nt, Human
ucaggcgguugcuaggcuccggcc

SEQ ID NO: 67037 - RNA, 21 nt, Human
ggcccugucccucccaccucu

SEQ ID NO: 67038 - RNA, 23 nt, Human
gacuauucccauuucucaguuua

SEQ ID NO: 67039 - RNA, 22 nt, Human
cuccuccgggcuucugaggacc

SEQ ID NO: 67040 - RNA, 26 nt, Human
agcuggccugcccucuugccaggaua

SEQ ID NO: 67041 - RNA, 21 nt, Human
ucucaacuccagucagaccag

SEQ ID NO: 67042 - RNA, 24 nt, Human
gccgagccgugugucuccuccucc

SEQ ID NO: 67043 - RNA, 22 nt, Human
gcacuggucucucuuggaauua

SEQ ID NO: 67044 - RNA, 27 nt, Human
caggcuggagugcaguggugcuaucuu

SEQ ID NO: 67045 - RNA, 22 nt, Human
ccaacauggcaacaccccgucu

SEQ ID NO: 67046 - RNA, 22 nt, Human
cagcuucaagaaauuacuggaa

SEQ ID NO: 67047 - RNA, 23 nt, Human
gcgagacuccaugggcguaggac

SEQ ID NO: 67048 - RNA, 25 nt, Human
gcagcugccaucauggucauugccu

SEQ ID NO: 67049 - RNA, 21 nt, Human
gcugccaggcuggaguggagu

SEQ ID NO: 67050 - RNA, 26 nt, Human
ccaggcugggagacagagucaggcug

SEQ ID NO: 67051 - RNA, 23 nt, Human
aggggagaagagggguggcgcag

SEQ ID NO: 67052 - RNA, 24 nt, Human
gccuagucuucucaagcaaugagg

SEQ ID NO: 67053 - RNA, 16 nt, Human
uuucuguugcaccuug

SEQ ID NO: 67054 - RNA, 24 nt, Human
uucucucucuagcuuuuuaauuca

SEQ ID NO: 67055 - RNA, 27 nt, Human
ggaggccaagacgggaugauugcuuga

SEQ ID NO: 67056 - RNA, 23 nt, Human
aucaugggacugcacuccagccu

SEQ ID NO: 67057 - RNA, 21 nt, Human
gagugacaccaguaacacagc

SEQ ID NO: 67058 - RNA, 21 nt, Human
ugaucauaauacgaagaccag

SEQ ID NO: 67059 - RNA, 26 nt, Human
cugccucuuggguucaagugauucuu

SEQ ID NO: 67060 - RNA, 21 nt, Human
gucugacuugcucaaaccaga

SEQ ID NO: 67061 - RNA, 22 nt, Human
gggggugcuggauggacagugg

SEQ ID NO: 67062 - RNA, 21 nt, Human
ccucugccucugucuccugcc

SEQ ID NO: 67063 - RNA, 25 nt, Human
gaugauauuucagaagaguuggcug

SEQ ID NO: 67064 - RNA, 26 nt, Human
gggaggugggaggacaguuagacccc

SEQ ID NO: 67065 - RNA, 29 nt, Human
ggcucccucgucaucaggugcauagcaag

SEQ ID NO: 67066 - RNA, 21 nt, Human
guuuuuaaaaaauguuuucug

SEQ ID NO: 67067 - RNA, 16 nt, Human
cgccuuggccuguguu

SEQ ID NO: 67068 - RNA, 22 nt, Human
cugucuugggacaaaaagggua

SEQ ID NO: 67069 - RNA, 27 nt, Human
aguuuugacaagcuggcuuacacuggc

SEQ ID NO: 67070 - RNA, 23 nt, Human
ucagaagugauuuaguuguggaa

SEQ ID NO: 67071 - RNA, 19 nt, Human
uugccaccagaaaccacaa

SEQ ID NO: 67072 - RNA, 22 nt, Human
ugcaucucaucaacuuaaaagu

SEQ ID NO: 67073 - RNA, 20 nt, Human
agcuuccugaagugcuggga

SEQ ID NO: 67074 - RNA, 23 nt, Human
caucugugaaauggggauaaaaa

SEQ ID NO: 67075 - RNA, 25 nt, Human
cuggauugugggcaagugggcggaa

SEQ ID NO: 67076 - RNA, 23 nt, Human
aacugagcuccggguggcugguu

SEQ ID NO: 67077 - RNA, 27 nt, Human
uuuuacccagacucaaggaguugguaa

SEQ ID NO: 67078 - RNA, 23 nt, Human
ucuccugccagcuguugcagacu

SEQ ID NO: 67079 - RNA, 23 nt, Human
gcuaugcguacacuugcauccug

SEQ ID NO: 67080 - RNA, 22 nt, Human
cuacaucuuugcuuuguuggca

SEQ ID NO: 67081 - RNA, 21 nt, Human
ggacuuucucgucgugcccca

SEQ ID NO: 67082 - RNA, 22 nt, Human
accugccacucugccccuugcc

SEQ ID NO: 67083 - RNA, 22 nt, Human
ucucuuguauaugaugaucugg

SEQ ID NO: 67084 - RNA, 27 nt, Human
uucacacaccauauggauucuauuuau

SEQ ID NO: 67085 - RNA, 26 nt, Human
gggcacagucguagagagggggcggg

SEQ ID NO: 67086 - RNA, 24 nt, Human
guuuugccugaaguuggagugagu

SEQ ID NO: 67087 - RNA, 23 nt, Human
gggaagccaccugcggauucacu

SEQ ID NO: 67088 - RNA, 24 nt, Human
uugucuuccaggcuucaaagcugc

SEQ ID NO: 67089 - RNA, 24 nt, Human
ccccacacccuggaguggcauggu

SEQ ID NO: 67090 - RNA, 26 nt, Human
cucuguucccuucuccuuucauccca

SEQ ID NO: 67091 - RNA, 27 nt, Human
agaagcagcguuagggacuuugggcug

SEQ ID NO: 67092 - RNA, 26 nt, Human
acaaagcucauacccagcccuaccaa

SEQ ID NO: 67093 - RNA, 21 nt, Human
ggggggagagccgggagucgc

SEQ ID NO: 67094 - RNA, 27 nt, Human
cucucauucccuuuuccacggagcccc

SEQ ID NO: 67095 - RNA, 21 nt, Human
cguucaccuccaagcauuuca

SEQ ID NO: 67096 - RNA, 21 nt, Human
caaagaauguguuucacuauc

SEQ ID NO: 67097 - RNA, 23 nt, Human
uuaaagguauuugaagaaacuau

SEQ ID NO: 67098 - RNA, 21 nt, Human
cugcagcugugccaucgcgcc

SEQ ID NO: 67099 - RNA, 25 nt, Human
uucauucuuucaguaaauauuuauu

SEQ ID NO: 67100 - RNA, 23 nt, Human
uccaagguagcuguaagaaaaau

SEQ ID NO: 67101 - RNA, 26 nt, Human
ucgggguggggacagguagaccaggu

SEQ ID NO: 67102 - RNA, 21 nt, Human
uaaccagguugugagccagug

SEQ ID NO: 67103 - RNA, 22 nt, Human
ucacacaccccuucccucauca

SEQ ID NO: 67104 - RNA, 20 nt, Human
gggggaguugcccagaggaa

SEQ ID NO: 67105 - RNA, 20 nt, Human
ugagaauguuuauguuuaca

SEQ ID NO: 67106 - RNA, 24 nt, Human
augggugccagggucucuguucuc

SEQ ID NO: 67107 - RNA, 24 nt, Human
uccuaggcuggacacaggauucag

SEQ ID NO: 67108 - RNA, 24 nt, Human
aaaaagggggaggagaagguucuu

SEQ ID NO: 67109 - RNA, 28 nt, Human
ccaaggagcagaggggugcggguaaacg

SEQ ID NO: 67110 - RNA, 19 nt, Human
uacaacaaauguuucuucu

SEQ ID NO: 67111 - RNA, 25 nt, Human
ugaacuucacuccucccucaguggu

SEQ ID NO: 67112 - RNA, 26 nt, Human
ugcugucugcccucaugaaauuggcu

SEQ ID NO: 67113 - RNA, 27 nt, Human
uccucuuguccuggcccuucagucugc

SEQ ID NO: 67114 - RNA, 21 nt, Human
cccuucagucaccacuccucu

SEQ ID NO: 67115 - RNA, 26 nt, Human
ggacuccagccccaugcaacuucaaa

SEQ ID NO: 67116 - RNA, 23 nt, Human
uuucuguaaauaaugugcacuga

SEQ ID NO: 67117 - RNA, 18 nt, Human
cuucccuuguccuucccu

SEQ ID NO: 67118 - RNA, 20 nt, Human
ccacaagggcauagugcagu

SEQ ID NO: 67119 - RNA, 23 nt, Human
gggcccagcuccccucccugccu

SEQ ID NO: 67120 - RNA, 23 nt, Human
ucuccuuccccugccuucagcuc

SEQ ID NO: 67121 - RNA, 22 nt, Human
uacaacacagauguaccgaaac

SEQ ID NO: 67122 - RNA, 22 nt, Human
ucacagcaaccuaaauaaacca

SEQ ID NO: 67123 - RNA, 26 nt, Human
ccugcaggaagaucuggcucagucua

SEQ ID NO: 67124 - RNA, 22 nt, Human
uucauuuguguaacgacaauaa

SEQ ID NO: 67125 - RNA, 23 nt, Human
gagcccaaaccauccucuccuua

SEQ ID NO: 67126 - RNA, 27 nt, Human
gaaagagaaaagcuguaguaaacugug

SEQ ID NO: 67127 - RNA, 24 nt, Human
aguuucucuucaccccuacacugu

SEQ ID NO: 67128 - RNA, 27 nt, Human
acugagucccaggaaacagugcuuucc

SEQ ID NO: 67129 - RNA, 24 nt, Human
gguucacccagcgcccucuaccuc

SEQ ID NO: 67130 - RNA, 25 nt, Human
aauucaggcaauuacugaaauagga

SEQ ID NO: 67131 - RNA, 23 nt, Human
gcacagaaaacagucuucuauca

SEQ ID NO: 67132 - RNA, 16 nt, Human
auccuauacucuucag

SEQ ID NO: 67133 - RNA, 23 nt, Human
ugccuguagucccagcuacuuga

SEQ ID NO: 67134 - RNA, 20 nt, Human
uuaccucuucucucucaguu

SEQ ID NO: 67135 - RNA, 28 nt, Human
gcauccccuucagggagcaggagcccag

SEQ ID NO: 67136 - RNA, 21 nt, Human
aggcugagggccccaauguau

SEQ ID NO: 67137 - RNA, 28 nt, Human
cuugggcugagagcaggaacaacgcggu

SEQ ID NO: 67138 - RNA, 23 nt, Human
gcuucuuuucucccuugaugguc

SEQ ID NO: 67139 - RNA, 21 nt, Human
cccggcugacucagugcaggg

SEQ ID NO: 67140 - RNA, 23 nt, Human
caccccacauccagccuacacag

SEQ ID NO: 67141 - RNA, 25 nt, Human
uuccauucaggaugccggcuuuauu

SEQ ID NO: 67142 - RNA, 26 nt, Human
gauuaauccacugaaguccaacuuug

SEQ ID NO: 67143 - RNA, 20 nt, Human
auuuggcuuucacacuggac

SEQ ID NO: 67144 - RNA, 20 nt, Human
uuuuuccaccccugugacac

SEQ ID NO: 67145 - RNA, 27 nt, Human
agaaaaauaaggaauugcagugugauu

SEQ ID NO: 67146 - RNA, 22 nt, Human
ggagugaagagguagaacugug

SEQ ID NO: 67147 - RNA, 21 nt, Human
aaagccauauggacacuguga

SEQ ID NO: 67148 - RNA, 24 nt, Human
ccguggaggcaggaaacggcacua

SEQ ID NO: 67149 - RNA, 21 nt, Human
gggugacuugccucagaggcu

SEQ ID NO: 67150 - RNA, 19 nt, Human
cgagagccacaccagcucu

SEQ ID NO: 67151 - RNA, 22 nt, Human
cucucugguguucaggguccuu

SEQ ID NO: 67152 - RNA, 22 nt, Human
ugcugucaaaaugacauugaug

SEQ ID NO: 67153 - RNA, 24 nt, Human
ccccgacuugcccuccugccucag

SEQ ID NO: 67154 - RNA, 18 nt, Human
cugccuccugucucucca

SEQ ID NO: 67155 - RNA, 20 nt, Human
ugcacccuaaagcugcuuac

SEQ ID NO: 67156 - RNA, 20 nt, Human
ugggguggggagagagggug

SEQ ID NO: 67157 - RNA, 27 nt, Human
ccccacccacucuguccugggaaauga

SEQ ID NO: 67158 - RNA, 21 nt, Human
cccaccccagcaguggccccu

SEQ ID NO: 67159 - RNA, 21 nt, Human
cuugauguuuugacagauuga

SEQ ID NO: 67160 - RNA, 22 nt, Human
ucuuggcaucaagaauagucaa

SEQ ID NO: 67161 - RNA, 27 nt, Human
ucccagccauguccaacgucccccaca

SEQ ID NO: 67162 - RNA, 26 nt, Human
uggggagagaggaacaaaggaccgug

SEQ ID NO: 67163 - RNA, 25 nt, Human
gagagggaaagaauguugcaccugc

SEQ ID NO: 67164 - RNA, 26 nt, Human
aagacuguuuccacaccauaggcaau

SEQ ID NO: 67165 - RNA, 23 nt, Human
acaugccugccagcguuguguca

SEQ ID NO: 67166 - RNA, 21 nt, Human
gcccaauuagcaucaucuagg

SEQ ID NO: 67167 - RNA, 27 nt, Human
cagaguucagacccaggaagcggccgg

SEQ ID NO: 67168 - RNA, 27 nt, Human
gaggcucagcagagcgugcaccaauga

SEQ ID NO: 67169 - RNA, 28 nt, Human
ucaugcuuuuuucccagaaucccucauc

SEQ ID NO: 67170 - RNA, 22 nt, Human
ccacccacaaacuccaggcugg

SEQ ID NO: 67171 - RNA, 19 nt, Human
uucucuuucuucagucuuu

SEQ ID NO: 67172 - RNA, 22 nt, Human
uauaggcauuaaagacaagucg

SEQ ID NO: 67173 - RNA, 24 nt, Human
ggggcuggccagagggucugcucc

SEQ ID NO: 67174 - RNA, 22 nt, Human
ccgggaggcggagcuugcagcg

SEQ ID NO: 67175 - RNA, 24 nt, Human
gugucucuuuucucuuucuccuua

SEQ ID NO: 67176 - RNA, 25 nt, Human
aguuguguugguuucucggugacuu

SEQ ID NO: 67177 - RNA, 25 nt, Human
ggggugaggguggcacccaggcagc

SEQ ID NO: 67178 - RNA, 24 nt, Human
uacagaagaguuucuuaacuuacu

SEQ ID NO: 67179 - RNA, 24 nt, Human
ccugccucgccacuguccugcugc

SEQ ID NO: 67180 - RNA, 23 nt, Human
gcggccuauaggcuacugcagca

SEQ ID NO: 67181 - RNA, 22 nt, Human
aaacagccaccgagaagguucu

SEQ ID NO: 67182 - RNA, 23 nt, Human
cugaucgggguggauuugugucc

SEQ ID NO: 67183 - RNA, 20 nt, Human
gagcgagaccgucucaaaaa

SEQ ID NO: 67184 - RNA, 24 nt, Human
ccccaaaauugaucacuccgccuu

SEQ ID NO: 67185 - RNA, 24 nt, Human
cuguaaucccagcuacuuaggagg

SEQ ID NO: 67186 - RNA, 21 nt, Human
gaggcgauggcagagagcagc

SEQ ID NO: 67187 - RNA, 23 nt, Human
cacgugcucaccugucccccucc

SEQ ID NO: 67188 - RNA, 22 nt, Human
aagugaagugacuugcccaggg

SEQ ID NO: 67189 - RNA, 22 nt, Human
ugacuagaugaguaaucugauu

SEQ ID NO: 67190 - RNA, 23 nt, Human
uguccagggaagaagccaccuca

SEQ ID NO: 67191 - RNA, 27 nt, Human
ggaggcugccggaggagccugagccug

SEQ ID NO: 67192 - RNA, 24 nt, Human
gccuccauggagcuacagccuccu

SEQ ID NO: 67193 - RNA, 23 nt, Human
aaacaccuggucauuucaaucca

SEQ ID NO: 67194 - RNA, 21 nt, Human
ggacaggagggagccugggga

SEQ ID NO: 67195 - RNA, 20 nt, Human
guggcuucugucaucuugaa

SEQ ID NO: 67196 - RNA, 23 nt, Human
uggaggggagagaaggauucuag

SEQ ID NO: 67197 - RNA, 21 nt, Human
acuaaaaucagagccauccag

SEQ ID NO: 67198 - RNA, 21 nt, Human
uuccuaaugauuagcacuuaa

SEQ ID NO: 67199 - RNA, 19 nt, Human
ggggugaggggcaggcagc

SEQ ID NO: 67200 - RNA, 24 nt, Human
gccaucccccucccucccugggcc

SEQ ID NO: 67201 - RNA, 22 nt, Human
uggauuuauuuucacuguuaua

SEQ ID NO: 67202 - RNA, 23 nt, Human
ggagagggcgagcaugaacuggc

SEQ ID NO: 67203 - RNA, 24 nt, Human
cacuccacuccaggcugccggcac

SEQ ID NO: 67204 - RNA, 22 nt, Human
caacauagugagacacugucuc

SEQ ID NO: 67205 - RNA, 27 nt, Human
ucagcaguugacauccaaaucuagcca

SEQ ID NO: 67206 - RNA, 21 nt, Human
ucacaugcacauuucaaaaca

SEQ ID NO: 67207 - RNA, 27 nt, Human
ggguccuguauccuggaguauuauguc

SEQ ID NO: 67208 - RNA, 24 nt, Human
cccuucaguagaauuagauuuugu

SEQ ID NO: 67209 - RNA, 24 nt, Human
gggcuccauuucugcugccucccu

SEQ ID NO: 67210 - RNA, 22 nt, Human
aaagggguuggaaaaacugauu

SEQ ID NO: 67211 - RNA, 26 nt, Human
gugcccaggcucaggugcagccccca

SEQ ID NO: 67212 - RNA, 21 nt, Human
cugucuaaugaaaccuguguc

SEQ ID NO: 67213 - RNA, 26 nt, Human
ugcuuuauacaggaauugacacugau

SEQ ID NO: 67214 - RNA, 24 nt, Human
acacauuuaauuccuauuaaguac

SEQ ID NO: 67215 - RNA, 21 nt, Human
cagacccugacaccucucauu

SEQ ID NO: 67216 - RNA, 20 nt, Human
agauggaaaagggaggcagg

SEQ ID NO: 67217 - RNA, 20 nt, Human
cucuugcccauugugggggg

SEQ ID NO: 67218 - RNA, 23 nt, Human
gguugcacugcaaccaaguguca

SEQ ID NO: 67219 - RNA, 22 nt, Human
aauggggucuuguuauguugcc

SEQ ID NO: 67220 - RNA, 29 nt, Human
uuucaggagugcaagcagcacucaaaccu

SEQ ID NO: 67221 - RNA, 27 nt, Human
uucacaguauuuacaagcuauuuuugc

SEQ ID NO: 67222 - RNA, 27 nt, Human
cagagccccaagcaggacgaaaaagag

SEQ ID NO: 67223 - RNA, 28 nt, Human
gaggggagagacaggcagcccagcagug

SEQ ID NO: 67224 - RNA, 23 nt, Human
gacuauacgggacauauguaaua

SEQ ID NO: 67225 - RNA, 30 nt, Human
cuccgagaacaacaguugggcugucaacau

SEQ ID NO: 67226 - RNA, 22 nt, Human
cuguggcucaguuuuaccaccc

SEQ ID NO: 67227 - RNA, 25 nt, Human
uaacugcauuauugaauuguucuua

SEQ ID NO: 67228 - RNA, 22 nt, Human
ggcucacugcaaccucugccua

SEQ ID NO: 67229 - RNA, 24 nt, Human
uuccucucacauacaugcucuguc

SEQ ID NO: 67230 - RNA, 23 nt, Human
cccaggaggcagagauugcggug

SEQ ID NO: 67231 - RNA, 27 nt, Human
gagaccuuagaagcgaauuccucucug

SEQ ID NO: 67232 - RNA, 22 nt, Human
ugggagguggugguugcaguga

SEQ ID NO: 67233 - RNA, 20 nt, Human
ugucugugucuuauugaaac

SEQ ID NO: 67234 - RNA, 22 nt, Human
acugccugaaagacuuggguug

SEQ ID NO: 67235 - RNA, 23 nt, Human
guuuccaucuucucaacuuuuua

SEQ ID NO: 67236 - RNA, 22 nt, Human
aaauucucaguucucuucacuc

SEQ ID NO: 67237 - RNA, 22 nt, Human
auaccuggcccuucugaagugc

SEQ ID NO: 67238 - RNA, 26 nt, Human
uucagcuuucggacucugguucuugg

SEQ ID NO: 67239 - RNA, 27 nt, Human
ccugccugcaaaccugcugguggggca

SEQ ID NO: 67240 - RNA, 23 nt, Human
uuugcgggcugccucaccuccuc

SEQ ID NO: 67241 - RNA, 22 nt, Human
ugcauggucaugacacccagaa

SEQ ID NO: 67242 - RNA, 25 nt, Human
uagggcagcagagagcuuuuugcac

SEQ ID NO: 67243 - RNA, 22 nt, Human
caaacucaguucaaaccauuuc

SEQ ID NO: 67244 - RNA, 23 nt, Human
ggcaggagaaucgcuugaaccag

SEQ ID NO: 67245 - RNA, 20 nt, Human
uucuauguuuguguuaccau

SEQ ID NO: 67246 - RNA, 22 nt, Human
cugccucucuguggucuccauc

SEQ ID NO: 67247 - RNA, 23 nt, Human
aacagaaccucuguugcucugcg

SEQ ID NO: 67248 - RNA, 21 nt, Human
agugcuaagugugaacuggac

SEQ ID NO: 67249 - RNA, 23 nt, Human
ggccggccuccucugccugguaa

SEQ ID NO: 67250 - RNA, 27 nt, Human
gggcugcaggcaggcggcuccuccuca

SEQ ID NO: 67251 - RNA, 25 nt, Human
guuuuauguugaucugcauauuucu

SEQ ID NO: 67252 - RNA, 20 nt, Human
cucaucccaugacuucccuc

SEQ ID NO: 67253 - RNA, 22 nt, Human
cuaggcacuccaugaucugcag

SEQ ID NO: 67254 - RNA, 23 nt, Human
guuugucuuugaugucauggucc

SEQ ID NO: 67255 - RNA, 26 nt, Human
cuaaucaacauuccuuuuguugguga

SEQ ID NO: 67256 - RNA, 27 nt, Human
augaaggagggacucaggaucauuguu

SEQ ID NO: 67257 - RNA, 20 nt, Human
agugacgaagagagggacag

SEQ ID NO: 67258 - RNA, 26 nt, Human
gccucugcacucccacgccuguccuc

SEQ ID NO: 67259 - RNA, 19 nt, Human
gaguaaggugguuggggug

SEQ ID NO: 67260 - RNA, 23 nt, Human
ccugcuguguggagccucuucug

SEQ ID NO: 67261 - RNA, 26 nt, Human
ucauuguuauaaaaaaucaguuauca

SEQ ID NO: 67262 - RNA, 22 nt, Human
gcggagcugggugaaggcugcg

SEQ ID NO: 67263 - RNA, 20 nt, Human
ggagcagaauuuucccacug

SEQ ID NO: 67264 - RNA, 24 nt, Human
aucagauccuggcugggaaugcgg

SEQ ID NO: 67265 - RNA, 21 nt, Human
uggaaguauugcauucugccg

SEQ ID NO: 67266 - RNA, 23 nt, Human
gagacauuugaacuguauucagg

SEQ ID NO: 67267 - RNA, 21 nt, Human
ggcagguggggaggggaagcc

SEQ ID NO: 67268 - RNA, 22 nt, Human
gucaucaugucucucgagcaga

SEQ ID NO: 67269 - RNA, 22 nt, Human
guguuuucaaaaggucuuccca

SEQ ID NO: 67270 - RNA, 27 nt, Human
ccugcucccagccucuugcucagagcu

SEQ ID NO: 67271 - RNA, 25 nt, Human
accagccugggcuaagcuccugggc

SEQ ID NO: 67272 - RNA, 25 nt, Human
gaacaccuccagauuccggcuucua

SEQ ID NO: 67273 - RNA, 23 nt, Human
aacuucugcuuuaaugacuuuac

SEQ ID NO: 67274 - RNA, 23 nt, Human
cuucugcugccccggaguccccu

SEQ ID NO: 67275 - RNA, 20 nt, Human
ccuuguggagaggagggauu

SEQ ID NO: 67276 - RNA, 20 nt, Human
guugcugucugccccuuguc

SEQ ID NO: 67277 - RNA, 21 nt, Human
ccaugaucagcgcagccugga

SEQ ID NO: 67278 - RNA, 21 nt, Human
ugugugcccagcucagcuagc

SEQ ID NO: 67279 - RNA, 21 nt, Human
gcaucaaagcacuguuuaacu

SEQ ID NO: 67280 - RNA, 23 nt, Human
cucauuucacuggcucuuuaucg

SEQ ID NO: 67281 - RNA, 25 nt, Human
uuuccuccccucagucaacccccau

SEQ ID NO: 67282 - RNA, 22 nt, Human
acagucauaggagaaagauaug

SEQ ID NO: 67283 - RNA, 26 nt, Human
ccgagucugcuuucugugccuaguug

SEQ ID NO: 67284 - RNA, 19 nt, Human
acacaaauuacaaaugugu

SEQ ID NO: 67285 - RNA, 22 nt, Human
cauuucacucugugcugcauau

SEQ ID NO: 67286 - RNA, 22 nt, Human
cuuugccgacaaccacugccca

SEQ ID NO: 67287 - RNA, 21 nt, Human
guggggguggagaaaggggaa

SEQ ID NO: 67288 - RNA, 19 nt, Human
ccagcacucugggaggcug

SEQ ID NO: 67289 - RNA, 19 nt, Human
ccagcacuuugggagguug

SEQ ID NO: 67290 - RNA, 22 nt, Human
gcucacugcaaccuucgccacc

SEQ ID NO: 67291 - RNA, 17 nt, Human
aacugugcccugccuuc

SEQ ID NO: 67292 - RNA, 27 nt, Human
cuuaaagcucagggguacuauuaguua

SEQ ID NO: 67293 - RNA, 18 nt, Human
cagcuccagggcacaguc

SEQ ID NO: 67294 - RNA, 27 nt, Human
uggggcuauugucugaggaccccaaga

SEQ ID NO: 67295 - RNA, 26 nt, Human
gaacuccagaggaaccaggagucuug

SEQ ID NO: 67296 - RNA, 26 nt, Human
ggguagcagaggcucuccucagucug

SEQ ID NO: 67297 - RNA, 25 nt, Human
ucccucggguuggguggcccagcca

SEQ ID NO: 67298 - RNA, 24 nt, Human
uuguauauuaggccaagugcaauu

SEQ ID NO: 67299 - RNA, 22 nt, Human
gagggcugggcagggaggcgcc

SEQ ID NO: 67300 - RNA, 21 nt, Human
aaggguggggagagggaagau

SEQ ID NO: 67301 - RNA, 19 nt, Human
cugagccuuguugugacac

SEQ ID NO: 67302 - RNA, 21 nt, Human
uccccggcuggagugcagugg

SEQ ID NO: 67303 - RNA, 25 nt, Human
caggcugguaugcagucauguugua

SEQ ID NO: 67304 - RNA, 28 nt, Human
agaggggagagagggcaggacaggccag

SEQ ID NO: 67305 - RNA, 20 nt, Human
ggcuaaugucaccugccucu

SEQ ID NO: 67306 - RNA, 20 nt, Human
uauuucacagaaaacaaaac

SEQ ID NO: 67307 - RNA, 24 nt, Human
uugucaaccgggcuggagugcagu

SEQ ID NO: 67308 - RNA, 26 nt, Human
agcuaguggagaggcaggaaaaagga

SEQ ID NO: 67309 - RNA, 28 nt, Human
uacggagagaaaggggaaauggaaaagu

SEQ ID NO: 67310 - RNA, 18 nt, Human
uuuguggaagaaaggagg

SEQ ID NO: 67311 - RNA, 24 nt, Human
ggcggcgacugcagucuggagggu

SEQ ID NO: 67312 - RNA, 27 nt, Human
gucacccaggcuggggcgcaauggcac

SEQ ID NO: 67313 - RNA, 21 nt, Human
cuuugcacuccaaucauucac

SEQ ID NO: 67314 - RNA, 24 nt, Human
ucuauuggaaggagguguaacggc

SEQ ID NO: 67315 - RNA, 20 nt, Human
acauuuauuuucaaagcgag

SEQ ID NO: 67316 - RNA, 27 nt, Human
cugcccuucucacucagcauuauggau

SEQ ID NO: 67317 - RNA, 20 nt, Human
uuuuuccaggcuggaacaau

SEQ ID NO: 67318 - RNA, 21 nt, Human
gcugcgugguugaugaucuuu

SEQ ID NO: 67319 - RNA, 27 nt, Human
ccaggcaaacuuccugcuacacaugcc

SEQ ID NO: 67320 - RNA, 20 nt, Human
gccauaaaagaaaaucuuua

SEQ ID NO: 67321 - RNA, 20 nt, Human
ucauucucuguacuucuagg

SEQ ID NO: 67322 - RNA, 19 nt, Human
augagacaggcacuggcug

SEQ ID NO: 67323 - RNA, 21 nt, Human
ggagaagcagcgcuguggggg

SEQ ID NO: 67324 - RNA, 29 nt, Human
ccacauuuaacuccagccuuggguuugac

SEQ ID NO: 67325 - RNA, 27 nt, Human
uccuagccauggucagacuguacaaaa

SEQ ID NO: 67326 - RNA, 22 nt, Human
uaaggcggaggucgcgggcggg

SEQ ID NO: 67327 - RNA, 18 nt, Human
accagucacuuacuccaa

SEQ ID NO: 67328 - RNA, 24 nt, Human
acucuuccugaguucaguggcacu

SEQ ID NO: 67329 - RNA, 21 nt, Human
gucacucagguagaguugaga

SEQ ID NO: 67330 - RNA, 20 nt, Human
uauuaaaagggggcuuuuua

SEQ ID NO: 67331 - RNA, 28 nt, Human
cugccucguuuaaauggucacaagaaau

SEQ ID NO: 67332 - RNA, 27 nt, Human
gcugggaugauaaagaugaggcuugcg

SEQ ID NO: 67333 - RNA, 27 nt, Human
gccccugcuucuccagccuggaccccc

SEQ ID NO: 67334 - RNA, 26 nt, Human
caaagugccucaugcaaccgggcccu

SEQ ID NO: 67335 - RNA, 21 nt, Human
ucagauucaccuuucuuccag

SEQ ID NO: 67336 - RNA, 25 nt, Human
gcagcugccugcauuucaggaaaag

SEQ ID NO: 67337 - RNA, 23 nt, Human
aaggucaaaguucacaaagauga

SEQ ID NO: 67338 - RNA, 23 nt, Human
ggcucacugcagccucugccucc

SEQ ID NO: 67339 - RNA, 24 nt, Human
gcacgaggcuccagcugagcuaag

SEQ ID NO: 67340 - RNA, 27 nt, Human
uccugcagggcuucuccuccucugucu

SEQ ID NO: 67341 - RNA, 26 nt, Human
uaaaauucugggaagcagaaccuggc

SEQ ID NO: 67342 - RNA, 24 nt, Human
aguuguuuugcauaacgucugccu

SEQ ID NO: 67343 - RNA, 22 nt, Human
cuguaaucccagcuauuuggga

SEQ ID NO: 67344 - RNA, 26 nt, Human
ugcccaggcuggagugcaguggugca

SEQ ID NO: 67345 - RNA, 25 nt, Human
ugcuucaaacuacuacuggaccuua

SEQ ID NO: 67346 - RNA, 22 nt, Human
ugccuccugggcucaagcaauc

SEQ ID NO: 67347 - RNA, 25 nt, Human
ucaguuucuucaucuguaacaucaa

SEQ ID NO: 67348 - RNA, 26 nt, Human
acagagaccuggcuggcaacgagcag

SEQ ID NO: 67349 - RNA, 26 nt, Human
aaacucaagaaugauuuuucuaaaaa

SEQ ID NO: 67350 - RNA, 20 nt, Human
ggggcaagauggcagaggua

SEQ ID NO: 67351 - RNA, 25 nt, Human
acccgagcuggagugcaguggugca

SEQ ID NO: 67352 - RNA, 22 nt, Human
agcacacacacccuaccuucca

SEQ ID NO: 67353 - RNA, 23 nt, Human
gucgcccaggcuggagcgcaguc

SEQ ID NO: 67354 - RNA, 22 nt, Human
ccccaggcuggagugcaguggc

SEQ ID NO: 67355 - RNA, 22 nt, Human
acccaggcuggagugccguggc

SEQ ID NO: 67356 - RNA, 22 nt, Human
ccaguggcaguccaaaagcaga

SEQ ID NO: 67357 - RNA, 21 nt, Human
agacggguucaccauguugcc

SEQ ID NO: 67358 - RNA, 27 nt, Human
ucaacuagggagugagugcaaaaagcu

SEQ ID NO: 67359 - RNA, 22 nt, Human
cuuguucuucccuucucuucac

SEQ ID NO: 67360 - RNA, 21 nt, Human
gcccucugccagcauaaacca

SEQ ID NO: 67361 - RNA, 22 nt, Human
agacccaggggacucugagaau

SEQ ID NO: 67362 - RNA, 26 nt, Human
cgccugccuuuagccugggggccccc

SEQ ID NO: 67363 - RNA, 27 nt, Human
gccuuucugcaccccuucucuccuggg

SEQ ID NO: 67364 - RNA, 21 nt, Human
gcuccugauauaacacuuucc

SEQ ID NO: 67365 - RNA, 29 nt, Human
gaggccgggagucagaaauucaggagcca

SEQ ID NO: 67366 - RNA, 27 nt, Human
gcucugucgcccaggcuggagugcagg

SEQ ID NO: 67367 - RNA, 21 nt, Human
uccagccugggagacagagcg

SEQ ID NO: 67368 - RNA, 24 nt, Human
gccaaguacagucucuguggugcg

SEQ ID NO: 67369 - RNA, 30 nt, Human
ugagcgaacaaacaagaacauuuccucccu

SEQ ID NO: 67370 - RNA, 27 nt, Human
ccaacagcucaagucuucccugaucaa

SEQ ID NO: 67371 - RNA, 23 nt, Human
uguuuuucuuuuccucuagagac

SEQ ID NO: 67372 - RNA, 22 nt, Human
cacagccgcgcccgugccgcag

SEQ ID NO: 67373 - RNA, 19 nt, Human
ugagcuggggacucaggga

SEQ ID NO: 67374 - RNA, 21 nt, Human
cccagcacuuugggaggcuga

SEQ ID NO: 67375 - RNA, 21 nt, Human
cuggcugcgucagccuccccc

SEQ ID NO: 67376 - RNA, 20 nt, Human
agcugcucagcaccauuuca

SEQ ID NO: 67377 - RNA, 23 nt, Human
caguucucaauuuccuguguuug

SEQ ID NO: 67378 - RNA, 27 nt, Human
uuacccaggcuggucucaaacuccugg

SEQ ID NO: 67379 - RNA, 21 nt, Human
ucaucauuuaagcacagucuu

SEQ ID NO: 67380 - RNA, 27 nt, Human
uggcuaacauggcgaaaccccgucucu

SEQ ID NO: 67381 - RNA, 27 nt, Human
uggccaacauggcgaaacccugucucu

SEQ ID NO: 67382 - RNA, 27 nt, Human
uggccaacauggugaaaccccgucucu

SEQ ID NO: 67383 - RNA, 19 nt, Human
ggugcaggccaagcauuuu

SEQ ID NO: 67384 - RNA, 21 nt, Human
acacucuccaggcuggagugc

SEQ ID NO: 67385 - RNA, 22 nt, Human
ucuuccauguuuugacguuugc

SEQ ID NO: 67386 - RNA, 23 nt, Human
ugcacccacaucuuucucugucc

SEQ ID NO: 67387 - RNA, 22 nt, Human
ggggccuggcagggaggucagg

SEQ ID NO: 67388 - RNA, 21 nt, Human
ggcuucguggucacugcucca

SEQ ID NO: 67389 - RNA, 23 nt, Human
uucccaggggggcuuugacacag

SEQ ID NO: 67390 - RNA, 27 nt, Human
agacgcugucaaauacagacaaaggau

SEQ ID NO: 67391 - RNA, 24 nt, Human
agcagagauggguccagugcagug

SEQ ID NO: 67392 - RNA, 22 nt, Human
ugccuguaaucccagcacugug

SEQ ID NO: 67393 - RNA, 22 nt, Human
cacccaggcuggaguguagugg

SEQ ID NO: 67394 - RNA, 22 nt, Human
uacccaggcuggagugcagugg

SEQ ID NO: 67395 - RNA, 22 nt, Human
cacccagguuggagugcagugg

SEQ ID NO: 67396 - RNA, 22 nt, Human
ugcccaggcuggagugcggugg

SEQ ID NO: 67397 - RNA, 22 nt, Human
uguucccaacucagcugccacg

SEQ ID NO: 67398 - RNA, 21 nt, Human
uuuauuucccuuccacagugu

SEQ ID NO: 67399 - RNA, 17 nt, Human
aaauucaauuuggauuu

SEQ ID NO: 67400 - RNA, 20 nt, Human
caggccgagccccuggaacc

SEQ ID NO: 67401 - RNA, 22 nt, Human
uauugcccaggcuugagugcaa

SEQ ID NO: 67402 - RNA, 24 nt, Human
gacgaauaaagacuuacugccuac

SEQ ID NO: 67403 - RNA, 26 nt, Human
augaaugauucuacagcuaggacuua

SEQ ID NO: 67404 - RNA, 27 nt, Human
caauugcuuacuuuguggguucuuuua

SEQ ID NO: 67405 - RNA, 23 nt, Human
ccccgcuaccucgcuccuccucc

SEQ ID NO: 67406 - RNA, 25 nt, Human
cgcgcgggagagcgggagccucggc

SEQ ID NO: 67407 - RNA, 22 nt, Human
uuagaaaagaucucaagucuuu

SEQ ID NO: 67408 - RNA, 20 nt, Human
cuggcugcugccauaguuuc

SEQ ID NO: 67409 - RNA, 21 nt, Human
ucuauuuaaaucagagauggg

SEQ ID NO: 67410 - RNA, 21 nt, Human
uaaugagagccuacaaauggg

SEQ ID NO: 67411 - RNA, 21 nt, Human
ggagagcaucuuccuggugau

SEQ ID NO: 67412 - RNA, 26 nt, Human
aaugcaugugugggggcagagguuau

SEQ ID NO: 67413 - RNA, 20 nt, Human
uauguucuucauauuuaguu

SEQ ID NO: 67414 - RNA, 22 nt, Human
agcuguuugguuugaguucuuu

SEQ ID NO: 67415 - RNA, 30 nt, Human
ggcucacugcaaccuccuccuccuggauuc

SEQ ID NO: 67416 - RNA, 25 nt, Human
gagaaguuagaauuacagcuacuga

SEQ ID NO: 67417 - RNA, 22 nt, Human
caagaagggaauagguggucug

SEQ ID NO: 67418 - RNA, 19 nt, Human
aaucacugcagccccccuc

SEQ ID NO: 67419 - RNA, 22 nt, Human
accauuccaccagaaccuuuga

SEQ ID NO: 67420 - RNA, 24 nt, Human
ucucccacuuccuccuaccugggg

SEQ ID NO: 67421 - RNA, 26 nt, Human
agcauuuucggacuucuuagucuuga

SEQ ID NO: 67422 - RNA, 20 nt, Human
cugguccccucccucugucu

SEQ ID NO: 67423 - RNA, 21 nt, Human
ccacagccauggugggagugg

SEQ ID NO: 67424 - RNA, 20 nt, Human
ucucacagauugcugccuca

SEQ ID NO: 67425 - RNA, 20 nt, Human
ccuggcccugaaggugccac

SEQ ID NO: 67426 - RNA, 23 nt, Human
uuucgccaaggcuggagugcagu

SEQ ID NO: 67427 - RNA, 22 nt, Human
gcgugagccuguaguccuagcu

SEQ ID NO: 67428 - RNA, 30 nt, Human
cagcacccacauccccuuucuugacaaaug

SEQ ID NO: 67429 - RNA, 21 nt, Human
ccucccucuuccauggagaga

SEQ ID NO: 67430 - RNA, 23 nt, Human
cuuaauacugcccucuuaaucca

SEQ ID NO: 67431 - RNA, 25 nt, Human
uaugcacugacaugacccuggguga

SEQ ID NO: 67432 - RNA, 24 nt, Human
gcagccagagaaugcccacugccu

SEQ ID NO: 67433 - RNA, 25 nt, Human
gcugcucugccccuugugcucagag

SEQ ID NO: 67434 - RNA, 24 nt, Human
cccacugcauuugcagccuugagg

SEQ ID NO: 67435 - RNA, 21 nt, Human
uuguaaaaagcccagcacuug

SEQ ID NO: 67436 - RNA, 23 nt, Human
agcagcucaagagaccuuaucuu

SEQ ID NO: 67437 - RNA, 21 nt, Human
cuuacagacucagauucaucu

SEQ ID NO: 67438 - RNA, 27 nt, Human
gggaacuggcgugugggacuccagaca

SEQ ID NO: 67439 - RNA, 19 nt, Human
gggaauggguugggagagg

SEQ ID NO: 67440 - RNA, 22 nt, Human
guucccauccacucacccacac

SEQ ID NO: 67441 - RNA, 21 nt, Human
cgggaagcggagcuugcagug

SEQ ID NO: 67442 - RNA, 28 nt, Human
acuguugucugugccuuuuugaaaaacu

SEQ ID NO: 67443 - RNA, 18 nt, Human
cuucccuuuuucuccuca

SEQ ID NO: 67444 - RNA, 25 nt, Human
gccucacuccaccuuccuuccauca

SEQ ID NO: 67445 - RNA, 28 nt, Human
agcucaccucccuccuguucacacccca

SEQ ID NO: 67446 - RNA, 23 nt, Human
ccucugcuuucccccacucugag

SEQ ID NO: 67447 - RNA, 22 nt, Human
cacucaggcuggaguacagugg

SEQ ID NO: 67448 - RNA, 20 nt, Human
gacccaggucuuccugcugc

SEQ ID NO: 67449 - RNA, 22 nt, Human
aaagggaauuauuucucagucu

SEQ ID NO: 67450 - RNA, 22 nt, Human
ugcccaggcuggagcauagugg

SEQ ID NO: 67451 - RNA, 21 nt, Human
ggaggaugccucccccaggag

SEQ ID NO: 67452 - RNA, 21 nt, Human
agggccuguccacacccugga

SEQ ID NO: 67453 - RNA, 28 nt, Human
gucagaauuuuguuggucugaauacaaa

SEQ ID NO: 67454 - RNA, 22 nt, Human
uuuccuuucucucucacucucu

SEQ ID NO: 67455 - RNA, 19 nt, Human
cugagcucuguucucucca

SEQ ID NO: 67456 - RNA, 21 nt, Human
ugcaucuuuucuacuucagua

SEQ ID NO: 67457 - RNA, 23 nt, Human
caggaaggagggggccaccugug

SEQ ID NO: 67458 - RNA, 26 nt, Human
cuagaaccccaauucagccuccuggg

SEQ ID NO: 67459 - RNA, 17 nt, Human
uaguaaaaccucaucua

SEQ ID NO: 67460 - RNA, 25 nt, Human
ggaaaacugaaauuuggaaaaagaa

SEQ ID NO: 67461 - RNA, 32 nt, Human
aggcagacggaagauguggcagaaguccucaa

SEQ ID NO: 67462 - RNA, 27 nt, Human
cgcaaaacugaaaggcaugugaaggga

SEQ ID NO: 67463 - RNA, 23 nt, Human
aagccugaauuggcuaugcagua

SEQ ID NO: 67464 - RNA, 21 nt, Human
gaggccauggcgagaauccag

SEQ ID NO: 67465 - RNA, 22 nt, Human
gcccagcccggcacccagcgcu

SEQ ID NO: 67466 - RNA, 25 nt, Human
gagggagggggaaggcagggagggc

SEQ ID NO: 67467 - RNA, 26 nt, Human
gcccaucaauaaaacuauugcaccug

SEQ ID NO: 67468 - RNA, 22 nt, Human
aggcugagacaggaggauugcc

SEQ ID NO: 67469 - RNA, 22 nt, Human
gcaaaauuguuuucaaucuaga

SEQ ID NO: 67470 - RNA, 23 nt, Human
gucacccaggcugcagugcaaug

SEQ ID NO: 67471 - RNA, 21 nt, Human
cggacaaacuuuuugucuuca

SEQ ID NO: 67472 - RNA, 22 nt, Human
ggagugugucaaguuacagagg

SEQ ID NO: 67473 - RNA, 27 nt, Human
agcccucccccuuccccuucuguguca

SEQ ID NO: 67474 - RNA, 21 nt, Human
cuccaucucuauauaaaaaca

SEQ ID NO: 67475 - RNA, 19 nt, Human
uucguagaguucccucaga

SEQ ID NO: 67476 - RNA, 23 nt, Human
gucagaugcuaccugcuguuacu

SEQ ID NO: 67477 - RNA, 18 nt, Human
ucagguggugcuggguga

SEQ ID NO: 67478 - RNA, 28 nt, Human
uucuaagauuauucuccucuauccacag

SEQ ID NO: 67479 - RNA, 27 nt, Human
uccugcucugggagguggacaugccuc

SEQ ID NO: 67480 - RNA, 23 nt, Human
ugaaggaaaauggaaauucuuga

SEQ ID NO: 67481 - RNA, 20 nt, Human
ucugcuccaacagacaccuu

SEQ ID NO: 67482 - RNA, 20 nt, Human
ugcccaggcagaggagaaug

SEQ ID NO: 67483 - RNA, 24 nt, Human
ccuggagcguugacucccuucucg

SEQ ID NO: 67484 - RNA, 22 nt, Human
ucacugcagccuccaucuccua

SEQ ID NO: 67485 - RNA, 23 nt, Human
cagccuagaguacagggugagca

SEQ ID NO: 67486 - RNA, 20 nt, Human
cccgccucccugccuggagc

SEQ ID NO: 67487 - RNA, 21 nt, Human
caaaacugguacuuacgugaa

SEQ ID NO: 67488 - RNA, 19 nt, Human
ccugaagugagucuuuggg

SEQ ID NO: 67489 - RNA, 22 nt, Human
ggcuuaccugaccucuugcugu

SEQ ID NO: 67490 - RNA, 24 nt, Human
augggauaaagaaaaauagacaac

SEQ ID NO: 67491 - RNA, 23 nt, Human
uucacagcacugcacugcagccu

SEQ ID NO: 67492 - RNA, 22 nt, Human
cagugucuggaucccagcaucu

SEQ ID NO: 67493 - RNA, 18 nt, Human
ccugcagccauggaugcc

SEQ ID NO: 67494 - RNA, 22 nt, Human
ugcagugagccgagauggcgcc

SEQ ID NO: 67495 - RNA, 22 nt, Human
ugcagugagcugagauggugcc

SEQ ID NO: 67496 - RNA, 25 nt, Human
gguucagagggggaucuugaaugaa

SEQ ID NO: 67497 - RNA, 25 nt, Human
gccccagggcuguggguggggaagg

SEQ ID NO: 67498 - RNA, 22 nt, Human
ccacuguacuccagccuggaug

SEQ ID NO: 67499 - RNA, 22 nt, Human
ccacugcacuccagucuggaug

SEQ ID NO: 67500 - RNA, 22 nt, Human
gugagaagcuacucccuccgca

SEQ ID NO: 67501 - RNA, 19 nt, Human
ucagggucccugaacugcu

SEQ ID NO: 67502 - RNA, 21 nt, Human
uaagccgagaucacaccauug

SEQ ID NO: 67503 - RNA, 25 nt, Human
uugguuuugucauguggaaagugau

SEQ ID NO: 67504 - RNA, 23 nt, Human
gccuguaaucccagcuacacugg

SEQ ID NO: 67505 - RNA, 28 nt, Human
cugucuccuucuuccugccuggcuuguc

SEQ ID NO: 67506 - RNA, 21 nt, Human
uucagagaaccaggguucaaa

SEQ ID NO: 67507 - RNA, 21 nt, Human
cugcagcugcgccuccuugca

SEQ ID NO: 67508 - RNA, 27 nt, Human
gcagugcccugcccugcccugcagugu

SEQ ID NO: 67509 - RNA, 27 nt, Human
gggagggcccggcgcagaggauugagg

SEQ ID NO: 67510 - RNA, 18 nt, Human
guuucucucccugggccu

SEQ ID NO: 67511 - RNA, 23 nt, Human
gaugcagagggcuguaagugugg

SEQ ID NO: 67512 - RNA, 27 nt, Human
uccuagaguuuuccaggggguucugag

SEQ ID NO: 67513 - RNA, 23 nt, Human
ccuuaaaucugccuuuguuucua

SEQ ID NO: 67514 - RNA, 21 nt, Human
cuauucggucucacaccuaca

SEQ ID NO: 67515 - RNA, 23 nt, Human
aucuucuuccaagaaaugcaaac

SEQ ID NO: 67516 - RNA, 17 nt, Human
gggacccccugcccaac

SEQ ID NO: 67517 - RNA, 27 nt, Human
accgcaguccaugccccauuguggacc

SEQ ID NO: 67518 - RNA, 21 nt, Human
uccuggggucugagauguguu

SEQ ID NO: 67519 - RNA, 27 nt, Human
agaggcagcagcacauaucugcuuccg

SEQ ID NO: 67520 - RNA, 21 nt, Human
gaaaguacugggauuacaagc

SEQ ID NO: 67521 - RNA, 25 nt, Human
gccaucacuuuugcagagaacuucu

SEQ ID NO: 67522 - RNA, 21 nt, Human
cagcuggcagagagcacagug

SEQ ID NO: 67523 - RNA, 26 nt, Human
auucuuaccaucuuacuccugccucc

SEQ ID NO: 67524 - RNA, 23 nt, Human
caggacagacgauggcagaggag

SEQ ID NO: 67525 - RNA, 21 nt, Human
ggagaaagcugugcagaggaa

SEQ ID NO: 67526 - RNA, 22 nt, Human
cauuagcccagcucaagccggg

SEQ ID NO: 67527 - RNA, 23 nt, Human
ggcuucuagaauuggacuggcag

SEQ ID NO: 67528 - RNA, 20 nt, Human
gcaucccucccccacacccu

SEQ ID NO: 67529 - RNA, 24 nt, Human
gcaaauuucuccccuuuauugacc

SEQ ID NO: 67530 - RNA, 21 nt, Human
agccucgggugagccgccucc

SEQ ID NO: 67531 - RNA, 22 nt, Human
gauccuuccuuuugagggagca

SEQ ID NO: 67532 - RNA, 27 nt, Human
uggaugcccauuauauuguuuucuccu

SEQ ID NO: 67533 - RNA, 22 nt, Human
aggcuggaaugcaguggugugc

SEQ ID NO: 67534 - RNA, 22 nt, Human
uggcugaggcaggcagaucacc

SEQ ID NO: 67535 - RNA, 20 nt, Human
aguugguuuguaucuugccu

SEQ ID NO: 67536 - RNA, 22 nt, Human
uuguucucuuuucuuacauuau

SEQ ID NO: 67537 - RNA, 21 nt, Human
caauccucaguccucaccugc

SEQ ID NO: 67538 - RNA, 23 nt, Human
gcugugcacaccugcucucuccu

SEQ ID NO: 67539 - RNA, 19 nt, Human
acucugugucccaggcugg

SEQ ID NO: 67540 - RNA, 26 nt, Human
ucuuccuaguggcuugaaaaucugga

SEQ ID NO: 67541 - RNA, 26 nt, Human
cuguccccacucacaggcccacgcag

SEQ ID NO: 67542 - RNA, 24 nt, Human
gacgccauccuucaaaaacaacua

SEQ ID NO: 67543 - RNA, 22 nt, Human
gacaacccuuucucuccaguuc

SEQ ID NO: 67544 - RNA, 22 nt, Human
uaaacucagaaauacccaaagc

SEQ ID NO: 67545 - RNA, 22 nt, Human
acuuugacagcgcacagcugcu

SEQ ID NO: 67546 - RNA, 22 nt, Human
cucucaucuuguuuuuguuuca

SEQ ID NO: 67547 - RNA, 21 nt, Human
ccggccugcagccccugcugc

SEQ ID NO: 67548 - RNA, 21 nt, Human
gggccccggaugacuugggga

SEQ ID NO: 67549 - RNA, 27 nt, Human
ugacacaugguacaggcuuggagcuug

SEQ ID NO: 67550 - RNA, 21 nt, Human
gccuguaaucccaacauuuug

SEQ ID NO: 67551 - RNA, 22 nt, Human
agcauccuggggcccagagcca

SEQ ID NO: 67552 - RNA, 24 nt, Human
agaggaagaagagcgcaggccugg

SEQ ID NO: 67553 - RNA, 22 nt, Human
caugccuguaaucccaacacuu

SEQ ID NO: 67554 - RNA, 22 nt, Human
aucagcuguuuaacuuugagcu

SEQ ID NO: 67555 - RNA, 26 nt, Human
ggaagauagagaggggccucugggau

SEQ ID NO: 67556 - RNA, 21 nt, Human
gaacccagggcaacaaugcca

SEQ ID NO: 67557 - RNA, 21 nt, Human
gguuucuucaggaaaauaaau

SEQ ID NO: 67558 - RNA, 22 nt, Human
gcuauugggggagcccagagac

SEQ ID NO: 67559 - RNA, 28 nt, Human
gaacagucuucagccacaguugugaugg

SEQ ID NO: 67560 - RNA, 26 nt, Human
cuuuccagauccuuauagauacggua

SEQ ID NO: 67561 - RNA, 26 nt, Human
ccagcagagcuguguuauauuuucua

SEQ ID NO: 67562 - RNA, 22 nt, Human
cagguauuugugauuuugucac

SEQ ID NO: 67563 - RNA, 21 nt, Human
cccagccugggggucugcgcu

SEQ ID NO: 67564 - RNA, 26 nt, Human
gggccugaggcccccuguguccaagc

SEQ ID NO: 67565 - RNA, 18 nt, Human
uaggaauagccugacuga

SEQ ID NO: 67566 - RNA, 20 nt, Human
agguggacaggcagagucug

SEQ ID NO: 67567 - RNA, 26 nt, Human
uccuugacuuagauucugguggagag

SEQ ID NO: 67568 - RNA, 25 nt, Human
cugggagggggugggggaucugggc

SEQ ID NO: 67569 - RNA, 20 nt, Human
aagacuccuagcuguccuuu

SEQ ID NO: 67570 - RNA, 22 nt, Human
uuaaggaagcauuuucccauug

SEQ ID NO: 67571 - RNA, 24 nt, Human
aacaucugaaagcacauuucagcc

SEQ ID NO: 67572 - RNA, 22 nt, Human
gguuuucuucccaucacuggag

SEQ ID NO: 67573 - RNA, 21 nt, Human
uuagaucuuuguauuuuuaau

SEQ ID NO: 67574 - RNA, 23 nt, Human
ugcaaccuccaccucgcagguuc

SEQ ID NO: 67575 - RNA, 23 nt, Human
cccuagcugaggcacacagggag

SEQ ID NO: 67576 - RNA, 20 nt, Human
gagcuggagugcugcgggca

SEQ ID NO: 67577 - RNA, 22 nt, Human
uaacugcaaaauauuuuccuuu

SEQ ID NO: 67578 - RNA, 22 nt, Human
gauggaggccaccucagcugga

SEQ ID NO: 67579 - RNA, 23 nt, Human
aucgcgccacugcacucuagccg

SEQ ID NO: 67580 - RNA, 27 nt, Human
uuuuacagcgaaacccuuacaugagua

SEQ ID NO: 67581 - RNA, 22 nt, Human
caugccucagugccucagugaa

SEQ ID NO: 67582 - RNA, 22 nt, Human
cccaaaauucugggauuacagg

SEQ ID NO: 67583 - RNA, 21 nt, Human
uguucugaaaugucaguucug

SEQ ID NO: 67584 - RNA, 21 nt, Human
cucagagggggcagguggccu

SEQ ID NO: 67585 - RNA, 23 nt, Human
gggguccaccugugugcaccagg

SEQ ID NO: 67586 - RNA, 32 nt, Human
agcuccucuuuaaacuccuccucucuugauga

SEQ ID NO: 67587 - RNA, 21 nt, Human
ucagccugggugacagaguga

SEQ ID NO: 67588 - RNA, 27 nt, Human
gacugaaucgccacuacagccugggug

SEQ ID NO: 67589 - RNA, 28 nt, Human
gccugagguguguccugggcuccucaga

SEQ ID NO: 67590 - RNA, 22 nt, Human
gcucaggcaguggguagaaagg

SEQ ID NO: 67591 - RNA, 21 nt, Human
ccuccaggcugcaggggcggg

SEQ ID NO: 67592 - RNA, 20 nt, Human
uaguuucugcugaacgugcu

SEQ ID NO: 67593 - RNA, 17 nt, Human
cccugcugcaaccccuc

SEQ ID NO: 67594 - RNA, 20 nt, Human
ccagugagaagccaggcuag

SEQ ID NO: 67595 - RNA, 29 nt, Human
ccugcggguuccuguugacgucuugcccu

SEQ ID NO: 67596 - RNA, 24 nt, Human
auaauuguaucuuuccauagcuuu

SEQ ID NO: 67597 - RNA, 23 nt, Human
ccacaccccacauuggacuuccu

SEQ ID NO: 67598 - RNA, 25 nt, Human
cggcucaccccggacuugcaccuua

SEQ ID NO: 67599 - RNA, 24 nt, Human
caguggggugagaagguccuggcu

SEQ ID NO: 67600 - RNA, 27 nt, Human
auccuccuuccuggcgggggugggccg

SEQ ID NO: 67601 - RNA, 20 nt, Human
ccgcaauguggagcagcagc

SEQ ID NO: 67602 - RNA, 24 nt, Human
guauuuccccuucuccagaagcag

SEQ ID NO: 67603 - RNA, 21 nt, Human
aauccuaucucuaccaaaaau

SEQ ID NO: 67604 - RNA, 20 nt, Human
ccaaugcaucuucccaccac

SEQ ID NO: 67605 - RNA, 27 nt, Human
uucucauuccucuguucuuauuggguc

SEQ ID NO: 67606 - RNA, 27 nt, Human
uuuggcauuuuaaaguaaaaacaagug

SEQ ID NO: 67607 - RNA, 24 nt, Human
ucuuugccagucccuucagucuug

SEQ ID NO: 67608 - RNA, 26 nt, Human
ggccuccagcaccuacuuggucccgc

SEQ ID NO: 67609 - RNA, 26 nt, Human
ugagccaagagcgcaccauugcacuc

SEQ ID NO: 67610 - RNA, 27 nt, Human
cugccagcugugccuugcuugcccucu

SEQ ID NO: 67611 - RNA, 28 nt, Human
guggaggagguggugauauuuaaaccau

SEQ ID NO: 67612 - RNA, 21 nt, Human
gaacaccgcugccacuguggc

SEQ ID NO: 67613 - RNA, 22 nt, Human
cugcagcugcccacugagggcu

SEQ ID NO: 67614 - RNA, 30 nt, Human
uccuuuucugcuaucaccuuccucuuguca

SEQ ID NO: 67615 - RNA, 22 nt, Human
gugugagccaccgcguccagcc

SEQ ID NO: 67616 - RNA, 22 nt, Human
gccucucucauggcuugggcug

SEQ ID NO: 67617 - RNA, 22 nt, Human
cacuauuccucacucaagauua

SEQ ID NO: 67618 - RNA, 24 nt, Human
ccacaaccaccuccagccugggag

SEQ ID NO: 67619 - RNA, 24 nt, Human
cacuugaggucaggaguuugagac

SEQ ID NO: 67620 - RNA, 19 nt, Human
ggaaaugugacuuucuaau

SEQ ID NO: 67621 - RNA, 22 nt, Human
uucccgggacacauucuucugg

SEQ ID NO: 67622 - RNA, 26 nt, Human
cugcagccuccaccucgccgcugggg

SEQ ID NO: 67623 - RNA, 22 nt, Human
gucuguaaucccagcacuuugg

SEQ ID NO: 67624 - RNA, 22 nt, Human
gccuguaauuccagcacuuugg

SEQ ID NO: 67625 - RNA, 21 nt, Human
cuguuuucgcaccuaccauca

SEQ ID NO: 67626 - RNA, 20 nt, Human
uccugggccccuccuugcca

SEQ ID NO: 67627 - RNA, 24 nt, Human
ggccuggaguuacuacaguauggg

SEQ ID NO: 67628 - RNA, 26 nt, Human
ucaggaggcugaggcaggagaaucgc

SEQ ID NO: 67629 - RNA, 21 nt, Human
ggugaucucugggaguuauag

SEQ ID NO: 67630 - RNA, 22 nt, Human
gaucuacagaacaagaaucucu

SEQ ID NO: 67631 - RNA, 21 nt, Human
cguacggcagugacucggggc

SEQ ID NO: 67632 - RNA, 27 nt, Human
cuucccaagcccuuagggaccgcagag

SEQ ID NO: 67633 - RNA, 20 nt, Human
uggccgggugcaguggcuca

SEQ ID NO: 67634 - RNA, 22 nt, Human
ugggauuagaggcaugagccac

SEQ ID NO: 67635 - RNA, 27 nt, Human
cugaucccagccauggccuuccucucc

SEQ ID NO: 67636 - RNA, 23 nt, Human
uggaggggcagcgcagccuccca

SEQ ID NO: 67637 - RNA, 19 nt, Human
ccaguaggaaccaggcugg

SEQ ID NO: 67638 - RNA, 20 nt, Human
aagcuuuguacauuuuuuau

SEQ ID NO: 67639 - RNA, 22 nt, Human
aaaccugggcuggagugaggug

SEQ ID NO: 67640 - RNA, 22 nt, Human
gucuuuuuucauuucuuccuca

SEQ ID NO: 67641 - RNA, 23 nt, Human
ccuugcuccaacuccuugucucu

SEQ ID NO: 67642 - RNA, 26 nt, Human
ccucacaaccaguccugucuguuuau

SEQ ID NO: 67643 - RNA, 27 nt, Human
gaccaaaucaugaugaugaguauuugg

SEQ ID NO: 67644 - RNA, 27 nt, Human
gggcuuccugccugguuuuucucuucu

SEQ ID NO: 67645 - RNA, 27 nt, Human
gccaccuuuucagcgauguaugcagcu

SEQ ID NO: 67646 - RNA, 22 nt, Human
ggaggcugaggugggaaaauca

SEQ ID NO: 67647 - RNA, 25 nt, Human
cauagcaauuaacugauuuguagug

SEQ ID NO: 67648 - RNA, 26 nt, Human
cagccuccucuuucugucucugauca

SEQ ID NO: 67649 - RNA, 20 nt, Human
gaaaguuggguggcuucauu

SEQ ID NO: 67650 - RNA, 23 nt, Human
aauuguguugauuuucuuugcuu

SEQ ID NO: 67651 - RNA, 22 nt, Human
gccuuggaagcucccugauccu

SEQ ID NO: 67652 - RNA, 22 nt, Human
ccucuacccucagcauccuggc

SEQ ID NO: 67653 - RNA, 24 nt, Human
acuuacucugugcuuguguaugug

SEQ ID NO: 67654 - RNA, 22 nt, Human
uccaacaaagaaaggugccaug

SEQ ID NO: 67655 - RNA, 24 nt, Human
aaaacacccagcacagacacucca

SEQ ID NO: 67656 - RNA, 24 nt, Human
ucauggcaaccccgcaggaaacca

SEQ ID NO: 67657 - RNA, 22 nt, Human
aaacccaggcugucuagcuccg

SEQ ID NO: 67658 - RNA, 21 nt, Human
uugauuucuuuucuuccuggc

SEQ ID NO: 67659 - RNA, 21 nt, Human
gggaaacuggcugaggggaua

SEQ ID NO: 67660 - RNA, 26 nt, Human
gcuacagaaaggagguuuaggauugc

SEQ ID NO: 67661 - RNA, 26 nt, Human
uucucgaucuccugaccucaugaucc

SEQ ID NO: 67662 - RNA, 20 nt, Human
uaaucugaagauauauuuca

SEQ ID NO: 67663 - RNA, 23 nt, Human
agggcagcuaggacaugggggga

SEQ ID NO: 67664 - RNA, 22 nt, Human
cuucccuucuacaaggacucca

SEQ ID NO: 67665 - RNA, 21 nt, Human
aguuuccauuucccucccuca

SEQ ID NO: 67666 - RNA, 30 nt, Human
cagcuuuugauuauaacugcuuuagcauua

SEQ ID NO: 67667 - RNA, 23 nt, Human
uuucucuuaacgauuaucacugu

SEQ ID NO: 67668 - RNA, 27 nt, Human
agguccuuuucagggagugacaaguag

SEQ ID NO: 67669 - RNA, 18 nt, Human
ggugggaauggggugggg

SEQ ID NO: 67670 - RNA, 26 nt, Human
ggcuuauccuggcaaugggguaguca

SEQ ID NO: 67671 - RNA, 24 nt, Human
ccugcugagcugccccugcugcuu

SEQ ID NO: 67672 - RNA, 27 nt, Human
cugccgcaggcugggugcacggccggg

SEQ ID NO: 67673 - RNA, 24 nt, Human
cuucugcugacaccucaucuagca

SEQ ID NO: 67674 - RNA, 24 nt, Human
ccaaaguagcugauguauuggacg

SEQ ID NO: 67675 - RNA, 22 nt, Human
uguuuuuaacacagagucucua

SEQ ID NO: 67676 - RNA, 21 nt, Human
ccagaucaccaccccuuacaa

SEQ ID NO: 67677 - RNA, 17 nt, Human
aacugacugccuugcua

SEQ ID NO: 67678 - RNA, 25 nt, Human
ccggcagaagaaugaggugacccuc

SEQ ID NO: 67679 - RNA, 24 nt, Human
agccuccucuccagguuccugccc

SEQ ID NO: 67680 - RNA, 24 nt, Human
cuccuugcagccaugcuccugggc

SEQ ID NO: 67681 - RNA, 27 nt, Human
cucuccauccuccccagggguagaggc

SEQ ID NO: 67682 - RNA, 22 nt, Human
uggcucaugccuguaaucccag

SEQ ID NO: 67683 - RNA, 20 nt, Human
uaauguaagcuugugguuug

SEQ ID NO: 67684 - RNA, 23 nt, Human
ccagaaagguuucuaaaguuaca

SEQ ID NO: 67685 - RNA, 22 nt, Human
caggcuggagugcaauggugag

SEQ ID NO: 67686 - RNA, 22 nt, Human
cagacuagaguacaguggugag

SEQ ID NO: 67687 - RNA, 22 nt, Human
ggguaaucuaguaccaugucgu

SEQ ID NO: 67688 - RNA, 21 nt, Human
gugcuuccuucacuucaccuc

SEQ ID NO: 67689 - RNA, 25 nt, Human
auacauacuaguaccauuaucuucu

SEQ ID NO: 67690 - RNA, 25 nt, Human
gcuuguuuuaccuacaucuaguuuc

SEQ ID NO: 67691 - RNA, 21 nt, Human
uccagccugggcaauacagug

SEQ ID NO: 67692 - RNA, 23 nt, Human
cccuucccuuugucucaguggga

SEQ ID NO: 67693 - RNA, 23 nt, Human
uccagguugugcuauuaaccaag

SEQ ID NO: 67694 - RNA, 24 nt, Human
ucucggaacuccugaccucaggug

SEQ ID NO: 67695 - RNA, 21 nt, Human
gaagagauacagccuuccgua

SEQ ID NO: 67696 - RNA, 22 nt, Human
gccagcacaggcugagugcagc

SEQ ID NO: 67697 - RNA, 22 nt, Human
ccgagaucgccccacugcacuc

SEQ ID NO: 67698 - RNA, 22 nt, Human
cuugcauguuccuuacuccugu

SEQ ID NO: 67699 - RNA, 25 nt, Human
ccagcccucuggguuggccugcugu

SEQ ID NO: 67700 - RNA, 21 nt, Human
ugcugcacucugcuugggccu

SEQ ID NO: 67701 - RNA, 24 nt, Human
ugugaucaugguucacugcagucu

SEQ ID NO: 67702 - RNA, 22 nt, Human
uucugccccagccuccuccuuc

SEQ ID NO: 67703 - RNA, 19 nt, Human
aauacuccucaucagccuu

SEQ ID NO: 67704 - RNA, 22 nt, Human
ccaaagugcugggauuaccggu

SEQ ID NO: 67705 - RNA, 26 nt, Human
uuugugucugugacuuuugugaaagg

SEQ ID NO: 67706 - RNA, 23 nt, Human
guaaagaauuuuaauuaauucug

SEQ ID NO: 67707 - RNA, 20 nt, Human
gaacucauggccacugugga

SEQ ID NO: 67708 - RNA, 23 nt, Human
gugcucaggccagugucuuccca

SEQ ID NO: 67709 - RNA, 22 nt, Human
cagcucuuuccagagaauucuc

SEQ ID NO: 67710 - RNA, 19 nt, Human
ucugggaggguggcauucu

SEQ ID NO: 67711 - RNA, 27 nt, Human
ccugggcaacagagcaagauccugucu

SEQ ID NO: 67712 - RNA, 19 nt, Human
agggagagaauaaaaugca

SEQ ID NO: 67713 - RNA, 21 nt, Human
uccagccuggucgacagagug

SEQ ID NO: 67714 - RNA, 26 nt, Human
cucacacugaaacaaaggaagugaug

SEQ ID NO: 67715 - RNA, 21 nt, Human
caaaguuggugccaagcuucu

SEQ ID NO: 67716 - RNA, 22 nt, Human
ucaucgacuuccucaucgacac

SEQ ID NO: 67717 - RNA, 20 nt, Human
uucaaccaaaugaaacuuga

SEQ ID NO: 67718 - RNA, 26 nt, Human
ccucaccuccacccuuccuguuguuc

SEQ ID NO: 67719 - RNA, 27 nt, Human
cucuagggaaagaacaaaacagcuuga

SEQ ID NO: 67720 - RNA, 20 nt, Human
gucugucccugucuuggugu

SEQ ID NO: 67721 - RNA, 21 nt, Human
aguuauccccuccuuuacccc

SEQ ID NO: 67722 - RNA, 22 nt, Human
gcaugugucaccaugcccagcu

SEQ ID NO: 67723 - RNA, 23 nt, Human
uuugcuugcucauaugcauguag

SEQ ID NO: 67724 - RNA, 22 nt, Human
aggugucaaaaugacaccagcu

SEQ ID NO: 67725 - RNA, 23 nt, Human
uggguagcugggauuacaagcac

SEQ ID NO: 67726 - RNA, 25 nt, Human
gaguuuucuggucaagcuuuuacca

SEQ ID NO: 67727 - RNA, 24 nt, Human
gccuccaucccuggccuccucccc

SEQ ID NO: 67728 - RNA, 25 nt, Human
gaggaagaggcaaagaacccuggcc

SEQ ID NO: 67729 - RNA, 21 nt, Human
aauucagaguugugaugcucu

SEQ ID NO: 67730 - RNA, 16 nt, Human
accauaaaauguccag

SEQ ID NO: 67731 - RNA, 22 nt, Human
ccccugaguggcagggcugacu

SEQ ID NO: 67732 - RNA, 22 nt, Human
ugcaaccucugccacccggguu

SEQ ID NO: 67733 - RNA, 21 nt, Human
cauaugcaacugcucuaggcu

SEQ ID NO: 67734 - RNA, 20 nt, Human
ccagaaugaagagggucuca

SEQ ID NO: 67735 - RNA, 20 nt, Human
gcuguaauuugacauucugg

SEQ ID NO: 67736 - RNA, 26 nt, Human
agugcaaauacuccaagcuucaagug

SEQ ID NO: 67737 - RNA, 19 nt, Human
uaaguuauacauguaugca

SEQ ID NO: 67738 - RNA, 21 nt, Human
agccugugguuacagugcaga

SEQ ID NO: 67739 - RNA, 27 nt, Human
ggcaaaguuuucugggacuugaucaua

SEQ ID NO: 67740 - RNA, 29 nt, Human
uuagugagacaagcaauuucucccuucug

SEQ ID NO: 67741 - RNA, 24 nt, Human
gccccacacccacccuccuggcuc

SEQ ID NO: 67742 - RNA, 23 nt, Human
agccuccucccaggugcuugccc

SEQ ID NO: 67743 - RNA, 21 nt, Human
acguuuucacacaaaauuuca

SEQ ID NO: 67744 - RNA, 21 nt, Human
cacccuccagcuucuggcgcc

SEQ ID NO: 67745 - RNA, 26 nt, Human
gccggcguuugcacacauuuucggac

SEQ ID NO: 67746 - RNA, 25 nt, Human
ugcccacuccccucuacuugcugcu

SEQ ID NO: 67747 - RNA, 22 nt, Human
ggccuuagcugucccacacaac

SEQ ID NO: 67748 - RNA, 26 nt, Human
ucagaagaaggaaagggagcuacaga

SEQ ID NO: 67749 - RNA, 26 nt, Human
uucagaaauucucugaaaguuucuuc

SEQ ID NO: 67750 - RNA, 26 nt, Human
ugcuaucuccuaauuacuugguggcu

SEQ ID NO: 67751 - RNA, 23 nt, Human
agcugccucuuccuacugcuucc

SEQ ID NO: 67752 - RNA, 20 nt, Human
uagcauaaaacuagacacau

SEQ ID NO: 67753 - RNA, 23 nt, Human
agcauguugcaguuucuuuucgg

SEQ ID NO: 67754 - RNA, 24 nt, Human
ggcugaccuugaacuccugggcuc

SEQ ID NO: 67755 - RNA, 24 nt, Human
guggaaauagaagcaaaugacaaa

SEQ ID NO: 67756 - RNA, 19 nt, Human
ucuuccucuuucucgacuc

SEQ ID NO: 67757 - RNA, 17 nt, Human
uucuuuacuacugaucc

SEQ ID NO: 67758 - RNA, 20 nt, Human
ucacauuccauuucucucca

SEQ ID NO: 67759 - RNA, 22 nt, Human
aaacuaugccacagucuggaug

SEQ ID NO: 67760 - RNA, 26 nt, Human
aggcucugaagagauacccacagagu

SEQ ID NO: 67761 - RNA, 22 nt, Human
ccagcuaauuugauuaaaauuc

SEQ ID NO: 67762 - RNA, 26 nt, Human
caccuccaucuucuuugcagccuggg

SEQ ID NO: 67763 - RNA, 27 nt, Human
gguuucgaacuccugaccucgugaucc

SEQ ID NO: 67764 - RNA, 27 nt, Human
ggucucgaacuccugaccuugugaucc

SEQ ID NO: 67765 - RNA, 22 nt, Human
agcacuuucauggcugcccucu

SEQ ID NO: 67766 - RNA, 27 nt, Human
cauugcacuccagccuaggcaacaaga

SEQ ID NO: 67767 - RNA, 28 nt, Human
uccauuugcaacaggaagacacuggcuu

SEQ ID NO: 67768 - RNA, 20 nt, Human
cacucuccuccccucccuca

SEQ ID NO: 67769 - RNA, 26 nt, Human
ccaggagugguggcucugagguguga

SEQ ID NO: 67770 - RNA, 26 nt, Human
auugcccaggcuggucuucuggcuuc

SEQ ID NO: 67771 - RNA, 27 nt, Human
auacauacauguaacuucauuauuuua

SEQ ID NO: 67772 - RNA, 25 nt, Human
uaaauucuccuguucacauuguaca

SEQ ID NO: 67773 - RNA, 21 nt, Human
acaaggacaguaacacacaug

SEQ ID NO: 67774 - RNA, 18 nt, Human
ugggacaaagauggggaa

SEQ ID NO: 67775 - RNA, 20 nt, Human
agcccuccuggaauggagcu

SEQ ID NO: 67776 - RNA, 23 nt, Human
gcacccaggcugcagggugaggc

SEQ ID NO: 67777 - RNA, 21 nt, Human
gcuguggcuuuguguugcguu

SEQ ID NO: 67778 - RNA, 22 nt, Human
auugagcaucuguaaugugcca

SEQ ID NO: 67779 - RNA, 26 nt, Human
aaacaucuuuuccuucuucccucucc

SEQ ID NO: 67780 - RNA, 22 nt, Human
ccagcaaauuaucaccaucugu

SEQ ID NO: 67781 - RNA, 23 nt, Human
cuagaugacuucugcacuuuuag

SEQ ID NO: 67782 - RNA, 25 nt, Human
caggaaaaauggcagcucuuaaagg

SEQ ID NO: 67783 - RNA, 27 nt, Human
cccacucaugagucuuuucaucaugcc

SEQ ID NO: 67784 - RNA, 21 nt, Human
cuucagauuauggcuuuuucu

SEQ ID NO: 67785 - RNA, 20 nt, Human
gaagaaauuuaagcugcaaa

SEQ ID NO: 67786 - RNA, 19 nt, Human
ccccaggcuggagugcagu

SEQ ID NO: 67787 - RNA, 19 nt, Human
acccaggcuggagugccgu

SEQ ID NO: 67788 - RNA, 25 nt, Human
uuucccuaagaaaucaugcgcagag

SEQ ID NO: 67789 - RNA, 25 nt, Human
gccucaaaauguguaagcaggagag

SEQ ID NO: 67790 - RNA, 23 nt, Human
cugagucucaguguaggugucug

SEQ ID NO: 67791 - RNA, 29 nt, Human
guaagcagcuaucuuccagagggccacac

SEQ ID NO: 67792 - RNA, 22 nt, Human
cucauccucccaaguagguggg

SEQ ID NO: 67793 - RNA, 22 nt, Human
agauacagcugcuuagaaagga

SEQ ID NO: 67794 - RNA, 22 nt, Human
aaccuguaaucccagcacuuug

SEQ ID NO: 67795 - RNA, 21 nt, Human
cggaagguggaggcugccgug

SEQ ID NO: 67796 - RNA, 18 nt, Human
ggaguuucuuuagcugac

SEQ ID NO: 67797 - RNA, 20 nt, Human
aaaggccaaccaaugcccac

SEQ ID NO: 67798 - RNA, 27 nt, Human
ugcuggguguuggagcagagugaggga

SEQ ID NO: 67799 - RNA, 22 nt, Human
gggcagccccaagccuccuggg

SEQ ID NO: 67800 - RNA, 21 nt, Human
gcagcuuuccagccuuggugg

SEQ ID NO: 67801 - RNA, 29 nt, Human
uugcccccuucggggcuggaggucucagu

SEQ ID NO: 67802 - RNA, 27 nt, Human
caggaauugggcagcuuccacauccga

SEQ ID NO: 67803 - RNA, 27 nt, Human
cugccugcacucugucucuccaaguac

SEQ ID NO: 67804 - RNA, 24 nt, Human
gguuucucacaccucuguucccag

SEQ ID NO: 67805 - RNA, 24 nt, Human
ucugcaguggaugcagccauugca

SEQ ID NO: 67806 - RNA, 22 nt, Human
agggguaggaauggaaggaugg

SEQ ID NO: 67807 - RNA, 27 nt, Human
ugcagcucccuccgugccucagaucug

SEQ ID NO: 67808 - RNA, 27 nt, Human
gaugcugcugugagaggcacagagccc

SEQ ID NO: 67809 - RNA, 22 nt, Human
aggcugaggugggaggaucauu

SEQ ID NO: 67810 - RNA, 22 nt, Human
cuucccagcagcggcaccaagg

SEQ ID NO: 67811 - RNA, 22 nt, Human
auugcuugaacccaggagaugg

SEQ ID NO: 67812 - RNA, 27 nt, Human
ggcuuguguauccaugcaccuaccuca

SEQ ID NO: 67813 - RNA, 23 nt, Human
cacucagaccaauuucugcuuca

SEQ ID NO: 67814 - RNA, 26 nt, Human
cugccugaauucucuuuggcuucugu

SEQ ID NO: 67815 - RNA, 21 nt, Human
gacaccaauaaauucuuuuug

SEQ ID NO: 67816 - RNA, 23 nt, Human
ucaggugcagagguucugaggga

SEQ ID NO: 67817 - RNA, 20 nt, Human
uggccuggccccuucucugc

SEQ ID NO: 67818 - RNA, 29 nt, Human
gucuagggggcagugucucuuccaggggg

SEQ ID NO: 67819 - RNA, 26 nt, Human
gcacagcccacggggaucacagcguu

SEQ ID NO: 67820 - RNA, 22 nt, Human
gagaaucuuuaauaaaguggcu

SEQ ID NO: 67821 - RNA, 24 nt, Human
ugacugcccuuuuccaugugucuu

SEQ ID NO: 67822 - RNA, 20 nt, Human
cuggcugccacaggguccuc

SEQ ID NO: 67823 - RNA, 21 nt, Human
ucccugagagcguggccugac

SEQ ID NO: 67824 - RNA, 20 nt, Human
ucagcacugaccacugugau

SEQ ID NO: 67825 - RNA, 22 nt, Human
gggcgguggagcaggagcuggc

SEQ ID NO: 67826 - RNA, 21 nt, Human
caggaauaaaaaggauacuca

SEQ ID NO: 67827 - RNA, 27 nt, Human
uggucucaggguucugaucuugccuuc

SEQ ID NO: 67828 - RNA, 25 nt, Human
gggcgcagaggcaggcagcaucucu

SEQ ID NO: 67829 - RNA, 26 nt, Human
cacuucagacagggacaaggcuuccu

SEQ ID NO: 67830 - RNA, 19 nt, Human
acagaaaucugcauuuaga

SEQ ID NO: 67831 - RNA, 19 nt, Human
aaguccuggugagagagau

SEQ ID NO: 67832 - RNA, 22 nt, Human
gcuggccauggcccacagcucu

SEQ ID NO: 67833 - RNA, 23 nt, Human
gaccuagaagcagcaucuuccca

SEQ ID NO: 67834 - RNA, 26 nt, Human
uuguuugcaauggggaauuuauaaga

SEQ ID NO: 67835 - RNA, 24 nt, Human
cuuuucauugagacaaacuccagg

SEQ ID NO: 67836 - RNA, 22 nt, Human
uugggaugggcgucugcucugg

SEQ ID NO: 67837 - RNA, 21 nt, Human
gcuucuccucuuguuucugcc

SEQ ID NO: 67838 - RNA, 22 nt, Human
uggauaguauguaauuucugca

SEQ ID NO: 67839 - RNA, 21 nt, Human
ccugccugcugccguguccuc

SEQ ID NO: 67840 - RNA, 20 nt, Human
ccauggaacuccacucuguc

SEQ ID NO: 67841 - RNA, 21 nt, Human
ugcagagugggagaccuuaaa

SEQ ID NO: 67842 - RNA, 22 nt, Human
ccuugcccucuugagcucauuc

SEQ ID NO: 67843 - RNA, 22 nt, Human
cagggagggguuucugcuuagc

SEQ ID NO: 67844 - RNA, 18 nt, Human
gugcagcugccaaaaguc

SEQ ID NO: 67845 - RNA, 24 nt, Human
agguugugauuggugacauucuga

SEQ ID NO: 67846 - RNA, 19 nt, Human
cugaacacagguucugaug

SEQ ID NO: 67847 - RNA, 22 nt, Human
augccugcgccugcugccugcu

SEQ ID NO: 67848 - RNA, 26 nt, Human
uuccaguguuaccaucuccugaguuu

SEQ ID NO: 67849 - RNA, 23 nt, Human
cucuuuaaaaacaaaacaaaaca

SEQ ID NO: 67850 - RNA, 19 nt, Human
ucugcucucuauuggugcc

SEQ ID NO: 67851 - RNA, 25 nt, Human
gguggagaggaggaugggccucagg

SEQ ID NO: 67852 - RNA, 20 nt, Human
aaaauauaugucccaucguu

SEQ ID NO: 67853 - RNA, 17 nt, Human
ucaguugcaucugugau

SEQ ID NO: 67854 - RNA, 27 nt, Human
agcauuuucacauuuugccuuucucgu

SEQ ID NO: 67855 - RNA, 23 nt, Human
auagccccuccaagaaagauucu

SEQ ID NO: 67856 - RNA, 27 nt, Human
uucccuuccucuuccugcccuugaacc

SEQ ID NO: 67857 - RNA, 20 nt, Human
gcuuccacgccaguugccuc

SEQ ID NO: 67858 - RNA, 26 nt, Human
uccugguuccuaggggaaugaggggg

SEQ ID NO: 67859 - RNA, 22 nt, Human
ccuacuucucugagucagcuga

SEQ ID NO: 67860 - RNA, 25 nt, Human
ggacacuacaaacauggggagccau

SEQ ID NO: 67861 - RNA, 23 nt, Human
ugggaagaccagcuuugcaguga

SEQ ID NO: 67862 - RNA, 23 nt, Human
acagaagaaggcagcagguggca

SEQ ID NO: 67863 - RNA, 21 nt, Human
gggagagaaggagguggcccu

SEQ ID NO: 67864 - RNA, 26 nt, Human
aaugguagaauucaaagaucugggga

SEQ ID NO: 67865 - RNA, 26 nt, Human
guuugaaaaaccuguucugguagcuc

SEQ ID NO: 67866 - RNA, 21 nt, Human
ugucuugugauuaaaaucauc

SEQ ID NO: 67867 - RNA, 24 nt, Human
cccagccugggaagaugucucacu

SEQ ID NO: 67868 - RNA, 27 nt, Human
agcuauuugagggacuaagggauggag

SEQ ID NO: 67869 - RNA, 23 nt, Human
cugcguaguccgcuuucucuugc

SEQ ID NO: 67870 - RNA, 29 nt, Human
caauagcaccuugaaaaucugcccuaaaa

SEQ ID NO: 67871 - RNA, 16 nt, Human
cguccacaagagucuc

SEQ ID NO: 67872 - RNA, 25 nt, Human
caugacugaaggacaucugacaaug

SEQ ID NO: 67873 - RNA, 23 nt, Human
cccgccgccuccgcucuccccgg

SEQ ID NO: 67874 - RNA, 27 nt, Human
acuaccugaguuuuuacuugcauaaac

SEQ ID NO: 67875 - RNA, 21 nt, Human
ccacugccccaggagcacuuu

SEQ ID NO: 67876 - RNA, 22 nt, Human
ugcccuuuugccgaugcauacu

SEQ ID NO: 67877 - RNA, 22 nt, Human
ccccaaaaugcaaguuuacuuu

SEQ ID NO: 67878 - RNA, 21 nt, Human
auaaagcucauggcccaccag

SEQ ID NO: 67879 - RNA, 20 nt, Human
uuucacugcaaacacaccuu

SEQ ID NO: 67880 - RNA, 26 nt, Human
aaaugcucucuuacauuuuauuaucc

SEQ ID NO: 67881 - RNA, 21 nt, Human
guggugcuugcagucacagga

SEQ ID NO: 67882 - RNA, 22 nt, Human
cagggguggcccaaugagggaa

SEQ ID NO: 67883 - RNA, 21 nt, Human
ugaguaugccagcugcauuag

SEQ ID NO: 67884 - RNA, 24 nt, Human
cucugcuuggagaggacaagugca

SEQ ID NO: 67885 - RNA, 26 nt, Human
ugcccuaccagccugcacauggguag

SEQ ID NO: 67886 - RNA, 25 nt, Human
cugucacccacgcuggagugcugug

SEQ ID NO: 67887 - RNA, 25 nt, Human
cccugccccuccccaaaagaaacca

SEQ ID NO: 67888 - RNA, 26 nt, Human
uuuacugacauggagugaagugcaau

SEQ ID NO: 67889 - RNA, 22 nt, Human
cucagccucccaaagagcuggg

SEQ ID NO: 67890 - RNA, 21 nt, Human
auccagcuucuggcuccuggg

SEQ ID NO: 67891 - RNA, 19 nt, Human
gucacucucuauugucaug

SEQ ID NO: 67892 - RNA, 22 nt, Human
ucgggaggcagagguugucaug

SEQ ID NO: 67893 - RNA, 22 nt, Human
ggaaaggggagagccugcuggc

SEQ ID NO: 67894 - RNA, 20 nt, Human
gagcaucugcccagcaaccu

SEQ ID NO: 67895 - RNA, 22 nt, Human
cuccccacgaugccaaaggaca

SEQ ID NO: 67896 - RNA, 20 nt, Human
cuucccuugccacuuugcac

SEQ ID NO: 67897 - RNA, 19 nt, Human
guacucaggcagugcaaua

SEQ ID NO: 67898 - RNA, 26 nt, Human
cugccucucccucccuguuugaaucu

SEQ ID NO: 67899 - RNA, 19 nt, Human
cccacccccaguguggcug

SEQ ID NO: 67900 - RNA, 22 nt, Human
agccuccugaauagcugggaau

SEQ ID NO: 67901 - RNA, 26 nt, Human
agagaagaagggggucuuugcccacu

SEQ ID NO: 67902 - RNA, 26 nt, Human
gauuccugccuccccacuuugguuca

SEQ ID NO: 67903 - RNA, 26 nt, Human
ucucugcccugcuccaggcaccaggc

SEQ ID NO: 67904 - RNA, 21 nt, Human
cacccucugggccucaguguc

SEQ ID NO: 67905 - RNA, 23 nt, Human
uaguguugccagaucuucugauu

SEQ ID NO: 67906 - RNA, 22 nt, Human
guggacaaaagcacauaauucu

SEQ ID NO: 67907 - RNA, 27 nt, Human
gggacuugccagcucagcccguuagga

SEQ ID NO: 67908 - RNA, 23 nt, Human
uauaagccguauauagaucaaug

SEQ ID NO: 67909 - RNA, 18 nt, Human
uuaguaaaacaaagugau

SEQ ID NO: 67910 - RNA, 18 nt, Human
cugagccucuuuucaauu

SEQ ID NO: 67911 - RNA, 22 nt, Human
ccauuccuucacaacuguauug

SEQ ID NO: 67912 - RNA, 26 nt, Human
cugcccaggacggggccggccaggug

SEQ ID NO: 67913 - RNA, 32 nt, Human
cuugaauuccugaccuccugaccugcccaccu

SEQ ID NO: 67914 - RNA, 27 nt, Human
cgauagagucucacugugucacccagg

SEQ ID NO: 67915 - RNA, 27 nt, Human
uaaauguuuuugguucaauuacauaaa

SEQ ID NO: 67916 - RNA, 27 nt, Human
ugccuguaauccuagcuacuugggagg

SEQ ID NO: 67917 - RNA, 22 nt, Human
aggaucucaggcuggagugcag

SEQ ID NO: 67918 - RNA, 22 nt, Human
ugccuucagcuuuggugaaagg

SEQ ID NO: 67919 - RNA, 25 nt, Human
cuccucugugccugcucucuccaga

SEQ ID NO: 67920 - RNA, 22 nt, Human
ucacauccuuuuccuugacuuc

SEQ ID NO: 67921 - RNA, 28 nt, Human
ggugggaggagagagggcacaucuccag

SEQ ID NO: 67922 - RNA, 22 nt, Human
uggagucucgcucugucauuca

SEQ ID NO: 67923 - RNA, 31 nt, Human
ccuccacucugggaacagcucacacccccaa

SEQ ID NO: 67924 - RNA, 25 nt, Human
ugacuucugcuuauggaaaacaaag

SEQ ID NO: 67925 - RNA, 26 nt, Human
cuuacucccuucccuucuacucugcg

SEQ ID NO: 67926 - RNA, 20 nt, Human
uggugugaacucacccuggg

SEQ ID NO: 67927 - RNA, 20 nt, Human
cccagcacuccugggucucg

SEQ ID NO: 67928 - RNA, 28 nt, Human
gccaccgcccccagccuggccuggcauu

SEQ ID NO: 67929 - RNA, 27 nt, Human
ccugccugggccucccaaagugcuagg

SEQ ID NO: 67930 - RNA, 19 nt, Human
caucccucagcaaacgcag

SEQ ID NO: 67931 - RNA, 26 nt, Human
caugggaaaauauugaaaaggacaga

SEQ ID NO: 67932 - RNA, 25 nt, Human
gggagagggacgcacagcacugccu

SEQ ID NO: 67933 - RNA, 22 nt, Human
ugcuguugcugggagcuguucu

SEQ ID NO: 67934 - RNA, 27 nt, Human
uugcucccaugauggagucuuugcagc

SEQ ID NO: 67935 - RNA, 23 nt, Human
cuuugcacuugaccucaucuccc

SEQ ID NO: 67936 - RNA, 22 nt, Human
gggagagagaaaagaaaccaga

SEQ ID NO: 67937 - RNA, 29 nt, Human
gggagagaugccuuccaggcagacacagc

SEQ ID NO: 67938 - RNA, 22 nt, Human
cucacccaggcuggaaugcagu

SEQ ID NO: 67939 - RNA, 21 nt, Human
ggugaucugugaaaaugguuc

SEQ ID NO: 67940 - RNA, 21 nt, Human
ugacuuuugguaaaggguuuu

SEQ ID NO: 67941 - RNA, 22 nt, Human
gacccuucccaaaucugcucca

SEQ ID NO: 67942 - RNA, 23 nt, Human
ugggcucccuggcccugccccac

SEQ ID NO: 67943 - RNA, 22 nt, Human
ugucuucaaguaaucugacagc

SEQ ID NO: 67944 - RNA, 23 nt, Human
uguuuuuccccaugaaccacagu

SEQ ID NO: 67945 - RNA, 23 nt, Human
caacaagagugaaacuccaucuc

SEQ ID NO: 67946 - RNA, 22 nt, Human
agcggggaggggcacugagaug

SEQ ID NO: 67947 - RNA, 20 nt, Human
aaagugcugagauuaggcgu

SEQ ID NO: 67948 - RNA, 21 nt, Human
agcauuuugccccgggcucca

SEQ ID NO: 67949 - RNA, 27 nt, Human
gggggaugucaauauugcauaccuuuu

SEQ ID NO: 67950 - RNA, 24 nt, Human
cuucacagaugugugauucacagu

SEQ ID NO: 67951 - RNA, 24 nt, Human
ggaaagcaggauguaguucugcca

SEQ ID NO: 67952 - RNA, 21 nt, Human
aacuguacauuccuucuuccu

SEQ ID NO: 67953 - RNA, 22 nt, Human
ugggcagccuccauccacccgc

SEQ ID NO: 67954 - RNA, 27 nt, Human
uggucaacauggcgaaaucccgucucu

SEQ ID NO: 67955 - RNA, 23 nt, Human
cugguccccucccucugucuuca

SEQ ID NO: 67956 - RNA, 21 nt, Human
cagccuuucuguaucaagccc

SEQ ID NO: 67957 - RNA, 27 nt, Human
ccuguucuguuuagugaaggcccaaag

SEQ ID NO: 67958 - RNA, 16 nt, Human
agcaauugcagcacuu

SEQ ID NO: 67959 - RNA, 22 nt, Human
uggugggcaccuguagucccag

SEQ ID NO: 67960 - RNA, 22 nt, Human
agccuccugaguagcugggcac

SEQ ID NO: 67961 - RNA, 25 nt, Human
aacauaaaagcaccacuguucuguu

SEQ ID NO: 67962 - RNA, 17 nt, Human
acucuggggcuuggggg

SEQ ID NO: 67963 - RNA, 21 nt, Human
gccacgcccucgcugcggggc

SEQ ID NO: 67964 - RNA, 28 nt, Human
gaggauuuggcucgcugugguuucucgu

SEQ ID NO: 67965 - RNA, 19 nt, Human
ugcuccucuaccugcucca

SEQ ID NO: 67966 - RNA, 18 nt, Human
cuucccuuccucaggcuc

SEQ ID NO: 67967 - RNA, 27 nt, Human
caggcagagcauucuaaaaccacaugg

SEQ ID NO: 67968 - RNA, 27 nt, Human
gaucguccuuccaaauggcuguauuua

SEQ ID NO: 67969 - RNA, 17 nt, Human
uuaggcugcaacuguac

SEQ ID NO: 67970 - RNA, 23 nt, Human
uugcccagauagacagggcugac

SEQ ID NO: 67971 - RNA, 22 nt, Human
uuacuucuaaguaaucacagau

SEQ ID NO: 67972 - RNA, 26 nt, Human
ccuccaggagcggugggaugaugagg

SEQ ID NO: 67973 - RNA, 20 nt, Human
ugcuuaacaggcuuuguguc

SEQ ID NO: 67974 - RNA, 24 nt, Human
auuauuucuucaguuuucuuuucu

SEQ ID NO: 67975 - RNA, 27 nt, Human
cacuacccuauucucucuuuacgcuua

SEQ ID NO: 67976 - RNA, 25 nt, Human
gacccuggcuguccccuccccacca

SEQ ID NO: 67977 - RNA, 26 nt, Human
gcuggugguuucagggggcuguugug

SEQ ID NO: 67978 - RNA, 23 nt, Human
cuuacaagucaagccuagccuga

SEQ ID NO: 67979 - RNA, 26 nt, Human
guuguuguguugagauccagugcagu

SEQ ID NO: 67980 - RNA, 27 nt, Human
cccuggcaggaagcuuccaagaguaaa

SEQ ID NO: 67981 - RNA, 25 nt, Human
ugucugacuuucguaugauuuaauu

SEQ ID NO: 67982 - RNA, 20 nt, Human
agcccaggcuggagugcaau

SEQ ID NO: 67983 - RNA, 20 nt, Human
guguauauuuaauuucuuca

SEQ ID NO: 67984 - RNA, 21 nt, Human
ccgccagaucugcaccaccuu

SEQ ID NO: 67985 - RNA, 22 nt, Human
ucuccccaggagcgggugcggc

SEQ ID NO: 67986 - RNA, 19 nt, Human
ccaccaccaccaccaccac

SEQ ID NO: 67987 - RNA, 26 nt, Human
gcuguugcuauaguacgugugauccu

SEQ ID NO: 67988 - RNA, 25 nt, Human
gggaugaccuccagaagucccuuca

SEQ ID NO: 67989 - RNA, 23 nt, Human
ggccuuuguaucuuucuuucucu

SEQ ID NO: 67990 - RNA, 26 nt, Human
cugccucuuggguucaagugauucuc

SEQ ID NO: 67991 - RNA, 16 nt, Human
acuacuucccugccgg

SEQ ID NO: 67992 - RNA, 23 nt, Human
gcgugugugcgagugugugcaag

SEQ ID NO: 67993 - RNA, 26 nt, Human
agcauaaggauguuuugcaacuuucc

SEQ ID NO: 67994 - RNA, 20 nt, Human
ugccuggaacgugaauugga

SEQ ID NO: 67995 - RNA, 27 nt, Human
accagccugggcaacauagcaaaaccc

SEQ ID NO: 67996 - RNA, 22 nt, Human
gacagccccuuccuccuccucc

SEQ ID NO: 67997 - RNA, 22 nt, Human
aaaucaugcaugaucugaaagg

SEQ ID NO: 67998 - RNA, 22 nt, Human
uugcugaaucacuaaaugacca

SEQ ID NO: 67999 - RNA, 21 nt, Human
aucauacucacgggaggaauc

SEQ ID NO: 68000 - RNA, 20 nt, Human
augacugccuccagugacac

SEQ ID NO: 68001 - RNA, 20 nt, Human
uuuuguugucuucuuugccu

SEQ ID NO: 68002 - RNA, 26 nt, Human
guucaguuuaaccacugauugccuug

SEQ ID NO: 68003 - RNA, 23 nt, Human
cuccuccuugccugcuuuucuuu

SEQ ID NO: 68004 - RNA, 20 nt, Human
caacaaagacaugcuuucca

SEQ ID NO: 68005 - RNA, 22 nt, Human
gcuaucuccuaacuuuggaccu

SEQ ID NO: 68006 - RNA, 24 nt, Human
ggucagguggaggguggggcgugg

SEQ ID NO: 68007 - RNA, 19 nt, Human
ggagaggccgaggagcagc

SEQ ID NO: 68008 - RNA, 27 nt, Human
ucacagccacaacuucagaaagcagcc

SEQ ID NO: 68009 - RNA, 21 nt, Human
cacacagaucuccuacuccau

SEQ ID NO: 68010 - RNA, 19 nt, Human
ggggcagcaggaggagugg

SEQ ID NO: 68011 - RNA, 27 nt, Human
cagucacaggggcagugucacccugga

SEQ ID NO: 68012 - RNA, 21 nt, Human
caguguuauccuggaacuguu

SEQ ID NO: 68013 - RNA, 23 nt, Human
uguugcucaggcuggaguacagu

SEQ ID NO: 68014 - RNA, 26 nt, Human
aaucuagauaucgacuuguuuuugca

SEQ ID NO: 68015 - RNA, 27 nt, Human
ccuagcaccuggcuaguuucuaacaug

SEQ ID NO: 68016 - RNA, 26 nt, Human
caggaggcagacuugcagagcuuguu

SEQ ID NO: 68017 - RNA, 24 nt, Human
ccuaaggacuucuuuaauuuugga

SEQ ID NO: 68018 - RNA, 30 nt, Human
ucuuagauguuuucuugcuguuccuugucu

SEQ ID NO: 68019 - RNA, 22 nt, Human
gacucugcaagccuugcugguc

SEQ ID NO: 68020 - RNA, 27 nt, Human
uguugcccaggcuggucgugaacuccu

SEQ ID NO: 68021 - RNA, 22 nt, Human
gcuuugggggagugggcgcagu

SEQ ID NO: 68022 - RNA, 22 nt, Human
cgccacggcacuccagccuggg

SEQ ID NO: 68023 - RNA, 21 nt, Human
cuccugccucagccucccaua

SEQ ID NO: 68024 - RNA, 23 nt, Human
ugacccucuuugaauuaagugga

SEQ ID NO: 68025 - RNA, 21 nt, Human
uucucucuugcccaaauaaua

SEQ ID NO: 68026 - RNA, 20 nt, Human
aaacuggucuucuucaagag

SEQ ID NO: 68027 - RNA, 21 nt, Human
uuuucagugaguaauuuugga

SEQ ID NO: 68028 - RNA, 27 nt, Human
gaugaauguaaaguuacacuguucaca

SEQ ID NO: 68029 - RNA, 20 nt, Human
acuggaccccaggucuggag

SEQ ID NO: 68030 - RNA, 23 nt, Human
ggccugaaugaucuccaugaaga

SEQ ID NO: 68031 - RNA, 25 nt, Human
ucucccagugggugaugcuuuugcu

SEQ ID NO: 68032 - RNA, 23 nt, Human
agagaaggagauguaaugacaga

SEQ ID NO: 68033 - RNA, 22 nt, Human
gaugugauucuaaaagcuuuua

SEQ ID NO: 68034 - RNA, 22 nt, Human
uuuugccucaugaacacuggcu

SEQ ID NO: 68035 - RNA, 23 nt, Human
gcuguucuggagcugcuguucca

SEQ ID NO: 68036 - RNA, 24 nt, Human
cggaaggcgcaagcugggcagcga

SEQ ID NO: 68037 - RNA, 23 nt, Human
aucaucugcacugcccacuucac

SEQ ID NO: 68038 - RNA, 25 nt, Human
auuauccuuguuacugcuuugccag

SEQ ID NO: 68039 - RNA, 21 nt, Human
ucccugcaggcccaaggcguu

SEQ ID NO: 68040 - RNA, 22 nt, Human
acuaccaauuucccauuuugga

SEQ ID NO: 68041 - RNA, 26 nt, Human
gggcagcaguugaggugggguagugc

SEQ ID NO: 68042 - RNA, 22 nt, Human
gccccagguguacgguuucucu

SEQ ID NO: 68043 - RNA, 18 nt, Human
cuucccuugucugcgcgg

SEQ ID NO: 68044 - RNA, 24 nt, Human
caguguguguuuaacauucacagc

SEQ ID NO: 68045 - RNA, 24 nt, Human
uagcagaucaucucagcaguaagc

SEQ ID NO: 68046 - RNA, 23 nt, Human
gccgcgcuucagccucccgcucc

SEQ ID NO: 68047 - RNA, 29 nt, Human
aacaucggggagaggagccuacugggugg

SEQ ID NO: 68048 - RNA, 22 nt, Human
gggaggggaaggaaugagcuaa

SEQ ID NO: 68049 - RNA, 23 nt, Human
gggccggccucacagagagcgcc

SEQ ID NO: 68050 - RNA, 22 nt, Human
gauuacaggcguacaccaccau

SEQ ID NO: 68051 - RNA, 20 nt, Human
aaaccagcucagcacugccu

SEQ ID NO: 68052 - RNA, 24 nt, Human
uggcaagaaugaaauggugucaua

SEQ ID NO: 68053 - RNA, 20 nt, Human
guuuucaggacaacacuuca

SEQ ID NO: 68054 - RNA, 22 nt, Human
cucacccaggcacugggcaagu

SEQ ID NO: 68055 - RNA, 24 nt, Human
gcagcagaggcggucuucaacauc

SEQ ID NO: 68056 - RNA, 22 nt, Human
ccuguguguucuguuaucucuu

SEQ ID NO: 68057 - RNA, 21 nt, Human
auggcccuuccuccuccacca

SEQ ID NO: 68058 - RNA, 23 nt, Human
acacauuugaaccucagguucau

SEQ ID NO: 68059 - RNA, 23 nt, Human
gcuggcucacccacaggugccau

SEQ ID NO: 68060 - RNA, 24 nt, Human
uguccuucuuaguuguccagguga

SEQ ID NO: 68061 - RNA, 23 nt, Human
uugggggcaguguuguggcccug

SEQ ID NO: 68062 - RNA, 25 nt, Human
gcucagggccaccugagacugucac

SEQ ID NO: 68063 - RNA, 24 nt, Human
agaaagggggaggccuguguucuu

SEQ ID NO: 68064 - RNA, 27 nt, Human
cuguauauauaaucuaccucugccucu

SEQ ID NO: 68065 - RNA, 19 nt, Human
gagaagcagaacgugguga

SEQ ID NO: 68066 - RNA, 20 nt, Human
accuccaggacugagacugg

SEQ ID NO: 68067 - RNA, 26 nt, Human
cuccaaugucucauuuugcaguaacu

SEQ ID NO: 68068 - RNA, 27 nt, Human
uggaugccagagacauccuuucugaau

SEQ ID NO: 68069 - RNA, 24 nt, Human
gcagccugagagucuagaggccuu

SEQ ID NO: 68070 - RNA, 20 nt, Human
aaugauacugguucauuuua

SEQ ID NO: 68071 - RNA, 23 nt, Human
ugcggccucugccuuggggaguu

SEQ ID NO: 68072 - RNA, 21 nt, Human
ggagagagggggaggacccug

SEQ ID NO: 68073 - RNA, 25 nt, Human
cuccugagcucuguaacugucacac

SEQ ID NO: 68074 - RNA, 22 nt, Human
cucagcuucacaaagucauuga

SEQ ID NO: 68075 - RNA, 20 nt, Human
acaugugaagaacuauagua

SEQ ID NO: 68076 - RNA, 27 nt, Human
aaccaaaacauuccguuuacauuuuag

SEQ ID NO: 68077 - RNA, 17 nt, Human
acucucuaaugcaccug

SEQ ID NO: 68078 - RNA, 21 nt, Human
uuuguaacccacugagaggac

SEQ ID NO: 68079 - RNA, 23 nt, Human
gcugggggagagaaacaugcugc

SEQ ID NO: 68080 - RNA, 28 nt, Human
aacuugaaugcacaacugucuuauuuua

SEQ ID NO: 68081 - RNA, 19 nt, Human
ucuucuuucuccuuuaagc

SEQ ID NO: 68082 - RNA, 23 nt, Human
ccuccagucccccacccugccga

SEQ ID NO: 68083 - RNA, 20 nt, Human
gaugucuucugccuguuaua

SEQ ID NO: 68084 - RNA, 22 nt, Human
aaaaagaguuuaggaauucuac

SEQ ID NO: 68085 - RNA, 24 nt, Human
gcccaugcuggagugcaauggcac

SEQ ID NO: 68086 - RNA, 25 nt, Human
ugcccugaaauuaauugcugcagca

SEQ ID NO: 68087 - RNA, 22 nt, Human
cccaggagcuacacugauacug

SEQ ID NO: 68088 - RNA, 27 nt, Human
ggauacuuucucucucuuucaugcagu

SEQ ID NO: 68089 - RNA, 17 nt, Human
aaacugccuucuuguca

SEQ ID NO: 68090 - RNA, 22 nt, Human
aaaugaauaugagaacaucuug

SEQ ID NO: 68091 - RNA, 22 nt, Human
uaguacaaacaaucucugugau

SEQ ID NO: 68092 - RNA, 23 nt, Human
ccauuuuccugagaucaaaaaga

SEQ ID NO: 68093 - RNA, 27 nt, Human
ugauggccacauaauaacuacugcaua

SEQ ID NO: 68094 - RNA, 22 nt, Human
uuucccacucuuccacugacuu

SEQ ID NO: 68095 - RNA, 27 nt, Human
gagaucuauauauguauaaauauguau

SEQ ID NO: 68096 - RNA, 21 nt, Human
gggaacaaagagaggagccag

SEQ ID NO: 68097 - RNA, 26 nt, Human
uucccaaggcacucauuuuuauuuug

SEQ ID NO: 68098 - RNA, 24 nt, Human
uuagaaauguaaacucucaggccc

SEQ ID NO: 68099 - RNA, 20 nt, Human
gacagugacccucuucccag

SEQ ID NO: 68100 - RNA, 25 nt, Human
cuauccuugcucaaaaugugggaua

SEQ ID NO: 68101 - RNA, 20 nt, Human
agcucaaagaagaaaaagaa

SEQ ID NO: 68102 - RNA, 26 nt, Human
ugguauucaccgugccugaucugcac

SEQ ID NO: 68103 - RNA, 31 nt, Human
ccuguccuccuaaaguggccccuguucccau

SEQ ID NO: 68104 - RNA, 27 nt, Human
ccuggugcaggaagcgacucacguuug

SEQ ID NO: 68105 - RNA, 21 nt, Human
caguugucauuuggaagucac

SEQ ID NO: 68106 - RNA, 22 nt, Human
aaacacacauacacaaaugcac

SEQ ID NO: 68107 - RNA, 20 nt, Human
uuggcugcugauuguugcca

SEQ ID NO: 68108 - RNA, 23 nt, Human
aggugggugaggaaauccagagu

SEQ ID NO: 68109 - RNA, 21 nt, Human
ggaggaagggggcguggcaag

SEQ ID NO: 68110 - RNA, 22 nt, Human
uggcugucgccuguaaugccag

SEQ ID NO: 68111 - RNA, 23 nt, Human
ugaacuuucagggcagucagggg

SEQ ID NO: 68112 - RNA, 24 nt, Human
uugaggugcuagguagaaaguuag

SEQ ID NO: 68113 - RNA, 27 nt, Human
uccuagaguggaaccaggaaggauucu

SEQ ID NO: 68114 - RNA, 21 nt, Human
auagggccugacuuccuacau

SEQ ID NO: 68115 - RNA, 27 nt, Human
auccugcuacccagagggugaaugggu

SEQ ID NO: 68116 - RNA, 22 nt, Human
uugaguauuuaaaaaauauaua

SEQ ID NO: 68117 - RNA, 19 nt, Human
aagcacucccuuccugcug

SEQ ID NO: 68118 - RNA, 23 nt, Human
uuuucuuuuucauuucuuuuguu

SEQ ID NO: 68119 - RNA, 21 nt, Human
agaggcagaggaaggcuaguc

SEQ ID NO: 68120 - RNA, 22 nt, Human
ucagccucccccacucuugccg

SEQ ID NO: 68121 - RNA, 22 nt, Human
gaacuccugaccucaggugauc

SEQ ID NO: 68122 - RNA, 22 nt, Human
aaacuccuaaccucaggugauc

SEQ ID NO: 68123 - RNA, 22 nt, Human
aaacuccugaccucagaugauc

SEQ ID NO: 68124 - RNA, 22 nt, Human
gcccugccgcaccagagcacag

SEQ ID NO: 68125 - RNA, 25 nt, Human
auucagucauaggcgaaucuguucu

SEQ ID NO: 68126 - RNA, 22 nt, Human
cugaggcacaagaaucauuuga

SEQ ID NO: 68127 - RNA, 21 nt, Human
ugagccaagaaacacugccug

SEQ ID NO: 68128 - RNA, 22 nt, Human
gcagugagccgcaucuucucca

SEQ ID NO: 68129 - RNA, 17 nt, Human
caccagcaccaccaaga

SEQ ID NO: 68130 - RNA, 22 nt, Human
gcccuguucugaugucagugcc

SEQ ID NO: 68131 - RNA, 19 nt, Human
ucccucuccccucucuacu

SEQ ID NO: 68132 - RNA, 28 nt, Human
aggaccugcccuacacacucagcauggu

SEQ ID NO: 68133 - RNA, 23 nt, Human
cacugugcccagccuaauugcag

SEQ ID NO: 68134 - RNA, 27 nt, Human
cuccagccugagacaucaggggagagc

SEQ ID NO: 68135 - RNA, 25 nt, Human
uuguagauauaacucguucaucuuc

SEQ ID NO: 68136 - RNA, 23 nt, Human
cuccguucccgguccuuucuccc

SEQ ID NO: 68137 - RNA, 27 nt, Human
ggcagccuggaaaguugugucuucugg

SEQ ID NO: 68138 - RNA, 24 nt, Human
acuguccccaccuccuguguuagu

SEQ ID NO: 68139 - RNA, 22 nt, Human
ugucacccagucuggagugcag

SEQ ID NO: 68140 - RNA, 22 nt, Human
guuggucucgaacuccugggcu

SEQ ID NO: 68141 - RNA, 23 nt, Human
cgaguagcugggauugcaggcgc

SEQ ID NO: 68142 - RNA, 18 nt, Human
cuuugcagagagcgcccu

SEQ ID NO: 68143 - RNA, 22 nt, Human
accauaaacucuguuugcuuau

SEQ ID NO: 68144 - RNA, 20 nt, Human
guuuccguaaaagcuggaau

SEQ ID NO: 68145 - RNA, 22 nt, Human
uccaggcccguggggcuggccc

SEQ ID NO: 68146 - RNA, 27 nt, Human
uuuucuuucuuuuuccuuggauuaaau

SEQ ID NO: 68147 - RNA, 25 nt, Human
ggcugcacgcggcggacugggcagg

SEQ ID NO: 68148 - RNA, 27 nt, Human
agcucuucccagaccuaagcugccuuc

SEQ ID NO: 68149 - RNA, 22 nt, Human
gggcgcugaagccgggcgggcg

SEQ ID NO: 68150 - RNA, 23 nt, Human
ggugcaugccaccaugccuggcu

SEQ ID NO: 68151 - RNA, 22 nt, Human
ggggaccucagccugcacccuc

SEQ ID NO: 68152 - RNA, 22 nt, Human
gggacuuuuuuacaauuuuuau

SEQ ID NO: 68153 - RNA, 23 nt, Human
acagagcauaagucuacugggug

SEQ ID NO: 68154 - RNA, 23 nt, Human
cgggcacugggcuuuucuucuga

SEQ ID NO: 68155 - RNA, 30 nt, Human
gcuuggauuuuucuaccaggaggcucaggg

SEQ ID NO: 68156 - RNA, 20 nt, Human
guguguuaaaaaacagcugu

SEQ ID NO: 68157 - RNA, 19 nt, Human
agguaggaaugaggcuaga

SEQ ID NO: 68158 - RNA, 21 nt, Human
ggcuaauuuuguauuuuucag

SEQ ID NO: 68159 - RNA, 23 nt, Human
gaggcuauagggucacuugccau

SEQ ID NO: 68160 - RNA, 22 nt, Human
cccagcacaaagcagauccuca

SEQ ID NO: 68161 - RNA, 19 nt, Human
cauugcuaaccccaaacag

SEQ ID NO: 68162 - RNA, 25 nt, Human
gauucauauauccgaacuacuguua

SEQ ID NO: 68163 - RNA, 22 nt, Human
accauucuuucaaggcuuuuca

SEQ ID NO: 68164 - RNA, 23 nt, Human
cugauacagagucucacucuguu

SEQ ID NO: 68165 - RNA, 23 nt, Human
uguuuuguuuuuguaauucuggc

SEQ ID NO: 68166 - RNA, 21 nt, Human
ccaggagcuagaaccagggag

SEQ ID NO: 68167 - RNA, 22 nt, Human
uuuaccgcccaggcuggagugc

SEQ ID NO: 68168 - RNA, 22 nt, Human
cgccucccugguucaagcaauu

SEQ ID NO: 68169 - RNA, 24 nt, Human
uauaucccaauuaauaaagagcuc

SEQ ID NO: 68170 - RNA, 27 nt, Human
gacgacggguagaaaagcaggaggagc

SEQ ID NO: 68171 - RNA, 17 nt, Human
ggggagccucacuguga

SEQ ID NO: 68172 - RNA, 27 nt, Human
ucuacuguuaaugacagauguucuguu

SEQ ID NO: 68173 - RNA, 23 nt, Human
aagauauugguacauuuuauagg

SEQ ID NO: 68174 - RNA, 21 nt, Human
accaugagacaaagcccaagc

SEQ ID NO: 68175 - RNA, 26 nt, Human
ucccuccucugcucccccgccagauc

SEQ ID NO: 68176 - RNA, 21 nt, Human
gccuucuguuucacagcugcc

SEQ ID NO: 68177 - RNA, 21 nt, Human
cuggagagccgaguugcagug

SEQ ID NO: 68178 - RNA, 22 nt, Human
ucucuuuauuuguuagcauuaa

SEQ ID NO: 68179 - RNA, 22 nt, Human
aggaggaagaagagggcugugg

SEQ ID NO: 68180 - RNA, 14 nt, Human
uccgccuccugggu

SEQ ID NO: 68181 - RNA, 25 nt, Human
guccuuugugaaauggaauucaugg

SEQ ID NO: 68182 - RNA, 19 nt, Human
acacuccugaaugccugag

SEQ ID NO: 68183 - RNA, 20 nt, Human
uuucugcccagcucgccagu

SEQ ID NO: 68184 - RNA, 26 nt, Human
ugcccaggcuggcgugcaguggugcg

SEQ ID NO: 68185 - RNA, 19 nt, Human
accaggcaaccucugccuu

SEQ ID NO: 68186 - RNA, 27 nt, Human
uucaguuauaugugcugaaauaauuac

SEQ ID NO: 68187 - RNA, 23 nt, Human
gaauggagcaagaaugagaggaa

SEQ ID NO: 68188 - RNA, 25 nt, Human
uccugcccuugcuccagccugacaa

SEQ ID NO: 68189 - RNA, 22 nt, Human
gccagccacuggcuggacaggg

SEQ ID NO: 68190 - RNA, 23 nt, Human
ggagggaagcauuuccugguagg

SEQ ID NO: 68191 - RNA, 19 nt, Human
aguccucugaguacaucug

SEQ ID NO: 68192 - RNA, 20 nt, Human
aaacccagggaaccucucug

SEQ ID NO: 68193 - RNA, 21 nt, Human
uccaucucaaguagccuagca

SEQ ID NO: 68194 - RNA, 26 nt, Human
guggcugcaagagaaaaggggcugga

SEQ ID NO: 68195 - RNA, 21 nt, Human
caagauugauguuuccuugag

SEQ ID NO: 68196 - RNA, 19 nt, Human
gggaguggaggguggagga

SEQ ID NO: 68197 - RNA, 19 nt, Human
uaaccuuuuuugcacagca

SEQ ID NO: 68198 - RNA, 22 nt, Human
cuuagccucccaaagugcuggg

SEQ ID NO: 68199 - RNA, 19 nt, Human
ggaggggcccugcccaugc

SEQ ID NO: 68200 - RNA, 21 nt, Human
gcauucagcaguuucugacaa

SEQ ID NO: 68201 - RNA, 22 nt, Human
uucuugagaggggucagucuag

SEQ ID NO: 68202 - RNA, 23 nt, Human
ccaaagucucccaggaagcugug

SEQ ID NO: 68203 - RNA, 22 nt, Human
ugagacaaaacaguacucacug

SEQ ID NO: 68204 - RNA, 27 nt, Human
cuugggcaacagagcaagacccugucu

SEQ ID NO: 68205 - RNA, 27 nt, Human
uuaagccugugaccuggcaaguguuuu

SEQ ID NO: 68206 - RNA, 27 nt, Human
ggccagccugggcccaguggacacagg

SEQ ID NO: 68207 - RNA, 20 nt, Human
acccaaaacgccauugccuu

SEQ ID NO: 68208 - RNA, 20 nt, Human
cagagccucagcuccuaccu

SEQ ID NO: 68209 - RNA, 19 nt, Human
cagcucugcacuggguaga

SEQ ID NO: 68210 - RNA, 26 nt, Human
ucuaaagaaaacaagcugaaccuacu

SEQ ID NO: 68211 - RNA, 22 nt, Human
caugucuguaauccuagcacug

SEQ ID NO: 68212 - RNA, 27 nt, Human
ggagcaggaguggagaaagggaaaggc

SEQ ID NO: 68213 - RNA, 23 nt, Human
ccacagacacacccacgacaccu

SEQ ID NO: 68214 - RNA, 24 nt, Human
ccccgaucuccccagcagcagcaa

SEQ ID NO: 68215 - RNA, 21 nt, Human
ggaucugcagaguucgggcga

SEQ ID NO: 68216 - RNA, 21 nt, Human
ccuccucggggucuguguccu

SEQ ID NO: 68217 - RNA, 23 nt, Human
gcccuccgccuccuggcccugcc

SEQ ID NO: 68218 - RNA, 21 nt, Human
cugcaacccagggcagggggc

SEQ ID NO: 68219 - RNA, 23 nt, Human
gcugcuuggauggguggauuugg

SEQ ID NO: 68220 - RNA, 26 nt, Human
ggggguaaggcaagagaggguggagg

SEQ ID NO: 68221 - RNA, 31 nt, Human
ucaauauucaacagcucaccaacuacagaaa

SEQ ID NO: 68222 - RNA, 20 nt, Human
gcuccaguaaaaucuugccu

SEQ ID NO: 68223 - RNA, 23 nt, Human
cccuaacccuuggcuccaggaga

SEQ ID NO: 68224 - RNA, 22 nt, Human
gugaccucccaaaccagccugc

SEQ ID NO: 68225 - RNA, 27 nt, Human
cacugcuuuccagccugggcaacauag

SEQ ID NO: 68226 - RNA, 22 nt, Human
agcacagcuguccacgucugug

SEQ ID NO: 68227 - RNA, 22 nt, Human
cugcccaggcuagagugcagug

SEQ ID NO: 68228 - RNA, 20 nt, Human
cccauuugucgacauggccc

SEQ ID NO: 68229 - RNA, 19 nt, Human
cuguggcugcagcugugcu

SEQ ID NO: 68230 - RNA, 27 nt, Human
gugaggcucuucacaucccauugggac

SEQ ID NO: 68231 - RNA, 22 nt, Human
aaccuucuccgagccucugcag

SEQ ID NO: 68232 - RNA, 23 nt, Human
caguccuucuuauucucuuccuc

SEQ ID NO: 68233 - RNA, 20 nt, Human
cacaugaaagaaaaaugggu

SEQ ID NO: 68234 - RNA, 21 nt, Human
uugguacuguguuuucacuca

SEQ ID NO: 68235 - RNA, 26 nt, Human
cccugucacucaggcuggagcacagu

SEQ ID NO: 68236 - RNA, 23 nt, Human
cucgcuggcccugcacuccgccu

SEQ ID NO: 68237 - RNA, 27 nt, Human
uagaucauaugacugccuuucuguaaa

SEQ ID NO: 68238 - RNA, 20 nt, Human
uuucugauuuuuauucucaa

SEQ ID NO: 68239 - RNA, 22 nt, Human
ccacugcauuccagccugggcg

SEQ ID NO: 68240 - RNA, 25 nt, Human
gcucuuugccagcugaaaguuccca

SEQ ID NO: 68241 - RNA, 22 nt, Human
augaagcccuauuacuuguuug

SEQ ID NO: 68242 - RNA, 21 nt, Human
gggccuggccaccucucuccu

SEQ ID NO: 68243 - RNA, 19 nt, Human
ucccaucucacucucugga

SEQ ID NO: 68244 - RNA, 21 nt, Human
ucaagccuuucaccuuccuca

SEQ ID NO: 68245 - RNA, 24 nt, Human
caggaagaaaaugaugcagcucug

SEQ ID NO: 68246 - RNA, 20 nt, Human
ccccacucccucuccaugcc

SEQ ID NO: 68247 - RNA, 22 nt, Human
aguaauuuuauaaaauccaccu

SEQ ID NO: 68248 - RNA, 27 nt, Human
gcugcccccuuccucaccuacuucgga

SEQ ID NO: 68249 - RNA, 26 nt, Human
ugcccagcccugacaccugcccuuug

SEQ ID NO: 68250 - RNA, 27 nt, Human
uccucaagaccuaaaaugucagacugg

SEQ ID NO: 68251 - RNA, 21 nt, Human
guggcuucucuuuacagcuuu

SEQ ID NO: 68252 - RNA, 22 nt, Human
aacaauugcuuucucucuggcc

SEQ ID NO: 68253 - RNA, 27 nt, Human
ggagggacagggucggccuguaccccg

SEQ ID NO: 68254 - RNA, 17 nt, Human
gcaaggccugcugcagu

SEQ ID NO: 68255 - RNA, 21 nt, Human
ucagggcuguuuauucggugg

SEQ ID NO: 68256 - RNA, 21 nt, Human
uuccaauguggaauccugggc

SEQ ID NO: 68257 - RNA, 23 nt, Human
auugcaccacugcacuccagccg

SEQ ID NO: 68258 - RNA, 25 nt, Human
cagcucuguagccugacaagaaaua

SEQ ID NO: 68259 - RNA, 22 nt, Human
uucucuagcugugaucuuacca

SEQ ID NO: 68260 - RNA, 26 nt, Human
uuccaaguccugaaguagaugguuga

SEQ ID NO: 68261 - RNA, 28 nt, Human
gccaucuucacuggaggguggggagcuc

SEQ ID NO: 68262 - RNA, 27 nt, Human
uggagagagagccauuggcuggaguug

SEQ ID NO: 68263 - RNA, 28 nt, Human
gcugcaagagcuucuuagcaguuccugg

SEQ ID NO: 68264 - RNA, 21 nt, Human
acuucugcucugcacaggacc

SEQ ID NO: 68265 - RNA, 21 nt, Human
ugugagccaccaugccaggcu

SEQ ID NO: 68266 - RNA, 27 nt, Human
uccucaccugccaaucuuugcaauuug

SEQ ID NO: 68267 - RNA, 24 nt, Human
cuccagcagacuccugcucucuau

SEQ ID NO: 68268 - RNA, 20 nt, Human
cagacucaggaagcuggggg

SEQ ID NO: 68269 - RNA, 20 nt, Human
cccgcaggaaggcuuauccu

SEQ ID NO: 68270 - RNA, 27 nt, Human
uugcccaggagcaagugaggccggaga

SEQ ID NO: 68271 - RNA, 21 nt, Human
cacucaccaccaugcccggcu

SEQ ID NO: 68272 - RNA, 24 nt, Human
gagcaguucccaaggacagucagc

SEQ ID NO: 68273 - RNA, 21 nt, Human
augauagacacugggguaggg

SEQ ID NO: 68274 - RNA, 26 nt, Human
cgacucggccucccaaagugcuggga

SEQ ID NO: 68275 - RNA, 22 nt, Human
gggggaaagaaaaugcauggca

SEQ ID NO: 68276 - RNA, 25 nt, Human
uuacccucccuuccucacauuguua

SEQ ID NO: 68277 - RNA, 21 nt, Human
ugaguguugcacuuuuauuua

SEQ ID NO: 68278 - RNA, 29 nt, Human
caggccggagacaaguugcagucccgggc

SEQ ID NO: 68279 - RNA, 27 nt, Human
aggccuccagccacuuauuuccaugga

SEQ ID NO: 68280 - RNA, 25 nt, Human
cacaggcacgaucuguuccuccugg

SEQ ID NO: 68281 - RNA, 22 nt, Human
caccacaugaaccucuguuuag

SEQ ID NO: 68282 - RNA, 27 nt, Human
uaacugcagaaaaaauauuguaguuug

SEQ ID NO: 68283 - RNA, 22 nt, Human
cuggguauuacagaaacagucu

SEQ ID NO: 68284 - RNA, 23 nt, Human
gggugugagggacacauacaucc

SEQ ID NO: 68285 - RNA, 21 nt, Human
aaacuauucauuuugcuucua

SEQ ID NO: 68286 - RNA, 22 nt, Human
caagaucacgccauugcacucc

SEQ ID NO: 68287 - RNA, 22 nt, Human
uacaauucuuuuuaaauuuuua

SEQ ID NO: 68288 - RNA, 20 nt, Human
uguccaaaccagcaaacuuc

SEQ ID NO: 68289 - RNA, 24 nt, Human
guccugagucuuggccugccuccc

SEQ ID NO: 68290 - RNA, 25 nt, Human
cauguaccaucaauaaaguacccug

SEQ ID NO: 68291 - RNA, 18 nt, Human
cugauucccaggcuucgc

SEQ ID NO: 68292 - RNA, 27 nt, Human
aguuauggcuucacauucauugcagug

SEQ ID NO: 68293 - RNA, 24 nt, Human
gauuacaucagcgucuccuuggga

SEQ ID NO: 68294 - RNA, 22 nt, Human
aaaugcacucagaauuacuuag

SEQ ID NO: 68295 - RNA, 26 nt, Human
acaacaaaagucagugucuucauuau

SEQ ID NO: 68296 - RNA, 20 nt, Human
aucguuuggcaggacacaga

SEQ ID NO: 68297 - RNA, 22 nt, Human
aaagugcuggaaccacaggccu

SEQ ID NO: 68298 - RNA, 24 nt, Human
gugaugauuuucagaaaguuguug

SEQ ID NO: 68299 - RNA, 18 nt, Human
cagguugcacaggagugg

SEQ ID NO: 68300 - RNA, 27 nt, Human
aaaggcuuggcucccgaaugucgcauu

SEQ ID NO: 68301 - RNA, 21 nt, Human
cgaggcuggggcucuguaaug

SEQ ID NO: 68302 - RNA, 22 nt, Human
gucccagguggcuuacagauga

SEQ ID NO: 68303 - RNA, 19 nt, Human
uagaagagucaacuguuca

SEQ ID NO: 68304 - RNA, 22 nt, Human
cgccaucacacuccagccuagg

SEQ ID NO: 68305 - RNA, 22 nt, Human
cgccugcacgcuucucaguguu

SEQ ID NO: 68306 - RNA, 23 nt, Human
uuccauuacagagaaaugcuucu

SEQ ID NO: 68307 - RNA, 18 nt, Human
gaagcagagggaggccuc

SEQ ID NO: 68308 - RNA, 27 nt, Human
ucugccuggccaccugccuggaccacc

SEQ ID NO: 68309 - RNA, 21 nt, Human
cccuccagagccucccuccgg

SEQ ID NO: 68310 - RNA, 27 nt, Human
gcaacugcucaaccucucgugacugcc

SEQ ID NO: 68311 - RNA, 22 nt, Human
ccauugcacuccacccugggcg

SEQ ID NO: 68312 - RNA, 27 nt, Human
gggagagaagagaaugcacaaacagag

SEQ ID NO: 68313 - RNA, 19 nt, Human
cuaggcuggagugcagugg

SEQ ID NO: 68314 - RNA, 24 nt, Human
ccuaaucauccugugaaagugguu

SEQ ID NO: 68315 - RNA, 25 nt, Human
aucaucuccaauggaaagcuuuuca

SEQ ID NO: 68316 - RNA, 21 nt, Human
cugcaagcuccgccucccggg

SEQ ID NO: 68317 - RNA, 21 nt, Human
ucccuuccuguucccuccugg

SEQ ID NO: 68318 - RNA, 21 nt, Human
cuugacaaaauaggaacagga

SEQ ID NO: 68319 - RNA, 21 nt, Human
agcucagucuaauaaaaaaga

SEQ ID NO: 68320 - RNA, 25 nt, Human
gcccggggccucccuucccaccugc

SEQ ID NO: 68321 - RNA, 25 nt, Human
acuggcagcugcuccaggggcugcc

SEQ ID NO: 68322 - RNA, 22 nt, Human
ggaaggcagaaggucuuggugg

SEQ ID NO: 68323 - RNA, 22 nt, Human
cucccuugccucucccccucca

SEQ ID NO: 68324 - RNA, 22 nt, Human
ucugucugauuccaggguguuu

SEQ ID NO: 68325 - RNA, 24 nt, Human
uccuccagggggccugcaggcccc

SEQ ID NO: 68326 - RNA, 23 nt, Human
aucaugccacugcacuccagccu

SEQ ID NO: 68327 - RNA, 25 nt, Human
uuucuuauaaaccaguaaucuugcu

SEQ ID NO: 68328 - RNA, 26 nt, Human
ccugcauugcugcccuggcuaugguc

SEQ ID NO: 68329 - RNA, 22 nt, Human
ucaugccaccgcacuucagccu

SEQ ID NO: 68330 - RNA, 21 nt, Human
cugugugaccuuaggcccgga

SEQ ID NO: 68331 - RNA, 25 nt, Human
ugauucacauuugaugaguuuuuaa

SEQ ID NO: 68332 - RNA, 22 nt, Human
agagccagagaugggaugugug

SEQ ID NO: 68333 - RNA, 26 nt, Human
agugugacccagaucaagugugagga

SEQ ID NO: 68334 - RNA, 18 nt, Human
gggguggggugagguuaa

SEQ ID NO: 68335 - RNA, 27 nt, Human
uuauggacugggcaaagcccacuauaa

SEQ ID NO: 68336 - RNA, 20 nt, Human
ggucaucugcugucauggau

SEQ ID NO: 68337 - RNA, 22 nt, Human
gaacaagguaggcagagguugc

SEQ ID NO: 68338 - RNA, 22 nt, Human
gcaugugcaauacuuucugugc

SEQ ID NO: 68339 - RNA, 27 nt, Human
ucuucaguuuucuuuucuugcacugau

SEQ ID NO: 68340 - RNA, 21 nt, Human
aagcacugguucucaaacuuu

SEQ ID NO: 68341 - RNA, 22 nt, Human
gcucaugccuguaauccuagca

SEQ ID NO: 68342 - RNA, 22 nt, Human
guucaugccuguaaucccagca

SEQ ID NO: 68343 - RNA, 22 nt, Human
cccaggcccagagggcuuccca

SEQ ID NO: 68344 - RNA, 22 nt, Human
cuccgauucuccugucgccgag

SEQ ID NO: 68345 - RNA, 20 nt, Human
gacggaguuuauagcucacu

SEQ ID NO: 68346 - RNA, 21 nt, Human
auuggacuuccuugguuugga

SEQ ID NO: 68347 - RNA, 20 nt, Human
auggagcauuuucacuucua

SEQ ID NO: 68348 - RNA, 21 nt, Human
ggccucgggaaagccgccacc

SEQ ID NO: 68349 - RNA, 22 nt, Human
cuuccaccacaaccccacgcgc

SEQ ID NO: 68350 - RNA, 22 nt, Human
gcaaaguguuuggugcgaggaa

SEQ ID NO: 68351 - RNA, 19 nt, Human
guucuagcuuggucucugu

SEQ ID NO: 68352 - RNA, 22 nt, Human
gcagaaaaacaggauuagaaac

SEQ ID NO: 68353 - RNA, 23 nt, Human
ugccuucagaguuaggagugaga

SEQ ID NO: 68354 - RNA, 27 nt, Human
augcucacugauguuuugcacuuuaaa

SEQ ID NO: 68355 - RNA, 22 nt, Human
cucaggcaccagccccuccuug

SEQ ID NO: 68356 - RNA, 21 nt, Human
guccaguucaaauaagaaaua

SEQ ID NO: 68357 - RNA, 20 nt, Human
ccgacaaaucugauuugcca

SEQ ID NO: 68358 - RNA, 21 nt, Human
cauggcaguaggaaacagcau

SEQ ID NO: 68359 - RNA, 16 nt, Human
acguuuccgcugcagu

SEQ ID NO: 68360 - RNA, 18 nt, Human
cccgcaucccucuguggu

SEQ ID NO: 68361 - RNA, 23 nt, Human
ugugaugcccccagacacuguca

SEQ ID NO: 68362 - RNA, 24 nt, Human
agaguucaugaagaggcccuccuc

SEQ ID NO: 68363 - RNA, 21 nt, Human
aagacuccagaaaugucccuu

SEQ ID NO: 68364 - RNA, 21 nt, Human
auagcucuuccccaccuccuc

SEQ ID NO: 68365 - RNA, 19 nt, Human
agcagcccuggggucacag

SEQ ID NO: 68366 - RNA, 21 nt, Human
cugcccaggcagaggagaaug

SEQ ID NO: 68367 - RNA, 25 nt, Human
agcauuuucauucuuccugcugaag

SEQ ID NO: 68368 - RNA, 20 nt, Human
augggaaagcugaucuauaa

SEQ ID NO: 68369 - RNA, 25 nt, Human
acagauaccaucauccugccuuugu

SEQ ID NO: 68370 - RNA, 26 nt, Human
cuugaaggacaguugcccuccaggag

SEQ ID NO: 68371 - RNA, 22 nt, Human
uguaacccaggcuggaaugcaa

SEQ ID NO: 68372 - RNA, 21 nt, Human
aacacuccuuucuauucucuc

SEQ ID NO: 68373 - RNA, 19 nt, Human
cgccucuccgagcucuugu

SEQ ID NO: 68374 - RNA, 22 nt, Human
uccuaguagcugggauugcagg

SEQ ID NO: 68375 - RNA, 22 nt, Human
uacuaccucagaaacugcagcu

SEQ ID NO: 68376 - RNA, 27 nt, Human
acuguaaccuccgccucccggauacuc

SEQ ID NO: 68377 - RNA, 24 nt, Human
gucacccaggaugcuggggcacuu

SEQ ID NO: 68378 - RNA, 24 nt, Human
gaccucaagugauccacccgccuc

SEQ ID NO: 68379 - RNA, 21 nt, Human
gggaggcggagguugcaauga

SEQ ID NO: 68380 - RNA, 21 nt, Human
gagaggcggagguugcaguga

SEQ ID NO: 68381 - RNA, 26 nt, Human
ugcgggagaggguuagagcuauagag

SEQ ID NO: 68382 - RNA, 24 nt, Human
cugcggcuuguacugccucuuguc

SEQ ID NO: 68383 - RNA, 22 nt, Human
ccaaagugcugggaugacaggu

SEQ ID NO: 68384 - RNA, 26 nt, Human
ccugagccuggcccagccucggcugc

SEQ ID NO: 68385 - RNA, 26 nt, Human
ccucucuuggcuugcaagauaacgcu

SEQ ID NO: 68386 - RNA, 22 nt, Human
ggccucccaaaguacugggauu

SEQ ID NO: 68387 - RNA, 25 nt, Human
caggagaugcaagccacuaacagag

SEQ ID NO: 68388 - RNA, 22 nt, Human
gacccagacguggaguggagug

SEQ ID NO: 68389 - RNA, 19 nt, Human
uccagugagcaguguugcg

SEQ ID NO: 68390 - RNA, 26 nt, Human
agcaaggcauagagacaacauagagc

SEQ ID NO: 68391 - RNA, 23 nt, Human
ucugggcaccacaaaauauacaa

SEQ ID NO: 68392 - RNA, 25 nt, Human
gacagucacugcauuugccugcuuc

SEQ ID NO: 68393 - RNA, 27 nt, Human
cccuguguguguuuuguggacagccgu

SEQ ID NO: 68394 - RNA, 25 nt, Human
ggggaguguucagggccagcccugg

SEQ ID NO: 68395 - RNA, 24 nt, Human
ucggcuucagaggccaggaggcag

SEQ ID NO: 68396 - RNA, 18 nt, Human
cacaucucauuuuuccgu

SEQ ID NO: 68397 - RNA, 22 nt, Human
cucugcuugcuaccaaaggaca

SEQ ID NO: 68398 - RNA, 23 nt, Human
uugacacagaauugugugcaaua

SEQ ID NO: 68399 - RNA, 25 nt, Human
ccccauuacuguaccucuggaguca

SEQ ID NO: 68400 - RNA, 20 nt, Human
aacuguuugccacugcugcc

SEQ ID NO: 68401 - RNA, 27 nt, Human
acugcaacuuccgccuccuguguucaa

SEQ ID NO: 68402 - RNA, 23 nt, Human
uggcuucagaauuaaaacuauga

SEQ ID NO: 68403 - RNA, 21 nt, Human
cucuggcccuucuugccuacu

SEQ ID NO: 68404 - RNA, 22 nt, Human
cuccaguuuccucagccucugc

SEQ ID NO: 68405 - RNA, 23 nt, Human
uuugaucucaaaacagcuugaca

SEQ ID NO: 68406 - RNA, 24 nt, Human
acauaggaaaagacacacauccac

SEQ ID NO: 68407 - RNA, 26 nt, Human
cccaaguagugugaacuaaaggcaug

SEQ ID NO: 68408 - RNA, 25 nt, Human
uuagaaauuugguuucaaguguaca

SEQ ID NO: 68409 - RNA, 27 nt, Human
ggcucacuguguucugcaugguuugga

SEQ ID NO: 68410 - RNA, 27 nt, Human
gcaguucaugacccaggauaucugaaa

SEQ ID NO: 68411 - RNA, 22 nt, Human
acaccagggccaggagcucuuc

SEQ ID NO: 68412 - RNA, 28 nt, Human
aaguuugcagggugcagcuuggaugugg

SEQ ID NO: 68413 - RNA, 22 nt, Human
uaaaggacugcagaccaaggag

SEQ ID NO: 68414 - RNA, 21 nt, Human
accucgguuuuuccacgugag

SEQ ID NO: 68415 - RNA, 28 nt, Human
aguuauacuguaaccucuuaaguuuuaa

SEQ ID NO: 68416 - RNA, 27 nt, Human
ccauuuacacuuuacaguuuuaccuca

SEQ ID NO: 68417 - RNA, 22 nt, Human
gguggccaccuuccacugugga

SEQ ID NO: 68418 - RNA, 23 nt, Human
ccauccagcggggcugccagaga

SEQ ID NO: 68419 - RNA, 26 nt, Human
cuugucgcccaggcuggagugcagug

SEQ ID NO: 68420 - RNA, 20 nt, Human
ggacuggcgauggcuucugc

SEQ ID NO: 68421 - RNA, 26 nt, Human
ggcucacaccuguaaucccaauacug

SEQ ID NO: 68422 - RNA, 20 nt, Human
ugcucauucugucaucacua

SEQ ID NO: 68423 - RNA, 22 nt, Human
gcgcccaggcugguaugcaguc

SEQ ID NO: 68424 - RNA, 19 nt, Human
auuaucugucagcugcaag

SEQ ID NO: 68425 - RNA, 24 nt, Human
ucuccaccccugcuccccugagcu

SEQ ID NO: 68426 - RNA, 21 nt, Human
ucuuuuuggggguagauuaga

SEQ ID NO: 68427 - RNA, 27 nt, Human
gggagugccgggcaggagcauggggug

SEQ ID NO: 68428 - RNA, 20 nt, Human
ugcuaugccaacuaguagaa

SEQ ID NO: 68429 - RNA, 22 nt, Human
uacacacuaccacauccuuucu

SEQ ID NO: 68430 - RNA, 17 nt, Human
cuucccuucaauagugg

SEQ ID NO: 68431 - RNA, 22 nt, Human
ugucugauuuucuccaucaucc

SEQ ID NO: 68432 - RNA, 22 nt, Human
gggaggcggagguuacagugag

SEQ ID NO: 68433 - RNA, 23 nt, Human
aggaacuucucaugguaaacuca

SEQ ID NO: 68434 - RNA, 20 nt, Human
ggaguguugcuguugcacca

SEQ ID NO: 68435 - RNA, 23 nt, Human
cagcucuuccccagcuccgccuc

SEQ ID NO: 68436 - RNA, 22 nt, Human
gcgugagccaccuugcccagcc

SEQ ID NO: 68437 - RNA, 24 nt, Human
cacacaguuuuauauauagauaga

SEQ ID NO: 68438 - RNA, 25 nt, Human
cccucauggcucuggcacaguguaa

SEQ ID NO: 68439 - RNA, 27 nt, Human
cucuaggggcuaggggggaguggggag

SEQ ID NO: 68440 - RNA, 25 nt, Human
agaaggcagagaggcaguucugaau

SEQ ID NO: 68441 - RNA, 27 nt, Human
cagccaggcagcugggauucaauuccc

SEQ ID NO: 68442 - RNA, 22 nt, Human
agggaaagaaaguugauuggaa

SEQ ID NO: 68443 - RNA, 32 nt, Human
cagccuuggugggggagccucuggaaugcaug

SEQ ID NO: 68444 - RNA, 21 nt, Human
acugacgaagaccugccugug

SEQ ID NO: 68445 - RNA, 22 nt, Human
caauuugaaucagaaagaaaua

SEQ ID NO: 68446 - RNA, 22 nt, Human
cuguggcuucccaagaacuggg

SEQ ID NO: 68447 - RNA, 18 nt, Human
acagaaaaggucagaaaa

SEQ ID NO: 68448 - RNA, 24 nt, Human
uagagcuuucuccuguucuggacc

SEQ ID NO: 68449 - RNA, 24 nt, Human
ggaggcggaggucugaguuucgag

SEQ ID NO: 68450 - RNA, 20 nt, Human
gucuuggcugucauaacuuu

SEQ ID NO: 68451 - RNA, 24 nt, Human
cccucugcuuuacucucauguggc

SEQ ID NO: 68452 - RNA, 23 nt, Human
agcccuggcaaaugaaucaaaga

SEQ ID NO: 68453 - RNA, 24 nt, Human
ccgguggcugcgccucccuccucc

SEQ ID NO: 68454 - RNA, 19 nt, Human
aaggcauuuugcugacuuu

SEQ ID NO: 68455 - RNA, 21 nt, Human
gaggggcgcagagaugagcac

SEQ ID NO: 68456 - RNA, 24 nt, Human
ucugccucuucuugcucacugugu

SEQ ID NO: 68457 - RNA, 20 nt, Human
acacauuucuauacuugcaa

SEQ ID NO: 68458 - RNA, 20 nt, Human
ucaggguucaggucuuccag

SEQ ID NO: 68459 - RNA, 26 nt, Human
ccacagcaaccagcaccaugcccaug

SEQ ID NO: 68460 - RNA, 27 nt, Human
gaucaacagcaaccucuucaugagcuu

SEQ ID NO: 68461 - RNA, 27 nt, Human
gaucagauaauuaugcuuuuaaacuga

SEQ ID NO: 68462 - RNA, 19 nt, Human
ugggauggauuucacagga

SEQ ID NO: 68463 - RNA, 22 nt, Human
agagcagccuggcuaacauggu

SEQ ID NO: 68464 - RNA, 22 nt, Human
agaccagccugcccaacauggc

SEQ ID NO: 68465 - RNA, 26 nt, Human
uggcucugucacccaggcuggagugc

SEQ ID NO: 68466 - RNA, 26 nt, Human
aggcccugucgccauugaggugccuc

SEQ ID NO: 68467 - RNA, 22 nt, Human
gcacagccaaucuccaggcucc

SEQ ID NO: 68468 - RNA, 20 nt, Human
cauguuuuucauuugauacu

SEQ ID NO: 68469 - RNA, 24 nt, Human
ccaggcagagcugggauugaagga

SEQ ID NO: 68470 - RNA, 22 nt, Human
aacaggaccugggaaugcacag

SEQ ID NO: 68471 - RNA, 21 nt, Human
ucuauguuccaaccuacuuuc

SEQ ID NO: 68472 - RNA, 24 nt, Human
uaaccagcucauaaaucuccuaaa

SEQ ID NO: 68473 - RNA, 23 nt, Human
gcugccuugccaugucuuguuca

SEQ ID NO: 68474 - RNA, 23 nt, Human
agagacgcagaagagaggaacag

SEQ ID NO: 68475 - RNA, 23 nt, Human
ggcaaagcuuuuagaaauacugc

SEQ ID NO: 68476 - RNA, 19 nt, Human
aauaccugcaaauaaugag

SEQ ID NO: 68477 - RNA, 27 nt, Human
cuguccgggcaucaacccucucuggcg

SEQ ID NO: 68478 - RNA, 23 nt, Human
agacuggagcuuucuguuccauu

SEQ ID NO: 68479 - RNA, 21 nt, Human
ggaagccaggugaggccaggc

SEQ ID NO: 68480 - RNA, 22 nt, Human
ggggaaguaauaaguugaaaaa

SEQ ID NO: 68481 - RNA, 23 nt, Human
gggagaaaguugagugucagggg

SEQ ID NO: 68482 - RNA, 26 nt, Human
ggagagaaaauggcggcggagccgaa

SEQ ID NO: 68483 - RNA, 25 nt, Human
ucugggcacuuuuaaaaauagagaa

SEQ ID NO: 68484 - RNA, 18 nt, Human
ggcugccugggccuguuc

SEQ ID NO: 68485 - RNA, 27 nt, Human
ugcauuucucguucuuuacugggucua

SEQ ID NO: 68486 - RNA, 22 nt, Human
cugagccucuauuuucuuucuu

SEQ ID NO: 68487 - RNA, 21 nt, Human
caagaaaauuuaagcugcaaa

SEQ ID NO: 68488 - RNA, 21 nt, Human
cccagcacuaugcugagcuua

SEQ ID NO: 68489 - RNA, 22 nt, Human
ccucacugcugccucaacuucc

SEQ ID NO: 68490 - RNA, 22 nt, Human
uuuagcccuucaccucucagcu

SEQ ID NO: 68491 - RNA, 21 nt, Human
acucuuccuuccuccuccucc

SEQ ID NO: 68492 - RNA, 19 nt, Human
cugccuggacuggucuggc

SEQ ID NO: 68493 - RNA, 23 nt, Human
aaaauugaaggacgguugccagu

SEQ ID NO: 68494 - RNA, 22 nt, Human
aaacucuuuggcucaagccauc

SEQ ID NO: 68495 - RNA, 17 nt, Human
ccaacuggaaagucaaa

SEQ ID NO: 68496 - RNA, 22 nt, Human
cuacucuucccaacucagucuu

SEQ ID NO: 68497 - RNA, 22 nt, Human
gcacccaggcggaucugcaagc

SEQ ID NO: 68498 - RNA, 20 nt, Human
uuuauggugugacugugucu

SEQ ID NO: 68499 - RNA, 21 nt, Human
gaguuguuuuaauaacuuauc

SEQ ID NO: 68500 - RNA, 24 nt, Human
aggcaggcggaucaccugaaguca

SEQ ID NO: 68501 - RNA, 22 nt, Human
cuggcuggagugcaauggugug

SEQ ID NO: 68502 - RNA, 25 nt, Human
uuucuuucuuuuuaagcucaguggc

SEQ ID NO: 68503 - RNA, 19 nt, Human
agccccgggauccgccucc

SEQ ID NO: 68504 - RNA, 22 nt, Human
uugagauuuugcagggacccgg

SEQ ID NO: 68505 - RNA, 22 nt, Human
uaacucuuucagacaacuugca

SEQ ID NO: 68506 - RNA, 22 nt, Human
uuuuaguauuauuuuucuauua

SEQ ID NO: 68507 - RNA, 21 nt, Human
augggggugugggcaggggaa

SEQ ID NO: 68508 - RNA, 26 nt, Human
uuacccaggcuggagugcaaugaugc

SEQ ID NO: 68509 - RNA, 21 nt, Human
gagggaggggauaagagaggu

SEQ ID NO: 68510 - RNA, 23 nt, Human
uggugacauucugacacugccca

SEQ ID NO: 68511 - RNA, 21 nt, Human
ugccuguuucucuuauccuuu

SEQ ID NO: 68512 - RNA, 21 nt, Human
aaguccgaagccaauguagcu

SEQ ID NO: 68513 - RNA, 24 nt, Human
gggcagcagggaagagggagcaag

SEQ ID NO: 68514 - RNA, 20 nt, Human
ugguccccuccagcuucaaa

SEQ ID NO: 68515 - RNA, 27 nt, Human
ucuauuucugcugaauuuucacaugaa

SEQ ID NO: 68516 - RNA, 22 nt, Human
gcgucccccacacccucccuca

SEQ ID NO: 68517 - RNA, 21 nt, Human
gggcuuuuguccuccuggguc

SEQ ID NO: 68518 - RNA, 21 nt, Human
aaaaaugauccucagugcaaa

SEQ ID NO: 68519 - RNA, 17 nt, Human
gacuaugucagucuaau

SEQ ID NO: 68520 - RNA, 24 nt, Human
aguucugcaaaccuccccuggacc

SEQ ID NO: 68521 - RNA, 22 nt, Human
guuuuuauaucugucauguaca

SEQ ID NO: 68522 - RNA, 20 nt, Human
ccagggcggcggcccccagg

SEQ ID NO: 68523 - RNA, 20 nt, Human
gcuauaaucucagcacuuug

SEQ ID NO: 68524 - RNA, 24 nt, Human
aucacaccguucuccccagaguca

SEQ ID NO: 68525 - RNA, 22 nt, Human
caguggggagagcaguggcagu

SEQ ID NO: 68526 - RNA, 23 nt, Human
uucagaagugagcuuugcugcua

SEQ ID NO: 68527 - RNA, 24 nt, Human
ugggaggggcaauccucaaaugcg

SEQ ID NO: 68528 - RNA, 21 nt, Human
cugagggcuuuguucaucugg

SEQ ID NO: 68529 - RNA, 22 nt, Human
acaggggcagucuccucaguau

SEQ ID NO: 68530 - RNA, 23 nt, Human
ccaggaggucugggguaccagug

SEQ ID NO: 68531 - RNA, 27 nt, Human
agccuccucucaccccauuccaggugg

SEQ ID NO: 68532 - RNA, 17 nt, Human
cugaagccugggccagg

SEQ ID NO: 68533 - RNA, 22 nt, Human
acugguacuuccuuucaguagg

SEQ ID NO: 68534 - RNA, 20 nt, Human
gauuuggaucaucucaggau

SEQ ID NO: 68535 - RNA, 25 nt, Human
aaaugagaggcaggggcuucccggg

SEQ ID NO: 68536 - RNA, 22 nt, Human
cugaguagcugagacuacaggu

SEQ ID NO: 68537 - RNA, 31 nt, Human
ggagcuagggacacagagggagacuauggac

SEQ ID NO: 68538 - RNA, 23 nt, Human
ccuucucuuucucgcauaacucc

SEQ ID NO: 68539 - RNA, 19 nt, Human
aagauuauuauacaaaaaa

SEQ ID NO: 68540 - RNA, 25 nt, Human
ucccaaaccucaggguugcccugcc

SEQ ID NO: 68541 - RNA, 26 nt, Human
accauccuggccccuccagacccugc

SEQ ID NO: 68542 - RNA, 22 nt, Human
ucccugcacaacaaaaacagug

SEQ ID NO: 68543 - RNA, 27 nt, Human
ucagaacuuugccauuugucuacagaa

SEQ ID NO: 68544 - RNA, 22 nt, Human
ugagaauagcaguuuugcucau

SEQ ID NO: 68545 - RNA, 22 nt, Human
gaacuccuggccucaagugauc

SEQ ID NO: 68546 - RNA, 23 nt, Human
ccgggcaggagguucucacuguu

SEQ ID NO: 68547 - RNA, 18 nt, Human
uuuaucucuuuuuuguaa

SEQ ID NO: 68548 - RNA, 20 nt, Human
gccaccaguccccaguuauc

SEQ ID NO: 68549 - RNA, 28 nt, Human
agaaggagggcccaggcacuuucuguuu

SEQ ID NO: 68550 - RNA, 23 nt, Human
uucagguuuuuagacuauugcuc

SEQ ID NO: 68551 - RNA, 24 nt, Human
ccguuccaggagcaggcaggcugg

SEQ ID NO: 68552 - RNA, 21 nt, Human
ccaccaggauuaaucucuaaa

SEQ ID NO: 68553 - RNA, 21 nt, Human
gcacagcccuuaugcgguuaa

SEQ ID NO: 68554 - RNA, 20 nt, Human
ugggcacaguggcucaugcc

SEQ ID NO: 68555 - RNA, 20 nt, Human
gaucuugcccuuccuaacua

SEQ ID NO: 68556 - RNA, 23 nt, Human
gggagagauggauggcgggaaag

SEQ ID NO: 68557 - RNA, 27 nt, Human
acaaaccuuaauguguguaugugaacu

SEQ ID NO: 68558 - RNA, 20 nt, Human
gaaaucuuauaagcuacuua

SEQ ID NO: 68559 - RNA, 27 nt, Human
agcucuauggauuauccacugcaaagu

SEQ ID NO: 68560 - RNA, 24 nt, Human
auuagaggacauuuagcgugauga

SEQ ID NO: 68561 - RNA, 21 nt, Human
ggccccuuggauuuaaaaaua

SEQ ID NO: 68562 - RNA, 23 nt, Human
cugucuguaagacaaaaaacaaa

SEQ ID NO: 68563 - RNA, 24 nt, Human
auuccuccucuuccucucaaaggc

SEQ ID NO: 68564 - RNA, 22 nt, Human
ggagaagaaaacauuuuuguca

SEQ ID NO: 68565 - RNA, 22 nt, Human
ccgcccuggcccuggucacugc

SEQ ID NO: 68566 - RNA, 19 nt, Human
ccaggacaauuagaaaaau

SEQ ID NO: 68567 - RNA, 27 nt, Human
ccggcucccagugucugcccagcccuc

SEQ ID NO: 68568 - RNA, 23 nt, Human
ugcaucuuguggauuacuccuua

SEQ ID NO: 68569 - RNA, 30 nt, Human
cagcagacguguuuaagccuucaacuugau

SEQ ID NO: 68570 - RNA, 27 nt, Human
gucaaccaggcuagaaugcagcggugc

SEQ ID NO: 68571 - RNA, 22 nt, Human
agaggauggggagacaggcagg

SEQ ID NO: 68572 - RNA, 23 nt, Human
cggguaggagcuaggugacccuc

SEQ ID NO: 68573 - RNA, 27 nt, Human
agaagcagcauccuccacuuguucagg

SEQ ID NO: 68574 - RNA, 18 nt, Human
ucugugucaccagcacag

SEQ ID NO: 68575 - RNA, 31 nt, Human
ugcuccacgucaggcacugugcuuugcaccg

SEQ ID NO: 68576 - RNA, 24 nt, Human
uuguaccucuuuugcuugccaaag

SEQ ID NO: 68577 - RNA, 21 nt, Human
ggcuucuccccacuguaacgc

SEQ ID NO: 68578 - RNA, 25 nt, Human
guccccagcccuaucaccucaucuc

SEQ ID NO: 68579 - RNA, 25 nt, Human
auugccauucccugccuggggcggg

SEQ ID NO: 68580 - RNA, 17 nt, Human
aaaguggaucucaggga

SEQ ID NO: 68581 - RNA, 20 nt, Human
gugcuuccagcaucacucca

SEQ ID NO: 68582 - RNA, 20 nt, Human
uguucuuacuuaaaaccaga

SEQ ID NO: 68583 - RNA, 20 nt, Human
uaguaacuaaagguuguaaa

SEQ ID NO: 68584 - RNA, 22 nt, Human
uccgcuccccucccccgcaucc

SEQ ID NO: 68585 - RNA, 23 nt, Human
acagaagcugguggcuguggaga

SEQ ID NO: 68586 - RNA, 27 nt, Human
cugcuuccccccuccuggggugcagug

SEQ ID NO: 68587 - RNA, 23 nt, Human
aagguaggcagagguugcaguga

SEQ ID NO: 68588 - RNA, 23 nt, Human
cugcuccuucccugccaccgcug

SEQ ID NO: 68589 - RNA, 21 nt, Human
gcuuggcuaugacucuaccuc

SEQ ID NO: 68590 - RNA, 22 nt, Human
cacccaggcuggacugcaauga

SEQ ID NO: 68591 - RNA, 23 nt, Human
ccuuaaaaauguuguggccaagc

SEQ ID NO: 68592 - RNA, 17 nt, Human
caggaguuuggaaguga

SEQ ID NO: 68593 - RNA, 27 nt, Human
ccugcagaacucuggagauggugccua

SEQ ID NO: 68594 - RNA, 23 nt, Human
ucuuugcugugggaccucagaca

SEQ ID NO: 68595 - RNA, 21 nt, Human
cggcugucuccuugaagguuc

SEQ ID NO: 68596 - RNA, 21 nt, Human
ucacauuucccacuugagguu

SEQ ID NO: 68597 - RNA, 21 nt, Human
aaggcauuggcaucugcuuuu

SEQ ID NO: 68598 - RNA, 20 nt, Human
gcuucaguucaugagacggg

SEQ ID NO: 68599 - RNA, 20 nt, Human
cauucaggacauaggcacag

SEQ ID NO: 68600 - RNA, 22 nt, Human
gccaauggugcugcaguggcca

SEQ ID NO: 68601 - RNA, 23 nt, Human
ugaugauggauugcaagugcaaa

SEQ ID NO: 68602 - RNA, 22 nt, Human
ucucccaucucucuggauuucc

SEQ ID NO: 68603 - RNA, 21 nt, Human
cccauuauuuucacagugcca

SEQ ID NO: 68604 - RNA, 19 nt, Human
cuuccucugcuguagagcc

SEQ ID NO: 68605 - RNA, 22 nt, Human
cacaaccucucugaucuugugc

SEQ ID NO: 68606 - RNA, 22 nt, Human
aacacagccaguuauucuucca

SEQ ID NO: 68607 - RNA, 25 nt, Human
ucuccuccccuugaauauggguggc

SEQ ID NO: 68608 - RNA, 23 nt, Human
uucuuuuuuguaaaauguuugua

SEQ ID NO: 68609 - RNA, 24 nt, Human
agaucacugcagcuucuaggaccc

SEQ ID NO: 68610 - RNA, 26 nt, Human
agguauccuacccuggugaagcagcu

SEQ ID NO: 68611 - RNA, 26 nt, Human
cuguauguuugccuuggacaaaaagg

SEQ ID NO: 68612 - RNA, 22 nt, Human
accuaacucacuggacucagag

SEQ ID NO: 68613 - RNA, 28 nt, Human
ugaggggagacaaagggagccgagaccc

SEQ ID NO: 68614 - RNA, 26 nt, Human
gacaucuccgcagccacuccugggcc

SEQ ID NO: 68615 - RNA, 22 nt, Human
uuuccuggcuaguucauuucau

SEQ ID NO: 68616 - RNA, 23 nt, Human
gcccagccugcauacuugccacu

SEQ ID NO: 68617 - RNA, 22 nt, Human
ugucuccagguggccgcugguc

SEQ ID NO: 68618 - RNA, 24 nt, Human
cauguuuugacucauuugguaacc

SEQ ID NO: 68619 - RNA, 26 nt, Human
gggagcugaggggaggaucuuacuga

SEQ ID NO: 68620 - RNA, 20 nt, Human
gcuuucuucuaggggugggu

SEQ ID NO: 68621 - RNA, 27 nt, Human
aaccaaaacagcauaguacuggcacaa

SEQ ID NO: 68622 - RNA, 20 nt, Human
cuacccagacuagauguagu

SEQ ID NO: 68623 - RNA, 22 nt, Human
cccaaaacaguugccaaacuuu

SEQ ID NO: 68624 - RNA, 24 nt, Human
ucuugccccagucccuucucucca

SEQ ID NO: 68625 - RNA, 23 nt, Human
cucccucugcugcauuucaagcu

SEQ ID NO: 68626 - RNA, 21 nt, Human
cucacucagagacacauggua

SEQ ID NO: 68627 - RNA, 27 nt, Human
agagcaucggccccugucugcugcucg

SEQ ID NO: 68628 - RNA, 27 nt, Human
caguucugcuccucuccaggcacccuu

SEQ ID NO: 68629 - RNA, 26 nt, Human
aagauuucucuuuuauaccuuccuca

SEQ ID NO: 68630 - RNA, 21 nt, Human
gggccaguucuggugggcagc

SEQ ID NO: 68631 - RNA, 23 nt, Human
caaguugggggcccaggaggcgg

SEQ ID NO: 68632 - RNA, 21 nt, Human
aagauaaaaagacauucuucc

SEQ ID NO: 68633 - RNA, 25 nt, Human
uuuuaaaaugaaaugcauuuugcua

SEQ ID NO: 68634 - RNA, 22 nt, Human
ccaacaugguguaacgcugucu

SEQ ID NO: 68635 - RNA, 27 nt, Human
gcugugaucuccaccuugaagccaggc

SEQ ID NO: 68636 - RNA, 22 nt, Human
cacugccaggaagccccagcug

SEQ ID NO: 68637 - RNA, 22 nt, Human
ugugccaccuccagugagccuc

SEQ ID NO: 68638 - RNA, 22 nt, Human
aguagguuuggcuuugguugaa

SEQ ID NO: 68639 - RNA, 18 nt, Human
cucuacuguuacuaggcu

SEQ ID NO: 68640 - RNA, 27 nt, Human
uggagagaggucugggcaggauaggaa

SEQ ID NO: 68641 - RNA, 19 nt, Human
auccggcuuagcuuggggc

SEQ ID NO: 68642 - RNA, 18 nt, Human
aaauaaauaagccugguu

SEQ ID NO: 68643 - RNA, 26 nt, Human
ugccuuuccuucugaccuugcacugc

SEQ ID NO: 68644 - RNA, 24 nt, Human
cucuagacugggaaacuaagccug

SEQ ID NO: 68645 - RNA, 21 nt, Human
guccccauggauuggaaaugu

SEQ ID NO: 68646 - RNA, 24 nt, Human
ggggacacaccuguguccuccuca

SEQ ID NO: 68647 - RNA, 24 nt, Human
cuccacccucccaagugacaggcc

SEQ ID NO: 68648 - RNA, 22 nt, Human
cccuuuguaaccucagugcugg

SEQ ID NO: 68649 - RNA, 21 nt, Human
ggggaggccuccugacaccag

SEQ ID NO: 68650 - RNA, 22 nt, Human
ugccacugcacuccaaccuggg

SEQ ID NO: 68651 - RNA, 23 nt, Human
ugaaugcuauccuugcaaacuuc

SEQ ID NO: 68652 - RNA, 20 nt, Human
gugucuaauucccuguuaua

SEQ ID NO: 68653 - RNA, 25 nt, Human
cuucccacucuucucaucuugacag

SEQ ID NO: 68654 - RNA, 27 nt, Human
ggucucgaugcugcuggccucccuccg

SEQ ID NO: 68655 - RNA, 21 nt, Human
gcuuccucaguuuccuacugc

SEQ ID NO: 68656 - RNA, 31 nt, Human
ucugccugccugugucugcugagauucugca

SEQ ID NO: 68657 - RNA, 19 nt, Human
uaaaccaacaacuuauaau

SEQ ID NO: 68658 - RNA, 26 nt, Human
cuggggcauuccaggcagagaaggag

SEQ ID NO: 68659 - RNA, 26 nt, Human
cccaagaaaaccuguuuuuaacaugu

SEQ ID NO: 68660 - RNA, 24 nt, Human
gaacaaauuauuaauauuggauga

SEQ ID NO: 68661 - RNA, 22 nt, Human
ugagggacuuggagggagcugg

SEQ ID NO: 68662 - RNA, 23 nt, Human
cuguucucuucuugaacacucau

SEQ ID NO: 68663 - RNA, 22 nt, Human
agaccagccuggacaacauggu

SEQ ID NO: 68664 - RNA, 19 nt, Human
aucacagaauugugccagu

SEQ ID NO: 68665 - RNA, 27 nt, Human
cuuugcucuccccggguagugaugaac

SEQ ID NO: 68666 - RNA, 22 nt, Human
cucugcugcuucuuuccagaaa

SEQ ID NO: 68667 - RNA, 27 nt, Human
ccugccugcugucccccagucugccug

SEQ ID NO: 68668 - RNA, 23 nt, Human
aguccuuaacuuacucagcuuaa

SEQ ID NO: 68669 - RNA, 22 nt, Human
uauuuuucuccacugcuuggau

SEQ ID NO: 68670 - RNA, 16 nt, Human
ugccucuuccuagcca

SEQ ID NO: 68671 - RNA, 27 nt, Human
uuuucauuuucuuagcagugucucuca

SEQ ID NO: 68672 - RNA, 20 nt, Human
aggggagggggcaguugggc

SEQ ID NO: 68673 - RNA, 23 nt, Human
agaccaaaagcaacauucguucu

SEQ ID NO: 68674 - RNA, 24 nt, Human
aacgcuguugaaccuugugccucu

SEQ ID NO: 68675 - RNA, 19 nt, Human
aaacagcacaacccccuca

SEQ ID NO: 68676 - RNA, 20 nt, Human
gccucuccccugauuacacc

SEQ ID NO: 68677 - RNA, 21 nt, Human
cucugcguggcgcaggugcca

SEQ ID NO: 68678 - RNA, 22 nt, Human
augcauuacaccuguaguguaa

SEQ ID NO: 68679 - RNA, 24 nt, Human
uuuauugaucaguuucuguuggga

SEQ ID NO: 68680 - RNA, 21 nt, Human
gggauuugugccuggcagcug

SEQ ID NO: 68681 - RNA, 21 nt, Human
gcaggagagacacccaggagg

SEQ ID NO: 68682 - RNA, 23 nt, Human
cccaggaggcgaagauugcagug

SEQ ID NO: 68683 - RNA, 19 nt, Human
gccaucugacaaaaugaca

SEQ ID NO: 68684 - RNA, 22 nt, Human
ccgagaucacgucacugcacuc

SEQ ID NO: 68685 - RNA, 24 nt, Human
aggccuggccgugaccucuucugc

SEQ ID NO: 68686 - RNA, 22 nt, Human
ccaucuccagccugauccucug

SEQ ID NO: 68687 - RNA, 27 nt, Human
gaucugccuggccagcagugagccuga

SEQ ID NO: 68688 - RNA, 20 nt, Human
auguuuucccaccagccugu

SEQ ID NO: 68689 - RNA, 21 nt, Human
guggauuuauuuucacuguua

SEQ ID NO: 68690 - RNA, 29 nt, Human
agacccuuacuaggaagaacguuuuuucc

SEQ ID NO: 68691 - RNA, 27 nt, Human
guuggaggggcuaaggaggagugcaga

SEQ ID NO: 68692 - RNA, 22 nt, Human
uggagcuuucugauuucuugga

SEQ ID NO: 68693 - RNA, 21 nt, Human
gauccuggggaaggaggggaa

SEQ ID NO: 68694 - RNA, 19 nt, Human
cuaaucaauccauuuaugu

SEQ ID NO: 68695 - RNA, 21 nt, Human
cucuugaaacugccagugccu

SEQ ID NO: 68696 - RNA, 23 nt, Human
cugccucuguggcucugccugug

SEQ ID NO: 68697 - RNA, 21 nt, Human
ggcgccaccauccugcagccu

SEQ ID NO: 68698 - RNA, 27 nt, Human
ggucacaugcuuuguuuccauucuugu

SEQ ID NO: 68699 - RNA, 19 nt, Human
ucaagccauuccaaaguuc

SEQ ID NO: 68700 - RNA, 28 nt, Human
uguuacgaugcugaucaucauugagcuu

SEQ ID NO: 68701 - RNA, 23 nt, Human
cugccucucccugggucugggga

SEQ ID NO: 68702 - RNA, 22 nt, Human
ucgccacugccaccugccuccc

SEQ ID NO: 68703 - RNA, 23 nt, Human
uuuuauuugucaucuagucucaa

SEQ ID NO: 68704 - RNA, 26 nt, Human
accggcaugacuuuauauuguauaca

SEQ ID NO: 68705 - RNA, 23 nt, Human
augaauauggaaaggccagaggc

SEQ ID NO: 68706 - RNA, 22 nt, Human
ugagaauucacauuucccacug

SEQ ID NO: 68707 - RNA, 20 nt, Human
gagccuugcauguacuugaa

SEQ ID NO: 68708 - RNA, 21 nt, Human
gggcuggugugcaguggugcg

SEQ ID NO: 68709 - RNA, 21 nt, Human
cggauacuccugccucagccu

SEQ ID NO: 68710 - RNA, 22 nt, Human
gcucccguacugucuguguccu

SEQ ID NO: 68711 - RNA, 22 nt, Human
agacaauggacccuuuuuguua

SEQ ID NO: 68712 - RNA, 22 nt, Human
gcugguggcugcagccucagag

SEQ ID NO: 68713 - RNA, 22 nt, Human
agcaaccucucugccuccagaa

SEQ ID NO: 68714 - RNA, 23 nt, Human
guaacauccugauuuacagcuuc

SEQ ID NO: 68715 - RNA, 20 nt, Human
ugaggcagaaggaaggguaa

SEQ ID NO: 68716 - RNA, 26 nt, Human
ugcucuggacacuugcucaugcccug

SEQ ID NO: 68717 - RNA, 22 nt, Human
augaucucagcucacugcaacc

SEQ ID NO: 68718 - RNA, 19 nt, Human
uucaugguuuucauucaua

SEQ ID NO: 68719 - RNA, 18 nt, Human
aacugauuugcacagcug

SEQ ID NO: 68720 - RNA, 25 nt, Human
caagccccaaccggauccuggacag

SEQ ID NO: 68721 - RNA, 27 nt, Human
ggugucgaucuccugaccucgugaucc

SEQ ID NO: 68722 - RNA, 22 nt, Human
ggcucacugcaagcucugccuc

SEQ ID NO: 68723 - RNA, 20 nt, Human
uauugccuuuguagugcuuu

SEQ ID NO: 68724 - RNA, 20 nt, Human
ugcaacuuugagaacaaaac

SEQ ID NO: 68725 - RNA, 22 nt, Human
aguggacugcagcccugggggu

SEQ ID NO: 68726 - RNA, 26 nt, Human
uacuacuguaggcaguuuccuccuca

SEQ ID NO: 68727 - RNA, 21 nt, Human
uuagacauuucagacacuccu

SEQ ID NO: 68728 - RNA, 20 nt, Human
ucauucuuuucaugagcccg

SEQ ID NO: 68729 - RNA, 21 nt, Human
ugcaguauuauaaguuaucau

SEQ ID NO: 68730 - RNA, 21 nt, Human
guugcccaggugggucucaaa

SEQ ID NO: 68731 - RNA, 22 nt, Human
ggcgggcgcccccagggccagg

SEQ ID NO: 68732 - RNA, 20 nt, Human
ugucaggaagaaaucacaga

SEQ ID NO: 68733 - RNA, 28 nt, Human
ggggcuuccugaggacagagacugcucu

SEQ ID NO: 68734 - RNA, 26 nt, Human
cccuccaggcuguuggcaggcggugg

SEQ ID NO: 68735 - RNA, 22 nt, Human
uucaguucccuccuuuucuugc

SEQ ID NO: 68736 - RNA, 21 nt, Human
cccguaggagaaaauggggga

SEQ ID NO: 68737 - RNA, 20 nt, Human
auauuacuuuaucacuuuuu

SEQ ID NO: 68738 - RNA, 24 nt, Human
auagagcaaaauaucaaauccagg

SEQ ID NO: 68739 - RNA, 26 nt, Human
ggguuucuggcaccuaccuaccugcu

SEQ ID NO: 68740 - RNA, 30 nt, Human
cagaaguaggcauggaaaagacuucuuuuc

SEQ ID NO: 68741 - RNA, 24 nt, Human
auguaaggauuuaaacuugcugaa

SEQ ID NO: 68742 - RNA, 21 nt, Human
ccuucggccccaaggcugucg

SEQ ID NO: 68743 - RNA, 21 nt, Human
uuaccacauuacucugccucu

SEQ ID NO: 68744 - RNA, 23 nt, Human
aggcugagauuucuacagcaaua

SEQ ID NO: 68745 - RNA, 23 nt, Human
caauaagagcaaaacuccaucaa

SEQ ID NO: 68746 - RNA, 19 nt, Human
uacauagccuuacacuucu

SEQ ID NO: 68747 - RNA, 22 nt, Human
uaguuauacauuuuggugacuu

SEQ ID NO: 68748 - RNA, 17 nt, Human
uggggggaaaugccuua

SEQ ID NO: 68749 - RNA, 19 nt, Human
gaacacuucagccugugca

SEQ ID NO: 68750 - RNA, 23 nt, Human
uuugcccaggcuggagugcagug

SEQ ID NO: 68751 - RNA, 25 nt, Human
ugcauuuccauuucucuccuuaacc

SEQ ID NO: 68752 - RNA, 24 nt, Human
cagucccacagccuuccuccccca

SEQ ID NO: 68753 - RNA, 20 nt, Human
uguuucucccccugccaguc

SEQ ID NO: 68754 - RNA, 27 nt, Human
cuuaccucagguuucuuuagugugcuu

SEQ ID NO: 68755 - RNA, 23 nt, Human
ccagugcuuguuccucucaucuc

SEQ ID NO: 68756 - RNA, 25 nt, Human
guuuggucagacucccgacacccac

SEQ ID NO: 68757 - RNA, 19 nt, Human
ggcguggccacuuccuccu

SEQ ID NO: 68758 - RNA, 24 nt, Human
uagggacuguuguaauuucucaua

SEQ ID NO: 68759 - RNA, 25 nt, Human
caucccuggcuguggauagugcuuu

SEQ ID NO: 68760 - RNA, 28 nt, Human
gggagcagcagaccgggaagcaccguga

SEQ ID NO: 68761 - RNA, 19 nt, Human
gcaguuuccuuauagcuca

SEQ ID NO: 68762 - RNA, 24 nt, Human
cuuggagcuugcaggucccuuucu

SEQ ID NO: 68763 - RNA, 26 nt, Human
ccuguggcugucuuauuuuaaauagc

SEQ ID NO: 68764 - RNA, 24 nt, Human
cuaaguugcuguccagccucagug

SEQ ID NO: 68765 - RNA, 27 nt, Human
ucuucucccuucucccuccaucaucga

SEQ ID NO: 68766 - RNA, 23 nt, Human
gccaugauagccacuggcagcuu

SEQ ID NO: 68767 - RNA, 29 nt, Human
ccuacgcucacuguucccugaucauucca

SEQ ID NO: 68768 - RNA, 21 nt, Human
uugcccaagcuggagugcaau

SEQ ID NO: 68769 - RNA, 22 nt, Human
augaggguuugugcuaccagag

SEQ ID NO: 68770 - RNA, 27 nt, Human
uucugcacuugcgguuccggcauggac

SEQ ID NO: 68771 - RNA, 22 nt, Human
ccaccuguagucccagcacuuu

SEQ ID NO: 68772 - RNA, 20 nt, Human
uuuauuauccugcaccaccu

SEQ ID NO: 68773 - RNA, 20 nt, Human
auacauuucagaaucuaaga

SEQ ID NO: 68774 - RNA, 20 nt, Human
uuggaagucccaugaccucu

SEQ ID NO: 68775 - RNA, 29 nt, Human
uagaggaagacgagacaggacgaggcaga

SEQ ID NO: 68776 - RNA, 20 nt, Human
uauccacaaagcaaugucuc

SEQ ID NO: 68777 - RNA, 21 nt, Human
auuguaauccuagcacuuugg

SEQ ID NO: 68778 - RNA, 23 nt, Human
acugcugucugcccucucugguc

SEQ ID NO: 68779 - RNA, 22 nt, Human
uguaaggaggaagugaaugaaa

SEQ ID NO: 68780 - RNA, 22 nt, Human
gugcagcugcugcgccugugcu

SEQ ID NO: 68781 - RNA, 22 nt, Human
aggagucaguggggaacuccac

SEQ ID NO: 68782 - RNA, 21 nt, Human
agggugagcagagggcacugg

SEQ ID NO: 68783 - RNA, 22 nt, Human
cccaaggacccgauuccugggc

SEQ ID NO: 68784 - RNA, 24 nt, Human
ugccaggagcugaacauuaauaug

SEQ ID NO: 68785 - RNA, 26 nt, Human
gccugggccucggucccuccugcacc

SEQ ID NO: 68786 - RNA, 24 nt, Human
ugccugauaccucucagcauuuga

SEQ ID NO: 68787 - RNA, 22 nt, Human
aucucuucucuuuccacuuugg

SEQ ID NO: 68788 - RNA, 26 nt, Human
gcauuauacuccauaccugcuuuucc

SEQ ID NO: 68789 - RNA, 21 nt, Human
ucaugccaccccacagcucca

SEQ ID NO: 68790 - RNA, 20 nt, Human
ggagguggggcgaggcagcc

SEQ ID NO: 68791 - RNA, 23 nt, Human
ucguauucuauucaaaaggaaau

SEQ ID NO: 68792 - RNA, 25 nt, Human
aaauguuccauuauucagcuggcug

SEQ ID NO: 68793 - RNA, 26 nt, Human
ccccgaaaccugggcuggagugaggu

SEQ ID NO: 68794 - RNA, 26 nt, Human
gugaacaaauagaccgucugguguca

SEQ ID NO: 68795 - RNA, 26 nt, Human
gggcugaggccaggggagacaucaca

SEQ ID NO: 68796 - RNA, 26 nt, Human
gugagacaagcaauuucucccuucug

SEQ ID NO: 68797 - RNA, 21 nt, Human
gcugggcagaggggaagggug

SEQ ID NO: 68798 - RNA, 21 nt, Human
guagaagauaucacugcagcc

SEQ ID NO: 68799 - RNA, 27 nt, Human
uggucucaaaucgauuugccucccuuu

SEQ ID NO: 68800 - RNA, 21 nt, Human
gaaaagacacaggacugugaa

SEQ ID NO: 68801 - RNA, 26 nt, Human
ccucugaugaacucacacaugccuca

SEQ ID NO: 68802 - RNA, 19 nt, Human
gucucuccaacagcccgac

SEQ ID NO: 68803 - RNA, 18 nt, Human
gcccacacucugcaugcc

SEQ ID NO: 68804 - RNA, 20 nt, Human
ugcccaggauagauguaaua

SEQ ID NO: 68805 - RNA, 26 nt, Human
ugcugagaaaugggguggaauaggga

SEQ ID NO: 68806 - RNA, 22 nt, Human
ccgggaggcagagguugcagcc

SEQ ID NO: 68807 - RNA, 27 nt, Human
ccugugcgccccggcccccaucccucu

SEQ ID NO: 68808 - RNA, 22 nt, Human
cucaagugaucugccugccuca

SEQ ID NO: 68809 - RNA, 22 nt, Human
cucaggugaucuaccugccuca

SEQ ID NO: 68810 - RNA, 24 nt, Human
ugguugcugccauugcugcugccu

SEQ ID NO: 68811 - RNA, 21 nt, Human
aacagcaucuggucuacuaga

SEQ ID NO: 68812 - RNA, 21 nt, Human
uggccugccacugacccuguc

SEQ ID NO: 68813 - RNA, 26 nt, Human
cuacuuccuuuuucuuggcugcugcu

SEQ ID NO: 68814 - RNA, 27 nt, Human
uggagggaagcauuggaacuggaguug

SEQ ID NO: 68815 - RNA, 26 nt, Human
gcagugcuguccaauagaaagauaau

SEQ ID NO: 68816 - RNA, 20 nt, Human
ugcugauuuccccucuuccc

SEQ ID NO: 68817 - RNA, 25 nt, Human
uugcccaggucuggguauugcuccu

SEQ ID NO: 68818 - RNA, 20 nt, Human
acuaccuguuaucaguagug

SEQ ID NO: 68819 - RNA, 22 nt, Human
agguucccgaguagcugggacu

SEQ ID NO: 68820 - RNA, 24 nt, Human
ucagggucccugaacugcugcggg

SEQ ID NO: 68821 - RNA, 27 nt, Human
ccagcacugugucuugccuuucagauc

SEQ ID NO: 68822 - RNA, 21 nt, Human
gguaaauucucuauuuuuugu

SEQ ID NO: 68823 - RNA, 21 nt, Human
gugacuuaucuaccauugaag

SEQ ID NO: 68824 - RNA, 18 nt, Human
ucuuacauuccaauacau

SEQ ID NO: 68825 - RNA, 23 nt, Human
ugagagugaagaggaaccagcag

SEQ ID NO: 68826 - RNA, 22 nt, Human
agccuccucugucugcccuuca

SEQ ID NO: 68827 - RNA, 26 nt, Human
ucaaagcuacuaaaccacuguuaaug

SEQ ID NO: 68828 - RNA, 27 nt, Human
ugaccaacguggcgaaaccucgucucu

SEQ ID NO: 68829 - RNA, 21 nt, Human
guucacggugacacaggucag

SEQ ID NO: 68830 - RNA, 21 nt, Human
cagccaggaaaagcacaaaga

SEQ ID NO: 68831 - RNA, 20 nt, Human
augcuguaccuuucugacaa

SEQ ID NO: 68832 - RNA, 23 nt, Human
ucucaacugauuuacucacuuag

SEQ ID NO: 68833 - RNA, 24 nt, Human
gccuggacaaaugggagugacaug

SEQ ID NO: 68834 - RNA, 22 nt, Human
ugugacccaggguggggacagg

SEQ ID NO: 68835 - RNA, 26 nt, Human
cccagccuuugggccuccccagccag

SEQ ID NO: 68836 - RNA, 23 nt, Human
gcucagccccagcccagcccagc

SEQ ID NO: 68837 - RNA, 28 nt, Human
gcuaggcuacuguaacacuugccuguaa

SEQ ID NO: 68838 - RNA, 22 nt, Human
gauaaugcuggcuccaaacuuc

SEQ ID NO: 68839 - RNA, 23 nt, Human
gcucacgccuuguaaucccagca

SEQ ID NO: 68840 - RNA, 23 nt, Human
augcuggcagggagguggcagag

SEQ ID NO: 68841 - RNA, 22 nt, Human
gugugagccaccgcgccuggcc

SEQ ID NO: 68842 - RNA, 22 nt, Human
gcgugagccaccgcgcccggcc

SEQ ID NO: 68843 - RNA, 23 nt, Human
ugccucccuaaguugcugggauu

SEQ ID NO: 68844 - RNA, 23 nt, Human
acaguugggggaggcagagccag

SEQ ID NO: 68845 - RNA, 23 nt, Human
agcaggaggauugauugagccug

SEQ ID NO: 68846 - RNA, 27 nt, Human
caugugacccuaucuauccuucacugc

SEQ ID NO: 68847 - RNA, 27 nt, Human
ccauugcaacaaaauacauucuuuuug

SEQ ID NO: 68848 - RNA, 27 nt, Human
guggaaaccaggagguuaucaugguag

SEQ ID NO: 68849 - RNA, 22 nt, Human
gucagggcaugcuuuauuagug

SEQ ID NO: 68850 - RNA, 25 nt, Human
augugggaaaaaauauuacauuuua

SEQ ID NO: 68851 - RNA, 22 nt, Human
aacuguaaucccaguuauaggg

SEQ ID NO: 68852 - RNA, 23 nt, Human
cugcuauuuaaauaaagcucaua

SEQ ID NO: 68853 - RNA, 21 nt, Human
cugaccucugcugcaguggcc

SEQ ID NO: 68854 - RNA, 23 nt, Human
ucccaaguagcugagacugcagg

SEQ ID NO: 68855 - RNA, 20 nt, Human
gccccugcgcuccucgccag

SEQ ID NO: 68856 - RNA, 22 nt, Human
ccuguaaaucccagcacuuugg

SEQ ID NO: 68857 - RNA, 27 nt, Human
auugcuugagcuugggaagucgaggcu

SEQ ID NO: 68858 - RNA, 20 nt, Human
aguugucacugccuggcuuu

SEQ ID NO: 68859 - RNA, 23 nt, Human
cagcccagagccagagggcuggg

SEQ ID NO: 68860 - RNA, 21 nt, Human
cagaggcagagguugcaguga

SEQ ID NO: 68861 - RNA, 22 nt, Human
cuucucucaauguuuguaauaa

SEQ ID NO: 68862 - RNA, 26 nt, Human
gggguagcgagguugcaggagcuggc

SEQ ID NO: 68863 - RNA, 22 nt, Human
cuuuucucucuuuacccaccuc

SEQ ID NO: 68864 - RNA, 24 nt, Human
gacaaguguucggagggcagcaga

SEQ ID NO: 68865 - RNA, 27 nt, Human
uuuuacaaauuuccuuuuuuguccuca

SEQ ID NO: 68866 - RNA, 19 nt, Human
cauuguugaaaucaaugaa

SEQ ID NO: 68867 - RNA, 23 nt, Human
ugcuguuguguuagcucugagua

SEQ ID NO: 68868 - RNA, 27 nt, Human
aggacacagugggacaaaguuggguug

SEQ ID NO: 68869 - RNA, 32 nt, Human
aggauucuguucccugggcugaaacugaaaua

SEQ ID NO: 68870 - RNA, 20 nt, Human
guucccaggggccaggcugg

SEQ ID NO: 68871 - RNA, 21 nt, Human
ccaacauggcuagauccauca

SEQ ID NO: 68872 - RNA, 19 nt, Human
uucaaauuggcaguucuuu

SEQ ID NO: 68873 - RNA, 20 nt, Human
agaaaugaguuuuugccaug

SEQ ID NO: 68874 - RNA, 22 nt, Human
aucagccuuuuaccaucauguc

SEQ ID NO: 68875 - RNA, 19 nt, Human
auccuccugggccuuuuuc

SEQ ID NO: 68876 - RNA, 26 nt, Human
cacuaggcugcugaggaagaucaaua

SEQ ID NO: 68877 - RNA, 21 nt, Human
cgcacacccagacgcacacgc

SEQ ID NO: 68878 - RNA, 23 nt, Human
aucguacuucuuuaauugaucua

SEQ ID NO: 68879 - RNA, 25 nt, Human
gaccucaagcgauccacccaccucg

SEQ ID NO: 68880 - RNA, 22 nt, Human
ccaaaauggugaaaccuccucu

SEQ ID NO: 68881 - RNA, 21 nt, Human
augucucagaugaggagggag

SEQ ID NO: 68882 - RNA, 24 nt, Human
gauagacaaauaauuuucccaaug

SEQ ID NO: 68883 - RNA, 24 nt, Human
acuuccuauaauacaaauacacaa

SEQ ID NO: 68884 - RNA, 29 nt, Human
acagggugcagagaaggcaggucugggca

SEQ ID NO: 68885 - RNA, 24 nt, Human
agagacacuccccccuccauuccc

SEQ ID NO: 68886 - RNA, 21 nt, Human
cuguccugccucucugcucca

SEQ ID NO: 68887 - RNA, 27 nt, Human
accauugggcaggaaacuagacuucua

SEQ ID NO: 68888 - RNA, 18 nt, Human
ggggagagaugacugggg

SEQ ID NO: 68889 - RNA, 22 nt, Human
accgcucucccuuugcgcagcc

SEQ ID NO: 68890 - RNA, 22 nt, Human
uacugcacuccagcuuaggugg

SEQ ID NO: 68891 - RNA, 17 nt, Human
caacagcacugcucugu

SEQ ID NO: 68892 - RNA, 24 nt, Human
agguaccgucuacauuucacauua

SEQ ID NO: 68893 - RNA, 20 nt, Human
gaucgugcucguggccaggg

SEQ ID NO: 68894 - RNA, 21 nt, Human
ccuuugcuaugauuuguacuu

SEQ ID NO: 68895 - RNA, 21 nt, Human
gucauguugugggaucuuuag

SEQ ID NO: 68896 - RNA, 21 nt, Human
ccuuugucagaaugcaguuuc

SEQ ID NO: 68897 - RNA, 22 nt, Human
cuccccucggauuuggaguguc

SEQ ID NO: 68898 - RNA, 23 nt, Human
gagccagauuuucucugugcucu

SEQ ID NO: 68899 - RNA, 23 nt, Human
acuuaaauuaguugugcucugcu

SEQ ID NO: 68900 - RNA, 27 nt, Human
ccugccugcugccucagucugcaaccu

SEQ ID NO: 68901 - RNA, 23 nt, Human
ucccaccuacagacuaccaccuu

SEQ ID NO: 68902 - RNA, 21 nt, Human
uugcccaguaguuggaaagug

SEQ ID NO: 68903 - RNA, 20 nt, Human
aucgcccaggcuggagcugg

SEQ ID NO: 68904 - RNA, 23 nt, Human
ggcccugcugcccaaucuccauc

SEQ ID NO: 68905 - RNA, 22 nt, Human
auauuguaauccuagcacuuug

SEQ ID NO: 68906 - RNA, 21 nt, Human
uugcccaggcuggugucaaac

SEQ ID NO: 68907 - RNA, 26 nt, Human
gucuccucaggguggggggugacagu

SEQ ID NO: 68908 - RNA, 21 nt, Human
gaggcugggccaggaggcagc

SEQ ID NO: 68909 - RNA, 21 nt, Human
agaagcagcucaaacauuuug

SEQ ID NO: 68910 - RNA, 29 nt, Human
ucuccauccccucuccccgcguggacucc

SEQ ID NO: 68911 - RNA, 26 nt, Human
uuuggcuucugugcucuguaugcugc

SEQ ID NO: 68912 - RNA, 23 nt, Human
acucccacucugaacaucuggcc

SEQ ID NO: 68913 - RNA, 27 nt, Human
caggacaaugcaagcccaugagcuguu

SEQ ID NO: 68914 - RNA, 20 nt, Human
ggaggugagggcgggcgcca

SEQ ID NO: 68915 - RNA, 23 nt, Human
ccagcuguagugagguugcagug

SEQ ID NO: 68916 - RNA, 25 nt, Human
aacuaauuuuauuucuauuuuuugu

SEQ ID NO: 68917 - RNA, 27 nt, Human
gugugagugugacagggccaguggggc

SEQ ID NO: 68918 - RNA, 26 nt, Human
guuuauauacauuaacuaaaucagua

SEQ ID NO: 68919 - RNA, 27 nt, Human
gaggaagaguccggccugggagccguc

SEQ ID NO: 68920 - RNA, 19 nt, Human
aggcagacguggggagggu

SEQ ID NO: 68921 - RNA, 21 nt, Human
ugggaggcggagguugcagcg

SEQ ID NO: 68922 - RNA, 28 nt, Human
ggaaauggacugccucucuugagcacuu

SEQ ID NO: 68923 - RNA, 23 nt, Human
gcugcugcugccccagcgucuug

SEQ ID NO: 68924 - RNA, 24 nt, Human
gggcagcaggggguguguuugugg

SEQ ID NO: 68925 - RNA, 22 nt, Human
gcccuucccccucccauccguc

SEQ ID NO: 68926 - RNA, 22 nt, Human
cugaagcucaguuugcaaaccu

SEQ ID NO: 68927 - RNA, 27 nt, Human
gucacguuuuuuaggcuggacagcguc

SEQ ID NO: 68928 - RNA, 27 nt, Human
ccagaaacuuuaagaacaaacucugaa

SEQ ID NO: 68929 - RNA, 20 nt, Human
gcuagugcuggggaggaaca

SEQ ID NO: 68930 - RNA, 27 nt, Human
guccagcaacugaaccugccauuaccu

SEQ ID NO: 68931 - RNA, 26 nt, Human
cccacugagaggauggagguguccgc

SEQ ID NO: 68932 - RNA, 25 nt, Human
ugggagguggaggguuguacuguga

SEQ ID NO: 68933 - RNA, 26 nt, Human
cccaggaggucucugcagagcaagug

SEQ ID NO: 68934 - RNA, 20 nt, Human
ccaucucuaccaucauccgg

SEQ ID NO: 68935 - RNA, 31 nt, Human
ucaccaccaucugaucuaucuuguucucuuc

SEQ ID NO: 68936 - RNA, 18 nt, Human
uggccuuaacacuccuua

SEQ ID NO: 68937 - RNA, 26 nt, Human
cauuguacuccagcuugggcaacaga

SEQ ID NO: 68938 - RNA, 27 nt, Human
guggacucuggcgcacucuaguggaca

SEQ ID NO: 68939 - RNA, 22 nt, Human
gaucaugagacuugacugaggc

SEQ ID NO: 68940 - RNA, 20 nt, Human
cuagggcagacaugcaguga

SEQ ID NO: 68941 - RNA, 21 nt, Human
auugcccaggcuggaguacaa

SEQ ID NO: 68942 - RNA, 22 nt, Human
gaccccaggaggagaggcuugc

SEQ ID NO: 68943 - RNA, 27 nt, Human
ggaggcugagacaggaggauuccuuga

SEQ ID NO: 68944 - RNA, 27 nt, Human
gggccaccuggccuuucaguuacuuga

SEQ ID NO: 68945 - RNA, 26 nt, Human
gaaaguuggcuuugccaaaagacgca

SEQ ID NO: 68946 - RNA, 22 nt, Human
agaucagccugggcaacauggu

SEQ ID NO: 68947 - RNA, 24 nt, Human
gggcccccagccccuccccuggcu

SEQ ID NO: 68948 - RNA, 23 nt, Human
gucccugccucuggggcuuuucu

SEQ ID NO: 68949 - RNA, 21 nt, Human
accucuguggaccacagcgua

SEQ ID NO: 68950 - RNA, 22 nt, Human
ggccucccgcaggcaggcagag

SEQ ID NO: 68951 - RNA, 22 nt, Human
gaggucaggggaacgcucuccc

SEQ ID NO: 68952 - RNA, 21 nt, Human
ccacagaaaagagaagcucug

SEQ ID NO: 68953 - RNA, 30 nt, Human
gcacccucagccacaugaacaaucuccccu

SEQ ID NO: 68954 - RNA, 22 nt, Human
gagacggagucuugcucuguca

SEQ ID NO: 68955 - RNA, 32 nt, Human
cgggcaaagggucuuuugcagcuuuugcagac

SEQ ID NO: 68956 - RNA, 20 nt, Human
aaagaguuuauauacuucua

SEQ ID NO: 68957 - RNA, 21 nt, Human
aaagacuguuauuucaccauu

SEQ ID NO: 68958 - RNA, 22 nt, Human
cccuccuuccugucaugcuccc

SEQ ID NO: 68959 - RNA, 23 nt, Human
ucagcucucaaaaugucuucugu

SEQ ID NO: 68960 - RNA, 23 nt, Human
cuguugagcaggccucucugccu

SEQ ID NO: 68961 - RNA, 27 nt, Human
aaagcauuugaacaugacaccagaaca

SEQ ID NO: 68962 - RNA, 19 nt, Human
agcucccuucuguugaugc

SEQ ID NO: 68963 - RNA, 22 nt, Human
guaagucaggcugaacugcagu

SEQ ID NO: 68964 - RNA, 22 nt, Human
cagaugguggagggugcuggga

SEQ ID NO: 68965 - RNA, 23 nt, Human
ccggaguagcugggauuacaggc

SEQ ID NO: 68966 - RNA, 22 nt, Human
aggcuaggaaccucucugccac

SEQ ID NO: 68967 - RNA, 21 nt, Human
cccuaaccugacagagguguc

SEQ ID NO: 68968 - RNA, 22 nt, Human
ccuaccugcuccucacccacag

SEQ ID NO: 68969 - RNA, 20 nt, Human
acuggcuaccccuccuggcc

SEQ ID NO: 68970 - RNA, 22 nt, Human
cccuguuuacggccuaugagau

SEQ ID NO: 68971 - RNA, 21 nt, Human
ucauagacagugaucauucag

SEQ ID NO: 68972 - RNA, 24 nt, Human
ugcacaggcuggggaguccucagg

SEQ ID NO: 68973 - RNA, 22 nt, Human
augacagauguauuuuaaaagu

SEQ ID NO: 68974 - RNA, 27 nt, Human
gggcucccucuugugggauaaugggag

SEQ ID NO: 68975 - RNA, 19 nt, Human
agacccacccaccuugccu

SEQ ID NO: 68976 - RNA, 27 nt, Human
gggggauguacauauucucugaaacua

SEQ ID NO: 68977 - RNA, 22 nt, Human
cacugcacuccaaccugggcaa

SEQ ID NO: 68978 - RNA, 22 nt, Human
cacugcacuccagccugggcga

SEQ ID NO: 68979 - RNA, 22 nt, Human
augccguuccuggagcuggaca

SEQ ID NO: 68980 - RNA, 25 nt, Human
gccuggcacugggagguggggguga

SEQ ID NO: 68981 - RNA, 26 nt, Human
ccugccucucggacucgggcugcggc

SEQ ID NO: 68982 - RNA, 24 nt, Human
agagagaagucgaggaagagagag

SEQ ID NO: 68983 - RNA, 30 nt, Human
ccagcugcaccugccagccuggcuucugga

SEQ ID NO: 68984 - RNA, 26 nt, Human
cuccaggagucucaucagcaaaccgc

SEQ ID NO: 68985 - RNA, 22 nt, Human
guccuguuugcauuucacuggg

SEQ ID NO: 68986 - RNA, 23 nt, Human
gaagagaguucuuuauaaagccu

SEQ ID NO: 68987 - RNA, 22 nt, Human
ucuuuuucuuacccuacuucuc

SEQ ID NO: 68988 - RNA, 24 nt, Human
ggagcugggggugcagugggggac

SEQ ID NO: 68989 - RNA, 23 nt, Human
acccuuacuuugaauucaaagaa

SEQ ID NO: 68990 - RNA, 24 nt, Human
ucuguuggcagacuggagugcaau

SEQ ID NO: 68991 - RNA, 26 nt, Human
gcccagcugacacccuccacagccua

SEQ ID NO: 68992 - RNA, 22 nt, Human
gugagaugugaucuugccaaag

SEQ ID NO: 68993 - RNA, 26 nt, Human
uuccggccugugcuccugugcugcug

SEQ ID NO: 68994 - RNA, 22 nt, Human
accuggucccuucuaggugugg

SEQ ID NO: 68995 - RNA, 22 nt, Human
gucgaucucaucaccauaauaa

SEQ ID NO: 68996 - RNA, 24 nt, Human
ggucaucuggaacuguucauauaa

SEQ ID NO: 68997 - RNA, 23 nt, Human
gucccuccucuccggagcauuuu

SEQ ID NO: 68998 - RNA, 27 nt, Human
ccccaucugcugagcucugaccugccc

SEQ ID NO: 68999 - RNA, 21 nt, Human
agaaguuagggguagcggggg

SEQ ID NO: 69000 - RNA, 22 nt, Human
gcucacugugaagccagacucc

SEQ ID NO: 69001 - RNA, 21 nt, Human
gagagugaggagaguguguga

SEQ ID NO: 69002 - RNA, 24 nt, Human
acaggaccuggaaaacacucuugg

SEQ ID NO: 69003 - RNA, 18 nt, Human
auugccaaacauuaaugu

SEQ ID NO: 69004 - RNA, 23 nt, Human
cagagggugcgauugaaugagua

SEQ ID NO: 69005 - RNA, 20 nt, Human
gacaacaccguuagaugugu

SEQ ID NO: 69006 - RNA, 24 nt, Human
ccugaggccagcugcucuaauauc

SEQ ID NO: 69007 - RNA, 21 nt, Human
acugcauuccuuccccaauca

SEQ ID NO: 69008 - RNA, 23 nt, Human
ccauugucagcacagccuaggag

SEQ ID NO: 69009 - RNA, 22 nt, Human
gacggggcugugccggagcagc

SEQ ID NO: 69010 - RNA, 22 nt, Human
ugagaaaggagaaaaagauggg

SEQ ID NO: 69011 - RNA, 21 nt, Human
uuggauauuugaggccaugcu

SEQ ID NO: 69012 - RNA, 25 nt, Human
gguggcaggggcugcaggagcaagu

SEQ ID NO: 69013 - RNA, 26 nt, Human
auaccucuuucaggagacaacuugca

SEQ ID NO: 69014 - RNA, 20 nt, Human
gcucacugaaagcuccgccu

SEQ ID NO: 69015 - RNA, 22 nt, Human
cagacuucuuuacuacacugca

SEQ ID NO: 69016 - RNA, 25 nt, Human
gcccaaacuggagugcaguggcaca

SEQ ID NO: 69017 - RNA, 27 nt, Human
uccucaaggaacuugcaaaugugucua

SEQ ID NO: 69018 - RNA, 21 nt, Human
gauacucucccugacauuucu

SEQ ID NO: 69019 - RNA, 22 nt, Human
gccucuauuuuuccugucccca

SEQ ID NO: 69020 - RNA, 27 nt, Human
ggauaacuacauuaccuguucuugccu

SEQ ID NO: 69021 - RNA, 18 nt, Human
aaugugucuccugagaca

SEQ ID NO: 69022 - RNA, 20 nt, Human
ccugcccugcagcaugugcc

SEQ ID NO: 69023 - RNA, 32 nt, Human
uggggaugauguuuggggaacaagauacuuga

SEQ ID NO: 69024 - RNA, 22 nt, Human
ggcuuuggagauccgcacuuac

SEQ ID NO: 69025 - RNA, 27 nt, Human
cucugcucccacccuugccugccucua

SEQ ID NO: 69026 - RNA, 22 nt, Human
cagacugucaccccuaccaguu

SEQ ID NO: 69027 - RNA, 22 nt, Human
caaaccuguaaucccagcacuu

SEQ ID NO: 69028 - RNA, 22 nt, Human
ccaaaguucugggauuacaggc

SEQ ID NO: 69029 - RNA, 22 nt, Human
ccaaagugcugggaugacaggc

SEQ ID NO: 69030 - RNA, 27 nt, Human
cugccucucugcaaaguugagcacuac

SEQ ID NO: 69031 - RNA, 24 nt, Human
cacacuuguggcuuccgugcacac

SEQ ID NO: 69032 - RNA, 22 nt, Human
ccugggaccaagaggcagcagu

SEQ ID NO: 69033 - RNA, 27 nt, Human
ucuguugacuuuuaaaaaauuaugcuu

SEQ ID NO: 69034 - RNA, 27 nt, Human
ucugugauauuuucacacugguaaaug

SEQ ID NO: 69035 - RNA, 21 nt, Human
ggggagaaccucuagcacagg

SEQ ID NO: 69036 - RNA, 20 nt, Human
cccagcacuuugggagguca

SEQ ID NO: 69037 - RNA, 25 nt, Human
ccagggagacccccgaaccuuugug

SEQ ID NO: 69038 - RNA, 21 nt, Human
cccaagggagcacagguccca

SEQ ID NO: 69039 - RNA, 28 nt, Human
cgcugggggcucugggcuuguggccggu

SEQ ID NO: 69040 - RNA, 22 nt, Human
ccugccugaccacgugaacugu

SEQ ID NO: 69041 - RNA, 24 nt, Human
ccuccgcccagcucggccaagggc

SEQ ID NO: 69042 - RNA, 21 nt, Human
gugcuuccacacccgggcucu

SEQ ID NO: 69043 - RNA, 24 nt, Human
ugguucucaaacuuuuuggucuca

SEQ ID NO: 69044 - RNA, 22 nt, Human
caguucugcuugcucccaagcc

SEQ ID NO: 69045 - RNA, 23 nt, Human
ccauccaccaccaaaguagccgg

SEQ ID NO: 69046 - RNA, 20 nt, Human
cucugccaccaccaagucau

SEQ ID NO: 69047 - RNA, 26 nt, Human
aaggagccacgaagcaagcggccguc

SEQ ID NO: 69048 - RNA, 27 nt, Human
ggaggcugaggcaggaggaucccuuga

SEQ ID NO: 69049 - RNA, 26 nt, Human
ccauuuuuauucaggggaaacuugau

SEQ ID NO: 69050 - RNA, 23 nt, Human
ugucuggucugggagcucguuaa

SEQ ID NO: 69051 - RNA, 25 nt, Human
ggcacacacauuuuucuacccuucu

SEQ ID NO: 69052 - RNA, 20 nt, Human
gcacagcccagcugggcuag

SEQ ID NO: 69053 - RNA, 27 nt, Human
gggcacugacugauagcuuacacugag

SEQ ID NO: 69054 - RNA, 22 nt, Human
agacccauggcuggaccugcca

SEQ ID NO: 69055 - RNA, 27 nt, Human
cccaaguagcugggauuacagauugau

SEQ ID NO: 69056 - RNA, 24 nt, Human
uaaaggagaaggcaugaaauuguc

SEQ ID NO: 69057 - RNA, 29 nt, Human
cuccggccucagaggcugugacaauggac

SEQ ID NO: 69058 - RNA, 22 nt, Human
auguggaguuuacaugggccuc

SEQ ID NO: 69059 - RNA, 19 nt, Human
guucauaaguuguacaacc

SEQ ID NO: 69060 - RNA, 20 nt, Human
gugagucuugcgagguggaa

SEQ ID NO: 69061 - RNA, 22 nt, Human
agaaauuuggauuauuuuagaa

SEQ ID NO: 69062 - RNA, 22 nt, Human
auugauugaagagucacugucu

SEQ ID NO: 69063 - RNA, 28 nt, Human
uguggggguuggaagcugucuguggccc

SEQ ID NO: 69064 - RNA, 23 nt, Human
cccuguaauuccagggcuuuugg

SEQ ID NO: 69065 - RNA, 21 nt, Human
cagcucuuccagggcagcggc

SEQ ID NO: 69066 - RNA, 20 nt, Human
cguguucuucgaguugggcu

SEQ ID NO: 69067 - RNA, 21 nt, Human
ucaacuggacaucacagcaga

SEQ ID NO: 69068 - RNA, 20 nt, Human
ccucccacucugggcucagg

SEQ ID NO: 69069 - RNA, 23 nt, Human
cccugacagcccaacaccaccuu

SEQ ID NO: 69070 - RNA, 21 nt, Human
ccucuugcacguuuccccuca

SEQ ID NO: 69071 - RNA, 25 nt, Human
gaggugggcugguagagcaggaagc

SEQ ID NO: 69072 - RNA, 23 nt, Human
ggguugaggcagggcaaaugaca

SEQ ID NO: 69073 - RNA, 23 nt, Human
ggcauaaacaagaacaacaaaac

SEQ ID NO: 69074 - RNA, 25 nt, Human
ggaaaacacugcagcggugcucgga

SEQ ID NO: 69075 - RNA, 27 nt, Human
gggcaaaggaaaaccgaguaucuggcc

SEQ ID NO: 69076 - RNA, 23 nt, Human
cuugucucuugccugccacugug

SEQ ID NO: 69077 - RNA, 23 nt, Human
guaucucucuguggugguucauu

SEQ ID NO: 69078 - RNA, 25 nt, Human
augcccccuuugcaaggccugcugc

SEQ ID NO: 69079 - RNA, 22 nt, Human
ggcucaccgcaaccuccaccuu

SEQ ID NO: 69080 - RNA, 23 nt, Human
cuuugggcucgggggcucccgga

SEQ ID NO: 69081 - RNA, 27 nt, Human
ccugcagcuccgcaccugcggccagug

SEQ ID NO: 69082 - RNA, 22 nt, Human
aaggaauaaacaaguugaauag

SEQ ID NO: 69083 - RNA, 22 nt, Human
cagccucccuucuccuuccacu

SEQ ID NO: 69084 - RNA, 25 nt, Human
ggcuggugccugagccccucagaca

SEQ ID NO: 69085 - RNA, 25 nt, Human
uagauguuuuuaauaagauguucua

SEQ ID NO: 69086 - RNA, 21 nt, Human
acucacaaauguugucuauaa

SEQ ID NO: 69087 - RNA, 24 nt, Human
gucauuuucuucacauucucaucu

SEQ ID NO: 69088 - RNA, 22 nt, Human
agggaauuguccucuguggaag

SEQ ID NO: 69089 - RNA, 22 nt, Human
ccaaguguccaucuccaucgga

SEQ ID NO: 69090 - RNA, 21 nt, Human
cuagaggcccagccucugugg

SEQ ID NO: 69091 - RNA, 26 nt, Human
cucacuucuagaucucagccauucua

SEQ ID NO: 69092 - RNA, 26 nt, Human
agggcgcaggagggaaugagcugugg

SEQ ID NO: 69093 - RNA, 27 nt, Human
ccacgaagcacaagccugggagugacg

SEQ ID NO: 69094 - RNA, 21 nt, Human
ccccugcuucagcuccuagcu

SEQ ID NO: 69095 - RNA, 24 nt, Human
gccuuucuguuccuuggacaugcc

SEQ ID NO: 69096 - RNA, 21 nt, Human
ccuguuucucugagaugagga

SEQ ID NO: 69097 - RNA, 22 nt, Human
guaauuuauuuugcuaccucuu

SEQ ID NO: 69098 - RNA, 26 nt, Human
cucagcccugcucccugccuccugcc

SEQ ID NO: 69099 - RNA, 19 nt, Human
ggacuugcccacaccucca

SEQ ID NO: 69100 - RNA, 21 nt, Human
ucugcagcucaaagauguggg

SEQ ID NO: 69101 - RNA, 22 nt, Human
aaggggagaccucagaaguaaa

SEQ ID NO: 69102 - RNA, 21 nt, Human
ucauuuccuuggggcugcagu

SEQ ID NO: 69103 - RNA, 21 nt, Human
ggaacuccuggcucaaucgau

SEQ ID NO: 69104 - RNA, 25 nt, Human
ucuuccucucuccuaucuuucccuc

SEQ ID NO: 69105 - RNA, 23 nt, Human
agaacugcuuucuuucguuuguu

SEQ ID NO: 69106 - RNA, 24 nt, Human
cagcccaggcuguugucccuugaa

SEQ ID NO: 69107 - RNA, 22 nt, Human
uuugcuugauccugggaggcag

SEQ ID NO: 69108 - RNA, 27 nt, Human
uuguuugcaggacgaaaacuucugagu

SEQ ID NO: 69109 - RNA, 27 nt, Human
uugaggggagaggaaaucuuaagauua

SEQ ID NO: 69110 - RNA, 24 nt, Human
uaucagccaaaauuugaguuagca

SEQ ID NO: 69111 - RNA, 22 nt, Human
cgagcagcugugccagaggcug

SEQ ID NO: 69112 - RNA, 22 nt, Human
gaaacucaagaaugacagcuuc

SEQ ID NO: 69113 - RNA, 21 nt, Human
uguggccuggcuucugggaca

SEQ ID NO: 69114 - RNA, 21 nt, Human
aggagguuguggcugcaguga

SEQ ID NO: 69115 - RNA, 22 nt, Human
gcaacauggugaaaccccaucu

SEQ ID NO: 69116 - RNA, 22 nt, Human
gcaacauggcaaaacccugucu

SEQ ID NO: 69117 - RNA, 26 nt, Human
ccgcaguccaugccccauuguggacc

SEQ ID NO: 69118 - RNA, 20 nt, Human
gcucuucuucugugucucua

SEQ ID NO: 69119 - RNA, 24 nt, Human
cgccucuccaucgucuugggcccu

SEQ ID NO: 69120 - RNA, 24 nt, Human
gcugucacucccugugcauggucu

SEQ ID NO: 69121 - RNA, 23 nt, Human
aagcggaaguggaaaauaucacu

SEQ ID NO: 69122 - RNA, 26 nt, Human
acuacagauaugcaacuaaaauagac

SEQ ID NO: 69123 - RNA, 23 nt, Human
caccagguuccuccccucacccc

SEQ ID NO: 69124 - RNA, 20 nt, Human
aacuuuuaagcugugccuca

SEQ ID NO: 69125 - RNA, 22 nt, Human
ugguggauaccuguaaucccag

SEQ ID NO: 69126 - RNA, 27 nt, Human
gagaaagcgguuggggucucccaggga

SEQ ID NO: 69127 - RNA, 23 nt, Human
ugaguagcugggacuacaggcau

SEQ ID NO: 69128 - RNA, 22 nt, Human
gaaauaaaauauuuuguucuca

SEQ ID NO: 69129 - RNA, 21 nt, Human
ugucuuuucuggaggagggag

SEQ ID NO: 69130 - RNA, 31 nt, Human; identical to SEQ ID NO: 5399

SEQ ID NO: 69131 - RNA, 25 nt, Human
ggggggccaggugccuccacaguca

SEQ ID NO: 69132 - RNA, 22 nt, Human
cagacggaguacacggagcagc

SEQ ID NO: 69133 - RNA, 24 nt, Human
uggauucauggcuguuuauuauga

SEQ ID NO: 69134 - RNA, 16 nt, Human
cuucccuugcgugcgu

SEQ ID NO: 69135 - RNA, 23 nt, Human
ccagaagucccugcgguccuacu

SEQ ID NO: 69136 - RNA, 23 nt, Human
aagauccuagucagacagagccc

SEQ ID NO: 69137 - RNA, 22 nt, Human
ucucccuugggacugugucuca

SEQ ID NO: 69138 - RNA, 21 nt, Human
cacuaccaggcccugcagcca

SEQ ID NO: 69139 - RNA, 22 nt, Human
cagguuggagugcauucauuca

SEQ ID NO: 69140 - RNA, 23 nt, Human
guugcccaggauggagugcagug

SEQ ID NO: 69141 - RNA, 29 nt, Human
ugagaaaugaaugaauguuucuauuuaca

SEQ ID NO: 69142 - RNA, 21 nt, Human
gcaguggcuggugcccaugaa

SEQ ID NO: 69143 - RNA, 19 nt, Human
cuguuuucuuaaaaggccu

SEQ ID NO: 69144 - RNA, 28 nt, Human
gggcccugggcauuucugcugagaacca

SEQ ID NO: 69145 - RNA, 22 nt, Human
cugucccagggagaguugcauc

SEQ ID NO: 69146 - RNA, 32 nt, Human
ggagguaggcuaguugggaugggcagcuaagc

SEQ ID NO: 69147 - RNA, 27 nt, Human
ccugcuguuugcuuuugguaaugugau

SEQ ID NO: 69148 - RNA, 21 nt, Human
aggcaggggcggguggaucac

SEQ ID NO: 69149 - RNA, 27 nt, Human
cagaaaugcugcuggccaaauagcaaa

SEQ ID NO: 69150 - RNA, 21 nt, Human
guuccucuccaccugcauuau

SEQ ID NO: 69151 - RNA, 20 nt, Human
agauuaguuugaagcauuga

SEQ ID NO: 69152 - RNA, 27 nt, Human
uucugaauugcagaaaucagauaaaaa

SEQ ID NO: 69153 - RNA, 21 nt, Human
caggaggcggagguuacagug

SEQ ID NO: 69154 - RNA, 26 nt, Human
gcagccccuuggagcugcagggagcu

SEQ ID NO: 69155 - RNA, 25 nt, Human
ccccagugcacagacauagaggcac

SEQ ID NO: 69156 - RNA, 27 nt, Human
gucaagcugacccaggcggccguggaa

SEQ ID NO: 69157 - RNA, 20 nt, Human
agcccaccucauguccagcu

SEQ ID NO: 69158 - RNA, 27 nt, Human
caggcuggagugcaguggcaugaucuc

SEQ ID NO: 69159 - RNA, 25 nt, Human
ccucugacucuaagaauucucucuu

SEQ ID NO: 69160 - RNA, 20 nt, Human
gguuaucaaaauuaaccuca

SEQ ID NO: 69161 - RNA, 19 nt, Human
gugccugggcucagccugg

SEQ ID NO: 69162 - RNA, 22 nt, Human
cuuuguugcuuaaucuagagcu

SEQ ID NO: 69163 - RNA, 25 nt, Human
ugcagugacuguaaauuggccuggc

SEQ ID NO: 69164 - RNA, 27 nt, Human
gcccaggacucucccuguuuuagcacu

SEQ ID NO: 69165 - RNA, 27 nt, Human
uggugacucguccacacugcucgcuuc

SEQ ID NO: 69166 - RNA, 26 nt, Human
gcaguuuccccacugugucuguccca

SEQ ID NO: 69167 - RNA, 20 nt, Human
cccuccuuuuuauuuuuucc

SEQ ID NO: 69168 - RNA, 27 nt, Human
ucuguuucagaaaccaacagugauggc

SEQ ID NO: 69169 - RNA, 22 nt, Human
gggcuggacgucaggagccaag

SEQ ID NO: 69170 - RNA, 30 nt, Human
aacuguuccgcugccuucuugucugugcua

SEQ ID NO: 69171 - RNA, 20 nt, Human
cuucauauucuaaaaccauu

SEQ ID NO: 69172 - RNA, 23 nt, Human
ugcuccagcuuccagcuggagau

SEQ ID NO: 69173 - RNA, 25 nt, Human
cucuuugagggcagggauugugucu

SEQ ID NO: 69174 - RNA, 20 nt, Human
aauccugccggaacugaggc

SEQ ID NO: 69175 - RNA, 23 nt, Human
aagauucacguauccaucuggag

SEQ ID NO: 69176 - RNA, 29 nt, Human
gccuuuuucucccguuucauuccuuucuc

SEQ ID NO: 69177 - RNA, 22 nt, Human
ccagggagagagaaaaagcuga

SEQ ID NO: 69178 - RNA, 24 nt, Human
auuaauugguggcccugccugccc

SEQ ID NO: 69179 - RNA, 29 nt, Human
cugcggcugcuccugcucacaauaaagcc

SEQ ID NO: 69180 - RNA, 22 nt, Human
gguggagguugugcauguuguc

SEQ ID NO: 69181 - RNA, 21 nt, Human
acacuccugcuguuggcugga

SEQ ID NO: 69182 - RNA, 17 nt, Human
uagucccagcacucugg

SEQ ID NO: 69183 - RNA, 22 nt, Human
gcacagccagcguuguggccug

SEQ ID NO: 69184 - RNA, 23 nt, Human
ccugcugccugcuucaccagaag

SEQ ID NO: 69185 - RNA, 21 nt, Human
ugcugcucucccuggacgacc

SEQ ID NO: 69186 - RNA, 22 nt, Human
ccuacuaucaucucuuaaauuu

SEQ ID NO: 69187 - RNA, 22 nt, Human
acccagguuggagugcaguggc

SEQ ID NO: 69188 - RNA, 22 nt, Human
acccaggcuggaguguaguggc

SEQ ID NO: 69189 - RNA, 22 nt, Human
gugacaugaggcccauucuucu

SEQ ID NO: 69190 - RNA, 18 nt, Human
cugucugccugugcugug

SEQ ID NO: 69191 - RNA, 22 nt, Human
aggccuuggagcccacacaugg

SEQ ID NO: 69192 - RNA, 28 nt, Human
gggcuggacuucuggagcugcuaagcca

SEQ ID NO: 69193 - RNA, 21 nt, Human
ucuaucuuucuuccaccagac

SEQ ID NO: 69194 - RNA, 17 nt, Human
gcaggcagcacagcaga

SEQ ID NO: 69195 - RNA, 22 nt, Human
gccauuuuccuguuucaagaau

SEQ ID NO: 69196 - RNA, 23 nt, Human
gggaagcagggacaguggagagg

SEQ ID NO: 69197 - RNA, 25 nt, Human
aaucuuguaaauagaaaauguaaua

SEQ ID NO: 69198 - RNA, 24 nt, Human
gcuuugcagggcggccagugcagu

SEQ ID NO: 69199 - RNA, 25 nt, Human
gcuagcacugcaugugcugugcaua

SEQ ID NO: 69200 - RNA, 21 nt, Human
ccucugaagauuucacuccau

SEQ ID NO: 69201 - RNA, 28 nt, Human
ccucagccugcaaccucuauccuggaac

SEQ ID NO: 69202 - RNA, 22 nt, Human
cuccaucucuacaaaaaaugca

SEQ ID NO: 69203 - RNA, 19 nt, Human
ccccggcuggagugcagug

SEQ ID NO: 69204 - RNA, 25 nt, Human
guuacccaggcuggagugcaauggc

SEQ ID NO: 69205 - RNA, 21 nt, Human
gaucccuggguucaacucugc

SEQ ID NO: 69206 - RNA, 21 nt, Human
ccggagcgguggcucacaccu

SEQ ID NO: 69207 - RNA, 22 nt, Human
ccugccuggggagcccuguucc

SEQ ID NO: 69208 - RNA, 24 nt, Human
gcucuucuucugugucucuauuuc

SEQ ID NO: 69209 - RNA, 22 nt, Human
gccuuucccacccuccugcccc

SEQ ID NO: 69210 - RNA, 16 nt, Human
acaagugugcacagua

SEQ ID NO: 69211 - RNA, 28 nt, Human
augaguucuuccacagugaacccuugga

SEQ ID NO: 69212 - RNA, 23 nt, Human
ccaggucucccugucucuccccc

SEQ ID NO: 69213 - RNA, 27 nt, Human
gucacccagcacuguggcagcgcccag

SEQ ID NO: 69214 - RNA, 21 nt, Human
accauuuuguuaugaggaauu

SEQ ID NO: 69215 - RNA, 22 nt, Human
cauggagcagcgggaagggcga

SEQ ID NO: 69216 - RNA, 22 nt, Human
uggugggcgccuguaaucccag

SEQ ID NO: 69217 - RNA, 26 nt, Human
cuucccuucuucccaccugccugcug

SEQ ID NO: 69218 - RNA, 22 nt, Human
ggucuugaacuccuggacuuag

SEQ ID NO: 69219 - RNA, 22 nt, Human
guuguucuucccuauacuucac

SEQ ID NO: 69220 - RNA, 23 nt, Human
agaccccagccccauucccaucu

SEQ ID NO: 69221 - RNA, 22 nt, Human
cuuucucugcccucugugacau

SEQ ID NO: 69222 - RNA, 20 nt, Human
gcagaaguaagccucaucau

SEQ ID NO: 69223 - RNA, 23 nt, Human
ugcccugcuuuauauuucuuuga

SEQ ID NO: 69224 - RNA, 21 nt, Human
cacacagccaggaguuuucca

SEQ ID NO: 69225 - RNA, 18 nt, Human
cagagcauuggggugggg

SEQ ID NO: 69226 - RNA, 23 nt, Human
augccuaauguggucugccugug

SEQ ID NO: 69227 - RNA, 25 nt, Human
gcccccacuuucaccaguuucugcg

SEQ ID NO: 69228 - RNA, 24 nt, Human
auuuuuccugaacaaccccaucuc

SEQ ID NO: 69229 - RNA, 20 nt, Human
auuugucaaaguugaccuca

SEQ ID NO: 69230 - RNA, 21 nt, Human
ccaggaggaagacuaguggug

SEQ ID NO: 69231 - RNA, 23 nt, Human
ggcaggagaacuacuugaaccug

SEQ ID NO: 69232 - RNA, 26 nt, Human
cucuguggcccagggcagguuugcuu

SEQ ID NO: 69233 - RNA, 22 nt, Human
uuucuuucuuugacuccucuuc

SEQ ID NO: 69234 - RNA, 26 nt, Human
uuauguuugguuauggcaagauguua

SEQ ID NO: 69235 - RNA, 19 nt, Human
uacagccugggcucaggga

SEQ ID NO: 69236 - RNA, 22 nt, Human
ucaacauggugaggggcuacaa

SEQ ID NO: 69237 - RNA, 23 nt, Human
acucaccuucucuauccuugcuc

SEQ ID NO: 69238 - RNA, 24 nt, Human
aggcugccaggcuggaguggagug

SEQ ID NO: 69239 - RNA, 26 nt, Human
aggcagcagcguucgcggaguucgcc

SEQ ID NO: 69240 - RNA, 26 nt, Human
gggaguuggggaagggaaggagccag

SEQ ID NO: 69241 - RNA, 28 nt, Human
ggaguggcguagaguucaguguucgcag

SEQ ID NO: 69242 - RNA, 27 nt, Human
uggagagagcuggaaggaaggagccag

SEQ ID NO: 69243 - RNA, 23 nt, Human
uaacugcaagggauggaaccugc

SEQ ID NO: 69244 - RNA, 26 nt, Human
cucuucuguauucacucagcaaccau

SEQ ID NO: 69245 - RNA, 31 nt, Human
acacccuggaguagccuucccccuuggccgu

SEQ ID NO: 69246 - RNA, 22 nt, Human
uccguuaaacagagaaagagcu

SEQ ID NO: 69247 - RNA, 30 nt, Human
ggcgagggcgcgagugaggagcagacccag

SEQ ID NO: 69248 - RNA, 22 nt, Human
uccaacuuuguuggacuccuua

SEQ ID NO: 69249 - RNA, 22 nt, Human
cccagaguacugggauuacagg

SEQ ID NO: 69250 - RNA, 23 nt, Human
agggaucuucugaaguugcuuug

SEQ ID NO: 69251 - RNA, 21 nt, Human
uucuaggugauucugaugcac

SEQ ID NO: 69252 - RNA, 25 nt, Human
gcugggagcugggggaaacgacgcc

SEQ ID NO: 69253 - RNA, 20 nt, Human
uaaauccguccuguuuagcg

SEQ ID NO: 69254 - RNA, 23 nt, Human
guuuguuuucucccacugccucc

SEQ ID NO: 69255 - RNA, 24 nt, Human
agucacaaaggccuccuucccugc

SEQ ID NO: 69256 - RNA, 23 nt, Human
agaguccuuuagagugacagguu

SEQ ID NO: 69257 - RNA, 24 nt, Human
gucuccaacagggcaggagugagu

SEQ ID NO: 69258 - RNA, 26 nt, Human
ggacuugccuccagagacugcuccag

SEQ ID NO: 69259 - RNA, 20 nt, Human
cauccguguugugagcacag

SEQ ID NO: 69260 - RNA, 27 nt, Human
gcuuguaauaaauacugcagcuugaga

SEQ ID NO: 69261 - RNA, 27 nt, Human
acgaaugucucaagcuuugaaaagagc

SEQ ID NO: 69262 - RNA, 21 nt, Human
ccagccugggcaauagaguga

SEQ ID NO: 69263 - RNA, 24 nt, Human
cuugucagaaugaauauagacaca

SEQ ID NO: 69264 - RNA, 21 nt, Human
cgugauuaaggauaggaaucg

SEQ ID NO: 69265 - RNA, 22 nt, Human
ucuuccucaccuggcuugggcc

SEQ ID NO: 69266 - RNA, 28 nt, Human
agugggaggagagggcagagguccccug

SEQ ID NO: 69267 - RNA, 22 nt, Human
gaggcuggaggaacaacugggc

SEQ ID NO: 69268 - RNA, 22 nt, Human
uacuguacuccagccagggcaa

SEQ ID NO: 69269 - RNA, 23 nt, Human
uccuucauagguuugaacacugu

SEQ ID NO: 69270 - RNA, 27 nt, Human
ggcauuuucaaauucugccuaccacag

SEQ ID NO: 69271 - RNA, 25 nt, Human
uugugcaaagcuauggcuuccuugg

SEQ ID NO: 69272 - RNA, 20 nt, Human
augugauuuguaaauucuuu

SEQ ID NO: 69273 - RNA, 20 nt, Human
aggaaagaggaagugcuaga

SEQ ID NO: 69274 - RNA, 23 nt, Human
cacuuucucccuccuccuuuucc

SEQ ID NO: 69275 - RNA, 22 nt, Human
uggucucaaacuccugaccuug

SEQ ID NO: 69276 - RNA, 23 nt, Human
cucagucccuaaaaaugaugugg

SEQ ID NO: 69277 - RNA, 27 nt, Human
gucccuuuggcuggagugccucucugg

SEQ ID NO: 69278 - RNA, 21 nt, Human
agcccugacuccuggacuccg

SEQ ID NO: 69279 - RNA, 27 nt, Human
uaucugaagcccucccagguguuaaca

SEQ ID NO: 69280 - RNA, 21 nt, Human
cucagcgccugagaauggagg

SEQ ID NO: 69281 - RNA, 22 nt, Human
cucggccucccaaagugcaggg

SEQ ID NO: 69282 - RNA, 27 nt, Human
ccucaggccagcucuucugaggaggcu

SEQ ID NO: 69283 - RNA, 27 nt, Human
aaugucagacuuugcugcauuuuacac

SEQ ID NO: 69284 - RNA, 19 nt, Human
gagauggcuuacaaaaaga

SEQ ID NO: 69285 - RNA, 19 nt, Human
cuuuuuaaaaaaugcccua

SEQ ID NO: 69286 - RNA, 22 nt, Human
auuuguaggcugaacuaaugac

SEQ ID NO: 69287 - RNA, 18 nt, Human
agcauuuugcuccuacca

SEQ ID NO: 69288 - RNA, 25 nt, Human
ucccuaggcuagaaauugcugggcc

SEQ ID NO: 69289 - RNA, 24 nt, Human
acagucuaguagaagaaagauuag

SEQ ID NO: 69290 - RNA, 23 nt, Human
gaaccuugugugacaaaugagaa

SEQ ID NO: 69291 - RNA, 23 nt, Human
gaccuugugaugcucccaccucg

SEQ ID NO: 69292 - RNA, 26 nt, Human
ccaguaucuuuuaccaccaaagucau

SEQ ID NO: 69293 - RNA, 21 nt, Human
gcccccacucugucuccugcc

SEQ ID NO: 69294 - RNA, 24 nt, Human
caaaaagaaauccaggaagaaaua

SEQ ID NO: 69295 - RNA, 22 nt, Human
uagcugagauucaucucaggau

SEQ ID NO: 69296 - RNA, 21 nt, Human
uccagugauuugggagcugca

SEQ ID NO: 69297 - RNA, 20 nt, Human
gcuggugcccaucaccacug

SEQ ID NO: 69298 - RNA, 24 nt, Human
ggaggugggguugggauugggggc

SEQ ID NO: 69299 - RNA, 20 nt, Human
uucucucugucacugacuua

SEQ ID NO: 69300 - RNA, 27 nt, Human
cuccagaggaagacuccugaaacccuc

SEQ ID NO: 69301 - RNA, 24 nt, Human
gucaauaaaugacacccagaccuu

SEQ ID NO: 69302 - RNA, 23 nt, Human
aacacaaacacuguccuuuuggg

SEQ ID NO: 69303 - RNA, 18 nt, Human
cggcaguuggaggaaggc

SEQ ID NO: 69304 - RNA, 27 nt, Human
cuucaguugcaauaugcuaaucccacu

SEQ ID NO: 69305 - RNA, 20 nt, Human
cccaagaagcugggguggug

SEQ ID NO: 69306 - RNA, 22 nt, Human
gcuuccuuuuauaauacugguc

SEQ ID NO: 69307 - RNA, 23 nt, Human
ccgggcagcggagguugcaguga

SEQ ID NO: 69308 - RNA, 23 nt, Human
guugggcccuuauucucuuauga

SEQ ID NO: 69309 - RNA, 25 nt, Human
gucuuggcagccuacuagggaccug

SEQ ID NO: 69310 - RNA, 22 nt, Human
ccccaccccccuggccuuggug

SEQ ID NO: 69311 - RNA, 23 nt, Human
augugguucauucuagcauuucu

SEQ ID NO: 69312 - RNA, 22 nt, Human
ggccuggggacccaaacccccu

SEQ ID NO: 69313 - RNA, 22 nt, Human
aagccauguguggaaacccacu

SEQ ID NO: 69314 - RNA, 26 nt, Human
gcuguugccaaugaacugcaggagcu

SEQ ID NO: 69315 - RNA, 27 nt, Human
ucggcucccagcaagugccucuuuguc

SEQ ID NO: 69316 - RNA, 21 nt, Human
cagaauucuuccaaacucccu

SEQ ID NO: 69317 - RNA, 22 nt, Human
uugguuccuguugugcucuugu

SEQ ID NO: 69318 - RNA, 25 nt, Human
caguuucagacauuuucaccacucc

SEQ ID NO: 69319 - RNA, 32 nt, Human
ggcugggccuccacuucagccuagugaacaaa

SEQ ID NO: 69320 - RNA, 26 nt, Human
ggcuuacuuugucugccacagacaca

SEQ ID NO: 69321 - RNA, 27 nt, Human
ugccacaggcugggcucuugugcuaga

SEQ ID NO: 69322 - RNA, 27 nt, Human
aaaauguugggauuaccuguuuaaauc

SEQ ID NO: 69323 - RNA, 22 nt, Human
gccagaagcccaggggcucagg

SEQ ID NO: 69324 - RNA, 19 nt, Human
aagguguggcuggaagcac

SEQ ID NO: 69325 - RNA, 23 nt, Human
gcaauaaagaagcacauuauuuu

SEQ ID NO: 69326 - RNA, 25 nt, Human
ccucaguuuaauccuucuaguuucc

SEQ ID NO: 69327 - RNA, 26 nt, Human
cucugccugugauaucuguaucuuuu

SEQ ID NO: 69328 - RNA, 19 nt, Human
ggauaaauagaaaaauguc

SEQ ID NO: 69329 - RNA, 28 nt, Human
uacuauaauugagaacuacagcuuuuaa

SEQ ID NO: 69330 - RNA, 24 nt, Human
acucuucuagcauuuagaucuaca

SEQ ID NO: 69331 - RNA, 19 nt, Human
ugagaccaugaugguuaca

SEQ ID NO: 69332 - RNA, 21 nt, Human
uuacaucuuguuuuuacucau

SEQ ID NO: 69333 - RNA, 20 nt, Human
cugaucugcccccacugucc

SEQ ID NO: 69334 - RNA, 19 nt, Human
uacaauagugcuuguacaa

SEQ ID NO: 69335 - RNA, 24 nt, Human
uuacuuaaacuuucuuuccaguca

SEQ ID NO: 69336 - RNA, 20 nt, Human
ccaugcugugccucaguuua

SEQ ID NO: 69337 - RNA, 23 nt, Human
guugccuaggcuggagugcagug

SEQ ID NO: 69338 - RNA, 27 nt, Human
acaggaagucacaguggugcccaggga

SEQ ID NO: 69339 - RNA, 25 nt, Human
gggagccugaggcaggaggauugcu

SEQ ID NO: 69340 - RNA, 24 nt, Human
ggugguagaagcugcuguuuauga

SEQ ID NO: 69341 - RNA, 22 nt, Human
aucuccaaagucgaaugagaaa

SEQ ID NO: 69342 - RNA, 26 nt, Human
cuguacagaccagcgggagugcgcgc

SEQ ID NO: 69343 - RNA, 20 nt, Human
ugcugcucugggagggccag

SEQ ID NO: 69344 - RNA, 23 nt, Human
cgugcaaauaucagaauuguuaa

SEQ ID NO: 69345 - RNA, 26 nt, Human
cugagcaaugucugugcuagggaaac

SEQ ID NO: 69346 - RNA, 27 nt, Human
aacaaauuggucaugacaaggggaccc

SEQ ID NO: 69347 - RNA, 23 nt, Human
aagugaccacuuugcuauauaca

SEQ ID NO: 69348 - RNA, 23 nt, Human
gccucucuucacacacuuggcgg

SEQ ID NO: 69349 - RNA, 22 nt, Human
gcagauguuauaucacagcaau

SEQ ID NO: 69350 - RNA, 22 nt, Human
cccugcugagcacguggaguua

SEQ ID NO: 69351 - RNA, 21 nt, Human
agccgcccucuccuccaggcc

SEQ ID NO: 69352 - RNA, 24 nt, Human
auaagcuggggaagugaggacugu

SEQ ID NO: 69353 - RNA, 22 nt, Human
ugggagguugugguugcaguga

SEQ ID NO: 69354 - RNA, 19 nt, Human
agcuaauuuuauuuuuugu

SEQ ID NO: 69355 - RNA, 25 nt, Human
gcgacagccacuuuuuacucucccu

SEQ ID NO: 69356 - RNA, 20 nt, Human
uuucacugcaaugaccuuuc

SEQ ID NO: 69357 - RNA, 20 nt, Human
agcaaaauaaaacugugaug

SEQ ID NO: 69358 - RNA, 31 nt, Human
acucccucucccuggugggccuggcaaugac

SEQ ID NO: 69359 - RNA, 19 nt, Human
cuggcaaaaucacauugca

SEQ ID NO: 69360 - RNA, 20 nt, Human
ugggcucugggcacugacuu

SEQ ID NO: 69361 - RNA, 22 nt, Human
gcugcagccacugccuccuggg

SEQ ID NO: 69362 - RNA, 20 nt, Human
ccugugccucacccagggcc

SEQ ID NO: 69363 - RNA, 22 nt, Human
cccaagcuccuccucggaaccg

SEQ ID NO: 69364 - RNA, 22 nt, Human
cugcaaccucugccucccaggu

SEQ ID NO: 69365 - RNA, 29 nt, Human
ucuuuguuuucuuuuuugucuugaaugaa

SEQ ID NO: 69366 - RNA, 25 nt, Human
cggaggcagaggaagagggagcggg

SEQ ID NO: 69367 - RNA, 22 nt, Human
ggcuaaauacuuacauuuacaa

SEQ ID NO: 69368 - RNA, 22 nt, Human
aacuuccugggcucaagugacc

SEQ ID NO: 69369 - RNA, 24 nt, Human
uacagcuagaaagcugcacuggug

SEQ ID NO: 69370 - RNA, 19 nt, Human
acaugucugcauguguaua

SEQ ID NO: 69371 - RNA, 26 nt, Human
agguccuuguuccagggaacagcugc

SEQ ID NO: 69372 - RNA, 24 nt, Human
cacagaaccacacagccaguccca

SEQ ID NO: 69373 - RNA, 21 nt, Human
cccggagcagggacugucauu

SEQ ID NO: 69374 - RNA, 23 nt, Human
gccugguuucaggagacucagag

SEQ ID NO: 69375 - RNA, 25 nt, Human
gugauggagggcaacaaggacuccg

SEQ ID NO: 69376 - RNA, 27 nt, Human
aaccaguaccucuguauagaaaucuaa

SEQ ID NO: 69377 - RNA, 18 nt, Human
acacagacccacagaagg

SEQ ID NO: 69378 - RNA, 26 nt, Human
caccuacaggacugggccgggcccag

SEQ ID NO: 69379 - RNA, 23 nt, Human
cuauucaugcuuuuauccauucu

SEQ ID NO: 69380 - RNA, 21 nt, Human
uuaacucauuuuauccauucc

SEQ ID NO: 69381 - RNA, 20 nt, Human
gaacugucuuuaccacugau

SEQ ID NO: 69382 - RNA, 22 nt, Human
ggagagaggaacccacucacuc

SEQ ID NO: 69383 - RNA, 21 nt, Human
uggggucuugcucugucgcca

SEQ ID NO: 69384 - RNA, 23 nt, Human
gcaaaguguuuuguaccagugaa

SEQ ID NO: 69385 - RNA, 29 nt, Human
aagugccuugcucauuugaaaauggacag

SEQ ID NO: 69386 - RNA, 25 nt, Human
ugucagcguucuaccaggcaaauuc

SEQ ID NO: 69387 - RNA, 20 nt, Human
agugagacaaggcuugcugu

SEQ ID NO: 69388 - RNA, 21 nt, Human
gcaaggccucucagacccaga

SEQ ID NO: 69389 - RNA, 23 nt, Human
gcgagauuuccagggcgcagucc

SEQ ID NO: 69390 - RNA, 22 nt, Human
cccaaauuguguauauaucuua

SEQ ID NO: 69391 - RNA, 16 nt, Human
auaguauuuaaagaca

SEQ ID NO: 69392 - RNA, 20 nt, Human
cucaaaaagagugaaugaaa

SEQ ID NO: 69393 - RNA, 21 nt, Human
agcgggccuggcugggcaucc

SEQ ID NO: 69394 - RNA, 26 nt, Human
gcuuugucaccaggcuggagugcagu

SEQ ID NO: 69395 - RNA, 22 nt, Human
cauccaggcuggccagugcugc

SEQ ID NO: 69396 - RNA, 25 nt, Human
caugggcuagaagaggagagggggg

SEQ ID NO: 69397 - RNA, 21 nt, Human
ucuccaggaagguggcgcugg

SEQ ID NO: 69398 - RNA, 28 nt, Human
agccaaggacagagaccuggaacagaug

SEQ ID NO: 69399 - RNA, 22 nt, Human
ggaaaacaaaaauaucuugcaa

SEQ ID NO: 69400 - RNA, 23 nt, Human
ccgucuccacaggaaacccagaa

SEQ ID NO: 69401 - RNA, 19 nt, Human
gggaggugggguuugguga

SEQ ID NO: 69402 - RNA, 23 nt, Human
cugcccccuuuccuuuucugacc

SEQ ID NO: 69403 - RNA, 32 nt, Human; identical to SEQ ID NO: 4875

SEQ ID NO: 69404 - RNA, 26 nt, Human
accaguaccugaaagcacuguagccc

SEQ ID NO: 69405 - RNA, 23 nt, Human
ggucugaucugcauuucacuucc

SEQ ID NO: 69406 - RNA, 23 nt, Human
uguacuuguuuucuugguagcag

SEQ ID NO: 69407 - RNA, 27 nt, Human
uucauucucguccagccauugcucccc

SEQ ID NO: 69408 - RNA, 26 nt, Human
cugcuuccuguggccuccauggcuga

SEQ ID NO: 69409 - RNA, 27 nt, Human
ccccagccauggcccucaggagcuccc

SEQ ID NO: 69410 - RNA, 20 nt, Human
gagcccccagaggacuuuau

SEQ ID NO: 69411 - RNA, 26 nt, Human
uggccucaggagcugggggugcagug

SEQ ID NO: 69412 - RNA, 22 nt, Human
ucuugaggaauaaaugccuuua

SEQ ID NO: 69413 - RNA, 23 nt, Human
cuguccaccuggcggaaccaccg

SEQ ID NO: 69414 - RNA, 20 nt, Human
ggcacgagggcggaaaagaa

SEQ ID NO: 69415 - RNA, 22 nt, Human
uguuggguggaggauggacgag

SEQ ID NO: 69416 - RNA, 27 nt, Human
cuuagccccauugcuccauucacuccc

SEQ ID NO: 69417 - RNA, 20 nt, Human
ucuucaugaccuacuucaaa

SEQ ID NO: 69418 - RNA, 21 nt, Human
aucccaagccuccugcugcca

SEQ ID NO: 69419 - RNA, 23 nt, Human
agccagccccacuacuuccuucc

SEQ ID NO: 69420 - RNA, 28 nt, Human
agacugcgccacggcacuccagccuggg

SEQ ID NO: 69421 - RNA, 26 nt, Human
gaccuccaguccugcuggccugcucu

SEQ ID NO: 69422 - RNA, 22 nt, Human
ucgagaacaggaauuucuucua

SEQ ID NO: 69423 - RNA, 22 nt, Human
gaggagccccucuuucucccau

SEQ ID NO: 69424 - RNA, 23 nt, Human
aacugcaggagggcccucagcug

SEQ ID NO: 69425 - RNA, 24 nt, Human
gcaguugacugcaugcacacuuua

SEQ ID NO: 69426 - RNA, 22 nt, Human
ugccuguaaucccgguacuuug

SEQ ID NO: 69427 - RNA, 21 nt, Human
ucacauuuuguaucaguauua

SEQ ID NO: 69428 - RNA, 23 nt, Human
aggagccugcuggucacagccuc

SEQ ID NO: 69429 - RNA, 20 nt, Human
ugcaaaugccauauauucaa

SEQ ID NO: 69430 - RNA, 27 nt, Human
ccccacccucccuggcguguggcugag

SEQ ID NO: 69431 - RNA, 27 nt, Human
uggccaacauggcaaaaccccuucucu

SEQ ID NO: 69432 - RNA, 26 nt, Human
cugggagcaguugcaggccacaguga

SEQ ID NO: 69433 - RNA, 23 nt, Human
caggcaguggcgugaucuuggcu

SEQ ID NO: 69434 - RNA, 21 nt, Human
guccucuggcccuuugcaaau

SEQ ID NO: 69435 - RNA, 22 nt, Human
agcuccaggagcccagcgccgg

SEQ ID NO: 69436 - RNA, 20 nt, Human
cugaugagacuccacucagg

SEQ ID NO: 69437 - RNA, 27 nt, Human
aaccuauaaauuaacucaaccuauauc

SEQ ID NO: 69438 - RNA, 22 nt, Human
guuacccaggguggagugcagu

SEQ ID NO: 69439 - RNA, 22 nt, Human
ggugcugcagauacugcaguga

SEQ ID NO: 69440 - RNA, 26 nt, Human
ucaauaccaucaucucuuaucucuau

SEQ ID NO: 69441 - RNA, 23 nt, Human
aacacaaaaagggggauugggcg

SEQ ID NO: 69442 - RNA, 23 nt, Human
ccuccgucgcggcuccuggagag

SEQ ID NO: 69443 - RNA, 21 nt, Human
cuuugggugggcuugcgccuc

SEQ ID NO: 69444 - RNA, 22 nt, Human
ugaacuccuggccucaagcaau

SEQ ID NO: 69445 - RNA, 19 nt, Human
uucucugcccagcuuuuca

SEQ ID NO: 69446 - RNA, 27 nt, Human
uccuccaggagucucagccuuucccug

SEQ ID NO: 69447 - RNA, 24 nt, Human
agguucuucuuaaaaaguaaucua

SEQ ID NO: 69448 - RNA, 23 nt, Human
aagaggagaggguauggggcggc

SEQ ID NO: 69449 - RNA, 22 nt, Human
agcuuccugaagugcugggauu

SEQ ID NO: 69450 - RNA, 23 nt, Human
gccugaaagcaagauuucagccu

SEQ ID NO: 69451 - RNA, 20 nt, Human
ccuggaggagagcaggcuag

SEQ ID NO: 69452 - RNA, 23 nt, Human
aagccuggccccaccagugcugu

SEQ ID NO: 69453 - RNA, 23 nt, Human
aucacgccacugcacuccagccu

SEQ ID NO: 69454 - RNA, 23 nt, Human
aucaugccacugcacuccagucu

SEQ ID NO: 69455 - RNA, 27 nt, Human
ccugcugcaucucuugcucucauuccu

SEQ ID NO: 69456 - RNA, 22 nt, Human
acugucucccugccugucaauc

SEQ ID NO: 69457 - RNA, 21 nt, Human
ucucugugucuuccucucacc

SEQ ID NO: 69458 - RNA, 23 nt, Human
uuuauaaacuucauuuaggucuc

SEQ ID NO: 69459 - RNA, 24 nt, Human
cacuaauuuuuguauuauuuuugu

SEQ ID NO: 69460 - RNA, 23 nt, Human
ucuccugggcauugguuccugcu

SEQ ID NO: 69461 - RNA, 24 nt, Human
ugucuuagacagccugacucucca

SEQ ID NO: 69462 - RNA, 25 nt, Human
guaaucagcucaguguguuacuggu

SEQ ID NO: 69463 - RNA, 22 nt, Human
uuaaauuaccauauguuuuuag

SEQ ID NO: 69464 - RNA, 19 nt, Human
uaaggugggcuucacugga

SEQ ID NO: 69465 - RNA, 25 nt, Human
uauagaguuuguggacagauuuaua

SEQ ID NO: 69466 - RNA, 25 nt, Human
ccacaucuucacucaagccaggaga

SEQ ID NO: 69467 - RNA, 22 nt, Human
cuuaacaacagcuucuugcuug

SEQ ID NO: 69468 - RNA, 22 nt, Human
uguuuaauauuuguuguuguau

SEQ ID NO: 69469 - RNA, 19 nt, Human
gcccccagccccucgucgc

SEQ ID NO: 69470 - RNA, 27 nt, Human
uuuugcagucacagaagaguguauuua

SEQ ID NO: 69471 - RNA, 22 nt, Human
uuuccagcaaguuuguucaaga

SEQ ID NO: 69472 - RNA, 20 nt, Human
cacaaagacgugcacaggag

SEQ ID NO: 69473 - RNA, 20 nt, Human
uagcguguaaauggaagcac

SEQ ID NO: 69474 - RNA, 22 nt, Human
cuggcaggcggagguugcagug

SEQ ID NO: 69475 - RNA, 23 nt, Human
cucccaccauucguggcaaccaa

SEQ ID NO: 69476 - RNA, 21 nt, Human
cgaaucuacccugaccaaugg

SEQ ID NO: 69477 - RNA, 19 nt, Human
ugcaaauauaaaaggcaag

SEQ ID NO: 69478 - RNA, 22 nt, Human
cuguagucccagcuauuuggga

SEQ ID NO: 69479 - RNA, 22 nt, Human
cuuccuccaagaucucagucuc

SEQ ID NO: 69480 - RNA, 23 nt, Human
cuacaguguacguaugcaacaaa

SEQ ID NO: 69481 - RNA, 27 nt, Human
cugugugauccugggcaagguagaggg

SEQ ID NO: 69482 - RNA, 24 nt, Human
uugaccaugaauuucuuagcaaua

SEQ ID NO: 69483 - RNA, 27 nt, Human
uugaacuguauuaugugguuuuuguug

SEQ ID NO: 69484 - RNA, 21 nt, Human
uuaguaaucaauuauguugau

SEQ ID NO: 69485 - RNA, 24 nt, Human
ccagcagguaugggcagguugcuu

SEQ ID NO: 69486 - RNA, 27 nt, Human
ggaaugcuguaauuacaggagcaagag

SEQ ID NO: 69487 - RNA, 23 nt, Human
ccaggcugaagugcagugaguca

SEQ ID NO: 69488 - RNA, 24 nt, Human
gggcuugcuggagcugagcuguuu

SEQ ID NO: 69489 - RNA, 23 nt, Human
gcaucaaaagaagaacuaugaca

SEQ ID NO: 69490 - RNA, 20 nt, Human
gagcgagacugucucaaaaa

SEQ ID NO: 69491 - RNA, 23 nt, Human
agcuaauuuuuguuuuguuuugu

SEQ ID NO: 69492 - RNA, 27 nt, Human
uaggaagggagaggcagcucuuccuuc

SEQ ID NO: 69493 - RNA, 21 nt, Human
ccugagcucacagaguuuaua

SEQ ID NO: 69494 - RNA, 23 nt, Human
ccugccauccccccaaccuccuc

SEQ ID NO: 69495 - RNA, 20 nt, Human
gaugcuccucacaugcugag

SEQ ID NO: 69496 - RNA, 23 nt, Human
ccuuuggcaauaucauauucuaa

SEQ ID NO: 69497 - RNA, 20 nt, Human
ucugagccauucacacaucu

SEQ ID NO: 69498 - RNA, 21 nt, Human
gagaggcagagagugagggaa

SEQ ID NO: 69499 - RNA, 26 nt, Human
gucacccaggcuggagugaucucagc

SEQ ID NO: 69500 - RNA, 21 nt, Human
aggggguggagguugcaguga

SEQ ID NO: 69501 - RNA, 22 nt, Human
aaucuaagcuguguuacuccaa

SEQ ID NO: 69502 - RNA, 21 nt, Human
gcugucccuuuuuaacaccca

SEQ ID NO: 69503 - RNA, 27 nt, Human
acuccucauguaaucuuugccucucuc

SEQ ID NO: 69504 - RNA, 20 nt, Human
cagaaacuacauggagugug

SEQ ID NO: 69505 - RNA, 27 nt, Human
ugucauugucucccaaaguauuuagga

SEQ ID NO: 69506 - RNA, 22 nt, Human
aacucacuggggagaaacccua

SEQ ID NO: 69507 - RNA, 17 nt, Human
uccuuagcaaugccuua

SEQ ID NO: 69508 - RNA, 22 nt, Human
aucacuugaaccuaggaggucg

SEQ ID NO: 69509 - RNA, 26 nt, Human
guugcagcugcucuugcaucugggcc

SEQ ID NO: 69510 - RNA, 20 nt, Human
cugcugucuaggauuuuguu

SEQ ID NO: 69511 - RNA, 21 nt, Human
aggaggcggagauugcaguga

SEQ ID NO: 69512 - RNA, 25 nt, Human
ugugccacuaaacuacauuguucuu

SEQ ID NO: 69513 - RNA, 23 nt, Human
ugacugcacuuguucucauagua

SEQ ID NO: 69514 - RNA, 25 nt, Human
gagagugagaaugggggugagcagg

SEQ ID NO: 69515 - RNA, 18 nt, Human
ggaguguccugcccaugc

SEQ ID NO: 69516 - RNA, 23 nt, Human
cugggaacucuggacuugagugu

SEQ ID NO: 69517 - RNA, 23 nt, Human
cccaaaccaccacaggugcuccu

SEQ ID NO: 69518 - RNA, 26 nt, Human
gaguauuucaucagcugaaaagugau

SEQ ID NO: 69519 - RNA, 32 nt, Human
ccgcagucccgcccgccgcauccucggcgccu

SEQ ID NO: 69520 - RNA, 26 nt, Human
ucuaucuccuugcacacaugggcaca

SEQ ID NO: 69521 - RNA, 21 nt, Human
ccuaugucaagagaagggaug

SEQ ID NO: 69522 - RNA, 22 nt, Human
caggaguuugaggcugcaauga

SEQ ID NO: 69523 - RNA, 23 nt, Human
ggggggucugcacccgggugggg

SEQ ID NO: 69524 - RNA, 21 nt, Human
ugcauuuuuaaauaaaauacc

SEQ ID NO: 69525 - RNA, 24 nt, Human
aagccugugcuccagagccuccag

SEQ ID NO: 69526 - RNA, 18 nt, Human
uuccuguccugcugguau

SEQ ID NO: 69527 - RNA, 19 nt, Human
uuagugccaccagacuaga

SEQ ID NO: 69528 - RNA, 15 nt, Human
cugccuggugcagug

SEQ ID NO: 69529 - RNA, 23 nt, Human
ccuagcuaaggugguaaaggcca

SEQ ID NO: 69530 - RNA, 21 nt, Human
aaacaguuugaauacugugaa

SEQ ID NO: 69531 - RNA, 22 nt, Human
auguaccagaagcacuagacca

SEQ ID NO: 69532 - RNA, 30 nt, Human
ccugucccugagcuuggccugcuggagcau

SEQ ID NO: 69533 - RNA, 22 nt, Human
cgaaagggugagacuccaucuc

SEQ ID NO: 69534 - RNA, 25 nt, Human
gccugggcuggaguccuugcuuugc

SEQ ID NO: 69535 - RNA, 25 nt, Human
gcucucuguugagaauuuucaugga

SEQ ID NO: 69536 - RNA, 26 nt, Human
agguggcagugaccagcgcccuggac

SEQ ID NO: 69537 - RNA, 27 nt, Human
cuuaccuccccuggcccuccuuucugg

SEQ ID NO: 69538 - RNA, 23 nt, Human
ccuucccuggccccgccggaugu

SEQ ID NO: 69539 - RNA, 20 nt, Human
uauuaagaauuaccuuucau

SEQ ID NO: 69540 - RNA, 17 nt, Human
gagcaguagacagcccu

SEQ ID NO: 69541 - RNA, 22 nt, Human
gcucacgccuguaaucccaggg

SEQ ID NO: 69542 - RNA, 22 nt, Human
aagggcugucugcagaaacccc

SEQ ID NO: 69543 - RNA, 25 nt, Human
ugauuuuuguucucccuucuugaag

SEQ ID NO: 69544 - RNA, 22 nt, Human
uucaucuaggcuaggugcagug

SEQ ID NO: 69545 - RNA, 20 nt, Human
auccccacucuacagaugag

SEQ ID NO: 69546 - RNA, 22 nt, Human
augucugaaaaaugccugcugc

SEQ ID NO: 69547 - RNA, 23 nt, Human
aaaacggaauaaaugacugagug

SEQ ID NO: 69548 - RNA, 29 nt, Human
agugauaccaguucagacacuaccccaua

SEQ ID NO: 69549 - RNA, 21 nt, Human
ucaguuuggaaaacccaaugg

SEQ ID NO: 69550 - RNA, 30 nt, Human
uggcuuuuagguuauucugcuuuagugcau

SEQ ID NO: 69551 - RNA, 27 nt, Human
cuguguuucuuuuucuccaugagaaag

SEQ ID NO: 69552 - RNA, 22 nt, Human
uugcugguuuuuaacuugggga

SEQ ID NO: 69553 - RNA, 23 nt, Human
agccuagugugugugcuuucuua

SEQ ID NO: 69554 - RNA, 20 nt, Human
aauacugugcuuacugugaa

SEQ ID NO: 69555 - RNA, 25 nt, Human
auagaggccuggcugacuggagcag

SEQ ID NO: 69556 - RNA, 27 nt, Human
gaaaagaaugaucuuuauuaaugacaa

SEQ ID NO: 69557 - RNA, 24 nt, Human
gccuuagagagagcgcgcucugcu

SEQ ID NO: 69558 - RNA, 24 nt, Human
cucugccauugucuaagccaccuc

SEQ ID NO: 69559 - RNA, 23 nt, Human
aaagucagugaaagacaaucuuu

SEQ ID NO: 69560 - RNA, 23 nt, Human
ucucacccaggcuggaaugcagu

SEQ ID NO: 69561 - RNA, 22 nt, Human
agcauuuugagaucagucuuua

SEQ ID NO: 69562 - RNA, 26 nt, Human
caugcuguuuuuccuauuugguuuga

SEQ ID NO: 69563 - RNA, 24 nt, Human
agaccucuuacuuccacugcuagu

SEQ ID NO: 69564 - RNA, 24 nt, Human
gcccgcucaggauggccugggcag

SEQ ID NO: 69565 - RNA, 27 nt, Human
gagggagagaauaaccugguguguuca

SEQ ID NO: 69566 - RNA, 24 nt, Human
uagcuaaaauauguaaaccuuucu

SEQ ID NO: 69567 - RNA, 25 nt, Human
ccucacugaggaagggagacauauu

SEQ ID NO: 69568 - RNA, 27 nt, Human
ggcccugcuggcagggacuugcagugg

SEQ ID NO: 69569 - RNA, 27 nt, Human
uccaugaguuugcccugguuucacugg

SEQ ID NO: 69570 - RNA, 26 nt, Human
gucuucuguccaucagugccauuucc

SEQ ID NO: 69571 - RNA, 22 nt, Human
ugcuauuuuuugcauuuuuugu

SEQ ID NO: 69572 - RNA, 29 nt, Human
ucugcuccuccuguucgacagucagccgc

SEQ ID NO: 69573 - RNA, 22 nt, Human
gccagcccccagccacagccuu

SEQ ID NO: 69574 - RNA, 26 nt, Human
gcuuuuguuuuuauuuauuuuuugcc

SEQ ID NO: 69575 - RNA, 23 nt, Human
cgaagacaaccaucacacuuauc

SEQ ID NO: 69576 - RNA, 23 nt, Human
guguuaauucuggucaguuucac

SEQ ID NO: 69577 - RNA, 28 nt, Human
ccagcugaagcccacugugugccaaagg

SEQ ID NO: 69578 - RNA, 28 nt, Human
ugcccugcuggggaaggccucacccagc

SEQ ID NO: 69579 - RNA, 21 nt, Human
cuccaucuuuuuacaguggca

SEQ ID NO: 69580 - RNA, 22 nt, Human
ugggcuggugugcaguggugcg

SEQ ID NO: 69581 - RNA, 21 nt, Human
gggcuuucauaguguucauug

SEQ ID NO: 69582 - RNA, 22 nt, Human
cucaaggacccucagcaacugg

SEQ ID NO: 69583 - RNA, 30 nt, Human
ccuggucucgaugggccucagucuucccau

SEQ ID NO: 69584 - RNA, 28 nt, Human
ucuuucagccuucaggcuguuuuuggcu

SEQ ID NO: 69585 - RNA, 25 nt, Human
uaugcacacacagaugcacacacag

SEQ ID NO: 69586 - RNA, 23 nt, Human
uguccgcccuucacaccuccagc

SEQ ID NO: 69587 - RNA, 23 nt, Human
cguucuguaaggagcaccaggac

SEQ ID NO: 69588 - RNA, 23 nt, Human
uccaguccugaaucaucuuggag

SEQ ID NO: 69589 - RNA, 21 nt, Human
ucacccaggaggagugggguc

SEQ ID NO: 69590 - RNA, 26 nt, Human
cugcgggggcaggccgggccugcugu

SEQ ID NO: 69591 - RNA, 20 nt, Human
uggcccacgaccaagggguc

SEQ ID NO: 69592 - RNA, 26 nt, Human
ucugccucucccugggucuggggaca

SEQ ID NO: 69593 - RNA, 23 nt, Human
gagacuuugcaaccuguucucag

SEQ ID NO: 69594 - RNA, 25 nt, Human
gcccaggcuggagugcaauggcgua

SEQ ID NO: 69595 - RNA, 22 nt, Human
accuuccuagugagcagcugcc

SEQ ID NO: 69596 - RNA, 28 nt, Human
ugucugugggcuucagcacuuuaaagag

SEQ ID NO: 69597 - RNA, 22 nt, Human
cccuguauucucagcacuuugg

SEQ ID NO: 69598 - RNA, 22 nt, Human
ggccuccgaaagugcugggauu

SEQ ID NO: 69599 - RNA, 25 nt, Human
gcccugcagagggaccagagcuugg

SEQ ID NO: 69600 - RNA, 22 nt, Human
agcugccucuuugcugcuuugu

SEQ ID NO: 69601 - RNA, 22 nt, Human
guuugccccucacccaccagcu

SEQ ID NO: 69602 - RNA, 22 nt, Human
ucaaugauuuuucacaagugga

SEQ ID NO: 69603 - RNA, 27 nt, Human
aaaugauuuuucuagagaacuauguuc

SEQ ID NO: 69604 - RNA, 22 nt, Human
aauuugagaaacuuacguauau

SEQ ID NO: 69605 - RNA, 20 nt, Human
cgguuuuuuauuuucuuuac

SEQ ID NO: 69606 - RNA, 23 nt, Human
aaccagccaaccaucauguguag

SEQ ID NO: 69607 - RNA, 17 nt, Human
gaacugcacagcccuug

SEQ ID NO: 69608 - RNA, 23 nt, Human
uucacuauccgccauucuuguca

SEQ ID NO: 69609 - RNA, 27 nt, Human
uuaccugcaggcugagccacucucuuc

SEQ ID NO: 69610 - RNA, 24 nt, Human
ugacaauauacuggagaaacuuug

SEQ ID NO: 69611 - RNA, 26 nt, Human
cucuccagaucuucaguugcuucagg

SEQ ID NO: 69612 - RNA, 24 nt, Human
auuuuucuggaagaacuagauuua

SEQ ID NO: 69613 - RNA, 21 nt, Human
ccaggggccucugggagccug

SEQ ID NO: 69614 - RNA, 22 nt, Human
uguguccuggggacuuccucag

SEQ ID NO: 69615 - RNA, 22 nt, Human
caggcuggagugcaguggcggg

SEQ ID NO: 69616 - RNA, 25 nt, Human
agcagauugcagaaaaacaggauua

SEQ ID NO: 69617 - RNA, 21 nt, Human
cgggcggaucaccugugguca

SEQ ID NO: 69618 - RNA, 23 nt, Human
gcucugcccucuccagaggugcc

SEQ ID NO: 69619 - RNA, 20 nt, Human
ugagcuuuggaucaaacuuu

SEQ ID NO: 69620 - RNA, 24 nt, Human
ccaucugcugucuuuucuuugcca

SEQ ID NO: 69621 - RNA, 29 nt, Human
agaugugcgugcagucuggcagccuuaag

SEQ ID NO: 69622 - RNA, 24 nt, Human
uucacagucuacugccuguuucca

SEQ ID NO: 69623 - RNA, 24 nt, Human
cgaggcuuggaccugcuguggagg

SEQ ID NO: 69624 - RNA, 23 nt, Human
acaagcagggaucagagcaacuc

SEQ ID NO: 69625 - RNA, 24 nt, Human
agcgauuucagaccuagcagggaa

SEQ ID NO: 69626 - RNA, 20 nt, Human
auuaacuguugcacuuuuga

SEQ ID NO: 69627 - RNA, 27 nt, Human
gggaauagggagacaggguaggaaagg

SEQ ID NO: 69628 - RNA, 26 nt, Human
gcugggacuacaggcaugagccacca

SEQ ID NO: 69629 - RNA, 26 nt, Human
uucuuuuaguuuaauagaugugcaua

SEQ ID NO: 69630 - RNA, 21 nt, Human
ucaaagcagcaaccacauagu

SEQ ID NO: 69631 - RNA, 20 nt, Human
cagaccccugggcaccucuc

SEQ ID NO: 69632 - RNA, 27 nt, Human
auuugcuuucguuuuguuuuccuugcu

SEQ ID NO: 69633 - RNA, 20 nt, Human
uaggcuucagguugcauugg

SEQ ID NO: 69634 - RNA, 22 nt, Human
gcaaaugcuucuggaaaacccu

SEQ ID NO: 69635 - RNA, 21 nt, Human
ccaggagaccuuccacaaagg

SEQ ID NO: 69636 - RNA, 27 nt, Human
gcuggauuggccgagcaagccuggaaa

SEQ ID NO: 69637 - RNA, 26 nt, Human
uggacuuuugcauuauuucauugugc

SEQ ID NO: 69638 - RNA, 22 nt, Human
acgcccauuuuccuacccacag

SEQ ID NO: 69639 - RNA, 24 nt, Human
uuuuuauguuguaaaaugcuagua

SEQ ID NO: 69640 - RNA, 25 nt, Human
ccggagcgggacccaggagccggcg

SEQ ID NO: 69641 - RNA, 21 nt, Human
aggaugugccugauagugcag

SEQ ID NO: 69642 - RNA, 27 nt, Human
gcacagcccgccccaagggucacgccc

SEQ ID NO: 69643 - RNA, 25 nt, Human
gagagggagucagcaggcaugcugc

SEQ ID NO: 69644 - RNA, 21 nt, Human
gcuggagcacagccuggggga

SEQ ID NO: 69645 - RNA, 23 nt, Human
uguguccaggcuggagugcagug

SEQ ID NO: 69646 - RNA, 19 nt, Human
uguuaaaauguacuuuuua

SEQ ID NO: 69647 - RNA, 21 nt, Human
gggagguagagguugcacuga

SEQ ID NO: 69648 - RNA, 22 nt, Human
cauggcagaaggaggccagcac

SEQ ID NO: 69649 - RNA, 26 nt, Human
ccacccuuggcuccugucccugcugc

SEQ ID NO: 69650 - RNA, 22 nt, Human
gaggaaggauaggcuguggaaa

SEQ ID NO: 69651 - RNA, 30 nt, Human
cuggaacugcagcagccaccccccggggcc

SEQ ID NO: 69652 - RNA, 22 nt, Human
agguacugcugauuauaaggcc

SEQ ID NO: 69653 - RNA, 21 nt, Human
agcucccugcagcaugggugc

SEQ ID NO: 69654 - RNA, 26 nt, Human
ucugugagaagccucuuuccgagucg

SEQ ID NO: 69655 - RNA, 22 nt, Human
aguccccccucuugucucccac

SEQ ID NO: 69656 - RNA, 19 nt, Human
gggucugagagucacugga

SEQ ID NO: 69657 - RNA, 19 nt, Human
ucucagauuuccacagaga

SEQ ID NO: 69658 - RNA, 20 nt, Human
uagcaggccccccaaaguag

SEQ ID NO: 69659 - RNA, 25 nt, Human
uguuuaugugcucucaaaacaugga

SEQ ID NO: 69660 - RNA, 22 nt, Human
cuugcagcuggguggcacugcc

SEQ ID NO: 69661 - RNA, 25 nt, Human
gcuucucugcugaucugagucugcc

SEQ ID NO: 69662 - RNA, 27 nt, Human
gauccucuauuuugugaugaugcugug

SEQ ID NO: 69663 - RNA, 26 nt, Human
ugcccaggagcugaagguggggguga

SEQ ID NO: 69664 - RNA, 21 nt, Human
ccucaagggucuucaggggag

SEQ ID NO: 69665 - RNA, 25 nt, Human
ccaggaggagcaggggccagcagug

SEQ ID NO: 69666 - RNA, 19 nt, Human
uuuaguaccuggagguuug

SEQ ID NO: 69667 - RNA, 30 nt, Human
cccugugacauuccuucguguugucauuug

SEQ ID NO: 69668 - RNA, 21 nt, Human
gcauuucucaaccaucucuca

SEQ ID NO: 69669 - RNA, 23 nt, Human
cucugugucucuccaucauucca

SEQ ID NO: 69670 - RNA, 23 nt, Human
guggggucuggucacacacaggu

SEQ ID NO: 69671 - RNA, 21 nt, Human
ggaggcggguccccuugugcg

SEQ ID NO: 69672 - RNA, 23 nt, Human
cuauggcaaggaucucugucacu

SEQ ID NO: 69673 - RNA, 22 nt, Human
ugccuguaccucucaagcuuug

SEQ ID NO: 69674 - RNA, 19 nt, Human
uuuuccauguugcccaggc

SEQ ID NO: 69675 - RNA, 22 nt, Human
cauugcacucccgccugggcga

SEQ ID NO: 69676 - RNA, 26 nt, Human
gccucgggggcagggcaugggcggcc

SEQ ID NO: 69677 - RNA, 23 nt, Human
ucaucgacgaggcgcacaaccug

SEQ ID NO: 69678 - RNA, 22 nt, Human
aaccuccacaucuccaaaaauc

SEQ ID NO: 69679 - RNA, 21 nt, Human
agagcccugugagccaaaaag

SEQ ID NO: 69680 - RNA, 21 nt, Human
uucuccucugagaaacauuuc

SEQ ID NO: 69681 - RNA, 31 nt, Human
uagccaucuuacuuggcuuuuuacuauuaac

SEQ ID NO: 69682 - RNA, 22 nt, Human
gcagacagcuccagacacucag

SEQ ID NO: 69683 - RNA, 22 nt, Human
aagcccaguuagucuuacugag

SEQ ID NO: 69684 - RNA, 22 nt, Human
ugccuccagcuguugaagggua

SEQ ID NO: 69685 - RNA, 24 nt, Human
aggaucuggcucuagguugggauc

SEQ ID NO: 69686 - RNA, 21 nt, Human
cucuccccuccaauccuaucc

SEQ ID NO: 69687 - RNA, 21 nt, Human
ucagcacugggcauucuugga

SEQ ID NO: 69688 - RNA, 26 nt, Human
aucuuagaguuuacaguuuguguuuu

SEQ ID NO: 69689 - RNA, 21 nt, Human
uucauuuccugcccuuccuca

SEQ ID NO: 69690 - RNA, 24 nt, Human
ucucuagcccaucauuaccuguga

SEQ ID NO: 69691 - RNA, 22 nt, Human
cuguccgguggacaaaaugaca

SEQ ID NO: 69692 - RNA, 24 nt, Human
agggcagccuuuuucccagcuucc

SEQ ID NO: 69693 - RNA, 19 nt, Human
ucugcagggucucugugau

SEQ ID NO: 69694 - RNA, 19 nt, Human
ccccaguuucacacauacc

SEQ ID NO: 69695 - RNA, 27 nt, Human
agcucacugaaguuucgaccugggcuc

SEQ ID NO: 69696 - RNA, 23 nt, Human
gcuccacccacaccuccaugacc

SEQ ID NO: 69697 - RNA, 22 nt, Human
uuugcaaauaguuuuucuuuaa

SEQ ID NO: 69698 - RNA, 22 nt, Human
gaggaaacgcccgcugugggcg

SEQ ID NO: 69699 - RNA, 24 nt, Human
ggcagggggaggggagugugagga

SEQ ID NO: 69700 - RNA, 27 nt, Human
uucuccucuccuagccccugucauggu

SEQ ID NO: 69701 - RNA, 23 nt, Human
cugcagcugauggaagaugagcc

SEQ ID NO: 69702 - RNA, 24 nt, Human
uguuacaggcucuaaagugcaaug

SEQ ID NO: 69703 - RNA, 27 nt, Human
cuguucgcugcccgaguauggagcugc

SEQ ID NO: 69704 - RNA, 26 nt, Human
acugggccaagugcaguggaucaugu

SEQ ID NO: 69705 - RNA, 27 nt, Human
uuggcugcuuucaucugaagcgccacu

SEQ ID NO: 69706 - RNA, 18 nt, Human
cuaauaugaaagaaaaau

SEQ ID NO: 69707 - RNA, 23 nt, Human
ggcaaucaaagcaugcacuugua

SEQ ID NO: 69708 - RNA, 27 nt, Human
cuuucagccuucugucaucaguaaaau

SEQ ID NO: 69709 - RNA, 22 nt, Human
ggaguauggaagaaaugcccaa

SEQ ID NO: 69710 - RNA, 26 nt, Human
uugaggcagggucucgcucugucacc

SEQ ID NO: 69711 - RNA, 27 nt, Human
ucucuucccccuuuuuggcauccuggc

SEQ ID NO: 69712 - RNA, 20 nt, Human
gcccucugguggccggcacg

SEQ ID NO: 69713 - RNA, 25 nt, Human
aacagggaugaagcacauuccuacc

SEQ ID NO: 69714 - RNA, 20 nt, Human
aggaaggaagagcagcagca

SEQ ID NO: 69715 - RNA, 23 nt, Human
uaacauaguaauucuuaagucuu

SEQ ID NO: 69716 - RNA, 26 nt, Human
cccugcccucccucuggacccccagc

SEQ ID NO: 69717 - RNA, 26 nt, Human
ucaucccucaguggcaacagaaacag

SEQ ID NO: 69718 - RNA, 26 nt, Human
ugcccaggcucacuucaguguugagu

SEQ ID NO: 69719 - RNA, 24 nt, Human
ucccugccaccucuuccucuauca

SEQ ID NO: 69720 - RNA, 25 nt, Human
cacugcucaccuaggcgcuagcaaa

SEQ ID NO: 69721 - RNA, 21 nt, Human
cccccaggcuggagugcagug

SEQ ID NO: 69722 - RNA, 21 nt, Human
cacccaggcuggagugccgug

SEQ ID NO: 69723 - RNA, 23 nt, Human
ugcccccauucauccuggcuuuc

SEQ ID NO: 69724 - RNA, 27 nt, Human
ccgacucugcacucuccacccuggcug

SEQ ID NO: 69725 - RNA, 23 nt, Human
augucuggaggcugauuuuccug

SEQ ID NO: 69726 - RNA, 23 nt, Human
caccaugagcuggaguggggaug

SEQ ID NO: 69727 - RNA, 28 nt, Human
agucuugcucuguagcccaggccagagu

SEQ ID NO: 69728 - RNA, 23 nt, Human
gggaggaagcagagggaggcaga

SEQ ID NO: 69729 - RNA, 22 nt, Human
ucauccagcccagaaaccaaga

SEQ ID NO: 69730 - RNA, 21 nt, Human
cucagggcccaucccuucucu

SEQ ID NO: 69731 - RNA, 20 nt, Human
gcgcaggcugggcugcaggc

SEQ ID NO: 69732 - RNA, 19 nt, Human
ggacuccuggucuccuccg

SEQ ID NO: 69733 - RNA, 20 nt, Human
augaagagacaaaaccuuua

SEQ ID NO: 69734 - RNA, 19 nt, Human
ggaaaaaaggccacaaaag

SEQ ID NO: 69735 - RNA, 29 nt, Human
ucucccuccucagcuccagggcagugucc

SEQ ID NO: 69736 - RNA, 26 nt, Human
uccuaagugucaccccgcuguaagcu

SEQ ID NO: 69737 - RNA, 20 nt, Human
ccuuuucagcagcuugccca

SEQ ID NO: 69738 - RNA, 23 nt, Human
auauguacuuacacuuugggcca

SEQ ID NO: 69739 - RNA, 25 nt, Human
agguugcaaacuggcaaccuguggu

SEQ ID NO: 69740 - RNA, 25 nt, Human
uauguucuucuucauugaauuucau

SEQ ID NO: 69741 - RNA, 23 nt, Human
acccuguggggcccagacuacag

SEQ ID NO: 69742 - RNA, 27 nt, Human
ggcuggcuggggccuaucagugugccc

SEQ ID NO: 69743 - RNA, 22 nt, Human
acugcaaccuccaccucgcagg

SEQ ID NO: 69744 - RNA, 25 nt, Human
aggcagggugugcucuagccuagcg

SEQ ID NO: 69745 - RNA, 23 nt, Human
uucagcucuggagcacagacuuu

SEQ ID NO: 69746 - RNA, 21 nt, Human
ucccaaacaccaccccaaucu

SEQ ID NO: 69747 - RNA, 27 nt, Human
ccugugcacagccccuaagucaacuua

SEQ ID NO: 69748 - RNA, 22 nt, Human
gugaagugaaugaaacacucag

SEQ ID NO: 69749 - RNA, 22 nt, Human
acugugugagaguguagaaggg

SEQ ID NO: 69750 - RNA, 27 nt, Human
gggaaacaaaauauuuauuuguuuugg

SEQ ID NO: 69751 - RNA, 23 nt, Human
ggugggcccucugugcucuucuc

SEQ ID NO: 69752 - RNA, 22 nt, Human
cagcugccauugcucccugucu

SEQ ID NO: 69753 - RNA, 19 nt, Human
augcauucacuucuccuuu

SEQ ID NO: 69754 - RNA, 22 nt, Human
ccauauuuuaaagauauuuuua

SEQ ID NO: 69755 - RNA, 18 nt, Human
gugacuucuauuuuaaag

SEQ ID NO: 69756 - RNA, 20 nt, Human
cuccuccauuuuacccccua

SEQ ID NO: 69757 - RNA, 23 nt, Human
ccagccucuucucucacuauccg

SEQ ID NO: 69758 - RNA, 22 nt, Human
cacuaugcauuaaaagcacuuu

SEQ ID NO: 69759 - RNA, 24 nt, Human
aguccacaucagaggcagagucag

SEQ ID NO: 69760 - RNA, 23 nt, Human
acauuaaaauacucacugaagag

SEQ ID NO: 69761 - RNA, 23 nt, Human
uugcccccacccuggcugccugc

SEQ ID NO: 69762 - RNA, 26 nt, Human
cccugccugccccgacacccagccca

SEQ ID NO: 69763 - RNA, 23 nt, Human
gucucucuauuacacuggagcug

SEQ ID NO: 69764 - RNA, 27 nt, Human
acuguggcacuugccugggucacacac

SEQ ID NO: 69765 - RNA, 22 nt, Human
cuggccccugaggcaguggcgg

SEQ ID NO: 69766 - RNA, 18 nt, Human
aggaagaguuuauggcaa

SEQ ID NO: 69767 - RNA, 27 nt, Human
aacacagagagacagacuugagaacuu

SEQ ID NO: 69768 - RNA, 23 nt, Human
ggcuucuguggcuuucauuugag

SEQ ID NO: 69769 - RNA, 25 nt, Human
cagugcuggagguccuggcaggguc

SEQ ID NO: 69770 - RNA, 26 nt, Human
aggacuagaggaagaaugcuccuggc

SEQ ID NO: 69771 - RNA, 22 nt, Human
ccucauuuacaaagcaaaaaga

SEQ ID NO: 69772 - RNA, 23 nt, Human
agcccuuuuuaaaugugauuucc

SEQ ID NO: 69773 - RNA, 20 nt, Human
gaccacucuuggcuauugaa

SEQ ID NO: 69774 - RNA, 19 nt, Human
uccaauuauuacaguccuu

SEQ ID NO: 69775 - RNA, 20 nt, Human
ggaccccgggaagggaaggc

SEQ ID NO: 69776 - RNA, 22 nt, Human
uacugcacuccagccuggggga

SEQ ID NO: 69777 - RNA, 24 nt, Human
ccauaauccugcauuucucuaaca

SEQ ID NO: 69778 - RNA, 17 nt, Human
caugggaaaaugccuua

SEQ ID NO: 69779 - RNA, 23 nt, Human
ccugggcagugcccaccaugcac

SEQ ID NO: 69780 - RNA, 22 nt, Human
ugugcaggcuggagugcagugg

SEQ ID NO: 69781 - RNA, 26 nt, Human
cauacagcagcgggaagugugccaag

SEQ ID NO: 69782 - RNA, 23 nt, Human
caucauauacagcucucugcucc

SEQ ID NO: 69783 - RNA, 21 nt, Human
ucuuuaguuccuccuggacaa

SEQ ID NO: 69784 - RNA, 28 nt, Human
aaggguggagaauggaggggaaccaggc

SEQ ID NO: 69785 - RNA, 22 nt, Human
ugcuucuugacuuuaacaucag

SEQ ID NO: 69786 - RNA, 23 nt, Human
ggagcagguggcuagaaaaagag

SEQ ID NO: 69787 - RNA, 26 nt, Human
cccgccaugggcgccccugccugcgc

SEQ ID NO: 69788 - RNA, 22 nt, Human
ccaccuccuggguucaagcgau

SEQ ID NO: 69789 - RNA, 27 nt, Human
uucugaccuuuuggugaaagcugagaa

SEQ ID NO: 69790 - RNA, 21 nt, Human
uuuggccuauguaauccugcc

SEQ ID NO: 69791 - RNA, 24 nt, Human
uugaugccauuguuuucuugaccu

SEQ ID NO: 69792 - RNA, 26 nt, Human
ugcccaggcucaggugcagcccccag

SEQ ID NO: 69793 - RNA, 22 nt, Human
aguauuuuuauucugguguuuu

SEQ ID NO: 69794 - RNA, 18 nt, Human
guagugaccuguuuauga

SEQ ID NO: 69795 - RNA, 19 nt, Human
cuuuaggguaaaaauugcg

SEQ ID NO: 69796 - RNA, 25 nt, Human
cacucaauacgcuggaguccacgug

SEQ ID NO: 69797 - RNA, 21 nt, Human
uagagaauuuagaaaugagac

SEQ ID NO: 69798 - RNA, 23 nt, Human
ucucaacuucauggugcgcugag

SEQ ID NO: 69799 - RNA, 23 nt, Human
cucucuggaugccuuccugcugc

SEQ ID NO: 69800 - RNA, 27 nt, Human
guuccucccugucaccugccuccucau

SEQ ID NO: 69801 - RNA, 27 nt, Human
ugacugaugcccaacacugcaucucuc

SEQ ID NO: 69802 - RNA, 27 nt, Human
uucugcaggaggcagcgacaguuucga

SEQ ID NO: 69803 - RNA, 24 nt, Human
aguccagggaaaagacuugcuugu

SEQ ID NO: 69804 - RNA, 14 nt, Human
uccacuaugccuua

SEQ ID NO: 69805 - RNA, 21 nt, Human
acguacugggauuacaggcgu

SEQ ID NO: 69806 - RNA, 21 nt, Human
ccuccuaugccucaucauguc

SEQ ID NO: 69807 - RNA, 25 nt, Human
gcccaggcuggagugcagugccaug

SEQ ID NO: 69808 - RNA, 22 nt, Human
cuuuuuauuuguguaaaggagg

SEQ ID NO: 69809 - RNA, 23 nt, Human
cggagcugcaaacugcagagccc

SEQ ID NO: 69810 - RNA, 27 nt, Human
cacguucagaagaauggaaggaaagcu

SEQ ID NO: 69811 - RNA, 23 nt, Human
cuuuucucccuggcuuuugguuc

SEQ ID NO: 69812 - RNA, 21 nt, Human
auuggaucuucaacuuugcca

SEQ ID NO: 69813 - RNA, 28 nt, Human
acauacuaugaagccucugauacuuaaa

SEQ ID NO: 69814 - RNA, 22 nt, Human
caucagcauucagccuccaaug

SEQ ID NO: 69815 - RNA, 25 nt, Human
caguuucacccucuauuuccaaagc

SEQ ID NO: 69816 - RNA, 21 nt, Human
aaaauacaaaaaauuagccag

SEQ ID NO: 69817 - RNA, 22 nt, Human
cucccguugcggcucccgccug

SEQ ID NO: 69818 - RNA, 23 nt, Human
gggaggccguccucggggugggg

SEQ ID NO: 69819 - RNA, 23 nt, Human
ugggaguagccacaugcucuugc

SEQ ID NO: 69820 - RNA, 24 nt, Human
uccaauaaaugaaaaucugucaga

SEQ ID NO: 69821 - RNA, 23 nt, Human
agggucaggcccuucagagccag

SEQ ID NO: 69822 - RNA, 23 nt, Human
uguacauccaaauuaaagggaaa

SEQ ID NO: 69823 - RNA, 22 nt, Human
ccugcaugcugcccagccacuc

SEQ ID NO: 69824 - RNA, 31 nt, Human
ccacucccggcacuccaugcuuagucacugc

SEQ ID NO: 69825 - RNA, 19 nt, Human
ccuucuuucucccuccgcc

SEQ ID NO: 69826 - RNA, 19 nt, Human
accccuuccaaugagcucc

SEQ ID NO: 69827 - RNA, 22 nt, Human
uguuaccaaaggugggguaggg

SEQ ID NO: 69828 - RNA, 23 nt, Human
ggacccaggaggcccaaggagcu

SEQ ID NO: 69829 - RNA, 22 nt, Human
ugcuugaacccagaaggcagag

SEQ ID NO: 69830 - RNA, 22 nt, Human
ucugaaucuagcccacuuggcg

SEQ ID NO: 69831 - RNA, 23 nt, Human
agagaaacccugcaauuuaaaug

SEQ ID NO: 69832 - RNA, 22 nt, Human
aacacuauuucuggaaugcuuc

SEQ ID NO: 69833 - RNA, 22 nt, Human
cuuucaaggucauucccuauca

SEQ ID NO: 69834 - RNA, 23 nt, Human
gcccagucucuucucuggaucug

SEQ ID NO: 69835 - RNA, 22 nt, Human
gcagagaagagaaccaugccag

SEQ ID NO: 69836 - RNA, 27 nt, Human
ucugcccucagcuucuuccugggagag

SEQ ID NO: 69837 - RNA, 23 nt, Human
uccuguaauguuaaacucuuugg

SEQ ID NO: 69838 - RNA, 22 nt, Human
cuucuaguggguuuaauguuua

SEQ ID NO: 69839 - RNA, 22 nt, Human
gccacagccaccucugcaucuu

SEQ ID NO: 69840 - RNA, 20 nt, Human
ugcaauuggugcacagcagg

SEQ ID NO: 69841 - RNA, 23 nt, Human
ugcagacaguccuuaaugcugaa

SEQ ID NO: 69842 - RNA, 17 nt, Human
agaaagucagcucuugu

SEQ ID NO: 69843 - RNA, 20 nt, Human
gcugcucuccguuuauuugg

SEQ ID NO: 69844 - RNA, 25 nt, Human
cagggaggagucaguaccccuggua

SEQ ID NO: 69845 - RNA, 19 nt, Human
agaaauuuaagcugcaaaa

SEQ ID NO: 69846 - RNA, 26 nt, Human
gggggaggggcaggagagggauaugg

SEQ ID NO: 69847 - RNA, 26 nt, Human
uccugcaggagucagcguucaaucuu

SEQ ID NO: 69848 - RNA, 23 nt, Human
accuggacucugcucccaggaag

SEQ ID NO: 69849 - RNA, 24 nt, Human
ugccaauaacaaauuccuacuucg

SEQ ID NO: 69850 - RNA, 24 nt, Human
ugggacugcugugaggcagaggaa

SEQ ID NO: 69851 - RNA, 22 nt, Human
agccagagacccuuauccacug

SEQ ID NO: 69852 - RNA, 21 nt, Human
ccugcacuccagccuggguga

SEQ ID NO: 69853 - RNA, 22 nt, Human
ccagaguaagagaagaugcuag

SEQ ID NO: 69854 - RNA, 27 nt, Human
aagcgugcagcccaaaugggcacuugc

SEQ ID NO: 69855 - RNA, 20 nt, Human
aucucugcugacgucacguc

SEQ ID NO: 69856 - RNA, 24 nt, Human
ucucuuccugcucuccaucauggc

SEQ ID NO: 69857 - RNA, 23 nt, Human
ugcuguacaacuuaauuguuuua

SEQ ID NO: 69858 - RNA, 22 nt, Human
gaacccaggagguggaaguugc

SEQ ID NO: 69859 - RNA, 26 nt, Human
uuacuccacuucgcuucucugcucca

SEQ ID NO: 69860 - RNA, 24 nt, Human
uaugaagccuuuggugaauuccuu

SEQ ID NO: 69861 - RNA, 27 nt, Human
ugugauuuuugcuaguccaugugcuag

SEQ ID NO: 69862 - RNA, 21 nt, Human
uuaccuaagauuacaaaucag

SEQ ID NO: 69863 - RNA, 25 nt, Human
uauucccucuaggaaccuuggaggg

SEQ ID NO: 69864 - RNA, 23 nt, Human
gguggccgggcugaagaagcagu

SEQ ID NO: 69865 - RNA, 20 nt, Human
auggaaaugauuuucauuga

SEQ ID NO: 69866 - RNA, 24 nt, Human
uuccuguucccuccugguccugga

SEQ ID NO: 69867 - RNA, 23 nt, Human
aaggaggugaaggucaugcgaug

SEQ ID NO: 69868 - RNA, 20 nt, Human
agggcagccuauuaucccac

SEQ ID NO: 69869 - RNA, 27 nt, Human
agagacaccugagaaucgauggcucag

SEQ ID NO: 69870 - RNA, 22 nt, Human
uucuaaagauaaagauuuugga

SEQ ID NO: 69871 - RNA, 21 nt, Human
accgucacagugcaccucugg

SEQ ID NO: 69872 - RNA, 26 nt, Human
uugcccagguggauaaauguguacau

SEQ ID NO: 69873 - RNA, 27 nt, Human
agcucacugcaaccuucgccaccuggg

SEQ ID NO: 69874 - RNA, 22 nt, Human
aagaugcucuggcuucucucuu

SEQ ID NO: 69875 - RNA, 22 nt, Human
ggucuuuuucuuuccuccuaau

SEQ ID NO: 69876 - RNA, 26 nt, Human
agcaggaauucaaagcugcuugcugu

SEQ ID NO: 69877 - RNA, 25 nt, Human
ugcuuuguaguuugcuuugcuuugu

SEQ ID NO: 69878 - RNA, 21 nt, Human
agcaguuuuccccuggccuca

SEQ ID NO: 69879 - RNA, 21 nt, Human
ucauucuccuuucugcccaua

SEQ ID NO: 69880 - RNA, 22 nt, Human
gggauuacaggcuugagccacc

SEQ ID NO: 69881 - RNA, 21 nt, Human
ucucacucugaauaaaggaca

SEQ ID NO: 69882 - RNA, 23 nt, Human
uucucucuccaaauauuaacuaa

SEQ ID NO: 69883 - RNA, 24 nt, Human
ucaguccccuucacugcagagccu

SEQ ID NO: 69884 - RNA, 23 nt, Human
ucugucugcugcucccucuccuc

SEQ ID NO: 69885 - RNA, 21 nt, Human
cggauaguucccgagggucau

SEQ ID NO: 69886 - RNA, 23 nt, Human
ccugaacuaaacaucacacacug

SEQ ID NO: 69887 - RNA, 24 nt, Human
cucagcuuucuuaaaaugggaucu

SEQ ID NO: 69888 - RNA, 21 nt, Human
uaugcuuuuauaggccugugu

SEQ ID NO: 69889 - RNA, 21 nt, Human
gcaguuacacaguuuccugua

SEQ ID NO: 69890 - RNA, 24 nt, Human
guuaucuguguccauuuccaaaac

SEQ ID NO: 69891 - RNA, 23 nt, Human
ugcccuccaggagguuccucaca

SEQ ID NO: 69892 - RNA, 26 nt, Human
ccugugauccuagcacuuugcgaggc

SEQ ID NO: 69893 - RNA, 29 nt, Human
gggacaccccuacacacacccaggcccac

SEQ ID NO: 69894 - RNA, 19 nt, Human
uacuucagaagcggaggca

SEQ ID NO: 69895 - RNA, 23 nt, Human
gaaagguugaaauauugaguggu

SEQ ID NO: 69896 - RNA, 22 nt, Human
ccuuagguaaaacaaaaauauu

SEQ ID NO: 69897 - RNA, 22 nt, Human
gcccugcagacaaaagcugguu

SEQ ID NO: 69898 - RNA, 26 nt, Human
ucuuuuguuugauauuuuuucucucc

SEQ ID NO: 69899 - RNA, 22 nt, Human
cuugcacuuucagacucucucu

SEQ ID NO: 69900 - RNA, 24 nt, Human
ccaagcccacggccaugcacaggg

SEQ ID NO: 69901 - RNA, 22 nt, Human
cuguggaaaaccuucuguugcu

SEQ ID NO: 69902 - RNA, 22 nt, Human
ccugcugcuucucugucuccga

SEQ ID NO: 69903 - RNA, 21 nt, Human
cuagggagaaugcagagaggu

SEQ ID NO: 69904 - RNA, 26 nt, Human
ggcccgggcagggagaagugugcggg

SEQ ID NO: 69905 - RNA, 21 nt, Human
gcagugagccaagaucgcgcu

SEQ ID NO: 69906 - RNA, 22 nt, Human
auuuccccucuguccuccaucc

SEQ ID NO: 69907 - RNA, 24 nt, Human
ccuguaguuuauaguaaugacggu

SEQ ID NO: 69908 - RNA, 23 nt, Human
cucgcuucuucacuuucuuuucc

SEQ ID NO: 69909 - RNA, 23 nt, Human
ucaccagcaaccaugacggacca

SEQ ID NO: 69910 - RNA, 28 nt, Human
ccacugcucuccagccuggcgacagagg

SEQ ID NO: 69911 - RNA, 26 nt, Human
agccucuacuccagccaacauuuuaa

SEQ ID NO: 69912 - RNA, 21 nt, Human
cugcacguuucuuucucucuu

SEQ ID NO: 69913 - RNA, 21 nt, Human
gcguuuugccuuuaacacuaa

SEQ ID NO: 69914 - RNA, 17 nt, Human
cuucuugccaagccuca

SEQ ID NO: 69915 - RNA, 20 nt, Human
gaacaguguuuuaugcuggg

SEQ ID NO: 69916 - RNA, 21 nt, Human
aggagcuugggcagugcccca

SEQ ID NO: 69917 - RNA, 27 nt, Human
ugcagcuccugccgggcaacaugucaa

SEQ ID NO: 69918 - RNA, 22 nt, Human
ggcagccccacaccugcccuug

SEQ ID NO: 69919 - RNA, 22 nt, Human
gucaucuguuuaauuuacacac

SEQ ID NO: 69920 - RNA, 26 nt, Human
ccugugccacaggaaaagagggccug

SEQ ID NO: 69921 - RNA, 20 nt, Human
ugugcccagguggaguuaga

SEQ ID NO: 69922 - RNA, 24 nt, Human
auuuaacaguugccuuuuuucuua

SEQ ID NO: 69923 - RNA, 18 nt, Human
uggguggaaaggugugag

SEQ ID NO: 69924 - RNA, 26 nt, Human
ggcuggagagaagccgugguggugaa

SEQ ID NO: 69925 - RNA, 24 nt, Human
aggauuuuuaugaaauuauauugc

SEQ ID NO: 69926 - RNA, 20 nt, Human
aagggaaaaguucucaggga

SEQ ID NO: 69927 - RNA, 23 nt, Human
uaaagagccuucacugguucugc

SEQ ID NO: 69928 - RNA, 26 nt, Human
ggcccaggcuagagugcaguggugcg

SEQ ID NO: 69929 - RNA, 24 nt, Human
cagaaguauuuauacuucauuuug

SEQ ID NO: 69930 - RNA, 23 nt, Human
cagcugucgcaucucagcggggc

SEQ ID NO: 69931 - RNA, 27 nt, Human
ucuguaaccacagguucgguggugaga

SEQ ID NO: 69932 - RNA, 25 nt, Human
gagcuaggauggggaaccugccaca

SEQ ID NO: 69933 - RNA, 23 nt, Human
ugcuaaaagauguuaauauacau

SEQ ID NO: 69934 - RNA, 21 nt, Human
gccacugcauuccagccuggg

SEQ ID NO: 69935 - RNA, 23 nt, Human
uuggagacuaugaccaagccaau

SEQ ID NO: 69936 - RNA, 20 nt, Human
augauacaaacuuccaucug

SEQ ID NO: 69937 - RNA, 22 nt, Human
auuuucucauuuucuuuucacu

SEQ ID NO: 69938 - RNA, 23 nt, Human
ucuuuccccagcuucugucuguc

SEQ ID NO: 69939 - RNA, 21 nt, Human
aaccaaacaaaugcuuuuugg

SEQ ID NO: 69940 - RNA, 21 nt, Human
uucccaccacauacuaggcac

SEQ ID NO: 69941 - RNA, 23 nt, Human
aggauggagugcaguggugagau

SEQ ID NO: 69942 - RNA, 23 nt, Human
aggcuggaguguaguggugugau

SEQ ID NO: 69943 - RNA, 23 nt, Human
aggcuggagugcaguggugcgau

SEQ ID NO: 69944 - RNA, 23 nt, Human
agguuggagugcaguggugugau

SEQ ID NO: 69945 - RNA, 21 nt, Human
ggaggggguccagaagaucau

SEQ ID NO: 69946 - RNA, 26 nt, Human
cuugcaugcuuguacuugacuucuua

SEQ ID NO: 69947 - RNA, 25 nt, Human
agccugggcuggaguccuugcuuug

SEQ ID NO: 69948 - RNA, 26 nt, Human
ccagccgcccgcgcccuccagccccg

SEQ ID NO: 69949 - RNA, 22 nt, Human
ggcaugguaggcuacuuuucag

SEQ ID NO: 69950 - RNA, 19 nt, Human
ccagcacuuuggcaggccg

SEQ ID NO: 69951 - RNA, 27 nt, Human
gcuugucugcugcuccaaaucacuuag

SEQ ID NO: 69952 - RNA, 21 nt, Human
ggaauggcugagggaggcagg

SEQ ID NO: 69953 - RNA, 27 nt, Human
gcaccuggaaguggagugcaggcugca

SEQ ID NO: 69954 - RNA, 24 nt, Human
cuuucgccaaggcuggagugcagu

SEQ ID NO: 69955 - RNA, 21 nt, Human
ccucugcugccgcccuuccug

SEQ ID NO: 69956 - RNA, 21 nt, Human
aggcugaagugcaguggagca

SEQ ID NO: 69957 - RNA, 26 nt, Human
cuagcaccuggugugguacaggagga

SEQ ID NO: 69958 - RNA, 21 nt, Human
auugguauuaacuaugaucau

SEQ ID NO: 69959 - RNA, 25 nt, Human
acaauuauaaucaccagcaguguga

SEQ ID NO: 69960 - RNA, 22 nt, Human
uaggccugugguuccccugcuc

SEQ ID NO: 69961 - RNA, 22 nt, Human
cgccuguaauccuagcaguuug

SEQ ID NO: 69962 - RNA, 24 nt, Human
caggccuguggccccaccgagcug

SEQ ID NO: 69963 - RNA, 23 nt, Human
ccugggguuucuagacuggggcc

SEQ ID NO: 69964 - RNA, 26 nt, Human
gugaaggaggagaacuugggagccag

SEQ ID NO: 69965 - RNA, 22 nt, Human
agugaguacaugcacacucaug

SEQ ID NO: 69966 - RNA, 21 nt, Human
uaaaacucccuuccuuaugca

SEQ ID NO: 69967 - RNA, 24 nt, Human
cggaguuuuagcaaaacagcuagc

SEQ ID NO: 69968 - RNA, 23 nt, Human
caggcagccuucauaggcgguca

SEQ ID NO: 69969 - RNA, 20 nt, Human
ccauguuuacuucaaaaaga

SEQ ID NO: 69970 - RNA, 21 nt, Human
gggaagggaagaagaggacga

SEQ ID NO: 69971 - RNA, 27 nt, Human
gagagugagaaauggcagucugccugc

SEQ ID NO: 69972 - RNA, 26 nt, Human
guuuuuaagaaagaacuucuaacccc

SEQ ID NO: 69973 - RNA, 20 nt, Human
uccaguccuccccuuggauc

SEQ ID NO: 69974 - RNA, 22 nt, Human
cgccucccggauucaagcaauu

SEQ ID NO: 69975 - RNA, 22 nt, Human
cgccucccggguucaagcgauu

SEQ ID NO: 69976 - RNA, 26 nt, Human
gcagugaaaucacaguuacaaaagcg

SEQ ID NO: 69977 - RNA, 19 nt, Human
cuccgaggcuccccgccuc

SEQ ID NO: 69978 - RNA, 22 nt, Human
guuuuuaaaagguccaguucua

SEQ ID NO: 69979 - RNA, 23 nt, Human
ccugaucuuaacccuuuccuggg

SEQ ID NO: 69980 - RNA, 27 nt, Human
ucuccacccuggcugggaucagagcag

SEQ ID NO: 69981 - RNA, 28 nt, Human
uucaaaaccauuauuccugugacuggag

SEQ ID NO: 69982 - RNA, 24 nt, Human
caguacucaucuuggcccugggaa

SEQ ID NO: 69983 - RNA, 21 nt, Human
guauacgggguuacaaaaaga

SEQ ID NO: 69984 - RNA, 20 nt, Human
agagaauauuuacaauauau

SEQ ID NO: 69985 - RNA, 29 nt, Human
ggugcugcugcuccugcagcugccuuuuc

SEQ ID NO: 69986 - RNA, 23 nt, Human
gccucuaaucccagcuacucagg

SEQ ID NO: 69987 - RNA, 23 nt, Human
uuuguagcuuguuagauuuucug

SEQ ID NO: 69988 - RNA, 24 nt, Human
gugguugcggcgcgggaaguuugg

SEQ ID NO: 69989 - RNA, 26 nt, Human
cacagccaaaccccagaucaucugaa

SEQ ID NO: 69990 - RNA, 27 nt, Human
uucucucuacugaauaucauacguuac

SEQ ID NO: 69991 - RNA, 22 nt, Human
cggcugagauuggcagagugaa

SEQ ID NO: 69992 - RNA, 26 nt, Human
caaggacagcuuccugggggcagcac

SEQ ID NO: 69993 - RNA, 22 nt, Human
ccagaguauugggauuacagac

SEQ ID NO: 69994 - RNA, 20 nt, Human
uuuaguauugcuauuaaaag

SEQ ID NO: 69995 - RNA, 21 nt, Human
caaccaaagugugucaacccu

SEQ ID NO: 69996 - RNA, 15 nt, Human
accugaaaugccuuc

SEQ ID NO: 69997 - RNA, 20 nt, Human
guguccaugugugugcagug

SEQ ID NO: 69998 - RNA, 26 nt, Human
ucgcucaggcuggagugccauggcgc

SEQ ID NO: 69999 - RNA, 27 nt, Human
uccugcucugcuaacccugcgugcacc

SEQ ID NO: 70000 - RNA, 23 nt, Human
cagcacaugcuggccagccuggg

SEQ ID NO: 70001 - RNA, 24 nt, Human
agaacccaaacugccuuugccuca

SEQ ID NO: 70002 - RNA, 19 nt, Human
uuuccucucaucacuguga

SEQ ID NO: 70003 - RNA, 20 nt, Human
aggguggaagaugaaaugaa

SEQ ID NO: 70004 - RNA, 25 nt, Human
ggggcggggcgccagcgcugccuuu

SEQ ID NO: 70005 - RNA, 26 nt, Human
cuucaccaguuuuacaaugaguuauc

SEQ ID NO: 70006 - RNA, 21 nt, Human
gcucaggaacuagacugccug

SEQ ID NO: 70007 - RNA, 27 nt, Human
cccuccaggggcugacaccuagagaga

SEQ ID NO: 70008 - RNA, 19 nt, Human
uggaagaauacaauauaug

SEQ ID NO: 70009 - RNA, 25 nt, Human
ugcagcucagguuucggggugcuug

SEQ ID NO: 70010 - RNA, 27 nt, Human
aagacuuggugccaccgccagcaauaa

SEQ ID NO: 70011 - RNA, 27 nt, Human
uggccaacauggcgaaacuccgucacu

SEQ ID NO: 70012 - RNA, 22 nt, Human
ugcggccagucccuggugcccu

SEQ ID NO: 70013 - RNA, 25 nt, Human
cuguaaacccagggcuuuagaaggc

SEQ ID NO: 70014 - RNA, 22 nt, Human
gccugcccuuugcaagcagguu

SEQ ID NO: 70015 - RNA, 22 nt, Human
augcacaaacuuggcuucuuua

SEQ ID NO: 70016 - RNA, 22 nt, Human
uacccaggcuggagugcaauga

SEQ ID NO: 70017 - RNA, 27 nt, Human
uccuccagggacugcugugaaaucaag

SEQ ID NO: 70018 - RNA, 20 nt, Human
aacagagcuaacaccaccuu

SEQ ID NO: 70019 - RNA, 22 nt, Human
gcuuuuaaaaaauauauuccua

SEQ ID NO: 70020 - RNA, 24 nt, Human
gcacccccagcagcccacagcgcu

SEQ ID NO: 70021 - RNA, 23 nt, Human
uugcucuuaacgucacacacuac

SEQ ID NO: 70022 - RNA, 23 nt, Human
ucaucccuugggauaagccccag

SEQ ID NO: 70023 - RNA, 23 nt, Human
agucuguuccccuucucagguag

SEQ ID NO: 70024 - RNA, 30 nt, Human
ugaccuuaggcauggagaaaauuacuuguu

SEQ ID NO: 70025 - RNA, 21 nt, Human
ccacaggcacacaggucucau

SEQ ID NO: 70026 - RNA, 24 nt, Human
gugagcuaugggaaggccauuggu

SEQ ID NO: 70027 - RNA, 21 nt, Human
gacuccugggcucaagcaauc

SEQ ID NO: 70028 - RNA, 26 nt, Human
aggcaagaaugcagcaggagccagaa

SEQ ID NO: 70029 - RNA, 32 nt, Human
ccuuuagcaagaugucacaccuuguuguacau

SEQ ID NO: 70030 - RNA, 17 nt, Human
cagguguguugcagugu

SEQ ID NO: 70031 - RNA, 32 nt, Human
acaguacaucuggagccuggagauauccucag

SEQ ID NO: 70032 - RNA, 27 nt, Human
uccaugccauugcaccuucuuuagucu

SEQ ID NO: 70033 - RNA, 21 nt, Human
ggugccacagcugaagucagu

SEQ ID NO: 70034 - RNA, 27 nt, Human
cuuccucuuuauagggagacacucuga

SEQ ID NO: 70035 - RNA, 21 nt, Human
ucucugagaaguggggugugg

SEQ ID NO: 70036 - RNA, 20 nt, Human
cacuguuuauucaacaacua

SEQ ID NO: 70037 - RNA, 27 nt, Human
ugucccaggcuguggugccacccucuc

SEQ ID NO: 70038 - RNA, 19 nt, Human
gugggugggggaggaagag

SEQ ID NO: 70039 - RNA, 22 nt, Human
ucacccccucacacaggcccag

SEQ ID NO: 70040 - RNA, 23 nt, Human
caguuuaucuagguugcaguggc

SEQ ID NO: 70041 - RNA, 24 nt, Human
gauuuuuacuuccaacugcugaua

SEQ ID NO: 70042 - RNA, 20 nt, Human
uagggugcuggacuguaugg

SEQ ID NO: 70043 - RNA, 21 nt, Human
auaauuggaacgcacacugcc

SEQ ID NO: 70044 - RNA, 20 nt, Human
cugacuccucuggcuuuccc

SEQ ID NO: 70045 - RNA, 21 nt, Human
gggagcugaaaaggaucgagg

SEQ ID NO: 70046 - RNA, 19 nt, Human
gcuggggagagcaagcggc

SEQ ID NO: 70047 - RNA, 20 nt, Human
uacugcacugcccuggucga

SEQ ID NO: 70048 - RNA, 30 nt, Human
aaccugcucaccccacaugaccuucugugu

SEQ ID NO: 70049 - RNA, 22 nt, Human
gcucacgccuguaauccuggca

SEQ ID NO: 70050 - RNA, 21 nt, Human
agcgaagccucggggcccaag

SEQ ID NO: 70051 - RNA, 28 nt, Human
gccaggugcuuuagcagcguggcugccu

SEQ ID NO: 70052 - RNA, 18 nt, Human
ccacggcccaggucuccu

SEQ ID NO: 70053 - RNA, 25 nt, Human
aauuaaaauauauuauguuucucca

SEQ ID NO: 70054 - RNA, 22 nt, Human
cuggcaccugggaacgcuaugg

SEQ ID NO: 70055 - RNA, 22 nt, Human
caguguugcaagagucugggcu

SEQ ID NO: 70056 - RNA, 27 nt, Human
cuguguuuuaaaaggcaagucaaauac

SEQ ID NO: 70057 - RNA, 24 nt, Human
cuugggcaggucuagugagcugua

SEQ ID NO: 70058 - RNA, 19 nt, Human
ugaacucucagacaucucu

SEQ ID NO: 70059 - RNA, 22 nt, Human
cuaacauggugaaauccuaucu

SEQ ID NO: 70060 - RNA, 22 nt, Human
ccaacaugguaaaaucccgucu

SEQ ID NO: 70061 - RNA, 26 nt, Human
ugaaauccugucaugaauccuuggua

SEQ ID NO: 70062 - RNA, 27 nt, Human
gggaggcggagguugcagugaaccaag

SEQ ID NO: 70063 - RNA, 21 nt, Human
gacuucugaucuuugucuacu

SEQ ID NO: 70064 - RNA, 24 nt, Human
ugucuccguaaauggaggaaaugu

SEQ ID NO: 70065 - RNA, 24 nt, Human
ggagcugugggcggcagcugcguc

SEQ ID NO: 70066 - RNA, 26 nt, Human
gucccaagccccccaucuccacuucc

SEQ ID NO: 70067 - RNA, 20 nt, Human
ugaagugccuugugaacccu

SEQ ID NO: 70068 - RNA, 23 nt, Human
cccaggaggcggagcuugcagug

SEQ ID NO: 70069 - RNA, 27 nt, Human
cccagagugcugggauuacaauuguga

SEQ ID NO: 70070 - RNA, 26 nt, Human
ggcuccugccaucuccucugccauga

SEQ ID NO: 70071 - RNA, 21 nt, Human
caggacucccccaucuugcug

SEQ ID NO: 70072 - RNA, 21 nt, Human
ugagagaauggaagcaaccaa

SEQ ID NO: 70073 - RNA, 24 nt, Human
ucugcuuccugugggacguggugg

SEQ ID NO: 70074 - RNA, 23 nt, Human
ggggagccacuggggagggggug

SEQ ID NO: 70075 - RNA, 28 nt, Human
ucacaguacccaaacugcuuuuuccaac

SEQ ID NO: 70076 - RNA, 21 nt, Human
aguggucucauucacaaaaaa

SEQ ID NO: 70077 - RNA, 24 nt, Human
auuuuaugcccugaucagacuagc

SEQ ID NO: 70078 - RNA, 22 nt, Human
uauucccuauuuguuuucuucu

SEQ ID NO: 70079 - RNA, 23 nt, Human
ggacacauccucuccacccucug

SEQ ID NO: 70080 - RNA, 27 nt, Human
aauucaccuguguuucguguauaugcc

SEQ ID NO: 70081 - RNA, 24 nt, Human
gggagagacagagaagugggcagg

SEQ ID NO: 70082 - RNA, 22 nt, Human
gguggaugaggaaacaggcacc

SEQ ID NO: 70083 - RNA, 26 nt, Human
cucuaacucuuaucuuccacaggguc

SEQ ID NO: 70084 - RNA, 27 nt, Human
acagagcccuggcuuugaccugcucag

SEQ ID NO: 70085 - RNA, 22 nt, Human
cugaguagcugggaccacaggc

SEQ ID NO: 70086 - RNA, 21 nt, Human
aggcauuggacgugacaauca

SEQ ID NO: 70087 - RNA, 22 nt, Human
ugaauccuuguaucuuuauuug

SEQ ID NO: 70088 - RNA, 18 nt, Human
cccgcucugcugcaugcc

SEQ ID NO: 70089 - RNA, 22 nt, Human
ggcauacagcacccucuaccuc

SEQ ID NO: 70090 - RNA, 23 nt, Human
gacgggguuucaccauguugacc

SEQ ID NO: 70091 - RNA, 26 nt, Human
cccagccucaggugcuccgggaacgc

SEQ ID NO: 70092 - RNA, 21 nt, Human
cagccagaggagccugugauu

SEQ ID NO: 70093 - RNA, 21 nt, Human
uuccuuaaggauuuuagccag

SEQ ID NO: 70094 - RNA, 26 nt, Human
ucuguguugcugugaaaugaaugaag

SEQ ID NO: 70095 - RNA, 22 nt, Human
uauuguaauccuagcacuuugg

SEQ ID NO: 70096 - RNA, 22 nt, Human
gcugguggcgccacaggcgcug

SEQ ID NO: 70097 - RNA, 20 nt, Human
gcagcccagccuagucaggg

SEQ ID NO: 70098 - RNA, 19 nt, Human
cagguagauaaaacugaca

SEQ ID NO: 70099 - RNA, 22 nt, Human
gaagacacagaaccaacaaaac

SEQ ID NO: 70100 - RNA, 21 nt, Human
uagagaugaauuuucugagaa

SEQ ID NO: 70101 - RNA, 20 nt, Human
gcaccuugcagauuuucuua

SEQ ID NO: 70102 - RNA, 25 nt, Human
aguuaguugcucacacacuuaggcu

SEQ ID NO: 70103 - RNA, 24 nt, Human
cauccaggcuggacaguucaguga

SEQ ID NO: 70104 - RNA, 22 nt, Human
cuuuguuuuucuccacugagca

SEQ ID NO: 70105 - RNA, 26 nt, Human
uguccaccaccuuuccuggccuugcu

SEQ ID NO: 70106 - RNA, 25 nt, Human
caccagcucuccagccugcucgucc

SEQ ID NO: 70107 - RNA, 23 nt, Human
cauccuccaagaccacccagcuu

SEQ ID NO: 70108 - RNA, 22 nt, Human
cacugcacuccagccuggguga

SEQ ID NO: 70109 - RNA, 25 nt, Human
ccuguagcaaccuucugcauucaua

SEQ ID NO: 70110 - RNA, 30 nt, Human
gcuaggcugcagacugccuuguacucccug

SEQ ID NO: 70111 - RNA, 17 nt, Human
gcugccccugccugugu

SEQ ID NO: 70112 - RNA, 20 nt, Human
cacugacgggcacugagccu

SEQ ID NO: 70113 - RNA, 23 nt, Human
uguugccagguugcagcugcucu

SEQ ID NO: 70114 - RNA, 20 nt, Human
ggggcagcagcacagcgugg

SEQ ID NO: 70115 - RNA, 19 nt, Human
ugugcagauuuucccacug

SEQ ID NO: 70116 - RNA, 19 nt, Human
ggguguccacagcacuggc

SEQ ID NO: 70117 - RNA, 25 nt, Human
gccauugcucccugucuguuucccc

SEQ ID NO: 70118 - RNA, 20 nt, Human
aagcagccauuggcacugug

SEQ ID NO: 70119 - RNA, 25 nt, Human
ccucacuugccaaauucuggcuuca

SEQ ID NO: 70120 - RNA, 23 nt, Human
gccacaauccuaugcucuugccu

SEQ ID NO: 70121 - RNA, 26 nt, Human
gccuccugagccuguggguccccacu

SEQ ID NO: 70122 - RNA, 21 nt, Human
gcagugaaccaagaucacgcc

SEQ ID NO: 70123 - RNA, 26 nt, Human
uuucucucacucuucugucauuugcu

SEQ ID NO: 70124 - RNA, 20 nt, Human
gguggagcuccuggaggcug

SEQ ID NO: 70125 - RNA, 20 nt, Human
gauuuguugccaugugcacc

SEQ ID NO: 70126 - RNA, 27 nt, Human
aggcuggagacagggaggccuuccacu

SEQ ID NO: 70127 - RNA, 23 nt, Human
cacccuggugggccaacaaagaa

SEQ ID NO: 70128 - RNA, 22 nt, Human
ugguuguccacuaaaccccaua

SEQ ID NO: 70129 - RNA, 21 nt, Human
gggagcacauggguuauaaug

SEQ ID NO: 70130 - RNA, 23 nt, Human
cagaaccauaaagcauauguguu

SEQ ID NO: 70131 - RNA, 26 nt, Human
gguuccgccgccuccagcgccccauc

SEQ ID NO: 70132 - RNA, 27 nt, Human
gagcagugaguuacagcgagaggcaga

SEQ ID NO: 70133 - RNA, 19 nt, Human
gagcacuucuggagacugc

SEQ ID NO: 70134 - RNA, 25 nt, Human
ggaccaucuggggcaccugcuucca

SEQ ID NO: 70135 - RNA, 26 nt, Human
uuauccaggcugagauggaaaacaag

SEQ ID NO: 70136 - RNA, 27 nt, Human
gggggagcuggggagccucccccuacc

SEQ ID NO: 70137 - RNA, 27 nt, Human
aucucuagcccagcuacagcagaauac

SEQ ID NO: 70138 - RNA, 23 nt, Human
aggaagcugugcagcaugcuccu

SEQ ID NO: 70139 - RNA, 25 nt, Human
gguuggacuucaccucucagcacug

SEQ ID NO: 70140 - RNA, 25 nt, Human
ccagccgccaccgccgccgcaccag

SEQ ID NO: 70141 - RNA, 20 nt, Human
cauugcagagcuacuuuucu

SEQ ID NO: 70142 - RNA, 32 nt, Human
ucugcccaccauggcccuggugcugauccucc

SEQ ID NO: 70143 - RNA, 25 nt, Human
ucugucauucagggcauagcucacu

SEQ ID NO: 70144 - RNA, 21 nt, Human
uguuucacaacacuccuggcc

SEQ ID NO: 70145 - RNA, 21 nt, Human
cugccucugaagccagguguu

SEQ ID NO: 70146 - RNA, 22 nt, Human
ggaggcugaggcagguggauca

SEQ ID NO: 70147 - RNA, 20 nt, Human
acaucuuggaugucaagugc

SEQ ID NO: 70148 - RNA, 20 nt, Human
uucucucucauuuggacuug

SEQ ID NO: 70149 - RNA, 24 nt, Human
ugucuaaauaaguuugcaauuugg

SEQ ID NO: 70150 - RNA, 26 nt, Human
gcugucuccccugacaggcacaacuc

SEQ ID NO: 70151 - RNA, 22 nt, Human
uucuuuauuaaauucauccugc

SEQ ID NO: 70152 - RNA, 19 nt, Human
uccgggggcuggccaguca

SEQ ID NO: 70153 - RNA, 21 nt, Human
agacucuaacuuaaccccaac

SEQ ID NO: 70154 - RNA, 23 nt, Human
gccuguccccauucucauggccc

SEQ ID NO: 70155 - RNA, 18 nt, Human
uugcuggucuuagcagug

SEQ ID NO: 70156 - RNA, 20 nt, Human
aauucccucaaacucuauuu

SEQ ID NO: 70157 - RNA, 24 nt, Human
uacaggcuaaucagcaucuggcca

SEQ ID NO: 70158 - RNA, 22 nt, Human
uucucagugcugcggaucaugu

SEQ ID NO: 70159 - RNA, 21 nt, Human
gggcuguagggcagggccacu

SEQ ID NO: 70160 - RNA, 21 nt, Human
gggcagcuucccccugccuuu

SEQ ID NO: 70161 - RNA, 22 nt, Human
ccauucucuugccaaugcugca

SEQ ID NO: 70162 - RNA, 26 nt, Human
uccggccugugaaacugugaggggau

SEQ ID NO: 70163 - RNA, 21 nt, Human
aggcacuuuucacacucuguc

SEQ ID NO: 70164 - RNA, 24 nt, Human
ucuucuuuguuaggcugugucucc

SEQ ID NO: 70165 - RNA, 20 nt, Human
ggaaaguucaaauaugcagg

SEQ ID NO: 70166 - RNA, 21 nt, Human
ccaauuugucacaagaagaac

SEQ ID NO: 70167 - RNA, 24 nt, Human
cuguccauuccaucaaguccugaa

SEQ ID NO: 70168 - RNA, 21 nt, Human
uggaccaaggacguggaugac

SEQ ID NO: 70169 - RNA, 26 nt, Human
ccuccaggagcccagacaccagcccc

SEQ ID NO: 70170 - RNA, 27 nt, Human
cacacugccgcuccagccuuccuggca

SEQ ID NO: 70171 - RNA, 21 nt, Human
cucagccaggcuggaggcggc

SEQ ID NO: 70172 - RNA, 23 nt, Human
caugccuguaaucgcagcuacuc

SEQ ID NO: 70173 - RNA, 20 nt, Human
cagaaggagggggugaccuc

SEQ ID NO: 70174 - RNA, 20 nt, Human
ccaaaggcgggguggcggug

SEQ ID NO: 70175 - RNA, 22 nt, Human
gggugucuucaucuucaauuug

SEQ ID NO: 70176 - RNA, 29 nt, Human
uugagaggugaugucuguguuagccaaug

SEQ ID NO: 70177 - RNA, 21 nt, Human
gcagugagccaagaucgcggc

SEQ ID NO: 70178 - RNA, 21 nt, Human
guggugaguuagagguaugcu

SEQ ID NO: 70179 - RNA, 20 nt, Human
aauacagcucaucuugaaga

SEQ ID NO: 70180 - RNA, 27 nt, Human
ccacguauuuuguuauuauuuuggauu

SEQ ID NO: 70181 - RNA, 27 nt, Human
acaggugaguuaaauauaccauuucac

SEQ ID NO: 70182 - RNA, 25 nt, Human
aggaaacugcaccagugucuauucc

SEQ ID NO: 70183 - RNA, 26 nt, Human
gauucuuuguuacaggcaccgagaau

SEQ ID NO: 70184 - RNA, 22 nt, Human
ccuguaaucccagcacuuuagg

SEQ ID NO: 70185 - RNA, 25 nt, Human
ucagucccuacuuaggaaauacuca

SEQ ID NO: 70186 - RNA, 25 nt, Human
uuguucuuaaccauuucagggcuuc

SEQ ID NO: 70187 - RNA, 22 nt, Human
uggucgucaacuuuccucaaau

SEQ ID NO: 70188 - RNA, 22 nt, Human
uggcucaccccuguaaucucag

SEQ ID NO: 70189 - RNA, 27 nt, Human
ucuucauuaauuuuguguuuaaguuaa

SEQ ID NO: 70190 - RNA, 27 nt, Human
ugcccaggcuggagggcaauggugcaa

SEQ ID NO: 70191 - RNA, 21 nt, Human
uauucuuaauaggccuaaaau

SEQ ID NO: 70192 - RNA, 27 nt, Human
caugccuuucuguaaaacucaaauaua

SEQ ID NO: 70193 - RNA, 20 nt, Human
cauacgugucuguguguaua

SEQ ID NO: 70194 - RNA, 22 nt, Human
auugcuugaagccaggaguuug

SEQ ID NO: 70195 - RNA, 26 nt, Human
ccccagccuuggugaggacaguguug

SEQ ID NO: 70196 - RNA, 20 nt, Human
aucucguucucucuccuucc

SEQ ID NO: 70197 - RNA, 26 nt, Human
uucauucuucuucauaugaauauccc

SEQ ID NO: 70198 - RNA, 24 nt, Human
ccugggaaauuuccuuucuccaga

SEQ ID NO: 70199 - RNA, 23 nt, Human
gugcuacuugagagugggggaga

SEQ ID NO: 70200 - RNA, 22 nt, Human
aggucacugcaaccuccaccuc

SEQ ID NO: 70201 - RNA, 27 nt, Human
gccucgaacuccuggucucuugcgguc

SEQ ID NO: 70202 - RNA, 27 nt, Human
ccugccuuuuucaaauaucccugccuu

SEQ ID NO: 70203 - RNA, 27 nt, Human
cacugcacuccagccuuggcaacacag

SEQ ID NO: 70204 - RNA, 27 nt, Human
cauugcacccuagccugggcaacagag

SEQ ID NO: 70205 - RNA, 27 nt, Human
cacgcacacacauccccaagaaccucg

SEQ ID NO: 70206 - RNA, 21 nt, Human
gcgucuuguauuuucuuccca

SEQ ID NO: 70207 - RNA, 21 nt, Human
aucuugcagccuuccuuucca

SEQ ID NO: 70208 - RNA, 22 nt, Human
ugaucaugacaaagaagauuaa

SEQ ID NO: 70209 - RNA, 25 nt, Human
cuguucuggacugugccuguuaguu

SEQ ID NO: 70210 - RNA, 22 nt, Human
ugcuguugcccuguuuccugcu

SEQ ID NO: 70211 - RNA, 21 nt, Human
uccuggagugacuguguacga

SEQ ID NO: 70212 - RNA, 21 nt, Human
guugcaaauauuuuucuccua

SEQ ID NO: 70213 - RNA, 23 nt, Human
aggcugggcaggaagggccugcu

SEQ ID NO: 70214 - RNA, 26 nt, Human
ccugcagggaagccccacauguccag

SEQ ID NO: 70215 - RNA, 27 nt, Human
uggucugaacguggugucucacucuga

SEQ ID NO: 70216 - RNA, 21 nt, Human
cuucucugcugucagucuuug

SEQ ID NO: 70217 - RNA, 21 nt, Human
aagaauugcacguaugagaaa

SEQ ID NO: 70218 - RNA, 20 nt, Human
auaauaauagcuacacugcu

SEQ ID NO: 70219 - RNA, 20 nt, Human
uaaaggagaaaauguuugag

SEQ ID NO: 70220 - RNA, 23 nt, Human
agaguuaaacuggguucauuuua

SEQ ID NO: 70221 - RNA, 19 nt, Human
uaucuugccauaucucaua

SEQ ID NO: 70222 - RNA, 21 nt, Human
agggagccacagagagggguc

SEQ ID NO: 70223 - RNA, 22 nt, Human
agugccuuuaauucagccuuau

SEQ ID NO: 70224 - RNA, 23 nt, Human
cuacaugacuccaaguauaugag

SEQ ID NO: 70225 - RNA, 26 nt, Human
ccauuaccaccugaccucuugcugcc

SEQ ID NO: 70226 - RNA, 25 nt, Human
uguaggaagaguagcauuucauucu

SEQ ID NO: 70227 - RNA, 24 nt, Human
ccccccgguaugggaaccagcacc

SEQ ID NO: 70228 - RNA, 26 nt, Human
ucucgaaccucugggcucaagcaauu

SEQ ID NO: 70229 - RNA, 22 nt, Human
ggaggcggagacggaggaaggu

SEQ ID NO: 70230 - RNA, 23 nt, Human
uucugaacauauccaugcgcaau

SEQ ID NO: 70231 - RNA, 17 nt, Human
gcuuaaaaauggccuuc

SEQ ID NO: 70232 - RNA, 20 nt, Human
ucugacaucugccacuccuc

SEQ ID NO: 70233 - RNA, 26 nt, Human
gcauagugccugcaugcuucaugauc

SEQ ID NO: 70234 - RNA, 26 nt, Human
ugacugaaaacacugaaaccuaccac

SEQ ID NO: 70235 - RNA, 20 nt, Human
ucuugucacaugauuucuuu

SEQ ID NO: 70236 - RNA, 27 nt, Human
uacuacacuccagccuggugacagagu

SEQ ID NO: 70237 - RNA, 27 nt, Human
aaagugcugggauuacaggcaagagcc

SEQ ID NO: 70238 - RNA, 20 nt, Human
cccucauuuaaauuggucca

SEQ ID NO: 70239 - RNA, 21 nt, Human
gaaggagaagaaagagccuug

SEQ ID NO: 70240 - RNA, 27 nt, Human
ucuguuuaaaguggcaaucucagaugc

SEQ ID NO: 70241 - RNA, 24 nt, Human
uuagguuauuuugcuuugguuaaa

SEQ ID NO: 70242 - RNA, 22 nt, Human
gacuauucugcuuccucaggca

SEQ ID NO: 70243 - RNA, 28 nt, Human
gucaguuuucauaguauccauauuuuau

SEQ ID NO: 70244 - RNA, 22 nt, Human
agacaccagggaaccacaucua

SEQ ID NO: 70245 - RNA, 27 nt, Human
cccugcuguuugcuuuugguaauguga

SEQ ID NO: 70246 - RNA, 31 nt, Human
aacuguauaaugagguuacuacuaguaucua

SEQ ID NO: 70247 - RNA, 24 nt, Human
augccugcucuaauuucuuuugcc

SEQ ID NO: 70248 - RNA, 20 nt, Human
ugccuccccggaagugccuu

SEQ ID NO: 70249 - RNA, 20 nt, Human
gacuacaggugugccaccac

SEQ ID NO: 70250 - RNA, 22 nt, Human
ucuucuuucucaucuacucguc

SEQ ID NO: 70251 - RNA, 20 nt, Human
caggacccaggucugcugcc

SEQ ID NO: 70252 - RNA, 27 nt, Human
gggaggcagguucugcaaagcaagugc

SEQ ID NO: 70253 - RNA, 23 nt, Human
cuguccagcaaauacucuaauga

SEQ ID NO: 70254 - RNA, 21 nt, Human
ugggcagccaucaccagccac

SEQ ID NO: 70255 - RNA, 21 nt, Human
acugggcuuguuggggccaga

SEQ ID NO: 70256 - RNA, 23 nt, Human
gucacccacgcuggagugcugug

SEQ ID NO: 70257 - RNA, 27 nt, Human
ccugcagcuuuguccccacugugcaug

SEQ ID NO: 70258 - RNA, 22 nt, Human
cacuguacuccagccuggacaa

SEQ ID NO: 70259 - RNA, 25 nt, Human
gcauugccagcucuuccaaucucca

SEQ ID NO: 70260 - RNA, 22 nt, Human
uuacauuuaggguucaccagga

SEQ ID NO: 70261 - RNA, 27 nt, Human
ugggacccccuuuagcgggacucagug

SEQ ID NO: 70262 - RNA, 25 nt, Human
ccauagucaguguaaauacagcccu

SEQ ID NO: 70263 - RNA, 21 nt, Human
uugcccaggcuggaguacaau

SEQ ID NO: 70264 - RNA, 23 nt, Human
ggcuccuaggggguuccuuccac

SEQ ID NO: 70265 - RNA, 24 nt, Human
cuggaacccaggcucuaaacaagc

SEQ ID NO: 70266 - RNA, 24 nt, Human
aggaagggaaggagaggugucugu

SEQ ID NO: 70267 - RNA, 21 nt, Human
uucaauuucaacauguaugua

SEQ ID NO: 70268 - RNA, 26 nt, Human
uccuggagagagugaggagagugugu

SEQ ID NO: 70269 - RNA, 19 nt, Human
ugccugcugcaucuuccca

SEQ ID NO: 70270 - RNA, 25 nt, Human
ggauaagagaccugaaauuagccag

SEQ ID NO: 70271 - RNA, 21 nt, Human
aacagcucugccagcagccuu

SEQ ID NO: 70272 - RNA, 22 nt, Human
ccaucaucucauuaccucuguc

SEQ ID NO: 70273 - RNA, 20 nt, Human
uucaguuuuuguuauuguaa

SEQ ID NO: 70274 - RNA, 21 nt, Human
guggagaaccuuucccaccug

SEQ ID NO: 70275 - RNA, 19 nt, Human
ugcaucugaccaaaggacg

SEQ ID NO: 70276 - RNA, 20 nt, Human
uucuaguauuuuuguuacuu

SEQ ID NO: 70277 - RNA, 22 nt, Human
agccucccgaguugcugggauu

SEQ ID NO: 70278 - RNA, 22 nt, Human
ggccucccaaguugcugggauu

SEQ ID NO: 70279 - RNA, 22 nt, Human
ccuaguagcugggauugcaggc

SEQ ID NO: 70280 - RNA, 25 nt, Human
gcacagccgcgggccaggaggcugc

SEQ ID NO: 70281 - RNA, 21 nt, Human
uggauaccagcucaggggaca

SEQ ID NO: 70282 - RNA, 23 nt, Human
guugcccaggcuggagugcaaug

SEQ ID NO: 70283 - RNA, 23 nt, Human
ugggguggacucagauggguggg

SEQ ID NO: 70284 - RNA, 29 nt, Human
aggugccugcaucugucugccuucuggcu

SEQ ID NO: 70285 - RNA, 20 nt, Human
gagaagcacuaagacugcuu

SEQ ID NO: 70286 - RNA, 21 nt, Human
cccugcucccuauccuguccc

SEQ ID NO: 70287 - RNA, 23 nt, Human
uugccaggcugauugaagcaggc

SEQ ID NO: 70288 - RNA, 28 nt, Human
cugcuugugcggcgaugaucuguuugug

SEQ ID NO: 70289 - RNA, 27 nt, Human
uccacgccauggguaacuugggggaga

SEQ ID NO: 70290 - RNA, 22 nt, Human
gggcugaggcgggagaaucacu

SEQ ID NO: 70291 - RNA, 22 nt, Human
gaguaccugggauuacaggcau

SEQ ID NO: 70292 - RNA, 25 nt, Human
gcggaccagaccugcccugcucugu

SEQ ID NO: 70293 - RNA, 25 nt, Human
ccuuacuguuugaguuucucucaca

SEQ ID NO: 70294 - RNA, 22 nt, Human
ucuucuuuccuuuagucuucac

SEQ ID NO: 70295 - RNA, 19 nt, Human
ccucugcugccaccaucac

SEQ ID NO: 70296 - RNA, 27 nt, Human
ugcugggacccuuaggauggggcuccc

SEQ ID NO: 70297 - RNA, 21 nt, Human
auuugaaaacacaaccuauuu

SEQ ID NO: 70298 - RNA, 26 nt, Human
ggcugagagcagggaucuaccuggcu

SEQ ID NO: 70299 - RNA, 21 nt, Human
cggcccaggguggccuuggug

SEQ ID NO: 70300 - RNA, 20 nt, Human
cucaaguuuuauuauugcaa

SEQ ID NO: 70301 - RNA, 20 nt, Human
caccgagcggccucugagga

SEQ ID NO: 70302 - RNA, 25 nt, Human
cuucacccacccuccaggaccccag

SEQ ID NO: 70303 - RNA, 27 nt, Human
agaaauucccuugugagugccugguag

SEQ ID NO: 70304 - RNA, 22 nt, Human
aggagagaagacgugcagggac

SEQ ID NO: 70305 - RNA, 26 nt, Human
gcugggacggacaggagaggcugucg

SEQ ID NO: 70306 - RNA, 25 nt, Human
gcaugcagcucucagcacugggugg

SEQ ID NO: 70307 - RNA, 20 nt, Human
agguggccuuccugcuguua

SEQ ID NO: 70308 - RNA, 26 nt, Human
uaaagcugugucugagaucuggaucu

SEQ ID NO: 70309 - RNA, 26 nt, Human
auauaaaaucacaguagccugcuaaa

SEQ ID NO: 70310 - RNA, 21 nt, Human
accaaagcucaaaacaaucaa

SEQ ID NO: 70311 - RNA, 22 nt, Human
ccuguauuaugugaacagucuu

SEQ ID NO: 70312 - RNA, 19 nt, Human
cagcacaauucugucccug

SEQ ID NO: 70313 - RNA, 27 nt, Human
gggcagggacagggcagaggacucuga

SEQ ID NO: 70314 - RNA, 24 nt, Human
ucucaggcucuaggugcaauguga

SEQ ID NO: 70315 - RNA, 26 nt, Human
gaggcucgcagacccagggcaaugug

SEQ ID NO: 70316 - RNA, 22 nt, Human
gagcagcgcuuccagagccaga

SEQ ID NO: 70317 - RNA, 24 nt, Human
agugugagacacuggaaggcaaga

SEQ ID NO: 70318 - RNA, 21 nt, Human
cuucgguccugcuguagugcc

SEQ ID NO: 70319 - RNA, 23 nt, Human
gugccuggcacucagugugugaa

SEQ ID NO: 70320 - RNA, 22 nt, Human
cucagccaaagcagaaugcagg

SEQ ID NO: 70321 - RNA, 21 nt, Human
aaccaaaaucaguguuuauag

SEQ ID NO: 70322 - RNA, 25 nt, Human
gcacacggcugccugacacugagcc

SEQ ID NO: 70323 - RNA, 26 nt, Human
aauguaaacauaaggguaauggucug

SEQ ID NO: 70324 - RNA, 22 nt, Human
gcauauaaggaaaguguucaag

SEQ ID NO: 70325 - RNA, 19 nt, Human
ggacgagccccagacugga

SEQ ID NO: 70326 - RNA, 25 nt, Human
agaacaauggcagcccgaguacuua

SEQ ID NO: 70327 - RNA, 25 nt, Human
uugcucucugggcuuuugguuuggg

SEQ ID NO: 70328 - RNA, 23 nt, Human
ugggggaucugggcaaggugggu

SEQ ID NO: 70329 - RNA, 24 nt, Human
ccuccuuguuggucuacucaggcc

SEQ ID NO: 70330 - RNA, 21 nt, Human
auguagaaagaaaaauggaga

SEQ ID NO: 70331 - RNA, 30 nt, Human
gagauggcugagaagggaaggguauccuuu

SEQ ID NO: 70332 - RNA, 23 nt, Human
uccuguacaacccuuuguggacc

SEQ ID NO: 70333 - RNA, 19 nt, Human
uuuaucagccacugccuuc

SEQ ID NO: 70334 - RNA, 21 nt, Human
cuccuuuauggacgucuaguc

SEQ ID NO: 70335 - RNA, 24 nt, Human
guguuuggcagguuccugcuccac

SEQ ID NO: 70336 - RNA, 22 nt, Human
acaaaauuuauuuuuauuuuuu

SEQ ID NO: 70337 - RNA, 22 nt, Human
ccagccugggcaacgagaguga

SEQ ID NO: 70338 - RNA, 27 nt, Human
cacagcgagguacugcagcuuccucca

SEQ ID NO: 70339 - RNA, 27 nt, Human
ucgcccaggcuggagugcaggggcgca

SEQ ID NO: 70340 - RNA, 24 nt, Human
uguuagccaggauggucuggaucu

SEQ ID NO: 70341 - RNA, 20 nt, Human
ccagcacucaagccuugcca

SEQ ID NO: 70342 - RNA, 24 nt, Human
ugugaggcagcggagcugggugaa

SEQ ID NO: 70343 - RNA, 22 nt, Human
auucaaaucacauggcuuucca

SEQ ID NO: 70344 - RNA, 20 nt, Human
uggaaagaaggaugucaaga

SEQ ID NO: 70345 - RNA, 23 nt, Human
aucgccccacugcacuccagccu

SEQ ID NO: 70346 - RNA, 23 nt, Human
aucgcaccacugcccuccagccu

SEQ ID NO: 70347 - RNA, 26 nt, Human
ucauucucucugcuaaccuuccaccu

SEQ ID NO: 70348 - RNA, 24 nt, Human
uagaaaaacauguagauuguuucu

SEQ ID NO: 70349 - RNA, 23 nt, Human
ccugcagcuuuguuacauaggua

SEQ ID NO: 70350 - RNA, 22 nt, Human
ugcuccuguggggagcggggau

SEQ ID NO: 70351 - RNA, 22 nt, Human
cugaacugccuuccuccacgca

SEQ ID NO: 70352 - RNA, 25 nt, Human
cacucugugccgccaccucuaccug

SEQ ID NO: 70353 - RNA, 22 nt, Human
cugcagccacugccuccugggu

SEQ ID NO: 70354 - RNA, 27 nt, Human
cuucugcucuggauucacucuucccug

SEQ ID NO: 70355 - RNA, 26 nt, Human
ccccucgccgccucugccuggccaca

SEQ ID NO: 70356 - RNA, 18 nt, Human
ugucugcuaucauuauuc

SEQ ID NO: 70357 - RNA, 21 nt, Human
guucuguucugucaugugcca

SEQ ID NO: 70358 - RNA, 19 nt, Human
aaauuugcaaacugccuuc

SEQ ID NO: 70359 - RNA, 22 nt, Human
agccugcugaguagcugggacu

SEQ ID NO: 70360 - RNA, 23 nt, Human
cuuuuuccucuccacacagugcu

SEQ ID NO: 70361 - RNA, 25 nt, Human
ggacucuuccaucagagaugggaaa

SEQ ID NO: 70362 - RNA, 21 nt, Human
aacccagacuuaaucuugaau

SEQ ID NO: 70363 - RNA, 21 nt, Human
cuguggacuccaguuuuguug

SEQ ID NO: 70364 - RNA, 22 nt, Human
uccuggagccuccucugggcag

SEQ ID NO: 70365 - RNA, 18 nt, Human
cgucagcaaccucugccg

SEQ ID NO: 70366 - RNA, 23 nt, Human
cugccaagagcucaggagccagg

SEQ ID NO: 70367 - RNA, 20 nt, Human
acuauacacagucaccgucc

SEQ ID NO: 70368 - RNA, 22 nt, Human
gcaaccuuuuucccucuuccca

SEQ ID NO: 70369 - RNA, 22 nt, Human
gccuguggacaucucuacagca

SEQ ID NO: 70370 - RNA, 22 nt, Human
auuggcgccuccuaccuccucc

SEQ ID NO: 70371 - RNA, 22 nt, Human
agaggcauucaguuagcaaaga

SEQ ID NO: 70372 - RNA, 23 nt, Human
cagaucucugggaucuucagcug

SEQ ID NO: 70373 - RNA, 22 nt, Human
agaggaagaaugagagcuuugu

SEQ ID NO: 70374 - RNA, 22 nt, Human
gcacagcccugcaccccgcccc

SEQ ID NO: 70375 - RNA, 24 nt, Human
ccccagcuaaccucuucuggacca

SEQ ID NO: 70376 - RNA, 22 nt, Human
agcaggaggaggagcccggugg

SEQ ID NO: 70377 - RNA, 26 nt, Human
uucauucuagauguagcuugugcaga

SEQ ID NO: 70378 - RNA, 23 nt, Human
ccguaacagccaccagacaagcu

SEQ ID NO: 70379 - RNA, 21 nt, Human
aaccuccaggcugaggagguc

SEQ ID NO: 70380 - RNA, 26 nt, Human
uuugaaaaacacguguugacuccauu

SEQ ID NO: 70381 - RNA, 27 nt, Human
ccuacuuccugucccacugccacaaag

SEQ ID NO: 70382 - RNA, 22 nt, Human
ggggguggggagggagggaucu

SEQ ID NO: 70383 - RNA, 27 nt, Human
cugucucccaggcugcuggagugcagu

SEQ ID NO: 70384 - RNA, 22 nt, Human
gccuuccaguccaagaaacugc

SEQ ID NO: 70385 - RNA, 23 nt, Human
ccgggagguggagguugcaguga

SEQ ID NO: 70386 - RNA, 23 nt, Human
gggugcacacaugaguggggcag

SEQ ID NO: 70387 - RNA, 22 nt, Human
ccgccgucuuccguccuaggag

SEQ ID NO: 70388 - RNA, 22 nt, Human
auggccucucacaagcugcugg

SEQ ID NO: 70389 - RNA, 19 nt, Human
ggucucacaucccaccccu

SEQ ID NO: 70390 - RNA, 22 nt, Human
gcaaaaugcugggauuacaggc

SEQ ID NO: 70391 - RNA, 24 nt, Human
cugagauauccucagguuuucuca

SEQ ID NO: 70392 - RNA, 19 nt, Human
aacugucaccacuaacuca

SEQ ID NO: 70393 - RNA, 22 nt, Human
gauugcacuccaaccugggcga

SEQ ID NO: 70394 - RNA, 22 nt, Human
gucacaccagugcuagaaguuu

SEQ ID NO: 70395 - RNA, 22 nt, Human
agcaguugucugccaugagcac

SEQ ID NO: 70396 - RNA, 21 nt, Human
ucccugcacucagcccugugg

SEQ ID NO: 70397 - RNA, 30 nt, Human
cuucacugcgaagacccucuugcccacccu

SEQ ID NO: 70398 - RNA, 21 nt, Human
aaaauacagugcccugccuuc

SEQ ID NO: 70399 - RNA, 23 nt, Human
cacgucaggcuguggagcaggag

SEQ ID NO: 70400 - RNA, 20 nt, Human
agacaaucaguaugugcuua

SEQ ID NO: 70401 - RNA, 24 nt, Human
uuaccugcagcuuuuuaguccuuu

SEQ ID NO: 70402 - RNA, 25 nt, Human
agagaaacgcaagcagacuggauug

SEQ ID NO: 70403 - RNA, 21 nt, Human
gcagggcggccagugcaguga

SEQ ID NO: 70404 - RNA, 22 nt, Human
gucauugucgcucagcaauagg

SEQ ID NO: 70405 - RNA, 22 nt, Human
ugcugcuuagacauaacaaaac

SEQ ID NO: 70406 - RNA, 20 nt, Human
cugagggucacaguaccuug

SEQ ID NO: 70407 - RNA, 23 nt, Human
gcugaguugagaacacuguggcu

SEQ ID NO: 70408 - RNA, 22 nt, Human
gggguagccagagaaacacugu

SEQ ID NO: 70409 - RNA, 27 nt, Human
gggcgggcccuuuucacaacaggcugg

SEQ ID NO: 70410 - RNA, 20 nt, Human
ucuggccagcgacugccuuc

SEQ ID NO: 70411 - RNA, 21 nt, Human
gcgugagagaaaacagcuggu

SEQ ID NO: 70412 - RNA, 21 nt, Human
ccauuuuuuguucccuaauga

SEQ ID NO: 70413 - RNA, 25 nt, Human
uucaccucucaguaugucucuuuca

SEQ ID NO: 70414 - RNA, 27 nt, Human
gaggaagagcugaccagcugaccuugc

SEQ ID NO: 70415 - RNA, 26 nt, Human
ucucaacuuuuuaacacagaaauacu

SEQ ID NO: 70416 - RNA, 22 nt, Human
guugaggcccacaacacgguga

SEQ ID NO: 70417 - RNA, 24 nt, Human
uggcuucugcuucauccugcucca

SEQ ID NO: 70418 - RNA, 21 nt, Human
gaccagcccagccaacauggc

SEQ ID NO: 70419 - RNA, 21 nt, Human
auagugcagcccaaaaccacu

SEQ ID NO: 70420 - RNA, 23 nt, Human
uucucaucugcacuauguuucca

SEQ ID NO: 70421 - RNA, 27 nt, Human
acccugcucagcauuuacauuuuugcc

SEQ ID NO: 70422 - RNA, 23 nt, Human
uucuccaggaauacugaacaugg

SEQ ID NO: 70423 - RNA, 27 nt, Human
agcugcugguuuauuacugaagaaaga

SEQ ID NO: 70424 - RNA, 22 nt, Human
ugggacugcaggcaugagccau

SEQ ID NO: 70425 - RNA, 21 nt, Human
ucaaagcugauucaguacugg

SEQ ID NO: 70426 - RNA, 26 nt, Human
ccacucucuucagcagccacccggcc

SEQ ID NO: 70427 - RNA, 21 nt, Human
caaaugucccuucuguaugua

SEQ ID NO: 70428 - RNA, 23 nt, Human
cgcugccgacccugccugagcgc

SEQ ID NO: 70429 - RNA, 27 nt, Human
ugucucccaggcuggagugcuauggug

SEQ ID NO: 70430 - RNA, 26 nt, Human
acacagccaucagcagcuugcgcccu

SEQ ID NO: 70431 - RNA, 21 nt, Human
auaccccaaguccaccugccu

SEQ ID NO: 70432 - RNA, 20 nt, Human
agcuccagcuuucugccauc

SEQ ID NO: 70433 - RNA, 21 nt, Human
ccagccugagcaacagaguga

SEQ ID NO: 70434 - RNA, 26 nt, Human
auauacucccugcccuucccccugca

SEQ ID NO: 70435 - RNA, 20 nt, Human
ccauuguauauacuaguuuc

SEQ ID NO: 70436 - RNA, 21 nt, Human
uagugugcuuucugcuacacu

SEQ ID NO: 70437 - RNA, 22 nt, Human
gagaagccuuauuuuauuucuc

SEQ ID NO: 70438 - RNA, 23 nt, Human
uggucauagagucagggaucuau

SEQ ID NO: 70439 - RNA, 26 nt, Human
uguucuuccugccuccagccgcccgc

SEQ ID NO: 70440 - RNA, 28 nt, Human
ugucaaguaccaaaauguuaauguaugu

SEQ ID NO: 70441 - RNA, 20 nt, Human
uaauuucuucuuuagaugcc

SEQ ID NO: 70442 - RNA, 19 nt, Human
cugccggcccugccagugc

SEQ ID NO: 70443 - RNA, 20 nt, Human
uacucuacuacacucagccu

SEQ ID NO: 70444 - RNA, 27 nt, Human
uuuuccugcacuuucugcuucuuaauu

SEQ ID NO: 70445 - RNA, 21 nt, Human
ugugcuuguaauccagcaugu

SEQ ID NO: 70446 - RNA, 27 nt, Human
ucugagccacccuccccgcacagcccu

SEQ ID NO: 70447 - RNA, 22 nt, Human
gcuuacugcaaccuccaccucc

SEQ ID NO: 70448 - RNA, 22 nt, Human
gcucacugcaaccuccaccccc

SEQ ID NO: 70449 - RNA, 22 nt, Human
aaccccugccucuucccugaac

SEQ ID NO: 70450 - RNA, 24 nt, Human
guccgaugccaaggaguccuggcc

SEQ ID NO: 70451 - RNA, 18 nt, Human
uucccuccucuccaggcc

SEQ ID NO: 70452 - RNA, 21 nt, Human
uaaaugauacagaucuguuua

SEQ ID NO: 70453 - RNA, 26 nt, Human
ggagagggaagagugcauuuucccag

SEQ ID NO: 70454 - RNA, 21 nt, Human
guccauagauauaaagccauu

SEQ ID NO: 70455 - RNA, 24 nt, Human
ucugcagcccagccuagucagggc

SEQ ID NO: 70456 - RNA, 31 nt, Human
ugcacuguuuaaagcauuugcacuguauuuu

SEQ ID NO: 70457 - RNA, 18 nt, Human
uccucaaggucauccugg

SEQ ID NO: 70458 - RNA, 22 nt, Human
guggcaaagccuuuaaccaguu

SEQ ID NO: 70459 - RNA, 27 nt, Human
ggggcgcagcgcugaggucacccugga

SEQ ID NO: 70460 - RNA, 19 nt, Human
uaugggguaaagccaugua

SEQ ID NO: 70461 - RNA, 21 nt, Human
gcgguacccacccagcccaag

SEQ ID NO: 70462 - RNA, 24 nt, Human
auguuuuuccgacacuccuggguc

SEQ ID NO: 70463 - RNA, 25 nt, Human
ccuuauggccaggugcaguggcuca

SEQ ID NO: 70464 - RNA, 25 nt, Human
cccaacaucaccacuacuuaccuca

SEQ ID NO: 70465 - RNA, 27 nt, Human
ugguagacauggagaccccugccuggc

SEQ ID NO: 70466 - RNA, 21 nt, Human
cccugauauacaccuggacca

SEQ ID NO: 70467 - RNA, 24 nt, Human
ccuccugcuauauccauuggaaga

SEQ ID NO: 70468 - RNA, 18 nt, Human
cuaccugcuaugcgcuag

SEQ ID NO: 70469 - RNA, 23 nt, Human
ugaaggaaagaggaagugcuaga

SEQ ID NO: 70470 - RNA, 21 nt, Human
cucuccucuccccaugauguu

SEQ ID NO: 70471 - RNA, 27 nt, Human
ucucagccuggaauccccaccuugccc

SEQ ID NO: 70472 - RNA, 20 nt, Human
ugaugaguuagaaucugauu

SEQ ID NO: 70473 - RNA, 23 nt, Human
guuucauaccauucauuuuuuaa

SEQ ID NO: 70474 - RNA, 21 nt, Human
ugccagaaugugagugugaga

SEQ ID NO: 70475 - RNA, 22 nt, Human
gcucacuguagucucgaccucc

SEQ ID NO: 70476 - RNA, 23 nt, Human
uucuaauucucauuuaauuuuag

SEQ ID NO: 70477 - RNA, 19 nt, Human
acuucguccuguuccccga

SEQ ID NO: 70478 - RNA, 23 nt, Human
uuguguuuacacaagcugugggg

SEQ ID NO: 70479 - RNA, 23 nt, Human
uucagguaaagaagcagcuuuga

SEQ ID NO: 70480 - RNA, 21 nt, Human
ugccugugauccuagcacuuu

SEQ ID NO: 70481 - RNA, 18 nt, Human
gccugccugccugucugc

SEQ ID NO: 70482 - RNA, 25 nt, Human
agcccagcgccaggugcucuugccu

SEQ ID NO: 70483 - RNA, 23 nt, Human
ccugcuccucugaccucccgguc

SEQ ID NO: 70484 - RNA, 24 nt, Human
ccacccucugggccucagugucuu

SEQ ID NO: 70485 - RNA, 21 nt, Human
cugugugcauaugugugugcg

SEQ ID NO: 70486 - RNA, 24 nt, Human
uuuaaaaaauacauuguuguaaga

SEQ ID NO: 70487 - RNA, 25 nt, Human
ccucuguucuucccccaccugccac

SEQ ID NO: 70488 - RNA, 20 nt, Human
ccucuggccccaccucccuc

SEQ ID NO: 70489 - RNA, 27 nt, Human
cuugcagacugagcgaugacaccacac

SEQ ID NO: 70490 - RNA, 26 nt, Human
uuuuaauaacaugcaugggucccucu

SEQ ID NO: 70491 - RNA, 20 nt, Human
ugacggcaaccucugagcca

SEQ ID NO: 70492 - RNA, 22 nt, Human
uauuaucauaagaauuuuucag

SEQ ID NO: 70493 - RNA, 22 nt, Human
cugugauguuucagggagcuug

SEQ ID NO: 70494 - RNA, 26 nt, Human
agguuuagaggaccagugaguuggga

SEQ ID NO: 70495 - RNA, 18 nt, Human
ugacuuuuguuuagucuu

SEQ ID NO: 70496 - RNA, 25 nt, Human
ucugcagcugcucccagauuacucc

SEQ ID NO: 70497 - RNA, 17 nt, Human
uuccuuuucauaacuuu

SEQ ID NO: 70498 - RNA, 21 nt, Human
acucaacuccuggcuccuggg

SEQ ID NO: 70499 - RNA, 20 nt, Human
gcuacagucuucauuuuagu

SEQ ID NO: 70500 - RNA, 21 nt, Human
gaucucaaacuccugaccuca

SEQ ID NO: 70501 - RNA, 19 nt, Human
ucagaggccacacagccca

SEQ ID NO: 70502 - RNA, 21 nt, Human
cccacacugggggccagagcu

SEQ ID NO: 70503 - RNA, 30 nt, Human
ggaguugaugagaaaggggagccaaggcuu

SEQ ID NO: 70504 - RNA, 26 nt, Human
caaaacugaaugcaaauguccuuugu

SEQ ID NO: 70505 - RNA, 27 nt, Human
cugcgaguaguuccacacagguuugua

SEQ ID NO: 70506 - RNA, 21 nt, Human
ccccuuucccugucccagccc

SEQ ID NO: 70507 - RNA, 26 nt, Human
ugugcacauuucuuugcauuccagcu

SEQ ID NO: 70508 - RNA, 27 nt, Human
caaccaaacucccaucagcccaauccc

SEQ ID NO: 70509 - RNA, 24 nt, Human
gaggggaagcugggguuugcagug

SEQ ID NO: 70510 - RNA, 23 nt, Human
gaguucuuuuuucuuucuucuuu

SEQ ID NO: 70511 - RNA, 26 nt, Human
gucagugugcaaaaggcuuuacuuca

SEQ ID NO: 70512 - RNA, 20 nt, Human
auugaguuauuaacuguauu

SEQ ID NO: 70513 - RNA, 23 nt, Human
ugucacccgagcuggagugcagu

SEQ ID NO: 70514 - RNA, 23 nt, Human
ugcgccuguaaucccagcuacuc

SEQ ID NO: 70515 - RNA, 21 nt, Human
cuaacaacagaaucuaaucuu

SEQ ID NO: 70516 - RNA, 21 nt, Human
aacaacaacaacaaaaagucc

SEQ ID NO: 70517 - RNA, 21 nt, Human
agacccugccuuuuagaucca

SEQ ID NO: 70518 - RNA, 23 nt, Human
uagugcuucaaccacugcucucc

SEQ ID NO: 70519 - RNA, 28 nt, Human
gguggugaggacuaggccacagcuuugg

SEQ ID NO: 70520 - RNA, 21 nt, Human
uaaaaacauggagaaccacua

SEQ ID NO: 70521 - RNA, 25 nt, Human
aauccauucaacaagggugcagccu

SEQ ID NO: 70522 - RNA, 27 nt, Human
ccacagcgcuccagccuggucgacaga

SEQ ID NO: 70523 - RNA, 26 nt, Human
cugcugaaguuucuuauuuaauucca

SEQ ID NO: 70524 - RNA, 22 nt, Human
ucgcccaggcuggagugcagca

SEQ ID NO: 70525 - RNA, 23 nt, Human
aggcugugggcaggaaagaaagg

SEQ ID NO: 70526 - RNA, 22 nt, Human
gagggcacaucgugacuguguu

SEQ ID NO: 70527 - RNA, 26 nt, Human
uuuguugccaaagcuggucucaaacu

SEQ ID NO: 70528 - RNA, 24 nt, Human
ggucacugcugcuuacucuaccuu

SEQ ID NO: 70529 - RNA, 27 nt, Human
gagaaacucuuacaggccaggaagcca

SEQ ID NO: 70530 - RNA, 27 nt, Human
ugcugaagcuucccaagcaucagucua

SEQ ID NO: 70531 - RNA, 21 nt, Human
aaaugcuggguuuaagaaagg

SEQ ID NO: 70532 - RNA, 27 nt, Human
cuaccugcaacacaacauuugugucac

SEQ ID NO: 70533 - RNA, 21 nt, Human
ggauggggcuuccagcucaga

SEQ ID NO: 70534 - RNA, 27 nt, Human
gagcacuuggauuauggaucugaauag

SEQ ID NO: 70535 - RNA, 22 nt, Human
accguugaccgcuccuccaacu

SEQ ID NO: 70536 - RNA, 20 nt, Human
ucccccgguucuccugcugc

SEQ ID NO: 70537 - RNA, 27 nt, Human
ugcagcucacugcugcugccucugaaa

SEQ ID NO: 70538 - RNA, 18 nt, Human
ucacugcaagcucugcuu

SEQ ID NO: 70539 - RNA, 21 nt, Human
agggagaggcaggaggacacc

SEQ ID NO: 70540 - RNA, 27 nt, Human
aaguacuucacacagaagccuagguag

SEQ ID NO: 70541 - RNA, 23 nt, Human
aaagacaaagaacuacaugugaa

SEQ ID NO: 70542 - RNA, 23 nt, Human
ucacaguaccucacaggucucuu

SEQ ID NO: 70543 - RNA, 23 nt, Human
aucgcccaggccugggaugcagu

SEQ ID NO: 70544 - RNA, 21 nt, Human
uacaagugagaauuaaagaga

SEQ ID NO: 70545 - RNA, 19 nt, Human
ucuuccuuggcccuuuugg

SEQ ID NO: 70546 - RNA, 26 nt, Human
ucugcaguuaaauaguggguaaagga

SEQ ID NO: 70547 - RNA, 30 nt, Human
cuccugcaacgggucagccuaggauaaaaa

SEQ ID NO: 70548 - RNA, 22 nt, Human
uauugguuucuuucuuuacuuu

SEQ ID NO: 70549 - RNA, 19 nt, Human
ucugacccaacaguuaccc

SEQ ID NO: 70550 - RNA, 23 nt, Human
gucccuucucucuuccuugcuuu

SEQ ID NO: 70551 - RNA, 23 nt, Human
ugucacccacgcuggagugcugu

SEQ ID NO: 70552 - RNA, 23 nt, Human
cgcgagcugagaggagcagguag

SEQ ID NO: 70553 - RNA, 22 nt, Human
aaguggugguuauuagggcuuu

SEQ ID NO: 70554 - RNA, 22 nt, Human
cugcuguggcccugcccagggc

SEQ ID NO: 70555 - RNA, 23 nt, Human
ccuuucuccacugcacuggagcu

SEQ ID NO: 70556 - RNA, 20 nt, Human
gggcgacuccaucucaaaaa

SEQ ID NO: 70557 - RNA, 29 nt, Human
gcaauagaaauacuggugccugcagagca

SEQ ID NO: 70558 - RNA, 19 nt, Human
gccauccugaggaucgggg

SEQ ID NO: 70559 - RNA, 21 nt, Human
ggcucacaccuguaaucccaa

SEQ ID NO: 70560 - RNA, 20 nt, Human
gugagucuggcaggcaggag

SEQ ID NO: 70561 - RNA, 27 nt, Human
gcccugugccucggugccugugaccug

SEQ ID NO: 70562 - RNA, 25 nt, Human
uuacccaggaugcagcaggugugug

SEQ ID NO: 70563 - RNA, 20 nt, Human
agggcugugcugagagggag

SEQ ID NO: 70564 - RNA, 24 nt, Human
ucaaccuaacuguaacaacagggu

SEQ ID NO: 70565 - RNA, 22 nt, Human
uaaucaaaaaacuuaauauucu

SEQ ID NO: 70566 - RNA, 22 nt, Human
uggcaugagggagaggggcuga

SEQ ID NO: 70567 - RNA, 23 nt, Human
ggccaagccuccucaacuaugac

SEQ ID NO: 70568 - RNA, 18 nt, Human
ugacccccuccuccagca

SEQ ID NO: 70569 - RNA, 27 nt, Human
cauagcaauaucauaauuaauguagua

SEQ ID NO: 70570 - RNA, 26 nt, Human
gccuuuucugaauuaugcuuccacag

SEQ ID NO: 70571 - RNA, 20 nt, Human
agggcuggggugcagaggag

SEQ ID NO: 70572 - RNA, 23 nt, Human
ugcccugugcaaccucuuggccu

SEQ ID NO: 70573 - RNA, 23 nt, Human
ugagaugggagagcaacaaguag

SEQ ID NO: 70574 - RNA, 22 nt, Human
ugccugggcuggagaacagugg

SEQ ID NO: 70575 - RNA, 23 nt, Human
agucaucuucagggaccagucug

SEQ ID NO: 70576 - RNA, 19 nt, Human
agacuucuccacuacugug

SEQ ID NO: 70577 - RNA, 24 nt, Human
gaggauccuggcuaccacucugaa

SEQ ID NO: 70578 - RNA, 24 nt, Human
aacuuggauguagccaugaccuua

SEQ ID NO: 70579 - RNA, 23 nt, Human
aaucugaccaguaucuugcagug

SEQ ID NO: 70580 - RNA, 20 nt, Human
uccccacccuccccauggcc

SEQ ID NO: 70581 - RNA, 20 nt, Human
uagaaggcuucucuccacag

SEQ ID NO: 70582 - RNA, 22 nt, Human
gccuguaauccuagcacuuugg

SEQ ID NO: 70583 - RNA, 22 nt, Human
caccuccuggguuuaagcaaug

SEQ ID NO: 70584 - RNA, 24 nt, Human
guggccuuuggaaccgucgugaag

SEQ ID NO: 70585 - RNA, 21 nt, Human
agggcagcagcuuauuggugg

SEQ ID NO: 70586 - RNA, 23 nt, Human
uuccagcacuuugggaggcagag

SEQ ID NO: 70587 - RNA, 20 nt, Human
cuggugcugcagcacuugua

SEQ ID NO: 70588 - RNA, 26 nt, Human
guucugagaggaggcagcaauccaga

SEQ ID NO: 70589 - RNA, 19 nt, Human
acagagccucucaaucaga

SEQ ID NO: 70590 - RNA, 26 nt, Human
ccagcagagcuugggaagggccaugg

SEQ ID NO: 70591 - RNA, 22 nt, Human
acucuguuccuugacugucuuu

SEQ ID NO: 70592 - RNA, 21 nt, Human
uaggcuuugauuggcacuuuu

SEQ ID NO: 70593 - RNA, 23 nt, Human
guugaucuacccgugccugggcc

SEQ ID NO: 70594 - RNA, 20 nt, Human
gcaggcuggggaggccagug

SEQ ID NO: 70595 - RNA, 23 nt, Human
gucugccuuuauguccuuucuuc

SEQ ID NO: 70596 - RNA, 27 nt, Human
uggagaaauggugauaguuuuuucuuc

SEQ ID NO: 70597 - RNA, 25 nt, Human
ggagaggagggaaaauaagcgaggc

SEQ ID NO: 70598 - RNA, 22 nt, Human
gcucucuucuccccacugugcc

SEQ ID NO: 70599 - RNA, 22 nt, Human
cuguagaaauuuaaaaacuaca

SEQ ID NO: 70600 - RNA, 22 nt, Human
caggcuggagugcaguggcgcc

SEQ ID NO: 70601 - RNA, 22 nt, Human
caggcuagagugcaauggcgcc

SEQ ID NO: 70602 - RNA, 24 nt, Human
gguucaaucaauucuccuaccuca

SEQ ID NO: 70603 - RNA, 17 nt, Human
aaccugcucccaccuca

SEQ ID NO: 70604 - RNA, 19 nt, Human
acauagauaauggugccac

SEQ ID NO: 70605 - RNA, 23 nt, Human
ccuccaaggcuggagugcaguga

SEQ ID NO: 70606 - RNA, 20 nt, Human
ucagcacagccuaggagggu

SEQ ID NO: 70607 - RNA, 22 nt, Human
gguuggaccuauugccaggaau

SEQ ID NO: 70608 - RNA, 25 nt, Human
aaacuauuuaagaacugauguuccg

SEQ ID NO: 70609 - RNA, 25 nt, Human
aauacuccaagaguuagggcagcag

SEQ ID NO: 70610 - RNA, 24 nt, Human
cuucucaaauaauucuuaaccuca

SEQ ID NO: 70611 - RNA, 28 nt, Human
auaggaaaaaguuguuuaaugcucaggg

SEQ ID NO: 70612 - RNA, 22 nt, Human
caggagcuaauggaagugacag

SEQ ID NO: 70613 - RNA, 24 nt, Human
cuccaguucauuuucaguuauuuu

SEQ ID NO: 70614 - RNA, 27 nt, Human
cucucucuagaaguccaaaauggcuag

SEQ ID NO: 70615 - RNA, 24 nt, Human
acauuuauaccugaccagauggcu

SEQ ID NO: 70616 - RNA, 20 nt, Human
caaucccaggcuggggucag

SEQ ID NO: 70617 - RNA, 22 nt, Human
gacccagccacuguuucugcca

SEQ ID NO: 70618 - RNA, 23 nt, Human
gggggugggggagagggagagag

SEQ ID NO: 70619 - RNA, 29 nt, Human
cacugggcuuagcugggccucugaggccu

SEQ ID NO: 70620 - RNA, 27 nt, Human
ccaggaggugacgaggcaggggcucca

SEQ ID NO: 70621 - RNA, 23 nt, Human
cacuauuuauuuuuaaugcuucu

SEQ ID NO: 70622 - RNA, 21 nt, Human
cugaguauuuccuugauugcg

SEQ ID NO: 70623 - RNA, 23 nt, Human
ccagagaaugcuggagcugcaag

SEQ ID NO: 70624 - RNA, 24 nt, Human
uaacugcaacuucacaguauagua

SEQ ID NO: 70625 - RNA, 19 nt, Human
gugggaccuggugggcuca

SEQ ID NO: 70626 - RNA, 22 nt, Human
ccugguguguucccuaacauuc

SEQ ID NO: 70627 - RNA, 20 nt, Human
uacuauguuugaugucuucu

SEQ ID NO: 70628 - RNA, 20 nt, Human
caagaaugacagcuucuaua

SEQ ID NO: 70629 - RNA, 22 nt, Human
ugaauccaagauuccugucucu

SEQ ID NO: 70630 - RNA, 26 nt, Human
ugcaggagacucggggcucggagccc

SEQ ID NO: 70631 - RNA, 27 nt, Human
cugguuuacaggcccugcuccugcagc

SEQ ID NO: 70632 - RNA, 22 nt, Human
ugccaggcuggagugcaguggc

SEQ ID NO: 70633 - RNA, 22 nt, Human
gcucauaugcugacagcucuuc

SEQ ID NO: 70634 - RNA, 20 nt, Human
agagaugauuucuggaacau

SEQ ID NO: 70635 - RNA, 25 nt, Human
ccugccuggcccccaaccucagggc

SEQ ID NO: 70636 - RNA, 27 nt, Human
ggguucucuucauucccacugcacuug

SEQ ID NO: 70637 - RNA, 21 nt, Human
ggggugagugccccgggcgag

SEQ ID NO: 70638 - RNA, 24 nt, Human
aggagcugcucuccuaucugcacu

SEQ ID NO: 70639 - RNA, 21 nt, Human
gacaguguuggaauuuggagg

SEQ ID NO: 70640 - RNA, 21 nt, Human
gucuuuuucucccuuaaguuc

SEQ ID NO: 70641 - RNA, 23 nt, Human
cccuccuccuccucggaauccug

SEQ ID NO: 70642 - RNA, 21 nt, Human
aauacaagagacugaacugua

SEQ ID NO: 70643 - RNA, 24 nt, Human
cgcccaggcugccggugcugaggg

SEQ ID NO: 70644 - RNA, 24 nt, Human
uuucauuauaaggaacaaaggggg

SEQ ID NO: 70645 - RNA, 24 nt, Human
ccugccgcugcaccugccugccgc

SEQ ID NO: 70646 - RNA, 20 nt, Human
cuauuucucaaccuuaggca

SEQ ID NO: 70647 - RNA, 20 nt, Human
aauccagugggcagaggcag

SEQ ID NO: 70648 - RNA, 20 nt, Human
cccugcagauggcccauuug

SEQ ID NO: 70649 - RNA, 24 nt, Human
gccccacuccucugcugaccugcu

SEQ ID NO: 70650 - RNA, 27 nt, Human
cccugugccucacucagcuccugcugc

SEQ ID NO: 70651 - RNA, 22 nt, Human
cuuucauuauggccuccagagg

SEQ ID NO: 70652 - RNA, 27 nt, Human
augggaaaacauauuugcaaaucaucu

SEQ ID NO: 70653 - RNA, 27 nt, Human
ccugccuguggccccuccccugcagac

SEQ ID NO: 70654 - RNA, 21 nt, Human
ugaggucccaggaaguggcca

SEQ ID NO: 70655 - RNA, 20 nt, Human
gcagggaggggaggauaagu

SEQ ID NO: 70656 - RNA, 21 nt, Human
cccgcuggaagccuccaucuc

SEQ ID NO: 70657 - RNA, 20 nt, Human
guccacccuguccuaugacu

SEQ ID NO: 70658 - RNA, 21 nt, Human
guacauacuccagucuaauuu

SEQ ID NO: 70659 - RNA, 16 nt, Human
uucauauaaugccuug

SEQ ID NO: 70660 - RNA, 23 nt, Human
ugaggguggaaggaugggauggg

SEQ ID NO: 70661 - RNA, 27 nt, Human
uguccccagagccauggagagagccag

SEQ ID NO: 70662 - RNA, 23 nt, Human
gguuggaugucauuugaggauca

SEQ ID NO: 70663 - RNA, 20 nt, Human
gugagcgcccucucucuccg

SEQ ID NO: 70664 - RNA, 19 nt, Human
aaaugccacucauccccac

SEQ ID NO: 70665 - RNA, 20 nt, Human
cccagggcacauuucuggau

SEQ ID NO: 70666 - RNA, 21 nt, Human
ucugccgccuuuccuccauuc

SEQ ID NO: 70667 - RNA, 25 nt, Human
agagacuucucccauagcaaagagg

SEQ ID NO: 70668 - RNA, 20 nt, Human
gggugcucuccuuuugggcu

SEQ ID NO: 70669 - RNA, 27 nt, Human
ggucuugaacuccuggccucaagcaau

SEQ ID NO: 70670 - RNA, 22 nt, Human
ucuccuccuccuucccacaggc

SEQ ID NO: 70671 - RNA, 23 nt, Human
gggcguccacaccugcugcucca

SEQ ID NO: 70672 - RNA, 31 nt, Human
gagcagaacacuucagccugugcagguuuau

SEQ ID NO: 70673 - RNA, 26 nt, Human
ugcaccaccuaucacacucccucaca

SEQ ID NO: 70674 - RNA, 21 nt, Human
gcagagcagagaggcugaaua

SEQ ID NO: 70675 - RNA, 27 nt, Human
accugggaguuuugguggaguccgaug

SEQ ID NO: 70676 - RNA, 22 nt, Human
agaguacugggauuacaggcuc

SEQ ID NO: 70677 - RNA, 20 nt, Human
uaagcucaggagcccgaagg

SEQ ID NO: 70678 - RNA, 24 nt, Human
agguaucuuggauuucagacacau

SEQ ID NO: 70679 - RNA, 22 nt, Human
cagucccagggccaucucuugg

SEQ ID NO: 70680 - RNA, 20 nt, Human
cucccccagcagaauggagg

SEQ ID NO: 70681 - RNA, 22 nt, Human
agcaaaaaucagggcuggggga

SEQ ID NO: 70682 - RNA, 26 nt, Human
uggggagggguuugcaggcaggaaua

SEQ ID NO: 70683 - RNA, 22 nt, Human
uagcuuuucugucuuuuggcca

SEQ ID NO: 70684 - RNA, 24 nt, Human
ugucgccuaggcuggagugcagug

SEQ ID NO: 70685 - RNA, 24 nt, Human
cgcugccccucucugggccuguug

SEQ ID NO: 70686 - RNA, 27 nt, Human
aacucacaaacugauguuauauacuca

SEQ ID NO: 70687 - RNA, 22 nt, Human
aaagugcugggauuacaggccu

SEQ ID NO: 70688 - RNA, 21 nt, Human
uggagaaacugcauuaucuua

SEQ ID NO: 70689 - RNA, 24 nt, Human
ucugucgccaaguuggagugcaau

SEQ ID NO: 70690 - RNA, 23 nt, Human
ggaaccucaggcccgcggauggg

SEQ ID NO: 70691 - RNA, 23 nt, Human
aaacuggagcauguugccaaggc

SEQ ID NO: 70692 - RNA, 21 nt, Human
uggagguggagguugugguga

SEQ ID NO: 70693 - RNA, 23 nt, Human
acucuccaggauggaggagcaac

SEQ ID NO: 70694 - RNA, 23 nt, Human
gcucugugguacuuccucucugg

SEQ ID NO: 70695 - RNA, 30 nt, Human
aagagguacacgaggaaauggaauugguau

SEQ ID NO: 70696 - RNA, 23 nt, Human
cucuaaccuuuaaaagagggguc

SEQ ID NO: 70697 - RNA, 24 nt, Human
cugauuugaaaguuuguuuuuaaa

SEQ ID NO: 70698 - RNA, 26 nt, Human
cacccaugggcucugacagaaagcag

SEQ ID NO: 70699 - RNA, 22 nt, Human
uugccucacaguuguuuguuua

SEQ ID NO: 70700 - RNA, 20 nt, Human
uugugggguggaguugagug

SEQ ID NO: 70701 - RNA, 20 nt, Human
gguagaaaugucauggguga

SEQ ID NO: 70702 - RNA, 23 nt, Human
acucuccuuagagccgacagguu

SEQ ID NO: 70703 - RNA, 22 nt, Human
aauauaaugaucagcaaaaaga

SEQ ID NO: 70704 - RNA, 22 nt, Human
ccggugcagccucuaacuccug

SEQ ID NO: 70705 - RNA, 26 nt, Human
caauucacagauaggaagaggucaau

SEQ ID NO: 70706 - RNA, 21 nt, Human
agggagggagaggaggggagc

SEQ ID NO: 70707 - RNA, 23 nt, Human
gccaggaagagaaacagcuccuc

SEQ ID NO: 70708 - RNA, 19 nt, Human
ggacacuucuuuauacucu

SEQ ID NO: 70709 - RNA, 24 nt, Human
uuuucaucuucuuccaugguucca

SEQ ID NO: 70710 - RNA, 19 nt, Human
guacucaggcagugcagua

SEQ ID NO: 70711 - RNA, 24 nt, Human
gguuuugggguguuccugauaauu

SEQ ID NO: 70712 - RNA, 21 nt, Human
cagagugcccagcugucugga

SEQ ID NO: 70713 - RNA, 26 nt, Human
gcuacucagaggaggcucauuagcug

SEQ ID NO: 70714 - RNA, 23 nt, Human
ggugcuuguugggccuuuuucca

SEQ ID NO: 70715 - RNA, 17 nt, Human
gccacugcacuccuggg

SEQ ID NO: 70716 - RNA, 24 nt, Human
gggaggccaaagcaggaggaucgc

SEQ ID NO: 70717 - RNA, 22 nt, Human
guggcaaagcaaaacucuauca

SEQ ID NO: 70718 - RNA, 21 nt, Human
gaauuaggaagauuguauuua

SEQ ID NO: 70719 - RNA, 21 nt, Human
aucucugaucccuuccuuguu

SEQ ID NO: 70720 - RNA, 24 nt, Human
gggcgccuauaaucccagcuacuu

SEQ ID NO: 70721 - RNA, 26 nt, Human
uccuccucacauggcaggugagcaca

SEQ ID NO: 70722 - RNA, 28 nt, Human
ccagaaagcagagaacugagugcagcca

SEQ ID NO: 70723 - RNA, 27 nt, Human
gagagugagagcacaaagauaacgcag

SEQ ID NO: 70724 - RNA, 27 nt, Human
gaaccagcaucggguguucacugucga

SEQ ID NO: 70725 - RNA, 19 nt, Human
auccuuuccucuagcuuuu

SEQ ID NO: 70726 - RNA, 21 nt, Human
acacuccuauuuguaccucaa

SEQ ID NO: 70727 - RNA, 26 nt, Human
aucauuuuaaaggagauacuugaauu

SEQ ID NO: 70728 - RNA, 28 nt, Human
ugcugcugguaggagacccccaagucaa

SEQ ID NO: 70729 - RNA, 23 nt, Human
gagggcgcgaggguagcagccag

SEQ ID NO: 70730 - RNA, 22 nt, Human
uggggacuucuguuuucucccu

SEQ ID NO: 70731 - RNA, 23 nt, Human
cuuccugggauucauuuuuucaa

SEQ ID NO: 70732 - RNA, 23 nt, Human
uucuguauucauaaacacuuucc

SEQ ID NO: 70733 - RNA, 24 nt, Human
cagcuugaaccugcuuccuggcuc

SEQ ID NO: 70734 - RNA, 20 nt, Human
ugccuucucccaccccgugg

SEQ ID NO: 70735 - RNA, 26 nt, Human
cccagccuguuugcuuuacugcauga

SEQ ID NO: 70736 - RNA, 26 nt, Human
ucugcucuccccgggaaucucuaaca

SEQ ID NO: 70737 - RNA, 27 nt, Human
uugaauugcuuuuucauguucaucuua

SEQ ID NO: 70738 - RNA, 26 nt, Human
acucauuccuuuuugaguuugugacc

SEQ ID NO: 70739 - RNA, 24 nt, Human
auugcuuuuguauuuaauucugca

SEQ ID NO: 70740 - RNA, 26 nt, Human
gcaucaggaaauacaacccuuuugcc

SEQ ID NO: 70741 - RNA, 24 nt, Human
gccuguccugucaucaucauggcc

SEQ ID NO: 70742 - RNA, 23 nt, Human
auuuguuuucuugcugacuuugc

SEQ ID NO: 70743 - RNA, 26 nt, Human
gaugcuggcggcgagccggguugcua

SEQ ID NO: 70744 - RNA, 27 nt, Human
guuagcauccaggcuggccagugcugc

SEQ ID NO: 70745 - RNA, 19 nt, Human
uagaaagagaagacccaga

SEQ ID NO: 70746 - RNA, 23 nt, Human
ccaacuugguuuuuugcuucacc

SEQ ID NO: 70747 - RNA, 20 nt, Human
gacccugccuuuuagaucca

SEQ ID NO: 70748 - RNA, 20 nt, Human
uauuggucuuccacagcccu

SEQ ID NO: 70749 - RNA, 29 nt, Human
gagaggcugacuuucucucggugcgucca

SEQ ID NO: 70750 - RNA, 22 nt, Human
ucacuuucccacccauuuaggg

SEQ ID NO: 70751 - RNA, 21 nt, Human
agcccagacucuuccuagccu

SEQ ID NO: 70752 - RNA, 21 nt, Human
gaaugucccugagucaacacc

SEQ ID NO: 70753 - RNA, 19 nt, Human
uucuccaaucaagcacuug

SEQ ID NO: 70754 - RNA, 26 nt, Human
ggaaaucucacauggugggcacugca

SEQ ID NO: 70755 - RNA, 22 nt, Human
caggaucguguguguggggcuu

SEQ ID NO: 70756 - RNA, 27 nt, Human
agguacccccuccacaucccuagggcu

SEQ ID NO: 70757 - RNA, 22 nt, Human
ucuuaaaagugcaggugagcca

SEQ ID NO: 70758 - RNA, 23 nt, Human
ggacagguuccgccgccuccagc

SEQ ID NO: 70759 - RNA, 23 nt, Human
aacaugcacuagaugacagauug

SEQ ID NO: 70760 - RNA, 21 nt, Human
guaggauguugagcagcaugu

SEQ ID NO: 70761 - RNA, 24 nt, Human
acccaggcugggaauugcaguggc

SEQ ID NO: 70762 - RNA, 18 nt, Human
ugcuacugcugugaggcc

SEQ ID NO: 70763 - RNA, 28 nt, Human
ggcaggggguguggcaggagcucccagc

SEQ ID NO: 70764 - RNA, 24 nt, Human
ucccaauaaaaaucaggagacccu

SEQ ID NO: 70765 - RNA, 20 nt, Human
ucacgagacacagguaggca

SEQ ID NO: 70766 - RNA, 20 nt, Human
uuccucuccaaaagcaauaa

SEQ ID NO: 70767 - RNA, 25 nt, Human
ccucuacuucugucucaaaauggcu

SEQ ID NO: 70768 - RNA, 23 nt, Human
ggggcauauaccuguaauccuag

SEQ ID NO: 70769 - RNA, 27 nt, Human
cgaaacugacuugcucaccuggaacac

SEQ ID NO: 70770 - RNA, 26 nt, Human
gugacuuccuggggccaagaaacuaa

SEQ ID NO: 70771 - RNA, 26 nt, Human
uuugcagcuguaucucacacuaugau

SEQ ID NO: 70772 - RNA, 21 nt, Human
uguuuccccucaguccuccuu

SEQ ID NO: 70773 - RNA, 23 nt, Human
uccacgcccgggagugggguaga

SEQ ID NO: 70774 - RNA, 22 nt, Human
ugcaacaacacuuuacuaccua

SEQ ID NO: 70775 - RNA, 23 nt, Human
gauuucugcuggcugcuauuaua

SEQ ID NO: 70776 - RNA, 21 nt, Human
gccugcaucuucuugcaucua

SEQ ID NO: 70777 - RNA, 23 nt, Human
cucuuucuccuccuggccuggcc

SEQ ID NO: 70778 - RNA, 28 nt, Human
cugcccuggguccugccugcaguauuac

SEQ ID NO: 70779 - RNA, 22 nt, Human
aauccagccagagaugcacauu

SEQ ID NO: 70780 - RNA, 23 nt, Human
uuuuagcacgaugugcaugauaa

SEQ ID NO: 70781 - RNA, 22 nt, Human
accagccuggccaacauggcga

SEQ ID NO: 70782 - RNA, 22 nt, Human
accagccuggcuaacaugguga

SEQ ID NO: 70783 - RNA, 28 nt, Human
agacuuuacagccccaugcuacaggcca

SEQ ID NO: 70784 - RNA, 23 nt, Human
uuggucccuuaucuuguugucac

SEQ ID NO: 70785 - RNA, 22 nt, Human
caugcagcuccuuucccccugg

SEQ ID NO: 70786 - RNA, 24 nt, Human
ugagcagcaccuucuggacagggg

SEQ ID NO: 70787 - RNA, 25 nt, Human
auuucugaccucaguuccuggaggg

SEQ ID NO: 70788 - RNA, 21 nt, Human
ccaguguccucugauccuguc

SEQ ID NO: 70789 - RNA, 20 nt, Human
cgaauaaaaaacuggauucu

SEQ ID NO: 70790 - RNA, 20 nt, Human
gggcuguguucagccacuuu

SEQ ID NO: 70791 - RNA, 23 nt, Human
ucucccacuuucuaggaucauuu

SEQ ID NO: 70792 - RNA, 20 nt, Human
ggggguggaaguguggugac

SEQ ID NO: 70793 - RNA, 21 nt, Human
ucaucaucugugucuuuuguc

SEQ ID NO: 70794 - RNA, 23 nt, Human
gaugggaaaauaugcuuggcaga

SEQ ID NO: 70795 - RNA, 27 nt, Human
uugauucagacuggaguggauaggaua

SEQ ID NO: 70796 - RNA, 27 nt, Human
agcuagcaaucuaugcaaacaccuuuc

SEQ ID NO: 70797 - RNA, 28 nt, Human
ucuugaacuccugaccucaggugauccg

SEQ ID NO: 70798 - RNA, 21 nt, Human
ggagauagugacuuugagaua

SEQ ID NO: 70799 - RNA, 24 nt, Human
uccucugcugggugccuccuugcc

SEQ ID NO: 70800 - RNA, 26 nt, Human
uaggacaccaggaggccagggaaagc

SEQ ID NO: 70801 - RNA, 27 nt, Human
ugugccaggcuggcuggcaggaacugg

SEQ ID NO: 70802 - RNA, 22 nt, Human
gaacccaggaagcagagguugc

SEQ ID NO: 70803 - RNA, 25 nt, Human
ggcacggagagaaggcccauaccuu

SEQ ID NO: 70804 - RNA, 18 nt, Human
auguugcccaggcugguc

SEQ ID NO: 70805 - RNA, 20 nt, Human
uuggagccacucuguuccug

SEQ ID NO: 70806 - RNA, 25 nt, Human
auucaucaccccuguccucucaucc

SEQ ID NO: 70807 - RNA, 21 nt, Human
ccaaugccacagacaacucac

SEQ ID NO: 70808 - RNA, 22 nt, Human
agacagcaaccaucgccugcca

SEQ ID NO: 70809 - RNA, 24 nt, Human
gugcgcugggcacuucccugcugc

SEQ ID NO: 70810 - RNA, 30 nt, Human
ggguuucuggcaccuaccuaccugcuuccc

SEQ ID NO: 70811 - RNA, 22 nt, Human
aauuugugauugaaagcacuuu

SEQ ID NO: 70812 - RNA, 29 nt, Human
ugugugcugacaggagacccagagagcua

SEQ ID NO: 70813 - RNA, 19 nt, Human
uucuggcugagauuuugga

SEQ ID NO: 70814 - RNA, 21 nt, Human
cagccggugugucuccagcag

SEQ ID NO: 70815 - RNA, 22 nt, Human
ccgagaucaugccacugcacuc

SEQ ID NO: 70816 - RNA, 22 nt, Human
ugggaagggaaagaccugacug

SEQ ID NO: 70817 - RNA, 21 nt, Human
uucugguuaucucuuuaagga

SEQ ID NO: 70818 - RNA, 22 nt, Human
ugaaagaacauacaugauacau

SEQ ID NO: 70819 - RNA, 27 nt, Human
agagcuguacccagagaguccugugcu

SEQ ID NO: 70820 - RNA, 22 nt, Human
augauguuuauuaaacacuucu

SEQ ID NO: 70821 - RNA, 20 nt, Human
uuccugagagagcaccuucu

SEQ ID NO: 70822 - RNA, 21 nt, Human
gccaggcccaagaacuagaac

SEQ ID NO: 70823 - RNA, 29 nt, Human
aggugguagugggacaggacaauuggagc

SEQ ID NO: 70824 - RNA, 22 nt, Human
cugcucccagauguccuuucuc

SEQ ID NO: 70825 - RNA, 25 nt, Human
ccugcugcugcccucgcugccccug

SEQ ID NO: 70826 - RNA, 27 nt, Human
guggcccaggcugagagcagcagggua

SEQ ID NO: 70827 - RNA, 24 nt, Human
ccacuuuucuccugggggcugggc

SEQ ID NO: 70828 - RNA, 24 nt, Human
ccgggagggugcggcugugcagcc

SEQ ID NO: 70829 - RNA, 25 nt, Human
aagagggaggaaggggccccauggc

SEQ ID NO: 70830 - RNA, 19 nt, Human
ccagcacuccucugggcug

SEQ ID NO: 70831 - RNA, 23 nt, Human
acaucuuggggagggggagggag

SEQ ID NO: 70832 - RNA, 20 nt, Human
auagucuuccaguuuaauga

SEQ ID NO: 70833 - RNA, 19 nt, Human
uucuaguaacaauuuugga

SEQ ID NO: 70834 - RNA, 24 nt, Human
caccugaggucaggaguucaagag

SEQ ID NO: 70835 - RNA, 23 nt, Human
agagcugccauuugucuccagcc

SEQ ID NO: 70836 - RNA, 23 nt, Human
ggacacuccaggguagagaauga

SEQ ID NO: 70837 - RNA, 20 nt, Human
gccgccugccugucauuccu

SEQ ID NO: 70838 - RNA, 27 nt, Human
gaacucauagaaucaugcaagcuuccu

SEQ ID NO: 70839 - RNA, 25 nt, Human
uuguaaccagaggguccuggaggug

SEQ ID NO: 70840 - RNA, 19 nt, Human
gcgaggggaaaggccugug

SEQ ID NO: 70841 - RNA, 21 nt, Human
gaaaccugcauuucucccaca

SEQ ID NO: 70842 - RNA, 16 nt, Human
ucccucuuccuguguc

SEQ ID NO: 70843 - RNA, 23 nt, Human
aggcuggagugcaguggcgugau

SEQ ID NO: 70844 - RNA, 23 nt, Human
aggcuggaguacaguggcaugau

SEQ ID NO: 70845 - RNA, 23 nt, Human
aggcuggaguguaguggcgcgau

SEQ ID NO: 70846 - RNA, 25 nt, Human
agccaagagcuucaaauuacucuag

SEQ ID NO: 70847 - RNA, 19 nt, Human
acauaguuccaguaauacu

SEQ ID NO: 70848 - RNA, 22 nt, Human
ccaucuugccagcucugucuuu

SEQ ID NO: 70849 - RNA, 27 nt, Human
caggcuggagcgcaguggggugaucuc

SEQ ID NO: 70850 - RNA, 26 nt, Human
uccuccaccuccacaugcuccgccuc

SEQ ID NO: 70851 - RNA, 28 nt, Human
gguuccuugcugacucagcacuuauuuc

SEQ ID NO: 70852 - RNA, 26 nt, Human
ggagucaucugaagaugacugaguca

SEQ ID NO: 70853 - RNA, 22 nt, Human
ugccuguagaguuaguauuucu

SEQ ID NO: 70854 - RNA, 23 nt, Human
ugaugugaagacaccugcagccu

SEQ ID NO: 70855 - RNA, 21 nt, Human
uguucacauaugcacauacac

SEQ ID NO: 70856 - RNA, 23 nt, Human
gguuccccucccuuucccugcca

SEQ ID NO: 70857 - RNA, 20 nt, Human
auaagauggaaggcagcagu

SEQ ID NO: 70858 - RNA, 22 nt, Human
ccugccgucugugcuuccuccu

SEQ ID NO: 70859 - RNA, 19 nt, Human
ucucucucgaggccacuga

SEQ ID NO: 70860 - RNA, 27 nt, Human
cuguggacucucucaguuguauguugc

SEQ ID NO: 70861 - RNA, 22 nt, Human
caucguucuuucagaagugcug

SEQ ID NO: 70862 - RNA, 21 nt, Human
aggccagcugcucacccugcc

SEQ ID NO: 70863 - RNA, 23 nt, Human
cgagcccacagaagauggcaugg

SEQ ID NO: 70864 - RNA, 22 nt, Human
gcaccauccagcaccuccguca

SEQ ID NO: 70865 - RNA, 21 nt, Human
uaagucugcucagugaaaugc

SEQ ID NO: 70866 - RNA, 23 nt, Human
ugcuucuguggcugcugcugcug

SEQ ID NO: 70867 - RNA, 20 nt, Human
gagacaaacuccuaugucau

SEQ ID NO: 70868 - RNA, 22 nt, Human
ccgaaugcauuuggaaccaaag

SEQ ID NO: 70869 - RNA, 22 nt, Human
uaggagguggcgguugcuguga

SEQ ID NO: 70870 - RNA, 26 nt, Human
gcaagcuuucucucauaacguaauga

SEQ ID NO: 70871 - RNA, 25 nt, Human
cuggcagcugugucauaaaaugcug

SEQ ID NO: 70872 - RNA, 19 nt, Human
acuuuggacaaucccaaga

SEQ ID NO: 70873 - RNA, 26 nt, Human
accagugacaggugcugccuguuuac

SEQ ID NO: 70874 - RNA, 21 nt, Human
cucgcccaucagugccagccc

SEQ ID NO: 70875 - RNA, 26 nt, Human
ugacaccuccacccucuacuuuauua

SEQ ID NO: 70876 - RNA, 21 nt, Human
ggacuccuccuuucuccuccg

SEQ ID NO: 70877 - RNA, 29 nt, Human
gccgcugugcugaaggaggugugcgacgc

SEQ ID NO: 70878 - RNA, 20 nt, Human
aggggaaggauguacuuucc

SEQ ID NO: 70879 - RNA, 26 nt, Human
ccaggccaggugcccaggaaaggacg

SEQ ID NO: 70880 - RNA, 26 nt, Human
cagcuuguucuuucuuucucuucagu

SEQ ID NO: 70881 - RNA, 22 nt, Human
cgcugccucuuuccggcuguga

SEQ ID NO: 70882 - RNA, 23 nt, Human
aucacaccauugcacugcagccu

SEQ ID NO: 70883 - RNA, 22 nt, Human
ccacgaggaacaaacagcagau

SEQ ID NO: 70884 - RNA, 25 nt, Human
ggagugcauggcgagaaucaagcac

SEQ ID NO: 70885 - RNA, 22 nt, Human
ugggagcagcagccaccuggcc

SEQ ID NO: 70886 - RNA, 22 nt, Human
aguaucuuucccuuccuucucu

SEQ ID NO: 70887 - RNA, 24 nt, Human
guuucaaagcgccagucauuugcu

SEQ ID NO: 70888 - RNA, 27 nt, Human
auuguuaucuuuaccuccugaguaaua

SEQ ID NO: 70889 - RNA, 20 nt, Human
uccgguucuuggugaagaca

SEQ ID NO: 70890 - RNA, 20 nt, Human
gcaccggguaaaaagcacaa

SEQ ID NO: 70891 - RNA, 19 nt, Human
gaaaccagcuucuugccag

SEQ ID NO: 70892 - RNA, 23 nt, Human
aacugcaggacucaggugcaaug

SEQ ID NO: 70893 - RNA, 27 nt, Human
ccacugcauuucagccugggggauaca

SEQ ID NO: 70894 - RNA, 21 nt, Human
uuggaggugguguuugcacug

SEQ ID NO: 70895 - RNA, 21 nt, Human
cgcggaaggcguggcagggag

SEQ ID NO: 70896 - RNA, 26 nt, Human
aaguguuuaauaacuggcauuaagcu

SEQ ID NO: 70897 - RNA, 20 nt, Human
uucucauucacacagaaggu

SEQ ID NO: 70898 - RNA, 27 nt, Human
ccagaucaguccuuucuaaucucagcu

SEQ ID NO: 70899 - RNA, 17 nt, Human
cuggccucucauccccc

SEQ ID NO: 70900 - RNA, 22 nt, Human
gaggaagaggagaaagucuuca

SEQ ID NO: 70901 - RNA, 27 nt, Human
uugcugucuucccucucccucaggcca

SEQ ID NO: 70902 - RNA, 22 nt, Human
caauucuccagcucaacccagc

SEQ ID NO: 70903 - RNA, 20 nt, Human
acaaaugccaccacagcagg

SEQ ID NO: 70904 - RNA, 22 nt, Human
acacccagcuaauuuuuauguu

SEQ ID NO: 70905 - RNA, 21 nt, Human
acugucagcuaaagaccugca

SEQ ID NO: 70906 - RNA, 18 nt, Human
aaggccugcagcagauga

SEQ ID NO: 70907 - RNA, 22 nt, Human
ugugaacugccuggugcagugu

SEQ ID NO: 70908 - RNA, 22 nt, Human
gcccacgagcugcccagucccu

SEQ ID NO: 70909 - RNA, 22 nt, Human
uguuacagcagauccugccucc

SEQ ID NO: 70910 - RNA, 21 nt, Human
guggguggaggcugggguguc

SEQ ID NO: 70911 - RNA, 23 nt, Human
cgggaggccuuuccugggaccuu

SEQ ID NO: 70912 - RNA, 26 nt, Human
cggccacaggcaaggggguugcagug

SEQ ID NO: 70913 - RNA, 20 nt, Human
cagggagggguuucugcuua

SEQ ID NO: 70914 - RNA, 24 nt, Human
gucgcuugccucccgcaccuccuc

SEQ ID NO: 70915 - RNA, 23 nt, Human
augauguguugguuuacagggua

SEQ ID NO: 70916 - RNA, 20 nt, Human
cucauugucuugcugcccag

SEQ ID NO: 70917 - RNA, 21 nt, Human
cccugaaucugugccugcacu

SEQ ID NO: 70918 - RNA, 19 nt, Human
gaacugagaagaagaaaua

SEQ ID NO: 70919 - RNA, 22 nt, Human
gcaaaugcacugaaacccaggg

SEQ ID NO: 70920 - RNA, 23 nt, Human
ggguugucuauacccacagcccu

SEQ ID NO: 70921 - RNA, 22 nt, Human
ugaucucaaacuccugaccuca

SEQ ID NO: 70922 - RNA, 27 nt, Human
guuucccaccaggaugaccccacagcc

SEQ ID NO: 70923 - RNA, 23 nt, Human
agcgccguuuccaggcugccuuc

SEQ ID NO: 70924 - RNA, 22 nt, Human
uugcuuucacaaauauaguuga

SEQ ID NO: 70925 - RNA, 24 nt, Human
cuccugcccgcacuccugccugcu

SEQ ID NO: 70926 - RNA, 22 nt, Human
ggcuccucugccacccaccucc

SEQ ID NO: 70927 - RNA, 26 nt, Human
gcagaaguccccggagcugcggucuc

SEQ ID NO: 70928 - RNA, 23 nt, Human
uccaguauuccgucuguagcagg

SEQ ID NO: 70929 - RNA, 26 nt, Human
ccacagccgcauacacacaggggagc

SEQ ID NO: 70930 - RNA, 21 nt, Human
augcuuguacaguugaugucg

SEQ ID NO: 70931 - RNA, 19 nt, Human
gggcaguaucucucugccu

SEQ ID NO: 70932 - RNA, 23 nt, Human
guucuguccuuccucccaucgga

SEQ ID NO: 70933 - RNA, 24 nt, Human
uccuguaccaguaggagaucagaa

SEQ ID NO: 70934 - RNA, 21 nt, Human
ucugaggcuccugcucuccca

SEQ ID NO: 70935 - RNA, 19 nt, Human
uucuccuccuaaucugggc

SEQ ID NO: 70936 - RNA, 26 nt, Human
ggaggaacggaagggagcccugcugg

SEQ ID NO: 70937 - RNA, 27 nt, Human
gguuuacagucuauuugagacuccuca

SEQ ID NO: 70938 - RNA, 22 nt, Human
acacaaaauuucacucucuaaa

SEQ ID NO: 70939 - RNA, 27 nt, Human
uggagauuggcaugccauugaaacuaa

SEQ ID NO: 70940 - RNA, 24 nt, Human
cccagcucuccccagagaggggcc

SEQ ID NO: 70941 - RNA, 23 nt, Human
gacaugagccacugugccugucu

SEQ ID NO: 70942 - RNA, 20 nt, Human
cgggccgccaccacugcucc

SEQ ID NO: 70943 - RNA, 22 nt, Human
cugacuuccuggaggagaagua

SEQ ID NO: 70944 - RNA, 23 nt, Human
uccuggagaacacguuggcucag

SEQ ID NO: 70945 - RNA, 22 nt, Human
gggagguggagguugcauugag

SEQ ID NO: 70946 - RNA, 27 nt, Human
ggcuacuguucuccugugccgcugcau

SEQ ID NO: 70947 - RNA, 28 nt, Human
uguguugugagccaggacgcaacuugcc

SEQ ID NO: 70948 - RNA, 22 nt, Human
agcuggaugucccaccucucug

SEQ ID NO: 70949 - RNA, 21 nt, Human
aaugaguuucuucaaaggagg

SEQ ID NO: 70950 - RNA, 27 nt, Human
gcugcaacuuaaugcucugauauggcu

SEQ ID NO: 70951 - RNA, 27 nt, Human
gggcuugcucucucuucaccugcucug

SEQ ID NO: 70952 - RNA, 22 nt, Human
aucauaccacugcccuccaaau

SEQ ID NO: 70953 - RNA, 26 nt, Human
gcugucauuaugaaugugacaaguuu

SEQ ID NO: 70954 - RNA, 22 nt, Human
cacagcccuuucucaggguugg

SEQ ID NO: 70955 - RNA, 20 nt, Human
uuuucauuuuauugauucuc

SEQ ID NO: 70956 - RNA, 32 nt, Human
cuccaguguaucucaaaagaccgggcgccagg

SEQ ID NO: 70957 - RNA, 21 nt, Human
ugaaaugcuuaugcuugugua

SEQ ID NO: 70958 - RNA, 22 nt, Human
ggugccccccguggagcuggcc

SEQ ID NO: 70959 - RNA, 27 nt, Human
cagcagccacuugacuaauaccuugug

SEQ ID NO: 70960 - RNA, 24 nt, Human
cugucgggguccccuccaucucgc

SEQ ID NO: 70961 - RNA, 21 nt, Human
uaugguugcuucuguccuucu

SEQ ID NO: 70962 - RNA, 20 nt, Human
agccuugccagaaggcagag

SEQ ID NO: 70963 - RNA, 20 nt, Human
ugcuucuuuugggugcagug

SEQ ID NO: 70964 - RNA, 24 nt, Human
ccuuggccuuggcuccacagggug

SEQ ID NO: 70965 - RNA, 20 nt, Human
gccgcuuucccucuggacca

SEQ ID NO: 70966 - RNA, 24 nt, Human
cagacauccugauggggaggcaga

SEQ ID NO: 70967 - RNA, 25 nt, Human
acaaucagaauugauaagcacuguu

SEQ ID NO: 70968 - RNA, 20 nt, Human
gggaauccgcccaucugggg

SEQ ID NO: 70969 - RNA, 23 nt, Human
ucacugcuggacuggagcugggc

SEQ ID NO: 70970 - RNA, 21 nt, Human
gaguccuugcaaaauugucua

SEQ ID NO: 70971 - RNA, 29 nt, Human
gcucagcucugccagcucagaggaccagc

SEQ ID NO: 70972 - RNA, 23 nt, Human
cuugcacagcccacacaugaacc

SEQ ID NO: 70973 - RNA, 23 nt, Human
gguaguguccccagccuaccucu

SEQ ID NO: 70974 - RNA, 22 nt, Human
aggcugagguacaagaauugcu

SEQ ID NO: 70975 - RNA, 27 nt, Human
ccauuuucuucugaucauacuuccuca

SEQ ID NO: 70976 - RNA, 23 nt, Human
aucaagcaacucuccugccucag

SEQ ID NO: 70977 - RNA, 27 nt, Human
uggccaacauggcggaacccugucucu

SEQ ID NO: 70978 - RNA, 21 nt, Human
guggccgaggcuggacccugu

SEQ ID NO: 70979 - RNA, 26 nt, Human
caccuugcucuucuuucugagaguug

SEQ ID NO: 70980 - RNA, 14 nt, Human
aggggaaagaggau

SEQ ID NO: 70981 - RNA, 27 nt, Human
ucacccagacagcucuguggaggcagg

SEQ ID NO: 70982 - RNA, 26 nt, Human
ccuuugcccaugugucuaugagguua

SEQ ID NO: 70983 - RNA, 20 nt, Human
uugggguuuggcugcagugg

SEQ ID NO: 70984 - RNA, 25 nt, Human
acagguugguguggguucauuggca

SEQ ID NO: 70985 - RNA, 26 nt, Human
gugaacaaaugucuuaaagggaauca

SEQ ID NO: 70986 - RNA, 24 nt, Human
auugagauacaaacagcauuuagg

SEQ ID NO: 70987 - RNA, 20 nt, Human
ucuauuaaaaauagaaaaau

SEQ ID NO: 70988 - RNA, 21 nt, Human
ggaguggggacggaagaugag

SEQ ID NO: 70989 - RNA, 25 nt, Human
uuuucucaggauggauuuuugcugu

SEQ ID NO: 70990 - RNA, 20 nt, Human
ccccagauaccagaccugag

SEQ ID NO: 70991 - RNA, 25 nt, Human
aagcaaccaccacaagcucucggga

SEQ ID NO: 70992 - RNA, 29 nt, Human
gggaggcugagacaggaggauugccugag

SEQ ID NO: 70993 - RNA, 20 nt, Human
ggagagacagcgagaucuau

SEQ ID NO: 70994 - RNA, 31 nt, Human
ggcuaaacccuuuccugauugagaguuaaag

SEQ ID NO: 70995 - RNA, 23 nt, Human
ucucccacuaucucugccccccu

SEQ ID NO: 70996 - RNA, 22 nt, Human
ugucaucacuaguggcaaauga

SEQ ID NO: 70997 - RNA, 23 nt, Human
caaaacccccaaaccuggagcag

SEQ ID NO: 70998 - RNA, 27 nt, Human
accaaaaccaaccccagagugcagaua

SEQ ID NO: 70999 - RNA, 27 nt, Human
cggccacaggcaaggggguugcagugg

SEQ ID NO: 71000 - RNA, 20 nt, Human
cuggaaaccucaccccaaau

SEQ ID NO: 71001 - RNA, 24 nt, Human
ugucccuuggagcuguaaaccaga

SEQ ID NO: 71002 - RNA, 19 nt, Human
ucagcucuccagucucugc

SEQ ID NO: 71003 - RNA, 23 nt, Human
ggaaugagcagcuuuagcaaaga

SEQ ID NO: 71004 - RNA, 18 nt, Human
gacccaggcaguguagcg

SEQ ID NO: 71005 - RNA, 20 nt, Human
agguuaaaccuuagcccugu

SEQ ID NO: 71006 - RNA, 22 nt, Human
ugggaggcugugauuugcugug

SEQ ID NO: 71007 - RNA, 23 nt, Human
gcggcagcggagagcccaggaga

SEQ ID NO: 71008 - RNA, 20 nt, Human
uuuucccuuuugccuaaauc

SEQ ID NO: 71009 - RNA, 23 nt, Human
uccagcuugguggugaaugcuga

SEQ ID NO: 71010 - RNA, 21 nt, Human
ugucuuguggccuccauggga

SEQ ID NO: 71011 - RNA, 29 nt, Human
cugcuucccaccccugccuguuccccuuc

SEQ ID NO: 71012 - RNA, 27 nt, Human
ggugaagccucugggcuuccugaagcc

SEQ ID NO: 71013 - RNA, 26 nt, Human
ugcuuugguucuggguuguuuccuaa

SEQ ID NO: 71014 - RNA, 20 nt, Human
ccgaggcuggagugcagugg

SEQ ID NO: 71015 - RNA, 22 nt, Human
ccaaguagcugggauuacaggu

SEQ ID NO: 71016 - RNA, 20 nt, Human
cacccaggcuggaguacagu

SEQ ID NO: 71017 - RNA, 20 nt, Human
cacccagacuggagugcagu

SEQ ID NO: 71018 - RNA, 24 nt, Human
acuccugccagccuccaggucccc

SEQ ID NO: 71019 - RNA, 19 nt, Human
gagggugaccucccuaccu

SEQ ID NO: 71020 - RNA, 22 nt, Human
uaaacauacuaauccucuuuca

SEQ ID NO: 71021 - RNA, 24 nt, Human
ugccuuucacuugcauccaacucc

SEQ ID NO: 71022 - RNA, 22 nt, Human
ugcgggugcuuugaagugccuu

SEQ ID NO: 71023 - RNA, 25 nt, Human
aggccgcccaccugcaucagccucu

SEQ ID NO: 71024 - RNA, 20 nt, Human
gagcucuucucaggagccuu

SEQ ID NO: 71025 - RNA, 27 nt, Human
uucucugcaaaugcaggaagaaaucag

SEQ ID NO: 71026 - RNA, 23 nt, Human
cucaagugacccuccugcaucag

SEQ ID NO: 71027 - RNA, 19 nt, Human
ugcuguugccaagacugca

SEQ ID NO: 71028 - RNA, 23 nt, Human
uucuggauguagauugagcuuau

SEQ ID NO: 71029 - RNA, 21 nt, Human
ugcacuuagaaugauguaaua

SEQ ID NO: 71030 - RNA, 27 nt, Human
cacugugcuccugggccugugacccca

SEQ ID NO: 71031 - RNA, 21 nt, Human
uucugaaggcccauucauuag

SEQ ID NO: 71032 - RNA, 22 nt, Human
ccuuggggaggggucagcucug

SEQ ID NO: 71033 - RNA, 20 nt, Human
cauuuacucucuggcagugu

SEQ ID NO: 71034 - RNA, 27 nt, Human
accacgccuggcuaggaaauuuuuugu

SEQ ID NO: 71035 - RNA, 27 nt, Human
gucaagaaaagcaugaaaacugagaug

SEQ ID NO: 71036 - RNA, 27 nt, Human
ugccuucucugccgaugacauccuggc

SEQ ID NO: 71037 - RNA, 22 nt, Human
cuggucucaaaagucaccugcc

SEQ ID NO: 71038 - RNA, 21 nt, Human
auguuauuucuugcucuguua

SEQ ID NO: 71039 - RNA, 26 nt, Human
cgggggcaggugcuggagcacugggc

SEQ ID NO: 71040 - RNA, 17 nt, Human
cugcuucuccucuuguu

SEQ ID NO: 71041 - RNA, 23 nt, Human
uaccuguaaaucccagcacuuug

SEQ ID NO: 71042 - RNA, 17 nt, Human
gguucugcagcuggacc

SEQ ID NO: 71043 - RNA, 25 nt, Human
uuugcugcugaaaugcugccucuug

SEQ ID NO: 71044 - RNA, 25 nt, Human
ccucuccuugcccugccucagcugc

SEQ ID NO: 71045 - RNA, 21 nt, Human
gacuuccucccacugucugcc

SEQ ID NO: 71046 - RNA, 21 nt, Human
aggcagcacgugguuuuauga

SEQ ID NO: 71047 - RNA, 23 nt, Human
cgcgcacacacuccugcccacgc

SEQ ID NO: 71048 - RNA, 23 nt, Human
guggccccaggguagguaacagu

SEQ ID NO: 71049 - RNA, 24 nt, Human
agguuugacaaaaagauaucaugu

SEQ ID NO: 71050 - RNA, 22 nt, Human
cccuccaccacagccauccugu

SEQ ID NO: 71051 - RNA, 27 nt, Human
uugcguuuguauauccaaauggacguu

SEQ ID NO: 71052 - RNA, 20 nt, Human
ggcuuugggugaauucugga

SEQ ID NO: 71053 - RNA, 27 nt, Human
gccauagcgccugguguauccauugag

SEQ ID NO: 71054 - RNA, 26 nt, Human
agcccaacuccucccucuccuugcuc

SEQ ID NO: 71055 - RNA, 20 nt, Human
cuagugggaguggaggcagg

SEQ ID NO: 71056 - RNA, 23 nt, Human
gacuucggaaucccaggaggcag

SEQ ID NO: 71057 - RNA, 27 nt, Human
ccacugcacugggaaucuaggaugggg

SEQ ID NO: 71058 - RNA, 27 nt, Human
cccuucccccugcuccaugggcaccuc

SEQ ID NO: 71059 - RNA, 24 nt, Human
gugcuccccuuccugccagcguca

SEQ ID NO: 71060 - RNA, 20 nt, Human
ccaggaggacaaggcugaca

SEQ ID NO: 71061 - RNA, 17 nt, Human
ccucuucucccuugcca

SEQ ID NO: 71062 - RNA, 25 nt, Human
ccugugcaguggcccccacagaaag

SEQ ID NO: 71063 - RNA, 22 nt, Human
gcacacaguggguagcaggaga

SEQ ID NO: 71064 - RNA, 26 nt, Human
gguccccguccagccugcgcuucgcc

SEQ ID NO: 71065 - RNA, 22 nt, Human
aaccuugccgggcuguuucccg

SEQ ID NO: 71066 - RNA, 26 nt, Human
auuacuaguuuuaauuagcucugccc

SEQ ID NO: 71067 - RNA, 27 nt, Human
ccuuggaguguugguggagaucagagu

SEQ ID NO: 71068 - RNA, 22 nt, Human
cugcagccuccaccucccgggu

SEQ ID NO: 71069 - RNA, 23 nt, Human
agaacagaauucuugugccuacc

SEQ ID NO: 71070 - RNA, 20 nt, Human
cugcuugccuagccccaggu

SEQ ID NO: 71071 - RNA, 19 nt, Human
uuccccuccucuuccgagc

SEQ ID NO: 71072 - RNA, 25 nt, Human
gcucauuggugaaaacaguucucag

SEQ ID NO: 71073 - RNA, 21 nt, Human
uagaaccagcacaaaugagug

SEQ ID NO: 71074 - RNA, 18 nt, Human
ugggagauggcagaggcc

SEQ ID NO: 71075 - RNA, 18 nt, Human
ugccccaaccccaccuca

SEQ ID NO: 71076 - RNA, 19 nt, Human
gugguagaagcaacugaac

SEQ ID NO: 71077 - RNA, 25 nt, Human
auaggggugauggagggggagaagc

SEQ ID NO: 71078 - RNA, 22 nt, Human
gcucagagagagaaagaucuga

SEQ ID NO: 71079 - RNA, 28 nt, Human
gguuguuggagcuuuccucaaaggguau

SEQ ID NO: 71080 - RNA, 21 nt, Human
ugcaucagugggaucccagac

SEQ ID NO: 71081 - RNA, 23 nt, Human
ccagguguccauccccgugcuga

SEQ ID NO: 71082 - RNA, 24 nt, Human
uuuaaaaaaccaaguagugucuuc

SEQ ID NO: 71083 - RNA, 21 nt, Human
cuaaagaaagcacauuuuacc

SEQ ID NO: 71084 - RNA, 26 nt, Human
ugcugaacugugagugcaguauucua

SEQ ID NO: 71085 - RNA, 20 nt, Human
ccaaggcuggagugcaguga

SEQ ID NO: 71086 - RNA, 22 nt, Human
ucaaaaccacagccacuuagug

SEQ ID NO: 71087 - RNA, 22 nt, Human
ucuucucccaucucccuucaca

SEQ ID NO: 71088 - RNA, 21 nt, Human
aagaggagaaaaagaagaaaa

SEQ ID NO: 71089 - RNA, 23 nt, Human
aaaaggagcaagagaauacugua

SEQ ID NO: 71090 - RNA, 21 nt, Human
gugauucucccuugacucugg

SEQ ID NO: 71091 - RNA, 24 nt, Human
gucuacuaagagacaucauuccau

SEQ ID NO: 71092 - RNA, 26 nt, Human
gcuggcugugccauguuuguagaugg

SEQ ID NO: 71093 - RNA, 27 nt, Human
agcucacucgcgcacgcccgcccggcc

SEQ ID NO: 71094 - RNA, 27 nt, Human
ccugccugagccuuccgaguagcuggg

SEQ ID NO: 71095 - RNA, 22 nt, Human
uguauaugcauucuuuucagau

SEQ ID NO: 71096 - RNA, 20 nt, Human
aucauugagggaaugccuug

SEQ ID NO: 71097 - RNA, 23 nt, Human
aaagaaagcagcuuguuuugaaa

SEQ ID NO: 71098 - RNA, 27 nt, Human
acacagccuuuugagcacacaugagaa

SEQ ID NO: 71099 - RNA, 20 nt, Human
ccuuucgugaacacauucuu

SEQ ID NO: 71100 - RNA, 22 nt, Human
gccauuuuuagcucugaucagc

SEQ ID NO: 71101 - RNA, 17 nt, Human
uuaagaaugagguaguu

SEQ ID NO: 71102 - RNA, 26 nt, Human
gggugaggcgcaaaaggauaaaaagc

SEQ ID NO: 71103 - RNA, 19 nt, Human
cugggccuuuuaugugccg

SEQ ID NO: 71104 - RNA, 21 nt, Human
uggcaaaucugucggucucca

SEQ ID NO: 71105 - RNA, 25 nt, Human
ggagggagguggagggagggaaggg

SEQ ID NO: 71106 - RNA, 22 nt, Human
auuccucauucugcauccuggc

SEQ ID NO: 71107 - RNA, 19 nt, Human
ccucccucuccacucugag

SEQ ID NO: 71108 - RNA, 25 nt, Human
cucacucucccuuguacagccuuau

SEQ ID NO: 71109 - RNA, 24 nt, Human
aagcuccuuuucuccaccucucuc

SEQ ID NO: 71110 - RNA, 16 nt, Human
gcugugccaucagcuc

SEQ ID NO: 71111 - RNA, 21 nt, Human
uugagccuccauuucuggcuu

SEQ ID NO: 71112 - RNA, 24 nt, Human
caggccaccuggcucucaccucua

SEQ ID NO: 71113 - RNA, 27 nt, Human
aaguagcuggguuuacaggcacccacc

SEQ ID NO: 71114 - RNA, 27 nt, Human
cuccagccucagggccucuucuggaaa

SEQ ID NO: 71115 - RNA, 19 nt, Human
gacauugagaaaaggaugg

SEQ ID NO: 71116 - RNA, 27 nt, Human
ccacaaacacagcacuucggcuccucu

SEQ ID NO: 71117 - RNA, 22 nt, Human
ugucgcccaggcuggagugcag

SEQ ID NO: 71118 - RNA, 22 nt, Human
uguugcccaggcuggaguguag

SEQ ID NO: 71119 - RNA, 22 nt, Human
ugucacccaggcuggagugcgg

SEQ ID NO: 71120 - RNA, 18 nt, Human
gcuaucucucagugaacu

SEQ ID NO: 71121 - RNA, 25 nt, Human
cacccucucugggccucaguuuccc

SEQ ID NO: 71122 - RNA, 23 nt, Human
uuacuguccugggaaaaucauuu

SEQ ID NO: 71123 - RNA, 22 nt, Human
gucgccuaagcuggaguguggu

SEQ ID NO: 71124 - RNA, 20 nt, Human
uugauguguuugucaccucc

SEQ ID NO: 71125 - RNA, 24 nt, Human
ugagguggggaagccggggagggc

SEQ ID NO: 71126 - RNA, 23 nt, Human
gaagaagagaaacugggccagca

SEQ ID NO: 71127 - RNA, 21 nt, Human
uuccaggauggcagcaauggc

SEQ ID NO: 71128 - RNA, 21 nt, Human
cggaagccuugguaauccaga

SEQ ID NO: 71129 - RNA, 19 nt, Human
uccucuuaagaagauuaaa

SEQ ID NO: 71130 - RNA, 22 nt, Human
ucugccuggaguguaugacugc

SEQ ID NO: 71131 - RNA, 19 nt, Human
agcuacucgggaggcugag

SEQ ID NO: 71132 - RNA, 24 nt, Human
gcucagcgccccggcugggcggag

SEQ ID NO: 71133 - RNA, 24 nt, Human
ugggcaugugggcuucaacuccuc

SEQ ID NO: 71134 - RNA, 22 nt, Human
agcuugggaggaagcccaguag

SEQ ID NO: 71135 - RNA, 32 nt, Human
cuuagacauguugugaggagacuaugauauaa

SEQ ID NO: 71136 - RNA, 22 nt, Human
gugccuccccucccccuuuguu

SEQ ID NO: 71137 - RNA, 20 nt, Human
augaaaaugugaauacauac

SEQ ID NO: 71138 - RNA, 24 nt, Human
uagcuuccuccugguguccuggcc

SEQ ID NO: 71139 - RNA, 23 nt, Human
guucccaggagggaagagguucc

SEQ ID NO: 71140 - RNA, 20 nt, Human
gugagcuuggcagggccagg

SEQ ID NO: 71141 - RNA, 22 nt, Human
ugcccaccccuccaugcuccac

SEQ ID NO: 71142 - RNA, 28 nt, Human
gcccacauucucuucccugccugccugu

SEQ ID NO: 71143 - RNA, 21 nt, Human
acucagcugcuucuuugguca

SEQ ID NO: 71144 - RNA, 21 nt, Human
gaguccuggaaaaggaaaauu

SEQ ID NO: 71145 - RNA, 19 nt, Human
uucugcuacuuugcugcua

SEQ ID NO: 71146 - RNA, 21 nt, Human
ugcuaauuucuuuuguuuugu

SEQ ID NO: 71147 - RNA, 23 nt, Human
uuaguagagacgggguuucucca

SEQ ID NO: 71148 - RNA, 26 nt, Human
ggguaaucuucacagaaaugacugag

SEQ ID NO: 71149 - RNA, 21 nt, Human
uccagccugggcaacagagcg

SEQ ID NO: 71150 - RNA, 21 nt, Human
uccagccuggguaacagagug

SEQ ID NO: 71151 - RNA, 21 nt, Human
caggggguggacaaacuggag

SEQ ID NO: 71152 - RNA, 22 nt, Human
gcucacgcauguaaucccagca

SEQ ID NO: 71153 - RNA, 25 nt, Human
ucuuuguuaugacagugaauauugc

SEQ ID NO: 71154 - RNA, 26 nt, Human
ggcggguggagacuuugggauggacu

SEQ ID NO: 71155 - RNA, 20 nt, Human
cugcccacagggccugugcc

SEQ ID NO: 71156 - RNA, 31 nt, Human
uuucagaauaaaauuaggaacaguaaaaucc

SEQ ID NO: 71157 - RNA, 23 nt, Human
cccucccucucccccucauaacc

SEQ ID NO: 71158 - RNA, 21 nt, Human
cuugcccaggcuggagugcaa

SEQ ID NO: 71159 - RNA, 27 nt, Human
cuuugcaggaaguuugcaaaagucuuu

SEQ ID NO: 71160 - RNA, 23 nt, Human
agguuugcuugaccucugccuca

SEQ ID NO: 71161 - RNA, 21 nt, Human
agauaacuaggaaauccauuc

SEQ ID NO: 71162 - RNA, 22 nt, Human
cuguauuuuuaaaugaagagcu

SEQ ID NO: 71163 - RNA, 27 nt, Human
cugagcccugcucgguuuaggccuguc

SEQ ID NO: 71164 - RNA, 19 nt, Human
caguggagaaauguaaaga

SEQ ID NO: 71165 - RNA, 22 nt, Human
aggccuuacaguccaaccuuuu

SEQ ID NO: 71166 - RNA, 21 nt, Human
cuacuaauaauagagcacuug

SEQ ID NO: 71167 - RNA, 27 nt, Human
uugggaggcagagggcagcuacugcag

SEQ ID NO: 71168 - RNA, 22 nt, Human
cggaauagauaauuaagaguga

SEQ ID NO: 71169 - RNA, 27 nt, Human
cccuuuugcagguauuaaaaauaauua

SEQ ID NO: 71170 - RNA, 22 nt, Human
gggguggggugagagugugugg

SEQ ID NO: 71171 - RNA, 21 nt, Human
cuaucccacgaugcaguauug

SEQ ID NO: 71172 - RNA, 23 nt, Human
cuuccgccucccccauccugggc

SEQ ID NO: 71173 - RNA, 26 nt, Human
agcaggagaagacgcagccgggccgc

SEQ ID NO: 71174 - RNA, 20 nt, Human
ccugggcagcuacaagugca

SEQ ID NO: 71175 - RNA, 27 nt, Human
uucuccuccuagcuaguccuguccugc

SEQ ID NO: 71176 - RNA, 21 nt, Human
cgcccaggcuggagggcagug

SEQ ID NO: 71177 - RNA, 21 nt, Human
cgcccaugcuggagugcagug

SEQ ID NO: 71178 - RNA, 24 nt, Human
ugcaguucuaguuugcauuccuga

SEQ ID NO: 71179 - RNA, 24 nt, Human
ggccagcccagccaggccaacagc

SEQ ID NO: 71180 - RNA, 24 nt, Human
gccguucuucuguguaauauuaag

SEQ ID NO: 71181 - RNA, 21 nt, Human
uccccugggggccugagagac

SEQ ID NO: 71182 - RNA, 25 nt, Human
agcuuaaucucuauguuucucucca

SEQ ID NO: 71183 - RNA, 21 nt, Human
ucugcaggcugggggcagagg

SEQ ID NO: 71184 - RNA, 23 nt, Human
cccaccugccccugccucucagc

SEQ ID NO: 71185 - RNA, 24 nt, Human
agaugggggaggaggcaguaauaa

SEQ ID NO: 71186 - RNA, 21 nt, Human
uuucuauccaucgucuucauu

SEQ ID NO: 71187 - RNA, 20 nt, Human
ugaagugaaagaagaaccag

SEQ ID NO: 71188 - RNA, 17 nt, Human
gaguuugauucuuaccu

SEQ ID NO: 71189 - RNA, 26 nt, Human
ccaccccucacaccuggcuucuagaa

SEQ ID NO: 71190 - RNA, 22 nt, Human
aagcccaggccaggcagccaaa

SEQ ID NO: 71191 - RNA, 27 nt, Human
ggcugccuuuggaaguccagagcugga

SEQ ID NO: 71192 - RNA, 20 nt, Human
uuaguaaauguacuuguuua

SEQ ID NO: 71193 - RNA, 21 nt, Human
gcucaggcuccugaaggguug

SEQ ID NO: 71194 - RNA, 23 nt, Human
caacuugcuucauuucuuuuuca

SEQ ID NO: 71195 - RNA, 22 nt, Human
auccucugggguuucagcuuau

SEQ ID NO: 71196 - RNA, 22 nt, Human
ggccuccuggguucaaaugauu

SEQ ID NO: 71197 - RNA, 21 nt, Human
cuaccuggcugggauucuggu

SEQ ID NO: 71198 - RNA, 31 nt, Human
cggagcccagggcagaggcagcucagagugg

SEQ ID NO: 71199 - RNA, 22 nt, Human
agcuggaacccaagcugcagca

SEQ ID NO: 71200 - RNA, 18 nt, Human
uucauugucucucacaga

SEQ ID NO: 71201 - RNA, 19 nt, Human
aauccaggcgugagagugu

SEQ ID NO: 71202 - RNA, 27 nt, Human
ucuucuuuuucuucuuguuucucauga

SEQ ID NO: 71203 - RNA, 23 nt, Human
agguccuugugguuuuccaguua

SEQ ID NO: 71204 - RNA, 16 nt, Human
ucugugagcugaggcc

SEQ ID NO: 71205 - RNA, 23 nt, Human
caggccaccuccagaaacggcca

SEQ ID NO: 71206 - RNA, 23 nt, Human
ucagcacuuaauuuuaauguaag

SEQ ID NO: 71207 - RNA, 21 nt, Human
uuuaguuuuucacuuuagcaa

SEQ ID NO: 71208 - RNA, 27 nt, Human
caggcuggagugcaguggcgagaucuc

SEQ ID NO: 71209 - RNA, 27 nt, Human
uucauucuuacuaguuucauucuaauc

SEQ ID NO: 71210 - RNA, 20 nt, Human
cucucugggggcaggugcca

SEQ ID NO: 71211 - RNA, 22 nt, Human
acuauuuugcagcauagcuacc

SEQ ID NO: 71212 - RNA, 22 nt, Human
ucugugucccaggcuggagugc

SEQ ID NO: 71213 - RNA, 17 nt, Human
uccugcccaagcacuuc

SEQ ID NO: 71214 - RNA, 23 nt, Human
ggcaggagaaucacuuggaccug

SEQ ID NO: 71215 - RNA, 26 nt, Human
ggcggcaccuuuccucuaauccagca

SEQ ID NO: 71216 - RNA, 26 nt, Human
ucucucucuaaaaauacugacauuuc

SEQ ID NO: 71217 - RNA, 22 nt, Human
guucucuccccacccccucacc

SEQ ID NO: 71218 - RNA, 27 nt, Human
uucugagcacucaacucauguuuggca

SEQ ID NO: 71219 - RNA, 20 nt, Human
ugcuucuugagaucucccug

SEQ ID NO: 71220 - RNA, 26 nt, Human
cacugcacuccagucugggugagagu

SEQ ID NO: 71221 - RNA, 23 nt, Human
guuaccacuuguuagaaggcagg

SEQ ID NO: 71222 - RNA, 25 nt, Human
cagauauauuuucuuucucuuccuc

SEQ ID NO: 71223 - RNA, 27 nt, Human
gagccccggauccgguggggugaaagc

SEQ ID NO: 71224 - RNA, 23 nt, Human
acuguauuuugcauuuugucuac

SEQ ID NO: 71225 - RNA, 21 nt, Human
gugguaugaucacggcucacu

SEQ ID NO: 71226 - RNA, 20 nt, Human
ucacuccugccacuguucca

SEQ ID NO: 71227 - RNA, 23 nt, Human
uuuuuguuggggggugggagagg

SEQ ID NO: 71228 - RNA, 25 nt, Human
gcugacuuugccaaccugcccagcu

SEQ ID NO: 71229 - RNA, 21 nt, Human
guaagcuuuuucacuuaguau

SEQ ID NO: 71230 - RNA, 21 nt, Human
acacuccccucucccucuuuc

SEQ ID NO: 71231 - RNA, 20 nt, Human
cuucauccugcggggcuggc

SEQ ID NO: 71232 - RNA, 27 nt, Human
cauauuccuuucuaucauuuuuguaca

SEQ ID NO: 71233 - RNA, 22 nt, Human
uccuggguggcacaucccaaga

SEQ ID NO: 71234 - RNA, 19 nt, Human
gccacauccucugagaaga

SEQ ID NO: 71235 - RNA, 25 nt, Human
acaucagugaguuggcuacagcaga

SEQ ID NO: 71236 - RNA, 29 nt, Human
cccaaugugcugggauuacaguugucacg

SEQ ID NO: 71237 - RNA, 27 nt, Human
agggugcugggagcuggcaggguccuu

SEQ ID NO: 71238 - RNA, 22 nt, Human
ugcagugagccgagauugcgcc

SEQ ID NO: 71239 - RNA, 21 nt, Human
ugccccaucugacgcucggcu

SEQ ID NO: 71240 - RNA, 29 nt, Human
cugggccuccauggccccaaaaacucccu

SEQ ID NO: 71241 - RNA, 27 nt, Human
caggccugggggccccaugcuaggcuu

SEQ ID NO: 71242 - RNA, 21 nt, Human
ccucacucagcuccugcugcu

SEQ ID NO: 71243 - RNA, 21 nt, Human
gcuggugccuccuccuucacc

SEQ ID NO: 71244 - RNA, 23 nt, Human
auuuuuaucaaggcuaagucccc

SEQ ID NO: 71245 - RNA, 22 nt, Human
uuagaggcuagagggagcugag

SEQ ID NO: 71246 - RNA, 22 nt, Human
cugucacuaugcucucuugccu

SEQ ID NO: 71247 - RNA, 22 nt, Human
ccgaguagcugagauuauaggc

SEQ ID NO: 71248 - RNA, 22 nt, Human
cucaaccucccaagcaguuggg

SEQ ID NO: 71249 - RNA, 26 nt, Human
agccccauuugugcccugccgcacaa

SEQ ID NO: 71250 - RNA, 27 nt, Human
agcuuugacaaggaacuuuccuaagaa

SEQ ID NO: 71251 - RNA, 30 nt, Human
ugcccugcccucucaccucugacacccagc

SEQ ID NO: 71252 - RNA, 20 nt, Human
aacuacugccuccucauuuu

SEQ ID NO: 71253 - RNA, 26 nt, Human
cuuuguuuucuaugaaaaugauaugg

SEQ ID NO: 71254 - RNA, 21 nt, Human
ccugagcugcaucaccuccua

SEQ ID NO: 71255 - RNA, 23 nt, Human
uucccuggcaggcagccuugcca

SEQ ID NO: 71256 - RNA, 26 nt, Human
gugcgcggagcagucagggcgcaggu

SEQ ID NO: 71257 - RNA, 25 nt, Human
uggcuaaacuacuaacuaauguggg

SEQ ID NO: 71258 - RNA, 23 nt, Human
uggcaccuucagacuuugcuucc

SEQ ID NO: 71259 - RNA, 24 nt, Human
aaaugauuucaguugaauaacuug

SEQ ID NO: 71260 - RNA, 18 nt, Human
uggccuuuugcagcugau

SEQ ID NO: 71261 - RNA, 19 nt, Human
caugccacugccugcaccu

SEQ ID NO: 71262 - RNA, 22 nt, Human
ccacagccauggccgagagugg

SEQ ID NO: 71263 - RNA, 20 nt, Human
cugccugggaugcccccugc

SEQ ID NO: 71264 - RNA, 20 nt, Human
ggguucucuucacacuauca

SEQ ID NO: 71265 - RNA, 26 nt, Human
cuguugucugugccuuuuugaaaaac

SEQ ID NO: 71266 - RNA, 22 nt, Human
gcagggguggcagaaguacugu

SEQ ID NO: 71267 - RNA, 21 nt, Human
gccuguaauuuugguucuugg

SEQ ID NO: 71268 - RNA, 22 nt, Human
gaaucacugcaaaaugaaucca

SEQ ID NO: 71269 - RNA, 26 nt, Human
gcuuggaucaugcucgucugcccuca

SEQ ID NO: 71270 - RNA, 27 nt, Human
cugggaggugggggugagccccucaca

SEQ ID NO: 71271 - RNA, 22 nt, Human
cgaacuccugacaucaggugau

SEQ ID NO: 71272 - RNA, 22 nt, Human
cugggauuugucaagaagugaa

SEQ ID NO: 71273 - RNA, 22 nt, Human
uucauuucuguguauuuucuaa

SEQ ID NO: 71274 - RNA, 26 nt, Human
ggagggacucuggaguagcagagggg

SEQ ID NO: 71275 - RNA, 27 nt, Human
ccaagccccaaugccagaauucuucca

SEQ ID NO: 71276 - RNA, 24 nt, Human
uccucccaaaggcuuucuuuccaa

SEQ ID NO: 71277 - RNA, 27 nt, Human
gugagccaaggacagggcuggcuccuc

SEQ ID NO: 71278 - RNA, 26 nt, Human
ggggagcaggcccguggcaggaggag

SEQ ID NO: 71279 - RNA, 22 nt, Human
ucggauuacaaacgugagccau

SEQ ID NO: 71280 - RNA, 24 nt, Human
acugccugaguugugccucuugug

SEQ ID NO: 71281 - RNA, 27 nt, Human
gggaaucggagguugcagggccaagau

SEQ ID NO: 71282 - RNA, 19 nt, Human
guauauauuuuaaaagccu

SEQ ID NO: 71283 - RNA, 23 nt, Human
ugagcagcugggauuacaggugc

SEQ ID NO: 71284 - RNA, 23 nt, Human
ugaguagcugggauuacaggcgc

SEQ ID NO: 71285 - RNA, 23 nt, Human
ccagcaaugcccugccuugcugc

SEQ ID NO: 71286 - RNA, 20 nt, Human
caacagcagcuccuccuccg

SEQ ID NO: 71287 - RNA, 26 nt, Human
ccugaaggcucugggcucaccauaca

SEQ ID NO: 71288 - RNA, 28 nt, Human
uuuagucugagccuggagauguucuaga

SEQ ID NO: 71289 - RNA, 21 nt, Human
uuaaucaguuugcuuucucca

SEQ ID NO: 71290 - RNA, 24 nt, Human
aggagccaggugaggaggagccag

SEQ ID NO: 71291 - RNA, 22 nt, Human
ccuccacuggaauguaggcucc

SEQ ID NO: 71292 - RNA, 22 nt, Human
cuaacauggcaaaaccccaucu

SEQ ID NO: 71293 - RNA, 22 nt, Human
ccgacauggugaaaccccaucu

SEQ ID NO: 71294 - RNA, 22 nt, Human
ccaacauggugaaaccccgucu

SEQ ID NO: 71295 - RNA, 22 nt, Human
ccaacaugguaaaaccccaucu

SEQ ID NO: 71296 - RNA, 22 nt, Human
cuaacauggcgaaaccccgucu

SEQ ID NO: 71297 - RNA, 22 nt, Human
ccaacauggcgaaacccugucu

SEQ ID NO: 71298 - RNA, 22 nt, Human
cuaacauggugaaacccugucu

SEQ ID NO: 71299 - RNA, 20 nt, Human
uguuuuuagugaauuucuua

SEQ ID NO: 71300 - RNA, 17 nt, Human
uaaaccuagccuagcca

SEQ ID NO: 71301 - RNA, 22 nt, Human
caaagaacugccccaucuccuc

SEQ ID NO: 71302 - RNA, 22 nt, Human
ggacccaaaucacuauguagcu

SEQ ID NO: 71303 - RNA, 26 nt, Human
agcaacaaaagaaaaugcacucuaac

SEQ ID NO: 71304 - RNA, 18 nt, Human
acuccagugauguuuuuc

SEQ ID NO: 71305 - RNA, 19 nt, Human
acuucaccuccauccuggu

SEQ ID NO: 71306 - RNA, 18 nt, Human
ccuuacaauccuguccca

SEQ ID NO: 71307 - RNA, 24 nt, Human
uguggcccaggcugagagcagcag

SEQ ID NO: 71308 - RNA, 26 nt, Human
uuagaugauucagcuuuuguuccauu

SEQ ID NO: 71309 - RNA, 21 nt, Human
cuuugauucuccuuugguagg

SEQ ID NO: 71310 - RNA, 20 nt, Human
gcuuccuuggcuuuuacuga

SEQ ID NO: 71311 - RNA, 20 nt, Human
auucaugccaaagcaaaaga

SEQ ID NO: 71312 - RNA, 20 nt, Human
cuuaagugacauuuagauaa

SEQ ID NO: 71313 - RNA, 24 nt, Human
ccugccuggcaggcugucuggcca

SEQ ID NO: 71314 - RNA, 29 nt, Human
ugcugccaaucuccagcuacuguggccac

SEQ ID NO: 71315 - RNA, 21 nt, Human
aacgugcacuuccuguccucg

SEQ ID NO: 71316 - RNA, 27 nt, Human
cucaguggugccugcaaccccugguuc

SEQ ID NO: 71317 - RNA, 22 nt, Human
ucaaaguugccuggugaaggaa

SEQ ID NO: 71318 - RNA, 18 nt, Human
cgcuuccuggaagugaag

SEQ ID NO: 71319 - RNA, 21 nt, Human
uaugcugguaggcuccugcca

SEQ ID NO: 71320 - RNA, 19 nt, Human
uaucugcucgcaucccacu

SEQ ID NO: 71321 - RNA, 27 nt, Human
uggaaggcaaggugcuauaauggcagg

SEQ ID NO: 71322 - RNA, 23 nt, Human
uccuugucugggucuaccaggaa

SEQ ID NO: 71323 - RNA, 27 nt, Human
uccugcuccugggguaacacaugcgcu

SEQ ID NO: 71324 - RNA, 27 nt, Human
accauuucgacucgagcagugccacuu

SEQ ID NO: 71325 - RNA, 23 nt, Human
cccaucaauugcucaaauacuca

SEQ ID NO: 71326 - RNA, 22 nt, Human
cucagcucagcucuccuccucu

SEQ ID NO: 71327 - RNA, 22 nt, Human
caguuucuaaauaaaauucugu

SEQ ID NO: 71328 - RNA, 17 nt, Human
uucuacaauagguuggg

SEQ ID NO: 71329 - RNA, 23 nt, Human
acaaccugaggcacugugcucgg

SEQ ID NO: 71330 - RNA, 22 nt, Human
auacucuuugugcaagugccuu

SEQ ID NO: 71331 - RNA, 22 nt, Human
agcucagucucagccuuguguu

SEQ ID NO: 71332 - RNA, 21 nt, Human
ggcuuugggguuucgcccuau

SEQ ID NO: 71333 - RNA, 21 nt, Human
cccagugacuagaccuuccag

SEQ ID NO: 71334 - RNA, 23 nt, Human
ucucucugacuuuuugugucucc

SEQ ID NO: 71335 - RNA, 21 nt, Human
ugucggucaggcuggucucga

SEQ ID NO: 71336 - RNA, 27 nt, Human
uugguccacagggccauuucaagcaag

SEQ ID NO: 71337 - RNA, 22 nt, Human
aggagaucagagaccagaggaa

SEQ ID NO: 71338 - RNA, 23 nt, Human
guuuugagagacuuccucuuggc

SEQ ID NO: 71339 - RNA, 25 nt, Human
uguuggggaaaaagaaaaguaaaaa

SEQ ID NO: 71340 - RNA, 27 nt, Human
acuguaugguggagaaagaagugggaa

SEQ ID NO: 71341 - RNA, 20 nt, Human
uccucuuggagaaaauaaca

SEQ ID NO: 71342 - RNA, 19 nt, Human
cccuggggccuggcuuaaa

SEQ ID NO: 71343 - RNA, 25 nt, Human
gccucaaggggugcggcccucucag

SEQ ID NO: 71344 - RNA, 27 nt, Human
ggggugagugacccaccgacugagggc

SEQ ID NO: 71345 - RNA, 22 nt, Human
caaacuuuucuauuucacuggg

SEQ ID NO: 71346 - RNA, 22 nt, Human
gaccaaaaccuggguguccuca

SEQ ID NO: 71347 - RNA, 19 nt, Human
ggucuggcugguguuaaca

SEQ ID NO: 71348 - RNA, 19 nt, Human
uugcucugccacagacaua

SEQ ID NO: 71349 - RNA, 20 nt, Human
uggguuaacaaaugagccau

SEQ ID NO: 71350 - RNA, 20 nt, Human
cucucugcugcuggcauguu

SEQ ID NO: 71351 - RNA, 22 nt, Human
ucaguuucacuggguaucugca

SEQ ID NO: 71352 - RNA, 20 nt, Human
acucacugcaaccuccgccu

SEQ ID NO: 71353 - RNA, 26 nt, Human
gugcagcucugucccagccuucacug

SEQ ID NO: 71354 - RNA, 22 nt, Human
gccuggucaggcccuggugcga

SEQ ID NO: 71355 - RNA, 20 nt, Human
ggggccuccugccugggcag

SEQ ID NO: 71356 - RNA, 26 nt, Human
cguccuuccuuagacagaggccagca

SEQ ID NO: 71357 - RNA, 22 nt, Human
uuuccaucuguacuccccucau

SEQ ID NO: 71358 - RNA, 27 nt, Human
uccuccaggaauucccagcaggcucuc

SEQ ID NO: 71359 - RNA, 24 nt, Human
guaccuuaaauuugcaucuucccu

SEQ ID NO: 71360 - RNA, 23 nt, Human
ucagcuccccggcacugcagucu

SEQ ID NO: 71361 - RNA, 28 nt, Human
gggagcaucagagaaggccaggaagaau

SEQ ID NO: 71362 - RNA, 21 nt, Human
guaggucuuucacagcuagcu

SEQ ID NO: 71363 - RNA, 23 nt, Human
caauaaacauccugaaccucugu

SEQ ID NO: 71364 - RNA, 23 nt, Human
ccugccugcccaccccuccaugc

SEQ ID NO: 71365 - RNA, 19 nt, Human
cccuccacuccacucugcu

SEQ ID NO: 71366 - RNA, 22 nt, Human
gaacuccagcacccaccucccu

SEQ ID NO: 71367 - RNA, 23 nt, Human
ggcuauuggguuuuacuagauua

SEQ ID NO: 71368 - RNA, 20 nt, Human
augacuccaacagacaggau

SEQ ID NO: 71369 - RNA, 20 nt, Human
uccuggagcccauaccucac

SEQ ID NO: 71370 - RNA, 26 nt, Human
caggccucucagaagucccagcagga

SEQ ID NO: 71371 - RNA, 26 nt, Human
ugccuuaaguaggaagagagggaagg

SEQ ID NO: 71372 - RNA, 22 nt, Human
ucuuccauagggcaguuguugc

SEQ ID NO: 71373 - RNA, 21 nt, Human
gugguucucugggccucaguu

SEQ ID NO: 71374 - RNA, 21 nt, Human
ugucaucagaguagagaaugc

SEQ ID NO: 71375 - RNA, 26 nt, Human
ggggugaguguaguucuggccuagca

SEQ ID NO: 71376 - RNA, 26 nt, Human
aggucccugcuggaguguuuccagug

SEQ ID NO: 71377 - RNA, 23 nt, Human
cuacagugauuuguauuuuucua

SEQ ID NO: 71378 - RNA, 21 nt, Human
gccgccucccccuccucugcc

SEQ ID NO: 71379 - RNA, 19 nt, Human
uauuaaaaugcauuuuauc

SEQ ID NO: 71380 - RNA, 27 nt, Human
aacuguacugcugcauuuccugucuuc

SEQ ID NO: 71381 - RNA, 22 nt, Human
cccaaagcgauaggauuacagg

SEQ ID NO: 71382 - RNA, 21 nt, Human
ccccuguuagcauucccacgu

SEQ ID NO: 71383 - RNA, 20 nt, Human
gcugcucugggcagcgccuu

SEQ ID NO: 71384 - RNA, 21 nt, Human
ucacccagguuggagugcagu

SEQ ID NO: 71385 - RNA, 21 nt, Human
ucacccaggcuggaguguagu

SEQ ID NO: 71386 - RNA, 27 nt, Human
ggaggcugaggcacgagaaucgcuuga

SEQ ID NO: 71387 - RNA, 22 nt, Human
aucaaaguccagaucuccaucu

SEQ ID NO: 71388 - RNA, 20 nt, Human
aauugggaguccaggcacag

SEQ ID NO: 71389 - RNA, 21 nt, Human
ucgcccaggcuggagcgcagu

SEQ ID NO: 71390 - RNA, 20 nt, Human
auuuaaaacauuuuaccuca

SEQ ID NO: 71391 - RNA, 20 nt, Human
uuagagccaccgugccaucc

SEQ ID NO: 71392 - RNA, 26 nt, Human
aacagguguccaugggacaaaaaaga

SEQ ID NO: 71393 - RNA, 22 nt, Human
ugcgggggagcaggcagugggg

SEQ ID NO: 71394 - RNA, 27 nt, Human
uuugcagcacuuuaccucucugaaagc

SEQ ID NO: 71395 - RNA, 28 nt, Human
gugucagggggagacuugcugguggguu

SEQ ID NO: 71396 - RNA, 20 nt, Human
cacccaggaggaaggccgug

SEQ ID NO: 71397 - RNA, 21 nt, Human
gcugggccagaguuaagggaa

SEQ ID NO: 71398 - RNA, 29 nt, Human
uuguggacucuuuaaaaucugguauccua

SEQ ID NO: 71399 - RNA, 27 nt, Human
cucuuuggaaucgugaacacaggugug

SEQ ID NO: 71400 - RNA, 21 nt, Human
auagagcuccagaaacagcac

SEQ ID NO: 71401 - RNA, 20 nt, Human
uugcuguccauccuuuuuca

SEQ ID NO: 71402 - RNA, 22 nt, Human
cagcccagggggcaggagaagc

SEQ ID NO: 71403 - RNA, 30 nt, Human
ucucucuaaauaugccccaggaugaccgag

SEQ ID NO: 71404 - RNA, 22 nt, Human
ccucagcuucauguccagugga

SEQ ID NO: 71405 - RNA, 23 nt, Human
agcugcuuguccugcucucuuca

SEQ ID NO: 71406 - RNA, 21 nt, Human
ggccacacuggggcagagggg

SEQ ID NO: 71407 - RNA, 23 nt, Human
gguggaugccugguggcagcugc

SEQ ID NO: 71408 - RNA, 27 nt, Human
aggcgcuuggcugggcucucagcccgc

SEQ ID NO: 71409 - RNA, 20 nt, Human
caggaaggaggaggagucug

SEQ ID NO: 71410 - RNA, 21 nt, Human
gggaacuauguuugaauaugu

SEQ ID NO: 71411 - RNA, 22 nt, Human
uucucauugagccucaggcuau

SEQ ID NO: 71412 - RNA, 19 nt, Human
gcuggccacagaugccacu

SEQ ID NO: 71413 - RNA, 26 nt, Human
cagauuagaguccugccuugggcagc

SEQ ID NO: 71414 - RNA, 29 nt, Human
ucuuucagcauucaaucaggcugagcuga

SEQ ID NO: 71415 - RNA, 20 nt, Human
uuggaugugugauguuuaua

SEQ ID NO: 71416 - RNA, 22 nt, Human
ccuccgcggugggggcuuggag

SEQ ID NO: 71417 - RNA, 23 nt, Human
ugugaucauacaguuaugugggu

SEQ ID NO: 71418 - RNA, 27 nt, Human
gggagagagcgagaccugggagggagg

SEQ ID NO: 71419 - RNA, 22 nt, Human
uugcccaggcuggagugcagag

SEQ ID NO: 71420 - RNA, 25 nt, Human
cuuucucuugggugaggcucuggca

SEQ ID NO: 71421 - RNA, 22 nt, Human
aggcugaggcaggaggaucccu

SEQ ID NO: 71422 - RNA, 23 nt, Human
gacagcgccgggaagaugagcac

SEQ ID NO: 71423 - RNA, 23 nt, Human
cucaccccacccggggcucacuc

SEQ ID NO: 71424 - RNA, 26 nt, Human
uguugcccaggcuggaguucagcggu

SEQ ID NO: 71425 - RNA, 20 nt, Human
ggcuaauuuuucauuuuugg

SEQ ID NO: 71426 - RNA, 28 nt, Human
cugccugaguugugccucuugugugcua

SEQ ID NO: 71427 - RNA, 21 nt, Human
aguaucucucgggugcccuca

SEQ ID NO: 71428 - RNA, 24 nt, Human
cuucccaagcaucagucuacacca

SEQ ID NO: 71429 - RNA, 15 nt, Human
gccacaaaugccuug

SEQ ID NO: 71430 - RNA, 26 nt, Human
gcucaaucucaggucuucacgcgggg

SEQ ID NO: 71431 - RNA, 23 nt, Human
aaacaccuugucaaccucuuccu

SEQ ID NO: 71432 - RNA, 24 nt, Human
guuauuauccugcauuuuacgucu

SEQ ID NO: 71433 - RNA, 22 nt, Human
cucagcccugcaccaugcugcu

SEQ ID NO: 71434 - RNA, 24 nt, Human
ggcaggcggcugcaggcuaggggc

SEQ ID NO: 71435 - RNA, 22 nt, Human
uauaacauuaacuuuuacuuug

SEQ ID NO: 71436 - RNA, 23 nt, Human
gaugaauggcuaauauuuuggug

SEQ ID NO: 71437 - RNA, 20 nt, Human
cucuggccucuugguucauu

SEQ ID NO: 71438 - RNA, 25 nt, Human
guugugagucaggcugggggacuug

SEQ ID NO: 71439 - RNA, 21 nt, Human
uuguaacccagcacuuuggga

SEQ ID NO: 71440 - RNA, 21 nt, Human
caccugcaaucccagcacuuu

SEQ ID NO: 71441 - RNA, 21 nt, Human
ccaguauuuugagcuggcaaa

SEQ ID NO: 71442 - RNA, 22 nt, Human
gaguggaguucacucacaugga

SEQ ID NO: 71443 - RNA, 26 nt, Human
gagagacacucccagggacaagggaa

SEQ ID NO: 71444 - RNA, 22 nt, Human
cagagucuccugggcacagguu

SEQ ID NO: 71445 - RNA, 24 nt, Human
ucuccucuuaagcucacucgggcc

SEQ ID NO: 71446 - RNA, 22 nt, Human
gccccacucugaggggcucaga

SEQ ID NO: 71447 - RNA, 21 nt, Human
ucuuaggaacugggaguuggu

SEQ ID NO: 71448 - RNA, 23 nt, Human
gcgucagugccgccacugccccc

SEQ ID NO: 71449 - RNA, 25 nt, Human
gcuccuccgugcuuccucaguuaca

SEQ ID NO: 71450 - RNA, 24 nt, Human
gaccuuuccccaccaccgcaacaa

SEQ ID NO: 71451 - RNA, 27 nt, Human
uucuccucucucuaucccugaaaucca

SEQ ID NO: 71452 - RNA, 23 nt, Human
gcuuguucccuguccucuggccc

SEQ ID NO: 71453 - RNA, 26 nt, Human
gcuccacuccagccuggcguccaggg

SEQ ID NO: 71454 - RNA, 27 nt, Human
aggaagauaaaacaacagccacaaaag

SEQ ID NO: 71455 - RNA, 25 nt, Human
auucacauuuuccuuccuccuguua

SEQ ID NO: 71456 - RNA, 22 nt, Human
caggcagcaccagggcuccuga

SEQ ID NO: 71457 - RNA, 21 nt, Human
ccggacugaccaaaucaccca

SEQ ID NO: 71458 - RNA, 25 nt, Human
uggucacccugagagucccaucgcc

SEQ ID NO: 71459 - RNA, 20 nt, Human
gcagaguuauuuuccuguuu

SEQ ID NO: 71460 - RNA, 22 nt, Human
ggaaauuuacagacauguagga

SEQ ID NO: 71461 - RNA, 23 nt, Human
ggcccucugggcuccugccucag

SEQ ID NO: 71462 - RNA, 22 nt, Human
ugugaagccaaaagggaccagg

SEQ ID NO: 71463 - RNA, 27 nt, Human
gcuuuucucccaccccuccuagcaccc

SEQ ID NO: 71464 - RNA, 21 nt, Human
ugucaccaggcuggagugcag

SEQ ID NO: 71465 - RNA, 19 nt, Human
auggcuccccugugcccca

SEQ ID NO: 71466 - RNA, 28 nt, Human
cgcugagauuuggugguucugcaugugu

SEQ ID NO: 71467 - RNA, 26 nt, Human
ggaggguuguguggucagugacucag

SEQ ID NO: 71468 - RNA, 27 nt, Human
caggcuggagugcaauggcacguucuc

SEQ ID NO: 71469 - RNA, 19 nt, Human
ccugaaggugccucuuggc

SEQ ID NO: 71470 - RNA, 20 nt, Human
aguuauccccaaaugcagcu

SEQ ID NO: 71471 - RNA, 27 nt, Human
ggcucacugcuaccucuaccaugagca

SEQ ID NO: 71472 - RNA, 17 nt, Human
gcagccaggcucaggga

SEQ ID NO: 71473 - RNA, 26 nt, Human
ccugcagggcuggcccuggcucgggc

SEQ ID NO: 71474 - RNA, 16 nt, Human
ggaaugccagcauuuu

SEQ ID NO: 71475 - RNA, 21 nt, Human
aauugcauacaacugugcauu

SEQ ID NO: 71476 - RNA, 22 nt, Human
cacguggcuucaacagcuuugg

SEQ ID NO: 71477 - RNA, 27 nt, Human
ggcaggcaggggagacucacagaaaaa

SEQ ID NO: 71478 - RNA, 24 nt, Human
ucucucuucuuuucuacugugcua

SEQ ID NO: 71479 - RNA, 27 nt, Human
ggcagaacuguguggccccugccugug

SEQ ID NO: 71480 - RNA, 23 nt, Human
aacauucuaacauuuacacuuuu

SEQ ID NO: 71481 - RNA, 21 nt, Human
cugacuuaauaaacagccgag

SEQ ID NO: 71482 - RNA, 19 nt, Human
aguccauauagagcugucc

SEQ ID NO: 71483 - RNA, 20 nt, Human
aacucacaguuuugcccucg

SEQ ID NO: 71484 - RNA, 27 nt, Human
aaguagcugggauuacagacucaugcc

SEQ ID NO: 71485 - RNA, 23 nt, Human
cuaacuccuagaggcugcggcgg

SEQ ID NO: 71486 - RNA, 22 nt, Human
acuaugucaucaauaaucauaa

SEQ ID NO: 71487 - RNA, 23 nt, Human
ggccccucuuuugucuucuguga

SEQ ID NO: 71488 - RNA, 23 nt, Human
gcaugcagaugucugguacugga

SEQ ID NO: 71489 - RNA, 26 nt, Human
agagacacuuagguccagccuguuca

SEQ ID NO: 71490 - RNA, 22 nt, Human
cagagcugccccugcucuccca

SEQ ID NO: 71491 - RNA, 21 nt, Human
cuuuggggaugauaauccaaa

SEQ ID NO: 71492 - RNA, 20 nt, Human
ucuagccuggcaacagagcg

SEQ ID NO: 71493 - RNA, 22 nt, Human
gagaggagacacaaggagcagc

SEQ ID NO: 71494 - RNA, 21 nt, Human
ucaggaccccaaacuccaccu

SEQ ID NO: 71495 - RNA, 21 nt, Human
ugcuugggguaggguggagug

SEQ ID NO: 71496 - RNA, 27 nt, Human
cacugcacuccagccuggggcugacag

SEQ ID NO: 71497 - RNA, 20 nt, Human
ggccccggaucagagcagga

SEQ ID NO: 71498 - RNA, 23 nt, Human
ucaggcaaagcuuuaauuuauac

SEQ ID NO: 71499 - RNA, 21 nt, Human
aaccuguagaagaugaccucg

SEQ ID NO: 71500 - RNA, 23 nt, Human
cugauguguguggguuguugagg

SEQ ID NO: 71501 - RNA, 22 nt, Human
uccauggaaaugccucucuaaa

SEQ ID NO: 71502 - RNA, 22 nt, Human
accuguaaugccagcacuuugg

SEQ ID NO: 71503 - RNA, 27 nt, Human
aucuuaaagccuugaaaaauguuaaua

SEQ ID NO: 71504 - RNA, 22 nt, Human
uggcccagggugagguggcaug

SEQ ID NO: 71505 - RNA, 25 nt, Human
auccaggcuggagugcgguggugga

SEQ ID NO: 71506 - RNA, 26 nt, Human
uagaguugguacagaaaccauuucag

SEQ ID NO: 71507 - RNA, 24 nt, Human
guuccuggcuuaaccuguucuuac

SEQ ID NO: 71508 - RNA, 19 nt, Human
uguuugagacggaggcaga

SEQ ID NO: 71509 - RNA, 21 nt, Human
ggaaaagacaccagcccaggg

SEQ ID NO: 71510 - RNA, 23 nt, Human
uuuaaaugaacacaguugaguau

SEQ ID NO: 71511 - RNA, 23 nt, Human
aauacagccacuaauugccuuac

SEQ ID NO: 71512 - RNA, 20 nt, Human
ggcaugggaaaugaaagaaa

SEQ ID NO: 71513 - RNA, 24 nt, Human
cagacagaguggaucuggagucug

SEQ ID NO: 71514 - RNA, 22 nt, Human
ccuucauuuucccacaaguuug

SEQ ID NO: 71515 - RNA, 27 nt, Human
ucccagccucugcugacagcaccucag

SEQ ID NO: 71516 - RNA, 23 nt, Human
gcaacccacagcaaagcccugac

SEQ ID NO: 71517 - RNA, 19 nt, Human
ugacucaagaauuaaucag

SEQ ID NO: 71518 - RNA, 20 nt, Human
uuuacugacacuuccugucc

SEQ ID NO: 71519 - RNA, 24 nt, Human
agagaggcuguucauugauccacu

SEQ ID NO: 71520 - RNA, 24 nt, Human
gcaccuucuagaagagagcgugcc

SEQ ID NO: 71521 - RNA, 27 nt, Human
cagaaaugcucuaagcuaccaaaguua

SEQ ID NO: 71522 - RNA, 24 nt, Human
caaucagauuuaucauucggcaua

SEQ ID NO: 71523 - RNA, 22 nt, Human
cuccucccucagacucagaggu

SEQ ID NO: 71524 - RNA, 23 nt, Human
cauucguucuguggagggacaag

SEQ ID NO: 71525 - RNA, 22 nt, Human
cuugugagggguuaaggcuggg

SEQ ID NO: 71526 - RNA, 19 nt, Human
auggaaaggagaauucagg

SEQ ID NO: 71527 - RNA, 26 nt, Human
ggcucgggggcaggaaggucagagca

SEQ ID NO: 71528 - RNA, 27 nt, Human
caggguuuuaaaucaaacaauguagca

SEQ ID NO: 71529 - RNA, 21 nt, Human
gagaguguuucuccaagguuu

SEQ ID NO: 71530 - RNA, 21 nt, Human
guaugcacagaauaacuuucc

SEQ ID NO: 71531 - RNA, 21 nt, Human
gcagugagccaagaucaugcu

SEQ ID NO: 71532 - RNA, 17 nt, Human
cuaccacuuaaggugau

SEQ ID NO: 71533 - RNA, 22 nt, Human
gauggcaggagaaucagccugg

SEQ ID NO: 71534 - RNA, 27 nt, Human
uuaugcuguuaaaacuacuuuagguga

SEQ ID NO: 71535 - RNA, 27 nt, Human
acacaguguguguauccaaaaggccau

SEQ ID NO: 71536 - RNA, 22 nt, Human
ccuccaggccccuccuggcugg

SEQ ID NO: 71537 - RNA, 20 nt, Human
uacuacacagagaggugagc

SEQ ID NO: 71538 - RNA, 20 nt, Human
auagacuuguuuuaaaacaa

SEQ ID NO: 71539 - RNA, 27 nt, Human
agagggauggaggaagaacugaaaggc

SEQ ID NO: 71540 - RNA, 22 nt, Human
gcaggcaacuuugggugcugcu

SEQ ID NO: 71541 - RNA, 19 nt, Human
cccuagacaaugacauaua

SEQ ID NO: 71542 - RNA, 23 nt, Human
gguccuaaaucuguccaaagcag

SEQ ID NO: 71543 - RNA, 22 nt, Human
gaccagccugaccaacguggcg

SEQ ID NO: 71544 - RNA, 24 nt, Human
gggugguuuuugagccaugcgugg

SEQ ID NO: 71545 - RNA, 25 nt, Human
ugggugcuggguuuucacggaguau

SEQ ID NO: 71546 - RNA, 23 nt, Human
caggacagggacccucaucugcc

SEQ ID NO: 71547 - RNA, 27 nt, Human
cuuuucugguagguucugucugugcca

SEQ ID NO: 71548 - RNA, 19 nt, Human
acucaccugcaugaucaca

SEQ ID NO: 71549 - RNA, 22 nt, Human
uggauauuggaaugagcauuga

SEQ ID NO: 71550 - RNA, 24 nt, Human
ccugagguuggugcccacuggcug

SEQ ID NO: 71551 - RNA, 24 nt, Human
uggacuuuuauagacauuuuuuau

SEQ ID NO: 71552 - RNA, 22 nt, Human
gcucgcucugcucgcagucaca

SEQ ID NO: 71553 - RNA, 26 nt, Human
gcagugagcaggguuccugugguuuc

SEQ ID NO: 71554 - RNA, 23 nt, Human
aggcuagagugcaguggcaugau

SEQ ID NO: 71555 - RNA, 23 nt, Human
aggcuggaguacaauggcgugau

SEQ ID NO: 71556 - RNA, 23 nt, Human
aggcuggagugcaauggcaugau

SEQ ID NO: 71557 - RNA, 23 nt, Human
cugugagcaaaguggccgccggg

SEQ ID NO: 71558 - RNA, 27 nt, Human
ccacugcacucuagccugggccauaga

SEQ ID NO: 71559 - RNA, 25 nt, Human
ucggcuucgagaucuucuucgccuu

SEQ ID NO: 71560 - RNA, 20 nt, Human
cucauaaguaaauuccuaac

SEQ ID NO: 71561 - RNA, 28 nt, Human
aaggccuugccuagaccaggucacacug

SEQ ID NO: 71562 - RNA, 23 nt, Human
aggaugcugugcacacugugugu

SEQ ID NO: 71563 - RNA, 23 nt, Human
agcuguugcuacugcgucucucu

SEQ ID NO: 71564 - RNA, 22 nt, Human
acccuccucccgcgcccggcaa

SEQ ID NO: 71565 - RNA, 24 nt, Human
ggcaggggaacgggauccuucucc

SEQ ID NO: 71566 - RNA, 21 nt, Human
guucacugcuccuugcugcau

SEQ ID NO: 71567 - RNA, 22 nt, Human
cacuccaguccagcuugggccu

SEQ ID NO: 71568 - RNA, 21 nt, Human
ugaguacaaaugccuuaaaau

SEQ ID NO: 71569 - RNA, 27 nt, Human
uccggguugggcugagauggcugugcc

SEQ ID NO: 71570 - RNA, 24 nt, Human
agcaucagagguuugcuuccucag

SEQ ID NO: 71571 - RNA, 21 nt, Human
cuuccuaaccuuccaucaucc

SEQ ID NO: 71572 - RNA, 23 nt, Human
uugaugucaugguccccucucuu

SEQ ID NO: 71573 - RNA, 19 nt, Human
cuguggcugcucagcugcc

SEQ ID NO: 71574 - RNA, 21 nt, Human
gcuaaaaucuaaagcuuucaa

SEQ ID NO: 71575 - RNA, 15 nt, Human
uuggagcuugcagug

SEQ ID NO: 71576 - RNA, 22 nt, Human
agucuucucuuugcuugcugau

SEQ ID NO: 71577 - RNA, 22 nt, Human
ggaaaaauuucuauucucucca

SEQ ID NO: 71578 - RNA, 22 nt, Human
ccuccaaacugcugacuagguc

SEQ ID NO: 71579 - RNA, 26 nt, Human
aaaugaugcagcucuggcuccuuguc

SEQ ID NO: 71580 - RNA, 20 nt, Human
gcauuuucauauugcuacca

SEQ ID NO: 71581 - RNA, 27 nt, Human
ugauacuuuuaauuuacacuuaguaaa

SEQ ID NO: 71582 - RNA, 25 nt, Human
cucaguugagugguucacacucaga

SEQ ID NO: 71583 - RNA, 23 nt, Human
cugccuaaaucacuuuucucgca

SEQ ID NO: 71584 - RNA, 27 nt, Human
ccagaagcagagguagaaucaggcggg

SEQ ID NO: 71585 - RNA, 23 nt, Human
ccccaaaggacaaccaucuuguu

SEQ ID NO: 71586 - RNA, 24 nt, Human
uguccgcccaccuagugcuuccac

SEQ ID NO: 71587 - RNA, 24 nt, Human
ugggugguggaggcugcgagggug

SEQ ID NO: 71588 - RNA, 23 nt, Human
auuugucccuaacaacugucuuu

SEQ ID NO: 71589 - RNA, 22 nt, Human
aggcuggaagcugcagacagga

SEQ ID NO: 71590 - RNA, 22 nt, Human
gcucccccuuccccuucuggga

SEQ ID NO: 71591 - RNA, 27 nt, Human
ucccacauuucucauuugguaauggug

SEQ ID NO: 71592 - RNA, 30 nt, Human
ccagaccagcaaccagauuaucuagugcca

SEQ ID NO: 71593 - RNA, 28 nt, Human
cuugcaugaauauuauucuuaauuccuu

SEQ ID NO: 71594 - RNA, 21 nt, Human
uggagugcuuaggguaguugg

SEQ ID NO: 71595 - RNA, 25 nt, Human
cucucgaacuccugaccucaucguc

SEQ ID NO: 71596 - RNA, 23 nt, Human
ugaccucauuaaccgaugcuuua

SEQ ID NO: 71597 - RNA, 21 nt, Human
ucuguuucccuuucacuggca

SEQ ID NO: 71598 - RNA, 27 nt, Human
ucuugcaugaaugcucucuucuguguu

SEQ ID NO: 71599 - RNA, 22 nt, Human
cuggggcugccucugcucucca

SEQ ID NO: 71600 - RNA, 25 nt, Human
agagaagcaggaagagcacuggacu

SEQ ID NO: 71601 - RNA, 22 nt, Human
acugcagccuccaccucccggg

SEQ ID NO: 71602 - RNA, 22 nt, Human
cugaagcagaaagauugcuuga

SEQ ID NO: 71603 - RNA, 21 nt, Human
ggaggaaccagaggcacuucc

SEQ ID NO: 71604 - RNA, 30 nt, Human
uuucuuucuuucucuuaccugaaaugaacu

SEQ ID NO: 71605 - RNA, 23 nt, Human
gcgaucucggcucacugcaagcu

SEQ ID NO: 71606 - RNA, 23 nt, Human
acgaucucagcucacugcaagcu

SEQ ID NO: 71607 - RNA, 20 nt, Human
aguacagcuauccagagaga

SEQ ID NO: 71608 - RNA, 21 nt, Human
cccugguucuggaggaaccgc

SEQ ID NO: 71609 - RNA, 22 nt, Human
cgcugcuccugaaguuguagag

SEQ ID NO: 71610 - RNA, 23 nt, Human
gcacagcccagcguuggggccgg

SEQ ID NO: 71611 - RNA, 21 nt, Human
aggcacccacaaccagaggaa

SEQ ID NO: 71612 - RNA, 21 nt, Human
uucccauccucuucuuuuagc

SEQ ID NO: 71613 - RNA, 28 nt, Human
gagccucagucucccucccuuggggccu

SEQ ID NO: 71614 - RNA, 22 nt, Human
ugaggugggcugguagagcagg

SEQ ID NO: 71615 - RNA, 23 nt, Human
auucuuggcucuagauuuaucag

SEQ ID NO: 71616 - RNA, 26 nt, Human
gguggagggagccacugcugggcuca

SEQ ID NO: 71617 - RNA, 22 nt, Human
ggcaggagaauggcgugaaccc

SEQ ID NO: 71618 - RNA, 28 nt, Human
ccauauaauuccaccaaccaaaauuaau

SEQ ID NO: 71619 - RNA, 18 nt, Human
ccccaaaccagacauaug

SEQ ID NO: 71620 - RNA, 25 nt, Human
cugucauggagggggaggaggaggc

SEQ ID NO: 71621 - RNA, 19 nt, Human
ggaccuguugucaccuuaa

SEQ ID NO: 71622 - RNA, 27 nt, Human
accagccuggucaauauagcaagacca

SEQ ID NO: 71623 - RNA, 22 nt, Human
acacacacgugcucacauacau

SEQ ID NO: 71624 - RNA, 20 nt, Human
gacugagucuucucaguuga

SEQ ID NO: 71625 - RNA, 23 nt, Human
cuguuggcagacuggagugcaau

SEQ ID NO: 71626 - RNA, 18 nt, Human
aaggaaaccgcugccuuu

SEQ ID NO: 71627 - RNA, 26 nt, Human
cccuugccaguguuuagaacaguguc

SEQ ID NO: 71628 - RNA, 22 nt, Human
uggagagaaggagaaggauuag

SEQ ID NO: 71629 - RNA, 23 nt, Human
ucuccacugcaugccagaggccc

SEQ ID NO: 71630 - RNA, 19 nt, Human
agaugccaaagacaagguu

SEQ ID NO: 71631 - RNA, 27 nt, Human
accauuuuuaaaguagaagaggguuuu

SEQ ID NO: 71632 - RNA, 21 nt, Human
gcauccucaaccuccuggguu

SEQ ID NO: 71633 - RNA, 25 nt, Human
ccaccauggugagugcucugugccu

SEQ ID NO: 71634 - RNA, 29 nt, Human
ugcuucaaaauaucaaggaguaacacagu

SEQ ID NO: 71635 - RNA, 23 nt, Human
auugcugcugcuaccugcuuucc

SEQ ID NO: 71636 - RNA, 21 nt, Human
caucugcauccagccuccugc

SEQ ID NO: 71637 - RNA, 20 nt, Human
gggaggaguuccugcccacc

SEQ ID NO: 71638 - RNA, 22 nt, Human
gaguaagggagcuauguggaaa

SEQ ID NO: 71639 - RNA, 21 nt, Human
augagcuuagugcacaagcac

SEQ ID NO: 71640 - RNA, 27 nt, Human
auccuccuggaggguguggcuacccuc

SEQ ID NO: 71641 - RNA, 22 nt, Human
acaacauagugaaacccugucu

SEQ ID NO: 71642 - RNA, 24 nt, Human
auccuuuaguuauauuguauuaaa

SEQ ID NO: 71643 - RNA, 23 nt, Human
gcaaauaauuuguuuugccuugu

SEQ ID NO: 71644 - RNA, 22 nt, Human
aggggucuggguacuucuugaa

SEQ ID NO: 71645 - RNA, 20 nt, Human
ggaagaagguuuuugcucag

SEQ ID NO: 71646 - RNA, 24 nt, Human
gcuaggcaucaaggccagaccagg

SEQ ID NO: 71647 - RNA, 21 nt, Human
ucugggacuagaggccaggau

SEQ ID NO: 71648 - RNA, 24 nt, Human
ugucaacaggccgggggaagccgu

SEQ ID NO: 71649 - RNA, 20 nt, Human
cugaacucuaccuccagaca

SEQ ID NO: 71650 - RNA, 22 nt, Human
ccaggaggcagagguugcagug

SEQ ID NO: 71651 - RNA, 22 nt, Human
cugggaggcagagguuguggug

SEQ ID NO: 71652 - RNA, 22 nt, Human
ccgggaggcagagguugcggug

SEQ ID NO: 71653 - RNA, 23 nt, Human
ccucacgcucuccaucauaggcu

SEQ ID NO: 71654 - RNA, 18 nt, Human
aauaggggacaugcauau

SEQ ID NO: 71655 - RNA, 23 nt, Human
agucuaaggcuggaaguuuaaug

SEQ ID NO: 71656 - RNA, 27 nt, Human
ccagguggugagguauaaguuacuugc

SEQ ID NO: 71657 - RNA, 19 nt, Human
cacuggccuccccuaggag

SEQ ID NO: 71658 - RNA, 26 nt, Human
cgugggacagcgcgcucagcccagcc

SEQ ID NO: 71659 - RNA, 26 nt, Human
uguuccaguucacaggcagcaaaccu

SEQ ID NO: 71660 - RNA, 23 nt, Human
cccccucucccugcauggcaucc

SEQ ID NO: 71661 - RNA, 22 nt, Human
gcauggagcacgcugcccagcc

SEQ ID NO: 71662 - RNA, 25 nt, Human
gcacugccagcaucuggagaccguc

SEQ ID NO: 71663 - RNA, 23 nt, Human
ugcccugccuuuuacuagcuacu

SEQ ID NO: 71664 - RNA, 22 nt, Human
ggucggcagaagagcacugauc

SEQ ID NO: 71665 - RNA, 26 nt, Human
ggcggggaucagaacucuccuaucug

SEQ ID NO: 71666 - RNA, 24 nt, Human
uuccuccaguggcugccaggauuu

SEQ ID NO: 71667 - RNA, 22 nt, Human
aagaacagugaacacagugguu

SEQ ID NO: 71668 - RNA, 20 nt, Human
ugcuguuucuccucugacca

SEQ ID NO: 71669 - RNA, 23 nt, Human
cagcuugaggccccuccugcugc

SEQ ID NO: 71670 - RNA, 23 nt, Human
caagacguccuggaaugaagcau

SEQ ID NO: 71671 - RNA, 21 nt, Human
ggcugagaaguggguucaggc

SEQ ID NO: 71672 - RNA, 22 nt, Human
uggggaugugaacaaccugcuc

SEQ ID NO: 71673 - RNA, 20 nt, Human
auauauuuucuaccauucca

SEQ ID NO: 71674 - RNA, 23 nt, Human
agcuuuaguggguccuagugcac

SEQ ID NO: 71675 - RNA, 25 nt, Human
uauguauguaugcccucagugcagu

SEQ ID NO: 71676 - RNA, 18 nt, Human
uagcuugaccugcuuuca

SEQ ID NO: 71677 - RNA, 23 nt, Human
ugguucacucuuggagccugcag

SEQ ID NO: 71678 - RNA, 21 nt, Human
uccagccuggcgacaagagug

SEQ ID NO: 71679 - RNA, 23 nt, Human
aagguaacaacuauguugaaaua

SEQ ID NO: 71680 - RNA, 24 nt, Human
agagcaccgcugcacucgcggccg

SEQ ID NO: 71681 - RNA, 19 nt, Human
cuccucugaccugccugua

SEQ ID NO: 71682 - RNA, 22 nt, Human
ccuggaguccaauggcugcuua

SEQ ID NO: 71683 - RNA, 21 nt, Human
cuucugggaagccagccuucu

SEQ ID NO: 71684 - RNA, 25 nt, Human
auuuugagcaauucuccugccucag

SEQ ID NO: 71685 - RNA, 20 nt, Human
gggugcuggggccagggcag

SEQ ID NO: 71686 - RNA, 17 nt, Human
aaguugugauuaccugc

SEQ ID NO: 71687 - RNA, 23 nt, Human
cugccauuuccacccuccaguca

SEQ ID NO: 71688 - RNA, 22 nt, Human
aucagaggguuuucucuaauca

SEQ ID NO: 71689 - RNA, 22 nt, Human
acucccuggcccuguaggcugu

SEQ ID NO: 71690 - RNA, 22 nt, Human
cuaccuguuccaaggcuagauc

SEQ ID NO: 71691 - RNA, 21 nt, Human
cgccuguaucccagcacuuug

SEQ ID NO: 71692 - RNA, 22 nt, Human
gaaguauuuugccauauauaaa

SEQ ID NO: 71693 - RNA, 23 nt, Human
cucgagucccuggagcaggcagu

SEQ ID NO: 71694 - RNA, 20 nt, Human
aggugcgcaccaccaugccc

SEQ ID NO: 71695 - RNA, 21 nt, Human
caauccagauucacuguuaua

SEQ ID NO: 71696 - RNA, 24 nt, Human
ucagaaucuguggagcaagaaagg

SEQ ID NO: 71697 - RNA, 22 nt, Human
guguagccuugaccaacugaaa

SEQ ID NO: 71698 - RNA, 24 nt, Human
ugcagccgccucacaggucggcgg

SEQ ID NO: 71699 - RNA, 23 nt, Human
cccucauuccccucgugugacuc

SEQ ID NO: 71700 - RNA, 23 nt, Human
gccugggcaacaagagugaaaug

SEQ ID NO: 71701 - RNA, 20 nt, Human
ugcaguauuaucauugacau

SEQ ID NO: 71702 - RNA, 28 nt, Human
cuugacugucauccuguucuuguuagcc

SEQ ID NO: 71703 - RNA, 24 nt, Human
uuuuuauaaaugaucuguaguucc

SEQ ID NO: 71704 - RNA, 23 nt, Human
ucuggagggaagccuuggggcug

SEQ ID NO: 71705 - RNA, 26 nt, Human
gaaaacaggccaaucugugggcaagg

SEQ ID NO: 71706 - RNA, 26 nt, Human
caaggcuugauagcagagguuuggug

SEQ ID NO: 71707 - RNA, 24 nt, Human
gcaagagucauuccaucacaggga

SEQ ID NO: 71708 - RNA, 26 nt, Human
gcuagugccagccacuguguugucac

SEQ ID NO: 71709 - RNA, 22 nt, Human
ugaacuccauugcuuaagaaac

SEQ ID NO: 71710 - RNA, 22 nt, Human
ugcauauauacauguaucugua

SEQ ID NO: 71711 - RNA, 22 nt, Human
uccagacucccugccuggacca

SEQ ID NO: 71712 - RNA, 22 nt, Human
cccuucccucacuuccauccau

SEQ ID NO: 71713 - RNA, 21 nt, Human
gguguaccucccccugccuuc

SEQ ID NO: 71714 - RNA, 22 nt, Human
gucucugagcaccagggagcag

SEQ ID NO: 71715 - RNA, 22 nt, Human
ugcagugagccaagaucaugcu

SEQ ID NO: 71716 - RNA, 18 nt, Human
cugcacucugucucucca

SEQ ID NO: 71717 - RNA, 20 nt, Human
caagauaaaaaggauaguga

SEQ ID NO: 71718 - RNA, 23 nt, Human
gaugggguuucaccauguuggcc

SEQ ID NO: 71719 - RNA, 22 nt, Human
cauucacugcaaugccuauucc

SEQ ID NO: 71720 - RNA, 22 nt, Human
uggcucucgccuguaaucucag

SEQ ID NO: 71721 - RNA, 24 nt, Human
ccugccuguucccccacaccugcc

SEQ ID NO: 71722 - RNA, 22 nt, Human
gcuuccgggccaccaguuucuc

SEQ ID NO: 71723 - RNA, 20 nt, Human
gggggauguccugcgccuca

SEQ ID NO: 71724 - RNA, 25 nt, Human
ccugucucaucuccugggagaggca

SEQ ID NO: 71725 - RNA, 21 nt, Human
ggagacagagguugcagugag

SEQ ID NO: 71726 - RNA, 24 nt, Human
gaagaauuguuugaaccugggagg

SEQ ID NO: 71727 - RNA, 25 nt, Human
gucucaagagauauaauuuagauuc

SEQ ID NO: 71728 - RNA, 22 nt, Human
uacagcuuggaaacuaugcaaa

SEQ ID NO: 71729 - RNA, 21 nt, Human
uguaguuaauuucagugccuu

SEQ ID NO: 71730 - RNA, 27 nt, Human
aacacaaaauuaucaguguuuuagaaa

SEQ ID NO: 71731 - RNA, 22 nt, Human
auguaggaucuugaugggccuu

SEQ ID NO: 71732 - RNA, 26 nt, Human
uuccugccucaggcuucugaguagcu

SEQ ID NO: 71733 - RNA, 19 nt, Human
cucuuucucugcuggagcu

SEQ ID NO: 71734 - RNA, 21 nt, Human
uguuagauucuucuccugucu

SEQ ID NO: 71735 - RNA, 21 nt, Human
gccgagacugugcucuggccu

SEQ ID NO: 71736 - RNA, 22 nt, Human
gccaggaucccucuuugcacag

SEQ ID NO: 71737 - RNA, 25 nt, Human
uggggaggggacuagaugggcaagg

SEQ ID NO: 71738 - RNA, 27 nt, Human
uacagaaguuaaauucgaacuagccac

SEQ ID NO: 71739 - RNA, 22 nt, Human
gugcccaaacaccagucaccuc

SEQ ID NO: 71740 - RNA, 23 nt, Human
agccuaacccgcgggaggcggaa

SEQ ID NO: 71741 - RNA, 27 nt, Human
ucucugcuuuccuccggagaaauaaca

SEQ ID NO: 71742 - RNA, 20 nt, Human
augaaauuaugcaacuuuga

SEQ ID NO: 71743 - RNA, 22 nt, Human
uucaaaacaaauguggauacag

SEQ ID NO: 71744 - RNA, 21 nt, Human
ugcugccaucauuaucauccc

SEQ ID NO: 71745 - RNA, 22 nt, Human
gauggguggaggggcuggggaa

SEQ ID NO: 71746 - RNA, 27 nt, Human
gagagugagaccuggcagccacaacug

SEQ ID NO: 71747 - RNA, 24 nt, Human
ggaggcuggggucacagcuggcca

SEQ ID NO: 71748 - RNA, 22 nt, Human
caguucugcagcuguuuuaguu

SEQ ID NO: 71749 - RNA, 26 nt, Human
cuuccugcugaagcucuguggccucu

SEQ ID NO: 71750 - RNA, 27 nt, Human
gcuugggcucuucaaggcacugggcug

SEQ ID NO: 71751 - RNA, 23 nt, Human
uucaaugcccuucauccaauggg

SEQ ID NO: 71752 - RNA, 27 nt, Human
gucacccaggcuggagugccguggcac

SEQ ID NO: 71753 - RNA, 23 nt, Human
ggcaggagaauugauugaaccug

SEQ ID NO: 71754 - RNA, 24 nt, Human
ugcuuaagaauauguuauuuccac

SEQ ID NO: 71755 - RNA, 23 nt, Human
acucuguugauaggcaaugggaa

SEQ ID NO: 71756 - RNA, 24 nt, Human
uggggacccccucgcugucuccac

SEQ ID NO: 71757 - RNA, 21 nt, Human
gucccaucucuucacaggcau

SEQ ID NO: 71758 - RNA, 21 nt, Human
uguggcuggagcaugagccag

SEQ ID NO: 71759 - RNA, 27 nt, Human
caagaccagccagggcaacaugaugag

SEQ ID NO: 71760 - RNA, 24 nt, Human
ccccugagaugugcguagccuccg

SEQ ID NO: 71761 - RNA, 27 nt, Human
agcagcagcagcagcagcacaaacauu

SEQ ID NO: 71762 - RNA, 23 nt, Human
aauaguuuuagacagauacugaa

SEQ ID NO: 71763 - RNA, 23 nt, Human
gaaaguacugggauuacaagcau

SEQ ID NO: 71764 - RNA, 20 nt, Human
cuuuuuccccuaauccuggc

SEQ ID NO: 71765 - RNA, 19 nt, Human
cagcaaauuuuuauacagu

SEQ ID NO: 71766 - RNA, 23 nt, Human
auugcaccacugcacuccagccu

SEQ ID NO: 71767 - RNA, 25 nt, Human
ggcagaauagcaucguguugggggu

SEQ ID NO: 71768 - RNA, 23 nt, Human
ugucacccaggcuggaguacacu

SEQ ID NO: 71769 - RNA, 21 nt, Human
gccucagcuccugaguagcug

SEQ ID NO: 71770 - RNA, 22 nt, Human
cgcagcugcauuuggggugggg

SEQ ID NO: 71771 - RNA, 20 nt, Human
gggauguaaucaugagcucu

SEQ ID NO: 71772 - RNA, 18 nt, Human
cccacgcuggagugcagu

SEQ ID NO: 71773 - RNA, 26 nt, Human
accugacaguaugaccgaucucugcg

SEQ ID NO: 71774 - RNA, 23 nt, Human
uguaauguuucacagagugugcu

SEQ ID NO: 71775 - RNA, 21 nt, Human
uauuaaaugagauuauuucug

SEQ ID NO: 71776 - RNA, 22 nt, Human
ggucuuuccucugaguguguuu

SEQ ID NO: 71777 - RNA, 25 nt, Human
acucaaccacucugccaaaccugcc

SEQ ID NO: 71778 - RNA, 22 nt, Human
gaggggcuuuuucucucugugc

SEQ ID NO: 71779 - RNA, 21 nt, Human
ugggaauacuuuucuaacuag

SEQ ID NO: 71780 - RNA, 22 nt, Human
ugaaauauauucaaauacauac

SEQ ID NO: 71781 - RNA, 27 nt, Human
uucucucucacucauguaugcauacau

SEQ ID NO: 71782 - RNA, 24 nt, Human
cucuccaagcccaggauucuggca

SEQ ID NO: 71783 - RNA, 19 nt, Human
acccagacuggagacugga

SEQ ID NO: 71784 - RNA, 21 nt, Human
ggauuuucuuaucacaaaaaa

SEQ ID NO: 71785 - RNA, 27 nt, Human
aguggcgcgaucccagcacugcagccu

SEQ ID NO: 71786 - RNA, 21 nt, Human
ccgacccgggccgcaucccug

SEQ ID NO: 71787 - RNA, 21 nt, Human
aguggggagagcaguggcagu

SEQ ID NO: 71788 - RNA, 26 nt, Human
caucacacaacucagccuggcugauu

SEQ ID NO: 71789 - RNA, 21 nt, Human
ccgucugacugaccucugacc

SEQ ID NO: 71790 - RNA, 20 nt, Human
agacuaaaucaaccacucca

SEQ ID NO: 71791 - RNA, 22 nt, Human
gccuguaauccuaacacuuugg

SEQ ID NO: 71792 - RNA, 22 nt, Human
auggauuuauuuuucauuuuug

SEQ ID NO: 71793 - RNA, 24 nt, Human
ccuccaccugccguccugucuucc

SEQ ID NO: 71794 - RNA, 24 nt, Human
gccucaagaucaaugaaaugaugu

SEQ ID NO: 71795 - RNA, 19 nt, Human
uguaauaaaacuuaugcua

SEQ ID NO: 71796 - RNA, 24 nt, Human
caucugcacaacugggcacuggac

SEQ ID NO: 71797 - RNA, 27 nt, Human
agcauuuuucuucauguaucaccuuca

SEQ ID NO: 71798 - RNA, 19 nt, Human
guugcccaggcuggucgug

SEQ ID NO: 71799 - RNA, 23 nt, Human
ccucaguuaagccuuuguggacu

SEQ ID NO: 71800 - RNA, 24 nt, Human
cacaccaccugugacuccagcucu

SEQ ID NO: 71801 - RNA, 26 nt, Human
gccccaacccuucuucauguucaauu

SEQ ID NO: 71802 - RNA, 23 nt, Human
cagcggcagaucucuccagggaa

SEQ ID NO: 71803 - RNA, 22 nt, Human
aaaguguuaggauuacaggcau

SEQ ID NO: 71804 - RNA, 23 nt, Human
uaucucagugugugagauauaua

SEQ ID NO: 71805 - RNA, 19 nt, Human
aagucgaggaagagagaga

SEQ ID NO: 71806 - RNA, 28 nt, Human
ugccuaugacacagaagccccacaccag

SEQ ID NO: 71807 - RNA, 22 nt, Human
cccgggagguugaggcugcagu

SEQ ID NO: 71808 - RNA, 27 nt, Human
gggccauggguccucggcccaucuguc

SEQ ID NO: 71809 - RNA, 29 nt, Human
uuucaugaggcugaccuaggaacuuggcc

SEQ ID NO: 71810 - RNA, 21 nt, Human
ugcuacuugagagugggggag

SEQ ID NO: 71811 - RNA, 19 nt, Human
cacuacaaccucugccucc

SEQ ID NO: 71812 - RNA, 23 nt, Human
uuucccugucugucuguguuagu

SEQ ID NO: 71813 - RNA, 25 nt, Human
ggaaacuuggacauuuauguacaaa

SEQ ID NO: 71814 - RNA, 23 nt, Human
cacucugcauuaaagugcuaaug

SEQ ID NO: 71815 - RNA, 21 nt, Human
uccugagugaggaaggcauga

SEQ ID NO: 71816 - RNA, 27 nt, Human
ccugcuuccuguuaccugucuugcucc

SEQ ID NO: 71817 - RNA, 20 nt, Human
ccaaugccuauaaaaugccc

SEQ ID NO: 71818 - RNA, 21 nt, Human
cuaccucugucauuagcaaug

SEQ ID NO: 71819 - RNA, 21 nt, Human
aucguuuuccauacagcagug

SEQ ID NO: 71820 - RNA, 22 nt, Human
uugcaauuucaucugcuuucua

SEQ ID NO: 71821 - RNA, 20 nt, Human
gcccccuucucacuggacug

SEQ ID NO: 71822 - RNA, 21 nt, Human
guuaauucagcacugauuuca

SEQ ID NO: 71823 - RNA, 20 nt, Human
gguuacugcaacccuaacuc

SEQ ID NO: 71824 - RNA, 27 nt, Human
gcaaguggcuguguuuuaaaugggauu

SEQ ID NO: 71825 - RNA, 21 nt, Human
uggaccuucacaaaugcccug

SEQ ID NO: 71826 - RNA, 22 nt, Human
acccuuuauucacagucacuug

SEQ ID NO: 71827 - RNA, 21 nt, Human
ucugacauaugcggugacaug

SEQ ID NO: 71828 - RNA, 20 nt, Human
cgagcgcagaccaggcucca

SEQ ID NO: 71829 - RNA, 23 nt, Human
cuuaccucaucuccuaaaaggca

SEQ ID NO: 71830 - RNA, 21 nt, Human
gcugagugccugagccgggaa

SEQ ID NO: 71831 - RNA, 27 nt, Human
uggcuguaagguuugcccuugaacuaa

SEQ ID NO: 71832 - RNA, 19 nt, Human
cacaggcacccagcuuugg

SEQ ID NO: 71833 - RNA, 28 nt, Human
ucacccuacccugcuucuugaggucccu

SEQ ID NO: 71834 - RNA, 24 nt, Human
cugucacccaaguuggagugcagu

SEQ ID NO: 71835 - RNA, 19 nt, Human
cuggguugauucaaaggga

SEQ ID NO: 71836 - RNA, 27 nt, Human
uugcugucagucuugaccucugccuuu

SEQ ID NO: 71837 - RNA, 21 nt, Human
uucuucuggggucaggugcca

SEQ ID NO: 71838 - RNA, 26 nt, Human
gacagagaccuggaacagaugcuuuc

SEQ ID NO: 71839 - RNA, 17 nt, Human
cuccacccacaccugcc

SEQ ID NO: 71840 - RNA, 19 nt, Human
ucagguuuccaucuguaaa

SEQ ID NO: 71841 - RNA, 20 nt, Human
ggcccccuucccccaccucu

SEQ ID NO: 71842 - RNA, 27 nt, Human
uguccccaaagggguggguuguggagc

SEQ ID NO: 71843 - RNA, 22 nt, Human
gcagcagccacaagugggccca

SEQ ID NO: 71844 - RNA, 21 nt, Human
uaccucuacugaauauucuag

SEQ ID NO: 71845 - RNA, 24 nt, Human
uuuaucauuccuuuccaguucaua

SEQ ID NO: 71846 - RNA, 20 nt, Human
agcucugcuccucuccccag

SEQ ID NO: 71847 - RNA, 24 nt, Human
ucuccuguggaugcuccuggaaug

SEQ ID NO: 71848 - RNA, 24 nt, Human
gacacaaagaugagacuguguuug

SEQ ID NO: 71849 - RNA, 25 nt, Human
cucuccucagcuugcagagcuggcc

SEQ ID NO: 71850 - RNA, 22 nt, Human
cauugcacugcagccuggauga

SEQ ID NO: 71851 - RNA, 21 nt, Human
uuaggguuuugccauuguaaa

SEQ ID NO: 71852 - RNA, 25 nt, Human
uccuuuccuccucccccucggagcc

SEQ ID NO: 71853 - RNA, 26 nt, Human
gcccugcuugugguggcgcuccacag

SEQ ID NO: 71854 - RNA, 21 nt, Human
ccuggccaagcccccaagagg

SEQ ID NO: 71855 - RNA, 24 nt, Human
gggcugggcagggcccuguggcuc

SEQ ID NO: 71856 - RNA, 26 nt, Human
cccugcucuacucugcgcucucugcc

SEQ ID NO: 71857 - RNA, 21 nt, Human
aagggcauggcucacaaaagg

SEQ ID NO: 71858 - RNA, 21 nt, Human
uugacgucuccaacagaagaa

SEQ ID NO: 71859 - RNA, 22 nt, Human
gcugcucuuuagcugggugcag

SEQ ID NO: 71860 - RNA, 20 nt, Human
agggaaagucgggggaggac

SEQ ID NO: 71861 - RNA, 21 nt, Human
guaucugaacauugacacaaa

SEQ ID NO: 71862 - RNA, 30 nt, Human
uugcucucgaccggcccugcauucuuccgc

SEQ ID NO: 71863 - RNA, 21 nt, Human
gcacagccagcugugagcucc

SEQ ID NO: 71864 - RNA, 25 nt, Human
cuaccuugaguaguuggagcacuug

SEQ ID NO: 71865 - RNA, 26 nt, Human
agccaagccacccauuugcuuuuaau

SEQ ID NO: 71866 - RNA, 27 nt, Human
gccagaaacgacgguacccaggagaag

SEQ ID NO: 71867 - RNA, 23 nt, Human
guuuuucuggacuuccaaaucuc

SEQ ID NO: 71868 - RNA, 19 nt, Human
ccuccacuucuccaacuuc

SEQ ID NO: 71869 - RNA, 26 nt, Human
ucggagcucaucugggcccaugaccu

SEQ ID NO: 71870 - RNA, 20 nt, Human
ggaguuucuuagucauuacu

SEQ ID NO: 71871 - RNA, 20 nt, Human
ccucagaguugcaagauggu

SEQ ID NO: 71872 - RNA, 21 nt, Human
cacuuaugugccucugcuccg

SEQ ID NO: 71873 - RNA, 17 nt, Human
uaaagaagaagacugua

SEQ ID NO: 71874 - RNA, 21 nt, Human
cggugcuuccagccuucguaa

SEQ ID NO: 71875 - RNA, 20 nt, Human
uguacugagaggagggguaa

SEQ ID NO: 71876 - RNA, 22 nt, Human
ugggaggugaagguugcugugg

SEQ ID NO: 71877 - RNA, 19 nt, Human
auuauaaaaauuagccggg

SEQ ID NO: 71878 - RNA, 19 nt, Human
ugggcacauucugucagcc

SEQ ID NO: 71879 - RNA, 19 nt, Human
gaucacugcaaaccugccu

SEQ ID NO: 71880 - RNA, 21 nt, Human
cagguuaagaaaauuacuugg

SEQ ID NO: 71881 - RNA, 22 nt, Human
uggugugcaccuguaaucccag

SEQ ID NO: 71882 - RNA, 24 nt, Human
ggaucagacaagggugcugagagc

SEQ ID NO: 71883 - RNA, 27 nt, Human
ccauugcacuccagccuaggcaacaag

SEQ ID NO: 71884 - RNA, 20 nt, Human
uggagugcuuuuuauguaug

SEQ ID NO: 71885 - RNA, 22 nt, Human
acugucucuaaccacuccuggg

SEQ ID NO: 71886 - RNA, 25 nt, Human
gggaagugcguguguugggccaggu

SEQ ID NO: 71887 - RNA, 23 nt, Human
gcucagcccggcccggccacagc

SEQ ID NO: 71888 - RNA, 21 nt, Human
accccaaaugaugaggaucuc

SEQ ID NO: 71889 - RNA, 23 nt, Human
gcaacaaaaaugugggugucucc

SEQ ID NO: 71890 - RNA, 23 nt, Human
gucuguaaucccagcuacucugg

SEQ ID NO: 71891 - RNA, 23 nt, Human
gccuguaauuccagcuacucugg

SEQ ID NO: 71892 - RNA, 25 nt, Human
ccugcucugugcucacaccucggcu

SEQ ID NO: 71893 - RNA, 20 nt, Human
aauccaggugccugccucca

SEQ ID NO: 71894 - RNA, 23 nt, Human
gccagccgcaggcuccucucugg

SEQ ID NO: 71895 - RNA, 27 nt, Human
gcccagccgugauccagcgacggguuu

SEQ ID NO: 71896 - RNA, 22 nt, Human
cuguguguauuccuuuucucua

SEQ ID NO: 71897 - RNA, 22 nt, Human
gagagagggccgggcguggugg

SEQ ID NO: 71898 - RNA, 20 nt, Human
agguguccuucgcacccaac

SEQ ID NO: 71899 - RNA, 22 nt, Human
cguaugugcgugcauguguaua

SEQ ID NO: 71900 - RNA, 20 nt, Human
agagaauaauugcauuuuaa

SEQ ID NO: 71901 - RNA, 24 nt, Human
cacugcccugagcccaaauggggg

SEQ ID NO: 71902 - RNA, 23 nt, Human
ucucccacuguauucauuuauac

SEQ ID NO: 71903 - RNA, 26 nt, Human
cuacagagccaaaaugccauuuagca

SEQ ID NO: 71904 - RNA, 21 nt, Human
gggcuucaggcugggggcagu

SEQ ID NO: 71905 - RNA, 21 nt, Human
aguucuuccauaaccaccuuu

SEQ ID NO: 71906 - RNA, 21 nt, Human
uggauuccuuuggaaaaccaa

SEQ ID NO: 71907 - RNA, 23 nt, Human
caauuguuuagugacuguaagug

SEQ ID NO: 71908 - RNA, 20 nt, Human
ccucccacacacacccacac

SEQ ID NO: 71909 - RNA, 20 nt, Human
ggggugaugacaaauguuaa

SEQ ID NO: 71910 - RNA, 19 nt, Human
ucagguuucuuuaccucca

SEQ ID NO: 71911 - RNA, 24 nt, Human
gguccguacaggguggggucccca

SEQ ID NO: 71912 - RNA, 21 nt, Human
gggcuccacaccuuugcugug

SEQ ID NO: 71913 - RNA, 22 nt, Human
guuaagaugaaauuauauuuuu

SEQ ID NO: 71914 - RNA, 21 nt, Human
uucccuggcaaacaaaggaac

SEQ ID NO: 71915 - RNA, 22 nt, Human
cacgucacaaccucugaucuca

SEQ ID NO: 71916 - RNA, 24 nt, Human
cagggagagugaugcuccaggcaa

SEQ ID NO: 71917 - RNA, 21 nt, Human
gcaacaaaaagucauuuuucu

SEQ ID NO: 71918 - RNA, 24 nt, Human
cacagccccaguuucuggaggcag

SEQ ID NO: 71919 - RNA, 21 nt, Human
gcuucuucaggacagcacugc

SEQ ID NO: 71920 - RNA, 19 nt, Human
uaagagaccuccuucuggg

SEQ ID NO: 71921 - RNA, 21 nt, Human
gcuguuguucagaaguuguua

SEQ ID NO: 71922 - RNA, 20 nt, Human
gcugccucuuuccggcugug

SEQ ID NO: 71923 - RNA, 22 nt, Human
cuccagccauagcgccuggugu

SEQ ID NO: 71924 - RNA, 20 nt, Human
cuuugcagaguucaaguuua

SEQ ID NO: 71925 - RNA, 20 nt, Human
ugcuucuucacucccaccug

SEQ ID NO: 71926 - RNA, 27 nt, Human
ucucaacuccgucugucuacuguguga

SEQ ID NO: 71927 - RNA, 22 nt, Human
cccgaggaguagaggcagcagc

SEQ ID NO: 71928 - RNA, 21 nt, Human
cugagccuccuugucuauccu

SEQ ID NO: 71929 - RNA, 21 nt, Human
cugcagccucaaccuccuggg

SEQ ID NO: 71930 - RNA, 22 nt, Human
uaagaagaagucaauaugcuua

SEQ ID NO: 71931 - RNA, 19 nt, Human
gcacugccucacagccaag

SEQ ID NO: 71932 - RNA, 24 nt, Human
uggggaggcugaggcaggagaauc

SEQ ID NO: 71933 - RNA, 20 nt, Human
gaccagguuccccuccgugc

SEQ ID NO: 71934 - RNA, 22 nt, Human
ucucgcccaggcuggagugcag

SEQ ID NO: 71935 - RNA, 26 nt, Human
uggcauccuuccccagcacuugcauu

SEQ ID NO: 71936 - RNA, 20 nt, Human
gaagcugccucacagcaugg

SEQ ID NO: 71937 - RNA, 23 nt, Human
ccuugccguucagccacugugaa

SEQ ID NO: 71938 - RNA, 20 nt, Human
agugcccuucccaugggguc

SEQ ID NO: 71939 - RNA, 21 nt, Human
aaagcugugcuuggggucaaa

SEQ ID NO: 71940 - RNA, 20 nt, Human
cuucuucucuccauccuugg

SEQ ID NO: 71941 - RNA, 22 nt, Human
uaauauuuaaaauuuacacuuc

SEQ ID NO: 71942 - RNA, 19 nt, Human
ccucuagaaccugccuuuu

SEQ ID NO: 71943 - RNA, 27 nt, Human
accgccacccuugcccccucagcugcc

SEQ ID NO: 71944 - RNA, 25 nt, Human
accacaugaauucagauuuaccuca

SEQ ID NO: 71945 - RNA, 19 nt, Human
cacagacacagacauacuu

SEQ ID NO: 71946 - RNA, 21 nt, Human
ugcucagacugcccccaagau

SEQ ID NO: 71947 - RNA, 27 nt, Human
ggcugggugguugguagaggagauguu

SEQ ID NO: 71948 - RNA, 22 nt, Human
ucuccugggcucuuccugcugc

SEQ ID NO: 71949 - RNA, 26 nt, Human
gcucccaggauggcggugguggcagc

SEQ ID NO: 71950 - RNA, 17 nt, Human
cugaguacaguacucuu

SEQ ID NO: 71951 - RNA, 21 nt, Human
cccuugccugacccucaggga

SEQ ID NO: 71952 - RNA, 23 nt, Human
uccuuucuccugccccaagggcc

SEQ ID NO: 71953 - RNA, 25 nt, Human
ggaaucaggagccuggacacugcca

SEQ ID NO: 71954 - RNA, 23 nt, Human
gaggugcaggggaagaccaaagu

SEQ ID NO: 71955 - RNA, 22 nt, Human
uagauauuaccaguuuuccuaa

SEQ ID NO: 71956 - RNA, 21 nt, Human
agcuuccuccccacuucgcag

SEQ ID NO: 71957 - RNA, 22 nt, Human
cagauuuugcaagagccaggcu

SEQ ID NO: 71958 - RNA, 21 nt, Human
gagggccggggcugggcgcgg

SEQ ID NO: 71959 - RNA, 29 nt, Human
ggggcgcagaagagaggggagcccuucuc

SEQ ID NO: 71960 - RNA, 20 nt, Human
uccugcacuccuucuggagg

SEQ ID NO: 71961 - RNA, 27 nt, Human
auguugacuaaaggcuugguugguaga

SEQ ID NO: 71962 - RNA, 26 nt, Human
ucauuucugucuccuguuucuccacu

SEQ ID NO: 71963 - RNA, 20 nt, Human
gacccucugacccuagcucu

SEQ ID NO: 71964 - RNA, 21 nt, Human
gccuuaagcgauggcccaggg

SEQ ID NO: 71965 - RNA, 24 nt, Human
cugcaacccuauggccucuuggag

SEQ ID NO: 71966 - RNA, 23 nt, Human
caggccuguagucccagcuacuu

SEQ ID NO: 71967 - RNA, 27 nt, Human
gucucaaacuccugggcucaagcaaug

SEQ ID NO: 71968 - RNA, 21 nt, Human
acgaucacauucuuuauuucu

SEQ ID NO: 71969 - RNA, 22 nt, Human
uucugcaauuucauacuaccua

SEQ ID NO: 71970 - RNA, 27 nt, Human
ccccacccucaaacccuguggggccug

SEQ ID NO: 71971 - RNA, 20 nt, Human
aaccuguuucuuacagcuuu

SEQ ID NO: 71972 - RNA, 24 nt, Human
gcacccaggaggggaacacugccc

SEQ ID NO: 71973 - RNA, 24 nt, Human
cacugggcuuagcugggccucuga

SEQ ID NO: 71974 - RNA, 22 nt, Human
caaaguugcauguucuaugaca

SEQ ID NO: 71975 - RNA, 26 nt, Human
acuaaauuuaagaugcagcauuuuag

SEQ ID NO: 71976 - RNA, 23 nt, Human
cucaagggauccuccugcaucag

SEQ ID NO: 71977 - RNA, 24 nt, Human
caccgggaagccagccucagggac

SEQ ID NO: 71978 - RNA, 20 nt, Human
gauuggcaccccacagcccu

SEQ ID NO: 71979 - RNA, 20 nt, Human
gagucuaaugaaacucucau

SEQ ID NO: 71980 - RNA, 27 nt, Human
ggagcaucuggcagccccacaccugcc

SEQ ID NO: 71981 - RNA, 23 nt, Human
cuuagcagagauugggaugccuu

SEQ ID NO: 71982 - RNA, 27 nt, Human
gcauuuuauuugcuauaguuuguaaag

SEQ ID NO: 71983 - RNA, 26 nt, Human
ccucugccuccugggcucaacggauc

SEQ ID NO: 71984 - RNA, 22 nt, Human
cugugucuuggagcugacuuac

SEQ ID NO: 71985 - RNA, 22 nt, Human
ggauagaaggggggcuauuuua

SEQ ID NO: 71986 - RNA, 20 nt, Human
cagacgugugugagaggccu

SEQ ID NO: 71987 - RNA, 19 nt, Human
gggauuuugacacagccuu

SEQ ID NO: 71988 - RNA, 24 nt, Human
aauugaaucuuuaacaugacuuua

SEQ ID NO: 71989 - RNA, 23 nt, Human
ucauuucugagucgccugcauua

SEQ ID NO: 71990 - RNA, 28 nt, Human
agggagcugaggccauucccuguaggag

SEQ ID NO: 71991 - RNA, 19 nt, Human
accaaacaaaaaugccauu

SEQ ID NO: 71992 - RNA, 22 nt, Human
auuccuaagaguggaggaggag

SEQ ID NO: 71993 - RNA, 22 nt, Human
gcugguccuccagcccuggcag

SEQ ID NO: 71994 - RNA, 23 nt, Human
ucuuauugcccaggcuugagugc

SEQ ID NO: 71995 - RNA, 25 nt, Human
gugggacccucaucucugcugccuc

SEQ ID NO: 71996 - RNA, 21 nt, Human
cuccgagcccuccugguggga

SEQ ID NO: 71997 - RNA, 19 nt, Human
uggauauuuggaaacuuac

SEQ ID NO: 71998 - RNA, 20 nt, Human
guuuugacaaugcuuugggu

SEQ ID NO: 71999 - RNA, 25 nt, Human
gggagcuggggcggugagggcaugg

SEQ ID NO: 72000 - RNA, 22 nt, Human
gauuguauucauuacuagauaa

SEQ ID NO: 72001 - RNA, 23 nt, Human
uagggcaaacuguggcccccagg

SEQ ID NO: 72002 - RNA, 22 nt, Human
gugaucaugguucacugcaguc

SEQ ID NO: 72003 - RNA, 21 nt, Human
cacucaacguggucccuagaa

SEQ ID NO: 72004 - RNA, 22 nt, Human
auaaaguguuuuuaaaaucucc

SEQ ID NO: 72005 - RNA, 27 nt, Human
uauuaccuccuuaauuuuuaacaacua

SEQ ID NO: 72006 - RNA, 26 nt, Human
caguccccuccugccugcuccugucc

SEQ ID NO: 72007 - RNA, 23 nt, Human
aacucauauuuucaugcuguuca

SEQ ID NO: 72008 - RNA, 21 nt, Human
gcucugcuccucuccugggcc

SEQ ID NO: 72009 - RNA, 22 nt, Human
gugagccccaaaccuuacuggg

SEQ ID NO: 72010 - RNA, 18 nt, Human
aguugacaaaaagcucuu

SEQ ID NO: 72011 - RNA, 22 nt, Human
ccauacagcuaaugcugacaga

SEQ ID NO: 72012 - RNA, 22 nt, Human
ccgccgccagcuccucggaggc

SEQ ID NO: 72013 - RNA, 23 nt, Human
cugacagauuuuaaaaauugaua

SEQ ID NO: 72014 - RNA, 24 nt, Human
ucuccugcccccgcggcuggagca

SEQ ID NO: 72015 - RNA, 26 nt, Human
cugccgucuguucccugagcugugcu

SEQ ID NO: 72016 - RNA, 21 nt, Human
uucaauaagcucuucccacug

SEQ ID NO: 72017 - RNA, 21 nt, Human
gccagucucauccagcagguu

SEQ ID NO: 72018 - RNA, 30 nt, Human
caaaugccuguucaaucaaccaaacaucua

SEQ ID NO: 72019 - RNA, 22 nt, Human
caacauagugaaacccugucuc

SEQ ID NO: 72020 - RNA, 27 nt, Human
ggaggcagcagcgcccccgcacucccc

SEQ ID NO: 72021 - RNA, 29 nt, Human
uggguggagagguuugucucagccucugc

SEQ ID NO: 72022 - RNA, 21 nt, Human
ucucacuuccuucuagaagga

SEQ ID NO: 72023 - RNA, 21 nt, Human
auuuuucugagacggagucgu

SEQ ID NO: 72024 - RNA, 23 nt, Human
uuaggccaccuccaaggacucua

SEQ ID NO: 72025 - RNA, 18 nt, Human
uuguuucagccuuccuua

SEQ ID NO: 72026 - RNA, 19 nt, Human
aacaacaaauauguucucu

SEQ ID NO: 72027 - RNA, 22 nt, Human
ugcgccugcaggcagagcugga

SEQ ID NO: 72028 - RNA, 20 nt, Human
ucuucucucaaccuuuuggg

SEQ ID NO: 72029 - RNA, 26 nt, Human
gagaauugcuugaggccaggaguuug

SEQ ID NO: 72030 - RNA, 26 nt, Human
gaggauugcuuaaggccaggaguuug

SEQ ID NO: 72031 - RNA, 27 nt, Human
ccgcagcuugugugcgugagugcagug

SEQ ID NO: 72032 - RNA, 21 nt, Human
ggauuuccuuuauacugugaa

SEQ ID NO: 72033 - RNA, 22 nt, Human
acuauagucacuacuuuuucca

SEQ ID NO: 72034 - RNA, 21 nt, Human
ucuuuccaaaauguaucugua

SEQ ID NO: 72035 - RNA, 20 nt, Human
gcugccucuucgcggggugu

SEQ ID NO: 72036 - RNA, 21 nt, Human
uaucuccuuccuucccuacca

SEQ ID NO: 72037 - RNA, 19 nt, Human
ccugcuguccccucuugcc

SEQ ID NO: 72038 - RNA, 26 nt, Human
gcauuuuucuuacuaggaggagaugg

SEQ ID NO: 72039 - RNA, 24 nt, Human
ucuccuaucugcacucacccaggc

SEQ ID NO: 72040 - RNA, 26 nt, Human
gggcgcguuugcaggccaguggccac

SEQ ID NO: 72041 - RNA, 20 nt, Human
agggcacagggccaucuguc

SEQ ID NO: 72042 - RNA, 21 nt, Human
uccucgggguuccuucucaca

SEQ ID NO: 72043 - RNA, 23 nt, Human
gucgcccaggcuagaguggauug

SEQ ID NO: 72044 - RNA, 22 nt, Human
uguggguaguaugauggguguu

SEQ ID NO: 72045 - RNA, 23 nt, Human
aguaugagcccuaaaaauccaga

SEQ ID NO: 72046 - RNA, 27 nt, Human
cagccaauccaagcauuuucuccuggg

SEQ ID NO: 72047 - RNA, 23 nt, Human
ccgucuggcccuucccugcaggc

SEQ ID NO: 72048 - RNA, 20 nt, Human
uaaagaagacacuaauuguc

SEQ ID NO: 72049 - RNA, 22 nt, Human
ugacauucuuuucuuuucuccu

SEQ ID NO: 72050 - RNA, 20 nt, Human
cccaggcuggagugcagugg

SEQ ID NO: 72051 - RNA, 21 nt, Human
uaauauggaaccuucccucca

SEQ ID NO: 72052 - RNA, 21 nt, Human
gacuuguuuccuucuacuuuu

SEQ ID NO: 72053 - RNA, 22 nt, Human
cugccuccugggcucaagcaau

SEQ ID NO: 72054 - RNA, 22 nt, Human
auggguaccuacagaagccucu

SEQ ID NO: 72055 - RNA, 20 nt, Human
aguggugacgagcuguggga

SEQ ID NO: 72056 - RNA, 26 nt, Human
guggagccucagggacagaucugaug

SEQ ID NO: 72057 - RNA, 22 nt, Human
cacucaacaccgaguguggggg

SEQ ID NO: 72058 - RNA, 18 nt, Human
ccuccuccucuucugggc

SEQ ID NO: 72059 - RNA, 22 nt, Human
uugcccaaccuggagugcagug

SEQ ID NO: 72060 - RNA, 30 nt, Human
ugggaccauugggagcagagcugauauuaa

SEQ ID NO: 72061 - RNA, 24 nt, Human
cugggcuggagaagccacuguggg

SEQ ID NO: 72062 - RNA, 24 nt, Human
uucagcaggugcagaucucggcuu

SEQ ID NO: 72063 - RNA, 22 nt, Human
cucccaggucauugucaguuua

SEQ ID NO: 72064 - RNA, 24 nt, Human
uggggagagggagggccgggaagc

SEQ ID NO: 72065 - RNA, 21 nt, Human
ccucugccccuggccuuugag

SEQ ID NO: 72066 - RNA, 23 nt, Human
accaugucccaucacugggggua

SEQ ID NO: 72067 - RNA, 19 nt, Human
ucuccuccuccgccugugu

SEQ ID NO: 72068 - RNA, 24 nt, Human
ugaacauuaaaugugaugaugauu

SEQ ID NO: 72069 - RNA, 26 nt, Human
cggagagaaggggaggaggacuccag

SEQ ID NO: 72070 - RNA, 19 nt, Human
acucaggaggaccugugaa

SEQ ID NO: 72071 - RNA, 24 nt, Human
auagaugaauuuauuuuauuucua

SEQ ID NO: 72072 - RNA, 25 nt, Human
ccuuuauuuuaaaugaucuguacua

SEQ ID NO: 72073 - RNA, 22 nt, Human
aaacucauaccuguaugaauua

SEQ ID NO: 72074 - RNA, 27 nt, Human
cuaagcugugaugaagaaaguguggua

SEQ ID NO: 72075 - RNA, 22 nt, Human
uggggauggugagaauggaggu

SEQ ID NO: 72076 - RNA, 22 nt, Human
gcugcuuguggcggauuccuca

SEQ ID NO: 72077 - RNA, 26 nt, Human
cguccaucucucucccuuacuauucc

SEQ ID NO: 72078 - RNA, 25 nt, Human
uucggcgcggggggacagaggaggc

SEQ ID NO: 72079 - RNA, 21 nt, Human
ggaagaaggaaugaccucugg

SEQ ID NO: 72080 - RNA, 24 nt, Human
ccucuggaucaguggcauggcuua

SEQ ID NO: 72081 - RNA, 20 nt, Human
ccccagcccccaguucucuc

SEQ ID NO: 72082 - RNA, 23 nt, Human
uggggaagaggugcaggagaagc

SEQ ID NO: 72083 - RNA, 21 nt, Human
gaauugugacaggcagagggu

SEQ ID NO: 72084 - RNA, 26 nt, Human
agggcacagggucccaaaccgaggcc

SEQ ID NO: 72085 - RNA, 23 nt, Human
cuguuuaaucauaguuacugugu

SEQ ID NO: 72086 - RNA, 21 nt, Human
aacucauguuucucuguuucu

SEQ ID NO: 72087 - RNA, 22 nt, Human
auggagccuucagucuccuggg

SEQ ID NO: 72088 - RNA, 26 nt, Human
gcuuauaaucaugcauauaaccuuua

SEQ ID NO: 72089 - RNA, 27 nt, Human
uggcuuguaccuguggucccaucugcu

SEQ ID NO: 72090 - RNA, 30 nt, Human
uggagauguugugugcaaugcuggccugug

SEQ ID NO: 72091 - RNA, 26 nt, Human
gagagggagaaacaggcgcggggucu

SEQ ID NO: 72092 - RNA, 20 nt, Human
cccaaugccauauguaauag

SEQ ID NO: 72093 - RNA, 20 nt, Human
uacucacugaagccugcguu

SEQ ID NO: 72094 - RNA, 23 nt, Human
cgagguugagaggaaggaggguc

SEQ ID NO: 72095 - RNA, 26 nt, Human
gcaggcaaugcuguacuuuucuucag

SEQ ID NO: 72096 - RNA, 22 nt, Human
caccagguggcagcaucuuguc

SEQ ID NO: 72097 - RNA, 21 nt, Human
cacccucucugggccucaguu

SEQ ID NO: 72098 - RNA, 17 nt, Human
cuucccuuguagagcca

SEQ ID NO: 72099 - RNA, 22 nt, Human
ucuguugcccaggcugcagugc

SEQ ID NO: 72100 - RNA, 26 nt, Human
uuugaaaaguuguggccugcuugucc

SEQ ID NO: 72101 - RNA, 21 nt, Human
ucuccccuccccaucuguguu

SEQ ID NO: 72102 - RNA, 25 nt, Human
gguuacucugagaauuuugcuuaug

SEQ ID NO: 72103 - RNA, 20 nt, Human
uggagaagaaacaggcugug

SEQ ID NO: 72104 - RNA, 31 nt, Human
gaagcagcagaugcaggaccagugcgcucgc

SEQ ID NO: 72105 - RNA, 27 nt, Human
acaaucaguuaauuuaccauguaaaau

SEQ ID NO: 72106 - RNA, 19 nt, Human
agacugcuaucagucucuu

SEQ ID NO: 72107 - RNA, 27 nt, Human
ucagcacuuauuucuguaguuuuaaaa

SEQ ID NO: 72108 - RNA, 19 nt, Human
cuuuguugugcguggggcu

SEQ ID NO: 72109 - RNA, 26 nt, Human
cucacauucccacauacauucacuau

SEQ ID NO: 72110 - RNA, 20 nt, Human
uggagcuaaacaaaauauua

SEQ ID NO: 72111 - RNA, 23 nt, Human
gggagagauagggugggaggcag

SEQ ID NO: 72112 - RNA, 25 nt, Human
acggagccccugaaagccucacgua

SEQ ID NO: 72113 - RNA, 23 nt, Human
uuuugcaggaauaccugaggcug

SEQ ID NO: 72114 - RNA, 23 nt, Human
cuccugccucagccuccagaaua

SEQ ID NO: 72115 - RNA, 22 nt, Human
agccucccgaauagcugggacu

SEQ ID NO: 72116 - RNA, 21 nt, Human
gccagcuggcuuugcacuuga

SEQ ID NO: 72117 - RNA, 21 nt, Human
ugugagccaccgcugccagcc

SEQ ID NO: 72118 - RNA, 26 nt, Human
ggaagcaccagccuggaccuaccacc

SEQ ID NO: 72119 - RNA, 20 nt, Human
gagaccccaggcuguuaggg

SEQ ID NO: 72120 - RNA, 22 nt, Human
ucccgccuuccaaaaccugcuu

SEQ ID NO: 72121 - RNA, 24 nt, Human
caguagccgccucugccgccgcgg

SEQ ID NO: 72122 - RNA, 21 nt, Human
ugcaggagaaagcuaagccuc

SEQ ID NO: 72123 - RNA, 20 nt, Human
aggcuucucccaacccaugg

SEQ ID NO: 72124 - RNA, 27 nt, Human
uccucucugcccuaaugcgcaggcugg

SEQ ID NO: 72125 - RNA, 29 nt, Human
cgcacacacagugauucccuccucccguc

SEQ ID NO: 72126 - RNA, 23 nt, Human
acccccaaaccaccgacucucau

SEQ ID NO: 72127 - RNA, 21 nt, Human
ggagaauacuuucaauucuga

SEQ ID NO: 72128 - RNA, 27 nt, Human
ucgcccaggcuggagugcagcagcaca

SEQ ID NO: 72129 - RNA, 26 nt, Human
gaagaacugguucuguggaauuugug

SEQ ID NO: 72130 - RNA, 27 nt, Human
ucaaaagccaaagaauaacaagaaaua

SEQ ID NO: 72131 - RNA, 26 nt, Human
ccucuguggggcucugaccucagggc

SEQ ID NO: 72132 - RNA, 26 nt, Human
guucagcccagcugaggccugucugc

SEQ ID NO: 72133 - RNA, 23 nt, Human
ggcagcaccacugccugcucccu

SEQ ID NO: 72134 - RNA, 22 nt, Human
ggaauauccuggaguggucccc

SEQ ID NO: 72135 - RNA, 20 nt, Human
ucuguggaugaaaugaauca

SEQ ID NO: 72136 - RNA, 16 nt, Human
ugucaggcagugaaug

SEQ ID NO: 72137 - RNA, 23 nt, Human
uuuggcaguggagccgccagucu

SEQ ID NO: 72138 - RNA, 31 nt, Human
ccucgccauagaguuccagacauauuuuccg

SEQ ID NO: 72139 - RNA, 19 nt, Human
caaugccaucacaguacac

SEQ ID NO: 72140 - RNA, 21 nt, Human
ccucacaccugggggacagag

SEQ ID NO: 72141 - RNA, 20 nt, Human
auagcccagcaaauagugau

SEQ ID NO: 72142 - RNA, 24 nt, Human
guaggagggucacauccacuuggu

SEQ ID NO: 72143 - RNA, 21 nt, Human
caguaacugaauuugugcaca

SEQ ID NO: 72144 - RNA, 24 nt, Human
accgagccaccaggagguuguuga

SEQ ID NO: 72145 - RNA, 20 nt, Human
cugcuucuuccagagaaaua

SEQ ID NO: 72146 - RNA, 23 nt, Human
uagacaacauuauuauaugugcu

SEQ ID NO: 72147 - RNA, 26 nt, Human
gagaacaucuuugacacucugcagac

SEQ ID NO: 72148 - RNA, 27 nt, Human
cuucccaaaggacuccacccauccuau

SEQ ID NO: 72149 - RNA, 22 nt, Human
ucauuucaaaagcagaaaaaga

SEQ ID NO: 72150 - RNA, 22 nt, Human
aaagggagauucuggcuuggga

SEQ ID NO: 72151 - RNA, 20 nt, Human
gcaagaacucaucacugugg

SEQ ID NO: 72152 - RNA, 22 nt, Human
uccuuccaugaucugaucaugu

SEQ ID NO: 72153 - RNA, 22 nt, Human
guggauaccugcccugacaugu

SEQ ID NO: 72154 - RNA, 20 nt, Human
gccuuccugccccuggacug

SEQ ID NO: 72155 - RNA, 26 nt, Human
agugcagcuguggguggaggcugggg

SEQ ID NO: 72156 - RNA, 25 nt, Human
agagacacucccaaggagacagcca

SEQ ID NO: 72157 - RNA, 24 nt, Human
cugcuucucucuugcauagauaca

SEQ ID NO: 72158 - RNA, 20 nt, Human
ucacauagcuagaaaggccc

SEQ ID NO: 72159 - RNA, 27 nt, Human
aucaguacuucauccaaaggccuguca

SEQ ID NO: 72160 - RNA, 24 nt, Human
ccugcagcgcuuccucccgcagcc

SEQ ID NO: 72161 - RNA, 22 nt, Human
cucccacacucguuucccuuug

SEQ ID NO: 72162 - RNA, 21 nt, Human
cugcuaaccccucuccucgcc

SEQ ID NO: 72163 - RNA, 21 nt, Human
agccaagaucccaucucucca

SEQ ID NO: 72164 - RNA, 23 nt, Human
guccccgcccucucucauaucac

SEQ ID NO: 72165 - RNA, 23 nt, Human
agugggggcugugccgugaacug

SEQ ID NO: 72166 - RNA, 25 nt, Human
gccacauggacuggggugcaauggg

SEQ ID NO: 72167 - RNA, 27 nt, Human
uggauacgaucccuuuagaaccugcuu

SEQ ID NO: 72168 - RNA, 24 nt, Human
guugcccaggcugggagggcaaug

SEQ ID NO: 72169 - RNA, 21 nt, Human
caccucccagguucaagcagu

SEQ ID NO: 72170 - RNA, 20 nt, Human
aacuaucuauuugcaccuua

SEQ ID NO: 72171 - RNA, 25 nt, Human
gcgcgugccagccugggccgcuggg

SEQ ID NO: 72172 - RNA, 22 nt, Human
auuuuaugcuggacucuggacc

SEQ ID NO: 72173 - RNA, 22 nt, Human
cacugugcuccugggccuguga

SEQ ID NO: 72174 - RNA, 23 nt, Human
gugacauucucucccaugacacc

SEQ ID NO: 72175 - RNA, 25 nt, Human
uguacuuguucuuuucugguagguu

SEQ ID NO: 72176 - RNA, 25 nt, Human
ucaggcuuuuucuccacacuuguau

SEQ ID NO: 72177 - RNA, 24 nt, Human
gcaguguucccccuccuccucacc

SEQ ID NO: 72178 - RNA, 23 nt, Human
cucaagcgauccuccugccucag

SEQ ID NO: 72179 - RNA, 22 nt, Human
gccugggacacuucccugggcc

SEQ ID NO: 72180 - RNA, 19 nt, Human
aagggagggggagagaagc

SEQ ID NO: 72181 - RNA, 28 nt, Human
cuuauccuuauccccuccagucucugcc

SEQ ID NO: 72182 - RNA, 23 nt, Human
ccuuuucucuaguauuugacugu

SEQ ID NO: 72183 - RNA, 26 nt, Human
uuaaggcuucucuuaaacacuaaaaa

SEQ ID NO: 72184 - RNA, 23 nt, Human
uaacaugagaauuucucucuaaa

SEQ ID NO: 72185 - RNA, 22 nt, Human
ccacuggccuauuuucucagcu

SEQ ID NO: 72186 - RNA, 26 nt, Human
uuaauuuccauuucucugaugacuuu

SEQ ID NO: 72187 - RNA, 20 nt, Human
uugugauugauuauauguca

SEQ ID NO: 72188 - RNA, 21 nt, Human
cacacuccucacagagaucug

SEQ ID NO: 72189 - RNA, 26 nt, Human
agguacagcuauuaaaacaagguagg

SEQ ID NO: 72190 - RNA, 22 nt, Human
uucucucaaacugcuaauugcg

SEQ ID NO: 72191 - RNA, 22 nt, Human
caucagaugccggagacucgcc

SEQ ID NO: 72192 - RNA, 26 nt, Human
uccgaguagcugggaccacaggcaug

SEQ ID NO: 72193 - RNA, 22 nt, Human
gagaggaaagcagggaggucuc

SEQ ID NO: 72194 - RNA, 27 nt, Human
ccccugccucuaucccuggccaccugc

SEQ ID NO: 72195 - RNA, 26 nt, Human
guucaguuugggugucugcuaaagag

SEQ ID NO: 72196 - RNA, 20 nt, Human
gucucaucucuaacguucua

SEQ ID NO: 72197 - RNA, 22 nt, Human
agcauuguggcuuuauauccuc

SEQ ID NO: 72198 - RNA, 27 nt, Human
aguguuuauauaauuuuauguucuacu

SEQ ID NO: 72199 - RNA, 13 nt, Human
uagccuuacuuga

SEQ ID NO: 72200 - RNA, 21 nt, Human
agacuccugggcccuuggaua

SEQ ID NO: 72201 - RNA, 21 nt, Human
uuccuguuccucuccccacca

SEQ ID NO: 72202 - RNA, 21 nt, Human
ugcccgagccucucagggcca

SEQ ID NO: 72203 - RNA, 25 nt, Human
ugucagaugauaaacaugacuggga

SEQ ID NO: 72204 - RNA, 24 nt, Human
acaaccagagaacaggauucuucc

SEQ ID NO: 72205 - RNA, 27 nt, Human
uuuucauuuucaagaugauugcucuau

SEQ ID NO: 72206 - RNA, 17 nt, Human
cgucucgucccaccugg

SEQ ID NO: 72207 - RNA, 18 nt, Human
agcuucugcucugcccca

SEQ ID NO: 72208 - RNA, 21 nt, Human
ucaugcaucucugggaaauga

SEQ ID NO: 72209 - RNA, 21 nt, Human
gugcugaaucuacacaucugu

SEQ ID NO: 72210 - RNA, 19 nt, Human
agaaaucaugaacaacuuu

SEQ ID NO: 72211 - RNA, 19 nt, Human
gggagguggggaggaauga

SEQ ID NO: 72212 - RNA, 21 nt, Human
cuguaggagugagacucugaa

SEQ ID NO: 72213 - RNA, 21 nt, Human
cuaggaacuuggcuguguugu

SEQ ID NO: 72214 - RNA, 27 nt, Human
ccauugcacuccaaccuggacgacaga

SEQ ID NO: 72215 - RNA, 23 nt, Human
ucugccuggagucccgccccugc

SEQ ID NO: 72216 - RNA, 24 nt, Human
cccuuccuccuggccuggacgcug

SEQ ID NO: 72217 - RNA, 19 nt, Human
agcauggucacaagcacaa

SEQ ID NO: 72218 - RNA, 26 nt, Human
gagagggagaagaagucagagagggu

SEQ ID NO: 72219 - RNA, 22 nt, Human
ggaguuucuauuaaaaucuguc

SEQ ID NO: 72220 - RNA, 26 nt, Human
cugcuucuuauucacacuauaauaca

SEQ ID NO: 72221 - RNA, 24 nt, Human
gcugcugcugcuucccaagauccu

SEQ ID NO: 72222 - RNA, 30 nt, Human
ggcaggggcguggagggcagagggccgcgg

SEQ ID NO: 72223 - RNA, 27 nt, Human
cgcaucccaagagcugcaguuucagcc

SEQ ID NO: 72224 - RNA, 23 nt, Human
guggguggcagagucaaaaggaa

SEQ ID NO: 72225 - RNA, 13 nt, Human
cagcaauauugcc

SEQ ID NO: 72226 - RNA, 27 nt, Human
ggcuguggcuaugguggccuguuagug

SEQ ID NO: 72227 - RNA, 19 nt, Human
gagugagugagagggcaga

SEQ ID NO: 72228 - RNA, 21 nt, Human
agcaucugaguggggccucua

SEQ ID NO: 72229 - RNA, 27 nt, Human
guugcccaggcuggagugcaauggugc

SEQ ID NO: 72230 - RNA, 20 nt, Human
ugcuuggaguuuaccuggcu

SEQ ID NO: 72231 - RNA, 21 nt, Human
cacccagacuggagugcagug

SEQ ID NO: 72232 - RNA, 21 nt, Human
cacccaggcuggaguacagug

SEQ ID NO: 72233 - RNA, 26 nt, Human
ccugagcccugucccugcccuucucu

SEQ ID NO: 72234 - RNA, 22 nt, Human
gauugcauacaagaugcauguu

SEQ ID NO: 72235 - RNA, 24 nt, Human
ugcccaggcuggaauccaagagug

SEQ ID NO: 72236 - RNA, 19 nt, Human
ugcagugagcagugcagug

SEQ ID NO: 72237 - RNA, 26 nt, Human
uggaaaagcuuuguauuuugguuagc

SEQ ID NO: 72238 - RNA, 23 nt, Human
agacaaccacuacgcgggccgua

SEQ ID NO: 72239 - RNA, 22 nt, Human
cacccaggcagggagcaagugg

SEQ ID NO: 72240 - RNA, 22 nt, Human
uggagagcugcugaggagccag

SEQ ID NO: 72241 - RNA, 24 nt, Human
gagcucaaaauaaauuggaaaugu

SEQ ID NO: 72242 - RNA, 21 nt, Human
gcucacugcaaccugugccuc

SEQ ID NO: 72243 - RNA, 22 nt, Human
uagaagggcuagaaccuggaga

SEQ ID NO: 72244 - RNA, 21 nt, Human
ugcuccagcuuccagcuggag

SEQ ID NO: 72245 - RNA, 28 nt, Human
ucuuuaguuccuccuggacaacacugua

SEQ ID NO: 72246 - RNA, 22 nt, Human
agaguccucuucagaagauauu

SEQ ID NO: 72247 - RNA, 24 nt, Human
acccucacuggccuucugcagcag

SEQ ID NO: 72248 - RNA, 21 nt, Human
ggcccaugaggggaaagagga

SEQ ID NO: 72249 - RNA, 21 nt, Human
guggccuuucguacagugggc

SEQ ID NO: 72250 - RNA, 22 nt, Human
uuuggcuggucacaucuagugc

SEQ ID NO: 72251 - RNA, 21 nt, Human
cacagccucagccuccgucgc

SEQ ID NO: 72252 - RNA, 20 nt, Human
gugacuugauugccaaggaa

SEQ ID NO: 72253 - RNA, 28 nt, Human
cucagagccucagcuucugggggagaca

SEQ ID NO: 72254 - RNA, 21 nt, Human
aaacuauuugcgacucaccca

SEQ ID NO: 72255 - RNA, 26 nt, Human
cagcaaacagaucacuaggccucuga

SEQ ID NO: 72256 - RNA, 17 nt, Human
gaccugacacugaucca

SEQ ID NO: 72257 - RNA, 24 nt, Human
gcacauuuaacaauuacagguuau

SEQ ID NO: 72258 - RNA, 22 nt, Human
gagcgagacuucaucucagaaa

SEQ ID NO: 72259 - RNA, 20 nt, Human
gaacaauggggacuuuguug

SEQ ID NO: 72260 - RNA, 27 nt, Human
uuucuguguuauccuucuuaucccacu

SEQ ID NO: 72261 - RNA, 27 nt, Human
uucacaguguguggucaacauuucuca

SEQ ID NO: 72262 - RNA, 22 nt, Human
cacuucauuccagccuggguga

SEQ ID NO: 72263 - RNA, 22 nt, Human
cugcuuuggcugaggggcuugg

SEQ ID NO: 72264 - RNA, 20 nt, Human
uaacauugaacauuuuauca

SEQ ID NO: 72265 - RNA, 22 nt, Human
ugagagugccuacucuggcuug

SEQ ID NO: 72266 - RNA, 26 nt, Human
caucccccuucuuccuccccucaaca

SEQ ID NO: 72267 - RNA, 21 nt, Human
acaggguuuuaacgugcucaa

SEQ ID NO: 72268 - RNA, 22 nt, Human
ccucugccccucuccugccacc

SEQ ID NO: 72269 - RNA, 23 nt, Human
aaugggguuucgucauguuggcc

SEQ ID NO: 72270 - RNA, 22 nt, Human
uuauuugcagagacaccugaga

SEQ ID NO: 72271 - RNA, 23 nt, Human
acacauuuccacuauaauuuuac

SEQ ID NO: 72272 - RNA, 21 nt, Human
gggagagaaggagggaggcgc

SEQ ID NO: 72273 - RNA, 23 nt, Human
cagccuuacacugggcacaugga

SEQ ID NO: 72274 - RNA, 24 nt, Human
ugccugcagaagucccaagacccu

SEQ ID NO: 72275 - RNA, 19 nt, Human
caaaagcucuuggguguuu

SEQ ID NO: 72276 - RNA, 22 nt, Human
gcuuauuggcauaugguugggc

SEQ ID NO: 72277 - RNA, 27 nt, Human
ugacauaguaacucuucagcuccgucu

SEQ ID NO: 72278 - RNA, 19 nt, Human
uuuguuguuuuuaacaacu

SEQ ID NO: 72279 - RNA, 23 nt, Human
aagcucauuuccagaaaaguuua

SEQ ID NO: 72280 - RNA, 23 nt, Human
cuugaagcagaguucaccaguga

SEQ ID NO: 72281 - RNA, 24 nt, Human
ggcugauuucaaaauauagagccc

SEQ ID NO: 72282 - RNA, 21 nt, Human
cacccaggcugcagugcaaug

SEQ ID NO: 72283 - RNA, 22 nt, Human
ugucuuggagugcauuugacuc

SEQ ID NO: 72284 - RNA, 19 nt, Human
cccaggcugaagugcagug

SEQ ID NO: 72285 - RNA, 29 nt, Human
ccgcgcugaccggcccuccagacgccucc

SEQ ID NO: 72286 - RNA, 27 nt, Human
aacucacagcuucuccaagcaucaccc

SEQ ID NO: 72287 - RNA, 23 nt, Human
aaaggucuguggccaucugugag

SEQ ID NO: 72288 - RNA, 27 nt, Human
guuacccaggcuggagugcaauggcgc

SEQ ID NO: 72289 - RNA, 22 nt, Human
cccuucucucccccagcucauc

SEQ ID NO: 72290 - RNA, 21 nt, Human
uugucguagacuugugcaaua

SEQ ID NO: 72291 - RNA, 22 nt, Human
ugcgugccuagcgcugugcuau

SEQ ID NO: 72292 - RNA, 28 nt, Human
cuccugugggcauggcucagguugugcg

SEQ ID NO: 72293 - RNA, 23 nt, Human
acagugcaccaugucacugugcu

SEQ ID NO: 72294 - RNA, 22 nt, Human
aggacagacgauggcagaggag

SEQ ID NO: 72295 - RNA, 26 nt, Human
ucuuggagauuguugaaugcagccag

SEQ ID NO: 72296 - RNA, 29 nt, Human
uggccagagagugucucucuagacuggga

SEQ ID NO: 72297 - RNA, 25 nt, Human
ggcagguccuccccucucuugucag

SEQ ID NO: 72298 - RNA, 21 nt, Human
uuaccuuucuucauugaacaa

SEQ ID NO: 72299 - RNA, 22 nt, Human
gaccagccuguccaacagaggg

SEQ ID NO: 72300 - RNA, 21 nt, Human
uuugggucucacgcagaggaa

SEQ ID NO: 72301 - RNA, 21 nt, Human
gcuggugaccuuuuuaaucca

SEQ ID NO: 72302 - RNA, 26 nt, Human
acugacacaaaugcuggugcccauuc

SEQ ID NO: 72303 - RNA, 22 nt, Human
ucugccccacacccagccagcu

SEQ ID NO: 72304 - RNA, 20 nt, Human
ugcccaggguggagugcagu

SEQ ID NO: 72305 - RNA, 23 nt, Human
cucccacuuuuggcuuuccugga

SEQ ID NO: 72306 - RNA, 25 nt, Human
gaaguagggagucucagucaaugua

SEQ ID NO: 72307 - RNA, 27 nt, Human
uucaguuucucacauuuuaugcuuuca

SEQ ID NO: 72308 - RNA, 21 nt, Human
acaaggcuuaucaccaaugga

SEQ ID NO: 72309 - RNA, 23 nt, Human
gugacauucucucucagcauucu

SEQ ID NO: 72310 - RNA, 24 nt, Human
acaaacagccucuuucacauuaca

SEQ ID NO: 72311 - RNA, 22 nt, Human
cccacugcagccuccaccuccc

SEQ ID NO: 72312 - RNA, 26 nt, Human
acccaggcugcagggugaggccaggc

SEQ ID NO: 72313 - RNA, 24 nt, Human
cuggcucccagucagugguggcca

SEQ ID NO: 72314 - RNA, 24 nt, Human
gcagcagcugcuacccacagccua

SEQ ID NO: 72315 - RNA, 19 nt, Human
caucagguuccaucccgaa

SEQ ID NO: 72316 - RNA, 24 nt, Human
cugucacccaggcuggagugcuau

SEQ ID NO: 72317 - RNA, 24 nt, Human
cugucucccaggcuggagugcaau

SEQ ID NO: 72318 - RNA, 24 nt, Human
aauaaagugccuuacugacuguag

SEQ ID NO: 72319 - RNA, 21 nt, Human
aaguaugcugcuauagaaaau

SEQ ID NO: 72320 - RNA, 21 nt, Human
uagucuaugaccacugccaca

SEQ ID NO: 72321 - RNA, 23 nt, Human
guaccugaaagcuccuggcaaug

SEQ ID NO: 72322 - RNA, 27 nt, Human
caccacugcauuccagccuggcgacag

SEQ ID NO: 72323 - RNA, 23 nt, Human
gugcaguauuuaagaaaaugaca

SEQ ID NO: 72324 - RNA, 22 nt, Human
cucccaccugcccuucuuuuca

SEQ ID NO: 72325 - RNA, 20 nt, Human
uggcgagcccuuagccuugc

SEQ ID NO: 72326 - RNA, 26 nt, Human
acugaccuucuuuuggaauuucugag

SEQ ID NO: 72327 - RNA, 25 nt, Human
ggugggagggggcagggggcuuggc

SEQ ID NO: 72328 - RNA, 22 nt, Human
ucaagugguucuccugccucag

SEQ ID NO: 72329 - RNA, 24 nt, Human
ugguuuugccuuucccaaaaauga

SEQ ID NO: 72330 - RNA, 19 nt, Human
cucuggcuuggacaggguc

SEQ ID NO: 72331 - RNA, 21 nt, Human
aaguguccuuguucauuuuca

SEQ ID NO: 72332 - RNA, 22 nt, Human
caacauagugagaccuugucuc

SEQ ID NO: 72333 - RNA, 25 nt, Human
ccugcagcuacagcugcuucauucc

SEQ ID NO: 72334 - RNA, 25 nt, Human
ggcauugagcuuuuucuuucauuuu

SEQ ID NO: 72335 - RNA, 21 nt, Human
ccugcugcuggcuccucacug

SEQ ID NO: 72336 - RNA, 21 nt, Human
uaccaguaccugaaguaggcu

SEQ ID NO: 72337 - RNA, 24 nt, Human
ggcuuccuuucauugucuuaggcc

SEQ ID NO: 72338 - RNA, 25 nt, Human
ccuaggugggagccaccacuccugc

SEQ ID NO: 72339 - RNA, 27 nt, Human
cugcucagauccugcuucaguggacaa

SEQ ID NO: 72340 - RNA, 28 nt, Human
ggcuuucagggcuggagcuggcuuugcu

SEQ ID NO: 72341 - RNA, 21 nt, Human
cagauaagugaguaaagcuuu

SEQ ID NO: 72342 - RNA, 26 nt, Human
cccugucucuucuuuuuucuggaccu

SEQ ID NO: 72343 - RNA, 26 nt, Human
uguuuuaaaaugaaaccugcuacuua

SEQ ID NO: 72344 - RNA, 22 nt, Human
uuguaggaaacugggaaauaaa

SEQ ID NO: 72345 - RNA, 22 nt, Human
ugucaacaaguagaaccucagu

SEQ ID NO: 72346 - RNA, 24 nt, Human
caggcagcuuugaggacaaaaagg

SEQ ID NO: 72347 - RNA, 21 nt, Human
aauauuuauuacaaauguuag

SEQ ID NO: 72348 - RNA, 25 nt, Human
uacucuuaguuacaguaaagcaauu

SEQ ID NO: 72349 - RNA, 26 nt, Human
ucgggagguugaggcaggagaaucgc

SEQ ID NO: 72350 - RNA, 21 nt, Human
ggacucggaggagcaggaggc

SEQ ID NO: 72351 - RNA, 21 nt, Human
cuccacccuccuacaggugcu

SEQ ID NO: 72352 - RNA, 22 nt, Human
uugugaacaguguuauuuauaa

SEQ ID NO: 72353 - RNA, 23 nt, Human
cccaucucagagccauaagguca

SEQ ID NO: 72354 - RNA, 26 nt, Human
ggucccggggcccgguuggcagcugg

SEQ ID NO: 72355 - RNA, 19 nt, Human
uucugggguuggagcuuaa

SEQ ID NO: 72356 - RNA, 26 nt, Human
ugucccaccauacgagcaccuccagc

SEQ ID NO: 72357 - RNA, 19 nt, Human
ucaggguuucuagcuuuga

SEQ ID NO: 72358 - RNA, 21 nt, Human
uuuaggguucaaaaugaugga

SEQ ID NO: 72359 - RNA, 20 nt, Human
guuguuuuugcuguuaaauu

SEQ ID NO: 72360 - RNA, 24 nt, Human
ugcuucaaaguauuauuaaaaaca

SEQ ID NO: 72361 - RNA, 20 nt, Human
ugcugcacuaguauuccuua

SEQ ID NO: 72362 - RNA, 22 nt, Human
cuguucucugucccccaaccau

SEQ ID NO: 72363 - RNA, 22 nt, Human
gcaagauggugaaaccccaucu

SEQ ID NO: 72364 - RNA, 27 nt, Human
auggaggugggagagcuuuuaguuaag

SEQ ID NO: 72365 - RNA, 21 nt, Human
ucauucuggggagacugaaaa

SEQ ID NO: 72366 - RNA, 23 nt, Human
aguccugcagaguccuuccagcc

SEQ ID NO: 72367 - RNA, 21 nt, Human
ggcuccuugaaguuauuacug

SEQ ID NO: 72368 - RNA, 18 nt, Human
guucagccccacagcucc

SEQ ID NO: 72369 - RNA, 24 nt, Human
ccgacucccagcccggccaaaaag

SEQ ID NO: 72370 - RNA, 24 nt, Human
aggaaagagaaaaauuaaguuagg

SEQ ID NO: 72371 - RNA, 27 nt, Human
caaauaguggucuuuguuauuagggcu

SEQ ID NO: 72372 - RNA, 22 nt, Human
ucucacccaggcaaucuugccu

SEQ ID NO: 72373 - RNA, 27 nt, Human
gccccugggcuggugcuggcaguggga

SEQ ID NO: 72374 - RNA, 22 nt, Human
agccccuuccuugcucugcacc

SEQ ID NO: 72375 - RNA, 17 nt, Human
caggcucucuuacuuga

SEQ ID NO: 72376 - RNA, 21 nt, Human
cugcaaaccacaccuucucuu

SEQ ID NO: 72377 - RNA, 26 nt, Human
cugcaugauuuauuaguuucucucca

SEQ ID NO: 72378 - RNA, 23 nt, Human
ggagaggggugugauggggcaga

SEQ ID NO: 72379 - RNA, 21 nt, Human
caaucuuucacugcaugugaa

SEQ ID NO: 72380 - RNA, 20 nt, Human
uucaugagagaugaaugaca

SEQ ID NO: 72381 - RNA, 23 nt, Human
ugggaccccgcacaacaucccuc

SEQ ID NO: 72382 - RNA, 20 nt, Human
gcauuuccuauccaguguga

SEQ ID NO: 72383 - RNA, 19 nt, Human
gaaugauuuagacaacuuc

SEQ ID NO: 72384 - RNA, 25 nt, Human
gacaguucauucagggccgaugggg

SEQ ID NO: 72385 - RNA, 27 nt, Human
caguccgugagucuuccagcugccacc

SEQ ID NO: 72386 - RNA, 19 nt, Human
gaggaagagaagcccagcu

SEQ ID NO: 72387 - RNA, 23 nt, Human
ccagguguugccauuucucugcu

SEQ ID NO: 72388 - RNA, 23 nt, Human
acacaugugcacgcaugugcaca

SEQ ID NO: 72389 - RNA, 23 nt, Human
aaguguuuguaaucccagcacuu

SEQ ID NO: 72390 - RNA, 22 nt, Human
uauuaaaaggacuauuucucua

SEQ ID NO: 72391 - RNA, 21 nt, Human
ggccuuaauauguuaaccuca

SEQ ID NO: 72392 - RNA, 26 nt, Human
accauucucccuucaccagccgaacc

SEQ ID NO: 72393 - RNA, 25 nt, Human
augguaacaugcacauccuguuuac

SEQ ID NO: 72394 - RNA, 22 nt, Human
ugccauugcauuccagccuagg

SEQ ID NO: 72395 - RNA, 20 nt, Human
ucuccugauccuccuagcuc

SEQ ID NO: 72396 - RNA, 23 nt, Human
cagaugucugccaacaagaaaug

SEQ ID NO: 72397 - RNA, 25 nt, Human
acuuucaauguaggggaauguaaua

SEQ ID NO: 72398 - RNA, 27 nt, Human
ucucccacauuuuccccucacccucca

SEQ ID NO: 72399 - RNA, 20 nt, Human
ggcugggcgugugaugcgau

SEQ ID NO: 72400 - RNA, 23 nt, Human
aaggagcagugcugcagcucuga

SEQ ID NO: 72401 - RNA, 25 nt, Human
ggggccaccaugcuccugcccaggc

SEQ ID NO: 72402 - RNA, 21 nt, Human
ugagaacucuccuuauugcug

SEQ ID NO: 72403 - RNA, 26 nt, Human
acuggcuucagccuccccaccuucuu

SEQ ID NO: 72404 - RNA, 22 nt, Human
guuauagugguaacugcaguuc

SEQ ID NO: 72405 - RNA, 21 nt, Human
ggccucccgggagccgggcgu

SEQ ID NO: 72406 - RNA, 27 nt, Human
caggacccuaugauauuucucuucuuu

SEQ ID NO: 72407 - RNA, 22 nt, Human
ccucugcuggaaggggcagcag

SEQ ID NO: 72408 - RNA, 22 nt, Human
ccugcuaacgcauuagcauuag

SEQ ID NO: 72409 - RNA, 27 nt, Human
cugugugacccugggcaagucacuuaa

SEQ ID NO: 72410 - RNA, 27 nt, Human
ccugcagcuuuguuacauagguaggcu

SEQ ID NO: 72411 - RNA, 21 nt, Human
ccugccugguaugaccucucc

SEQ ID NO: 72412 - RNA, 25 nt, Human
aucuucaugcagagauauucagggu

SEQ ID NO: 72413 - RNA, 26 nt, Human
aauaucuucgcugagguuuccuccuc

SEQ ID NO: 72414 - RNA, 27 nt, Human
caggaggccaagggcagcuccaggaca

SEQ ID NO: 72415 - RNA, 20 nt, Human
uuccuaggaucuccccacca

SEQ ID NO: 72416 - RNA, 25 nt, Human
uacuccaggcuguuuggggugggag

SEQ ID NO: 72417 - RNA, 26 nt, Human
agcaagucacugagaaugagcacuuu

SEQ ID NO: 72418 - RNA, 23 nt, Human
uuggaaaagagaaaaacaaugga

SEQ ID NO: 72419 - RNA, 22 nt, Human
ccaggccaggacucugcagccu

SEQ ID NO: 72420 - RNA, 23 nt, Human
accaauaaaaauaaacugcuuga

SEQ ID NO: 72421 - RNA, 21 nt, Human
cugggugcagaagcugugggg

SEQ ID NO: 72422 - RNA, 25 nt, Human
ucuuggauuugaggagaguuuauga

SEQ ID NO: 72423 - RNA, 20 nt, Human
ccccaacaauuggagggucu

SEQ ID NO: 72424 - RNA, 22 nt, Human
auacugcagcuuuacugccuuc

SEQ ID NO: 72425 - RNA, 21 nt, Human
cuacuacacuccagccuggug

SEQ ID NO: 72426 - RNA, 17 nt, Human
ugccuucaagauccaga

SEQ ID NO: 72427 - RNA, 22 nt, Human
augcagcugcacuugacugacc

SEQ ID NO: 72428 - RNA, 23 nt, Human
cuuuggugaaggacacgugucuu

SEQ ID NO: 72429 - RNA, 26 nt, Human
gaggcugaggcaggagaaucucuuga

SEQ ID NO: 72430 - RNA, 24 nt, Human
ucccuauaggaacagcccagcaca

SEQ ID NO: 72431 - RNA, 24 nt, Human
agcuaggagaagggcugaacccuc

SEQ ID NO: 72432 - RNA, 22 nt, Human
agggagauggagucaguggggc

SEQ ID NO: 72433 - RNA, 27 nt, Human
agggcauguaucucauucagaugugcc

SEQ ID NO: 72434 - RNA, 21 nt, Human
gugccucaucccgugccgcuc

SEQ ID NO: 72435 - RNA, 20 nt, Human
ggacgggagaaccugcccau

SEQ ID NO: 72436 - RNA, 22 nt, Human
gggggagggggacggugaaggc

SEQ ID NO: 72437 - RNA, 27 nt, Human
ggcuccccagagaggcgugggucuggg

SEQ ID NO: 72438 - RNA, 20 nt, Human
cuugcagaggcaugugugcu

SEQ ID NO: 72439 - RNA, 22 nt, Human
ucugaggcccagauaaugguga

SEQ ID NO: 72440 - RNA, 18 nt, Human
ccuccuucuuccuagcca

SEQ ID NO: 72441 - RNA, 23 nt, Human
auagagguugauaggacugcuug

SEQ ID NO: 72442 - RNA, 21 nt, Human
cggacugacuggacuccaucu

SEQ ID NO: 72443 - RNA, 22 nt, Human
cugcaugucuguuuacacuucu

SEQ ID NO: 72444 - RNA, 25 nt, Human
ucuuggcguccacaucuguuccuca

SEQ ID NO: 72445 - RNA, 28 nt, Human
gagucccucccuccuacuucccucacuc

SEQ ID NO: 72446 - RNA, 25 nt, Human
uacaggauguugucccaucaaggga

SEQ ID NO: 72447 - RNA, 21 nt, Human
uccccagccagagguggagcc

SEQ ID NO: 72448 - RNA, 26 nt, Human
agagugccucaguuaggggaacuucu

SEQ ID NO: 72449 - RNA, 26 nt, Human
ucucucucuucuccuggcgcucgcgu

SEQ ID NO: 72450 - RNA, 17 nt, Human
caacccaggcaguacca

SEQ ID NO: 72451 - RNA, 22 nt, Human
uaccuggaaauggccuccaguc

SEQ ID NO: 72452 - RNA, 24 nt, Human
acaggggugaacuguucacugugg

SEQ ID NO: 72453 - RNA, 21 nt, Human
uacauguaaagauuauguuag

SEQ ID NO: 72454 - RNA, 20 nt, Human
ucagggcagaggccacagga

SEQ ID NO: 72455 - RNA, 21 nt, Human
aaaaugcuuggguacacuucu

SEQ ID NO: 72456 - RNA, 25 nt, Human
uauuaucuucuuauuuauccucuau

SEQ ID NO: 72457 - RNA, 23 nt, Human
caagucaacuuucuguccagugg

SEQ ID NO: 72458 - RNA, 22 nt, Human
cuauggacuuucuucccccuca

SEQ ID NO: 72459 - RNA, 25 nt, Human
cuguuucagaggaagcaggccgaga

SEQ ID NO: 72460 - RNA, 23 nt, Human
cgcggcacuuuuuuaauuuuuuc

SEQ ID NO: 72461 - RNA, 19 nt, Human
cuguccacauacagccaaa

SEQ ID NO: 72462 - RNA, 27 nt, Human
uccuuauuccucccccgaccuaauugu

SEQ ID NO: 72463 - RNA, 22 nt, Human
ucucuaacaccuugugaccuuc

SEQ ID NO: 72464 - RNA, 24 nt, Human
ucccugagacccagcuggcuuuua

SEQ ID NO: 72465 - RNA, 20 nt, Human
aggaagugacaguucuacuu

SEQ ID NO: 72466 - RNA, 22 nt, Human
agccagacugccuuccggguca

SEQ ID NO: 72467 - RNA, 24 nt, Human
ucucagucaaccuccagauuuuua

SEQ ID NO: 72468 - RNA, 22 nt, Human
ggccgcaauccagccugggcgg

SEQ ID NO: 72469 - RNA, 20 nt, Human
uauuucuuaacugugcuggg

SEQ ID NO: 72470 - RNA, 23 nt, Human
uuggcacuguuugccauucucug

SEQ ID NO: 72471 - RNA, 17 nt, Human
uccauggaaaugccucu

SEQ ID NO: 72472 - RNA, 22 nt, Human
cagaaccuugcuuaacaugaga

SEQ ID NO: 72473 - RNA, 21 nt, Human
cgcagccucugccgcagcgcc

SEQ ID NO: 72474 - RNA, 27 nt, Human
cccaacaacuuagcggaaacuucucag

SEQ ID NO: 72475 - RNA, 25 nt, Human
agccaaauaaaccucuuuucuuucu

SEQ ID NO: 72476 - RNA, 22 nt, Human
cuguagucccagcuacuugaga

SEQ ID NO: 72477 - RNA, 19 nt, Human
gcagaaagagguugcugca

SEQ ID NO: 72478 - RNA, 27 nt, Human
uuugccucaagcaaccuacccugaugu

SEQ ID NO: 72479 - RNA, 21 nt, Human
ggagagggaggagugagcucc

SEQ ID NO: 72480 - RNA, 24 nt, Human
uucucacugccacugcucuugccu

SEQ ID NO: 72481 - RNA, 25 nt, Human
agcaguuuaaaccccacuuuccucc

SEQ ID NO: 72482 - RNA, 25 nt, Human
gcacggcugcugcagucucuuccca

SEQ ID NO: 72483 - RNA, 22 nt, Human
cccaagucacacagugguauca

SEQ ID NO: 72484 - RNA, 26 nt, Human
gcaguguagggaguuguggguagugg

SEQ ID NO: 72485 - RNA, 27 nt, Human
gcacagccagacuugcucagguggccc

SEQ ID NO: 72486 - RNA, 21 nt, Human
cuuucuaggcugagucuagug

SEQ ID NO: 72487 - RNA, 20 nt, Human
ucaugccaccacgccagcua

SEQ ID NO: 72488 - RNA, 21 nt, Human
ucuucuuugggauuacacuca

SEQ ID NO: 72489 - RNA, 26 nt, Human
ccugcugcagccuguccccgccgcuc

SEQ ID NO: 72490 - RNA, 24 nt, Human
ggaggccggggacggaaggcgggc

SEQ ID NO: 72491 - RNA, 24 nt, Human
ccgcgccacggagcccacagcccg

SEQ ID NO: 72492 - RNA, 25 nt, Human
ccccauuucuccuccucuuagguca

SEQ ID NO: 72493 - RNA, 22 nt, Human
uucauccugaacauuuuuaaaa

SEQ ID NO: 72494 - RNA, 22 nt, Human
ccuguccugccucucugcucca

SEQ ID NO: 72495 - RNA, 24 nt, Human
uagcagccaauugggaagagugac

SEQ ID NO: 72496 - RNA, 21 nt, Human
uggucaccuuccucugccuuu

SEQ ID NO: 72497 - RNA, 23 nt, Human
acucacugauucucuacaugcuc

SEQ ID NO: 72498 - RNA, 26 nt, Human
ucucuucccagcacuucccugccucc

SEQ ID NO: 72499 - RNA, 25 nt, Human
aacuuuguuguugaacaauuaguga

SEQ ID NO: 72500 - RNA, 27 nt, Human
gaaaugagaaacuuugaucucugcuua

SEQ ID NO: 72501 - RNA, 22 nt, Human
ucuuacagcacaucaccucuuu

SEQ ID NO: 72502 - RNA, 28 nt, Human
gcaggguucuccccucuggagucugacc

SEQ ID NO: 72503 - RNA, 22 nt, Human
agccauccaaauagcugggacc

SEQ ID NO: 72504 - RNA, 20 nt, Human
uuuucugcuuuuucccuucc

SEQ ID NO: 72505 - RNA, 30 nt, Human
guuuuccaacuauguugaauaaauaguaau

SEQ ID NO: 72506 - RNA, 20 nt, Human
guccccagacauugcaccug

SEQ ID NO: 72507 - RNA, 23 nt, Human
ggggagagagcgucccaucuguc

SEQ ID NO: 72508 - RNA, 24 nt, Human
cuggccuuugaggcaaaggccagc

SEQ ID NO: 72509 - RNA, 22 nt, Human
ccuucccagccugccugcaugc

SEQ ID NO: 72510 - RNA, 20 nt, Human
uuauguaucauuaagaaaaa

SEQ ID NO: 72511 - RNA, 25 nt, Human
uguuuuucuguguaugggccugguc

SEQ ID NO: 72512 - RNA, 25 nt, Human
ggagccacagagcuggugcugccgc

SEQ ID NO: 72513 - RNA, 22 nt, Human
uguccuguaauacuucaccucc

SEQ ID NO: 72514 - RNA, 26 nt, Human
uccuguguguuuugcaagaaugugug

SEQ ID NO: 72515 - RNA, 27 nt, Human
ucuucauuuauuuugacugugauuuau

SEQ ID NO: 72516 - RNA, 22 nt, Human
uccuggaggguccagucauuca

SEQ ID NO: 72517 - RNA, 22 nt, Human
cccucccgcgagccuccucccc

SEQ ID NO: 72518 - RNA, 25 nt, Human
cuuuuauuccuccuuuugguaaaca

SEQ ID NO: 72519 - RNA, 22 nt, Human
acgauauacuuugauuuuguag

SEQ ID NO: 72520 - RNA, 22 nt, Human
caucacugcacuccagccuggg

SEQ ID NO: 72521 - RNA, 22 nt, Human
caucauugcacucuagccuggg

SEQ ID NO: 72522 - RNA, 27 nt, Human
acugcaaccuccuccuccuggauucaa

SEQ ID NO: 72523 - RNA, 21 nt, Human
ucccgggaaagagaacugucc

SEQ ID NO: 72524 - RNA, 23 nt, Human
ggcgucugugcuuguggaggugu

SEQ ID NO: 72525 - RNA, 21 nt, Human
cugacucugucacucaagccu

SEQ ID NO: 72526 - RNA, 22 nt, Human
acccaaguuggagugcaguggc

SEQ ID NO: 72527 - RNA, 25 nt, Human
ucuguccucugcucuucugcaguca

SEQ ID NO: 72528 - RNA, 25 nt, Human
aagaaaggaaaagauuucauaagca

SEQ ID NO: 72529 - RNA, 21 nt, Human
cuggccucugcugauccuccc

SEQ ID NO: 72530 - RNA, 26 nt, Human
aagaguacacucagccacugucacag

SEQ ID NO: 72531 - RNA, 22 nt, Human
guggagcuaaucaguccugccu

SEQ ID NO: 72532 - RNA, 24 nt, Human
aagaguaagaccuguuguuuugga

SEQ ID NO: 72533 - RNA, 22 nt, Human
uugagccuuaaaacggugcugc

SEQ ID NO: 72534 - RNA, 24 nt, Human
caggcuguucuugaacuccuggcc

SEQ ID NO: 72535 - RNA, 26 nt, Human
accagaugugugcagugcaacagaug

SEQ ID NO: 72536 - RNA, 27 nt, Human
guuacccagacagugagaagccccugg

SEQ ID NO: 72537 - RNA, 27 nt, Human
cuccugagcgcccguucuuggucuaau

SEQ ID NO: 72538 - RNA, 24 nt, Human
caggggcgcaggaauucugaugug

SEQ ID NO: 72539 - RNA, 23 nt, Human
ccggccaguuaauucauucucag

SEQ ID NO: 72540 - RNA, 22 nt, Human
gccagggaagcagugcaauggc

SEQ ID NO: 72541 - RNA, 19 nt, Human
aucccagacccauuccuua

SEQ ID NO: 72542 - RNA, 24 nt, Human
uaacugacuuucuagaugccuuaa

SEQ ID NO: 72543 - RNA, 22 nt, Human
gacaaggucggcagagguggac

SEQ ID NO: 72544 - RNA, 18 nt, Human
agaaccuguuacagcuca

SEQ ID NO: 72545 - RNA, 23 nt, Human
acagcucaggaacuagacugccu

SEQ ID NO: 72546 - RNA, 23 nt, Human
ugaaccccaggcuggagugcagu

SEQ ID NO: 72547 - RNA, 19 nt, Human
ucugcacucuaaacugcaa

SEQ ID NO: 72548 - RNA, 22 nt, Human
ucaccuaggcaagagugcaaug

SEQ ID NO: 72549 - RNA, 24 nt, Human
ccuaucucccauccuguggaaccc

SEQ ID NO: 72550 - RNA, 20 nt, Human
cccugccuccagaauguucu

SEQ ID NO: 72551 - RNA, 20 nt, Human
cauuucucuucaccauguau

SEQ ID NO: 72552 - RNA, 23 nt, Human
ucuguucucccucuacauuucuc

SEQ ID NO: 72553 - RNA, 26 nt, Human
aaacaguguuugaaaugaagacuguc

SEQ ID NO: 72554 - RNA, 22 nt, Human
cccacccccaagcagggcuccu

SEQ ID NO: 72555 - RNA, 21 nt, Human
ccugacucgcugcucuuuuug

SEQ ID NO: 72556 - RNA, 19 nt, Human
cgcugccccagccuagggg

SEQ ID NO: 72557 - RNA, 25 nt, Human
aguaagacuuucaggcacuucuucc

SEQ ID NO: 72558 - RNA, 22 nt, Human
gccuguaaucccagcauuuuga

SEQ ID NO: 72559 - RNA, 22 nt, Human
gccuguaaucccaacauuuugg

SEQ ID NO: 72560 - RNA, 23 nt, Human
agcugcaggaacaggaaaaagag

SEQ ID NO: 72561 - RNA, 20 nt, Human
ccggcugcgaggacgcccag

SEQ ID NO: 72562 - RNA, 21 nt, Human
cucgccgcgccggugccaccu

SEQ ID NO: 72563 - RNA, 22 nt, Human
ccaacauggagauauccugucu

SEQ ID NO: 72564 - RNA, 24 nt, Human
agaaguaccuuuguuacagcuacu

SEQ ID NO: 72565 - RNA, 20 nt, Human
cauggacucaccacugugug

SEQ ID NO: 72566 - RNA, 20 nt, Human
uucauuuccauuucacacac

SEQ ID NO: 72567 - RNA, 23 nt, Human
aagaucauagcucauugcaagcu

SEQ ID NO: 72568 - RNA, 23 nt, Human
ugacguaacuguaucagagggug

SEQ ID NO: 72569 - RNA, 22 nt, Human
uccacccgggggagcccaguga

SEQ ID NO: 72570 - RNA, 22 nt, Human
agaccagccugaccaacauggg

SEQ ID NO: 72571 - RNA, 26 nt, Human
ugucuucaagcugaaugaagcccagc

SEQ ID NO: 72572 - RNA, 20 nt, Human
acuucaacauuuacauguau

SEQ ID NO: 72573 - RNA, 27 nt, Human
ucugcucccuuuccaguucuggcaucu

SEQ ID NO: 72574 - RNA, 25 nt, Human
ccaugccuggcccuauguguguuuu

SEQ ID NO: 72575 - RNA, 27 nt, Human
ggcucacugcguguuaccuaagacgua

SEQ ID NO: 72576 - RNA, 22 nt, Human
aggcugaggcaggagagucacu

SEQ ID NO: 72577 - RNA, 22 nt, Human
aggcugagacaggagaaucacu

SEQ ID NO: 72578 - RNA, 23 nt, Human
cuuugcaggcuuuugcuagcccu

SEQ ID NO: 72579 - RNA, 18 nt, Human
aucaugggggauuuuuca

SEQ ID NO: 72580 - RNA, 21 nt, Human
acauuucucauaccuucccca

SEQ ID NO: 72581 - RNA, 25 nt, Human
uggcaccccccuagacuuugcuucc

SEQ ID NO: 72582 - RNA, 22 nt, Human
ccuuaaagcacauuuuucugac

SEQ ID NO: 72583 - RNA, 20 nt, Human
cuuuaccuugcuccaccucu

SEQ ID NO: 72584 - RNA, 26 nt, Human
ggcucuugggcuggaguaccguggug

SEQ ID NO: 72585 - RNA, 23 nt, Human
cccagcaccugugucaguaaaga

SEQ ID NO: 72586 - RNA, 22 nt, Human
cguuugaacccgggaagcggag

SEQ ID NO: 72587 - RNA, 20 nt, Human
uucuaccacguguaggauaa

SEQ ID NO: 72588 - RNA, 21 nt, Human
caucucagugagcaccagcug

SEQ ID NO: 72589 - RNA, 27 nt, Human
auuaccuaggcuugccugaacuuuggg

SEQ ID NO: 72590 - RNA, 22 nt, Human
gccuguaaucccaacacuuagg

SEQ ID NO: 72591 - RNA, 22 nt, Human
caggucugaaaaaguagagaga

SEQ ID NO: 72592 - RNA, 27 nt, Human
uucauucuucuucauaugaauaucccc

SEQ ID NO: 72593 - RNA, 22 nt, Human
ugaagaaugcauggaggacugc

SEQ ID NO: 72594 - RNA, 23 nt, Human
ccccuucccccaccccacaacag

SEQ ID NO: 72595 - RNA, 22 nt, Human
cugggaggcggagauugcagug

SEQ ID NO: 72596 - RNA, 22 nt, Human
cuggggggcggagguugcagug

SEQ ID NO: 72597 - RNA, 26 nt, Human
uuucuuucuuucucuuaccugaaaug

SEQ ID NO: 72598 - RNA, 18 nt, Human
ucauuaacaccuucccca

SEQ ID NO: 72599 - RNA, 18 nt, Human
uucauucuucccauggca

SEQ ID NO: 72600 - RNA, 21 nt, Human
cuuuugcagauaucagcuggu

SEQ ID NO: 72601 - RNA, 21 nt, Human
ucuuuugcaagaguuuuucac

SEQ ID NO: 72602 - RNA, 25 nt, Human
ugggaggagggcaagaguacaccaa

SEQ ID NO: 72603 - RNA, 27 nt, Human
gggagagagcgccuaggagcugccugc

SEQ ID NO: 72604 - RNA, 21 nt, Human
cacugagguucauucacugga

SEQ ID NO: 72605 - RNA, 22 nt, Human
cagguuugccuacguuggugca

SEQ ID NO: 72606 - RNA, 21 nt, Human
uggucucccugguuccugcca

SEQ ID NO: 72607 - RNA, 21 nt, Human
ucuaucauuccuuaugacaug

SEQ ID NO: 72608 - RNA, 27 nt, Human
gagucccggaaggaggagagcgcacac

SEQ ID NO: 72609 - RNA, 20 nt, Human
cuguggacgaacaucugggg

SEQ ID NO: 72610 - RNA, 25 nt, Human
ucagaaucguggagagaauacucag

SEQ ID NO: 72611 - RNA, 21 nt, Human
acgggcagggucucugucgcc

SEQ ID NO: 72612 - RNA, 21 nt, Human
agccucccgaguuccaggagc

SEQ ID NO: 72613 - RNA, 27 nt, Human
caaaacaauguguguugugagccagga

SEQ ID NO: 72614 - RNA, 21 nt, Human
gcaguauuucauauuuauaaa

SEQ ID NO: 72615 - RNA, 22 nt, Human
ugcacuaaccccagcugccggc

SEQ ID NO: 72616 - RNA, 22 nt, Human
ccucucauagaaauugccucca

SEQ ID NO: 72617 - RNA, 26 nt, Human
uugggagcuuccaaagccgggugauc

SEQ ID NO: 72618 - RNA, 23 nt, Human
ugaccuaagaucucagcaauuug

SEQ ID NO: 72619 - RNA, 22 nt, Human
ccagaaaguuguuaggccugcc

SEQ ID NO: 72620 - RNA, 23 nt, Human
ucacagaaagucauuaucuagaa

SEQ ID NO: 72621 - RNA, 24 nt, Human
agggaaaggcucgggcaaaaggcg

SEQ ID NO: 72622 - RNA, 22 nt, Human
acuguaaucccagcuacucagg

SEQ ID NO: 72623 - RNA, 19 nt, Human
cuucaggcucucugggcag

SEQ ID NO: 72624 - RNA, 24 nt, Human
uuggauggcuucaaaggaauauac

SEQ ID NO: 72625 - RNA, 22 nt, Human
ggcugccgccagucucaugccc

SEQ ID NO: 72626 - RNA, 23 nt, Human
cuccccacucuucacagcaaacc

SEQ ID NO: 72627 - RNA, 23 nt, Human
aacuccacucuguccuccuuacu

SEQ ID NO: 72628 - RNA, 18 nt, Human
ccaugagaauugcaguga

SEQ ID NO: 72629 - RNA, 25 nt, Human
aggagguggguccugggaagcggga

SEQ ID NO: 72630 - RNA, 22 nt, Human
ugguuuccuuuucuccucucuc

SEQ ID NO: 72631 - RNA, 20 nt, Human
acacaggauggugacuggaa

SEQ ID NO: 72632 - RNA, 30 nt, Human
ucuguuugaaccccugucaugaucacagug

SEQ ID NO: 72633 - RNA, 22 nt, Human
cacucacugaagcuucgauuuc

SEQ ID NO: 72634 - RNA, 22 nt, Human
ggagcgcccgccgucugcuccg

SEQ ID NO: 72635 - RNA, 27 nt, Human
ugcaaccuccgccuccugcguucgggu

SEQ ID NO: 72636 - RNA, 19 nt, Human
uguuauaguagagcuguuc

SEQ ID NO: 72637 - RNA, 21 nt, Human
ucccugaaggacccaggauuu

SEQ ID NO: 72638 - RNA, 22 nt, Human
ugugugucuuggagugcauuug

SEQ ID NO: 72639 - RNA, 23 nt, Human
ugggggagggggacuggagaggc

SEQ ID NO: 72640 - RNA, 27 nt, Human
ggcuggcuggcuccgaguguggggcgc

SEQ ID NO: 72641 - RNA, 21 nt, Human
cacugcgguuggucauacuga

SEQ ID NO: 72642 - RNA, 22 nt, Human
ccaaucagccaacuaaguuguc

SEQ ID NO: 72643 - RNA, 25 nt, Human
agccuguagacaucuuuuacuccaa

SEQ ID NO: 72644 - RNA, 22 nt, Human
gcuuuugauuugcaucuucuca

SEQ ID NO: 72645 - RNA, 21 nt, Human
ugagggucgggccggagccag

SEQ ID NO: 72646 - RNA, 26 nt, Human
ucucuucucagacucuuccucuguca

SEQ ID NO: 72647 - RNA, 22 nt, Human
accucccagaggugcagcugcc

SEQ ID NO: 72648 - RNA, 21 nt, Human
uugcucauuucacacucuuca

SEQ ID NO: 72649 - RNA, 26 nt, Human
gcugcuuccuccccuccuggcaccca

SEQ ID NO: 72650 - RNA, 24 nt, Human
uuucaaaaucaacugacuagugca

SEQ ID NO: 72651 - RNA, 23 nt, Human
guggugucugugcagcugguguc

SEQ ID NO: 72652 - RNA, 23 nt, Human
ucuguugacuccuuucuuuuggg

SEQ ID NO: 72653 - RNA, 28 nt, Human
gucuccgggccgccugaccuccgcacgg

SEQ ID NO: 72654 - RNA, 20 nt, Human
gaucugccuuccugcugaaa

SEQ ID NO: 72655 - RNA, 20 nt, Human
aucaccugcuuucugugcca

SEQ ID NO: 72656 - RNA, 20 nt, Human
ggcuccgagccagcuggauu

SEQ ID NO: 72657 - RNA, 18 nt, Human
gugccucugccugucucc

SEQ ID NO: 72658 - RNA, 21 nt, Human
acacccagauauuuucuucaa

SEQ ID NO: 72659 - RNA, 29 nt, Human
ugaaggccaugauauuuuguuuuucccca

SEQ ID NO: 72660 - RNA, 22 nt, Human
ccaggaggcugaggcugcaaug

SEQ ID NO: 72661 - RNA, 22 nt, Human
cgcucacugccaccuccgccuc

SEQ ID NO: 72662 - RNA, 26 nt, Human
ggcucacugcccaugauucagagcuu

SEQ ID NO: 72663 - RNA, 26 nt, Human
guuuuuaaaauaaugcuacaaucuuc

SEQ ID NO: 72664 - RNA, 23 nt, Human
uccuugaccuuccucuggggcuc

SEQ ID NO: 72665 - RNA, 22 nt, Human
agcaucagacgggcuuccagga

SEQ ID NO: 72666 - RNA, 22 nt, Human
cugccucuucuaccccuauguc

SEQ ID NO: 72667 - RNA, 23 nt, Human
cugggucucagagcuucaggccu

SEQ ID NO: 72668 - RNA, 22 nt, Human
ugaucagagagacacauucccu

SEQ ID NO: 72669 - RNA, 27 nt, Human
gucucgaacuccugaccucaagcaguc

SEQ ID NO: 72670 - RNA, 28 nt, Human
cacaaagggcucugaagcucaagucaga

SEQ ID NO: 72671 - RNA, 25 nt, Human
gagcgcaaagugcuagccacuggaa

SEQ ID NO: 72672 - RNA, 25 nt, Human
gcuccaaccuccuuuuugucuuuug

SEQ ID NO: 72673 - RNA, 20 nt, Human
aggcuggaguuggggcagag

SEQ ID NO: 72674 - RNA, 23 nt, Human
caccugcaaucucauauccuggu

SEQ ID NO: 72675 - RNA, 22 nt, Human
cucaagugauccuccugccuca

SEQ ID NO: 72676 - RNA, 22 nt, Human
ugcucagggccaccugagacug

SEQ ID NO: 72677 - RNA, 24 nt, Human
ucugccucacucucuugcuaucgg

SEQ ID NO: 72678 - RNA, 21 nt, Human
caccgcaucgcgcagcucuuu

SEQ ID NO: 72679 - RNA, 24 nt, Human
ucuggauuccugguucccugaagg

SEQ ID NO: 72680 - RNA, 19 nt, Human
ccuuucucguuccccggcc

SEQ ID NO: 72681 - RNA, 21 nt, Human
auggguaccuacagaagccuc

SEQ ID NO: 72682 - RNA, 25 nt, Human
cucagccuguugguuucuccucauu

SEQ ID NO: 72683 - RNA, 21 nt, Human
ggggcagccugccuugcccac

SEQ ID NO: 72684 - RNA, 26 nt, Human
cccugcacuugcagacucuacagagg

SEQ ID NO: 72685 - RNA, 22 nt, Human
gguucacugcaaccuccgccuc

SEQ ID NO: 72686 - RNA, 27 nt, Human
gccucaaauucugcguuuuugguuuua

SEQ ID NO: 72687 - RNA, 21 nt, Human
ggggaagagagaggccugggu

SEQ ID NO: 72688 - RNA, 17 nt, Human
ucaugcugucuguguga

SEQ ID NO: 72689 - RNA, 25 nt, Human
cccuccucucuccccagaugugacu

SEQ ID NO: 72690 - RNA, 26 nt, Human
gcauggggaccacacccuggagcccg

SEQ ID NO: 72691 - RNA, 22 nt, Human
cuuugcaucuucugauagucua

SEQ ID NO: 72692 - RNA, 22 nt, Human
uagaacuuugccagucuuuaag

SEQ ID NO: 72693 - RNA, 27 nt, Human
acugccucugccugucgcaugagaaca

SEQ ID NO: 72694 - RNA, 23 nt, Human
aguacaggccucuagccccacca

SEQ ID NO: 72695 - RNA, 23 nt, Human
ggaaagugccugguaggacugac

SEQ ID NO: 72696 - RNA, 23 nt, Human
auggcccagucccuggcuccacu

SEQ ID NO: 72697 - RNA, 25 nt, Human
ugccucugauaagcacuuuuuaaau

SEQ ID NO: 72698 - RNA, 22 nt, Human
ccuccugcuggcuaccggggca

SEQ ID NO: 72699 - RNA, 23 nt, Human
gcuacugagucaugauccuugcu

SEQ ID NO: 72700 - RNA, 22 nt, Human
caggcacuuugagucucagucu

SEQ ID NO: 72701 - RNA, 23 nt, Human
ugccuguaaucccaguuacuugg

SEQ ID NO: 72702 - RNA, 25 nt, Human
aggaaacugcaucacgauugaaaga

SEQ ID NO: 72703 - RNA, 28 nt, Human
uuuccuaauuuugagaaagucuuauuua

SEQ ID NO: 72704 - RNA, 22 nt, Human
gcgcucccaccacccacaccca

SEQ ID NO: 72705 - RNA, 24 nt, Human
ggagguggcggcggccgaaucggc

SEQ ID NO: 72706 - RNA, 27 nt, Human
ucugcuagcugucacccugccuugugc

SEQ ID NO: 72707 - RNA, 20 nt, Human
uuucucucacugucuauuua

SEQ ID NO: 72708 - RNA, 21 nt, Human
gugugaagggaaaugccaagg

SEQ ID NO: 72709 - RNA, 22 nt, Human
acugauccccaccuccucaggg

SEQ ID NO: 72710 - RNA, 22 nt, Human
gguuuucaagcuuuuacucuua

SEQ ID NO: 72711 - RNA, 23 nt, Human
ucaccaacauuucaaguuuguau

SEQ ID NO: 72712 - RNA, 23 nt, Human
guucuauuuuguaaaucauucca

SEQ ID NO: 72713 - RNA, 20 nt, Human
gggcuggaguggguagagua

SEQ ID NO: 72714 - RNA, 19 nt, Human
ugacuucugcuuuccacgg

SEQ ID NO: 72715 - RNA, 21 nt, Human
agacagugcugagauuggaaa

SEQ ID NO: 72716 - RNA, 20 nt, Human
gaaagagaauguuccuggua

SEQ ID NO: 72717 - RNA, 25 nt, Human
agacaggaacuguggaacugugaug

SEQ ID NO: 72718 - RNA, 23 nt, Human
uguauugaagagggauucacauc

SEQ ID NO: 72719 - RNA, 20 nt, Human
aaccucuucacgguuucacu

SEQ ID NO: 72720 - RNA, 21 nt, Human
uuacaagaauaauuagcaaua

SEQ ID NO: 72721 - RNA, 26 nt, Human
cccagccucagccugggacaccuagg

SEQ ID NO: 72722 - RNA, 20 nt, Human
uugguuauuuuucagaaaga

SEQ ID NO: 72723 - RNA, 23 nt, Human
ucuguaacucugugggcuggguc

SEQ ID NO: 72724 - RNA, 21 nt, Human
uuucagucuguugcugaggcc

SEQ ID NO: 72725 - RNA, 21 nt, Human
ccuccacuuguuauauaaccu

SEQ ID NO: 72726 - RNA, 22 nt, Human
ugccuaggagguugaggcugca

SEQ ID NO: 72727 - RNA, 22 nt, Human
gagacagacugugagccuagca

SEQ ID NO: 72728 - RNA, 23 nt, Human
cuuggucuuuucuugccuuuuau

SEQ ID NO: 72729 - RNA, 19 nt, Human
ggcagucuccccucuccag

SEQ ID NO: 72730 - RNA, 23 nt, Human
aagaauuaccuaguuuugcuuaa

SEQ ID NO: 72731 - RNA, 27 nt, Human
gggccaggggucucccuggagugcagu

SEQ ID NO: 72732 - RNA, 25 nt, Human
ccuccccaccagucucacccacuag

SEQ ID NO: 72733 - RNA, 25 nt, Human
ucuucccuguauuuucuuucucuac

SEQ ID NO: 72734 - RNA, 21 nt, Human
cugcuugaccguacucucaca

SEQ ID NO: 72735 - RNA, 22 nt, Human
uuuucuuucuguuuucuuuuac

SEQ ID NO: 72736 - RNA, 27 nt, Human
uuucccuucaucugucacaggaaacag

SEQ ID NO: 72737 - RNA, 24 nt, Human
aaguggcuuuccccacaucggcuc

SEQ ID NO: 72738 - RNA, 30 nt, Human
caaucuugaaaauauguugugcaccaagac

SEQ ID NO: 72739 - RNA, 23 nt, Human
ugcacacccacacccacgcgcgc

SEQ ID NO: 72740 - RNA, 25 nt, Human
gggcagugguggagcuggaccugcc

SEQ ID NO: 72741 - RNA, 21 nt, Human
ccacugcacuccagucugguc

SEQ ID NO: 72742 - RNA, 22 nt, Human
gcucugaagacggacagcccug

SEQ ID NO: 72743 - RNA, 24 nt, Human
uguuuuauaauacuuccaagccug

SEQ ID NO: 72744 - RNA, 24 nt, Human
gccuguaauuuuucuuucaaggau

SEQ ID NO: 72745 - RNA, 20 nt, Human
cacccacgcuggagugcugu

SEQ ID NO: 72746 - RNA, 19 nt, Human
ggacccacuuucucucuca

SEQ ID NO: 72747 - RNA, 21 nt, Human
gcuguuugguggucugccuuc

SEQ ID NO: 72748 - RNA, 27 nt, Human
cuguccaggaagagcuguguggccugg

SEQ ID NO: 72749 - RNA, 21 nt, Human
aagaauacaaaguauacauac

SEQ ID NO: 72750 - RNA, 23 nt, Human
uuuagguuucaggggcaagagca

SEQ ID NO: 72751 - RNA, 20 nt, Human
cccucaccacacagucccuu

SEQ ID NO: 72752 - RNA, 23 nt, Human
cagaacaaagaacggcaugugaa

SEQ ID NO: 72753 - RNA, 23 nt, Human
cgaggggggcucaggaggaggaa

SEQ ID NO: 72754 - RNA, 27 nt, Human
ucaagacgcucuccaaagggcaggaag

SEQ ID NO: 72755 - RNA, 21 nt, Human
uuacccagggcucugcagcac

SEQ ID NO: 72756 - RNA, 20 nt, Human
gacuccaggaaaagccauuu

SEQ ID NO: 72757 - RNA, 24 nt, Human
ccccccuccucugaaacagcugcc

SEQ ID NO: 72758 - RNA, 21 nt, Human
ggcaggcaggggcccugcagc

SEQ ID NO: 72759 - RNA, 23 nt, Human
gggcugaguugcuggagcugggc

SEQ ID NO: 72760 - RNA, 22 nt, Human
caugccuguaaucccagcauuu

SEQ ID NO: 72761 - RNA, 22 nt, Human
caugccuguaaccccagcacuu

SEQ ID NO: 72762 - RNA, 22 nt, Human
gccuuccacccuccugucugcu

SEQ ID NO: 72763 - RNA, 22 nt, Human
aaaaaacaaaaugugccuguuu

SEQ ID NO: 72764 - RNA, 21 nt, Human
aagagagagcuuccuaggccu

SEQ ID NO: 72765 - RNA, 24 nt, Human
ucuguucucuaccugucaugcuuc

SEQ ID NO: 72766 - RNA, 22 nt, Human
ggaaauguuggcuucaccagaa

SEQ ID NO: 72767 - RNA, 27 nt, Human
agggaggaggagcagacggcagaggaa

SEQ ID NO: 72768 - RNA, 19 nt, Human
ccaagucagguggggugga

SEQ ID NO: 72769 - RNA, 25 nt, Human
caguccuaggcuggaugggagggug

SEQ ID NO: 72770 - RNA, 23 nt, Human
gccucccccugcacagcccugca

SEQ ID NO: 72771 - RNA, 27 nt, Human
gcaccuuggucccagugucuuccuuuu

SEQ ID NO: 72772 - RNA, 17 nt, Human
ccaccacugcuggcuuc

SEQ ID NO: 72773 - RNA, 26 nt, Human
agcaguuuugcucaugacuuaccauu

SEQ ID NO: 72774 - RNA, 24 nt, Human
gaagugcuguuguucaacagguac

SEQ ID NO: 72775 - RNA, 27 nt, Human
ccaucauuaccugugaacugcaguggg

SEQ ID NO: 72776 - RNA, 21 nt, Human
agaagcacgagacgcacuuuu

SEQ ID NO: 72777 - RNA, 21 nt, Human
uagggcaagaggaugaaggaa

SEQ ID NO: 72778 - RNA, 21 nt, Human
cauacagugagccagccuugc

SEQ ID NO: 72779 - RNA, 19 nt, Human
guuuuucugggccagccuu

SEQ ID NO: 72780 - RNA, 22 nt, Human
aaggcagggcccggcagaggaa

SEQ ID NO: 72781 - RNA, 22 nt, Human
uucaaugcuaguguuuaauccu

SEQ ID NO: 72782 - RNA, 25 nt, Human
uuucagugacagauguugggguguu

SEQ ID NO: 72783 - RNA, 22 nt, Human
agaggugugggaugucagaaca

SEQ ID NO: 72784 - RNA, 22 nt, Human
uggucucaaacugcuaacauca

SEQ ID NO: 72785 - RNA, 22 nt, Human
ccagcauggugaaaccucaucc

SEQ ID NO: 72786 - RNA, 24 nt, Human
ucuuucuagugaggagauacauau

SEQ ID NO: 72787 - RNA, 20 nt, Human
ucccuagcucucugcacuga

SEQ ID NO: 72788 - RNA, 20 nt, Human
ccacccccacccacagugcu

SEQ ID NO: 72789 - RNA, 23 nt, Human
uuagcacugaacuccucugugau

SEQ ID NO: 72790 - RNA, 21 nt, Human
cuggccucucccugcaugucu

SEQ ID NO: 72791 - RNA, 25 nt, Human
cagcucugugcugagccuccuggcc

SEQ ID NO: 72792 - RNA, 24 nt, Human
uuccuuccccaccagggaggacaa

SEQ ID NO: 72793 - RNA, 24 nt, Human
aaaugauugcuucagucuuugccu

SEQ ID NO: 72794 - RNA, 21 nt, Human
gcacagcccagcuggggcuag

SEQ ID NO: 72795 - RNA, 22 nt, Human
gaccagccugggcaacauagug

SEQ ID NO: 72796 - RNA, 27 nt, Human
gauaccaccaucauguucagaccauuu

SEQ ID NO: 72797 - RNA, 27 nt, Human
uguuuaauuguauuuaagcauugugca

SEQ ID NO: 72798 - RNA, 20 nt, Human
ugaggaggggauggaggggu

SEQ ID NO: 72799 - RNA, 25 nt, Human
uccucuuagccucuggaucuagaag

SEQ ID NO: 72800 - RNA, 21 nt, Human
cuugggggcaaggaauccaga

SEQ ID NO: 72801 - RNA, 22 nt, Human
agggccucuccccuugcaggcc

SEQ ID NO: 72802 - RNA, 27 nt, Human
caagcaguggauuccuggagguggcac

SEQ ID NO: 72803 - RNA, 26 nt, Human
aauuuaugcucacaccuuacugcaca

SEQ ID NO: 72804 - RNA, 22 nt, Human
uggcauguagcuacaaauauua

SEQ ID NO: 72805 - RNA, 23 nt, Human
ccauauuucaggagaauguuucc

SEQ ID NO: 72806 - RNA, 27 nt, Human
ggaggcuggaguagagggaagccugca

SEQ ID NO: 72807 - RNA, 26 nt, Human
gagaaacacaucuucccuagaggguu

SEQ ID NO: 72808 - RNA, 25 nt, Human
ugcuacuuaaucagaaucuugagaa

SEQ ID NO: 72809 - RNA, 25 nt, Human
gcuggggucgcugcguugcugugcc

SEQ ID NO: 72810 - RNA, 21 nt, Human
cugagccccggcacugccugg

SEQ ID NO: 72811 - RNA, 25 nt, Human
uguguauguguaucucacacucaug

SEQ ID NO: 72812 - RNA, 24 nt, Human
gcuuugccugccacuucugccucc

SEQ ID NO: 72813 - RNA, 20 nt, Human
ucuccgacucugcacccgcc

SEQ ID NO: 72814 - RNA, 21 nt, Human
cuuggcuaauuuuuuggauuu

SEQ ID NO: 72815 - RNA, 27 nt, Human
gucaguugaaaauuauggcuguacuau

SEQ ID NO: 72816 - RNA, 21 nt, Human
ugcuucuuugaaacuuguaug

SEQ ID NO: 72817 - RNA, 25 nt, Human
gguagcuucagcuagcuuuuaggaa

SEQ ID NO: 72818 - RNA, 21 nt, Human
acaguaaguugacaccacuua

SEQ ID NO: 72819 - RNA, 26 nt, Human
uuuuccuacaguaacaaaacaggaau

SEQ ID NO: 72820 - RNA, 21 nt, Human
cacuuucucccugucuggccc

SEQ ID NO: 72821 - RNA, 22 nt, Human
caucucuaccccacccaaauaa

SEQ ID NO: 72822 - RNA, 21 nt, Human
accaccaccaacuccuccucc

SEQ ID NO: 72823 - RNA, 22 nt, Human
cugagucuugcccaaacauucu

SEQ ID NO: 72824 - RNA, 23 nt, Human
uggaaccuccagucacugugcca

SEQ ID NO: 72825 - RNA, 22 nt, Human
uggucuugaacuccuaaccucg

SEQ ID NO: 72826 - RNA, 25 nt, Human
cuucucuucucucuggacuucggug

SEQ ID NO: 72827 - RNA, 21 nt, Human
aagguagauggcagaggcaga

SEQ ID NO: 72828 - RNA, 21 nt, Human
gaugcucugcuuuucugucaa

SEQ ID NO: 72829 - RNA, 27 nt, Human
accuguaguucuguuuauuggucagug

SEQ ID NO: 72830 - RNA, 23 nt, Human
gagucuaauguucguaagcauca

SEQ ID NO: 72831 - RNA, 24 nt, Human
cugucacccaggcugaagugcagu

SEQ ID NO: 72832 - RNA, 26 nt, Human
cucucggccccucugcuggcgucccc

SEQ ID NO: 72833 - RNA, 22 nt, Human
cauuccccucgcugcucccaaa

SEQ ID NO: 72834 - RNA, 25 nt, Human
gccucugccuucugaugcuggacug

SEQ ID NO: 72835 - RNA, 22 nt, Human
cuuugcagagccuuuuaccccu

SEQ ID NO: 72836 - RNA, 25 nt, Human
aaagagucuuaauuuucuaaaacaa

SEQ ID NO: 72837 - RNA, 24 nt, Human
ccuucccugccuccagcugucagc

SEQ ID NO: 72838 - RNA, 24 nt, Human
acugugguuugauggaaugaauca

SEQ ID NO: 72839 - RNA, 22 nt, Human
gggaugagagggagggagaauc

SEQ ID NO: 72840 - RNA, 14 nt, Human
gccauaaaacuuug

SEQ ID NO: 72841 - RNA, 23 nt, Human
ggagcuggguggaaacugcuuug

SEQ ID NO: 72842 - RNA, 21 nt, Human
cgaggcgggcugaucgcuuga

SEQ ID NO: 72843 - RNA, 25 nt, Human
ggucuugaggggguaauaaaccucc

SEQ ID NO: 72844 - RNA, 21 nt, Human
gccgccugaaaguacagcugg

SEQ ID NO: 72845 - RNA, 18 nt, Human
agccaucuccaucuugaa

SEQ ID NO: 72846 - RNA, 22 nt, Human
gccucacuuccccuccuccccc

SEQ ID NO: 72847 - RNA, 21 nt, Human
augccaccuggagcaucauaa

SEQ ID NO: 72848 - RNA, 19 nt, Human
agcaggagaagcaaacacc

SEQ ID NO: 72849 - RNA, 22 nt, Human
cuuccugguuuucaguccacag

SEQ ID NO: 72850 - RNA, 22 nt, Human
uggugaugguguagcccuccca

SEQ ID NO: 72851 - RNA, 22 nt, Human
ugucucccaggcuggagugcag

SEQ ID NO: 72852 - RNA, 27 nt, Human
agcauuuucauuucuaauggcccaugg

SEQ ID NO: 72853 - RNA, 22 nt, Human
cccucuauuuuauuuuucuuga

SEQ ID NO: 72854 - RNA, 27 nt, Human
uggaaacacuaaauguuaaagauguag

SEQ ID NO: 72855 - RNA, 25 nt, Human
aaggggcaggccagagcuacccgca

SEQ ID NO: 72856 - RNA, 26 nt, Human
ucguuuuuguuccaagaaugauauga

SEQ ID NO: 72857 - RNA, 23 nt, Human
accuucugugaagaacuggggua

SEQ ID NO: 72858 - RNA, 20 nt, Human
agcugggugggaggagcagc

SEQ ID NO: 72859 - RNA, 27 nt, Human
agucaucugauguaauucucucacuua

SEQ ID NO: 72860 - RNA, 26 nt, Human
ccccucggagcuagggagugugugcg

SEQ ID NO: 72861 - RNA, 27 nt, Human
cugcccugguggcccucuccccugccc

SEQ ID NO: 72862 - RNA, 27 nt, Human
agcugauuucuaaaauaugauuaaagu

SEQ ID NO: 72863 - RNA, 19 nt, Human
cugcccccugcccucucuc

SEQ ID NO: 72864 - RNA, 24 nt, Human
gggacugcauuucuggaaacauac

SEQ ID NO: 72865 - RNA, 22 nt, Human
ccagagugcucaucaucauguc

SEQ ID NO: 72866 - RNA, 21 nt, Human
uugggagcuuccaaagccggg

SEQ ID NO: 72867 - RNA, 24 nt, Human
guucucuucucuacccugcccuaa

SEQ ID NO: 72868 - RNA, 27 nt, Human
caggcugggguguuuucgguaucugcu

SEQ ID NO: 72869 - RNA, 32 nt, Human
gcuguuggagggggcaggcucgcggguggcug

SEQ ID NO: 72870 - RNA, 22 nt, Human
uucuucugcccccuccugaguc

SEQ ID NO: 72871 - RNA, 25 nt, Human
aacuugauugaacugucuaggaacu

SEQ ID NO: 72872 - RNA, 18 nt, Human
ucuggcuucuuucacuua

SEQ ID NO: 72873 - RNA, 22 nt, Human
ucucccaggcuggagugcagug

SEQ ID NO: 72874 - RNA, 23 nt, Human
uuccccucugcugcugucccucc

SEQ ID NO: 72875 - RNA, 26 nt, Human
ccugcaggacucgggcuaaguccagc

SEQ ID NO: 72876 - RNA, 27 nt, Human
aaguagcugggauuacuggugcacacc

SEQ ID NO: 72877 - RNA, 22 nt, Human
auuuccccucuucccuucaaca

SEQ ID NO: 72878 - RNA, 25 nt, Human
accccauccucuccacgccgcugcc

SEQ ID NO: 72879 - RNA, 22 nt, Human
ccuguuaacccuccaccuccuc

SEQ ID NO: 72880 - RNA, 27 nt, Human
acuccacuguaguuuacuuugccugua

SEQ ID NO: 72881 - RNA, 25 nt, Human
acugaucuacaacuucguccuguuc

SEQ ID NO: 72882 - RNA, 21 nt, Human
cucucucccucuacuaauuuc

SEQ ID NO: 72883 - RNA, 20 nt, Human
agagagaagggagacucuau

SEQ ID NO: 72884 - RNA, 22 nt, Human
ggacucccuuucugccacccca

SEQ ID NO: 72885 - RNA, 22 nt, Human
ggaggggagagaaggauucuag

SEQ ID NO: 72886 - RNA, 20 nt, Human
cugcagauggcccagaaugg

SEQ ID NO: 72887 - RNA, 27 nt, Human
acccagucuccucuccauuuuagccca

SEQ ID NO: 72888 - RNA, 22 nt, Human
gcugcuugugaugagagccucc

SEQ ID NO: 72889 - RNA, 27 nt, Human
augcggagcuccaaauucaaacagcug

SEQ ID NO: 72890 - RNA, 25 nt, Human
gcugugucucccuucauccuucugg

SEQ ID NO: 72891 - RNA, 23 nt, Human
cagggggagagcacaggacuggc

SEQ ID NO: 72892 - RNA, 23 nt, Human
acugguuacccuccucucugcag

SEQ ID NO: 72893 - RNA, 25 nt, Human
ggcugaucucaaacuccugaccuca

SEQ ID NO: 72894 - RNA, 25 nt, Human
ggcugaucucgaacuccuaaccuca

SEQ ID NO: 72895 - RNA, 22 nt, Human
ucacaaaccugaauggucugaa

SEQ ID NO: 72896 - RNA, 21 nt, Human
cauuucuacuccagcaugcag

SEQ ID NO: 72897 - RNA, 22 nt, Human
ugugcugcugcuucacuuccgc

SEQ ID NO: 72898 - RNA, 24 nt, Human
ggccuucucuugaggccugugcuc

SEQ ID NO: 72899 - RNA, 23 nt, Human
uggcccuaaaggacucuccagcc

SEQ ID NO: 72900 - RNA, 20 nt, Human
cguggaggaagcccacccag

SEQ ID NO: 72901 - RNA, 27 nt, Human
caggcuggagugccguggcacgaucuc

SEQ ID NO: 72902 - RNA, 22 nt, Human
gguuucauuugggaucagaccg

SEQ ID NO: 72903 - RNA, 26 nt, Human
ggggugcugagucaucucacgaagaa

SEQ ID NO: 72904 - RNA, 22 nt, Human
agaccagccuaggugacauagu

SEQ ID NO: 72905 - RNA, 21 nt, Human
cccaccccgcgucugucgccc

SEQ ID NO: 72906 - RNA, 27 nt, Human
ccaggagguggagguugcaguaagcug

SEQ ID NO: 72907 - RNA, 19 nt, Human
uguauacagacagaaaaau

SEQ ID NO: 72908 - RNA, 21 nt, Human
agugacacaccucuccccuca

SEQ ID NO: 72909 - RNA, 19 nt, Human
agcaguuauucucucucca

SEQ ID NO: 72910 - RNA, 26 nt, Human
aggucggaggaauggaggcuuacuaa

SEQ ID NO: 72911 - RNA, 24 nt, Human
uuccuuuaauaaaauuugcuuguu

SEQ ID NO: 72912 - RNA, 25 nt, Human
gaacagcuacaguuucacaguagga

SEQ ID NO: 72913 - RNA, 22 nt, Human
gccugggcuggagaacaguggc

SEQ ID NO: 72914 - RNA, 19 nt, Human
aagcccccagaggccgugu

SEQ ID NO: 72915 - RNA, 27 nt, Human
acauggucagguugagcugaagccaca

SEQ ID NO: 72916 - RNA, 24 nt, Human
ccaugauugugccacugcacucca

SEQ ID NO: 72917 - RNA, 24 nt, Human
cuaugauugugccacuguacucca

SEQ ID NO: 72918 - RNA, 21 nt, Human
ccuccgaguggacuccagaaa

SEQ ID NO: 72919 - RNA, 11 nt, Human
gccaugaugcc

SEQ ID NO: 72920 - RNA, 27 nt, Human
cguacugagaggaggugauaccggguc

SEQ ID NO: 72921 - RNA, 25 nt, Human
guagcuggggagaccucagcagggc

SEQ ID NO: 72922 - RNA, 23 nt, Human
cauaggagucagauacaaaaaga

SEQ ID NO: 72923 - RNA, 22 nt, Human
cucccacccucugcuccuggcc

SEQ ID NO: 72924 - RNA, 23 nt, Human
gagaacauccguguaaaucaucu

SEQ ID NO: 72925 - RNA, 22 nt, Human
guugcccuaagaaugcuucuca

SEQ ID NO: 72926 - RNA, 22 nt, Human
gggacugucacccucagcacug

SEQ ID NO: 72927 - RNA, 21 nt, Human
ugaggugggcauggagugagc

SEQ ID NO: 72928 - RNA, 23 nt, Human
gcagaagaacuagagaaggacca

SEQ ID NO: 72929 - RNA, 21 nt, Human
gugucucucaggauggugcuc

SEQ ID NO: 72930 - RNA, 21 nt, Human
uguuuagggcagugggaggag

SEQ ID NO: 72931 - RNA, 24 nt, Human
acaaaaaccgucacuuaggaaaag

SEQ ID NO: 72932 - RNA, 25 nt, Human
gcaguauguaguuauuuauuacaaa

SEQ ID NO: 72933 - RNA, 27 nt, Human
ggcuucaccuuaaaaacagugugcaaa

SEQ ID NO: 72934 - RNA, 24 nt, Human
gucaucugccaccacaccuggcua

SEQ ID NO: 72935 - RNA, 22 nt, Human
ucaaacacaaguggguaguguc

SEQ ID NO: 72936 - RNA, 28 nt, Human
ugccucgguaccuguuacugcugcuacu

SEQ ID NO: 72937 - RNA, 25 nt, Human
gcucagagagacacuuucuccggga

SEQ ID NO: 72938 - RNA, 20 nt, Human
uaaagucaucuuuacuuucc

SEQ ID NO: 72939 - RNA, 23 nt, Human
uuccugagccucucccagcucca

SEQ ID NO: 72940 - RNA, 21 nt, Human
agagcuuucuuucacaaaaaa

SEQ ID NO: 72941 - RNA, 19 nt, Human
cacuaaacuguuuuucuca

SEQ ID NO: 72942 - RNA, 20 nt, Human
guacaucuucuccgacaaga

SEQ ID NO: 72943 - RNA, 23 nt, Human
guccucucccacaucugggaggg

SEQ ID NO: 72944 - RNA, 22 nt, Human
gcugggcucccagacuccuggg

SEQ ID NO: 72945 - RNA, 27 nt, Human
cucccacaugaugucaccuccccauca

SEQ ID NO: 72946 - RNA, 27 nt, Human
ccuuugucccguuucacacuaaacggg

SEQ ID NO: 72947 - RNA, 23 nt, Human
gggcuguagaauggggucuggcc

SEQ ID NO: 72948 - RNA, 24 nt, Human
aucaguuuuguccucuuauugcaa

SEQ ID NO: 72949 - RNA, 28 nt, Human
ugacuauccugaaaagaaauaauaauca

SEQ ID NO: 72950 - RNA, 21 nt, Human
acugaacaccuguagucccag

SEQ ID NO: 72951 - RNA, 27 nt, Human
aaaguuuauaaaggcaugugguacaau

SEQ ID NO: 72952 - RNA, 25 nt, Human
ccaaaacaaugcccguaagauggcu

SEQ ID NO: 72953 - RNA, 15 nt, Human
auucccuuaagguua

SEQ ID NO: 72954 - RNA, 26 nt, Human
guuagucugguuggaaaccaagagaa

SEQ ID NO: 72955 - RNA, 19 nt, Human
ucgaaguucugccucucug

SEQ ID NO: 72956 - RNA, 24 nt, Human
cacacacaaccuccccuguuuuca

SEQ ID NO: 72957 - RNA, 18 nt, Human
aucucucguuuagcuacc

SEQ ID NO: 72958 - RNA, 27 nt, Human
gccccuugccaggcuuccuuauuccuu

SEQ ID NO: 72959 - RNA, 23 nt, Human
gcuggucacagagucuccugggc

SEQ ID NO: 72960 - RNA, 27 nt, Human
ucccuguaugcucagaaaacauugauu

SEQ ID NO: 72961 - RNA, 24 nt, Human
ggucuguggauuucuaguuuauga

SEQ ID NO: 72962 - RNA, 24 nt, Human
guuuucucccacugccuccaggcc

SEQ ID NO: 72963 - RNA, 21 nt, Human
uucacucaggcuggaauguag

SEQ ID NO: 72964 - RNA, 22 nt, Human
cugagggaaaccagagucugua

SEQ ID NO: 72965 - RNA, 22 nt, Human
cccugcucuagccaagguggcc

SEQ ID NO: 72966 - RNA, 23 nt, Human
cauacucaagagcauaaugguaa

SEQ ID NO: 72967 - RNA, 20 nt, Human
cugugcauguguguacagca

SEQ ID NO: 72968 - RNA, 26 nt, Human
cugguauugcugcuggagggcugugg

SEQ ID NO: 72969 - RNA, 26 nt, Human
ccgguguaugccaaguggcccccggg

SEQ ID NO: 72970 - RNA, 22 nt, Human
uugugccucaguuuacccaccc

SEQ ID NO: 72971 - RNA, 22 nt, Human
cacucacugcggccucaaccuu

SEQ ID NO: 72972 - RNA, 21 nt, Human
ccuauaacauuuacaaaaaga

SEQ ID NO: 72973 - RNA, 22 nt, Human
cgccagacccugccccaccuca

SEQ ID NO: 72974 - RNA, 17 nt, Human
agaacuucaugaugauu

SEQ ID NO: 72975 - RNA, 21 nt, Human
gggccgggcgggagugcaggg

SEQ ID NO: 72976 - RNA, 21 nt, Human
gccccggggccagguggagaa

SEQ ID NO: 72977 - RNA, 22 nt, Human
gacaagcuccuacgcucacugu

SEQ ID NO: 72978 - RNA, 29 nt, Human
ucuccuccuccuccuccugggucccccag

SEQ ID NO: 72979 - RNA, 21 nt, Human
cagccccuucucucgcuuugg

SEQ ID NO: 72980 - RNA, 23 nt, Human
uuaucugaggucacagggccugg

SEQ ID NO: 72981 - RNA, 19 nt, Human
guuuuuaaggguuaucuua

SEQ ID NO: 72982 - RNA, 24 nt, Human
aucagcaauagucugcucuccccg

SEQ ID NO: 72983 - RNA, 22 nt, Human
aggcuggaguacaguggugcca

SEQ ID NO: 72984 - RNA, 23 nt, Human
accgggguuucaccauguuggcc

SEQ ID NO: 72985 - RNA, 23 nt, Human
ucuccugguuuucuuccuaggcc

SEQ ID NO: 72986 - RNA, 22 nt, Human
ugugccgcuggggucuccauca

SEQ ID NO: 72987 - RNA, 21 nt, Human
acaacagcccucuagccuggg

SEQ ID NO: 72988 - RNA, 23 nt, Human
uuuauguaagagcaccuuccuca

SEQ ID NO: 72989 - RNA, 26 nt, Human
gaggccugccuucugccugcucuccu

SEQ ID NO: 72990 - RNA, 24 nt, Human
uauuuuaaaaauguuaaugcagga

SEQ ID NO: 72991 - RNA, 23 nt, Human
cugugggaaagagguugagcuuc

SEQ ID NO: 72992 - RNA, 28 nt, Human
uuccugccgcccuccuccguagccuugc

SEQ ID NO: 72993 - RNA, 22 nt, Human
cuuggagcucuuugagaauggg

SEQ ID NO: 72994 - RNA, 21 nt, Human
ugaacaaagagcauggcuuga

SEQ ID NO: 72995 - RNA, 27 nt, Human
gguauuuucacagguuuguuucuugau

SEQ ID NO: 72996 - RNA, 26 nt, Human
ccugcucucucuauagagaaggaaau

SEQ ID NO: 72997 - RNA, 27 nt, Human
uagaccaccuccagccagugacgcucc

SEQ ID NO: 72998 - RNA, 26 nt, Human
gcgagccuggccagcgaggguagccg

SEQ ID NO: 72999 - RNA, 22 nt, Human
auaccccauuuccuuccaguca

SEQ ID NO: 73000 - RNA, 22 nt, Human
gacccucugcugaagacuugcc

SEQ ID NO: 73001 - RNA, 28 nt, Human
ccugcuaccagucugugccuuagagguc

SEQ ID NO: 73002 - RNA, 24 nt, Human
aaagugggaugaucugucacuaca

SEQ ID NO: 73003 - RNA, 26 nt, Human
ugcagacuagaauucuagugcugcug

SEQ ID NO: 73004 - RNA, 22 nt, Human
gcagcuguugcagugagccaag

SEQ ID NO: 73005 - RNA, 27 nt, Human
gggcuccugccucagaaugucagugag

SEQ ID NO: 73006 - RNA, 25 nt, Human
ugcauuuagcugccuagugagaaua

SEQ ID NO: 73007 - RNA, 25 nt, Human
gggcugcuagaagcacgauccgcca

SEQ ID NO: 73008 - RNA, 22 nt, Human
ggacuccugccccgaggguccg

SEQ ID NO: 73009 - RNA, 24 nt, Human
ggagagggacagacagccggcugc

SEQ ID NO: 73010 - RNA, 24 nt, Human
gggaggcugaggugggaggacugc

SEQ ID NO: 73011 - RNA, 26 nt, Human
aaucagcggccacaacugucuagggc

SEQ ID NO: 73012 - RNA, 21 nt, Human
uaucaguauuccaagccuggg

SEQ ID NO: 73013 - RNA, 21 nt, Human
auguccccugccagggccugu

SEQ ID NO: 73014 - RNA, 19 nt, Human
cugauacuuacauuucaug

SEQ ID NO: 73015 - RNA, 23 nt, Human
agcuuauucuuuccuuccuucau

SEQ ID NO: 73016 - RNA, 27 nt, Human
acugccucuucccuucucgcuugggaa

SEQ ID NO: 73017 - RNA, 21 nt, Human
ugugcacaccugaguucacag

SEQ ID NO: 73018 - RNA, 22 nt, Human
uggaagcaucuuucacugggac

SEQ ID NO: 73019 - RNA, 20 nt, Human
uccuacccacaccucugcca

SEQ ID NO: 73020 - RNA, 21 nt, Human
acuaccugagucuuuccaaac

SEQ ID NO: 73021 - RNA, 26 nt, Human
ggcucacgccuguaauccagcacuuu

SEQ ID NO: 73022 - RNA, 24 nt, Human
ccuuuucuauguugcuauuguaag

SEQ ID NO: 73023 - RNA, 25 nt, Human
acagguguccaugggacaaaaaaga

SEQ ID NO: 73024 - RNA, 26 nt, Human
gcuguuaaaagaggaggaaacuacuu

SEQ ID NO: 73025 - RNA, 20 nt, Human
uuccucuccauccuucaucc

SEQ ID NO: 73026 - RNA, 27 nt, Human
ggucucgaacuccugggcucaagcagu

SEQ ID NO: 73027 - RNA, 17 nt, Human
gggaaacugacugugcu

SEQ ID NO: 73028 - RNA, 22 nt, Human
uggcuuuuaguaaucauguugg

SEQ ID NO: 73029 - RNA, 20 nt, Human
ugcagggucaggaacugggc

SEQ ID NO: 73030 - RNA, 18 nt, Human
cugacucaacagagacgg

SEQ ID NO: 73031 - RNA, 26 nt, Human
caucucucuccauaucaaucuggacc

SEQ ID NO: 73032 - RNA, 23 nt, Human
auccucccuccccuucaaggcag

SEQ ID NO: 73033 - RNA, 21 nt, Human
uguacuuugaaaacaccagcu

SEQ ID NO: 73034 - RNA, 23 nt, Human
cuucaaaaaauguuccaagguaa

SEQ ID NO: 73035 - RNA, 20 nt, Human
uccuuucuccuuuucuuucc

SEQ ID NO: 73036 - RNA, 22 nt, Human
gcucucucacuccacuacuuuu

SEQ ID NO: 73037 - RNA, 28 nt, Human
cacacauguauauuucccccugguacac

SEQ ID NO: 73038 - RNA, 22 nt, Human
ucugacacagggcuggcccgcc

SEQ ID NO: 73039 - RNA, 25 nt, Human
cagguggggaaaugugcugaaggac

SEQ ID NO: 73040 - RNA, 23 nt, Human
gaccagccacauccagggguccu

SEQ ID NO: 73041 - RNA, 23 nt, Human
gcaaagguugucacaucuuccca

SEQ ID NO: 73042 - RNA, 19 nt, Human
ucuuagcauuuucuuugua

SEQ ID NO: 73043 - RNA, 20 nt, Human
aggccuggaauuagcuuggg

SEQ ID NO: 73044 - RNA, 17 nt, Human
uuuucucacgguaggaa

SEQ ID NO: 73045 - RNA, 24 nt, Human
aacaugcuuuuacuuuauugcccu

SEQ ID NO: 73046 - RNA, 25 nt, Human
ggagcuggcugugccugcuucugug

SEQ ID NO: 73047 - RNA, 24 nt, Human
caucugcugacuucugucuaggcu

SEQ ID NO: 73048 - RNA, 22 nt, Human
cuuugcaggcuuuuccuccucu

SEQ ID NO: 73049 - RNA, 23 nt, Human
cccugcaggaggaccccggccuc

SEQ ID NO: 73050 - RNA, 23 nt, Human
ucuacuuccugucugcaugccca

SEQ ID NO: 73051 - RNA, 15 nt, Human
uaaaggaaugcuuga

SEQ ID NO: 73052 - RNA, 26 nt, Human
guuuuccagcggaggguggauggcuc

SEQ ID NO: 73053 - RNA, 23 nt, Human
uucgauuccauuuuaccuccucu

SEQ ID NO: 73054 - RNA, 25 nt, Human
ggggagaccuggccaagggagccag

SEQ ID NO: 73055 - RNA, 26 nt, Human
ucgcccaggcuggagugcaggggcgc

SEQ ID NO: 73056 - RNA, 18 nt, Human
aagcaggaagauucuaua

SEQ ID NO: 73057 - RNA, 22 nt, Human
uuucccaagccuacuuuugcca

SEQ ID NO: 73058 - RNA, 21 nt, Human
uauuaaaaagcauacagucua

SEQ ID NO: 73059 - RNA, 22 nt, Human
agggcuggagucaggggacuuc

SEQ ID NO: 73060 - RNA, 20 nt, Human
gcaaagugcuagccacugga

SEQ ID NO: 73061 - RNA, 21 nt, Human
gggggccaggcuggaggcagg

SEQ ID NO: 73062 - RNA, 22 nt, Human
ucucagcccaccaaugccaaga

SEQ ID NO: 73063 - RNA, 22 nt, Human
cccugugacccucucacuuugg

SEQ ID NO: 73064 - RNA, 21 nt, Human
ccggaggcggaaccggcagug

SEQ ID NO: 73065 - RNA, 19 nt, Human
gccuccugaauagcuggga

SEQ ID NO: 73066 - RNA, 27 nt, Human
cacugguuuggaccguuacucugcaca

SEQ ID NO: 73067 - RNA, 21 nt, Human
agcgccugccuucucuugccu

SEQ ID NO: 73068 - RNA, 22 nt, Human
cagagacaaaaucucuauacug

SEQ ID NO: 73069 - RNA, 27 nt, Human
gcucuucuguggucugccaccauuccc

SEQ ID NO: 73070 - RNA, 27 nt, Human
uccaaguaguuuugguucacuauucac

SEQ ID NO: 73071 - RNA, 22 nt, Human
aucccuuuuccucccagcugcc

SEQ ID NO: 73072 - RNA, 22 nt, Human
uaggagguugaggcugcaguga

SEQ ID NO: 73073 - RNA, 21 nt, Human
acugggagaaggaauaacuuu

SEQ ID NO: 73074 - RNA, 22 nt, Human
cucucuagccacccccuugucc

SEQ ID NO: 73075 - RNA, 21 nt, Human
aggcucuggacuggagcucuc

SEQ ID NO: 73076 - RNA, 22 nt, Human
guacccaggagguggagguugc

SEQ ID NO: 73077 - RNA, 22 nt, Human
ugucuucucuuccuccuccacc

SEQ ID NO: 73078 - RNA, 20 nt, Human
ugggcuguuguaaacagggu

SEQ ID NO: 73079 - RNA, 25 nt, Human
uguccaucuugugccuucuccugga

SEQ ID NO: 73080 - RNA, 20 nt, Human
uguccagucauccugcccug

SEQ ID NO: 73081 - RNA, 26 nt, Human
aggauggaggaaugugggcaguuuga

SEQ ID NO: 73082 - RNA, 20 nt, Human
aagaaaaggcaaaagacugg

SEQ ID NO: 73083 - RNA, 23 nt, Human
gggaccacucucucaguccccag

SEQ ID NO: 73084 - RNA, 24 nt, Human
gagcagccuccacuguguccagag

SEQ ID NO: 73085 - RNA, 22 nt, Human
caacaccuacacccaccuguuu

SEQ ID NO: 73086 - RNA, 24 nt, Human
cagcuguggguggaggcuggggug

SEQ ID NO: 73087 - RNA, 19 nt, Human
ugcagugagccaugaucau

SEQ ID NO: 73088 - RNA, 18 nt, Human
cugccccugcuccagucg

SEQ ID NO: 73089 - RNA, 21 nt, Human
ggcucacugcagccuccaccu

SEQ ID NO: 73090 - RNA, 19 nt, Human
uugccaucuucuguuacca

SEQ ID NO: 73091 - RNA, 21 nt, Human
ccguccugccaccucucugcu

SEQ ID NO: 73092 - RNA, 23 nt, Human
auuuggaggcggugggagcuuuu

SEQ ID NO: 73093 - RNA, 24 nt, Human
ccuucaacuucagcaccugccccg

SEQ ID NO: 73094 - RNA, 23 nt, Human
aaagaaaagggaaagccauccaa

SEQ ID NO: 73095 - RNA, 32 nt, Human
gaagcaccagcacguuucacaccucccccuuc

SEQ ID NO: 73096 - RNA, 23 nt, Human
uuagaugauucagcuucaucauu

SEQ ID NO: 73097 - RNA, 23 nt, Human
ccucucgggggcaggagggcgau

SEQ ID NO: 73098 - RNA, 20 nt, Human
gggaaggcuacuaccuaggg

SEQ ID NO: 73099 - RNA, 21 nt, Human
gggagagaguccuuacucccu

SEQ ID NO: 73100 - RNA, 26 nt, Human
ccaguucugggcaaucaguguuaccg

SEQ ID NO: 73101 - RNA, 21 nt, Human
ccuaaagaaaaccacucuuug

SEQ ID NO: 73102 - RNA, 21 nt, Human
gcugacuguuuucucuugaga

SEQ ID NO: 73103 - RNA, 21 nt, Human
guucuuucauuuccuccagca

SEQ ID NO: 73104 - RNA, 23 nt, Human
acaaugacagaagauaaggucac

SEQ ID NO: 73105 - RNA, 26 nt, Human
cccaugcaccuggucauugugucucc

SEQ ID NO: 73106 - RNA, 21 nt, Human
gccacugcagucgagccuggg

SEQ ID NO: 73107 - RNA, 17 nt, Human
cuuccacugccgucucc

SEQ ID NO: 73108 - RNA, 30 nt, Human
gcucggcaaguucucccaggagaaagccau

SEQ ID NO: 73109 - RNA, 24 nt, Human
ugagggaaauaacaauggagccag

SEQ ID NO: 73110 - RNA, 21 nt, Human
gagacuccacccuccccaccu

SEQ ID NO: 73111 - RNA, 27 nt, Human
uacuaccuguguauauaguuuuuaccu

SEQ ID NO: 73112 - RNA, 22 nt, Human
ccuuucugccaccccaggcugg

SEQ ID NO: 73113 - RNA, 20 nt, Human
uggaaaggagggguccugca

SEQ ID NO: 73114 - RNA, 26 nt, Human
gggagacugacacaggaaaaugaacu

SEQ ID NO: 73115 - RNA, 23 nt, Human
ggaccagcacuuggugccuugga

SEQ ID NO: 73116 - RNA, 28 nt, Human
ugcagugagccaagaucaugccacugca

SEQ ID NO: 73117 - RNA, 25 nt, Human
ggagggagaagcucuggggagccag

SEQ ID NO: 73118 - RNA, 24 nt, Human
ugcauagugccaugauuggaaccc

SEQ ID NO: 73119 - RNA, 23 nt, Human
ggggugagaggcagaccagcaga

SEQ ID NO: 73120 - RNA, 26 nt, Human
uucucaucuauuuauuucuuuauaca

SEQ ID NO: 73121 - RNA, 23 nt, Human
agagcccccuccagaccacucua

SEQ ID NO: 73122 - RNA, 23 nt, Human
auagcaauucauauaacccucua

SEQ ID NO: 73123 - RNA, 27 nt, Human
uggucucaguauaugcuauucuggccc

SEQ ID NO: 73124 - RNA, 26 nt, Human
ugcacacccuuuucccauucaauuug

SEQ ID NO: 73125 - RNA, 20 nt, Human
aaaauaaacaaacuaauaaa

SEQ ID NO: 73126 - RNA, 23 nt, Human
cuccaucgccuucccugccucuc

SEQ ID NO: 73127 - RNA, 20 nt, Human
agagguaagaggaacacuag

SEQ ID NO: 73128 - RNA, 23 nt, Human
uucauuucuuccacuucuccaga

SEQ ID NO: 73129 - RNA, 21 nt, Human
uuggaacuuccuaauuuuggg

SEQ ID NO: 73130 - RNA, 22 nt, Human
gcuguggugguguucuguuggu

SEQ ID NO: 73131 - RNA, 26 nt, Human
cccagauucaacaggaaaccgaucuu

SEQ ID NO: 73132 - RNA, 24 nt, Human
ucccuuaaugucauuccucucucu

SEQ ID NO: 73133 - RNA, 17 nt, Human
uccagggagagagcagc

SEQ ID NO: 73134 - RNA, 22 nt, Human
ccaggagguggagguugcagug

SEQ ID NO: 73135 - RNA, 22 nt, Human
ucaggaggcggagguugcagug

SEQ ID NO: 73136 - RNA, 22 nt, Human
aggcuggagugcaauggcacaa

SEQ ID NO: 73137 - RNA, 22 nt, Human
aggcuggagugcaguggcacag

SEQ ID NO: 73138 - RNA, 26 nt, Human
uuacucugucgcccaggcuggagugu

SEQ ID NO: 73139 - RNA, 26 nt, Human
aucaaauucuaucugcuaauguuuua

SEQ ID NO: 73140 - RNA, 25 nt, Human
cugcuuucucuguuccugugaugca

SEQ ID NO: 73141 - RNA, 19 nt, Human
accggaccugcuggaggcu

SEQ ID NO: 73142 - RNA, 24 nt, Human
ccaagcccaccauggcccagaugg

SEQ ID NO: 73143 - RNA, 23 nt, Human
gaggcagcaucugggggcagugg

SEQ ID NO: 73144 - RNA, 23 nt, Human
ccugggcugcuggaugcagcagc

SEQ ID NO: 73145 - RNA, 26 nt, Human
ucauggacagcggggcgggcggccgg

SEQ ID NO: 73146 - RNA, 22 nt, Human
ugaugucuugcugaaugcugug

SEQ ID NO: 73147 - RNA, 22 nt, Human
ggcuuccugccucugcacgcca

SEQ ID NO: 73148 - RNA, 26 nt, Human
ucaaugcucaucacacacagggcuau

SEQ ID NO: 73149 - RNA, 22 nt, Human
uuucuggucuucggcugcucag

SEQ ID NO: 73150 - RNA, 19 nt, Human
agucaucucuguaaaucug

SEQ ID NO: 73151 - RNA, 22 nt, Human
agguugaggcaggagaaucgcu

SEQ ID NO: 73152 - RNA, 20 nt, Human
ccagaagcaggguucuggga

SEQ ID NO: 73153 - RNA, 21 nt, Human
ggaggcugggugcuguggcuc

SEQ ID NO: 73154 - RNA, 24 nt, Human
uauuauuacuaauugucuacuucu

SEQ ID NO: 73155 - RNA, 23 nt, Human
augcuuugguauuuucuugggga

SEQ ID NO: 73156 - RNA, 22 nt, Human
caggaauggggaaaugugacac

SEQ ID NO: 73157 - RNA, 21 nt, Human
cccaggcccuugacauggcuu

SEQ ID NO: 73158 - RNA, 21 nt, Human
aacuccugggcucaagcaaug

SEQ ID NO: 73159 - RNA, 23 nt, Human
uccggugagcugagcgcggcgcg

SEQ ID NO: 73160 - RNA, 26 nt, Human
ccccagacuuuacaugacacagcuuu

SEQ ID NO: 73161 - RNA, 23 nt, Human
cucucugcuuagguuuugcuugg

SEQ ID NO: 73162 - RNA, 27 nt, Human
acugcaacuucuguauccuuccuuccc

SEQ ID NO: 73163 - RNA, 29 nt, Human
ccugggccccuucucuccugggcagccac

SEQ ID NO: 73164 - RNA, 20 nt, Human
gcuccuccuccucccuccca

SEQ ID NO: 73165 - RNA, 13 nt, Human
ugggugggguggg

SEQ ID NO: 73166 - RNA, 20 nt, Human
gccuggccuguggcugcccu

SEQ ID NO: 73167 - RNA, 28 nt, Human
ccaccgacuuuguuuucucaggauggau

SEQ ID NO: 73168 - RNA, 28 nt, Human
ucuagucagaguauaauuuugguuguaa

SEQ ID NO: 73169 - RNA, 22 nt, Human
ggaggcugaggcaggcagauca

SEQ ID NO: 73170 - RNA, 19 nt, Human
cucuaccagugcaggcugg

SEQ ID NO: 73171 - RNA, 22 nt, Human
cucaaguaauccaccugccucg

SEQ ID NO: 73172 - RNA, 25 nt, Human
uccccgcccucuccccgccucggcc

SEQ ID NO: 73173 - RNA, 20 nt, Human
agcuccccauucacacacac

SEQ ID NO: 73174 - RNA, 25 nt, Human
ugugggggagagaggccgcagccag

SEQ ID NO: 73175 - RNA, 21 nt, Human
uugaacacaggaggcagaggu

SEQ ID NO: 73176 - RNA, 25 nt, Human
gucauauaucaaaucaucucuuuaa

SEQ ID NO: 73177 - RNA, 25 nt, Human
uguucuguucuauagaguuaaaccu

SEQ ID NO: 73178 - RNA, 29 nt, Human
gguuuuucaucugaaaagcaguucauguc

SEQ ID NO: 73179 - RNA, 22 nt, Human
uccuauucuguauccuuaccuu

SEQ ID NO: 73180 - RNA, 23 nt, Human
ccaggagacggagguugcaguga

SEQ ID NO: 73181 - RNA, 21 nt, Human
ucagggugccuguccaggaag

SEQ ID NO: 73182 - RNA, 25 nt, Human
cugucccaugccugccuggggagcc

SEQ ID NO: 73183 - RNA, 21 nt, Human
agagugaucaggaaaugagua

SEQ ID NO: 73184 - RNA, 22 nt, Human
cccaacuccgggacgcacgcug

SEQ ID NO: 73185 - RNA, 22 nt, Human
cacgggugucaaaccccuguca

SEQ ID NO: 73186 - RNA, 25 nt, Human
ucuuguuuuaaacaagaaugaauca

SEQ ID NO: 73187 - RNA, 21 nt, Human
cugacccaagaaguugcuuga

SEQ ID NO: 73188 - RNA, 16 nt, Human
cucuuucuccaaaggg

SEQ ID NO: 73189 - RNA, 25 nt, Human
aggacuuggggaaaaugagauggag

SEQ ID NO: 73190 - RNA, 20 nt, Human
gaggaaggcagugcagagcu

SEQ ID NO: 73191 - RNA, 24 nt, Human
cacugcacucugacccuguaguac

SEQ ID NO: 73192 - RNA, 23 nt, Human
cuuauaguaaggaaacucacuug

SEQ ID NO: 73193 - RNA, 21 nt, Human
ucauuucuagagacagcaauc

SEQ ID NO: 73194 - RNA, 22 nt, Human
uccagauagggcuaauuacaaa

SEQ ID NO: 73195 - RNA, 26 nt, Human
gcaccuacccccuccuccuuuccaca

SEQ ID NO: 73196 - RNA, 22 nt, Human
uauuuuaauucugcuugguguu

SEQ ID NO: 73197 - RNA, 17 nt, Human
cuucaaaaaacggauag

SEQ ID NO: 73198 - RNA, 24 nt, Human
caguucuggacuuuccucgacguc

SEQ ID NO: 73199 - RNA, 23 nt, Human
ggugcagaucggagaaucugcag

SEQ ID NO: 73200 - RNA, 27 nt, Human
cauacccacagguguuaaaaaguaauc

SEQ ID NO: 73201 - RNA, 22 nt, Human
uaacuauaaaacuaauuuuucu

SEQ ID NO: 73202 - RNA, 24 nt, Human
aaggacagugaagagcuagcacca

SEQ ID NO: 73203 - RNA, 23 nt, Human
cagucucaaacuccuggccucau

SEQ ID NO: 73204 - RNA, 21 nt, Human
gcugcaaugcagcauguugcc

SEQ ID NO: 73205 - RNA, 22 nt, Human
uuuucuugccuuuccuguugua

SEQ ID NO: 73206 - RNA, 21 nt, Human
cuccacccuacuuugauuucc

SEQ ID NO: 73207 - RNA, 25 nt, Human
gucccuggacccuggaccagcuacu

SEQ ID NO: 73208 - RNA, 21 nt, Human
gaagugaccaucacauuugga

SEQ ID NO: 73209 - RNA, 22 nt, Human
uguuuguuagugaacuguggac

SEQ ID NO: 73210 - RNA, 22 nt, Human
aagcucagagauuugcaaccag

SEQ ID NO: 73211 - RNA, 27 nt, Human
ugcuucaaaauugucccacaguggcau

SEQ ID NO: 73212 - RNA, 25 nt, Human
agcaucaaucgcagaccugcccugc

SEQ ID NO: 73213 - RNA, 21 nt, Human
gcuauagauagcacugccuuc

SEQ ID NO: 73214 - RNA, 20 nt, Human
acuacuuccucucugaucgu

SEQ ID NO: 73215 - RNA, 21 nt, Human
cuaaacauguuuuuaccugcu

SEQ ID NO: 73216 - RNA, 27 nt, Human
uggcucaugccuguaaucccaacacuu

SEQ ID NO: 73217 - RNA, 26 nt, Human
aauuuuucuuucuucuuuuaagaaca

SEQ ID NO: 73218 - RNA, 25 nt, Human
cccugcacacagccuggggagaagc

SEQ ID NO: 73219 - RNA, 26 nt, Human
cugggaggaagauguuuacauuuuua

SEQ ID NO: 73220 - RNA, 22 nt, Human
cauuccccucccaccucuccuu

SEQ ID NO: 73221 - RNA, 26 nt, Human
uucuaaaauacaauuuuguuucucca

SEQ ID NO: 73222 - RNA, 23 nt, Human
auugcccaggcuugagugcaaug

SEQ ID NO: 73223 - RNA, 27 nt, Human
cccuccagggaagcuccugauuucccc

SEQ ID NO: 73224 - RNA, 20 nt, Human
cccugggugacgugcacauu

SEQ ID NO: 73225 - RNA, 25 nt, Human
uguuuccaggcuuuugcuacucuuc

SEQ ID NO: 73226 - RNA, 23 nt, Human
aucagaaugaacccuccuccuuu

SEQ ID NO: 73227 - RNA, 25 nt, Human
ccugccugggccgggccgaggaugc

SEQ ID NO: 73228 - RNA, 24 nt, Human
ggauccugccuugauuuuacuuca

SEQ ID NO: 73229 - RNA, 25 nt, Human
guugcccaggcuggaguucagcggu

SEQ ID NO: 73230 - RNA, 27 nt, Human
guuucaaguuccugggcucaaagaugg

SEQ ID NO: 73231 - RNA, 28 nt, Human
gugcucaugguucugucauucuuggacc

SEQ ID NO: 73232 - RNA, 21 nt, Human
cacaccuuggccuucugggaa

SEQ ID NO: 73233 - RNA, 23 nt, Human
agaacaauggaucggcuuccuua

SEQ ID NO: 73234 - RNA, 25 nt, Human
cugcccaggcagaggagaauggggu

SEQ ID NO: 73235 - RNA, 21 nt, Human
auacaaaccaauagaauuuca

SEQ ID NO: 73236 - RNA, 19 nt, Human
ugaaaucccaaaccuucua

SEQ ID NO: 73237 - RNA, 27 nt, Human
caggcaguuggagaccagucugggcaa

SEQ ID NO: 73238 - RNA, 22 nt, Human
uaaguuuuuuauuacuaauuca

SEQ ID NO: 73239 - RNA, 23 nt, Human
ggagggagggagcgagcaggcga

SEQ ID NO: 73240 - RNA, 24 nt, Human
uugcagugcuuucuuaauuuuaug

SEQ ID NO: 73241 - RNA, 23 nt, Human
gacccugcacaauacugugagga

SEQ ID NO: 73242 - RNA, 22 nt, Human
acuuucucauguccagggucag

SEQ ID NO: 73243 - RNA, 22 nt, Human
guauuggccugguuuucucaga

SEQ ID NO: 73244 - RNA, 22 nt, Human
aaagaaaaaaugacaccaucuu

SEQ ID NO: 73245 - RNA, 22 nt, Human
ggcagcuccucccugugccccc

SEQ ID NO: 73246 - RNA, 23 nt, Human
aacaaaagucaaauagcaaacag

SEQ ID NO: 73247 - RNA, 23 nt, Human
gccaagggaguggcagaacuggg

SEQ ID NO: 73248 - RNA, 29 nt, Human
gcaaauuugcagcuguuguguaaauacug

SEQ ID NO: 73249 - RNA, 29 nt, Human
ggacagcugcagagguggcagugugugga

SEQ ID NO: 73250 - RNA, 29 nt, Human
uugagcauauacaacuacaaauccaagca

SEQ ID NO: 73251 - RNA, 21 nt, Human
ggagaggugggcagagcugga

SEQ ID NO: 73252 - RNA, 24 nt, Human
auuuacccagacugguuugggcaa

SEQ ID NO: 73253 - RNA, 20 nt, Human
ucuauuugaauugaaugaaa

SEQ ID NO: 73254 - RNA, 22 nt, Human
uggagaaaaauuugaauucuca

SEQ ID NO: 73255 - RNA, 25 nt, Human
guguagcugccaccuccccgcuggg

SEQ ID NO: 73256 - RNA, 21 nt, Human
gaggcaggggacaagggaggc

SEQ ID NO: 73257 - RNA, 21 nt, Human
ggggacucagacacucaggga

SEQ ID NO: 73258 - RNA, 20 nt, Human
auuuucuauuugaaaaugug

SEQ ID NO: 73259 - RNA, 22 nt, Human
uagaaccuucuaauccaugugc

SEQ ID NO: 73260 - RNA, 22 nt, Human
ucgguccggagcccuggaacgc

SEQ ID NO: 73261 - RNA, 18 nt, Human
gagagggagauccccagu

SEQ ID NO: 73262 - RNA, 27 nt, Human
ucuuccuuuccaauuuugcuuauacug

SEQ ID NO: 73263 - RNA, 19 nt, Human
auucuugugucuacuucuc

SEQ ID NO: 73264 - RNA, 23 nt, Human
agcugggcucagcuucuuuuuga

SEQ ID NO: 73265 - RNA, 22 nt, Human
gcgugagccacugcaccgggcc

SEQ ID NO: 73266 - RNA, 22 nt, Human
gauguuucugccacugcugggc

SEQ ID NO: 73267 - RNA, 26 nt, Human
aggaauagagaagggcuuugauuucu

SEQ ID NO: 73268 - RNA, 20 nt, Human
cugccugcacucaguucuca

SEQ ID NO: 73269 - RNA, 22 nt, Human
guuaauaagucucuagcucucc

SEQ ID NO: 73270 - RNA, 21 nt, Human
aacugcucugcccacugugaa

SEQ ID NO: 73271 - RNA, 29 nt, Human
agcaagcgucugggcaagaggaaaaugcc

SEQ ID NO: 73272 - RNA, 21 nt, Human
uguuuucuucuuuuuccugau

SEQ ID NO: 73273 - RNA, 19 nt, Human
ccuccccucccacccacag

SEQ ID NO: 73274 - RNA, 21 nt, Human
ugccuccucccucccucccga

SEQ ID NO: 73275 - RNA, 20 nt, Human
uguugaagaaaauucaucug

SEQ ID NO: 73276 - RNA, 20 nt, Human
gagcuguagacgaacuguuu

SEQ ID NO: 73277 - RNA, 23 nt, Human
cucacugagaaccaucccgguaa

SEQ ID NO: 73278 - RNA, 26 nt, Human
gaacggcaacugagacuggguaccug

SEQ ID NO: 73279 - RNA, 25 nt, Human
gcugcuuacacuccagguguggacc

SEQ ID NO: 73280 - RNA, 22 nt, Human
uauuucuugaauguucucuaug

SEQ ID NO: 73281 - RNA, 22 nt, Human
cuccagugcccaccugccucac

SEQ ID NO: 73282 - RNA, 23 nt, Human
augucuggggaaauuuuaucuug

SEQ ID NO: 73283 - RNA, 22 nt, Human
augauuuuaaagggccugaauu

SEQ ID NO: 73284 - RNA, 25 nt, Human
ggcuggaucuuggagaaugugagaa

SEQ ID NO: 73285 - RNA, 21 nt, Human
ucuuauggccauuagauguua

SEQ ID NO: 73286 - RNA, 22 nt, Human
acaaucagauuagaguccugcc

SEQ ID NO: 73287 - RNA, 20 nt, Human
cuguccugaagagugggaca

SEQ ID NO: 73288 - RNA, 21 nt, Human
ggucuguucugugacucucuc

SEQ ID NO: 73289 - RNA, 22 nt, Human
ggagcaguucaauaacaaaggu

SEQ ID NO: 73290 - RNA, 24 nt, Human
cuugccaggaacccaguggccagg

SEQ ID NO: 73291 - RNA, 21 nt, Human
gaacagcuugaagaccguuca

SEQ ID NO: 73292 - RNA, 22 nt, Human
ucuuccaaagaauuuucacugg

SEQ ID NO: 73293 - RNA, 22 nt, Human
cucaggaggcucagcagcagga

SEQ ID NO: 73294 - RNA, 22 nt, Human
ucucagcuggcagugcaaugcu

SEQ ID NO: 73295 - RNA, 28 nt, Human
gacauuggauagaacaugggauacuuua

SEQ ID NO: 73296 - RNA, 24 nt, Human
gcucugaagaaucaacggugcugg

SEQ ID NO: 73297 - RNA, 22 nt, Human
aucccggguucaagagauucug

SEQ ID NO: 73298 - RNA, 22 nt, Human
cgccucccggguucaggugauu

SEQ ID NO: 73299 - RNA, 23 nt, Human
ggcuugcaucccagggaucccag

SEQ ID NO: 73300 - RNA, 25 nt, Human
cugcaggaucucaccaggcagccuc

SEQ ID NO: 73301 - RNA, 22 nt, Human
caccacuggcugccagucaggg

SEQ ID NO: 73302 - RNA, 22 nt, Human
ccuuugugucuguguccuuguu

SEQ ID NO: 73303 - RNA, 21 nt, Human
gaucacaucuuucuuuaugau

SEQ ID NO: 73304 - RNA, 22 nt, Human
ggaggcugaggcgagaggauca

SEQ ID NO: 73305 - RNA, 22 nt, Human
gaaaagagugaaaugaggacau

SEQ ID NO: 73306 - RNA, 21 nt, Human
gcagagcucugcuaucacuga

SEQ ID NO: 73307 - RNA, 24 nt, Human
agcugcguggguacuggaacaagc

SEQ ID NO: 73308 - RNA, 30 nt, Human
caggugguagugggacaggacaauuggagc

SEQ ID NO: 73309 - RNA, 21 nt, Human
acacagacucauuuucuacuc

SEQ ID NO: 73310 - RNA, 23 nt, Human
gucaggugugcccacagaugcgg

SEQ ID NO: 73311 - RNA, 18 nt, Human
gccccuggugauccagcu

SEQ ID NO: 73312 - RNA, 20 nt, Human
agugacuugguaugcuuuau

SEQ ID NO: 73313 - RNA, 20 nt, Human
gaccucaucuccaaaaaaga

SEQ ID NO: 73314 - RNA, 18 nt, Human
uagacuuuuaaucuuuau

SEQ ID NO: 73315 - RNA, 27 nt, Human
gcccagccuauuaccuuuacguuguac

SEQ ID NO: 73316 - RNA, 20 nt, Human
uuggucgcuacacccuggac

SEQ ID NO: 73317 - RNA, 23 nt, Human
uucaauuucuucuuuuauguuca

SEQ ID NO: 73318 - RNA, 20 nt, Human
uggguuuuugcuuaaguuuu

SEQ ID NO: 73319 - RNA, 22 nt, Human
aaaacugcuacuaucuguuuuu

SEQ ID NO: 73320 - RNA, 25 nt, Human
ugguggcaggcaccuguagucccag

SEQ ID NO: 73321 - RNA, 21 nt, Human
ucagaggcgcaugaauuugug

SEQ ID NO: 73322 - RNA, 20 nt, Human
gagaaacguuuggauaauau

SEQ ID NO: 73323 - RNA, 21 nt, Human
ccugcucuggccuaauggauc

SEQ ID NO: 73324 - RNA, 24 nt, Human
gcaccuggucacagacauggcuug

SEQ ID NO: 73325 - RNA, 21 nt, Human
gcucaaugcaugaucuguacc

SEQ ID NO: 73326 - RNA, 24 nt, Human
ucugcucccugcuugccuccacuc

SEQ ID NO: 73327 - RNA, 22 nt, Human
ugggggaggcagagccagcagg

SEQ ID NO: 73328 - RNA, 25 nt, Human
ucuccaccuuguuacacauuauguu

SEQ ID NO: 73329 - RNA, 23 nt, Human
cccaggaggucaaggcugcagug

SEQ ID NO: 73330 - RNA, 23 nt, Human
cgcuggcugcucugccugagcau

SEQ ID NO: 73331 - RNA, 27 nt, Human
ucuccaccuuuuucuuaugagucucac

SEQ ID NO: 73332 - RNA, 19 nt, Human
cacuguguucucugagcaa

SEQ ID NO: 73333 - RNA, 26 nt, Human
ucacagaccacacacccagcccuccu

SEQ ID NO: 73334 - RNA, 22 nt, Human
agguuguugcagccaucuacug

SEQ ID NO: 73335 - RNA, 23 nt, Human
gccuccuuggcagccucuggcgg

SEQ ID NO: 73336 - RNA, 26 nt, Human
cuuccuggucccucugugcuucucuc

SEQ ID NO: 73337 - RNA, 23 nt, Human
ugacgagaagcaggaagagggug

SEQ ID NO: 73338 - RNA, 27 nt, Human
ccuuacaacaaacaaauaucaaaaaga

SEQ ID NO: 73339 - RNA, 27 nt, Human
aaccugacaggaacaugcuacugaagu

SEQ ID NO: 73340 - RNA, 25 nt, Human
ggaauuggucaaaauucaucucuuu

SEQ ID NO: 73341 - RNA, 23 nt, Human
ccugcugcugagccccacgccaa

SEQ ID NO: 73342 - RNA, 22 nt, Human
ggccucccaaaaugcugggauu

SEQ ID NO: 73343 - RNA, 22 nt, Human
agccucccaaagugcuaggguu

SEQ ID NO: 73344 - RNA, 22 nt, Human
aguccacccucuccuugaugca

SEQ ID NO: 73345 - RNA, 22 nt, Human
gagcuggaaggaaggagccagc

SEQ ID NO: 73346 - RNA, 20 nt, Human
auccuccuuuccccucucuc

SEQ ID NO: 73347 - RNA, 27 nt, Human
cuccccuucuccuccauggcuucccag

SEQ ID NO: 73348 - RNA, 26 nt, Human
uccccugggcaucuucuggcuugacu

SEQ ID NO: 73349 - RNA, 23 nt, Human
gcacaccgggguuaacacugguu

SEQ ID NO: 73350 - RNA, 20 nt, Human
gggcuuaucagaacuccuuu

SEQ ID NO: 73351 - RNA, 24 nt, Human
cagccucuguccagccugcaggug

SEQ ID NO: 73352 - RNA, 17 nt, Human
ccccgggcaaccagcca

SEQ ID NO: 73353 - RNA, 22 nt, Human
cagggccucucugucgcugucg

SEQ ID NO: 73354 - RNA, 20 nt, Human
cuuccaaccugcuccggccg

SEQ ID NO: 73355 - RNA, 22 nt, Human
gaagcucacugugccucuuguu

SEQ ID NO: 73356 - RNA, 27 nt, Human
agcauuuucugcaucuccacuuggcau

SEQ ID NO: 73357 - RNA, 23 nt, Human
uuugggguuuuauuucuguuguu

SEQ ID NO: 73358 - RNA, 23 nt, Human
ggacuggcacuauuugagguuaa

SEQ ID NO: 73359 - RNA, 27 nt, Human
cgggaggucggaggcagcaaggccuua

SEQ ID NO: 73360 - RNA, 22 nt, Human
aucgcuuaaacccaggcggcag

SEQ ID NO: 73361 - RNA, 21 nt, Human
guccucugcucuugggagugu

SEQ ID NO: 73362 - RNA, 27 nt, Human
ugacugucucagcauuaccucuuugga

SEQ ID NO: 73363 - RNA, 24 nt, Human
gcggucugucgcgcgugccugugu

SEQ ID NO: 73364 - RNA, 22 nt, Human
ggggucaggguggcauuagccc

SEQ ID NO: 73365 - RNA, 21 nt, Human
gccugcucagggacuguuccu

SEQ ID NO: 73366 - RNA, 22 nt, Human
uuucccauguuuuuaugucuua

SEQ ID NO: 73367 - RNA, 18 nt, Human
agaaaacuggcaacuggg

SEQ ID NO: 73368 - RNA, 23 nt, Human
aagaggaaguguuugcccaggga

SEQ ID NO: 73369 - RNA, 27 nt, Human
caguaacugccauuuuuugucugugau

SEQ ID NO: 73370 - RNA, 22 nt, Human
cugugggaagguuuugggcucu

SEQ ID NO: 73371 - RNA, 29 nt, Human
agcuugcugcucaaccucuagugucccuc

SEQ ID NO: 73372 - RNA, 20 nt, Human
uggccuggcugggugcagug

SEQ ID NO: 73373 - RNA, 20 nt, Human
cuccacccgcccuaaccccc

SEQ ID NO: 73374 - RNA, 21 nt, Human
aacgaagugccuuuaauucag

SEQ ID NO: 73375 - RNA, 26 nt, Human
agcacagacacagaauauuuucauca

SEQ ID NO: 73376 - RNA, 27 nt, Human
cuucccucccuucuguccuuccaugug

SEQ ID NO: 73377 - RNA, 22 nt, Human
uaacuaaaaucuuccucaggac

SEQ ID NO: 73378 - RNA, 22 nt, Human
uucagaggcgaggagauucugu

SEQ ID NO: 73379 - RNA, 20 nt, Human
augguggcaaagcagacuca

SEQ ID NO: 73380 - RNA, 21 nt, Human
cuccccagcccuccgccucac

SEQ ID NO: 73381 - RNA, 21 nt, Human
uaguuuccuuaccugcugcua

SEQ ID NO: 73382 - RNA, 16 nt, Human
cuucccuuuacagcuc

SEQ ID NO: 73383 - RNA, 23 nt, Human
accuguauucccagcuacuuggg

SEQ ID NO: 73384 - RNA, 22 nt, Human
uggggguagagucucccaagcc

SEQ ID NO: 73385 - RNA, 20 nt, Human
uuauccaauccucaggauuu

SEQ ID NO: 73386 - RNA, 21 nt, Human
ucacauggaacgcuuucauaa

SEQ ID NO: 73387 - RNA, 27 nt, Human
ucugccucuggcugccugcguccucuc

SEQ ID NO: 73388 - RNA, 22 nt, Human
cacugcacccagccuagaaucu

SEQ ID NO: 73389 - RNA, 23 nt, Human
aaggggaaugguugagccucugg

SEQ ID NO: 73390 - RNA, 21 nt, Human
ucaugccacugcgcccagcua

SEQ ID NO: 73391 - RNA, 24 nt, Human
aaaguuacacuuuuauuuccugua

SEQ ID NO: 73392 - RNA, 26 nt, Human
aaguaacuguuuucuucuuggugcua

SEQ ID NO: 73393 - RNA, 19 nt, Human
gaggcugcucugagaagua

SEQ ID NO: 73394 - RNA, 31 nt, Human
cccuggcagcaggaagccuucaaggagccau

SEQ ID NO: 73395 - RNA, 22 nt, Human
augggucaccaguugcuuuuuc

SEQ ID NO: 73396 - RNA, 22 nt, Human
ggggaaugggcauuuugguagg

SEQ ID NO: 73397 - RNA, 16 nt, Human
cggguccugccuucca

SEQ ID NO: 73398 - RNA, 21 nt, Human
acuucaggaaagcaccaauga

SEQ ID NO: 73399 - RNA, 21 nt, Human
ucucagccuugccccuccugc

SEQ ID NO: 73400 - RNA, 22 nt, Human
gcgugugccaccaugccuggcu

SEQ ID NO: 73401 - RNA, 22 nt, Human
gcccucauccccuccuggggcc

SEQ ID NO: 73402 - RNA, 26 nt, Human
aggacuagcauaugagacuucuggua

SEQ ID NO: 73403 - RNA, 23 nt, Human
uuuucuugcuuuuuguuuuugcc

SEQ ID NO: 73404 - RNA, 23 nt, Human
gccaaucucccugcucuugguuc

SEQ ID NO: 73405 - RNA, 23 nt, Human
agcccuagguuuccucuccagcc

SEQ ID NO: 73406 - RNA, 27 nt, Human
ggacugccagccccuguccucccuuca

SEQ ID NO: 73407 - RNA, 25 nt, Human
gucuuguauuucuauaauacuccaa

SEQ ID NO: 73408 - RNA, 22 nt, Human
ugucgcccaggcuggggugcag

SEQ ID NO: 73409 - RNA, 24 nt, Human
ugcugugcagcacuucuguccuca

SEQ ID NO: 73410 - RNA, 27 nt, Human
gccuguugggguuugagucacugggau

SEQ ID NO: 73411 - RNA, 23 nt, Human
uucuuacuagugcacuuguguuu

SEQ ID NO: 73412 - RNA, 20 nt, Human
aagagcuuauaaauacauua

SEQ ID NO: 73413 - RNA, 24 nt, Human
aagcaugcccucccuguccauuug

SEQ ID NO: 73414 - RNA, 22 nt, Human
acccaaaggcaacaugacggaa

SEQ ID NO: 73415 - RNA, 21 nt, Human
caaaaucaacaugacuggugg

SEQ ID NO: 73416 - RNA, 27 nt, Human
gggccuccaugugcaagcgcagaggaa

SEQ ID NO: 73417 - RNA, 19 nt, Human
uagccucuuccucuacuca

SEQ ID NO: 73418 - RNA, 27 nt, Human
cacugccucuucuuuucccugcugcca

SEQ ID NO: 73419 - RNA, 22 nt, Human
uguugcccaggcuggaaugcag

SEQ ID NO: 73420 - RNA, 21 nt, Human
uaguaucccacuagcccaggg

SEQ ID NO: 73421 - RNA, 23 nt, Human
ggcgagaggagccccuuguggca

SEQ ID NO: 73422 - RNA, 30 nt, Human
aacuaugauuccaauuacuacuuuguuauu

SEQ ID NO: 73423 - RNA, 32 nt, Human
cugugggaaggaaauagggaauccaauggaac

SEQ ID NO: 73424 - RNA, 26 nt, Human
cuccagaggccagcaucagcaacugg

SEQ ID NO: 73425 - RNA, 23 nt, Human
ggaccaaugaggcagaggcuugc

SEQ ID NO: 73426 - RNA, 27 nt, Human
gaguggcugggauugcgggcacaugca

SEQ ID NO: 73427 - RNA, 27 nt, Human
uuugcugucugaucuuuguagacuguu

SEQ ID NO: 73428 - RNA, 22 nt, Human
aucggccaggcuggagugcagu

SEQ ID NO: 73429 - RNA, 26 nt, Human
gcuccucccugccgccuccucucagu

SEQ ID NO: 73430 - RNA, 26 nt, Human
aguauuucacacucaguucucccuuu

SEQ ID NO: 73431 - RNA, 21 nt, Human
cccaccccaggccuugccccu

SEQ ID NO: 73432 - RNA, 25 nt, Human
uuucauugcuuuucaaaacaauaca

SEQ ID NO: 73433 - RNA, 20 nt, Human
guucucaccauggagugagu

SEQ ID NO: 73434 - RNA, 26 nt, Human
ccagcccagauucaacaggaaaccga

SEQ ID NO: 73435 - RNA, 23 nt, Human
ggauucucugagaaaugaugggg

SEQ ID NO: 73436 - RNA, 19 nt, Human
aaggggcagagauggaggc

SEQ ID NO: 73437 - RNA, 27 nt, Human
gcaaccaauaguuaagauuauauuuua

SEQ ID NO: 73438 - RNA, 24 nt, Human
cuguuauguagaggaaauacgagg

SEQ ID NO: 73439 - RNA, 27 nt, Human
uguugcccaggcuggagugcauuggcg

SEQ ID NO: 73440 - RNA, 21 nt, Human
gggacauugaggcugcaguga

SEQ ID NO: 73441 - RNA, 27 nt, Human
gcucuucuguuugcgguaucuacuuga

SEQ ID NO: 73442 - RNA, 23 nt, Human
uucugguucucacacuguacucu

SEQ ID NO: 73443 - RNA, 21 nt, Human
gucuuauguucucuguauuua

SEQ ID NO: 73444 - RNA, 25 nt, Human
agagagaugucuccgggcccuuauu

SEQ ID NO: 73445 - RNA, 20 nt, Human
agugagguggcaggagcagc

SEQ ID NO: 73446 - RNA, 25 nt, Human
ggacccgcuauuaucagaucaugcc

SEQ ID NO: 73447 - RNA, 22 nt, Human
guugcucaggcuggaguacagu

SEQ ID NO: 73448 - RNA, 23 nt, Human
caguugggacucaggauauuagu

SEQ ID NO: 73449 - RNA, 21 nt, Human
ugcauauguccugcccgugua

SEQ ID NO: 73450 - RNA, 17 nt, Human
ucagcauuuuuugcagc

SEQ ID NO: 73451 - RNA, 19 nt, Human
guagauucaaaaauccaga

SEQ ID NO: 73452 - RNA, 23 nt, Human
aacugcucucccucagcugggcu

SEQ ID NO: 73453 - RNA, 26 nt, Human
ucagcuuucauguacauaugguauag

SEQ ID NO: 73454 - RNA, 23 nt, Human
ggaaggagaaagagacauuacag

SEQ ID NO: 73455 - RNA, 20 nt, Human
ugucuuuggccacauagggc

SEQ ID NO: 73456 - RNA, 23 nt, Human
acugggaaauaaaaaccugggga

SEQ ID NO: 73457 - RNA, 30 nt, Human
ugaccuaccuaccccaucagaaauaacuuu

SEQ ID NO: 73458 - RNA, 21 nt, Human
gccccaggcuggagcagcaug

SEQ ID NO: 73459 - RNA, 22 nt, Human
ugagguccugaauauuuaauau

SEQ ID NO: 73460 - RNA, 25 nt, Human
cacugccuccuggguucaggugauu

SEQ ID NO: 73461 - RNA, 27 nt, Human
gccccccguguggcuuacaaauucuac

SEQ ID NO: 73462 - RNA, 19 nt, Human
cuucccuucuuuuugguuu

SEQ ID NO: 73463 - RNA, 29 nt, Human
cuguucccaggcccugcugcucccauccc

SEQ ID NO: 73464 - RNA, 21 nt, Human
aggcuuggauuccugggccug

SEQ ID NO: 73465 - RNA, 26 nt, Human
gcauuccguccaucuaagcucaucgu

SEQ ID NO: 73466 - RNA, 23 nt, Human
aagggagaagaaaggugaguuug

SEQ ID NO: 73467 - RNA, 18 nt, Human
cuuccacugccacucucu

SEQ ID NO: 73468 - RNA, 25 nt, Human
cacuguucaucuggccaaacaacug

SEQ ID NO: 73469 - RNA, 16 nt, Human
gcccaccccuccuucc

SEQ ID NO: 73470 - RNA, 23 nt, Human
agagcaaccuccagccuucucca

SEQ ID NO: 73471 - RNA, 22 nt, Human
ccccacccuccaggguuagggg

SEQ ID NO: 73472 - RNA, 22 nt, Human
cuuccugggucuccacucuccg

SEQ ID NO: 73473 - RNA, 19 nt, Human
ccacugcacuccagccuug

SEQ ID NO: 73474 - RNA, 20 nt, Human
cucaacacuuauuagugaca

SEQ ID NO: 73475 - RNA, 27 nt, Human
agucacacucuccaggcuggagugcag

SEQ ID NO: 73476 - RNA, 21 nt, Human
uaaaaagaauuccaccaggcu

SEQ ID NO: 73477 - RNA, 24 nt, Human
ggcugagaacacccagaacaggag

SEQ ID NO: 73478 - RNA, 28 nt, Human
gguugcacugcaaccaagugucagaguc

SEQ ID NO: 73479 - RNA, 19 nt, Human
gcuguugcagacucugccu

SEQ ID NO: 73480 - RNA, 24 nt, Human
ucucuucugccauugugcuggucc

SEQ ID NO: 73481 - RNA, 27 nt, Human
ugggaccccugcuccagcccgaaugac

SEQ ID NO: 73482 - RNA, 23 nt, Human
auccucucagacccucgcagcag

SEQ ID NO: 73483 - RNA, 23 nt, Human
cuaucugaccuuagacaggcggc

SEQ ID NO: 73484 - RNA, 27 nt, Human
ggauaguuggagagcagaaccuugcgc

SEQ ID NO: 73485 - RNA, 19 nt, Human
acuugugauugugccaaac

SEQ ID NO: 73486 - RNA, 22 nt, Human
cauaugauuguauuuguguaua

SEQ ID NO: 73487 - RNA, 26 nt, Human
gcuucccugccgcauccucuccccuc

SEQ ID NO: 73488 - RNA, 23 nt, Human
acacuccugccugcugugccuaa

SEQ ID NO: 73489 - RNA, 24 nt, Human
ccuuuacccccaaacuuucuaagg

SEQ ID NO: 73490 - RNA, 27 nt, Human
cuuccaucugcaucuuaacaugcucuc

SEQ ID NO: 73491 - RNA, 26 nt, Human
ugcagcccuggcccaucaugggggga

SEQ ID NO: 73492 - RNA, 20 nt, Human
guuucuacugcuaagaaggu

SEQ ID NO: 73493 - RNA, 23 nt, Human
ugccugcccaugccagcacuucc

SEQ ID NO: 73494 - RNA, 23 nt, Human
ucauccaguaauaaaauggaaga

SEQ ID NO: 73495 - RNA, 27 nt, Human
ccacugcacuggagcuuugaagaccua

SEQ ID NO: 73496 - RNA, 23 nt, Human
cuauucuguuucucuccugggcu

SEQ ID NO: 73497 - RNA, 22 nt, Human
gcaaucagcaggcugggcaccc

SEQ ID NO: 73498 - RNA, 22 nt, Human
ucagaguuuacaugcauuuuua

SEQ ID NO: 73499 - RNA, 23 nt, Human
gacagagaaccucagguguucuu

SEQ ID NO: 73500 - RNA, 20 nt, Human
ucaugcugguggacuucgag

SEQ ID NO: 73501 - RNA, 23 nt, Human
ccugcugcagucuacacagcuuc

SEQ ID NO: 73502 - RNA, 27 nt, Human
uccagaagcaugagcaacagcuaagca

SEQ ID NO: 73503 - RNA, 23 nt, Human
ccaggaggcagagguugggguga

SEQ ID NO: 73504 - RNA, 27 nt, Human
ccgcccagucugggacuccaccugccu

SEQ ID NO: 73505 - RNA, 20 nt, Human
uugcuacaacuucuaguuua

SEQ ID NO: 73506 - RNA, 22 nt, Human
ggggauggaguagaccugcugc

SEQ ID NO: 73507 - RNA, 23 nt, Human
ccaacuuguccuuugacaucacu

SEQ ID NO: 73508 - RNA, 21 nt, Human
ccucccggaagagcuucaaga

SEQ ID NO: 73509 - RNA, 20 nt, Human
cuggucccagaggagcuuga

SEQ ID NO: 73510 - RNA, 25 nt, Human
agucuuccuggaaguaauuguaagc

SEQ ID NO: 73511 - RNA, 18 nt, Human
uugauggggaggagggau

SEQ ID NO: 73512 - RNA, 20 nt, Human
gauaucugaauucaccagcu

SEQ ID NO: 73513 - RNA, 21 nt, Human
auguugugccuucuucuuaag

SEQ ID NO: 73514 - RNA, 22 nt, Human
gaacuccugaccucaagcaguc

SEQ ID NO: 73515 - RNA, 23 nt, Human
cagcauuuugucaagcacugugc

SEQ ID NO: 73516 - RNA, 22 nt, Human
uggagcuggaacagagggcugg

SEQ ID NO: 73517 - RNA, 22 nt, Human
cugcaaacccagcuacucggga

SEQ ID NO: 73518 - RNA, 24 nt, Human
cucgucuuuacuuccaucuguuug

SEQ ID NO: 73519 - RNA, 20 nt, Human
uaaaucaagaauauuugugg

SEQ ID NO: 73520 - RNA, 25 nt, Human
uuguggaacauuccguauaacggca

SEQ ID NO: 73521 - RNA, 27 nt, Human
acccaggcugccaggcuggaguggagu

SEQ ID NO: 73522 - RNA, 27 nt, Human
aacccaaguggccuuauccgugcagug

SEQ ID NO: 73523 - RNA, 22 nt, Human
uuggccccuaaaaggaccuguu

SEQ ID NO: 73524 - RNA, 17 nt, Human
cuucccuucccagacca

SEQ ID NO: 73525 - RNA, 19 nt, Human
auaaacacaccuguccccc

SEQ ID NO: 73526 - RNA, 18 nt, Human
aaaagugccuacagcccc

SEQ ID NO: 73527 - RNA, 26 nt, Human
gaacagcuucaggauacuuccaggag

SEQ ID NO: 73528 - RNA, 21 nt, Human
uucuacccacuccuuugcuuc

SEQ ID NO: 73529 - RNA, 20 nt, Human
gccagcucucagucccacag

SEQ ID NO: 73530 - RNA, 22 nt, Human
gucuacaccauuaugugcgcug

SEQ ID NO: 73531 - RNA, 21 nt, Human
ccccaucuguguucauggccu

SEQ ID NO: 73532 - RNA, 23 nt, Human
ucuccagcacgacucacccacuc

SEQ ID NO: 73533 - RNA, 22 nt, Human
uccugccucugcugaguguacc

SEQ ID NO: 73534 - RNA, 24 nt, Human
auucacuccauggugcucauugga

SEQ ID NO: 73535 - RNA, 24 nt, Human
auauuuuuauaugaaucaucuccu

SEQ ID NO: 73536 - RNA, 20 nt, Human
aagucuuugcuauugugaau

SEQ ID NO: 73537 - RNA, 26 nt, Human
accauuagacacucaccagauguuua

SEQ ID NO: 73538 - RNA, 20 nt, Human
gugaaauccagacaauugaa

SEQ ID NO: 73539 - RNA, 22 nt, Human
ucugcagcugaccucuguuguc

SEQ ID NO: 73540 - RNA, 26 nt, Human
cuuaaaacauggugccuauaucugag

SEQ ID NO: 73541 - RNA, 22 nt, Human
ggcucacugcaaccaccaucuc

SEQ ID NO: 73542 - RNA, 27 nt, Human
aguguguugcuucugucacuuuauauu

SEQ ID NO: 73543 - RNA, 23 nt, Human
cuuauuucuucauuaucucgacc

SEQ ID NO: 73544 - RNA, 23 nt, Human
cgccccaccaagagcuccuggcc

SEQ ID NO: 73545 - RNA, 26 nt, Human
gccauaguugacuuuuacauuccaua

SEQ ID NO: 73546 - RNA, 24 nt, Human
guuauggcuuaaaagcaaguuuca

SEQ ID NO: 73547 - RNA, 23 nt, Human
uucaacaacaccagaacugugug

SEQ ID NO: 73548 - RNA, 24 nt, Human
ggagggaucuaggauacagggcag

SEQ ID NO: 73549 - RNA, 20 nt, Human
ugaccuacuuccuccuagca

SEQ ID NO: 73550 - RNA, 23 nt, Human
uguuauacuuuaaaacugccuuc

SEQ ID NO: 73551 - RNA, 17 nt, Human
guaggugcaugccuuca

SEQ ID NO: 73552 - RNA, 26 nt, Human
gugccucuuuguuuuuccccaaacca

SEQ ID NO: 73553 - RNA, 22 nt, Human
aggagugacagaucacagggug

SEQ ID NO: 73554 - RNA, 21 nt, Human
ccaagcuuguuucccugcugg

SEQ ID NO: 73555 - RNA, 21 nt, Human
cgcuaccucacacccccggcu

SEQ ID NO: 73556 - RNA, 27 nt, Human
ccccaaaccuggagcagcaagugggca

SEQ ID NO: 73557 - RNA, 23 nt, Human
cgagugugugugcacauguuaca

SEQ ID NO: 73558 - RNA, 25 nt, Human
ccauugccucgcagaagaaagcucu

SEQ ID NO: 73559 - RNA, 27 nt, Human
cacugcagccucgaccuccuggacuca

SEQ ID NO: 73560 - RNA, 27 nt, Human
cucccacaugggcccaggccucaccau

SEQ ID NO: 73561 - RNA, 16 nt, Human
uucuacucuugucauu

SEQ ID NO: 73562 - RNA, 19 nt, Human
caccccccagccuccagag

SEQ ID NO: 73563 - RNA, 20 nt, Human
caauugucagaaggccgugg

SEQ ID NO: 73564 - RNA, 26 nt, Human
cucgcugucugcugucgucggugguc

SEQ ID NO: 73565 - RNA, 21 nt, Human
cuccccggaagaagaugagga

SEQ ID NO: 73566 - RNA, 21 nt, Human
acccugugggcuuaugucucu

SEQ ID NO: 73567 - RNA, 24 nt, Human
uucauucuucuuucuugaaauccc

SEQ ID NO: 73568 - RNA, 21 nt, Human
gacagcccuaucuggucccag

SEQ ID NO: 73569 - RNA, 22 nt, Human
ccaauauggugaaaccccaucu

SEQ ID NO: 73570 - RNA, 23 nt, Human
ccuugacacuccccuugcaaacc

SEQ ID NO: 73571 - RNA, 19 nt, Human
cggaaggaagggcacugug

SEQ ID NO: 73572 - RNA, 17 nt, Human
gagagggaagggaaagc

SEQ ID NO: 73573 - RNA, 26 nt, Human
acacacacaucucacucauccuucua

SEQ ID NO: 73574 - RNA, 22 nt, Human
gugacuugaaugagcagcacuu

SEQ ID NO: 73575 - RNA, 23 nt, Human
uguuuaauuacaacaagguggca

SEQ ID NO: 73576 - RNA, 26 nt, Human
uggaaagaggacgguugguugugugu

SEQ ID NO: 73577 - RNA, 23 nt, Human
ucaaugcccaacagggcaaccaa

SEQ ID NO: 73578 - RNA, 23 nt, Human
uguacacacaagaaggugggcug

SEQ ID NO: 73579 - RNA, 20 nt, Human
gguccuugccuggauuuuga

SEQ ID NO: 73580 - RNA, 23 nt, Human
cgcauucacucggggcaguauua

SEQ ID NO: 73581 - RNA, 27 nt, Human
gggagagauccggggaggaguugcacu

SEQ ID NO: 73582 - RNA, 21 nt, Human
cagggcagcuaguacucagua

SEQ ID NO: 73583 - RNA, 20 nt, Human
gccaccggcgggagugcagc

SEQ ID NO: 73584 - RNA, 22 nt, Human
uccuuugccuuacauuuccaua

SEQ ID NO: 73585 - RNA, 26 nt, Human
ccuccuggccagacgcugccgcugcc

SEQ ID NO: 73586 - RNA, 27 nt, Human
cuccaucuucgucucucaggauggcga

SEQ ID NO: 73587 - RNA, 24 nt, Human
gguacccauacauuugccuggcca

SEQ ID NO: 73588 - RNA, 22 nt, Human
cggugucuuguucugucacuca

SEQ ID NO: 73589 - RNA, 26 nt, Human
uuuccuuuuucuccucccgaaggaac

SEQ ID NO: 73590 - RNA, 26 nt, Human
ugguggaggcggcggaggcggcggcg

SEQ ID NO: 73591 - RNA, 20 nt, Human
uucugcaggcuguuuuccca

SEQ ID NO: 73592 - RNA, 29 nt, Human
agcucaacuugaagcuuucuugccugcag

SEQ ID NO: 73593 - RNA, 22 nt, Human
aaccucuuggguucaagugauu

SEQ ID NO: 73594 - RNA, 26 nt, Human
cugggauuacaggcuugagccaccgc

SEQ ID NO: 73595 - RNA, 29 nt, Human
gccucuaagcuguauuuuuuguuguugcu

SEQ ID NO: 73596 - RNA, 22 nt, Human
ucacagcacugcacugcagccu

SEQ ID NO: 73597 - RNA, 22 nt, Human
gggauuacaggcgugagccacc

SEQ ID NO: 73598 - RNA, 27 nt, Human
ucccuccaccccaggacgccacucauu

SEQ ID NO: 73599 - RNA, 21 nt, Human
ucgcucgucucuuccucucuc

SEQ ID NO: 73600 - RNA, 19 nt, Human
ccugggcucaaagauggga

SEQ ID NO: 73601 - RNA, 22 nt, Human
ugcaaccuccaccucccggguu

SEQ ID NO: 73602 - RNA, 24 nt, Human
gcuggaaaaguauguuagugcaaa

SEQ ID NO: 73603 - RNA, 26 nt, Human
agugccuuagaaguggcagaggugag

SEQ ID NO: 73604 - RNA, 22 nt, Human
ccagaaagugaucacaaaaaga

SEQ ID NO: 73605 - RNA, 18 nt, Human
aucagguauuaauggaaa

SEQ ID NO: 73606 - RNA, 21 nt, Human
gcuucucaucaccagaaggaa

SEQ ID NO: 73607 - RNA, 26 nt, Human
gcauuucucaugcuuuucuauaagau

SEQ ID NO: 73608 - RNA, 23 nt, Human
gcuccugcccaggccuggagacu

SEQ ID NO: 73609 - RNA, 22 nt, Human
agugcaggcagagccaucugcc

SEQ ID NO: 73610 - RNA, 27 nt, Human
guguaagccaccgcaccccgcccagcc

SEQ ID NO: 73611 - RNA, 21 nt, Human
ccagccugggcaacaaaguga

SEQ ID NO: 73612 - RNA, 29 nt, Human
cucauggaccagccgcacaacuuuugaag

SEQ ID NO: 73613 - RNA, 21 nt, Human
aagcccaaacuuuauuuuuau

SEQ ID NO: 73614 - RNA, 20 nt, Human
auuucuaccacaccuuugaa

SEQ ID NO: 73615 - RNA, 20 nt, Human
ugccuucagcaaaggucaga

SEQ ID NO: 73616 - RNA, 22 nt, Human
caggcggcagagguugcaguga

SEQ ID NO: 73617 - RNA, 21 nt, Human
acugcugguuuaaaaauauuu

SEQ ID NO: 73618 - RNA, 21 nt, Human
auccucucucuagggcagcag

SEQ ID NO: 73619 - RNA, 19 nt, Human
augucugagagaaccagag

SEQ ID NO: 73620 - RNA, 23 nt, Human
uaucugaaaucuucccucuuggc

SEQ ID NO: 73621 - RNA, 24 nt, Human
ucuccugccuccuccuaaguagcu

SEQ ID NO: 73622 - RNA, 21 nt, Human
uagaaagaauguguugccucc

SEQ ID NO: 73623 - RNA, 20 nt, Human
uaguagauuguuuuuuccua

SEQ ID NO: 73624 - RNA, 21 nt, Human
agguaccccuucuuaucagcg

SEQ ID NO: 73625 - RNA, 22 nt, Human
acugggaaggcaauuucauacu

SEQ ID NO: 73626 - RNA, 27 nt, Human
uuauagaaaacccacacccacuguccu

SEQ ID NO: 73627 - RNA, 24 nt, Human
uuuuacuccuccuuuucauucaua

SEQ ID NO: 73628 - RNA, 26 nt, Human
gguuguuaaggaacuuacacugggga

SEQ ID NO: 73629 - RNA, 22 nt, Human
agagaggcuggcaaggaguucg

SEQ ID NO: 73630 - RNA, 21 nt, Human
cuuuugcccaggcuggagugc

SEQ ID NO: 73631 - RNA, 23 nt, Human
gcagcacagaguccccuggggcu

SEQ ID NO: 73632 - RNA, 20 nt, Human
gaucuucccugggggacuuu

SEQ ID NO: 73633 - RNA, 27 nt, Human
cucccucugcccucaucaaacccacag

SEQ ID NO: 73634 - RNA, 29 nt, Human
uuucauaaguaauucuccccacuugauuu

SEQ ID NO: 73635 - RNA, 22 nt, Human
uaaugaagccugcaugugccca

SEQ ID NO: 73636 - RNA, 22 nt, Human
uagcgcagcaguucgcagcgau

SEQ ID NO: 73637 - RNA, 26 nt, Human
cgcggauccuggccgcugcucuccag

SEQ ID NO: 73638 - RNA, 22 nt, Human
cugaggugggaggaucgcuuga

SEQ ID NO: 73639 - RNA, 24 nt, Human
gcucacaucuuacucagcaucaga

SEQ ID NO: 73640 - RNA, 21 nt, Human
uugccccacugcugugcaaug

SEQ ID NO: 73641 - RNA, 26 nt, Human
cccuccagaacuucaggcucucagug

SEQ ID NO: 73642 - RNA, 32 nt, Human
cauacauuucucauaccuuccccacaucugag

SEQ ID NO: 73643 - RNA, 20 nt, Human
acuucaccuucuguaauacu

SEQ ID NO: 73644 - RNA, 22 nt, Human
gccugagguccucaccuuccuc

SEQ ID NO: 73645 - RNA, 21 nt, Human
gucuucuguagggguauggug

SEQ ID NO: 73646 - RNA, 21 nt, Human
aaaugauuuuuacaaguuuua

SEQ ID NO: 73647 - RNA, 27 nt, Human
cucugguggcugggauucagaugccac

SEQ ID NO: 73648 - RNA, 21 nt, Human
uguaaggggguacagugcagu

SEQ ID NO: 73649 - RNA, 22 nt, Human
cacccaggcugcggagacucac

SEQ ID NO: 73650 - RNA, 25 nt, Human
agcaucuguaguguccaucagcagg

SEQ ID NO: 73651 - RNA, 23 nt, Human
ucucugacccucuccccacugcu

SEQ ID NO: 73652 - RNA, 25 nt, Human
ggaaaagagaagggcugcucaggga

SEQ ID NO: 73653 - RNA, 26 nt, Human
gcucacugcagcuuugaucugaccgc

SEQ ID NO: 73654 - RNA, 27 nt, Human
ccaacugggccucugauguucuuccag

SEQ ID NO: 73655 - RNA, 21 nt, Human
ccaagugcugggauuacaggc

SEQ ID NO: 73656 - RNA, 16 nt, Human
ggacuugccuccuggu

SEQ ID NO: 73657 - RNA, 26 nt, Human
ugaaaucccauggaagguugugcuca

SEQ ID NO: 73658 - RNA, 24 nt, Human
uucagccgccaccggcacggccag

SEQ ID NO: 73659 - RNA, 20 nt, Human
aguucacacuguguccccag

SEQ ID NO: 73660 - RNA, 27 nt, Human
uugggaggccgaggugggaggauugcu

SEQ ID NO: 73661 - RNA, 23 nt, Human
ugucgccagccucuggguccagc

SEQ ID NO: 73662 - RNA, 19 nt, Human
ccaguagcugccaaaaaga

SEQ ID NO: 73663 - RNA, 20 nt, Human
ucaggaaaacacccagggaa

SEQ ID NO: 73664 - RNA, 22 nt, Human
uuuuaaacugccaaauuaccuu

SEQ ID NO: 73665 - RNA, 25 nt, Human
uggaaugcuguguccucucuucugu

SEQ ID NO: 73666 - RNA, 21 nt, Human
ccagacaaagccgcgagccca

SEQ ID NO: 73667 - RNA, 26 nt, Human
ccuccugccuuggccuccuggcugcu

SEQ ID NO: 73668 - RNA, 20 nt, Human
ucucucucccucccucucuc

SEQ ID NO: 73669 - RNA, 23 nt, Human
auuuuuuaaaguggggaagaauc

SEQ ID NO: 73670 - RNA, 24 nt, Human
agcucucccucacaccucccuuca

SEQ ID NO: 73671 - RNA, 22 nt, Human
uucaaacgauucuccugccuca

SEQ ID NO: 73672 - RNA, 21 nt, Human
guuccucccuucccccucgcc

SEQ ID NO: 73673 - RNA, 17 nt, Human
ggguuuuccaaugugac

SEQ ID NO: 73674 - RNA, 22 nt, Human
accuucucccccaagugugaca

SEQ ID NO: 73675 - RNA, 20 nt, Human
ugucaccaggauuacuaguc

SEQ ID NO: 73676 - RNA, 28 nt, Human
gacuccgucucuaccaaaaaauauauaa

SEQ ID NO: 73677 - RNA, 21 nt, Human
ucugcagcuggugcaaaagcu

SEQ ID NO: 73678 - RNA, 23 nt, Human
gggccaaucacugaguuuguggu

SEQ ID NO: 73679 - RNA, 22 nt, Human
agcaccccccuugcggcucagc

SEQ ID NO: 73680 - RNA, 25 nt, Human
aaaacacucuuaucagccugggcaa

SEQ ID NO: 73681 - RNA, 23 nt, Human
agcugguugagguuucaaaccuc

SEQ ID NO: 73682 - RNA, 23 nt, Human
augacaguacagacugagauuug

SEQ ID NO: 73683 - RNA, 23 nt, Human
caacagggguguuccacagggua

SEQ ID NO: 73684 - RNA, 17 nt, Human
uuuccucugccugcgcc

SEQ ID NO: 73685 - RNA, 26 nt, Human
gaggcugagaggucaagguugcagug

SEQ ID NO: 73686 - RNA, 20 nt, Human
auucugcugccaucuuagcu

SEQ ID NO: 73687 - RNA, 26 nt, Human
aggaggcgcgagaauggagguggagg

SEQ ID NO: 73688 - RNA, 22 nt, Human
aggguccaagaguucaucagga

SEQ ID NO: 73689 - RNA, 20 nt, Human
uugagaccagccaccaaacc

SEQ ID NO: 73690 - RNA, 23 nt, Human
gaagcagcaggccaugcaccccc

SEQ ID NO: 73691 - RNA, 26 nt, Human
ucaggcugagggucuuugcugugcac

SEQ ID NO: 73692 - RNA, 24 nt, Human
ugaacuuuaagaagcaguguuuua

SEQ ID NO: 73693 - RNA, 23 nt, Human
cccacgcugguuucugugcagug

SEQ ID NO: 73694 - RNA, 22 nt, Human
uuauagcaaccucucucuaccc

SEQ ID NO: 73695 - RNA, 22 nt, Human
guacuugguuauccagugcagu

SEQ ID NO: 73696 - RNA, 22 nt, Human
ucacaugcacagggauuuaaca

SEQ ID NO: 73697 - RNA, 22 nt, Human
ugggcaauauagugaaacccca

SEQ ID NO: 73698 - RNA, 24 nt, Human
uuugcuuucucuuuacuuuagaca

SEQ ID NO: 73699 - RNA, 22 nt, Human
ugaauuuccucccuuggggaag

SEQ ID NO: 73700 - RNA, 27 nt, Human
ggcuggguuaagaacucgagucuucca

SEQ ID NO: 73701 - RNA, 21 nt, Human
cuggggcauggagaggucuga

SEQ ID NO: 73702 - RNA, 22 nt, Human
gaauguaacacuguggacauug

SEQ ID NO: 73703 - RNA, 19 nt, Human
gaucccggccaaggcggag

SEQ ID NO: 73704 - RNA, 15 nt, Human
caggaagcagaggag

SEQ ID NO: 73705 - RNA, 23 nt, Human
gucccauuucauucucuugcuuu

SEQ ID NO: 73706 - RNA, 20 nt, Human
agcaggaagcaaaguugguu

SEQ ID NO: 73707 - RNA, 27 nt, Human
cuacuacacuccagccuggugacagag

SEQ ID NO: 73708 - RNA, 26 nt, Human
ccugcagcucuucagagccacagacc

SEQ ID NO: 73709 - RNA, 26 nt, Human
gccuaucuauugcucuuaguuuuccc

SEQ ID NO: 73710 - RNA, 18 nt, Human
cccuuugcacacaggggc

SEQ ID NO: 73711 - RNA, 25 nt, Human
gacugggucuaugaauagaggugga

SEQ ID NO: 73712 - RNA, 19 nt, Human
uggagcaggcccaucugcc

SEQ ID NO: 73713 - RNA, 24 nt, Human
ugcugggacaacuaagaagagaga

SEQ ID NO: 73714 - RNA, 22 nt, Human
ucaugugagccucgugucaucu

SEQ ID NO: 73715 - RNA, 22 nt, Human
gcgcacaccuguaauccuagcu

SEQ ID NO: 73716 - RNA, 21 nt, Human
ccucuccuugcccugccucag

SEQ ID NO: 73717 - RNA, 24 nt, Human
gguuucugagccuucugcccugcg

SEQ ID NO: 73718 - RNA, 32 nt, Human
ucagauccagaaggagcaagaaucaaguuugg

SEQ ID NO: 73719 - RNA, 21 nt, Human
caaagcccagccucuuugucu

SEQ ID NO: 73720 - RNA, 21 nt, Human
aaagucagcacagcuuuucuu

SEQ ID NO: 73721 - RNA, 22 nt, Human
ugauuccuuguaaaauauuuuc

SEQ ID NO: 73722 - RNA, 16 nt, Human
cccauaaaaagccuuc

SEQ ID NO: 73723 - RNA, 22 nt, Human
auagcacaugauuugggcucua

SEQ ID NO: 73724 - RNA, 22 nt, Human
cucacccugugcguggccuugu

SEQ ID NO: 73725 - RNA, 25 nt, Human
accucugcuccuuccugcucacauc

SEQ ID NO: 73726 - RNA, 24 nt, Human
ggggagcaggggguggcagagggc

SEQ ID NO: 73727 - RNA, 28 nt, Human
aguucugcuacaaccucuagaucugcag

SEQ ID NO: 73728 - RNA, 20 nt, Human
gcagccgccuugcugcgugg

SEQ ID NO: 73729 - RNA, 22 nt, Human
gaccagcccggccaacauggug

SEQ ID NO: 73730 - RNA, 20 nt, Human
cugucucucuucuuucuguc

SEQ ID NO: 73731 - RNA, 26 nt, Human
ccaaguagcugggauuacagucaggc

SEQ ID NO: 73732 - RNA, 21 nt, Human
agauccggaagcacagccccg

SEQ ID NO: 73733 - RNA, 21 nt, Human
ccaagaauuggcaaauuugca

SEQ ID NO: 73734 - RNA, 24 nt, Human
ucugggcaacagaaugagauccug

SEQ ID NO: 73735 - RNA, 20 nt, Human
aguucagagagcgguaccuu

SEQ ID NO: 73736 - RNA, 21 nt, Human
cuacauuagaaagcagcagau

SEQ ID NO: 73737 - RNA, 20 nt, Human
gccuguaaucagcucuccug

SEQ ID NO: 73738 - RNA, 19 nt, Human
ugggugugggaugaaggug

SEQ ID NO: 73739 - RNA, 22 nt, Human
cgcacaggcuggagugcagugg

SEQ ID NO: 73740 - RNA, 24 nt, Human
gggaggggcaggagagggauaugg

SEQ ID NO: 73741 - RNA, 27 nt, Human
accagccucggcaacauggcaaaaucu

SEQ ID NO: 73742 - RNA, 19 nt, Human
agaacuccggggaaacugg

SEQ ID NO: 73743 - RNA, 21 nt, Human
cagcccagagacauacuugaa

SEQ ID NO: 73744 - RNA, 21 nt, Human
aguucacugcaacuucugccu

SEQ ID NO: 73745 - RNA, 22 nt, Human
aggcuggagugcaguggcauaa

SEQ ID NO: 73746 - RNA, 22 nt, Human
aggcuggaguguaguggcacaa

SEQ ID NO: 73747 - RNA, 27 nt, Human
caccugcaucagccucuggccagacgg

SEQ ID NO: 73748 - RNA, 27 nt, Human
agucuccgcccugauuggaugaggaaa

SEQ ID NO: 73749 - RNA, 26 nt, Human
gcugucucucuggcuccugaccuggc

SEQ ID NO: 73750 - RNA, 26 nt, Human
ucugggcuggggucggcccugggcag

SEQ ID NO: 73751 - RNA, 27 nt, Human
cugggcaacaagagcaaaacuccgucu

SEQ ID NO: 73752 - RNA, 26 nt, Human
cacagaacaguuccagaucuagacug

SEQ ID NO: 73753 - RNA, 20 nt, Human
ccaucugaaagugguacuug

SEQ ID NO: 73754 - RNA, 21 nt, Human
cccccagggcauuugccucca

SEQ ID NO: 73755 - RNA, 20 nt, Human
ccccuuuucuccagaaaagc

SEQ ID NO: 73756 - RNA, 21 nt, Human
ggaggugggggaagagcugaa

SEQ ID NO: 73757 - RNA, 22 nt, Human
gugccucaccucccccugccuc

SEQ ID NO: 73758 - RNA, 21 nt, Human
uaucagcuagcaucaggacag

SEQ ID NO: 73759 - RNA, 27 nt, Human
cacuguuguaguuuagaaggcuuuuca

SEQ ID NO: 73760 - RNA, 21 nt, Human
cuccaaaugacuuugguuccc

SEQ ID NO: 73761 - RNA, 24 nt, Human
ggaaucacuugcuuuuauguccac

SEQ ID NO: 73762 - RNA, 20 nt, Human
cauuacaguauuuugcuuaa

SEQ ID NO: 73763 - RNA, 19 nt, Human
gcccagacugaagugcagu

SEQ ID NO: 73764 - RNA, 24 nt, Human
cuuuucucccauuucuugcuagcu

SEQ ID NO: 73765 - RNA, 27 nt, Human
aaagugcugggauuacagaugugagcc

SEQ ID NO: 73766 - RNA, 20 nt, Human
augaaaauuuuuuaggauaa

SEQ ID NO: 73767 - RNA, 22 nt, Human
cuccugagaauuccuguuacag

SEQ ID NO: 73768 - RNA, 23 nt, Human
gaccugucugaauuauaaaccag

SEQ ID NO: 73769 - RNA, 24 nt, Human
ggaagcuuccugccuuuuucuuug

SEQ ID NO: 73770 - RNA, 23 nt, Human
ugugcuccugggcuacaaggacc

SEQ ID NO: 73771 - RNA, 19 nt, Human
ggguggccaaacaggucag

SEQ ID NO: 73772 - RNA, 27 nt, Human
ccugccugccccacugugcuggcagga

SEQ ID NO: 73773 - RNA, 26 nt, Human
ugugaauucugccacugugcccagcu

SEQ ID NO: 73774 - RNA, 25 nt, Human
ugaacuucuguuguccucaagcaug

SEQ ID NO: 73775 - RNA, 25 nt, Human
cuaacauggugaugggcucccuccc

SEQ ID NO: 73776 - RNA, 21 nt, Human
ucgcacccacccacccccuca

SEQ ID NO: 73777 - RNA, 22 nt, Human
ucggaggcacagaagcugcaaa

SEQ ID NO: 73778 - RNA, 23 nt, Human
caguggaguccuggcuccagagc

SEQ ID NO: 73779 - RNA, 22 nt, Human
ugucacccaggcuggacugcaa

SEQ ID NO: 73780 - RNA, 21 nt, Human
aguuaaaucacuagaaauuua

SEQ ID NO: 73781 - RNA, 27 nt, Human
gaccagccuggccaauauggcaaaacc

SEQ ID NO: 73782 - RNA, 21 nt, Human
cucccuggccugucuccccac

SEQ ID NO: 73783 - RNA, 21 nt, Human
uaagagggagagaggggaggc

SEQ ID NO: 73784 - RNA, 19 nt, Human
caguguacacgucuggacc

SEQ ID NO: 73785 - RNA, 21 nt, Human
ucucucuccaaguuuaucuca

SEQ ID NO: 73786 - RNA, 23 nt, Human
uggauguggauuuggaaggggac

SEQ ID NO: 73787 - RNA, 22 nt, Human
ucucucuggauuuccuuuugcu

SEQ ID NO: 73788 - RNA, 22 nt, Human
ccuguuuucgcaccuaccauca

SEQ ID NO: 73789 - RNA, 27 nt, Human
agcaagacuaugaaaggcucagauuuc

SEQ ID NO: 73790 - RNA, 22 nt, Human
gugaggagugucugcugucacc

SEQ ID NO: 73791 - RNA, 19 nt, Human
gaagacuucacuguggaag

SEQ ID NO: 73792 - RNA, 27 nt, Human
accuaaggcuggaugggaaagugcagu

SEQ ID NO: 73793 - RNA, 25 nt, Human
aucuucuucuuguaaaagugcuuuu

SEQ ID NO: 73794 - RNA, 21 nt, Human
gaaaccuauuuccaaaaaagg

SEQ ID NO: 73795 - RNA, 19 nt, Human
uccucaagaguugggaugg

SEQ ID NO: 73796 - RNA, 29 nt, Human
ucuuuggcucugcuguagucugauuggag

SEQ ID NO: 73797 - RNA, 23 nt, Human
cuuggagagaggugagcaaccaa

SEQ ID NO: 73798 - RNA, 24 nt, Human
caggggcacaagcccagguccugc

SEQ ID NO: 73799 - RNA, 21 nt, Human
ccagcacugugggggccuuca

SEQ ID NO: 73800 - RNA, 20 nt, Human
uugaguuuaaaaaauaaaca

SEQ ID NO: 73801 - RNA, 28 nt, Human
ugaugcaauuacgucaucacccagcuga

SEQ ID NO: 73802 - RNA, 24 nt, Human
cgacucgagcagugccacuuuaaa

SEQ ID NO: 73803 - RNA, 27 nt, Human
ugauggcccuucgugauaagucagcug

SEQ ID NO: 73804 - RNA, 26 nt, Human
caagaucauagcucauugcaagcuca

SEQ ID NO: 73805 - RNA, 21 nt, Human
guugcaucuucuguaggacca

SEQ ID NO: 73806 - RNA, 27 nt, Human
aagaauugacuggggcaauaacguuua

SEQ ID NO: 73807 - RNA, 27 nt, Human
accaggauuuaaguuucacagcacuua

SEQ ID NO: 73808 - RNA, 20 nt, Human
uucucuggcucccaaaagga

SEQ ID NO: 73809 - RNA, 22 nt, Human
cuccucccucagacccaggagu

SEQ ID NO: 73810 - RNA, 24 nt, Human
agaacaaugacaaacacccacuua

SEQ ID NO: 73811 - RNA, 30 nt, Human
ggcugcccugacccuuccacagucauuucu

SEQ ID NO: 73812 - RNA, 19 nt, Human
agcucuccaggacuggaaa

SEQ ID NO: 73813 - RNA, 22 nt, Human
gggcaggucacccucccugucu

SEQ ID NO: 73814 - RNA, 26 nt, Human
auggaaagugaaccaaaaaggcuaga

SEQ ID NO: 73815 - RNA, 24 nt, Human
uuuauuccugugucuuggcuguca

SEQ ID NO: 73816 - RNA, 25 nt, Human
gcccauuguuucugucaugguuucc

SEQ ID NO: 73817 - RNA, 24 nt, Human
gggggaagggggacggagaaugac

SEQ ID NO: 73818 - RNA, 28 nt, Human
ggcugcggaaagcggagggaguccgacg

SEQ ID NO: 73819 - RNA, 22 nt, Human
uuuggaaucuaaccacuuaagg

SEQ ID NO: 73820 - RNA, 21 nt, Human
ccaccgaggcauaguguagaa

SEQ ID NO: 73821 - RNA, 23 nt, Human
guagggggaggggcuggggaaga

SEQ ID NO: 73822 - RNA, 26 nt, Human
ccuggcugcugauccugagccugcug

SEQ ID NO: 73823 - RNA, 22 nt, Human
cucagccucccaaguagcuugg

SEQ ID NO: 73824 - RNA, 21 nt, Human
aagcacauuccucagcaggau

SEQ ID NO: 73825 - RNA, 21 nt, Human
ccgccuggccaugaccggggc

SEQ ID NO: 73826 - RNA, 29 nt, Human
ccugcuuaggauucuguucccugggcuga

SEQ ID NO: 73827 - RNA, 25 nt, Human
uaacuggacaacuuugaguacugac

SEQ ID NO: 73828 - RNA, 27 nt, Human
gguuccuuuuucaacuuggaaaaagaa

SEQ ID NO: 73829 - RNA, 22 nt, Human
aggcugagguaggagaaucguu

SEQ ID NO: 73830 - RNA, 22 nt, Human
augaugaggccuucaucuacug

SEQ ID NO: 73831 - RNA, 20 nt, Human
auuccuggucaaagcuccuu

SEQ ID NO: 73832 - RNA, 25 nt, Human
gagacuaagggcuacaggccagcgu

SEQ ID NO: 73833 - RNA, 22 nt, Human
ggggagggaagggacagaggaa

SEQ ID NO: 73834 - RNA, 23 nt, Human
gacaugaggcagcauuuccucca

SEQ ID NO: 73835 - RNA, 20 nt, Human
ggugacgccacagggcagcg

SEQ ID NO: 73836 - RNA, 18 nt, Human
acaucucagcaucucuua

SEQ ID NO: 73837 - RNA, 20 nt, Human
uuguaaaauaaaguuuucua

SEQ ID NO: 73838 - RNA, 31 nt, Human
cugcaccuccaccugccccagccccugccuc

SEQ ID NO: 73839 - RNA, 26 nt, Human
ucuggaggcugaggcaggagaauugc

SEQ ID NO: 73840 - RNA, 22 nt, Human
gcacagcccaggccacagccag

SEQ ID NO: 73841 - RNA, 26 nt, Human
gccgacaacagagacuggacuguggg

SEQ ID NO: 73842 - RNA, 21 nt, Human
ucuccacccccuuacucugcu

SEQ ID NO: 73843 - RNA, 26 nt, Human
cugagcgggauuuuugggcucuccgg

SEQ ID NO: 73844 - RNA, 20 nt, Human
caguucugcaaagauucguc

SEQ ID NO: 73845 - RNA, 21 nt, Human
uuucuggggccucccccacca

SEQ ID NO: 73846 - RNA, 26 nt, Human
ugcuuccugggaagaucuuugcaauu

SEQ ID NO: 73847 - RNA, 27 nt, Human
ggaggcugagguugcaggaucgcuuga

SEQ ID NO: 73848 - RNA, 25 nt, Human
cccagccaacaggaagcccagccuu

SEQ ID NO: 73849 - RNA, 23 nt, Human
ccccucggggcagaguuugcaca

SEQ ID NO: 73850 - RNA, 21 nt, Human
cacugcagccccucugccccu

SEQ ID NO: 73851 - RNA, 21 nt, Human
ccuucgacuuccugaagcugg

SEQ ID NO: 73852 - RNA, 26 nt, Human
ugaccucauuucaaauuugugcagug

SEQ ID NO: 73853 - RNA, 24 nt, Human
uucaauucagucuuuacuuugcca

SEQ ID NO: 73854 - RNA, 21 nt, Human
auggauaauccgcaugacaga

SEQ ID NO: 73855 - RNA, 30 nt, Human
gcacuuccuugccagucuuuagugaucagg

SEQ ID NO: 73856 - RNA, 20 nt, Human
ucggucucaaaaacaaaaca

SEQ ID NO: 73857 - RNA, 24 nt, Human
agccuccugccuccgccuuuguuu

SEQ ID NO: 73858 - RNA, 21 nt, Human
gcuaggguagagaaggacgca

SEQ ID NO: 73859 - RNA, 22 nt, Human
acuguguaacuuucucuuaaga

SEQ ID NO: 73860 - RNA, 25 nt, Human
cucauuucuuagcagccucucuaca

SEQ ID NO: 73861 - RNA, 24 nt, Human
ucauccacaggguuuucucacugc

SEQ ID NO: 73862 - RNA, 27 nt, Human
ccugccugggccccuccugggacuuua

SEQ ID NO: 73863 - RNA, 20 nt, Human
acugugguuaaaaacacaug

SEQ ID NO: 73864 - RNA, 22 nt, Human
cacuggccgauucuggucucca

SEQ ID NO: 73865 - RNA, 19 nt, Human
guugauuuaaacucuuaga

SEQ ID NO: 73866 - RNA, 25 nt, Human
uacuucuccuucugucucuuggaaa

SEQ ID NO: 73867 - RNA, 21 nt, Human
caacaccacuaggaaucccag

SEQ ID NO: 73868 - RNA, 24 nt, Human
agggcuucagaguccaauuuugcu

SEQ ID NO: 73869 - RNA, 23 nt, Human
cacacacucucugccaugcacac

SEQ ID NO: 73870 - RNA, 27 nt, Human
cuucagagcugacacaggaugaaggca

SEQ ID NO: 73871 - RNA, 22 nt, Human
cuaacucccuguucuccugccu

SEQ ID NO: 73872 - RNA, 26 nt, Human
acagcaggugacaggccuagcuauag

SEQ ID NO: 73873 - RNA, 21 nt, Human
uugcagcuucaccugccuggg

SEQ ID NO: 73874 - RNA, 20 nt, Human
cuguggcucccaaaaggccu

SEQ ID NO: 73875 - RNA, 24 nt, Human
ggcauucggaauggaaauguaaua

SEQ ID NO: 73876 - RNA, 20 nt, Human
cuaguguccccaucuguaaa

SEQ ID NO: 73877 - RNA, 26 nt, Human
ucucuacugcuggacuuuucagaguc

SEQ ID NO: 73878 - RNA, 20 nt, Human
cuuccuggaugugcccucuc

SEQ ID NO: 73879 - RNA, 26 nt, Human
ugacuuccccagcaaggaucuuccca

SEQ ID NO: 73880 - RNA, 23 nt, Human
cauaauaguugaaagaucaagau

SEQ ID NO: 73881 - RNA, 19 nt, Human
agccucgggaagccccugg

SEQ ID NO: 73882 - RNA, 25 nt, Human
acauuuagauacaggaaaauuuuac

SEQ ID NO: 73883 - RNA, 21 nt, Human
ugugauaaguucuagugcagu

SEQ ID NO: 73884 - RNA, 22 nt, Human
uauugagcaccuacuacaugca

SEQ ID NO: 73885 - RNA, 22 nt, Human
uauucacaaccaugugucuuca

SEQ ID NO: 73886 - RNA, 24 nt, Human
uggaaugauugguuaaaaugugau

SEQ ID NO: 73887 - RNA, 23 nt, Human
gucacccaggcuggggcgcaaug

SEQ ID NO: 73888 - RNA, 30 nt, Human
agccaguccccccuguuguguuccaugugc

SEQ ID NO: 73889 - RNA, 27 nt, Human
gccugagcccggcgaggguggggaggg

SEQ ID NO: 73890 - RNA, 26 nt, Human
caggccugcagucucauccugcccuu

SEQ ID NO: 73891 - RNA, 22 nt, Human
ccucuccugggggccuggagag

SEQ ID NO: 73892 - RNA, 27 nt, Human
uacugcacucagauuuaagccuuacaa

SEQ ID NO: 73893 - RNA, 20 nt, Human
uuugccucgggaaucgcugc

SEQ ID NO: 73894 - RNA, 23 nt, Human
uuuccuugagcucucuggacacu

SEQ ID NO: 73895 - RNA, 20 nt, Human
ucgcggaccucagcccugca

SEQ ID NO: 73896 - RNA, 27 nt, Human
ccugccugugcuccugcuggggaaggc

SEQ ID NO: 73897 - RNA, 21 nt, Human
cuggccgcgggggcaggggag

SEQ ID NO: 73898 - RNA, 22 nt, Human
auugcaguucagcaaagccgga

SEQ ID NO: 73899 - RNA, 21 nt, Human
caggagauggaaguugcagug

SEQ ID NO: 73900 - RNA, 27 nt, Human
ggcugugauguaaagggguugaccuca

SEQ ID NO: 73901 - RNA, 22 nt, Human
ggcgaucugugcuaagagguca

SEQ ID NO: 73902 - RNA, 26 nt, Human
cuugcauuccccuugcugaauggcgu

SEQ ID NO: 73903 - RNA, 22 nt, Human
ccacugcacuccagccuaggug

SEQ ID NO: 73904 - RNA, 24 nt, Human
ucugucgccaggcuggagugcagu

SEQ ID NO: 73905 - RNA, 17 nt, Human
aaaugcucuagugccuu

SEQ ID NO: 73906 - RNA, 25 nt, Human
cuaggcuuucaaagucaaaggguga

SEQ ID NO: 73907 - RNA, 22 nt, Human
cacaccuguaauaccagcaguu

SEQ ID NO: 73908 - RNA, 24 nt, Human
cccagccugcggcccuggagcgcu

SEQ ID NO: 73909 - RNA, 24 nt, Human
agacaagcauugggucagacccau

SEQ ID NO: 73910 - RNA, 21 nt, Human
ggaaacagaucucagcaaagc

SEQ ID NO: 73911 - RNA, 28 nt, Human
ccuucuuuauccccuccuuuggcaucca

SEQ ID NO: 73912 - RNA, 27 nt, Human
ucacuuaaaaucaaauuuuucugggaa

SEQ ID NO: 73913 - RNA, 18 nt, Human
aaagugcuccuaagccca

SEQ ID NO: 73914 - RNA, 25 nt, Human
uuaaagguggugagaagugaacauu

SEQ ID NO: 73915 - RNA, 22 nt, Human
cugcuguuggcuggagcaugug

SEQ ID NO: 73916 - RNA, 25 nt, Human
cugcucccucuaccccuuaccccac

SEQ ID NO: 73917 - RNA, 26 nt, Human
gcaccuaggcggaggcggcgcaggcu

SEQ ID NO: 73918 - RNA, 26 nt, Human
cugggagcagaggugaggccagaaag

SEQ ID NO: 73919 - RNA, 24 nt, Human
cagagaucguuuuguggaauagca

SEQ ID NO: 73920 - RNA, 26 nt, Human
cagguauuuuuguuucauuuuguuuu

SEQ ID NO: 73921 - RNA, 22 nt, Human
caggaaaauguauccagaggaa

SEQ ID NO: 73922 - RNA, 19 nt, Human
uuuucaucuugcuguuuuc

SEQ ID NO: 73923 - RNA, 17 nt, Human
acaacuuggggugggaa

SEQ ID NO: 73924 - RNA, 15 nt, Human
gggcagcagcagugg

SEQ ID NO: 73925 - RNA, 22 nt, Human
ccugcugccccucccugccucc

SEQ ID NO: 73926 - RNA, 27 nt, Human
acugcaacuuccguccagugcugugau

SEQ ID NO: 73927 - RNA, 26 nt, Human
gaccaugguguuguucuugaugacau

SEQ ID NO: 73928 - RNA, 22 nt, Human
gcugcuccagucucagccuggg

SEQ ID NO: 73929 - RNA, 26 nt, Human
ccuaaccuuagaacacauuuguaacu

SEQ ID NO: 73930 - RNA, 26 nt, Human
uaguccagucugugcuccugggcuac

SEQ ID NO: 73931 - RNA, 25 nt, Human
aauucuccuuuagggacagcuuaga

SEQ ID NO: 73932 - RNA, 24 nt, Human
uucucacccucuaggcccugugcc

SEQ ID NO: 73933 - RNA, 26 nt, Human
cucgcuacgucuugaaccuuuuguau

SEQ ID NO: 73934 - RNA, 21 nt, Human
guaaaaaucucauuauugcca

SEQ ID NO: 73935 - RNA, 22 nt, Human
auuuggcuuuucuuuaccaguu

SEQ ID NO: 73936 - RNA, 23 nt, Human
aucccuuccuuccucuucgguga

SEQ ID NO: 73937 - RNA, 26 nt, Human
uuauauuguagaaggaaacaccaaga

SEQ ID NO: 73938 - RNA, 27 nt, Human
ucauauauuucuccuucaguccauucc

SEQ ID NO: 73939 - RNA, 23 nt, Human
ucaagacgcucuccaaagggcag

SEQ ID NO: 73940 - RNA, 22 nt, Human
gcuccaggaccucggcccuugg

SEQ ID NO: 73941 - RNA, 19 nt, Human
uccacugugcuauuacaaa

SEQ ID NO: 73942 - RNA, 22 nt, Human
aguauguuagaugcaguagacg

SEQ ID NO: 73943 - RNA, 19 nt, Human
gcugcuuccuguuggcugg

SEQ ID NO: 73944 - RNA, 21 nt, Human
ggcuccaacacugcugcucca

SEQ ID NO: 73945 - RNA, 22 nt, Human
cugcagccucaaccuccugggc

SEQ ID NO: 73946 - RNA, 27 nt, Human
cgaguggggccaaggaggcagccggga

SEQ ID NO: 73947 - RNA, 26 nt, Human
uguagcccaggcuggagugcaauggc

SEQ ID NO: 73948 - RNA, 23 nt, Human
cuauagugaggccuuauugccag

SEQ ID NO: 73949 - RNA, 24 nt, Human
agaccuuaacccaccaaccugccu

SEQ ID NO: 73950 - RNA, 22 nt, Human
auguucauucucaucaguguga

SEQ ID NO: 73951 - RNA, 22 nt, Human
ugucgcucaggcuggagugcag

SEQ ID NO: 73952 - RNA, 24 nt, Human
aucaagggagaggccaggcgcagc

SEQ ID NO: 73953 - RNA, 23 nt, Human
acuuuacaugacacagcuuuauc

SEQ ID NO: 73954 - RNA, 21 nt, Human
gcacagcccuuguucugccag

SEQ ID NO: 73955 - RNA, 22 nt, Human
ugaggucuaaccucuagcugcu

SEQ ID NO: 73956 - RNA, 23 nt, Human
gacccagcuguggacugugccgg

SEQ ID NO: 73957 - RNA, 26 nt, Human
gccauugcacugcagccuggaugaca

SEQ ID NO: 73958 - RNA, 20 nt, Human
ccugcaggggccacucucua

SEQ ID NO: 73959 - RNA, 24 nt, Human
uggguugucugucuugucuucuca

SEQ ID NO: 73960 - RNA, 21 nt, Human
guuuagauucuguagguguua

SEQ ID NO: 73961 - RNA, 26 nt, Human
accuguaaucccagcacuuuuggagg

SEQ ID NO: 73962 - RNA, 21 nt, Human
gaggaagauuucucucaaaau

SEQ ID NO: 73963 - RNA, 25 nt, Human
cccauucugggacugcucaggcucc

SEQ ID NO: 73964 - RNA, 25 nt, Human
gagacggagcggaccucagcgcuga

SEQ ID NO: 73965 - RNA, 22 nt, Human
gaggaagaaaaugagccauuuu

SEQ ID NO: 73966 - RNA, 27 nt, Human
agcucacuggcaggaaaguccuuguug

SEQ ID NO: 73967 - RNA, 23 nt, Human
ucgugccucagcuuuaagcacaa

SEQ ID NO: 73968 - RNA, 19 nt, Human
uaugcauacauauauacac

SEQ ID NO: 73969 - RNA, 21 nt, Human
ugugagccagcacaccgggcc

SEQ ID NO: 73970 - RNA, 26 nt, Human
ggaaagucacccaaacacuucugcuu

SEQ ID NO: 73971 - RNA, 23 nt, Human
cagggaggaggggcugcccggag

SEQ ID NO: 73972 - RNA, 27 nt, Human
ucuccaccugucucccauucugugacg

SEQ ID NO: 73973 - RNA, 23 nt, Human
cucggcgucuuccuuccuccucc

SEQ ID NO: 73974 - RNA, 24 nt, Human
cugacaucuggggacuucccccac

SEQ ID NO: 73975 - RNA, 22 nt, Human
ccgggucccccggggcugcagu

SEQ ID NO: 73976 - RNA, 21 nt, Human
agcuaaaaguuccauaguacu

SEQ ID NO: 73977 - RNA, 26 nt, Human
guuaucagucucucuuuccacaguac

SEQ ID NO: 73978 - RNA, 23 nt, Human
ugguagacauugggaccuggggg

SEQ ID NO: 73979 - RNA, 22 nt, Human
ugccuccuggguucaagcaauu

SEQ ID NO: 73980 - RNA, 23 nt, Human
uugcccaggcuggucuugaaguc

SEQ ID NO: 73981 - RNA, 27 nt, Human
ccuuucugugaacagcaucauaacuuc

SEQ ID NO: 73982 - RNA, 20 nt, Human
gauauugucuucaugugggg

SEQ ID NO: 73983 - RNA, 24 nt, Human
gauccacacuggagaaaaacccua

SEQ ID NO: 73984 - RNA, 21 nt, Human
aucuuugucuucuggcuggag

SEQ ID NO: 73985 - RNA, 22 nt, Human
cagcuuccuucuuuacaaaacc

SEQ ID NO: 73986 - RNA, 29 nt, Human
cccgcggcgcaggagcuucaguggucugg

SEQ ID NO: 73987 - RNA, 19 nt, Human
uucaguccugcuucuucca

SEQ ID NO: 73988 - RNA, 22 nt, Human
ccacagaagagguauucuauug

SEQ ID NO: 73989 - RNA, 19 nt, Human
uucggccccauguaucuca

SEQ ID NO: 73990 - RNA, 24 nt, Human
ggucaucugacagucucuacgcug

SEQ ID NO: 73991 - RNA, 27 nt, Human
ucugugacuugaaugagcagcacuuug

SEQ ID NO: 73992 - RNA, 21 nt, Human
gcaaacccaaaggacccaagu

SEQ ID NO: 73993 - RNA, 22 nt, Human
augauugucucuaacaaacagg

SEQ ID NO: 73994 - RNA, 23 nt, Human
agucagaacaggauggcuggguc

SEQ ID NO: 73995 - RNA, 27 nt, Human
acaauugccuucacuuuuaaggaguaa

SEQ ID NO: 73996 - RNA, 26 nt, Human
ucucggggaagggaagauauuuuaag

SEQ ID NO: 73997 - RNA, 21 nt, Human
ccaggauugauggcagcugag

SEQ ID NO: 73998 - RNA, 25 nt, Human
agaccuuugucaaggagagugcagu

SEQ ID NO: 73999 - RNA, 23 nt, Human
uccaaacaugagguucucucuac

SEQ ID NO: 74000 - RNA, 22 nt, Human
ccgggagcucugccagcuuugg

SEQ ID NO: 74001 - RNA, 23 nt, Human
guggggaggggcuggggaccggc

SEQ ID NO: 74002 - RNA, 18 nt, Human
guuuuugcuuugaaaauc

SEQ ID NO: 74003 - RNA, 26 nt, Human
caaggagaauaugauaaaacacugcc

SEQ ID NO: 74004 - RNA, 27 nt, Human
accagccugggcaacauagcaaaaucu

SEQ ID NO: 74005 - RNA, 21 nt, Human
cuccugagaguuauuucucag

SEQ ID NO: 74006 - RNA, 20 nt, Human
caugggccuggccaccucuc

SEQ ID NO: 74007 - RNA, 27 nt, Human
gggccaggccucgcacuugcagaggag

SEQ ID NO: 74008 - RNA, 22 nt, Human
gcauuauuacauggcaguauaa

SEQ ID NO: 74009 - RNA, 22 nt, Human
gacaaggggagggaguuuuucu

SEQ ID NO: 74010 - RNA, 22 nt, Human
acccagccugcugagacuccuc

SEQ ID NO: 74011 - RNA, 21 nt, Human
cugccgcccaggcuggagugc

SEQ ID NO: 74012 - RNA, 14 nt, Human
ccucccccuagcca

SEQ ID NO: 74013 - RNA, 22 nt, Human
accagcacugaccccgaccuca

SEQ ID NO: 74014 - RNA, 20 nt, Human
cccucaucugcaauauuuuc

SEQ ID NO: 74015 - RNA, 22 nt, Human
guucuuugcauuucaauuucac

SEQ ID NO: 74016 - RNA, 22 nt, Human
cugccuggccacugagcacugg

SEQ ID NO: 74017 - RNA, 22 nt, Human
uagagcuguuuagagagggccu

SEQ ID NO: 74018 - RNA, 27 nt, Human
caaaaucaaucuuuuccuuugaucuug

SEQ ID NO: 74019 - RNA, 25 nt, Human
aggaagagaggaaaguuuuuaagua

SEQ ID NO: 74020 - RNA, 22 nt, Human
guuuuuaaaaaacugcugacug

SEQ ID NO: 74021 - RNA, 27 nt, Human
guugcccaggcagaucucagacuccug

SEQ ID NO: 74022 - RNA, 31 nt, Human; identical to SEQ ID NO: 6833

SEQ ID NO: 74023 - RNA, 21 nt, Human
gcugugcuucucuuggauuug

SEQ ID NO: 74024 - RNA, 17 nt, Human
agaggaaggaagggucc

SEQ ID NO: 74025 - RNA, 24 nt, Human
gcccugcaucagcgggucaacauc

SEQ ID NO: 74026 - RNA, 25 nt, Human
gugguuuccucggcccuccuggguu

SEQ ID NO: 74027 - RNA, 25 nt, Human
ugccauaaugacucagaauauugcu

SEQ ID NO: 74028 - RNA, 25 nt, Human
cguguguguagacacacacgcauac

SEQ ID NO: 74029 - RNA, 21 nt, Human
gcguguagggaacacugcccu

SEQ ID NO: 74030 - RNA, 27 nt, Human
acugcaaccuccaacucccugguuuaa

SEQ ID NO: 74031 - RNA, 27 nt, Human
ggagagaagggggcagagucuucccua

SEQ ID NO: 74032 - RNA, 22 nt, Human
cugcuuuggcaaucugggcuga

SEQ ID NO: 74033 - RNA, 20 nt, Human
gcaccaccacacccagcuaa

SEQ ID NO: 74034 - RNA, 21 nt, Human
uagccccaggguuuggccauu

SEQ ID NO: 74035 - RNA, 23 nt, Human
cggcggccugagcuucagggcag

SEQ ID NO: 74036 - RNA, 26 nt, Human
cacucacucuccaccagccugggaaa

SEQ ID NO: 74037 - RNA, 23 nt, Human
cccuccccaugaacacaaggguu

SEQ ID NO: 74038 - RNA, 23 nt, Human
caacaagaguaaaacuucaucuc

SEQ ID NO: 74039 - RNA, 17 nt, Human
cugccucucccgucguc

SEQ ID NO: 74040 - RNA, 22 nt, Human
ugaauggggaggcugggaggac

SEQ ID NO: 74041 - RNA, 19 nt, Human
acuagggagugagugcaaa

SEQ ID NO: 74042 - RNA, 21 nt, Human
agguuauaggucacuccuggg

SEQ ID NO: 74043 - RNA, 21 nt, Human
ucccaggcccaagcucugugu

SEQ ID NO: 74044 - RNA, 22 nt, Human
ggugcuucugccuuuaguuuua

SEQ ID NO: 74045 - RNA, 23 nt, Human
cuucccaagguuacucagcagca

SEQ ID NO: 74046 - RNA, 21 nt, Human
gcuacugcacuccagccuggg

SEQ ID NO: 74047 - RNA, 22 nt, Human
uguuaaagacuccaaggcucca

SEQ ID NO: 74048 - RNA, 28 nt, Human
uuuuguuuguuuucuuugagauggaguc

SEQ ID NO: 74049 - RNA, 21 nt, Human
ccuguaaucccaguacuuugg

SEQ ID NO: 74050 - RNA, 21 nt, Human
cacggagauagacagcuuugg

SEQ ID NO: 74051 - RNA, 22 nt, Human
cguucgggaggcggaaaaagau

SEQ ID NO: 74052 - RNA, 23 nt, Human
cuugagguucaaaaauaauucau

SEQ ID NO: 74053 - RNA, 26 nt, Human
ccagugcuccagaacagcgggagcac

SEQ ID NO: 74054 - RNA, 21 nt, Human
uaaagcaccagucugcucccc

SEQ ID NO: 74055 - RNA, 26 nt, Human
ccguuaguaucugcucgcaucccacu

SEQ ID NO: 74056 - RNA, 27 nt, Human
gauaauacggcugauagacaacaagaa

SEQ ID NO: 74057 - RNA, 23 nt, Human
uuuggaaacauuuuuuaaaacaa

SEQ ID NO: 74058 - RNA, 25 nt, Human
uggccucuccaguccugcuuacucc

SEQ ID NO: 74059 - RNA, 24 nt, Human
ucagagcuuccagcaggaggaagg

SEQ ID NO: 74060 - RNA, 26 nt, Human
agccuuucauaccagucaguauuucc

SEQ ID NO: 74061 - RNA, 30 nt, Human
gggacuggggaugugggagggagcagacag

SEQ ID NO: 74062 - RNA, 21 nt, Human
uugaaaccacagugaucucua

SEQ ID NO: 74063 - RNA, 22 nt, Human
agaaguacuucugucucacuua

SEQ ID NO: 74064 - RNA, 21 nt, Human
ccgcagcugcuccuggucccc

SEQ ID NO: 74065 - RNA, 20 nt, Human
guggggcucccuugccagac

SEQ ID NO: 74066 - RNA, 20 nt, Human
uaaagaagaugaggaaggug

SEQ ID NO: 74067 - RNA, 27 nt, Human
ccugguggcauccuccagaucguacug

SEQ ID NO: 74068 - RNA, 27 nt, Human
guguaguuaaaaauuaaggggcugguc

SEQ ID NO: 74069 - RNA, 22 nt, Human
uuuauuauaagucacugcagcu

SEQ ID NO: 74070 - RNA, 19 nt, Human
ucuguagccacaccuguga

SEQ ID NO: 74071 - RNA, 22 nt, Human
ccccgcuacuguccuguccuca

SEQ ID NO: 74072 - RNA, 26 nt, Human
acuggguggaggcugggggucccagc

SEQ ID NO: 74073 - RNA, 20 nt, Human
gugaauucucggaauggcag

SEQ ID NO: 74074 - RNA, 19 nt, Human
agaccuacagggggucugg

SEQ ID NO: 74075 - RNA, 23 nt, Human
ccaggcgguugaggcugcaguga

SEQ ID NO: 74076 - RNA, 26 nt, Human
ccuccuggcuccagaggcagcugggc

SEQ ID NO: 74077 - RNA, 27 nt, Human
ccuccugucugugucguucucugugcc

SEQ ID NO: 74078 - RNA, 24 nt, Human
acuccagccagcccgccuccgggg

SEQ ID NO: 74079 - RNA, 21 nt, Human
cauaacugccuagagccuggg

SEQ ID NO: 74080 - RNA, 21 nt, Human
cagaggacaauggcuuccaug

SEQ ID NO: 74081 - RNA, 22 nt, Human
cuuguucuuuuaaauuuuguga

SEQ ID NO: 74082 - RNA, 23 nt, Human
gcuccugagagaaaggucugacu

SEQ ID NO: 74083 - RNA, 26 nt, Human
aggauauuucuacccaugcaacggaa

SEQ ID NO: 74084 - RNA, 31 nt, Human
gcugucuaacccugugccuugccugggauaa

SEQ ID NO: 74085 - RNA, 22 nt, Human
cuguaaucccagcuacugggga

SEQ ID NO: 74086 - RNA, 23 nt, Human
uccacaaaacaucuagccaucua

SEQ ID NO: 74087 - RNA, 21 nt, Human
ugaauugguuucuacuuuuuu

SEQ ID NO: 74088 - RNA, 21 nt, Human
ggcaaagucuuggcuuuugag

SEQ ID NO: 74089 - RNA, 26 nt, Human
uccucggggccacugcacugggugau

SEQ ID NO: 74090 - RNA, 28 nt, Human
gugguuugagccaaguaugugucuugcg

SEQ ID NO: 74091 - RNA, 24 nt, Human
cggggauuaaaaagacuacccaaa

SEQ ID NO: 74092 - RNA, 27 nt, Human
cugggaggugggagggccaggccaacu

SEQ ID NO: 74093 - RNA, 26 nt, Human
ggguacccgggcacaccagcccucag

SEQ ID NO: 74094 - RNA, 23 nt, Human
aagguccuucaggcccuugggga

SEQ ID NO: 74095 - RNA, 24 nt, Human
ggguuccuggacagaucaggcuag

SEQ ID NO: 74096 - RNA, 23 nt, Human
ggggcugguugcugcugcaguga

SEQ ID NO: 74097 - RNA, 27 nt, Human
agagcaucccccuccuccaccaugaaa

SEQ ID NO: 74098 - RNA, 23 nt, Human
agugguauuuugguaugugcaaa

SEQ ID NO: 74099 - RNA, 20 nt, Human
cccaggaggagaguguggag

SEQ ID NO: 74100 - RNA, 20 nt, Human
acuuuucuuuauaaguuauc

SEQ ID NO: 74101 - RNA, 23 nt, Human
cuggaaggcagaaguugcaguga

SEQ ID NO: 74102 - RNA, 23 nt, Human
ccgggaggcagagguuguaguga

SEQ ID NO: 74103 - RNA, 19 nt, Human
ugucuacccuccuucggac

SEQ ID NO: 74104 - RNA, 25 nt, Human
uggugcucuggggcuggaggcuagu

SEQ ID NO: 74105 - RNA, 20 nt, Human
agacuuuuuuaugaguacuu

SEQ ID NO: 74106 - RNA, 27 nt, Human
cgcagccgccgcgcuccugcgcuccga

SEQ ID NO: 74107 - RNA, 20 nt, Human
aauuggcagguaauauuuca

SEQ ID NO: 74108 - RNA, 21 nt, Human
caggagggagagagaggcagu

SEQ ID NO: 74109 - RNA, 31 nt, Human
cuggguguuugugugggauaaauacuaccac

SEQ ID NO: 74110 - RNA, 25 nt, Human
guaaacccaccaagcaauccuagcc

SEQ ID NO: 74111 - RNA, 20 nt, Human
cacugacaugacccugggug

SEQ ID NO: 74112 - RNA, 20 nt, Human
uuguucccccuccuucuuuu

SEQ ID NO: 74113 - RNA, 22 nt, Human
cuccuccaauacauaaaggaca

SEQ ID NO: 74114 - RNA, 23 nt, Human
auucuuuuggugaaggacgcuuc

SEQ ID NO: 74115 - RNA, 22 nt, Human
gcucuucacccaggucuccucu

SEQ ID NO: 74116 - RNA, 22 nt, Human
cuuucuguuuugaucuggagcu

SEQ ID NO: 74117 - RNA, 28 nt, Human
ggacuugaaaagcugagauaugaugauu

SEQ ID NO: 74118 - RNA, 23 nt, Human
ucuaccacccucacuccaugacc

SEQ ID NO: 74119 - RNA, 21 nt, Human
cucuucuggcuccugguuacg

SEQ ID NO: 74120 - RNA, 18 nt, Human
agcuucuccucugcucca

SEQ ID NO: 74121 - RNA, 25 nt, Human
uacgucuguccauccaucuguccgu

SEQ ID NO: 74122 - RNA, 21 nt, Human
cgccuguaauccuagcacuuu

SEQ ID NO: 74123 - RNA, 24 nt, Human
ucgccaucgugaguuccaggauuu

SEQ ID NO: 74124 - RNA, 22 nt, Human
cugucaggguguugugggggug

SEQ ID NO: 74125 - RNA, 24 nt, Human
ggugggccugaggcuuucaagggu

SEQ ID NO: 74126 - RNA, 23 nt, Human
ggagagaagggcauagucuuuga

SEQ ID NO: 74127 - RNA, 20 nt, Human
ccaaguuggagcuugcagug

SEQ ID NO: 74128 - RNA, 27 nt, Human
gccccuggcgggugugguggaaauggc

SEQ ID NO: 74129 - RNA, 17 nt, Human
ccuacuuccccaaauga

SEQ ID NO: 74130 - RNA, 24 nt, Human
gcaaaaacuaacauugaaauuuug

SEQ ID NO: 74131 - RNA, 26 nt, Human
cgugguggggccugugggcuguggga

SEQ ID NO: 74132 - RNA, 22 nt, Human
cauccagcggggcugccagaga

SEQ ID NO: 74133 - RNA, 28 nt, Human
ucuacuuugccacagauuaucuuguaca

SEQ ID NO: 74134 - RNA, 19 nt, Human
uucuaaaguauucucucca

SEQ ID NO: 74135 - RNA, 19 nt, Human
aauuggauugucuggugag

SEQ ID NO: 74136 - RNA, 23 nt, Human
ugcacacaccucagaggcuguuc

SEQ ID NO: 74137 - RNA, 23 nt, Human
ucauguguucuaaagucuuuuug

SEQ ID NO: 74138 - RNA, 27 nt, Human
ucagauaaauucagaaugggucaaggc

SEQ ID NO: 74139 - RNA, 20 nt, Human
ccccgcccucucccgcagcu

SEQ ID NO: 74140 - RNA, 25 nt, Human
aggaucgcuugaggccaggaguuug

SEQ ID NO: 74141 - RNA, 24 nt, Human
ccaccuugccacccauucuucccg

SEQ ID NO: 74142 - RNA, 22 nt, Human
uggcugaugucucuuucuugga

SEQ ID NO: 74143 - RNA, 21 nt, Human
cucucugcggcuucugagcac

SEQ ID NO: 74144 - RNA, 20 nt, Human
aggcauggaaagauggggag

SEQ ID NO: 74145 - RNA, 20 nt, Human
gagggagagagggagagagc

SEQ ID NO: 74146 - RNA, 21 nt, Human
cugucauguggaaacuauuua

SEQ ID NO: 74147 - RNA, 20 nt, Human
aaguuuucucacacuccucu

SEQ ID NO: 74148 - RNA, 19 nt, Human
cagagccugggcucugcug

SEQ ID NO: 74149 - RNA, 26 nt, Human
ccugcugcaguccccagucugaccag

SEQ ID NO: 74150 - RNA, 20 nt, Human
gugaagagaccaagacucug

SEQ ID NO: 74151 - RNA, 24 nt, Human
uggugcuacuucuucuucuuuuug

SEQ ID NO: 74152 - RNA, 20 nt, Human
ggaggucgaggcugcaguga

SEQ ID NO: 74153 - RNA, 22 nt, Human
uacuuuccaauucuccuuuagg

SEQ ID NO: 74154 - RNA, 22 nt, Human
ggcugcccaaagugcugggauu

SEQ ID NO: 74155 - RNA, 23 nt, Human
cuucagacuuggacugugucaca

SEQ ID NO: 74156 - RNA, 21 nt, Human
caggcacggccaccggauccc

SEQ ID NO: 74157 - RNA, 24 nt, Human
ccaagagggcggcuucacugugcg

SEQ ID NO: 74158 - RNA, 20 nt, Human
cacccaggcugaagugcagu

SEQ ID NO: 74159 - RNA, 22 nt, Human
gagcccaugggcccucccggga

SEQ ID NO: 74160 - RNA, 19 nt, Human
gcccucugguguuaccacc

SEQ ID NO: 74161 - RNA, 20 nt, Human
ugcgcaggguggagggagug

SEQ ID NO: 74162 - RNA, 20 nt, Human
ccagagugagggguccguuc

SEQ ID NO: 74163 - RNA, 20 nt, Human
uccucagccuucauuuguuc

SEQ ID NO: 74164 - RNA, 27 nt, Human
gucaggguccaggagagccugggggug

SEQ ID NO: 74165 - RNA, 21 nt, Human
ugucuuguuaguuugcaguua

SEQ ID NO: 74166 - RNA, 19 nt, Human
aaaucagcaaaacaccaga

SEQ ID NO: 74167 - RNA, 25 nt, Human
caggauugagacuuccugugggcac

SEQ ID NO: 74168 - RNA, 20 nt, Human
gcacccuagcaaccuagcca

SEQ ID NO: 74169 - RNA, 22 nt, Human
gccugcaauuccagcacuuugg

SEQ ID NO: 74170 - RNA, 20 nt, Human
aggugcugaguguacagagu

SEQ ID NO: 74171 - RNA, 26 nt, Human
gcaguuucccagcguuauuucuuaau

SEQ ID NO: 74172 - RNA, 22 nt, Human
aagggugccaggucugggugaa

SEQ ID NO: 74173 - RNA, 22 nt, Human
uauuauuuuugaauucauggag

SEQ ID NO: 74174 - RNA, 22 nt, Human
uaccauuccauggcuuccagaa

SEQ ID NO: 74175 - RNA, 26 nt, Human
ccugccugcccagcgaggcccccagg

SEQ ID NO: 74176 - RNA, 26 nt, Human
ucccaccaaggauccaaagugcccca

SEQ ID NO: 74177 - RNA, 19 nt, Human
ucucaucacugugagauua

SEQ ID NO: 74178 - RNA, 22 nt, Human
ugugugaagaucacguuccuuc

SEQ ID NO: 74179 - RNA, 26 nt, Human
cuuaaaacaugagcucagaugccagc

SEQ ID NO: 74180 - RNA, 23 nt, Human
ccacggaccguugcacaaaaagg

SEQ ID NO: 74181 - RNA, 22 nt, Human
ugaagaauucacccaggcucca

SEQ ID NO: 74182 - RNA, 21 nt, Human
gcacagccugugcacagcucc

SEQ ID NO: 74183 - RNA, 27 nt, Human
ccuacuucuagcuguauuuuuuguaug

SEQ ID NO: 74184 - RNA, 25 nt, Human
aaagucaggugcagucccaguccuu

SEQ ID NO: 74185 - RNA, 28 nt, Human
ugucccccgugcacgguucaaugguaga

SEQ ID NO: 74186 - RNA, 21 nt, Human
ucccaagaagaaggucaaaua

SEQ ID NO: 74187 - RNA, 26 nt, Human
ccugcugcuucuccaaaaaucugccu

SEQ ID NO: 74188 - RNA, 24 nt, Human
uccguaggacaaguuuuaguuaaa

SEQ ID NO: 74189 - RNA, 27 nt, Human
uggguucaagcaauccuccugccucag

SEQ ID NO: 74190 - RNA, 27 nt, Human
uggguuuaagcaauucuccugccucag

SEQ ID NO: 74191 - RNA, 26 nt, Human
gcccgucuuggcuuauccacuuugac

SEQ ID NO: 74192 - RNA, 26 nt, Human
gcaccuggucacagacauggcuugca

SEQ ID NO: 74193 - RNA, 27 nt, Human
aaucugaaggggaagagggugaccuca

SEQ ID NO: 74194 - RNA, 21 nt, Human
ccugcacugcauccugccucc

SEQ ID NO: 74195 - RNA, 23 nt, Human
cugaucccaggaggcccugcagu

SEQ ID NO: 74196 - RNA, 19 nt, Human
gcugucuugccugcccgug

SEQ ID NO: 74197 - RNA, 19 nt, Human
cugagucaguuuuuuaucu

SEQ ID NO: 74198 - RNA, 21 nt, Human
agggaaagggugagggagacu

SEQ ID NO: 74199 - RNA, 20 nt, Human
ggcuaggugccugcuccugu

SEQ ID NO: 74200 - RNA, 23 nt, Human
ggagagggagcgccccuggcugc

SEQ ID NO: 74201 - RNA, 26 nt, Human
cccgcccccgccgcauccaccuccuc

SEQ ID NO: 74202 - RNA, 27 nt, Human
caggaauacaaggacaguggggguugg

SEQ ID NO: 74203 - RNA, 21 nt, Human
augaaugauuaagugcaugua

SEQ ID NO: 74204 - RNA, 24 nt, Human
ucugacugauuuuagaaaaaacuu

SEQ ID NO: 74205 - RNA, 27 nt, Human
cccugcucuuaggugcugggcagaggg

SEQ ID NO: 74206 - RNA, 21 nt, Human
cucagcuucacccugagguga

SEQ ID NO: 74207 - RNA, 22 nt, Human
ugauagucuuuaagccauucca

SEQ ID NO: 74208 - RNA, 23 nt, Human
ccgccugccuccuggcucaggcc

SEQ ID NO: 74209 - RNA, 27 nt, Human
ucacccaggaggaguggggucaacuag

SEQ ID NO: 74210 - RNA, 20 nt, Human
gcugcucucauacuugggcu

SEQ ID NO: 74211 - RNA, 24 nt, Human
gccccagucucuucagacucaugg

SEQ ID NO: 74212 - RNA, 21 nt, Human
auauuuccuaugucuacagca

SEQ ID NO: 74213 - RNA, 21 nt, Human
ccaucuauauuucacaaaaga

SEQ ID NO: 74214 - RNA, 26 nt, Human
acauugccuuuugccuaggcuggcgu

SEQ ID NO: 74215 - RNA, 22 nt, Human
gcaugagccacugugcccggcc

SEQ ID NO: 74216 - RNA, 22 nt, Human
gcaugagccacugcgcccggcu

SEQ ID NO: 74217 - RNA, 18 nt, Human
cauccagcagcgcuaagg

SEQ ID NO: 74218 - RNA, 23 nt, Human
ggugcagaugagguugcuagaga

SEQ ID NO: 74219 - RNA, 27 nt, Human
gaggcuggaggaagggggguugcagug

SEQ ID NO: 74220 - RNA, 20 nt, Human
caggcuggagugcaacggca

SEQ ID NO: 74221 - RNA, 22 nt, Human
aggcugagaugggaggaucacu

SEQ ID NO: 74222 - RNA, 22 nt, Human
gggagccggaggcugcagugag

SEQ ID NO: 74223 - RNA, 30 nt, Human
agcuuugacaaaccuccugcuccuuggugg

SEQ ID NO: 74224 - RNA, 24 nt, Human
acuaaaauuaaucuggaauuuaag

SEQ ID NO: 74225 - RNA, 26 nt, Human
uucacuugggucucuggauuccuguc

SEQ ID NO: 74226 - RNA, 22 nt, Human
ccaagagagccucuuguggacc

SEQ ID NO: 74227 - RNA, 18 nt, Human
ucaccaugacuuccucac

SEQ ID NO: 74228 - RNA, 21 nt, Human
ucugaaagugugacagugucc

SEQ ID NO: 74229 - RNA, 22 nt, Human
acccuggcucugcacgccuggg

SEQ ID NO: 74230 - RNA, 21 nt, Human
cucacuugccaaauucuggcu

SEQ ID NO: 74231 - RNA, 28 nt, Human
uugaucuagaugucuguuuguuguaugg

SEQ ID NO: 74232 - RNA, 26 nt, Human
ucacacucaccuagccaccauggaca

SEQ ID NO: 74233 - RNA, 20 nt, Human
uggggccgggcaggccaggc

SEQ ID NO: 74234 - RNA, 19 nt, Human
aaaauaagugcucugucaa

SEQ ID NO: 74235 - RNA, 25 nt, Human
aaccaauacagaacaugagcccuuu

SEQ ID NO: 74236 - RNA, 23 nt, Human
gggcuagaggcaggaaggaagug

SEQ ID NO: 74237 - RNA, 21 nt, Human
gagcgggguucgcggaaaggc

SEQ ID NO: 74238 - RNA, 23 nt, Human
ugacaagagugaaacuccaucuc

SEQ ID NO: 74239 - RNA, 22 nt, Human
ugagaaggggcagggacugggg

SEQ ID NO: 74240 - RNA, 27 nt, Human
uguugcccaggcuggucuugaacuccg

SEQ ID NO: 74241 - RNA, 23 nt, Human
gauaccaccgacauuuuucaaua

SEQ ID NO: 74242 - RNA, 28 nt, Human
aacacaagaucagggcugaggguaagga

SEQ ID NO: 74243 - RNA, 20 nt, Human
ggcaucuugaaucccaucua

SEQ ID NO: 74244 - RNA, 22 nt, Human
gcugcagcugccuugccuugcc

SEQ ID NO: 74245 - RNA, 27 nt, Human
ucugaacuccuuggcuucuuuacuuag

SEQ ID NO: 74246 - RNA, 25 nt, Human
cacugcugaccugccuagcgagcag

SEQ ID NO: 74247 - RNA, 20 nt, Human
gcugguuccucugccugugu

SEQ ID NO: 74248 - RNA, 22 nt, Human
acaccuguaauuccagcacuuu

SEQ ID NO: 74249 - RNA, 22 nt, Human
acaucuguaaucccagcacuuu

SEQ ID NO: 74250 - RNA, 26 nt, Human
gcuggggggucucagcauguagggcu

SEQ ID NO: 74251 - RNA, 19 nt, Human
gucaucuggauagugucua

SEQ ID NO: 74252 - RNA, 24 nt, Human
guaaucuauuccuguaaauaagag

SEQ ID NO: 74253 - RNA, 27 nt, Human
agggaaagucgggggaggacgcggaag

SEQ ID NO: 74254 - RNA, 24 nt, Human
gucaggguauaaacacuauuuguu

SEQ ID NO: 74255 - RNA, 25 nt, Human
ccauugcuauacuguaccaguguca

SEQ ID NO: 74256 - RNA, 27 nt, Human
uuuucauuuuuucaaaugucuggccau

SEQ ID NO: 74257 - RNA, 20 nt, Human
cugcccaggcugaggcaaga

SEQ ID NO: 74258 - RNA, 27 nt, Human
ucugaucuccaccuucuucuaauucaa

SEQ ID NO: 74259 - RNA, 29 nt, Human
gggcuugcugggaagagaggcgaagccag

SEQ ID NO: 74260 - RNA, 19 nt, Human
gaaucuccucagagcccag

SEQ ID NO: 74261 - RNA, 18 nt, Human
caacccauuaccuaguua

SEQ ID NO: 74262 - RNA, 27 nt, Human
acuugggagauugccacagccugcugc

SEQ ID NO: 74263 - RNA, 18 nt, Human
cucaaaaaugaaaucaua

SEQ ID NO: 74264 - RNA, 22 nt, Human
uagacaccucugauccccuuca

SEQ ID NO: 74265 - RNA, 25 nt, Human
uuucugcuguucaccaccacccaug

SEQ ID NO: 74266 - RNA, 24 nt, Human
ucagaaauaaaacuguaucugaca

SEQ ID NO: 74267 - RNA, 22 nt, Human
agcaagaggcaucguugccugg

SEQ ID NO: 74268 - RNA, 21 nt, Human
ggaaguuaguugccaaaguca

SEQ ID NO: 74269 - RNA, 24 nt, Human
uuuugucccugaauaauauuuuuc

SEQ ID NO: 74270 - RNA, 20 nt, Human
ugggcacugcggcugucucc

SEQ ID NO: 74271 - RNA, 23 nt, Human
uuaagcgggaucccagcaucuca

SEQ ID NO: 74272 - RNA, 23 nt, Human
caagguaccccaaaacucuguag

SEQ ID NO: 74273 - RNA, 22 nt, Human
agcuaauucuuguauuuuuggu

SEQ ID NO: 74274 - RNA, 22 nt, Human
cucugccagcauaaaccacuca

SEQ ID NO: 74275 - RNA, 19 nt, Human
ggcuuuggugaacuguugg

SEQ ID NO: 74276 - RNA, 18 nt, Human
cugagccucaguuucccu

SEQ ID NO: 74277 - RNA, 22 nt, Human
aagcucucuuugcauaccuuca

SEQ ID NO: 74278 - RNA, 23 nt, Human
guuuuauacacuuuuuaacuggu

SEQ ID NO: 74279 - RNA, 22 nt, Human
uugcuccuggguucaaguagua

SEQ ID NO: 74280 - RNA, 23 nt, Human
ggagccagggcugaguguggaaa

SEQ ID NO: 74281 - RNA, 20 nt, Human
cuuguuucuuuuucuuggac

SEQ ID NO: 74282 - RNA, 21 nt, Human
ggccugugucacucagcagug

SEQ ID NO: 74283 - RNA, 22 nt, Human
cagagggagggagcgagcgagc

SEQ ID NO: 74284 - RNA, 21 nt, Human
auccauggaaucagagcaaga

SEQ ID NO: 74285 - RNA, 29 nt, Human
gaaugaacgcacagaucuguuugacuuug

SEQ ID NO: 74286 - RNA, 25 nt, Human
agcauugccuguacuacaguauuuu

SEQ ID NO: 74287 - RNA, 21 nt, Human
ccaaaccuuuuguucuguaaa

SEQ ID NO: 74288 - RNA, 21 nt, Human
ggaugcagaaaaaucugggcu

SEQ ID NO: 74289 - RNA, 21 nt, Human
agagaaacuugcagugaaaag

SEQ ID NO: 74290 - RNA, 20 nt, Human
uacaucccacacagucugua

SEQ ID NO: 74291 - RNA, 23 nt, Human
ggcucgggagagagggacgcggg

SEQ ID NO: 74292 - RNA, 24 nt, Human
ucagaaauuuaaaagcagagcauu

SEQ ID NO: 74293 - RNA, 20 nt, Human
cuuccucugcuggucuuguu

SEQ ID NO: 74294 - RNA, 20 nt, Human
agccuuccaucccucugucc

SEQ ID NO: 74295 - RNA, 22 nt, Human
guggcccucucccuuacccugg

SEQ ID NO: 74296 - RNA, 22 nt, Human
aauucauaacacuuggcacuug

SEQ ID NO: 74297 - RNA, 27 nt, Human
aaguagcuuggauuacaggugagcacu

SEQ ID NO: 74298 - RNA, 27 nt, Human
uccagacauaaauagcucacugcagga

SEQ ID NO: 74299 - RNA, 22 nt, Human
uucaucaccauuuccuccuuua

SEQ ID NO: 74300 - RNA, 21 nt, Human
cuuuccagccaggaaucuaaa

SEQ ID NO: 74301 - RNA, 22 nt, Human
acccaggcuggaguacaauagc

SEQ ID NO: 74302 - RNA, 20 nt, Human
ugcuggucaguaacagccaa

SEQ ID NO: 74303 - RNA, 20 nt, Human
ccuuucuacccugccugugc

SEQ ID NO: 74304 - RNA, 21 nt, Human
ccuccucucuuccccaaaaag

SEQ ID NO: 74305 - RNA, 19 nt, Human
ggugccggugggccugugu

SEQ ID NO: 74306 - RNA, 18 nt, Human
uucaaaccauugcucuua

SEQ ID NO: 74307 - RNA, 22 nt, Human
cgcugaacaucagccugggaga

SEQ ID NO: 74308 - RNA, 25 nt, Human
cccagccucagacggcucugcgggc

SEQ ID NO: 74309 - RNA, 20 nt, Human
ucaacuguuguauccucgga

SEQ ID NO: 74310 - RNA, 22 nt, Human
ccgcugcaaaguuuccccggcg

SEQ ID NO: 74311 - RNA, 20 nt, Human
auaaggaucagaacagcaga

SEQ ID NO: 74312 - RNA, 26 nt, Human
gccuccugaugcugugcucuucaucu

SEQ ID NO: 74313 - RNA, 21 nt, Human
auucccucagaucugcccuaa

SEQ ID NO: 74314 - RNA, 21 nt, Human
uauuuagugaaggcaagugca

SEQ ID NO: 74315 - RNA, 23 nt, Human
uucagugccugcuguucgugacu

SEQ ID NO: 74316 - RNA, 21 nt, Human
caggucagccuugaccaauga

SEQ ID NO: 74317 - RNA, 24 nt, Human
cagguucugagauaaguguuaugu

SEQ ID NO: 74318 - RNA, 26 nt, Human
cuguguugcccaggcuggagugcggu

SEQ ID NO: 74319 - RNA, 21 nt, Human
uuugccaagccauccccacca

SEQ ID NO: 74320 - RNA, 24 nt, Human
uagggaggagguggcggcuguggc

SEQ ID NO: 74321 - RNA, 22 nt, Human
ggccccuggcggguaccugagc

SEQ ID NO: 74322 - RNA, 19 nt, Human
acuggcugacccuuugaca

SEQ ID NO: 74323 - RNA, 27 nt, Human
cauuucgagguuuacuuauuuuccacu

SEQ ID NO: 74324 - RNA, 27 nt, Human
ucuccuuuucagacauccugggaugaa

SEQ ID NO: 74325 - RNA, 21 nt, Human
aaacucauaacaacacagaca

SEQ ID NO: 74326 - RNA, 23 nt, Human
ugcaguugagaggggagggcagg

SEQ ID NO: 74327 - RNA, 22 nt, Human
guugagggagaugggagcuagg

SEQ ID NO: 74328 - RNA, 21 nt, Human
ugcuuacagugcaucacaacu

SEQ ID NO: 74329 - RNA, 21 nt, Human
uaacuuucuuccucuggauca

SEQ ID NO: 74330 - RNA, 18 nt, Human
ucucucugcugucauguu

SEQ ID NO: 74331 - RNA, 20 nt, Human
ggagaaggaaaaggcuggca

SEQ ID NO: 74332 - RNA, 23 nt, Human
ucuuuuugcuucuacuuucaucu

SEQ ID NO: 74333 - RNA, 22 nt, Human
ccagggucaaauacagcucuuu

SEQ ID NO: 74334 - RNA, 21 nt, Human
gcaggaagacaccaggcugca

SEQ ID NO: 74335 - RNA, 22 nt, Human
ccuaaauggcccuguuuacggc

SEQ ID NO: 74336 - RNA, 32 nt, Human
ugaagaggcagaaaccuaagaaguuaucuuuu

SEQ ID NO: 74337 - RNA, 22 nt, Human
agcccccuccuguggggacagc

SEQ ID NO: 74338 - RNA, 19 nt, Human
agcauuuuccugcuccuuc

SEQ ID NO: 74339 - RNA, 26 nt, Human
cugccuggccaccugccuggaccacc

SEQ ID NO: 74340 - RNA, 19 nt, Human
aaauguccuucugaguacu

SEQ ID NO: 74341 - RNA, 20 nt, Human
gcagcccugcccuguccugu

SEQ ID NO: 74342 - RNA, 24 nt, Human
ucaggcugugaugcacuguggcug

SEQ ID NO: 74343 - RNA, 26 nt, Human
cacugcacuccagucuggcaacagag

SEQ ID NO: 74344 - RNA, 22 nt, Human
auggggcaggaugucaccugga

SEQ ID NO: 74345 - RNA, 19 nt, Human
uauuaaaagcaggcuucua

SEQ ID NO: 74346 - RNA, 26 nt, Human
agcuaguguuauggucaacaacaggc

SEQ ID NO: 74347 - RNA, 22 nt, Human
cugcugugcugugccuagaugc

SEQ ID NO: 74348 - RNA, 21 nt, Human
aucccaugggugugaggguga

SEQ ID NO: 74349 - RNA, 26 nt, Human
gaggcugagcugaaggaaugugggcc

SEQ ID NO: 74350 - RNA, 25 nt, Human
caugcgcugcucaaccucucuccuu

SEQ ID NO: 74351 - RNA, 21 nt, Human
uucaauaucagcacacucauu

SEQ ID NO: 74352 - RNA, 27 nt, Human
gagagugaggcuggggguucucacacc

SEQ ID NO: 74353 - RNA, 26 nt, Human
cuucaaggagaaucacgcuucuuucu

SEQ ID NO: 74354 - RNA, 19 nt, Human
ccugccuggucacugcugc

SEQ ID NO: 74355 - RNA, 26 nt, Human
accucgggggccaggaccggcgcuca

SEQ ID NO: 74356 - RNA, 22 nt, Human
ugcacuuuuaugaaguuuuuaa

SEQ ID NO: 74357 - RNA, 26 nt, Human
agacuuauuuuaaugacaauguagcu

SEQ ID NO: 74358 - RNA, 21 nt, Human
ccuguucugaugucagugccu

SEQ ID NO: 74359 - RNA, 21 nt, Human
aagugugugccaccaugccuc

SEQ ID NO: 74360 - RNA, 26 nt, Human
cugauuuggucaccuuccucugccuu

SEQ ID NO: 74361 - RNA, 22 nt, Human
aauuuaucauacuuguacaauu

SEQ ID NO: 74362 - RNA, 23 nt, Human
ggguggaccuaaccaacuaucau

SEQ ID NO: 74363 - RNA, 28 nt, Human
caugcacgcugggggcucuguuuuccug

SEQ ID NO: 74364 - RNA, 25 nt, Human
ugcuaucucaacaauaacuguuacu

SEQ ID NO: 74365 - RNA, 22 nt, Human
auucaacauuagacuuaccuua

SEQ ID NO: 74366 - RNA, 27 nt, Human
ucuccaucuguaauuccucacccucac

SEQ ID NO: 74367 - RNA, 23 nt, Human
ccagaguagcuggaauuacaggc

SEQ ID NO: 74368 - RNA, 23 nt, Human
ccagaauagcugggauuacaggc

SEQ ID NO: 74369 - RNA, 22 nt, Human
ucaucuguaaaaaaggggggag

SEQ ID NO: 74370 - RNA, 19 nt, Human
uccaguguaauucagaauc

SEQ ID NO: 74371 - RNA, 22 nt, Human
cucuagaaacaugaaauacuca

SEQ ID NO: 74372 - RNA, 24 nt, Human
cggggaccccggagagggagucag

SEQ ID NO: 74373 - RNA, 16 nt, Human
auccaggugcuuucca

SEQ ID NO: 74374 - RNA, 25 nt, Human
aguuaucauuucucugacauauguu

SEQ ID NO: 74375 - RNA, 26 nt, Human
ugcucaggcugggaggcagagggcac

SEQ ID NO: 74376 - RNA, 27 nt, Human
cugucugucugugggcuucagcacuuu

SEQ ID NO: 74377 - RNA, 23 nt, Human
uguuuuuaagacugaauucacua

SEQ ID NO: 74378 - RNA, 21 nt, Human
gggagagaagaagggggucuu

SEQ ID NO: 74379 - RNA, 20 nt, Human
caacccaggauacaaacuuc

SEQ ID NO: 74380 - RNA, 22 nt, Human
cccgugggagucgggacauaua

SEQ ID NO: 74381 - RNA, 21 nt, Human
ugccuucuuggacuucuugaa

SEQ ID NO: 74382 - RNA, 24 nt, Human
cuguagcccagucuggagugcagu

SEQ ID NO: 74383 - RNA, 21 nt, Human
ccauaauuugccaucuuugga

SEQ ID NO: 74384 - RNA, 19 nt, Human
cuacaaaaucguucaagag

SEQ ID NO: 74385 - RNA, 21 nt, Human
gcuggcccagcuccugaggcu

SEQ ID NO: 74386 - RNA, 20 nt, Human
acaguuucucaaguuuaaag

SEQ ID NO: 74387 - RNA, 23 nt, Human
gggggagcugucugcggagccag

SEQ ID NO: 74388 - RNA, 23 nt, Human
cuucucucccugugacacagcuu

SEQ ID NO: 74389 - RNA, 24 nt, Human
aucaccagagcaucgccaggauuu

SEQ ID NO: 74390 - RNA, 23 nt, Human
ucaugcugaauuuugucuuccag

SEQ ID NO: 74391 - RNA, 26 nt, Human
gcuguguucgcggacucagguggaag

SEQ ID NO: 74392 - RNA, 26 nt, Human
aggaucaagacuucuuugugcucaaa

SEQ ID NO: 74393 - RNA, 21 nt, Human
agcccacauucccaugaccuc

SEQ ID NO: 74394 - RNA, 22 nt, Human
gccauaaaaguaaaggaugcuu

SEQ ID NO: 74395 - RNA, 20 nt, Human
ggaaagccuguuccucucug

SEQ ID NO: 74396 - RNA, 20 nt, Human
ccacugcacccggcccugag

SEQ ID NO: 74397 - RNA, 26 nt, Human
ugagggaaggggagcaguugccaaua

SEQ ID NO: 74398 - RNA, 24 nt, Human
ccuucgggagggcacucacaugcc

SEQ ID NO: 74399 - RNA, 20 nt, Human
gaugacugccuccucacuuc

SEQ ID NO: 74400 - RNA, 27 nt, Human
cuucagugacgggugacggcucaggga

SEQ ID NO: 74401 - RNA, 26 nt, Human
gcccuggaguuugaguccagccuggg

SEQ ID NO: 74402 - RNA, 19 nt, Human
cccgaccaccuccuccucu

SEQ ID NO: 74403 - RNA, 27 nt, Human
ugccucuguuagaaauucacacuguug

SEQ ID NO: 74404 - RNA, 25 nt, Human
agcacucucuaaaucuuccuuguga

SEQ ID NO: 74405 - RNA, 23 nt, Human
ggagcgccuggcccucccucccu

SEQ ID NO: 74406 - RNA, 22 nt, Human
aagccuggccacuguuggcugc

SEQ ID NO: 74407 - RNA, 22 nt, Human
uacaacaccucacacuggucag

SEQ ID NO: 74408 - RNA, 20 nt, Human
ucugguucuccucuuguaca

SEQ ID NO: 74409 - RNA, 20 nt, Human
caggcuuugauaucugugau

SEQ ID NO: 74410 - RNA, 21 nt, Human
ugccucgaugccucucuggcg

SEQ ID NO: 74411 - RNA, 22 nt, Human
uucagggcgauaaaacuaaaua

SEQ ID NO: 74412 - RNA, 22 nt, Human
guuuugcuuucgaucuggacug

SEQ ID NO: 74413 - RNA, 23 nt, Human
aucauccugaagaacuucgagaa

SEQ ID NO: 74414 - RNA, 23 nt, Human
ccugcagcccagccccacccaga

SEQ ID NO: 74415 - RNA, 23 nt, Human
cccggaggcugagcagugcagac

SEQ ID NO: 74416 - RNA, 24 nt, Human
uaaaggauauuuaucaaauccagg

SEQ ID NO: 74417 - RNA, 23 nt, Human
cuuuaaccuuggaggcggagguu

SEQ ID NO: 74418 - RNA, 22 nt, Human
cacccagcagccaagagaggug

SEQ ID NO: 74419 - RNA, 24 nt, Human
auccucuccugccagcuguugcag

SEQ ID NO: 74420 - RNA, 27 nt, Human
ugcuggagguuuuaaccuagacaagga

SEQ ID NO: 74421 - RNA, 20 nt, Human
auguugaccaggauggucuc

SEQ ID NO: 74422 - RNA, 26 nt, Human
ccaacauggcaaaaccaucucuacua

SEQ ID NO: 74423 - RNA, 19 nt, Human
aggugugugccacucagag

SEQ ID NO: 74424 - RNA, 18 nt, Human
uuuggagcugggaguggg

SEQ ID NO: 74425 - RNA, 23 nt, Human
ggggccccggguuugagcagaac

SEQ ID NO: 74426 - RNA, 23 nt, Human
gucucuuguagaggaaacuaaua

SEQ ID NO: 74427 - RNA, 21 nt, Human
uacugaccuggcuggugacag

SEQ ID NO: 74428 - RNA, 26 nt, Human
ugggcagcuuccuucaggaugaucac

SEQ ID NO: 74429 - RNA, 25 nt, Human
gacacacagagucacacacacucac

SEQ ID NO: 74430 - RNA, 22 nt, Human
gacauuucaacagcucuuuuug

SEQ ID NO: 74431 - RNA, 22 nt, Human
gaacuccugagcucaagugauc

SEQ ID NO: 74432 - RNA, 22 nt, Human
auagugagaagcagacacugcu

SEQ ID NO: 74433 - RNA, 20 nt, Human
caggaaagacgcugugggaa

SEQ ID NO: 74434 - RNA, 17 nt, Human
ucugagaccugcuccca

SEQ ID NO: 74435 - RNA, 19 nt, Human
uaccauguuguuacaugua

SEQ ID NO: 74436 - RNA, 25 nt, Human
gucagaggcaggagugggggaucag

SEQ ID NO: 74437 - RNA, 21 nt, Human
aaauguccuuaguuagggacu

SEQ ID NO: 74438 - RNA, 19 nt, Human
aggugucugagcuggguga

SEQ ID NO: 74439 - RNA, 29 nt, Human
cugggccgcgcugccaggaccucugcugu

SEQ ID NO: 74440 - RNA, 22 nt, Human
aagucucacagauugcugccuc

SEQ ID NO: 74441 - RNA, 21 nt, Human
agggcugaagucggagaagca

SEQ ID NO: 74442 - RNA, 27 nt, Human
accaggagucuggagugcaauggcacg

SEQ ID NO: 74443 - RNA, 26 nt, Human
acccagcaaagaagcaaacagcucac

SEQ ID NO: 74444 - RNA, 23 nt, Human
uuuuauuucaaaaacaaaguaca

SEQ ID NO: 74445 - RNA, 22 nt, Human
uuguaauuucuuguacauguau

SEQ ID NO: 74446 - RNA, 25 nt, Human
gcagacagaacacauacuggaacac

SEQ ID NO: 74447 - RNA, 24 nt, Human
aacuucagaaaucugugguacucu

SEQ ID NO: 74448 - RNA, 18 nt, Human
acauacagcuaaaaggga

SEQ ID NO: 74449 - RNA, 24 nt, Human
uggcugaauuccccaccugccuuu

SEQ ID NO: 74450 - RNA, 22 nt, Human
acugcaaccucugccuccuggg

SEQ ID NO: 74451 - RNA, 22 nt, Human
accgcaaccucugccucccggg

SEQ ID NO: 74452 - RNA, 22 nt, Human
cucagcuuucacacuggugaag

SEQ ID NO: 74453 - RNA, 23 nt, Human
cccuccagagaauuuuacgcaag

SEQ ID NO: 74454 - RNA, 21 nt, Human
cagugguucuaggaucugcca

SEQ ID NO: 74455 - RNA, 19 nt, Human
aacugcauccuucauucca

SEQ ID NO: 74456 - RNA, 19 nt, Human
ucuccacuguucuaauaua

SEQ ID NO: 74457 - RNA, 21 nt, Human
ggggggccuggcugggccaga

SEQ ID NO: 74458 - RNA, 27 nt, Human
ucccugcagaccucaagccaucaugcg

SEQ ID NO: 74459 - RNA, 19 nt, Human
gaccaaaaucagcuuugua

SEQ ID NO: 74460 - RNA, 20 nt, Human
cugauggggagaagaaguac

SEQ ID NO: 74461 - RNA, 23 nt, Human
uggggaauggagaggugggcagg

SEQ ID NO: 74462 - RNA, 22 nt, Human
aaugaagcaggugacugcagcc

SEQ ID NO: 74463 - RNA, 23 nt, Human
gugucuggagaagcuggacacug

SEQ ID NO: 74464 - RNA, 22 nt, Human
gagcccaggaguucaaagcugu

SEQ ID NO: 74465 - RNA, 22 nt, Human
ucgccucccagguucaagcaau

SEQ ID NO: 74466 - RNA, 23 nt, Human
aaggucagaauuuuguuggucug

SEQ ID NO: 74467 - RNA, 20 nt, Human
agaaggaaaccuacuauuac

SEQ ID NO: 74468 - RNA, 23 nt, Human
cccuguauuccucuuccccuugg

SEQ ID NO: 74469 - RNA, 27 nt, Human
ccacugcauuugcagccuugaggucau

SEQ ID NO: 74470 - RNA, 23 nt, Human
ugcuuaagcucuggcccugcccu

SEQ ID NO: 74471 - RNA, 22 nt, Human
gcucacugugccucuuguuucc

SEQ ID NO: 74472 - RNA, 22 nt, Human
gcucucgccuguaaucucagca

SEQ ID NO: 74473 - RNA, 21 nt, Human
gagcugccuccugucucucca

SEQ ID NO: 74474 - RNA, 27 nt, Human
gagcaacaugggagaaacugagaaaag

SEQ ID NO: 74475 - RNA, 21 nt, Human
gagugucacugagcuguguuu

SEQ ID NO: 74476 - RNA, 22 nt, Human
ggcauucagacugccagcacuu

SEQ ID NO: 74477 - RNA, 19 nt, Human
gggagaggagguugugugg

SEQ ID NO: 74478 - RNA, 22 nt, Human
auucagggccugugccugggga

SEQ ID NO: 74479 - RNA, 22 nt, Human
caaauuggccacuuaagaaaua

SEQ ID NO: 74480 - RNA, 21 nt, Human
ucuccaauaaagcaccuuguu

SEQ ID NO: 74481 - RNA, 25 nt, Human
ucucuguguaugugucugugugucu

SEQ ID NO: 74482 - RNA, 23 nt, Human
cucuaugcuuauuuacaucuucu

SEQ ID NO: 74483 - RNA, 22 nt, Human
cacacagcccugggacacugcc

SEQ ID NO: 74484 - RNA, 21 nt, Human
ucuuccucucuuuuuuggggg

SEQ ID NO: 74485 - RNA, 21 nt, Human
cggcaggagucaggagccagg

SEQ ID NO: 74486 - RNA, 26 nt, Human
ugagccagaaguggcgcugggaacag

SEQ ID NO: 74487 - RNA, 21 nt, Human
cuggaccccucuauuuauuuc

SEQ ID NO: 74488 - RNA, 20 nt, Human
uugugugcccagucuggucc

SEQ ID NO: 74489 - RNA, 26 nt, Human
acauagugcauuguuucugugggcgg

SEQ ID NO: 74490 - RNA, 20 nt, Human
uucaaauuggguacuuuuaa

SEQ ID NO: 74491 - RNA, 24 nt, Human
auucuauguugaucccauucuuga

SEQ ID NO: 74492 - RNA, 24 nt, Human
augauucuuuucccaucaccagaa

SEQ ID NO: 74493 - RNA, 23 nt, Human
gcccugguuguguggacuccuua

SEQ ID NO: 74494 - RNA, 26 nt, Human
ucucugagaggaguuucgugagcuga

SEQ ID NO: 74495 - RNA, 25 nt, Human
ucuucugcgccucaggcugcugggg

SEQ ID NO: 74496 - RNA, 20 nt, Human
ggugcuggaaagggagggag

SEQ ID NO: 74497 - RNA, 25 nt, Human
ggcuucaccauacuguaagcauuuu

SEQ ID NO: 74498 - RNA, 20 nt, Human
uuuauacaucuccauuuucu

SEQ ID NO: 74499 - RNA, 26 nt, Human
ccuccucugcuggcaugugaaauggc

SEQ ID NO: 74500 - RNA, 20 nt, Human
cuuguacagugucugugcca

SEQ ID NO: 74501 - RNA, 27 nt, Human
aggaguucgagaccacccuggccaaca

SEQ ID NO: 74502 - RNA, 23 nt, Human
gcccacgcuggagugcagugagc

SEQ ID NO: 74503 - RNA, 19 nt, Human
uucaggguaagauuuuauu

SEQ ID NO: 74504 - RNA, 24 nt, Human
auccagucucagguagaucuuuau

SEQ ID NO: 74505 - RNA, 22 nt, Human
guaacaacagaagaaaaccuuc

SEQ ID NO: 74506 - RNA, 26 nt, Human
gggagcacuggauugcuuucccauua

SEQ ID NO: 74507 - RNA, 20 nt, Human
ugccuuccccaccccagcag

SEQ ID NO: 74508 - RNA, 20 nt, Human
uguuuacauguccuugcuac

SEQ ID NO: 74509 - RNA, 22 nt, Human
guugaggucaggaguuugagac

SEQ ID NO: 74510 - RNA, 26 nt, Human
ggcugugucagaaacugaagcuguuc

SEQ ID NO: 74511 - RNA, 24 nt, Human
ucauaugcuucaccauucuguaaa

SEQ ID NO: 74512 - RNA, 24 nt, Human
cuuuuucuuccuuugcaaaggccu

SEQ ID NO: 74513 - RNA, 24 nt, Human
gggccugcggaggcgguggcagac

SEQ ID NO: 74514 - RNA, 28 nt, Human
gcagcuuccagacccaggaagccugagg

SEQ ID NO: 74515 - RNA, 27 nt, Human
ccccgucuccuccucaggcucggacca

SEQ ID NO: 74516 - RNA, 21 nt, Human
cgguggccagagcgagggcac

SEQ ID NO: 74517 - RNA, 22 nt, Human
ggauugccaaacucuucugcuu

SEQ ID NO: 74518 - RNA, 26 nt, Human
cuccuaucauuuucugaauuacuugg

SEQ ID NO: 74519 - RNA, 23 nt, Human
uagaagcugaucugauuggucca

SEQ ID NO: 74520 - RNA, 20 nt, Human
cagcucccuauuugaucuua

SEQ ID NO: 74521 - RNA, 22 nt, Human
acccggcuugcuccaguguagc

SEQ ID NO: 74522 - RNA, 23 nt, Human
cgaguagcuggcauuacaggcgc

SEQ ID NO: 74523 - RNA, 20 nt, Human
cgugagggauagcugagaug

SEQ ID NO: 74524 - RNA, 23 nt, Human
caggucuuuauuucuucuguaaa

SEQ ID NO: 74525 - RNA, 27 nt, Human
cccuuggcugaugccuccucuggguca

SEQ ID NO: 74526 - RNA, 23 nt, Human
cugcagcccagcugguggugcug

SEQ ID NO: 74527 - RNA, 23 nt, Human
gggcaagcccucccucggaggag

SEQ ID NO: 74528 - RNA, 20 nt, Human
auacacagaugaaguggccc

SEQ ID NO: 74529 - RNA, 18 nt, Human
ucuguaaaaaugauauug

SEQ ID NO: 74530 - RNA, 23 nt, Human
uuccaucucaagacaauuuguca

SEQ ID NO: 74531 - RNA, 22 nt, Human
gcauuaaguaauuuucuuuuug

SEQ ID NO: 74532 - RNA, 27 nt, Human
gcuggugcuuauucuuuuuuagugcag

SEQ ID NO: 74533 - RNA, 20 nt, Human
ucucuagcugccugauguca

SEQ ID NO: 74534 - RNA, 22 nt, Human
ucugaagguagcauucuuugga

SEQ ID NO: 74535 - RNA, 21 nt, Human
ccauacaguauuaggugagga

SEQ ID NO: 74536 - RNA, 22 nt, Human
aggcugagguagaagaauuguu

SEQ ID NO: 74537 - RNA, 24 nt, Human
ggcugcagaucuggagguggaggc

SEQ ID NO: 74538 - RNA, 21 nt, Human
agggagcucaaagucacaaga

SEQ ID NO: 74539 - RNA, 25 nt, Human
ggggcugcgucccugcucagcccau

SEQ ID NO: 74540 - RNA, 27 nt, Human
ucacccagacuuuaccgcggaggcggc

SEQ ID NO: 74541 - RNA, 21 nt, Human
agaucuagaaucagagcugga

SEQ ID NO: 74542 - RNA, 21 nt, Human
agguguugaaagcacaggcag

SEQ ID NO: 74543 - RNA, 22 nt, Human
cugaggcaggaagauagcuuga

SEQ ID NO: 74544 - RNA, 22 nt, Human
auguuauuccuuacaugucaua

SEQ ID NO: 74545 - RNA, 22 nt, Human
cugaggcaggugaauuguuuga

SEQ ID NO: 74546 - RNA, 21 nt, Human
aacacccagggccgggcggcu

SEQ ID NO: 74547 - RNA, 20 nt, Human
uuuauucucaguaacuuuua

SEQ ID NO: 74548 - RNA, 22 nt, Human
cuuaagagcuaugugccuucca

SEQ ID NO: 74549 - RNA, 26 nt, Human
gauguaugugucacugcauggcuucu

SEQ ID NO: 74550 - RNA, 27 nt, Human
cugcaguuccuccucuggaauguagac

SEQ ID NO: 74551 - RNA, 28 nt, Human
guuggggugacagucaucaucagggccu

SEQ ID NO: 74552 - RNA, 21 nt, Human
gcucccauacacccaaggcuu

SEQ ID NO: 74553 - RNA, 17 nt, Human
guaguguccucauuuua

SEQ ID NO: 74554 - RNA, 23 nt, Human
auugugucacugcacuccagcuu

SEQ ID NO: 74555 - RNA, 23 nt, Human
ccccuucuacugccuccaacacg

SEQ ID NO: 74556 - RNA, 23 nt, Human
cacuggcacuccagccugggcaa

SEQ ID NO: 74557 - RNA, 22 nt, Human
ccucgguugacaauggucucca

SEQ ID NO: 74558 - RNA, 28 nt, Human
ugcuaagaagcagucacauaaacagcag

SEQ ID NO: 74559 - RNA, 23 nt, Human
ggagaggcauggcuggggugggg

SEQ ID NO: 74560 - RNA, 23 nt, Human
gaucccuccuuucauugcuguug

SEQ ID NO: 74561 - RNA, 24 nt, Human
uagcacaaagugccuucuguuuca

SEQ ID NO: 74562 - RNA, 20 nt, Human
cagcagccauugcacgugca

SEQ ID NO: 74563 - RNA, 20 nt, Human
agagaaacugaccugacuaa

SEQ ID NO: 74564 - RNA, 27 nt, Human
agagauucugugccugcuuuaucugug

SEQ ID NO: 74565 - RNA, 27 nt, Human
acuccaucuugguaguucugugccucc

SEQ ID NO: 74566 - RNA, 20 nt, Human
auagaggaacggucacagcu

SEQ ID NO: 74567 - RNA, 21 nt, Human
aagccucuuuauacucacuua

SEQ ID NO: 74568 - RNA, 23 nt, Human
caguguugugacugucucauggg

SEQ ID NO: 74569 - RNA, 23 nt, Human
gagcugcacuaucacgagccuuu

SEQ ID NO: 74570 - RNA, 20 nt, Human
cagucccagcaccuguguca

SEQ ID NO: 74571 - RNA, 27 nt, Human
ccauauuuucaaccacucugauuaucu

SEQ ID NO: 74572 - RNA, 20 nt, Human
caguuacuccagccaggcag

SEQ ID NO: 74573 - RNA, 23 nt, Human
uuuccaucugcuuguauuuucca

SEQ ID NO: 74574 - RNA, 24 nt, Human
ucugcagcugcacagaagcauggc

SEQ ID NO: 74575 - RNA, 21 nt, Human
uucucauaaaacugugacuag

SEQ ID NO: 74576 - RNA, 28 nt, Human
gguugagggagaugggagcuagggggag

SEQ ID NO: 74577 - RNA, 18 nt, Human
cuucugcuucuuaccucu

SEQ ID NO: 74578 - RNA, 26 nt, Human
uguaacaguugauaucuggcuguccu

SEQ ID NO: 74579 - RNA, 23 nt, Human
ggaaagcauaugcagccaaccaa

SEQ ID NO: 74580 - RNA, 22 nt, Human
ugauuaaagugauaaaacccca

SEQ ID NO: 74581 - RNA, 20 nt, Human
guucugacaggaacagcaug

SEQ ID NO: 74582 - RNA, 21 nt, Human
gucaccuagcagggcuucagg

SEQ ID NO: 74583 - RNA, 20 nt, Human
accacacaccccuguuaagu

SEQ ID NO: 74584 - RNA, 23 nt, Human
gcugugacaugaagugaaugaag

SEQ ID NO: 74585 - RNA, 22 nt, Human
cugcaucuuuggucaucuaaga

SEQ ID NO: 74586 - RNA, 25 nt, Human
guauggcuccucccagcccugggcc

SEQ ID NO: 74587 - RNA, 22 nt, Human
ccuaaacaacacuugacaggcu

SEQ ID NO: 74588 - RNA, 23 nt, Human
acacaaaauacagcacuuugaca

SEQ ID NO: 74589 - RNA, 21 nt, Human
cugcugcaccaaccucacugc

SEQ ID NO: 74590 - RNA, 24 nt, Human
uguaauaaaagguaugaaacacua

SEQ ID NO: 74591 - RNA, 19 nt, Human
ucugccuggcagaggcugc

SEQ ID NO: 74592 - RNA, 22 nt, Human
cgcccaggcuggagugcagcag

SEQ ID NO: 74593 - RNA, 22 nt, Human
gucucacugcaaccuccgccuc

SEQ ID NO: 74594 - RNA, 22 nt, Human
ggcucacugcaaccuccuccuc

SEQ ID NO: 74595 - RNA, 23 nt, Human
ucaggcagaaagugcuggugcgu

SEQ ID NO: 74596 - RNA, 20 nt, Human
cugaaagcucaguaacucag

SEQ ID NO: 74597 - RNA, 25 nt, Human
ggucagaagcaucugcugucaugac

SEQ ID NO: 74598 - RNA, 23 nt, Human
cauuggcuucucuucucuccuua

SEQ ID NO: 74599 - RNA, 20 nt, Human
gccauggccaccgcccagcc

SEQ ID NO: 74600 - RNA, 21 nt, Human
ccucacugcugccucaacuuc

SEQ ID NO: 74601 - RNA, 21 nt, Human
gaauagaaugaaugaccccaa

SEQ ID NO: 74602 - RNA, 19 nt, Human
uucaugcuuguaucuugca

SEQ ID NO: 74603 - RNA, 23 nt, Human
cuccugaggcauuucuugcccag

SEQ ID NO: 74604 - RNA, 20 nt, Human
aaaguuucagccaaacuucg

SEQ ID NO: 74605 - RNA, 24 nt, Human
cuuccuuuugggcucugugcaacu

SEQ ID NO: 74606 - RNA, 20 nt, Human
ccuuccuggaagccuuccug

SEQ ID NO: 74607 - RNA, 22 nt, Human
ugugaggagggcguggggaagg

SEQ ID NO: 74608 - RNA, 22 nt, Human
aaggcuccucacaggcgcugug

SEQ ID NO: 74609 - RNA, 24 nt, Human
cagggagggaggcagcugcugggg

SEQ ID NO: 74610 - RNA, 21 nt, Human
ggcuguugggacuuucuugaa

SEQ ID NO: 74611 - RNA, 20 nt, Human
cugauucucccuuuaugaag

SEQ ID NO: 74612 - RNA, 22 nt, Human
cccugcagcucucuuuccucug

SEQ ID NO: 74613 - RNA, 19 nt, Human
ucuuggcuuccuuuagaga

SEQ ID NO: 74614 - RNA, 26 nt, Human
cugacaccucugcacucccuugggca

SEQ ID NO: 74615 - RNA, 25 nt, Human
agccuugcaggcuggagggcggcug

SEQ ID NO: 74616 - RNA, 26 nt, Human
uaggacuacuagaguucauugaacac

SEQ ID NO: 74617 - RNA, 28 nt, Human
gaggcgagcguggauugucacagcugcg

SEQ ID NO: 74618 - RNA, 23 nt, Human
ggaguggguugaaaaacugcuca

SEQ ID NO: 74619 - RNA, 25 nt, Human
cccccggggccaugcugccugcagc

SEQ ID NO: 74620 - RNA, 23 nt, Human
gauuucucccucucaguggagcc

SEQ ID NO: 74621 - RNA, 24 nt, Human
aagacauuuuguuucacuugcuau

SEQ ID NO: 74622 - RNA, 22 nt, Human
ccaaaauugaaugcuaugcuua

SEQ ID NO: 74623 - RNA, 23 nt, Human
gaacccaggaauugugagguuag

SEQ ID NO: 74624 - RNA, 25 nt, Human
ccagagaggcaguuggaagauggcg

SEQ ID NO: 74625 - RNA, 27 nt, Human
uugcccaggcugaagugcaguggggcg

SEQ ID NO: 74626 - RNA, 26 nt, Human
gcacagccaaguuacacuccucccca

SEQ ID NO: 74627 - RNA, 27 nt, Human
ccagcacucugccugcuccuucuugua

SEQ ID NO: 74628 - RNA, 17 nt, Human
uuuggcucugggcccuu

SEQ ID NO: 74629 - RNA, 23 nt, Human
acauacuagaagggcauuggcca

SEQ ID NO: 74630 - RNA, 21 nt, Human
uggacuugagcuuggcagcug

SEQ ID NO: 74631 - RNA, 27 nt, Human
ccauugcacuccagccugggcaacaca

SEQ ID NO: 74632 - RNA, 22 nt, Human
ccagcuauuuauugagugucuu

SEQ ID NO: 74633 - RNA, 22 nt, Human
ccgucuucugcuacaucaaugc

SEQ ID NO: 74634 - RNA, 27 nt, Human
gaccagccugggcaacauagcaagacc

SEQ ID NO: 74635 - RNA, 22 nt, Human
uuuggccucccaaagugcuggg

SEQ ID NO: 74636 - RNA, 21 nt, Human
cuugaaaaacacugucucuga

SEQ ID NO: 74637 - RNA, 22 nt, Human
aucucaggcucuaggugcaaug

SEQ ID NO: 74638 - RNA, 20 nt, Human
uguucugacagggcgcggug

SEQ ID NO: 74639 - RNA, 21 nt, Human
gugggaagaccucagccuugg

SEQ ID NO: 74640 - RNA, 18 nt, Human
aucagcuuuaaccaaugg

SEQ ID NO: 74641 - RNA, 22 nt, Human
gcacacugcuuaguauucuuga

SEQ ID NO: 74642 - RNA, 21 nt, Human
cauguugucuguuuggugucu

SEQ ID NO: 74643 - RNA, 22 nt, Human
cagugcacuccggccuggguga

SEQ ID NO: 74644 - RNA, 21 nt, Human
aaauauccuucugucuccucc

SEQ ID NO: 74645 - RNA, 22 nt, Human
agcuaagaucacuauaggucca

SEQ ID NO: 74646 - RNA, 21 nt, Human
caucugaaguucuccauggca

SEQ ID NO: 74647 - RNA, 23 nt, Human
gacuagagugcuguaaacuugcu

SEQ ID NO: 74648 - RNA, 23 nt, Human
ucuuuauauaaugccuauuucca

SEQ ID NO: 74649 - RNA, 26 nt, Human
caagccccgcacaucccggggcaaag

SEQ ID NO: 74650 - RNA, 26 nt, Human
gcucuccuccagcccugggcacauag

SEQ ID NO: 74651 - RNA, 16 nt, Human
ucugggagguugguuu

SEQ ID NO: 74652 - RNA, 20 nt, Human
agccucgggagggcaccucc

SEQ ID NO: 74653 - RNA, 22 nt, Human
ccaaggugggagaauugcuuga

SEQ ID NO: 74654 - RNA, 26 nt, Human
acccuaaagggagaaggaagggcaga

SEQ ID NO: 74655 - RNA, 22 nt, Human
uucccagggggcagaggcaggg

SEQ ID NO: 74656 - RNA, 23 nt, Human
ugcaaaacauagaugaccauuuu

SEQ ID NO: 74657 - RNA, 22 nt, Human
cagguucucacuagaugacugu

SEQ ID NO: 74658 - RNA, 23 nt, Human
uggauugaggcccaguuccuggg

SEQ ID NO: 74659 - RNA, 29 nt, Human
gcucacaucuuuccuccugcugcaaucca

SEQ ID NO: 74660 - RNA, 26 nt, Human
gugguuucagcuggugcauuauuuca

SEQ ID NO: 74661 - RNA, 22 nt, Human
gccuguagucccagcacuuuga

SEQ ID NO: 74662 - RNA, 25 nt, Human
ucuugugcccugcucuucagcacca

SEQ ID NO: 74663 - RNA, 26 nt, Human
aagccccagagaacugggcugggccc

SEQ ID NO: 74664 - RNA, 21 nt, Human
ggucauuuccauguaugcaua

SEQ ID NO: 74665 - RNA, 23 nt, Human
caucgucccggcugaagugcagu

SEQ ID NO: 74666 - RNA, 21 nt, Human
agacauuuugggaaacacugu

SEQ ID NO: 74667 - RNA, 29 nt, Human
gggccuguccacaggcuucugagcagcga

SEQ ID NO: 74668 - RNA, 24 nt, Human
ugaccucagaugauccaccugccu

SEQ ID NO: 74669 - RNA, 21 nt, Human
ccugcugcucacucagcugcc

SEQ ID NO: 74670 - RNA, 21 nt, Human
cagagugguccucacaccuag

SEQ ID NO: 74671 - RNA, 21 nt, Human
ugcuccuggagggaaaaagaa

SEQ ID NO: 74672 - RNA, 22 nt, Human
augaggaauggauuuucuuuaa

SEQ ID NO: 74673 - RNA, 19 nt, Human
augagaccucccccaggga

SEQ ID NO: 74674 - RNA, 22 nt, Human
gucuuaaaaagacacaaguuuu

SEQ ID NO: 74675 - RNA, 19 nt, Human
cucccagccucucccgcua

SEQ ID NO: 74676 - RNA, 22 nt, Human
agauucucucugagugccugca

SEQ ID NO: 74677 - RNA, 22 nt, Human
caggaggucaaggcuaugguga

SEQ ID NO: 74678 - RNA, 22 nt, Human
ugcagugagcugaaauccugcc

SEQ ID NO: 74679 - RNA, 27 nt, Human
ccucagcugacuccauauuuuccuacu

SEQ ID NO: 74680 - RNA, 24 nt, Human
gaggcugaggcugaggggcaguca

SEQ ID NO: 74681 - RNA, 28 nt, Human
ggucucagcucuggcauggcugccccgg

SEQ ID NO: 74682 - RNA, 27 nt, Human
agcucugcaucuccugucuuuucaggu

SEQ ID NO: 74683 - RNA, 21 nt, Human
cuggcuuuguugcugccaaag

SEQ ID NO: 74684 - RNA, 26 nt, Human
aaaauacaaaaaauuagccuggcgug

SEQ ID NO: 74685 - RNA, 22 nt, Human
ucaggcugggacccuggggcga

SEQ ID NO: 74686 - RNA, 22 nt, Human
ccgcugggccugcaggucucug

SEQ ID NO: 74687 - RNA, 24 nt, Human
cagcauuuguguguuacaauguaa

SEQ ID NO: 74688 - RNA, 22 nt, Human
acucacugcaaucuccaccucc

SEQ ID NO: 74689 - RNA, 22 nt, Human
gcuuacugcaaccuccgccucc

SEQ ID NO: 74690 - RNA, 23 nt, Human
cccuguggccucccuuguggaug

SEQ ID NO: 74691 - RNA, 23 nt, Human
agcgagagagccgggaggcagag

SEQ ID NO: 74692 - RNA, 19 nt, Human
uccaggcuggagugcagug

SEQ ID NO: 74693 - RNA, 27 nt, Human
aggcuacccaguauuuuaucguccaga

SEQ ID NO: 74694 - RNA, 21 nt, Human
cucuggagacacuucccgagg

SEQ ID NO: 74695 - RNA, 22 nt, Human
auaaaguguggacagcuuccuu

SEQ ID NO: 74696 - RNA, 22 nt, Human
uugccaucagaugugugcaaug

SEQ ID NO: 74697 - RNA, 24 nt, Human
cagcuacuucacaccuuaaacuug

SEQ ID NO: 74698 - RNA, 22 nt, Human
auugguggugaugaugggugag

SEQ ID NO: 74699 - RNA, 19 nt, Human
guuauggacauucaugccc

SEQ ID NO: 74700 - RNA, 21 nt, Human
gguuuugagagcaggggcugu

SEQ ID NO: 74701 - RNA, 23 nt, Human
gcagguggaucacucugagguca

SEQ ID NO: 74702 - RNA, 20 nt, Human
ggaaggcggaguucaggcug

SEQ ID NO: 74703 - RNA, 21 nt, Human
ccuguucucugacuaacgcca

SEQ ID NO: 74704 - RNA, 25 nt, Human
gaccucucccccucggaggcggcgg

SEQ ID NO: 74705 - RNA, 21 nt, Human
ccuccaauuccaucuucuccc

SEQ ID NO: 74706 - RNA, 20 nt, Human
cccuccaggccucaguuucu

SEQ ID NO: 74707 - RNA, 20 nt, Human
auuugcugcgugagcauuuu

SEQ ID NO: 74708 - RNA, 21 nt, Human
ggggucuccaucuacuuuuug

SEQ ID NO: 74709 - RNA, 22 nt, Human
guaguguccuccuaguauauua

SEQ ID NO: 74710 - RNA, 25 nt, Human
ggaaucacugguaaauguuggcuga

SEQ ID NO: 74711 - RNA, 21 nt, Human
guugagaccagcacucuguga

SEQ ID NO: 74712 - RNA, 21 nt, Human
ccuguaaucccaacacugugg

SEQ ID NO: 74713 - RNA, 21 nt, Human
ccuucuuccucccccugcucc

SEQ ID NO: 74714 - RNA, 23 nt, Human
ggcagaucauuaauuaugagcua

SEQ ID NO: 74715 - RNA, 29 nt, Human
acuauguaaucacagcauggugaagaguu

SEQ ID NO: 74716 - RNA, 22 nt, Human
aacacagccucuccuuuuagca

SEQ ID NO: 74717 - RNA, 22 nt, Human
ccaguuuaguaugcugugguau

SEQ ID NO: 74718 - RNA, 21 nt, Human
gaagugagaaaguuggcacag

SEQ ID NO: 74719 - RNA, 19 nt, Human
aggcugaggcaggauugcu

SEQ ID NO: 74720 - RNA, 21 nt, Human
guggaagcaggucuugcacac

SEQ ID NO: 74721 - RNA, 22 nt, Human
gggaauaagaauaagcugaaca

SEQ ID NO: 74722 - RNA, 27 nt, Human
uauggcuuuaguucacugugauuguac

SEQ ID NO: 74723 - RNA, 22 nt, Human
aaggcaugaauccaggaggcag

SEQ ID NO: 74724 - RNA, 20 nt, Human
cugugguggcuccuguggga

SEQ ID NO: 74725 - RNA, 22 nt, Human
agccucuugaguggcugggauu

SEQ ID NO: 74726 - RNA, 26 nt, Human
cccuccaguccucaguucccacugcc

SEQ ID NO: 74727 - RNA, 25 nt, Human
cucguuacccaggguggagugcagu

SEQ ID NO: 74728 - RNA, 19 nt, Human
gccggaccuccaccuggag

SEQ ID NO: 74729 - RNA, 26 nt, Human
ggcugauuguauuuaccuucuaccuc

SEQ ID NO: 74730 - RNA, 22 nt, Human
cacugccuuucaugggggguga

SEQ ID NO: 74731 - RNA, 21 nt, Human
cugagccucagagcguggaau

SEQ ID NO: 74732 - RNA, 22 nt, Human
caugccuguaaucccagaacuu

SEQ ID NO: 74733 - RNA, 27 nt, Human
cccagcaccaucgguucauagugugcu

SEQ ID NO: 74734 - RNA, 26 nt, Human
gggaccccuccaccccacccuuucac

SEQ ID NO: 74735 - RNA, 24 nt, Human
gaagguugagaccagcagagacug

SEQ ID NO: 74736 - RNA, 24 nt, Human
auuucagaaauuucucuguuugcu

SEQ ID NO: 74737 - RNA, 22 nt, Human
cagggguuucucuuucuggccu

SEQ ID NO: 74738 - RNA, 26 nt, Human
gacuccuguggcuucuggaccccucc

SEQ ID NO: 74739 - RNA, 23 nt, Human
ggcuguaauccuggcuacucagg

SEQ ID NO: 74740 - RNA, 26 nt, Human
cucaacuaaauucauuucuacuccag

SEQ ID NO: 74741 - RNA, 21 nt, Human
gggaaauugaugacuuccuca

SEQ ID NO: 74742 - RNA, 22 nt, Human
cugucccuucucacaggcauuc

SEQ ID NO: 74743 - RNA, 19 nt, Human
ggugaagcuuuguucuaag

SEQ ID NO: 74744 - RNA, 20 nt, Human
aaugucugggaagcugggga

SEQ ID NO: 74745 - RNA, 28 nt, Human
ugaucuccgucuuccugaugaagcaggc

SEQ ID NO: 74746 - RNA, 24 nt, Human
aaccuccagguuccuuaagcuuuu

SEQ ID NO: 74747 - RNA, 21 nt, Human
agacccaugugauuucugcuu

SEQ ID NO: 74748 - RNA, 23 nt, Human
cacaggcuguugucuuauuagua

SEQ ID NO: 74749 - RNA, 26 nt, Human
ucgcaaaccuggagugcagaccacag

SEQ ID NO: 74750 - RNA, 21 nt, Human
ucagaccuuuagacucauugu

SEQ ID NO: 74751 - RNA, 18 nt, Human
uuaaaucggcaacagggc

SEQ ID NO: 74752 - RNA, 21 nt, Human
ucacaugcaucacagccugca

SEQ ID NO: 74753 - RNA, 23 nt, Human
ggcgggggccccacagggccacc

SEQ ID NO: 74754 - RNA, 21 nt, Human
cuugcccaccuuccucuguag

SEQ ID NO: 74755 - RNA, 22 nt, Human
caggucccgaaagaugcaguga

SEQ ID NO: 74756 - RNA, 22 nt, Human
cgccuguaaucccagaacuuug

SEQ ID NO: 74757 - RNA, 22 nt, Human
cgccugucaucccagcacuuug

SEQ ID NO: 74758 - RNA, 26 nt, Human
gcuguugccaagcuggacggcacgag

SEQ ID NO: 74759 - RNA, 21 nt, Human
acagucuucacugugcugcag

SEQ ID NO: 74760 - RNA, 24 nt, Human
cagagcuccaagauauaagcccuc

SEQ ID NO: 74761 - RNA, 27 nt, Human
ccagugggcagaggcagcuucgcaggg

SEQ ID NO: 74762 - RNA, 21 nt, Human
gugaccugacccaggugcaag

SEQ ID NO: 74763 - RNA, 22 nt, Human
ucucccugcaaccuccgccucc

SEQ ID NO: 74764 - RNA, 18 nt, Human
cugucuuucucucuggcc

SEQ ID NO: 74765 - RNA, 23 nt, Human
agcccugcuuugggcugcccugg

SEQ ID NO: 74766 - RNA, 21 nt, Human
cuuggcuucuuugagaauuua

SEQ ID NO: 74767 - RNA, 20 nt, Human
uacucuuauagccugccuuc

SEQ ID NO: 74768 - RNA, 20 nt, Human
uccuccaagcuucaaucugc

SEQ ID NO: 74769 - RNA, 26 nt, Human
ugguggcagugaccucacuaggagaa

SEQ ID NO: 74770 - RNA, 21 nt, Human
ugcugggcucaggccugggug

SEQ ID NO: 74771 - RNA, 22 nt, Human
cuuaaucuugcuuucuuuagaa

SEQ ID NO: 74772 - RNA, 22 nt, Human
gcucugugcuuuccagcaggcg

SEQ ID NO: 74773 - RNA, 25 nt, Human
ggaagaaagggagagagggccaggc

SEQ ID NO: 74774 - RNA, 20 nt, Human
ucgggagaaacagagcugcu

SEQ ID NO: 74775 - RNA, 26 nt, Human
ccuggacuuuggcucagcggugccac

SEQ ID NO: 74776 - RNA, 20 nt, Human
auauuuauauauacauagua

SEQ ID NO: 74777 - RNA, 22 nt, Human
cugaggcacccgcuccucucug

SEQ ID NO: 74778 - RNA, 26 nt, Human
cucuuaucuuuccccacuucauucca

SEQ ID NO: 74779 - RNA, 21 nt, Human
ccucugcacucccuugggcag

SEQ ID NO: 74780 - RNA, 21 nt, Human
ccagcacugcccaucuguaaa

SEQ ID NO: 74781 - RNA, 28 nt, Human
caguggcuucaagaguccuuacugagcc

SEQ ID NO: 74782 - RNA, 22 nt, Human
ggcccugagcacuugaaggugc

SEQ ID NO: 74783 - RNA, 22 nt, Human
uggaagggaagaggcauuugug

SEQ ID NO: 74784 - RNA, 21 nt, Human
caggaccuggagacaggauug

SEQ ID NO: 74785 - RNA, 31 nt, Human
cgggcuggcgggagugcaguucugagucccg

SEQ ID NO: 74786 - RNA, 22 nt, Human
uggccuccuguuccucugcugg

SEQ ID NO: 74787 - RNA, 19 nt, Human
ccacagucuuucguuucca

SEQ ID NO: 74788 - RNA, 24 nt, Human
cgguugguauuguuaacuuuuuau

SEQ ID NO: 74789 - RNA, 19 nt, Human
cuaagcugccuguucgcgc

SEQ ID NO: 74790 - RNA, 22 nt, Human
uugaguuaaagaugacugugua

SEQ ID NO: 74791 - RNA, 23 nt, Human
ggagcuguuuguccaguuuagca

SEQ ID NO: 74792 - RNA, 24 nt, Human
acuucuuaauuuguucauuaauua

SEQ ID NO: 74793 - RNA, 26 nt, Human
ugcccugacuggaguucaguggugca

SEQ ID NO: 74794 - RNA, 22 nt, Human
aauguggccucugcuuccuccg

SEQ ID NO: 74795 - RNA, 20 nt, Human
gacccucaugugagcacuuu

SEQ ID NO: 74796 - RNA, 19 nt, Human
uauugaucuguguuaaucu

SEQ ID NO: 74797 - RNA, 22 nt, Human
uggccaggcuggccagggcgug

SEQ ID NO: 74798 - RNA, 24 nt, Human
ggaggggaagggacggaugggugc

SEQ ID NO: 74799 - RNA, 22 nt, Human
uuuuggauuuaauaaucuugcu

SEQ ID NO: 74800 - RNA, 24 nt, Human
aacuggagaggacccugagaggag

SEQ ID NO: 74801 - RNA, 22 nt, Human
cuaauacccaaacccuaaaccu

SEQ ID NO: 74802 - RNA, 22 nt, Human
uggcgcacaccuguaauccuag

SEQ ID NO: 74803 - RNA, 21 nt, Human
ucagugagccgagauugugcc

SEQ ID NO: 74804 - RNA, 22 nt, Human
uucauauucuucacuauucuug

SEQ ID NO: 74805 - RNA, 25 nt, Human
cgguuuccugcaagaucccuuggcc

SEQ ID NO: 74806 - RNA, 28 nt, Human
aaccauaugaauuuacuacuuuaaagag

SEQ ID NO: 74807 - RNA, 28 nt, Human
ccuaggaugcagugucucauugucccca

SEQ ID NO: 74808 - RNA, 26 nt, Human
cuccaauguaccguuuccuuauucca

SEQ ID NO: 74809 - RNA, 22 nt, Human
ugaagcucugggccucggcuuu

SEQ ID NO: 74810 - RNA, 26 nt, Human
ggccaggcuggagugcaguaaguggc

SEQ ID NO: 74811 - RNA, 21 nt, Human
cuucccugccucuccaggaca

SEQ ID NO: 74812 - RNA, 20 nt, Human
cugucccagccccaucugug

SEQ ID NO: 74813 - RNA, 22 nt, Human
ugaaagaguuuccucggagcau

SEQ ID NO: 74814 - RNA, 26 nt, Human
caugccuugacuucccccaccuccuc

SEQ ID NO: 74815 - RNA, 26 nt, Human
accagccugaccaacguggagaaacc

SEQ ID NO: 74816 - RNA, 20 nt, Human
gcagacacgccuuccccuca

SEQ ID NO: 74817 - RNA, 22 nt, Human
ugcuaagugccauguugggcuc

SEQ ID NO: 74818 - RNA, 25 nt, Human
acaagggcaagaguuagccagaugc

SEQ ID NO: 74819 - RNA, 20 nt, Human
cgaguguccaagaaggcuga

SEQ ID NO: 74820 - RNA, 23 nt, Human
aggagacagaauggaaacggagg

SEQ ID NO: 74821 - RNA, 27 nt, Human
ccuguccccucccccuccgccuccgcc

SEQ ID NO: 74822 - RNA, 20 nt, Human
ucuccccagggguguacggu

SEQ ID NO: 74823 - RNA, 21 nt, Human
gcacauuuaguugagguauac

SEQ ID NO: 74824 - RNA, 21 nt, Human
acuguucuugcaguguuucau

SEQ ID NO: 74825 - RNA, 27 nt, Human
ccgaucuacuggaccgcagaccaccuu

SEQ ID NO: 74826 - RNA, 21 nt, Human
acaagauacucaccaggauga

SEQ ID NO: 74827 - RNA, 22 nt, Human
gacagaaccaccugauguuuua

SEQ ID NO: 74828 - RNA, 19 nt, Human
cuccacacuccuggaauac

SEQ ID NO: 74829 - RNA, 22 nt, Human
cccaccccagacguuuuuaucu

SEQ ID NO: 74830 - RNA, 27 nt, Human
cuggggccugacugcucagaacuugcu

SEQ ID NO: 74831 - RNA, 22 nt, Human
agguugugcagcuggaggcaga

SEQ ID NO: 74832 - RNA, 25 nt, Human
uugccaggguggaggaggagcauug

SEQ ID NO: 74833 - RNA, 27 nt, Human
ugggagguggaggccaagauuguacca

SEQ ID NO: 74834 - RNA, 27 nt, Human
uguucuuucaucucuggaccccacuuu

SEQ ID NO: 74835 - RNA, 26 nt, Human
uuccucccaugguucacuuggcucug

SEQ ID NO: 74836 - RNA, 19 nt, Human
ccccaucccccugccuccc

SEQ ID NO: 74837 - RNA, 24 nt, Human
gggaaguguuuauuagggguacau

SEQ ID NO: 74838 - RNA, 21 nt, Human
ucucucuuucauaugaacuga

SEQ ID NO: 74839 - RNA, 25 nt, Human
gaggcggcguuaccuccagauuccg

SEQ ID NO: 74840 - RNA, 22 nt, Human
uaaaugagccuuucugccucac

SEQ ID NO: 74841 - RNA, 21 nt, Human
acccccacucucugcgacggc

SEQ ID NO: 74842 - RNA, 20 nt, Human
ccuguucccauuugagaagc

SEQ ID NO: 74843 - RNA, 22 nt, Human
ucgcuugagccugggacauuga

SEQ ID NO: 74844 - RNA, 28 nt, Human
ucuccauccauuuccuugcuggguuguc

SEQ ID NO: 74845 - RNA, 18 nt, Human
uuguguuuaugcauuuca

SEQ ID NO: 74846 - RNA, 22 nt, Human
aggaagagagagacggggucag

SEQ ID NO: 74847 - RNA, 21 nt, Human
ugcagccucuaacuccugggc

SEQ ID NO: 74848 - RNA, 20 nt, Human
cuuuucuucugcucucucua

SEQ ID NO: 74849 - RNA, 28 nt, Human
ggggcggcgggcaccgcaggagcuccgc

SEQ ID NO: 74850 - RNA, 27 nt, Human
gcagagaagagaacauuuuuaaaagga

SEQ ID NO: 74851 - RNA, 26 nt, Human
gcucagcugugacgccugaauaacug

SEQ ID NO: 74852 - RNA, 22 nt, Human
caaagagagcacuguccaagga

SEQ ID NO: 74853 - RNA, 18 nt, Human
cuucccuuacuaucgcag

SEQ ID NO: 74854 - RNA, 20 nt, Human
ccuucugcaaggcccuggcc

SEQ ID NO: 74855 - RNA, 23 nt, Human
cgguccaagccugcaacucaucu

SEQ ID NO: 74856 - RNA, 20 nt, Human
aaaacuugaaucacugcaaa

SEQ ID NO: 74857 - RNA, 23 nt, Human
caaaggguuucaccaaggaugga

SEQ ID NO: 74858 - RNA, 23 nt, Human
uuuaacaucaugauuaccaccuu

SEQ ID NO: 74859 - RNA, 22 nt, Human
ugggguuucagcucauaucuua

SEQ ID NO: 74860 - RNA, 22 nt, Human
cuuccaauuaaugcuuuuuuau

SEQ ID NO: 74861 - RNA, 21 nt, Human
cccucauggaccccgcuguca

SEQ ID NO: 74862 - RNA, 20 nt, Human
ucagguggaagccucuggaa

SEQ ID NO: 74863 - RNA, 21 nt, Human
caagaucauuucauccagucc

SEQ ID NO: 74864 - RNA, 22 nt, Human
gucauguaggcuuuucugcgga

SEQ ID NO: 74865 - RNA, 24 nt, Human
cuauguugcccaggcuggucucca

SEQ ID NO: 74866 - RNA, 21 nt, Human
gaguucuggucaaagaaagaa

SEQ ID NO: 74867 - RNA, 27 nt, Human
caucugucuguccuuccuuccauugcu

SEQ ID NO: 74868 - RNA, 27 nt, Human
uuccuuccccugcaccuggccugggcc

SEQ ID NO: 74869 - RNA, 22 nt, Human
uuaacuugccuuuuuccccaaa

SEQ ID NO: 74870 - RNA, 25 nt, Human
guugcccaggcuggucgugaacucc

SEQ ID NO: 74871 - RNA, 26 nt, Human
accgagcccugagugcugugcugcug

SEQ ID NO: 74872 - RNA, 21 nt, Human
ggggugagccgagguguugcc

SEQ ID NO: 74873 - RNA, 20 nt, Human
uacaccauuuagaacuuucc

SEQ ID NO: 74874 - RNA, 24 nt, Human
uuggccucuuugaagaaauggcca

SEQ ID NO: 74875 - RNA, 18 nt, Human
guuccugacuccccaacu

SEQ ID NO: 74876 - RNA, 23 nt, Human
acacaguaagauagguucugcuu

SEQ ID NO: 74877 - RNA, 23 nt, Human
ucggagcugguuccucucuccca

SEQ ID NO: 74878 - RNA, 20 nt, Human
ugauaccuuaauuacacucc

SEQ ID NO: 74879 - RNA, 23 nt, Human
ccacuggccgccucuccuugcca

SEQ ID NO: 74880 - RNA, 17 nt, Human
cuucccuuccccagccc

SEQ ID NO: 74881 - RNA, 26 nt, Human
ggcugcauaagaacuggugaaugggg

SEQ ID NO: 74882 - RNA, 22 nt, Human
ugccugugauccuagcacuuug

SEQ ID NO: 74883 - RNA, 26 nt, Human
ugguaggcacacuugcaguguuacga

SEQ ID NO: 74884 - RNA, 21 nt, Human
ugccucuccccugcucacucc

SEQ ID NO: 74885 - RNA, 20 nt, Human
uuuccucccucuccccugcc

SEQ ID NO: 74886 - RNA, 21 nt, Human
cucuuuguugcucuguauuug

SEQ ID NO: 74887 - RNA, 27 nt, Human
cgaggaggaagagguugauggcggcgg

SEQ ID NO: 74888 - RNA, 21 nt, Human
cugucucuuagagaaagaacu

SEQ ID NO: 74889 - RNA, 20 nt, Human
gucaaacuuuuacaugugaa

SEQ ID NO: 74890 - RNA, 20 nt, Human
ggacguuuuccccaaccucu

SEQ ID NO: 74891 - RNA, 24 nt, Human
guuuucuucuguugucuguuauuu

SEQ ID NO: 74892 - RNA, 23 nt, Human
aucucuagcccaugguuuuggag

SEQ ID NO: 74893 - RNA, 22 nt, Human
cuguaaucccagcuacuaggga

SEQ ID NO: 74894 - RNA, 27 nt, Human
aagcagccgcagcucaacucuuccagc

SEQ ID NO: 74895 - RNA, 21 nt, Human
cugcagucuccacagucuuca

SEQ ID NO: 74896 - RNA, 24 nt, Human
ccaccaggauuacaucaucugcug

SEQ ID NO: 74897 - RNA, 21 nt, Human
aauauuucuccaucauggccu

SEQ ID NO: 74898 - RNA, 22 nt, Human
agagugcugggauuacaguugu

SEQ ID NO: 74899 - RNA, 24 nt, Human
agaggagcuaggccaguccaucug

SEQ ID NO: 74900 - RNA, 22 nt, Human
agcuaauuuuuguauguuuagu

SEQ ID NO: 74901 - RNA, 23 nt, Human
aggcucagucucaggagcauggg

SEQ ID NO: 74902 - RNA, 23 nt, Human
uguggaaucuccaggcugccauc

SEQ ID NO: 74903 - RNA, 26 nt, Human
cugccucuaucccuggccaccugcca

SEQ ID NO: 74904 - RNA, 19 nt, Human
uagcacuguucuguccuca

SEQ ID NO: 74905 - RNA, 20 nt, Human
cugcgugugugcagggagac

SEQ ID NO: 74906 - RNA, 26 nt, Human
gcuggguuuuugaaaggauccuuggg

SEQ ID NO: 74907 - RNA, 27 nt, Human
uucaaaccugugaagaaaggaccugca

SEQ ID NO: 74908 - RNA, 23 nt, Human
ggcauuuuccuccucugccuaca

SEQ ID NO: 74909 - RNA, 26 nt, Human
cugaguuuuccucaguuuucucgucu

SEQ ID NO: 74910 - RNA, 22 nt, Human
aaagugcuaggguuacagacau

SEQ ID NO: 74911 - RNA, 20 nt, Human
gagcuuccugccugccugua

SEQ ID NO: 74912 - RNA, 27 nt, Human
cccugcagagucacucagccaaaucug

SEQ ID NO: 74913 - RNA, 22 nt, Human
ccacuacccacccccacuacag

SEQ ID NO: 74914 - RNA, 22 nt, Human
agaaaggacaacaguucugagc

SEQ ID NO: 74915 - RNA, 23 nt, Human
cccugcagucgacaucauguuug

SEQ ID NO: 74916 - RNA, 21 nt, Human
gccgcugccgccacugccugu

SEQ ID NO: 74917 - RNA, 17 nt, Human
uuucugguguguuaaca

SEQ ID NO: 74918 - RNA, 19 nt, Human
gaaaugaggaaauaaugga

SEQ ID NO: 74919 - RNA, 19 nt, Human
ucauggaauauauaugaca

SEQ ID NO: 74920 - RNA, 25 nt, Human
ucucccccuccucuucuggucuggc

SEQ ID NO: 74921 - RNA, 27 nt, Human
caggcuggacaguucagugauuugccu

SEQ ID NO: 74922 - RNA, 21 nt, Human
ccugucugugugcaucauguu

SEQ ID NO: 74923 - RNA, 24 nt, Human
uucauuucuucaagaugcucuggg

SEQ ID NO: 74924 - RNA, 22 nt, Human
uuagcagcuaucucucagugaa

SEQ ID NO: 74925 - RNA, 25 nt, Human
auagcauuuauuacaugucuuucag

SEQ ID NO: 74926 - RNA, 25 nt, Human
gcgcucuggaggcucaggcgccgcg

SEQ ID NO: 74927 - RNA, 24 nt, Human
gcccuucccaccaggcacuuccuu

SEQ ID NO: 74928 - RNA, 18 nt, Human
guacacagagaaggcuau

SEQ ID NO: 74929 - RNA, 26 nt, Human
cccucuucaggauggagcugaccuca

SEQ ID NO: 74930 - RNA, 23 nt, Human
aacugauuucccaccggggacug

SEQ ID NO: 74931 - RNA, 27 nt, Human
uucuuccccucucuacaacccucucuc

SEQ ID NO: 74932 - RNA, 21 nt, Human
ggaccuguugaacucucucag

SEQ ID NO: 74933 - RNA, 19 nt, Human
ugcagcugagccugagcca

SEQ ID NO: 74934 - RNA, 26 nt, Human
ugcauucacacuaugaaacagaaaga

SEQ ID NO: 74935 - RNA, 22 nt, Human
cugcaaacgcugccugcccgua

SEQ ID NO: 74936 - RNA, 22 nt, Human
cacgaggucagaagaucaagac

SEQ ID NO: 74937 - RNA, 22 nt, Human
cacaaggucaggagaucaagac

SEQ ID NO: 74938 - RNA, 21 nt, Human
uacauguuuuagacagagaca

SEQ ID NO: 74939 - RNA, 27 nt, Human
ggaggggcgcaggaccauggacugggg

SEQ ID NO: 74940 - RNA, 22 nt, Human
cagauucugauucuacagcugc

SEQ ID NO: 74941 - RNA, 21 nt, Human
caccugcacacuccaucuccu

SEQ ID NO: 74942 - RNA, 21 nt, Human
ugccacccaauuacugcuguu

SEQ ID NO: 74943 - RNA, 28 nt, Human
gggugaaaggaagaaggaaguggcugag

SEQ ID NO: 74944 - RNA, 23 nt, Human
cucucucagcugugcaguggaag

SEQ ID NO: 74945 - RNA, 26 nt, Human
aggaagagaaaccaggcccugcguca

SEQ ID NO: 74946 - RNA, 23 nt, Human
ggccuggaaccuuccagagagga

SEQ ID NO: 74947 - RNA, 21 nt, Human
uacauugucuugagcaccaga

SEQ ID NO: 74948 - RNA, 20 nt, Human
agggguacucagcuccaucu

SEQ ID NO: 74949 - RNA, 24 nt, Human
caagaauugcuggaaccugggagg

SEQ ID NO: 74950 - RNA, 22 nt, Human
uaagagcaacagccccagagcc

SEQ ID NO: 74951 - RNA, 29 nt, Human
uccugucuucccugcuccaacucuuucuc

SEQ ID NO: 74952 - RNA, 21 nt, Human
cuuuucuugacagacucucgu

SEQ ID NO: 74953 - RNA, 18 nt, Human
gccagccgugagugcaga

SEQ ID NO: 74954 - RNA, 20 nt, Human
ggggaaggaaaagggaggca

SEQ ID NO: 74955 - RNA, 23 nt, Human
caccacugcagacucgcucuagg

SEQ ID NO: 74956 - RNA, 25 nt, Human
cagagauucuaugaagcccacccag

SEQ ID NO: 74957 - RNA, 21 nt, Human
agcugugggugcaguggcgcc

SEQ ID NO: 74958 - RNA, 27 nt, Human
cugggagguggucugaagcagacaggg

SEQ ID NO: 74959 - RNA, 22 nt, Human
uuauuaaauauguuuucucaau

SEQ ID NO: 74960 - RNA, 21 nt, Human
gagcaccuguuucagacuggg

SEQ ID NO: 74961 - RNA, 32 nt, Human
cugcuccugcagcauggucccugccuuaggcc

SEQ ID NO: 74962 - RNA, 21 nt, Human
gaauuuggaggcaguaguuga

SEQ ID NO: 74963 - RNA, 22 nt, Human
cuaccuccuggguucaagugau

SEQ ID NO: 74964 - RNA, 22 nt, Human
ucccugagacagggagggaaga

SEQ ID NO: 74965 - RNA, 22 nt, Human
gauucacauccucucaaguuag

SEQ ID NO: 74966 - RNA, 20 nt, Human
ugauaccaggccacagcccu

SEQ ID NO: 74967 - RNA, 22 nt, Human
ggaggcaccgcuguauuaaagg

SEQ ID NO: 74968 - RNA, 22 nt, Human
auucucuccaccugagugguuu

SEQ ID NO: 74969 - RNA, 20 nt, Human
cgacagcucuguaucugcca

SEQ ID NO: 74970 - RNA, 21 nt, Human
acauuauuuuauuugccucca

SEQ ID NO: 74971 - RNA, 22 nt, Human
accaggaugugucucagccugg

SEQ ID NO: 74972 - RNA, 27 nt, Human
ucccuccacgcuuagggucugucccgg

SEQ ID NO: 74973 - RNA, 27 nt, Human
ucuuuggucugggcacauuuaauuugu

SEQ ID NO: 74974 - RNA, 21 nt, Human
guggaaagaaaguuugaugga

SEQ ID NO: 74975 - RNA, 22 nt, Human
cuggcuucacuacucagaagau

SEQ ID NO: 74976 - RNA, 27 nt, Human
uuaauuugucuucccauuucucuuuau

SEQ ID NO: 74977 - RNA, 21 nt, Human
ggacuguuuuugguuuuuugu

SEQ ID NO: 74978 - RNA, 27 nt, Human
aggggugccucaagagcaggugggggc

SEQ ID NO: 74979 - RNA, 26 nt, Human
uggaaaccugcccugccugagggccc

SEQ ID NO: 74980 - RNA, 24 nt, Human
gagucuccuucucuucucuucuuu

SEQ ID NO: 74981 - RNA, 26 nt, Human
cgccaaaccucggcauuuuuuguguu

SEQ ID NO: 74982 - RNA, 18 nt, Human
aaaauaaaacaaugagua

SEQ ID NO: 74983 - RNA, 24 nt, Human
cguaaguuuggaaaguuuagcaaa

SEQ ID NO: 74984 - RNA, 25 nt, Human
uuguaguccccgccuuguuucuccc

SEQ ID NO: 74985 - RNA, 24 nt, Human
gggauuacaggcgugugagccacc

SEQ ID NO: 74986 - RNA, 22 nt, Human
cucuguccaucugggccuuugu

SEQ ID NO: 74987 - RNA, 26 nt, Human
agcagcacacccugcaggcggaguuu

SEQ ID NO: 74988 - RNA, 19 nt, Human
gcucaggcaccuugcacua

SEQ ID NO: 74989 - RNA, 21 nt, Human
accugcugguauaacucagag

SEQ ID NO: 74990 - RNA, 25 nt, Human
gggagugagaagggugcguugcaga

SEQ ID NO: 74991 - RNA, 24 nt, Human
cugaauauauuuaaagaaccauca

SEQ ID NO: 74992 - RNA, 21 nt, Human
ggaguggaauauucuguuuag

SEQ ID NO: 74993 - RNA, 23 nt, Human
ggcugggacugcaggcaugugcc

SEQ ID NO: 74994 - RNA, 27 nt, Human
gccagcaugucacugguuuugaaggga

SEQ ID NO: 74995 - RNA, 21 nt, Human
ucuuuccuaaauacuccaucu

SEQ ID NO: 74996 - RNA, 18 nt, Human
agagaaacucuugaaaug

SEQ ID NO: 74997 - RNA, 26 nt, Human
uuggagcuuuccucaaaggguauggu

SEQ ID NO: 74998 - RNA, 22 nt, Human
ugcccaggacugaguccauaug

SEQ ID NO: 74999 - RNA, 23 nt, Human
ugcaaauccuacugaaugcucug

SEQ ID NO: 75000 - RNA, 23 nt, Human
ucuuccucugcuaaauugauguu

SEQ ID NO: 75001 - RNA, 27 nt, Human
cugcuucuagucaaagcuuucucucua

SEQ ID NO: 75002 - RNA, 23 nt, Human
ucugccaccaauauguaucuuca

SEQ ID NO: 75003 - RNA, 23 nt, Human
cacagccccagacccgaaaaaag

SEQ ID NO: 75004 - RNA, 20 nt, Human
uaguaaauuuaauuuacaga

SEQ ID NO: 75005 - RNA, 26 nt, Human
aaggugggagaauugcuugagcuugg

SEQ ID NO: 75006 - RNA, 22 nt, Human
accacgccuggcuaauuuuugu

SEQ ID NO: 75007 - RNA, 23 nt, Human
gugcuuuugccuuaugcauuuca

SEQ ID NO: 75008 - RNA, 24 nt, Human
cucugaagccucaucagucaccgg

SEQ ID NO: 75009 - RNA, 28 nt, Human
uaauccuuggcagggcucagcaggcgca

SEQ ID NO: 75010 - RNA, 19 nt, Human
uuaucaggaaauacugccu

SEQ ID NO: 75011 - RNA, 24 nt, Human
uuuuccauuauguuuagugccucu

SEQ ID NO: 75012 - RNA, 22 nt, Human
aaagugcugagauuacaggugu

SEQ ID NO: 75013 - RNA, 22 nt, Human
aaagugcugggauuacaagugu

SEQ ID NO: 75014 - RNA, 22 nt, Human
agagugcugggauuacaggugu

SEQ ID NO: 75015 - RNA, 22 nt, Human
aaugaaaccaccaguguuauca

SEQ ID NO: 75016 - RNA, 24 nt, Human
cuccucuccacaccugccuggcac

SEQ ID NO: 75017 - RNA, 22 nt, Human
aagcaggcaguguuuugccuuc

SEQ ID NO: 75018 - RNA, 21 nt, Human
gccaugagacugaucccuggc

SEQ ID NO: 75019 - RNA, 22 nt, Human
ugggggcagagggggucuguga

SEQ ID NO: 75020 - RNA, 19 nt, Human
agcucugcaugucugcacc

SEQ ID NO: 75021 - RNA, 23 nt, Human
gugucggggggacagagggaacc

SEQ ID NO: 75022 - RNA, 25 nt, Human
uaacugcaucagggaagaauucuua

SEQ ID NO: 75023 - RNA, 27 nt, Human
uccaguucaauuaaggugauuuuuugu

SEQ ID NO: 75024 - RNA, 18 nt, Human
uccuagagaagauuaucc

SEQ ID NO: 75025 - RNA, 21 nt, Human
uuaagcuugagaugucuguua

SEQ ID NO: 75026 - RNA, 20 nt, Human
gcagccuccagccugcccaa

SEQ ID NO: 75027 - RNA, 26 nt, Human
cauuauuacauggcaguauaaauauu

SEQ ID NO: 75028 - RNA, 19 nt, Human
cugcccuuugagcuuuauu

SEQ ID NO: 75029 - RNA, 24 nt, Human
augucuuaaaaugugggugauagg

SEQ ID NO: 75030 - RNA, 26 nt, Human
ggaacauguuguaagcacugacuggg

SEQ ID NO: 75031 - RNA, 19 nt, Human
gaacaguucagccauuuga

SEQ ID NO: 75032 - RNA, 26 nt, Human
aggauuccauuuugaggaaaaacuac

SEQ ID NO: 75033 - RNA, 22 nt, Human
cgcugccucagccucugccucc

SEQ ID NO: 75034 - RNA, 21 nt, Human
agcaggaaccuguacuggguu

SEQ ID NO: 75035 - RNA, 19 nt, Human
aucacccuaccaacuuuac

SEQ ID NO: 75036 - RNA, 22 nt, Human
uuccuaaaucucuaucucuuua

SEQ ID NO: 75037 - RNA, 21 nt, Human
gagacuucucccauagcaaag

SEQ ID NO: 75038 - RNA, 22 nt, Human
cacugcacuccaaccuagguaa

SEQ ID NO: 75039 - RNA, 22 nt, Human
cacugcacuccagccuagguga

SEQ ID NO: 75040 - RNA, 26 nt, Human
aauugcacuaggcacuccaugaucug

SEQ ID NO: 75041 - RNA, 25 nt, Human
uccucauucauccuggagaggauug

SEQ ID NO: 75042 - RNA, 22 nt, Human
gggcugaggggcggagaggccu

SEQ ID NO: 75043 - RNA, 20 nt, Human
uucaucugagucaccauuua

SEQ ID NO: 75044 - RNA, 25 nt, Human
cucuuccuguuucuguccaucuugu

SEQ ID NO: 75045 - RNA, 26 nt, Human
uugacgccauucuccugccucagccu

SEQ ID NO: 75046 - RNA, 18 nt, Human
ccagcccauuucuccaca

SEQ ID NO: 75047 - RNA, 25 nt, Human
gccuacuccaccuguuacuacuucu

SEQ ID NO: 75048 - RNA, 24 nt, Human
gcaaucaggacucacagcucuuca

SEQ ID NO: 75049 - RNA, 23 nt, Human
cucccagaccuccuucugcuucu

SEQ ID NO: 75050 - RNA, 23 nt, Human
gggcaggcaccugguaccaaggg

SEQ ID NO: 75051 - RNA, 22 nt, Human
agcacagugccuuauucgguag

SEQ ID NO: 75052 - RNA, 25 nt, Human
acauguguacuuaauuucuuuaugu

SEQ ID NO: 75053 - RNA, 18 nt, Human
guucucaggcuggccaga

SEQ ID NO: 75054 - RNA, 25 nt, Human
ccuccuucccugccugcccaccccu

SEQ ID NO: 75055 - RNA, 20 nt, Human
ugggagccaggaugaguguc

SEQ ID NO: 75056 - RNA, 22 nt, Human
cacacucacaggaagcugaugu

SEQ ID NO: 75057 - RNA, 27 nt, Human
caugaacacaaggguuuuauccuuucc

SEQ ID NO: 75058 - RNA, 23 nt, Human
guugauacauaaggaguacuuua

SEQ ID NO: 75059 - RNA, 25 nt, Human
auauauuucacaucuuuauuauugc

SEQ ID NO: 75060 - RNA, 22 nt, Human
aguugguacuuuuucacucccu

SEQ ID NO: 75061 - RNA, 26 nt, Human
ggaggcugaggcagaagaauugaacc

SEQ ID NO: 75062 - RNA, 27 nt, Human
uuauuugcacuaugagccuauagacua

SEQ ID NO: 75063 - RNA, 20 nt, Human
auggaagagaaaacuuagga

SEQ ID NO: 75064 - RNA, 21 nt, Human
uguuuugucaugaauucuuau

SEQ ID NO: 75065 - RNA, 21 nt, Human
cgaguucaaggcugcagugag

SEQ ID NO: 75066 - RNA, 22 nt, Human
acuguuuccccucucugcugcu

SEQ ID NO: 75067 - RNA, 22 nt, Human
acuucucugcugagaaccuucc

SEQ ID NO: 75068 - RNA, 23 nt, Human
aggcuggagugcaguggcaugau

SEQ ID NO: 75069 - RNA, 23 nt, Human
aggcuggagcacaguggugugau

SEQ ID NO: 75070 - RNA, 23 nt, Human
aggcuggagugcagcggcaugac

SEQ ID NO: 75071 - RNA, 21 nt, Human
cugugguucugagaagcccga

SEQ ID NO: 75072 - RNA, 21 nt, Human
gucaacaacaggccagggucu

SEQ ID NO: 75073 - RNA, 25 nt, Human
gcccaggcuggagugcaguggcagg

SEQ ID NO: 75074 - RNA, 22 nt, Human
agcgugaaagcagaugagcugu

SEQ ID NO: 75075 - RNA, 22 nt, Human
ugcaagugucuggagcggcugc

SEQ ID NO: 75076 - RNA, 23 nt, Human
gcucgucggggggacagcuccac

SEQ ID NO: 75077 - RNA, 24 nt, Human
cgcagagaaaagcuccauucuucc

SEQ ID NO: 75078 - RNA, 27 nt, Human
cccuccaggcagagccuaagaugcugg

SEQ ID NO: 75079 - RNA, 21 nt, Human
ugguuccucucuaccugggga

SEQ ID NO: 75080 - RNA, 26 nt, Human
ucagugcuucucugugcaggagccag

SEQ ID NO: 75081 - RNA, 23 nt, Human
ucuguaaccccuguuugugguac

SEQ ID NO: 75082 - RNA, 23 nt, Human
guggccuucagaaaccauucaau

SEQ ID NO: 75083 - RNA, 23 nt, Human
uccccaccucucucagcuuccgg

SEQ ID NO: 75084 - RNA, 25 nt, Human
gaaucacugcaaaucuaucugcucu

SEQ ID NO: 75085 - RNA, 25 nt, Human
gcaccaagcugccagaagcccaggg

SEQ ID NO: 75086 - RNA, 23 nt, Human
acguuucaucuuuuuccccucug

SEQ ID NO: 75087 - RNA, 24 nt, Human
gggugggaugcucacuacagcucu

SEQ ID NO: 75088 - RNA, 21 nt, Human
aggcugaggcaagagaaggcc

SEQ ID NO: 75089 - RNA, 23 nt, Human
uucucucuggguuuggacaugaa

SEQ ID NO: 75090 - RNA, 22 nt, Human
ugaccaggcuggagugcagugg

SEQ ID NO: 75091 - RNA, 27 nt, Human
guuccaggguucucuuguuuugaucug

SEQ ID NO: 75092 - RNA, 25 nt, Human
uccaucaaacaaaucauauguaaua

SEQ ID NO: 75093 - RNA, 24 nt, Human
uacauguuuuuacuaauaauucuu

SEQ ID NO: 75094 - RNA, 21 nt, Human
uguucuccagucucugcagca

SEQ ID NO: 75095 - RNA, 21 nt, Human
aguucacugcaugugcugccc

SEQ ID NO: 75096 - RNA, 22 nt, Human
acucccucagccucucagugcc

SEQ ID NO: 75097 - RNA, 21 nt, Human
aaggcgugucuagaguguggg

SEQ ID NO: 75098 - RNA, 22 nt, Human
caaacucuggggcucaagcagu

SEQ ID NO: 75099 - RNA, 22 nt, Human
gcucacugcaagcuccaacucc

SEQ ID NO: 75100 - RNA, 20 nt, Human
ggccucggcggcaccccucg

SEQ ID NO: 75101 - RNA, 21 nt, Human
cugcucuucccauguuggccu

SEQ ID NO: 75102 - RNA, 22 nt, Human
aaacccaacagauacuggaagu

SEQ ID NO: 75103 - RNA, 23 nt, Human
augcaaacaagaaacgugucaca

SEQ ID NO: 75104 - RNA, 25 nt, Human
gaggaagaagagcgcaggccugggc

SEQ ID NO: 75105 - RNA, 22 nt, Human
ucucuagcugaucagaauuuua

SEQ ID NO: 75106 - RNA, 21 nt, Human
ugugugacagucauucugguu

SEQ ID NO: 75107 - RNA, 20 nt, Human
agccuuucauccuuaguuug

SEQ ID NO: 75108 - RNA, 19 nt, Human
ggacuggccauuuuucugg

SEQ ID NO: 75109 - RNA, 25 nt, Human
auacuacaucuuuaaacaguauuuc

SEQ ID NO: 75110 - RNA, 20 nt, Human
gccaucagguacaguuuaca

SEQ ID NO: 75111 - RNA, 21 nt, Human
gccaugucagcuaucccagua

SEQ ID NO: 75112 - RNA, 19 nt, Human
cugcagccccacuccuggg

SEQ ID NO: 75113 - RNA, 19 nt, Human
acuccauugcccaggcugg

SEQ ID NO: 75114 - RNA, 27 nt, Human
ccuguucugagcugccccuugcccaca

SEQ ID NO: 75115 - RNA, 27 nt, Human
cuugcagaaucugaaugugucuccuga

SEQ ID NO: 75116 - RNA, 26 nt, Human
gcauccagagaccugcccuucuaccu

SEQ ID NO: 75117 - RNA, 21 nt, Human
gcacccagggacgugguuuua

SEQ ID NO: 75118 - RNA, 23 nt, Human
augagacacaucuuguuuuacug

SEQ ID NO: 75119 - RNA, 27 nt, Human
guggaaaugcugcaggaccuaaauaac

SEQ ID NO: 75120 - RNA, 26 nt, Human
cuuuucugucucaaggcauugugugu

SEQ ID NO: 75121 - RNA, 26 nt, Human
uguucugagaucuuuugggugcaguu

SEQ ID NO: 75122 - RNA, 20 nt, Human
ccuuuugguaucuacuucua

SEQ ID NO: 75123 - RNA, 18 nt, Human
ugcuugaggaauauugcu

SEQ ID NO: 75124 - RNA, 25 nt, Human
cacuacaaguauuauuuuacaauca

SEQ ID NO: 75125 - RNA, 23 nt, Human
ccuccaggccccuccuggcuggc

SEQ ID NO: 75126 - RNA, 22 nt, Human
ccuccucccagcuccuggaaac

SEQ ID NO: 75127 - RNA, 21 nt, Human
cuuggggccacaguugccuua

SEQ ID NO: 75128 - RNA, 27 nt, Human
gucugaguugcuguuuggucuggugac

SEQ ID NO: 75129 - RNA, 22 nt, Human
cugggcuuuugcauggcaaugg

SEQ ID NO: 75130 - RNA, 28 nt, Human
uccacaaaacaucuagccaucuaaaaug

SEQ ID NO: 75131 - RNA, 21 nt, Human
uucaugccaccauggccagcc

SEQ ID NO: 75132 - RNA, 20 nt, Human
gcugcuucuggggccugugu

SEQ ID NO: 75133 - RNA, 25 nt, Human
uugcacuccaggcugggcagcaaga

SEQ ID NO: 75134 - RNA, 22 nt, Human
aggcugaggcaggagaaucgcu

SEQ ID NO: 75135 - RNA, 22 nt, Human
gcggggccaccaugcuccugcc

SEQ ID NO: 75136 - RNA, 20 nt, Human
cuguuugcagaaaacugggu

SEQ ID NO: 75137 - RNA, 21 nt, Human
ggguuuuuaaauaagcauuaa

SEQ ID NO: 75138 - RNA, 22 nt, Human
aagaaagaguuguccugauguu

SEQ ID NO: 75139 - RNA, 27 nt, Human
agcucacugcggccucuaagaagguga

SEQ ID NO: 75140 - RNA, 26 nt, Human
uacacugagagccuuuuugaaaguaa

SEQ ID NO: 75141 - RNA, 23 nt, Human
guuuuucuauauuuaacuggaaa

SEQ ID NO: 75142 - RNA, 20 nt, Human
cuguggccccuccuucuccc

SEQ ID NO: 75143 - RNA, 22 nt, Human
ugaauccucacuaugcuauuug

SEQ ID NO: 75144 - RNA, 21 nt, Human
ugacugaugaagugcaccuuu

SEQ ID NO: 75145 - RNA, 20 nt, Human
ggcuacuguauaagugugua

SEQ ID NO: 75146 - RNA, 23 nt, Human
uaucugcaccuggacguaaugga

SEQ ID NO: 75147 - RNA, 25 nt, Human
cccagccucauccucuuaguugggu

SEQ ID NO: 75148 - RNA, 18 nt, Human
gccccagguaucacugca

SEQ ID NO: 75149 - RNA, 26 nt, Human
acuugucaucugaagagucauauuag

SEQ ID NO: 75150 - RNA, 25 nt, Human
agaaaacaacaaaaaacuuaagcuu

SEQ ID NO: 75151 - RNA, 15 nt, Human
acuuucucauacacu

SEQ ID NO: 75152 - RNA, 23 nt, Human
gccuucccccucccuuuugcgca

SEQ ID NO: 75153 - RNA, 26 nt, Human
aucaaauuacauguguaaucaaggcu

SEQ ID NO: 75154 - RNA, 21 nt, Human
uuaaaaaagugguggcaaaag

SEQ ID NO: 75155 - RNA, 20 nt, Human
aucauuuguucccacucaga

SEQ ID NO: 75156 - RNA, 27 nt, Human
ccugguauuccccuccuaaccuggguu

SEQ ID NO: 75157 - RNA, 23 nt, Human
ucuccaaugcuaacuuucugaca

SEQ ID NO: 75158 - RNA, 27 nt, Human
guacuguuccagcaucuucccuggaug

SEQ ID NO: 75159 - RNA, 29 nt, Human
uuaguuuucucaguauuuucccaaauauu

SEQ ID NO: 75160 - RNA, 20 nt, Human
ccucccagggccagggcccu

SEQ ID NO: 75161 - RNA, 21 nt, Human
uggucucaagcuaaaacaaaa

SEQ ID NO: 75162 - RNA, 23 nt, Human
ugucagcauuacaggauccccag

SEQ ID NO: 75163 - RNA, 21 nt, Human
ccccagacauacccacagcau

SEQ ID NO: 75164 - RNA, 25 nt, Human
agguaucuccccuccucucucuccc

SEQ ID NO: 75165 - RNA, 21 nt, Human
ccuuucucacacuccacugcc

SEQ ID NO: 75166 - RNA, 27 nt, Human
cuuuguuguauuuuccaugauguuucu

SEQ ID NO: 75167 - RNA, 22 nt, Human
cgcgggacgaggagaucggagc

SEQ ID NO: 75168 - RNA, 23 nt, Human
uaucuccuuuaaugacauugauu

SEQ ID NO: 75169 - RNA, 26 nt, Human
cuucccagccucuccucaguuuccca

SEQ ID NO: 75170 - RNA, 21 nt, Human
gaguucuggaauuggaaaacc

SEQ ID NO: 75171 - RNA, 27 nt, Human
agcaggaaccaagaaagcaauacugua

SEQ ID NO: 75172 - RNA, 23 nt, Human
gugucuugguuucugccugcugc

SEQ ID NO: 75173 - RNA, 21 nt, Human
gucuggagauccgggugaagg

SEQ ID NO: 75174 - RNA, 23 nt, Human
guuguuuucuguucccuugccau

SEQ ID NO: 75175 - RNA, 28 nt, Human
agcagccccucagggcuucccaaggaug

SEQ ID NO: 75176 - RNA, 20 nt, Human
ggugaagccuuauuuguuuu

SEQ ID NO: 75177 - RNA, 22 nt, Human
cacccaggcuggagugcggugg

SEQ ID NO: 75178 - RNA, 21 nt, Human
guugcccaggcuggucucgaa

SEQ ID NO: 75179 - RNA, 22 nt, Human
cgcccaggcuggagugcagugg

SEQ ID NO: 75180 - RNA, 22 nt, Human
ugcccaggcuggaguguagugg

SEQ ID NO: 75181 - RNA, 24 nt, Human
auacauuuaacuuguaaaauagac

SEQ ID NO: 75182 - RNA, 26 nt, Human
uucuucacaaggcugagagugcuucc

SEQ ID NO: 75183 - RNA, 18 nt, Human
uagagggagagaugcagu

SEQ ID NO: 75184 - RNA, 27 nt, Human
agcagcagcagcagcagcacaauucug

SEQ ID NO: 75185 - RNA, 23 nt, Human
uuuaguauuuauuacaauaaaaa

SEQ ID NO: 75186 - RNA, 27 nt, Human
ccuugcucuguggcuuuucccaacaca

SEQ ID NO: 75187 - RNA, 22 nt, Human
guuccuugacccugggaaaugu

SEQ ID NO: 75188 - RNA, 23 nt, Human
uuuugcccaggcuggagugcagu

SEQ ID NO: 75189 - RNA, 24 nt, Human
cagcuuuuuagcuuacauaacugg

SEQ ID NO: 75190 - RNA, 22 nt, Human
uccucaccuugaaaucgggcuu

SEQ ID NO: 75191 - RNA, 27 nt, Human
cuuuguuggcaccucagauuaaucaua

SEQ ID NO: 75192 - RNA, 27 nt, Human
gugaugauugaagaugcugcuccaaua

SEQ ID NO: 75193 - RNA, 25 nt, Human
ccuccugcacaccuggccuccuggg

SEQ ID NO: 75194 - RNA, 19 nt, Human
gggggagcuggugccugga

SEQ ID NO: 75195 - RNA, 20 nt, Human
ucaaaccauuugccaaaaau

SEQ ID NO: 75196 - RNA, 24 nt, Human
agcuuuuuggcuuucuuuuuuccc

SEQ ID NO: 75197 - RNA, 22 nt, Human
cccagccucagguugcuggagc

SEQ ID NO: 75198 - RNA, 19 nt, Human
ucuccucuguggucuugcc

SEQ ID NO: 75199 - RNA, 24 nt, Human
cugugugcccugaaaauguuacca

SEQ ID NO: 75200 - RNA, 23 nt, Human
cguucccaguacugccucgucug

SEQ ID NO: 75201 - RNA, 22 nt, Human
aaaucguguaucugucauucua

SEQ ID NO: 75202 - RNA, 20 nt, Human
uuuaagccucagggcugguc

SEQ ID NO: 75203 - RNA, 20 nt, Human
uccugucaagggggcagcag

SEQ ID NO: 75204 - RNA, 25 nt, Human
agccuccucucaccccauuccaggu

SEQ ID NO: 75205 - RNA, 25 nt, Human
cuccuccccacccuccuggccucag

SEQ ID NO: 75206 - RNA, 22 nt, Human
aauggcgcgaucucagcucacu

SEQ ID NO: 75207 - RNA, 22 nt, Human
aauggcacgaucucggcucacu

SEQ ID NO: 75208 - RNA, 19 nt, Human
auacauucagguggugcug

SEQ ID NO: 75209 - RNA, 27 nt, Human
cuauugcacuccagucuggguaacagg

SEQ ID NO: 75210 - RNA, 22 nt, Human
gggaggcagagguugcagugag

SEQ ID NO: 75211 - RNA, 22 nt, Human
ggaaggcagaaguugcagugag

SEQ ID NO: 75212 - RNA, 25 nt, Human
cucaaucauuuuauucagcaacugg

SEQ ID NO: 75213 - RNA, 26 nt, Human
auugcuuuuucauuuucuuagcagug

SEQ ID NO: 75214 - RNA, 25 nt, Human
gacaccugcucacucaccaccagcu

SEQ ID NO: 75215 - RNA, 28 nt, Human
acaggagcugggaccaagaucuucggcc

SEQ ID NO: 75216 - RNA, 25 nt, Human
agggcagacagaaccucugggacac

SEQ ID NO: 75217 - RNA, 23 nt, Human
acuuccaccuccagccucugguc

SEQ ID NO: 75218 - RNA, 23 nt, Human
guuggcgggcggcgaggagaagc

SEQ ID NO: 75219 - RNA, 24 nt, Human
ccuucagcuguguaucccagacug

SEQ ID NO: 75220 - RNA, 25 nt, Human
caugagccacugcaccugcccagcu

SEQ ID NO: 75221 - RNA, 22 nt, Human
guguaauuucuuugccuguuca

SEQ ID NO: 75222 - RNA, 22 nt, Human
cugcaaccucugccuccugggc

SEQ ID NO: 75223 - RNA, 23 nt, Human
cagccucucucgugcuuuucucc

SEQ ID NO: 75224 - RNA, 23 nt, Human
gguugcugagcgggccugggaca

SEQ ID NO: 75225 - RNA, 26 nt, Human
uacccuuagugguagccaugacacga

SEQ ID NO: 75226 - RNA, 22 nt, Human
ccauugcacuccagccugggug

SEQ ID NO: 75227 - RNA, 27 nt, Human
ugggaggucaagaugggaggauugcuu

SEQ ID NO: 75228 - RNA, 22 nt, Human
ccacugcacucuagccugggug

SEQ ID NO: 75229 - RNA, 27 nt, Human
gggcugcugcugucacucccucuccac

SEQ ID NO: 75230 - RNA, 21 nt, Human
uuuacugugaaaaagcauuuu

SEQ ID NO: 75231 - RNA, 21 nt, Human
uuaagcaagcagggugggguu

SEQ ID NO: 75232 - RNA, 26 nt, Human
cuuuguuuugggggucaggcagccag

SEQ ID NO: 75233 - RNA, 21 nt, Human
gaaaaugcuuaaaagugauag

SEQ ID NO: 75234 - RNA, 26 nt, Human
gcccggcuuugaacccgcccugcacu

SEQ ID NO: 75235 - RNA, 25 nt, Human
uucucauaugauagcuuaugaugcc

SEQ ID NO: 75236 - RNA, 19 nt, Human
ggaaaggguugaugcucau

SEQ ID NO: 75237 - RNA, 26 nt, Human
uauuuauacugaaugaguuacuguaa

SEQ ID NO: 75238 - RNA, 19 nt, Human
gcauucuucaaauaguccg

SEQ ID NO: 75239 - RNA, 20 nt, Human
ggaaggcuuggcuccugucu

SEQ ID NO: 75240 - RNA, 23 nt, Human
uaguccugccugagguugcagug

SEQ ID NO: 75241 - RNA, 22 nt, Human
uugaccagaugcgagacauguu

SEQ ID NO: 75242 - RNA, 26 nt, Human
aacucauguaacccuccuguuucuua

SEQ ID NO: 75243 - RNA, 27 nt, Human
ccugucccucuuagcacucuagcugcc

SEQ ID NO: 75244 - RNA, 20 nt, Human
ucuugggcaagcagaaaaau

SEQ ID NO: 75245 - RNA, 22 nt, Human
cacuggagcuuagccugagagg

SEQ ID NO: 75246 - RNA, 22 nt, Human
uagaagcuccucaggaaagcca

SEQ ID NO: 75247 - RNA, 22 nt, Human
ccauccacagagcagugcagug

SEQ ID NO: 75248 - RNA, 21 nt, Human
ugccuuugcaucuccacacau

SEQ ID NO: 75249 - RNA, 21 nt, Human
auuagcucaguuuucucauca

SEQ ID NO: 75250 - RNA, 27 nt, Human
aagccccggaguuggagaccagccaga

SEQ ID NO: 75251 - RNA, 23 nt, Human
auauacuugcuccaaauaaguca

SEQ ID NO: 75252 - RNA, 22 nt, Human
cuuggccucccaaagcguuggg

SEQ ID NO: 75253 - RNA, 22 nt, Human
gagcgagacucugucucaauaa

SEQ ID NO: 75254 - RNA, 22 nt, Human
gagcgagacucagucucaaaaa

SEQ ID NO: 75255 - RNA, 21 nt, Human
cuguuuccuguuuucucccga

SEQ ID NO: 75256 - RNA, 23 nt, Human
aaagugcugggacuuuuugguaa

SEQ ID NO: 75257 - RNA, 27 nt, Human
gccucaaccuccugggcucaagcaacc

SEQ ID NO: 75258 - RNA, 23 nt, Human
ucauaagaaaaaucagcugaagu

SEQ ID NO: 75259 - RNA, 23 nt, Human
aacaggggcuucuuucuuuucga

SEQ ID NO: 75260 - RNA, 25 nt, Human
ccucgcuugccuguuccuuuuccac

SEQ ID NO: 75261 - RNA, 20 nt, Human
uccuucuccccgccuuggcc

SEQ ID NO: 75262 - RNA, 21 nt, Human
gaagucuugcucugucgccca

SEQ ID NO: 75263 - RNA, 26 nt, Human
uguauacaaacaggugcuaacacugu

SEQ ID NO: 75264 - RNA, 26 nt, Human
gugcauuaugcacuugcugcugccuc

SEQ ID NO: 75265 - RNA, 22 nt, Human
uggcuauaauccuagcacuuug

SEQ ID NO: 75266 - RNA, 25 nt, Human
gcccaggcugcagugcaguggcaug

SEQ ID NO: 75267 - RNA, 21 nt, Human
ugcuuaguauugacacucucu

SEQ ID NO: 75268 - RNA, 24 nt, Human
ccagcacucugggaaccuggguug

SEQ ID NO: 75269 - RNA, 18 nt, Human
uaccauguuagcugugua

SEQ ID NO: 75270 - RNA, 27 nt, Human
cuguggcuucaggaagaggagggcaag

SEQ ID NO: 75271 - RNA, 22 nt, Human
gucgggaguuggaggccagccu

SEQ ID NO: 75272 - RNA, 18 nt, Human
ugacaucuucagcuucca

SEQ ID NO: 75273 - RNA, 18 nt, Human
ccugcucugcugugagcc

SEQ ID NO: 75274 - RNA, 22 nt, Human
cacugcacugcagccugaguga

SEQ ID NO: 75275 - RNA, 22 nt, Human
cccugcacuccagccuggguga

SEQ ID NO: 75276 - RNA, 23 nt, Human
guuccccaggcucacaguguaga

SEQ ID NO: 75277 - RNA, 22 nt, Human
ccagcacuuucuuucugaugau

SEQ ID NO: 75278 - RNA, 27 nt, Human
auuucauucaaaccucacaacagucuu

SEQ ID NO: 75279 - RNA, 20 nt, Human
uauuaagccugccuacuucu

SEQ ID NO: 75280 - RNA, 23 nt, Human
gucccuuuaaacguuugccccug

SEQ ID NO: 75281 - RNA, 24 nt, Human
uaguggggucagggcugagaggag

SEQ ID NO: 75282 - RNA, 27 nt, Human
cucgaggcuguucccuguccugccuca

SEQ ID NO: 75283 - RNA, 21 nt, Human
uggaaauguuuuaugcuacaa

SEQ ID NO: 75284 - RNA, 20 nt, Human
gcccgcagucuuuuucucug

SEQ ID NO: 75285 - RNA, 26 nt, Human
gacugccagccccuguccucccuuca

SEQ ID NO: 75286 - RNA, 21 nt, Human
auguagaaaggacauauuuga

SEQ ID NO: 75287 - RNA, 19 nt, Human
gcacagccucuggggugcu

SEQ ID NO: 75288 - RNA, 26 nt, Human
ucacuugagccugaguucaacacugc

SEQ ID NO: 75289 - RNA, 20 nt, Human
aggagagaagaaugagccua

SEQ ID NO: 75290 - RNA, 25 nt, Human
uucuauuaacuuuaauucucuuuca

SEQ ID NO: 75291 - RNA, 21 nt, Human
uuuguuucguuucugugaucu

SEQ ID NO: 75292 - RNA, 22 nt, Human
ccugagcacuccucucucucca

SEQ ID NO: 75293 - RNA, 27 nt, Human
auccuaagguucuugcuuucucucuca

SEQ ID NO: 75294 - RNA, 19 nt, Human
ccaggacccaggaggugug

SEQ ID NO: 75295 - RNA, 26 nt, Human
cugagcugaauguagugauguuuaca

SEQ ID NO: 75296 - RNA, 26 nt, Human
ccugcagcugcagggcacuaaugacc

SEQ ID NO: 75297 - RNA, 24 nt, Human
guccauacccauucauuaauaaac

SEQ ID NO: 75298 - RNA, 22 nt, Human
cugagccucuaguuccucacuc

SEQ ID NO: 75299 - RNA, 27 nt, Human
caaaaucaagcuguuuucuuuugaaag

SEQ ID NO: 75300 - RNA, 21 nt, Human
agcuccucaaacaggguucag

SEQ ID NO: 75301 - RNA, 27 nt, Human
cagcauuugucuccuccuuuaacugag

SEQ ID NO: 75302 - RNA, 25 nt, Human
uaugcuuauuucugugccuacugua

SEQ ID NO: 75303 - RNA, 20 nt, Human
ugagagaaacuuuuauuuug

SEQ ID NO: 75304 - RNA, 19 nt, Human
gaagcaguugagucgucau

SEQ ID NO: 75305 - RNA, 24 nt, Human
acugguuuuaagugcuuuccuucu

SEQ ID NO: 75306 - RNA, 22 nt, Human
aaaccuaccagccagaggguag

SEQ ID NO: 75307 - RNA, 26 nt, Human
cccugccucuguguagccgcccugag

SEQ ID NO: 75308 - RNA, 27 nt, Human
aaacuauuguccauuaacaugauaugc

SEQ ID NO: 75309 - RNA, 22 nt, Human
gcacagccaggcuggagucagu

SEQ ID NO: 75310 - RNA, 22 nt, Human
uuccaccauagagauggcgucc

SEQ ID NO: 75311 - RNA, 20 nt, Human
ucacuucucuuccucccuca

SEQ ID NO: 75312 - RNA, 21 nt, Human
uuccaccuucuuuucauuucu

SEQ ID NO: 75313 - RNA, 26 nt, Human
ucaccuaggugaggugugugcagcag

SEQ ID NO: 75314 - RNA, 30 nt, Human
caaaacagaucaugccaaaugaguugccug

SEQ ID NO: 75315 - RNA, 21 nt, Human
acaagcuuggaaaguguuagg

SEQ ID NO: 75316 - RNA, 24 nt, Human
ccucuaaccuccugaccucaugcu

SEQ ID NO: 75317 - RNA, 26 nt, Human
uucccuucaucugggcacugaaggga

SEQ ID NO: 75318 - RNA, 22 nt, Human
gaugggguuucaucacguugcc

SEQ ID NO: 75319 - RNA, 21 nt, Human
ggcuuuguggucaucauguuc

SEQ ID NO: 75320 - RNA, 25 nt, Human
ugucaacaaguuggcuccagucaga

SEQ ID NO: 75321 - RNA, 22 nt, Human
cuggaauacuuucacaaaauaa

SEQ ID NO: 75322 - RNA, 22 nt, Human
aaugggaagaggagaauggugu

SEQ ID NO: 75323 - RNA, 23 nt, Human
gggagacacacacagccucucug

SEQ ID NO: 75324 - RNA, 22 nt, Human
ggggcagccagccacagcccga

SEQ ID NO: 75325 - RNA, 24 nt, Human
ugcagcucugguaccuccugccca

SEQ ID NO: 75326 - RNA, 26 nt, Human
cauagaacaauguuuaugcuauagcc

SEQ ID NO: 75327 - RNA, 21 nt, Human
agccuccuucccuuccagcuc

SEQ ID NO: 75328 - RNA, 22 nt, Human
uuuguucugcuccagcuguucg

SEQ ID NO: 75329 - RNA, 21 nt, Human
accagaagacguggaggggag

SEQ ID NO: 75330 - RNA, 19 nt, Human
cgaccuacagggagcccua

SEQ ID NO: 75331 - RNA, 20 nt, Human
gcacccucauacacauuuag

SEQ ID NO: 75332 - RNA, 23 nt, Human
gcaggagacagagauccccuugc

SEQ ID NO: 75333 - RNA, 21 nt, Human
gcuuuuucgaaaacagcccac

SEQ ID NO: 75334 - RNA, 24 nt, Human
ucucguaccucagccucccgagua

SEQ ID NO: 75335 - RNA, 22 nt, Human
gggauuacaggugugagccacg

SEQ ID NO: 75336 - RNA, 21 nt, Human
uguguugagcaaguugcagug

SEQ ID NO: 75337 - RNA, 25 nt, Human
caacauuugcagauguuuuagaagg

SEQ ID NO: 75338 - RNA, 22 nt, Human
cgccuguaaucccagcucuuug

SEQ ID NO: 75339 - RNA, 22 nt, Human
ugccuguacucccagcacuuug

SEQ ID NO: 75340 - RNA, 21 nt, Human
ucugccuccccucuggucucc

SEQ ID NO: 75341 - RNA, 26 nt, Human
caaguagagucaggaugaacuaugug

SEQ ID NO: 75342 - RNA, 24 nt, Human
ggaugcagcucuugggaccguguu

SEQ ID NO: 75343 - RNA, 20 nt, Human
guuuaguucuccuugucaua

SEQ ID NO: 75344 - RNA, 22 nt, Human
gucaggacuuuugcuauugcaa

SEQ ID NO: 75345 - RNA, 23 nt, Human
accagcccugcucacgccaugcc

SEQ ID NO: 75346 - RNA, 21 nt, Human
gagcaagcucaucucuggaac

SEQ ID NO: 75347 - RNA, 20 nt, Human
uuccaguuugauguugcugg

SEQ ID NO: 75348 - RNA, 25 nt, Human
gaagaagaagagacagagcugccca

SEQ ID NO: 75349 - RNA, 21 nt, Human
cugggcaggccuucucuuguc

SEQ ID NO: 75350 - RNA, 22 nt, Human
gggauuacaagcgugagccacc

SEQ ID NO: 75351 - RNA, 27 nt, Human
uguucugacauuaacaguuuuccauga

SEQ ID NO: 75352 - RNA, 22 nt, Human
ugaccucaugaaaugaguugca

SEQ ID NO: 75353 - RNA, 25 nt, Human
aucuaaucacuggaaaccaugugau

SEQ ID NO: 75354 - RNA, 26 nt, Human
cccggcagacuucaagagucucagac

SEQ ID NO: 75355 - RNA, 21 nt, Human
ccaggugcaggcaugagccag

SEQ ID NO: 75356 - RNA, 23 nt, Human
cuccacaugguuccugccugcuc

SEQ ID NO: 75357 - RNA, 21 nt, Human
caacuugugacugcucacuua

SEQ ID NO: 75358 - RNA, 27 nt, Human
acuguaacauuuggggggugggccagg

SEQ ID NO: 75359 - RNA, 24 nt, Human
cugcugcuagaugaucucuaauga

SEQ ID NO: 75360 - RNA, 22 nt, Human
gccugugaucccagcacuuugg

SEQ ID NO: 75361 - RNA, 19 nt, Human
ugcucaaggaaucggcugg

SEQ ID NO: 75362 - RNA, 22 nt, Human
ggguccugcuccuaucucucca

SEQ ID NO: 75363 - RNA, 21 nt, Human
cuccagccuggcguccagggc

SEQ ID NO: 75364 - RNA, 23 nt, Human
cacaagguaaacguggucaaggg

SEQ ID NO: 75365 - RNA, 26 nt, Human
gcccaaagcucugaauaguuaaaaau

SEQ ID NO: 75366 - RNA, 18 nt, Human
aggggcagcaaugcugaa

SEQ ID NO: 75367 - RNA, 27 nt, Human
uucucauaagcgaugucuggagugauu

SEQ ID NO: 75368 - RNA, 21 nt, Human
cgaaagaugggacugguugac

SEQ ID NO: 75369 - RNA, 22 nt, Human
uaccugcacaguuugauucuuu

SEQ ID NO: 75370 - RNA, 20 nt, Human
agagagcagagaggaugacu

SEQ ID NO: 75371 - RNA, 27 nt, Human
cacugcugagaaaucuccucaaaccca

SEQ ID NO: 75372 - RNA, 26 nt, Human
acugagcaguagguaggcucacuucu

SEQ ID NO: 75373 - RNA, 26 nt, Human
auacgcaccacaucucuaucuggccu

SEQ ID NO: 75374 - RNA, 25 nt, Human
cucccugggggccccaggauggggg

SEQ ID NO: 75375 - RNA, 26 nt, Human
agcucuguguguaccgagaacugggg

SEQ ID NO: 75376 - RNA, 19 nt, Human
cuaucuagcaacccuaaca

SEQ ID NO: 75377 - RNA, 26 nt, Human
ggagcaagaaaugaaaaggaaccuga

SEQ ID NO: 75378 - RNA, 32 nt, Human
cuuggcuaacuuuucaaaauuaaagauuuuga

SEQ ID NO: 75379 - RNA, 24 nt, Human
cccacagugggugccuuccagaaa

SEQ ID NO: 75380 - RNA, 22 nt, Human
ccccuaugccuuccuucucuuu

SEQ ID NO: 75381 - RNA, 19 nt, Human
gccucuagcuucaggcugg

SEQ ID NO: 75382 - RNA, 22 nt, Human
cugaggcaggagaaucgcuaga

SEQ ID NO: 75383 - RNA, 22 nt, Human
cuguggcaggagaaucgcuuga

SEQ ID NO: 75384 - RNA, 22 nt, Human
agggaaagcccgugucaaugaa

SEQ ID NO: 75385 - RNA, 25 nt, Human
ggcugggaaaacaugggaacaagag

SEQ ID NO: 75386 - RNA, 26 nt, Human
gcaguuucuucaucucaccauccugu

SEQ ID NO: 75387 - RNA, 20 nt, Human
caaaaauuauuuucuguuag

SEQ ID NO: 75388 - RNA, 23 nt, Human
gggagguggccaaggaugcugga

SEQ ID NO: 75389 - RNA, 21 nt, Human
cccugccggagccucagacac

SEQ ID NO: 75390 - RNA, 21 nt, Human
uucuucucccuggcaaggcuc

SEQ ID NO: 75391 - RNA, 22 nt, Human
ucacccaggcuggagugcagua

SEQ ID NO: 75392 - RNA, 25 nt, Human
ucagcuaaguauuugccuaacccug

SEQ ID NO: 75393 - RNA, 27 nt, Human
guacuuguuacccagcuucucaacauc

SEQ ID NO: 75394 - RNA, 27 nt, Human
uucauucuucuuucuugaaaucccaaa

SEQ ID NO: 75395 - RNA, 27 nt, Human
ccccaacagcacagcuaaauuuccaag

SEQ ID NO: 75396 - RNA, 21 nt, Human
uggauuuuguuauaagcauca

SEQ ID NO: 75397 - RNA, 21 nt, Human
gcccuggcuccugggggcggg

SEQ ID NO: 75398 - RNA, 22 nt, Human
ggaggugguggcggggguuauu

SEQ ID NO: 75399 - RNA, 25 nt, Human
agcucucaauuucauggcaggccau

SEQ ID NO: 75400 - RNA, 22 nt, Human
gcuggagggguggggagcuaga

SEQ ID NO: 75401 - RNA, 21 nt, Human
cccugggugugcacacagggc

SEQ ID NO: 75402 - RNA, 22 nt, Human
cugggugaaacccuuuucuccc

SEQ ID NO: 75403 - RNA, 26 nt, Human
ugggacuggagguugauaguuuaagu

SEQ ID NO: 75404 - RNA, 18 nt, Human
agacccaucucuccucca

SEQ ID NO: 75405 - RNA, 22 nt, Human
ccuucccuggcccugcugccga

SEQ ID NO: 75406 - RNA, 22 nt, Human
ccugucugcccuccuggaugcu

SEQ ID NO: 75407 - RNA, 27 nt, Human
agagaauguuccagacauucucgcuuc

SEQ ID NO: 75408 - RNA, 22 nt, Human
gacuacaggcacgcgccaccau

SEQ ID NO: 75409 - RNA, 21 nt, Human
ucagggagggagggcggugga

SEQ ID NO: 75410 - RNA, 23 nt, Human
auccuuugacugguuagccaguu

SEQ ID NO: 75411 - RNA, 23 nt, Human
agguagccucuucauaggaacca

SEQ ID NO: 75412 - RNA, 21 nt, Human
auuaagguagcagcauuuuua

SEQ ID NO: 75413 - RNA, 24 nt, Human
acaggauuuuaccauguuggccag

SEQ ID NO: 75414 - RNA, 24 nt, Human
ggcugcaguucuggacgggcuggc

SEQ ID NO: 75415 - RNA, 25 nt, Human
ccaaagaccugcagccaccagugcu

SEQ ID NO: 75416 - RNA, 22 nt, Human
caggagcaggaguugagcuugg

SEQ ID NO: 75417 - RNA, 19 nt, Human
caguaaaauauuuucuuua

SEQ ID NO: 75418 - RNA, 27 nt, Human
gcugccccaucuccccucagcucggcu

SEQ ID NO: 75419 - RNA, 26 nt, Human
ugaggagaagugaaguuucacugugg

SEQ ID NO: 75420 - RNA, 18 nt, Human
uuguuuccccuccuuccc

SEQ ID NO: 75421 - RNA, 22 nt, Human
acagacacuucuccugccuucc

SEQ ID NO: 75422 - RNA, 20 nt, Human
agcuuugcaaccuuguacuu

SEQ ID NO: 75423 - RNA, 17 nt, Human
cagaacagcuguggaga

SEQ ID NO: 75424 - RNA, 19 nt, Human
uuggggaaaacugggugaa

SEQ ID NO: 75425 - RNA, 26 nt, Human
gcaaugcucagcuucucacuagacua

SEQ ID NO: 75426 - RNA, 21 nt, Human
gccaguaacaagaaaaauuaa

SEQ ID NO: 75427 - RNA, 23 nt, Human
cccagguaacaggaauaauucug

SEQ ID NO: 75428 - RNA, 29 nt, Human
uuauuugggggacaggaguguggauaccu

SEQ ID NO: 75429 - RNA, 24 nt, Human
acagaccaucugcauauuuuguag

SEQ ID NO: 75430 - RNA, 21 nt, Human
aaagaaucccugcagccuggu

SEQ ID NO: 75431 - RNA, 21 nt, Human
aucaguaucaguugugauuau

SEQ ID NO: 75432 - RNA, 23 nt, Human
uacuuccugagagguuaguacau

SEQ ID NO: 75433 - RNA, 20 nt, Human
cuaggaaugaagaggaggcu

SEQ ID NO: 75434 - RNA, 25 nt, Human
uuccauucuuguccuggcuggacca

SEQ ID NO: 75435 - RNA, 22 nt, Human
uuccuccucccgguccuuucga

SEQ ID NO: 75436 - RNA, 22 nt, Human
cucuagcuaccaugcacaugua

SEQ ID NO: 75437 - RNA, 27 nt, Human
uccauugggugcagucauguagaucug

SEQ ID NO: 75438 - RNA, 23 nt, Human
cagagcuggggaaaugggcccgc

SEQ ID NO: 75439 - RNA, 26 nt, Human
cccaagacuucaguccuggucugcuc

SEQ ID NO: 75440 - RNA, 25 nt, Human
aaagauaggcuaucucaacacugcu

SEQ ID NO: 75441 - RNA, 23 nt, Human
uucugugccaucugaacaugcuc

SEQ ID NO: 75442 - RNA, 21 nt, Human
ggcucacugcaaccuccgccu

SEQ ID NO: 75443 - RNA, 21 nt, Human
agcucacuacaaccuccgccu

SEQ ID NO: 75444 - RNA, 26 nt, Human
cuuagcaaucuuauugcacacuguuc

SEQ ID NO: 75445 - RNA, 22 nt, Human
uuccaugagcugauuuuccuga

SEQ ID NO: 75446 - RNA, 21 nt, Human
accagcccgacagugccaucc

SEQ ID NO: 75447 - RNA, 20 nt, Human
cccucuuuuccucuggaugc

SEQ ID NO: 75448 - RNA, 20 nt, Human
gggguuucuuugguguuacc

SEQ ID NO: 75449 - RNA, 20 nt, Human
aguucucuagcauggccuga

SEQ ID NO: 75450 - RNA, 22 nt, Human
cauuuccacagaauucacagga

SEQ ID NO: 75451 - RNA, 26 nt, Human
gccuugcaggcuggagggcggcugga

SEQ ID NO: 75452 - RNA, 27 nt, Human
gaacccaggaaguggcaguugcaguga

SEQ ID NO: 75453 - RNA, 20 nt, Human
auuuuaucaucagugugucu

SEQ ID NO: 75454 - RNA, 27 nt, Human
cucuggcccagccuacccuuguacccc

SEQ ID NO: 75455 - RNA, 20 nt, Human
ccuuugaaaguagaucaugu

SEQ ID NO: 75456 - RNA, 25 nt, Human
uucauguaacucuccagccauugua

SEQ ID NO: 75457 - RNA, 22 nt, Human
ugaguguuagaaaaaacuggaa

SEQ ID NO: 75458 - RNA, 22 nt, Human
cucucuggggcugaucacuuag

SEQ ID NO: 75459 - RNA, 26 nt, Human
ccugcacuccagacugaucugccugg

SEQ ID NO: 75460 - RNA, 23 nt, Human
caggaauauacugaagaacuaga

SEQ ID NO: 75461 - RNA, 21 nt, Human
cucugucugagacaggugccu

SEQ ID NO: 75462 - RNA, 21 nt, Human
ucuacuccucccuccuccucc

SEQ ID NO: 75463 - RNA, 23 nt, Human
ugugagguauauacuaaaaugaa

SEQ ID NO: 75464 - RNA, 20 nt, Human
aaccaaauguuuauuuucua

SEQ ID NO: 75465 - RNA, 28 nt, Human
uggaggucccgcagaagcuacagcugcc

SEQ ID NO: 75466 - RNA, 27 nt, Human
gggcuggcccaggugcugaccuugcca

SEQ ID NO: 75467 - RNA, 19 nt, Human
auugagucugaagcacucu

SEQ ID NO: 75468 - RNA, 22 nt, Human
ccaauauggugaaacccgucuc

SEQ ID NO: 75469 - RNA, 23 nt, Human
aucaugccauugcacuccagccu

SEQ ID NO: 75470 - RNA, 21 nt, Human
gcacauuccucagcaggauca

SEQ ID NO: 75471 - RNA, 19 nt, Human
cccaucuauuuccacaccc

SEQ ID NO: 75472 - RNA, 22 nt, Human
uucuagcucucacagacauaua

SEQ ID NO: 75473 - RNA, 26 nt, Human
cacugcucuaacaacaagcauaauau

SEQ ID NO: 75474 - RNA, 22 nt, Human
aguggguggagaguggagugug

SEQ ID NO: 75475 - RNA, 23 nt, Human
gggucuguagguugcacacuuug

SEQ ID NO: 75476 - RNA, 23 nt, Human
uuccuucaggaugaucaccgagg

SEQ ID NO: 75477 - RNA, 21 nt, Human
ucucauaacuggucaacgacu

SEQ ID NO: 75478 - RNA, 13 nt, Human
uggaaagaacaga

SEQ ID NO: 75479 - RNA, 21 nt, Human
ugagagcccaucaaauccuga

SEQ ID NO: 75480 - RNA, 22 nt, Human
gcucaugcuuguaauccuagca

SEQ ID NO: 75481 - RNA, 20 nt, Human
gcagggcuucaaccaggaag

SEQ ID NO: 75482 - RNA, 23 nt, Human
gcauacuacaguaacugugacug

SEQ ID NO: 75483 - RNA, 21 nt, Human
ggcuuugcuuuucaaaccaga

SEQ ID NO: 75484 - RNA, 26 nt, Human
agugaaaguuagagauaacugaacag

SEQ ID NO: 75485 - RNA, 24 nt, Human
acccacccaccaaagacccccuca

SEQ ID NO: 75486 - RNA, 24 nt, Human
uggccaaagcacuucacugcucug

SEQ ID NO: 75487 - RNA, 28 nt, Human
gcuggccaccccacccacaccugucccu

SEQ ID NO: 75488 - RNA, 19 nt, Human
gccgagagacagcaaacug

SEQ ID NO: 75489 - RNA, 24 nt, Human
cccagccugggaaggagagcuugc

SEQ ID NO: 75490 - RNA, 26 nt, Human
ggcugauggggguuugcucagcacug

SEQ ID NO: 75491 - RNA, 23 nt, Human
aaaaagagaauuguagauaauac

SEQ ID NO: 75492 - RNA, 30 nt, Human
gaaaaugcuaguauguuuugcucacuucau

SEQ ID NO: 75493 - RNA, 23 nt, Human
acauguguugagauuucacaagc

SEQ ID NO: 75494 - RNA, 24 nt, Human
gaaucacuggaaccugggagccgg

SEQ ID NO: 75495 - RNA, 24 nt, Human
ugucaccuguagauuuccacacgc

SEQ ID NO: 75496 - RNA, 21 nt, Human
acagugagccgagaucaugcc

SEQ ID NO: 75497 - RNA, 20 nt, Human
gcugccuuggccguauuugg

SEQ ID NO: 75498 - RNA, 19 nt, Human
uguguuccuggagaaggca

SEQ ID NO: 75499 - RNA, 21 nt, Human
cuuagugccuacggaggccuc

SEQ ID NO: 75500 - RNA, 27 nt, Human
aaauguccuuaguuagggacugacuuu

SEQ ID NO: 75501 - RNA, 22 nt, Human
ucaugcaguuuucaaaguuagg

SEQ ID NO: 75502 - RNA, 22 nt, Human
ggcucacugcagccucugccuc

SEQ ID NO: 75503 - RNA, 27 nt, Human
uguaaaccauucagaauuuuccugcua

SEQ ID NO: 75504 - RNA, 27 nt, Human
ccagaaacacuugcuuacagaccgaaa

SEQ ID NO: 75505 - RNA, 20 nt, Human
acuuuauucagaagcaguua

SEQ ID NO: 75506 - RNA, 26 nt, Human
uacugaaggaacugaggccuggguga

SEQ ID NO: 75507 - RNA, 21 nt, Human
ccugcugcugcucaucucccu

SEQ ID NO: 75508 - RNA, 22 nt, Human
cugcaaccccagggucaagggu

SEQ ID NO: 75509 - RNA, 29 nt, Human
cucccgaagccaccauccccacccugucu

SEQ ID NO: 75510 - RNA, 21 nt, Human
ccucccugccuccacccacag

SEQ ID NO: 75511 - RNA, 22 nt, Human
gugaagugccuuuuuccuagaa

SEQ ID NO: 75512 - RNA, 20 nt, Human
ucagagaagaacacugaacu

SEQ ID NO: 75513 - RNA, 27 nt, Human
ccagucugccccacugggucuggcagc

SEQ ID NO: 75514 - RNA, 22 nt, Human
agugaagucgugcuguccugaa

SEQ ID NO: 75515 - RNA, 23 nt, Human
ggaaaacagauacaacugcccau

SEQ ID NO: 75516 - RNA, 26 nt, Human
uugccaggcugugguugugagucuga

SEQ ID NO: 75517 - RNA, 21 nt, Human
cccugcacaucuuuuuagggg

SEQ ID NO: 75518 - RNA, 23 nt, Human
caagucaaggccaggcacggcgg

SEQ ID NO: 75519 - RNA, 25 nt, Human
uaaagagaccaccuucacuuguuga

SEQ ID NO: 75520 - RNA, 21 nt, Human
caguuuaucuagguugcagug

SEQ ID NO: 75521 - RNA, 30 nt, Human
gcugccaccucuguguuccugucauagcaa

SEQ ID NO: 75522 - RNA, 18 nt, Human
gcucacccucucucuguc

SEQ ID NO: 75523 - RNA, 21 nt, Human
ugugcacacuuccaggccucc

SEQ ID NO: 75524 - RNA, 26 nt, Human
agaacuuggguugagggcacuaccag

SEQ ID NO: 75525 - RNA, 22 nt, Human
uuagggcuagauuugagcugcu

SEQ ID NO: 75526 - RNA, 21 nt, Human
aagugcaauggguaagggagg

SEQ ID NO: 75527 - RNA, 21 nt, Human
uuuauaaaaauggcaacuuua

SEQ ID NO: 75528 - RNA, 21 nt, Human
ggcaucgugcuggugccucug

SEQ ID NO: 75529 - RNA, 23 nt, Human
cugaggacaucaccaucaucuca

SEQ ID NO: 75530 - RNA, 19 nt, Human
gcaagcaucuccgcaucgc

SEQ ID NO: 75531 - RNA, 22 nt, Human
gaugauggauugcaagugcaaa

SEQ ID NO: 75532 - RNA, 22 nt, Human
gccuauauucccugcacuuugg

SEQ ID NO: 75533 - RNA, 26 nt, Human
uguuaaggaauagggacagcugguca

SEQ ID NO: 75534 - RNA, 22 nt, Human
ggaaauucugcaggagacaggc

SEQ ID NO: 75535 - RNA, 22 nt, Human
uuagaaaaccugcacuuucucu

SEQ ID NO: 75536 - RNA, 28 nt, Human
ccaauguacccaccgggccacuccuucc

SEQ ID NO: 75537 - RNA, 21 nt, Human
cgcacuuggaaagguuucaag

SEQ ID NO: 75538 - RNA, 22 nt, Human
agucccuaucccacaccugccu

SEQ ID NO: 75539 - RNA, 21 nt, Human
caccagagcaaccucucacuc

SEQ ID NO: 75540 - RNA, 19 nt, Human
ccagcagaggaauuuugua

SEQ ID NO: 75541 - RNA, 27 nt, Human
ucagaagcauagauuguaguguaccuu

SEQ ID NO: 75542 - RNA, 22 nt, Human
ucuucuuuuuaauacacuuaac

SEQ ID NO: 75543 - RNA, 29 nt, Human
ccagaaagccccacccaggccaggcaugu

SEQ ID NO: 75544 - RNA, 21 nt, Human
cccuucagugcuacauuuugu

SEQ ID NO: 75545 - RNA, 20 nt, Human
acuguccuuaaaacaaaaca

SEQ ID NO: 75546 - RNA, 27 nt, Human
ggguggggagggcgggggaauggaccu

SEQ ID NO: 75547 - RNA, 27 nt, Human
augagacacacuuaacuacuuaucucu

SEQ ID NO: 75548 - RNA, 21 nt, Human
cccagccugccggccgguacu

SEQ ID NO: 75549 - RNA, 22 nt, Human
gguuaauugacucacaccagcu

SEQ ID NO: 75550 - RNA, 23 nt, Human
uugaauuuaacaaaaacugggaa

SEQ ID NO: 75551 - RNA, 25 nt, Human
uauggauuucagaggugcucuuaga

SEQ ID NO: 75552 - RNA, 23 nt, Human
auauuuccuccgacuuaccucuu

SEQ ID NO: 75553 - RNA, 27 nt, Human
uagacuuugucuuaugugucaaaaguc

SEQ ID NO: 75554 - RNA, 25 nt, Human
cugucaggguggggagcugguuccc

SEQ ID NO: 75555 - RNA, 22 nt, Human
gcucuuagcagaggcacuuugg

SEQ ID NO: 75556 - RNA, 24 nt, Human
aagggaggguacaguggugggggc

SEQ ID NO: 75557 - RNA, 21 nt, Human
ccccgaccccgcuuauuuauu

SEQ ID NO: 75558 - RNA, 22 nt, Human
uugcagaugcaccguggccugg

SEQ ID NO: 75559 - RNA, 20 nt, Human
acuaacuguagagccuuggg

SEQ ID NO: 75560 - RNA, 20 nt, Human
aauucucacagaagaaggaa

SEQ ID NO: 75561 - RNA, 19 nt, Human
gaguucagccuacucuuuc

SEQ ID NO: 75562 - RNA, 27 nt, Human
cuccugaccucgugauccgcccgccuc

SEQ ID NO: 75563 - RNA, 21 nt, Human
uucugcauacuguguuauguu

SEQ ID NO: 75564 - RNA, 21 nt, Human
cuuagcucaaaaugucagugg

SEQ ID NO: 75565 - RNA, 13 nt, Human
accguaugccuua

SEQ ID NO: 75566 - RNA, 25 nt, Human
uaucaggcugaugcuggcuucauag

SEQ ID NO: 75567 - RNA, 26 nt, Human
cggaaaggaaagaacacuaguguucu

SEQ ID NO: 75568 - RNA, 20 nt, Human
uagccucuuuguguuuuugu

SEQ ID NO: 75569 - RNA, 30 nt, Human
caaacuguagcaaccaucuccuaucaaagg

SEQ ID NO: 75570 - RNA, 27 nt, Human
uucaaugaucaguuucaucuguaagug

SEQ ID NO: 75571 - RNA, 19 nt, Human
agcuauacaaauuacuucc

SEQ ID NO: 75572 - RNA, 19 nt, Human
caccagucacuuacuccaa

SEQ ID NO: 75573 - RNA, 24 nt, Human
ccugcccuagcucuucucuaacuu

SEQ ID NO: 75574 - RNA, 19 nt, Human
cgagacuccaucucaaaaa

SEQ ID NO: 75575 - RNA, 21 nt, Human
uguacucucacuuuaaacuca

SEQ ID NO: 75576 - RNA, 21 nt, Human
agauacuaggcccaggaguca

SEQ ID NO: 75577 - RNA, 24 nt, Human
agcacccuguaucacagacuggca

SEQ ID NO: 75578 - RNA, 22 nt, Human
ucauucuugcuaaccuagucua

SEQ ID NO: 75579 - RNA, 27 nt, Human
cacugaacuccagccugggccacauag

SEQ ID NO: 75580 - RNA, 19 nt, Human
gauuacaggcgugcaccac

SEQ ID NO: 75581 - RNA, 20 nt, Human
ucgaguggcuuccuggccau

SEQ ID NO: 75582 - RNA, 23 nt, Human
acugcaggcuggagcccugggga

SEQ ID NO: 75583 - RNA, 22 nt, Human
guuucaguucacuccugccaag

SEQ ID NO: 75584 - RNA, 20 nt, Human
gggggcagcuggcacuguga

SEQ ID NO: 75585 - RNA, 20 nt, Human
uccgagccauggaagggugg

SEQ ID NO: 75586 - RNA, 27 nt, Human
ggaaaagccucauauggugauaugcca

SEQ ID NO: 75587 - RNA, 22 nt, Human
guggcccuggcuggaguucagu

SEQ ID NO: 75588 - RNA, 20 nt, Human
gcugucccucauggagaccu

SEQ ID NO: 75589 - RNA, 25 nt, Human
acgcaggcggaucucugaagagcug

SEQ ID NO: 75590 - RNA, 17 nt, Human
ugccucgugccaccuca

SEQ ID NO: 75591 - RNA, 23 nt, Human
auacuuauauacacgcaggugua

SEQ ID NO: 75592 - RNA, 21 nt, Human
ugcuguugcugggagcuguuc

SEQ ID NO: 75593 - RNA, 20 nt, Human
cuacaucuuuauucucuaaa

SEQ ID NO: 75594 - RNA, 20 nt, Human
aggacuuuuuuguuuuuugc

SEQ ID NO: 75595 - RNA, 26 nt, Human
acagguuuguucuuguaguuuucuau

SEQ ID NO: 75596 - RNA, 21 nt, Human
cccugucugagaugcagccag

SEQ ID NO: 75597 - RNA, 23 nt, Human
uggaguguaggaaccaaaaugaa

SEQ ID NO: 75598 - RNA, 22 nt, Human
ugccauagagcuaacugggguc

SEQ ID NO: 75599 - RNA, 22 nt, Human
cgccuguaauccuggcacuuug

SEQ ID NO: 75600 - RNA, 19 nt, Human
aaagaacaauguuauaaug

SEQ ID NO: 75601 - RNA, 24 nt, Human
gcccaggcuggagugcagcagcac

SEQ ID NO: 75602 - RNA, 24 nt, Human
ggaggggagagacaggcagcccag

SEQ ID NO: 75603 - RNA, 26 nt, Human
ucauuaaaaaacacagcaguuuuccu

SEQ ID NO: 75604 - RNA, 25 nt, Human
uuugugaauuuucuaaaagcuuuca

SEQ ID NO: 75605 - RNA, 22 nt, Human
cacugcacucaagccugggcga

SEQ ID NO: 75606 - RNA, 21 nt, Human
gcccgcgcagccuccugcgcc

SEQ ID NO: 75607 - RNA, 27 nt, Human
ggcccggcauggagaagcgcgcggccg

SEQ ID NO: 75608 - RNA, 27 nt, Human
ugcuucuuuccuguauauucucuuguc

SEQ ID NO: 75609 - RNA, 24 nt, Human
uucagccugaccucaggcagcagg

SEQ ID NO: 75610 - RNA, 29 nt, Human
ucugccucuggccgcggccugugggaugg

SEQ ID NO: 75611 - RNA, 20 nt, Human
gccucagcaguuugcagugg

SEQ ID NO: 75612 - RNA, 21 nt, Human
uucaauaccugauuuguacuu

SEQ ID NO: 75613 - RNA, 22 nt, Human
gccgcccaggcuggacugcagu

SEQ ID NO: 75614 - RNA, 29 nt, Human
gcugguagcagcaggcucaggcacauaca

SEQ ID NO: 75615 - RNA, 23 nt, Human
aggcaggcccuccugggguacag

SEQ ID NO: 75616 - RNA, 22 nt, Human
ugaccucacuucuggcacugug

SEQ ID NO: 75617 - RNA, 28 nt, Human
ucauucccucgucuuucccaaaggcauc

SEQ ID NO: 75618 - RNA, 21 nt, Human
agaagcagagaaggcacuugc

SEQ ID NO: 75619 - RNA, 24 nt, Human
cgggcagucaagccaggugacccc

SEQ ID NO: 75620 - RNA, 25 nt, Human
gcaauuuaugcuucuugggaggcca

SEQ ID NO: 75621 - RNA, 23 nt, Human
aaacaugugcauuuuacaguuca

SEQ ID NO: 75622 - RNA, 20 nt, Human
ggcaggguggagcgaaggag

SEQ ID NO: 75623 - RNA, 18 nt, Human
cuuuuggggcuguauuua

SEQ ID NO: 75624 - RNA, 22 nt, Human
ggaacuugugugugccuccuca

SEQ ID NO: 75625 - RNA, 19 nt, Human
ucaugcuguucaucuauga

SEQ ID NO: 75626 - RNA, 26 nt, Human
uagaggcugcggcggaggggagaagc

SEQ ID NO: 75627 - RNA, 23 nt, Human
gcagaagaauugaacccaggagg

SEQ ID NO: 75628 - RNA, 27 nt, Human
uaccaugguuugugcaauuauguagua

SEQ ID NO: 75629 - RNA, 21 nt, Human
cuagaggcggaguuugcagug

SEQ ID NO: 75630 - RNA, 27 nt, Human
ccagcauuugguucuucucaagaguug

SEQ ID NO: 75631 - RNA, 22 nt, Human
guuuuucccuuccuuuuggggu

SEQ ID NO: 75632 - RNA, 19 nt, Human
cccucacugcacucugcuc

SEQ ID NO: 75633 - RNA, 22 nt, Human
gagaucaucuacccaggcuggg

SEQ ID NO: 75634 - RNA, 22 nt, Human
cagauguuauuaugcuauagcu

SEQ ID NO: 75635 - RNA, 22 nt, Human
cuaagccucccaaguaacuggg

SEQ ID NO: 75636 - RNA, 28 nt, Human
cccaagcccacacagagacuugcacagc

SEQ ID NO: 75637 - RNA, 27 nt, Human
ccacugcuuuccagccugggcaacaua

SEQ ID NO: 75638 - RNA, 30 nt, Human
ccagaucuaacaucuugaauacucugcccu

SEQ ID NO: 75639 - RNA, 22 nt, Human
gacuacaggcacgcgccaccac

SEQ ID NO: 75640 - RNA, 21 nt, Human
uggaugauuuuggaaaacaac

SEQ ID NO: 75641 - RNA, 24 nt, Human
ggaaauggaaucuggggaggcagg

SEQ ID NO: 75642 - RNA, 22 nt, Human
guuuuucaugggagacuuccuu

SEQ ID NO: 75643 - RNA, 27 nt, Human
ugucauuguccucaaguccuucgcaga

SEQ ID NO: 75644 - RNA, 22 nt, Human
agcagaaccuguaggaucuuau

SEQ ID NO: 75645 - RNA, 23 nt, Human
acugggccagggccagggccagg

SEQ ID NO: 75646 - RNA, 19 nt, Human
acuuuuguuagugcuuuau

SEQ ID NO: 75647 - RNA, 19 nt, Human
cccgauuccugggcuagga

SEQ ID NO: 75648 - RNA, 29 nt, Human
guuggguuccugaaugcaccauaaucgcu

SEQ ID NO: 75649 - RNA, 26 nt, Human
gcuguugccuuaaaugugugagaggg

SEQ ID NO: 75650 - RNA, 29 nt, Human
agaccaucacagaccagguccuaaugggu

SEQ ID NO: 75651 - RNA, 23 nt, Human
aagaggaagaagauguagggagg

SEQ ID NO: 75652 - RNA, 24 nt, Human
cccaguucaucaucaucucuuuua

SEQ ID NO: 75653 - RNA, 23 nt, Human
agcucugccuuugcucuggucua

SEQ ID NO: 75654 - RNA, 22 nt, Human
cucaauguauaguuagcuuuau

SEQ ID NO: 75655 - RNA, 20 nt, Human
cauuggaacaaguagaaaga

SEQ ID NO: 75656 - RNA, 22 nt, Human
uaagcuucuugucauucuucau

SEQ ID NO: 75657 - RNA, 26 nt, Human
caauuucaacugauauucccaaaaag

SEQ ID NO: 75658 - RNA, 23 nt, Human
cccuccugugaccagcugaggac

SEQ ID NO: 75659 - RNA, 27 nt, Human
cucugaaugccuacuauuauccugauu

SEQ ID NO: 75660 - RNA, 21 nt, Human
ggaggcggaggcuugggugcg

SEQ ID NO: 75661 - RNA, 21 nt, Human
ucugucugucucacugucuuc

SEQ ID NO: 75662 - RNA, 21 nt, Human
caccuccuggguucaagcaau

SEQ ID NO: 75663 - RNA, 22 nt, Human
ccagcacugcggacgcgacucg

SEQ ID NO: 75664 - RNA, 22 nt, Human
uuacaacucagauuuuauuuau

SEQ ID NO: 75665 - RNA, 27 nt, Human
cagacucagccaacagagauuguugau

SEQ ID NO: 75666 - RNA, 22 nt, Human
ugggacccgccgcggccucaac

SEQ ID NO: 75667 - RNA, 22 nt, Human
ggaaacauagaacucagagcca

SEQ ID NO: 75668 - RNA, 24 nt, Human
cucuaccucccaaggugauauggg

SEQ ID NO: 75669 - RNA, 20 nt, Human
agcaauagggucuuccucac

SEQ ID NO: 75670 - RNA, 23 nt, Human
aucagggaaacuaauuguauuua

SEQ ID NO: 75671 - RNA, 23 nt, Human
aggagccuugcaggcuggagggc

SEQ ID NO: 75672 - RNA, 26 nt, Human
uugggaggcugagacaggaggauugc

SEQ ID NO: 75673 - RNA, 22 nt, Human
gccaaaacauccucuaagcuuu

SEQ ID NO: 75674 - RNA, 25 nt, Human
uccaucaccuuccuccucugcucug

SEQ ID NO: 75675 - RNA, 22 nt, Human
gggagugagggaaggaggcagg

SEQ ID NO: 75676 - RNA, 20 nt, Human
gcagugccauguuccucucc

SEQ ID NO: 75677 - RNA, 27 nt, Human
aggaagguaaauugguugcuggaagag

SEQ ID NO: 75678 - RNA, 20 nt, Human
gggccuuuugaacaguagug

SEQ ID NO: 75679 - RNA, 22 nt, Human
acagaggcucacugagugauac

SEQ ID NO: 75680 - RNA, 24 nt, Human
cucuuaaaaaccguguuugguuuc

SEQ ID NO: 75681 - RNA, 22 nt, Human
gagcuaaaugucugucucuaaa

SEQ ID NO: 75682 - RNA, 22 nt, Human
cuccuccugcacaccuuccgca

SEQ ID NO: 75683 - RNA, 21 nt, Human
cccugcugcuuucucuaccuc

SEQ ID NO: 75684 - RNA, 22 nt, Human
cucagccagggcagggaggggg

SEQ ID NO: 75685 - RNA, 27 nt, Human
ccucacgcgggcgggauuuucuugccu

SEQ ID NO: 75686 - RNA, 23 nt, Human
gaagaauuccaguuguuaggaag

SEQ ID NO: 75687 - RNA, 24 nt, Human
cuccuuccgggcccuccuccgcga

SEQ ID NO: 75688 - RNA, 19 nt, Human
auuccagcaaguacagaga

SEQ ID NO: 75689 - RNA, 23 nt, Human
uguggaauacacuggcccauauu

SEQ ID NO: 75690 - RNA, 20 nt, Human
cugggugucuggugccugga

SEQ ID NO: 75691 - RNA, 22 nt, Human
ccaacuccucgcuucacuucac

SEQ ID NO: 75692 - RNA, 21 nt, Human
cagcuggaugauccucaggac

SEQ ID NO: 75693 - RNA, 19 nt, Human
uaaaugauguaauauucca

SEQ ID NO: 75694 - RNA, 29 nt, Human
aguggcaguggcagagaauccaaacucaa

SEQ ID NO: 75695 - RNA, 23 nt, Human
ucagcauuuuuauucccacucuu

SEQ ID NO: 75696 - RNA, 22 nt, Human
ccugcucuccucacacauugug

SEQ ID NO: 75697 - RNA, 22 nt, Human
uguugcccaggcuggggugcag

SEQ ID NO: 75698 - RNA, 21 nt, Human
cucuccaccuggacucaggcc

SEQ ID NO: 75699 - RNA, 27 nt, Human
cauacuuguaaucaaguuuuuccagcc

SEQ ID NO: 75700 - RNA, 21 nt, Human
agcucacugcaaacucugccu

SEQ ID NO: 75701 - RNA, 22 nt, Human
cuuccaccucuccaacauuguc

SEQ ID NO: 75702 - RNA, 19 nt, Human
uuugagccuuucucuugug

SEQ ID NO: 75703 - RNA, 27 nt, Human
uggggaaggcaggaggcagaaagacgg

SEQ ID NO: 75704 - RNA, 21 nt, Human
cuggauaguagaucucgagcg

SEQ ID NO: 75705 - RNA, 21 nt, Human
gagaauggguaauucaagagg

SEQ ID NO: 75706 - RNA, 21 nt, Human
ccuguggcccagccuggcugg

SEQ ID NO: 75707 - RNA, 26 nt, Human
ggagagaauggggugagcagccacca

SEQ ID NO: 75708 - RNA, 22 nt, Human
guggguggaccaccugagguua

SEQ ID NO: 75709 - RNA, 22 nt, Human
gcggguggaucaccugagguua

SEQ ID NO: 75710 - RNA, 28 nt, Human
cagaaugggauuuauuaaugugggauac

SEQ ID NO: 75711 - RNA, 26 nt, Human
cacucacacacaauuuaugugcacac

SEQ ID NO: 75712 - RNA, 22 nt, Human
cuuucacugcugaguuucuguu

SEQ ID NO: 75713 - RNA, 26 nt, Human
uuugaaccaggauggcugagccccgc

SEQ ID NO: 75714 - RNA, 27 nt, Human
ggcccccacaauggucccaaacagcug

SEQ ID NO: 75715 - RNA, 27 nt, Human
uggccaccuccauuguucuuugcuucu

SEQ ID NO: 75716 - RNA, 22 nt, Human
agagaggcgcuucugcggccaa

SEQ ID NO: 75717 - RNA, 25 nt, Human
aaaacaaaaauagaaaauuuucuag

SEQ ID NO: 75718 - RNA, 22 nt, Human
ggggcaaaguucccugcccacc

SEQ ID NO: 75719 - RNA, 21 nt, Human
gccagaaucagcacaaucccg

SEQ ID NO: 75720 - RNA, 22 nt, Human
ggauguccuguuuucaccagag

SEQ ID NO: 75721 - RNA, 26 nt, Human
caugauacgucauguugugggaucuu

SEQ ID NO: 75722 - RNA, 28 nt, Human
gccgaggccuggccaaugcggcccacuu

SEQ ID NO: 75723 - RNA, 21 nt, Human
ugggugggaugguggagcagc

SEQ ID NO: 75724 - RNA, 26 nt, Human
gcuccucccuuguucucuaaguucca

SEQ ID NO: 75725 - RNA, 19 nt, Human
ggaguagaagaagggucgu

SEQ ID NO: 75726 - RNA, 21 nt, Human
cccuuucucauucuccaagcc

SEQ ID NO: 75727 - RNA, 25 nt, Human
cucuccuccccuuauucccgaggcc

SEQ ID NO: 75728 - RNA, 22 nt, Human
cuugcagagaugcacgugugca

SEQ ID NO: 75729 - RNA, 26 nt, Human
cuguuccugaagucugugccccacuu

SEQ ID NO: 75730 - RNA, 27 nt, Human
ucuucuguuucuuccuccccgcuguca

SEQ ID NO: 75731 - RNA, 24 nt, Human
agacccggcauuggcaauguagcu

SEQ ID NO: 75732 - RNA, 21 nt, Human
uuaggaauuuggauggguaaa

SEQ ID NO: 75733 - RNA, 22 nt, Human
gcaagaucuuuuuuccuucacu

SEQ ID NO: 75734 - RNA, 22 nt, Human
guuucgaacucuggcaccuuuc

SEQ ID NO: 75735 - RNA, 23 nt, Human
ggucugaagugauguccaggcaa

SEQ ID NO: 75736 - RNA, 22 nt, Human
acagggcaaaagagauuuugca

SEQ ID NO: 75737 - RNA, 22 nt, Human
cccaaguagcugggguuacagg

SEQ ID NO: 75738 - RNA, 21 nt, Human
accuuccccaccgccugggcc

SEQ ID NO: 75739 - RNA, 27 nt, Human
cuacaucuucucucuuccccaucuugc

SEQ ID NO: 75740 - RNA, 23 nt, Human
auguacauagauauaugggccuc

SEQ ID NO: 75741 - RNA, 23 nt, Human
cacgccgccucuugccacccugg

SEQ ID NO: 75742 - RNA, 22 nt, Human
aucagagguuugcuuccucagu

SEQ ID NO: 75743 - RNA, 23 nt, Human
ucccguggagcccgccucuccag

SEQ ID NO: 75744 - RNA, 20 nt, Human
agggcagcagaguggagcga

SEQ ID NO: 75745 - RNA, 22 nt, Human
ggugaugccuggugcuggugga

SEQ ID NO: 75746 - RNA, 21 nt, Human
gcagucuccccucuccaggcc

SEQ ID NO: 75747 - RNA, 21 nt, Human
cagggagggggucaguugggc

SEQ ID NO: 75748 - RNA, 22 nt, Human
accagccuggucaagaugguga

SEQ ID NO: 75749 - RNA, 22 nt, Human
acuagccuggccaagaugguga

SEQ ID NO: 75750 - RNA, 25 nt, Human
ggggaggcauuaaaauucacugugc

SEQ ID NO: 75751 - RNA, 20 nt, Human
aggugcuuccagaaaaccuu

SEQ ID NO: 75752 - RNA, 22 nt, Human
cgccucccagguucaagcgauu

SEQ ID NO: 75753 - RNA, 22 nt, Human
gauggugcucugagagagggca

SEQ ID NO: 75754 - RNA, 22 nt, Human
aucaaaaccacuaagaguuccu

SEQ ID NO: 75755 - RNA, 26 nt, Human
ggcuuuuaaaagacuuguuagccaac

SEQ ID NO: 75756 - RNA, 26 nt, Human
uuuccuagggcauaguccaucccgcu

SEQ ID NO: 75757 - RNA, 26 nt, Human
acagccacuacugcugcagccagcca

SEQ ID NO: 75758 - RNA, 21 nt, Human
gcaauuuauucuugcuucauu

SEQ ID NO: 75759 - RNA, 21 nt, Human
aaaacugggaccaaccaaagu

SEQ ID NO: 75760 - RNA, 21 nt, Human
cuggagaaaccagaauccaag

SEQ ID NO: 75761 - RNA, 24 nt, Human
cuggccgcuaucaucccagcagug

SEQ ID NO: 75762 - RNA, 25 nt, Human
acgacugugucacuuugcuugggga

SEQ ID NO: 75763 - RNA, 23 nt, Human
agucacccaggaugcuggggcac

SEQ ID NO: 75764 - RNA, 22 nt, Human
ggaggccaagaugggaggauca

SEQ ID NO: 75765 - RNA, 26 nt, Human
gcaaguacgacuucguggaggugcgc

SEQ ID NO: 75766 - RNA, 21 nt, Human
cugguugaauccuucaguuaa

SEQ ID NO: 75767 - RNA, 19 nt, Human
uuguagcauuucuugaugu

SEQ ID NO: 75768 - RNA, 23 nt, Human
ugcccgggauggcaaugaggugg

SEQ ID NO: 75769 - RNA, 26 nt, Human
aggaauuuuguuuuugguuucuuuau

SEQ ID NO: 75770 - RNA, 27 nt, Human
cugggaggccgaggcagggggacugcu

SEQ ID NO: 75771 - RNA, 17 nt, Human
caacauccugcgguucc

SEQ ID NO: 75772 - RNA, 22 nt, Human
accuagaucagcguggcugguc

SEQ ID NO: 75773 - RNA, 20 nt, Human
gcaaaguuguacagauuucu

SEQ ID NO: 75774 - RNA, 22 nt, Human
uaugcuccuuuguucuguucag

SEQ ID NO: 75775 - RNA, 23 nt, Human
agcaggaccuacuaggagagggg

SEQ ID NO: 75776 - RNA, 23 nt, Human
ucagaagcaaguuaccagaguga

SEQ ID NO: 75777 - RNA, 20 nt, Human
agaaagaaaacauuuugauu

SEQ ID NO: 75778 - RNA, 22 nt, Human
acaugcuacacacugcauguuu

SEQ ID NO: 75779 - RNA, 22 nt, Human
ucauccaauccucacugggugg

SEQ ID NO: 75780 - RNA, 22 nt, Human
aaagaagaauguaauuuguuua

SEQ ID NO: 75781 - RNA, 27 nt, Human
ccccugccagggcucgggcgcuguggc

SEQ ID NO: 75782 - RNA, 22 nt, Human
ugcagucaaacuuugauccuug

SEQ ID NO: 75783 - RNA, 23 nt, Human
ucauuagguccagcuuucuauua

SEQ ID NO: 75784 - RNA, 22 nt, Human
ccugggccaaaagggcagccag

SEQ ID NO: 75785 - RNA, 25 nt, Human
gggauuacaggcaugcgccaccaca

SEQ ID NO: 75786 - RNA, 22 nt, Human
auuagcaccagcuugcuucucu

SEQ ID NO: 75787 - RNA, 27 nt, Human
aacucagaagacagagcugaaaaagaa

SEQ ID NO: 75788 - RNA, 24 nt, Human
uucauuucuuuuucauuugacuua

SEQ ID NO: 75789 - RNA, 26 nt, Human
cacagccccaucaaagaacagagagg

SEQ ID NO: 75790 - RNA, 25 nt, Human
uguccugugguguauuaacuccuuu

SEQ ID NO: 75791 - RNA, 21 nt, Human
ucgccaaggcuggagugcagu

SEQ ID NO: 75792 - RNA, 22 nt, Human
ugggacccccuggugauucagc

SEQ ID NO: 75793 - RNA, 23 nt, Human
ucugggcaaaugaaaauguuuca

SEQ ID NO: 75794 - RNA, 21 nt, Human
augaaacccuaggcagaggag

SEQ ID NO: 75795 - RNA, 26 nt, Human
guuucaucaagaggagucgcggcggc

SEQ ID NO: 75796 - RNA, 21 nt, Human
cuccccaggcucuagugcagg

SEQ ID NO: 75797 - RNA, 19 nt, Human
guguuuaaaaaaguuucua

SEQ ID NO: 75798 - RNA, 21 nt, Human
acuggcuguuucuccuuuguu

SEQ ID NO: 75799 - RNA, 25 nt, Human
ggggugagaauauagacagugcccu

SEQ ID NO: 75800 - RNA, 22 nt, Human
cucagccuccagaguaucuggg

SEQ ID NO: 75801 - RNA, 18 nt, Human
ggcaaugaugugugcaag

SEQ ID NO: 75802 - RNA, 26 nt, Human
cccucgggaaaaagcaaaauaucaau

SEQ ID NO: 75803 - RNA, 22 nt, Human
gacaaggggaaagaucuuucuu

SEQ ID NO: 75804 - RNA, 22 nt, Human
uggcuaaggcaggagaaucacu

SEQ ID NO: 75805 - RNA, 22 nt, Human
ucacugcaaccuccaucuccug

SEQ ID NO: 75806 - RNA, 21 nt, Human
aaacauuucaaguuuacuccu

SEQ ID NO: 75807 - RNA, 22 nt, Human
gugguauuuugguaugugcaaa

SEQ ID NO: 75808 - RNA, 23 nt, Human
agggagggggcagaggcaaauca

SEQ ID NO: 75809 - RNA, 20 nt, Human
ccuucuugggccugccucuu

SEQ ID NO: 75810 - RNA, 18 nt, Human
auaagcaggcagcuuuga

SEQ ID NO: 75811 - RNA, 23 nt, Human
uuguuaauuucuuauaagguccu

SEQ ID NO: 75812 - RNA, 27 nt, Human
ccaggaggcuggcaguacagagugcag

SEQ ID NO: 75813 - RNA, 21 nt, Human
uuuggcauucuuuucccauug

SEQ ID NO: 75814 - RNA, 20 nt, Human
aaggcagguggaggggaggc

SEQ ID NO: 75815 - RNA, 20 nt, Human
caguguacauuuccacaaau

SEQ ID NO: 75816 - RNA, 20 nt, Human
ccccaaaacaugcacccugg

SEQ ID NO: 75817 - RNA, 29 nt, Human
ggugacugucuccuggaaauguuaugcag

SEQ ID NO: 75818 - RNA, 24 nt, Human
cuggauaagagaauccuuuuagca

SEQ ID NO: 75819 - RNA, 20 nt, Human
cuucguuucugcucuccccg

SEQ ID NO: 75820 - RNA, 26 nt, Human
ucucucucagaaugacaauucuaggu

SEQ ID NO: 75821 - RNA, 18 nt, Human
gcaaaaaucacgggugua

SEQ ID NO: 75822 - RNA, 23 nt, Human
uugggaagaccagcuuugcagug

SEQ ID NO: 75823 - RNA, 22 nt, Human
gcccaugcuggagugcaguggc

SEQ ID NO: 75824 - RNA, 22 nt, Human
gcccaggcuggagcgcaguggg

SEQ ID NO: 75825 - RNA, 22 nt, Human
gcccaggcuggagggcaguggc

SEQ ID NO: 75826 - RNA, 19 nt, Human
ucagccgcccgccgcacag

SEQ ID NO: 75827 - RNA, 25 nt, Human
guucagucagauuggacccuguaaa

SEQ ID NO: 75828 - RNA, 20 nt, Human
ggccccacuccagugcugcc

SEQ ID NO: 75829 - RNA, 21 nt, Human
ugggaugacgggugccuccca

SEQ ID NO: 75830 - RNA, 22 nt, Human
cacccaggcuggagugcaguga

SEQ ID NO: 75831 - RNA, 22 nt, Human
cacccaggcuggaaugcagugg

SEQ ID NO: 75832 - RNA, 22 nt, Human
ccaucuucaccuguuccgcaga

SEQ ID NO: 75833 - RNA, 22 nt, Human
agccuagaugagagagauagag

SEQ ID NO: 75834 - RNA, 21 nt, Human
ucuguguaggagcuaaagcag

SEQ ID NO: 75835 - RNA, 22 nt, Human
ccccaguagcugagauugcagg

SEQ ID NO: 75836 - RNA, 26 nt, Human
cuccugggcccggcucaggcccgucg

SEQ ID NO: 75837 - RNA, 22 nt, Human
ucaccgaggcuggagugcagug

SEQ ID NO: 75838 - RNA, 24 nt, Human
gcuaucuggauuuuaaccugcacu

SEQ ID NO: 75839 - RNA, 28 nt, Human
gcggucugggcccaacacugcauagcac

SEQ ID NO: 75840 - RNA, 25 nt, Human
uguucaagcgauucuccugccucag

SEQ ID NO: 75841 - RNA, 21 nt, Human
cuacucuggcuugagcacuuc

SEQ ID NO: 75842 - RNA, 22 nt, Human
cuugaguggcugggauugcggg

SEQ ID NO: 75843 - RNA, 20 nt, Human
gggcugucuuggcucuggaa

SEQ ID NO: 75844 - RNA, 23 nt, Human
ucuuccucagucuuuucuaaauc

SEQ ID NO: 75845 - RNA, 17 nt, Human
acaggacccaccaggca

SEQ ID NO: 75846 - RNA, 24 nt, Human
aauuuuaaaauguaaugcuuuuua

SEQ ID NO: 75847 - RNA, 32 nt, Human
ggccccaguggcugagcuccaagugccugcug

SEQ ID NO: 75848 - RNA, 26 nt, Human
ugagccaagauugcgccauugcacuc

SEQ ID NO: 75849 - RNA, 21 nt, Human
acauggccuucuuuguguaca

SEQ ID NO: 75850 - RNA, 23 nt, Human
auggucaccucacccacuuguaa

SEQ ID NO: 75851 - RNA, 27 nt, Human
gaccuccugaucaggaacuuuaguuga

SEQ ID NO: 75852 - RNA, 22 nt, Human
ugcagugagcccugauugugcc

SEQ ID NO: 75853 - RNA, 26 nt, Human
acugcagcugcaccaucacacaugca

SEQ ID NO: 75854 - RNA, 22 nt, Human
aaguugaggcaggaggauugcu

SEQ ID NO: 75855 - RNA, 22 nt, Human
ucggagcugccgcgcugcccag

SEQ ID NO: 75856 - RNA, 21 nt, Human
uggccagaacaucucacugau

SEQ ID NO: 75857 - RNA, 20 nt, Human
gaauuaguucugcaaauacu

SEQ ID NO: 75858 - RNA, 23 nt, Human
ccauguugcccaggugggucuca

SEQ ID NO: 75859 - RNA, 22 nt, Human
aacuuggcccugcgucuuccca

SEQ ID NO: 75860 - RNA, 23 nt, Human
cagcugcagugaaacuccauuua

SEQ ID NO: 75861 - RNA, 23 nt, Human
auuguguuaucacucugccugug

SEQ ID NO: 75862 - RNA, 24 nt, Human
ggcuuaagugacccucccaccuca

SEQ ID NO: 75863 - RNA, 20 nt, Human
ggagggucucaaacuccuga

SEQ ID NO: 75864 - RNA, 28 nt, Human
cacaccucaacacaccucugccacccca

SEQ ID NO: 75865 - RNA, 22 nt, Human
gcguagaccuagggaagggaug

SEQ ID NO: 75866 - RNA, 25 nt, Human
gcccccagcugccuccucacaucug

SEQ ID NO: 75867 - RNA, 19 nt, Human
cuucccuugguuggauccu

SEQ ID NO: 75868 - RNA, 24 nt, Human
gucuuccccccaccccgcgcacac

SEQ ID NO: 75869 - RNA, 26 nt, Human
uguuaguagugaguuucuguucuauu

SEQ ID NO: 75870 - RNA, 21 nt, Human
aucuccaccauuucuucugca

SEQ ID NO: 75871 - RNA, 22 nt, Human
ugcuaaaaaccuguauuuucau

SEQ ID NO: 75872 - RNA, 20 nt, Human
gaugguugcagaagauccac

SEQ ID NO: 75873 - RNA, 22 nt, Human
agcucacugcaacuuccgcauc

SEQ ID NO: 75874 - RNA, 20 nt, Human
agcagccacuguaugauauu

SEQ ID NO: 75875 - RNA, 21 nt, Human
cccugugaucuauaccaccuu

SEQ ID NO: 75876 - RNA, 22 nt, Human
aggaaaaacagaggaugcugaa

SEQ ID NO: 75877 - RNA, 22 nt, Human
agaccagccuggguaucauagg

SEQ ID NO: 75878 - RNA, 21 nt, Human
cuaccugcuauagcacacucu

SEQ ID NO: 75879 - RNA, 20 nt, Human
aacauaguugcugcaggcgg

SEQ ID NO: 75880 - RNA, 28 nt, Human
ccucaggcagcagagaacuggcccagag

SEQ ID NO: 75881 - RNA, 21 nt, Human
gccagagggcugccucuccag

SEQ ID NO: 75882 - RNA, 21 nt, Human
ugcaguaaaauguuguuucau

SEQ ID NO: 75883 - RNA, 26 nt, Human
gagcauagugagagcagugguggagc

SEQ ID NO: 75884 - RNA, 19 nt, Human
uucagauuuucucucaucc

SEQ ID NO: 75885 - RNA, 20 nt, Human
auguugaagaauugaccuca

SEQ ID NO: 75886 - RNA, 26 nt, Human
ucagcagaaccuguaggaucuuauuu

SEQ ID NO: 75887 - RNA, 22 nt, Human
gcugcuuccgguagggaggcag

SEQ ID NO: 75888 - RNA, 26 nt, Human
ccacaucuggcuuucucagccacugu

SEQ ID NO: 75889 - RNA, 25 nt, Human
gggauguuuuuaggacaaccucccu

SEQ ID NO: 75890 - RNA, 26 nt, Human
gugaauuagacuuguauaucccacug

SEQ ID NO: 75891 - RNA, 20 nt, Human
ccucaccugccccugcccua

SEQ ID NO: 75892 - RNA, 20 nt, Human
agcaacgcagugcucugcug

SEQ ID NO: 75893 - RNA, 22 nt, Human
caaacuuuucuuucuuuucuuu

SEQ ID NO: 75894 - RNA, 22 nt, Human
cacaccaccuucacacccacac

SEQ ID NO: 75895 - RNA, 26 nt, Human
acuggguggggugaggaccacuccuu

SEQ ID NO: 75896 - RNA, 22 nt, Human
cccccgaaccucuccccagcua

SEQ ID NO: 75897 - RNA, 22 nt, Human
ugggcucgccgugucucagccu

SEQ ID NO: 75898 - RNA, 22 nt, Human
cucuugaacccgggaggcggag

SEQ ID NO: 75899 - RNA, 20 nt, Human
agagcacgucgccacagagc

SEQ ID NO: 75900 - RNA, 24 nt, Human
gguguuugaaauucucugaaaauc

SEQ ID NO: 75901 - RNA, 23 nt, Human
gcccgaaccugagacuggaccug

SEQ ID NO: 75902 - RNA, 22 nt, Human
aagacuccagaaaugucccuuu

SEQ ID NO: 75903 - RNA, 22 nt, Human
gaacagaauguuuuacugugaa

SEQ ID NO: 75904 - RNA, 21 nt, Human
ggaggcuggaaugaaugauca

SEQ ID NO: 75905 - RNA, 31 nt, Human
aguggacagugacaaagacuccuaucuguug

SEQ ID NO: 75906 - RNA, 22 nt, Human
uagccaagaucccaucucucca

SEQ ID NO: 75907 - RNA, 20 nt, Human
ugggaaaggaacaggcuugg

SEQ ID NO: 75908 - RNA, 18 nt, Human
cugacuuaagugugcaaa

SEQ ID NO: 75909 - RNA, 23 nt, Human
ugcuacccugugacuuacuggga

SEQ ID NO: 75910 - RNA, 25 nt, Human
gucuugccaaguguguaugagacua

SEQ ID NO: 75911 - RNA, 20 nt, Human
cacucccuugccccaaaagg

SEQ ID NO: 75912 - RNA, 27 nt, Human
cuugcagauugaucacuuauucauuag

SEQ ID NO: 75913 - RNA, 23 nt, Human
ccaugauugugaaguucuagcca

SEQ ID NO: 75914 - RNA, 23 nt, Human
caugacucuuuauugucuguaaa

SEQ ID NO: 75915 - RNA, 21 nt, Human
aaccucaaccuccuuucuucu

SEQ ID NO: 75916 - RNA, 22 nt, Human
cccaaugcuccaucccaaccag

SEQ ID NO: 75917 - RNA, 25 nt, Human
gccagcccuggcugcccaggcggag

SEQ ID NO: 75918 - RNA, 18 nt, Human
caggguuugugaggaccu

SEQ ID NO: 75919 - RNA, 21 nt, Human
agauuaucagugacuuuuaua

SEQ ID NO: 75920 - RNA, 21 nt, Human
ccuguaauccuggcacuuugg

SEQ ID NO: 75921 - RNA, 22 nt, Human
uuagagauggugaauauauucc

SEQ ID NO: 75922 - RNA, 27 nt, Human
gucccuggaugggugguuaccuccccu

SEQ ID NO: 75923 - RNA, 19 nt, Human
agcggcaccaacaucauca

SEQ ID NO: 75924 - RNA, 20 nt, Human
ucgccucccagggccugugc

SEQ ID NO: 75925 - RNA, 21 nt, Human
cgaccuaggcaguaggccggu

SEQ ID NO: 75926 - RNA, 30 nt, Human
acugacccagaggggaaugagggcugaguu

SEQ ID NO: 75927 - RNA, 27 nt, Human
gggaggcagagguugcagugaaccuag

SEQ ID NO: 75928 - RNA, 22 nt, Human
agaaaacaagcagcuucugcgc

SEQ ID NO: 75929 - RNA, 18 nt, Human
cccugcucccuguggaca

SEQ ID NO: 75930 - RNA, 20 nt, Human
aagcucugccuucccucccu

SEQ ID NO: 75931 - RNA, 23 nt, Human
uguugcccaggcuggugugcaau

SEQ ID NO: 75932 - RNA, 27 nt, Human
uacucccucucuguuccugucuuagcc

SEQ ID NO: 75933 - RNA, 31 nt, Human
acaugucuaucaaacccagacuugcuuccau

SEQ ID NO: 75934 - RNA, 20 nt, Human
uagcccucaccacagccuuc

SEQ ID NO: 75935 - RNA, 25 nt, Human
uuacuugcaaaauggagaccaaauu

SEQ ID NO: 75936 - RNA, 22 nt, Human
agaugccagggcaugcagggca

SEQ ID NO: 75937 - RNA, 21 nt, Human
guugcccugugacuguagucc

SEQ ID NO: 75938 - RNA, 27 nt, Human
cuccugagccccucaauccuaucacag

SEQ ID NO: 75939 - RNA, 22 nt, Human
aggcugaggcaggagacucgcu

SEQ ID NO: 75940 - RNA, 18 nt, Human
ccuagcagagaacugccu

SEQ ID NO: 75941 - RNA, 27 nt, Human
cuccugagcucgugaucugcccgccuc

SEQ ID NO: 75942 - RNA, 20 nt, Human
ucgacgaggaggagugcaug

SEQ ID NO: 75943 - RNA, 23 nt, Human
ggauggccagagaugcuggacuu

SEQ ID NO: 75944 - RNA, 27 nt, Human
gucaccuagcagggcuucagggguucc

SEQ ID NO: 75945 - RNA, 27 nt, Human
ccccugcccugcuccuaaggguagaaa

SEQ ID NO: 75946 - RNA, 22 nt, Human
ggaaagggagccugggagccag

SEQ ID NO: 75947 - RNA, 25 nt, Human
gugucucugugccuauguggcugug

SEQ ID NO: 75948 - RNA, 24 nt, Human
aagggccaaauucccaaccugcuc

SEQ ID NO: 75949 - RNA, 28 nt, Human
ucucgaacuccugaccucaggugaucug

SEQ ID NO: 75950 - RNA, 20 nt, Human
gccucggggcuaagagcgcg

SEQ ID NO: 75951 - RNA, 20 nt, Human
caacaggaugaacgugugca

SEQ ID NO: 75952 - RNA, 20 nt, Human
uuuguggcaagacaagcuca

SEQ ID NO: 75953 - RNA, 23 nt, Human
cuggggccccggguucagccugg

SEQ ID NO: 75954 - RNA, 24 nt, Human
agggucagagaucugucagaggaa

SEQ ID NO: 75955 - RNA, 23 nt, Human
gccaucaccaaaaggaaaggaca

SEQ ID NO: 75956 - RNA, 21 nt, Human
ucaucaacgggcgcaccaagg

SEQ ID NO: 75957 - RNA, 30 nt, Human
cggggucagguggagcaggcagggcagucu

SEQ ID NO: 75958 - RNA, 27 nt, Human
auugcauggugcuagugcccucucucu

SEQ ID NO: 75959 - RNA, 22 nt, Human
agcuggaacacucucugagaug

SEQ ID NO: 75960 - RNA, 28 nt, Human
uguaugaugucacacaagcuccuuaacc

SEQ ID NO: 75961 - RNA, 26 nt, Human
agggccuggcuuaccgacugagguca

SEQ ID NO: 75962 - RNA, 21 nt, Human
gguuaaaauauucagucuaca

SEQ ID NO: 75963 - RNA, 23 nt, Human
ggaagcaugagacccgcccacac

SEQ ID NO: 75964 - RNA, 22 nt, Human
ugucuucuuuaggaguaaugau

SEQ ID NO: 75965 - RNA, 22 nt, Human
acugcagccuggaacuccuggg

SEQ ID NO: 75966 - RNA, 22 nt, Human
caguugauaaaugaaaaucacu

SEQ ID NO: 75967 - RNA, 22 nt, Human
cccaccccaaaaccuggcaccc

SEQ ID NO: 75968 - RNA, 23 nt, Human
uguagaaauggccuccucccucc

SEQ ID NO: 75969 - RNA, 23 nt, Human
agagagaaagggagccgcugugc

SEQ ID NO: 75970 - RNA, 20 nt, Human
uucuaaacagucauuuucua

SEQ ID NO: 75971 - RNA, 22 nt, Human
cuacagaaaagaaacucuaugg

SEQ ID NO: 75972 - RNA, 19 nt, Human
augcaggcaguguuuucac

SEQ ID NO: 75973 - RNA, 22 nt, Human
gagaucauagcucacuguaacc

SEQ ID NO: 75974 - RNA, 21 nt, Human
cagauugcuuaaaagcauuuu

SEQ ID NO: 75975 - RNA, 25 nt, Human
ccuuuauguuagacaaucaggauuu

SEQ ID NO: 75976 - RNA, 25 nt, Human
uauagaaauagaucagagcacaguu

SEQ ID NO: 75977 - RNA, 23 nt, Human
gggcgcucugcccucccuggccu

SEQ ID NO: 75978 - RNA, 24 nt, Human
augcauuuuauagaaugugucaca

SEQ ID NO: 75979 - RNA, 22 nt, Human
ugagugugugugcgugugaacg

SEQ ID NO: 75980 - RNA, 22 nt, Human
cgccuguaaucucagcacuuug

SEQ ID NO: 75981 - RNA, 22 nt, Human
cgcuuguaaucccagcacuuug

SEQ ID NO: 75982 - RNA, 22 nt, Human
uucaccauguuguacaggcugg

SEQ ID NO: 75983 - RNA, 20 nt, Human
ggugucgcaucuucuccagc

SEQ ID NO: 75984 - RNA, 23 nt, Human
cgccuguaaucccaguuacucgg

SEQ ID NO: 75985 - RNA, 26 nt, Human
agcccaaacacaucagcuuucaaaug

SEQ ID NO: 75986 - RNA, 22 nt, Human
uucuagggucaggggaaaugua

SEQ ID NO: 75987 - RNA, 22 nt, Human
guaauuuuucacuuugagaacc

SEQ ID NO: 75988 - RNA, 24 nt, Human
uacucugcuaaccuuucuuacuca

SEQ ID NO: 75989 - RNA, 22 nt, Human
agggaggugguggacggacugu

SEQ ID NO: 75990 - RNA, 22 nt, Human
caucauguccuacaucacugcc

SEQ ID NO: 75991 - RNA, 27 nt, Human
cgccacugcacucuagccggagugaca

SEQ ID NO: 75992 - RNA, 22 nt, Human
gccagcugugccggcguuuguu

SEQ ID NO: 75993 - RNA, 26 nt, Human
acuacugcugccuuucauuuauaaua

SEQ ID NO: 75994 - RNA, 27 nt, Human
accagccugaccaacauggagauaucc

SEQ ID NO: 75995 - RNA, 19 nt, Human
uuucucucuagagcacuca

SEQ ID NO: 75996 - RNA, 21 nt, Human
cccaccccugacacuucacca

SEQ ID NO: 75997 - RNA, 20 nt, Human
cuucccuuucauuuuuucca

SEQ ID NO: 75998 - RNA, 27 nt, Human
cucagcaggugcggagccgucacugca

SEQ ID NO: 75999 - RNA, 24 nt, Human
uuugggaaaugcacggacacuggg

SEQ ID NO: 76000 - RNA, 20 nt, Human
agugcaaauacuaucuucaa

SEQ ID NO: 76001 - RNA, 22 nt, Human
ggccaucugccugaauguaacc

SEQ ID NO: 76002 - RNA, 28 nt, Human
uguugauugccaaauugacauguuguca

SEQ ID NO: 76003 - RNA, 23 nt, Human
acaaaccugucaccaguguagca

SEQ ID NO: 76004 - RNA, 23 nt, Human
ugcagccucugccucccaggcuc

SEQ ID NO: 76005 - RNA, 26 nt, Human
ugcccaggcccuuggcugcaggcaac

SEQ ID NO: 76006 - RNA, 21 nt, Human
cauuccucgguuagcuggaac

SEQ ID NO: 76007 - RNA, 22 nt, Human
cauugcacccuagccugggcaa

SEQ ID NO: 76008 - RNA, 27 nt, Human
acugaggaugaagagggagaaugucag

SEQ ID NO: 76009 - RNA, 22 nt, Human
gccuccagcaccuucccucuca

SEQ ID NO: 76010 - RNA, 21 nt, Human
gggugagggugggagauuuag

SEQ ID NO: 76011 - RNA, 21 nt, Human
gcucagcccuggaggugccag

SEQ ID NO: 76012 - RNA, 18 nt, Human
gcuuaagccacugccucu

SEQ ID NO: 76013 - RNA, 22 nt, Human
ugaguagcuggauuacaggcau

SEQ ID NO: 76014 - RNA, 21 nt, Human
aaagaacaguccauugaaagg

SEQ ID NO: 76015 - RNA, 27 nt, Human
uaucuggagagagaggaaaagucagca

SEQ ID NO: 76016 - RNA, 25 nt, Human
cccuggggagccucagaagccugcg

SEQ ID NO: 76017 - RNA, 25 nt, Human
ggcuuaggcagcaaccuccacauuc

SEQ ID NO: 76018 - RNA, 22 nt, Human
ccaaagugaugggauuacaggc

SEQ ID NO: 76019 - RNA, 24 nt, Human
ggcucaggugauccucccaccuca

SEQ ID NO: 76020 - RNA, 25 nt, Human
caccaggcuggagugcagugccgca

SEQ ID NO: 76021 - RNA, 25 nt, Human
ugcuuaggcucgcaaacaagaagug

SEQ ID NO: 76022 - RNA, 22 nt, Human
gcucacugcaacauccgccucc

SEQ ID NO: 76023 - RNA, 22 nt, Human
gcucccugcaaccuccgccucc

SEQ ID NO: 76024 - RNA, 21 nt, Human
gcugccucaacuuccugggcu

SEQ ID NO: 76025 - RNA, 27 nt, Human
ugucauuguuuuuaaaacuguuuuaua

SEQ ID NO: 76026 - RNA, 21 nt, Human
gccagacaucucucccccuca

SEQ ID NO: 76027 - RNA, 24 nt, Human
cagaaaacuuauuaacaacuguga

SEQ ID NO: 76028 - RNA, 27 nt, Human
ugccgcaggcugggcgggagagacugu

SEQ ID NO: 76029 - RNA, 24 nt, Human
gacuauggguacauuccacagugc

SEQ ID NO: 76030 - RNA, 27 nt, Human
ggguugcugccuuucaagcggugccua

SEQ ID NO: 76031 - RNA, 21 nt, Human
ggcacugugggccuguugguc

SEQ ID NO: 76032 - RNA, 19 nt, Human
cccaccccucacagcccca

SEQ ID NO: 76033 - RNA, 18 nt, Human
ucugggcccugggccaga

SEQ ID NO: 76034 - RNA, 22 nt, Human
auuaugaaucccuucagucaca

SEQ ID NO: 76035 - RNA, 23 nt, Human
gcuuucuuccaaacuccugggcc

SEQ ID NO: 76036 - RNA, 22 nt, Human
cuaaggcaggaggaucacuuga

SEQ ID NO: 76037 - RNA, 27 nt, Human
ccagcacucugguuaaauuuuaaggua

SEQ ID NO: 76038 - RNA, 23 nt, Human
acagcugggcuggagaguuggug

SEQ ID NO: 76039 - RNA, 21 nt, Human
aaacuauuauuauugaucaca

SEQ ID NO: 76040 - RNA, 22 nt, Human
guguggucuguucuuuaccucc

SEQ ID NO: 76041 - RNA, 27 nt, Human
uucauucuuaucuucugcuaguuaaua

SEQ ID NO: 76042 - RNA, 22 nt, Human
ugacgcacaggcuggagugcag

SEQ ID NO: 76043 - RNA, 22 nt, Human
uuuuaguaauuuguacuguauu

SEQ ID NO: 76044 - RNA, 30 nt, Human
cccagauucaacaggaaaccgaucuucccc

SEQ ID NO: 76045 - RNA, 21 nt, Human
guucucuuuggugucauucag

SEQ ID NO: 76046 - RNA, 22 nt, Human
ugcagugcgcugagaucgugcc

SEQ ID NO: 76047 - RNA, 21 nt, Human
cccccucuucucacauuaagg

SEQ ID NO: 76048 - RNA, 24 nt, Human
auguguuuagaaauaaaagcacaa

SEQ ID NO: 76049 - RNA, 22 nt, Human
ucuccugccucagccucccgau

SEQ ID NO: 76050 - RNA, 28 nt, Human
ugcuuguauuuauuuaccuugguauuuu

SEQ ID NO: 76051 - RNA, 21 nt, Human
gugacaagagaauugguuugg

SEQ ID NO: 76052 - RNA, 23 nt, Human
uauugcauaaugauauucacauc

SEQ ID NO: 76053 - RNA, 26 nt, Human
agacgcugguggcuguggacucccca

SEQ ID NO: 76054 - RNA, 25 nt, Human
uugagggacgagaaugugaacgugg

SEQ ID NO: 76055 - RNA, 22 nt, Human
gugcucaaagauguacugagag

SEQ ID NO: 76056 - RNA, 20 nt, Human
ccugccuccagccuuccuga

SEQ ID NO: 76057 - RNA, 22 nt, Human
ggaaaggggaaauucuguuuaa

SEQ ID NO: 76058 - RNA, 23 nt, Human
uucaaugcuauuaaaucauacaa

SEQ ID NO: 76059 - RNA, 22 nt, Human
ggcauuuucccagauguuuaca

SEQ ID NO: 76060 - RNA, 25 nt, Human
cccacaugccauuuguacugacccc

SEQ ID NO: 76061 - RNA, 20 nt, Human
ugagcuacaaccuggccuuc

SEQ ID NO: 76062 - RNA, 21 nt, Human
gaccacaccccguccaggcca

SEQ ID NO: 76063 - RNA, 21 nt, Human
gguuggguuuaggaugaacca

SEQ ID NO: 76064 - RNA, 27 nt, Human
uugaugaaauaaaauaucaauauuuuc

SEQ ID NO: 76065 - RNA, 23 nt, Human
ccuccuuccucuuuuccuuccca

SEQ ID NO: 76066 - RNA, 27 nt, Human
cccaggccuauguugauccauccagcu

SEQ ID NO: 76067 - RNA, 22 nt, Human
cucacugcagcugccagcacuu

SEQ ID NO: 76068 - RNA, 27 nt, Human
uacagaagcaggaaaaccaauuauaag

SEQ ID NO: 76069 - RNA, 19 nt, Human
agcuagcaguucccauuca

SEQ ID NO: 76070 - RNA, 19 nt, Human
agcugaucagaucucucca

SEQ ID NO: 76071 - RNA, 29 nt, Human
agaccuccccagccccuagcccaggagag

SEQ ID NO: 76072 - RNA, 23 nt, Human
gccaucucccccucccuuuuucc

SEQ ID NO: 76073 - RNA, 22 nt, Human
gggcugaggcaggaggaucagu

SEQ ID NO: 76074 - RNA, 21 nt, Human
ccccauuggcucagagcuagg

SEQ ID NO: 76075 - RNA, 22 nt, Human
cagacuccugcaaguuccccua

SEQ ID NO: 76076 - RNA, 20 nt, Human
uuugagaccagccugggcag

SEQ ID NO: 76077 - RNA, 20 nt, Human
gccaccaggcugaagucagc

SEQ ID NO: 76078 - RNA, 23 nt, Human
aacuggguggagaaagaauggaa

SEQ ID NO: 76079 - RNA, 22 nt, Human
ggcaggggaccccagugcucuc

SEQ ID NO: 76080 - RNA, 22 nt, Human
cacugcccucucugugccuugg

SEQ ID NO: 76081 - RNA, 22 nt, Human
ugcucuggcugaguugugugcc

SEQ ID NO: 76082 - RNA, 25 nt, Human
ugcaguucugccucacacggcucaa

SEQ ID NO: 76083 - RNA, 27 nt, Human
cccuccugcauugcugcugcgugggua

SEQ ID NO: 76084 - RNA, 22 nt, Human
aauuguccauaggccacacuuu

SEQ ID NO: 76085 - RNA, 27 nt, Human
ucugcugucuguaguucugugagcuca

SEQ ID NO: 76086 - RNA, 23 nt, Human
ccuccucugcucuccaucauaac

SEQ ID NO: 76087 - RNA, 20 nt, Human
ggccauccuggaaggaaguu

SEQ ID NO: 76088 - RNA, 24 nt, Human
uucuggagcuuaauuuucugugga

SEQ ID NO: 76089 - RNA, 22 nt, Human
ugggcaauaugacaaguauuac

SEQ ID NO: 76090 - RNA, 23 nt, Human
ugccuguagucccagcuacaugg

SEQ ID NO: 76091 - RNA, 21 nt, Human
acagccaacacgcaccugccu

SEQ ID NO: 76092 - RNA, 26 nt, Human
ucaggcuggggccugggucagagcgg

SEQ ID NO: 76093 - RNA, 21 nt, Human
ucuccgucacuccauucucag

SEQ ID NO: 76094 - RNA, 20 nt, Human
uuaucggacauucuaaugca

SEQ ID NO: 76095 - RNA, 21 nt, Human
aggguccacaggaagugaaga

SEQ ID NO: 76096 - RNA, 25 nt, Human
gucauuuaggcuggaaaaaaguuga

SEQ ID NO: 76097 - RNA, 27 nt, Human
gccauuuuuuacucuggggagaagcag

SEQ ID NO: 76098 - RNA, 27 nt, Human
uggccaacauggugaaaccuggccucu

SEQ ID NO: 76099 - RNA, 24 nt, Human
uuuuggaauccugcucuauguaca

SEQ ID NO: 76100 - RNA, 21 nt, Human
cuucugcuucccuugccuauu

SEQ ID NO: 76101 - RNA, 19 nt, Human
ucucucuucucuucuuuau

SEQ ID NO: 76102 - RNA, 25 nt, Human
cucauagaaauugccuccaguccag

SEQ ID NO: 76103 - RNA, 22 nt, Human
guggacugaguguuuuggccau

SEQ ID NO: 76104 - RNA, 29 nt, Human
cuggguaccaaugcugcaggucaacagcu

SEQ ID NO: 76105 - RNA, 24 nt, Human
ucuugcccuauuuuaauucugcua

SEQ ID NO: 76106 - RNA, 20 nt, Human
aacugcagacacagcuguuc

SEQ ID NO: 76107 - RNA, 21 nt, Human
acuuuuuacuuguauagauga

SEQ ID NO: 76108 - RNA, 22 nt, Human
uccucccuccucccccuucacc

SEQ ID NO: 76109 - RNA, 23 nt, Human
cugccucuacugggcgugcugcc

SEQ ID NO: 76110 - RNA, 23 nt, Human
cuuccagcucacuuuauucucag

SEQ ID NO: 76111 - RNA, 23 nt, Human
ucucuccauagaacagcacuacc

SEQ ID NO: 76112 - RNA, 22 nt, Human
ggcgagggugucuauggagagg

SEQ ID NO: 76113 - RNA, 24 nt, Human
cccuccagauuucuaucacuuugg

SEQ ID NO: 76114 - RNA, 22 nt, Human
uuaaaaaauuaaagacuaaaaa

SEQ ID NO: 76115 - RNA, 25 nt, Human
cuguuuucugggccagugagccaga

SEQ ID NO: 76116 - RNA, 26 nt, Human
cggaaucccagggacucucggcgccg

SEQ ID NO: 76117 - RNA, 21 nt, Human
uaugucaucguaaaagcugga

SEQ ID NO: 76118 - RNA, 22 nt, Human
agccucuggaguagcugggacu

SEQ ID NO: 76119 - RNA, 21 nt, Human
ugucaaaaucaaaaguauuua

SEQ ID NO: 76120 - RNA, 26 nt, Human
ccuuucuaaucucagcuccugccugu

SEQ ID NO: 76121 - RNA, 27 nt, Human
cugggcccugaacccuguagacagaug

SEQ ID NO: 76122 - RNA, 27 nt, Human
uuuugguguguaacuuagaaggauuga

SEQ ID NO: 76123 - RNA, 21 nt, Human
ugccacucugggcaaaugcuc

SEQ ID NO: 76124 - RNA, 26 nt, Human
aauacugauguuguacacuguuuuac

SEQ ID NO: 76125 - RNA, 25 nt, Human
cccaggagcugcaggcugggagggg

SEQ ID NO: 76126 - RNA, 23 nt, Human
ggagaaacaggcucugagauuuc

SEQ ID NO: 76127 - RNA, 21 nt, Human
caccuccuggguuuaagcaau

SEQ ID NO: 76128 - RNA, 23 nt, Human
cucaagcaguccuccugccuugg

SEQ ID NO: 76129 - RNA, 23 nt, Human
uuuuggcauuccaccuccuaggg

SEQ ID NO: 76130 - RNA, 27 nt, Human
uuuccagcagauuucaggcuguucuua

SEQ ID NO: 76131 - RNA, 24 nt, Human
ucucccacauccucuuccccaacu

SEQ ID NO: 76132 - RNA, 22 nt, Human
cuagcacuccuuuccccugcug

SEQ ID NO: 76133 - RNA, 22 nt, Human
ccaauauaacuaggcaaaaaga

SEQ ID NO: 76134 - RNA, 25 nt, Human
uugucauaaccauuuuuaaaaguca

SEQ ID NO: 76135 - RNA, 27 nt, Human
gcuguguagaaguccuagcauuauagg

SEQ ID NO: 76136 - RNA, 24 nt, Human
gcauuucagccagaaagagccucu

SEQ ID NO: 76137 - RNA, 19 nt, Human
ccucucuguaaucuaagug

SEQ ID NO: 76138 - RNA, 23 nt, Human
ucaccauacucucucgcccaggc

SEQ ID NO: 76139 - RNA, 21 nt, Human
ccaguugggaaacccaggaag

SEQ ID NO: 76140 - RNA, 18 nt, Human
uggaacaacagcuaucua

SEQ ID NO: 76141 - RNA, 22 nt, Human
ucuuuucagcugcuauuuugga

SEQ ID NO: 76142 - RNA, 22 nt, Human
ucaauuuuaaggaaacuuuuua

SEQ ID NO: 76143 - RNA, 19 nt, Human
aaccaaaaagagcaucccu

SEQ ID NO: 76144 - RNA, 21 nt, Human
gacuugucaagugaauucuuu

SEQ ID NO: 76145 - RNA, 21 nt, Human
ucgucacuggggugggagaag

SEQ ID NO: 76146 - RNA, 19 nt, Human
ucuucuuucuuccacccac

SEQ ID NO: 76147 - RNA, 26 nt, Human
gaggagugcuugaggccaggaguuca

SEQ ID NO: 76148 - RNA, 23 nt, Human
gaucccuggcccagaccucgggc

SEQ ID NO: 76149 - RNA, 26 nt, Human
ggggacugagccgcgagccccgaggu

SEQ ID NO: 76150 - RNA, 28 nt, Human
aacaccgucccagggcucugcaggccac

SEQ ID NO: 76151 - RNA, 23 nt, Human
uucuccucugugccccucaugcu

SEQ ID NO: 76152 - RNA, 22 nt, Human
accaaccaacggacuuaccuua

SEQ ID NO: 76153 - RNA, 21 nt, Human
gaggucagguguucaagacca

SEQ ID NO: 76154 - RNA, 26 nt, Human
ccuccaacuccugguucagccauugc

SEQ ID NO: 76155 - RNA, 22 nt, Human
caugccuguaaucccagcacug

SEQ ID NO: 76156 - RNA, 25 nt, Human
ucguauuuuccucccuacccgccaa

SEQ ID NO: 76157 - RNA, 25 nt, Human
ggaggcggcagcgacggaggagggg

SEQ ID NO: 76158 - RNA, 29 nt, Human
cccuucgccaccuccccaggagggcgucc

SEQ ID NO: 76159 - RNA, 23 nt, Human
ggcaagagguggaaggguacuga

SEQ ID NO: 76160 - RNA, 26 nt, Human
cacuggggcuggggccugugccuuau

SEQ ID NO: 76161 - RNA, 21 nt, Human
acucagcaucaaaauauuuca

SEQ ID NO: 76162 - RNA, 27 nt, Human
accuguguagugggcuuggggcuacgc

SEQ ID NO: 76163 - RNA, 21 nt, Human
guccuuaccucauggcuguga

SEQ ID NO: 76164 - RNA, 21 nt, Human
auaacugcacuccagccuggg

SEQ ID NO: 76165 - RNA, 23 nt, Human
uggcuaaagggcuaguguggccu

SEQ ID NO: 76166 - RNA, 27 nt, Human
agcuaggauuugaccccagacaaucug

SEQ ID NO: 76167 - RNA, 20 nt, Human
cacagccccuuaagggaaag

SEQ ID NO: 76168 - RNA, 22 nt, Human
cauuuuguuuccuaugaucauc

SEQ ID NO: 76169 - RNA, 21 nt, Human
uggcucagccucgaaucccag

SEQ ID NO: 76170 - RNA, 18 nt, Human
cacccauuaaaagaaaua

SEQ ID NO: 76171 - RNA, 19 nt, Human
ggaucugcccaucacuuug

SEQ ID NO: 76172 - RNA, 24 nt, Human
uuucucaucugcacuauguuucca

SEQ ID NO: 76173 - RNA, 18 nt, Human
cuuuagauacugaagaca

SEQ ID NO: 76174 - RNA, 23 nt, Human
cccaaaauugcugggauuacagg

SEQ ID NO: 76175 - RNA, 20 nt, Human
gagacccccgugggccagga

SEQ ID NO: 76176 - RNA, 22 nt, Human
cuaacacagugaaaccccgucu

SEQ ID NO: 76177 - RNA, 23 nt, Human
ccgaccaauuagucacugcugcu

SEQ ID NO: 76178 - RNA, 26 nt, Human
cugugaucuuauguauguaaagugaa

SEQ ID NO: 76179 - RNA, 22 nt, Human
uucucauuaaaauccaguauua

SEQ ID NO: 76180 - RNA, 21 nt, Human
uccucuucugggacugcugug

SEQ ID NO: 76181 - RNA, 19 nt, Human
aacacaaaacauucaugua

SEQ ID NO: 76182 - RNA, 20 nt, Human
auggcuacuguucaaauaca

SEQ ID NO: 76183 - RNA, 22 nt, Human
ccaugaagaaggaagcuguaga

SEQ ID NO: 76184 - RNA, 21 nt, Human
accagcaccaggcccacccuc

SEQ ID NO: 76185 - RNA, 26 nt, Human
agcucccugccagcuuccugucccug

SEQ ID NO: 76186 - RNA, 22 nt, Human
cacacaucauccaucucuccag

SEQ ID NO: 76187 - RNA, 22 nt, Human
caugcaaacauuuuccaguuac

SEQ ID NO: 76188 - RNA, 26 nt, Human
agcacccaccucccuuuucucagccu

SEQ ID NO: 76189 - RNA, 20 nt, Human
uacaagugggaguuaagaga

SEQ ID NO: 76190 - RNA, 16 nt, Human
uucugacuugcugcua

SEQ ID NO: 76191 - RNA, 27 nt, Human
cacuaccagucaccuuugauucgcgac

SEQ ID NO: 76192 - RNA, 24 nt, Human
accccaggcuguugggaacguaag

SEQ ID NO: 76193 - RNA, 30 nt, Human
aaacuaagcucaguaacaagaaggcauaaa

SEQ ID NO: 76194 - RNA, 24 nt, Human
uuccuggcccagucccugccucuc

SEQ ID NO: 76195 - RNA, 23 nt, Human
ccaggccucugcucugaagagca

SEQ ID NO: 76196 - RNA, 21 nt, Human
cucaaagacaacaacuaccug

SEQ ID NO: 76197 - RNA, 25 nt, Human
ccaggucagaaaguggcccaggaag

SEQ ID NO: 76198 - RNA, 21 nt, Human
ggagcauggcccucccuggcu

SEQ ID NO: 76199 - RNA, 21 nt, Human
uagcccagucuggagugcagu

SEQ ID NO: 76200 - RNA, 20 nt, Human
aggaacacugguugccugaa

SEQ ID NO: 76201 - RNA, 21 nt, Human
cuucucuggcugccuggucag

SEQ ID NO: 76202 - RNA, 21 nt, Human
caggcuccaagaguccacccu

SEQ ID NO: 76203 - RNA, 21 nt, Human
uucacaguccuuacuucucua

SEQ ID NO: 76204 - RNA, 25 nt, Human
gcccaggcuggagugcaguggcgca

SEQ ID NO: 76205 - RNA, 25 nt, Human
acccagguuggagugcaguggcgug

SEQ ID NO: 76206 - RNA, 25 nt, Human
acccaggcuggagugcgguggcgca

SEQ ID NO: 76207 - RNA, 23 nt, Human
ccuccuuuugcccuccgcaggag

SEQ ID NO: 76208 - RNA, 24 nt, Human
ucuaagauauuuugaacuaagcau

SEQ ID NO: 76209 - RNA, 27 nt, Human
uguuuuuaaacaaaagauauuauuuug

SEQ ID NO: 76210 - RNA, 21 nt, Human
cccugagagguagaggcugca

SEQ ID NO: 76211 - RNA, 26 nt, Human
ccuccuuccugaccucugaggcagga

SEQ ID NO: 76212 - RNA, 22 nt, Human
ccaggagguggagguugcagua

SEQ ID NO: 76213 - RNA, 23 nt, Human
agcuuucaccuccaggaucuauu

SEQ ID NO: 76214 - RNA, 29 nt, Human
cuccaggaaugccuccucccugggcagaa

SEQ ID NO: 76215 - RNA, 22 nt, Human
gugccaauuuauuuacauuuaa

SEQ ID NO: 76216 - RNA, 27 nt, Human
gggccaggagggcagguucccucucug

SEQ ID NO: 76217 - RNA, 19 nt, Human
ccagaaguucaaggcugca

SEQ ID NO: 76218 - RNA, 21 nt, Human
auuaugccccaggcuucccua

SEQ ID NO: 76219 - RNA, 22 nt, Human
gcugggagguagaaggggagga

SEQ ID NO: 76220 - RNA, 19 nt, Human
uuuucaguucaaagucaug

SEQ ID NO: 76221 - RNA, 23 nt, Human
uccagaaagugacaagcucacag

SEQ ID NO: 76222 - RNA, 22 nt, Human
gguggauuugagcuguggcugu

SEQ ID NO: 76223 - RNA, 20 nt, Human
uuuggccauuccaacagcuc

SEQ ID NO: 76224 - RNA, 22 nt, Human
uggucucaaacuccuaaccuug

SEQ ID NO: 76225 - RNA, 22 nt, Human
uccugcucugccuucugggacu

SEQ ID NO: 76226 - RNA, 21 nt, Human
uacaagugucagucauguauc

SEQ ID NO: 76227 - RNA, 16 nt, Human
ggccucggcugcggcg

SEQ ID NO: 76228 - RNA, 12 nt, Human
agccauguaaua

SEQ ID NO: 76229 - RNA, 24 nt, Human
gcuaugccucuaauuucaccaggg

SEQ ID NO: 76230 - RNA, 20 nt, Human
cccaucugguccaguuccuu

SEQ ID NO: 76231 - RNA, 20 nt, Human
agcuacaacaaauacuacag

SEQ ID NO: 76232 - RNA, 20 nt, Human
ccuccgccucuccaccagcc

SEQ ID NO: 76233 - RNA, 19 nt, Human
gggaagcucuggccugaga

SEQ ID NO: 76234 - RNA, 32 nt, Human
gaggacaguggaugacagggaagacgaguggg

SEQ ID NO: 76235 - RNA, 23 nt, Human
cuuccuggacuuguguuacuuca

SEQ ID NO: 76236 - RNA, 28 nt, Human
aauucaaucaaauccuguccuagugugu

SEQ ID NO: 76237 - RNA, 19 nt, Human
cccugcucuucaguggguc

SEQ ID NO: 76238 - RNA, 23 nt, Human
cacagguaccagcuuugcagagg

SEQ ID NO: 76239 - RNA, 28 nt, Human
ccuggccuugcugaccucagcgguugcc

SEQ ID NO: 76240 - RNA, 18 nt, Human
gaaaguguccaacaagga

SEQ ID NO: 76241 - RNA, 20 nt, Human
auguucuccaucugcaugau

SEQ ID NO: 76242 - RNA, 24 nt, Human
cuguugcccaugcuggagugcaau

SEQ ID NO: 76243 - RNA, 26 nt, Human
gcauuuuccugcucuuucauucucug

SEQ ID NO: 76244 - RNA, 21 nt, Human
agagagaaugaggcucaguug

SEQ ID NO: 76245 - RNA, 22 nt, Human
aaagcgcugggauuacaggcag

SEQ ID NO: 76246 - RNA, 22 nt, Human
aaaguucugggacuacaggcau

SEQ ID NO: 76247 - RNA, 23 nt, Human
cagcuguggugcaggagccaaga

SEQ ID NO: 76248 - RNA, 18 nt, Human
ggagagaacgggcgucag

SEQ ID NO: 76249 - RNA, 22 nt, Human
uccaccccaaaaaugucugucu

SEQ ID NO: 76250 - RNA, 20 nt, Human
cagccgggcuggaggcugug

SEQ ID NO: 76251 - RNA, 24 nt, Human
ccucuuuucugcaucaucuguaga

SEQ ID NO: 76252 - RNA, 24 nt, Human
augaagcucaucacagcgaaccag

SEQ ID NO: 76253 - RNA, 24 nt, Human
ggaaacacugauuuugcugcugaa

SEQ ID NO: 76254 - RNA, 21 nt, Human
uuguucccagccaugcuuuug

SEQ ID NO: 76255 - RNA, 24 nt, Human
gaauguugaaaaugcgucucagag

SEQ ID NO: 76256 - RNA, 20 nt, Human
caagggugaaggugagggaa

SEQ ID NO: 76257 - RNA, 21 nt, Human
ccucccacuucucaacuccag

SEQ ID NO: 76258 - RNA, 21 nt, Human
cuucugcuaauaccucuuacu

SEQ ID NO: 76259 - RNA, 21 nt, Human
ugggagguugagcugguagga

SEQ ID NO: 76260 - RNA, 28 nt, Human
gucucuugguccacaccucgcucccugu

SEQ ID NO: 76261 - RNA, 26 nt, Human
cgagcaggagugauaguuaccuucac

SEQ ID NO: 76262 - RNA, 27 nt, Human
accagccuggccaacauggcaaaacca

SEQ ID NO: 76263 - RNA, 21 nt, Human
uccagccugggcgauggagcg

SEQ ID NO: 76264 - RNA, 21 nt, Human
ggcacagugccugggacuggc

SEQ ID NO: 76265 - RNA, 21 nt, Human
guuagcuguggccacugugga

SEQ ID NO: 76266 - RNA, 25 nt, Human
aggagucugaggcaggagaaucgcu

SEQ ID NO: 76267 - RNA, 22 nt, Human
cagagcaggggcuccagcacuu

SEQ ID NO: 76268 - RNA, 23 nt, Human
ucauucuuuucagcuuguuucua

SEQ ID NO: 76269 - RNA, 27 nt, Human
cugagauacgucugugacuuaucuacc

SEQ ID NO: 76270 - RNA, 22 nt, Human
uuuccugccucuccuuucacca

SEQ ID NO: 76271 - RNA, 23 nt, Human
gcuucucccuucuuucugggacu

SEQ ID NO: 76272 - RNA, 24 nt, Human
agcugggcauuuagaaagauguca

SEQ ID NO: 76273 - RNA, 20 nt, Human
ggaggcuacaaaggccaggc

SEQ ID NO: 76274 - RNA, 20 nt, Human
ggcuauauuuuucugcuaca

SEQ ID NO: 76275 - RNA, 20 nt, Human
cccucaaagaagaaaaagaa

SEQ ID NO: 76276 - RNA, 22 nt, Human
acgucccagggagggaggggcg

SEQ ID NO: 76277 - RNA, 23 nt, Human
ucugugucauuaaccaucuuuaa

SEQ ID NO: 76278 - RNA, 23 nt, Human
gucaccaugugugggcucaggga

SEQ ID NO: 76279 - RNA, 18 nt, Human
agcauaauuuguucuaca

SEQ ID NO: 76280 - RNA, 22 nt, Human
guuagcaacacuguuuucuuua

SEQ ID NO: 76281 - RNA, 25 nt, Human
accucagggugaucagcccaccucg

SEQ ID NO: 76282 - RNA, 21 nt, Human
uugcagcacuuuaccucucug

SEQ ID NO: 76283 - RNA, 20 nt, Human
uuagcuuguuccuggacuuc

SEQ ID NO: 76284 - RNA, 22 nt, Human
cuucauuuugugguugucuuac

SEQ ID NO: 76285 - RNA, 21 nt, Human
aaagugcuaggauuaaaacau

SEQ ID NO: 76286 - RNA, 19 nt, Human
caucuggagaaaauucagu

SEQ ID NO: 76287 - RNA, 22 nt, Human
uguacuugaaggauggaugagu

SEQ ID NO: 76288 - RNA, 22 nt, Human
uucagugagccgagauugugcc

SEQ ID NO: 76289 - RNA, 19 nt, Human
uggaaaugccaaaccaagc

SEQ ID NO: 76290 - RNA, 21 nt, Human
cccaaugucaaguggcagcuc

SEQ ID NO: 76291 - RNA, 22 nt, Human
uuccauuccucccaagguggca

SEQ ID NO: 76292 - RNA, 26 nt, Human
aucuuagauaguguauuaugcuucca

SEQ ID NO: 76293 - RNA, 26 nt, Human
aggccccagccccugccucuccauua

SEQ ID NO: 76294 - RNA, 23 nt, Human
ccagaggacaaaccccaauacag

SEQ ID NO: 76295 - RNA, 26 nt, Human
gacucgcgcucucggcuucugcuccg

SEQ ID NO: 76296 - RNA, 21 nt, Human
agugcauuuccuccugccuuu

SEQ ID NO: 76297 - RNA, 22 nt, Human
gcaccuugcagcccugcaccug

SEQ ID NO: 76298 - RNA, 25 nt, Human
aacugcauccagccuggggcugagg

SEQ ID NO: 76299 - RNA, 27 nt, Human
aaaacucaagugacacaaguuacaagu

SEQ ID NO: 76300 - RNA, 26 nt, Human
ccucaagguuuuagguucuaaaguuc

SEQ ID NO: 76301 - RNA, 26 nt, Human
ucucccaccuucuacugggcauaauu

SEQ ID NO: 76302 - RNA, 26 nt, Human
uugcaagcagugugucgcuucugcac

SEQ ID NO: 76303 - RNA, 22 nt, Human
uaauaaucaguucuuuacaacc

SEQ ID NO: 76304 - RNA, 16 nt, Human
aauuuagaaccagaua

SEQ ID NO: 76305 - RNA, 21 nt, Human
ggaggcugaggcaggagaauc

SEQ ID NO: 76306 - RNA, 26 nt, Human
uuuguacuagcugugccugccuuguu

SEQ ID NO: 76307 - RNA, 24 nt, Human
aaacccagcagccucaaccuaguu

SEQ ID NO: 76308 - RNA, 25 nt, Human
gccacugccagaaagagagucaagc

SEQ ID NO: 76309 - RNA, 25 nt, Human
uucucuuccuccuccacuucugugc

SEQ ID NO: 76310 - RNA, 24 nt, Human
ucauggucauggacagauagacag

SEQ ID NO: 76311 - RNA, 22 nt, Human
ggagauggggauggaggaggaa

SEQ ID NO: 76312 - RNA, 20 nt, Human
uggucuuuauuccucccuca

SEQ ID NO: 76313 - RNA, 27 nt, Human
gaccagccugaccaacacggagaaacc

SEQ ID NO: 76314 - RNA, 27 nt, Human
ugcucuuucuuggauuggacaggagau

SEQ ID NO: 76315 - RNA, 24 nt, Human
acaaggcacagugcagcuugguga

SEQ ID NO: 76316 - RNA, 19 nt, Human
cuuggcacuucuccagaag

SEQ ID NO: 76317 - RNA, 20 nt, Human
uuucugcuuaguggcacuga

SEQ ID NO: 76318 - RNA, 27 nt, Human
cuuuucuucccagcaaagguuggccuu

SEQ ID NO: 76319 - RNA, 19 nt, Human
ccaagucccagaucauguc

SEQ ID NO: 76320 - RNA, 23 nt, Human
cugaggguugcaugaaucugcag

SEQ ID NO: 76321 - RNA, 22 nt, Human
cucacauuucccacuugagguu

SEQ ID NO: 76322 - RNA, 27 nt, Human
caaugaugccuagugaguaugugucca

SEQ ID NO: 76323 - RNA, 23 nt, Human
uuugcagaaauacagauccaaga

SEQ ID NO: 76324 - RNA, 25 nt, Human
ucuccaccgggggcuucauccuucc

SEQ ID NO: 76325 - RNA, 27 nt, Human
ugcucugggcuggagcgagggccaggu

SEQ ID NO: 76326 - RNA, 22 nt, Human
cucccacacucgccaucuccug

SEQ ID NO: 76327 - RNA, 22 nt, Human
aaaauucccucauuuaaaccca

SEQ ID NO: 76328 - RNA, 22 nt, Human
gauucauugucccuuucuugaa

SEQ ID NO: 76329 - RNA, 20 nt, Human
uauuguugggacaggugcca

SEQ ID NO: 76330 - RNA, 20 nt, Human
gccacucaggugcauugcag

SEQ ID NO: 76331 - RNA, 27 nt, Human
cccaaauguaaauauuaaaaauaaaua

SEQ ID NO: 76332 - RNA, 23 nt, Human
uagaauauaagcaacauucugaa

SEQ ID NO: 76333 - RNA, 20 nt, Human
uccagagacacaggcaccag

SEQ ID NO: 76334 - RNA, 23 nt, Human
uuuuaugcuuuuaaaaucaauag

SEQ ID NO: 76335 - RNA, 22 nt, Human
caucaauggccacagcuauggu

SEQ ID NO: 76336 - RNA, 22 nt, Human
ccgccgccgccaccacugccac

SEQ ID NO: 76337 - RNA, 21 nt, Human
aaccuuggagugagagcccag

SEQ ID NO: 76338 - RNA, 22 nt, Human
uucauucucuagacaaaaucca

SEQ ID NO: 76339 - RNA, 22 nt, Human
aucaagggauucuccugccuca

SEQ ID NO: 76340 - RNA, 23 nt, Human
agagccacacugaggagaagcac

SEQ ID NO: 76341 - RNA, 22 nt, Human
gcgugagccaccgagccuggcc

SEQ ID NO: 76342 - RNA, 22 nt, Human
gaacagcuucuaccuuuaggaa

SEQ ID NO: 76343 - RNA, 27 nt, Human
cagccuuaagcccaccugggcacuuuu

SEQ ID NO: 76344 - RNA, 23 nt, Human
cagucucccuccaggaaaggccu

SEQ ID NO: 76345 - RNA, 23 nt, Human
ugcacuccaggcugggugacaga

SEQ ID NO: 76346 - RNA, 26 nt, Human
uguccgcucugauuagcagaucgaca

SEQ ID NO: 76347 - RNA, 23 nt, Human
uucugcaggaagucccugagcug

SEQ ID NO: 76348 - RNA, 27 nt, Human
guccuccaggcuggggcagguucuuag

SEQ ID NO: 76349 - RNA, 27 nt, Human
cuagggcagagaacccaggaugggaca

SEQ ID NO: 76350 - RNA, 21 nt, Human
ggacccaggcuggcuggggac

SEQ ID NO: 76351 - RNA, 22 nt, Human
caggcuggaguacaguggugug

SEQ ID NO: 76352 - RNA, 23 nt, Human
ccugccugccagcaccuaggacu

SEQ ID NO: 76353 - RNA, 19 nt, Human
guauuuuucucaaaugaac

SEQ ID NO: 76354 - RNA, 26 nt, Human
gauuucuggcauauguuucugcuagc

SEQ ID NO: 76355 - RNA, 23 nt, Human
gguggaaggagggagggagccgc

SEQ ID NO: 76356 - RNA, 30 nt, Human
ggccugguugaggcuggagagaacacagug

SEQ ID NO: 76357 - RNA, 22 nt, Human
cugaggcacgagaaucacuuga

SEQ ID NO: 76358 - RNA, 24 nt, Human
uguuuccuuucugaggcugccaug

SEQ ID NO: 76359 - RNA, 24 nt, Human
gcucucaucuuuuuucuuuuucca

SEQ ID NO: 76360 - RNA, 20 nt, Human
ggcacugggcucagccuggg

SEQ ID NO: 76361 - RNA, 22 nt, Human
cgccuguaaucccaacacuuug

SEQ ID NO: 76362 - RNA, 20 nt, Human
ccugcagcucccgcgucgcu

SEQ ID NO: 76363 - RNA, 23 nt, Human
uggcagcagggcccgcgggguga

SEQ ID NO: 76364 - RNA, 22 nt, Human
cgggagguggagguugcaguga

SEQ ID NO: 76365 - RNA, 21 nt, Human
ggcucagucgccaccaccuca

SEQ ID NO: 76366 - RNA, 24 nt, Human
ccagcccuugagcuccccaaaaac

SEQ ID NO: 76367 - RNA, 24 nt, Human
cccaccugaggcaggagggcaugu

SEQ ID NO: 76368 - RNA, 24 nt, Human
ugccuuaaaaaggaagaccaguga

SEQ ID NO: 76369 - RNA, 27 nt, Human
cuuggaaaucuuccauuucucuugagg

SEQ ID NO: 76370 - RNA, 22 nt, Human
cuugcuugugccugccucuuuc

SEQ ID NO: 76371 - RNA, 22 nt, Human
ccgcaaccuccaccuuccuggu

SEQ ID NO: 76372 - RNA, 16 nt, Human
gggcucccccaccucc

SEQ ID NO: 76373 - RNA, 23 nt, Human
ugggauuuacaggcaugagccac

SEQ ID NO: 76374 - RNA, 20 nt, Human
cgcccaggcgccccgcaaug

SEQ ID NO: 76375 - RNA, 22 nt, Human
gccucacaaaguguugagacua

SEQ ID NO: 76376 - RNA, 27 nt, Human
ggugggagagggagaccuagagaucug

SEQ ID NO: 76377 - RNA, 24 nt, Human
gcuuguuuguuguuuucaccagag

SEQ ID NO: 76378 - RNA, 23 nt, Human
uuacuauguaauuuacucacuua

SEQ ID NO: 76379 - RNA, 21 nt, Human
ccaccuuuccauuccaaacca

SEQ ID NO: 76380 - RNA, 21 nt, Human
cuuaaucuccucuucucucca

SEQ ID NO: 76381 - RNA, 22 nt, Human
aaagagacucauuugcugaugg

SEQ ID NO: 76382 - RNA, 21 nt, Human
gugcaagccuggcugacacag

SEQ ID NO: 76383 - RNA, 26 nt, Human
auucguagccaucuccguggccaaug

SEQ ID NO: 76384 - RNA, 20 nt, Human
gaagugaggaugagacccag

SEQ ID NO: 76385 - RNA, 20 nt, Human
ccccucugccccugccucag

SEQ ID NO: 76386 - RNA, 22 nt, Human
cugucucugucccuuuuaggcc

SEQ ID NO: 76387 - RNA, 22 nt, Human
agcugcuccaggggcugccagg

SEQ ID NO: 76388 - RNA, 27 nt, Human
ccacugcacuugccaccugagucacau

SEQ ID NO: 76389 - RNA, 27 nt, Human
cugucucucuccugcaagaaucuaccu

SEQ ID NO: 76390 - RNA, 22 nt, Human
aguaauaaaaaguaacacacca

SEQ ID NO: 76391 - RNA, 32 nt, Human
ccuguacuguucugugucuuucacagcuccuc

SEQ ID NO: 76392 - RNA, 26 nt, Human
aacuggugugucucacacaaugccuc

SEQ ID NO: 76393 - RNA, 20 nt, Human
gaccuccugccuccgccuca

SEQ ID NO: 76394 - RNA, 20 nt, Human
ucacaugcucucaggagaca

SEQ ID NO: 76395 - RNA, 21 nt, Human
gguuuuguuugcuauucugug

SEQ ID NO: 76396 - RNA, 25 nt, Human
uccccacccuccccucuccugagcc

SEQ ID NO: 76397 - RNA, 25 nt, Human
uuaaaccacaccgaggugucuaauu

SEQ ID NO: 76398 - RNA, 26 nt, Human
cuguuuacuuucagaggaagcagaga

SEQ ID NO: 76399 - RNA, 22 nt, Human
agguccuugcccuuuguggaaa

SEQ ID NO: 76400 - RNA, 22 nt, Human
agccuccugaguagcuggugcg

SEQ ID NO: 76401 - RNA, 23 nt, Human
aguaaucaucuuuccaauccaga

SEQ ID NO: 76402 - RNA, 22 nt, Human
ccugcugcugcuguauacacuu

SEQ ID NO: 76403 - RNA, 21 nt, Human
uauaagcccugaagcuaugug

SEQ ID NO: 76404 - RNA, 18 nt, Human
aaaggcagaaggcaguga

SEQ ID NO: 76405 - RNA, 23 nt, Human
gaggagggagagaaggaggccgc

SEQ ID NO: 76406 - RNA, 27 nt, Human
ucccuccagccguggccccagcgcgca

SEQ ID NO: 76407 - RNA, 22 nt, Human
auccuguuggacacccagugcc

SEQ ID NO: 76408 - RNA, 25 nt, Human
uggaaacagucaggcacugacuggg

SEQ ID NO: 76409 - RNA, 22 nt, Human
ggagucggggucucagcagaac

SEQ ID NO: 76410 - RNA, 23 nt, Human
uuccauucaaaaugugguucaca

SEQ ID NO: 76411 - RNA, 23 nt, Human
gucagcucugcaucagguguuuu

SEQ ID NO: 76412 - RNA, 25 nt, Human
cccuccuggggccaggcuuggguuu

SEQ ID NO: 76413 - RNA, 20 nt, Human
gccccaggggaucacuggcu

SEQ ID NO: 76414 - RNA, 22 nt, Human
auuucccuucuucugucaucua

SEQ ID NO: 76415 - RNA, 21 nt, Human
agaaagggaaaggcaggucug

SEQ ID NO: 76416 - RNA, 22 nt, Human
cauccagagcuggagugcagcg

SEQ ID NO: 76417 - RNA, 25 nt, Human
acaaugcggcuucccccuuucguac

SEQ ID NO: 76418 - RNA, 21 nt, Human
ggccaggccuggugccaugag

SEQ ID NO: 76419 - RNA, 26 nt, Human
gcaugaucucccgggacccucuugag

SEQ ID NO: 76420 - RNA, 23 nt, Human
cccuugccaccacacucgcccac

SEQ ID NO: 76421 - RNA, 26 nt, Human
gugcuuguaaaccaucgcgugcaaug

SEQ ID NO: 76422 - RNA, 19 nt, Human
uauuacccugauacuagac

SEQ ID NO: 76423 - RNA, 23 nt, Human
gccuguaaucccaguuacuuggg

SEQ ID NO: 76424 - RNA, 24 nt, Human
cccuuccuccuucaugccugggcc

SEQ ID NO: 76425 - RNA, 22 nt, Human
gcaaauccaagaagacccagaa

SEQ ID NO: 76426 - RNA, 23 nt, Human
ccacagccacccuacagcagccu

SEQ ID NO: 76427 - RNA, 25 nt, Human
cggcugucauuuuucaccuggucau

SEQ ID NO: 76428 - RNA, 19 nt, Human
aucucccacaguauucaug

SEQ ID NO: 76429 - RNA, 20 nt, Human
uggugagaaaacaggcucag

SEQ ID NO: 76430 - RNA, 22 nt, Human
gucuguagguugcacacuuugg

SEQ ID NO: 76431 - RNA, 19 nt, Human
cgauauguauaucauucua

SEQ ID NO: 76432 - RNA, 20 nt, Human
uuccccaucuucuucuuuca

SEQ ID NO: 76433 - RNA, 22 nt, Human
guagcccaggccagagugcagu

SEQ ID NO: 76434 - RNA, 22 nt, Human
gaacagcagagagcaguuggcu

SEQ ID NO: 76435 - RNA, 27 nt, Human
ugcuucuuacaggaacaguuacccaag

SEQ ID NO: 76436 - RNA, 24 nt, Human
agcugggacugcaggcaugagcca

SEQ ID NO: 76437 - RNA, 23 nt, Human
cccacagcaacggagucucaaca

SEQ ID NO: 76438 - RNA, 22 nt, Human
uucaauucuguaauuacauauu

SEQ ID NO: 76439 - RNA, 26 nt, Human
cacgggguuugucuguaagcugcagu

SEQ ID NO: 76440 - RNA, 26 nt, Human
ggucucugcauuuuucugcagaagag

SEQ ID NO: 76441 - RNA, 23 nt, Human
uguugccuaggcuggagugcagu

SEQ ID NO: 76442 - RNA, 19 nt, Human
cugggccucaguuuccccu

SEQ ID NO: 76443 - RNA, 20 nt, Human
gaugaaagcagggaauuucu

SEQ ID NO: 76444 - RNA, 21 nt, Human
uaugcacuguaaaugcagccu

SEQ ID NO: 76445 - RNA, 26 nt, Human
guccuuaaaaguuauaguuuucagga

SEQ ID NO: 76446 - RNA, 26 nt, Human
cuccuuucuucucugcucccaaacca

SEQ ID NO: 76447 - RNA, 26 nt, Human
cugugggacccagagggcuugaggac

SEQ ID NO: 76448 - RNA, 24 nt, Human
agguguuucuuguguuugagaacc

SEQ ID NO: 76449 - RNA, 27 nt, Human
ggagagggagggccgggaagccaggaa

SEQ ID NO: 76450 - RNA, 21 nt, Human
gcacacucauaccacauacaa

SEQ ID NO: 76451 - RNA, 23 nt, Human
uggcuggaggaugggcagagggg

SEQ ID NO: 76452 - RNA, 25 nt, Human
cuugcugucugcccugccucacccu

SEQ ID NO: 76453 - RNA, 19 nt, Human
aacucauaaucuauaaaca

SEQ ID NO: 76454 - RNA, 19 nt, Human
ucuguaaauagugauauga

SEQ ID NO: 76455 - RNA, 24 nt, Human
cugcgacggcugcugguuuugaaa

SEQ ID NO: 76456 - RNA, 19 nt, Human
gucucccaggcuggagugc

SEQ ID NO: 76457 - RNA, 26 nt, Human
cuagaaucuggagagcuagaaccugg

SEQ ID NO: 76458 - RNA, 32 nt, Human
ggccccacagccgaaagaauccuuguucagcg

SEQ ID NO: 76459 - RNA, 22 nt, Human
ucccagcccaccucaacccaga

SEQ ID NO: 76460 - RNA, 24 nt, Human
cuaaucucucucuuuuucagugaa

SEQ ID NO: 76461 - RNA, 22 nt, Human
aaccuauaggauaagauuccag

SEQ ID NO: 76462 - RNA, 21 nt, Human
ucucuguauauugggcucaga

SEQ ID NO: 76463 - RNA, 24 nt, Human
cuuaucuccccuucacaugauucc

SEQ ID NO: 76464 - RNA, 22 nt, Human
aacuucacugugcucaucaaga

SEQ ID NO: 76465 - RNA, 22 nt, Human
ccgagauggcgccauuucacuc

SEQ ID NO: 76466 - RNA, 21 nt, Human
cagaggcagagguugugguga

SEQ ID NO: 76467 - RNA, 21 nt, Human
gggaggcagagguugucauga

SEQ ID NO: 76468 - RNA, 22 nt, Human
uauaguaaguuucuauuuuaug

SEQ ID NO: 76469 - RNA, 32 nt, Human
acaggcaaugccccugcccugugggccuuaua

SEQ ID NO: 76470 - RNA, 25 nt, Human
uucuccgcuucuccccauccccuac

SEQ ID NO: 76471 - RNA, 26 nt, Human
ccagagaccuucugaucuccaaaaag

SEQ ID NO: 76472 - RNA, 25 nt, Human
ccgagaaagaaaccagucccaggga

SEQ ID NO: 76473 - RNA, 26 nt, Human
acacccagacagaggcugcagggcug

SEQ ID NO: 76474 - RNA, 19 nt, Human
cagaugaggacagagcugg

SEQ ID NO: 76475 - RNA, 21 nt, Human
agucuuggagaucccaccuuc

SEQ ID NO: 76476 - RNA, 22 nt, Human
cgcucacugcaaccucugcuuc

SEQ ID NO: 76477 - RNA, 21 nt, Human
uaauugucaccgaagccuuaa

SEQ ID NO: 76478 - RNA, 22 nt, Human
uucuucucugcugccccauggc

SEQ ID NO: 76479 - RNA, 20 nt, Human
aggcugaguccgcacaucac

SEQ ID NO: 76480 - RNA, 22 nt, Human
uaccacuucauuccagccuggg

SEQ ID NO: 76481 - RNA, 19 nt, Human
ccugccugccucccugcgc

SEQ ID NO: 76482 - RNA, 27 nt, Human
ggagagggggcaagggcaacccaccau

SEQ ID NO: 76483 - RNA, 24 nt, Human
cagagaguuugaauuuuuugcccg

SEQ ID NO: 76484 - RNA, 21 nt, Human
agagauggccugguggaaagc

SEQ ID NO: 76485 - RNA, 22 nt, Human
ugcaguauuucauauuuauaaa

SEQ ID NO: 76486 - RNA, 22 nt, Human
augccuggccauuuuccauuua

SEQ ID NO: 76487 - RNA, 21 nt, Human
ucauuaugucugauggagauu

SEQ ID NO: 76488 - RNA, 24 nt, Human
cuguugugcaggcuggagugcagu

SEQ ID NO: 76489 - RNA, 20 nt, Human
aggaagggggaguaucugug

SEQ ID NO: 76490 - RNA, 23 nt, Human
caacaaaucuucacugagcaugu

SEQ ID NO: 76491 - RNA, 22 nt, Human
gcccaggcuggagugcaauggu

SEQ ID NO: 76492 - RNA, 22 nt, Human
gcccaggcuagagugcaguggu

SEQ ID NO: 76493 - RNA, 17 nt, Human
ugaguguguuuuguaca

SEQ ID NO: 76494 - RNA, 26 nt, Human
cacaggcagauccaacugggaguuga

SEQ ID NO: 76495 - RNA, 21 nt, Human
uuucuuucuuuccgcgccgau

SEQ ID NO: 76496 - RNA, 21 nt, Human
cccaaggucagagaauggggc

SEQ ID NO: 76497 - RNA, 21 nt, Human
guuuuuaauuaauaaauccua

SEQ ID NO: 76498 - RNA, 27 nt, Human
uugcccaggagagggaccaggggugcg

SEQ ID NO: 76499 - RNA, 26 nt, Human
aaacagugauuguacagcaggcuggg

SEQ ID NO: 76500 - RNA, 23 nt, Human
accacugcccagcagccucuggg

SEQ ID NO: 76501 - RNA, 19 nt, Human
accauucauacccacacac

SEQ ID NO: 76502 - RNA, 22 nt, Human
gggccagccucugucucaggac

SEQ ID NO: 76503 - RNA, 22 nt, Human
ccaggaggcggagguuacagug

SEQ ID NO: 76504 - RNA, 26 nt, Human
ucccugcuguccccagggugggcccc

SEQ ID NO: 76505 - RNA, 23 nt, Human
gccuauccuggccagguguggug

SEQ ID NO: 76506 - RNA, 20 nt, Human
aaauguuuggauuugcaaag

SEQ ID NO: 76507 - RNA, 23 nt, Human
aggguccacauagaaaagcaaga

SEQ ID NO: 76508 - RNA, 20 nt, Human
guggccuugaacaacugguu

SEQ ID NO: 76509 - RNA, 27 nt, Human
gccuaucucccccaagcuggaggcggc

SEQ ID NO: 76510 - RNA, 22 nt, Human
agaugacagggaaaacugcaaa

SEQ ID NO: 76511 - RNA, 20 nt, Human
uaaagaagggaagcuuugua

SEQ ID NO: 76512 - RNA, 22 nt, Human
uucuaagcauccauuuuucccu

SEQ ID NO: 76513 - RNA, 22 nt, Human
cagcagcagucacuucccucca

SEQ ID NO: 76514 - RNA, 21 nt, Human
uaggaaaagaggccagcucug

SEQ ID NO: 76515 - RNA, 21 nt, Human
auauauuuucaauuguguaca

SEQ ID NO: 76516 - RNA, 27 nt, Human
uugcccaggcuggagugcaguagcacg

SEQ ID NO: 76517 - RNA, 22 nt, Human
ugggguagggaggaagagggug

SEQ ID NO: 76518 - RNA, 21 nt, Human
ucagaagugaaaaucuuggag

SEQ ID NO: 76519 - RNA, 24 nt, Human
aacuuccagcccugucugcugucu

SEQ ID NO: 76520 - RNA, 26 nt, Human
caaaaagucuuuggggucuacacugc

SEQ ID NO: 76521 - RNA, 20 nt, Human
ugugggggccgaugggcagg

SEQ ID NO: 76522 - RNA, 20 nt, Human
uaggaggucaucaaccgaug

SEQ ID NO: 76523 - RNA, 24 nt, Human
ugcuccacuuucagccaggcugga

SEQ ID NO: 76524 - RNA, 32 nt, Human
cgucucaggcaggacugggcaccaagcuugca

SEQ ID NO: 76525 - RNA, 28 nt, Human
auacauauauacauuuugcagcuaugga

SEQ ID NO: 76526 - RNA, 18 nt, Human
ccugccaaggcucuuguc

SEQ ID NO: 76527 - RNA, 20 nt, Human
cccauucuggcgacacuugg

SEQ ID NO: 76528 - RNA, 15 nt, Human
ggacucucugcucca

SEQ ID NO: 76529 - RNA, 24 nt, Human
aagguaggaacaagaugagcuuga

SEQ ID NO: 76530 - RNA, 21 nt, Human
accaauucuagcacccacuga

SEQ ID NO: 76531 - RNA, 21 nt, Human
cuaaucaaauccaauggggga

SEQ ID NO: 76532 - RNA, 25 nt, Human
ggucccuugcgccugcgcucuugca

SEQ ID NO: 76533 - RNA, 27 nt, Human
ugggaaucggagguugcagggccaaga

SEQ ID NO: 76534 - RNA, 22 nt, Human
ugucaccuaggcuggagugcag

SEQ ID NO: 76535 - RNA, 27 nt, Human
augucuggagaaauguguguagugcuu

SEQ ID NO: 76536 - RNA, 32 nt, Human
ggguguagggauuuuaaaaaguuacuuaggca

SEQ ID NO: 76537 - RNA, 19 nt, Human
uuggaagcagggugaucgc

SEQ ID NO: 76538 - RNA, 21 nt, Human
caaaugaugugggaauuugug

SEQ ID NO: 76539 - RNA, 21 nt, Human
ggacgugcugcagaugcugaa

SEQ ID NO: 76540 - RNA, 23 nt, Human
gugucuugccagcaacauuccug

SEQ ID NO: 76541 - RNA, 23 nt, Human
aucaugacacugcacuccagccu

SEQ ID NO: 76542 - RNA, 21 nt, Human
gcccaggcugggcgcccaugc

SEQ ID NO: 76543 - RNA, 19 nt, Human
agagggccagaguggguag

SEQ ID NO: 76544 - RNA, 22 nt, Human
aaaguguugggauuacaggcgu

SEQ ID NO: 76545 - RNA, 26 nt, Human
uuugguuccugcuccauggucgggcc

SEQ ID NO: 76546 - RNA, 17 nt, Human
ugccggguuccagggac

SEQ ID NO: 76547 - RNA, 27 nt, Human
ggugaaugacacgccuaaggucacagc

SEQ ID NO: 76548 - RNA, 23 nt, Human
ccucucagcccccaccucagguu

SEQ ID NO: 76549 - RNA, 19 nt, Human
aacuguccucuuucuuggg

SEQ ID NO: 76550 - RNA, 22 nt, Human
ccgguuuagaaaccccagagac

SEQ ID NO: 76551 - RNA, 20 nt, Human
ucucaggaugaaucagucua

SEQ ID NO: 76552 - RNA, 22 nt, Human
ccaacccagcuccugcugcugu

SEQ ID NO: 76553 - RNA, 22 nt, Human
ugccuauaaucccagcacuuuu

SEQ ID NO: 76554 - RNA, 23 nt, Human
cacuugcuggacagucugagcca

SEQ ID NO: 76555 - RNA, 23 nt, Human
aaagaacccaguuccagcaggga

SEQ ID NO: 76556 - RNA, 20 nt, Human
uccccagcagggucuuuuca

SEQ ID NO: 76557 - RNA, 21 nt, Human
uguuauuaauguuauuuucag

SEQ ID NO: 76558 - RNA, 27 nt, Human
ugcugcucacugagaacccagcuuuga

SEQ ID NO: 76559 - RNA, 27 nt, Human
ggccagccuggcaucaguuuaggccuu

SEQ ID NO: 76560 - RNA, 23 nt, Human
cagccccuauccuccauucuuga

SEQ ID NO: 76561 - RNA, 17 nt, Human
acugaaaaaaugcuuua

SEQ ID NO: 76562 - RNA, 22 nt, Human
guuuuaggacaaacagcucagu

SEQ ID NO: 76563 - RNA, 27 nt, Human
agcuccuaaagaccucuuguacuuggu

SEQ ID NO: 76564 - RNA, 22 nt, Human
aaccucuaaccuccugaccuca

SEQ ID NO: 76565 - RNA, 22 nt, Human
gggaggggaagagagaggccug

SEQ ID NO: 76566 - RNA, 27 nt, Human
caggcucaggguuucaugacuuguuga

SEQ ID NO: 76567 - RNA, 27 nt, Human
gccucaaauccugacccaagggccagc

SEQ ID NO: 76568 - RNA, 22 nt, Human
ucaaucaggaauagauuugcca

SEQ ID NO: 76569 - RNA, 21 nt, Human
acucauuuaacuaaaguuaac

SEQ ID NO: 76570 - RNA, 27 nt, Human
gagggcccagagagucuguaaaguggc

SEQ ID NO: 76571 - RNA, 21 nt, Human
uucuagcaaccuuuguuagga

SEQ ID NO: 76572 - RNA, 21 nt, Human
ccgccgcgcccccuugcuggc

SEQ ID NO: 76573 - RNA, 22 nt, Human
gguuagccccuugcugccugcu

SEQ ID NO: 76574 - RNA, 23 nt, Human
gcacacaucaacccacagaccuu

SEQ ID NO: 76575 - RNA, 26 nt, Human
ccugccccuuucugcagccuaggcgg

SEQ ID NO: 76576 - RNA, 21 nt, Human
cuguguuuuugugaaaggccu

SEQ ID NO: 76577 - RNA, 20 nt, Human
uggaacuagaauuauuauua

SEQ ID NO: 76578 - RNA, 22 nt, Human
agagggagacaauucuagucac

SEQ ID NO: 76579 - RNA, 22 nt, Human
guggcucagagauaggacccug

SEQ ID NO: 76580 - RNA, 21 nt, Human
ugcuccagcugucgucugacu

SEQ ID NO: 76581 - RNA, 23 nt, Human
ggcuagcugugcugguauuggaa

SEQ ID NO: 76582 - RNA, 27 nt, Human
gggacaccccuacacacacccaggccc

SEQ ID NO: 76583 - RNA, 27 nt, Human
gaccagccuggucaauauagcaagacc

SEQ ID NO: 76584 - RNA, 20 nt, Human
cccucccagccuccuccucc

SEQ ID NO: 76585 - RNA, 29 nt, Human
gaguccccugggagagagcccagcaccca

SEQ ID NO: 76586 - RNA, 19 nt, Human
cagcuguagucuucuugaa

SEQ ID NO: 76587 - RNA, 23 nt, Human
cagcgaugccccucugucacuca

SEQ ID NO: 76588 - RNA, 20 nt, Human
ucuugcucucccuugaagcc

SEQ ID NO: 76589 - RNA, 22 nt, Human
ggagagggugggguggagcagc

SEQ ID NO: 76590 - RNA, 22 nt, Human
uucccucccuucuguccuucca

SEQ ID NO: 76591 - RNA, 28 nt, Human
ccagcuccacuccagccuggcguccagg

SEQ ID NO: 76592 - RNA, 19 nt, Human
agcaggaagcucugugaug

SEQ ID NO: 76593 - RNA, 30 nt, Human
ucagccccuagcuggcaucuugcucaccgc

SEQ ID NO: 76594 - RNA, 27 nt, Human
ucugcccaggcccuuguucccggcagu

SEQ ID NO: 76595 - RNA, 26 nt, Human
gcagcucuugggaaggacuugcuggg

SEQ ID NO: 76596 - RNA, 22 nt, Human
cccagggccaggucacaggguu

SEQ ID NO: 76597 - RNA, 22 nt, Human
ugccuuaucuaaaucaccagag

SEQ ID NO: 76598 - RNA, 22 nt, Human
ccuuccuggucccucugugcuu

SEQ ID NO: 76599 - RNA, 20 nt, Human
ugucucaaacucuaaggucg

SEQ ID NO: 76600 - RNA, 21 nt, Human
ucaaacacuauaaaaugagua

SEQ ID NO: 76601 - RNA, 23 nt, Human
gggcucgagccaucucugcuccc

SEQ ID NO: 76602 - RNA, 26 nt, Human
guaacauguaguuuacacugaauugc

SEQ ID NO: 76603 - RNA, 20 nt, Human
ucucuacaacccucucuccu

SEQ ID NO: 76604 - RNA, 27 nt, Human
cuggggagggggaccgggggguggggu

SEQ ID NO: 76605 - RNA, 21 nt, Human
agccagcuaacagcaugaucu

SEQ ID NO: 76606 - RNA, 24 nt, Human
ccacaaguuuugaucagcaaauaa

SEQ ID NO: 76607 - RNA, 20 nt, Human
ccauuuuuaaccacuugccu

SEQ ID NO: 76608 - RNA, 21 nt, Human
gaagccccaggccgcaggggg

SEQ ID NO: 76609 - RNA, 21 nt, Human
ccugccacuacauucugguuu

SEQ ID NO: 76610 - RNA, 19 nt, Human
cacccucugggcagcuguc

SEQ ID NO: 76611 - RNA, 18 nt, Human
ggcaguggcuuuccugag

SEQ ID NO: 76612 - RNA, 27 nt, Human
accacgcaccuccacgccacugccucc

SEQ ID NO: 76613 - RNA, 24 nt, Human
cccugcucuucagcaccaugggcc

SEQ ID NO: 76614 - RNA, 20 nt, Human
ucccauucgggagaucaugu

SEQ ID NO: 76615 - RNA, 23 nt, Human
agucaucucaagaacaaaagaca

SEQ ID NO: 76616 - RNA, 25 nt, Human
ggccacaacaacgacacccaccuca

SEQ ID NO: 76617 - RNA, 22 nt, Human
ccaacacagugaaaccccaucu

SEQ ID NO: 76618 - RNA, 26 nt, Human
guuguuguuuuccacugagaaagcua

SEQ ID NO: 76619 - RNA, 23 nt, Human
ggguguggugaguagaggugugu

SEQ ID NO: 76620 - RNA, 22 nt, Human
ugaaguccuuuccuaaaaaaga

SEQ ID NO: 76621 - RNA, 22 nt, Human
aggcagcagcaggcugaaggga

SEQ ID NO: 76622 - RNA, 22 nt, Human
ggggagcgcggggcgucccggg

SEQ ID NO: 76623 - RNA, 22 nt, Human
agcaggagcgcgugcaagccgg

SEQ ID NO: 76624 - RNA, 19 nt, Human
uggaggugggguuuauugg

SEQ ID NO: 76625 - RNA, 19 nt, Human
ccuggcagaggaacaagga

SEQ ID NO: 76626 - RNA, 22 nt, Human
agggcugccuccugacagcucc

SEQ ID NO: 76627 - RNA, 21 nt, Human
ugccuguaaaguaguauuuuu

SEQ ID NO: 76628 - RNA, 21 nt, Human
gagagggacggcucacgaggc

SEQ ID NO: 76629 - RNA, 20 nt, Human
ugaauguguucugucacuca

SEQ ID NO: 76630 - RNA, 23 nt, Human
cgggugugggcuggagaggcaga

SEQ ID NO: 76631 - RNA, 22 nt, Human
ugccuuuccccacccucaccga

SEQ ID NO: 76632 - RNA, 27 nt, Human
cuuuguuaccaacacuguuauauuucu

SEQ ID NO: 76633 - RNA, 20 nt, Human
ccagacugagaaacccagaa

SEQ ID NO: 76634 - RNA, 21 nt, Human
agggggagugggcugaaggga

SEQ ID NO: 76635 - RNA, 25 nt, Human
cuugcucccccuuguucggaagcug

SEQ ID NO: 76636 - RNA, 18 nt, Human
ggaggucgaggcugcagu

SEQ ID NO: 76637 - RNA, 24 nt, Human
gcccucauuacggcuccucucuaa

SEQ ID NO: 76638 - RNA, 23 nt, Human
cgaguagcugggauuagaggcgu

SEQ ID NO: 76639 - RNA, 21 nt, Human
caugcacacaaugugaaacag

SEQ ID NO: 76640 - RNA, 27 nt, Human
ccucacugccccacugugcuccugggc

SEQ ID NO: 76641 - RNA, 21 nt, Human
aggcucucacugggcgcugua

SEQ ID NO: 76642 - RNA, 24 nt, Human
ggagauagaucauuguucucucca

SEQ ID NO: 76643 - RNA, 25 nt, Human
gcuugauucucagcacuugggggau

SEQ ID NO: 76644 - RNA, 22 nt, Human
ugcagugagccgaggucaugcc

SEQ ID NO: 76645 - RNA, 21 nt, Human
uacagccugggcaauaaagug

SEQ ID NO: 76646 - RNA, 23 nt, Human
ucugguuuucaagcagugcuuua

SEQ ID NO: 76647 - RNA, 21 nt, Human
uuucucucauuuacuccuuaa

SEQ ID NO: 76648 - RNA, 22 nt, Human
ugaggggaugugggggccccaa

SEQ ID NO: 76649 - RNA, 21 nt, Human
caguccagcaagggccaaaga

SEQ ID NO: 76650 - RNA, 22 nt, Human
uucccucacuuccauccaucuc

SEQ ID NO: 76651 - RNA, 22 nt, Human
gcuguccuggccugugcccaau

SEQ ID NO: 76652 - RNA, 27 nt, Human
auagacaucugcccugacugaaugugu

SEQ ID NO: 76653 - RNA, 22 nt, Human
ugucagacaggcugggggccuc

SEQ ID NO: 76654 - RNA, 26 nt, Human
cauaaaccacauccagccaccuccuu

SEQ ID NO: 76655 - RNA, 24 nt, Human
agccugccuccccugccucaccag

SEQ ID NO: 76656 - RNA, 22 nt, Human
ccaugagcaccccaaggcugcg

SEQ ID NO: 76657 - RNA, 22 nt, Human
acagaacguugccuuguuuucc

SEQ ID NO: 76658 - RNA, 24 nt, Human
gcuaugggucccugaggccuggcu

SEQ ID NO: 76659 - RNA, 27 nt, Human
cugauguuuuagcauuuuuccaacaca

SEQ ID NO: 76660 - RNA, 26 nt, Human
ugagaaaauauuaauacagauuaaaa

SEQ ID NO: 76661 - RNA, 20 nt, Human
uguguggaggggaagcaaga

SEQ ID NO: 76662 - RNA, 21 nt, Human
uuguagacuuucauagccaaa

SEQ ID NO: 76663 - RNA, 22 nt, Human
cagugcuuuccagccuuuggug

SEQ ID NO: 76664 - RNA, 21 nt, Human
uauuuaugggagugggaggga

SEQ ID NO: 76665 - RNA, 25 nt, Human
gauguugagaauguucaucucucca

SEQ ID NO: 76666 - RNA, 23 nt, Human
gcuagcuggccagguggggaggg

SEQ ID NO: 76667 - RNA, 22 nt, Human
gggacaugguggacagucaccu

SEQ ID NO: 76668 - RNA, 23 nt, Human
uggccuacaugguugaaacccca

SEQ ID NO: 76669 - RNA, 24 nt, Human
cuccaccuugcagaaagaaucuag

SEQ ID NO: 76670 - RNA, 22 nt, Human
aaugaugcuuauuucuuugcca

SEQ ID NO: 76671 - RNA, 23 nt, Human
ggcaaaguaacugagaguuuggu

SEQ ID NO: 76672 - RNA, 22 nt, Human
cccaccccagccagggcucccu

SEQ ID NO: 76673 - RNA, 21 nt, Human
uucuuugaagaagguggaccu

SEQ ID NO: 76674 - RNA, 27 nt, Human
cugagucauuuauuuuccuuagcuuuu

SEQ ID NO: 76675 - RNA, 21 nt, Human
gccagcaagagggaacaaaac

SEQ ID NO: 76676 - RNA, 22 nt, Human
ccugcugacagucacccucccu

SEQ ID NO: 76677 - RNA, 25 nt, Human
ggcuggggaagaggacugugugaga

SEQ ID NO: 76678 - RNA, 21 nt, Human
uugcccagguagugaucagug

SEQ ID NO: 76679 - RNA, 18 nt, Human
agccccaucugugcauuc

SEQ ID NO: 76680 - RNA, 21 nt, Human
gccacugcacuccagcuuggg

SEQ ID NO: 76681 - RNA, 21 nt, Human
uguccuucaucguccaggggc

SEQ ID NO: 76682 - RNA, 26 nt, Human
aagccuuuugcuccagcccugcggcu

SEQ ID NO: 76683 - RNA, 25 nt, Human
cagcaagccccucaggccagcacuu

SEQ ID NO: 76684 - RNA, 20 nt, Human
acuccuccuccuuucuuugc

SEQ ID NO: 76685 - RNA, 22 nt, Human
ccagacugacucugcaccuggc

SEQ ID NO: 76686 - RNA, 21 nt, Human
aaccaucagauuucaguagua

SEQ ID NO: 76687 - RNA, 27 nt, Human
accagccugaccgacauggagaaaccu

SEQ ID NO: 76688 - RNA, 25 nt, Human
acaguguuaccaagaaauuuuguaa

SEQ ID NO: 76689 - RNA, 22 nt, Human
aacaugauaucaucacacuucu

SEQ ID NO: 76690 - RNA, 22 nt, Human
uaacccaggcuggaaugcaaug

SEQ ID NO: 76691 - RNA, 23 nt, Human
uucucagaaauaaagaucuuuug

SEQ ID NO: 76692 - RNA, 25 nt, Human
cucgcucuugacagaugucugggaa

SEQ ID NO: 76693 - RNA, 22 nt, Human
auugcuugagcccaggaauuug

SEQ ID NO: 76694 - RNA, 23 nt, Human
gcgucacuucucagacacugaag

SEQ ID NO: 76695 - RNA, 22 nt, Human
ggcgacugccaccacacccagc

SEQ ID NO: 76696 - RNA, 21 nt, Human
gccaauuagcucaugguccug

SEQ ID NO: 76697 - RNA, 25 nt, Human
acuggaacuugguaacuacaagggc

SEQ ID NO: 76698 - RNA, 21 nt, Human
ucuggccugugcaccucucuc

SEQ ID NO: 76699 - RNA, 27 nt, Human
ccucggcuccagaagcuggggcucagg

SEQ ID NO: 76700 - RNA, 21 nt, Human
ggagcccagagacaggggaag

SEQ ID NO: 76701 - RNA, 21 nt, Human
aaggugcuggauuacaggugu

SEQ ID NO: 76702 - RNA, 22 nt, Human
cacgaggucaggaaaucgagac

SEQ ID NO: 76703 - RNA, 28 nt, Human
gugcucggcagucauacuggggugcgag

SEQ ID NO: 76704 - RNA, 21 nt, Human
uccaugucccuacaaaggaua

SEQ ID NO: 76705 - RNA, 26 nt, Human
caugccacuuccugccagauagaggg

SEQ ID NO: 76706 - RNA, 22 nt, Human
accaggaugugugcccagccag

SEQ ID NO: 76707 - RNA, 20 nt, Human
cuggugccaccacuggccag

SEQ ID NO: 76708 - RNA, 22 nt, Human
gcccaggccagagugcaguggc

SEQ ID NO: 76709 - RNA, 27 nt, Human
cccugaccucugcugcaguggccgccc

SEQ ID NO: 76710 - RNA, 20 nt, Human
cuguguccuaagcccuuuca

SEQ ID NO: 76711 - RNA, 28 nt, Human
ucccaucguguagucaagagucugugcc

SEQ ID NO: 76712 - RNA, 18 nt, Human
ucagcacuuuuugguggg

SEQ ID NO: 76713 - RNA, 21 nt, Human
ucuaggggaauacucagucug

SEQ ID NO: 76714 - RNA, 27 nt, Human
ucuucauuccuacaaaggacgaacuug

SEQ ID NO: 76715 - RNA, 21 nt, Human
auggagcuauuauggcugguc

SEQ ID NO: 76716 - RNA, 27 nt, Human
ccccugccccggcuccccgccaaagca

SEQ ID NO: 76717 - RNA, 20 nt, Human
uacaaauguuuucaggcuuc

SEQ ID NO: 76718 - RNA, 20 nt, Human
uccucaagcaacacuccuag

SEQ ID NO: 76719 - RNA, 21 nt, Human
cgucugcugaugugcccagcc

SEQ ID NO: 76720 - RNA, 21 nt, Human
cugucugaccccgaggagcuc

SEQ ID NO: 76721 - RNA, 20 nt, Human
ggaggguuaaggcucaggga

SEQ ID NO: 76722 - RNA, 25 nt, Human
uccuuucuccagcuucugcucugcc

SEQ ID NO: 76723 - RNA, 25 nt, Human
ccugggggacccaucuuccaccuca

SEQ ID NO: 76724 - RNA, 25 nt, Human
ugaggaggcaguauggcugugcagg

SEQ ID NO: 76725 - RNA, 19 nt, Human
agccaggugugguggcaca

SEQ ID NO: 76726 - RNA, 24 nt, Human
aguaauacucauuccuugugugug

SEQ ID NO: 76727 - RNA, 26 nt, Human
uucuguugugauuccuaggacuuuuc

SEQ ID NO: 76728 - RNA, 22 nt, Human
ucagcauucauuuuaagaaaag

SEQ ID NO: 76729 - RNA, 24 nt, Human
cuguugccuaggcuggagugcagu

SEQ ID NO: 76730 - RNA, 19 nt, Human
aagccuuugcgaagcuaau

SEQ ID NO: 76731 - RNA, 22 nt, Human
ugcuggcacggggaugugcccu

SEQ ID NO: 76732 - RNA, 21 nt, Human
uucauuuagagaaacagcugc

SEQ ID NO: 76733 - RNA, 19 nt, Human
ccgcugcucggccugcugu

SEQ ID NO: 76734 - RNA, 22 nt, Human
aaggugcugggauugcagacgu

SEQ ID NO: 76735 - RNA, 20 nt, Human
uauuucuuggacauucccuu

SEQ ID NO: 76736 - RNA, 20 nt, Human
accucaguccccucacggag

SEQ ID NO: 76737 - RNA, 19 nt, Human
uggcaacaggacagaguuc

SEQ ID NO: 76738 - RNA, 23 nt, Human
ucaugcauucuuuucuguuugcc

SEQ ID NO: 76739 - RNA, 25 nt, Human
cacagacuaggucuuguggcugguc

SEQ ID NO: 76740 - RNA, 25 nt, Human
uccccaaauccuacucccucagccu

SEQ ID NO: 76741 - RNA, 21 nt, Human
ugguuccuagauguguucuaa

SEQ ID NO: 76742 - RNA, 26 nt, Human
acuauuaugaucuguccacagugccc

SEQ ID NO: 76743 - RNA, 23 nt, Human
ugaggcugagaugagaaugcgga

SEQ ID NO: 76744 - RNA, 22 nt, Human
ggagagugagaggaccaagucc

SEQ ID NO: 76745 - RNA, 21 nt, Human
aggccuugcugacaacuugca

SEQ ID NO: 76746 - RNA, 21 nt, Human
gggauuacaggcgcgagcacc

SEQ ID NO: 76747 - RNA, 23 nt, Human
uccuggagaagaggagauuuucu

SEQ ID NO: 76748 - RNA, 24 nt, Human
ugcacuacuccucugcagugccuu

SEQ ID NO: 76749 - RNA, 28 nt, Human
ggggcaggcucuggcacagugccuggga

SEQ ID NO: 76750 - RNA, 23 nt, Human
aggccaagaaggucagagcccag

SEQ ID NO: 76751 - RNA, 26 nt, Human
gaucuguauuggauaaggaccaauga

SEQ ID NO: 76752 - RNA, 20 nt, Human
ugcuucuccccugggcugcu

SEQ ID NO: 76753 - RNA, 20 nt, Human
agcauauuuaaucaaagcaa

SEQ ID NO: 76754 - RNA, 21 nt, Human
ugugcagugcuaagugucaca

SEQ ID NO: 76755 - RNA, 23 nt, Human
gucacccagacuagaggucagug

SEQ ID NO: 76756 - RNA, 20 nt, Human
gccucucuuuuauuguaaug

SEQ ID NO: 76757 - RNA, 22 nt, Human
gugagucugauauggaagggaa

SEQ ID NO: 76758 - RNA, 19 nt, Human
auggcagaugaucagggcu

SEQ ID NO: 76759 - RNA, 24 nt, Human
gugugcaugguggugugacaugag

SEQ ID NO: 76760 - RNA, 26 nt, Human
accaugucgcuggcagcuggugcugg

SEQ ID NO: 76761 - RNA, 24 nt, Human
ugucacccgagcuggagugcagug

SEQ ID NO: 76762 - RNA, 31 nt, Human
augcuuucaugcacccuuuacugcacuuucu

SEQ ID NO: 76763 - RNA, 27 nt, Human
ugaguggaggcaggagccacggguggg

SEQ ID NO: 76764 - RNA, 22 nt, Human
acugcaguuuagcagugaccuc

SEQ ID NO: 76765 - RNA, 27 nt, Human
ggagaggggaagcagaucugaggacau

SEQ ID NO: 76766 - RNA, 22 nt, Human
ccaggaggcgaagauugcagug

SEQ ID NO: 76767 - RNA, 27 nt, Human
ccaggagguggcuggauugcagggcug

SEQ ID NO: 76768 - RNA, 21 nt, Human
agggcccugagcugagggcau

SEQ ID NO: 76769 - RNA, 22 nt, Human
aaccuggcuccuucuucacuac

SEQ ID NO: 76770 - RNA, 25 nt, Human
guggggaggacaggagugaauguuc

SEQ ID NO: 76771 - RNA, 29 nt, Human
ucuguacuccccucauccuccuaauguug

SEQ ID NO: 76772 - RNA, 25 nt, Human
uccaucaucuuccgcgcaggugcca

SEQ ID NO: 76773 - RNA, 27 nt, Human
ugucgcucaggcuggagugccauggcg

SEQ ID NO: 76774 - RNA, 23 nt, Human
aguacucaguuaggcagugcagu

SEQ ID NO: 76775 - RNA, 22 nt, Human
ggugaagcccggcgggguugcc

SEQ ID NO: 76776 - RNA, 25 nt, Human
acagaaguaacuuugguuaauuauu

SEQ ID NO: 76777 - RNA, 21 nt, Human
ccucuuggugcuucaguuucc

SEQ ID NO: 76778 - RNA, 20 nt, Human
agagaggcuccaggggcuag

SEQ ID NO: 76779 - RNA, 21 nt, Human
ggcuuacugcaaccuccaccu

SEQ ID NO: 76780 - RNA, 21 nt, Human
ccaucugcuuuucccauugcc

SEQ ID NO: 76781 - RNA, 21 nt, Human
auccuccuccucugccuucaa

SEQ ID NO: 76782 - RNA, 22 nt, Human
ccagaaaauguuucccagaaaa

SEQ ID NO: 76783 - RNA, 21 nt, Human
ccaaucccugcaguuuugugg

SEQ ID NO: 76784 - RNA, 22 nt, Human
gucauccaggcuggagugcagu

SEQ ID NO: 76785 - RNA, 27 nt, Human
agcucacugcaagcuccaacucccggg

SEQ ID NO: 76786 - RNA, 22 nt, Human
cauggguggaaugauggcagaa

SEQ ID NO: 76787 - RNA, 23 nt, Human
ccggaggaccgggaucucugugg

SEQ ID NO: 76788 - RNA, 21 nt, Human
gccauugcacuccagccuagg

SEQ ID NO: 76789 - RNA, 27 nt, Human
ugucuggucuccgagcuucggcugcag

SEQ ID NO: 76790 - RNA, 24 nt, Human
uuucaauucucaaaagaaaaggca

SEQ ID NO: 76791 - RNA, 21 nt, Human
agugacaacaggaccaaccug

SEQ ID NO: 76792 - RNA, 23 nt, Human
aaggcuggacuggguuggcugca

SEQ ID NO: 76793 - RNA, 26 nt, Human
ucagcccagccuaggaaagaggcagc

SEQ ID NO: 76794 - RNA, 21 nt, Human
guaaggggguacagugcaguu

SEQ ID NO: 76795 - RNA, 22 nt, Human
uuugccuccacgagccugcugu

SEQ ID NO: 76796 - RNA, 22 nt, Human
caaacuuuuacguaacaucuca

SEQ ID NO: 76797 - RNA, 26 nt, Human
cuuugucucugcuggcuucuuuuucc

SEQ ID NO: 76798 - RNA, 26 nt, Human
guagagguggggacaggggcaggggc

SEQ ID NO: 76799 - RNA, 18 nt, Human
aaacaaggcagacuugca

SEQ ID NO: 76800 - RNA, 24 nt, Human
ugugggccuugcaagaugggagag

SEQ ID NO: 76801 - RNA, 27 nt, Human
ucuguucuggucaucuggaugcugguc

SEQ ID NO: 76802 - RNA, 23 nt, Human
gaggugaggacacagcaggccca

SEQ ID NO: 76803 - RNA, 26 nt, Human
caagccccagccccgaggaccgucca

SEQ ID NO: 76804 - RNA, 19 nt, Human
cucccucuccccucaugcu

SEQ ID NO: 76805 - RNA, 23 nt, Human
uaucuaaucuaaugagaaacuca

SEQ ID NO: 76806 - RNA, 24 nt, Human
ggaaccucaucucccugggucggg

SEQ ID NO: 76807 - RNA, 22 nt, Human
gauuacaggcgugagucaccgc

SEQ ID NO: 76808 - RNA, 26 nt, Human
gucuguaaucucagaggcuuguuugc

SEQ ID NO: 76809 - RNA, 22 nt, Human
ucaucuuuccucuccucccucu

SEQ ID NO: 76810 - RNA, 25 nt, Human
cccaggaggccugcagccuggagcc

SEQ ID NO: 76811 - RNA, 19 nt, Human
ggcuuuuugcaagcauuua

SEQ ID NO: 76812 - RNA, 25 nt, Human
uuugcuaucuuaauuuugguuguau

SEQ ID NO: 76813 - RNA, 21 nt, Human
ucucccacccucuuccuacug

SEQ ID NO: 76814 - RNA, 25 nt, Human
ugcgugggucaguucuuucugagua

SEQ ID NO: 76815 - RNA, 27 nt, Human
ccccugagcccagaucugcccccacca

SEQ ID NO: 76816 - RNA, 22 nt, Human
aagcauuucucugugaaaaugu

SEQ ID NO: 76817 - RNA, 25 nt, Human
uugagcugacauauacugggugggg

SEQ ID NO: 76818 - RNA, 26 nt, Human
acaucaacauggcaauugcacucaug

SEQ ID NO: 76819 - RNA, 23 nt, Human
cucgugcaggaaguacucaucga

SEQ ID NO: 76820 - RNA, 22 nt, Human
auacauacauacauauauaucu

SEQ ID NO: 76821 - RNA, 23 nt, Human
uaaagccacaagaaucaaugaug

SEQ ID NO: 76822 - RNA, 24 nt, Human
agagagaagcgcccuggucucuug

SEQ ID NO: 76823 - RNA, 20 nt, Human
uaaaaaauauuuuaggauaa

SEQ ID NO: 76824 - RNA, 24 nt, Human
ggcagagaaaagcaggagaggagc

SEQ ID NO: 76825 - RNA, 24 nt, Human
gggguggaagagaaaugagcuugg

SEQ ID NO: 76826 - RNA, 24 nt, Human
ucauccugaacgugaccagugggg

SEQ ID NO: 76827 - RNA, 21 nt, Human
cucuccuccccuguacgugcc

SEQ ID NO: 76828 - RNA, 22 nt, Human
cuuagaaauugcauuuccugac

SEQ ID NO: 76829 - RNA, 27 nt, Human
cuggcauggugaggcuuuucaaguacc

SEQ ID NO: 76830 - RNA, 24 nt, Human
ggcccgcugccgccacccaccucu

SEQ ID NO: 76831 - RNA, 28 nt, Human
cuaccugagagaaugagcaccccucauc

SEQ ID NO: 76832 - RNA, 26 nt, Human
gcagaggcugaggcacggggagccag

SEQ ID NO: 76833 - RNA, 22 nt, Human
cccagcacauaaugaauaaaua

SEQ ID NO: 76834 - RNA, 27 nt, Human
gggaggcaccccacagacucagcgccg

SEQ ID NO: 76835 - RNA, 22 nt, Human
ugccuguagucccggcacuuug

SEQ ID NO: 76836 - RNA, 22 nt, Human
ugccuauagucccagcacuuug

SEQ ID NO: 76837 - RNA, 26 nt, Human
aggaagggaagggaacauccacaucu

SEQ ID NO: 76838 - RNA, 23 nt, Human
gagaugagcccacccugcugaga

SEQ ID NO: 76839 - RNA, 19 nt, Human
uucuccucuuguuucugcc

SEQ ID NO: 76840 - RNA, 24 nt, Human
auccaguaucuccuucuggagcac

SEQ ID NO: 76841 - RNA, 22 nt, Human
uugauguuaugcaaacaucuug

SEQ ID NO: 76842 - RNA, 22 nt, Human
gcacuguuuucucuuucaguua

SEQ ID NO: 76843 - RNA, 21 nt, Human
gccucugcuccuccuggagcc

SEQ ID NO: 76844 - RNA, 21 nt, Human
ugcagccugggcgacagagcg

SEQ ID NO: 76845 - RNA, 22 nt, Human
uggcaugugcuuguaaucccag

SEQ ID NO: 76846 - RNA, 27 nt, Human
uggaaacaguggggaacuacugcugga

SEQ ID NO: 76847 - RNA, 22 nt, Human
ucucaaagcugggauuacaggu

SEQ ID NO: 76848 - RNA, 25 nt, Human
ggcuuccagguggcccuucccggca

SEQ ID NO: 76849 - RNA, 22 nt, Human
cagaaggcuacgcagggcugag

SEQ ID NO: 76850 - RNA, 27 nt, Human
uacccuuuaacaucugugacuacuaag

SEQ ID NO: 76851 - RNA, 26 nt, Human
ugagauaccuggcauuuugggaagug

SEQ ID NO: 76852 - RNA, 24 nt, Human
ggagagggugaagcagguaucaga

SEQ ID NO: 76853 - RNA, 22 nt, Human
gugugauuugugcuccauuuuu

SEQ ID NO: 76854 - RNA, 20 nt, Human
gagaggaagacucacuuugg

SEQ ID NO: 76855 - RNA, 22 nt, Human
ggagagggaggggcuguguagc

SEQ ID NO: 76856 - RNA, 25 nt, Human
gucuccuugguggguggcaggauuu

SEQ ID NO: 76857 - RNA, 24 nt, Human
agcaguaagcaguuuucaucugac

SEQ ID NO: 76858 - RNA, 32 nt, Human
uggguuaaauauuuugcuaacugguuaaacau

SEQ ID NO: 76859 - RNA, 22 nt, Human
uggccaacauggcaaaacccca

SEQ ID NO: 76860 - RNA, 19 nt, Human
uggggaggggagggggcgc

SEQ ID NO: 76861 - RNA, 22 nt, Human
caggaauauguauuaagauugu

SEQ ID NO: 76862 - RNA, 25 nt, Human
ggggguauuuaaaaaggacugaaca

SEQ ID NO: 76863 - RNA, 23 nt, Human
ugcccccaaaauaugcagaccuu

SEQ ID NO: 76864 - RNA, 20 nt, Human
cucuuccggucgcgggacac

SEQ ID NO: 76865 - RNA, 23 nt, Human
gcccagaccucaggugcuaggga

SEQ ID NO: 76866 - RNA, 21 nt, Human
cugucguagaaggaaguuuau

SEQ ID NO: 76867 - RNA, 31 nt, Human
gcucacgucugcugcaaccugaagcuugcau

SEQ ID NO: 76868 - RNA, 22 nt, Human
uaggcuggagugcagugaggca

SEQ ID NO: 76869 - RNA, 25 nt, Human
aucccuggcucaggguuauugccag

SEQ ID NO: 76870 - RNA, 24 nt, Human
aaauguucauguucauauguacuu

SEQ ID NO: 76871 - RNA, 20 nt, Human
uagcuacuaagauuacuugg

SEQ ID NO: 76872 - RNA, 19 nt, Human
cuguucuggcuuuuuaucu

SEQ ID NO: 76873 - RNA, 24 nt, Human
uccgggggcuggccagucagagaa

SEQ ID NO: 76874 - RNA, 23 nt, Human
aggacuagaaucguguccuauuu

SEQ ID NO: 76875 - RNA, 19 nt, Human
auccaagguucuguauuua

SEQ ID NO: 76876 - RNA, 25 nt, Human
ugaggguggguggguggacccaggc

SEQ ID NO: 76877 - RNA, 28 nt, Human
gggcagggaugauggcagagccaggcug

SEQ ID NO: 76878 - RNA, 22 nt, Human
gggagagaagaccuugggccaa

SEQ ID NO: 76879 - RNA, 25 nt, Human
auccaggcuggagugcagugaugcg

SEQ ID NO: 76880 - RNA, 22 nt, Human
ccuucacuuagcaccugccuca

SEQ ID NO: 76881 - RNA, 21 nt, Human
ccacugggguguguggcagag

SEQ ID NO: 76882 - RNA, 22 nt, Human
agagccccaaaaaucgaaacag

SEQ ID NO: 76883 - RNA, 24 nt, Human
gcagugggaguugaagucauuguc

SEQ ID NO: 76884 - RNA, 22 nt, Human
gggucucuggcccuucuugccu

SEQ ID NO: 76885 - RNA, 26 nt, Human
ggaugcacacacagauggucacacag

SEQ ID NO: 76886 - RNA, 24 nt, Human
uuccacuuaucuuggaaucaugca

SEQ ID NO: 76887 - RNA, 22 nt, Human
acaauuugccuccaugccugaa

SEQ ID NO: 76888 - RNA, 20 nt, Human
aauuuuguuguuucucagcu

SEQ ID NO: 76889 - RNA, 21 nt, Human
cauuuuucugacauaaacuca

SEQ ID NO: 76890 - RNA, 28 nt, Human
uccuuguuccacugugccuugguuucuc

SEQ ID NO: 76891 - RNA, 18 nt, Human
aagacaggcuauucucug

SEQ ID NO: 76892 - RNA, 19 nt, Human
ucuugguuagggagucaaa

SEQ ID NO: 76893 - RNA, 20 nt, Human
cugccucugucccucugguc

SEQ ID NO: 76894 - RNA, 21 nt, Human
cuuccugaagaguccgugguu

SEQ ID NO: 76895 - RNA, 24 nt, Human
ugggaaaggcagggcccugaaaug

SEQ ID NO: 76896 - RNA, 22 nt, Human
acacacacauauguagauuuca

SEQ ID NO: 76897 - RNA, 22 nt, Human
aucacccagacuggcgugcagu

SEQ ID NO: 76898 - RNA, 20 nt, Human
aacuuggauuagguggagag

SEQ ID NO: 76899 - RNA, 21 nt, Human
aucugcaugccagccuggagg

SEQ ID NO: 76900 - RNA, 23 nt, Human
ucaaggaucuggaccccaaagaa

SEQ ID NO: 76901 - RNA, 24 nt, Human
acucagaaaaacacacaccaccuu

SEQ ID NO: 76902 - RNA, 18 nt, Human
accaucugaauuccagaa

SEQ ID NO: 76903 - RNA, 23 nt, Human
ccgggagguggagcuugcaguga

SEQ ID NO: 76904 - RNA, 25 nt, Human
ucaucccaucucuaauuuccccucu

SEQ ID NO: 76905 - RNA, 27 nt, Human
gaagcaguucagaaggaauaagcauuc

SEQ ID NO: 76906 - RNA, 22 nt, Human
gcccugacuggaguucaguggu

SEQ ID NO: 76907 - RNA, 26 nt, Human
gcugagcucgguggcucaugccugua

SEQ ID NO: 76908 - RNA, 21 nt, Human
uauuaaaaggaguauuuacua

SEQ ID NO: 76909 - RNA, 25 nt, Human
cuccucucucaguggccaucauguc

SEQ ID NO: 76910 - RNA, 26 nt, Human
uaucugucaugggcaccugcugucua

SEQ ID NO: 76911 - RNA, 22 nt, Human
gcacacaucuguaauccuagcu

SEQ ID NO: 76912 - RNA, 20 nt, Human
gccaguauaaaaauguagua

SEQ ID NO: 76913 - RNA, 20 nt, Human
ccuggagaugacuugaggcc

SEQ ID NO: 76914 - RNA, 27 nt, Human
acaagggcuggagcaguuuauaaacaa

SEQ ID NO: 76915 - RNA, 21 nt, Human
agaagaaagcugacucaggga

SEQ ID NO: 76916 - RNA, 26 nt, Human
agccuggauggguggaggcuuaggua

SEQ ID NO: 76917 - RNA, 26 nt, Human
gacggcugccuuuguccuccuccucu

SEQ ID NO: 76918 - RNA, 21 nt, Human
acagcaggcuacaaaaccacu

SEQ ID NO: 76919 - RNA, 27 nt, Human
cucagcaggaauaugguggaguucagu

SEQ ID NO: 76920 - RNA, 21 nt, Human
cacugcacuccauccugggcg

SEQ ID NO: 76921 - RNA, 21 nt, Human
cucuggcccaggacgccugcu

SEQ ID NO: 76922 - RNA, 20 nt, Human
uggucucaauccuggccucu

SEQ ID NO: 76923 - RNA, 24 nt, Human
gccggccacugugugucauggcuc

SEQ ID NO: 76924 - RNA, 21 nt, Human
uucaaaaccucuuuuuucugg

SEQ ID NO: 76925 - RNA, 22 nt, Human
ucacccaaguuggagugcagug

SEQ ID NO: 76926 - RNA, 24 nt, Human
cgcgcucccagucgcugagugccu

SEQ ID NO: 76927 - RNA, 27 nt, Human
uagaugucuuuuauaguggaaaaacac

SEQ ID NO: 76928 - RNA, 21 nt, Human
ggauacuugaauggaccucua

SEQ ID NO: 76929 - RNA, 23 nt, Human
guagagugucugacuauacuggg

SEQ ID NO: 76930 - RNA, 21 nt, Human
agguucucgggacugaaggaa

SEQ ID NO: 76931 - RNA, 22 nt, Human
aguuugacaccugucuacccag

SEQ ID NO: 76932 - RNA, 24 nt, Human
cuguguacugccaggcaugugggu

SEQ ID NO: 76933 - RNA, 22 nt, Human
uacaaggauauagguuuuucuc

SEQ ID NO: 76934 - RNA, 25 nt, Human
gaagaacaauaaacuaaaggaaagc

SEQ ID NO: 76935 - RNA, 22 nt, Human
aauggcgugaucucagcucacu

SEQ ID NO: 76936 - RNA, 22 nt, Human
aauggcaugaucucggcucacu

SEQ ID NO: 76937 - RNA, 21 nt, Human
caaaugcuucuacacacucca

SEQ ID NO: 76938 - RNA, 19 nt, Human
cagugguuccuggcugcug

SEQ ID NO: 76939 - RNA, 27 nt, Human
gccuggaugcugauugcacugucauug

SEQ ID NO: 76940 - RNA, 22 nt, Human
aaauuucagcagcugcagcuca

SEQ ID NO: 76941 - RNA, 26 nt, Human
ugcagcaaaaaccaauacaacaaaac

SEQ ID NO: 76942 - RNA, 22 nt, Human
cugcaagcagccucucagcuga

SEQ ID NO: 76943 - RNA, 28 nt, Human
ucucgagcuccugaccucaggugauccg

SEQ ID NO: 76944 - RNA, 26 nt, Human
gggaagggagggacagcucacugguu

SEQ ID NO: 76945 - RNA, 23 nt, Human
ugcaugccaccacgcacagcuac

SEQ ID NO: 76946 - RNA, 24 nt, Human
uguagcucuggguaagaugaccug

SEQ ID NO: 76947 - RNA, 21 nt, Human
ccugcaagaaagagcacagua

SEQ ID NO: 76948 - RNA, 26 nt, Human
uuuuauuuuuugaaaaacaaaaggca

SEQ ID NO: 76949 - RNA, 27 nt, Human
uucaaacauuuuuggugagugcugcuu

SEQ ID NO: 76950 - RNA, 31 nt, Human
ggcugagcuggugccuggccccagucuuauc

SEQ ID NO: 76951 - RNA, 24 nt, Human
cgaagggggcaugucacgacagcu

SEQ ID NO: 76952 - RNA, 23 nt, Human
ugcucccagaaucuggugcucug

SEQ ID NO: 76953 - RNA, 25 nt, Human
caaaaagcaugugaaagugcacuua

SEQ ID NO: 76954 - RNA, 23 nt, Human
uguuuuuaaaauaaaguaucuug

SEQ ID NO: 76955 - RNA, 23 nt, Human
cugagguagcaagugcagccuca

SEQ ID NO: 76956 - RNA, 23 nt, Human
aggaggcagagcuucugcccacu

SEQ ID NO: 76957 - RNA, 22 nt, Human
ggaggcugagguaggaggauca

SEQ ID NO: 76958 - RNA, 24 nt, Human
caggaagucugagugugaggggcu

SEQ ID NO: 76959 - RNA, 22 nt, Human
agagaauguuccagacauucuc

SEQ ID NO: 76960 - RNA, 27 nt, Human
cccaaguagcagggacuacagagugau

SEQ ID NO: 76961 - RNA, 23 nt, Human
cucugccgugccaucugggaugc

SEQ ID NO: 76962 - RNA, 27 nt, Human
ugccacucugggcagucuuuuguguca

SEQ ID NO: 76963 - RNA, 19 nt, Human
ccucagcaguuugcagugg

SEQ ID NO: 76964 - RNA, 20 nt, Human
gcugcuugugaauuuucuga

SEQ ID NO: 76965 - RNA, 22 nt, Human
ucaucagguaccuccucccuuu

SEQ ID NO: 76966 - RNA, 18 nt, Human
gacucucgcaucuuccca

SEQ ID NO: 76967 - RNA, 20 nt, Human
cccaggcccacaggucucga

SEQ ID NO: 76968 - RNA, 22 nt, Human
ggcuggguucugggccuguauc

SEQ ID NO: 76969 - RNA, 22 nt, Human
guucucccaugauuugggguga

SEQ ID NO: 76970 - RNA, 27 nt, Human
ggcaaagccaaauuuucaagccacaga

SEQ ID NO: 76971 - RNA, 20 nt, Human
gcccacauagaugccccuug

SEQ ID NO: 76972 - RNA, 22 nt, Human
gaagagccaaaaagacccagaa

SEQ ID NO: 76973 - RNA, 21 nt, Human
ccagcucuacuggucuugugg

SEQ ID NO: 76974 - RNA, 24 nt, Human
aggccugauaagcgaucagaggaa

SEQ ID NO: 76975 - RNA, 23 nt, Human
caacauagugagacccccaucuc

SEQ ID NO: 76976 - RNA, 21 nt, Human
uagacuuuuauuuauacucuu

SEQ ID NO: 76977 - RNA, 24 nt, Human
cugucaccgaggcuggagugcagu

SEQ ID NO: 76978 - RNA, 30 nt, Human
ggugcuguuugggccucugcucccaugcuc

SEQ ID NO: 76979 - RNA, 27 nt, Human
cagcagccaguggguucccgcgcgugc

SEQ ID NO: 76980 - RNA, 26 nt, Human
agcaaaugguuuugggcaagggcuuu

SEQ ID NO: 76981 - RNA, 22 nt, Human
auuuucuguggcaucuuuuaug

SEQ ID NO: 76982 - RNA, 22 nt, Human
gaccaccugugcucaagcaauc

SEQ ID NO: 76983 - RNA, 22 nt, Human
uuuucucaggauggagugaaga

SEQ ID NO: 76984 - RNA, 24 nt, Human
uauccucccuuuuccuuaagcaca

SEQ ID NO: 76985 - RNA, 27 nt, Human
agaaaacagaaaggagcagcaguguuu

SEQ ID NO: 76986 - RNA, 24 nt, Human
agacauuccuccugcgcagggcca

SEQ ID NO: 76987 - RNA, 22 nt, Human
cugggaggcggagguugcagug

SEQ ID NO: 76988 - RNA, 24 nt, Human
acucucaaaaaaugaaauucucaa

SEQ ID NO: 76989 - RNA, 23 nt, Human
guacuuccucuggcccuggcuga

SEQ ID NO: 76990 - RNA, 32 nt, Human
cccuccccgcccggcuggaggcugcuccggac

SEQ ID NO: 76991 - RNA, 21 nt, Human
guugcuuggcuggagaacuga

SEQ ID NO: 76992 - RNA, 21 nt, Human
uuuacuuagagcuuuuucuua

SEQ ID NO: 76993 - RNA, 20 nt, Human
ggcucugucucaaaagcaaa

SEQ ID NO: 76994 - RNA, 27 nt, Human
ggaaacaauaaauuccugagauacauu

SEQ ID NO: 76995 - RNA, 21 nt, Human
cuugcacuuucucuccaguca

SEQ ID NO: 76996 - RNA, 21 nt, Human
uacugaaaacaccauccauuu

SEQ ID NO: 76997 - RNA, 23 nt, Human
cugcacccucuucucuucuggcu

SEQ ID NO: 76998 - RNA, 25 nt, Human
ggaggcugagacugcagaggagcca

SEQ ID NO: 76999 - RNA, 31 nt, Human
gaaugggacgacaagaauguacugguuucuu

SEQ ID NO: 77000 - RNA, 26 nt, Human
ccuagccaguucucuugcucuucugu

SEQ ID NO: 77001 - RNA, 17 nt, Human
uccugcucccuguguuc

SEQ ID NO: 77002 - RNA, 27 nt, Human
uucuccuccuuuuaucuuuuguguuuu

SEQ ID NO: 77003 - RNA, 21 nt, Human
ggcuuguuuuuacagcuugug

SEQ ID NO: 77004 - RNA, 21 nt, Human
uuuuacuugagagaaggugag

SEQ ID NO: 77005 - RNA, 21 nt, Human
uccauaagcgcuucagugggg

SEQ ID NO: 77006 - RNA, 23 nt, Human
aucgagccacugcacuccagccu

SEQ ID NO: 77007 - RNA, 24 nt, Human
ucaaaucucugucucugcuugguu

SEQ ID NO: 77008 - RNA, 22 nt, Human
caggaggcggagguugcaguaa

SEQ ID NO: 77009 - RNA, 22 nt, Human
cgggaggcggagauugcgguga

SEQ ID NO: 77010 - RNA, 22 nt, Human
caggaggcggagauugcaguga

SEQ ID NO: 77011 - RNA, 21 nt, Human
ugagcaacaaagcgagauccc

SEQ ID NO: 77012 - RNA, 23 nt, Human
ugcagccagggcuguggggaagg

SEQ ID NO: 77013 - RNA, 23 nt, Human
cgcgcacagagccgcaucccgcc

SEQ ID NO: 77014 - RNA, 27 nt, Human
gagguggggauaggggacaccuucagc

SEQ ID NO: 77015 - RNA, 27 nt, Human
ucuuagcacauccucuguucucuaccu

SEQ ID NO: 77016 - RNA, 26 nt, Human
gggacccccuggaagccuagaaaugg

SEQ ID NO: 77017 - RNA, 25 nt, Human
aucacguuugaaucuaccauucaua

SEQ ID NO: 77018 - RNA, 26 nt, Human
gaaagagaagaaccgcgccgcccgga

SEQ ID NO: 77019 - RNA, 20 nt, Human
gcucuagccuguaccaguua

SEQ ID NO: 77020 - RNA, 16 nt, Human
gggcugaggcccaggg

SEQ ID NO: 77021 - RNA, 26 nt, Human
uucacuuccccaaucuugucguugau

SEQ ID NO: 77022 - RNA, 23 nt, Human
cccaaagccuccaaaacuaacca

SEQ ID NO: 77023 - RNA, 18 nt, Human
ggggaagagaaacuugca

SEQ ID NO: 77024 - RNA, 22 nt, Human
ccgccccuaacagucacccacc

SEQ ID NO: 77025 - RNA, 25 nt, Human
ucuuuggagcaaggcugcugcccgu

SEQ ID NO: 77026 - RNA, 22 nt, Human
aaucauucaaccaacgcuucca

SEQ ID NO: 77027 - RNA, 24 nt, Human
uguuuuauaaauagguuuaugugu

SEQ ID NO: 77028 - RNA, 23 nt, Human
gaguaauuuuguguuuucuugag

SEQ ID NO: 77029 - RNA, 26 nt, Human
ggcuugcaucccccaucccuuguuca

SEQ ID NO: 77030 - RNA, 24 nt, Human
cuuugaccaaaugccuucuauggu

SEQ ID NO: 77031 - RNA, 23 nt, Human
acaagaaugaacccaugacagca

SEQ ID NO: 77032 - RNA, 25 nt, Human
ugguguuggcaucagcuugggcagg

SEQ ID NO: 77033 - RNA, 22 nt, Human
caaacaauguuuauaaugugua

SEQ ID NO: 77034 - RNA, 19 nt, Human
acauucuuucaacacuaca

SEQ ID NO: 77035 - RNA, 24 nt, Human
ccguccaucugcaucucuguccca

SEQ ID NO: 77036 - RNA, 21 nt, Human
auugccucugggugucaugug

SEQ ID NO: 77037 - RNA, 24 nt, Human
gcgcgcuccagccgguguaggcga

SEQ ID NO: 77038 - RNA, 21 nt, Human
auagguuuauuuccauaccug

SEQ ID NO: 77039 - RNA, 20 nt, Human
ggaaguauguaauuugagaa

SEQ ID NO: 77040 - RNA, 20 nt, Human
ugaaagggugggugccugaa

SEQ ID NO: 77041 - RNA, 23 nt, Human
aguacuuacaucaggaaauuugg

SEQ ID NO: 77042 - RNA, 20 nt, Human
aguguugauuccauggaacu

SEQ ID NO: 77043 - RNA, 22 nt, Human
ucuaucuccacaacgugagccu

SEQ ID NO: 77044 - RNA, 25 nt, Human
gcacagccugggaaaagacaguuac

SEQ ID NO: 77045 - RNA, 21 nt, Human
gagacagcaacuggcccaggg

SEQ ID NO: 77046 - RNA, 27 nt, Human
cugugcaugccggcuugagacuggagc

SEQ ID NO: 77047 - RNA, 26 nt, Human
cagguaccuggaguuuaauacaguga

SEQ ID NO: 77048 - RNA, 22 nt, Human
ugggcacuuggguaucuucuuc

SEQ ID NO: 77049 - RNA, 22 nt, Human
cuucccuucacuccccuauccc

SEQ ID NO: 77050 - RNA, 21 nt, Human
uauuaauuuuucugugcucaa

SEQ ID NO: 77051 - RNA, 22 nt, Human
auucucuauuuuuuguaaugug

SEQ ID NO: 77052 - RNA, 23 nt, Human
gugcuaacccauucauaguuggc

SEQ ID NO: 77053 - RNA, 20 nt, Human
caugcagcagagggcagaag

SEQ ID NO: 77054 - RNA, 26 nt, Human
uccuuccucuguccggagaggcacag

SEQ ID NO: 77055 - RNA, 17 nt, Human
caguucugguccuggcc

SEQ ID NO: 77056 - RNA, 23 nt, Human
caggaccuguguggggaggcccu

SEQ ID NO: 77057 - RNA, 27 nt, Human
cccuccagggaaguuaagaguuuugac

SEQ ID NO: 77058 - RNA, 22 nt, Human
gccuaaccugggaccugugguc

SEQ ID NO: 77059 - RNA, 26 nt, Human
cauuagauucacauaggaccagguuu

SEQ ID NO: 77060 - RNA, 31 nt, Human
cacuguuugccaucaucuaagccacugaauc

SEQ ID NO: 77061 - RNA, 23 nt, Human
cuacuuugguaguggaauaguga

SEQ ID NO: 77062 - RNA, 26 nt, Human
agauaaaaugaacaggguuacuccca

SEQ ID NO: 77063 - RNA, 23 nt, Human
gagacucagccuuccuccucauc

SEQ ID NO: 77064 - RNA, 21 nt, Human
ccacagacacuacaugaacac

SEQ ID NO: 77065 - RNA, 19 nt, Human
ucagugucuuaaaggggcc

SEQ ID NO: 77066 - RNA, 19 nt, Human
uguagauuuggagauacug

SEQ ID NO: 77067 - RNA, 20 nt, Human
gucuauagccuuggcucaga

SEQ ID NO: 77068 - RNA, 21 nt, Human
cacccuccucacagaccucug

SEQ ID NO: 77069 - RNA, 32 nt, Human
agcccuuguuuauaugcccauucuuuucacuu

SEQ ID NO: 77070 - RNA, 22 nt, Human
gucaagaugggauuuggaagac

SEQ ID NO: 77071 - RNA, 23 nt, Human
augccuaauuucauucuuuguga

SEQ ID NO: 77072 - RNA, 24 nt, Human
gcacagaaaacagauaguuaacug

SEQ ID NO: 77073 - RNA, 25 nt, Human
gcugggugaauuccagccuggggag

SEQ ID NO: 77074 - RNA, 21 nt, Human
ggcucacugcgaccuccgucu

SEQ ID NO: 77075 - RNA, 18 nt, Human
cagucacccaccccgggg

SEQ ID NO: 77076 - RNA, 23 nt, Human
gaugggguuucaccauguuaacc

SEQ ID NO: 77077 - RNA, 23 nt, Human
cgggugucaaaccccugucagag

SEQ ID NO: 77078 - RNA, 23 nt, Human
ccugccgcugcaccugccugccg

SEQ ID NO: 77079 - RNA, 22 nt, Human
gucccugcaggaagcuaaaggg

SEQ ID NO: 77080 - RNA, 27 nt, Human
uacuauuauuccauacuacuauauucu

SEQ ID NO: 77081 - RNA, 25 nt, Human
cuggaaccuguccucccuuucuccc

SEQ ID NO: 77082 - RNA, 27 nt, Human
accaggccuuuuucuguguccacugga

SEQ ID NO: 77083 - RNA, 27 nt, Human
cagaguguuguuccguuaaccuuuuug

SEQ ID NO: 77084 - RNA, 22 nt, Human
acaugggguuggcugggcccag

SEQ ID NO: 77085 - RNA, 26 nt, Human
gcacgcccuggcuggcacuguugccg

SEQ ID NO: 77086 - RNA, 24 nt, Human
uugauuuuuauccauuucuuuuac

SEQ ID NO: 77087 - RNA, 18 nt, Human
aaucccugcagcugagcc

SEQ ID NO: 77088 - RNA, 27 nt, Human
acucuucuaugcaguuacuacauaucu

SEQ ID NO: 77089 - RNA, 23 nt, Human
cucggggccaugccgugccaccg

SEQ ID NO: 77090 - RNA, 27 nt, Human
aaaaagaguuuuuucuuuauuaguaaa

SEQ ID NO: 77091 - RNA, 22 nt, Human
aggcuggagugcaguggcacaa

SEQ ID NO: 77092 - RNA, 19 nt, Human
gggggcuggagggagccgg

SEQ ID NO: 77093 - RNA, 23 nt, Human
caagugccaccagauaaaaacaa

SEQ ID NO: 77094 - RNA, 26 nt, Human
aaucucaaugcaagccccaacuuucu

SEQ ID NO: 77095 - RNA, 19 nt, Human
agaaaacaaaccauugcuu

SEQ ID NO: 77096 - RNA, 21 nt, Human
guauaagcaucugccaucugc

SEQ ID NO: 77097 - RNA, 21 nt, Human
uccucagaagagaacuuaucu

SEQ ID NO: 77098 - RNA, 26 nt, Human
cacaugcuccgccuccaggucccgcu

SEQ ID NO: 77099 - RNA, 27 nt, Human
ugccuguaucuuuuauuuuccugucuu

SEQ ID NO: 77100 - RNA, 22 nt, Human
uuccuauacugccaaagaaugu

SEQ ID NO: 77101 - RNA, 22 nt, Human
cccagccagaaaccccaaaguc

SEQ ID NO: 77102 - RNA, 23 nt, Human
uacacagaugcuacagacuugua

SEQ ID NO: 77103 - RNA, 21 nt, Human
cuggcccuuggaggcuggcac

SEQ ID NO: 77104 - RNA, 22 nt, Human
uuuauaucuugacuugccuugu

SEQ ID NO: 77105 - RNA, 29 nt, Human
gcucuuuccuuccccuccucucuccaggg

SEQ ID NO: 77106 - RNA, 22 nt, Human
ccagcggggcugcucacccacc

SEQ ID NO: 77107 - RNA, 21 nt, Human
caauuucuguccacuuccuca

SEQ ID NO: 77108 - RNA, 25 nt, Human
gggcaggaggaaugcaggagcagga

SEQ ID NO: 77109 - RNA, 21 nt, Human
guucagugugcugaucauuca

SEQ ID NO: 77110 - RNA, 26 nt, Human
gccucccaguagcugggauuagaggc

SEQ ID NO: 77111 - RNA, 22 nt, Human
ccugcacugcauccugccuccu

SEQ ID NO: 77112 - RNA, 23 nt, Human
ugccuucauggaacucagcuguc

SEQ ID NO: 77113 - RNA, 23 nt, Human
ccuuaccucauggcugugaagcu

SEQ ID NO: 77114 - RNA, 19 nt, Human
ucuucgccaccaugccgcc

SEQ ID NO: 77115 - RNA, 24 nt, Human
auugccauuuggcugaaguguggu

SEQ ID NO: 77116 - RNA, 24 nt, Human
uucuucagauuaacuucaggauuu

SEQ ID NO: 77117 - RNA, 20 nt, Human
cucucuggaccucagguuuc

SEQ ID NO: 77118 - RNA, 22 nt, Human
acagaacucuagccaaaggcaa

SEQ ID NO: 77119 - RNA, 27 nt, Human
ccaggaggucaggaggccccagagaag

SEQ ID NO: 77120 - RNA, 25 nt, Human
agggccaugugguucccugcagccu

SEQ ID NO: 77121 - RNA, 21 nt, Human
uuccuuuaauuauugcuuguc

SEQ ID NO: 77122 - RNA, 30 nt, Human
ccgcuagguccagagagcgagcccccaaug

SEQ ID NO: 77123 - RNA, 21 nt, Human
uuuaaacacauuuucacaagu

SEQ ID NO: 77124 - RNA, 22 nt, Human
uuguccaggaugcuggcuggug

SEQ ID NO: 77125 - RNA, 22 nt, Human
caccucuguucuuccuauuucu

SEQ ID NO: 77126 - RNA, 20 nt, Human
gcccugccccauccugggcc

SEQ ID NO: 77127 - RNA, 17 nt, Human
uugguacuuucuuguca

SEQ ID NO: 77128 - RNA, 22 nt, Human
gcucacgccuguaaucccagcg

SEQ ID NO: 77129 - RNA, 22 nt, Human
ugcccugcagaagaugugauga

SEQ ID NO: 77130 - RNA, 28 nt, Human
ugcagugagccgagaucaugccacugca

SEQ ID NO: 77131 - RNA, 24 nt, Human
gcuccgacuugugcacaggcagag

SEQ ID NO: 77132 - RNA, 20 nt, Human
cuucgccucuccaugaaccc

SEQ ID NO: 77133 - RNA, 22 nt, Human
ugcuaauuuuuguauuuuuagu

SEQ ID NO: 77134 - RNA, 22 nt, Human
agcccuccccuccugcgcugga

SEQ ID NO: 77135 - RNA, 27 nt, Human
agguccccagaugagaagucugcuacc

SEQ ID NO: 77136 - RNA, 21 nt, Human
gccauauguuuguauauugug

SEQ ID NO: 77137 - RNA, 23 nt, Human
ggcaugagaguuucagacucagc

SEQ ID NO: 77138 - RNA, 23 nt, Human
cuuaauguaauaugagcaaccaa

SEQ ID NO: 77139 - RNA, 27 nt, Human
guuuuguuuuaaaauagcuuugcagug

SEQ ID NO: 77140 - RNA, 18 nt, Human
gucaguuugaaaaggagg

SEQ ID NO: 77141 - RNA, 21 nt, Human
ccggccauucucccucuuguu

SEQ ID NO: 77142 - RNA, 19 nt, Human
agaccugauuucuccugcg

SEQ ID NO: 77143 - RNA, 22 nt, Human
cccaggaggcuuccuuccagcc

SEQ ID NO: 77144 - RNA, 23 nt, Human
acuauuguuaauucuuccuauuu

SEQ ID NO: 77145 - RNA, 17 nt, Human
ccugcccugccugcucc

SEQ ID NO: 77146 - RNA, 22 nt, Human
gcgcuucccuuccagcaucacc

SEQ ID NO: 77147 - RNA, 27 nt, Human
cagcauuuuuccccucugugcuggaua

SEQ ID NO: 77148 - RNA, 20 nt, Human
cuagauuuuucuggaagaac

SEQ ID NO: 77149 - RNA, 17 nt, Human
gcuuuggggaaaaagaa

SEQ ID NO: 77150 - RNA, 22 nt, Human
gugcugaaaaaugcucaucucu

SEQ ID NO: 77151 - RNA, 27 nt, Human
uuccuuuguuugcggggggcuggggau

SEQ ID NO: 77152 - RNA, 21 nt, Human
uggaaagacuggcaauuagag

SEQ ID NO: 77153 - RNA, 22 nt, Human
cuuuucaggaagcuuagaucug

SEQ ID NO: 77154 - RNA, 26 nt, Human
aaugggguaagcauuuucauucuucc

SEQ ID NO: 77155 - RNA, 28 nt, Human
ggcugacacaccuccuguccacuguguc

SEQ ID NO: 77156 - RNA, 22 nt, Human
uagguuucuccauuuucaccuc

SEQ ID NO: 77157 - RNA, 17 nt, Human
acauaggauuuguacuc

SEQ ID NO: 77158 - RNA, 22 nt, Human
acccuuuaaagcagugaaucug

SEQ ID NO: 77159 - RNA, 25 nt, Human
uauaaacuuuuauuaugugcucuua

SEQ ID NO: 77160 - RNA, 20 nt, Human
ugaacaaaagcuuuucuuuc

SEQ ID NO: 77161 - RNA, 20 nt, Human
cucuuagcauccugccuuag

SEQ ID NO: 77162 - RNA, 19 nt, Human
uauugcaacggucaaggcu

SEQ ID NO: 77163 - RNA, 28 nt, Human
uugucuucacucuucauucuuugaagga

SEQ ID NO: 77164 - RNA, 21 nt, Human
ggggauuuggcuggugccgaa

SEQ ID NO: 77165 - RNA, 22 nt, Human
cagugguuuuuccauagugcuu

SEQ ID NO: 77166 - RNA, 27 nt, Human
ggagagggagucagccgagguccuggc

SEQ ID NO: 77167 - RNA, 18 nt, Human
agucugaggcggagggag

SEQ ID NO: 77168 - RNA, 22 nt, Human
ccugcagcuggugcucuguguc

SEQ ID NO: 77169 - RNA, 27 nt, Human
gcuucucagcccuggauuuccugcugc

SEQ ID NO: 77170 - RNA, 25 nt, Human
ccucacugcccugugacuuccaccu

SEQ ID NO: 77171 - RNA, 19 nt, Human
ucaaaagacuuaauuugua

SEQ ID NO: 77172 - RNA, 20 nt, Human
gaucacacagagaugaaugg

SEQ ID NO: 77173 - RNA, 20 nt, Human
gggcuuucacccaaccugcu

SEQ ID NO: 77174 - RNA, 22 nt, Human
ugacuuuucugcccugcccuca

SEQ ID NO: 77175 - RNA, 27 nt, Human
ccagaagcacgaggcccuugagaacug

SEQ ID NO: 77176 - RNA, 22 nt, Human
gccccugcugacccccuccucc

SEQ ID NO: 77177 - RNA, 24 nt, Human
acacuuggauuucauuuguaacuu

SEQ ID NO: 77178 - RNA, 21 nt, Human
cccaaagugcuggauuacagg

SEQ ID NO: 77179 - RNA, 25 nt, Human
acacagcaagggguuuggugaccuc

SEQ ID NO: 77180 - RNA, 27 nt, Human
cauaugcagaacguauuuagccauuac

SEQ ID NO: 77181 - RNA, 20 nt, Human
aaagcaagacuguugcucaa

SEQ ID NO: 77182 - RNA, 22 nt, Human
aaucaucuguaacaauuauguu

SEQ ID NO: 77183 - RNA, 21 nt, Human
ccuuaggccuuccucucucca

SEQ ID NO: 77184 - RNA, 22 nt, Human
ccagcaucuuuuauugcauugg

SEQ ID NO: 77185 - RNA, 23 nt, Human
ggcauuuuccacaccuguccacu

SEQ ID NO: 77186 - RNA, 22 nt, Human
uuuuuaaucuuaaaagauugug

SEQ ID NO: 77187 - RNA, 22 nt, Human
agacauccuuucugaauacuuc

SEQ ID NO: 77188 - RNA, 21 nt, Human
auagaugaugauguguuuggg

SEQ ID NO: 77189 - RNA, 22 nt, Human
caagucccugucauuugaaccu

SEQ ID NO: 77190 - RNA, 21 nt, Human
cugacugaacugucacuguga

SEQ ID NO: 77191 - RNA, 23 nt, Human
cacacaccccacuccagcuccgg

SEQ ID NO: 77192 - RNA, 21 nt, Human
aaacacucuuaucagccuggg

SEQ ID NO: 77193 - RNA, 27 nt, Human
uccugcucuccaucauggcgcaggauc

SEQ ID NO: 77194 - RNA, 22 nt, Human
gaccagcgggcauuuguuuucu

SEQ ID NO: 77195 - RNA, 23 nt, Human
gaauguucuccugggcagcguug

SEQ ID NO: 77196 - RNA, 29 nt, Human
cuuuggcuuuguggcagggccuccccagg

SEQ ID NO: 77197 - RNA, 21 nt, Human
ugccaucuucgcuuugcugga

SEQ ID NO: 77198 - RNA, 20 nt, Human
accacagucuuucguuucca

SEQ ID NO: 77199 - RNA, 18 nt, Human
cacagcccccaggggagg

SEQ ID NO: 77200 - RNA, 26 nt, Human
ccaaacacugcuuuaggcacugggga

SEQ ID NO: 77201 - RNA, 19 nt, Human
cccucagcucuuccuugcc

SEQ ID NO: 77202 - RNA, 30 nt, Human
cugcccucaucuggcccuggccagcucugc

SEQ ID NO: 77203 - RNA, 27 nt, Human
agucuucucucagcuuccacugccguc

SEQ ID NO: 77204 - RNA, 18 nt, Human
aggauccucacaccagcu

SEQ ID NO: 77205 - RNA, 25 nt, Human
cagauugaaacaaacaaaaagcuuu

SEQ ID NO: 77206 - RNA, 20 nt, Human
agugaucaauaaaaugugau

SEQ ID NO: 77207 - RNA, 20 nt, Human
ggaucacuccacaguccuca

SEQ ID NO: 77208 - RNA, 22 nt, Human
aacuuagcugucguucaguuaa

SEQ ID NO: 77209 - RNA, 21 nt, Human
acccccacuccucugcauguc

SEQ ID NO: 77210 - RNA, 23 nt, Human
aagaucuggggagugugaggaga

SEQ ID NO: 77211 - RNA, 30 nt, Human
gcccugcucccugcccuccugggcagccag

SEQ ID NO: 77212 - RNA, 22 nt, Human
cagggaggacuuccuagaggaa

SEQ ID NO: 77213 - RNA, 21 nt, Human
ucaucccucugcagagcgcgg

SEQ ID NO: 77214 - RNA, 23 nt, Human
uguuuaauggggcugauguguaa

SEQ ID NO: 77215 - RNA, 24 nt, Human
gcaggugacccaagacagagcuga

SEQ ID NO: 77216 - RNA, 20 nt, Human
guguucugcuccugcuuuuc

SEQ ID NO: 77217 - RNA, 21 nt, Human
gugcuggcuggucacugccag

SEQ ID NO: 77218 - RNA, 22 nt, Human
cuaucuggccugagacaacaaa

SEQ ID NO: 77219 - RNA, 19 nt, Human
cggaggaggcgggagcagc

SEQ ID NO: 77220 - RNA, 19 nt, Human
ggcugcguuccucucucca

SEQ ID NO: 77221 - RNA, 21 nt, Human
ucucgaauggaagaacagugg

SEQ ID NO: 77222 - RNA, 22 nt, Human
ccaccgcgccuggccuaaaaug

SEQ ID NO: 77223 - RNA, 22 nt, Human
caccugccucggcucaccucuu

SEQ ID NO: 77224 - RNA, 20 nt, Human
ccacuccuuccccaggguuu

SEQ ID NO: 77225 - RNA, 23 nt, Human
gcucaggacugcuauuuagcucc

SEQ ID NO: 77226 - RNA, 26 nt, Human
ucuugaacuccugggcucaagccauc

SEQ ID NO: 77227 - RNA, 21 nt, Human
cugauuugaugaaccaaggaa

SEQ ID NO: 77228 - RNA, 18 nt, Human
uuugucgccugucugacu

SEQ ID NO: 77229 - RNA, 20 nt, Human
uuuggcuaucuacugagaca

SEQ ID NO: 77230 - RNA, 19 nt, Human
gaaugacacagcugaacag

SEQ ID NO: 77231 - RNA, 21 nt, Human
gguggcuaaccugaccaauaa

SEQ ID NO: 77232 - RNA, 24 nt, Human
gucacaccugacaaauggaaggag

SEQ ID NO: 77233 - RNA, 25 nt, Human
auccuagcacuuuugggaggcagag

SEQ ID NO: 77234 - RNA, 22 nt, Human
gcccagucuggagugcaguggu

SEQ ID NO: 77235 - RNA, 22 nt, Human
ggcaugguggcgggugccugua

SEQ ID NO: 77236 - RNA, 21 nt, Human
ucuucuuggcagccaggcugg

SEQ ID NO: 77237 - RNA, 23 nt, Human
uuaucuuucuguccuucaaucug

SEQ ID NO: 77238 - RNA, 21 nt, Human
ccagaaauuggaggugguagg

SEQ ID NO: 77239 - RNA, 22 nt, Human
ccuacuuagagauauucuagaa

SEQ ID NO: 77240 - RNA, 24 nt, Human
cugccccuuggagcccagugacag

SEQ ID NO: 77241 - RNA, 19 nt, Human
acuggagguaaaagcacaa

SEQ ID NO: 77242 - RNA, 21 nt, Human
ggccuccuccccucugggcag

SEQ ID NO: 77243 - RNA, 20 nt, Human
gguggaggcaguagcccagg

SEQ ID NO: 77244 - RNA, 20 nt, Human
ggauacuuaucuacuguccg

SEQ ID NO: 77245 - RNA, 24 nt, Human
auuuuucuuaauaaauaaaggaca

SEQ ID NO: 77246 - RNA, 21 nt, Human
ggguuucucucccaaaagcuu

SEQ ID NO: 77247 - RNA, 24 nt, Human
acagcuugaggccccuccugcugc

SEQ ID NO: 77248 - RNA, 23 nt, Human
ucuuaucucccagcucgcccagg

SEQ ID NO: 77249 - RNA, 18 nt, Human
gccuccucuccugggacu

SEQ ID NO: 77250 - RNA, 20 nt, Human
gaagaaaagcaacaugugag

SEQ ID NO: 77251 - RNA, 27 nt, Human
ggucucgaacuccuggacucaagcaau

SEQ ID NO: 77252 - RNA, 24 nt, Human
ugcgagcccucucugcaccugcuc

SEQ ID NO: 77253 - RNA, 25 nt, Human
uugaacagaugucugucucccuagu

SEQ ID NO: 77254 - RNA, 23 nt, Human
gggccuggggucgggggagcagc

SEQ ID NO: 77255 - RNA, 20 nt, Human
auagaacaggcugaaauuuc

SEQ ID NO: 77256 - RNA, 24 nt, Human
uuucuuugcccuccugauucuugg

SEQ ID NO: 77257 - RNA, 23 nt, Human
agcugaaggucaaaaaugauuua

SEQ ID NO: 77258 - RNA, 24 nt, Human
ggagcucuacccugcucccugcuu

SEQ ID NO: 77259 - RNA, 27 nt, Human
agggcacguggcucccucagccaugaa

SEQ ID NO: 77260 - RNA, 27 nt, Human
gcuguucuuucgcucuuugugcuucgc

SEQ ID NO: 77261 - RNA, 24 nt, Human
cgcugggcggcugugggcugcagg

SEQ ID NO: 77262 - RNA, 27 nt, Human
cucagcuuuccuuaaggauaucaguaa

SEQ ID NO: 77263 - RNA, 25 nt, Human
ggcucacugcagccuugaacuccca

SEQ ID NO: 77264 - RNA, 20 nt, Human
gggacuauaugauuucuuac

SEQ ID NO: 77265 - RNA, 22 nt, Human
aggccgaggcagguggaucacc

SEQ ID NO: 77266 - RNA, 19 nt, Human
augcaggcauccacaugcc

SEQ ID NO: 77267 - RNA, 32 nt, Human
guaauuauaaacuccugaccuccugguggggu

SEQ ID NO: 77268 - RNA, 23 nt, Human
uggaggcccgugugugaauuccu

SEQ ID NO: 77269 - RNA, 21 nt, Human
guuggccagguuggucucgaa

SEQ ID NO: 77270 - RNA, 27 nt, Human
guccauguggcucuaucuuuuaaaacc

SEQ ID NO: 77271 - RNA, 20 nt, Human
acuuguaacccagcacuuug

SEQ ID NO: 77272 - RNA, 24 nt, Human
uauccaucugcaggugaaucuuca

SEQ ID NO: 77273 - RNA, 25 nt, Human
acuacuguaggcaguuuccuccuca

SEQ ID NO: 77274 - RNA, 27 nt, Human
cccuagagcuagcaguucccauucagg

SEQ ID NO: 77275 - RNA, 22 nt, Human
gugagguauauacuaaaaugaa

SEQ ID NO: 77276 - RNA, 23 nt, Human
gccacccaggcagggagcaagug

SEQ ID NO: 77277 - RNA, 26 nt, Human
guggguggaagggcugggugucgaaa

SEQ ID NO: 77278 - RNA, 26 nt, Human
ucaguauuuuaauaugguuacauuua

SEQ ID NO: 77279 - RNA, 27 nt, Human
ugcaggcaagcggucggguggggaggg

SEQ ID NO: 77280 - RNA, 22 nt, Human
ggcucucuuccuguucugcacc

SEQ ID NO: 77281 - RNA, 27 nt, Human
ccuuuggcagcugcaauacacaguguu

SEQ ID NO: 77282 - RNA, 22 nt, Human
uggacaacaggaagugaaccuu

SEQ ID NO: 77283 - RNA, 19 nt, Human
agaccuacaucaggccuuc

SEQ ID NO: 77284 - RNA, 20 nt, Human
gucuauguuuucuacuccaa

SEQ ID NO: 77285 - RNA, 26 nt, Human
augggcaugggaagaugggcucccug

SEQ ID NO: 77286 - RNA, 22 nt, Human
gaagcuguauacugugugcuaa

SEQ ID NO: 77287 - RNA, 22 nt, Human
ccacugcacuccagucugggug

SEQ ID NO: 77288 - RNA, 22 nt, Human
ccacuguacuccagccugggug

SEQ ID NO: 77289 - RNA, 27 nt, Human
ccuccugccagccacgccugcgaggcg

SEQ ID NO: 77290 - RNA, 21 nt, Human
cugguaccuccuucaagcugg

SEQ ID NO: 77291 - RNA, 24 nt, Human
cuggcuuuauuuaaaggaacugca

SEQ ID NO: 77292 - RNA, 22 nt, Human
ccaggcccugcuccauggagcc

SEQ ID NO: 77293 - RNA, 22 nt, Human
cugaguagcugggacuacaggu

SEQ ID NO: 77294 - RNA, 22 nt, Human
cugagcagcugggacuacaggc

SEQ ID NO: 77295 - RNA, 20 nt, Human
gcuuccaucucagcacucug

SEQ ID NO: 77296 - RNA, 24 nt, Human
guuagggagagagaagcaggcaga

SEQ ID NO: 77297 - RNA, 16 nt, Human
aaaacaauacuaccua

SEQ ID NO: 77298 - RNA, 21 nt, Human
aaagugcugggauuaaagcug

SEQ ID NO: 77299 - RNA, 24 nt, Human
gcgcacagcagaggaggugugugu

SEQ ID NO: 77300 - RNA, 27 nt, Human
cuguggaauauaaauagcugaaaacua

SEQ ID NO: 77301 - RNA, 19 nt, Human
cacauuccauuucucucca

SEQ ID NO: 77302 - RNA, 19 nt, Human
uaguauuggaacuacuucu

SEQ ID NO: 77303 - RNA, 22 nt, Human
auggugauggaugauauccucu

SEQ ID NO: 77304 - RNA, 23 nt, Human
gaauccagagcgcugcagucaca

SEQ ID NO: 77305 - RNA, 22 nt, Human
ggccccaucuccaugugccucc

SEQ ID NO: 77306 - RNA, 29 nt, Human
ggagcgcuagugccuugcccacaggugcg

SEQ ID NO: 77307 - RNA, 30 nt, Human
cuggcucccuuacuuuaccucucugucaug

SEQ ID NO: 77308 - RNA, 24 nt, Human
cauauauuuuagaauauguguaug

SEQ ID NO: 77309 - RNA, 23 nt, Human
auucauaaccauagccucgauca

SEQ ID NO: 77310 - RNA, 21 nt, Human
caguacaccagcaaugcugag

SEQ ID NO: 77311 - RNA, 21 nt, Human
uugucuugcaucauuaucucu

SEQ ID NO: 77312 - RNA, 22 nt, Human
ugggaagagaaaguuaucaaga

SEQ ID NO: 77313 - RNA, 22 nt, Human
cacugcacuccagccucagcaa

SEQ ID NO: 77314 - RNA, 27 nt, Human
ugaaacaauguuuuuauagauggugug

SEQ ID NO: 77315 - RNA, 32 nt, Human
ggggaagaaaaaggaaaaccuauuaaaaaaua

SEQ ID NO: 77316 - RNA, 24 nt, Human
aauaggaguuacagaaaacuguua

SEQ ID NO: 77317 - RNA, 30 nt, Human
cccaggacccucucccuuguggacaggcag

SEQ ID NO: 77318 - RNA, 24 nt, Human
cccuggaaauaacugagcacuuug

SEQ ID NO: 77319 - RNA, 31 nt, Human
ggagcggcgccaagagaggagccgagaaagu

SEQ ID NO: 77320 - RNA, 24 nt, Human
uuugcccuuccagcagugacccuc

SEQ ID NO: 77321 - RNA, 26 nt, Human
gcaaagcaagccacaccaugggugag

SEQ ID NO: 77322 - RNA, 26 nt, Human
caggcagcagcgaaagcuuguuagga

SEQ ID NO: 77323 - RNA, 22 nt, Human
cacuucgauaacccuaacgaac

SEQ ID NO: 77324 - RNA, 17 nt, Human
cccauaaaaauauuuua

SEQ ID NO: 77325 - RNA, 21 nt, Human
uaucaugucuugugcauaauu

SEQ ID NO: 77326 - RNA, 27 nt, Human
ugaaggaaugcucaguuucauuugcca

SEQ ID NO: 77327 - RNA, 22 nt, Human
cuguggggcauuggauccuccc

SEQ ID NO: 77328 - RNA, 23 nt, Human
gagggaugauggauaagagggug

SEQ ID NO: 77329 - RNA, 22 nt, Human
gcuaggaacugcuuuuggcacu

SEQ ID NO: 77330 - RNA, 27 nt, Human
ccuguuuccuguuuuuaagauuuugcc

SEQ ID NO: 77331 - RNA, 21 nt, Human
ucuuccuuccuccucccgguc

SEQ ID NO: 77332 - RNA, 24 nt, Human
acucagucuccuacauuagcauuc

SEQ ID NO: 77333 - RNA, 24 nt, Human
gcuagccucagccuccauuguggu

SEQ ID NO: 77334 - RNA, 21 nt, Human
aggaagauggagaaugaggaa

SEQ ID NO: 77335 - RNA, 21 nt, Human
gugggaaaguggaguccaccc

SEQ ID NO: 77336 - RNA, 22 nt, Human
agacauuuaaauacacaaucac

SEQ ID NO: 77337 - RNA, 18 nt, Human
cauaauaaaacaccaaga

SEQ ID NO: 77338 - RNA, 28 nt, Human
gcagagagccaagcaucuucccugggaa

SEQ ID NO: 77339 - RNA, 24 nt, Human
ggucugagguggacucccaccucc

SEQ ID NO: 77340 - RNA, 26 nt, Human
augcagcuguuuuaacuaucccugcc

SEQ ID NO: 77341 - RNA, 23 nt, Human
cuugcagacugagcgaugacacc

SEQ ID NO: 77342 - RNA, 20 nt, Human
uugucccucaggcuuguugc

SEQ ID NO: 77343 - RNA, 20 nt, Human
gcuagucaagcuccuccucc

SEQ ID NO: 77344 - RNA, 24 nt, Human
cgccccggaacguguccaggagga

SEQ ID NO: 77345 - RNA, 20 nt, Human
guugcccaggcuagucugga

SEQ ID NO: 77346 - RNA, 29 nt, Human
cucacaggagcuacaggccggagacuggg

SEQ ID NO: 77347 - RNA, 25 nt, Human
aucuucugccuuucacuugcaucca

SEQ ID NO: 77348 - RNA, 23 nt, Human
accagaaaccacauguauuugca

SEQ ID NO: 77349 - RNA, 22 nt, Human
cccuucaggcuaagucucaggc

SEQ ID NO: 77350 - RNA, 23 nt, Human
uuugcggaaaauacaguaccgug

SEQ ID NO: 77351 - RNA, 19 nt, Human
ggacuuucacccagcacug

SEQ ID NO: 77352 - RNA, 21 nt, Human
aggcuauccaguagagcccag

SEQ ID NO: 77353 - RNA, 22 nt, Human
guugcccaggauggagugcagu

SEQ ID NO: 77354 - RNA, 19 nt, Human
cuguaaaauauagucgcug

SEQ ID NO: 77355 - RNA, 23 nt, Human
ugucucccaggcugaagugcagu

SEQ ID NO: 77356 - RNA, 31 nt, Human
guggggggugcaggugggcacuggagcaugc

SEQ ID NO: 77357 - RNA, 25 nt, Human
cacuaccaggcugugggucugcacc

SEQ ID NO: 77358 - RNA, 23 nt, Human
gguagggaaagcggaagguagaa

SEQ ID NO: 77359 - RNA, 20 nt, Human
ggugcgagucugggaaaggc

SEQ ID NO: 77360 - RNA, 29 nt, Human
aaacccacgcguguucugaaggugcccag

SEQ ID NO: 77361 - RNA, 24 nt, Human
acuaccugaauucuaccugcauuu

SEQ ID NO: 77362 - RNA, 19 nt, Human
cugguuugcccucuaccuc

SEQ ID NO: 77363 - RNA, 20 nt, Human
cauugugccuucugugugua

SEQ ID NO: 77364 - RNA, 22 nt, Human
aauuauuuuuguccauguaaua

SEQ ID NO: 77365 - RNA, 24 nt, Human
gagagugugaaauagacauuugua

SEQ ID NO: 77366 - RNA, 20 nt, Human
gccuucugacaaaguuuaca

SEQ ID NO: 77367 - RNA, 22 nt, Human
ugaacaucugggaauccuguua

SEQ ID NO: 77368 - RNA, 26 nt, Human
gccuguauagacagcacuuggcuccu

SEQ ID NO: 77369 - RNA, 24 nt, Human
cugccugagcucugggccuuagcu

SEQ ID NO: 77370 - RNA, 22 nt, Human
ucuauuaucuccaaccucucuu

SEQ ID NO: 77371 - RNA, 23 nt, Human
uaggcuagaaacaaaaaguuaga

SEQ ID NO: 77372 - RNA, 21 nt, Human
uacuccugggcucaagcaauc

SEQ ID NO: 77373 - RNA, 27 nt, Human
guggcguggaaagauggcaaaaagagc

SEQ ID NO: 77374 - RNA, 22 nt, Human
ucucauguagaacaagaaaucu

SEQ ID NO: 77375 - RNA, 21 nt, Human
uuauauuuuucuuucucuuuc

SEQ ID NO: 77376 - RNA, 24 nt, Human
uguuuuuagaaucauuaccuuuua

SEQ ID NO: 77377 - RNA, 27 nt, Human
gggagagaagauuggcgcugggugccg

SEQ ID NO: 77378 - RNA, 23 nt, Human
gccacaacugucuagggcucaga

SEQ ID NO: 77379 - RNA, 22 nt, Human
gggaggagggaggcugggaggc

SEQ ID NO: 77380 - RNA, 22 nt, Human
gccugugaucccagcauuuugg

SEQ ID NO: 77381 - RNA, 22 nt, Human
aaagugcugggauuaccggcuu

SEQ ID NO: 77382 - RNA, 19 nt, Human
uccugcucucccauccacc

SEQ ID NO: 77383 - RNA, 23 nt, Human
aggagcugcucacuaccuccuca

SEQ ID NO: 77384 - RNA, 22 nt, Human
cucgcccaggcuggagugcagu

SEQ ID NO: 77385 - RNA, 25 nt, Human
aacuauacauguuuuuuacuaaauc

SEQ ID NO: 77386 - RNA, 26 nt, Human
agaaaggcucaaaaggaagcacuuuu

SEQ ID NO: 77387 - RNA, 20 nt, Human
gacuauguuuggaguuuaau

SEQ ID NO: 77388 - RNA, 23 nt, Human
ggcgggcaagggggacagccagc

SEQ ID NO: 77389 - RNA, 21 nt, Human
ccauuucucccugucuguccc

SEQ ID NO: 77390 - RNA, 22 nt, Human
ucccacccucccccaugcugcc

SEQ ID NO: 77391 - RNA, 27 nt, Human
cucggggccucggagcaaccacccgag

SEQ ID NO: 77392 - RNA, 22 nt, Human
ucuuucuccaccccgccgagcc

SEQ ID NO: 77393 - RNA, 25 nt, Human
cugucucccaggcuggaggucagug

SEQ ID NO: 77394 - RNA, 22 nt, Human
cugggagccaggcagggccagg

SEQ ID NO: 77395 - RNA, 21 nt, Human
uuugggaaaagaaggggcuga

SEQ ID NO: 77396 - RNA, 27 nt, Human
agagacacucagaaggacuucccugac

SEQ ID NO: 77397 - RNA, 27 nt, Human
gcugggaugcaauguaggcugagggaa

SEQ ID NO: 77398 - RNA, 22 nt, Human
uacccuuuaacaucugugacua

SEQ ID NO: 77399 - RNA, 21 nt, Human
ggguuuuccaugaaaugugau

SEQ ID NO: 77400 - RNA, 24 nt, Human
ggaaaaauaaaggaaauucagauu

SEQ ID NO: 77401 - RNA, 19 nt, Human
cuggaacccaggugagggc

SEQ ID NO: 77402 - RNA, 23 nt, Human
gccagcccagagagaaacuaucu

SEQ ID NO: 77403 - RNA, 23 nt, Human
uucugauuuuuaauuucuaugga

SEQ ID NO: 77404 - RNA, 21 nt, Human
gaggggggcucaggaggagga

SEQ ID NO: 77405 - RNA, 19 nt, Human
ucauuugucacacacuuug

SEQ ID NO: 77406 - RNA, 25 nt, Human
acagcucucuuucccccuugcuaug

SEQ ID NO: 77407 - RNA, 22 nt, Human
aggcugaggcagguggaucgcc

SEQ ID NO: 77408 - RNA, 22 nt, Human
uacccugcuaggcucuggagcu

SEQ ID NO: 77409 - RNA, 32 nt, Human
gcaucacaguuuugcaaccucugcuccaaaga

SEQ ID NO: 77410 - RNA, 26 nt, Human
ugugaagccuuuaucuaugggagauu

SEQ ID NO: 77411 - RNA, 22 nt, Human
ccaguuucuucuuacacuucuu

SEQ ID NO: 77412 - RNA, 23 nt, Human
gccuccucggggcuccaggcugg

SEQ ID NO: 77413 - RNA, 22 nt, Human
acuugucacaccuuuuguuuca

SEQ ID NO: 77414 - RNA, 31 nt, Human
ccucguccucauguccccuuguccugucacc

SEQ ID NO: 77415 - RNA, 23 nt, Human
uuugggccugcauagugccauga

SEQ ID NO: 77416 - RNA, 24 nt, Human
uguuagugccaccaccuucugaac

SEQ ID NO: 77417 - RNA, 21 nt, Human
auggggaccaggcucagaguu

SEQ ID NO: 77418 - RNA, 26 nt, Human
uucauucucucugaacacacauugcu

SEQ ID NO: 77419 - RNA, 22 nt, Human
agaggcguccugggugaaggaa

SEQ ID NO: 77420 - RNA, 19 nt, Human
uuucuuucucuccccauua

SEQ ID NO: 77421 - RNA, 25 nt, Human
ccuugggagagaugccuuccaggca

SEQ ID NO: 77422 - RNA, 25 nt, Human
gggaggcugaggcagcauugcuuga

SEQ ID NO: 77423 - RNA, 20 nt, Human
gcugccuccccucuccuucc

SEQ ID NO: 77424 - RNA, 26 nt, Human
gggguuagaguggggagugggcuucu

SEQ ID NO: 77425 - RNA, 25 nt, Human
uucuauauuuuacauucuuggaaag

SEQ ID NO: 77426 - RNA, 22 nt, Human
acuuaacuguuugggagcugga

SEQ ID NO: 77427 - RNA, 26 nt, Human
cagaaagccuauuccaucaacuguga

SEQ ID NO: 77428 - RNA, 26 nt, Human
ucgcccaggcuggagugcaaugcacg

SEQ ID NO: 77429 - RNA, 21 nt, Human
ucauggagaagaaauggggua

SEQ ID NO: 77430 - RNA, 21 nt, Human
agagaucuacccaucucaccu

SEQ ID NO: 77431 - RNA, 27 nt, Human
augacaccugccgcugccccucggggc

SEQ ID NO: 77432 - RNA, 22 nt, Human
acaugccaagcacugugcucag

SEQ ID NO: 77433 - RNA, 21 nt, Human
gagcgcccaguucagacuggg

SEQ ID NO: 77434 - RNA, 22 nt, Human
ccaggguugucuuuauauucuu

SEQ ID NO: 77435 - RNA, 24 nt, Human
cuucuguuauguuuugucuugaau

SEQ ID NO: 77436 - RNA, 24 nt, Human
ucaagguugcagcaagaggacuga

SEQ ID NO: 77437 - RNA, 18 nt, Human
uuucugcuguuucccaau

SEQ ID NO: 77438 - RNA, 20 nt, Human
cagacuagggccuucaccuc

SEQ ID NO: 77439 - RNA, 21 nt, Human
ucuuuuacaacuccugcugug

SEQ ID NO: 77440 - RNA, 26 nt, Human
cacaaugacagaaaugacaacaaggc

SEQ ID NO: 77441 - RNA, 26 nt, Human
gccaggcucagagcugagauguggcc

SEQ ID NO: 77442 - RNA, 23 nt, Human
ucaagagcuuacauaauuuuaac

SEQ ID NO: 77443 - RNA, 22 nt, Human
ugcaacgucugccuccuggguu

SEQ ID NO: 77444 - RNA, 24 nt, Human
aagagguggcggcgggcagagggu

SEQ ID NO: 77445 - RNA, 20 nt, Human
ucuugauaguccugaccuca

SEQ ID NO: 77446 - RNA, 22 nt, Human
gugugagccacagcaccuggcc

SEQ ID NO: 77447 - RNA, 22 nt, Human
caacccaggauacaaacuucca

SEQ ID NO: 77448 - RNA, 18 nt, Human
ugucaaguuagaaauacu

SEQ ID NO: 77449 - RNA, 30 nt, Human
ugcaggagggguggcugaaaccaccauccu

SEQ ID NO: 77450 - RNA, 21 nt, Human
gguacugcagcuuccuccaca

SEQ ID NO: 77451 - RNA, 16 nt, Human
cuccccucaccaggag

SEQ ID NO: 77452 - RNA, 27 nt, Human
gaguuuucuuuaguauagccacaaaug

SEQ ID NO: 77453 - RNA, 22 nt, Human
cgcccccgcggcuggagggugg

SEQ ID NO: 77454 - RNA, 20 nt, Human
ggaggaggaggcugcaguga

SEQ ID NO: 77455 - RNA, 24 nt, Human
cugccucuccucuggcccugggaa

SEQ ID NO: 77456 - RNA, 22 nt, Human
gaaccucugggcucaagcaauu

SEQ ID NO: 77457 - RNA, 22 nt, Human
gauucuaaucccacugcugaca

SEQ ID NO: 77458 - RNA, 21 nt, Human
ccgguuuccaaagacagucuu

SEQ ID NO: 77459 - RNA, 18 nt, Human
uucaggaggcuuguaguu

SEQ ID NO: 77460 - RNA, 18 nt, Human
cgggggcagaaagacuga

SEQ ID NO: 77461 - RNA, 23 nt, Human
uuguuccugccuuuagaguucca

SEQ ID NO: 77462 - RNA, 19 nt, Human
ugcuuuuucucccuccucc

SEQ ID NO: 77463 - RNA, 27 nt, Human
gucucuagccacuuuggucccgugcag

SEQ ID NO: 77464 - RNA, 25 nt, Human
gcccagacuggagugcagugguggg

SEQ ID NO: 77465 - RNA, 25 nt, Human
ucuauggcauggugaaaaggucagu

SEQ ID NO: 77466 - RNA, 25 nt, Human
gacuacaggggaguuuuguugaagu

SEQ ID NO: 77467 - RNA, 22 nt, Human
gggagcccugcuggagcugcuc

SEQ ID NO: 77468 - RNA, 27 nt, Human
ccugcuuauugccucuuucucagaauc

SEQ ID NO: 77469 - RNA, 25 nt, Human
ugugucacuuuaauacaggaaauuu

SEQ ID NO: 77470 - RNA, 20 nt, Human
agcugacaaagauguucuuc

SEQ ID NO: 77471 - RNA, 25 nt, Human
uagagggaggagaaugagccucggc

SEQ ID NO: 77472 - RNA, 24 nt, Human
cagauucuuaagccaacaaaagug

SEQ ID NO: 77473 - RNA, 23 nt, Human
cuaaaauagacguggagcaagag

SEQ ID NO: 77474 - RNA, 27 nt, Human
aacacaaaagcccaccaggcugcugcu

SEQ ID NO: 77475 - RNA, 23 nt, Human
gauggccaugaagaggaugcugu

SEQ ID NO: 77476 - RNA, 27 nt, Human
cccagcacuuguguguacagcccccgu

SEQ ID NO: 77477 - RNA, 22 nt, Human
caugccuguaauccgagcacuu

SEQ ID NO: 77478 - RNA, 26 nt, Human
ggagaggugccuggcuucuaccuggg

SEQ ID NO: 77479 - RNA, 22 nt, Human
aacugcagguccagugcaggca

SEQ ID NO: 77480 - RNA, 24 nt, Human
ggcucaagcgauucucccaccuca

SEQ ID NO: 77481 - RNA, 26 nt, Human
uucugagccauuuauucugcuacacu

SEQ ID NO: 77482 - RNA, 22 nt, Human
aguaaaucucuauauuaacauu

SEQ ID NO: 77483 - RNA, 18 nt, Human
uuuuccucucucugccuc

SEQ ID NO: 77484 - RNA, 21 nt, Human
auuauauuuacaaaugggaaa

SEQ ID NO: 77485 - RNA, 20 nt, Human
ccagcccaguucuggaaggg

SEQ ID NO: 77486 - RNA, 20 nt, Human
uguugccuauucaguguuac

SEQ ID NO: 77487 - RNA, 22 nt, Human
cugguggcaagagggaauguca

SEQ ID NO: 77488 - RNA, 23 nt, Human
agguucuagaauagaagggcugc

SEQ ID NO: 77489 - RNA, 26 nt, Human
gacuccuggcauuugccuuaaggacc

SEQ ID NO: 77490 - RNA, 21 nt, Human
caugggcuucacgcagaagag

SEQ ID NO: 77491 - RNA, 20 nt, Human
accagcaccacucagccugc

SEQ ID NO: 77492 - RNA, 22 nt, Human
gcucacugcagccuugaacucc

SEQ ID NO: 77493 - RNA, 24 nt, Human
aaauuauuuuauaucauacaguuu

SEQ ID NO: 77494 - RNA, 21 nt, Human
gcucgugugccauccauaucc

SEQ ID NO: 77495 - RNA, 21 nt, Human
aguuuucuagaagguugggau

SEQ ID NO: 77496 - RNA, 31 nt, Human
ccuaacagcucuguucccuccugcuuugguu

SEQ ID NO: 77497 - RNA, 16 nt, Human
uuucuguauugcagug

SEQ ID NO: 77498 - RNA, 25 nt, Human
uaggucuuucucucagugaaggugg

SEQ ID NO: 77499 - RNA, 20 nt, Human
uacauggucagugggcuuuu

SEQ ID NO: 77500 - RNA, 20 nt, Human
aaggagcaaccaaaauguca

SEQ ID NO: 77501 - RNA, 22 nt, Human
ugucauccaggcuggagugcgg

SEQ ID NO: 77502 - RNA, 22 nt, Human
ugucguccaggcuggagugcag

SEQ ID NO: 77503 - RNA, 22 nt, Human
ggaugcaggagccuccuccuca

SEQ ID NO: 77504 - RNA, 27 nt, Human
uguuuuuaaaaaauucauuuugcagaa

SEQ ID NO: 77505 - RNA, 19 nt, Human
gccugccccuccuccagcc

SEQ ID NO: 77506 - RNA, 24 nt, Human
aagagagaguccucagcagagucu

SEQ ID NO: 77507 - RNA, 19 nt, Human
ccugcccaccagccuguga

SEQ ID NO: 77508 - RNA, 23 nt, Human
ugcuguuguagcagguuuuaacu

SEQ ID NO: 77509 - RNA, 20 nt, Human
uguaugggagauggcagcag

SEQ ID NO: 77510 - RNA, 24 nt, Human
aggggcgacaccuuccucccagga

SEQ ID NO: 77511 - RNA, 30 nt, Human
ccuagcccaacuucccuugugggaaacuga

SEQ ID NO: 77512 - RNA, 29 nt, Human
ggggcagagucucuggcagagguuauuaa

SEQ ID NO: 77513 - RNA, 23 nt, Human
cucagaucuucuguggguuucua

SEQ ID NO: 77514 - RNA, 20 nt, Human
aggggcuucagaaaaggagu

SEQ ID NO: 77515 - RNA, 24 nt, Human
acuucuaucauggaaaguguacua

SEQ ID NO: 77516 - RNA, 28 nt, Human
caaggcuaaacugccuggaacagaaucc

SEQ ID NO: 77517 - RNA, 21 nt, Human
uggaacuaguguuaaguaucu

SEQ ID NO: 77518 - RNA, 26 nt, Human
ucuccuuggccacagacugaacucgc

SEQ ID NO: 77519 - RNA, 20 nt, Human
augaggaacugcaccuuuag

SEQ ID NO: 77520 - RNA, 22 nt, Human
ggggagaagagaacauuagacu

SEQ ID NO: 77521 - RNA, 22 nt, Human
guccagcuggaaucaaccgaug

SEQ ID NO: 77522 - RNA, 23 nt, Human
ugcacacacacccauaccucuca

SEQ ID NO: 77523 - RNA, 19 nt, Human
uagauguguuuuuauuccu

SEQ ID NO: 77524 - RNA, 21 nt, Human
cuguugcucuggcuuccuuuc

SEQ ID NO: 77525 - RNA, 20 nt, Human
uaaaugaaagaacaaugaag

SEQ ID NO: 77526 - RNA, 22 nt, Human
gcuuccuuaacugcaagugaga

SEQ ID NO: 77527 - RNA, 22 nt, Human
acaaagugcaaagcugcuugaa

SEQ ID NO: 77528 - RNA, 20 nt, Human
gacuauucauggcuaccuca

SEQ ID NO: 77529 - RNA, 26 nt, Human
ccucggccugcccaagaguccaccag

SEQ ID NO: 77530 - RNA, 27 nt, Human
ugcagaagucuggaaaccuggguccua

SEQ ID NO: 77531 - RNA, 21 nt, Human
ggccacaugccuggucacuga

SEQ ID NO: 77532 - RNA, 22 nt, Human
aaacaccuguguuaaugcuuug

SEQ ID NO: 77533 - RNA, 24 nt, Human
ggcccacauaucuaucucuugccu

SEQ ID NO: 77534 - RNA, 27 nt, Human
ccaccucuuccucuaucagggacagug

SEQ ID NO: 77535 - RNA, 22 nt, Human
uuucucacagcaaugaauuugc

SEQ ID NO: 77536 - RNA, 24 nt, Human
uucccagacacacuuauucugggu

SEQ ID NO: 77537 - RNA, 26 nt, Human
caugaucuuagcuucuuuaaucagac

SEQ ID NO: 77538 - RNA, 20 nt, Human
ccuucucuggugauaacucc

SEQ ID NO: 77539 - RNA, 25 nt, Human
ggagcagggagagugcgcucccggc

SEQ ID NO: 77540 - RNA, 20 nt, Human
ggaaggcaaaguuuucuggg

SEQ ID NO: 77541 - RNA, 27 nt, Human
ugagaggagcuaucacaugggagccgg

SEQ ID NO: 77542 - RNA, 21 nt, Human
ggagcaggggugggaggcagg

SEQ ID NO: 77543 - RNA, 26 nt, Human
ggcacaucuucauucuuuuuauguag

SEQ ID NO: 77544 - RNA, 22 nt, Human
ucaggaggcauaguuuuuagug

SEQ ID NO: 77545 - RNA, 25 nt, Human
cccuccguaggagcucacagucuag

SEQ ID NO: 77546 - RNA, 21 nt, Human
ggcugagagcaggaacaacgc

SEQ ID NO: 77547 - RNA, 27 nt, Human
ggggcugcuuaacacaaacagccucag

SEQ ID NO: 77548 - RNA, 23 nt, Human
uuucuagacccuucaucucuuac

SEQ ID NO: 77549 - RNA, 27 nt, Human
uucuccuccucucccuuggagagcccg

SEQ ID NO: 77550 - RNA, 21 nt, Human
aagcaaaaugaaaagcacuua

SEQ ID NO: 77551 - RNA, 22 nt, Human
cuucccuuuuaaccccuaguca

SEQ ID NO: 77552 - RNA, 24 nt, Human
cugucaccgcuguucccagacaca

SEQ ID NO: 77553 - RNA, 21 nt, Human
uucuguuaggaaaagccauac

SEQ ID NO: 77554 - RNA, 22 nt, Human
cccucacagguuucuccagaaa

SEQ ID NO: 77555 - RNA, 23 nt, Human
gcuuagcucucucccuccugacc

SEQ ID NO: 77556 - RNA, 21 nt, Human
aaaguuuaucaccccaaagag

SEQ ID NO: 77557 - RNA, 26 nt, Human
uugcccuuugcccuccagucuccccu

SEQ ID NO: 77558 - RNA, 24 nt, Human
gcggcaccuggaaugaucaacuca

SEQ ID NO: 77559 - RNA, 22 nt, Human
gcugcuugggacguguacagca

SEQ ID NO: 77560 - RNA, 22 nt, Human
uagggcugaggcuggggucucu

SEQ ID NO: 77561 - RNA, 20 nt, Human
gcugcuuggaaaacugucca

SEQ ID NO: 77562 - RNA, 25 nt, Human
ccagugacuuucaggaauugcccau

SEQ ID NO: 77563 - RNA, 25 nt, Human
gacuucuccuuggggaucugggagc

SEQ ID NO: 77564 - RNA, 26 nt, Human
augccuaaagaagucacaggcuggcu

SEQ ID NO: 77565 - RNA, 23 nt, Human
ggaucuggcccugggccugcagc

SEQ ID NO: 77566 - RNA, 22 nt, Human
aaaauguuaggagaaaaauuaa

SEQ ID NO: 77567 - RNA, 27 nt, Human
gccacuggcucuggucuaaagugccug

SEQ ID NO: 77568 - RNA, 25 nt, Human
gacuccuggcauuugccuuaaggac

SEQ ID NO: 77569 - RNA, 18 nt, Human
aagacaccuuccuuucca

SEQ ID NO: 77570 - RNA, 23 nt, Human
ccgggagguggagauugcaguga

SEQ ID NO: 77571 - RNA, 24 nt, Human
cuucuuuuaauguaaucauuuuga

SEQ ID NO: 77572 - RNA, 21 nt, Human
guagggaguccacggagaaga

SEQ ID NO: 77573 - RNA, 21 nt, Human
gcugccuccagacagcaccug

SEQ ID NO: 77574 - RNA, 21 nt, Human
gcugcugcagcucccuccuca

SEQ ID NO: 77575 - RNA, 24 nt, Human
ccacugucucuaaccacuccuggg

SEQ ID NO: 77576 - RNA, 22 nt, Human
cuucauuucuuuuucauuugac

SEQ ID NO: 77577 - RNA, 21 nt, Human
aacugaugcuuucucacuguc

SEQ ID NO: 77578 - RNA, 22 nt, Human
ucuccacccucccagaccugcc

SEQ ID NO: 77579 - RNA, 20 nt, Human
cucaaagcugggauuacagg

SEQ ID NO: 77580 - RNA, 23 nt, Human
ucauauuuaaaugaggguuuaca

SEQ ID NO: 77581 - RNA, 21 nt, Human
accagccugguaaaauaguga

SEQ ID NO: 77582 - RNA, 17 nt, Human
augucucaagugcaaug

SEQ ID NO: 77583 - RNA, 22 nt, Human
uucuauaauuuccauuuacuua

SEQ ID NO: 77584 - RNA, 21 nt, Human
uuccucccucccugcagggua

SEQ ID NO: 77585 - RNA, 22 nt, Human
ccaagaucgcggcauugcacuu

SEQ ID NO: 77586 - RNA, 27 nt, Human
guuucuugcaaagacuuuccucucuuu

SEQ ID NO: 77587 - RNA, 22 nt, Human
ccuacuuccuugucuuugaaau

SEQ ID NO: 77588 - RNA, 25 nt, Human
uucuuucguuaaagauuugcuuuau

SEQ ID NO: 77589 - RNA, 22 nt, Human
uaaucaggaguuagaauucucu

SEQ ID NO: 77590 - RNA, 20 nt, Human
gcuugaccccucuagccccu

SEQ ID NO: 77591 - RNA, 23 nt, Human
gucagucaggaugacacuucggc

SEQ ID NO: 77592 - RNA, 25 nt, Human
ggaggauuugaccuuuucugagcua

SEQ ID NO: 77593 - RNA, 23 nt, Human
uuccagcaauucuccugccucag

SEQ ID NO: 77594 - RNA, 21 nt, Human
ggaggucagggcugcagugag

SEQ ID NO: 77595 - RNA, 19 nt, Human
cugcagcugcucgguugcc

SEQ ID NO: 77596 - RNA, 27 nt, Human
ccaaauaccuggacuaucaaccuuguu

SEQ ID NO: 77597 - RNA, 25 nt, Human
uauaugugccccuuccccaugcuca

SEQ ID NO: 77598 - RNA, 16 nt, Human
gcacccacaccccccg

SEQ ID NO: 77599 - RNA, 23 nt, Human
ggacaggcaaggggaguuggcgc

SEQ ID NO: 77600 - RNA, 26 nt, Human
ugcccaggcuggucagagcucagcac

SEQ ID NO: 77601 - RNA, 22 nt, Human
aucacuaugcauuucuacacau

SEQ ID NO: 77602 - RNA, 18 nt, Human
ugugguuuuaucuacguu

SEQ ID NO: 77603 - RNA, 27 nt, Human
acucaggguaugcuaucuggaggccug

SEQ ID NO: 77604 - RNA, 22 nt, Human
cucagccucccaaguaguuagg

SEQ ID NO: 77605 - RNA, 22 nt, Human
ggcacugauguuugaacuggaa

SEQ ID NO: 77606 - RNA, 26 nt, Human
caaugccaccagagaacgugauguca

SEQ ID NO: 77607 - RNA, 22 nt, Human
gugauguuugccauuugcugga

SEQ ID NO: 77608 - RNA, 21 nt, Human
uguuuuucauaccaguaccug

SEQ ID NO: 77609 - RNA, 26 nt, Human
aaaacaaucugcccaccgacccccuu

SEQ ID NO: 77610 - RNA, 27 nt, Human
ggcuucuaguuagcugcuuuaaaucua

SEQ ID NO: 77611 - RNA, 27 nt, Human
ucccugccucuugucacaaacugcccc

SEQ ID NO: 77612 - RNA, 25 nt, Human
uucacccacuuccagcuccacuucu

SEQ ID NO: 77613 - RNA, 24 nt, Human
cugucccuucugcuggcucaggga

SEQ ID NO: 77614 - RNA, 28 nt, Human
agaaaaucuaagacaguucuuucugcua

SEQ ID NO: 77615 - RNA, 21 nt, Human
gggucccuucccccugcucca

SEQ ID NO: 77616 - RNA, 24 nt, Human
caggcaccuguaaucccagcugcc

SEQ ID NO: 77617 - RNA, 24 nt, Human
cgcgggcccugaggcucaaagggg

SEQ ID NO: 77618 - RNA, 25 nt, Human
gguuggauagccuaucaguuuaugg

SEQ ID NO: 77619 - RNA, 25 nt, Human
uguccguuugaaacuccuagcucau

SEQ ID NO: 77620 - RNA, 22 nt, Human
cuaguuacuaaacauguaugua

SEQ ID NO: 77621 - RNA, 24 nt, Human
augcccagguucagguguaucgug

SEQ ID NO: 77622 - RNA, 27 nt, Human
augaaggaaugucuucaaucauauuuu

SEQ ID NO: 77623 - RNA, 19 nt, Human
ggccuccuaucuuuaguca

SEQ ID NO: 77624 - RNA, 21 nt, Human
uguccuccucugugucccggc

SEQ ID NO: 77625 - RNA, 27 nt, Human
ccugggcaacagagcaagacuucgucu

SEQ ID NO: 77626 - RNA, 27 nt, Human
ccugggcaacagagcgagacuucaucu

SEQ ID NO: 77627 - RNA, 18 nt, Human
cccagcaugauucuuggc

SEQ ID NO: 77628 - RNA, 25 nt, Human
uggcaauggaugccauucacaucgg

SEQ ID NO: 77629 - RNA, 22 nt, Human
cuucucucccgcagcugccuca

SEQ ID NO: 77630 - RNA, 23 nt, Human
ccacuaaaccacagcuguccccu

SEQ ID NO: 77631 - RNA, 31 nt, Human
gaguugcgggagagagaaggagcaggcacgc

SEQ ID NO: 77632 - RNA, 22 nt, Human
aguguugaaguugacuugcucc

SEQ ID NO: 77633 - RNA, 22 nt, Human
gccuguauugccugcaugcugc

SEQ ID NO: 77634 - RNA, 20 nt, Human
cuuacucccaggcacugucu

SEQ ID NO: 77635 - RNA, 23 nt, Human
aggauuuggagaauaagugugua

SEQ ID NO: 77636 - RNA, 27 nt, Human
gcacagccuacugaccccaaggagccu

SEQ ID NO: 77637 - RNA, 22 nt, Human
guauugucauuuggagaaacaa

SEQ ID NO: 77638 - RNA, 24 nt, Human
ugcagugugacauggacuugcugu

SEQ ID NO: 77639 - RNA, 21 nt, Human
acuuggggauggcugagggaa

SEQ ID NO: 77640 - RNA, 22 nt, Human
aagcagaauucugcauggugac

SEQ ID NO: 77641 - RNA, 29 nt, Human
caagucggugccacuagcccaggcagagc

SEQ ID NO: 77642 - RNA, 21 nt, Human
ucucucugugucugugccaag

SEQ ID NO: 77643 - RNA, 24 nt, Human
aacaggcguucucagccuccggau

SEQ ID NO: 77644 - RNA, 22 nt, Human
gcaugauggugguagagcugga

SEQ ID NO: 77645 - RNA, 23 nt, Human
ugcaacacaggaaacgaugggac

SEQ ID NO: 77646 - RNA, 19 nt, Human
auugaucucugaaugugau

SEQ ID NO: 77647 - RNA, 25 nt, Human
gccauccgucaccagaauuaguccu

SEQ ID NO: 77648 - RNA, 22 nt, Human
gcauucuuaaaggaaugcagug

SEQ ID NO: 77649 - RNA, 21 nt, Human
gggagagacagagggagagug

SEQ ID NO: 77650 - RNA, 25 nt, Human
aaggucugcaagaaccugacucguc

SEQ ID NO: 77651 - RNA, 21 nt, Human
ggaguagccaccagccuccca

SEQ ID NO: 77652 - RNA, 26 nt, Human
ccaccacaccuggccccaagcuugaa

SEQ ID NO: 77653 - RNA, 23 nt, Human
ccuuccaggcuggauuuuuaaug

SEQ ID NO: 77654 - RNA, 21 nt, Human
aucaggguuggucccuucuaa

SEQ ID NO: 77655 - RNA, 28 nt, Human
aacagacaaaagccuuugccuucaugaa

SEQ ID NO: 77656 - RNA, 19 nt, Human
auccaaaaucaggguuugg

SEQ ID NO: 77657 - RNA, 22 nt, Human
uugccugaaguuggagugagug

SEQ ID NO: 77658 - RNA, 20 nt, Human
agagguuuaccucccuacuu

SEQ ID NO: 77659 - RNA, 21 nt, Human
cacaggcuguugagguuuuua

SEQ ID NO: 77660 - RNA, 31 nt, Human
gaaugcagcugaagaccuguuauguagagga

SEQ ID NO: 77661 - RNA, 26 nt, Human
ggagagaaguuagggcuggcacaccu

SEQ ID NO: 77662 - RNA, 20 nt, Human
uucuacuuguucuaaaacaa

SEQ ID NO: 77663 - RNA, 21 nt, Human
guuaugaguuugguugcagug

SEQ ID NO: 77664 - RNA, 22 nt, Human
cuaccacccuguuacaucauaa

SEQ ID NO: 77665 - RNA, 24 nt, Human
aacaucuucagggcgggaaagggg

SEQ ID NO: 77666 - RNA, 19 nt, Human
cuuuggucuuccacaguca

SEQ ID NO: 77667 - RNA, 22 nt, Human
agccucccuaugggaggcagag

SEQ ID NO: 77668 - RNA, 19 nt, Human
uaucacugcaggcuuuccu

SEQ ID NO: 77669 - RNA, 19 nt, Human
ggcagccuggagaaaacca

SEQ ID NO: 77670 - RNA, 21 nt, Human
ucccuccagccucagcuggcu

SEQ ID NO: 77671 - RNA, 22 nt, Human
ggagcucgccaccacacccagc

SEQ ID NO: 77672 - RNA, 24 nt, Human
ccucgaagcugcuguucucuuguc

SEQ ID NO: 77673 - RNA, 20 nt, Human
gcauggauguucacauacag

SEQ ID NO: 77674 - RNA, 23 nt, Human
caucccgcugccucuaccugccu

SEQ ID NO: 77675 - RNA, 25 nt, Human
gggcucaauucuccacucugcucag

SEQ ID NO: 77676 - RNA, 22 nt, Human
aagaucuguauuugauggaaga

SEQ ID NO: 77677 - RNA, 27 nt, Human
uuagaaaacaaaacugccaguuugugc

SEQ ID NO: 77678 - RNA, 23 nt, Human
gggccuggggcuggaggccuggg

SEQ ID NO: 77679 - RNA, 22 nt, Human
gcucacaucuuuccuccugcug

SEQ ID NO: 77680 - RNA, 24 nt, Human
augagugagcuggugugggaugcc

SEQ ID NO: 77681 - RNA, 25 nt, Human
ucguuacccaggguggagugcagug

SEQ ID NO: 77682 - RNA, 21 nt, Human
uguccaucccagcggcuggug

SEQ ID NO: 77683 - RNA, 22 nt, Human
gcaugagccaccacacccagcc

SEQ ID NO: 77684 - RNA, 22 nt, Human
gugugagccaccacaccuggcc

SEQ ID NO: 77685 - RNA, 27 nt, Human
uugaggcugaagagugaggacucuuca

SEQ ID NO: 77686 - RNA, 21 nt, Human
gagaaugcugugcuguggaug

SEQ ID NO: 77687 - RNA, 23 nt, Human
ggagagaggugguagggagcagc

SEQ ID NO: 77688 - RNA, 20 nt, Human
gcuuugcugaauuagucuga

SEQ ID NO: 77689 - RNA, 27 nt, Human
gaccagccugggcagcauagcaagaca

SEQ ID NO: 77690 - RNA, 20 nt, Human
ggcugagaaaugcacaagau

SEQ ID NO: 77691 - RNA, 24 nt, Human
ggaagugaacacuggagugaagaa

SEQ ID NO: 77692 - RNA, 21 nt, Human
aaaaccugcauauuuuguaca

SEQ ID NO: 77693 - RNA, 20 nt, Human
cgaguuccaugucucuuucc

SEQ ID NO: 77694 - RNA, 20 nt, Human
ggaagugcagguugcaguga

SEQ ID NO: 77695 - RNA, 31 nt, Human
gaugggaggguuggauugaacagccagaggg

SEQ ID NO: 77696 - RNA, 20 nt, Human
uggaauaucugagaauugca

SEQ ID NO: 77697 - RNA, 28 nt, Human
ggaggcagggguuccagcacaaaguuua

SEQ ID NO: 77698 - RNA, 20 nt, Human
uauuaucauuucuccuuuaa

SEQ ID NO: 77699 - RNA, 26 nt, Human
ucccagguuauguuuucauaguguuu

SEQ ID NO: 77700 - RNA, 21 nt, Human
gugccugauaccucucagcau

SEQ ID NO: 77701 - RNA, 27 nt, Human
ugccugaacgcuaagaacaugacuucu

SEQ ID NO: 77702 - RNA, 22 nt, Human
gugaacaaaucaaauugcuuaa

SEQ ID NO: 77703 - RNA, 27 nt, Human
guuagugcuuuaugggaagaauaggga

SEQ ID NO: 77704 - RNA, 23 nt, Human
cuugcaagccucuccauccagca

SEQ ID NO: 77705 - RNA, 23 nt, Human
uccacagacuucucuucagccuc

SEQ ID NO: 77706 - RNA, 22 nt, Human
gaccagccuggccaacauggug

SEQ ID NO: 77707 - RNA, 22 nt, Human
ugcuccucccccagcugccacc

SEQ ID NO: 77708 - RNA, 23 nt, Human
ggacacaaacaggcagagaggga

SEQ ID NO: 77709 - RNA, 22 nt, Human
ccagggccaagagaaaggccug

SEQ ID NO: 77710 - RNA, 20 nt, Human
caaauaggagaaaccauaaa

SEQ ID NO: 77711 - RNA, 23 nt, Human
aucaccucaggccaggugcagug

SEQ ID NO: 77712 - RNA, 27 nt, Human
auuagcacauauugaacauuugacuua

SEQ ID NO: 77713 - RNA, 19 nt, Human
uggaugacaaagaaauuga

SEQ ID NO: 77714 - RNA, 22 nt, Human
cagauuuuuuacuuguuaccca

SEQ ID NO: 77715 - RNA, 26 nt, Human
guguccauguguaugcguguccgucu

SEQ ID NO: 77716 - RNA, 17 nt, Human
ucuccauccuuucugcc

SEQ ID NO: 77717 - RNA, 21 nt, Human
acagcuuggaaacuaugcaaa

SEQ ID NO: 77718 - RNA, 19 nt, Human
gcaaucaguuuacucuucc

SEQ ID NO: 77719 - RNA, 20 nt, Human
cauuuggcuggagcccggug

SEQ ID NO: 77720 - RNA, 21 nt, Human
gguuaccauuaugugauguua

SEQ ID NO: 77721 - RNA, 23 nt, Human
acucacagauuccucacacuggg

SEQ ID NO: 77722 - RNA, 27 nt, Human
acugagucugcgggagaagagcggccc

SEQ ID NO: 77723 - RNA, 27 nt, Human
ccaggcaaaggaaauugucaucugcca

SEQ ID NO: 77724 - RNA, 24 nt, Human
uaggaaagaagaaacaaaugcuug

SEQ ID NO: 77725 - RNA, 22 nt, Human
cucagagauggucuccagguga

SEQ ID NO: 77726 - RNA, 21 nt, Human
gcucugaaaugacagcgccac

SEQ ID NO: 77727 - RNA, 23 nt, Human
ucugcagaugaucuucucugguu

SEQ ID NO: 77728 - RNA, 19 nt, Human
agagcugacccaggaaggg

SEQ ID NO: 77729 - RNA, 22 nt, Human
uguggguggaggcugggguguc

SEQ ID NO: 77730 - RNA, 27 nt, Human
ggcuuuggugugccugugaccaccuca

SEQ ID NO: 77731 - RNA, 21 nt, Human
auguaaacugugaagauaguu

SEQ ID NO: 77732 - RNA, 21 nt, Human
uauagcuuuauacucucucca

SEQ ID NO: 77733 - RNA, 22 nt, Human
gcgugagccaccguacccagcc

SEQ ID NO: 77734 - RNA, 23 nt, Human
agccccaucugcuguuccuuggu

SEQ ID NO: 77735 - RNA, 22 nt, Human
aggcugaggugggcagaucauu

SEQ ID NO: 77736 - RNA, 18 nt, Human
gagguggcagagagcuca

SEQ ID NO: 77737 - RNA, 25 nt, Human
ggcaguggggccagagcccaccucc

SEQ ID NO: 77738 - RNA, 26 nt, Human
ugcuggaaguguggggagaacccgga

SEQ ID NO: 77739 - RNA, 22 nt, Human
gaaccugggaggcagagcuugc

SEQ ID NO: 77740 - RNA, 28 nt, Human
uuacucuuucacucaggcuggaauguag

SEQ ID NO: 77741 - RNA, 20 nt, Human
ccgaacuuccccuccucccc

SEQ ID NO: 77742 - RNA, 24 nt, Human
ccagggcagagcuccccuuccugc

SEQ ID NO: 77743 - RNA, 26 nt, Human
uccgacauaaaggaacaguugugcuc

SEQ ID NO: 77744 - RNA, 25 nt, Human
guugcccaggcuagucuggaacucc

SEQ ID NO: 77745 - RNA, 26 nt, Human
ccugguuuguuccucucuccacugaa

SEQ ID NO: 77746 - RNA, 22 nt, Human
cccgaggucaggaauucgagac

SEQ ID NO: 77747 - RNA, 23 nt, Human
cucugauuuuugccucuggauag

SEQ ID NO: 77748 - RNA, 21 nt, Human
uagucuuccuucuuucuuggg

SEQ ID NO: 77749 - RNA, 22 nt, Human
acagugcugggauuacaggcau

SEQ ID NO: 77750 - RNA, 27 nt, Human
uucagccccugcucccauccaguggcc

SEQ ID NO: 77751 - RNA, 25 nt, Human
ccaccuucccuuccucagcaggcca

SEQ ID NO: 77752 - RNA, 21 nt, Human
cccugucucuagccacuuugg

SEQ ID NO: 77753 - RNA, 27 nt, Human
uuuuccuccucugaacuggauuuuaua

SEQ ID NO: 77754 - RNA, 19 nt, Human
ugggaaagacauagaagaa

SEQ ID NO: 77755 - RNA, 22 nt, Human
gagaauuuuauuuauagcuaau

SEQ ID NO: 77756 - RNA, 19 nt, Human
caccuccacucccaccuca

SEQ ID NO: 77757 - RNA, 27 nt, Human
ccuccacugucacauuguaacugaacu

SEQ ID NO: 77758 - RNA, 22 nt, Human
ucaugaguaaaagcacuccaga

SEQ ID NO: 77759 - RNA, 21 nt, Human
ccugcucuucccauguuggcc

SEQ ID NO: 77760 - RNA, 22 nt, Human
augaucuuagcucacugcaacc

SEQ ID NO: 77761 - RNA, 28 nt, Human
uaacuauuguauuucuaucauacauucc

SEQ ID NO: 77762 - RNA, 20 nt, Human
cucuccuccgcugucaugcc

SEQ ID NO: 77763 - RNA, 22 nt, Human
gggacuuggcugcaguucugca

SEQ ID NO: 77764 - RNA, 19 nt, Human
gcuuugugaaaugugcaaa

SEQ ID NO: 77765 - RNA, 19 nt, Human
aagaaggaaaaauuccagg

SEQ ID NO: 77766 - RNA, 26 nt, Human
gagaggcagaucaagauaugguucca

SEQ ID NO: 77767 - RNA, 21 nt, Human
auggugauuuuaaauguguga

SEQ ID NO: 77768 - RNA, 18 nt, Human
ucugcucuccuuugaacc

SEQ ID NO: 77769 - RNA, 24 nt, Human
ucuuaaccuugaauccaaaguguc

SEQ ID NO: 77770 - RNA, 27 nt, Human
ccuguucuugcugggcaauggcugaug

SEQ ID NO: 77771 - RNA, 21 nt, Human
cugucucuccuaaaaauacaa

SEQ ID NO: 77772 - RNA, 23 nt, Human
ugcagcucuugggaccguguucu

SEQ ID NO: 77773 - RNA, 22 nt, Human
ugccuucauuuuugaaaguagu

SEQ ID NO: 77774 - RNA, 24 nt, Human
acucuucuguucaccagacacccu

SEQ ID NO: 77775 - RNA, 21 nt, Human
cccgaaggccgacaccacucc

SEQ ID NO: 77776 - RNA, 26 nt, Human
aggacuagcuggaggaacccaguggg

SEQ ID NO: 77777 - RNA, 25 nt, Human
ccugccugggacggucaccuguugc

SEQ ID NO: 77778 - RNA, 26 nt, Human
ugcgacagcuugaacuuuuccuaggg

SEQ ID NO: 77779 - RNA, 23 nt, Human
cacaaaugguaacauauuccaaa

SEQ ID NO: 77780 - RNA, 26 nt, Human
aagccuuuugcaaauaguagaguguc

SEQ ID NO: 77781 - RNA, 20 nt, Human
ggacaguuucagaggccuua

SEQ ID NO: 77782 - RNA, 26 nt, Human
ugcuauuuuggggggcuggagugggu

SEQ ID NO: 77783 - RNA, 24 nt, Human
ugucgccaaguuggagcuugcagu

SEQ ID NO: 77784 - RNA, 23 nt, Human
uugcuuuucccuuccuggagucg

SEQ ID NO: 77785 - RNA, 25 nt, Human
uucccucaccaaaacccagccuugc

SEQ ID NO: 77786 - RNA, 17 nt, Human
acuaagauuaugccuua

SEQ ID NO: 77787 - RNA, 18 nt, Human
cuaucuaguuuguaaaua

SEQ ID NO: 77788 - RNA, 23 nt, Human
uggggacuuuucccauauauuuc

SEQ ID NO: 77789 - RNA, 22 nt, Human
uuccuaugaggcaugcuuuccg

SEQ ID NO: 77790 - RNA, 20 nt, Human
aaggcuggaggcauuuguca

SEQ ID NO: 77791 - RNA, 21 nt, Human
ggcucauugcaaccucugccu

SEQ ID NO: 77792 - RNA, 21 nt, Human
ugucagucgggagggagggag

SEQ ID NO: 77793 - RNA, 21 nt, Human
gcagccugggcaacaugguga

SEQ ID NO: 77794 - RNA, 24 nt, Human
aggcugggaauugcaguggcacaa

SEQ ID NO: 77795 - RNA, 24 nt, Human
ccuuuccuccucccccucggagcc

SEQ ID NO: 77796 - RNA, 22 nt, Human
aggcugaggcaagcagguuguu

SEQ ID NO: 77797 - RNA, 26 nt, Human
gcggccucuguucccugcagucugug

SEQ ID NO: 77798 - RNA, 27 nt, Human
gggcccaucuuacauccucucucucca

SEQ ID NO: 77799 - RNA, 27 nt, Human
gugcagccacacugggacucagaaccc

SEQ ID NO: 77800 - RNA, 27 nt, Human
ggagagcuucaggccccaggacugugg

SEQ ID NO: 77801 - RNA, 27 nt, Human
gcugggagcucugcggaaucugagcca

SEQ ID NO: 77802 - RNA, 18 nt, Human
uucugcucucuucuggcc

SEQ ID NO: 77803 - RNA, 21 nt, Human
cacugcaugagcuuuuauacu

SEQ ID NO: 77804 - RNA, 27 nt, Human
aucugcacugugggcuuuuauugccau

SEQ ID NO: 77805 - RNA, 18 nt, Human
uggcuucuccccacgaag

SEQ ID NO: 77806 - RNA, 22 nt, Human
guauuacaaucucaaagccagu

SEQ ID NO: 77807 - RNA, 25 nt, Human
gcauuaugaaagucaacagcucuuu

SEQ ID NO: 77808 - RNA, 23 nt, Human
ggacguucccggacagugccuca

SEQ ID NO: 77809 - RNA, 21 nt, Human
agcuuugccugucucuugccu

SEQ ID NO: 77810 - RNA, 17 nt, Human
cuucccuucugugagcu

SEQ ID NO: 77811 - RNA, 26 nt, Human
agcuugagucaacuaaaucugccuuc

SEQ ID NO: 77812 - RNA, 21 nt, Human
uugugaauguuguccuguguc

SEQ ID NO: 77813 - RNA, 25 nt, Human
gcugcuucuccccccaucccggguc

SEQ ID NO: 77814 - RNA, 20 nt, Human
ggcaggagggguggugaagg

SEQ ID NO: 77815 - RNA, 25 nt, Human
gggaaacugaggcccagggaggaga

SEQ ID NO: 77816 - RNA, 25 nt, Human
cgcucuggaggcugugguguguucu

SEQ ID NO: 77817 - RNA, 22 nt, Human
agcucacugaaccucugccucc

SEQ ID NO: 77818 - RNA, 22 nt, Human
ugcacauccaaaaauucugggu

SEQ ID NO: 77819 - RNA, 22 nt, Human
cucuuucugcaugugcugguca

SEQ ID NO: 77820 - RNA, 22 nt, Human
gcccuuggacacuaugggagga

SEQ ID NO: 77821 - RNA, 17 nt, Human
uacuuccugauguaaug

SEQ ID NO: 77822 - RNA, 23 nt, Human
ugggcagagcagaggggcagcga

SEQ ID NO: 77823 - RNA, 24 nt, Human
ugugcccucgggcgagucacugcc

SEQ ID NO: 77824 - RNA, 21 nt, Human
aaauaaugccugcuggauugu

SEQ ID NO: 77825 - RNA, 23 nt, Human
gcucacacucaaagaucagagga

SEQ ID NO: 77826 - RNA, 22 nt, Human
cgugccuguaaucccagcucuu

SEQ ID NO: 77827 - RNA, 22 nt, Human
gguucuugggggagggagggag

SEQ ID NO: 77828 - RNA, 22 nt, Human
cugcauguuaaauaaaaccauu

SEQ ID NO: 77829 - RNA, 27 nt, Human
ccuguucugugacuguguauagugcca

SEQ ID NO: 77830 - RNA, 20 nt, Human
uuaaaagcauauaccaccuu

SEQ ID NO: 77831 - RNA, 17 nt, Human
cuucccuucccuggaga

SEQ ID NO: 77832 - RNA, 22 nt, Human
uugaccaggcuggagugaagug

SEQ ID NO: 77833 - RNA, 20 nt, Human
agagaaacugaaauggaaca

SEQ ID NO: 77834 - RNA, 27 nt, Human
gcagaggcaaaucaccgggcagaggga

SEQ ID NO: 77835 - RNA, 27 nt, Human
uagcuauccauggaauauuagaacuug

SEQ ID NO: 77836 - RNA, 25 nt, Human
gcccgcugcccccgccuccuccgcc

SEQ ID NO: 77837 - RNA, 21 nt, Human
gguugcgacuccugacucugg

SEQ ID NO: 77838 - RNA, 25 nt, Human
uccuggcugucaguuucucaguggc

SEQ ID NO: 77839 - RNA, 21 nt, Human
cacacucggucaugugcucag

SEQ ID NO: 77840 - RNA, 21 nt, Human
ugcggccgcuccuccaggccu

SEQ ID NO: 77841 - RNA, 21 nt, Human
ccuaggauuuuacauguugcc

SEQ ID NO: 77842 - RNA, 22 nt, Human
acuuaaacauauucuguucacu

SEQ ID NO: 77843 - RNA, 27 nt, Human
cgcagggagaugcaggucucucuaaac

SEQ ID NO: 77844 - RNA, 21 nt, Human
ugcccaggcugggagggcaau

SEQ ID NO: 77845 - RNA, 27 nt, Human
uucucucuccaacacuucauucucucu

SEQ ID NO: 77846 - RNA, 22 nt, Human
ggacugucugugugcucuuauc

SEQ ID NO: 77847 - RNA, 26 nt, Human
ggcaccuguaaucccagcuacuuggg

SEQ ID NO: 77848 - RNA, 20 nt, Human
gauugggauacuguaauacu

SEQ ID NO: 77849 - RNA, 21 nt, Human
ggcucauugaaccucuugggu

SEQ ID NO: 77850 - RNA, 23 nt, Human
ccgaagagaccagaccaucucuu

SEQ ID NO: 77851 - RNA, 24 nt, Human
caggcuccucacucuucuccauca

SEQ ID NO: 77852 - RNA, 27 nt, Human
uggggccgugaugguggggugagggaa

SEQ ID NO: 77853 - RNA, 24 nt, Human
cccuccagggaaugcugaguucca

SEQ ID NO: 77854 - RNA, 23 nt, Human
gucaguuccucacagugguucug

SEQ ID NO: 77855 - RNA, 20 nt, Human
aaaauacaaaaauuagccag

SEQ ID NO: 77856 - RNA, 23 nt, Human
auaugaguacauacucaagagca

SEQ ID NO: 77857 - RNA, 22 nt, Human
uccacauucaauaaaaaguaua

SEQ ID NO: 77858 - RNA, 21 nt, Human
uuaaauaauaauacacaaaaa

SEQ ID NO: 77859 - RNA, 19 nt, Human
caggcaaucaaaaugagug

SEQ ID NO: 77860 - RNA, 21 nt, Human
ccgucugugccuaggcugcuu

SEQ ID NO: 77861 - RNA, 24 nt, Human
uuucuauucucucuuauagugacc

SEQ ID NO: 77862 - RNA, 21 nt, Human
ggguccccaucgcccaagucc

SEQ ID NO: 77863 - RNA, 26 nt, Human
agcccuuuuagugguggugucucacu

SEQ ID NO: 77864 - RNA, 22 nt, Human
aucgcuugaaccugggaggcgg

SEQ ID NO: 77865 - RNA, 21 nt, Human
aacacagcuuuauuaccucau

SEQ ID NO: 77866 - RNA, 25 nt, Human
gggucccgggaucggcuaagaguag

SEQ ID NO: 77867 - RNA, 23 nt, Human
ucccaguucuggaggagccaggu

SEQ ID NO: 77868 - RNA, 20 nt, Human
agugcuguuugaacuguuga

SEQ ID NO: 77869 - RNA, 14 nt, Human
gccaaaaugccuau

SEQ ID NO: 77870 - RNA, 26 nt, Human
auuucuggcuacuuccuugggcucag

SEQ ID NO: 77871 - RNA, 27 nt, Human
uugcccagaguugggggcuaggggagg

SEQ ID NO: 77872 - RNA, 20 nt, Human
cucccaccugguuaccacag

SEQ ID NO: 77873 - RNA, 17 nt, Human
auugcuuuaaugagcug

SEQ ID NO: 77874 - RNA, 28 nt, Human
uaacuugaccauuuucucucuccuuuug

SEQ ID NO: 77875 - RNA, 27 nt, Human
cugccuccugugccucccuuuucuccu

SEQ ID NO: 77876 - RNA, 23 nt, Human
cuggugccccacgcuuuucucuc

SEQ ID NO: 77877 - RNA, 20 nt, Human
uuugggaaugaauuuuccaa

SEQ ID NO: 77878 - RNA, 26 nt, Human
ucugcaggaacuggccuuguucuccu

SEQ ID NO: 77879 - RNA, 27 nt, Human
agggaaagcggaagguagaaggcuuuu

SEQ ID NO: 77880 - RNA, 23 nt, Human
ugcaaccuccgccucucagguuc

SEQ ID NO: 77881 - RNA, 21 nt, Human
cuggagccacaggcaggggug

SEQ ID NO: 77882 - RNA, 19 nt, Human
accuaccuuuucaggauuu

SEQ ID NO: 77883 - RNA, 21 nt, Human
aauuagccuugauauucucca

SEQ ID NO: 77884 - RNA, 22 nt, Human
gucagcucaggcuggagcaggc

SEQ ID NO: 77885 - RNA, 24 nt, Human
gccgugcugcgcucaccugccucc

SEQ ID NO: 77886 - RNA, 20 nt, Human
ccuagcccugcuccaacucc

SEQ ID NO: 77887 - RNA, 22 nt, Human
ccuaacuguguguuuucaggga

SEQ ID NO: 77888 - RNA, 24 nt, Human
cucagguugucagguucugccuuc

SEQ ID NO: 77889 - RNA, 18 nt, Human
gcaauaacgucacugccu

SEQ ID NO: 77890 - RNA, 20 nt, Human
ugaccugcuggguaaacugu

SEQ ID NO: 77891 - RNA, 21 nt, Human
ucgcacaucuucuguauucca

SEQ ID NO: 77892 - RNA, 19 nt, Human
uuucaaacuugaccaccuu

SEQ ID NO: 77893 - RNA, 21 nt, Human
gcaaaucaagcugagcuuuga

SEQ ID NO: 77894 - RNA, 22 nt, Human
ggucucgaacucuugaccucgg

SEQ ID NO: 77895 - RNA, 22 nt, Human
uugcucuuagcauuuggucuga

SEQ ID NO: 77896 - RNA, 23 nt, Human
cagaaucacauggcaaaagcuuu

SEQ ID NO: 77897 - RNA, 27 nt, Human
accccaggcacuaggggccaccugccu

SEQ ID NO: 77898 - RNA, 23 nt, Human
uguauuuucuggagaccaaacca

SEQ ID NO: 77899 - RNA, 22 nt, Human
gcgugagccaccgcuccuggcc

SEQ ID NO: 77900 - RNA, 24 nt, Human
gggagcgcaagaugcgggagcagc

SEQ ID NO: 77901 - RNA, 21 nt, Human
ccuggcugccccaccauccuc

SEQ ID NO: 77902 - RNA, 22 nt, Human
aggcugaggugggcagaucacu

SEQ ID NO: 77903 - RNA, 23 nt, Human
gcaaaguuuacaaccuuauucca

SEQ ID NO: 77904 - RNA, 22 nt, Human
ccaacauggugaaacuccaucu

SEQ ID NO: 77905 - RNA, 22 nt, Human
ugaaucccaucaggcuguuauu

SEQ ID NO: 77906 - RNA, 23 nt, Human
uaggacacagagcacaucaaaag

SEQ ID NO: 77907 - RNA, 21 nt, Human
uucaagaaaaucaccaaguga

SEQ ID NO: 77908 - RNA, 20 nt, Human
ccgagaucgcgccaguacau

SEQ ID NO: 77909 - RNA, 22 nt, Human
ccuuaguuuuuucaucuguaaa

SEQ ID NO: 77910 - RNA, 22 nt, Human
augcuuauguacuaauaguuga

SEQ ID NO: 77911 - RNA, 22 nt, Human
aauuugcaaagauggacuuuaa

SEQ ID NO: 77912 - RNA, 27 nt, Human
ccccugcccuggagcaacuuaaacagg

SEQ ID NO: 77913 - RNA, 19 nt, Human
uuccuugucaugucugaag

SEQ ID NO: 77914 - RNA, 27 nt, Human
cgugccuuucacaaagccacauccugc

SEQ ID NO: 77915 - RNA, 21 nt, Human
uucaguguuaacacagcagug

SEQ ID NO: 77916 - RNA, 21 nt, Human
aaccagccacuauuuuguuga

SEQ ID NO: 77917 - RNA, 28 nt, Human
cuuggcaggagugggcucugagcaguug

SEQ ID NO: 77918 - RNA, 23 nt, Human
gguagugcagcuguggguggagg

SEQ ID NO: 77919 - RNA, 21 nt, Human
uugcccaagauaggaguucuc

SEQ ID NO: 77920 - RNA, 27 nt, Human
uaucccuugguuuagaggaacccaaga

SEQ ID NO: 77921 - RNA, 25 nt, Human
gcccaggcuagagugcaguggugcg

SEQ ID NO: 77922 - RNA, 27 nt, Human
gcucugacgcacaggcuggagugcagu

SEQ ID NO: 77923 - RNA, 23 nt, Human
ucuucuuuccuuuacguuuuaac

SEQ ID NO: 77924 - RNA, 21 nt, Human
guccugcuuaaauucacaugg

SEQ ID NO: 77925 - RNA, 23 nt, Human
cucccuuuuauauugcaucugcu

SEQ ID NO: 77926 - RNA, 27 nt, Human
cucuccucuuggggcugcugcauuaaa

SEQ ID NO: 77927 - RNA, 24 nt, Human
ugccaucuuuuuguuuucuuugaa

SEQ ID NO: 77928 - RNA, 20 nt, Human
gugggggagggcagggagaa

SEQ ID NO: 77929 - RNA, 22 nt, Human
ggaaauuuacuggggggcaaag

SEQ ID NO: 77930 - RNA, 21 nt, Human
uugcgaagcuaaugaccugcc

SEQ ID NO: 77931 - RNA, 27 nt, Human
cucccgcuccggugaccccauccuugc

SEQ ID NO: 77932 - RNA, 23 nt, Human
cagacuccgggagcugcugccug

SEQ ID NO: 77933 - RNA, 22 nt, Human
aguucgccuccauuccuugcca

SEQ ID NO: 77934 - RNA, 27 nt, Human
aucucuagcuugguuuccacaugaggu

SEQ ID NO: 77935 - RNA, 27 nt, Human
ucaucccaaccucuuuuuccuccugga

SEQ ID NO: 77936 - RNA, 22 nt, Human
guuacuucuacucaccuucaca

SEQ ID NO: 77937 - RNA, 30 nt, Human
ccauuccaaaccaccuguuuccccuuccau

SEQ ID NO: 77938 - RNA, 22 nt, Human
ucucuccccuucuacugccucc

SEQ ID NO: 77939 - RNA, 21 nt, Human
ucagcuuucaggggagaagga

SEQ ID NO: 77940 - RNA, 22 nt, Human
gggcaggaguagcugagcucac

SEQ ID NO: 77941 - RNA, 20 nt, Human
uugccuuaugcauuucagca

SEQ ID NO: 77942 - RNA, 19 nt, Human
uguuuacagucuugcagug

SEQ ID NO: 77943 - RNA, 22 nt, Human
uggcuugcgcucaggaggcaga

SEQ ID NO: 77944 - RNA, 22 nt, Human
aaaacucuaacaagucaccucc

SEQ ID NO: 77945 - RNA, 26 nt, Human
cuagggucuauaauuccuuaaaauuu

SEQ ID NO: 77946 - RNA, 24 nt, Human
acccucaguuucucacagauuuuc

SEQ ID NO: 77947 - RNA, 23 nt, Human
cgugaccccaccauguccucucc

SEQ ID NO: 77948 - RNA, 22 nt, Human
cacugcacuuggugcugcuuug

SEQ ID NO: 77949 - RNA, 24 nt, Human
agcuuuuggcuccuucuuccugag

SEQ ID NO: 77950 - RNA, 24 nt, Human
cuacaugauugaugauggucucca

SEQ ID NO: 77951 - RNA, 24 nt, Human
gagagugaagugaagagaggcaaa

SEQ ID NO: 77952 - RNA, 25 nt, Human
gcugccuggcccaugugcccacugu

SEQ ID NO: 77953 - RNA, 23 nt, Human
ccccugagugggcugggcccucu

SEQ ID NO: 77954 - RNA, 27 nt, Human
ccccagccaguggcagaacugggucuc

SEQ ID NO: 77955 - RNA, 20 nt, Human
cuucuugcugaucagaguuc

SEQ ID NO: 77956 - RNA, 27 nt, Human
cgcucguuacccaggguggagugcagu

SEQ ID NO: 77957 - RNA, 27 nt, Human
uuccaggguuaaccacugugguggugu

SEQ ID NO: 77958 - RNA, 30 nt, Human
ccuguuuauggguuucuuccagcagaacag

SEQ ID NO: 77959 - RNA, 21 nt, Human
cuccccucugcccuguuuugu

SEQ ID NO: 77960 - RNA, 22 nt, Human
cacacaguauucgugaauaagu

SEQ ID NO: 77961 - RNA, 25 nt, Human
guggccuuuuaggcgggaguuaggc

SEQ ID NO: 77962 - RNA, 26 nt, Human
aaaccugaggcagcccuuuggaugcc

SEQ ID NO: 77963 - RNA, 25 nt, Human
ggcaauaugucaucuaccuaccuca

SEQ ID NO: 77964 - RNA, 24 nt, Human
ggaggguggucauugccuagaggu

SEQ ID NO: 77965 - RNA, 25 nt, Human
ccccugccucagggucauucuccug

SEQ ID NO: 77966 - RNA, 23 nt, Human
gcuugcuuccggcgucauggcuc

SEQ ID NO: 77967 - RNA, 26 nt, Human
uguggaauauugacauguguaagaag

SEQ ID NO: 77968 - RNA, 23 nt, Human
agggaaaggcccugggaggggcu

SEQ ID NO: 77969 - RNA, 26 nt, Human
gacagcuucaugaaacuguccaccaa

SEQ ID NO: 77970 - RNA, 25 nt, Human
uuuuguaccuguuaauuuuuguggg

SEQ ID NO: 77971 - RNA, 21 nt, Human
uccuggcauucgaggagcccu

SEQ ID NO: 77972 - RNA, 24 nt, Human
ggcauccauuuccauacaggaaca

SEQ ID NO: 77973 - RNA, 23 nt, Human
ccuguuucuaaguggccugcagg

SEQ ID NO: 77974 - RNA, 20 nt, Human
uccacucugugaacaucuca

SEQ ID NO: 77975 - RNA, 22 nt, Human
ucucaaaucugaacugcagcuu

SEQ ID NO: 77976 - RNA, 29 nt, Human
aacaguacaacagcuucuuugaggaccca

SEQ ID NO: 77977 - RNA, 19 nt, Human
gaucccucuuugcacagca

SEQ ID NO: 77978 - RNA, 25 nt, Human
cagucaacauguggaaauccaagga

SEQ ID NO: 77979 - RNA, 19 nt, Human
uuuuauuuuauagucucaa

SEQ ID NO: 77980 - RNA, 25 nt, Human
acuccugaauugucuccucucccuc

SEQ ID NO: 77981 - RNA, 23 nt, Human
gccaugauuugucccagccuggg

SEQ ID NO: 77982 - RNA, 23 nt, Human
cuuuuccugcacuuucugcuucu

SEQ ID NO: 77983 - RNA, 24 nt, Human
ucucucccugcucuuccaggguga

SEQ ID NO: 77984 - RNA, 21 nt, Human
aauguggguucuaaugcacag

SEQ ID NO: 77985 - RNA, 22 nt, Human
gcucauaccuauaaucccagcc

SEQ ID NO: 77986 - RNA, 28 nt, Human
gcaagucuugguuuuaauuauuauuauu

SEQ ID NO: 77987 - RNA, 19 nt, Human
aaggaguuuaaugcaguga

SEQ ID NO: 77988 - RNA, 19 nt, Human
ggugugcccacacaccacu

SEQ ID NO: 77989 - RNA, 27 nt, Human
uacaugguggcagggacaggaccacac

SEQ ID NO: 77990 - RNA, 26 nt, Human
cucugcagcugccucaguuuccccag

SEQ ID NO: 77991 - RNA, 24 nt, Human
agaccucccuuuccaagccugccu

SEQ ID NO: 77992 - RNA, 25 nt, Human
ucuccuccuaaucugggccucuugu

SEQ ID NO: 77993 - RNA, 22 nt, Human
cugugagguggagcuugcagug

SEQ ID NO: 77994 - RNA, 22 nt, Human
augugggaagcauuugauuuuc

SEQ ID NO: 77995 - RNA, 26 nt, Human
ggaccccagccccccaaacuuuggca

SEQ ID NO: 77996 - RNA, 22 nt, Human
gggauagcuauugcagcuuaaa

SEQ ID NO: 77997 - RNA, 20 nt, Human
cuggcccacucuccucucuc

SEQ ID NO: 77998 - RNA, 24 nt, Human
ccuccccauucacccaccuugcca

SEQ ID NO: 77999 - RNA, 18 nt, Human
ucuccucccuguccugag

SEQ ID NO: 78000 - RNA, 20 nt, Human
ggcgcgggccuuuccuucca

SEQ ID NO: 78001 - RNA, 25 nt, Human
cacaucccuauagaccacuggguuu

SEQ ID NO: 78002 - RNA, 25 nt, Human
gggacuggggagggagcuaagcuug

SEQ ID NO: 78003 - RNA, 29 nt, Human
ggagccugcacuuucaagagguacagcgg

SEQ ID NO: 78004 - RNA, 30 nt, Human
ccacucucccuuguccuccugggggcauau

SEQ ID NO: 78005 - RNA, 27 nt, Human
ccacugcacuccagccugggcaacaag

SEQ ID NO: 78006 - RNA, 16 nt, Human
gccucuuuugcacugg

SEQ ID NO: 78007 - RNA, 27 nt, Human
ucugucugaucaaggcaccacacaacc

SEQ ID NO: 78008 - RNA, 27 nt, Human
uggccaacauggcaacaccccgucucu

SEQ ID NO: 78009 - RNA, 27 nt, Human
acagacaccggcuugcuuggcaggcug

SEQ ID NO: 78010 - RNA, 19 nt, Human
gccgcagcuccacacucca

SEQ ID NO: 78011 - RNA, 25 nt, Human
uucauucucacccuguauuucuuua

SEQ ID NO: 78012 - RNA, 19 nt, Human
gcugugccacucugggcaa

SEQ ID NO: 78013 - RNA, 22 nt, Human
aggcuggaggucaguggcacaa

SEQ ID NO: 78014 - RNA, 22 nt, Human
uggugggcgccuguaauuccag

SEQ ID NO: 78015 - RNA, 23 nt, Human
agacaggcaggugaucugcugca

SEQ ID NO: 78016 - RNA, 22 nt, Human
augugaauuuuuaagcugcaaa

SEQ ID NO: 78017 - RNA, 25 nt, Human
ugagcugccuccagccugguggccc

SEQ ID NO: 78018 - RNA, 22 nt, Human
uucugaguaauagaaauucauu

SEQ ID NO: 78019 - RNA, 25 nt, Human
aaaugauuuggugcauauuuugcaa

SEQ ID NO: 78020 - RNA, 20 nt, Human
ccaccggcgggagugcagcg

SEQ ID NO: 78021 - RNA, 25 nt, Human
uggaaaacugccuuuuaucugccca

SEQ ID NO: 78022 - RNA, 21 nt, Human
agcagcuacuucuaagccaua

SEQ ID NO: 78023 - RNA, 22 nt, Human
ugggugaucuggggaucacgcc

SEQ ID NO: 78024 - RNA, 21 nt, Human
gccaacugcuccaaucugccu

SEQ ID NO: 78025 - RNA, 21 nt, Human
uccuucgggggcgugcgugua

SEQ ID NO: 78026 - RNA, 20 nt, Human
acauacaauggaaaugcuuu

SEQ ID NO: 78027 - RNA, 20 nt, Human
uguggagggggugcgggacg

SEQ ID NO: 78028 - RNA, 27 nt, Human
acugcgggcgagauggagcugagggaa

SEQ ID NO: 78029 - RNA, 21 nt, Human
ugcgucuccccucgggcugga

SEQ ID NO: 78030 - RNA, 20 nt, Human
uuugcaccuuuccauccucc

SEQ ID NO: 78031 - RNA, 27 nt, Human
ugagcuauuucccuugcuagugugcag

SEQ ID NO: 78032 - RNA, 27 nt, Human
uuugcccucagcuuugcagaaugaagc

SEQ ID NO: 78033 - RNA, 22 nt, Human
cuacaaugcuggcuuucuccca

SEQ ID NO: 78034 - RNA, 23 nt, Human
ucuuuuuauaugugcagaaaagu

SEQ ID NO: 78035 - RNA, 20 nt, Human
agagcucagaccugagccau

SEQ ID NO: 78036 - RNA, 27 nt, Human
gagaugcagaagauaauugaauuugua

SEQ ID NO: 78037 - RNA, 20 nt, Human
ugacucaccugaagugcaau

SEQ ID NO: 78038 - RNA, 23 nt, Human
agucccccaaaugaguacacauc

SEQ ID NO: 78039 - RNA, 22 nt, Human
ccccaaaggcagcuccugggga

SEQ ID NO: 78040 - RNA, 21 nt, Human
gcaaugagccaagauugcgcc

SEQ ID NO: 78041 - RNA, 21 nt, Human
acaucuucaucagcuccagac

SEQ ID NO: 78042 - RNA, 20 nt, Human
agcuuuguacaucagcacug

SEQ ID NO: 78043 - RNA, 27 nt, Human
uccagaaggaaaggaggaagaaauguu

SEQ ID NO: 78044 - RNA, 27 nt, Human
cuguuuugagagugggacucacucuga

SEQ ID NO: 78045 - RNA, 28 nt, Human
cagcccgucuuggcuuauccacuuugac

SEQ ID NO: 78046 - RNA, 23 nt, Human
ccuagcgcugcaggcuccugggc

SEQ ID NO: 78047 - RNA, 24 nt, Human
uucuguggggucugcaguggcaag

SEQ ID NO: 78048 - RNA, 20 nt, Human
agggacacuauaaauaagac

SEQ ID NO: 78049 - RNA, 21 nt, Human
gugaccaggggccaccaaagu

SEQ ID NO: 78050 - RNA, 22 nt, Human
aggcgugcugguccccuccuca

SEQ ID NO: 78051 - RNA, 26 nt, Human
cccugcucaccccuuguugcugggcu

SEQ ID NO: 78052 - RNA, 24 nt, Human
ccaagcaccugggauuacaagcau

SEQ ID NO: 78053 - RNA, 24 nt, Human
gccaaguuggagugcaauggugcg

SEQ ID NO: 78054 - RNA, 25 nt, Human
ccaaacaucucccaccgaguuauuu

SEQ ID NO: 78055 - RNA, 22 nt, Human
acuauacagaugguucguguuc

SEQ ID NO: 78056 - RNA, 27 nt, Human
caggcugaagugcaguggggcgcucuc

SEQ ID NO: 78057 - RNA, 26 nt, Human
ugugggaagagggugcagcacuggac

SEQ ID NO: 78058 - RNA, 23 nt, Human
gguguucuauuuaauaaacuauu

SEQ ID NO: 78059 - RNA, 20 nt, Human
gcacaucugcuguggucuga

SEQ ID NO: 78060 - RNA, 22 nt, Human
caacauagcgagaccucaucuc

SEQ ID NO: 78061 - RNA, 27 nt, Human
ucucucucccaucaccuugcccucauu

SEQ ID NO: 78062 - RNA, 22 nt, Human
gcccaggcuggagugcaggggc

SEQ ID NO: 78063 - RNA, 22 nt, Human
aaguacaccuacacuaauaguc

SEQ ID NO: 78064 - RNA, 22 nt, Human
gccagcccuccuugacccagaa

SEQ ID NO: 78065 - RNA, 24 nt, Human
gcaaaacuucccguuugcauguca

SEQ ID NO: 78066 - RNA, 20 nt, Human
gagugaggacagcaggcagg

SEQ ID NO: 78067 - RNA, 23 nt, Human
gcggagccgccgguggcccagcc

SEQ ID NO: 78068 - RNA, 19 nt, Human
ggucucaaaauauaacucg

SEQ ID NO: 78069 - RNA, 26 nt, Human
auagcagaagcacauuuucagacugc

SEQ ID NO: 78070 - RNA, 23 nt, Human
gagagggagaugacuugaguggu

SEQ ID NO: 78071 - RNA, 23 nt, Human
agguucucuuggcuggacaucau

SEQ ID NO: 78072 - RNA, 26 nt, Human
cacucugcuccugggugugagcagag

SEQ ID NO: 78073 - RNA, 27 nt, Human
ccugugcagauggccaugcccaaccaa

SEQ ID NO: 78074 - RNA, 24 nt, Human
gucauccagagcuggagugcagcg

SEQ ID NO: 78075 - RNA, 22 nt, Human
ccugaauugcuguaacaagcac

SEQ ID NO: 78076 - RNA, 22 nt, Human
uggaagguggagcuugcaguga

SEQ ID NO: 78077 - RNA, 22 nt, Human
agacauuuuauauuuuauucug

SEQ ID NO: 78078 - RNA, 26 nt, Human
cuggcugaaggaagccaagaggauca

SEQ ID NO: 78079 - RNA, 23 nt, Human
uaucugaaggcccagccaaagca

SEQ ID NO: 78080 - RNA, 26 nt, Human
guaggcugccuggugugucugaugag

SEQ ID NO: 78081 - RNA, 26 nt, Human
gcguccagccccccacucagcucuuc

SEQ ID NO: 78082 - RNA, 22 nt, Human
ccaggaggcggaccuuguagug

SEQ ID NO: 78083 - RNA, 25 nt, Human
aagaucauaccacugcacugcagcc

SEQ ID NO: 78084 - RNA, 21 nt, Human
cagccgguguccuggaaagcc

SEQ ID NO: 78085 - RNA, 22 nt, Human
uccucuuggagaaaauaacaag

SEQ ID NO: 78086 - RNA, 22 nt, Human
auugcuugaacccaggaagcag

SEQ ID NO: 78087 - RNA, 26 nt, Human
cacucacuuccaucuugacuggguga

SEQ ID NO: 78088 - RNA, 23 nt, Human
guugugcaggcuguagugcagug

SEQ ID NO: 78089 - RNA, 21 nt, Human
cuccagccugggugacagggc

SEQ ID NO: 78090 - RNA, 20 nt, Human
ugccgugccuggauccugaa

SEQ ID NO: 78091 - RNA, 22 nt, Human
gugccuggccucccugaacugu

SEQ ID NO: 78092 - RNA, 23 nt, Human
uacauacuuuuuacacagauucu

SEQ ID NO: 78093 - RNA, 27 nt, Human
uuuucuuucuucucuuuuuguuuggaa

SEQ ID NO: 78094 - RNA, 22 nt, Human
uuccuguggaacugaaucccuc

SEQ ID NO: 78095 - RNA, 24 nt, Human
ucaugcauucuuugcaaaggaggu

SEQ ID NO: 78096 - RNA, 22 nt, Human
ccgggaagaguuccuggcaaag

SEQ ID NO: 78097 - RNA, 22 nt, Human
accaauuaacugagcacuugcu

SEQ ID NO: 78098 - RNA, 22 nt, Human
cccagcugagugaagagcccag

SEQ ID NO: 78099 - RNA, 22 nt, Human
ggcucucugcaaccucugucuc

SEQ ID NO: 78100 - RNA, 22 nt, Human
auuaauauuucaauauuuuaug

SEQ ID NO: 78101 - RNA, 21 nt, Human
uagacaaugcccccacgcuug

SEQ ID NO: 78102 - RNA, 21 nt, Human
cuucugugggcuuaaugguuc

SEQ ID NO: 78103 - RNA, 22 nt, Human
agcaggacacagaggggagggg

SEQ ID NO: 78104 - RNA, 24 nt, Human
uuccgauagaaauuucuuaccuca

SEQ ID NO: 78105 - RNA, 21 nt, Human
gaaagaucuucauggcuguuu

SEQ ID NO: 78106 - RNA, 24 nt, Human
cucuacagccugacuuucucucca

SEQ ID NO: 78107 - RNA, 23 nt, Human
cacucacuuugcaccuuucccug

SEQ ID NO: 78108 - RNA, 22 nt, Human
agguagaggaggccaucugauc

SEQ ID NO: 78109 - RNA, 22 nt, Human
gaauucuuaaaacugugcucaa

SEQ ID NO: 78110 - RNA, 24 nt, Human
agggaagaggagagaaaagacagg

SEQ ID NO: 78111 - RNA, 25 nt, Human
uauuuuuguggaugguguugacuuc

SEQ ID NO: 78112 - RNA, 30 nt, Human
gaauauuagauauuauuuugcaucuguaac

SEQ ID NO: 78113 - RNA, 23 nt, Human
ugucggugaagaaaauuuucaau

SEQ ID NO: 78114 - RNA, 22 nt, Human
aaggagauuuauauucuggccu

SEQ ID NO: 78115 - RNA, 26 nt, Human
aauugcuuccucuggggaggcgaaua

SEQ ID NO: 78116 - RNA, 21 nt, Human
uaugcaggcccccugcagccu

SEQ ID NO: 78117 - RNA, 21 nt, Human
guucauuaacagcaucuuuaa

SEQ ID NO: 78118 - RNA, 20 nt, Human
cauuccuuagucucaagggc

SEQ ID NO: 78119 - RNA, 27 nt, Human
ccugccugccugccugccugagguccc

SEQ ID NO: 78120 - RNA, 21 nt, Human
gugaccacucuucuuuaagcc

SEQ ID NO: 78121 - RNA, 20 nt, Human
uccaugucucugagcauuag

SEQ ID NO: 78122 - RNA, 20 nt, Human
cucuucugggaacuuccuca

SEQ ID NO: 78123 - RNA, 27 nt, Human
cccuacucuucaccccuuguuuucacc

SEQ ID NO: 78124 - RNA, 21 nt, Human
cauacuccaguuuacuaauac

SEQ ID NO: 78125 - RNA, 26 nt, Human
uguagcucuggacuucccugggccuu

SEQ ID NO: 78126 - RNA, 25 nt, Human
gcagagaaagagcaaagcccaaaag

SEQ ID NO: 78127 - RNA, 23 nt, Human
cucgccuaaagguggagaacgag

SEQ ID NO: 78128 - RNA, 23 nt, Human
ccuccacccacccuccugccuca

SEQ ID NO: 78129 - RNA, 24 nt, Human
ggggcuaaagacugaucucagggg

SEQ ID NO: 78130 - RNA, 21 nt, Human
aaggaguuuagcuuucagaga

SEQ ID NO: 78131 - RNA, 23 nt, Human
uguguuggccaggauggucucca

SEQ ID NO: 78132 - RNA, 25 nt, Human
ggccucggggccucggagcaaccac

SEQ ID NO: 78133 - RNA, 19 nt, Human
uccuuucccuuccucuucg

SEQ ID NO: 78134 - RNA, 22 nt, Human
ucacugcaaucucugccuccug

SEQ ID NO: 78135 - RNA, 19 nt, Human
aggaaagacaacuggggaa

SEQ ID NO: 78136 - RNA, 22 nt, Human
cugcccuucucaagacuuuagc

SEQ ID NO: 78137 - RNA, 24 nt, Human
gcacacagccugguuuuguccuca

SEQ ID NO: 78138 - RNA, 23 nt, Human
gcggauccaguguuccguuucca

SEQ ID NO: 78139 - RNA, 26 nt, Human
gcgcacacacaccgauguacacacac

SEQ ID NO: 78140 - RNA, 22 nt, Human
ggggaagagagagaccucggac

SEQ ID NO: 78141 - RNA, 23 nt, Human
ucuaggugaccuacagugccgug

SEQ ID NO: 78142 - RNA, 19 nt, Human
gcagcaccccagcuaggga

SEQ ID NO: 78143 - RNA, 27 nt, Human
caaucagguagcuuaauggauguaaua

SEQ ID NO: 78144 - RNA, 20 nt, Human
uuuuaguauaauggugcuau

SEQ ID NO: 78145 - RNA, 21 nt, Human
uuacccuagaaaacagcugca

SEQ ID NO: 78146 - RNA, 24 nt, Human
aaaccucccuucccuuucgugucg

SEQ ID NO: 78147 - RNA, 27 nt, Human
cagaaaugcugcaguacaaacuuuccc

SEQ ID NO: 78148 - RNA, 22 nt, Human
ugcggggacacgggucgcuuug

SEQ ID NO: 78149 - RNA, 19 nt, Human
auugucuugagcaccagaa

SEQ ID NO: 78150 - RNA, 21 nt, Human
agcaaacugaauaaagcaaca

SEQ ID NO: 78151 - RNA, 23 nt, Human
acuuucuccugccuccaggcauu

SEQ ID NO: 78152 - RNA, 23 nt, Human
ugcagcugccucacaccgccccu

SEQ ID NO: 78153 - RNA, 28 nt, Human
gcuccugagaaaggugaggagggcaguc

SEQ ID NO: 78154 - RNA, 22 nt, Human
ggcugggcuuccuacuccccau

SEQ ID NO: 78155 - RNA, 26 nt, Human
auuaagagugaaaauugucuucuucu

SEQ ID NO: 78156 - RNA, 20 nt, Human
uuuagcuccacaucaugcuu

SEQ ID NO: 78157 - RNA, 19 nt, Human
caacccagaagacaacccu

SEQ ID NO: 78158 - RNA, 25 nt, Human
uccagcaccauguuccuccugaccc

SEQ ID NO: 78159 - RNA, 25 nt, Human
gcaacugguuuuacuagugugcaag

SEQ ID NO: 78160 - RNA, 22 nt, Human
uagaaagagguuccugggaguu

SEQ ID NO: 78161 - RNA, 22 nt, Human
cuguagccugggaaggagacag

SEQ ID NO: 78162 - RNA, 21 nt, Human
cucauuaaaaaggaucagaga

SEQ ID NO: 78163 - RNA, 18 nt, Human
aggaagcuccaucugagc

SEQ ID NO: 78164 - RNA, 20 nt, Human
uggguggaggggcuggggaa

SEQ ID NO: 78165 - RNA, 21 nt, Human
auaguggcauacugucacuua

SEQ ID NO: 78166 - RNA, 20 nt, Human
ucugcuugcugugccuuguu

SEQ ID NO: 78167 - RNA, 17 nt, Human
gcgaucucacugcaacc

SEQ ID NO: 78168 - RNA, 22 nt, Human
ucuucuuucucuguauuccgau

SEQ ID NO: 78169 - RNA, 22 nt, Human
ucaaugaaugggaugucuaaug

SEQ ID NO: 78170 - RNA, 22 nt, Human
cugcaaucccagcuacucggga

SEQ ID NO: 78171 - RNA, 27 nt, Human
ggcuccaccuggauguucugugccugu

SEQ ID NO: 78172 - RNA, 23 nt, Human
agggcacagggcucugcugugcc

SEQ ID NO: 78173 - RNA, 21 nt, Human
ugaugugauguuuacuuugac

SEQ ID NO: 78174 - RNA, 25 nt, Human
ggagaggggggucgggaaugggggg

SEQ ID NO: 78175 - RNA, 26 nt, Human
ucuuuucccucuacucucauccuagg

SEQ ID NO: 78176 - RNA, 21 nt, Human
gagaguggggagacaggcagc

SEQ ID NO: 78177 - RNA, 21 nt, Human
uagccaucuuugccuuuugcu

SEQ ID NO: 78178 - RNA, 21 nt, Human
ugcuugaaauugggugugaga

SEQ ID NO: 78179 - RNA, 22 nt, Human
caggcuggagggcaauggugca

SEQ ID NO: 78180 - RNA, 22 nt, Human
ucagaugcucauugcuuucuaa

SEQ ID NO: 78181 - RNA, 21 nt, Human
gcuauaugaucaaacagcaaa

SEQ ID NO: 78182 - RNA, 20 nt, Human
cacuuuuaaaaccugccucu

SEQ ID NO: 78183 - RNA, 23 nt, Human
uuuccuuugagucuucuggagcu

SEQ ID NO: 78184 - RNA, 22 nt, Human
agcuggacuucguuuuuacuua

SEQ ID NO: 78185 - RNA, 25 nt, Human
ccaucaccaucugcuugacuaugua

SEQ ID NO: 78186 - RNA, 20 nt, Human
cagucuggaggguccuggcc

SEQ ID NO: 78187 - RNA, 28 nt, Human
uggccagcucugccucucuaaaacugac

SEQ ID NO: 78188 - RNA, 20 nt, Human
cuguaaccgggucaaugugu

SEQ ID NO: 78189 - RNA, 20 nt, Human
ccuuccucuccccuggggcu

SEQ ID NO: 78190 - RNA, 23 nt, Human
auccuuccuccucacccugccgg

SEQ ID NO: 78191 - RNA, 27 nt, Human
cuaccuuuggaucugugagaaggugaa

SEQ ID NO: 78192 - RNA, 25 nt, Human
cucaguggaaaaugauguucagaug

SEQ ID NO: 78193 - RNA, 29 nt, Human
gcccugccucaguuuaccugcacaugcuu

SEQ ID NO: 78194 - RNA, 22 nt, Human
aaccaacugcugcugugcacau

SEQ ID NO: 78195 - RNA, 32 nt, Human
gacacauuuuaaauacuccuucacucuaaaac

SEQ ID NO: 78196 - RNA, 23 nt, Human
guggcagcaagcugaaugacaga

SEQ ID NO: 78197 - RNA, 21 nt, Human
cucugcagcugccucaguuuc

SEQ ID NO: 78198 - RNA, 19 nt, Human
uucaaaugugugcauuaaa

SEQ ID NO: 78199 - RNA, 18 nt, Human
agguggagcuugcaguga

SEQ ID NO: 78200 - RNA, 28 nt, Human
cugauguguguggguuguugaggggaac

SEQ ID NO: 78201 - RNA, 23 nt, Human
uccaacaacagaaguggcaucug

SEQ ID NO: 78202 - RNA, 19 nt, Human
caacuacuggaauauuguc

SEQ ID NO: 78203 - RNA, 21 nt, Human
uguggggcgaguacugggaca

SEQ ID NO: 78204 - RNA, 30 nt, Human
cucugcacuaacugcccucccaaauaucuu

SEQ ID NO: 78205 - RNA, 22 nt, Human
cugccuccugacuucaagcaau

SEQ ID NO: 78206 - RNA, 26 nt, Human
gucucgaacuccugaccccaaguuau

SEQ ID NO: 78207 - RNA, 18 nt, Human
uugccaggcuggacaaug

SEQ ID NO: 78208 - RNA, 23 nt, Human
uccuagaggguauaaaaucaucu

SEQ ID NO: 78209 - RNA, 21 nt, Human
cucuucucuucugugaucuca

SEQ ID NO: 78210 - RNA, 20 nt, Human
cugcucggccugcugugcca

SEQ ID NO: 78211 - RNA, 21 nt, Human
cugucaugaauguguacgugc

SEQ ID NO: 78212 - RNA, 21 nt, Human
guaucuguguguuacugcugu

SEQ ID NO: 78213 - RNA, 29 nt, Human
ccaguuguuccucccccaccucagcccuc

SEQ ID NO: 78214 - RNA, 25 nt, Human
ccgaguuccccuccugggauuugca

SEQ ID NO: 78215 - RNA, 26 nt, Human
ccugcucuguuuuuggcugugagacu

SEQ ID NO: 78216 - RNA, 28 nt, Human
gcgcaggaacagcggcugcugacugggc

SEQ ID NO: 78217 - RNA, 24 nt, Human
auguuuuacuucucuauacaccau

SEQ ID NO: 78218 - RNA, 22 nt, Human
gagaccccauuuucugucgagg

SEQ ID NO: 78219 - RNA, 22 nt, Human
cacgaggucaggaguucaagac

SEQ ID NO: 78220 - RNA, 23 nt, Human
uggcugccucuccaaacccgcuc

SEQ ID NO: 78221 - RNA, 24 nt, Human
ugguaccgagggacucauuccugg

SEQ ID NO: 78222 - RNA, 21 nt, Human
ccauuucugggcuccuggggc

SEQ ID NO: 78223 - RNA, 26 nt, Human
gcccuaggcggcggaucuaagcuaac

SEQ ID NO: 78224 - RNA, 22 nt, Human
caggcucgcuccuuguggggcc

SEQ ID NO: 78225 - RNA, 19 nt, Human
ccuguucuuggaucugcca

SEQ ID NO: 78226 - RNA, 21 nt, Human
uuuuaccuuaagaaacacaau

SEQ ID NO: 78227 - RNA, 22 nt, Human
ggagggcccugccggaaugugc

SEQ ID NO: 78228 - RNA, 22 nt, Human
gagaugacucugucucauugac

SEQ ID NO: 78229 - RNA, 24 nt, Human
gcgcaaucacggcucucugcagcc

SEQ ID NO: 78230 - RNA, 22 nt, Human
uccugcucucauaaggucagcc

SEQ ID NO: 78231 - RNA, 22 nt, Human
agcaaacuaacaaagaaaaaca

SEQ ID NO: 78232 - RNA, 20 nt, Human
auuuuuguuuuuccuguuga

SEQ ID NO: 78233 - RNA, 22 nt, Human
gggauuacaggugacugccacc

SEQ ID NO: 78234 - RNA, 22 nt, Human
ucacuacccacuaucuuauuca

SEQ ID NO: 78235 - RNA, 24 nt, Human
uccucugcugaauuuuuaaauguu

SEQ ID NO: 78236 - RNA, 19 nt, Human
ccaacuuccugcucucaca

SEQ ID NO: 78237 - RNA, 22 nt, Human
auguucucuagccuuccaccag

SEQ ID NO: 78238 - RNA, 27 nt, Human
ugaacaacaggauauauagacugauaa

SEQ ID NO: 78239 - RNA, 25 nt, Human
ucuccaagugaagcucagaaauacc

SEQ ID NO: 78240 - RNA, 20 nt, Human
ggggcugagaaacaggcugc

SEQ ID NO: 78241 - RNA, 25 nt, Human
cacgaugcaaaauaccagucuggcu

SEQ ID NO: 78242 - RNA, 23 nt, Human
cucaggaagcacaucuguagugc

SEQ ID NO: 78243 - RNA, 19 nt, Human
agggcuuccugugugccgg

SEQ ID NO: 78244 - RNA, 23 nt, Human
augaauaaaggcuacaggcucca

SEQ ID NO: 78245 - RNA, 23 nt, Human
acuccacccuccccguuuuugcu

SEQ ID NO: 78246 - RNA, 20 nt, Human
cuuauugaaccucuagcucu

SEQ ID NO: 78247 - RNA, 22 nt, Human
ggcaggagaauggugugaaccc

SEQ ID NO: 78248 - RNA, 24 nt, Human
gcugccgacccugccugagcgcgg

SEQ ID NO: 78249 - RNA, 22 nt, Human
cuuugcugcuauccacugugau

SEQ ID NO: 78250 - RNA, 25 nt, Human
acgcgccaccuuccccggucgcggu

SEQ ID NO: 78251 - RNA, 22 nt, Human
gaacuccaauuaagggacugga

SEQ ID NO: 78252 - RNA, 20 nt, Human
aggaaugaaugcuguggaag

SEQ ID NO: 78253 - RNA, 20 nt, Human
ggagacaccucagagccccg

SEQ ID NO: 78254 - RNA, 27 nt, Human
ggaacaucccagcaggcugugcuugga

SEQ ID NO: 78255 - RNA, 21 nt, Human
uuugcgccauccggggccaag

SEQ ID NO: 78256 - RNA, 25 nt, Human
auuacauagaagcauuguagucuug

SEQ ID NO: 78257 - RNA, 21 nt, Human
aaguguuuuacaaugauuugu

SEQ ID NO: 78258 - RNA, 24 nt, Human
ggcuccagggacuggaguguaaug

SEQ ID NO: 78259 - RNA, 19 nt, Human
aauguauuuucuucaccuc

SEQ ID NO: 78260 - RNA, 21 nt, Human
agagucugcagcccagagcca

SEQ ID NO: 78261 - RNA, 21 nt, Human
uggcuuccagaaaaccccagc

SEQ ID NO: 78262 - RNA, 25 nt, Human
ggguccagggugcagugaacucagu

SEQ ID NO: 78263 - RNA, 22 nt, Human
ucaugccacugcacuccagucu

SEQ ID NO: 78264 - RNA, 22 nt, Human
ucaugccacuguacuccagccu

SEQ ID NO: 78265 - RNA, 22 nt, Human
ucgcgccacuacacuccagccu

SEQ ID NO: 78266 - RNA, 27 nt, Human
gcaaucagaaucucacugagccaccca

SEQ ID NO: 78267 - RNA, 22 nt, Human
ucauggauuagagugacugaaa

SEQ ID NO: 78268 - RNA, 25 nt, Human
acagucuaguuuccugguuccguuu

SEQ ID NO: 78269 - RNA, 21 nt, Human
cuguccguggaguggagcugc

SEQ ID NO: 78270 - RNA, 21 nt, Human
uguucucugcuguuaucugcc

SEQ ID NO: 78271 - RNA, 24 nt, Human
gggccccgccuccuuucuguuuua

SEQ ID NO: 78272 - RNA, 16 nt, Human
cuccacccucccuccc

SEQ ID NO: 78273 - RNA, 24 nt, Human
aucgucagccaccuugccuuugcc

SEQ ID NO: 78274 - RNA, 26 nt, Human
uggcaccuccaaguggugucauuuga

SEQ ID NO: 78275 - RNA, 25 nt, Human
cuuaguaugcucagccuccuucuuu

SEQ ID NO: 78276 - RNA, 25 nt, Human
ucauauccccucuccuuauuuuucu

SEQ ID NO: 78277 - RNA, 21 nt, Human
gcagccuggccaacauagugg

SEQ ID NO: 78278 - RNA, 27 nt, Human
ggcuguguuuagaaugaucuaguguaa

SEQ ID NO: 78279 - RNA, 22 nt, Human
uagcgagacucggucucaaaaa

SEQ ID NO: 78280 - RNA, 27 nt, Human
guugcccaggcuggucucgaacuucug

SEQ ID NO: 78281 - RNA, 17 nt, Human
cucagugagcuggggcc

SEQ ID NO: 78282 - RNA, 22 nt, Human
agagcaucugacugcccugccu

SEQ ID NO: 78283 - RNA, 27 nt, Human
cugugcucuccccuccuuggggcguuu

SEQ ID NO: 78284 - RNA, 14 nt, Human
ugccuuccaccuca

SEQ ID NO: 78285 - RNA, 21 nt, Human
gagggaggggugggggacagu

SEQ ID NO: 78286 - RNA, 20 nt, Human
uggacaguauuuaaauauug

SEQ ID NO: 78287 - RNA, 27 nt, Human
ggaggcugaauccuugaaggaggaggu

SEQ ID NO: 78288 - RNA, 19 nt, Human
ccacccagggcucgcgggg

SEQ ID NO: 78289 - RNA, 27 nt, Human
caggccugugcacacacccccucagca

SEQ ID NO: 78290 - RNA, 24 nt, Human
agcuaaaucaaauguaauuuauag

SEQ ID NO: 78291 - RNA, 21 nt, Human
gcucuaucccccucugaugcu

SEQ ID NO: 78292 - RNA, 22 nt, Human
acugcaaccucuaccucccagg

SEQ ID NO: 78293 - RNA, 21 nt, Human
acccaguccuguuugguuuuc

SEQ ID NO: 78294 - RNA, 25 nt, Human
ggugaaggcaggaguugggggcagg

SEQ ID NO: 78295 - RNA, 25 nt, Human
agcuugcuuacaaagggagcauuau

SEQ ID NO: 78296 - RNA, 26 nt, Human
acagauucugguuugagguuugacuc

SEQ ID NO: 78297 - RNA, 29 nt, Human
uuaucuguuccaguuuucucaguguuuuc

SEQ ID NO: 78298 - RNA, 22 nt, Human
ugccuucuuccuugaggggcag

SEQ ID NO: 78299 - RNA, 18 nt, Human
gcguggaggaggagggag

SEQ ID NO: 78300 - RNA, 26 nt, Human
cuggaaucuggagagcuagaaccugg

SEQ ID NO: 78301 - RNA, 13 nt, Human
accaaaugccuaa

SEQ ID NO: 78302 - RNA, 21 nt, Human
ugagaaguuucugaauaggug

SEQ ID NO: 78303 - RNA, 24 nt, Human
cucuagauuaguagaugcaucuaa

SEQ ID NO: 78304 - RNA, 23 nt, Human
uuagaaaacauaaucuucugccu

SEQ ID NO: 78305 - RNA, 21 nt, Human
gcucuccacuuccuccgugca

SEQ ID NO: 78306 - RNA, 24 nt, Human
auuuuucugacuuuuacagauuaa

SEQ ID NO: 78307 - RNA, 19 nt, Human
gccgguccccagcugcagu

SEQ ID NO: 78308 - RNA, 21 nt, Human
acacagaaacauacacauacc

SEQ ID NO: 78309 - RNA, 20 nt, Human
ggaaccuuugggagugccuu

SEQ ID NO: 78310 - RNA, 26 nt, Human
uggagacagagucuugcuuuguugcc

SEQ ID NO: 78311 - RNA, 24 nt, Human
uguuacccaggcuggagugcaaug

SEQ ID NO: 78312 - RNA, 19 nt, Human
cuguggcuggaagcgagga

SEQ ID NO: 78313 - RNA, 24 nt, Human
ggggagaugagggagcccugucug

SEQ ID NO: 78314 - RNA, 22 nt, Human
agccgggagaccagagaucuag

SEQ ID NO: 78315 - RNA, 25 nt, Human
acagcauuucuaucuuuauuauuuc

SEQ ID NO: 78316 - RNA, 18 nt, Human
aaggaagaaguguggaaa

SEQ ID NO: 78317 - RNA, 22 nt, Human
uguuaauagaaauggaaauacu

SEQ ID NO: 78318 - RNA, 27 nt, Human
ccaccaccugaugaaagauacaccaca

SEQ ID NO: 78319 - RNA, 26 nt, Human
ccuccagggauggcucugagcucucg

SEQ ID NO: 78320 - RNA, 22 nt, Human
aagacagagucuugcucuguca

SEQ ID NO: 78321 - RNA, 23 nt, Human
gcugggguuugcagugguuugau

SEQ ID NO: 78322 - RNA, 28 nt, Human
gcaucucugcuugcaucuuccauccuac

SEQ ID NO: 78323 - RNA, 21 nt, Human
ugcgcacuguguccucuucca

SEQ ID NO: 78324 - RNA, 21 nt, Human
ccugaccuucuccagggacag

SEQ ID NO: 78325 - RNA, 20 nt, Human
ugcagcucggccaaggccag

SEQ ID NO: 78326 - RNA, 18 nt, Human
uugcccaggcaagagugc

SEQ ID NO: 78327 - RNA, 20 nt, Human
cggggucccuaugcccaguc

SEQ ID NO: 78328 - RNA, 24 nt, Human
gaucagguuccccgccuuccaguc

SEQ ID NO: 78329 - RNA, 23 nt, Human
uucggaguuccuguuuugcucau

SEQ ID NO: 78330 - RNA, 18 nt, Human
guagaaaaggccaguaua

SEQ ID NO: 78331 - RNA, 22 nt, Human
ugggagccagcgguauggcguc

SEQ ID NO: 78332 - RNA, 21 nt, Human
uccucucuccccacuugaacc

SEQ ID NO: 78333 - RNA, 25 nt, Human
cugcuggugggaaaugggagccagg

SEQ ID NO: 78334 - RNA, 24 nt, Human
ccucucuggcccugggagggcagc

SEQ ID NO: 78335 - RNA, 23 nt, Human
uccuccucugcuggcuuaggguc

SEQ ID NO: 78336 - RNA, 27 nt, Human
ucucucuggcccucuaccccugaucug

SEQ ID NO: 78337 - RNA, 21 nt, Human
uacaagugcaucacugguaca

SEQ ID NO: 78338 - RNA, 24 nt, Human
gagaauccccuacccuacucugau

SEQ ID NO: 78339 - RNA, 26 nt, Human
gguuaaucagaguaucugaagggaau

SEQ ID NO: 78340 - RNA, 22 nt, Human
ggaagcaacuccgucugcugca

SEQ ID NO: 78341 - RNA, 29 nt, Human
ugcugcguguccaucaucagcugaccaag

SEQ ID NO: 78342 - RNA, 22 nt, Human
ucuccuccauuauuacccaggc

SEQ ID NO: 78343 - RNA, 23 nt, Human
ugacaccugcccuuuguccccca

SEQ ID NO: 78344 - RNA, 22 nt, Human
aaaggacaacaaaguuuacauu

SEQ ID NO: 78345 - RNA, 24 nt, Human
gcgccgacucccugagucuggacc

SEQ ID NO: 78346 - RNA, 19 nt, Human
agggaaagaaaaguuggau

SEQ ID NO: 78347 - RNA, 21 nt, Human
uuuggcuguugaggagugaga

SEQ ID NO: 78348 - RNA, 21 nt, Human
acugcucucaaaaugugaacu

SEQ ID NO: 78349 - RNA, 24 nt, Human
acauuucugccugauaaucaugcu

SEQ ID NO: 78350 - RNA, 22 nt, Human
gaaacaccucccaggggcucca

SEQ ID NO: 78351 - RNA, 25 nt, Human
agaagagauuccagaaucaucaucu

SEQ ID NO: 78352 - RNA, 24 nt, Human
gcauuugccccaccccacagcuua

SEQ ID NO: 78353 - RNA, 22 nt, Human
gccuggucuagcuccucuccaa

SEQ ID NO: 78354 - RNA, 24 nt, Human
aacuuuuuauugccuucucaccag

SEQ ID NO: 78355 - RNA, 25 nt, Human
ggcugcugaggcggaggcugaggca

SEQ ID NO: 78356 - RNA, 19 nt, Human
uaugcaccuggucaacuua

SEQ ID NO: 78357 - RNA, 24 nt, Human
ggguauuccagacacuucuuauga

SEQ ID NO: 78358 - RNA, 20 nt, Human
caaaacaauauaaauggaua

SEQ ID NO: 78359 - RNA, 21 nt, Human
caguuucagcacucaaccuca

SEQ ID NO: 78360 - RNA, 26 nt, Human
gcugcucugugcccuguccggccagg

SEQ ID NO: 78361 - RNA, 20 nt, Human
cgcagcguuacugccugugu

SEQ ID NO: 78362 - RNA, 21 nt, Human
uugggguugguuggggugggg

SEQ ID NO: 78363 - RNA, 22 nt, Human
ccauugcccuccagccugggug

SEQ ID NO: 78364 - RNA, 26 nt, Human
gggcaccuccagcugccccugggaug

SEQ ID NO: 78365 - RNA, 23 nt, Human
ucucaggauggguccugggggcc

SEQ ID NO: 78366 - RNA, 20 nt, Human
cugagacuagauucucaccu

SEQ ID NO: 78367 - RNA, 22 nt, Human
acuucagccucccaaauagcug

SEQ ID NO: 78368 - RNA, 28 nt, Human
caguauuucuauccugacugccucuugg

SEQ ID NO: 78369 - RNA, 21 nt, Human
gcaucaaggcucacugcagcc

SEQ ID NO: 78370 - RNA, 21 nt, Human
cuccaucugucaacaggggcg

SEQ ID NO: 78371 - RNA, 25 nt, Human
cuaccccucagcuccgguagucgcc

SEQ ID NO: 78372 - RNA, 23 nt, Human
gguucaagugauucuucuugccu

SEQ ID NO: 78373 - RNA, 27 nt, Human
ugggcaagagaaaaguccacagugaua

SEQ ID NO: 78374 - RNA, 19 nt, Human
ggaucaccggcgugcccca

SEQ ID NO: 78375 - RNA, 20 nt, Human
guaugcagacugguuguagu

SEQ ID NO: 78376 - RNA, 22 nt, Human
agaaggcagaggugguccgugg

SEQ ID NO: 78377 - RNA, 25 nt, Human
acccaggcuagagugcaguggcgcg

SEQ ID NO: 78378 - RNA, 25 nt, Human
acccaggcuggagugcaauggcgcg

SEQ ID NO: 78379 - RNA, 26 nt, Human
aaugcuguuuauucaugcugagguga

SEQ ID NO: 78380 - RNA, 19 nt, Human
cguguugucacuggguuga

SEQ ID NO: 78381 - RNA, 20 nt, Human
ucucuccugauuauuuauca

SEQ ID NO: 78382 - RNA, 27 nt, Human
gaccagccugaccgacauggagaaacc

SEQ ID NO: 78383 - RNA, 26 nt, Human
uggcucugucucccaggcuggagugc

SEQ ID NO: 78384 - RNA, 27 nt, Human
uuccuuugauugauagagaaggacagu

SEQ ID NO: 78385 - RNA, 29 nt, Human
guuuugggaggaaaacaauugaauuacau

SEQ ID NO: 78386 - RNA, 20 nt, Human
ggaggcagagguugcaauga

SEQ ID NO: 78387 - RNA, 25 nt, Human
gucucaucuguugcacuguauuuca

SEQ ID NO: 78388 - RNA, 25 nt, Human
acacuggucuagaauugagagguug

SEQ ID NO: 78389 - RNA, 22 nt, Human
ucuucauuuucuuuuggaggac

SEQ ID NO: 78390 - RNA, 23 nt, Human
agcgagacauugaguugcugcug

SEQ ID NO: 78391 - RNA, 21 nt, Human
ugcuggaggcagagggcaagg

SEQ ID NO: 78392 - RNA, 24 nt, Human
uguacaguagggguagagaugcag

SEQ ID NO: 78393 - RNA, 27 nt, Human
gaggcauucaccuuuauguguuagaaa

SEQ ID NO: 78394 - RNA, 27 nt, Human
ugccuauacuaagaaucuauacugcag

SEQ ID NO: 78395 - RNA, 22 nt, Human
gagcaagacucugucucaauaa

SEQ ID NO: 78396 - RNA, 24 nt, Human
ccuccugcccgccugagaacugca

SEQ ID NO: 78397 - RNA, 22 nt, Human
cuccagccuucucucucugguc

SEQ ID NO: 78398 - RNA, 22 nt, Human
cggcuggcggaggaggaggcga

SEQ ID NO: 78399 - RNA, 22 nt, Human
ugccacuuaauagcucugugau

SEQ ID NO: 78400 - RNA, 21 nt, Human
uucuaauuccagucauuuugg

SEQ ID NO: 78401 - RNA, 31 nt, Human
ucccucugccacuauccccagggaaggaaag

SEQ ID NO: 78402 - RNA, 25 nt, Human
caggaggucgggaaaggcaguccug

SEQ ID NO: 78403 - RNA, 22 nt, Human
gucacccaggcuggaguacaau

SEQ ID NO: 78404 - RNA, 27 nt, Human
aguuuccccauggugaauguuaccgga

SEQ ID NO: 78405 - RNA, 23 nt, Human
ucuucugcucuuucuucuuccac

SEQ ID NO: 78406 - RNA, 23 nt, Human
ucacugcauccuggagugcaaaa

SEQ ID NO: 78407 - RNA, 21 nt, Human
ccggaagcagaagccuggugg

SEQ ID NO: 78408 - RNA, 22 nt, Human
ucucuuaccgcgagacugagag

SEQ ID NO: 78409 - RNA, 23 nt, Human
uggaaacugcuugaaaucuugcu

SEQ ID NO: 78410 - RNA, 26 nt, Human
cccaacucuccccugaccugugagcc

SEQ ID NO: 78411 - RNA, 27 nt, Human
gcgucccccacacccucccucagcccc

SEQ ID NO: 78412 - RNA, 23 nt, Human
ggcuuugcagaaaggaaaugaga

SEQ ID NO: 78413 - RNA, 23 nt, Human
ccugcugcuucucccaacagccc

SEQ ID NO: 78414 - RNA, 22 nt, Human
cucaccccccacaccuuccccg

SEQ ID NO: 78415 - RNA, 26 nt, Human
caaaacuguugguaaaugucagauuu

SEQ ID NO: 78416 - RNA, 24 nt, Human
cccccugcaacuuccgcugagggg

SEQ ID NO: 78417 - RNA, 20 nt, Human
augccgaccuuuccccacca

SEQ ID NO: 78418 - RNA, 26 nt, Human
ucccuuuccuccccaggaauaugugu

SEQ ID NO: 78419 - RNA, 22 nt, Human
ugacuucagagcuuucucucca

SEQ ID NO: 78420 - RNA, 25 nt, Human
cccucccuucucaccucuggagcug

SEQ ID NO: 78421 - RNA, 27 nt, Human
ggcucacaccugugaucccagcacuuu

SEQ ID NO: 78422 - RNA, 26 nt, Human
accgggcgcccacccuguccuccucc

SEQ ID NO: 78423 - RNA, 25 nt, Human
cuucucacucuaaaagaaagauauu

SEQ ID NO: 78424 - RNA, 25 nt, Human
ccuaaggacagcuacaaaggaaaga

SEQ ID NO: 78425 - RNA, 22 nt, Human
caacuugaagauuguagcaaua

SEQ ID NO: 78426 - RNA, 20 nt, Human
gucagaaggucagcauuuac

SEQ ID NO: 78427 - RNA, 24 nt, Human
agcaggaaugacaaagcuugcuuu

SEQ ID NO: 78428 - RNA, 21 nt, Human
ccugccuggcuugucuguucc

SEQ ID NO: 78429 - RNA, 23 nt, Human
uggagagaggacuguccugaggg

SEQ ID NO: 78430 - RNA, 24 nt, Human
cucucuucaagcggcgacccccua

SEQ ID NO: 78431 - RNA, 27 nt, Human
cucauuucauaagacuuacaauaacuc

SEQ ID NO: 78432 - RNA, 26 nt, Human
uuguccaggcuggagugcaauagcgc

SEQ ID NO: 78433 - RNA, 20 nt, Human
aucuuuucuauaaguuuaca

SEQ ID NO: 78434 - RNA, 21 nt, Human
ccuccuguuccaccucagguu

SEQ ID NO: 78435 - RNA, 24 nt, Human
agccuguuuguuucuaaagauguu

SEQ ID NO: 78436 - RNA, 23 nt, Human
guucucuucucucuucaaucucu

SEQ ID NO: 78437 - RNA, 21 nt, Human
agugauuugggaaugccuuca

SEQ ID NO: 78438 - RNA, 25 nt, Human
aucuauugcucuaccucaggggucc

SEQ ID NO: 78439 - RNA, 19 nt, Human
ccagcagaacugaagugug

SEQ ID NO: 78440 - RNA, 26 nt, Human
gagacaaacaccucccaggagacagu

SEQ ID NO: 78441 - RNA, 20 nt, Human
auugcccaccugggugugau

SEQ ID NO: 78442 - RNA, 23 nt, Human
guacaguacgauauaucauuccu

SEQ ID NO: 78443 - RNA, 27 nt, Human
cagccuauuuuauacuuuuuauuuauu

SEQ ID NO: 78444 - RNA, 27 nt, Human
agaugcacacauaucuguacauauaca

SEQ ID NO: 78445 - RNA, 19 nt, Human
cugugugaccugggaguga

SEQ ID NO: 78446 - RNA, 25 nt, Human
uuuuaaucacacauugaaaaauuca

SEQ ID NO: 78447 - RNA, 21 nt, Human
ucuguguuauuuuaucuuuaa

SEQ ID NO: 78448 - RNA, 27 nt, Human
ggucucgaucuccugaccucuugaucu

SEQ ID NO: 78449 - RNA, 24 nt, Human
ggucaucucaguuucuuuucucac

SEQ ID NO: 78450 - RNA, 27 nt, Human
ucaugccacgaacaugcuccacagccu

SEQ ID NO: 78451 - RNA, 25 nt, Human
gaugcagcugcucauacucaauccc

SEQ ID NO: 78452 - RNA, 21 nt, Human
gccuguaauuccaucauuuug

SEQ ID NO: 78453 - RNA, 27 nt, Human
ucaaugaaaaaaucgaauugguggcuu

SEQ ID NO: 78454 - RNA, 22 nt, Human
cucagccucccaaagugcaggg

SEQ ID NO: 78455 - RNA, 25 nt, Human
ccuuccuggcccagcagcccauggc

SEQ ID NO: 78456 - RNA, 26 nt, Human
agaggaagaauuaaggggcauguugg

SEQ ID NO: 78457 - RNA, 27 nt, Human
cuccugccucucccauggcuuacagcu

SEQ ID NO: 78458 - RNA, 22 nt, Human
uagaaagaguucuauggagacu

SEQ ID NO: 78459 - RNA, 22 nt, Human
cacgccuguaaucccagcaguu

SEQ ID NO: 78460 - RNA, 23 nt, Human
gccaugccacaaggugggggagg

SEQ ID NO: 78461 - RNA, 22 nt, Human
cagggagggguuccccuuggua

SEQ ID NO: 78462 - RNA, 29 nt, Human
ucuuagguuucuuuuccugucccucuucc

SEQ ID NO: 78463 - RNA, 27 nt, Human
uggaaguucaugauauuuugauuucaa

SEQ ID NO: 78464 - RNA, 23 nt, Human
cuugcagaguaagucggguggca

SEQ ID NO: 78465 - RNA, 21 nt, Human
cacugccugucugcucuguuc

SEQ ID NO: 78466 - RNA, 24 nt, Human
ggccacgucacaaccucugaucuc

SEQ ID NO: 78467 - RNA, 27 nt, Human
gucauuucccuguucacuuacugacau

SEQ ID NO: 78468 - RNA, 23 nt, Human
gagcgagaccucuaucucaaaaa

SEQ ID NO: 78469 - RNA, 23 nt, Human
ugcuggcuggacggcaccacccu

SEQ ID NO: 78470 - RNA, 19 nt, Human
cugccuucacagugcagug

SEQ ID NO: 78471 - RNA, 21 nt, Human
uagcuguaacaguucuuuuug

SEQ ID NO: 78472 - RNA, 21 nt, Human
gggcaggucucucaaccaggc

SEQ ID NO: 78473 - RNA, 22 nt, Human
uauuuucccaauagcacuuuca

SEQ ID NO: 78474 - RNA, 23 nt, Human
aagugugcuaaaaaugagcuuga

SEQ ID NO: 78475 - RNA, 22 nt, Human
uuugcugcugcuacacauccuc

SEQ ID NO: 78476 - RNA, 26 nt, Human
cugagagaacugggugaugacagggg

SEQ ID NO: 78477 - RNA, 18 nt, Human
gggacagaagcagaggag

SEQ ID NO: 78478 - RNA, 24 nt, Human
cuggugggggguggggcacacauu

SEQ ID NO: 78479 - RNA, 27 nt, Human
caucuacacuguggaguacgccugcag

SEQ ID NO: 78480 - RNA, 21 nt, Human
cuucaugugguuuauugcgag

SEQ ID NO: 78481 - RNA, 22 nt, Human
cguggguggggagggagguguu

SEQ ID NO: 78482 - RNA, 27 nt, Human
gaggaagagaagacaccagugccucag

SEQ ID NO: 78483 - RNA, 24 nt, Human
cacuggauuaaacaaauucacaua

SEQ ID NO: 78484 - RNA, 22 nt, Human
gcaaaggaagcagcugagacug

SEQ ID NO: 78485 - RNA, 22 nt, Human
caaaauggagcagccuacuaua

SEQ ID NO: 78486 - RNA, 22 nt, Human
augauaauaguucacuuauacc

SEQ ID NO: 78487 - RNA, 27 nt, Human
uucuacccuucuucugagauguccucu

SEQ ID NO: 78488 - RNA, 24 nt, Human
ccugcuggcagggacuugcagugg

SEQ ID NO: 78489 - RNA, 22 nt, Human
uuuggaaucugaccccuuggau

SEQ ID NO: 78490 - RNA, 22 nt, Human
ucuaauacucuacccucuuaga

SEQ ID NO: 78491 - RNA, 29 nt, Human
gaacagccugucuguucugcuccuagaca

SEQ ID NO: 78492 - RNA, 27 nt, Human
cucccacauccuggccucuccucucca

SEQ ID NO: 78493 - RNA, 22 nt, Human
ccacugcaauucagccugggug

SEQ ID NO: 78494 - RNA, 21 nt, Human
ugcgccacuacacuccagccu

SEQ ID NO: 78495 - RNA, 22 nt, Human
guccucucccaaguccacacag

SEQ ID NO: 78496 - RNA, 27 nt, Human
cgucccccuggccccucaguguccaug

SEQ ID NO: 78497 - RNA, 21 nt, Human
uuacauguguuuuucucuccc

SEQ ID NO: 78498 - RNA, 21 nt, Human
cuguguguguuggggagcugu

SEQ ID NO: 78499 - RNA, 17 nt, Human
cuucccuuuccaagccg

SEQ ID NO: 78500 - RNA, 26 nt, Human
uguuuuuaauaaaugugaauuuuuua

SEQ ID NO: 78501 - RNA, 22 nt, Human
ugaaucugcggauugcuuuuuc

SEQ ID NO: 78502 - RNA, 21 nt, Human
agugggcccaagcaaggggcc

SEQ ID NO: 78503 - RNA, 21 nt, Human
cuuacuaauuugggcuuuuca

SEQ ID NO: 78504 - RNA, 19 nt, Human
cuuccccugacuccccacc

SEQ ID NO: 78505 - RNA, 27 nt, Human
auugccccucugccuugcccuccuggg

SEQ ID NO: 78506 - RNA, 22 nt, Human
caagaggacagaggcuggugag

SEQ ID NO: 78507 - RNA, 28 nt, Human
gugcgagugcaccaugcucacuguugcu

SEQ ID NO: 78508 - RNA, 24 nt, Human
cuguguagaaacuggaagcuguuc

SEQ ID NO: 78509 - RNA, 22 nt, Human
ggaccagggaugcugugcugcu

SEQ ID NO: 78510 - RNA, 24 nt, Human
cagugguucuuaaauuguaagcuc

SEQ ID NO: 78511 - RNA, 26 nt, Human
cccuucugagccuguccauucaucgg

SEQ ID NO: 78512 - RNA, 20 nt, Human
acuccuccagccuccucccu

SEQ ID NO: 78513 - RNA, 19 nt, Human
acaccugcuuccucccucg

SEQ ID NO: 78514 - RNA, 21 nt, Human
uauuaaaagggauauuuauuc

SEQ ID NO: 78515 - RNA, 31 nt, Human
ccuucucuuucuucguucccugcccacuggg

SEQ ID NO: 78516 - RNA, 23 nt, Human
gcuuuuaaaacaguacauuccug

SEQ ID NO: 78517 - RNA, 26 nt, Human
ugauauucucaccauccugacugaag

SEQ ID NO: 78518 - RNA, 22 nt, Human
gggauuacaggcaugagucauu

SEQ ID NO: 78519 - RNA, 21 nt, Human
gcuucuaaguaggcuugcugu

SEQ ID NO: 78520 - RNA, 21 nt, Human
cccugcucccuauccugcccc

SEQ ID NO: 78521 - RNA, 22 nt, Human
acaucuggugaccaggcugcuu

SEQ ID NO: 78522 - RNA, 22 nt, Human
uucuugggaagcagaucagccu

SEQ ID NO: 78523 - RNA, 27 nt, Human
gaccggguggaggcgguggggacccag

SEQ ID NO: 78524 - RNA, 27 nt, Human
uuggggcaggaaaggaaugcugcugaa

SEQ ID NO: 78525 - RNA, 22 nt, Human
aagccuggccuccugaugcugu

SEQ ID NO: 78526 - RNA, 26 nt, Human
ggccucuccccggcacguucucagcu

SEQ ID NO: 78527 - RNA, 27 nt, Human
ggcacagccauguuuugucuucucucu

SEQ ID NO: 78528 - RNA, 25 nt, Human
cacacacacccuuccccacucccgu

SEQ ID NO: 78529 - RNA, 27 nt, Human
uaguugggauuacaggugacugccacc

SEQ ID NO: 78530 - RNA, 23 nt, Human
agaaauguuaaagguucacaggg

SEQ ID NO: 78531 - RNA, 22 nt, Human
auaauacuucagccaccagguu

SEQ ID NO: 78532 - RNA, 25 nt, Human
aaacuggucuacugugucucuaggg

SEQ ID NO: 78533 - RNA, 21 nt, Human
cagcagccaggugcacggagc

SEQ ID NO: 78534 - RNA, 21 nt, Human
cuggaggcugguucugcugcc

SEQ ID NO: 78535 - RNA, 24 nt, Human
auggaaccucuggaaaggacaggg

SEQ ID NO: 78536 - RNA, 20 nt, Human
gcauuggaaagacuggcaaa

SEQ ID NO: 78537 - RNA, 27 nt, Human
cccuccagggaaugcugaguuccaguu

SEQ ID NO: 78538 - RNA, 21 nt, Human
acuguacuuacaguguuucca

SEQ ID NO: 78539 - RNA, 20 nt, Human
aaucccugacccuuugaggc

SEQ ID NO: 78540 - RNA, 27 nt, Human
uccuauuggaaacagagagguuuuucu

SEQ ID NO: 78541 - RNA, 22 nt, Human
caagcgcugagauuacaggugu

SEQ ID NO: 78542 - RNA, 22 nt, Human
uuugggagcugcaggucacaca

SEQ ID NO: 78543 - RNA, 24 nt, Human
cugcaccagccggccucagccugg

SEQ ID NO: 78544 - RNA, 27 nt, Human
cucaaguagcugggacuacagaugugg

SEQ ID NO: 78545 - RNA, 19 nt, Human
ccugcuuauugccucuuuc

SEQ ID NO: 78546 - RNA, 27 nt, Human
uuccaucgugaagccauaaacaggaau

SEQ ID NO: 78547 - RNA, 22 nt, Human
acugggugguagcgugucugaa

SEQ ID NO: 78548 - RNA, 26 nt, Human
gccagccacagggaagggccaagccc

SEQ ID NO: 78549 - RNA, 23 nt, Human
acuccugccagcuugggggagug

SEQ ID NO: 78550 - RNA, 20 nt, Human
caugaguuuuuucucuuggg

SEQ ID NO: 78551 - RNA, 23 nt, Human
gaggaagaggaaggggccucauc

SEQ ID NO: 78552 - RNA, 19 nt, Human
cacagaugggcaaggccuu

SEQ ID NO: 78553 - RNA, 27 nt, Human
uggagccgccgcaccccgacuccuggg

SEQ ID NO: 78554 - RNA, 23 nt, Human
cauugcuguggcugagcuggaag

SEQ ID NO: 78555 - RNA, 22 nt, Human
uguaugaacugcuuuaccaaau

SEQ ID NO: 78556 - RNA, 20 nt, Human
auguuggccaggauggucuc

SEQ ID NO: 78557 - RNA, 27 nt, Human
ugggaacacuggcagacuguguaaaau

SEQ ID NO: 78558 - RNA, 24 nt, Human
acugcagcugcaccagcaggugcc

SEQ ID NO: 78559 - RNA, 22 nt, Human
uuugaggccuugguggauggga

SEQ ID NO: 78560 - RNA, 22 nt, Human
cugaucaccugcccugcugagu

SEQ ID NO: 78561 - RNA, 23 nt, Human
agucuggagugcaguggugugau

SEQ ID NO: 78562 - RNA, 20 nt, Human
uaguagcaauaauuucugua

SEQ ID NO: 78563 - RNA, 25 nt, Human
cgcuccguggacuggaaagcuguuc

SEQ ID NO: 78564 - RNA, 22 nt, Human
gccuuugccugcgcggcucaga

SEQ ID NO: 78565 - RNA, 22 nt, Human
gcacaugccuguaaucccaguu

SEQ ID NO: 78566 - RNA, 20 nt, Human
aacuugcuccuuuccaucag

SEQ ID NO: 78567 - RNA, 22 nt, Human
ugggcucuucuuggcagagggg

SEQ ID NO: 78568 - RNA, 20 nt, Human
acuucaaaugaauaguauua

SEQ ID NO: 78569 - RNA, 24 nt, Human
aucccccaggcuauggagggcgga

SEQ ID NO: 78570 - RNA, 24 nt, Human
ggcugaggaauucuucuguucucu

SEQ ID NO: 78571 - RNA, 20 nt, Human
auauacaagcuccauaacuc

SEQ ID NO: 78572 - RNA, 25 nt, Human
acagccuggucccugauacugggcu

SEQ ID NO: 78573 - RNA, 23 nt, Human
uucacuuuccccaucacacucac

SEQ ID NO: 78574 - RNA, 23 nt, Human
cacagcaaagaaaaggaauagga

SEQ ID NO: 78575 - RNA, 27 nt, Human
ugucuggucuggggcuuggauguugca

SEQ ID NO: 78576 - RNA, 20 nt, Human
agaaagggagagaaguuuga

SEQ ID NO: 78577 - RNA, 23 nt, Human
ugcuccugccuuccugagggcca

SEQ ID NO: 78578 - RNA, 23 nt, Human
acuuacuauuuagaugagaucuu

SEQ ID NO: 78579 - RNA, 26 nt, Human
augccuaaauacaagauucucugaua

SEQ ID NO: 78580 - RNA, 22 nt, Human
cugaggcaugaaaauuguguua

SEQ ID NO: 78581 - RNA, 25 nt, Human
cacccguggaagugggaggaggugg

SEQ ID NO: 78582 - RNA, 24 nt, Human
gggggccuuugaggcugugguugg

SEQ ID NO: 78583 - RNA, 22 nt, Human
gugcaguugguacaguacuuug

SEQ ID NO: 78584 - RNA, 26 nt, Human
gggaggcugaggcaagagaguugcuu

SEQ ID NO: 78585 - RNA, 23 nt, Human
uacaugguaauuaugugauauaa

SEQ ID NO: 78586 - RNA, 22 nt, Human
uccaggccucccuggagaggug

SEQ ID NO: 78587 - RNA, 22 nt, Human
cacccuccaaucugcacuuuga

SEQ ID NO: 78588 - RNA, 21 nt, Human
auuaguccauuucugcugcua

SEQ ID NO: 78589 - RNA, 27 nt, Human
ucucaacuaauuucuacauugccagaa

SEQ ID NO: 78590 - RNA, 24 nt, Human
gggaaguaaacgcuuccagaggaa

SEQ ID NO: 78591 - RNA, 22 nt, Human
caccuccuggguucaagcaguu

SEQ ID NO: 78592 - RNA, 21 nt, Human
ucuccucuccccucuaaggcc

SEQ ID NO: 78593 - RNA, 21 nt, Human
ugcagcacuucacuaccaaau

SEQ ID NO: 78594 - RNA, 26 nt, Human
aagaaguccuuggggaagcugcuggu

SEQ ID NO: 78595 - RNA, 20 nt, Human
caaaccuguaaucccagcac

SEQ ID NO: 78596 - RNA, 25 nt, Human
cggggguaaggcaagagagggugga

SEQ ID NO: 78597 - RNA, 28 nt, Human
ggacuauagaucauaggcaaugcaugaa

SEQ ID NO: 78598 - RNA, 27 nt, Human
auagguggggaaaucugaaguggguac

SEQ ID NO: 78599 - RNA, 20 nt, Human
gucccuggggagacuugaaa

SEQ ID NO: 78600 - RNA, 18 nt, Human
ucucugcccagcuuuuca

SEQ ID NO: 78601 - RNA, 23 nt, Human
ggcugggaggggaguguggcagg

SEQ ID NO: 78602 - RNA, 21 nt, Human
gcucagccaggcuggaggcgg

SEQ ID NO: 78603 - RNA, 22 nt, Human
cucaguuuuuccauuuguucag

SEQ ID NO: 78604 - RNA, 19 nt, Human
uuuccccuucugugucuca

SEQ ID NO: 78605 - RNA, 21 nt, Human
acucuaauucuaaccagagca

SEQ ID NO: 78606 - RNA, 18 nt, Human
aaacuuaacauuagccag

SEQ ID NO: 78607 - RNA, 27 nt, Human
uccuagaguagaguggagggagggugg

SEQ ID NO: 78608 - RNA, 20 nt, Human
gugccucacucagcuccugc

SEQ ID NO: 78609 - RNA, 22 nt, Human
agcagccagcccugccuggagg

SEQ ID NO: 78610 - RNA, 27 nt, Human
caaccaaaggcauaagaacuaggagcu

SEQ ID NO: 78611 - RNA, 19 nt, Human
cccaggcuggagguuaaug

SEQ ID NO: 78612 - RNA, 28 nt, Human
gaggcagggagaggcgggacuucgcggg

SEQ ID NO: 78613 - RNA, 25 nt, Human
gcaugaucauagcucacugcagccu

SEQ ID NO: 78614 - RNA, 21 nt, Human
auuaggacuuuuaucaugccc

SEQ ID NO: 78615 - RNA, 20 nt, Human
acucagggagagccugggga

SEQ ID NO: 78616 - RNA, 24 nt, Human
ggcuguaggugugcacugucuauu

SEQ ID NO: 78617 - RNA, 21 nt, Human
caggcggaucaccugaggucg

SEQ ID NO: 78618 - RNA, 22 nt, Human
cuggcaccuggggcagccgcgc

SEQ ID NO: 78619 - RNA, 21 nt, Human
acaagugucugcuacagucgc

SEQ ID NO: 78620 - RNA, 27 nt, Human
cucuaggguuaagccaaaagacaaaaa

SEQ ID NO: 78621 - RNA, 23 nt, Human
gagaguguuguaaaguguggaaa

SEQ ID NO: 78622 - RNA, 23 nt, Human
agcuagcaguuuguccagccucu

SEQ ID NO: 78623 - RNA, 24 nt, Human
ccuuugucucuucauaccgguuuu

SEQ ID NO: 78624 - RNA, 27 nt, Human
agcuagcaauuccuuuuucuguguucc

SEQ ID NO: 78625 - RNA, 25 nt, Human
uuuguuacccaggcuggagugcagu

SEQ ID NO: 78626 - RNA, 22 nt, Human
agcucacugcaaacucugccuc

SEQ ID NO: 78627 - RNA, 22 nt, Human
uaucuuucccucagucucccaa

SEQ ID NO: 78628 - RNA, 21 nt, Human
aacugcauuugaaauucucca

SEQ ID NO: 78629 - RNA, 22 nt, Human
cacuuucaugcaucucugggaa

SEQ ID NO: 78630 - RNA, 21 nt, Human
aucauucuuuuuuaugguuca

SEQ ID NO: 78631 - RNA, 25 nt, Human
gcaucaagaaagaaguuauucuucc

SEQ ID NO: 78632 - RNA, 14 nt, Human
caucauccuucaug

SEQ ID NO: 78633 - RNA, 23 nt, Human
agaauucugcccaacacaggaga

SEQ ID NO: 78634 - RNA, 26 nt, Human
ggaacuugaggaagugaacauuucgg

SEQ ID NO: 78635 - RNA, 22 nt, Human
cccuuuuauaaggaaacuucug

SEQ ID NO: 78636 - RNA, 21 nt, Human
cgacagagcgagacuccaucu

SEQ ID NO: 78637 - RNA, 27 nt, Human
auuugucuuguuuuucucacacugugu

SEQ ID NO: 78638 - RNA, 26 nt, Human
ugugcuugggggaaaaugaaggggag

SEQ ID NO: 78639 - RNA, 23 nt, Human
ccucugcuuacuugcccaacaca

SEQ ID NO: 78640 - RNA, 27 nt, Human
acugcaaccucugccucccggauuuaa

SEQ ID NO: 78641 - RNA, 19 nt, Human
ugagaaugagguugaaaug

SEQ ID NO: 78642 - RNA, 26 nt, Human
gucucauauucuacuguucuaucuag

SEQ ID NO: 78643 - RNA, 22 nt, Human
guacuuccuuucucccugcggg

SEQ ID NO: 78644 - RNA, 23 nt, Human
cugucuccuuucucuuaugcuua

SEQ ID NO: 78645 - RNA, 22 nt, Human
auccucuccccacggcugaugg

SEQ ID NO: 78646 - RNA, 23 nt, Human
acaaggugucuuuuccacuccua

SEQ ID NO: 78647 - RNA, 21 nt, Human
aggcuccugggcuaagggagc

SEQ ID NO: 78648 - RNA, 27 nt, Human
cccugcucgucacuugggauggagacc

SEQ ID NO: 78649 - RNA, 21 nt, Human
aaaagccacgucgugcugcug

SEQ ID NO: 78650 - RNA, 25 nt, Human
ggcuucugcuugucauccacacaac

SEQ ID NO: 78651 - RNA, 22 nt, Human
ucucagccuuccugaccucugc

SEQ ID NO: 78652 - RNA, 21 nt, Human
ccugcagcugaccuggcaacc

SEQ ID NO: 78653 - RNA, 27 nt, Human
ccaacuuguaaauacaccaccucacuc

SEQ ID NO: 78654 - RNA, 22 nt, Human
uucagugagccaugaucaugcc

SEQ ID NO: 78655 - RNA, 29 nt, Human
uccccucugagacuggagugagagggucu

SEQ ID NO: 78656 - RNA, 19 nt, Human
ucuccauuuccugccucuc

SEQ ID NO: 78657 - RNA, 19 nt, Human
cucugcccacuccaucacc

SEQ ID NO: 78658 - RNA, 21 nt, Human
accuugaauuuacagugggaa

SEQ ID NO: 78659 - RNA, 20 nt, Human
guuuugaucucagcauccug

SEQ ID NO: 78660 - RNA, 32 nt, Human
cugucauguguguucccugccugcacaaaccu

SEQ ID NO: 78661 - RNA, 25 nt, Human
agcaguagugccucucggguggcgg

SEQ ID NO: 78662 - RNA, 22 nt, Human
aggaugaggcaggaggaucucu

SEQ ID NO: 78663 - RNA, 20 nt, Human
gacuuccuuuguguuaguua

SEQ ID NO: 78664 - RNA, 21 nt, Human
aacaaucucccaaguauugau

SEQ ID NO: 78665 - RNA, 26 nt, Human
caucaucuguuuguaaucauuaucuc

SEQ ID NO: 78666 - RNA, 18 nt, Human
ucuccauccuccccguca

SEQ ID NO: 78667 - RNA, 27 nt, Human
ggucucgaacuccugaccuggugaucu

SEQ ID NO: 78668 - RNA, 28 nt, Human
gggcuaaggaacaaaucucuccuuugcu

SEQ ID NO: 78669 - RNA, 21 nt, Human
caggagguggaguugcagcug

SEQ ID NO: 78670 - RNA, 26 nt, Human
ggauggugccagcugugccuuggcug

SEQ ID NO: 78671 - RNA, 22 nt, Human
uauuaaaauuuuacacuuuuac

SEQ ID NO: 78672 - RNA, 22 nt, Human
gagaagcccucaggccucgcug

SEQ ID NO: 78673 - RNA, 26 nt, Human
ugcgcuugcuuaguguugacauuuga

SEQ ID NO: 78674 - RNA, 26 nt, Human
aggauuuaaauucacaaaaccugcca

SEQ ID NO: 78675 - RNA, 23 nt, Human
caguuaaugcuacaguuacugua

SEQ ID NO: 78676 - RNA, 27 nt, Human
ccccaacaaacucuacuauccaauaug

SEQ ID NO: 78677 - RNA, 19 nt, Human
ucaggggaauaaaguguca

SEQ ID NO: 78678 - RNA, 21 nt, Human
acaaucaggaugacaaucacc

SEQ ID NO: 78679 - RNA, 29 nt, Human
uggcagcuaucuuaccagacugugccuaa

SEQ ID NO: 78680 - RNA, 22 nt, Human
gagcccaggaggucgaggcugc

SEQ ID NO: 78681 - RNA, 20 nt, Human
gcuauagagaacauucuucc

SEQ ID NO: 78682 - RNA, 21 nt, Human
uuucagaugauuucauugagc

SEQ ID NO: 78683 - RNA, 21 nt, Human
acaaagccacagccacacucu

SEQ ID NO: 78684 - RNA, 21 nt, Human
gcuaaaacugcagcauuuuac

SEQ ID NO: 78685 - RNA, 24 nt, Human
cagguauuugaguuguuuuggugc

SEQ ID NO: 78686 - RNA, 26 nt, Human
agucccgggcuggcgggagugcaguu

SEQ ID NO: 78687 - RNA, 25 nt, Human
gcuggcaggaaugaggcucacaacu

SEQ ID NO: 78688 - RNA, 23 nt, Human
gaaagauacuugguuucuguuaa

SEQ ID NO: 78689 - RNA, 20 nt, Human
ggggucgggugguggagagg

SEQ ID NO: 78690 - RNA, 27 nt, Human
agauauugagacaggcuggaguccaga

SEQ ID NO: 78691 - RNA, 20 nt, Human
ugagacagacuugugguucu

SEQ ID NO: 78692 - RNA, 26 nt, Human
gcugcuucucuggggcugggcucuac

SEQ ID NO: 78693 - RNA, 22 nt, Human
cugguaacauaauaauguguaa

SEQ ID NO: 78694 - RNA, 22 nt, Human
uucaagcaaaucuccugccuca

SEQ ID NO: 78695 - RNA, 24 nt, Human
gagguaguuuugaauggcauuuca

SEQ ID NO: 78696 - RNA, 22 nt, Human
augugggaaagccuuuaguuug

SEQ ID NO: 78697 - RNA, 25 nt, Human
gccuuucuccuccccaccuguagcu

SEQ ID NO: 78698 - RNA, 20 nt, Human
ggcucagggcugcugccuuc

SEQ ID NO: 78699 - RNA, 23 nt, Human
cccuccccaaacccaucagacag

SEQ ID NO: 78700 - RNA, 22 nt, Human
gauuucucccuguauugaggcu

SEQ ID NO: 78701 - RNA, 22 nt, Human
ggguugguuccuagaggcagag

SEQ ID NO: 78702 - RNA, 21 nt, Human
ccccugccuugucccaccagg

SEQ ID NO: 78703 - RNA, 19 nt, Human
uuguguuuucuuuucuccu

SEQ ID NO: 78704 - RNA, 22 nt, Human
ucagccacugucacaggcauau

SEQ ID NO: 78705 - RNA, 20 nt, Human
ucaguguugggguugcagga

SEQ ID NO: 78706 - RNA, 20 nt, Human
cugugggaaggccagcugcc

SEQ ID NO: 78707 - RNA, 26 nt, Human
ggacgcucuggcgagggcagacccca

SEQ ID NO: 78708 - RNA, 21 nt, Human
caucugaaaagcccuccugga

SEQ ID NO: 78709 - RNA, 19 nt, Human
uuagggcagauuuucaugc

SEQ ID NO: 78710 - RNA, 24 nt, Human
aacucugucuggcuuccuagagga

SEQ ID NO: 78711 - RNA, 21 nt, Human
caaggacugaccagggaccuu

SEQ ID NO: 78712 - RNA, 21 nt, Human
ugugucuucagacaguuugaa

SEQ ID NO: 78713 - RNA, 24 nt, Human
ccauuccugccuuccagugcccca

SEQ ID NO: 78714 - RNA, 26 nt, Human
ccuccuccuccucaccaccuuggggc

SEQ ID NO: 78715 - RNA, 21 nt, Human
uuuaccuucacaccagcagug

SEQ ID NO: 78716 - RNA, 24 nt, Human
ccaacagggucagugucacagcca

SEQ ID NO: 78717 - RNA, 24 nt, Human
ggcuccgucuucugcuccucagag

SEQ ID NO: 78718 - RNA, 20 nt, Human
uggacuuugguuuucagaca

SEQ ID NO: 78719 - RNA, 26 nt, Human
cugaccuggccccuuucugcggcugc

SEQ ID NO: 78720 - RNA, 20 nt, Human
uuuaaaguguagcauuucag

SEQ ID NO: 78721 - RNA, 27 nt, Human
cagccaucuuagauuucuuuguuccug

SEQ ID NO: 78722 - RNA, 25 nt, Human
ggguaaaaggaaugacuguccuuga

SEQ ID NO: 78723 - RNA, 23 nt, Human
guugggaaagauggacuuacggg

SEQ ID NO: 78724 - RNA, 21 nt, Human
gccaccaauaugggaccugug

SEQ ID NO: 78725 - RNA, 17 nt, Human
caacaacagcagacuuc

SEQ ID NO: 78726 - RNA, 26 nt, Human
gcagacacaccugucccccagugaug

SEQ ID NO: 78727 - RNA, 26 nt, Human
gcauuuauuuacauagugucauucca

SEQ ID NO: 78728 - RNA, 25 nt, Human
ggcucuggaagaaaaggaaaaaguc

SEQ ID NO: 78729 - RNA, 23 nt, Human
augcugaggagaacuacaguuuu

SEQ ID NO: 78730 - RNA, 22 nt, Human
aaauguuccccaaauaauuguu

SEQ ID NO: 78731 - RNA, 26 nt, Human
gcuuccuucuccucaccaucuuccca

SEQ ID NO: 78732 - RNA, 20 nt, Human
aagcugaugacuuugcagug

SEQ ID NO: 78733 - RNA, 22 nt, Human
uaguucugccuugaguccugcc

SEQ ID NO: 78734 - RNA, 27 nt, Human
ccugcugucagaccuucuuccacagca

SEQ ID NO: 78735 - RNA, 16 nt, Human
uagauguuuuauucca

SEQ ID NO: 78736 - RNA, 23 nt, Human
aggcuggaaggcagcaggcauuu

SEQ ID NO: 78737 - RNA, 27 nt, Human
uuugcagcugcagaauguguaguaccu

SEQ ID NO: 78738 - RNA, 28 nt, Human
ggugacaaggccuuagggccaaaagucu

SEQ ID NO: 78739 - RNA, 24 nt, Human
aguugcuguagacugaacuguagc

SEQ ID NO: 78740 - RNA, 22 nt, Human
ucuucauuccuacaaaggacga

SEQ ID NO: 78741 - RNA, 22 nt, Human
gcuccucccugugucuuguaug

SEQ ID NO: 78742 - RNA, 26 nt, Human
ggagaaacguauaucccuacaaaccu

SEQ ID NO: 78743 - RNA, 25 nt, Human
gaucccauggguuguguguuuauuu

SEQ ID NO: 78744 - RNA, 22 nt, Human
agucuccugaguagcuaggacu

SEQ ID NO: 78745 - RNA, 20 nt, Human
guuauuuacugacaguggug

SEQ ID NO: 78746 - RNA, 26 nt, Human
gcccugcucgguuuaggccugucugc

SEQ ID NO: 78747 - RNA, 25 nt, Human
aggaaacugucuggggugauuccua

SEQ ID NO: 78748 - RNA, 24 nt, Human
gcagcuagcaagggugcuuguagu

SEQ ID NO: 78749 - RNA, 27 nt, Human
ccugccugguguggagggcucugucug

SEQ ID NO: 78750 - RNA, 19 nt, Human
gaccucgggauccuccugg

SEQ ID NO: 78751 - RNA, 26 nt, Human
uucucuccuuuuaauuuugguguauc

SEQ ID NO: 78752 - RNA, 22 nt, Human
aguuacccgagggaaaauaaau

SEQ ID NO: 78753 - RNA, 26 nt, Human
cgggaggucaggagcgcggcgggcga

SEQ ID NO: 78754 - RNA, 27 nt, Human
augcacagaggggaucacugugcagug

SEQ ID NO: 78755 - RNA, 26 nt, Human
gcacagacauguuuauccacauacac

SEQ ID NO: 78756 - RNA, 27 nt, Human
cugagccccaagaccccgggggccaug

SEQ ID NO: 78757 - RNA, 20 nt, Human
cuguccguuuaaaugcugcu

SEQ ID NO: 78758 - RNA, 24 nt, Human
ccucccucggacacauggcugcuu

SEQ ID NO: 78759 - RNA, 24 nt, Human
ggcggggcuugccuucugguguug

SEQ ID NO: 78760 - RNA, 22 nt, Human
cuguacucugggugacucagag

SEQ ID NO: 78761 - RNA, 22 nt, Human
ccacagcaacuauauauuucca

SEQ ID NO: 78762 - RNA, 18 nt, Human
gccucuccccugccugcc

SEQ ID NO: 78763 - RNA, 23 nt, Human
ugcacacagaguaggcaucuuua

SEQ ID NO: 78764 - RNA, 27 nt, Human
acagagcgagaaggugucaggagcagc

SEQ ID NO: 78765 - RNA, 22 nt, Human
ugagacuacaggcacacaccac

SEQ ID NO: 78766 - RNA, 22 nt, Human
ccaggaggcagagguuggggug

SEQ ID NO: 78767 - RNA, 21 nt, Human
uccugauaacauuauguggcc

SEQ ID NO: 78768 - RNA, 29 nt, Human
gcugcgcgucuccagccucugcacacaca

SEQ ID NO: 78769 - RNA, 22 nt, Human
cuaacagcaaauaaauuaacua

SEQ ID NO: 78770 - RNA, 22 nt, Human
gcgugagccaccacgccccgcc

SEQ ID NO: 78771 - RNA, 20 nt, Human
cuccgcgccucacgccccgg

SEQ ID NO: 78772 - RNA, 22 nt, Human
acugaaugauagcacaauccag

SEQ ID NO: 78773 - RNA, 25 nt, Human
cuguugcuagaccgagccuguggga

SEQ ID NO: 78774 - RNA, 23 nt, Human
accuauaaucccagcacuuuagg

SEQ ID NO: 78775 - RNA, 24 nt, Human
aaagugcucagauuucaacugugu

SEQ ID NO: 78776 - RNA, 19 nt, Human
ggaucugcauuuagcaaug

SEQ ID NO: 78777 - RNA, 21 nt, Human
uggggcuggggagaggacuua

SEQ ID NO: 78778 - RNA, 22 nt, Human
ccugaauaaagcagacaggugu

SEQ ID NO: 78779 - RNA, 20 nt, Human
gcccggagugcaugggcgcg

SEQ ID NO: 78780 - RNA, 24 nt, Human
ucagccugcuuucucaucuguaaa

SEQ ID NO: 78781 - RNA, 20 nt, Human
ucucagcccacucucccugu

SEQ ID NO: 78782 - RNA, 22 nt, Human
guacacuuucugucucaaaccc

SEQ ID NO: 78783 - RNA, 25 nt, Human
agccuccucuuucugucucugauca

SEQ ID NO: 78784 - RNA, 23 nt, Human
cucagcuugguaugugaaaauga

SEQ ID NO: 78785 - RNA, 26 nt, Human
cugccauggacagcccgugccagccg

SEQ ID NO: 78786 - RNA, 27 nt, Human
ugcagugaacuguggcuguauaugcau

SEQ ID NO: 78787 - RNA, 21 nt, Human
gcagagugggggcagugccuu

SEQ ID NO: 78788 - RNA, 21 nt, Human
gggcauccuggauggaauuga

SEQ ID NO: 78789 - RNA, 19 nt, Human
ucugccccugcuccagucg

SEQ ID NO: 78790 - RNA, 26 nt, Human
cugggccagcugggguagagcggagg

SEQ ID NO: 78791 - RNA, 29 nt, Human
gggagggagcucuuucucuggcccugcag

SEQ ID NO: 78792 - RNA, 20 nt, Human
cucucauuccauuucugccu

SEQ ID NO: 78793 - RNA, 22 nt, Human
guguccucuggcugaguggcca

SEQ ID NO: 78794 - RNA, 20 nt, Human
gggggagggggcaaaugagc

SEQ ID NO: 78795 - RNA, 20 nt, Human
accuuuuuugcacagcaguc

SEQ ID NO: 78796 - RNA, 27 nt, Human
aacagcaucugccucuauucaauuuaa

SEQ ID NO: 78797 - RNA, 21 nt, Human
ugcccuugugcccugccucca

SEQ ID NO: 78798 - RNA, 25 nt, Human
ugccucacaucucccuuccaccuca

SEQ ID NO: 78799 - RNA, 32 nt, Human
cugcaucuugcucugugccuuggcccugaccc

SEQ ID NO: 78800 - RNA, 27 nt, Human
ggagagggcgcagccgaugcgggcggc

SEQ ID NO: 78801 - RNA, 22 nt, Human
cuguuucucuggguuguuuguc

SEQ ID NO: 78802 - RNA, 21 nt, Human
uuucuuucuuuuguguuggau

SEQ ID NO: 78803 - RNA, 27 nt, Human
ggccaggggucucccuggagugcaguu

SEQ ID NO: 78804 - RNA, 22 nt, Human
ugaauuaaagucuacacugccu

SEQ ID NO: 78805 - RNA, 21 nt, Human
ugagguggagguugcggugag

SEQ ID NO: 78806 - RNA, 22 nt, Human
cuaucuggugauuucuagcucu

SEQ ID NO: 78807 - RNA, 20 nt, Human
gagugaccaacccaaagagg

SEQ ID NO: 78808 - RNA, 24 nt, Human
uuccauucccagaauauguuugcu

SEQ ID NO: 78809 - RNA, 21 nt, Human
accaggagccuccuccacacc

SEQ ID NO: 78810 - RNA, 21 nt, Human
uccaugacaccugccggcagu

SEQ ID NO: 78811 - RNA, 26 nt, Human
accaggggcugcuguaauuaccgagc

SEQ ID NO: 78812 - RNA, 18 nt, Human
guccaguggaaugcaggu

SEQ ID NO: 78813 - RNA, 21 nt, Human
uggaauauaauggaauauucu

SEQ ID NO: 78814 - RNA, 22 nt, Human
auuauccaggcugagauggaaa

SEQ ID NO: 78815 - RNA, 21 nt, Human
gggaggcgagagcccggcagc

SEQ ID NO: 78816 - RNA, 22 nt, Human
acccaggcuugagugcaguggu

SEQ ID NO: 78817 - RNA, 22 nt, Human
ggguugucugugugcauauguc

SEQ ID NO: 78818 - RNA, 20 nt, Human
gucuagcuuaguuucagaga

SEQ ID NO: 78819 - RNA, 23 nt, Human
acuccugaauauucugauuucau

SEQ ID NO: 78820 - RNA, 21 nt, Human
uaauauuuuguaacaaaaaga

SEQ ID NO: 78821 - RNA, 27 nt, Human
cagauaguguaauugcuacauucucug

SEQ ID NO: 78822 - RNA, 22 nt, Human
gugcccagagcacuacucucaa

SEQ ID NO: 78823 - RNA, 22 nt, Human
gcccuuaccccuccugcccgcc

SEQ ID NO: 78824 - RNA, 23 nt, Human
ucucgaacuccugaccucaggug

SEQ ID NO: 78825 - RNA, 23 nt, Human
gggccaaaaguauccaagguuag

SEQ ID NO: 78826 - RNA, 22 nt, Human
ugcguuucagugaccuaccuua

SEQ ID NO: 78827 - RNA, 22 nt, Human
uccugcuccguggacugcaguc

SEQ ID NO: 78828 - RNA, 22 nt, Human
ccuuccaggaauuccuuguuga

SEQ ID NO: 78829 - RNA, 24 nt, Human
aggagaaggaagagucuaauagua

SEQ ID NO: 78830 - RNA, 25 nt, Human
agcaaugcccugccuugcugccuuc

SEQ ID NO: 78831 - RNA, 22 nt, Human
cucaggguucccagagcucauu

SEQ ID NO: 78832 - RNA, 21 nt, Human
gccccacuccagaauagccaa

SEQ ID NO: 78833 - RNA, 22 nt, Human
ucaaauacuccguccuggaagc

SEQ ID NO: 78834 - RNA, 21 nt, Human
acuccagcuccuggguuaggg

SEQ ID NO: 78835 - RNA, 20 nt, Human
gggcagugucugucacuggc

SEQ ID NO: 78836 - RNA, 26 nt, Human
aggaagauggagguuuaccgguuguu

SEQ ID NO: 78837 - RNA, 23 nt, Human
uccuccccuccuucgcucgcuca

SEQ ID NO: 78838 - RNA, 20 nt, Human
gaggaccuggaguggcacug

SEQ ID NO: 78839 - RNA, 26 nt, Human
guagggagugcguagcaggguggagu

SEQ ID NO: 78840 - RNA, 26 nt, Human
ccuuucucucccucucaguaaagcaa

SEQ ID NO: 78841 - RNA, 18 nt, Human
caaaccagagauguucaa

SEQ ID NO: 78842 - RNA, 26 nt, Human
aaaugacugguuuuuguuugcuugca

SEQ ID NO: 78843 - RNA, 26 nt, Human
cugauuucccugcucucucugcucag

SEQ ID NO: 78844 - RNA, 20 nt, Human
cucugcuggggagauaaaaa

SEQ ID NO: 78845 - RNA, 24 nt, Human
uucuccauucucuagcaucccucc

SEQ ID NO: 78846 - RNA, 25 nt, Human
ccugccagacccugcucacauuccc

SEQ ID NO: 78847 - RNA, 19 nt, Human
uguagcagccuccaggcag

SEQ ID NO: 78848 - RNA, 25 nt, Human
caguguggaguguugagaccagaca

SEQ ID NO: 78849 - RNA, 20 nt, Human
uguggguggaagagggagua

SEQ ID NO: 78850 - RNA, 23 nt, Human
uaguaguggguuucuauuuuguu

SEQ ID NO: 78851 - RNA, 21 nt, Human
ugcauuugcaaaaugugcaaa

SEQ ID NO: 78852 - RNA, 32 nt, Human
uggagcagcaaagagaagaacaaaagcgcaga

SEQ ID NO: 78853 - RNA, 24 nt, Human
gugugggagggagggaggaggaau

SEQ ID NO: 78854 - RNA, 21 nt, Human
gggucugagugguaccccgga

SEQ ID NO: 78855 - RNA, 24 nt, Human
cuguaugcccugcucccuuugcug

SEQ ID NO: 78856 - RNA, 21 nt, Human
gcacacacacccuaccuucca

SEQ ID NO: 78857 - RNA, 25 nt, Human
cagcagaugcuguugaauaacacca

SEQ ID NO: 78858 - RNA, 20 nt, Human
auugcaaacuauuccucagg

SEQ ID NO: 78859 - RNA, 21 nt, Human
cucacagacugacuugggcuc

SEQ ID NO: 78860 - RNA, 28 nt, Human
ugcuucuuuauaaaugcauuaaauaaga

SEQ ID NO: 78861 - RNA, 22 nt, Human
caaccuccugggcucaagcaac

SEQ ID NO: 78862 - RNA, 18 nt, Human
ggugaagacagggccagc

SEQ ID NO: 78863 - RNA, 18 nt, Human
cagaggacuuccccaaau

SEQ ID NO: 78864 - RNA, 21 nt, Human
agcugaggccuggggauguga

SEQ ID NO: 78865 - RNA, 24 nt, Human
uagcgccuacccucauaccuaucu

SEQ ID NO: 78866 - RNA, 21 nt, Human
gcccuccuucccuccugugcc

SEQ ID NO: 78867 - RNA, 25 nt, Human
gauagugaugguaacugaugccuuu

SEQ ID NO: 78868 - RNA, 26 nt, Human
uccuccaggaauucccagcaggcucu

SEQ ID NO: 78869 - RNA, 23 nt, Human
ucauuuugauuuucucucucaca

SEQ ID NO: 78870 - RNA, 23 nt, Human
ccuaacaggaauuuucauuguuc

SEQ ID NO: 78871 - RNA, 21 nt, Human
aacaacaauaacacugucucc

SEQ ID NO: 78872 - RNA, 22 nt, Human
aagcaccagggaauuaauuccc

SEQ ID NO: 78873 - RNA, 27 nt, Human
auuuuucuccccuugcucuuccuggcc

SEQ ID NO: 78874 - RNA, 20 nt, Human
gucggcugcaaaggcagcag

SEQ ID NO: 78875 - RNA, 22 nt, Human
agagggaggggauaagagaggu

SEQ ID NO: 78876 - RNA, 25 nt, Human
aacucuucgccagcauaucaucccg

SEQ ID NO: 78877 - RNA, 26 nt, Human
ccuguaaucccagcacuuugagaggc

SEQ ID NO: 78878 - RNA, 25 nt, Human
cauagcucaugcccuucagcuuuga

SEQ ID NO: 78879 - RNA, 21 nt, Human
ucagcuuuaaccaauggauga

SEQ ID NO: 78880 - RNA, 27 nt, Human
uguaugcugggguagagcaaguagccc

SEQ ID NO: 78881 - RNA, 20 nt, Human
ggcaccagggacuuccugac

SEQ ID NO: 78882 - RNA, 22 nt, Human
gaauccaggaggcaguggacau

SEQ ID NO: 78883 - RNA, 22 nt, Human
aggcugaggcacgagauucacu

SEQ ID NO: 78884 - RNA, 26 nt, Human
ggggaguucuggguggaggaggagga

SEQ ID NO: 78885 - RNA, 21 nt, Human
aaaccugaaguguggcugcau

SEQ ID NO: 78886 - RNA, 23 nt, Human
cacccaggccucagaguuucagg

SEQ ID NO: 78887 - RNA, 20 nt, Human
aacuguucugagaaggugaa

SEQ ID NO: 78888 - RNA, 23 nt, Human
aagagagccccagagcagaggaa

SEQ ID NO: 78889 - RNA, 25 nt, Human
gucuggaagaaagauaaaauaguga

SEQ ID NO: 78890 - RNA, 27 nt, Human
ccccaagacuuucuucuagauauaucu

SEQ ID NO: 78891 - RNA, 17 nt, Human
gcuccuccccuuucaca

SEQ ID NO: 78892 - RNA, 21 nt, Human
acauaguaaucuuuagcuuuu

SEQ ID NO: 78893 - RNA, 18 nt, Human
ggcuccaccucuguccuc

SEQ ID NO: 78894 - RNA, 24 nt, Human
cuggacucuguaaacccacugggc

SEQ ID NO: 78895 - RNA, 24 nt, Human
gauucagcaaaaaucucccaguga

SEQ ID NO: 78896 - RNA, 27 nt, Human
ccugugcacagguagccccucaugcug

SEQ ID NO: 78897 - RNA, 26 nt, Human
ucacugcucaccugaggauaacucaa

SEQ ID NO: 78898 - RNA, 24 nt, Human
uuccagccuccaagucaccuggcc

SEQ ID NO: 78899 - RNA, 24 nt, Human
acacugugugcgaaggcuuggagu

SEQ ID NO: 78900 - RNA, 21 nt, Human
acgaucaugccacugcacucc

SEQ ID NO: 78901 - RNA, 27 nt, Human
ggucucgaucucuugaccuggugaucu

SEQ ID NO: 78902 - RNA, 25 nt, Human
cagaacagcagcagacgugucggga

SEQ ID NO: 78903 - RNA, 20 nt, Human
ucuccaggaggggcaggugg

SEQ ID NO: 78904 - RNA, 23 nt, Human
acacuagagucauauaagaaaua

SEQ ID NO: 78905 - RNA, 26 nt, Human
uguaaaccacaaggcuguugcauggg

SEQ ID NO: 78906 - RNA, 22 nt, Human
agagacagcgugaugccuccca

SEQ ID NO: 78907 - RNA, 19 nt, Human
uuugaugcccauugagugc

SEQ ID NO: 78908 - RNA, 26 nt, Human
ggacagggaagggagcaggagccugc

SEQ ID NO: 78909 - RNA, 23 nt, Human
uaaauugagcuuuggaucaaacu

SEQ ID NO: 78910 - RNA, 26 nt, Human
ccucuggcuccugaauaucagucacu

SEQ ID NO: 78911 - RNA, 22 nt, Human
ucccuguauucaaaaacaaaug

SEQ ID NO: 78912 - RNA, 24 nt, Human
agggaaagucagcuuucagagcca

SEQ ID NO: 78913 - RNA, 24 nt, Human
ccugcucccagccugcugagagcc

SEQ ID NO: 78914 - RNA, 20 nt, Human
acgggggccgaggccaggcu

SEQ ID NO: 78915 - RNA, 17 nt, Human
uccuagagucuacaugc

SEQ ID NO: 78916 - RNA, 23 nt, Human
gaagaagaaaagagagaaguuaa

SEQ ID NO: 78917 - RNA, 22 nt, Human
ggccagcagugugugacuuugg

SEQ ID NO: 78918 - RNA, 19 nt, Human
aacuccaucugcugccaug

SEQ ID NO: 78919 - RNA, 24 nt, Human
ccuccuccccagccgccuggagcg

SEQ ID NO: 78920 - RNA, 27 nt, Human
cacagccggcccccggcccacguuuuc

SEQ ID NO: 78921 - RNA, 26 nt, Human
gggugaggccaaaucagguccagcaa

SEQ ID NO: 78922 - RNA, 16 nt, Human
uuuugcuuuguaagua

SEQ ID NO: 78923 - RNA, 28 nt, Human
guuccaggguucucuuguuuugaucugc

SEQ ID NO: 78924 - RNA, 21 nt, Human
auuccucuaagaucuugccuc

SEQ ID NO: 78925 - RNA, 24 nt, Human
cccauguagccccagucauccugc

SEQ ID NO: 78926 - RNA, 22 nt, Human
uggagcuggagcaggcacuugc

SEQ ID NO: 78927 - RNA, 23 nt, Human
gaagcaccuggggaaucccgcca

SEQ ID NO: 78928 - RNA, 20 nt, Human
ucuuuuuucuuuugguccag

SEQ ID NO: 78929 - RNA, 14 nt, Human
ggugggugggugga

SEQ ID NO: 78930 - RNA, 28 nt, Human
ggccaggcuccagcacuucaguacguca

SEQ ID NO: 78931 - RNA, 22 nt, Human
cggccaggcuggagugcagugg

SEQ ID NO: 78932 - RNA, 22 nt, Human
gcccaggcggggugcgaguggc

SEQ ID NO: 78933 - RNA, 28 nt, Human
uguuuacucucugggcacuguuguaaga

SEQ ID NO: 78934 - RNA, 24 nt, Human
agaggggaugucuggcuugccuga

SEQ ID NO: 78935 - RNA, 23 nt, Human
uaacugcaguaacagaaaccuuu

SEQ ID NO: 78936 - RNA, 26 nt, Human
gaaaguugguccagauauaugucaca

SEQ ID NO: 78937 - RNA, 21 nt, Human
ucaugccucauccugcagccu

SEQ ID NO: 78938 - RNA, 22 nt, Human
caggcugcaguguaguggugca

SEQ ID NO: 78939 - RNA, 23 nt, Human
uguaccucuuuugcuugccaaag

SEQ ID NO: 78940 - RNA, 20 nt, Human
gggaggaagaagaguguuua

SEQ ID NO: 78941 - RNA, 23 nt, Human
uauacugcagcuuuacugccuuc

SEQ ID NO: 78942 - RNA, 21 nt, Human
cucuguacacaugauaugcaa

SEQ ID NO: 78943 - RNA, 20 nt, Human
uggaaagagugugcugcccc

SEQ ID NO: 78944 - RNA, 25 nt, Human
cucaaagccugcaucaauaaaugaa

SEQ ID NO: 78945 - RNA, 23 nt, Human
aggcugcagugcaguggugugau

SEQ ID NO: 78946 - RNA, 25 nt, Human
uggaaucccugugggaagugcuccc

SEQ ID NO: 78947 - RNA, 24 nt, Human
gggcggaguguguuagucucucca

SEQ ID NO: 78948 - RNA, 23 nt, Human
ccugaucaaguuuauugcagccu

SEQ ID NO: 78949 - RNA, 26 nt, Human
uguuuuuaguuaaaaguaucuacuua

SEQ ID NO: 78950 - RNA, 27 nt, Human
agagacacuuaagcuaaaaauucccuu

SEQ ID NO: 78951 - RNA, 25 nt, Human
uaucugcugggaacacuugcauuug

SEQ ID NO: 78952 - RNA, 21 nt, Human
gaguuggcaucaccugcgcag

SEQ ID NO: 78953 - RNA, 20 nt, Human
ggccacaaaaguucccucuc

SEQ ID NO: 78954 - RNA, 19 nt, Human
accugucagggcaguacaa

SEQ ID NO: 78955 - RNA, 20 nt, Human
uauucaaagcagcuguaauu

SEQ ID NO: 78956 - RNA, 21 nt, Human
uccuagaggacagugcuaugu

SEQ ID NO: 78957 - RNA, 23 nt, Human
ugaauuucaacuuuugacaauca

SEQ ID NO: 78958 - RNA, 21 nt, Human
aguacccaucuguugugcgca

SEQ ID NO: 78959 - RNA, 27 nt, Human
cucugugcaaauuuaaaacaaauaaca

SEQ ID NO: 78960 - RNA, 27 nt, Human
ccagcucccgggagcccuuaagcccca

SEQ ID NO: 78961 - RNA, 25 nt, Human
ucaagccccagcagcccucaacagg

SEQ ID NO: 78962 - RNA, 20 nt, Human
acagguggagcugacccucg

SEQ ID NO: 78963 - RNA, 27 nt, Human
cacucacugauuccuacacauugccaa

SEQ ID NO: 78964 - RNA, 25 nt, Human
acuuucuucuuucugugauaauuca

SEQ ID NO: 78965 - RNA, 20 nt, Human
cagguaauccgucugccuug

SEQ ID NO: 78966 - RNA, 20 nt, Human
uguuaaaucagaaauuuuuu

SEQ ID NO: 78967 - RNA, 23 nt, Human
gugccgaucuuagcugcugccug

SEQ ID NO: 78968 - RNA, 21 nt, Human
uugauugaaucuggacaauaa

SEQ ID NO: 78969 - RNA, 27 nt, Human
gggcccuuauguacccaccuaaaacca

SEQ ID NO: 78970 - RNA, 22 nt, Human
agagggagagaucgaagacuga

SEQ ID NO: 78971 - RNA, 21 nt, Human
uggcggccgugggcuccuggg

SEQ ID NO: 78972 - RNA, 26 nt, Human
gccaggacccggaucauucacuguga

SEQ ID NO: 78973 - RNA, 29 nt, Human
ugucgcccaggcuggagugcaggggcgca

SEQ ID NO: 78974 - RNA, 26 nt, Human
ucagcacuuggcaucuugucaucuac

SEQ ID NO: 78975 - RNA, 22 nt, Human
aaagugcugggaugaccagcau

SEQ ID NO: 78976 - RNA, 19 nt, Human
gugacacccuaucuuguca

SEQ ID NO: 78977 - RNA, 27 nt, Human
cugggcccagcuggagguucugacagg

SEQ ID NO: 78978 - RNA, 23 nt, Human
agacugaggcaggcggagcugcu

SEQ ID NO: 78979 - RNA, 25 nt, Human
ggagagggagggccgggaagccagg

SEQ ID NO: 78980 - RNA, 20 nt, Human
aacugauuaagggugagcag

SEQ ID NO: 78981 - RNA, 20 nt, Human
cacugccucucgcccuguau

SEQ ID NO: 78982 - RNA, 27 nt, Human
uucuccucuucugguccugcccgggag

SEQ ID NO: 78983 - RNA, 26 nt, Human
gaggggagggggcgcccaggaggggu

SEQ ID NO: 78984 - RNA, 22 nt, Human
cguauguaaucccagcacuuug

SEQ ID NO: 78985 - RNA, 22 nt, Human
auaauagaguuuauuguauuua

SEQ ID NO: 78986 - RNA, 26 nt, Human
ggggagaagcaaggguugggcccagu

SEQ ID NO: 78987 - RNA, 25 nt, Human
gcugccaggaaccucauuuuccugg

SEQ ID NO: 78988 - RNA, 24 nt, Human
ucagagggagcgccuggcagcagc

SEQ ID NO: 78989 - RNA, 26 nt, Human
uugcucugucgcccaggcuggaguac

SEQ ID NO: 78990 - RNA, 21 nt, Human
cccaccccgugcagcccaugc

SEQ ID NO: 78991 - RNA, 22 nt, Human
cacugcacuccagccugggugg

SEQ ID NO: 78992 - RNA, 31 nt, Human
auugccucuccaaacgccugccugacgacug

SEQ ID NO: 78993 - RNA, 23 nt, Human
ccuuuugacuggggacuugcugg

SEQ ID NO: 78994 - RNA, 21 nt, Human
cagcugaaagcaccuagcuca

SEQ ID NO: 78995 - RNA, 18 nt, Human
accaaaaccaccaugaca

SEQ ID NO: 78996 - RNA, 21 nt, Human
gcaaagcucuguggccacauu

SEQ ID NO: 78997 - RNA, 21 nt, Human
cucuugauaguccugaccuca

SEQ ID NO: 78998 - RNA, 22 nt, Human
uaaacaacagcaaauauacuug

SEQ ID NO: 78999 - RNA, 23 nt, Human
ggcaguuuuuauggcguuuugua

SEQ ID NO: 79000 - RNA, 20 nt, Human
ucaccaaccucuaacugcag

SEQ ID NO: 79001 - RNA, 21 nt, Human
ucagggcgacuuccacagcag

SEQ ID NO: 79002 - RNA, 19 nt, Human
aaacuccacccaccuggcu

SEQ ID NO: 79003 - RNA, 27 nt, Human
ugggacccccaacauucugcccucacc

SEQ ID NO: 79004 - RNA, 24 nt, Human
cuccugcaaggggcucaacccccu

SEQ ID NO: 79005 - RNA, 27 nt, Human
ccacugcacuccaggcuggguaacaga

SEQ ID NO: 79006 - RNA, 27 nt, Human
gaagaauuuaaaggucuuuuuaaggaa

SEQ ID NO: 79007 - RNA, 22 nt, Human
ucagaaaaggggugaaagagaa

SEQ ID NO: 79008 - RNA, 21 nt, Human
ccacccaggcagggagcaagu

SEQ ID NO: 79009 - RNA, 23 nt, Human
aacagcuuccuucagaucuggaa

SEQ ID NO: 79010 - RNA, 25 nt, Human
ggggugagaggaggcccaggaggag

SEQ ID NO: 79011 - RNA, 24 nt, Human
ugggaccccccucagccccucccu

SEQ ID NO: 79012 - RNA, 25 nt, Human
ucuccuugcuccuggccuugcugac

SEQ ID NO: 79013 - RNA, 20 nt, Human
ggauacgcuggcagcaaaga

SEQ ID NO: 79014 - RNA, 22 nt, Human
accauccuggcuaacaugguaa

SEQ ID NO: 79015 - RNA, 27 nt, Human
ccugcuguggccucuuaugcacuccac

SEQ ID NO: 79016 - RNA, 24 nt, Human
gcgcgggagagcgggagccucggc

SEQ ID NO: 79017 - RNA, 22 nt, Human
gccacaucagcaccauccgaga

SEQ ID NO: 79018 - RNA, 23 nt, Human
acacuaugcauuaaaagcacuuu

SEQ ID NO: 79019 - RNA, 18 nt, Human
guuuuuaaaggcuuucua

SEQ ID NO: 79020 - RNA, 23 nt, Human
gcaccgucccacagcaucuccua

SEQ ID NO: 79021 - RNA, 25 nt, Human
gggcgcaggcccaccuuggcauggc

SEQ ID NO: 79022 - RNA, 24 nt, Human
agggcaugcgcacaaggcugacca

SEQ ID NO: 79023 - RNA, 23 nt, Human
caacauagcaagacccccaucuc

SEQ ID NO: 79024 - RNA, 22 nt, Human
cgggcggggguccgggagaagc

SEQ ID NO: 79025 - RNA, 24 nt, Human
cagaaggguacuaacagggccaag

SEQ ID NO: 79026 - RNA, 28 nt, Human
aaucagaaaagcuaacaacuaggaagaa

SEQ ID NO: 79027 - RNA, 27 nt, Human
gcuugucuucuugacugucuucccucu

SEQ ID NO: 79028 - RNA, 22 nt, Human
cugucugaccucuacggaccuc

SEQ ID NO: 79029 - RNA, 23 nt, Human
uggugagaguccaacagacacaa

SEQ ID NO: 79030 - RNA, 24 nt, Human
aguugccugaaucaucccagcuca

SEQ ID NO: 79031 - RNA, 21 nt, Human
cccaagauccugcaggggcca

SEQ ID NO: 79032 - RNA, 23 nt, Human
uaucuaaaugaaaaagaaagaaa

SEQ ID NO: 79033 - RNA, 24 nt, Human
gcagagauuggagugcccugcgga

SEQ ID NO: 79034 - RNA, 20 nt, Human
ugcucuuuccucccccacca

SEQ ID NO: 79035 - RNA, 22 nt, Human
ucuaucucucuuugccuaucuc

SEQ ID NO: 79036 - RNA, 22 nt, Human
gccagcuguacugccggcucug

SEQ ID NO: 79037 - RNA, 22 nt, Human
caccugaaccccagaggcagag

SEQ ID NO: 79038 - RNA, 27 nt, Human
ccagcuccuaguagcuuuccucccaaa

SEQ ID NO: 79039 - RNA, 21 nt, Human
ggagggcagaguccccaucac

SEQ ID NO: 79040 - RNA, 23 nt, Human
uaggaaaucguaaaucaugugaa

SEQ ID NO: 79041 - RNA, 24 nt, Human
ccuucccuggcccuuggcugugac

SEQ ID NO: 79042 - RNA, 21 nt, Human
caccauggagugaguggccuu

SEQ ID NO: 79043 - RNA, 22 nt, Human
gcgugagccugucgucccagcu

SEQ ID NO: 79044 - RNA, 24 nt, Human
ccuggccugaucuggccucugccc

SEQ ID NO: 79045 - RNA, 25 nt, Human
ggagcaaaggcugagaacacuguga

SEQ ID NO: 79046 - RNA, 26 nt, Human
caccucugugcccagccuggaaaccu

SEQ ID NO: 79047 - RNA, 27 nt, Human
gucauuuuucaucaagcaacagaggac

SEQ ID NO: 79048 - RNA, 23 nt, Human
gacugggaaggaagccugugaug

SEQ ID NO: 79049 - RNA, 17 nt, Human
aucugaaaaccccauuu

SEQ ID NO: 79050 - RNA, 27 nt, Human
gagggaagauggcggacgaggagaagc

SEQ ID NO: 79051 - RNA, 26 nt, Human
aggaggucaaggcuucagugagccau

SEQ ID NO: 79052 - RNA, 22 nt, Human
ccaaauagcugggauuacaggu

SEQ ID NO: 79053 - RNA, 22 nt, Human
ccaaguagcugggauuacagau

SEQ ID NO: 79054 - RNA, 23 nt, Human
ugcacaucgaaggugggguggga

SEQ ID NO: 79055 - RNA, 22 nt, Human
uauuuucuauuuuucaccagaa

SEQ ID NO: 79056 - RNA, 22 nt, Human
ggcucacugcaacuuccgccuc

SEQ ID NO: 79057 - RNA, 18 nt, Human
gccacugcaauucagccu

SEQ ID NO: 79058 - RNA, 21 nt, Human
uuugaugccaucaccagccua

SEQ ID NO: 79059 - RNA, 19 nt, Human
cugacaccuccacccucua

SEQ ID NO: 79060 - RNA, 22 nt, Human
uguauuccagacugggugacag

SEQ ID NO: 79061 - RNA, 27 nt, Human
aaauguucguuuucuccugccugugcu

SEQ ID NO: 79062 - RNA, 25 nt, Human
ugugcccgugcacaccagugacuac

SEQ ID NO: 79063 - RNA, 21 nt, Human
uuacccaggcuggucucaaac

SEQ ID NO: 79064 - RNA, 21 nt, Human
uuuuaugcuggacucuggacc

SEQ ID NO: 79065 - RNA, 21 nt, Human
gccuauaaucccagcacuuug

SEQ ID NO: 79066 - RNA, 21 nt, Human
gccuauaaucucagcacucug

SEQ ID NO: 79067 - RNA, 21 nt, Human
ugaaggaggugagggauguga

SEQ ID NO: 79068 - RNA, 23 nt, Human
guggcacucuugccaguccuuga

SEQ ID NO: 79069 - RNA, 27 nt, Human
cuugacagaugucugggaaagcagagu

SEQ ID NO: 79070 - RNA, 20 nt, Human
auccuguggagugaucccau

SEQ ID NO: 79071 - RNA, 21 nt, Human
ccccacugggugggcagaggu

SEQ ID NO: 79072 - RNA, 23 nt, Human
guggaccuugagaccacaggguu

SEQ ID NO: 79073 - RNA, 27 nt, Human
gccuggauccuuccagcucauucuuug

SEQ ID NO: 79074 - RNA, 26 nt, Human
ugcuucugacuuuuacggacuuggcu

SEQ ID NO: 79075 - RNA, 24 nt, Human
uggugcgggcaccuguaguccuag

SEQ ID NO: 79076 - RNA, 24 nt, Human
auccucuccaugcugagcuugaca

SEQ ID NO: 79077 - RNA, 22 nt, Human
gaggcuggggccccaucuugau

SEQ ID NO: 79078 - RNA, 21 nt, Human
guuccccaggaagagagcagg

SEQ ID NO: 79079 - RNA, 22 nt, Human
gaagaagagaaagauguguuuu

SEQ ID NO: 79080 - RNA, 23 nt, Human
acccgggcuggggcgcagaggga

SEQ ID NO: 79081 - RNA, 26 nt, Human
cggaguauuugcagaaggcucaggca

SEQ ID NO: 79082 - RNA, 21 nt, Human
ucuugucuucuuuuuaauuua

SEQ ID NO: 79083 - RNA, 21 nt, Human
agaaggcagagguugcaguga

SEQ ID NO: 79084 - RNA, 27 nt, Human
uguuuuuaauaagauguucuauuuuaa

SEQ ID NO: 79085 - RNA, 21 nt, Human
agagaaacccagggaggaaga

SEQ ID NO: 79086 - RNA, 27 nt, Human
agcuaauuauuuauuucuuuuguauuu

SEQ ID NO: 79087 - RNA, 19 nt, Human
guuuuguucacuguauuua

SEQ ID NO: 79088 - RNA, 29 nt, Human
ucuacuugccugccucccugccucuggcc

SEQ ID NO: 79089 - RNA, 19 nt, Human
ccccugccaggcuggggcu

SEQ ID NO: 79090 - RNA, 20 nt, Human
ccuguaacuuaauuuuguga

SEQ ID NO: 79091 - RNA, 25 nt, Human
cugccgccugccugccugccacuga

SEQ ID NO: 79092 - RNA, 26 nt, Human
cugcagcugcaccaucacacaugcau

SEQ ID NO: 79093 - RNA, 21 nt, Human
ucagaaucugaaagcggaagg

SEQ ID NO: 79094 - RNA, 25 nt, Human
agcagucagcaccaguucugcacca

SEQ ID NO: 79095 - RNA, 22 nt, Human
gagggaagcggcuagaggaucg

SEQ ID NO: 79096 - RNA, 25 nt, Human
ucugcucugcugacuggggaaguca

SEQ ID NO: 79097 - RNA, 22 nt, Human
acccaugagcccgugaccgugu

SEQ ID NO: 79098 - RNA, 18 nt, Human
cuacuccucugcagugcc

SEQ ID NO: 79099 - RNA, 27 nt, Human
acugcaaccucugccuccuaaguucag

SEQ ID NO: 79100 - RNA, 21 nt, Human
ccggcugcaaaugaggggaca

SEQ ID NO: 79101 - RNA, 22 nt, Human
gcccgcgagcugaaauucgcgg

SEQ ID NO: 79102 - RNA, 19 nt, Human
ggccucgggcaccgcgucc

SEQ ID NO: 79103 - RNA, 22 nt, Human
cacuccucaguccuuggcacag

SEQ ID NO: 79104 - RNA, 20 nt, Human
ugggagggaaagggagaaug

SEQ ID NO: 79105 - RNA, 27 nt, Human
gaguccccagaaccagcugcagaugga

SEQ ID NO: 79106 - RNA, 23 nt, Human
agauacaaauuaauuuuacucca

SEQ ID NO: 79107 - RNA, 22 nt, Human
uucuggcuucugaaagugagau

SEQ ID NO: 79108 - RNA, 25 nt, Human
uaccuuuuuucacuuuuccuccucc

SEQ ID NO: 79109 - RNA, 22 nt, Human
aucguuugaacccgggaagcgg

SEQ ID NO: 79110 - RNA, 22 nt, Human
acuuaaagauccuuagcauuaa

SEQ ID NO: 79111 - RNA, 21 nt, Human
cuccuggcccuggccagaagc

SEQ ID NO: 79112 - RNA, 25 nt, Human
auacacacaccauacacuauccaca

SEQ ID NO: 79113 - RNA, 17 nt, Human
cuguuuuuaccuaguua

SEQ ID NO: 79114 - RNA, 27 nt, Human
ggcugagcucugaggggugggugcuca

SEQ ID NO: 79115 - RNA, 21 nt, Human
gcugaggucagaaggaggcgu

SEQ ID NO: 79116 - RNA, 23 nt, Human
ucucccacccucuuuuccaagcu

SEQ ID NO: 79117 - RNA, 18 nt, Human
uaugccuugcccuagcca

SEQ ID NO: 79118 - RNA, 22 nt, Human
gcaucucaucuuucucuuuuca

SEQ ID NO: 79119 - RNA, 24 nt, Human
ugaacaacaggauauauagacuga

SEQ ID NO: 79120 - RNA, 24 nt, Human
uucaugcaaccagaaacuaguuaa

SEQ ID NO: 79121 - RNA, 21 nt, Human
ggcuugucuuugucugguaga

SEQ ID NO: 79122 - RNA, 22 nt, Human
gauuuucuuaucacaaaaaaga

SEQ ID NO: 79123 - RNA, 22 nt, Human
cugaguauucucaggagggacg

SEQ ID NO: 79124 - RNA, 29 nt, Human
gccugucuguucugcuccuagacauuaga

SEQ ID NO: 79125 - RNA, 23 nt, Human
ugaagcucaucacagcgaaccag

SEQ ID NO: 79126 - RNA, 20 nt, Human
ccagaacugagcgcuguggg

SEQ ID NO: 79127 - RNA, 27 nt, Human
ggucucgaucucuugaccucaugaucu

SEQ ID NO: 79128 - RNA, 22 nt, Human
cauucagagucagccaggacca

SEQ ID NO: 79129 - RNA, 29 nt, Human
guucacagccaaaccacugacauuccucc

SEQ ID NO: 79130 - RNA, 24 nt, Human
agucguccguggguuucccgccag

SEQ ID NO: 79131 - RNA, 21 nt, Human
acagaagugcuagaagccagu

SEQ ID NO: 79132 - RNA, 22 nt, Human
uuuaagaaacacaggguuuugu

SEQ ID NO: 79133 - RNA, 22 nt, Human
gcuccucccccagcuccagggc

SEQ ID NO: 79134 - RNA, 23 nt, Human
aucuuuuuaagcuuauuguguuu

SEQ ID NO: 79135 - RNA, 24 nt, Human
uucauaauaagauaugugcuggua

SEQ ID NO: 79136 - RNA, 16 nt, Human
cgccugguuucuugaa

SEQ ID NO: 79137 - RNA, 26 nt, Human
ggagugagaagggcaugguauuggga

SEQ ID NO: 79138 - RNA, 27 nt, Human
cuggccuuacuuugauuuuuaaaacaa

SEQ ID NO: 79139 - RNA, 27 nt, Human
aagacuccauuugugccucuuggaucc

SEQ ID NO: 79140 - RNA, 19 nt, Human
ccaugggacaaaauuugua

SEQ ID NO: 79141 - RNA, 23 nt, Human
guugcccaagguugcacagcaag

SEQ ID NO: 79142 - RNA, 22 nt, Human
cauuguugaaacaagauaaaga

SEQ ID NO: 79143 - RNA, 27 nt, Human
ucucggagcagcuucaggccucugcca

SEQ ID NO: 79144 - RNA, 22 nt, Human
cccugccaaucucaagcaccug

SEQ ID NO: 79145 - RNA, 25 nt, Human
ccaucuguccaucccaacagcaaga

SEQ ID NO: 79146 - RNA, 18 nt, Human
cugaccugcugaccugug

SEQ ID NO: 79147 - RNA, 24 nt, Human
gggguucggcccugcccguagcac

SEQ ID NO: 79148 - RNA, 28 nt, Human
cuacagugagcuaugauuacaccacugc

SEQ ID NO: 79149 - RNA, 22 nt, Human
caccuguaauccuagcacuuug

SEQ ID NO: 79150 - RNA, 21 nt, Human
cugugugagauugugaagugg

SEQ ID NO: 79151 - RNA, 21 nt, Human
aaaaugcuguaaauauugcau

SEQ ID NO: 79152 - RNA, 23 nt, Human
aucaaggguacacugccuucuca

SEQ ID NO: 79153 - RNA, 23 nt, Human
gacaaggacuaggguccugggga

SEQ ID NO: 79154 - RNA, 23 nt, Human
ggacccaggaaaggcaggauuga

SEQ ID NO: 79155 - RNA, 26 nt, Human
ucugccucuuggguuucagugauuuu

SEQ ID NO: 79156 - RNA, 27 nt, Human
ucuuagcagcuaggauucucaaaugga

SEQ ID NO: 79157 - RNA, 20 nt, Human
aaccgcaucugcucaucuga

SEQ ID NO: 79158 - RNA, 21 nt, Human
aaucccugucauaaaccaggc

SEQ ID NO: 79159 - RNA, 22 nt, Human
ugugauucuguuuauucuucca

SEQ ID NO: 79160 - RNA, 25 nt, Human
ccaacuucauuugcuucucucaaca

SEQ ID NO: 79161 - RNA, 22 nt, Human
gcugccuuuggcuuugaucuca

SEQ ID NO: 79162 - RNA, 25 nt, Human
ggcauagcauuagcugcuuccuccc

SEQ ID NO: 79163 - RNA, 21 nt, Human
ucagagucuuuguagcuuuga

SEQ ID NO: 79164 - RNA, 26 nt, Human
agcaugcuuccuuucucuccuggcuc

SEQ ID NO: 79165 - RNA, 22 nt, Human
gacuaggauccuaauuucucua

SEQ ID NO: 79166 - RNA, 27 nt, Human
caccacugaugccacccaggaccucgg

SEQ ID NO: 79167 - RNA, 22 nt, Human
ccugcugucauugcuucuucug

SEQ ID NO: 79168 - RNA, 22 nt, Human
uguguccaggcuggagugcagu

SEQ ID NO: 79169 - RNA, 25 nt, Human
cagguuagagggacaaagagcuuug

SEQ ID NO: 79170 - RNA, 27 nt, Human
gguuucuggugguggaaaagcucaagc

SEQ ID NO: 79171 - RNA, 23 nt, Human
gucagcaggccggccuggcagug

SEQ ID NO: 79172 - RNA, 26 nt, Human
cuccgucucucggguucaagcaauug

SEQ ID NO: 79173 - RNA, 20 nt, Human
uacccuuuaagaggcggaug

SEQ ID NO: 79174 - RNA, 26 nt, Human
aucuguguuuuauugacaucucuuuu

SEQ ID NO: 79175 - RNA, 24 nt, Human
uccggccgccucgcccuuccccgg

SEQ ID NO: 79176 - RNA, 22 nt, Human
gucucugccacuccugacccag

SEQ ID NO: 79177 - RNA, 20 nt, Human
gguggaaaauggugccugga

SEQ ID NO: 79178 - RNA, 23 nt, Human
agccagggaagcagugcaauggc

SEQ ID NO: 79179 - RNA, 22 nt, Human
cuucccaaacuaauauuuauca

SEQ ID NO: 79180 - RNA, 27 nt, Human
ugggagguggaggcccagcaucccgcg

SEQ ID NO: 79181 - RNA, 21 nt, Human
agaagagagauuagaacuguu

SEQ ID NO: 79182 - RNA, 22 nt, Human
gggcuuugaaggaacuacuuca

SEQ ID NO: 79183 - RNA, 22 nt, Human
gaauagcugggauuacaggcgu

SEQ ID NO: 79184 - RNA, 24 nt, Human
ucuacuugccugccucccugccuc

SEQ ID NO: 79185 - RNA, 23 nt, Human
cacugccaccaucucaaagccau

SEQ ID NO: 79186 - RNA, 22 nt, Human
auucuucuuuugggagcugagc

SEQ ID NO: 79187 - RNA, 19 nt, Human
cuucccaagauccucagca

SEQ ID NO: 79188 - RNA, 20 nt, Human
caggcuccaagaguccaccc

SEQ ID NO: 79189 - RNA, 27 nt, Human
ggagccagauccccauccuauaguuca

SEQ ID NO: 79190 - RNA, 18 nt, Human
uucuccuccuggccuggc

SEQ ID NO: 79191 - RNA, 21 nt, Human
gagucuuagaggaagagaaga

SEQ ID NO: 79192 - RNA, 20 nt, Human
cuggcugcacagcauccucc

SEQ ID NO: 79193 - RNA, 21 nt, Human
uucacuuccccaaucuugucg

SEQ ID NO: 79194 - RNA, 26 nt, Human
gcugcaggcucauuccccaccucuuc

SEQ ID NO: 79195 - RNA, 22 nt, Human
uccucaucaauucucaggcugc

SEQ ID NO: 79196 - RNA, 21 nt, Human
ccugauacuuuucucuugaga

SEQ ID NO: 79197 - RNA, 24 nt, Human
cuguucuucuuuaucauuuauuca

SEQ ID NO: 79198 - RNA, 19 nt, Human
cuggucccacacacuguuc

SEQ ID NO: 79199 - RNA, 27 nt, Human
caggcagcgacccuagaggcgucugua

SEQ ID NO: 79200 - RNA, 21 nt, Human
gcgugucacgugacccccagg

SEQ ID NO: 79201 - RNA, 19 nt, Human
ugcaguugggcaaggucag

SEQ ID NO: 79202 - RNA, 26 nt, Human
uaaaaccauauaacaugugauuauaa

SEQ ID NO: 79203 - RNA, 22 nt, Human
cuaccaccuuucgagaucagga

SEQ ID NO: 79204 - RNA, 27 nt, Human
ggggguaucaggcagggagggggcaga

SEQ ID NO: 79205 - RNA, 22 nt, Human
accagccuggccaacaugauga

SEQ ID NO: 79206 - RNA, 23 nt, Human
gggugagggaagaugagaggggg

SEQ ID NO: 79207 - RNA, 22 nt, Human
guuucaccauguugcccaggau

SEQ ID NO: 79208 - RNA, 22 nt, Human
aggggaggcuggggucacagcu

SEQ ID NO: 79209 - RNA, 21 nt, Human
gcaggacacuuagagcucucu

SEQ ID NO: 79210 - RNA, 22 nt, Human
auucacaugaucauugcucacu

SEQ ID NO: 79211 - RNA, 31 nt, Human
gggggagggugcagaugagggagcgacccag

SEQ ID NO: 79212 - RNA, 31 nt, Human
cagcgcaguggaagagguugcacuucuccga

SEQ ID NO: 79213 - RNA, 22 nt, Human
aacugcacuucggcagaguuga

SEQ ID NO: 79214 - RNA, 27 nt, Human
ugcacacacaucucuggcucuccaggc

SEQ ID NO: 79215 - RNA, 26 nt, Human
acauguguguauauguagauguaugc

SEQ ID NO: 79216 - RNA, 21 nt, Human
gaaacacgcggaucugaacag

SEQ ID NO: 79217 - RNA, 23 nt, Human
gauguacauggagguaucucccg

SEQ ID NO: 79218 - RNA, 19 nt, Human
ugaguugaacaggccaggu

SEQ ID NO: 79219 - RNA, 20 nt, Human
cucagagaggcucucuugug

SEQ ID NO: 79220 - RNA, 25 nt, Human
cucuuuauuaaucucaccauccucc

SEQ ID NO: 79221 - RNA, 20 nt, Human
gaacccugggacaggcacag

SEQ ID NO: 79222 - RNA, 22 nt, Human
gggcuucaggcugggggcagug

SEQ ID NO: 79223 - RNA, 27 nt, Human
aauucacaaccucccacccaaacaaug

SEQ ID NO: 79224 - RNA, 25 nt, Human
cggccccaggcucguggacugagug

SEQ ID NO: 79225 - RNA, 22 nt, Human
ccuggauucacgcccucuuguu

SEQ ID NO: 79226 - RNA, 22 nt, Human
ugaaggagaagaucugccugug

SEQ ID NO: 79227 - RNA, 19 nt, Human
cauucauuuucucaguuga

SEQ ID NO: 79228 - RNA, 26 nt, Human
ucauucuucgcuaauuuguauuugua

SEQ ID NO: 79229 - RNA, 20 nt, Human
ccugucugcagaauccacag

SEQ ID NO: 79230 - RNA, 22 nt, Human
caggcacacaccaccaugcuca

SEQ ID NO: 79231 - RNA, 23 nt, Human
uaaaccaucucccuggugcuuau

SEQ ID NO: 79232 - RNA, 22 nt, Human
uaauguacugcacuugaugcca

SEQ ID NO: 79233 - RNA, 23 nt, Human
uggaggagggagguugugguugg

SEQ ID NO: 79234 - RNA, 25 nt, Human
caguaguacgaugagccaaagcuuu

SEQ ID NO: 79235 - RNA, 27 nt, Human
ccugaagggaguggcucuguaaggacg

SEQ ID NO: 79236 - RNA, 27 nt, Human
caaccaaaaaacaauccgaguaggccc

SEQ ID NO: 79237 - RNA, 22 nt, Human
aggccgaggcaggaggaucccu

SEQ ID NO: 79238 - RNA, 32 nt, Human
agucuguuggcagacuggagugcaaucauggc

SEQ ID NO: 79239 - RNA, 20 nt, Human
cuggacuccuggauaggcag

SEQ ID NO: 79240 - RNA, 24 nt, Human
agaaaauucaucaguuuucugcuu

SEQ ID NO: 79241 - RNA, 27 nt, Human
ccuggaggugggguugauggguuuccu

SEQ ID NO: 79242 - RNA, 27 nt, Human
ucacugcaccuccaccuuccgggcuca

SEQ ID NO: 79243 - RNA, 24 nt, Human
cgcagccgccgccuccuccgcgcc

SEQ ID NO: 79244 - RNA, 22 nt, Human
aggccaaggcaggagaaucacu

SEQ ID NO: 79245 - RNA, 27 nt, Human
cccugcacuccugccucccagcccaca

SEQ ID NO: 79246 - RNA, 19 nt, Human
guccuggccccugugucau

SEQ ID NO: 79247 - RNA, 23 nt, Human
gcaaguaagccuagauaacucua

SEQ ID NO: 79248 - RNA, 20 nt, Human
ugcagugagccgagauugcc

SEQ ID NO: 79249 - RNA, 26 nt, Human
ucaugugaucaucaccuaagaacuag

SEQ ID NO: 79250 - RNA, 19 nt, Human
cagguucuaugcagauugu

SEQ ID NO: 79251 - RNA, 21 nt, Human
aguagcugggauuacaggcau

SEQ ID NO: 79252 - RNA, 20 nt, Human
uacuggaccacccugagcag

SEQ ID NO: 79253 - RNA, 21 nt, Human
gcuggacuucguuuuuacuua

SEQ ID NO: 79254 - RNA, 23 nt, Human
cucagaccacacaguagccaagu

SEQ ID NO: 79255 - RNA, 24 nt, Human
agggccaugggagauacaauucca

SEQ ID NO: 79256 - RNA, 24 nt, Human
cagucuguggagaguccugcugcc

SEQ ID NO: 79257 - RNA, 23 nt, Human
auggcaccacugcacuccggccu

SEQ ID NO: 79258 - RNA, 21 nt, Human
ggaaggggccucaggagcagg

SEQ ID NO: 79259 - RNA, 22 nt, Human
uccaggcugggcagcaagagca

SEQ ID NO: 79260 - RNA, 23 nt, Human
cagagcuggagugcagcggcaca

SEQ ID NO: 79261 - RNA, 24 nt, Human
uucauucuaguuuuguuuggugua

SEQ ID NO: 79262 - RNA, 20 nt, Human
gucuauuggaugaaggugaa

SEQ ID NO: 79263 - RNA, 26 nt, Human
gaacauaccacugaacuaguaugugc

SEQ ID NO: 79264 - RNA, 21 nt, Human
cuacagcugugucccuuccug

SEQ ID NO: 79265 - RNA, 19 nt, Human
guuacggugaggaucaugu

SEQ ID NO: 79266 - RNA, 22 nt, Human
cuuacucauuucuaagugcaau

SEQ ID NO: 79267 - RNA, 22 nt, Human
uuugggaaaagaagcugucaga

SEQ ID NO: 79268 - RNA, 21 nt, Human
cgucugacuugggaggcagag

SEQ ID NO: 79269 - RNA, 22 nt, Human
caggcuggagugcaauggcgug

SEQ ID NO: 79270 - RNA, 22 nt, Human
caggcuagagugcaguggcgug

SEQ ID NO: 79271 - RNA, 25 nt, Human
aggcuggaguagagggaagccugca

SEQ ID NO: 79272 - RNA, 27 nt, Human
cuccacacugccuccuggccagcugcc

SEQ ID NO: 79273 - RNA, 24 nt, Human
gcuccaaaaaauaaacacuuccuu

SEQ ID NO: 79274 - RNA, 22 nt, Human
cuaaugaaagagagaguugaga

SEQ ID NO: 79275 - RNA, 16 nt, Human
cuccugacaucuugcu

SEQ ID NO: 79276 - RNA, 27 nt, Human
gggcagccuggccacugccuagcugga

SEQ ID NO: 79277 - RNA, 23 nt, Human
uuguccucuucuucagauucagc

SEQ ID NO: 79278 - RNA, 25 nt, Human
uguuccaauaaaacuuuauuuacaa

SEQ ID NO: 79279 - RNA, 22 nt, Human
ggauuuggaaguuggaauuccu

SEQ ID NO: 79280 - RNA, 22 nt, Human
guggauauuaaaaaucuguaaa

SEQ ID NO: 79281 - RNA, 24 nt, Human
gccugauccugcccugggcucaga

SEQ ID NO: 79282 - RNA, 21 nt, Human
ggugccugagguugcagccga

SEQ ID NO: 79283 - RNA, 20 nt, Human
gaagagcagagggcugggcu

SEQ ID NO: 79284 - RNA, 24 nt, Human
gcuucccuucccucccccuucacc

SEQ ID NO: 79285 - RNA, 24 nt, Human
gauaccugaggcaggaggugcagc

SEQ ID NO: 79286 - RNA, 20 nt, Human
cacuuuuaauucaaaccaga

SEQ ID NO: 79287 - RNA, 22 nt, Human
ggggugagaagguccuggcucc

SEQ ID NO: 79288 - RNA, 21 nt, Human
auuuccaggcugaacugaggc

SEQ ID NO: 79289 - RNA, 23 nt, Human
ucccacauuaggauggugaacca

SEQ ID NO: 79290 - RNA, 21 nt, Human
uguucuggccuagaggucagu

SEQ ID NO: 79291 - RNA, 24 nt, Human
cucaguuuaauccuucuaguuucc

SEQ ID NO: 79292 - RNA, 21 nt, Human
augaauauuguaacaugugaa

SEQ ID NO: 79293 - RNA, 22 nt, Human
cauucacagagccuuuuucaca

SEQ ID NO: 79294 - RNA, 25 nt, Human
cuaauaguugaaaucugccuuuuuc

SEQ ID NO: 79295 - RNA, 21 nt, Human
auucuaggggcuuccugccuu

SEQ ID NO: 79296 - RNA, 19 nt, Human
guuuguuaauucuaguuuc

SEQ ID NO: 79297 - RNA, 25 nt, Human
ccgugggaacagagaauaccuguuu

SEQ ID NO: 79298 - RNA, 24 nt, Human
gcccgaagggagagacugagacug

SEQ ID NO: 79299 - RNA, 17 nt, Human
ccccaacagaccugucu

SEQ ID NO: 79300 - RNA, 22 nt, Human
cugaggcaggaaaauggcguga

SEQ ID NO: 79301 - RNA, 25 nt, Human
ccggagugaggaacugauuuggcuc

SEQ ID NO: 79302 - RNA, 23 nt, Human
uaucugaauggucaucugguaac

SEQ ID NO: 79303 - RNA, 21 nt, Human
uccagauaggaacaugcacaa

SEQ ID NO: 79304 - RNA, 28 nt, Human
ugcagugagccaagaucaugccacauca

SEQ ID NO: 79305 - RNA, 23 nt, Human
caauguucauuguaauguuacug

SEQ ID NO: 79306 - RNA, 19 nt, Human
ggccacugcuguccucuuc

SEQ ID NO: 79307 - RNA, 24 nt, Human
agaauaaagcaaggcucccgaaac

SEQ ID NO: 79308 - RNA, 27 nt, Human
caguucuggugcuguagaggcccuggu

SEQ ID NO: 79309 - RNA, 20 nt, Human
gcgccagaagacagcgcgca

SEQ ID NO: 79310 - RNA, 22 nt, Human
aagguuggaaacagggccaggu

SEQ ID NO: 79311 - RNA, 22 nt, Human
ggaggcugggugcuguggcuca

SEQ ID NO: 79312 - RNA, 21 nt, Human
cgcugacugcaggcagcgggg

SEQ ID NO: 79313 - RNA, 18 nt, Human
cgcuuccagcauccucug

SEQ ID NO: 79314 - RNA, 21 nt, Human
aggcucucucauaaccccucu

SEQ ID NO: 79315 - RNA, 22 nt, Human
cucugcaaaggccagccagcuu

SEQ ID NO: 79316 - RNA, 20 nt, Human
ggcgcgaggggaacggaggc

SEQ ID NO: 79317 - RNA, 27 nt, Human
uuuacagucuuuugugucugucauuuc

SEQ ID NO: 79318 - RNA, 22 nt, Human
ugccucauccccuucccaccaa

SEQ ID NO: 79319 - RNA, 26 nt, Human
ggagaauugggugcgagaugugguuu

SEQ ID NO: 79320 - RNA, 27 nt, Human
uacuggcagauuugcaggcugggaagg

SEQ ID NO: 79321 - RNA, 21 nt, Human
gccuguaauuccagugcuuug

SEQ ID NO: 79322 - RNA, 27 nt, Human
cauacauuucucauaccuuccccacau

SEQ ID NO: 79323 - RNA, 24 nt, Human
cccuacuggaagccugcaagucua

SEQ ID NO: 79324 - RNA, 23 nt, Human
gacgggguuucaccguguuagcc

SEQ ID NO: 79325 - RNA, 25 nt, Human
aacacugcacuccaauuuccucggg

SEQ ID NO: 79326 - RNA, 24 nt, Human
gcauugcucaaagcuggcuuuuca

SEQ ID NO: 79327 - RNA, 18 nt, Human
uagagugcacugagugca

SEQ ID NO: 79328 - RNA, 23 nt, Human
agcaggagauuugcuugaaccug

SEQ ID NO: 79329 - RNA, 28 nt, Human
gccaaacaucuaaaagaacuucaucauc

SEQ ID NO: 79330 - RNA, 22 nt, Human
cuguaaauacuuuccaguauua

SEQ ID NO: 79331 - RNA, 28 nt, Human
ucucgaucuccugaccucgugaucugcc

SEQ ID NO: 79332 - RNA, 20 nt, Human
cccccaaacucuacucuuau

SEQ ID NO: 79333 - RNA, 22 nt, Human
gggagcugggguacagguuugg

SEQ ID NO: 79334 - RNA, 24 nt, Human
uaaccucuuccuccaguugucucc

SEQ ID NO: 79335 - RNA, 25 nt, Human
cgcuggcgaccugcuccagucucca

SEQ ID NO: 79336 - RNA, 18 nt, Human
uuaaauaaugugcugcua

SEQ ID NO: 79337 - RNA, 23 nt, Human
auugccuaagcccuugccugcug

SEQ ID NO: 79338 - RNA, 27 nt, Human
ugucacccaggcuggagugaucucagc

SEQ ID NO: 79339 - RNA, 27 nt, Human
ccaggugggagagggagcagaacagcc

SEQ ID NO: 79340 - RNA, 20 nt, Human
agacuagcugcaccuccuca

SEQ ID NO: 79341 - RNA, 23 nt, Human
aaggcauuucaaagucucacuuu

SEQ ID NO: 79342 - RNA, 24 nt, Human
agauaaaaagucagaaaucugaaa

SEQ ID NO: 79343 - RNA, 24 nt, Human
ugauauuacauccacaguaccaca

SEQ ID NO: 79344 - RNA, 23 nt, Human
ucuugagcagugaccugccaagg

SEQ ID NO: 79345 - RNA, 21 nt, Human
agcuccaccuccucggcuuuc

SEQ ID NO: 79346 - RNA, 26 nt, Human
ggcuuuauauccucugggccuggguu

SEQ ID NO: 79347 - RNA, 20 nt, Human
ggagacagugaucuccauau

SEQ ID NO: 79348 - RNA, 22 nt, Human
cagcucuuccuggacaggccag

SEQ ID NO: 79349 - RNA, 21 nt, Human
gccuacucugugaacuccggg

SEQ ID NO: 79350 - RNA, 26 nt, Human
ugggaggcggggagcugccacuccca

SEQ ID NO: 79351 - RNA, 27 nt, Human
cacagccccaaggcugggggaacuuca

SEQ ID NO: 79352 - RNA, 26 nt, Human
acacauuuuggucuuaauccauguac

SEQ ID NO: 79353 - RNA, 23 nt, Human
uuaugugucguugcuuucugugu

SEQ ID NO: 79354 - RNA, 21 nt, Human
ggcucaugccuguaaucccag

SEQ ID NO: 79355 - RNA, 29 nt, Human
cuuuucucuucccccucacuugaagcagc

SEQ ID NO: 79356 - RNA, 23 nt, Human
ccugagugguuuaaaaaggacuu

SEQ ID NO: 79357 - RNA, 26 nt, Human
ucaggagacucagaguccucugugaa

SEQ ID NO: 79358 - RNA, 26 nt, Human
cccuccagguuacuaaagggugcaug

SEQ ID NO: 79359 - RNA, 21 nt, Human
ugcuaucuuauuuuuguuauc

SEQ ID NO: 79360 - RNA, 25 nt, Human
ucaggacugaagugcuguaaagcaa

SEQ ID NO: 79361 - RNA, 21 nt, Human
uuuuaaaauccugauuuugga

SEQ ID NO: 79362 - RNA, 22 nt, Human
aagcaaauuaguaauugucaau

SEQ ID NO: 79363 - RNA, 27 nt, Human
uggcuguaaaguaaguguaagguccac

SEQ ID NO: 79364 - RNA, 20 nt, Human
gccggucccagccauggccc

SEQ ID NO: 79365 - RNA, 19 nt, Human
ccucaccucaaaccuugcc

SEQ ID NO: 79366 - RNA, 26 nt, Human
gaggcaacgggcggcagguugcagug

SEQ ID NO: 79367 - RNA, 22 nt, Human
aauaacugcagcaguucugaaa

SEQ ID NO: 79368 - RNA, 19 nt, Human
gccauugaaaacaaagaca

SEQ ID NO: 79369 - RNA, 18 nt, Human
ucaccagcagacacugcc

SEQ ID NO: 79370 - RNA, 24 nt, Human
ggauuauacuuccuuucuguacca

SEQ ID NO: 79371 - RNA, 22 nt, Human
cccuaccuccuccucuggacaa

SEQ ID NO: 79372 - RNA, 21 nt, Human
accuacucucaugcugcagag

SEQ ID NO: 79373 - RNA, 23 nt, Human
agggauacugggcccucuucuca

SEQ ID NO: 79374 - RNA, 20 nt, Human
auuuuuauaucuaacuuucc

SEQ ID NO: 79375 - RNA, 27 nt, Human
cucguugagaccaccaccauaccucag

SEQ ID NO: 79376 - RNA, 20 nt, Human
aguaauacuguuguguugug

SEQ ID NO: 79377 - RNA, 21 nt, Human
uugccuggauaccucuggcuc

SEQ ID NO: 79378 - RNA, 22 nt, Human
uuccugagaggcucagcuugag

SEQ ID NO: 79379 - RNA, 22 nt, Human
uggucccccaccaggcuuggga

SEQ ID NO: 79380 - RNA, 23 nt, Human
guauuucucccugaaaugggguc

SEQ ID NO: 79381 - RNA, 23 nt, Human
uguugcccaggcuggaguacaau

SEQ ID NO: 79382 - RNA, 26 nt, Human
cauccucccuucccauauccuucaaa

SEQ ID NO: 79383 - RNA, 22 nt, Human
uuggccaggcuggucucgaaug

SEQ ID NO: 79384 - RNA, 26 nt, Human
aucacuccacugcacaguguuagugg

SEQ ID NO: 79385 - RNA, 23 nt, Human
aguccaggcagccugcaggcugg

SEQ ID NO: 79386 - RNA, 25 nt, Human
cucugccauaguuuguuaguacucu

SEQ ID NO: 79387 - RNA, 27 nt, Human
uccagaagugcgggguaggggaagaag

SEQ ID NO: 79388 - RNA, 22 nt, Human
acacacaaccaacagcucuguc

SEQ ID NO: 79389 - RNA, 26 nt, Human
uggauaaggaccaaugacagcaaagc

SEQ ID NO: 79390 - RNA, 20 nt, Human
uucuugaacuuccugaguca

SEQ ID NO: 79391 - RNA, 22 nt, Human
accagcccugcccccaccugcc

SEQ ID NO: 79392 - RNA, 27 nt, Human
uucaugauuucaaccacauuugcuaga

SEQ ID NO: 79393 - RNA, 24 nt, Human
ggucucggaagguuccgaccucag

SEQ ID NO: 79394 - RNA, 25 nt, Human
cgaggacaacggcuccaccaggguc

SEQ ID NO: 79395 - RNA, 17 nt, Human
cuucccuuucuaagcaa

SEQ ID NO: 79396 - RNA, 22 nt, Human
gcaggagcaucuucuuggcagc

SEQ ID NO: 79397 - RNA, 21 nt, Human
uggacgcagaggugacagugg

SEQ ID NO: 79398 - RNA, 20 nt, Human
cuauauuuuuguccaaacca

SEQ ID NO: 79399 - RNA, 22 nt, Human
uguggccaccccucacccugac

SEQ ID NO: 79400 - RNA, 26 nt, Human
uaacuggccucauuucuucaaaauau

SEQ ID NO: 79401 - RNA, 22 nt, Human
cauguguggcccugucugcuua

SEQ ID NO: 79402 - RNA, 22 nt, Human
uggagguagcuccuaaaaugaa

SEQ ID NO: 79403 - RNA, 25 nt, Human
acacuaaacaacccugagcccaggg

SEQ ID NO: 79404 - RNA, 24 nt, Human
gcgccuguugacaaguguggagaa

SEQ ID NO: 79405 - RNA, 21 nt, Human
aacuccugauucuuccuuuuc

SEQ ID NO: 79406 - RNA, 21 nt, Human
uauuccaaucacugugcuuaa

SEQ ID NO: 79407 - RNA, 23 nt, Human
acccagccaggacccacagcccu

SEQ ID NO: 79408 - RNA, 16 nt, Human
uuucccuuaaaacaca

SEQ ID NO: 79409 - RNA, 22 nt, Human
cauugguauuuagguauacaaa

SEQ ID NO: 79410 - RNA, 24 nt, Human
uuguuugcuauuuauuuuucuccu

SEQ ID NO: 79411 - RNA, 22 nt, Human
cgcucgccgccucagucgccag

SEQ ID NO: 79412 - RNA, 25 nt, Human
ggucagcucaggcuggagcaggcau

SEQ ID NO: 79413 - RNA, 23 nt, Human
caguguuggaagcuuuuucccaa

SEQ ID NO: 79414 - RNA, 24 nt, Human
gagcccaggagccugccaggcuga

SEQ ID NO: 79415 - RNA, 24 nt, Human
uuuccucccuugccuucucccacu

SEQ ID NO: 79416 - RNA, 26 nt, Human
ucccgggcuggcgggagugcaguucu

SEQ ID NO: 79417 - RNA, 21 nt, Human
ucucucucccucccucucuca

SEQ ID NO: 79418 - RNA, 20 nt, Human
ggcuuaaggagcuacacugg

SEQ ID NO: 79419 - RNA, 22 nt, Human
ggucucaaacuccugcccucag

SEQ ID NO: 79420 - RNA, 21 nt, Human
cccagccgccucgguucccgg

SEQ ID NO: 79421 - RNA, 20 nt, Human
uaagcugaagcacuggguga

SEQ ID NO: 79422 - RNA, 26 nt, Human
gccuuauccuucuguuuguucauaca

SEQ ID NO: 79423 - RNA, 20 nt, Human
ucgggagcagugucuuccau

SEQ ID NO: 79424 - RNA, 22 nt, Human
cacugcacuucagucuguguga

SEQ ID NO: 79425 - RNA, 22 nt, Human
gucaucuccgggguggccacag

SEQ ID NO: 79426 - RNA, 24 nt, Human
cccagccuguagacaucuuuuacu

SEQ ID NO: 79427 - RNA, 23 nt, Human
cagacagacagccagguucucca

SEQ ID NO: 79428 - RNA, 21 nt, Human
acccgggaaccccaacaguug

SEQ ID NO: 79429 - RNA, 20 nt, Human
uuauagguucugagcugaac

SEQ ID NO: 79430 - RNA, 18 nt, Human
uccuuggcuauucuugca

SEQ ID NO: 79431 - RNA, 17 nt, Human
cuucccuuucugugugu

SEQ ID NO: 79432 - RNA, 24 nt, Human
gcucccauugucuccaucagagcc

SEQ ID NO: 79433 - RNA, 27 nt, Human
cacugccuucucugccgaugacauccu

SEQ ID NO: 79434 - RNA, 27 nt, Human
uccauccuucugcacaggguaucgccu

SEQ ID NO: 79435 - RNA, 22 nt, Human
gcuggucucgaacuccugggcu

SEQ ID NO: 79436 - RNA, 27 nt, Human
ccacugcacuccaaccugggaaacgca

SEQ ID NO: 79437 - RNA, 26 nt, Human
gguuucagaaagaaguggggacagag

SEQ ID NO: 79438 - RNA, 22 nt, Human
ggaggaaggauggcucuggccu

SEQ ID NO: 79439 - RNA, 24 nt, Human
uguugcucugggcaacgcggucug

SEQ ID NO: 79440 - RNA, 21 nt, Human
gaggacaaaagcaugucuucc

SEQ ID NO: 79441 - RNA, 21 nt, Human
ugccuaacuuguaaaaagggg

SEQ ID NO: 79442 - RNA, 28 nt, Human
cucacccugccaccuccaugugacaagu

SEQ ID NO: 79443 - RNA, 25 nt, Human
ggacgccuucccaugaaaaauuccg

SEQ ID NO: 79444 - RNA, 19 nt, Human
ugcgacccugggggcacag

SEQ ID NO: 79445 - RNA, 28 nt, Human
caaacgaguaaaauaaugugcaaugauu

SEQ ID NO: 79446 - RNA, 21 nt, Human
gccuguaauccuggcacuuug

SEQ ID NO: 79447 - RNA, 22 nt, Human
uugagguagguagauugcuuga

SEQ ID NO: 79448 - RNA, 23 nt, Human
acucacugcgggcuccugagccu

SEQ ID NO: 79449 - RNA, 21 nt, Human
cucugggggcugaggagcagc

SEQ ID NO: 79450 - RNA, 22 nt, Human
cuguuugauuuggaucaucuca

SEQ ID NO: 79451 - RNA, 22 nt, Human
gcccccucccuucacaggggua

SEQ ID NO: 79452 - RNA, 29 nt, Human
cccagggcaacaggaguaguucacuccgc

SEQ ID NO: 79453 - RNA, 26 nt, Human
cuugccgcccaccugcucacccagcu

SEQ ID NO: 79454 - RNA, 21 nt, Human
uaguaguucuggaauauugcc

SEQ ID NO: 79455 - RNA, 23 nt, Human
uucagacuaugagcucaccuaca

SEQ ID NO: 79456 - RNA, 22 nt, Human
gagcuccugggaccaagcaaau

SEQ ID NO: 79457 - RNA, 26 nt, Human
gucgccaaguuggagugcaauggugc

SEQ ID NO: 79458 - RNA, 25 nt, Human
uucuggugccuauuuauucauucag

SEQ ID NO: 79459 - RNA, 21 nt, Human
uccagugaguugagaucaugc

SEQ ID NO: 79460 - RNA, 26 nt, Human
gauuccugccuaucccaacuccccag

SEQ ID NO: 79461 - RNA, 19 nt, Human
ggccaugaagcagauucuc

SEQ ID NO: 79462 - RNA, 26 nt, Human
ugcaucuucgcuccuuccugguggcg

SEQ ID NO: 79463 - RNA, 20 nt, Human
ccucacugcaaccuccgccu

SEQ ID NO: 79464 - RNA, 19 nt, Human
auacauuuauuuacacucu

SEQ ID NO: 79465 - RNA, 26 nt, Human
cauuugcaggaugagccugaacuggu

SEQ ID NO: 79466 - RNA, 22 nt, Human
caggcuggagugcuauggcucg

SEQ ID NO: 79467 - RNA, 25 nt, Human
aggguuaggaggguuucauugucug

SEQ ID NO: 79468 - RNA, 23 nt, Human
cauaccuguaaaucccagcacuu

SEQ ID NO: 79469 - RNA, 22 nt, Human
cucccuggaccuuuccuagcca

SEQ ID NO: 79470 - RNA, 22 nt, Human
guuuccucugccccuucuugcu

SEQ ID NO: 79471 - RNA, 22 nt, Human
uuucuucccucucccugguguc

SEQ ID NO: 79472 - RNA, 21 nt, Human
caguguaacgaugcacuuugg

SEQ ID NO: 79473 - RNA, 21 nt, Human
ucuccaucuccgcuguuuugg

SEQ ID NO: 79474 - RNA, 32 nt, Human
guuuauaaagcagauuaccucuugcccuuggg

SEQ ID NO: 79475 - RNA, 26 nt, Human
ucucauucuccucaaauauuccauuu

SEQ ID NO: 79476 - RNA, 26 nt, Human
cuguucugccuugccugugagcuaug

SEQ ID NO: 79477 - RNA, 26 nt, Human
gagcugcuggugaacuccaucucauu

SEQ ID NO: 79478 - RNA, 21 nt, Human
agcugcacguggccugagcag

SEQ ID NO: 79479 - RNA, 25 nt, Human
ugcuucaauguagucagaauuagcu

SEQ ID NO: 79480 - RNA, 26 nt, Human
ugucccccacccccaaagaccugccu

SEQ ID NO: 79481 - RNA, 26 nt, Human
gcuuugaaaaaucuaaucagugacuu

SEQ ID NO: 79482 - RNA, 24 nt, Human
gccacaaaaccuguauuacugaau

SEQ ID NO: 79483 - RNA, 22 nt, Human
ugucuuuuaaaaagugugcuua

SEQ ID NO: 79484 - RNA, 20 nt, Human
aucagaacucuuccuccucc

SEQ ID NO: 79485 - RNA, 23 nt, Human
gcggcagcagagaggagcgcuga

SEQ ID NO: 79486 - RNA, 21 nt, Human
gugagucugcaucuuagggca

SEQ ID NO: 79487 - RNA, 24 nt, Human
agcuguacuguaauuucuuugagu

SEQ ID NO: 79488 - RNA, 26 nt, Human
gccucccccgacuccuggguguggga

SEQ ID NO: 79489 - RNA, 22 nt, Human
gacugaauaauggaugagggag

SEQ ID NO: 79490 - RNA, 23 nt, Human
ggucaucucagucauggagggag

SEQ ID NO: 79491 - RNA, 15 nt, Human
cacagccgcacccag

SEQ ID NO: 79492 - RNA, 24 nt, Human
uaaucuaucugguucauuaacuca

SEQ ID NO: 79493 - RNA, 27 nt, Human
agaacuccugggcuuucuaaagaggcu

SEQ ID NO: 79494 - RNA, 19 nt, Human
agcucuauauuuuaucccc

SEQ ID NO: 79495 - RNA, 22 nt, Human
ugucacccaggcuggaguacac

SEQ ID NO: 79496 - RNA, 22 nt, Human
cuuguucauuuuaguaacgguu

SEQ ID NO: 79497 - RNA, 22 nt, Human
gaccagccagagcaacacagug

SEQ ID NO: 79498 - RNA, 22 nt, Human
ccuguaccauucccacuugcuc

SEQ ID NO: 79499 - RNA, 25 nt, Human
uuuguuguuuucaccagagugagcu

SEQ ID NO: 79500 - RNA, 22 nt, Human
agagggguaggauguacagggg

SEQ ID NO: 79501 - RNA, 23 nt, Human
auuuuggacgugugaggaugugg

SEQ ID NO: 79502 - RNA, 27 nt, Human
cugggcaacaagaguaaaacuccaucu

SEQ ID NO: 79503 - RNA, 27 nt, Human
cagcugugcucacuuuuccugcuuugu

SEQ ID NO: 79504 - RNA, 22 nt, Human
gagaagcaggcggguugggugg

SEQ ID NO: 79505 - RNA, 19 nt, Human
ugcccugcuguuuuacugg

SEQ ID NO: 79506 - RNA, 23 nt, Human
ccugauggagagugagagcaugu

SEQ ID NO: 79507 - RNA, 23 nt, Human
uaguuggguauaauuuuuaucca

SEQ ID NO: 79508 - RNA, 20 nt, Human
agaucacuccucugccaaag

SEQ ID NO: 79509 - RNA, 19 nt, Human
ugcagugagcuggccugcc

SEQ ID NO: 79510 - RNA, 21 nt, Human
uuguuauuuucucucaucuuu

SEQ ID NO: 79511 - RNA, 24 nt, Human
ccagcacuucaaccuaguccgcug

SEQ ID NO: 79512 - RNA, 26 nt, Human
aguggucaauguagauuucaaguuga

SEQ ID NO: 79513 - RNA, 27 nt, Human
ugccaauccuguaggcacaaaaccaga

SEQ ID NO: 79514 - RNA, 20 nt, Human
cauaaaguccagaucuggua

SEQ ID NO: 79515 - RNA, 22 nt, Human
aauggcacaaucucagcucacu

SEQ ID NO: 79516 - RNA, 27 nt, Human
gacaguuuucacacauaucuaccugua

SEQ ID NO: 79517 - RNA, 21 nt, Human
gguagcugggauuacaggcau

SEQ ID NO: 79518 - RNA, 24 nt, Human
cucuggguggugguggcacaugga

SEQ ID NO: 79519 - RNA, 24 nt, Human
ggaggaucacuugagcccaggaag

SEQ ID NO: 79520 - RNA, 23 nt, Human
gaccuguauuccacuuacuccac

SEQ ID NO: 79521 - RNA, 26 nt, Human
gccaugucacggccaggccacggugg

SEQ ID NO: 79522 - RNA, 23 nt, Human
aguaaagcaacucaaguuauagg

SEQ ID NO: 79523 - RNA, 22 nt, Human
ggccucccacagugcugggauu

SEQ ID NO: 79524 - RNA, 21 nt, Human
uucuugucuguucugccucac

SEQ ID NO: 79525 - RNA, 23 nt, Human
ggccggccagggcuggggcagug

SEQ ID NO: 79526 - RNA, 20 nt, Human
auuggguuucuucuuuguca

SEQ ID NO: 79527 - RNA, 22 nt, Human
uuuacaaucuguaucuuugaca

SEQ ID NO: 79528 - RNA, 21 nt, Human
gacuucagagcuuucucucca

SEQ ID NO: 79529 - RNA, 19 nt, Human
ccucucugcugccagcaca

SEQ ID NO: 79530 - RNA, 27 nt, Human
ggucuccaccugucauucuagaaacag

SEQ ID NO: 79531 - RNA, 22 nt, Human
uuuuucuccccaugccguacag

SEQ ID NO: 79532 - RNA, 22 nt, Human
ucacaaaccccacauuauucca

SEQ ID NO: 79533 - RNA, 22 nt, Human
cagagccagagggcaguggcgc

SEQ ID NO: 79534 - RNA, 21 nt, Human
gcuuccaugcuucauucccug

SEQ ID NO: 79535 - RNA, 27 nt, Human
acacugcgaccaccuugccgcuuuuca

SEQ ID NO: 79536 - RNA, 18 nt, Human
ccucuucaacuccucuca

SEQ ID NO: 79537 - RNA, 20 nt, Human
agcuuugggaucccacccug

SEQ ID NO: 79538 - RNA, 21 nt, Human
cuugccagaguccuuuuugcc

SEQ ID NO: 79539 - RNA, 21 nt, Human
aauugauuucacaguucguua

SEQ ID NO: 79540 - RNA, 19 nt, Human
uccccuaaucacacacucu

SEQ ID NO: 79541 - RNA, 27 nt, Human
cccuucccagccgcgggccucgcucgg

SEQ ID NO: 79542 - RNA, 25 nt, Human
auaauggaagaaaguaaacugcuua

SEQ ID NO: 79543 - RNA, 21 nt, Human
guccacagcuuccugucccca

SEQ ID NO: 79544 - RNA, 27 nt, Human
ugacuuacagcagucagacucugacag

SEQ ID NO: 79545 - RNA, 22 nt, Human
gcccacagcacagcucccugcc

SEQ ID NO: 79546 - RNA, 31 nt, Human
gaagucaggagagagggugaagcggagcagc

SEQ ID NO: 79547 - RNA, 23 nt, Human
uuccuccaagagaagguggaccu

SEQ ID NO: 79548 - RNA, 20 nt, Human
cuucucugcuaucuagaucu

SEQ ID NO: 79549 - RNA, 19 nt, Human
ccgggagcugcucugugcu

SEQ ID NO: 79550 - RNA, 18 nt, Human
ugccagacugcauuaggu

SEQ ID NO: 79551 - RNA, 21 nt, Human
aguaagcuuuuaaaguauauu

SEQ ID NO: 79552 - RNA, 26 nt, Human
cucagcuuugcagaaugaagccuuga

SEQ ID NO: 79553 - RNA, 23 nt, Human
gucucuagccucaaagauggcca

SEQ ID NO: 79554 - RNA, 22 nt, Human
ugggccuggcgggggaggcagg

SEQ ID NO: 79555 - RNA, 26 nt, Human
cagacaccugcaucccuggcuccucu

SEQ ID NO: 79556 - RNA, 23 nt, Human
aacaauuacagaaucaugauugc

SEQ ID NO: 79557 - RNA, 22 nt, Human
cucuauuagcaaugaagggaau

SEQ ID NO: 79558 - RNA, 23 nt, Human
cugcaaccuucgccucccaggag

SEQ ID NO: 79559 - RNA, 26 nt, Human
auggaaagacaaacugcacaggcaga

SEQ ID NO: 79560 - RNA, 20 nt, Human
ucacagacauuucucuuuca

SEQ ID NO: 79561 - RNA, 28 nt, Human
acugucacccuccaccucuucacccccc

SEQ ID NO: 79562 - RNA, 29 nt, Human
caggauucagacgcaaaagacuugcauaa

SEQ ID NO: 79563 - RNA, 25 nt, Human
gccagcucccugggucuccuccucu

SEQ ID NO: 79564 - RNA, 22 nt, Human
ugguugcgaagaccuaaccuca

SEQ ID NO: 79565 - RNA, 20 nt, Human
acgucugucccucucugcuu

SEQ ID NO: 79566 - RNA, 22 nt, Human
ucucacccaggcuggaaugcag

SEQ ID NO: 79567 - RNA, 21 nt, Human
cuguuccagcuccugcugcug

SEQ ID NO: 79568 - RNA, 22 nt, Human
cauuuggcaaaaugucuuaaca

SEQ ID NO: 79569 - RNA, 25 nt, Human
auggaagagaauauuccuacuugca

SEQ ID NO: 79570 - RNA, 21 nt, Human
cccccugacauuaucuuggau

SEQ ID NO: 79571 - RNA, 22 nt, Human
ccgccucucggguucaagcaau

SEQ ID NO: 79572 - RNA, 29 nt, Human
gccaguuucucccucuucaccccugcgcc

SEQ ID NO: 79573 - RNA, 27 nt, Human
aaccuguaagugucuugggcucaggga

SEQ ID NO: 79574 - RNA, 31 nt, Human
gcugaccugacaaguacuaugugugugcaug

SEQ ID NO: 79575 - RNA, 28 nt, Human
ccucccuuccuuuucccugcuuccagga

SEQ ID NO: 79576 - RNA, 25 nt, Human
acccccacuccccguacagugcgca

SEQ ID NO: 79577 - RNA, 27 nt, Human
cucaccccacacccucccucugccccc

SEQ ID NO: 79578 - RNA, 27 nt, Human
uugacccucucuguagaaaaccgcaca

SEQ ID NO: 79579 - RNA, 22 nt, Human
ccacaucuuuggagccucggga

SEQ ID NO: 79580 - RNA, 21 nt, Human
caccaagguucuugaccguga

SEQ ID NO: 79581 - RNA, 22 nt, Human
gagcuaaagaaccuucuaggca

SEQ ID NO: 79582 - RNA, 24 nt, Human
agagucaggguggcuuuuccccug

SEQ ID NO: 79583 - RNA, 22 nt, Human
gugggucccggcgucucagccu

SEQ ID NO: 79584 - RNA, 28 nt, Human
gaugccaucuacccugccccuguccacc

SEQ ID NO: 79585 - RNA, 17 nt, Human
gaaaccagcugguuuag

SEQ ID NO: 79586 - RNA, 22 nt, Human
uugcccaggcugcagugcagug

SEQ ID NO: 79587 - RNA, 20 nt, Human
uuccugcuccguggcugaag

SEQ ID NO: 79588 - RNA, 27 nt, Human
gagggcugggcagggaggcgccgugga

SEQ ID NO: 79589 - RNA, 27 nt, Human
cuguuauauuaauugccaauauaagua

SEQ ID NO: 79590 - RNA, 21 nt, Human
guugcaagcacgauggagauu

SEQ ID NO: 79591 - RNA, 20 nt, Human
gagccucaugaucugcuguc

SEQ ID NO: 79592 - RNA, 24 nt, Human
gaggacggcgagaaaugccucugg

SEQ ID NO: 79593 - RNA, 24 nt, Human
agguucuuuagcugucacuuaggg

SEQ ID NO: 79594 - RNA, 22 nt, Human
cucagcuucaccuugauacugg

SEQ ID NO: 79595 - RNA, 21 nt, Human
gucucaucucccugcgugucu

SEQ ID NO: 79596 - RNA, 22 nt, Human
ccgcugcacucaagcuugggug

SEQ ID NO: 79597 - RNA, 22 nt, Human
ucucuaaccuuuaaaagagggg

SEQ ID NO: 79598 - RNA, 23 nt, Human
aauggacuuuuuccuuacugucu

SEQ ID NO: 79599 - RNA, 22 nt, Human
gcuccucucuagaaccugggcu

SEQ ID NO: 79600 - RNA, 20 nt, Human
aucagaggaguuuuuucuaa

SEQ ID NO: 79601 - RNA, 25 nt, Human
ccuggacaguggcccccagcaguca

SEQ ID NO: 79602 - RNA, 22 nt, Human
auaaauacgagucucaaggucu

SEQ ID NO: 79603 - RNA, 28 nt, Human
uggcgaaugacuguaaucccagcuacuc

SEQ ID NO: 79604 - RNA, 27 nt, Human
cucagcagguagaggaggacugaugac

SEQ ID NO: 79605 - RNA, 22 nt, Human
cccugcaccuuccccaaaggaa

SEQ ID NO: 79606 - RNA, 22 nt, Human
agccucccuaagugcugggauu

SEQ ID NO: 79607 - RNA, 22 nt, Human
ugccucccaaagugcugggauu

SEQ ID NO: 79608 - RNA, 21 nt, Human
gucugcugggggcacaguaaa

SEQ ID NO: 79609 - RNA, 20 nt, Human
guguacagugacaggcucca

SEQ ID NO: 79610 - RNA, 22 nt, Human
aaccaaaaccaccaugacacag

SEQ ID NO: 79611 - RNA, 23 nt, Human
ccacuucucagaaacacacagag

SEQ ID NO: 79612 - RNA, 22 nt, Human
ucucaacagaugguuucagugg

SEQ ID NO: 79613 - RNA, 27 nt, Human
cgccuggcccucucccccaacgcccag

SEQ ID NO: 79614 - RNA, 27 nt, Human
uccucauaacauuuaucuuuaguuuua

SEQ ID NO: 79615 - RNA, 25 nt, Human
gaaaugagaguggcaucuuuaugga

SEQ ID NO: 79616 - RNA, 20 nt, Human
cucagggcacuuugggcuug

SEQ ID NO: 79617 - RNA, 20 nt, Human
cuuccaauuaucaugcucac

SEQ ID NO: 79618 - RNA, 25 nt, Human
uucaguuugaguuuuauuauuuauu

SEQ ID NO: 79619 - RNA, 20 nt, Human
ugguuucguaucugccaaag

SEQ ID NO: 79620 - RNA, 21 nt, Human
gcucuugucccugucgcgucu

SEQ ID NO: 79621 - RNA, 22 nt, Human
caguuuuguuuaauaauguacc

SEQ ID NO: 79622 - RNA, 23 nt, Human
auuacagccaccucauucuucua

SEQ ID NO: 79623 - RNA, 24 nt, Human
cccucccuaaccucggugccaccg

SEQ ID NO: 79624 - RNA, 22 nt, Human
gugcagaaugaacgaagucaca

SEQ ID NO: 79625 - RNA, 25 nt, Human
aguucaagaaauuguucugccuggg

SEQ ID NO: 79626 - RNA, 26 nt, Human
uguaucucacacagugccuugcuaau

SEQ ID NO: 79627 - RNA, 27 nt, Human
cugggaugugguggggagcugggccag

SEQ ID NO: 79628 - RNA, 26 nt, Human
ucuggcuucugcauuacuauuaacuc

SEQ ID NO: 79629 - RNA, 25 nt, Human
aaugcuacagcugugagagcuuguu

SEQ ID NO: 79630 - RNA, 25 nt, Human
gguggcaccaggcaaugcaggugaa

SEQ ID NO: 79631 - RNA, 24 nt, Human
gcccaggcuggagugcaacgguac

SEQ ID NO: 79632 - RNA, 26 nt, Human
auuuuucugaucuaagcaaacaacuc

SEQ ID NO: 79633 - RNA, 22 nt, Human
cagguucuccguuagcuccugu

SEQ ID NO: 79634 - RNA, 20 nt, Human
aauuucuggagaacuccagg

SEQ ID NO: 79635 - RNA, 28 nt, Human
caggagcagcauuauccccaaagauauu

SEQ ID NO: 79636 - RNA, 21 nt, Human
aaacccaggaggagagugugg

SEQ ID NO: 79637 - RNA, 22 nt, Human
agcaggacugaggacaggcccc

SEQ ID NO: 79638 - RNA, 23 nt, Human
cguuucacccuccagcugcuguc

SEQ ID NO: 79639 - RNA, 21 nt, Human
aaccuguuucacuauggccuc

SEQ ID NO: 79640 - RNA, 22 nt, Human
gccuguaauccaagcacuuggg

SEQ ID NO: 79641 - RNA, 22 nt, Human
gcauuuuccaaagagaggaauc

SEQ ID NO: 79642 - RNA, 26 nt, Human
auaagaaauuuagggcagggcacggu

SEQ ID NO: 79643 - RNA, 26 nt, Human
aaacauuugaaaaacuuuuuauaaaa

SEQ ID NO: 79644 - RNA, 23 nt, Human
aggcugcccccaacaacuccagg

SEQ ID NO: 79645 - RNA, 21 nt, Human
acccuugcccaccgccgugga

SEQ ID NO: 79646 - RNA, 25 nt, Human
caguucuguaagucucacuuuguuc

SEQ ID NO: 79647 - RNA, 27 nt, Human
cgggaggcagagguugcagccggcuga

SEQ ID NO: 79648 - RNA, 27 nt, Human
ggggugaggaaaaaccucuacauuggc

SEQ ID NO: 79649 - RNA, 20 nt, Human
ccuguuugccccaccuucac

SEQ ID NO: 79650 - RNA, 22 nt, Human
ggugggggaggcccugggcagg

SEQ ID NO: 79651 - RNA, 22 nt, Human
aaguacacacaggaauacauac

SEQ ID NO: 79652 - RNA, 27 nt, Human
gcaccuuggcccaggagcucugcgcca

SEQ ID NO: 79653 - RNA, 21 nt, Human
guuggcugaggaaggggaaga

SEQ ID NO: 79654 - RNA, 21 nt, Human
gaaauguauucauacugugaa

SEQ ID NO: 79655 - RNA, 28 nt, Human
cucuuggcccaaccugcucaccccaccg

SEQ ID NO: 79656 - RNA, 24 nt, Human
caauuuuugaacaacuguuggaaa

SEQ ID NO: 79657 - RNA, 24 nt, Human
gugcucagcccugcccauggcugu

SEQ ID NO: 79658 - RNA, 27 nt, Human
ccccugccuuugaaaacaaggaaaggu

SEQ ID NO: 79659 - RNA, 27 nt, Human
ccacuacacuccagccuggcgacagag

SEQ ID NO: 79660 - RNA, 22 nt, Human
ugggaggcggagguugcaauga

SEQ ID NO: 79661 - RNA, 27 nt, Human
uguuugcuuugugauaaaauguuaaca

SEQ ID NO: 79662 - RNA, 23 nt, Human
guucaagcaagucuccugccuca

SEQ ID NO: 79663 - RNA, 23 nt, Human
ccuguaauccuuguacuguucgg

SEQ ID NO: 79664 - RNA, 22 nt, Human
uggaaguaaccauuugcacugg

SEQ ID NO: 79665 - RNA, 25 nt, Human
gcccaggcuggagugcaauggcagg

SEQ ID NO: 79666 - RNA, 21 nt, Human
aucccuuaaacugaguguagg

SEQ ID NO: 79667 - RNA, 22 nt, Human
gcuugugaucccagcacuuugg

SEQ ID NO: 79668 - RNA, 26 nt, Human
ggcuccugccuucucacgugggaauc

SEQ ID NO: 79669 - RNA, 16 nt, Human
gcccccaaaugccuua

SEQ ID NO: 79670 - RNA, 26 nt, Human
gggagagggcagggaggcuuccuggg

SEQ ID NO: 79671 - RNA, 21 nt, Human
ucccauaguacuucagucaag

SEQ ID NO: 79672 - RNA, 20 nt, Human
ggagaggggcaacaggaggc

SEQ ID NO: 79673 - RNA, 22 nt, Human
ggucgccugcauuucuccgugc

SEQ ID NO: 79674 - RNA, 27 nt, Human
aaucaguuuuuaaaauauuuagucuaa

SEQ ID NO: 79675 - RNA, 22 nt, Human
aucgcuugggcccaggaggugg

SEQ ID NO: 79676 - RNA, 20 nt, Human
ucacuugugucaaucaugcu

SEQ ID NO: 79677 - RNA, 27 nt, Human
aggagccucucaagcgguccuguuggc

SEQ ID NO: 79678 - RNA, 22 nt, Human
agcaccugcuacacagcaggcu

SEQ ID NO: 79679 - RNA, 20 nt, Human
ucgaaugcagaaccucaccu

SEQ ID NO: 79680 - RNA, 23 nt, Human
gucagcaaacaacaaacaaacca

SEQ ID NO: 79681 - RNA, 22 nt, Human
gccccuucccaaguaaaacuuu

SEQ ID NO: 79682 - RNA, 23 nt, Human
agucagcguaaaccucuuugccu

SEQ ID NO: 79683 - RNA, 22 nt, Human
caucaccuuugaaaauauuuca

SEQ ID NO: 79684 - RNA, 23 nt, Human
gugacuugcuuuuccugugcaca

SEQ ID NO: 79685 - RNA, 21 nt, Human
ggaagaccagcuuugcaguga

SEQ ID NO: 79686 - RNA, 28 nt, Human
gucuuugccuuuguuugcacuguguguu

SEQ ID NO: 79687 - RNA, 23 nt, Human
agugcucagagcuggggagggag

SEQ ID NO: 79688 - RNA, 26 nt, Human
cgcugcccgagcucuggccuagggac

SEQ ID NO: 79689 - RNA, 32 nt, Human
aagcuccaauuauugguccccaaaagcagcuu

SEQ ID NO: 79690 - RNA, 25 nt, Human
cagggaguccucagaguugcaguuc

SEQ ID NO: 79691 - RNA, 22 nt, Human
uagugcugaagaggaggggcgu

SEQ ID NO: 79692 - RNA, 25 nt, Human
augaagaaaucggagugggaagaga

SEQ ID NO: 79693 - RNA, 26 nt, Human
cucugccucccagguucaagcgaguc

SEQ ID NO: 79694 - RNA, 25 nt, Human
ugcuggugggguagggaugagggag

SEQ ID NO: 79695 - RNA, 22 nt, Human
agugaaaaugccacucucucca

SEQ ID NO: 79696 - RNA, 19 nt, Human
guaggcaaaggugggagga

SEQ ID NO: 79697 - RNA, 23 nt, Human
auggguacauuuuagagucuucc

SEQ ID NO: 79698 - RNA, 20 nt, Human
ggcaaaaccugaaccaccuu

SEQ ID NO: 79699 - RNA, 22 nt, Human
uuucaucuggcuccccccacca

SEQ ID NO: 79700 - RNA, 24 nt, Human
ucucaucccucuccuaagugagcc

SEQ ID NO: 79701 - RNA, 24 nt, Human
caaagggggccagccagaacugag

SEQ ID NO: 79702 - RNA, 23 nt, Human
gagaggauguagagauuuggggu

SEQ ID NO: 79703 - RNA, 25 nt, Human
caggacuccagcccauugguagacg

SEQ ID NO: 79704 - RNA, 23 nt, Human
ggagucccaggacccagggagag

SEQ ID NO: 79705 - RNA, 23 nt, Human
gguccagaagccucucagccagg

SEQ ID NO: 79706 - RNA, 24 nt, Human
aaacaugggcuucaaccugacuuu

SEQ ID NO: 79707 - RNA, 21 nt, Human
aucuucuucccuacagcagua

SEQ ID NO: 79708 - RNA, 23 nt, Human
ccucuucucuacccuccuucaug

SEQ ID NO: 79709 - RNA, 21 nt, Human
caguuuaugguuucauaggca

SEQ ID NO: 79710 - RNA, 20 nt, Human
ggucaggcugauggagacag

SEQ ID NO: 79711 - RNA, 24 nt, Human
cagcgggcguggaggucgcggcgg

SEQ ID NO: 79712 - RNA, 27 nt, Human
uggccaacaugaugaaacccuugucuc

SEQ ID NO: 79713 - RNA, 27 nt, Human
cuaccugcuauagcacacucuccgauu

SEQ ID NO: 79714 - RNA, 27 nt, Human
uguuuuuaaaaaggucauauauuuuuu

SEQ ID NO: 79715 - RNA, 22 nt, Human
gaccauccuggccaacauggug

SEQ ID NO: 79716 - RNA, 27 nt, Human
aggacugugaccugccauaaagacuga

SEQ ID NO: 79717 - RNA, 22 nt, Human
ucaacccugccauuuuaccaca

SEQ ID NO: 79718 - RNA, 25 nt, Human
gggggauguacgaguaaaaagguua

SEQ ID NO: 79719 - RNA, 25 nt, Human
caggcugcaguugagggucuguccu

SEQ ID NO: 79720 - RNA, 19 nt, Human
aacucccugggcagagcca

SEQ ID NO: 79721 - RNA, 22 nt, Human
gcccccaauaaaggcagcugcc

SEQ ID NO: 79722 - RNA, 24 nt, Human
auuggguagaaugaggauccuguu

SEQ ID NO: 79723 - RNA, 22 nt, Human
aggauuugcuaauuucagugaa

SEQ ID NO: 79724 - RNA, 23 nt, Human
cuuuucuauuuuugauuguguug

SEQ ID NO: 79725 - RNA, 27 nt, Human
aaccaaaacacucugguucaguguuuu

SEQ ID NO: 79726 - RNA, 21 nt, Human
augccuggccucucucugcca

SEQ ID NO: 79727 - RNA, 22 nt, Human
ggcggcggaggcggcggcggag

SEQ ID NO: 79728 - RNA, 22 nt, Human
agucuuccggguagcugggacu

SEQ ID NO: 79729 - RNA, 25 nt, Human
gggucuuccuccagcaguuacuuga

SEQ ID NO: 79730 - RNA, 25 nt, Human
gaaagagaauagaaaacacgcauga

SEQ ID NO: 79731 - RNA, 24 nt, Human
ccacuccaugaacaucauccaccg

SEQ ID NO: 79732 - RNA, 25 nt, Human
ucucugucugucucucucugugucu

SEQ ID NO: 79733 - RNA, 24 nt, Human
ugaaggaggcagagaagggguugg

SEQ ID NO: 79734 - RNA, 22 nt, Human
gcaguaggggaaauggaguugc

SEQ ID NO: 79735 - RNA, 20 nt, Human
ggcgguggggagagauggac

SEQ ID NO: 79736 - RNA, 22 nt, Human
gggcgcucucccuaccuugccu

SEQ ID NO: 79737 - RNA, 21 nt, Human
gcagagggaagagaugaucau

SEQ ID NO: 79738 - RNA, 23 nt, Human
cuugcagauggcgcguucucacg

SEQ ID NO: 79739 - RNA, 26 nt, Human
uccuguucucuuauccuuauccccuc

SEQ ID NO: 79740 - RNA, 27 nt, Human
uggagagaagagugaucuggcuucucc

SEQ ID NO: 79741 - RNA, 21 nt, Human
cacagcuguuguucggggcug

SEQ ID NO: 79742 - RNA, 24 nt, Human
uccaggccugaagagacuaugcug

SEQ ID NO: 79743 - RNA, 23 nt, Human
agggcugcaagaccauccugccc

SEQ ID NO: 79744 - RNA, 21 nt, Human
ccuguugccugcuccugggca

SEQ ID NO: 79745 - RNA, 27 nt, Human
acgcuggugcugagacaggggcaaggc

SEQ ID NO: 79746 - RNA, 18 nt, Human
gugaggguggagccaggu

SEQ ID NO: 79747 - RNA, 23 nt, Human
cagaguaacauuauuguucucau

SEQ ID NO: 79748 - RNA, 23 nt, Human
aaacccaggaggagaguguggag

SEQ ID NO: 79749 - RNA, 27 nt, Human
ccugcugguaccacaccccaccuucgg

SEQ ID NO: 79750 - RNA, 27 nt, Human
ggggaaagauaguggcaacaggcaaag

SEQ ID NO: 79751 - RNA, 23 nt, Human
caagugagccugagggaggcuga

SEQ ID NO: 79752 - RNA, 23 nt, Human
aauaucucuccguaucauggccc

SEQ ID NO: 79753 - RNA, 22 nt, Human
uguccuaaaggguuaguagaca

SEQ ID NO: 79754 - RNA, 21 nt, Human
uuuacaaggguucauuuugga

SEQ ID NO: 79755 - RNA, 27 nt, Human
cacaggucccugagccuuggggagucc

SEQ ID NO: 79756 - RNA, 21 nt, Human
cuguucaaguacaggggccug

SEQ ID NO: 79757 - RNA, 25 nt, Human
gcugcugcuucugcuccagccccuu

SEQ ID NO: 79758 - RNA, 20 nt, Human
uuuauuccuucuuguggguu

SEQ ID NO: 79759 - RNA, 25 nt, Human
gucugcauaaacccuccuguccugg

SEQ ID NO: 79760 - RNA, 26 nt, Human
cuccuccucugggcacagggugugcg

SEQ ID NO: 79761 - RNA, 22 nt, Human
ucuuucucauagccucuccacu

SEQ ID NO: 79762 - RNA, 22 nt, Human
gugaucauaacucuuuguugaa

SEQ ID NO: 79763 - RNA, 19 nt, Human
gugaacaaacuauauuccu

SEQ ID NO: 79764 - RNA, 25 nt, Human
guguccaccguggagugguuuggug

SEQ ID NO: 79765 - RNA, 23 nt, Human
gaggauuuggcucgcugugguuu

SEQ ID NO: 79766 - RNA, 24 nt, Human
cagacuuccagguguuuaaauucu

SEQ ID NO: 79767 - RNA, 21 nt, Human
cucuccuccccuuugcucacu

SEQ ID NO: 79768 - RNA, 18 nt, Human
ggacccuccccugcucca

SEQ ID NO: 79769 - RNA, 26 nt, Human
ugccucuuucauuucucaguauauau

SEQ ID NO: 79770 - RNA, 23 nt, Human
agaggugggaagggaaggaggag

SEQ ID NO: 79771 - RNA, 22 nt, Human
uguggugagccaugaucgcacc

SEQ ID NO: 79772 - RNA, 22 nt, Human
cugagaucccaccauugcacuc

SEQ ID NO: 79773 - RNA, 27 nt, Human
gcuguguuugcagugcaaauagcucug

SEQ ID NO: 79774 - RNA, 22 nt, Human
gcccuugucucugaggcugaag

SEQ ID NO: 79775 - RNA, 25 nt, Human
uccucgcucacaccuuguuugaacu

SEQ ID NO: 79776 - RNA, 20 nt, Human
ucagcacugccaguggagau

SEQ ID NO: 79777 - RNA, 17 nt, Human
cuugacaaaaaugacug

SEQ ID NO: 79778 - RNA, 26 nt, Human
ccuucacugcacuuucuuccugccuu

SEQ ID NO: 79779 - RNA, 19 nt, Human
cccagccuugaacuucacu

SEQ ID NO: 79780 - RNA, 21 nt, Human
agacccagggagccgggguua

SEQ ID NO: 79781 - RNA, 24 nt, Human
aagaugguuuuauuaguacccugg

SEQ ID NO: 79782 - RNA, 29 nt, Human
cuaccugacuaugcuuucucuccuaggag

SEQ ID NO: 79783 - RNA, 26 nt, Human
gccagccuggcuucuggagcccuugg

SEQ ID NO: 79784 - RNA, 21 nt, Human
auugcccagacuggucucgaa

SEQ ID NO: 79785 - RNA, 21 nt, Human
uguaauaaaauaugggcaacg

SEQ ID NO: 79786 - RNA, 21 nt, Human
agacuuuuguugaaauagcuu

SEQ ID NO: 79787 - RNA, 25 nt, Human
uuuuaucucaaaaugccgaacgaga

SEQ ID NO: 79788 - RNA, 21 nt, Human
uucuggauccuccauugcucg

SEQ ID NO: 79789 - RNA, 26 nt, Human
cccuccuccuccucggaauccugggu

SEQ ID NO: 79790 - RNA, 23 nt, Human
uuccaugaauguuccugccuccu

SEQ ID NO: 79791 - RNA, 29 nt, Human
ugggauuuuggcagagaaauuuucagcug

SEQ ID NO: 79792 - RNA, 21 nt, Human
cuccuccccucuccuacuguc

SEQ ID NO: 79793 - RNA, 24 nt, Human
ggagagaaggcuggggagggcugg

SEQ ID NO: 79794 - RNA, 26 nt, Human
gcagugcgggaagaugagcaggccag

SEQ ID NO: 79795 - RNA, 28 nt, Human
ccgguggcugaagaggcugcccccucag

SEQ ID NO: 79796 - RNA, 17 nt, Human
gcuggcagagggaaagg

SEQ ID NO: 79797 - RNA, 22 nt, Human
augccagucagcuccugggguu

SEQ ID NO: 79798 - RNA, 21 nt, Human
gcuuuuccugucugacucuga

SEQ ID NO: 79799 - RNA, 22 nt, Human
caccucaggccaggugcagugg

SEQ ID NO: 79800 - RNA, 22 nt, Human
ccaacauggugaaacccuaucu

SEQ ID NO: 79801 - RNA, 22 nt, Human
ccaacauggcaaaaccccgucu

SEQ ID NO: 79802 - RNA, 22 nt, Human
cuaacauggugaaaccccaucu

SEQ ID NO: 79803 - RNA, 22 nt, Human
cuaacaugguaaaaccccgucu

SEQ ID NO: 79804 - RNA, 24 nt, Human
uccacugaucugaggagauccugu

SEQ ID NO: 79805 - RNA, 15 nt, Human
ggggugaggggcucc

SEQ ID NO: 79806 - RNA, 21 nt, Human
ugcccgccuccagcucucggg

SEQ ID NO: 79807 - RNA, 23 nt, Human
cuuuuucuggcugaaaggauuuu

SEQ ID NO: 79808 - RNA, 22 nt, Human
gacgaaagcuuucuuccugguu

SEQ ID NO: 79809 - RNA, 24 nt, Human
aggccagcugcggugaagagggug

SEQ ID NO: 79810 - RNA, 25 nt, Human
auugacuuuuuaauuuucuuauuug

SEQ ID NO: 79811 - RNA, 22 nt, Human
cccaucuggggguagugccuua

SEQ ID NO: 79812 - RNA, 22 nt, Human
agcuccucgaguagcugggacc

SEQ ID NO: 79813 - RNA, 26 nt, Human
uuaguuacacuggauaugcugcuguu

SEQ ID NO: 79814 - RNA, 22 nt, Human
uguacuccucuuuacacuggcc

SEQ ID NO: 79815 - RNA, 27 nt, Human
aggagagagucuuaccuccccuggccc

SEQ ID NO: 79816 - RNA, 19 nt, Human
ucagugagcucugaucucc

SEQ ID NO: 79817 - RNA, 22 nt, Human
gucucauauuggucauucccug

SEQ ID NO: 79818 - RNA, 25 nt, Human
ucaccagacuggggaugccuauagg

SEQ ID NO: 79819 - RNA, 20 nt, Human
gcuguggcaucccauuguuc

SEQ ID NO: 79820 - RNA, 26 nt, Human
ggacccagggcucuguaaguagaugc

SEQ ID NO: 79821 - RNA, 26 nt, Human
ccucuucccccgccccgcccugggcc

SEQ ID NO: 79822 - RNA, 23 nt, Human
uucaguuauuuucugagugugca

SEQ ID NO: 79823 - RNA, 25 nt, Human
ggugucuggaagcauggagcauggg

SEQ ID NO: 79824 - RNA, 19 nt, Human
acuucagagcagggcuucu

SEQ ID NO: 79825 - RNA, 22 nt, Human
gaggaauuuugacagcuguuga

SEQ ID NO: 79826 - RNA, 26 nt, Human
ccaggccaccaccccgaaccccuccg

SEQ ID NO: 79827 - RNA, 18 nt, Human
acuccaggaaggggcugg

SEQ ID NO: 79828 - RNA, 22 nt, Human
caucccugaaaccuaaauucac

SEQ ID NO: 79829 - RNA, 24 nt, Human
cugccuaaaucacuuuucucgcag

SEQ ID NO: 79830 - RNA, 27 nt, Human
ccucaagugagccaagaaacacugccu

SEQ ID NO: 79831 - RNA, 27 nt, Human
uaaccaaaaguaacaauccaucaaccu

SEQ ID NO: 79832 - RNA, 18 nt, Human
agcuguguaagcaccuua

SEQ ID NO: 79833 - RNA, 32 nt, Human
cuggcuugguucgagauaggagcuuuucugug

SEQ ID NO: 79834 - RNA, 25 nt, Human
uccaacuuuucucaaagaguuuaca

SEQ ID NO: 79835 - RNA, 19 nt, Human
ugccuaaaauuuuauuuuu

SEQ ID NO: 79836 - RNA, 20 nt, Human
uuacauccuugauuacuucc

SEQ ID NO: 79837 - RNA, 26 nt, Human
cuccucuaucgggacccccuccccau

SEQ ID NO: 79838 - RNA, 27 nt, Human
ugucuucaggccacaccacaucuucca

SEQ ID NO: 79839 - RNA, 24 nt, Human
cuuauucaacaaguuuaccucccu

SEQ ID NO: 79840 - RNA, 19 nt, Human
uucaaccucaguaucugau

SEQ ID NO: 79841 - RNA, 20 nt, Human
ucuguggauacagucccaga

SEQ ID NO: 79842 - RNA, 21 nt, Human
cuauuguacaaaauguucaca

SEQ ID NO: 79843 - RNA, 26 nt, Human
gauagaagaaucuuacagaugcugcu

SEQ ID NO: 79844 - RNA, 25 nt, Human
uacaaacuaaaucagugugcugcua

SEQ ID NO: 79845 - RNA, 22 nt, Human
acugugggcccuccugcuggag

SEQ ID NO: 79846 - RNA, 22 nt, Human
cgucugaggggacaggaggauc

SEQ ID NO: 79847 - RNA, 22 nt, Human
gcaacaacagaagggaaauuuc

SEQ ID NO: 79848 - RNA, 26 nt, Human
ugcuguauuuuaacacuuuguauuac

SEQ ID NO: 79849 - RNA, 31 nt, Human
aucgugucgcaggagagcacagcccagcguu

SEQ ID NO: 79850 - RNA, 22 nt, Human
ggucuuggaaauugucuucaga

SEQ ID NO: 79851 - RNA, 21 nt, Human
gcucucagccaccuguuacua

SEQ ID NO: 79852 - RNA, 21 nt, Human
gagagggaacccaggaauugu

SEQ ID NO: 79853 - RNA, 17 nt, Human
cugcuccugccugcuuc

SEQ ID NO: 79854 - RNA, 25 nt, Human
ccacaggcuagauccccggugguuu

SEQ ID NO: 79855 - RNA, 21 nt, Human
aggccagccugggaacaugga

SEQ ID NO: 79856 - RNA, 25 nt, Human
aguuuccuuccuuccuucucggcag

SEQ ID NO: 79857 - RNA, 22 nt, Human
agcagcagcagcagguaccagc

SEQ ID NO: 79858 - RNA, 21 nt, Human
ucauucuauuuguuauugcua

SEQ ID NO: 79859 - RNA, 26 nt, Human
ugccagguuugcaccagccucgaguc

SEQ ID NO: 79860 - RNA, 22 nt, Human
ucagcucccugccuugucacau

SEQ ID NO: 79861 - RNA, 17 nt, Human
ucagaagcagaugcuga

SEQ ID NO: 79862 - RNA, 21 nt, Human
cacuacugcgcuucugccucg

SEQ ID NO: 79863 - RNA, 21 nt, Human
aagcuggaacccaggagcagu

SEQ ID NO: 79864 - RNA, 22 nt, Human
aaaugccacacuugugugccac

SEQ ID NO: 79865 - RNA, 21 nt, Human
acccccuagaaaugagcugca

SEQ ID NO: 79866 - RNA, 21 nt, Human
ccuucauuccaaaccccucuc

SEQ ID NO: 79867 - RNA, 23 nt, Human
cugaaauugaguuuauguaguca

SEQ ID NO: 79868 - RNA, 20 nt, Human
agaagauuuuuauuuuuugu

SEQ ID NO: 79869 - RNA, 21 nt, Human
gugggcucuucacugagccau

SEQ ID NO: 79870 - RNA, 23 nt, Human
ugcaucuuugguauugugccucu

SEQ ID NO: 79871 - RNA, 22 nt, Human
auauuugauuuacucuccaaug

SEQ ID NO: 79872 - RNA, 22 nt, Human
uugggaggccgagaugggugaa

SEQ ID NO: 79873 - RNA, 20 nt, Human
cuuguuuucuagccuggcaa

SEQ ID NO: 79874 - RNA, 23 nt, Human
cuuuaugcugaccaucgguaacg

SEQ ID NO: 79875 - RNA, 21 nt, Human
guguaugccacaccuggccuu

SEQ ID NO: 79876 - RNA, 19 nt, Human
uaagaaaaacuuugaaaug

SEQ ID NO: 79877 - RNA, 26 nt, Human
aggaagaggcaggcacuggcuggcuc

SEQ ID NO: 79878 - RNA, 27 nt, Human
ggcaaagcgugucccauagaaaauugg

SEQ ID NO: 79879 - RNA, 31 nt, Human
uacagguguguguccaugcacagcuaacuuu

SEQ ID NO: 79880 - RNA, 21 nt, Human
acuggggccaggcucacaccu

SEQ ID NO: 79881 - RNA, 26 nt, Human
cccauugauacaaggcugcugaggcc

SEQ ID NO: 79882 - RNA, 22 nt, Human
ggaugcaauuguugaaagcuuu

SEQ ID NO: 79883 - RNA, 26 nt, Human
guaccucccucacuucucuccuauca

SEQ ID NO: 79884 - RNA, 21 nt, Human
guguucucugaucugccccca

SEQ ID NO: 79885 - RNA, 26 nt, Human
agccuccaccgugcugaggucaggag

SEQ ID NO: 79886 - RNA, 23 nt, Human
ugggcagguugcuugaggcucca

SEQ ID NO: 79887 - RNA, 22 nt, Human
gggagggagaaggaguuggagc

SEQ ID NO: 79888 - RNA, 22 nt, Human
cuugcagagaagccagauucug

SEQ ID NO: 79889 - RNA, 23 nt, Human
gccugugagccccaggcacuuug

SEQ ID NO: 79890 - RNA, 23 nt, Human
accacgccacugcacuccagccu

SEQ ID NO: 79891 - RNA, 21 nt, Human
gaaagagaacaauauuuggga

SEQ ID NO: 79892 - RNA, 27 nt, Human
ccuguucuguugacuggggcccugcag

SEQ ID NO: 79893 - RNA, 23 nt, Human
gggacugcugugaggcagaggaa

SEQ ID NO: 79894 - RNA, 27 nt, Human
ggcaggagacacuggucucagaggagg

SEQ ID NO: 79895 - RNA, 21 nt, Human
gcagugagccaagaucgcgcc

SEQ ID NO: 79896 - RNA, 29 nt, Human
acauuacagagcagacagcucuaugaugu

SEQ ID NO: 79897 - RNA, 25 nt, Human
aaggcuugauagcagagguuuggug

SEQ ID NO: 79898 - RNA, 21 nt, Human
ugcuuuauccaucaccaccug

SEQ ID NO: 79899 - RNA, 27 nt, Human
aggugccacggccacaccagugagaug

SEQ ID NO: 79900 - RNA, 20 nt, Human
ucaaacccacagacccggac

SEQ ID NO: 79901 - RNA, 26 nt, Human
gguugccaggaaggggugagcacaga

SEQ ID NO: 79902 - RNA, 21 nt, Human
ucucacugccaccucaaaccc

SEQ ID NO: 79903 - RNA, 24 nt, Human
agggcugccacagcaauguaccac

SEQ ID NO: 79904 - RNA, 22 nt, Human
ccagguagcuggagaccuaggc

SEQ ID NO: 79905 - RNA, 27 nt, Human
aucgcaccacuguguauuuaacugccu

SEQ ID NO: 79906 - RNA, 22 nt, Human
ucccacucgccuuccuuucccu

SEQ ID NO: 79907 - RNA, 21 nt, Human
aacuuccgccuccuguguuca

SEQ ID NO: 79908 - RNA, 20 nt, Human
agcgugccccgcggcgggcc

SEQ ID NO: 79909 - RNA, 22 nt, Human
gugcacaucuauaaucccaguu

SEQ ID NO: 79910 - RNA, 22 nt, Human
ugcccccagcaguacaguccuu

SEQ ID NO: 79911 - RNA, 23 nt, Human
accacaccugguuaauuuuuuau

SEQ ID NO: 79912 - RNA, 21 nt, Human
cagacauuggagguggcagug

SEQ ID NO: 79913 - RNA, 26 nt, Human
cugcuuugaauuaugaucucugauuc

SEQ ID NO: 79914 - RNA, 27 nt, Human
gaguuugaguuagucaccucggggauu

SEQ ID NO: 79915 - RNA, 26 nt, Human
cagcuccacuuccagaauuuacuuga

SEQ ID NO: 79916 - RNA, 20 nt, Human
uucugccuuuucuuuucuuu

SEQ ID NO: 79917 - RNA, 23 nt, Human
ggcugagggagagcagcggcggc

SEQ ID NO: 79918 - RNA, 22 nt, Human
gccucccgaguagcugagacuu

SEQ ID NO: 79919 - RNA, 24 nt, Human
uggauauguccagucauccugccc

SEQ ID NO: 79920 - RNA, 21 nt, Human
cacaucucaccuccgaacugu

SEQ ID NO: 79921 - RNA, 26 nt, Human
ugccaggaagcaaagguugucacauc

SEQ ID NO: 79922 - RNA, 23 nt, Human
ugaaaaguaaacacugacuuuug

SEQ ID NO: 79923 - RNA, 23 nt, Human
aguuugauggagagagaggcaga

SEQ ID NO: 79924 - RNA, 23 nt, Human
cagcuguccacugggccauugug

SEQ ID NO: 79925 - RNA, 21 nt, Human
ccccaacaacuaucaaagucu

SEQ ID NO: 79926 - RNA, 27 nt, Human
uacccacuucccugcaaggugcaccug

SEQ ID NO: 79927 - RNA, 25 nt, Human
ccucugccccacucugggcuuuuca

SEQ ID NO: 79928 - RNA, 23 nt, Human
uucacccagccgccagucaugga

SEQ ID NO: 79929 - RNA, 26 nt, Human
ugagccaagaucacgucauugcacuc

SEQ ID NO: 79930 - RNA, 30 nt, Human
gcugcguucgcuccagccgcggcucuacag

SEQ ID NO: 79931 - RNA, 23 nt, Human
ucaucugguugaauggcuuuucu

SEQ ID NO: 79932 - RNA, 25 nt, Human
ucucaucagucccucuccuggagcu

SEQ ID NO: 79933 - RNA, 24 nt, Human
cugggaggaugacaugcagaggaa

SEQ ID NO: 79934 - RNA, 23 nt, Human
gcgucccagggcucugguucugg

SEQ ID NO: 79935 - RNA, 23 nt, Human
ccugcaggacaggccugggccug

SEQ ID NO: 79936 - RNA, 27 nt, Human
ccugccugggacagccacuggaaacuu

SEQ ID NO: 79937 - RNA, 22 nt, Human
gcuaaaaucaauuuuaauuuag

SEQ ID NO: 79938 - RNA, 25 nt, Human
ucugucucccaggcuggagugcagu

SEQ ID NO: 79939 - RNA, 20 nt, Human
ugggacucugagaacuccuc

SEQ ID NO: 79940 - RNA, 26 nt, Human
acaggcuggggcaggccaaggcgguc

SEQ ID NO: 79941 - RNA, 27 nt, Human
ggggcaguaguacuuugugggagccag

SEQ ID NO: 79942 - RNA, 22 nt, Human
ggaccagccuggucaagauggu

SEQ ID NO: 79943 - RNA, 25 nt, Human
uggggugggagccaaaaagaguuga

SEQ ID NO: 79944 - RNA, 22 nt, Human
gcccggggugguccaaugggug

SEQ ID NO: 79945 - RNA, 25 nt, Human
aguuaaguagugucuucucucucca

SEQ ID NO: 79946 - RNA, 27 nt, Human
ucuuccuggucauaggcucacucuuuc

SEQ ID NO: 79947 - RNA, 20 nt, Human
caaagagacaaccacuuugg

SEQ ID NO: 79948 - RNA, 17 nt, Human
uucucucucagcauucu

SEQ ID NO: 79949 - RNA, 20 nt, Human
uauugcuugucagccugugu

SEQ ID NO: 79950 - RNA, 26 nt, Human
acugggugggguggaaggcgacucac

SEQ ID NO: 79951 - RNA, 21 nt, Human
ccacagcucuaucaaggcuug

SEQ ID NO: 79952 - RNA, 23 nt, Human
caugccuguaaucccagcuacuc

SEQ ID NO: 79953 - RNA, 21 nt, Human
uguugcucaggcuggucucaa

SEQ ID NO: 79954 - RNA, 22 nt, Human
agaccuccuuaucuauuuuucu

SEQ ID NO: 79955 - RNA, 27 nt, Human
uccuggacuggacugaacauccagaaa

SEQ ID NO: 79956 - RNA, 24 nt, Human
cucuuccaguccaauccacgcugu

SEQ ID NO: 79957 - RNA, 22 nt, Human
ucaggggaaacgaggcugcagu

SEQ ID NO: 79958 - RNA, 20 nt, Human
ucaucccuccccgggccugg

SEQ ID NO: 79959 - RNA, 26 nt, Human
gccauucuucauuccuacaaaggacg

SEQ ID NO: 79960 - RNA, 24 nt, Human
ccaguggccacacagaacucuccc

SEQ ID NO: 79961 - RNA, 22 nt, Human
acugccacuccacuccaggugg

SEQ ID NO: 79962 - RNA, 23 nt, Human
ucuuucaccacauauucuugcca

SEQ ID NO: 79963 - RNA, 21 nt, Human
ugaaaaauuguaaaucugauc

SEQ ID NO: 79964 - RNA, 22 nt, Human
cugccucuuggguuucagugau

SEQ ID NO: 79965 - RNA, 27 nt, Human
cccucauuucaccugcgcuguggacac

SEQ ID NO: 79966 - RNA, 22 nt, Human
aacacuuaaagguuucuuugaa

SEQ ID NO: 79967 - RNA, 24 nt, Human
ggccuccuaugccucaucaugucc

SEQ ID NO: 79968 - RNA, 22 nt, Human
ucacccuauguggguggggcca

SEQ ID NO: 79969 - RNA, 22 nt, Human
gcaaagcaggauucaaaagaac

SEQ ID NO: 79970 - RNA, 27 nt, Human
ccuguugacuuuguaucucugccugug

SEQ ID NO: 79971 - RNA, 26 nt, Human
aacaguuauucuaucaacuuuuaaag

SEQ ID NO: 79972 - RNA, 17 nt, Human
cgugcuuguaaugcuca

SEQ ID NO: 79973 - RNA, 22 nt, Human
acaaacccagaguccacacaac

SEQ ID NO: 79974 - RNA, 21 nt, Human
uccuuaugguauuaacccccu

SEQ ID NO: 79975 - RNA, 19 nt, Human
guggaauugcuugccaaag

SEQ ID NO: 79976 - RNA, 25 nt, Human
gcuagagcaggucuucaucaugccu

SEQ ID NO: 79977 - RNA, 19 nt, Human
cugccagagcccaggcugg

SEQ ID NO: 79978 - RNA, 25 nt, Human
ccugcucugugccucagacuuggcu

SEQ ID NO: 79979 - RNA, 22 nt, Human
gaaaucuuaacagaaagguaau

SEQ ID NO: 79980 - RNA, 26 nt, Human
cauggucacccccacucugcauaccc

SEQ ID NO: 79981 - RNA, 23 nt, Human
gcuuuuucuucauuaccuuuuuu

SEQ ID NO: 79982 - RNA, 27 nt, Human
cucuagcaugggugacccagccgaccu

SEQ ID NO: 79983 - RNA, 26 nt, Human
agcccagcuaugaacuccuucuccac

SEQ ID NO: 79984 - RNA, 21 nt, Human
cuagcccucucccucuaggcu

SEQ ID NO: 79985 - RNA, 27 nt, Human
ugaccuguuuuaaaugaaccaaaccaa

SEQ ID NO: 79986 - RNA, 26 nt, Human
uugcccagacuggagagcaguggcca

SEQ ID NO: 79987 - RNA, 20 nt, Human
aauguaauuuaucuuugcca

SEQ ID NO: 79988 - RNA, 25 nt, Human
gccucuucccccugcuuccaccuca

SEQ ID NO: 79989 - RNA, 21 nt, Human
agauacugaugacaguguggg

SEQ ID NO: 79990 - RNA, 21 nt, Human
gauuauucuaaaucaccagaa

SEQ ID NO: 79991 - RNA, 29 nt, Human
auuauuuuuauuggaggaggaagcaucau

SEQ ID NO: 79992 - RNA, 21 nt, Human
agaagccacuccagccacucc

SEQ ID NO: 79993 - RNA, 28 nt, Human
gggcagcucgggggcugaaagcugggaa

SEQ ID NO: 79994 - RNA, 26 nt, Human
ucauuuucuugaaucaagaaaucgug

SEQ ID NO: 79995 - RNA, 28 nt, Human
ugcauggauguagggcuuggggugggaa

SEQ ID NO: 79996 - RNA, 22 nt, Human
ggagguugaggcacagccugug

SEQ ID NO: 79997 - RNA, 29 nt, Human
caggcuggaguauaauggcaugucucgac

SEQ ID NO: 79998 - RNA, 20 nt, Human
gcuccuggagggaaaaagaa

SEQ ID NO: 79999 - RNA, 18 nt, Human
gacuggaaaaaugaacug

SEQ ID NO: 80000 - RNA, 30 nt, Human
gccgccgcgcugucugcacagcugggggcc

SEQ ID NO: 80001 - RNA, 21 nt, Human
uuucaaagcuuccucuggcca

SEQ ID NO: 80002 - RNA, 22 nt, Human
uuuaguaucuuuaccuaccuca

SEQ ID NO: 80003 - RNA, 22 nt, Human
gcucacacacuccccugccucc

SEQ ID NO: 80004 - RNA, 21 nt, Human
agacuagauucucaccugccu

SEQ ID NO: 80005 - RNA, 23 nt, Human
ucucccauggugcccgugccucu

SEQ ID NO: 80006 - RNA, 26 nt, Human
ugcaaucuuccugccucaggcuucug

SEQ ID NO: 80007 - RNA, 32 nt, Human
ucuacucccuuccccucucugguccucagcuu

SEQ ID NO: 80008 - RNA, 22 nt, Human
cgggacgcagggguugcaguga

SEQ ID NO: 80009 - RNA, 19 nt, Human
uugcaauuuaugcuuuucg

SEQ ID NO: 80010 - RNA, 22 nt, Human
ugggaggcagagguuucaguga

SEQ ID NO: 80011 - RNA, 22 nt, Human
cugucccuggaccuggagcugc

SEQ ID NO: 80012 - RNA, 22 nt, Human
uugggagcuuuagaacacaagg

SEQ ID NO: 80013 - RNA, 20 nt, Human
cucaacaaaaggaagggugg

SEQ ID NO: 80014 - RNA, 21 nt, Human
agcccaaaugggcacuugcau

SEQ ID NO: 80015 - RNA, 22 nt, Human
caugccuguaaucccaguuagu

SEQ ID NO: 80016 - RNA, 22 nt, Human
ccccgagagagcucagccuugc

SEQ ID NO: 80017 - RNA, 25 nt, Human
ucccaaaauggagucauucauccug

SEQ ID NO: 80018 - RNA, 27 nt, Human
aaauguucugcagugucagggguaguc

SEQ ID NO: 80019 - RNA, 24 nt, Human
cucucacucccaaguuucuuugag

SEQ ID NO: 80020 - RNA, 23 nt, Human
cugaguucuugacaacagaaugu

SEQ ID NO: 80021 - RNA, 22 nt, Human
gggcacagugagggggagccag

SEQ ID NO: 80022 - RNA, 25 nt, Human
ggcacugugcuggguggggcugggg

SEQ ID NO: 80023 - RNA, 22 nt, Human
guaucuaugcauuuucuggacc

SEQ ID NO: 80024 - RNA, 28 nt, Human
cccagccaacaggaagcccagccuuuca

SEQ ID NO: 80025 - RNA, 22 nt, Human
cagcccugucuuucuguucucu

SEQ ID NO: 80026 - RNA, 24 nt, Human
uaccuugugccacugaauuuccaa

SEQ ID NO: 80027 - RNA, 23 nt, Human
cuguggacaccccaaauaggaag

SEQ ID NO: 80028 - RNA, 27 nt, Human
gggucucaccuuccgcgcaaggcugag

SEQ ID NO: 80029 - RNA, 24 nt, Human
uuguuccaggauguggaaugcagc

SEQ ID NO: 80030 - RNA, 20 nt, Human
aaauggaaauaucuccaucu

SEQ ID NO: 80031 - RNA, 22 nt, Human
cugggaggcagagguuguagug

SEQ ID NO: 80032 - RNA, 22 nt, Human
ccgggaggcagagguugcagug

SEQ ID NO: 80033 - RNA, 27 nt, Human
ccaacccaaaccuggagauggggagaa

SEQ ID NO: 80034 - RNA, 22 nt, Human
gggauuacaagcaugagucacu

SEQ ID NO: 80035 - RNA, 20 nt, Human
ccugccuguugccucuugug

SEQ ID NO: 80036 - RNA, 17 nt, Human
uaaacaacagaaacuuc

SEQ ID NO: 80037 - RNA, 27 nt, Human
ccguggcugaagagcagcaggaaguaa

SEQ ID NO: 80038 - RNA, 22 nt, Human
ucuaaaaauaaaccaaaggaca

SEQ ID NO: 80039 - RNA, 25 nt, Human
agcauuuuccuucuagucuauuuca

SEQ ID NO: 80040 - RNA, 23 nt, Human
ccuggacugaagcugucccgcag

SEQ ID NO: 80041 - RNA, 30 nt, Human
ucccugcucucucugcucagaacacuacca

SEQ ID NO: 80042 - RNA, 26 nt, Human
ucugcuccccuugcccacugggacuc

SEQ ID NO: 80043 - RNA, 27 nt, Human
gcccgugcugccgugcaguucuugccu

SEQ ID NO: 80044 - RNA, 22 nt, Human
gccuguaaucccaguacucugg

SEQ ID NO: 80045 - RNA, 25 nt, Human
gucgggauauuugggugcagagggu

SEQ ID NO: 80046 - RNA, 22 nt, Human
ugugcccaggcuggagugcaau

SEQ ID NO: 80047 - RNA, 22 nt, Human
gucgcccaggcuggagguuaau

SEQ ID NO: 80048 - RNA, 23 nt, Human
auggucaccuucuaaaagauaua

SEQ ID NO: 80049 - RNA, 22 nt, Human
uacgcuccagguggagaacagc

SEQ ID NO: 80050 - RNA, 19 nt, Human
ugaucccgggcuaggggag

SEQ ID NO: 80051 - RNA, 27 nt, Human
ccugcugucuucagcucuucuugacau

SEQ ID NO: 80052 - RNA, 24 nt, Human
gcaaaguuuugaaaauauauuuga

SEQ ID NO: 80053 - RNA, 27 nt, Human
ccugugcaguggcccccacagaaagac

SEQ ID NO: 80054 - RNA, 17 nt, Human
gcagguugcagcuugga

SEQ ID NO: 80055 - RNA, 21 nt, Human
caccacacuuuguuuggacau

SEQ ID NO: 80056 - RNA, 28 nt, Human
gggagggugagcuggugccugcuuugac

SEQ ID NO: 80057 - RNA, 24 nt, Human
gcccccagaggcucagcacuuugg

SEQ ID NO: 80058 - RNA, 22 nt, Human
uaccacggcacuccagccuggg

SEQ ID NO: 80059 - RNA, 22 nt, Human
aacaaguuuuacuaaaggaugg

SEQ ID NO: 80060 - RNA, 25 nt, Human
cuuccucugcuuggugaauugugcc

SEQ ID NO: 80061 - RNA, 24 nt, Human
acuccugacagucuugugcuuuuc

SEQ ID NO: 80062 - RNA, 24 nt, Human
uugugagcucgccugcauaugcag

SEQ ID NO: 80063 - RNA, 23 nt, Human
acuccuaugcaauauuacucagc

SEQ ID NO: 80064 - RNA, 22 nt, Human
gccacacacccauuuuccucac

SEQ ID NO: 80065 - RNA, 19 nt, Human
gucagcaaagcaagugaug

SEQ ID NO: 80066 - RNA, 25 nt, Human
ggcuucauggagaaaucuucucuga

SEQ ID NO: 80067 - RNA, 20 nt, Human
gucacccaggccacaaggcc

SEQ ID NO: 80068 - RNA, 21 nt, Human
ucaggcuucugcagcuguaga

SEQ ID NO: 80069 - RNA, 22 nt, Human
gcugcugcgcccucgcuuucuu

SEQ ID NO: 80070 - RNA, 23 nt, Human
cuuuguaaauagcaguucacauu

SEQ ID NO: 80071 - RNA, 22 nt, Human
caggcuggggugcaguggcacg

SEQ ID NO: 80072 - RNA, 22 nt, Human
gaggagaagggggucucuguua

SEQ ID NO: 80073 - RNA, 21 nt, Human
auuuuuaaaaaauaugucgua

SEQ ID NO: 80074 - RNA, 25 nt, Human
caaucuuauuagggugcagaaggaa

SEQ ID NO: 80075 - RNA, 19 nt, Human
ugcuaaaaauuauuggcuu

SEQ ID NO: 80076 - RNA, 23 nt, Human
ccacacugagcaaugaaugugag

SEQ ID NO: 80077 - RNA, 22 nt, Human
agcuggagugaggaguagaggu

SEQ ID NO: 80078 - RNA, 22 nt, Human
cacugccccguguccauggggu

SEQ ID NO: 80079 - RNA, 22 nt, Human
gcucauucauauuccugccuuu

SEQ ID NO: 80080 - RNA, 23 nt, Human
gggcuccagggauaaagcagguc

SEQ ID NO: 80081 - RNA, 23 nt, Human
cuucuugccagcaauagaucuca

SEQ ID NO: 80082 - RNA, 23 nt, Human
cugugucacccaggcuggagugc

SEQ ID NO: 80083 - RNA, 26 nt, Human
ggggggcauggaggccaggucucagu

SEQ ID NO: 80084 - RNA, 21 nt, Human
ucgguccuucagcaccccucg

SEQ ID NO: 80085 - RNA, 21 nt, Human
ccuccgcccagcucggcgagc

SEQ ID NO: 80086 - RNA, 23 nt, Human
agguagugccaaucuccuugccc

SEQ ID NO: 80087 - RNA, 26 nt, Human
aacucauaaaaagccugcaauuucau

SEQ ID NO: 80088 - RNA, 25 nt, Human
uuauauuggcaucucuuuccaaaag

SEQ ID NO: 80089 - RNA, 24 nt, Human
ccggauccaccacccuucccccac

SEQ ID NO: 80090 - RNA, 21 nt, Human
gauggggggaauuaccugccc

SEQ ID NO: 80091 - RNA, 26 nt, Human
acaggcuggcuccagaugcagggcag

SEQ ID NO: 80092 - RNA, 25 nt, Human
gcacagacaagucuggcacuuccuu

SEQ ID NO: 80093 - RNA, 21 nt, Human
gcccaaauuuggcaauaaaua

SEQ ID NO: 80094 - RNA, 20 nt, Human
cuagaugagucagaacuuag

SEQ ID NO: 80095 - RNA, 24 nt, Human
cauauaauucauccauuuaaagug

SEQ ID NO: 80096 - RNA, 27 nt, Human
ccccacccucucuccugggccacugag

SEQ ID NO: 80097 - RNA, 25 nt, Human
cccaaggcaaaaacuaccuucugac

SEQ ID NO: 80098 - RNA, 22 nt, Human
agguauuaagaaauggagagaa

SEQ ID NO: 80099 - RNA, 22 nt, Human
aaucucuagagaacuacugaac

SEQ ID NO: 80100 - RNA, 22 nt, Human
agagcaugcgucucagcagagc

SEQ ID NO: 80101 - RNA, 23 nt, Human
ccccaagaucugccagaccugca

SEQ ID NO: 80102 - RNA, 19 nt, Human
acaagucauggucacagua

SEQ ID NO: 80103 - RNA, 21 nt, Human
ggcugagauuggcagagugaa

SEQ ID NO: 80104 - RNA, 26 nt, Human
uaagcucauaaaaauaauugaugaua

SEQ ID NO: 80105 - RNA, 24 nt, Human
guuggucucuccccuucuacugcc

SEQ ID NO: 80106 - RNA, 26 nt, Human
gccguggagagacacugcccccagga

SEQ ID NO: 80107 - RNA, 22 nt, Human
ccgaaguagcugggauuacagg

SEQ ID NO: 80108 - RNA, 25 nt, Human
ccuccucccuccauccugggaaguc

SEQ ID NO: 80109 - RNA, 22 nt, Human
cagaagcagccgggggcgcuga

SEQ ID NO: 80110 - RNA, 18 nt, Human
gaugccacucugcagguu

SEQ ID NO: 80111 - RNA, 22 nt, Human
gacuaauuuuuguauuuugagu

SEQ ID NO: 80112 - RNA, 21 nt, Human
gcaaaggcugacuugccugaa

SEQ ID NO: 80113 - RNA, 16 nt, Human
gagggaggggaaaagc

SEQ ID NO: 80114 - RNA, 21 nt, Human
gcacacgagacaaucccaagu

SEQ ID NO: 80115 - RNA, 23 nt, Human
gguuacagagagccuccucagau

SEQ ID NO: 80116 - RNA, 22 nt, Human
agcuaaguagacccaaugggga

SEQ ID NO: 80117 - RNA, 22 nt, Human
ccaacauggcaaaaccacaucu

SEQ ID NO: 80118 - RNA, 26 nt, Human
ccgcuccguggacuggaaagcuguuc

SEQ ID NO: 80119 - RNA, 27 nt, Human
gcucuguuacccaggcuggagugcagu

SEQ ID NO: 80120 - RNA, 22 nt, Human
cugcgcccucgcuuucuugaca

SEQ ID NO: 80121 - RNA, 20 nt, Human
gcuaaagcugccuuuugucu

SEQ ID NO: 80122 - RNA, 23 nt, Human
guuagcucuucucauugugaagg

SEQ ID NO: 80123 - RNA, 22 nt, Human
uuacaacaucuguuacauucua

SEQ ID NO: 80124 - RNA, 22 nt, Human
accagccugggcuacauaguga

SEQ ID NO: 80125 - RNA, 26 nt, Human
ggaccccagggagagcugaccacugc

SEQ ID NO: 80126 - RNA, 23 nt, Human
uuaccuaccucguaaaagucuga

SEQ ID NO: 80127 - RNA, 22 nt, Human
ccuccugccgcugccugccauu

SEQ ID NO: 80128 - RNA, 23 nt, Human
ccccaccuuggugacucgcccca

SEQ ID NO: 80129 - RNA, 21 nt, Human
caucugcuuccacuguguucc

SEQ ID NO: 80130 - RNA, 22 nt, Human
cagagccuucucuuuacucucc

SEQ ID NO: 80131 - RNA, 25 nt, Human
ucccugcaccgccgcagaagcagcc

SEQ ID NO: 80132 - RNA, 21 nt, Human
guugcccaggcuggucgcgaa

SEQ ID NO: 80133 - RNA, 20 nt, Human
gugaucauuacucugcucuu

SEQ ID NO: 80134 - RNA, 29 nt, Human
gaguuaaugaacagucuaauauugacuua

SEQ ID NO: 80135 - RNA, 26 nt, Human
agguacugguacuauagcauuuugcu

SEQ ID NO: 80136 - RNA, 22 nt, Human
ccaggaggcggagcuugcagug

SEQ ID NO: 80137 - RNA, 23 nt, Human
uagauguuuucuugcuguuccuu

SEQ ID NO: 80138 - RNA, 24 nt, Human
uuucuaaaugacacauacuguuca

SEQ ID NO: 80139 - RNA, 22 nt, Human
ccaaugccccuuuaagugcugc

SEQ ID NO: 80140 - RNA, 21 nt, Human
gugccuuaaaaggagagaaga

SEQ ID NO: 80141 - RNA, 24 nt, Human
aggcucacuuccugcacagcuguc

SEQ ID NO: 80142 - RNA, 27 nt, Human
ucuccaccagcacaucacuaugcaucu

SEQ ID NO: 80143 - RNA, 30 nt, Human
ccuccccuccggcccguccugggcagguga

SEQ ID NO: 80144 - RNA, 26 nt, Human
ccaucauuuuuaauuucaagauauug

SEQ ID NO: 80145 - RNA, 22 nt, Human
ggcucacugcaaccucugccuc

SEQ ID NO: 80146 - RNA, 22 nt, Human
caggcacacaccaucacccuca

SEQ ID NO: 80147 - RNA, 27 nt, Human
gccucuaacuccugggcucaagcaauc

SEQ ID NO: 80148 - RNA, 21 nt, Human
uuaauuguuggcugggcacag

SEQ ID NO: 80149 - RNA, 21 nt, Human
cuccaccuugcacucaacuug

SEQ ID NO: 80150 - RNA, 30 nt, Human
gcucagcaugcauccuuugcacugucgaua

SEQ ID NO: 80151 - RNA, 23 nt, Human
accagugugaagcagaaggauga

SEQ ID NO: 80152 - RNA, 18 nt, Human
cuuuucuccccuuggguc

SEQ ID NO: 80153 - RNA, 22 nt, Human
gaacuccugggcucaagugauc

SEQ ID NO: 80154 - RNA, 24 nt, Human
uaauugccccugcaccuuugucaa

SEQ ID NO: 80155 - RNA, 22 nt, Human
cugccaggcacuguucaucuca

SEQ ID NO: 80156 - RNA, 23 nt, Human
ucaauaacaacaguuuuuauguu

SEQ ID NO: 80157 - RNA, 21 nt, Human
uggaaaucaagaaaugggugu

SEQ ID NO: 80158 - RNA, 25 nt, Human
uccauacucagcucuuuaacuuuuc

SEQ ID NO: 80159 - RNA, 22 nt, Human
cccuucuuucugggacucagag

SEQ ID NO: 80160 - RNA, 28 nt, Human
gggaggggauaagagaggugcauguugg

SEQ ID NO: 80161 - RNA, 21 nt, Human
ugugugccagcccugugugca

SEQ ID NO: 80162 - RNA, 21 nt, Human
ccucacucucuugccauacgg

SEQ ID NO: 80163 - RNA, 25 nt, Human
ugccuccaggcauuggcucagggug

SEQ ID NO: 80164 - RNA, 22 nt, Human
cugucugcuuuuuucuuauguc

SEQ ID NO: 80165 - RNA, 19 nt, Human
aaaugguucaacuguauua

SEQ ID NO: 80166 - RNA, 27 nt, Human
ccuuggcauagagcacccaggcaucga

SEQ ID NO: 80167 - RNA, 22 nt, Human
gggagagauggaagaggaccgg

SEQ ID NO: 80168 - RNA, 25 nt, Human
ccuggccucugugccuucuuuugau

SEQ ID NO: 80169 - RNA, 27 nt, Human
uucucauugagccucaggcuauacucc

SEQ ID NO: 80170 - RNA, 21 nt, Human
uuucauguguugcaaauuauu

SEQ ID NO: 80171 - RNA, 19 nt, Human
uauuuucauauucacaaga

SEQ ID NO: 80172 - RNA, 27 nt, Human
ccaacuugugugccuuucuuccgcccc

SEQ ID NO: 80173 - RNA, 19 nt, Human
ccagaaagugugggcugaa

SEQ ID NO: 80174 - RNA, 20 nt, Human
cacccaggcugcagugccau

SEQ ID NO: 80175 - RNA, 26 nt, Human
gcagaaggugaaauggaggaaaccac

SEQ ID NO: 80176 - RNA, 22 nt, Human
uggagggaucuggugccuccag

SEQ ID NO: 80177 - RNA, 22 nt, Human
aaacaccucacaccucacucuu

SEQ ID NO: 80178 - RNA, 23 nt, Human
ucuuauacugcugucucaaaucc

SEQ ID NO: 80179 - RNA, 22 nt, Human
auuccugaagucucuaauguga

SEQ ID NO: 80180 - RNA, 25 nt, Human
uggcuggcagggaaggaaaauagcu

SEQ ID NO: 80181 - RNA, 22 nt, Human
ucuccugcaccugacuggagcu

SEQ ID NO: 80182 - RNA, 25 nt, Human
ucuacuuccuguccaccuaugucuu

SEQ ID NO: 80183 - RNA, 22 nt, Human
ggcugguggagcugcugguguu

SEQ ID NO: 80184 - RNA, 22 nt, Human
ucacugcagguucagccuucug

SEQ ID NO: 80185 - RNA, 20 nt, Human
ggccaggcuggagugcagug

SEQ ID NO: 80186 - RNA, 20 nt, Human
gggaagagagugagggacag

SEQ ID NO: 80187 - RNA, 27 nt, Human
gaguacuagaauuuguauuuugcuuaa

SEQ ID NO: 80188 - RNA, 19 nt, Human
gcuuaaggagcuacacugg

SEQ ID NO: 80189 - RNA, 19 nt, Human
ccaggaggucaaggcugca

SEQ ID NO: 80190 - RNA, 22 nt, Human
gucacccagacuagaggucagu

SEQ ID NO: 80191 - RNA, 21 nt, Human
ucccugcuuugguuuguuuga

SEQ ID NO: 80192 - RNA, 21 nt, Human
uuuccucuguggggcauugga

SEQ ID NO: 80193 - RNA, 21 nt, Human
auugcguggaauugugcugag

SEQ ID NO: 80194 - RNA, 21 nt, Human
uccccaggcuguggccucagg

SEQ ID NO: 80195 - RNA, 24 nt, Human
ccagaagagaaaaaugaagacggg

SEQ ID NO: 80196 - RNA, 19 nt, Human
ucucuccuuugcugaggcc

SEQ ID NO: 80197 - RNA, 22 nt, Human
cuuggaggugguguuugcacug

SEQ ID NO: 80198 - RNA, 20 nt, Human
cuuagcccagguuccugggc

SEQ ID NO: 80199 - RNA, 18 nt, Human
cuucagcccagucccagc

SEQ ID NO: 80200 - RNA, 22 nt, Human
uacucauaaagggacaggcuag

SEQ ID NO: 80201 - RNA, 23 nt, Human
aggcuggagugcaauagcgcgau

SEQ ID NO: 80202 - RNA, 21 nt, Human
agcccccagcaaugcaucgcc

SEQ ID NO: 80203 - RNA, 21 nt, Human
cucaucauccuccucaugcca

SEQ ID NO: 80204 - RNA, 22 nt, Human
auaugcguauauuuuucugugc

SEQ ID NO: 80205 - RNA, 26 nt, Human
ccccaguguggucaagcagccaugcu

SEQ ID NO: 80206 - RNA, 22 nt, Human
agccucacgaguagcuggaauu

SEQ ID NO: 80207 - RNA, 23 nt, Human
cucugggaucuucagcugagauu

SEQ ID NO: 80208 - RNA, 14 nt, Human
ucuuucuucuucca

SEQ ID NO: 80209 - RNA, 22 nt, Human
uccuucuuaaccauucuacugu

SEQ ID NO: 80210 - RNA, 21 nt, Human
uggaagcucuaagaugagagc

SEQ ID NO: 80211 - RNA, 23 nt, Human
aaagagucuuaauuuucuaaaac

SEQ ID NO: 80212 - RNA, 22 nt, Human
aaagugcugggauuaaaggugu

SEQ ID NO: 80213 - RNA, 23 nt, Human
ggagcaucccggaggaaaucugc

SEQ ID NO: 80214 - RNA, 27 nt, Human
cccuuaaccaugacaccauuguaagag

SEQ ID NO: 80215 - RNA, 25 nt, Human
ccuccccaggacagggugagucaga

SEQ ID NO: 80216 - RNA, 22 nt, Human
uccaugagacgccaccgugaga

SEQ ID NO: 80217 - RNA, 23 nt, Human
auuuagcaucuauuacacucaug

SEQ ID NO: 80218 - RNA, 22 nt, Human
gcaggcggaucaccugaaguca

SEQ ID NO: 80219 - RNA, 19 nt, Human
gccagccagcgucacccuc

SEQ ID NO: 80220 - RNA, 20 nt, Human
caacaccaugauuccuuuaa

SEQ ID NO: 80221 - RNA, 22 nt, Human
auccaugucccuacaaaggaua

SEQ ID NO: 80222 - RNA, 27 nt, Human
guguauucacaaauucuguuacuucaa

SEQ ID NO: 80223 - RNA, 21 nt, Human
ccuccaucaccuucugcuccu

SEQ ID NO: 80224 - RNA, 22 nt, Human
cucaucagcuucuacucuuucu

SEQ ID NO: 80225 - RNA, 20 nt, Human
cuugcagaaaaaauauuaca

SEQ ID NO: 80226 - RNA, 21 nt, Human
caccuuggaagagauuauugg

SEQ ID NO: 80227 - RNA, 22 nt, Human
ggaggcugaggugggcagauca

SEQ ID NO: 80228 - RNA, 22 nt, Human
gagugccaucccugagagacca

SEQ ID NO: 80229 - RNA, 22 nt, Human
gcacgcaacauggcacaugugu

SEQ ID NO: 80230 - RNA, 24 nt, Human
uuuauacaguuuuaaagaaucauu

SEQ ID NO: 80231 - RNA, 22 nt, Human
aggcucucaauugcacucuuug

SEQ ID NO: 80232 - RNA, 21 nt, Human
acauguguauacauauguagc

SEQ ID NO: 80233 - RNA, 20 nt, Human
ucaagauucaguccagcaga

SEQ ID NO: 80234 - RNA, 23 nt, Human
accauccuggcuaacacagugaa

SEQ ID NO: 80235 - RNA, 26 nt, Human
uggggaaagcagaacugaagccacuu

SEQ ID NO: 80236 - RNA, 22 nt, Human
ugagauuauaggcaugagccac

SEQ ID NO: 80237 - RNA, 21 nt, Human
aggcuggaucuuguggaagac

SEQ ID NO: 80238 - RNA, 27 nt, Human
uguggguugcaauuaccaugucugacu

SEQ ID NO: 80239 - RNA, 22 nt, Human
ccuucuguaacaguggcauucc

SEQ ID NO: 80240 - RNA, 20 nt, Human
cuugggccuggggggaggga

SEQ ID NO: 80241 - RNA, 27 nt, Human
agccuccuuccuugaauuucuccgugg

SEQ ID NO: 80242 - RNA, 18 nt, Human
auuuucagaaguaaagca

SEQ ID NO: 80243 - RNA, 24 nt, Human
ccuuuggugccaacugguguuuga

SEQ ID NO: 80244 - RNA, 23 nt, Human
gccuggcugggugcaguggcuca

SEQ ID NO: 80245 - RNA, 28 nt, Human
cccucuuuuuccccuugauggaaauuga

SEQ ID NO: 80246 - RNA, 24 nt, Human
agccucucucgugcuuuucuccua

SEQ ID NO: 80247 - RNA, 27 nt, Human
aaguacaccuuuuccccccaugccugc

SEQ ID NO: 80248 - RNA, 27 nt, Human
guugcccaggcuggagugcauuggcgc

SEQ ID NO: 80249 - RNA, 25 nt, Human
gcacaaggcacaacaggcugcucug

SEQ ID NO: 80250 - RNA, 21 nt, Human
ugccucaugggcagggccaca

SEQ ID NO: 80251 - RNA, 21 nt, Human
acuggcuagucaugugaccuc

SEQ ID NO: 80252 - RNA, 21 nt, Human
auacauacaguauugcuuacc

SEQ ID NO: 80253 - RNA, 27 nt, Human
ucacccaguugguagaggagucaggag

SEQ ID NO: 80254 - RNA, 23 nt, Human
ggcagucgcccacuucucuccag

SEQ ID NO: 80255 - RNA, 26 nt, Human
ccucaagcaguugaacacagccaguu

SEQ ID NO: 80256 - RNA, 22 nt, Human
aggcugaggcaggagaaaggca

SEQ ID NO: 80257 - RNA, 26 nt, Human
ccauuuuucuccaagccaugggggac

SEQ ID NO: 80258 - RNA, 23 nt, Human
cacauggucaagaccaggcagaa

SEQ ID NO: 80259 - RNA, 27 nt, Human
ugccucuccccaccuucuuuggagcaa

SEQ ID NO: 80260 - RNA, 25 nt, Human
uaggcccuguaauuuaaccagucuu

SEQ ID NO: 80261 - RNA, 24 nt, Human
gcugcuguugcuacuguuugccuc

SEQ ID NO: 80262 - RNA, 21 nt, Human
aagauggcuacagaaccaaag

SEQ ID NO: 80263 - RNA, 24 nt, Human
ucccuggacagagcuaaacucucg

SEQ ID NO: 80264 - RNA, 27 nt, Human
ccugugcaaauuccucuagucaagugu

SEQ ID NO: 80265 - RNA, 21 nt, Human
cuguaugguuucuacuuuaug

SEQ ID NO: 80266 - RNA, 22 nt, Human
uggugcuaacaacaaaguucca

SEQ ID NO: 80267 - RNA, 22 nt, Human
agaccagccuggccagcauggu

SEQ ID NO: 80268 - RNA, 21 nt, Human
gguucauugcaaccuccgccu

SEQ ID NO: 80269 - RNA, 22 nt, Human
agcucacugccagcugcggccu

SEQ ID NO: 80270 - RNA, 23 nt, Human
uucauuugagagggagagcugug

SEQ ID NO: 80271 - RNA, 26 nt, Human
uuuggaauugaacucucugccuguaa

SEQ ID NO: 80272 - RNA, 23 nt, Human
cauucacuacaaacgugcagccu

SEQ ID NO: 80273 - RNA, 24 nt, Human
gggccuggagauaaccagcuuugg

SEQ ID NO: 80274 - RNA, 25 nt, Human
gcagccauucaaggaaaacccagcc

SEQ ID NO: 80275 - RNA, 22 nt, Human
acggaggcucacgagguacaag

SEQ ID NO: 80276 - RNA, 22 nt, Human
caacaugguaaaacuccauuuc

SEQ ID NO: 80277 - RNA, 19 nt, Human
cccuugcccagccaaugga

SEQ ID NO: 80278 - RNA, 21 nt, Human
gcaaucaguacaaagccacaa

SEQ ID NO: 80279 - RNA, 23 nt, Human
guuuuuaaagacucaccuuuuua

SEQ ID NO: 80280 - RNA, 21 nt, Human
gguggggacagggaugagcau

SEQ ID NO: 80281 - RNA, 24 nt, Human
ugccacccaggcuggaguacagug

SEQ ID NO: 80282 - RNA, 21 nt, Human
augaaaugucauggcucuguu

SEQ ID NO: 80283 - RNA, 29 nt, Human
cagagcugguggacccagggaacagccac

SEQ ID NO: 80284 - RNA, 24 nt, Human
aaugguuugucugucuuuuuuccu

SEQ ID NO: 80285 - RNA, 25 nt, Human
uccuggccgggcagggacagggcag

SEQ ID NO: 80286 - RNA, 20 nt, Human
ugccacagaauucacaugag

SEQ ID NO: 80287 - RNA, 22 nt, Human
gugucgaacuccugaccucagg

SEQ ID NO: 80288 - RNA, 27 nt, Human
uugcccaggaacuuaggguggguaccu

SEQ ID NO: 80289 - RNA, 23 nt, Human
ggcugcggaaagcggagggaguc

SEQ ID NO: 80290 - RNA, 24 nt, Human
ggauuguggggacaggagugagac

SEQ ID NO: 80291 - RNA, 21 nt, Human
gagauugcacuccagccuggg

SEQ ID NO: 80292 - RNA, 21 nt, Human
ggcucacugcauccucugccu

SEQ ID NO: 80293 - RNA, 22 nt, Human
ggugcagcuggcucgcgccucc

SEQ ID NO: 80294 - RNA, 21 nt, Human
gcacagugaccaaaucugaca

SEQ ID NO: 80295 - RNA, 22 nt, Human
uauuugggggaagggaaauguu

SEQ ID NO: 80296 - RNA, 21 nt, Human
aagaaagagaaaguacucaga

SEQ ID NO: 80297 - RNA, 27 nt, Human
accagccugaccaacacggagaaaccc

SEQ ID NO: 80298 - RNA, 27 nt, Human
ggaggcugaggugggaggguugaucac

SEQ ID NO: 80299 - RNA, 27 nt, Human
ggaggcugaggcgagagaaucgcuuga

SEQ ID NO: 80300 - RNA, 23 nt, Human
gggagggcuggcugcuggaagaa

SEQ ID NO: 80301 - RNA, 20 nt, Human
cucacgcagcugggaacaug

SEQ ID NO: 80302 - RNA, 22 nt, Human
aagacuucggaaaauuagucag

SEQ ID NO: 80303 - RNA, 23 nt, Human
gagggcugccugggggaggcaga

SEQ ID NO: 80304 - RNA, 22 nt, Human
ucgccuaagcuggaguguggug

SEQ ID NO: 80305 - RNA, 22 nt, Human
cuggguugcucuaagaacugau

SEQ ID NO: 80306 - RNA, 24 nt, Human
gagcggagguuuaccacagccuga

SEQ ID NO: 80307 - RNA, 22 nt, Human
ggugcuuggaagagaugaaaga

SEQ ID NO: 80308 - RNA, 21 nt, Human
cgcucaggcuggagugccaug

SEQ ID NO: 80309 - RNA, 21 nt, Human
cauugcacuucagccugguga

SEQ ID NO: 80310 - RNA, 21 nt, Human
agaacaacaagguuaagcuuc

SEQ ID NO: 80311 - RNA, 26 nt, Human
cucauuucucaacaguucauugcuca

SEQ ID NO: 80312 - RNA, 22 nt, Human
accaugcccccaccuaagucac

SEQ ID NO: 80313 - RNA, 22 nt, Human
uccaucauuuuacagugaccuu

SEQ ID NO: 80314 - RNA, 21 nt, Human
ucacuugucaggagugugugu

SEQ ID NO: 80315 - RNA, 26 nt, Human
cagacaguucuaaagcaaggagcugc

SEQ ID NO: 80316 - RNA, 24 nt, Human
uuggccaggcaggaugggcugugu

SEQ ID NO: 80317 - RNA, 22 nt, Human
aaagugcugggauuauaggcau

SEQ ID NO: 80318 - RNA, 23 nt, Human
uagccauuguuggcuuucccuua

SEQ ID NO: 80319 - RNA, 26 nt, Human
ggaguucuuuacaaagggcuuaggcu

SEQ ID NO: 80320 - RNA, 20 nt, Human
ccuaaccuagagaaagaguu

SEQ ID NO: 80321 - RNA, 22 nt, Human
accagcaaacgccaggacuugg

SEQ ID NO: 80322 - RNA, 25 nt, Human
agcccagucccccucacugcuugag

SEQ ID NO: 80323 - RNA, 21 nt, Human
uuucugaaccucuuagacucu

SEQ ID NO: 80324 - RNA, 27 nt, Human
gggccuggagauaaccagcuuuggauu

SEQ ID NO: 80325 - RNA, 23 nt, Human
gagcaagccuagguacgaagagg

SEQ ID NO: 80326 - RNA, 27 nt, Human
cugggcccugagucugggcagcugucc

SEQ ID NO: 80327 - RNA, 23 nt, Human
ggugacagugccuggagaauggg

SEQ ID NO: 80328 - RNA, 21 nt, Human
uugccuagggccucugugaug

SEQ ID NO: 80329 - RNA, 24 nt, Human
gauucaaugaugcuuucaaacuuu

SEQ ID NO: 80330 - RNA, 22 nt, Human
ggccugcagccuuccucuucug

SEQ ID NO: 80331 - RNA, 21 nt, Human
gcuuucuccccucccgcuagu

SEQ ID NO: 80332 - RNA, 19 nt, Human
gcgggggcugggauucacg

SEQ ID NO: 80333 - RNA, 20 nt, Human
ugaacagccacagugccuga

SEQ ID NO: 80334 - RNA, 21 nt, Human
ccauucuuucaaggcuuuuca

SEQ ID NO: 80335 - RNA, 19 nt, Human
cugggaaagaacucccccu

SEQ ID NO: 80336 - RNA, 20 nt, Human
gaaaacagcaauagugaaug

SEQ ID NO: 80337 - RNA, 21 nt, Human
gcacaguguaauauuucucca

SEQ ID NO: 80338 - RNA, 22 nt, Human
ucacugcagccucgaccuccug

SEQ ID NO: 80339 - RNA, 22 nt, Human
gggauuacaggcaugagccacu

SEQ ID NO: 80340 - RNA, 20 nt, Human
uuucugcauuaaaauaaaug

SEQ ID NO: 80341 - RNA, 22 nt, Human
ucuguuacccaggcuggagugc

SEQ ID NO: 80342 - RNA, 22 nt, Human
ucugucacccaggcuggagugu

SEQ ID NO: 80343 - RNA, 23 nt, Human
uaucaguuacaguggcaguauug

SEQ ID NO: 80344 - RNA, 23 nt, Human
ggucaucuguagggccaccccac

SEQ ID NO: 80345 - RNA, 23 nt, Human
guugcugauucaguggguguggg

SEQ ID NO: 80346 - RNA, 26 nt, Human
ggcucuucccuucuguccuccgaggg

SEQ ID NO: 80347 - RNA, 16 nt, Human
cugccucuguuguguu

SEQ ID NO: 80348 - RNA, 26 nt, Human
aucauccugaacuucacgucccugga

SEQ ID NO: 80349 - RNA, 29 nt, Human
ccucuguggcucuccucugguucaccuuu

SEQ ID NO: 80350 - RNA, 21 nt, Human
ugggagaucuucucagcccug

SEQ ID NO: 80351 - RNA, 20 nt, Human
accugcucauuuacacugag

SEQ ID NO: 80352 - RNA, 21 nt, Human
uucugcccugccuccuccuuu

SEQ ID NO: 80353 - RNA, 22 nt, Human
ccugcucucuucccuccaggcu

SEQ ID NO: 80354 - RNA, 20 nt, Human
gccuuucugccgcccaggcc

SEQ ID NO: 80355 - RNA, 23 nt, Human
cuaucugaauccaagacagccac

SEQ ID NO: 80356 - RNA, 20 nt, Human
cugacauauacugggugggg

SEQ ID NO: 80357 - RNA, 22 nt, Human
guggguaugaacuucugccuuc

SEQ ID NO: 80358 - RNA, 20 nt, Human
uguggacacucagucacauu

SEQ ID NO: 80359 - RNA, 22 nt, Human
uagcuguagaguccaucuguuu

SEQ ID NO: 80360 - RNA, 20 nt, Human
cuuggcucugcuggguuucc

SEQ ID NO: 80361 - RNA, 21 nt, Human
uauacucauguuaagugcaau

SEQ ID NO: 80362 - RNA, 23 nt, Human
ucugcuaucaccuuccucuuguc

SEQ ID NO: 80363 - RNA, 20 nt, Human
gcaagugccuuccugagcag

SEQ ID NO: 80364 - RNA, 19 nt, Human
aauuuuuauuucuaccuca

SEQ ID NO: 80365 - RNA, 21 nt, Human
gaaaauagggguuaagacuga

SEQ ID NO: 80366 - RNA, 20 nt, Human
aggugugaggcccucauggg

SEQ ID NO: 80367 - RNA, 25 nt, Human
cagaagcccguuuccuucccucauc

SEQ ID NO: 80368 - RNA, 25 nt, Human
guagagugcuguugaaaaaauugca

SEQ ID NO: 80369 - RNA, 19 nt, Human
cucagcagcaggacgacuu

SEQ ID NO: 80370 - RNA, 20 nt, Human
uuucuuaaaaaauauucuua

SEQ ID NO: 80371 - RNA, 23 nt, Human
ggaagugucuaugaacuuccaua

SEQ ID NO: 80372 - RNA, 22 nt, Human
aggcugaggugggagaaucacu

SEQ ID NO: 80373 - RNA, 20 nt, Human
ggcuuaaucagaguguggca

SEQ ID NO: 80374 - RNA, 32 nt, Human
uguguacggagggucuagccuggguguguacg

SEQ ID NO: 80375 - RNA, 27 nt, Human
agagacaccugggcgaacucagacggu

SEQ ID NO: 80376 - RNA, 24 nt, Human
agcccuguaucugucaugggcacc

SEQ ID NO: 80377 - RNA, 23 nt, Human
ggcucagagcugcugagcaggaa

SEQ ID NO: 80378 - RNA, 22 nt, Human
cagauguuuacaaguuuucuuu

SEQ ID NO: 80379 - RNA, 19 nt, Human
agcuguagacgaacuguuu

SEQ ID NO: 80380 - RNA, 22 nt, Human
uugccuugagcuuuucaguuaa

SEQ ID NO: 80381 - RNA, 22 nt, Human
gggaaagggugaggacuucaca

SEQ ID NO: 80382 - RNA, 21 nt, Human
agcccagggggcaggagaagc

SEQ ID NO: 80383 - RNA, 21 nt, Human
aauuuauuugaaaaugcauca

SEQ ID NO: 80384 - RNA, 22 nt, Human
acugcaacgccugccucucagg

SEQ ID NO: 80385 - RNA, 23 nt, Human
aucaaaaucuuccaauuaucaug

SEQ ID NO: 80386 - RNA, 26 nt, Human
ugaacacguaaacaacacagacuuca

SEQ ID NO: 80387 - RNA, 21 nt, Human
ggauuuucaguguuccaggac

SEQ ID NO: 80388 - RNA, 24 nt, Human
gucucaaaggaguaacugcagcuu

SEQ ID NO: 80389 - RNA, 25 nt, Human
aagugcuugauuccuuccuaaauug

SEQ ID NO: 80390 - RNA, 22 nt, Human
uaguuccugguaacauuuccuu

SEQ ID NO: 80391 - RNA, 25 nt, Human
ggagaggcaggugagagggaggugg

SEQ ID NO: 80392 - RNA, 20 nt, Human
ugcuugcuuucuagugccuu

SEQ ID NO: 80393 - RNA, 23 nt, Human
ggagacugaggcccacgcuuggg

SEQ ID NO: 80394 - RNA, 22 nt, Human
cugaggugggagaauugcucga

SEQ ID NO: 80395 - RNA, 25 nt, Human
cucugcucuccugcggccaugggcc

SEQ ID NO: 80396 - RNA, 27 nt, Human
gcaguguccagaaccuuuuugccuuuu

SEQ ID NO: 80397 - RNA, 23 nt, Human
agcuaaaaauuccuuuuuaucaa

SEQ ID NO: 80398 - RNA, 25 nt, Human
agggaaguuuuggcugaaguaggag

SEQ ID NO: 80399 - RNA, 19 nt, Human
aagguggccuguugcagug

SEQ ID NO: 80400 - RNA, 27 nt, Human
ccaacccauggcgcuaccaggcuccuc

SEQ ID NO: 80401 - RNA, 21 nt, Human
uaaccaggggaagcaccaaga

SEQ ID NO: 80402 - RNA, 20 nt, Human
cugccccauuccccaaacag

SEQ ID NO: 80403 - RNA, 19 nt, Human
ccugcgauuuugccugugu

SEQ ID NO: 80404 - RNA, 22 nt, Human
cugucuuugcggggccugucuc

SEQ ID NO: 80405 - RNA, 22 nt, Human
uccaucucauaagaaaaaucag

SEQ ID NO: 80406 - RNA, 20 nt, Human
gugauuauaugugugcucaa

SEQ ID NO: 80407 - RNA, 27 nt, Human
uccuuguauaaggagcuuugcucuugg

SEQ ID NO: 80408 - RNA, 23 nt, Human
gugccgccgcugccugcucccgc

SEQ ID NO: 80409 - RNA, 20 nt, Human
ggagagggcgcgggagcggc

SEQ ID NO: 80410 - RNA, 22 nt, Human
aacauacaucuaagucaguuuc

SEQ ID NO: 80411 - RNA, 19 nt, Human
uuuccaaaggcagagcuua

SEQ ID NO: 80412 - RNA, 23 nt, Human
ccacagaccucagcuguguaucc

SEQ ID NO: 80413 - RNA, 29 nt, Human
ccagcaugauccugaaaucugcauccgcc

SEQ ID NO: 80414 - RNA, 20 nt, Human
gccagcaccacuuugccuua

SEQ ID NO: 80415 - RNA, 22 nt, Human
gcuucuauuuuuuacuuguuuu

SEQ ID NO: 80416 - RNA, 21 nt, Human
gaacccaggaggcggagcugg

SEQ ID NO: 80417 - RNA, 21 nt, Human
ucuaaauggaaccacucuauc

SEQ ID NO: 80418 - RNA, 21 nt, Human
ucugacugcaacuucuguccc

SEQ ID NO: 80419 - RNA, 22 nt, Human
cuggucuucuucaagagagcua

SEQ ID NO: 80420 - RNA, 27 nt, Human
ucuucuuucugugacccuccuuuuuug

SEQ ID NO: 80421 - RNA, 24 nt, Human
caauugcuauaucuucuaauugua

SEQ ID NO: 80422 - RNA, 24 nt, Human
uguacuuccucuggcccuggcuga

SEQ ID NO: 80423 - RNA, 21 nt, Human
ucuugcuuugagucuccggga

SEQ ID NO: 80424 - RNA, 21 nt, Human
auucagucaugaaccuguuuu

SEQ ID NO: 80425 - RNA, 30 nt, Human; identical to SEQ ID NO: 6868

SEQ ID NO: 80426 - RNA, 22 nt, Human
gcuccaggagcccacaggcugg

SEQ ID NO: 80427 - RNA, 22 nt, Human
ccagccugggcaacaagaguga

SEQ ID NO: 80428 - RNA, 20 nt, Human
aggagggagagagaggcagu

SEQ ID NO: 80429 - RNA, 25 nt, Human
gacuaggcuguguauuucuuuucag

SEQ ID NO: 80430 - RNA, 22 nt, Human
accacaaaaguauaaaugaaua

SEQ ID NO: 80431 - RNA, 23 nt, Human
gguaucugaccucagaggcagag

SEQ ID NO: 80432 - RNA, 27 nt, Human
gaggaagaaguaacaagaggaaccugc

SEQ ID NO: 80433 - RNA, 22 nt, Human
uagauuuacagaacaaaguuuu

SEQ ID NO: 80434 - RNA, 24 nt, Human
gggaugggacuguuacaauacuuc

SEQ ID NO: 80435 - RNA, 20 nt, Human
gaacccccuccagacaccca

SEQ ID NO: 80436 - RNA, 27 nt, Human
cccuccugguugauacuuguuccagau

SEQ ID NO: 80437 - RNA, 22 nt, Human
acuguucugacuuucuuuuucc

SEQ ID NO: 80438 - RNA, 26 nt, Human
gcuccuugcagccaugcuccugggca

SEQ ID NO: 80439 - RNA, 21 nt, Human
ugcuucccgggguggggagga

SEQ ID NO: 80440 - RNA, 19 nt, Human
uuauucuuuuccagaaaga

SEQ ID NO: 80441 - RNA, 27 nt, Human
cagcccagaaccacagaugugucuggg

SEQ ID NO: 80442 - RNA, 25 nt, Human
ccaccacccacacccaccgcgcccu

SEQ ID NO: 80443 - RNA, 21 nt, Human
acaagggcacacauccagcac

SEQ ID NO: 80444 - RNA, 23 nt, Human
cuauuucugaacaaagagagcuc

SEQ ID NO: 80445 - RNA, 22 nt, Human
gcauaggaaacaaucuaccuca

SEQ ID NO: 80446 - RNA, 20 nt, Human
agcauuuuccucugcuuuga

SEQ ID NO: 80447 - RNA, 23 nt, Human
gcuuacaaaguggccuuuccagg

SEQ ID NO: 80448 - RNA, 19 nt, Human
uguguuagaagcagcugug

SEQ ID NO: 80449 - RNA, 19 nt, Human
ccuggcccccgccugggcc

SEQ ID NO: 80450 - RNA, 27 nt, Human
ugagccaggcagcagagcacucgcugc

SEQ ID NO: 80451 - RNA, 22 nt, Human
aucuuauuuuuaagcacuuuuu

SEQ ID NO: 80452 - RNA, 20 nt, Human
gucuucuuggcuggaccugu

SEQ ID NO: 80453 - RNA, 21 nt, Human
cugcaaccuccaccuccgggu

SEQ ID NO: 80454 - RNA, 23 nt, Human
aaucauuaacagugcuguaaacu

SEQ ID NO: 80455 - RNA, 32 nt, Human
gcaugugucagccacagcgaaucccaugucuu

SEQ ID NO: 80456 - RNA, 24 nt, Human
aggcuggagugcagugaugcaauc

SEQ ID NO: 80457 - RNA, 22 nt, Human
agagguccacagacauccagga

SEQ ID NO: 80458 - RNA, 22 nt, Human
cggucauguucucugaagugga

SEQ ID NO: 80459 - RNA, 23 nt, Human
gucacuuccuuuucacucaguuu

SEQ ID NO: 80460 - RNA, 23 nt, Human
caggucccuuugaagaacugaca

SEQ ID NO: 80461 - RNA, 26 nt, Human
uccacauucuacuucagcuuuggaug

SEQ ID NO: 80462 - RNA, 21 nt, Human
uuguaccugcuuuggcugcug

SEQ ID NO: 80463 - RNA, 22 nt, Human
ucagaagcaaugggggcagaga

SEQ ID NO: 80464 - RNA, 19 nt, Human
agacguuuccagccacuuu

SEQ ID NO: 80465 - RNA, 25 nt, Human
uggcuccaggcauggccaccugccu

SEQ ID NO: 80466 - RNA, 19 nt, Human
gcucuguuuuccauccccu

SEQ ID NO: 80467 - RNA, 21 nt, Human
ccacuugccagggcucugggg

SEQ ID NO: 80468 - RNA, 22 nt, Human
cuguuacugcugcuacuuccuc

SEQ ID NO: 80469 - RNA, 23 nt, Human
cucuggcuguuugucuauauguc

SEQ ID NO: 80470 - RNA, 29 nt, Human
gguggggaggggccuuugcugcccuuggu

SEQ ID NO: 80471 - RNA, 27 nt, Human
gaacagcuucccucacuguguacagaa

SEQ ID NO: 80472 - RNA, 21 nt, Human
cgaggacaugaaacuccaccu

SEQ ID NO: 80473 - RNA, 21 nt, Human
gacaccucccuuucuccugca

SEQ ID NO: 80474 - RNA, 30 nt, Human
ggcuauuuaaagcaccagucuggggucgcc

SEQ ID NO: 80475 - RNA, 21 nt, Human
uagcggaugauucuucaagag

SEQ ID NO: 80476 - RNA, 26 nt, Human
ggcuuuguuaauccuauuuuacugaa

SEQ ID NO: 80477 - RNA, 28 nt, Human
ucgaggacucuccaaacccccaaagcag

SEQ ID NO: 80478 - RNA, 27 nt, Human
cgcagugcucacccguguccccgcccc

SEQ ID NO: 80479 - RNA, 22 nt, Human
cauuccugccagcucugccucc

SEQ ID NO: 80480 - RNA, 26 nt, Human
agcaccaccagggcuccaggagccuc

SEQ ID NO: 80481 - RNA, 21 nt, Human
cuuccacccuccugucuggcu

SEQ ID NO: 80482 - RNA, 23 nt, Human
aaagcuguaaauguguguacagu

SEQ ID NO: 80483 - RNA, 23 nt, Human
gcgcugugccuuucuacaguaga

SEQ ID NO: 80484 - RNA, 20 nt, Human
ccguuuucacacugcuguua

SEQ ID NO: 80485 - RNA, 22 nt, Human
gggaggucgaggcugcagugag

SEQ ID NO: 80486 - RNA, 20 nt, Human
cucugaugcuuccaucuucc

SEQ ID NO: 80487 - RNA, 22 nt, Human
gcugcugcugcuccuccguauc

SEQ ID NO: 80488 - RNA, 27 nt, Human
ugaagugaaggaugaagagucaucuuc

SEQ ID NO: 80489 - RNA, 23 nt, Human
ggcgguggcaguggagcugcuuc

SEQ ID NO: 80490 - RNA, 22 nt, Human
uaaggaguuuugaagugccuaa

SEQ ID NO: 80491 - RNA, 25 nt, Human
acaaagucuaaaugagcacauguau

SEQ ID NO: 80492 - RNA, 22 nt, Human
cuuggggucccagggaugagga

SEQ ID NO: 80493 - RNA, 27 nt, Human
gugaugcccugugaaauggcuugucuc

SEQ ID NO: 80494 - RNA, 25 nt, Human
aagacggacagcccaucgugugaac

SEQ ID NO: 80495 - RNA, 24 nt, Human
uuucagcaaacucuuuucccacug

SEQ ID NO: 80496 - RNA, 20 nt, Human
cuucccuuuuuaggaagccc

SEQ ID NO: 80497 - RNA, 22 nt, Human
agauguuucaaaaaaucugacc

SEQ ID NO: 80498 - RNA, 26 nt, Human
aaaugaugcaaaaugugcaccuggcu

SEQ ID NO: 80499 - RNA, 23 nt, Human
agaaccucaaaauaauggugaua

SEQ ID NO: 80500 - RNA, 27 nt, Human
ccugccuggaccuuguucccugggggu

SEQ ID NO: 80501 - RNA, 23 nt, Human
cgcugcggcuccggcccgggagc

SEQ ID NO: 80502 - RNA, 27 nt, Human
gggccugagcaggauugagggagccag

SEQ ID NO: 80503 - RNA, 24 nt, Human
cuuagccaaaaugauuaguguucc

SEQ ID NO: 80504 - RNA, 23 nt, Human
uuugccucaugaacacuggcugc

SEQ ID NO: 80505 - RNA, 25 nt, Human
ugccuccugccccuuccuucugcca

SEQ ID NO: 80506 - RNA, 22 nt, Human
guacugaagaacaguacuccac

SEQ ID NO: 80507 - RNA, 22 nt, Human
acgcaucucaaaacagagggcu

SEQ ID NO: 80508 - RNA, 20 nt, Human
ccuaccacguaaccaaaaau

SEQ ID NO: 80509 - RNA, 24 nt, Human
uagcaagauguuggcuuuucugga

SEQ ID NO: 80510 - RNA, 22 nt, Human
uucucagucuucagccagaggg

SEQ ID NO: 80511 - RNA, 22 nt, Human
uguucucuguauuuaugcagcu

SEQ ID NO: 80512 - RNA, 29 nt, Human
ggagucagggagagcugaacuauuagagc

SEQ ID NO: 80513 - RNA, 23 nt, Human
cuuucacaaccuucuguggcuca

SEQ ID NO: 80514 - RNA, 21 nt, Human
ccaucugaacuagacaaugga

SEQ ID NO: 80515 - RNA, 22 nt, Human
gcauguguauauguucgugugu

SEQ ID NO: 80516 - RNA, 22 nt, Human
aauauuuauagaguucauagaa

SEQ ID NO: 80517 - RNA, 19 nt, Human
aauacagcugcuaaaauga

SEQ ID NO: 80518 - RNA, 20 nt, Human
acuguaacuuaagugcuggg

SEQ ID NO: 80519 - RNA, 20 nt, Human
augcccugccuugcugccuu

SEQ ID NO: 80520 - RNA, 23 nt, Human
cacacuuggugcucccagcaucc

SEQ ID NO: 80521 - RNA, 23 nt, Human
gcauuuaagaauugaacuagggg

SEQ ID NO: 80522 - RNA, 22 nt, Human
uucugauggagaugaagccauc

SEQ ID NO: 80523 - RNA, 22 nt, Human
aucauggcuaucauuagccaca

SEQ ID NO: 80524 - RNA, 25 nt, Human
ggggcagcagggugugugcauauga

SEQ ID NO: 80525 - RNA, 21 nt, Human
cugucacuggucucagacaca

SEQ ID NO: 80526 - RNA, 22 nt, Human
aauaguuuugugccauugaaaa

SEQ ID NO: 80527 - RNA, 23 nt, Human
ugucuguugccaaacagccugcc

SEQ ID NO: 80528 - RNA, 21 nt, Human
cgccccccgccaggcccagcc

SEQ ID NO: 80529 - RNA, 25 nt, Human
uucccuagaggccaaauucuuuuua

SEQ ID NO: 80530 - RNA, 22 nt, Human
gcgggcggaucaccugagguca

SEQ ID NO: 80531 - RNA, 22 nt, Human
gcggguggaucacuugagguca

SEQ ID NO: 80532 - RNA, 22 nt, Human
uaguuaagagccuucaaaagca

SEQ ID NO: 80533 - RNA, 20 nt, Human
gcucugcccacuccaucacc

SEQ ID NO: 80534 - RNA, 21 nt, Human
augaguaagccaucacacaga

SEQ ID NO: 80535 - RNA, 21 nt, Human
aucgacaccaucacgggcaug

SEQ ID NO: 80536 - RNA, 26 nt, Human
ggcuggagagucucuguugacauagu

SEQ ID NO: 80537 - RNA, 23 nt, Human
gagacaguccagugucaccucuc

SEQ ID NO: 80538 - RNA, 22 nt, Human
acugcaaccuccgcauccgggg

SEQ ID NO: 80539 - RNA, 23 nt, Human
ggagcugugcugggcacugaggg

SEQ ID NO: 80540 - RNA, 22 nt, Human
gagcgagacuccaucucaaaca

SEQ ID NO: 80541 - RNA, 23 nt, Human
acugaaugggaauucucuuaaga

SEQ ID NO: 80542 - RNA, 22 nt, Human
gccugcaaucccagcacuuugg

SEQ ID NO: 80543 - RNA, 22 nt, Human
gcacucuggaaaacaaucuacu

SEQ ID NO: 80544 - RNA, 23 nt, Human
ugagaaaugaagucagugcaagg

SEQ ID NO: 80545 - RNA, 21 nt, Human
ucugcucccucuuccucuagc

SEQ ID NO: 80546 - RNA, 26 nt, Human
uccuggagcccagaggagggcagcag

SEQ ID NO: 80547 - RNA, 21 nt, Human
augacagaacacagaucucuu

SEQ ID NO: 80548 - RNA, 21 nt, Human
ccuguguccuuggacagcaga

SEQ ID NO: 80549 - RNA, 19 nt, Human
cucaaggaaauacaaccua

SEQ ID NO: 80550 - RNA, 22 nt, Human
uaaacuuuuuaaaaaagaaaua

SEQ ID NO: 80551 - RNA, 26 nt, Human
ucuccaccgucacccaacaucaaucc

SEQ ID NO: 80552 - RNA, 24 nt, Human
aaaaacacacugcuucacuuuguu

SEQ ID NO: 80553 - RNA, 25 nt, Human
uacugcacucugcuguuagaagcag

SEQ ID NO: 80554 - RNA, 18 nt, Human
gcuuugagaaaggaguag

SEQ ID NO: 80555 - RNA, 21 nt, Human
caaccgggcuggagugcagug

SEQ ID NO: 80556 - RNA, 19 nt, Human
auccugucuucucagcauc

SEQ ID NO: 80557 - RNA, 21 nt, Human
acgggacccugaaacuccacu

SEQ ID NO: 80558 - RNA, 27 nt, Human
cugauauuuuaaaugguugacaucauc

SEQ ID NO: 80559 - RNA, 25 nt, Human
aaggguugagagccaguggcgggug

SEQ ID NO: 80560 - RNA, 19 nt, Human
ucucucagugcaucuugcu

SEQ ID NO: 80561 - RNA, 26 nt, Human
aaaacaauggaacaaggguggguuug

SEQ ID NO: 80562 - RNA, 27 nt, Human
uucuggugggugacccagugcauccaa

SEQ ID NO: 80563 - RNA, 23 nt, Human
uuacaacuagauauuaguuuuag

SEQ ID NO: 80564 - RNA, 26 nt, Human
acaguaagugacugggugacacuguu

SEQ ID NO: 80565 - RNA, 27 nt, Human
uccuaucucaaaacccauggagggagg

SEQ ID NO: 80566 - RNA, 26 nt, Human
cucacugcugccucaacuuccugggc

SEQ ID NO: 80567 - RNA, 21 nt, Human
caguguaaguuucugucagca

SEQ ID NO: 80568 - RNA, 26 nt, Human
ggugccaucauugcugucugcagccu

SEQ ID NO: 80569 - RNA, 23 nt, Human
gcucuagaucccccuccccugcc

SEQ ID NO: 80570 - RNA, 22 nt, Human
ccgauucugauuccuguggacc

SEQ ID NO: 80571 - RNA, 23 nt, Human
gcaugggcugggccugggcacag

SEQ ID NO: 80572 - RNA, 21 nt, Human
gguguuucugagcaccagcac

SEQ ID NO: 80573 - RNA, 22 nt, Human
gcuuacaccuguaaucccaaca

SEQ ID NO: 80574 - RNA, 20 nt, Human
guuuguaaagcguuccaagu

SEQ ID NO: 80575 - RNA, 20 nt, Human
uuuguugccaggcuccaacu

SEQ ID NO: 80576 - RNA, 27 nt, Human
gccagccucagcucagccucccccugc

SEQ ID NO: 80577 - RNA, 21 nt, Human
cgcuccuuggccgucuacugg

SEQ ID NO: 80578 - RNA, 16 nt, Human
cuucccuuccuaaagg

SEQ ID NO: 80579 - RNA, 22 nt, Human
cuugcguuagaguguacucuga

SEQ ID NO: 80580 - RNA, 24 nt, Human
cuuguuucauaaucaucuaacuau

SEQ ID NO: 80581 - RNA, 21 nt, Human
aauggcugagaacuugcugga

SEQ ID NO: 80582 - RNA, 25 nt, Human
gcuuucuccuuugagggcagugggg

SEQ ID NO: 80583 - RNA, 23 nt, Human
cagugguuuguagcguggugcac

SEQ ID NO: 80584 - RNA, 19 nt, Human
acccucuccuucuguuuuu

SEQ ID NO: 80585 - RNA, 31 nt, Human
acuacccugccccaaaccucuaccccuaacu

SEQ ID NO: 80586 - RNA, 23 nt, Human
ggccuuucaccucuuccuugauu

SEQ ID NO: 80587 - RNA, 21 nt, Human
aguguuuggacaaaaacuaca

SEQ ID NO: 80588 - RNA, 26 nt, Human
gagguuguacaggugaaugagccggg

SEQ ID NO: 80589 - RNA, 21 nt, Human
gcuggucucaacuccugggcu

SEQ ID NO: 80590 - RNA, 22 nt, Human
aaacaaaaucaccgaccuugca

SEQ ID NO: 80591 - RNA, 28 nt, Human
ugcuuccaggcugggcagcacaaggccu

SEQ ID NO: 80592 - RNA, 20 nt, Human
cccaggcugaaccugccacu

SEQ ID NO: 80593 - RNA, 21 nt, Human
cucugacauaaagacauggca

SEQ ID NO: 80594 - RNA, 22 nt, Human
accacccaggcuugaggcagcg

SEQ ID NO: 80595 - RNA, 25 nt, Human
uggauaggggaugagguugcuguga

SEQ ID NO: 80596 - RNA, 26 nt, Human
gcgcuggaggagacucaggaagcaga

SEQ ID NO: 80597 - RNA, 20 nt, Human
uggcagucuggaauaaagcc

SEQ ID NO: 80598 - RNA, 23 nt, Human
acaagugccuucacacagacccc

SEQ ID NO: 80599 - RNA, 25 nt, Human
gcaaaaacauucacucuugaguuug

SEQ ID NO: 80600 - RNA, 19 nt, Human
acagguccacguuguguca

SEQ ID NO: 80601 - RNA, 24 nt, Human
ccgacguccccaaaccuagcuagg

SEQ ID NO: 80602 - RNA, 27 nt, Human
aguagcagcuguaucgggcuuccucau

SEQ ID NO: 80603 - RNA, 27 nt, Human
gucacccagacagcucuguggaggcag

SEQ ID NO: 80604 - RNA, 28 nt, Human
uugcaacaggcugggcuucaguggcagc

SEQ ID NO: 80605 - RNA, 26 nt, Human
ccucauucuucuccgguagccucucc

SEQ ID NO: 80606 - RNA, 20 nt, Human
cacugcacccaucccggcug

SEQ ID NO: 80607 - RNA, 28 nt, Human
guccugcccugugaauuacugcuacaau

SEQ ID NO: 80608 - RNA, 22 nt, Human
cccaggcgguugaggcugcagu

SEQ ID NO: 80609 - RNA, 24 nt, Human
cccagcugggucuaauccuucuca

SEQ ID NO: 80610 - RNA, 27 nt, Human
aaauguucuugcaguuaaggguuaguu

SEQ ID NO: 80611 - RNA, 29 nt, Human
ggucaggaaucugcauuuuaacuagucgc

SEQ ID NO: 80612 - RNA, 27 nt, Human
gcuuuugcccaucuaaagcacaauuaa

SEQ ID NO: 80613 - RNA, 25 nt, Human
uugucuccccggcuggagugcagug

SEQ ID NO: 80614 - RNA, 24 nt, Human
gcuggagaauaaauuugggaugcu

SEQ ID NO: 80615 - RNA, 22 nt, Human
agaacuucaggcucucagugac

SEQ ID NO: 80616 - RNA, 24 nt, Human
ucucucuuccuugcuuucucuucu

SEQ ID NO: 80617 - RNA, 26 nt, Human
guuguagcuuuggagugcagagugua

SEQ ID NO: 80618 - RNA, 29 nt, Human
cagcacagaugccauuagaaugugaauug

SEQ ID NO: 80619 - RNA, 22 nt, Human
gucccccacucucucacccacc

SEQ ID NO: 80620 - RNA, 22 nt, Human
guagggaggaaggggaccaagc

SEQ ID NO: 80621 - RNA, 22 nt, Human
ugcaaccuccacccccggggau

SEQ ID NO: 80622 - RNA, 19 nt, Human
gggaggcaggcuggggaga

SEQ ID NO: 80623 - RNA, 15 nt, Human
gcugccagccugugu

SEQ ID NO: 80624 - RNA, 29 nt, Human
gaaucaggagccuggacacugccaucucu

SEQ ID NO: 80625 - RNA, 22 nt, Human
gggaacugagcuaggcggugag

SEQ ID NO: 80626 - RNA, 24 nt, Human
gccagcacccaguccucugccucc

SEQ ID NO: 80627 - RNA, 24 nt, Human
ggucugccccucagucaggccccc

SEQ ID NO: 80628 - RNA, 27 nt, Human
aaccaguggaaaaaauguugacuuuaa

SEQ ID NO: 80629 - RNA, 24 nt, Human
agugacuuagcagaugcuggucau

SEQ ID NO: 80630 - RNA, 26 nt, Human
caggcggcagaggugcuggaccacau

SEQ ID NO: 80631 - RNA, 25 nt, Human
ucaugguuugcauuuaaacauguuu

SEQ ID NO: 80632 - RNA, 26 nt, Human
guauaugauguaggcuaaaagugaaa

SEQ ID NO: 80633 - RNA, 26 nt, Human
ccagcaaccaugcaacaaggacuuca

SEQ ID NO: 80634 - RNA, 25 nt, Human
ccgaugccaccacagccaucgccac

SEQ ID NO: 80635 - RNA, 25 nt, Human
cugccccccauggcucugugcugcu

SEQ ID NO: 80636 - RNA, 26 nt, Human
ugaaguccagggaaaggcaucugguc

SEQ ID NO: 80637 - RNA, 23 nt, Human
cugccugccugucugucucucca

SEQ ID NO: 80638 - RNA, 22 nt, Human
auguguuagugaaaaugugugc

SEQ ID NO: 80639 - RNA, 27 nt, Human
uucuccuccucccccauuuugauguua

SEQ ID NO: 80640 - RNA, 22 nt, Human
uagccuguacuggucagccugc

SEQ ID NO: 80641 - RNA, 25 nt, Human
uaccucuccccgcugaaaccagcag

SEQ ID NO: 80642 - RNA, 21 nt, Human
ggccaucaucuccccaccucu

SEQ ID NO: 80643 - RNA, 22 nt, Human
uuaauccuucuuuccuggauau

SEQ ID NO: 80644 - RNA, 22 nt, Human
uagggacugcgacugggaccag

SEQ ID NO: 80645 - RNA, 27 nt, Human
gccucaagacugcuggagucaggacau

SEQ ID NO: 80646 - RNA, 21 nt, Human
aauauuuuggcguucuuuuug

SEQ ID NO: 80647 - RNA, 21 nt, Human
cagcucagcagacaacaugcu

SEQ ID NO: 80648 - RNA, 19 nt, Human
ucagccuuuucagcagguu

SEQ ID NO: 80649 - RNA, 24 nt, Human
accagaaaacugguaagugugacc

SEQ ID NO: 80650 - RNA, 22 nt, Human
cuuguuccugugcccucuuguu

SEQ ID NO: 80651 - RNA, 22 nt, Human
ugcccaacagcaucacggcacu

SEQ ID NO: 80652 - RNA, 21 nt, Human
gugguggcugggcucacagcu

SEQ ID NO: 80653 - RNA, 26 nt, Human
cccguagcucuucacagcugaacuca

SEQ ID NO: 80654 - RNA, 22 nt, Human
aaaguguucggauuacaaacgu

SEQ ID NO: 80655 - RNA, 23 nt, Human
gcugaaaaguugcacuuuuguua

SEQ ID NO: 80656 - RNA, 22 nt, Human
cuccaaaucaaagcucuuucug

SEQ ID NO: 80657 - RNA, 21 nt, Human
gccuugugugaaaaugccuuc

SEQ ID NO: 80658 - RNA, 20 nt, Human
cuccuucucacuugccaaag

SEQ ID NO: 80659 - RNA, 27 nt, Human
ugucccggaggaaggcuggguggugga

SEQ ID NO: 80660 - RNA, 24 nt, Human
gugggagaaucagagagagcugua

SEQ ID NO: 80661 - RNA, 27 nt, Human
gcacuagcauggccucugacgugacca

SEQ ID NO: 80662 - RNA, 22 nt, Human
cacugcacuccagccuggggcu

SEQ ID NO: 80663 - RNA, 23 nt, Human
gugccucaccaccugcugagcuc

SEQ ID NO: 80664 - RNA, 22 nt, Human
cuagccugggcaacauggugag

SEQ ID NO: 80665 - RNA, 23 nt, Human
uaccgcccaggcuggagugcagu

SEQ ID NO: 80666 - RNA, 19 nt, Human
ggccaagugugguggugca

SEQ ID NO: 80667 - RNA, 27 nt, Human
accucaagaucuuggcaaugguacacu

SEQ ID NO: 80668 - RNA, 22 nt, Human
ugaaacacuggcagucguugga

SEQ ID NO: 80669 - RNA, 25 nt, Human
gaaaucugaguuguacugguuagau

SEQ ID NO: 80670 - RNA, 23 nt, Human
uccuuucucucauccucuuuaca

SEQ ID NO: 80671 - RNA, 25 nt, Human
ugguuucagcacuagccaaaccuca

SEQ ID NO: 80672 - RNA, 21 nt, Human
ggcaggguggacagugugaga

SEQ ID NO: 80673 - RNA, 23 nt, Human
accccagguccugcagucuggcu

SEQ ID NO: 80674 - RNA, 16 nt, Human
uccugucccaaguuuu

SEQ ID NO: 80675 - RNA, 22 nt, Human
uuauuuggccaaaauguuauau

SEQ ID NO: 80676 - RNA, 26 nt, Human
aaauuucauuucagccacuucugcag

SEQ ID NO: 80677 - RNA, 24 nt, Human
gcgagugcccggagcauccuggcc

SEQ ID NO: 80678 - RNA, 18 nt, Human
ucauucuaggaugauaca

SEQ ID NO: 80679 - RNA, 24 nt, Human
cuguacauacccuccuuuccuucu

SEQ ID NO: 80680 - RNA, 18 nt, Human
cuucccuuccugaaguga

SEQ ID NO: 80681 - RNA, 20 nt, Human
agccaaaguggauuucucca

SEQ ID NO: 80682 - RNA, 26 nt, Human
cuccuuuugcuccuggacccuuuagc

SEQ ID NO: 80683 - RNA, 26 nt, Human
gagcagcuaucugauuggaaaccugc

SEQ ID NO: 80684 - RNA, 21 nt, Human
ugaaucuucccugucaggcuc

SEQ ID NO: 80685 - RNA, 22 nt, Human
ggggauggagaggggguacaau

SEQ ID NO: 80686 - RNA, 21 nt, Human
cgucuguggagccauccuccu

SEQ ID NO: 80687 - RNA, 17 nt, Human
agcucuauucuuugccu

SEQ ID NO: 80688 - RNA, 22 nt, Human
uguuuuggacuccaucucucau

SEQ ID NO: 80689 - RNA, 20 nt, Human
caccccauaccagucaccuc

SEQ ID NO: 80690 - RNA, 20 nt, Human
cccaggccugcugugguucu

SEQ ID NO: 80691 - RNA, 22 nt, Human
auggucauaguuacugugagcc

SEQ ID NO: 80692 - RNA, 21 nt, Human
gagaggaggauggaagggagg

SEQ ID NO: 80693 - RNA, 24 nt, Human
aaccacauucagggaaauggcuua

SEQ ID NO: 80694 - RNA, 27 nt, Human
uucucugccuuuauuuuuugauuugug

SEQ ID NO: 80695 - RNA, 20 nt, Human
auguuuccguaaaagcugga

SEQ ID NO: 80696 - RNA, 22 nt, Human
acuccauuccggaaccuccugg

SEQ ID NO: 80697 - RNA, 27 nt, Human
ugccuguaaucgcagcuacucaggagg

SEQ ID NO: 80698 - RNA, 22 nt, Human
ccugccuggcugagguggcagc

SEQ ID NO: 80699 - RNA, 19 nt, Human
auugcuguccucucuuguc

SEQ ID NO: 80700 - RNA, 21 nt, Human
caggaaguccagccacuugac

SEQ ID NO: 80701 - RNA, 21 nt, Human
gaaggggacuucgggagccag

SEQ ID NO: 80702 - RNA, 24 nt, Human
aggagagaaugggggaggaggcgg

SEQ ID NO: 80703 - RNA, 21 nt, Human
uuuucuuucuguuucuaagac

SEQ ID NO: 80704 - RNA, 27 nt, Human
gguggccuuucugggggugggugcugg

SEQ ID NO: 80705 - RNA, 23 nt, Human
aaugugcucaccucggcagcaca

SEQ ID NO: 80706 - RNA, 26 nt, Human
cuuaagagaugggauuacaaguggac

SEQ ID NO: 80707 - RNA, 22 nt, Human
ggccuuggucuaggucucucca

SEQ ID NO: 80708 - RNA, 16 nt, Human
cacacuugcaguguua

SEQ ID NO: 80709 - RNA, 21 nt, Human
agcuuugaaaaaguuugucuu

SEQ ID NO: 80710 - RNA, 22 nt, Human
aaccugacaggaacaugcuacu

SEQ ID NO: 80711 - RNA, 21 nt, Human
gcaguagccuccuccugggcu

SEQ ID NO: 80712 - RNA, 21 nt, Human
ugagccaagaucauaccacgg

SEQ ID NO: 80713 - RNA, 26 nt, Human
uggaccuagccuggaauuuagauguc

SEQ ID NO: 80714 - RNA, 23 nt, Human
auagcuuuaaugauaugcuugua

SEQ ID NO: 80715 - RNA, 23 nt, Human
gacacccuguguguaagcagaac

SEQ ID NO: 80716 - RNA, 23 nt, Human
acuccuccccuaguuuacacauc

SEQ ID NO: 80717 - RNA, 21 nt, Human
gaccaaaaacuguaauauccu

SEQ ID NO: 80718 - RNA, 22 nt, Human
aaaacggucucgacaaugagua

SEQ ID NO: 80719 - RNA, 22 nt, Human
auacuauucaacccauagcaca

SEQ ID NO: 80720 - RNA, 26 nt, Human
ugcacuugcuuaguggauuguauugg

SEQ ID NO: 80721 - RNA, 21 nt, Human
gugggcuucagccaaagugag

SEQ ID NO: 80722 - RNA, 26 nt, Human
uccuggacuguggccacccgcccaca

SEQ ID NO: 80723 - RNA, 20 nt, Human
ucgaaacugccaagggugcu

SEQ ID NO: 80724 - RNA, 22 nt, Human
aggcuucugaguagcuaggacu

SEQ ID NO: 80725 - RNA, 21 nt, Human
gacuuaagugggacuuuguga

SEQ ID NO: 80726 - RNA, 21 nt, Human
agauggagagaccucuaggga

SEQ ID NO: 80727 - RNA, 21 nt, Human
uuucuagguggcaggacaaau

SEQ ID NO: 80728 - RNA, 20 nt, Human
aaaaggaggauauauuugca

SEQ ID NO: 80729 - RNA, 25 nt, Human
cuuucagucuuccacacacaaaaaa

SEQ ID NO: 80730 - RNA, 17 nt, Human
aggguuugucagaggaa

SEQ ID NO: 80731 - RNA, 24 nt, Human
uguuagacucaugguguguuacac

SEQ ID NO: 80732 - RNA, 26 nt, Human
agaagcuuucuuccaaacuccugggc

SEQ ID NO: 80733 - RNA, 23 nt, Human
gacacccaggcuggagugcagug

SEQ ID NO: 80734 - RNA, 21 nt, Human
ggcucacugcaacauccgccu

SEQ ID NO: 80735 - RNA, 21 nt, Human
ggcucccugcaaccuccgccu

SEQ ID NO: 80736 - RNA, 20 nt, Human
uguugacgucugacgucuga

SEQ ID NO: 80737 - RNA, 21 nt, Human
cacccgagcuggagugcagug

SEQ ID NO: 80738 - RNA, 22 nt, Human
cccccagccuacauuucucagc

SEQ ID NO: 80739 - RNA, 29 nt, Human
uucucaccucgauggugcauaacaggaug

SEQ ID NO: 80740 - RNA, 26 nt, Human
ccugcagcaguucugggcccuaugcc

SEQ ID NO: 80741 - RNA, 23 nt, Human
ugaagaagaccuguuggacugga

SEQ ID NO: 80742 - RNA, 20 nt, Human
ucccuuaaauaacacuuaga

SEQ ID NO: 80743 - RNA, 21 nt, Human
cagcucccagccucuucccau

SEQ ID NO: 80744 - RNA, 20 nt, Human
gucacucagagugaagcggg

SEQ ID NO: 80745 - RNA, 27 nt, Human
cuugccuggcccuccucccccuccgcc

SEQ ID NO: 80746 - RNA, 20 nt, Human
uccucaaggguaacaucuua

SEQ ID NO: 80747 - RNA, 20 nt, Human
cauggcagaaggaggggaaa

SEQ ID NO: 80748 - RNA, 21 nt, Human
gaaagaagaaccagagcuuca

SEQ ID NO: 80749 - RNA, 24 nt, Human
caguuuucaacuuccucuuccuca

SEQ ID NO: 80750 - RNA, 31 nt, Human
ccaagcguuacacuggaaacuacuuuuuaaa

SEQ ID NO: 80751 - RNA, 24 nt, Human
uaaacuaagcauuuaauagaaaug

SEQ ID NO: 80752 - RNA, 23 nt, Human
cagggaagacaccagcguuuggg

SEQ ID NO: 80753 - RNA, 23 nt, Human
cugcucuguuauuucuucaucug

SEQ ID NO: 80754 - RNA, 26 nt, Human
caagaaaauacucuugagugaaaugc

SEQ ID NO: 80755 - RNA, 22 nt, Human
ucgcagcccagaggcgcccaga

SEQ ID NO: 80756 - RNA, 23 nt, Human
cccucauuccuucccagagaugu

SEQ ID NO: 80757 - RNA, 21 nt, Human
cggcacugcaccgaggcgggg

SEQ ID NO: 80758 - RNA, 17 nt, Human
cuucccuugccugguau

SEQ ID NO: 80759 - RNA, 24 nt, Human
acuaaaaucagagccauccagaca

SEQ ID NO: 80760 - RNA, 22 nt, Human
ucccaucucagggcagaggcca

SEQ ID NO: 80761 - RNA, 22 nt, Human
acugccuuuccuucuaaaggga

SEQ ID NO: 80762 - RNA, 25 nt, Human
ugcaacauacaggugccuuggggaa

SEQ ID NO: 80763 - RNA, 25 nt, Human
gggucccgaaacuccuggcuguuuc

SEQ ID NO: 80764 - RNA, 19 nt, Human
augagacaaauaccuacuu

SEQ ID NO: 80765 - RNA, 21 nt, Human
uagccagucugcuguccugaa

SEQ ID NO: 80766 - RNA, 24 nt, Human
cugaacuuucagggcagucagggg

SEQ ID NO: 80767 - RNA, 24 nt, Human
cuuaugcccacgcuggagugcagu

SEQ ID NO: 80768 - RNA, 21 nt, Human
uucauaauauguucaccagga

SEQ ID NO: 80769 - RNA, 23 nt, Human
gcacuacacggcugugacgaggu

SEQ ID NO: 80770 - RNA, 19 nt, Human
cuggagccuuucucaucau

SEQ ID NO: 80771 - RNA, 22 nt, Human
aaauguaagauuuuuacacuuu

SEQ ID NO: 80772 - RNA, 20 nt, Human
gcccucccuuuaccuucaua

SEQ ID NO: 80773 - RNA, 26 nt, Human
aagcugacagaagaguuugggccuca

SEQ ID NO: 80774 - RNA, 18 nt, Human
acuaguaauaauguaaua

SEQ ID NO: 80775 - RNA, 22 nt, Human
uaacaaaucagaucagauguuc

SEQ ID NO: 80776 - RNA, 21 nt, Human
uauguauguauguguguuucu

SEQ ID NO: 80777 - RNA, 27 nt, Human
agcaucaauacuccuagggcucaggac

SEQ ID NO: 80778 - RNA, 22 nt, Human
gcuggaaaagggucuugggaaa

SEQ ID NO: 80779 - RNA, 22 nt, Human
cagagggagugacagaggcagc

SEQ ID NO: 80780 - RNA, 24 nt, Human
aguuuaagucucugacucuugccu

SEQ ID NO: 80781 - RNA, 19 nt, Human
uugucaucugccaacuguc

SEQ ID NO: 80782 - RNA, 24 nt, Human
uugcaauuuaugguugugugccca

SEQ ID NO: 80783 - RNA, 20 nt, Human
ggagacggugguugcaguga

SEQ ID NO: 80784 - RNA, 23 nt, Human
cccaaauugcugggauuuacagg

SEQ ID NO: 80785 - RNA, 23 nt, Human
agaaaacaaaacgaacucugguu

SEQ ID NO: 80786 - RNA, 20 nt, Human
uaaaaucaaauuuugcuuaa

SEQ ID NO: 80787 - RNA, 22 nt, Human
cugucaguuuucauuucuagcu

SEQ ID NO: 80788 - RNA, 23 nt, Human
aaucagcacugaaaauaccauca

SEQ ID NO: 80789 - RNA, 21 nt, Human
caggcugggcacgguggcuca

SEQ ID NO: 80790 - RNA, 21 nt, Human
caccagggugggggugaagga

SEQ ID NO: 80791 - RNA, 16 nt, Human
gcggguggugagggaa

SEQ ID NO: 80792 - RNA, 26 nt, Human
cccugcaagccagccuggccagcugc

SEQ ID NO: 80793 - RNA, 26 nt, Human
gaauuaaagccuacucgcuuccuuuc

SEQ ID NO: 80794 - RNA, 20 nt, Human
cccaggaggcugaagcagga

SEQ ID NO: 80795 - RNA, 18 nt, Human
aaacaaugccauuucuug

SEQ ID NO: 80796 - RNA, 20 nt, Human
aguaucuuuaaaagugccuu

SEQ ID NO: 80797 - RNA, 29 nt, Human
ccggaggaagaaagaggaggggcuggcug

SEQ ID NO: 80798 - RNA, 24 nt, Human
uagguuuuuuauagcuauuaaaaa

SEQ ID NO: 80799 - RNA, 27 nt, Human
ccugagagugagguggaauuauuuuaa

SEQ ID NO: 80800 - RNA, 18 nt, Human
ugguucugccuccuggcc

SEQ ID NO: 80801 - RNA, 21 nt, Human
cuucuaugaucauuacuccaa

SEQ ID NO: 80802 - RNA, 22 nt, Human
accagcccagccaacauggcga

SEQ ID NO: 80803 - RNA, 23 nt, Human
agggaggaaguccugggacccag

SEQ ID NO: 80804 - RNA, 22 nt, Human
cuccugccucagccuccugggu

SEQ ID NO: 80805 - RNA, 18 nt, Human
aguggcaaccugcuucca

SEQ ID NO: 80806 - RNA, 22 nt, Human
gcuucuggaccccuccucugcc

SEQ ID NO: 80807 - RNA, 22 nt, Human
cuggguggggacagugauaggc

SEQ ID NO: 80808 - RNA, 22 nt, Human
acuuaauuggaacaagaaagcu

SEQ ID NO: 80809 - RNA, 21 nt, Human
ccccaaaaugaauaaagccuu

SEQ ID NO: 80810 - RNA, 24 nt, Human
guuaccugguauuuccacucucac

SEQ ID NO: 80811 - RNA, 20 nt, Human
acaguuucugccugugauca

SEQ ID NO: 80812 - RNA, 24 nt, Human
uuagggggaaaaucagucauaucu

SEQ ID NO: 80813 - RNA, 27 nt, Human
cacugccuggaggcucuguauuugcuc

SEQ ID NO: 80814 - RNA, 20 nt, Human
uacaagugugugauguuaga

SEQ ID NO: 80815 - RNA, 24 nt, Human
uaguggcacuggcuucguccuccc

SEQ ID NO: 80816 - RNA, 19 nt, Human
ccugccgcaggaacgcuag

SEQ ID NO: 80817 - RNA, 22 nt, Human
gcccucuguugaaauugucacc

SEQ ID NO: 80818 - RNA, 23 nt, Human
gggccuggaguggagguucagga

SEQ ID NO: 80819 - RNA, 22 nt, Human
cuugcugcugcugaauccuuuc

SEQ ID NO: 80820 - RNA, 22 nt, Human
auuuucugccagaggggugggu

SEQ ID NO: 80821 - RNA, 22 nt, Human
agagggguggaggcugccccau

SEQ ID NO: 80822 - RNA, 27 nt, Human
uucuacccuagucaucuucacucgugu

SEQ ID NO: 80823 - RNA, 22 nt, Human
gugugguggagccagggccucu

SEQ ID NO: 80824 - RNA, 27 nt, Human
caggcuggagugcggugguggaaucau

SEQ ID NO: 80825 - RNA, 22 nt, Human
ugguacacaccuguggucccag

SEQ ID NO: 80826 - RNA, 21 nt, Human
gcaguuggacugaauucuucc

SEQ ID NO: 80827 - RNA, 27 nt, Human
cgcggcucccccuccggcuccuccucc

SEQ ID NO: 80828 - RNA, 26 nt, Human
gcauuuucauagugugcucauuucua

SEQ ID NO: 80829 - RNA, 27 nt, Human
gauucuggaaugaaaauucaccugccu

SEQ ID NO: 80830 - RNA, 18 nt, Human
ugggaagcuuugcugaaa

SEQ ID NO: 80831 - RNA, 21 nt, Human
ccuggggggacacugcagucu

SEQ ID NO: 80832 - RNA, 17 nt, Human
uguauaaaaaugccuua

SEQ ID NO: 80833 - RNA, 27 nt, Human
auaaagugaagauggugcuguuauugu

SEQ ID NO: 80834 - RNA, 22 nt, Human
ucccacuggucugcugggagaa

SEQ ID NO: 80835 - RNA, 24 nt, Human
ccaggugaugucuggucaacuggc

SEQ ID NO: 80836 - RNA, 28 nt, Human
cucggcuucuccagcuguaaaauggaca

SEQ ID NO: 80837 - RNA, 25 nt, Human
uucucuauuuguguuucauuucugu

SEQ ID NO: 80838 - RNA, 21 nt, Human
gcuguaucucccuucacuguc

SEQ ID NO: 80839 - RNA, 27 nt, Human
ugggagguggugcuggugcucucucca

SEQ ID NO: 80840 - RNA, 26 nt, Human
cgcuuugaauaugaaaucauagguga

SEQ ID NO: 80841 - RNA, 22 nt, Human
cgccccccggguucaagcgaug

SEQ ID NO: 80842 - RNA, 19 nt, Human
uggugguuaggaaugugau

SEQ ID NO: 80843 - RNA, 22 nt, Human
acucacugcaagcuccgccucc

SEQ ID NO: 80844 - RNA, 17 nt, Human
uggcugcuggaaacccc

SEQ ID NO: 80845 - RNA, 27 nt, Human
uguugcucugggcaacgcggucugcug

SEQ ID NO: 80846 - RNA, 25 nt, Human
ugcugauuguugccaucacguuccu

SEQ ID NO: 80847 - RNA, 24 nt, Human
ccaagagguccaaggcugcaguga

SEQ ID NO: 80848 - RNA, 27 nt, Human
uggggccaggcucacaccuguaauccu

SEQ ID NO: 80849 - RNA, 30 nt, Human
gcuuuucucccaccccuccuagcaccccca

SEQ ID NO: 80850 - RNA, 22 nt, Human
cccaaugccauacauaugguag

SEQ ID NO: 80851 - RNA, 20 nt, Human
ggagggugggugaugcugaa

SEQ ID NO: 80852 - RNA, 17 nt, Human
auuuggagaaauaaaaa

SEQ ID NO: 80853 - RNA, 21 nt, Human
cacagagcagcuugggcacag

SEQ ID NO: 80854 - RNA, 22 nt, Human
cacugcuggugaacuguggcac

SEQ ID NO: 80855 - RNA, 23 nt, Human
uuucagccaggcuggagcaaggu

SEQ ID NO: 80856 - RNA, 21 nt, Human
aauaaaucuagcaccccugau

SEQ ID NO: 80857 - RNA, 23 nt, Human
cgaguagcugggauuacaggcuc

SEQ ID NO: 80858 - RNA, 23 nt, Human
ucauccucuucgccaugugggcu

SEQ ID NO: 80859 - RNA, 27 nt, Human
gguagcagugggauuugugcuucuuau

SEQ ID NO: 80860 - RNA, 19 nt, Human
gcuguugccaaguuugauu

SEQ ID NO: 80861 - RNA, 27 nt, Human
gcuuuugucuucgucacugcggcgggg

SEQ ID NO: 80862 - RNA, 26 nt, Human
cuuagcaauuauuaauuuuucuuuua

SEQ ID NO: 80863 - RNA, 23 nt, Human
gaaucacuguggacugagaccca

SEQ ID NO: 80864 - RNA, 20 nt, Human
ccgcccaggcugggugcagu

SEQ ID NO: 80865 - RNA, 24 nt, Human
uguuagguggagcaguuggugugg

SEQ ID NO: 80866 - RNA, 22 nt, Human
cagucuuuaagaucuuggcuua

SEQ ID NO: 80867 - RNA, 26 nt, Human
aucuuagaaucacuccugaguaucuc

SEQ ID NO: 80868 - RNA, 27 nt, Human
uuuuccccuaccaauauuaggugaucc

SEQ ID NO: 80869 - RNA, 27 nt, Human
gcauagcaaucguuuuauuuaaguuga

SEQ ID NO: 80870 - RNA, 21 nt, Human
acccauggugacgaugacaca

SEQ ID NO: 80871 - RNA, 21 nt, Human
gagcuaggauuugaccccaga

SEQ ID NO: 80872 - RNA, 22 nt, Human
gcaggccacgcaacacuuccuc

SEQ ID NO: 80873 - RNA, 23 nt, Human
cuuuuagucuuaccugaauuuau

SEQ ID NO: 80874 - RNA, 22 nt, Human
cuccagcgauggugcugcccag

SEQ ID NO: 80875 - RNA, 22 nt, Human
ggcuuccuccucccuccugccg

SEQ ID NO: 80876 - RNA, 24 nt, Human
cagcaucuucccuggauggcugga

SEQ ID NO: 80877 - RNA, 25 nt, Human
aaagaaugucucggucacaucaggc

SEQ ID NO: 80878 - RNA, 18 nt, Human
gcagugccugguucugag

SEQ ID NO: 80879 - RNA, 24 nt, Human
augaguucucuguaagacuguggu

SEQ ID NO: 80880 - RNA, 20 nt, Human
ccaaagggaaaacucuucau

SEQ ID NO: 80881 - RNA, 21 nt, Human
gaaccugaacuuuaguaacac

SEQ ID NO: 80882 - RNA, 26 nt, Human
gggaccccacuccccucacacacacc

SEQ ID NO: 80883 - RNA, 21 nt, Human
ucaaaucucuguuacuccauu

SEQ ID NO: 80884 - RNA, 26 nt, Human
guucagugccuggguguuuggugaug

SEQ ID NO: 80885 - RNA, 25 nt, Human
agaggauguaucucacaaguaggau

SEQ ID NO: 80886 - RNA, 23 nt, Human
ugaccaugaauuucuuagcaaua

SEQ ID NO: 80887 - RNA, 21 nt, Human
acggucagggucagggccauu

SEQ ID NO: 80888 - RNA, 21 nt, Human
cucucuuccuacccuuccuca

SEQ ID NO: 80889 - RNA, 24 nt, Human
cuucccaauccucugcuuuagaca

SEQ ID NO: 80890 - RNA, 23 nt, Human
uuuaaggcuuuuucccccuugaa

SEQ ID NO: 80891 - RNA, 23 nt, Human
uucauuucaucucucccuuuuuu

SEQ ID NO: 80892 - RNA, 22 nt, Human
gauauuccccauuuccuguaca

SEQ ID NO: 80893 - RNA, 22 nt, Human
ugguucaugccuguaaucccag

SEQ ID NO: 80894 - RNA, 22 nt, Human
uggcucaugccuguaauccuag

SEQ ID NO: 80895 - RNA, 26 nt, Human
ggccaggugcugucacacagcaaagg

SEQ ID NO: 80896 - RNA, 23 nt, Human
ccuggaagguggagcuugcagug

SEQ ID NO: 80897 - RNA, 20 nt, Human
cggaggcugggguuuuagua

SEQ ID NO: 80898 - RNA, 24 nt, Human
ugggccuggcccugcuuucuacgc

SEQ ID NO: 80899 - RNA, 27 nt, Human
uagacugccuaaucuggcacuugccac

SEQ ID NO: 80900 - RNA, 21 nt, Human
uugcagacuugaaaaguuugu

SEQ ID NO: 80901 - RNA, 23 nt, Human
uccucaaaagagaauucagucua

SEQ ID NO: 80902 - RNA, 32 nt, Human
ucuugcauugugacaagaauuguuaccuguca

SEQ ID NO: 80903 - RNA, 22 nt, Human
uggugcgcgcauguaaucccag

SEQ ID NO: 80904 - RNA, 20 nt, Human
ugggcagucucucagccucc

SEQ ID NO: 80905 - RNA, 20 nt, Human
cccccaagcccucccuccua

SEQ ID NO: 80906 - RNA, 21 nt, Human
uuucccacuccuggcccacag

SEQ ID NO: 80907 - RNA, 20 nt, Human
uaaaggaucauuaaaaugaa

SEQ ID NO: 80908 - RNA, 23 nt, Human
uggcaucuacccucccguccccu

SEQ ID NO: 80909 - RNA, 27 nt, Human
uugcuuguuuauuauguuuucucucca

SEQ ID NO: 80910 - RNA, 21 nt, Human
gcuuacucaaccucugccucu

SEQ ID NO: 80911 - RNA, 22 nt, Human
ccaggaggaugagguuguccug

SEQ ID NO: 80912 - RNA, 22 nt, Human
ggacagaccagaccagacccag

SEQ ID NO: 80913 - RNA, 21 nt, Human
ccuccuuccugucaugcuccc

SEQ ID NO: 80914 - RNA, 22 nt, Human
auuaguauaauaacaauguuaa

SEQ ID NO: 80915 - RNA, 24 nt, Human
aaccccucucggccgggugcagug

SEQ ID NO: 80916 - RNA, 22 nt, Human
ggaagcugaagcgggcagauca

SEQ ID NO: 80917 - RNA, 21 nt, Human
ucacuguuuucuugggacaac

SEQ ID NO: 80918 - RNA, 27 nt, Human
ugacuccugucccuuccccuucugcuu

SEQ ID NO: 80919 - RNA, 21 nt, Human
auaugcuuuuuccacgagugu

SEQ ID NO: 80920 - RNA, 20 nt, Human
cacagcuucucacugccgaa

SEQ ID NO: 80921 - RNA, 20 nt, Human
cuccacccguucugccucag

SEQ ID NO: 80922 - RNA, 27 nt, Human
cucaaguagcugggauuacaagcacca

SEQ ID NO: 80923 - RNA, 22 nt, Human
uguauauguucgugugugaaau

SEQ ID NO: 80924 - RNA, 20 nt, Human
aaugcuuaacaaaugcucuu

SEQ ID NO: 80925 - RNA, 22 nt, Human
ccacugcauucucuuuuguuug

SEQ ID NO: 80926 - RNA, 22 nt, Human
agagaauaaauaucaaaucuaa

SEQ ID NO: 80927 - RNA, 26 nt, Human
uagaauauuaaauucuuaugugucuu

SEQ ID NO: 80928 - RNA, 20 nt, Human
gugauuucuacuugccaacu

SEQ ID NO: 80929 - RNA, 29 nt, Human
accauggauuucagaggaggaaguacgga

SEQ ID NO: 80930 - RNA, 18 nt, Human
caacagcaaucaacacca

SEQ ID NO: 80931 - RNA, 26 nt, Human
uggggagggguccgggaagaagggga

SEQ ID NO: 80932 - RNA, 22 nt, Human
cacaaauguaccaaucgacaag

SEQ ID NO: 80933 - RNA, 22 nt, Human
cccaaguuucuccucugaccca

SEQ ID NO: 80934 - RNA, 22 nt, Human
cgaacuccuggcaucaagcgau

SEQ ID NO: 80935 - RNA, 23 nt, Human
ggacuccuguuguugaaguucgu

SEQ ID NO: 80936 - RNA, 18 nt, Human
acauaaaugcacaaccua

SEQ ID NO: 80937 - RNA, 24 nt, Human
agaugggaagaaaacagucauaug

SEQ ID NO: 80938 - RNA, 19 nt, Human
caguucugcaccacugguu

SEQ ID NO: 80939 - RNA, 25 nt, Human
uauagcaccuggcccauuacauauc

SEQ ID NO: 80940 - RNA, 20 nt, Human
gggguuaucacccacugugc

SEQ ID NO: 80941 - RNA, 27 nt, Human
ugacccuuuauauuuguucuaaaauaa

SEQ ID NO: 80942 - RNA, 19 nt, Human
cagacguuuuuucugcaca

SEQ ID NO: 80943 - RNA, 27 nt, Human
agccacugcuuagcuaucauagucacc

SEQ ID NO: 80944 - RNA, 24 nt, Human
aaacugccuucgcucaagcaggug

SEQ ID NO: 80945 - RNA, 22 nt, Human
accugcaggcguucucucucua

SEQ ID NO: 80946 - RNA, 20 nt, Human
gcauuuuucugucagaauca

SEQ ID NO: 80947 - RNA, 21 nt, Human
gugucugauuccauauggagg

SEQ ID NO: 80948 - RNA, 30 nt, Human
uggugucagaggcaggagugggggaucagg

SEQ ID NO: 80949 - RNA, 25 nt, Human
acuggcccaacuccaggcguuuccu

SEQ ID NO: 80950 - RNA, 21 nt, Human
gauaccacacauuucucaucu

SEQ ID NO: 80951 - RNA, 19 nt, Human
ccugcacucuuucuugcaa

SEQ ID NO: 80952 - RNA, 23 nt, Human
gagcuaguucagcagaagcaguu

SEQ ID NO: 80953 - RNA, 24 nt, Human
agccaacacccuucucucgcccca

SEQ ID NO: 80954 - RNA, 27 nt, Human
ggaggcugaggcaggagaauugauuga

SEQ ID NO: 80955 - RNA, 27 nt, Human
ggaggcugaagcaggaggauugauuga

SEQ ID NO: 80956 - RNA, 18 nt, Human
cacugucucuucuggacc

SEQ ID NO: 80957 - RNA, 22 nt, Human
aucgcuugaaccuaggaggugg

SEQ ID NO: 80958 - RNA, 23 nt, Human
uuaacauccuucuuuucuauugc

SEQ ID NO: 80959 - RNA, 23 nt, Human
ggacuuagggcccaugagguugu

SEQ ID NO: 80960 - RNA, 26 nt, Human
gcugccuggauccccggccugccugg

SEQ ID NO: 80961 - RNA, 19 nt, Human
agacuugcucggagcccag

SEQ ID NO: 80962 - RNA, 26 nt, Human
ggcuaguggagaaguaaggaggggcg

SEQ ID NO: 80963 - RNA, 28 nt, Human
gcauuucaaagcaucacacuugucugca

SEQ ID NO: 80964 - RNA, 25 nt, Human
cggcaagugaauaaagcacauuucc

SEQ ID NO: 80965 - RNA, 20 nt, Human
ucaucuuuuucucucuguau

SEQ ID NO: 80966 - RNA, 20 nt, Human
agaauugcacuugugccuca

SEQ ID NO: 80967 - RNA, 19 nt, Human
cuucaucuaaugacccuga

SEQ ID NO: 80968 - RNA, 22 nt, Human
auccuuccagccaccugccuca

SEQ ID NO: 80969 - RNA, 27 nt, Human
caguuucuaccauaauuaauuguguuu

SEQ ID NO: 80970 - RNA, 21 nt, Human
guguaaggaguaugcccagcc

SEQ ID NO: 80971 - RNA, 28 nt, Human
ccagcuaaucccaggaauuugcugcccc

SEQ ID NO: 80972 - RNA, 22 nt, Human
aaagugcugggauuacuggcau

SEQ ID NO: 80973 - RNA, 26 nt, Human
uaucacuaauaacugggaaaauacaa

SEQ ID NO: 80974 - RNA, 15 nt, Human
aaaacaauaugagua

SEQ ID NO: 80975 - RNA, 22 nt, Human
uuggggucuucccgaagccagg

SEQ ID NO: 80976 - RNA, 25 nt, Human
gguuuuaauuugcauuuccauaaua

SEQ ID NO: 80977 - RNA, 28 nt, Human
cugccugugguccugagcacugaucagc

SEQ ID NO: 80978 - RNA, 25 nt, Human
ugugcucagccaggcuggaggcggc

SEQ ID NO: 80979 - RNA, 25 nt, Human
uggccucuccuuggcuuuaugacuu

SEQ ID NO: 80980 - RNA, 27 nt, Human
ggaggcugaggcagaagaauugcuuua

SEQ ID NO: 80981 - RNA, 22 nt, Human
ugccuccaggaccauucaggcu

SEQ ID NO: 80982 - RNA, 20 nt, Human
ggcugcaccugcaugcuucc

SEQ ID NO: 80983 - RNA, 22 nt, Human
cccuucccagcagcagaaucug

SEQ ID NO: 80984 - RNA, 22 nt, Human
ucgccaaggcuggagugcagug

SEQ ID NO: 80985 - RNA, 21 nt, Human
augucugcucuguuuuuuguu

SEQ ID NO: 80986 - RNA, 22 nt, Human
uugaugaaaauaaugaaugaaa

SEQ ID NO: 80987 - RNA, 26 nt, Human
ugcuucuuaugaucagaacucuuuuu

SEQ ID NO: 80988 - RNA, 20 nt, Human
ucaucuguccaguggguagg

SEQ ID NO: 80989 - RNA, 22 nt, Human
uccaggcucccauccauggccc

SEQ ID NO: 80990 - RNA, 23 nt, Human
gcuccucuuaucuccccuucaca

SEQ ID NO: 80991 - RNA, 20 nt, Human
caccgggucggccuccagcc

SEQ ID NO: 80992 - RNA, 26 nt, Human
aauagggucuaugucauaucccaagu

SEQ ID NO: 80993 - RNA, 26 nt, Human
guguauuuauaaaacaaggcuagcca

SEQ ID NO: 80994 - RNA, 20 nt, Human
cccuccacugacuccagaga

SEQ ID NO: 80995 - RNA, 26 nt, Human
uacauaauugcaauauuucccccuua

SEQ ID NO: 80996 - RNA, 23 nt, Human
ggggcccugaccuggggugucau

SEQ ID NO: 80997 - RNA, 19 nt, Human
cuucagaaaggaacaggaa

SEQ ID NO: 80998 - RNA, 22 nt, Human
gcccuugugcuccagucauugc

SEQ ID NO: 80999 - RNA, 22 nt, Human
aguggcgcgaucucagcucacu

SEQ ID NO: 81000 - RNA, 22 nt, Human
aguggcacgaucucggcucacu

SEQ ID NO: 81001 - RNA, 22 nt, Human
ccgaaccuugagguaaagggcc

SEQ ID NO: 81002 - RNA, 25 nt, Human
guggaagccgauggcuggaggaugg

SEQ ID NO: 81003 - RNA, 23 nt, Human
uggggguuuugaguuuguagugc

SEQ ID NO: 81004 - RNA, 24 nt, Human
ccacagcaagacugacauccacuu

SEQ ID NO: 81005 - RNA, 21 nt, Human
cgggaggcggagcuugcagcg

SEQ ID NO: 81006 - RNA, 24 nt, Human
uccuuucucuggcuucuuuuagca

SEQ ID NO: 81007 - RNA, 22 nt, Human
ccaaguagcugggauuacaggc

SEQ ID NO: 81008 - RNA, 22 nt, Human
ccaagcagcugggauuacaggu

SEQ ID NO: 81009 - RNA, 22 nt, Human
ccgaguagcugggauuacgggc

SEQ ID NO: 81010 - RNA, 20 nt, Human
aauuaauguagccugccucu

SEQ ID NO: 81011 - RNA, 22 nt, Human
aggcugaggcaagagaguugcu

SEQ ID NO: 81012 - RNA, 19 nt, Human
acugcucuccuuugcagcc

SEQ ID NO: 81013 - RNA, 23 nt, Human
aaacagccucagcucaagcggug

SEQ ID NO: 81014 - RNA, 27 nt, Human
caggcugguguguaggugguaaaaccu

SEQ ID NO: 81015 - RNA, 22 nt, Human
gguacuccccagcaccaccuca

SEQ ID NO: 81016 - RNA, 24 nt, Human
ggcaccaggcugggaugagcugug

SEQ ID NO: 81017 - RNA, 22 nt, Human
uuucuacaguugggcagcuggu

SEQ ID NO: 81018 - RNA, 27 nt, Human
gucacauuuacaacuggaaaagaacua

SEQ ID NO: 81019 - RNA, 21 nt, Human
cucggcuuuacacaauuuauc

SEQ ID NO: 81020 - RNA, 20 nt, Human
gucaucuccccucugccucc

SEQ ID NO: 81021 - RNA, 19 nt, Human
caucaagcuuuaacaaaua

SEQ ID NO: 81022 - RNA, 25 nt, Human
ggggugggaaaggcuuuaucaggua

SEQ ID NO: 81023 - RNA, 25 nt, Human
gcaaugccaccauuguugaugugac

SEQ ID NO: 81024 - RNA, 26 nt, Human
ccuucagugcugguggcccucaggcc

SEQ ID NO: 81025 - RNA, 19 nt, Human
guuauuucuucccugccca

SEQ ID NO: 81026 - RNA, 19 nt, Human
ccccuucuucccucucuca

SEQ ID NO: 81027 - RNA, 25 nt, Human
ccacagaugacagccccaccuccuu

SEQ ID NO: 81028 - RNA, 25 nt, Human
cgcugccuccuggguucaagcaauu

SEQ ID NO: 81029 - RNA, 22 nt, Human
gucuuuucuguuauuguauuua

SEQ ID NO: 81030 - RNA, 27 nt, Human
gccucucuccuccacucgcucgggcuc

SEQ ID NO: 81031 - RNA, 23 nt, Human
gucucccaggcuggaggucagug

SEQ ID NO: 81032 - RNA, 22 nt, Human
ggugagcagagggcacugggcu

SEQ ID NO: 81033 - RNA, 23 nt, Human
gcugguggcaccucucccuccug

SEQ ID NO: 81034 - RNA, 20 nt, Human
ucuguuccuguuacuguugg

SEQ ID NO: 81035 - RNA, 22 nt, Human
uucauuucucaguauauauuuc

SEQ ID NO: 81036 - RNA, 23 nt, Human
acuuaggaggcugaggugggaga

SEQ ID NO: 81037 - RNA, 25 nt, Human
accuaggcuggagugcaguggggca

SEQ ID NO: 81038 - RNA, 27 nt, Human
auauuauauacaacacaggcuuugauc

SEQ ID NO: 81039 - RNA, 22 nt, Human
gcuguaagcaccugggcugagg

SEQ ID NO: 81040 - RNA, 20 nt, Human
cuugcuggcuugccucuugc

SEQ ID NO: 81041 - RNA, 25 nt, Human
cugcccaggaaggugccugcacaug

SEQ ID NO: 81042 - RNA, 20 nt, Human
uuuuaaaaugugauuuucua

SEQ ID NO: 81043 - RNA, 18 nt, Human
ccaggcacacacugugcu

SEQ ID NO: 81044 - RNA, 24 nt, Human
ucuacuuccucuuaccuauguccc

SEQ ID NO: 81045 - RNA, 22 nt, Human
aggggucagugcagcagaggac

SEQ ID NO: 81046 - RNA, 17 nt, Human
uaccauccacaucagaa

SEQ ID NO: 81047 - RNA, 22 nt, Human
aaagaaauucauuucugaaaug

SEQ ID NO: 81048 - RNA, 27 nt, Human
agaccuccauucacaacuucauggcca

SEQ ID NO: 81049 - RNA, 21 nt, Human
caugccacuacucugaggccu

SEQ ID NO: 81050 - RNA, 21 nt, Human
ucucaccacagaagggcauuu

SEQ ID NO: 81051 - RNA, 30 nt, Human
ccuuugacuuccugacuguccccuggcugc

SEQ ID NO: 81052 - RNA, 31 nt, Human
aggaagccucaagacgcggagcagcggcagg

SEQ ID NO: 81053 - RNA, 27 nt, Human
aacacaaaauuucacucucuaaaagca

SEQ ID NO: 81054 - RNA, 20 nt, Human
ccucuugcauuccauccuca

SEQ ID NO: 81055 - RNA, 17 nt, Human
uauuucucacuggucau

SEQ ID NO: 81056 - RNA, 26 nt, Human
uucucucucccaucaccuugcccuca

SEQ ID NO: 81057 - RNA, 19 nt, Human
cccaaaacgccauugccuu

SEQ ID NO: 81058 - RNA, 23 nt, Human
agaggccaccugccauucccccu

SEQ ID NO: 81059 - RNA, 22 nt, Human
uggugucuuuuugugcacagau

SEQ ID NO: 81060 - RNA, 26 nt, Human
uggcagcaggggcugcuccacgagug

SEQ ID NO: 81061 - RNA, 22 nt, Human
gggcugaggaggcaguuuuugu

SEQ ID NO: 81062 - RNA, 22 nt, Human
uggagugagagcccagggacag

SEQ ID NO: 81063 - RNA, 19 nt, Human
cucucaccuuaucuggaag

SEQ ID NO: 81064 - RNA, 23 nt, Human
uuagcacauccauaucuuuucua

SEQ ID NO: 81065 - RNA, 21 nt, Human
augcuuaacauacuaaccuua

SEQ ID NO: 81066 - RNA, 21 nt, Human
gucucagguuucuuuaccucc

SEQ ID NO: 81067 - RNA, 24 nt, Human
uuuaacaacagccaggagcuuccu

SEQ ID NO: 81068 - RNA, 23 nt, Human
auguauccccugccuauuuuccu

SEQ ID NO: 81069 - RNA, 19 nt, Human
guguuaauguacacuggac

SEQ ID NO: 81070 - RNA, 27 nt, Human
ucaggaggcagagguuacagguuacag

SEQ ID NO: 81071 - RNA, 20 nt, Human
aauuuucugcaucaacuuga

SEQ ID NO: 81072 - RNA, 22 nt, Human
ucgggggguguucaaggccaca

SEQ ID NO: 81073 - RNA, 21 nt, Human
acaagacagugaagugaccuc

SEQ ID NO: 81074 - RNA, 22 nt, Human
ccuccccugcuaucccuccucc

SEQ ID NO: 81075 - RNA, 23 nt, Human
gggacucgacauuuuucugggga

SEQ ID NO: 81076 - RNA, 22 nt, Human
agcucacugcaaccuccgcauc

SEQ ID NO: 81077 - RNA, 22 nt, Human
agcucacugcacccuccgccuc

SEQ ID NO: 81078 - RNA, 21 nt, Human
ccuguggucucagcacuuugg

SEQ ID NO: 81079 - RNA, 21 nt, Human
accuuucuagaaccugguaga

SEQ ID NO: 81080 - RNA, 26 nt, Human
guacucaaaaugcaaaaauuagccag

SEQ ID NO: 81081 - RNA, 25 nt, Human
uggccucuccaagcguccugcacgu

SEQ ID NO: 81082 - RNA, 26 nt, Human
gauuuccagccccaccaugugugcug

SEQ ID NO: 81083 - RNA, 26 nt, Human
gccuguaaucccagcuacuugggaag

SEQ ID NO: 81084 - RNA, 20 nt, Human
ggcucuuccccaccuugcca

SEQ ID NO: 81085 - RNA, 23 nt, Human
acccugggaccuucuugccucag

SEQ ID NO: 81086 - RNA, 29 nt, Human
cacugccagcugcggccugggcaccgcgg

SEQ ID NO: 81087 - RNA, 27 nt, Human
cugcagccaaaucuggcccaccuccuu

SEQ ID NO: 81088 - RNA, 27 nt, Human
aggcgguccaccuagacccacagcccc

SEQ ID NO: 81089 - RNA, 26 nt, Human
gcucacugacccucaauuguccucuu

SEQ ID NO: 81090 - RNA, 21 nt, Human
guauuugaagccaucaacauc

SEQ ID NO: 81091 - RNA, 23 nt, Human
auguuggaaaacuacacacauau

SEQ ID NO: 81092 - RNA, 26 nt, Human
gcguggugagcaucaccaacccacag

SEQ ID NO: 81093 - RNA, 26 nt, Human
ugcuccaaaaauguuguuuguugcaa

SEQ ID NO: 81094 - RNA, 22 nt, Human
ucugggagcuucuacuuuguaa

SEQ ID NO: 81095 - RNA, 26 nt, Human
ucauuucuggcuacuuccuugggcuc

SEQ ID NO: 81096 - RNA, 27 nt, Human
ucagcacuugggcccacugacagugac

SEQ ID NO: 81097 - RNA, 22 nt, Human
ugccucacugcaacgccugccu

SEQ ID NO: 81098 - RNA, 22 nt, Human
ccagcucccacaauuuucccau

SEQ ID NO: 81099 - RNA, 20 nt, Human
ccucauccauuucuuuuaua

SEQ ID NO: 81100 - RNA, 26 nt, Human
auuuucucaugaugaaauaaaguuca

SEQ ID NO: 81101 - RNA, 20 nt, Human
gccagcccuccuccuccucg

SEQ ID NO: 81102 - RNA, 23 nt, Human
uuuguaugcgacuccaccuccgc

SEQ ID NO: 81103 - RNA, 24 nt, Human
gccuccuugccagccccaccccca

SEQ ID NO: 81104 - RNA, 21 nt, Human
aaugcugccuucccaugaauc

SEQ ID NO: 81105 - RNA, 26 nt, Human
ccuaggacaguguauucaagaguuga

SEQ ID NO: 81106 - RNA, 24 nt, Human
cugccugguaggcugggaacugaa

SEQ ID NO: 81107 - RNA, 21 nt, Human
uucaggaaggaaugaaagaga

SEQ ID NO: 81108 - RNA, 21 nt, Human
cugcccuuuuuucugccuccu

SEQ ID NO: 81109 - RNA, 22 nt, Human
uuagcuguuuguaauuuuuguu

SEQ ID NO: 81110 - RNA, 26 nt, Human
cccugcuccugucuugugcuuuaucc

SEQ ID NO: 81111 - RNA, 24 nt, Human
accugcucuccucuugccacugcc

SEQ ID NO: 81112 - RNA, 18 nt, Human
ugcaauuucuagugccuu

SEQ ID NO: 81113 - RNA, 22 nt, Human
uuuugccugugaauaugguguc

SEQ ID NO: 81114 - RNA, 28 nt, Human
uugagagagacagcagggaggagguaga

SEQ ID NO: 81115 - RNA, 20 nt, Human
gguggccucuccuuguggcc

SEQ ID NO: 81116 - RNA, 22 nt, Human
ucuuggcucucucugcacuuug

SEQ ID NO: 81117 - RNA, 27 nt, Human
uucauuucuuuccuuaucacccccuug

SEQ ID NO: 81118 - RNA, 21 nt, Human
uguaaacacuggacagaugga

SEQ ID NO: 81119 - RNA, 24 nt, Human
agaccaccuucccuuccucagcag

SEQ ID NO: 81120 - RNA, 21 nt, Human
uuggaaccuaauucgagagga

SEQ ID NO: 81121 - RNA, 26 nt, Human
aaaugcuggggcagggggugaagaac

SEQ ID NO: 81122 - RNA, 20 nt, Human
ucuuuuucugaucuuccuca

SEQ ID NO: 81123 - RNA, 26 nt, Human
agcucacugcaaccuccaucuccugg

SEQ ID NO: 81124 - RNA, 25 nt, Human
cgucacuauuuuagauuccuggcau

SEQ ID NO: 81125 - RNA, 21 nt, Human
guccugccccuuccuccuuca

SEQ ID NO: 81126 - RNA, 28 nt, Human
gcagcgcgcuacugcagcuuucuuccgc

SEQ ID NO: 81127 - RNA, 20 nt, Human
aguuugucucuuugcaacuc

SEQ ID NO: 81128 - RNA, 24 nt, Human
ucaugccaggcugacggguccagu

SEQ ID NO: 81129 - RNA, 23 nt, Human
accagcaccaccaagaccugauu

SEQ ID NO: 81130 - RNA, 25 nt, Human
gagugugcucaggccgggcuuucca

SEQ ID NO: 81131 - RNA, 27 nt, Human
ucugcucuuccuuuuucugguuaucag

SEQ ID NO: 81132 - RNA, 22 nt, Human
acuguaggcacugccauggccc

SEQ ID NO: 81133 - RNA, 26 nt, Human
ggugggcagaggcuggcagugcugau

SEQ ID NO: 81134 - RNA, 17 nt, Human
uuuuaguucaaugugau

SEQ ID NO: 81135 - RNA, 26 nt, Human
cuagaugacucuguaaagacucucca

SEQ ID NO: 81136 - RNA, 21 nt, Human
gccucccaggcuggggcagug

SEQ ID NO: 81137 - RNA, 26 nt, Human
guggcucuuccccaccuugccagcag

SEQ ID NO: 81138 - RNA, 18 nt, Human
ucugaagucccuuccauu

SEQ ID NO: 81139 - RNA, 20 nt, Human
augggcuugccagguaauga

SEQ ID NO: 81140 - RNA, 26 nt, Human
gccacagugccuggcccauucuugag

SEQ ID NO: 81141 - RNA, 25 nt, Human
augagacaggcuuuauuauccgcau

SEQ ID NO: 81142 - RNA, 23 nt, Human
gaaugaaccaaugugugauugua

SEQ ID NO: 81143 - RNA, 21 nt, Human
cacacccuucaggaaggggga

SEQ ID NO: 81144 - RNA, 22 nt, Human
aaccaggccccagccuccaggc

SEQ ID NO: 81145 - RNA, 21 nt, Human
uccuaagcacccacgugucag

SEQ ID NO: 81146 - RNA, 20 nt, Human
gcccagccuugcgccgcauu

SEQ ID NO: 81147 - RNA, 21 nt, Human
gcauuguucugagcaguguga

SEQ ID NO: 81148 - RNA, 21 nt, Human
aucugugucuuuuuaauauuc

SEQ ID NO: 81149 - RNA, 22 nt, Human
accuuuuuuccccuccuguucu

SEQ ID NO: 81150 - RNA, 27 nt, Human
uuuccagacacauuuagggguucgcgc

SEQ ID NO: 81151 - RNA, 22 nt, Human
ggccuccagaaccuuacuggca

SEQ ID NO: 81152 - RNA, 23 nt, Human
ccuggcaggcggagguugcagug

SEQ ID NO: 81153 - RNA, 23 nt, Human
ccuccacccuccucucucgcacc

SEQ ID NO: 81154 - RNA, 27 nt, Human
uucucucuacauacguauaugugugug

SEQ ID NO: 81155 - RNA, 19 nt, Human
ccaguaggacucaaggugg

SEQ ID NO: 81156 - RNA, 26 nt, Human
uccucguccuccuccugcucccgggg

SEQ ID NO: 81157 - RNA, 26 nt, Human
agacuccugcccaggccaggacugag

SEQ ID NO: 81158 - RNA, 26 nt, Human
agcaaucgguuccccagauuacuuga

SEQ ID NO: 81159 - RNA, 17 nt, Human
ucagcuuuaaaauauga

SEQ ID NO: 81160 - RNA, 27 nt, Human
cccagagugcugggauuacaguuguga

SEQ ID NO: 81161 - RNA, 19 nt, Human
acuagacuguaagugccuu

SEQ ID NO: 81162 - RNA, 22 nt, Human
gcccaucucccuucaagaaccc

SEQ ID NO: 81163 - RNA, 23 nt, Human
gccaggcuccuguggugcugcug

SEQ ID NO: 81164 - RNA, 28 nt, Human
acagcccuccugugccugcuucccugug

SEQ ID NO: 81165 - RNA, 26 nt, Human
augugggaaaaugacaucuaagcuuu

SEQ ID NO: 81166 - RNA, 30 nt, Human
uccuuguuaauccagugaucuuuuaggcca

SEQ ID NO: 81167 - RNA, 20 nt, Human
auugcaacaggcugggcuuc

SEQ ID NO: 81168 - RNA, 21 nt, Human
caacacaggcuucagcacuuc

SEQ ID NO: 81169 - RNA, 24 nt, Human
agcucugugcugagccuccuggcc

SEQ ID NO: 81170 - RNA, 19 nt, Human
ccaacuugguucugcuuca

SEQ ID NO: 81171 - RNA, 22 nt, Human
gcaggcagaucacuugagguca

SEQ ID NO: 81172 - RNA, 22 nt, Human
ugauuuagcuggcaggccaggu

SEQ ID NO: 81173 - RNA, 22 nt, Human
gcgggcgcaggagcaggcggcg

SEQ ID NO: 81174 - RNA, 22 nt, Human
ugucacccaggcugcagugcaa

SEQ ID NO: 81175 - RNA, 22 nt, Human
ggaggcugaggugggaggauca

SEQ ID NO: 81176 - RNA, 22 nt, Human
gcagguggaucaccugagguua

SEQ ID NO: 81177 - RNA, 22 nt, Human
cugaguauuuugcaaaugcaca

SEQ ID NO: 81178 - RNA, 18 nt, Human
gguuuaagaguccuggcc

SEQ ID NO: 81179 - RNA, 21 nt, Human
uguuugauuuuaugcacuuug

SEQ ID NO: 81180 - RNA, 20 nt, Human
aaaauacaaaaauuagcccg

SEQ ID NO: 81181 - RNA, 24 nt, Human
cauuuuugcaagcuguagaaggaa

SEQ ID NO: 81182 - RNA, 20 nt, Human
gcgccuccgccuccuucgca

SEQ ID NO: 81183 - RNA, 21 nt, Human
ggcuucauuuaugcacuugug

SEQ ID NO: 81184 - RNA, 23 nt, Human
gcugggcugagugacacaagcac

SEQ ID NO: 81185 - RNA, 20 nt, Human
ccuguuccucuuccccuggc

SEQ ID NO: 81186 - RNA, 19 nt, Human
cacaucucuaucuggccuu

SEQ ID NO: 81187 - RNA, 23 nt, Human
ugcaaccuccaccucccagguca

SEQ ID NO: 81188 - RNA, 24 nt, Human
uguucagcuaagaauuggaaaagu

SEQ ID NO: 81189 - RNA, 22 nt, Human
uacuuguaaauaaaauagcugc

SEQ ID NO: 81190 - RNA, 21 nt, Human
cugcguuuccucugccugcgc

SEQ ID NO: 81191 - RNA, 19 nt, Human
ucugaguuagcucuuugga

SEQ ID NO: 81192 - RNA, 19 nt, Human
gcgcacacucgcacaccgc

SEQ ID NO: 81193 - RNA, 22 nt, Human
gcucacugcaacuucuaccucc

SEQ ID NO: 81194 - RNA, 28 nt, Human
gagaaaggagagccaggagcauuuaaaa

SEQ ID NO: 81195 - RNA, 21 nt, Human
uaaacuagauugacuaauaaa

SEQ ID NO: 81196 - RNA, 26 nt, Human
caaacuccaucagaucuucucaccuu

SEQ ID NO: 81197 - RNA, 21 nt, Human
uuggaucuuuugaagggagaa

SEQ ID NO: 81198 - RNA, 22 nt, Human
gcgaggaaggcuagugagggaa

SEQ ID NO: 81199 - RNA, 21 nt, Human
gcugcagaaagauacgacuga

SEQ ID NO: 81200 - RNA, 22 nt, Human
ccuccaauucccgugaucccaa

SEQ ID NO: 81201 - RNA, 26 nt, Human
gagccccuccugguugauacuuguuc

SEQ ID NO: 81202 - RNA, 20 nt, Human
cauuucucggcaguacugug

SEQ ID NO: 81203 - RNA, 25 nt, Human
gacaggggacaauuucuuuguaguu

SEQ ID NO: 81204 - RNA, 27 nt, Human
aaagugcugggauuacaggugggagcc

SEQ ID NO: 81205 - RNA, 21 nt, Human
uguggugaggcaggcuuuguu

SEQ ID NO: 81206 - RNA, 25 nt, Human
uuggaaauuauucuaaacacaaaaa

SEQ ID NO: 81207 - RNA, 23 nt, Human
ccugggcaacagagacccugucu

SEQ ID NO: 81208 - RNA, 18 nt, Human
uccaguauucuauuuaag

SEQ ID NO: 81209 - RNA, 20 nt, Human
cugucaguucccaaaggcca

SEQ ID NO: 81210 - RNA, 22 nt, Human
gggguggggaccucaggccugg

SEQ ID NO: 81211 - RNA, 21 nt, Human
cuguauugacaucaucaugcc

SEQ ID NO: 81212 - RNA, 21 nt, Human
caucacugcuggcagccuggg

SEQ ID NO: 81213 - RNA, 19 nt, Human
aacccugccuuuuucacua

SEQ ID NO: 81214 - RNA, 20 nt, Human
ugggguggaagcuuggggaa

SEQ ID NO: 81215 - RNA, 22 nt, Human
ggucucccaaaaugcugggauu

SEQ ID NO: 81216 - RNA, 22 nt, Human
gcuuugucuucuguagucgcca

SEQ ID NO: 81217 - RNA, 23 nt, Human
gcgccauggagaggagaggcacu

SEQ ID NO: 81218 - RNA, 27 nt, Human
uuaaaaaagugcuucccugcaaagucu

SEQ ID NO: 81219 - RNA, 24 nt, Human
guguagcaucuuccucugcagaau

SEQ ID NO: 81220 - RNA, 21 nt, Human
ccuccacuccucucaacugcc

SEQ ID NO: 81221 - RNA, 20 nt, Human
acucagaaauggacaaagaa

SEQ ID NO: 81222 - RNA, 27 nt, Human
gaaugcugaugaacaauuuugcuaucg

SEQ ID NO: 81223 - RNA, 20 nt, Human
aggugcccaccaccgcgccc

SEQ ID NO: 81224 - RNA, 26 nt, Human
cugagcugggauuacaggcgccugcc

SEQ ID NO: 81225 - RNA, 20 nt, Human
acucuccuuaaaaaccgaua

SEQ ID NO: 81226 - RNA, 28 nt, Human
ccugggcaacaacagcaaaacuccaucu

SEQ ID NO: 81227 - RNA, 23 nt, Human
agaaccugcucccaccucaggcc

SEQ ID NO: 81228 - RNA, 21 nt, Human
auccuguggagcccacuccug

SEQ ID NO: 81229 - RNA, 25 nt, Human
ugaaaguuuugaguagauauuacuu

SEQ ID NO: 81230 - RNA, 21 nt, Human
ggagcccgccggccugggcag

SEQ ID NO: 81231 - RNA, 17 nt, Human
uaugcccucagugcagu

SEQ ID NO: 81232 - RNA, 29 nt, Human
ccuugauacaacagcugaccucauuuccc

SEQ ID NO: 81233 - RNA, 22 nt, Human
gcugagcagggggaggggaaga

SEQ ID NO: 81234 - RNA, 25 nt, Human
cccuuuuuaucugcugguguggacc

SEQ ID NO: 81235 - RNA, 21 nt, Human
aggauggccuuuccuucccuc

SEQ ID NO: 81236 - RNA, 22 nt, Human
auaccuguugagacugauucag

SEQ ID NO: 81237 - RNA, 27 nt, Human
caugccuuuugggcaucucccaugucc

SEQ ID NO: 81238 - RNA, 19 nt, Human
uaagaugagggggccaggc

SEQ ID NO: 81239 - RNA, 21 nt, Human
uuccuuuggcagcguguuucc

SEQ ID NO: 81240 - RNA, 22 nt, Human
ugagauuacauguaugagccac

SEQ ID NO: 81241 - RNA, 25 nt, Human
gugugggaaugcucgugugauggau

SEQ ID NO: 81242 - RNA, 26 nt, Human
gucgcuguugccuccgccaccuccuc

SEQ ID NO: 81243 - RNA, 26 nt, Human
ccugauuggccacuggauccugcugc

SEQ ID NO: 81244 - RNA, 23 nt, Human
aaagaggccuucuggauggccaa

SEQ ID NO: 81245 - RNA, 25 nt, Human
ccauuuucuuccucaccaaugacau

SEQ ID NO: 81246 - RNA, 18 nt, Human
acuacuggaagagcuuug

SEQ ID NO: 81247 - RNA, 24 nt, Human
gggaggcggaggagguugcaguga

SEQ ID NO: 81248 - RNA, 23 nt, Human
ggugauuuuaugaucaguguugu

SEQ ID NO: 81249 - RNA, 20 nt, Human
gccucagggggccaggcugg

SEQ ID NO: 81250 - RNA, 27 nt, Human
agcugaguacauccuuaugcuacagca

SEQ ID NO: 81251 - RNA, 25 nt, Human
uccuccuagaaagagugggagagca

SEQ ID NO: 81252 - RNA, 22 nt, Human
ucucuugccuaaaucuuccucu

SEQ ID NO: 81253 - RNA, 22 nt, Human
ucauggucaaauuuaagaaacu

SEQ ID NO: 81254 - RNA, 19 nt, Human
ccuuggggagaugagggag

SEQ ID NO: 81255 - RNA, 21 nt, Human
agcuugacaagcauguccuca

SEQ ID NO: 81256 - RNA, 22 nt, Human
cccuaccugccagugcuggugu

SEQ ID NO: 81257 - RNA, 28 nt, Human
ccugccuugcccacuccugcucugcucg

SEQ ID NO: 81258 - RNA, 21 nt, Human
guuggccaggcugguuucaaa

SEQ ID NO: 81259 - RNA, 21 nt, Human
ugguaacauaaaagcaguuca

SEQ ID NO: 81260 - RNA, 21 nt, Human
gacacugccacauggagccac

SEQ ID NO: 81261 - RNA, 27 nt, Human
cccugcaggauccggcccucaaagacg

SEQ ID NO: 81262 - RNA, 27 nt, Human
aagccucuauagaaaguccucugugau

SEQ ID NO: 81263 - RNA, 27 nt, Human
gccuaucucucuucugcgugggaguau

SEQ ID NO: 81264 - RNA, 21 nt, Human
cacacugagggggcagugugg

SEQ ID NO: 81265 - RNA, 26 nt, Human
uucaaaccaacuaucuaucuaugcuu

SEQ ID NO: 81266 - RNA, 27 nt, Human
agcacuauuguaccuugaaaggauuuc

SEQ ID NO: 81267 - RNA, 20 nt, Human
uuuuugggcugggugcagug

SEQ ID NO: 81268 - RNA, 26 nt, Human
uccaucccaaccagugccaaggaccu

SEQ ID NO: 81269 - RNA, 23 nt, Human
ggaagcgggcuccaggagcaagc

SEQ ID NO: 81270 - RNA, 21 nt, Human
ggcaugcacccaccuaaccca

SEQ ID NO: 81271 - RNA, 23 nt, Human
auguuuugaaaauaaugaucuca

SEQ ID NO: 81272 - RNA, 22 nt, Human
gaccagccuggacaacacagug

SEQ ID NO: 81273 - RNA, 23 nt, Human
cccaggagguggagguuacagug

SEQ ID NO: 81274 - RNA, 18 nt, Human
uauuucuuaaaauucagu

SEQ ID NO: 81275 - RNA, 24 nt, Human
uaccugggaaggacucccaccuca

SEQ ID NO: 81276 - RNA, 24 nt, Human
ccagggaugcaaagguugcaguga

SEQ ID NO: 81277 - RNA, 22 nt, Human
agacccagggaucacuuagcca

SEQ ID NO: 81278 - RNA, 26 nt, Human
ggagagaagguuucacaugggaccca

SEQ ID NO: 81279 - RNA, 22 nt, Human
cagccuaucagugauugccauu

SEQ ID NO: 81280 - RNA, 21 nt, Human
agagcccaggcuggggaagug

SEQ ID NO: 81281 - RNA, 24 nt, Human
ugcuagugcccucucucugggccc

SEQ ID NO: 81282 - RNA, 28 nt, Human
gcuaugcugcuucccagccuggcuuccc

SEQ ID NO: 81283 - RNA, 20 nt, Human
cacgcugcuccccugggcag

SEQ ID NO: 81284 - RNA, 21 nt, Human
gagcacagcuauauacagugu

SEQ ID NO: 81285 - RNA, 23 nt, Human
agagagccgggaggcagagggag

SEQ ID NO: 81286 - RNA, 28 nt, Human
cagagcagcagaaaaggcaguuccucuu

SEQ ID NO: 81287 - RNA, 22 nt, Human
auucguacuauauuggccaaag

SEQ ID NO: 81288 - RNA, 22 nt, Human
uguuguagcuuuggagugcaga

SEQ ID NO: 81289 - RNA, 23 nt, Human
gcagucggucccugucauugucc

SEQ ID NO: 81290 - RNA, 20 nt, Human
aucucccagggcuacucacu

SEQ ID NO: 81291 - RNA, 19 nt, Human
ccuuucugcuguucuccca

SEQ ID NO: 81292 - RNA, 19 nt, Human
uguccccuucuccaucgcc

SEQ ID NO: 81293 - RNA, 20 nt, Human
cucaaagcugucgccgcuag

SEQ ID NO: 81294 - RNA, 23 nt, Human
ucucaauaacuuagugaaucacu

SEQ ID NO: 81295 - RNA, 22 nt, Human
caggcuggagugaaguggugug

SEQ ID NO: 81296 - RNA, 23 nt, Human
agggcuccacagaggccacaaaa

SEQ ID NO: 81297 - RNA, 24 nt, Human
cucuggcccucuaccuugcuuccu

SEQ ID NO: 81298 - RNA, 25 nt, Human
gcaauggucagcuuggaaaccacag

SEQ ID NO: 81299 - RNA, 22 nt, Human
cccuccugguucugcccugucc

SEQ ID NO: 81300 - RNA, 19 nt, Human
uacagacuuccuucuuaga

SEQ ID NO: 81301 - RNA, 22 nt, Human
auugacccacaaaguuucagaa

SEQ ID NO: 81302 - RNA, 22 nt, Human
gcucacaccuguaaucccaaca

SEQ ID NO: 81303 - RNA, 23 nt, Human
aguucagaugaaaucuguuacuc

SEQ ID NO: 81304 - RNA, 22 nt, Human
aaaugugagaacuucugcacua

SEQ ID NO: 81305 - RNA, 27 nt, Human
ggagaugggagagagauuuaagacaaa

SEQ ID NO: 81306 - RNA, 23 nt, Human
aggcccggaagugagcuggaaga

SEQ ID NO: 81307 - RNA, 27 nt, Human
guuucuauauuggucauugccuugcca

SEQ ID NO: 81308 - RNA, 23 nt, Human
aggcccaacugaccugcgcugga

SEQ ID NO: 81309 - RNA, 21 nt, Human
gagcuacagacgggggcgcgg

SEQ ID NO: 81310 - RNA, 22 nt, Human
cggucucaaacuccugaccuca

SEQ ID NO: 81311 - RNA, 22 nt, Human
ggcucugggguucuuaauucau

SEQ ID NO: 81312 - RNA, 27 nt, Human
cugcuucuaaaauugccccaccugcuc

SEQ ID NO: 81313 - RNA, 22 nt, Human
ugccuuccagccccuccaggac

SEQ ID NO: 81314 - RNA, 23 nt, Human
aaggagcccagccuucaccuucc

SEQ ID NO: 81315 - RNA, 22 nt, Human
cuccagcauaccccaccaccuu

SEQ ID NO: 81316 - RNA, 21 nt, Human
agcuuaccccuccugugcugg

SEQ ID NO: 81317 - RNA, 27 nt, Human
ccucucugccuccagccccaccuuccc

SEQ ID NO: 81318 - RNA, 19 nt, Human
acuaucucccuuauucucc

SEQ ID NO: 81319 - RNA, 24 nt, Human
aauagcaaaggaaaucacugugaa

SEQ ID NO: 81320 - RNA, 22 nt, Human
ggauaccucaugacauuuuccu

SEQ ID NO: 81321 - RNA, 22 nt, Human
augaucucggcucacugcaacc

SEQ ID NO: 81322 - RNA, 21 nt, Human
aagaguaaacauuacucagug

SEQ ID NO: 81323 - RNA, 23 nt, Human
aacuggacuugucuuccuuggcc

SEQ ID NO: 81324 - RNA, 20 nt, Human
augcaaagagaagcgagaga

SEQ ID NO: 81325 - RNA, 22 nt, Human
aucaacaaaagggagaacaugg

SEQ ID NO: 81326 - RNA, 23 nt, Human
cuaauuacaaaguucacuguuua

SEQ ID NO: 81327 - RNA, 22 nt, Human
ugacccuacucccuugcccuag

SEQ ID NO: 81328 - RNA, 23 nt, Human
aucacccaggcuggagugcagug

SEQ ID NO: 81329 - RNA, 25 nt, Human
cacgucugcugcaaccugaagcuug

SEQ ID NO: 81330 - RNA, 23 nt, Human
cuucaaacauguaugaguaguca

SEQ ID NO: 81331 - RNA, 21 nt, Human
ccuugccccuuugugucccag

SEQ ID NO: 81332 - RNA, 18 nt, Human
cuaguacaauauagugau

SEQ ID NO: 81333 - RNA, 21 nt, Human
ggugaggagggggcggcaaga

SEQ ID NO: 81334 - RNA, 24 nt, Human
ccccugccacuccucaaacucgca

SEQ ID NO: 81335 - RNA, 21 nt, Human
gagaacuggcucuuaagagca

SEQ ID NO: 81336 - RNA, 20 nt, Human
ccaaaacaagccaaagagcc

SEQ ID NO: 81337 - RNA, 24 nt, Human
aaaaaguuuauuuuagccauucua

SEQ ID NO: 81338 - RNA, 26 nt, Human
aaggagaccuguaucaaacugcuuuu

SEQ ID NO: 81339 - RNA, 25 nt, Human
cagcagauccacacccugggcaccu

SEQ ID NO: 81340 - RNA, 21 nt, Human
auaaucuccccuuugguuucc

SEQ ID NO: 81341 - RNA, 23 nt, Human
ucugagccaucugcugcucucuc

SEQ ID NO: 81342 - RNA, 21 nt, Human
uccugaaagaaaugcuagaag

SEQ ID NO: 81343 - RNA, 26 nt, Human
gcacagccccagacagacacgguggg

SEQ ID NO: 81344 - RNA, 22 nt, Human
agcgcagaugcuagcacaugcc

SEQ ID NO: 81345 - RNA, 26 nt, Human
cccacauuuuggcugucuaguauuca

SEQ ID NO: 81346 - RNA, 21 nt, Human
ggaggcacugggaagccuaga

SEQ ID NO: 81347 - RNA, 21 nt, Human
uugggcucuguuuucucagcu

SEQ ID NO: 81348 - RNA, 23 nt, Human
gaaucccagauaugguugcacaa

SEQ ID NO: 81349 - RNA, 25 nt, Human
uuagugcuuucuugucaguggcguu

SEQ ID NO: 81350 - RNA, 25 nt, Human
ugacccugcuuuguucuuucccuga

SEQ ID NO: 81351 - RNA, 24 nt, Human
cauaccuucaucagcaccagaagc

SEQ ID NO: 81352 - RNA, 23 nt, Human
caauugucaucacaauguuauau

SEQ ID NO: 81353 - RNA, 23 nt, Human
gccccaucugagcacauccagcu

SEQ ID NO: 81354 - RNA, 26 nt, Human
gucacccagaacuggaugguaccuga

SEQ ID NO: 81355 - RNA, 24 nt, Human
uguggucaucagaaaauaagccau

SEQ ID NO: 81356 - RNA, 22 nt, Human
uagcccaggcuggagugcaaug

SEQ ID NO: 81357 - RNA, 23 nt, Human
gcgaguguccagccaagggcuga

SEQ ID NO: 81358 - RNA, 19 nt, Human
uuuaucaacagaguuauuu

SEQ ID NO: 81359 - RNA, 24 nt, Human
uacaaaccauuaugauuuaugcua

SEQ ID NO: 81360 - RNA, 21 nt, Human
ucacauggucuuuccucugag

SEQ ID NO: 81361 - RNA, 27 nt, Human
guugcccaggcuggagugcaauggcgu

SEQ ID NO: 81362 - RNA, 25 nt, Human
auauuuuucuacuaguagauaggac

SEQ ID NO: 81363 - RNA, 23 nt, Human
ucuuguggaauugggagcuuggg

SEQ ID NO: 81364 - RNA, 19 nt, Human
augagucuuuauuuuuugu

SEQ ID NO: 81365 - RNA, 24 nt, Human
gcgagcgccugaccuuccuccucc

SEQ ID NO: 81366 - RNA, 22 nt, Human
caggcuggagcgcagucccgca

SEQ ID NO: 81367 - RNA, 22 nt, Human
ccucuacuggagaaucucagca

SEQ ID NO: 81368 - RNA, 28 nt, Human
agcuuccaccucauggauugccacagcu

SEQ ID NO: 81369 - RNA, 24 nt, Human
acagcuaccuggugagcugugcca

SEQ ID NO: 81370 - RNA, 23 nt, Human
ggagagggggccgcaguggcgac

SEQ ID NO: 81371 - RNA, 21 nt, Human
aaacccuggcucggagcccag

SEQ ID NO: 81372 - RNA, 19 nt, Human
uacuauugaaacuggugag

SEQ ID NO: 81373 - RNA, 25 nt, Human
gcgggaggggcgacaagagcugagc

SEQ ID NO: 81374 - RNA, 23 nt, Human
aucagccugggcaacauggugaa

SEQ ID NO: 81375 - RNA, 27 nt, Human
gucagagggacugucagcugagcuuga

SEQ ID NO: 81376 - RNA, 22 nt, Human
agaccuccggccugaaugaucu

SEQ ID NO: 81377 - RNA, 22 nt, Human
ccucaccacugugccucaaguu

SEQ ID NO: 81378 - RNA, 25 nt, Human
gggcagcaggccugguugcagcugg

SEQ ID NO: 81379 - RNA, 27 nt, Human
caguacacaugaacaaggccaguccuc

SEQ ID NO: 81380 - RNA, 23 nt, Human
caaaccugccucccacuucucac

SEQ ID NO: 81381 - RNA, 22 nt, Human
agugaaaagcagagaauuuuau

SEQ ID NO: 81382 - RNA, 22 nt, Human
ucuccauggcccugucccaggc

SEQ ID NO: 81383 - RNA, 20 nt, Human
uguucugcagagccugagcu

SEQ ID NO: 81384 - RNA, 20 nt, Human
gcccuuucugcacagcuggu

SEQ ID NO: 81385 - RNA, 24 nt, Human
accacaaugacagaaaugacaaca

SEQ ID NO: 81386 - RNA, 21 nt, Human
uggacuuuuauggcucuaucu

SEQ ID NO: 81387 - RNA, 22 nt, Human
gcuaggaaauaucauuaauuca

SEQ ID NO: 81388 - RNA, 27 nt, Human
aaggcauuccucaucaccaucguguuu

SEQ ID NO: 81389 - RNA, 26 nt, Human
gccgcucauggcggugaggugugugc

SEQ ID NO: 81390 - RNA, 27 nt, Human
caguucuguagcucaugagucuggcac

SEQ ID NO: 81391 - RNA, 22 nt, Human
caggccugguccccaagagcuu

SEQ ID NO: 81392 - RNA, 22 nt, Human
cuagguacuguaaucuaccaua

SEQ ID NO: 81393 - RNA, 26 nt, Human
cccugcucguuggcuguggcagggcc

SEQ ID NO: 81394 - RNA, 24 nt, Human
aggagguggggcgcguuucagugg

SEQ ID NO: 81395 - RNA, 26 nt, Human
cuccagccccagacaacagcccaggc

SEQ ID NO: 81396 - RNA, 22 nt, Human
ccucaacaggaacauugacuug

SEQ ID NO: 81397 - RNA, 18 nt, Human
cccugcuccccuccuacc

SEQ ID NO: 81398 - RNA, 23 nt, Human
ucugcccuuggggaaaugcuauc

SEQ ID NO: 81399 - RNA, 27 nt, Human
ggucucgaacuccugaccuagugaucu

SEQ ID NO: 81400 - RNA, 19 nt, Human
cgccucgggggcguuuuca

SEQ ID NO: 81401 - RNA, 20 nt, Human
cguguguuaaaaaguacuuu

SEQ ID NO: 81402 - RNA, 22 nt, Human
uuuccaauuauaugcuaauuaa

SEQ ID NO: 81403 - RNA, 17 nt, Human
uuugcacguuaacucua

SEQ ID NO: 81404 - RNA, 25 nt, Human
uggagaagugaaaugacaaccucac

SEQ ID NO: 81405 - RNA, 26 nt, Human
uucucaucuucugccucccuuccuac

SEQ ID NO: 81406 - RNA, 26 nt, Human
acacuacccugagaucugcacaguca

SEQ ID NO: 81407 - RNA, 21 nt, Human
guccgugugggcuuccaccuc

SEQ ID NO: 81408 - RNA, 21 nt, Human
uuuccuguaacugcuuuugcu

SEQ ID NO: 81409 - RNA, 26 nt, Human
ccugccucuuugugugcgucacugug

SEQ ID NO: 81410 - RNA, 24 nt, Human
uggugcucacgccuguaaucccag

SEQ ID NO: 81411 - RNA, 21 nt, Human
gagcgaugcuuaucucucaca

SEQ ID NO: 81412 - RNA, 21 nt, Human
ucguuuucuuuuccucuaggc

SEQ ID NO: 81413 - RNA, 22 nt, Human
uggugggcaccuguaaucccag

SEQ ID NO: 81414 - RNA, 18 nt, Human
agcauuccuuucucuuca

SEQ ID NO: 81415 - RNA, 21 nt, Human
uuuuuuaaaaaguuuauuuua

SEQ ID NO: 81416 - RNA, 18 nt, Human
uucucauuccuuuuccca

SEQ ID NO: 81417 - RNA, 21 nt, Human
caggagggauaaccggauuuc

SEQ ID NO: 81418 - RNA, 26 nt, Human
gcgcgggccaccaugggggcccagcu

SEQ ID NO: 81419 - RNA, 26 nt, Human
guucucaggcuggccagaagagacau

SEQ ID NO: 81420 - RNA, 25 nt, Human
ugcuauacucacagucuuguuuucc

SEQ ID NO: 81421 - RNA, 25 nt, Human
ucuuuuugccuuaagucauuuugga

SEQ ID NO: 81422 - RNA, 22 nt, Human
uuagugguuaaguggcuuuuca

SEQ ID NO: 81423 - RNA, 23 nt, Human
ucucuccugaagcuccauccccu

SEQ ID NO: 81424 - RNA, 19 nt, Human
uucccacuucagccuccca

SEQ ID NO: 81425 - RNA, 22 nt, Human
cugaagccucaguccuucaccu

SEQ ID NO: 81426 - RNA, 24 nt, Human
gccucuaugugcuguuuuuccuca

SEQ ID NO: 81427 - RNA, 21 nt, Human
ccuguaaucccagugacuugg

SEQ ID NO: 81428 - RNA, 21 nt, Human
ccugcauuccagccuaggcga

SEQ ID NO: 81429 - RNA, 27 nt, Human
ccuguucugugucugcuguaagacggc

SEQ ID NO: 81430 - RNA, 26 nt, Human
guguuuuuauaacuuauccauaugca

SEQ ID NO: 81431 - RNA, 20 nt, Human
ucuccagcuccacacauguu

SEQ ID NO: 81432 - RNA, 24 nt, Human
gcaagcacaucaugacccuuucug

SEQ ID NO: 81433 - RNA, 21 nt, Human
caccagccacugcuuccuccu

SEQ ID NO: 81434 - RNA, 27 nt, Human
gcugccuuuugggacuuaaaccccagc

SEQ ID NO: 81435 - RNA, 24 nt, Human
gagugacccggacagcuguccucu

SEQ ID NO: 81436 - RNA, 26 nt, Human
cagacaccuccuucuuccuagccagg

SEQ ID NO: 81437 - RNA, 21 nt, Human
uccugcuguuuggagauguga

SEQ ID NO: 81438 - RNA, 24 nt, Human
uuucuuccaaacuccugggccucc

SEQ ID NO: 81439 - RNA, 23 nt, Human
ccgggggcauuugguccccaaau

SEQ ID NO: 81440 - RNA, 21 nt, Human
gcucugacccucuccugggca

SEQ ID NO: 81441 - RNA, 26 nt, Human
aaaugagagacauuuuguaacccugu

SEQ ID NO: 81442 - RNA, 27 nt, Human
ggaggcugaggcaugagaauugcuuga

SEQ ID NO: 81443 - RNA, 21 nt, Human
gagagagcuuccuaggccugg

SEQ ID NO: 81444 - RNA, 22 nt, Human
ggagagggaggagguugcaaaa

SEQ ID NO: 81445 - RNA, 24 nt, Human
aggcugaggcaggauaauuuugcu

SEQ ID NO: 81446 - RNA, 23 nt, Human
cccaccccgaauucugucugcuu

SEQ ID NO: 81447 - RNA, 20 nt, Human
aacaccaccaaguuccucca

SEQ ID NO: 81448 - RNA, 21 nt, Human
cugguccacuaaaugcagccu

SEQ ID NO: 81449 - RNA, 22 nt, Human
gaacagcuuggccuuuuguggg

SEQ ID NO: 81450 - RNA, 24 nt, Human
ucuguaccuuucuaaaccucucuu

SEQ ID NO: 81451 - RNA, 26 nt, Human
ucccugagagaaguagcacucagguu

SEQ ID NO: 81452 - RNA, 27 nt, Human
uucaaaccccuacugaccuggcuggug

SEQ ID NO: 81453 - RNA, 27 nt, Human
ucagcacaccuuggaugggggaggcgg

SEQ ID NO: 81454 - RNA, 21 nt, Human
cacugcagaaacccugagcag

SEQ ID NO: 81455 - RNA, 22 nt, Human
cuuuuaugguuguccaguuugc

SEQ ID NO: 81456 - RNA, 24 nt, Human
uggagagaaguugacguggaaagg

SEQ ID NO: 81457 - RNA, 23 nt, Human
ucuggaaucccuuucucauuagc

SEQ ID NO: 81458 - RNA, 27 nt, Human
ugccugagcugcagcucuccaccagcu

SEQ ID NO: 81459 - RNA, 22 nt, Human
ucccaggaucugcuccaacaga

SEQ ID NO: 81460 - RNA, 22 nt, Human
aaccucuggguccguucucgaa

SEQ ID NO: 81461 - RNA, 21 nt, Human
ugccuucaggguaggcucuga

SEQ ID NO: 81462 - RNA, 21 nt, Human
ucauccaggucaagacuaagu

SEQ ID NO: 81463 - RNA, 25 nt, Human
aaggggcagcaggggguguguuugu

SEQ ID NO: 81464 - RNA, 22 nt, Human
caggaggcgaagauugcaguga

SEQ ID NO: 81465 - RNA, 30 nt, Human
guaauuaaauccuucuaaauauuugaacua

SEQ ID NO: 81466 - RNA, 26 nt, Human
cuuuauuacgauuaguauaugaucaa

SEQ ID NO: 81467 - RNA, 21 nt, Human
ccagcucuccccaagugcucc

SEQ ID NO: 81468 - RNA, 27 nt, Human
gggagagaagauacagacauggaggag

SEQ ID NO: 81469 - RNA, 26 nt, Human
gugguugccaaugucugagggagguu

SEQ ID NO: 81470 - RNA, 22 nt, Human
augccugugauccuagcacuuu

SEQ ID NO: 81471 - RNA, 24 nt, Human
cuguccucuauggcaaugaucuca

SEQ ID NO: 81472 - RNA, 21 nt, Human
aaagugcuggauuacaggcgu

SEQ ID NO: 81473 - RNA, 22 nt, Human
uucuguugaggaaagauaaaaa

SEQ ID NO: 81474 - RNA, 21 nt, Human
agccucauacccgugcccuca

SEQ ID NO: 81475 - RNA, 17 nt, Human
gccuaaaaaugauuuug

SEQ ID NO: 81476 - RNA, 21 nt, Human
gacuccugaagcccugcgcua

SEQ ID NO: 81477 - RNA, 26 nt, Human
cacuggccuggcuggaccaguacugc

SEQ ID NO: 81478 - RNA, 21 nt, Human
accuguaauccuagcacuuug

SEQ ID NO: 81479 - RNA, 30 nt, Human
ggugcagccuacauggcacaggauauuucc

SEQ ID NO: 81480 - RNA, 27 nt, Human
aaaaguuugauuuacauuuauauuccu

SEQ ID NO: 81481 - RNA, 26 nt, Human
cugugucacccaggcuggagugcagu

SEQ ID NO: 81482 - RNA, 22 nt, Human
ugaacucagaaggauggcauuu

SEQ ID NO: 81483 - RNA, 28 nt, Human
uggugaaagacgguuggggaugggggga

SEQ ID NO: 81484 - RNA, 27 nt, Human
uagcuuugucuaguuuauagcaccuua

SEQ ID NO: 81485 - RNA, 24 nt, Human
accuucucuccuuccucuuccuca

SEQ ID NO: 81486 - RNA, 21 nt, Human
gagcacuuacaaggcuguggu

SEQ ID NO: 81487 - RNA, 25 nt, Human
guuuuuaaaaaccauauacugacug

SEQ ID NO: 81488 - RNA, 20 nt, Human
acuguacaaaugugaagaau

SEQ ID NO: 81489 - RNA, 19 nt, Human
acgacucuaccauguccag

SEQ ID NO: 81490 - RNA, 25 nt, Human
ccaggagacucaugaggacugugug

SEQ ID NO: 81491 - RNA, 23 nt, Human
uucagugcucauacguaucugcu

SEQ ID NO: 81492 - RNA, 22 nt, Human
gagaacaacaagguacccagaa

SEQ ID NO: 81493 - RNA, 18 nt, Human
uucuuuucauaauccacu

SEQ ID NO: 81494 - RNA, 22 nt, Human
acuacucuguccucugccugug

SEQ ID NO: 81495 - RNA, 22 nt, Human
ccaacacagccuccacugugau

SEQ ID NO: 81496 - RNA, 26 nt, Human
gcuggcuggcugcuugcacccacauc

SEQ ID NO: 81497 - RNA, 21 nt, Human
acugcccucucccugccuggg

SEQ ID NO: 81498 - RNA, 21 nt, Human
ggauacguacaccucuugccu

SEQ ID NO: 81499 - RNA, 19 nt, Human
uaaguugcccagcccaggg

SEQ ID NO: 81500 - RNA, 21 nt, Human
cgaagggauuccuggagcagc

SEQ ID NO: 81501 - RNA, 21 nt, Human
accuauaaccccagcacuuug

SEQ ID NO: 81502 - RNA, 22 nt, Human
ccacugcacuccggccuaggug

SEQ ID NO: 81503 - RNA, 24 nt, Human
cuccccagcuucuggacgcguuug

SEQ ID NO: 81504 - RNA, 22 nt, Human
gguuauuuggaagcaguuuccu

SEQ ID NO: 81505 - RNA, 29 nt, Human
agguucucccagagaguagugugauggga

SEQ ID NO: 81506 - RNA, 24 nt, Human
uggggcucugggcgcuguugccug

SEQ ID NO: 81507 - RNA, 22 nt, Human
cucugcaccuaguuuuuuccca

SEQ ID NO: 81508 - RNA, 24 nt, Human
cagaaacaugcauuugccauaaau

SEQ ID NO: 81509 - RNA, 20 nt, Human
acccucucugggccucaguu

SEQ ID NO: 81510 - RNA, 22 nt, Human
uggaaaacuuuucucaguuuac

SEQ ID NO: 81511 - RNA, 22 nt, Human
uguguggcuuccugccucugca

SEQ ID NO: 81512 - RNA, 21 nt, Human
ccggccaccugcagagccucu

SEQ ID NO: 81513 - RNA, 22 nt, Human
aggccguucuaaggaacacugu

SEQ ID NO: 81514 - RNA, 26 nt, Human
ugaacaaaagcagguuuuuauaugua

SEQ ID NO: 81515 - RNA, 23 nt, Human
ugucaucugcagccucugccucc

SEQ ID NO: 81516 - RNA, 25 nt, Human
gcgcgccucccaccuuccaccccca

SEQ ID NO: 81517 - RNA, 22 nt, Human
cuuggugguuuucuuuccuaac

SEQ ID NO: 81518 - RNA, 21 nt, Human
aagaacauauucauauuauac

SEQ ID NO: 81519 - RNA, 22 nt, Human
aaagugcugggauuaccgguau

SEQ ID NO: 81520 - RNA, 22 nt, Human
gagaagaucuggucagcagagc

SEQ ID NO: 81521 - RNA, 16 nt, Human
gcaaaguuauauuuac

SEQ ID NO: 81522 - RNA, 24 nt, Human
cugauuucuauggcuuucaaagcu

SEQ ID NO: 81523 - RNA, 21 nt, Human
aauggccauggaauaaaccau

SEQ ID NO: 81524 - RNA, 24 nt, Human
uugcuguggcuggagcuggacagu

SEQ ID NO: 81525 - RNA, 21 nt, Human
gguucacugcaaccuccgccu

SEQ ID NO: 81526 - RNA, 22 nt, Human
uaugagcucaucuagcaaucag

SEQ ID NO: 81527 - RNA, 24 nt, Human
gcauucaggccaagcccauccugc

SEQ ID NO: 81528 - RNA, 24 nt, Human
aauacucuuucacuuaauucuuua

SEQ ID NO: 81529 - RNA, 27 nt, Human
ugcagugagccaugauucacagcacug

SEQ ID NO: 81530 - RNA, 27 nt, Human
ugcugggacugcccagggaggaggccu

SEQ ID NO: 81531 - RNA, 27 nt, Human
uguaugcugggauacccauuaaaacca

SEQ ID NO: 81532 - RNA, 27 nt, Human
caaccaacaaacaaugccaucacugga

SEQ ID NO: 81533 - RNA, 23 nt, Human
ccuacuuccuuccagugccauga

SEQ ID NO: 81534 - RNA, 24 nt, Human
uccagcucuggcacagugguuccu

SEQ ID NO: 81535 - RNA, 25 nt, Human
agugcugccucacauugggccucag

SEQ ID NO: 81536 - RNA, 21 nt, Human
cugucacccaggcuggagugc

SEQ ID NO: 81537 - RNA, 22 nt, Human
gaauuugccauucugcuguaca

SEQ ID NO: 81538 - RNA, 27 nt, Human
ccguucccccuaacauccucagagaac

SEQ ID NO: 81539 - RNA, 26 nt, Human
uucuggcuucuucucaaacccugagc

SEQ ID NO: 81540 - RNA, 28 nt, Human
uuacauuccauucaccuaacuuuagaca

SEQ ID NO: 81541 - RNA, 22 nt, Human
gugccggcccugcagugccugc

SEQ ID NO: 81542 - RNA, 28 nt, Human
gcacagagcguccuucccccuguagacu

SEQ ID NO: 81543 - RNA, 21 nt, Human
acccaagacaugacauucuua

SEQ ID NO: 81544 - RNA, 27 nt, Human
cccaacuaccagagaacgcuguccccc

SEQ ID NO: 81545 - RNA, 26 nt, Human
cugggaggcucuggagcccacuguac

SEQ ID NO: 81546 - RNA, 23 nt, Human
ccagaaggcagagguuguaguga

SEQ ID NO: 81547 - RNA, 27 nt, Human
gcagcccugucugaaggacacuuccug

SEQ ID NO: 81548 - RNA, 23 nt, Human
caccuguaaucccagcuacucug

SEQ ID NO: 81549 - RNA, 21 nt, Human
gguggagaaggaaaaaacccu

SEQ ID NO: 81550 - RNA, 26 nt, Human
aaaagcuuguccaucacucuaguagg

SEQ ID NO: 81551 - RNA, 26 nt, Human
uuucugcugaugaacaaaucugcacc

SEQ ID NO: 81552 - RNA, 25 nt, Human
cgcaagagugacacacagguguuca

SEQ ID NO: 81553 - RNA, 28 nt, Human
cacaagagagggcccaggaaaaaagguu

SEQ ID NO: 81554 - RNA, 20 nt, Human
cuucuacuugccugccuccc

SEQ ID NO: 81555 - RNA, 23 nt, Human
caagugucugccuuaucaaaaga

SEQ ID NO: 81556 - RNA, 20 nt, Human
guggugagucgcggucuguu

SEQ ID NO: 81557 - RNA, 26 nt, Human
cagagcuguggagaggggacccuaag

SEQ ID NO: 81558 - RNA, 26 nt, Human
acauuccaccauuuuaauuuuuguaa

SEQ ID NO: 81559 - RNA, 20 nt, Human
aguuugcaaaagcacuuuga

SEQ ID NO: 81560 - RNA, 16 nt, Human
uaccccuuggaaaugu

SEQ ID NO: 81561 - RNA, 23 nt, Human
ggggcauuccugcuucucucuca

SEQ ID NO: 81562 - RNA, 19 nt, Human
ugagacaaauuuccucuug

SEQ ID NO: 81563 - RNA, 22 nt, Human
gccaguauuaugcauauauaag

SEQ ID NO: 81564 - RNA, 27 nt, Human
agcuacuuaacaaugacaaauauuuca

SEQ ID NO: 81565 - RNA, 19 nt, Human
cauagcccuuccuaggcag

SEQ ID NO: 81566 - RNA, 21 nt, Human
gccuccacccagccacaucuu

SEQ ID NO: 81567 - RNA, 24 nt, Human
ccaggagggacccaggaaacuaag

SEQ ID NO: 81568 - RNA, 13 nt, Human
ggcccccaccucc

SEQ ID NO: 81569 - RNA, 23 nt, Human
gugaguggguugagggaggcagu

SEQ ID NO: 81570 - RNA, 21 nt, Human
acguuauuuuccugguggcug

SEQ ID NO: 81571 - RNA, 21 nt, Human
acuuuuuguauagaaagcacu

SEQ ID NO: 81572 - RNA, 22 nt, Human
aacaacaagagagggcaagucc

SEQ ID NO: 81573 - RNA, 22 nt, Human
acagccucccuggcuacauggu

SEQ ID NO: 81574 - RNA, 27 nt, Human
cuuuuacugcuggcugggaaggaggag

SEQ ID NO: 81575 - RNA, 21 nt, Human
cgguccccccucacuccacac

SEQ ID NO: 81576 - RNA, 19 nt, Human
uugugcucaggccuguguu

SEQ ID NO: 81577 - RNA, 23 nt, Human
uacaugucaccgaagcaagugua

SEQ ID NO: 81578 - RNA, 22 nt, Human
aagaauaagaaggaaggguugg

SEQ ID NO: 81579 - RNA, 20 nt, Human
auugggagagagaggccuga

SEQ ID NO: 81580 - RNA, 18 nt, Human
ccuacaaauguaaagaau

SEQ ID NO: 81581 - RNA, 28 nt, Human
ggaguagcugggauuacaggcacaugcc

SEQ ID NO: 81582 - RNA, 20 nt, Human
gcugggugguguacaagcau

SEQ ID NO: 81583 - RNA, 21 nt, Human
gacaugcaugguuuaacuucc

SEQ ID NO: 81584 - RNA, 23 nt, Human
ucuucauaaaguucugcguuugg

SEQ ID NO: 81585 - RNA, 23 nt, Human
ucugggcuucacagcuugaguua

SEQ ID NO: 81586 - RNA, 27 nt, Human
guugcccaggcuggagugcaauggcgc

SEQ ID NO: 81587 - RNA, 27 nt, Human
gucgcccaggcuggagugcaauggcgu

SEQ ID NO: 81588 - RNA, 20 nt, Human
ccccugcccugcccaccuca

SEQ ID NO: 81589 - RNA, 24 nt, Human
ggcacgccugccuucuccccucca

SEQ ID NO: 81590 - RNA, 27 nt, Human
ucauuaaggagcggaggcuuuuggagc

SEQ ID NO: 81591 - RNA, 25 nt, Human
cugguggcccugcuucuucccauug

SEQ ID NO: 81592 - RNA, 27 nt, Human
gugagccaggcaggguagggauuagug

SEQ ID NO: 81593 - RNA, 22 nt, Human
agagggcccucugaugccccac

SEQ ID NO: 81594 - RNA, 23 nt, Human
gggaguccagggagggagcugag

SEQ ID NO: 81595 - RNA, 26 nt, Human
cugccucuucuugcucacugugugac

SEQ ID NO: 81596 - RNA, 23 nt, Human
uaaaacagaucccuucugcccca

SEQ ID NO: 81597 - RNA, 19 nt, Human
cugccugggugaaugcugc

SEQ ID NO: 81598 - RNA, 26 nt, Human
cagucuuagagguugcaguacuauau

SEQ ID NO: 81599 - RNA, 21 nt, Human
cggcuccccucgacagcucuc

SEQ ID NO: 81600 - RNA, 23 nt, Human
cacuuuauugugagucuuugcca

SEQ ID NO: 81601 - RNA, 24 nt, Human
ucuuucagaagaccugguggggca

SEQ ID NO: 81602 - RNA, 23 nt, Human
cggagccauuuuuagcucugauc

SEQ ID NO: 81603 - RNA, 27 nt, Human
ccucugucucugcucuugccucgaccc

SEQ ID NO: 81604 - RNA, 20 nt, Human
uaacaccauuagacacucac

SEQ ID NO: 81605 - RNA, 18 nt, Human
gauacuuccuguugccgg

SEQ ID NO: 81606 - RNA, 21 nt, Human
cuuuguaucacauuuccuaag

SEQ ID NO: 81607 - RNA, 23 nt, Human
ggccuccaggaggggccugggca

SEQ ID NO: 81608 - RNA, 22 nt, Human
uaaaagcaaguccugcaaccaa

SEQ ID NO: 81609 - RNA, 25 nt, Human
uaaaggauuuggugaaacauuugua

SEQ ID NO: 81610 - RNA, 21 nt, Human
cuguucuguagguuaagucca

SEQ ID NO: 81611 - RNA, 22 nt, Human
gcugcucuuaugugaggaccag

SEQ ID NO: 81612 - RNA, 23 nt, Human
ccaucaucuuccgcgcaggugcc

SEQ ID NO: 81613 - RNA, 23 nt, Human
aucacgucacugcacuccagcuu

SEQ ID NO: 81614 - RNA, 25 nt, Human
aggaguggaggucagagugucacuu

SEQ ID NO: 81615 - RNA, 18 nt, Human
cccaccccccacccccca

SEQ ID NO: 81616 - RNA, 16 nt, Human
gcaaggaagcagucuc

SEQ ID NO: 81617 - RNA, 26 nt, Human
cccaacaccuuccaugacacuuccuu

SEQ ID NO: 81618 - RNA, 27 nt, Human
ugcagcuccuccccuugggcaggcugg

SEQ ID NO: 81619 - RNA, 27 nt, Human
aaguccccaggugaacauggcugaaga

SEQ ID NO: 81620 - RNA, 24 nt, Human
gccacugcacaggaggaggugaca

SEQ ID NO: 81621 - RNA, 22 nt, Human
auguccacacaccagcccacgg

SEQ ID NO: 81622 - RNA, 22 nt, Human
aaggaacacccggaaagacuga

SEQ ID NO: 81623 - RNA, 20 nt, Human
uucagagacugcccuucuca

SEQ ID NO: 81624 - RNA, 25 nt, Human
uccagccccucgcccugugccaccc

SEQ ID NO: 81625 - RNA, 23 nt, Human
ugggcacauccucuccucucucc

SEQ ID NO: 81626 - RNA, 22 nt, Human
uaguuauucacugugcuccugu

SEQ ID NO: 81627 - RNA, 26 nt, Human
cccuccaggcuccgggacccggcccg

SEQ ID NO: 81628 - RNA, 21 nt, Human
ggcaaucuuggcacacguggg

SEQ ID NO: 81629 - RNA, 24 nt, Human
gcuucugacuccugggacuuugga

SEQ ID NO: 81630 - RNA, 25 nt, Human
uuucaauuaggcagcacuucccaaa

SEQ ID NO: 81631 - RNA, 23 nt, Human
auagcacuuuguuucuucaccuu

SEQ ID NO: 81632 - RNA, 21 nt, Human
agacaaguaaaacaauguuuc

SEQ ID NO: 81633 - RNA, 22 nt, Human
cacuuuuggggccaauggagaa

SEQ ID NO: 81634 - RNA, 29 nt, Human
cagacucaaaacacucauucuuuuuucua

SEQ ID NO: 81635 - RNA, 26 nt, Human
ccuuuucucccugccugauucucuga

SEQ ID NO: 81636 - RNA, 23 nt, Human
cucaagugaucugccugccucag

SEQ ID NO: 81637 - RNA, 23 nt, Human
cucaggugaucuaccugccucag

SEQ ID NO: 81638 - RNA, 22 nt, Human
gagguggggaaacugaguccac

SEQ ID NO: 81639 - RNA, 26 nt, Human
gggcccgguccugccugucagcucca

SEQ ID NO: 81640 - RNA, 21 nt, Human
uucagguucuccacugacuca

SEQ ID NO: 81641 - RNA, 21 nt, Human
gaauugggagccucugccacc

SEQ ID NO: 81642 - RNA, 22 nt, Human
cuguguauuuaauaaauggaca

SEQ ID NO: 81643 - RNA, 28 nt, Human
gaggaagaucgaugaguucuggugucgg

SEQ ID NO: 81644 - RNA, 21 nt, Human
ucaucccacuuccuuuccuac

SEQ ID NO: 81645 - RNA, 23 nt, Human
cugcuagugggauucuauauuuc

SEQ ID NO: 81646 - RNA, 25 nt, Human
accacaaccucugccuacuggguuc

SEQ ID NO: 81647 - RNA, 24 nt, Human
ggucaucaaaaaaggaguguaaua

SEQ ID NO: 81648 - RNA, 23 nt, Human
gccguuucuccccugggcucgga

SEQ ID NO: 81649 - RNA, 20 nt, Human
acuaucucaugccagugccu

SEQ ID NO: 81650 - RNA, 24 nt, Human
aggccagcucacacucugcugcac

SEQ ID NO: 81651 - RNA, 21 nt, Human
aucugaaauauguuuccauca

SEQ ID NO: 81652 - RNA, 21 nt, Human
acugccucagcuucccuagua

SEQ ID NO: 81653 - RNA, 26 nt, Human
ugcuuuguuugcuuuaaaaauuccac

SEQ ID NO: 81654 - RNA, 27 nt, Human
cacagugucuguucagcaaacuaacca

SEQ ID NO: 81655 - RNA, 19 nt, Human
ucagaugcaugacacaagg

SEQ ID NO: 81656 - RNA, 26 nt, Human
uggcaucaaggacucagggggaaaga

SEQ ID NO: 81657 - RNA, 19 nt, Human
agggacaccucgcccuuca

SEQ ID NO: 81658 - RNA, 24 nt, Human
acccuuuaauacauuacaucccug

SEQ ID NO: 81659 - RNA, 26 nt, Human
gccacuggaccacaggaggugugaua

SEQ ID NO: 81660 - RNA, 27 nt, Human
cuggggcaaaauuagaccucaagucug

SEQ ID NO: 81661 - RNA, 18 nt, Human
gagaauugcagagaauca

SEQ ID NO: 81662 - RNA, 27 nt, Human
uucuaguuccaguuuaguuugcugcua

SEQ ID NO: 81663 - RNA, 22 nt, Human
cucuucccucucccugccucac

SEQ ID NO: 81664 - RNA, 28 nt, Human
gcucugcaucccuucucccauaccuugc

SEQ ID NO: 81665 - RNA, 19 nt, Human
uuugucuccccuagucccc

SEQ ID NO: 81666 - RNA, 20 nt, Human
cucaaagcugacuuugccaa

SEQ ID NO: 81667 - RNA, 19 nt, Human
augcugggguccuugggga

SEQ ID NO: 81668 - RNA, 20 nt, Human
caccuggcuaccauuuuguu

SEQ ID NO: 81669 - RNA, 20 nt, Human
cagagccuggaccaaugccc

SEQ ID NO: 81670 - RNA, 22 nt, Human
ugcccaggcuggaguacaguga

SEQ ID NO: 81671 - RNA, 26 nt, Human
uaucccucgucauguggcaguauuua

SEQ ID NO: 81672 - RNA, 21 nt, Human
ucaggaaugaagauaaaagua

SEQ ID NO: 81673 - RNA, 27 nt, Human
ggacauaagccaacaagagaaaccauc

SEQ ID NO: 81674 - RNA, 22 nt, Human
ccaacaugaugaaaccccgucu

SEQ ID NO: 81675 - RNA, 22 nt, Human
acaaaacaaaacacagcuuauc

SEQ ID NO: 81676 - RNA, 27 nt, Human
aaaguucugggauuacaaguaauacaa

SEQ ID NO: 81677 - RNA, 21 nt, Human
cacugcacuccagccuggcaa

SEQ ID NO: 81678 - RNA, 21 nt, Human
cauugcacucuagccuggcaa

SEQ ID NO: 81679 - RNA, 29 nt, Human
acagucagucaggaugacacuucggcauc

SEQ ID NO: 81680 - RNA, 20 nt, Human
acuuagugacuugacugaga

SEQ ID NO: 81681 - RNA, 23 nt, Human
auagagaaguugauugucccuua

SEQ ID NO: 81682 - RNA, 22 nt, Human
gcuggguguguuggcacaugcc

SEQ ID NO: 81683 - RNA, 21 nt, Human
uagucucuucuuuaugucuac

SEQ ID NO: 81684 - RNA, 21 nt, Human
uuccuccugguucaagcgauu

SEQ ID NO: 81685 - RNA, 24 nt, Human
gcacagccaccagcagccagcccc

SEQ ID NO: 81686 - RNA, 21 nt, Human
uuccuaagugcucgccgcggu

SEQ ID NO: 81687 - RNA, 21 nt, Human
accuuugcccacacacacucc

SEQ ID NO: 81688 - RNA, 26 nt, Human
auauuccuauuacuuuugauuguguc

SEQ ID NO: 81689 - RNA, 22 nt, Human
uuuaauucucacaaccaaccag

SEQ ID NO: 81690 - RNA, 18 nt, Human
ucgaugaucaccaagcag

SEQ ID NO: 81691 - RNA, 26 nt, Human
cucccgggcugggcuuuugaauuggc

SEQ ID NO: 81692 - RNA, 21 nt, Human
acagugagccaagaucgcgcc

SEQ ID NO: 81693 - RNA, 21 nt, Human
gcagugagccaagaucacgcc

SEQ ID NO: 81694 - RNA, 23 nt, Human
gccaggauuccaggcagcagguu

SEQ ID NO: 81695 - RNA, 28 nt, Human
guuugcugguuguaaauacuuuguccua

SEQ ID NO: 81696 - RNA, 27 nt, Human
gcuguuacucagccccugagucugacu

SEQ ID NO: 81697 - RNA, 26 nt, Human
agucauucaguggaaagaugcacguu

SEQ ID NO: 81698 - RNA, 22 nt, Human
agccuccuggguagcugggauu

SEQ ID NO: 81699 - RNA, 31 nt, Human
ggaguccagcagcaggccgcauugcccgucu

SEQ ID NO: 81700 - RNA, 24 nt, Human
cccucacccaaaagaauuaucauc

SEQ ID NO: 81701 - RNA, 23 nt, Human
ggggccacaugugugaauuuuac

SEQ ID NO: 81702 - RNA, 25 nt, Human
ccuaugguuacagcauuaaacucua

SEQ ID NO: 81703 - RNA, 26 nt, Human
gucucuguuucuuuguucauuuauua

SEQ ID NO: 81704 - RNA, 23 nt, Human
ugggcugcaggagguugcggcgg

SEQ ID NO: 81705 - RNA, 26 nt, Human
ccgggagggggcaccgggaggaggug

SEQ ID NO: 81706 - RNA, 29 nt, Human
gaugcggacucauccucagccagcgccca

SEQ ID NO: 81707 - RNA, 24 nt, Human
gccagcuacagccuccuccgagcc

SEQ ID NO: 81708 - RNA, 25 nt, Human
uuaggaaaagcaucugccacaaaaa

SEQ ID NO: 81709 - RNA, 21 nt, Human
aggauaauugggcaaauaaau

SEQ ID NO: 81710 - RNA, 27 nt, Human
accguaaccucugccuccugacuucaa

SEQ ID NO: 81711 - RNA, 20 nt, Human
uuagcugccagucaccaccu

SEQ ID NO: 81712 - RNA, 22 nt, Human
cauucuacaaaucagcuggaug

SEQ ID NO: 81713 - RNA, 21 nt, Human
guugaguuagaaaugccuuca

SEQ ID NO: 81714 - RNA, 20 nt, Human
ccgccgcggacuccagcaca

SEQ ID NO: 81715 - RNA, 20 nt, Human
ccaggcagcagacacaugcc

SEQ ID NO: 81716 - RNA, 25 nt, Human
caugguggcggguagacaagggaug

SEQ ID NO: 81717 - RNA, 22 nt, Human
ggugggguuucaccauauugcc

SEQ ID NO: 81718 - RNA, 19 nt, Human
ggagggagggagaucauga

SEQ ID NO: 81719 - RNA, 21 nt, Human
gacacugucuuccuucaagag

SEQ ID NO: 81720 - RNA, 24 nt, Human
ucgucucugcccugaugcugccuc

SEQ ID NO: 81721 - RNA, 24 nt, Human
ugcagugacuugucaucaagaguc

SEQ ID NO: 81722 - RNA, 21 nt, Human
ucucagccccaucgccccaac

SEQ ID NO: 81723 - RNA, 19 nt, Human
ccagcacuuuggaaggcug

SEQ ID NO: 81724 - RNA, 20 nt, Human
guagaauggagagggaccgg

SEQ ID NO: 81725 - RNA, 24 nt, Human
ggggguaccuuaagagacacucca

SEQ ID NO: 81726 - RNA, 22 nt, Human
gcucaggacuacuuucuggguc

SEQ ID NO: 81727 - RNA, 24 nt, Human
uccccgggaaccucaggcccgcgg

SEQ ID NO: 81728 - RNA, 20 nt, Human
uggaguacacugaugcugaa

SEQ ID NO: 81729 - RNA, 19 nt, Human
guagcagaauaauucuucc

SEQ ID NO: 81730 - RNA, 21 nt, Human
aucacaaaaugauauuuaaua

SEQ ID NO: 81731 - RNA, 22 nt, Human
guugccaaaagucacuaucaca

SEQ ID NO: 81732 - RNA, 22 nt, Human
uucuaaugucuguuagcuaccc

SEQ ID NO: 81733 - RNA, 22 nt, Human
gaaagagagggcuacacugcua

SEQ ID NO: 81734 - RNA, 19 nt, Human
aggauggagagcagccagc

SEQ ID NO: 81735 - RNA, 27 nt, Human
ucaugcugagcgcucucuuaggcacag

SEQ ID NO: 81736 - RNA, 30 nt, Human
ggcugaagggagaguagauggugcaaagca

SEQ ID NO: 81737 - RNA, 22 nt, Human
ccgggaggcggagguugcagug

SEQ ID NO: 81738 - RNA, 22 nt, Human
ucgggagguggagguugcagug

SEQ ID NO: 81739 - RNA, 18 nt, Human
agggcacagggcccugcu

SEQ ID NO: 81740 - RNA, 28 nt, Human
cagcuugggggaguguuccuucacccuc

SEQ ID NO: 81741 - RNA, 23 nt, Human
guuugaugaaggggagugacagg

SEQ ID NO: 81742 - RNA, 20 nt, Human
uucuauugacuuugcaccug

SEQ ID NO: 81743 - RNA, 23 nt, Human
ggcggccucagaguccacggagc

SEQ ID NO: 81744 - RNA, 23 nt, Human
aaauguucuuuaacuauauacua

SEQ ID NO: 81745 - RNA, 22 nt, Human
gcaugagccaccgugccugucc

SEQ ID NO: 81746 - RNA, 21 nt, Human
cccugcucccuuugcuggguc

SEQ ID NO: 81747 - RNA, 23 nt, Human
aaauuagcuaaugcuuucuuguu

SEQ ID NO: 81748 - RNA, 22 nt, Human
cuguggcccaggccuccugggu

SEQ ID NO: 81749 - RNA, 23 nt, Human
gggcugaggucagggaggucuga

SEQ ID NO: 81750 - RNA, 25 nt, Human
cuuuuuaacacagaaauacuuccug

SEQ ID NO: 81751 - RNA, 23 nt, Human
guugugucugugcccuccaaaga

SEQ ID NO: 81752 - RNA, 24 nt, Human
ccauggaggaauuuguaacgaucg

SEQ ID NO: 81753 - RNA, 25 nt, Human
gcugcugcugcuucccaagauccuc

SEQ ID NO: 81754 - RNA, 27 nt, Human
ucuucuuuccuaugcccucucugugga

SEQ ID NO: 81755 - RNA, 21 nt, Human
cuccaucuucuggcaaggaca

SEQ ID NO: 81756 - RNA, 23 nt, Human
ugggggcugggugcaguggcuca

SEQ ID NO: 81757 - RNA, 22 nt, Human
accagccuggguaacauaguga

SEQ ID NO: 81758 - RNA, 23 nt, Human
cugcaaccaccaucucccaggag

SEQ ID NO: 81759 - RNA, 27 nt, Human
agcuuugaaaaguuguggccugcuugu

SEQ ID NO: 81760 - RNA, 28 nt, Human
aaguuugcaguuacaggccaguucucca

SEQ ID NO: 81761 - RNA, 24 nt, Human
gcagccacagaagcugugccugaa

SEQ ID NO: 81762 - RNA, 22 nt, Human
cacgaggucaggaggucgagau

SEQ ID NO: 81763 - RNA, 26 nt, Human
cuugcacuuguuauucgaaccacuga

SEQ ID NO: 81764 - RNA, 23 nt, Human
ugaaggcugugggaucuauuaca

SEQ ID NO: 81765 - RNA, 26 nt, Human
uaguaaaagaauaaaucuccuaagca

SEQ ID NO: 81766 - RNA, 19 nt, Human
aggaggggaggugcaggga

SEQ ID NO: 81767 - RNA, 18 nt, Human
ucaggcuggaggccagcc

SEQ ID NO: 81768 - RNA, 22 nt, Human
cacugcacuccauccuggguga

SEQ ID NO: 81769 - RNA, 23 nt, Human
augugcacuuuauccucauucca

SEQ ID NO: 81770 - RNA, 22 nt, Human
uacuuccugcauuuuaacaaga

SEQ ID NO: 81771 - RNA, 26 nt, Human
ugaguauuuaaagcccguuuugaaau

SEQ ID NO: 81772 - RNA, 22 nt, Human
acauuuauagcccuaggggugg

SEQ ID NO: 81773 - RNA, 22 nt, Human
gccauucauguccuguaauacu

SEQ ID NO: 81774 - RNA, 20 nt, Human
ccacuccugcucuuucucca

SEQ ID NO: 81775 - RNA, 20 nt, Human
uauacgggguuacaaaaaga

SEQ ID NO: 81776 - RNA, 21 nt, Human
uaguucaucuaggauccuuuu

SEQ ID NO: 81777 - RNA, 24 nt, Human
agugcacacaaggauugagaagag

SEQ ID NO: 81778 - RNA, 21 nt, Human
uuacauguucaucucuugcca

SEQ ID NO: 81779 - RNA, 19 nt, Human
gcuuugcaggaagugucua

SEQ ID NO: 81780 - RNA, 22 nt, Human
ggggauguuuaauacugaauca

SEQ ID NO: 81781 - RNA, 27 nt, Human
gagaaucgcuugaacucgggaggcaga

SEQ ID NO: 81782 - RNA, 20 nt, Human
cuuacacccugcccucaugc

SEQ ID NO: 81783 - RNA, 20 nt, Human
ucccucucccucccuaacag

SEQ ID NO: 81784 - RNA, 22 nt, Human
gauuagcuagacuaggagacca

SEQ ID NO: 81785 - RNA, 21 nt, Human
agaguuuuaaagguucugcuu

SEQ ID NO: 81786 - RNA, 25 nt, Human
guagcucauccuuuacaccaacucc

SEQ ID NO: 81787 - RNA, 20 nt, Human
agaucugggcucuaguggga

SEQ ID NO: 81788 - RNA, 21 nt, Human
cggagucagggcguguggcug

SEQ ID NO: 81789 - RNA, 20 nt, Human
uagccucugcugcaaaugcu

SEQ ID NO: 81790 - RNA, 20 nt, Human
aucauuuuaaacaaaguaua

SEQ ID NO: 81791 - RNA, 22 nt, Human
uuugccuuggucguuguggacc

SEQ ID NO: 81792 - RNA, 27 nt, Human
gaggaagaugacgaguacuccccuggg

SEQ ID NO: 81793 - RNA, 20 nt, Human
gguacaucaaguccaucuga

SEQ ID NO: 81794 - RNA, 24 nt, Human
cggucauuagaggaaugagccggg

SEQ ID NO: 81795 - RNA, 23 nt, Human
ucuacuacuugaaugauuuugga

SEQ ID NO: 81796 - RNA, 27 nt, Human
guuccccaggcucacaguguagagaca

SEQ ID NO: 81797 - RNA, 22 nt, Human
ugagacucugucuggauuugcc

SEQ ID NO: 81798 - RNA, 21 nt, Human
gcccgccagccguggaaaugu

SEQ ID NO: 81799 - RNA, 27 nt, Human
ugagggggaauagucuagauggcuccu

SEQ ID NO: 81800 - RNA, 25 nt, Human
gccgaggccuccacccaggacaguc

SEQ ID NO: 81801 - RNA, 22 nt, Human
aggcugaggugggaggguugcu

SEQ ID NO: 81802 - RNA, 25 nt, Human
ugacuucugcucuggaccaguguuu

SEQ ID NO: 81803 - RNA, 19 nt, Human
gauugucagggaggugcca

SEQ ID NO: 81804 - RNA, 23 nt, Human
gcccuacuggccuucccccacca

SEQ ID NO: 81805 - RNA, 21 nt, Human
aaauguccucuuaaaagaucc

SEQ ID NO: 81806 - RNA, 19 nt, Human
cgggcggcagguugcagug

SEQ ID NO: 81807 - RNA, 21 nt, Human
ucuucuuucuuccacccacaa

SEQ ID NO: 81808 - RNA, 26 nt, Human
acagcccaggggugggaaguuuucau

SEQ ID NO: 81809 - RNA, 26 nt, Human
cuggaaggcaggccaaccagcaaaau

SEQ ID NO: 81810 - RNA, 21 nt, Human
auucacaaccaugugucuuca

SEQ ID NO: 81811 - RNA, 22 nt, Human
aggacaucugugccaggcuucc

SEQ ID NO: 81812 - RNA, 27 nt, Human
cugggggcucugggcuuguggccggua

SEQ ID NO: 81813 - RNA, 22 nt, Human
gcuucagagcaaaaugagcucg

SEQ ID NO: 81814 - RNA, 24 nt, Human
ugggcuguggaggugggcaugugg

SEQ ID NO: 81815 - RNA, 21 nt, Human
auuuaauuacugauuguguuu

SEQ ID NO: 81816 - RNA, 27 nt, Human
acccauucguggugaucaauuaaaugu

SEQ ID NO: 81817 - RNA, 21 nt, Human
uaaugccaccaaaggagacau

SEQ ID NO: 81818 - RNA, 19 nt, Human
aaaaguuuuuaauacugua

SEQ ID NO: 81819 - RNA, 22 nt, Human
uguacucuugaagucaagcaau

SEQ ID NO: 81820 - RNA, 24 nt, Human
agagcgagacccugucucaauaaa

SEQ ID NO: 81821 - RNA, 26 nt, Human
aaggcucauuccagccacagggcagc

SEQ ID NO: 81822 - RNA, 20 nt, Human
uccagcccagcccaccgggu

SEQ ID NO: 81823 - RNA, 22 nt, Human
cgccuccgucucuauauaagga

SEQ ID NO: 81824 - RNA, 27 nt, Human
ugggcagaccuacaaggcugcgcaaac

SEQ ID NO: 81825 - RNA, 25 nt, Human
ggagcagaguuucucccucaaagaa

SEQ ID NO: 81826 - RNA, 17 nt, Human
ucuccuccucuugcugc

SEQ ID NO: 81827 - RNA, 25 nt, Human
caggaugucgacagcuguggcuucc

SEQ ID NO: 81828 - RNA, 24 nt, Human
guccucaagugaguucuuaguauu

SEQ ID NO: 81829 - RNA, 23 nt, Human
ucucccacccucacugaucacgc

SEQ ID NO: 81830 - RNA, 22 nt, Human
aagucccagugcaugucucuga

SEQ ID NO: 81831 - RNA, 20 nt, Human
cauuucagcuacaucaugcc

SEQ ID NO: 81832 - RNA, 20 nt, Human
gcuccucugcugucagcgcc

SEQ ID NO: 81833 - RNA, 22 nt, Human
ugguuucacugagagcugccuc

SEQ ID NO: 81834 - RNA, 23 nt, Human
uuacccagacucaaggaguuggu

SEQ ID NO: 81835 - RNA, 26 nt, Human
agaguguuacuguaguauucucuaga

SEQ ID NO: 81836 - RNA, 18 nt, Human
uauuuacuuaacauuuua

SEQ ID NO: 81837 - RNA, 22 nt, Human
ugccuccuggguucaagcgauu

SEQ ID NO: 81838 - RNA, 22 nt, Human
gugcccuggccccagguauuau

SEQ ID NO: 81839 - RNA, 21 nt, Human
acacauucuacaaaucagcug

SEQ ID NO: 81840 - RNA, 23 nt, Human
acggugccaccaggcacggccac

SEQ ID NO: 81841 - RNA, 22 nt, Human
agucuccugaguagcuggaacu

SEQ ID NO: 81842 - RNA, 28 nt, Human
gauacccuuacccuuuccuccuuuauca

SEQ ID NO: 81843 - RNA, 22 nt, Human
aaacaauaaaacauuuaauauu

SEQ ID NO: 81844 - RNA, 24 nt, Human
ucugcuuucuuuugacuacuugac

SEQ ID NO: 81845 - RNA, 26 nt, Human
ccagacagaagaaaucugcuucccua

SEQ ID NO: 81846 - RNA, 26 nt, Human
aucuugaacuccugaccucgugaucu

SEQ ID NO: 81847 - RNA, 21 nt, Human
gaauaauuagaaacacacuuu

SEQ ID NO: 81848 - RNA, 24 nt, Human
cugucauccaggcuggagugcagu

SEQ ID NO: 81849 - RNA, 22 nt, Human
uaccauuccagcugcaugggaa

SEQ ID NO: 81850 - RNA, 19 nt, Human
uccucuugaugugacuaaa

SEQ ID NO: 81851 - RNA, 26 nt, Human
ucuaugucccuagccugucauuuuuc

SEQ ID NO: 81852 - RNA, 21 nt, Human
auuugguggagacaaugggaa

SEQ ID NO: 81853 - RNA, 19 nt, Human
gacuuucauucucauucca

SEQ ID NO: 81854 - RNA, 23 nt, Human
gucuuucuccucuuugagacccc

SEQ ID NO: 81855 - RNA, 23 nt, Human
ucccccagccgaccaguuuccuc

SEQ ID NO: 81856 - RNA, 20 nt, Human
aaguuggccaccuugcuuga

SEQ ID NO: 81857 - RNA, 20 nt, Human
aggcaucuuuacaucuaaga

SEQ ID NO: 81858 - RNA, 22 nt, Human
ccaacacggagaaaccccgucu

SEQ ID NO: 81859 - RNA, 22 nt, Human
uggguuuuauggauuucuuugu

SEQ ID NO: 81860 - RNA, 20 nt, Human
ggcgauuacagagaacgucu

SEQ ID NO: 81861 - RNA, 20 nt, Human
gaaacuaggagccuaauaaa

SEQ ID NO: 81862 - RNA, 24 nt, Human
aaguugggauuugcaaauaaaggc

SEQ ID NO: 81863 - RNA, 23 nt, Human
cucucucaugcugaaucacaucc

SEQ ID NO: 81864 - RNA, 23 nt, Human
aaccuauacgguaguugcuuuag

SEQ ID NO: 81865 - RNA, 23 nt, Human
gcuuugaaaucuccccuugcacu

SEQ ID NO: 81866 - RNA, 27 nt, Human
uaagccuuuacugcauagcagaccaca

SEQ ID NO: 81867 - RNA, 22 nt, Human
auacuucucaaucuuugcuuua

SEQ ID NO: 81868 - RNA, 25 nt, Human
ggagauggagaccuaaaaugaaugu

SEQ ID NO: 81869 - RNA, 23 nt, Human
gggugcuucuugauuaguaggga

SEQ ID NO: 81870 - RNA, 21 nt, Human
gagagcuuggggguggggaga

SEQ ID NO: 81871 - RNA, 26 nt, Human
ucucugagaugaggaauagcauucuu

SEQ ID NO: 81872 - RNA, 21 nt, Human
uagauagugcuuuauuuuguu

SEQ ID NO: 81873 - RNA, 22 nt, Human
cugcacccugcgccuccagagg

SEQ ID NO: 81874 - RNA, 22 nt, Human
gcgugagccaccaugccuggcc

SEQ ID NO: 81875 - RNA, 22 nt, Human
gcgugagccaccacgccuggcu

SEQ ID NO: 81876 - RNA, 21 nt, Human
gauuuuaucuuucgcacagca

SEQ ID NO: 81877 - RNA, 22 nt, Human
gcucacugcaaccugugccucc

SEQ ID NO: 81878 - RNA, 22 nt, Human
gaguugagggaaggagcuguau

SEQ ID NO: 81879 - RNA, 25 nt, Human
ggcuguacugcuauucuuacugcug

SEQ ID NO: 81880 - RNA, 21 nt, Human
uggaguugcuggagguagagg

SEQ ID NO: 81881 - RNA, 21 nt, Human
acuugauuguauacugucuuu

SEQ ID NO: 81882 - RNA, 22 nt, Human
cccaccccacccccgggcgccu

SEQ ID NO: 81883 - RNA, 20 nt, Human
ggagagaacaggagggccag

SEQ ID NO: 81884 - RNA, 24 nt, Human
augucugcuucuucccagccuggg

SEQ ID NO: 81885 - RNA, 24 nt, Human
aaccacuguccuguccuuuguggc

SEQ ID NO: 81886 - RNA, 19 nt, Human
uaucagauguguuuucacu

SEQ ID NO: 81887 - RNA, 26 nt, Human
gccagcaccugguugauguguauuca

SEQ ID NO: 81888 - RNA, 21 nt, Human
auagcacaccuuagauguggu

SEQ ID NO: 81889 - RNA, 26 nt, Human
guuuuugaaaaauacagucaguagau

SEQ ID NO: 81890 - RNA, 21 nt, Human
uggcuccuagauuauugagag

SEQ ID NO: 81891 - RNA, 20 nt, Human
ucguaauuccaaaagccauu

SEQ ID NO: 81892 - RNA, 27 nt, Human
guuccugagaucuggguuuaacgaucu

SEQ ID NO: 81893 - RNA, 26 nt, Human
ggguuagagauggaguuugcuguuga

SEQ ID NO: 81894 - RNA, 25 nt, Human
cuggguuuccugacuguagccacau

SEQ ID NO: 81895 - RNA, 21 nt, Human
cacccaaguuggagugcagug

SEQ ID NO: 81896 - RNA, 20 nt, Human
gggucagaccugggguccuc

SEQ ID NO: 81897 - RNA, 22 nt, Human
agccuccugaguagcugagacu

SEQ ID NO: 81898 - RNA, 27 nt, Human
uggcaugguuauugaugaguuucuuaa

SEQ ID NO: 81899 - RNA, 22 nt, Human
ugcaugagacauugacaccaga

SEQ ID NO: 81900 - RNA, 22 nt, Human
cauuggccauucuauuguggca

SEQ ID NO: 81901 - RNA, 26 nt, Human
ccucaagggacuuauaguuuauuuuu

SEQ ID NO: 81902 - RNA, 21 nt, Human
cacacguguaugcacagcaga

SEQ ID NO: 81903 - RNA, 25 nt, Human
uugcccagugcugccagagugagug

SEQ ID NO: 81904 - RNA, 26 nt, Human
gcccuucucuugcugccuccugggca

SEQ ID NO: 81905 - RNA, 21 nt, Human
ccugucagaacagucauuuuc

SEQ ID NO: 81906 - RNA, 23 nt, Human
gugcccuucucgguugcugccgc

SEQ ID NO: 81907 - RNA, 24 nt, Human
uacaagaagcuaggcucugugacg

SEQ ID NO: 81908 - RNA, 26 nt, Human
aggcugagaggaguaggaagaucagg

SEQ ID NO: 81909 - RNA, 23 nt, Human
cugagcuuucuaaaaugauagcu

SEQ ID NO: 81910 - RNA, 20 nt, Human
guuuccgaugggacaggaaa

SEQ ID NO: 81911 - RNA, 21 nt, Human
gaagaagagaagcuuccggca

SEQ ID NO: 81912 - RNA, 25 nt, Human
ccugccugccuuauuugcuuacuga

SEQ ID NO: 81913 - RNA, 27 nt, Human
ggcggggguuggggcggagggagcagc

SEQ ID NO: 81914 - RNA, 21 nt, Human
ggccuaaggugaagcacuccu

SEQ ID NO: 81915 - RNA, 24 nt, Human
uuagcuaccaacggccaggaaaag

SEQ ID NO: 81916 - RNA, 27 nt, Human
ggaggccugugcuuguguuugcugcua

SEQ ID NO: 81917 - RNA, 22 nt, Human
ccgguuuuguucgccagcagau

SEQ ID NO: 81918 - RNA, 20 nt, Human
cccgagcagccuuuguacuc

SEQ ID NO: 81919 - RNA, 20 nt, Human
gagccuaucauuugauuuga

SEQ ID NO: 81920 - RNA, 22 nt, Human
gucaggauaucuuugggaaugg

SEQ ID NO: 81921 - RNA, 21 nt, Human
gccccuggacgaaggucugaa

SEQ ID NO: 81922 - RNA, 25 nt, Human
uggguggagggguuagguuguucac

SEQ ID NO: 81923 - RNA, 23 nt, Human
ugucacccaggcugaagugcagu

SEQ ID NO: 81924 - RNA, 21 nt, Human
cuugccucugugcugugugug

SEQ ID NO: 81925 - RNA, 22 nt, Human
ggggggcggagguugcagugag

SEQ ID NO: 81926 - RNA, 22 nt, Human
guuucauccuucuuaacaugcu

SEQ ID NO: 81927 - RNA, 26 nt, Human
ccagaagaggagcagggacccuucuu

SEQ ID NO: 81928 - RNA, 19 nt, Human
gcaguguccauuguggaga

SEQ ID NO: 81929 - RNA, 23 nt, Human
agcuggguuggaucuucucucca

SEQ ID NO: 81930 - RNA, 26 nt, Human
aaucaucugcaguucuuuuuguacac

SEQ ID NO: 81931 - RNA, 25 nt, Human
ggcugaucuggaacuucugaccuca

SEQ ID NO: 81932 - RNA, 26 nt, Human
gguucagguuggugcagaggcgcuca

SEQ ID NO: 81933 - RNA, 21 nt, Human
guggagcagggucuucaccuu

SEQ ID NO: 81934 - RNA, 18 nt, Human
auucagugccuucugcag

SEQ ID NO: 81935 - RNA, 26 nt, Human
ccucuagccccaccauugcucucucu

SEQ ID NO: 81936 - RNA, 21 nt, Human
acagugagcuaugauuacacc

SEQ ID NO: 81937 - RNA, 29 nt, Human
cugggcagagcuugaggcuggagcccuug

SEQ ID NO: 81938 - RNA, 25 nt, Human
gccaguucugacaguguuuuaggug

SEQ ID NO: 81939 - RNA, 22 nt, Human
cuccacucuuccauccagaucc

SEQ ID NO: 81940 - RNA, 20 nt, Human
uuaaaugccaaucuuccaua

SEQ ID NO: 81941 - RNA, 20 nt, Human
ccuuguagagaugcagccug

SEQ ID NO: 81942 - RNA, 22 nt, Human
acucugcuguuuacagcuuuga

SEQ ID NO: 81943 - RNA, 23 nt, Human
cuguggacugaaaaaucgugucc

SEQ ID NO: 81944 - RNA, 22 nt, Human
cacuggcagcuuugaagaacgg

SEQ ID NO: 81945 - RNA, 27 nt, Human
cgcgucuacccugggauucaggaaaag

SEQ ID NO: 81946 - RNA, 22 nt, Human
gucucaaacucccgaccucagg

SEQ ID NO: 81947 - RNA, 21 nt, Human
cauggcccacagcaggcacag

SEQ ID NO: 81948 - RNA, 20 nt, Human
aucucucuacugcuggacug

SEQ ID NO: 81949 - RNA, 25 nt, Human
acccaggcuggagugcaguggcgca

SEQ ID NO: 81950 - RNA, 25 nt, Human
gcccaggcuggagugcaguggcgcg

SEQ ID NO: 81951 - RNA, 19 nt, Human
ucaagaucacugggaccag

SEQ ID NO: 81952 - RNA, 27 nt, Human
ucagaaucagauggaaaauuaaaccgg

SEQ ID NO: 81953 - RNA, 23 nt, Human
gugacaucaggauuaugugcccc

SEQ ID NO: 81954 - RNA, 24 nt, Human
uccucaagucaugcccgaauuuag

SEQ ID NO: 81955 - RNA, 21 nt, Human
uugcacuaaaguuucugugau

SEQ ID NO: 81956 - RNA, 26 nt, Human
cuguccuuucuucugggccccugguc

SEQ ID NO: 81957 - RNA, 18 nt, Human
aaagcagaaaccaucuca

SEQ ID NO: 81958 - RNA, 26 nt, Human
aggcuacaaccacuagcacggcugac

SEQ ID NO: 81959 - RNA, 23 nt, Human
ucucccaugucucaguguugccu

SEQ ID NO: 81960 - RNA, 27 nt, Human
ccauugcucuguaguucaaaucuguua

SEQ ID NO: 81961 - RNA, 25 nt, Human
auguucucuuggcaugcuaaaucau

SEQ ID NO: 81962 - RNA, 20 nt, Human
ccucuggagcuuccaccugg

SEQ ID NO: 81963 - RNA, 21 nt, Human
guauacacagggaggccaggc

SEQ ID NO: 81964 - RNA, 25 nt, Human
augugggcagugaugucacuagggc

SEQ ID NO: 81965 - RNA, 22 nt, Human
ugggcagcacgucucuccccac

SEQ ID NO: 81966 - RNA, 19 nt, Human
ccgguccacagguccaagg

SEQ ID NO: 81967 - RNA, 22 nt, Human
gugugugccaccaugccucacu

SEQ ID NO: 81968 - RNA, 23 nt, Human
uuuguacauguaucuugaucauu

SEQ ID NO: 81969 - RNA, 23 nt, Human
ccugugccaggcugaauuacagu

SEQ ID NO: 81970 - RNA, 21 nt, Human
cccaccccacagcaggccccg

SEQ ID NO: 81971 - RNA, 20 nt, Human
gccaguagcuaauuuguugc

SEQ ID NO: 81972 - RNA, 20 nt, Human
ccacuacacuccagccugag

SEQ ID NO: 81973 - RNA, 21 nt, Human
gugaaaacugagccccagaag

SEQ ID NO: 81974 - RNA, 23 nt, Human
ucuugaaauguaggcaucaugca

SEQ ID NO: 81975 - RNA, 20 nt, Human
gccggcaugccuccucuucc

SEQ ID NO: 81976 - RNA, 27 nt, Human
ggagaggggugugauggggcagaggaa

SEQ ID NO: 81977 - RNA, 24 nt, Human
cugagauaucucggcuuccgcuca

SEQ ID NO: 81978 - RNA, 26 nt, Human
cacugggcucagccugggcauuaaag

SEQ ID NO: 81979 - RNA, 25 nt, Human
uugggggaagagaaacuugcaguga

SEQ ID NO: 81980 - RNA, 18 nt, Human
agcucacugcuggugcug

SEQ ID NO: 81981 - RNA, 31 nt, Human
gagggagggugaguuagggggagacccggcc

SEQ ID NO: 81982 - RNA, 27 nt, Human
gugccgggguguccuggaaucugugcc

SEQ ID NO: 81983 - RNA, 27 nt, Human
aaacccauggaggaauucugaagccau

SEQ ID NO: 81984 - RNA, 24 nt, Human
uuacccagacugguuugggcaagc

SEQ ID NO: 81985 - RNA, 20 nt, Human
agaggaaguauuuauuuuaa

SEQ ID NO: 81986 - RNA, 28 nt, Human
uccuggcaggugccccaggaugccacgc

SEQ ID NO: 81987 - RNA, 24 nt, Human
ucucguacaacucucccuggacca

SEQ ID NO: 81988 - RNA, 19 nt, Human
acaaucagaugcaaaagcu

SEQ ID NO: 81989 - RNA, 24 nt, Human
aagugaucucagaggggcccaugg

SEQ ID NO: 81990 - RNA, 24 nt, Human
cuuccauaaugcuacugucucacu

SEQ ID NO: 81991 - RNA, 25 nt, Human
gccaaucaugcgcccaccucuccag

SEQ ID NO: 81992 - RNA, 24 nt, Human
guagcuguccaucacacugacagg

SEQ ID NO: 81993 - RNA, 20 nt, Human
ggagggagagagguggacag

SEQ ID NO: 81994 - RNA, 21 nt, Human
uggugggaaagggaggguggu

SEQ ID NO: 81995 - RNA, 20 nt, Human
acuccagcuuucuucuagcc

SEQ ID NO: 81996 - RNA, 21 nt, Human
ccagaagugccugguucuggg

SEQ ID NO: 81997 - RNA, 21 nt, Human
gccacugaagccagaggaucg

SEQ ID NO: 81998 - RNA, 24 nt, Human
gcgcacacgcacacucggacucac

SEQ ID NO: 81999 - RNA, 18 nt, Human
gaaugaaccuuacuugca

SEQ ID NO: 82000 - RNA, 20 nt, Human
ccucugcugccucccucugc

SEQ ID NO: 82001 - RNA, 17 nt, Human
ccuuccccuuggcggcu

SEQ ID NO: 82002 - RNA, 20 nt, Human
uuagaaucuggcacacaaca

SEQ ID NO: 82003 - RNA, 26 nt, Human
gagugggcuuuguggaaacagcuggu

SEQ ID NO: 82004 - RNA, 20 nt, Human
caguuugucagugucuguga

SEQ ID NO: 82005 - RNA, 27 nt, Human
ucugcaugauuucucugggcuugcugu

SEQ ID NO: 82006 - RNA, 23 nt, Human
ggcuaauuuuuucuauuuuuagu

SEQ ID NO: 82007 - RNA, 24 nt, Human
cugucaccugcucacagggaugcu

SEQ ID NO: 82008 - RNA, 22 nt, Human
cgaacuccugggcucaagcaau

SEQ ID NO: 82009 - RNA, 22 nt, Human
auugcuugaacccaggaguuca

SEQ ID NO: 82010 - RNA, 22 nt, Human
aucaauucugauacagccuuac

SEQ ID NO: 82011 - RNA, 21 nt, Human
ggagaggggagcagagccgga

SEQ ID NO: 82012 - RNA, 29 nt, Human
aaauuauuuuauaucauacaguuuucauu

SEQ ID NO: 82013 - RNA, 23 nt, Human
ggggaguagagggaaggagcagg

SEQ ID NO: 82014 - RNA, 23 nt, Human
guugcuugaauguuggggagagg

SEQ ID NO: 82015 - RNA, 23 nt, Human
ccugcuuccucccucccugcccu

SEQ ID NO: 82016 - RNA, 22 nt, Human
gcccuccuccccuccuugcacc

SEQ ID NO: 82017 - RNA, 27 nt, Human
gagagugagacugggaacuugauggcu

SEQ ID NO: 82018 - RNA, 26 nt, Human
cuguaaacccugacggugggccuggc

SEQ ID NO: 82019 - RNA, 20 nt, Human
uuguuuucugccuacaccgu

SEQ ID NO: 82020 - RNA, 19 nt, Human
cuccuugcuacacugagau

SEQ ID NO: 82021 - RNA, 27 nt, Human
augagacacaccccacagcugccaccg

SEQ ID NO: 82022 - RNA, 22 nt, Human
gccuguaauuccagcuacucug

SEQ ID NO: 82023 - RNA, 24 nt, Human
cugccaccacgccuggcuaggaaa

SEQ ID NO: 82024 - RNA, 22 nt, Human
ccacagccucuccaaguucaga

SEQ ID NO: 82025 - RNA, 17 nt, Human
cuuccuggcacucucau

SEQ ID NO: 82026 - RNA, 22 nt, Human
gcucacugcaagcuccgccucu

SEQ ID NO: 82027 - RNA, 21 nt, Human
agacgucuauuuuugugucuu

SEQ ID NO: 82028 - RNA, 25 nt, Human
ugccucuagggaguuacucagccua

SEQ ID NO: 82029 - RNA, 20 nt, Human
gggauugggcuaaggacugu

SEQ ID NO: 82030 - RNA, 22 nt, Human
ucauugcagccugaaauuuuaa

SEQ ID NO: 82031 - RNA, 21 nt, Human
cagacuucuuacuugaaugaa

SEQ ID NO: 82032 - RNA, 22 nt, Human
uagguuucugcaauuuuguuac

SEQ ID NO: 82033 - RNA, 27 nt, Human
cccaagaucuucagaagggcuugguuu

SEQ ID NO: 82034 - RNA, 25 nt, Human
ucaaggcaaaucagcaagcccccaa

SEQ ID NO: 82035 - RNA, 19 nt, Human
gccacccagaggcagcaga

SEQ ID NO: 82036 - RNA, 22 nt, Human
ccaggaagagccagcaagagca

SEQ ID NO: 82037 - RNA, 24 nt, Human
gcccaggcuggagugcaacggcau

SEQ ID NO: 82038 - RNA, 27 nt, Human
gccguguguacugcgugcucagcacug

SEQ ID NO: 82039 - RNA, 25 nt, Human
acuuacauuucauggacagcauuaa

SEQ ID NO: 82040 - RNA, 17 nt, Human
cuucccuuggcaggcug

SEQ ID NO: 82041 - RNA, 23 nt, Human
ucuuaaaauuuccuccauugggg

SEQ ID NO: 82042 - RNA, 21 nt, Human
gcacuuauucucaagaagaac

SEQ ID NO: 82043 - RNA, 20 nt, Human
uucauaacguguaucuuuaa

SEQ ID NO: 82044 - RNA, 23 nt, Human
gucaucaggaauacucuuugucu

SEQ ID NO: 82045 - RNA, 24 nt, Human
acuuucucaugguuuguagguauu

SEQ ID NO: 82046 - RNA, 20 nt, Human
cugcagcugcugccgccgcc

SEQ ID NO: 82047 - RNA, 23 nt, Human
gccucacccuucugcccuucaca

SEQ ID NO: 82048 - RNA, 23 nt, Human
gguccaguucuucccccuucaca

SEQ ID NO: 82049 - RNA, 26 nt, Human
aucuagagugucagccuuaucagugu

SEQ ID NO: 82050 - RNA, 22 nt, Human
gaugccuggccauuccugggaa

SEQ ID NO: 82051 - RNA, 22 nt, Human
cuaccaccuuuuggugccacac

SEQ ID NO: 82052 - RNA, 23 nt, Human
gccuuauuccucccuucccccca

SEQ ID NO: 82053 - RNA, 17 nt, Human
aucuuccuggggcaaug

SEQ ID NO: 82054 - RNA, 22 nt, Human
ccaaggcgggaggauugcuuga

SEQ ID NO: 82055 - RNA, 21 nt, Human
ccuguaauccgagcacuuugg

SEQ ID NO: 82056 - RNA, 20 nt, Human
uuucaucugcuuucuauguu

SEQ ID NO: 82057 - RNA, 23 nt, Human
gcccucgcccccucccccaggcc

SEQ ID NO: 82058 - RNA, 26 nt, Human
ucgcucugucauccaggcuggagugc

SEQ ID NO: 82059 - RNA, 18 nt, Human
agccagaauucacuagga

SEQ ID NO: 82060 - RNA, 28 nt, Human
uuacagccuucacauuuguacaauucau

SEQ ID NO: 82061 - RNA, 27 nt, Human
gcgucacugcacuccaaccugggugac

SEQ ID NO: 82062 - RNA, 27 nt, Human
gccuccaccuccugggcucuccagcga

SEQ ID NO: 82063 - RNA, 20 nt, Human
cauguauguguuucugucag

SEQ ID NO: 82064 - RNA, 22 nt, Human
aucucccugcaaccuccgccuc

SEQ ID NO: 82065 - RNA, 22 nt, Human
ugcccaggcuagcaugcaaugg

SEQ ID NO: 82066 - RNA, 20 nt, Human
aaugccaguaguauuuagag

SEQ ID NO: 82067 - RNA, 21 nt, Human
ggugaaugacauuugugggua

SEQ ID NO: 82068 - RNA, 21 nt, Human
ccuccaggggcuaagugaugg

SEQ ID NO: 82069 - RNA, 26 nt, Human
uugucaauguuaguaauugugcagug

SEQ ID NO: 82070 - RNA, 23 nt, Human
ccucuaaacugccccaccuccua

SEQ ID NO: 82071 - RNA, 23 nt, Human
uucuauaaacugaauuauuuuaa

SEQ ID NO: 82072 - RNA, 22 nt, Human
uucaggccauucuccugccuca

SEQ ID NO: 82073 - RNA, 20 nt, Human
uuuuccccuuugcuuucuuc

SEQ ID NO: 82074 - RNA, 23 nt, Human
auacuaauauguuucacacuaua

SEQ ID NO: 82075 - RNA, 20 nt, Human
acagacucaucagcauucag

SEQ ID NO: 82076 - RNA, 26 nt, Human
gcccagcgccccgccuggaguggaug

SEQ ID NO: 82077 - RNA, 22 nt, Human
ugguauccaacuuaaaucccag

SEQ ID NO: 82078 - RNA, 19 nt, Human
agggaaagugggagaggga

SEQ ID NO: 82079 - RNA, 25 nt, Human
auggcucucucugccagaauugugu

SEQ ID NO: 82080 - RNA, 22 nt, Human
guguaacauggaaagcuaaggg

SEQ ID NO: 82081 - RNA, 20 nt, Human
guaaaauuauacugugugug

SEQ ID NO: 82082 - RNA, 27 nt, Human
aagagccucagcaagagaguuuugcca

SEQ ID NO: 82083 - RNA, 20 nt, Human
gcccuucucacccauggccc

SEQ ID NO: 82084 - RNA, 22 nt, Human
gcucacugccaggccagccucc

SEQ ID NO: 82085 - RNA, 26 nt, Human
gaaaacuggcccugcccugccccugc

SEQ ID NO: 82086 - RNA, 25 nt, Human
cggaaggcggcagaggcugggaggc

SEQ ID NO: 82087 - RNA, 22 nt, Human
gcagggacggagcugacuuuua

SEQ ID NO: 82088 - RNA, 23 nt, Human
cucgccugcuucauuuggauauc

SEQ ID NO: 82089 - RNA, 21 nt, Human
gccuucggggucucaguuggc

SEQ ID NO: 82090 - RNA, 25 nt, Human
aaccugaccguggacgagggcacca

SEQ ID NO: 82091 - RNA, 27 nt, Human
ggaggcugaggcaggaggauugcuuga

SEQ ID NO: 82092 - RNA, 23 nt, Human
agggacacuggcagcuguggaaa

SEQ ID NO: 82093 - RNA, 21 nt, Human
ccacaccacuggcaccaggcc

SEQ ID NO: 82094 - RNA, 27 nt, Human
uugccuuucugggagcagaaacagcca

SEQ ID NO: 82095 - RNA, 23 nt, Human
ggacagcgggaggcucaaaccug

SEQ ID NO: 82096 - RNA, 27 nt, Human
gccuguaucuggugucugagugaggca

SEQ ID NO: 82097 - RNA, 15 nt, Human
aacuauaccugcuuc

SEQ ID NO: 82098 - RNA, 23 nt, Human
caguguaugacucaaacagcugc

SEQ ID NO: 82099 - RNA, 18 nt, Human
aacacugaugaauguaaa

SEQ ID NO: 82100 - RNA, 27 nt, Human
cuggaugaagacacagacuaaaaggaa

SEQ ID NO: 82101 - RNA, 22 nt, Human
gguucuuugugguuaaaaguuu

SEQ ID NO: 82102 - RNA, 23 nt, Human
gccucaacguccaacccuucugc

SEQ ID NO: 82103 - RNA, 22 nt, Human
gccagggacucaacaaugggga

SEQ ID NO: 82104 - RNA, 23 nt, Human
aaacccaaagcuuuucaaacuuc

SEQ ID NO: 82105 - RNA, 23 nt, Human
aagcucagguuuguccuggucau

SEQ ID NO: 82106 - RNA, 16 nt, Human
accauaaaaagcugac

SEQ ID NO: 82107 - RNA, 23 nt, Human
acaaguauuuugcuauauauaaa

SEQ ID NO: 82108 - RNA, 21 nt, Human
uuccucacugguguuuuggau

SEQ ID NO: 82109 - RNA, 29 nt, Human
gcuaucacuguuuguaagcaucuggggag

SEQ ID NO: 82110 - RNA, 22 nt, Human
gccuguaaacccagggcuuuag

SEQ ID NO: 82111 - RNA, 27 nt, Human
ggacacugugcuacugaaacucccagc

SEQ ID NO: 82112 - RNA, 23 nt, Human
auuggucugugcuccucucucgg

SEQ ID NO: 82113 - RNA, 27 nt, Human
accccuuccaaauagaaacccauacca

SEQ ID NO: 82114 - RNA, 20 nt, Human
uuuggaauuuuugcuugacu

SEQ ID NO: 82115 - RNA, 30 nt, Human
caucaucuccacccuccagccauggaagac

SEQ ID NO: 82116 - RNA, 19 nt, Human
aggcuggaaggaggaagaa

SEQ ID NO: 82117 - RNA, 23 nt, Human
aaaucagugccugguguucugaa

SEQ ID NO: 82118 - RNA, 25 nt, Human
gcaugcccacaucucuuucgugccu

SEQ ID NO: 82119 - RNA, 21 nt, Human
gagcauuuuccuccaucgcag

SEQ ID NO: 82120 - RNA, 25 nt, Human
cuccucagcccucccccacccacag

SEQ ID NO: 82121 - RNA, 26 nt, Human
cuucugcuugggcucuucaaggcacu

SEQ ID NO: 82122 - RNA, 25 nt, Human
gcuuucuggguauuugcugccaagg

SEQ ID NO: 82123 - RNA, 23 nt, Human
ccauccuggaaggaaacugucug

SEQ ID NO: 82124 - RNA, 23 nt, Human
acaccccagccucugacuugcug

SEQ ID NO: 82125 - RNA, 24 nt, Human
uggugcuaugacagugugagacuc

SEQ ID NO: 82126 - RNA, 26 nt, Human
gaccauaggcuggcaggcagcugaga

SEQ ID NO: 82127 - RNA, 22 nt, Human
ggacagucacuguacacuugua

SEQ ID NO: 82128 - RNA, 26 nt, Human
gcucugugagcggcggguggcagcag

SEQ ID NO: 82129 - RNA, 22 nt, Human
gauaggacauucuaugcuuaca

SEQ ID NO: 82130 - RNA, 27 nt, Human
aauggcugagugcacaagugaguuguu

SEQ ID NO: 82131 - RNA, 23 nt, Human
gggaagggagggaaacaguuuug

SEQ ID NO: 82132 - RNA, 21 nt, Human
ggcuuggaaauuuaacacagu

SEQ ID NO: 82133 - RNA, 22 nt, Human
cguggggacagagaugggugau

SEQ ID NO: 82134 - RNA, 27 nt, Human
uagugcgcuccagccugggcaacagag

SEQ ID NO: 82135 - RNA, 26 nt, Human
ccaggagagcuuagggucucagggug

SEQ ID NO: 82136 - RNA, 21 nt, Human
caagcuaacugagcuggguga

SEQ ID NO: 82137 - RNA, 22 nt, Human
ucaccugcuggaguccuuugug

SEQ ID NO: 82138 - RNA, 27 nt, Human
uacuguaaauguggcccccagugggca

SEQ ID NO: 82139 - RNA, 27 nt, Human
caggaauauccaagaagcuguuguccu

SEQ ID NO: 82140 - RNA, 21 nt, Human
cuucuguggaguuauccuccu

SEQ ID NO: 82141 - RNA, 27 nt, Human
cuccaagaauugugcaaguaaagacau

SEQ ID NO: 82142 - RNA, 22 nt, Human
accauuggcuaaaaauguguuu

SEQ ID NO: 82143 - RNA, 25 nt, Human
caaccuauccuguucuuuuaauuga

SEQ ID NO: 82144 - RNA, 27 nt, Human
ccucuacuggagaaucucagcaggggu

SEQ ID NO: 82145 - RNA, 22 nt, Human
agccccaucucuuucgccugca

SEQ ID NO: 82146 - RNA, 21 nt, Human
gaguaccugcuccaucaugcu

SEQ ID NO: 82147 - RNA, 16 nt, Human
uuuggagcucaguguu

SEQ ID NO: 82148 - RNA, 24 nt, Human
uucauggucgcccauuuuuucauc

SEQ ID NO: 82149 - RNA, 23 nt, Human
uccuugggaggaaguuguagugg

SEQ ID NO: 82150 - RNA, 20 nt, Human
ucauuuuuauaaugucccuu

SEQ ID NO: 82151 - RNA, 24 nt, Human
ucaugaauccauuuggcacagaga

SEQ ID NO: 82152 - RNA, 23 nt, Human
agggguugugggggcagaggggg

SEQ ID NO: 82153 - RNA, 22 nt, Human
caggcugaagugcagugaguca

SEQ ID NO: 82154 - RNA, 19 nt, Human
ucccugucuuccucuacca

SEQ ID NO: 82155 - RNA, 22 nt, Human
gcgcucccuaacaugcccaacc

SEQ ID NO: 82156 - RNA, 27 nt, Human
gacuggguccagaauggcuucggauuc

SEQ ID NO: 82157 - RNA, 26 nt, Human
aacucauuucuuauaucauauuguua

SEQ ID NO: 82158 - RNA, 21 nt, Human
gcaaagcacuuuaaccauuuc

SEQ ID NO: 82159 - RNA, 27 nt, Human
uagauaauuuauuugcuuauauguuuu

SEQ ID NO: 82160 - RNA, 19 nt, Human
ggcuagagaggcagaggaa

SEQ ID NO: 82161 - RNA, 26 nt, Human
gcucacugcucacccaccugcugcug

SEQ ID NO: 82162 - RNA, 21 nt, Human
gccauaauacaaaaggcucca

SEQ ID NO: 82163 - RNA, 22 nt, Human
ggcugccugcacucaguucuca

SEQ ID NO: 82164 - RNA, 20 nt, Human
gcuagagguugugcuucuua

SEQ ID NO: 82165 - RNA, 21 nt, Human
ggacaaaaaaguugugguuug

SEQ ID NO: 82166 - RNA, 28 nt, Human
ggccaaguauugccucucugcaauagac

SEQ ID NO: 82167 - RNA, 21 nt, Human
gagacuggggcaggaggauca

SEQ ID NO: 82168 - RNA, 21 nt, Human
ccuucauucaauaacgauuuu

SEQ ID NO: 82169 - RNA, 25 nt, Human
cccugcagggcugaagccuaagcua

SEQ ID NO: 82170 - RNA, 25 nt, Human
ccugggagaggggaagcagaucuga

SEQ ID NO: 82171 - RNA, 27 nt, Human
cagcccgauacuugagccuccucuuua

SEQ ID NO: 82172 - RNA, 21 nt, Human
auaaacacuggaaacgcuggg

SEQ ID NO: 82173 - RNA, 21 nt, Human
aacuguaaaugaaucuuggua

SEQ ID NO: 82174 - RNA, 16 nt, Human
agcaguucagugccuu

SEQ ID NO: 82175 - RNA, 23 nt, Human
accuguaaucccagcuacucggg

SEQ ID NO: 82176 - RNA, 27 nt, Human
augagacaggcuuuauuauccgcauuu

SEQ ID NO: 82177 - RNA, 26 nt, Human
cuuguaacuuugauaaugaacaguga

SEQ ID NO: 82178 - RNA, 20 nt, Human
aggaggaagacuaguggugg

SEQ ID NO: 82179 - RNA, 23 nt, Human
gagcagucaggcccacagcaucu

SEQ ID NO: 82180 - RNA, 21 nt, Human
cugagacugggagcagaguug

SEQ ID NO: 82181 - RNA, 27 nt, Human
ugcuucaaguguuaccuaacaauguuu

SEQ ID NO: 82182 - RNA, 22 nt, Human
gacucugcucucuauuuaaaag

SEQ ID NO: 82183 - RNA, 20 nt, Human
cugcuuucugcuuuucuccc

SEQ ID NO: 82184 - RNA, 19 nt, Human
ugcccaucgcuugcacugg

SEQ ID NO: 82185 - RNA, 18 nt, Human
uacuccggccaaaaaaga

SEQ ID NO: 82186 - RNA, 17 nt, Human
cucaaagggaacaguga

SEQ ID NO: 82187 - RNA, 24 nt, Human
uucaccccacacccagggcuagua

SEQ ID NO: 82188 - RNA, 22 nt, Human
ucuguugcccaggcugaagugc

SEQ ID NO: 82189 - RNA, 23 nt, Human
gcagggcugcacuuggcuccugu

SEQ ID NO: 82190 - RNA, 21 nt, Human
cccagacagggacacaggguc

SEQ ID NO: 82191 - RNA, 25 nt, Human
ugggccuguuugccgucugugacau

SEQ ID NO: 82192 - RNA, 23 nt, Human
uccaauacuguugcccuuuuccu

SEQ ID NO: 82193 - RNA, 18 nt, Human
acccccuuaccuccccca

SEQ ID NO: 82194 - RNA, 27 nt, Human
ccccaacuccaggggcaccuaugagau

SEQ ID NO: 82195 - RNA, 21 nt, Human
uucccuugaacuuugaaccug

SEQ ID NO: 82196 - RNA, 23 nt, Human
aaugcuguagacagaagcauuuu

SEQ ID NO: 82197 - RNA, 23 nt, Human
gggaugagagggagggagaaucc

SEQ ID NO: 82198 - RNA, 24 nt, Human
ggaggcacaguuuuagaauaagga

SEQ ID NO: 82199 - RNA, 25 nt, Human
aguguaguguagcaucuggggagac

SEQ ID NO: 82200 - RNA, 22 nt, Human
cacccagacuggagugcagugc

SEQ ID NO: 82201 - RNA, 23 nt, Human
gacaugauagagggacagagcca

SEQ ID NO: 82202 - RNA, 21 nt, Human
uagaauucccagagggguuuu

SEQ ID NO: 82203 - RNA, 26 nt, Human
cuucccucagaccauaacucaagaau

SEQ ID NO: 82204 - RNA, 21 nt, Human
gcuucuuggaaguagaccaag

SEQ ID NO: 82205 - RNA, 21 nt, Human
aagaugaaagaaaaaaugaaa

SEQ ID NO: 82206 - RNA, 25 nt, Human
gucgcucgcccuugguuucugggga

SEQ ID NO: 82207 - RNA, 26 nt, Human
ccugcagcugagucugugcccgagac

SEQ ID NO: 82208 - RNA, 21 nt, Human
cucugcagcaaacugcgguca

SEQ ID NO: 82209 - RNA, 21 nt, Human
cugguuaguccagcucuuuac

SEQ ID NO: 82210 - RNA, 21 nt, Human
gcauucucauaccugcccaca

SEQ ID NO: 82211 - RNA, 18 nt, Human
gugacccugccugcucgc

SEQ ID NO: 82212 - RNA, 22 nt, Human
aaguuuacugugaagggguuuc

SEQ ID NO: 82213 - RNA, 22 nt, Human
gaaaacagugaaucuuauggug

SEQ ID NO: 82214 - RNA, 24 nt, Human
ugcuaucuuauccuuuuuagugcu

SEQ ID NO: 82215 - RNA, 22 nt, Human
augcuuggccccugugaagugc

SEQ ID NO: 82216 - RNA, 24 nt, Human
cgaugccaccuuccuuguccccgc

SEQ ID NO: 82217 - RNA, 26 nt, Human
gcuggugagaggugcaaagaggcaga

SEQ ID NO: 82218 - RNA, 26 nt, Human
cuuuuccccucuuuaacuuucuaguu

SEQ ID NO: 82219 - RNA, 22 nt, Human
ggccccuccccgggagguacag

SEQ ID NO: 82220 - RNA, 25 nt, Human
gcugaggcccacagacuuacagaag

SEQ ID NO: 82221 - RNA, 22 nt, Human
ccauggguggcuaaauccacug

SEQ ID NO: 82222 - RNA, 21 nt, Human
ccgcccagcagccaguggguu

SEQ ID NO: 82223 - RNA, 22 nt, Human
aaacccaggaguuugugugucu

SEQ ID NO: 82224 - RNA, 22 nt, Human
ucuccagcugcucucaauggcu

SEQ ID NO: 82225 - RNA, 23 nt, Human
caguuacccuuucaaccuaccca

SEQ ID NO: 82226 - RNA, 25 nt, Human
gccacaugugcuccugucauccucc

SEQ ID NO: 82227 - RNA, 28 nt, Human
uuuagucccauaugcucuuccugaaucu

SEQ ID NO: 82228 - RNA, 24 nt, Human
gcauaaaguagaaauucacugccu

SEQ ID NO: 82229 - RNA, 20 nt, Human
uucucucucacaaucaguaa

SEQ ID NO: 82230 - RNA, 20 nt, Human
uaggaaggggaggaagucug

SEQ ID NO: 82231 - RNA, 21 nt, Human
gggaccuuuuuccuccucugc

SEQ ID NO: 82232 - RNA, 27 nt, Human
aagcgcuuaaccucauugggguggagg

SEQ ID NO: 82233 - RNA, 27 nt, Human
gaucagccugggcaaugugauaaaacc

SEQ ID NO: 82234 - RNA, 25 nt, Human
cucauuucauuaaguuuuucccucc

SEQ ID NO: 82235 - RNA, 22 nt, Human
cacugcacuccauccugggcga

SEQ ID NO: 82236 - RNA, 22 nt, Human
cacugcacuccagccugggcua

SEQ ID NO: 82237 - RNA, 20 nt, Human
ccagaacuccccacuugccg

SEQ ID NO: 82238 - RNA, 28 nt, Human
agcauguugcuguuauuccugcccugca

SEQ ID NO: 82239 - RNA, 25 nt, Human
cugggcuuugguaugguaacucuuu

SEQ ID NO: 82240 - RNA, 22 nt, Human
agagacacuaaccagcuaucca

SEQ ID NO: 82241 - RNA, 24 nt, Human
cugaagggaaaugggcagcugcug

SEQ ID NO: 82242 - RNA, 22 nt, Human
accauggagaugaaaugccuuu

SEQ ID NO: 82243 - RNA, 17 nt, Human
acuccuccuccugcugc

SEQ ID NO: 82244 - RNA, 21 nt, Human
aaaacaaugccaauucaagua

SEQ ID NO: 82245 - RNA, 21 nt, Human
auuacuuagaggaaauaagaa

SEQ ID NO: 82246 - RNA, 25 nt, Human
cucaaguaggccucaucugccggca

SEQ ID NO: 82247 - RNA, 23 nt, Human
uucugcacaucaugaugacuuua

SEQ ID NO: 82248 - RNA, 31 nt, Human
ccuaccagaugagcccugccucugggagccc

SEQ ID NO: 82249 - RNA, 22 nt, Human
uuggguccuaaacagcuuuuua

SEQ ID NO: 82250 - RNA, 22 nt, Human
agcuaggagaugggaggcacag

SEQ ID NO: 82251 - RNA, 23 nt, Human
uucuagcccuugcccucagggag

SEQ ID NO: 82252 - RNA, 20 nt, Human
ggggagacaggagccuagcg

SEQ ID NO: 82253 - RNA, 28 nt, Human
ggagguuugaggcccaccuccgcccauu

SEQ ID NO: 82254 - RNA, 24 nt, Human
acaggaagaucuuaaauuuuguga

SEQ ID NO: 82255 - RNA, 27 nt, Human
gcgauugggaaagcuggcuacacugau

SEQ ID NO: 82256 - RNA, 17 nt, Human
ugucugagagcuuuaag

SEQ ID NO: 82257 - RNA, 28 nt, Human
agguuccuucuaagugguagaacuuggg

SEQ ID NO: 82258 - RNA, 22 nt, Human
ccacuguuuuggcuuucaugaa

SEQ ID NO: 82259 - RNA, 21 nt, Human
aacagacucaucagcauucag

SEQ ID NO: 82260 - RNA, 21 nt, Human
gucagcaaggauaugaugaga

SEQ ID NO: 82261 - RNA, 27 nt, Human
gcucagccuggccacguugccguuaca

SEQ ID NO: 82262 - RNA, 24 nt, Human
gggaccauggucugggagcuguuc

SEQ ID NO: 82263 - RNA, 26 nt, Human
gcucccucuuccucuccauaccugcc

SEQ ID NO: 82264 - RNA, 19 nt, Human
cagcacaaccuuuuccuca

SEQ ID NO: 82265 - RNA, 23 nt, Human
gcggguguaucccucacagcacc

SEQ ID NO: 82266 - RNA, 24 nt, Human
gcugcagccgccuccucguuccuc

SEQ ID NO: 82267 - RNA, 27 nt, Human
gggaggcagaaguugcagugaacugaa

SEQ ID NO: 82268 - RNA, 23 nt, Human
cggcccugucuccauggccaggu

SEQ ID NO: 82269 - RNA, 21 nt, Human
ccuuucuccaggguauggggc

SEQ ID NO: 82270 - RNA, 26 nt, Human
aggaagggagaaggcagaacccauag

SEQ ID NO: 82271 - RNA, 26 nt, Human
ccuugguccauggaugacaccaccuu

SEQ ID NO: 82272 - RNA, 26 nt, Human
ggucucggucccaggguggucccagc

SEQ ID NO: 82273 - RNA, 22 nt, Human
uucauucuauuuguuauugcua

SEQ ID NO: 82274 - RNA, 26 nt, Human
ucacuauucuuggaauauuuaugguc

SEQ ID NO: 82275 - RNA, 20 nt, Human
cuaaggcauacaguucuuga

SEQ ID NO: 82276 - RNA, 20 nt, Human
accucccauuggccaaagga

SEQ ID NO: 82277 - RNA, 28 nt, Human
gccucucugaugauggagaugaagugaa

SEQ ID NO: 82278 - RNA, 27 nt, Human
ggaggcugaggcaugagaaucgcuuga

SEQ ID NO: 82279 - RNA, 27 nt, Human
ggaggcugaggcaggagaaucucuuga

SEQ ID NO: 82280 - RNA, 22 nt, Human
cauucugggguggggcuuggaa

SEQ ID NO: 82281 - RNA, 28 nt, Human
guuggcuccuaaugggggugggaguguu

SEQ ID NO: 82282 - RNA, 19 nt, Human
aggguccaucugggcaagg

SEQ ID NO: 82283 - RNA, 27 nt, Human
acauggcccugggacacccacagcugc

SEQ ID NO: 82284 - RNA, 21 nt, Human
aucagguggagaugauagugg

SEQ ID NO: 82285 - RNA, 22 nt, Human
gcuauaaucuccccugccuucc

SEQ ID NO: 82286 - RNA, 26 nt, Human
ccuugaacuccugggcucaagcaguc

SEQ ID NO: 82287 - RNA, 26 nt, Human
gaucaaugcugcuguaaauacaggua

SEQ ID NO: 82288 - RNA, 18 nt, Human
acauugucgggcuuuuca

SEQ ID NO: 82289 - RNA, 26 nt, Human
cuggugcucucuucuccccacugugc

SEQ ID NO: 82290 - RNA, 19 nt, Human
uuguggcaucagugcugcu

SEQ ID NO: 82291 - RNA, 19 nt, Human
ucacacauuuacacauacc

SEQ ID NO: 82292 - RNA, 24 nt, Human
uguuucuugagauaagauuccaaa

SEQ ID NO: 82293 - RNA, 22 nt, Human
ccacuggcgaagauggucucca

SEQ ID NO: 82294 - RNA, 23 nt, Human
gcacauuuaacugugugaugucc

SEQ ID NO: 82295 - RNA, 18 nt, Human
uggcaaaaucacauugca

SEQ ID NO: 82296 - RNA, 28 nt, Human
ucgcugcacacacaucucuggcucucca

SEQ ID NO: 82297 - RNA, 23 nt, Human
gggaggccacacccacaagcgcu

SEQ ID NO: 82298 - RNA, 20 nt, Human
ggagguugagaaugcaguga

SEQ ID NO: 82299 - RNA, 17 nt, Human
agagugacauguuuaca

SEQ ID NO: 82300 - RNA, 24 nt, Human
gcuugggagaggccaagugagugg

SEQ ID NO: 82301 - RNA, 21 nt, Human
uggacaaaauucaguguugga

SEQ ID NO: 82302 - RNA, 24 nt, Human
cuucauugcccagcuccugcccgc

SEQ ID NO: 82303 - RNA, 22 nt, Human
uuguauccucuccuuuuagagg

SEQ ID NO: 82304 - RNA, 20 nt, Human
guccucuguguucccgcgga

SEQ ID NO: 82305 - RNA, 27 nt, Human
augugguuucuacaaagaugaaacuac

SEQ ID NO: 82306 - RNA, 20 nt, Human
gaugaaugucuguguuggug

SEQ ID NO: 82307 - RNA, 24 nt, Human
acccaggaagcagagguugcagua

SEQ ID NO: 82308 - RNA, 24 nt, Human
ccagcugcugcagcgcgccuucgc

SEQ ID NO: 82309 - RNA, 27 nt, Human
gagcaaauuacccuccuuaaacaagag

SEQ ID NO: 82310 - RNA, 25 nt, Human
ccaguuuuccugucaugacaagccu

SEQ ID NO: 82311 - RNA, 22 nt, Human
aaagugcuggaauuacaggcga

SEQ ID NO: 82312 - RNA, 22 nt, Human
gggauuacaggcaugacccacc

SEQ ID NO: 82313 - RNA, 23 nt, Human
caggaauaugaaagaaaggcaca

SEQ ID NO: 82314 - RNA, 29 nt, Human
ucagcuguugccauuuucuuucaaucuga

SEQ ID NO: 82315 - RNA, 22 nt, Human
ccugcagggcaggucaggcugg

SEQ ID NO: 82316 - RNA, 20 nt, Human
acacugggacacugucagug

SEQ ID NO: 82317 - RNA, 27 nt, Human
ggagagggaggccgcggaauuaaaagg

SEQ ID NO: 82318 - RNA, 18 nt, Human
cgagaaggaagccuccca

SEQ ID NO: 82319 - RNA, 23 nt, Human
aguugaagucuguggaugcagcu

SEQ ID NO: 82320 - RNA, 25 nt, Human
uucuacuccuucccuaauagcuuuu

SEQ ID NO: 82321 - RNA, 27 nt, Human
ugccaccccuagccuugcuggggacgu

SEQ ID NO: 82322 - RNA, 18 nt, Human
ccuccacugacuuccucc

SEQ ID NO: 82323 - RNA, 20 nt, Human
cagacuauauuaacagcugc

SEQ ID NO: 82324 - RNA, 22 nt, Human
cgcccaccccuccuuccuugac

SEQ ID NO: 82325 - RNA, 25 nt, Human
acagggccacagcccacacagcccu

SEQ ID NO: 82326 - RNA, 21 nt, Human
agacagcaggcuggagcccag

SEQ ID NO: 82327 - RNA, 26 nt, Human
ccuagagugggaguccugauaaccca

SEQ ID NO: 82328 - RNA, 23 nt, Human
cuggggcagggugggggagaggg

SEQ ID NO: 82329 - RNA, 24 nt, Human
ccaggaugucggaggagaucauca

SEQ ID NO: 82330 - RNA, 27 nt, Human
gacaguuacuaggaaugaguuuauaac

SEQ ID NO: 82331 - RNA, 20 nt, Human
ggagaagaagaugauucuuu

SEQ ID NO: 82332 - RNA, 25 nt, Human
cgugcuucuuauuccuggcaggcuu

SEQ ID NO: 82333 - RNA, 20 nt, Human
augaaugucuccagagacau

SEQ ID NO: 82334 - RNA, 21 nt, Human
gcccaggucuccucacucaaa

SEQ ID NO: 82335 - RNA, 19 nt, Human
auauuuuuucugauccccc

SEQ ID NO: 82336 - RNA, 21 nt, Human
aaauugucauaaaauuaauaa

SEQ ID NO: 82337 - RNA, 27 nt, Human
augacaccuucgugguccguguggccc

SEQ ID NO: 82338 - RNA, 30 nt, Human
ccuguugggagugaggaugucugggccacu

SEQ ID NO: 82339 - RNA, 22 nt, Human
caggaggcagagguugcagugc

SEQ ID NO: 82340 - RNA, 21 nt, Human
ugccuccuccuuucguuguag

SEQ ID NO: 82341 - RNA, 20 nt, Human
gagcuagggcagggaccaaa

SEQ ID NO: 82342 - RNA, 20 nt, Human
ccaugagcagaggguagugg

SEQ ID NO: 82343 - RNA, 24 nt, Human
gugaccuaggaccccagggccacc

SEQ ID NO: 82344 - RNA, 21 nt, Human
aauucuuaaaacugugcucaa

SEQ ID NO: 82345 - RNA, 27 nt, Human
gcggagcugugagccggcgacucgggu

SEQ ID NO: 82346 - RNA, 19 nt, Human
ucuccuggucauuuuuguu

SEQ ID NO: 82347 - RNA, 21 nt, Human
cgcccuggcuggagugcaaug

SEQ ID NO: 82348 - RNA, 24 nt, Human
gccaguauuuauguuuuuuauaaa

SEQ ID NO: 82349 - RNA, 20 nt, Human
aaggucaguuugauuggaua

SEQ ID NO: 82350 - RNA, 20 nt, Human
cuaucaggaguccacugccu

SEQ ID NO: 82351 - RNA, 23 nt, Human
gcuucugaggacucagcuggaac

SEQ ID NO: 82352 - RNA, 27 nt, Human
cucauuucuguguuuugccugccucug

SEQ ID NO: 82353 - RNA, 18 nt, Human
cucuccuccaccggcgcc

SEQ ID NO: 82354 - RNA, 22 nt, Human
agcacuauacugggagucacaa

SEQ ID NO: 82355 - RNA, 20 nt, Human
ccauuugaacagucacuucc

SEQ ID NO: 82356 - RNA, 23 nt, Human
ggccacgucacaaccucugaucu

SEQ ID NO: 82357 - RNA, 27 nt, Human
gccuuucuccugcccggccucggaacc

SEQ ID NO: 82358 - RNA, 20 nt, Human
uagccaucuacucucuugag

SEQ ID NO: 82359 - RNA, 22 nt, Human
ugccuggggcaaggccagggga

SEQ ID NO: 82360 - RNA, 21 nt, Human
gacgaaggggagugagcuuga

SEQ ID NO: 82361 - RNA, 27 nt, Human
gcguuugcauuugcagugcaucagaua

SEQ ID NO: 82362 - RNA, 22 nt, Human
uucaagcgaugcuccugccuca

SEQ ID NO: 82363 - RNA, 21 nt, Human
uaaaucacaggaagaagcggc

SEQ ID NO: 82364 - RNA, 26 nt, Human
cugccuaccugggccuggccagcagg

SEQ ID NO: 82365 - RNA, 21 nt, Human
gcacaaaagggacuuggaaaa

SEQ ID NO: 82366 - RNA, 22 nt, Human
cuccuccaaaugccagcugugc

SEQ ID NO: 82367 - RNA, 28 nt, Human
uaaacuaugaaaccuuuuuccuaguagu

SEQ ID NO: 82368 - RNA, 21 nt, Human
ccaaacacuugucaccguucc

SEQ ID NO: 82369 - RNA, 21 nt, Human
aguuuuauuuugggccuguuc

SEQ ID NO: 82370 - RNA, 24 nt, Human
gggaggggugggagagggaauuua

SEQ ID NO: 82371 - RNA, 21 nt, Human
uccacagucuuuaccguuuua

SEQ ID NO: 82372 - RNA, 21 nt, Human
ccuccacuccgcugagaaucc

SEQ ID NO: 82373 - RNA, 22 nt, Human
aucaaaccacaucuugaugcua

SEQ ID NO: 82374 - RNA, 25 nt, Human
uccuugccaucaccagccacagaga

SEQ ID NO: 82375 - RNA, 25 nt, Human
guuuucugcccuuuuccucuccagc

SEQ ID NO: 82376 - RNA, 22 nt, Human
ccacugcacucaagccugggcg

SEQ ID NO: 82377 - RNA, 24 nt, Human
aacaacaaauucacggaaucuuuu

SEQ ID NO: 82378 - RNA, 27 nt, Human
guugcccagaaagacugucugggugag

SEQ ID NO: 82379 - RNA, 26 nt, Human
agccggaggggccggagcggagaagc

SEQ ID NO: 82380 - RNA, 23 nt, Human
cugugguucucuguuuuguguua

SEQ ID NO: 82381 - RNA, 26 nt, Human
aaagacacuucaucaagauaacucug

SEQ ID NO: 82382 - RNA, 27 nt, Human
uagagacacucccuugugcagcuuuga

SEQ ID NO: 82383 - RNA, 24 nt, Human
aucuauuaugcagcuauuaugugg

SEQ ID NO: 82384 - RNA, 22 nt, Human
agaguuuugaaacaguacugug

SEQ ID NO: 82385 - RNA, 23 nt, Human
ccccugaggacaggggcaucucu

SEQ ID NO: 82386 - RNA, 26 nt, Human
uguccacccuucccuggaaucugcuc

SEQ ID NO: 82387 - RNA, 25 nt, Human
gacagugacaacccuuucucuccag

SEQ ID NO: 82388 - RNA, 22 nt, Human
gcgugagccaccacaccaggcc

SEQ ID NO: 82389 - RNA, 22 nt, Human
acccauuaucuggaauauugug

SEQ ID NO: 82390 - RNA, 21 nt, Human
ggcuuggggaggggagggggc

SEQ ID NO: 82391 - RNA, 25 nt, Human
agcucugaaucagaagacagagcua

SEQ ID NO: 82392 - RNA, 23 nt, Human
gcgcugcccuggccucggcauuc

SEQ ID NO: 82393 - RNA, 21 nt, Human
cgauccuggauucacucacuc

SEQ ID NO: 82394 - RNA, 22 nt, Human
ucugggucuccugggggagacc

SEQ ID NO: 82395 - RNA, 27 nt, Human
aguucucuuggccccucucuaccccuu

SEQ ID NO: 82396 - RNA, 23 nt, Human
cagagcagcacaauaaaugaggc

SEQ ID NO: 82397 - RNA, 30 nt, Human
ggcaguguagcaucucuuccacaaucagac

SEQ ID NO: 82398 - RNA, 24 nt, Human
uugcaaucccaggcuggggucagc

SEQ ID NO: 82399 - RNA, 27 nt, Human
gugagccugaagcagauucgccccaga

SEQ ID NO: 82400 - RNA, 29 nt, Human
gcaagugaauuuuucucuaacucagaaac

SEQ ID NO: 82401 - RNA, 21 nt, Human
aaggaaucacaccauuauucc

SEQ ID NO: 82402 - RNA, 22 nt, Human
uccuccaaggcuggagugcagu

SEQ ID NO: 82403 - RNA, 24 nt, Human
gcugggaagucuggggaagggaua

SEQ ID NO: 82404 - RNA, 23 nt, Human
uacagaagaugaacuguauuuug

SEQ ID NO: 82405 - RNA, 26 nt, Human
gaaugagagacacacugaagaagcac

SEQ ID NO: 82406 - RNA, 22 nt, Human
gcccaggcugugaguuccaggu

SEQ ID NO: 82407 - RNA, 23 nt, Human
caccuuguguucuuccuagcucc

SEQ ID NO: 82408 - RNA, 19 nt, Human
ugccaggcuggagugcagu

SEQ ID NO: 82409 - RNA, 27 nt, Human
ucugcagcugccacuggugcaaggccu

SEQ ID NO: 82410 - RNA, 22 nt, Human
ggggugagacacaacagucuga

SEQ ID NO: 82411 - RNA, 27 nt, Human
gcaguagagugugugagugcagacugg

SEQ ID NO: 82412 - RNA, 26 nt, Human
ggucagaaucagucagccucugucau

SEQ ID NO: 82413 - RNA, 27 nt, Human
gaccagccugggcaacacaguaagacc

SEQ ID NO: 82414 - RNA, 18 nt, Human
ggugggaccagggccagg

SEQ ID NO: 82415 - RNA, 20 nt, Human
auuggguagugggagguggg

SEQ ID NO: 82416 - RNA, 21 nt, Human
auugguggcaucaucacgcca

SEQ ID NO: 82417 - RNA, 25 nt, Human
ccucccccuccuucucacccuuaag

SEQ ID NO: 82418 - RNA, 22 nt, Human
caggagguggagguugcaguga

SEQ ID NO: 82419 - RNA, 25 nt, Human
cuacucagaugcuggcuucagcuaa

SEQ ID NO: 82420 - RNA, 20 nt, Human
uccugcacugacucuggaaa

SEQ ID NO: 82421 - RNA, 27 nt, Human
caccgcugcacucgcggccggcgaugc

SEQ ID NO: 82422 - RNA, 20 nt, Human
ucucaauuugaaacacaaga

SEQ ID NO: 82423 - RNA, 20 nt, Human
aagguaggaaugaggcuaga

SEQ ID NO: 82424 - RNA, 22 nt, Human
cugggccucagucuguucaucu

SEQ ID NO: 82425 - RNA, 21 nt, Human
ucauuacccucucagcaugcu

SEQ ID NO: 82426 - RNA, 22 nt, Human
aacaguuuuguuuggugcugug

SEQ ID NO: 82427 - RNA, 21 nt, Human
ugggaccacaggcaugcacaa

SEQ ID NO: 82428 - RNA, 22 nt, Human
ccgccuccuggguucaagcaau

SEQ ID NO: 82429 - RNA, 22 nt, Human
ccaaagugcugggauuccaggu

SEQ ID NO: 82430 - RNA, 25 nt, Human
ucacaugcacaggugcucucagcuc

SEQ ID NO: 82431 - RNA, 23 nt, Human
cacuccauuggaucuuuuacuuu

SEQ ID NO: 82432 - RNA, 19 nt, Human
uauauuuauagucacaaga

SEQ ID NO: 82433 - RNA, 20 nt, Human
uccucaacagaguuuuauuu

SEQ ID NO: 82434 - RNA, 19 nt, Human
cuccuggugagagcuuaaa

SEQ ID NO: 82435 - RNA, 29 nt, Human
caucaucaccaaugacaucaugacagcaa

SEQ ID NO: 82436 - RNA, 22 nt, Human
cagccagcaagaguuaggggcc

SEQ ID NO: 82437 - RNA, 22 nt, Human
uaagggguugguugagguggaa

SEQ ID NO: 82438 - RNA, 25 nt, Human
agcugauaaagacuuuagcugacuc

SEQ ID NO: 82439 - RNA, 23 nt, Human
gaggcccuggcagaggugaagga

SEQ ID NO: 82440 - RNA, 22 nt, Human
cccagcugucaggagagaggug

SEQ ID NO: 82441 - RNA, 26 nt, Human
agagcaucugcucugggcccuggccu

SEQ ID NO: 82442 - RNA, 18 nt, Human
cacaggcaggggccuuga

SEQ ID NO: 82443 - RNA, 25 nt, Human
aggcuugauagcagagguuuggugg

SEQ ID NO: 82444 - RNA, 24 nt, Human
ugggaccccgcucagcauggcugc

SEQ ID NO: 82445 - RNA, 21 nt, Human
gucuauuucauuuuuccacac

SEQ ID NO: 82446 - RNA, 20 nt, Human
uucccagcugauucuuuuuc

SEQ ID NO: 82447 - RNA, 21 nt, Human
cuagccucugcuggagugcag

SEQ ID NO: 82448 - RNA, 26 nt, Human
uuccucagauccccagcuuucuccuc

SEQ ID NO: 82449 - RNA, 22 nt, Human
cccuccagacagcaccagcuca

SEQ ID NO: 82450 - RNA, 20 nt, Human
aagaauuaaucaagacucuu

SEQ ID NO: 82451 - RNA, 21 nt, Human
cuucuggagagugguggagaa

SEQ ID NO: 82452 - RNA, 27 nt, Human
uuguccaguguucgagugcucaacagu

SEQ ID NO: 82453 - RNA, 22 nt, Human
cuccuagcuggagugccauggc

SEQ ID NO: 82454 - RNA, 22 nt, Human
acagguucuguuuucacuuuuu

SEQ ID NO: 82455 - RNA, 23 nt, Human
gucaggccagggcagugcugcug

SEQ ID NO: 82456 - RNA, 22 nt, Human
cugcugucaaaggccagccugu

SEQ ID NO: 82457 - RNA, 22 nt, Human
agaccagccugggcaacaaagu

SEQ ID NO: 82458 - RNA, 20 nt, Human
augccuuucuaaggguugga

SEQ ID NO: 82459 - RNA, 20 nt, Human
gccgccucugccucggcgcg

SEQ ID NO: 82460 - RNA, 24 nt, Human
ucucucuuccagagagaggcagca

SEQ ID NO: 82461 - RNA, 21 nt, Human
gccacuuccgaaaaguuuaca

SEQ ID NO: 82462 - RNA, 17 nt, Human
cauuuucaaaagcaauu

SEQ ID NO: 82463 - RNA, 27 nt, Human
uacaaguccaguuugcaauucauuugu

SEQ ID NO: 82464 - RNA, 22 nt, Human
auauccuuucaagacagaaaga

SEQ ID NO: 82465 - RNA, 23 nt, Human
ucuuauauuuccuuucccucaga

SEQ ID NO: 82466 - RNA, 22 nt, Human
uuccccugcccuccuuucucag

SEQ ID NO: 82467 - RNA, 20 nt, Human
ggggugagguucuuggccuc

SEQ ID NO: 82468 - RNA, 21 nt, Human
ucagaggccuggcaucuucug

SEQ ID NO: 82469 - RNA, 22 nt, Human
auguucuccucuaucuuagagg

SEQ ID NO: 82470 - RNA, 24 nt, Human
cugcucuaguuucuuaguacucug

SEQ ID NO: 82471 - RNA, 20 nt, Human
uguuuuucccucccugggcc

SEQ ID NO: 82472 - RNA, 27 nt, Human
ccuuguuccugauuuuaaugggacuac

SEQ ID NO: 82473 - RNA, 21 nt, Human
ugcuaccacaccgugcccuca

SEQ ID NO: 82474 - RNA, 27 nt, Human
ccucccaggcuuccgugugggucagug

SEQ ID NO: 82475 - RNA, 24 nt, Human
aucuaggccgggugcaguggcuca

SEQ ID NO: 82476 - RNA, 21 nt, Human
uccucccauccacugccaccu

SEQ ID NO: 82477 - RNA, 21 nt, Human
gcaguucacucaccaagguga

SEQ ID NO: 82478 - RNA, 24 nt, Human
gccccagcaaaggggagucucagc

SEQ ID NO: 82479 - RNA, 21 nt, Human
ugggaggcugagguugcagga

SEQ ID NO: 82480 - RNA, 22 nt, Human
gaggugagaggaaugaggggca

SEQ ID NO: 82481 - RNA, 22 nt, Human
gccuguuuuagggacugcaaaa

SEQ ID NO: 82482 - RNA, 27 nt, Human
ggcugagaaaauguaaggauucuggaa

SEQ ID NO: 82483 - RNA, 21 nt, Human
gcagucuccuggaaccagcag

SEQ ID NO: 82484 - RNA, 22 nt, Human
acugcuugaacccaggaggcag

SEQ ID NO: 82485 - RNA, 22 nt, Human
cagacaacuuacauacacucca

SEQ ID NO: 82486 - RNA, 29 nt, Human
gcagagugugagggagaccccgguuauuu

SEQ ID NO: 82487 - RNA, 22 nt, Human
uccaaaacuguggggugugaca

SEQ ID NO: 82488 - RNA, 23 nt, Human
cuccuagugagugugcugacuuu

SEQ ID NO: 82489 - RNA, 18 nt, Human
ccaggagguguugcagug

SEQ ID NO: 82490 - RNA, 17 nt, Human
aggaaagagggagcagg

SEQ ID NO: 82491 - RNA, 25 nt, Human
ugguagcucacaccuguaaucccag

SEQ ID NO: 82492 - RNA, 19 nt, Human
uuuuaacaaaaaacgggga

SEQ ID NO: 82493 - RNA, 27 nt, Human
uccugguggcuuuucuuagcaugugug

SEQ ID NO: 82494 - RNA, 22 nt, Human
ucugauuggagcuucaugauag

SEQ ID NO: 82495 - RNA, 20 nt, Human
agcacaugccuucugugccg

SEQ ID NO: 82496 - RNA, 26 nt, Human
augaaaagagaaaagaaaaauguagg

SEQ ID NO: 82497 - RNA, 22 nt, Human
ucgcccuggcuggagugcaaug

SEQ ID NO: 82498 - RNA, 21 nt, Human
acagcccuguguugugcucag

SEQ ID NO: 82499 - RNA, 22 nt, Human
cagccagcagaggcagcagcac

SEQ ID NO: 82500 - RNA, 27 nt, Human
acugcaaccuccaccuuccugguucaa

SEQ ID NO: 82501 - RNA, 22 nt, Human
cgagccgccuccgccugccucg

SEQ ID NO: 82502 - RNA, 22 nt, Human
cugaggcgagagaaucgcuuga

SEQ ID NO: 82503 - RNA, 23 nt, Human
uggucccaggccguucagccuga

SEQ ID NO: 82504 - RNA, 21 nt, Human
cucuuccguuccacauccaca

SEQ ID NO: 82505 - RNA, 22 nt, Human
gggcuuuguggcccugggggug

SEQ ID NO: 82506 - RNA, 27 nt, Human
uuuccaaauggcgacaguugcuucuua

SEQ ID NO: 82507 - RNA, 22 nt, Human
uccacccucugggccucagugu

SEQ ID NO: 82508 - RNA, 21 nt, Human
ccagagaguauuaugagggag

SEQ ID NO: 82509 - RNA, 26 nt, Human
ccagcauuaggaaacuuguucacuuu

SEQ ID NO: 82510 - RNA, 20 nt, Human
agaccuaagauuaucgggag

SEQ ID NO: 82511 - RNA, 23 nt, Human
agucacugagguuuaaacacaau

SEQ ID NO: 82512 - RNA, 22 nt, Human
ucaagcagcaaaaguucccgga

SEQ ID NO: 82513 - RNA, 22 nt, Human
acugauuuccagaggaaagcua

SEQ ID NO: 82514 - RNA, 22 nt, Human
ccaaaaugucaguuguacugag

SEQ ID NO: 82515 - RNA, 24 nt, Human
ucugcuaucaccuuccucuuguca

SEQ ID NO: 82516 - RNA, 25 nt, Human
ucuuguguugcuucuggucucucca

SEQ ID NO: 82517 - RNA, 20 nt, Human
ccugcugcugcucaucuccc

SEQ ID NO: 82518 - RNA, 26 nt, Human
gggggaugaauuauaaauuauauuca

SEQ ID NO: 82519 - RNA, 22 nt, Human
ccagaucuguaugauuuguucc

SEQ ID NO: 82520 - RNA, 20 nt, Human
uucugugagcucaggucccu

SEQ ID NO: 82521 - RNA, 20 nt, Human
gagccccaggcagggcuagu

SEQ ID NO: 82522 - RNA, 23 nt, Human
ggagguggcggauggagugggaa

SEQ ID NO: 82523 - RNA, 23 nt, Human
cucuggauucucugggucuaugu

SEQ ID NO: 82524 - RNA, 26 nt, Human
uggacucugugugagcguguccacag

SEQ ID NO: 82525 - RNA, 27 nt, Human
aaaacauugaauguuuuacaaaugaag

SEQ ID NO: 82526 - RNA, 21 nt, Human
cuagauugaucaagaucugac

SEQ ID NO: 82527 - RNA, 20 nt, Human
aucaaauuagaauucacuga

SEQ ID NO: 82528 - RNA, 20 nt, Human
uucugcugauuaucacacau

SEQ ID NO: 82529 - RNA, 22 nt, Human
uuuaauacaggaaauugacuua

SEQ ID NO: 82530 - RNA, 26 nt, Human
gucucugugaguuugcauuucauuug

SEQ ID NO: 82531 - RNA, 22 nt, Human
uucccugaauaaaugcauuauu

SEQ ID NO: 82532 - RNA, 27 nt, Human
ccccaguagcugggauuacaguguuau

SEQ ID NO: 82533 - RNA, 21 nt, Human
ccagccuggcgacaagaguga

SEQ ID NO: 82534 - RNA, 24 nt, Human
accacaggcugguguguagguggu

SEQ ID NO: 82535 - RNA, 32 nt, Human
cugcaccgcgcguccugcacucaaccccgccu

SEQ ID NO: 82536 - RNA, 27 nt, Human
uucacacaccuacuuuucugcuucguu

SEQ ID NO: 82537 - RNA, 16 nt, Human
auuuccuucuuaacuc

SEQ ID NO: 82538 - RNA, 23 nt, Human
ggauuugacuuuucuuccuugcc

SEQ ID NO: 82539 - RNA, 19 nt, Human
uggucccagagcagaggaa

SEQ ID NO: 82540 - RNA, 24 nt, Human
agagauacccugagguucauguca

SEQ ID NO: 82541 - RNA, 27 nt, Human
accuugacagaaaaacaacuuuuauuc

SEQ ID NO: 82542 - RNA, 27 nt, Human
gggcggggcggucgcggcggaggcaga

SEQ ID NO: 82543 - RNA, 25 nt, Human
uggggugggaguagguagagcugag

SEQ ID NO: 82544 - RNA, 22 nt, Human
ggaaagcaucuugccuugggac

SEQ ID NO: 82545 - RNA, 20 nt, Human
gcacggacauacaaaaucaa

SEQ ID NO: 82546 - RNA, 23 nt, Human
agcaggaauuuauacauugggua

SEQ ID NO: 82547 - RNA, 25 nt, Human
ugcgccuuccuuucucucuccugug

SEQ ID NO: 82548 - RNA, 22 nt, Human
ggcauauuaacaccugccuucu

SEQ ID NO: 82549 - RNA, 28 nt, Human
gcccuggggaugauguggaaauaggggc

SEQ ID NO: 82550 - RNA, 24 nt, Human
gcaauuagguagcacagcacuuug

SEQ ID NO: 82551 - RNA, 23 nt, Human
cugcagaugaccucaugaacugg

SEQ ID NO: 82552 - RNA, 27 nt, Human
cccuccugcgcugccccagagccuggg

SEQ ID NO: 82553 - RNA, 26 nt, Human
aauguuguaucuuugagaccguuguc

SEQ ID NO: 82554 - RNA, 24 nt, Human
aaaagcuggaggaaggccgugggc

SEQ ID NO: 82555 - RNA, 29 nt, Human
gcuggggccuccaggcucacagaccaccc

SEQ ID NO: 82556 - RNA, 24 nt, Human
gggaggcaagagacugggagccac

SEQ ID NO: 82557 - RNA, 21 nt, Human
cagaagccaguuuuaucuaac

SEQ ID NO: 82558 - RNA, 23 nt, Human
gcugcagcuaauuugugaaagug

SEQ ID NO: 82559 - RNA, 23 nt, Human
caaaacaauaugcaucaggagaa

SEQ ID NO: 82560 - RNA, 20 nt, Human
cacccaggcuugagugcagu

SEQ ID NO: 82561 - RNA, 23 nt, Human
guuacagacaccuuccucugugu

SEQ ID NO: 82562 - RNA, 21 nt, Human
ccggguagcugggacuacagg

SEQ ID NO: 82563 - RNA, 24 nt, Human
acagcuuggugggaagggaagcac

SEQ ID NO: 82564 - RNA, 18 nt, Human
uaguuuaggcuggaaaug

SEQ ID NO: 82565 - RNA, 23 nt, Human
aacuacacaaagauaauguaaua

SEQ ID NO: 82566 - RNA, 22 nt, Human
ucuccaaugagacucaauggcu

SEQ ID NO: 82567 - RNA, 23 nt, Human
ccaaaagggaaaccaaggcugca

SEQ ID NO: 82568 - RNA, 20 nt, Human
agaaauguagguccucagaa

SEQ ID NO: 82569 - RNA, 22 nt, Human
gcccuggcuggagugcaauggu

SEQ ID NO: 82570 - RNA, 27 nt, Human
agucagauggcaaugaaagcccugguc

SEQ ID NO: 82571 - RNA, 21 nt, Human
aucaacuuucauacugacgcg

SEQ ID NO: 82572 - RNA, 22 nt, Human
ccuaguagcugggauuacaggc

SEQ ID NO: 82573 - RNA, 19 nt, Human
ggaggccaaggugggaaga

SEQ ID NO: 82574 - RNA, 22 nt, Human
aaauuuauaucauuaacaaugu

SEQ ID NO: 82575 - RNA, 21 nt, Human
cuagaugagugucucaggcca

SEQ ID NO: 82576 - RNA, 28 nt, Human
gguaaugagggacuggaaccagggagac

SEQ ID NO: 82577 - RNA, 19 nt, Human
ggaggaagauugauuuucu

SEQ ID NO: 82578 - RNA, 22 nt, Human
gaccaaccuggccaacauggug

SEQ ID NO: 82579 - RNA, 21 nt, Human
gagagaugcaguuugacccca

SEQ ID NO: 82580 - RNA, 18 nt, Human
gucuguguguuucugugu

SEQ ID NO: 82581 - RNA, 22 nt, Human
gagccaacuucaggcugcucag

SEQ ID NO: 82582 - RNA, 22 nt, Human
cgcaucccggguucaagagauu

SEQ ID NO: 82583 - RNA, 22 nt, Human
uacaaguguauaucagaaaagg

SEQ ID NO: 82584 - RNA, 24 nt, Human
ccugaauccaucccccuccugacc

SEQ ID NO: 82585 - RNA, 21 nt, Human
guggagggggaggggagaagc

SEQ ID NO: 82586 - RNA, 27 nt, Human
cucuugucaaccgggcuggagugcagu

SEQ ID NO: 82587 - RNA, 22 nt, Human
guucagcuugugcuagucauca

SEQ ID NO: 82588 - RNA, 21 nt, Human
cggcccaugcccagggccgcu

SEQ ID NO: 82589 - RNA, 27 nt, Human
gguccucacugcagcuggccucuggca

SEQ ID NO: 82590 - RNA, 21 nt, Human
accuguauuccucuucuucgu

SEQ ID NO: 82591 - RNA, 22 nt, Human
aaaggauacuuucacaauuucc

SEQ ID NO: 82592 - RNA, 21 nt, Human
uacccaggguggagugcagug

SEQ ID NO: 82593 - RNA, 26 nt, Human
cuccagugcucagcuguggcuggagg

SEQ ID NO: 82594 - RNA, 24 nt, Human
agagagggcugggugggagcccag

SEQ ID NO: 82595 - RNA, 19 nt, Human
ucccuuuaaauuuuaucug

SEQ ID NO: 82596 - RNA, 29 nt, Human
ggucuccugcagcccucugcuccucccgg

SEQ ID NO: 82597 - RNA, 27 nt, Human
gcuagguagaauuuguacuuguuuucu

SEQ ID NO: 82598 - RNA, 19 nt, Human
ccccucacaggcuuggggg

SEQ ID NO: 82599 - RNA, 22 nt, Human
ugcacauaucaugaacagcgua

SEQ ID NO: 82600 - RNA, 22 nt, Human
uuccagugauucuccugccuca

SEQ ID NO: 82601 - RNA, 20 nt, Human
guauucccaacacuuuugga

SEQ ID NO: 82602 - RNA, 22 nt, Human
ggcauauccguguaauggaaga

SEQ ID NO: 82603 - RNA, 21 nt, Human
gauucaguuguuauugcagug

SEQ ID NO: 82604 - RNA, 22 nt, Human
cuucaacuaaaaacaaaggaga

SEQ ID NO: 82605 - RNA, 21 nt, Human
aggcaacugguccugggggug

SEQ ID NO: 82606 - RNA, 24 nt, Human
caggcauucacugaccaggccuuu

SEQ ID NO: 82607 - RNA, 27 nt, Human
gagaaagaggagcccucccgcucagcc

SEQ ID NO: 82608 - RNA, 25 nt, Human
cucccucuuccucuccauaccugcc

SEQ ID NO: 82609 - RNA, 19 nt, Human
caggaugcggcuguggaag

SEQ ID NO: 82610 - RNA, 19 nt, Human
acuuauuucaagggugcug

SEQ ID NO: 82611 - RNA, 18 nt, Human
cgcccucgucaggcccag

SEQ ID NO: 82612 - RNA, 26 nt, Human
auggaaagaaagaagcguaugacaca

SEQ ID NO: 82613 - RNA, 27 nt, Human
caaccaaaagaauuucaauacccauuc

SEQ ID NO: 82614 - RNA, 18 nt, Human
gaggggugaaagcauuaa

SEQ ID NO: 82615 - RNA, 21 nt, Human
uaucuagucacuugcuuucua

SEQ ID NO: 82616 - RNA, 25 nt, Human
uggaagagauuuugucuaaagggca

SEQ ID NO: 82617 - RNA, 24 nt, Human
acacacaccccuguccuccagcac

SEQ ID NO: 82618 - RNA, 18 nt, Human
ggaggucaaagcugcagu

SEQ ID NO: 82619 - RNA, 21 nt, Human
uugucauuggaaacacugccu

SEQ ID NO: 82620 - RNA, 32 nt, Human
ggagagugcguggccauagggagccgacaugc

SEQ ID NO: 82621 - RNA, 21 nt, Human
guccugccucagggcuuuucg

SEQ ID NO: 82622 - RNA, 24 nt, Human
ggaggcagcaggggguacagacuu

SEQ ID NO: 82623 - RNA, 22 nt, Human
cuaguuccauguuucuuuucua

SEQ ID NO: 82624 - RNA, 22 nt, Human
aggagguggugggcucgcagga

SEQ ID NO: 82625 - RNA, 25 nt, Human
gcuucaagagcauacucuguacuag

SEQ ID NO: 82626 - RNA, 21 nt, Human
uguuuccaggugggcaugguu

SEQ ID NO: 82627 - RNA, 22 nt, Human
caagcaccuuccccuccauucc

SEQ ID NO: 82628 - RNA, 22 nt, Human
cucccuaaaaugccagcugagc

SEQ ID NO: 82629 - RNA, 22 nt, Human
ggaaaguucuuucuguagaucu

SEQ ID NO: 82630 - RNA, 20 nt, Human
ccgaagcagaggauacagga

SEQ ID NO: 82631 - RNA, 22 nt, Human
accagccugggcaacauaguga

SEQ ID NO: 82632 - RNA, 22 nt, Human
ucuaaacaaccuacccuccuuc

SEQ ID NO: 82633 - RNA, 29 nt, Human
ggggagcaggggguggcagagggcacccg

SEQ ID NO: 82634 - RNA, 24 nt, Human
gggccugggcacaggaggagcagc

SEQ ID NO: 82635 - RNA, 25 nt, Human
ugcucuuuuaaagccaaugauuccc

SEQ ID NO: 82636 - RNA, 21 nt, Human
cucuuggaaagauacagcucc

SEQ ID NO: 82637 - RNA, 21 nt, Human
ggguggugcuaagauccuccu

SEQ ID NO: 82638 - RNA, 27 nt, Human
uacagccgccgccgccgcuguugccgc

SEQ ID NO: 82639 - RNA, 23 nt, Human
cuccagggacuggaguguaaugc

SEQ ID NO: 82640 - RNA, 22 nt, Human
ggccgggcucucuaguggugau

SEQ ID NO: 82641 - RNA, 22 nt, Human
acuccuguuuucucucucacag

SEQ ID NO: 82642 - RNA, 21 nt, Human
aaugacacuuucuaugcugaa

SEQ ID NO: 82643 - RNA, 21 nt, Human
uuuggauugagaaucauuggc

SEQ ID NO: 82644 - RNA, 23 nt, Human
cucccucccguagucuccugggu

SEQ ID NO: 82645 - RNA, 23 nt, Human
ggcucauugcaaccucugccucc

SEQ ID NO: 82646 - RNA, 23 nt, Human
auuugucccuccggccugggcgg

SEQ ID NO: 82647 - RNA, 21 nt, Human
cugugcccccuccucccugcc

SEQ ID NO: 82648 - RNA, 23 nt, Human
cccagugacuucuuuuugcccag

SEQ ID NO: 82649 - RNA, 27 nt, Human
aggggggcugugccaaccuguucuuag

SEQ ID NO: 82650 - RNA, 21 nt, Human
caugagccaccaugcccggcc

SEQ ID NO: 82651 - RNA, 24 nt, Human
uugccucacuggacucuuuauccu

SEQ ID NO: 82652 - RNA, 23 nt, Human
ggaaaucagcaaacuuugcauua

SEQ ID NO: 82653 - RNA, 22 nt, Human
uuugggaaaauuaaguaacaac

SEQ ID NO: 82654 - RNA, 26 nt, Human
uuguucagccugccuucuuuucuccc

SEQ ID NO: 82655 - RNA, 25 nt, Human
accaaaugguuacauugugcugcua

SEQ ID NO: 82656 - RNA, 22 nt, Human
ccugccuggguuuucuaacugu

SEQ ID NO: 82657 - RNA, 20 nt, Human
cccaggagcuaaugguagag

SEQ ID NO: 82658 - RNA, 27 nt, Human
gagcuuuugggcucaucacuggccugg

SEQ ID NO: 82659 - RNA, 32 nt, Human
cuaagccaaaccccaaaaacaacuguauaauu

SEQ ID NO: 82660 - RNA, 23 nt, Human
accuguaaucccagcuacucagg

SEQ ID NO: 82661 - RNA, 25 nt, Human
acccaggaggaggaaacuucacaua

SEQ ID NO: 82662 - RNA, 29 nt, Human
uucuccauguuggucaggcugcucucaga

SEQ ID NO: 82663 - RNA, 26 nt, Human
uggaaagagaaaucugugacuccaau

SEQ ID NO: 82664 - RNA, 22 nt, Human
gucucccaggcuggaggucagu

SEQ ID NO: 82665 - RNA, 24 nt, Human
uguauuugagaaaauaaacaucug

SEQ ID NO: 82666 - RNA, 26 nt, Human
ccucuucauauugaagauggauuagg

SEQ ID NO: 82667 - RNA, 19 nt, Human
cugaucuugggccuguuuc

SEQ ID NO: 82668 - RNA, 22 nt, Human
aagugaccauguuuuguuuacg

SEQ ID NO: 82669 - RNA, 21 nt, Human
guguccaaaaguagcccaggg

SEQ ID NO: 82670 - RNA, 26 nt, Human
ccauguugggcuccucacacaugauc

SEQ ID NO: 82671 - RNA, 22 nt, Human
uagguauauaauucucuucuua

SEQ ID NO: 82672 - RNA, 27 nt, Human
cccagcacagaggaauauuggcuggca

SEQ ID NO: 82673 - RNA, 20 nt, Human
gcacacaggaucaugugguu

SEQ ID NO: 82674 - RNA, 22 nt, Human
cugaagcaggaaaaucgcuuga

SEQ ID NO: 82675 - RNA, 22 nt, Human
cugaggcaagagaguugcuuga

SEQ ID NO: 82676 - RNA, 24 nt, Human
caccagaggucaggaguucgagac

SEQ ID NO: 82677 - RNA, 23 nt, Human
aucaugcuauucuuacacuugcu

SEQ ID NO: 82678 - RNA, 27 nt, Human
acacuauacuggagggauuucauuuuu

SEQ ID NO: 82679 - RNA, 24 nt, Human
ccuugaaaaguggcagaaaaagaa

SEQ ID NO: 82680 - RNA, 20 nt, Human
gcaacgccugguggccuggg

SEQ ID NO: 82681 - RNA, 27 nt, Human
ucuuggccgggaacacagacagggugu

SEQ ID NO: 82682 - RNA, 22 nt, Human
uucaagcaccaccuccacccag

SEQ ID NO: 82683 - RNA, 19 nt, Human
cccuuuuccaugcuguggu

SEQ ID NO: 82684 - RNA, 26 nt, Human
gcugccucucuggggagaugcuggag

SEQ ID NO: 82685 - RNA, 27 nt, Human
gagacuugcuuacaguggaugccacuu

SEQ ID NO: 82686 - RNA, 19 nt, Human
ggggauugggccccugcca

SEQ ID NO: 82687 - RNA, 23 nt, Human
aucauaccacugcacugcagccu

SEQ ID NO: 82688 - RNA, 22 nt, Human
gcgccggcuugccaggagcugg

SEQ ID NO: 82689 - RNA, 24 nt, Human
cagcuaaugcuuucuuggucacuc

SEQ ID NO: 82690 - RNA, 20 nt, Human
cugucucuuggaaagauaca

SEQ ID NO: 82691 - RNA, 22 nt, Human
gugccugcuguucgugacucag

SEQ ID NO: 82692 - RNA, 22 nt, Human
ggaucuguucuggaacggaagc

SEQ ID NO: 82693 - RNA, 26 nt, Human
uggugccuguaaagcucucagcauug

SEQ ID NO: 82694 - RNA, 25 nt, Human
guggaugaugauugcgcagggaggg

SEQ ID NO: 82695 - RNA, 23 nt, Human
ccuggcccuccugggaucugggg

SEQ ID NO: 82696 - RNA, 20 nt, Human
gugauuucccuguauugggu

SEQ ID NO: 82697 - RNA, 22 nt, Human
cuccauguccuguuguggggcu

SEQ ID NO: 82698 - RNA, 21 nt, Human
ucauuaaaggaaacguggcag

SEQ ID NO: 82699 - RNA, 23 nt, Human
agccccuccccuacuuuuugguc

SEQ ID NO: 82700 - RNA, 17 nt, Human
cuggggguuucuaucac

SEQ ID NO: 82701 - RNA, 19 nt, Human
cuuccagccagucugcugc

SEQ ID NO: 82702 - RNA, 20 nt, Human
cuagggucccugaacgcccu

SEQ ID NO: 82703 - RNA, 22 nt, Human
gcccaggcuggaguguaguggc

SEQ ID NO: 82704 - RNA, 22 nt, Human
uuuaagcaaugcuucugccuca

SEQ ID NO: 82705 - RNA, 32 nt, Human
ugggaggggagguguuagugcaugcaaggguu

SEQ ID NO: 82706 - RNA, 18 nt, Human
ucaggcuggagcacagug

SEQ ID NO: 82707 - RNA, 28 nt, Human
cugcccuccccucccccacucuauacua

SEQ ID NO: 82708 - RNA, 21 nt, Human
gcucaagaccagccuggucaa

SEQ ID NO: 82709 - RNA, 26 nt, Human
ucuuucuccucugugccccucaugcu

SEQ ID NO: 82710 - RNA, 25 nt, Human
accaucuguuuggggagcacacucu

SEQ ID NO: 82711 - RNA, 21 nt, Human
gucacuacuggucuguacucc

SEQ ID NO: 82712 - RNA, 22 nt, Human
aacgcugacagaaaugaaugca

SEQ ID NO: 82713 - RNA, 22 nt, Human
ugguccuccauuucaacuccag

SEQ ID NO: 82714 - RNA, 26 nt, Human
ugccuagggccggaguugcugccagu

SEQ ID NO: 82715 - RNA, 19 nt, Human
auuuuucugaaguagccuc

SEQ ID NO: 82716 - RNA, 28 nt, Human
aaccugggaaagccaugaccuugugccc

SEQ ID NO: 82717 - RNA, 24 nt, Human
gccagagccaagaaacacuuucag

SEQ ID NO: 82718 - RNA, 25 nt, Human
gggagaagagaggagaggagggcuc

SEQ ID NO: 82719 - RNA, 23 nt, Human
cagccagggcccaggcagcuuug

SEQ ID NO: 82720 - RNA, 21 nt, Human
uuaagaccccaaacaaacaaa

SEQ ID NO: 82721 - RNA, 25 nt, Human
acugucccccaggcuggagugcagu

SEQ ID NO: 82722 - RNA, 21 nt, Human
cgucuggcauuccugggucgu

SEQ ID NO: 82723 - RNA, 23 nt, Human
gggaauggaaaggacagcaagca

SEQ ID NO: 82724 - RNA, 18 nt, Human
aaaacauuuaauuuaugg

SEQ ID NO: 82725 - RNA, 22 nt, Human
ggguguccaguccucagggcaa

SEQ ID NO: 82726 - RNA, 24 nt, Human
guuggugagaggaucugugugugc

SEQ ID NO: 82727 - RNA, 27 nt, Human
gcucuuccuccaaggcuggagugcagu

SEQ ID NO: 82728 - RNA, 20 nt, Human
aagcguugcagcuguggaag

SEQ ID NO: 82729 - RNA, 19 nt, Human
caaguguccaacaagaagg

SEQ ID NO: 82730 - RNA, 27 nt, Human
caccacccuccagccugggcaacguag

SEQ ID NO: 82731 - RNA, 22 nt, Human
ugagccggaggcgguggcauuu

SEQ ID NO: 82732 - RNA, 22 nt, Human
gacaguuuaucgucaugcuguu

SEQ ID NO: 82733 - RNA, 24 nt, Human
cacaucuguaacuucuuuuuccag

SEQ ID NO: 82734 - RNA, 27 nt, Human
cccaccccgggcucuccugcccugccc

SEQ ID NO: 82735 - RNA, 23 nt, Human
gggguggagauggguguggcagu

SEQ ID NO: 82736 - RNA, 19 nt, Human
cugugugaccugagaguga

SEQ ID NO: 82737 - RNA, 21 nt, Human
ucgcacugggggacaugggag

SEQ ID NO: 82738 - RNA, 20 nt, Human
cucuaaagucuuugccucag

SEQ ID NO: 82739 - RNA, 23 nt, Human
cugcagguuucugugccccugug

SEQ ID NO: 82740 - RNA, 21 nt, Human
gggcaaauuguuugagucagu

SEQ ID NO: 82741 - RNA, 25 nt, Human
ugugaauuccucuuucucugcugga

SEQ ID NO: 82742 - RNA, 24 nt, Human
aaguaugacagagcagggccuuaa

SEQ ID NO: 82743 - RNA, 22 nt, Human
cgccucuuggguucaagcgauu

SEQ ID NO: 82744 - RNA, 26 nt, Human
gaggaauuucuguugagcugaaaugc

SEQ ID NO: 82745 - RNA, 31 nt, Human
ucuccugcugcucggguucugaggcacagcu

SEQ ID NO: 82746 - RNA, 20 nt, Human
ggcugcaccugaagcauuug

SEQ ID NO: 82747 - RNA, 25 nt, Human
agccauguucacaccgcugcacuca

SEQ ID NO: 82748 - RNA, 20 nt, Human
uuacauauuugacucuuuca

SEQ ID NO: 82749 - RNA, 23 nt, Human
ucagaaucuugaaaacaacauuu

SEQ ID NO: 82750 - RNA, 28 nt, Human
uucccugcucagcuucugcucaggaguu

SEQ ID NO: 82751 - RNA, 22 nt, Human
uggucucaaacuccugacccug

SEQ ID NO: 82752 - RNA, 22 nt, Human
cccgaguaguugggauuacagg

SEQ ID NO: 82753 - RNA, 27 nt, Human
aguguuuggcaguuugagaccgcuacc

SEQ ID NO: 82754 - RNA, 23 nt, Human
ugucacccagacuggagugcagg

SEQ ID NO: 82755 - RNA, 24 nt, Human
ugucacacaagcuccuuaaccuuc

SEQ ID NO: 82756 - RNA, 22 nt, Human
ugcagugagccuggaucaugcc

SEQ ID NO: 82757 - RNA, 21 nt, Human
cccucccagggccagggcccu

SEQ ID NO: 82758 - RNA, 28 nt, Human
gggaggcugagacaggagaaucgcuuga

SEQ ID NO: 82759 - RNA, 21 nt, Human
ugacugcugccggaugcugug

SEQ ID NO: 82760 - RNA, 27 nt, Human
ucacugcaacuucugccucccaugcuu

SEQ ID NO: 82761 - RNA, 20 nt, Human
ugauccucagacaugcagcu

SEQ ID NO: 82762 - RNA, 23 nt, Human
cuauauauaaagacaacaaaaga

SEQ ID NO: 82763 - RNA, 25 nt, Human
gggcuauccugggaccuccccagcc

SEQ ID NO: 82764 - RNA, 23 nt, Human
uucaguuuaaccacugauugccu

SEQ ID NO: 82765 - RNA, 23 nt, Human
augcuggaggcuugguaaguucc

SEQ ID NO: 82766 - RNA, 22 nt, Human
cucuaccagaacuaagcacuuu

SEQ ID NO: 82767 - RNA, 27 nt, Human
guggcaaaaauuagcuauacugaugua

SEQ ID NO: 82768 - RNA, 27 nt, Human
ucaucccuguggggagugcagggccag

SEQ ID NO: 82769 - RNA, 22 nt, Human
auaucgacauacauauauauuu

SEQ ID NO: 82770 - RNA, 27 nt, Human
ucuagaucagagagcaagaaaaaagua

SEQ ID NO: 82771 - RNA, 26 nt, Human
agggucuguaaucucgcagagcacag

SEQ ID NO: 82772 - RNA, 25 nt, Human
gccugugucccuguccuucaggccc

SEQ ID NO: 82773 - RNA, 25 nt, Human
ggauggccagcugccagagcugcgg

SEQ ID NO: 82774 - RNA, 25 nt, Human
agaaguccuuggggaagcugcuggu

SEQ ID NO: 82775 - RNA, 20 nt, Human
cuacagguccaggguuguua

SEQ ID NO: 82776 - RNA, 26 nt, Human
acucgagagcgguggggguggcggcg

SEQ ID NO: 82777 - RNA, 21 nt, Human
cucaacaacaaugugcagugg

SEQ ID NO: 82778 - RNA, 22 nt, Human
cagauauuggguaaaccaaagu

SEQ ID NO: 82779 - RNA, 21 nt, Human
ggggaaaugcaaaaaccugca

SEQ ID NO: 82780 - RNA, 25 nt, Human
guucaagucuucuguuagggggcca

SEQ ID NO: 82781 - RNA, 25 nt, Human
ccuaacgucuuccuuucccugcacu

SEQ ID NO: 82782 - RNA, 26 nt, Human
ucucucucauagcuuuuaugcccuua

SEQ ID NO: 82783 - RNA, 19 nt, Human
ugagcucugccucuuccag

SEQ ID NO: 82784 - RNA, 18 nt, Human
aaacgcacaccagacggg

SEQ ID NO: 82785 - RNA, 27 nt, Human
caugaacacaugcacaugugcacacac

SEQ ID NO: 82786 - RNA, 21 nt, Human
cuccagccugggcuacagagc

SEQ ID NO: 82787 - RNA, 22 nt, Human
caaguuggcagugguucuggua

SEQ ID NO: 82788 - RNA, 22 nt, Human
uagagaguauauuuucugcugu

SEQ ID NO: 82789 - RNA, 23 nt, Human
guugcccaggcuggagugcauug

SEQ ID NO: 82790 - RNA, 18 nt, Human
uugcucaggcuggaguac

SEQ ID NO: 82791 - RNA, 23 nt, Human
gucacccagucuguugcugcucc

SEQ ID NO: 82792 - RNA, 22 nt, Human
cccugcccuggcgcagccagag

SEQ ID NO: 82793 - RNA, 21 nt, Human
ucugcaauaaaacaagaagcu

SEQ ID NO: 82794 - RNA, 22 nt, Human
agggcggugggaggggaggagu

SEQ ID NO: 82795 - RNA, 26 nt, Human
aaaguuaaaguuucucagggugggaa

SEQ ID NO: 82796 - RNA, 25 nt, Human
gggaccccuuccuccugacuccagc

SEQ ID NO: 82797 - RNA, 22 nt, Human
uaugagucgucguuucugucag

SEQ ID NO: 82798 - RNA, 26 nt, Human
gucucccccaucucauccuuuucccc

SEQ ID NO: 82799 - RNA, 24 nt, Human
aauacuccagguggguguuagcac

SEQ ID NO: 82800 - RNA, 21 nt, Human
cagcccagcccagggccugag

SEQ ID NO: 82801 - RNA, 25 nt, Human
gcccaggcuggagugcaguggccug

SEQ ID NO: 82802 - RNA, 24 nt, Human
uacagcuauauuugauuauguaug

SEQ ID NO: 82803 - RNA, 22 nt, Human
auuaaagagaauuagcuuagcg

SEQ ID NO: 82804 - RNA, 21 nt, Human
auaaauguauuuaugcugcua

SEQ ID NO: 82805 - RNA, 23 nt, Human
cuguugacagccagcucacaguu

SEQ ID NO: 82806 - RNA, 26 nt, Human
uccgucacucuuccuugugguaaucc

SEQ ID NO: 82807 - RNA, 23 nt, Human
cuuccaucugcugggugccucca

SEQ ID NO: 82808 - RNA, 24 nt, Human
aacaacaaauacuuccauauggag

SEQ ID NO: 82809 - RNA, 23 nt, Human
cugugccucggcuuuucucagcu

SEQ ID NO: 82810 - RNA, 19 nt, Human
gaagucaggcugcccccuc

SEQ ID NO: 82811 - RNA, 22 nt, Human
ccugaacugaaaggacugugug

SEQ ID NO: 82812 - RNA, 23 nt, Human
cuuuugcaucauauggguaucua

SEQ ID NO: 82813 - RNA, 31 nt, Human
guacauugaggaguauuuacauuuuauaaaa

SEQ ID NO: 82814 - RNA, 26 nt, Human
gcagcaccugcccuaccugccccacu

SEQ ID NO: 82815 - RNA, 21 nt, Human
gaaccccuggaaaacccauaa

SEQ ID NO: 82816 - RNA, 24 nt, Human
auaucucccuugaaaauacuuuca

SEQ ID NO: 82817 - RNA, 20 nt, Human
ucacgcaugucauucacugc

SEQ ID NO: 82818 - RNA, 22 nt, Human
agccuccugggaguuguagucg

SEQ ID NO: 82819 - RNA, 23 nt, Human
gggaagagagaaacucuucagcg

SEQ ID NO: 82820 - RNA, 25 nt, Human
acuaauuuugccacaggguacuaaa

SEQ ID NO: 82821 - RNA, 24 nt, Human
uaccaccccccgccuucccccugc

SEQ ID NO: 82822 - RNA, 26 nt, Human
gaguuuaguccacagaacuaacugga

SEQ ID NO: 82823 - RNA, 22 nt, Human
ccgggaagcggagcuugcagug

SEQ ID NO: 82824 - RNA, 23 nt, Human
ccccaugcaacaaccaccaccuu

SEQ ID NO: 82825 - RNA, 20 nt, Human
cgggguggggacagguagac

SEQ ID NO: 82826 - RNA, 22 nt, Human
agaaaacuugcucucaaacuuc

SEQ ID NO: 82827 - RNA, 20 nt, Human
cuucucugaucuguguguuu

SEQ ID NO: 82828 - RNA, 27 nt, Human
aaagugcagggauuacaggcacaagcc

SEQ ID NO: 82829 - RNA, 22 nt, Human
cuaaggcagguggaucacuuga

SEQ ID NO: 82830 - RNA, 22 nt, Human
ccgaguagcuggcauuacaggc

SEQ ID NO: 82831 - RNA, 27 nt, Human
ccccaaaacugacaccuuuguuagcca

SEQ ID NO: 82832 - RNA, 22 nt, Human
aaauagagcucauaaagaaaua

SEQ ID NO: 82833 - RNA, 20 nt, Human
cucccauuuuccgcuacuga

SEQ ID NO: 82834 - RNA, 25 nt, Human
ucagcauuggccucuguguacaaac

SEQ ID NO: 82835 - RNA, 27 nt, Human
augagggaaaaaauaaaccccaguucu

SEQ ID NO: 82836 - RNA, 23 nt, Human
guuucuccagaagcuccagugau

SEQ ID NO: 82837 - RNA, 22 nt, Human
ccuggagggagguguagaaaga

SEQ ID NO: 82838 - RNA, 25 nt, Human
cucauggucagccaagcuuacccuu

SEQ ID NO: 82839 - RNA, 27 nt, Human
ugaaaccagauuucucacuugcucuuc

SEQ ID NO: 82840 - RNA, 20 nt, Human
ucuccaccuggacucaggcc

SEQ ID NO: 82841 - RNA, 21 nt, Human
guuuccagaguagaaaaagaa

SEQ ID NO: 82842 - RNA, 25 nt, Human
gcccaggcuggagugcaauggcaca

SEQ ID NO: 82843 - RNA, 25 nt, Human
acccaggcuggagugcaauggcacg

SEQ ID NO: 82844 - RNA, 23 nt, Human
cuggacccuccaguucugccaca

SEQ ID NO: 82845 - RNA, 20 nt, Human
ggcuucaccuguccuuuagg

SEQ ID NO: 82846 - RNA, 22 nt, Human
gucucccuuuguuccuuucugg

SEQ ID NO: 82847 - RNA, 21 nt, Human
guucuccuuuuaagggugggu

SEQ ID NO: 82848 - RNA, 25 nt, Human
ggccccggagaaacugagguauggc

SEQ ID NO: 82849 - RNA, 20 nt, Human
guacacacauacacagggug

SEQ ID NO: 82850 - RNA, 25 nt, Human
ccaggaugucugugaaauggacuuc

SEQ ID NO: 82851 - RNA, 25 nt, Human
gguuuacgugucucaaagcacacug

SEQ ID NO: 82852 - RNA, 24 nt, Human
uuuaaacauagcaaucaaggcuac

SEQ ID NO: 82853 - RNA, 24 nt, Human
cacuaggucucugggcccuugugc

SEQ ID NO: 82854 - RNA, 21 nt, Human
ccuccuucucacuugccaaag

SEQ ID NO: 82855 - RNA, 28 nt, Human
cuugugguggggggcacauagauucccc

SEQ ID NO: 82856 - RNA, 25 nt, Human
ugcagugaguuaugauggcacugcu

SEQ ID NO: 82857 - RNA, 21 nt, Human
gaaugaaccacugccccuuca

SEQ ID NO: 82858 - RNA, 21 nt, Human
guaaaaaacaaaaacaaagaa

SEQ ID NO: 82859 - RNA, 22 nt, Human
ggucaaggcaguagaacuccag

SEQ ID NO: 82860 - RNA, 21 nt, Human
accucuuuuagagaacaaaua

SEQ ID NO: 82861 - RNA, 25 nt, Human
cccuccaggccuugccuccugcggg

SEQ ID NO: 82862 - RNA, 25 nt, Human
cugcugcugcucauuccacacuguu

SEQ ID NO: 82863 - RNA, 27 nt, Human
ccccauguaacugagacacccugccug

SEQ ID NO: 82864 - RNA, 19 nt, Human
cccuccaggccucaguuuc

SEQ ID NO: 82865 - RNA, 20 nt, Human
aagacugccuggaaggggcc

SEQ ID NO: 82866 - RNA, 28 nt, Human
ccuggccuggcccugcccugaggaagga

SEQ ID NO: 82867 - RNA, 21 nt, Human
ggcuuugcccuggaauuugcc

SEQ ID NO: 82868 - RNA, 22 nt, Human
acucugcaaccuccacuuccca

SEQ ID NO: 82869 - RNA, 22 nt, Human
ggggaagcugggguuugcagug

SEQ ID NO: 82870 - RNA, 28 nt, Human
cauaauauucccagccuagaccaagcag

SEQ ID NO: 82871 - RNA, 23 nt, Human
cccaaguaggcaaggacugcacg

SEQ ID NO: 82872 - RNA, 23 nt, Human
ccacgaguucaaggcugcaguga

SEQ ID NO: 82873 - RNA, 26 nt, Human
ucuucagcauucccucccaucaugcc

SEQ ID NO: 82874 - RNA, 24 nt, Human
aaaagacaauuuuccuuggaacac

SEQ ID NO: 82875 - RNA, 23 nt, Human
caccuauaauucccagcacuuug

SEQ ID NO: 82876 - RNA, 17 nt, Human
gaaccugcaaggaaggg

SEQ ID NO: 82877 - RNA, 19 nt, Human
gggaaguugccucagugcu

SEQ ID NO: 82878 - RNA, 20 nt, Human
auguagaauaaaagcauuaa

SEQ ID NO: 82879 - RNA, 23 nt, Human
ccauccaggaaaacuugugcugg

SEQ ID NO: 82880 - RNA, 25 nt, Human
gggcccuacccagaggacagaaaga

SEQ ID NO: 82881 - RNA, 26 nt, Human
ccuuccccugcaccuggccugggcca

SEQ ID NO: 82882 - RNA, 26 nt, Human
gaccaaaacaaacaaacagaaaacag

SEQ ID NO: 82883 - RNA, 21 nt, Human
cuccucguagcugagccuucu

SEQ ID NO: 82884 - RNA, 24 nt, Human
auugcuuuucccuuccuggagucg

SEQ ID NO: 82885 - RNA, 22 nt, Human
ggcaggcauggcggauuccagc

SEQ ID NO: 82886 - RNA, 23 nt, Human
gcccaggccugggaugcagugau

SEQ ID NO: 82887 - RNA, 22 nt, Human
aaaccccaucucuaccaaaaau

SEQ ID NO: 82888 - RNA, 21 nt, Human
gcuaucuccuaacuuuggacc

SEQ ID NO: 82889 - RNA, 23 nt, Human
ucuuaaggagcuuccauuucucc

SEQ ID NO: 82890 - RNA, 21 nt, Human
cagaagccaacuucaugucug

SEQ ID NO: 82891 - RNA, 27 nt, Human
uugauggucccuauuccuccuucccuu

SEQ ID NO: 82892 - RNA, 19 nt, Human
cauucgaaaagcacuuuga

SEQ ID NO: 82893 - RNA, 27 nt, Human
gcugcuuguccugggccugccccugug

SEQ ID NO: 82894 - RNA, 18 nt, Human
ucacccaggcuggaguga

SEQ ID NO: 82895 - RNA, 21 nt, Human
acugccaccuccgccucucua

SEQ ID NO: 82896 - RNA, 27 nt, Human
ugucacccaggcuggagugccguggca

SEQ ID NO: 82897 - RNA, 21 nt, Human
cacagccgcuccgccucccgg

SEQ ID NO: 82898 - RNA, 23 nt, Human
guugcccagguugauauugaacu

SEQ ID NO: 82899 - RNA, 23 nt, Human
accuccacucugccauuccggcc

SEQ ID NO: 82900 - RNA, 21 nt, Human
cggucuugggucgccugcugc

SEQ ID NO: 82901 - RNA, 24 nt, Human
ggccgggagcugcucugugcuuuu

SEQ ID NO: 82902 - RNA, 23 nt, Human
cgcucuccgccgcgcucuaccuc

SEQ ID NO: 82903 - RNA, 20 nt, Human
aagacaccacugcccucccu

SEQ ID NO: 82904 - RNA, 15 nt, Human
cuucccuuucagcau

SEQ ID NO: 82905 - RNA, 28 nt, Human
ucuuugcugugggaccucagacaaaacc

SEQ ID NO: 82906 - RNA, 24 nt, Human
aggcuuuggaagagaaggugagga

SEQ ID NO: 82907 - RNA, 21 nt, Human
uucacucagcuggacugcauu

SEQ ID NO: 82908 - RNA, 24 nt, Human
aaugguacacaaugugauuuuaug

SEQ ID NO: 82909 - RNA, 22 nt, Human
agaccccuuccuuuccucugca

SEQ ID NO: 82910 - RNA, 20 nt, Human
uaggguauuugaccccgaua

SEQ ID NO: 82911 - RNA, 22 nt, Human
gauuacaggcgugagccaccau

SEQ ID NO: 82912 - RNA, 26 nt, Human
augcucagaugucagauccucuuguu

SEQ ID NO: 82913 - RNA, 20 nt, Human
acagagaucuuccacauccc

SEQ ID NO: 82914 - RNA, 23 nt, Human
agaaacaguggcuuauuucuuca

SEQ ID NO: 82915 - RNA, 21 nt, Human
auucaaaaccagccuggccaa

SEQ ID NO: 82916 - RNA, 22 nt, Human
auucauauuuuuguggguaaaa

SEQ ID NO: 82917 - RNA, 22 nt, Human
guuuuauuggaacauagccaca

SEQ ID NO: 82918 - RNA, 30 nt, Human
auguaauauuccaggaugcugcugcagguc

SEQ ID NO: 82919 - RNA, 27 nt, Human
uguggguggaguggggacaagcggugg

SEQ ID NO: 82920 - RNA, 27 nt, Human
auagcuguuggaguaaaguugcagugg

SEQ ID NO: 82921 - RNA, 23 nt, Human
ccucauucuuaacuguguggcca

SEQ ID NO: 82922 - RNA, 27 nt, Human
guuaccauuacaaaugggauauaagag

SEQ ID NO: 82923 - RNA, 26 nt, Human
ucuucauuccucuuaggagagugcca

SEQ ID NO: 82924 - RNA, 24 nt, Human
cuccaagguuucacggcuuccuca

SEQ ID NO: 82925 - RNA, 22 nt, Human
caugaggucaggaguucgaggc

SEQ ID NO: 82926 - RNA, 22 nt, Human
ccagcacugcgagcuucugccu

SEQ ID NO: 82927 - RNA, 22 nt, Human
ucuaccuuccugucccugaggu

SEQ ID NO: 82928 - RNA, 23 nt, Human
uugaggauugcauucuauuuucu

SEQ ID NO: 82929 - RNA, 23 nt, Human
ugucaccaaggcuuagugcagug

SEQ ID NO: 82930 - RNA, 23 nt, Human
augacuccagcagcaccagcugc

SEQ ID NO: 82931 - RNA, 29 nt, Human
ccacggccuuugaccaucuguauugaagc

SEQ ID NO: 82932 - RNA, 26 nt, Human
gcggccccgagaguccggggagggag

SEQ ID NO: 82933 - RNA, 26 nt, Human
ggguuucuuuagugucuuaaaagcgu

SEQ ID NO: 82934 - RNA, 21 nt, Human
gggacugaagcguugugugca

SEQ ID NO: 82935 - RNA, 15 nt, Human
acaugacacucugaa

SEQ ID NO: 82936 - RNA, 21 nt, Human
ggacaagaucgacgugaucaa

SEQ ID NO: 82937 - RNA, 22 nt, Human
cuuaaauauauccccuuccuca

SEQ ID NO: 82938 - RNA, 19 nt, Human
ggccaucucagucucucca

SEQ ID NO: 82939 - RNA, 18 nt, Human
cugagucucauuccucug

SEQ ID NO: 82940 - RNA, 29 nt, Human
cugcugagacuccuccugcaguuccucaa

SEQ ID NO: 82941 - RNA, 26 nt, Human
cuuccuuccuguuaaaccccuguuaa

SEQ ID NO: 82942 - RNA, 19 nt, Human
cuccuccccuccuucgcuc

SEQ ID NO: 82943 - RNA, 20 nt, Human
ggccagagcucuaccucuuu

SEQ ID NO: 82944 - RNA, 21 nt, Human
aaccaaaaucauaggcuuuuu

SEQ ID NO: 82945 - RNA, 25 nt, Human
gggaggaaagggggugcuggaagau

SEQ ID NO: 82946 - RNA, 25 nt, Human
auacauacucaaauauaggcugucu

SEQ ID NO: 82947 - RNA, 22 nt, Human
cucuucccuaaugccaccucag

SEQ ID NO: 82948 - RNA, 26 nt, Human
cuuccugccagcacgugccugaaggu

SEQ ID NO: 82949 - RNA, 21 nt, Human
aauagaagaugaaucauugau

SEQ ID NO: 82950 - RNA, 23 nt, Human
gguuccuugccuccuucuggugc

SEQ ID NO: 82951 - RNA, 20 nt, Human
auuguaaaauacagaacaga

SEQ ID NO: 82952 - RNA, 27 nt, Human
gucucgaacuccuggacucaagcaauc

SEQ ID NO: 82953 - RNA, 28 nt, Human
gaguuucccagagagacauagcuggaaa

SEQ ID NO: 82954 - RNA, 25 nt, Human
gcuccauuggauccauggaugagga

SEQ ID NO: 82955 - RNA, 22 nt, Human
uacaggcuggcgcagaacgaac

SEQ ID NO: 82956 - RNA, 25 nt, Human
cacagcaacuuccuguagugagcac

SEQ ID NO: 82957 - RNA, 20 nt, Human
gucugugucaguauuaccac

SEQ ID NO: 82958 - RNA, 20 nt, Human
ucucccacccccugccccag

SEQ ID NO: 82959 - RNA, 20 nt, Human
accuuguuuagucacauuaa

SEQ ID NO: 82960 - RNA, 22 nt, Human
gaaacucccacaagcucugccu

SEQ ID NO: 82961 - RNA, 22 nt, Human
ccagaguagcugggacuacagg

SEQ ID NO: 82962 - RNA, 23 nt, Human
ggugggagagacacucccaggga

SEQ ID NO: 82963 - RNA, 27 nt, Human
cauugcacuccauccugagccacaaga

SEQ ID NO: 82964 - RNA, 21 nt, Human
agcagaagcacauuuucagac

SEQ ID NO: 82965 - RNA, 18 nt, Human
ggagagggaggccgcgga

SEQ ID NO: 82966 - RNA, 27 nt, Human
ccugagcaacagagcaaaaccccgucu

SEQ ID NO: 82967 - RNA, 27 nt, Human
ccaggaggccgggcucucaguuugggg

SEQ ID NO: 82968 - RNA, 21 nt, Human
uucauuguagaaaauguaaua

SEQ ID NO: 82969 - RNA, 20 nt, Human
ucucaugaaaguaaaaagaa

SEQ ID NO: 82970 - RNA, 27 nt, Human
aggccuccagcuucaggcaggccaagg

SEQ ID NO: 82971 - RNA, 22 nt, Human
gaacaagugccuccuggacugu

SEQ ID NO: 82972 - RNA, 22 nt, Human
cuccccaucuucucucugccca

SEQ ID NO: 82973 - RNA, 20 nt, Human
uuugcccuugauugagaacc

SEQ ID NO: 82974 - RNA, 27 nt, Human
gaggaagaggaaggcagcccuggagug

SEQ ID NO: 82975 - RNA, 26 nt, Human
ugguuggcgucgccuugaaaucccag

SEQ ID NO: 82976 - RNA, 27 nt, Human
caaccaaaggagaaaugagcaauccgc

SEQ ID NO: 82977 - RNA, 28 nt, Human
ggguccugcagaaccugaggccagcucu

SEQ ID NO: 82978 - RNA, 17 nt, Human
caacagcagaguuguua

SEQ ID NO: 82979 - RNA, 23 nt, Human
acugaguuuauacucaccuuuua

SEQ ID NO: 82980 - RNA, 19 nt, Human
cuucccaggaguggaggag

SEQ ID NO: 82981 - RNA, 23 nt, Human
caggugagcaaaaagaaagugga

SEQ ID NO: 82982 - RNA, 25 nt, Human
gggagccugaggcaugagaaucacu

SEQ ID NO: 82983 - RNA, 21 nt, Human
cugcucccuggugccccacuc

SEQ ID NO: 82984 - RNA, 22 nt, Human
acagauagaguguggcuucauu

SEQ ID NO: 82985 - RNA, 25 nt, Human
auugagcaggaaguaaaaacaaaug

SEQ ID NO: 82986 - RNA, 24 nt, Human
agguacaaugccugccaucauggg

SEQ ID NO: 82987 - RNA, 18 nt, Human
uuuccacccucaccugcc

SEQ ID NO: 82988 - RNA, 27 nt, Human
agaagccaacaaaacaguuuguugcca

SEQ ID NO: 82989 - RNA, 27 nt, Human
uaacugcaagggcucugcugacaucuu

SEQ ID NO: 82990 - RNA, 26 nt, Human
caggaagcaagcggagguugcaguga

SEQ ID NO: 82991 - RNA, 24 nt, Human
acucugugccuuucuacaacugau

SEQ ID NO: 82992 - RNA, 21 nt, Human
agcccgggaagcaggaagccc

SEQ ID NO: 82993 - RNA, 20 nt, Human
acuugcuucuaaaugcccag

SEQ ID NO: 82994 - RNA, 22 nt, Human
gacuccggcucuacaaaaaaga

SEQ ID NO: 82995 - RNA, 27 nt, Human
gugacccaggguggggacaggggcugg

SEQ ID NO: 82996 - RNA, 25 nt, Human
gacuauggauugggccucugccucu

SEQ ID NO: 82997 - RNA, 22 nt, Human
cugccuuccuguccucuggaga

SEQ ID NO: 82998 - RNA, 20 nt, Human
cucacagccucuugcugcua

SEQ ID NO: 82999 - RNA, 21 nt, Human
gggacuagaaggaaaauaaau

SEQ ID NO: 83000 - RNA, 20 nt, Human
agcaggagguuuucaaccua

SEQ ID NO: 83001 - RNA, 25 nt, Human
cuuuuccacggacaguguuguguuu

SEQ ID NO: 83002 - RNA, 27 nt, Human
gcaaucagaguguacaaauugucguuu

SEQ ID NO: 83003 - RNA, 21 nt, Human
aaugugauucuucuaaagcaa

SEQ ID NO: 83004 - RNA, 23 nt, Human
cccugcacucucaacaugaguag

SEQ ID NO: 83005 - RNA, 22 nt, Human
uguuaugauuuguaacauucac

SEQ ID NO: 83006 - RNA, 23 nt, Human
uuuuucauagugaaauuguguuu

SEQ ID NO: 83007 - RNA, 22 nt, Human
cuaccaugccucuccaacaucu

SEQ ID NO: 83008 - RNA, 28 nt, Human
gguugcuacuuaccuagcacauuguaau

SEQ ID NO: 83009 - RNA, 22 nt, Human
aucgaauguugagagaagcagu

SEQ ID NO: 83010 - RNA, 25 nt, Human
gcaggcacugaagcugcggcccuga

SEQ ID NO: 83011 - RNA, 27 nt, Human
ccugagcggggucucucagacugacgu

SEQ ID NO: 83012 - RNA, 23 nt, Human
ggccuuuauuuuuccucauuucu

SEQ ID NO: 83013 - RNA, 21 nt, Human
caaggaaggggaggaugggga

SEQ ID NO: 83014 - RNA, 19 nt, Human
uacaguaucuguuaccuca

SEQ ID NO: 83015 - RNA, 27 nt, Human
agcuggguuaggaaaaccauggguaag

SEQ ID NO: 83016 - RNA, 24 nt, Human
acagcugcagcugccuugccuugc

SEQ ID NO: 83017 - RNA, 19 nt, Human
cugcucugcucccugccgg

SEQ ID NO: 83018 - RNA, 19 nt, Human
uagcauaguaacuccuuuc

SEQ ID NO: 83019 - RNA, 22 nt, Human
uccuuucucucuccccggacag

SEQ ID NO: 83020 - RNA, 26 nt, Human
cuguucuguucuguuccuuguguaac

SEQ ID NO: 83021 - RNA, 26 nt, Human
cugcugucucccucucugaccuaugc

SEQ ID NO: 83022 - RNA, 24 nt, Human
gggcucucuuccacccgcucugcg

SEQ ID NO: 83023 - RNA, 21 nt, Human
acagcugagcacauucuggcu

SEQ ID NO: 83024 - RNA, 21 nt, Human
cagcgaugggucuccaggcaa

SEQ ID NO: 83025 - RNA, 19 nt, Human
guuguucuucaagcaaguu

SEQ ID NO: 83026 - RNA, 22 nt, Human
ugucucagccgagcccagggga

SEQ ID NO: 83027 - RNA, 25 nt, Human
uguuugcuguaugggcucggguggg

SEQ ID NO: 83028 - RNA, 19 nt, Human
cuucccuucuccccagcca

SEQ ID NO: 83029 - RNA, 20 nt, Human
caggagcccagagggccaag

SEQ ID NO: 83030 - RNA, 27 nt, Human
augaucuguccacagugcccauuguca

SEQ ID NO: 83031 - RNA, 21 nt, Human
gcaaggagggagggaucuugg

SEQ ID NO: 83032 - RNA, 27 nt, Human
gggagagagaaggagcaggcacgcugg

SEQ ID NO: 83033 - RNA, 16 nt, Human
gggaaauuuucuuuca

SEQ ID NO: 83034 - RNA, 21 nt, Human
aagaacuuuguaaauaaauac

SEQ ID NO: 83035 - RNA, 23 nt, Human
ggcgcugcacuuuaaauccagua

SEQ ID NO: 83036 - RNA, 23 nt, Human
ccuggccuggucugugccugccc

SEQ ID NO: 83037 - RNA, 25 nt, Human
agcuggcuaggaccccucugccuuc

SEQ ID NO: 83038 - RNA, 26 nt, Human
ugcuacuuaaaaauauuaaaauagag

SEQ ID NO: 83039 - RNA, 26 nt, Human
acacacacgccagcuccucucugaag

SEQ ID NO: 83040 - RNA, 21 nt, Human
cgcgguggcucccaagccaca

SEQ ID NO: 83041 - RNA, 21 nt, Human
agcagcaaugccagggcacag

SEQ ID NO: 83042 - RNA, 20 nt, Human
gaaaagaaagcgcaaaagaa

SEQ ID NO: 83043 - RNA, 21 nt, Human
ucagagggcagcaggagcagc

SEQ ID NO: 83044 - RNA, 25 nt, Human
cuguccuguggagcaggcagugauu

SEQ ID NO: 83045 - RNA, 27 nt, Human
cacuccacuccaggcugccggcaccug

SEQ ID NO: 83046 - RNA, 24 nt, Human
ggaaagggagcaagaguuguccag

SEQ ID NO: 83047 - RNA, 24 nt, Human
ggaaaagaagaaacuuugccucaa

SEQ ID NO: 83048 - RNA, 22 nt, Human
agagagugaugcuaacacucca

SEQ ID NO: 83049 - RNA, 17 nt, Human
cguggaggcugggcagg

SEQ ID NO: 83050 - RNA, 25 nt, Human
uuugguaccugcucuccccuggacu

SEQ ID NO: 83051 - RNA, 26 nt, Human
gcugcuggguucauucauucauucca

SEQ ID NO: 83052 - RNA, 21 nt, Human
aaaaggagagaagaaagugua

SEQ ID NO: 83053 - RNA, 29 nt, Human
ccaugaauucuucuuuucucagcacgugu

SEQ ID NO: 83054 - RNA, 22 nt, Human
ccugccuggcacugcucaccgc

SEQ ID NO: 83055 - RNA, 21 nt, Human
uugucuuuguggcaugcagcu

SEQ ID NO: 83056 - RNA, 26 nt, Human
cacaugcuggccuagcggccuggccc

SEQ ID NO: 83057 - RNA, 25 nt, Human
gcuauccauuuguucuuacucucua

SEQ ID NO: 83058 - RNA, 22 nt, Human
gggaggugguguguucacguga

SEQ ID NO: 83059 - RNA, 18 nt, Human
ccucuggcgcccugcugc

SEQ ID NO: 83060 - RNA, 24 nt, Human
cuuuccauguguaugugugugucu

SEQ ID NO: 83061 - RNA, 23 nt, Human
gaaggauggacuccagagcccag

SEQ ID NO: 83062 - RNA, 22 nt, Human
agagaguuaagugaaugucuaa

SEQ ID NO: 83063 - RNA, 25 nt, Human
gggugcuggaguuggaggaggcugu

SEQ ID NO: 83064 - RNA, 25 nt, Human
gccuccugggggauacgguggagaa

SEQ ID NO: 83065 - RNA, 32 nt, Human
gcagcuguguuuuggaaagugauuaagcaaua

SEQ ID NO: 83066 - RNA, 27 nt, Human
gccuuucuacccaggcccccugcccug

SEQ ID NO: 83067 - RNA, 14 nt, Human
gaacauccuacucu

SEQ ID NO: 83068 - RNA, 22 nt, Human
cuuucaucagauccugccuccu

SEQ ID NO: 83069 - RNA, 23 nt, Human
ccugggacagugggcucugcaug

SEQ ID NO: 83070 - RNA, 20 nt, Human
ccagugcuggcugcagguau

SEQ ID NO: 83071 - RNA, 19 nt, Human
auucuggugcucaggcugg

SEQ ID NO: 83072 - RNA, 24 nt, Human
gccuuuucuccccguuaaagggca

SEQ ID NO: 83073 - RNA, 20 nt, Human
cuuccuuggggauguucaug

SEQ ID NO: 83074 - RNA, 20 nt, Human
accuggucaacuuagcuuuu

SEQ ID NO: 83075 - RNA, 21 nt, Human
caggaagcugggaaagacuga

SEQ ID NO: 83076 - RNA, 22 nt, Human
gagcccagggaggccgaagcua

SEQ ID NO: 83077 - RNA, 27 nt, Human
augugggaaggauuuauuuacagugug

SEQ ID NO: 83078 - RNA, 18 nt, Human
ugcgaugcugucuggacu

SEQ ID NO: 83079 - RNA, 22 nt, Human
gucugggcaggggcagggcaag

SEQ ID NO: 83080 - RNA, 24 nt, Human
ucugccuggccacaucgauguugu

SEQ ID NO: 83081 - RNA, 28 nt, Human
gcugggaucagccaugcccagaggucug

SEQ ID NO: 83082 - RNA, 21 nt, Human
aguugaaugucagacucucau

SEQ ID NO: 83083 - RNA, 22 nt, Human
agcuuuucuucuacuagucuga

SEQ ID NO: 83084 - RNA, 20 nt, Human
augucugggagcccuuccuu

SEQ ID NO: 83085 - RNA, 24 nt, Human
uauacucucagauauggccucuua

SEQ ID NO: 83086 - RNA, 26 nt, Human
agcuagcaaucuaugcaaacaccuuu

SEQ ID NO: 83087 - RNA, 23 nt, Human
gcaucaccuuugaaaauauuuca

SEQ ID NO: 83088 - RNA, 23 nt, Human
gcccugcccacaccuccuggggc

SEQ ID NO: 83089 - RNA, 25 nt, Human
gcccaggcugcugggcuguagccaa

SEQ ID NO: 83090 - RNA, 19 nt, Human
uccuagagggagauuguua

SEQ ID NO: 83091 - RNA, 15 nt, Human
agcuagaguguaugu

SEQ ID NO: 83092 - RNA, 26 nt, Human
ggguuucuuuaaucuauucagcuaga

SEQ ID NO: 83093 - RNA, 19 nt, Human
gaggaagaggaggcugguu

SEQ ID NO: 83094 - RNA, 23 nt, Human
aaccgagguguugccagugcuaa

SEQ ID NO: 83095 - RNA, 20 nt, Human
gcuuuuuagcuuacauaacu

SEQ ID NO: 83096 - RNA, 24 nt, Human
gcccagucgcugcaaccauccagc

SEQ ID NO: 83097 - RNA, 19 nt, Human
uacaagaucaauauacaaa

SEQ ID NO: 83098 - RNA, 25 nt, Human
ggccuccucgggagggagcgccucc

SEQ ID NO: 83099 - RNA, 21 nt, Human
accaaaaauuuagaugccuua

SEQ ID NO: 83100 - RNA, 21 nt, Human
aucucugcuuuauuucuuguc

SEQ ID NO: 83101 - RNA, 23 nt, Human
acuauuuuaacacuuuuaaucug

SEQ ID NO: 83102 - RNA, 27 nt, Human
gggcgggcugacucccugcuuccucca

SEQ ID NO: 83103 - RNA, 22 nt, Human
cuuauuuucuuuuguuuaugau

SEQ ID NO: 83104 - RNA, 21 nt, Human
acuguaaagagaccuaccuca

SEQ ID NO: 83105 - RNA, 22 nt, Human
guccauguggcucuaucuuuua

SEQ ID NO: 83106 - RNA, 22 nt, Human
uucuccucucugagccuuuguc

SEQ ID NO: 83107 - RNA, 31 nt, Human
cggagaguuuccuauguuucacugugcaaau

SEQ ID NO: 83108 - RNA, 20 nt, Human
ucggacugggagcgagcgcg

SEQ ID NO: 83109 - RNA, 20 nt, Human
uguuaguuuguuaaaccaga

SEQ ID NO: 83110 - RNA, 20 nt, Human
cuccuggccuccugcuucuu

SEQ ID NO: 83111 - RNA, 23 nt, Human
ggauagaaggggggcuauuuuaa

SEQ ID NO: 83112 - RNA, 21 nt, Human
cauccugaccugcggguccuc

SEQ ID NO: 83113 - RNA, 27 nt, Human
cccuccugcuacucuguuccuucacau

SEQ ID NO: 83114 - RNA, 22 nt, Human
uuaugauugucccucugggcca

SEQ ID NO: 83115 - RNA, 23 nt, Human
ccgcuggcaggagcgcuugggga

SEQ ID NO: 83116 - RNA, 26 nt, Human
uggauggggaacugcaagcagccucu

SEQ ID NO: 83117 - RNA, 20 nt, Human
caucacggauggugcauggg

SEQ ID NO: 83118 - RNA, 24 nt, Human
gucccgggcuggcgggagugcagu

SEQ ID NO: 83119 - RNA, 27 nt, Human
cucucucuauggaaauaaaaaggaaaa

SEQ ID NO: 83120 - RNA, 28 nt, Human
gggugaaagacgaguaaggggcaaauca

SEQ ID NO: 83121 - RNA, 27 nt, Human
uugguaaaauagauuguuuuucaugga

SEQ ID NO: 83122 - RNA, 24 nt, Human
caggaauaauaaaggcaucacuga

SEQ ID NO: 83123 - RNA, 25 nt, Human
ugaccucauccaaggccaugauguc

SEQ ID NO: 83124 - RNA, 22 nt, Human
cucuccucacacauuguguggu

SEQ ID NO: 83125 - RNA, 27 nt, Human
ccaagaaaagaggccaaagcaagagca

SEQ ID NO: 83126 - RNA, 25 nt, Human
gccuuccucccccuauuccaccccc

SEQ ID NO: 83127 - RNA, 21 nt, Human
cugccaccauggugucuugcc

SEQ ID NO: 83128 - RNA, 19 nt, Human
caaaggaaauacauuugua

SEQ ID NO: 83129 - RNA, 20 nt, Human
uucugucggguuacugaccu

SEQ ID NO: 83130 - RNA, 20 nt, Human
acagaaagagcaaggcuguu

SEQ ID NO: 83131 - RNA, 21 nt, Human
cagggagggucagagggaggc

SEQ ID NO: 83132 - RNA, 19 nt, Human
gcuggagagaaacucuuga

SEQ ID NO: 83133 - RNA, 25 nt, Human
uuuucaaggagaggcuucuugcuga

SEQ ID NO: 83134 - RNA, 23 nt, Human
accagucagcacagcaugccugg

SEQ ID NO: 83135 - RNA, 24 nt, Human
uccugcacuucuacaguuuagaaa

SEQ ID NO: 83136 - RNA, 27 nt, Human
ugcagcuccuggaaggugucauuugac

SEQ ID NO: 83137 - RNA, 22 nt, Human
gaagcugcugggcucaagcaau

SEQ ID NO: 83138 - RNA, 22 nt, Human
uggaagggaaguucaggcucug

SEQ ID NO: 83139 - RNA, 24 nt, Human
aaggaagacucauuaccuucccuc

SEQ ID NO: 83140 - RNA, 20 nt, Human
acugcacuuuggagaggcaa

SEQ ID NO: 83141 - RNA, 20 nt, Human
gacuccgucucuacagaagg

SEQ ID NO: 83142 - RNA, 20 nt, Human
gaccauauuuauuuacuucu

SEQ ID NO: 83143 - RNA, 15 nt, Human
uggcuguacugcuau

SEQ ID NO: 83144 - RNA, 27 nt, Human
ucugggagccugugccccuggguccuc

SEQ ID NO: 83145 - RNA, 26 nt, Human
aacagcuucagagauacugcuucuca

SEQ ID NO: 83146 - RNA, 26 nt, Human
cacuaugcaaccuaagccaugguccc

SEQ ID NO: 83147 - RNA, 21 nt, Human
cgccccggaagcccucgccga

SEQ ID NO: 83148 - RNA, 27 nt, Human
ggcaucguugucugcuaaauuacuuga

SEQ ID NO: 83149 - RNA, 20 nt, Human
ucuaauugaagaagauuaaa

SEQ ID NO: 83150 - RNA, 23 nt, Human
ugaaauuuaggacaguugcaaac

SEQ ID NO: 83151 - RNA, 21 nt, Human
guucucuagcccuuggcucug

SEQ ID NO: 83152 - RNA, 26 nt, Human
gcuaucuuaagaaucauuaaauacac

SEQ ID NO: 83153 - RNA, 23 nt, Human
gcccagcuggcuggaguccaggc

SEQ ID NO: 83154 - RNA, 22 nt, Human
gcggacgucuguaaucucagag

SEQ ID NO: 83155 - RNA, 22 nt, Human
uccuccauuccucugcacuugc

SEQ ID NO: 83156 - RNA, 19 nt, Human
uugcagaggacaaggcugg

SEQ ID NO: 83157 - RNA, 21 nt, Human
uguuagccaggcuggucucaa

SEQ ID NO: 83158 - RNA, 21 nt, Human
ugaacaucugggcugccuugu

SEQ ID NO: 83159 - RNA, 23 nt, Human
agcuuuucuagagcagcugugcg

SEQ ID NO: 83160 - RNA, 23 nt, Human
acagucuggaaagugaugucaga

SEQ ID NO: 83161 - RNA, 27 nt, Human
ggagcccuuacccucccaccacucccc

SEQ ID NO: 83162 - RNA, 21 nt, Human
cuggucucuucaccacuguag

SEQ ID NO: 83163 - RNA, 21 nt, Human
augccagaaugagcuggaaua

SEQ ID NO: 83164 - RNA, 19 nt, Human
cuucugcuuucaucccaug

SEQ ID NO: 83165 - RNA, 22 nt, Human
cacgagggagagcuggaggggc

SEQ ID NO: 83166 - RNA, 23 nt, Human
cuugcagcccugcaccugccugc

SEQ ID NO: 83167 - RNA, 22 nt, Human
aguugucagaaauaacuggaag

SEQ ID NO: 83168 - RNA, 23 nt, Human
agagaaacugcaaacguggagaa

SEQ ID NO: 83169 - RNA, 23 nt, Human
ugucccucuccauguccaggaaa

SEQ ID NO: 83170 - RNA, 22 nt, Human
uugcaaccucucuuccucuggg

SEQ ID NO: 83171 - RNA, 29 nt, Human
ugcaguauguugccaagagcccgucugcu

SEQ ID NO: 83172 - RNA, 20 nt, Human
acucacugcaaucuccaccu

SEQ ID NO: 83173 - RNA, 23 nt, Human
uugguguuuugcacuucuguaaa

SEQ ID NO: 83174 - RNA, 20 nt, Human
guuuuuuguuaauuuuuugu

SEQ ID NO: 83175 - RNA, 26 nt, Human
cccggcacuccagccuggcgacaaga

SEQ ID NO: 83176 - RNA, 19 nt, Human
auccuuucuucucaguccc

SEQ ID NO: 83177 - RNA, 21 nt, Human
caggaugaagggaugcaguga

SEQ ID NO: 83178 - RNA, 21 nt, Human
gcaggggagaaagacagcaga

SEQ ID NO: 83179 - RNA, 21 nt, Human
gcuguucucaggaucacuggg

SEQ ID NO: 83180 - RNA, 31 nt, Human
cguggagaaaguagcagaugggcagauuuuc

SEQ ID NO: 83181 - RNA, 22 nt, Human
gcgugagucaccgugcccagcc

SEQ ID NO: 83182 - RNA, 22 nt, Human
cuaggagguggcgguugcugug

SEQ ID NO: 83183 - RNA, 21 nt, Human
ccucuuagaagaaaagccuga

SEQ ID NO: 83184 - RNA, 19 nt, Human
uuugcuuuuucccugccug

SEQ ID NO: 83185 - RNA, 24 nt, Human
gagugucucaguucugcuuuuggc

SEQ ID NO: 83186 - RNA, 21 nt, Human
acugcugacucuuugaaaauc

SEQ ID NO: 83187 - RNA, 26 nt, Human
agucucucuuccuccucagcgaacca

SEQ ID NO: 83188 - RNA, 21 nt, Human
gugccuggcacagccgcgggc

SEQ ID NO: 83189 - RNA, 22 nt, Human
ugcaucaguguggacuccuaga

SEQ ID NO: 83190 - RNA, 22 nt, Human
cugcaaccucugacucccuggu

SEQ ID NO: 83191 - RNA, 19 nt, Human
gcacagccccuagggcucu

SEQ ID NO: 83192 - RNA, 22 nt, Human
uccucuccuccuucccaaguca

SEQ ID NO: 83193 - RNA, 21 nt, Human
uggcgugagagggacggcuca

SEQ ID NO: 83194 - RNA, 26 nt, Human
agcaggcugccaccccuucuaccuca

SEQ ID NO: 83195 - RNA, 23 nt, Human
uggcuagaguugcaacuacagcu

SEQ ID NO: 83196 - RNA, 21 nt, Human
agcuaaauuaaagggacucca

SEQ ID NO: 83197 - RNA, 20 nt, Human
uuaaaaaagacccuuaaaaa

SEQ ID NO: 83198 - RNA, 25 nt, Human
cuguauccaauacuuuguugugucu

SEQ ID NO: 83199 - RNA, 21 nt, Human
ucuuccuugccgccucaccgc

SEQ ID NO: 83200 - RNA, 27 nt, Human
ugccagacuucagacugagaagucaga

SEQ ID NO: 83201 - RNA, 31 nt, Human
cuccguccuucauuucugucauucaagcuca

SEQ ID NO: 83202 - RNA, 21 nt, Human
uccuccaugcccucaggcagc

SEQ ID NO: 83203 - RNA, 22 nt, Human
gggguggacucagauggguggg

SEQ ID NO: 83204 - RNA, 23 nt, Human
aguaauagauaugugauuuuaca

SEQ ID NO: 83205 - RNA, 24 nt, Human
ggaaagggaaggaggaggucccga

SEQ ID NO: 83206 - RNA, 22 nt, Human
cccugcuccucuucuccccacc

SEQ ID NO: 83207 - RNA, 23 nt, Human
uaaagugucaccccucacuguga

SEQ ID NO: 83208 - RNA, 22 nt, Human
ucacugcaaccucugccuaccg

SEQ ID NO: 83209 - RNA, 19 nt, Human
acaggauuuacaagcagga

SEQ ID NO: 83210 - RNA, 21 nt, Human
gcauuuauauuccacuuggga

SEQ ID NO: 83211 - RNA, 21 nt, Human
agaggcagagguugcagugag

SEQ ID NO: 83212 - RNA, 21 nt, Human
ggaggcagagguugcaaugag

SEQ ID NO: 83213 - RNA, 19 nt, Human
ccucugagcuccugggggu

SEQ ID NO: 83214 - RNA, 26 nt, Human
cugggccaacagacccacacacuuag

SEQ ID NO: 83215 - RNA, 23 nt, Human
ccaguucaucaucaucucuuuua

SEQ ID NO: 83216 - RNA, 21 nt, Human
cagcucagcucccugccuugu

SEQ ID NO: 83217 - RNA, 22 nt, Human
gcggauggaucaccugagguca

SEQ ID NO: 83218 - RNA, 23 nt, Human
gucacacaccccuucccucauca

SEQ ID NO: 83219 - RNA, 24 nt, Human
ggcugcaggcacuggcagugggaa

SEQ ID NO: 83220 - RNA, 22 nt, Human
uguucaaaauaguuugcacuuu

SEQ ID NO: 83221 - RNA, 26 nt, Human
uucuaguaucacauagaagcuguccu

SEQ ID NO: 83222 - RNA, 23 nt, Human
gagauggagacaugagacucagu

SEQ ID NO: 83223 - RNA, 22 nt, Human
ugcgcagccuuacccaguccua

SEQ ID NO: 83224 - RNA, 20 nt, Human
aaucaucugcugcugugguu

SEQ ID NO: 83225 - RNA, 25 nt, Human
gccugucuuccaccccuccugaccc

SEQ ID NO: 83226 - RNA, 21 nt, Human
aagaacaaacaaaauacauuu

SEQ ID NO: 83227 - RNA, 27 nt, Human
gagagcuaguacuucauuuucacugga

SEQ ID NO: 83228 - RNA, 19 nt, Human
ccccaacaacgcgcccucu

SEQ ID NO: 83229 - RNA, 23 nt, Human
acuaugccugacuaauuuuguag

SEQ ID NO: 83230 - RNA, 26 nt, Human
cagcugccugauuagaugacucucag

SEQ ID NO: 83231 - RNA, 26 nt, Human
cucaugaaagaacaaaagaaaugaag

SEQ ID NO: 83232 - RNA, 22 nt, Human
ucucuguuuugaaaaagcagag

SEQ ID NO: 83233 - RNA, 18 nt, Human
aacugauuuuaaaugcaa

SEQ ID NO: 83234 - RNA, 20 nt, Human
gaccaccugcccaaccugcu

SEQ ID NO: 83235 - RNA, 26 nt, Human
auccggacccucuccccaucccagcc

SEQ ID NO: 83236 - RNA, 20 nt, Human
uucucagauuccaaggacug

SEQ ID NO: 83237 - RNA, 22 nt, Human
aacugcacuccagccugggcaa

SEQ ID NO: 83238 - RNA, 23 nt, Human
uaucgcccaggcuggagugcagu

SEQ ID NO: 83239 - RNA, 21 nt, Human
acaccugccauggacacuuca

SEQ ID NO: 83240 - RNA, 23 nt, Human
gccagggcaggagaggugugaaa

SEQ ID NO: 83241 - RNA, 24 nt, Human
ccucuugccacccucagugccaca

SEQ ID NO: 83242 - RNA, 20 nt, Human
cuugcauuuauuauucucaa

SEQ ID NO: 83243 - RNA, 24 nt, Human
ugucuccuaagcuggagugcagug

SEQ ID NO: 83244 - RNA, 25 nt, Human
cuucauuccuugcugcucacauucu

SEQ ID NO: 83245 - RNA, 21 nt, Human
cacacagugaaguguuccagu

SEQ ID NO: 83246 - RNA, 21 nt, Human
caccaacauggagcucucgca

SEQ ID NO: 83247 - RNA, 21 nt, Human
cagcugggggaaaggcaguuc

SEQ ID NO: 83248 - RNA, 22 nt, Human
gugugagccaccacgaucagcc

SEQ ID NO: 83249 - RNA, 23 nt, Human
uccuacucccugucuuucuggca

SEQ ID NO: 83250 - RNA, 22 nt, Human
gcaaaacuuuuaaauauuugaa

SEQ ID NO: 83251 - RNA, 21 nt, Human
cauuguuuuugguuguucuuu

SEQ ID NO: 83252 - RNA, 26 nt, Human
aagagggagcagcuagggcgcggguc

SEQ ID NO: 83253 - RNA, 25 nt, Human
guuuaucagacaauugaauguagua

SEQ ID NO: 83254 - RNA, 20 nt, Human
cacagauugaggagacacug

SEQ ID NO: 83255 - RNA, 20 nt, Human
uggagccucugggcggccuu

SEQ ID NO: 83256 - RNA, 26 nt, Human
gauggccauggcagucaguggcagca

SEQ ID NO: 83257 - RNA, 22 nt, Human
ugcagugaaccaagaucgggcc

SEQ ID NO: 83258 - RNA, 24 nt, Human
ggcaucucucagcgccuccagcag

SEQ ID NO: 83259 - RNA, 21 nt, Human
ucgguuaacuccgcugcagcc

SEQ ID NO: 83260 - RNA, 22 nt, Human
cccaggugcugcccacuccuga

SEQ ID NO: 83261 - RNA, 21 nt, Human
gcucacugcagccuugaccuc

SEQ ID NO: 83262 - RNA, 21 nt, Human
aggcugcugccuccugcucug

SEQ ID NO: 83263 - RNA, 21 nt, Human
aaccauccaguuauucuugaa

SEQ ID NO: 83264 - RNA, 20 nt, Human
ggugcuuaaggaaacuuacu

SEQ ID NO: 83265 - RNA, 20 nt, Human
agaccaugggcuguagggga

SEQ ID NO: 83266 - RNA, 19 nt, Human
cagccuauuugcuuaguga

SEQ ID NO: 83267 - RNA, 22 nt, Human
gcucacugcagccuccgcuucc

SEQ ID NO: 83268 - RNA, 20 nt, Human
gcugucccugagccucuagu

SEQ ID NO: 83269 - RNA, 22 nt, Human
uucuggucagaaaccuguccac

SEQ ID NO: 83270 - RNA, 26 nt, Human
ccgccuaccaggcccucuggcauuug

SEQ ID NO: 83271 - RNA, 21 nt, Human
cccauccugauacauccugaa

SEQ ID NO: 83272 - RNA, 20 nt, Human
ccuuaaaacuguucccagug

SEQ ID NO: 83273 - RNA, 21 nt, Human
gaacuauuuuacauuuuaugg

SEQ ID NO: 83274 - RNA, 27 nt, Human
ucccacuccuaaucaagagucucucca

SEQ ID NO: 83275 - RNA, 21 nt, Human
cccaccccagcagugcucucu

SEQ ID NO: 83276 - RNA, 24 nt, Human
accccuggaagagacucuuuaaga

SEQ ID NO: 83277 - RNA, 27 nt, Human
aagcuauucaauucuuuuaacuguugu

SEQ ID NO: 83278 - RNA, 20 nt, Human
accugugaccagcacugucu

SEQ ID NO: 83279 - RNA, 23 nt, Human
ccauauuuuugaaagauuuuuca

SEQ ID NO: 83280 - RNA, 27 nt, Human
guacuauauauuuucauuacuauaggc

SEQ ID NO: 83281 - RNA, 18 nt, Human
ugagagucacauccaggu

SEQ ID NO: 83282 - RNA, 20 nt, Human
ugggugcuuacacacuguac

SEQ ID NO: 83283 - RNA, 21 nt, Human
uugcccagaugucuucauaug

SEQ ID NO: 83284 - RNA, 21 nt, Human
auuuuaacauuucuguauuug

SEQ ID NO: 83285 - RNA, 23 nt, Human
uagaauugggaagcugggggaag

SEQ ID NO: 83286 - RNA, 21 nt, Human
uuuauuacugccuucuuuuca

SEQ ID NO: 83287 - RNA, 24 nt, Human
caccagccacugcuuccuccuggg

SEQ ID NO: 83288 - RNA, 19 nt, Human
ggguacccacuauaugaga

SEQ ID NO: 83289 - RNA, 26 nt, Human
aucuuuguugugugggagggcagcag

SEQ ID NO: 83290 - RNA, 24 nt, Human
gucggccauuucucucucaccucu

SEQ ID NO: 83291 - RNA, 21 nt, Human
uagagcuuucuuucacaaaaa

SEQ ID NO: 83292 - RNA, 19 nt, Human
ccccucuccccaugggacc

SEQ ID NO: 83293 - RNA, 21 nt, Human
cguuuguccucugcugccauc

SEQ ID NO: 83294 - RNA, 26 nt, Human
ugagccagacggagagccaccuccuc

SEQ ID NO: 83295 - RNA, 27 nt, Human
auuccuauauuuacuugguaagaucca

SEQ ID NO: 83296 - RNA, 21 nt, Human
guagggccaccccacagcucu

SEQ ID NO: 83297 - RNA, 21 nt, Human
gcuacugcugccuccauuucu

SEQ ID NO: 83298 - RNA, 22 nt, Human
ucacccagacuggcgugcagug

SEQ ID NO: 83299 - RNA, 19 nt, Human
uaguaacugccucaguguu

SEQ ID NO: 83300 - RNA, 24 nt, Human
ugaaacacacgagcaaacccagag

SEQ ID NO: 83301 - RNA, 21 nt, Human
cuuggcccugcugugccuuca

SEQ ID NO: 83302 - RNA, 20 nt, Human
uucugaauguacacuuucug

SEQ ID NO: 83303 - RNA, 18 nt, Human
caguccucaguucucugc

SEQ ID NO: 83304 - RNA, 27 nt, Human
ucuccugccucagccuucugaguagcu

SEQ ID NO: 83305 - RNA, 23 nt, Human
uccuuaugguuuaggccuugcca

SEQ ID NO: 83306 - RNA, 18 nt, Human
ccugcuccucccugcccc

SEQ ID NO: 83307 - RNA, 21 nt, Human
cugaacuuuggaagcugggga

SEQ ID NO: 83308 - RNA, 27 nt, Human
gacucugcugccuucuccuuugucuuu

SEQ ID NO: 83309 - RNA, 20 nt, Human
gcaacacucacacuaggcaa

SEQ ID NO: 83310 - RNA, 25 nt, Human
ugaccuacuuuccccuucuuaucug

SEQ ID NO: 83311 - RNA, 20 nt, Human
auauuaacucaaaagaaaua

SEQ ID NO: 83312 - RNA, 23 nt, Human
gucagauuuuugaguaccaauga

SEQ ID NO: 83313 - RNA, 27 nt, Human
ucuccccugggcuucucccacgcagcc

SEQ ID NO: 83314 - RNA, 21 nt, Human
uuuauggaacugaguguuagg

SEQ ID NO: 83315 - RNA, 26 nt, Human
ugggcgugcuagagguugcagcauga

SEQ ID NO: 83316 - RNA, 24 nt, Human
cagcuaggcuagcugguuuggagu

SEQ ID NO: 83317 - RNA, 29 nt, Human
ggccucgccugccuuucugccuuuuaauu

SEQ ID NO: 83318 - RNA, 23 nt, Human
gcccuacuucuuugcuuugccca

SEQ ID NO: 83319 - RNA, 21 nt, Human
ccuugcccuccgguccccuua

SEQ ID NO: 83320 - RNA, 23 nt, Human
gaccggcgugacagccuccagaa

SEQ ID NO: 83321 - RNA, 24 nt, Human
gaguuauuuuacuuuucuaaccca

SEQ ID NO: 83322 - RNA, 21 nt, Human
acaguugaaauucauggaacu

SEQ ID NO: 83323 - RNA, 20 nt, Human
ccuccugcugcucuggagug

SEQ ID NO: 83324 - RNA, 26 nt, Human
ggacccagggcccucggugggagcca

SEQ ID NO: 83325 - RNA, 24 nt, Human
cuacuacaugcuggcaaaggugaa

SEQ ID NO: 83326 - RNA, 22 nt, Human
gcucguggcgugggaaaggagg

SEQ ID NO: 83327 - RNA, 23 nt, Human
ugccugcaugcauucuggcggaa

SEQ ID NO: 83328 - RNA, 21 nt, Human
cugcuugucuugaggagguca

SEQ ID NO: 83329 - RNA, 30 nt, Human
guggggaaaccaaggcagagcugaggggac

SEQ ID NO: 83330 - RNA, 21 nt, Human
uggcuaggacaggaagccagg

SEQ ID NO: 83331 - RNA, 26 nt, Human
cucuacugaguacuuucugcaggggc

SEQ ID NO: 83332 - RNA, 26 nt, Human
ucuggagcuugacaggccugacgucg

SEQ ID NO: 83333 - RNA, 22 nt, Human
ggcucacugcaacauccgccuc

SEQ ID NO: 83334 - RNA, 22 nt, Human
ggcucccugcaaccuccgccuc

SEQ ID NO: 83335 - RNA, 22 nt, Human
agaccagccucggcaacaugcc

SEQ ID NO: 83336 - RNA, 27 nt, Human
ccccugccucagucgagcacucacugu

SEQ ID NO: 83337 - RNA, 27 nt, Human
ugaucaucauggagagaaacuccuacu

SEQ ID NO: 83338 - RNA, 20 nt, Human
gcugccggcccugccagugc

SEQ ID NO: 83339 - RNA, 17 nt, Human
ugaguacaaaugccuua

SEQ ID NO: 83340 - RNA, 20 nt, Human
ugagcccaggccuccugcca

SEQ ID NO: 83341 - RNA, 27 nt, Human
ucaggaggcugaggcaggagaaucacu

SEQ ID NO: 83342 - RNA, 23 nt, Human
cacagugugcuccagauggugcu

SEQ ID NO: 83343 - RNA, 27 nt, Human
cacucuugaccuggagccaucuuccua

SEQ ID NO: 83344 - RNA, 22 nt, Human
cacugcacuccaggcuggguga

SEQ ID NO: 83345 - RNA, 24 nt, Human
agcucacugcaaccuccaucuccu

SEQ ID NO: 83346 - RNA, 25 nt, Human
ggcaaauucuguucuccuuaguggc

SEQ ID NO: 83347 - RNA, 23 nt, Human
uggagaaggaggccaggagccag

SEQ ID NO: 83348 - RNA, 27 nt, Human
cugacuugauucagucacucguagcuu

SEQ ID NO: 83349 - RNA, 27 nt, Human
agguaauaugcuauaaugucugcugua

SEQ ID NO: 83350 - RNA, 21 nt, Human
accuguaauccuagcacucug

SEQ ID NO: 83351 - RNA, 23 nt, Human
aaagggagaacggggcaagggac

SEQ ID NO: 83352 - RNA, 27 nt, Human
ggggaauuccguaagccuagaaucaaa

SEQ ID NO: 83353 - RNA, 26 nt, Human
ccacccuaguaaaggcaaguucugua

SEQ ID NO: 83354 - RNA, 22 nt, Human
caggcguauuuuuguacaguga

SEQ ID NO: 83355 - RNA, 21 nt, Human
ugccccagugggccaugauua

SEQ ID NO: 83356 - RNA, 26 nt, Human
acucacugagucuuaacuuuucacca

SEQ ID NO: 83357 - RNA, 27 nt, Human
gagauccagaccacgagaagugaccuu

SEQ ID NO: 83358 - RNA, 24 nt, Human
aacauguguauucuuuuaauuguu

SEQ ID NO: 83359 - RNA, 23 nt, Human
acauugcaacuggccuaauuggg

SEQ ID NO: 83360 - RNA, 21 nt, Human
cuauaugauacagacucuaua

SEQ ID NO: 83361 - RNA, 21 nt, Human
uucucauaauuucuguaaucc

SEQ ID NO: 83362 - RNA, 26 nt, Human
agaguguugcuguugaucaucuuugc

SEQ ID NO: 83363 - RNA, 25 nt, Human
uuuucauuuacucuggacuggugaa

SEQ ID NO: 83364 - RNA, 22 nt, Human
ugaaguucuagccacagcaguu

SEQ ID NO: 83365 - RNA, 22 nt, Human
gauuacaggcgugugucaccac

SEQ ID NO: 83366 - RNA, 18 nt, Human
gggggagaccggaaguga

SEQ ID NO: 83367 - RNA, 23 nt, Human
uaggugaugcagauaauagccua

SEQ ID NO: 83368 - RNA, 22 nt, Human
ggcaguuuacagaagaggucgc

SEQ ID NO: 83369 - RNA, 21 nt, Human
gcggggguggagccgggggaa

SEQ ID NO: 83370 - RNA, 19 nt, Human
cuggggcagaagagcccaa

SEQ ID NO: 83371 - RNA, 20 nt, Human
cugcgcugcgacugcucugg

SEQ ID NO: 83372 - RNA, 21 nt, Human
cuuauuucucauugagccuca

SEQ ID NO: 83373 - RNA, 22 nt, Human
ggauccccgcccccaccugccc

SEQ ID NO: 83374 - RNA, 26 nt, Human
ugcuucucucaacaaccucaucugca

SEQ ID NO: 83375 - RNA, 23 nt, Human
gggccuacaggggggucuccccu

SEQ ID NO: 83376 - RNA, 24 nt, Human
gcuaguuuuaaaauaaugaucuca

SEQ ID NO: 83377 - RNA, 21 nt, Human
uucaaauugggauuuuccgga

SEQ ID NO: 83378 - RNA, 22 nt, Human
ggcucacugccaggccagccuc

SEQ ID NO: 83379 - RNA, 22 nt, Human
caugcuuguaauccuagcacuu

SEQ ID NO: 83380 - RNA, 23 nt, Human
aucgugccacugcacgccagccu

SEQ ID NO: 83381 - RNA, 26 nt, Human
cugccugggaccugugcugagagagc

SEQ ID NO: 83382 - RNA, 27 nt, Human
ccccuaucccgguucugggagagcauu

SEQ ID NO: 83383 - RNA, 21 nt, Human
gaacaacaucaguuagaguuu

SEQ ID NO: 83384 - RNA, 24 nt, Human
gggaaagagaggaggccaucauuc

SEQ ID NO: 83385 - RNA, 23 nt, Human
agggucuggggccggcgccuggg

SEQ ID NO: 83386 - RNA, 27 nt, Human
agcuggaguucucauccagggcugcuu

SEQ ID NO: 83387 - RNA, 22 nt, Human
ugaagaaacuccuuucaucuca

SEQ ID NO: 83388 - RNA, 23 nt, Human
cuggccacuauuaaguggguuug

SEQ ID NO: 83389 - RNA, 23 nt, Human
ugcaugcugggcugccuggcaaa

SEQ ID NO: 83390 - RNA, 27 nt, Human
ugccaucuccccucguccugcgucccg

SEQ ID NO: 83391 - RNA, 21 nt, Human
gagugcuuucguaagcccugu

SEQ ID NO: 83392 - RNA, 25 nt, Human
cccuccaguguacugaggguacugg

SEQ ID NO: 83393 - RNA, 27 nt, Human
ucaccuggcacauucauuuucucaguu

SEQ ID NO: 83394 - RNA, 27 nt, Human
cuccugaccucgugauccacccgccuc

SEQ ID NO: 83395 - RNA, 22 nt, Human
cuaacuccaagcuggugugccu

SEQ ID NO: 83396 - RNA, 20 nt, Human
cccaggcuggagugcggugg

SEQ ID NO: 83397 - RNA, 19 nt, Human
gcugggugcugagacacug

SEQ ID NO: 83398 - RNA, 27 nt, Human
uuuacugacacugucuuaaauccuaaa

SEQ ID NO: 83399 - RNA, 20 nt, Human
gaccccugugagcaugggaa

SEQ ID NO: 83400 - RNA, 27 nt, Human
cagcgcacagcugcucugugaccaggg

SEQ ID NO: 83401 - RNA, 18 nt, Human
acgccgccuccgccucag

SEQ ID NO: 83402 - RNA, 20 nt, Human
uuucuaggcugagucuagug

SEQ ID NO: 83403 - RNA, 19 nt, Human
ggucuucccaaggauuuua

SEQ ID NO: 83404 - RNA, 22 nt, Human
aguggcggugggacugaccugc

SEQ ID NO: 83405 - RNA, 20 nt, Human
ccuuccagcauuccugcugc

SEQ ID NO: 83406 - RNA, 20 nt, Human
uuugaguuuugagcuacugg

SEQ ID NO: 83407 - RNA, 20 nt, Human
uugguaugaugcauauacaa

SEQ ID NO: 83408 - RNA, 26 nt, Human
ucucucuucuuuuccucagguaggac

SEQ ID NO: 83409 - RNA, 21 nt, Human
auuacauauuugacucuuuca

SEQ ID NO: 83410 - RNA, 22 nt, Human
gcccccagccucagcccaacuu

SEQ ID NO: 83411 - RNA, 24 nt, Human
gugggaaucaggcuuuucccgcag

SEQ ID NO: 83412 - RNA, 21 nt, Human
ugggauuacagacaugaacug

SEQ ID NO: 83413 - RNA, 21 nt, Human
gcccacccucauugucaugcc

SEQ ID NO: 83414 - RNA, 25 nt, Human
cuguucccucuccaaucuuccagcc

SEQ ID NO: 83415 - RNA, 17 nt, Human
gaaccuucuuagcauua

SEQ ID NO: 83416 - RNA, 19 nt, Human
cccaccccgucggucaccu

SEQ ID NO: 83417 - RNA, 18 nt, Human
aagaucuuuauugguaga

SEQ ID NO: 83418 - RNA, 27 nt, Human
ccuguuucuuuguuugaucaccaauaa

SEQ ID NO: 83419 - RNA, 17 nt, Human
ugcuacccucugccuca

SEQ ID NO: 83420 - RNA, 23 nt, Human
ucacugugccagcaugcuuccuc

SEQ ID NO: 83421 - RNA, 21 nt, Human
gauuacaggcgugugagccac

SEQ ID NO: 83422 - RNA, 26 nt, Human
uagauguuuuucuuacugucacuucu

SEQ ID NO: 83423 - RNA, 19 nt, Human
ggaauguguccauugaaaa

SEQ ID NO: 83424 - RNA, 28 nt, Human
ccaccugccucugucucacugaacuaga

SEQ ID NO: 83425 - RNA, 19 nt, Human
uguuaacucuuucucucca

SEQ ID NO: 83426 - RNA, 23 nt, Human
accaugccaggcuaauuuuuuau

SEQ ID NO: 83427 - RNA, 22 nt, Human
uuugugaaagaagaaaaggaaa

SEQ ID NO: 83428 - RNA, 23 nt, Human
gcgcuuggagucagagcucuaga

SEQ ID NO: 83429 - RNA, 27 nt, Human
ccugcuguccccucuugccccaacccc

SEQ ID NO: 83430 - RNA, 22 nt, Human
gcuaaggucaaguaaagcacaa

SEQ ID NO: 83431 - RNA, 21 nt, Human
uuuuugggcugggugcagugg

SEQ ID NO: 83432 - RNA, 23 nt, Human
cgucaggacccaccaugucugcc

SEQ ID NO: 83433 - RNA, 22 nt, Human
ccucaccuagccccuguccuga

SEQ ID NO: 83434 - RNA, 22 nt, Human
gaguuuuccuuuguuuuaauaa

SEQ ID NO: 83435 - RNA, 26 nt, Human
caagcagggcccugccuaaggaacac

SEQ ID NO: 83436 - RNA, 22 nt, Human
cguccacccaccccuggcuggc

SEQ ID NO: 83437 - RNA, 22 nt, Human
ugccuugaguccugccagugua

SEQ ID NO: 83438 - RNA, 22 nt, Human
uuuucaccucuccaguuuuucc

SEQ ID NO: 83439 - RNA, 20 nt, Human
ccuuucucgcaccugcuccu

SEQ ID NO: 83440 - RNA, 19 nt, Human
uaugauacaaaugcuuuca

SEQ ID NO: 83441 - RNA, 28 nt, Human
uguaaacaauugaaauauuuugucuuaa

SEQ ID NO: 83442 - RNA, 25 nt, Human
ucugcagcuuagcuuguguccugcc

SEQ ID NO: 83443 - RNA, 23 nt, Human
cugcugcccuaguuuucuuuccu

SEQ ID NO: 83444 - RNA, 20 nt, Human
cuuccugcacuguuuucuuu

SEQ ID NO: 83445 - RNA, 23 nt, Human
agagacgagaggggcaagggagg

SEQ ID NO: 83446 - RNA, 23 nt, Human
gggaggacagcuugucugcugcu

SEQ ID NO: 83447 - RNA, 25 nt, Human
uacaacauuaugaagacauucuuuu

SEQ ID NO: 83448 - RNA, 22 nt, Human
auuaacuccccucccgccuacc

SEQ ID NO: 83449 - RNA, 21 nt, Human
uggugaggaaguccaggcucc

SEQ ID NO: 83450 - RNA, 22 nt, Human
uucccaagcuggagugcagugg

SEQ ID NO: 83451 - RNA, 22 nt, Human
aaccaagaauugcaggcauaug

SEQ ID NO: 83452 - RNA, 22 nt, Human
uugucuaggagacagagccaag

SEQ ID NO: 83453 - RNA, 23 nt, Human
agcucacugcaggaacgaguuca

SEQ ID NO: 83454 - RNA, 25 nt, Human
gccagauggggaaggucacuggaaa

SEQ ID NO: 83455 - RNA, 21 nt, Human
agccgacacuugaauguagua

SEQ ID NO: 83456 - RNA, 21 nt, Human
auggaaagggauccugauuga

SEQ ID NO: 83457 - RNA, 21 nt, Human
uccaggcccaaggaguaagua

SEQ ID NO: 83458 - RNA, 20 nt, Human
cuauguguagccaucuuugc

SEQ ID NO: 83459 - RNA, 21 nt, Human
acuccaguuucugucuugcuc

SEQ ID NO: 83460 - RNA, 22 nt, Human
aauccaggcuguucucagcguu

SEQ ID NO: 83461 - RNA, 19 nt, Human
ugcccuauccacagcugcu

SEQ ID NO: 83462 - RNA, 22 nt, Human
ucucuucuuugagaagccagac

SEQ ID NO: 83463 - RNA, 20 nt, Human
ccgcugcugcuuuccuucgg

SEQ ID NO: 83464 - RNA, 26 nt, Human
ggaggcaccuguccagaagccuggcc

SEQ ID NO: 83465 - RNA, 22 nt, Human
uacagugagccuugauuguguc

SEQ ID NO: 83466 - RNA, 25 nt, Human
ccucuuuucccuugugugagggcaa

SEQ ID NO: 83467 - RNA, 22 nt, Human
cggcuccuguugacccgguccg

SEQ ID NO: 83468 - RNA, 23 nt, Human
ucccucccucccaucugggggua

SEQ ID NO: 83469 - RNA, 23 nt, Human
cucccuugccucagauuuauugc

SEQ ID NO: 83470 - RNA, 21 nt, Human
augccauggccgggugcagug

SEQ ID NO: 83471 - RNA, 26 nt, Human
uuaggagcugaagaaauggaaaagca

SEQ ID NO: 83472 - RNA, 21 nt, Human
cuucugagcagcgagccugcu

SEQ ID NO: 83473 - RNA, 20 nt, Human
gcaguaacauuuuucucagu

SEQ ID NO: 83474 - RNA, 23 nt, Human
gucgaagcgauucuccugccuca

SEQ ID NO: 83475 - RNA, 23 nt, Human
gucaggacaacugccugcugcua

SEQ ID NO: 83476 - RNA, 23 nt, Human
gcucaggcugggaggcagagggc

SEQ ID NO: 83477 - RNA, 26 nt, Human
ggaggcugaguucugguucaugcaga

SEQ ID NO: 83478 - RNA, 21 nt, Human
uauuaaaagaauaauuuuuug

SEQ ID NO: 83479 - RNA, 22 nt, Human
uugccagacuggagugcagugg

SEQ ID NO: 83480 - RNA, 26 nt, Human
gcuauugugauauuuuagcacuuugg

SEQ ID NO: 83481 - RNA, 23 nt, Human
ccugcaguuucuggguaacaggg

SEQ ID NO: 83482 - RNA, 26 nt, Human
aagcgcugggauuacaggcaggagcc

SEQ ID NO: 83483 - RNA, 21 nt, Human
ccaaguccccuucccggcagu

SEQ ID NO: 83484 - RNA, 20 nt, Human
uguuguguggaguccuggcu

SEQ ID NO: 83485 - RNA, 21 nt, Human
agccccucaagggcugaggcc

SEQ ID NO: 83486 - RNA, 21 nt, Human
ccagcccacccagccaaaaau

SEQ ID NO: 83487 - RNA, 27 nt, Human
ggaugugagggcccgcaggagccgagu

SEQ ID NO: 83488 - RNA, 21 nt, Human
cccuucuguuucuucagcaca

SEQ ID NO: 83489 - RNA, 22 nt, Human
agcauuuuggucuuuugcuuca

SEQ ID NO: 83490 - RNA, 20 nt, Human
uuugggccagacuccugugu

SEQ ID NO: 83491 - RNA, 23 nt, Human
uaccuugacuggugaagucagcc

SEQ ID NO: 83492 - RNA, 26 nt, Human
gguauacuagaagcagaaugaaacca

SEQ ID NO: 83493 - RNA, 23 nt, Human
gggggaugcucuggcaccugucg

SEQ ID NO: 83494 - RNA, 19 nt, Human
auggguggaaaggugugag

SEQ ID NO: 83495 - RNA, 21 nt, Human
ggaggcggagguugcauugag

SEQ ID NO: 83496 - RNA, 23 nt, Human
gggaggcugagacaggaggauug

SEQ ID NO: 83497 - RNA, 24 nt, Human
guggaaagagcagaacaccauaga

SEQ ID NO: 83498 - RNA, 27 nt, Human
agagacacguggcagccacacucaccc

SEQ ID NO: 83499 - RNA, 20 nt, Human
gccugcaucuguauccagcg

SEQ ID NO: 83500 - RNA, 18 nt, Human
uuucaaacuguaggguca

SEQ ID NO: 83501 - RNA, 21 nt, Human
ucauuauaguauucaggauuu

SEQ ID NO: 83502 - RNA, 24 nt, Human
gcaggcccaaagcugcagguccca

SEQ ID NO: 83503 - RNA, 23 nt, Human
aaaagaaaacacaaccugccugg

SEQ ID NO: 83504 - RNA, 22 nt, Human
ccugaguagcugggauuauagg

SEQ ID NO: 83505 - RNA, 22 nt, Human
cccgaguagcugggauuacagg

SEQ ID NO: 83506 - RNA, 26 nt, Human
uggaagauuuuaaauaauuucuuuac

SEQ ID NO: 83507 - RNA, 20 nt, Human
cggccccucucccgccccac

SEQ ID NO: 83508 - RNA, 23 nt, Human
agcucaggugaaagacugagaug

SEQ ID NO: 83509 - RNA, 18 nt, Human
ggacuggaucccagggca

SEQ ID NO: 83510 - RNA, 22 nt, Human
guaccuugccuagccucucccu

SEQ ID NO: 83511 - RNA, 20 nt, Human
ccucaucguggucugugcca

SEQ ID NO: 83512 - RNA, 20 nt, Human
aagcugaaauacaagccuua

SEQ ID NO: 83513 - RNA, 24 nt, Human
cugucguccaggcuggagugcagu

SEQ ID NO: 83514 - RNA, 19 nt, Human
aaguuuuuuacugcuuuau

SEQ ID NO: 83515 - RNA, 22 nt, Human
aaagugcugggauuacaggcgu

SEQ ID NO: 83516 - RNA, 22 nt, Human
aaagugcugagauuacaagcgu

SEQ ID NO: 83517 - RNA, 20 nt, Human
auagaguuuaauuacucauu

SEQ ID NO: 83518 - RNA, 23 nt, Human
guagcccaggccagagugcagug

SEQ ID NO: 83519 - RNA, 18 nt, Human
uuaguaaauuucugugau

SEQ ID NO: 83520 - RNA, 24 nt, Human
gggaggcacucuugaugguuagga

SEQ ID NO: 83521 - RNA, 23 nt, Human
ucuuucugugagaguccugaguc

SEQ ID NO: 83522 - RNA, 22 nt, Human
uaggcugggaggagcccagggc

SEQ ID NO: 83523 - RNA, 24 nt, Human
uuucauaaguaguucugaauuccc

SEQ ID NO: 83524 - RNA, 23 nt, Human
ucuguuuuuaaaaccuucugaac

SEQ ID NO: 83525 - RNA, 22 nt, Human
gcuguucuucaacuccugggcu

SEQ ID NO: 83526 - RNA, 27 nt, Human
cauuuccuguagaacuaaaggcuguuc

SEQ ID NO: 83527 - RNA, 26 nt, Human
caguuuguauaguuggaauauuuguc

SEQ ID NO: 83528 - RNA, 21 nt, Human
cuccccagccgcgggccaucc

SEQ ID NO: 83529 - RNA, 23 nt, Human
aaccaguauuuuuguuguuuauu

SEQ ID NO: 83530 - RNA, 19 nt, Human
uacaguuuuuacauuguaa

SEQ ID NO: 83531 - RNA, 23 nt, Human
auugcgucacugcacuccaaccu

SEQ ID NO: 83532 - RNA, 26 nt, Human
agccaucaaaauuggacuuuguauug

SEQ ID NO: 83533 - RNA, 22 nt, Human
cagacuccgaguccuucaguga

SEQ ID NO: 83534 - RNA, 23 nt, Human
ucauacugucugggauuaagggc

SEQ ID NO: 83535 - RNA, 19 nt, Human
gagcuaaauaucuuguuca

SEQ ID NO: 83536 - RNA, 24 nt, Human
ucccucugaccagcaaccaggaca

SEQ ID NO: 83537 - RNA, 23 nt, Human
ccacagucuguaauccauucaca

SEQ ID NO: 83538 - RNA, 20 nt, Human
uuaaaaaacuacuauuugaa

SEQ ID NO: 83539 - RNA, 24 nt, Human
cgucagugccaucggucuagaacc

SEQ ID NO: 83540 - RNA, 19 nt, Human
aaauaaaauauguucuuua

SEQ ID NO: 83541 - RNA, 21 nt, Human
cugccucugcgccucucgggg

SEQ ID NO: 83542 - RNA, 22 nt, Human
ccugccuggcuagcccugaacc

SEQ ID NO: 83543 - RNA, 24 nt, Human
ugggauuauauaggcaugagccac

SEQ ID NO: 83544 - RNA, 24 nt, Human
cagaguguggcuguaccacauucg

SEQ ID NO: 83545 - RNA, 21 nt, Human
cucuccagcucugaauggaga

SEQ ID NO: 83546 - RNA, 27 nt, Human
aaaagagagcugcuuucccuuuuaccu

SEQ ID NO: 83547 - RNA, 26 nt, Human
acagaaauugcccugccuacuacaag

SEQ ID NO: 83548 - RNA, 22 nt, Human
ucuugugguaagagcaagugca

SEQ ID NO: 83549 - RNA, 22 nt, Human
cccgaggucaggaguucaagac

SEQ ID NO: 83550 - RNA, 21 nt, Human
ggcucugaggcugccccaggg

SEQ ID NO: 83551 - RNA, 22 nt, Human
cugcugagcccugcccgccggc

SEQ ID NO: 83552 - RNA, 25 nt, Human
guuucccaggcuggucuuaagcuca

SEQ ID NO: 83553 - RNA, 22 nt, Human
gcgaacacacacagguguccug

SEQ ID NO: 83554 - RNA, 23 nt, Human
uguuuguguugguuuucugacuu

SEQ ID NO: 83555 - RNA, 24 nt, Human
ugucgcccaggcuggagugcaaug

SEQ ID NO: 83556 - RNA, 26 nt, Human
uaaugauuuuuuauuaacaugauuuc

SEQ ID NO: 83557 - RNA, 21 nt, Human
acuuuuuaaaaaagaaauacu

SEQ ID NO: 83558 - RNA, 20 nt, Human
ucugcccuggaggugcuggg

SEQ ID NO: 83559 - RNA, 22 nt, Human
cucacccucccaaaaugcuggg

SEQ ID NO: 83560 - RNA, 21 nt, Human
cugaaaauauuaagguauuuu

SEQ ID NO: 83561 - RNA, 20 nt, Human
aggaaaggaacacugcaggc

SEQ ID NO: 83562 - RNA, 23 nt, Human
ucuucauuccacuacaaagucac

SEQ ID NO: 83563 - RNA, 20 nt, Human
uguuagugccaugcgagucc

SEQ ID NO: 83564 - RNA, 26 nt, Human
guugcaggaaguuaguuuuaguucug

SEQ ID NO: 83565 - RNA, 23 nt, Human
auuccuucaaguuuccuagcucu

SEQ ID NO: 83566 - RNA, 25 nt, Human
acaacagcauccaacauaucugucu

SEQ ID NO: 83567 - RNA, 24 nt, Human
uugaggccuggcagcugggccaag

SEQ ID NO: 83568 - RNA, 21 nt, Human
gcuuaggggcucuccugggcc

SEQ ID NO: 83569 - RNA, 23 nt, Human
cacugccugcccucugucugucu

SEQ ID NO: 83570 - RNA, 22 nt, Human
caagucaagcagagcugggugg

SEQ ID NO: 83571 - RNA, 20 nt, Human
ggggccuuucuuuaacugcc

SEQ ID NO: 83572 - RNA, 25 nt, Human
guuguuuagagaaugagaaauggaa

SEQ ID NO: 83573 - RNA, 18 nt, Human
aaaagggacacauuugug

SEQ ID NO: 83574 - RNA, 23 nt, Human
gccugugaucccagcuacucggg

SEQ ID NO: 83575 - RNA, 23 nt, Human
gcaggagcucguuucacagcccc

SEQ ID NO: 83576 - RNA, 27 nt, Human
aguggcugauucugaacaauugugguc

SEQ ID NO: 83577 - RNA, 22 nt, Human
augggaaaacuucacuccaaag

SEQ ID NO: 83578 - RNA, 21 nt, Human
ugagagaaggcugcucuuuug

SEQ ID NO: 83579 - RNA, 21 nt, Human
aaugcuugaauauuacuggau

SEQ ID NO: 83580 - RNA, 25 nt, Human
aggugagugaagauggcagagagga

SEQ ID NO: 83581 - RNA, 22 nt, Human
ccacauuacccaaucaguaaaa

SEQ ID NO: 83582 - RNA, 19 nt, Human
ggaggcugcaggaugguca

SEQ ID NO: 83583 - RNA, 25 nt, Human
ggguucaaacuauucucccgccuca

SEQ ID NO: 83584 - RNA, 29 nt, Human
gggcuccagggacuggaguguaaugcucg

SEQ ID NO: 83585 - RNA, 23 nt, Human
auaucugcucacaucuuacucag

SEQ ID NO: 83586 - RNA, 21 nt, Human
cccagcgucaggccuaccuca

SEQ ID NO: 83587 - RNA, 23 nt, Human
gggugggggcaucaggagcaggg

SEQ ID NO: 83588 - RNA, 19 nt, Human
ccaugccauauaagcacaa

SEQ ID NO: 83589 - RNA, 22 nt, Human
gcagugaggagcugucuggacc

SEQ ID NO: 83590 - RNA, 26 nt, Human
uaguugagcaaagggguccucacguu

SEQ ID NO: 83591 - RNA, 21 nt, Human
ccagaggguugaggcgggugc

SEQ ID NO: 83592 - RNA, 21 nt, Human
acugaugcugccucugccuuc

SEQ ID NO: 83593 - RNA, 23 nt, Human
gguaaagcaagcaaccucugcuu

SEQ ID NO: 83594 - RNA, 21 nt, Human
cgcccaccacugccacggccu

SEQ ID NO: 83595 - RNA, 21 nt, Human
auaguuuucugaucuguguua

SEQ ID NO: 83596 - RNA, 21 nt, Human
guuuuuguuuuguugcacuga

SEQ ID NO: 83597 - RNA, 23 nt, Human
ggcccuaggagcuggugcugccc

SEQ ID NO: 83598 - RNA, 22 nt, Human
ucuuucacaagcccuccaggag

SEQ ID NO: 83599 - RNA, 24 nt, Human
gcaaacuauaugcaaaaaugagua

SEQ ID NO: 83600 - RNA, 27 nt, Human
ugaacuugacgugaggccucaagcagu

SEQ ID NO: 83601 - RNA, 26 nt, Human
ggagguugaggcugcagugggggguc

SEQ ID NO: 83602 - RNA, 22 nt, Human
cauuuucaucuggguuccaauu

SEQ ID NO: 83603 - RNA, 22 nt, Human
aucguccagacccauggcaggg

SEQ ID NO: 83604 - RNA, 18 nt, Human
ugcuccauggcugccauc

SEQ ID NO: 83605 - RNA, 18 nt, Human
ccuucauccuccucccca

SEQ ID NO: 83606 - RNA, 20 nt, Human
ugccugguacaguauggggg

SEQ ID NO: 83607 - RNA, 22 nt, Human
cccccagggaaaaccaggcugg

SEQ ID NO: 83608 - RNA, 20 nt, Human
aaaacacaaaaauuagccag

SEQ ID NO: 83609 - RNA, 25 nt, Human
uuuuaggacacauuuaugcagauga

SEQ ID NO: 83610 - RNA, 21 nt, Human
ggagcugaggagcagcuguuc

SEQ ID NO: 83611 - RNA, 29 nt, Human
gucaaaacaagacaaauggggauagauug

SEQ ID NO: 83612 - RNA, 21 nt, Human
guauucaaagaaaacaggaaa

SEQ ID NO: 83613 - RNA, 19 nt, Human
ccacagcagucucaguccu

SEQ ID NO: 83614 - RNA, 21 nt, Human
uuaguaucuuuaccuaccuca

SEQ ID NO: 83615 - RNA, 24 nt, Human
gcaccccugcaucuuccugcuggg

SEQ ID NO: 83616 - RNA, 21 nt, Human
guggauggggagaucggggcc

SEQ ID NO: 83617 - RNA, 25 nt, Human
ugggugagggauaaaaugaggcucc

SEQ ID NO: 83618 - RNA, 22 nt, Human
acaucagccugggagacgcggu

SEQ ID NO: 83619 - RNA, 23 nt, Human
cuggaaauggccauugagcuguu

SEQ ID NO: 83620 - RNA, 22 nt, Human
gcaacuuugauaucauauuccu

SEQ ID NO: 83621 - RNA, 24 nt, Human
ucugacagucucuacgcugugaau

SEQ ID NO: 83622 - RNA, 22 nt, Human
cgccucucggguucaagcgauu

SEQ ID NO: 83623 - RNA, 25 nt, Human
gggaggcggcagaaugcagccagag

SEQ ID NO: 83624 - RNA, 21 nt, Human
ccucucucaacacacuccuca

SEQ ID NO: 83625 - RNA, 20 nt, Human
gguaauaguuaucaccuucu

SEQ ID NO: 83626 - RNA, 19 nt, Human
accucuuccugaaucacug

SEQ ID NO: 83627 - RNA, 31 nt, Human
ccuuaugaccaggaaccuuuguuuugggcuc

SEQ ID NO: 83628 - RNA, 21 nt, Human
ugucucaguaucuagcacaua

SEQ ID NO: 83629 - RNA, 23 nt, Human
ucaauauucagaaaaccaaaaau

SEQ ID NO: 83630 - RNA, 20 nt, Human
uugggaaugaagagguagca

SEQ ID NO: 83631 - RNA, 22 nt, Human
agaccagccuuaccaacaugga

SEQ ID NO: 83632 - RNA, 22 nt, Human
gcccagccuggcuggccugcag

SEQ ID NO: 83633 - RNA, 20 nt, Human
gcuccagcaaaagcgcagga

SEQ ID NO: 83634 - RNA, 26 nt, Human
uuucuaucugcacuuuuugaucucca

SEQ ID NO: 83635 - RNA, 22 nt, Human
ugcaaccuccaccuuccugguu

SEQ ID NO: 83636 - RNA, 20 nt, Human
gaggcagucugggcacuuuu

SEQ ID NO: 83637 - RNA, 21 nt, Human
auucuaaaacaugcugcagca

SEQ ID NO: 83638 - RNA, 25 nt, Human
gagaaggaguuugagacuguguaug

SEQ ID NO: 83639 - RNA, 20 nt, Human
uuaagccacaaaguuugugg

SEQ ID NO: 83640 - RNA, 21 nt, Human
ucucccacaagcccccuacag

SEQ ID NO: 83641 - RNA, 24 nt, Human
uggcaagcacgggacaggaggggc

SEQ ID NO: 83642 - RNA, 20 nt, Human
agcccaaaugccgcucuuca

SEQ ID NO: 83643 - RNA, 20 nt, Human
ugaacaaaagaugcucuucu

SEQ ID NO: 83644 - RNA, 25 nt, Human
uuauggugcugauuaauggugauca

SEQ ID NO: 83645 - RNA, 27 nt, Human
ccauuugccaauuuuccuacucucaca

SEQ ID NO: 83646 - RNA, 20 nt, Human
cuucagaauaggcaugauaa

SEQ ID NO: 83647 - RNA, 23 nt, Human
ccuucccagcccccuccagggcc

SEQ ID NO: 83648 - RNA, 22 nt, Human
gagucuguggacacuguggaaa

SEQ ID NO: 83649 - RNA, 21 nt, Human
ggagcaucuugucucuaaccu

SEQ ID NO: 83650 - RNA, 23 nt, Human
gggagccgguuugggagagacca

SEQ ID NO: 83651 - RNA, 28 nt, Human
cugcacacaauaggugcuucuuggaugu

SEQ ID NO: 83652 - RNA, 24 nt, Human
uuuagcccugggcucgaaccugcg

SEQ ID NO: 83653 - RNA, 27 nt, Human
gaugcccagguucagguguaucgugca

SEQ ID NO: 83654 - RNA, 30 nt, Human
gcauguaacagacuggcacaugugccagcu

SEQ ID NO: 83655 - RNA, 24 nt, Human
cacagggaggcauggagugccaug

SEQ ID NO: 83656 - RNA, 21 nt, Human
aacaucaaaugaauaauaaua

SEQ ID NO: 83657 - RNA, 23 nt, Human
auggugccacugcacuccagccu

SEQ ID NO: 83658 - RNA, 22 nt, Human
augucuauuuugaaauucccua

SEQ ID NO: 83659 - RNA, 21 nt, Human
uucaguaacaacagaaacccc

SEQ ID NO: 83660 - RNA, 23 nt, Human
ccgccgccgcgcaccugccuucg

SEQ ID NO: 83661 - RNA, 22 nt, Human
ccgagaucacaccacuguacuc

SEQ ID NO: 83662 - RNA, 27 nt, Human
ggucuugaucuccugaccuugugaucc

SEQ ID NO: 83663 - RNA, 21 nt, Human
ccccagcaucacuaacaaaua

SEQ ID NO: 83664 - RNA, 20 nt, Human
cggggcggaggugaggaccu

SEQ ID NO: 83665 - RNA, 25 nt, Human
cccgugugagaauaccuguggugug

SEQ ID NO: 83666 - RNA, 19 nt, Human
aguguagcuaugugcugcu

SEQ ID NO: 83667 - RNA, 22 nt, Human
gugcggauggacaaggagaagg

SEQ ID NO: 83668 - RNA, 23 nt, Human
ucagguagggagcuaaggaagac

SEQ ID NO: 83669 - RNA, 27 nt, Human
ggcuggccgacauggugaaaccccauc

SEQ ID NO: 83670 - RNA, 21 nt, Human
uccuacuccauccuucaugga

SEQ ID NO: 83671 - RNA, 22 nt, Human
cccuuucugcccuccugcucca

SEQ ID NO: 83672 - RNA, 22 nt, Human
ugccuguaaucccagcacuugg

SEQ ID NO: 83673 - RNA, 26 nt, Human
agggugaagaauggguuggagcaugg

SEQ ID NO: 83674 - RNA, 26 nt, Human
ugcagcccagccuagucagggcacag

SEQ ID NO: 83675 - RNA, 22 nt, Human
cauuuucagcacuuacuucaaa

SEQ ID NO: 83676 - RNA, 29 nt, Human
gcagaugcucuuaaaagcauugauaaccu

SEQ ID NO: 83677 - RNA, 21 nt, Human
ggaggcggagguaguggugag

SEQ ID NO: 83678 - RNA, 26 nt, Human
gguaucuccuggaugccagugagcgg

SEQ ID NO: 83679 - RNA, 23 nt, Human
ggacuuugccucuacagcauuuu

SEQ ID NO: 83680 - RNA, 21 nt, Human
gcauuuuaaaaugacacuguu

SEQ ID NO: 83681 - RNA, 26 nt, Human
ggcacccaucccagggcuccucugga

SEQ ID NO: 83682 - RNA, 21 nt, Human
ugccuuaaucccagcacuuug

SEQ ID NO: 83683 - RNA, 21 nt, Human
gcacgguggcugacaccugua

SEQ ID NO: 83684 - RNA, 26 nt, Human
uucaggaucagucaaaggcagcaagc

SEQ ID NO: 83685 - RNA, 26 nt, Human
uuguucugcugaucuguagugguugc

SEQ ID NO: 83686 - RNA, 27 nt, Human
accggcuucucggcuuggauccugggc

SEQ ID NO: 83687 - RNA, 27 nt, Human
cucauuucuguauauuccuuuuauggg

SEQ ID NO: 83688 - RNA, 26 nt, Human
ccaguggcugcuccuuccuucaccuc

SEQ ID NO: 83689 - RNA, 20 nt, Human
aacaaauuauaacuauguga

SEQ ID NO: 83690 - RNA, 23 nt, Human
agagugggagggaagcccucagc

SEQ ID NO: 83691 - RNA, 31 nt, Human
gggaagugggauggagguugcccugcauccc

SEQ ID NO: 83692 - RNA, 24 nt, Human
ccagagcaaaggucauucagccgc

SEQ ID NO: 83693 - RNA, 25 nt, Human
gaugcuaucacagacucugcuagug

SEQ ID NO: 83694 - RNA, 20 nt, Human
gaaaagauuuauuaaaacua

SEQ ID NO: 83695 - RNA, 24 nt, Human
gucuuacaaaacacuucucuauca

SEQ ID NO: 83696 - RNA, 27 nt, Human
cauucauaucuaggcaguauuuugcuu

SEQ ID NO: 83697 - RNA, 17 nt, Human
ccucacugcucuacuuc

SEQ ID NO: 83698 - RNA, 22 nt, Human
ggcaggagaauugcucgaacuc

SEQ ID NO: 83699 - RNA, 18 nt, Human
cgagggggccaagggugg

SEQ ID NO: 83700 - RNA, 20 nt, Human
uggaaacacuggagucugaa

SEQ ID NO: 83701 - RNA, 22 nt, Human
uucuaaaaacuucaagcacuua

SEQ ID NO: 83702 - RNA, 22 nt, Human
uuacaugccugauggcaccuua

SEQ ID NO: 83703 - RNA, 17 nt, Human
uaguguugacauuugaa

SEQ ID NO: 83704 - RNA, 24 nt, Human
gcugcaacacagcuggugaugaga

SEQ ID NO: 83705 - RNA, 25 nt, Human
cagagcagcagaacggguucaguuu

SEQ ID NO: 83706 - RNA, 22 nt, Human
uucaguuucuucagagugguaa

SEQ ID NO: 83707 - RNA, 29 nt, Human
ggcuucauacggaaaguguuugagagcaa

SEQ ID NO: 83708 - RNA, 21 nt, Human
aguugagacagggaggcagga

SEQ ID NO: 83709 - RNA, 24 nt, Human
guucaacaacaccagaacugugug

SEQ ID NO: 83710 - RNA, 23 nt, Human
gggcaucaggaacagugcuacuu

SEQ ID NO: 83711 - RNA, 21 nt, Human
ggggugaggguaggaggcauu

SEQ ID NO: 83712 - RNA, 23 nt, Human
cucuccuuccccaucagacugga

SEQ ID NO: 83713 - RNA, 31 nt, Human
cugccgccccuccccgccugccuggacugcg

SEQ ID NO: 83714 - RNA, 21 nt, Human
ggcuuaacauuuuugcaagaa

SEQ ID NO: 83715 - RNA, 22 nt, Human
cugccucccgaguucaagcaau

SEQ ID NO: 83716 - RNA, 26 nt, Human
ccagcaccugcgagaggucccugcuu

SEQ ID NO: 83717 - RNA, 21 nt, Human
augugggaaaacuuccagccc

SEQ ID NO: 83718 - RNA, 22 nt, Human
cugcagaccuccgccaucuggg

SEQ ID NO: 83719 - RNA, 19 nt, Human
gcagccaagggugcacuga

SEQ ID NO: 83720 - RNA, 21 nt, Human
aggaaaacugagacucagaca

SEQ ID NO: 83721 - RNA, 27 nt, Human
cccaaagugcugggauuaaagguguga

SEQ ID NO: 83722 - RNA, 22 nt, Human
gggacaucaggagacugggcuc

SEQ ID NO: 83723 - RNA, 26 nt, Human
ccaacugccaaccccaaagcuuccac

SEQ ID NO: 83724 - RNA, 18 nt, Human
uacagauauuuauaucaa

SEQ ID NO: 83725 - RNA, 26 nt, Human
ccucuucuucgcccuguucugugcca

SEQ ID NO: 83726 - RNA, 21 nt, Human
aggccuuccggaagaaaaaga

SEQ ID NO: 83727 - RNA, 27 nt, Human
ucugggagcugggcgggcacagcaucc

SEQ ID NO: 83728 - RNA, 23 nt, Human
cugauacuccuaugcuugaguuc

SEQ ID NO: 83729 - RNA, 24 nt, Human
uuucucuagugugucggacacaaa

SEQ ID NO: 83730 - RNA, 27 nt, Human
guugcccaggcuggucucgaacuccug

SEQ ID NO: 83731 - RNA, 23 nt, Human
agcgaguccgcgugcggagccag

SEQ ID NO: 83732 - RNA, 21 nt, Human
gacuuagugccugucuggcag

SEQ ID NO: 83733 - RNA, 22 nt, Human
auuucuuaccucacauagauga

SEQ ID NO: 83734 - RNA, 21 nt, Human
accagccugggugacagagcg

SEQ ID NO: 83735 - RNA, 24 nt, Human
ccuccacuuccuggguucacauga

SEQ ID NO: 83736 - RNA, 24 nt, Human
cacuggcgaagauggucuccauau

SEQ ID NO: 83737 - RNA, 21 nt, Human
gaguacguucuggauuacuca

SEQ ID NO: 83738 - RNA, 28 nt, Human
cccgcugccucuugucuagcugcuguca

SEQ ID NO: 83739 - RNA, 27 nt, Human
agaauuaaaaggcaguugcuguggaaa

SEQ ID NO: 83740 - RNA, 23 nt, Human
ugccugugagcuaugucacuccc

SEQ ID NO: 83741 - RNA, 21 nt, Human
ucacccuucucucacccgucc

SEQ ID NO: 83742 - RNA, 24 nt, Human
acucuucaaccucuacugaaaaca

SEQ ID NO: 83743 - RNA, 24 nt, Human
gagcagcccauggcuuagcagaac

SEQ ID NO: 83744 - RNA, 26 nt, Human
uauggugcucuucccagucugguucc

SEQ ID NO: 83745 - RNA, 21 nt, Human
uuaagguuuaauuauauuuuu

SEQ ID NO: 83746 - RNA, 21 nt, Human
ucucagacuuucuaaguuaaa

SEQ ID NO: 83747 - RNA, 19 nt, Human
ccaggaguuugaggcugca

SEQ ID NO: 83748 - RNA, 27 nt, Human
aucaguuggaaauuuauaaccaaccaa

SEQ ID NO: 83749 - RNA, 27 nt, Human
cacugcaugcagaaacuuggaugucac

SEQ ID NO: 83750 - RNA, 23 nt, Human
ccagagacugagagcagagacca

SEQ ID NO: 83751 - RNA, 22 nt, Human
augucacugcugacauaacucc

SEQ ID NO: 83752 - RNA, 21 nt, Human
ucaccauggauggucuuccua

SEQ ID NO: 83753 - RNA, 23 nt, Human
ccaaagugcugggauuaacaggu

SEQ ID NO: 83754 - RNA, 23 nt, Human
acacgucuguugcacaaaugcau

SEQ ID NO: 83755 - RNA, 28 nt, Human
caccagcucuccagccugcucguccagg

SEQ ID NO: 83756 - RNA, 19 nt, Human
accaacaccuccucuccag

SEQ ID NO: 83757 - RNA, 24 nt, Human
gacccucuaguucaacugugccag

SEQ ID NO: 83758 - RNA, 24 nt, Human
ccaguauuugcugcuauuuuuaaa

SEQ ID NO: 83759 - RNA, 22 nt, Human
agcggucagggcuccaggcauc

SEQ ID NO: 83760 - RNA, 26 nt, Human
gcccagccauccucccauccugcacu

SEQ ID NO: 83761 - RNA, 20 nt, Human
cggagaaggacgaagacuga

SEQ ID NO: 83762 - RNA, 27 nt, Human
agcauuuucuguuuucccaccaggccc

SEQ ID NO: 83763 - RNA, 21 nt, Human
cucugccauccccuuggggcc

SEQ ID NO: 83764 - RNA, 20 nt, Human
ugcccugggggaggaagaga

SEQ ID NO: 83765 - RNA, 21 nt, Human
cacuucagggcaccugagcca

SEQ ID NO: 83766 - RNA, 24 nt, Human
ccacuccccuaaacuccaggauuu

SEQ ID NO: 83767 - RNA, 24 nt, Human
gcugcuuguuuacaaagcaucuca

SEQ ID NO: 83768 - RNA, 23 nt, Human
uuaguagacacaggguuucucca

SEQ ID NO: 83769 - RNA, 24 nt, Human
ggcccugccagcaucucuggcucg

SEQ ID NO: 83770 - RNA, 27 nt, Human
ggucaucugguaacucauggguuuuug

SEQ ID NO: 83771 - RNA, 27 nt, Human
aggggucagugcagcagaggacagucu

SEQ ID NO: 83772 - RNA, 23 nt, Human
gcagaaaguuuauuuaaaccacu

SEQ ID NO: 83773 - RNA, 21 nt, Human
aaccaaggagccugagcccag

SEQ ID NO: 83774 - RNA, 21 nt, Human
ucuaacaaacuucagccuggg

SEQ ID NO: 83775 - RNA, 21 nt, Human
guguuccuagaagagcuucau

SEQ ID NO: 83776 - RNA, 21 nt, Human
auucucuuagcuugugugugu

SEQ ID NO: 83777 - RNA, 26 nt, Human
ucucagacuccugggcucaagcgauc

SEQ ID NO: 83778 - RNA, 20 nt, Human
cggggacuggcccucccuug

SEQ ID NO: 83779 - RNA, 27 nt, Human
uugcuucucucaacaaccucaucugca

SEQ ID NO: 83780 - RNA, 25 nt, Human
ccaggagguggaggaaggagcaggu

SEQ ID NO: 83781 - RNA, 21 nt, Human
ugaagucucccuuuguuacgg

SEQ ID NO: 83782 - RNA, 23 nt, Human
ugcugugcccuagggccugggug

SEQ ID NO: 83783 - RNA, 24 nt, Human
caccugaggucaggaguucuagac

SEQ ID NO: 83784 - RNA, 24 nt, Human
cacuugaggucaggaguuccagac

SEQ ID NO: 83785 - RNA, 23 nt, Human
gugcucuuccaggaugcugccuc

SEQ ID NO: 83786 - RNA, 25 nt, Human
ugguggcuggcaccuguagucccag

SEQ ID NO: 83787 - RNA, 24 nt, Human
gcuugauuauucugcaaaagugau

SEQ ID NO: 83788 - RNA, 22 nt, Human
caggcuuaaacaucacagcaga

SEQ ID NO: 83789 - RNA, 22 nt, Human
gcuguuugcaaaccugccugua

SEQ ID NO: 83790 - RNA, 20 nt, Human
cucugccauuguuccaccuc

SEQ ID NO: 83791 - RNA, 23 nt, Human
ugccaacaccuacugacacucac

SEQ ID NO: 83792 - RNA, 25 nt, Human
acuggcuccgaguuccccuccuggg

SEQ ID NO: 83793 - RNA, 24 nt, Human
uagagcaaggaaaccagaaaggug

SEQ ID NO: 83794 - RNA, 27 nt, Human
ucacucccuguuuuaauucaacccagc

SEQ ID NO: 83795 - RNA, 22 nt, Human
gccucaccagccuccacacccc

SEQ ID NO: 83796 - RNA, 22 nt, Human
agccagauuuucaagcuucauu

SEQ ID NO: 83797 - RNA, 20 nt, Human
accuuuagcucccuccugcc

SEQ ID NO: 83798 - RNA, 21 nt, Human
uagaucuuucuugccaaggaa

SEQ ID NO: 83799 - RNA, 28 nt, Human
gcaguagucucugugcuuugacucaccu

SEQ ID NO: 83800 - RNA, 21 nt, Human
gauacagcugcuuagaaagga

SEQ ID NO: 83801 - RNA, 26 nt, Human
gcuaugaaagaaaauaacaaaugaaa

SEQ ID NO: 83802 - RNA, 21 nt, Human
ccuucuggccucuccugcugc

SEQ ID NO: 83803 - RNA, 26 nt, Human
aggaagggaaguggaacuuuccaugc

SEQ ID NO: 83804 - RNA, 19 nt, Human
gucaagaauauaauaugug

SEQ ID NO: 83805 - RNA, 22 nt, Human
acccaacucuccuggacugccu

SEQ ID NO: 83806 - RNA, 23 nt, Human
uuuuucaauuaugacagccuguu

SEQ ID NO: 83807 - RNA, 23 nt, Human
guuccugagggcuggagaacacu

SEQ ID NO: 83808 - RNA, 27 nt, Human
cugggcugaggcacagacucauuuguc

SEQ ID NO: 83809 - RNA, 21 nt, Human
uuccacugaggacauucagcc

SEQ ID NO: 83810 - RNA, 17 nt, Human
aaucucuccauucccgu

SEQ ID NO: 83811 - RNA, 27 nt, Human
ugcuaauagaggaaucauagccauuua

SEQ ID NO: 83812 - RNA, 26 nt, Human
gcucugggccccuccucccugcugcc

SEQ ID NO: 83813 - RNA, 19 nt, Human
gacuuugacaggggugccu

SEQ ID NO: 83814 - RNA, 20 nt, Human
gaguuuguuaccuaccuuac

SEQ ID NO: 83815 - RNA, 21 nt, Human
cccucgcucucccuccgcgcc

SEQ ID NO: 83816 - RNA, 20 nt, Human
acuuaacgggggaagauggu

SEQ ID NO: 83817 - RNA, 21 nt, Human
ggugcacuacaccccaugccu

SEQ ID NO: 83818 - RNA, 27 nt, Human
caggaggucgaggcugcagugugcugu

SEQ ID NO: 83819 - RNA, 23 nt, Human
gcuggagugagguggaaggaugu

SEQ ID NO: 83820 - RNA, 20 nt, Human
uugagcccccaggggugggg

SEQ ID NO: 83821 - RNA, 20 nt, Human
gggcaaccccuggauaugaa

SEQ ID NO: 83822 - RNA, 22 nt, Human
gggauuacaggugcaggccacc

SEQ ID NO: 83823 - RNA, 29 nt, Human
gauccuaaucccuuccucucccauucacc

SEQ ID NO: 83824 - RNA, 22 nt, Human
agcgauggucagaguguguaga

SEQ ID NO: 83825 - RNA, 29 nt, Human
uuccucaucugggucucccaggacacauc

SEQ ID NO: 83826 - RNA, 23 nt, Human
gagcuggggguugaauuucucca

SEQ ID NO: 83827 - RNA, 17 nt, Human
gccccugcugugcugcu

SEQ ID NO: 83828 - RNA, 21 nt, Human
uucaucuuuccucccuccucc

SEQ ID NO: 83829 - RNA, 21 nt, Human
aaguuggcgggggcuuggcug

SEQ ID NO: 83830 - RNA, 19 nt, Human
agggcaaagucaaugagua

SEQ ID NO: 83831 - RNA, 23 nt, Human
guucaugccauucuccugccuca

SEQ ID NO: 83832 - RNA, 24 nt, Human
ugauagcuguuucuggguauuuaa

SEQ ID NO: 83833 - RNA, 21 nt, Human
gggaugcaaagguugcaguga

SEQ ID NO: 83834 - RNA, 22 nt, Human
ggggugagaggcugucaucugg

SEQ ID NO: 83835 - RNA, 18 nt, Human
acuuuugcuuucuucucc

SEQ ID NO: 83836 - RNA, 26 nt, Human
uguuuuuaaaauaagcuaguuuucug

SEQ ID NO: 83837 - RNA, 21 nt, Human
gaggccacugugucucagggg

SEQ ID NO: 83838 - RNA, 26 nt, Human
uguuaauucuuuucagaaucauugaa

SEQ ID NO: 83839 - RNA, 21 nt, Human
ccucugcugaccccuggagca

SEQ ID NO: 83840 - RNA, 27 nt, Human
gccucuggaccugcuacagaucaaaga

SEQ ID NO: 83841 - RNA, 23 nt, Human
uuaaaccuuuucucaacuugugc

SEQ ID NO: 83842 - RNA, 23 nt, Human
ccuucuggaggacacacagucuc

SEQ ID NO: 83843 - RNA, 22 nt, Human
augauccugaacuugccgagga

SEQ ID NO: 83844 - RNA, 16 nt, Human
ucaacccgagugcagu

SEQ ID NO: 83845 - RNA, 24 nt, Human
cucacccaggcugcagugccaugc

SEQ ID NO: 83846 - RNA, 21 nt, Human
cauggggguaggagcaguuga

SEQ ID NO: 83847 - RNA, 24 nt, Human
agcuuagcuucucuugccaccuca

SEQ ID NO: 83848 - RNA, 22 nt, Human
cuuugugcuucuauugcuuuuu

SEQ ID NO: 83849 - RNA, 21 nt, Human
ggcgcaugccugcaaucccag

SEQ ID NO: 83850 - RNA, 27 nt, Human
ucauguuggccaaacauggugcaccga

SEQ ID NO: 83851 - RNA, 21 nt, Human
gcagcguuuggaaagcagguu

SEQ ID NO: 83852 - RNA, 22 nt, Human
ggaggccgggguuggaggauca

SEQ ID NO: 83853 - RNA, 24 nt, Human
aacugcagcauuccagucugggcu

SEQ ID NO: 83854 - RNA, 22 nt, Human
ugcagcucucugcgggaaccug

SEQ ID NO: 83855 - RNA, 26 nt, Human
cccagcccuggcucugcaaugggcac

SEQ ID NO: 83856 - RNA, 22 nt, Human
ccucauccucuccacagcugcc

SEQ ID NO: 83857 - RNA, 21 nt, Human
cggacggcggaggcggcggga

SEQ ID NO: 83858 - RNA, 26 nt, Human
gggcccaggcuggugcagccuacaug

SEQ ID NO: 83859 - RNA, 22 nt, Human
agccuuugauuuccuggacugg

SEQ ID NO: 83860 - RNA, 26 nt, Human
augcaagagaccucagucccccggaa

SEQ ID NO: 83861 - RNA, 22 nt, Human
gugacucuuguguuugcugcug

SEQ ID NO: 83862 - RNA, 24 nt, Human
caccguggguuccagacuugggau

SEQ ID NO: 83863 - RNA, 27 nt, Human
gugaagaucuacugcucccucucucca

SEQ ID NO: 83864 - RNA, 22 nt, Human
uuuuguaaaugaaacaguugua

SEQ ID NO: 83865 - RNA, 20 nt, Human
ggggugagcaagggcugucu

SEQ ID NO: 83866 - RNA, 27 nt, Human
aggcucugcaagagcucccuggcaaua

SEQ ID NO: 83867 - RNA, 25 nt, Human
uggggacuggaggggaacguggagc

SEQ ID NO: 83868 - RNA, 25 nt, Human
auucuuuggguccuuccaucccacu

SEQ ID NO: 83869 - RNA, 32 nt, Human
uagcacugaauuccuucuucacuguuguuugu

SEQ ID NO: 83870 - RNA, 23 nt, Human
aaacagaucucuacagacuugca

SEQ ID NO: 83871 - RNA, 25 nt, Human
ccuggccuggggccacaccugcugc

SEQ ID NO: 83872 - RNA, 20 nt, Human
agucacccuccucuggccca

SEQ ID NO: 83873 - RNA, 32 nt, Human
cccguggauccugguccuaggcuggacacagg

SEQ ID NO: 83874 - RNA, 27 nt, Human
cgcugccugcucccgccacccuaggag

SEQ ID NO: 83875 - RNA, 22 nt, Human
gagguagggaagaaugagcuga

SEQ ID NO: 83876 - RNA, 20 nt, Human
ucaccugacgucaguaguuu

SEQ ID NO: 83877 - RNA, 23 nt, Human
gccagaaaucccagcgcaccugg

SEQ ID NO: 83878 - RNA, 25 nt, Human
ucuucauucuuccucauucauucuu

SEQ ID NO: 83879 - RNA, 20 nt, Human
cuguauuuagcuuucuaauc

SEQ ID NO: 83880 - RNA, 23 nt, Human
ugggacuucucagacgucaggag

SEQ ID NO: 83881 - RNA, 20 nt, Human
aacugaucaaaaauaaacua

SEQ ID NO: 83882 - RNA, 27 nt, Human
augaaaaugccauuucuucguugccaa

SEQ ID NO: 83883 - RNA, 29 nt, Human
ccagccucuguggcccugugaccugcagg

SEQ ID NO: 83884 - RNA, 21 nt, Human
caaggucagggguggggaaga

SEQ ID NO: 83885 - RNA, 29 nt, Human
ugcugccacaucugggcauacagugucug

SEQ ID NO: 83886 - RNA, 21 nt, Human
gcucacuggggucuguguggu

SEQ ID NO: 83887 - RNA, 20 nt, Human
acccacccucucccucuccc

SEQ ID NO: 83888 - RNA, 20 nt, Human
guuuuggacugaccuggggg

SEQ ID NO: 83889 - RNA, 21 nt, Human
uugucucucugcugugucgcc

SEQ ID NO: 83890 - RNA, 24 nt, Human
uucuuuacuaauguuauugaaacc

SEQ ID NO: 83891 - RNA, 26 nt, Human
gggccugggcaaugggaaggagccag

SEQ ID NO: 83892 - RNA, 25 nt, Human
gccagucucagagaccagcacucag

SEQ ID NO: 83893 - RNA, 24 nt, Human
cauuucuuaagacuuucugcugca

SEQ ID NO: 83894 - RNA, 25 nt, Human
uuugggccugcuccagaccugaucc

SEQ ID NO: 83895 - RNA, 22 nt, Human
aguauuuuugacauuuuucuuu

SEQ ID NO: 83896 - RNA, 22 nt, Human
cugccuccuggguucaagcaau

SEQ ID NO: 83897 - RNA, 25 nt, Human
ggcagccagcucugucuccagggag

SEQ ID NO: 83898 - RNA, 24 nt, Human
gcccaggcuggagugcaaugccgu

SEQ ID NO: 83899 - RNA, 23 nt, Human
guuuaggguagaucuuguuuucc

SEQ ID NO: 83900 - RNA, 23 nt, Human
gcuagaaaacauucuauuguaua

SEQ ID NO: 83901 - RNA, 27 nt, Human
caggccuguggucaucaaugccccagu

SEQ ID NO: 83902 - RNA, 27 nt, Human
cccuccagagcccugaguuucuuggcu

SEQ ID NO: 83903 - RNA, 23 nt, Human
gucaacauggacacgaacaaaac

SEQ ID NO: 83904 - RNA, 23 nt, Human
ccuccacugaugcaggagcugcc

SEQ ID NO: 83905 - RNA, 14 nt, Human
acagcacuugugaa

SEQ ID NO: 83906 - RNA, 24 nt, Human
ccuuucucucccaggugcuggacc

SEQ ID NO: 83907 - RNA, 21 nt, Human
acgaagcagagaucugaagac

SEQ ID NO: 83908 - RNA, 24 nt, Human
uagaaauugauuuugcggagcuca

SEQ ID NO: 83909 - RNA, 27 nt, Human
cucagcuuuucauuugcagaggacaug

SEQ ID NO: 83910 - RNA, 27 nt, Human
uuuuugggguuuggaaaaacaugcauu

SEQ ID NO: 83911 - RNA, 23 nt, Human
ccccaaaucagacauaccucugu

SEQ ID NO: 83912 - RNA, 22 nt, Human
uguugucuauuuuuucugagga

SEQ ID NO: 83913 - RNA, 21 nt, Human
caccuugccuugcucuugcca

SEQ ID NO: 83914 - RNA, 13 nt, Human
acaugaagcacaa

SEQ ID NO: 83915 - RNA, 26 nt, Human
gguccuguauccuggaguauuauguc

SEQ ID NO: 83916 - RNA, 27 nt, Human
uccuugagugaggcaugccccauucug

SEQ ID NO: 83917 - RNA, 24 nt, Human
acuucucuccucagacuucaaggg

SEQ ID NO: 83918 - RNA, 20 nt, Human
gguggggguugcuguugauu

SEQ ID NO: 83919 - RNA, 23 nt, Human
gggagguguggacuggaugagga

SEQ ID NO: 83920 - RNA, 22 nt, Human
ggacugggagcaguuccaagac

SEQ ID NO: 83921 - RNA, 21 nt, Human
aguucacugcagccucaaccu

SEQ ID NO: 83922 - RNA, 22 nt, Human
cggagucuggcucugucaccca

SEQ ID NO: 83923 - RNA, 22 nt, Human
cagagucuggcucugucgccca

SEQ ID NO: 83924 - RNA, 22 nt, Human
ccaguuaccaccuccugccuca

SEQ ID NO: 83925 - RNA, 20 nt, Human
cuccucuuuuguuuguguuu

SEQ ID NO: 83926 - RNA, 21 nt, Human
cacaagucguuguaccucagu

SEQ ID NO: 83927 - RNA, 29 nt, Human
ggggaagauggagcaaaccuagcccccaa

SEQ ID NO: 83928 - RNA, 22 nt, Human
uugccuaggcuggucuggagcu

SEQ ID NO: 83929 - RNA, 24 nt, Human
aggcgcgagguugcggcgcgcagc

SEQ ID NO: 83930 - RNA, 20 nt, Human
uggcccagucccagguugga

SEQ ID NO: 83931 - RNA, 29 nt, Human
gagauuuugaacauuaaguuaguccacaa

SEQ ID NO: 83932 - RNA, 17 nt, Human
cuguuauuucugugcua

SEQ ID NO: 83933 - RNA, 27 nt, Human
ugcuucuugaguggguggaguggugcu

SEQ ID NO: 83934 - RNA, 21 nt, Human
ccuaguacugcuguacuggcc

SEQ ID NO: 83935 - RNA, 24 nt, Human
cuggucuugcauaacuucaguaau

SEQ ID NO: 83936 - RNA, 23 nt, Human
ugguuuuuccuuucucucucuua

SEQ ID NO: 83937 - RNA, 25 nt, Human
uuucugggucgugcuccugccccac

SEQ ID NO: 83938 - RNA, 24 nt, Human
ugccccagccaacacccuucucuc

SEQ ID NO: 83939 - RNA, 25 nt, Human
aagaacagccaccaugcagcucuuc

SEQ ID NO: 83940 - RNA, 20 nt, Human
ccgcuugccccuuguucucc

SEQ ID NO: 83941 - RNA, 28 nt, Human
cuggggcccagcacaacugcuguuuagu

SEQ ID NO: 83942 - RNA, 18 nt, Human
ggcacauuaccauucaua

SEQ ID NO: 83943 - RNA, 19 nt, Human
agcauggacaacugugaua

SEQ ID NO: 83944 - RNA, 27 nt, Human
gggaggcggagacgcggagcgggccuu

SEQ ID NO: 83945 - RNA, 20 nt, Human
ucucaaugccuuuucacuua

SEQ ID NO: 83946 - RNA, 25 nt, Human
uggcggccgugggcuccuggggagc

SEQ ID NO: 83947 - RNA, 19 nt, Human
cggggaggaggggcuggaa

SEQ ID NO: 83948 - RNA, 26 nt, Human
ucuggcuucuuucacuuugcauaauu

SEQ ID NO: 83949 - RNA, 24 nt, Human
gauuccccuuucugcaccucggaa

SEQ ID NO: 83950 - RNA, 23 nt, Human
ggcgcuacaaaauaaagcuguuc

SEQ ID NO: 83951 - RNA, 27 nt, Human
ggacaucucuuugaauuuucuguguuu

SEQ ID NO: 83952 - RNA, 22 nt, Human
gugaagcagcagccaccaggga

SEQ ID NO: 83953 - RNA, 20 nt, Human
aucuugagcaaguuccuucu

SEQ ID NO: 83954 - RNA, 24 nt, Human
aggguucccugagcuauaugcaca

SEQ ID NO: 83955 - RNA, 27 nt, Human
uuagaaaacaaacuaauucugauugug

SEQ ID NO: 83956 - RNA, 21 nt, Human
uaaguuccccuguucaaggca

SEQ ID NO: 83957 - RNA, 24 nt, Human
cccuuccuccuccuuugccuagga

SEQ ID NO: 83958 - RNA, 25 nt, Human
uucauuuuauucucuucuaguuuug

SEQ ID NO: 83959 - RNA, 24 nt, Human
uggaaucccagaccgagucugcuu

SEQ ID NO: 83960 - RNA, 21 nt, Human
auucccuuucuaccauugauu

SEQ ID NO: 83961 - RNA, 20 nt, Human
ugaacauuacuacucagccu

SEQ ID NO: 83962 - RNA, 26 nt, Human
uagagccucuguaaacuucuccugcc

SEQ ID NO: 83963 - RNA, 27 nt, Human
ggcuggagcgaccccuuguucuuuggu

SEQ ID NO: 83964 - RNA, 26 nt, Human
cgaccuucacgucucagccucaggga

SEQ ID NO: 83965 - RNA, 21 nt, Human
ucucuacugugccuucauccc

SEQ ID NO: 83966 - RNA, 23 nt, Human
ucuuucugcaaccuguacuuaca

SEQ ID NO: 83967 - RNA, 27 nt, Human
ugcuuauauccaggaccaaggaggcaa

SEQ ID NO: 83968 - RNA, 27 nt, Human
ggagagggagcaagaggaguuuuuagu

SEQ ID NO: 83969 - RNA, 20 nt, Human
uuacaguguaaauuuuuccu

SEQ ID NO: 83970 - RNA, 27 nt, Human
ugggaccccagccucucacucucaguu

SEQ ID NO: 83971 - RNA, 28 nt, Human
gggagggaccgugagggagccccagaau

SEQ ID NO: 83972 - RNA, 27 nt, Human
ggagcugggcagguagagcccaagcuc

SEQ ID NO: 83973 - RNA, 22 nt, Human
gauguauuuuagauaagcuauu

SEQ ID NO: 83974 - RNA, 24 nt, Human
gccucaagagaauagcugguuucc

SEQ ID NO: 83975 - RNA, 22 nt, Human
acuguuuucauuuggagcuaga

SEQ ID NO: 83976 - RNA, 25 nt, Human
ccagaucucuguaauuuuauguaga

SEQ ID NO: 83977 - RNA, 21 nt, Human
gguaggcagagguugcaguga

SEQ ID NO: 83978 - RNA, 27 nt, Human
cucuaggguaagccagaaggcaagauc

SEQ ID NO: 83979 - RNA, 22 nt, Human
cccaccuggcccuuucuccagc

SEQ ID NO: 83980 - RNA, 24 nt, Human
gaaagcugcaguuacuauagguug

SEQ ID NO: 83981 - RNA, 21 nt, Human
uugccaucccaucaugaagga

SEQ ID NO: 83982 - RNA, 21 nt, Human
acugccgugcauuagcacaga

SEQ ID NO: 83983 - RNA, 21 nt, Human
gagagcaaucaguguucucag

SEQ ID NO: 83984 - RNA, 20 nt, Human
gccuggugccuuccauggag

SEQ ID NO: 83985 - RNA, 31 nt, Human
ggggugauggagaagaaacaggcugugcugu

SEQ ID NO: 83986 - RNA, 30 nt, Human
cucugcagcaggaagccagcugucauauuc

SEQ ID NO: 83987 - RNA, 22 nt, Human
ugcuauccuccaaagccauugu

SEQ ID NO: 83988 - RNA, 23 nt, Human
ccagcugcgaggaccucuguggu

SEQ ID NO: 83989 - RNA, 23 nt, Human
cccacaguggcugccugccuccg

SEQ ID NO: 83990 - RNA, 22 nt, Human
uuaccuguaauccuagcacuuu

SEQ ID NO: 83991 - RNA, 27 nt, Human
guggcucaggcugggagggacuucagu

SEQ ID NO: 83992 - RNA, 22 nt, Human
gccguucgauucccacuuccuu

SEQ ID NO: 83993 - RNA, 25 nt, Human
ggccucggggcuguccccacgcugu

SEQ ID NO: 83994 - RNA, 30 nt, Human
uccuucuucagcaggaagggugggaaggga

SEQ ID NO: 83995 - RNA, 21 nt, Human
ccuccugcagacacuuggacu

SEQ ID NO: 83996 - RNA, 20 nt, Human
auaaaaagaaacuucugcuu

SEQ ID NO: 83997 - RNA, 26 nt, Human
gaucuugauggaggcuuggugagaca

SEQ ID NO: 83998 - RNA, 28 nt, Human
accgcgccuggccgaugguacuauuuag

SEQ ID NO: 83999 - RNA, 22 nt, Human
ucaauccuucagucccagccag

SEQ ID NO: 84000 - RNA, 23 nt, Human
uaggcuaggugcaguggcuuguu

SEQ ID NO: 84001 - RNA, 22 nt, Human
ucucagaaaagucugagaagaa

SEQ ID NO: 84002 - RNA, 25 nt, Human
agcacggcucuguccccagccuggg

SEQ ID NO: 84003 - RNA, 16 nt, Human
uuuuucuccuuagaga

SEQ ID NO: 84004 - RNA, 22 nt, Human
uacaguguacauguacauagua

SEQ ID NO: 84005 - RNA, 19 nt, Human
gcugggaaggugccuccaa

SEQ ID NO: 84006 - RNA, 31 nt, Human
uauuguagauauauacaagaaaagagcggua

SEQ ID NO: 84007 - RNA, 22 nt, Human
uaucuguggccuuguucuucau

SEQ ID NO: 84008 - RNA, 31 nt, Human
ggcucccaggguggaggaaggugacugugug

SEQ ID NO: 84009 - RNA, 22 nt, Human
gcacacugugugugaugaaucu

SEQ ID NO: 84010 - RNA, 20 nt, Human
aggaaaucaaccacagugaa

SEQ ID NO: 84011 - RNA, 21 nt, Human
ucucuuuaucuuucucucuca

SEQ ID NO: 84012 - RNA, 20 nt, Human
gcccacccucuccuggugcu

SEQ ID NO: 84013 - RNA, 25 nt, Human
ccuauuuuucccuguucccuggugc

SEQ ID NO: 84014 - RNA, 22 nt, Human
gcaaaggcugacgaagagggga

SEQ ID NO: 84015 - RNA, 22 nt, Human
agcuucaaauuaaaacagcugc

SEQ ID NO: 84016 - RNA, 22 nt, Human
cucaccaguucugcugccucag

SEQ ID NO: 84017 - RNA, 19 nt, Human
uuucuaacgggaaugggug

SEQ ID NO: 84018 - RNA, 27 nt, Human
ggcauuuucuuuauugcauuucucuau

SEQ ID NO: 84019 - RNA, 23 nt, Human
cuuuguugauuuagaugaugacu

SEQ ID NO: 84020 - RNA, 21 nt, Human
aucacucuucaugcuucccug

SEQ ID NO: 84021 - RNA, 22 nt, Human
uaucuccuuuggcugcuguaac

SEQ ID NO: 84022 - RNA, 24 nt, Human
uauguauguaacaaaccagcacuu

SEQ ID NO: 84023 - RNA, 27 nt, Human
uuccaauacucguuuugccucuauuuu

SEQ ID NO: 84024 - RNA, 26 nt, Human
uguuuguugcuuuuuaucucgcugcc

SEQ ID NO: 84025 - RNA, 22 nt, Human
aagaccaaggagauaagggugg

SEQ ID NO: 84026 - RNA, 22 nt, Human
cccgaguagcuggaauuauagg

SEQ ID NO: 84027 - RNA, 21 nt, Human
ccugcucucccuccccacacc

SEQ ID NO: 84028 - RNA, 18 nt, Human
auugagggaaugccuugg

SEQ ID NO: 84029 - RNA, 22 nt, Human
ccaacaugaugaaacccuaucu

SEQ ID NO: 84030 - RNA, 22 nt, Human
aguggcaucaucucagcucacu

SEQ ID NO: 84031 - RNA, 23 nt, Human
ucccagaaugccuccugcaggga

SEQ ID NO: 84032 - RNA, 26 nt, Human
uuugggccuggcggcucuccguuccc

SEQ ID NO: 84033 - RNA, 28 nt, Human
gugagcacauaagcagaggcugcaggaa

SEQ ID NO: 84034 - RNA, 21 nt, Human
gcuggucucggacuccugggc

SEQ ID NO: 84035 - RNA, 21 nt, Human
gauuguaccacuguauuccag

SEQ ID NO: 84036 - RNA, 22 nt, Human
acuccagccuggguaacagagu

SEQ ID NO: 84037 - RNA, 26 nt, Human
aggcaugugagaaaaucagccuagca

SEQ ID NO: 84038 - RNA, 23 nt, Human
ccugcugcugaccugaucaccuc

SEQ ID NO: 84039 - RNA, 17 nt, Human
aguuccugccuuuuccg

SEQ ID NO: 84040 - RNA, 22 nt, Human
ccgccuccuuucccugugucau

SEQ ID NO: 84041 - RNA, 21 nt, Human
ccaauuuuguugcaucauguu

SEQ ID NO: 84042 - RNA, 29 nt, Human
ccugugugcccuguuccuugcccaccuca

SEQ ID NO: 84043 - RNA, 19 nt, Human
uuguaaccucagcucuggg

SEQ ID NO: 84044 - RNA, 16 nt, Human
uccuugcucuauuucc

SEQ ID NO: 84045 - RNA, 22 nt, Human
agcauuucuagaaaaaaggaga

SEQ ID NO: 84046 - RNA, 20 nt, Human
cugccaguggccugggggug

SEQ ID NO: 84047 - RNA, 25 nt, Human
cagcauggcuuuuuacgucuguaaa

SEQ ID NO: 84048 - RNA, 23 nt, Human
ucacucaucaccaagucauguug

SEQ ID NO: 84049 - RNA, 19 nt, Human
ucugucugccagggucucc

SEQ ID NO: 84050 - RNA, 27 nt, Human
ugaguggguugagggaggcaguaauau

SEQ ID NO: 84051 - RNA, 24 nt, Human
ucagaccugcauugaacaguccug

SEQ ID NO: 84052 - RNA, 22 nt, Human
auucugggacacuugagccaga

SEQ ID NO: 84053 - RNA, 22 nt, Human
auugcuugaagucaggaguuca

SEQ ID NO: 84054 - RNA, 18 nt, Human
acgcccguccugccugug

SEQ ID NO: 84055 - RNA, 19 nt, Human
ucccccacuguacccacag

SEQ ID NO: 84056 - RNA, 27 nt, Human
gccaagcugugugagagggccaccgca

SEQ ID NO: 84057 - RNA, 21 nt, Human
uacuccauuacugugauuucu

SEQ ID NO: 84058 - RNA, 22 nt, Human
caguucuuugaaaaaguuccau

SEQ ID NO: 84059 - RNA, 20 nt, Human
cacuccaucagccaggcugg

SEQ ID NO: 84060 - RNA, 23 nt, Human
cacuccaggcuggacgacagagc

SEQ ID NO: 84061 - RNA, 21 nt, Human
gaguagggacucagggccaug

SEQ ID NO: 84062 - RNA, 27 nt, Human
cuggccccuuugggcccugcauguagu

SEQ ID NO: 84063 - RNA, 22 nt, Human
uagagauggcagagagugaggu

SEQ ID NO: 84064 - RNA, 27 nt, Human
ucagaaauuugguggguuuuuuguugu

SEQ ID NO: 84065 - RNA, 22 nt, Human
cccaccaccugguuccggcucu

SEQ ID NO: 84066 - RNA, 24 nt, Human
ugucugugucuuagaccugcaaac

SEQ ID NO: 84067 - RNA, 22 nt, Human
gcagcugcucuguggaggaccu

SEQ ID NO: 84068 - RNA, 23 nt, Human
uguagcccaggcuggagugcaau

SEQ ID NO: 84069 - RNA, 22 nt, Human
ccaagcccgggaacugagagag

SEQ ID NO: 84070 - RNA, 21 nt, Human
augagaggaaaaaggccggca

SEQ ID NO: 84071 - RNA, 24 nt, Human
uugaggugggagcggggcugggag

SEQ ID NO: 84072 - RNA, 23 nt, Human
acgcgagggcuggcugugaugaa

SEQ ID NO: 84073 - RNA, 22 nt, Human
uugcccaggcuggucuccaaca

SEQ ID NO: 84074 - RNA, 23 nt, Human
ucaugcuguuuaaacuguugugg

SEQ ID NO: 84075 - RNA, 27 nt, Human
uucagucaaguuccgucuccucuccag

SEQ ID NO: 84076 - RNA, 25 nt, Human
ggaauuccggcuauaggcagaggag

SEQ ID NO: 84077 - RNA, 22 nt, Human
ugaggggaauggucaguaccag

SEQ ID NO: 84078 - RNA, 27 nt, Human
ccuugccccaccccuugcuuccagaaa

SEQ ID NO: 84079 - RNA, 25 nt, Human
gauccaggcugucaugugauuuaug

SEQ ID NO: 84080 - RNA, 22 nt, Human
ggccucgggagggcccagguag

SEQ ID NO: 84081 - RNA, 21 nt, Human
guauguuuaauuauguuaccu

SEQ ID NO: 84082 - RNA, 21 nt, Human
ugcaaagaggaaauucacagc

SEQ ID NO: 84083 - RNA, 19 nt, Human
accagugaaucuuugucag

SEQ ID NO: 84084 - RNA, 24 nt, Human
ggcccaaaauggucaggacuuuaa

SEQ ID NO: 84085 - RNA, 23 nt, Human
ccagaagcucaaggcugcaguga

SEQ ID NO: 84086 - RNA, 17 nt, Human
ccccacaacaggcccug

SEQ ID NO: 84087 - RNA, 22 nt, Human
ggccucggaggcuccucccucu

SEQ ID NO: 84088 - RNA, 26 nt, Human
ucacucugucucccaggcuggagugc

SEQ ID NO: 84089 - RNA, 21 nt, Human
augagagaaggaggggagcag

SEQ ID NO: 84090 - RNA, 27 nt, Human
ugaaagcggccacggugccuccagaug

SEQ ID NO: 84091 - RNA, 22 nt, Human
cuaagcuggagugcaguggcau

SEQ ID NO: 84092 - RNA, 22 nt, Human
ugucgcucaggcuggagugcca

SEQ ID NO: 84093 - RNA, 21 nt, Human
ugaugauuuuuauuuuuguug

SEQ ID NO: 84094 - RNA, 26 nt, Human
accccuuccuuuagcccacagcccag

SEQ ID NO: 84095 - RNA, 19 nt, Human
auugguuaccucaguauua

SEQ ID NO: 84096 - RNA, 22 nt, Human
gugagcagguugaccucagguc

SEQ ID NO: 84097 - RNA, 27 nt, Human
cugccugcacucuaagcgcucucccca

SEQ ID NO: 84098 - RNA, 22 nt, Human
uucagcugauugccggcagcuu

SEQ ID NO: 84099 - RNA, 20 nt, Human
cauccaggcuggagugcggu

SEQ ID NO: 84100 - RNA, 20 nt, Human
cguccaggcuggagugcagu

SEQ ID NO: 84101 - RNA, 23 nt, Human
uugauguggcccuggcugccggc

SEQ ID NO: 84102 - RNA, 23 nt, Human
uagcucugcaagguguuuaugcc

SEQ ID NO: 84103 - RNA, 21 nt, Human
agaaaacuagagcuggaagga

SEQ ID NO: 84104 - RNA, 27 nt, Human
uucuaaaacuuuuaauuuuucugcuuc

SEQ ID NO: 84105 - RNA, 23 nt, Human
aucagaggaguaaauaauuggaa

SEQ ID NO: 84106 - RNA, 23 nt, Human
cucgcucagugccauagccuuac

SEQ ID NO: 84107 - RNA, 21 nt, Human
cacuccucucaacugccucag

SEQ ID NO: 84108 - RNA, 22 nt, Human
agaauggggucuccacagccug

SEQ ID NO: 84109 - RNA, 27 nt, Human
aggauuuggaucucacaagacaccuua

SEQ ID NO: 84110 - RNA, 24 nt, Human
gggaccaagucacuugcuuccuua

SEQ ID NO: 84111 - RNA, 22 nt, Human
gucacccgagcuggagugcagu

SEQ ID NO: 84112 - RNA, 23 nt, Human
ugggagccagcggcagggccggc

SEQ ID NO: 84113 - RNA, 21 nt, Human
gagguaccuuuucaaagugca

SEQ ID NO: 84114 - RNA, 23 nt, Human
ccccaaaaccaaacacacuccug

SEQ ID NO: 84115 - RNA, 18 nt, Human
ccccuccccuuuuguccu

SEQ ID NO: 84116 - RNA, 21 nt, Human
auggcaucuuucacugcauuc

SEQ ID NO: 84117 - RNA, 21 nt, Human
cccaaccaacaggacugacug

SEQ ID NO: 84118 - RNA, 26 nt, Human
ccagcugccauuugccaaacucugca

SEQ ID NO: 84119 - RNA, 19 nt, Human
uauguggcaaaauguuaca

SEQ ID NO: 84120 - RNA, 28 nt, Human
uugccauucucuggguuggcuguggcau

SEQ ID NO: 84121 - RNA, 22 nt, Human
ucccaucccguaagaccaccuu

SEQ ID NO: 84122 - RNA, 23 nt, Human
cuggacauugcugaucuuuucca

SEQ ID NO: 84123 - RNA, 20 nt, Human
aucuucccuugggcuuuuca

SEQ ID NO: 84124 - RNA, 21 nt, Human
augcccagaagacaacuggac

SEQ ID NO: 84125 - RNA, 23 nt, Human
uggucaggaaaacucuggcugga

SEQ ID NO: 84126 - RNA, 19 nt, Human
cccauaaacaaauguaaug

SEQ ID NO: 84127 - RNA, 21 nt, Human
ugcaaccuccaccuccggguu

SEQ ID NO: 84128 - RNA, 21 nt, Human
auccagucugaagauguuugu

SEQ ID NO: 84129 - RNA, 28 nt, Human
ccaggcaaccaggaaacugcuacuugug

SEQ ID NO: 84130 - RNA, 24 nt, Human
ggcacuuuucacacucugucuuaa

SEQ ID NO: 84131 - RNA, 25 nt, Human
accaguggcccagguaauuuuuugu

SEQ ID NO: 84132 - RNA, 22 nt, Human
uugcccagcccugcuggcaauc

SEQ ID NO: 84133 - RNA, 22 nt, Human
ccugcagccccucaugccugga

SEQ ID NO: 84134 - RNA, 27 nt, Human
ccagcacuccaaaaucucugugugucc

SEQ ID NO: 84135 - RNA, 19 nt, Human
auauacuugguucucucca

SEQ ID NO: 84136 - RNA, 19 nt, Human
gagcacaaccuuguccaca

SEQ ID NO: 84137 - RNA, 26 nt, Human
ugggguggagucccagagcugcacag

SEQ ID NO: 84138 - RNA, 22 nt, Human
ucuuagaguaggguuaagguuc

SEQ ID NO: 84139 - RNA, 21 nt, Human
guuagccuggugacaggcaga

SEQ ID NO: 84140 - RNA, 27 nt, Human
uugcuaccuuugcugccagaucuuuuc

SEQ ID NO: 84141 - RNA, 17 nt, Human
cagucucuucugguuua

SEQ ID NO: 84142 - RNA, 20 nt, Human
agacauuacauuuuacuuua

SEQ ID NO: 84143 - RNA, 26 nt, Human
cuccuggcagcggcuuuuguggaaga

SEQ ID NO: 84144 - RNA, 16 nt, Human
cuucccuuccuaauua

SEQ ID NO: 84145 - RNA, 22 nt, Human
accccugaaccuccagccaggg

SEQ ID NO: 84146 - RNA, 23 nt, Human
cagggcugcaaagcaaggucuug

SEQ ID NO: 84147 - RNA, 22 nt, Human
uucaacuacuuguucuacccag

SEQ ID NO: 84148 - RNA, 22 nt, Human
aggcuggagugcggugguggaa

SEQ ID NO: 84149 - RNA, 27 nt, Human
uaggggcgccgcaaaccacacuggacu

SEQ ID NO: 84150 - RNA, 27 nt, Human
ccucugcuguccaaggcuggcuagcug

SEQ ID NO: 84151 - RNA, 27 nt, Human
gcagccugcgcgggaggccacagcccg

SEQ ID NO: 84152 - RNA, 24 nt, Human
gacagcuucgguuucuaacuugga

SEQ ID NO: 84153 - RNA, 22 nt, Human
acgcugcgcuccaggagccaga

SEQ ID NO: 84154 - RNA, 23 nt, Human
ccccgggcaucuuuggggaggug

SEQ ID NO: 84155 - RNA, 19 nt, Human
cagccucgccugcugccuc

SEQ ID NO: 84156 - RNA, 25 nt, Human
gcccaggcugaagugcaguggggcg

SEQ ID NO: 84157 - RNA, 22 nt, Human
gucgcccaugcuggagugcagu

SEQ ID NO: 84158 - RNA, 22 nt, Human
gucgcccaggcuggagggcagu

SEQ ID NO: 84159 - RNA, 22 nt, Human
gucgccuagucuggagaacuag

SEQ ID NO: 84160 - RNA, 27 nt, Human
cacaggagucuucagacccagagaagg

SEQ ID NO: 84161 - RNA, 23 nt, Human
gcaaaacuuaccuucuuacucua

SEQ ID NO: 84162 - RNA, 26 nt, Human
aaccaaaaaagcugacaacugagagu

SEQ ID NO: 84163 - RNA, 23 nt, Human
agccucgguggcccagcuggggc

SEQ ID NO: 84164 - RNA, 22 nt, Human
agauccuagucagacagagccc

SEQ ID NO: 84165 - RNA, 20 nt, Human
uaaaacaauguauuugacua

SEQ ID NO: 84166 - RNA, 22 nt, Human
cugaggcaggagaauggcguga

SEQ ID NO: 84167 - RNA, 22 nt, Human
aacugaagaucagagaaguuaa

SEQ ID NO: 84168 - RNA, 21 nt, Human
guggccucuggacacuguggu

SEQ ID NO: 84169 - RNA, 24 nt, Human
cagggggaggagagggaaccccag

SEQ ID NO: 84170 - RNA, 22 nt, Human
aucagccugggcaauauaguga

SEQ ID NO: 84171 - RNA, 31 nt, Human
aucuggacacaaaaauaagauaaauguaugg

SEQ ID NO: 84172 - RNA, 24 nt, Human
acuuccccaggaguguggaggggg

SEQ ID NO: 84173 - RNA, 23 nt, Human
auccugagcugugguggcuucag

SEQ ID NO: 84174 - RNA, 20 nt, Human
gaggcagcauugcacaguga

SEQ ID NO: 84175 - RNA, 23 nt, Human
ugcugucccccagucugccugcc

SEQ ID NO: 84176 - RNA, 22 nt, Human
ugcagugagccgagaucgagcc

SEQ ID NO: 84177 - RNA, 21 nt, Human
gcuguguaaagaaaugggaaa

SEQ ID NO: 84178 - RNA, 24 nt, Human
ugucuggggcagggagggcacagg

SEQ ID NO: 84179 - RNA, 23 nt, Human
acccgugggagucgggacauaua

SEQ ID NO: 84180 - RNA, 25 nt, Human
ccuucuggagaaugccuuuugaaac

SEQ ID NO: 84181 - RNA, 29 nt, Human
acaauuucaaaagaacauucuuauauuuu

SEQ ID NO: 84182 - RNA, 24 nt, Human
accaguaguucuuuaauuuacggg

SEQ ID NO: 84183 - RNA, 24 nt, Human
ugagacacugagaaaaagaacagg

SEQ ID NO: 84184 - RNA, 28 nt, Human
ccccuaagucaacuuagcauuuucugca

SEQ ID NO: 84185 - RNA, 21 nt, Human
gucaccuaggggaaaugcaaa

SEQ ID NO: 84186 - RNA, 22 nt, Human
cucggcaaaccaauuuggggaa

SEQ ID NO: 84187 - RNA, 27 nt, Human
uccaugugccucauggcacugccaccu

SEQ ID NO: 84188 - RNA, 24 nt, Human
ugcucugguugaaggugggguggg

SEQ ID NO: 84189 - RNA, 27 nt, Human
acuggaagaugagcucaccaggcaaag

SEQ ID NO: 84190 - RNA, 22 nt, Human
gccugcaaucccagcuacuugg

SEQ ID NO: 84191 - RNA, 23 nt, Human
gggguuaggcugaaaaguguuca

SEQ ID NO: 84192 - RNA, 22 nt, Human
uguuuuuaacccagaauuucug

SEQ ID NO: 84193 - RNA, 26 nt, Human
gcuguugcuggacuacaugcuggcca

SEQ ID NO: 84194 - RNA, 24 nt, Human
ucauugaucaguuuggagaguagg

SEQ ID NO: 84195 - RNA, 25 nt, Human
ccuccugcuacucuguuccuucaca

SEQ ID NO: 84196 - RNA, 26 nt, Human
gauauuuggcuuaaauauaguuccua

SEQ ID NO: 84197 - RNA, 26 nt, Human
aggcugagccaagcccacggccaugc

SEQ ID NO: 84198 - RNA, 20 nt, Human
cucugccuucuccccuuacc

SEQ ID NO: 84199 - RNA, 26 nt, Human
guggaguuuucugugagaauaaagca

SEQ ID NO: 84200 - RNA, 22 nt, Human
gcuucaaagccuaaccaaggcu

SEQ ID NO: 84201 - RNA, 22 nt, Human
cagagcaagacucugucucagg

SEQ ID NO: 84202 - RNA, 24 nt, Human
caauaagugcccgagcacacugcc

SEQ ID NO: 84203 - RNA, 21 nt, Human
auacuuuaaagagagaggauc

SEQ ID NO: 84204 - RNA, 23 nt, Human
cagccuggcuggcagcugcucug

SEQ ID NO: 84205 - RNA, 20 nt, Human
gcccaacaucuuccauggac

SEQ ID NO: 84206 - RNA, 20 nt, Human
auguuuuucaccuauaaaau

SEQ ID NO: 84207 - RNA, 21 nt, Human
gggguugcuccggggccaggu

SEQ ID NO: 84208 - RNA, 23 nt, Human
gcuccucccaugccuccugcaca

SEQ ID NO: 84209 - RNA, 22 nt, Human
ugagguacaaccuguucugcuu

SEQ ID NO: 84210 - RNA, 27 nt, Human
gacuagaacaacccaaauagcaucuag

SEQ ID NO: 84211 - RNA, 24 nt, Human
ggucccucuucaacacugccacau

SEQ ID NO: 84212 - RNA, 24 nt, Human
uuggcucuugggcuggaguaccgu

SEQ ID NO: 84213 - RNA, 27 nt, Human
gacacacaaccuccuccuccucuucca

SEQ ID NO: 84214 - RNA, 25 nt, Human
cccuucagccacuccgacugccugg

SEQ ID NO: 84215 - RNA, 21 nt, Human
cagaacugaggguugcaaugg

SEQ ID NO: 84216 - RNA, 26 nt, Human
gggcucuucuggagggaaguaacauu

SEQ ID NO: 84217 - RNA, 27 nt, Human
ccuaaaauuaaaggaggcagccuccua

SEQ ID NO: 84218 - RNA, 23 nt, Human
cgcagccucaucaaaaugcagcu

SEQ ID NO: 84219 - RNA, 21 nt, Human
cgccugucaucccagcacuuu

SEQ ID NO: 84220 - RNA, 22 nt, Human
ggcucacugcagccucgaacuc

SEQ ID NO: 84221 - RNA, 22 nt, Human
agcucacugcagccucaaacuc

SEQ ID NO: 84222 - RNA, 19 nt, Human
uguguucaugcacacuugc

SEQ ID NO: 84223 - RNA, 22 nt, Human
aauaaaucccagugugccugau

SEQ ID NO: 84224 - RNA, 26 nt, Human
cugucuggcccuugcugggugagggc

SEQ ID NO: 84225 - RNA, 22 nt, Human
cguuucuuaacaaucaaaucug

SEQ ID NO: 84226 - RNA, 22 nt, Human
cuucuauguuucuacucccucc

SEQ ID NO: 84227 - RNA, 26 nt, Human
agccuccaguuccccuucaauggugg

SEQ ID NO: 84228 - RNA, 23 nt, Human
ucucauugcccaggcuggagugc

SEQ ID NO: 84229 - RNA, 21 nt, Human
agguagcacagggcagagcca

SEQ ID NO: 84230 - RNA, 21 nt, Human
uuguuagggcaacacugaccu

SEQ ID NO: 84231 - RNA, 26 nt, Human
cugccucuccucuggcccugggaaca

SEQ ID NO: 84232 - RNA, 24 nt, Human
caggguguuuugucaaagcagguu

SEQ ID NO: 84233 - RNA, 23 nt, Human
gcuguggaacugcccuccaagcu

SEQ ID NO: 84234 - RNA, 22 nt, Human
cauugggcagaggaguauagga

SEQ ID NO: 84235 - RNA, 23 nt, Human
cuucauuucauccuguuggcugc

SEQ ID NO: 84236 - RNA, 25 nt, Human
gggccucucugcagaccucuuccca

SEQ ID NO: 84237 - RNA, 19 nt, Human
uuaaccucaucacuacuaa

SEQ ID NO: 84238 - RNA, 27 nt, Human
uuuaccccugggaugggggaugcaucu

SEQ ID NO: 84239 - RNA, 21 nt, Human
cuggacucaggcuggaggcag

SEQ ID NO: 84240 - RNA, 20 nt, Human
uaccugggcgugguggugca

SEQ ID NO: 84241 - RNA, 24 nt, Human
ugucuggauguggagaagcucugu

SEQ ID NO: 84242 - RNA, 24 nt, Human
acaaagauccacacacauccucac

SEQ ID NO: 84243 - RNA, 22 nt, Human
cauuucaguaucaucuccauca

SEQ ID NO: 84244 - RNA, 21 nt, Human
cucuggguugucauucacuuu

SEQ ID NO: 84245 - RNA, 21 nt, Human
ggaaaaguaaggaaaacgauu

SEQ ID NO: 84246 - RNA, 28 nt, Human
uguucccaaucugaaauucaaaaugcuc

SEQ ID NO: 84247 - RNA, 22 nt, Human
acuccacccuccccaccuggcu

SEQ ID NO: 84248 - RNA, 27 nt, Human
gacaaccaaguaugaaucuauuugugg

SEQ ID NO: 84249 - RNA, 21 nt, Human
uacauuaucaagcaagcacaa

SEQ ID NO: 84250 - RNA, 23 nt, Human
guggguggggagcuuuuggggag

SEQ ID NO: 84251 - RNA, 26 nt, Human
gucggcucuccugggcucaguccugg

SEQ ID NO: 84252 - RNA, 23 nt, Human
gcaguggacucaaaagcauuuuc

SEQ ID NO: 84253 - RNA, 27 nt, Human
caggaggcagagguugcagugcgcuga

SEQ ID NO: 84254 - RNA, 27 nt, Human
aguaucaccauacaaguauuuguuuau

SEQ ID NO: 84255 - RNA, 23 nt, Human
ggggaaagaauaguaaccaugca

SEQ ID NO: 84256 - RNA, 24 nt, Human
cccuccaggaugcugccggacugg

SEQ ID NO: 84257 - RNA, 27 nt, Human
ucucacuuccugaaacaccccugaaga

SEQ ID NO: 84258 - RNA, 20 nt, Human
auuaugcuuuuauaugcuau

SEQ ID NO: 84259 - RNA, 24 nt, Human
cucaaccuuuuggggauuucugug

SEQ ID NO: 84260 - RNA, 21 nt, Human
agagacugacucucagagcca

SEQ ID NO: 84261 - RNA, 23 nt, Human
caggcacugcaaaccgccaccuc

SEQ ID NO: 84262 - RNA, 20 nt, Human
uggaaacacucugaucugaa

SEQ ID NO: 84263 - RNA, 26 nt, Human
ucugcugcuacugcugcugccgcugc

SEQ ID NO: 84264 - RNA, 24 nt, Human
augcugcugcugcugcugcugcug

SEQ ID NO: 84265 - RNA, 21 nt, Human
ccuccagccugggacugcugu

SEQ ID NO: 84266 - RNA, 24 nt, Human
acucggugaugaaauaauggagau

SEQ ID NO: 84267 - RNA, 23 nt, Human
ggugagggagacuggggccuggu

SEQ ID NO: 84268 - RNA, 22 nt, Human
acugcaaccuucgccaccuggg

SEQ ID NO: 84269 - RNA, 23 nt, Human
cuuuugcugacuuuucaaaugca

SEQ ID NO: 84270 - RNA, 21 nt, Human
ugcaccuguaggaacaacuag

SEQ ID NO: 84271 - RNA, 24 nt, Human
ccuccuagcuaguccuguccugca

SEQ ID NO: 84272 - RNA, 20 nt, Human
ccacaaauagguauguagca

SEQ ID NO: 84273 - RNA, 18 nt, Human
gccagccucggagugggc

SEQ ID NO: 84274 - RNA, 22 nt, Human
ucuuuccccucagcucuucucc

SEQ ID NO: 84275 - RNA, 23 nt, Human
auuccuucucucuaccugccacc

SEQ ID NO: 84276 - RNA, 24 nt, Human
cuguuuggauuagaccauaguuga

SEQ ID NO: 84277 - RNA, 27 nt, Human
cuguaggaaaucuaguuauuuacagga

SEQ ID NO: 84278 - RNA, 27 nt, Human
agcauuuucauucuuccugcugaagua

SEQ ID NO: 84279 - RNA, 21 nt, Human
uuugagaugcuucuggcuccc

SEQ ID NO: 84280 - RNA, 22 nt, Human
acucacuggggccuacagcuuu

SEQ ID NO: 84281 - RNA, 26 nt, Human
cugccucugucuccugccacaauccu

SEQ ID NO: 84282 - RNA, 22 nt, Human
ugaaacccacaggcggagguug

SEQ ID NO: 84283 - RNA, 23 nt, Human
ggagaagaaagagaaaugaugca

SEQ ID NO: 84284 - RNA, 22 nt, Human
ggcuaauuuuuauauuuuuaga

SEQ ID NO: 84285 - RNA, 25 nt, Human
ggcaggaugacccugcgaaggggcc

SEQ ID NO: 84286 - RNA, 22 nt, Human
ugagcccagauuccuggaagag

SEQ ID NO: 84287 - RNA, 30 nt, Human
gaggcucuuugcaaaccccagagacucauu

SEQ ID NO: 84288 - RNA, 21 nt, Human
uguaccugcuuaguuaauugg

SEQ ID NO: 84289 - RNA, 22 nt, Human
aguccgucugucuucucuuucc

SEQ ID NO: 84290 - RNA, 23 nt, Human
ucucagccgagcccaggggaggc

SEQ ID NO: 84291 - RNA, 26 nt, Human
agcuucccgccuccuccagcugcuuc

SEQ ID NO: 84292 - RNA, 24 nt, Human
cuccacugcuuaccuacuuucuuc

SEQ ID NO: 84293 - RNA, 21 nt, Human
gggucugaagcgccgccggga

SEQ ID NO: 84294 - RNA, 21 nt, Human
gagcccaaacugcugucccaa

SEQ ID NO: 84295 - RNA, 21 nt, Human
cugaguagcugggacuacagg

SEQ ID NO: 84296 - RNA, 25 nt, Human
uaugaacugaaggcuaaagugcuag

SEQ ID NO: 84297 - RNA, 23 nt, Human
aagugaaaaugccacucucucca

SEQ ID NO: 84298 - RNA, 23 nt, Human
ccuccacccuccuccucuucacc

SEQ ID NO: 84299 - RNA, 18 nt, Human
ccucagcaaccucugccg

SEQ ID NO: 84300 - RNA, 21 nt, Human
uuugggcuauaaagaugaaga

SEQ ID NO: 84301 - RNA, 25 nt, Human
ugccucuaaguucuugucucuggcc

SEQ ID NO: 84302 - RNA, 25 nt, Human
ccaugggauggagaaccacucuguc

SEQ ID NO: 84303 - RNA, 27 nt, Human
ugacucagcagggaugauucagcagag

SEQ ID NO: 84304 - RNA, 22 nt, Human
ugcagagaaguuagauccugcu

SEQ ID NO: 84305 - RNA, 21 nt, Human
gguuggaccccagagucuucc

SEQ ID NO: 84306 - RNA, 21 nt, Human
aguccccagcagagccugugu

SEQ ID NO: 84307 - RNA, 27 nt, Human
ccugccuggguucugucccagcucccu

SEQ ID NO: 84308 - RNA, 23 nt, Human
uaggggaggggggagccagaggc

SEQ ID NO: 84309 - RNA, 20 nt, Human
gcuccagccucuccagugcu

SEQ ID NO: 84310 - RNA, 24 nt, Human
cagcaacuguuuaaccuguuuuca

SEQ ID NO: 84311 - RNA, 24 nt, Human
uacuuggaauccuguguccugucu

SEQ ID NO: 84312 - RNA, 26 nt, Human
gggaaagacuggagcagcgaacagga

SEQ ID NO: 84313 - RNA, 21 nt, Human
aggcgguugaggcugcaguga

SEQ ID NO: 84314 - RNA, 24 nt, Human
ugucacccaggcuggagugcagug

SEQ ID NO: 84315 - RNA, 24 nt, Human
cucaaagccuguugagcccaucaa

SEQ ID NO: 84316 - RNA, 27 nt, Human
cagagccgccucccucugcuugcccag

SEQ ID NO: 84317 - RNA, 21 nt, Human
aucagccugggcaacacagug

SEQ ID NO: 84318 - RNA, 25 nt, Human
uuccaaaggugguaaacuaugggau

SEQ ID NO: 84319 - RNA, 25 nt, Human
uuguagagacccaggccuggagagu

SEQ ID NO: 84320 - RNA, 23 nt, Human
ccucucacucuucugucuuugca

SEQ ID NO: 84321 - RNA, 27 nt, Human
agccaaccuuaaaccucuucuauugcu

SEQ ID NO: 84322 - RNA, 23 nt, Human
cucggcucucccucuuucauacc

SEQ ID NO: 84323 - RNA, 23 nt, Human
gcuggcauccuguccuugggaac

SEQ ID NO: 84324 - RNA, 25 nt, Human
acauuuuugauacauaacagaccuc

SEQ ID NO: 84325 - RNA, 24 nt, Human
aucccauuucuccccacccugggg

SEQ ID NO: 84326 - RNA, 24 nt, Human
acauuucucccauaacuuuuuaca

SEQ ID NO: 84327 - RNA, 27 nt, Human
ucaggaggccgaggcaggagaauugcu

SEQ ID NO: 84328 - RNA, 27 nt, Human
cccuccaggccucaguuucuucaccug

SEQ ID NO: 84329 - RNA, 32 nt, Human
augagugucuuuuagugucacagggaacaguu

SEQ ID NO: 84330 - RNA, 21 nt, Human
cauggccgcggagguggcacg

SEQ ID NO: 84331 - RNA, 24 nt, Human
aaaggaggaucgagcucacugugg

SEQ ID NO: 84332 - RNA, 27 nt, Human
gcccuggccuuucacuccaguucuggg

SEQ ID NO: 84333 - RNA, 21 nt, Human
aagagguggagguuacaguga

SEQ ID NO: 84334 - RNA, 25 nt, Human
gagaaacuugacaaguaucucucca

SEQ ID NO: 84335 - RNA, 20 nt, Human
ugagagaaggaggggagcag

SEQ ID NO: 84336 - RNA, 29 nt, Human
ggaagugggaagagagguggucuucuggc

SEQ ID NO: 84337 - RNA, 26 nt, Human
acaccuaggcuaggguggggagagac

SEQ ID NO: 84338 - RNA, 24 nt, Human
uacacccaagguugucagcuuugg

SEQ ID NO: 84339 - RNA, 23 nt, Human
gccuccaggaccauucaggcugu

SEQ ID NO: 84340 - RNA, 20 nt, Human
cgcagccgccaccuacccag

SEQ ID NO: 84341 - RNA, 22 nt, Human
guuguccugaauucuacauuau

SEQ ID NO: 84342 - RNA, 22 nt, Human
agugccagagaaguggaggcag

SEQ ID NO: 84343 - RNA, 21 nt, Human
cugagaagagugaggcagcgc

SEQ ID NO: 84344 - RNA, 22 nt, Human
agggguuucagccccacccuca

SEQ ID NO: 84345 - RNA, 21 nt, Human
ucccuccugugaaccaacaca

SEQ ID NO: 84346 - RNA, 28 nt, Human
acuggccucugugccauggaugauucuu

SEQ ID NO: 84347 - RNA, 21 nt, Human
agagggcugcuauuagauugu

SEQ ID NO: 84348 - RNA, 25 nt, Human
uugcuuggcaggcugggccucugug

SEQ ID NO: 84349 - RNA, 22 nt, Human
uauacccaagggcagaaaguag

SEQ ID NO: 84350 - RNA, 22 nt, Human
gugggugggucaggugagugga

SEQ ID NO: 84351 - RNA, 23 nt, Human
gggcccugauuugcugggcaguu

SEQ ID NO: 84352 - RNA, 26 nt, Human
uagggacuucugguaugcuuuccucu

SEQ ID NO: 84353 - RNA, 20 nt, Human
agagacacuacaugacucca

SEQ ID NO: 84354 - RNA, 17 nt, Human
cugccucuuggcuucuc

SEQ ID NO: 84355 - RNA, 22 nt, Human
guccacccuucccagcucagcu

SEQ ID NO: 84356 - RNA, 28 nt, Human
uuucgaacuccugaccucaggugauccu

SEQ ID NO: 84357 - RNA, 24 nt, Human
aaacaguauguaaaacucuguuuu

SEQ ID NO: 84358 - RNA, 24 nt, Human
ggugggcagggcggagggagccuc

SEQ ID NO: 84359 - RNA, 21 nt, Human
gccucaagguagugaggcuag

SEQ ID NO: 84360 - RNA, 26 nt, Human
uguuaucacucugccuguguauaguc

SEQ ID NO: 84361 - RNA, 22 nt, Human
agcucacugcagccuccacuuc

SEQ ID NO: 84362 - RNA, 19 nt, Human
cgggaaaagagcagaggaa

SEQ ID NO: 84363 - RNA, 27 nt, Human
ggccucgaacuccuggcacuaccaaag

SEQ ID NO: 84364 - RNA, 19 nt, Human
guacauguucuagaccauu

SEQ ID NO: 84365 - RNA, 27 nt, Human
cccagcacuuuccgucaacguuguacu

SEQ ID NO: 84366 - RNA, 22 nt, Human
cggccuuucuuucucccucuug

SEQ ID NO: 84367 - RNA, 20 nt, Human
ucugcuacccucauccuggu

SEQ ID NO: 84368 - RNA, 21 nt, Human
uguguuuagagaauuauggga

SEQ ID NO: 84369 - RNA, 16 nt, Human
aacuauacauguuuuu

SEQ ID NO: 84370 - RNA, 23 nt, Human
cccuuucuaaaaugaaagcugau

SEQ ID NO: 84371 - RNA, 24 nt, Human
cuuucucucagccucuggaagcca

SEQ ID NO: 84372 - RNA, 22 nt, Human
acaggaagagaaagagaucagg

SEQ ID NO: 84373 - RNA, 19 nt, Human
acccccaccuuccaguguu

SEQ ID NO: 84374 - RNA, 23 nt, Human
aaacucauggggagacagcagau

SEQ ID NO: 84375 - RNA, 24 nt, Human
cgcucugcucuguccggucacagg

SEQ ID NO: 84376 - RNA, 19 nt, Human
uaacaauaccucaaacuuu

SEQ ID NO: 84377 - RNA, 20 nt, Human
uaugcagcccagugcagccu

SEQ ID NO: 84378 - RNA, 27 nt, Human
uugaugaaaccauacaaauguaacgug

SEQ ID NO: 84379 - RNA, 20 nt, Human
augcaaaauauauacaagca

SEQ ID NO: 84380 - RNA, 22 nt, Human
gucuguauauugauugagacua

SEQ ID NO: 84381 - RNA, 27 nt, Human
aagacauuugagcggugaauuacuugg

SEQ ID NO: 84382 - RNA, 26 nt, Human
ugcccaggcugcccugcccagcgccu

SEQ ID NO: 84383 - RNA, 20 nt, Human
cgggcaggugguugcagcau

SEQ ID NO: 84384 - RNA, 22 nt, Human
ccgaguagcugggaccacaggu

SEQ ID NO: 84385 - RNA, 23 nt, Human
gcucagccuggagugcagugagc

SEQ ID NO: 84386 - RNA, 27 nt, Human
uucaggccugcugcugaguuaugcaca

SEQ ID NO: 84387 - RNA, 23 nt, Human
ugugcuuguuaacugagugccuu

SEQ ID NO: 84388 - RNA, 27 nt, Human
ggagagggagggcccacaggucagaaa

SEQ ID NO: 84389 - RNA, 22 nt, Human
gggagguagagguugcagugag

SEQ ID NO: 84390 - RNA, 22 nt, Human
gggggcaggggcugcugggaca

SEQ ID NO: 84391 - RNA, 22 nt, Human
gggggcugaggcaggaggauca

SEQ ID NO: 84392 - RNA, 26 nt, Human
aguuucagcuuucuucagcugccagu

SEQ ID NO: 84393 - RNA, 23 nt, Human
accaggcccggcuaauuuuuugu

SEQ ID NO: 84394 - RNA, 24 nt, Human
ucugaagcccuugggaucuaccuu

SEQ ID NO: 84395 - RNA, 23 nt, Human
gcaagucauuaaauccucaucau

SEQ ID NO: 84396 - RNA, 25 nt, Human
gaccugcgucggguggugaccgugg

SEQ ID NO: 84397 - RNA, 27 nt, Human
cuuuuucuucacuuacaagaaaggccu

SEQ ID NO: 84398 - RNA, 21 nt, Human
agcugcccaggcuuucuggaa

SEQ ID NO: 84399 - RNA, 24 nt, Human
agugacacaagagaaauccaguuc

SEQ ID NO: 84400 - RNA, 24 nt, Human
aaaauugaagaggugcugccaagg

SEQ ID NO: 84401 - RNA, 19 nt, Human
uauauagagaaagugaccu

SEQ ID NO: 84402 - RNA, 22 nt, Human
ccgaguggcugggauuagcggc

SEQ ID NO: 84403 - RNA, 20 nt, Human
uauauccaaaauucagggcu

SEQ ID NO: 84404 - RNA, 28 nt, Human
agugcucaggaaauauuuggugaugggc

SEQ ID NO: 84405 - RNA, 23 nt, Human
gcugaggcaggugguucacugga

SEQ ID NO: 84406 - RNA, 26 nt, Human
gaccaaccuggugaaaccccgucucu

SEQ ID NO: 84407 - RNA, 25 nt, Human
gccccucuuucuccugcacuuggcu

SEQ ID NO: 84408 - RNA, 26 nt, Human
cugggaggcaggcgcagugccccccu

SEQ ID NO: 84409 - RNA, 19 nt, Human
cuccgagcccgccugcugu

SEQ ID NO: 84410 - RNA, 22 nt, Human
cugaggcaggagaauugauuga

SEQ ID NO: 84411 - RNA, 21 nt, Human
ccacagcugaaaagagcuuug

SEQ ID NO: 84412 - RNA, 21 nt, Human
uucaccccuuaccccaaagag

SEQ ID NO: 84413 - RNA, 20 nt, Human
uuauuggaacaccugcccca

SEQ ID NO: 84414 - RNA, 20 nt, Human
uggagcgggcagcugugaac

SEQ ID NO: 84415 - RNA, 25 nt, Human
cacagccuggucaggagggaaggac

SEQ ID NO: 84416 - RNA, 21 nt, Human
ucaucagcuuauaaacuacua

SEQ ID NO: 84417 - RNA, 23 nt, Human
uauguuagaaaauacuguuucua

SEQ ID NO: 84418 - RNA, 20 nt, Human
gcuggagagugcccaggcca

SEQ ID NO: 84419 - RNA, 27 nt, Human
uggucugcauuucuacuguaaaaugca

SEQ ID NO: 84420 - RNA, 26 nt, Human
gcucaguuuucucugaaggagaagga

SEQ ID NO: 84421 - RNA, 23 nt, Human
accccccaggcugaagugcagug

SEQ ID NO: 84422 - RNA, 18 nt, Human
caggaaagccugaaaugc

SEQ ID NO: 84423 - RNA, 26 nt, Human
ucggcucccagcaagugccucuuugu

SEQ ID NO: 84424 - RNA, 24 nt, Human
gggguuucagccccacccucagga

SEQ ID NO: 84425 - RNA, 24 nt, Human
ucauggacauugaagcauaucuug

SEQ ID NO: 84426 - RNA, 19 nt, Human
uucuggcccucgcaccacu

SEQ ID NO: 84427 - RNA, 21 nt, Human
agaacuccagaaguguugaca

SEQ ID NO: 84428 - RNA, 24 nt, Human
cuacaaaccauacuaauuauucca

SEQ ID NO: 84429 - RNA, 22 nt, Human
uguugcccaggcuggagugcaa

SEQ ID NO: 84430 - RNA, 27 nt, Human
uagagcuagcuggugugguugcaguga

SEQ ID NO: 84431 - RNA, 28 nt, Human
agguggggagcagagaauucucuuaucc

SEQ ID NO: 84432 - RNA, 16 nt, Human
uacucucauauaguca

SEQ ID NO: 84433 - RNA, 24 nt, Human
ggcaucuccuuucccuuccugucu

SEQ ID NO: 84434 - RNA, 19 nt, Human
uagguuuuuauuaaacuca

SEQ ID NO: 84435 - RNA, 21 nt, Human
cucaggaggcugagaugagag

SEQ ID NO: 84436 - RNA, 19 nt, Human
aagcuuuuauauuacuuga

SEQ ID NO: 84437 - RNA, 22 nt, Human
gcaggcuguagugcaguggcac

SEQ ID NO: 84438 - RNA, 22 nt, Human
ucaggcuggagugcaguggcac

SEQ ID NO: 84439 - RNA, 27 nt, Human
ugcccugcuuugccuuaaagccucggg

SEQ ID NO: 84440 - RNA, 22 nt, Human
cuucucuuugcugauuauguua

SEQ ID NO: 84441 - RNA, 20 nt, Human
aaucaacuaagauuacacag

SEQ ID NO: 84442 - RNA, 20 nt, Human
ugucuuugcucagaaccagc

SEQ ID NO: 84443 - RNA, 22 nt, Human
aaaaagggaagaaacugcugag

SEQ ID NO: 84444 - RNA, 26 nt, Human
cccuccagcugggggcccucaggugg

SEQ ID NO: 84445 - RNA, 21 nt, Human
ccccccagccccugccagcuc

SEQ ID NO: 84446 - RNA, 21 nt, Human
uagcccaguggaccuucugaa

SEQ ID NO: 84447 - RNA, 26 nt, Human
ucuguauauuuuccugcucugccuuc

SEQ ID NO: 84448 - RNA, 24 nt, Human
aguggcagaggugagggucaaaga

SEQ ID NO: 84449 - RNA, 20 nt, Human
cuggccuuuaacuucugagc

SEQ ID NO: 84450 - RNA, 20 nt, Human
ggugaggauaaggggugggg

SEQ ID NO: 84451 - RNA, 18 nt, Human
cccugaccucugaccuca

SEQ ID NO: 84452 - RNA, 21 nt, Human
gguugggcugaguuuuuuauu

SEQ ID NO: 84453 - RNA, 27 nt, Human
ccugccugcgcccgcagcugaccuucu

SEQ ID NO: 84454 - RNA, 22 nt, Human
agcucacugcagcuucaaacuc

SEQ ID NO: 84455 - RNA, 26 nt, Human
uugcccucucgccuccuccuccuggg

SEQ ID NO: 84456 - RNA, 23 nt, Human
ugugccgagcuguuuucuaccuu

SEQ ID NO: 84457 - RNA, 21 nt, Human
uggucccucugucccuguguc

SEQ ID NO: 84458 - RNA, 21 nt, Human
agcccacccaccuucccccca

SEQ ID NO: 84459 - RNA, 20 nt, Human
cugaggcaugggaggcccag

SEQ ID NO: 84460 - RNA, 20 nt, Human
uauuaaaauugcacuuuuau

SEQ ID NO: 84461 - RNA, 22 nt, Human
uuguaacaaguauucaaagggg

SEQ ID NO: 84462 - RNA, 20 nt, Human
cuucugaaguaccuagcaca

SEQ ID NO: 84463 - RNA, 22 nt, Human
gccucuauuuauuuauuagcuu

SEQ ID NO: 84464 - RNA, 21 nt, Human
cuguugccugcuccugggcag

SEQ ID NO: 84465 - RNA, 22 nt, Human
uugggucccuguuuucucuccu

SEQ ID NO: 84466 - RNA, 20 nt, Human
uuauaaagauuuuagugcag

SEQ ID NO: 84467 - RNA, 27 nt, Human
uggccagagagugucucucuagacugg

SEQ ID NO: 84468 - RNA, 23 nt, Human
caacuugcauaugucaucccaua

SEQ ID NO: 84469 - RNA, 30 nt, Human
uuuuccucucaugucuuugcugcagaacug

SEQ ID NO: 84470 - RNA, 21 nt, Human
ggugggggcaaguacagggua

SEQ ID NO: 84471 - RNA, 25 nt, Human
uggugacucacacuuguaaucccag

SEQ ID NO: 84472 - RNA, 23 nt, Human
ccucccagcccucuccucauucu

SEQ ID NO: 84473 - RNA, 21 nt, Human
cguuuccuuccugcuccugcu

SEQ ID NO: 84474 - RNA, 22 nt, Human
gucgcccaggcuagaguggauu

SEQ ID NO: 84475 - RNA, 22 nt, Human
cagcucccauuucuagaacaca

SEQ ID NO: 84476 - RNA, 28 nt, Human
gggaagagaagaccuagagcagacgccg

SEQ ID NO: 84477 - RNA, 20 nt, Human
cuuucacaguccuguccucu

SEQ ID NO: 84478 - RNA, 22 nt, Human
cuccaccaagcccaucagaagg

SEQ ID NO: 84479 - RNA, 29 nt, Human
acugaacuuuucaaaauaaagcuuuugca

SEQ ID NO: 84480 - RNA, 22 nt, Human
gcuggcaucuguaguaucauug

SEQ ID NO: 84481 - RNA, 26 nt, Human
agaugaugcagagugcgacugucccc

SEQ ID NO: 84482 - RNA, 20 nt, Human
acacauuuaugcagaugagc

SEQ ID NO: 84483 - RNA, 27 nt, Human
guagggagaugcggggagcaggguggg

SEQ ID NO: 84484 - RNA, 17 nt, Human
agauuuagucuguuaua

SEQ ID NO: 84485 - RNA, 23 nt, Human
uuugaacuucuuggaucuguggg

SEQ ID NO: 84486 - RNA, 27 nt, Human
uaacugcauaaguaaugacuuucagug

SEQ ID NO: 84487 - RNA, 20 nt, Human
uacagauauuaaguaugcaa

SEQ ID NO: 84488 - RNA, 26 nt, Human
ggccaugaguuacucgggaggcugag

SEQ ID NO: 84489 - RNA, 22 nt, Human
uaccaccagacacagagcccgg

SEQ ID NO: 84490 - RNA, 23 nt, Human
uugccucugcuggagccccugcc

SEQ ID NO: 84491 - RNA, 29 nt, Human
ccugguguuuuucucucuggacccuucug

SEQ ID NO: 84492 - RNA, 24 nt, Human
uugucgcucagccuggagugcagu

SEQ ID NO: 84493 - RNA, 23 nt, Human
cagaucugaucaagaguccggau

SEQ ID NO: 84494 - RNA, 19 nt, Human
gggcacacuggcagagggu

SEQ ID NO: 84495 - RNA, 22 nt, Human
uucuuuaccuggcucugcuucc

SEQ ID NO: 84496 - RNA, 27 nt, Human
acugcaaccucugccuuccaagaucaa

SEQ ID NO: 84497 - RNA, 21 nt, Human
ggagcugaccagggagggagg

SEQ ID NO: 84498 - RNA, 25 nt, Human
cugcuccccuaacccuacuuugcuu

SEQ ID NO: 84499 - RNA, 30 nt, Human
ccuggacuggcccaccugccugccacaugc

SEQ ID NO: 84500 - RNA, 23 nt, Human
caugggagacccuugacaacugc

SEQ ID NO: 84501 - RNA, 18 nt, Human
gaagaaguaagugaggaa

SEQ ID NO: 84502 - RNA, 22 nt, Human
cccaaguaguugggauugcagg

SEQ ID NO: 84503 - RNA, 27 nt, Human
ggacuccuuucacuccuuuaacaaaaa

SEQ ID NO: 84504 - RNA, 22 nt, Human
augugccagagccuguacugga

SEQ ID NO: 84505 - RNA, 28 nt, Human
gcacagaccucucccacccacaagaacu

SEQ ID NO: 84506 - RNA, 21 nt, Human
uccaggagaagauacaaaucc

SEQ ID NO: 84507 - RNA, 27 nt, Human
agccucuccccagccuccccgugccaa

SEQ ID NO: 84508 - RNA, 30 nt, Human
uccucauggaagaagagcaagauuuaccag

SEQ ID NO: 84509 - RNA, 22 nt, Human
gcauguacuaccaugccuggcu

SEQ ID NO: 84510 - RNA, 22 nt, Human
gccagugcccgaggccaggaag

SEQ ID NO: 84511 - RNA, 23 nt, Human
uguucacagccuacuuuaucucu

SEQ ID NO: 84512 - RNA, 19 nt, Human
aggcucucuccacugccug

SEQ ID NO: 84513 - RNA, 27 nt, Human
aaguccccaggggguacucuggaguga

SEQ ID NO: 84514 - RNA, 21 nt, Human
gacgucaugcagaaaagcagc

SEQ ID NO: 84515 - RNA, 21 nt, Human
gccacaaucagaaaaaggaca

SEQ ID NO: 84516 - RNA, 21 nt, Human
gacuauucaauaccauacuga

SEQ ID NO: 84517 - RNA, 22 nt, Human
ugcguuauuuucucaucagcug

SEQ ID NO: 84518 - RNA, 27 nt, Human
guccgagaucggggguuggagugcggg

SEQ ID NO: 84519 - RNA, 20 nt, Human
ggaggaagagguugcaguga

SEQ ID NO: 84520 - RNA, 27 nt, Human
cagcucuuccuagcuggagaggagccc

SEQ ID NO: 84521 - RNA, 29 nt, Human
ccgcucgcucuccccaucgagggacaaac

SEQ ID NO: 84522 - RNA, 26 nt, Human
cucacuccagcuucacaaaugugcug

SEQ ID NO: 84523 - RNA, 22 nt, Human
uccagaagcuauggaaccagca

SEQ ID NO: 84524 - RNA, 23 nt, Human
ugcaaccucugccuuccaagauc

SEQ ID NO: 84525 - RNA, 22 nt, Human
uguucccaguuguaaauuacug

SEQ ID NO: 84526 - RNA, 21 nt, Human
guggccuuuggaacaccaagc

SEQ ID NO: 84527 - RNA, 21 nt, Human
gacgcacaggcuggagugcag

SEQ ID NO: 84528 - RNA, 23 nt, Human
uuuucugaaagcuguuccuggcc

SEQ ID NO: 84529 - RNA, 23 nt, Human
gugaaauaaacuuuucaaaaaug

SEQ ID NO: 84530 - RNA, 22 nt, Human
uucaagcgacucuccugccuca

SEQ ID NO: 84531 - RNA, 19 nt, Human
agaguauuuuuauuaaaga

SEQ ID NO: 84532 - RNA, 20 nt, Human
gaugcugggucucacugcca

SEQ ID NO: 84533 - RNA, 20 nt, Human
ucuuugaauacaaguuugca

SEQ ID NO: 84534 - RNA, 27 nt, Human
ucacccaggcuccagcuagaucaucag

SEQ ID NO: 84535 - RNA, 24 nt, Human
gggaggagcacucggaaggguugg

SEQ ID NO: 84536 - RNA, 24 nt, Human
caggccugcccugcuauuucaggc

SEQ ID NO: 84537 - RNA, 27 nt, Human
ucgcgugcuacagguuugacaaaaaga

SEQ ID NO: 84538 - RNA, 24 nt, Human
ugucaccuaggcuggagugcagug

SEQ ID NO: 84539 - RNA, 22 nt, Human
agcagacugugcaugcuccugu

SEQ ID NO: 84540 - RNA, 21 nt, Human
ucuugcuccagguccuucagu

SEQ ID NO: 84541 - RNA, 26 nt, Human
ugucuucauuuuuccuccugucugca

SEQ ID NO: 84542 - RNA, 27 nt, Human
uuucccaagccgccaucuuccagcuga

SEQ ID NO: 84543 - RNA, 27 nt, Human
ccuuauaaucuugcuucaaaugcugug

SEQ ID NO: 84544 - RNA, 24 nt, Human
gcaauaugucaucuaccuaccuca

SEQ ID NO: 84545 - RNA, 23 nt, Human
gggugccuguaaucccagcuauu

SEQ ID NO: 84546 - RNA, 23 nt, Human
acagagcacuggcugggcaucag

SEQ ID NO: 84547 - RNA, 26 nt, Human
ccagcccagacccaguggacucuucc

SEQ ID NO: 84548 - RNA, 21 nt, Human
aggccuggaaggugauuuccc

SEQ ID NO: 84549 - RNA, 23 nt, Human
ugggcuaggcugcaacuuuaucu

SEQ ID NO: 84550 - RNA, 23 nt, Human
ugcuaaaauuuuuauauugacaa

SEQ ID NO: 84551 - RNA, 20 nt, Human
ggaaaucaauugcuuccauu

SEQ ID NO: 84552 - RNA, 23 nt, Human
ucauucucuuuaagacaauuaua

SEQ ID NO: 84553 - RNA, 21 nt, Human
cacccaggcuggaguggagug

SEQ ID NO: 84554 - RNA, 23 nt, Human
uucucucuaucagauaccauuua

SEQ ID NO: 84555 - RNA, 23 nt, Human
ggccuccucccuccauccuggga

SEQ ID NO: 84556 - RNA, 25 nt, Human
aaacuauuuauugugcuggguccca

SEQ ID NO: 84557 - RNA, 22 nt, Human
aggaauuuaacaauuugcaucc

SEQ ID NO: 84558 - RNA, 22 nt, Human
agacccaggaguccagaccccc

SEQ ID NO: 84559 - RNA, 24 nt, Human
ugaaacuauauuuugucauaucaa

SEQ ID NO: 84560 - RNA, 27 nt, Human
cuguauuuggcuagcaaucugccugua

SEQ ID NO: 84561 - RNA, 21 nt, Human
cacaccaaaauccaaccuucu

SEQ ID NO: 84562 - RNA, 21 nt, Human
uuccuacccucucuaauggcc

SEQ ID NO: 84563 - RNA, 19 nt, Human
aggcuaaggugggaggauc

SEQ ID NO: 84564 - RNA, 22 nt, Human
aaagugcugggauuacaggcgc

SEQ ID NO: 84565 - RNA, 22 nt, Human
aaagugcugggaucacaggcgu

SEQ ID NO: 84566 - RNA, 25 nt, Human
cugauuucaaccagucacuuagcug

SEQ ID NO: 84567 - RNA, 22 nt, Human
ggaggcugaggugggagaauca

SEQ ID NO: 84568 - RNA, 25 nt, Human
uucauucuuaucuucugcuaguuaa

SEQ ID NO: 84569 - RNA, 22 nt, Human
gugacuuguuuacucauugaag

SEQ ID NO: 84570 - RNA, 26 nt, Human
gcuuucucuguggaaaaagacaaaac

SEQ ID NO: 84571 - RNA, 23 nt, Human
cugcaccucuuugucacagggug

SEQ ID NO: 84572 - RNA, 21 nt, Human
gagaugaaaguaugcacagaa

SEQ ID NO: 84573 - RNA, 21 nt, Human
uugugcuuccugugggugggg

SEQ ID NO: 84574 - RNA, 19 nt, Human
agccauggucaucugacag

SEQ ID NO: 84575 - RNA, 27 nt, Human
aaaauucaagaaaauaaauguagcugg

SEQ ID NO: 84576 - RNA, 22 nt, Human
ucaucuuuuucuuccuccuacc

SEQ ID NO: 84577 - RNA, 28 nt, Human
cugagugaggaauggcagugagguuucu

SEQ ID NO: 84578 - RNA, 20 nt, Human
cuggaggccccuggagccag

SEQ ID NO: 84579 - RNA, 21 nt, Human
gcuggguccugccuccuuccg

SEQ ID NO: 84580 - RNA, 21 nt, Human
uguugccagacuggagugcag

SEQ ID NO: 84581 - RNA, 22 nt, Human
ugaucccagcucacugcagccu

SEQ ID NO: 84582 - RNA, 21 nt, Human
caagugagucucucugggccu

SEQ ID NO: 84583 - RNA, 22 nt, Human
gggggaugcauauaacagauca

SEQ ID NO: 84584 - RNA, 22 nt, Human
cccugcuccgacucucagggcu

SEQ ID NO: 84585 - RNA, 27 nt, Human
ugggguugggguuguuuagggagaagc

SEQ ID NO: 84586 - RNA, 24 nt, Human
ugucauccaggcuggagugcagug

SEQ ID NO: 84587 - RNA, 20 nt, Human
ccugucuuccucauguucac

SEQ ID NO: 84588 - RNA, 26 nt, Human
ccauuucuccuuuccuuccucccauc

SEQ ID NO: 84589 - RNA, 20 nt, Human
ucuucccucucccucucucu

SEQ ID NO: 84590 - RNA, 28 nt, Human
gggacagcuuccucacaccccuguccca

SEQ ID NO: 84591 - RNA, 23 nt, Human
ugcagcugcccagccccuccucc

SEQ ID NO: 84592 - RNA, 27 nt, Human
ucucagccaugcacggacucguuucca

SEQ ID NO: 84593 - RNA, 23 nt, Human
acucccaggcagcccuacuucuu

SEQ ID NO: 84594 - RNA, 27 nt, Human
aacagggaagggggaaaaacccuccuc

SEQ ID NO: 84595 - RNA, 24 nt, Human
agcccaaacuuuccucagcugcau

SEQ ID NO: 84596 - RNA, 22 nt, Human
cccagcaccacguucuucuugc

SEQ ID NO: 84597 - RNA, 22 nt, Human
acccuguguaccuugucccuca

SEQ ID NO: 84598 - RNA, 23 nt, Human
uugaagguccucugccuccagcu

SEQ ID NO: 84599 - RNA, 23 nt, Human
uuccacccuccccauuuggaguc

SEQ ID NO: 84600 - RNA, 22 nt, Human
ucagcaauacaggccgccuggc

SEQ ID NO: 84601 - RNA, 20 nt, Human
ugggagaaucaugaaagucu

SEQ ID NO: 84602 - RNA, 21 nt, Human
aagugggcaaaggagugugug

SEQ ID NO: 84603 - RNA, 24 nt, Human
caccacacuccagcuacuguguag

SEQ ID NO: 84604 - RNA, 27 nt, Human
ggucucgaacuccugggcucaagugau

SEQ ID NO: 84605 - RNA, 22 nt, Human
ugaccccacgugcucucuggcc

SEQ ID NO: 84606 - RNA, 22 nt, Human
aagcuccaugugccucuuuguc

SEQ ID NO: 84607 - RNA, 21 nt, Human
uuggccaggcuggagugcagu

SEQ ID NO: 84608 - RNA, 22 nt, Human
aggcucagguucagggagugag

SEQ ID NO: 84609 - RNA, 19 nt, Human
aguagugauggguuuccca

SEQ ID NO: 84610 - RNA, 21 nt, Human
accuguauuuaagauuuuugu

SEQ ID NO: 84611 - RNA, 26 nt, Human
ucuuguuaauaaaugcaaaaugcccg

SEQ ID NO: 84612 - RNA, 22 nt, Human
uugaugggauuuuaaauucagc

SEQ ID NO: 84613 - RNA, 23 nt, Human
cuauuuugguaagugcagcuuga

SEQ ID NO: 84614 - RNA, 27 nt, Human
uggaaaagagaaaucugauacuccauu

SEQ ID NO: 84615 - RNA, 24 nt, Human
cacuccuccagucuugugggggca

SEQ ID NO: 84616 - RNA, 22 nt, Human
gcccgggcuggaggcgccgagc

SEQ ID NO: 84617 - RNA, 21 nt, Human
acgccaaccgccgcuccuggg

SEQ ID NO: 84618 - RNA, 27 nt, Human
cguguccccugacagggccagugcagu

SEQ ID NO: 84619 - RNA, 27 nt, Human
ccagccacugcuuagcuaucauaguca

SEQ ID NO: 84620 - RNA, 26 nt, Human
cuccacccauucucugauuuuccugc

SEQ ID NO: 84621 - RNA, 18 nt, Human
uggaagcuuucaucgagu

SEQ ID NO: 84622 - RNA, 25 nt, Human
gccaucuacccuccgcuccugggcg

SEQ ID NO: 84623 - RNA, 30 nt, Human
ccagagggugaaagcuggagucugucaaug

SEQ ID NO: 84624 - RNA, 22 nt, Human
ggucucgaacucuugaccucag

SEQ ID NO: 84625 - RNA, 25 nt, Human
gcaaaaaacagccaccgauuuugcu

SEQ ID NO: 84626 - RNA, 21 nt, Human
aggugggauugugggugacuu

SEQ ID NO: 84627 - RNA, 21 nt, Human
gugccaggcccucuccugcca

SEQ ID NO: 84628 - RNA, 30 nt, Human
cccagcaacaacaaaagaacuaguccucuu

SEQ ID NO: 84629 - RNA, 25 nt, Human
uacaggugcgugcuaccacgcccag

SEQ ID NO: 84630 - RNA, 22 nt, Human
gguguugaacuccuaaccucag

SEQ ID NO: 84631 - RNA, 26 nt, Human
cacccaggcugagggugccuuugugg

SEQ ID NO: 84632 - RNA, 19 nt, Human
ccccaacaguugguugucu

SEQ ID NO: 84633 - RNA, 21 nt, Human
accccucugcuggaucagauc

SEQ ID NO: 84634 - RNA, 22 nt, Human
agucucccgaguagcugggauu

SEQ ID NO: 84635 - RNA, 26 nt, Human
ucccgggaaccucagcaaccucugcc

SEQ ID NO: 84636 - RNA, 21 nt, Human
ggagggcuuccugggaggugu

SEQ ID NO: 84637 - RNA, 21 nt, Human
ccauaguuuauuucucucuca

SEQ ID NO: 84638 - RNA, 24 nt, Human
ccucugucauuuuaaccucaggug

SEQ ID NO: 84639 - RNA, 22 nt, Human
uccuuuuauaucacuguguuug

SEQ ID NO: 84640 - RNA, 18 nt, Human
cacuccagcaucucccca

SEQ ID NO: 84641 - RNA, 26 nt, Human
cugccucuuuggugcucuuaaaagcc

SEQ ID NO: 84642 - RNA, 20 nt, Human
gugaacacacaggcuggcug

SEQ ID NO: 84643 - RNA, 21 nt, Human
uugaguuucuuauauauucug

SEQ ID NO: 84644 - RNA, 20 nt, Human
guggguggaucaugagguca

SEQ ID NO: 84645 - RNA, 22 nt, Human
guaacuguugaaaaacuaccug

SEQ ID NO: 84646 - RNA, 27 nt, Human
aucucugauggagauggguuggguacc

SEQ ID NO: 84647 - RNA, 24 nt, Human
ggcggcggcaggaucggccagagg

SEQ ID NO: 84648 - RNA, 19 nt, Human
cucaaaaugaugcaaccaa

SEQ ID NO: 84649 - RNA, 26 nt, Human
agaggaagaggggacguguguuugca

SEQ ID NO: 84650 - RNA, 24 nt, Human
aaguccaggcagccugcaggcugg

SEQ ID NO: 84651 - RNA, 26 nt, Human
auuggaugcaggcucuuaacucagca

SEQ ID NO: 84652 - RNA, 20 nt, Human
cugccgccugggaaucagga

SEQ ID NO: 84653 - RNA, 19 nt, Human
agagugaggaagaagcaga

SEQ ID NO: 84654 - RNA, 22 nt, Human
acauuuagcaacaacaguguga

SEQ ID NO: 84655 - RNA, 21 nt, Human
guugucugggguggguggagu

SEQ ID NO: 84656 - RNA, 25 nt, Human
ccugguuccuaggggaaugaggggg

SEQ ID NO: 84657 - RNA, 30 nt, Human
gacgcucagccucagggcucagaaggugcc

SEQ ID NO: 84658 - RNA, 21 nt, Human
gccguguuacuguugcacuga

SEQ ID NO: 84659 - RNA, 23 nt, Human
ggggugagcgcagccggggcggg

SEQ ID NO: 84660 - RNA, 22 nt, Human
cucauuuauuuugcuauacagg

SEQ ID NO: 84661 - RNA, 27 nt, Human
ccugggcugccagccucaggcagcucu

SEQ ID NO: 84662 - RNA, 30 nt, Human
gguggguguuaagcuagaaugggcugugug

SEQ ID NO: 84663 - RNA, 23 nt, Human
acuguggucagucuccuguccca

SEQ ID NO: 84664 - RNA, 20 nt, Human
gagagguuaauuucugcuca

SEQ ID NO: 84665 - RNA, 21 nt, Human
acuaaacuuguauuacauauc

SEQ ID NO: 84666 - RNA, 21 nt, Human
auuaugcuuuaaugcuguuau

SEQ ID NO: 84667 - RNA, 22 nt, Human
cuucuccuggguccaagcaauu

SEQ ID NO: 84668 - RNA, 23 nt, Human
cucaacaacauauauuauacuug

SEQ ID NO: 84669 - RNA, 26 nt, Human
ccucaaacucuggggcucaagcaguu

SEQ ID NO: 84670 - RNA, 20 nt, Human
uauuugccuccagucuggcu

SEQ ID NO: 84671 - RNA, 24 nt, Human
cacugguggggugggaggagcacc

SEQ ID NO: 84672 - RNA, 22 nt, Human
auuaauuccagacaaaagggag

SEQ ID NO: 84673 - RNA, 21 nt, Human
gcauuccugguuuucuucagc

SEQ ID NO: 84674 - RNA, 24 nt, Human
aaauguucugggacuaguugaguu

SEQ ID NO: 84675 - RNA, 24 nt, Human
ggagagaggaaagagcggagcagc

SEQ ID NO: 84676 - RNA, 22 nt, Human
agcagugucuuugaucugcaac

SEQ ID NO: 84677 - RNA, 19 nt, Human
gaagucaggguauugugca

SEQ ID NO: 84678 - RNA, 23 nt, Human
cccagaagggacacaccagcaca

SEQ ID NO: 84679 - RNA, 23 nt, Human
gggaggcgggagaugauggcgag

SEQ ID NO: 84680 - RNA, 21 nt, Human
ggcgcccaggcucggugcugg

SEQ ID NO: 84681 - RNA, 22 nt, Human
uggcaugugccuguaaucccag

SEQ ID NO: 84682 - RNA, 20 nt, Human
ucacagcagcugccugggug

SEQ ID NO: 84683 - RNA, 19 nt, Human
acaguuggcugagugccuu

SEQ ID NO: 84684 - RNA, 22 nt, Human
uaagagaagacaagagggccgg

SEQ ID NO: 84685 - RNA, 22 nt, Human
gaggguggaaggaugggauggg

SEQ ID NO: 84686 - RNA, 26 nt, Human
uuucucucacauuacuguauauacuu

SEQ ID NO: 84687 - RNA, 20 nt, Human
cacuuuccugggcugcaaug

SEQ ID NO: 84688 - RNA, 17 nt, Human
auggcuguucuggguga

SEQ ID NO: 84689 - RNA, 26 nt, Human
auuauucuucuuacauuauuaaucau

SEQ ID NO: 84690 - RNA, 24 nt, Human
gagcacagggaggcagaggcuugg

SEQ ID NO: 84691 - RNA, 23 nt, Human
ugguguggacucugucuuaaaag

SEQ ID NO: 84692 - RNA, 28 nt, Human
ggucucgagucuccugaccucgugaucc

SEQ ID NO: 84693 - RNA, 22 nt, Human
uugaccacauuccauccauuuc

SEQ ID NO: 84694 - RNA, 25 nt, Human
ggaacaaugacgugccuaccucuua

SEQ ID NO: 84695 - RNA, 20 nt, Human
gaggaagagggugccgggga

SEQ ID NO: 84696 - RNA, 24 nt, Human
gccucucccucccuuccucaggca

SEQ ID NO: 84697 - RNA, 27 nt, Human
ggaagguugagagagaggugcuggggu

SEQ ID NO: 84698 - RNA, 22 nt, Human
uacugcugaguggcccuggaca

SEQ ID NO: 84699 - RNA, 21 nt, Human
ccuccuggaacuccuggcuca

SEQ ID NO: 84700 - RNA, 25 nt, Human
uucaguuucauguaucuuugucuuu

SEQ ID NO: 84701 - RNA, 21 nt, Human
agaaagauugugaugcaagau

SEQ ID NO: 84702 - RNA, 22 nt, Human
auuuugacagucaucaucauug

SEQ ID NO: 84703 - RNA, 27 nt, Human
cuugccucuucccuucccacuggugca

SEQ ID NO: 84704 - RNA, 21 nt, Human
ugggggcagggagaggaguga

SEQ ID NO: 84705 - RNA, 27 nt, Human
ccaacagcaguuguaggcugcccugga

SEQ ID NO: 84706 - RNA, 16 nt, Human
accauaaaaucacugg

SEQ ID NO: 84707 - RNA, 27 nt, Human
ucccacccucccuagaggggcaccuuu

SEQ ID NO: 84708 - RNA, 21 nt, Human
ggagacggagguugcagugag

SEQ ID NO: 84709 - RNA, 21 nt, Human
acugcacuccagccuggguga

SEQ ID NO: 84710 - RNA, 28 nt, Human
ccugcagcuggcugcucaggagauggcc

SEQ ID NO: 84711 - RNA, 22 nt, Human
ccugcagugguuuaauggcaga

SEQ ID NO: 84712 - RNA, 25 nt, Human
agguaaucccagaaacguacccguu

SEQ ID NO: 84713 - RNA, 23 nt, Human
gagcaacauggcagauaaucuca

SEQ ID NO: 84714 - RNA, 21 nt, Human
ugagaguaaucaugcccaccc

SEQ ID NO: 84715 - RNA, 25 nt, Human
acagagcagaggaaggcaggggauu

SEQ ID NO: 84716 - RNA, 23 nt, Human
agagaauauuuuuggcauuccuc

SEQ ID NO: 84717 - RNA, 23 nt, Human
acuuuuuauuccagcugcugaaa

SEQ ID NO: 84718 - RNA, 21 nt, Human
guauuuuuaguuuuuucccuu

SEQ ID NO: 84719 - RNA, 26 nt, Human
uuucuguaacacagaauauaggauaa

SEQ ID NO: 84720 - RNA, 22 nt, Human
agcacagaccuuuguauuauaa

SEQ ID NO: 84721 - RNA, 22 nt, Human
aaagggaggggaaggaaugagc

SEQ ID NO: 84722 - RNA, 21 nt, Human
uucaaccccacuuccuacugu

SEQ ID NO: 84723 - RNA, 24 nt, Human
cuacuuccuucccugccucccagc

SEQ ID NO: 84724 - RNA, 20 nt, Human
gcggucuccggccauggccc

SEQ ID NO: 84725 - RNA, 26 nt, Human
cccagccucugacuugcuguguuguc

SEQ ID NO: 84726 - RNA, 18 nt, Human
cagcacugugucuugccu

SEQ ID NO: 84727 - RNA, 26 nt, Human
gggagguggcagggaagggugccugg

SEQ ID NO: 84728 - RNA, 21 nt, Human
ggcaggguggaguggaggggg

SEQ ID NO: 84729 - RNA, 27 nt, Human
aacaaauuuugggggcaggagaucccu

SEQ ID NO: 84730 - RNA, 20 nt, Human
accacugcaaucaauguguc

SEQ ID NO: 84731 - RNA, 26 nt, Human
ggcaggagauggccaaucaugcgccc

SEQ ID NO: 84732 - RNA, 27 nt, Human
uuuuguuguuuaaauuauggggccuaa

SEQ ID NO: 84733 - RNA, 22 nt, Human
accagccuggacaacaugguga

SEQ ID NO: 84734 - RNA, 28 nt, Human
ccagggcugaagaugcgagcccguccuc

SEQ ID NO: 84735 - RNA, 21 nt, Human
ccugccugcccugccuccguc

SEQ ID NO: 84736 - RNA, 22 nt, Human
uccagccugggugacaagagcg

SEQ ID NO: 84737 - RNA, 27 nt, Human
aacuucuguuuccuucucuuguguuau

SEQ ID NO: 84738 - RNA, 26 nt, Human
cucucuguucacagaacucaggcugc

SEQ ID NO: 84739 - RNA, 21 nt, Human
caaagagaggaaucacaggga

SEQ ID NO: 84740 - RNA, 24 nt, Human
uaucuaugggagauuaaaaccaga

SEQ ID NO: 84741 - RNA, 24 nt, Human
uuccccagaaauauuuggaaauua

SEQ ID NO: 84742 - RNA, 23 nt, Human
gcuguucuucacuuucaucuugu

SEQ ID NO: 84743 - RNA, 17 nt, Human
gcacagcagccauugca

SEQ ID NO: 84744 - RNA, 22 nt, Human
gacacaagaccucagacuugug

SEQ ID NO: 84745 - RNA, 24 nt, Human
agccaaacccccuaaaggucucca

SEQ ID NO: 84746 - RNA, 25 nt, Human
uguucagagccuuuggccucucugu

SEQ ID NO: 84747 - RNA, 25 nt, Human
uaucuuuguuuccccaccucaggcc

SEQ ID NO: 84748 - RNA, 22 nt, Human
uuuggagcuauuucuugaugga

SEQ ID NO: 84749 - RNA, 23 nt, Human
uggguaucccaccuccagcccac

SEQ ID NO: 84750 - RNA, 22 nt, Human
cuuucagcaaaccucagucaua

SEQ ID NO: 84751 - RNA, 25 nt, Human
caaagugauugaguagguaauguuc

SEQ ID NO: 84752 - RNA, 22 nt, Human
gggcuggagugcaguggugcaa

SEQ ID NO: 84753 - RNA, 23 nt, Human
aguuuugacaaugaccagguugg

SEQ ID NO: 84754 - RNA, 22 nt, Human
ugggccccagaccagagaaaag

SEQ ID NO: 84755 - RNA, 23 nt, Human
uccugugaggccuuccuaucucc

SEQ ID NO: 84756 - RNA, 27 nt, Human
agcaguuugugaucuguccuuccaacc

SEQ ID NO: 84757 - RNA, 25 nt, Human
ggagggcguucguccugggagcugc

SEQ ID NO: 84758 - RNA, 22 nt, Human
ugacugcagccuugaacuccug

SEQ ID NO: 84759 - RNA, 26 nt, Human
acaacagccacucaccuuuuccuccu

SEQ ID NO: 84760 - RNA, 27 nt, Human
gccagccugagccagcagugggaggug

SEQ ID NO: 84761 - RNA, 23 nt, Human
ggccucucuggcugggugcagug

SEQ ID NO: 84762 - RNA, 23 nt, Human
ucccugccuggcccccaaccuca

SEQ ID NO: 84763 - RNA, 30 nt, Human
cugauuuuuaaaccucuuugaccaucuucu

SEQ ID NO: 84764 - RNA, 27 nt, Human
cugcugguuuaaaaauauuuacugaua

SEQ ID NO: 84765 - RNA, 22 nt, Human
ccggaguagcugggauugcagg

SEQ ID NO: 84766 - RNA, 19 nt, Human
acuuccuuucuuucuuccc

SEQ ID NO: 84767 - RNA, 21 nt, Human
aaagaacaaaacaucaaaaug

SEQ ID NO: 84768 - RNA, 24 nt, Human
ugagugggcuucucugggagcucu

SEQ ID NO: 84769 - RNA, 23 nt, Human
gugugggcagucaucagucauca

SEQ ID NO: 84770 - RNA, 21 nt, Human
ucucauuccaguaaugaccca

SEQ ID NO: 84771 - RNA, 26 nt, Human
gcauacagaugaguuggcagccgguc

SEQ ID NO: 84772 - RNA, 27 nt, Human
gacaguccagcccagaacuuuuccuuc

SEQ ID NO: 84773 - RNA, 20 nt, Human
ucccuucucugcuccacagg

SEQ ID NO: 84774 - RNA, 21 nt, Human
auuucccaagcuggagugcag

SEQ ID NO: 84775 - RNA, 21 nt, Human
ucucuaaugcaccugccucag

SEQ ID NO: 84776 - RNA, 20 nt, Human
aacacacccucugugcuugu

SEQ ID NO: 84777 - RNA, 25 nt, Human
aaguuuggcaaaauccugaguagug

SEQ ID NO: 84778 - RNA, 20 nt, Human
aguguggguucuaaguacag

SEQ ID NO: 84779 - RNA, 28 nt, Human
ucuagcugcauaucuucaucauauuggu

SEQ ID NO: 84780 - RNA, 18 nt, Human
caccuugcuuugcacuga

SEQ ID NO: 84781 - RNA, 23 nt, Human
gggggccgucuuccugugguugu

SEQ ID NO: 84782 - RNA, 22 nt, Human
gggaggcgggugggggagggag

SEQ ID NO: 84783 - RNA, 22 nt, Human
ucguauccccucucagucgccc

SEQ ID NO: 84784 - RNA, 27 nt, Human
gguuucaucauauuggucagggugguc

SEQ ID NO: 84785 - RNA, 20 nt, Human
auuguauucccagccugugu

SEQ ID NO: 84786 - RNA, 21 nt, Human
ugaaucuuuuacuuaccucuu

SEQ ID NO: 84787 - RNA, 21 nt, Human
gagcuccccucugucuggggc

SEQ ID NO: 84788 - RNA, 19 nt, Human
uagccuauuuuugaagauu

SEQ ID NO: 84789 - RNA, 27 nt, Human
cccagcacuggugucucugugcuuccu

SEQ ID NO: 84790 - RNA, 24 nt, Human
accucugagcccaagaccuugccu

SEQ ID NO: 84791 - RNA, 18 nt, Human
ggggaggcgggggaggug

SEQ ID NO: 84792 - RNA, 23 nt, Human
ggcauauaauccuuccacacagc

SEQ ID NO: 84793 - RNA, 21 nt, Human
aacagcaugcacucaacuugg

SEQ ID NO: 84794 - RNA, 26 nt, Human
gucugaaauccugggcucaagugauc

SEQ ID NO: 84795 - RNA, 26 nt, Human
aucucaguuugaacaaacuagcaaca

SEQ ID NO: 84796 - RNA, 24 nt, Human
ggagagggacuccuggggggccug

SEQ ID NO: 84797 - RNA, 24 nt, Human
ggguccccucccuccuuccuaucg

SEQ ID NO: 84798 - RNA, 27 nt, Human
ccacagaaaauggaggcuuucacaagg

SEQ ID NO: 84799 - RNA, 20 nt, Human
cacacaacaggcuuauuuuc

SEQ ID NO: 84800 - RNA, 27 nt, Human
ggggaagagaccuagaaacaagcuuuc

SEQ ID NO: 84801 - RNA, 22 nt, Human
auucagucauucucuagguaau

SEQ ID NO: 84802 - RNA, 27 nt, Human
uugaggugacgguaggaaugugagcag

SEQ ID NO: 84803 - RNA, 22 nt, Human
agcacgucacuagagacuggga

SEQ ID NO: 84804 - RNA, 26 nt, Human
cuguuuauuguaauguauucuaaauu

SEQ ID NO: 84805 - RNA, 20 nt, Human
acugccgagcugccugcugu

SEQ ID NO: 84806 - RNA, 21 nt, Human
aaaauaucauaaaaaugagug

SEQ ID NO: 84807 - RNA, 21 nt, Human
uaaugcuguccuuuaguagca

SEQ ID NO: 84808 - RNA, 21 nt, Human
caccugcuccuacccggccag

SEQ ID NO: 84809 - RNA, 24 nt, Human
uguuggcaggcuggccaguccagg

SEQ ID NO: 84810 - RNA, 23 nt, Human
aauuuauuaaggaaauuuguacc

SEQ ID NO: 84811 - RNA, 26 nt, Human
gacucaggcuggaggcagauagacac

SEQ ID NO: 84812 - RNA, 27 nt, Human
uucucucucagaaaucaauggcauuug

SEQ ID NO: 84813 - RNA, 22 nt, Human
acacaucaaaaucauaauaaua

SEQ ID NO: 84814 - RNA, 22 nt, Human
gcagcccaggcccggcggacag

SEQ ID NO: 84815 - RNA, 23 nt, Human
uugucucagucaugcuugcugau

SEQ ID NO: 84816 - RNA, 17 nt, Human
cccugaccaugaccuga

SEQ ID NO: 84817 - RNA, 20 nt, Human
cugugauaccaaaaucucag

SEQ ID NO: 84818 - RNA, 20 nt, Human
uuaccccaaacucuucccca

SEQ ID NO: 84819 - RNA, 22 nt, Human
gcuggcauuugcaccuaccuca

SEQ ID NO: 84820 - RNA, 23 nt, Human
agccucaaacuauaguaacuuca

SEQ ID NO: 84821 - RNA, 21 nt, Human
caaggaggggggucacaggcc

SEQ ID NO: 84822 - RNA, 20 nt, Human
cacacacccagccucacucc

SEQ ID NO: 84823 - RNA, 14 nt, Human
accuuaaugccuua

SEQ ID NO: 84824 - RNA, 22 nt, Human
guuuaaaauauuucaauaaaga

SEQ ID NO: 84825 - RNA, 19 nt, Human
uugccuggagggugcagug

SEQ ID NO: 84826 - RNA, 22 nt, Human
ucagauauuggguaaaccaaag

SEQ ID NO: 84827 - RNA, 25 nt, Human
uuuuguuuuuaaugcagaaaaggaa

SEQ ID NO: 84828 - RNA, 21 nt, Human
cucaucuccugggagaggcag

SEQ ID NO: 84829 - RNA, 27 nt, Human
gcugucuuggaaaguacugugcaugua

SEQ ID NO: 84830 - RNA, 26 nt, Human
auucuauugccuucuuugaagaaggu

SEQ ID NO: 84831 - RNA, 21 nt, Human
ucucugagucaaauccagugg

SEQ ID NO: 84832 - RNA, 23 nt, Human
agaguagcuggaauuacaggcac

SEQ ID NO: 84833 - RNA, 28 nt, Human
acggcacaggcguccaggaaagcagcug

SEQ ID NO: 84834 - RNA, 20 nt, Human
cuaagcugcugcuugugcgc

SEQ ID NO: 84835 - RNA, 21 nt, Human
gaauuucuaaaaaugagugca

SEQ ID NO: 84836 - RNA, 23 nt, Human
guccuuuaacucguugcagucug

SEQ ID NO: 84837 - RNA, 22 nt, Human
ggcacuccagguuuccggagga

SEQ ID NO: 84838 - RNA, 22 nt, Human
ccucuacuaggcgccuuagcuc

SEQ ID NO: 84839 - RNA, 25 nt, Human
caaaauguguugaagugcccuauga

SEQ ID NO: 84840 - RNA, 31 nt, Human
caaaacauugugccuuaaaaugagucauaca

SEQ ID NO: 84841 - RNA, 22 nt, Human
uuuuuguaaguagugcuuuucc

SEQ ID NO: 84842 - RNA, 19 nt, Human
gaccacccuccccucagcc

SEQ ID NO: 84843 - RNA, 27 nt, Human
uuguccaggcuggucucgaacuccuga

SEQ ID NO: 84844 - RNA, 22 nt, Human
cgucagccagcucagccuuggc

SEQ ID NO: 84845 - RNA, 20 nt, Human
uuaucuugccauaucucaua

SEQ ID NO: 84846 - RNA, 24 nt, Human
cugcugucuuggcagcuucugggc

SEQ ID NO: 84847 - RNA, 25 nt, Human
cucugggaucucccccuuguggggc

SEQ ID NO: 84848 - RNA, 20 nt, Human
ccaggggcagaaugauaugg

SEQ ID NO: 84849 - RNA, 25 nt, Human
uugggggcucuguuuugaaugugga

SEQ ID NO: 84850 - RNA, 24 nt, Human
uauuaaaauguugcucugguuuua

SEQ ID NO: 84851 - RNA, 25 nt, Human
ucacacugcgcaggucucuucuggg

SEQ ID NO: 84852 - RNA, 21 nt, Human
ggacacaaaccagacagguuu

SEQ ID NO: 84853 - RNA, 25 nt, Human
guccuccucccuuucugggcuucca

SEQ ID NO: 84854 - RNA, 24 nt, Human
aggggugggggacagugggugggc

SEQ ID NO: 84855 - RNA, 22 nt, Human
gugccacacugaaacagccaga

SEQ ID NO: 84856 - RNA, 23 nt, Human
uccuagagguagagaaaccgugg

SEQ ID NO: 84857 - RNA, 23 nt, Human
ccaccugaggcaggagggcaugu

SEQ ID NO: 84858 - RNA, 22 nt, Human
gugauauuuuaaauauccacag

SEQ ID NO: 84859 - RNA, 23 nt, Human
acuccugaaauauacuuacucug

SEQ ID NO: 84860 - RNA, 22 nt, Human
agccccaucugaauguguuggg

SEQ ID NO: 84861 - RNA, 26 nt, Human
agacuugcgugggucaguucuuucug

SEQ ID NO: 84862 - RNA, 20 nt, Human
aagagugggcuuuguggaaa

SEQ ID NO: 84863 - RNA, 23 nt, Human
gcucgccccgccgcuccugcugc

SEQ ID NO: 84864 - RNA, 23 nt, Human
ucauucacuguuuuaauaugaca

SEQ ID NO: 84865 - RNA, 21 nt, Human
uccgggagcggauggagaagc

SEQ ID NO: 84866 - RNA, 22 nt, Human
gccccuggacaguugcagagaa

SEQ ID NO: 84867 - RNA, 25 nt, Human
ccugcucucccuccugcaggugacc

SEQ ID NO: 84868 - RNA, 21 nt, Human
gaagagggaggaaggggcggc

SEQ ID NO: 84869 - RNA, 19 nt, Human
guauaugauccauccagac

SEQ ID NO: 84870 - RNA, 20 nt, Human
gaccugcagccccagacucu

SEQ ID NO: 84871 - RNA, 23 nt, Human
cuccagagacaggaaagaauuug

SEQ ID NO: 84872 - RNA, 19 nt, Human
ucaucauuccauggagauu

SEQ ID NO: 84873 - RNA, 24 nt, Human
ccccuccccaaacacaccaagaag

SEQ ID NO: 84874 - RNA, 22 nt, Human
ugaacuccuggccucaaaugau

SEQ ID NO: 84875 - RNA, 24 nt, Human
uccagcaggagcaguggaugaaug

SEQ ID NO: 84876 - RNA, 20 nt, Human
ucugagaccagccugggcaa

SEQ ID NO: 84877 - RNA, 24 nt, Human
gcccagcuuggagugccacguggc

SEQ ID NO: 84878 - RNA, 23 nt, Human
acuguguaaauguccaagcacag

SEQ ID NO: 84879 - RNA, 16 nt, Human
ggggcagcagcagugg

SEQ ID NO: 84880 - RNA, 26 nt, Human
ggaaggcagcugguauauucagucuc

SEQ ID NO: 84881 - RNA, 22 nt, Human
cugggaggcggauguugaagug

SEQ ID NO: 84882 - RNA, 27 nt, Human
aagaggggaaaaggaagggugauucac

SEQ ID NO: 84883 - RNA, 18 nt, Human
ugccacccucucccugcc

SEQ ID NO: 84884 - RNA, 22 nt, Human
aaagcaaagggcgucucaggga

SEQ ID NO: 84885 - RNA, 22 nt, Human
uuugaggcgaaggcgucugucu

SEQ ID NO: 84886 - RNA, 22 nt, Human
agccuucugaguagcugggauu

SEQ ID NO: 84887 - RNA, 22 nt, Human
cacaaccucugccuacuggguu

SEQ ID NO: 84888 - RNA, 19 nt, Human
agcuuccucagucucucca

SEQ ID NO: 84889 - RNA, 26 nt, Human
cagcaagggaaggcagcuggcucuuc

SEQ ID NO: 84890 - RNA, 17 nt, Human
cugcccuuaccugaccc

SEQ ID NO: 84891 - RNA, 25 nt, Human
uuguggcaccuuuucuuuuucuccc

SEQ ID NO: 84892 - RNA, 29 nt, Human
gcugcugggccuccgccuucuuuucuacg

SEQ ID NO: 84893 - RNA, 24 nt, Human
ggcagugagacugguggggcacgg

SEQ ID NO: 84894 - RNA, 24 nt, Human
uaggacuccaguccaggcuggacg

SEQ ID NO: 84895 - RNA, 27 nt, Human
uugcccaggcuggucgugaacuccugg

SEQ ID NO: 84896 - RNA, 27 nt, Human
cugcccagaguaugggcacucaggugu

SEQ ID NO: 84897 - RNA, 26 nt, Human
ugcuguuucuguuggugcuagcuacu

SEQ ID NO: 84898 - RNA, 24 nt, Human
aucugacagaaucccugaguuaca

SEQ ID NO: 84899 - RNA, 25 nt, Human
gauaagaguuguccaaagggucgcu

SEQ ID NO: 84900 - RNA, 21 nt, Human
uuucgugauuuaaugaccuga

SEQ ID NO: 84901 - RNA, 23 nt, Human
uaauuagcuuguuacaauucuag

SEQ ID NO: 84902 - RNA, 20 nt, Human
augcugcugcucaaaaugcc

SEQ ID NO: 84903 - RNA, 21 nt, Human
guucuuguaaccuuuauuuca

SEQ ID NO: 84904 - RNA, 20 nt, Human
gcauuuauauaaacuuguga

SEQ ID NO: 84905 - RNA, 21 nt, Human
ucagagccuuuggccucucug

SEQ ID NO: 84906 - RNA, 30 nt, Human
cacccuacauuccagcaucuuaccuucaua

SEQ ID NO: 84907 - RNA, 22 nt, Human
aagcguuuuuaaccuguuuugu

SEQ ID NO: 84908 - RNA, 25 nt, Human
ugaucuaccacugaaaucauucuag

SEQ ID NO: 84909 - RNA, 23 nt, Human
aaaugucccucauguccauuucc

SEQ ID NO: 84910 - RNA, 22 nt, Human
caaacuccugaccucaagugau

SEQ ID NO: 84911 - RNA, 22 nt, Human
cgaacuccuaaccucaagugau

SEQ ID NO: 84912 - RNA, 27 nt, Human
cuagguggcaguagaugguggcagccc

SEQ ID NO: 84913 - RNA, 22 nt, Human
gggaaagcaucuuaaguuuaac

SEQ ID NO: 84914 - RNA, 26 nt, Human
guccucuccugcauuccugacaacaa

SEQ ID NO: 84915 - RNA, 19 nt, Human
gccuacaagcucuuuaguc

SEQ ID NO: 84916 - RNA, 22 nt, Human
uggcauucaugcagagcaaagc

SEQ ID NO: 84917 - RNA, 26 nt, Human
cacuuaaacucuugucagucugggcu

SEQ ID NO: 84918 - RNA, 31 nt, Human
ugcaugaugaacucaccuaauuaugaggugg

SEQ ID NO: 84919 - RNA, 21 nt, Human
aaugaauggcguuucucucca

SEQ ID NO: 84920 - RNA, 25 nt, Human
cugaauguaaccugcuagcucuccg

SEQ ID NO: 84921 - RNA, 21 nt, Human
aacuauacuuuggucugcuuc

SEQ ID NO: 84922 - RNA, 21 nt, Human
ucauucuauuggucaauucca

SEQ ID NO: 84923 - RNA, 22 nt, Human
agcuaauuguuguauuuuugau

SEQ ID NO: 84924 - RNA, 22 nt, Human
cuagaggacaucucggucguuu

SEQ ID NO: 84925 - RNA, 19 nt, Human
gggguucaaauugagugga

SEQ ID NO: 84926 - RNA, 27 nt, Human
cuugugagaugauaaaacugggcacag

SEQ ID NO: 84927 - RNA, 27 nt, Human
cauauucccuuuuuucuuuugaugucu

SEQ ID NO: 84928 - RNA, 21 nt, Human
agcccaggcagagaucaggug

SEQ ID NO: 84929 - RNA, 16 nt, Human
aguaugugcugucuca

SEQ ID NO: 84930 - RNA, 22 nt, Human
cacgcagccugcuccuggagcu

SEQ ID NO: 84931 - RNA, 23 nt, Human
uuagagcucugauaaggugucaa

SEQ ID NO: 84932 - RNA, 23 nt, Human
gugggggagagcaggcuggcagc

SEQ ID NO: 84933 - RNA, 21 nt, Human
caauguuaauaaagcauuuca

SEQ ID NO: 84934 - RNA, 27 nt, Human
gcccagaucacugugggcuggagagga

SEQ ID NO: 84935 - RNA, 22 nt, Human
cucuucuccccacccauccugg

SEQ ID NO: 84936 - RNA, 22 nt, Human
gcuuucaguauuccuaauuuuu

SEQ ID NO: 84937 - RNA, 24 nt, Human
caagcccuacuuuuguucuucuau

SEQ ID NO: 84938 - RNA, 21 nt, Human
uaauucucaccccugcccugg

SEQ ID NO: 84939 - RNA, 23 nt, Human
uuaaaacaagagaccacuuccuu

SEQ ID NO: 84940 - RNA, 22 nt, Human
caggagguggaaacugcagaga

SEQ ID NO: 84941 - RNA, 26 nt, Human
ccucgcugucugauucacuucuuacc

SEQ ID NO: 84942 - RNA, 23 nt, Human
aaccuauaaaguguuuaugacaa

SEQ ID NO: 84943 - RNA, 21 nt, Human
aggucuuuguucucacuguau

SEQ ID NO: 84944 - RNA, 24 nt, Human
uugcccaggaacuuagggugggua

SEQ ID NO: 84945 - RNA, 20 nt, Human
aagugaaaaaccuucuauua

SEQ ID NO: 84946 - RNA, 27 nt, Human
cagaccucugcugaguagcucugugau

SEQ ID NO: 84947 - RNA, 26 nt, Human
cacggacagcuuucccccuuccgccc

SEQ ID NO: 84948 - RNA, 30 nt, Human
gcugcccuucugaggccugccugauuuggg

SEQ ID NO: 84949 - RNA, 23 nt, Human
uccuccuuuauuuaacuccauuu

SEQ ID NO: 84950 - RNA, 29 nt, Human
acgagggagagucgaacccggagcagggu

SEQ ID NO: 84951 - RNA, 20 nt, Human
gggaaaucucucccuucauu

SEQ ID NO: 84952 - RNA, 22 nt, Human
ucacaugcucucacucaccaca

SEQ ID NO: 84953 - RNA, 22 nt, Human
ggccaggcuggagugcaguggu

SEQ ID NO: 84954 - RNA, 22 nt, Human
ugugagccagcacaccgggcca

SEQ ID NO: 84955 - RNA, 19 nt, Human
uccacaaaaugcaagagca

SEQ ID NO: 84956 - RNA, 25 nt, Human
gcuugugcagaaaacauuguuccag

SEQ ID NO: 84957 - RNA, 19 nt, Human
ucugggagcuaucuugucu

SEQ ID NO: 84958 - RNA, 21 nt, Human
auguugggaaaaacuggcuuu

SEQ ID NO: 84959 - RNA, 22 nt, Human
aagagaagacagucccaggaga

SEQ ID NO: 84960 - RNA, 24 nt, Human
gaucaaauccauauuaccauuugg

SEQ ID NO: 84961 - RNA, 21 nt, Human
uuuuaauuuauucaucuugcu

SEQ ID NO: 84962 - RNA, 20 nt, Human
gacaaaccacuguacauaua

SEQ ID NO: 84963 - RNA, 20 nt, Human
gacagcugacauaauucauu

SEQ ID NO: 84964 - RNA, 22 nt, Human
cacaccugugaucccagcacuu

SEQ ID NO: 84965 - RNA, 21 nt, Human
uuggcugcugccuuacuuccc

SEQ ID NO: 84966 - RNA, 22 nt, Human
uuuuuuaaaaaaugcugucuug

SEQ ID NO: 84967 - RNA, 28 nt, Human
uucaguuguuuauuuuaaaugauaucga

SEQ ID NO: 84968 - RNA, 22 nt, Human
cguauuucuuuuagcagcacuu

SEQ ID NO: 84969 - RNA, 23 nt, Human
guguuggagcuuggcugaagaca

SEQ ID NO: 84970 - RNA, 18 nt, Human
uuuguccugccuucucca

SEQ ID NO: 84971 - RNA, 21 nt, Human
ucucccacucgccgcccgcuu

SEQ ID NO: 84972 - RNA, 23 nt, Human
acccccacauuugcacaccuucc

SEQ ID NO: 84973 - RNA, 26 nt, Human
gugaagccucaagcccaugaaugcca

SEQ ID NO: 84974 - RNA, 21 nt, Human
gcacacagaaugcucaggguc

SEQ ID NO: 84975 - RNA, 20 nt, Human
ugggggucucugcccaggca

SEQ ID NO: 84976 - RNA, 25 nt, Human
uacuccugcaauuccagcugccauu

SEQ ID NO: 84977 - RNA, 23 nt, Human
aagugcuuccaucagaacggagu

SEQ ID NO: 84978 - RNA, 23 nt, Human
cuuauuucuucaacauuccaucc

SEQ ID NO: 84979 - RNA, 20 nt, Human
agguccugccaucugugcua

SEQ ID NO: 84980 - RNA, 20 nt, Human
cuguucccugcguggaggaa

SEQ ID NO: 84981 - RNA, 24 nt, Human
gauuguuuucauccugauacugua

SEQ ID NO: 84982 - RNA, 20 nt, Human
cacucuguccucauucccug

SEQ ID NO: 84983 - RNA, 24 nt, Human
agauagucccaguauacucacuua

SEQ ID NO: 84984 - RNA, 27 nt, Human
uggccuccaacaucccuugccugcugc

SEQ ID NO: 84985 - RNA, 24 nt, Human
gggucuguagguuguugcagugaa

SEQ ID NO: 84986 - RNA, 28 nt, Human
cgcuaggcgcucgccacgcccaugccuc

SEQ ID NO: 84987 - RNA, 22 nt, Human
guugaccaggcuggagugcagu

SEQ ID NO: 84988 - RNA, 22 nt, Human
ccaagagcgcaccauugcacuc

SEQ ID NO: 84989 - RNA, 25 nt, Human
gauaacaaaagcuuuacaagcugac

SEQ ID NO: 84990 - RNA, 21 nt, Human
aucuggaacuucugaccucag

SEQ ID NO: 84991 - RNA, 23 nt, Human
gucacccaggcugcaguguagug

SEQ ID NO: 84992 - RNA, 27 nt, Human
agaugcgaacauaguacacugcagccu

SEQ ID NO: 84993 - RNA, 21 nt, Human
gcuuagcagagaaucauggga

SEQ ID NO: 84994 - RNA, 24 nt, Human
caaugccccaaacuuucucauaag

SEQ ID NO: 84995 - RNA, 22 nt, Human
cuuguaugccuauguaauucaa

SEQ ID NO: 84996 - RNA, 22 nt, Human
cuucuggaacuaugggcuugag

SEQ ID NO: 84997 - RNA, 22 nt, Human
ucacccagggaucaaggcgcug

SEQ ID NO: 84998 - RNA, 21 nt, Human
ucuccacugcacuggagcuuu

SEQ ID NO: 84999 - RNA, 23 nt, Human
gucuuaaaguaguuacucccuuc

SEQ ID NO: 85000 - RNA, 20 nt, Human
acacugcacugagcacuuua

SEQ ID NO: 85001 - RNA, 24 nt, Human
ccgggaagugagagaaaaggggau

SEQ ID NO: 85002 - RNA, 23 nt, Human
ugaaguaagcaacaaggaugaca

SEQ ID NO: 85003 - RNA, 21 nt, Human
aucuauaaaggucaucaucuu

SEQ ID NO: 85004 - RNA, 26 nt, Human
ggccaccguaagcaagggaaaaaggg

SEQ ID NO: 85005 - RNA, 27 nt, Human
cauauuggccccacuguaacuuuuggg

SEQ ID NO: 85006 - RNA, 22 nt, Human
cacugcucuccagccuggggaa

SEQ ID NO: 85007 - RNA, 24 nt, Human
ccucauugauuaauacaucaucuc

SEQ ID NO: 85008 - RNA, 24 nt, Human
gaaaaugagaaaggacagagccag

SEQ ID NO: 85009 - RNA, 22 nt, Human
gucaccuaggcaagagugcaau

SEQ ID NO: 85010 - RNA, 21 nt, Human
cugcaggcugggggcagaggc

SEQ ID NO: 85011 - RNA, 26 nt, Human
gccaggcaacaggacuaaacuaccuc

SEQ ID NO: 85012 - RNA, 21 nt, Human
aaguuguuucucaguuguuuu

SEQ ID NO: 85013 - RNA, 26 nt, Human
cucuucuguucaccagacacccugcc

SEQ ID NO: 85014 - RNA, 24 nt, Human
cucacugguuuacaaauauagguu

SEQ ID NO: 85015 - RNA, 22 nt, Human
ggacgaaggggagugagcuuga

SEQ ID NO: 85016 - RNA, 27 nt, Human
ugccagacaacuuguccugacucaaca

SEQ ID NO: 85017 - RNA, 23 nt, Human
uuauugucaucaaaaguucauaa

SEQ ID NO: 85018 - RNA, 25 nt, Human
gguucaagcaauucuccugccucag

SEQ ID NO: 85019 - RNA, 25 nt, Human
gauucaagcgauucuccugccucag

SEQ ID NO: 85020 - RNA, 22 nt, Human
gcuccccagggccuggccuacu

SEQ ID NO: 85021 - RNA, 20 nt, Human
ccugcugcgcgcccccuccc

SEQ ID NO: 85022 - RNA, 23 nt, Human
acagauggcgucaaugugaacac

SEQ ID NO: 85023 - RNA, 18 nt, Human
guuuuucucccccgcccc

SEQ ID NO: 85024 - RNA, 25 nt, Human
gcaucgugugggucccuaagcacaa

SEQ ID NO: 85025 - RNA, 23 nt, Human
gaauuugugcuuacaugcacucc

SEQ ID NO: 85026 - RNA, 24 nt, Human
gccccaugcacaguguccugcgug

SEQ ID NO: 85027 - RNA, 24 nt, Human
gcagcuguguggacccagggacag

SEQ ID NO: 85028 - RNA, 26 nt, Human
gggaaaggagauagccuugcuccggc

SEQ ID NO: 85029 - RNA, 24 nt, Human
auaagcuagaucacuacaaggagc

SEQ ID NO: 85030 - RNA, 25 nt, Human
cuugguucaugcuucuacugugaca

SEQ ID NO: 85031 - RNA, 22 nt, Human
aagcaguagccacauggugcug

SEQ ID NO: 85032 - RNA, 23 nt, Human
ucacccuggaugcccagcagccc

SEQ ID NO: 85033 - RNA, 20 nt, Human
ccugucucucuggcugaugu

SEQ ID NO: 85034 - RNA, 27 nt, Human
ggcuggguggccacaacugggaugcca

SEQ ID NO: 85035 - RNA, 27 nt, Human
uccucauccacugcucgcugccucucc

SEQ ID NO: 85036 - RNA, 26 nt, Human
cagagcugcgggcugagggcaucucu

SEQ ID NO: 85037 - RNA, 26 nt, Human
ccugguagaauugggaagcuggggga

SEQ ID NO: 85038 - RNA, 27 nt, Human
uucuccauguuggucaggcugcucuca

SEQ ID NO: 85039 - RNA, 23 nt, Human
caauaaaucucagcuacuaugca

SEQ ID NO: 85040 - RNA, 23 nt, Human
ccacuucuuagaggcauucaguu

SEQ ID NO: 85041 - RNA, 24 nt, Human
ccucugggcugaaaacagcagcau

SEQ ID NO: 85042 - RNA, 21 nt, Human
ggaccuaggauuagaaaaugg

SEQ ID NO: 85043 - RNA, 21 nt, Human
uuugaucugagaucuguggua

SEQ ID NO: 85044 - RNA, 20 nt, Human
augcucucuggcugggccag

SEQ ID NO: 85045 - RNA, 26 nt, Human
ucuuaaggagcucagcucaguaaaca

SEQ ID NO: 85046 - RNA, 21 nt, Human
gccugugcagagagggugggu

SEQ ID NO: 85047 - RNA, 23 nt, Human
uucaaaacugccucuuuuuucca

SEQ ID NO: 85048 - RNA, 22 nt, Human
ugguauucucccuuggguaggg

SEQ ID NO: 85049 - RNA, 25 nt, Human
ccagaccagaguugagacaaaaaga

SEQ ID NO: 85050 - RNA, 23 nt, Human
caugggcugagcaggcugagcac

SEQ ID NO: 85051 - RNA, 22 nt, Human
cucagccucccaaauugcuggg

SEQ ID NO: 85052 - RNA, 27 nt, Human
accauauuugaauucauuaccuuggag

SEQ ID NO: 85053 - RNA, 27 nt, Human
gugagacuccugcugggaggguggagg

SEQ ID NO: 85054 - RNA, 22 nt, Human
ccagaagcuggagggggcuugg

SEQ ID NO: 85055 - RNA, 22 nt, Human
ggcagacuuggcaaggucucca

SEQ ID NO: 85056 - RNA, 25 nt, Human
ggcuggagaagagaaggcaaguugg

SEQ ID NO: 85057 - RNA, 19 nt, Human
gcagccaggaaaagcacaa

SEQ ID NO: 85058 - RNA, 21 nt, Human
acaaugccagcauaaauccau

SEQ ID NO: 85059 - RNA, 23 nt, Human
uucuaaguauuuauuuaaaacaa

SEQ ID NO: 85060 - RNA, 23 nt, Human
ggugggugggucaggugagugga

SEQ ID NO: 85061 - RNA, 22 nt, Human
ugucuugucuugggucucccau

SEQ ID NO: 85062 - RNA, 27 nt, Human
ccagaaacagcucuccucaacaugaga

SEQ ID NO: 85063 - RNA, 26 nt, Human
ccgggaggggagugacagagggacgu

SEQ ID NO: 85064 - RNA, 20 nt, Human
acauuuauucacaaaugaga

SEQ ID NO: 85065 - RNA, 20 nt, Human
gccugggugggaggagcgaa

SEQ ID NO: 85066 - RNA, 22 nt, Human
gggaggcggagguugcaaugag

SEQ ID NO: 85067 - RNA, 19 nt, Human
ccugauccaauggugccaa

SEQ ID NO: 85068 - RNA, 22 nt, Human
gcauuuacaagguuaaagauuc

SEQ ID NO: 85069 - RNA, 23 nt, Human
ucucuacugagugcuccagaguc

SEQ ID NO: 85070 - RNA, 28 nt, Human
uacagauacuuaugaagacauucuuucg

SEQ ID NO: 85071 - RNA, 22 nt, Human
ccaaagugcuuggauuacaggu

SEQ ID NO: 85072 - RNA, 21 nt, Human
aggguccaaguugccacauug

SEQ ID NO: 85073 - RNA, 20 nt, Human
uaauguccugagucaggcgu

SEQ ID NO: 85074 - RNA, 22 nt, Human
cccaugacaacagagagcaucu

SEQ ID NO: 85075 - RNA, 21 nt, Human
uucaauacuguaugccuucug

SEQ ID NO: 85076 - RNA, 25 nt, Human
ugugaauuucacuggcaguuuugaa

SEQ ID NO: 85077 - RNA, 27 nt, Human
gguaaaauuauguaaugcaguguuugg

SEQ ID NO: 85078 - RNA, 21 nt, Human
ccuuuucagauuuuucaucug

SEQ ID NO: 85079 - RNA, 19 nt, Human
aaauacuguauauugcaaa

SEQ ID NO: 85080 - RNA, 27 nt, Human
cuucccaaaccucccccauccccucuc

SEQ ID NO: 85081 - RNA, 20 nt, Human
cagagacccaauggucugug

SEQ ID NO: 85082 - RNA, 20 nt, Human
aauuauuugaguacugugaa

SEQ ID NO: 85083 - RNA, 27 nt, Human
gagacuagcuggaaccagggagguaga

SEQ ID NO: 85084 - RNA, 20 nt, Human
auucuauaaaucagucuguu

SEQ ID NO: 85085 - RNA, 23 nt, Human
caagucacugauuuguuuugaac

SEQ ID NO: 85086 - RNA, 21 nt, Human
ugguauaaaucuucugccuuu

SEQ ID NO: 85087 - RNA, 21 nt, Human
gcuggaccuauguccuaagga

SEQ ID NO: 85088 - RNA, 22 nt, Human
ucaaagacucauuucuccuaua

SEQ ID NO: 85089 - RNA, 30 nt, Human
ccaggcagagagcgaccagcaggcuccuca

SEQ ID NO: 85090 - RNA, 24 nt, Human
ccagcuguagugagguugcaguga

SEQ ID NO: 85091 - RNA, 21 nt, Human
gggcuggagggaaggagccag

SEQ ID NO: 85092 - RNA, 20 nt, Human
ggucacauuacaucucucca

SEQ ID NO: 85093 - RNA, 21 nt, Human
gucuggcacucuguguauuua

SEQ ID NO: 85094 - RNA, 25 nt, Human
gcugcuccagucucagccugggcag

SEQ ID NO: 85095 - RNA, 25 nt, Human
auaaggcuucagggcccaaguuggg

SEQ ID NO: 85096 - RNA, 27 nt, Human
agcaguuuggucaacuuaccaacuucc

SEQ ID NO: 85097 - RNA, 16 nt, Human
ucuauugaaugccuug

SEQ ID NO: 85098 - RNA, 27 nt, Human
ucauccagcaccaaaucuuugcuuaug

SEQ ID NO: 85099 - RNA, 23 nt, Human
cacugcacgcuggugcugggagc

SEQ ID NO: 85100 - RNA, 21 nt, Human
accuguaaugccagcccuuug

SEQ ID NO: 85101 - RNA, 25 nt, Human
gccucauuccccauucuguguccca

SEQ ID NO: 85102 - RNA, 22 nt, Human
cugcagcugccagcacuugguc

SEQ ID NO: 85103 - RNA, 24 nt, Human
acauuucaagcggacaaagcacaa

SEQ ID NO: 85104 - RNA, 22 nt, Human
ggggcagccucgucuagcgcgc

SEQ ID NO: 85105 - RNA, 21 nt, Human
cagagugcuuuguagcaggca

SEQ ID NO: 85106 - RNA, 26 nt, Human
gaggggaaggauuuucuucauucugu

SEQ ID NO: 85107 - RNA, 22 nt, Human
accauggagugguagccgagga

SEQ ID NO: 85108 - RNA, 22 nt, Human
acuuuuccuugcagaaagcacu

SEQ ID NO: 85109 - RNA, 20 nt, Human
ucagcauuggccucugugua

SEQ ID NO: 85110 - RNA, 22 nt, Human
uucggagaaaaacgaauaggaa

SEQ ID NO: 85111 - RNA, 25 nt, Human
guggagggagagguggggccccugc

SEQ ID NO: 85112 - RNA, 30 nt, Human
gggaaaggaaagaaaaagaaguaccuagua

SEQ ID NO: 85113 - RNA, 27 nt, Human
uuuuguuuguuuuucaaucucagugaa

SEQ ID NO: 85114 - RNA, 27 nt, Human
cgggaggcagagguugcagugugguga

SEQ ID NO: 85115 - RNA, 19 nt, Human
gcccaacaauaaaugccgc

SEQ ID NO: 85116 - RNA, 22 nt, Human
gagcagacugggcaacauagcg

SEQ ID NO: 85117 - RNA, 19 nt, Human
gggaauuggcccugggaga

SEQ ID NO: 85118 - RNA, 24 nt, Human
ucagggauuuuauuuuuaauuuua

SEQ ID NO: 85119 - RNA, 18 nt, Human
ucuaagauaagacauaua

SEQ ID NO: 85120 - RNA, 21 nt, Human
uucuccaacagaguggugucu

SEQ ID NO: 85121 - RNA, 27 nt, Human
caggauggaggaaugugggcaguuuga

SEQ ID NO: 85122 - RNA, 22 nt, Human
cccaagccugggcuugagcugc

SEQ ID NO: 85123 - RNA, 19 nt, Human
auuauaaaaauuagucggg

SEQ ID NO: 85124 - RNA, 22 nt, Human
gaaaagaaaucauagggccaag

SEQ ID NO: 85125 - RNA, 21 nt, Human
ggcugggauggagcacuucuu

SEQ ID NO: 85126 - RNA, 23 nt, Human
agcucauuuuccagcugcucuuc

SEQ ID NO: 85127 - RNA, 19 nt, Human
gucuuaagagaacuaucca

SEQ ID NO: 85128 - RNA, 23 nt, Human
cugaaagagagugaaaaugcaga

SEQ ID NO: 85129 - RNA, 20 nt, Human
gugggcuggagaggagaagg

SEQ ID NO: 85130 - RNA, 25 nt, Human
aggugcaggugcccugaaugcaggu

SEQ ID NO: 85131 - RNA, 22 nt, Human
ucuguuaccuguuuuccagaaa

SEQ ID NO: 85132 - RNA, 20 nt, Human
agaugucccuuugauggccc

SEQ ID NO: 85133 - RNA, 22 nt, Human
aggcuaguaaggaaacugcauc

SEQ ID NO: 85134 - RNA, 22 nt, Human
accucuaacacgcacagcugaa

SEQ ID NO: 85135 - RNA, 27 nt, Human
gggaaaaaagaaaaaccugcucccuuu

SEQ ID NO: 85136 - RNA, 22 nt, Human
ugucacccaggcugcaguucac

SEQ ID NO: 85137 - RNA, 22 nt, Human
ucuccgccaagucacugcccag

SEQ ID NO: 85138 - RNA, 19 nt, Human
cuccacccucggucacccc

SEQ ID NO: 85139 - RNA, 22 nt, Human
ccacugcacuccagccugggcg

SEQ ID NO: 85140 - RNA, 22 nt, Human
caaacuucuuagcgcaagcaau

SEQ ID NO: 85141 - RNA, 22 nt, Human
ccaacuuccuguggccugaaga

SEQ ID NO: 85142 - RNA, 22 nt, Human
accagcuuagccaacauaguaa

SEQ ID NO: 85143 - RNA, 22 nt, Human
agagauggcuccagacaccccg

SEQ ID NO: 85144 - RNA, 22 nt, Human
agguccacaccagccugggcaa

SEQ ID NO: 85145 - RNA, 20 nt, Human
auauuucuggguucucaauu

SEQ ID NO: 85146 - RNA, 28 nt, Human
gagaggacagggcuggaggcagccaagu

SEQ ID NO: 85147 - RNA, 24 nt, Human
uacuauucaaugcaaugcaauuca

SEQ ID NO: 85148 - RNA, 24 nt, Human
ugcagaaacaguuucuccuccucc

SEQ ID NO: 85149 - RNA, 26 nt, Human
ugacaccuuuucagguuggagugcau

SEQ ID NO: 85150 - RNA, 23 nt, Human
gaauccucuaguuuuaagacuga

SEQ ID NO: 85151 - RNA, 22 nt, Human
uucauucuuucucacuuugcca

SEQ ID NO: 85152 - RNA, 22 nt, Human
gggacccuuggcuccugugucu

SEQ ID NO: 85153 - RNA, 21 nt, Human
cauucugcuccuuccccaucg

SEQ ID NO: 85154 - RNA, 22 nt, Human
gaccuugaaaagaacaugcuca

SEQ ID NO: 85155 - RNA, 20 nt, Human
uugguuccuguauauuccau

SEQ ID NO: 85156 - RNA, 24 nt, Human
uccccgugcggauuccagaccaaa

SEQ ID NO: 85157 - RNA, 26 nt, Human
uguaaucccagcacuuuggcaggcca

SEQ ID NO: 85158 - RNA, 21 nt, Human
uucuacaaauguaauuuuaaa

SEQ ID NO: 85159 - RNA, 21 nt, Human
acucagaggcugacacugaca

SEQ ID NO: 85160 - RNA, 22 nt, Human
acauguuugcaguguuaagaua

SEQ ID NO: 85161 - RNA, 26 nt, Human
gggacagguguccaguugcugggccg

SEQ ID NO: 85162 - RNA, 22 nt, Human
gcaccuuguucuccaagaacuu

SEQ ID NO: 85163 - RNA, 25 nt, Human
acaucccucagccccacaggcacga

SEQ ID NO: 85164 - RNA, 24 nt, Human
uaggauucuccuguuucaucuggg

SEQ ID NO: 85165 - RNA, 23 nt, Human
gaaagagaucgcagcagggguga

SEQ ID NO: 85166 - RNA, 20 nt, Human
aagugccuagauaucauuuu

SEQ ID NO: 85167 - RNA, 21 nt, Human
ggaaaaaauagaguucaagaa

SEQ ID NO: 85168 - RNA, 21 nt, Human
gccaggagggucuucccaaga

SEQ ID NO: 85169 - RNA, 22 nt, Human
ggagaguuuauucacugucuua

SEQ ID NO: 85170 - RNA, 23 nt, Human
cuauaaagagaacugcuuuuaac

SEQ ID NO: 85171 - RNA, 27 nt, Human
agcuucugagcuagagcuguacugccu

SEQ ID NO: 85172 - RNA, 21 nt, Human
ucuucauuccuugcugcucac

SEQ ID NO: 85173 - RNA, 20 nt, Human
gcucuucugcuagugcccug

SEQ ID NO: 85174 - RNA, 21 nt, Human
cuaccugcaugcuguuccuuu

SEQ ID NO: 85175 - RNA, 25 nt, Human
ucauuaagcccucuuccaucauguc

SEQ ID NO: 85176 - RNA, 22 nt, Human
ccaaguagcugggacuauaggc

SEQ ID NO: 85177 - RNA, 23 nt, Human
uguuaaaaugggaucaucaucuu

SEQ ID NO: 85178 - RNA, 27 nt, Human
guugcaacccauguggugauaaggcuc

SEQ ID NO: 85179 - RNA, 30 nt, Human
uuccaccaggagucuggagugcaauggcac

SEQ ID NO: 85180 - RNA, 19 nt, Human
ugccuaaggcaaagaaaua

SEQ ID NO: 85181 - RNA, 19 nt, Human
acuuucuccucccucugcc

SEQ ID NO: 85182 - RNA, 22 nt, Human
uguugcccaggcuggagugcau

SEQ ID NO: 85183 - RNA, 22 nt, Human
gguggggacucugaccuggggg

SEQ ID NO: 85184 - RNA, 22 nt, Human
cuguagucccagcuaccuggga

SEQ ID NO: 85185 - RNA, 20 nt, Human
aacagcuuggacuguuugga

SEQ ID NO: 85186 - RNA, 27 nt, Human
uggagaaacuguagucucaggaccuag

SEQ ID NO: 85187 - RNA, 21 nt, Human
ccuccuccugcuccaagggcc

SEQ ID NO: 85188 - RNA, 21 nt, Human
ugguagaguccuaggacaucu

SEQ ID NO: 85189 - RNA, 21 nt, Human
ccccaucucccugccuggccc

SEQ ID NO: 85190 - RNA, 22 nt, Human
uuuuaauaaaacauuacuuauu

SEQ ID NO: 85191 - RNA, 21 nt, Human
gcuaagcaucuccuuacaguc

SEQ ID NO: 85192 - RNA, 26 nt, Human
gaaaucaagauguuauuuuuguauac

SEQ ID NO: 85193 - RNA, 25 nt, Human
gugugaucacagcucacugcagccu

SEQ ID NO: 85194 - RNA, 25 nt, Human
guaugaucacggcucacugcagccu

SEQ ID NO: 85195 - RNA, 21 nt, Human
uacagggugcucugugcuuau

SEQ ID NO: 85196 - RNA, 27 nt, Human
uggccagcauggugaaaccccgucugu

SEQ ID NO: 85197 - RNA, 23 nt, Human
gggguucccccugcugaggagag

SEQ ID NO: 85198 - RNA, 26 nt, Human
acaaaugauacaaauggugccaggga

SEQ ID NO: 85199 - RNA, 23 nt, Human
ugcuuuggggugucuggccucag

SEQ ID NO: 85200 - RNA, 22 nt, Human
cccucauuucucucugcaaucu

SEQ ID NO: 85201 - RNA, 19 nt, Human
uacugaaagcucugccuuc

SEQ ID NO: 85202 - RNA, 22 nt, Human
gccuguugagccccauucuaca

SEQ ID NO: 85203 - RNA, 25 nt, Human
ucuucccucagcuucccagaaugcc

SEQ ID NO: 85204 - RNA, 23 nt, Human
ugacugugccacugcaccucuag

SEQ ID NO: 85205 - RNA, 19 nt, Human
cugacaugucacuugcccc

SEQ ID NO: 85206 - RNA, 20 nt, Human
guccuaccccuuccucucca

SEQ ID NO: 85207 - RNA, 20 nt, Human
gguagaaagagaagacccag

SEQ ID NO: 85208 - RNA, 25 nt, Human
gugauguucuuagcacuuuaauucc

SEQ ID NO: 85209 - RNA, 19 nt, Human
aguuccaccuccgcgccuc

SEQ ID NO: 85210 - RNA, 24 nt, Human
ggcaacuugaagaaacgcuucaga

SEQ ID NO: 85211 - RNA, 22 nt, Human
gaagaaggggagaggagguugu

SEQ ID NO: 85212 - RNA, 23 nt, Human
uugggagcuugggcaggccagcu

SEQ ID NO: 85213 - RNA, 22 nt, Human
cguguucuguaaucaaacugca

SEQ ID NO: 85214 - RNA, 21 nt, Human
aucaugccaccgacgggccac

SEQ ID NO: 85215 - RNA, 21 nt, Human
ugaccucaggccuacgcuuug

SEQ ID NO: 85216 - RNA, 22 nt, Human
uaccacugccucuagacuaagg

SEQ ID NO: 85217 - RNA, 25 nt, Human
uguugccuccccucucugagccccc

SEQ ID NO: 85218 - RNA, 21 nt, Human
ccuaguuuuuauacaugugua

SEQ ID NO: 85219 - RNA, 26 nt, Human
aaacucaagacaaugcaccuagcugu

SEQ ID NO: 85220 - RNA, 25 nt, Human
ggcauccauagugcacuagcauuuu

SEQ ID NO: 85221 - RNA, 22 nt, Human
auccuguuagauugccaguucc

SEQ ID NO: 85222 - RNA, 24 nt, Human
cccaagaacuccugaaaucauaua

SEQ ID NO: 85223 - RNA, 21 nt, Human
gcucacugcaacuuccgcauc

SEQ ID NO: 85224 - RNA, 25 nt, Human
gggaugcugggauucuugccuguau

SEQ ID NO: 85225 - RNA, 21 nt, Human
caguucugacugaaccaugcc

SEQ ID NO: 85226 - RNA, 21 nt, Human
ccaaagccccgcacacagggc

SEQ ID NO: 85227 - RNA, 23 nt, Human
ugagggguagugggauggugggg

SEQ ID NO: 85228 - RNA, 28 nt, Human
ggcgggggccccacagggccaccuucuu

SEQ ID NO: 85229 - RNA, 22 nt, Human
caccaggcuggagugcagugcc

SEQ ID NO: 85230 - RNA, 20 nt, Human
uucacccucacccugaggcc

SEQ ID NO: 85231 - RNA, 26 nt, Human
agcccuggcuggagagcgggacgugg

SEQ ID NO: 85232 - RNA, 29 nt, Human
gcagaagguggaaggugggaacagagguu

SEQ ID NO: 85233 - RNA, 20 nt, Human
aucauuaugcauucaguugg

SEQ ID NO: 85234 - RNA, 21 nt, Human
cgucccugggaggggagggag

SEQ ID NO: 85235 - RNA, 23 nt, Human
gugggccuuaguuuucugcagcu

SEQ ID NO: 85236 - RNA, 25 nt, Human
ggcccugccuucugccgcauccccg

SEQ ID NO: 85237 - RNA, 22 nt, Human
cuccugagcccagacaccucac

SEQ ID NO: 85238 - RNA, 25 nt, Human
ccccaacagaagagaaagacugaag

SEQ ID NO: 85239 - RNA, 22 nt, Human
ccuuuugucucccaagggaaga

SEQ ID NO: 85240 - RNA, 26 nt, Human
gcugucaucugcagccucugccucca

SEQ ID NO: 85241 - RNA, 21 nt, Human
agcuaacaauaaagugugagg

SEQ ID NO: 85242 - RNA, 22 nt, Human
uggccuagaaguccucuguggu

SEQ ID NO: 85243 - RNA, 19 nt, Human
acaacugauaaugugcaaa

SEQ ID NO: 85244 - RNA, 21 nt, Human
uucaaaccacugauguugaua

SEQ ID NO: 85245 - RNA, 21 nt, Human
ggcccuguauuuucaaauucu

SEQ ID NO: 85246 - RNA, 22 nt, Human
uuuuggucagaugaaacugcau

SEQ ID NO: 85247 - RNA, 24 nt, Human
caggcugggguggacucagaugcc

SEQ ID NO: 85248 - RNA, 27 nt, Human
cuugacagagccucuacuucugucuca

SEQ ID NO: 85249 - RNA, 21 nt, Human
ugcucuguguccucugcucca

SEQ ID NO: 85250 - RNA, 22 nt, Human
ggauaaauagaaaaacugaauc

SEQ ID NO: 85251 - RNA, 20 nt, Human
uuuaaccuugcugacaucca

SEQ ID NO: 85252 - RNA, 25 nt, Human
aggcagaguggagagggagagacgg

SEQ ID NO: 85253 - RNA, 27 nt, Human
acuuucuucccccucacgaggcugggg

SEQ ID NO: 85254 - RNA, 21 nt, Human
ugugaggaagagguugcagug

SEQ ID NO: 85255 - RNA, 22 nt, Human
uaaaacaauuugggggccaggc

SEQ ID NO: 85256 - RNA, 21 nt, Human
guuggucucgaacuccugggc

SEQ ID NO: 85257 - RNA, 26 nt, Human
acuuggugaaaggaagaugccccgac

SEQ ID NO: 85258 - RNA, 18 nt, Human
cucuuaccuucccgccuc

SEQ ID NO: 85259 - RNA, 26 nt, Human
ggcucuggaccagcggcaggagcagc

SEQ ID NO: 85260 - RNA, 25 nt, Human
uccucaaauucauauucacaggguc

SEQ ID NO: 85261 - RNA, 24 nt, Human
ugucaugccacauuucacugauug

SEQ ID NO: 85262 - RNA, 23 nt, Human
gcaaugguacacuacaaaugugc

SEQ ID NO: 85263 - RNA, 22 nt, Human
guagagacauaacugacuuuug

SEQ ID NO: 85264 - RNA, 18 nt, Human
guagaggaagugugcaga

SEQ ID NO: 85265 - RNA, 24 nt, Human
uagcucuuccaguagaggggugag

SEQ ID NO: 85266 - RNA, 21 nt, Human
ggugaggacagcaggaggggc

SEQ ID NO: 85267 - RNA, 25 nt, Human
ccuggacuccugugugccuccugcc

SEQ ID NO: 85268 - RNA, 23 nt, Human
uccagccuuggaaucuaacgggc

SEQ ID NO: 85269 - RNA, 22 nt, Human
cucacacucagugcuccauucc

SEQ ID NO: 85270 - RNA, 22 nt, Human
cauuccccgcgccccuccagcc

SEQ ID NO: 85271 - RNA, 26 nt, Human
ugcagggaugcggcggcgggagcagc

SEQ ID NO: 85272 - RNA, 22 nt, Human
gguaacaguuagauguuuccua

SEQ ID NO: 85273 - RNA, 26 nt, Human
ccccacuacauacagagaaacuauca

SEQ ID NO: 85274 - RNA, 21 nt, Human
uugacaccuccaguccggcca

SEQ ID NO: 85275 - RNA, 21 nt, Human
ugcuggcauuugcaccuaccu

SEQ ID NO: 85276 - RNA, 22 nt, Human
gggccuggggcucuagcccaag

SEQ ID NO: 85277 - RNA, 24 nt, Human
uguccagggcagugaguccucuac

SEQ ID NO: 85278 - RNA, 22 nt, Human
cuguagucccagcuacucgaga

SEQ ID NO: 85279 - RNA, 23 nt, Human
cccugcuggccucuuguggagcc

SEQ ID NO: 85280 - RNA, 19 nt, Human
guuucauccuucccacucu

SEQ ID NO: 85281 - RNA, 21 nt, Human
cuuggccauauauuugcucaa

SEQ ID NO: 85282 - RNA, 21 nt, Human
gggaaugcaggaagguuuugc

SEQ ID NO: 85283 - RNA, 22 nt, Human
cgccucccagguucaagugauu

SEQ ID NO: 85284 - RNA, 20 nt, Human
uuuaaacaaaagauauuauu

SEQ ID NO: 85285 - RNA, 20 nt, Human
ugggagccggaggcugcagu

SEQ ID NO: 85286 - RNA, 22 nt, Human
ccaaguagcuaggacugcaggc

SEQ ID NO: 85287 - RNA, 25 nt, Human
aggcaaacggcaugcuaucacaaga

SEQ ID NO: 85288 - RNA, 25 nt, Human
cucucuuuuggaaguaugauuuuuu

SEQ ID NO: 85289 - RNA, 25 nt, Human
cucugcgcugggguccgacugcccu

SEQ ID NO: 85290 - RNA, 22 nt, Human
ccagcaaugugguuccugugca

SEQ ID NO: 85291 - RNA, 22 nt, Human
ugcuugaacccgggaggcagag

SEQ ID NO: 85292 - RNA, 20 nt, Human
uagacuuuugacaaauucuu

SEQ ID NO: 85293 - RNA, 28 nt, Human
uagaacaugauguuaaaugagaccagac

SEQ ID NO: 85294 - RNA, 24 nt, Human
ggcucacugcagccucgaacuccu

SEQ ID NO: 85295 - RNA, 24 nt, Human
agcucacugcagccucaaacuccu

SEQ ID NO: 85296 - RNA, 24 nt, Human
uguuuggccugccccagugcagug

SEQ ID NO: 85297 - RNA, 21 nt, Human
ugcaaggguucucuucugugu

SEQ ID NO: 85298 - RNA, 25 nt, Human
caccaguccccagcugcagaccuuc

SEQ ID NO: 85299 - RNA, 20 nt, Human
gagcuacagucuucauuuua

SEQ ID NO: 85300 - RNA, 22 nt, Human
cugggaggagcugagugugaug

SEQ ID NO: 85301 - RNA, 25 nt, Human
agucugcucugggcggaagagcuuu

SEQ ID NO: 85302 - RNA, 23 nt, Human
gacagaaaacucuaguucaagag

SEQ ID NO: 85303 - RNA, 21 nt, Human
uuugauucucucgauccuggc

SEQ ID NO: 85304 - RNA, 23 nt, Human
cuuaaaguaaaaacuacaugauu

SEQ ID NO: 85305 - RNA, 20 nt, Human
agcgcauucauucacauagc

SEQ ID NO: 85306 - RNA, 21 nt, Human
augcagacauaaaaauagcaa

SEQ ID NO: 85307 - RNA, 19 nt, Human
aagugggggcuguacuggg

SEQ ID NO: 85308 - RNA, 20 nt, Human
uucuggucaguaugaugcag

SEQ ID NO: 85309 - RNA, 22 nt, Human
ucccacugggguccagggagca

SEQ ID NO: 85310 - RNA, 21 nt, Human
gcuuuacugccuuccuccuua

SEQ ID NO: 85311 - RNA, 24 nt, Human
ggccuucugccuugagcugggacu

SEQ ID NO: 85312 - RNA, 20 nt, Human
caacagcaucuggucuacua

SEQ ID NO: 85313 - RNA, 21 nt, Human
ucuagccccuguccucuuaga

SEQ ID NO: 85314 - RNA, 25 nt, Human
cccaggcgugcagguucucuuugag

SEQ ID NO: 85315 - RNA, 22 nt, Human
ugaagcucgugacaagugccuu

SEQ ID NO: 85316 - RNA, 22 nt, Human
ugcagugagccauguucacacc

SEQ ID NO: 85317 - RNA, 22 nt, Human
guuccgcacuguucuugcagug

SEQ ID NO: 85318 - RNA, 31 nt, Human; identical to SEQ ID NO: 4792

SEQ ID NO: 85319 - RNA, 25 nt, Human
gccaugucacuagaagcgcaguuua

SEQ ID NO: 85320 - RNA, 22 nt, Human
ccugggcaacagagcgagacca

SEQ ID NO: 85321 - RNA, 26 nt, Human
cuccacccuguuuguucccacaugug

SEQ ID NO: 85322 - RNA, 22 nt, Human
uuugagccucagaccccagggc

SEQ ID NO: 85323 - RNA, 21 nt, Human
ugcagccagaacagguggcug

SEQ ID NO: 85324 - RNA, 19 nt, Human
gacagcucaccuagcggca

SEQ ID NO: 85325 - RNA, 20 nt, Human
gcaugguauaaggaaauauc

SEQ ID NO: 85326 - RNA, 25 nt, Human
uguacuuagagcguggacugugaac

SEQ ID NO: 85327 - RNA, 23 nt, Human
uucacucaggcuggaauguagug

SEQ ID NO: 85328 - RNA, 26 nt, Human
ccuggaccucuaugucaacaugacag

SEQ ID NO: 85329 - RNA, 24 nt, Human
gggggagaagagugcgcaggucag

SEQ ID NO: 85330 - RNA, 23 nt, Human
gagagaaaagacagggacuuuga

SEQ ID NO: 85331 - RNA, 26 nt, Human
ccaggauauguuugcgggggugggug

SEQ ID NO: 85332 - RNA, 22 nt, Human
agcacagacuuggauuccuucu

SEQ ID NO: 85333 - RNA, 21 nt, Human
aauguuccuuugucucugaca

SEQ ID NO: 85334 - RNA, 21 nt, Human
gcgagggagagagaggacacc

SEQ ID NO: 85335 - RNA, 22 nt, Human
uauauuguuugcuaagcauucc

SEQ ID NO: 85336 - RNA, 23 nt, Human
gcugggugaggcggcucacaccu

SEQ ID NO: 85337 - RNA, 24 nt, Human
ggucauguacucagcucaugacag

SEQ ID NO: 85338 - RNA, 22 nt, Human
gcccccacuaggcacuguggcu

SEQ ID NO: 85339 - RNA, 27 nt, Human
gucaacuuauucuuugaguaaugugac

SEQ ID NO: 85340 - RNA, 26 nt, Human
agacgcuggucaguucaccugcccca

SEQ ID NO: 85341 - RNA, 25 nt, Human
cccucccguccccagggcagauuug

SEQ ID NO: 85342 - RNA, 26 nt, Human
ggcucauaccuguuauaccagcacuu

SEQ ID NO: 85343 - RNA, 21 nt, Human
gcauaugccucacuacugccu

SEQ ID NO: 85344 - RNA, 17 nt, Human
gacacugaaaugccuua

SEQ ID NO: 85345 - RNA, 29 nt, Human
ugggaagagagagggacagggacaagggc

SEQ ID NO: 85346 - RNA, 19 nt, Human
ggagguggauggggaggau

SEQ ID NO: 85347 - RNA, 21 nt, Human
cuuccuggcucacuaucucca

SEQ ID NO: 85348 - RNA, 22 nt, Human
gucuccaaaccagacggugacg

SEQ ID NO: 85349 - RNA, 26 nt, Human
ggccagaaucauuauccuugaaauuu

SEQ ID NO: 85350 - RNA, 25 nt, Human
ucagcaaauuuauaucaccaucuua

SEQ ID NO: 85351 - RNA, 21 nt, Human
guaauuaucuuccaugaaagc

SEQ ID NO: 85352 - RNA, 22 nt, Human
cucuugaagccaaacuccaccu

SEQ ID NO: 85353 - RNA, 22 nt, Human
uacaccucgucaagagcaugca

SEQ ID NO: 85354 - RNA, 21 nt, Human
ggaagacgccuuucuccucca

SEQ ID NO: 85355 - RNA, 20 nt, Human
uacuuaaccaaaaacaaaua

SEQ ID NO: 85356 - RNA, 23 nt, Human
guucuaauuauauaaguguguuu

SEQ ID NO: 85357 - RNA, 20 nt, Human
uuaaguuuacaaaucagauu

SEQ ID NO: 85358 - RNA, 29 nt, Human
aagcacuuaaccauuucucuuucuucuua

SEQ ID NO: 85359 - RNA, 22 nt, Human
ccaaagagcugggauuacaggu

SEQ ID NO: 85360 - RNA, 22 nt, Human
gcccaggcuggagugcagugag

SEQ ID NO: 85361 - RNA, 27 nt, Human
aauccacaaagauucugggcagcugcc

SEQ ID NO: 85362 - RNA, 28 nt, Human
gucagcccaggcugcugggcuguagcca

SEQ ID NO: 85363 - RNA, 27 nt, Human
ggcaaagugagugaccugcuuuugggg

SEQ ID NO: 85364 - RNA, 20 nt, Human
cauugagaugagaaugggua

SEQ ID NO: 85365 - RNA, 23 nt, Human
ccuaauaaucaucaccacaccgg

SEQ ID NO: 85366 - RNA, 25 nt, Human
aauaagaacaacuguccuggcugga

SEQ ID NO: 85367 - RNA, 21 nt, Human
ucccuaagccaacaggguaua

SEQ ID NO: 85368 - RNA, 24 nt, Human
gguucaagcgauucuccuaccuca

SEQ ID NO: 85369 - RNA, 22 nt, Human
gaacccaggaggcggagguugu

SEQ ID NO: 85370 - RNA, 20 nt, Human
cagcagccacugcacaggag

SEQ ID NO: 85371 - RNA, 22 nt, Human
ucauggaaaagcccagugaccu

SEQ ID NO: 85372 - RNA, 27 nt, Human
uaucugugucuaagcacaauaucuuca

SEQ ID NO: 85373 - RNA, 26 nt, Human
ccugcucuccuuuggguguaugcagg

SEQ ID NO: 85374 - RNA, 20 nt, Human
aguuuauagaccagaaccag

SEQ ID NO: 85375 - RNA, 24 nt, Human
accacucuaucaaguauuauaccu

SEQ ID NO: 85376 - RNA, 26 nt, Human
aggacuuggggcaggaaaggaaugcu

SEQ ID NO: 85377 - RNA, 25 nt, Human
ggaaugggggaagaggaggagcagg

SEQ ID NO: 85378 - RNA, 22 nt, Human
gagucaaguggagucacugccu

SEQ ID NO: 85379 - RNA, 23 nt, Human
gcacagccccggcuccggcuccu

SEQ ID NO: 85380 - RNA, 23 nt, Human
cuuuucacccugcccccugggcc

SEQ ID NO: 85381 - RNA, 21 nt, Human
cuaucacccaggcuggagugc

SEQ ID NO: 85382 - RNA, 23 nt, Human
caggccuguacucaucggcaggu

SEQ ID NO: 85383 - RNA, 23 nt, Human
ccagggcagaggacucucugggc

SEQ ID NO: 85384 - RNA, 20 nt, Human
caggaaaguggcagacagaa

SEQ ID NO: 85385 - RNA, 32 nt, Human
ccgacaugggcaacaugacaagaccccaucuc

SEQ ID NO: 85386 - RNA, 22 nt, Human
caccaggucacugcagccagag

SEQ ID NO: 85387 - RNA, 22 nt, Human
aacuuaagugagagagaaaggg

SEQ ID NO: 85388 - RNA, 22 nt, Human
aguggcaugaucucgacucacu

SEQ ID NO: 85389 - RNA, 22 nt, Human
uuucguuaaucuugcugcuuau

SEQ ID NO: 85390 - RNA, 20 nt, Human
cucccuccccaccccaacca

SEQ ID NO: 85391 - RNA, 21 nt, Human
uguggagggacuccugggaca

SEQ ID NO: 85392 - RNA, 26 nt, Human
uuguaaccuagggcuuccuggaaguu

SEQ ID NO: 85393 - RNA, 22 nt, Human
accgcgccagacccagacagag

SEQ ID NO: 85394 - RNA, 26 nt, Human
ucuggcuucucuccucagacuucuau

SEQ ID NO: 85395 - RNA, 24 nt, Human
cuuacccagcaucuggaguacagg

SEQ ID NO: 85396 - RNA, 24 nt, Human
cucagcucucccuugaguggcacu

SEQ ID NO: 85397 - RNA, 24 nt, Human
ccaaggauucuuccaccucccaac

SEQ ID NO: 85398 - RNA, 22 nt, Human
accagccuguccaacaugguga

SEQ ID NO: 85399 - RNA, 21 nt, Human
cucaugggcaagaucuuucag

SEQ ID NO: 85400 - RNA, 21 nt, Human
ccacugcaaucaaugugucau

SEQ ID NO: 85401 - RNA, 30 nt, Human
gcuugaaaguacuggagcacguggucaggg

SEQ ID NO: 85402 - RNA, 22 nt, Human
ccucauucaguuucugggguca

SEQ ID NO: 85403 - RNA, 22 nt, Human
ugcacacacagaaggggaccug

SEQ ID NO: 85404 - RNA, 26 nt, Human
acugccccacugccugucccuucugg

SEQ ID NO: 85405 - RNA, 27 nt, Human
ucagcaacaaugccucuguucaaacuc

SEQ ID NO: 85406 - RNA, 20 nt, Human
uuuacuuccucucugagugg

SEQ ID NO: 85407 - RNA, 23 nt, Human
cacacccuuuuaauaaugcucag

SEQ ID NO: 85408 - RNA, 29 nt, Human
ucuuuucuuugcccuccugauucuuggcu

SEQ ID NO: 85409 - RNA, 27 nt, Human
agcuuaaacugaauuuguauuucauuu

SEQ ID NO: 85410 - RNA, 21 nt, Human
uccuucucggcuuccuccuca

SEQ ID NO: 85411 - RNA, 20 nt, Human
cugcucccugcccuccuggg

SEQ ID NO: 85412 - RNA, 26 nt, Human
cucugccucccggguucaagcgauuc

SEQ ID NO: 85413 - RNA, 21 nt, Human
ucgcccagacuggagugcagu

SEQ ID NO: 85414 - RNA, 21 nt, Human
ucgcccaggcuggaguacagu

SEQ ID NO: 85415 - RNA, 26 nt, Human
ucauuugaaccuggauccagcacugg

SEQ ID NO: 85416 - RNA, 19 nt, Human
agaccucaugacagcugga

SEQ ID NO: 85417 - RNA, 24 nt, Human
ggccugguggaguuggugggucau

SEQ ID NO: 85418 - RNA, 21 nt, Human
uuuccucccuuuuccuguaca

SEQ ID NO: 85419 - RNA, 21 nt, Human
gguugugguguagacuguguc

SEQ ID NO: 85420 - RNA, 20 nt, Human
cccaggcagggucugucacc

SEQ ID NO: 85421 - RNA, 25 nt, Human
ccgucucucacuggauuggugccac

SEQ ID NO: 85422 - RNA, 25 nt, Human
gcuucuuuggaucucaggcucuagg

SEQ ID NO: 85423 - RNA, 23 nt, Human
gcacucugcaaccaguguugccu

SEQ ID NO: 85424 - RNA, 24 nt, Human
cucuccagacccaggaugccgggg

SEQ ID NO: 85425 - RNA, 27 nt, Human
uuuuuguaucacauuauaaaucccacu

SEQ ID NO: 85426 - RNA, 22 nt, Human
uggccaacauggcaaaaccaca

SEQ ID NO: 85427 - RNA, 20 nt, Human
ggauuucagaguuaaccuca

SEQ ID NO: 85428 - RNA, 22 nt, Human
ccuuuucuccccucucuggguu

SEQ ID NO: 85429 - RNA, 24 nt, Human
gaugccauccgcugccaccuccuu

SEQ ID NO: 85430 - RNA, 25 nt, Human
gggaggcauggcuuuccaccgucgg

SEQ ID NO: 85431 - RNA, 27 nt, Human
ccggaaagaagagcgagagaucaaaga

SEQ ID NO: 85432 - RNA, 23 nt, Human
uggccucucccaugucucagugu

SEQ ID NO: 85433 - RNA, 22 nt, Human
ccccuuuaguuuccaaccuucu

SEQ ID NO: 85434 - RNA, 20 nt, Human
caacuguuucuagaugcuuc

SEQ ID NO: 85435 - RNA, 26 nt, Human
acugcagccucgaccuccuggacuca

SEQ ID NO: 85436 - RNA, 22 nt, Human
uuugauuucaagaucucuuaga

SEQ ID NO: 85437 - RNA, 24 nt, Human
agcugcuggcugggcaaguguuca

SEQ ID NO: 85438 - RNA, 24 nt, Human
gacccuguacacuccuccuuuucu

SEQ ID NO: 85439 - RNA, 25 nt, Human
uuuccacccugucccuaucucuacc

SEQ ID NO: 85440 - RNA, 23 nt, Human
aggcaaaucaccgggcagaggga

SEQ ID NO: 85441 - RNA, 23 nt, Human
cuggguccccaguguucgcugug

SEQ ID NO: 85442 - RNA, 23 nt, Human
uucacuggagggcccagccuggg

SEQ ID NO: 85443 - RNA, 22 nt, Human
uguagccuggccagaccccaga

SEQ ID NO: 85444 - RNA, 25 nt, Human
cccacucaggggcugagaguagcuu

SEQ ID NO: 85445 - RNA, 23 nt, Human
aagcuggagugcaguggugcgau

SEQ ID NO: 85446 - RNA, 19 nt, Human
uuuaucucuucauuuugga

SEQ ID NO: 85447 - RNA, 20 nt, Human
aaagccuguaucucugugau

SEQ ID NO: 85448 - RNA, 22 nt, Human
ugccccuucccaaucagcacug

SEQ ID NO: 85449 - RNA, 25 nt, Human
uggaccugagacacuguggcugucu

SEQ ID NO: 85450 - RNA, 23 nt, Human
uuguaucuguuuucuacuuuaug

SEQ ID NO: 85451 - RNA, 24 nt, Human
ucucuaugccagcucagucccauc

SEQ ID NO: 85452 - RNA, 23 nt, Human
cgcccucuuuuguccucuuccca

SEQ ID NO: 85453 - RNA, 26 nt, Human
cgcuuugcuggaaaugucaagcaaau

SEQ ID NO: 85454 - RNA, 22 nt, Human
cagccuauucaguuccuuuguu

SEQ ID NO: 85455 - RNA, 22 nt, Human
gggacaagggcaagaggacuga

SEQ ID NO: 85456 - RNA, 24 nt, Human
gcugcugcagucucggucucucuc

SEQ ID NO: 85457 - RNA, 27 nt, Human
gaugcagagaugaccucucgcugccuc

SEQ ID NO: 85458 - RNA, 22 nt, Human
agaacucugugucagccacuuu

SEQ ID NO: 85459 - RNA, 28 nt, Human
uucauucucaggcugggguggacucaga

SEQ ID NO: 85460 - RNA, 27 nt, Human
cacaucugucugcaggcugucucucca

SEQ ID NO: 85461 - RNA, 23 nt, Human
ccuccugcacuccacaugaugag

SEQ ID NO: 85462 - RNA, 20 nt, Human
gccacuccagcuccuggguu

SEQ ID NO: 85463 - RNA, 24 nt, Human
ccacgcuggagugcugugaugcga

SEQ ID NO: 85464 - RNA, 22 nt, Human
ucuaagauaaaagcuuaggcug

SEQ ID NO: 85465 - RNA, 22 nt, Human
uuaguucuuaaugucucaguuu

SEQ ID NO: 85466 - RNA, 22 nt, Human
cgcuugaacccaggaggcagag

SEQ ID NO: 85467 - RNA, 20 nt, Human
cugaaugguucacugcagcu

SEQ ID NO: 85468 - RNA, 24 nt, Human
gaucccacucuucuugcagcuguu

SEQ ID NO: 85469 - RNA, 21 nt, Human
agacagggucuugcucuguca

SEQ ID NO: 85470 - RNA, 19 nt, Human
agucggcagaucaugggac

SEQ ID NO: 85471 - RNA, 23 nt, Human
ggcugggcugugguggggugggg

SEQ ID NO: 85472 - RNA, 23 nt, Human
cuuugauuugcuucccagucaca

SEQ ID NO: 85473 - RNA, 22 nt, Human
gaccagccucaucaacacagug

SEQ ID NO: 85474 - RNA, 28 nt, Human
gacuaaagaccugcuguaauaaauguau

SEQ ID NO: 85475 - RNA, 23 nt, Human
ugauuauucuguaucagaaauga

SEQ ID NO: 85476 - RNA, 20 nt, Human
cccauagcugggacuacagg

SEQ ID NO: 85477 - RNA, 26 nt, Human
gcuaucucucucauagcuuuuaugcc

SEQ ID NO: 85478 - RNA, 22 nt, Human
cgggaggcggagguugcaguga

SEQ ID NO: 85479 - RNA, 22 nt, Human
agccauucuauuguguucuacu

SEQ ID NO: 85480 - RNA, 21 nt, Human
acagugagccuugauuguguc

SEQ ID NO: 85481 - RNA, 24 nt, Human
guuuucuuuuaaaaaugcuuguug

SEQ ID NO: 85482 - RNA, 27 nt, Human
cgccacugcacuccagccucagcaaua

SEQ ID NO: 85483 - RNA, 22 nt, Human
uccuucuugacaaauuguguuu

SEQ ID NO: 85484 - RNA, 24 nt, Human
accaaggagccugagcccaggaag

SEQ ID NO: 85485 - RNA, 23 nt, Human
ccaaaucaccaguauuugcuuau

SEQ ID NO: 85486 - RNA, 26 nt, Human
cacgcuaccccgucccccuccagacu

SEQ ID NO: 85487 - RNA, 21 nt, Human
cgucccgcuggaguggccaug

SEQ ID NO: 85488 - RNA, 27 nt, Human
uucuccugguccugugcaucuucugca

SEQ ID NO: 85489 - RNA, 27 nt, Human
cuccuguauaaauccaaccucuggguc

SEQ ID NO: 85490 - RNA, 21 nt, Human
gcugugccaucgucauagugc

SEQ ID NO: 85491 - RNA, 23 nt, Human
agaccugaaaccucaccuugcac

SEQ ID NO: 85492 - RNA, 19 nt, Human
gcuggcccaggucuucauu

SEQ ID NO: 85493 - RNA, 23 nt, Human
acuccgagaagugcuguggucuc

SEQ ID NO: 85494 - RNA, 19 nt, Human
cacugcacugucugagaau

SEQ ID NO: 85495 - RNA, 20 nt, Human
uuuuucuucagacugaggcc

SEQ ID NO: 85496 - RNA, 22 nt, Human
auuguauugucugacacaugcu

SEQ ID NO: 85497 - RNA, 27 nt, Human
uuggcccaguuugggccaguccauuuu

SEQ ID NO: 85498 - RNA, 23 nt, Human
ccaacauggugaaaaccccaucu

SEQ ID NO: 85499 - RNA, 27 nt, Human
gcucacugcagcuuugaucugaccgcu

SEQ ID NO: 85500 - RNA, 26 nt, Human
uugcccaggcuggucuugaaccccug

SEQ ID NO: 85501 - RNA, 20 nt, Human
cuaggcuuggcacugccuuu

SEQ ID NO: 85502 - RNA, 21 nt, Human
uugucgcccaggcuggagugc

SEQ ID NO: 85503 - RNA, 21 nt, Human
caggcucccuuucucuucuuc

SEQ ID NO: 85504 - RNA, 19 nt, Human
aauggagaauuauaugaca

SEQ ID NO: 85505 - RNA, 26 nt, Human
cugaccuguuuuaaaugaaccaaacc

SEQ ID NO: 85506 - RNA, 27 nt, Human
ucaggggaagaagaaacagcccuccuc

SEQ ID NO: 85507 - RNA, 22 nt, Human
ccucuaaagcccugccugcuau

SEQ ID NO: 85508 - RNA, 22 nt, Human
cugcuuugaguuguuuggauga

SEQ ID NO: 85509 - RNA, 22 nt, Human
ccagcuccuguuccugugccuu

SEQ ID NO: 85510 - RNA, 23 nt, Human
ggcucaggaggaggggugagaga

SEQ ID NO: 85511 - RNA, 21 nt, Human
aggauuucuucacaccucucc

SEQ ID NO: 85512 - RNA, 22 nt, Human
uaaguauuuuccuguugucaag

SEQ ID NO: 85513 - RNA, 26 nt, Human
agcacaaaauuucugacuaucuugcg

SEQ ID NO: 85514 - RNA, 28 nt, Human
gaaguagcugggauuacaggcgcccgcc

SEQ ID NO: 85515 - RNA, 21 nt, Human
gagggccaggaaagaugugaa

SEQ ID NO: 85516 - RNA, 23 nt, Human
cuccacagccucacuucauucca

SEQ ID NO: 85517 - RNA, 28 nt, Human
uccagcucauccccuuggcugggaacau

SEQ ID NO: 85518 - RNA, 25 nt, Human
ucagugucccaggcagcacagugug

SEQ ID NO: 85519 - RNA, 21 nt, Human
aaagucacuccuguuuuguuu

SEQ ID NO: 85520 - RNA, 25 nt, Human
gcuuagugcucagacaaccugggga

SEQ ID NO: 85521 - RNA, 22 nt, Human
gagcagccuggcuaacauggug

SEQ ID NO: 85522 - RNA, 24 nt, Human
guggugucuuaaacaacuaaaagc

SEQ ID NO: 85523 - RNA, 21 nt, Human
uugcuguggcuggagcuggac

SEQ ID NO: 85524 - RNA, 23 nt, Human
ucuuccaggaagcacaggccagg

SEQ ID NO: 85525 - RNA, 26 nt, Human
cucugccucccgaguucaagcaauuc

SEQ ID NO: 85526 - RNA, 26 nt, Human
gggccgggcgggccccugggagcagc

SEQ ID NO: 85527 - RNA, 23 nt, Human
aauguuucugugucauuaaccau

SEQ ID NO: 85528 - RNA, 21 nt, Human
gggguccacaucaguauugga

SEQ ID NO: 85529 - RNA, 18 nt, Human
gggcaacaaacagucugg

SEQ ID NO: 85530 - RNA, 26 nt, Human
ggaaauagaagaaacugagaaccuag

SEQ ID NO: 85531 - RNA, 24 nt, Human
ccauagaucuggagaucuucgcca

SEQ ID NO: 85532 - RNA, 24 nt, Human
ggggugaggcccuggggaggcagg

SEQ ID NO: 85533 - RNA, 24 nt, Human
acugcauuucauuuugauuuugga

SEQ ID NO: 85534 - RNA, 26 nt, Human
acagagggagaggccagagaagcugc

SEQ ID NO: 85535 - RNA, 22 nt, Human
gcuagaccgagggcacuuccug

SEQ ID NO: 85536 - RNA, 19 nt, Human
cacccggcucccuccagac

SEQ ID NO: 85537 - RNA, 22 nt, Human
ccucacuuuucucaucuguaaa

SEQ ID NO: 85538 - RNA, 18 nt, Human
uaccuacagagcagccag

SEQ ID NO: 85539 - RNA, 26 nt, Human
cugcauugaaccuuggcucuccuggg

SEQ ID NO: 85540 - RNA, 26 nt, Human
uugggaggcugaggcaggagaauggc

SEQ ID NO: 85541 - RNA, 16 nt, Human
agggauggcagagagu

SEQ ID NO: 85542 - RNA, 26 nt, Human
ccuccagggauaagccuggggcuacu

SEQ ID NO: 85543 - RNA, 22 nt, Human
gacagauuuuauauuaugucaa

SEQ ID NO: 85544 - RNA, 23 nt, Human
ccccggggcuggggcccagcaca

SEQ ID NO: 85545 - RNA, 24 nt, Human
gggucgggccagcccagcccaggg

SEQ ID NO: 85546 - RNA, 22 nt, Human
gcccaggcuagcaugcaauggu

SEQ ID NO: 85547 - RNA, 20 nt, Human
augguucaugaaaauggucu

SEQ ID NO: 85548 - RNA, 28 nt, Human
ccuuccauggaaacucaggcugaucucg

SEQ ID NO: 85549 - RNA, 21 nt, Human
ugcuguugcccuacacugccu

SEQ ID NO: 85550 - RNA, 24 nt, Human
ugguuuugguuuucauacuccuca

SEQ ID NO: 85551 - RNA, 23 nt, Human
uccucagcugaggugacacuguu

SEQ ID NO: 85552 - RNA, 22 nt, Human
uccucugguucuugccugcuuc

SEQ ID NO: 85553 - RNA, 26 nt, Human
ggaggaagaggaagaagggacagugc

SEQ ID NO: 85554 - RNA, 22 nt, Human
uaggcuuucaaaauaaggauga

SEQ ID NO: 85555 - RNA, 21 nt, Human
uucuucucagcuucucugguu

SEQ ID NO: 85556 - RNA, 24 nt, Human
uucugggguccauucucugaguca

SEQ ID NO: 85557 - RNA, 20 nt, Human
auguaaaauaaguauuucca

SEQ ID NO: 85558 - RNA, 22 nt, Human
caaccucucgugacugccugug

SEQ ID NO: 85559 - RNA, 22 nt, Human
cacgaggucaggagaucaagac

SEQ ID NO: 85560 - RNA, 23 nt, Human
uuguauaauagccuuuuucuccc

SEQ ID NO: 85561 - RNA, 19 nt, Human
cugaauccccuccuacccc

SEQ ID NO: 85562 - RNA, 27 nt, Human
cuuuccucugcugcucaauaguuuuau

SEQ ID NO: 85563 - RNA, 23 nt, Human
uggaagccuguugcuuugcucua

SEQ ID NO: 85564 - RNA, 27 nt, Human
aggugauuuuuaaaugaaaauguguaa

SEQ ID NO: 85565 - RNA, 24 nt, Human
aaggcagcuagaaaugggagggaa

SEQ ID NO: 85566 - RNA, 27 nt, Human
cauaggcuggggacacaggauccuggc

SEQ ID NO: 85567 - RNA, 20 nt, Human
ggcuggggugugaaaaagaa

SEQ ID NO: 85568 - RNA, 26 nt, Human
ucuggacuuugcuuccccuccaggag

SEQ ID NO: 85569 - RNA, 20 nt, Human
accgcccccuccccaaaagg

SEQ ID NO: 85570 - RNA, 21 nt, Human
ucucagaaaacuucucuucug

SEQ ID NO: 85571 - RNA, 23 nt, Human
cgcaagcucucagcaagugccca

SEQ ID NO: 85572 - RNA, 28 nt, Human
ccugcuucccaccucccugcccaggccg

SEQ ID NO: 85573 - RNA, 30 nt, Human
ccacuccccacucucagccugggagacucc

SEQ ID NO: 85574 - RNA, 22 nt, Human
uaggguagcaugggauuacagg

SEQ ID NO: 85575 - RNA, 22 nt, Human
ggugugaacccgggaagcggag

SEQ ID NO: 85576 - RNA, 24 nt, Human
ccacagcaaccagcuccacggccu

SEQ ID NO: 85577 - RNA, 23 nt, Human
cacauuuuaauaccacagcacuu

SEQ ID NO: 85578 - RNA, 20 nt, Human
uuggggguacgauguuuaua

SEQ ID NO: 85579 - RNA, 20 nt, Human
uccagcaccuccgucauuca

SEQ ID NO: 85580 - RNA, 25 nt, Human
agacucgucucaggccaguugcagc

SEQ ID NO: 85581 - RNA, 23 nt, Human
ugccugcuggaggguaaugagaa

SEQ ID NO: 85582 - RNA, 21 nt, Human
ucugggcauggcagggccagg

SEQ ID NO: 85583 - RNA, 20 nt, Human
cgcccaggcuggagggcagu

SEQ ID NO: 85584 - RNA, 20 nt, Human
cgcccaugcuggagugcagu

SEQ ID NO: 85585 - RNA, 24 nt, Human
uccuauucauucuuagcacuuuga

SEQ ID NO: 85586 - RNA, 26 nt, Human
aacucacugcauuucugugcucccuc

SEQ ID NO: 85587 - RNA, 19 nt, Human
gaguuugagcuauuaaagu

SEQ ID NO: 85588 - RNA, 20 nt, Human
ugacgcacaggcuggagugc

SEQ ID NO: 85589 - RNA, 22 nt, Human
gaacccaggaggcggagguugc

SEQ ID NO: 85590 - RNA, 19 nt, Human
ggcaaggcugcuguuauca

SEQ ID NO: 85591 - RNA, 25 nt, Human
uuuccuuuuuguugauuccaaacca

SEQ ID NO: 85592 - RNA, 23 nt, Human
guggccuuuuagacuuuuguugc

SEQ ID NO: 85593 - RNA, 27 nt, Human
guguucauuccuguuaccugcauaucu

SEQ ID NO: 85594 - RNA, 21 nt, Human
ucuucauuaucauuuguaaac

SEQ ID NO: 85595 - RNA, 21 nt, Human
guggggcguggucucaggcuc

SEQ ID NO: 85596 - RNA, 24 nt, Human
agcuagaggcaucuucuacgggau

SEQ ID NO: 85597 - RNA, 26 nt, Human
guguucucuuuugacuaaaucaccua

SEQ ID NO: 85598 - RNA, 19 nt, Human
aauuggcuugaaauuuuca

SEQ ID NO: 85599 - RNA, 23 nt, Human
gcugggucuuagggaaaggaaug

SEQ ID NO: 85600 - RNA, 27 nt, Human
ggggaagagaauacaugggaaaauauu

SEQ ID NO: 85601 - RNA, 21 nt, Human
cgggggaggggcaggagaggg

SEQ ID NO: 85602 - RNA, 26 nt, Human
gcucaggcuggagcaggcauaugagc

SEQ ID NO: 85603 - RNA, 25 nt, Human
gaaacagaaguuuagcaagggucau

SEQ ID NO: 85604 - RNA, 20 nt, Human
ugguggagguggauggcagg

SEQ ID NO: 85605 - RNA, 19 nt, Human
uuacaguauuuucuuuuug

SEQ ID NO: 85606 - RNA, 23 nt, Human
ucuccacccguguccagcaugac

SEQ ID NO: 85607 - RNA, 23 nt, Human
ucaccuuuuuauacaucuguaaa

SEQ ID NO: 85608 - RNA, 19 nt, Human
ugcaucuggggagagcaaa

SEQ ID NO: 85609 - RNA, 22 nt, Human
ucagguaaagaagcagcuuuga

SEQ ID NO: 85610 - RNA, 20 nt, Human
cgugcggagccaggaggcag

SEQ ID NO: 85611 - RNA, 22 nt, Human
guuggcagaagagggaaggcag

SEQ ID NO: 85612 - RNA, 26 nt, Human
gucaggcugggguuagugagcagguu

SEQ ID NO: 85613 - RNA, 19 nt, Human
gggugaggaugagugcugg

SEQ ID NO: 85614 - RNA, 19 nt, Human
caacgugaauucucucagg

SEQ ID NO: 85615 - RNA, 22 nt, Human
ccagccugggcaacaguguuaa

SEQ ID NO: 85616 - RNA, 21 nt, Human
cguugauggguauguguuuaa

SEQ ID NO: 85617 - RNA, 19 nt, Human
uucaaauuuaucucuuuca

SEQ ID NO: 85618 - RNA, 20 nt, Human
uugaauugcccugccugggc

SEQ ID NO: 85619 - RNA, 27 nt, Human
gcccuugccuaucaaagaguauguugu

SEQ ID NO: 85620 - RNA, 21 nt, Human
uugggcccuccacccaguggg

SEQ ID NO: 85621 - RNA, 21 nt, Human
acacaucuauaaaauguaaug

SEQ ID NO: 85622 - RNA, 26 nt, Human
ucugggugggugaggggcgcgcggau

SEQ ID NO: 85623 - RNA, 25 nt, Human
aagccucauauuuucuguccaguca

SEQ ID NO: 85624 - RNA, 27 nt, Human
cuggcccccugaguuuccuuuucucgu

SEQ ID NO: 85625 - RNA, 21 nt, Human
gggaggcggagcuugcaguga

SEQ ID NO: 85626 - RNA, 24 nt, Human
ucuuacgcuugcuaucauggcagc

SEQ ID NO: 85627 - RNA, 24 nt, Human
cuccugccuccccauuccuugccu

SEQ ID NO: 85628 - RNA, 23 nt, Human
cuaagccagucucacugugaacc

SEQ ID NO: 85629 - RNA, 24 nt, Human
cccugcccacaaaaccccagggac

SEQ ID NO: 85630 - RNA, 20 nt, Human
ggcuucagaaacagcuuaaa

SEQ ID NO: 85631 - RNA, 23 nt, Human
gacucagccuuccuccucauccu

SEQ ID NO: 85632 - RNA, 22 nt, Human
uuucagcuggacacaggcgcgg

SEQ ID NO: 85633 - RNA, 24 nt, Human
guagaaaaggaagacauaagaaac

SEQ ID NO: 85634 - RNA, 19 nt, Human
uuuucucuuucuuccuguc

SEQ ID NO: 85635 - RNA, 23 nt, Human
ucacccagccucugagagcaguu

SEQ ID NO: 85636 - RNA, 26 nt, Human
agggcacuugggcugaaggaucgcuu

SEQ ID NO: 85637 - RNA, 27 nt, Human
gccugaguaaaaggcuuggaaguugga

SEQ ID NO: 85638 - RNA, 27 nt, Human
cacagcccaggcgaggaagccuggcuu

SEQ ID NO: 85639 - RNA, 26 nt, Human
agaaauguaccggcuuccauccuguc

SEQ ID NO: 85640 - RNA, 17 nt, Human
gaacagaaaacauucug

SEQ ID NO: 85641 - RNA, 23 nt, Human
auuccuguaaguauucuggagcu

SEQ ID NO: 85642 - RNA, 22 nt, Human
augguggccaggauggucuauc

SEQ ID NO: 85643 - RNA, 21 nt, Human
aggggccaagcaggcacucug

SEQ ID NO: 85644 - RNA, 21 nt, Human
ugacauccuccuccuccauca

SEQ ID NO: 85645 - RNA, 25 nt, Human
gcagcaucugcccugugaaguuugu

SEQ ID NO: 85646 - RNA, 27 nt, Human
ccacuguacuccagccuggacaacagc

SEQ ID NO: 85647 - RNA, 27 nt, Human
ucccuagggcacaugcaucagcacaua

SEQ ID NO: 85648 - RNA, 20 nt, Human
acugaaauaaagaugagcua

SEQ ID NO: 85649 - RNA, 22 nt, Human
gauaugcagcauuaacuuuacu

SEQ ID NO: 85650 - RNA, 22 nt, Human
acuagugccugguauguaguag

SEQ ID NO: 85651 - RNA, 21 nt, Human
gcugccaggggagaccccggg

SEQ ID NO: 85652 - RNA, 22 nt, Human
cuuuugucuuccucagcagguu

SEQ ID NO: 85653 - RNA, 24 nt, Human
ucccagggccucuuuccucucuuu

SEQ ID NO: 85654 - RNA, 22 nt, Human
ugggagguggagguugcuguga

SEQ ID NO: 85655 - RNA, 17 nt, Human
cgcccagggccuguguu

SEQ ID NO: 85656 - RNA, 22 nt, Human
cucacugccaugccagcuuauc

SEQ ID NO: 85657 - RNA, 29 nt, Human
uccucuggcuccccaaggcugcaaagcaa

SEQ ID NO: 85658 - RNA, 22 nt, Human
gacucaucuuccuguuguucca

SEQ ID NO: 85659 - RNA, 32 nt, Human
ggcuaaaggcggccagguuugcagugcgggaa

SEQ ID NO: 85660 - RNA, 26 nt, Human
ucccagucuucagauucucugguaag

SEQ ID NO: 85661 - RNA, 22 nt, Human
cuucccaagaacuuucaagcca

SEQ ID NO: 85662 - RNA, 29 nt, Human
cuccugcuaggaaaagcuuuugcaugugu

SEQ ID NO: 85663 - RNA, 19 nt, Human
gggaggugagucugucacc

SEQ ID NO: 85664 - RNA, 27 nt, Human
ucugacuggcacagucuuugcauggag

SEQ ID NO: 85665 - RNA, 25 nt, Human
guaucucugcugggcuuucugggcc

SEQ ID NO: 85666 - RNA, 22 nt, Human
aggcugaggaugugauguuacu

SEQ ID NO: 85667 - RNA, 28 nt, Human
gggcagugcaaggagggagcacaacccc

SEQ ID NO: 85668 - RNA, 17 nt, Human
agcuuaaauuacucaau

SEQ ID NO: 85669 - RNA, 21 nt, Human
agccguccggcggcugggauc

SEQ ID NO: 85670 - RNA, 21 nt, Human
uaaagaagaaacgucuaugug

SEQ ID NO: 85671 - RNA, 17 nt, Human
gcucacugcuucugcuu

SEQ ID NO: 85672 - RNA, 25 nt, Human
caggcagcagaggcgacugcggaca

SEQ ID NO: 85673 - RNA, 20 nt, Human
aaacccggacuggaggaggu

SEQ ID NO: 85674 - RNA, 27 nt, Human
uccaagagaaaacaccacacugugaug

SEQ ID NO: 85675 - RNA, 22 nt, Human
cugggcuggagaacaguggcac

SEQ ID NO: 85676 - RNA, 23 nt, Human
uuucagcccaaugucaacccagu

SEQ ID NO: 85677 - RNA, 26 nt, Human
ccgcuucauuuguagagggcuguaac

SEQ ID NO: 85678 - RNA, 23 nt, Human
aauugauugccuucagcacagca

SEQ ID NO: 85679 - RNA, 23 nt, Human
gcucaucacggucagucauuccu

SEQ ID NO: 85680 - RNA, 26 nt, Human
ggcuaaggaugcaaccucugacguuc

SEQ ID NO: 85681 - RNA, 17 nt, Human
ugagcccuuccuggcac

SEQ ID NO: 85682 - RNA, 21 nt, Human
gugauuuuucuaccagacagc

SEQ ID NO: 85683 - RNA, 24 nt, Human
ccugcagccacucccagcacaccc

SEQ ID NO: 85684 - RNA, 24 nt, Human
aacauagugucuucauuagugugc

SEQ ID NO: 85685 - RNA, 22 nt, Human
cuaacacggugaaacccaaucu

SEQ ID NO: 85686 - RNA, 21 nt, Human
uguuaucauuguauuguuuag

SEQ ID NO: 85687 - RNA, 23 nt, Human
ggugcgcaccaccaugcccggcu

SEQ ID NO: 85688 - RNA, 22 nt, Human
aguaguaggaagugagcuguuc

SEQ ID NO: 85689 - RNA, 23 nt, Human
cuacgaugggaugggaacagugg

SEQ ID NO: 85690 - RNA, 22 nt, Human
cauugcacuccagccuggguga

SEQ ID NO: 85691 - RNA, 22 nt, Human
cacugcacucuagccuggguga

SEQ ID NO: 85692 - RNA, 23 nt, Human
gggaggcagagccagcaggugga

SEQ ID NO: 85693 - RNA, 25 nt, Human
ggcucagggauccccggacaccucu

SEQ ID NO: 85694 - RNA, 23 nt, Human
gggguggaagugggguaggggaa

SEQ ID NO: 85695 - RNA, 26 nt, Human
cauccaggcuggggcaccuucuccuc

SEQ ID NO: 85696 - RNA, 27 nt, Human
uuuugcagaagauuacaguuauguacu

SEQ ID NO: 85697 - RNA, 19 nt, Human
ucuacccccucacuuuuau

SEQ ID NO: 85698 - RNA, 22 nt, Human
ugucucaaagcacacugucuuc

SEQ ID NO: 85699 - RNA, 26 nt, Human
agagaaaucacugacauucuauacca

SEQ ID NO: 85700 - RNA, 23 nt, Human
aggagagaccuuuucugccugga

SEQ ID NO: 85701 - RNA, 24 nt, Human
ugcuggaaugucccuuuuuuccua

SEQ ID NO: 85702 - RNA, 28 nt, Human
aggugugcccacagaugcggaggcgagg

SEQ ID NO: 85703 - RNA, 22 nt, Human
ugcagugagcugagaucacacc

SEQ ID NO: 85704 - RNA, 22 nt, Human
ugcagugagccaagaucaugcc

SEQ ID NO: 85705 - RNA, 27 nt, Human
gacuaucaaaauacauguauguuucag

SEQ ID NO: 85706 - RNA, 27 nt, Human
uguugcccaggcuggucugaagcugcu

SEQ ID NO: 85707 - RNA, 22 nt, Human
acagaguuucauugucacccag

SEQ ID NO: 85708 - RNA, 21 nt, Human
ugcugcucacccacagacaca

SEQ ID NO: 85709 - RNA, 27 nt, Human
uguugcauuuacuaucaacugcugcua

SEQ ID NO: 85710 - RNA, 23 nt, Human
uaaguggagaguuuucucaggga

SEQ ID NO: 85711 - RNA, 27 nt, Human
ccucuguuccuccuugagccugucggg

SEQ ID NO: 85712 - RNA, 21 nt, Human
ccaucaucugcccuuuuauuc

SEQ ID NO: 85713 - RNA, 19 nt, Human
agcuacucgggaggcugaa

SEQ ID NO: 85714 - RNA, 21 nt, Human
acccugggcauguccagauga

SEQ ID NO: 85715 - RNA, 26 nt, Human
gauaagcuuuuuucauaauucaggaa

SEQ ID NO: 85716 - RNA, 27 nt, Human
cacugcacuccggccugaugacagagc

SEQ ID NO: 85717 - RNA, 22 nt, Human
ugcagugagcugauaucaugcc

SEQ ID NO: 85718 - RNA, 22 nt, Human
ugguccucagugaggcugcugc

SEQ ID NO: 85719 - RNA, 21 nt, Human
cucagccugggaaacuaucaa

SEQ ID NO: 85720 - RNA, 21 nt, Human
gccaccacucugcccuggucc

SEQ ID NO: 85721 - RNA, 27 nt, Human
gccuaggcuggagugcagugaggcaau

SEQ ID NO: 85722 - RNA, 22 nt, Human
gcuagcacaauguguguugcug

SEQ ID NO: 85723 - RNA, 20 nt, Human
aagccagacucugccaaaac

SEQ ID NO: 85724 - RNA, 24 nt, Human
uguucucuguuuucucugucugcu

SEQ ID NO: 85725 - RNA, 22 nt, Human
gcgggcagaucacuugagguca

SEQ ID NO: 85726 - RNA, 23 nt, Human
aacuauacuugaacaaaaggguc

SEQ ID NO: 85727 - RNA, 22 nt, Human
guggccuuuaucucaacggaag

SEQ ID NO: 85728 - RNA, 23 nt, Human
gacuggaauauaauuucaaacca

SEQ ID NO: 85729 - RNA, 23 nt, Human
cugaugcguuuuuggugggccua

SEQ ID NO: 85730 - RNA, 23 nt, Human
cucccauuggccucuccuugcca

SEQ ID NO: 85731 - RNA, 26 nt, Human
aaugaaaaguuguuucucaguuguuu

SEQ ID NO: 85732 - RNA, 27 nt, Human
cacauauauacauauauucacuauagu

SEQ ID NO: 85733 - RNA, 23 nt, Human
cugagacaaaacaguacucacug

SEQ ID NO: 85734 - RNA, 20 nt, Human
agucagcccacaagaugcca

SEQ ID NO: 85735 - RNA, 28 nt, Human
agagggcagaugcagagcaggugguagu

SEQ ID NO: 85736 - RNA, 20 nt, Human
gagcccaggcaguuggagac

SEQ ID NO: 85737 - RNA, 29 nt, Human
ccuggcucggcucccugccuccgcgucgc

SEQ ID NO: 85738 - RNA, 19 nt, Human
gaaaccucuucuccaguca

SEQ ID NO: 85739 - RNA, 22 nt, Human
gugaucauuucuuuauguuauu

SEQ ID NO: 85740 - RNA, 27 nt, Human
ccugcagccgcgcguaggcagagacgg

SEQ ID NO: 85741 - RNA, 23 nt, Human
uagaagcuaauguaggacuguau

SEQ ID NO: 85742 - RNA, 23 nt, Human
uagcccaugacguguuucuugaa

SEQ ID NO: 85743 - RNA, 21 nt, Human
uguuuauuuaaaccaaagggg

SEQ ID NO: 85744 - RNA, 21 nt, Human
aagaagucuuaagauauuuca

SEQ ID NO: 85745 - RNA, 22 nt, Human
ccugacuuugacacacauggcc

SEQ ID NO: 85746 - RNA, 26 nt, Human
caggaggcugaggcaggagaaucacu

SEQ ID NO: 85747 - RNA, 16 nt, Human
aucacaaaaugccuug

SEQ ID NO: 85748 - RNA, 22 nt, Human
gguugaggcugcagugagcugu

SEQ ID NO: 85749 - RNA, 21 nt, Human
aaggcggccagguuugcagug

SEQ ID NO: 85750 - RNA, 23 nt, Human
agaacagacacuuuaaaagcuuc

SEQ ID NO: 85751 - RNA, 16 nt, Human
cuucccuucuuguucu

SEQ ID NO: 85752 - RNA, 21 nt, Human
caugacccaggcugggcaagg

SEQ ID NO: 85753 - RNA, 24 nt, Human
uuccacaaaucuuaccucuuuagg

SEQ ID NO: 85754 - RNA, 26 nt, Human
ucauuucuuaaggcugccuuccucuc

SEQ ID NO: 85755 - RNA, 19 nt, Human
cacccccucuguugcacau

SEQ ID NO: 85756 - RNA, 20 nt, Human
cccggcuucccuccuccucc

SEQ ID NO: 85757 - RNA, 22 nt, Human
aauuacccugaaaacguuggaa

SEQ ID NO: 85758 - RNA, 22 nt, Human
uaguagccuuaucccuggucau

SEQ ID NO: 85759 - RNA, 18 nt, Human
gggacugagguuggggga

SEQ ID NO: 85760 - RNA, 22 nt, Human
gcucaccacaaucgcugccucc

SEQ ID NO: 85761 - RNA, 21 nt, Human
ccaggaguuuaaagcugcagu

SEQ ID NO: 85762 - RNA, 21 nt, Human
gccacugcacaccggccuggg

SEQ ID NO: 85763 - RNA, 21 nt, Human
uucuuccuuggcccuuuugga

SEQ ID NO: 85764 - RNA, 22 nt, Human
ggcucugccacuaacuugcugu

SEQ ID NO: 85765 - RNA, 22 nt, Human
cccagcacccaguuccuccuca

SEQ ID NO: 85766 - RNA, 21 nt, Human
aaaauuuuaaaauuagcuggg

SEQ ID NO: 85767 - RNA, 27 nt, Human
aggguguuuguagacgugggggaggag

SEQ ID NO: 85768 - RNA, 22 nt, Human
caguuguuccagcuguucacaa

SEQ ID NO: 85769 - RNA, 21 nt, Human
ccacugcacuccagucuggca

SEQ ID NO: 85770 - RNA, 24 nt, Human
augaaacugaugguucaauuucag

SEQ ID NO: 85771 - RNA, 24 nt, Human
cuaucauggugaaaagcuccauca

SEQ ID NO: 85772 - RNA, 23 nt, Human
agcgccucuccagaccuaccucg

SEQ ID NO: 85773 - RNA, 27 nt, Human
cagaaucuugcucugucaccuaggcug

SEQ ID NO: 85774 - RNA, 19 nt, Human
uccccaggcuuggggcaau

SEQ ID NO: 85775 - RNA, 20 nt, Human
gaaauacaaaaauuagcugg

SEQ ID NO: 85776 - RNA, 28 nt, Human
uucaguaagaaagagaaagggaaugcag

SEQ ID NO: 85777 - RNA, 25 nt, Human
ggcugggacugcugucccuuguaca

SEQ ID NO: 85778 - RNA, 24 nt, Human
auugcaaaauagcauuuguuuaag

SEQ ID NO: 85779 - RNA, 18 nt, Human
cugcucccaguaacccau

SEQ ID NO: 85780 - RNA, 21 nt, Human
ugucccaggcuggagugcagu

SEQ ID NO: 85781 - RNA, 20 nt, Human
uguucuuccuuuagucauca

SEQ ID NO: 85782 - RNA, 21 nt, Human
uccaggagggagaccuguugg

SEQ ID NO: 85783 - RNA, 21 nt, Human
cugugucuuggguucucaccu

SEQ ID NO: 85784 - RNA, 24 nt, Human
agagaacaacaggggcugggaaug

SEQ ID NO: 85785 - RNA, 26 nt, Human
auggcuguguccacugcaauuggugg

SEQ ID NO: 85786 - RNA, 20 nt, Human
gcuaucuuuaugaaaggaca

SEQ ID NO: 85787 - RNA, 22 nt, Human
uggauaugaaaggccaucugcu

SEQ ID NO: 85788 - RNA, 25 nt, Human
ccuuuucucccauuucuugcuagcu

SEQ ID NO: 85789 - RNA, 22 nt, Human
cucaaacauacugauguucaua

SEQ ID NO: 85790 - RNA, 26 nt, Human
gcccuggcuggagagcgggacguggc

SEQ ID NO: 85791 - RNA, 26 nt, Human
uggggugagaggaugugaguggccgg

SEQ ID NO: 85792 - RNA, 21 nt, Human
cgcccaggcuggaguguagug

SEQ ID NO: 85793 - RNA, 28 nt, Human
gggcguucccugaugaaggcaccuuggg

SEQ ID NO: 85794 - RNA, 20 nt, Human
gcaaaaacaccaccaaucac

SEQ ID NO: 85795 - RNA, 20 nt, Human
ccaggccugggaugcaguga

SEQ ID NO: 85796 - RNA, 22 nt, Human
uucaguucucaaugugcugcug

SEQ ID NO: 85797 - RNA, 20 nt, Human
cucagccaaggaaacucuug

SEQ ID NO: 85798 - RNA, 26 nt, Human
guagcuuggaaaacuugggaggcgga

SEQ ID NO: 85799 - RNA, 24 nt, Human
cuguucucuccaaccacacaucau

SEQ ID NO: 85800 - RNA, 27 nt, Human
cgccacuacacuccagccugagcaaca

SEQ ID NO: 85801 - RNA, 22 nt, Human
ucugcagcuucacuccugagcc

SEQ ID NO: 85802 - RNA, 22 nt, Human
ggaggcugggcacgggggcuca

SEQ ID NO: 85803 - RNA, 20 nt, Human
aacaaauuuuuccagcaagc

SEQ ID NO: 85804 - RNA, 21 nt, Human
gaccuugcucuuccuaguccu

SEQ ID NO: 85805 - RNA, 26 nt, Human
acccccagccaccagcccucauccuc

SEQ ID NO: 85806 - RNA, 22 nt, Human
ucuguccuggagcaggauugua

SEQ ID NO: 85807 - RNA, 21 nt, Human
uaggaugccauuucuuuuaua

SEQ ID NO: 85808 - RNA, 23 nt, Human
cacuguguuuuguggaucuuuaa

SEQ ID NO: 85809 - RNA, 25 nt, Human
agauauuaaaauaagcacagaaaau

SEQ ID NO: 85810 - RNA, 26 nt, Human
guugccgccucgggcgcuguacccag

SEQ ID NO: 85811 - RNA, 21 nt, Human
gaccccagccucucacucuca

SEQ ID NO: 85812 - RNA, 21 nt, Human
acccaacagugaugaugcaug

SEQ ID NO: 85813 - RNA, 27 nt, Human
aacaacaaaauacacuguuuugucuuc

SEQ ID NO: 85814 - RNA, 21 nt, Human
ggcggggacccuaacaaccuu

SEQ ID NO: 85815 - RNA, 22 nt, Human
cugaggcaggagaaucucuuga

SEQ ID NO: 85816 - RNA, 22 nt, Human
cugaggcaugagaaucgcuuga

SEQ ID NO: 85817 - RNA, 24 nt, Human
gcccaggcuggagugcagaggugc

SEQ ID NO: 85818 - RNA, 24 nt, Human
uuaucauugcuaucaaauaauuuc

SEQ ID NO: 85819 - RNA, 22 nt, Human
uagcauguguccagagcccugu

SEQ ID NO: 85820 - RNA, 22 nt, Human
aggcugaggcaggagaauggcg

SEQ ID NO: 85821 - RNA, 21 nt, Human
gggcugggcgcuggagccaga

SEQ ID NO: 85822 - RNA, 19 nt, Human
agagauuuaaaacauggca

SEQ ID NO: 85823 - RNA, 27 nt, Human
uucaguuaugcagaagcucauuuguga

SEQ ID NO: 85824 - RNA, 20 nt, Human
gcguuuugggaggacacaga

SEQ ID NO: 85825 - RNA, 21 nt, Human
caggcuggagugcagugggug

SEQ ID NO: 85826 - RNA, 18 nt, Human
cgcugcugccugcuuugu

SEQ ID NO: 85827 - RNA, 24 nt, Human
cuccagguccccgugguaccaaag

SEQ ID NO: 85828 - RNA, 21 nt, Human
ccugguacuggcagcagccag

SEQ ID NO: 85829 - RNA, 22 nt, Human
uagggaagaguucugaucugua

SEQ ID NO: 85830 - RNA, 20 nt, Human
auccuccucuccaugcacag

SEQ ID NO: 85831 - RNA, 16 nt, Human
ucacgaaguggagauu

SEQ ID NO: 85832 - RNA, 27 nt, Human
aggcuacacagcugcccacuccuccug

SEQ ID NO: 85833 - RNA, 24 nt, Human
aaagccccaacuaaucuuuagaag

SEQ ID NO: 85834 - RNA, 21 nt, Human
gaagacagacaucuguggaau

SEQ ID NO: 85835 - RNA, 25 nt, Human
ugcuaucuucauuccagucccuacc

SEQ ID NO: 85836 - RNA, 28 nt, Human
gccaguaugacccacuuggacucacccc

SEQ ID NO: 85837 - RNA, 27 nt, Human
ugggcuucauccuccucagaucuucug

SEQ ID NO: 85838 - RNA, 26 nt, Human
uucacacaccagauguaacuguuuuu

SEQ ID NO: 85839 - RNA, 25 nt, Human
cucaguagucccugcacagugacuu

SEQ ID NO: 85840 - RNA, 21 nt, Human
cuccaucucaaagaaauaaca

SEQ ID NO: 85841 - RNA, 23 nt, Human
ggagguuguggugagcugaaaug

SEQ ID NO: 85842 - RNA, 22 nt, Human
ccaaguagcuggaacuacaggu

SEQ ID NO: 85843 - RNA, 21 nt, Human
uagaagcugucuaaaccuccu

SEQ ID NO: 85844 - RNA, 26 nt, Human
ugcccaggcugugcagcgcagcugga

SEQ ID NO: 85845 - RNA, 21 nt, Human
cacagccuguggcugggaagg

SEQ ID NO: 85846 - RNA, 27 nt, Human
cccugcauucugcucugcucuaauaca

SEQ ID NO: 85847 - RNA, 22 nt, Human
ccacuucucucaguuccuggca

SEQ ID NO: 85848 - RNA, 23 nt, Human
aagcaccguugagguugcaguga

SEQ ID NO: 85849 - RNA, 21 nt, Human
gcuggaugguaggaagggaug

SEQ ID NO: 85850 - RNA, 27 nt, Human
gacugggugugcaacuugaggcugauc

SEQ ID NO: 85851 - RNA, 23 nt, Human
ugugagaccuguagaaccucuuu

SEQ ID NO: 85852 - RNA, 21 nt, Human
aggggucgcccgugcacccug

SEQ ID NO: 85853 - RNA, 21 nt, Human
guguccagagugagcaaggau

SEQ ID NO: 85854 - RNA, 22 nt, Human
ggagagagggaagaggggcguu

SEQ ID NO: 85855 - RNA, 26 nt, Human
uuguuuaucaugaaugcaggaugugg

SEQ ID NO: 85856 - RNA, 23 nt, Human
ucuuagucauugauuuuuguguu

SEQ ID NO: 85857 - RNA, 21 nt, Human
cauaggagcgcaaagaagcua

SEQ ID NO: 85858 - RNA, 28 nt, Human
gugggagcugccacagugccccuugcug

SEQ ID NO: 85859 - RNA, 20 nt, Human
uccccaagcccuccccacca

SEQ ID NO: 85860 - RNA, 23 nt, Human
ugcaucuagagugucagccuuau

SEQ ID NO: 85861 - RNA, 25 nt, Human
uaucacugcagccugcuuugugcuu

SEQ ID NO: 85862 - RNA, 24 nt, Human
auucucucacaucccgugcgguca

SEQ ID NO: 85863 - RNA, 20 nt, Human
cagaaaugaauuuaugugcu

SEQ ID NO: 85864 - RNA, 25 nt, Human
uugcgggguggagugagguuaguuc

SEQ ID NO: 85865 - RNA, 24 nt, Human
aggccacacagauucuccucaaga

SEQ ID NO: 85866 - RNA, 27 nt, Human
aagaggaaggaaaggaguagggcuagu

SEQ ID NO: 85867 - RNA, 22 nt, Human
gcgugagcgcgccugcgccgcc

SEQ ID NO: 85868 - RNA, 27 nt, Human
gucacccaggcuggagugcaauggcac

SEQ ID NO: 85869 - RNA, 22 nt, Human
ucacuucaguacuucagcucuu

SEQ ID NO: 85870 - RNA, 23 nt, Human
auugcuuggguauggaacgguag

SEQ ID NO: 85871 - RNA, 20 nt, Human
gagacugaaaauaccuucau

SEQ ID NO: 85872 - RNA, 23 nt, Human
gggaccacgaggcagggagccag

SEQ ID NO: 85873 - RNA, 21 nt, Human
cugucucucaccaacaagcca

SEQ ID NO: 85874 - RNA, 22 nt, Human
aaagugcugggauuacaggagu

SEQ ID NO: 85875 - RNA, 21 nt, Human
ucccccuccggcuccuccucc

SEQ ID NO: 85876 - RNA, 23 nt, Human
gagauauuaaaauaagcacagaa

SEQ ID NO: 85877 - RNA, 24 nt, Human
cuuuggaucuucauucauuaagca

SEQ ID NO: 85878 - RNA, 21 nt, Human
gguaggggagauguuucguuu

SEQ ID NO: 85879 - RNA, 24 nt, Human
ccucaccucccuguuccaggcuga

SEQ ID NO: 85880 - RNA, 26 nt, Human
aggcugaucucaaacuccugaccuca

SEQ ID NO: 85881 - RNA, 26 nt, Human
aggcugaucucgaacuccuaaccuca

SEQ ID NO: 85882 - RNA, 27 nt, Human
uuuuaauuacuguuuucuuuuuucuua

SEQ ID NO: 85883 - RNA, 26 nt, Human
gaucguaaaauuugugcaauguaaug

SEQ ID NO: 85884 - RNA, 21 nt, Human
agucaagaaccacagcacuug

SEQ ID NO: 85885 - RNA, 20 nt, Human
cccccacuggcccacuggug

SEQ ID NO: 85886 - RNA, 25 nt, Human
gaagaagaagauccaagaaggcuga

SEQ ID NO: 85887 - RNA, 27 nt, Human
gcagauggggauguagguaaaucuuuu

SEQ ID NO: 85888 - RNA, 20 nt, Human
uuucccuuagacuuuaguag

SEQ ID NO: 85889 - RNA, 27 nt, Human
gugcucuuggcucuugggcuggaguac

SEQ ID NO: 85890 - RNA, 19 nt, Human
uaagauggaaaaagacugg

SEQ ID NO: 85891 - RNA, 24 nt, Human
ccggaggggcuguauuaauuugua

SEQ ID NO: 85892 - RNA, 23 nt, Human
gggaguuuugcucucugucaggu

SEQ ID NO: 85893 - RNA, 22 nt, Human
gcccaaacuggagugcaguggc

SEQ ID NO: 85894 - RNA, 25 nt, Human
ugcuaagauguacgggucuugggga

SEQ ID NO: 85895 - RNA, 21 nt, Human
ucuggcaaugauuacuguguu

SEQ ID NO: 85896 - RNA, 21 nt, Human
ccagcauggagcccaagagca

SEQ ID NO: 85897 - RNA, 21 nt, Human
cggcccaggcggggugcgagu

SEQ ID NO: 85898 - RNA, 19 nt, Human
gugccgauuccugcccugc

SEQ ID NO: 85899 - RNA, 21 nt, Human
aaugcuaccauuucuuccucu

SEQ ID NO: 85900 - RNA, 28 nt, Human
acuguuuaguugaggcuagucuggaacc

SEQ ID NO: 85901 - RNA, 21 nt, Human
uccugcaggaucaugcagcug

SEQ ID NO: 85902 - RNA, 19 nt, Human
agccuggagggaggcauug

SEQ ID NO: 85903 - RNA, 26 nt, Human
guggguuugcauuugaaaagcagguu

SEQ ID NO: 85904 - RNA, 22 nt, Human
acauacagcuuauauuaaaaga

SEQ ID NO: 85905 - RNA, 23 nt, Human
cuugccuugcccaaauggaaugg

SEQ ID NO: 85906 - RNA, 20 nt, Human
cugguccccucuuuucccuu

SEQ ID NO: 85907 - RNA, 24 nt, Human
gcaguaucuccucuagcuagugcc

SEQ ID NO: 85908 - RNA, 25 nt, Human
aaugggauuauuacaguugaucucu

SEQ ID NO: 85909 - RNA, 18 nt, Human
ggcaucgaaaguguuaaa

SEQ ID NO: 85910 - RNA, 22 nt, Human
ucugccgcccaggcuggagugc

SEQ ID NO: 85911 - RNA, 26 nt, Human
gcucggcaacccugccgacucagccg

SEQ ID NO: 85912 - RNA, 25 nt, Human
ccaagggagagugagaccuggcagc

SEQ ID NO: 85913 - RNA, 19 nt, Human
ucuccaauuacauucccac

SEQ ID NO: 85914 - RNA, 21 nt, Human
acaugcacagcuuccugaguc

SEQ ID NO: 85915 - RNA, 25 nt, Human
aguccuugugaaccacaacugaucc

SEQ ID NO: 85916 - RNA, 25 nt, Human
caguuuguggcaucuugccaagggu

SEQ ID NO: 85917 - RNA, 23 nt, Human
uuuauguuuuugcugcuacuucu

SEQ ID NO: 85918 - RNA, 23 nt, Human
cagggaggcaggagacacugguc

SEQ ID NO: 85919 - RNA, 27 nt, Human
uacaugguagaucaacaauucuuuuug

SEQ ID NO: 85920 - RNA, 23 nt, Human
acuguacuucaucuuacuugcca

SEQ ID NO: 85921 - RNA, 26 nt, Human
acgcacacagccugguuuuguccuca

SEQ ID NO: 85922 - RNA, 18 nt, Human
caggcagcuggcuaguuc

SEQ ID NO: 85923 - RNA, 22 nt, Human
ggaccccuaaugucagcuuggc

SEQ ID NO: 85924 - RNA, 27 nt, Human
aggguguggcuuggaacauuugggaga

SEQ ID NO: 85925 - RNA, 21 nt, Human
gcacccaggcaaucuggggac

SEQ ID NO: 85926 - RNA, 23 nt, Human
uagacccuuuuuaauuacauuca

SEQ ID NO: 85927 - RNA, 22 nt, Human
cuguguaauauuaagaacugaa

SEQ ID NO: 85928 - RNA, 21 nt, Human
ccggggugaaggcaagagaug

SEQ ID NO: 85929 - RNA, 26 nt, Human
caccacugaguccagccuauauucuu

SEQ ID NO: 85930 - RNA, 27 nt, Human
cugugugaucuuggacaagucacucua

SEQ ID NO: 85931 - RNA, 25 nt, Human
ugggugaggcggcggcgcggcucgg

SEQ ID NO: 85932 - RNA, 23 nt, Human
ccgggaucccacucugauugcau

SEQ ID NO: 85933 - RNA, 27 nt, Human
ggcucagaccaagugagugagaggcag

SEQ ID NO: 85934 - RNA, 22 nt, Human
ccucugccugcccccucaggcc

SEQ ID NO: 85935 - RNA, 21 nt, Human
ucugagaugugcagacuggga

SEQ ID NO: 85936 - RNA, 19 nt, Human
ccagcagagcugagaugug

SEQ ID NO: 85937 - RNA, 29 nt, Human
uuugguuucuucauucuuuacugcacuca

SEQ ID NO: 85938 - RNA, 25 nt, Human
ccucaggcgauccacccccaccucg

SEQ ID NO: 85939 - RNA, 26 nt, Human
guggcaccugcccugccugcauccgg

SEQ ID NO: 85940 - RNA, 18 nt, Human
ccuacuucccucaauuga

SEQ ID NO: 85941 - RNA, 22 nt, Human
cacagguucuugcagcuucugg

SEQ ID NO: 85942 - RNA, 23 nt, Human
aucuaaaacaugacuaucauuuc

SEQ ID NO: 85943 - RNA, 21 nt, Human
cagauuucucuaagaauagca

SEQ ID NO: 85944 - RNA, 22 nt, Human
ccuccuccucgcugccugcagc

SEQ ID NO: 85945 - RNA, 22 nt, Human
agaccagccuggacaacauagu

SEQ ID NO: 85946 - RNA, 26 nt, Human
cagugcacuccagucugcagguacug

SEQ ID NO: 85947 - RNA, 21 nt, Human
aucaaauuaguaaaccaaagg

SEQ ID NO: 85948 - RNA, 25 nt, Human
uguuuuuaaacaaaguuuucuccug

SEQ ID NO: 85949 - RNA, 27 nt, Human
ggaugcacaccucugaauauauuaaaa

SEQ ID NO: 85950 - RNA, 27 nt, Human
gaccagccuucccaacaugccuccugc

SEQ ID NO: 85951 - RNA, 24 nt, Human
gccagaacugggguacagccuggg

SEQ ID NO: 85952 - RNA, 20 nt, Human
ucacacacuaugcucucuca

SEQ ID NO: 85953 - RNA, 25 nt, Human
agugcugugcugcggaagaguggag

SEQ ID NO: 85954 - RNA, 27 nt, Human
gauggaagccugguggccuuccuuuca

SEQ ID NO: 85955 - RNA, 21 nt, Human
ccccugcugcugacaggggcc

SEQ ID NO: 85956 - RNA, 18 nt, Human
gccucaagagaauagcug

SEQ ID NO: 85957 - RNA, 23 nt, Human
aagaugagcugugcgcugcucug

SEQ ID NO: 85958 - RNA, 20 nt, Human
uuaaucaggaaaaauagcuu

SEQ ID NO: 85959 - RNA, 23 nt, Human
cagacuccaagcaacagagagac

SEQ ID NO: 85960 - RNA, 21 nt, Human
gcccugcguggaggugugaaa

SEQ ID NO: 85961 - RNA, 26 nt, Human
cuccauacucagcucuuuaacuuuuc

SEQ ID NO: 85962 - RNA, 24 nt, Human
ccacugcugaggacacucaguguc

SEQ ID NO: 85963 - RNA, 21 nt, Human
auguagaaacaggcuuggaga

SEQ ID NO: 85964 - RNA, 22 nt, Human
uuugcagggcggccagugcagu

SEQ ID NO: 85965 - RNA, 22 nt, Human
ccugcagccccgcgcucuaccc

SEQ ID NO: 85966 - RNA, 22 nt, Human
guggcacauggaugaaugagua

SEQ ID NO: 85967 - RNA, 22 nt, Human
ugugggucucaauugcccagcu

SEQ ID NO: 85968 - RNA, 25 nt, Human
gacuaagaguaacugugugaucugu

SEQ ID NO: 85969 - RNA, 20 nt, Human
uccggugcuccuuuccuaac

SEQ ID NO: 85970 - RNA, 24 nt, Human
gcccgcucucucaggcccucaggg

SEQ ID NO: 85971 - RNA, 21 nt, Human
ccuuguuccuguaaaauccau

SEQ ID NO: 85972 - RNA, 20 nt, Human
ucaaagcagcagccaccgcc

SEQ ID NO: 85973 - RNA, 21 nt, Human
cugccucuccaucccucucuc

SEQ ID NO: 85974 - RNA, 22 nt, Human
aagccccaguccagguccagga

SEQ ID NO: 85975 - RNA, 21 nt, Human
cuuauuucucagcuuuucuau

SEQ ID NO: 85976 - RNA, 21 nt, Human
agcuucuuaacccaucaccuu

SEQ ID NO: 85977 - RNA, 23 nt, Human
cucacacacuucuagauucuucc

SEQ ID NO: 85978 - RNA, 27 nt, Human
ggagguggaagccaggccagaggacuu

SEQ ID NO: 85979 - RNA, 20 nt, Human
uuuauucuucugagugucua

SEQ ID NO: 85980 - RNA, 20 nt, Human
caucucaggaagcacuggac

SEQ ID NO: 85981 - RNA, 26 nt, Human
gcuugcuuggcaggcugggccucugu

SEQ ID NO: 85982 - RNA, 22 nt, Human
aagacuuuccuuuuuucuuuau

SEQ ID NO: 85983 - RNA, 29 nt, Human
ucacuucugggguggaugaugugaccuuc

SEQ ID NO: 85984 - RNA, 21 nt, Human
guaacccuucuuucugaaccc

SEQ ID NO: 85985 - RNA, 22 nt, Human
uuuccuagcucugugcucaguu

SEQ ID NO: 85986 - RNA, 20 nt, Human
agggaaagacgucagguucc

SEQ ID NO: 85987 - RNA, 22 nt, Human
cuccugaggccuuuucccucgc

SEQ ID NO: 85988 - RNA, 28 nt, Human
gggcucacgccugucaccccagagcuuu

SEQ ID NO: 85989 - RNA, 22 nt, Human
ucugcccacacuucccugccua

SEQ ID NO: 85990 - RNA, 19 nt, Human
uccucauucuucucuccca

SEQ ID NO: 85991 - RNA, 15 nt, Human
aaaacaaaaugagua

SEQ ID NO: 85992 - RNA, 23 nt, Human
uuuucuuccucuucuccuugggc

SEQ ID NO: 85993 - RNA, 20 nt, Human
ggcccuccacccccaccuca

SEQ ID NO: 85994 - RNA, 21 nt, Human
accaguauugucacagcauga

SEQ ID NO: 85995 - RNA, 19 nt, Human
gaacaguguccccacagag

SEQ ID NO: 85996 - RNA, 24 nt, Human
uauuaacuuauuuaugugcugcug

SEQ ID NO: 85997 - RNA, 26 nt, Human
guuaguauagcuuuauacucucucca

SEQ ID NO: 85998 - RNA, 23 nt, Human
uguuaucuucucaaguucuaaga

SEQ ID NO: 85999 - RNA, 20 nt, Human
ccaucucuucacaggcaugg

SEQ ID NO: 86000 - RNA, 22 nt, Human
gccacuagcccuccucucccag

SEQ ID NO: 86001 - RNA, 26 nt, Human
ccugcugcugucuuggugccugucac

SEQ ID NO: 86002 - RNA, 23 nt, Human
guaguacaaacaaucucugugau

SEQ ID NO: 86003 - RNA, 22 nt, Human
uugcccagcgugaggagcgauc

SEQ ID NO: 86004 - RNA, 21 nt, Human
caacagcaaccaaagaaaaca

SEQ ID NO: 86005 - RNA, 24 nt, Human
uuaugcugguaaaacaaaugcugu

SEQ ID NO: 86006 - RNA, 24 nt, Human
gggcuucaaucacuguaaccugau

SEQ ID NO: 86007 - RNA, 24 nt, Human
uaauuuuaaaagucucacaaagaa

SEQ ID NO: 86008 - RNA, 22 nt, Human
ccuugagugacugggcagcagc

SEQ ID NO: 86009 - RNA, 25 nt, Human
gugcuuacugaaugccugcccugug

SEQ ID NO: 86010 - RNA, 24 nt, Human
gggagagauaaugaggcaacucag

SEQ ID NO: 86011 - RNA, 21 nt, Human
caguggcugcuuccuggggac

SEQ ID NO: 86012 - RNA, 22 nt, Human
accuuucgcagauuucacauga

SEQ ID NO: 86013 - RNA, 26 nt, Human
cuuuggguccuuccaucccacuggga

SEQ ID NO: 86014 - RNA, 21 nt, Human
aguguguuugcauugcuuuau

SEQ ID NO: 86015 - RNA, 19 nt, Human
gcuguugagagguggacuc

SEQ ID NO: 86016 - RNA, 21 nt, Human
gacuaauuuuguauuuuuagu

SEQ ID NO: 86017 - RNA, 19 nt, Human
aacaacucgaaucacucau

SEQ ID NO: 86018 - RNA, 21 nt, Human
gggagguggagcuugcaguga

SEQ ID NO: 86019 - RNA, 21 nt, Human
auacuuguaacccagcacuuu

SEQ ID NO: 86020 - RNA, 21 nt, Human
gccguugcacuccagccuggg

SEQ ID NO: 86021 - RNA, 29 nt, Human
ggugcugaugucaaaguguaacagauauc

SEQ ID NO: 86022 - RNA, 26 nt, Human
gcuagcaaacuucugccaagaucgga

SEQ ID NO: 86023 - RNA, 21 nt, Human
gguuugggguggcugucucug

SEQ ID NO: 86024 - RNA, 24 nt, Human
agggaggagaagggaccugccuug

SEQ ID NO: 86025 - RNA, 22 nt, Human
caaguuggagugcaauggugcg

SEQ ID NO: 86026 - RNA, 22 nt, Human
acacccuggggacuaggaaaag

SEQ ID NO: 86027 - RNA, 19 nt, Human
accccaggagugggccagg

SEQ ID NO: 86028 - RNA, 25 nt, Human
agggucacgcccacccugcuaaggu

SEQ ID NO: 86029 - RNA, 22 nt, Human
ugccuguaaucccaggacuuug

SEQ ID NO: 86030 - RNA, 22 nt, Human
gacuucuaaguaaaaccacagc

SEQ ID NO: 86031 - RNA, 27 nt, Human
cccuuauuccucccucauaccuagcca

SEQ ID NO: 86032 - RNA, 24 nt, Human
ugcugagaggaacuggaagaagaa

SEQ ID NO: 86033 - RNA, 21 nt, Human
uaaacaaaauauuaauaaaag

SEQ ID NO: 86034 - RNA, 23 nt, Human
gcugcuugucaagaagcauuucc

SEQ ID NO: 86035 - RNA, 23 nt, Human
cagggcacuugcucccugggcaa

SEQ ID NO: 86036 - RNA, 22 nt, Human
aaaguguugggauuauaggcgu

SEQ ID NO: 86037 - RNA, 22 nt, Human
cucuccucuucgugguuguguu

SEQ ID NO: 86038 - RNA, 27 nt, Human
acgccggccaccuucccgcuuccgagc

SEQ ID NO: 86039 - RNA, 27 nt, Human
ugccuguaaucccagcuacaugggagc

SEQ ID NO: 86040 - RNA, 20 nt, Human
gagcacacaccaccccugca

SEQ ID NO: 86041 - RNA, 20 nt, Human
agaagcagcggcucacuugg

SEQ ID NO: 86042 - RNA, 20 nt, Human
aaacucaugauaaugcugcg

SEQ ID NO: 86043 - RNA, 28 nt, Human
acucuguggaggaggaagaugggagcug

SEQ ID NO: 86044 - RNA, 23 nt, Human
cuugggaaaguacauaucuggga

SEQ ID NO: 86045 - RNA, 23 nt, Human
gauauacuucagggacucuguga

SEQ ID NO: 86046 - RNA, 23 nt, Human
uguugcccaggcuggagugcaga

SEQ ID NO: 86047 - RNA, 22 nt, Human
gugcccgugccucugugcugug

SEQ ID NO: 86048 - RNA, 22 nt, Human
aggcugaggugggagaauugcu

SEQ ID NO: 86049 - RNA, 26 nt, Human
cuuugccauguggaggaaagugccug

SEQ ID NO: 86050 - RNA, 22 nt, Human
uuguuucggaaauccaggauuu

SEQ ID NO: 86051 - RNA, 27 nt, Human
ugcaaaauauacacucauccuacuuca

SEQ ID NO: 86052 - RNA, 23 nt, Human
gcacagcccuagcucaggccacu

SEQ ID NO: 86053 - RNA, 20 nt, Human
gcuggguuggaaugugaaca

SEQ ID NO: 86054 - RNA, 21 nt, Human
cuuccugcugacauucccauc

SEQ ID NO: 86055 - RNA, 20 nt, Human
gaggguugcagggaggcagg

SEQ ID NO: 86056 - RNA, 23 nt, Human
ccuuuguccucacuacaggucuc

SEQ ID NO: 86057 - RNA, 22 nt, Human
guacacuuguggucacagggau

SEQ ID NO: 86058 - RNA, 22 nt, Human
uggcuaacauggugaaacccca

SEQ ID NO: 86059 - RNA, 22 nt, Human
uggccaacauggugaaacccua

SEQ ID NO: 86060 - RNA, 22 nt, Human
uggccaacauggcgaaacccca

SEQ ID NO: 86061 - RNA, 26 nt, Human
cugccacucaccccuccuggcccagg

SEQ ID NO: 86062 - RNA, 22 nt, Human
uggaaagguuuggauuucucca

SEQ ID NO: 86063 - RNA, 20 nt, Human
ggggccugugcucaggauca

SEQ ID NO: 86064 - RNA, 25 nt, Human
gagggagggagcgagcaggcgaagc

SEQ ID NO: 86065 - RNA, 22 nt, Human
uguaggcauaagccaccaggcc

SEQ ID NO: 86066 - RNA, 26 nt, Human
ucauuacacuuucacuagaagcccaa

SEQ ID NO: 86067 - RNA, 18 nt, Human
gagacagggagagucagc

SEQ ID NO: 86068 - RNA, 23 nt, Human
gccgaaacucuucaccuugaugu

SEQ ID NO: 86069 - RNA, 22 nt, Human
uugagauuguccuuuuccccug

SEQ ID NO: 86070 - RNA, 27 nt, Human
augugucacuugugcuuugcucuuguc

SEQ ID NO: 86071 - RNA, 21 nt, Human
uacugaaauaaagaugagcua

SEQ ID NO: 86072 - RNA, 27 nt, Human
uuuacuuccuuccccuguuguccaguc

SEQ ID NO: 86073 - RNA, 26 nt, Human
cuccacugcacuggcucauuccugcc

SEQ ID NO: 86074 - RNA, 26 nt, Human
accgagguguugccagugcuaagcug

SEQ ID NO: 86075 - RNA, 25 nt, Human
gggcccccuacccugccccaauuca

SEQ ID NO: 86076 - RNA, 28 nt, Human
agcaguacugcggccuccucuccucucc

SEQ ID NO: 86077 - RNA, 26 nt, Human
gcuccaggaggacaaggcugacaagc

SEQ ID NO: 86078 - RNA, 23 nt, Human
gaacauucuaacauuuacacuuu

SEQ ID NO: 86079 - RNA, 22 nt, Human
cugugcggaccccuuguuggcc

SEQ ID NO: 86080 - RNA, 24 nt, Human
guucaugccauucuccugccucag

SEQ ID NO: 86081 - RNA, 20 nt, Human
caucagcagagccaccaaga

SEQ ID NO: 86082 - RNA, 22 nt, Human
gcugcuugaaccuuuggaugca

SEQ ID NO: 86083 - RNA, 22 nt, Human
agucuaauuuuacgcuguagca

SEQ ID NO: 86084 - RNA, 20 nt, Human
caguaacuacaaaagguuac

SEQ ID NO: 86085 - RNA, 21 nt, Human
gcuggguucagaaaaguguua

SEQ ID NO: 86086 - RNA, 22 nt, Human
cuuggguaggguaguggcuggg

SEQ ID NO: 86087 - RNA, 28 nt, Human
uggccauguacuuuggaaaagaaagcau

SEQ ID NO: 86088 - RNA, 28 nt, Human
ucagggguagcgagguugcaggagcugg

SEQ ID NO: 86089 - RNA, 26 nt, Human
auuaaauuauguuucgaaguccaguu

SEQ ID NO: 86090 - RNA, 23 nt, Human
gcucuccccucccuuuuuaaaca

SEQ ID NO: 86091 - RNA, 22 nt, Human
cggaccugcagccaucugugag

SEQ ID NO: 86092 - RNA, 21 nt, Human
gccugacccucagcacuuuca

SEQ ID NO: 86093 - RNA, 22 nt, Human
ugaggugcugaugagugauuga

SEQ ID NO: 86094 - RNA, 22 nt, Human
agaggaaggguuuuuguuuuca

SEQ ID NO: 86095 - RNA, 17 nt, Human
ucauagaauuuugugca

SEQ ID NO: 86096 - RNA, 27 nt, Human
gguggugaggaggagcaccugggcucu

SEQ ID NO: 86097 - RNA, 24 nt, Human
cacacauguaaccucugugauucu

SEQ ID NO: 86098 - RNA, 24 nt, Human
gcggggucgcgggacaggagaagc

SEQ ID NO: 86099 - RNA, 23 nt, Human
gaguccauuuucuagcugccuuu

SEQ ID NO: 86100 - RNA, 20 nt, Human
ggccugccuguucccauucu

SEQ ID NO: 86101 - RNA, 26 nt, Human
gcguccugguccaccauggccaaacc

SEQ ID NO: 86102 - RNA, 22 nt, Human
ugcacacagaaugcucaggguc

SEQ ID NO: 86103 - RNA, 21 nt, Human
auucugagagcugugcaucag

SEQ ID NO: 86104 - RNA, 22 nt, Human
auggagauggcaaagaucucuu

SEQ ID NO: 86105 - RNA, 28 nt, Human
ggccuguaaucguagcgcuuugagaggc

SEQ ID NO: 86106 - RNA, 20 nt, Human
ugaaucagauauuuuaucaa

SEQ ID NO: 86107 - RNA, 24 nt, Human
ccagcgaacacacacagguguccu

SEQ ID NO: 86108 - RNA, 23 nt, Human
gacaggguuucaccauguugguc

SEQ ID NO: 86109 - RNA, 23 nt, Human
aacauuuuauucucaacaggugu

SEQ ID NO: 86110 - RNA, 27 nt, Human
uggucucaugcuuaaucuugucucucu

SEQ ID NO: 86111 - RNA, 30 nt, Human
ucuuggucaucacaaaaugccuugauguuc

SEQ ID NO: 86112 - RNA, 25 nt, Human
caggggugcugugaggaccagggag

SEQ ID NO: 86113 - RNA, 29 nt, Human
ucucuguaaucucagcuucucaggaggcu

SEQ ID NO: 86114 - RNA, 20 nt, Human
gagcuccagggcccagcccu

SEQ ID NO: 86115 - RNA, 27 nt, Human
aacuauuguauuucuaucauacauucc

SEQ ID NO: 86116 - RNA, 20 nt, Human
ucuuauaaaacaaacaguga

SEQ ID NO: 86117 - RNA, 21 nt, Human
caaaguguggguagaaacccc

SEQ ID NO: 86118 - RNA, 24 nt, Human
ggagaagaagcagagauacguuuu

SEQ ID NO: 86119 - RNA, 21 nt, Human
gaggagcauaccccaaaccag

SEQ ID NO: 86120 - RNA, 23 nt, Human
ugaauucugguuacauguguuuu

SEQ ID NO: 86121 - RNA, 23 nt, Human
uuuguuucugcugcuucugucca

SEQ ID NO: 86122 - RNA, 23 nt, Human
ggaguccucggaggaggagcagu

SEQ ID NO: 86123 - RNA, 24 nt, Human
gcuaagacuuggcuucauuucguc

SEQ ID NO: 86124 - RNA, 21 nt, Human
aaaugaacuccauugcuuaag

SEQ ID NO: 86125 - RNA, 21 nt, Human
gcucacaugccuuuucccugc

SEQ ID NO: 86126 - RNA, 22 nt, Human
agaagcagcagaggggacuccc

SEQ ID NO: 86127 - RNA, 20 nt, Human
caagucacuugguucccacu

SEQ ID NO: 86128 - RNA, 21 nt, Human
agaugccagcuucucucucca

SEQ ID NO: 86129 - RNA, 17 nt, Human
uuucccuuaucagauca

SEQ ID NO: 86130 - RNA, 20 nt, Human
agaugaaggcuuccaggcag

SEQ ID NO: 86131 - RNA, 24 nt, Human
aaauccccaccacuuccucccucc

SEQ ID NO: 86132 - RNA, 21 nt, Human
augcguguaacaguacugcaa

SEQ ID NO: 86133 - RNA, 25 nt, Human
cuuugugcugaccgucagauugugu

SEQ ID NO: 86134 - RNA, 22 nt, Human
gggguggaggggccacccuggg

SEQ ID NO: 86135 - RNA, 27 nt, Human
cagguucuagagcuaugcagcuggagc

SEQ ID NO: 86136 - RNA, 19 nt, Human
ccugcuguugccugggcag

SEQ ID NO: 86137 - RNA, 20 nt, Human
aagcuuuacccacuaacugg

SEQ ID NO: 86138 - RNA, 22 nt, Human
ggcucacugcaagcuccgccuc

SEQ ID NO: 86139 - RNA, 23 nt, Human
uuauguaauuuuauuuacauucu

SEQ ID NO: 86140 - RNA, 22 nt, Human
ucugaggucaggaguucaagac

SEQ ID NO: 86141 - RNA, 22 nt, Human
gcuugucuggaacuccugggcu

SEQ ID NO: 86142 - RNA, 21 nt, Human
agcagagauacagaggcagag

SEQ ID NO: 86143 - RNA, 22 nt, Human
ccuaaagucaccccacuccuua

SEQ ID NO: 86144 - RNA, 21 nt, Human
gugauucuugugccucagccu

SEQ ID NO: 86145 - RNA, 21 nt, Human
uccuguaacauacuggccugg

SEQ ID NO: 86146 - RNA, 21 nt, Human
accggcagcgccuccuccucu

SEQ ID NO: 86147 - RNA, 22 nt, Human
cugaacacaggcuuguuaaugu

SEQ ID NO: 86148 - RNA, 27 nt, Human
cugugacugaagaagaugagccuugca

SEQ ID NO: 86149 - RNA, 27 nt, Human
cuggggacccaggcuugcaaagugacg

SEQ ID NO: 86150 - RNA, 22 nt, Human
ucagaggcaacgaaacuggacu

SEQ ID NO: 86151 - RNA, 21 nt, Human
aggcugaggcacgagauuccu

SEQ ID NO: 86152 - RNA, 26 nt, Human
uucacacaagaaccaccucucccgca

SEQ ID NO: 86153 - RNA, 22 nt, Human
caccacugaacuccagccuggg

SEQ ID NO: 86154 - RNA, 20 nt, Human
auuucuacuuugugucauuu

SEQ ID NO: 86155 - RNA, 23 nt, Human
ucugcuguuuccaacacugguga

SEQ ID NO: 86156 - RNA, 27 nt, Human
cucucauucccuuuuccucuauggagc

SEQ ID NO: 86157 - RNA, 21 nt, Human
ggcucccucgucaucaggugc

SEQ ID NO: 86158 - RNA, 25 nt, Human
ccuuucucugccugcccugcccuug

SEQ ID NO: 86159 - RNA, 22 nt, Human
uagccuucccaggugggacuuu

SEQ ID NO: 86160 - RNA, 25 nt, Human
ugaggugggggcggcagcgggaggc

SEQ ID NO: 86161 - RNA, 20 nt, Human
ugucccccaggcuggagugc

SEQ ID NO: 86162 - RNA, 25 nt, Human
aacaugccagccacugugauagagg

SEQ ID NO: 86163 - RNA, 17 nt, Human
cccaccccgccccgccu

SEQ ID NO: 86164 - RNA, 27 nt, Human
uggccaucuucuuucuuccacccacaa

SEQ ID NO: 86165 - RNA, 25 nt, Human
ucuccaccucucgcgucgugacacc

SEQ ID NO: 86166 - RNA, 24 nt, Human
agagagaagggagugggugggcag

SEQ ID NO: 86167 - RNA, 22 nt, Human
ucgggggcaggaaggucagagc

SEQ ID NO: 86168 - RNA, 27 nt, Human
agaacgauuggaaauaaauuugaaaug

SEQ ID NO: 86169 - RNA, 22 nt, Human
ggugaggaaugaaagggccaag

SEQ ID NO: 86170 - RNA, 27 nt, Human
ggucucgaucucuugaccucgugaucc

SEQ ID NO: 86171 - RNA, 23 nt, Human
ucucugaggaggugucaggcugg

SEQ ID NO: 86172 - RNA, 25 nt, Human
ccgagcuguuuucgccucucaguug

SEQ ID NO: 86173 - RNA, 27 nt, Human
gcugcagagagcuaugaucaucccacu

SEQ ID NO: 86174 - RNA, 23 nt, Human
ugcuauucaguauuaaaacgagc

SEQ ID NO: 86175 - RNA, 21 nt, Human
gcugaaugccuccugugggga

SEQ ID NO: 86176 - RNA, 21 nt, Human
ugucuucaggcugccagggga

SEQ ID NO: 86177 - RNA, 23 nt, Human
ccccaugaacucugaaccaccuu

SEQ ID NO: 86178 - RNA, 30 nt, Human
ggaaugggggaagaggaggagcaggaggcc

SEQ ID NO: 86179 - RNA, 22 nt, Human
cuaggccagcugggauuccagc

SEQ ID NO: 86180 - RNA, 21 nt, Human
gauucucucuuguccuucaca

SEQ ID NO: 86181 - RNA, 20 nt, Human
aagugaucugccugccuugg

SEQ ID NO: 86182 - RNA, 20 nt, Human
aagccaggcucaggagaagc

SEQ ID NO: 86183 - RNA, 26 nt, Human
gagagggaaccgcggccggcaggccg

SEQ ID NO: 86184 - RNA, 21 nt, Human
gaauacaguguguguuauuac

SEQ ID NO: 86185 - RNA, 19 nt, Human
ccagcccucugccugcagc

SEQ ID NO: 86186 - RNA, 23 nt, Human
ugcugaguucugucagcacucug

SEQ ID NO: 86187 - RNA, 20 nt, Human
guccccaauagugcaaaagu

SEQ ID NO: 86188 - RNA, 23 nt, Human
aacacuccugcaaagaugguuuu

SEQ ID NO: 86189 - RNA, 21 nt, Human
uuuccucaucagcagaauuua

SEQ ID NO: 86190 - RNA, 22 nt, Human
cuucugagcucuuuagcauuga

SEQ ID NO: 86191 - RNA, 19 nt, Human
uuucauguugaaugcuauu

SEQ ID NO: 86192 - RNA, 19 nt, Human
cuucuggaaauuaaccuca

SEQ ID NO: 86193 - RNA, 21 nt, Human
caggaagguggagcugcauug

SEQ ID NO: 86194 - RNA, 23 nt, Human
ugaggacaguccugcccauccac

SEQ ID NO: 86195 - RNA, 21 nt, Human
uuuauaccugcucuuguucua

SEQ ID NO: 86196 - RNA, 22 nt, Human
caccacugcacuccaaccuagg

SEQ ID NO: 86197 - RNA, 23 nt, Human
gguuauccuauaguuacuaugaa

SEQ ID NO: 86198 - RNA, 21 nt, Human
ccuucagguuucuuccuuccc

SEQ ID NO: 86199 - RNA, 23 nt, Human
ucucccucucucucaucuuacau

SEQ ID NO: 86200 - RNA, 25 nt, Human
ccccacuguaguggccuuuggagau

SEQ ID NO: 86201 - RNA, 23 nt, Human
agcaaauuauauaaaucaguuga

SEQ ID NO: 86202 - RNA, 20 nt, Human
aucugccuggccagcaguga

SEQ ID NO: 86203 - RNA, 20 nt, Human
uugcugcagccuaugcacug

SEQ ID NO: 86204 - RNA, 22 nt, Human
gaccagccugaccaacauggug

SEQ ID NO: 86205 - RNA, 22 nt, Human
gaccagccuggccaacauagug

SEQ ID NO: 86206 - RNA, 28 nt, Human
ugguugguaaagccucagcaacagccag

SEQ ID NO: 86207 - RNA, 23 nt, Human
guugcacaggcagauacugcugu

SEQ ID NO: 86208 - RNA, 24 nt, Human
ugcugaacuggcaacuuacuuggg

SEQ ID NO: 86209 - RNA, 27 nt, Human
cauugcgcuucagccugggcaacaaga

SEQ ID NO: 86210 - RNA, 23 nt, Human
cuggacaugggugggcucugaug

SEQ ID NO: 86211 - RNA, 27 nt, Human
ggggaaggacguggcauccaagcugag

SEQ ID NO: 86212 - RNA, 21 nt, Human
augacugguuguucaaacaca

SEQ ID NO: 86213 - RNA, 27 nt, Human
gaccugacagccauacguauuccccuc

SEQ ID NO: 86214 - RNA, 22 nt, Human
ucuucuggcccuuagcuggugc

SEQ ID NO: 86215 - RNA, 21 nt, Human
ucaguagauguaauggaagcc

SEQ ID NO: 86216 - RNA, 27 nt, Human
uucauucugagucuuuaguuuuaguca

SEQ ID NO: 86217 - RNA, 21 nt, Human
ggaauacuggagauauuugua

SEQ ID NO: 86218 - RNA, 23 nt, Human
ccaacauuuacuaacauccacug

SEQ ID NO: 86219 - RNA, 25 nt, Human
aucuggagguagccgaccugaggac

SEQ ID NO: 86220 - RNA, 24 nt, Human
gacuauacugcugaguucuggucu

SEQ ID NO: 86221 - RNA, 24 nt, Human
agugcuaugcuauuuccugguuau

SEQ ID NO: 86222 - RNA, 22 nt, Human
uuagaaucugugcuguguaagg

SEQ ID NO: 86223 - RNA, 22 nt, Human
uaaaacacgagaauacauaggc

SEQ ID NO: 86224 - RNA, 20 nt, Human
uacuccucagacgggcugag

SEQ ID NO: 86225 - RNA, 22 nt, Human
uuuccuuuguugucuacauuaa

SEQ ID NO: 86226 - RNA, 24 nt, Human
gagcccccacccuguuccugcugc

SEQ ID NO: 86227 - RNA, 32 nt, Human
cuccaacugaauugcuaucauuuggcuggaug

SEQ ID NO: 86228 - RNA, 24 nt, Human
aagcuccagagagcugccuuccac

SEQ ID NO: 86229 - RNA, 23 nt, Human
caguauuuugcuuuuuaacucua

SEQ ID NO: 86230 - RNA, 20 nt, Human
ugaggugagaagaucauugg

SEQ ID NO: 86231 - RNA, 28 nt, Human
ggacccagcucuguuucugcugcuucca

SEQ ID NO: 86232 - RNA, 27 nt, Human
ucuagggucucagcuuuucauuugcag

SEQ ID NO: 86233 - RNA, 19 nt, Human
cagcucucuccagcccugu

SEQ ID NO: 86234 - RNA, 23 nt, Human
ggccucccuccgucccucugucc

SEQ ID NO: 86235 - RNA, 21 nt, Human
gcccagacuggagugcagugg

SEQ ID NO: 86236 - RNA, 27 nt, Human
ccuccuuccugucaugcucccuccagc

SEQ ID NO: 86237 - RNA, 23 nt, Human
uccauugagcacauuuuccuaag

SEQ ID NO: 86238 - RNA, 18 nt, Human
cugcugcacuaggacuug

SEQ ID NO: 86239 - RNA, 23 nt, Human
ucucauuuucuuugcugacuuac

SEQ ID NO: 86240 - RNA, 19 nt, Human
acacagugaauucuuuuug

SEQ ID NO: 86241 - RNA, 21 nt, Human
caagcacaucaugucuaucug

SEQ ID NO: 86242 - RNA, 21 nt, Human
gcucagccuccuucuuugcua

SEQ ID NO: 86243 - RNA, 22 nt, Human
uagauguuuggaugaugucucu

SEQ ID NO: 86244 - RNA, 22 nt, Human
gagaggcagagguggcacagga

SEQ ID NO: 86245 - RNA, 24 nt, Human
gccuguaguccuagccacucagga

SEQ ID NO: 86246 - RNA, 21 nt, Human
uaaagugcugggauuacaggg

SEQ ID NO: 86247 - RNA, 23 nt, Human
gcccccagccucccacucgacuu

SEQ ID NO: 86248 - RNA, 20 nt, Human
gcaugcuguccacugugugg

SEQ ID NO: 86249 - RNA, 23 nt, Human
uugaccaagguguuaaggggaua

SEQ ID NO: 86250 - RNA, 25 nt, Human
ccuguaggacucaaagggagccagg

SEQ ID NO: 86251 - RNA, 27 nt, Human
agaaggcagagguuguagugagcugag

SEQ ID NO: 86252 - RNA, 23 nt, Human
ccucacugcaggcuccccuccuc

SEQ ID NO: 86253 - RNA, 23 nt, Human
caccagguggcagcaucuuguca
